United States Patent 9,624,556 (VIRAL AND VIRAL ASSOCIATED MIRNAS AND USES THEREOF) - sequence listing, part 7

SEQ ID NO: 181265 - RNA, 63 nt, Human
ucuggggggcaaccuggaggucugaaaagaggagccagagaaggugguacccaggcuuccugg

SEQ ID NO: 181266 - RNA, 63 nt, Human
uuccuuaccacaucccuguaaguaaggugaaaugccagagaccuagacgggguggaaggagca

SEQ ID NO: 181267 - RNA, 63 nt, Human
uuuuccccuaccagaugccagcagcucuuccuugccagagaugaucugacccggugggggcag

SEQ ID NO: 181268 - RNA, 63 nt, Human
ccuccccugauggucuuguucucuugugcucaggccagagacuugcucacuuccugcauuguu

SEQ ID NO: 181269 - RNA, 63 nt, Human
gcccucugcagagcgcucucugugugccagagagccagagacccaagacagggcccgggcucu

SEQ ID NO: 181270 - RNA, 63 nt, Human
cgagggcugcccucugcagagcgcucucugugugccagagagccagagacccaagacagggcc

SEQ ID NO: 181271 - RNA, 63 nt, Human
ccucacagucacgccgcagcauggaugugucgcgccagagaguaaacuacaaauucuugugag

SEQ ID NO: 181272 - RNA, 63 nt, Human
uuccggcaccaaguucauaauagagaucuucuggccagagaaucaggggagaggagaggccug

SEQ ID NO: 181273 - RNA, 63 nt, Human
uguggccauccugucaccagguaguuuuucccugccagagauggcaggggaaagccagugguu

SEQ ID NO: 181274 - RNA, 63 nt, Human
uggcgucucugggaaccuggccccgggcaaccagccagagaaggagggccgggcgcaccagug

SEQ ID NO: 181275 - RNA, 63 nt, Human
cccagcacgggugacuucuuuuucucuucauuagccagagaugacuaauuuaaauuuagaacc

SEQ ID NO: 181276 - RNA, 63 nt, Human
gaucuacagcuccuggauaauugcuugauucucgccagagacugucaauguuucauucauugc

SEQ ID NO: 181277 - RNA, 63 nt, Human
uccuaccugugccuuucucugaggggacaccccgccagagagggccccgggagccgggggugg

SEQ ID NO: 181278 - RNA, 55 nt, Human
uccgagucacgcucaauugaacccugccagagacgggaagaggggggcugucggc

SEQ ID NO: 181279 - RNA, 63 nt, Human
gaucugggagccagcagcuggaugcuguggcuggccagagacaccuccaggcuguggccuggg

SEQ ID NO: 181280 - RNA, 63 nt, Human
gggcagccgcuccagccuuugaagacuuugaaagccagagauuccuggcgcaggcuuggacuu

SEQ ID NO: 181281 - RNA, 63 nt, Human
cuuagcagaagaacaaacugaagaacagacccagccagagaagcagggauuccagaagcugcc

SEQ ID NO: 181282 - RNA, 63 nt, Human
aaaguugaaaugaaggaaaaaauguuaagggcagccagagagaaaggucggguuacccacaaa

SEQ ID NO: 181283 - RNA, 63 nt, Human
ugccgaucagacaugugggcuccccgaagcccagccagagacugccgugcugugggugccacc

SEQ ID NO: 181284 - RNA, 63 nt, Human
ugcccagccuccugcauccccucgaagagccuggccagagagggaagacacagaugaugaagc

SEQ ID NO: 181285 - RNA, 63 nt, Human
agcccuggggauggggaaggacauggagccugagccagagaaccagcucugaguccugaggag

SEQ ID NO: 181286 - RNA, 63 nt, Human
agcccuggggauggggaaggacaugaagccugagccagagaaccagcuauaaguccugagaag

SEQ ID NO: 181287 - RNA, 63 nt, Human
cugagaucugggaugcugaguggcuguuugggggccagagaaacacacacucaacugcccacu

SEQ ID NO: 181288 - RNA, 63 nt, Human
accgugugaggggacagcagcccuuggugcaaagccagagacugauccuggcucugacggcug

SEQ ID NO: 181289 - RNA, 63 nt, Human
ccccauguccccauguccuucccccacuaaauggccagagaggcccuggacaaccucuugcgg

SEQ ID NO: 181290 - RNA, 63 nt, Human
ugggucccuaggccccgccuggcacucagccuugccagagauuggcuccagaauuuuugccag

SEQ ID NO: 181291 - RNA, 63 nt, Human
acaaguuagggcauggacuugacccagcuuugugccagagaacccaauaugaguguuguuggc

SEQ ID NO: 181292 - RNA, 63 nt, Human
aauucucuugcccaggcuuuuugcuccuucaaggccagagaguucacaccagaucaagguguu

SEQ ID NO: 181293 - RNA, 63 nt, Human
cgaggcagcccagagcagcgggaugagcuggcggccagagaacgcccagcccagcccaccccc

SEQ ID NO: 181294 - RNA, 63 nt, Human
uggggugcucaggaggggguacccggggccccggccagagauacaucaauuacacccccgugg

SEQ ID NO: 181295 - RNA, 63 nt, Human
auggggggugcuccuggccuggaguggguggaggccagagacacugcucagcagcacccugca

SEQ ID NO: 181296 - RNA, 63 nt, Human
cuuucaaaauugggauccuuccauguugagccagccagagaagauagcgagaucuaaaucucu

SEQ ID NO: 181297 - RNA, 63 nt, Human
acccaggcugugucucauaaaagucggccuggugccagagaggaccuccuuucucccacagaa

SEQ ID NO: 181298 - RNA, 63 nt, Human
ugccuggaacagagccugcgggaaacggggcuugccagagacacucacaguuuccuucauggc

SEQ ID NO: 181299 - RNA, 63 nt, Human
uauauaaggcacuguggugguuauucccgaggagccagagaaaccuggagaagagaucagaac

SEQ ID NO: 181300 - RNA, 63 nt, Human
cuuuugaguauaacuauugagggaaauauuuuggccagagagaugucuuaguaucugauaauu

SEQ ID NO: 181301 - RNA, 63 nt, Human
ggugcggcuuccagaggugcagcugccgaaagugccagagaugaaagucccugagaugaagcu

SEQ ID NO: 181302 - RNA, 63 nt, Human
gcugaaagugucggagaugaaacucccaaaggugccagagauggcugugccggaggugcggcu

SEQ ID NO: 181303 - RNA, 63 nt, Human
gcccaaagugucagagaugaaacucccaaaggugccagagauggcugugccggaggugcggcu

SEQ ID NO: 181304 - RNA, 63 nt, Human
ccccaaggugucagagaugaaacucccaaaggugccagagauggcugugccggaggugcggcu

SEQ ID NO: 181305 - RNA, 63 nt, Human
agcccuggggacggggaaggacauggagccugagccagagaaccagcucugaguccugaggag

SEQ ID NO: 181306 - RNA, 63 nt, Human
aaaugagccaaacgugaccacuagccuccuggagccagagaguggggcucguuugccgguugc

SEQ ID NO: 181307 - RNA, 63 nt, Human
guguuugcugagggcuuccugugccagagcccagccagagagcaggugcaggugucauccuga

SEQ ID NO: 181308 - RNA, 63 nt, Human
ccaagcagggggacguugccagaggggaccagggccagagacgggaccaggaaggaacugagg

SEQ ID NO: 181309 - RNA, 63 nt, Human
gauucuccuuccaggccuaagccugggauuugggccagagauaagaauccaaacuaugaggcu

SEQ ID NO: 181310 - RNA, 63 nt, Human
agcaguccccaccgggaguuccccccugcuaccgccagagagguggacccacuccggauuccu

SEQ ID NO: 181311 - RNA, 63 nt, Human
ugguagaccuuauaagaaggcacuuguuuguaagccagagaagaaacuuuaauugcauccuau

SEQ ID NO: 181312 - RNA, 63 nt, Human
cuagaucauccuuauaccgacggggaaacggaggccagagagggcgugggcgcuugcaccacu

SEQ ID NO: 181313 - RNA, 63 nt, Human
ugaagagauccuggcauuucugguccaacccaagccagagaaccauuaagaaggggccuucau

SEQ ID NO: 181314 - RNA, 63 nt, Human
ucuuucuuuuuuaaacaaagaacuuugcacuuggccagagaggaggagaaagcccauuuucuc

SEQ ID NO: 181315 - RNA, 63 nt, Human
aggaguguggccacgugggcaaacaggcaguuggccagagagccuggugcugcugcugcugug

SEQ ID NO: 181316 - RNA, 63 nt, Human
gcuagccaaaaucucuuaaauacacguaggugggccagagaacauuggaagaaucaagagaga

SEQ ID NO: 181317 - RNA, 52 nt, Human
agcugcagcuguuucccugaaagccagagaagaccuuccucuuacaucacau

SEQ ID NO: 181318 - RNA, 63 nt, Human
caguagcagaagccucauuccagaacccaucuggccagagaagcagcagcauccugggggaug

SEQ ID NO: 181319 - RNA, 63 nt, Human
ugugucuauaaagguuucucuuguuauuguuaagccagagaucuaagguuuagauucaauuug

SEQ ID NO: 181320 - RNA, 63 nt, Human
ugggugccaagcucagagggggaaaaaaagauagccagagagagaccuggcccucaaaaaggu

SEQ ID NO: 181321 - RNA, 63 nt, Human
ucagacacauugggacaaacccuggacagccaugccagagagaggccuuugaccggccccaga

SEQ ID NO: 181322 - RNA, 63 nt, Human
aggucucaguguuucuagauuccagacccugcugccagagagaccugcugccggagagaaggg

SEQ ID NO: 181323 - RNA, 63 nt, Human
aguaaagcugagaaaggaccagauugaccaagcgccagagacaaaauguggcacaacgagaac

SEQ ID NO: 181324 - RNA, 63 nt, Human
aaaucuuauauuaauuuuauuaagcaaggguucgccagagaaacagaaccaauaggauauaua

SEQ ID NO: 181325 - RNA, 63 nt, Human
cuuacaccauacaaaaauauugggcaccgcagugccagagaagaugcuugagguuagauuuua

SEQ ID NO: 181326 - RNA, 63 nt, Human
agaaaagucugcaggaacugcugccugagccaagccagagaaccgaagacccggccggcccug

SEQ ID NO: 181327 - RNA, 63 nt, Human
gggcugcccccgacaggcuggcucucaguggaggccagagaucuggaaucggggucagcgggg

SEQ ID NO: 181328 - RNA, 63 nt, Human
uaauacauaaucuuuaaaaucugagggaucauugccagagauuguugcggagggaaauguuau

SEQ ID NO: 181329 - RNA, 63 nt, Human
ugauguuuauuauuuaggacucgucguagacaagccagagaacaaaccgguaagauggcagau

SEQ ID NO: 181330 - RNA, 63 nt, Human
ccccagggguccucccucuuaacccauguaggugccagagaaaccacccccacuccaugagaa

SEQ ID NO: 181331 - RNA, 63 nt, Human
uuguucacgaaguucaugaagugccgcuggagagccagagaccagcugcgcaggagccggagg

SEQ ID NO: 181332 - RNA, 63 nt, Human
gaccuccgugcccaggcccaaucucgucaggcugccagagaaaguuggugcugcucauacugg

SEQ ID NO: 181333 - RNA, 63 nt, Human
ggaagaaccccugccuggggugggacugugcaggccagagaagguggcaugggccugaaccca

SEQ ID NO: 181334 - RNA, 63 nt, Human
ggaaggaggcaagagagaaauuccuucuucccagccagagagggcagaagcagaccguagccc

SEQ ID NO: 181335 - RNA, 63 nt, Human
aaucacaaaacuacaggacaguacaaacagauugccagagaaaucugggucaaagaaaggaau

SEQ ID NO: 181336 - RNA, 63 nt, Human
aggcaucugagucggcguuuacccaggggccgggccagagacgggggucggccgcucgcuccc

SEQ ID NO: 181337 - RNA, 63 nt, Human
caggcagagcugcuuggaugugugagucaugaagccagagaagccccgcuccaugagcaguga

SEQ ID NO: 181338 - RNA, 63 nt, Human
gucuuucuguagguugguuccuguauaccuugggccagagagcaaacauagguggccugagag

SEQ ID NO: 181339 - RNA, 63 nt, Human
cacuugccccgcccucccacaccugcuugggaggccagagaggccagacaagccgagagcccc

SEQ ID NO: 181340 - RNA, 63 nt, Human
guguugcauucuugcacaagucaugaaaauggagccagagagccuggacaucagggacuuuug

SEQ ID NO: 181341 - RNA, 63 nt, Human
uggugaccucucagaugccagcgaccugaagacgccagagaagcagagugccaauggcucuuu

SEQ ID NO: 181342 - RNA, 63 nt, Human
aggccagcugcucuaauaucgaugguccugcuugccagagaguuccucuacccagcaaaaaug

SEQ ID NO: 181343 - RNA, 63 nt, Human
gacagcccaggggaccagguggaccaggugguggccagagaggcuccaggggcuagacucccu

SEQ ID NO: 181344 - RNA, 63 nt, Human
uguucacuaggucuucagaauggacguccuucugccagagacuuccagcgggcggcuccaaag

SEQ ID NO: 181345 - RNA, 63 nt, Human
cagccaugacaaggaaagaaaagacaaaggaaggccagagagccgcgcaguucucugcaggug

SEQ ID NO: 181346 - RNA, 63 nt, Human
guggaccuggcauuuaucuggccaaaaacaggagccagagaaauaugaauauaccaaaguugu

SEQ ID NO: 181347 - RNA, 63 nt, Human
uaagagaagacuuuaagagaugagggagagagagccagagacaguguugcaacugggccuggc

SEQ ID NO: 181348 - RNA, 63 nt, Human
gggccuugcucuugucggccagcccacuccccagccagagagggcuugaccaaaucaaauuga

SEQ ID NO: 181349 - RNA, 63 nt, Human
uucuguuucauuacuuccguuuuaaaaguuuuugccagagaguuuugcuaaauacucucuuau

SEQ ID NO: 181350 - RNA, 63 nt, Human
uuguugcacuaaaaugaggauccagggcagcaggccagagaaagcaaaggugcacuccagacu

SEQ ID NO: 181351 - RNA, 63 nt, Human
agugggaagggagcauugcagccuaagaagaaggccagagagggaaaaggcaggugcuuuugg

SEQ ID NO: 181352 - RNA, 55 nt, Human
agauuauugaaacaauguaaaaugagccagagauagaacauuuuaagccaucuuc

SEQ ID NO: 181353 - RNA, 63 nt, Human
gcuuccuugggcagccaguaauucccaggcaaggccagagacuucaagucuaucugaaaaguc

SEQ ID NO: 181354 - RNA, 63 nt, Human
cucucuucggacagccaguaauucccgggcaaggccagagacuucaagucuaucugaaaaguc

SEQ ID NO: 181355 - RNA, 63 nt, Human
agguauaauuggagcauuugcacugagaccccugccagagaggagaaaacccuuucaagggaa

SEQ ID NO: 181356 - RNA, 63 nt, Human
auuuacucagucuuuaaaauucgucucugauuugccagagaaaaacggugguagccauggaaa

SEQ ID NO: 181357 - RNA, 63 nt, Human
augaaauaaaaaugaacuuauuccccacucagggccagagaaagucagaacaaagaaaauguc

SEQ ID NO: 181358 - RNA, 63 nt, Human
uucugcuuuucugcugucuuuguuacuucuugugccagagauuacguuuucccugagcuucca

SEQ ID NO: 181359 - RNA, 63 nt, Human
aagugggaacauuaauugucacguggcuguugagccagagaggccacuggcugccaugccucu

SEQ ID NO: 181360 - RNA, 63 nt, Human
gagaaaacgacaccuagaagaaggcaaagaaaggccagagaaagagcaguccaagcauaaaag

SEQ ID NO: 181361 - RNA, 63 nt, Human
caaaccaucuccuccuugccggcucccccuccagccagagacagaggauguggccugguucaa

SEQ ID NO: 181362 - RNA, 63 nt, Human
ugacugaccucccauaaggcugaugcugauuuggccagagaugaccucaaggcccaccaaaua

SEQ ID NO: 181363 - RNA, 63 nt, Human
acaaauaggucagcuccaccuggagugcgaauugccagagacaccuugguagugcccaucggc

SEQ ID NO: 181364 - RNA, 63 nt, Human
guguggaauguguuguauuuucgacagguugcugccagagagccugcuuccugcugccugccg

SEQ ID NO: 181365 - RNA, 63 nt, Human
augugccuguaaucccagcuucuggaggcugaggccagagaaucgcuugaaccugggaggugg

SEQ ID NO: 181366 - RNA, 64 nt, Human
acgcuccuccaccacgaggcacugaccugcgucggguggugaccguggcuggcggucacgcccu

SEQ ID NO: 181367 - RNA, 64 nt, Human
uaucaaagagugcagagcucuccccagccccguggguggugacuuuguuuuccugcggggcuca

SEQ ID NO: 181368 - RNA, 64 nt, Human
cuucaucccauuugcagagccucagacacgucuugguggugaggcucaguuaccccugggcuua

SEQ ID NO: 181369 - RNA, 64 nt, Human
gggugaguuuuaguuugugugugucuugcugggggguggugaugauugucucagcacucacgca

SEQ ID NO: 181370 - RNA, 64 nt, Human
ugcggcuggaggagaagaucacagagccauucuugguggugagccuagacucugagccugggau

SEQ ID NO: 181371 - RNA, 64 nt, Human
gaacacaaccuuaggaccuugggccccaaaagcugguggugaaaugaggaggagccaauuuaag

SEQ ID NO: 181372 - RNA, 64 nt, Human
aaaggcaggggcaguggcauccuugccguagcaggguggugaggaggguggcugugggggcuca

SEQ ID NO: 181373 - RNA, 64 nt, Human
ucuccuugccaaaagauuuaaaccuguccacauugguggugaugaugggugaguuuccauggua

SEQ ID NO: 181374 - RNA, 64 nt, Human
cugaagccucuacuugaugagagacagaguuuuggguggugauagugaugugcugguggucauu

SEQ ID NO: 181375 - RNA, 64 nt, Human
gcugcagcugaaaguaguuccccaggcugcccucgguggugaggacuggaugcuagacugcuga

SEQ ID NO: 181376 - RNA, 64 nt, Human
cuuaguggauggguguguguguguguguguuggggguggugaucaggcagguucauaaauuucc

SEQ ID NO: 181377 - RNA, 64 nt, Human
accugcaguucuuagggcuguggggucagauggugguggugagaggccuuggggcuggggaagg

SEQ ID NO: 181378 - RNA, 64 nt, Human
uucaccagcuccuugggacaauggaauaucccaggguggugacagcagauggagcuacuugggg

SEQ ID NO: 181379 - RNA, 64 nt, Human
aggaaagccccguucacugcuccugugagagguugguggugacaggauggggaaccgaccucuu

SEQ ID NO: 181380 - RNA, 64 nt, Human
aaagcuagguaagcuauuuuguugcagcucauaagguggugaaaaggacucuccuguguuucuu

SEQ ID NO: 181381 - RNA, 64 nt, Human
ccucagcaaauguucuaccacucgcaggggcaaagguggugagccacgggacguccaaggggag

SEQ ID NO: 181382 - RNA, 64 nt, Human
acucucccgguagacccuagcaaggguccuccaugguggugagggacucaggagaauuguaggg

SEQ ID NO: 181383 - RNA, 64 nt, Human
guuucccuggugaauuuuucaccacugcguuuuagguggugaucuuaaaugggugagauggaac

SEQ ID NO: 181384 - RNA, 64 nt, Human
gacaaaaggcuccaguugggcugaacaugugugugguggugacucauuuccauaccauugugga

SEQ ID NO: 181385 - RNA, 64 nt, Human
aauauuuccucaucuuuuuguuguugucauggaugguggugacauggacuuguuuauagaggac

SEQ ID NO: 181386 - RNA, 64 nt, Human
uucauuguaaaacuaaaagugaggaaggcucguggguggugaaccucugcucuguaauacuggg

SEQ ID NO: 181387 - RNA, 64 nt, Human
uucucuccucuuccccauucuccagagggagggagguggugaggaagaggaagggaggggcagg

SEQ ID NO: 181388 - RNA, 64 nt, Human
auagcccucacccuggggcuaggaaauccagggugguggugauagguauaagugguguguguau

SEQ ID NO: 181389 - RNA, 64 nt, Human
ggagacugacugugagugcuggcuaaaagcccuggguggugaggcucacaguacugguuuccag

SEQ ID NO: 181390 - RNA, 64 nt, Human
agaucaaaaccaaaaaaaaugaaccaaaggcuuggguggugagggugcuuauccuuucuguuau

SEQ ID NO: 181391 - RNA, 64 nt, Human
cagcaggucacccuuaacuucagaaacaauuauugguggugaacuguacuuaaauugcagagaa

SEQ ID NO: 181392 - RNA, 64 nt, Human
gucaaacuggagguccuguugucgcagagcauucgguggugaggcuguugugugcgcggaugag

SEQ ID NO: 181393 - RNA, 64 nt, Human
uuuuauuuucggagcuaagaugguguuauuuaaggguggugaugggugagcgcucuggcccagg

SEQ ID NO: 181394 - RNA, 64 nt, Human
uuucuucuauuucuuugucuucauuuaauuuggugguggugaacuuuacuugcugauuuucuuu

SEQ ID NO: 181395 - RNA, 64 nt, Human
aagaaagaccgaguucauugaagcagagaugggagguggugaggcguccucaccuccccccacc

SEQ ID NO: 181396 - RNA, 64 nt, Human
gccaaagauuggacagagacaccgaaggaaaugggguggugaaaccccacagcgaaaagccaca

SEQ ID NO: 181397 - RNA, 64 nt, Human
gccauagaacugacuccuggaagccuggagagaagguggugacacccauggguucucaacugua

SEQ ID NO: 181398 - RNA, 64 nt, Human
uaaugggaugaggcuuuucaccccaggccaugcugguggugauuuuuuagccccuaaauaaaac

SEQ ID NO: 181399 - RNA, 64 nt, Human
gccuucucucucuggucaggcccacugcagagaugguggugagcacaucugggaggcuggucuc

SEQ ID NO: 181400 - RNA, 64 nt, Human
cuacuaaaaaauuauuuuaaaaggcuggaggcaagguggugacaggcagcaggguggcgacaug

SEQ ID NO: 181401 - RNA, 64 nt, Human
aaaauacaaaaaaaaaaaaaaauuagccgggcgugguggugagugccuguaaucacagcuacuu

SEQ ID NO: 181402 - RNA, 64 nt, Human
aacaucuggaaggaugcucgagagaacaaauggagguggugaaaaucaagcuuuggauugugca

SEQ ID NO: 181403 - RNA, 64 nt, Human
aagggauucgagaccuccaacauacuugucugaagguggugauucuggccauggccccucugcc

SEQ ID NO: 181404 - RNA, 64 nt, Human
aggagggucuucccaagauaggagaggaaccgcagguggugagcggcuggggagggccaggaca

SEQ ID NO: 181405 - RNA, 64 nt, Human
ugccuguuccucccaagaggccaggguggccagggguggugagggcaguucugcacccagccaa

SEQ ID NO: 181406 - RNA, 64 nt, Human
ugguuuaauacuuagugcuaacauugaaacuguugguggugauggauuuuguagcuugcugcuu

SEQ ID NO: 181407 - RNA, 64 nt, Human
cccagaacaauuacugaaaagcugaaauuuaauggguggugauguagcccaaugagggcgaaug

SEQ ID NO: 181408 - RNA, 64 nt, Human
cucugacaaaugguccuuugccuuaucuugugcugguggugaagaggcccucaaagccaggccu

SEQ ID NO: 181409 - RNA, 64 nt, Human
gggagaggcuaaagggaaagguaguaggggcggggguggugaccuuuaagucuucugagguugg

SEQ ID NO: 181410 - RNA, 64 nt, Human
gucuccuagacacuccccacgggaaacucaaggagguggugaauuuuuaaucagcaauauugcc

SEQ ID NO: 181411 - RNA, 64 nt, Human
uugauuuaugcuuuaacuucagagugaguguagggguggugaugcuaccauuacugugaggacc

SEQ ID NO: 181412 - RNA, 64 nt, Human
aaguauucaucccugagguuuugaguuuuauugugguggugauuuucucaugagaagguagaca

SEQ ID NO: 181413 - RNA, 64 nt, Human
ccagugaguaaguuggugucugggucagguuaaugguggugaacuaugugccugugagcucuuc

SEQ ID NO: 181414 - RNA, 64 nt, Human
cugggaauaacauggugaggugcagggugguggugguggugaaacauacgacagaccacuguaa

SEQ ID NO: 181415 - RNA, 64 nt, Human
cagaaaacauggucaccuucagcgagaaccaugggguggugauccagccugccuauaaggacaa

SEQ ID NO: 181416 - RNA, 64 nt, Human
ccuugcugcuuuggugggacaugaggccucaguggguggugagagggggccaugggccuugugg

SEQ ID NO: 181417 - RNA, 64 nt, Human
aaaaauucaacucagacuaguuuaguuaaaugaggguggugaauauuguucauauuguggcaca

SEQ ID NO: 181418 - RNA, 64 nt, Human
agaggcacuuccugugucagucuuguuugaaggagguggugaugguggauagaggugaaggagg

SEQ ID NO: 181419 - RNA, 64 nt, Human
augguguuuuggaaauuuuaaaauuaucaucgaagguggugaaacuauuucaggcccaaaugaa

SEQ ID NO: 181420 - RNA, 64 nt, Human
ugucaagaggcugaauuauuuuuauuuuuaaacagguggugagaaauuucugugaaaccuguga

SEQ ID NO: 181421 - RNA, 64 nt, Human
uguugguuuguguguggacaagaggugguugguggguggugaaggcuaauggcagaguuagcac

SEQ ID NO: 181422 - RNA, 64 nt, Human
aguagaaaguguuuuuauagggcuucaauacccagguggugacagagcagaagaaccgguuuuu

SEQ ID NO: 181423 - RNA, 64 nt, Human
ccauucuugguauaauacaguguagcuuagaugagguggugaaauagggguaucagccgaauau

SEQ ID NO: 181424 - RNA, 64 nt, Human
gcaaauucaaaagcuuagagagaauaagcuucuugguggugaaacuacaacucucacgugugcu

SEQ ID NO: 181425 - RNA, 64 nt, Human
uauccagugcauuguuggcaccaugggaccagaagguggugaccccccuggacccagcuuucac

SEQ ID NO: 181426 - RNA, 64 nt, Human
aaugcugaagugacuuuugccagugccauguccagguggugagguauaaguuacuugcucuuag

SEQ ID NO: 181427 - RNA, 64 nt, Human
uuuugugaggcuuuugugcucccauacgcccccugguggugaguguaaagaagacuuugccucu

SEQ ID NO: 181428 - RNA, 64 nt, Human
aucucccaccccccacccuccucccgcugccccggguggugagcgggcaggaaccuggcgccgc

SEQ ID NO: 181429 - RNA, 60 nt, Human
acuuugacuacauagacuaaaauauuccaugguggugaaggauguacaagcuugugaaua

SEQ ID NO: 181430 - RNA, 64 nt, Human
cagcaggugugggcagcgugugaggcugccgggugguggugacuggugacuuccuuguguucag

SEQ ID NO: 181431 - RNA, 64 nt, Human
ucugggacgcccagacccugcccgccgcccaccugguggugacaagcuccagcagccagugggu

SEQ ID NO: 181432 - RNA, 57 nt, Human
gaaucuguucaguacaguagugcagaggguggugaaggcagauauuguaaacuacaa

SEQ ID NO: 181433 - RNA, 64 nt, Human
gucuuuccaauggugccuugcuuggugcucuccugguggugacauaacauugguucuacagaau

SEQ ID NO: 181434 - RNA, 64 nt, Human
acuaaauuauuccauuugcaacuuauccccaacagguggugaagcaguauuuuccaauuugaag

SEQ ID NO: 181435 - RNA, 64 nt, Human
ugcugaugaauuuaugccuagcuuuuuuuuucuagguggugauuuuucaauuucuuuuauauuu

SEQ ID NO: 181436 - RNA, 64 nt, Human
aaaucagaaacuugugaaguggaaauguucuaaagguggugaggcaauaaaaaucauaguacuc

SEQ ID NO: 181437 - RNA, 64 nt, Human
guaaaagacugaggugggggugggaggccagcacgguggugaggcaguugagaaaauuugaaug

SEQ ID NO: 181438 - RNA, 64 nt, Human
guaaaagacuggggugggggugggaggccagcacgguggugaggcaguugagaaaauuugaaug

SEQ ID NO: 181439 - RNA, 64 nt, Human
uuccacagggaaaugggcagacugaaccaguccagguggugaauuuuccaagaacauaguuuaa

SEQ ID NO: 181440 - RNA, 64 nt, Human
auuuuaccuuauaauccuuuauuaaaugaugggagguggugaucaggacaaaaguguuagguuc

SEQ ID NO: 181441 - RNA, 64 nt, Human
cguggcugcucuggggcuaccccaggugaacagagguggugagaugcgcagggaagaccagcuc

SEQ ID NO: 181442 - RNA, 64 nt, Human
cuuuccacuccauuuugagcaggcugcuuaaagugguggugaugaugaugaugaugauggcagc

SEQ ID NO: 181443 - RNA, 64 nt, Human
accagagaaccugauugcugaugauggccuuaaagguggugagggagauacugggggcagagca

SEQ ID NO: 181444 - RNA, 64 nt, Human
acuuggccucugaagggggaagguagugggaauagguggugagagaacucacauuuuucucuug

SEQ ID NO: 181445 - RNA, 64 nt, Human
agcuuugccaguggcauaucugucaucugauugcgguggugaaauggaauugaggcccaagguu

SEQ ID NO: 181446 - RNA, 64 nt, Human
ccuccuugguggccacaauuuagccaugucaucugguggugaccagcuccaccaagccccuuuc

SEQ ID NO: 181447 - RNA, 64 nt, Human
acccagcugauaugcaaggucauggcgugcccaggguggugacaguugaacaaaguguauagua

SEQ ID NO: 181448 - RNA, 64 nt, Human
gaacuaccuucucuucugucaugacccuaucuaggguggugaaaugccugaaaucucuggggcu

SEQ ID NO: 181449 - RNA, 64 nt, Human
aucauuuuuuuccagugaggauagaccacaaguggguggugagaccauugaaagccuuuaucaa

SEQ ID NO: 181450 - RNA, 64 nt, Human
caaauuggauaauccacugucucccaucccaggagguggugaguuggcuacaagagaaagggac

SEQ ID NO: 181451 - RNA, 64 nt, Human
gaucgcuggcagagaaggcuuccuccagcggcuggguggugaaggacccuggcucuucucucgg

SEQ ID NO: 181452 - RNA, 64 nt, Human
aaguugaucacuugcccaugguggacauuuuugugguggugauguccauuaaggaaaccagauu

SEQ ID NO: 181453 - RNA, 64 nt, Human
acagggacuggugagaauggggcugaguggaggagguggugauauuuaaaccauuuggugcuug

SEQ ID NO: 181454 - RNA, 64 nt, Human
cuauuggagagaacuuucagccccugaacuccccgguggugaccccucaccccugcacugagcc

SEQ ID NO: 181455 - RNA, 64 nt, Human
agacauuacacaaccugguacacaaaggggucaagguggugauggacauccccuaugagcugug

SEQ ID NO: 181456 - RNA, 64 nt, Human
guaaacagaaagcuguuuucccuacaaggugcuugguggugaagccaccaagcugucuuuggua

SEQ ID NO: 181457 - RNA, 64 nt, Human
uucuuaacuggaaauucuuucuuuucagaaucuagguggugaauuuuuuuuaaguggcacgguc

SEQ ID NO: 181458 - RNA, 64 nt, Human
aaaugaaucuauuucauaacucggacaauuucuggguggugacugaguaccccuuuagugagua

SEQ ID NO: 181459 - RNA, 64 nt, Human
acucuaaaaaguaugcaaaaucuuccuuguacaggguggugagccgccugccaguggaggacag

SEQ ID NO: 181460 - RNA, 64 nt, Human
guuaccaucucuuaccagucacaaagucagagaugguggugaggcugcagagcaaaagaaacag

SEQ ID NO: 181461 - RNA, 64 nt, Human
agucucucgccugugcugucucaugggacucaaugguggugaagaaaucucaaucggacaccag

SEQ ID NO: 181462 - RNA, 64 nt, Human
ggucucagggcgcaaacacaucccugcacccggugguggugauguugggaagauguuucccugc

SEQ ID NO: 181463 - RNA, 64 nt, Human
ucgggcuacugagaguggagaugggggcgggggugguggugaagagaguuggagaaggaaugga

SEQ ID NO: 181464 - RNA, 64 nt, Human
acuuuuuaaaagcaaaaaaaaaaaaaaguaugaugguggugaauaaagaccaaaggguccucuc

SEQ ID NO: 181465 - RNA, 64 nt, Human
uugaggggauugugugagguucaguugugggguggguggugagcugcugcauauuuuuuauuuu

SEQ ID NO: 181466 - RNA, 64 nt, Human
aggucaccuucugugauccccaucccaaggcacugguggugacucugcuuccugcacugaccca

SEQ ID NO: 181467 - RNA, 64 nt, Human
ugcagucagacugaaauauaaaaaaggugguggugguggugaaggggcugguggagauguagga

SEQ ID NO: 181468 - RNA, 64 nt, Human
auucuggcugaaggaaaugauccgccacccugaggguggugaugguaguuucuacccauaccuc

SEQ ID NO: 181469 - RNA, 64 nt, Human
aaggaacacaggguaaaggggauaggugccauuugguggugagaaugcugacugaaaaauagaa

SEQ ID NO: 181470 - RNA, 64 nt, Human
gggagcgcaagacgcccugagccucccucucacugguggugauaagaggagccgucuggugugu

SEQ ID NO: 181471 - RNA, 64 nt, Human
gcccuggggccagcucugccccagcccugagagggguggugaggcagcccccuggaccccagaa

SEQ ID NO: 181472 - RNA, 64 nt, Human
acucaaugauggaugagcugguagaaaaaaagcugguggugaaccaaggucaaacuggaaauua

SEQ ID NO: 181473 - RNA, 64 nt, Human
gagccacagggagccugugagggaguagugcggugguggugaguguggcugcccuggcuccccc

SEQ ID NO: 181474 - RNA, 57 nt, Human
ggccgccaggggagcuguaagcagccggguggugacaaggagaaaagccuucuaggg

SEQ ID NO: 181475 - RNA, 64 nt, Human
gacugaauucuacuauugcuaggugugagaaagugguggugagaaccuuagagcaguggagauu

SEQ ID NO: 181476 - RNA, 64 nt, Human
uuccccauuuuggccagacucaccggcccacugggguggugauguuuucguucuguuuuauuuu

SEQ ID NO: 181477 - RNA, 64 nt, Human
ugauguuuuaggugauuuaaaaauauaccguguugguggugaaugacuauugaugacuguguua

SEQ ID NO: 181478 - RNA, 64 nt, Human
ucacugugacguguuagaacaucuaauccacaaagguggugaugugcuugcuuuggcggaugau

SEQ ID NO: 181479 - RNA, 64 nt, Human
guuaaggagcuuuuuaacaagagugucuuugcuggguggugauugggauguaacagaucaguuc

SEQ ID NO: 181480 - RNA, 64 nt, Human
agccaacaugugacuaauuggaagaagagcaaaggguggugacguguugaugaggcagauggag

SEQ ID NO: 181481 - RNA, 64 nt, Human
ucaaauauucagaaagcagauguaugcugggcacgguggugacucaagccuauaaucccagcac

SEQ ID NO: 181482 - RNA, 64 nt, Human
ucuagaaucaguaauuuuguguuugggguguggggguggugaaagggaaguagaaccgaaacaa

SEQ ID NO: 181483 - RNA, 64 nt, Human
cccgcugggagggcaguuacaggagagaguaggugguggugacgugagggcugugaaggaucca

SEQ ID NO: 181484 - RNA, 64 nt, Human
uaguguccuguagggggacagaaugggguggccagguggugauuucucuuugaccaaugcauag

SEQ ID NO: 181485 - RNA, 64 nt, Human
aaucgauuagcagaaaggcauggcuaauaauguugguggugaaaauaaauaaauaaguaaacaa

SEQ ID NO: 181486 - RNA, 64 nt, Human
auuuugagaaaaauagagcaaaaucaacaugacugguggugagagaccacacauuuuaugagag

SEQ ID NO: 181487 - RNA, 64 nt, Human
gacaaaaauaaaauaaauaaaauaaaaauggauagguggugacccacugagccugaucauaaua

SEQ ID NO: 181488 - RNA, 64 nt, Human
uuuauagggauuuuuaguuuugcccuuuuugguagguggugauuuugaggcuguaacaugccca

SEQ ID NO: 181489 - RNA, 64 nt, Human
cugaagaaggcaacagauaugauggcauuuauaagguggugaaauacuggccagagauuucauc

SEQ ID NO: 181490 - RNA, 64 nt, Human
uuacauuagugugugugcauucguucagccccaugguggugaauucuguuucuuuccuuuccua

SEQ ID NO: 181491 - RNA, 64 nt, Human
gauggugacuuagacucgggugguuagugguagagguggugagaagacaucagauccugggcac

SEQ ID NO: 181492 - RNA, 64 nt, Human
cccuucaguuaaagauauuuaaggaaaaauuugggguggugauaauauggcuuuucacagaaag

SEQ ID NO: 181493 - RNA, 64 nt, Human
uagcugagccaagugagugaguuugcagaaagcagguggugagcuccugccugcuggagguugc

SEQ ID NO: 181494 - RNA, 64 nt, Human
cauauuuccccuagaagcaaugguuuucagccuugguggugaccuuauagaacauaaauauugu

SEQ ID NO: 181495 - RNA, 64 nt, Human
acuucagaggcuucugggaacccaggcugggccugguggugaagagcaguccugggcacaggcu

SEQ ID NO: 181496 - RNA, 64 nt, Human
gacugugggugugugcaggccggggaguauuaaagguggugauuuuuggagacaagucuggugg

SEQ ID NO: 181497 - RNA, 64 nt, Human
cgaccaagugcaugcuggccacugggaguggaucgguggugaaccuguugccuucaccaauggg

SEQ ID NO: 181498 - RNA, 64 nt, Human
guacauugcuacaguucacuguagcaacagauuugguggugauggggggauagagguagaagca

SEQ ID NO: 181499 - RNA, 62 nt, Human
ucuagccaaauaacuguuuuggaauaaaaaccuugguggugagggaugacugcacugugcug

SEQ ID NO: 181500 - RNA, 64 nt, Human
uggcaucaguggguggcuggccgcgguucuggaagguggugagcauugaggcccaguaagacac

SEQ ID NO: 181501 - RNA, 64 nt, Human
ggccuuaccagcuugucugcacuauuuucuuuuggguggugacuguuuuuuucugacuuugcau

SEQ ID NO: 181502 - RNA, 64 nt, Human
guucaaaauguuuaacacauucuaccugacgggagguggugaccucauucagucgguuaagagc

SEQ ID NO: 181503 - RNA, 64 nt, Human
gcugugaugaagaaaaauacauggccgacuccaggguggugacauuuagagcuagucuugaaac

SEQ ID NO: 181504 - RNA, 64 nt, Human
uugacauugugugaggucucaccugaaggaacuugguggugacauuugggaggguggagggagg

SEQ ID NO: 181505 - RNA, 64 nt, Human
caagugggggcugaggcagaggcagggauagcuggguggugaccucuuagcggguggauuuccc

SEQ ID NO: 181506 - RNA, 64 nt, Human
guaaguuucugugaccuguaguguaccauucucagguggugauaugguuuggauguuuuguccc

SEQ ID NO: 181507 - RNA, 64 nt, Human
cugcaaagagaccuccucacccuggugcuuaugcgguggugacggguguagacguugcaaacaa

SEQ ID NO: 181508 - RNA, 64 nt, Human
guggggcagggcucaaggcugcucugguguaugggguggugacccagucacauuggcagaggug

SEQ ID NO: 181509 - RNA, 64 nt, Human
gggggcuggaauccaccuccucccacacaagcucgguggugacucuucggccccuggggaaaaa

SEQ ID NO: 181510 - RNA, 64 nt, Human
ugccuuccaucaacugcaguguaaugggaaagaggguggugagguuuugaaagacagauuucca

SEQ ID NO: 181511 - RNA, 64 nt, Human
guuccaucugggcuuauauguacuuuuauuuuuugguggugaaauugacugaugauuuuccuuu

SEQ ID NO: 181512 - RNA, 64 nt, Human
ugacccccccccauguuuuauuaaagggggugcugguggugagccgugugugcgugucccugcu

SEQ ID NO: 181513 - RNA, 64 nt, Human
aucucuaccaaaaauacaaagauuagccaggcgugguggugagcgccuguagucccagcuacuu

SEQ ID NO: 181514 - RNA, 64 nt, Human
caggagcuuggaccuugguacuaccucagcugaggguggugacacaaccccuuccauuugucag

SEQ ID NO: 181515 - RNA, 64 nt, Human
agcccugcauuuccucuacgcccagguuccggaagguggugagacaggccagcgugcaugacag

SEQ ID NO: 181516 - RNA, 64 nt, Human
gauuacugguagauaauaugcucuggucucgccugguggugaguuuugccagccauggccaggg

SEQ ID NO: 181517 - RNA, 64 nt, Human
ucaggggcuaccgugucuucacucuccagccugagguggugaaggcaggaugcucucucuaagc

SEQ ID NO: 181518 - RNA, 64 nt, Human
uucucuuuacccagugggucccuucgaugcugaggguggugaguaugucacuaugcaagggccc

SEQ ID NO: 181519 - RNA, 64 nt, Human
cgcggggaggggugggggucccuacgaugcgcccgguggugaugacuccuacaucuaaguggcc

SEQ ID NO: 181520 - RNA, 64 nt, Human
ggauuuacaggaacugucauaguguucaguauuggguggugauaagcccauuggauuguccccu

SEQ ID NO: 181521 - RNA, 64 nt, Human
ucuaaguuaguggacagcaagccuguggcuacgggguggugauguuccucuuccagcugucccc

SEQ ID NO: 181522 - RNA, 64 nt, Human
uuuuccaaaucaaucaccagaaggagacaccagugguggugauuggcugguugccuuagcugau

SEQ ID NO: 181523 - RNA, 64 nt, Human
aaggacacuuugagacaccaaucuggauugagcggguggugauaauaggggcuggaaagccagc

SEQ ID NO: 181524 - RNA, 64 nt, Human
acaucuccccugcuucuuccucucucugccuaaggguggugaugguggggagugguugauaaag

SEQ ID NO: 181525 - RNA, 64 nt, Human
auuccuucucuccugcaauugcacaaaaacaagugguggugaaacauuguucuguuuucacaag

SEQ ID NO: 181526 - RNA, 64 nt, Human
uccuguuugacucaugaacauuuaggaaguuuaagguggugaucuucucuuucaaacaaagaua

SEQ ID NO: 181527 - RNA, 64 nt, Human
cucccauugggguuucuagccugcccuagggggagguggugauguugggagugggaucuccuga

SEQ ID NO: 181528 - RNA, 64 nt, Human
cuucccugggcaccugguaccuggggaccuacaagguggugagggaaggguacgaguacauucc

SEQ ID NO: 181529 - RNA, 64 nt, Human
gguggcaugggagagaagggaggaggugggcacagguggugagcuuaugugugggcacucuacu

SEQ ID NO: 181530 - RNA, 64 nt, Human
ccuaaaauucuaggggauuucuggugggacaauggguggugaauucugaaguuuuggagaggga

SEQ ID NO: 181531 - RNA, 64 nt, Human
acuaauccagauacaucccaccagccucuccaaggguggugaccaaugcauuaccuucuguucc

SEQ ID NO: 181532 - RNA, 64 nt, Human
ccugucucuacuaaaaauacaaaaauuagccggggguggugacaugugccuguaaucccagcua

SEQ ID NO: 181533 - RNA, 64 nt, Human
cucggcaggccgcgggcauccggcugcaggaccagguggugaucaucgacgaggcgcacaaccu

SEQ ID NO: 181534 - RNA, 64 nt, Human
auaguauuuaacgaagccuagaagcacggcuguggguggugauuuggucagcauaucuuaggua

SEQ ID NO: 181535 - RNA, 64 nt, Human
uaaacuggcuuuguauauauguauaaaugcuggugguggugaaaguagucuuguuuuaugagga

SEQ ID NO: 181536 - RNA, 64 nt, Human
ucucuccuuuaccaccaugcaggaacagacuuuugguggugaggaggaagaacaaauaauagaa

SEQ ID NO: 181537 - RNA, 64 nt, Human
cccucagcccuuuguaaagucugaugaaggcagggguggugauucaugcugugugacugacugu

SEQ ID NO: 181538 - RNA, 64 nt, Human
cacaacccggaaggcuguggaccgauuccucuaggguggugaccucccauuagcaaacgguguc

SEQ ID NO: 181539 - RNA, 64 nt, Human
gcuugguuguggaacauuuuaaagaugacguggagguggugaugagggaucccauauuguuugg

SEQ ID NO: 181540 - RNA, 64 nt, Human
ucucuacuaaaaaauacaaaaauuagccagguaugguggugaacaccuguaaucccagcuacuu

SEQ ID NO: 181541 - RNA, 64 nt, Human
aaaugcuugcuucaaccccaugagacucgauagugguggugaacagaacaaaaggucauuggug

SEQ ID NO: 181542 - RNA, 64 nt, Human
ugguuguaaaaccuuaacuuucuuucuccaggaggguggugauagaaacagaugguaguauuua

SEQ ID NO: 181543 - RNA, 64 nt, Human
ccagcaugguggggugacacgagaccuguaagcagguggugagaaguuagacagccuuuacuug

SEQ ID NO: 181544 - RNA, 64 nt, Human
aggaagaagagaaaacauauuuccggucaucucugguggugagaggcugguguucuguuuugag

SEQ ID NO: 181545 - RNA, 64 nt, Human
cauuucuaauguuguccucacaagaaggcuaauugguggugagacagcaggggaggaggaagag

SEQ ID NO: 181546 - RNA, 64 nt, Human
ucugauaucgaauuaaugaaguaaaguuguugaugguggugaaacaccguagggcaugugguuc

SEQ ID NO: 181547 - RNA, 64 nt, Human
cauuaaaagaacagugaugauggugguucccagagguggugacugagauccuaaaccguucugg

SEQ ID NO: 181548 - RNA, 64 nt, Human
ccacaaacuccccuccaggcugccccugggacaugguggugaugugggugcaggagccaguguc

SEQ ID NO: 181549 - RNA, 64 nt, Human
uuugaaagccacuggggccaauuugugguuaagagguggugagauaagaaguggaacgugacau

SEQ ID NO: 181550 - RNA, 64 nt, Human
uuaacugaaucuaaaagaaaacuauuuugaagaugguggugagcugcaaaauagcuggauggau

SEQ ID NO: 181551 - RNA, 64 nt, Human
uuggcugaguacuuguaacugucagaagaaggaugguggugaguggucuuugucugccuaaacc

SEQ ID NO: 181552 - RNA, 64 nt, Human
ugcuggugugcaugcugggcugccuggcaaaucugguggugaugggauuccucaaggagaaaac

SEQ ID NO: 181553 - RNA, 64 nt, Human
augaaaacacggaugaaugaauaaaacacucuuugguggugacugaggcaucauuagaaggccc

SEQ ID NO: 181554 - RNA, 64 nt, Human
uuugcuaguuagaaguacauauugagguuuuaaugguggugauagugaguuuuguggcaccagc

SEQ ID NO: 181555 - RNA, 64 nt, Human
cuuggggaacuugcuguuucuaaacaugcaggcugguggugauggguucuguguggagaagcca

SEQ ID NO: 181556 - RNA, 64 nt, Human
ugccaggucccaccuagugaaguaauaaaccguggguggugauagugacccagugcccucacug

SEQ ID NO: 181557 - RNA, 64 nt, Human
gcaggaaaugucucaagaaccagaaauaaauaaggguggugauagaaagguauacuuuuauauu

SEQ ID NO: 181558 - RNA, 64 nt, Human
agugugggaugucccugagagguagcaagucuaggguggugaguuccugcuaggcaaccaaauu

SEQ ID NO: 181559 - RNA, 64 nt, Human
ugcuuuugucaggcagugguaggacuuugguguggguggugagaaauuguaaacaaaaacugac

SEQ ID NO: 181560 - RNA, 64 nt, Human
acacggcuuuaggaagauaccugggggauggagggguggugaugucaggguugggcgcgggaag

SEQ ID NO: 181561 - RNA, 64 nt, Human
cacuuugacaaaugugaacucucggaaauaguaugguggugaaacuuguacugcaugaacaucc

SEQ ID NO: 181562 - RNA, 64 nt, Human
aagucucagguccuagagucagggcaaaaggugagguggugaaguggcccgggccugggaacug

SEQ ID NO: 181563 - RNA, 64 nt, Human
ugugugugugagagagagagagagagagaugggugguggugagaaguguuguuagaaacauaua

SEQ ID NO: 181564 - RNA, 64 nt, Human
ccacugugugucagcugggauuggccgacagcgugguggugacuucuagguagaccgauggacc

SEQ ID NO: 181565 - RNA, 64 nt, Human
gacaauuucugagugaaagagaaagaauggggucgguggugaaggugcucucacuuuacagaau

SEQ ID NO: 181566 - RNA, 64 nt, Human
uugagcccaggaguuuuaaguccagcuuggccaagguggugaaaucccaucucuacaaaaaaug

SEQ ID NO: 181567 - RNA, 64 nt, Human
ccuggggcugagggccuuguggaggauggucggugguggugauggagguggagagcauuaaacu

SEQ ID NO: 181568 - RNA, 64 nt, Human
ggugacagccuccugucugaugacaggacagacugguggugaggagucuaagugggcucaguuu

SEQ ID NO: 181569 - RNA, 64 nt, Human
aaaauuuuaaaaauauaacgagggauaaauuuuugguggugauagugucccaguacaaaaaggc

SEQ ID NO: 181570 - RNA, 64 nt, Human
ugggacauacguuguucuccccucucuggaucaagguggugacaggcagccugcugccguaugc

SEQ ID NO: 181571 - RNA, 64 nt, Human
agacucgaagucucacugcaccagugucuuugaugguggugagggugggugauggugcccagca

SEQ ID NO: 181572 - RNA, 64 nt, Human
acguuuuuaucugaaugcauacaaggaguccugagguggugauuuggccaguguuuuaacuugu

SEQ ID NO: 181573 - RNA, 64 nt, Human
aggcaagccuugaucauaguucauacauauaaaugguggugaaauaaagaaauaaaacacaaua

SEQ ID NO: 181574 - RNA, 64 nt, Human
agaagugucccguggacaacgucaaacugaccgugguggugaacaacaucgcgguggccgagca

SEQ ID NO: 181575 - RNA, 64 nt, Human
aucugggugugaauccuuuuuugccucugagguggguggugagagacgggcccagcuguccaag

SEQ ID NO: 181576 - RNA, 64 nt, Human
agagagucccuggggguucugcucugaccguguggguggugauccuugucaggauguacagucc

SEQ ID NO: 181577 - RNA, 64 nt, Human
caguccauagcagagaaugaaagggcccagagaggguggugaccucugccugaagucacacagu

SEQ ID NO: 181578 - RNA, 64 nt, Human
gugaacuugaaguucaggacuugacucucccacagguggugagcugguggcucucuggugagcu

SEQ ID NO: 181579 - RNA, 64 nt, Human
gcacaagguuuuauacugcuaagugcuugguugggguggugagaugaugauuagaucaggggug

SEQ ID NO: 181580 - RNA, 64 nt, Human
acaacaagacccuaguccugguuccaauuuaggugguggugaugaccucaaacuucguuaauua

SEQ ID NO: 181581 - RNA, 64 nt, Human
aaagcuuuuuuuuuuuucccaucacucuuuacaugguggugauguccaaaagauacccaaauuu

SEQ ID NO: 181582 - RNA, 64 nt, Human
gugcacgcggcuuuaagugugcugggcagagggagguggugauauuguguggucugguuccugu

SEQ ID NO: 181583 - RNA, 64 nt, Human
cucagccucaggcauccaaagccacaccacagucgguggugaugcaacugggggcuuacucuga

SEQ ID NO: 181584 - RNA, 64 nt, Human
cagauagacaugaagagagcuuagcagugauugagguggugacuaaauauacagucauugaaua

SEQ ID NO: 181585 - RNA, 64 nt, Human
gucaccccacuuggugggcuugggguugguucuggguggugaaccggggcagacccagcuaaug

SEQ ID NO: 181586 - RNA, 64 nt, Human
agcaaggccuugccuggcgaguugucaugugguugguggugacuguuuuauuuuuuuuaauaaa

SEQ ID NO: 181587 - RNA, 64 nt, Human
gagagcuucacacagacaaugagagaggguggaugguggugaguggaucauuucuuucagccac

SEQ ID NO: 181588 - RNA, 51 nt, Human
gccagcuggcagccgccugaggguggugaccccaggagggaggcaggggag

SEQ ID NO: 181589 - RNA, 64 nt, Human
cuaagaugcauguccagcauaggcaggauugcucgguggugagaagguuagguccggcucagac

SEQ ID NO: 181590 - RNA, 64 nt, Human
ccuccauccauccagacagcccuucccaccuccugguggugagccagucugcauucccacgcca

SEQ ID NO: 181591 - RNA, 64 nt, Human
guguuuuguauuuuuauucauuguguaauuuagugguggugaaaguucuacacucaauccuuaa

SEQ ID NO: 181592 - RNA, 50 nt, Human
cacgaaaggaaacaggcuaagguggugaacccuccaauucaggaaguggg

SEQ ID NO: 181593 - RNA, 64 nt, Human
acuaccuggccaccauggccauggauggaauggagguggugauucuagauguccggguucccug

SEQ ID NO: 181594 - RNA, 64 nt, Human
gcugcagaguucuuucugcuuucagcccuaccuugguggugauuuaccugaaaaucuucacaac

SEQ ID NO: 181595 - RNA, 64 nt, Human
ugaagacccuggcccgggaccuuggcauggcagugguggugaccaaccacauaacucgagacag

SEQ ID NO: 181596 - RNA, 64 nt, Human
guuuccuuuccucgugcuugugccccccgcuugggguggugacgugacauugacaucaaacaag

SEQ ID NO: 181597 - RNA, 64 nt, Human
accgggcacagugcauccagagcaugacccgccugguggugaaggaacggaaucgcaaguauga

SEQ ID NO: 181598 - RNA, 64 nt, Human
agaggagcaagugauaugauguguaaaguauguugguggugaaagcaagguuccccaggagagg

SEQ ID NO: 181599 - RNA, 64 nt, Human
guaagagagcucaccugugucccagcccucugaugguggugagaccaggggaaaggccagcuca

SEQ ID NO: 181600 - RNA, 64 nt, Human
cuccucagguguggacuagacggcguggcccaaggguggugagaaccggagaaccccaggacgc

SEQ ID NO: 181601 - RNA, 64 nt, Human
gccgcggucugaacugcuuuccaugcugccaucugguggugauuucggucacuucaggcauuga

SEQ ID NO: 181602 - RNA, 64 nt, Human
uuggguuaauucuucggugacacuggcauugcuggguggugaugcccguccucuggcuuggguu

SEQ ID NO: 181603 - RNA, 64 nt, Human
gaccucgugcagaccgaggccuucuccaaagaaagguggugagggcggaggggccgcuccaggc

SEQ ID NO: 181604 - RNA, 64 nt, Human
gauuuggggaggaaaacuuauucugaauauuaacgguggugaaaaggggacaguuuuuacccua

SEQ ID NO: 181605 - RNA, 64 nt, Human
ggagaaaauaaagagaaggcuggagagaagccgugguggugaaaccgugugcauguguguccuu

SEQ ID NO: 181606 - RNA, 64 nt, Human
guugggcagcaucaaaggugcugggacaucccaggguggugagauccauccacgauccagcucc

SEQ ID NO: 181607 - RNA, 64 nt, Human
cagaaaaauguauacuggggaaaaguuguaugaagguggugaacaugggagacuuuuagcaaug

SEQ ID NO: 181608 - RNA, 64 nt, Human
acccaggcaucuaucaaagucccucauucaugaggguggugaggacacagacugcgaccagaac

SEQ ID NO: 181609 - RNA, 64 nt, Human
cuuguaguuuuaguagggacauguuggccaggcugguggugagcuccuggccucaggugaucca

SEQ ID NO: 181610 - RNA, 64 nt, Human
gugcggccagugacuuccccaggaguguggaggggguggugaggaggagcaccugggcucucua

SEQ ID NO: 181611 - RNA, 64 nt, Human
gguggccgcggcagccucaguggcagcagcugccgguggugaccuggguuggauggcagagacc

SEQ ID NO: 181612 - RNA, 64 nt, Human
acggccccugccggauaggccuagcccuggcccagguggugagcgguuugcaguguccguucuc

SEQ ID NO: 181613 - RNA, 64 nt, Human
gguggguggggccccucuguaaauacggccccaggguggugagagagucccaugccacccgucc

SEQ ID NO: 181614 - RNA, 64 nt, Human
cucagcaccccaggaccugaguauccccagcucagguggugaguccuccuguccagccugcauc

SEQ ID NO: 181615 - RNA, 64 nt, Human
guagaacugcauugacuaaccagucccucuggaugguggugaaccugaagcaugcuuuaaccuc

SEQ ID NO: 181616 - RNA, 64 nt, Human
gcccaguccccgugcccacggggcucccucucccgguggugaaaguguccacacgugugguagu

SEQ ID NO: 181617 - RNA, 64 nt, Human
cucuucccucaccagagcagggcgcuucucuugggguggugagaaggaucuucgagaaaucgug

SEQ ID NO: 181618 - RNA, 64 nt, Human
ggugacccugucucugccuggagcccagguugcagguggugagcugcuggugggugaggguguc

SEQ ID NO: 181619 - RNA, 64 nt, Human
gcccaucucuacuaaaaauacaaaauuagcugaggguggugacgcaugccuguaaucccagcua

SEQ ID NO: 181620 - RNA, 64 nt, Human
gcgucauucagaagaaggcguccaaggagcugaagguggugaaauuuguccugcaggucccucg

SEQ ID NO: 181621 - RNA, 64 nt, Human
ucauggugauugucauguaaggcuuaacacaguggguggugaguucugacuaaagguuaccugu

SEQ ID NO: 181622 - RNA, 64 nt, Human
auuuucccuccccacagugcacugagcaauggaggguggugagggagccaugcugcugaauucu

SEQ ID NO: 181623 - RNA, 64 nt, Human
ggccauaucaugaacccaggacaggcacaguggggguggugaggaccugauagaguuggaucag

SEQ ID NO: 181624 - RNA, 64 nt, Human
caaccccuggucuaagauaagagauaaaacaucagguggugagguugagguuuggggcuuggua

SEQ ID NO: 181625 - RNA, 64 nt, Human
gcucaaacgcccacccccacucccaccaucugcagguggugaaaacaaaccccguguaucucuc

SEQ ID NO: 181626 - RNA, 64 nt, Human
ccuugggccggcuuccuuaggggacagacuguuggguggugauggggauuguuaggauggagcc

SEQ ID NO: 181627 - RNA, 64 nt, Human
cugguggcagauuucgcuuuucguuguaaauaucgguggugauuguugccaaaaugaccuucag

SEQ ID NO: 181628 - RNA, 64 nt, Human
cagguggccacgaggacuugcaggcuauaguuaugguggugacaugcaugaggugggcugguag

SEQ ID NO: 181629 - RNA, 64 nt, Human
ugagugggggaccuucacugaugugggcaggagggguggugaaggccucccccagcccagaccc

SEQ ID NO: 181630 - RNA, 64 nt, Human
uggugguggugguggugguggugguggugguggugguggugagugucagcaucuacaguacagc

SEQ ID NO: 181631 - RNA, 64 nt, Human
ugaaccgaggcagugaggugauugcugcugggaugguggugaaugacuggugugccuucugugg

SEQ ID NO: 181632 - RNA, 64 nt, Human
ccauuaggcggacugcggcgucagggggauagcggguggugagggaaggggcacgugcuagacc

SEQ ID NO: 181633 - RNA, 64 nt, Human
ggaggaagcggggggacgccugucaccccuggcagguggugaguucaggugggggcucccugcu

SEQ ID NO: 181634 - RNA, 64 nt, Human
cccuguccugacccauccaagcgcuguuggggcugguggugacguggucacauguccuggcaua

SEQ ID NO: 181635 - RNA, 64 nt, Human
gcaggaagagcauaaagaagaugcuggaagugcugguggugaagcucccucucuccgagcacug

SEQ ID NO: 181636 - RNA, 64 nt, Human
acccccgccgguggcugcugucacuuuuguaguagguggugacugaugcugcuuuugcucuucc

SEQ ID NO: 181637 - RNA, 64 nt, Human
agggaacacugcccuggcucagcgugcgagcuaagguggugauguaugcgaugggacucugcau

SEQ ID NO: 181638 - RNA, 64 nt, Human
ugguggccagaaauaaagggaccagcccuucauggguggugacgugguagucacuuguaagggg

SEQ ID NO: 181639 - RNA, 64 nt, Human
ggcgcggccugcucuggcaggccccugugugugggguggugagggucuccccaccagugcugca

SEQ ID NO: 181640 - RNA, 64 nt, Human
uccacagggucaggauggaguagcugccuugcgagguggugagacuccugucucuggaggucug

SEQ ID NO: 181641 - RNA, 64 nt, Human
gcgccuacugggcauccggccugugcugggcauggguggugacauuggcagaaauggccacugg

SEQ ID NO: 181642 - RNA, 64 nt, Human
augacauccauccaucuguggugaaccaagugaagguggugacuucuggugacauaguaauaaa

SEQ ID NO: 181643 - RNA, 64 nt, Human
guccuuccucuaggaaguguagaucagaaagugagguggugaccucccaccucuggucugguua

SEQ ID NO: 181644 - RNA, 64 nt, Human
ggucuggagggugggucuugagauuggggaugaggguggugagccccugggcguggccucuuaa

SEQ ID NO: 181645 - RNA, 64 nt, Human
caaauccgcucuggagcaugaggcuggaugcagugguggugaggccgccccgcuccaucccgag

SEQ ID NO: 181646 - RNA, 64 nt, Human
cccagccagagagggcuugaccaaaucaaauugagguggugacuuuuguuggaaaauugggcug

SEQ ID NO: 181647 - RNA, 64 nt, Human
ccuucccucuccucagcccagaguguucugcguggguggugauggggguucaccugaacacaga

SEQ ID NO: 181648 - RNA, 64 nt, Human
agauagcacuuaggacaagaaugugcauugaugggguggugaugaggugccaggcacuggguag

SEQ ID NO: 181649 - RNA, 64 nt, Human
auguguccuagacacagcaugaaguuggggcacugguggugagaggcggaauccaaaaaaauuc

SEQ ID NO: 181650 - RNA, 64 nt, Human
uuucuugagaggaaguuauagaaggcuuguuggugguggugauguuaaacugauggaaauucuu

SEQ ID NO: 181651 - RNA, 64 nt, Human
uggucaucccaucuuguccuguuuuaaggauauggguggugaaagaugaaagaggcagaguuua

SEQ ID NO: 181652 - RNA, 64 nt, Human
augugaagauucagagaaggcauccuguagucuagguggugauaccugaacugagucuugaggg

SEQ ID NO: 181653 - RNA, 64 nt, Human
uccuuccuuuguagagaaagugacagagcaggcggguggugaaguaggguccuggauuaaaagc

SEQ ID NO: 181654 - RNA, 64 nt, Human
caaaugaccaaagguuagccuagaccuuuggucagguggugaaggcccugggaaugcagguucu

SEQ ID NO: 181655 - RNA, 64 nt, Human
agcaggaagggaccccuggagcaggcuggcccgggguggugaaguagcuggagcccgaucacag

SEQ ID NO: 181656 - RNA, 64 nt, Human
aucauucuccuaaacugaacacaugacuagaauugguggugagauaucgcuugauuuucuuuuc

SEQ ID NO: 181657 - RNA, 64 nt, Human
ggugucagccgcugagcccccucccugcuguguggguggugagcaggcugggucuuugucuguc

SEQ ID NO: 181658 - RNA, 64 nt, Human
uauuauagaaugcauguauuuucuuuuaucuuuggaacaucagcaccaguauauugcuggcagc

SEQ ID NO: 181659 - RNA, 64 nt, Human
uuccauuuggcauuagcccagcacagagccaccggaacaucaagauccuagaggacgaacccca

SEQ ID NO: 181660 - RNA, 64 nt, Human
ugacuagcaaauaucauuuucuguaugaauuguggaacaucacaauaaaauuauuucugugcug

SEQ ID NO: 181661 - RNA, 64 nt, Human
ugcgaacgcugaaucuaggugggacgcuugccuugaacaucaugguuccuuuggugaucuauaa

SEQ ID NO: 181662 - RNA, 64 nt, Human
ucuaaucaucauuaaugauguaauugguauauaggaacaucauguuuucugcaggaaagaaagu

SEQ ID NO: 181663 - RNA, 59 nt, Human
gcucuggggacugcugcugaccagaccucgaacaucacagagcaacccuuauggagaaa

SEQ ID NO: 181664 - RNA, 64 nt, Human
guuaguugagacugaaguguucacuuccauagaagaacaucacuuuuaaccuugcuuuggcgaa

SEQ ID NO: 181665 - RNA, 64 nt, Human
auuccugaaaguguggaugcgcuggaugcgcagggaacaucaggaaaaggccacggggcucuga

SEQ ID NO: 181666 - RNA, 64 nt, Human
cucaucagucuauccuucugccuccauauauccugaacaucaaacuaucccaggaaaaccaucu

SEQ ID NO: 181667 - RNA, 64 nt, Human
gauaugaagacuauccaguucucaguuugaauuggaacaucauguuaaaaacaguuaugagauu

SEQ ID NO: 181668 - RNA, 64 nt, Human
ugggaugugaagaggcaaggcagaaauggaugaugaacaucaaaaacugucagaggacaggucu

SEQ ID NO: 181669 - RNA, 64 nt, Human
ucccugcuuccaggccugaagucuucuccuccaugaacaucauggacugagcugggggaagaag

SEQ ID NO: 181670 - RNA, 64 nt, Human
aaggacugacucaagcugugucuuucagaccaaggaacaucagagaagcuguggggcugccugc

SEQ ID NO: 181671 - RNA, 64 nt, Human
uuuuuuccucccaguuuccaaacaagcccucagugaacaucauugaagcgugacugccugucug

SEQ ID NO: 181672 - RNA, 59 nt, Human
acuuuccagcaaacagaugacauggaagagaacaucauuuacuaguccucuucaacaca

SEQ ID NO: 181673 - RNA, 64 nt, Human
uguacauauuuauaaaucuguaccaccuaacauugaacaucauuuuauaugaagaacauacaug

SEQ ID NO: 181674 - RNA, 64 nt, Human
cacaugauuaaugauuuagcucccuccauaccucgaacaucaguugggaucccuccuccagcca

SEQ ID NO: 181675 - RNA, 64 nt, Human
augcagaugagaagcacccagaacaugcugagcagaacaucagaaaaagcaagaagaagaaaag

SEQ ID NO: 181676 - RNA, 64 nt, Human
auguauccauaaaauaucagagcuuguugggcaugaacaucaaacuuuuguuccacuaauaugg

SEQ ID NO: 181677 - RNA, 64 nt, Human
uaaaagagaguaccuuucacugcauuggauggaugaacaucagugcccuaacuuuauccaucau

SEQ ID NO: 181678 - RNA, 64 nt, Human
gaaccaucagagaaucuagaaccaaccaagcuaggaacaucagccuggugcccuguuaaccccu

SEQ ID NO: 181679 - RNA, 64 nt, Human
ugaagauuuccccccuuuuguuuuauuccugaaggaacaucaguacccgaucuugaagaaauuc

SEQ ID NO: 181680 - RNA, 64 nt, Human
gguaaaccuugugagcucaguacaucuauuuugugaacaucaguuggauuauauugcauauugu

SEQ ID NO: 181681 - RNA, 64 nt, Human
guuuuaaagugaauuguuguaaugaaguuccugugaacaucauuaugguuuuguacaaauagga

SEQ ID NO: 181682 - RNA, 51 nt, Human
gcaacuggagucuguuuuaaggaacaucauaaaagaacgaaaaggaaggaa

SEQ ID NO: 181683 - RNA, 64 nt, Human
gccugugaguccuagcuaccuggaggugaggugggaacaucacuugagcccaggaguuggaggc

SEQ ID NO: 181684 - RNA, 64 nt, Human
caaauacuuuuccugccuccaccaaaccccuacagaacaucaccuggaauugccacucacacug

SEQ ID NO: 181685 - RNA, 64 nt, Human
uacauucagaauugaaagguguugguuaagucuugaacaucacuauucuaugcauaaaacuugg

SEQ ID NO: 181686 - RNA, 64 nt, Human
cagggcauugauggaucacaugagaugguagaaggaacaucaucacauaccccucucacagaga

SEQ ID NO: 181687 - RNA, 64 nt, Human
gacaacauaauuuauuuccagaaaacaacagaaugaacaucaucaugaauacaugaaucggcug

SEQ ID NO: 181688 - RNA, 64 nt, Human
uguucugaaaggcagacgugcuccucagacaucagaacaucacauuggaacggauuacuccugc

SEQ ID NO: 181689 - RNA, 64 nt, Human
aacauuuucugggaagagguaagggugacaaauggaacaucagaaacguaucuugcuugcuaau

SEQ ID NO: 181690 - RNA, 64 nt, Human
ugguagcauuugcucagagccuacgcuugguccagaacaucaaacuccaaacccuggggacaaa

SEQ ID NO: 181691 - RNA, 64 nt, Human
uaauauaauuauuuacuuuaaaaauuguacuucagaacaucagauuuuauucacauuuuuuaac

SEQ ID NO: 181692 - RNA, 64 nt, Human
gauguagaagaagacugugaugagcucgucuguggaacaucacaaguaucgaaaauacaguaau

SEQ ID NO: 181693 - RNA, 64 nt, Human
uaucagcaguacuaaaauguaucagccaaccagagaacaucagugacuuuaacuucugcagagu

SEQ ID NO: 181694 - RNA, 64 nt, Human
gccguaccaggggcccuggcagggucagcugcaagaacaucaaaccagagugcccaaccccggc

SEQ ID NO: 181695 - RNA, 64 nt, Human
cucaaaacuuggaauucucucaccucuaacaucagaacaucaauuccaguggaacagucuuccc

SEQ ID NO: 181696 - RNA, 64 nt, Human
agcagggcaucgugcaccuggaccucaagccggagaacaucaugugugucaacaagacgggcac

SEQ ID NO: 181697 - RNA, 64 nt, Human
gucccgguggcugccaugcgcaggcagguuuuaggaacaucauggguggaugauuccuggucuc

SEQ ID NO: 181698 - RNA, 64 nt, Human
aucagaaaacaguuggcauaagaauuaaacauaugaacaucacaaaacaauuuauaaaaacuuc

SEQ ID NO: 181699 - RNA, 64 nt, Human
acaaacacuccuuuggccuguugaauuugcugaagaacaucaccuaaagucugcacacgagccc

SEQ ID NO: 181700 - RNA, 64 nt, Human
aagcugaaaaccuaaguccuuuauguggaaaacagaacaucauuagaacaaaggacagaguaug

SEQ ID NO: 181701 - RNA, 64 nt, Human
agacugaccuguccuuuuuuaucugcgcaugcgagaacaucaccuuccucuguacacuuggaaa

SEQ ID NO: 181702 - RNA, 64 nt, Human
acugugccuuauagcuguuaauucauuucccccugaacaucaaauaugccugaagagaagaaag

SEQ ID NO: 181703 - RNA, 64 nt, Human
agauaaauaagugguuucccucaauugaagacaggaacaucauuuuccacaggauaugaagagc

SEQ ID NO: 181704 - RNA, 64 nt, Human
guuuaaaauccaaaugagaacuaaauaaaguguugaacaucagcuggggaauugaagccaauaa

SEQ ID NO: 181705 - RNA, 64 nt, Human
auuuaaaauucaagugagaaguaaauaaaguguugaacaucagcuggggaauugaagccaacaa

SEQ ID NO: 181706 - RNA, 64 nt, Human
guuuaaaauccaaaugagaacuaaauaaaguguugaacaucaacuggggaauugaagccaauaa

SEQ ID NO: 181707 - RNA, 61 nt, Human
augugugucagaaaauuugaucaccauugaggaacaucaucaauugcagacugugaaguug

SEQ ID NO: 181708 - RNA, 64 nt, Human
agauuuucauauaauguauuaaagacaaaguagugaacaucaaugaacaucugauagagauaaa

SEQ ID NO: 181709 - RNA, 64 nt, Human
uauaucugugcuucauaaauauuaauguucuucagaacaucauuuuaaaggagauacuugaauu

SEQ ID NO: 181710 - RNA, 64 nt, Human
uggaaguuugccccuguucuuuuuucuuuugaaagaacaucaguucaugccugaggcaugagug

SEQ ID NO: 181711 - RNA, 64 nt, Human
guuaguguuugccaagaaccauugcaaauaaauugaacaucaaagauccaaguuuguacuaucc

SEQ ID NO: 181712 - RNA, 64 nt, Human
accuuaaaaaaaucagugaggauauuuauuuaaugaacaucaauuccuuuuaaauuuucuuaga

SEQ ID NO: 181713 - RNA, 64 nt, Human
uuuccccuuucuucuagaacucuuagcuguggaagaacaucaugccuauuuauaaccacugaau

SEQ ID NO: 181714 - RNA, 64 nt, Human
acaaaaugaaacaaagcauauugugagcaauacugaacaucaauaauacccuuaguuuauauac

SEQ ID NO: 181715 - RNA, 64 nt, Human
gaaggggccucacugaccaauugugggacaauuugaacaucaggaugaauaaugacaggagaga

SEQ ID NO: 181716 - RNA, 64 nt, Human
gcuguuugccuuucgugaacacauucuugguaaagaacaucaaaaguuuuaaaaaagaaaauga

SEQ ID NO: 181717 - RNA, 64 nt, Human
uuuaaggaauuaaaaauacacaugcaugaaccuugaacaucaaauaucggguacuacucugaaa

SEQ ID NO: 181718 - RNA, 64 nt, Human
aacuuugcugagaauauggaggguauagaugagugaacaucaacaaacauaacuucuaccaugg

SEQ ID NO: 181719 - RNA, 64 nt, Human
uauguuugaacauaauggcucagaauacauauuugaacaucauaguuguauauauuuuuaaagu

SEQ ID NO: 181720 - RNA, 64 nt, Human
gugcagacaaauuugaaaacugaaccaaccacaggaacaucaaguacacugugggccugggucc

SEQ ID NO: 181721 - RNA, 64 nt, Human
cccacuggugacaccgggaucgggcugagcaggagaacaucaccggcuccaguuccccugaucc

SEQ ID NO: 181722 - RNA, 64 nt, Human
acaaacuggcuugaugagguguucucuccuuguagaacaucagagaaggcacauugacuagcaa

SEQ ID NO: 181723 - RNA, 64 nt, Human
agcauguuuuaucauuaccauuaagaaguuaaaugaacaucagaauuuaaaaucauaaauauaa

SEQ ID NO: 181724 - RNA, 64 nt, Human
accccuccuugucggguagccggaauggggaggagaacaucaucgauaacccuuaucugcggcc

SEQ ID NO: 181725 - RNA, 64 nt, Human
auguuaagauacuacuacauuugaagugggcagagaacaucagaugauugaaauguucgcccag

SEQ ID NO: 181726 - RNA, 64 nt, Human
agacaauugcauuuaacauuguuauaaauaaaaggaacaucagaucaaucauuaagggcuccag

SEQ ID NO: 181727 - RNA, 64 nt, Human
aagaugggaaaacacacaugguuuggagcaauaggaacaucaucauaauuuuugugguucuauu

SEQ ID NO: 181728 - RNA, 59 nt, Human
gacugcauccuggcauaugacaauucuaggaacaucauaaauuuaggggagauauuuac

SEQ ID NO: 181729 - RNA, 64 nt, Human
ugcaucucuauauauauuuucccucucaaaaccagaacaucaacagugcuguuucugacacuuc

SEQ ID NO: 181730 - RNA, 64 nt, Human
cuuauuucccuaccuuauuaagacuaaauaaguggaacaucauagagcucuuuauuuauaacag

SEQ ID NO: 181731 - RNA, 64 nt, Human
gcugggauuacaagcauaagcaccacaccuggcugaacaucagauauuuuaaaguguagcccag

SEQ ID NO: 181732 - RNA, 64 nt, Human
cuaauauguauaaauguuaaaugauauuaaauaugaacaucagaauuacuuugaaggcuacuau

SEQ ID NO: 181733 - RNA, 64 nt, Human
aaggaacucuagaagaccaaaugccccgaguuaagaacaucaaaacuaaccaucugaagaaacu

SEQ ID NO: 181734 - RNA, 64 nt, Human
uauuaaauauuucacagcuaaaaagcuaaagagggaacaucacucuuuugccuuuccuuauuuu

SEQ ID NO: 181735 - RNA, 64 nt, Human
ucugggacacuugccuugacuugcaacuugccuugaacaucacgaucaaagcagcaggugcugu

SEQ ID NO: 181736 - RNA, 64 nt, Human
cguguccccgucccuaggccuaccuccacuccaugaacaucauccaccgagaccucaacuccca

SEQ ID NO: 181737 - RNA, 64 nt, Human
uggcagugacuucugccauacuucauaccuacuugaacaucagaggguccaucaugaagagaaa

SEQ ID NO: 181738 - RNA, 64 nt, Human
cuaugagacagauaugaaagaacaauuuaaauuugaacaucaacaaaagauugguccuugguga

SEQ ID NO: 181739 - RNA, 64 nt, Human
aaugaaugucuauuuaagaugaaggagggacgaagaacaucaaguuuaaaagccaguuaugaag

SEQ ID NO: 181740 - RNA, 64 nt, Human
gucauauuugagauucuaugaaauguuuaaaucugaacaucacuccaauuauuaaugaaccaaa

SEQ ID NO: 181741 - RNA, 64 nt, Human
auucagacagcaucuucucuauuggccucucagggaacaucaguauagaucuuuccgguauccc

SEQ ID NO: 181742 - RNA, 64 nt, Human
auccuuauguuggauaaacuaccuucccaaaagagaacaucagagguuuucauugcugaaaaga

SEQ ID NO: 181743 - RNA, 64 nt, Human
uuaagugaugagaccauauuucuuugauguuucugaacaucaaagcugauucaguacugguaga

SEQ ID NO: 181744 - RNA, 64 nt, Human
ccacaggcgucacucaaggagucugcauagccaggaacaucaaguuuugguguuacuuucuugu

SEQ ID NO: 181745 - RNA, 64 nt, Human
uuuggcagcuauggaagaaccaaaauaacgugaagaacaucacagagagacagugcaguguagc

SEQ ID NO: 181746 - RNA, 64 nt, Human
cucauguucuuucuacacugacacuauucauuaagaacaucaagcuucaucucugcuuacagaa

SEQ ID NO: 181747 - RNA, 64 nt, Human
gcugggggcacggaauaagcacauaguaaaaagggaacaucagggucaaauggaaaucaccuga

SEQ ID NO: 181748 - RNA, 64 nt, Human
gagaacacggcugaaaauuauugugcuguucuaggaacaucauccuagagagugugauguucac

SEQ ID NO: 181749 - RNA, 64 nt, Human
uaaaugauugcuuuuuuauauugcaucaaacuuggaacaucaaggcauccaaaacacuaagaau

SEQ ID NO: 181750 - RNA, 64 nt, Human
uuuuuuccuuuggccuggguuuuauaaacaacuugaacaucauaucauauaggauaacaaagga

SEQ ID NO: 181751 - RNA, 64 nt, Human
gucccaguguaguuauaucaguguuuacugaagggaacaucaaaauauuaaugguauauuauaa

SEQ ID NO: 181752 - RNA, 64 nt, Human
aaacugaguuuacuaggauaucugagcuaauguagaacaucaaacagaaggacccauggcagua

SEQ ID NO: 181753 - RNA, 64 nt, Human
augucaguuaaagauuuuuuuacccucuuuuugggaacaucaauuuuguacuguuaugcaguaa

SEQ ID NO: 181754 - RNA, 64 nt, Human
agcugaagucucuuuuucuuccucucggcuggaagaacaucaagauaccuuugcguggaucaag

SEQ ID NO: 181755 - RNA, 64 nt, Human
uaccuuuccuuuccacuuuuacccuguguucuuugaacaucauuugugcagauucugcccucaa

SEQ ID NO: 181756 - RNA, 64 nt, Human
uuuuaccuucuuuaaggguguacauuuugauguugaacaucaguuuucauguagacuuaggacu

SEQ ID NO: 181757 - RNA, 64 nt, Human
aaagucguaaguuuggaugaaagugcaagauguggaacaucaacuaccuauuuuccuuggguuu

SEQ ID NO: 181758 - RNA, 64 nt, Human
uaaaacuugagaagcuuuuggggucagaucucuggaacaucaugugaugaagcugacauuuuua

SEQ ID NO: 181759 - RNA, 64 nt, Human
gguucuggaaucaauguuuuccagucccaucccagaacaucaguuguaagauaaguacaauugg

SEQ ID NO: 181760 - RNA, 64 nt, Human
auggaguauauguaauaagaaguagcuucucagugaacaucagauaguagagaaaguauuuuua

SEQ ID NO: 181761 - RNA, 64 nt, Human
ugcacaguaagcauuuauuuuucagaccauuuuugaacaucacuccuaaauuaauaaaguauuc

SEQ ID NO: 181762 - RNA, 64 nt, Human
gggcaaaccucuuguugaucauagucuucaaguugaacaucaaauuugaacgucaaagaagacu

SEQ ID NO: 181763 - RNA, 64 nt, Human
uuuucaccucuuccugcuuccacccccaaacugagaacaucacucaauuguuuggaagaaacug

SEQ ID NO: 181764 - RNA, 64 nt, Human
ucaaaacauccaacuguuuguuauaaaguggcuagaacaucaauuaccucccauguguggacau

SEQ ID NO: 181765 - RNA, 64 nt, Human
gaacuuugcauugaauaaauuuuugccauggaaagaacaucaaacaagccacucaucucuacag

SEQ ID NO: 181766 - RNA, 64 nt, Human
acuggaaggacuucuugcuggugaagagcaggaggaacaucaccauggugucauauccugacgc

SEQ ID NO: 181767 - RNA, 64 nt, Human
uugaggaauucauugagucuugucaaaaggaugagaacaucaugagguccaugcagcucuuuga

SEQ ID NO: 181768 - RNA, 64 nt, Human
guccucuaagaguugauugcuguauauuaaaauugaacaucagaggaugggaagagggcucugu

SEQ ID NO: 181769 - RNA, 64 nt, Human
uuagaucagguugucugcauuuguugguguaagugaacaucaucacaguuauccugaguugagu

SEQ ID NO: 181770 - RNA, 64 nt, Human
cacaacauccugacuccgucauuuaauaaagaaggaacaucaggcaugcuaccaggccugugca

SEQ ID NO: 181771 - RNA, 64 nt, Human
cccacaaucuugaaaaacuuccuuucucuucugugaacaucauuggccagauccauuuucagug

SEQ ID NO: 181772 - RNA, 64 nt, Human
cucgugcuuaagauugaugauuucgugaaauaaagaacaucauuucauuuaagagaucauuuca

SEQ ID NO: 181773 - RNA, 64 nt, Human
uaaacuuuuuuuuuuuuuuaucauuuuacuacaugaacaucauggauaacaagggauucugauu

SEQ ID NO: 181774 - RNA, 64 nt, Human
ccugguagguguaacagauaguucaccugugaacgaacaucagcuuacagaugaugaggacuua

SEQ ID NO: 181775 - RNA, 64 nt, Human
guagugugaugucccauguaauaaaacaggcuuagaacaucaauuccucugcugccauuuaugu

SEQ ID NO: 181776 - RNA, 64 nt, Human
cacccccaccauuuccucucccugggaucuggaggaacaucauacauaguaggugaaucguuuu

SEQ ID NO: 181777 - RNA, 64 nt, Human
uuuuagaaauacacucugugcucacugugcagaggaacaucaguuuucaaaccaacacugaaau

SEQ ID NO: 181778 - RNA, 64 nt, Human
aaauagccuucucagauucagaaaacaauacagagaacaucagaaauuuucuaaaaugggucac

SEQ ID NO: 181779 - RNA, 64 nt, Human
acuaaucaaagcauuaaguguguccaguaaugaagaacaucauauaaaaucuuucccuaaaucu

SEQ ID NO: 181780 - RNA, 64 nt, Human
aguaaggggugggaaguggguggcagggagaaaagaacaucaggguggguggggacaggccagu

SEQ ID NO: 181781 - RNA, 64 nt, Human
agaaaaguuauugcuggugcaaagauagauggcugaacaucaggguguggcauuuuguucccuu

SEQ ID NO: 181782 - RNA, 64 nt, Human
cagucuuucucagauuuuuaguaaaugcaaguaagaacaucaucaaaguucacuuuguauugua

SEQ ID NO: 181783 - RNA, 64 nt, Human
caucacgaaccaguuuuguuuuucuuuuaaauuugaacaucacaucuuguguuuuaguuuuuug

SEQ ID NO: 181784 - RNA, 64 nt, Human
ccccaagcccuagagcucccuccacucuucccgcgaacaucacaccguuccccgaccaagccgu

SEQ ID NO: 181785 - RNA, 64 nt, Human
cuucaugcuuuccagaguuagagccuugaucacggaacaucauugugugcagaagaauacugua

SEQ ID NO: 181786 - RNA, 64 nt, Human
ugaaaaaaaaagcuuguggccaauggaacaguaagaacaucauaaaauuuuuauauauauaguu

SEQ ID NO: 181787 - RNA, 64 nt, Human
gcaaugugagagguaaaauagcccuugacaugaugaacaucacuuauuucagcacuuggauugu

SEQ ID NO: 181788 - RNA, 64 nt, Human
uuuuccauagugccaaagccauacauauucaguagaacaucaauaaauuacaucagaaauucaa

SEQ ID NO: 181789 - RNA, 64 nt, Human
aaucauguuuuaauguagaaccucaaacaggauggaacaucaguggauggcaggagguugggaa

SEQ ID NO: 181790 - RNA, 62 nt, Human
uggccuccuuggggaagugacgaccgcugggagaacaucaggugcacuguggacgugggucu

SEQ ID NO: 181791 - RNA, 64 nt, Human
cucagcgaggcagaggguggggcugcacagaggggaacaucagcugcagcucugcaccaggccg

SEQ ID NO: 181792 - RNA, 64 nt, Human
ucuuaaguuacucugaguuuacacaugaaaaggugaacaucaucaaaaacccuggacacaguuc

SEQ ID NO: 181793 - RNA, 64 nt, Human
gauaccauccuuuuucugaacucuucuucaaaaggaacaucagcccuccugauugcaaaggaau

SEQ ID NO: 181794 - RNA, 64 nt, Human
auugaacaauaaaaacacuuggacacaggguggggaacaucacacaccgggccugucauggggu

SEQ ID NO: 181795 - RNA, 56 nt, Human
cugugcccagcaacaacugaaggaaagaacaucagcugaccaaaugucaucgcugc

SEQ ID NO: 181796 - RNA, 64 nt, Human
uuuuauuugcuuuuauuguugauuuuuuaacuuugaacaucaauacauuuuacuugaauacaua

SEQ ID NO: 181797 - RNA, 64 nt, Human
cccccuaaaaaaguaccaaacauuugcauucucagaacaucaaacaaaaaugcccugguggcaa

SEQ ID NO: 181798 - RNA, 64 nt, Human
uccccucugagaucugaaaaaugaaguggcuuaggaacaucagcagugaagaacugccaagagu

SEQ ID NO: 181799 - RNA, 64 nt, Human
aauuacaaugcauuuauggugucugggggcaggggaacaucagaaagguuaaauugggcaaaaa

SEQ ID NO: 181800 - RNA, 64 nt, Human
aaauaauguaaugugaaguguuucuuaaagcucugaacaucauuaaguaguuaauaauaauucc

SEQ ID NO: 181801 - RNA, 64 nt, Human
aaaagagucaucgcaggaagaaguuaagaacacugaacaucagaacagucugccaagaaggaca

SEQ ID NO: 181802 - RNA, 64 nt, Human
auacuaaauauuaguuuuaauuaugcaucucuuugaacaucauaaacacacuuugguguuggua

SEQ ID NO: 181803 - RNA, 64 nt, Human
acuuaauauuuuuaauguuuuuuaaagcauuaaugaacaucaucauuaauuucaccuauuauau

SEQ ID NO: 181804 - RNA, 64 nt, Human
uucacggaauacaguuucuagaccgauucugugugaacaucaguuuuguccucuuauugcaaga

SEQ ID NO: 181805 - RNA, 64 nt, Human
cggacaccaccauggucagcgaccuggucucccagaacaucaaugucuuccugcggaacacagu

SEQ ID NO: 181806 - RNA, 64 nt, Human
accuacuugaacagggcauauuuuuuagacuucugaacaucaguauguucgaggguacuaugau

SEQ ID NO: 181807 - RNA, 64 nt, Human
caaaaauuaacauuuucaucucaguaaguuuuuagaacaucaaaauguuuucugagcuccaagu

SEQ ID NO: 181808 - RNA, 64 nt, Human
uaauuaucuauuucaaauuuagcaggaaaaaagagaacaucaccuuguaaaacugaagauugug

SEQ ID NO: 181809 - RNA, 64 nt, Human
uaaauuuuuagaucucuggaacacauucuuaauggaacaucacaaaagaucaauuccaagggac

SEQ ID NO: 181810 - RNA, 64 nt, Human
ugaacuccuggcuuuccaggagacauauauaggggaacaucacccuauauauaauuugagugua

SEQ ID NO: 181811 - RNA, 64 nt, Human
auugaacaaugagaacacauggagacaggaaggggaacaucacacucuagggacuguugugggg

SEQ ID NO: 181812 - RNA, 64 nt, Human
gcauuuguacacauggcccuguauuguccuugaagaacaucaauaaaauauaugguuuuaaauu

SEQ ID NO: 181813 - RNA, 64 nt, Human
auucuaucacuauagguuaguuuucuuuguuccagaacaucaugaaagcggcgucauguacugu

SEQ ID NO: 181814 - RNA, 64 nt, Human
ccaucagaagugaagauaggaagcucaucagauagaacaucagcccaugagauguuugcaacaa

SEQ ID NO: 181815 - RNA, 64 nt, Human
uaccccagccgguuuggauuacaggccugugcuggaacaucaucucaguuggccaccuuccugg

SEQ ID NO: 181816 - RNA, 64 nt, Human
uggcuuguuccacuggccaaagaugggacaauuugaacaucaaaagagauacuuacugacucca

SEQ ID NO: 181817 - RNA, 64 nt, Human
cugccaugcagggccucacacgguuugaagccuggaacaucaucaaggcacugccugauggacc

SEQ ID NO: 181818 - RNA, 64 nt, Human
cugagaaaugcauuguaaggugacuuuauugugugaacaucauggagugcacuuauacaaaccu

SEQ ID NO: 181819 - RNA, 64 nt, Human
aucugacccuaugggucuaggacacaguuccugggaacaucacauuccucugcccuuccugcag

SEQ ID NO: 181820 - RNA, 64 nt, Human
gcuuugugaggaacugaguguguccacguugggggaacaucauacuugauacacacguuuuuau

SEQ ID NO: 181821 - RNA, 64 nt, Human
cuucugcggccagagccgaggcgggcgggggugagaacaucaaucgucagcgacagccugggca

SEQ ID NO: 181822 - RNA, 64 nt, Human
ggcuguaaaaauuuuguuugaaagucaaacauuugaacaucaaauauguauugauuagauccag

SEQ ID NO: 181823 - RNA, 64 nt, Human
agcuuuuaaacaaaguaauaauaauugguguugagaacaucaguugccuuauucuaagauuuca

SEQ ID NO: 181824 - RNA, 64 nt, Human
cacucauugucuuugaggaagaagauguccgugagaacaucauuacuuaugaugaugaaggggg

SEQ ID NO: 181825 - RNA, 64 nt, Human
uccaggacauccagcgcggggugacaagugccgugaacaucaugcacagcagccuccagcaagg

SEQ ID NO: 181826 - RNA, 64 nt, Human
cuucuuaagacuuuugggacaugguuugacucccgaacaucaccgacgcgucuccuguuuuucu

SEQ ID NO: 181827 - RNA, 64 nt, Human
gacccguauguggcaaauucuaagcugccauauugaacaucaucccacugggagugguuauguu

SEQ ID NO: 181828 - RNA, 64 nt, Human
caccaaguugagagcuggaggggagguggggagagaacaucacagagcagccagcccugguuca

SEQ ID NO: 181829 - RNA, 64 nt, Human
caguaaccagguaauauuggcaaaggcaucucaggaacaucaccuuagugaggaaacaaaaugu

SEQ ID NO: 181830 - RNA, 64 nt, Human
uugugaauuuucugagacggauguaacaaauacugaacaucaucaacccaguaauaaugauuug

SEQ ID NO: 181831 - RNA, 64 nt, Human
ccauggacccaacugggccccagaagagccacaggaacaucauuccucucccgcaaccacuccc

SEQ ID NO: 181832 - RNA, 64 nt, Human
cuaucagcuuggguaaggacagugggauuuaugugaacaucaggcaaagccaugagaucaaacc

SEQ ID NO: 181833 - RNA, 64 nt, Human
aagaaauguaucugcuagacucuacauagaaacugaacaucaagaaccccaccaaaauauuacu

SEQ ID NO: 181834 - RNA, 64 nt, Human
uuucuacuaccauaaaaacuaucucaaaucaccugaacaucaagugauauuaagguugucaucu

SEQ ID NO: 181835 - RNA, 64 nt, Human
ccuuuauguguugaaaguuaaugguuucagaugugaacaucacguguuauaacuguagcgcugu

SEQ ID NO: 181836 - RNA, 64 nt, Human
ggcagagagggccacggggcagggcccacugagggaacaucaguggcccuccagucagguucug

SEQ ID NO: 181837 - RNA, 64 nt, Human
agcuuuuuuagugaagaguauuuauuuugaaguugaacaucacaaauauaaaaaggguuguagu

SEQ ID NO: 181838 - RNA, 64 nt, Human
agaaaaacccucaggcaguuguuaaaauuuuguugaacaucagggaguuuaagaaaacccugca

SEQ ID NO: 181839 - RNA, 64 nt, Human
gaauuacaaaacucagagaaaugugucaucaggagaacaucauaacccaugaaggauaaaagcc

SEQ ID NO: 181840 - RNA, 64 nt, Human
agcugggaucuucaacuggggacaguacaguaaagaacaucacagcaucucacagguucugcau

SEQ ID NO: 181841 - RNA, 52 nt, Human
cuaucuccagugucagcuaauggaacaucaggggaacgaugacuccuggauu

SEQ ID NO: 181842 - RNA, 64 nt, Human
uggcaaggucuucaguccgaggucacuccuugcagaacaucagaaaauucauuuuugagauaac

SEQ ID NO: 181843 - RNA, 64 nt, Human
ugauuuaauccuuccacauuguauacauguaucagaacaucacauuguacuccaucaauauaau

SEQ ID NO: 181844 - RNA, 64 nt, Human
augucaaauaugcauuuaauacaccuacccugcugaacaucauagccgaucuugccuucagaau

SEQ ID NO: 181845 - RNA, 64 nt, Human
ucugaggauggccuuuaugagggagcuggcaauugaacaucauucaucuaaauaugcacacugg

SEQ ID NO: 181846 - RNA, 64 nt, Human
gugacguguauuaagccagcgguugugacucauugaacaucagaggacauauccuggagaaaag

SEQ ID NO: 181847 - RNA, 64 nt, Human
caccucugggaaagagaaaagguuuggguccacugaacaucauguuuguagacgcugacaggug

SEQ ID NO: 181848 - RNA, 64 nt, Human
acuugagaauuaauucuggagagaaugccccauugaacaucaucaauauuggagagcuuucugu

SEQ ID NO: 181849 - RNA, 64 nt, Human
uuaaugucagaaaacaccugucacuuccaucauagaacaucagaaaacucacacccaaagaaaa

SEQ ID NO: 181850 - RNA, 64 nt, Human
uagaagaaagccuucaaauguauaugauguuacagaacaucagaaaauucauuuuugagaaaau

SEQ ID NO: 181851 - RNA, 64 nt, Human
cagaagacauugcauaccagcucucaugcucucggaacaucaccugccugccggcagggcaguc

SEQ ID NO: 181852 - RNA, 64 nt, Human
gcaugcuuaagcuuuuacccaggcaucaaaaccggaacaucacaggguuuauacuggagaguaa

SEQ ID NO: 181853 - RNA, 64 nt, Human
uggcaaggucuucaguccaagaucacuccaugcagaacaucagaaaauucauuuuugagauaac

SEQ ID NO: 181854 - RNA, 64 nt, Human
uggcaaggucuugaguccgaggucacuccuugcagaacaucagaaaauucauuuuugagauaac

SEQ ID NO: 181855 - RNA, 64 nt, Human
aacaguuuggaugcccuaaacuucuguagcucaggaacaucacugguguauuuguuuuuuuguu

SEQ ID NO: 181856 - RNA, 64 nt, Human
uccgaagcacaaggaccucaagucaccagcauaagaacaucaacaggaaugccgcccucucuac

SEQ ID NO: 181857 - RNA, 64 nt, Human
cucgaguagaggucugccuagugagugagcaggagaacaucaucuuaauagccuuuggcucacc

SEQ ID NO: 181858 - RNA, 64 nt, Human
guccgucaccuccccauccccuaguccccaccuugaacaucaugagcuguuguuauuagucuug

SEQ ID NO: 181859 - RNA, 64 nt, Human
ccaggacccaaccccuagaucccaccaacucggggaacaucaccccagagcccagccuuaucca

SEQ ID NO: 181860 - RNA, 64 nt, Human
uccgaagcacaaggacaucaaaucaucagcacaagaacaucaacaggaaugccacccuccccag

SEQ ID NO: 181861 - RNA, 64 nt, Human
aaggugaaaucaugcuuaaaauauuauuaccagugaacaucaggcacucugaguuuuagacaau

SEQ ID NO: 181862 - RNA, 64 nt, Human
cccuucucuguauuccuagaaacugacacaugcugaacaucacagcuuauuuccucauuuuuau

SEQ ID NO: 181863 - RNA, 64 nt, Human
gguagccccgacccucucaggcauuccagccacagaacaucaaagugagcgaguacugcgcugg

SEQ ID NO: 181864 - RNA, 64 nt, Human
ucauucauggagccaagggugggguuucaccugcgaacaucagacugacuugcuggcgucaaga

SEQ ID NO: 181865 - RNA, 64 nt, Human
uuguauuuaccuaaauuuggaacacaguaugcaggaacaucaggcaucauuuugaagaacuuug

SEQ ID NO: 181866 - RNA, 64 nt, Human
aggcuucaaguccagagcugccugucuccgucgagaacaucaagcaggaaacagacgacugagc

SEQ ID NO: 181867 - RNA, 64 nt, Human
aguauucuggaguaccuuuugaguauugguuccugaacaucagcagucuuggcugccucugugg

SEQ ID NO: 181868 - RNA, 64 nt, Human
agaugcagaagcuccauugaccaugaggccuugugaacaucaguggccacaggcccagugugcu

SEQ ID NO: 181869 - RNA, 64 nt, Human
acuccaagagauucugccucccuuguguccgggagaacaucaaugcuuuuccucaggaaauucg

SEQ ID NO: 181870 - RNA, 64 nt, Human
cuugaagcaggguacacacguuagguauugugaagaacaucaauccgaacuuuucuucuguugu

SEQ ID NO: 181871 - RNA, 64 nt, Human
auauguaaaauauauacuuuuccaagacaaaauggaacaucacuucucucuucuaguuuuucug

SEQ ID NO: 181872 - RNA, 64 nt, Human
ggaagcauaccuuuaucaagaugcuauuaaaauugaacaucaaguauaauauuucauuuggauu

SEQ ID NO: 181873 - RNA, 64 nt, Human
gcuauuagggaagagaagaauguugcuuaagaaagaacaucaccauugauuuuaaauacaagua

SEQ ID NO: 181874 - RNA, 64 nt, Human
aucacuaugucacuugucacuccuuuuuauugcugaacaucauuguucaguaucaugucaagag

SEQ ID NO: 181875 - RNA, 64 nt, Human
aguggaaaucaaucagaagguauucugaccuugugaacaucagaagguauuuuuuaacucccaa

SEQ ID NO: 181876 - RNA, 64 nt, Human
gaggggaucacuucagcugccugcuguggacaaagaacaucaaauuacagcaucacgagugcua

SEQ ID NO: 181877 - RNA, 64 nt, Human
uuuagauauguuccggucccacaugcaaggaagugaacaucaaauuaaguaaguauuuuugcca

SEQ ID NO: 181878 - RNA, 64 nt, Human
gagucuuaaauuauaugugggaggaggagggauagaacaucacaacacugcucuaguuucuugg

SEQ ID NO: 181879 - RNA, 64 nt, Human
aaucaccgaauucauacagaucguuuaaauaaaugaacaucauuaaagucaaauaugaguauga

SEQ ID NO: 181880 - RNA, 64 nt, Human
aaugaauuaucauucccaaacccguguccaccuggaacaucaggaugggaccauguuugaaaau

SEQ ID NO: 181881 - RNA, 64 nt, Human
caacuuuucggaagcagcauucacuguggauuuggaacaucacggacguucuucaucuugaguc

SEQ ID NO: 181882 - RNA, 64 nt, Human
uucccacccuccaguguuggcacaggcccaccccuggcuccaccagagccagaagcagagguag

SEQ ID NO: 181883 - RNA, 64 nt, Human
gacaucuccuggcuaagccucugcuuccguacuauggcuccaacagaaauaaaauacacaacac

SEQ ID NO: 181884 - RNA, 64 nt, Human
agcuagaugucucgcuccaccugggucugggaccuggcuccacaccaguuaccugggaccagua

SEQ ID NO: 181885 - RNA, 64 nt, Human
gcugugucucuuuucuucucugaagacagcguccuggcuccaguuggaacacuuuccugagaug

SEQ ID NO: 181886 - RNA, 64 nt, Human
guacaagauccacugaggguggccaccacagccuuggcuccaugguggcggguagacaagggau

SEQ ID NO: 181887 - RNA, 64 nt, Human
ucacucagguagaguugagauucaaacccacauguggcuccaaagucugcaucuggauuugggg

SEQ ID NO: 181888 - RNA, 64 nt, Human
ucucucccucccugcuuccccuucagugcuuacuuggcuccagcccuccagcugcagccccugg

SEQ ID NO: 181889 - RNA, 64 nt, Human
caagguucuguucagaucccuaugggggcccagcuggcuccacgguuccagaauguucaggugg

SEQ ID NO: 181890 - RNA, 64 nt, Human
ccaaggcgaagaccuugccagaguucaucaaggauggcuccaguacguacagcaagauuccugc

SEQ ID NO: 181891 - RNA, 64 nt, Human
guucauaaguagcaauuuuguuuuaguaacagacuggcuccaacacugcaacauggggacauuu

SEQ ID NO: 181892 - RNA, 56 nt, Human
cugaaaagcagucauccugauggcucuggcuccagaggaccugagacucacacucu

SEQ ID NO: 181893 - RNA, 64 nt, Human
gaauuuacccaggagaguccuauauuuccauugguggcuccacagugguggcugucagacccga

SEQ ID NO: 181894 - RNA, 64 nt, Human
guggcccggggggaggaugccagcagccugccuauggcuccagcugugcuguggcccagcagca

SEQ ID NO: 181895 - RNA, 64 nt, Human
gaaggaaggaaaggagggagaaaggagggaauacuggcuccaucuuugagagcucuggugggca

SEQ ID NO: 181896 - RNA, 64 nt, Human
cugcuucuggaagugcuggaagcaucaccccaauuggcuccaaauacugucauguuuucuugca

SEQ ID NO: 181897 - RNA, 64 nt, Human
uugccugagggaauuccaacaugagauuaugggcuggcuccauuucuuggacuuaaaaugcauu

SEQ ID NO: 181898 - RNA, 64 nt, Human
ucagaucgucucauacaagggaagagagagccacuggcuccacuuauuucggguccgcuaggug

SEQ ID NO: 181899 - RNA, 64 nt, Human
cacacauauuaaugacagccuguuguauuaaugauggcuccaggucagugucuggaguuucauu

SEQ ID NO: 181900 - RNA, 64 nt, Human
aauuggucagacaugcugucugcccucaugaaauuggcuccaaaugaaugaacuacuuucauga

SEQ ID NO: 181901 - RNA, 64 nt, Human
agcuuuugagugcauugagaaccaagacagggccuggcuccaacucugugggccagaggugggg

SEQ ID NO: 181902 - RNA, 64 nt, Human
gcaacagaggagccacaaaauguucuuuguucuuuggcuccaaaaagacugucagcuuucaguc

SEQ ID NO: 181903 - RNA, 64 nt, Human
gaagaaaaacaagggaggagggcauuccaccuccuggcuccaagcuaagucacucaacagaaug

SEQ ID NO: 181904 - RNA, 64 nt, Human
agcagugugaucuauagcaggauggcccagucccuggcuccacugaucaccucucuccugugac

SEQ ID NO: 181905 - RNA, 64 nt, Human
guucaguaaucauuucugauauuugcuggagugcuggcuccacgcccuggggagugagcuuggu

SEQ ID NO: 181906 - RNA, 64 nt, Human
aaagaucauguguucccaaaguauucccuauuguuggcuccacagccuuaaagugcuauagauu

SEQ ID NO: 181907 - RNA, 64 nt, Human
gcggcagccccgacucucagcacugugccucagauggcuccacggagacccuggccaugguugu

SEQ ID NO: 181908 - RNA, 64 nt, Human
ugcugguucagccuucguguggcuccugguaacguggcuccaccuugaugggucaaccuuugug

SEQ ID NO: 181909 - RNA, 64 nt, Human
caucuucugaagaggaaaagucaaaguguugcuguggcuccauauuucaacuaaaaauauaucu

SEQ ID NO: 181910 - RNA, 64 nt, Human
uugggugaagccuagacaaagccgccaggucuuguggcuccaggcaccagagccuugaguacuu

SEQ ID NO: 181911 - RNA, 64 nt, Human
agggagguauaguugggggacaggggucuggguuuggcuccaggugggaacaaggccugguaaa

SEQ ID NO: 181912 - RNA, 64 nt, Human
ccucaggggaagcugcuaggggaaggacuggccguggcuccagaaugugcugccuuuuuaaguu

SEQ ID NO: 181913 - RNA, 64 nt, Human
aaagucugcugagcaggcagcagccucugcucuguggcuccauucaggcuuuuucaucuacgaa

SEQ ID NO: 181914 - RNA, 59 nt, Human
uccgcagcaccccgauguaaccuucucuguggcuccaaccccaagacucccaggcacau

SEQ ID NO: 181915 - RNA, 64 nt, Human
uagagucguuugugguauuuuauguuguugacucuggcuccagggccugugcuugaaaaggaca

SEQ ID NO: 181916 - RNA, 64 nt, Human
gaugguggaaccacaguaccucuuacacucccuguggcuccaacuucaggaaauaaauuuccca

SEQ ID NO: 181917 - RNA, 64 nt, Human
ugguucauguaacuagaaaguccauagguagugcuggcuccaggugaagacuugacccaguagu

SEQ ID NO: 181918 - RNA, 64 nt, Human
ccugccucucugaagggccauggcuaugcuucccuggcuccaagggcccauuuccuccuagaug

SEQ ID NO: 181919 - RNA, 64 nt, Human
ugcucuucucauaguguacacccaccugccucucuggcuccagaagcugccagagugcacuggg

SEQ ID NO: 181920 - RNA, 64 nt, Human
caggaucccuauuccuaccccaucuauucucuguuggcuccaagagcuaccccagagaccuuaa

SEQ ID NO: 181921 - RNA, 64 nt, Human
ugagugggaaggucuucuggcuccccaucccaccuggcuccagagccugcccuccacagcuugc

SEQ ID NO: 181922 - RNA, 64 nt, Human
auuaucaaaacacaugugcacacagauuauuuuuuggcuccaaaacuggauugcaaaagaaaga

SEQ ID NO: 181923 - RNA, 64 nt, Human
ggcggccucaggaguggaugcgaucugucucuccuggcuccacucuugccgccuuccagcucug

SEQ ID NO: 181924 - RNA, 64 nt, Human
acagcacgggggccaaggaugccccgucccccucuggcuccagcuggccgggagccugaucacc

SEQ ID NO: 181925 - RNA, 64 nt, Human
gagaagggaagaggggaucuuuggacuacguucuuggcuccagaccuggaauccacaaaagcca

SEQ ID NO: 181926 - RNA, 53 nt, Human
ggaccaggaccaagaagugaccguggcuccagccaccccgggacauugcuaag

SEQ ID NO: 181927 - RNA, 64 nt, Human
aucagucuggguauugauuuccuuuuccagugacuggcuccaggccaugucuaaugaccagcuc

SEQ ID NO: 181928 - RNA, 64 nt, Human
cccugacccuagccagggacucccaugcugcuguuggcuccaucucuccacacugccucuuucu

SEQ ID NO: 181929 - RNA, 64 nt, Human
aagugcugggauuacaagugugagccaccacaccuggcuccagaaauuuuauuuuauuuuuuug

SEQ ID NO: 181930 - RNA, 64 nt, Human
agccuggccuccccugcggagcugcauggacgccuggcuccaggcuccaggcugacugggggcc

SEQ ID NO: 181931 - RNA, 64 nt, Human
gagacgcuaaccgcccuucugcguuccauaaagguggcuccagaaagggcauccucuaccccaa

SEQ ID NO: 181932 - RNA, 64 nt, Human
aauguccucuggcagaggacccagaaaaccacacuggcuccaacuuccuccucauggggcauua

SEQ ID NO: 181933 - RNA, 64 nt, Human
ggaauuucuuuuucugggguuuccuucaaacucuuggcuccaccuagcgguucuauuuguucau

SEQ ID NO: 181934 - RNA, 64 nt, Human
uuaauagacaaucugaauuccacuacauuucuuuuggcuccaacauuccuuuuagcuugaccag

SEQ ID NO: 181935 - RNA, 64 nt, Human
augaauuaaggcauuccucuuucccuaaccccgauggcuccauucccaaguaccccaacucacu

SEQ ID NO: 181936 - RNA, 64 nt, Human
ucagaauuccuagcacccccgggaccccugccgguggcuccaucagccagcaaccuuagagaga

SEQ ID NO: 181937 - RNA, 64 nt, Human
aggguggauccucauggagcaggagaguagcucauggcuccaggagccugaggccaugcaguug

SEQ ID NO: 181938 - RNA, 64 nt, Human
uagaccucgccuagcacucugccuugccagagauuggcuccagaauuugugccagacuuacaga

SEQ ID NO: 181939 - RNA, 64 nt, Human
acaaaaguaagcugugacauugucuauaagcauuuggcuccacaaauguauuuggauuguuuuc

SEQ ID NO: 181940 - RNA, 64 nt, Human
agugggccccauuccuagggcugggcuccccuucuggcuccagcuucccuccagccacucccca

SEQ ID NO: 181941 - RNA, 64 nt, Human
gccugagagccaucugugaccugucacacucaccuggcuccagccuccccuacccagggucucu

SEQ ID NO: 181942 - RNA, 64 nt, Human
cuuggggcuuuuuccaucuucuccccacagccucuggcuccacaccuccaccguucaagcgcca

SEQ ID NO: 181943 - RNA, 64 nt, Human
ugcccgggcccaaggggugcacagggcaccuccauggcuccauuauuaacacaacucuagcaau

SEQ ID NO: 181944 - RNA, 64 nt, Human
uauuggguaauaaauauuuucaugaaagcgccuuuggcuccagauccuugggagagggacacgu

SEQ ID NO: 181945 - RNA, 64 nt, Human
acaugagcacuugacucgcuggguuaucaggcuuuggcuccaaauguuuggcuucaaauaugaa

SEQ ID NO: 181946 - RNA, 64 nt, Human
ggaaagugaccagugaccacuggcguuaggaagguggcuccaguaaaggguuuuggcugcauuu

SEQ ID NO: 181947 - RNA, 64 nt, Human
uggaugacccuccccuagucacucauccauccccuggcuccagagauggucacaugacccaggc

SEQ ID NO: 181948 - RNA, 64 nt, Human
gagagaggacucuggaccuaggaaaagaggcuuuuggcuccagguggucaggacaguggggguu

SEQ ID NO: 181949 - RNA, 64 nt, Human
cucccucuagguccugccacaaccugucccuggcuggcuccagcguccucgucccuccugggcc

SEQ ID NO: 181950 - RNA, 64 nt, Human
cugcauuucuaggauauuucuaggacaccuggauuggcuccaucacaucagaguggcugagggc

SEQ ID NO: 181951 - RNA, 64 nt, Human
uuggcuuaaccagauccuauauacagauuauuacuggcuccaaaggaugaguagauaagaccau

SEQ ID NO: 181952 - RNA, 64 nt, Human
ccugccugccccauggaguugcgcagcacaacccuggcuccaauugccagaaggcucuuuuuaa

SEQ ID NO: 181953 - RNA, 64 nt, Human
gaggcccuggauugagccaggcccccagaaccccuggcuccaggccagggggccagucccugag

SEQ ID NO: 181954 - RNA, 64 nt, Human
gaggccaagcugaggaggugcugcaggucccgucuggcuccagcccuugucagauucacccagg

SEQ ID NO: 181955 - RNA, 64 nt, Human
guuauucuagcccucauggcugaaggcccaguccuggcuccaccacuccuccagccagaggguc

SEQ ID NO: 181956 - RNA, 64 nt, Human
guuuauuccuacuggagcuuaguuccaaugcauuuggcuccagaaagaccccagugccuuuuga

SEQ ID NO: 181957 - RNA, 64 nt, Human
gguccugagauuguggcucccccucuggaggagguggcuccacgaugccuugauuuucacucau

SEQ ID NO: 181958 - RNA, 64 nt, Human
acauccugauuaucucugaaaguaaucaaucaaguggcuccaguagcucuggauuuucugccag

SEQ ID NO: 181959 - RNA, 64 nt, Human
ucacagaugccuagcuggacacagcucccagaacuggcuccacccuggggccuugccccuagua

SEQ ID NO: 181960 - RNA, 64 nt, Human
cacuggcagaaacucuccuuuauacaaacuucauuggcuccaacauuugaaucucauauuuuug

SEQ ID NO: 181961 - RNA, 64 nt, Human
ugcccacgggacccccaccaccagccucuugaaguggcuccacagcuccugucccuggaacauc

SEQ ID NO: 181962 - RNA, 64 nt, Human
cggggguugggacccagcgggagccggggcagccuggcuccacggccuguacucgguuuacacc

SEQ ID NO: 181963 - RNA, 64 nt, Human
auaacaauccagaggacgacuucaggaugcccaauggcuccaccauucccccagggagcccuga

SEQ ID NO: 181964 - RNA, 64 nt, Human
gggagagcaccuguccaggucugccuaaaggaaauggcuccagugggucuaaacaaccacaucc

SEQ ID NO: 181965 - RNA, 64 nt, Human
ggauccacacugugguguggcugccacggccuccuggcuccagaggcagcugggcugggccaag

SEQ ID NO: 181966 - RNA, 64 nt, Human
ugucuuguucugucccuuccacuucuaacuccacuggcuccaugauucucugaguggugguucc

SEQ ID NO: 181967 - RNA, 64 nt, Human
gcagcaauuggagcuucaggaccggcuugcacuguggcuccagguuauaccaccacugcccaaa

SEQ ID NO: 181968 - RNA, 64 nt, Human
gauuuuaauuuuaacauuuuauuucuagaauauauggcuccauuuuauuuuauaguguaaaguu

SEQ ID NO: 181969 - RNA, 64 nt, Human
cagcacuguugguguucggagcucuucugugcccuggcuccaugcuuucaccuacacaagcauc

SEQ ID NO: 181970 - RNA, 64 nt, Human
aaaaaaagugucuccaggaggcuguccagccucguggcuccauuucaacaucuccccccaggcg

SEQ ID NO: 181971 - RNA, 64 nt, Human
gagccaggucgcccugaagguuuuccaaagggcuuggcuccagagccaccuggcagacugcccg

SEQ ID NO: 181972 - RNA, 64 nt, Human
agaagaagaauuuuaaugaaaaaauuacccagauuggcuccauggaaaaggaggaacagcguuu

SEQ ID NO: 181973 - RNA, 64 nt, Human
accaacuucagaucuaugacauuauucugaucacuggcuccaucauacauauucaccacuugag

SEQ ID NO: 181974 - RNA, 64 nt, Human
guauuuacuacuuugagguuucccucacaacuucuggcuccauaccuagccccucuuuuauaau

SEQ ID NO: 181975 - RNA, 64 nt, Human
aaaaaggagagagaaauaacugaaauuguucagguggcuccaucgucuauucugugguccccuc

SEQ ID NO: 181976 - RNA, 64 nt, Human
guaugugggaggggaaggaaggacagaacuugacuggcuccauuucauggaccaacugaucaau

SEQ ID NO: 181977 - RNA, 64 nt, Human
aagaaacaaagaacaugaacaaaaagcauuaaacuggcuccaucagaagacguugaagggcagu

SEQ ID NO: 181978 - RNA, 64 nt, Human
ggauauaggagaaaauuucugccuggcacacaccuggcuccaaccacugccaagugaucacucu

SEQ ID NO: 181979 - RNA, 64 nt, Human
gagcugcgugccguuuguguccgagcaucacguguggcuccagcccuuguuucugccaguguag

SEQ ID NO: 181980 - RNA, 64 nt, Human
agauaacuguauuuauaaaccacucuucaacagcuggcuccagugcugguuuuagaacaagaau

SEQ ID NO: 181981 - RNA, 64 nt, Human
uugcuaccugaacgcaccacccucuggccuaggcuggcuccagugugccaugcccagccaaaac

SEQ ID NO: 181982 - RNA, 64 nt, Human
uuaauauugcaaaggcccauuggaguuucugaaguggcuccacagaauugaaauaauuucaaau

SEQ ID NO: 181983 - RNA, 64 nt, Human
gacacaaaauuguuugaaaaacauuuuccaggccuggcuccaaccuaaagccugacugucacgu

SEQ ID NO: 181984 - RNA, 64 nt, Human
cucuaguaguucuggcccaccucuuuccccacccuggcuccaugacccaccccacucuggaugc

SEQ ID NO: 181985 - RNA, 64 nt, Human
aauccaagagcagccaaauccugcuuuuccaguuuggcuccacaaguccuccaggacagagccc

SEQ ID NO: 181986 - RNA, 64 nt, Human
aaauaaauaaaaauccaaacccaagucaaaaccuuggcuccagcaugaaaacacguuuacagga

SEQ ID NO: 181987 - RNA, 64 nt, Human
gugaggggccucagugagaccagauugugucauuuggcuccaccuucaucuugcagagccagcu

SEQ ID NO: 181988 - RNA, 64 nt, Human
aaugaaccugauacacaauuaugaccagaaaauauggcuccaugaaggugcuacuuuuaaguaa

SEQ ID NO: 181989 - RNA, 64 nt, Human
acccaccuguagcccugagguucuuuucccaggauggcuccaggauaaggaucacuguaggugg

SEQ ID NO: 181990 - RNA, 64 nt, Human
ggggagggaccagcccgggcugcaccagugggaguggcuccacccuucccaccucagagccaug

SEQ ID NO: 181991 - RNA, 64 nt, Human
ccuuuuucuguuucuuaacucaacagcuaaaaaauggcuccagguagugagucaaugaaguuca

SEQ ID NO: 181992 - RNA, 64 nt, Human
uuaggaaaagcauuugcuguguuucguuagcaucuggcuccaggacagaccuucaacuuccaaa

SEQ ID NO: 181993 - RNA, 64 nt, Human
agaccucacugucguguccaugccacccccggcauggcuccagguggccuggugacuccaugau

SEQ ID NO: 181994 - RNA, 64 nt, Human
gugcccuguggggguccgugugagcaggcccaccuggcuccagacccgcccccaaccugagaca

SEQ ID NO: 181995 - RNA, 64 nt, Human
ggugugagggggcaggucugaccugccccaaaguuggcuccauccuggacaacucggugagagg

SEQ ID NO: 181996 - RNA, 64 nt, Human
cuuuugcugagcuucaaucaggaagcuauuugccuggcuccagcagaugaugagauaaugaggu

SEQ ID NO: 181997 - RNA, 64 nt, Human
ggcugggaagugcuccucaccuguguggcccagauggcuccaacaagcaaaaggaaggaugcag

SEQ ID NO: 181998 - RNA, 64 nt, Human
uuucauuguaagaaagcagagagcggaaaaucaauggcuccagugauuaauagauggguuuuua

SEQ ID NO: 181999 - RNA, 64 nt, Human
cuuggcucuuugggucuuucccggguacacuagauggcuccaucccaaggcaucuugucauaaa

SEQ ID NO: 182000 - RNA, 64 nt, Human
agaugugcucguuuuuauuccuccucucccagauuggcuccagcagaaaagucccucgugcaca

SEQ ID NO: 182001 - RNA, 64 nt, Human
uuagaugguguuacugagaaggaaacuaaggacuuggcuccaaaacaaaacaaaacaaaaucug

SEQ ID NO: 182002 - RNA, 64 nt, Human
uccgcggggugauucaguccagugauuggguuuguggcuccaggccucgcccacagacggacag

SEQ ID NO: 182003 - RNA, 64 nt, Human
agggggacaaacagaacugguaaagaggccccccuggcuccaggccuguccaucaggaaguaaa

SEQ ID NO: 182004 - RNA, 64 nt, Human
ucugaagcccagaguuaaaaaucaucuguccaccuggcuccaaagacaaaaaauaaaaagaaaa

SEQ ID NO: 182005 - RNA, 64 nt, Human
uucucggugacaugucaccucccugccccaauccuggcuccaacccucucuggaaaaucgaagu

SEQ ID NO: 182006 - RNA, 64 nt, Human
cacucccugggcaccaugcccucuggugaccuguuggcuccacucuugucacucauguccagau

SEQ ID NO: 182007 - RNA, 64 nt, Human
cacuccagagaaaguuucaugcuguugcgugugguggcuccaagccaagcaccuggcaugcagg

SEQ ID NO: 182008 - RNA, 64 nt, Human
aaaaacccauuccuuccaagcuaguguuuuucauuggcuccaggucuaauuuuucacugugguc

SEQ ID NO: 182009 - RNA, 64 nt, Human
ucauuuugcaacuuggagauuuugcuaauacauuuggcuccacuguaaauuuaauagauaaagu

SEQ ID NO: 182010 - RNA, 64 nt, Human
auuuuucuccaaaggccauccuuuuggggccaccuggcuccaagaagcaucgcuggucuugggg

SEQ ID NO: 182011 - RNA, 64 nt, Human
caucuggcagggcuggcucuguccccugggccuuuggcuccaguggccccugugcccagcaguc

SEQ ID NO: 182012 - RNA, 64 nt, Human
ggugggaaugcuccgggggugacacaggccacgguggcuccagccaggaccagccagaccagca

SEQ ID NO: 182013 - RNA, 64 nt, Human
caggguccuuuccauuccuauuuagagggaguccuggcuccaugacccccucccgaguggacug

SEQ ID NO: 182014 - RNA, 64 nt, Human
ggcaaccacaacauaauaguugaaagaucaagauuggcuccacgaaagugauacggagguuagg

SEQ ID NO: 182015 - RNA, 64 nt, Human
cagggacgacagagacaguuucuaguuagagccuuggcuccauuuuuggaugauuuagccccga

SEQ ID NO: 182016 - RNA, 64 nt, Human
uaaacauaaaauauugcaguguauuagccggcuguggcuccagagucugugcccuuuaccaccg

SEQ ID NO: 182017 - RNA, 64 nt, Human
cagcagcaugugcuaauaggugccaauacugugcuggcuccagugggauuccucucugcaaagc

SEQ ID NO: 182018 - RNA, 64 nt, Human
gcaugggaaagaaggcuacuuaucucuuuguauguggcuccagucugugaggauacauaacauu

SEQ ID NO: 182019 - RNA, 64 nt, Human
ucguauaaaaaaagcaggccaucugcuuaacccuuggcuccaccauaaggcacugggacucgga

SEQ ID NO: 182020 - RNA, 64 nt, Human
gugcuuuucaggugcccagcucucggaaugacuguggcuccacugucccugacaaccccuucgu

SEQ ID NO: 182021 - RNA, 64 nt, Human
augcagagaaaauguaugcaagagaccaaaaagauggcuccaagcuaugucauguuaccuguaa

SEQ ID NO: 182022 - RNA, 64 nt, Human
gggaagggugucccgaccgcuuccucuccagcuguggcuccaucugcccagcuugccugccucc

SEQ ID NO: 182023 - RNA, 64 nt, Human
ggccugucuucccuuuauuggguagaguucuugauggcuccaaggugacuucuggugacagcca

SEQ ID NO: 182024 - RNA, 64 nt, Human
gccucagcucccucugcccuguacccuaggcacguggcuccagcaagagccccaggcaggacaa

SEQ ID NO: 182025 - RNA, 64 nt, Human
cauuaccugaaggacgccucaucauuucauuccuuggcuccaaaccuucugcugccucuaagau

SEQ ID NO: 182026 - RNA, 64 nt, Human
gagccggcagagcaggccggacgcagcagcccucuggcuccagcauggggccuggccaggcuau

SEQ ID NO: 182027 - RNA, 51 nt, Human
aguaucuuuuacaaaagugacuggcuccacucccccgcacaggacucaaca

SEQ ID NO: 182028 - RNA, 64 nt, Human
ucgcugaucacugccagggaggcucaggcugccauggcuccaggcucccuccccugccuagggg

SEQ ID NO: 182029 - RNA, 64 nt, Human
uuuagccccuauuuucagggguagugagaggguguggcuccacuaauuuccaguuuguuuuucu

SEQ ID NO: 182030 - RNA, 64 nt, Human
cccacucuaaagccuccucccucccagcguccacuggcuccaggcuccucacaacagcagcuca

SEQ ID NO: 182031 - RNA, 64 nt, Human
uggcacugcccaaggccauaccugccuagcccuuuggcuccauccuguggaugcccacucaccc

SEQ ID NO: 182032 - RNA, 64 nt, Human
aaggccaaggguaauagaaaugcauaccaguaauuggcuccaauucauaauauguucaccagga

SEQ ID NO: 182033 - RNA, 64 nt, Human
uguaugagccuuuguuugagauuugaaaacaacauggcuccaucacauauucccuuuuuucuuu

SEQ ID NO: 182034 - RNA, 64 nt, Human
uauguguggacauguguucacugucauuaugcuguggcuccaggugagggugaggacugggccu

SEQ ID NO: 182035 - RNA, 64 nt, Human
gccauguacuuggaaaaaggccgcaugaucuuucuggcuccacucagugucuaaggcacccugc

SEQ ID NO: 182036 - RNA, 64 nt, Human
cuaaaacuuagagauuuucucuuugcauaaauuuuggcuccauucuuuccauaacaaucuaauc

SEQ ID NO: 182037 - RNA, 64 nt, Human
ggugcuccucaggcaccuccucucugacggggccuggcuccaccugugaucaccucccccugcu

SEQ ID NO: 182038 - RNA, 64 nt, Human
ccucugggcaguuugcccccaucccucccagugcuggcuccaggcuccucguguggccauacaa

SEQ ID NO: 182039 - RNA, 64 nt, Human
ugcccucuggacagcuugacucuacucccagcgcuggcuccaggcuccucaugaggccaugcaa

SEQ ID NO: 182040 - RNA, 64 nt, Human
gcuuuccugagacuguaucuaaugggcaagucaguggcuccagaggggucuuaggccaaagccc

SEQ ID NO: 182041 - RNA, 64 nt, Human
gacugucccuugaguagaauccacugauuuucuguggcuccagugagaacaaggcuuugaaacu

SEQ ID NO: 182042 - RNA, 64 nt, Human
caucuccgccucaggggcuucuccaccccaagucuggcuccauuccuggccuucuguuggugac

SEQ ID NO: 182043 - RNA, 64 nt, Human
ucauggccaagcgucuaaccuaaagucccaggauuggcuccaggcagcaauuauaucauaacuu

SEQ ID NO: 182044 - RNA, 64 nt, Human
ugccugagaccaggguggccacacaggcagggccuggcuccagucucauccucccauugcccag

SEQ ID NO: 182045 - RNA, 64 nt, Human
cagggccucuuucggguuuccuuggacagugccauggcuccagugcucuggugucacccaggac

SEQ ID NO: 182046 - RNA, 64 nt, Human
ggacacaaguggcgacagccugcugggggcucuguggcuccauuccuggcuguggggucuaguc

SEQ ID NO: 182047 - RNA, 64 nt, Human
gagcuggacccagcggcccagagucuagccagcuuggcuccaauaggagcucaguggcccuaag

SEQ ID NO: 182048 - RNA, 64 nt, Human
cccaucucaucccaugcaccgacggugccuggccuggcuccaaacucccgaaaggaacuauuuu

SEQ ID NO: 182049 - RNA, 64 nt, Human
uauucuaaacuuccauucuguuuucuuuucacauuggcuccaucacuggugacugaugaagagc

SEQ ID NO: 182050 - RNA, 64 nt, Human
uccugcuggugaaucacaugcggcaagaggcaacuggcuccacagccugggaugcugccguacc

SEQ ID NO: 182051 - RNA, 64 nt, Human
agaagugagggagacagaagucuaggcccagggauggcuccaguuggggauccagcaggagacc

SEQ ID NO: 182052 - RNA, 64 nt, Human
uaccccagcuauaucugcuuuaaggaguuuucccuggcuccaaaggccauuggcacccacccaa

SEQ ID NO: 182053 - RNA, 64 nt, Human
agaaauagacacaacugcaguucacaaguaguacuggcuccaccccuuggugcuggcaguguuu

SEQ ID NO: 182054 - RNA, 64 nt, Human
uagaucagggauagcgcuguugauccccucucuguggcuccaacccguugggucccuugcugca

SEQ ID NO: 182055 - RNA, 64 nt, Human
uagucaccuagcugugagggugccugaggcugaauggcuccaccccucccccagcccugcuucu

SEQ ID NO: 182056 - RNA, 64 nt, Human
uugaaccuggguguugcuuccgggccagucugcguggcuccaugaaaagcucacugcugcccca

SEQ ID NO: 182057 - RNA, 64 nt, Human
cuggguguccuuuuacucagcuuuauaacaaauguggcuccaagcucaggugccuuugaguucu

SEQ ID NO: 182058 - RNA, 64 nt, Human
aagccugagcaccaugauucccacagccagcucuuggcuccaagaugagcacccacaggaagcc

SEQ ID NO: 182059 - RNA, 64 nt, Human
agccaggguuuuaaggaauuucacauguauaagguggcuccauagcuuuauuuguaaguaggcu

SEQ ID NO: 182060 - RNA, 64 nt, Human
cgaccuuagcacccauagccuaugccaugagcacuggcuccacccugaaucccagcuccucccc

SEQ ID NO: 182061 - RNA, 64 nt, Human
ugugcugcaauuguccaggcgaugacaauggugauggcuccagagaacacaccagcuauuuaug

SEQ ID NO: 182062 - RNA, 55 nt, Human
ggucccuggagaagaacuaagccuuuggcuccagaguuucuuucugaagugcucu

SEQ ID NO: 182063 - RNA, 64 nt, Human
uugacuugacagagccucuacuucugucucaaaauggcuccaaaugauuucuguacugcaaaau

SEQ ID NO: 182064 - RNA, 64 nt, Human
gaugcuguccuccccacuccuccgcucugcucccuggcuccaggggugugggggaccccagaac

SEQ ID NO: 182065 - RNA, 64 nt, Human
gcgccccaggaaggaucuguguuagucccugggauggcuccaaggccugcucuaggaaggcagc

SEQ ID NO: 182066 - RNA, 64 nt, Human
guuuccuccucugauuugcaucauuuccccucucuggcuccaauuuggagagggaaugcugagc

SEQ ID NO: 182067 - RNA, 64 nt, Human
uguuuccuucuuguuauuuaugcuauucucuuuguggcuccauucuucuuucaaucuucucagc

SEQ ID NO: 182068 - RNA, 64 nt, Human
ucauaaauccugcaggcaguccaacaaacagggcuggcuccagcacaaacucucccuuccaccu

SEQ ID NO: 182069 - RNA, 64 nt, Human
acaaccauaagcaagacaugcccaggguuugccguggcuccagaucuacucccuguaggaguuc

SEQ ID NO: 182070 - RNA, 64 nt, Human
cgcuuugauacagcaaauggagcagcugaccucauggcuccaaucccaccugccuguuagggua

SEQ ID NO: 182071 - RNA, 64 nt, Human
uuuccuugcugccagguaugugaugcuguaggcuuggcuccaaaccagcugagugccugcuuuu

SEQ ID NO: 182072 - RNA, 64 nt, Human
aauaaggguaaaaucaggcugaacugcauguauauggcuccacuguggcuugugacacuuuuaa

SEQ ID NO: 182073 - RNA, 64 nt, Human
cacacacacacacacacacacaccccuucuugaauggcuccaaggauacccuuuuaacuucuuc

SEQ ID NO: 182074 - RNA, 64 nt, Human
cccugggugcgcugaggccuggaggcgucuacacuggcuccacauccacuucccccgcagcucg

SEQ ID NO: 182075 - RNA, 64 nt, Human
cuggaacccgggugcuggggucaugcugccuccguggcuccaaggugagggucaucuucacgag

SEQ ID NO: 182076 - RNA, 64 nt, Human
ugagcccagaagaauggucccagagaaagcagacuggcuccaauagauaucaggcagcaauccc

SEQ ID NO: 182077 - RNA, 64 nt, Human
caacucuucuccaagucuagcuuuccuuuccuucuggcuccaaggugcucuguguccgucugug

SEQ ID NO: 182078 - RNA, 64 nt, Human
gguuugcugauguugucuugugcuguuccacucuuggcuccagcagacccacugucccagaaaa

SEQ ID NO: 182079 - RNA, 64 nt, Human
cacaaaagcuccaaagggcccccuaacccucuuguggcuccaguuauuuggaaacuaugaucug

SEQ ID NO: 182080 - RNA, 64 nt, Human
uccaucauucccgaaaaguggauggagagagugauggcuccacugaagagacagacgagucgga

SEQ ID NO: 182081 - RNA, 64 nt, Human
cacacugcacagggaaaauugccccauccagaccuggcuccacucuugaucucucuuguccucu

SEQ ID NO: 182082 - RNA, 64 nt, Human
ccuucauucugcagcggcauggucccucccauucuggcuccaccugcagccucccuggguggcc

SEQ ID NO: 182083 - RNA, 64 nt, Human
acucugcaccuuccuccaccaggagccugggauauggcuccaucugccuucagggccuggacug

SEQ ID NO: 182084 - RNA, 53 nt, Human
acgauauccucuacaaauagggcuggcuccagcccgcugcugcccugcugccc

SEQ ID NO: 182085 - RNA, 64 nt, Human
ugcaggaggcagagggugccccgcagggagcugguggcuccagccccacuagagcuccuaaaga

SEQ ID NO: 182086 - RNA, 64 nt, Human
cugguggugaguuuugccagccauggccaggguuuggcuccacugguggcacacguggccuccg

SEQ ID NO: 182087 - RNA, 64 nt, Human
gagacauugugcaauggggcuacgaggcugcaucuggcuccagggaagcguguugcaauccaug

SEQ ID NO: 182088 - RNA, 64 nt, Human
gcuggggugggggguguggaaaaugccuacauccuggcuccaucucccgaaguuucgauuugau

SEQ ID NO: 182089 - RNA, 64 nt, Human
ggauuuggaguaucggccgugucucaccacauccuggcuccaguguggaugcagagagagugug

SEQ ID NO: 182090 - RNA, 64 nt, Human
gcaggucgccacggccaucccuuugcucccagccuggcuccaucagccuccagcuuccuuucuu

SEQ ID NO: 182091 - RNA, 64 nt, Human
cacacacacacuacagaagaggauugcaaacacauggcuccaucuucugcacacgaaaggaaag

SEQ ID NO: 182092 - RNA, 64 nt, Human
ggcccggcccucguggggacauuaaagggcgcgguggcuccacucgccccauuucugcucuuug

SEQ ID NO: 182093 - RNA, 64 nt, Human
aacaaagaguuauuaaagagcccgcaugcauuuguggcuccacaauuacaucagcagaaugguc

SEQ ID NO: 182094 - RNA, 64 nt, Human
acacaugauuaggccucagacccaacucugguccuggcuccacaacaguggcugccacucacuu

SEQ ID NO: 182095 - RNA, 64 nt, Human
agaacaauccccgagggcugcugcuuugcgucuguggcuccaagaagugccuguggucaggccc

SEQ ID NO: 182096 - RNA, 64 nt, Human
cagcaugaguacugccccaccccugggggaaaccuggcuccaaccaaccccuccccugccucca

SEQ ID NO: 182097 - RNA, 64 nt, Human
cugaguuauuuuuguggacggaaucggaacacgcuggcuccauaucgugaaauuuuuauuaauu

SEQ ID NO: 182098 - RNA, 64 nt, Human
ugaggacccacugggcagcuccuggacagccucuuggcuccagcccccacccgaaaguggacac

SEQ ID NO: 182099 - RNA, 64 nt, Human
cucugcuaguccucaugcaacucaguccccagaauggcuccacugggaguggaggaagagcuca

SEQ ID NO: 182100 - RNA, 64 nt, Human
cccacaucaccacgccaacaggaccacagcgcacuggcuccaccccaucucugccaucuccacu

SEQ ID NO: 182101 - RNA, 64 nt, Human
guccucucucagcuaucacaucacaagauaaugcuggcuccaaacuuccuuucugugccucauc

SEQ ID NO: 182102 - RNA, 64 nt, Human
uuuccaaaaucucugcuugugucuguccagccucuggcuccacugcuuggcugagauccuggcc

SEQ ID NO: 182103 - RNA, 64 nt, Human
uugaugcagggaggaggaaggcugaggaaugacuuggcuccagauuacuugguuauuaagaaga

SEQ ID NO: 182104 - RNA, 64 nt, Human
ccucuucaccccggcaggcccugcaguguucgcuuggcuccaugcuccucacugcccgcacacc

SEQ ID NO: 182105 - RNA, 64 nt, Human
aacaaacaaacaaacagaaagcaccgucgagaaauggcuccagcgcugacuagcggccaccuca

SEQ ID NO: 182106 - RNA, 64 nt, Human
aguagcucaauauuuuacagggcuaacauaaagcuggcuccauuuaaaaacuggaguacuuccu

SEQ ID NO: 182107 - RNA, 64 nt, Human
cccauggaagauggaugggcaagaguguacuucuuggcuccauuuacuaccuacugcucaguag

SEQ ID NO: 182108 - RNA, 64 nt, Human
acgcacacacauacacacugaaggccacgauugcuggcuccacaauuuaguaacauuuauauua

SEQ ID NO: 182109 - RNA, 64 nt, Human
gcugaagaguuucugagucugugagcuucuuacauggcuccaaauggucaaauaagugaaugaa

SEQ ID NO: 182110 - RNA, 64 nt, Human
gcaccugagcauagguaugaccuugggaagacauuggcuccauaagcaaugccaagagaaugau

SEQ ID NO: 182111 - RNA, 64 nt, Human
ucccaccacacagacucugggccuccccgcaaaauggcuccagaauuagaguaauuaugagaug

SEQ ID NO: 182112 - RNA, 64 nt, Human
cccuggguucacagaucuuucugccuuuggcuuuuggcuccacccucuuuagcuguuaauuuga

SEQ ID NO: 182113 - RNA, 64 nt, Human
ccacaaggacauagcuguucccuaacuugguggauggcuccaguuugcuuuuaacgaaaaucac

SEQ ID NO: 182114 - RNA, 64 nt, Human
gaacaguagcugaugaagcugcccagaagugccuuggcuccagcccuguaccccuugguacugc

SEQ ID NO: 182115 - RNA, 64 nt, Human
ggugggaaaaguccuuuucuuccuugacaggccuuggcuccaucuccuugggccucugucacgg

SEQ ID NO: 182116 - RNA, 64 nt, Human
uaauagugaaccccugggccacugaagaguaacauggcuccacuggacacaaaagagggaugga

SEQ ID NO: 182117 - RNA, 64 nt, Human
uacccaucauucauucucaagaccucugaaggguuggcuccagaacuuagaccuuugcuuaugc

SEQ ID NO: 182118 - RNA, 64 nt, Human
ggcuagcuugcugcaggucuggguaguuggaucauggcuccacugggauugggguggaaagcuu

SEQ ID NO: 182119 - RNA, 64 nt, Human
ccaaguggguccaaguggcugugacaucuacguauggcuccacaccuccaaugcugccugggag

SEQ ID NO: 182120 - RNA, 64 nt, Human
gggugauguuagagacagucaccuuuugaguuauuggcuccagaugugacuacuuuucuuguuu

SEQ ID NO: 182121 - RNA, 64 nt, Human
aagcacgugucucagacugcauguaccauuugcauggcuccagaaaugucuaaaugcugaaaaa

SEQ ID NO: 182122 - RNA, 64 nt, Human
aauguuuguguagaugaaaccaucucaugcucuguggcuccaggguuucuguuacuauuuuaug

SEQ ID NO: 182123 - RNA, 64 nt, Human
uuucucagaauuacacgcacgaccauccaaacauuggcuccaugccagggcugugacugcagcc

SEQ ID NO: 182124 - RNA, 64 nt, Human
cggcagaaacagaaaucccaaaaggugucaugcuuggcuccagcucugugcucucagaacuccc

SEQ ID NO: 182125 - RNA, 64 nt, Human
gugcuuucgucggcugucggaaaguucugagcaguggcuccagaccaccuugucuugcuacuug

SEQ ID NO: 182126 - RNA, 64 nt, Human
cagugggccugcugcaugcguguuaccuggcuuuuggcuccacgcucacucauagccaugucca

SEQ ID NO: 182127 - RNA, 64 nt, Human
gcugucucugaggggugggggugccgcucuaaauuggcuccauaucauuugaguuuaggguucu

SEQ ID NO: 182128 - RNA, 64 nt, Human
gacaccaugacagcugcccggggcugagggcagcuggcuccacucaaaugaggaagaagggauc

SEQ ID NO: 182129 - RNA, 64 nt, Human
gcuagaggggauuaguuccggagacugagacuguuggcuccaccuccaagcugagcuagggugg

SEQ ID NO: 182130 - RNA, 64 nt, Human
gagccaaggugaaagucucugaugacggcggaacuggcuccauuagaccaugguucauccucuu

SEQ ID NO: 182131 - RNA, 64 nt, Human
uaaagcacacacuuagcgcucuggagccggacgguggcuccaccacuuccgcaggccuggaaac

SEQ ID NO: 182132 - RNA, 64 nt, Human
cuggggcccagggccaggguggggcccaggccacuggcuccagagcccugcccuaaccccuugg

SEQ ID NO: 182133 - RNA, 64 nt, Human
uucagccagggacuugagaaguuauauugggcaguggcuccaaucuguggaccaguauuucagc

SEQ ID NO: 182134 - RNA, 64 nt, Human
ugaauuuuuagacacaugcucuccugccaccucuuggcuccaucaagauccaguuccccaucuc

SEQ ID NO: 182135 - RNA, 64 nt, Human
gaagaucugggcaauuuuggccuugacucuuuccuggcuccagagcucaagcuuagaagccagc

SEQ ID NO: 182136 - RNA, 64 nt, Human
ugccuucacacccccuagagagcuaauguaguauuggcuccaccugcucacauuucucccuccc

SEQ ID NO: 182137 - RNA, 64 nt, Human
cgggcagguuggccuagccuggguccuccgcggguggcuccacgugaggccugagccuucagcc

SEQ ID NO: 182138 - RNA, 64 nt, Human
auuauuucagugcuaggcauuauugauuaggucuuggcuccacuguuuaccucuugcuauguau

SEQ ID NO: 182139 - RNA, 64 nt, Human
aaucuuccuuuuauuccucacucggguuucucuguggcuccaggccaaagugccggugagaccc

SEQ ID NO: 182140 - RNA, 64 nt, Human
gccacugcccacagcugauggucacuguuuuggcuggcuccagaguggacagguacgcucuguc

SEQ ID NO: 182141 - RNA, 64 nt, Human
uuugccaaugaagcaacacaucugaucuaaagacuggcuccagaccccgggcugccaggauuau

SEQ ID NO: 182142 - RNA, 64 nt, Human
accuugagggauuagacauucuaauggaauguccuggcuccacccuccagcauguucucaccca

SEQ ID NO: 182143 - RNA, 64 nt, Human
agccagcagacuggccagcgccucuguguagggcuggcuccaggcauggccaccugccuucccc

SEQ ID NO: 182144 - RNA, 64 nt, Human
gucaguaaugauuggucccuggggaaggucuggcuggcuccagcacagugaggcauuuagguau

SEQ ID NO: 182145 - RNA, 64 nt, Human
gcuaagaagugcugagaaguuacucgccuggcgguggcuccaggguucucugguucucuggagc

SEQ ID NO: 182146 - RNA, 64 nt, Human
ccaaguacccugcuccagagcgccugcaggaauauggcuccaucuucacgggcgcccaggaccc

SEQ ID NO: 182147 - RNA, 64 nt, Human
cuguccuugaccugccgugguccuuuguaaacuauggcuccaugcugugugacagaucaacgug

SEQ ID NO: 182148 - RNA, 64 nt, Human
accuggcuccuuucuacuccuggcuaugucgucuuggcuccaccucuguccucucucuagccug

SEQ ID NO: 182149 - RNA, 64 nt, Human
uaucuuuucacuucagguggagcugaaauucugcuggcuccagaguuugagauuugaggcaaga

SEQ ID NO: 182150 - RNA, 64 nt, Human
agacagucccuugacuugaaguaaugguacagacuggcuccagcugcauguuaguuauuacguu

SEQ ID NO: 182151 - RNA, 64 nt, Human
gcgucaugagcugaaggaucaugcuuuccuguccuggcuccauagguuauaggcuggcugguga

SEQ ID NO: 182152 - RNA, 64 nt, Human
ccaagcucuuuccacagccacaucagucagggcauggcuccaauccauucuuugcuccaauguc

SEQ ID NO: 182153 - RNA, 64 nt, Human
cuaaaauggugauauccucucaaaugcugcuuguuggcuccagucuuccgacaaacuaacagga

SEQ ID NO: 182154 - RNA, 64 nt, Human
gaacccuggccucaccaaaacagcagcagcucguuggcuccaaaaccagggagcagaccaugcc

SEQ ID NO: 182155 - RNA, 64 nt, Human
gggaaccuuccaaggugucugguugcccugccucuggcuccagaacagaaagggagccucacgc

SEQ ID NO: 182156 - RNA, 64 nt, Human
agccaccugcccaccaaucuggugaggauaaugguggcuccagcgacaggaggccaacccugga

SEQ ID NO: 182157 - RNA, 64 nt, Human
caagccuuccuuccauuguuuuucuuccguucacuggcuccacacguuuccuggggaguagccu

SEQ ID NO: 182158 - RNA, 64 nt, Human
cucccagacccucugaucucccuccaacaaacccuggcuccagcccccuuucccaacuugaguu

SEQ ID NO: 182159 - RNA, 64 nt, Human
ccuuaauccugugccccugccugggacagaaauguggcuccaguugcucugucucucgugguca

SEQ ID NO: 182160 - RNA, 64 nt, Human
acaggcacccaggauaaggacaagguccugccuuuggcuccacauugccacaugacccuuaagg

SEQ ID NO: 182161 - RNA, 64 nt, Human
gggcucaccaggcacuggcagggaggguaagggcuggcuccagauaccccucccccacagauuc

SEQ ID NO: 182162 - RNA, 64 nt, Human
aggccuauguggcccacaguaggugaagaaugucuggcuccagcccuuucucugugccuucagc

SEQ ID NO: 182163 - RNA, 64 nt, Human
gcugcugaugguggaacugcugugaccuuaggacuggcuccacaggguggacuggcugggcccu

SEQ ID NO: 182164 - RNA, 64 nt, Human
cagcacugccaucuugccauguacaggcuugggguggcuccaggaagccucguccagugauaua

SEQ ID NO: 182165 - RNA, 64 nt, Human
gggcuccagggacuccaaauaaauguucagugacuggcuccaaggaugaccgugaacguguccg

SEQ ID NO: 182166 - RNA, 64 nt, Human
uaagaaaaucaccauaaaucagacaugaaaauucuggcuccaaaaauagcauuuucuuugugca

SEQ ID NO: 182167 - RNA, 64 nt, Human
ggaccuugaaagcaagcuugcuaggugcccucuguggcuccagccuuuaccggaaguguggugc

SEQ ID NO: 182168 - RNA, 64 nt, Human
cggcugggacugacccccgcucccccgacgcauguggcuccagcccggccuggccgccagggag

SEQ ID NO: 182169 - RNA, 64 nt, Human
uggcccaggcagcucuagcugggagcuuggccucuggcuccaucugaguccccugggagagagc

SEQ ID NO: 182170 - RNA, 64 nt, Human
uaccaagguggaaguuuucauggagaaaagcaccuggcuccagggccaguguuacaguguuacc

SEQ ID NO: 182171 - RNA, 64 nt, Human
cacuggcugggaguggagaggcacuguggugaaauggcuccagaggucuguacaucacauacau

SEQ ID NO: 182172 - RNA, 64 nt, Human
gccugaaaauuccaaaucuagccucugaaugucuuggcuccaucucuucagaccccuuugccuu

SEQ ID NO: 182173 - RNA, 64 nt, Human
ggggcuucagccuagagcccugccaggcagccccuggcuccagguucccugccuccuagcgcuc

SEQ ID NO: 182174 - RNA, 64 nt, Human
uaagcccagcucugcuuuuuccagauucuuccacuggcuccacauccaccccacuggaucuuca

SEQ ID NO: 182175 - RNA, 64 nt, Human
ccuccccaggucccagcggcaccaacaucaucauuggcuccauugcuggggcuguccugguugc

SEQ ID NO: 182176 - RNA, 64 nt, Human
gaagagggacuguucuuuugucccagaaaagcaguggcuccauugguguugacauacauccaac

SEQ ID NO: 182177 - RNA, 64 nt, Human
gaggcagauguccugucugugagccaguuccagcuggcuccagccauccugcagggccagacca

SEQ ID NO: 182178 - RNA, 64 nt, Human
cccucucaggcaugccugugugacaucaguggcauggcuccagucugcugcccuccaucccgac

SEQ ID NO: 182179 - RNA, 64 nt, Human
caaagagaguuaaaagcagcagccccggcaacucuggcuccaggcagaaggagaggcccggugc

SEQ ID NO: 182180 - RNA, 64 nt, Human
aucacgcaggacacugugauuguguugaugcagcuggcuccacagcugugcauuccacagagau

SEQ ID NO: 182181 - RNA, 64 nt, Human
gcucuguguguggaggacaaagcuucuuccugcguggcuccaggaaaagauguggcucacguag

SEQ ID NO: 182182 - RNA, 64 nt, Human
gaaacugaggccagagggaggagagaauugcucauggcuccagaacugguggcaaguuucucug

SEQ ID NO: 182183 - RNA, 64 nt, Human
agggagucaggaagagacggcaacguaaaggauguggcuccauguccauggugcccccugguca

SEQ ID NO: 182184 - RNA, 64 nt, Human
cuuccagaccccuggcgaccaccgccccucucaguggcuccagggccucccucagaggucccca

SEQ ID NO: 182185 - RNA, 64 nt, Human
cagccucccagagggacagcugagcccccugccuuggcuccagguugguagaagcagccgaagg

SEQ ID NO: 182186 - RNA, 64 nt, Human
uccccucuugccucaggaaacccgguggcaccuguggcuccaggugacugucuugaacagagcg

SEQ ID NO: 182187 - RNA, 64 nt, Human
uuugagacaaaaucaccaccugucaaaaggcagguggcuccagaggggucaagacccccccccg

SEQ ID NO: 182188 - RNA, 64 nt, Human
gauccuguccucucugccgccucauucugggguguggcuccagccuucccuggcccccgccgga

SEQ ID NO: 182189 - RNA, 64 nt, Human
ucugucuguuguacauagaguucagcuuguuuuuuggcuccaguaggaaaaaaaauccauccau

SEQ ID NO: 182190 - RNA, 64 nt, Human
agaccuccccacccccgguucugggcugggacccuggcuccagggccauguccagggcucuggu

SEQ ID NO: 182191 - RNA, 64 nt, Human
gucccuccuggucgugccccgucucuuuugguccuggcuccagaaaacccgcgccccacauacc

SEQ ID NO: 182192 - RNA, 64 nt, Human
acacaugcaaaugaacuugcuuguguguauuugauggcuccaagggcuauaaauuacaaacaaa

SEQ ID NO: 182193 - RNA, 64 nt, Human
cugaggaggucagcggcgcccugccgaggcccgauggcuccaucaucuucuuccgagaugaccg

SEQ ID NO: 182194 - RNA, 64 nt, Human
agcaugcccugggcugagaugagauggugguuuauggcuccagagcugcugcucgcuucgucag

SEQ ID NO: 182195 - RNA, 64 nt, Human
ggcuccagaguggggaugacaugcacucagcucuuggcuccacugggaugggaggagaggacaa

SEQ ID NO: 182196 - RNA, 64 nt, Human
ugugcaguguggcuucugaccagcugcauagacauggcuccagguaacagucccugggacugag

SEQ ID NO: 182197 - RNA, 64 nt, Human
uaaguagcagugcugguauuugaaccaggcauccuggcuccagagcccauucuuuuaaucagag

SEQ ID NO: 182198 - RNA, 64 nt, Human
uuuggucuguucuccuuccuuacaggcuaagcccuggcuccaugcaacugcauucuuugauuuc

SEQ ID NO: 182199 - RNA, 64 nt, Human
uggccaucauggugucuggaaggcuuagaugcauuggcuccauccaacaccugaaaaacaaacu

SEQ ID NO: 182200 - RNA, 64 nt, Human
caccccccaacacgguguccugccacccagcgccuggcuccaggaaaacacgcuugccuuccuu

SEQ ID NO: 182201 - RNA, 64 nt, Human
gaaaguguagugcaugggacccacgaaacugcccuggcuccagugaaacuugggcacaugcuca

SEQ ID NO: 182202 - RNA, 64 nt, Human
aauccgaccacuaauugccaagcaccgcuucguguggcuccaccuggauguucugugccuguaa

SEQ ID NO: 182203 - RNA, 64 nt, Human
gccccucccacagcgcuggccgggaccccgagccuggcuccaaacccucgaggcggaucuuugg

SEQ ID NO: 182204 - RNA, 64 nt, Human
accccugguucucagaauuuuaaccaaaaggaguuggcuccaaccaaugggagccuuccccuca

SEQ ID NO: 182205 - RNA, 64 nt, Human
gugccugcuacccagcuggaagccacaagguggcuggcuccaggggcggcuuuuguuggaaguu

SEQ ID NO: 182206 - RNA, 64 nt, Human
uauuuugguaauaaauuuuuuguuaaaaaaaacuuggcuccaaguucuauuaaccacagguugu

SEQ ID NO: 182207 - RNA, 64 nt, Human
agagauuaccccucucaacaggccagcugcugguuggcuccagccaguguggcccugggguaaa

SEQ ID NO: 182208 - RNA, 64 nt, Human
uuucccuguguugcccaggcuggucuugaacucuuggcuccaagugauacuucugccuuggccu

SEQ ID NO: 182209 - RNA, 64 nt, Human
ccagagaggacccccgcccccagagacuugguuuuggcuccagccuuccccuggccccgugaca

SEQ ID NO: 182210 - RNA, 64 nt, Human
uuggacccauuugaggacugaacuaggcaggcaauggcuccagugcccucccucuguucccugg

SEQ ID NO: 182211 - RNA, 64 nt, Human
gccccucaccucuuugaaacucuggacguauuuauggcuccaccuccccaccucccucccccgu

SEQ ID NO: 182212 - RNA, 64 nt, Human
uaggccccgccuggcacucagccuugccagagauuggcuccagaauuuuugccaggcuuacaga

SEQ ID NO: 182213 - RNA, 64 nt, Human
aagacaugccagauccaugugcaguaaugccugguggcuccaggucugccccgccguccugugg

SEQ ID NO: 182214 - RNA, 64 nt, Human
cccuuccuccuauaauccagggcggaagggggccuggcuccauccggcugccccauuccggcuc

SEQ ID NO: 182215 - RNA, 64 nt, Human
gugcgugcagugaaaauggccucaucucauaccauggcuccaccuuccauacaccagccacacg

SEQ ID NO: 182216 - RNA, 64 nt, Human
gagccuggccucagcaaggggccuuccugaccucuggcuccagugaagcugaauguccucacuu

SEQ ID NO: 182217 - RNA, 64 nt, Human
cuggccucaccuuuauggaacugcugaucgaugcuggcuccaccuggaccagggauucaugugg

SEQ ID NO: 182218 - RNA, 64 nt, Human
uucuguacagucaggucugcucuggucugggugcuggcuccaaucugcguccacuuaggaggcc

SEQ ID NO: 182219 - RNA, 64 nt, Human
ugcacuccagaauccacaaagccgugccuuucucuggcuccagaauaugcauaaucagcgcccu

SEQ ID NO: 182220 - RNA, 64 nt, Human
caccguccgcuuuuccugaguucucccucccaauuggcuccagcuuccugggggcguggccaag

SEQ ID NO: 182221 - RNA, 64 nt, Human
ccgccuagcgacaagggauuugcucgcacggcauuggcuccauccccuagucgcuggacagcuc

SEQ ID NO: 182222 - RNA, 64 nt, Human
uaccuucugaaauguuuaccccauugaccaaacuuggcuccagccauugcggugguuucuagau

SEQ ID NO: 182223 - RNA, 64 nt, Human
aauaagcaacagagccaggauucaaacccagguguggcuccagagcccauccucuucccacugc

SEQ ID NO: 182224 - RNA, 64 nt, Human
agggccagggggugcccaggugguggcugcaagguggcuccagcaccauccgccagggcccaca

SEQ ID NO: 182225 - RNA, 64 nt, Human
ucccugggcagcccccaggaaggccuuccagaucuggcuccagggucaccaccugucacagcaa

SEQ ID NO: 182226 - RNA, 64 nt, Human
ccuuuugugccagaugccaguacugucugcccauuggcuccaggggcuguaugggcagauucag

SEQ ID NO: 182227 - RNA, 64 nt, Human
guucccccucuuucugggucaagagcuggagugguggcuccauccucucugggccacuucgguc

SEQ ID NO: 182228 - RNA, 64 nt, Human
aaccccaggagaucaauuuucccgacgaucuuccuggcuccaacacugcugcuccagugcagga

SEQ ID NO: 182229 - RNA, 64 nt, Human
aaaauaaauuuuuuugcaauccuuuccucagaccuggcuccaggcuaacuggaaggcagcacuc

SEQ ID NO: 182230 - RNA, 64 nt, Human
aagcacaucuccaucucuuccaccucaggcaguguggcuccagaugucaggagggacugaccuc

SEQ ID NO: 182231 - RNA, 64 nt, Human
gagagaaugagccagugagaagcuucucuagacuuggcuccaaacaucuccccucccaagacau

SEQ ID NO: 182232 - RNA, 64 nt, Human
ugccucagaagggagccacugugaaccucucgaguggcuccaaagagcaguggcuuuuugagaa

SEQ ID NO: 182233 - RNA, 64 nt, Human
gucaguuggucaggcccugcuguagaaggucacuuggcuccauugccugcuuccaaccaauggg

SEQ ID NO: 182234 - RNA, 64 nt, Human
ucacaggccugugggaugcuccauggggcccugcuggcuccauggggcccaggugcaaaggguu

SEQ ID NO: 182235 - RNA, 64 nt, Human
agggaacuggaccuggcagggcaccgugcucauguggcuccaaggacaagcauggcgguggccc

SEQ ID NO: 182236 - RNA, 64 nt, Human
ucugugugguccagguccuuuccacccugagacuuggcuccaccacugauauccuccuuugggg

SEQ ID NO: 182237 - RNA, 64 nt, Human
caagacgucacagguagcaagagguacuuuuaccuggcuccaaaucuguguucuuuccacugac

SEQ ID NO: 182238 - RNA, 64 nt, Human
uguaaaaugccuuuuuaaaauuuaauuuucuagcuggcuccaauucaaauugaggauuuaugua

SEQ ID NO: 182239 - RNA, 64 nt, Human
ggaggcuggguggccggcccugccccccacauucuggcuccaccgggagggacagucuggaggu

SEQ ID NO: 182240 - RNA, 64 nt, Human
ggacccccagagaugcuggaaucgcuaggaggguuggcuccaggggcagccaauuccuaucauu

SEQ ID NO: 182241 - RNA, 64 nt, Human
cgagcagcuccccacucugcccguccaccuucccuggcuccagccucauucucucuuuaguuua

SEQ ID NO: 182242 - RNA, 64 nt, Human
aggcugaccgggcuguucuguagacucaggaccguggcuccagaacuccugugccaggcgggag

SEQ ID NO: 182243 - RNA, 64 nt, Human
cacuuuaugggacugugacuggacucuuccguucuggcuccagccagaccuucagugguccugc

SEQ ID NO: 182244 - RNA, 64 nt, Human
agggcugucaucugugcacugcccauggacaggcuggcuccagaugcagggcagucauuggcug

SEQ ID NO: 182245 - RNA, 64 nt, Human
cagacuuacuggguaaucagccaaguucauuuucuggcuccaaccugacauugaaugaugacug

SEQ ID NO: 182246 - RNA, 64 nt, Human
uggugggggcagagaaguaggaccaggccauccuuggcuccagagcucgaagaccccaagacag

SEQ ID NO: 182247 - RNA, 64 nt, Human
ggaguguuuauugagcacccuuugugugcagacauggcuccaggugcuuagcaaucaaugguga

SEQ ID NO: 182248 - RNA, 64 nt, Human
gccuaagagccgcagggacccacgcugucugcgcuggcuccacccgggaacccgccgcacgcug

SEQ ID NO: 182249 - RNA, 64 nt, Human
cacagcagacuggccuggcccugagacuggggaguggcuccaacagccuccugccacccacaca

SEQ ID NO: 182250 - RNA, 64 nt, Human
uaacccggcuaugaccagggaucuguaagcccuguggcuccacaggugcugcuucucacuggcc

SEQ ID NO: 182251 - RNA, 64 nt, Human
gaauaguuuucaauguauuaaugaagugauuaauuggcuccauauuuagacuaauaaaacauua

SEQ ID NO: 182252 - RNA, 64 nt, Human
uuuguuaccaaucacugugcucucugccgcccccuggcuccaggcuaauuuuucuggaaugaau

SEQ ID NO: 182253 - RNA, 64 nt, Human
cuuggaggggcuaggguacccgccuggucucggcuggcuccagcugcccugcaggugccccugg

SEQ ID NO: 182254 - RNA, 64 nt, Human
ugguggcccuccagaggucaugaagggaccucuguggcuccagcugccaacccuggagcccaga

SEQ ID NO: 182255 - RNA, 64 nt, Human
caaaauacucagaaguugcauuugccauggccacuggcuccagcugggguuuggugccaguguu

SEQ ID NO: 182256 - RNA, 64 nt, Human
cauggcagggcugccuggaacaccgcugccacuguggcuccaggaggcccuugggagcaugagg

SEQ ID NO: 182257 - RNA, 64 nt, Human
ggggugaucucuggugcucacagccgaggagccguggcuccauggccagaugacggaaacaggg

SEQ ID NO: 182258 - RNA, 64 nt, Human
cccagagagugacagcugcucaggcccuaacccuuggcuccaggagacacagggcccagcaccc

SEQ ID NO: 182259 - RNA, 64 nt, Human
cuggcccagcaccucagccugcucuucucucugguggcuccaccccaaccccuacuucuuuucc

SEQ ID NO: 182260 - RNA, 64 nt, Human
gcugccaggugugcacaggggccucccaggcuccuggcuccaccagccaaggaggugggggcaa

SEQ ID NO: 182261 - RNA, 64 nt, Human
ggagcaggucucaggccucuuguccucuccccaguggcuccaggccucacuaguggcaagggca

SEQ ID NO: 182262 - RNA, 64 nt, Human
auguuaaacuggcuuacuauagacuucguaaaaauggcuccagaagaguaacaaacugaaaucu

SEQ ID NO: 182263 - RNA, 64 nt, Human
gggugccgcugucaggagcagagccaggcccagguggcuccagcugccuguccuguccccuuuc

SEQ ID NO: 182264 - RNA, 64 nt, Human
gacggugucuaagaagccagguggaugugugugguggcuccaguggguguuucuacucugccag

SEQ ID NO: 182265 - RNA, 64 nt, Human
gcaucuuuaugucucuguaacauuggccuuuucauggcuccacacuggguggaaccauauucuc

SEQ ID NO: 182266 - RNA, 59 nt, Human
accccuggcucaaccccuaggcccggcuguggcuccaccuccagcucuccgugccuuaa

SEQ ID NO: 182267 - RNA, 64 nt, Human
aaaugugcauguggguagagaucaaaggaggcaauggcuccaagccuugccauagggcugccuc

SEQ ID NO: 182268 - RNA, 64 nt, Human
ucucucugcugcugugacaucucccucuccuugcuggcuccaucuuucgucugcacuaccaauu

SEQ ID NO: 182269 - RNA, 64 nt, Human; identical to SEQ ID NO: 181882

SEQ ID NO: 182270 - RNA, 64 nt, Human; identical to SEQ ID NO: 181883

SEQ ID NO: 182271 - RNA, 64 nt, Human; identical to SEQ ID NO: 181884

SEQ ID NO: 182272 - RNA, 64 nt, Human; identical to SEQ ID NO: 181885

SEQ ID NO: 182273 - RNA, 64 nt, Human; identical to SEQ ID NO: 181886

SEQ ID NO: 182274 - RNA, 64 nt, Human; identical to SEQ ID NO: 181887

SEQ ID NO: 182275 - RNA, 64 nt, Human; identical to SEQ ID NO: 181888

SEQ ID NO: 182276 - RNA, 64 nt, Human; identical to SEQ ID NO: 181889

SEQ ID NO: 182277 - RNA, 64 nt, Human; identical to SEQ ID NO: 181890

SEQ ID NO: 182278 - RNA, 64 nt, Human; identical to SEQ ID NO: 181891

SEQ ID NO: 182279 - RNA, 56 nt, Human; identical to SEQ ID NO: 181892

SEQ ID NO: 182280 - RNA, 64 nt, Human; identical to SEQ ID NO: 181893

SEQ ID NO: 182281 - RNA, 64 nt, Human; identical to SEQ ID NO: 181894

SEQ ID NO: 182282 - RNA, 64 nt, Human; identical to SEQ ID NO: 181895

SEQ ID NO: 182283 - RNA, 64 nt, Human; identical to SEQ ID NO: 181896

SEQ ID NO: 182284 - RNA, 64 nt, Human; identical to SEQ ID NO: 181897

SEQ ID NO: 182285 - RNA, 64 nt, Human; identical to SEQ ID NO: 181898

SEQ ID NO: 182286 - RNA, 64 nt, Human; identical to SEQ ID NO: 181899

SEQ ID NO: 182287 - RNA, 64 nt, Human; identical to SEQ ID NO: 181900

SEQ ID NO: 182288 - RNA, 64 nt, Human; identical to SEQ ID NO: 181901

SEQ ID NO: 182289 - RNA, 64 nt, Human; identical to SEQ ID NO: 181902

SEQ ID NO: 182290 - RNA, 64 nt, Human; identical to SEQ ID NO: 181903

SEQ ID NO: 182291 - RNA, 64 nt, Human; identical to SEQ ID NO: 181904

SEQ ID NO: 182292 - RNA, 64 nt, Human; identical to SEQ ID NO: 181905

SEQ ID NO: 182293 - RNA, 64 nt, Human; identical to SEQ ID NO: 181906

SEQ ID NO: 182294 - RNA, 64 nt, Human; identical to SEQ ID NO: 181907

SEQ ID NO: 182295 - RNA, 64 nt, Human; identical to SEQ ID NO: 181908

SEQ ID NO: 182296 - RNA, 64 nt, Human; identical to SEQ ID NO: 181909

SEQ ID NO: 182297 - RNA, 64 nt, Human; identical to SEQ ID NO: 181910

SEQ ID NO: 182298 - RNA, 64 nt, Human; identical to SEQ ID NO: 181911

SEQ ID NO: 182299 - RNA, 64 nt, Human; identical to SEQ ID NO: 181912

SEQ ID NO: 182300 - RNA, 64 nt, Human; identical to SEQ ID NO: 181913

SEQ ID NO: 182301 - RNA, 59 nt, Human; identical to SEQ ID NO: 181914

SEQ ID NO: 182302 - RNA, 64 nt, Human; identical to SEQ ID NO: 181915

SEQ ID NO: 182303 - RNA, 64 nt, Human; identical to SEQ ID NO: 181916

SEQ ID NO: 182304 - RNA, 64 nt, Human; identical to SEQ ID NO: 181917

SEQ ID NO: 182305 - RNA, 64 nt, Human; identical to SEQ ID NO: 181918

SEQ ID NO: 182306 - RNA, 64 nt, Human; identical to SEQ ID NO: 181919

SEQ ID NO: 182307 - RNA, 64 nt, Human; identical to SEQ ID NO: 181920

SEQ ID NO: 182308 - RNA, 64 nt, Human; identical to SEQ ID NO: 181921

SEQ ID NO: 182309 - RNA, 64 nt, Human; identical to SEQ ID NO: 181922

SEQ ID NO: 182310 - RNA, 64 nt, Human; identical to SEQ ID NO: 181923

SEQ ID NO: 182311 - RNA, 64 nt, Human; identical to SEQ ID NO: 181924

SEQ ID NO: 182312 - RNA, 64 nt, Human; identical to SEQ ID NO: 181925

SEQ ID NO: 182313 - RNA, 53 nt, Human; identical to SEQ ID NO: 181926

SEQ ID NO: 182314 - RNA, 64 nt, Human; identical to SEQ ID NO: 181927

SEQ ID NO: 182315 - RNA, 64 nt, Human; identical to SEQ ID NO: 181928

SEQ ID NO: 182316 - RNA, 64 nt, Human; identical to SEQ ID NO: 181929

SEQ ID NO: 182317 - RNA, 64 nt, Human; identical to SEQ ID NO: 181930

SEQ ID NO: 182318 - RNA, 64 nt, Human; identical to SEQ ID NO: 181931

SEQ ID NO: 182319 - RNA, 64 nt, Human; identical to SEQ ID NO: 181932

SEQ ID NO: 182320 - RNA, 64 nt, Human; identical to SEQ ID NO: 181933

SEQ ID NO: 182321 - RNA, 64 nt, Human; identical to SEQ ID NO: 181934

SEQ ID NO: 182322 - RNA, 64 nt, Human; identical to SEQ ID NO: 181935

SEQ ID NO: 182323 - RNA, 64 nt, Human; identical to SEQ ID NO: 181936

SEQ ID NO: 182324 - RNA, 64 nt, Human; identical to SEQ ID NO: 181937

SEQ ID NO: 182325 - RNA, 64 nt, Human; identical to SEQ ID NO: 181938

SEQ ID NO: 182326 - RNA, 64 nt, Human; identical to SEQ ID NO: 181939

SEQ ID NO: 182327 - RNA, 64 nt, Human; identical to SEQ ID NO: 181940

SEQ ID NO: 182328 - RNA, 64 nt, Human; identical to SEQ ID NO: 181941

SEQ ID NO: 182329 - RNA, 64 nt, Human; identical to SEQ ID NO: 181942

SEQ ID NO: 182330 - RNA, 64 nt, Human; identical to SEQ ID NO: 181943

SEQ ID NO: 182331 - RNA, 64 nt, Human; identical to SEQ ID NO: 181944

SEQ ID NO: 182332 - RNA, 64 nt, Human; identical to SEQ ID NO: 181945

SEQ ID NO: 182333 - RNA, 64 nt, Human; identical to SEQ ID NO: 181946

SEQ ID NO: 182334 - RNA, 64 nt, Human; identical to SEQ ID NO: 181947

SEQ ID NO: 182335 - RNA, 64 nt, Human; identical to SEQ ID NO: 181948

SEQ ID NO: 182336 - RNA, 64 nt, Human; identical to SEQ ID NO: 181949

SEQ ID NO: 182337 - RNA, 64 nt, Human; identical to SEQ ID NO: 181950

SEQ ID NO: 182338 - RNA, 64 nt, Human; identical to SEQ ID NO: 181951

SEQ ID NO: 182339 - RNA, 64 nt, Human; identical to SEQ ID NO: 181952

SEQ ID NO: 182340 - RNA, 64 nt, Human; identical to SEQ ID NO: 181953

SEQ ID NO: 182341 - RNA, 64 nt, Human; identical to SEQ ID NO: 181954

SEQ ID NO: 182342 - RNA, 64 nt, Human; identical to SEQ ID NO: 181955

SEQ ID NO: 182343 - RNA, 64 nt, Human; identical to SEQ ID NO: 181956

SEQ ID NO: 182344 - RNA, 64 nt, Human; identical to SEQ ID NO: 181957

SEQ ID NO: 182345 - RNA, 64 nt, Human; identical to SEQ ID NO: 181958

SEQ ID NO: 182346 - RNA, 64 nt, Human; identical to SEQ ID NO: 181959

SEQ ID NO: 182347 - RNA, 64 nt, Human; identical to SEQ ID NO: 181960

SEQ ID NO: 182348 - RNA, 64 nt, Human; identical to SEQ ID NO: 181961

SEQ ID NO: 182349 - RNA, 64 nt, Human; identical to SEQ ID NO: 181962

SEQ ID NO: 182350 - RNA, 64 nt, Human; identical to SEQ ID NO: 181963

SEQ ID NO: 182351 - RNA, 64 nt, Human; identical to SEQ ID NO: 181964

SEQ ID NO: 182352 - RNA, 64 nt, Human; identical to SEQ ID NO: 181965

SEQ ID NO: 182353 - RNA, 64 nt, Human; identical to SEQ ID NO: 181966

SEQ ID NO: 182354 - RNA, 64 nt, Human; identical to SEQ ID NO: 181967

SEQ ID NO: 182355 - RNA, 64 nt, Human; identical to SEQ ID NO: 181968

SEQ ID NO: 182356 - RNA, 64 nt, Human; identical to SEQ ID NO: 181969

SEQ ID NO: 182357 - RNA, 64 nt, Human; identical to SEQ ID NO: 181970

SEQ ID NO: 182358 - RNA, 64 nt, Human; identical to SEQ ID NO: 181971

SEQ ID NO: 182359 - RNA, 64 nt, Human; identical to SEQ ID NO: 181972

SEQ ID NO: 182360 - RNA, 64 nt, Human; identical to SEQ ID NO: 181973

SEQ ID NO: 182361 - RNA, 64 nt, Human; identical to SEQ ID NO: 181974

SEQ ID NO: 182362 - RNA, 64 nt, Human; identical to SEQ ID NO: 181975

SEQ ID NO: 182363 - RNA, 64 nt, Human; identical to SEQ ID NO: 181976

SEQ ID NO: 182364 - RNA, 64 nt, Human; identical to SEQ ID NO: 181977

SEQ ID NO: 182365 - RNA, 64 nt, Human; identical to SEQ ID NO: 181978

SEQ ID NO: 182366 - RNA, 64 nt, Human; identical to SEQ ID NO: 181979

SEQ ID NO: 182367 - RNA, 64 nt, Human; identical to SEQ ID NO: 181980

SEQ ID NO: 182368 - RNA, 64 nt, Human; identical to SEQ ID NO: 181981

SEQ ID NO: 182369 - RNA, 64 nt, Human; identical to SEQ ID NO: 181982

SEQ ID NO: 182370 - RNA, 64 nt, Human; identical to SEQ ID NO: 181983

SEQ ID NO: 182371 - RNA, 64 nt, Human; identical to SEQ ID NO: 181984

SEQ ID NO: 182372 - RNA, 64 nt, Human; identical to SEQ ID NO: 181985

SEQ ID NO: 182373 - RNA, 64 nt, Human; identical to SEQ ID NO: 181986

SEQ ID NO: 182374 - RNA, 64 nt, Human; identical to SEQ ID NO: 181987

SEQ ID NO: 182375 - RNA, 64 nt, Human; identical to SEQ ID NO: 181988

SEQ ID NO: 182376 - RNA, 64 nt, Human; identical to SEQ ID NO: 181989

SEQ ID NO: 182377 - RNA, 64 nt, Human; identical to SEQ ID NO: 181990

SEQ ID NO: 182378 - RNA, 64 nt, Human; identical to SEQ ID NO: 181991

SEQ ID NO: 182379 - RNA, 64 nt, Human; identical to SEQ ID NO: 181992

SEQ ID NO: 182380 - RNA, 64 nt, Human; identical to SEQ ID NO: 181993

SEQ ID NO: 182381 - RNA, 64 nt, Human; identical to SEQ ID NO: 181994

SEQ ID NO: 182382 - RNA, 64 nt, Human; identical to SEQ ID NO: 181995

SEQ ID NO: 182383 - RNA, 64 nt, Human; identical to SEQ ID NO: 181996

SEQ ID NO: 182384 - RNA, 64 nt, Human; identical to SEQ ID NO: 181997

SEQ ID NO: 182385 - RNA, 64 nt, Human; identical to SEQ ID NO: 181998

SEQ ID NO: 182386 - RNA, 64 nt, Human; identical to SEQ ID NO: 181999

SEQ ID NO: 182387 - RNA, 64 nt, Human; identical to SEQ ID NO: 182000

SEQ ID NO: 182388 - RNA, 64 nt, Human; identical to SEQ ID NO: 182001

SEQ ID NO: 182389 - RNA, 64 nt, Human; identical to SEQ ID NO: 182002

SEQ ID NO: 182390 - RNA, 64 nt, Human; identical to SEQ ID NO: 182003

SEQ ID NO: 182391 - RNA, 64 nt, Human; identical to SEQ ID NO: 182004

SEQ ID NO: 182392 - RNA, 64 nt, Human; identical to SEQ ID NO: 182005

SEQ ID NO: 182393 - RNA, 64 nt, Human; identical to SEQ ID NO: 182006

SEQ ID NO: 182394 - RNA, 64 nt, Human; identical to SEQ ID NO: 182007

SEQ ID NO: 182395 - RNA, 64 nt, Human; identical to SEQ ID NO: 182008

SEQ ID NO: 182396 - RNA, 64 nt, Human; identical to SEQ ID NO: 182009

SEQ ID NO: 182397 - RNA, 64 nt, Human; identical to SEQ ID NO: 182010

SEQ ID NO: 182398 - RNA, 64 nt, Human; identical to SEQ ID NO: 182011

SEQ ID NO: 182399 - RNA, 64 nt, Human; identical to SEQ ID NO: 182012

SEQ ID NO: 182400 - RNA, 64 nt, Human; identical to SEQ ID NO: 182013

SEQ ID NO: 182401 - RNA, 64 nt, Human; identical to SEQ ID NO: 182014

SEQ ID NO: 182402 - RNA, 64 nt, Human; identical to SEQ ID NO: 182015

SEQ ID NO: 182403 - RNA, 64 nt, Human; identical to SEQ ID NO: 182016

SEQ ID NO: 182404 - RNA, 64 nt, Human; identical to SEQ ID NO: 182017

SEQ ID NO: 182405 - RNA, 64 nt, Human; identical to SEQ ID NO: 182018

SEQ ID NO: 182406 - RNA, 64 nt, Human; identical to SEQ ID NO: 182019

SEQ ID NO: 182407 - RNA, 64 nt, Human; identical to SEQ ID NO: 182020

SEQ ID NO: 182408 - RNA, 64 nt, Human; identical to SEQ ID NO: 182021

SEQ ID NO: 182409 - RNA, 64 nt, Human; identical to SEQ ID NO: 182022

SEQ ID NO: 182410 - RNA, 64 nt, Human; identical to SEQ ID NO: 182023

SEQ ID NO: 182411 - RNA, 64 nt, Human; identical to SEQ ID NO: 182024

SEQ ID NO: 182412 - RNA, 64 nt, Human; identical to SEQ ID NO: 182025

SEQ ID NO: 182413 - RNA, 64 nt, Human; identical to SEQ ID NO: 182026

SEQ ID NO: 182414 - RNA, 51 nt, Human; identical to SEQ ID NO: 182027

SEQ ID NO: 182415 - RNA, 64 nt, Human; identical to SEQ ID NO: 182028

SEQ ID NO: 182416 - RNA, 64 nt, Human; identical to SEQ ID NO: 182029

SEQ ID NO: 182417 - RNA, 64 nt, Human; identical to SEQ ID NO: 182030

SEQ ID NO: 182418 - RNA, 64 nt, Human; identical to SEQ ID NO: 182031

SEQ ID NO: 182419 - RNA, 64 nt, Human; identical to SEQ ID NO: 182032

SEQ ID NO: 182420 - RNA, 64 nt, Human; identical to SEQ ID NO: 182033

SEQ ID NO: 182421 - RNA, 64 nt, Human; identical to SEQ ID NO: 182034

SEQ ID NO: 182422 - RNA, 64 nt, Human; identical to SEQ ID NO: 182035

SEQ ID NO: 182423 - RNA, 64 nt, Human; identical to SEQ ID NO: 182036

SEQ ID NO: 182424 - RNA, 64 nt, Human; identical to SEQ ID NO: 182037

SEQ ID NO: 182425 - RNA, 64 nt, Human; identical to SEQ ID NO: 182038

SEQ ID NO: 182426 - RNA, 64 nt, Human; identical to SEQ ID NO: 182039

SEQ ID NO: 182427 - RNA, 64 nt, Human; identical to SEQ ID NO: 182040

SEQ ID NO: 182428 - RNA, 64 nt, Human; identical to SEQ ID NO: 182041

SEQ ID NO: 182429 - RNA, 64 nt, Human; identical to SEQ ID NO: 182042

SEQ ID NO: 182430 - RNA, 64 nt, Human; identical to SEQ ID NO: 182043

SEQ ID NO: 182431 - RNA, 64 nt, Human; identical to SEQ ID NO: 182044

SEQ ID NO: 182432 - RNA, 64 nt, Human; identical to SEQ ID NO: 182045

SEQ ID NO: 182433 - RNA, 64 nt, Human; identical to SEQ ID NO: 182046

SEQ ID NO: 182434 - RNA, 64 nt, Human; identical to SEQ ID NO: 182047

SEQ ID NO: 182435 - RNA, 64 nt, Human; identical to SEQ ID NO: 182048

SEQ ID NO: 182436 - RNA, 64 nt, Human; identical to SEQ ID NO: 182049

SEQ ID NO: 182437 - RNA, 64 nt, Human; identical to SEQ ID NO: 182050

SEQ ID NO: 182438 - RNA, 64 nt, Human; identical to SEQ ID NO: 182051

SEQ ID NO: 182439 - RNA, 64 nt, Human; identical to SEQ ID NO: 182052

SEQ ID NO: 182440 - RNA, 64 nt, Human; identical to SEQ ID NO: 182053

SEQ ID NO: 182441 - RNA, 64 nt, Human; identical to SEQ ID NO: 182054

SEQ ID NO: 182442 - RNA, 64 nt, Human; identical to SEQ ID NO: 182055

SEQ ID NO: 182443 - RNA, 64 nt, Human; identical to SEQ ID NO: 182056

SEQ ID NO: 182444 - RNA, 64 nt, Human; identical to SEQ ID NO: 182057

SEQ ID NO: 182445 - RNA, 64 nt, Human; identical to SEQ ID NO: 182058

SEQ ID NO: 182446 - RNA, 64 nt, Human; identical to SEQ ID NO: 182059

SEQ ID NO: 182447 - RNA, 64 nt, Human; identical to SEQ ID NO: 182060

SEQ ID NO: 182448 - RNA, 64 nt, Human; identical to SEQ ID NO: 182061

SEQ ID NO: 182449 - RNA, 55 nt, Human; identical to SEQ ID NO: 182062

SEQ ID NO: 182450 - RNA, 64 nt, Human; identical to SEQ ID NO: 182063

SEQ ID NO: 182451 - RNA, 64 nt, Human; identical to SEQ ID NO: 182064

SEQ ID NO: 182452 - RNA, 64 nt, Human; identical to SEQ ID NO: 182065

SEQ ID NO: 182453 - RNA, 64 nt, Human; identical to SEQ ID NO: 182066

SEQ ID NO: 182454 - RNA, 64 nt, Human; identical to SEQ ID NO: 182067

SEQ ID NO: 182455 - RNA, 64 nt, Human; identical to SEQ ID NO: 182068

SEQ ID NO: 182456 - RNA, 64 nt, Human; identical to SEQ ID NO: 182069

SEQ ID NO: 182457 - RNA, 64 nt, Human; identical to SEQ ID NO: 182070

SEQ ID NO: 182458 - RNA, 64 nt, Human; identical to SEQ ID NO: 182071

SEQ ID NO: 182459 - RNA, 64 nt, Human; identical to SEQ ID NO: 182072

SEQ ID NO: 182460 - RNA, 64 nt, Human; identical to SEQ ID NO: 182073

SEQ ID NO: 182461 - RNA, 64 nt, Human; identical to SEQ ID NO: 182074

SEQ ID NO: 182462 - RNA, 64 nt, Human; identical to SEQ ID NO: 182075

SEQ ID NO: 182463 - RNA, 64 nt, Human; identical to SEQ ID NO: 182076

SEQ ID NO: 182464 - RNA, 64 nt, Human; identical to SEQ ID NO: 182077

SEQ ID NO: 182465 - RNA, 64 nt, Human; identical to SEQ ID NO: 182078

SEQ ID NO: 182466 - RNA, 64 nt, Human; identical to SEQ ID NO: 182079

SEQ ID NO: 182467 - RNA, 64 nt, Human; identical to SEQ ID NO: 182080

SEQ ID NO: 182468 - RNA, 64 nt, Human; identical to SEQ ID NO: 182081

SEQ ID NO: 182469 - RNA, 64 nt, Human; identical to SEQ ID NO: 182082

SEQ ID NO: 182470 - RNA, 64 nt, Human; identical to SEQ ID NO: 182083

SEQ ID NO: 182471 - RNA, 53 nt, Human; identical to SEQ ID NO: 182084

SEQ ID NO: 182472 - RNA, 64 nt, Human; identical to SEQ ID NO: 182085

SEQ ID NO: 182473 - RNA, 64 nt, Human; identical to SEQ ID NO: 182086

SEQ ID NO: 182474 - RNA, 64 nt, Human; identical to SEQ ID NO: 182087

SEQ ID NO: 182475 - RNA, 64 nt, Human; identical to SEQ ID NO: 182088

SEQ ID NO: 182476 - RNA, 64 nt, Human; identical to SEQ ID NO: 182089

SEQ ID NO: 182477 - RNA, 64 nt, Human; identical to SEQ ID NO: 182090

SEQ ID NO: 182478 - RNA, 64 nt, Human; identical to SEQ ID NO: 182091

SEQ ID NO: 182479 - RNA, 64 nt, Human; identical to SEQ ID NO: 182092

SEQ ID NO: 182480 - RNA, 64 nt, Human; identical to SEQ ID NO: 182093

SEQ ID NO: 182481 - RNA, 64 nt, Human; identical to SEQ ID NO: 182094

SEQ ID NO: 182482 - RNA, 64 nt, Human; identical to SEQ ID NO: 182095

SEQ ID NO: 182483 - RNA, 64 nt, Human; identical to SEQ ID NO: 182096

SEQ ID NO: 182484 - RNA, 64 nt, Human; identical to SEQ ID NO: 182097

SEQ ID NO: 182485 - RNA, 64 nt, Human; identical to SEQ ID NO: 182098

SEQ ID NO: 182486 - RNA, 64 nt, Human; identical to SEQ ID NO: 182099

SEQ ID NO: 182487 - RNA, 64 nt, Human; identical to SEQ ID NO: 182100

SEQ ID NO: 182488 - RNA, 64 nt, Human; identical to SEQ ID NO: 182101

SEQ ID NO: 182489 - RNA, 64 nt, Human; identical to SEQ ID NO: 182102

SEQ ID NO: 182490 - RNA, 64 nt, Human; identical to SEQ ID NO: 182103

SEQ ID NO: 182491 - RNA, 64 nt, Human; identical to SEQ ID NO: 182104

SEQ ID NO: 182492 - RNA, 64 nt, Human; identical to SEQ ID NO: 182105

SEQ ID NO: 182493 - RNA, 64 nt, Human; identical to SEQ ID NO: 182106

SEQ ID NO: 182494 - RNA, 64 nt, Human; identical to SEQ ID NO: 182107

SEQ ID NO: 182495 - RNA, 64 nt, Human; identical to SEQ ID NO: 182108

SEQ ID NO: 182496 - RNA, 64 nt, Human; identical to SEQ ID NO: 182109

SEQ ID NO: 182497 - RNA, 64 nt, Human; identical to SEQ ID NO: 182110

SEQ ID NO: 182498 - RNA, 64 nt, Human; identical to SEQ ID NO: 182111

SEQ ID NO: 182499 - RNA, 64 nt, Human; identical to SEQ ID NO: 182112

SEQ ID NO: 182500 - RNA, 64 nt, Human; identical to SEQ ID NO: 182113

SEQ ID NO: 182501 - RNA, 64 nt, Human; identical to SEQ ID NO: 182114

SEQ ID NO: 182502 - RNA, 64 nt, Human; identical to SEQ ID NO: 182115

SEQ ID NO: 182503 - RNA, 64 nt, Human; identical to SEQ ID NO: 182116

SEQ ID NO: 182504 - RNA, 64 nt, Human; identical to SEQ ID NO: 182117

SEQ ID NO: 182505 - RNA, 64 nt, Human; identical to SEQ ID NO: 182118

SEQ ID NO: 182506 - RNA, 64 nt, Human; identical to SEQ ID NO: 182119

SEQ ID NO: 182507 - RNA, 64 nt, Human; identical to SEQ ID NO: 182120

SEQ ID NO: 182508 - RNA, 64 nt, Human; identical to SEQ ID NO: 182121

SEQ ID NO: 182509 - RNA, 64 nt, Human; identical to SEQ ID NO: 182122

SEQ ID NO: 182510 - RNA, 64 nt, Human; identical to SEQ ID NO: 182123

SEQ ID NO: 182511 - RNA, 64 nt, Human; identical to SEQ ID NO: 182124

SEQ ID NO: 182512 - RNA, 64 nt, Human; identical to SEQ ID NO: 182125

SEQ ID NO: 182513 - RNA, 64 nt, Human; identical to SEQ ID NO: 182126

SEQ ID NO: 182514 - RNA, 64 nt, Human; identical to SEQ ID NO: 182127

SEQ ID NO: 182515 - RNA, 64 nt, Human; identical to SEQ ID NO: 182128

SEQ ID NO: 182516 - RNA, 64 nt, Human; identical to SEQ ID NO: 182129

SEQ ID NO: 182517 - RNA, 64 nt, Human; identical to SEQ ID NO: 182130

SEQ ID NO: 182518 - RNA, 64 nt, Human; identical to SEQ ID NO: 182131

SEQ ID NO: 182519 - RNA, 64 nt, Human; identical to SEQ ID NO: 182132

SEQ ID NO: 182520 - RNA, 64 nt, Human; identical to SEQ ID NO: 182133

SEQ ID NO: 182521 - RNA, 64 nt, Human; identical to SEQ ID NO: 182134

SEQ ID NO: 182522 - RNA, 64 nt, Human; identical to SEQ ID NO: 182135

SEQ ID NO: 182523 - RNA, 64 nt, Human; identical to SEQ ID NO: 182136

SEQ ID NO: 182524 - RNA, 64 nt, Human; identical to SEQ ID NO: 182137

SEQ ID NO: 182525 - RNA, 64 nt, Human; identical to SEQ ID NO: 182138

SEQ ID NO: 182526 - RNA, 64 nt, Human; identical to SEQ ID NO: 182139

SEQ ID NO: 182527 - RNA, 64 nt, Human; identical to SEQ ID NO: 182140

SEQ ID NO: 182528 - RNA, 64 nt, Human; identical to SEQ ID NO: 182141

SEQ ID NO: 182529 - RNA, 64 nt, Human; identical to SEQ ID NO: 182142

SEQ ID NO: 182530 - RNA, 64 nt, Human; identical to SEQ ID NO: 182143

SEQ ID NO: 182531 - RNA, 64 nt, Human; identical to SEQ ID NO: 182144

SEQ ID NO: 182532 - RNA, 64 nt, Human; identical to SEQ ID NO: 182145

SEQ ID NO: 182533 - RNA, 64 nt, Human; identical to SEQ ID NO: 182146

SEQ ID NO: 182534 - RNA, 64 nt, Human; identical to SEQ ID NO: 182147

SEQ ID NO: 182535 - RNA, 64 nt, Human; identical to SEQ ID NO: 182148

SEQ ID NO: 182536 - RNA, 64 nt, Human; identical to SEQ ID NO: 182149

SEQ ID NO: 182537 - RNA, 64 nt, Human; identical to SEQ ID NO: 182150

SEQ ID NO: 182538 - RNA, 64 nt, Human; identical to SEQ ID NO: 182151

SEQ ID NO: 182539 - RNA, 64 nt, Human; identical to SEQ ID NO: 182152

SEQ ID NO: 182540 - RNA, 64 nt, Human; identical to SEQ ID NO: 182153

SEQ ID NO: 182541 - RNA, 64 nt, Human; identical to SEQ ID NO: 182154

SEQ ID NO: 182542 - RNA, 64 nt, Human; identical to SEQ ID NO: 182155

SEQ ID NO: 182543 - RNA, 64 nt, Human; identical to SEQ ID NO: 182156

SEQ ID NO: 182544 - RNA, 64 nt, Human; identical to SEQ ID NO: 182157

SEQ ID NO: 182545 - RNA, 64 nt, Human; identical to SEQ ID NO: 182158

SEQ ID NO: 182546 - RNA, 64 nt, Human; identical to SEQ ID NO: 182159

SEQ ID NO: 182547 - RNA, 64 nt, Human; identical to SEQ ID NO: 182160

SEQ ID NO: 182548 - RNA, 64 nt, Human; identical to SEQ ID NO: 182161

SEQ ID NO: 182549 - RNA, 64 nt, Human; identical to SEQ ID NO: 182162

SEQ ID NO: 182550 - RNA, 64 nt, Human; identical to SEQ ID NO: 182163

SEQ ID NO: 182551 - RNA, 64 nt, Human; identical to SEQ ID NO: 182164

SEQ ID NO: 182552 - RNA, 64 nt, Human; identical to SEQ ID NO: 182165

SEQ ID NO: 182553 - RNA, 64 nt, Human; identical to SEQ ID NO: 182166

SEQ ID NO: 182554 - RNA, 64 nt, Human; identical to SEQ ID NO: 182167

SEQ ID NO: 182555 - RNA, 64 nt, Human; identical to SEQ ID NO: 182168

SEQ ID NO: 182556 - RNA, 64 nt, Human; identical to SEQ ID NO: 182169

SEQ ID NO: 182557 - RNA, 64 nt, Human; identical to SEQ ID NO: 182170

SEQ ID NO: 182558 - RNA, 64 nt, Human; identical to SEQ ID NO: 182171

SEQ ID NO: 182559 - RNA, 64 nt, Human; identical to SEQ ID NO: 182172

SEQ ID NO: 182560 - RNA, 64 nt, Human; identical to SEQ ID NO: 182173

SEQ ID NO: 182561 - RNA, 64 nt, Human; identical to SEQ ID NO: 182174

SEQ ID NO: 182562 - RNA, 64 nt, Human; identical to SEQ ID NO: 182175

SEQ ID NO: 182563 - RNA, 64 nt, Human; identical to SEQ ID NO: 182176

SEQ ID NO: 182564 - RNA, 64 nt, Human; identical to SEQ ID NO: 182177

SEQ ID NO: 182565 - RNA, 64 nt, Human; identical to SEQ ID NO: 182178

SEQ ID NO: 182566 - RNA, 64 nt, Human; identical to SEQ ID NO: 182179

SEQ ID NO: 182567 - RNA, 64 nt, Human; identical to SEQ ID NO: 182180

SEQ ID NO: 182568 - RNA, 64 nt, Human; identical to SEQ ID NO: 182181

SEQ ID NO: 182569 - RNA, 64 nt, Human; identical to SEQ ID NO: 182182

SEQ ID NO: 182570 - RNA, 64 nt, Human; identical to SEQ ID NO: 182183

SEQ ID NO: 182571 - RNA, 64 nt, Human; identical to SEQ ID NO: 182184

SEQ ID NO: 182572 - RNA, 64 nt, Human; identical to SEQ ID NO: 182185

SEQ ID NO: 182573 - RNA, 64 nt, Human; identical to SEQ ID NO: 182186

SEQ ID NO: 182574 - RNA, 64 nt, Human; identical to SEQ ID NO: 182187

SEQ ID NO: 182575 - RNA, 64 nt, Human; identical to SEQ ID NO: 182188

SEQ ID NO: 182576 - RNA, 64 nt, Human; identical to SEQ ID NO: 182189

SEQ ID NO: 182577 - RNA, 64 nt, Human; identical to SEQ ID NO: 182190

SEQ ID NO: 182578 - RNA, 64 nt, Human; identical to SEQ ID NO: 182191

SEQ ID NO: 182579 - RNA, 64 nt, Human; identical to SEQ ID NO: 182192

SEQ ID NO: 182580 - RNA, 64 nt, Human; identical to SEQ ID NO: 182193

SEQ ID NO: 182581 - RNA, 64 nt, Human; identical to SEQ ID NO: 182194

SEQ ID NO: 182582 - RNA, 64 nt, Human; identical to SEQ ID NO: 182195

SEQ ID NO: 182583 - RNA, 64 nt, Human; identical to SEQ ID NO: 182196

SEQ ID NO: 182584 - RNA, 64 nt, Human; identical to SEQ ID NO: 182197

SEQ ID NO: 182585 - RNA, 64 nt, Human; identical to SEQ ID NO: 182198

SEQ ID NO: 182586 - RNA, 64 nt, Human; identical to SEQ ID NO: 182199

SEQ ID NO: 182587 - RNA, 64 nt, Human; identical to SEQ ID NO: 182200

SEQ ID NO: 182588 - RNA, 64 nt, Human; identical to SEQ ID NO: 182201

SEQ ID NO: 182589 - RNA, 64 nt, Human; identical to SEQ ID NO: 182202

SEQ ID NO: 182590 - RNA, 64 nt, Human; identical to SEQ ID NO: 182203

SEQ ID NO: 182591 - RNA, 64 nt, Human; identical to SEQ ID NO: 182204

SEQ ID NO: 182592 - RNA, 64 nt, Human; identical to SEQ ID NO: 182205

SEQ ID NO: 182593 - RNA, 64 nt, Human; identical to SEQ ID NO: 182206

SEQ ID NO: 182594 - RNA, 64 nt, Human; identical to SEQ ID NO: 182207

SEQ ID NO: 182595 - RNA, 64 nt, Human; identical to SEQ ID NO: 182208

SEQ ID NO: 182596 - RNA, 64 nt, Human; identical to SEQ ID NO: 182209

SEQ ID NO: 182597 - RNA, 64 nt, Human; identical to SEQ ID NO: 182210

SEQ ID NO: 182598 - RNA, 64 nt, Human; identical to SEQ ID NO: 182211

SEQ ID NO: 182599 - RNA, 64 nt, Human; identical to SEQ ID NO: 182212

SEQ ID NO: 182600 - RNA, 64 nt, Human; identical to SEQ ID NO: 182213

SEQ ID NO: 182601 - RNA, 64 nt, Human; identical to SEQ ID NO: 182214

SEQ ID NO: 182602 - RNA, 64 nt, Human; identical to SEQ ID NO: 182215

SEQ ID NO: 182603 - RNA, 64 nt, Human; identical to SEQ ID NO: 182216

SEQ ID NO: 182604 - RNA, 64 nt, Human; identical to SEQ ID NO: 182217

SEQ ID NO: 182605 - RNA, 64 nt, Human; identical to SEQ ID NO: 182218

SEQ ID NO: 182606 - RNA, 64 nt, Human; identical to SEQ ID NO: 182219

SEQ ID NO: 182607 - RNA, 64 nt, Human; identical to SEQ ID NO: 182220

SEQ ID NO: 182608 - RNA, 64 nt, Human; identical to SEQ ID NO: 182221

SEQ ID NO: 182609 - RNA, 64 nt, Human; identical to SEQ ID NO: 182222

SEQ ID NO: 182610 - RNA, 64 nt, Human; identical to SEQ ID NO: 182223

SEQ ID NO: 182611 - RNA, 64 nt, Human; identical to SEQ ID NO: 182224

SEQ ID NO: 182612 - RNA, 64 nt, Human; identical to SEQ ID NO: 182225

SEQ ID NO: 182613 - RNA, 64 nt, Human; identical to SEQ ID NO: 182226

SEQ ID NO: 182614 - RNA, 64 nt, Human; identical to SEQ ID NO: 182227

SEQ ID NO: 182615 - RNA, 64 nt, Human; identical to SEQ ID NO: 182228

SEQ ID NO: 182616 - RNA, 64 nt, Human; identical to SEQ ID NO: 182229

SEQ ID NO: 182617 - RNA, 64 nt, Human; identical to SEQ ID NO: 182230

SEQ ID NO: 182618 - RNA, 64 nt, Human; identical to SEQ ID NO: 182231

SEQ ID NO: 182619 - RNA, 64 nt, Human; identical to SEQ ID NO: 182232

SEQ ID NO: 182620 - RNA, 64 nt, Human; identical to SEQ ID NO: 182233

SEQ ID NO: 182621 - RNA, 64 nt, Human; identical to SEQ ID NO: 182234

SEQ ID NO: 182622 - RNA, 64 nt, Human; identical to SEQ ID NO: 182235

SEQ ID NO: 182623 - RNA, 64 nt, Human; identical to SEQ ID NO: 182236

SEQ ID NO: 182624 - RNA, 64 nt, Human; identical to SEQ ID NO: 182237

SEQ ID NO: 182625 - RNA, 64 nt, Human; identical to SEQ ID NO: 182238

SEQ ID NO: 182626 - RNA, 64 nt, Human; identical to SEQ ID NO: 182239

SEQ ID NO: 182627 - RNA, 64 nt, Human; identical to SEQ ID NO: 182240

SEQ ID NO: 182628 - RNA, 64 nt, Human; identical to SEQ ID NO: 182241

SEQ ID NO: 182629 - RNA, 64 nt, Human; identical to SEQ ID NO: 182242

SEQ ID NO: 182630 - RNA, 64 nt, Human; identical to SEQ ID NO: 182243

SEQ ID NO: 182631 - RNA, 64 nt, Human; identical to SEQ ID NO: 182244

SEQ ID NO: 182632 - RNA, 64 nt, Human; identical to SEQ ID NO: 182245

SEQ ID NO: 182633 - RNA, 64 nt, Human; identical to SEQ ID NO: 182246

SEQ ID NO: 182634 - RNA, 64 nt, Human; identical to SEQ ID NO: 182247

SEQ ID NO: 182635 - RNA, 64 nt, Human; identical to SEQ ID NO: 182248

SEQ ID NO: 182636 - RNA, 64 nt, Human; identical to SEQ ID NO: 182249

SEQ ID NO: 182637 - RNA, 64 nt, Human; identical to SEQ ID NO: 182250

SEQ ID NO: 182638 - RNA, 64 nt, Human; identical to SEQ ID NO: 182251

SEQ ID NO: 182639 - RNA, 64 nt, Human; identical to SEQ ID NO: 182252

SEQ ID NO: 182640 - RNA, 64 nt, Human; identical to SEQ ID NO: 182253

SEQ ID NO: 182641 - RNA, 64 nt, Human; identical to SEQ ID NO: 182254

SEQ ID NO: 182642 - RNA, 64 nt, Human; identical to SEQ ID NO: 182255

SEQ ID NO: 182643 - RNA, 64 nt, Human; identical to SEQ ID NO: 182256

SEQ ID NO: 182644 - RNA, 64 nt, Human; identical to SEQ ID NO: 182257

SEQ ID NO: 182645 - RNA, 64 nt, Human; identical to SEQ ID NO: 182258

SEQ ID NO: 182646 - RNA, 64 nt, Human; identical to SEQ ID NO: 182259

SEQ ID NO: 182647 - RNA, 64 nt, Human; identical to SEQ ID NO: 182260

SEQ ID NO: 182648 - RNA, 64 nt, Human; identical to SEQ ID NO: 182261

SEQ ID NO: 182649 - RNA, 64 nt, Human; identical to SEQ ID NO: 182262

SEQ ID NO: 182650 - RNA, 64 nt, Human; identical to SEQ ID NO: 182263

SEQ ID NO: 182651 - RNA, 64 nt, Human; identical to SEQ ID NO: 182264

SEQ ID NO: 182652 - RNA, 64 nt, Human; identical to SEQ ID NO: 182265

SEQ ID NO: 182653 - RNA, 59 nt, Human; identical to SEQ ID NO: 182266

SEQ ID NO: 182654 - RNA, 64 nt, Human; identical to SEQ ID NO: 182267

SEQ ID NO: 182655 - RNA, 64 nt, Human; identical to SEQ ID NO: 182268

SEQ ID NO: 182656 - RNA, 64 nt, Human
gagauguaaaaaugguccagcagagacaagcucccguggaaaacagacaggagcaugggggcag

SEQ ID NO: 182657 - RNA, 64 nt, Human
uguuggccuggcuucuggaauggacugaguccaucguggaaagggcugggggcaggaggaggug

SEQ ID NO: 182658 - RNA, 64 nt, Human
aaguucucuccuccccagaauggauuaacagcugcguggaaagugggggagagaguggauggag

SEQ ID NO: 182659 - RNA, 64 nt, Human
cuuguaugcuaucauugauauucccaguggugcccguggaaagagggagaaagagaagcugaac

SEQ ID NO: 182660 - RNA, 64 nt, Human
ggauuucucuaacccuauccuaauuguccacauacguggaaacaauccuguuacucugucccac

SEQ ID NO: 182661 - RNA, 64 nt, Human
ccauagccaaaaugauguacaguuaaaaagagugcguggaaacaaccaaacaauauaaccuaaa

SEQ ID NO: 182662 - RNA, 64 nt, Human
ucguauuuauaaucuuaauuuauauagugaccaccguggaaacaaacgccucuuguauugucau

SEQ ID NO: 182663 - RNA, 64 nt, Human
agucuuugaggucucugucucuauucaugcgccucguggaaaauuaccuugguacaaugguagc

SEQ ID NO: 182664 - RNA, 64 nt, Human
gucacaauacuguugugcgcacaucgcgguagggcguggaaaggggcaggccagagcuacccgc

SEQ ID NO: 182665 - RNA, 64 nt, Human
gccuugagacaucaauuuugcaacguauuuccuucguggaaaggauuuagauuguaacccgcac

SEQ ID NO: 182666 - RNA, 64 nt, Human
aaguucugccuuucugaucaaucuuuuggguucacguggaaaccaggacuuggcaacaugaugu

SEQ ID NO: 182667 - RNA, 64 nt, Human
cauaagauaauucacacugaagagaaacugcaaacguggaaagugugacaaagcuugcaaccac

SEQ ID NO: 182668 - RNA, 64 nt, Human
gugccgccuuacuuccugcuucgagaauguauaacguggaaauccacgggaccaaauuucugca

SEQ ID NO: 182669 - RNA, 64 nt, Human
uccuccccaggcaggcaggaggccgcggggagcacguggaaaguuggcugcugccuggggaagc

SEQ ID NO: 182670 - RNA, 64 nt, Human
ggcuggacuaaucugggaucgcggugauuugcagcguggaaaagaaaugcagaugaucaugucu

SEQ ID NO: 182671 - RNA, 64 nt, Human
ucacaggcuuaaucuucagcuucuaugcaccaagcguggaaaaggagaaaguccugcagaauca

SEQ ID NO: 182672 - RNA, 64 nt, Human
auaauuuguaggcuuuguaaugauugaaugcaagcguggaaauuuaggcugaacucucuaucaa

SEQ ID NO: 182673 - RNA, 64 nt, Human
ggaggccuaaaggacaggagaaaaggucuucaaucguggaaagaaaauuaaauguuguauuaaa

SEQ ID NO: 182674 - RNA, 64 nt, Human
uuucuuuaaaaaucuuuauuaguggcuauaaugacguggaaauguaaucuguguuuucugguuu

SEQ ID NO: 182675 - RNA, 64 nt, Human
ugccuauacacccagcagcccaagguggagggugcguggaaaugagaaagcuuuuuacccaaaa

SEQ ID NO: 182676 - RNA, 64 nt, Human
cccagcuagauaaugacuuguccaagauggcacacguggaaaguugaucugcaccagaacccgg

SEQ ID NO: 182677 - RNA, 64 nt, Human
gcguggaggccaggaggcuggggccccugggcugcguggaaaaagggcucuuuggcccaggaga

SEQ ID NO: 182678 - RNA, 64 nt, Human
ucuacccugucucuccccgccacccccgacuucccguggaaauucccaacucgguucucaugga

SEQ ID NO: 182679 - RNA, 64 nt, Human
uuuugcauggucuaaauuguguuuauuccaaccacguggaaagcuccuggaaagaaauuuuaca

SEQ ID NO: 182680 - RNA, 64 nt, Human
agagaacuuugggagcaaagcaacugauguccugcguggaaaguccucuucuccccaugaaauu

SEQ ID NO: 182681 - RNA, 64 nt, Human
agcaaugcacugacugggccacaucuugaaaacucguggaaagggaaaggggaggagaugggac

SEQ ID NO: 182682 - RNA, 64 nt, Human
aaucagaauaaauuaauauuguauugcugcugugcguggaaaaagacgauguuuauguucuuau

SEQ ID NO: 182683 - RNA, 64 nt, Human
guuuauuuuuuaucacaagcaccuuugaaauguacguggaaaacgucggcugcucgugagaauc

SEQ ID NO: 182684 - RNA, 64 nt, Human
ucuacauccuggggugcagcugcaaaaggccagacguggaaaggccuguauccugccagugucc

SEQ ID NO: 182685 - RNA, 64 nt, Human
aagaggugugcacaccaaagcuauuggagauuugcguggaaaucucagauucuucacuggugag

SEQ ID NO: 182686 - RNA, 64 nt, Human
cguaguaaauguauacuuaguguuuucuuacaaucguggaaaucagaaauguuuauacaggugu

SEQ ID NO: 182687 - RNA, 64 nt, Human
aacaggaauggagagaggacucaacugggacccacguggaaaagaccgagcaggccacagaggc

SEQ ID NO: 182688 - RNA, 64 nt, Human
gagcuguggguucgcguccuggguugcgugcauucguggaaagcggcguagccgugcgugugug

SEQ ID NO: 182689 - RNA, 64 nt, Human
augcuucaaagagcuuaguuugcgguuuccuggacguggaaacaaguaucugaguucccuggag

SEQ ID NO: 182690 - RNA, 64 nt, Human
aaagcuuuaauguugagcaugcugcgagcugcugcguggaaaggccucuguaugggccgaagac

SEQ ID NO: 182691 - RNA, 64 nt, Human
ccugucagucaggcgaauucaaccggaaaagggacguggaaaggccacugugaacugcagaggg

SEQ ID NO: 182692 - RNA, 64 nt, Human
ugagaacacggugugucucgacacguaccacguacguggaaacacaagagcccaccacuugaau

SEQ ID NO: 182693 - RNA, 64 nt, Human
guucucuuuguccaaucagauggcaagggcagugcguggaaaggccggggaggugcagaaacca

SEQ ID NO: 182694 - RNA, 64 nt, Human
aacaaaacaaaaaaaaaagcuuggaacuccaucacguggaaaaacuagauccuguugguuauag

SEQ ID NO: 182695 - RNA, 64 nt, Human
ucuuauggagucuuaugauggauuuuuaacuucccguggaaaaaaaaauaaaggcuguaucuaa

SEQ ID NO: 182696 - RNA, 64 nt, Human
agucaggugggcggugugucuuuccagaaggucacguggaaaugucucgggacuugggucccgg

SEQ ID NO: 182697 - RNA, 64 nt, Human
cccgucugagaaggaucuuguguucaguuagagucguggaaaaaucccugauccuucaagguca

SEQ ID NO: 182698 - RNA, 64 nt, Human
uguccacagcagucagucguguaugacccuguaacguggaaaucuuaucacacaccuguuaucc

SEQ ID NO: 182699 - RNA, 57 nt, Human
cccgauuccuggaaguaugauggaucacguggaaagugaccagauggccgucauagu

SEQ ID NO: 182700 - RNA, 63 nt, Human
aggaggaagugcucuugugagaggcagucccugcguggaaaguugcugggcccccgcccccgg

SEQ ID NO: 182701 - RNA, 64 nt, Human
aaauaauuuuguaagaggcuucaaaauguuuauacguggaaacacaccuacaugaaaagcagaa

SEQ ID NO: 182702 - RNA, 64 nt, Human
ucccuggcuugcugcugagcuaaaggaccagggacguggaaacaggaggugaacuaaggcaccc

SEQ ID NO: 182703 - RNA, 64 nt, Human
uugguuuggaauagggaaaaagguaagagacuaacguggaaaggugcuaacucagagacuggag

SEQ ID NO: 182704 - RNA, 64 nt, Human
auuuaaauaacaaaaauaauaccagauuuuaagccguggaaaauguucuugaucauuugcaguu

SEQ ID NO: 182705 - RNA, 64 nt, Human
uguggaugagcccucagaacccuuggcuugcccacguggaaaagggauagagguuggguuuccc

SEQ ID NO: 182706 - RNA, 64 nt, Human
uggugccgaagugucuuccaccugcccugcggaccguggaaaauaaaaggcucugcccccagug

SEQ ID NO: 182707 - RNA, 64 nt, Human
gcagugucucccaggugugcacggacaccugguccguggaaacaggugugaugggcacaggcug

SEQ ID NO: 182708 - RNA, 64 nt, Human
gagagguuucucaggggaaacucaaaucucuguccguggaaauuuucaagaagggaagguaaag

SEQ ID NO: 182709 - RNA, 64 nt, Human
cugagaccuaacucacuggacucagaggaggaaucguggaaaacaagagcaaaacuaccccaca

SEQ ID NO: 182710 - RNA, 64 nt, Human
ccccgucuccagccccuguacuuuggcuugaccucguggaaauauuuauuuucuuaaggaaaca

SEQ ID NO: 182711 - RNA, 64 nt, Human
cucugucuaaaaauaugggagcugagauuccguucguggaaaaaagacaaggccacccucucgc

SEQ ID NO: 182712 - RNA, 64 nt, Human
gggccugguccaugauggagucagguuugggguucguggaaagggugcugcuucccucugccug

SEQ ID NO: 182713 - RNA, 64 nt, Human
cacuguggauguuuugugggaggcagcauggcaccguggaaagggcaguagacguggagccggc

SEQ ID NO: 182714 - RNA, 64 nt, Human
agcucagcaagugcacaagccuuacuuugguuaccguggaaaccacugccgccccuccccgaug

SEQ ID NO: 182715 - RNA, 64 nt, Human
uaugaaacauucuuucugagauauaucaaccacacguggaaaagccuuucagucauacaugcaa

SEQ ID NO: 182716 - RNA, 64 nt, Human
ggaucauccuuccucuguuccucuuucccugccacguggaaacaaucaucagauccuugcccca

SEQ ID NO: 182717 - RNA, 64 nt, Human
cugaggccugcuagaaucacugccgcugugcuuucguggaaaugacaguuccuuguuuuuuuug

SEQ ID NO: 182718 - RNA, 64 nt, Human
uucccucuucuaacccaacugacuuguaucuguccguggaaaauuucaguccagaagaauugac

SEQ ID NO: 182719 - RNA, 64 nt, Human
gggagagauugugucaugugccacacgagaccaacguggaaaagucugaagggccuugggagac

SEQ ID NO: 182720 - RNA, 64 nt, Human
accugcccaaccccaacacgugcuuauguaaccacguggaaagcggccccugcugccccuccac

SEQ ID NO: 182721 - RNA, 64 nt, Human
gccgguggucagugagggaguuaaguggcuucuccguggaaacacagccuucugcugcagcaga

SEQ ID NO: 182722 - RNA, 64 nt, Human
aaaaaucuucugaauaagaucuucccucuuugcccguggaaaaucugaacaaucuuugagccau

SEQ ID NO: 182723 - RNA, 64 nt, Human
ccucuguugaaauugucaccccacagcugcccgccguggaaauugaggaagggcggcuggagau

SEQ ID NO: 182724 - RNA, 64 nt, Human
uguuugcacgguggggggauggguggggggagggcguggaaauagggauucugugucuuugugu

SEQ ID NO: 182725 - RNA, 64 nt, Human
gaagugaucauagaucaugaauaaacuacuaauucguggaaauguaauaauuauaggaacgucu

SEQ ID NO: 182726 - RNA, 64 nt, Human
ugaagaccccccggagugcugagcuucagggcugcguggaaagaguuuuuacucucuuuuucua

SEQ ID NO: 182727 - RNA, 64 nt, Human
uucucuuaauuguaaugguuccuuggaaagucaucguggaaaaugaaggcuggcucauacauuu

SEQ ID NO: 182728 - RNA, 64 nt, Human
augaaagcaaaaaauuugugaauacuggaaguaacguggaaaucuaauguggaagccauugugg

SEQ ID NO: 182729 - RNA, 64 nt, Human
gggaccuuugggggugaguuccccuuuguccucucguggaaacagcacacagcaagcaaccaca

SEQ ID NO: 182730 - RNA, 64 nt, Human
gagagcagggagggguaggguggacaggcgaugccguggaaagacgucucgguggaaacugcca

SEQ ID NO: 182731 - RNA, 64 nt, Human
ucaguucuugaccaaaggugcuacgagaaccugccguggaaacuuccaguugugcgucugcccc

SEQ ID NO: 182732 - RNA, 64 nt, Human
aucccaaaauuuguacauuucuugcugcuccuggcguggaaacuuaagugagaccaccaaauac

SEQ ID NO: 182733 - RNA, 64 nt, Human
uuucacacaugugcauugcagagacgucaugauucguggaaaaauaaagcagcuuauaauauca

SEQ ID NO: 182734 - RNA, 64 nt, Human
auagccgugcacucuugaccccgucagcguccaacguggaaaaggcguuaccucuucucccagc

SEQ ID NO: 182735 - RNA, 64 nt, Human
acgucucuaacaauccuucgcuuuuccucacucacguggaaaugugaacugucccggcucuguc

SEQ ID NO: 182736 - RNA, 64 nt, Human
uuguauuguuuggaagaaaaaaugaugauagagucccaaaaagaagagaaaaaaaaugcccaag

SEQ ID NO: 182737 - RNA, 64 nt, Human
uauauuauaggcuucaauguuuucaugaauguuacccaaaaagcuguguuuucuuuggucagag

SEQ ID NO: 182738 - RNA, 64 nt, Human
guuggaucgcuuccuagaaauaagcaacaccucucccaaaaagcagcccacaaggcaggggccc

SEQ ID NO: 182739 - RNA, 64 nt, Human
cccuucucaccuucccuucuccccgaccccaccccccaaaaaagcuacuucuucauuccguggu

SEQ ID NO: 182740 - RNA, 64 nt, Human
ccaugugguucucagacuugaaucuucucggccccccaaaaagaaggaccucauuucuuauagc

SEQ ID NO: 182741 - RNA, 64 nt, Human
ucuccugccuccaguggcccugccgcagaugucucccaaaaaguugagccuuucuagauggcuu

SEQ ID NO: 182742 - RNA, 64 nt, Human
agugcucuccaauaaaguagggggagaaagcaaacccaaaaacccgcuucuaaaauggugauau

SEQ ID NO: 182743 - RNA, 64 nt, Human
gucuccuucccuccuuuagaacucauuuucucuucccaaaaaguguuaucuuuuccuuaaauau

SEQ ID NO: 182744 - RNA, 64 nt, Human
uugccaaaucuuuuaaacuuauguauucaccaagcccaaaaauagauuguggcucccaggauuc

SEQ ID NO: 182745 - RNA, 64 nt, Human
gugaauaaguaguagucauuauuugugaaaaauucccaaaaagcuggggaaaacaaauguguaa

SEQ ID NO: 182746 - RNA, 64 nt, Human
gucccauuugccuugcaauuagcauucugucucccccaaaaaagaaugugcuaugaagcuuucu

SEQ ID NO: 182747 - RNA, 64 nt, Human
aucuccucaaacccagaagguuuaaucacuucaucccaaaaaugggauugugaaugucagcaaa

SEQ ID NO: 182748 - RNA, 64 nt, Human
aggugacuagggacuuucuaagaagauaccuacccccaaaaaacaauuauguaauugaaaacca

SEQ ID NO: 182749 - RNA, 64 nt, Human
uccuucuaacgaguuguagaaaucugaguaaccacccaaaaaagcaauagaauguuucugucac

SEQ ID NO: 182750 - RNA, 64 nt, Human
uaaaaggcauuaggugggcauuuuucugugugcccccaaaaagcuccauggaaacaggcaccug

SEQ ID NO: 182751 - RNA, 64 nt, Human
aagagaccacauggggcguacuauuuuuauugagcccaaaaacaagcaaaaccaaagaauaugu

SEQ ID NO: 182752 - RNA, 64 nt, Human
uacuaaaccuugaaaacuagaaucuaaugucuaccccaaaaaaguaguucuuugauauuuuaua

SEQ ID NO: 182753 - RNA, 64 nt, Human
caucauuacuguggacauggcaguuguugcuccacccaaaaaaacagacuccaggugaggcugc

SEQ ID NO: 182754 - RNA, 64 nt, Human
caucaagccucuaaagaaugucucaccuccucugcccaaaaaugaugccuuucuguaggcuggu

SEQ ID NO: 182755 - RNA, 64 nt, Human
cuugagagaacaggggagcaagccugccccaguacccaaaaaacaauggcuaucauguacuggg

SEQ ID NO: 182756 - RNA, 64 nt, Human
uuuuuccccuuauauuucccuacccuacccuccccccaaaaaaaagcaaaaaaaaaaaaaaaaa

SEQ ID NO: 182757 - RNA, 64 nt, Human
ccccaaggaauaaggaagguucuuuuaccaggagcccaaaaaagggcacugccuuuucugcuuu

SEQ ID NO: 182758 - RNA, 64 nt, Human
uaaugaauagauuuugaauugauucuuuagaccccccaaaaagugucaguucuaauggggaaau

SEQ ID NO: 182759 - RNA, 64 nt, Human
uguuuccuggaaagucgauguaauuaacugauggcccaaaaacuaccucaagagaccuggcccu

SEQ ID NO: 182760 - RNA, 64 nt, Human
gccuauguaaggaaagugcuauucacccaguaaacccaaaaaaagcaaauggauaaugcuggcc

SEQ ID NO: 182761 - RNA, 64 nt, Human
gaccagccugggcaacauagugagaccccugucucccaaaaauuuuuuuuaauuagcugugcgc

SEQ ID NO: 182762 - RNA, 57 nt, Human
aaaaagaaaaugcugauuaauuauauucccaaaaaugaaaacacugagaaccaugga

SEQ ID NO: 182763 - RNA, 64 nt, Human
caagucuuugagugugcacuaaaagugucacacucccaaaaaacucacaaaacauuuugcuaaa

SEQ ID NO: 182764 - RNA, 64 nt, Human
acaucucacuucuacuccugcucuccuaguuccccccaaaaaagaaauacugaccagugucucu

SEQ ID NO: 182765 - RNA, 64 nt, Human
ccuuggggauaaguuuagugaggggauuggaauccccaaaaagauaacauuuuucuucugcuuu

SEQ ID NO: 182766 - RNA, 64 nt, Human
uggggccccucaacugcagucagagagcaagccccccaaaaaaaagaaaaagaaaaggaggcag

SEQ ID NO: 182767 - RNA, 64 nt, Human
uauaugaguguaugaauuugucacauguaucacccccaaaaaaagagaaaaagaaaaauagaag

SEQ ID NO: 182768 - RNA, 64 nt, Human
augucuucccaugacucaaguuuuguuaaauaugcccaaaaacuuugauuggcaguuucuucgg

SEQ ID NO: 182769 - RNA, 64 nt, Human
uuaaauacauaucauuuuuaaaaauaaaaaaaaacccaaaaauaaugcaugcauaauuuaaaug

SEQ ID NO: 182770 - RNA, 64 nt, Human
gaacucauccauguaaccaaaaaccacuuguacccccaaaaacuauugaaauaaaaauuuaaaa

SEQ ID NO: 182771 - RNA, 64 nt, Human
uuaagcccugucucagaaaaaaaaaaaacaaaaacccaaaaaguacuuaaaguuucauuuacuu

SEQ ID NO: 182772 - RNA, 64 nt, Human
aguugcauaccuagucuggaguugugauuauuuucccaaaaaauguguuuuuguaauuacuauu

SEQ ID NO: 182773 - RNA, 64 nt, Human
gcuaaaaagaaggaauacacacaggaauaaugaccccaaaaaugcuuagauaaggccccuauac

SEQ ID NO: 182774 - RNA, 64 nt, Human
aauggaacugauggauuccucucccacugccucacccaaaaaaaacggucuuggcggccuaggg

SEQ ID NO: 182775 - RNA, 64 nt, Human
cuuuuauuauagacagugaauaaaacaccaaaaacccaaaaaugcuuuaaccacaguauaaaua

SEQ ID NO: 182776 - RNA, 64 nt, Human
uugccucgucuucuccaaaacugaauuuucaccccccaaaaagauguccauugccugcacugcc

SEQ ID NO: 182777 - RNA, 64 nt, Human
agauuuuucuaucuucuguggucgcccgcccccccccaaaaaaauaccauuuaugguucucucc

SEQ ID NO: 182778 - RNA, 64 nt, Human
ugguggaaaaaagaaaacaaccacccccccacugcccaaaaaaaaaagcccugcccuguugcuc

SEQ ID NO: 182779 - RNA, 64 nt, Human
acacaugguuaaauguuaaauuuuaauuaaggcccccaaaaauuaaauauaacuuuuuaaaaug

SEQ ID NO: 182780 - RNA, 64 nt, Human
uauuuuuuguuuuguuuccuccccuaucuguauucccaaaaauuacuuuggggcuaauuuaaca

SEQ ID NO: 182781 - RNA, 64 nt, Human
acucugcuuuuauccuuuggagccugggagacuccccaaaaagguaaaugcuaucaagaguaga

SEQ ID NO: 182782 - RNA, 64 nt, Human
agggagaggcuuuucucugagccucccucaucugcccaaaaacaaauccucaaaagaaauuuga

SEQ ID NO: 182783 - RNA, 64 nt, Human
ccacuauuguguguugcuaaucauugacuguagucccaaaaaagccuugugaaaauguuaugcc

SEQ ID NO: 182784 - RNA, 64 nt, Human
auucuuuucaaaucaggaaagauuagaaaaggaacccaaaaaacccuuuaacagugugaaucuu

SEQ ID NO: 182785 - RNA, 64 nt, Human
uuguaaggcugggcuucaaaaucaaaacaaaaaccccaaaaacagcaggcaaaugcuuuuuaac

SEQ ID NO: 182786 - RNA, 64 nt, Human
uuuaguagcagaaaugggaugauuguuaaaguuccccaaaaauguuggcaugaaauuaauuuuu

SEQ ID NO: 182787 - RNA, 64 nt, Human
ugggcuacagagugagacugcaucucaaaaaaaacccaaaaaacaaaaacaaacaacaacaaca

SEQ ID NO: 182788 - RNA, 64 nt, Human
ggguugcaauuaaaaugugauuggcuuagguaaucccaaaaacuaacaaauaacaaaggugcau

SEQ ID NO: 182789 - RNA, 64 nt, Human
aauuucaaucuuauuugugauuaccuuucuccuucccaaaaagcuuuaucuauuaccaaaaguc

SEQ ID NO: 182790 - RNA, 64 nt, Human
ggggccuguaauauuuuuuucugaguuucuucugcccaaaaauauaauauagaacuaauugcua

SEQ ID NO: 182791 - RNA, 64 nt, Human
auagaauaaaaaugacaacaaaguaaaaggguaucccaaaaauaaaacuauccuuuuggaaaaa

SEQ ID NO: 182792 - RNA, 64 nt, Human
ugccuggcagcucuuuggagcuggcucacauuuucccaaaaaaaguugaucucucccagugggc

SEQ ID NO: 182793 - RNA, 64 nt, Human
cagaacuacuucuuacuucuuugcccugcccucucccaaaaaacuacuucuuuuuucaaaagaa

SEQ ID NO: 182794 - RNA, 64 nt, Human
uccaaccccucuucagagaaaggugucccauggccccaaaaagaacugccaaguuuuggugagg

SEQ ID NO: 182795 - RNA, 64 nt, Human
ucagcacgggcggaagaaacucccggagagcucacccaaaaaacaaggagaucccaucuagauu

SEQ ID NO: 182796 - RNA, 64 nt, Human
ucuuuaaguuagguaucuaccuucccaccagccccccaaaaaaccucucaguaguuucuuucag

SEQ ID NO: 182797 - RNA, 64 nt, Human
aauacauuaucagugauugaaacguuuacauguacccaaaaaccauaaucaucucuuggaagaa

SEQ ID NO: 182798 - RNA, 64 nt, Human
uaagaugcugaggacuaaaaccauuuuuuuugcacccaaaaaaaaaggcaggaaaaugaucauc

SEQ ID NO: 182799 - RNA, 64 nt, Human
gaccuucuggaagcaagaccugggccuccauggccccaaaaacucccuaggugauccgaugugc

SEQ ID NO: 182800 - RNA, 64 nt, Human
ucuucgccuggcugcaacucaauucuuccuucuacccaaaaacacuccagucaguuguacuuac

SEQ ID NO: 182801 - RNA, 64 nt, Human
aggucacagaugggccgugcacgggcagaugggccccaaaaaaucuuggcgaaggucgguaaag

SEQ ID NO: 182802 - RNA, 64 nt, Human
ccccacaagcugagucuggccuucuccagcuggccccaaaaaaggccuuugcuacauccugauu

SEQ ID NO: 182803 - RNA, 64 nt, Human
ggugagacuccaucucaaaaaagaaacaaaaaaacccaaaaaguuuucuuuacuguugguuaaa

SEQ ID NO: 182804 - RNA, 64 nt, Human
ggccagaguccuuuccaaggcuucuccaauucugcccaaaaauaugguugauaguuuaccugaa

SEQ ID NO: 182805 - RNA, 64 nt, Human
acagcaguuucucuaguucuaaauuuuaccaauucccaaaaaaccuaaguuuugcugaaaucug

SEQ ID NO: 182806 - RNA, 64 nt, Human
gacaacacuacccucguaacuacugcuucuacuacccaaaaauaagaauuucaacacuacuucc

SEQ ID NO: 182807 - RNA, 64 nt, Human
gucacuaaauauacacuuuagauagaugaagaagcccaaaaacagauaaauuccugauugcuaa

SEQ ID NO: 182808 - RNA, 64 nt, Human
agagauguuauauucuuuucucauuucuuccccacccaaaaauaagcuaccauauagcuuauaa

SEQ ID NO: 182809 - RNA, 64 nt, Human
gcacucuagccugggugacagagucagacuccgucccaaaaaaacaaacaaacaaaacaaaaca

SEQ ID NO: 182810 - RNA, 64 nt, Human
gaauccacaguccaauuccacuucaauugauagacccaaaaaauauaauuuaaucaaaguucua

SEQ ID NO: 182811 - RNA, 64 nt, Human
gaagggaaaggaguucagacagacagacguauuccccaaaaagggauaccccaggccgauggug

SEQ ID NO: 182812 - RNA, 64 nt, Human
caauuggagaaucuugccuuuuuucuuggcuccccccaaaaauacaaaccaacagaaacuuguu

SEQ ID NO: 182813 - RNA, 64 nt, Human
auagguauuuuagaaugugaauugaagaauggaucccaaaaacuucagaaagaggauagcaaaa

SEQ ID NO: 182814 - RNA, 64 nt, Human
ugggcaacagagcaagaccccauccuccaccccccccaaaaaauagaaagaaaaaaaaaguuug

SEQ ID NO: 182815 - RNA, 64 nt, Human
caaaagaucauguugggauuaacuugccuuuuuccccaaaaaauaaacucucaggcaagcauuu

SEQ ID NO: 182816 - RNA, 64 nt, Human
aagccucucauagaaauugccuccaguccaguuucccaaaaaccccaguguuuuacauaucugu

SEQ ID NO: 182817 - RNA, 64 nt, Human
uuacaaguacagcauucuuggaaagaauuuaacacccaaaaaggggaaaauguaaugaaaaauc

SEQ ID NO: 182818 - RNA, 64 nt, Human
uggggaaaacaauauguacuaccuuauacccuuccccaaaaacaaagggauuaaagaccuaaau

SEQ ID NO: 182819 - RNA, 64 nt, Human
uacaaaugggaauucacucacuggaaucguggcucccaaaaagaugcuuuaauuguguggugcu

SEQ ID NO: 182820 - RNA, 64 nt, Human
uacacaaccuucucuaaccaacuauauaucaagacccaaaaauugaagaaaaauauuguuuucu

SEQ ID NO: 182821 - RNA, 64 nt, Human
agcuuuugaaauuaaauuaucuauucuucccccccccaaaaaaaaguauuguaaauccuuaagu

SEQ ID NO: 182822 - RNA, 64 nt, Human
ugaaggggaagagggugaccucagcggcuuuucucccaaaaaucggcugaaggcugguugugga

SEQ ID NO: 182823 - RNA, 64 nt, Human
guacaguguuagguauuauuugaauggaaagacacccaaaaaaaaaaaugugcuccgacuaggg

SEQ ID NO: 182824 - RNA, 64 nt, Human
ccucauccguaaggacucgguucuguguugggaccccaaaaaaccagaacaaguucugugugcc

SEQ ID NO: 182825 - RNA, 64 nt, Human
ccagagaaguuucgagggguccucaccugguugacccaaaaauguucccuugaccauuggcugc

SEQ ID NO: 182826 - RNA, 64 nt, Human
aaucagacaaaguaauuccucucacuaaacuuuacccaaaaacuaaaucucuaauauggcaaaa

SEQ ID NO: 182827 - RNA, 64 nt, Human
ccccagaguuugauacaguagaccucaggugggacccaaaaauuugcauuucuaacacauucuc

SEQ ID NO: 182828 - RNA, 64 nt, Human
ccuaaaggaaucugaccauuuuacgucucuacggcccaaaaaaagacaaaaauaaaaauuccuu

SEQ ID NO: 182829 - RNA, 64 nt, Human
uuaagcaaaauguuuaaagacacaacggaauagacccaaaaagauaauuucuaucugauuugcu

SEQ ID NO: 182830 - RNA, 64 nt, Human
aaacauaaccgugaagcucuuccuacccuccucccccaaaaacccaccaaaauuaguuuuagcu

SEQ ID NO: 182831 - RNA, 64 nt, Human
agaaacgucuucuuaauccccaccuuuucuuacucccaaaaaagaaugaacaccccugacucug

SEQ ID NO: 182832 - RNA, 64 nt, Human
uguugaauauuuucuacugucaucaaaacauauucccaaaaaguauuaaaaaggaaccuuagca

SEQ ID NO: 182833 - RNA, 64 nt, Human
uuagugccuuuauuccuuucaggccaauaauccacccaaaaauuagaauguucugagacaucca

SEQ ID NO: 182834 - RNA, 64 nt, Human
aaaaccuuugguagaagcuccugucuuaucaggccccaaaaaaccuguucugcagugagagauu

SEQ ID NO: 182835 - RNA, 64 nt, Human
aagcauucguuggagagccuuacuuggguuugcacccaaaaaaaaaaacccaaucugaggaaag

SEQ ID NO: 182836 - RNA, 64 nt, Human
cccggccgccuucuaacugugacuccccgcacuccccaaaaagaauccgaaaaaccacaaagaa

SEQ ID NO: 182837 - RNA, 64 nt, Human
uuucucucaggaccucuuaaaaaucaucaaggaccccaaaaagcuuuuggguauguggguuaua

SEQ ID NO: 182838 - RNA, 64 nt, Human
gcuugugugaaauucccucuucaccuccccaccccccaaaaaauaaaagggggcauaaacuuua

SEQ ID NO: 182839 - RNA, 64 nt, Human
ugauucuggaagcaaauggcaaaaccaguagcuucccaaaaacagccccccugcugcugcccgg

SEQ ID NO: 182840 - RNA, 64 nt, Human
auaaggggucagauaaugcuggcaaauccuccuacccaaaaaggggucaauuguccagagaccu

SEQ ID NO: 182841 - RNA, 64 nt, Human
gucaguuucuuaauguagacacuaugucuucaaucccaaaaauuauaaaacugaaacccaugaa

SEQ ID NO: 182842 - RNA, 64 nt, Human
aaaacagauaaucaaauagaucuucuccaggauucccaaaaagcuuuuggcagugaguaaauac

SEQ ID NO: 182843 - RNA, 64 nt, Human
agguuauccuauaguuacuaugaaguuaacacagcccaaaaaccuacuucuccuuguguuuuuu

SEQ ID NO: 182844 - RNA, 64 nt, Human
ggcuuuuccuguugggagucacaguaaacagaaacccaaaaaucucaucuuggguguuuucagg

SEQ ID NO: 182845 - RNA, 64 nt, Human
acauuggauacucuguaaguaggagguacuuugucccaaaaagauguauaagaauguacuaaua

SEQ ID NO: 182846 - RNA, 64 nt, Human
aagcuauuucauaauaaauucuguacaguuuccccccaaaaaagagauuuauuuaugaaauauu

SEQ ID NO: 182847 - RNA, 64 nt, Human
gcaauacaguuucauuaacuccuucccccgcucccccaaaaauuugaauuuuuuuuucaacacu

SEQ ID NO: 182848 - RNA, 64 nt, Human
uuucauguaugaaguuuuuaaucacccccuaacccccaaaaaagauucgguugucaagggauau

SEQ ID NO: 182849 - RNA, 64 nt, Human
cuuuaagauuuuacaccuaaaaaaucucuccuaucccaaaaauaaugugggauccuuaucagca

SEQ ID NO: 182850 - RNA, 64 nt, Human
uugcacuuugaagagcuugaagauuugaaagauucccaaaaaagcauuuuaaaguuuacauuua

SEQ ID NO: 182851 - RNA, 64 nt, Human
auguggugugggcagcgugacauuuuaugucccacccaaaaauuggauuccuuuuggagacuga

SEQ ID NO: 182852 - RNA, 64 nt, Human
auuggugaagaaacugcauugucaauuucacugucccaaaaaagccaaauuguggcaggacuuc

SEQ ID NO: 182853 - RNA, 64 nt, Human
auuuuuucuuuucaccacccuguugagcaauuuucccaaaaaaagggcagcaauuauuaaauug

SEQ ID NO: 182854 - RNA, 64 nt, Human
aaaugaaaucacauuuaaaauaaacugccucugacccaaaaauaaauauggcucuuuauuuucc

SEQ ID NO: 182855 - RNA, 64 nt, Human
ucccuugggcaggaaagccagcagccccagacugcccaaaaacuugcccaccagaccaagggca

SEQ ID NO: 182856 - RNA, 64 nt, Human
aucuccccuucuuugugacagcuccucccacccccccaaaaaauaaaaaaaccacaaaaaacaa

SEQ ID NO: 182857 - RNA, 64 nt, Human
gaagacugggaugccugucuugaguagacuuggacccaaaaaaucaucucaccuugagcccacc

SEQ ID NO: 182858 - RNA, 64 nt, Human
uggcauuuuauuccuaaaucuuccagcaugcauccccaaaaaacaagaaacuugucuuacauaa

SEQ ID NO: 182859 - RNA, 59 nt, Human
uacaggaaacucaaauaugacuccccucccccaaaaaacuuauaaaaugcaauagaaug

SEQ ID NO: 182860 - RNA, 53 nt, Human
ugguugugcgcaacaccuaggagcccaaaaauaagcagcacgacggaacuuuc

SEQ ID NO: 182861 - RNA, 64 nt, Human
cgguaaagaaauuuaaaguguagaauuuuccucccccaaaaagucauguguugauaguagaagc

SEQ ID NO: 182862 - RNA, 64 nt, Human
accacaccccagauccgcccucuccugcgugcaccccaaaaaaucacuugcguuuuugaggcuu

SEQ ID NO: 182863 - RNA, 64 nt, Human
ggaucauuaauaaaguagcaagauccucaaaaaacccaaaaacaccauucucuaauagucauga

SEQ ID NO: 182864 - RNA, 64 nt, Human
accaggaugggagagcagcugccuuauucugaaucccaaaaauuacuugggggugauugucaca

SEQ ID NO: 182865 - RNA, 64 nt, Human
uaaugccugugaacuaaaaaaaugggaagcccuccccaaaaaaagugcauaaaauguuauuuuu

SEQ ID NO: 182866 - RNA, 64 nt, Human
acauuacuguacagaguacaucaacuauuuucagcccaaaaaggugccaaaugcauauaaaucu

SEQ ID NO: 182867 - RNA, 64 nt, Human
uaagacuuuaacugcaguuccaaagcuucucuaacccaaaaauuacaguaccaaaugauugacu

SEQ ID NO: 182868 - RNA, 64 nt, Human
aauguauaaaauuucuaggaauuaaaagcuuaaacccaaaaauuguucauccauauauaagaaa

SEQ ID NO: 182869 - RNA, 64 nt, Human
uaagaccuacagcaagugaccagcccuugagcuccccaaaaaccucacccgaggcugcccacua

SEQ ID NO: 182870 - RNA, 64 nt, Human
cccgccaagugguuacccaagucaccacuccugacccaaaaaucaggcauggcauuaaaacguu

SEQ ID NO: 182871 - RNA, 64 nt, Human
uuuaguccuaaagggacaauaacucugagcaugccccaaaaaaguaguuuagcaaccuuuuguu

SEQ ID NO: 182872 - RNA, 64 nt, Human
aaauucagggcuuuaaacaugauuaucuugauuucccaaaaacacuaaaggugguuuuauuuuc

SEQ ID NO: 182873 - RNA, 64 nt, Human
uagaugagugaaauacccucaagucucuuuucugcccaaaaagggaaaagugauagaaaugggg

SEQ ID NO: 182874 - RNA, 64 nt, Human
acuaagauccgagcagaacugaaggagauagagacccaaaaaacccuucaaaaaaucaaugaau

SEQ ID NO: 182875 - RNA, 64 nt, Human
ccaaaugugauaguagcuucaguauguuuccucacccaaaaaccauuuggcuggcagaaauuau

SEQ ID NO: 182876 - RNA, 64 nt, Human
acugaacacagccauauuagggaaagcaaaaaaacccaaaaaauccucuauuguauauuuauuc

SEQ ID NO: 182877 - RNA, 64 nt, Human
ggauuguuuaagaacuauuuuaaaguguuccagacccaaaaaggaaaaauaaaaaaaaaggaau

SEQ ID NO: 182878 - RNA, 64 nt, Human
ucucauguuaaccaaguuuuaaaaguucaaauuccccaaaaaggcuuguccaaggcuggcccca

SEQ ID NO: 182879 - RNA, 64 nt, Human
gccuguggcagccuaacagggagaggccacggggcccaaaaacgcaacacgucucaaggcaaac

SEQ ID NO: 182880 - RNA, 64 nt, Human
auuauugaccucuguugcauuuauucuaaagccccccaaaaauuaucuagccguuucgaauauc

SEQ ID NO: 182881 - RNA, 64 nt, Human
cuuugggagugccuuuuuuguuuuucaagauggacccaaaaaaguggaggaagauauuguucuu

SEQ ID NO: 182882 - RNA, 64 nt, Human
ggauggcuggagaguaggauaguucuauggguugcccaaaaaaugugaugcgcuucauguuuuc

SEQ ID NO: 182883 - RNA, 64 nt, Human
agcaacuuguuuuaaaaaaaugcacaauuuacuucccaaaaaaguuguuacuugccuuuucaag

SEQ ID NO: 182884 - RNA, 64 nt, Human; identical to SEQ ID NO: 182834

SEQ ID NO: 182885 - RNA, 64 nt, Human
aagcauucauuggagagccuuacuuggguuugcacccaaaaaaaaaaacccaaucugaggaaag

SEQ ID NO: 182886 - RNA, 64 nt, Human
gggcaaagcugagaagcugcaacccagauuucaacccaaaaaggucaagcugaaugccucagac

SEQ ID NO: 182887 - RNA, 64 nt, Human
guccuuuucuaaugucuuccauuccuaccccccacccaaaaacaaaagaaauauuuguagcuug

SEQ ID NO: 182888 - RNA, 64 nt, Human
gaugauugcauuacuucauucacugaaguuuuugcccaaaaauuggaagguaaacagagagcua

SEQ ID NO: 182889 - RNA, 64 nt, Human
gcauaucuauaugcauagauguaccuauccugcacccaaaaaggugccugguauuggcacuaaa

SEQ ID NO: 182890 - RNA, 64 nt, Human
acccugugacuaugaagaaaauauauauugcuagcccaaaaaucccaggggcaaaauaaaguuc

SEQ ID NO: 182891 - RNA, 64 nt, Human
ucauaguuuuuuuuuuuuuuuuuuggagcuguugcccaaaaaaauggaucuguugcaguggugc

SEQ ID NO: 182892 - RNA, 64 nt, Human
cuaaaacacagcaagagucaccuuuacuccaguucccaaaaaguuuuucaucuccaucugagac

SEQ ID NO: 182893 - RNA, 64 nt, Human
agcaauaaguuuauguuaguagagcuguuuucaacccaaaaauaagaaaaaauagcucuaaaua

SEQ ID NO: 182894 - RNA, 64 nt, Human
ucuaugcgaaucaaccuuucuaccuuaauaucuccccaaaaauguauagugccuuguuuuuaug

SEQ ID NO: 182895 - RNA, 64 nt, Human
ccuaaaucugagucaguaauucucuuacauccuucccaaaaaucagugucuagggacuaguuga

SEQ ID NO: 182896 - RNA, 64 nt, Human
cuaaaucugagucaguaauucucuaaaaauccuucccaaaaaucagugucuagggacugguuga

SEQ ID NO: 182897 - RNA, 64 nt, Human
ucuccauugcagaaauaagcuagggaaacacuaacccaaaaacuuucuguagagcuguuccuuu

SEQ ID NO: 182898 - RNA, 64 nt, Human
agcaaagggcuccuugauucauaagcaccucccccccaaaaaaaccaaauugguaaaaauucau

SEQ ID NO: 182899 - RNA, 64 nt, Human
gcaguaggcauuacuacaguacauggcuaaucuucccaaaaacuagcucauuaaagaugaaaua

SEQ ID NO: 182900 - RNA, 64 nt, Human
ugucuuuuuuucuauauauugaauuagauguuaucccaaaaaaaauaucuuuucacuucaaaau

SEQ ID NO: 182901 - RNA, 53 nt, Human
ccagaauuuauaacacaugagcccccaaaaagccgggacuggcagcuuuaaga

SEQ ID NO: 182902 - RNA, 64 nt, Human
aacauguuuuaaauccuuaaaugaauugcuuucucccaaaaaaagcacaauauaaagaaacaca

SEQ ID NO: 182903 - RNA, 64 nt, Human
ugcauauaauacauauuugugaaugagacauauucccaaaaaauucuuaucucuguaugugauu

SEQ ID NO: 182904 - RNA, 64 nt, Human
agccagagaugguuuuccacuccuucuagauauucccaaaaagaggcugagacaggagguuauu

SEQ ID NO: 182905 - RNA, 64 nt, Human
auggcuuaucaauuuuuucaaagaauucuuuuuucccaaaaagaggaguaacaaaaugucauuu

SEQ ID NO: 182906 - RNA, 64 nt, Human
uuccaucucugacuuaagcaaaagaaaaagauuacccaaaaacugucuuuaaaagagagagaga

SEQ ID NO: 182907 - RNA, 64 nt, Human
uggagaaauggagucugugugcuuacugaagagucccaaaaaccagagaccauuuucauuuacu

SEQ ID NO: 182908 - RNA, 64 nt, Human
aaaaacaucuggccagggguagcuugauuucgcccccaaaaauacugaagacuaauccauugac

SEQ ID NO: 182909 - RNA, 64 nt, Human
cuccccucucaccccucccacccauuaaccuccucccaaaaaacaaguaaaguuauucucaauc

SEQ ID NO: 182910 - RNA, 64 nt, Human
uuaauauaaaaauguuugcugccuaccuuuuucucccaaaaaaucuuuaaguaaagaugaucug

SEQ ID NO: 182911 - RNA, 64 nt, Human
cuuaacaacuguagcaagaacugcacgguacaaacccaaaaaagaacaagcucaucuauuugga

SEQ ID NO: 182912 - RNA, 64 nt, Human
uucaucuuuccugugagucggaauugaagucuuccccaaaaauauauguauauauuguaugucu

SEQ ID NO: 182913 - RNA, 64 nt, Human
cugagcaaugcuugugaaucuuuucuuaagaaaucccaaaaagccaauauuaguuaaaauucug

SEQ ID NO: 182914 - RNA, 64 nt, Human
cucuaugucuguuucacuuuuuggauugcaucuccccaaaaacuaaaugugaaaucccuaccau

SEQ ID NO: 182915 - RNA, 64 nt, Human
caucaucuuaaguucuucaugcuacucuuaaccucccaaaaagcaguaucuaagucacauacau

SEQ ID NO: 182916 - RNA, 64 nt, Human
ucuuuuggacuaauacaauucaggaaagaaaaaacccaaaaaccaaccucauucacauauggcu

SEQ ID NO: 182917 - RNA, 64 nt, Human
ugcucuccagccugggaggcacagcaaacugucccccaaaaaaaaaaaagaguccuuaccaaua

SEQ ID NO: 182918 - RNA, 64 nt, Human
augucacugacucuaaaucaggugauucaagaugcccaaaaaugauggauagagaaacagaaau

SEQ ID NO: 182919 - RNA, 64 nt, Human
cuguguuuuggcaaggugauccuuccagagccaucccaaaaagucagcacugacaugggaugca

SEQ ID NO: 182920 - RNA, 64 nt, Human
cuccagccugcggacagaccaagacuucaucccccccaaaaaaaaaagauuggaggugauuuac

SEQ ID NO: 182921 - RNA, 64 nt, Human
uagagaaauuugccaauuuacuuuguuauuuuuccccaaaaagaaugggaugaucauguauuua

SEQ ID NO: 182922 - RNA, 64 nt, Human
ccuacagauuuuuaaauuuagcuuuauuuaucaacccaaaaaacaaauaaauaagaucaauauu

SEQ ID NO: 182923 - RNA, 64 nt, Human
uuguccucuguacugucucucuccuugccccuaacccaaaaagcuucauuuuucuguguaggcu

SEQ ID NO: 182924 - RNA, 64 nt, Human
gaagugcugcuguaauugggagcacaaggggccucccaaaaaggagccccaccucagcaucacu

SEQ ID NO: 182925 - RNA, 64 nt, Human
ucagaagcuugacucauaaacuauacuauauauucccaaaaaugucaguauugacaacacaguc

SEQ ID NO: 182926 - RNA, 64 nt, Human
ucaugcaacauuaguuugcuuaccuuaagaauugcccaaaaaugaaagaaaauaugagcuuuuc

SEQ ID NO: 182927 - RNA, 64 nt, Human
acuaugaucccaaucaagguauagaugccgucaccccaaaaaguucccuccauaucccuuugca

SEQ ID NO: 182928 - RNA, 64 nt, Human
gugcuuauucuuaacuuauuaccucaggugccaacccaaaaauugguuuuauuuuuuucuuaaa

SEQ ID NO: 182929 - RNA, 64 nt, Human
gugggcaauauagcaagacuccaccccuccacaccccaaaaaaguaaguuuaggauuagaauau

SEQ ID NO: 182930 - RNA, 64 nt, Human
ucuaacauccacuauuguucaguauagguaaucucccaaaaauaucacauccucuugaaaauga

SEQ ID NO: 182931 - RNA, 64 nt, Human
aaccaauguagcauuauuuuuuucuaaaugaagccccaaaaaagaaaagugccuugcaucauuu

SEQ ID NO: 182932 - RNA, 64 nt, Human
caucuuuucugucuuccugacaaacuuccaucaacccaaaaaguuccaguugcaaagauccaag

SEQ ID NO: 182933 - RNA, 64 nt, Human
aaugaaaggugacaaaaggcagaaggagggagaccccaaaaagagguaaauuugguaucuuagc

SEQ ID NO: 182934 - RNA, 64 nt, Human
uuaugauaagaaaggaggguaucaguuacugauacccaaaaauauauuccagguaaagccaggu

SEQ ID NO: 182935 - RNA, 64 nt, Human
uugagcacaagauguauuucagcccaugcccccucccaaaaagaaauugauaaguaaaagcuuc

SEQ ID NO: 182936 - RNA, 64 nt, Human
ugaaaagaaucuguacugcaaguaaaaccuacuccccaaaaauguguggcuuugggucugcauu

SEQ ID NO: 182937 - RNA, 64 nt, Human
auaaaagcuguuuucaccaccucccuccccaccccccaaaaaaggcguacagccaacucuuagu

SEQ ID NO: 182938 - RNA, 64 nt, Human
ugccauguuauauauauguaguuggcauuugguucccaaaaaguaggauguagguauuuauugu

SEQ ID NO: 182939 - RNA, 64 nt, Human
acugcagugauacuauucaggauggugggaaauccccaaaaauauguaugugugggcuugcuua

SEQ ID NO: 182940 - RNA, 64 nt, Human
ucaugcuccccacuugcccuuauuggccugcuuucccaaaaacagcccacucauccuuucccca

SEQ ID NO: 182941 - RNA, 64 nt, Human
agcuugccccaggccuugggcauaauuauuuccccccaaaaaaggcacaaaaauagguuuugga

SEQ ID NO: 182942 - RNA, 64 nt, Human
ugcacgaagggaagauccaagcuucgaaagauaucccaaaaauuucagugacuccagaagaaau

SEQ ID NO: 182943 - RNA, 64 nt, Human
acagccuucuccuauagcuguacuugccccccuccccaaaaaaccauggaugagaaagaaagga

SEQ ID NO: 182944 - RNA, 64 nt, Human
agggauaaaucaagaguccucagcacuccacauucccaaaaaaucccaggaacuccuaaaccuu

SEQ ID NO: 182945 - RNA, 64 nt, Human
ggccuccagucccaucucccccaacacaugugcccccaaaaagugagccaggcaccucuguuuc

SEQ ID NO: 182946 - RNA, 64 nt, Human
uuccucauaguaugguggcuggguuggagggugucccaaaaagaaaggaggggauagagagaga

SEQ ID NO: 182947 - RNA, 64 nt, Human
caaccuuuuccuuaaggucuuuuaccaccucccccccaaaaaaaucccccaaaacugauucaga

SEQ ID NO: 182948 - RNA, 64 nt, Human
uuauuuaaguuuaaaaaaaggaaaacugcugccccccaaaaaaagaaauuuucaaaacaacgug

SEQ ID NO: 182949 - RNA, 64 nt, Human
gcccccaccucugccuccaggucucaucuuccaccccaaaaaugucugucucucucuuuuuguu

SEQ ID NO: 182950 - RNA, 64 nt, Human
aaagcauuaaaauuuauuugaaaccaaaaaagagcccaaaaagccaaagcaauccuaagcaaaa

SEQ ID NO: 182951 - RNA, 64 nt, Human
acauaggaacggaaaaagauuucaugacaaagaucccaaaaauaauuguaacgaaagcaaaaau

SEQ ID NO: 182952 - RNA, 64 nt, Human
cuuacagcucacaaccucagcuggguuuuagguacccaaaaagggccugucuagauuuuuucag

SEQ ID NO: 182953 - RNA, 64 nt, Human
auguaaaagaaugugcaaaauuaguaaaaauauacccaaaaauuuaccagcaacagagaagcaa

SEQ ID NO: 182954 - RNA, 64 nt, Human
aauuuccuauccuaaucccuccuacuuauacuuccccaaaaaacaagcuuuacuggaauuaaug

SEQ ID NO: 182955 - RNA, 64 nt, Human
uguggagggcaucauucauuccugauucacaaaccccaaaaaccucuggugggagauaggaaga

SEQ ID NO: 182956 - RNA, 64 nt, Human
auaugcagaguauuucugccccacccaccuaccccccaaaaaaagcugaagccuauuuauuuga

SEQ ID NO: 182957 - RNA, 64 nt, Human
agaccuuauccuuguaaccaaaagccaucugcuccccaaaaacuauugaaauaaaauaaaauau

SEQ ID NO: 182958 - RNA, 64 nt, Human
uacauaauuuaauaccaaaaaaggcgccuggauccccaaaaaaccgaggcugggagcuaguggc

SEQ ID NO: 182959 - RNA, 64 nt, Human
auuggauaaauauuucccaucccacccaccuccccccaaaaaauagcucacaaggggagagcca

SEQ ID NO: 182960 - RNA, 64 nt, Human
aacccggucucaugcccacuccccaucccugcuucccaaaaauugcacugugugcaguuugcaa

SEQ ID NO: 182961 - RNA, 64 nt, Human
aguucuugugucguuugugaaaguucuuaaccugcccaaaaacccccuuuuccccaagcugccc

SEQ ID NO: 182962 - RNA, 64 nt, Human
acuagaagcaagauaguuugugacacauaagcuucccaaaaacuagaauagauuuuuacugaau

SEQ ID NO: 182963 - RNA, 64 nt, Human
aagaagggcaugggcacccccaggagaggauggccccaaaaaccuuauuuuuauacaugagagu

SEQ ID NO: 182964 - RNA, 64 nt, Human
ucauucacauguaaaaauaaccccaccuccccaccccaaaaagggcaagagcuguggaaaauga

SEQ ID NO: 182965 - RNA, 64 nt, Human
auaugcugagaaacugcagagcauaauacugccacccaaaaaucuuuuugaaaaucauuuccag

SEQ ID NO: 182966 - RNA, 64 nt, Human
cuguaugguuuauggagauuaaugaaaaugaaugcccaaaaauaagucuuagaaaauccuccau

SEQ ID NO: 182967 - RNA, 64 nt, Human
ccagaggaagugucagcacuuuaaaauucuagaccccaaaaaacuacaaaaucagaaaaaguau

SEQ ID NO: 182968 - RNA, 64 nt, Human
ucauagggguuugucugcagcaaacgccucauaucccaaaaacggugcaguagaauagacauca

SEQ ID NO: 182969 - RNA, 64 nt, Human
uuuuggacaaguacaaacaauuucaacugauauucccaaaaagcauucagaagcuaggcuuuaa

SEQ ID NO: 182970 - RNA, 64 nt, Human
gagggcagggcccgagccccgacacaucccuucccccaaaaagcaacaccugugcuugcagcca

SEQ ID NO: 182971 - RNA, 64 nt, Human
gggugacagaugagguccucuguuuaccuccccccccaaaaaaaaaauucaguaggaauuccuu

SEQ ID NO: 182972 - RNA, 64 nt, Human
gaacuaccccacaacacgccuaaaacucaaaacacccaaaaauaucuccuccaauguccugaaa

SEQ ID NO: 182973 - RNA, 64 nt, Human
caaaaauaucuccuccaauguccugaaacaugaacccaaaaagagacccacaauaaacucguga

SEQ ID NO: 182974 - RNA, 64 nt, Human
cagggauagcuguaaugcuuuuuucuuuuuauaacccaaaaagcagguaugucagucgcuuuuu

SEQ ID NO: 182975 - RNA, 64 nt, Human
gcccccccaccuuccaccucuuagcacuggugaccccaaaaaugaaaccaucaauaaagacuga

SEQ ID NO: 182976 - RNA, 64 nt, Human
caccucaguuuucuaaaggucaaauuaaggcccccccaaaaauacaguauguagcugaauuccu

SEQ ID NO: 182977 - RNA, 64 nt, Human
cuuugagacccugcuuucaauucuuauuggguaccccaaaaaguggaacugcuggaucacaugg

SEQ ID NO: 182978 - RNA, 64 nt, Human
aaacccaccacaaacguagaauccacuucuguuccccaaaaagcgagaagggggguucaggagg

SEQ ID NO: 182979 - RNA, 64 nt, Human
acagagagagagaaaaaaaaucacccaccacccccccaaaaacacaaaaaaagaaaaucuaucu

SEQ ID NO: 182980 - RNA, 64 nt, Human
ggcaugcgcuuguuggcaaaacgcagggccggcucccaaaaaccccauguguguacgauuaaaa

SEQ ID NO: 182981 - RNA, 64 nt, Human
ggggccugggguaggaggaacagguuuaaaaauccccaaaaaagcgaaccgugaggaggggugu

SEQ ID NO: 182982 - RNA, 64 nt, Human
agcugccccucucccugccaaagaggagucaucccccaaaaagacagagggggagccccaagcc

SEQ ID NO: 182983 - RNA, 64 nt, Human
accagugugggcaacagagugagaaccaucucuacccaaaaaaaaaauuaaaaauuagccaagc

SEQ ID NO: 182984 - RNA, 64 nt, Human
aaauuucuacuuuauuuugauacaacauauuccccccaaaaaaacacauacauaggaacugguu

SEQ ID NO: 182985 - RNA, 64 nt, Human
gaaauaggaagcgugggaggguccaguugccacccccaaaaauuccaaugauucuugacaucuu

SEQ ID NO: 182986 - RNA, 64 nt, Human
ucguggaaauguaauaauuauaggaacgucuuugcccaaaaauaaaacuucaacagauugagag

SEQ ID NO: 182987 - RNA, 64 nt, Human
gcaauuuuaaaauguaaaggcucuuuuauaaccccccaaaaaaucacacaaauauauuuuaaaa

SEQ ID NO: 182988 - RNA, 64 nt, Human
acuccuguaguagauaagcugucauuaaguaauucccaaaaaaagggccauuugcuugcauuac

SEQ ID NO: 182989 - RNA, 64 nt, Human
uggacauggacuagcuugagccaaggcaguggcacccaaaaaccaggcugcaguggggacggau

SEQ ID NO: 182990 - RNA, 64 nt, Human
gcaggcagcugcagcccccagaggggaccacaagcccaaaaaggacaaaaaugggcuggccugg

SEQ ID NO: 182991 - RNA, 64 nt, Human
cuuuccucuuuguccaagcauccuaucccucaaacccaaaaagaaagaagcucucccuucucuc

SEQ ID NO: 182992 - RNA, 64 nt, Human
ccaucauucaagauaacaugcugaucacccuccucccaaaaagcaagagcuuguuuauggcuga

SEQ ID NO: 182993 - RNA, 64 nt, Human
ccaccaaagaaaaccugagcuugaaguccuuuuccccaaaaagagggaagagucacaaaaaguc

SEQ ID NO: 182994 - RNA, 64 nt, Human
ccacaggacuaugugauuggcccacacaagguuucccaaaaauuugacuugguugccaacaaua

SEQ ID NO: 182995 - RNA, 64 nt, Human
accauuuucuacauaauaugacauggauacuugacccaaaaaaaaauguuuagugcuaaugagc

SEQ ID NO: 182996 - RNA, 64 nt, Human
gaggcaccgaguuccagguagugguuuugccuuucccaaaaaugaaaauaaacuguuaccgaag

SEQ ID NO: 182997 - RNA, 64 nt, Human
cugucuccucaccccucccugugcuggagccugucccaaaaaggugccaacugggaggccucgg

SEQ ID NO: 182998 - RNA, 64 nt, Human
cagagauuuaaaaaacugaaaagguauaccucaacccaaaaauaaagguuuguuuugguuuguu

SEQ ID NO: 182999 - RNA, 64 nt, Human
ucguucucugccacagggacuugccucacugugucccaaaaacaaaucgcagccagcuuuucca

SEQ ID NO: 183000 - RNA, 64 nt, Human
uggucacugucaaguggauggauauucuagcgcucccaaaaaagcacuauggccuuauaugcag

SEQ ID NO: 183001 - RNA, 64 nt, Human
aacuuuagaugaugauguauuuaugcccuuauaucccaaaaaugucuuagaaaauaaaaauucu

SEQ ID NO: 183002 - RNA, 64 nt, Human
gugaugggccgguuuugugagaugaauuguaucccccaaaaagacagguaccuucaaugugacc

SEQ ID NO: 183003 - RNA, 64 nt, Human
auaaaacagggauugccaagaagggaacaaucaccccaaaaaugaauguuugccuuuauuccgu

SEQ ID NO: 183004 - RNA, 64 nt, Human
uugcacauggcaggccuggaauccugcagcccuccccaaaaacagauugacccaggaaugaauc

SEQ ID NO: 183005 - RNA, 64 nt, Human
ugccaauggcucuuucuccugcgacauggcaguccccaaaaacaaaauggagucugauggggag

SEQ ID NO: 183006 - RNA, 64 nt, Human
uugcuggagggaagaucuugaugguguuucuuuccccaaaaauugacuuagauauuaaaauuug

SEQ ID NO: 183007 - RNA, 64 nt, Human
uuuaagaaaaaaaaaaucaauuccuagccuggaucccaaaaagguacaggcagcaguugcacau

SEQ ID NO: 183008 - RNA, 64 nt, Human
cuguuuucuuauucuguaauuguuuguuauauuucccaaaaacgucuugaucacuaagcaaagc

SEQ ID NO: 183009 - RNA, 64 nt, Human
cagcaguucccuuuuaaaugcaaaucaauaaauucccaaaaauuuaacugcuuuaugaauucaa

SEQ ID NO: 183010 - RNA, 64 nt, Human
uuuauaagaaacccagugaauuucuagagcaagucccaaaaacuaagggacagcuaagaaguua

SEQ ID NO: 183011 - RNA, 64 nt, Human
caguuuucccugaauuuggagcaccaaacuccgccccaaaaaggagaguaacaaauacacaauu

SEQ ID NO: 183012 - RNA, 64 nt, Human
gcccggcccagauagguugaucuuaauguaacaacccaaaaauaaaugucauagucaagauuug

SEQ ID NO: 183013 - RNA, 64 nt, Human
uguucuccccacuuuacagauaaggaaacugaggcccaaaaagguuugaacccaggucuuccaa

SEQ ID NO: 183014 - RNA, 64 nt, Human
acuccuaaccuugugauccgcccuccuuagcccccccaaaaaauuacaauaauuuugucaacca

SEQ ID NO: 183015 - RNA, 64 nt, Human
auaauguucugcuaaauuucaaaugggcucgugacccaaaaaagucaagaaccacagcacuuga

SEQ ID NO: 183016 - RNA, 64 nt, Human
gcuguuuucaccccuuccuccuccuagccucucucccaaaaaguaaaacacaaugcugaagaaa

SEQ ID NO: 183017 - RNA, 64 nt, Human
uuuauacaugugauaauuucauaaagugagggaucccaaaaaaagaguuucauccaacauucuu

SEQ ID NO: 183018 - RNA, 64 nt, Human
uuuauuuaucauguuaucuuauuaaaagaaaaagcccaaaaagcaguaaaauuuccauuucucc

SEQ ID NO: 183019 - RNA, 64 nt, Human
cgugaccacagucaauuuuagaacauuucguuaccccaaaaagaaacccuguacccuugagcag

SEQ ID NO: 183020 - RNA, 64 nt, Human
gccuauguaaggaaagugcuauucacccaguaaacccaaaaaagcaaauggauaaugcuggcca

SEQ ID NO: 183021 - RNA, 64 nt, Human
cagagugagacccuguuccaaaaaaaaaaaaaaacccaaaaaaccucaauggcuuuuugcuuuu

SEQ ID NO: 183022 - RNA, 64 nt, Human
gcuuugagcaguuuggucaacuuaccaacuuccccccaaaaaagggaacauaaaagagcccauc

SEQ ID NO: 183023 - RNA, 62 nt, Human
cucaguccugcugccugcuucaccagaagcagcccugugagugugggguggggaagucccuu

SEQ ID NO: 183024 - RNA, 62 nt, Human
aaaucucagcugggauccuggaccugggaggccccugugagggccagcucuggaaaaaccug

SEQ ID NO: 183025 - RNA, 62 nt, Human
acgaggggggccagggguucugagaagcgcugcccugugagagccacgcuggccuucgucuc

SEQ ID NO: 183026 - RNA, 62 nt, Human
gggugugaccauguuuccucucaauaaaguuccccugugacacuccuccugucucucuucca

SEQ ID NO: 183027 - RNA, 62 nt, Human
gcaacccugucaguguuccacccugucccaggcccugugauauuuauuguggcuaaaggcaa

SEQ ID NO: 183028 - RNA, 62 nt, Human
agaccucugagcccaagcaaagccaucauauccccugugaccugcauguauacauccagaug

SEQ ID NO: 183029 - RNA, 62 nt, Human
cacaaaggauggucuuggccauaugcuagggccccugugaaaauaaguaguuuugagaaguu

SEQ ID NO: 183030 - RNA, 62 nt, Human
uguuccucuuucuccccgacuccaccccagcucccugugaagagagaguuaauauauuuguu

SEQ ID NO: 183031 - RNA, 62 nt, Human
aagccacuucuuaguguaaucagcuccuguuucccugugagccuuaguuauauuuuaauuca

SEQ ID NO: 183032 - RNA, 62 nt, Human
gagcugauuugauggacaauggagagagcuuucccugugauuauaaaaaaggaagcuagcug

SEQ ID NO: 183033 - RNA, 62 nt, Human
ccuccccaugcucuccucccucagccuugcuacccugugacuuacugggaggagaaagaguc

SEQ ID NO: 183034 - RNA, 62 nt, Human
uucugcccuggcugcugcccccaccccggggacccugugacauggugccugagaggcaggca

SEQ ID NO: 183035 - RNA, 62 nt, Human
ccuuguggguaucucagcucuccgcgucuuuacccugugaucccagccccgccacugaccau

SEQ ID NO: 183036 - RNA, 62 nt, Human
gucccaucugccucuuuucucuccccagccugcccugugacccuugccucuuccugauacuc

SEQ ID NO: 183037 - RNA, 62 nt, Human
gauuuugaaaauauguauccaaagugggaggccccugugacauuuugccaacuuaaacgaga

SEQ ID NO: 183038 - RNA, 62 nt, Human
gggcccaugcugccacccucgaggagauggaacccugugaugcaaaagcuuugcuggugugu

SEQ ID NO: 183039 - RNA, 62 nt, Human
guagcccccagcacccagguucuucugucagacccugugaccugcgagcugcuacuacugua

SEQ ID NO: 183040 - RNA, 62 nt, Human
agccugaaacugaguugaauagagaagugugacccugugacaaaaugauacugugagaaaug

SEQ ID NO: 183041 - RNA, 62 nt, Human
uugcucucagccaccuugauagucacugggcucccugugacuucugacccugacaccccucc

SEQ ID NO: 183042 - RNA, 62 nt, Human
augcagaugcuguugugaucagcaugaaguuucccugugaggccgugguuagcguggacauc

SEQ ID NO: 183043 - RNA, 62 nt, Human
caccuugcuggaugcuucuccaguagugcugccccugugacaggcaucagcucccugcugga

SEQ ID NO: 183044 - RNA, 62 nt, Human
cgggggcggguccagcuuuggaagccaggcuccccugugagccguggcuugucuggucuucg

SEQ ID NO: 183045 - RNA, 62 nt, Human
uucuagccuugaauucauuuuaucuucauuaucccugugaaguaggugggacaaguauaagg

SEQ ID NO: 183046 - RNA, 62 nt, Human
cccuguugguggagaccagugccugaacuggacccugugaaaucugucccgugggaauccug

SEQ ID NO: 183047 - RNA, 62 nt, Human
ucuggcccuuccuuggcaaaagcaaaaauucucccugugagagcucaacaucucaaauacaa

SEQ ID NO: 183048 - RNA, 62 nt, Human
uccccuacuggcucucauucucacucuugccgcccugugaagaggugccuuccaccgugauu

SEQ ID NO: 183049 - RNA, 62 nt, Human
agcagacaauucaacugccauguuuugccacccccugugagcagggauuagguguucaggcc

SEQ ID NO: 183050 - RNA, 62 nt, Human
gagagagcagguguguuaaaugggacuggagucccugugaagacugggugaggauaacacaa

SEQ ID NO: 183051 - RNA, 62 nt, Human
accugagguucacgcugcuagcguggacauagcccugugauacugcaucucacuggggccag

SEQ ID NO: 183052 - RNA, 62 nt, Human
agaacaaaaauaauguucuuuuuaugcaaauccccugugaaaauaaaauuuucaauguuuuu

SEQ ID NO: 183053 - RNA, 62 nt, Human
caggccugaggcuuuugugaaaugcgucagcccccugugacaguagguuuugaugcuaguga

SEQ ID NO: 183054 - RNA, 62 nt, Human
cuaaagcgggagccaggccugaguguuccugucccugugagugggaaggucuucuggcuccc

SEQ ID NO: 183055 - RNA, 62 nt, Human
ggaaguucagaagguguguccuugaacugaggcccugugauauggcggccugcaguggugug

SEQ ID NO: 183056 - RNA, 62 nt, Human
ugcaagaacccuguuguacuggcguuuuccuccccugugaaaacguaacuacuguugggagu

SEQ ID NO: 183057 - RNA, 62 nt, Human
gccaggguccccuggggccccuucugcccagucccugugacgucacacugcacacacucacc

SEQ ID NO: 183058 - RNA, 62 nt, Human
auggacuugcccacaccuccaccuccccugagcccugugagaggcacgacugucuaugccaa

SEQ ID NO: 183059 - RNA, 62 nt, Human
gcugguggcaggagcugggggagaggacucuccccugugagacuccuccuugugaagggcca

SEQ ID NO: 183060 - RNA, 62 nt, Human
aaagcucuggacaggagacaccugcuccaggccccugugaucccaguucuguucucuugccc

SEQ ID NO: 183061 - RNA, 62 nt, Human
ggcuccuuugcucaguugccccaggaaggcuucccugugaguaaugcuuauggaaucugaca

SEQ ID NO: 183062 - RNA, 62 nt, Human
caguuuccauucuucagucagaguaugaugaucccugugacaguuuuugcucugaaauagua

SEQ ID NO: 183063 - RNA, 62 nt, Human
gcccuccugucccuuccccccagucaguauuacccugugaagccccuucccuccuuuauuau

SEQ ID NO: 183064 - RNA, 62 nt, Human
cuucaaauguaccagaaccugagccaacgccucccugugaaacuguugcugaucuguaguac

SEQ ID NO: 183065 - RNA, 58 nt, Human
gcaagaaagcuaacacuuaagacucccacccugugacacugagucccgagcacagcac

SEQ ID NO: 183066 - RNA, 62 nt, Human
cucuaucacccuuauuaccaagccuugugguucccugugauuuuagauaaugucugauauuu

SEQ ID NO: 183067 - RNA, 62 nt, Human
cacucccagccauugauuuuggugacccacuucccugugaugaucuucugaucuaguuucuc

SEQ ID NO: 183068 - RNA, 62 nt, Human
ucuuuccagagguccaugguggaagacgauaacccugugaaauacuuuauaaaaugucuuaa

SEQ ID NO: 183069 - RNA, 62 nt, Human
uguacuuauugugggguaccuuuagaugaauucccugugagugagagaaguugaucacccca

SEQ ID NO: 183070 - RNA, 62 nt, Human
cuugcugcucccuacugacucuagcuuacuuccccugugaagaaacagguguucucggcuga

SEQ ID NO: 183071 - RNA, 62 nt, Human
uucuguguuuaaacuucugagcagugagacaucccugugagcagauacaauagccaaugcaa

SEQ ID NO: 183072 - RNA, 62 nt, Human
aguguggaaucaaaugagcacauaagcugugucccugugaaaagagguuuguagccuuucag

SEQ ID NO: 183073 - RNA, 62 nt, Human
ccccugcugcagggcgaguggccuguccagaccccugugaggccccgggaaagguacagccc

SEQ ID NO: 183074 - RNA, 62 nt, Human
gcgccccagacuccaggccgccugcagccugccccugugaucccuucggcgccagcagcucc

SEQ ID NO: 183075 - RNA, 62 nt, Human
cacucauggauguuaggaaaucuagucaucuucccugugauugcccuguuaaguauuuaacc

SEQ ID NO: 183076 - RNA, 62 nt, Human
caaaaaaaauuuuuuuuuagaaauguuauuuucccugugauagaggaugacuucccaguuuc

SEQ ID NO: 183077 - RNA, 62 nt, Human
uagggggcagagaaggaaaagcugaggggggucccugugagggaggaaagaaggaucauuug

SEQ ID NO: 183078 - RNA, 62 nt, Human
gugcagcuuacaaucuauuuaacuauuagaggcccugugagauguaggcaguuauuuacaga

SEQ ID NO: 183079 - RNA, 62 nt, Human
aaagcaaaacuaauauuuauuuucuagauuaucccugugaauaauugagaacuuuuuggagu

SEQ ID NO: 183080 - RNA, 62 nt, Human
acaugcauuaucuucuuuuguucuugcuacaacccugugagauaguaguauuaucucauuuu

SEQ ID NO: 183081 - RNA, 62 nt, Human
ucaucauaauuaaacaacccauauuggggacccccugugacuaguagcagcuggaaaauucu

SEQ ID NO: 183082 - RNA, 62 nt, Human
ugauacugcucaacacagcccaaccuauagugcccugugacuucucuccuccccuuugcuca

SEQ ID NO: 183083 - RNA, 62 nt, Human
uuccaggucagaaaccauuguucagaagaccucccugugagagaguugcuccucaggguccc

SEQ ID NO: 183084 - RNA, 62 nt, Human
uuacccgaacccuucgccugaauaacuccagccccugugacauccgccuggauugggagacc

SEQ ID NO: 183085 - RNA, 62 nt, Human
aguuucugaugaacauucugcauccauauacacccugugacagucagcagucugcuauuaag

SEQ ID NO: 183086 - RNA, 62 nt, Human
ggcuccuagcuguggcugggggcuccaggcgccccugugauuaccuccuacugccaccaugg

SEQ ID NO: 183087 - RNA, 62 nt, Human
caggccucugagcccaagccaagcaucgcauccccugugauuugcacguauacauccagaug

SEQ ID NO: 183088 - RNA, 62 nt, Human
ggaacccucagagccggcaacugaaucuuggucccugugaugucaagcccauugcucuccca

SEQ ID NO: 183089 - RNA, 62 nt, Human
cagcccucuguauccaccugguuuuguucuuucccugugagcauuugugguuauagcuuccc

SEQ ID NO: 183090 - RNA, 62 nt, Human
cccgugccccuagcaggagcccuggugcuacccccugugaagagccaagcagcagggcacgc

SEQ ID NO: 183091 - RNA, 62 nt, Human
uagcugcagccuuaaauuagcuucuuugcccacccugugagccucauccgugauucugccuu

SEQ ID NO: 183092 - RNA, 62 nt, Human
uuacuuuaggggguuuuuggugggguuuuucccccugugaaaacuuacuuugccccuagucu

SEQ ID NO: 183093 - RNA, 62 nt, Human
uacaagcaggcccccguccuaucaguacaccccccugugaugccucugaaauauguacccuc

SEQ ID NO: 183094 - RNA, 62 nt, Human
ucuuauuuguauucugaaucagcaauuauauucccugugauuauuuggaagaguguguagga

SEQ ID NO: 183095 - RNA, 62 nt, Human
uguuggagacugagcugggugcacuggccaugcccugugaauccucaggcugugacgcccuc

SEQ ID NO: 183096 - RNA, 62 nt, Human
guaguacccagccugcuccccgaguccagcgacccugugacaccggucugcagggaguuggg

SEQ ID NO: 183097 - RNA, 62 nt, Human
gccaaacucaaagaauggggugguggggggcacccugugagguggccccugagagguggggg

SEQ ID NO: 183098 - RNA, 62 nt, Human
ugcuuucccgcggacuuccuagugcccaaaugcccugugaggcugagagacccaggccccug

SEQ ID NO: 183099 - RNA, 62 nt, Human
aacuucaaauuagccucaugaagagaauuuuucccugugaaaaguaagaccaagaaaaaaca

SEQ ID NO: 183100 - RNA, 62 nt, Human
uuaggaaguccuuacaugcaagcuguagccagcccugugagaccugccagcccuucagcacc

SEQ ID NO: 183101 - RNA, 62 nt, Human
acauggcugggcuacgugaauagcgcccucaacccugugaucuauaccaccuucaauaucga

SEQ ID NO: 183102 - RNA, 62 nt, Human
uucuaagauacggacucagcuggucuauuuuacccugugacauuuaaauauacuuuugaaua

SEQ ID NO: 183103 - RNA, 62 nt, Human
aaucaucugugccauugguaauaaggaguagccccugugaggucagguacacaguaaagagg

SEQ ID NO: 183104 - RNA, 62 nt, Human
uggaucacauuagagauauuuagaacauauuacccugugacuuacguaggaaaccuaauaug

SEQ ID NO: 183105 - RNA, 62 nt, Human
guucaacacugcaauuguuuguuagauguaaacccugugacuauaguacguugcuucuuguu

SEQ ID NO: 183106 - RNA, 62 nt, Human
gggagcucuuuccugugucagaaccaguccugcccugugaauuacugcuacaaucaaggcca

SEQ ID NO: 183107 - RNA, 62 nt, Human
guggcaccugccucucccaccuccagucuuuccccugugaugagcagaugaccaccgcccuc

SEQ ID NO: 183108 - RNA, 62 nt, Human
gguccccuccucuccuagcuucccgccucugccccugugaacacccaucugcaguauccccu

SEQ ID NO: 183109 - RNA, 62 nt, Human
gcuaguccuugccagagacauucuuaccucugcccugugauaauauuuuaugcuugacagug

SEQ ID NO: 183110 - RNA, 62 nt, Human
gcuuugcuaucuggguagaaauuaauacaauucccugugaucuauuccaauguucuuccaag

SEQ ID NO: 183111 - RNA, 62 nt, Human
uguuguuuauuuucagugacacuuauguaaggcccugugaguuguauuuauccuguauccgg

SEQ ID NO: 183112 - RNA, 62 nt, Human
uagugcaagggacucauuuuuugcgaacuugucccugugacuaguagauucccccuuuuccu

SEQ ID NO: 183113 - RNA, 62 nt, Human
cuuagugauaacauuaugaacaauucuaaaagcccugugauuugaaaaauauagaaucauua

SEQ ID NO: 183114 - RNA, 62 nt, Human
uggaguuccugugucugguuuuccuguuuauucccugugaugcccagaguaauggcccaucc

SEQ ID NO: 183115 - RNA, 62 nt, Human
ugaagccggccagagccccucugcccagcaugcccugugaucgccuggcccagcaggagcug

SEQ ID NO: 183116 - RNA, 62 nt, Human
uuuucucucacuuuugcccuuuguuuauccuucccugugauuagauaaacaaaauaaaaaac

SEQ ID NO: 183117 - RNA, 62 nt, Human
agguguggucccauaggagcagccuuagcauccccugugaacuuaucaaaaaugcaaauucu

SEQ ID NO: 183118 - RNA, 62 nt, Human
agcuccuuaaaguucugggcagcuaaaagcaucccugugagcaaaaaugccaggcagaaaac

SEQ ID NO: 183119 - RNA, 62 nt, Human
acacugguuugaauuucuauucaauuuauuuucccugugaucuguuaggcaugaaagcaguu

SEQ ID NO: 183120 - RNA, 62 nt, Human
ccaucuuggucaaguuggucuggaacuccugacccugugauccaccugccuuggcuucccaa

SEQ ID NO: 183121 - RNA, 62 nt, Human
aguaaaucuugaacagguucacuaagcacccacccugugaaaaguauuauggaaaucacugc

SEQ ID NO: 183122 - RNA, 62 nt, Human
agucacuuuaggaguugggacagagucgagcacccugugaaagucucccuugaguucaggug

SEQ ID NO: 183123 - RNA, 62 nt, Human
gacuuuguuuuguccugcaggagcucaggugccccugugauccaggucuucuacccugaaac

SEQ ID NO: 183124 - RNA, 62 nt, Human
aggcauuuggucucacuacuugaccauucucacccugugaaacgucccacacuuugaagcaa

SEQ ID NO: 183125 - RNA, 62 nt, Human
uccccaacccccaagaaccccacuacugcuuucccugugagguaggagauaucagugggccu

SEQ ID NO: 183126 - RNA, 62 nt, Human
ugucugucaauguguaaccugaugucucaacccccugugagaagaguccauuauuugguguu

SEQ ID NO: 183127 - RNA, 62 nt, Human
aauugucagaauggcagguggcuucuuaacagcccugugagaagcagacagaugcaaagaaa

SEQ ID NO: 183128 - RNA, 62 nt, Human
ucuggcacggagggagagacccugggugagaccccugugagcaugggaagggccugcagugg

SEQ ID NO: 183129 - RNA, 62 nt, Human
caugggucccuccauccuugggcuucccgggccccugugacaggggaaagggcucucuuaca

SEQ ID NO: 183130 - RNA, 62 nt, Human
auauagguucugaugaaagcuucauaauuucacccugugacuauccugaaaagaaauaauaa

SEQ ID NO: 183131 - RNA, 62 nt, Human
uuaggcccucagcucccugacguccugagccucccugugacgcucuggccuucucuguaccu

SEQ ID NO: 183132 - RNA, 62 nt, Human
caggaaaacccaccuauggaauaggugccuaucccugugaagaugaaccucuggcccuucca

SEQ ID NO: 183133 - RNA, 62 nt, Human
ccaucuucuaccucugaauggccacccuuagacccugugauccauccucucuccuagcugag

SEQ ID NO: 183134 - RNA, 62 nt, Human
uaacaaacacaaccuucucagcagcauuucuccccugugauggaaauaaaguguuuagggca

SEQ ID NO: 183135 - RNA, 62 nt, Human
cggugccccugugucccacuacacacagaaaacccugugagauggccagucuucauaauagc

SEQ ID NO: 183136 - RNA, 62 nt, Human
uucaaaaccaguacaagaacugcugccugguacccugugagucauuucuaugaaauuccaua

SEQ ID NO: 183137 - RNA, 62 nt, Human
cacacacaccacacacacacacacacacaaaacccugugacuggaguguuauauuacuaugc

SEQ ID NO: 183138 - RNA, 62 nt, Human
uuuugaaaaaucagcaguucugaugccuugaccccugugaugaccugguagucuuagcaggg

SEQ ID NO: 183139 - RNA, 62 nt, Human
uauccaaucucaucucuuguaaauacaugucccccugugaguucugggcugauuugggucuc

SEQ ID NO: 183140 - RNA, 62 nt, Human
gcauguuguagcagugauucaguaaguagcaacccugugauacuauuaccaccaccugcuca

SEQ ID NO: 183141 - RNA, 62 nt, Human
guaauuuugaggaaauugaagaugccaucuuccccugugagugacaugucuuuaauuuuuua

SEQ ID NO: 183142 - RNA, 62 nt, Human
cagacagaagagacccuguuuccccuccucuccccugugacuucacaagagcuugggcuagg

SEQ ID NO: 183143 - RNA, 62 nt, Human
cuuuaucuugcuuaccuuauagauuauaaguccccugugaguaaguaagagucauguuuuuc

SEQ ID NO: 183144 - RNA, 62 nt, Human
cugccuugcagggcgggcuggcuugacucaggcccugugagauagagggcccagcccagccc

SEQ ID NO: 183145 - RNA, 62 nt, Human
cagaggcaggucuucuggaguucucaggggggcccugugacccccucuccacaaccauggcc

SEQ ID NO: 183146 - RNA, 62 nt, Human
aguaccgggaccagaagccauacugcaucagccccugugagccuggcuucagugucuccaag

SEQ ID NO: 183147 - RNA, 62 nt, Human
ucuuuugugguucuagacccuggcuucuaucucccugugauuuguuuuaaugcugaaaugac

SEQ ID NO: 183148 - RNA, 62 nt, Human
auuuugcuuuaaaucucugguaguuuuuccaccccugugacacaauccuaauagacaguguc

SEQ ID NO: 183149 - RNA, 62 nt, Human
auucuuucuguaaagucaaacaggauuccauccccugugaaauaacacaaaauuucacucuc

SEQ ID NO: 183150 - RNA, 62 nt, Human
ugauguucaugucuaucucaaccaggaccagacccugugacuuacucgguaauaacagucca

SEQ ID NO: 183151 - RNA, 62 nt, Human
uccugggugacaaaauuaccuguacaccacaccccugugacacacaacuuacucauguaaca

SEQ ID NO: 183152 - RNA, 62 nt, Human
ugagugaucuuccuuugaaagagaaugaaagacccugugacauuucacuucaaaaauaagcc

SEQ ID NO: 183153 - RNA, 62 nt, Human
agcaggauggggaugggaaaacuaaaggggcccccugugaccgaggagcaggguccccaggg

SEQ ID NO: 183154 - RNA, 62 nt, Human
uacauaucuugaaagaaaagucugugagaaaacccugugauuagagggcaacuuaaugcaag

SEQ ID NO: 183155 - RNA, 62 nt, Human
cccacuguagcggggcaggggguguccaacuucccugugagacugauuaucaauaauaaugu

SEQ ID NO: 183156 - RNA, 62 nt, Human
guacguagaccagugucgucgugagggugggacccugugaaggucugaccaccguuucgcuu

SEQ ID NO: 183157 - RNA, 62 nt, Human
ccugccuugucugucuaggcccauuuggggcucccugugagugauuccccucucucugcuau

SEQ ID NO: 183158 - RNA, 62 nt, Human
acuggacacccuucgaguguggguuuuaacaucccugugagauugaauacuugugccacaca

SEQ ID NO: 183159 - RNA, 58 nt, Human
gugagaagaaugccaaaugaucacaguucccugugacaagaacuauacuugcaacucu

SEQ ID NO: 183160 - RNA, 62 nt, Human
uucuucaacacgucccuccccaggguguuccucccugugacccagccgccucgacuucggcc

SEQ ID NO: 183161 - RNA, 62 nt, Human
ugaaaccacaugcaucauucaggaagccuucacccugugacuauucagccucccugaauaug

SEQ ID NO: 183162 - RNA, 62 nt, Human
caacaaccgcugacuccaggauugcauaagcccccugugaaaucggugcuguacugcauacc

SEQ ID NO: 183163 - RNA, 62 nt, Human
uauaccauuguuuuuucccucaaguauuuuuucccugugaagaagauuauuuaucugcuuuu

SEQ ID NO: 183164 - RNA, 62 nt, Human
uggcucuguucauuaauagauuguuuuguugacccugugaggauuagucuguggaucuugga

SEQ ID NO: 183165 - RNA, 62 nt, Human
uccgcuuugccugcaaaaguaacccaguugcacccugugaagugucugacaaaggcagaaug

SEQ ID NO: 183166 - RNA, 62 nt, Human
uuuuguaugucuuuugagauccugaguucauccccugugaaucagagugcacaagcaccucu

SEQ ID NO: 183167 - RNA, 62 nt, Human
ugagcauaauaaauguaaaaccuauauaguaucccugugauuauuguaugagccuuuguuug

SEQ ID NO: 183168 - RNA, 62 nt, Human
auuuaggaauuuucucucuuggaaaaggcuuccccugugaugaaaaugaugugccagcuaaa

SEQ ID NO: 183169 - RNA, 62 nt, Human
uaguuccaggacucagggacucaggccagucacccugugaccgcagguugcuuucccacccu

SEQ ID NO: 183170 - RNA, 62 nt, Human
ucucaaggaacauuuuaaaaagaacgucuguccccugugaugcuggcuguuaugccuuugaa

SEQ ID NO: 183171 - RNA, 62 nt, Human
ggcuggguccccugcccaccugccucccugcccccugugacggagggggcaagcaagccccc

SEQ ID NO: 183172 - RNA, 62 nt, Human
ugagaaggagccacaaguuguggcugagaguucccugugaacuugaguaguucauagagugc

SEQ ID NO: 183173 - RNA, 62 nt, Human
agugcugcuugucuucccaguguugguuugaacccugugagccugagacagagagggccagg

SEQ ID NO: 183174 - RNA, 62 nt, Human
uggagcuggaagaaucugcucuccgguggcugcccugugaacagagggcucccggucagcuu

SEQ ID NO: 183175 - RNA, 62 nt, Human
ucgagagaucaucccuuugucugcauugacggcccugugacggccuccagcccacaggccug

SEQ ID NO: 183176 - RNA, 62 nt, Human
gguauggccaagcugcuagaagaugcugcugucccugugaucccagcagcccucccuucacc

SEQ ID NO: 183177 - RNA, 62 nt, Human
auccccgugguucaucugauauaauuaguguucccugugaauucccccccucuaugggaagg

SEQ ID NO: 183178 - RNA, 62 nt, Human
gaugaugaggucuuugaaguaauucugaacuccccugugaaugcaguucuuggcacaaagac

SEQ ID NO: 183179 - RNA, 62 nt, Human
acguuauguuacggcacaaaauuaauuucugccccugugauugggccacgguugccaaggua

SEQ ID NO: 183180 - RNA, 62 nt, Human
acauaguggguauaaucauggaucgcuuguaccccugugaaaauauauuuuuuaaaaauauc

SEQ ID NO: 183181 - RNA, 62 nt, Human
aguucugugcauaacaggaucccauaccaaagcccugugaguucaucagagucagcuccagg

SEQ ID NO: 183182 - RNA, 62 nt, Human
aagccuggguucugguuguagcucuggccccucccugugaucuucaacaagccacuugcuuu

SEQ ID NO: 183183 - RNA, 62 nt, Human
ucuggaugcuuggauggaaagggaaaaauggacccugugaugcuaauaaaacuguucucccu

SEQ ID NO: 183184 - RNA, 62 nt, Human
uaccuuuguauccaggagaaacugcagagcagcccugugacuuuacaaaauaugcuaccuca

SEQ ID NO: 183185 - RNA, 62 nt, Human
aggauggcacaagcgauucacguaggaucugccccugugaccaaaacaccucccauugggcc

SEQ ID NO: 183186 - RNA, 62 nt, Human
guuacaggcaggcugcacacagcagucccaggcccugugaggggcuucagacuccagcuaca

SEQ ID NO: 183187 - RNA, 62 nt, Human
ccucggagagagguggugggaugggagagagccccugugaaagccugugaggaucugaagag

SEQ ID NO: 183188 - RNA, 62 nt, Human
caucuggaguuuuaaaaggcucccaugugagucccugugauggccaggccaggggaccccug

SEQ ID NO: 183189 - RNA, 62 nt, Human
cuguuaccagacagaggcaacugaugaaaaagcccugugaaagauaggaugugaggugagca

SEQ ID NO: 183190 - RNA, 62 nt, Human
aagaaggugucugcucuuacauuauuguggagcccugugauagaaauauguaaaaucucaua

SEQ ID NO: 183191 - RNA, 62 nt, Human
ugggcugaaggacacggugcagcagagggugucccugugagaguucugcagagugcugggca

SEQ ID NO: 183192 - RNA, 62 nt, Human
caguguccccggcuucuaagccuccaauaucacccugugagccucgcacagcucagccccaa

SEQ ID NO: 183193 - RNA, 62 nt, Human
cuccucaaccuugacuucugcccaaauccccucccugugacccguuccauaucccuuucucu

SEQ ID NO: 183194 - RNA, 62 nt, Human
gaguguaagagcuuuguuucuuuauggaacuccccugugauugcaguaaauuacuguauugu

SEQ ID NO: 183195 - RNA, 62 nt, Human
agagcacagcuugugcaacucugguagcguuacccugugacacuguuuugagguccacuucc

SEQ ID NO: 183196 - RNA, 62 nt, Human
ggugaccucauucagucgguuaagagccugagcccugugaaguuaaacaccugcucaugguc

SEQ ID NO: 183197 - RNA, 62 nt, Human
aucaucacguaacaggaucuucagaaaaacuacccugugacuaugaagaaaauauauauugc

SEQ ID NO: 183198 - RNA, 62 nt, Human
uagcauuuauuuauauuucucuguaggguguucccugugacauugucucuuuaguuugcucu

SEQ ID NO: 183199 - RNA, 62 nt, Human
ugauucuugagagggcaaacucaggaggggagcccugugauuguccagcucaugcuccgagg

SEQ ID NO: 183200 - RNA, 62 nt, Human
aucaccucucucuccuagacgcccaggaccggcccugugagccgugcuggccccacccgagg

SEQ ID NO: 183201 - RNA, 62 nt, Human
cuguccuggagcuuccgaucucuguucggggacccugugagccuucuggccggcugcgugca

SEQ ID NO: 183202 - RNA, 62 nt, Human
ccauguuagccaggcuggucucaaacuccugacccugugauccgcccgccucggccucccaa

SEQ ID NO: 183203 - RNA, 62 nt, Human
ggaaucucuuuaacugauuuugcuaaaaaucucccugugagccuuccacucaacucuuaaua

SEQ ID NO: 183204 - RNA, 62 nt, Human
uauuuuacaggccacaauugauuaugaagucacccugugauucucuuugcccacaugaccac

SEQ ID NO: 183205 - RNA, 62 nt, Human
caucuaccucagaccccuaucauggggcucuacccugugacaagagccaaacccauucucca

SEQ ID NO: 183206 - RNA, 62 nt, Human
guggugccccagcacgguggugcccaagccaacccugugacugacauguacgauucacuccu

SEQ ID NO: 183207 - RNA, 62 nt, Human
ucuuugugggggccagaucagaagagagaggccccugugacgcccgggcugcuuggucacaa

SEQ ID NO: 183208 - RNA, 62 nt, Human
aaaagaaaaagggagaaaaccucuuagcaaagcccugugaguuugggggucagguucaagaa

SEQ ID NO: 183209 - RNA, 62 nt, Human
cugcccucuguggaagccagcuuaaacccuagcccugugagagcuuccugugcccagcagga

SEQ ID NO: 183210 - RNA, 62 nt, Human
uggccuccccugugcaccugggggguccuggccccugugaugcucccccauccccacccacu

SEQ ID NO: 183211 - RNA, 62 nt, Human
ccacauuugaaauuguuuucccuuucauuuuacccugugaaagcaucucuccuagagccuug

SEQ ID NO: 183212 - RNA, 62 nt, Human
agcuggccuuugggccuuuuccuuucuaccuccccugugaccuuuccuagccucagaucugu

SEQ ID NO: 183213 - RNA, 62 nt, Human
aaacacaggcuguccuuaacccaccucuccugcccugugauaugucugcugaguuggccugg

SEQ ID NO: 183214 - RNA, 62 nt, Human
ccuuaaagucuuagccaagagccaagacauagcccugugacaaggugaacaguuggguggga

SEQ ID NO: 183215 - RNA, 62 nt, Human
auuucacacaugugaccaggggccaccaaagucccugugaccuuugugacuaggauccuaau

SEQ ID NO: 183216 - RNA, 62 nt, Human
caagcuuugaggaggcaggagauuccgugggucccugugacauauugcauuaagaucguggc

SEQ ID NO: 183217 - RNA, 62 nt, Human
aacacugacccagcuucuggguauggaaauaacccugugaugauguguuaauauaaaauguu

SEQ ID NO: 183218 - RNA, 62 nt, Human
aagaguuugcucacguaaacgcccgugcugggcccugugaagccagcauguucaccacuggu

SEQ ID NO: 183219 - RNA, 62 nt, Human
ccuucaagucucuccaguguguggggacgggucccugugagcaacaaaacugcacuguuucu

SEQ ID NO: 183220 - RNA, 62 nt, Human
cuggcagccccaggccauggcguugccagccucccugugacagagccuggugaacagugagc

SEQ ID NO: 183221 - RNA, 62 nt, Human
cugcuacagcugaggccuggaucccggccuuucccugugacuuacgugucugucaccggcag

SEQ ID NO: 183222 - RNA, 62 nt, Human
agguguaggcaggugggcucugcuucccgauucccugugagcgcccacccucucgaaagaau

SEQ ID NO: 183223 - RNA, 62 nt, Human
acauguauaacaaaaagcucucuccagaucaucccugugaaugccaaaguaaacuuuaugua

SEQ ID NO: 183224 - RNA, 62 nt, Human
cuauuacuacuucuuaucaaaaaucuguaaugcccugugauuuuuaugauacuucuucaaua

SEQ ID NO: 183225 - RNA, 62 nt, Human
gguccugcccucggcuggaguuccuuucucaccccugugauuuggagguguggagaagggga

SEQ ID NO: 183226 - RNA, 62 nt, Human
cccccuacucccugcugugaaacaaucccucucccugugagaggaaacuguggagcguuucu

SEQ ID NO: 183227 - RNA, 62 nt, Human
uuguccaggccugggugguauagggcguuuggcccugugacuauggcucuggcaccacuagg

SEQ ID NO: 183228 - RNA, 62 nt, Human
uuggccugccccagugacagugggacgggcugcccugugaguguccaccuggagggaucccc

SEQ ID NO: 183229 - RNA, 62 nt, Human
auucuuggaccucuccuggcugagcucugauucccugugagcacgaugcugaugcaauaguc

SEQ ID NO: 183230 - RNA, 62 nt, Human
uuuugcuauuuccaaagcuuccccuuaucguccccugugauuaucucccaaccccgugacaa

SEQ ID NO: 183231 - RNA, 62 nt, Human
caccuuucauaacaggcucagaucacucagcucccugugaccuuuguauucacccaggcuuc

SEQ ID NO: 183232 - RNA, 62 nt, Human
auaggucaaauggauuucagagguuuaaacuucccugugauucccccgaauacccccaaaau

SEQ ID NO: 183233 - RNA, 62 nt, Human
cgucagucugucuuucuccgcucuucucugaccccugugaggaaccuccuuacccuguucug

SEQ ID NO: 183234 - RNA, 62 nt, Human
ugcguggauguuuccuuaaccucagcugacuucccugugaaugucuaaugcuaguucagggc

SEQ ID NO: 183235 - RNA, 62 nt, Human
gcuccuggcucugcaggcggcacagccuggggcccugugauccucugguuucuuccauuggg

SEQ ID NO: 183236 - RNA, 62 nt, Human
cgagccccccacauggugccgcggcacguccccccugugacgcguuccagaccaacaugacc

SEQ ID NO: 183237 - RNA, 62 nt, Human
aaugucacucuuaccgucaugucuugcaacaacccugugagggcaguauuaaugcccccuua

SEQ ID NO: 183238 - RNA, 62 nt, Human
cugucacccuggagaagggaaacuguacuuuucccugugaggaaacggcuuuguauuuucuc

SEQ ID NO: 183239 - RNA, 51 nt, Human
gcuaccugcucuaccagugagcccugugauaccacagacugugcugagguc

SEQ ID NO: 183240 - RNA, 62 nt, Human
ucccuggagcaggcaguguggaggcagccauccccugugaugacuggcagcuaaggaggacc

SEQ ID NO: 183241 - RNA, 62 nt, Human
cuccaggggucuugggugggggagcccagggccccugugaccccuccuuucuuccuccaauc

SEQ ID NO: 183242 - RNA, 62 nt, Human
ccugauugggguggggacuguccuacuguaaccccugugaaaaaccuugaaauauaacacuc

SEQ ID NO: 183243 - RNA, 62 nt, Human
aggccauaauuguuccauagaccccucucuagcccugugacuguaguuaguuacuuugauaa

SEQ ID NO: 183244 - RNA, 62 nt, Human
uuugggagcuggagaacagggguuaucccuaccccugugaacucuguuaacagcuuacauag

SEQ ID NO: 183245 - RNA, 62 nt, Human
ucccugccaggaauuuccaacaaaccccaccacccugugagcacucuacuggcugucccuga

SEQ ID NO: 183246 - RNA, 62 nt, Human
ucacaucaaccgccagaaguggaguugggcagcccugugaagccagaggagauggacugguc

SEQ ID NO: 183247 - RNA, 62 nt, Human
cucucuuaugucacagcuggccugcagcaggucccugugagcacauaagcagaggcugcagg

SEQ ID NO: 183248 - RNA, 62 nt, Human
uucugcauuugguugguuuccugaagcgcagccccugugaauaacagguggcuuuucaugga

SEQ ID NO: 183249 - RNA, 62 nt, Human
ccauguuggccaggcuggucuugaacuccugacccugugauccgaccaccuuggccucccaa

SEQ ID NO: 183250 - RNA, 62 nt, Human
ugacccgacuccacuccaggaaggccaucugacccugugacaggcauagcucauaaacuacc

SEQ ID NO: 183251 - RNA, 62 nt, Human
augguggacgcguucugcucacgggcccagagcccugugaaaugcaucaagguccucuccgc

SEQ ID NO: 183252 - RNA, 62 nt, Human
cugucugaguaagcccucaggagccucugcuccccugugaacccacugaaccuucugagccc

SEQ ID NO: 183253 - RNA, 62 nt, Human
auagcaggacugcaaauuauccuucugccugccccugugacacacacacacacacacacaca

SEQ ID NO: 183254 - RNA, 62 nt, Human
cugcacugcauccugccuccuugcugaggggccccugugagaggccucuggaugggcauggg

SEQ ID NO: 183255 - RNA, 62 nt, Human
uccaagaauuuuauaguacaucuuguuugucucccugugaaaacaacuggaaucuuaaaaaa

SEQ ID NO: 183256 - RNA, 62 nt, Human
auggguaaacaucccuuccugucucccacaaccccugugacugcccugcauguguucaugac

SEQ ID NO: 183257 - RNA, 62 nt, Human
caaaagacuuuuuugaaucugucauucacauacccugugaagacaauacuaucuacaauuuu

SEQ ID NO: 183258 - RNA, 62 nt, Human
ccccaucgggcucgcugacgaggaagcgcugucccugugaugagguucucucucagagaguc

SEQ ID NO: 183259 - RNA, 62 nt, Human
ccaugaagggccaggaugcccagaugcuuggccccugugaagugcugucuggagcagcagga

SEQ ID NO: 183260 - RNA, 62 nt, Human
accuuacuguucaccucaucaaaucaguucugcccugugaaaagauccagccuucccugccg

SEQ ID NO: 183261 - RNA, 62 nt, Human; identical to SEQ ID NO: 183260

SEQ ID NO: 183262 - RNA, 62 nt, Human
uuuuccuuguguaacaaauggaaaacauucuccccugugagaaauaaugcaauuucuaauua

SEQ ID NO: 183263 - RNA, 62 nt, Human
ugagucgcggccccugggagcugaucuggacacccugugacacuggcguucuccucuccccu

SEQ ID NO: 183264 - RNA, 62 nt, Human
uauuuucuuaagccaugaugugaaaccaaugacccugugaccacauggcacagaacacuaaa

SEQ ID NO: 183265 - RNA, 62 nt, Human
uagucucauuguagguuugugcaccagagugacccugugagccuuuguuaauagguugggag

SEQ ID NO: 183266 - RNA, 62 nt, Human
acugagcaauuuuauuucaggcuuccagcugucccugugaguuauccuggacauuucgaugg

SEQ ID NO: 183267 - RNA, 62 nt, Human
gcacgccaccugcuccugagccuccacuaucucccugugacgggugaacuucguguacugug

SEQ ID NO: 183268 - RNA, 62 nt, Human
guacacagcuggcaccagagcaucacagagagcccugugagccaaaaaguauaguuuuggaa

SEQ ID NO: 183269 - RNA, 62 nt, Human
ccgugugccuacccacuggaggccauggacagcccugugagccuacaggacgagcaccaggg

SEQ ID NO: 183270 - RNA, 62 nt, Human
uuacaggcgugagacacugcgcccagccucaucccugugaauuucuuauuguacacaaguuc

SEQ ID NO: 183271 - RNA, 62 nt, Human
ccucccaggcauucucagugccagggcuucaucccugugaaggcacagggccugcuaguggg

SEQ ID NO: 183272 - RNA, 62 nt, Human
gguccaaguguguggagggcugagugugcuggcccugugacucaggaccagcucuggagucu

SEQ ID NO: 183273 - RNA, 62 nt, Human
cagcauggcuuaugugcacguguaaauggagucccugugaaugacagcauguuucuuacaua

SEQ ID NO: 183274 - RNA, 62 nt, Human
ucucccuccaagaggggcccagcauuguauuucccugugaccccuuacucuccuggccagaa

SEQ ID NO: 183275 - RNA, 62 nt, Human
gaauaugggacaggacauggucagggagaggacccugugaguuggugacauauauguggcag

SEQ ID NO: 183276 - RNA, 62 nt, Human
gaucccagcuagacuuagaacuuggacuuuuccccugugaagggggcugccaggacaucuca

SEQ ID NO: 183277 - RNA, 62 nt, Human
caucuuggcuugcagagcugggcugggcacagcccugugacgucuggagcauuggcugcauu

SEQ ID NO: 183278 - RNA, 62 nt, Human
cuggaaacaaagggcucaagcaccccuuucaacccugugacugggguccucccucgggcugu

SEQ ID NO: 183279 - RNA, 62 nt, Human
uuaucaccuuuauuagauaaaucaugaagugucccugugaaauugaagugaaacuaucucug

SEQ ID NO: 183280 - RNA, 62 nt, Human
uacgaaucuucuuaaauauauauauauacacacccugugagaacuguaaaaaguaccucugg

SEQ ID NO: 183281 - RNA, 62 nt, Human
accagcuugcgaauaacaguccccguggccaucccugugagggugacguuagcauuaccccc

SEQ ID NO: 183282 - RNA, 62 nt, Human
uauaaugacacuguguucugugagggagcaggcccugugagaaucaauucaggacaguauuu

SEQ ID NO: 183283 - RNA, 62 nt, Human
aggggagugagaguucagggaggcccuucccacccugugaggcuugacuugaucuggauugg

SEQ ID NO: 183284 - RNA, 62 nt, Human
ucccaaaaaaucccaggaacuccuaaaccuuccccugugacagaagaugagguuggcagcug

SEQ ID NO: 183285 - RNA, 62 nt, Human
cuauccagagaggugcagcaagagagccauuucccugugacauuuaguggacuggccaguuc

SEQ ID NO: 183286 - RNA, 62 nt, Human
cugccagacggcacggucugggugcggguguucccugugagcccgaguccgcuucaggaggg

SEQ ID NO: 183287 - RNA, 62 nt, Human
gccaggaagaaauaggacgugacgguacugggcccugugauucucccagcccuugcaguccg

SEQ ID NO: 183288 - RNA, 62 nt, Human
ugcuucugucaccugcucccuuucuugcgucucccugugaugggcccuuaggccuggcuggg

SEQ ID NO: 183289 - RNA, 62 nt, Human
gccccugcuagcguauuacuguucugugacuucccugugaccucugcagaacuccucauccu

SEQ ID NO: 183290 - RNA, 62 nt, Human
uuaauggccuuccccucggccucguuaagcaucccugugacgcucucaacuucauucuaagg

SEQ ID NO: 183291 - RNA, 62 nt, Human
gucuuuggagucggggauggaggagguucugccccugugagguguuauacaugaccaucaaa

SEQ ID NO: 183292 - RNA, 62 nt, Human
aucauuccagcuagaagagcuucccccugacacccugugacugagccuguguccugucugcc

SEQ ID NO: 183293 - RNA, 62 nt, Human
auuaaaugcccagccccuucugacccaugcugcccugugaguacuacaguccucccaucuca

SEQ ID NO: 183294 - RNA, 62 nt, Human
ccaggcugggagagccuuccaggggugggacacccugugauggggcccugccuccuuuguga

SEQ ID NO: 183295 - RNA, 62 nt, Human
ccugagggagggggagggaucggccaccuccucccugugagacggaugcagguccuucccuc

SEQ ID NO: 183296 - RNA, 62 nt, Human
uggagagcuccuauuucaaggagaagccccuacccugugagccggagcucaugccgaccuuu

SEQ ID NO: 183297 - RNA, 62 nt, Human
ccuucuuuuccuggcccugucucuggacucuccccugugaggcccaauuccaagacagacuc

SEQ ID NO: 183298 - RNA, 62 nt, Human
uaacuguugcguggaguucacaguucgacuaacccugugaacacccaagccaggaguucuau

SEQ ID NO: 183299 - RNA, 62 nt, Human
guaggaaaggacacgccgucuguccucacgcccccugugacuuuucauauuuccguuuucca

SEQ ID NO: 183300 - RNA, 62 nt, Human
gcaaccuggaccccaucugggugugggucagacccugugacccacaugccacccccacccuc

SEQ ID NO: 183301 - RNA, 62 nt, Human
guccagagaggugagauuagaucuucuugguucccugugagguuucaggcacuaaaacucua

SEQ ID NO: 183302 - RNA, 52 nt, Human
aagggaaguuugaagagugagucccugugagggccgugugccccaugcuacc

SEQ ID NO: 183303 - RNA, 62 nt, Human
ucgcauccgccucugagccaggagccuccugacccugugaugccugacacaggggacacuga

SEQ ID NO: 183304 - RNA, 62 nt, Human
uuacugauauuucauuauaauuaguucaccuucccugugaaacaagagaauuguaaaauguu

SEQ ID NO: 183305 - RNA, 62 nt, Human
gccaguuguugccaaccuuauagggaugaguccccugugagauuuugcuuuuccacugccug

SEQ ID NO: 183306 - RNA, 62 nt, Human
gaagcugacaucuccaagagguacagcgggcgcccugugaaccugaugggaaccucucugug

SEQ ID NO: 183307 - RNA, 62 nt, Human
ggcaguuucacuugcaaaauuacacagcuggucccugugaugugucucgacaccaauacaca

SEQ ID NO: 183308 - RNA, 62 nt, Human
cgagccacugcaaagcacagcugauccuggcccccugugaagaaguguucuggucaaaacua

SEQ ID NO: 183309 - RNA, 62 nt, Human
gccauugagggcagcguccaggagagcucgggcccugugaccacgaucuacaugcuggcagg

SEQ ID NO: 183310 - RNA, 62 nt, Human
uugauaugauuuuaauucauuacagaaagaaacccugugaaggguauucaaaaacauaacuc

SEQ ID NO: 183311 - RNA, 62 nt, Human
ucuggcaaauaagauucuaaaagcacuuauaucccugugaauacuucagaggacuuuggccu

SEQ ID NO: 183312 - RNA, 62 nt, Human
guucacccauggugcccaugucguucuucucucccugugacacagcuuguacagucugauuc

SEQ ID NO: 183313 - RNA, 62 nt, Human
ucaguuuccuccaacuccugguucagccauugcccugugagggcucacucggcuuccaggga

SEQ ID NO: 183314 - RNA, 62 nt, Human
gcugggcucuuggacaccugguucucagagaacccugugaugaucacccaagccccaggcug

SEQ ID NO: 183315 - RNA, 62 nt, Human
cagcccagguaggggcaggauggagggcugagcccugugacaaccugcuguuaccaacugaa

SEQ ID NO: 183316 - RNA, 62 nt, Human
uccucugucagucaugcguccacuuucccuuccccugugacuccucccuuccccacucugcu

SEQ ID NO: 183317 - RNA, 62 nt, Human
gaaagaaaaggauuuaagcaaaggcucccucgcccugugagggcgagcggcaaaggcccggc

SEQ ID NO: 183318 - RNA, 62 nt, Human
cagacuucuugcguuucaaaacugccaugccccccugugaugcucccgugaaggaaugcacu

SEQ ID NO: 183319 - RNA, 62 nt, Human
gcagcuguggcuucuagcugcccggguggcaucccugugaccccuccccagugccucuccug

SEQ ID NO: 183320 - RNA, 62 nt, Human; identical to SEQ ID NO: 183319

SEQ ID NO: 183321 - RNA, 62 nt, Human
ugugagggagugcagaacaccuggccgggucacccugugacccucucacuuugguuggaacu

SEQ ID NO: 183322 - RNA, 62 nt, Human
ccuccugggaaaggggccgcugcugucuggugcccugugagcugugauugauugccuuuggu

SEQ ID NO: 183323 - RNA, 62 nt, Human
caugccccuuccucuuucuccuccuaccucugcccugugagcccauccauaaggcucucaga

SEQ ID NO: 183324 - RNA, 62 nt, Human
agccuagguggccaaggcuuccugcauugcuucccugugaguccaaggccuucccccaccac

SEQ ID NO: 183325 - RNA, 62 nt, Human
uuccuucuaccuaucuugccuuaauuaacauucccugugaccuaguuggugcaguggcuuga

SEQ ID NO: 183326 - RNA, 62 nt, Human
agacugccccccgagcaguguccccagccuagcccugugagaccccauggggacacgggugc

SEQ ID NO: 183327 - RNA, 62 nt, Human
gccauauugucaccucagcacuguggacaccucccugugaagagauccuuccauuccaucua

SEQ ID NO: 183328 - RNA, 62 nt, Human
auucauucagaaccuguuagauuaaagcugcacccugugauuauuugaaaagaauuagcuug

SEQ ID NO: 183329 - RNA, 62 nt, Human
agccuuugaauucugcaggugucaugugcuggcccugugauuuugccucccacacccagcca

SEQ ID NO: 183330 - RNA, 62 nt, Human
ggcuaauuccaaaaagcaaggcuagaaaauagcccugugaggucaagacaauuuaauuuauu

SEQ ID NO: 183331 - RNA, 62 nt, Human
ggaucagccccuccugaguggccagccuuucccccugugaaagcaaaauagcuuggaccccu

SEQ ID NO: 183332 - RNA, 62 nt, Human
guuaccaacccugccugagccucaguuuccuccccugugaaaugagaacacgggguaacugc

SEQ ID NO: 183333 - RNA, 62 nt, Human
gauuucauaaaaggacacacacuggagagaaacccugugaauguaagaaauguagaaaagca

SEQ ID NO: 183334 - RNA, 62 nt, Human
uggaaguguucagacaguuuauaauaguaagccccugugacccucucacuuaccccgagacc

SEQ ID NO: 183335 - RNA, 62 nt, Human
agagcaugcccuuugccguugcaugcaaccagcccugugauuccacgugcagaucccagcag

SEQ ID NO: 183336 - RNA, 62 nt, Human
uuggacugcgaccuccuucccuccugggagagcccugugaccugcaugcuacucuuaacugu

SEQ ID NO: 183337 - RNA, 62 nt, Human
uaccaguuguccccaccaucccccgcccuccucccugugagacacugggccaaaggcucacu

SEQ ID NO: 183338 - RNA, 62 nt, Human
ggccuggcuguggucuucuuggucuugcugcccccugugacccaaaggcaugggauggacag

SEQ ID NO: 183339 - RNA, 62 nt, Human
cuaggcagcagagaauucauacuggagagaagcccugugaauguuaacaaauguggaaaagc

SEQ ID NO: 183340 - RNA, 62 nt, Human
cuguccugaguacugggaaguuucuccugaagcccugugagauggcucuguggcugguaucc

SEQ ID NO: 183341 - RNA, 62 nt, Human
ggccacgcccccacccaccccgcguguuucugcccugugacuccuggaaccugcguccuccc

SEQ ID NO: 183342 - RNA, 62 nt, Human
gcguucacugcagggcgggggcggcaccgcuccccugugacugcaucccgccucccugggga

SEQ ID NO: 183343 - RNA, 62 nt, Human
ccagggccccggcaccccggucggcagccugccccugugagacccacccucccgagcggcca

SEQ ID NO: 183344 - RNA, 62 nt, Human
ucagaggagcgggcugccuuccgccuggggcucccugugaccucucaguccccuggcccggc

SEQ ID NO: 183345 - RNA, 62 nt, Human
acggccuaaaagccucuuuguggcugaaaggucccugugacauuuucugccacccaaacgga

SEQ ID NO: 183346 - RNA, 62 nt, Human
cagauacuuguacgaaacacauuggagauagacccugugaauguaagcacuugguaaagccu

SEQ ID NO: 183347 - RNA, 62 nt, Human
cccuccaccccccggccacacguguccuauuccccugugauccguaaggccggcggcucggg

SEQ ID NO: 183348 - RNA, 62 nt, Human
acuuccagacucuccccucucccacccuucuacccugugaagggaaaugagggcuuuaguuu

SEQ ID NO: 183349 - RNA, 62 nt, Human
uuacaaaauauauauauggagaugcucccucccccugugaaccccccagugcccccgugggg

SEQ ID NO: 183350 - RNA, 62 nt, Human
gaugcccuggugucuuucuccugggcuucuaucccugugaggagaggugcugucugcuggag

SEQ ID NO: 183351 - RNA, 62 nt, Human
ugauaauuuauacuaacuagaaacagaauugucccugugaaaucuuuuuauggcagguaauc

SEQ ID NO: 183352 - RNA, 62 nt, Human
cuccucucuccccagaacauccagagucuguccccugugaagaagaagaagauggugccugg

SEQ ID NO: 183353 - RNA, 62 nt, Human
auuucuuccaccuuuccugcuaguucccacuccccugugaccacuggggccucagggaagau

SEQ ID NO: 183354 - RNA, 62 nt, Human
cuguauuuuacauaauugauuuucuacuccugcccugugaauuaaggcagaguuuuacugua

SEQ ID NO: 183355 - RNA, 62 nt, Human
ggacuggggccgcaacccaggguccgaaugagcccugugaggcccacacccccaggugaacc

SEQ ID NO: 183356 - RNA, 62 nt, Human
cgccugcucccucugcugacauuucaagcugacccugugaucucugcccugucuucgggcga

SEQ ID NO: 183357 - RNA, 62 nt, Human
uugacaucuuuucacuucacguaguccuaagucccugugaccugccagagucucuuccccag

SEQ ID NO: 183358 - RNA, 62 nt, Human
aauaaauauuuaauggaagguuccacaagucacccugugaucaacaguacccguaugggaca

SEQ ID NO: 183359 - RNA, 62 nt, Human
cuaggggaagggggcauuuggcuagggggugccccugugagccucgaccuugcccccucguc

SEQ ID NO: 183360 - RNA, 62 nt, Human
acuaacacaugagcagucacuuuggagagaagcccugugaauacagugaauguaaggauccc

SEQ ID NO: 183361 - RNA, 62 nt, Human
aagugaauaauaauuagguuaacauuguugcucccugugacaaaauuuuauaagcaaauuuc

SEQ ID NO: 183362 - RNA, 62 nt, Human
ccaucauccucuuccuaccuugaguuuuucuacccugugaggugggacuuucaguaaaagcc

SEQ ID NO: 183363 - RNA, 62 nt, Human
cuccuagccccugucaugguguccagacagagcccugugaggcuggguccaauuguggcacu

SEQ ID NO: 183364 - RNA, 62 nt, Human
cugagcuggguaggcucuaaacuucacaauaacccugugacuuaacuacuuuaucuccauuu

SEQ ID NO: 183365 - RNA, 62 nt, Human
gccggggcugccagcgcauccagccagcccagcccugugaaagauggagcugacuugcugca

SEQ ID NO: 183366 - RNA, 62 nt, Human
caaaugaccuuuugucuuuggggcguucuucccccugugauagcggcaguggcuuuuucugg

SEQ ID NO: 183367 - RNA, 62 nt, Human
uguuugcauggcagggcuccagcugccuucagcccugugacgucuccucagggcagcuggac

SEQ ID NO: 183368 - RNA, 62 nt, Human
gcuguauuuuacccuugagcuuagccgcgggucccugugaaccggcacauuccuuuccuuua

SEQ ID NO: 183369 - RNA, 62 nt, Human
ggccuggggccggcgagaaaucuccugugaugcccugugaaauggcuugucuccucccccau

SEQ ID NO: 183370 - RNA, 62 nt, Human
ucccgaguuagcucuuuggguggccccugagccccugugagugcacuugaccgggugcggag

SEQ ID NO: 183371 - RNA, 62 nt, Human
accaggccgggcgcggcugggucccccgggggcccugugagagagguggcggugaccguggu

SEQ ID NO: 183372 - RNA, 62 nt, Human
gcccgucagccauggcugccaucuggcuucugcccugugaccccgugaccccgugaccccga

SEQ ID NO: 183373 - RNA, 62 nt, Human
uccccagcagguggugcgggugugugaguggccccugugauggccagccuggcuuggacacg

SEQ ID NO: 183374 - RNA, 62 nt, Human
gauuacaggggugagccgcugugccuggcuggcccugugauauuucugugaaauaaauuggg

SEQ ID NO: 183375 - RNA, 62 nt, Human
gacacgcagcgcguuggugucuccguguuugucccugugaaaacauguaacgucugccuuag

SEQ ID NO: 183376 - RNA, 62 nt, Human
acuccuaggacgcacgcauaucagcccguguacccugugacagugacuguccccaccuccua

SEQ ID NO: 183377 - RNA, 62 nt, Human
uuugucugcugggcugagggacacgagggcaacccugugacaauggcagguagugugcaucc

SEQ ID NO: 183378 - RNA, 62 nt, Human
augaaugccaucagucccuccugcuguugccucccugugaccuggaggacagugugugccau

SEQ ID NO: 183379 - RNA, 62 nt, Human
gaccaggaaggggacucugggggacuggcuuccccugugagcagcagagcagcacaauaaau

SEQ ID NO: 183380 - RNA, 62 nt, Human
gaccaggaaggggacucugggggaccggcuuccccugugagcagcagagcagcacaauaaau

SEQ ID NO: 183381 - RNA, 62 nt, Human
ugaagccuuuuuccuggucccagcagcaucugcccugugaaguuuguuuucucccacugccu

SEQ ID NO: 183382 - RNA, 62 nt, Human
cccagcagccuccuacagagcaggaagaggcgcccugugaacccugaguguugcaggcccag

SEQ ID NO: 183383 - RNA, 62 nt, Human
aagccccgcuccaugagcagugacuccccaggcccugugaccucccuccugucuugcagcuc

SEQ ID NO: 183384 - RNA, 62 nt, Human
ggcgcgccccaccugccuggcuggugguaggccccugugagcuggucccgggcugcuaaaag

SEQ ID NO: 183385 - RNA, 62 nt, Human
ggguggaggggccucggccucagagucaugugcccugugaccacugaagggugucagcagag

SEQ ID NO: 183386 - RNA, 62 nt, Human
cccaugaaaucaauggccucuguauggagcgacccugugagaagcacuuggcuggcugagca

SEQ ID NO: 183387 - RNA, 62 nt, Human
gaugaggaagaggacuuugggggacgggcuuccccugugagcagcagagcagcauaauaaau

SEQ ID NO: 183388 - RNA, 62 nt, Human
cuaauugugagauggugaagauaaauuuucugcccugugagugacacuggccaggggauagg

SEQ ID NO: 183389 - RNA, 62 nt, Human
cgggaaaccagagucaaaaguuaucucccucucccugugaugccuugagauuuuuuucugcg

SEQ ID NO: 183390 - RNA, 62 nt, Human
cugauggcugccuugcuccuugcucccccacccccugugaggacuucucuaggaaguccuuc

SEQ ID NO: 183391 - RNA, 62 nt, Human
cuucacaauuugugucucguuguucagaacaacccugugaaguaguuuuggcaaugucugug

SEQ ID NO: 183392 - RNA, 62 nt, Human
aggacccaucccugccuggaggcuccucuaggcccugugagcacaaagaagaaagcugauuu

SEQ ID NO: 183393 - RNA, 62 nt, Human
gcagcguuaaugcgcauugcgugcgaaugaaccccugugaacgguugacuagaugaguaauc

SEQ ID NO: 183394 - RNA, 62 nt, Human
cuggaguuccaaaugcaauauagaaaaaaaaacccugugacucuggauuuuauuuuaaguuc

SEQ ID NO: 183395 - RNA, 62 nt, Human
ccaugcaccaccucagaucuccaaacugaugucccugugaacaccugcacuaugagaagguu

SEQ ID NO: 183396 - RNA, 62 nt, Human
aguacacauaaguuauuuccuaggauuuuucccccugugaacaggcauguuguauuauauaa

SEQ ID NO: 183397 - RNA, 62 nt, Human
cagcuucgugucuaguaugagcucaguacuugcccugugaaaaucccagaagcccccgcugu

SEQ ID NO: 183398 - RNA, 62 nt, Human
ggaaggaagcaccagggcaaggcggacgcucacccugugaccacgauggugaccgugacugu

SEQ ID NO: 183399 - RNA, 62 nt, Human
agcccaaaccauccucuccuuaccacucccaucccugugagcccuaccuuaccccucugccc

SEQ ID NO: 183400 - RNA, 62 nt, Human
guguuuuccaguauuacaagaucaacuucugacccugugaaaugugagaaguacacauuucu

SEQ ID NO: 183401 - RNA, 62 nt, Human
uagggcuggagggcuauggauucccagcccaucccugugaaggaguaggccacucuuuaagu

SEQ ID NO: 183402 - RNA, 62 nt, Human
aaaggaauuuggcuggggagcugaacagggcucccugugaucugaagaaagcuuuuggugcu

SEQ ID NO: 183403 - RNA, 62 nt, Human
cagucaugccagucuggacaugcucuguugugcccugugacaaaacugcucaguauuccuau

SEQ ID NO: 183404 - RNA, 62 nt, Human
uugcuuuucuuguuaagauaaucucuuuacuccccugugagugauucacugccuugucauua

SEQ ID NO: 183405 - RNA, 62 nt, Human
aguacuccugaccccagugacagcuagcccuccccugugaugguggugguggauacuaauac

SEQ ID NO: 183406 - RNA, 62 nt, Human
uuuuucuuuaauuuuaggacauuuaggguccccccugugaauuagaaaguugcuuggcugga

SEQ ID NO: 183407 - RNA, 62 nt, Human
ccucauguucuugcauggcccaagauguauuucccugugacugaaccaggagaucuggcugg

SEQ ID NO: 183408 - RNA, 62 nt, Human
cuuuauaugccacccucuuccuucucuuugaccccugugacucuuucuguaacuuucccagu

SEQ ID NO: 183409 - RNA, 62 nt, Human
ggagaguacaccguucacuauuguagaguaaccccugugacucaauauuaccauagugcgau

SEQ ID NO: 183410 - RNA, 62 nt, Human
gcccuggggcuggggggcuucaacuauaguugcccugugacuguaguccaccccugccugcc

SEQ ID NO: 183411 - RNA, 62 nt, Human
gccauucucauggucaccuauacaguguguuucccugugagcuagcagacacaaugaccagg

SEQ ID NO: 183412 - RNA, 62 nt, Human
ccacaaaugaugcaggugcaaaugguuuauagcccugugaaguucuuaaaguuuagaggcua

SEQ ID NO: 183413 - RNA, 64 nt, Human; identical to SEQ ID NO: 24370

SEQ ID NO: 183414 - RNA, 64 nt, Human; identical to SEQ ID NO: 24371

SEQ ID NO: 183415 - RNA, 64 nt, Human; identical to SEQ ID NO: 24372

SEQ ID NO: 183416 - RNA, 64 nt, Human; identical to SEQ ID NO: 24373

SEQ ID NO: 183417 - RNA, 64 nt, Human; identical to SEQ ID NO: 24374

SEQ ID NO: 183418 - RNA, 64 nt, Human; identical to SEQ ID NO: 24375

SEQ ID NO: 183419 - RNA, 64 nt, Human; identical to SEQ ID NO: 24376

SEQ ID NO: 183420 - RNA, 64 nt, Human; identical to SEQ ID NO: 24377

SEQ ID NO: 183421 - RNA, 64 nt, Human; identical to SEQ ID NO: 24378

SEQ ID NO: 183422 - RNA, 64 nt, Human; identical to SEQ ID NO: 24379

SEQ ID NO: 183423 - RNA, 64 nt, Human; identical to SEQ ID NO: 24380

SEQ ID NO: 183424 - RNA, 64 nt, Human; identical to SEQ ID NO: 24381

SEQ ID NO: 183425 - RNA, 64 nt, Human; identical to SEQ ID NO: 24382

SEQ ID NO: 183426 - RNA, 64 nt, Human; identical to SEQ ID NO: 24383

SEQ ID NO: 183427 - RNA, 64 nt, Human; identical to SEQ ID NO: 24384

SEQ ID NO: 183428 - RNA, 64 nt, Human; identical to SEQ ID NO: 24385

SEQ ID NO: 183429 - RNA, 64 nt, Human; identical to SEQ ID NO: 24386

SEQ ID NO: 183430 - RNA, 64 nt, Human; identical to SEQ ID NO: 24387

SEQ ID NO: 183431 - RNA, 64 nt, Human; identical to SEQ ID NO: 24388

SEQ ID NO: 183432 - RNA, 64 nt, Human; identical to SEQ ID NO: 24389

SEQ ID NO: 183433 - RNA, 64 nt, Human; identical to SEQ ID NO: 24390

SEQ ID NO: 183434 - RNA, 64 nt, Human; identical to SEQ ID NO: 24391

SEQ ID NO: 183435 - RNA, 64 nt, Human; identical to SEQ ID NO: 24392

SEQ ID NO: 183436 - RNA, 64 nt, Human; identical to SEQ ID NO: 24393

SEQ ID NO: 183437 - RNA, 64 nt, Human; identical to SEQ ID NO: 24394

SEQ ID NO: 183438 - RNA, 64 nt, Human; identical to SEQ ID NO: 24395

SEQ ID NO: 183439 - RNA, 64 nt, Human; identical to SEQ ID NO: 24396

SEQ ID NO: 183440 - RNA, 64 nt, Human; identical to SEQ ID NO: 24397

SEQ ID NO: 183441 - RNA, 64 nt, Human; identical to SEQ ID NO: 24398

SEQ ID NO: 183442 - RNA, 64 nt, Human; identical to SEQ ID NO: 24399

SEQ ID NO: 183443 - RNA, 64 nt, Human; identical to SEQ ID NO: 24400

SEQ ID NO: 183444 - RNA, 64 nt, Human; identical to SEQ ID NO: 24401

SEQ ID NO: 183445 - RNA, 64 nt, Human; identical to SEQ ID NO: 24402

SEQ ID NO: 183446 - RNA, 64 nt, Human; identical to SEQ ID NO: 24403

SEQ ID NO: 183447 - RNA, 64 nt, Human; identical to SEQ ID NO: 24404

SEQ ID NO: 183448 - RNA, 64 nt, Human; identical to SEQ ID NO: 24405

SEQ ID NO: 183449 - RNA, 64 nt, Human; identical to SEQ ID NO: 24406

SEQ ID NO: 183450 - RNA, 64 nt, Human; identical to SEQ ID NO: 24407

SEQ ID NO: 183451 - RNA, 64 nt, Human; identical to SEQ ID NO: 24408

SEQ ID NO: 183452 - RNA, 64 nt, Human; identical to SEQ ID NO: 24409

SEQ ID NO: 183453 - RNA, 64 nt, Human; identical to SEQ ID NO: 24410

SEQ ID NO: 183454 - RNA, 64 nt, Human; identical to SEQ ID NO: 24411

SEQ ID NO: 183455 - RNA, 64 nt, Human; identical to SEQ ID NO: 24412

SEQ ID NO: 183456 - RNA, 64 nt, Human; identical to SEQ ID NO: 24413

SEQ ID NO: 183457 - RNA, 64 nt, Human; identical to SEQ ID NO: 24414

SEQ ID NO: 183458 - RNA, 64 nt, Human; identical to SEQ ID NO: 24415

SEQ ID NO: 183459 - RNA, 64 nt, Human; identical to SEQ ID NO: 24416

SEQ ID NO: 183460 - RNA, 64 nt, Human; identical to SEQ ID NO: 24417

SEQ ID NO: 183461 - RNA, 64 nt, Human; identical to SEQ ID NO: 24418

SEQ ID NO: 183462 - RNA, 64 nt, Human; identical to SEQ ID NO: 24419

SEQ ID NO: 183463 - RNA, 64 nt, Human; identical to SEQ ID NO: 24420

SEQ ID NO: 183464 - RNA, 64 nt, Human; identical to SEQ ID NO: 24421

SEQ ID NO: 183465 - RNA, 64 nt, Human; identical to SEQ ID NO: 24422

SEQ ID NO: 183466 - RNA, 64 nt, Human; identical to SEQ ID NO: 24423

SEQ ID NO: 183467 - RNA, 64 nt, Human; identical to SEQ ID NO: 24424

SEQ ID NO: 183468 - RNA, 64 nt, Human; identical to SEQ ID NO: 24425

SEQ ID NO: 183469 - RNA, 64 nt, Human; identical to SEQ ID NO: 24426

SEQ ID NO: 183470 - RNA, 64 nt, Human; identical to SEQ ID NO: 24427

SEQ ID NO: 183471 - RNA, 64 nt, Human; identical to SEQ ID NO: 24428

SEQ ID NO: 183472 - RNA, 64 nt, Human; identical to SEQ ID NO: 24429

SEQ ID NO: 183473 - RNA, 64 nt, Human; identical to SEQ ID NO: 24430

SEQ ID NO: 183474 - RNA, 64 nt, Human; identical to SEQ ID NO: 24431

SEQ ID NO: 183475 - RNA, 64 nt, Human; identical to SEQ ID NO: 24432

SEQ ID NO: 183476 - RNA, 64 nt, Human; identical to SEQ ID NO: 24433

SEQ ID NO: 183477 - RNA, 64 nt, Human; identical to SEQ ID NO: 24434

SEQ ID NO: 183478 - RNA, 64 nt, Human; identical to SEQ ID NO: 24435

SEQ ID NO: 183479 - RNA, 64 nt, Human; identical to SEQ ID NO: 24436

SEQ ID NO: 183480 - RNA, 64 nt, Human; identical to SEQ ID NO: 24437

SEQ ID NO: 183481 - RNA, 64 nt, Human; identical to SEQ ID NO: 24438

SEQ ID NO: 183482 - RNA, 64 nt, Human; identical to SEQ ID NO: 24439

SEQ ID NO: 183483 - RNA, 64 nt, Human; identical to SEQ ID NO: 24440

SEQ ID NO: 183484 - RNA, 64 nt, Human; identical to SEQ ID NO: 24441

SEQ ID NO: 183485 - RNA, 64 nt, Human; identical to SEQ ID NO: 24442

SEQ ID NO: 183486 - RNA, 64 nt, Human; identical to SEQ ID NO: 24443

SEQ ID NO: 183487 - RNA, 64 nt, Human; identical to SEQ ID NO: 24444

SEQ ID NO: 183488 - RNA, 64 nt, Human; identical to SEQ ID NO: 24445

SEQ ID NO: 183489 - RNA, 64 nt, Human; identical to SEQ ID NO: 24446

SEQ ID NO: 183490 - RNA, 64 nt, Human; identical to SEQ ID NO: 24447

SEQ ID NO: 183491 - RNA, 64 nt, Human; identical to SEQ ID NO: 24448

SEQ ID NO: 183492 - RNA, 64 nt, Human; identical to SEQ ID NO: 24449

SEQ ID NO: 183493 - RNA, 64 nt, Human; identical to SEQ ID NO: 24450

SEQ ID NO: 183494 - RNA, 64 nt, Human; identical to SEQ ID NO: 24451

SEQ ID NO: 183495 - RNA, 64 nt, Human; identical to SEQ ID NO: 24452

SEQ ID NO: 183496 - RNA, 64 nt, Human; identical to SEQ ID NO: 24453

SEQ ID NO: 183497 - RNA, 64 nt, Human; identical to SEQ ID NO: 24454

SEQ ID NO: 183498 - RNA, 64 nt, Human; identical to SEQ ID NO: 24455

SEQ ID NO: 183499 - RNA, 64 nt, Human; identical to SEQ ID NO: 24456

SEQ ID NO: 183500 - RNA, 64 nt, Human; identical to SEQ ID NO: 24457

SEQ ID NO: 183501 - RNA, 64 nt, Human; identical to SEQ ID NO: 24458

SEQ ID NO: 183502 - RNA, 64 nt, Human; identical to SEQ ID NO: 24459

SEQ ID NO: 183503 - RNA, 64 nt, Human; identical to SEQ ID NO: 24460

SEQ ID NO: 183504 - RNA, 64 nt, Human; identical to SEQ ID NO: 24461

SEQ ID NO: 183505 - RNA, 64 nt, Human; identical to SEQ ID NO: 24462

SEQ ID NO: 183506 - RNA, 64 nt, Human; identical to SEQ ID NO: 24463

SEQ ID NO: 183507 - RNA, 64 nt, Human; identical to SEQ ID NO: 24464

SEQ ID NO: 183508 - RNA, 64 nt, Human; identical to SEQ ID NO: 24465

SEQ ID NO: 183509 - RNA, 64 nt, Human; identical to SEQ ID NO: 24466

SEQ ID NO: 183510 - RNA, 64 nt, Human; identical to SEQ ID NO: 24467

SEQ ID NO: 183511 - RNA, 64 nt, Human; identical to SEQ ID NO: 24468

SEQ ID NO: 183512 - RNA, 64 nt, Human; identical to SEQ ID NO: 24469

SEQ ID NO: 183513 - RNA, 64 nt, Human; identical to SEQ ID NO: 24470

SEQ ID NO: 183514 - RNA, 64 nt, Human; identical to SEQ ID NO: 24471

SEQ ID NO: 183515 - RNA, 64 nt, Human; identical to SEQ ID NO: 24472

SEQ ID NO: 183516 - RNA, 64 nt, Human; identical to SEQ ID NO: 24473

SEQ ID NO: 183517 - RNA, 64 nt, Human; identical to SEQ ID NO: 24474

SEQ ID NO: 183518 - RNA, 64 nt, Human; identical to SEQ ID NO: 24475

SEQ ID NO: 183519 - RNA, 64 nt, Human; identical to SEQ ID NO: 24476

SEQ ID NO: 183520 - RNA, 64 nt, Human; identical to SEQ ID NO: 24477

SEQ ID NO: 183521 - RNA, 64 nt, Human; identical to SEQ ID NO: 24478

SEQ ID NO: 183522 - RNA, 64 nt, Human; identical to SEQ ID NO: 24479

SEQ ID NO: 183523 - RNA, 64 nt, Human; identical to SEQ ID NO: 24480

SEQ ID NO: 183524 - RNA, 64 nt, Human; identical to SEQ ID NO: 24481

SEQ ID NO: 183525 - RNA, 64 nt, Human; identical to SEQ ID NO: 24482

SEQ ID NO: 183526 - RNA, 64 nt, Human; identical to SEQ ID NO: 24483

SEQ ID NO: 183527 - RNA, 64 nt, Human; identical to SEQ ID NO: 24484

SEQ ID NO: 183528 - RNA, 64 nt, Human; identical to SEQ ID NO: 24485

SEQ ID NO: 183529 - RNA, 64 nt, Human; identical to SEQ ID NO: 24486

SEQ ID NO: 183530 - RNA, 64 nt, Human; identical to SEQ ID NO: 24487

SEQ ID NO: 183531 - RNA, 64 nt, Human; identical to SEQ ID NO: 24488

SEQ ID NO: 183532 - RNA, 64 nt, Human; identical to SEQ ID NO: 24489

SEQ ID NO: 183533 - RNA, 64 nt, Human; identical to SEQ ID NO: 24490

SEQ ID NO: 183534 - RNA, 64 nt, Human; identical to SEQ ID NO: 24491

SEQ ID NO: 183535 - RNA, 64 nt, Human; identical to SEQ ID NO: 24492

SEQ ID NO: 183536 - RNA, 64 nt, Human; identical to SEQ ID NO: 24493

SEQ ID NO: 183537 - RNA, 64 nt, Human; identical to SEQ ID NO: 24494

SEQ ID NO: 183538 - RNA, 64 nt, Human; identical to SEQ ID NO: 24495

SEQ ID NO: 183539 - RNA, 64 nt, Human; identical to SEQ ID NO: 24496

SEQ ID NO: 183540 - RNA, 64 nt, Human; identical to SEQ ID NO: 24497

SEQ ID NO: 183541 - RNA, 64 nt, Human; identical to SEQ ID NO: 24498

SEQ ID NO: 183542 - RNA, 64 nt, Human; identical to SEQ ID NO: 24499

SEQ ID NO: 183543 - RNA, 64 nt, Human; identical to SEQ ID NO: 24500

SEQ ID NO: 183544 - RNA, 64 nt, Human; identical to SEQ ID NO: 24501

SEQ ID NO: 183545 - RNA, 64 nt, Human; identical to SEQ ID NO: 24502

SEQ ID NO: 183546 - RNA, 64 nt, Human; identical to SEQ ID NO: 24503

SEQ ID NO: 183547 - RNA, 64 nt, Human; identical to SEQ ID NO: 24504

SEQ ID NO: 183548 - RNA, 64 nt, Human; identical to SEQ ID NO: 24505

SEQ ID NO: 183549 - RNA, 64 nt, Human; identical to SEQ ID NO: 24506

SEQ ID NO: 183550 - RNA, 64 nt, Human; identical to SEQ ID NO: 24507

SEQ ID NO: 183551 - RNA, 64 nt, Human; identical to SEQ ID NO: 24508

SEQ ID NO: 183552 - RNA, 64 nt, Human; identical to SEQ ID NO: 24509

SEQ ID NO: 183553 - RNA, 64 nt, Human; identical to SEQ ID NO: 24510

SEQ ID NO: 183554 - RNA, 64 nt, Human; identical to SEQ ID NO: 24511

SEQ ID NO: 183555 - RNA, 64 nt, Human; identical to SEQ ID NO: 24512

SEQ ID NO: 183556 - RNA, 64 nt, Human; identical to SEQ ID NO: 24513

SEQ ID NO: 183557 - RNA, 64 nt, Human; identical to SEQ ID NO: 24514

SEQ ID NO: 183558 - RNA, 64 nt, Human; identical to SEQ ID NO: 24515

SEQ ID NO: 183559 - RNA, 64 nt, Human; identical to SEQ ID NO: 24516

SEQ ID NO: 183560 - RNA, 64 nt, Human; identical to SEQ ID NO: 24517

SEQ ID NO: 183561 - RNA, 64 nt, Human; identical to SEQ ID NO: 24518

SEQ ID NO: 183562 - RNA, 64 nt, Human; identical to SEQ ID NO: 24519

SEQ ID NO: 183563 - RNA, 64 nt, Human; identical to SEQ ID NO: 24520

SEQ ID NO: 183564 - RNA, 64 nt, Human; identical to SEQ ID NO: 24521

SEQ ID NO: 183565 - RNA, 64 nt, Human; identical to SEQ ID NO: 24522

SEQ ID NO: 183566 - RNA, 64 nt, Human; identical to SEQ ID NO: 24523

SEQ ID NO: 183567 - RNA, 64 nt, Human; identical to SEQ ID NO: 24524

SEQ ID NO: 183568 - RNA, 64 nt, Human; identical to SEQ ID NO: 24525

SEQ ID NO: 183569 - RNA, 64 nt, Human; identical to SEQ ID NO: 24526

SEQ ID NO: 183570 - RNA, 64 nt, Human; identical to SEQ ID NO: 24527

SEQ ID NO: 183571 - RNA, 64 nt, Human; identical to SEQ ID NO: 24528

SEQ ID NO: 183572 - RNA, 64 nt, Human; identical to SEQ ID NO: 24529

SEQ ID NO: 183573 - RNA, 64 nt, Human; identical to SEQ ID NO: 24530

SEQ ID NO: 183574 - RNA, 64 nt, Human; identical to SEQ ID NO: 24531

SEQ ID NO: 183575 - RNA, 64 nt, Human; identical to SEQ ID NO: 24532

SEQ ID NO: 183576 - RNA, 64 nt, Human; identical to SEQ ID NO: 24533

SEQ ID NO: 183577 - RNA, 64 nt, Human; identical to SEQ ID NO: 24534

SEQ ID NO: 183578 - RNA, 64 nt, Human; identical to SEQ ID NO: 24535

SEQ ID NO: 183579 - RNA, 64 nt, Human; identical to SEQ ID NO: 24536

SEQ ID NO: 183580 - RNA, 64 nt, Human; identical to SEQ ID NO: 24537

SEQ ID NO: 183581 - RNA, 64 nt, Human; identical to SEQ ID NO: 24538

SEQ ID NO: 183582 - RNA, 64 nt, Human; identical to SEQ ID NO: 24539

SEQ ID NO: 183583 - RNA, 64 nt, Human; identical to SEQ ID NO: 24540

SEQ ID NO: 183584 - RNA, 64 nt, Human; identical to SEQ ID NO: 24541

SEQ ID NO: 183585 - RNA, 64 nt, Human; identical to SEQ ID NO: 24542

SEQ ID NO: 183586 - RNA, 64 nt, Human; identical to SEQ ID NO: 24543

SEQ ID NO: 183587 - RNA, 64 nt, Human; identical to SEQ ID NO: 24544

SEQ ID NO: 183588 - RNA, 64 nt, Human; identical to SEQ ID NO: 24545

SEQ ID NO: 183589 - RNA, 64 nt, Human; identical to SEQ ID NO: 24546

SEQ ID NO: 183590 - RNA, 64 nt, Human; identical to SEQ ID NO: 24547

SEQ ID NO: 183591 - RNA, 64 nt, Human; identical to SEQ ID NO: 24548

SEQ ID NO: 183592 - RNA, 64 nt, Human; identical to SEQ ID NO: 24549

SEQ ID NO: 183593 - RNA, 64 nt, Human; identical to SEQ ID NO: 24550

SEQ ID NO: 183594 - RNA, 64 nt, Human; identical to SEQ ID NO: 24551

SEQ ID NO: 183595 - RNA, 64 nt, Human; identical to SEQ ID NO: 24552

SEQ ID NO: 183596 - RNA, 64 nt, Human; identical to SEQ ID NO: 24553

SEQ ID NO: 183597 - RNA, 64 nt, Human; identical to SEQ ID NO: 24554

SEQ ID NO: 183598 - RNA, 64 nt, Human; identical to SEQ ID NO: 24555

SEQ ID NO: 183599 - RNA, 64 nt, Human; identical to SEQ ID NO: 24556

SEQ ID NO: 183600 - RNA, 64 nt, Human; identical to SEQ ID NO: 24557

SEQ ID NO: 183601 - RNA, 64 nt, Human; identical to SEQ ID NO: 24558

SEQ ID NO: 183602 - RNA, 64 nt, Human; identical to SEQ ID NO: 24559

SEQ ID NO: 183603 - RNA, 64 nt, Human; identical to SEQ ID NO: 24560

SEQ ID NO: 183604 - RNA, 64 nt, Human; identical to SEQ ID NO: 24561

SEQ ID NO: 183605 - RNA, 64 nt, Human; identical to SEQ ID NO: 24562

SEQ ID NO: 183606 - RNA, 64 nt, Human; identical to SEQ ID NO: 24563

SEQ ID NO: 183607 - RNA, 64 nt, Human; identical to SEQ ID NO: 24564

SEQ ID NO: 183608 - RNA, 64 nt, Human; identical to SEQ ID NO: 24565

SEQ ID NO: 183609 - RNA, 64 nt, Human; identical to SEQ ID NO: 24566

SEQ ID NO: 183610 - RNA, 64 nt, Human; identical to SEQ ID NO: 24567

SEQ ID NO: 183611 - RNA, 64 nt, Human; identical to SEQ ID NO: 24568

SEQ ID NO: 183612 - RNA, 64 nt, Human; identical to SEQ ID NO: 24569

SEQ ID NO: 183613 - RNA, 64 nt, Human; identical to SEQ ID NO: 24570

SEQ ID NO: 183614 - RNA, 64 nt, Human; identical to SEQ ID NO: 24571

SEQ ID NO: 183615 - RNA, 64 nt, Human; identical to SEQ ID NO: 24572

SEQ ID NO: 183616 - RNA, 64 nt, Human; identical to SEQ ID NO: 24573

SEQ ID NO: 183617 - RNA, 64 nt, Human; identical to SEQ ID NO: 24574

SEQ ID NO: 183618 - RNA, 64 nt, Human; identical to SEQ ID NO: 24575

SEQ ID NO: 183619 - RNA, 64 nt, Human; identical to SEQ ID NO: 24576

SEQ ID NO: 183620 - RNA, 64 nt, Human; identical to SEQ ID NO: 24577

SEQ ID NO: 183621 - RNA, 64 nt, Human; identical to SEQ ID NO: 24578

SEQ ID NO: 183622 - RNA, 64 nt, Human; identical to SEQ ID NO: 24579

SEQ ID NO: 183623 - RNA, 64 nt, Human; identical to SEQ ID NO: 24580

SEQ ID NO: 183624 - RNA, 64 nt, Human; identical to SEQ ID NO: 24581

SEQ ID NO: 183625 - RNA, 64 nt, Human; identical to SEQ ID NO: 24582

SEQ ID NO: 183626 - RNA, 64 nt, Human; identical to SEQ ID NO: 24583

SEQ ID NO: 183627 - RNA, 64 nt, Human; identical to SEQ ID NO: 24584

SEQ ID NO: 183628 - RNA, 64 nt, Human; identical to SEQ ID NO: 24585

SEQ ID NO: 183629 - RNA, 64 nt, Human; identical to SEQ ID NO: 24586

SEQ ID NO: 183630 - RNA, 64 nt, Human; identical to SEQ ID NO: 24587

SEQ ID NO: 183631 - RNA, 64 nt, Human; identical to SEQ ID NO: 24588

SEQ ID NO: 183632 - RNA, 64 nt, Human; identical to SEQ ID NO: 24589

SEQ ID NO: 183633 - RNA, 64 nt, Human; identical to SEQ ID NO: 24590

SEQ ID NO: 183634 - RNA, 64 nt, Human; identical to SEQ ID NO: 24591

SEQ ID NO: 183635 - RNA, 64 nt, Human; identical to SEQ ID NO: 24592

SEQ ID NO: 183636 - RNA, 64 nt, Human; identical to SEQ ID NO: 24593

SEQ ID NO: 183637 - RNA, 64 nt, Human; identical to SEQ ID NO: 24594

SEQ ID NO: 183638 - RNA, 64 nt, Human; identical to SEQ ID NO: 24595

SEQ ID NO: 183639 - RNA, 64 nt, Human; identical to SEQ ID NO: 24596

SEQ ID NO: 183640 - RNA, 64 nt, Human; identical to SEQ ID NO: 24597

SEQ ID NO: 183641 - RNA, 64 nt, Human; identical to SEQ ID NO: 24598

SEQ ID NO: 183642 - RNA, 64 nt, Human; identical to SEQ ID NO: 24599

SEQ ID NO: 183643 - RNA, 64 nt, Human; identical to SEQ ID NO: 24600

SEQ ID NO: 183644 - RNA, 64 nt, Human; identical to SEQ ID NO: 24601

SEQ ID NO: 183645 - RNA, 64 nt, Human; identical to SEQ ID NO: 24602

SEQ ID NO: 183646 - RNA, 64 nt, Human; identical to SEQ ID NO: 24603

SEQ ID NO: 183647 - RNA, 58 nt, Human; identical to SEQ ID NO: 23463

SEQ ID NO: 183648 - RNA, 64 nt, Human; identical to SEQ ID NO: 24605

SEQ ID NO: 183649 - RNA, 64 nt, Human; identical to SEQ ID NO: 24606

SEQ ID NO: 183650 - RNA, 64 nt, Human; identical to SEQ ID NO: 24607

SEQ ID NO: 183651 - RNA, 64 nt, Human; identical to SEQ ID NO: 24608

SEQ ID NO: 183652 - RNA, 64 nt, Human; identical to SEQ ID NO: 24609

SEQ ID NO: 183653 - RNA, 64 nt, Human; identical to SEQ ID NO: 24610

SEQ ID NO: 183654 - RNA, 64 nt, Human; identical to SEQ ID NO: 24611

SEQ ID NO: 183655 - RNA, 56 nt, Human; identical to SEQ ID NO: 23471

SEQ ID NO: 183656 - RNA, 64 nt, Human; identical to SEQ ID NO: 24613

SEQ ID NO: 183657 - RNA, 64 nt, Human; identical to SEQ ID NO: 24614

SEQ ID NO: 183658 - RNA, 64 nt, Human; identical to SEQ ID NO: 24615

SEQ ID NO: 183659 - RNA, 64 nt, Human; identical to SEQ ID NO: 24616

SEQ ID NO: 183660 - RNA, 64 nt, Human; identical to SEQ ID NO: 24617

SEQ ID NO: 183661 - RNA, 64 nt, Human; identical to SEQ ID NO: 24618

SEQ ID NO: 183662 - RNA, 64 nt, Human; identical to SEQ ID NO: 24619

SEQ ID NO: 183663 - RNA, 64 nt, Human; identical to SEQ ID NO: 24620

SEQ ID NO: 183664 - RNA, 64 nt, Human; identical to SEQ ID NO: 24621

SEQ ID NO: 183665 - RNA, 64 nt, Human; identical to SEQ ID NO: 24622

SEQ ID NO: 183666 - RNA, 64 nt, Human; identical to SEQ ID NO: 24623

SEQ ID NO: 183667 - RNA, 64 nt, Human; identical to SEQ ID NO: 24624

SEQ ID NO: 183668 - RNA, 64 nt, Human; identical to SEQ ID NO: 24625

SEQ ID NO: 183669 - RNA, 64 nt, Human; identical to SEQ ID NO: 24626

SEQ ID NO: 183670 - RNA, 64 nt, Human; identical to SEQ ID NO: 24627

SEQ ID NO: 183671 - RNA, 64 nt, Human; identical to SEQ ID NO: 24628

SEQ ID NO: 183672 - RNA, 64 nt, Human; identical to SEQ ID NO: 24629

SEQ ID NO: 183673 - RNA, 64 nt, Human; identical to SEQ ID NO: 24630

SEQ ID NO: 183674 - RNA, 64 nt, Human; identical to SEQ ID NO: 24631

SEQ ID NO: 183675 - RNA, 64 nt, Human; identical to SEQ ID NO: 24632

SEQ ID NO: 183676 - RNA, 64 nt, Human; identical to SEQ ID NO: 24633

SEQ ID NO: 183677 - RNA, 64 nt, Human; identical to SEQ ID NO: 24634

SEQ ID NO: 183678 - RNA, 64 nt, Human; identical to SEQ ID NO: 24635

SEQ ID NO: 183679 - RNA, 64 nt, Human; identical to SEQ ID NO: 24636

SEQ ID NO: 183680 - RNA, 64 nt, Human; identical to SEQ ID NO: 24637

SEQ ID NO: 183681 - RNA, 64 nt, Human; identical to SEQ ID NO: 24638

SEQ ID NO: 183682 - RNA, 64 nt, Human; identical to SEQ ID NO: 24639

SEQ ID NO: 183683 - RNA, 64 nt, Human; identical to SEQ ID NO: 24640

SEQ ID NO: 183684 - RNA, 64 nt, Human; identical to SEQ ID NO: 24641

SEQ ID NO: 183685 - RNA, 64 nt, Human; identical to SEQ ID NO: 24642

SEQ ID NO: 183686 - RNA, 64 nt, Human; identical to SEQ ID NO: 24643

SEQ ID NO: 183687 - RNA, 64 nt, Human; identical to SEQ ID NO: 24644

SEQ ID NO: 183688 - RNA, 64 nt, Human; identical to SEQ ID NO: 24645

SEQ ID NO: 183689 - RNA, 64 nt, Human; identical to SEQ ID NO: 24646

SEQ ID NO: 183690 - RNA, 64 nt, Human; identical to SEQ ID NO: 24647

SEQ ID NO: 183691 - RNA, 64 nt, Human; identical to SEQ ID NO: 24648

SEQ ID NO: 183692 - RNA, 64 nt, Human; identical to SEQ ID NO: 24649

SEQ ID NO: 183693 - RNA, 64 nt, Human; identical to SEQ ID NO: 24650

SEQ ID NO: 183694 - RNA, 64 nt, Human; identical to SEQ ID NO: 24651

SEQ ID NO: 183695 - RNA, 64 nt, Human; identical to SEQ ID NO: 24652

SEQ ID NO: 183696 - RNA, 64 nt, Human; identical to SEQ ID NO: 24653

SEQ ID NO: 183697 - RNA, 64 nt, Human; identical to SEQ ID NO: 24654

SEQ ID NO: 183698 - RNA, 64 nt, Human; identical to SEQ ID NO: 24655

SEQ ID NO: 183699 - RNA, 64 nt, Human; identical to SEQ ID NO: 24656

SEQ ID NO: 183700 - RNA, 64 nt, Human; identical to SEQ ID NO: 24657

SEQ ID NO: 183701 - RNA, 64 nt, Human; identical to SEQ ID NO: 24658

SEQ ID NO: 183702 - RNA, 64 nt, Human; identical to SEQ ID NO: 24659

SEQ ID NO: 183703 - RNA, 64 nt, Human; identical to SEQ ID NO: 24660

SEQ ID NO: 183704 - RNA, 64 nt, Human; identical to SEQ ID NO: 24661

SEQ ID NO: 183705 - RNA, 64 nt, Human; identical to SEQ ID NO: 24662

SEQ ID NO: 183706 - RNA, 64 nt, Human; identical to SEQ ID NO: 24663

SEQ ID NO: 183707 - RNA, 64 nt, Human; identical to SEQ ID NO: 24664

SEQ ID NO: 183708 - RNA, 64 nt, Human; identical to SEQ ID NO: 24665

SEQ ID NO: 183709 - RNA, 64 nt, Human; identical to SEQ ID NO: 24666

SEQ ID NO: 183710 - RNA, 64 nt, Human; identical to SEQ ID NO: 24667

SEQ ID NO: 183711 - RNA, 64 nt, Human; identical to SEQ ID NO: 24668

SEQ ID NO: 183712 - RNA, 64 nt, Human; identical to SEQ ID NO: 24669

SEQ ID NO: 183713 - RNA, 64 nt, Human; identical to SEQ ID NO: 24670

SEQ ID NO: 183714 - RNA, 64 nt, Human; identical to SEQ ID NO: 24671

SEQ ID NO: 183715 - RNA, 64 nt, Human; identical to SEQ ID NO: 24672

SEQ ID NO: 183716 - RNA, 63 nt, Human; identical to SEQ ID NO: 24673

SEQ ID NO: 183717 - RNA, 64 nt, Human; identical to SEQ ID NO: 24674

SEQ ID NO: 183718 - RNA, 64 nt, Human; identical to SEQ ID NO: 24675

SEQ ID NO: 183719 - RNA, 64 nt, Human; identical to SEQ ID NO: 24676

SEQ ID NO: 183720 - RNA, 64 nt, Human; identical to SEQ ID NO: 24677

SEQ ID NO: 183721 - RNA, 64 nt, Human; identical to SEQ ID NO: 24678

SEQ ID NO: 183722 - RNA, 64 nt, Human; identical to SEQ ID NO: 24679

SEQ ID NO: 183723 - RNA, 64 nt, Human; identical to SEQ ID NO: 24680

SEQ ID NO: 183724 - RNA, 64 nt, Human; identical to SEQ ID NO: 24681

SEQ ID NO: 183725 - RNA, 64 nt, Human; identical to SEQ ID NO: 24682

SEQ ID NO: 183726 - RNA, 64 nt, Human; identical to SEQ ID NO: 24683

SEQ ID NO: 183727 - RNA, 64 nt, Human; identical to SEQ ID NO: 24684

SEQ ID NO: 183728 - RNA, 64 nt, Human; identical to SEQ ID NO: 24685

SEQ ID NO: 183729 - RNA, 64 nt, Human; identical to SEQ ID NO: 24686

SEQ ID NO: 183730 - RNA, 64 nt, Human; identical to SEQ ID NO: 24687

SEQ ID NO: 183731 - RNA, 64 nt, Human; identical to SEQ ID NO: 24688

SEQ ID NO: 183732 - RNA, 64 nt, Human; identical to SEQ ID NO: 24689

SEQ ID NO: 183733 - RNA, 64 nt, Human; identical to SEQ ID NO: 24690

SEQ ID NO: 183734 - RNA, 64 nt, Human; identical to SEQ ID NO: 24691

SEQ ID NO: 183735 - RNA, 64 nt, Human; identical to SEQ ID NO: 24692

SEQ ID NO: 183736 - RNA, 64 nt, Human; identical to SEQ ID NO: 24693

SEQ ID NO: 183737 - RNA, 64 nt, Human; identical to SEQ ID NO: 24694

SEQ ID NO: 183738 - RNA, 64 nt, Human; identical to SEQ ID NO: 24695

SEQ ID NO: 183739 - RNA, 64 nt, Human; identical to SEQ ID NO: 24696

SEQ ID NO: 183740 - RNA, 64 nt, Human; identical to SEQ ID NO: 24697

SEQ ID NO: 183741 - RNA, 64 nt, Human; identical to SEQ ID NO: 24698

SEQ ID NO: 183742 - RNA, 64 nt, Human; identical to SEQ ID NO: 24699

SEQ ID NO: 183743 - RNA, 64 nt, Human; identical to SEQ ID NO: 24700

SEQ ID NO: 183744 - RNA, 64 nt, Human; identical to SEQ ID NO: 24701

SEQ ID NO: 183745 - RNA, 64 nt, Human; identical to SEQ ID NO: 24702

SEQ ID NO: 183746 - RNA, 64 nt, Human; identical to SEQ ID NO: 24703

SEQ ID NO: 183747 - RNA, 64 nt, Human; identical to SEQ ID NO: 24704

SEQ ID NO: 183748 - RNA, 64 nt, Human; identical to SEQ ID NO: 24705

SEQ ID NO: 183749 - RNA, 64 nt, Human; identical to SEQ ID NO: 24706

SEQ ID NO: 183750 - RNA, 64 nt, Human; identical to SEQ ID NO: 24707

SEQ ID NO: 183751 - RNA, 64 nt, Human; identical to SEQ ID NO: 24708

SEQ ID NO: 183752 - RNA, 64 nt, Human; identical to SEQ ID NO: 24709

SEQ ID NO: 183753 - RNA, 64 nt, Human; identical to SEQ ID NO: 24710

SEQ ID NO: 183754 - RNA, 64 nt, Human; identical to SEQ ID NO: 24711

SEQ ID NO: 183755 - RNA, 64 nt, Human; identical to SEQ ID NO: 24712

SEQ ID NO: 183756 - RNA, 64 nt, Human; identical to SEQ ID NO: 24713

SEQ ID NO: 183757 - RNA, 64 nt, Human; identical to SEQ ID NO: 24714

SEQ ID NO: 183758 - RNA, 64 nt, Human; identical to SEQ ID NO: 24715

SEQ ID NO: 183759 - RNA, 64 nt, Human; identical to SEQ ID NO: 24716

SEQ ID NO: 183760 - RNA, 64 nt, Human; identical to SEQ ID NO: 24717

SEQ ID NO: 183761 - RNA, 64 nt, Human; identical to SEQ ID NO: 24718

SEQ ID NO: 183762 - RNA, 64 nt, Human; identical to SEQ ID NO: 24719

SEQ ID NO: 183763 - RNA, 64 nt, Human; identical to SEQ ID NO: 24720

SEQ ID NO: 183764 - RNA, 64 nt, Human; identical to SEQ ID NO: 24721

SEQ ID NO: 183765 - RNA, 64 nt, Human; identical to SEQ ID NO: 24722

SEQ ID NO: 183766 - RNA, 64 nt, Human; identical to SEQ ID NO: 24723

SEQ ID NO: 183767 - RNA, 64 nt, Human; identical to SEQ ID NO: 24724

SEQ ID NO: 183768 - RNA, 64 nt, Human; identical to SEQ ID NO: 24725

SEQ ID NO: 183769 - RNA, 64 nt, Human; identical to SEQ ID NO: 24726

SEQ ID NO: 183770 - RNA, 64 nt, Human; identical to SEQ ID NO: 24727

SEQ ID NO: 183771 - RNA, 64 nt, Human; identical to SEQ ID NO: 24728

SEQ ID NO: 183772 - RNA, 64 nt, Human; identical to SEQ ID NO: 24729

SEQ ID NO: 183773 - RNA, 64 nt, Human; identical to SEQ ID NO: 24730

SEQ ID NO: 183774 - RNA, 64 nt, Human; identical to SEQ ID NO: 24731

SEQ ID NO: 183775 - RNA, 64 nt, Human; identical to SEQ ID NO: 24732

SEQ ID NO: 183776 - RNA, 64 nt, Human; identical to SEQ ID NO: 24733

SEQ ID NO: 183777 - RNA, 64 nt, Human; identical to SEQ ID NO: 24734

SEQ ID NO: 183778 - RNA, 64 nt, Human; identical to SEQ ID NO: 24735

SEQ ID NO: 183779 - RNA, 64 nt, Human; identical to SEQ ID NO: 24736

SEQ ID NO: 183780 - RNA, 64 nt, Human; identical to SEQ ID NO: 24737

SEQ ID NO: 183781 - RNA, 64 nt, Human; identical to SEQ ID NO: 24738

SEQ ID NO: 183782 - RNA, 64 nt, Human; identical to SEQ ID NO: 24739

SEQ ID NO: 183783 - RNA, 64 nt, Human; identical to SEQ ID NO: 24740

SEQ ID NO: 183784 - RNA, 64 nt, Human; identical to SEQ ID NO: 24741

SEQ ID NO: 183785 - RNA, 64 nt, Human; identical to SEQ ID NO: 24742

SEQ ID NO: 183786 - RNA, 64 nt, Human; identical to SEQ ID NO: 24743

SEQ ID NO: 183787 - RNA, 64 nt, Human; identical to SEQ ID NO: 24744

SEQ ID NO: 183788 - RNA, 64 nt, Human; identical to SEQ ID NO: 24745

SEQ ID NO: 183789 - RNA, 64 nt, Human; identical to SEQ ID NO: 24746

SEQ ID NO: 183790 - RNA, 64 nt, Human; identical to SEQ ID NO: 24747

SEQ ID NO: 183791 - RNA, 64 nt, Human; identical to SEQ ID NO: 24748

SEQ ID NO: 183792 - RNA, 64 nt, Human; identical to SEQ ID NO: 24749

SEQ ID NO: 183793 - RNA, 64 nt, Human; identical to SEQ ID NO: 24750

SEQ ID NO: 183794 - RNA, 64 nt, Human; identical to SEQ ID NO: 24751

SEQ ID NO: 183795 - RNA, 64 nt, Human; identical to SEQ ID NO: 24752

SEQ ID NO: 183796 - RNA, 64 nt, Human; identical to SEQ ID NO: 24753

SEQ ID NO: 183797 - RNA, 64 nt, Human; identical to SEQ ID NO: 24754

SEQ ID NO: 183798 - RNA, 64 nt, Human; identical to SEQ ID NO: 24755

SEQ ID NO: 183799 - RNA, 64 nt, Human; identical to SEQ ID NO: 24756

SEQ ID NO: 183800 - RNA, 64 nt, Human; identical to SEQ ID NO: 24757

SEQ ID NO: 183801 - RNA, 64 nt, Human; identical to SEQ ID NO: 24758

SEQ ID NO: 183802 - RNA, 64 nt, Human; identical to SEQ ID NO: 24759

SEQ ID NO: 183803 - RNA, 64 nt, Human; identical to SEQ ID NO: 24760

SEQ ID NO: 183804 - RNA, 64 nt, Human; identical to SEQ ID NO: 24761

SEQ ID NO: 183805 - RNA, 64 nt, Human; identical to SEQ ID NO: 24762

SEQ ID NO: 183806 - RNA, 64 nt, Human; identical to SEQ ID NO: 24763

SEQ ID NO: 183807 - RNA, 64 nt, Human; identical to SEQ ID NO: 24764

SEQ ID NO: 183808 - RNA, 64 nt, Human; identical to SEQ ID NO: 24765

SEQ ID NO: 183809 - RNA, 64 nt, Human; identical to SEQ ID NO: 24766

SEQ ID NO: 183810 - RNA, 64 nt, Human; identical to SEQ ID NO: 24767

SEQ ID NO: 183811 - RNA, 64 nt, Human; identical to SEQ ID NO: 24768

SEQ ID NO: 183812 - RNA, 64 nt, Human; identical to SEQ ID NO: 24769

SEQ ID NO: 183813 - RNA, 64 nt, Human; identical to SEQ ID NO: 24770

SEQ ID NO: 183814 - RNA, 64 nt, Human; identical to SEQ ID NO: 24771

SEQ ID NO: 183815 - RNA, 64 nt, Human; identical to SEQ ID NO: 24772

SEQ ID NO: 183816 - RNA, 64 nt, Human; identical to SEQ ID NO: 24773

SEQ ID NO: 183817 - RNA, 64 nt, Human; identical to SEQ ID NO: 24774

SEQ ID NO: 183818 - RNA, 64 nt, Human; identical to SEQ ID NO: 24775

SEQ ID NO: 183819 - RNA, 64 nt, Human; identical to SEQ ID NO: 24776

SEQ ID NO: 183820 - RNA, 64 nt, Human; identical to SEQ ID NO: 24777

SEQ ID NO: 183821 - RNA, 64 nt, Human; identical to SEQ ID NO: 24778

SEQ ID NO: 183822 - RNA, 64 nt, Human; identical to SEQ ID NO: 24779

SEQ ID NO: 183823 - RNA, 64 nt, Human; identical to SEQ ID NO: 24780

SEQ ID NO: 183824 - RNA, 64 nt, Human; identical to SEQ ID NO: 24781

SEQ ID NO: 183825 - RNA, 64 nt, Human; identical to SEQ ID NO: 24782

SEQ ID NO: 183826 - RNA, 64 nt, Human; identical to SEQ ID NO: 24783

SEQ ID NO: 183827 - RNA, 64 nt, Human; identical to SEQ ID NO: 24784

SEQ ID NO: 183828 - RNA, 64 nt, Human; identical to SEQ ID NO: 24785

SEQ ID NO: 183829 - RNA, 64 nt, Human; identical to SEQ ID NO: 24786

SEQ ID NO: 183830 - RNA, 64 nt, Human; identical to SEQ ID NO: 24787

SEQ ID NO: 183831 - RNA, 64 nt, Human; identical to SEQ ID NO: 24788

SEQ ID NO: 183832 - RNA, 64 nt, Human; identical to SEQ ID NO: 24789

SEQ ID NO: 183833 - RNA, 64 nt, Human; identical to SEQ ID NO: 24790

SEQ ID NO: 183834 - RNA, 64 nt, Human; identical to SEQ ID NO: 24791

SEQ ID NO: 183835 - RNA, 64 nt, Human; identical to SEQ ID NO: 24792

SEQ ID NO: 183836 - RNA, 64 nt, Human; identical to SEQ ID NO: 24793

SEQ ID NO: 183837 - RNA, 64 nt, Human; identical to SEQ ID NO: 24794

SEQ ID NO: 183838 - RNA, 64 nt, Human; identical to SEQ ID NO: 24795

SEQ ID NO: 183839 - RNA, 64 nt, Human; identical to SEQ ID NO: 24796

SEQ ID NO: 183840 - RNA, 64 nt, Human; identical to SEQ ID NO: 24797

SEQ ID NO: 183841 - RNA, 64 nt, Human; identical to SEQ ID NO: 24798

SEQ ID NO: 183842 - RNA, 64 nt, Human; identical to SEQ ID NO: 24799

SEQ ID NO: 183843 - RNA, 64 nt, Human; identical to SEQ ID NO: 24800

SEQ ID NO: 183844 - RNA, 64 nt, Human; identical to SEQ ID NO: 24801

SEQ ID NO: 183845 - RNA, 64 nt, Human; identical to SEQ ID NO: 24802

SEQ ID NO: 183846 - RNA, 64 nt, Human; identical to SEQ ID NO: 24803

SEQ ID NO: 183847 - RNA, 64 nt, Human; identical to SEQ ID NO: 24804

SEQ ID NO: 183848 - RNA, 64 nt, Human; identical to SEQ ID NO: 24805

SEQ ID NO: 183849 - RNA, 64 nt, Human; identical to SEQ ID NO: 24806

SEQ ID NO: 183850 - RNA, 64 nt, Human; identical to SEQ ID NO: 24807

SEQ ID NO: 183851 - RNA, 64 nt, Human; identical to SEQ ID NO: 24808

SEQ ID NO: 183852 - RNA, 64 nt, Human; identical to SEQ ID NO: 24809

SEQ ID NO: 183853 - RNA, 64 nt, Human; identical to SEQ ID NO: 24810

SEQ ID NO: 183854 - RNA, 64 nt, Human; identical to SEQ ID NO: 24811

SEQ ID NO: 183855 - RNA, 64 nt, Human; identical to SEQ ID NO: 24812

SEQ ID NO: 183856 - RNA, 64 nt, Human; identical to SEQ ID NO: 24813

SEQ ID NO: 183857 - RNA, 64 nt, Human; identical to SEQ ID NO: 24814

SEQ ID NO: 183858 - RNA, 64 nt, Human; identical to SEQ ID NO: 24815

SEQ ID NO: 183859 - RNA, 64 nt, Human; identical to SEQ ID NO: 24816

SEQ ID NO: 183860 - RNA, 64 nt, Human; identical to SEQ ID NO: 24817

SEQ ID NO: 183861 - RNA, 64 nt, Human; identical to SEQ ID NO: 24818

SEQ ID NO: 183862 - RNA, 64 nt, Human; identical to SEQ ID NO: 24819

SEQ ID NO: 183863 - RNA, 64 nt, Human; identical to SEQ ID NO: 24820

SEQ ID NO: 183864 - RNA, 64 nt, Human; identical to SEQ ID NO: 24821

SEQ ID NO: 183865 - RNA, 64 nt, Human; identical to SEQ ID NO: 24822

SEQ ID NO: 183866 - RNA, 64 nt, Human; identical to SEQ ID NO: 24823

SEQ ID NO: 183867 - RNA, 64 nt, Human; identical to SEQ ID NO: 24824

SEQ ID NO: 183868 - RNA, 64 nt, Human; identical to SEQ ID NO: 24825

SEQ ID NO: 183869 - RNA, 64 nt, Human; identical to SEQ ID NO: 24826

SEQ ID NO: 183870 - RNA, 64 nt, Human; identical to SEQ ID NO: 24827

SEQ ID NO: 183871 - RNA, 64 nt, Human; identical to SEQ ID NO: 24828

SEQ ID NO: 183872 - RNA, 64 nt, Human; identical to SEQ ID NO: 24829

SEQ ID NO: 183873 - RNA, 64 nt, Human; identical to SEQ ID NO: 24830

SEQ ID NO: 183874 - RNA, 64 nt, Human; identical to SEQ ID NO: 24831

SEQ ID NO: 183875 - RNA, 64 nt, Human; identical to SEQ ID NO: 24832

SEQ ID NO: 183876 - RNA, 64 nt, Human; identical to SEQ ID NO: 24833

SEQ ID NO: 183877 - RNA, 64 nt, Human; identical to SEQ ID NO: 24834

SEQ ID NO: 183878 - RNA, 64 nt, Human; identical to SEQ ID NO: 24835

SEQ ID NO: 183879 - RNA, 64 nt, Human; identical to SEQ ID NO: 24836

SEQ ID NO: 183880 - RNA, 64 nt, Human; identical to SEQ ID NO: 24837

SEQ ID NO: 183881 - RNA, 64 nt, Human; identical to SEQ ID NO: 24838

SEQ ID NO: 183882 - RNA, 64 nt, Human; identical to SEQ ID NO: 24839

SEQ ID NO: 183883 - RNA, 64 nt, Human; identical to SEQ ID NO: 24840

SEQ ID NO: 183884 - RNA, 64 nt, Human; identical to SEQ ID NO: 24841

SEQ ID NO: 183885 - RNA, 64 nt, Human; identical to SEQ ID NO: 24842

SEQ ID NO: 183886 - RNA, 64 nt, Human; identical to SEQ ID NO: 24843

SEQ ID NO: 183887 - RNA, 64 nt, Human; identical to SEQ ID NO: 24844

SEQ ID NO: 183888 - RNA, 64 nt, Human; identical to SEQ ID NO: 24845

SEQ ID NO: 183889 - RNA, 64 nt, Human; identical to SEQ ID NO: 24846

SEQ ID NO: 183890 - RNA, 64 nt, Human; identical to SEQ ID NO: 24847

SEQ ID NO: 183891 - RNA, 64 nt, Human; identical to SEQ ID NO: 24848

SEQ ID NO: 183892 - RNA, 64 nt, Human; identical to SEQ ID NO: 24849

SEQ ID NO: 183893 - RNA, 64 nt, Human; identical to SEQ ID NO: 24850

SEQ ID NO: 183894 - RNA, 64 nt, Human; identical to SEQ ID NO: 24851

SEQ ID NO: 183895 - RNA, 64 nt, Human; identical to SEQ ID NO: 24852

SEQ ID NO: 183896 - RNA, 64 nt, Human; identical to SEQ ID NO: 24853

SEQ ID NO: 183897 - RNA, 64 nt, Human; identical to SEQ ID NO: 24854

SEQ ID NO: 183898 - RNA, 64 nt, Human; identical to SEQ ID NO: 24855

SEQ ID NO: 183899 - RNA, 64 nt, Human; identical to SEQ ID NO: 24856

SEQ ID NO: 183900 - RNA, 64 nt, Human; identical to SEQ ID NO: 24857

SEQ ID NO: 183901 - RNA, 64 nt, Human; identical to SEQ ID NO: 24858

SEQ ID NO: 183902 - RNA, 64 nt, Human; identical to SEQ ID NO: 24859

SEQ ID NO: 183903 - RNA, 64 nt, Human; identical to SEQ ID NO: 24860

SEQ ID NO: 183904 - RNA, 64 nt, Human; identical to SEQ ID NO: 24861

SEQ ID NO: 183905 - RNA, 64 nt, Human; identical to SEQ ID NO: 24862

SEQ ID NO: 183906 - RNA, 64 nt, Human; identical to SEQ ID NO: 24863

SEQ ID NO: 183907 - RNA, 64 nt, Human; identical to SEQ ID NO: 24864

SEQ ID NO: 183908 - RNA, 64 nt, Human; identical to SEQ ID NO: 24865

SEQ ID NO: 183909 - RNA, 64 nt, Human; identical to SEQ ID NO: 24866

SEQ ID NO: 183910 - RNA, 64 nt, Human; identical to SEQ ID NO: 24867

SEQ ID NO: 183911 - RNA, 64 nt, Human; identical to SEQ ID NO: 24868

SEQ ID NO: 183912 - RNA, 64 nt, Human; identical to SEQ ID NO: 24869

SEQ ID NO: 183913 - RNA, 64 nt, Human; identical to SEQ ID NO: 24870

SEQ ID NO: 183914 - RNA, 64 nt, Human; identical to SEQ ID NO: 24871

SEQ ID NO: 183915 - RNA, 64 nt, Human; identical to SEQ ID NO: 24872

SEQ ID NO: 183916 - RNA, 64 nt, Human; identical to SEQ ID NO: 24873

SEQ ID NO: 183917 - RNA, 64 nt, Human; identical to SEQ ID NO: 24874

SEQ ID NO: 183918 - RNA, 64 nt, Human; identical to SEQ ID NO: 24875

SEQ ID NO: 183919 - RNA, 64 nt, Human; identical to SEQ ID NO: 24876

SEQ ID NO: 183920 - RNA, 64 nt, Human; identical to SEQ ID NO: 24877

SEQ ID NO: 183921 - RNA, 64 nt, Human; identical to SEQ ID NO: 24878

SEQ ID NO: 183922 - RNA, 64 nt, Human; identical to SEQ ID NO: 24879

SEQ ID NO: 183923 - RNA, 64 nt, Human; identical to SEQ ID NO: 24880

SEQ ID NO: 183924 - RNA, 64 nt, Human; identical to SEQ ID NO: 24881

SEQ ID NO: 183925 - RNA, 64 nt, Human; identical to SEQ ID NO: 24882

SEQ ID NO: 183926 - RNA, 64 nt, Human; identical to SEQ ID NO: 24883

SEQ ID NO: 183927 - RNA, 64 nt, Human; identical to SEQ ID NO: 24884

SEQ ID NO: 183928 - RNA, 64 nt, Human; identical to SEQ ID NO: 24885

SEQ ID NO: 183929 - RNA, 64 nt, Human; identical to SEQ ID NO: 24886

SEQ ID NO: 183930 - RNA, 64 nt, Human; identical to SEQ ID NO: 24887

SEQ ID NO: 183931 - RNA, 64 nt, Human; identical to SEQ ID NO: 24888

SEQ ID NO: 183932 - RNA, 64 nt, Human; identical to SEQ ID NO: 24889

SEQ ID NO: 183933 - RNA, 64 nt, Human; identical to SEQ ID NO: 24890

SEQ ID NO: 183934 - RNA, 64 nt, Human; identical to SEQ ID NO: 24891

SEQ ID NO: 183935 - RNA, 64 nt, Human; identical to SEQ ID NO: 24892

SEQ ID NO: 183936 - RNA, 64 nt, Human; identical to SEQ ID NO: 24893

SEQ ID NO: 183937 - RNA, 64 nt, Human; identical to SEQ ID NO: 24894

SEQ ID NO: 183938 - RNA, 64 nt, Human; identical to SEQ ID NO: 24895

SEQ ID NO: 183939 - RNA, 64 nt, Human; identical to SEQ ID NO: 24896

SEQ ID NO: 183940 - RNA, 64 nt, Human; identical to SEQ ID NO: 24897

SEQ ID NO: 183941 - RNA, 64 nt, Human; identical to SEQ ID NO: 24898

SEQ ID NO: 183942 - RNA, 64 nt, Human; identical to SEQ ID NO: 24899

SEQ ID NO: 183943 - RNA, 64 nt, Human; identical to SEQ ID NO: 24900

SEQ ID NO: 183944 - RNA, 64 nt, Human; identical to SEQ ID NO: 24901

SEQ ID NO: 183945 - RNA, 64 nt, Human; identical to SEQ ID NO: 24902

SEQ ID NO: 183946 - RNA, 64 nt, Human; identical to SEQ ID NO: 24903

SEQ ID NO: 183947 - RNA, 64 nt, Human; identical to SEQ ID NO: 24904

SEQ ID NO: 183948 - RNA, 64 nt, Human; identical to SEQ ID NO: 24905

SEQ ID NO: 183949 - RNA, 64 nt, Human; identical to SEQ ID NO: 24906

SEQ ID NO: 183950 - RNA, 64 nt, Human; identical to SEQ ID NO: 24907

SEQ ID NO: 183951 - RNA, 64 nt, Human; identical to SEQ ID NO: 24908

SEQ ID NO: 183952 - RNA, 64 nt, Human; identical to SEQ ID NO: 24909

SEQ ID NO: 183953 - RNA, 64 nt, Human; identical to SEQ ID NO: 24910

SEQ ID NO: 183954 - RNA, 64 nt, Human; identical to SEQ ID NO: 24911

SEQ ID NO: 183955 - RNA, 64 nt, Human; identical to SEQ ID NO: 24912

SEQ ID NO: 183956 - RNA, 64 nt, Human; identical to SEQ ID NO: 24913

SEQ ID NO: 183957 - RNA, 64 nt, Human; identical to SEQ ID NO: 24914

SEQ ID NO: 183958 - RNA, 64 nt, Human; identical to SEQ ID NO: 24915

SEQ ID NO: 183959 - RNA, 64 nt, Human; identical to SEQ ID NO: 24916

SEQ ID NO: 183960 - RNA, 64 nt, Human; identical to SEQ ID NO: 24917

SEQ ID NO: 183961 - RNA, 64 nt, Human; identical to SEQ ID NO: 24918

SEQ ID NO: 183962 - RNA, 64 nt, Human; identical to SEQ ID NO: 24919

SEQ ID NO: 183963 - RNA, 64 nt, Human; identical to SEQ ID NO: 24920

SEQ ID NO: 183964 - RNA, 64 nt, Human; identical to SEQ ID NO: 24921

SEQ ID NO: 183965 - RNA, 64 nt, Human; identical to SEQ ID NO: 24922

SEQ ID NO: 183966 - RNA, 64 nt, Human; identical to SEQ ID NO: 24923

SEQ ID NO: 183967 - RNA, 64 nt, Human; identical to SEQ ID NO: 24924

SEQ ID NO: 183968 - RNA, 64 nt, Human; identical to SEQ ID NO: 24925

SEQ ID NO: 183969 - RNA, 64 nt, Human; identical to SEQ ID NO: 24926

SEQ ID NO: 183970 - RNA, 64 nt, Human; identical to SEQ ID NO: 24927

SEQ ID NO: 183971 - RNA, 64 nt, Human; identical to SEQ ID NO: 24928

SEQ ID NO: 183972 - RNA, 64 nt, Human; identical to SEQ ID NO: 24929

SEQ ID NO: 183973 - RNA, 64 nt, Human; identical to SEQ ID NO: 24930

SEQ ID NO: 183974 - RNA, 64 nt, Human; identical to SEQ ID NO: 24931

SEQ ID NO: 183975 - RNA, 64 nt, Human; identical to SEQ ID NO: 24932

SEQ ID NO: 183976 - RNA, 64 nt, Human; identical to SEQ ID NO: 24933

SEQ ID NO: 183977 - RNA, 64 nt, Human; identical to SEQ ID NO: 24934

SEQ ID NO: 183978 - RNA, 64 nt, Human; identical to SEQ ID NO: 24935

SEQ ID NO: 183979 - RNA, 64 nt, Human; identical to SEQ ID NO: 24936

SEQ ID NO: 183980 - RNA, 64 nt, Human; identical to SEQ ID NO: 24937

SEQ ID NO: 183981 - RNA, 64 nt, Human; identical to SEQ ID NO: 24938

SEQ ID NO: 183982 - RNA, 64 nt, Human; identical to SEQ ID NO: 24939

SEQ ID NO: 183983 - RNA, 64 nt, Human; identical to SEQ ID NO: 24940

SEQ ID NO: 183984 - RNA, 64 nt, Human; identical to SEQ ID NO: 24941

SEQ ID NO: 183985 - RNA, 64 nt, Human; identical to SEQ ID NO: 24942

SEQ ID NO: 183986 - RNA, 64 nt, Human; identical to SEQ ID NO: 24943

SEQ ID NO: 183987 - RNA, 64 nt, Human; identical to SEQ ID NO: 24944

SEQ ID NO: 183988 - RNA, 64 nt, Human; identical to SEQ ID NO: 24945

SEQ ID NO: 183989 - RNA, 64 nt, Human; identical to SEQ ID NO: 24946

SEQ ID NO: 183990 - RNA, 50 nt, Human; identical to SEQ ID NO: 23806

SEQ ID NO: 183991 - RNA, 64 nt, Human; identical to SEQ ID NO: 24948

SEQ ID NO: 183992 - RNA, 64 nt, Human; identical to SEQ ID NO: 24949

SEQ ID NO: 183993 - RNA, 64 nt, Human; identical to SEQ ID NO: 24950

SEQ ID NO: 183994 - RNA, 64 nt, Human; identical to SEQ ID NO: 24951

SEQ ID NO: 183995 - RNA, 64 nt, Human; identical to SEQ ID NO: 24952

SEQ ID NO: 183996 - RNA, 64 nt, Human; identical to SEQ ID NO: 24953

SEQ ID NO: 183997 - RNA, 64 nt, Human; identical to SEQ ID NO: 24954

SEQ ID NO: 183998 - RNA, 64 nt, Human; identical to SEQ ID NO: 24955

SEQ ID NO: 183999 - RNA, 64 nt, Human; identical to SEQ ID NO: 24956

SEQ ID NO: 184000 - RNA, 64 nt, Human; identical to SEQ ID NO: 24957

SEQ ID NO: 184001 - RNA, 64 nt, Human; identical to SEQ ID NO: 24958

SEQ ID NO: 184002 - RNA, 64 nt, Human; identical to SEQ ID NO: 24959

SEQ ID NO: 184003 - RNA, 64 nt, Human; identical to SEQ ID NO: 24960

SEQ ID NO: 184004 - RNA, 64 nt, Human; identical to SEQ ID NO: 24961

SEQ ID NO: 184005 - RNA, 64 nt, Human; identical to SEQ ID NO: 24962

SEQ ID NO: 184006 - RNA, 64 nt, Human; identical to SEQ ID NO: 24963

SEQ ID NO: 184007 - RNA, 64 nt, Human; identical to SEQ ID NO: 24964

SEQ ID NO: 184008 - RNA, 64 nt, Human; identical to SEQ ID NO: 24965

SEQ ID NO: 184009 - RNA, 64 nt, Human; identical to SEQ ID NO: 24966

SEQ ID NO: 184010 - RNA, 64 nt, Human; identical to SEQ ID NO: 24967

SEQ ID NO: 184011 - RNA, 64 nt, Human; identical to SEQ ID NO: 24968

SEQ ID NO: 184012 - RNA, 64 nt, Human; identical to SEQ ID NO: 24969

SEQ ID NO: 184013 - RNA, 64 nt, Human; identical to SEQ ID NO: 24970

SEQ ID NO: 184014 - RNA, 64 nt, Human; identical to SEQ ID NO: 24971

SEQ ID NO: 184015 - RNA, 64 nt, Human; identical to SEQ ID NO: 24972

SEQ ID NO: 184016 - RNA, 64 nt, Human; identical to SEQ ID NO: 24973

SEQ ID NO: 184017 - RNA, 64 nt, Human; identical to SEQ ID NO: 24974

SEQ ID NO: 184018 - RNA, 64 nt, Human; identical to SEQ ID NO: 24975

SEQ ID NO: 184019 - RNA, 64 nt, Human; identical to SEQ ID NO: 24976

SEQ ID NO: 184020 - RNA, 64 nt, Human; identical to SEQ ID NO: 24977

SEQ ID NO: 184021 - RNA, 64 nt, Human; identical to SEQ ID NO: 24978

SEQ ID NO: 184022 - RNA, 64 nt, Human; identical to SEQ ID NO: 24979

SEQ ID NO: 184023 - RNA, 64 nt, Human; identical to SEQ ID NO: 24980

SEQ ID NO: 184024 - RNA, 64 nt, Human; identical to SEQ ID NO: 24981

SEQ ID NO: 184025 - RNA, 64 nt, Human; identical to SEQ ID NO: 24982

SEQ ID NO: 184026 - RNA, 64 nt, Human; identical to SEQ ID NO: 24983

SEQ ID NO: 184027 - RNA, 64 nt, Human; identical to SEQ ID NO: 24984

SEQ ID NO: 184028 - RNA, 64 nt, Human; identical to SEQ ID NO: 24985

SEQ ID NO: 184029 - RNA, 64 nt, Human; identical to SEQ ID NO: 24986

SEQ ID NO: 184030 - RNA, 64 nt, Human; identical to SEQ ID NO: 24987

SEQ ID NO: 184031 - RNA, 64 nt, Human; identical to SEQ ID NO: 24988

SEQ ID NO: 184032 - RNA, 64 nt, Human; identical to SEQ ID NO: 24989

SEQ ID NO: 184033 - RNA, 64 nt, Human; identical to SEQ ID NO: 24990

SEQ ID NO: 184034 - RNA, 64 nt, Human; identical to SEQ ID NO: 24991

SEQ ID NO: 184035 - RNA, 64 nt, Human; identical to SEQ ID NO: 24992

SEQ ID NO: 184036 - RNA, 64 nt, Human; identical to SEQ ID NO: 24993

SEQ ID NO: 184037 - RNA, 64 nt, Human; identical to SEQ ID NO: 24994

SEQ ID NO: 184038 - RNA, 64 nt, Human; identical to SEQ ID NO: 24995

SEQ ID NO: 184039 - RNA, 64 nt, Human; identical to SEQ ID NO: 24996

SEQ ID NO: 184040 - RNA, 64 nt, Human; identical to SEQ ID NO: 24997

SEQ ID NO: 184041 - RNA, 64 nt, Human; identical to SEQ ID NO: 24998

SEQ ID NO: 184042 - RNA, 64 nt, Human; identical to SEQ ID NO: 24999

SEQ ID NO: 184043 - RNA, 64 nt, Human; identical to SEQ ID NO: 25000

SEQ ID NO: 184044 - RNA, 64 nt, Human; identical to SEQ ID NO: 25001

SEQ ID NO: 184045 - RNA, 64 nt, Human; identical to SEQ ID NO: 25002

SEQ ID NO: 184046 - RNA, 64 nt, Human; identical to SEQ ID NO: 25003

SEQ ID NO: 184047 - RNA, 64 nt, Human; identical to SEQ ID NO: 25004

SEQ ID NO: 184048 - RNA, 64 nt, Human; identical to SEQ ID NO: 25005

SEQ ID NO: 184049 - RNA, 64 nt, Human; identical to SEQ ID NO: 24970

SEQ ID NO: 184050 - RNA, 64 nt, Human; identical to SEQ ID NO: 25007

SEQ ID NO: 184051 - RNA, 64 nt, Human; identical to SEQ ID NO: 25008

SEQ ID NO: 184052 - RNA, 64 nt, Human; identical to SEQ ID NO: 25009

SEQ ID NO: 184053 - RNA, 58 nt, Human; identical to SEQ ID NO: 23869

SEQ ID NO: 184054 - RNA, 64 nt, Human; identical to SEQ ID NO: 25011

SEQ ID NO: 184055 - RNA, 64 nt, Human; identical to SEQ ID NO: 25012

SEQ ID NO: 184056 - RNA, 64 nt, Human; identical to SEQ ID NO: 25013

SEQ ID NO: 184057 - RNA, 64 nt, Human; identical to SEQ ID NO: 25014

SEQ ID NO: 184058 - RNA, 64 nt, Human; identical to SEQ ID NO: 25015

SEQ ID NO: 184059 - RNA, 64 nt, Human; identical to SEQ ID NO: 25016

SEQ ID NO: 184060 - RNA, 64 nt, Human; identical to SEQ ID NO: 25017

SEQ ID NO: 184061 - RNA, 64 nt, Human; identical to SEQ ID NO: 25018

SEQ ID NO: 184062 - RNA, 64 nt, Human; identical to SEQ ID NO: 25019

SEQ ID NO: 184063 - RNA, 64 nt, Human; identical to SEQ ID NO: 25020

SEQ ID NO: 184064 - RNA, 64 nt, Human; identical to SEQ ID NO: 25021

SEQ ID NO: 184065 - RNA, 64 nt, Human; identical to SEQ ID NO: 25022

SEQ ID NO: 184066 - RNA, 55 nt, Human; identical to SEQ ID NO: 23882

SEQ ID NO: 184067 - RNA, 64 nt, Human; identical to SEQ ID NO: 25024

SEQ ID NO: 184068 - RNA, 64 nt, Human; identical to SEQ ID NO: 25025

SEQ ID NO: 184069 - RNA, 64 nt, Human; identical to SEQ ID NO: 25026

SEQ ID NO: 184070 - RNA, 64 nt, Human; identical to SEQ ID NO: 25027

SEQ ID NO: 184071 - RNA, 64 nt, Human; identical to SEQ ID NO: 25028

SEQ ID NO: 184072 - RNA, 64 nt, Human; identical to SEQ ID NO: 25029

SEQ ID NO: 184073 - RNA, 64 nt, Human; identical to SEQ ID NO: 25030

SEQ ID NO: 184074 - RNA, 64 nt, Human; identical to SEQ ID NO: 25031

SEQ ID NO: 184075 - RNA, 64 nt, Human; identical to SEQ ID NO: 25032

SEQ ID NO: 184076 - RNA, 64 nt, Human; identical to SEQ ID NO: 25033

SEQ ID NO: 184077 - RNA, 64 nt, Human; identical to SEQ ID NO: 25034

SEQ ID NO: 184078 - RNA, 64 nt, Human; identical to SEQ ID NO: 25035

SEQ ID NO: 184079 - RNA, 64 nt, Human; identical to SEQ ID NO: 25036

SEQ ID NO: 184080 - RNA, 64 nt, Human; identical to SEQ ID NO: 25037

SEQ ID NO: 184081 - RNA, 64 nt, Human; identical to SEQ ID NO: 25038

SEQ ID NO: 184082 - RNA, 64 nt, Human; identical to SEQ ID NO: 25039

SEQ ID NO: 184083 - RNA, 64 nt, Human; identical to SEQ ID NO: 25040

SEQ ID NO: 184084 - RNA, 64 nt, Human; identical to SEQ ID NO: 25041

SEQ ID NO: 184085 - RNA, 64 nt, Human; identical to SEQ ID NO: 25042

SEQ ID NO: 184086 - RNA, 64 nt, Human; identical to SEQ ID NO: 25043

SEQ ID NO: 184087 - RNA, 64 nt, Human; identical to SEQ ID NO: 25044

SEQ ID NO: 184088 - RNA, 64 nt, Human; identical to SEQ ID NO: 25045

SEQ ID NO: 184089 - RNA, 64 nt, Human; identical to SEQ ID NO: 25046

SEQ ID NO: 184090 - RNA, 64 nt, Human; identical to SEQ ID NO: 25047

SEQ ID NO: 184091 - RNA, 64 nt, Human; identical to SEQ ID NO: 25048

SEQ ID NO: 184092 - RNA, 64 nt, Human; identical to SEQ ID NO: 25049

SEQ ID NO: 184093 - RNA, 64 nt, Human; identical to SEQ ID NO: 25050

SEQ ID NO: 184094 - RNA, 64 nt, Human; identical to SEQ ID NO: 25051

SEQ ID NO: 184095 - RNA, 64 nt, Human; identical to SEQ ID NO: 25052

SEQ ID NO: 184096 - RNA, 64 nt, Human; identical to SEQ ID NO: 25053

SEQ ID NO: 184097 - RNA, 64 nt, Human; identical to SEQ ID NO: 25054

SEQ ID NO: 184098 - RNA, 64 nt, Human; identical to SEQ ID NO: 25055

SEQ ID NO: 184099 - RNA, 64 nt, Human; identical to SEQ ID NO: 25056

SEQ ID NO: 184100 - RNA, 64 nt, Human; identical to SEQ ID NO: 25057

SEQ ID NO: 184101 - RNA, 64 nt, Human; identical to SEQ ID NO: 25058

SEQ ID NO: 184102 - RNA, 64 nt, Human; identical to SEQ ID NO: 25059

SEQ ID NO: 184103 - RNA, 64 nt, Human; identical to SEQ ID NO: 25060

SEQ ID NO: 184104 - RNA, 64 nt, Human; identical to SEQ ID NO: 25061

SEQ ID NO: 184105 - RNA, 64 nt, Human; identical to SEQ ID NO: 25062

SEQ ID NO: 184106 - RNA, 64 nt, Human; identical to SEQ ID NO: 25063

SEQ ID NO: 184107 - RNA, 64 nt, Human; identical to SEQ ID NO: 25064

SEQ ID NO: 184108 - RNA, 64 nt, Human; identical to SEQ ID NO: 25065

SEQ ID NO: 184109 - RNA, 64 nt, Human; identical to SEQ ID NO: 25066

SEQ ID NO: 184110 - RNA, 64 nt, Human; identical to SEQ ID NO: 25067

SEQ ID NO: 184111 - RNA, 64 nt, Human; identical to SEQ ID NO: 25068

SEQ ID NO: 184112 - RNA, 64 nt, Human; identical to SEQ ID NO: 25069

SEQ ID NO: 184113 - RNA, 64 nt, Human; identical to SEQ ID NO: 25070

SEQ ID NO: 184114 - RNA, 64 nt, Human; identical to SEQ ID NO: 25071

SEQ ID NO: 184115 - RNA, 64 nt, Human; identical to SEQ ID NO: 25072

SEQ ID NO: 184116 - RNA, 64 nt, Human; identical to SEQ ID NO: 25073

SEQ ID NO: 184117 - RNA, 64 nt, Human; identical to SEQ ID NO: 25074

SEQ ID NO: 184118 - RNA, 64 nt, Human; identical to SEQ ID NO: 25075

SEQ ID NO: 184119 - RNA, 64 nt, Human; identical to SEQ ID NO: 25076

SEQ ID NO: 184120 - RNA, 62 nt, Human; identical to SEQ ID NO: 25077

SEQ ID NO: 184121 - RNA, 64 nt, Human; identical to SEQ ID NO: 25078

SEQ ID NO: 184122 - RNA, 64 nt, Human; identical to SEQ ID NO: 25079

SEQ ID NO: 184123 - RNA, 64 nt, Human; identical to SEQ ID NO: 25080

SEQ ID NO: 184124 - RNA, 64 nt, Human; identical to SEQ ID NO: 25081

SEQ ID NO: 184125 - RNA, 64 nt, Human; identical to SEQ ID NO: 25082

SEQ ID NO: 184126 - RNA, 64 nt, Human; identical to SEQ ID NO: 25083

SEQ ID NO: 184127 - RNA, 64 nt, Human; identical to SEQ ID NO: 25084

SEQ ID NO: 184128 - RNA, 64 nt, Human; identical to SEQ ID NO: 25085

SEQ ID NO: 184129 - RNA, 64 nt, Human; identical to SEQ ID NO: 25086

SEQ ID NO: 184130 - RNA, 64 nt, Human; identical to SEQ ID NO: 25087

SEQ ID NO: 184131 - RNA, 64 nt, Human; identical to SEQ ID NO: 25088

SEQ ID NO: 184132 - RNA, 64 nt, Human; identical to SEQ ID NO: 25089

SEQ ID NO: 184133 - RNA, 64 nt, Human; identical to SEQ ID NO: 25090

SEQ ID NO: 184134 - RNA, 64 nt, Human; identical to SEQ ID NO: 25091

SEQ ID NO: 184135 - RNA, 64 nt, Human; identical to SEQ ID NO: 25092

SEQ ID NO: 184136 - RNA, 64 nt, Human; identical to SEQ ID NO: 25093

SEQ ID NO: 184137 - RNA, 64 nt, Human; identical to SEQ ID NO: 25094

SEQ ID NO: 184138 - RNA, 64 nt, Human; identical to SEQ ID NO: 25095

SEQ ID NO: 184139 - RNA, 64 nt, Human; identical to SEQ ID NO: 25096

SEQ ID NO: 184140 - RNA, 64 nt, Human; identical to SEQ ID NO: 25097

SEQ ID NO: 184141 - RNA, 64 nt, Human; identical to SEQ ID NO: 25098

SEQ ID NO: 184142 - RNA, 64 nt, Human; identical to SEQ ID NO: 25099

SEQ ID NO: 184143 - RNA, 64 nt, Human; identical to SEQ ID NO: 25100

SEQ ID NO: 184144 - RNA, 64 nt, Human; identical to SEQ ID NO: 25101

SEQ ID NO: 184145 - RNA, 64 nt, Human; identical to SEQ ID NO: 25102

SEQ ID NO: 184146 - RNA, 64 nt, Human; identical to SEQ ID NO: 25103

SEQ ID NO: 184147 - RNA, 60 nt, Human; identical to SEQ ID NO: 23963

SEQ ID NO: 184148 - RNA, 64 nt, Human; identical to SEQ ID NO: 25105

SEQ ID NO: 184149 - RNA, 64 nt, Human; identical to SEQ ID NO: 25106

SEQ ID NO: 184150 - RNA, 64 nt, Human; identical to SEQ ID NO: 25107

SEQ ID NO: 184151 - RNA, 64 nt, Human; identical to SEQ ID NO: 25108

SEQ ID NO: 184152 - RNA, 64 nt, Human; identical to SEQ ID NO: 25109

SEQ ID NO: 184153 - RNA, 64 nt, Human; identical to SEQ ID NO: 25110

SEQ ID NO: 184154 - RNA, 64 nt, Human; identical to SEQ ID NO: 25111

SEQ ID NO: 184155 - RNA, 64 nt, Human; identical to SEQ ID NO: 25112

SEQ ID NO: 184156 - RNA, 64 nt, Human; identical to SEQ ID NO: 25113

SEQ ID NO: 184157 - RNA, 64 nt, Human; identical to SEQ ID NO: 25114

SEQ ID NO: 184158 - RNA, 64 nt, Human; identical to SEQ ID NO: 25115

SEQ ID NO: 184159 - RNA, 64 nt, Human; identical to SEQ ID NO: 25116

SEQ ID NO: 184160 - RNA, 64 nt, Human; identical to SEQ ID NO: 25117

SEQ ID NO: 184161 - RNA, 64 nt, Human; identical to SEQ ID NO: 25118

SEQ ID NO: 184162 - RNA, 64 nt, Human; identical to SEQ ID NO: 25119

SEQ ID NO: 184163 - RNA, 64 nt, Human; identical to SEQ ID NO: 25120

SEQ ID NO: 184164 - RNA, 64 nt, Human; identical to SEQ ID NO: 25121

SEQ ID NO: 184165 - RNA, 64 nt, Human; identical to SEQ ID NO: 25122

SEQ ID NO: 184166 - RNA, 64 nt, Human; identical to SEQ ID NO: 25123

SEQ ID NO: 184167 - RNA, 64 nt, Human; identical to SEQ ID NO: 25124

SEQ ID NO: 184168 - RNA, 64 nt, Human; identical to SEQ ID NO: 25125

SEQ ID NO: 184169 - RNA, 64 nt, Human; identical to SEQ ID NO: 25126

SEQ ID NO: 184170 - RNA, 64 nt, Human; identical to SEQ ID NO: 25127

SEQ ID NO: 184171 - RNA, 64 nt, Human; identical to SEQ ID NO: 25128

SEQ ID NO: 184172 - RNA, 64 nt, Human; identical to SEQ ID NO: 25129

SEQ ID NO: 184173 - RNA, 64 nt, Human; identical to SEQ ID NO: 25130

SEQ ID NO: 184174 - RNA, 64 nt, Human; identical to SEQ ID NO: 25131

SEQ ID NO: 184175 - RNA, 64 nt, Human; identical to SEQ ID NO: 25132

SEQ ID NO: 184176 - RNA, 64 nt, Human; identical to SEQ ID NO: 25133

SEQ ID NO: 184177 - RNA, 64 nt, Human; identical to SEQ ID NO: 25134

SEQ ID NO: 184178 - RNA, 64 nt, Human; identical to SEQ ID NO: 25135

SEQ ID NO: 184179 - RNA, 64 nt, Human; identical to SEQ ID NO: 25136

SEQ ID NO: 184180 - RNA, 64 nt, Human; identical to SEQ ID NO: 25137

SEQ ID NO: 184181 - RNA, 64 nt, Human; identical to SEQ ID NO: 25138

SEQ ID NO: 184182 - RNA, 64 nt, Human; identical to SEQ ID NO: 25139

SEQ ID NO: 184183 - RNA, 64 nt, Human; identical to SEQ ID NO: 25140

SEQ ID NO: 184184 - RNA, 64 nt, Human; identical to SEQ ID NO: 25141

SEQ ID NO: 184185 - RNA, 64 nt, Human; identical to SEQ ID NO: 25142

SEQ ID NO: 184186 - RNA, 64 nt, Human; identical to SEQ ID NO: 25143

SEQ ID NO: 184187 - RNA, 64 nt, Human; identical to SEQ ID NO: 25144

SEQ ID NO: 184188 - RNA, 64 nt, Human; identical to SEQ ID NO: 25145

SEQ ID NO: 184189 - RNA, 64 nt, Human; identical to SEQ ID NO: 25146

SEQ ID NO: 184190 - RNA, 64 nt, Human; identical to SEQ ID NO: 25147

SEQ ID NO: 184191 - RNA, 64 nt, Human; identical to SEQ ID NO: 25148

SEQ ID NO: 184192 - RNA, 64 nt, Human; identical to SEQ ID NO: 25149

SEQ ID NO: 184193 - RNA, 64 nt, Human; identical to SEQ ID NO: 25150

SEQ ID NO: 184194 - RNA, 64 nt, Human; identical to SEQ ID NO: 25151

SEQ ID NO: 184195 - RNA, 64 nt, Human; identical to SEQ ID NO: 25152

SEQ ID NO: 184196 - RNA, 64 nt, Human; identical to SEQ ID NO: 25153

SEQ ID NO: 184197 - RNA, 64 nt, Human; identical to SEQ ID NO: 25154

SEQ ID NO: 184198 - RNA, 64 nt, Human; identical to SEQ ID NO: 25155

SEQ ID NO: 184199 - RNA, 64 nt, Human; identical to SEQ ID NO: 25156

SEQ ID NO: 184200 - RNA, 64 nt, Human; identical to SEQ ID NO: 25157

SEQ ID NO: 184201 - RNA, 64 nt, Human; identical to SEQ ID NO: 25158

SEQ ID NO: 184202 - RNA, 64 nt, Human; identical to SEQ ID NO: 25159

SEQ ID NO: 184203 - RNA, 64 nt, Human; identical to SEQ ID NO: 25160

SEQ ID NO: 184204 - RNA, 64 nt, Human; identical to SEQ ID NO: 25161

SEQ ID NO: 184205 - RNA, 64 nt, Human; identical to SEQ ID NO: 25162

SEQ ID NO: 184206 - RNA, 64 nt, Human; identical to SEQ ID NO: 25163

SEQ ID NO: 184207 - RNA, 64 nt, Human; identical to SEQ ID NO: 25164

SEQ ID NO: 184208 - RNA, 64 nt, Human; identical to SEQ ID NO: 25165

SEQ ID NO: 184209 - RNA, 64 nt, Human; identical to SEQ ID NO: 25166

SEQ ID NO: 184210 - RNA, 64 nt, Human; identical to SEQ ID NO: 25167

SEQ ID NO: 184211 - RNA, 64 nt, Human; identical to SEQ ID NO: 25168

SEQ ID NO: 184212 - RNA, 64 nt, Human; identical to SEQ ID NO: 25169

SEQ ID NO: 184213 - RNA, 64 nt, Human; identical to SEQ ID NO: 25170

SEQ ID NO: 184214 - RNA, 64 nt, Human; identical to SEQ ID NO: 25171

SEQ ID NO: 184215 - RNA, 64 nt, Human; identical to SEQ ID NO: 25172

SEQ ID NO: 184216 - RNA, 64 nt, Human; identical to SEQ ID NO: 25173

SEQ ID NO: 184217 - RNA, 64 nt, Human; identical to SEQ ID NO: 25174

SEQ ID NO: 184218 - RNA, 64 nt, Human; identical to SEQ ID NO: 25175

SEQ ID NO: 184219 - RNA, 51 nt, Human; identical to SEQ ID NO: 24035

SEQ ID NO: 184220 - RNA, 64 nt, Human; identical to SEQ ID NO: 25177

SEQ ID NO: 184221 - RNA, 64 nt, Human; identical to SEQ ID NO: 25178

SEQ ID NO: 184222 - RNA, 64 nt, Human; identical to SEQ ID NO: 25179

SEQ ID NO: 184223 - RNA, 64 nt, Human; identical to SEQ ID NO: 25180

SEQ ID NO: 184224 - RNA, 64 nt, Human; identical to SEQ ID NO: 25181

SEQ ID NO: 184225 - RNA, 64 nt, Human; identical to SEQ ID NO: 25182

SEQ ID NO: 184226 - RNA, 64 nt, Human; identical to SEQ ID NO: 25183

SEQ ID NO: 184227 - RNA, 64 nt, Human; identical to SEQ ID NO: 25184

SEQ ID NO: 184228 - RNA, 64 nt, Human; identical to SEQ ID NO: 25185

SEQ ID NO: 184229 - RNA, 64 nt, Human; identical to SEQ ID NO: 25186

SEQ ID NO: 184230 - RNA, 64 nt, Human; identical to SEQ ID NO: 25187

SEQ ID NO: 184231 - RNA, 64 nt, Human; identical to SEQ ID NO: 25188

SEQ ID NO: 184232 - RNA, 64 nt, Human; identical to SEQ ID NO: 25189

SEQ ID NO: 184233 - RNA, 64 nt, Human; identical to SEQ ID NO: 25190

SEQ ID NO: 184234 - RNA, 64 nt, Human; identical to SEQ ID NO: 25191

SEQ ID NO: 184235 - RNA, 64 nt, Human; identical to SEQ ID NO: 25192

SEQ ID NO: 184236 - RNA, 64 nt, Human; identical to SEQ ID NO: 25193

SEQ ID NO: 184237 - RNA, 64 nt, Human; identical to SEQ ID NO: 25194

SEQ ID NO: 184238 - RNA, 64 nt, Human; identical to SEQ ID NO: 25195

SEQ ID NO: 184239 - RNA, 64 nt, Human; identical to SEQ ID NO: 25196

SEQ ID NO: 184240 - RNA, 64 nt, Human; identical to SEQ ID NO: 25197

SEQ ID NO: 184241 - RNA, 64 nt, Human; identical to SEQ ID NO: 25198

SEQ ID NO: 184242 - RNA, 64 nt, Human; identical to SEQ ID NO: 25199

SEQ ID NO: 184243 - RNA, 64 nt, Human; identical to SEQ ID NO: 25200

SEQ ID NO: 184244 - RNA, 64 nt, Human; identical to SEQ ID NO: 25201

SEQ ID NO: 184245 - RNA, 64 nt, Human; identical to SEQ ID NO: 25202

SEQ ID NO: 184246 - RNA, 64 nt, Human; identical to SEQ ID NO: 25203

SEQ ID NO: 184247 - RNA, 64 nt, Human; identical to SEQ ID NO: 25204

SEQ ID NO: 184248 - RNA, 64 nt, Human; identical to SEQ ID NO: 25205

SEQ ID NO: 184249 - RNA, 64 nt, Human; identical to SEQ ID NO: 25206

SEQ ID NO: 184250 - RNA, 64 nt, Human; identical to SEQ ID NO: 25207

SEQ ID NO: 184251 - RNA, 64 nt, Human; identical to SEQ ID NO: 25208

SEQ ID NO: 184252 - RNA, 64 nt, Human; identical to SEQ ID NO: 25209

SEQ ID NO: 184253 - RNA, 64 nt, Human; identical to SEQ ID NO: 25210

SEQ ID NO: 184254 - RNA, 64 nt, Human; identical to SEQ ID NO: 25211

SEQ ID NO: 184255 - RNA, 64 nt, Human; identical to SEQ ID NO: 25212

SEQ ID NO: 184256 - RNA, 57 nt, Human; identical to SEQ ID NO: 24072

SEQ ID NO: 184257 - RNA, 64 nt, Human; identical to SEQ ID NO: 25214

SEQ ID NO: 184258 - RNA, 64 nt, Human; identical to SEQ ID NO: 25215

SEQ ID NO: 184259 - RNA, 64 nt, Human; identical to SEQ ID NO: 25216

SEQ ID NO: 184260 - RNA, 64 nt, Human; identical to SEQ ID NO: 25217

SEQ ID NO: 184261 - RNA, 64 nt, Human; identical to SEQ ID NO: 25218

SEQ ID NO: 184262 - RNA, 64 nt, Human; identical to SEQ ID NO: 25219

SEQ ID NO: 184263 - RNA, 64 nt, Human; identical to SEQ ID NO: 25220

SEQ ID NO: 184264 - RNA, 64 nt, Human; identical to SEQ ID NO: 25221

SEQ ID NO: 184265 - RNA, 64 nt, Human; identical to SEQ ID NO: 25222

SEQ ID NO: 184266 - RNA, 64 nt, Human; identical to SEQ ID NO: 25223

SEQ ID NO: 184267 - RNA, 64 nt, Human; identical to SEQ ID NO: 25224

SEQ ID NO: 184268 - RNA, 64 nt, Human; identical to SEQ ID NO: 25225

SEQ ID NO: 184269 - RNA, 64 nt, Human; identical to SEQ ID NO: 25226

SEQ ID NO: 184270 - RNA, 64 nt, Human; identical to SEQ ID NO: 25227

SEQ ID NO: 184271 - RNA, 64 nt, Human; identical to SEQ ID NO: 25228

SEQ ID NO: 184272 - RNA, 64 nt, Human; identical to SEQ ID NO: 25229

SEQ ID NO: 184273 - RNA, 64 nt, Human; identical to SEQ ID NO: 25230

SEQ ID NO: 184274 - RNA, 64 nt, Human; identical to SEQ ID NO: 25231

SEQ ID NO: 184275 - RNA, 64 nt, Human; identical to SEQ ID NO: 25232

SEQ ID NO: 184276 - RNA, 64 nt, Human; identical to SEQ ID NO: 25233

SEQ ID NO: 184277 - RNA, 64 nt, Human; identical to SEQ ID NO: 25234

SEQ ID NO: 184278 - RNA, 64 nt, Human; identical to SEQ ID NO: 25235

SEQ ID NO: 184279 - RNA, 64 nt, Human; identical to SEQ ID NO: 25236

SEQ ID NO: 184280 - RNA, 64 nt, Human; identical to SEQ ID NO: 25237

SEQ ID NO: 184281 - RNA, 64 nt, Human; identical to SEQ ID NO: 25238

SEQ ID NO: 184282 - RNA, 64 nt, Human; identical to SEQ ID NO: 25239

SEQ ID NO: 184283 - RNA, 64 nt, Human; identical to SEQ ID NO: 25240

SEQ ID NO: 184284 - RNA, 64 nt, Human; identical to SEQ ID NO: 25241

SEQ ID NO: 184285 - RNA, 64 nt, Human; identical to SEQ ID NO: 25242

SEQ ID NO: 184286 - RNA, 64 nt, Human; identical to SEQ ID NO: 25243

SEQ ID NO: 184287 - RNA, 64 nt, Human; identical to SEQ ID NO: 25244

SEQ ID NO: 184288 - RNA, 64 nt, Human; identical to SEQ ID NO: 25245

SEQ ID NO: 184289 - RNA, 64 nt, Human; identical to SEQ ID NO: 25246

SEQ ID NO: 184290 - RNA, 64 nt, Human; identical to SEQ ID NO: 25247

SEQ ID NO: 184291 - RNA, 64 nt, Human; identical to SEQ ID NO: 25248

SEQ ID NO: 184292 - RNA, 64 nt, Human; identical to SEQ ID NO: 25249

SEQ ID NO: 184293 - RNA, 64 nt, Human; identical to SEQ ID NO: 25250

SEQ ID NO: 184294 - RNA, 64 nt, Human; identical to SEQ ID NO: 25251

SEQ ID NO: 184295 - RNA, 64 nt, Human; identical to SEQ ID NO: 25252

SEQ ID NO: 184296 - RNA, 64 nt, Human; identical to SEQ ID NO: 25253

SEQ ID NO: 184297 - RNA, 64 nt, Human; identical to SEQ ID NO: 25254

SEQ ID NO: 184298 - RNA, 64 nt, Human; identical to SEQ ID NO: 25255

SEQ ID NO: 184299 - RNA, 64 nt, Human; identical to SEQ ID NO: 25256

SEQ ID NO: 184300 - RNA, 64 nt, Human; identical to SEQ ID NO: 25257

SEQ ID NO: 184301 - RNA, 64 nt, Human; identical to SEQ ID NO: 25258

SEQ ID NO: 184302 - RNA, 64 nt, Human; identical to SEQ ID NO: 25259

SEQ ID NO: 184303 - RNA, 64 nt, Human; identical to SEQ ID NO: 25260

SEQ ID NO: 184304 - RNA, 64 nt, Human; identical to SEQ ID NO: 25261

SEQ ID NO: 184305 - RNA, 64 nt, Human; identical to SEQ ID NO: 25262

SEQ ID NO: 184306 - RNA, 64 nt, Human; identical to SEQ ID NO: 25263

SEQ ID NO: 184307 - RNA, 64 nt, Human; identical to SEQ ID NO: 25264

SEQ ID NO: 184308 - RNA, 64 nt, Human; identical to SEQ ID NO: 25265

SEQ ID NO: 184309 - RNA, 64 nt, Human; identical to SEQ ID NO: 25266

SEQ ID NO: 184310 - RNA, 64 nt, Human; identical to SEQ ID NO: 25267

SEQ ID NO: 184311 - RNA, 64 nt, Human; identical to SEQ ID NO: 25268

SEQ ID NO: 184312 - RNA, 64 nt, Human; identical to SEQ ID NO: 25269

SEQ ID NO: 184313 - RNA, 64 nt, Human; identical to SEQ ID NO: 25270

SEQ ID NO: 184314 - RNA, 64 nt, Human; identical to SEQ ID NO: 25271

SEQ ID NO: 184315 - RNA, 64 nt, Human; identical to SEQ ID NO: 25272

SEQ ID NO: 184316 - RNA, 64 nt, Human; identical to SEQ ID NO: 25273

SEQ ID NO: 184317 - RNA, 64 nt, Human; identical to SEQ ID NO: 25274

SEQ ID NO: 184318 - RNA, 64 nt, Human; identical to SEQ ID NO: 25275

SEQ ID NO: 184319 - RNA, 64 nt, Human; identical to SEQ ID NO: 25276

SEQ ID NO: 184320 - RNA, 64 nt, Human; identical to SEQ ID NO: 25277

SEQ ID NO: 184321 - RNA, 64 nt, Human; identical to SEQ ID NO: 25278

SEQ ID NO: 184322 - RNA, 64 nt, Human; identical to SEQ ID NO: 25279

SEQ ID NO: 184323 - RNA, 64 nt, Human; identical to SEQ ID NO: 25280

SEQ ID NO: 184324 - RNA, 64 nt, Human; identical to SEQ ID NO: 25281

SEQ ID NO: 184325 - RNA, 64 nt, Human; identical to SEQ ID NO: 25282

SEQ ID NO: 184326 - RNA, 64 nt, Human; identical to SEQ ID NO: 25283

SEQ ID NO: 184327 - RNA, 64 nt, Human; identical to SEQ ID NO: 25284

SEQ ID NO: 184328 - RNA, 64 nt, Human; identical to SEQ ID NO: 25284

SEQ ID NO: 184329 - RNA, 64 nt, Human; identical to SEQ ID NO: 25286

SEQ ID NO: 184330 - RNA, 64 nt, Human; identical to SEQ ID NO: 25287

SEQ ID NO: 184331 - RNA, 64 nt, Human; identical to SEQ ID NO: 25288

SEQ ID NO: 184332 - RNA, 64 nt, Human; identical to SEQ ID NO: 25289

SEQ ID NO: 184333 - RNA, 64 nt, Human; identical to SEQ ID NO: 25290

SEQ ID NO: 184334 - RNA, 64 nt, Human; identical to SEQ ID NO: 25291

SEQ ID NO: 184335 - RNA, 64 nt, Human; identical to SEQ ID NO: 25292

SEQ ID NO: 184336 - RNA, 64 nt, Human; identical to SEQ ID NO: 25293

SEQ ID NO: 184337 - RNA, 64 nt, Human; identical to SEQ ID NO: 25294

SEQ ID NO: 184338 - RNA, 64 nt, Human; identical to SEQ ID NO: 25295

SEQ ID NO: 184339 - RNA, 64 nt, Human; identical to SEQ ID NO: 25296

SEQ ID NO: 184340 - RNA, 64 nt, Human; identical to SEQ ID NO: 25297

SEQ ID NO: 184341 - RNA, 64 nt, Human; identical to SEQ ID NO: 25298

SEQ ID NO: 184342 - RNA, 64 nt, Human; identical to SEQ ID NO: 25299

SEQ ID NO: 184343 - RNA, 64 nt, Human; identical to SEQ ID NO: 25300

SEQ ID NO: 184344 - RNA, 64 nt, Human; identical to SEQ ID NO: 25301

SEQ ID NO: 184345 - RNA, 64 nt, Human; identical to SEQ ID NO: 25302

SEQ ID NO: 184346 - RNA, 64 nt, Human; identical to SEQ ID NO: 25303

SEQ ID NO: 184347 - RNA, 64 nt, Human; identical to SEQ ID NO: 25304

SEQ ID NO: 184348 - RNA, 64 nt, Human; identical to SEQ ID NO: 25305

SEQ ID NO: 184349 - RNA, 64 nt, Human; identical to SEQ ID NO: 25306

SEQ ID NO: 184350 - RNA, 64 nt, Human; identical to SEQ ID NO: 25307

SEQ ID NO: 184351 - RNA, 64 nt, Human; identical to SEQ ID NO: 25308

SEQ ID NO: 184352 - RNA, 64 nt, Human; identical to SEQ ID NO: 25309

SEQ ID NO: 184353 - RNA, 64 nt, Human; identical to SEQ ID NO: 25310

SEQ ID NO: 184354 - RNA, 64 nt, Human; identical to SEQ ID NO: 25311

SEQ ID NO: 184355 - RNA, 64 nt, Human; identical to SEQ ID NO: 25312

SEQ ID NO: 184356 - RNA, 64 nt, Human; identical to SEQ ID NO: 25313

SEQ ID NO: 184357 - RNA, 64 nt, Human; identical to SEQ ID NO: 25314

SEQ ID NO: 184358 - RNA, 64 nt, Human; identical to SEQ ID NO: 25315

SEQ ID NO: 184359 - RNA, 64 nt, Human; identical to SEQ ID NO: 25316

SEQ ID NO: 184360 - RNA, 64 nt, Human; identical to SEQ ID NO: 25317

SEQ ID NO: 184361 - RNA, 64 nt, Human; identical to SEQ ID NO: 25318

SEQ ID NO: 184362 - RNA, 64 nt, Human; identical to SEQ ID NO: 25319

SEQ ID NO: 184363 - RNA, 63 nt, Human; identical to SEQ ID NO: 25320

SEQ ID NO: 184364 - RNA, 64 nt, Human; identical to SEQ ID NO: 25321

SEQ ID NO: 184365 - RNA, 64 nt, Human; identical to SEQ ID NO: 25322

SEQ ID NO: 184366 - RNA, 64 nt, Human; identical to SEQ ID NO: 25323

SEQ ID NO: 184367 - RNA, 64 nt, Human; identical to SEQ ID NO: 25324

SEQ ID NO: 184368 - RNA, 64 nt, Human; identical to SEQ ID NO: 25325

SEQ ID NO: 184369 - RNA, 64 nt, Human; identical to SEQ ID NO: 25326

SEQ ID NO: 184370 - RNA, 64 nt, Human; identical to SEQ ID NO: 25327

SEQ ID NO: 184371 - RNA, 64 nt, Human; identical to SEQ ID NO: 25328

SEQ ID NO: 184372 - RNA, 64 nt, Human; identical to SEQ ID NO: 25329

SEQ ID NO: 184373 - RNA, 64 nt, Human; identical to SEQ ID NO: 25330

SEQ ID NO: 184374 - RNA, 64 nt, Human; identical to SEQ ID NO: 25331

SEQ ID NO: 184375 - RNA, 64 nt, Human; identical to SEQ ID NO: 25332

SEQ ID NO: 184376 - RNA, 64 nt, Human; identical to SEQ ID NO: 25333

SEQ ID NO: 184377 - RNA, 64 nt, Human; identical to SEQ ID NO: 25334

SEQ ID NO: 184378 - RNA, 64 nt, Human; identical to SEQ ID NO: 25335

SEQ ID NO: 184379 - RNA, 64 nt, Human; identical to SEQ ID NO: 25336

SEQ ID NO: 184380 - RNA, 64 nt, Human; identical to SEQ ID NO: 25337

SEQ ID NO: 184381 - RNA, 64 nt, Human; identical to SEQ ID NO: 25338

SEQ ID NO: 184382 - RNA, 64 nt, Human; identical to SEQ ID NO: 25339

SEQ ID NO: 184383 - RNA, 64 nt, Human; identical to SEQ ID NO: 25340

SEQ ID NO: 184384 - RNA, 64 nt, Human; identical to SEQ ID NO: 25341

SEQ ID NO: 184385 - RNA, 64 nt, Human; identical to SEQ ID NO: 25342

SEQ ID NO: 184386 - RNA, 64 nt, Human; identical to SEQ ID NO: 25343

SEQ ID NO: 184387 - RNA, 64 nt, Human; identical to SEQ ID NO: 25344

SEQ ID NO: 184388 - RNA, 64 nt, Human; identical to SEQ ID NO: 25345

SEQ ID NO: 184389 - RNA, 64 nt, Human; identical to SEQ ID NO: 25346

SEQ ID NO: 184390 - RNA, 64 nt, Human; identical to SEQ ID NO: 25347

SEQ ID NO: 184391 - RNA, 64 nt, Human; identical to SEQ ID NO: 25348

SEQ ID NO: 184392 - RNA, 64 nt, Human; identical to SEQ ID NO: 25349

SEQ ID NO: 184393 - RNA, 64 nt, Human; identical to SEQ ID NO: 25350

SEQ ID NO: 184394 - RNA, 64 nt, Human; identical to SEQ ID NO: 25351

SEQ ID NO: 184395 - RNA, 64 nt, Human; identical to SEQ ID NO: 25352

SEQ ID NO: 184396 - RNA, 64 nt, Human; identical to SEQ ID NO: 25353

SEQ ID NO: 184397 - RNA, 64 nt, Human; identical to SEQ ID NO: 25354

SEQ ID NO: 184398 - RNA, 64 nt, Human; identical to SEQ ID NO: 25355

SEQ ID NO: 184399 - RNA, 64 nt, Human; identical to SEQ ID NO: 25356

SEQ ID NO: 184400 - RNA, 64 nt, Human; identical to SEQ ID NO: 25357

SEQ ID NO: 184401 - RNA, 64 nt, Human; identical to SEQ ID NO: 25358

SEQ ID NO: 184402 - RNA, 64 nt, Human; identical to SEQ ID NO: 25359

SEQ ID NO: 184403 - RNA, 64 nt, Human; identical to SEQ ID NO: 25360

SEQ ID NO: 184404 - RNA, 64 nt, Human; identical to SEQ ID NO: 25361

SEQ ID NO: 184405 - RNA, 64 nt, Human; identical to SEQ ID NO: 25362

SEQ ID NO: 184406 - RNA, 64 nt, Human; identical to SEQ ID NO: 25363

SEQ ID NO: 184407 - RNA, 64 nt, Human; identical to SEQ ID NO: 25364

SEQ ID NO: 184408 - RNA, 64 nt, Human; identical to SEQ ID NO: 25365

SEQ ID NO: 184409 - RNA, 64 nt, Human; identical to SEQ ID NO: 25366

SEQ ID NO: 184410 - RNA, 64 nt, Human; identical to SEQ ID NO: 25367

SEQ ID NO: 184411 - RNA, 64 nt, Human; identical to SEQ ID NO: 25368

SEQ ID NO: 184412 - RNA, 64 nt, Human; identical to SEQ ID NO: 25369

SEQ ID NO: 184413 - RNA, 64 nt, Human; identical to SEQ ID NO: 25370

SEQ ID NO: 184414 - RNA, 64 nt, Human; identical to SEQ ID NO: 25371

SEQ ID NO: 184415 - RNA, 64 nt, Human; identical to SEQ ID NO: 25372

SEQ ID NO: 184416 - RNA, 64 nt, Human; identical to SEQ ID NO: 25373

SEQ ID NO: 184417 - RNA, 64 nt, Human; identical to SEQ ID NO: 25374

SEQ ID NO: 184418 - RNA, 64 nt, Human; identical to SEQ ID NO: 25375

SEQ ID NO: 184419 - RNA, 64 nt, Human; identical to SEQ ID NO: 25376

SEQ ID NO: 184420 - RNA, 64 nt, Human; identical to SEQ ID NO: 25377

SEQ ID NO: 184421 - RNA, 64 nt, Human; identical to SEQ ID NO: 25378

SEQ ID NO: 184422 - RNA, 64 nt, Human; identical to SEQ ID NO: 25379

SEQ ID NO: 184423 - RNA, 64 nt, Human; identical to SEQ ID NO: 25380

SEQ ID NO: 184424 - RNA, 64 nt, Human; identical to SEQ ID NO: 25381

SEQ ID NO: 184425 - RNA, 64 nt, Human; identical to SEQ ID NO: 25382

SEQ ID NO: 184426 - RNA, 64 nt, Human; identical to SEQ ID NO: 25383

SEQ ID NO: 184427 - RNA, 64 nt, Human; identical to SEQ ID NO: 25384

SEQ ID NO: 184428 - RNA, 64 nt, Human; identical to SEQ ID NO: 25385

SEQ ID NO: 184429 - RNA, 64 nt, Human; identical to SEQ ID NO: 25386

SEQ ID NO: 184430 - RNA, 64 nt, Human; identical to SEQ ID NO: 25387

SEQ ID NO: 184431 - RNA, 64 nt, Human; identical to SEQ ID NO: 25388

SEQ ID NO: 184432 - RNA, 64 nt, Human; identical to SEQ ID NO: 25389

SEQ ID NO: 184433 - RNA, 64 nt, Human; identical to SEQ ID NO: 25390

SEQ ID NO: 184434 - RNA, 64 nt, Human; identical to SEQ ID NO: 25391

SEQ ID NO: 184435 - RNA, 64 nt, Human; identical to SEQ ID NO: 25392

SEQ ID NO: 184436 - RNA, 64 nt, Human; identical to SEQ ID NO: 25393

SEQ ID NO: 184437 - RNA, 64 nt, Human; identical to SEQ ID NO: 25394

SEQ ID NO: 184438 - RNA, 64 nt, Human; identical to SEQ ID NO: 25395

SEQ ID NO: 184439 - RNA, 64 nt, Human; identical to SEQ ID NO: 25396

SEQ ID NO: 184440 - RNA, 64 nt, Human; identical to SEQ ID NO: 25397

SEQ ID NO: 184441 - RNA, 64 nt, Human; identical to SEQ ID NO: 25398

SEQ ID NO: 184442 - RNA, 64 nt, Human; identical to SEQ ID NO: 25399

SEQ ID NO: 184443 - RNA, 64 nt, Human; identical to SEQ ID NO: 25400

SEQ ID NO: 184444 - RNA, 64 nt, Human; identical to SEQ ID NO: 25401

SEQ ID NO: 184445 - RNA, 64 nt, Human; identical to SEQ ID NO: 25402

SEQ ID NO: 184446 - RNA, 64 nt, Human; identical to SEQ ID NO: 25403

SEQ ID NO: 184447 - RNA, 64 nt, Human; identical to SEQ ID NO: 25404

SEQ ID NO: 184448 - RNA, 64 nt, Human; identical to SEQ ID NO: 25405

SEQ ID NO: 184449 - RNA, 64 nt, Human; identical to SEQ ID NO: 25406

SEQ ID NO: 184450 - RNA, 64 nt, Human; identical to SEQ ID NO: 25407

SEQ ID NO: 184451 - RNA, 64 nt, Human; identical to SEQ ID NO: 25408

SEQ ID NO: 184452 - RNA, 64 nt, Human; identical to SEQ ID NO: 25409

SEQ ID NO: 184453 - RNA, 64 nt, Human; identical to SEQ ID NO: 25410

SEQ ID NO: 184454 - RNA, 64 nt, Human; identical to SEQ ID NO: 25411

SEQ ID NO: 184455 - RNA, 64 nt, Human; identical to SEQ ID NO: 25412

SEQ ID NO: 184456 - RNA, 64 nt, Human; identical to SEQ ID NO: 25413

SEQ ID NO: 184457 - RNA, 64 nt, Human; identical to SEQ ID NO: 25414

SEQ ID NO: 184458 - RNA, 64 nt, Human; identical to SEQ ID NO: 25415

SEQ ID NO: 184459 - RNA, 64 nt, Human; identical to SEQ ID NO: 25416

SEQ ID NO: 184460 - RNA, 64 nt, Human; identical to SEQ ID NO: 25417

SEQ ID NO: 184461 - RNA, 64 nt, Human; identical to SEQ ID NO: 25418

SEQ ID NO: 184462 - RNA, 64 nt, Human; identical to SEQ ID NO: 25419

SEQ ID NO: 184463 - RNA, 64 nt, Human; identical to SEQ ID NO: 25420

SEQ ID NO: 184464 - RNA, 64 nt, Human; identical to SEQ ID NO: 25421

SEQ ID NO: 184465 - RNA, 64 nt, Human; identical to SEQ ID NO: 25422

SEQ ID NO: 184466 - RNA, 64 nt, Human; identical to SEQ ID NO: 25423

SEQ ID NO: 184467 - RNA, 64 nt, Human; identical to SEQ ID NO: 25424

SEQ ID NO: 184468 - RNA, 64 nt, Human; identical to SEQ ID NO: 25425

SEQ ID NO: 184469 - RNA, 64 nt, Human; identical to SEQ ID NO: 25426

SEQ ID NO: 184470 - RNA, 64 nt, Human; identical to SEQ ID NO: 25427

SEQ ID NO: 184471 - RNA, 64 nt, Human; identical to SEQ ID NO: 25428

SEQ ID NO: 184472 - RNA, 64 nt, Human; identical to SEQ ID NO: 25429

SEQ ID NO: 184473 - RNA, 64 nt, Human; identical to SEQ ID NO: 25430

SEQ ID NO: 184474 - RNA, 64 nt, Human; identical to SEQ ID NO: 25431

SEQ ID NO: 184475 - RNA, 64 nt, Human; identical to SEQ ID NO: 25432

SEQ ID NO: 184476 - RNA, 64 nt, Human; identical to SEQ ID NO: 25433

SEQ ID NO: 184477 - RNA, 64 nt, Human; identical to SEQ ID NO: 25434

SEQ ID NO: 184478 - RNA, 64 nt, Human; identical to SEQ ID NO: 25435

SEQ ID NO: 184479 - RNA, 64 nt, Human; identical to SEQ ID NO: 25436

SEQ ID NO: 184480 - RNA, 64 nt, Human; identical to SEQ ID NO: 25437

SEQ ID NO: 184481 - RNA, 64 nt, Human; identical to SEQ ID NO: 25438

SEQ ID NO: 184482 - RNA, 64 nt, Human; identical to SEQ ID NO: 25439

SEQ ID NO: 184483 - RNA, 64 nt, Human; identical to SEQ ID NO: 25440

SEQ ID NO: 184484 - RNA, 64 nt, Human; identical to SEQ ID NO: 25441

SEQ ID NO: 184485 - RNA, 64 nt, Human; identical to SEQ ID NO: 25442

SEQ ID NO: 184486 - RNA, 64 nt, Human; identical to SEQ ID NO: 25443

SEQ ID NO: 184487 - RNA, 64 nt, Human; identical to SEQ ID NO: 25444

SEQ ID NO: 184488 - RNA, 64 nt, Human; identical to SEQ ID NO: 25445

SEQ ID NO: 184489 - RNA, 64 nt, Human; identical to SEQ ID NO: 25446

SEQ ID NO: 184490 - RNA, 64 nt, Human; identical to SEQ ID NO: 25447

SEQ ID NO: 184491 - RNA, 64 nt, Human; identical to SEQ ID NO: 25448

SEQ ID NO: 184492 - RNA, 64 nt, Human; identical to SEQ ID NO: 25449

SEQ ID NO: 184493 - RNA, 64 nt, Human; identical to SEQ ID NO: 25450

SEQ ID NO: 184494 - RNA, 64 nt, Human; identical to SEQ ID NO: 25451

SEQ ID NO: 184495 - RNA, 64 nt, Human; identical to SEQ ID NO: 25452

SEQ ID NO: 184496 - RNA, 64 nt, Human; identical to SEQ ID NO: 25453

SEQ ID NO: 184497 - RNA, 64 nt, Human; identical to SEQ ID NO: 25454

SEQ ID NO: 184498 - RNA, 64 nt, Human; identical to SEQ ID NO: 25455

SEQ ID NO: 184499 - RNA, 64 nt, Human; identical to SEQ ID NO: 25456

SEQ ID NO: 184500 - RNA, 64 nt, Human; identical to SEQ ID NO: 25457

SEQ ID NO: 184501 - RNA, 64 nt, Human; identical to SEQ ID NO: 25458

SEQ ID NO: 184502 - RNA, 64 nt, Human; identical to SEQ ID NO: 25459

SEQ ID NO: 184503 - RNA, 64 nt, Human; identical to SEQ ID NO: 25460

SEQ ID NO: 184504 - RNA, 64 nt, Human; identical to SEQ ID NO: 25461

SEQ ID NO: 184505 - RNA, 64 nt, Human; identical to SEQ ID NO: 25462

SEQ ID NO: 184506 - RNA, 64 nt, Human; identical to SEQ ID NO: 25463

SEQ ID NO: 184507 - RNA, 64 nt, Human; identical to SEQ ID NO: 25464

SEQ ID NO: 184508 - RNA, 64 nt, Human; identical to SEQ ID NO: 25465

SEQ ID NO: 184509 - RNA, 64 nt, Human; identical to SEQ ID NO: 25466

SEQ ID NO: 184510 - RNA, 64 nt, Human; identical to SEQ ID NO: 25467

SEQ ID NO: 184511 - RNA, 64 nt, Human; identical to SEQ ID NO: 25468

SEQ ID NO: 184512 - RNA, 64 nt, Human; identical to SEQ ID NO: 25469

SEQ ID NO: 184513 - RNA, 64 nt, Human; identical to SEQ ID NO: 25470

SEQ ID NO: 184514 - RNA, 64 nt, Human; identical to SEQ ID NO: 25471

SEQ ID NO: 184515 - RNA, 64 nt, Human; identical to SEQ ID NO: 25472

SEQ ID NO: 184516 - RNA, 64 nt, Human; identical to SEQ ID NO: 25473

SEQ ID NO: 184517 - RNA, 64 nt, Human; identical to SEQ ID NO: 25474

SEQ ID NO: 184518 - RNA, 64 nt, Human; identical to SEQ ID NO: 25475

SEQ ID NO: 184519 - RNA, 64 nt, Human; identical to SEQ ID NO: 25476

SEQ ID NO: 184520 - RNA, 64 nt, Human; identical to SEQ ID NO: 25477

SEQ ID NO: 184521 - RNA, 64 nt, Human; identical to SEQ ID NO: 25478

SEQ ID NO: 184522 - RNA, 64 nt, Human; identical to SEQ ID NO: 25479

SEQ ID NO: 184523 - RNA, 64 nt, Human; identical to SEQ ID NO: 25480

SEQ ID NO: 184524 - RNA, 64 nt, Human; identical to SEQ ID NO: 25481

SEQ ID NO: 184525 - RNA, 64 nt, Human; identical to SEQ ID NO: 25482

SEQ ID NO: 184526 - RNA, 64 nt, Human; identical to SEQ ID NO: 25483

SEQ ID NO: 184527 - RNA, 64 nt, Human; identical to SEQ ID NO: 25484

SEQ ID NO: 184528 - RNA, 64 nt, Human; identical to SEQ ID NO: 25485

SEQ ID NO: 184529 - RNA, 64 nt, Human; identical to SEQ ID NO: 25486

SEQ ID NO: 184530 - RNA, 64 nt, Human; identical to SEQ ID NO: 25487

SEQ ID NO: 184531 - RNA, 64 nt, Human; identical to SEQ ID NO: 25488

SEQ ID NO: 184532 - RNA, 64 nt, Human; identical to SEQ ID NO: 25489

SEQ ID NO: 184533 - RNA, 64 nt, Human; identical to SEQ ID NO: 25490

SEQ ID NO: 184534 - RNA, 64 nt, Human; identical to SEQ ID NO: 25491

SEQ ID NO: 184535 - RNA, 64 nt, Human; identical to SEQ ID NO: 25492

SEQ ID NO: 184536 - RNA, 64 nt, Human; identical to SEQ ID NO: 25493

SEQ ID NO: 184537 - RNA, 64 nt, Human; identical to SEQ ID NO: 25494

SEQ ID NO: 184538 - RNA, 64 nt, Human; identical to SEQ ID NO: 25495

SEQ ID NO: 184539 - RNA, 64 nt, Human; identical to SEQ ID NO: 25496

SEQ ID NO: 184540 - RNA, 64 nt, Human; identical to SEQ ID NO: 25497

SEQ ID NO: 184541 - RNA, 64 nt, Human; identical to SEQ ID NO: 25498

SEQ ID NO: 184542 - RNA, 64 nt, Human; identical to SEQ ID NO: 25499

SEQ ID NO: 184543 - RNA, 64 nt, Human; identical to SEQ ID NO: 25500

SEQ ID NO: 184544 - RNA, 64 nt, Human; identical to SEQ ID NO: 25501

SEQ ID NO: 184545 - RNA, 64 nt, Human; identical to SEQ ID NO: 25502

SEQ ID NO: 184546 - RNA, 64 nt, Human; identical to SEQ ID NO: 25503

SEQ ID NO: 184547 - RNA, 64 nt, Human; identical to SEQ ID NO: 25504

SEQ ID NO: 184548 - RNA, 64 nt, Human; identical to SEQ ID NO: 25505

SEQ ID NO: 184549 - RNA, 64 nt, Human; identical to SEQ ID NO: 25506

SEQ ID NO: 184550 - RNA, 64 nt, Human; identical to SEQ ID NO: 25507

SEQ ID NO: 184551 - RNA, 64 nt, Human; identical to SEQ ID NO: 25508

SEQ ID NO: 184552 - RNA, 64 nt, Human; identical to SEQ ID NO: 25466

SEQ ID NO: 184553 - RNA, 64 nt, Human; identical to SEQ ID NO: 25510

SEQ ID NO: 184554 - RNA, 63 nt, Human; identical to SEQ ID NO: 98267

SEQ ID NO: 184555 - RNA, 63 nt, Human; identical to SEQ ID NO: 98268

SEQ ID NO: 184556 - RNA, 63 nt, Human; identical to SEQ ID NO: 98269

SEQ ID NO: 184557 - RNA, 63 nt, Human; identical to SEQ ID NO: 98270

SEQ ID NO: 184558 - RNA, 63 nt, Human; identical to SEQ ID NO: 98271

SEQ ID NO: 184559 - RNA, 63 nt, Human; identical to SEQ ID NO: 98272

SEQ ID NO: 184560 - RNA, 63 nt, Human; identical to SEQ ID NO: 98273

SEQ ID NO: 184561 - RNA, 63 nt, Human; identical to SEQ ID NO: 98274

SEQ ID NO: 184562 - RNA, 63 nt, Human; identical to SEQ ID NO: 98275

SEQ ID NO: 184563 - RNA, 63 nt, Human; identical to SEQ ID NO: 98276

SEQ ID NO: 184564 - RNA, 63 nt, Human; identical to SEQ ID NO: 98277

SEQ ID NO: 184565 - RNA, 63 nt, Human; identical to SEQ ID NO: 98278

SEQ ID NO: 184566 - RNA, 63 nt, Human; identical to SEQ ID NO: 98279

SEQ ID NO: 184567 - RNA, 63 nt, Human; identical to SEQ ID NO: 98280

SEQ ID NO: 184568 - RNA, 63 nt, Human; identical to SEQ ID NO: 98281

SEQ ID NO: 184569 - RNA, 63 nt, Human; identical to SEQ ID NO: 98282

SEQ ID NO: 184570 - RNA, 63 nt, Human; identical to SEQ ID NO: 98283

SEQ ID NO: 184571 - RNA, 63 nt, Human; identical to SEQ ID NO: 98284

SEQ ID NO: 184572 - RNA, 63 nt, Human; identical to SEQ ID NO: 98285

SEQ ID NO: 184573 - RNA, 63 nt, Human; identical to SEQ ID NO: 98286

SEQ ID NO: 184574 - RNA, 63 nt, Human; identical to SEQ ID NO: 98287

SEQ ID NO: 184575 - RNA, 63 nt, Human; identical to SEQ ID NO: 98288

SEQ ID NO: 184576 - RNA, 63 nt, Human; identical to SEQ ID NO: 98289

SEQ ID NO: 184577 - RNA, 63 nt, Human; identical to SEQ ID NO: 98290

SEQ ID NO: 184578 - RNA, 63 nt, Human; identical to SEQ ID NO: 98291

SEQ ID NO: 184579 - RNA, 63 nt, Human; identical to SEQ ID NO: 98292

SEQ ID NO: 184580 - RNA, 63 nt, Human; identical to SEQ ID NO: 98293

SEQ ID NO: 184581 - RNA, 63 nt, Human; identical to SEQ ID NO: 98294

SEQ ID NO: 184582 - RNA, 63 nt, Human; identical to SEQ ID NO: 98295

SEQ ID NO: 184583 - RNA, 63 nt, Human; identical to SEQ ID NO: 98296

SEQ ID NO: 184584 - RNA, 63 nt, Human; identical to SEQ ID NO: 98297

SEQ ID NO: 184585 - RNA, 63 nt, Human; identical to SEQ ID NO: 98298

SEQ ID NO: 184586 - RNA, 63 nt, Human; identical to SEQ ID NO: 98299

SEQ ID NO: 184587 - RNA, 62 nt, Human; identical to SEQ ID NO: 98132

SEQ ID NO: 184588 - RNA, 63 nt, Human; identical to SEQ ID NO: 98301

SEQ ID NO: 184589 - RNA, 63 nt, Human; identical to SEQ ID NO: 98302

SEQ ID NO: 184590 - RNA, 63 nt, Human; identical to SEQ ID NO: 98303

SEQ ID NO: 184591 - RNA, 63 nt, Human; identical to SEQ ID NO: 98304

SEQ ID NO: 184592 - RNA, 63 nt, Human; identical to SEQ ID NO: 98305

SEQ ID NO: 184593 - RNA, 63 nt, Human; identical to SEQ ID NO: 98306

SEQ ID NO: 184594 - RNA, 63 nt, Human; identical to SEQ ID NO: 98307

SEQ ID NO: 184595 - RNA, 63 nt, Human; identical to SEQ ID NO: 98308

SEQ ID NO: 184596 - RNA, 63 nt, Human; identical to SEQ ID NO: 98309

SEQ ID NO: 184597 - RNA, 63 nt, Human; identical to SEQ ID NO: 98310

SEQ ID NO: 184598 - RNA, 63 nt, Human; identical to SEQ ID NO: 98311

SEQ ID NO: 184599 - RNA, 63 nt, Human; identical to SEQ ID NO: 98312

SEQ ID NO: 184600 - RNA, 63 nt, Human; identical to SEQ ID NO: 98313

SEQ ID NO: 184601 - RNA, 63 nt, Human; identical to SEQ ID NO: 98314

SEQ ID NO: 184602 - RNA, 63 nt, Human; identical to SEQ ID NO: 98315

SEQ ID NO: 184603 - RNA, 63 nt, Human; identical to SEQ ID NO: 98316

SEQ ID NO: 184604 - RNA, 63 nt, Human; identical to SEQ ID NO: 98317

SEQ ID NO: 184605 - RNA, 63 nt, Human; identical to SEQ ID NO: 98318

SEQ ID NO: 184606 - RNA, 63 nt, Human; identical to SEQ ID NO: 98319

SEQ ID NO: 184607 - RNA, 63 nt, Human; identical to SEQ ID NO: 98320

SEQ ID NO: 184608 - RNA, 63 nt, Human; identical to SEQ ID NO: 98321

SEQ ID NO: 184609 - RNA, 63 nt, Human; identical to SEQ ID NO: 98322

SEQ ID NO: 184610 - RNA, 63 nt, Human; identical to SEQ ID NO: 98323

SEQ ID NO: 184611 - RNA, 63 nt, Human; identical to SEQ ID NO: 98324

SEQ ID NO: 184612 - RNA, 63 nt, Human; identical to SEQ ID NO: 98325

SEQ ID NO: 184613 - RNA, 63 nt, Human; identical to SEQ ID NO: 98326

SEQ ID NO: 184614 - RNA, 63 nt, Human; identical to SEQ ID NO: 98327

SEQ ID NO: 184615 - RNA, 63 nt, Human; identical to SEQ ID NO: 98328

SEQ ID NO: 184616 - RNA, 63 nt, Human; identical to SEQ ID NO: 98329

SEQ ID NO: 184617 - RNA, 63 nt, Human; identical to SEQ ID NO: 98330

SEQ ID NO: 184618 - RNA, 63 nt, Human; identical to SEQ ID NO: 98331

SEQ ID NO: 184619 - RNA, 63 nt, Human; identical to SEQ ID NO: 98332

SEQ ID NO: 184620 - RNA, 63 nt, Human; identical to SEQ ID NO: 98333

SEQ ID NO: 184621 - RNA, 63 nt, Human; identical to SEQ ID NO: 98334

SEQ ID NO: 184622 - RNA, 63 nt, Human; identical to SEQ ID NO: 98335

SEQ ID NO: 184623 - RNA, 63 nt, Human; identical to SEQ ID NO: 98336

SEQ ID NO: 184624 - RNA, 63 nt, Human; identical to SEQ ID NO: 98337

SEQ ID NO: 184625 - RNA, 63 nt, Human; identical to SEQ ID NO: 98338

SEQ ID NO: 184626 - RNA, 63 nt, Human; identical to SEQ ID NO: 98339

SEQ ID NO: 184627 - RNA, 63 nt, Human; identical to SEQ ID NO: 98340

SEQ ID NO: 184628 - RNA, 63 nt, Human; identical to SEQ ID NO: 98341

SEQ ID NO: 184629 - RNA, 53 nt, Human; identical to SEQ ID NO: 98174

SEQ ID NO: 184630 - RNA, 63 nt, Human; identical to SEQ ID NO: 98343

SEQ ID NO: 184631 - RNA, 63 nt, Human; identical to SEQ ID NO: 98344

SEQ ID NO: 184632 - RNA, 63 nt, Human; identical to SEQ ID NO: 98345

SEQ ID NO: 184633 - RNA, 63 nt, Human; identical to SEQ ID NO: 98346

SEQ ID NO: 184634 - RNA, 63 nt, Human; identical to SEQ ID NO: 98347

SEQ ID NO: 184635 - RNA, 63 nt, Human; identical to SEQ ID NO: 98348

SEQ ID NO: 184636 - RNA, 63 nt, Human; identical to SEQ ID NO: 98349

SEQ ID NO: 184637 - RNA, 63 nt, Human; identical to SEQ ID NO: 98350

SEQ ID NO: 184638 - RNA, 63 nt, Human; identical to SEQ ID NO: 98351

SEQ ID NO: 184639 - RNA, 63 nt, Human; identical to SEQ ID NO: 98352

SEQ ID NO: 184640 - RNA, 63 nt, Human; identical to SEQ ID NO: 98353

SEQ ID NO: 184641 - RNA, 63 nt, Human; identical to SEQ ID NO: 98354

SEQ ID NO: 184642 - RNA, 63 nt, Human; identical to SEQ ID NO: 98355

SEQ ID NO: 184643 - RNA, 63 nt, Human; identical to SEQ ID NO: 98356

SEQ ID NO: 184644 - RNA, 63 nt, Human; identical to SEQ ID NO: 98357

SEQ ID NO: 184645 - RNA, 63 nt, Human; identical to SEQ ID NO: 98358

SEQ ID NO: 184646 - RNA, 63 nt, Human; identical to SEQ ID NO: 98359

SEQ ID NO: 184647 - RNA, 63 nt, Human; identical to SEQ ID NO: 98360

SEQ ID NO: 184648 - RNA, 63 nt, Human; identical to SEQ ID NO: 98361

SEQ ID NO: 184649 - RNA, 63 nt, Human; identical to SEQ ID NO: 98362

SEQ ID NO: 184650 - RNA, 63 nt, Human; identical to SEQ ID NO: 98363

SEQ ID NO: 184651 - RNA, 63 nt, Human; identical to SEQ ID NO: 98364

SEQ ID NO: 184652 - RNA, 63 nt, Human; identical to SEQ ID NO: 98365

SEQ ID NO: 184653 - RNA, 63 nt, Human; identical to SEQ ID NO: 98366

SEQ ID NO: 184654 - RNA, 63 nt, Human; identical to SEQ ID NO: 98367

SEQ ID NO: 184655 - RNA, 63 nt, Human; identical to SEQ ID NO: 98368

SEQ ID NO: 184656 - RNA, 63 nt, Human; identical to SEQ ID NO: 98369

SEQ ID NO: 184657 - RNA, 63 nt, Human; identical to SEQ ID NO: 98370

SEQ ID NO: 184658 - RNA, 63 nt, Human; identical to SEQ ID NO: 98371

SEQ ID NO: 184659 - RNA, 63 nt, Human; identical to SEQ ID NO: 98372

SEQ ID NO: 184660 - RNA, 63 nt, Human; identical to SEQ ID NO: 98373

SEQ ID NO: 184661 - RNA, 63 nt, Human; identical to SEQ ID NO: 98374

SEQ ID NO: 184662 - RNA, 63 nt, Human; identical to SEQ ID NO: 98375

SEQ ID NO: 184663 - RNA, 63 nt, Human; identical to SEQ ID NO: 98376

SEQ ID NO: 184664 - RNA, 63 nt, Human; identical to SEQ ID NO: 98377

SEQ ID NO: 184665 - RNA, 63 nt, Human; identical to SEQ ID NO: 98378

SEQ ID NO: 184666 - RNA, 63 nt, Human; identical to SEQ ID NO: 98379

SEQ ID NO: 184667 - RNA, 63 nt, Human; identical to SEQ ID NO: 98380

SEQ ID NO: 184668 - RNA, 63 nt, Human; identical to SEQ ID NO: 98381

SEQ ID NO: 184669 - RNA, 63 nt, Human; identical to SEQ ID NO: 98382

SEQ ID NO: 184670 - RNA, 63 nt, Human; identical to SEQ ID NO: 98383

SEQ ID NO: 184671 - RNA, 63 nt, Human; identical to SEQ ID NO: 98384

SEQ ID NO: 184672 - RNA, 63 nt, Human; identical to SEQ ID NO: 98385

SEQ ID NO: 184673 - RNA, 63 nt, Human; identical to SEQ ID NO: 98386

SEQ ID NO: 184674 - RNA, 63 nt, Human; identical to SEQ ID NO: 98387

SEQ ID NO: 184675 - RNA, 63 nt, Human; identical to SEQ ID NO: 98388

SEQ ID NO: 184676 - RNA, 63 nt, Human; identical to SEQ ID NO: 98389

SEQ ID NO: 184677 - RNA, 63 nt, Human; identical to SEQ ID NO: 98390

SEQ ID NO: 184678 - RNA, 63 nt, Human; identical to SEQ ID NO: 98391

SEQ ID NO: 184679 - RNA, 63 nt, Human; identical to SEQ ID NO: 98392

SEQ ID NO: 184680 - RNA, 63 nt, Human; identical to SEQ ID NO: 98393

SEQ ID NO: 184681 - RNA, 63 nt, Human; identical to SEQ ID NO: 98394

SEQ ID NO: 184682 - RNA, 63 nt, Human; identical to SEQ ID NO: 98395

SEQ ID NO: 184683 - RNA, 63 nt, Human; identical to SEQ ID NO: 98396

SEQ ID NO: 184684 - RNA, 63 nt, Human; identical to SEQ ID NO: 98397

SEQ ID NO: 184685 - RNA, 63 nt, Human; identical to SEQ ID NO: 98398

SEQ ID NO: 184686 - RNA, 63 nt, Human; identical to SEQ ID NO: 98399

SEQ ID NO: 184687 - RNA, 63 nt, Human; identical to SEQ ID NO: 98400

SEQ ID NO: 184688 - RNA, 63 nt, Human; identical to SEQ ID NO: 98401

SEQ ID NO: 184689 - RNA, 63 nt, Human; identical to SEQ ID NO: 98402

SEQ ID NO: 184690 - RNA, 63 nt, Human; identical to SEQ ID NO: 98403

SEQ ID NO: 184691 - RNA, 63 nt, Human; identical to SEQ ID NO: 98404

SEQ ID NO: 184692 - RNA, 63 nt, Human; identical to SEQ ID NO: 98405

SEQ ID NO: 184693 - RNA, 63 nt, Human; identical to SEQ ID NO: 98406

SEQ ID NO: 184694 - RNA, 63 nt, Human; identical to SEQ ID NO: 98407

SEQ ID NO: 184695 - RNA, 63 nt, Human; identical to SEQ ID NO: 98408

SEQ ID NO: 184696 - RNA, 63 nt, Human; identical to SEQ ID NO: 98409

SEQ ID NO: 184697 - RNA, 63 nt, Human; identical to SEQ ID NO: 98410

SEQ ID NO: 184698 - RNA, 63 nt, Human; identical to SEQ ID NO: 98411

SEQ ID NO: 184699 - RNA, 63 nt, Human; identical to SEQ ID NO: 98412

SEQ ID NO: 184700 - RNA, 63 nt, Human; identical to SEQ ID NO: 98413

SEQ ID NO: 184701 - RNA, 63 nt, Human; identical to SEQ ID NO: 98414

SEQ ID NO: 184702 - RNA, 63 nt, Human; identical to SEQ ID NO: 98415

SEQ ID NO: 184703 - RNA, 63 nt, Human; identical to SEQ ID NO: 98416

SEQ ID NO: 184704 - RNA, 63 nt, Human; identical to SEQ ID NO: 98417

SEQ ID NO: 184705 - RNA, 63 nt, Human; identical to SEQ ID NO: 98418

SEQ ID NO: 184706 - RNA, 63 nt, Human; identical to SEQ ID NO: 98419

SEQ ID NO: 184707 - RNA, 63 nt, Human; identical to SEQ ID NO: 98420

SEQ ID NO: 184708 - RNA, 63 nt, Human; identical to SEQ ID NO: 98421

SEQ ID NO: 184709 - RNA, 63 nt, Human; identical to SEQ ID NO: 98422

SEQ ID NO: 184710 - RNA, 63 nt, Human; identical to SEQ ID NO: 98423

SEQ ID NO: 184711 - RNA, 63 nt, Human; identical to SEQ ID NO: 98424

SEQ ID NO: 184712 - RNA, 63 nt, Human; identical to SEQ ID NO: 98425

SEQ ID NO: 184713 - RNA, 63 nt, Human; identical to SEQ ID NO: 98426

SEQ ID NO: 184714 - RNA, 63 nt, Human; identical to SEQ ID NO: 98427

SEQ ID NO: 184715 - RNA, 63 nt, Human; identical to SEQ ID NO: 98428

SEQ ID NO: 184716 - RNA, 63 nt, Human; identical to SEQ ID NO: 98429

SEQ ID NO: 184717 - RNA, 63 nt, Human; identical to SEQ ID NO: 98430

SEQ ID NO: 184718 - RNA, 63 nt, Human; identical to SEQ ID NO: 98431

SEQ ID NO: 184719 - RNA, 63 nt, Human; identical to SEQ ID NO: 98432

SEQ ID NO: 184720 - RNA, 63 nt, Human; identical to SEQ ID NO: 98433

SEQ ID NO: 184721 - RNA, 63 nt, Human; identical to SEQ ID NO: 98434

SEQ ID NO: 184722 - RNA, 64 nt, Human
uagccccugcgcugugugucuggagcgcgguccucggccuuauugaaaugguccaaguagacag

SEQ ID NO: 184723 - RNA, 64 nt, Human
agcagucagacgcccucugaggccacgccccgcccggccuuaccucggcuccgccuucagucgg

SEQ ID NO: 184724 - RNA, 64 nt, Human
agggcugcaugcuccuccccucccaccucacaggcggccuuaggcaagucauuuucugucauca

SEQ ID NO: 184725 - RNA, 64 nt, Human
aacaugaagcaagucuggcgugugggcugcgugccggccuuagugggacccgugggguuggagc

SEQ ID NO: 184726 - RNA, 64 nt, Human
aagugcugggauuacaggugugagccaccacacccggccuuaucuccuaacauuuugauagcac

SEQ ID NO: 184727 - RNA, 64 nt, Human
ccgcuuccggcccaacccccugaacaaucccagacggccuuacuacugaguguucuggaaauac

SEQ ID NO: 184728 - RNA, 64 nt, Human
caguuagagaagaggaguggugauaaagcccacugaccuucacacauucuaaaaauugguuggc

SEQ ID NO: 184729 - RNA, 64 nt, Human
ccuggacuuuggacccuuggccuaggagccuaaggaccuucaccccugugcaccacccaagaaa

SEQ ID NO: 184730 - RNA, 64 nt, Human
uaacuugcaccuuugagguucuuuucuacaugaugaccuucagcuccugcugcuagucuccaau

SEQ ID NO: 184731 - RNA, 64 nt, Human
gggaauuccgcuggcauuagggaauuccgcuggcauuagggaauuccgcuggcauuagggaauu

SEQ ID NO: 184732 - RNA, 64 nt, Human; identical to SEQ ID NO: 184731

SEQ ID NO: 184733 - RNA, 64 nt, Human; identical to SEQ ID NO: 184731

SEQ ID NO: 184734 - RNA, 64 nt, Human
cagacccccgcuggcauuagggaauuccgcuggcauuagggaauuccgcuggcauuagggaauu

SEQ ID NO: 184735 - RNA, 64 nt, Human
cuaagcagcugagaccuuucagacccccgcuggcauuagggaauuccgcuggcauuagggaauu

SEQ ID NO: 184736 - RNA, 64 nt, Human
ccagaagauggugcuggguaauaaaaucaucacaauuagggaaugguuaguggucucuacugug

SEQ ID NO: 184737 - RNA, 64 nt, Human
ccuguuucuggcaaagagucaggaagguuacugaauuagggaacauuuucugcaccuucugauu

SEQ ID NO: 184738 - RNA, 64 nt, Human
ucuuucuucacuuugcacacauuugcauccacauauuagggaagaggaauccauaaguagcuga

SEQ ID NO: 184739 - RNA, 64 nt, Human
uuauaugagucaagauccugccuaaccugaaauuauuagggauuuacucagcccugcugccgcu

SEQ ID NO: 184740 - RNA, 64 nt, Human
gauaucaccccuucccccauccaagcauccuucgauuagggaaguggagagcacaucccuguaa

SEQ ID NO: 184741 - RNA, 64 nt, Human
guaguuuuuguaguuuuauauuggauacugaggcauuagggaggcaugaaaggaagaggaauga

SEQ ID NO: 184742 - RNA, 64 nt, Human
uguagaauaaaugguuucucauuaaacucuaaagauuagggaaaauggauauagaaaaucuuag

SEQ ID NO: 184743 - RNA, 64 nt, Human
uagggaggucacucccucuacucacugagcuaggauuagggaggguuauugccccaaccauugc

SEQ ID NO: 184744 - RNA, 64 nt, Human
aaggauaaugcaaaaauuauguaauagauaccaaauuagggaaguuuggcaauuucaauggcau

SEQ ID NO: 184745 - RNA, 64 nt, Human
auccugacaugccauuucaaggacuugggaauagauuagggauauccguacuucauuacaguca

SEQ ID NO: 184746 - RNA, 64 nt, Human
ccuccccccucccaauucucugccccaggcuaauauuagggacuggggaggggaccaccagagg

SEQ ID NO: 184747 - RNA, 64 nt, Human
acuucuguugaaaccauucaaagcuaaagacauggaccuucagcaguguaagaagauauuguac

SEQ ID NO: 184748 - RNA, 64 nt, Human
cuaauauauuuacguugcauucagaaauacugaugaccuucauauacguagucuguauacucau

SEQ ID NO: 184749 - RNA, 64 nt, Human
uugagcuugagcucugacaggcaugggccucuccgaccuucaucacuauucuuaggauaaugcu

SEQ ID NO: 184750 - RNA, 64 nt, Human
accuggggccugggggaggcuauaggauauaagcauuagggacccugaggcuuuaagugguuuc

SEQ ID NO: 184751 - RNA, 64 nt, Human
guauaaucuagaugguaaaaaaugugaaauugggauuagggaccaaccaaaauauuucauuaau

SEQ ID NO: 184752 - RNA, 64 nt, Human
auuuacaguuacuuuaagaaaaugggcagucagaauuagggacuagaauguauaugagaaaccc

SEQ ID NO: 184753 - RNA, 64 nt, Human
gaauccuucaacaaaugugucauucaaaacaguaauuagggaaaucccacagaugaaaaaugcc

SEQ ID NO: 184754 - RNA, 64 nt, Human
aggaaaggcucgaaauacaagccauucuaaggaaauuagggagucaguugaaauucuauucuga

SEQ ID NO: 184755 - RNA, 64 nt, Human
uuuuuucaccuccuuauucuuagauuauuaauguauuagggaagaaugagacaauuuuguguag

SEQ ID NO: 184756 - RNA, 64 nt, Human
aaagcuuuuaauuugauagauuuaucaguauaaaauuagggaaaccacguguggggaaugaauc

SEQ ID NO: 184757 - RNA, 64 nt, Human
gugggggugugcccccuucaagccugugcaaugcauuagggaugccuccuuucccgcaggggau

SEQ ID NO: 184758 - RNA, 64 nt, Human
aauaucagaauugguagacauuucaaacugucacauuagggauacaaaaaugaacaggcuggga

SEQ ID NO: 184759 - RNA, 64 nt, Human
augccccacaagccgcaaaaaccagcaaguuuuuauuagggauuuucaaaaggggagggagugu

SEQ ID NO: 184760 - RNA, 64 nt, Human
aauaagcacguaacaaugcucgacaucuuuagucauuagggaaauacaaaucaaacucaagaca

SEQ ID NO: 184761 - RNA, 64 nt, Human
agccgcacacaggccuagagguaaccaauaaaguauuagggaaaggugugagucuguguuggug

SEQ ID NO: 184762 - RNA, 64 nt, Human
augggcugugcagaagggggcuguaucaacaucaauuagggaaccaaaguugcacuaucugggc

SEQ ID NO: 184763 - RNA, 64 nt, Human
uagaucugcugcucuuagguguggggcuguccacauuagggaacuugccucaaaaacaguccac

SEQ ID NO: 184764 - RNA, 64 nt, Human
caguguccuucucaguuauggaggacaucgucucauuagggaacuuuuacaguucaaauuaauu

SEQ ID NO: 184765 - RNA, 64 nt, Human
aauacaacagaaagaguuggaucuuauuuauuuaauuagggaguuaaaacaagaccaaaaagac

SEQ ID NO: 184766 - RNA, 64 nt, Human
aggagaaaaaauccuggaagguaacaaggcugaagaccuucaaauuuccuggcuuacugguuua

SEQ ID NO: 184767 - RNA, 64 nt, Human
cuuccagcgaacacacacagguguccugccguuggaccuucaccuccuagagauaaaccagccu

SEQ ID NO: 184768 - RNA, 64 nt, Human
gaaaagagaacauacagaaccuguccaucuuuaagaccuucauccauggaaucuacuauacagg

SEQ ID NO: 184769 - RNA, 64 nt, Human
uucguaaguuggcaguuuuagauagauaacauucuggugguagcuagggauuuaccuuuuguca

SEQ ID NO: 184770 - RNA, 64 nt, Human
cccaucucuacuaaaaacacaaauuagccaggcguggugguacaugccuguaaucccagcuacu

SEQ ID NO: 184771 - RNA, 64 nt, Human
acagcgucuuccuucuuuaucuauagcaacucauuggugguagccaucaagcacuucccaggau

SEQ ID NO: 184772 - RNA, 64 nt, Human
aaaaguguccccaaagacuacacuguuguugagguggugguagugcugguggguuuuuguuuaa

SEQ ID NO: 184773 - RNA, 64 nt, Human
ggaugaggucagaggccccaccugauuuuccugguggugguauccaaaaucuucaguaacuagg

SEQ ID NO: 184774 - RNA, 64 nt, Human
gugaacaggaggcaaagccacgcgugguuuguguuggugguauguuccacaaauggaagagauc

SEQ ID NO: 184775 - RNA, 64 nt, Human
aucucuuacccuugcccccuccacccggucuugguggugguauauuaaaaaaagaaagaaugaa

SEQ ID NO: 184776 - RNA, 64 nt, Human
aauggccuuaaaaauaaauguaauaaagucagaguggugguaugaaaacauuccuagugaucau

SEQ ID NO: 184777 - RNA, 64 nt, Human
ccuuuaugacugaaguucaaugacaguuuguguuuggugguaaaggauuuucuccauggccuga

SEQ ID NO: 184778 - RNA, 64 nt, Human
auugcccuggaguuccugccaugacauggaaaccuggugguauggaagcauguacucaaaauau

SEQ ID NO: 184779 - RNA, 64 nt, Human
ucaccacacagucccuuuggacaaaugcauuuaguggugguagaaaugauucaccagguccaau

SEQ ID NO: 184780 - RNA, 64 nt, Human
gcgaacauguaacaagaauccaaagaaaacaaaauggugguaucaugguaagcaguuugaauuu

SEQ ID NO: 184781 - RNA, 64 nt, Human
aaaguuuauggaaguuaaugcugucauaccccccuggugguaccuuaaagagauaaaaugcaga

SEQ ID NO: 184782 - RNA, 64 nt, Human
gaauagugaagggagcccuuuuaaaacaaggcuuuggugguaauccugugauuuuuuuuucucc

SEQ ID NO: 184783 - RNA, 64 nt, Human
acugagaccagccucucugggcgaugaaggacaauggugguagggccacuuagagagcaguagg

SEQ ID NO: 184784 - RNA, 64 nt, Human
uaagggagcuaaggaagcgcggcgcgcccccugguggugguaagccgccaacgcaccugggggc

SEQ ID NO: 184785 - RNA, 64 nt, Human
gccaaggggccagcugccccucauuuaucacucugaccuucacagggacagaucugauuuauuu

SEQ ID NO: 184786 - RNA, 64 nt, Human
cugcaaagcuugugcaggaccugggggccaggucgaccuucaaguggcuuuuggggccccaggu

SEQ ID NO: 184787 - RNA, 64 nt, Human
uguucagguuuggccaggucggcaucaauguaaggaccuucagagcaucccaggguuacagcaa

SEQ ID NO: 184788 - RNA, 64 nt, Human
gaccauuccuauauaauuccuggacuggugagauuggugguaggccugugaaauuugcccuagu

SEQ ID NO: 184789 - RNA, 64 nt, Human
cucaguuugguuuaaaaacuucuguacuggcaaauggugguauucagugugggauagugucaua

SEQ ID NO: 184790 - RNA, 64 nt, Human
acauggucauccccagggcuguauacauugauucuggugguagacugguagugagcagcaaaug

SEQ ID NO: 184791 - RNA, 64 nt, Human
auggagagauuccaugccaucuuuacuauguggauggugguaucagggaagagggcucacaaga

SEQ ID NO: 184792 - RNA, 64 nt, Human
uccaaauaaaauaugggcuuggggauggaauggguggugguaaguucacagaguguaguuagau

SEQ ID NO: 184793 - RNA, 64 nt, Human
cucucucuuucuuccccacacccaagaggaggauuggugguagggggcaggcagaggggguggg

SEQ ID NO: 184794 - RNA, 64 nt, Human
ucuggagaaagcucauggcuguguccacugcaauuggugguaacagugguagagucauguuugc

SEQ ID NO: 184795 - RNA, 64 nt, Human
acucaguucugucacugucaaggaugcagagagcuggugguaggugggaagcaugguguccacc

SEQ ID NO: 184796 - RNA, 64 nt, Human
gcugaguagcuaccaucaucgcugguggggaaacuggugguaggggugugaggguagugggggu

SEQ ID NO: 184797 - RNA, 64 nt, Human
ucuauagauuauacauaacuacaucuauugcuuuuggugguaaaucaagauuuaguuguaauuu

SEQ ID NO: 184798 - RNA, 64 nt, Human
uuuucuagugauagaauguauuugucuuuuuuccuggugguacccucuuagcauauaucuuugc

SEQ ID NO: 184799 - RNA, 64 nt, Human
agaaucaaauucauaggauaagucaauaccuuaauggugguagagccuuuaccuguagcuugaa

SEQ ID NO: 184800 - RNA, 64 nt, Human
gacacgcaaguucagcuccagccgacuggggcauuggugguagccccuggagacauugugcaau

SEQ ID NO: 184801 - RNA, 64 nt, Human
uaaaaauacaaaaagaaaagaaaacagccaagcuuggugguaugugccuguggucccagcuacu

SEQ ID NO: 184802 - RNA, 64 nt, Human
cauuguacuaauaccgggaacaugaagccagguguggugguaugugccuguagucccaggcuga

SEQ ID NO: 184803 - RNA, 64 nt, Human
uucaaacagcaaacgcccacagauggcccagagguggugguagucaggguguguggguguuuuu

SEQ ID NO: 184804 - RNA, 64 nt, Human
cuccagccuccccuacccagggucucugcacagugaccuucacagcaguuguuggagugguuua

SEQ ID NO: 184805 - RNA, 64 nt, Human
ggaaaaauaaaaugggaacauggacaccauuucugaccuucaaauaaaacuuauuauguauugg

SEQ ID NO: 184806 - RNA, 64 nt, Human
ccucuuccacccaccccauucgguucuucugccugaccuucaaaugcccauguuggccuuuuac

SEQ ID NO: 184807 - RNA, 64 nt, Human
gggauggggaggggaagaguaaacagauaacagguggugguaccugguugggggaggggggcgu

SEQ ID NO: 184808 - RNA, 64 nt, Human
augccuugguguuccaauaagugaauggaagcaguggugguagcuacacugggcagaguuggca

SEQ ID NO: 184809 - RNA, 64 nt, Human
cauuaaagcuuugccucccauucugugguugugguggugguaagaaggagauauugguaccaag

SEQ ID NO: 184810 - RNA, 64 nt, Human
cccaccucucauagcagagccaaaccuuuaguguuggugguaggaggauggggagaggaaaaaa

SEQ ID NO: 184811 - RNA, 64 nt, Human
guuuaggaaggugaaauacauucacugucucuguuggugguacaucuuguugaauucaauauua

SEQ ID NO: 184812 - RNA, 64 nt, Human
ugcuuuagaugauugccucucaauaauugaaagguggugguaguuguauucuaaaugauguaga

SEQ ID NO: 184813 - RNA, 64 nt, Human
ggggaagaagcuguuacagaaguggaaugguuucuggugguauuucugaaguuagguaaagugc

SEQ ID NO: 184814 - RNA, 64 nt, Human
aguccuagaagccauaaaagagacacuuuccugcuggugguaucuauggaaaugaugaaguuac

SEQ ID NO: 184815 - RNA, 64 nt, Human
uuaaaccuaccaacaucuuaaauggacuuuccuguggugguacccuuuaagaggcggaugaaag

SEQ ID NO: 184816 - RNA, 64 nt, Human
agcccucagacguguucugcacaucccuucuuccuggugguaccaucccuauuuccuggagcac

SEQ ID NO: 184817 - RNA, 64 nt, Human
uuuggcuucugaaaggaaggccuagauccagcccuggugguaguuccuuucugaggucucucag

SEQ ID NO: 184818 - RNA, 64 nt, Human
uagugaugucugccauggaugcaguagaggaaaguggugguacaagugccaugauugauuagca

SEQ ID NO: 184819 - RNA, 64 nt, Human
uugaaagcuaagugagagagccagagggccuccuuggugguaaaagaggguugcauuucuugca

SEQ ID NO: 184820 - RNA, 64 nt, Human
cuugagcaucucuggggaagagcugucaaaagacuggugguaggcuggugaaaacuugacagcu

SEQ ID NO: 184821 - RNA, 64 nt, Human
gauuguaagagaaugagaaagaugaccaaaagguuggugguagggaggcuuuuucuuauuucca

SEQ ID NO: 184822 - RNA, 64 nt, Human
aaaugauuuuuuuuguacauuuuggcugcaguauuggugguagaauauacuauaauauggauca

SEQ ID NO: 184823 - RNA, 64 nt, Human
ggguccuccggacccgauccugcagcucuuucuggaccuucaggcacccccaagcgugcagcuc

SEQ ID NO: 184824 - RNA, 64 nt, Human
uuauuugguucuguuccugauaaacagaguaacugaccuucauuucuagguucuucaagaaugg

SEQ ID NO: 184825 - RNA, 64 nt, Human
auagggccugguuuacauucauuuaacucuuuaugaccuucacucagcuguggauuugggggca

SEQ ID NO: 184826 - RNA, 64 nt, Human
aagguuucuccccauacuggaaugaaugauuucuuggugguauuagcaucaucacagaccuaua

SEQ ID NO: 184827 - RNA, 64 nt, Human
ccagccaagucagcuguaucaggagccauccuccuggugguacccaaugucaugggaaugaugu

SEQ ID NO: 184828 - RNA, 64 nt, Human
uauauuccuuuaccucacaugaccccagcaacuguggugguaucuagaggugaaacaggcaagu

SEQ ID NO: 184829 - RNA, 64 nt, Human
gaucaaauaguggguauuauggaggagguugugauggugguaagccuucaaagaaagaaaggcc

SEQ ID NO: 184830 - RNA, 64 nt, Human
auaauaaaacaauugcagauugcuaaguagcuguuggugguacaaguuugauauuuagcuugag

SEQ ID NO: 184831 - RNA, 64 nt, Human
auauuuuugggucaguuuuuuuccuucauuaacuuggugguagaaaaaaauauauacuuagaaa

SEQ ID NO: 184832 - RNA, 64 nt, Human
aggugcauuuuucaacacuuacuuuugguuucaauggugguaguuguggacagccaucuucacu

SEQ ID NO: 184833 - RNA, 64 nt, Human
cgaugcguauucuguggccgccaucugcgcaggguggugguauucugucauuuacacacgucgu

SEQ ID NO: 184834 - RNA, 64 nt, Human
guaaacuaaauaaaaaaaaaaugauagugcauuuuggugguaauuuuaaaggucuugauuaggu

SEQ ID NO: 184835 - RNA, 64 nt, Human
acacuaccgaaugugucuuuagauagcccuguccuggugguauuuucaauagccacuaaccuug

SEQ ID NO: 184836 - RNA, 64 nt, Human
gaauauguagaauaacaugaaaaauuggaggugcuggugguauggcugacccuguuucagaagc

SEQ ID NO: 184837 - RNA, 64 nt, Human
uucaguuauuccagauuaucuagcuuauggauucuggugguagggguuguuugguuuugguuuu

SEQ ID NO: 184838 - RNA, 64 nt, Human
gugaaaagcuccaucaaugagguaucuucuuuaguggugguauguaauggaacuuagccauuuu

SEQ ID NO: 184839 - RNA, 59 nt, Human
acauuuacuacaaggucugagagggacccuggugguaccugugcuuucccagaggacac

SEQ ID NO: 184840 - RNA, 64 nt, Human
uacuaaaaauacaaaaacaaaaauuagccagggguggugguaugcaccugcagucccagcaaca

SEQ ID NO: 184841 - RNA, 64 nt, Human
gcuccuuacucugaggaaguugauucuuauuugauggugguauugugaccacugaauucacucc

SEQ ID NO: 184842 - RNA, 64 nt, Human; identical to SEQ ID NO: 143570

SEQ ID NO: 184843 - RNA, 64 nt, Human; identical to SEQ ID NO: 143571

SEQ ID NO: 184844 - RNA, 64 nt, Human; identical to SEQ ID NO: 143572

SEQ ID NO: 184845 - RNA, 64 nt, Human
gauuuauuuuguuauugaugauuuuuuuuuaaaguggugguauuaagggagaguuaucuacaug

SEQ ID NO: 184846 - RNA, 64 nt, Human
uaagaaauugguuauuaugcuuacuguucuaaucuggugguaaagguauucuuaagaauuugca

SEQ ID NO: 184847 - RNA, 64 nt, Human
auucuuucagauugcuuuggguaauaaauauugguggugguaucugacucaugcugcuguuuau

SEQ ID NO: 184848 - RNA, 64 nt, Human
cugucugccuguauuuucgggauucuuugacauuuggugguacuuuauucuugcugggcauacu

SEQ ID NO: 184849 - RNA, 64 nt, Human
cgucucuauuaaaaauacaaaaauuagcuggguguggugguaugugccuguagucucagcuacu

SEQ ID NO: 184850 - RNA, 64 nt, Human
acuguuuaauugacauacucaggauaacagagaauggugguauucagugguccaggauucugua

SEQ ID NO: 184851 - RNA, 64 nt, Human
uccacagaggcucucaccgccauugccaccaguauggugguauguacucacaaagauuaagaaa

SEQ ID NO: 184852 - RNA, 64 nt, Human
aaaaggaacaggguuuuccuagaggcaggcagccuggugguauggcacagcagaagcuuacugc

SEQ ID NO: 184853 - RNA, 64 nt, Human
ucaucuauacaagaauuuaaaaauaagcugggcguggugguacacaccuguggucccagcuacu

SEQ ID NO: 184854 - RNA, 64 nt, Human
gcugggggaugucaggugccacccaacgcuguccuggugguauuuacaaugacauccuccuccu

SEQ ID NO: 184855 - RNA, 64 nt, Human
cugucucuacuaaaaauacaaaauuagccagguguggugguacaugccuguaaucccagcuacu

SEQ ID NO: 184856 - RNA, 64 nt, Human
ccccuacccccuugucugcugcucccagccacguuggugguauuggccgaugagcugguuugac

SEQ ID NO: 184857 - RNA, 64 nt, Human
agaagcaccagcuguacuacuagaagggagcuuuuggugguagauccccuggugucuccaaccu

SEQ ID NO: 184858 - RNA, 64 nt, Human
caucucuaccaaaaauacaaaaauuaaccaugcguggugguacacgucugucaucccagcagcu

SEQ ID NO: 184859 - RNA, 64 nt, Human
cuucggugcuucuguuguuugaguuuacugugccuggugguauauugggcauucuuuggauuga

SEQ ID NO: 184860 - RNA, 64 nt, Human
caaaaugauggaaggccgaagagcaaggcuuauauggugguagggagcuuauagcuugugcuaa

SEQ ID NO: 184861 - RNA, 64 nt, Human
ugcuccuugugccacugcucccagugcugcugcugaccuucacugacagcuccuaguggaagcc

SEQ ID NO: 184862 - RNA, 64 nt, Human
ggccucucauccggcaccgggcccuggcugcagagaccuucagugccauccugacucuagaagg

SEQ ID NO: 184863 - RNA, 64 nt, Human
auauuuauuuacuucugucaacuauagaaagaaagaccuucagcuguauuuccacagauuucuc

SEQ ID NO: 184864 - RNA, 64 nt, Human
gagacauggcggaguguccaaauggauccuuuauuggugguagagcaaaaaaacccaaacacga

SEQ ID NO: 184865 - RNA, 64 nt, Human
ggacccaggaccccuggggccugggugcccugaguggugguaaaguggagcaaucccuucacgc

SEQ ID NO: 184866 - RNA, 64 nt, Human
caaaggaaaagccagaggaacaaucgccuccugguggugguacgagguagcgcaccguccggcu

SEQ ID NO: 184867 - RNA, 64 nt, Human
ccuuggcuuaaagcucuuauauaaucaauauuauuggugguaaauaccaaguuugguaucucau

SEQ ID NO: 184868 - RNA, 64 nt, Human
ugcucaggaguggugcccagaaaaggaaagggcuuggugguacaugaagugggggcagugggca

SEQ ID NO: 184869 - RNA, 64 nt, Human
aaagccugcaagcacauuuuguggaaagaggaguuggugguaucggugucgagggagaggaggg

SEQ ID NO: 184870 - RNA, 64 nt, Human
ggguauguuuucuugucacagugacugaguacgguggugguaguggugguacuacuacuacugg

SEQ ID NO: 184871 - RNA, 64 nt, Human
uucuugucacagugacugaguacgguggugguaguggugguacuacuacuacugguauuuaguc

SEQ ID NO: 184872 - RNA, 64 nt, Human
auucuaaguauucuucacggcagccagaaguuaauggugguagcagcugagguaugguuguugg

SEQ ID NO: 184873 - RNA, 64 nt, Human
cugcucaggccugucccuggcuucugggggcugcuggugguauuuucaguuccuuggugugugg

SEQ ID NO: 184874 - RNA, 64 nt, Human
gcccaugucaagccuuguucugcaccccaagcauuggugguaggacuggguccuggcugaucgu

SEQ ID NO: 184875 - RNA, 64 nt, Human
cuccuggaugaccaggcaccgcuguugagcagccuggugguacuggccacgccccucaaggcaa

SEQ ID NO: 184876 - RNA, 64 nt, Human
aacaucauaacccaugaaggauaaaagccccaaauggugguaacugauaauagcacuaaugcuu

SEQ ID NO: 184877 - RNA, 64 nt, Human
aaugcacaucuucaaguuuuuggcuaguccaugcuggugguaaacccuguaaaacuacugagag

SEQ ID NO: 184878 - RNA, 64 nt, Human
augucucuacaaaaaauagaaaaaguagcagguguggugguaugccccuguagucccagcuacu

SEQ ID NO: 184879 - RNA, 64 nt, Human
uucuaaguaaacauaacgaaauauuaauucuggguggugguaauauuuguguucauucuaucau

SEQ ID NO: 184880 - RNA, 64 nt, Human; identical to SEQ ID NO: 143576

SEQ ID NO: 184881 - RNA, 64 nt, Human; identical to SEQ ID NO: 143577

SEQ ID NO: 184882 - RNA, 64 nt, Human; identical to SEQ ID NO: 143578

SEQ ID NO: 184883 - RNA, 64 nt, Human
ccugucucuguggguuucuaagcucugggcaaaguggugguagggggagggagggggaaguuaa

SEQ ID NO: 184884 - RNA, 64 nt, Human
uucagccccugauguauuuguauugauuuguuucuggugguagcuuguccugaaauguguguag

SEQ ID NO: 184885 - RNA, 64 nt, Human
uugcagugacauaaaaggcaaagaggagcuggcauggugguacagaagguaucagucaagcgca

SEQ ID NO: 184886 - RNA, 64 nt, Human
aaaaaaaacaaaaacaaaaaacaacacuuugguguggugguaugguacguagcuauuuuccuaa

SEQ ID NO: 184887 - RNA, 64 nt, Human
ggcugaccuguaggauguaaccccuguguuucuuuggugguagcuuucuuuggaagagacaaac

SEQ ID NO: 184888 - RNA, 61 nt, Human
ucgcguuuugccagcgauaauacgccucagauggugguauuugcuaacaucauauccaacu

SEQ ID NO: 184889 - RNA, 64 nt, Human
ucuaccgaaaaauacaaaaaaaaauagcuggguguggugguacgugccuguagucccagcuacu

SEQ ID NO: 184890 - RNA, 64 nt, Human
cucucugagacccaaggcugcagucccucagugcuggugguaucguguggggauagcaauacuu

SEQ ID NO: 184891 - RNA, 64 nt, Human
auuacacacagacauggagguugggguaagaagauggugguaaauaugaagauaaguaaucuuu

SEQ ID NO: 184892 - RNA, 64 nt, Human
ccaggacccccaggugcuugacagagucaccccauggugguauggcugaacaaggagcggcaga

SEQ ID NO: 184893 - RNA, 64 nt, Human
uaccaacccaccauggagcaaagcugauuuuaaguggugguagagauacaguuucucuuuuaau

SEQ ID NO: 184894 - RNA, 64 nt, Human
uggaaaggggagcgaugagcuguggaggaagcccuggugguaccagaggccagaauggugggaa

SEQ ID NO: 184895 - RNA, 64 nt, Human
cacugucccggguggcgcgccccaccugccuggcuggugguaggccccugugagcuggucccgg

SEQ ID NO: 184896 - RNA, 64 nt, Human
gcccagaguguguguguucaacccccacaccagguggugguaggcggugugacugcacagcgag

SEQ ID NO: 184897 - RNA, 64 nt, Human
uaugaaaaaacuuuuuuaaaaauuuagcuggguguggugguacgugccuguaggccuagcuacu

SEQ ID NO: 184898 - RNA, 64 nt, Human
caggucaugccccucccugcagggaagggaaagcuggugguagaggcugggcacagacugacgu

SEQ ID NO: 184899 - RNA, 64 nt, Human
gcagagcugggguugaagaggcagcuugucccccgaccuucaggaauggcagccugcagcaacu

SEQ ID NO: 184900 - RNA, 64 nt, Human
uucuuguuuaaucugugcaaucagaaggugucuugaccuucaauucaauugguuucuuuuaaca

SEQ ID NO: 184901 - RNA, 64 nt, Human
caacuugcuucaucauaagaauaauuuauaacuugaccuucaaagagauuagagcauuuguuuc

SEQ ID NO: 184902 - RNA, 64 nt, Human
cacgcgaccuaucacagacaauggaauucgucaguggugguaagacugaaauccugaugcuuuu

SEQ ID NO: 184903 - RNA, 64 nt, Human
aguauuauuugggcucugggcagcagcagggaucuggugguaugugaggugcaugcgggcagug

SEQ ID NO: 184904 - RNA, 64 nt, Human
cuuuaaaauauacuuuaaaugauuauuaugauuuuggugguaacgaucccccacacacaaccac

SEQ ID NO: 184905 - RNA, 64 nt, Human
agauguuucuggcauuuucuuuuuauuuguaagguggugguaacuaugguuauuggcuagaaau

SEQ ID NO: 184906 - RNA, 64 nt, Human
uugucuguuuucaaccaaagaagucacguaccacuggugguacugugugccauaauuuggcaaa

SEQ ID NO: 184907 - RNA, 64 nt, Human
aaaaucaguucuuuccuugguuuuguguuaguguuggugguauuuuauuguuguuuuucugugu

SEQ ID NO: 184908 - RNA, 64 nt, Human
uauuuaugaagaaaauacuuaaauguuauguauauggugguaauaagggaaaaaucaaguauua

SEQ ID NO: 184909 - RNA, 64 nt, Human
ccuuguuuuaacuuagguauggguaaauuuacauuggugguauugcaggaauuuuucaaaaaca

SEQ ID NO: 184910 - RNA, 64 nt, Human
cauuuuuuuuuucaacaggugaaaaagcaggaaguggugguagagauggccucagagucuuuuc

SEQ ID NO: 184911 - RNA, 64 nt, Human
ggagauuacuacccaaauguguauuuuggcaauuuggugguauuuaggauguaauauguuuucc

SEQ ID NO: 184912 - RNA, 64 nt, Human
ucuuguuaauccuucuuuccuggauauauaaggcuggugguaacuuuugaauuauaugguugau

SEQ ID NO: 184913 - RNA, 64 nt, Human
agagggaagugauggaaaaagaauauagcagcuuauuagggacucccacccucuucaaguuaua

SEQ ID NO: 184914 - RNA, 64 nt, Human
uuacagcuuuacaauggggcuguugacagccauaauuagggaggcaugaauuaugcggcuauaa

SEQ ID NO: 184915 - RNA, 64 nt, Human
agucaaguucccuggguuguuccccucauaagguauuagggacuugugucacaucucucuggag

SEQ ID NO: 184916 - RNA, 64 nt, Human
guucuuugauuguuuauccaguccaaccugauccauuagggaucgaggugcuacacuggccucc

SEQ ID NO: 184917 - RNA, 64 nt, Human
cugauaccaaguaauucaagcuggcauuccuucuauuagggaaauucauuuuacccaauuugca

SEQ ID NO: 184918 - RNA, 64 nt, Human; identical to SEQ ID NO: 143582

SEQ ID NO: 184919 - RNA, 64 nt, Human; identical to SEQ ID NO: 143583

SEQ ID NO: 184920 - RNA, 64 nt, Human; identical to SEQ ID NO: 143584

SEQ ID NO: 184921 - RNA, 64 nt, Human
uugucaaagauggucuguagaaauguuuuuaaagauuagggaugcuguacuuuuugaauuguug

SEQ ID NO: 184922 - RNA, 64 nt, Human
aauacccauucaaauuguccuaggucuaucagaaauuagggaagguaguccugcuuuauaauag

SEQ ID NO: 184923 - RNA, 64 nt, Human
cagaaucuuagcacucuuuagcacaauauuuuguauuagggaacuuuuaauugacaugagaugc

SEQ ID NO: 184924 - RNA, 64 nt, Human
ggcagaggcuuucucugggugccaagccauauauauuagggaauaguagauuguuauuucguuu

SEQ ID NO: 184925 - RNA, 64 nt, Human
auuagccauaagaaacucaaaggaggaagacauaauuagggaaagaagucuauuugaugaauau

SEQ ID NO: 184926 - RNA, 64 nt, Human
ccacuguucuuaucucuauagugaugaaacauuaauuagggaucuugcugcuuuucuuuuucua

SEQ ID NO: 184927 - RNA, 64 nt, Human
caugugaccuccagcuuggugagguugccugaagauuagggaaaauaaaaauguccuucccauc

SEQ ID NO: 184928 - RNA, 64 nt, Human
acuagcuaagaaauuucuacauguuugccaguuaauuagggaguuauuugguaagcaaaucaau

SEQ ID NO: 184929 - RNA, 64 nt, Human
aacuuacuagaugaaauugacuggcuaaggaggcauuagggaucuauaucuuaggcaccuugca

SEQ ID NO: 184930 - RNA, 64 nt, Human
cagcugugcucccagggcucauguucucuacuggauuagggauaggcaccucugaaaucuccac

SEQ ID NO: 184931 - RNA, 64 nt, Human
gcacacaugcuucuguauuucacucuuucucccuauuagggaguuaugcaaaauuuguccccga

SEQ ID NO: 184932 - RNA, 64 nt, Human
ucugauuuuuuuuuucuucuggaaaccaaguagaauuagggaugggaauacaaaugcauuuauu

SEQ ID NO: 184933 - RNA, 64 nt, Human
uaaugcauuuuauuuauaaaaauacagacagaaaauuagggagaaaccucuaguuuugccaaua

SEQ ID NO: 184934 - RNA, 64 nt, Human
ccuaacuuuagaaauguuguacuuggcuauuuugauuagggaagagggauguggucucugaucu

SEQ ID NO: 184935 - RNA, 64 nt, Human
ugaucaaaccaaaggaaaaguguugcuagagaaaauuagggaaaaggugaaaaagaaaaaaugg

SEQ ID NO: 184936 - RNA, 64 nt, Human
uuggcucccauuaaaaaucaacaacauucuaaugauuagggaacaacagaaggggaacagucau

SEQ ID NO: 184937 - RNA, 55 nt, Human
ucaugaaggguguggaguagaugcugaccuucacccagagcugccuaugcccagc

SEQ ID NO: 184938 - RNA, 64 nt, Human
ccauuuuagcuaugugguaccaagauuagcaaaugaccuucauauccacugauuuccugauguc

SEQ ID NO: 184939 - RNA, 64 nt, Human
caguagaaagacacaggaugcacagaaugggcaugaccuucagcucacgagcacaccuggagaa

SEQ ID NO: 184940 - RNA, 64 nt, Human
aaauugaaguucugcagcaugucaggccaggauuauuagggagauuccucgaaacuagugugug

SEQ ID NO: 184941 - RNA, 64 nt, Human
ggaagaauuccccaccagaucuccuugaagcagaauuagggaucagcaucauuaacaccuuccc

SEQ ID NO: 184942 - RNA, 64 nt, Human
ggauaaaucaaggcucaaggcuuccccagcaaagauuagggaaagagacuugaccccaggacug

SEQ ID NO: 184943 - RNA, 64 nt, Human
ucaccuucuguguguugcaacagcuucuaagauaauuagggacaaaugauguuacaaaaggaag

SEQ ID NO: 184944 - RNA, 64 nt, Human
auacaauuuuuccuguaaacaauaccaauuuuuaauuagggagcauuuuccuucuagucuauuu

SEQ ID NO: 184945 - RNA, 64 nt, Human
uuaaugguauuucuuuuuuacacucuacaagugaauuagggagucucuuguugaccccuuuguu

SEQ ID NO: 184946 - RNA, 64 nt, Human
gugaugucacuagggcagggacaggauaagagggauuagggagagaagauagcagggcauggcu

SEQ ID NO: 184947 - RNA, 64 nt, Human
aucuaaaucugaugcuuauguaaggguugagcgaauuagggagauugcuaguggaaauuggagg

SEQ ID NO: 184948 - RNA, 64 nt, Human
ggaagggguuaagccagaagugcaaucaauaggaauuagggaauguuguauauuuauauaugua

SEQ ID NO: 184949 - RNA, 64 nt, Human
guuaacauuauuuaaagacugaaaauucauugcaauuagggaacgcacagccucacaaaaagug

SEQ ID NO: 184950 - RNA, 64 nt, Human
aauaagauaaacuuuuuugucuuugcuuuaucuuauuagggaguuguaugucaguguauaaaac

SEQ ID NO: 184951 - RNA, 64 nt, Human
caguguuaaguuuuuguuuacuuguucacaagccauuagggaaauuucaugggauaauuagcag

SEQ ID NO: 184952 - RNA, 64 nt, Human
gcaaaguaguaaaaugaccuuaaagauaaaaaugauuagggaauagccuuagaaaauuuauagg

SEQ ID NO: 184953 - RNA, 64 nt, Human
ccacaucugaccuggcagcccauguauuccggucauuagggaugggaagccaugaggaccuggc

SEQ ID NO: 184954 - RNA, 64 nt, Human
aguuugccauuggacagcuuucacaaguaacaggauuagggaaggacauaauguauuuaagaau

SEQ ID NO: 184955 - RNA, 64 nt, Human
gaauauguucuggcauuuaccugaccugccaaucauuagggagaggcaacaagguaauucagcc

SEQ ID NO: 184956 - RNA, 64 nt, Human; identical to SEQ ID NO: 143588

SEQ ID NO: 184957 - RNA, 64 nt, Human; identical to SEQ ID NO: 143589

SEQ ID NO: 184958 - RNA, 64 nt, Human; identical to SEQ ID NO: 143590

SEQ ID NO: 184959 - RNA, 64 nt, Human
uaagcacaugaaaaaauacucaacauuauuauucauuagggaaaugcaagucaaaaucacaaug

SEQ ID NO: 184960 - RNA, 64 nt, Human
ccugagugaauucgcaagcgcacuagcaugugauauuagggaguuugcaauaaauuauugaggc

SEQ ID NO: 184961 - RNA, 64 nt, Human
uauaaagugaauuugauugaaaaggcaaauagcuauuagggaagcaguuugccauuguugcaga

SEQ ID NO: 184962 - RNA, 64 nt, Human
ugccuugcaggaggcaagggaaaugggguuagacauuagggaggauuccccgcccggaguccua

SEQ ID NO: 184963 - RNA, 64 nt, Human
gguuggccuucuggucuaaagcuguguccugaauauuagggaucacaauucacugaaauacagc

SEQ ID NO: 184964 - RNA, 64 nt, Human
cauaaaugacuuggaguuuuauguucaugaaaaaauuagggauuauguuaagaguacuauuuuu

SEQ ID NO: 184965 - RNA, 52 nt, Human
aaacuguucagcaaagguagucauuagggagcaggcacuaccacuaagauau

SEQ ID NO: 184966 - RNA, 64 nt, Human
uauaugggaguccuuguuugugaauguuuccuggauuagggaggugucaacauaaauguauuau

SEQ ID NO: 184967 - RNA, 64 nt, Human
uagaauuugaauaaguacuccuaaagugaccauuauuagggaccagaaaauuauaucuuggcua

SEQ ID NO: 184968 - RNA, 64 nt, Human
uaauuuaaauuuggcuguucucuggagcuaaaccauuagggaaguucaaaggaaugugccauga

SEQ ID NO: 184969 - RNA, 64 nt, Human
uaggucucaaagacucuuggaucagaaucaggagauuagggaaaacaggauggauaccugagca

SEQ ID NO: 184970 - RNA, 64 nt, Human
aaacugcaggacaguuuaugaaauagguggcacuauuagggaaucuuccuuuaaagcaagaaau

SEQ ID NO: 184971 - RNA, 64 nt, Human
accauuagaaauauuucaugucaaggaggaaaacauuagggaaaacaaaaaugauauaaagcca

SEQ ID NO: 184972 - RNA, 64 nt, Human
ucuuuucagaguauuauaauaucuuuggaagaccauuagggaaaagaaauuccugcacaauggg

SEQ ID NO: 184973 - RNA, 64 nt, Human
guucaauacucuugaaauguagaauugaaaaugcauuagggaaaacuuaauaaaaauuauuacc

SEQ ID NO: 184974 - RNA, 64 nt, Human
aggggauaggccgaguuccggguguaagggggccauuagggagagcagagcgaggcagcugauc

SEQ ID NO: 184975 - RNA, 64 nt, Human
uagguggaucagugaaggcauaaugggcuguggagaccuucacuucuagauuauugauucaaaa

SEQ ID NO: 184976 - RNA, 64 nt, Human
ugagugaacuguauugauuuuucuaaucuuuagagaccuucacacagcaugagggcuguuggca

SEQ ID NO: 184977 - RNA, 64 nt, Human
gacuguucucccugacacugugagagugugcugggaccuucagcuaaaugugagggugggcccu

SEQ ID NO: 184978 - RNA, 64 nt, Human
aauuuugggcccaauuccccuaaaagaauugaggauuagggagaaaggagacaacucaaaguca

SEQ ID NO: 184979 - RNA, 64 nt, Human
gcugggccucccugguggcagggguggguggagaauuagggagagggugcaacgagucuggccc

SEQ ID NO: 184980 - RNA, 64 nt, Human
gguuguggcaguggagcuggggagauguggucggauuagggagguagaaucaauaagacucagu

SEQ ID NO: 184981 - RNA, 64 nt, Human
auaccagcucggcagaacaguuccccacccagcgauuagggagcugggcuggccaguacagcca

SEQ ID NO: 184982 - RNA, 64 nt, Human
uuguuuccugaauuauucgcauugguagaaauauauuagggaaagaaaguagccuucuuuuuau

SEQ ID NO: 184983 - RNA, 64 nt, Human
cucucuguaccuuccuacuggagcuugauguuauauuagggacugugguauaauuauuuuaaua

SEQ ID NO: 184984 - RNA, 64 nt, Human
uuccucucucucccaaggccugacaaugguaccuauuagggaugagauacagacaaggauagcu

SEQ ID NO: 184985 - RNA, 64 nt, Human
auugcuugaguuauauguucacugucccccuaauauuagggaguaaaacggauaccaaguugau

SEQ ID NO: 184986 - RNA, 64 nt, Human
gugugauuuuaguuccacaugaugacuugugaacauuagggauuuaaaggaaaaaaaaaaagaa

SEQ ID NO: 184987 - RNA, 64 nt, Human
auaggaaacuacuuggagcaaacucaaaggacagauuagggaucgagauugggucagguuagca

SEQ ID NO: 184988 - RNA, 64 nt, Human
aacaacaucaguuagaguuugagcauuauucagcauuagggaaaccacacacuggugagagguc

SEQ ID NO: 184989 - RNA, 64 nt, Human
uuuuagcucugaaggauuuaguagauucuguuagauuagggaggccuuacagacugacuuuacu

SEQ ID NO: 184990 - RNA, 64 nt, Human
acagaaaucuuuaugcaauuugugaauuuuguauauuagggaggaaaagcuuccuauauuuuua

SEQ ID NO: 184991 - RNA, 64 nt, Human
uaauguucauuaaagaguuuacaguaaaaauaagauuagggauaaacuucucaaaaauuguaca

SEQ ID NO: 184992 - RNA, 64 nt, Human
uuuuaucaguuuuagagaggcaagacaaguuugcauuagggaagaccgaaaacuaaauuuuguu

SEQ ID NO: 184993 - RNA, 64 nt, Human
ugcccuugagucaagcacugagauacguuacccaauuagggaaauaaauuuguuaauaaaauug

SEQ ID NO: 184994 - RNA, 64 nt, Human; identical to SEQ ID NO: 143564

SEQ ID NO: 184995 - RNA, 64 nt, Human; identical to SEQ ID NO: 143565

SEQ ID NO: 184996 - RNA, 64 nt, Human; identical to SEQ ID NO: 143566

SEQ ID NO: 184997 - RNA, 64 nt, Human
ccucuuucuccuaaaaaaaaaaaaaaaugagagaauuagggaaacaccaaaagcaaagagagca

SEQ ID NO: 184998 - RNA, 64 nt, Human
cucugccacccucuacagccuucaugccccaugcauuagggaauagaaagggaaagaaggugug

SEQ ID NO: 184999 - RNA, 64 nt, Human
uuccugagaaguucuccugccugcauaaccauucauuagggaguacuuuacaagcaugaaggau

SEQ ID NO: 185000 - RNA, 64 nt, Human
uugguuugagggucuguucaaaagcuuugggccaauuagggaguaaaaggagggaaggggccua

SEQ ID NO: 185001 - RNA, 64 nt, Human
agcagggacaugcugagaggacgaagccaaggaaauuagggaggagagucaaagggaucaagga

SEQ ID NO: 185002 - RNA, 64 nt, Human
acgcauucuucaagcagcaaaaguucccggaacaauuagggaagacguauggucugaauuuauc

SEQ ID NO: 185003 - RNA, 64 nt, Human
caccuggccuucccugcuuccucucuagaauccaauuagggauguuuguuacuacucauauuga

SEQ ID NO: 185004 - RNA, 64 nt, Human
cuugugauuuggugacucuucuaaaugcugauucauuagggauuauuacagcggaugucaacug

SEQ ID NO: 185005 - RNA, 64 nt, Human
uuuuggcaaguuugcauuuuaguauuaauuuauaauuagggauuguucaaacuucagaucuguu

SEQ ID NO: 185006 - RNA, 64 nt, Human
cuagacacuaauuuuauccuuugaggcuggcuuaauuagggaugcugucauuaaggagagggag

SEQ ID NO: 185007 - RNA, 64 nt, Human
uuuggagauuaagaacuuauuugaggauuuaagaauuagggaaauaauuugguggaaaccggga

SEQ ID NO: 185008 - RNA, 64 nt, Human
uuuugccaauagaccuagggaucuaagaaauagaauuagggagaguuuacacuuacuuaccuau

SEQ ID NO: 185009 - RNA, 64 nt, Human
ucuguaaaaugggcaugauuagagugcccaccgcauuagggauguuggggugagucagugugac

SEQ ID NO: 185010 - RNA, 64 nt, Human
ggagcacacacuggccauuacugaacacagccauauuagggaaagcaaaaaaacccaaaaaauc

SEQ ID NO: 185011 - RNA, 64 nt, Human
uuuggcucguaacucagaaagaaccaaagggcagauuagggacggggcaggagggauccuagga

SEQ ID NO: 185012 - RNA, 64 nt, Human
ucaaauguuuuuuucuuaugcgggucuuuuauauauuagggauccugagauacccgauucuaua

SEQ ID NO: 185013 - RNA, 64 nt, Human
cguguuggaaaaaagggguagugcauuuuaaauugaccuucauacgcuuuuaaaauaagacaaa

SEQ ID NO: 185014 - RNA, 64 nt, Human
ccuacagcuccagagacacagagaacaaaggggugaccuucauuuuucuucaagccggccucug

SEQ ID NO: 185015 - RNA, 64 nt, Human
gaucccucugggggcucuggccaagggccagacagaccuucacagaugccuacuuuuggccuca

SEQ ID NO: 185016 - RNA, 64 nt, Human
cagugcuuccuuggguugccagcugagucccgguauuagggaauaguuucagcucuuucaaagu

SEQ ID NO: 185017 - RNA, 64 nt, Human
uauuaguaguucuauaaagagaacugcuuuuaacauuagggacugggagcaguccaugggauaa

SEQ ID NO: 185018 - RNA, 64 nt, Human
uacagggggcucagugucauccacaacuuccuauauuagggauaaaacauauaggugcacaaga

SEQ ID NO: 185019 - RNA, 64 nt, Human
caaaccauaucacuggugaugccacuucuucaguauuagggauucucagucagaagagaccccc

SEQ ID NO: 185020 - RNA, 64 nt, Human
uuuguaaaauuuucaaaugucagucaaguuuugcauuagggacacauuuauauauagcaaaagc

SEQ ID NO: 185021 - RNA, 64 nt, Human
cccaagcccauccaugcacauuacuuagcuaacaauuagggagacucguaaggccaggcccugu

SEQ ID NO: 185022 - RNA, 64 nt, Human
uuauuuucacacucauauugcuuaaauauuacauauuagggauuguaagaaaacuuuaauuaaa

SEQ ID NO: 185023 - RNA, 64 nt, Human
gcauagaaguauuuugguauuuuaaggucucaugauuagggauuuguagccucagguuugaauc

SEQ ID NO: 185024 - RNA, 64 nt, Human
aucucacucuggcgcucuggagugcaguggugugauuagggaucauugcagacucugccucuca

SEQ ID NO: 185025 - RNA, 64 nt, Human
cuuuaguacuuuccguucaauuaaauaucaguauauuagggauuuuuuucuacagguguauauu

SEQ ID NO: 185026 - RNA, 64 nt, Human
ccugacagugugggacaggcucuucuuucccaaaauuagggagcucuugacagaaagcaguucu

SEQ ID NO: 185027 - RNA, 64 nt, Human
cccagcuauagugugggugcccuacugaacucugauuagggaaccuguauaaggguauugagug

SEQ ID NO: 185028 - RNA, 64 nt, Human
gauuacccccaaagauguucucagcuaagaauggauuagggauucuugcuucugucuguucuua

SEQ ID NO: 185029 - RNA, 64 nt, Human
uauuuuaaaagucguguuaauacucaugauaauuauuagggaccuggcagcgugauuggaguau

SEQ ID NO: 185030 - RNA, 64 nt, Human
gcacaauugauguguuuugauucccuaaaacaaaauuagggagucaaacguggaccugaaaguc

SEQ ID NO: 185031 - RNA, 64 nt, Human
uaaaacaagaugugccaauaucauagguaaauaaauuagggaaaaugugggacuuuauggcugu

SEQ ID NO: 185032 - RNA, 64 nt, Human; identical to SEQ ID NO: 143570

SEQ ID NO: 185033 - RNA, 64 nt, Human; identical to SEQ ID NO: 143571

SEQ ID NO: 185034 - RNA, 64 nt, Human; identical to SEQ ID NO: 143572

SEQ ID NO: 185035 - RNA, 64 nt, Human
ucagaacacagguguggccugaagguauucccuuauuagggaagugucacugcugucuucuagu

SEQ ID NO: 185036 - RNA, 64 nt, Human
gugcucagaaauuuucugaucucagagcauuucaauuagggaugcucaaacgcaacuguuucua

SEQ ID NO: 185037 - RNA, 64 nt, Human
aauauaagaauaaaaaggauuaugggaggggaacauuagggaaauccagagaaggcaaaauuga

SEQ ID NO: 185038 - RNA, 64 nt, Human
ccgugcucuuugggcuccccagagaccugacaguauuagggagugaagggaggaggggcccugg

SEQ ID NO: 185039 - RNA, 64 nt, Human
ccagaugagcucuucuuuccuacaaguuuucauaauuagggaaugccaggguuuaggguagggg

SEQ ID NO: 185040 - RNA, 64 nt, Human
cuaggcauguugccacauacuuguagucccaguuauuagggaagcugaggugggaggauagcuu

SEQ ID NO: 185041 - RNA, 64 nt, Human
aggagcccuuacuugguuuugaucaguguagcaaauuagggaugaagaguucaaaccuuuuggc

SEQ ID NO: 185042 - RNA, 64 nt, Human
cagacuuguuuugcuaucuuauaagcaguucagaauuagggaaugcugguuuugaagagcaaag

SEQ ID NO: 185043 - RNA, 64 nt, Human
gacagcuauucaccuuucacggugcuggggccagauuagggaucacucccgugaggagggccuu

SEQ ID NO: 185044 - RNA, 64 nt, Human
ggcuaccucauaauuuguaugggaaugaacaugaauuagggaacuucaaauagugcguagacuu

SEQ ID NO: 185045 - RNA, 64 nt, Human
augucaaguucuacaucaauaucaucccugucuuauuagggauuaccguuuccuaagccaagag

SEQ ID NO: 185046 - RNA, 64 nt, Human
ucuuugagauaauuaaacuaauuuuuucuuccccauuagggauuaugcugaauuuguaugguuu

SEQ ID NO: 185047 - RNA, 64 nt, Human
caaccuccaaaaucuacauuuacacaguagguaaauuagggaugacugcauuaucaaaauacuc

SEQ ID NO: 185048 - RNA, 64 nt, Human
ucacagaauccuuauuuuucuguucaaauuaggaauuagggacauggaugaaauuggaaaucuu

SEQ ID NO: 185049 - RNA, 64 nt, Human
aaguucuggaucuuggagcaguucagauuuucagauuagggaugcucaaaucuauauagauaua

SEQ ID NO: 185050 - RNA, 64 nt, Human
aauaauuuagaauggauauuuauuggaggugguaauuagggaagauguccuuuuaaacaguaga

SEQ ID NO: 185051 - RNA, 64 nt, Human
aaagaaaaacaaaagaccucuaaaacuucaacaagaccuucaagaucacagaaauuuuuaaaau

SEQ ID NO: 185052 - RNA, 64 nt, Human
aaugggaaaaguaucuaauauuuuguaacaaaaagaccuucauauuaucuguuuugaccaaaau

SEQ ID NO: 185053 - RNA, 64 nt, Human
gucugaacacuggccugugauugguccauuccaggaccuucauuugcauaagguaucaaaccac

SEQ ID NO: 185054 - RNA, 64 nt, Human
caagcaguauaaaauaccugugauuuuucuuuacauuagggauaaugcauaaggaauuaaucuu

SEQ ID NO: 185055 - RNA, 64 nt, Human
aaauaagguuggguuuucuaaaaaaauagucuauauuagggaacaacaacagcaaauuagacaa

SEQ ID NO: 185056 - RNA, 64 nt, Human
accagaagaaaagacuuaccugaauaauuacuacauuagggaagcuacugucuacguuaagaua

SEQ ID NO: 185057 - RNA, 64 nt, Human
uccccacccuuacucaucaccugcaguggccagaauuagggaaucagaaucaaaccaguguaag

SEQ ID NO: 185058 - RNA, 64 nt, Human
gacaaaacuaugguuucagucaacauauucaugaauuagggagcuaauggguuaagcuuccagu

SEQ ID NO: 185059 - RNA, 64 nt, Human
uuuauaauuugcccuugaauuggaaggaauggagauuagggaaggaaaacuacucuagaggcca

SEQ ID NO: 185060 - RNA, 64 nt, Human
uuguauuguguaacaaguacugcucccagcagcaauuagggagaaaacuagucuaaauuauuuc

SEQ ID NO: 185061 - RNA, 64 nt, Human
cuuuucuccuaugucuccuaggcuuuccaugauaauuagggagagaagacauauugacucugac

SEQ ID NO: 185062 - RNA, 64 nt, Human
agaaaaagaaaacaagagauauacauugugauauauuagggacacuuucacaguccuguccucu

SEQ ID NO: 185063 - RNA, 64 nt, Human
ugaaguaaacaaccguuuuuauuaacugcaucucauuagggaaaguuuauaugucuuguuauuu

SEQ ID NO: 185064 - RNA, 64 nt, Human
guuccagcaguuuucaagucaaauuaauaaucuuauuagggagaaaauucaauuguaaauugaa

SEQ ID NO: 185065 - RNA, 64 nt, Human
aucuggcauucggaauggaaauguaauaauggacauuagggagcccugccuuuuucuacugguu

SEQ ID NO: 185066 - RNA, 64 nt, Human
gggaauuccgcuggcauuagggaauuccgcuggcauuagggaauuccgcuggcauuagcauugc

SEQ ID NO: 185067 - RNA, 64 nt, Human; identical to SEQ ID NO: 184731

SEQ ID NO: 185068 - RNA, 64 nt, Human; identical to SEQ ID NO: 184731

SEQ ID NO: 185069 - RNA, 64 nt, Human; identical to SEQ ID NO: 184731

SEQ ID NO: 185070 - RNA, 64 nt, Human; identical to SEQ ID NO: 143576

SEQ ID NO: 185071 - RNA, 64 nt, Human; identical to SEQ ID NO: 143577

SEQ ID NO: 185072 - RNA, 64 nt, Human; identical to SEQ ID NO: 143578

SEQ ID NO: 185073 - RNA, 64 nt, Human
uguuuucaaacuauauaacugagccuuauuuauaauuagggauauuaucaaaauauguaaccau

SEQ ID NO: 185074 - RNA, 64 nt, Human
ugcaguguugcuguaaauccccauuggagacugcauuagggaauuaaagcugcuugucacuuuu

SEQ ID NO: 185075 - RNA, 64 nt, Human
uucccccaacugcugagucugugggauuaaggggauuagggagugucaguggccuagucaugcu

SEQ ID NO: 185076 - RNA, 64 nt, Human
cccacaauauuaagaaaagcauucaugugacuuuauuagggacacuaaacuacaucauuaacau

SEQ ID NO: 185077 - RNA, 64 nt, Human
aaauauuguagaaggauuuuucucaugcucuuauauuagggauucuauuugaguugcguuuauc

SEQ ID NO: 185078 - RNA, 64 nt, Human
cagggaaaacagguucuacauuuuucuuaaauaaauuagggaguaaaaguuauacuuaacuugu

SEQ ID NO: 185079 - RNA, 64 nt, Human
uuuagugauaauaaacauagacuuaauuccaauaauuagggaaaauugauaaauaucugucacc

SEQ ID NO: 185080 - RNA, 64 nt, Human
ucuguuucuuaauaaggauuuuguauuagaguauauuagggaaaguguguauuuggucucacag

SEQ ID NO: 185081 - RNA, 64 nt, Human
aauuuugaaauuuuggagcauuuuggauuuucagauuagggaugcucaaccuguauauauauuu

SEQ ID NO: 185082 - RNA, 64 nt, Human
agugagcuguugcguacuguaucauauuguagcuauuagggaagagaagaauguugcuuaagaa

SEQ ID NO: 185083 - RNA, 64 nt, Human
augccuggaccccugagagcuucugaucccagcuauuagggacagaagaagccuccaaaucugg

SEQ ID NO: 185084 - RNA, 64 nt, Human
caaaugucucguaucaguuuuaguguuuuucaguauuagggaaagguaauauaaaaacagguaa

SEQ ID NO: 185085 - RNA, 64 nt, Human
aacaccugaucuugauuggaaagcauuguaggucauuagggaaaacugaugaugcugacuguug

SEQ ID NO: 185086 - RNA, 64 nt, Human
ggcccucuuaagggagcucagagagaauuacuaaauuagggacaguuucaauaguuaucauucu

SEQ ID NO: 185087 - RNA, 64 nt, Human
uauuuuuuuuuaaguaaaaauuuacuaaggccuuuagcauaauacuguaaaugucuuuugguca

SEQ ID NO: 185088 - RNA, 64 nt, Human
ucaguuaaugaaaacuguauuaacauaauuguuguagcauaauauuaauagugcaaaaguacau

SEQ ID NO: 185089 - RNA, 64 nt, Human
ggguggggccgggugaaaaugccagucuguguuugaccuucacauuuguucaugaguggaugga

SEQ ID NO: 185090 - RNA, 64 nt, Human
agguggacuugucucccagucgaggcugguaagggaccuucagggagagcugggcagacaggug

SEQ ID NO: 185091 - RNA, 64 nt, Human
gccugagcaagggggaggaagaggaggaagguuggaccuucaucagaccacucccuucccccau

SEQ ID NO: 185092 - RNA, 64 nt, Human
caagaauaagauaaaaacuugaauaagaaguaaguagcauaaaucaguauuuaaccuaaaauua

SEQ ID NO: 185093 - RNA, 64 nt, Human
auuguaaacacaauagauguagcucuaucaugucuagcauaauuuaaaaaaucaguguuuuuag

SEQ ID NO: 185094 - RNA, 64 nt, Human
gacauuucaaccaucaacauaauauagugaggaguagcauaauauuuuuuaauaaugcagaaaa

SEQ ID NO: 185095 - RNA, 64 nt, Human
uccuggaugugauggggauugccagagaggcucuuagcauaaaaggcauuaggugggcauuuuu

SEQ ID NO: 185096 - RNA, 64 nt, Human
acugaggcugcgaacuaguucuguggcaguggacuagcauaaguggaugucuaagaaauuuuuc

SEQ ID NO: 185097 - RNA, 64 nt, Human
caaaaauaauuuuuaaaaagccugagguaugauauagcauaaaagauugagaugaaaauauauu

SEQ ID NO: 185098 - RNA, 64 nt, Human
gggggcggggggcaggacugaagauuucacuacuuagcauaauauuuucuuucuuuuuuuuuuu

SEQ ID NO: 185099 - RNA, 64 nt, Human
uuuauuuaacaguuaucuugaaagcuauuggguauagcauaaaauaauaucacucuuuuaauag

SEQ ID NO: 185100 - RNA, 64 nt, Human
uugcagcauaguauuacuucuuugauguucucauuagcauaauguuauuuuugaaaaggaaaga

SEQ ID NO: 185101 - RNA, 64 nt, Human
ggcaaugguagauccacccuuaugcuucucaguuuagcauaaccucuuauggauuuucaucaaa

SEQ ID NO: 185102 - RNA, 64 nt, Human
uuguugugaggauuaaauaauguaaauaaagaacuagcauaacacucagcaucuaguaagugcu

SEQ ID NO: 185103 - RNA, 64 nt, Human
acaaacauacuguucccauacauaguacaaagaguagcauaauaaauauuuucugugaauguuu

SEQ ID NO: 185104 - RNA, 64 nt, Human
cuuaaucaaaagacuggaaaacugcagucuguaauagcauaaggcuuccauuaugaaagaaaac

SEQ ID NO: 185105 - RNA, 64 nt, Human
aguaauaaaaaaaagaaaagauaagugcuuguucuagcauaaauuaaaagguccaagggaauuu

SEQ ID NO: 185106 - RNA, 64 nt, Human
guacaaggaaauuuauuaucucagugucuuuauuuagcauaaaaguggccuuagaagaagggug

SEQ ID NO: 185107 - RNA, 64 nt, Human
uugcacaaauuuccuuaaaaaucaacuuguacuguagcauaagaaaaguuuuuauuuaucuauu

SEQ ID NO: 185108 - RNA, 64 nt, Human; identical to SEQ ID NO: 143582

SEQ ID NO: 185109 - RNA, 64 nt, Human; identical to SEQ ID NO: 143583

SEQ ID NO: 185110 - RNA, 64 nt, Human; identical to SEQ ID NO: 143584

SEQ ID NO: 185111 - RNA, 64 nt, Human
gccagcauucacaaaaugaggaagauaaggaaaguagcauaaauauuuucuauuaacauggcuu

SEQ ID NO: 185112 - RNA, 64 nt, Human
cccagauucucuuuccaguuucauccuaaguuccuagcauaaacacuauuuauuuucugcagca

SEQ ID NO: 185113 - RNA, 64 nt, Human
uuaucaaacuguuuccuuauccucuuuucugauguagcauaaaaauugucccgguuugaguuau

SEQ ID NO: 185114 - RNA, 64 nt, Human
aaauuugaaacauuauucuuguuguuguugguaauagcauaaugacagugggagggguacaagg

SEQ ID NO: 185115 - RNA, 64 nt, Human
guagucuuuagcacacuaggugguaugccuuuauuagcauaaaacaaaaaaaacuuuaacagga

SEQ ID NO: 185116 - RNA, 64 nt, Human
acauuuugcuaaagugaaaaauuuccaaguucucuagcauaacuuuuuacauuuaauuuuucau

SEQ ID NO: 185117 - RNA, 64 nt, Human
auauguauauaauuaagcacuaauuuguacugcuuagcauaaaagaacauccagucuuagaucc

SEQ ID NO: 185118 - RNA, 64 nt, Human
ucuccuggggccgacacguugggacagcacaccauagcauaaagcuaggggaugcauggaaaua

SEQ ID NO: 185119 - RNA, 64 nt, Human
uccuuauggggcuacauuuguucauuuccagcaguagcauaaacuuacggugacaugguagacu

SEQ ID NO: 185120 - RNA, 64 nt, Human
cuacuuuuaaguugcugaugaacucuuaaucaaauagcauaaguuucugggaccucaguuuuau

SEQ ID NO: 185121 - RNA, 64 nt, Human
aucuccauuaggcuccaccuuccaaugcaacaguuagcauaaguuuucaacacaugcuuuuugu

SEQ ID NO: 185122 - RNA, 64 nt, Human
ggcccacagucgccguauuccagagaugcgacauuagcauaaacacaucacagaugaauauaaa

SEQ ID NO: 185123 - RNA, 64 nt, Human
uaauaguacuuguacuucccaccacuggaaauguuagcauaaaagaacuuggagaggaaaaaag

SEQ ID NO: 185124 - RNA, 64 nt, Human
uugguuagggcucccacugccaaaugcaagcagauagcauaaccugacuguuaugugcccucag

SEQ ID NO: 185125 - RNA, 64 nt, Human
aaagggcuguaagcuaauuguggugucuaguaaguagcauaaugagaugugaggaguuggaacu

SEQ ID NO: 185126 - RNA, 64 nt, Human
uuuuuuuuucuuuuuucuuuuuuuaaagaaaugguagcauaauauacacaguuguccauuuuuu

SEQ ID NO: 185127 - RNA, 64 nt, Human
uuccaacuuuguuuuaaggaauaaacaucauccugaccuucaucucugggcuuguuccgggaag

SEQ ID NO: 185128 - RNA, 64 nt, Human
ucaggacuuggacgccauaguggcccgggaccgagaccuucagcaguugaggcuggggcuagug

SEQ ID NO: 185129 - RNA, 57 nt, Human
cacaccaucuugagccuuagcuccucagaccuucagugaggcuucuaauggggggug

SEQ ID NO: 185130 - RNA, 64 nt, Human
cauggcuaacaaucuucaaauacccaaauugugauagcauaaauaaaguauuuauuuuaugccu

SEQ ID NO: 185131 - RNA, 64 nt, Human
accuuaaugcuaauucaaugagaaaugaguuuaauagcauaacauuaccaagguaaucaaacua

SEQ ID NO: 185132 - RNA, 64 nt, Human
caauucuuguguggaauuuaacuccaugacugaauagcauaaggaagagguuauuuaaaagcaa

SEQ ID NO: 185133 - RNA, 64 nt, Human
agaauuauguaaaagccauucuuuaaaauauuuauagcauaaauauauguuauguaaagugugu

SEQ ID NO: 185134 - RNA, 64 nt, Human
ucuuucuuagaauggucuaguuaaguuccacauguagcauaauucuuaaauaggcacuuuucug

SEQ ID NO: 185135 - RNA, 64 nt, Human
auauauagcuaucacauuuguaagauucuguuuuuagcauaaaaaucaauagggaugaaaauuu

SEQ ID NO: 185136 - RNA, 64 nt, Human
uguuagaaguccuaaaagaggauggguuguaauuuagcauaauauucugaauucauuccaaguu

SEQ ID NO: 185137 - RNA, 64 nt, Human
ucuaaaacccagaguaaacaucaaugcucagaguuagcauaauuuggagcuauucaggaauugc

SEQ ID NO: 185138 - RNA, 64 nt, Human
accaguucuuucugagaaacuggagaugucuuguuagcauaagugucuucauucccaccuggag

SEQ ID NO: 185139 - RNA, 64 nt, Human
aauauuuuugauacagcaagugucaaacuugcuauagcauaaaagccggggcuccugauuucca

SEQ ID NO: 185140 - RNA, 64 nt, Human
cugcugcaucauaauaaauauaucuauauauauuuagcauaagacgugauauuuuuaauuucuu

SEQ ID NO: 185141 - RNA, 64 nt, Human
gaucuuuuuccgacuucuaaacaagugacuauacuagcauaaaucauucuucuaguaaaacagc

SEQ ID NO: 185142 - RNA, 64 nt, Human
uagaugauaaaccaggguuuuaaaucaaacaauguagcauaaagugguauugaaguaccauauu

SEQ ID NO: 185143 - RNA, 64 nt, Human
aacaaaaauacauaaagcuuugaauauaauuauguagcauaaaaguuaagguuguucacuauga

SEQ ID NO: 185144 - RNA, 60 nt, Human
agagcauuaagcuuaaaugaaguuuuugcuuagcauaagguuuuuggcaguuuuggauca

SEQ ID NO: 185145 - RNA, 64 nt, Human
ccgaauuugcacaagagaauguuuuaagcauugguagcauaauugaauaaaagaauaguuuccu

SEQ ID NO: 185146 - RNA, 64 nt, Human; identical to SEQ ID NO: 143588

SEQ ID NO: 185147 - RNA, 64 nt, Human; identical to SEQ ID NO: 143589

SEQ ID NO: 185148 - RNA, 64 nt, Human; identical to SEQ ID NO: 143590

SEQ ID NO: 185149 - RNA, 64 nt, Human
aagcauucuuuccacugaaugcauaauguuuaaauagcauaaaaugaaaugcuacaaaaauuga

SEQ ID NO: 185150 - RNA, 64 nt, Human
aaauuuaguggcacagaaaacaaagugaauuuguuagcauaauuauuccuauucuuauuucuuc

SEQ ID NO: 185151 - RNA, 64 nt, Human
cucaaaauagagaggagacuuuaaacuuacauguuagcauaaaacagacuucucucucauugca

SEQ ID NO: 185152 - RNA, 64 nt, Human
gaaagccuuguuuuuucccagagcaaccauguuuuagcauaaugggaugaccuggugucccauu

SEQ ID NO: 185153 - RNA, 63 nt, Human
cuuuuuuguauuaucaaaaaaauacauuugaacuuagcauaaaaaguggccagccuuuuuuau

SEQ ID NO: 185154 - RNA, 64 nt, Human
cuuuguacuauucacauuuuguaucaguauuauguagcauaacaaaggucauaaugcuuucagc

SEQ ID NO: 185155 - RNA, 64 nt, Human
ggaagguaccacaaacauuaucuaccagggaacauagcauaaauuagucugaaauuuccugaga

SEQ ID NO: 185156 - RNA, 64 nt, Human
auuaggagccggagggaccuacuuugcaggaaccuagcauaacuuugugugacgagacugcaca

SEQ ID NO: 185157 - RNA, 64 nt, Human
acaaauguuuccuugaaugcuugcuuuuguguguuagcauaauuuuuagaauuguuugagaauu

SEQ ID NO: 185158 - RNA, 64 nt, Human
uuaucuuaaguucuaugaagaguauuaauguaacuagcauaagugguuuucuucaggaaaauaa

SEQ ID NO: 185159 - RNA, 64 nt, Human
aaugggaugugaagaauugaggcaugcaacccaauagcauaaauguccuuuuuccccccaaaua

SEQ ID NO: 185160 - RNA, 64 nt, Human
ucuuuuauuuugcacuuuuaugggugacaguuuuuagcauaaccuuugauaaaauacacucaag

SEQ ID NO: 185161 - RNA, 64 nt, Human
auuuuuuguugucguuuuaacaucuccacgucccuagcauaaaaagaaaaagaaaaaaauuuaa

SEQ ID NO: 185162 - RNA, 64 nt, Human
aaugcagaugccugugcccaaauaauaauucauauagcauaaauuggaguuguguguuaaugug

SEQ ID NO: 185163 - RNA, 64 nt, Human
uaccccaaaagaagccuggaagucuaauuaagaguagcauaaggaaccuaauuauguuuaccau

SEQ ID NO: 185164 - RNA, 64 nt, Human
gcucucccaugacaucuccaugcugguuucuccauagcauaaaugaaaaaaaaaaaaaaaaagu

SEQ ID NO: 185165 - RNA, 64 nt, Human
ugugcagugcccagcacgggacccggcugcaggggaccuucaauaaacacuuguccagugaccu

SEQ ID NO: 185166 - RNA, 64 nt, Human
ccacaggcugcgucaucaccaucucgggacgcaugaccuucacgagcaauaaguccauggagau

SEQ ID NO: 185167 - RNA, 64 nt, Human
caccagauaaacuacaguuuguuuaggaggcccugaccuucauggugucuuugaagcccaacca

SEQ ID NO: 185168 - RNA, 64 nt, Human
gaaaggaagagucuuagaauuccuaagggaaccuuagcauaaagguuuuggggaaggaggccgu

SEQ ID NO: 185169 - RNA, 64 nt, Human
agaucauuuuguuguucauugugcaguauguauauagcauaauauacacagugaauuauagguc

SEQ ID NO: 185170 - RNA, 64 nt, Human
cacacagccaacauuuuaggaacuuucuagauuauagcauaaggacauguaauuuuugaagacc

SEQ ID NO: 185171 - RNA, 64 nt, Human
uaaaauuggaauaugaaaaacuaauggauaaagcuagcauaaaauugauauuuuaguuuguauu

SEQ ID NO: 185172 - RNA, 64 nt, Human
gacugauuuuagauugggaggguggggggauuuguagcauaacuguagcucaaguuuaaaagcc

SEQ ID NO: 185173 - RNA, 64 nt, Human
uauuucugccuauaaauuuacucuguugaauauuuagcauaaauuuaauguagacauuuuuauu

SEQ ID NO: 185174 - RNA, 64 nt, Human
auuguuugucacugggaaccaaaggauaaaagaguagcauaagcugcugaauguugccauauua

SEQ ID NO: 185175 - RNA, 64 nt, Human
caguuaaguguaaauauuguauguuuuguaucaauagcauaauuaacuuguuaagcaaguaugg

SEQ ID NO: 185176 - RNA, 64 nt, Human
uguuggucuguagcaagcugaguuuggaugucuguagcauaaggucugguaacugcagaaacau

SEQ ID NO: 185177 - RNA, 64 nt, Human
gccuggcugagucaccuaauucauacugucauacuagcauaauuaugacuauugcauaugcuug

SEQ ID NO: 185178 - RNA, 64 nt, Human
uuucuuguaaagugcuuuugaauuaauaaaauauuagcauaauuguguauagucaguugaaccc

SEQ ID NO: 185179 - RNA, 64 nt, Human
cauuaaacuagagccuuaagucaaucucagaagguagcauaaacaaauaaaaauuaacuguaug

SEQ ID NO: 185180 - RNA, 64 nt, Human
aaucauuuuuauuuaguuaauuaccagagagauuuagcauaauuuuguucuggauucaguaaau

SEQ ID NO: 185181 - RNA, 64 nt, Human
uuaaaaauuguaaaaauuauugugaugauucauuuagcauaaagagagguggacggaaggguuu

SEQ ID NO: 185182 - RNA, 64 nt, Human
cugcaaaggcaccugaaugugucugcguuccuguuagcauaaugugaggagguggagagacagc

SEQ ID NO: 185183 - RNA, 64 nt, Human
cugcaaaggcaccugaaugugucugcgucccuguuagcauaaugugaggagguggagagacagc

SEQ ID NO: 185184 - RNA, 64 nt, Human; identical to SEQ ID NO: 143552

SEQ ID NO: 185185 - RNA, 64 nt, Human; identical to SEQ ID NO: 143553

SEQ ID NO: 185186 - RNA, 64 nt, Human; identical to SEQ ID NO: 143554

SEQ ID NO: 185187 - RNA, 64 nt, Human
uucauugcaaaggcaguauaaaagauauauaaaauagcauaauaugagaaauuaagucccuaaa

SEQ ID NO: 185188 - RNA, 64 nt, Human
cuaaggaaaaguaaucuguaaaaauaauuuuaauuagcauaauacagucaccuagacacuucca

SEQ ID NO: 185189 - RNA, 64 nt, Human
acugugaucgaauuaagaauuuuaguuuacaguuuagcauaaacaaauaguaguagaaaugaau

SEQ ID NO: 185190 - RNA, 64 nt, Human
ugaacuaagcagaugccaucugcagaagugcugguagcauaaggaggaucgggucauaagcaau

SEQ ID NO: 185191 - RNA, 64 nt, Human
auuugccacauaguuguuguaauauuuaauccaguagcauaacuuauaucuguauuuaaggacu

SEQ ID NO: 185192 - RNA, 64 nt, Human
uuuguuugaaauucauauaucuuauuucaaaggauagcauaauaucugcauuaugcuggaaaaa

SEQ ID NO: 185193 - RNA, 64 nt, Human
aacucacuugaagaagagggucuugagaaauccuuagcauaaagggcuacuggugagauugaga

SEQ ID NO: 185194 - RNA, 64 nt, Human
uaauccuguguuguuucacucuuagaaauugaauuagcauaauugggccauggaacacauaugc

SEQ ID NO: 185195 - RNA, 64 nt, Human
agcuuaaucaacagaaguaucaagccaugugcuuuagcauaaaagaauauuuagaaaaacaucc

SEQ ID NO: 185196 - RNA, 64 nt, Human
aaaagucagaucuggccauuugucuuuccuagaauagcauaacuuuguucauuguuuuuuuugu

SEQ ID NO: 185197 - RNA, 64 nt, Human
agagcagcagccgcagccuccucgugauccucccuagcauaaauuucccaaacaguccacaggu

SEQ ID NO: 185198 - RNA, 64 nt, Human
ucgacguuuauuuaccucuuuagcacuuauacuuuagcauaaaaaauguugaguuaucaccacc

SEQ ID NO: 185199 - RNA, 64 nt, Human
uaaauguuauaaauuuggugaucagaacuauuaauagcauaaaucgaacucaaauggaagcaaa

SEQ ID NO: 185200 - RNA, 64 nt, Human
ccuauaaaucuccuuauuuuauuucuuguuuuuauagcauaaagcuuuaguuuggccuguuuuu

SEQ ID NO: 185201 - RNA, 64 nt, Human
uuuuauuugcuuauuuuuauaauuaaagaugccauagcauaauaugaagccuuuggugaauucc

SEQ ID NO: 185202 - RNA, 64 nt, Human
cuuuaggaaguuguccucaugaauuagcuagcauuagcauaauuaccgacguugcaugcuguga

SEQ ID NO: 185203 - RNA, 64 nt, Human
cuccaaaccuuucagauaacaaacuaucauugcagaccuucacuuuuggaaugcaaucuuuaua

SEQ ID NO: 185204 - RNA, 64 nt, Human
acucagggcuucaacauucuagaacugauaaguggaccuucagugugcaagaauggagaagcau

SEQ ID NO: 185205 - RNA, 64 nt, Human
auaaacaaugaaauauugcuguauagcuccuuuugaccuucauuucauguauaguuuucccuau

SEQ ID NO: 185206 - RNA, 64 nt, Human
auuccuauuuuuaaauaauuuccuacacaaaugauagcauaacauaugcaguguucuacaccuu

SEQ ID NO: 185207 - RNA, 64 nt, Human
guauaaucagaagucugaauuuuuauaaaacauauagcauaaaaacuuccaguacuuugguuga

SEQ ID NO: 185208 - RNA, 64 nt, Human
uauauagaacugauggguuuacccagcuacccaguagcauaacuuuucacagcucggggaugaa

SEQ ID NO: 185209 - RNA, 64 nt, Human
agcuggagccaucuucuccauagcauuacggacuuagcauaagaguaaaugacugugaacguug

SEQ ID NO: 185210 - RNA, 64 nt, Human
agcacucauuucacucucccugugugccaggcaauagcauaagcacuggaagaauacagauguu

SEQ ID NO: 185211 - RNA, 64 nt, Human
acuuuaaaugacauuuguauucucagacacugaguagcauaaaaaccacauagaacugaacugu

SEQ ID NO: 185212 - RNA, 64 nt, Human
aauagauuuaccuuacuuuuuaaaaacuacaaaguagcauaauuuguucuacauuuauuugaaa

SEQ ID NO: 185213 - RNA, 64 nt, Human
uuuaauuuuuugauuaaaacauacacacagcuguuagcauaaagucguggggggcauuuucugg

SEQ ID NO: 185214 - RNA, 64 nt, Human
auuauucuuuuaauuuuuauuugagcuguuucaauagcauaaugaaauaaaauuuugaauuggc

SEQ ID NO: 185215 - RNA, 64 nt, Human
gugacuugucuuuuugugacuggcuuauuucacuuagcauaauguccucaagguucauccaugu

SEQ ID NO: 185216 - RNA, 64 nt, Human
augugcuacugauuguuucauugcgaaucuuuuuuagcauaaaauuuucuacucuuuuuguuuu

SEQ ID NO: 185217 - RNA, 64 nt, Human
cuacacguauauuuuuacauuaaaaauacaguguuagcauaaauccccuuuucaggaagaacaa

SEQ ID NO: 185218 - RNA, 64 nt, Human
uccacuuguucagggcuuuucuuaauacugaacguagcauaagggcuucuggaacccagaagag

SEQ ID NO: 185219 - RNA, 64 nt, Human
cuuugcuuagcuuucuuuauuucugcaaaucuguuagcauaauuccaagguggccaagcagaug

SEQ ID NO: 185220 - RNA, 64 nt, Human
gaguauuugguaaaucccaguaggcuuuuaccauuagcauaauuuuguguuguacaauuaaguu

SEQ ID NO: 185221 - RNA, 64 nt, Human
uuaugaccccuuuguauaagauaccugggagagguagcauaaggauuaucauugcuaauacuua

SEQ ID NO: 185222 - RNA, 64 nt, Human; identical to SEQ ID NO: 143558

SEQ ID NO: 185223 - RNA, 50 nt, Human; identical to SEQ ID NO: 14033

SEQ ID NO: 185224 - RNA, 64 nt, Human; identical to SEQ ID NO: 143560

SEQ ID NO: 185225 - RNA, 64 nt, Human
accucagccucgugcauugccuggaaccuucuucuagcauaaaugaagguuuuuccuccuacac

SEQ ID NO: 185226 - RNA, 64 nt, Human
cuuccacuagaaccuggagacauagcaucuuugauagcauaagccagauuaucugugugugcgg

SEQ ID NO: 185227 - RNA, 64 nt, Human
uuauggauaaagaaagcauuagguaguugggcuauagcauaauuagauuuucuggcuuucaaaa

SEQ ID NO: 185228 - RNA, 64 nt, Human
gaaaacgugucucagauggcuggcuuuaccucgauagcauaagagagaccuaagacauguaaaa

SEQ ID NO: 185229 - RNA, 64 nt, Human
uacaauaauguaaauccuaaaagcaccacuauuuuagcauaauaaaagaaaguccaaagagcuc

SEQ ID NO: 185230 - RNA, 64 nt, Human
acagugcauaauuugcaaaauaaaaaauguacacuagcauaauauuuguggcauauccguguaa

SEQ ID NO: 185231 - RNA, 64 nt, Human
acuucugaccaagaagaaaaaggaccuuaguauuuagcauaaaauuccagcgcuggaugaaugc

SEQ ID NO: 185232 - RNA, 64 nt, Human
cuuccaaaaauaaucuauacauguucaaauuagguagcauaaagauaaaagugaaauuuaguag

SEQ ID NO: 185233 - RNA, 64 nt, Human
gcauccggaagugauaacacgcaaaaucacaaaguagcauaaaucaguaaauuaguugaguugu

SEQ ID NO: 185234 - RNA, 64 nt, Human
aguuuuaugaauucaugcccuuccuuuacucuauuagcauaagcaguaaauuuuuuuauuuuaa

SEQ ID NO: 185235 - RNA, 64 nt, Human
uuuguguacuuauaauguucaccuaaaaauguuguagcauaauucuguguuuuaugguugcuuc

SEQ ID NO: 185236 - RNA, 64 nt, Human
uuaaaaaucauaaagggagcaccauuguacagucuagcauaaacagcaaauuuuaaagaggaca

SEQ ID NO: 185237 - RNA, 64 nt, Human
uugucaauguuuuccaaauacuuagaguuaugaauagcauaauuucuugauaccauaacuuugc

SEQ ID NO: 185238 - RNA, 64 nt, Human
cauauauaugaccaugucugaaaugucaguucucuagcauaauuuguauugaaaugaaaccacc

SEQ ID NO: 185239 - RNA, 64 nt, Human
cuuuuggauuuuuuugaauuuuggaauauuugcauagcauaaugagauaucuugggaaugggac

SEQ ID NO: 185240 - RNA, 64 nt, Human
gagagacugagcuacacuacugcuaaacuauuuuuagcauaauauauaccauuuuuaugaguuc

SEQ ID NO: 185241 - RNA, 64 nt, Human
ucccccagagaccccauuugccucucaacacucagaccuucaacuguuuuuuaauaaaucuacu

SEQ ID NO: 185242 - RNA, 64 nt, Human
gaggggguuuagucccugccucaccuuggggauggaccuucagcugaaaccauauggcccccua

SEQ ID NO: 185243 - RNA, 64 nt, Human
auuugugguaaugcuuugguauuuucuuggggaagaccuucaccuuugcaaacuucccucaugu

SEQ ID NO: 185244 - RNA, 64 nt, Human
gcuacuguaguaccuaaaaagucaguguuguacauagcauaaaaacucugcagagaaguauucc

SEQ ID NO: 185245 - RNA, 64 nt, Human
caggacaaaauaguuguacagguuauauguggcauagcauaaccacaguaagaacagaacagau

SEQ ID NO: 185246 - RNA, 64 nt, Human
gaaggagaaagugguuacuagccaggcauaccccuagcauaagucugggcagcucuaugggaug

SEQ ID NO: 185247 - RNA, 64 nt, Human
aauuuuuuauuaaaagaaauaugcuuugaugugcuagcauaacugcucuagcuucuuguguacc

SEQ ID NO: 185248 - RNA, 64 nt, Human
gagaaugacuuucccuuuuuugccccauaagggcuagcauaagcugagguagaacuuaucuuua

SEQ ID NO: 185249 - RNA, 64 nt, Human
caagugguaugcuuuagaucugcacaugugaauuuagcauaaucacugggaauuugaaauucuu

SEQ ID NO: 185250 - RNA, 64 nt, Human
ccauugagccacgucgguggugucauccuacauguagcauaauagagucucucagccuuugcuu

SEQ ID NO: 185251 - RNA, 64 nt, Human
gugguuguugacuguaguauaagucagcuuucuguagcauaagauuugauuuucccauacuuac

SEQ ID NO: 185252 - RNA, 64 nt, Human
aaugguuucaaagaaagacuguaagcuccaugauuagcauaaagcacuaaccaugucuccaugu

SEQ ID NO: 185253 - RNA, 64 nt, Human
augaaugaaacuuaaguagugauaaaaggaaguuuagcauaaauuauagcaguuuucuguuauu

SEQ ID NO: 185254 - RNA, 64 nt, Human
uggauuuguaagguguuuuucuuuuuuacgcauuuagcauaaucagcugauuaagaauggaaaa

SEQ ID NO: 185255 - RNA, 64 nt, Human
gccaaaaagaauacauuguuuaaauucacaaaauuagcauaauugcagugcuaaugaauaucgg

SEQ ID NO: 185256 - RNA, 64 nt, Human
caauuuauuuucuuaguauuacaaaauaauucauuagcauaaaguacaauagugaaauauuuga

SEQ ID NO: 185257 - RNA, 64 nt, Human
ugugcugaggugauaauucauccaacauauuuguuagcauaaauauuaugcuucaguuucuguu

SEQ ID NO: 185258 - RNA, 64 nt, Human
ggcagggcuaagacuuucaagacugaaaagagacuagcauaaggagacuuaacaggaacccagu

SEQ ID NO: 185259 - RNA, 60 nt, Human
accaggauguuaccuccuaaaaaaaauuuuuagcauaaaguuucucuuuuacagugaucu

SEQ ID NO: 185260 - RNA, 64 nt, Human; identical to SEQ ID NO: 143564

SEQ ID NO: 185261 - RNA, 64 nt, Human; identical to SEQ ID NO: 143565

SEQ ID NO: 185262 - RNA, 64 nt, Human; identical to SEQ ID NO: 143566

SEQ ID NO: 185263 - RNA, 64 nt, Human
aagggguuuuucuuaaucaaaguuuuacauuugguagcauaaguaguucuuuaugcuucacagg

SEQ ID NO: 185264 - RNA, 64 nt, Human
aagauaagauuuucuguuuuuugaaauaagucuguagcauaaagguuaaacuauuuuaagacaa

SEQ ID NO: 185265 - RNA, 64 nt, Human
acagacacaauauguaugcuuuuuaccuagcugguagcauaaauaaaacugaaucucaacauac

SEQ ID NO: 185266 - RNA, 64 nt, Human
auuucugaaaaaugaccuccuuguuuuugaaaguuagcauaauuuuagaugccugugaaauagu

SEQ ID NO: 185267 - RNA, 64 nt, Human
auuaauguuuuaugaaaucucaugcaucaguucauagcauaaaaucuagcuggacaacuaagaa

SEQ ID NO: 185268 - RNA, 64 nt, Human
gugggcagguccagcauaguuaggaguuaggcuuuagcauaaauuucuagcugcaucugagucu

SEQ ID NO: 185269 - RNA, 64 nt, Human
aaaaagaacacaggagauuccagucuacuugaguuagcauaauacagaaguccccucuacuuua

SEQ ID NO: 185270 - RNA, 64 nt, Human
gaaauaaugcauguaaauugcucagcagcgugccuagcauaaaguaauuacucaaaccauaaug

SEQ ID NO: 185271 - RNA, 64 nt, Human
uuuauugcugcguaauaaauuaccacagacuuaguagcauaaaauaacauauaauuauaucuua

SEQ ID NO: 185272 - RNA, 64 nt, Human
aaaccgcuuaaagggguuccugaaccacaaaccauagcauaagugaucugugccuuaacgacau

SEQ ID NO: 185273 - RNA, 64 nt, Human
caccaaauuucucaagacccucuucucccuagcuuagcauaaugucuggggaaacaaccaaaau

SEQ ID NO: 185274 - RNA, 64 nt, Human
uccaguucuugcuuaguggcacgaccucuuuccauagcauaaaugcaggccagcguuuuagccc

SEQ ID NO: 185275 - RNA, 64 nt, Human
auggcacagaauauaauuugacuaucaagacuuuuagcauaaugaaaaacccucucucuauaua

SEQ ID NO: 185276 - RNA, 64 nt, Human
uuuuguuugggguuuuuaauuuugcguguuugcauagcauaaaaucaguagacaacaccacuga

SEQ ID NO: 185277 - RNA, 64 nt, Human
gguauuuacagugguuggaagauagcaguauuauuagcauaagcugcauacguaauauucagua

SEQ ID NO: 185278 - RNA, 64 nt, Human
guuagugaggauuauuaaccucugagcagugauauagcauaauaaagccccgggcauuauuauu

SEQ ID NO: 185279 - RNA, 64 nt, Human
gccacacagcagggcagugcacccuggcaccaugcacggccagcaagaaucaaggcccgcagau

SEQ ID NO: 185280 - RNA, 60 nt, Human
ccucggccgccagcagaugagccgcgcggccacggccaacccgcccgccccggcgcaggc

SEQ ID NO: 185281 - RNA, 64 nt, Human
ggcaguguuucuugagcucccaguaggggcuggccacggccaggugugggagggacuucgaaga

SEQ ID NO: 185282 - RNA, 64 nt, Human
uggguggaaccauauucucuuagaucacauuuaguagcauaacuguagggacuauuagagaugg

SEQ ID NO: 185283 - RNA, 64 nt, Human
uagauauacacacauauauauacucacacacauauagcauaaaauacucagcagggcuaguuau

SEQ ID NO: 185284 - RNA, 64 nt, Human
gucugggcuuguuuguguuacugcauacugugauuagcauaauaauuguuucuuugaggucauc

SEQ ID NO: 185285 - RNA, 64 nt, Human
auaaaggggaaaaaaguuucacaauggggacaauuagcauaacuaaacaaagauuaugagcucu

SEQ ID NO: 185286 - RNA, 64 nt, Human
uaauagaacuccaaacauuguaagaauugcuugguagcauaagcucagggauaaggugggaauu

SEQ ID NO: 185287 - RNA, 64 nt, Human
uucagagacacacaauuauaagagacuuaucuuuuagcauaaauacuuauggcucaaaauccac

SEQ ID NO: 185288 - RNA, 64 nt, Human; identical to SEQ ID NO: 143547

SEQ ID NO: 185289 - RNA, 64 nt, Human; identical to SEQ ID NO: 143548

SEQ ID NO: 185290 - RNA, 64 nt, Human; identical to SEQ ID NO: 143549

SEQ ID NO: 185291 - RNA, 64 nt, Human; identical to SEQ ID NO: 143550

SEQ ID NO: 185292 - RNA, 64 nt, Human; identical to SEQ ID NO: 122462

SEQ ID NO: 185293 - RNA, 64 nt, Human; identical to SEQ ID NO: 143552

SEQ ID NO: 185294 - RNA, 64 nt, Human; identical to SEQ ID NO: 143553

SEQ ID NO: 185295 - RNA, 64 nt, Human; identical to SEQ ID NO: 143554

SEQ ID NO: 185296 - RNA, 64 nt, Human; identical to SEQ ID NO: 3902

SEQ ID NO: 185297 - RNA, 64 nt, Human; identical to SEQ ID NO: 117960

SEQ ID NO: 185298 - RNA, 64 nt, Human; identical to SEQ ID NO: 122479

SEQ ID NO: 185299 - RNA, 64 nt, Human; identical to SEQ ID NO: 143558

SEQ ID NO: 185300 - RNA, 50 nt, Human; identical to SEQ ID NO: 14033

SEQ ID NO: 185301 - RNA, 64 nt, Human; identical to SEQ ID NO: 143560

SEQ ID NO: 185302 - RNA, 64 nt, Human; identical to SEQ ID NO: 143547

SEQ ID NO: 185303 - RNA, 64 nt, Human; identical to SEQ ID NO: 143548

SEQ ID NO: 185304 - RNA, 64 nt, Human; identical to SEQ ID NO: 143549

SEQ ID NO: 185305 - RNA, 64 nt, Human; identical to SEQ ID NO: 143550

SEQ ID NO: 185306 - RNA, 64 nt, Human
ucaacauccugcuguaugaugacaacagcaucaugaccuucaaccucagucaggugaguaucag

SEQ ID NO: 185307 - RNA, 64 nt, Human
acgguugcaucugcauauccuaagaggaaaaaaugaccuucaagagaauuaggacuuuuuucuu

SEQ ID NO: 185308 - RNA, 64 nt, Human
gugcagccuuugcucacagcuccauccaugucuagaccuucaggccagucugcagaugagguuc

SEQ ID NO: 185309 - RNA, 64 nt, Human
gcuuuugccaugggccccucacaucagggaaaaugaccuucacugcuguuaacaguaauguguc

SEQ ID NO: 185310 - RNA, 64 nt, Human
aaauaccgauaaaauggccuuaaguguauuccugacaguuaaauucagaaacgugccaaaugga

SEQ ID NO: 185311 - RNA, 64 nt, Human
auacuucuguguuuaaauuuucauucuuaccaaaacaguuaacucuuucuuuccaaucaauuua

SEQ ID NO: 185312 - RNA, 64 nt, Human
aauguuguccacuucccuuuuccacaggccuagaacaguuaaagggaacauaauuuguuuaggc

SEQ ID NO: 185313 - RNA, 64 nt, Human
caccaucgguuccagcgucucccagacuucucguacaguuaauuugugucaucccaucagcaau

SEQ ID NO: 185314 - RNA, 64 nt, Human
auauguucuuuaaaaaagaacauuugaaaauauaacaguuaaagauauuuuucuaaaagagaaa

SEQ ID NO: 185315 - RNA, 64 nt, Human
auuuuuuacuguuuuuuacuguuuucuuaagaaaacaguuaaaucauuaugcauucaguuggaa

SEQ ID NO: 185316 - RNA, 64 nt, Human
cagcauauuuaaucaaagcaagaaguaaucgcugacaguuaaaugugaccaaaaaaauuaaaag

SEQ ID NO: 185317 - RNA, 64 nt, Human
agucuuggaacuaguguuaaguaucuggcagagaacaguuaaucccuaaggucuugacaaaaca

SEQ ID NO: 185318 - RNA, 64 nt, Human
agacaucggaaucugagaugcugcccuagagaggacaguuaaagaagguucagugguccucagu

SEQ ID NO: 185319 - RNA, 64 nt, Human
auuuguaguaauaaauauuuuuaacuucauucauacaguuaaguuuaucugacaauaaaagcuc

SEQ ID NO: 185320 - RNA, 64 nt, Human
gcuagaagauacauggagaggaaugguguggucaacaguuaaugaaacgguucuaucaugcaug

SEQ ID NO: 185321 - RNA, 64 nt, Human
gcagagaaguauaacaugguaguuccucuaccuuacaguuaaucguuucuuaauaaagaagcag

SEQ ID NO: 185322 - RNA, 64 nt, Human
uuuauacuuauuuuuuccuuaaaagccacaggggacaguuaaauaucuuaaaauaucuaaaaca

SEQ ID NO: 185323 - RNA, 64 nt, Human
accuggugaugaccaugcaccuuacaauuucugaacaguuaacccuauagaagcaugcuuuaua

SEQ ID NO: 185324 - RNA, 64 nt, Human
gagacaugcuucuuugguuuauaaugagauguuuacaguuaaauacagauggcaguugagcacu

SEQ ID NO: 185325 - RNA, 64 nt, Human
uauuuccuuuuuaaaauguauuccuuuguguucaacaguuaaucaaaaccagagagucuagggc

SEQ ID NO: 185326 - RNA, 64 nt, Human
cuuuuuuguacaaaucuguauuguauuaauuucuggaugcaauuuuucaaauauuaaaauuaua

SEQ ID NO: 185327 - RNA, 64 nt, Human
uugagcacaacaggaaagccugggaggguuguugggaugcaaggaggugaugaaaaggagacag

SEQ ID NO: 185328 - RNA, 64 nt, Human
uagcccagaagccuccggcggcccaggauucuaaggaugcaauccucgaggaaaauuagucgau

SEQ ID NO: 185329 - RNA, 64 nt, Human
acuaacagagguacauuacugcaauguucucuuaacaguuaaacaagcuguuuacaguuuaaac

SEQ ID NO: 185330 - RNA, 64 nt, Human
aaaauaucuucaagaaaagauaggaccaucagugacaguuaaguguaaggagcaaguggaauug

SEQ ID NO: 185331 - RNA, 64 nt, Human
uuuuuuccuccuuacauuaaagaaaaguuuaauuacaguuaaaaauguauaauguauuuauaau

SEQ ID NO: 185332 - RNA, 64 nt, Human
aacauggucaaaaaggcaaucagaaauuuuaaauacaguuaauggauacauuuggcaacaauuu

SEQ ID NO: 185333 - RNA, 64 nt, Human
ugauucuuugcuucguauguaaauaaaguuaaaaacaguuaaaauaaggaguauuuugguagag

SEQ ID NO: 185334 - RNA, 64 nt, Human
uuuuuaauaguaucugucaaguuaauaucugucaacaguuaauaaucauguuauguuaauuuua

SEQ ID NO: 185335 - RNA, 64 nt, Human
ugcuuuuauuuuuguuaagucuuuugugacugggacaguuaauuuuaguagcugaagaacgucu

SEQ ID NO: 185336 - RNA, 64 nt, Human
agaacaacggcaagacagugccuauacugccucuacaguuaauaggaaaaacggaagaaguuac

SEQ ID NO: 185337 - RNA, 64 nt, Human
gcggggugggggugacugaauuugggccucuuguacaguuaacucucccagguggauuuugugg

SEQ ID NO: 185338 - RNA, 64 nt, Human
ccucugaaagacuucacuaaaaugaccaggauccacaguuaagagaagacccuguaguauuugc

SEQ ID NO: 185339 - RNA, 64 nt, Human
guguagcucaggagacaauuccagcacagacacuacaguuaacgcugaacugcagcugcaagua

SEQ ID NO: 185340 - RNA, 64 nt, Human
uuacaucaggacaaagagacagacuauuaacuccacaguuaauuaaggacguauguuccauguu

SEQ ID NO: 185341 - RNA, 64 nt, Human
ugcuuuucaauauaauugcaaacaaauuaaaaacacaguuaaacuaauauguuuauaagcuuga

SEQ ID NO: 185342 - RNA, 64 nt, Human
cuuuuaauauagccguguuuacuuguauuaacuuacaguuaacauaggaaaaauacaaguaagg

SEQ ID NO: 185343 - RNA, 64 nt, Human
auccuguguagaagcuguucucauuaaacaccaaacaguuaaguccauucucugguacuagcua

SEQ ID NO: 185344 - RNA, 64 nt, Human
uuucugucguugauauuaaaagugacuucugaguacaguuaaguuccuccuauuugccacuggg

SEQ ID NO: 185345 - RNA, 64 nt, Human
uuuguggcuuugggguccucugggagcugaagcacacggccauguuggagagcaaaacuuaaua

SEQ ID NO: 185346 - RNA, 64 nt, Human
cagcggcggggagggcgccucuggccccccaccucacggccaguucccgcgggcaccgccucgc

SEQ ID NO: 185347 - RNA, 64 nt, Human
gugucgccauccccuuccugcugcacaccugcaccacggccauggggaggcugcucccuggggg

SEQ ID NO: 185348 - RNA, 64 nt, Human
ccuuuuucuucuuugauuuaaaaaaauuaacuauacaguuaaugguuuagaacuuagaacuacu

SEQ ID NO: 185349 - RNA, 64 nt, Human
uuuuuauaaacuuuugugugugcuguggcagggaacaguuaacaaggaguuuauuuagaggggu

SEQ ID NO: 185350 - RNA, 64 nt, Human
uguuuuugauuucauaauucugcugguaaaugugacaguuaaaauggugcauuauguauauaua

SEQ ID NO: 185351 - RNA, 64 nt, Human
cgacucagugugucauccccgguuauuuagaauuacaguuaagaaggagaaacuucuauaagac

SEQ ID NO: 185352 - RNA, 64 nt, Human
aauguuagugcccacucuuccccuguacccccggacaguuaaaucagaaccucagacagcaaua

SEQ ID NO: 185353 - RNA, 64 nt, Human
augucucacaauauauauacacaagugugcauauacaguuaaugaaacuaucuuuaaauguuau

SEQ ID NO: 185354 - RNA, 64 nt, Human
aauuuuauugaaucuucauuggugcuaaugauggacaguuaaaaagauagcuaguguauauugu

SEQ ID NO: 185355 - RNA, 64 nt, Human
uuuaaaggcauguguuccauagccaaaaugauguacaguuaaaaagagugcguggaaacaacca

SEQ ID NO: 185356 - RNA, 64 nt, Human
gauccaguauaagacuacugaaucugcuaccaaaacaguuaaucagugagucgauguucuauuu

SEQ ID NO: 185357 - RNA, 64 nt, Human
gaugaaauugcaccuauuuuacacuuauauuuucacaguuaauugaacauauuuuuaaacaacu

SEQ ID NO: 185358 - RNA, 64 nt, Human
gugcccuccucgaggugggcagccaucaccagccacaguuaagccaagccccccaacauguauu

SEQ ID NO: 185359 - RNA, 64 nt, Human
agauacacugccucaaucuugaccagacaagagaacaguuaaguucucucaguuggguaguaac

SEQ ID NO: 185360 - RNA, 64 nt, Human
caugaaaacaguuacugagaauuguugugcuuugacaguuaacucuagaaagaaagaacacuac

SEQ ID NO: 185361 - RNA, 64 nt, Human
uaugaaaugcauauggcuugucagagcucauucgacaguuaaagccauuguuuaaagaaauggu

SEQ ID NO: 185362 - RNA, 64 nt, Human
ugaguccuucacugcuuccaucauguaaaaguucacaguuaaagacugaauuacagaaagauua

SEQ ID NO: 185363 - RNA, 64 nt, Human
auucuguuacuacaguaaacguuaagaguuuuaaacaguuaagauuguacaauuuuucuucuuu

SEQ ID NO: 185364 - RNA, 61 nt, Human
cggaccagccuuaccugugacacugcacccucacggccacccgacuacuuugccuccuugg

SEQ ID NO: 185365 - RNA, 64 nt, Human
gcacgcgggggcgugugcucugcgggacaguccccacggccagcgacguccaggucaccaaugg

SEQ ID NO: 185366 - RNA, 64 nt, Human
cucccaaagugcugggauuacaggcaugagccaccacggccagcccacaaugauauuacaaacc

SEQ ID NO: 185367 - RNA, 64 nt, Human
uauuucuguggcugaaaauaaaaucuugucuagcacaguuaaagucauuaaaaauaaaaaugac

SEQ ID NO: 185368 - RNA, 64 nt, Human
caguuguuuagaucuuaggcaugugcugguauccacaguuaauucccugcuaaaugccauguuu

SEQ ID NO: 185369 - RNA, 64 nt, Human
guagagaguauagccaaaacaguaauaaacaaugacaguuaaaauguaaagacuaugaaaauua

SEQ ID NO: 185370 - RNA, 64 nt, Human
gguuauacguaccacggauucucuuuaauauuguacaguuaaacuguauuucugauguugcaag

SEQ ID NO: 185371 - RNA, 64 nt, Human
auacaaaagcuuauuuucauuauuauuauaauaaacaguuaaugguugaaacuuaguaaaaugu

SEQ ID NO: 185372 - RNA, 64 nt, Human
cacugguacgaauucucaauaagaaugcaguggaacaguuaaguagaacuguaacuacguuggc

SEQ ID NO: 185373 - RNA, 64 nt, Human
uuauagguaucaaagcaauggcuuuucuuuugcaacaguuaauguauuuauuaacuuaauaauu

SEQ ID NO: 185374 - RNA, 64 nt, Human
gaaagaaaccauaagccuuaacaauacuccaaucacaguuaaauuaauuuagacagaaaagcaa

SEQ ID NO: 185375 - RNA, 64 nt, Human
cacagcacuuggucugggaaaguaccuuucaacaacaguuaagccaaaagguacagugaguccu

SEQ ID NO: 185376 - RNA, 64 nt, Human
ucucaucaguacuaguugucaaauuuaaaaugugacaguuaaagaauauucuaguuugacaauu

SEQ ID NO: 185377 - RNA, 64 nt, Human
cuaggaauauagacaaaugacugucugggcccacacaguuaaccagcccauuucuccacacugg

SEQ ID NO: 185378 - RNA, 64 nt, Human
aggguuguccugagaauaaaaugaguucugugugacaguuaacugccauuaauuaauuagccgu

SEQ ID NO: 185379 - RNA, 64 nt, Human
agaacuuuuauaaaauaauuagaacagagauuuuacaguuaagguuucaaauuguggcaggugg

SEQ ID NO: 185380 - RNA, 64 nt, Human
aaccauuaagaaaugcuguauucuuaaauaugaaacaguuaaucuaaagucuuauuauuucuuc

SEQ ID NO: 185381 - RNA, 64 nt, Human
uuuuuguauuguauaugaacuuuuuuuaaaugugacaguuaaacacaucuuuaaaagcauaguc

SEQ ID NO: 185382 - RNA, 64 nt, Human
cuagccucaggcuccagccccagugggguacuguacaguuaacugaagaagaauuuuaaagacg

SEQ ID NO: 185383 - RNA, 64 nt, Human
uggucuucaguccccaggagcaggagcugcugcucacggccagcgacgacgccaccaucaaagc

SEQ ID NO: 185384 - RNA, 64 nt, Human
uccugacugggcacaggagcucccagcuuuuguccacggccagcaggaugggcugucguguaua

SEQ ID NO: 185385 - RNA, 64 nt, Human
ggacagaagagagacuuuuacccuggggcacucacacggccaagcuucugccaccacuucauua

SEQ ID NO: 185386 - RNA, 64 nt, Human
ucuuuuuguucacuggagagagagagaacuguuuacaguuaaucugugucuaauuaucugauuu

SEQ ID NO: 185387 - RNA, 64 nt, Human
uacuaguuagagcuggucagccuuuuuggguaacacaguuaauuuaccaacugauacagauaau

SEQ ID NO: 185388 - RNA, 64 nt, Human
caaaacuugagccuuggauguuccuguggaccugacaguuaaaaauauaaagaaccuaggauuc

SEQ ID NO: 185389 - RNA, 64 nt, Human
auucauuuugacaguuaucaaagauguacuuuccacaguuaaauuuacauuaauggcaauuuuu

SEQ ID NO: 185390 - RNA, 64 nt, Human
aaauuauuacacgaccagaacuaaaaugcaauauacaguuaaguccacggauacucccauuaau

SEQ ID NO: 185391 - RNA, 64 nt, Human
uaucauuggucuggugagauguuucauauuugugacaguuaauuuaaaaauuaugaguuaaugc

SEQ ID NO: 185392 - RNA, 64 nt, Human
guggggggagaugaaagagagucgcguuuuguuuacaguuaaagacauccaauaucuuaaaaag

SEQ ID NO: 185393 - RNA, 64 nt, Human
ucaaaagguaagcacauuuagaauuuuguucuugacaguuaacugacuaaucuuacuuccacaa

SEQ ID NO: 185394 - RNA, 64 nt, Human
aggguuguuaauccaucacaagcaaaaggucagaacaguuaaacacugccuuuccuccuccucu

SEQ ID NO: 185395 - RNA, 64 nt, Human
cuuuggauaaauuuacagauuagaaagauaucugacaguuaaucucuguucuccuuacaaauuc

SEQ ID NO: 185396 - RNA, 64 nt, Human
aggcagagagagggaggcagauggaagaagaaaaacaguuaaauaagacauacccagucacugc

SEQ ID NO: 185397 - RNA, 64 nt, Human
acguguuuaauuaaauuucacaauauaaaguucuacaguuaauuaugugcauauuaaaacaaug

SEQ ID NO: 185398 - RNA, 64 nt, Human
aggaauguagcugguuuccucauuccugaaagaaacaguuaacuuucagaagagaugggcuugu

SEQ ID NO: 185399 - RNA, 64 nt, Human
aggugugcuauucacaguaccaugcgaguagcccacaguuaauucccggcagauucuuuggcug

SEQ ID NO: 185400 - RNA, 64 nt, Human
aacacuugcuacauaucauguuuuaauugcuuguacaguuaaccuuuaauuuuauuuaguaaag

SEQ ID NO: 185401 - RNA, 64 nt, Human
ucugccuccccugccuuauuucuuauguuuugccacaguuaacccauugugcuucuuuguaauc

SEQ ID NO: 185402 - RNA, 62 nt, Human
uuuggaaauacuguguuuaaagcuuuuucucuggaugcaaaaaaagauaagaauaucaggaa

SEQ ID NO: 185403 - RNA, 64 nt, Human
caugccaagguguauguguuuaagggggugugauggaugcaaagggaaugaggaauucagcacu

SEQ ID NO: 185404 - RNA, 64 nt, Human
uuuaaugaaguauuuuguguagaagguuaaauuaggaugcaaaacagaucugccauuccuuuuu

SEQ ID NO: 185405 - RNA, 64 nt, Human
gaaguagauuaagagccauauaaguuugaaggaaacaguuaauaccauuuuuuaaggaaacaau

SEQ ID NO: 185406 - RNA, 64 nt, Human
gaacacagaauaguaccuuacauuugcuaaacagacaguuaauaucaaauccuuucaauauucu

SEQ ID NO: 185407 - RNA, 64 nt, Human
ggaaaggaccccagcuuuccacgcgcgcgcaagcacaguuaagccaccugcaggaauaaacacg

SEQ ID NO: 185408 - RNA, 64 nt, Human
augacugacaacaaugucucugagugguaggauuacaguuaauuuuuauuuucuucauucuacu

SEQ ID NO: 185409 - RNA, 64 nt, Human
ucuuccguggcgaagcuuuauaucuguuccuaaaacaguuaauccugugaaauaaauauugaac

SEQ ID NO: 185410 - RNA, 64 nt, Human
aguauuguuuagcucccagagaaacauuuguuccacaguuaacacacucguaguauuacuguau

SEQ ID NO: 185411 - RNA, 64 nt, Human
aacuaaaauucagacuuuuagcaggacuuuguguacaguuaaaggagagauggccaagccaggg

SEQ ID NO: 185412 - RNA, 64 nt, Human
cuuggcaucuguacugaugaauaaguuauaaugaacaguuaaaaaugcucauugaaaauuaaau

SEQ ID NO: 185413 - RNA, 64 nt, Human
cguauuucagguccuugaaauuuuaauaaauauuacaguuaaauccugauaugacauaguuacc

SEQ ID NO: 185414 - RNA, 64 nt, Human
aauauuuuguuuuaaaaugaacuaugaauauuguacaguuaauuuccucacugaggacugugaa

SEQ ID NO: 185415 - RNA, 64 nt, Human
uuuuacccuuguauauuaucagugaaaaggaucaacaguuaauuugagccaaguaauaaaagaa

SEQ ID NO: 185416 - RNA, 64 nt, Human
ugugaggaggauauuuuaaauacuguaaaugauaacaguuaaugauauacacauuuagacugag

SEQ ID NO: 185417 - RNA, 64 nt, Human
cuguguaaucauguucuaguccaguguugcucaaacaguuaaaauccaggcugcuuuugguaaa

SEQ ID NO: 185418 - RNA, 64 nt, Human
auugugauauccuucuagaucauacacaagucuaacaguuaauuaguuaacaguuuuuaaacua

SEQ ID NO: 185419 - RNA, 64 nt, Human
gcauuuaacuugcaccaagcaagaaaauauaaauacaguuaacugcauuaagauaaucacguua

SEQ ID NO: 185420 - RNA, 64 nt, Human
cauggacuucucauccuuucuuuuuucaucuccaacaguuaaaugguaaggagagcaaaguuaa

SEQ ID NO: 185421 - RNA, 64 nt, Human
gguuaucugggaaucuuuccagcccgcaggucgccacggccaucccuuugcucccagccuggcu

SEQ ID NO: 185422 - RNA, 64 nt, Human
ugcugcagccacagcuccuccagaaagggacagccacggccaagugguugcuggucuuugggcc

SEQ ID NO: 185423 - RNA, 64 nt, Human
cacaacaagccccuacugauuucuggguuucugccacggccacagguucauauccagaggaaug

SEQ ID NO: 185424 - RNA, 64 nt, Human
ccuguaauuuaguuguaacauagaaaaugaaaaaacaguuaaaaaaagugaaguaguugcaaag

SEQ ID NO: 185425 - RNA, 64 nt, Human
aaaauguguauauauauauaauaguuuauuauguacaguuaauucuacuguuuuggcugcaaua

SEQ ID NO: 185426 - RNA, 64 nt, Human
uggaaaggaaacaaagagugcuuuugggcauccaacaguuaaucacuuauguuuuuagagcaug

SEQ ID NO: 185427 - RNA, 64 nt, Human
ucucacaagauggaaaucacauuuacaaaauuacacaguuaaugccacaaaacugacaguaaau

SEQ ID NO: 185428 - RNA, 64 nt, Human
ccgagcacugaauucccuugcgccuuuucaaagaacaguuaacuuggugcuaaugugcccuggu

SEQ ID NO: 185429 - RNA, 64 nt, Human
aacuacuacggaagaaaauuauucaucacaguguacaguuaaacaaaggaaucucagucacacc

SEQ ID NO: 185430 - RNA, 64 nt, Human
aauggguguuacaucuauccugccauuuaaccccacaguuaauaaaguggcugaaaauaauagu

SEQ ID NO: 185431 - RNA, 64 nt, Human
aauuuuagauuauauguccaccuaucuuaaguguacaguuaauaauuagcuuauucaaugauug

SEQ ID NO: 185432 - RNA, 64 nt, Human
cagauuauguaauggaagaaaaaugcggaugccuacaguuaacagauugcaaaauguaucuuaa

SEQ ID NO: 185433 - RNA, 64 nt, Human
auucuguuuuauaacaguuuguuugaauuuacuuacaguuaaaaaauuuaaauauauuuauguu

SEQ ID NO: 185434 - RNA, 64 nt, Human
uucuaauauuuuuguaaacauuaaauuauuuuguacaguuaaguguaaauauuguauguuuugu

SEQ ID NO: 185435 - RNA, 64 nt, Human
gagggagucagauaaagaacaaaccucgaaacgaacaguuaaauugaaaugcuaugugccugac

SEQ ID NO: 185436 - RNA, 64 nt, Human
cggcccugucaagaaucacauacucagcauuuugacaguuaaugucuucucuuuauuuguguag

SEQ ID NO: 185437 - RNA, 64 nt, Human
gagugccuacgugacacucaaauguugccagcauacaguuaagggcccuagucaauguaggccu

SEQ ID NO: 185438 - RNA, 64 nt, Human
acaacacaaaacucaaaagguacaaaagaauaaaacaguuaaaaacuaugccuucuuccuucuc

SEQ ID NO: 185439 - RNA, 64 nt, Human
agugugggcuuucuauuccccaaauauucuuacuacaguuaauauguagguuacugccccagcc

SEQ ID NO: 185440 - RNA, 64 nt, Human
agcgcuguauacgcuucaguuuuuccacauuguccacggccagcacaugaaagcaucacuucuu

SEQ ID NO: 185441 - RNA, 64 nt, Human
gccagcacuuguccagcugagcgccaggauggaacacggccacaucaaagaggcugaggcuggc

SEQ ID NO: 185442 - RNA, 64 nt, Human
aggcggcuuggagaaagggcagugggacgcuggccacggccaggguggugucgggagcaggccu

SEQ ID NO: 185443 - RNA, 64 nt, Human
gauaaaugcuugugcuaccuaaagcacuuagcacacaguuaaauuauauuuacauccuagaccc

SEQ ID NO: 185444 - RNA, 64 nt, Human
uccuuaaaaacuaaauaaaaugcacuguauucuuacaguuaauguuuauaacuauaguaaaaaa

SEQ ID NO: 185445 - RNA, 64 nt, Human
caaacaaaaaacaacaaaaaagcggugacaggaaacaguuaaggaaaugauuuaacugaaggga

SEQ ID NO: 185446 - RNA, 64 nt, Human
uuuauucuuucgguaugguaaaauugaaccaaucacaguuaagaugagagaucaaccugaguuu

SEQ ID NO: 185447 - RNA, 64 nt, Human
auauccaauuuuaaaaugaaaugcauuuugcuagacaguuaaacuggcuuaacuuaguauauua

SEQ ID NO: 185448 - RNA, 64 nt, Human
ccuuccucuuagccccaggagcaaauuaaaagguacaguuaaaauccuaacuuucugucuugug

SEQ ID NO: 185449 - RNA, 64 nt, Human
aaagguuaugauuauuucaacacaauggaagagcacaguuaaggccaacuaacguaaaaugcac

SEQ ID NO: 185450 - RNA, 64 nt, Human
caaaauauuuuacuucaaaaucuauaaagcagguacaguuaaggaauaaguagaacuaaggcuu

SEQ ID NO: 185451 - RNA, 64 nt, Human
cuuaagcaggugugugggcuccuuuaggcagguuacaguuaacuuucuagauuuagccaaaaug

SEQ ID NO: 185452 - RNA, 64 nt, Human
cucacacagcucagcaacaaccauuuugaugguaacaguuaauuucuuucauuaguuuuuuaaa

SEQ ID NO: 185453 - RNA, 64 nt, Human
uauacuuaaaauauuuucuuuccuuauguacuguacaguuaaucuuauuugccaucaucuugaa

SEQ ID NO: 185454 - RNA, 64 nt, Human
ugcuucaaauaaaacaacuucaagcuuccaagaaacaguuaagaggaggcagagaagagcagaa

SEQ ID NO: 185455 - RNA, 64 nt, Human
uauuucuauuauguguaaagugguguuaguguaaacaguuaacuccaaauagauuuuuuaaugu

SEQ ID NO: 185456 - RNA, 64 nt, Human
aacgaugacaaaaggggagacgcucuauuuuuucacaguuaaaugacaguuguagauugauacg

SEQ ID NO: 185457 - RNA, 64 nt, Human
uucagucaaguuuuaauaaaaauaaaacuguucuacaguuaauugcacuuuguucaguguaaau

SEQ ID NO: 185458 - RNA, 64 nt, Human
guguuuccauaggggcacuuuuagccuucccacaacaguuaagcacucuuugacugcugaagga

SEQ ID NO: 185459 - RNA, 64 nt, Human
caccaaccgcuaaaaugcacgccaucaucgagcgcacggccagcuucgugugcaggcagggagc

SEQ ID NO: 185460 - RNA, 64 nt, Human
aggagaccauugaccagauagagcuggaguuggccacggccaagaacgacaugaaccggcaccu

SEQ ID NO: 185461 - RNA, 64 nt, Human
aauauauauauauaaauauauuauacucacucaucacggccaucuuuguuguaaccauuucugu

SEQ ID NO: 185462 - RNA, 64 nt, Human
uaaauauucuuauccucuuaaauaaaacugcucaacaguuaaucagcagugaaucaucuugcag

SEQ ID NO: 185463 - RNA, 64 nt, Human
aaaauccagguuauuaaaggauucacacuuuauuacaguuaaaauuuaagguuuuuauguguaa

SEQ ID NO: 185464 - RNA, 64 nt, Human
gguugcugggguuuuaaaugauugauaagcuuguacaguuaacuuauagagggggagccauauu

SEQ ID NO: 185465 - RNA, 64 nt, Human
uuacuuuauauuucauaaucaggcaaaaauacuuacaguuaauaauauagauauaauguuaaaa

SEQ ID NO: 185466 - RNA, 64 nt, Human
gcccgcugaagucuguuaacaguugaaacauucuacaguuaaccauuagcaugcuaguuguccu

SEQ ID NO: 185467 - RNA, 64 nt, Human
ccacaaauacuuuaagcaaaucauuaaaauuauaacaguuaaugguuuggggguguuuaggcug

SEQ ID NO: 185468 - RNA, 64 nt, Human
aagauaauguuuauuuuaucgggguaucuaugguacaguuaauuucacguuguguaaauaucca

SEQ ID NO: 185469 - RNA, 64 nt, Human
auacucuuaaaagauguaauuguugucauuuugaacaguuaaacaucuugaguauaaaaagaac

SEQ ID NO: 185470 - RNA, 64 nt, Human
augauggaaagcaucuagauuucugccuccuuuuacaguuaauccaggagagggaguccuuugc

SEQ ID NO: 185471 - RNA, 64 nt, Human
cagaugccucagaggguagccuugauuuguucuuacaguuaagaagcccugcagagcacaaacu

SEQ ID NO: 185472 - RNA, 64 nt, Human
gaagaaauaauggggauauguggaauuuuuaacaacaguuaaauggaaaagcauagacaauuac

SEQ ID NO: 185473 - RNA, 64 nt, Human
agggaggccgcagagggaaaaaacaaaacguaacacaguuaagagaaauaaucguaagagaaca

SEQ ID NO: 185474 - RNA, 64 nt, Human
uuagggauguuuguuacuacucauauugauuaaaacaguuaacaaacuuuuuucuuuuuaaaau

SEQ ID NO: 185475 - RNA, 64 nt, Human
uauauuugaaaaccuucaaauuagaauacauuguacaguuaaagaaauugacuugguacuuaaa

SEQ ID NO: 185476 - RNA, 64 nt, Human
uauuuuuguauugcauuuuucuauuaaaaaauuaacaguuaauguuucagucaauguauuaucu

SEQ ID NO: 185477 - RNA, 64 nt, Human
acagguaaacuauauuuuuccuuaaacaccuauuacaguuaaauuaugcaaaucauuaaauaaa

SEQ ID NO: 185478 - RNA, 64 nt, Human
aguaccaggagggagccagcauuucagaucugaaguagacgauaggaauguggaagaacacaua

SEQ ID NO: 185479 - RNA, 64 nt, Human
aagagaagugguaauaggaaacggaagagacuugguagacgagauaaggaggacaagagaaggg

SEQ ID NO: 185480 - RNA, 64 nt, Human
gcugugugugucuguaaagaaagaaugcacauauguagacgauuaaguguauauuauaagcuau

SEQ ID NO: 185481 - RNA, 64 nt, Human
aaaaagaaucaaauugaauuaaagcuauauaaacacaguuaacccuuguaaaugaguaaacaaa

SEQ ID NO: 185482 - RNA, 64 nt, Human
auuguuuuaaccauuaacuugucaaauuacaaucacaguuaagaaaaugauguaaaauucuguu

SEQ ID NO: 185483 - RNA, 64 nt, Human
ucuuugccuuuugcaugacugauagcuguaacucacaguuaacaugcuuucagucaaguacaga

SEQ ID NO: 185484 - RNA, 64 nt, Human
cuuuugacaagugguaguccuacuguuuacacucacaguuaauguucauaccuaguuuuauaag

SEQ ID NO: 185485 - RNA, 64 nt, Human
ggauucauuaacucuuugaauuuguuaaauacuaacaguuaaccauuagaagugguucaaugau

SEQ ID NO: 185486 - RNA, 64 nt, Human
agacugauuguguuuguaaaagcuugaugaaaggacaguuaaguauuuugaucacugcauuuug

SEQ ID NO: 185487 - RNA, 64 nt, Human
uaaauauugcuauauuuucuuagcaguuauuucuacaguuaauuacauagucaugauuguucua

SEQ ID NO: 185488 - RNA, 64 nt, Human
aauagcugggguggagaaaaaaauagcucaagacacaguuaaucgagaagaaaagaaauaugua

SEQ ID NO: 185489 - RNA, 64 nt, Human
uauuaccauuucaaacuauuuuuuaaaaauaaauacaguuaacauagagugguuucuucauuca

SEQ ID NO: 185490 - RNA, 64 nt, Human
ccccagauaccagagcaucaagaguacaggaaauacaguuaaugcagggccucuguguggcugg

SEQ ID NO: 185491 - RNA, 64 nt, Human
uuaauggauaauuuauagacaguuaaauuuauagacaguuaaguaaaaauggauaauuuauaga

SEQ ID NO: 185492 - RNA, 64 nt, Human
agccaacauuuuaaaauuaauggauaauuuauagacaguuaaauuuauagacaguuaaguaaaa

SEQ ID NO: 185493 - RNA, 64 nt, Human
ugugggcauuucugcagugaauacauuuuccaaaacaguuaaauugucuguuuggauuugcuuu

SEQ ID NO: 185494 - RNA, 64 nt, Human
aagugaagcugguggaacauauggucuccauuuuacaguuaaggaauauaauggacagauuaau

SEQ ID NO: 185495 - RNA, 64 nt, Human
agauggaaggcuggagagaaugauugcuuuuuguacaguuaaauaaggucacaauauucuuaca

SEQ ID NO: 185496 - RNA, 64 nt, Human
uuggagcaauauccauuuauuauuuuguaacuuuacaguuaaacuaguuuuaguuuaaaaagaa

SEQ ID NO: 185497 - RNA, 64 nt, Human
aacaggggcccguuucugguugaaaucaagguuaggaugcaacugagaaaauaaaagacugcac

SEQ ID NO: 185498 - RNA, 64 nt, Human
aucuuucaggucgugauaaugagcuccuaugaaaggaugcaauauaaugacccgcuuuucuaga

SEQ ID NO: 185499 - RNA, 64 nt, Human
ugguggagaccagggacaggagagccagcaggguggaugcaaggggccucuacccacaccugga

SEQ ID NO: 185500 - RNA, 64 nt, Human
uuugcuaaauuuuacaauaaaccaaagucugauaacaguuaauguugcugcuugcguccuuaaa

SEQ ID NO: 185501 - RNA, 64 nt, Human
agugaaguauguuuuauggacuuaaaugccacaaacaguuaaguccauuggcuuggagaugaca

SEQ ID NO: 185502 - RNA, 64 nt, Human
ccagagcgguaauuccaaauuauuuuucaguaagacaguuaaucagcauuauugugagagggac

SEQ ID NO: 185503 - RNA, 64 nt, Human
ucgacugcuaugcucaaaaaguaaaaaaagcucaacaguuaaaaucuaauguuuguuuucuuuc

SEQ ID NO: 185504 - RNA, 64 nt, Human
cugaacauauuuauuaagcacuugcuguaggccaacaguuaagaauccaauaaugaaauggaca

SEQ ID NO: 185505 - RNA, 64 nt, Human
guuuuaacaaggacaaaaaguugaaagaaaaggcacaguuaacaaaaaaggguggcuagauuua

SEQ ID NO: 185506 - RNA, 64 nt, Human
aggcaggaauaagaagucagacagagacagcaagacaguuaacaauguagguaaagaaauaggg

SEQ ID NO: 185507 - RNA, 64 nt, Human
uaaauuauuuugggugguucagccaaaccucaaaacaguuaaucucccugguuuaaaaucacac

SEQ ID NO: 185508 - RNA, 64 nt, Human
gauucaacuugccauacaccucaaauucggagaaacaguuaauuugggcaaaucuacaguucug

SEQ ID NO: 185509 - RNA, 64 nt, Human
uauagcaguaauuuuaaauuuaagaguugcuuuuacaguuaacaauggaauaugccuucucugc

SEQ ID NO: 185510 - RNA, 64 nt, Human
uuucuucugaaggauuauuugcacagacuuaaauacaguuaaauguguuauuugcuuuuaaaau

SEQ ID NO: 185511 - RNA, 64 nt, Human
caaaggcuguaaccacagcaacagacuuugugauacaguuaaaaggugcagcugccagugacaa

SEQ ID NO: 185512 - RNA, 64 nt, Human
cucuacacagcuucuggugcuuaaccacauccacacaguuaaaaauaagcugaauuauuauuuc

SEQ ID NO: 185513 - RNA, 64 nt, Human
guguguagcauguaccuuauuauuuuuguuacugacaguuaacaguggugugacauccagagag

SEQ ID NO: 185514 - RNA, 64 nt, Human
uaauuaaaagaacucacauuaagcgguuacucagacaguuaaucauagaaaagauuauuugcuu

SEQ ID NO: 185515 - RNA, 64 nt, Human
ccagggaacauacugauuggucuuaaaagacuagacaguuaaguaaaagguggcuggaacaucu

SEQ ID NO: 185516 - RNA, 64 nt, Human
aaaucccugcccucauggugcucauucuacuugaguagacgaugaacuaguaaacaaauaaaca

SEQ ID NO: 185517 - RNA, 64 nt, Human
aauuuuaaauaaggaaauaaguauguuagaugcaguagacgauacagguugcauguggacacuc

SEQ ID NO: 185518 - RNA, 64 nt, Human
ccuuacuuacagcauaagggagcguagaaucuguguagacgaagggggcaucuggccuuacacc

SEQ ID NO: 185519 - RNA, 64 nt, Human
auuuguauguauauuuugugcauauucaccaauaacaguuaaaauuaauuauguguuauaguua

SEQ ID NO: 185520 - RNA, 64 nt, Human
gcuacugagucacacaagggaaguggaaggaagaacaguuaauuuaagaaugaaacuauaaauc

SEQ ID NO: 185521 - RNA, 64 nt, Human
uuaaaagcagucauuauuuaaaauauguaaacuuacaguuaaaaacaaagguaauaaauacuca

SEQ ID NO: 185522 - RNA, 64 nt, Human
auauuuuuucuuuucuauuguuguacacagaaauacaguuaaguuuuguguguagucuuacgau

SEQ ID NO: 185523 - RNA, 64 nt, Human
uggggagcaagucacgucagcucugucauuccccacaguuaacaaauuggcggggugggaaguc

SEQ ID NO: 185524 - RNA, 64 nt, Human
uucagaucuucauguucaucccacaagugcaagaacaguuaaccuuucuuaauugauuuuugua

SEQ ID NO: 185525 - RNA, 64 nt, Human
aaaauuuucuuuuuuccacaagaggaaauguaaaacaguuaagacuugaaauugaaaauucuuu

SEQ ID NO: 185526 - RNA, 64 nt, Human
cuuuucgauuaaaaaaauuuccuauaacugcuaaacaguuaaaaacuuuaaaguaguaaaugag

SEQ ID NO: 185527 - RNA, 64 nt, Human
uacuauaaauauggguuaaaguauaauguacuagacaguuaaauauuuuuaauaaauguuuccc

SEQ ID NO: 185528 - RNA, 64 nt, Human
uucugcauuugaauguuucguauauuuuuguuucacaguuaaucuucccuccccaaguuugcua

SEQ ID NO: 185529 - RNA, 64 nt, Human
uccuacuggccccuuggagccuccccuagcuuacacaguuaacuugauuuuaaaauccaaggcc

SEQ ID NO: 185530 - RNA, 64 nt, Human
uggggccucgcuuucccaucuuaaauuucuaaaaacaguuaagacaacaggcauuuucuuucuu

SEQ ID NO: 185531 - RNA, 64 nt, Human
uaucccuagaaaugaugaauaauuugccauuuggacaguuaacauccagguguuacaaagucag

SEQ ID NO: 185532 - RNA, 64 nt, Human
auuacauguagagugucuccuuccuuuucagagaacaguuaaucaaggcaaaucagcaagcccc

SEQ ID NO: 185533 - RNA, 64 nt, Human
uauauaaaaauaaacaaaaaguccuugaagcuuuacaguuaauuuagguaugggcuuacuggac

SEQ ID NO: 185534 - RNA, 64 nt, Human
aaagcagugcauccucaauccacagucuccaacaacaguuaaaacuuugauucucaaaugcaau

SEQ ID NO: 185535 - RNA, 64 nt, Human
uccagagccuaacugcagggugaaaaagucccugcacggccaccacccucgagacugccucuuc

SEQ ID NO: 185536 - RNA, 64 nt, Human
cugccuaauaugauuugccccgauacucaucuugcacggccagaacuguuugguugauuaaaau

SEQ ID NO: 185537 - RNA, 64 nt, Human
caagaagcagcuagacacacgccagggcgccaagcacggccagcuccgcggacccauggacaag

SEQ ID NO: 185538 - RNA, 64 nt, Human
ugauuugcugaacuuucucaguccugauuuuaaaacaguuaagagaguccuugugaggauuaag

SEQ ID NO: 185539 - RNA, 64 nt, Human
uggcugaucuagauaccaugagacacaaaaugagacaguuaaaaggucaguaugaacuauauca

SEQ ID NO: 185540 - RNA, 64 nt, Human
acuaggcugauaaucuuauuuuuuaggcuucuauacaguuaauucuauaaauucucuuucuccc

SEQ ID NO: 185541 - RNA, 64 nt, Human
aaacuacugguguuuuucugccuugagaaaacaaacaguuaaaacaagccucaaauguauuuua

SEQ ID NO: 185542 - RNA, 64 nt, Human
ugccaucauguguuucacaccacaauucugugccacaguuaagagggucugguacccuugcagg

SEQ ID NO: 185543 - RNA, 64 nt, Human
uuuacuucucuccucugcuaguucugauuuggaaacaguuaaaagccaauuuuuagcuccagug

SEQ ID NO: 185544 - RNA, 64 nt, Human
ccauucagauacagguugagcaucccuaaucugaacaguuaaaacccccaaaugccccaaaauc

SEQ ID NO: 185545 - RNA, 64 nt, Human
aacauagguuuacauuuguuuuaauugugugccuacaguuaaaagcaguauuuuuaauguauuu

SEQ ID NO: 185546 - RNA, 64 nt, Human
gauggucuuggaugauggauaaauagggacagggacaguuaaauugggagccuuucuuacaacc

SEQ ID NO: 185547 - RNA, 64 nt, Human
cuaaucaucugcaguucuuuuuguacacuuaauuacaguuaaagaagcaaucuccuuacugugu

SEQ ID NO: 185548 - RNA, 64 nt, Human
uguauggcaaccugguuuagcacuggcauccugaacaguuaagagucacugggaaauuauugua

SEQ ID NO: 185549 - RNA, 64 nt, Human
cucaguugcauuuuuaucgaauacauuuuuaucaacaguuaaagacuauggugguuuuuucaga

SEQ ID NO: 185550 - RNA, 64 nt, Human
uuccagcaaaaauaucaacucguaaggcacuaguacaguuaaacugacaucuuaaaggacaacu

SEQ ID NO: 185551 - RNA, 64 nt, Human
gcauuaaucaacauagaacaucuuauuugaaucaacaguuaacuucaguagucaugugaauaaa

SEQ ID NO: 185552 - RNA, 54 nt, Human
auacaguaaaaaaauccuaggaauacaguuaauaguagucuuugacagaucauc

SEQ ID NO: 185553 - RNA, 64 nt, Human
uagggagaguuguugcugagaauuaagaaaugauacaguuaaugcaacaaaagauggaaaauaa

SEQ ID NO: 185554 - RNA, 64 nt, Human
accggccggcucccaagccagcguugcgcagaugcacggccagcucagaggcggccuuucccgc

SEQ ID NO: 185555 - RNA, 64 nt, Human
cccauuaccuagauggcaccuccuuuggugaaaccacggccaauguuccuuagcugcaccaggc

SEQ ID NO: 185556 - RNA, 64 nt, Human
uucuccagcucagagucaccuggggcacaugugucacggccacucagcucucgcccgccugugc

SEQ ID NO: 185557 - RNA, 64 nt, Human
gagcaauucauccuccucuuuccaucuuugauucacaguuaauaggcuauaaauuuugauaaug

SEQ ID NO: 185558 - RNA, 64 nt, Human
uggaagcacauaacuuguuugguuucacagguucacaguuaagaaggaauuuugccucugaaua

SEQ ID NO: 185559 - RNA, 64 nt, Human
gggagcuauuagagaaggaugaggcagaccauguacaguuaaaauuauaaaaugggguagggaa

SEQ ID NO: 185560 - RNA, 64 nt, Human
ccccccaaaacugauuacaacugcuacagagcagacaguuaagagaaaugagcuugaccuuuaa

SEQ ID NO: 185561 - RNA, 64 nt, Human
ugcugucuuuagggcccuacccaaagucacuguaacaguuaagugugucauuaaccuuucuguc

SEQ ID NO: 185562 - RNA, 64 nt, Human
ucuuuuggaaacccucauguacuauaaauuguguacaguuaaaaaaauauauauauauauauau

SEQ ID NO: 185563 - RNA, 64 nt, Human
augagaggcuuucauugaagaaaagaaaaaaacaacaguuaaaagcuuuuggcucucuguuuca

SEQ ID NO: 185564 - RNA, 64 nt, Human
auuccucucuuguuuauaguaaucuaaggguugaacaguuaaaacggcuucaggauagaaagcu

SEQ ID NO: 185565 - RNA, 64 nt, Human
ggcaguuuugcucuuuuguacauuuuccgaaacuacaguuaaagcagaagucuguuuuuaggaa

SEQ ID NO: 185566 - RNA, 64 nt, Human
uagguugugaugaagugaauagacauaucagugaacaguuaacuauauuaaauuuuuaucauuu

SEQ ID NO: 185567 - RNA, 64 nt, Human
auggaaaguagaugaaacuacuuugaaaauuacgacaguuaagggcugggugcggugucucaca

SEQ ID NO: 185568 - RNA, 64 nt, Human
ggaguuagaaaaagaacaaaugcuaaauagaguaacaguuaaauguauguguacacucuuccca

SEQ ID NO: 185569 - RNA, 64 nt, Human
aaauuacuucaggaaaugaauauaaaauagguucacaguuaaaugaauaagcuuuuguuuauuu

SEQ ID NO: 185570 - RNA, 64 nt, Human
auuauugauuugagguuucccagagauauaguucacaguuaauuguugcgcucuaauacaacug

SEQ ID NO: 185571 - RNA, 64 nt, Human
gcugugcaaaacuuuguauaauucuguguuauuaacaguuaacaaaacuggagcaucugaauua

SEQ ID NO: 185572 - RNA, 64 nt, Human
augucauucuauuugaccaguggccuauuuggucacaguuaauugguguuuucuuauugcacug

SEQ ID NO: 185573 - RNA, 64 nt, Human
gagaccaucugcccagccucacugaggcucaggacacggccacaccaagugcagcccucguccu

SEQ ID NO: 185574 - RNA, 64 nt, Human
ggugacugaccccaucauacccaaagugcaaucucacggccagguucuaugcccuguccaagcg

SEQ ID NO: 185575 - RNA, 64 nt, Human
cgcugcuucgucuucugagggccgggcacggucacacggccacccgccccgcgcaccccacgcc

SEQ ID NO: 185576 - RNA, 64 nt, Human
gcuaaucaaugaauguuuguacucaggucucccuacaguuaaauuuaauguguaacuggaauua

SEQ ID NO: 185577 - RNA, 64 nt, Human
gaauguuuguaaauguacaaguaucaaaguucuuacaguuaauuacugcaacuugcugcuggac

SEQ ID NO: 185578 - RNA, 64 nt, Human
ucuggauauuuaaaacccucauaaacauguugguacaguuaauaaacuuauuuauaauuaugua

SEQ ID NO: 185579 - RNA, 64 nt, Human
aaaaugugaagaaagugugaauuuuaguuuugucacaguuaacugugucaaagagaauuaaaaa

SEQ ID NO: 185580 - RNA, 64 nt, Human
gaaacagcuuaaauauuuugacuagauuagacaaacaguuaauagauccaccauuaggaaucaa

SEQ ID NO: 185581 - RNA, 64 nt, Human
aacacuaugauaggauuuccuaaaguauuuguggacaguuaaaugcuaauuauauacaucugua

SEQ ID NO: 185582 - RNA, 64 nt, Human
cugucuaugauaggauuuccaaaaguauuuguggacaguuaaaugcuaauuaauauacaucugu

SEQ ID NO: 185583 - RNA, 64 nt, Human
uacaagagacuuuagauugaucugcaugaagaucacaguuaaguauacaggaguagaacugcau

SEQ ID NO: 185584 - RNA, 64 nt, Human
aaaucauaacuugaugaugcuugggaaagacucaacaguuaaaacuucaugaaguucuaauguc

SEQ ID NO: 185585 - RNA, 64 nt, Human
guauuaucaagguauagacuuuuuugguuaugauacaguuaagccaaaaacagcuaaucuuugc

SEQ ID NO: 185586 - RNA, 64 nt, Human
cuuuaucaagagaacaaaaugccagaauguuaaaacaguuaacucaaaaucuagucaucugugu

SEQ ID NO: 185587 - RNA, 64 nt, Human
gaaguagguguuuucccuauuccucccacuaaguacaguuaacaacccuggauguuacauauaa

SEQ ID NO: 185588 - RNA, 64 nt, Human; identical to SEQ ID NO: 185584

SEQ ID NO: 185589 - RNA, 64 nt, Human
aaaucauaacuugaugaugcuugggaaagaaucaacaguuaaaacuucaugaaguucuaauguc

SEQ ID NO: 185590 - RNA, 64 nt, Human
guaguuaaauacagcacuuaaaaauaccacagacacaguuaaagcaaaaggaaacaauaaaagg

SEQ ID NO: 185591 - RNA, 64 nt, Human
aagguguaugcaaguugaauuugcugacuccagcacaguuaaaaggucaauauucuuuugaccu

SEQ ID NO: 185592 - RNA, 64 nt, Human
cuccaggccgaccagcacuugggaucugaugggacacggccagugccuaggggugccaagucca

SEQ ID NO: 185593 - RNA, 64 nt, Human
gccccaggcaggcuagaggaggcacaggcccugccacggccaacucaggucagccagccugagg

SEQ ID NO: 185594 - RNA, 64 nt, Human
gauugggacuggggcugaagguugaagaggugagcacggccaacaaagcuguugaugguaggug

SEQ ID NO: 185595 - RNA, 64 nt, Human
gugugcauguaaaccugacacagacaaaauaaaaacaguuaagaaugcaucugcacuguagugc

SEQ ID NO: 185596 - RNA, 64 nt, Human
ucgagucuuuaauuguaaugacuuuguuuuauccacaguuaagccuuuucucauuacauauuua

SEQ ID NO: 185597 - RNA, 64 nt, Human
gagcuuggaacaagggggaauaaacccagaaaauacaguuaaacagauggcugugucauucuug

SEQ ID NO: 185598 - RNA, 64 nt, Human
ggccugacucagccucugauccaucccucaagccacaguuaaugauucagaugucaguagauga

SEQ ID NO: 185599 - RNA, 64 nt, Human
guaaacauuagaauccuguuuagagcuauucugcacaguuaacuacugaucuuuagaaucuaaa

SEQ ID NO: 185600 - RNA, 64 nt, Human
uuccaugcaguuauuagaacuuaguuuuguuccaacaguuaaacuugcaaugaaaagaaaaugu

SEQ ID NO: 185601 - RNA, 64 nt, Human
agguaacaguuugauaacuagggaagaaagcagaacaguuaagcagccgccacauccccgcugg

SEQ ID NO: 185602 - RNA, 64 nt, Human
uuuucaauuuggagcauuaacuaaaugcucauacacaguuaaauaaauagaaagaguucuaugg

SEQ ID NO: 185603 - RNA, 64 nt, Human
accuuaccugaguuucuguauguguauuugcaagacaguuaauacuaauccaucaucccucaca

SEQ ID NO: 185604 - RNA, 64 nt, Human
ucuuuauugcugcuuucaacauuuacguuugguuacaguuaacuauuuucggaguguggugauu

SEQ ID NO: 185605 - RNA, 64 nt, Human
ucuccccuuugaagacuuugaggccacagaaaagacaguuaaagcaaagaagagaagugacuuu

SEQ ID NO: 185606 - RNA, 64 nt, Human
aggaaagaaugagucuaauaucaagccuguacagacaguuaauaucacugcaggcuuuccugug

SEQ ID NO: 185607 - RNA, 64 nt, Human
ccuuccaagagaagaaaaagaagagaaacuagaaacaguuaaagugucuaauaaugcugaagac

SEQ ID NO: 185608 - RNA, 64 nt, Human
uauauagauaucuagaaaacuugguuuguggugcacaguuaaguguuggaucacuaaauaacca

SEQ ID NO: 185609 - RNA, 64 nt, Human
gaccaauuuuauuccuaagaauaaacaaaccccuacaguuaaaaugcaaagaugccugucaucu

SEQ ID NO: 185610 - RNA, 64 nt, Human
acaaagaacaaaagguuuaauauauuacagagaaacaguuaaugauaauguaauauuuuuuaaa

SEQ ID NO: 185611 - RNA, 64 nt, Human
cucccaaagugcugggauuacuggugugagccaccacggccagcugcuagcacauuucuuaccu

SEQ ID NO: 185612 - RNA, 64 nt, Human
acugagggaacugcuggcucgccuggcaccaccacacggccacagccagccaucugcucugcca

SEQ ID NO: 185613 - RNA, 64 nt, Human
gggugcucccaagguucaaauacuuuuuauuagacacggccaggcagagaagaccaugggaguu

SEQ ID NO: 185614 - RNA, 64 nt, Human
gaacagugguuaauccugacucuguuuuugacugacaguuaacaguuacaugaaccauucauau

SEQ ID NO: 185615 - RNA, 64 nt, Human
ucugcagaaagugggguaagaaagggcacauggcacaguuaaaguuguagaaaucaaauuacua

SEQ ID NO: 185616 - RNA, 64 nt, Human
caggccacggcagccuaccggcaauuuccggccaacaguuaaaugagaacaugaaaacagaaaa

SEQ ID NO: 185617 - RNA, 64 nt, Human
uuacuccccaucagaagaucgaguuuuaugcaucacaguuaacaugucagcuggcccuccaggc

SEQ ID NO: 185618 - RNA, 64 nt, Human
auaaaaauuucuggaauacugacauguaaagacuacaguuaauucugacacuguaucuuauuaa

SEQ ID NO: 185619 - RNA, 64 nt, Human
uauacaucuccucuccuuggagacacugaagcucacaguuaacggauuguaaugcccggcuuuu

SEQ ID NO: 185620 - RNA, 64 nt, Human
uucugaauaauguaaaacacucaaaagccaguuaacaguuaauuaccagauauguuugugcaug

SEQ ID NO: 185621 - RNA, 64 nt, Human
uaguauagcaagccaucaagcauuaauugacauuacaguuaaaugagcacugaccugaguuuga

SEQ ID NO: 185622 - RNA, 64 nt, Human
aagugacaauacguauagauugcugggcagugaaacaguuaagaugucaccguagcuugcuuuc

SEQ ID NO: 185623 - RNA, 64 nt, Human
ucagucagcacuucaucucaggcaaccacaggugacaguuaaacaugaugaaaccgcaugcuau

SEQ ID NO: 185624 - RNA, 64 nt, Human
ugauacacaagcaccaauaaagacuaauccauacacaguuaaccuaaugccaaauaaauacugg

SEQ ID NO: 185625 - RNA, 64 nt, Human
accguucaacuucaagaguuuuucuaccucuuuaacaguuaauauuuuuuaaaggaagaaaugg

SEQ ID NO: 185626 - RNA, 64 nt, Human
auuucaucucauguuuucuuauugucacaagaguacaguuaaugcugcgugcugcugaacucug

SEQ ID NO: 185627 - RNA, 64 nt, Human
aauaacucccaaccugaccaauuucacacugccaacaguuaaacaaccagauugcaagauuccu

SEQ ID NO: 185628 - RNA, 64 nt, Human
gaacuaaaaaauguuagauguuggugauaaguugacaguuaaauaaaauucucuaaaauugcuu

SEQ ID NO: 185629 - RNA, 64 nt, Human
gcaccuacugugaguagaugaucuccugucaaagacaguuaacaaauccucggaauauugcuuc

SEQ ID NO: 185630 - RNA, 64 nt, Human
ggacccugcgugugagcgugccugacaucucacgcacggccacuccagagccggucccuguccu

SEQ ID NO: 185631 - RNA, 64 nt, Human
ugcaauaugggcgggcagucgcugcagggagcaccacggccagaaguaacuuauuuuguacuag

SEQ ID NO: 185632 - RNA, 64 nt, Human
gaaugccuucauugugaggaagggugcuccaagucacggccacuagguugucuucacccaugua

SEQ ID NO: 185633 - RNA, 64 nt, Human
uaagaaucaaaaauaaagaaaauaaaaaaugcauacaguuaaacauuccaaauauauucugaaa

SEQ ID NO: 185634 - RNA, 64 nt, Human
uguuaccagucccagccaaucuuacggugacauuacaguuaaauuucccaauugaaaacaagca

SEQ ID NO: 185635 - RNA, 64 nt, Human
aauauuuggugguuuuuuuuuuuuuuaaacauccacaguuaagguugggccagcuaccuuuggg

SEQ ID NO: 185636 - RNA, 64 nt, Human
cuccccucauccgauuccccucuaucagucacugacaguuaauaaaccuuugcaaacguucccc

SEQ ID NO: 185637 - RNA, 64 nt, Human
cuccccucauccgauuccccuguaucagucacugacaguuaauaaaccuuugcaaacguucccc

SEQ ID NO: 185638 - RNA, 64 nt, Human
cuccccucauccgauuccccucuaucagucacugacaguuaacaaaccuuugcaaacauucccc

SEQ ID NO: 185639 - RNA, 64 nt, Human
cuccccucauccgauuccccuguagcagucacugacaguuaauaaaccuuugcaaacguucccc

SEQ ID NO: 185640 - RNA, 64 nt, Human
aauauuuagaguaggaugcagccucuuaugcaccacaguuaaaucuagaacgaacaaaauuuca

SEQ ID NO: 185641 - RNA, 64 nt, Human
cucguuuucucacugauucaugccaauuaagccuacaguuaaagaccaguuuuguucuuuucac

SEQ ID NO: 185642 - RNA, 64 nt, Human
gauuucuguccacacaaagguuaaauuagauugcacaguuaauuuucacuuauauuuaugguac

SEQ ID NO: 185643 - RNA, 64 nt, Human
aauugaaacacuauuaacccuguguauagugucaacaguuaaagcagacgaaacgaaguaagcu

SEQ ID NO: 185644 - RNA, 64 nt, Human
cuaaucaucauuuguuagucuguaguuaaugucaacaguuaauuuaugaacccacgaucguucc

SEQ ID NO: 185645 - RNA, 64 nt, Human
auaacauggauugaauguuuacugugcgucaagcacaguuaauauaugaugauguaaaguaacu

SEQ ID NO: 185646 - RNA, 64 nt, Human
acuccccuccucugauuccccguaucagucacugacaguuaauacaccuuugcaaacguucccc

SEQ ID NO: 185647 - RNA, 64 nt, Human
cuccccucauccgauuccguuguaucagucacugacaguuaauaaaccuuugcaaacguucccc

SEQ ID NO: 185648 - RNA, 64 nt, Human; identical to SEQ ID NO: 185646

SEQ ID NO: 185649 - RNA, 64 nt, Human
uaugccaaauaucaagaugugaaggacuaauucaggaugcaaaaacguuauugggggguuguaa

SEQ ID NO: 185650 - RNA, 64 nt, Human
gggggguuguaaauaucaacuauucaacaguuuaggaugcaauuacgaguguaaacugugugcc

SEQ ID NO: 185651 - RNA, 64 nt, Human
uuuaugcuuuaccauauaucaggaauuauauccaggaugcaauacucagacacuagcuuuuuuc

SEQ ID NO: 185652 - RNA, 64 nt, Human
uacaaauguguuuuucaguaggcuucaauuacaaacaguuaaguacuuguuucuuaauaguuuc

SEQ ID NO: 185653 - RNA, 64 nt, Human
auguuucuauguggauucuguaauguuccuccauacaguuaaaacauccuaacuuguuuuucaa

SEQ ID NO: 185654 - RNA, 64 nt, Human
auuucagaaauacagauaaaugauucaaaaagucacaguuaaggagaaucauguuucuuugauc

SEQ ID NO: 185655 - RNA, 64 nt, Human
aagauuguucuguguaaauaugucuuuauaauaaacaguuaaaagcugacaguucgcccuuacu

SEQ ID NO: 185656 - RNA, 64 nt, Human
ucgccgguggcucauuuucuggcaaauggaggcacgaacgcaggggccaaauagcaauaaaugg

SEQ ID NO: 185657 - RNA, 64 nt, Human
agagagggauagaaaacaagcgcaggagagccugcgaacgcaaaagugaaugagggcuuuuugu

SEQ ID NO: 185658 - RNA, 64 nt, Human
ccccucucauggggaggaaagagcuuccagggggcgaacgcagcacagaggaagaggccugcuc

SEQ ID NO: 185659 - RNA, 64 nt, Human
uggcgucugaaagagaauuacgccgcggaguacgcgaacgcacuggagaaggggcugccggacc

SEQ ID NO: 185660 - RNA, 64 nt, Human
ggagagggccccggacacgcgcguuuucuccugccgaacgcaggggcugcccugacuuugcucu

SEQ ID NO: 185661 - RNA, 64 nt, Human
aggcuggaaagcccucccacuaaaauugauaaaccgaacgcaugccacugugccaauuagacug

SEQ ID NO: 185662 - RNA, 64 nt, Human
caaccaaacugguccauuagauuccgaaaaacagguagacgaggaaguagacaguggaagugag

SEQ ID NO: 185663 - RNA, 64 nt, Human
cugcagguaaaaugcaauuaggacaacuaaccaaguagacgaaacaaguuccccuaggcagggg

SEQ ID NO: 185664 - RNA, 64 nt, Human
caccucauuccuguguuuucucuacuauugagcuguagacgaacuguuucucuaauuauaaagc

SEQ ID NO: 185665 - RNA, 64 nt, Human
caagagugguggcagcucaaaaugauauguuugaguagacgaacagcugacauggaguucccgu

SEQ ID NO: 185666 - RNA, 64 nt, Human
acgucacccuccucuucuagguugggugggugacguagacgacuacucgcugcacgggggcugc

SEQ ID NO: 185667 - RNA, 62 nt, Human
gagacaauguuuucuuuuucaggugaguaguugccgcguaauaucauuggaguacauucuuu

SEQ ID NO: 185668 - RNA, 62 nt, Human
caggggagaacccuacauggaaucauauucuagccgcguauucauuaguuuuuagcugggug

SEQ ID NO: 185669 - RNA, 60 nt, Human
uccuugcaauaucguuaauggcccuuuucagggccgcguacguuuucuuccgaagggcuc

SEQ ID NO: 185670 - RNA, 62 nt, Human
gcacgcgcaccucauuguggugcuggacaagggccgcguagugcagcagggcacccaccagc

SEQ ID NO: 185671 - RNA, 62 nt, Human
cuagggcuuucgguuuccccuucuuccgguaggccgcguagaggcaugcaccggguagguuu

SEQ ID NO: 185672 - RNA, 62 nt, Human
ggcccgaggccugcccuggcacacgcguuuccgccgcguauggauauacacauguuuucggc

SEQ ID NO: 185673 - RNA, 64 nt, Human
ucuucaacuucguguccuggaucgccuucuucaccacggccagcgucuacgacggcaaguaccu

SEQ ID NO: 185674 - RNA, 64 nt, Human
cuugggacuuugguccacguccugagccacugaccacggccagucucucuuuuuauaugugcag

SEQ ID NO: 185675 - RNA, 64 nt, Human
auggacugagggacuucucagaggcagggcagcacacggccagccccgcggccuggcgcuccga

SEQ ID NO: 185676 - RNA, 64 nt, Human
gucucauauccccaccccuucccacggcgugucccacggccagacacaugcacacacaucacac

SEQ ID NO: 185677 - RNA, 64 nt, Human
ccccuaagaccacaguggccaagaucacaguggccacggccacggccacagucaugguggccac

SEQ ID NO: 185678 - RNA, 64 nt, Human
agaccacaguggccaagaucacaguggccacggccacggccacagucaugguggccacggccac

SEQ ID NO: 185679 - RNA, 64 nt, Human
caguggccacggccacggccacagucaugguggccacggccacagccacuaaucaggaggccag

SEQ ID NO: 185680 - RNA, 64 nt, Human
gggggaucucagagcuuacaggcugagccaagcccacggccaugcacagggacacucacacagg

SEQ ID NO: 185681 - RNA, 64 nt, Human
ugcaacuccacucagcccugacaacccauccacacacggccaggccuguuuaucuacacugcug

SEQ ID NO: 185682 - RNA, 64 nt, Human
cccauaauuguguaucuuccagccaggaauccuacacggccagcauguauuucuacaaauaaag

SEQ ID NO: 185683 - RNA, 64 nt, Human
uugaccaggaugacuggggagcuuggcagaaguucacggccagugcaggaauccagguagugga

SEQ ID NO: 185684 - RNA, 64 nt, Human
auauuuucuucuggucacaaaauaaagaaauuugggaugcaaaguaccuaaagaucucugaucc

SEQ ID NO: 185685 - RNA, 64 nt, Human
gccagaugcagagaaagcuaaaugugggaaucauggaugcaaagaagaauuuggcuuuuugaaa

SEQ ID NO: 185686 - RNA, 64 nt, Human
gaggugggaggaucuauugagcccuggaauucgaggaugcaauuaauugugguugugucacagu

SEQ ID NO: 185687 - RNA, 64 nt, Human
aagguggugcuucugccauuagacgcaguuaggaggaugcaacugcaaaucuaaaauuacgaag

SEQ ID NO: 185688 - RNA, 64 nt, Human
aaggaaaaaagcaaguuugaagagaccacauggggcguacuauuuuuauugagcccaaaaacaa

SEQ ID NO: 185689 - RNA, 64 nt, Human
ccaggccccaccggccaggccgcgcccagcagaggcguacuacccagcucuguccucuuggcca

SEQ ID NO: 185690 - RNA, 64 nt, Human
aaacuacauguggccagcuccauucuuccacacugcguacuacauuuccugccuuuuucuuuca

SEQ ID NO: 185691 - RNA, 64 nt, Human
agaaucuuaccuugugcagucaucagaaauuccagcguacuauaaugaaaacauccuuguuuug

SEQ ID NO: 185692 - RNA, 64 nt, Human
ugauguuugcaaaauaagacugaagagacacgaggcguacuagucuuuuaucagcccuguccaa

SEQ ID NO: 185693 - RNA, 64 nt, Human
agaauuuauuugaaauagaauagguaacaccucagcguacuauagaaaaugcacucagcucaac

SEQ ID NO: 185694 - RNA, 64 nt, Human
cccaagagcuagcacaguuagaguaggagggggugcguacuagcacgugcccaguugcucagug

SEQ ID NO: 185695 - RNA, 64 nt, Human
aguugaggauguugaacaacaugggaaggucgcagcguacuaagugaagaagucagaggacaga

SEQ ID NO: 185696 - RNA, 64 nt, Human
cauccccuuguacaguaaggcuuaucaugacagagcguacuauuucugauguacaguauuuuuu

SEQ ID NO: 185697 - RNA, 64 nt, Human
ugugccccauugagcuucacagugucaggcuggacgccgugauuucagggaccuaugucacaau

SEQ ID NO: 185698 - RNA, 64 nt, Human
aaaaaaggaaaaguuaaacuaaaaaaaaaaaggccgccgugaccuauucacccuccacuucccg

SEQ ID NO: 185699 - RNA, 64 nt, Human
gcuuuaaaaagaaugaacgagcaaaagguauccccgccgugaccccugcagauagcaccggucu

SEQ ID NO: 185700 - RNA, 64 nt, Human
aagguggagcaacaaugcaccuccccuccugucgcgccgugauaucuugguggcucccugccac

SEQ ID NO: 185701 - RNA, 64 nt, Human
uggagacgggugggcggcuggagaccaugcagagcgccgugaguucucagggcuccugccuucu

SEQ ID NO: 185702 - RNA, 64 nt, Human
cuccugcacgcggacuccgggguucggaucgcuccgccgugaguauuugcguccgcacgcggcc

SEQ ID NO: 185703 - RNA, 64 nt, Human
aagucacagcagacacgcuagacagcauaguccuggaugcaaccuggaggaagggaggcccaug

SEQ ID NO: 185704 - RNA, 64 nt, Human
gcuaccccgucccccuccagacuggcaguuucaaggaugcaaauugcauugcaaaaucaaacug

SEQ ID NO: 185705 - RNA, 64 nt, Human
gcuguuucuaguuucuuaaauagcccacaccccuggaugcaaaaaggcaggguuauuuuuaccc

SEQ ID NO: 185706 - RNA, 64 nt, Human
uuaaaaaaaaaaauaaccaguaugaaagucguugcgccgugaaucucuacuguagccaugaauu

SEQ ID NO: 185707 - RNA, 64 nt, Human
gcuccaagugagccucucgcugcaguaacaguuccgccgugacccacaccccaaaggcucuuuu

SEQ ID NO: 185708 - RNA, 64 nt, Human
aacuuuccaguuuagguccccgucacugucuccacgccgugauggcagcgcugccgaggacaua

SEQ ID NO: 185709 - RNA, 51 nt, Human
aggagacagaaacggagugaccgccgugaauguagacgcccuaggaggaga

SEQ ID NO: 185710 - RNA, 64 nt, Human
acagucucacugggcuccacccucacuuacugcccgccgugauggccuugaggcugccugcccg

SEQ ID NO: 185711 - RNA, 64 nt, Human
cugccgccccuccccgccugccuggacugcgcggcgccgugagggggauucggcccagcucguc

SEQ ID NO: 185712 - RNA, 64 nt, Human
gggccacaaaucuggcgaaaaacuucaugcuggccgccgugagguuuuacuccagcguucccgc

SEQ ID NO: 185713 - RNA, 64 nt, Human
ccgagggaagagaggccgugacuagcucuuucuccgccgugagcucgcuuggucagcaaacuaa

SEQ ID NO: 185714 - RNA, 64 nt, Human
gagccucacccaucugcccucugcagcccagggccgccgugagcgggauucagcaaugguggaa

SEQ ID NO: 185715 - RNA, 64 nt, Human
cagugucuguggcacucacugcuuuucuaaggcucgccgugagccaggucuaaaguuugaagaa

SEQ ID NO: 185716 - RNA, 63 nt, Human
agcaccgcuucauggucuaaugcugcugccugccgccgugacugcguuuuaguucucuaaauu

SEQ ID NO: 185717 - RNA, 64 nt, Human
gcugcucccuccuagggaacccauuuccggggaacgccgugacugucgggcagccuggagcuuc

SEQ ID NO: 185718 - RNA, 64 nt, Human
ugcgcagggcgcgggggggaggcuggggucccgccgccgugaugaauguacugacgagccgagg

SEQ ID NO: 185719 - RNA, 64 nt, Human
ugucuacacaguauacacaggacaucguugcugccgccgugacugguuuucuguccccaagaac

SEQ ID NO: 185720 - RNA, 64 nt, Human
caccacccugcacuuccggacccgccgcuggaggcgccgugaggcguuggugucuccuggaugc

SEQ ID NO: 185721 - RNA, 64 nt, Human
uuuguccaagacucagugucccgacccuuguucucgccgugaaugucaaugggccaauccucuc

SEQ ID NO: 185722 - RNA, 64 nt, Human
agagugauccuacuauaugacggaaacuuuggcuggaugcaagagcuuuaaauugguagaaaag

SEQ ID NO: 185723 - RNA, 64 nt, Human
uuuauagcuaauuuuagcuaucuguaaccaagauggaugcaaagaggcuagugccucagagaga

SEQ ID NO: 185724 - RNA, 64 nt, Human
aagcaauaguugaagggaaggugcauauuaucacggaugcaauuuauguugugugccagucugg

SEQ ID NO: 185725 - RNA, 64 nt, Human
ccaucucuacgcgcuuucuugucccacagggagccgccgugaugagcacagccaacccaguucc

SEQ ID NO: 185726 - RNA, 64 nt, Human
ucuacgaauaggaggcgcaggcugacaggaaggucgccgugagucaagcugccuccagaaccuc

SEQ ID NO: 185727 - RNA, 64 nt, Human
ccaccuccuccagaaagcccucggccugggccgccgccgugacucuagcacucucagucgcugu

SEQ ID NO: 185728 - RNA, 64 nt, Human
guaaccuuugcuuucuuuuuaagggaagcgguuccgccgugaacuuggaacccucagcuccggg

SEQ ID NO: 185729 - RNA, 64 nt, Human
cccugccucccaccgcuuuauuucuuucgguuucggaugcaaaacaaaaaauuuuaaaagaaaa

SEQ ID NO: 185730 - RNA, 64 nt, Human
uacagauauuaaguaugcaauuacuuguauuauaggaugcaaggucaucauauguaaaugccuu

SEQ ID NO: 185731 - RNA, 64 nt, Human
ucuuaccacaugguggagggauggaggaacuacaggaugcaauucuucuucuaccaaugggcaa

SEQ ID NO: 185732 - RNA, 64 nt, Human
uaugaguguaggacacugagccauccgugggucaggaugcaauuauuuauaaaagucuccaggu

SEQ ID NO: 185733 - RNA, 64 nt, Human
ugugauauuacuucgcuauuaaauaaagaaaauuggaugcaagacaauggagaaacuuuaaaac

SEQ ID NO: 185734 - RNA, 64 nt, Human
uguaauuuucuuuuuaauuacuuuagagagcuagggaugcaaauguuuucaguuagaaagccuu

SEQ ID NO: 185735 - RNA, 64 nt, Human
gacacguggaagucaguuuaauugccagagagaaggaugcaaucacuagguaaaaugagguuuu

SEQ ID NO: 185736 - RNA, 64 nt, Human
uuuaauuuuaaagucaguguacugcaaggaagcuggaugcaagauagauacuauauuaaacugu

SEQ ID NO: 185737 - RNA, 64 nt, Human
ugggguuggggcuggguggucuggauuauggccuggaugcaauaaaguacugugacaguagcca

SEQ ID NO: 185738 - RNA, 64 nt, Human
guuugaagcucagagggagaugggcaauugacagggaugcaauccagggugggauuucuugagg

SEQ ID NO: 185739 - RNA, 64 nt, Human
accuuagaagaguuuaaaaucucccaggccuuuaggaugcaauaggauauuaugccuugguuug

SEQ ID NO: 185740 - RNA, 64 nt, Human
ggaugaagcccaguuaaccaggccggugugggcugugucguagccaaggugggcugagcccugg

SEQ ID NO: 185741 - RNA, 64 nt, Human
acaaaauuauaaagguagaaaauaaaccuaaauugugucguaauuaagauuauuaaaauuagaa

SEQ ID NO: 185742 - RNA, 64 nt, Human
uggagucaagcccuuauaagucaaaagcaucuaugugucguaaaacauuccucaaacauuuuuu

SEQ ID NO: 185743 - RNA, 64 nt, Human
cacuuuucaaagcucaugcauguucaucauguuagugucguauuuugagcugggguuuugagac

SEQ ID NO: 185744 - RNA, 64 nt, Human
gccucacaaaccuguuauuccaguguaaucugcagugucguaacuaaaguuacuggcuuggucu

SEQ ID NO: 185745 - RNA, 64 nt, Human
caucagauaaaugacccucccaagcaccaugucagugucguacaaucuaccaaccaaccagugc

SEQ ID NO: 185746 - RNA, 64 nt, Human
ccccagaccuccugugaggugaggcucuguugcagugucguaggcugugugugucuguaaagaa

SEQ ID NO: 185747 - RNA, 64 nt, Human
aaauauaaauuuagugguauccuauauuacuuuagugucguacgcuuuguaagacuuaaauauu

SEQ ID NO: 185748 - RNA, 64 nt, Human
agaaucucuuucuuaauuggccaaauauaaguuggugucguaacuccaggccacagugaguuau

SEQ ID NO: 185749 - RNA, 64 nt, Human
cuacuaggguagggaggacuuagggauguuuccugugucguaugugcuuuucuuucuuucauau

SEQ ID NO: 185750 - RNA, 64 nt, Human
aacaauauauuccuuaaauuaagaggaaagacaagugucguauuucgauccuguuuauucaaau

SEQ ID NO: 185751 - RNA, 64 nt, Human
gccaucacuggaauuucccaccgcuuugugagccgugucguaugaccuaguaaacuuuguacca

SEQ ID NO: 185752 - RNA, 64 nt, Human
ccuuuaaucugccaacuguggucaaaguucauaggugucguacauuuccauuauuugcuaaaau

SEQ ID NO: 185753 - RNA, 64 nt, Human
aaggaaguuauuugaguaacaacaaaagugcuuagugucguacuuuacacaucauagguguucu

SEQ ID NO: 185754 - RNA, 64 nt, Human
acuacaguuuuuuacaaauuggaacagcuuuggugugucguaaucaaggguuuuuuuuguuugu

SEQ ID NO: 185755 - RNA, 64 nt, Human
uacucuccuauuuguauuuuguguuccuaucaaagugucguaucugggagaugaccugccuuau

SEQ ID NO: 185756 - RNA, 64 nt, Human; identical to SEQ ID NO: 84608

SEQ ID NO: 185757 - RNA, 64 nt, Human; identical to SEQ ID NO: 84609

SEQ ID NO: 185758 - RNA, 64 nt, Human; identical to SEQ ID NO: 84610

SEQ ID NO: 185759 - RNA, 64 nt, Human
auguuucaauucacaaaggcuaauuguugaacuggugucguagaagaaauugucuacaggagcc

SEQ ID NO: 185760 - RNA, 64 nt, Human
ucaggaagaccgccuuguagguauuacaucccuggugucguauuuugccuguuaaaucguaaca

SEQ ID NO: 185761 - RNA, 64 nt, Human
gaaugaagcaggaaggccggagugggaaguacaugugucguaucauaguucauuuuauguggga

SEQ ID NO: 185762 - RNA, 64 nt, Human
ccucagugagaucagucagcuccgaguggcucccgugucguaacagcaggagcauggccgcaac

SEQ ID NO: 185763 - RNA, 64 nt, Human
guuacucuguucaucacaguguaaauggugaugcgugucguaggugugcagcuauuugagggac

SEQ ID NO: 185764 - RNA, 64 nt, Human
ucacggcuguuggacaucucgguaucaccguugaugaacucauugguuucacaagucauuugug

SEQ ID NO: 185765 - RNA, 64 nt, Human
agucuccacugccugaguuuuguuucggcugguuugaacucauuucgggugugugcauuuuucu

SEQ ID NO: 185766 - RNA, 64 nt, Human
gcugguggggaaaugauggugaaggguguuugcuugaacucaugagacgguccaaaucucauaa

SEQ ID NO: 185767 - RNA, 64 nt, Human
cugcccucugaggccuccggacuccucucguacuugaacucacucccucacggggagagagacc

SEQ ID NO: 185768 - RNA, 64 nt, Human
cucacauucaaaccaaaccaacgacuauguuuaaugaacucaguauucaaauuuauuauauaug

SEQ ID NO: 185769 - RNA, 64 nt, Human
cacuaaguuucgggaacuuauccccgacagugacugaacucacugacuaauaacuucauuuaug

SEQ ID NO: 185770 - RNA, 64 nt, Human
uccagagauagguauuuuuuguaggcuguuucacugaacucaguuaaugaaaacuguauuaaca

SEQ ID NO: 185771 - RNA, 64 nt, Human
gccuuuuuugcaccuuuguacagcagccaaaucaugaacucaaaauguauuugaucacaguucu

SEQ ID NO: 185772 - RNA, 64 nt, Human
uguccucccuccucucaaacucuccaguguggugugaacucagaagaaacgguuacuggggcug

SEQ ID NO: 185773 - RNA, 64 nt, Human
gcccagcccggcccgcgucucgaaggggcaccugugaacucaaaaggcucuuuucagagccacc

SEQ ID NO: 185774 - RNA, 64 nt, Human
ggaaugaagggccuuagaaccugcauagaagaaaugaacucacugcauuucugugcucccuccu

SEQ ID NO: 185775 - RNA, 64 nt, Human; identical to SEQ ID NO: 84558

SEQ ID NO: 185776 - RNA, 64 nt, Human; identical to SEQ ID NO: 84559

SEQ ID NO: 185777 - RNA, 64 nt, Human; identical to SEQ ID NO: 84560

SEQ ID NO: 185778 - RNA, 64 nt, Human
ccuauuauaauugucaugacuuucagauuguaucugaacucacagacugcugucuuacuaauag

SEQ ID NO: 185779 - RNA, 64 nt, Human
aaugaagaauaaagccuacuaggucucuaacuguugaacucaugaaagaagauaguguaugaga

SEQ ID NO: 185780 - RNA, 64 nt, Human
aauuuacugugccaggaaaucuuccugaacuccuugaacucauacacacagguauuugaguccu

SEQ ID NO: 185781 - RNA, 64 nt, Human
ucuccaaccuauuuucuauaagaugagguaguggugaacucagauaacaaacuucucuucuaaa

SEQ ID NO: 185782 - RNA, 64 nt, Human
aacaugacaagaaagcuauagaaaaaauaaacauugaacucaguucuucaagguuucaucacca

SEQ ID NO: 185783 - RNA, 64 nt, Human
aucuagauuaaugacugagaauaagauccacauuugaacucauuccuaagugaacauggacgua

SEQ ID NO: 185784 - RNA, 64 nt, Human
uuucuauauuuugagauguuuuuuccuuacaaugugaacucaucgugaucuuggaaaucaauaa

SEQ ID NO: 185785 - RNA, 64 nt, Human
gauuccauauaaaagacauuguaauggaguggauugaacucacagauggauaccaacacgguca

SEQ ID NO: 185786 - RNA, 64 nt, Human
acaggaaauaaaguaauaugaaaaacacccugcgugaacucaacggugugaacaggucaagaau

SEQ ID NO: 185787 - RNA, 64 nt, Human
uugaaccaugcauuccaucuauauuccuccugucugaacucaugcucuuuugauuauguuuuga

SEQ ID NO: 185788 - RNA, 64 nt, Human
aaccacuucauacauuuaaguauuuuguuugguuugaacucaaucaguagcuuuuccuuacaug

SEQ ID NO: 185789 - RNA, 64 nt, Human
cuucucccuucaucuugaucugggaagaaugaaaugaacucagcuacacucucugauuuugugc

SEQ ID NO: 185790 - RNA, 64 nt, Human
aaggaauucaggggaguuccagagacuuacaaaaugaacucauuuuauuuucccaccuucaaau

SEQ ID NO: 185791 - RNA, 64 nt, Human
uuucaccguguugcccaggcuguucuaaaacuccugaacucagguaaucugccugccucggccu

SEQ ID NO: 185792 - RNA, 64 nt, Human
cuuugagaggccgaggugagacgggaagauggcuugaacucaggaguucgagacuagccugggc

SEQ ID NO: 185793 - RNA, 64 nt, Human
uuauagcucccaaaugaugaguuugucaucuuuaugaacucaugacaggauaauaagcuugaag

SEQ ID NO: 185794 - RNA, 64 nt, Human; identical to SEQ ID NO: 84688

SEQ ID NO: 185795 - RNA, 64 nt, Human; identical to SEQ ID NO: 84689

SEQ ID NO: 185796 - RNA, 64 nt, Human; identical to SEQ ID NO: 84690

SEQ ID NO: 185797 - RNA, 64 nt, Human
cauaguugaagcuuaaauucaaguuuucuggcccugaacucauauuccuuucuaauauagcaca

SEQ ID NO: 185798 - RNA, 64 nt, Human
cacaguccuuucugcagcuucuaacccaggaccaugaacucaggugccuagagaagccaggcag

SEQ ID NO: 185799 - RNA, 64 nt, Human
cuuggguuggagggacagugaagcuuagagcacaugaacucaagguuagugacucugcaggacu

SEQ ID NO: 185800 - RNA, 64 nt, Human
cacaucuugguauguggccauauuuauagaaugcugaacucaaugugcaaguuguacuguaugc

SEQ ID NO: 185801 - RNA, 64 nt, Human
uggaucauuauccauuuaaucaucuaauuagacaugaacucaguuagcugaaucauuuacauuu

SEQ ID NO: 185802 - RNA, 64 nt, Human
ugugaagaacugugcuacauucaggcuuacccauugaacucaguauauauauuuuuuuccuucc

SEQ ID NO: 185803 - RNA, 64 nt, Human
gagugggccuaacucaugugagcuugauaacugaugaacucauugggagcauuuuaaacuuuuc

SEQ ID NO: 185804 - RNA, 64 nt, Human
ggggucuugguuucauaaauggguauauacagccugaacucaggaggcagaaaucaaaagaaau

SEQ ID NO: 185805 - RNA, 64 nt, Human
cucuuccaagccuacaacuucaaguuuuaucauuugaacucaaguacuuuugcugcugaggaau

SEQ ID NO: 185806 - RNA, 64 nt, Human
gaggggagcgagugcuguuuuugagaucauuaucugaacucaggcagccuaguagaggcagugg

SEQ ID NO: 185807 - RNA, 64 nt, Human
guaaugcuuucuuuuuuccuuuauugccaaucuuugaacucauucaacuccaggacauggaaga

SEQ ID NO: 185808 - RNA, 64 nt, Human
ucauucucaugucauucugcacacagucucugcaugaacucaggcagacccuucauuuaaugac

SEQ ID NO: 185809 - RNA, 64 nt, Human
cagcaucaaagagauggugcuaaaccauucaugaugaacucacccccaugauccaaucaccucc

SEQ ID NO: 185810 - RNA, 64 nt, Human
auuuccaauuucauccaugucccuacaaaggacaugaacucaucauuuuuuauggcugcauggu

SEQ ID NO: 185811 - RNA, 64 nt, Human
caguaaaaguacuuuuauuguaaauaaacaaucaugaacucaacacucugccugaauauaugcc

SEQ ID NO: 185812 - RNA, 64 nt, Human
cuaacacaaaaggucuaugugugugguuaguccaugaacucauggcauuuugaauacauccagu

SEQ ID NO: 185813 - RNA, 64 nt, Human; identical to SEQ ID NO: 84498

SEQ ID NO: 185814 - RNA, 64 nt, Human; identical to SEQ ID NO: 84499

SEQ ID NO: 185815 - RNA, 64 nt, Human; identical to SEQ ID NO: 84500

SEQ ID NO: 185816 - RNA, 64 nt, Human
caucugacaaagggcuaauaaccagaaucuacaaugaacucaaacaaauuuacaagaaaaaaac

SEQ ID NO: 185817 - RNA, 64 nt, Human
cgcaugucccaacaccuuggguucauuugcccggugaacucacuuuaagcauuggauuaacgga

SEQ ID NO: 185818 - RNA, 64 nt, Human
auaggcuguuggugaaauucuuaagaaguuguaaugaacucaaaauugaggccagagcuugcuu

SEQ ID NO: 185819 - RNA, 64 nt, Human
cuggaaccaguagcaaggagcccgagaucagcccugaacucacuguguauucucuuggagccuu

SEQ ID NO: 185820 - RNA, 64 nt, Human
gcaccaaagcuggcaccagggcucggaaggucucugaacucagaaggauggcauuuuuugcaag

SEQ ID NO: 185821 - RNA, 64 nt, Human
aaauaguuuucucaaccauuuaaaaauauucuucugaacucaucaaaguagaagagcccccaac

SEQ ID NO: 185822 - RNA, 64 nt, Human
caccugcaaucaaguccuacaagcuaaaauuagaugaacucaacuuugacaaccaugagaccac

SEQ ID NO: 185823 - RNA, 64 nt, Human
caugccuggcagucggaggagagcgcccagacucugaacucagcagaaaguggcaagaagaggg

SEQ ID NO: 185824 - RNA, 64 nt, Human
guuuccagcuucauccauguuccuacaaaggacaugaacucauccuuuuuuauggcugcauagu

SEQ ID NO: 185825 - RNA, 64 nt, Human
uauauuugugguagccuccaucuuuuaaacuuuuugaacucaguagaaaaacagacugaaauuu

SEQ ID NO: 185826 - RNA, 64 nt, Human
ccagccugguguuguucuucccuauacuucacacugaacucaggaugggaagaaaaaggaaaca

SEQ ID NO: 185827 - RNA, 64 nt, Human
agccagauggaagaagaugaagaaggaaaccaggugaacucagcaaggcagacuggcugcuuac

SEQ ID NO: 185828 - RNA, 64 nt, Human
gacaacccaucaucaaaauuacaaauuuucugauugaacucaucugaaucaucaguuccuugau

SEQ ID NO: 185829 - RNA, 64 nt, Human
uuguuauuauuuucuuagccagaacaucucucuuugaacucacacugauacacaccugcuacuc

SEQ ID NO: 185830 - RNA, 64 nt, Human
ccccaaccuuuacuccaccagagaaacuuccuuuugaacucaguggggaagagggugaugagac

SEQ ID NO: 185831 - RNA, 64 nt, Human
agcagauaccucacccugcuacacauacaggauuugaacucagaucugucugauaggaauguga

SEQ ID NO: 185832 - RNA, 64 nt, Human; identical to SEQ ID NO: 84564

SEQ ID NO: 185833 - RNA, 64 nt, Human; identical to SEQ ID NO: 84565

SEQ ID NO: 185834 - RNA, 64 nt, Human; identical to SEQ ID NO: 84566

SEQ ID NO: 185835 - RNA, 64 nt, Human
ucucaggccagcuggcgauggguggcuagagugaugaacucaagcccuguggccacaguucugg

SEQ ID NO: 185836 - RNA, 64 nt, Human
caugugguuuugcagacaacccuguccucaggccugaacucaccauagagacccaugucagcaa

SEQ ID NO: 185837 - RNA, 64 nt, Human
ugcagaggccggucaguggagccccuagcacgugugaacucaggcuuuucauugggcccggcuc

SEQ ID NO: 185838 - RNA, 64 nt, Human
agagaaccacccccaagucuccguucuacugccgugaacucauguguugccauguacagaggcc

SEQ ID NO: 185839 - RNA, 64 nt, Human
uacuaaagauaaagacaaagcacauuuucuagaaugaacucacagagaugugcuggcuuagacu

SEQ ID NO: 185840 - RNA, 64 nt, Human
aaacuguguuuauguguuauuauauuuauauuucugaacucaguacauguuaauauuuaaauaa

SEQ ID NO: 185841 - RNA, 64 nt, Human
ggccccagagacucuaugucugcccguccaucagugaacucauuaaaacuugugcaguguugcu

SEQ ID NO: 185842 - RNA, 64 nt, Human
agcacccuuauguuacuaaagccuagucuaacacugaacucauguucuugaugagaauacuucu

SEQ ID NO: 185843 - RNA, 64 nt, Human
ugcuguugagccucugguaagcuuucaucucccaugaacucauuuccccauaaaugaaaugggu

SEQ ID NO: 185844 - RNA, 64 nt, Human
cagauggaaauauuuugauaauaaauugaaauugugaacucauugcucccuaagacugugacaa

SEQ ID NO: 185845 - RNA, 64 nt, Human
uugaaaaaucuugguacugcuaaauuauuugauaugaacucaauccagcauuuguagcagguuu

SEQ ID NO: 185846 - RNA, 64 nt, Human
ugaaggccaaaauaaugacuucagcaagagugacugaacucacucuaaggccuuugacugcaga

SEQ ID NO: 185847 - RNA, 64 nt, Human
ucuguguuuugacugucacuuuggcauccucugaugaacucacacaugccucagugccucagug

SEQ ID NO: 185848 - RNA, 64 nt, Human
uuuuauccuuuuugauagacaguuucauauaucuugaacucaauaucucagaucucuucuacug

SEQ ID NO: 185849 - RNA, 64 nt, Human
ugcuuagaaugguucucaagaauuauaagagaaaugaacucacaguacaaaaauuuuauaauua

SEQ ID NO: 185850 - RNA, 64 nt, Human
cugucaacccucccuugguuuccaugaucauugcugaacucagagcuuucuucuauccccagac

SEQ ID NO: 185851 - RNA, 64 nt, Human; identical to SEQ ID NO: 84504

SEQ ID NO: 185852 - RNA, 64 nt, Human; identical to SEQ ID NO: 84505

SEQ ID NO: 185853 - RNA, 64 nt, Human; identical to SEQ ID NO: 84506

SEQ ID NO: 185854 - RNA, 64 nt, Human
gcuccaagggugugugggcagagagcuugcuaugugaacucacuccuuaagaaaauggaagaga

SEQ ID NO: 185855 - RNA, 64 nt, Human
auuauauccaagguaauauaaaagccauuacguaugaacucauccgugucucauuuuguguuuu

SEQ ID NO: 185856 - RNA, 64 nt, Human
ugcucccuagguggaaccacuucuucugccucauugaacucaacauccuucagacuuuuaaggc

SEQ ID NO: 185857 - RNA, 64 nt, Human
augaagauaaaaagaagugacaucucuuguacacugaacucacagaacauuuguuuacaauucu

SEQ ID NO: 185858 - RNA, 64 nt, Human
guuuccaauuucauccaugucccuacaaaggacaugaacucaucauuuuuuauggcugcauagu

SEQ ID NO: 185859 - RNA, 64 nt, Human
uagcuacucaggaggcugaggcaugagaaucgcuugaacucagcaaguggagguugcuaugagc

SEQ ID NO: 185860 - RNA, 64 nt, Human
ucucuggaaaaggagauaauacaauuccagaaagugaacucauauuucuaagguuaagauuccc

SEQ ID NO: 185861 - RNA, 64 nt, Human
uuaagauguuuccauucuccugugaauuuuaacuugaacucauuccugauguuugauacccugg

SEQ ID NO: 185862 - RNA, 64 nt, Human
cgggaaacacacauauacacauacaccaugcccuugaacucaaagcaaacuacgcucucaggga

SEQ ID NO: 185863 - RNA, 64 nt, Human
aacuuauuacuuuaaaggaaaggauuuggagaauugaacucacaaacugauguuauauacucaa

SEQ ID NO: 185864 - RNA, 64 nt, Human
cucacccccgcugcuucgaguuguccugccuuucugaacucaaccaauguauuucuuaaaugua

SEQ ID NO: 185865 - RNA, 64 nt, Human
ugggguugcuccggggccagguucuccuauuuccugaacucagcugaggccuugccuugaaggg

SEQ ID NO: 185866 - RNA, 64 nt, Human
cccuggggacauugggaaggugggcaggggcaagugaacucagcacucugcagugagagggaca

SEQ ID NO: 185867 - RNA, 64 nt, Human
ccucuucccaggaaccaucgccuucuauaaaccgugaacucaagcaggcauuuuuuuuuucuua

SEQ ID NO: 185868 - RNA, 64 nt, Human
ucuugaugauucaucuccaugagugcacaaucccugaacucacugucuuuucuccacacuuguc

SEQ ID NO: 185869 - RNA, 64 nt, Human
uuuauaaccacuugaguguuauugcagugauauuugaacucauuugaauauauucaguaucauu

SEQ ID NO: 185870 - RNA, 64 nt, Human; identical to SEQ ID NO: 84614

SEQ ID NO: 185871 - RNA, 55 nt, Human; identical to SEQ ID NO: 84615

SEQ ID NO: 185872 - RNA, 64 nt, Human; identical to SEQ ID NO: 84616

SEQ ID NO: 185873 - RNA, 64 nt, Human
uugucaagggucuccuuuuaacugagaaacuuuuugaacucacaaaguguucaagaaacccuug

SEQ ID NO: 185874 - RNA, 64 nt, Human
auaugccaaauagcuuuuauaguaaaccauguaaugaacucaaauuuaaauggugucuucagau

SEQ ID NO: 185875 - RNA, 64 nt, Human
uuaugcacucaucaaaauguacuaauggguacucugaacucauuaacauugacaucugcaacag

SEQ ID NO: 185876 - RNA, 64 nt, Human
cuugaguauaaauguacaccaguuuuuguauuugugaacucaucugugggaggaguaaagaaaa

SEQ ID NO: 185877 - RNA, 64 nt, Human
cucuucugaaaucauuguaaagaaauaaaaauauugaacucauagcaggagaauaguuuuuaaa

SEQ ID NO: 185878 - RNA, 64 nt, Human
uucuucugggucuuacagucuuuggcugaaauucugaacucagaaguccccuccaaggcaucca

SEQ ID NO: 185879 - RNA, 64 nt, Human
aauaaagggcuguuucuacagguaacauuaaaugugaacucaacacuuccagagucuuuaaagg

SEQ ID NO: 185880 - RNA, 64 nt, Human
gucagaguaaguaggcagcacuuuuaaaaauaugugaacucaaauauugcacuucuuucaagau

SEQ ID NO: 185881 - RNA, 64 nt, Human
aauguuuuuccccaguacuauaacuugugguuucugaacucauuauuguuguauuuccaaaaaa

SEQ ID NO: 185882 - RNA, 64 nt, Human
aggagaacucuuuucccugaaaaaggaaaaauauugaacucaaugauagcaccuaaacuuacau

SEQ ID NO: 185883 - RNA, 64 nt, Human
cuaaacaaagacuuucauauuaaauggguucaauugaacucauuucuuauuuuccaagugucaa

SEQ ID NO: 185884 - RNA, 64 nt, Human
agcagcuucuggaauauaaugugcauguccaaaaugaacucagcgcuucaaaaggacaaagucu

SEQ ID NO: 185885 - RNA, 64 nt, Human
gcauuaagaaagguaacaaucuucauucuacagaugaacucauugaaacaauuuaggggaauga

SEQ ID NO: 185886 - RNA, 64 nt, Human
uaauaaauuuaucuuuugaggucauuagcaaacaugaacucacagggauccagagaugguaaaa

SEQ ID NO: 185887 - RNA, 64 nt, Human
cuggcagaugauguggauuucaaagagcccagaaugaacucaucacuggcuuagacaguccugg

SEQ ID NO: 185888 - RNA, 64 nt, Human
cagcuacuugggagguugaggcaggagaaucauuugaacucaggaggcggaaguugcggugagc

SEQ ID NO: 185889 - RNA, 64 nt, Human; identical to SEQ ID NO: 84510

SEQ ID NO: 185890 - RNA, 64 nt, Human; identical to SEQ ID NO: 84511

SEQ ID NO: 185891 - RNA, 64 nt, Human; identical to SEQ ID NO: 84512

SEQ ID NO: 185892 - RNA, 64 nt, Human
ucaugguggaugaggaagccucaacguagauuccugaacucaagguaccagcaagaaugccuuc

SEQ ID NO: 185893 - RNA, 64 nt, Human
acccugugaaagucucccuugaguucaggugcccugaacucaguacagccucaucuucucaucc

SEQ ID NO: 185894 - RNA, 64 nt, Human
ggcagagccccucagugcucugagaaaccugcccugaacucaccgccuccccugccugggcacu

SEQ ID NO: 185895 - RNA, 64 nt, Human
uugcagcuuucgcccucugcuuugauggcugaggugaacucauguucuuugggaaaagggaagg

SEQ ID NO: 185896 - RNA, 64 nt, Human
ucccucuccuuccgcuggguccccuggggaggugugaacucaagggccuagccccaaaacacuu

SEQ ID NO: 185897 - RNA, 64 nt, Human
agauuauucaggacuguccuuuaguucugucuuuugaacucaugggaauaauugugagucagcg

SEQ ID NO: 185898 - RNA, 64 nt, Human
aaauacagugagcacuuauguaaccagaugauaaugaacucaaaugucaugauagcuugcauaa

SEQ ID NO: 185899 - RNA, 64 nt, Human
ggagaaauucaggacaggagugaacucaaggccaugaacucacuggauuuccauuuuuaggcac

SEQ ID NO: 185900 - RNA, 64 nt, Human
cuggaccugcacugggagaaauucaggacaggagugaacucaaggccaugaacucacuggauuu

SEQ ID NO: 185901 - RNA, 64 nt, Human
cagauguaaauuaacucaccagauuuacugggccugaacucauucucuucuugcuauaugauuu

SEQ ID NO: 185902 - RNA, 64 nt, Human
aaauguuuuuuaguucuagcuacuaaaaccuguaugaacucaaauggauaggcaucuugugagg

SEQ ID NO: 185903 - RNA, 64 nt, Human
uauaucacugcuuuauauaaguuauuuuuuaaggugaacucagauguuaugguuuuguaaaugu

SEQ ID NO: 185904 - RNA, 64 nt, Human
aagaacaugugaaagguguuuuuuuuuuccaauaugaacucaugcaaguuaccaaaacugugau

SEQ ID NO: 185905 - RNA, 64 nt, Human
ucaccauguguuggucaggcuggucuugaacuccugaacucaagugauccaccugccucgaccu

SEQ ID NO: 185906 - RNA, 64 nt, Human
aauugcagggcugugauuccucuuaccuuuaacgugaacucacaggcggauuaaagugaaauaa

SEQ ID NO: 185907 - RNA, 64 nt, Human
augguguuccuuaaaagaagaaaauuucuaauucugaacucaauguuuugcuuuuacucccuuu

SEQ ID NO: 185908 - RNA, 64 nt, Human; identical to SEQ ID NO: 84570

SEQ ID NO: 185909 - RNA, 64 nt, Human; identical to SEQ ID NO: 84571

SEQ ID NO: 185910 - RNA, 64 nt, Human; identical to SEQ ID NO: 84572

SEQ ID NO: 185911 - RNA, 64 nt, Human
uagcuacuugggagucugaggcaggagaauugcuugaacucaggaggugaagguugcaguaagc

SEQ ID NO: 185912 - RNA, 64 nt, Human
auuuuuaauauggcauguaaagcuuuuaaaguuaugaacucagugaucagcacagcaaguuaag

SEQ ID NO: 185913 - RNA, 64 nt, Human
aguuauggugaugacuuagcgucaagacauuugcugaacucagcacauucgggaccaauauaua

SEQ ID NO: 185914 - RNA, 64 nt, Human
cagggcugaauccccccuccuugaccccgaacagugaacucaggcagcuggcucuguguuggcu

SEQ ID NO: 185915 - RNA, 64 nt, Human
gagcccagggcacugguuauauucaguaggaaacugaacucagcacucagaauuuuaaauuaaa

SEQ ID NO: 185916 - RNA, 64 nt, Human
aggucugcguucuccuaguuuguuugcugccauuugaacucauguagggaaugaaagaaagcug

SEQ ID NO: 185917 - RNA, 64 nt, Human
gugcgugccccgggguggguaucuagcucugagaugaacucaguuauaggagaaaaccuccaug

SEQ ID NO: 185918 - RNA, 64 nt, Human
ugguguucuugucuuaacccuagauagaaucuaaugaacucagaggcuuagcucgccucuuuag

SEQ ID NO: 185919 - RNA, 64 nt, Human
gccuugugguuucaggacugcaaggacuccagugugaacucaggaggggcaggugucagaacug

SEQ ID NO: 185920 - RNA, 64 nt, Human
uuuugccacguugcuuaggcuggucuugaacuccugaacucaagugauccgcccaccucagccu

SEQ ID NO: 185921 - RNA, 64 nt, Human
ugcugacagauccaagaccuagaccuaggucuuuugaacucaaguccagcauucucaacuauau

SEQ ID NO: 185922 - RNA, 64 nt, Human
uauaagucaaaagcaagaaaaacguaaucccgucugaacucaaguagucauucauauaaauuug

SEQ ID NO: 185923 - RNA, 64 nt, Human
aaggaggaagucaauugggcaucugcuaauagaaugaacucaugauggaaacuucaguucauuu

SEQ ID NO: 185924 - RNA, 64 nt, Human
acuaagcgugaggauucccguagcucuucacagcugaacucagucuauggguuggggcucagau

SEQ ID NO: 185925 - RNA, 64 nt, Human
acaaaaaugugagagcagugagguccgaggaggaugaacucagaaagcaccagccagagaauuu

SEQ ID NO: 185926 - RNA, 64 nt, Human
cagcuacucaggagucugaggcacgagaaucaccugaacucaggaggcggagguugcggugagc

SEQ ID NO: 185927 - RNA, 64 nt, Human; identical to SEQ ID NO: 84516

SEQ ID NO: 185928 - RNA, 64 nt, Human; identical to SEQ ID NO: 84517

SEQ ID NO: 185929 - RNA, 64 nt, Human; identical to SEQ ID NO: 42598

SEQ ID NO: 185930 - RNA, 64 nt, Human
gagcguauccccaacugggacuuccgaggcaacuugaacucagaacacuacagcggagacgcca

SEQ ID NO: 185931 - RNA, 64 nt, Human
ggcaggucuagugagcuguagaauugaaucaaugugaacucagggaacuggggaaggcugagcc

SEQ ID NO: 185932 - RNA, 64 nt, Human
agggguagaagaucucugaaacuugucuugagauugaacucauucccuguuccacaaacccaua

SEQ ID NO: 185933 - RNA, 64 nt, Human
uaguuuugccccucccagcaaccuaagaccagucugaacucacacugucugaaaggccacccag

SEQ ID NO: 185934 - RNA, 64 nt, Human
cuuuugcuugaguggacaguagcaccuguaucauugaacucauuuuguaucagagcaauuuugc

SEQ ID NO: 185935 - RNA, 64 nt, Human
aagggcuuugaugccagcauccuuggaucaguacugaacucaguuccauccguaaaauauguaa

SEQ ID NO: 185936 - RNA, 64 nt, Human
aauaugcagacuuacuuuuaaucauuugaauaucugaacucauuuaccucauuucuugccaauu

SEQ ID NO: 185937 - RNA, 64 nt, Human
uaugguuugccuuaauauauauuuguuuuagucaugaacucauaauccauugaugcucuuucau

SEQ ID NO: 185938 - RNA, 64 nt, Human
uaaaauacaaacccauguugaucuuucucaaucuugaacucauagauuauuaucuauuaucuca

SEQ ID NO: 185939 - RNA, 64 nt, Human
gaaacaaugucuaacccaacccuaucuugaaaguugaacucaaguagaaaaauggauagaaaca

SEQ ID NO: 185940 - RNA, 64 nt, Human
aagcagaacagccucccgaaugaagcguugccauugaacucaccagugaguuagcagcacgugu

SEQ ID NO: 185941 - RNA, 64 nt, Human
aauucucuuagcuuguguguguuucuuuaauauuugaacucaagugggauuagaagacuaucaa

SEQ ID NO: 185942 - RNA, 64 nt, Human
ugaggaaaaauucuuuaacuuuggaauauugcauugaacucagcuauacacauaaaacauuuuc

SEQ ID NO: 185943 - RNA, 64 nt, Human
aaaugcugcauaaucucacuguggaaucuuaaguugaacucauagaaggagagaauagaauggu

SEQ ID NO: 185944 - RNA, 64 nt, Human
uuuugugagauuauuuuuauaugaaggaauagccugaacucaaacagaugguaagaauaguaca

SEQ ID NO: 185945 - RNA, 51 nt, Human
gcccagucuguuucaaauaaaugaacucaaucuaaauuaaaaaagaaagaa

SEQ ID NO: 185946 - RNA, 64 nt, Human; identical to SEQ ID NO: 84654

SEQ ID NO: 185947 - RNA, 64 nt, Human; identical to SEQ ID NO: 84655

SEQ ID NO: 185948 - RNA, 64 nt, Human; identical to SEQ ID NO: 84656

SEQ ID NO: 185949 - RNA, 64 nt, Human
uuaaagugaauuuuuaaagacaaagcauucuaaaugaacucaauauaaaaacauucauuuggaa

SEQ ID NO: 185950 - RNA, 64 nt, Human
ugaaguauuuugcuggaauaaguucaaauucuucugaacucaaacugaggaauuucaccuguaa

SEQ ID NO: 185951 - RNA, 64 nt, Human
auuauaacaaggcaaauuguaauauauauaauccugaacucaugaccaugucucgguuuauuuu

SEQ ID NO: 185952 - RNA, 64 nt, Human
ucuguccuaaugggcuuaccuccucuuugccuuuugaacucacuucaaagaucuaggccucauc

SEQ ID NO: 185953 - RNA, 64 nt, Human
uuaauuaauauuuuuagacucugugcugucauacugaacucacugcuagcuaagagaccuauca

SEQ ID NO: 185954 - RNA, 64 nt, Human
acgcgcaaaacacccagagacggcacaaggagguugaacucauguuucaguucgcgaacauuga

SEQ ID NO: 185955 - RNA, 64 nt, Human
uuauuguugcaguucugaugagcugcagguuuuuugaacucacuucuggaggugcagagccaca

SEQ ID NO: 185956 - RNA, 64 nt, Human
cacccauugugauuguggaagauagaauucaauuugaacucagguuguuuaugaggggaaaaaa

SEQ ID NO: 185957 - RNA, 64 nt, Human
gacggcauucaggaagcccugcaaacgugcuuuuugaacucauuggccaggugugauuuuuaca

SEQ ID NO: 185958 - RNA, 64 nt, Human
aggcuuuaaaaauuaaaaauggauggaucuucucugaacucagggagggcacauacuuagauac

SEQ ID NO: 185959 - RNA, 64 nt, Human
cuuacauaccaguacaugcuccucuguaagcagcugaacucaccggccacuucucuguuugccu

SEQ ID NO: 185960 - RNA, 64 nt, Human
ccuccucaccagaaaucccugggcuuccacaaugugaacucacucauugucagguguccgugga

SEQ ID NO: 185961 - RNA, 64 nt, Human
aguugggcagggaaaagggucaggguucaucaggugaacucaacacugggaugagacuagaacu

SEQ ID NO: 185962 - RNA, 64 nt, Human
auuuccagcuucauccaugucccuacaaaggacaugaacucaucauuuuuuauggcugcauagu

SEQ ID NO: 185963 - RNA, 64 nt, Human
gggugacaaauugggccaauaaaucugccaucuuugaacucaucuuugguggcuagacugcuac

SEQ ID NO: 185964 - RNA, 64 nt, Human
cuuugugggcuuuuauagucucuguugcugcugcugaacucagcuguuguagcacgaaagcagc

SEQ ID NO: 185965 - RNA, 64 nt, Human; identical to SEQ ID NO: 84522

SEQ ID NO: 185966 - RNA, 64 nt, Human; identical to SEQ ID NO: 84523

SEQ ID NO: 185967 - RNA, 52 nt, Human; identical to SEQ ID NO: 84524

SEQ ID NO: 185968 - RNA, 64 nt, Human
cacacugcguauguguacgcgcagcaugcuauacugaacucaacaagaucuuggcuguacauaa

SEQ ID NO: 185969 - RNA, 64 nt, Human
caggugugagccaccacuccuggccaacuguaguugaacucagguauuggaagggcuuccguuu

SEQ ID NO: 185970 - RNA, 64 nt, Human
ccagcacuagagaccgcucagugcucuuacuagaugaacucaguaacgccuugagcuggguuga

SEQ ID NO: 185971 - RNA, 64 nt, Human
agggcauauaauuuuacacucaaaguauaauugcugaacucagggguggguagacuucaaaaau

SEQ ID NO: 185972 - RNA, 64 nt, Human
aguaauuccuaguuacaauagauacauaaaguaaugaacucagcauucuguacuuuugcuucag

SEQ ID NO: 185973 - RNA, 53 nt, Human
uagagacaaccccucgcuagacgugaacucagaacugucggaggaaagacaac

SEQ ID NO: 185974 - RNA, 64 nt, Human
agaucaaaguucaaauuaauuuuaacuuagcuaaugaacucaucaccaggacaguuggaggggg

SEQ ID NO: 185975 - RNA, 64 nt, Human
ccaguuuucaaucuucgacagcugggcuggaacgugaacucaguagcugaaccugucugacccg

SEQ ID NO: 185976 - RNA, 64 nt, Human
gaaagccagaagacugcaguggauuucugaaacuugaacucagagcccagugggaagccagagg

SEQ ID NO: 185977 - RNA, 64 nt, Human
ccguguguccuaaaaaucuccuaaaaccagucuaugaacucagggcuuuaaaacauuuuuaauu

SEQ ID NO: 185978 - RNA, 64 nt, Human
guacguacaguuuugcuuauuauuugaugugacaugaacucaaaauccugcauuuuuagauucc

SEQ ID NO: 185979 - RNA, 64 nt, Human
gagauucagggucacagguuuuuccccacaccucugaacucagggccuagccacccccaaacuu

SEQ ID NO: 185980 - RNA, 64 nt, Human
cggggggucaccuuuucacaaauguagaccuccaugaacucauuggaugacccuggacagagcg

SEQ ID NO: 185981 - RNA, 64 nt, Human
aacucuauuauggaacccaauggacauauggguuugaacucacacuuuuuuuuuuuuuuuuguu

SEQ ID NO: 185982 - RNA, 64 nt, Human
gagacugagcagccgccagcugggagcacuggugugaacucacccugggagccaguccuccacu

SEQ ID NO: 185983 - RNA, 64 nt, Human
ggggcaaaugcuaccuauuugugucaccuuuugcugaacucacaguuagacaauccaugguuua

SEQ ID NO: 185984 - RNA, 64 nt, Human; identical to SEQ ID NO: 84576

SEQ ID NO: 185985 - RNA, 64 nt, Human; identical to SEQ ID NO: 84577

SEQ ID NO: 185986 - RNA, 64 nt, Human; identical to SEQ ID NO: 84578

SEQ ID NO: 185987 - RNA, 64 nt, Human
cuuaucaauuggauucauuuugguauccuguuuuugaacucagcuuaagaacuucucaucucaa

SEQ ID NO: 185988 - RNA, 64 nt, Human
gccaucagaaauuuucuacaguacaugacccggaugaacucaaugcaugaugacucuucuuauc

SEQ ID NO: 185989 - RNA, 64 nt, Human
ccuacucuuuagauguucucagucaaguacucacugaacucauugaucgagugcugucugcuaa

SEQ ID NO: 185990 - RNA, 64 nt, Human
ucugcgcuccauuccuggggguucagccugagagugaacucagcugucaucugcagccucugcc

SEQ ID NO: 185991 - RNA, 64 nt, Human
aagcaauggaaacuuuuacccauguaauucuagcugaacucaggaaaaagaagggggaaaggac

SEQ ID NO: 185992 - RNA, 64 nt, Human
gcaauagaaggcaaaaaauggaagugaauuaagaugaacucaucugaaauacacaaaugcauua

SEQ ID NO: 185993 - RNA, 64 nt, Human
gccuaguggguaguuccccugaugagcagaaaaaugaacucaaaucaggcaagacucuagguuc

SEQ ID NO: 185994 - RNA, 64 nt, Human
uucuuguuugcugaguaauuguuucuaaugucucugaacucaaagugaggugcuccaagacgcu

SEQ ID NO: 185995 - RNA, 64 nt, Human
cagcuacuugggaggcugaggugggaggaucacuugaacucaggaguuugagagcagccagggc

SEQ ID NO: 185996 - RNA, 64 nt, Human
uuauuauuauuauuauuauuuacagucauauuacugaacucaguguccaguauaaugcagaauu

SEQ ID NO: 185997 - RNA, 64 nt, Human
agaaagagagaaacacuucugcugucaccuugaaugaacucaggaauagcuucccucuggacug

SEQ ID NO: 185998 - RNA, 64 nt, Human
aaaaauggagccugaagggaaucaggcaaggaaaugaacucaggauucagagaucuuugaauua

SEQ ID NO: 185999 - RNA, 64 nt, Human
augaaugacuccaggaagaagguuaucaugaaacugaacucaccauuucuauuaauuucuguug

SEQ ID NO: 186000 - RNA, 64 nt, Human
uuuaauuguauguauuuggugcuucuucagggauugaacucaguaucuuucauuaaaaaacaca

SEQ ID NO: 186001 - RNA, 64 nt, Human
agccaggcugagugagccacagaccaccugcuucugaacucaagcugcguuuauuaaugccucu

SEQ ID NO: 186002 - RNA, 64 nt, Human
cucagcaagugauagcggaggcaccacgaagcugugaacucagagccccucccugcuaccaagg

SEQ ID NO: 186003 - RNA, 64 nt, Human; identical to SEQ ID NO: 84528

SEQ ID NO: 186004 - RNA, 64 nt, Human; identical to SEQ ID NO: 84529

SEQ ID NO: 186005 - RNA, 64 nt, Human; identical to SEQ ID NO: 84530

SEQ ID NO: 186006 - RNA, 64 nt, Human
gcugacugcaccagcgcccccagaacauacacugugaacucaaucuccagggcuccaaaucugc

SEQ ID NO: 186007 - RNA, 64 nt, Human
acagcaccucuuguccaggugcaucucauacaccugaacucauuugcaucauuuuaaccaucuu

SEQ ID NO: 186008 - RNA, 64 nt, Human
auucaauaagucauauuaaaaauauacaauuucuugaacucaggacuagccugaaaauccaaaa

SEQ ID NO: 186009 - RNA, 64 nt, Human
augaggagccagaagaaacagagcccgacuugaaugaacucagcucagaguucuaaggaccagc

SEQ ID NO: 186010 - RNA, 64 nt, Human
augagauucaaccaccgaugcccaccguggucuuugaacucacccaagcacccaccaggcaggc

SEQ ID NO: 186011 - RNA, 64 nt, Human
acgccauuuauggcaugauuagauugcaaagcaaugaacucaagaaggaauugaaauaaggagg

SEQ ID NO: 186012 - RNA, 64 nt, Human
ccccagcugacccugugagcccaagcaggccugcugaacucagaggagaaagccugagugagua

SEQ ID NO: 186013 - RNA, 64 nt, Human
agucucacagguaguauaugguggagccaacacuugaacucagaccuuuuuacacaaaauccca

SEQ ID NO: 186014 - RNA, 64 nt, Human
cuuuuccccguccaggccuugggggcucggacccugaacucagacucuacagauugcccuccaa

SEQ ID NO: 186015 - RNA, 64 nt, Human
agugacagggaagcuacagguuacaacagauuugugaacucagccaagcacagugguggcaggg

SEQ ID NO: 186016 - RNA, 64 nt, Human
auuuaaugaaaagguacaacagaauaaugcaugaugaacucaccuaauuaugaggugggaggag

SEQ ID NO: 186017 - RNA, 64 nt, Human
auggcuuuaaaaaaaaaacaaaaacacacacacaugaacucagauuugcaaaccagguuucuga

SEQ ID NO: 186018 - RNA, 64 nt, Human
cccgcccccucacacacaaacacacauguccuguugaacucaugcacgcacacccacgugccug

SEQ ID NO: 186019 - RNA, 64 nt, Human
gggcuucucugauuccaggauacauuacuuuagcugaacucagauuuagugcaaguaaaauguu

SEQ ID NO: 186020 - RNA, 64 nt, Human
ggauccucauuuguauaccuaguggaaaggacucugaacucagaggagucacuguuccuuuuuu

SEQ ID NO: 186021 - RNA, 64 nt, Human
gcaagacagaaaccuccaucaaaccucacauuugugaacucaaacgaugugcaauacauuuuuu

SEQ ID NO: 186022 - RNA, 64 nt, Human; identical to SEQ ID NO: 84620

SEQ ID NO: 186023 - RNA, 64 nt, Human; identical to SEQ ID NO: 84621

SEQ ID NO: 186024 - RNA, 64 nt, Human; identical to SEQ ID NO: 84622

SEQ ID NO: 186025 - RNA, 64 nt, Human
cagaauaaaguuguauuucaaauaucuaagcaagugaacucaucccuuguuuauaaauagcauu

SEQ ID NO: 186026 - RNA, 64 nt, Human
aaaauuugacuccucuucaagcuugaaaacccucugaacucagucuucuuuaccucauuaucac

SEQ ID NO: 186027 - RNA, 64 nt, Human
ucaaaaaaaaaaaauaauaauaaaauaagugagcugaacucaccugaagugguuuacuucugug

SEQ ID NO: 186028 - RNA, 64 nt, Human
uaacuguucuuugccagaacacaagacaccaaauugaacucacugcuuuugaggcaucuggaaa

SEQ ID NO: 186029 - RNA, 64 nt, Human
gggaugacuucagauucugcuggccaaggcaaauugaacucaguucaagauggccaccacuggu

SEQ ID NO: 186030 - RNA, 64 nt, Human; identical to SEQ ID NO: 186015

SEQ ID NO: 186031 - RNA, 64 nt, Human
uccucauuuaugcauguuuggaggagcugauuccugaacucauauuuaaucucuacugccaggg

SEQ ID NO: 186032 - RNA, 64 nt, Human
auguauauugauguaacugugucaggauugaggaugaacucagguuuccggcuacugacagugg

SEQ ID NO: 186033 - RNA, 64 nt, Human
uuaagagcaauguuuugcuuugcucucugguccaugaacucauuuccauuugagugaguucccu

SEQ ID NO: 186034 - RNA, 64 nt, Human
ugaguuugaaaagucuagaacuccuguaaguuuuugaacucaagggagaagguauaguggaaug

SEQ ID NO: 186035 - RNA, 64 nt, Human
guggugcuagggagaaggcaaccuucacugguuuugaacucagugccuaagaaagucucugaaa

SEQ ID NO: 186036 - RNA, 64 nt, Human
cagcuacucaggaggcugaggcaggagauucgcuugaacucaggagacggagguuacagugagu

SEQ ID NO: 186037 - RNA, 64 nt, Human
uucccucauguuuuacucaaaauaaacauggccaugaacucaggggccauugggauucuccccu

SEQ ID NO: 186038 - RNA, 64 nt, Human
acucaaaacaaaagcgagagagacuauugccauaugaacucaaaagcuaucaugguguucacuc

SEQ ID NO: 186039 - RNA, 64 nt, Human
caauuuugcagggagcauggcugugaggauggggugaacucacgcacagccaaggacuccaaaa

SEQ ID NO: 186040 - RNA, 64 nt, Human
accaaagaaauugucagcuauacauuuaucuuuaugaacucauuuauauuccuuuuuaaugacu

SEQ ID NO: 186041 - RNA, 59 nt, Human; identical to SEQ ID NO: 84474

SEQ ID NO: 186042 - RNA, 59 nt, Human; identical to SEQ ID NO: 84474

SEQ ID NO: 186043 - RNA, 64 nt, Human; identical to SEQ ID NO: 84476

SEQ ID NO: 186044 - RNA, 64 nt, Human
ucccaugucaugcugccagcaucacugaaugcacugaacucagaguugggaagagaugcacaua

SEQ ID NO: 186045 - RNA, 64 nt, Human
ucaucaugguauccaacuugugacucauagggucugaacucacuccaaaagauaauaacugcag

SEQ ID NO: 186046 - RNA, 64 nt, Human
cuccugcuuuccuaaggaugaaacagugauaaugugaacucaaaugagguuuccuggguaaugu

SEQ ID NO: 186047 - RNA, 64 nt, Human
gcuugcucuuggucacagggcgguucugggcacuugaacucagggcccaagcagaagcacaggc

SEQ ID NO: 186048 - RNA, 64 nt, Human
acuucuccuaccucaacagggguccagggugcagugaacucaguucuuggcccuugggugagga

SEQ ID NO: 186049 - RNA, 64 nt, Human
ugaaguuuccuuggcuggugcaccuagaauuggcugaacucaugagaaguugauauagaacagu

SEQ ID NO: 186050 - RNA, 64 nt, Human
uaaaauaucuaacaggugaaaaaggugugaggauugaacucaauaaaccuucagauucagucag

SEQ ID NO: 186051 - RNA, 64 nt, Human
ccccuucccaccauauccacccucgcuccaucuuugaacucaaacacgaggaacuaacugcacc

SEQ ID NO: 186052 - RNA, 64 nt, Human
ucucaccauguugcccaggcuggucuugaacuccugaacucaagcaauccuccugccucagccu

SEQ ID NO: 186053 - RNA, 64 nt, Human
cugcgcuuuggcaguccgaggcaggggaauugcuugaacucaggaguuggagaccagccugggc

SEQ ID NO: 186054 - RNA, 64 nt, Human
cacuaucccagggaugggaggcggaggguagagaugaacucacugagcagccagagccaaaugc

SEQ ID NO: 186055 - RNA, 64 nt, Human
gaagcaaaggauuccaggcuccagaaaaaaugaaugaacucaccuugacgucaaugcaauugaa

SEQ ID NO: 186056 - RNA, 64 nt, Human
ccgugucacuaaacuagugaaugaacccaggauuugaacucaguuacuguacaacugugagcca

SEQ ID NO: 186057 - RNA, 57 nt, Human
aggagacuggucagauguaaucggcagugaacucagaacgcacugcacaccuaaggc

SEQ ID NO: 186058 - RNA, 64 nt, Human
auaaagacaggcuuucuccccuauaguuaggaggugaacucacacauguguaccugaacauucu

SEQ ID NO: 186059 - RNA, 64 nt, Human
gcuaggacgugcguccuugugacacuggccugucugaacucaccuggccugggaagcaccgucu

SEQ ID NO: 186060 - RNA, 64 nt, Human; identical to SEQ ID NO: 84534

SEQ ID NO: 186061 - RNA, 64 nt, Human; identical to SEQ ID NO: 84535

SEQ ID NO: 186062 - RNA, 64 nt, Human; identical to SEQ ID NO: 84536

SEQ ID NO: 186063 - RNA, 64 nt, Human
uggguaacaucaccucgaagguuuacucacccagugaacucaacauguguuuacugaacaccac

SEQ ID NO: 186064 - RNA, 64 nt, Human
ucccagagaucaagcagcccggugccguggccagugaacucagaggugcugguggacgggcuag

SEQ ID NO: 186065 - RNA, 64 nt, Human
guggaggucagggaggugggaaggugggugggccugaacucaggcagcccuucaguggcuucuu

SEQ ID NO: 186066 - RNA, 64 nt, Human
caacguggauggagcuggaagccauuauccuaaaugaacucacucagaaacagaaaaccaaaua

SEQ ID NO: 186067 - RNA, 64 nt, Human
aaucucuccuuggucuuaaggaaaauacuaacauugaacucacugacaugaucuuagcuucuuu

SEQ ID NO: 186068 - RNA, 64 nt, Human
uuuuuucaucccugccaagaacucugggcacuuuugaacucacgagccuugcgcaaaacccaga

SEQ ID NO: 186069 - RNA, 64 nt, Human
uuuugccauauuggccaggcuggucucaaacuccugaacucaagugauaacacccaccuuggcc

SEQ ID NO: 186070 - RNA, 64 nt, Human
agcuacccggggaggcugaggcaggagaauugcuugaacucagaaggcggaggcugcagugagc

SEQ ID NO: 186071 - RNA, 64 nt, Human
aguugucauuccuuugcaacauuaaaauacaugcugaacucauauuuuuccuuccuucacuguu

SEQ ID NO: 186072 - RNA, 64 nt, Human
agcuugaggagcugggaagcucugguggaugcuaugaacucacuugcugaagagcagcguucag

SEQ ID NO: 186073 - RNA, 64 nt, Human
gcuaaauaauaggauugcucauaccagcgcguuaugaacucacccuagcuuguaacggaaucuu

SEQ ID NO: 186074 - RNA, 64 nt, Human
gaaggucagagcccagugaagaucugggagacccugaacucagaaggcugugugucuucugccc

SEQ ID NO: 186075 - RNA, 64 nt, Human
aaaauacaaccaauuuuuauauuucaaaaauauuugaacucaaauaaauuaauuucuuaaaaag

SEQ ID NO: 186076 - RNA, 64 nt, Human
uggguuagaggcgagccuggcaggcagcacagacugaacucagagguagacaggucaccuuacu

SEQ ID NO: 186077 - RNA, 64 nt, Human
aaaauguaggaauuuauuuuuucuuuaacugcugugaacucacuuugaggggguaggaggaggg

SEQ ID NO: 186078 - RNA, 64 nt, Human
aaugacuuacagccucauccucccuaacuccauuugaacucaacuuagcucacacucagugaua

SEQ ID NO: 186079 - RNA, 64 nt, Human; identical to SEQ ID NO: 84480

SEQ ID NO: 186080 - RNA, 64 nt, Human; identical to SEQ ID NO: 84481

SEQ ID NO: 186081 - RNA, 64 nt, Human; identical to SEQ ID NO: 84482

SEQ ID NO: 186082 - RNA, 64 nt, Human
cgaaguagcuuugugaucgcagauacauucauagugaacucaucagaauggcugguuugcagua

SEQ ID NO: 186083 - RNA, 64 nt, Human
gacauuauugaaggaaaggggaugaggacaacugugaacucacagugagcccuguggaaagaag

SEQ ID NO: 186084 - RNA, 64 nt, Human
uguggccccacuuaccucggggagucaugugcuuugaacucacgcaucuguuuuaccugcaucu

SEQ ID NO: 186085 - RNA, 64 nt, Human
uuugucaugcuucuucaguaccauggauuugaaaugaacucauccuugcugugagcauccagga

SEQ ID NO: 186086 - RNA, 64 nt, Human
cagcuacucgggaggcugaggcaggagaaucgcuugaacucaggagguggagguugcggugagc

SEQ ID NO: 186087 - RNA, 64 nt, Human
ugcugucagcucaaaaucauagccagguaguucuugaacucagaacuuaaauccugcacguggc

SEQ ID NO: 186088 - RNA, 64 nt, Human
gucaccgcauuguucucuuuugucuacaaaucacugaacucagguacuacuguaggcaguuucc

SEQ ID NO: 186089 - RNA, 64 nt, Human
acuucagcagacaaagacuuuugaauaaauaaacugaacucacaccugguaccacucagaaccu

SEQ ID NO: 186090 - RNA, 64 nt, Human
cuuuaaccaggaacuagggccauuuuuauuacaaugaacucaggacuggcaacaaccauauggu

SEQ ID NO: 186091 - RNA, 64 nt, Human
gguuguuuggcagcagcuuugaacguagcgccugugaacucaggaaugcacaguugacuuggga

SEQ ID NO: 186092 - RNA, 64 nt, Human
ucaucauauuuuguuuguuaucaccagagaugccugaacucaguuaagcgagcaauugcuaguu

SEQ ID NO: 186093 - RNA, 64 nt, Human
aaccugucgaugcuuacaucuuacugagucuguuugaacucaugcuggagagaaaugcuaugaa

SEQ ID NO: 186094 - RNA, 64 nt, Human
caucugacaaagggcuaauauccagaaucuacaaugaacucaaacaaauuuacaggaacaaaca

SEQ ID NO: 186095 - RNA, 64 nt, Human
gaaagcuguuauuuuaauaaagaacgcugggccaugaacucauaccugccaaugagucaaacau

SEQ ID NO: 186096 - RNA, 64 nt, Human
auagaauauccagaagcagauucaugaauauaugugaacucaguguauguuagaccugacauca

SEQ ID NO: 186097 - RNA, 64 nt, Human
uuucacuguguaggccaggcuggucucgaacuccugaacucaagugauucacccaccuuagccu

SEQ ID NO: 186098 - RNA, 64 nt, Human; identical to SEQ ID NO: 84582

SEQ ID NO: 186099 - RNA, 64 nt, Human; identical to SEQ ID NO: 84583

SEQ ID NO: 186100 - RNA, 64 nt, Human; identical to SEQ ID NO: 84584

SEQ ID NO: 186101 - RNA, 64 nt, Human
uuucagacaucguucauaccuugcaguucaucagugaacucauacuggagagaaaccuuacaaa

SEQ ID NO: 186102 - RNA, 64 nt, Human
aaauccugccaccauguuguagcucaauacaaugugaacucacuuuuuuuuuuuuuuuaaauaa

SEQ ID NO: 186103 - RNA, 64 nt, Human
cuuucugaaucccacaaaccuuaauguguguaugugaacucacauuggagagaaacccugcaau

SEQ ID NO: 186104 - RNA, 64 nt, Human
ucucauuuguuccaguucacuuuaaagacaugaaugaacucacucuggagagaagaagcugcau

SEQ ID NO: 186105 - RNA, 64 nt, Human
auggaacuaccuugcuucacaucacaaggcaaggugaacucaacucccaauaaacugcuugcug

SEQ ID NO: 186106 - RNA, 64 nt, Human
cagcacuuugggaagccaaggagggaggaucacuugaacucaggaauucgagaccagccugggc

SEQ ID NO: 186107 - RNA, 64 nt, Human
gaagaaagaaagacauucaacuugaacguccaaaugaacucaauggacauccguugcagugaca

SEQ ID NO: 186108 - RNA, 64 nt, Human
uuuccccacucagcuguggugucucguggccccgugaacucaccgcucacccuccugaaccccc

SEQ ID NO: 186109 - RNA, 64 nt, Human
caggaaggccuauuacaaguguguuugucuuuagugaacucauaguggugacauaccuuuccuu

SEQ ID NO: 186110 - RNA, 64 nt, Human
guaaugccuucuccuauuucuccaaagccuugugugaacucaccaaacacaagaaaaucaaaua

SEQ ID NO: 186111 - RNA, 64 nt, Human
cagcuacucgggaggcugagguaggagaaucguuugaacucaggaggcagagguugcaaugagc

SEQ ID NO: 186112 - RNA, 64 nt, Human
guuuucaggucuaaauaguggcugcuccaguccaugaacucaaagguuugaagcuaccaccauu

SEQ ID NO: 186113 - RNA, 64 nt, Human
ugcuguugcgccuggcacgcccagccaaacucucugaacucauccagccccuuccccuggagag

SEQ ID NO: 186114 - RNA, 64 nt, Human
uuucagagaucguucacauauugcaggucaucggugaacucauacuggagagaaaccuuacaaa

SEQ ID NO: 186115 - RNA, 64 nt, Human
uuucagacaucguucaugccuugcauuucacuggugaacucaugcuggagagaaaccuuauaaa

SEQ ID NO: 186116 - RNA, 64 nt, Human
accaccguuucuuccuguccuugagcuaccuuggugaacucaugaccccaggccccugcuccac

SEQ ID NO: 186117 - RNA, 64 nt, Human; identical to SEQ ID NO: 84486

SEQ ID NO: 186118 - RNA, 64 nt, Human; identical to SEQ ID NO: 84487

SEQ ID NO: 186119 - RNA, 64 nt, Human; identical to SEQ ID NO: 84488

SEQ ID NO: 186120 - RNA, 64 nt, Human
gcguguggaccgguccacgcaauucuuuauccugugaacucaucugagugggaggugguggaca

SEQ ID NO: 186121 - RNA, 64 nt, Human
aguucccauccuguuagucugcgugugugguagcugaacucaagaugauguggggcuaagaaaa

SEQ ID NO: 186122 - RNA, 64 nt, Human
uucaaauauaaauaaaaaauugugaguaauaaaaugaacucacaguuucaacaaugacccacau

SEQ ID NO: 186123 - RNA, 64 nt, Human
caacagccccagcugugacccccaggcuuccacaugaacucacaaaggagaggcccucauucuu

SEQ ID NO: 186124 - RNA, 64 nt, Human
acuucugcucugucgucucuccacagcaccuuugugaacucaggaaugugcgccagugggaagg

SEQ ID NO: 186125 - RNA, 64 nt, Human
acccuucuucguugcaccauccugcuucugacauugaacucauugaacuccuccugacacccug

SEQ ID NO: 186126 - RNA, 64 nt, Human
guggggugggguggagucgcagaccagagcugucugaacucaugugucagaagccuccaagccu

SEQ ID NO: 186127 - RNA, 64 nt, Human
aguacaggcugugacagguugugggccauuuuccugaacucaccacuuacccgggauaguaaac

SEQ ID NO: 186128 - RNA, 64 nt, Human
cagaaucuugcuauguugugcggcaagcuagucuugaacucauggccucaagucauccuccugu

SEQ ID NO: 186129 - RNA, 64 nt, Human
aaggguucagaaggugggcacccagccaacagcaugaacucagagcauuguuuuaggguuggag

SEQ ID NO: 186130 - RNA, 64 nt, Human
uaacugaccgcguugccauuggcgaccuggacucugaacucagguuuauucuaaacccagugag

SEQ ID NO: 186131 - RNA, 64 nt, Human
acuuuagggcucucaguucaaacugaaggacaguugaacucagaugggguucaugugggauucu

SEQ ID NO: 186132 - RNA, 64 nt, Human
gaaaugaauagccaggccugaccucaagcaaccaugaacucagcuauuaagaaaaucacauuuc

SEQ ID NO: 186133 - RNA, 64 nt, Human
accugcgaguguuaugaccaggauuccuuaaaccugaacucagaccacuugcauuagaaccauc

SEQ ID NO: 186134 - RNA, 64 nt, Human
aucuaaagagagcuacacuugagaaggggacuugugaacucaaccacaaucuccucgagacauu

SEQ ID NO: 186135 - RNA, 64 nt, Human
uggaaaagagcaagcaucugcaggagcagcucaaugaacucaagacagaaaucgaggccuugaa

SEQ ID NO: 186136 - RNA, 64 nt, Human; identical to SEQ ID NO: 84540

SEQ ID NO: 186137 - RNA, 64 nt, Human; identical to SEQ ID NO: 84541

SEQ ID NO: 186138 - RNA, 64 nt, Human; identical to SEQ ID NO: 84542

SEQ ID NO: 186139 - RNA, 64 nt, Human
cuguaugagagguaggacuggauuaaaugaccacugaacucacugaauccagaucauucauauc

SEQ ID NO: 186140 - RNA, 64 nt, Human
ugcauugacuauguuuuaguguauuuauaaauggugaacucaguuucugaaauuaaacuucuua

SEQ ID NO: 186141 - RNA, 64 nt, Human
ugaaguuuccuaaacauuuauggcugggcuaacaugaacucaucaugguaacacuggguauuuc

SEQ ID NO: 186142 - RNA, 64 nt, Human
acuagccaaucagaucaacucugucuugggcguuugaacucagggagggaggcccuugggagca

SEQ ID NO: 186143 - RNA, 64 nt, Human
cuaacagaagcuugcaugcgauuaguuaaagucgugaacucagaaacacagcggcaggaaauug

SEQ ID NO: 186144 - RNA, 64 nt, Human
cugaggggaauccugaaguaggagucagaugaccugaacucagaucucccucuaucacaugcuu

SEQ ID NO: 186145 - RNA, 64 nt, Human
ugaagauuugagagcaugaagauauucaugcuuuugaacucaaaauauugaagauacucucaag

SEQ ID NO: 186146 - RNA, 64 nt, Human
gagccgcugcacccugccccaguacaaucuuuuuugaacucaaauuuuugcugacaucugagug

SEQ ID NO: 186147 - RNA, 64 nt, Human
uucucuuaaaccacagcacuauugagugaaacauugaacucauaucuguaagaaauaaagagaa

SEQ ID NO: 186148 - RNA, 52 nt, Human
cuuuucccuuccagaucuaaauugaacucaacauuuuacauuccaucuuuuc

SEQ ID NO: 186149 - RNA, 64 nt, Human
accuuccaacccaggucaagacauugccaaaucuugaacucagaacccaaguguuccaugcccc

SEQ ID NO: 186150 - RNA, 64 nt, Human
uuagacuuuguuuuaaugcuuguacguacauaugugaacucauuggaaauauuguguguuuaau

SEQ ID NO: 186151 - RNA, 64 nt, Human
cauucuaaaucaaggcauauccagguggcccgguugaacucacuccacuguacccagucucaaa

SEQ ID NO: 186152 - RNA, 64 nt, Human
cagcuacacaggaggcugaggcacgagaaucacuugaacucaggagauggagguuucagugagc

SEQ ID NO: 186153 - RNA, 64 nt, Human
ucaauuauuugcgggaucuaaaagucaaaacaauugaacucauggauauagagaguagaaggau

SEQ ID NO: 186154 - RNA, 64 nt, Human
uacugugccuucuaaacggagacacucagacacuugaacucaucuuuuuaugacuaauaguuuu

SEQ ID NO: 186155 - RNA, 64 nt, Human; identical to SEQ ID NO: 84492

SEQ ID NO: 186156 - RNA, 64 nt, Human; identical to SEQ ID NO: 84493

SEQ ID NO: 186157 - RNA, 64 nt, Human; identical to SEQ ID NO: 84494

SEQ ID NO: 186158 - RNA, 64 nt, Human
uggcauuuucuugcugcaagcuuuuuuaaauuucugaacucaaggcaguggcagaagaugucag

SEQ ID NO: 186159 - RNA, 64 nt, Human
gccugaugacauuuaugcuuaggggacaagaguuugaacucaagggacugugaccccugcacac

SEQ ID NO: 186160 - RNA, 64 nt, Human
uacauuguugagcuauugcuguucucuugggaacugaacucacuuuccuccugaggcuuuggau

SEQ ID NO: 186161 - RNA, 64 nt, Human; identical to SEQ ID NO: 84456

SEQ ID NO: 186162 - RNA, 64 nt, Human; identical to SEQ ID NO: 84457

SEQ ID NO: 186163 - RNA, 64 nt, Human; identical to SEQ ID NO: 84458

SEQ ID NO: 186164 - RNA, 64 nt, Human; identical to SEQ ID NO: 84459

SEQ ID NO: 186165 - RNA, 64 nt, Human; identical to SEQ ID NO: 84460

SEQ ID NO: 186166 - RNA, 64 nt, Human; identical to SEQ ID NO: 84461

SEQ ID NO: 186167 - RNA, 64 nt, Human; identical to SEQ ID NO: 84462

SEQ ID NO: 186168 - RNA, 63 nt, Human; identical to SEQ ID NO: 84463

SEQ ID NO: 186169 - RNA, 64 nt, Human; identical to SEQ ID NO: 84464

SEQ ID NO: 186170 - RNA, 64 nt, Human; identical to SEQ ID NO: 84465

SEQ ID NO: 186171 - RNA, 64 nt, Human; identical to SEQ ID NO: 84466

SEQ ID NO: 186172 - RNA, 64 nt, Human; identical to SEQ ID NO: 84467

SEQ ID NO: 186173 - RNA, 64 nt, Human; identical to SEQ ID NO: 84468

SEQ ID NO: 186174 - RNA, 64 nt, Human; identical to SEQ ID NO: 84469

SEQ ID NO: 186175 - RNA, 64 nt, Human; identical to SEQ ID NO: 84470

SEQ ID NO: 186176 - RNA, 64 nt, Human; identical to SEQ ID NO: 84471

SEQ ID NO: 186177 - RNA, 64 nt, Human; identical to SEQ ID NO: 84472

SEQ ID NO: 186178 - RNA, 64 nt, Human; identical to SEQ ID NO: 84881

SEQ ID NO: 186179 - RNA, 64 nt, Human; identical to SEQ ID NO: 84882

SEQ ID NO: 186180 - RNA, 64 nt, Human; identical to SEQ ID NO: 84883

SEQ ID NO: 186181 - RNA, 64 nt, Human; identical to SEQ ID NO: 84884

SEQ ID NO: 186182 - RNA, 52 nt, Human; identical to SEQ ID NO: 84885

SEQ ID NO: 186183 - RNA, 64 nt, Human; identical to SEQ ID NO: 84886

SEQ ID NO: 186184 - RNA, 64 nt, Human; identical to SEQ ID NO: 84887

SEQ ID NO: 186185 - RNA, 64 nt, Human; identical to SEQ ID NO: 84888

SEQ ID NO: 186186 - RNA, 64 nt, Human; identical to SEQ ID NO: 84889

SEQ ID NO: 186187 - RNA, 64 nt, Human; identical to SEQ ID NO: 84890

SEQ ID NO: 186188 - RNA, 64 nt, Human; identical to SEQ ID NO: 84891

SEQ ID NO: 186189 - RNA, 64 nt, Human; identical to SEQ ID NO: 84892

SEQ ID NO: 186190 - RNA, 64 nt, Human; identical to SEQ ID NO: 84893

SEQ ID NO: 186191 - RNA, 64 nt, Human; identical to SEQ ID NO: 84894

SEQ ID NO: 186192 - RNA, 64 nt, Human; identical to SEQ ID NO: 84895

SEQ ID NO: 186193 - RNA, 50 nt, Human; identical to SEQ ID NO: 84896

SEQ ID NO: 186194 - RNA, 64 nt, Human; identical to SEQ ID NO: 84897

SEQ ID NO: 186195 - RNA, 59 nt, Human; identical to SEQ ID NO: 84898

SEQ ID NO: 186196 - RNA, 64 nt, Human; identical to SEQ ID NO: 84899

SEQ ID NO: 186197 - RNA, 64 nt, Human; identical to SEQ ID NO: 84900

SEQ ID NO: 186198 - RNA, 64 nt, Human; identical to SEQ ID NO: 84901

SEQ ID NO: 186199 - RNA, 64 nt, Human; identical to SEQ ID NO: 84902

SEQ ID NO: 186200 - RNA, 64 nt, Human; identical to SEQ ID NO: 84903

SEQ ID NO: 186201 - RNA, 64 nt, Human; identical to SEQ ID NO: 84904

SEQ ID NO: 186202 - RNA, 64 nt, Human; identical to SEQ ID NO: 84905

SEQ ID NO: 186203 - RNA, 64 nt, Human; identical to SEQ ID NO: 84906

SEQ ID NO: 186204 - RNA, 55 nt, Human; identical to SEQ ID NO: 84907

SEQ ID NO: 186205 - RNA, 64 nt, Human; identical to SEQ ID NO: 84908

SEQ ID NO: 186206 - RNA, 64 nt, Human; identical to SEQ ID NO: 84909

SEQ ID NO: 186207 - RNA, 64 nt, Human; identical to SEQ ID NO: 84910

SEQ ID NO: 186208 - RNA, 64 nt, Human; identical to SEQ ID NO: 84911

SEQ ID NO: 186209 - RNA, 64 nt, Human; identical to SEQ ID NO: 84912

SEQ ID NO: 186210 - RNA, 64 nt, Human; identical to SEQ ID NO: 84913

SEQ ID NO: 186211 - RNA, 64 nt, Human; identical to SEQ ID NO: 84914

SEQ ID NO: 186212 - RNA, 64 nt, Human; identical to SEQ ID NO: 84915

SEQ ID NO: 186213 - RNA, 64 nt, Human; identical to SEQ ID NO: 84916

SEQ ID NO: 186214 - RNA, 64 nt, Human; identical to SEQ ID NO: 84917

SEQ ID NO: 186215 - RNA, 64 nt, Human; identical to SEQ ID NO: 84918

SEQ ID NO: 186216 - RNA, 64 nt, Human; identical to SEQ ID NO: 84919

SEQ ID NO: 186217 - RNA, 64 nt, Human; identical to SEQ ID NO: 84920

SEQ ID NO: 186218 - RNA, 64 nt, Human; identical to SEQ ID NO: 84921

SEQ ID NO: 186219 - RNA, 64 nt, Human; identical to SEQ ID NO: 84922

SEQ ID NO: 186220 - RNA, 64 nt, Human; identical to SEQ ID NO: 84923

SEQ ID NO: 186221 - RNA, 64 nt, Human; identical to SEQ ID NO: 84924

SEQ ID NO: 186222 - RNA, 64 nt, Human; identical to SEQ ID NO: 84925

SEQ ID NO: 186223 - RNA, 64 nt, Human; identical to SEQ ID NO: 84926

SEQ ID NO: 186224 - RNA, 64 nt, Human; identical to SEQ ID NO: 84927

SEQ ID NO: 186225 - RNA, 64 nt, Human; identical to SEQ ID NO: 84928

SEQ ID NO: 186226 - RNA, 64 nt, Human; identical to SEQ ID NO: 84929

SEQ ID NO: 186227 - RNA, 64 nt, Human; identical to SEQ ID NO: 84930

SEQ ID NO: 186228 - RNA, 64 nt, Human; identical to SEQ ID NO: 84931

SEQ ID NO: 186229 - RNA, 64 nt, Human; identical to SEQ ID NO: 84932

SEQ ID NO: 186230 - RNA, 64 nt, Human; identical to SEQ ID NO: 84933

SEQ ID NO: 186231 - RNA, 64 nt, Human; identical to SEQ ID NO: 84934

SEQ ID NO: 186232 - RNA, 64 nt, Human; identical to SEQ ID NO: 84935

SEQ ID NO: 186233 - RNA, 64 nt, Human; identical to SEQ ID NO: 84936

SEQ ID NO: 186234 - RNA, 64 nt, Human; identical to SEQ ID NO: 84937

SEQ ID NO: 186235 - RNA, 64 nt, Human; identical to SEQ ID NO: 84938

SEQ ID NO: 186236 - RNA, 64 nt, Human; identical to SEQ ID NO: 84939

SEQ ID NO: 186237 - RNA, 64 nt, Human; identical to SEQ ID NO: 84940

SEQ ID NO: 186238 - RNA, 64 nt, Human; identical to SEQ ID NO: 84941

SEQ ID NO: 186239 - RNA, 64 nt, Human; identical to SEQ ID NO: 84942

SEQ ID NO: 186240 - RNA, 64 nt, Human; identical to SEQ ID NO: 84943

SEQ ID NO: 186241 - RNA, 64 nt, Human; identical to SEQ ID NO: 84944

SEQ ID NO: 186242 - RNA, 64 nt, Human; identical to SEQ ID NO: 84945

SEQ ID NO: 186243 - RNA, 64 nt, Human; identical to SEQ ID NO: 84946

SEQ ID NO: 186244 - RNA, 64 nt, Human; identical to SEQ ID NO: 84947

SEQ ID NO: 186245 - RNA, 64 nt, Human; identical to SEQ ID NO: 84948

SEQ ID NO: 186246 - RNA, 64 nt, Human; identical to SEQ ID NO: 84949

SEQ ID NO: 186247 - RNA, 64 nt, Human; identical to SEQ ID NO: 84950

SEQ ID NO: 186248 - RNA, 64 nt, Human; identical to SEQ ID NO: 84951

SEQ ID NO: 186249 - RNA, 64 nt, Human; identical to SEQ ID NO: 84952

SEQ ID NO: 186250 - RNA, 64 nt, Human; identical to SEQ ID NO: 84953

SEQ ID NO: 186251 - RNA, 64 nt, Human; identical to SEQ ID NO: 84954

SEQ ID NO: 186252 - RNA, 64 nt, Human; identical to SEQ ID NO: 84955

SEQ ID NO: 186253 - RNA, 64 nt, Human; identical to SEQ ID NO: 84956

SEQ ID NO: 186254 - RNA, 64 nt, Human; identical to SEQ ID NO: 84957

SEQ ID NO: 186255 - RNA, 64 nt, Human; identical to SEQ ID NO: 84958

SEQ ID NO: 186256 - RNA, 64 nt, Human; identical to SEQ ID NO: 84959

SEQ ID NO: 186257 - RNA, 64 nt, Human; identical to SEQ ID NO: 84960

SEQ ID NO: 186258 - RNA, 64 nt, Human; identical to SEQ ID NO: 84961

SEQ ID NO: 186259 - RNA, 64 nt, Human; identical to SEQ ID NO: 84962

SEQ ID NO: 186260 - RNA, 64 nt, Human; identical to SEQ ID NO: 84963

SEQ ID NO: 186261 - RNA, 64 nt, Human; identical to SEQ ID NO: 84964

SEQ ID NO: 186262 - RNA, 64 nt, Human; identical to SEQ ID NO: 84965

SEQ ID NO: 186263 - RNA, 64 nt, Human; identical to SEQ ID NO: 84966

SEQ ID NO: 186264 - RNA, 64 nt, Human; identical to SEQ ID NO: 84967

SEQ ID NO: 186265 - RNA, 64 nt, Human; identical to SEQ ID NO: 84968

SEQ ID NO: 186266 - RNA, 64 nt, Human; identical to SEQ ID NO: 84969

SEQ ID NO: 186267 - RNA, 64 nt, Human; identical to SEQ ID NO: 84970

SEQ ID NO: 186268 - RNA, 64 nt, Human; identical to SEQ ID NO: 84971

SEQ ID NO: 186269 - RNA, 64 nt, Human; identical to SEQ ID NO: 84972

SEQ ID NO: 186270 - RNA, 64 nt, Human; identical to SEQ ID NO: 84973

SEQ ID NO: 186271 - RNA, 64 nt, Human; identical to SEQ ID NO: 84974

SEQ ID NO: 186272 - RNA, 64 nt, Human; identical to SEQ ID NO: 84975

SEQ ID NO: 186273 - RNA, 64 nt, Human; identical to SEQ ID NO: 84976

SEQ ID NO: 186274 - RNA, 64 nt, Human; identical to SEQ ID NO: 84977

SEQ ID NO: 186275 - RNA, 64 nt, Human; identical to SEQ ID NO: 84978

SEQ ID NO: 186276 - RNA, 64 nt, Human; identical to SEQ ID NO: 84979

SEQ ID NO: 186277 - RNA, 64 nt, Human; identical to SEQ ID NO: 84980

SEQ ID NO: 186278 - RNA, 64 nt, Human; identical to SEQ ID NO: 84981

SEQ ID NO: 186279 - RNA, 64 nt, Human; identical to SEQ ID NO: 84982

SEQ ID NO: 186280 - RNA, 64 nt, Human; identical to SEQ ID NO: 84983

SEQ ID NO: 186281 - RNA, 64 nt, Human; identical to SEQ ID NO: 84984

SEQ ID NO: 186282 - RNA, 64 nt, Human; identical to SEQ ID NO: 84985

SEQ ID NO: 186283 - RNA, 64 nt, Human; identical to SEQ ID NO: 84986

SEQ ID NO: 186284 - RNA, 64 nt, Human; identical to SEQ ID NO: 84987

SEQ ID NO: 186285 - RNA, 64 nt, Human; identical to SEQ ID NO: 84988

SEQ ID NO: 186286 - RNA, 64 nt, Human; identical to SEQ ID NO: 84989

SEQ ID NO: 186287 - RNA, 64 nt, Human; identical to SEQ ID NO: 84990

SEQ ID NO: 186288 - RNA, 64 nt, Human; identical to SEQ ID NO: 84991

SEQ ID NO: 186289 - RNA, 64 nt, Human; identical to SEQ ID NO: 84992

SEQ ID NO: 186290 - RNA, 64 nt, Human; identical to SEQ ID NO: 84993

SEQ ID NO: 186291 - RNA, 64 nt, Human; identical to SEQ ID NO: 84994

SEQ ID NO: 186292 - RNA, 64 nt, Human; identical to SEQ ID NO: 84995

SEQ ID NO: 186293 - RNA, 64 nt, Human; identical to SEQ ID NO: 84996

SEQ ID NO: 186294 - RNA, 64 nt, Human; identical to SEQ ID NO: 84997

SEQ ID NO: 186295 - RNA, 64 nt, Human; identical to SEQ ID NO: 84998

SEQ ID NO: 186296 - RNA, 64 nt, Human; identical to SEQ ID NO: 84999

SEQ ID NO: 186297 - RNA, 64 nt, Human; identical to SEQ ID NO: 85000

SEQ ID NO: 186298 - RNA, 64 nt, Human; identical to SEQ ID NO: 85001

SEQ ID NO: 186299 - RNA, 64 nt, Human; identical to SEQ ID NO: 85002

SEQ ID NO: 186300 - RNA, 64 nt, Human; identical to SEQ ID NO: 85003

SEQ ID NO: 186301 - RNA, 64 nt, Human; identical to SEQ ID NO: 85004

SEQ ID NO: 186302 - RNA, 64 nt, Human; identical to SEQ ID NO: 85005

SEQ ID NO: 186303 - RNA, 64 nt, Human; identical to SEQ ID NO: 85006

SEQ ID NO: 186304 - RNA, 64 nt, Human; identical to SEQ ID NO: 85007

SEQ ID NO: 186305 - RNA, 64 nt, Human; identical to SEQ ID NO: 85008

SEQ ID NO: 186306 - RNA, 64 nt, Human; identical to SEQ ID NO: 85009

SEQ ID NO: 186307 - RNA, 64 nt, Human; identical to SEQ ID NO: 85010

SEQ ID NO: 186308 - RNA, 64 nt, Human; identical to SEQ ID NO: 85011

SEQ ID NO: 186309 - RNA, 64 nt, Human; identical to SEQ ID NO: 85012

SEQ ID NO: 186310 - RNA, 64 nt, Human; identical to SEQ ID NO: 85013

SEQ ID NO: 186311 - RNA, 64 nt, Human; identical to SEQ ID NO: 85014

SEQ ID NO: 186312 - RNA, 64 nt, Human; identical to SEQ ID NO: 85015

SEQ ID NO: 186313 - RNA, 64 nt, Human; identical to SEQ ID NO: 85016

SEQ ID NO: 186314 - RNA, 64 nt, Human; identical to SEQ ID NO: 85017

SEQ ID NO: 186315 - RNA, 61 nt, Human; identical to SEQ ID NO: 85018

SEQ ID NO: 186316 - RNA, 64 nt, Human; identical to SEQ ID NO: 85019

SEQ ID NO: 186317 - RNA, 64 nt, Human; identical to SEQ ID NO: 85020

SEQ ID NO: 186318 - RNA, 64 nt, Human; identical to SEQ ID NO: 85021

SEQ ID NO: 186319 - RNA, 64 nt, Human; identical to SEQ ID NO: 85022

SEQ ID NO: 186320 - RNA, 64 nt, Human; identical to SEQ ID NO: 85023

SEQ ID NO: 186321 - RNA, 64 nt, Human; identical to SEQ ID NO: 85024

SEQ ID NO: 186322 - RNA, 64 nt, Human; identical to SEQ ID NO: 85025

SEQ ID NO: 186323 - RNA, 64 nt, Human; identical to SEQ ID NO: 85026

SEQ ID NO: 186324 - RNA, 64 nt, Human; identical to SEQ ID NO: 85027

SEQ ID NO: 186325 - RNA, 64 nt, Human; identical to SEQ ID NO: 85028

SEQ ID NO: 186326 - RNA, 64 nt, Human; identical to SEQ ID NO: 85029

SEQ ID NO: 186327 - RNA, 64 nt, Human; identical to SEQ ID NO: 85030

SEQ ID NO: 186328 - RNA, 64 nt, Human; identical to SEQ ID NO: 85031

SEQ ID NO: 186329 - RNA, 64 nt, Human; identical to SEQ ID NO: 85032

SEQ ID NO: 186330 - RNA, 64 nt, Human; identical to SEQ ID NO: 85033

SEQ ID NO: 186331 - RNA, 57 nt, Human; identical to SEQ ID NO: 85034

SEQ ID NO: 186332 - RNA, 64 nt, Human; identical to SEQ ID NO: 85035

SEQ ID NO: 186333 - RNA, 64 nt, Human; identical to SEQ ID NO: 85036

SEQ ID NO: 186334 - RNA, 64 nt, Human; identical to SEQ ID NO: 85037

SEQ ID NO: 186335 - RNA, 64 nt, Human; identical to SEQ ID NO: 85038

SEQ ID NO: 186336 - RNA, 64 nt, Human; identical to SEQ ID NO: 85039

SEQ ID NO: 186337 - RNA, 64 nt, Human; identical to SEQ ID NO: 85040

SEQ ID NO: 186338 - RNA, 64 nt, Human; identical to SEQ ID NO: 85041

SEQ ID NO: 186339 - RNA, 64 nt, Human; identical to SEQ ID NO: 85042

SEQ ID NO: 186340 - RNA, 64 nt, Human; identical to SEQ ID NO: 85043

SEQ ID NO: 186341 - RNA, 62 nt, Human; identical to SEQ ID NO: 85044

SEQ ID NO: 186342 - RNA, 64 nt, Human; identical to SEQ ID NO: 85045

SEQ ID NO: 186343 - RNA, 64 nt, Human; identical to SEQ ID NO: 85046

SEQ ID NO: 186344 - RNA, 64 nt, Human; identical to SEQ ID NO: 85047

SEQ ID NO: 186345 - RNA, 62 nt, Human; identical to SEQ ID NO: 85048

SEQ ID NO: 186346 - RNA, 62 nt, Human; identical to SEQ ID NO: 85049

SEQ ID NO: 186347 - RNA, 64 nt, Human; identical to SEQ ID NO: 85050

SEQ ID NO: 186348 - RNA, 64 nt, Human; identical to SEQ ID NO: 85051

SEQ ID NO: 186349 - RNA, 64 nt, Human; identical to SEQ ID NO: 85052

SEQ ID NO: 186350 - RNA, 64 nt, Human; identical to SEQ ID NO: 85053

SEQ ID NO: 186351 - RNA, 64 nt, Human; identical to SEQ ID NO: 85054

SEQ ID NO: 186352 - RNA, 64 nt, Human; identical to SEQ ID NO: 85055

SEQ ID NO: 186353 - RNA, 64 nt, Human; identical to SEQ ID NO: 85056

SEQ ID NO: 186354 - RNA, 64 nt, Human; identical to SEQ ID NO: 85057

SEQ ID NO: 186355 - RNA, 64 nt, Human; identical to SEQ ID NO: 85058

SEQ ID NO: 186356 - RNA, 64 nt, Human; identical to SEQ ID NO: 85059

SEQ ID NO: 186357 - RNA, 64 nt, Human; identical to SEQ ID NO: 85060

SEQ ID NO: 186358 - RNA, 64 nt, Human; identical to SEQ ID NO: 85061

SEQ ID NO: 186359 - RNA, 64 nt, Human; identical to SEQ ID NO: 85062

SEQ ID NO: 186360 - RNA, 64 nt, Human; identical to SEQ ID NO: 85063

SEQ ID NO: 186361 - RNA, 64 nt, Human; identical to SEQ ID NO: 85064

SEQ ID NO: 186362 - RNA, 64 nt, Human; identical to SEQ ID NO: 85065

SEQ ID NO: 186363 - RNA, 64 nt, Human; identical to SEQ ID NO: 85066

SEQ ID NO: 186364 - RNA, 64 nt, Human; identical to SEQ ID NO: 85067

SEQ ID NO: 186365 - RNA, 64 nt, Human; identical to SEQ ID NO: 85068

SEQ ID NO: 186366 - RNA, 64 nt, Human; identical to SEQ ID NO: 85069

SEQ ID NO: 186367 - RNA, 64 nt, Human; identical to SEQ ID NO: 85070

SEQ ID NO: 186368 - RNA, 64 nt, Human; identical to SEQ ID NO: 85071

SEQ ID NO: 186369 - RNA, 64 nt, Human; identical to SEQ ID NO: 85072

SEQ ID NO: 186370 - RNA, 64 nt, Human; identical to SEQ ID NO: 85073

SEQ ID NO: 186371 - RNA, 64 nt, Human; identical to SEQ ID NO: 85074

SEQ ID NO: 186372 - RNA, 64 nt, Human; identical to SEQ ID NO: 85075

SEQ ID NO: 186373 - RNA, 64 nt, Human; identical to SEQ ID NO: 85076

SEQ ID NO: 186374 - RNA, 64 nt, Human; identical to SEQ ID NO: 85077

SEQ ID NO: 186375 - RNA, 64 nt, Human; identical to SEQ ID NO: 85078

SEQ ID NO: 186376 - RNA, 64 nt, Human; identical to SEQ ID NO: 85079

SEQ ID NO: 186377 - RNA, 64 nt, Human; identical to SEQ ID NO: 85080

SEQ ID NO: 186378 - RNA, 64 nt, Human; identical to SEQ ID NO: 85081

SEQ ID NO: 186379 - RNA, 64 nt, Human; identical to SEQ ID NO: 85082

SEQ ID NO: 186380 - RNA, 64 nt, Human; identical to SEQ ID NO: 85083

SEQ ID NO: 186381 - RNA, 64 nt, Human; identical to SEQ ID NO: 85084

SEQ ID NO: 186382 - RNA, 64 nt, Human; identical to SEQ ID NO: 85085

SEQ ID NO: 186383 - RNA, 64 nt, Human; identical to SEQ ID NO: 85086

SEQ ID NO: 186384 - RNA, 64 nt, Human; identical to SEQ ID NO: 85087

SEQ ID NO: 186385 - RNA, 64 nt, Human; identical to SEQ ID NO: 85088

SEQ ID NO: 186386 - RNA, 64 nt, Human; identical to SEQ ID NO: 85089

SEQ ID NO: 186387 - RNA, 64 nt, Human; identical to SEQ ID NO: 85090

SEQ ID NO: 186388 - RNA, 63 nt, Human; identical to SEQ ID NO: 85091

SEQ ID NO: 186389 - RNA, 64 nt, Human; identical to SEQ ID NO: 85092

SEQ ID NO: 186390 - RNA, 64 nt, Human; identical to SEQ ID NO: 85093

SEQ ID NO: 186391 - RNA, 64 nt, Human; identical to SEQ ID NO: 85094

SEQ ID NO: 186392 - RNA, 64 nt, Human; identical to SEQ ID NO: 85095

SEQ ID NO: 186393 - RNA, 64 nt, Human; identical to SEQ ID NO: 85096

SEQ ID NO: 186394 - RNA, 64 nt, Human; identical to SEQ ID NO: 85097

SEQ ID NO: 186395 - RNA, 64 nt, Human; identical to SEQ ID NO: 64517

SEQ ID NO: 186396 - RNA, 64 nt, Human; identical to SEQ ID NO: 64518

SEQ ID NO: 186397 - RNA, 55 nt, Human; identical to SEQ ID NO: 64519

SEQ ID NO: 186398 - RNA, 64 nt, Human; identical to SEQ ID NO: 64520

SEQ ID NO: 186399 - RNA, 64 nt, Human; identical to SEQ ID NO: 64521

SEQ ID NO: 186400 - RNA, 64 nt, Human; identical to SEQ ID NO: 64522

SEQ ID NO: 186401 - RNA, 64 nt, Human; identical to SEQ ID NO: 64523

SEQ ID NO: 186402 - RNA, 64 nt, Human; identical to SEQ ID NO: 64524

SEQ ID NO: 186403 - RNA, 64 nt, Human; identical to SEQ ID NO: 64525

SEQ ID NO: 186404 - RNA, 64 nt, Human; identical to SEQ ID NO: 64526

SEQ ID NO: 186405 - RNA, 64 nt, Human; identical to SEQ ID NO: 64527

SEQ ID NO: 186406 - RNA, 64 nt, Human; identical to SEQ ID NO: 64528

SEQ ID NO: 186407 - RNA, 64 nt, Human; identical to SEQ ID NO: 64529

SEQ ID NO: 186408 - RNA, 64 nt, Human; identical to SEQ ID NO: 64530

SEQ ID NO: 186409 - RNA, 64 nt, Human; identical to SEQ ID NO: 64531

SEQ ID NO: 186410 - RNA, 64 nt, Human; identical to SEQ ID NO: 64532

SEQ ID NO: 186411 - RNA, 64 nt, Human; identical to SEQ ID NO: 64533

SEQ ID NO: 186412 - RNA, 64 nt, Human; identical to SEQ ID NO: 64534

SEQ ID NO: 186413 - RNA, 64 nt, Human; identical to SEQ ID NO: 64535

SEQ ID NO: 186414 - RNA, 64 nt, Human; identical to SEQ ID NO: 64536

SEQ ID NO: 186415 - RNA, 64 nt, Human; identical to SEQ ID NO: 64537

SEQ ID NO: 186416 - RNA, 64 nt, Human; identical to SEQ ID NO: 64538

SEQ ID NO: 186417 - RNA, 64 nt, Human; identical to SEQ ID NO: 64539

SEQ ID NO: 186418 - RNA, 64 nt, Human; identical to SEQ ID NO: 64540

SEQ ID NO: 186419 - RNA, 64 nt, Human; identical to SEQ ID NO: 64541

SEQ ID NO: 186420 - RNA, 64 nt, Human; identical to SEQ ID NO: 64542

SEQ ID NO: 186421 - RNA, 64 nt, Human; identical to SEQ ID NO: 64543

SEQ ID NO: 186422 - RNA, 64 nt, Human; identical to SEQ ID NO: 64544

SEQ ID NO: 186423 - RNA, 64 nt, Human; identical to SEQ ID NO: 64545

SEQ ID NO: 186424 - RNA, 64 nt, Human; identical to SEQ ID NO: 64546

SEQ ID NO: 186425 - RNA, 64 nt, Human; identical to SEQ ID NO: 64547

SEQ ID NO: 186426 - RNA, 64 nt, Human; identical to SEQ ID NO: 64548

SEQ ID NO: 186427 - RNA, 64 nt, Human; identical to SEQ ID NO: 64549

SEQ ID NO: 186428 - RNA, 64 nt, Human; identical to SEQ ID NO: 64550

SEQ ID NO: 186429 - RNA, 64 nt, Human; identical to SEQ ID NO: 64551

SEQ ID NO: 186430 - RNA, 64 nt, Human; identical to SEQ ID NO: 64552

SEQ ID NO: 186431 - RNA, 64 nt, Human; identical to SEQ ID NO: 64553

SEQ ID NO: 186432 - RNA, 64 nt, Human; identical to SEQ ID NO: 64554

SEQ ID NO: 186433 - RNA, 64 nt, Human; identical to SEQ ID NO: 64555

SEQ ID NO: 186434 - RNA, 64 nt, Human; identical to SEQ ID NO: 64556

SEQ ID NO: 186435 - RNA, 64 nt, Human; identical to SEQ ID NO: 64557

SEQ ID NO: 186436 - RNA, 64 nt, Human; identical to SEQ ID NO: 64558

SEQ ID NO: 186437 - RNA, 64 nt, Human; identical to SEQ ID NO: 64559

SEQ ID NO: 186438 - RNA, 64 nt, Human; identical to SEQ ID NO: 64560

SEQ ID NO: 186439 - RNA, 64 nt, Human; identical to SEQ ID NO: 64561

SEQ ID NO: 186440 - RNA, 64 nt, Human; identical to SEQ ID NO: 64562

SEQ ID NO: 186441 - RNA, 64 nt, Human; identical to SEQ ID NO: 64563

SEQ ID NO: 186442 - RNA, 64 nt, Human; identical to SEQ ID NO: 64564

SEQ ID NO: 186443 - RNA, 64 nt, Human; identical to SEQ ID NO: 64565

SEQ ID NO: 186444 - RNA, 64 nt, Human; identical to SEQ ID NO: 64566

SEQ ID NO: 186445 - RNA, 64 nt, Human; identical to SEQ ID NO: 64567

SEQ ID NO: 186446 - RNA, 64 nt, Human; identical to SEQ ID NO: 64568

SEQ ID NO: 186447 - RNA, 64 nt, Human; identical to SEQ ID NO: 64569

SEQ ID NO: 186448 - RNA, 58 nt, Human; identical to SEQ ID NO: 64570

SEQ ID NO: 186449 - RNA, 64 nt, Human; identical to SEQ ID NO: 64571

SEQ ID NO: 186450 - RNA, 64 nt, Human; identical to SEQ ID NO: 64572

SEQ ID NO: 186451 - RNA, 64 nt, Human; identical to SEQ ID NO: 64573

SEQ ID NO: 186452 - RNA, 64 nt, Human; identical to SEQ ID NO: 64574

SEQ ID NO: 186453 - RNA, 64 nt, Human; identical to SEQ ID NO: 64575

SEQ ID NO: 186454 - RNA, 64 nt, Human; identical to SEQ ID NO: 64576

SEQ ID NO: 186455 - RNA, 64 nt, Human; identical to SEQ ID NO: 64577

SEQ ID NO: 186456 - RNA, 64 nt, Human; identical to SEQ ID NO: 64578

SEQ ID NO: 186457 - RNA, 64 nt, Human; identical to SEQ ID NO: 64579

SEQ ID NO: 186458 - RNA, 64 nt, Human; identical to SEQ ID NO: 64580

SEQ ID NO: 186459 - RNA, 64 nt, Human; identical to SEQ ID NO: 64581

SEQ ID NO: 186460 - RNA, 64 nt, Human; identical to SEQ ID NO: 64582

SEQ ID NO: 186461 - RNA, 64 nt, Human; identical to SEQ ID NO: 64583

SEQ ID NO: 186462 - RNA, 64 nt, Human; identical to SEQ ID NO: 64584

SEQ ID NO: 186463 - RNA, 64 nt, Human; identical to SEQ ID NO: 64585

SEQ ID NO: 186464 - RNA, 64 nt, Human; identical to SEQ ID NO: 64586

SEQ ID NO: 186465 - RNA, 64 nt, Human; identical to SEQ ID NO: 64587

SEQ ID NO: 186466 - RNA, 64 nt, Human; identical to SEQ ID NO: 64588

SEQ ID NO: 186467 - RNA, 64 nt, Human; identical to SEQ ID NO: 64589

SEQ ID NO: 186468 - RNA, 64 nt, Human; identical to SEQ ID NO: 64590

SEQ ID NO: 186469 - RNA, 64 nt, Human; identical to SEQ ID NO: 64591

SEQ ID NO: 186470 - RNA, 64 nt, Human; identical to SEQ ID NO: 64592

SEQ ID NO: 186471 - RNA, 64 nt, Human; identical to SEQ ID NO: 64593

SEQ ID NO: 186472 - RNA, 64 nt, Human; identical to SEQ ID NO: 64594

SEQ ID NO: 186473 - RNA, 64 nt, Human; identical to SEQ ID NO: 64595

SEQ ID NO: 186474 - RNA, 64 nt, Human; identical to SEQ ID NO: 64596

SEQ ID NO: 186475 - RNA, 64 nt, Human; identical to SEQ ID NO: 64597

SEQ ID NO: 186476 - RNA, 64 nt, Human; identical to SEQ ID NO: 64598

SEQ ID NO: 186477 - RNA, 64 nt, Human; identical to SEQ ID NO: 64599

SEQ ID NO: 186478 - RNA, 64 nt, Human; identical to SEQ ID NO: 64600

SEQ ID NO: 186479 - RNA, 64 nt, Human; identical to SEQ ID NO: 64601

SEQ ID NO: 186480 - RNA, 64 nt, Human; identical to SEQ ID NO: 64602

SEQ ID NO: 186481 - RNA, 64 nt, Human; identical to SEQ ID NO: 64603

SEQ ID NO: 186482 - RNA, 64 nt, Human; identical to SEQ ID NO: 64604

SEQ ID NO: 186483 - RNA, 64 nt, Human; identical to SEQ ID NO: 64605

SEQ ID NO: 186484 - RNA, 64 nt, Human; identical to SEQ ID NO: 64606

SEQ ID NO: 186485 - RNA, 64 nt, Human; identical to SEQ ID NO: 64607

SEQ ID NO: 186486 - RNA, 50 nt, Human; identical to SEQ ID NO: 64608

SEQ ID NO: 186487 - RNA, 64 nt, Human; identical to SEQ ID NO: 64609

SEQ ID NO: 186488 - RNA, 64 nt, Human; identical to SEQ ID NO: 64610

SEQ ID NO: 186489 - RNA, 64 nt, Human; identical to SEQ ID NO: 64611

SEQ ID NO: 186490 - RNA, 64 nt, Human; identical to SEQ ID NO: 64612

SEQ ID NO: 186491 - RNA, 64 nt, Human; identical to SEQ ID NO: 64613

SEQ ID NO: 186492 - RNA, 64 nt, Human; identical to SEQ ID NO: 64614

SEQ ID NO: 186493 - RNA, 64 nt, Human; identical to SEQ ID NO: 64615

SEQ ID NO: 186494 - RNA, 64 nt, Human; identical to SEQ ID NO: 64616

SEQ ID NO: 186495 - RNA, 64 nt, Human; identical to SEQ ID NO: 64617

SEQ ID NO: 186496 - RNA, 64 nt, Human; identical to SEQ ID NO: 64618

SEQ ID NO: 186497 - RNA, 64 nt, Human; identical to SEQ ID NO: 64619

SEQ ID NO: 186498 - RNA, 64 nt, Human; identical to SEQ ID NO: 64620

SEQ ID NO: 186499 - RNA, 64 nt, Human; identical to SEQ ID NO: 64621

SEQ ID NO: 186500 - RNA, 64 nt, Human; identical to SEQ ID NO: 64622

SEQ ID NO: 186501 - RNA, 64 nt, Human; identical to SEQ ID NO: 64623

SEQ ID NO: 186502 - RNA, 64 nt, Human; identical to SEQ ID NO: 64624

SEQ ID NO: 186503 - RNA, 64 nt, Human; identical to SEQ ID NO: 64625

SEQ ID NO: 186504 - RNA, 64 nt, Human; identical to SEQ ID NO: 64626

SEQ ID NO: 186505 - RNA, 64 nt, Human; identical to SEQ ID NO: 64627

SEQ ID NO: 186506 - RNA, 64 nt, Human; identical to SEQ ID NO: 64628

SEQ ID NO: 186507 - RNA, 64 nt, Human; identical to SEQ ID NO: 64629

SEQ ID NO: 186508 - RNA, 64 nt, Human; identical to SEQ ID NO: 64630

SEQ ID NO: 186509 - RNA, 64 nt, Human; identical to SEQ ID NO: 64631

SEQ ID NO: 186510 - RNA, 64 nt, Human; identical to SEQ ID NO: 64632

SEQ ID NO: 186511 - RNA, 64 nt, Human; identical to SEQ ID NO: 64633

SEQ ID NO: 186512 - RNA, 64 nt, Human; identical to SEQ ID NO: 64634

SEQ ID NO: 186513 - RNA, 64 nt, Human; identical to SEQ ID NO: 64635

SEQ ID NO: 186514 - RNA, 64 nt, Human; identical to SEQ ID NO: 64636

SEQ ID NO: 186515 - RNA, 64 nt, Human; identical to SEQ ID NO: 64637

SEQ ID NO: 186516 - RNA, 64 nt, Human; identical to SEQ ID NO: 64638

SEQ ID NO: 186517 - RNA, 64 nt, Human; identical to SEQ ID NO: 64639

SEQ ID NO: 186518 - RNA, 64 nt, Human; identical to SEQ ID NO: 64640

SEQ ID NO: 186519 - RNA, 57 nt, Human; identical to SEQ ID NO: 64641

SEQ ID NO: 186520 - RNA, 51 nt, Human; identical to SEQ ID NO: 64642

SEQ ID NO: 186521 - RNA, 64 nt, Human; identical to SEQ ID NO: 64643

SEQ ID NO: 186522 - RNA, 64 nt, Human; identical to SEQ ID NO: 64644

SEQ ID NO: 186523 - RNA, 64 nt, Human; identical to SEQ ID NO: 64645

SEQ ID NO: 186524 - RNA, 64 nt, Human; identical to SEQ ID NO: 64646

SEQ ID NO: 186525 - RNA, 64 nt, Human; identical to SEQ ID NO: 64647

SEQ ID NO: 186526 - RNA, 64 nt, Human; identical to SEQ ID NO: 64648

SEQ ID NO: 186527 - RNA, 64 nt, Human; identical to SEQ ID NO: 64649

SEQ ID NO: 186528 - RNA, 64 nt, Human; identical to SEQ ID NO: 64650

SEQ ID NO: 186529 - RNA, 64 nt, Human; identical to SEQ ID NO: 64651

SEQ ID NO: 186530 - RNA, 64 nt, Human; identical to SEQ ID NO: 64652

SEQ ID NO: 186531 - RNA, 64 nt, Human; identical to SEQ ID NO: 64653

SEQ ID NO: 186532 - RNA, 64 nt, Human; identical to SEQ ID NO: 64654

SEQ ID NO: 186533 - RNA, 64 nt, Human; identical to SEQ ID NO: 64655

SEQ ID NO: 186534 - RNA, 64 nt, Human; identical to SEQ ID NO: 64656

SEQ ID NO: 186535 - RNA, 64 nt, Human; identical to SEQ ID NO: 64657

SEQ ID NO: 186536 - RNA, 64 nt, Human; identical to SEQ ID NO: 64658

SEQ ID NO: 186537 - RNA, 64 nt, Human; identical to SEQ ID NO: 64659

SEQ ID NO: 186538 - RNA, 64 nt, Human; identical to SEQ ID NO: 64660

SEQ ID NO: 186539 - RNA, 64 nt, Human; identical to SEQ ID NO: 64661

SEQ ID NO: 186540 - RNA, 64 nt, Human; identical to SEQ ID NO: 64662

SEQ ID NO: 186541 - RNA, 64 nt, Human; identical to SEQ ID NO: 64663

SEQ ID NO: 186542 - RNA, 64 nt, Human; identical to SEQ ID NO: 64664

SEQ ID NO: 186543 - RNA, 64 nt, Human; identical to SEQ ID NO: 64665

SEQ ID NO: 186544 - RNA, 64 nt, Human; identical to SEQ ID NO: 64666

SEQ ID NO: 186545 - RNA, 53 nt, Human; identical to SEQ ID NO: 64667

SEQ ID NO: 186546 - RNA, 64 nt, Human; identical to SEQ ID NO: 64668

SEQ ID NO: 186547 - RNA, 64 nt, Human; identical to SEQ ID NO: 64669

SEQ ID NO: 186548 - RNA, 64 nt, Human; identical to SEQ ID NO: 64670

SEQ ID NO: 186549 - RNA, 64 nt, Human; identical to SEQ ID NO: 64671

SEQ ID NO: 186550 - RNA, 64 nt, Human; identical to SEQ ID NO: 64672

SEQ ID NO: 186551 - RNA, 64 nt, Human; identical to SEQ ID NO: 64673

SEQ ID NO: 186552 - RNA, 64 nt, Human
ccagaggcagagagacgaggauacccagcgaaagggacgggaggaagcauccgaaaccuaggau

SEQ ID NO: 186553 - RNA, 64 nt, Human
ccucuaggccucacucaacaaccaagcgccuggaggacgggacagauggacagacagccacccu

SEQ ID NO: 186554 - RNA, 57 nt, Human
ugccccuccuccagcccuagagugccuggacgggaucugaugcacaggcccccacgc

SEQ ID NO: 186555 - RNA, 64 nt, Human
guugcagcgggggcuuggggaggggcuggggguuggacgggauugaggaagguccgcacagccu

SEQ ID NO: 186556 - RNA, 64 nt, Human
ccucccuugcuggcccugaugggguggggucuuaggacgggaggcuguguccgugggugugcag

SEQ ID NO: 186557 - RNA, 64 nt, Human
ccucccauccggcaacagucugaaaguacguggaggacgggaccggaagacgagagagggcugg

SEQ ID NO: 186558 - RNA, 64 nt, Human
cagagcucgcgugggcuugccuucgugggggccaggacgggaggcaggguggggggcaggcugg

SEQ ID NO: 186559 - RNA, 64 nt, Human
gacucagccacuucuucaggaauuucacuuauuuggacgggauuuuagguuucccucccuuccc

SEQ ID NO: 186560 - RNA, 64 nt, Human
ccucucgcggcagcugucauuuccaugugcacugggacgggaagucaaacgaggaauuuaaaaa

SEQ ID NO: 186561 - RNA, 64 nt, Human
aaauuugagaagugcugcuguaauuccccuuaaaggacgggagaaagggccccggccaucuugc

SEQ ID NO: 186562 - RNA, 64 nt, Human
ccccaucagcgaguuauuguaacuggucaccacuggacgggaaggagaacagaggagagggaaa

SEQ ID NO: 186563 - RNA, 64 nt, Human
cuccugagcagcagcugaccgcccgucucaugcuggacgggaccccugggcggguggacaugag

SEQ ID NO: 186564 - RNA, 64 nt, Human
ccguuccuuucggacccuuuuagcugggguugggggacgggaagagccgugcccccuugggcgc

SEQ ID NO: 186565 - RNA, 64 nt, Human
ccagaguuuacuccaccugccgcacuuagcagggggacgggaccgaagcucccucaauccuugu

SEQ ID NO: 186566 - RNA, 64 nt, Human
gcggggugggaccaggcgcgggaccuggggcgggggacgggacuuaaauaaaggcagacgcugu

SEQ ID NO: 186567 - RNA, 64 nt, Human
aauuucgucaaccgguacuuuuaagguuaggaugggacgggaaaagugaagcaggauauuagcu

SEQ ID NO: 186568 - RNA, 64 nt, Human
gggagucccgccacuuccagauagacuacgaugaggacgggaacugcucuuuaauuauuaguga

SEQ ID NO: 186569 - RNA, 64 nt, Human
acaacaaggacaacuuuauguagagaaaaggaggggacgggacagacgaaggcaaccauuuuua

SEQ ID NO: 186570 - RNA, 64 nt, Human
cucuaguuuuaugugaaauuaguagaaucagggaggacgggacuuaugcugugguaggcaacag

SEQ ID NO: 186571 - RNA, 64 nt, Human
gccuaaacugcugauuggccucaacugcccaggcggacgggagggaggcacccggccggcugga

SEQ ID NO: 186572 - RNA, 64 nt, Human
uuacccccauugugcucuuaauggaaauuucaaaggacgggaguauucuguugguuggugucca

SEQ ID NO: 186573 - RNA, 64 nt, Human
aggaguaucauuccagaucugugcagagcggaucggacgggacaggguggagcggggaggccug

SEQ ID NO: 186574 - RNA, 64 nt, Human
aguguguuuccgguucugagucagggugaucuguggacgggaccccagcaccaagucuacgggu

SEQ ID NO: 186575 - RNA, 52 nt, Human
gagugaugagaaauaauuaauuggacgggagacagagugacgcacugacuca

SEQ ID NO: 186576 - RNA, 64 nt, Human
uguccuugagacuuggagcccugccucugagccuggacgggaaguguggccuguugugugugug

SEQ ID NO: 186577 - RNA, 64 nt, Human
ucacuucuuuggaauuccaggacucucaauggggggacgggaugccuggccuaagcaccuggag

SEQ ID NO: 186578 - RNA, 52 nt, Human
gaaugaugagaaauaauuaauuggacgggagacagagugaagcaucaaccua

SEQ ID NO: 186579 - RNA, 64 nt, Human
gccaccuggcuccaagaagcaucgcuggucuuggggacgggaagggaacccucuuccaggagcu

SEQ ID NO: 186580 - RNA, 64 nt, Human
auugucugagugacuccaagcuacucacuguauuggacgggaguaguaauuuauuuuaaagaua

SEQ ID NO: 186581 - RNA, 64 nt, Human
ccugggccuagcucgccagcgcugugcuccucauggacgggagcgcaguggggaagguagggga

SEQ ID NO: 186582 - RNA, 64 nt, Human
ugccugacagaauugcuuagaaaggagcagagaaggacgggagcuggcguagcucucagucuaa

SEQ ID NO: 186583 - RNA, 64 nt, Human
ggaaccaccugcagagguccccagacccaaagcaggacgggagacaacugcuuggaggagcgaa

SEQ ID NO: 186584 - RNA, 64 nt, Human
ugccuccuccuccuccucuaccuccagucaggcuggacgggaggguagccuuguggcugagagg

SEQ ID NO: 186585 - RNA, 64 nt, Human
cccugcagaggucgcgugcugugggaugacagcgggacgggagcucacaagugcuuucacugaa

SEQ ID NO: 186586 - RNA, 64 nt, Human
augggacccgguguaugccaaguggcccccgggaggacgggacccugagccugugugugucggg

SEQ ID NO: 186587 - RNA, 64 nt, Human
cucugcccccucccccgcagacagacagacagacggacgggacagcggcccggcccacgcagag

SEQ ID NO: 186588 - RNA, 64 nt, Human
uaucacauccagcauugucccagugcuuugaguuggacgggaaugggacucugcagccaaggca

SEQ ID NO: 186589 - RNA, 64 nt, Human
ccaggaggugaucaauuacaugugcacagugcuaggacgggaggcagagccggcucagagcagg

SEQ ID NO: 186590 - RNA, 64 nt, Human
gagaugaaaagacagucaaaggacggaaguggaaggacgggagugagcuggggagcuguugauc

SEQ ID NO: 186591 - RNA, 64 nt, Human
cgccccgccgccccacaccucuccccuuugggcuggacgggaacacacguguguggcucaggag

SEQ ID NO: 186592 - RNA, 64 nt, Human
cccuuuuuugucucugaaauuugcacuacgucuuggacgggaaucacuggggcagagggcgccu

SEQ ID NO: 186593 - RNA, 64 nt, Human
ccucuuuggcgggcuggggagcggcccccagccgggacgggagggcagcgaccccgaggccucg

SEQ ID NO: 186594 - RNA, 64 nt, Human
ggcagcgauagacucuggggauggagcaggacggggacgggaggggccggccaccugucuguaa

SEQ ID NO: 186595 - RNA, 56 nt, Human
accccuugaggacacugugagggccuggacgggagaugccagccaucacucacugc

SEQ ID NO: 186596 - RNA, 64 nt, Human
ggggugugaggaagacgcugccucccaauggccuggacgggauguuuccaagcucuuguucccc

SEQ ID NO: 186597 - RNA, 64 nt, Human
ggaagaaggaggcaucguccaguaagaccgucccggacgggaagcuggugaaagguaugcugcc

SEQ ID NO: 186598 - RNA, 64 nt, Human
ggaugcggugaaguuuaaacucugcucaggauaaggacgggaccauuuuuacauccaugaaaau

SEQ ID NO: 186599 - RNA, 64 nt, Human
uaaauaccaggauuuuuuuuuuuuuuugaagggaggacgggagcuggggagaggaaagagucuu

SEQ ID NO: 186600 - RNA, 64 nt, Human
uuagcacuuugguucaaggggcccaccaagucuuggacgggaaggcgcuacugguuuuauugcc

SEQ ID NO: 186601 - RNA, 64 nt, Human
cagagcagcuacaccaguaauggcacucuuccuaggacgggacuaaagaggacgccguccuuaa

SEQ ID NO: 186602 - RNA, 64 nt, Human
cuauccugaggagcgacaugugguugaacgccauggacgggacacaagcggaccaaggaaagag

SEQ ID NO: 186603 - RNA, 64 nt, Human
ggaaugacagccugggguccuugugccaccugguggacgggaaaggcagggcggcugcaguuuc

SEQ ID NO: 186604 - RNA, 64 nt, Human
guaugaugaauuuauccacaagaucacccuuccuggacgggacuauugaaggaggagaauggga

SEQ ID NO: 186605 - RNA, 64 nt, Human
ugaagguggaguugaagagcuuccuggaggugcuggacgggaagauugacgaccugcaugacuu

SEQ ID NO: 186606 - RNA, 64 nt, Human
gcacauccacccaggucccgagcccucacacccuggacgggaagggacagcugcauuccagagc

SEQ ID NO: 186607 - RNA, 64 nt, Human
aguaccgcuggaagugaauaaacuccggagggucggacgggaccugggcucucuccacgauucu

SEQ ID NO: 186608 - RNA, 64 nt, Human
gaaagcaagauuucagccuggaagagggcaaaguggacgggaguggacaggaguggaugcgaua

SEQ ID NO: 186609 - RNA, 64 nt, Human; identical to SEQ ID NO: 186608

SEQ ID NO: 186610 - RNA, 64 nt, Human
gccacccauccaggcccuggccagugugggaccgggacgggaaggaagaaggaggcuaggagca

SEQ ID NO: 186611 - RNA, 64 nt, Human
aauugagaccccucaggaguuuccacacugcuguggacgggauagccagggcagaccugcaucc

SEQ ID NO: 186612 - RNA, 64 nt, Human
ccagagggucaaaggagaacaagagaccagguguggacgggacagugaguggcugggaggaagc

SEQ ID NO: 186613 - RNA, 64 nt, Human
gcuggaggaugccgagcagggacucucgucugugggacgggauccaagaguuuggggauuaggg

SEQ ID NO: 186614 - RNA, 64 nt, Human
acccauccaguggacucuggggcgcggccacaggggacgggaugaggagcgggaggguuccgcc

SEQ ID NO: 186615 - RNA, 64 nt, Human
agggagaccaagagcacagcaggacugaaauuuuggacgggagagaggggcuauuccaucuugc

SEQ ID NO: 186616 - RNA, 64 nt, Human
ucccggggcccugccucggagcucugugguggaaggacgggagagggccccggacacgcgcguu

SEQ ID NO: 186617 - RNA, 64 nt, Human
gggucagguaacuuuaucccagaacauccaagcuggacgggaccuugaagaucaucuaguccag

SEQ ID NO: 186618 - RNA, 64 nt, Human
cagggcagcaacuuggagggaguucucuggggauggacgggacccagccuucugggggugcuau

SEQ ID NO: 186619 - RNA, 64 nt, Human
cagcaggcccccaacccccaggcagcccggcagaggacgggaggagaccagucccccacccagc

SEQ ID NO: 186620 - RNA, 64 nt, Human
aaaggaaagaaggaggugaggagaggacgagcaaggacgggacggaaaagcacgucuggcugcg

SEQ ID NO: 186621 - RNA, 64 nt, Human
ucucucucucuuugaucccauaaagcuacgagggggacgggagagggcagugcaaugggaagua

SEQ ID NO: 186622 - RNA, 64 nt, Human
cgggcucccaccccuggacggcagaggcaaggacggacgggagcuccacugugaaucggcggca

SEQ ID NO: 186623 - RNA, 64 nt, Human
gccugagguuggccacgggggagcuggccuccagggacgggagagauugugucaugugccacac

SEQ ID NO: 186624 - RNA, 64 nt, Human
uugaucaaucucucugcgggguggggugggggagggacgggagcugguugggguggcuuagcag

SEQ ID NO: 186625 - RNA, 64 nt, Human
uuuugaaacucacaucacccacugugcagcgugaggacgggacucuggucugcuguggggggca

SEQ ID NO: 186626 - RNA, 64 nt, Human
cgugagcgcagggcacgguggucagcgugcagcgggacgggacuggcccugcccagccaugaau

SEQ ID NO: 186627 - RNA, 64 nt, Human
uucugaaagaugacugcguccuccucugcggcacggacgggagcaggugcagccacaucuucca

SEQ ID NO: 186628 - RNA, 64 nt, Human
ccgccuuugucaucuccuuuggagggugcaugggggacgggaggaggggcacggguuuaaggga

SEQ ID NO: 186629 - RNA, 64 nt, Human
uucuuuauuuaaaauguucauuaauaaaguuguuggacgggaagcaaaaaaaaaaaguuguuua

SEQ ID NO: 186630 - RNA, 64 nt, Human
ggcuuccagaaaaugaacacagcaguucugcagaggacgggaggcuggaagcugggaggucagg

SEQ ID NO: 186631 - RNA, 64 nt, Human
cugucuccaugacgucuguggcaggagucccugaggacgggagcugccuagcuacaguuuucuu

SEQ ID NO: 186632 - RNA, 64 nt, Human
gccgccagggcucaucaugguagcugggagcuguggacgggagucaccaggugguggggccaag

SEQ ID NO: 186633 - RNA, 64 nt, Human
accaggaagccguccuggcgccuggcaguccgugggacgggaugguucuggcuguuugagauuc

SEQ ID NO: 186634 - RNA, 64 nt, Human
aggaagaccagguuugcugggcauaagcuucacaggacgggagaaccugcccaugguggacugu

SEQ ID NO: 186635 - RNA, 64 nt, Human
caccuugugacugggacaaucagggaccuggauuggacgggaucgcccaacuucacugggacug

SEQ ID NO: 186636 - RNA, 64 nt, Human
cccagcuucagugugcaggcucugaggcugcccaggacgggaaaguccaaggaaggggccuggu

SEQ ID NO: 186637 - RNA, 64 nt, Human
aaucguuuagcauggcaugagggccacauuccauggacgggaagaccccuuccucuucagaggu

SEQ ID NO: 186638 - RNA, 64 nt, Human
augcaaccuuccaagugcggagugucaaccaacuggacgggagagaguacugcuccuacuccag

SEQ ID NO: 186639 - RNA, 64 nt, Human
uuccuaaucaaauucugucuggggacgaaggguuggacgggaugaccuccagaagucccuucaa

SEQ ID NO: 186640 - RNA, 64 nt, Human
gggugccccaggcuagcucuucuaccucuggggcaccacggacuccccuuggccacucuuggga

SEQ ID NO: 186641 - RNA, 62 nt, Human
cuaccuggccguccaaauagaucccccaggguaccacggaggcgaaggaguuggagguguuu

SEQ ID NO: 186642 - RNA, 64 nt, Human
ccaaaccucgcagggcuccagcaggccaaccggcaccacggacuccuggguggcgcccuggcga

SEQ ID NO: 186643 - RNA, 59 nt, Human
gcuggcgaggaggcugcgagcguggaaucggaagcgaccgcgggcuuuuuugcccuucu

SEQ ID NO: 186644 - RNA, 59 nt, Human
ggcuuccuuggcaucacagggcagagccgggaagcgaugaauuuggagacucugugggg

SEQ ID NO: 186645 - RNA, 59 nt, Human
gagugaacugaaauaggacaaccgaaucaggaagcgaagccccaggagcugcagccauc

SEQ ID NO: 186646 - RNA, 59 nt, Human
uuuccugucucugccucugggagggaacaggaagcgaugaagaggucuuggaacaguag

SEQ ID NO: 186647 - RNA, 59 nt, Human
cagcuccucauggucaaugaacauguucaggaagcgaucaccuugaugcuugaacccaa

SEQ ID NO: 186648 - RNA, 59 nt, Human
cuccaguuuucuguuaauggcgaaagaauggaagcgaauaaaguuuuacugauuuuuga

SEQ ID NO: 186649 - RNA, 59 nt, Human
cuacuugggagcgggaagaggagaugacaggaagcgacgccucuggcagggcccuugcu

SEQ ID NO: 186650 - RNA, 59 nt, Human
gucuauuaucuguagguggaagaaauuuaggaagcgaaauauuacaguagugcauuggu

SEQ ID NO: 186651 - RNA, 59 nt, Human
aaggcucaucaaacagguaaagucucgaaggaagcgagaacgaaaucucucauugugug

SEQ ID NO: 186652 - RNA, 59 nt, Human
ugaaugcuccuaauauggucaggaagcaaggaagcgaaggauauauuaugaguuuuaag

SEQ ID NO: 186653 - RNA, 59 nt, Human
acuugaauguaauuaaagugcuguuuuuuggaagcgauaaacuuuaaauauacuuauua

SEQ ID NO: 186654 - RNA, 59 nt, Human
uugggagaaauaaaacaugcaauuuaaguggaagcgaagaaauuuaaagaggauuuuau

SEQ ID NO: 186655 - RNA, 59 nt, Human
guuguggggcuggagagagguuguggggaggaagcgaggaugcgugccugccacuaggc

SEQ ID NO: 186656 - RNA, 59 nt, Human
uugaaaagcaugauagcaauguggcauguggaagcgaacccccagggcauaacauagua

SEQ ID NO: 186657 - RNA, 59 nt, Human
auggguaccuguaauaauacugagcucuuggaagcgaaucaugcaugcaauuagcuccc

SEQ ID NO: 186658 - RNA, 64 nt, Human
guagaagcugcuggaaggcaggccugagccauucaccacggacaggaagagcagcucuggcuau

SEQ ID NO: 186659 - RNA, 64 nt, Human
gucaagcuugggcucucaaagcccugcgccuguuaccacggaugcccacagggccugggcaguu

SEQ ID NO: 186660 - RNA, 64 nt, Human
uguccgugcacaugguuuaaaggccaguccaaacaccacggagcauuuggcaaucaaggcccca

SEQ ID NO: 186661 - RNA, 59 nt, Human
aauuuguucuuacauuauggcucccgaggggaagcgauuacuuuuuuuaauuuuaaauu

SEQ ID NO: 186662 - RNA, 59 nt, Human
uccugaccuucaucucugggcuuguuccgggaagcgaaaagaccaagaucaaauaauag

SEQ ID NO: 186663 - RNA, 59 nt, Human
ugugucucuggacagacggauagacauacggaagcgaggccuggaccaagagaggccca

SEQ ID NO: 186664 - RNA, 59 nt, Human
cguggagagcuucaauugucagauaaacaggaagcgacagaugaccgcuuucuaacgcu

SEQ ID NO: 186665 - RNA, 59 nt, Human
agccauguuccuaugucagguggcagcggggaagcgaggguccaauccugcccugcgcu

SEQ ID NO: 186666 - RNA, 59 nt, Human
gaaaugaggggagguggaggcagggcaggggaagcgaagagucagccuuggagagagca

SEQ ID NO: 186667 - RNA, 59 nt, Human
guuucuucugaggggaauggggagagagaggaagcgacugagcccuuuggaaguauaau

SEQ ID NO: 186668 - RNA, 59 nt, Human
acucaggcugguggagaacucuggcuuuuggaagcgagaguaaaaagcuaaugacgagg

SEQ ID NO: 186669 - RNA, 59 nt, Human
gaguuagcauguaugaauguaaggaugagggaagcgaagcaagaggaaccucucgccau

SEQ ID NO: 186670 - RNA, 59 nt, Human
uccguaugaggaaacagacagcggacugaggaagcgauggccccagagaaagggccccu

SEQ ID NO: 186671 - RNA, 59 nt, Human
uaauaaaguugaugagagagaaggggagaggaagcgaacauaaagcgggucaaguguag

SEQ ID NO: 186672 - RNA, 59 nt, Human
acggguguagacguugcaaacaaaucuugggaagcgaggagggccggggaggacacuuc

SEQ ID NO: 186673 - RNA, 59 nt, Human
ugguucgagcggugaagccgcgcuccccuggaagcgacccaggggaggccaaguuguca

SEQ ID NO: 186674 - RNA, 59 nt, Human
caagauggacccgguaaauauaaccacaaggaagcgaaacugggugcguucacugaguu

SEQ ID NO: 186675 - RNA, 59 nt, Human
aaagcaaaaucucucuguccuaaacuaauggaagcgauucucccaugcucauguguaau

SEQ ID NO: 186676 - RNA, 59 nt, Human
ggucuuucuguucccaagauccugaacauggaagcgauggcagggcauagacucaggca

SEQ ID NO: 186677 - RNA, 64 nt, Human
gcuauugaagugucuuuggauagcugucugagugaccacggacaaagucuuaacaaaacucagg

SEQ ID NO: 186678 - RNA, 64 nt, Human
ucaacuugaagugcaagauucucuuauuuccgggaccacggagagucugacuuaacuacauaca

SEQ ID NO: 186679 - RNA, 64 nt, Human
uaaguuguucauguugcagaaaaagguuauacguaccacggauucucuuuaauauuguacaguu

SEQ ID NO: 186680 - RNA, 59 nt, Human
ccagucacugacccugugcagaaccuccuggaagcgagcuuugcugggagaggggguag

SEQ ID NO: 186681 - RNA, 59 nt, Human
ggagcaggcgggcugaggagaguggaaaaggaagcgacccagaaauggcagggacacuu

SEQ ID NO: 186682 - RNA, 59 nt, Human
cucuccauuauuuauuugcucugcucucaggaagcgacgugaccccugccccagcugga

SEQ ID NO: 186683 - RNA, 59 nt, Human
ccaacucaggcacaugcuuagcuguaaagggaagcgaggugaagucguccugcagcgua

SEQ ID NO: 186684 - RNA, 59 nt, Human
ccauugauguucuguuauguacuguaaugggaagcgauucugauuuuguuuuauauggg

SEQ ID NO: 186685 - RNA, 59 nt, Human
gaucugauugaaaaaaaacgacagucuggggaagcgaucacaucuggugaccaggcugc

SEQ ID NO: 186686 - RNA, 59 nt, Human
aggggacgagaugggguucaugugaaggaggaagcgaugccgagguaggaaaggccagc

SEQ ID NO: 186687 - RNA, 59 nt, Human
uccauauuguuccuuaucaccugccaacaggaagcgaaaggggauggagugagcccaug

SEQ ID NO: 186688 - RNA, 59 nt, Human
gccccagcucucuucuggcuuucugagcaggaagcgagcagaggcuccacaggcuuacg

SEQ ID NO: 186689 - RNA, 59 nt, Human
cacgugguacucugaagcacuugaaaaugggaagcgaugacaaaucugacuuuaaaaaa

SEQ ID NO: 186690 - RNA, 59 nt, Human
caauugucagcuaaaccuccugcaaaaguggaagcgaagccgaaaaaggcagcagcgaa

SEQ ID NO: 186691 - RNA, 59 nt, Human
ccuggcucugucugaacagaaggucugggggaagcgacggguggaguacaauaaaggga

SEQ ID NO: 186692 - RNA, 59 nt, Human
cuuucccccgcuaugucauagguaguggaggaagcgaaggaagugaacgcugaauguga

SEQ ID NO: 186693 - RNA, 59 nt, Human
gggaggcauagagggcccugggggucaugggaagcgagcacgcagcaggcgugcccagg

SEQ ID NO: 186694 - RNA, 59 nt, Human
ccaggaggcugguucacguccccuaccacggaagcgaggucccagaaggccagcggugg

SEQ ID NO: 186695 - RNA, 59 nt, Human
auaccagaauuuauaguagaaauauaugaggaagcgacacuucgaauauucuacuaaau

SEQ ID NO: 186696 - RNA, 64 nt, Human
gcacugguccuaugccagccucacccauguggggaccacggaaggcacacucccuuacccccgg

SEQ ID NO: 186697 - RNA, 64 nt, Human
gugcggagcuguuagggacgggcccagcuccugcaccacggacacagaaugucuggagagggcc

SEQ ID NO: 186698 - RNA, 64 nt, Human
aauaaguuuaauuauaaagugaaggaccaguuggaccacggaccccuagaaacucagccaagga

SEQ ID NO: 186699 - RNA, 59 nt, Human
uccacacacgcuauggaaugguuaugaagggaagcgagaagggggccuaggguggucug

SEQ ID NO: 186700 - RNA, 59 nt, Human
ggggagagcuggagaacaggauucuaggcggaagcgauagcauaggcaaaggcccuugg

SEQ ID NO: 186701 - RNA, 59 nt, Human
ggcaggaggagagcaccaggacgaggaugggaagcgaccuccagauuuaucaaaugguc

SEQ ID NO: 186702 - RNA, 59 nt, Human
ugcgugcucagagggucuguccagcccugggaagcgaccuuggccucaguucacagccu

SEQ ID NO: 186703 - RNA, 59 nt, Human
gcagcccuggcccuaggcuuccuaacccuggaagcgagaggaugagaggaggccggccc

SEQ ID NO: 186704 - RNA, 59 nt, Human
aacaaugcaccauugaaugcuggagccuuggaagcgaaucugaugguccuaggagguuc

SEQ ID NO: 186705 - RNA, 59 nt, Human
cuccaaguccaagcacagccaugcugaguggaagcgaggccaccaucugaguggauugg

SEQ ID NO: 186706 - RNA, 59 nt, Human
cugggggcagaccggugauccuuaccaguggaagcgagccaucgagccauuggcagaaa

SEQ ID NO: 186707 - RNA, 59 nt, Human
aaggccacggcucuacuaaaagagagagaggaagcgagagagagagagaaaaaacaaaa

SEQ ID NO: 186708 - RNA, 59 nt, Human
gaaagcuugauuuuguagcuuuggaagcuggaagcgaugguguuuggugccgaguccug

SEQ ID NO: 186709 - RNA, 59 nt, Human
uacugguggacugaauguagguugagagaggaagcgagaaguuaaggaugccuucaaaa

SEQ ID NO: 186710 - RNA, 59 nt, Human
ucuggcgacaggggagccaggggccgcggggaagcgaggacuggccugcgcugggcucg

SEQ ID NO: 186711 - RNA, 59 nt, Human
cuaggugagcugccucugccccugggcaaggaagcgaggcccucugggaggagggugcu

SEQ ID NO: 186712 - RNA, 59 nt, Human
ugagggacacucuccaaguugauaacaauggaagcgaguuuaauauaaaacaauucccu

SEQ ID NO: 186713 - RNA, 55 nt, Human; identical to SEQ ID NO: 53773

SEQ ID NO: 186714 - RNA, 59 nt, Human
gauccggaagaacuuugcucggacacacuggaagcgagccuucaaugccaccucguucc

SEQ ID NO: 186715 - RNA, 64 nt, Human
ggacuggggauucuggccaguguaauuucugucaaccacggacguuugccuucauguguagaau

SEQ ID NO: 186716 - RNA, 64 nt, Human
ucaccuccugagccacuucagaguucuggaagugaccacggaccaggguggaggaauagacuuc

SEQ ID NO: 186717 - RNA, 64 nt, Human
ucacagggauagacuacaacaccucuaggccccaaccacggauuuuuuuucucaguggcccaug

SEQ ID NO: 186718 - RNA, 64 nt, Human
gaugucucuaaguggaccucagugccucugcgugaccacggaaacucacugguacaguggggag

SEQ ID NO: 186719 - RNA, 64 nt, Human
uucaagcauaaaccuuagcgagugcggcuggaggaccacggacauuggacucacuguggcugga

SEQ ID NO: 186720 - RNA, 64 nt, Human
gagucaucagaaguguacuucuuggccacacaguaccacggaaggaagggcacugugaagcagu

SEQ ID NO: 186721 - RNA, 64 nt, Human
gaucgccagcccgaggacuuaccauccacaaugcaccacggaagaggccguucuaugaaaaacu

SEQ ID NO: 186722 - RNA, 64 nt, Human
gccuccgguugggucugcauuuuggagaguccacaccacggaccagguuuucccccaaggcuug

SEQ ID NO: 186723 - RNA, 64 nt, Human
aggagacaaagcaagaccagaagggugggaagcuaccacggauugggcugcggggucaggggcu

SEQ ID NO: 186724 - RNA, 64 nt, Human
uagccacucacccuucacaaacugaaguccauggaccacggaagucgagaauuaauguacaccu

SEQ ID NO: 186725 - RNA, 64 nt, Human
ugugaugaccaguuguccuccaaaaaccucacucaccacggagucacccugagggccccgggca

SEQ ID NO: 186726 - RNA, 64 nt, Human
ccaccagaccccaggccucaccggaggcccggugaccacggaacucaccgucugggggaggagg

SEQ ID NO: 186727 - RNA, 64 nt, Human
gcauggguggcaggguuuggacccgcccagcagcaccacggaccccagccacucucgggggcag

SEQ ID NO: 186728 - RNA, 64 nt, Human
ugcagggccacaugcugccugcaaacagggcaagaccacggaggcacagggguccugcuccuga

SEQ ID NO: 186729 - RNA, 64 nt, Human
caauccacgcuucuccggaucgcggugcgccggaaccacggaggaugaugccaguuacuugcuu

SEQ ID NO: 186730 - RNA, 64 nt, Human
ggagccauuagcucuuaaauuauucacagaagucaccacggaagguuguuuaagaugcagauuc

SEQ ID NO: 186731 - RNA, 64 nt, Human
ggagaagggauggaggucacacugguagaacguaaccacggaaaagagcgcaucaggccuggca

SEQ ID NO: 186732 - RNA, 64 nt, Human
gaggcaggcauugucucauuuuucaaugucacaaaccacggagcacucaucuacaaguucucug

SEQ ID NO: 186733 - RNA, 64 nt, Human
cacguggggagggcugccucagcagguuucucagaccacggagaagugacuuuugggcccgggg

SEQ ID NO: 186734 - RNA, 64 nt, Human
cagcccggcgccaccauccugcagccuccuccugaccacggacguuuccaucagguuccauccc

SEQ ID NO: 186735 - RNA, 64 nt, Human
ugacuggacuguggcucugaaccuugagcauaguaccacggacuccgugggcgcucaauaaaca

SEQ ID NO: 186736 - RNA, 64 nt, Human
ugggaaugcaucuugugggagcagcuucacucccaccacggaccaaugccuuucccccauaggc

SEQ ID NO: 186737 - RNA, 64 nt, Human
aacugacucuggucuugggaggugaggcuucccaaccacggaagacuacuuuaaaugaaaaaaa

SEQ ID NO: 186738 - RNA, 64 nt, Human
aaggauugauuugcaaccagaaagggagcugaaaaccacggagcuccauggcucuucauucaaa

SEQ ID NO: 186739 - RNA, 64 nt, Human
uacacagcugcaucagacaaugccauuucuccccaccacggaaccuuccaucuaagauuucuuc

SEQ ID NO: 186740 - RNA, 64 nt, Human
uaucugagcagcuucaaagaccccugagcugccaaccacggagaugugccaagcaucucaucuc

SEQ ID NO: 186741 - RNA, 64 nt, Human
cccugccaccauggggccucccgauacggcaaccaccacggaccuguggggaccaaugaggaaa

SEQ ID NO: 186742 - RNA, 64 nt, Human
cauccgcugugacugcggagccugcuccacugccaccacggagugugagaccaucugaggccgc

SEQ ID NO: 186743 - RNA, 64 nt, Human
agagccgggagagagccgcagcuccguccacagcaccacggagaggacagcgccucuugggcug

SEQ ID NO: 186744 - RNA, 64 nt, Human
uaucugcacucacccaggccuucacccagacuuuaccacggaggcggcugagugcagcuacagc

SEQ ID NO: 186745 - RNA, 64 nt, Human
ucccucucuggagaaagggcccugggccugccucaccacggaccaaagggagucugccagggcc

SEQ ID NO: 186746 - RNA, 64 nt, Human
uuuaccuccugccuuuggauugacucugcauuugaccacggacuccagucuguguguagggaga

SEQ ID NO: 186747 - RNA, 64 nt, Human
ccagccucagaaggccccagagagacccugcaagaccacggagggagcgacacuugaauguaga

SEQ ID NO: 186748 - RNA, 64 nt, Human
cucugauugucacuugcaucuucacaaaggauaaaccacggagcaacuggaaaaccaucagcca

SEQ ID NO: 186749 - RNA, 64 nt, Human
gcagugagggguauaucugggcuggccaguuggaaccacggagaucuccuugcccuagaugagc

SEQ ID NO: 186750 - RNA, 64 nt, Human
uugcuguaagaaguguugccuuugauuguuacuaaccacggauggguaacggucauacauuagg

SEQ ID NO: 186751 - RNA, 64 nt, Human
ggguggauggagcucagaaggaaaccccagccccaccacggaugacaccaucccucccguccca

SEQ ID NO: 186752 - RNA, 64 nt, Human
caaagcuccaccaggaggcugguucacguccccuaccacggaagcgaggucccagaaggccagc

SEQ ID NO: 186753 - RNA, 64 nt, Human
agaggacuacgaugagugugugcugccguucauuaccacggagauccucaagucacugguggcu

SEQ ID NO: 186754 - RNA, 64 nt, Human
uucgggggccucuggcugcugaaggauucggucuaccacggagggcugugcuguuaggcugcau

SEQ ID NO: 186755 - RNA, 64 nt, Human
aagaaagccaagcaucacuugcacuuaaaucauuaccacggaagauauauuagcuucaacuuua

SEQ ID NO: 186756 - RNA, 64 nt, Human
ucagauucuaugagaaacccagggucucugcuuuaccacggagcagggucaccaacccagaucu

SEQ ID NO: 186757 - RNA, 64 nt, Human
ccacggacggcccagacccgggcuggggcgcggcaccacggacggugccccuugcgcgccaucg

SEQ ID NO: 186758 - RNA, 64 nt, Human
cagccuuuaaaucacaagcaaaauaggaaaguuaaccacggaggcaccgaguuccagguagugg

SEQ ID NO: 186759 - RNA, 64 nt, Human
uccggcauccccuccccagacugccugcugucaaaccacggagcagcuggagccugcccugucc

SEQ ID NO: 186760 - RNA, 64 nt, Human
cuccucucuaggcagcgggugggcacagccccucaccacggacacggacagaggaccaccuccc

SEQ ID NO: 186761 - RNA, 64 nt, Human
ggagaacugaccagcccucaucauuccccauaaaaccacggacagcgucugugugcgcaucuug

SEQ ID NO: 186762 - RNA, 64 nt, Human
cucccggcuugucccagccccucuuuugcuucugaccacggaggcuuucucacagcccagccug

SEQ ID NO: 186763 - RNA, 64 nt, Human
gguccacguggauugucucagggaagccuugaaaaccacggagguggaugccaggaaagggccc

SEQ ID NO: 186764 - RNA, 64 nt, Human
aaucccucugcaguuuuggggagaucagcugcaggauuuuaacaggaauguuuuggucauugca

SEQ ID NO: 186765 - RNA, 64 nt, Human
aauucugaagaugugaagccucugucucacugaggauuuuaaaggucaauuauacuuuuguugu

SEQ ID NO: 186766 - RNA, 64 nt, Human
ucguguagaguagcagcugauuugaccugucccagauuuuaagugauauuccaaaagggacuuu

SEQ ID NO: 186767 - RNA, 64 nt, Human
guuuugcuuuuacaguuuccucauuuggcuguuggauuuuaagcaaaagcauccaagaaaaaca

SEQ ID NO: 186768 - RNA, 64 nt, Human
aauugugaaaccuuuuuggaaauaugauuuguaagauuuuaauaaugacuguuuuuggagauca

SEQ ID NO: 186769 - RNA, 64 nt, Human
auuugaugauuuucgaucucuuuuccccuguccugauuuuaaaagcccccuccuuuuuuuuuuu

SEQ ID NO: 186770 - RNA, 64 nt, Human
gauuuaaauacauuuaauaugucauuuuaaaaaugauuuuaauaauucauuucuuaaaacacug

SEQ ID NO: 186771 - RNA, 63 nt, Human
ugggagggugccauccacauuuuaacaguaccugugccugagaauuuaauuuuuaaaagacuu

SEQ ID NO: 186772 - RNA, 63 nt, Human
uugcuucuguuguccacugauuaaucagccuaugugccugacacuggucuugcaguacaacug

SEQ ID NO: 186773 - RNA, 63 nt, Human
gcuuuugugaaguauggcaaagguuuuucaugagugccugauuguuauuccugaacaauaucc

SEQ ID NO: 186774 - RNA, 63 nt, Human
cucauuggugggagcccagccauggcccuaauugugccugagcuugacuuucagucagggcca

SEQ ID NO: 186775 - RNA, 64 nt, Human
acaugaaacaccaagaugucugucucugaagcgugauuuuaaaauccccaugccuguggcugcg

SEQ ID NO: 186776 - RNA, 64 nt, Human
uacaggguguggguggggauuacccugaaucggggauuuuaaugauggaagcaggcagagccug

SEQ ID NO: 186777 - RNA, 64 nt, Human
uucauucauugggcacauaucaaauuauaauuuugauuuuaaauggucacccauguauuuauuu

SEQ ID NO: 186778 - RNA, 64 nt, Human
gaggggaaauguaauacuggaauaauuuguaaaugauuuuaauuuuauauucagugaaaagauu

SEQ ID NO: 186779 - RNA, 64 nt, Human
gauauuuccuaaucuuuccuauuucuuaacaaaagauuuuaaaguacuucucuagucauugaag

SEQ ID NO: 186780 - RNA, 64 nt, Human
ccuauuuguuuuaacauuguaaaauuuugagucagauuuuaauauuguaaaaucuugggucaaa

SEQ ID NO: 186781 - RNA, 64 nt, Human
gucucaugcugaaguauaguuuuugggaaagaaugauuuuaaauaaagagauuguaaaaguaaa

SEQ ID NO: 186782 - RNA, 64 nt, Human
ucugcacuaaccccuuacccuuaugguacgucaggauuuuaacuaguacugcuuuguugacuuu

SEQ ID NO: 186783 - RNA, 64 nt, Human
uuuuuuuuuuuaaauaacugacuuucucacaaaagauuuuaagauaacauuucuaauauauaug

SEQ ID NO: 186784 - RNA, 64 nt, Human
ucaggaaugguuuggagcugggaguggguagggggauuuuaaauguuccauaugggagccccaa

SEQ ID NO: 186785 - RNA, 64 nt, Human
aagaaauuagccuaacugccaauaucaaguugcagauuuuaauccauggaaauuguguuuugug

SEQ ID NO: 186786 - RNA, 64 nt, Human
aaacuggaaaucuggauuuucagcgaacaugccugauuuuaaaagguugacucaaguuuuuaca

SEQ ID NO: 186787 - RNA, 64 nt, Human
augucaauuugcucuugccgaaaagaugagccucgauuuuaaaaucuauccacauccaacugau

SEQ ID NO: 186788 - RNA, 64 nt, Human
caagguauuguaaaugacaagauaccaaauacaagauuuuaaaagcaaccauggggagaaaaag

SEQ ID NO: 186789 - RNA, 64 nt, Human
cuugcuacuuuuaaaaacuugcauuuauuccucagauuuuaaaaauaaauaaauaauucauuua

SEQ ID NO: 186790 - RNA, 63 nt, Human
cugcugcccccaccccggggacccugugacauggugccugagaggcaggcauagaggcuucuc

SEQ ID NO: 186791 - RNA, 63 nt, Human
cucgaguagaugggauuauaggcaugugccacggugccugacuugaguuucuuauucuagaac

SEQ ID NO: 186792 - RNA, 63 nt, Human
ucuugcuaagcuuauaugugccuguuaaugaaagugccugaaagaccuuccuuaauaaagaag

SEQ ID NO: 186793 - RNA, 63 nt, Human
gguucaaaacggcaugucucuccaacaauuuaagugccugauacaaaguccaaaguauaaaca

SEQ ID NO: 186794 - RNA, 64 nt, Human
uugccaggcuucauguagccgacacacgucucaggauuuuaaguccacauuggccucacacuac

SEQ ID NO: 186795 - RNA, 64 nt, Human
gccagucauuuuaugaaaaaucaaaauuauaagugauuuuaaaaaccagaauuuuaguugcaau

SEQ ID NO: 186796 - RNA, 64 nt, Human
ggggcugcaauguuuuaaaaaaaauaagucaucagauuuuaagaaaaaagugaugauuucuuau

SEQ ID NO: 186797 - RNA, 64 nt, Human
accagauaccacuauguaguaagucuuuuaggaugauuuuaauuuagucgugcgucauuuucug

SEQ ID NO: 186798 - RNA, 64 nt, Human
uuuuuccgugaacuuuauacuguccagcucuguugauuuuaaagccucuucauccaggucaguu

SEQ ID NO: 186799 - RNA, 64 nt, Human
guuuuagauacuuuuguucuuucuugcucuuaaggauuuuaaaaaccuguuaaucuuuuuauuu

SEQ ID NO: 186800 - RNA, 64 nt, Human
uuauuugucccacuuuuacuaaacaguggcagcagauuuuaaguuaaagaauauggaauauagu

SEQ ID NO: 186801 - RNA, 64 nt, Human
uaaaguauuauagugaaaaauucgcauucuggcugauuuuaagccauuuaaaauuuauauaaaa

SEQ ID NO: 186802 - RNA, 64 nt, Human
guguggaggugugggcugaagguagugacuguuugauuuuaaaaagugugacugucaguuguau

SEQ ID NO: 186803 - RNA, 64 nt, Human
aaucuaggcuuugccuguaaagaauacaacgauggauuuuaaauacuguuuguggaauguguuu

SEQ ID NO: 186804 - RNA, 64 nt, Human; identical to SEQ ID NO: 186767

SEQ ID NO: 186805 - RNA, 64 nt, Human
ccacuuaacugacuagcuuugauaaacaaugucagauuuuaacuaugaaaacgacauuaccuug

SEQ ID NO: 186806 - RNA, 64 nt, Human
guccagaagaauauucaggacuuaacggcuccaggauuuuaacaaaagcaagacuguugcucaa

SEQ ID NO: 186807 - RNA, 64 nt, Human
acuuggguuuuaaucagcaguucccuauuauucugauuuuaagcuguuccugugaugaacuuag

SEQ ID NO: 186808 - RNA, 64 nt, Human
uauuacugcuguaauaaacuaucacaaucucagugauuuuaaauaacgacuuuuauucucuuac

SEQ ID NO: 186809 - RNA, 63 nt, Human
gucaggagccaacacaggacccugcgugugagcgugccugacaucucacgcacggccacucca

SEQ ID NO: 186810 - RNA, 63 nt, Human
agagaaucaaagccuugucacauggauccucuggugccugaagaaaugagauuuuauuauccc

SEQ ID NO: 186811 - RNA, 63 nt, Human
aagguaccugaggccagggaucuugugucuguugugccugaauuuggcgugucuaauaaaggc

SEQ ID NO: 186812 - RNA, 63 nt, Human
uguggucuuuuuuuccuuucaagcucagccugugugccugaugucauuucuuucaaguugccc

SEQ ID NO: 186813 - RNA, 64 nt, Human
uuucuucuuucuguuuuaggauuugagccuccuugauuuuaauagagaacuucuaguguaugga

SEQ ID NO: 186814 - RNA, 64 nt, Human
gguacucuucucuguuugcccagaaucagcucuggauuuuaagcccagacuucaguggacccag

SEQ ID NO: 186815 - RNA, 64 nt, Human
uuaaaccaaaaucuuuauaagacacaauucuauugauuuuaaagcuucugcuuuccaggcucug

SEQ ID NO: 186816 - RNA, 64 nt, Human
auuugacauuuuuccuguuuuaaauucuaggauagauuuuaacauccuuugcggucccagucca

SEQ ID NO: 186817 - RNA, 64 nt, Human
caguacuuuuuuaaauauuuucuauuuuaagacugauuuuaauagggaauauaucucuauuuga

SEQ ID NO: 186818 - RNA, 64 nt, Human
aaaagggacagaaauugugcauucaaggagcuuggauuuuaaggcagcagcuugcugaugccac

SEQ ID NO: 186819 - RNA, 64 nt, Human
ugcuauuuacccuuuacauuuuuguaucauaauagauuuuaaaaaucuaauguucuuuauugca

SEQ ID NO: 186820 - RNA, 64 nt, Human
acaggugcgagcuacugcucccagcaagagccaagauuuuaaccuagaucucccuaacaccaaa

SEQ ID NO: 186821 - RNA, 64 nt, Human
gacacauuuucucuaacccuuaacuaaaguguaggauuuuaaaauuaaaugugagguaaaauaa

SEQ ID NO: 186822 - RNA, 64 nt, Human
cacacuuauuuaugaauugucuaaaguuacuacugauuuuaaaaugaauaauuuauuauuaagg

SEQ ID NO: 186823 - RNA, 64 nt, Human
ugaucugaaaacugaauguccuaugugaguauuagauuuuaauagcaugcuuuaaagacugaug

SEQ ID NO: 186824 - RNA, 64 nt, Human
aacacugccuuucaaacuuuuuacugaucucuuagauuuuaagaacucuugaauugugugguau

SEQ ID NO: 186825 - RNA, 64 nt, Human
gaagaguaacugauuuauaaaagcaggauguguugauuuuaaaauaaagugccuuuauacaaug

SEQ ID NO: 186826 - RNA, 64 nt, Human
agacuucauguguucauuuauuuccaccacagcagauuuuaagaaauuauaauauguaauauuu

SEQ ID NO: 186827 - RNA, 64 nt, Human
cauaaaccccaacuugugccauucuuuauaaaaugauuuuaaaggcaagaagugugugugucag

SEQ ID NO: 186828 - RNA, 63 nt, Human
ugcuacuuuaacagagcaccuggcgugggccaagugccugauacucccuuacacugaaucaug

SEQ ID NO: 186829 - RNA, 63 nt, Human
aaaucaucagucucggcucuucugaaauagaaggugccugaucuuccuaauaauucugccuau

SEQ ID NO: 186830 - RNA, 63 nt, Human
gaggaaagagccaaggcccacuuuugggaucaggugccugaucacugggcccccuaccucagc

SEQ ID NO: 186831 - RNA, 63 nt, Human
auaauuggauuuaauuuuuuuuaacauugaaaagugccugaaaaaugguaaauucuuaaaugu

SEQ ID NO: 186832 - RNA, 64 nt, Human
gugggggucuuuuguacuguuggauuaauaaaaugauuuuaaaaucccagacaaggacuccuug

SEQ ID NO: 186833 - RNA, 64 nt, Human
guggacaaucauuucuaacaugucaaagaaaaaagauuuuaauaagcacuauguccuugugauu

SEQ ID NO: 186834 - RNA, 64 nt, Human
aggaugacuuuuuuucugauucaaaagugaacuugauuuuaaaaaccagucaagagcaaucaaa

SEQ ID NO: 186835 - RNA, 64 nt, Human
ugauauguaaacauaauucuuguauauuauggaagauuuuaaauucacaauagaaacucaccau

SEQ ID NO: 186836 - RNA, 64 nt, Human
acuuuaaaaaauuuuagcuauaaauuauauaaaugauuuuaaauugcugagguuuccuuaggca

SEQ ID NO: 186837 - RNA, 64 nt, Human
gggaacuggacaucucaggguaaaagucaguacggauuuuaauagccuggggaggaaaacacau

SEQ ID NO: 186838 - RNA, 64 nt, Human
uaaauuuuuuaaaaagcaaaauuauagaaguuuagauuuuaaucaaauuuguaggguuucuagg

SEQ ID NO: 186839 - RNA, 64 nt, Human
uuuuaucugcuauaccaguuauuugagaaaguaugauuuuaauguaaaucauuuaaaaaggaca

SEQ ID NO: 186840 - RNA, 64 nt, Human
aguauuucuaucuuugauaucuaaguguuuugaggauuuuaaaacugaauuuuaucugcuauac

SEQ ID NO: 186841 - RNA, 64 nt, Human
gguauuuuugcauuaugacaguuguugagacuaggauuuuaagcuaggauaugauuauauuucc

SEQ ID NO: 186842 - RNA, 64 nt, Human
cuccucacugcuacagccuagaaggugagaagcagauuuuaaccccaucuggcagccauucaag

SEQ ID NO: 186843 - RNA, 64 nt, Human
gggaauguuacauuguuugucugucuucauagcagauuuuaauuuugaauaaauaaauguaucu

SEQ ID NO: 186844 - RNA, 64 nt, Human
aauugucaugucuagauuuaaauuuuaagucugagauuuuaaauguuuuugagcuuagaaaacc

SEQ ID NO: 186845 - RNA, 64 nt, Human
acaggcaugagccaccaugccuggccuuuggggggauuuuaauuacaguauuaauuauaguucu

SEQ ID NO: 186846 - RNA, 64 nt, Human
uggaaaguuauaaagguguauguuuuagccauaugauuuuaauuuuaauuuugcuucuuuuagg

SEQ ID NO: 186847 - RNA, 63 nt, Human
ccuugugccccaggcauccucagccucuggugggugccugagucugcacgcuggcuucugacc

SEQ ID NO: 186848 - RNA, 63 nt, Human
agaagagcuuuuguuggcuucucucccgagcuugugccugauucuguggcccaaaacaaucau

SEQ ID NO: 186849 - RNA, 63 nt, Human
gucaccacaggguucugagaacauuucacagaagugccugagacgcggagacauggcuggugu

SEQ ID NO: 186850 - RNA, 63 nt, Human
acccauuuggaccaaaagccaccagauugcuuagugccugacacagaaacaacugggaauccu

SEQ ID NO: 186851 - RNA, 64 nt, Human
uggagggugggacacaugaggauguauaaguacagauuuuaaaaaaggaaaucaacuuacacuu

SEQ ID NO: 186852 - RNA, 61 nt, Human
uacgcagaaaaaugcuguaauuucuugggaagauuuuaauguacaccuauuuguaaaguca

SEQ ID NO: 186853 - RNA, 64 nt, Human
auaacaggcaaauauuguagcuauauuacagugggauuuuaaaaaucuuguuaaacauucuaua

SEQ ID NO: 186854 - RNA, 64 nt, Human
cuggaaaaauauuuuaauagugauaauaacaucagauuuuaauauaacauuccagagaauugug

SEQ ID NO: 186855 - RNA, 64 nt, Human
ccaucccccuuccaccuccauuugucuguugaaagauuuuaaguuggaaacaguuccugucuga

SEQ ID NO: 186856 - RNA, 64 nt, Human
caguuaaaagaugcagccucacugcuucaacgcagauuuuaauguuuacuuaaauauaaaccug

SEQ ID NO: 186857 - RNA, 64 nt, Human
uuuaaaaaaaaauacgcacauuguccaauccagugauuuuaaucauacaguuugacugggcaaa

SEQ ID NO: 186858 - RNA, 64 nt, Human
gagaaaaguacuuuauauuuucaguguuuugucugauuuuaauguccguucuuagccaagcugc

SEQ ID NO: 186859 - RNA, 64 nt, Human
aauuuauguuuuccuguugaauguauuuuuaugagauuuuaaccagaacaaaggcagauaaaca

SEQ ID NO: 186860 - RNA, 64 nt, Human
uuuuauuuuggcaaaacugucaaaugagaaaaaugauuuuaaaaacuuuuuuuucaauugacaa

SEQ ID NO: 186861 - RNA, 64 nt, Human
ucaucaaaguauaguugauaauguuauaaaggaugauuuuaaaaauaggguauaaucaugacuc

SEQ ID NO: 186862 - RNA, 64 nt, Human
cauuauuggaccauaaggacauuuguuucaccuagauuuuaagauuauggagacugcugucauu

SEQ ID NO: 186863 - RNA, 64 nt, Human
auuaacuguugcuuaagguuuuuauacacuuccagauuuuaauuaauacuuucauauuucuagg

SEQ ID NO: 186864 - RNA, 64 nt, Human
acuugcauuucaaagcuuauaagauauaaauggagauuuuaaaguagaaauaaauauguauucc

SEQ ID NO: 186865 - RNA, 64 nt, Human
ccuggguaacagugagaccccccucccuacaaaagauuuuaauaauuaguugggcguaguggug

SEQ ID NO: 186866 - RNA, 63 nt, Human
cucuucuugaaauuuuaaccuaugauauuuucugugccugaauauuuguuauguagauaacaa

SEQ ID NO: 186867 - RNA, 63 nt, Human
aaaccaugaaacauuuuauccugaacagccacagugccugaauucacucaaguggauaaaaag

SEQ ID NO: 186868 - RNA, 63 nt, Human
ucugucuccccacuuccugaguucauguuccgcgugccugaacugaauaugucaccuugcucc

SEQ ID NO: 186869 - RNA, 63 nt, Human
auauaggguauuuuuuccaacugccccugcauugugccugaaccaauugaaucuuauguauga

SEQ ID NO: 186870 - RNA, 64 nt, Human
aaagauugauucaaaaguguaagacaggccaguggauuuuaauguauuaacaauauaagagugc

SEQ ID NO: 186871 - RNA, 64 nt, Human
gaguuuuaaugccagugcuuaauucgaaugaggggauuuuaagugucugaagaggcauuuucua

SEQ ID NO: 186872 - RNA, 64 nt, Human
aacuugaaauuuuuaacacauccuucuuggugaagauuuuaauauauuacuuauaugcuucaaa

SEQ ID NO: 186873 - RNA, 64 nt, Human
uuuuuaaaaaauauuuuuuaaauuuuuaaaauuugauuuuaaauuucaaauaaauuuaaauaaa

SEQ ID NO: 186874 - RNA, 64 nt, Human
uaagauuaggguggcauugcuuuuauagauucuugauuuuaaagcaacaggccuuucucaggug

SEQ ID NO: 186875 - RNA, 64 nt, Human
uuugcacagucaucugacuucugaucaagcauuagauuuuaacuuguuuagauuuugucuuaaa

SEQ ID NO: 186876 - RNA, 64 nt, Human
gcuauuuuuuuuaaaucaaaaacuuuucauuucagauuuuaaaaaggguaacuuguuuuuauug

SEQ ID NO: 186877 - RNA, 64 nt, Human
aucaugcuuuugcacuugaauuugcaacugaauggauuuuaaaaaauaauucuuuaaugggauc

SEQ ID NO: 186878 - RNA, 64 nt, Human
uuuucugaaaucauugauuauucuacaaaaacaugauuuuaaacagcuguaaaauauucuauga

SEQ ID NO: 186879 - RNA, 64 nt, Human
cgucugcagcgaauaagugcaggucuccgagcgugauuuuaaccuuuuuugcacagcagucucu

SEQ ID NO: 186880 - RNA, 64 nt, Human
gacuguggcauugcacaaauacagucucuguagggauuuuaaaagauuucagacuguuuugaua

SEQ ID NO: 186881 - RNA, 64 nt, Human
gugaguuauauaaacuuacuuccauucuguuucggauuuuaaguuugagagacuugcuaaugaa

SEQ ID NO: 186882 - RNA, 64 nt, Human
uaaauuuauaaaccaggcacaagguucaaguuuagauuuuaagcacuuuuauaacaaugauaag

SEQ ID NO: 186883 - RNA, 64 nt, Human
guauacguuguucuuuacguuguucuagaaaagagauuuuaaugcuguagugacuuugcucacu

SEQ ID NO: 186884 - RNA, 64 nt, Human
cucaacgauauguuugguuuuccugaaaauaaaugauuuuaaauaaauuaaauugcauaauuca

SEQ ID NO: 186885 - RNA, 63 nt, Human
auuaaccgucuccuugguuccuugguauucaccgugccugaucugcacauuucaucguggcug

SEQ ID NO: 186886 - RNA, 63 nt, Human
uuuugacuuuaguagcauccuccacacauuugugugccugauuugaaaggaagcuggggcacc

SEQ ID NO: 186887 - RNA, 63 nt, Human
uuuccaugcugggcagaguagucucaggcaaaagugccugaaaagaucagaauaaaaacugac

SEQ ID NO: 186888 - RNA, 63 nt, Human
acacacacacacacacacaaaauaaauccgggugugccugaaccucagaccuaguaauuuuuc

SEQ ID NO: 186889 - RNA, 64 nt, Human
ucaaucuggaagaaugacuguaucagucaauggggauuuuaacagacugccuugguacugccga

SEQ ID NO: 186890 - RNA, 64 nt, Human
aaauccaguuuuaagaggagccacuuaucaaagagauuuuaacaguaguaagaaggcaaagaau

SEQ ID NO: 186891 - RNA, 64 nt, Human
ggcuccuccugaguucggcccacaguagaagcaagauuuuaacuagccccuuuuccucuucacc

SEQ ID NO: 186892 - RNA, 64 nt, Human
uuuguuuaugaaauguuacauguagaaaaauacugauuuuaaauauuuuccauauuaacaauuu

SEQ ID NO: 186893 - RNA, 64 nt, Human
uuacucuuaaaaaaaaaaaaaaaagacuaagguggauuuuaaaaauuggaaacugacauaaugu

SEQ ID NO: 186894 - RNA, 64 nt, Human
uguuuauguagauguguuguuguuuuuaucauuggauuuuaacuuggcccgagugaaauaauca

SEQ ID NO: 186895 - RNA, 64 nt, Human
ugagaauuuuucugaaucauauuggggaagcagugauuuuaaaaccucaaguuuuuaaacauga

SEQ ID NO: 186896 - RNA, 64 nt, Human
guguguuagagcuuaugcauuuguuuuuaugagagauuuuaauaaauuuaauuauuugcuuguc

SEQ ID NO: 186897 - RNA, 64 nt, Human
ucugaauaguaaauuaaacaguuguuaucaaaaugauuuuaaagacuauuucuuuuucugggua

SEQ ID NO: 186898 - RNA, 64 nt, Human
gagagauuuucagaccccuggguacaugguggaugauuuuaaaucacccuagugugcugagacc

SEQ ID NO: 186899 - RNA, 64 nt, Human
aaugucuuguucacauauguguacuuucauauuugauuuuaaaauguacauuauaaccuguaug

SEQ ID NO: 186900 - RNA, 64 nt, Human
ucauuguugauauaccugaauuuacuuuguaagagauuuuaacuucacuucaugcugaugaugu

SEQ ID NO: 186901 - RNA, 64 nt, Human
uucuuauuguuaucaccuauguacaauggaaagggauuuuaagcacaaaccugcugcucaucua

SEQ ID NO: 186902 - RNA, 64 nt, Human
uuucuugugacuauucuaagaaugaaugcaaucagauuuuaaaaguaacuaaauauacuucagc

SEQ ID NO: 186903 - RNA, 64 nt, Human
ucugucaugaaaaaaaucaauugaaaaacaagcagauuuuaaauuuugaaguaaucaaaauaau

SEQ ID NO: 186904 - RNA, 63 nt, Human
cgacauugugcccagcugggacucuugggcucugugccugagggaaaauguuucacaacuagu

SEQ ID NO: 186905 - RNA, 63 nt, Human
cuagccaggccuuacugccccuacucguguacugugccugaagcugaaguuggaggcauccaa

SEQ ID NO: 186906 - RNA, 63 nt, Human
ccuugugagccccaggguuaucaguugcuggcugugccugagcagcucugggugcucuccaug

SEQ ID NO: 186907 - RNA, 63 nt, Human
aacugaugcuugagccccgaccguagaacccacgugccugagacaucugcugcuuggcucaaa

SEQ ID NO: 186908 - RNA, 64 nt, Human
uucugucaaagaugcagugccagaucaacaguuagauuuuaagcagcuccuggcccgcuauaaa

SEQ ID NO: 186909 - RNA, 63 nt, Human
cugucaccuuuccaaucuaagccgaagccacaggugccugacagguucccuucuaacaacuau

SEQ ID NO: 186910 - RNA, 63 nt, Human
agaagguuggauccaagcccuuguucagauuuggugccugauaagacagggguuucucuuuuu

SEQ ID NO: 186911 - RNA, 63 nt, Human
uguauuuuguuauuaagggggaaaaugugauuugugccugaucuuucaucugugauucuuaua

SEQ ID NO: 186912 - RNA, 63 nt, Human
cggggugcuguuuaagucccugcuuuuauccuggugccugauugggguggggacuguccuacu

SEQ ID NO: 186913 - RNA, 63 nt, Human
ccaguauugaguaugcuagcuaaaaaauaucaagugccugauuaaagaauugcuaaaugguug

SEQ ID NO: 186914 - RNA, 63 nt, Human
caguuuuaaauuuauaucguaacaccuacuuaagugccugacacaguagguauucaauaaaaa

SEQ ID NO: 186915 - RNA, 63 nt, Human
ccccuccuauuucagccuccugcacccaaggcagugccugagaagcccaucauagacaagaag

SEQ ID NO: 186916 - RNA, 64 nt, Human
cugagcccaggcgccaccacugaugccacccaggaccucggaccuuggagccugcggggugccu

SEQ ID NO: 186917 - RNA, 64 nt, Human
agugcagaaauuccgcaaggcugugacagacuucaccucggaggucaccuaugacccggcuggc

SEQ ID NO: 186918 - RNA, 64 nt, Human
aaaauauauaucuaucuauuugaggaaacugaggaccucggaaucucuagcaagggcucaacuu

SEQ ID NO: 186919 - RNA, 64 nt, Human
guucuggcuguagacaacauucuuuauauugccaaccucggagauagucggguauguggcucug

SEQ ID NO: 186920 - RNA, 64 nt, Human
cugucuucagcagcaucucaggguagcugcccugaccucggagcagucugucgccccccuacac

SEQ ID NO: 186921 - RNA, 64 nt, Human
guguccugggugcgcgccuagcuccgcacgggggaccucggagcugcucuaaggcgccugcaga

SEQ ID NO: 186922 - RNA, 64 nt, Human
gugggcucagauccugggcaugaugggccgagccaccucggaucccacugauuggccagccgag

SEQ ID NO: 186923 - RNA, 64 nt, Human
cuagcccuaucaagccaaagauuccccuuucugcaccucggaaaaauaccaacucagugaaaua

SEQ ID NO: 186924 - RNA, 64 nt, Human
cuucuguccuuggaacagucauaucucaaguucaaaggccaaaaccugagaagcggugggcuaa

SEQ ID NO: 186925 - RNA, 64 nt, Human
cagaugagcagcucacuuuuccaaaguaccccaaaaggccaaauuaaaaaagaaaaauaaucac

SEQ ID NO: 186926 - RNA, 64 nt, Human
ucuccguccucaugcuccucaguguccacacuucaaggccaaggauaguuucuuccucugacau

SEQ ID NO: 186927 - RNA, 64 nt, Human
uuuuuuuuuaacauguauucagauugagaaauaugauuuuaaugcuuuaaucucauguaguuug

SEQ ID NO: 186928 - RNA, 64 nt, Human
gaagaaaucugauuguuguguguauucaaugugugauuuuaaaaauaaacagcaacaacaauaa

SEQ ID NO: 186929 - RNA, 64 nt, Human
ccaaagaucauuaucuuuauugauuagcacugaggauuuuaacauugugauauauuauauauuu

SEQ ID NO: 186930 - RNA, 64 nt, Human
uuaaauucaagcugcuuuggacaacugacaauaugauuuuaaauuugaagaugggauguguaca

SEQ ID NO: 186931 - RNA, 64 nt, Human
ccuggggaugagacacacaauucauuggcuccuggauuuuaaguagacauuuguaaaucuauag

SEQ ID NO: 186932 - RNA, 64 nt, Human
auaauuguauuuguuugaaacuaagcuguccucagauuuuaacuugacucaaacauuuuucaau

SEQ ID NO: 186933 - RNA, 64 nt, Human
uuccaguuuuagcacagauuuguuuauguguucagauuuuaauagagauucaaaaaugacucau

SEQ ID NO: 186934 - RNA, 64 nt, Human
acaaaaugacuaauugaaaaaaguugaaacaaaugauuuuaaaagcuugcaguaaaaaauaaac

SEQ ID NO: 186935 - RNA, 64 nt, Human
gaaaucuuaaugcagaaauuauauagucuccucagauuuuaauauuuuuauuucuuuccuggca

SEQ ID NO: 186936 - RNA, 64 nt, Human
auguuuauuaguaaacaugaaauggggaauaagugauuuuaaguacaucccauacauuuaaaua

SEQ ID NO: 186937 - RNA, 64 nt, Human
cagguuuuagaaaugaucuuagaucuaauauagugauuuuaagcaucccgucaaaggcagaauc

SEQ ID NO: 186938 - RNA, 64 nt, Human
caacaaaaugcccuggcagagauaacuugggaaagauuuuaauauaaaacuugacauuggauau

SEQ ID NO: 186939 - RNA, 64 nt, Human
uuuuauggaggcuuugcauagauucccugagcaggauuuuaaucuuuuucuaacuggacugguu

SEQ ID NO: 186940 - RNA, 64 nt, Human
cugucauccuguucuuguuagccauugugaauaagauuuuaauguugauaauucuguuauuuac

SEQ ID NO: 186941 - RNA, 64 nt, Human
uauuuauuuuacuuacaauccucaaguuuuaauugauuuuaaauauuuuucaauacaacaguuu

SEQ ID NO: 186942 - RNA, 63 nt, Human
uuuaagagaaaaguuuguauuuuaaaugucaaugugccugagaaaugucagcuucaccacgcu

SEQ ID NO: 186943 - RNA, 63 nt, Human
gucugcccucugagagcaaccuccaagucgucugugccugagaugugaaacaucccauuuuau

SEQ ID NO: 186944 - RNA, 63 nt, Human
ggcagaccagggccagguagacggggcuguuuggugccugaaggauggcagacgccugguguc

SEQ ID NO: 186945 - RNA, 63 nt, Human
ucuugacccagcugaacaugucuuccugagucagugccugaaucuuuauuuuuuaaauugaau

SEQ ID NO: 186946 - RNA, 64 nt, Human
aaaucuuuucacaauauuacuccuauuucuuuuagauuuuaaugagccauuacuuaucucuuca

SEQ ID NO: 186947 - RNA, 64 nt, Human
uuaucaacuuggcuucaugauccucacuuugauugauuuuaagaggauggauaacacaguuauc

SEQ ID NO: 186948 - RNA, 64 nt, Human
uauuaaacacuaucuuaucuucuccugaacuguugauuuuaauuaaaauuaagugcuaauuacc

SEQ ID NO: 186949 - RNA, 64 nt, Human
guauuuaugcuuaagagcaaaaaaguuuugaugggauuuuaaauucaggcaaagccuacaacgc

SEQ ID NO: 186950 - RNA, 64 nt, Human
uggggguggaaaggaggaagagauacuaguuaaagauuuuaaaaauguaaauaaaauauacuuc

SEQ ID NO: 186951 - RNA, 64 nt, Human
uuaagggaaaaaugaacuaaacuucauauuuguugauuuuaaucaccuaauaguacugaagguu

SEQ ID NO: 186952 - RNA, 64 nt, Human
aguacuguaacugcaauucacauacaaaaugucugauuuuaaugugcugaauucauuuauuuuu

SEQ ID NO: 186953 - RNA, 64 nt, Human
ucagcacaaaaggaauagaucuaugauugacccugauuuuaauugugaaauuauaugauucaua

SEQ ID NO: 186954 - RNA, 64 nt, Human
gaagagagcugauggcaagucuuguagucauuuugauuuuaauugaagggugagcauaaccuug

SEQ ID NO: 186955 - RNA, 64 nt, Human
caaaauccuugggcuuugguuuuuuucuaguaaggauuuuaaauaacugccgacuucaaaagug

SEQ ID NO: 186956 - RNA, 64 nt, Human
aacuaguuaccaaaugaauugugccaccauaacugauuuuaauuuugcauuauuuaugauuuua

SEQ ID NO: 186957 - RNA, 64 nt, Human
ccaccauaacugauuuuaauuuugcauuauuuaugauuuuaaaauauuuguugcccagguguua

SEQ ID NO: 186958 - RNA, 64 nt, Human
uugcuuugcacucacuaaugagaauaauauucgggauuuuaaagcacaacuggaauagcuaauu

SEQ ID NO: 186959 - RNA, 64 nt, Human
uugaagucauaggacauuuuuauuuuauggaauagauuuuaaucuauuuacuacuauuaaggua

SEQ ID NO: 186960 - RNA, 64 nt, Human
uuuuauucugaaggacuuuaaggaagggauacaugauuuuaaaaaagccuguaagaggugaaau

SEQ ID NO: 186961 - RNA, 64 nt, Human
gcggaaaaaccuggccacuuauugccggccagugaaggccaagcacugucaggcuggugccccu

SEQ ID NO: 186962 - RNA, 64 nt, Human
caacauggccaacagcauugccaaccugagacugaaggccaaggaauauaguuuacagaggaac

SEQ ID NO: 186963 - RNA, 64 nt, Human
gaggcagcaaggccagugcugugccaagcccgguaaggccaagugccgaggcccagccuucccu

SEQ ID NO: 186964 - RNA, 64 nt, Human
aaauacaguaagugcuugaaagaugaaggaccaaaaggccaaaaaacagugaaauaugaucauc

SEQ ID NO: 186965 - RNA, 64 nt, Human
caaaaggaccacagcaccacuuagguguagcauggauuuuaaacugcagucaguaucagauccu

SEQ ID NO: 186966 - RNA, 64 nt, Human
aaauuuugauacuuucuauuacuagaucuaauuugauuuuaagcucuaaguuucacuuuuccau

SEQ ID NO: 186967 - RNA, 64 nt, Human
ugggauuacaggugugagucaccacaucuggucggauuuuaacuauucuaauagguauguagug

SEQ ID NO: 186968 - RNA, 64 nt, Human
gaaaacacaaggacuugguaggccaggaagaaaagauuuuaaaauuuagaaugaauagcccuuc

SEQ ID NO: 186969 - RNA, 64 nt, Human
ccaaccacugauguguuuuuauuuccuucuauaugauuuuaagauguguuuucugcauucugua

SEQ ID NO: 186970 - RNA, 64 nt, Human
aguuuuggauuugauucauagguaggagggcuuagauuuuaaggcacuucugaaagucaauccc

SEQ ID NO: 186971 - RNA, 64 nt, Human
caugaauauaguccaaccaucagcaucucaucaugauuuuaaacugugcgugauauaaacucuu

SEQ ID NO: 186972 - RNA, 64 nt, Human
aauauaugcauacaugaauauauccacccaccuagauuuuaagcaguaaauaaaacauuucgca

SEQ ID NO: 186973 - RNA, 64 nt, Human
auaguauauuuuccuugacagccuagcguuugaugauuuuaaagccuuauguauaaauaaacca

SEQ ID NO: 186974 - RNA, 64 nt, Human
guaauaauaaugggagacuugagugauaauaggggauuuuaaaacucuacagauggcauaccug

SEQ ID NO: 186975 - RNA, 64 nt, Human
cuagacaugguauguagcauguagugcacaagcugauuuuaagugauauucagauggccuuuua

SEQ ID NO: 186976 - RNA, 64 nt, Human
gggaacgguccaugaaaucuuuaugugauauaaggauuuuaaguuugggccagugaacagggua

SEQ ID NO: 186977 - RNA, 64 nt, Human
agaauuuaauuuagauuucaaaaauagcuuacaggauuuuaaacauggugugguauucuaaagc

SEQ ID NO: 186978 - RNA, 64 nt, Human
gccuuuuguuuuuguuuuuugguuggcaguaaccgauuuuaaugacuagcuuuuaaaaauacag

SEQ ID NO: 186979 - RNA, 64 nt, Human
ggaccucuuuauagucuaggauggcagagcagaagauuuuaauaugcuuuuauuaagugaugua

SEQ ID NO: 186980 - RNA, 64 nt, Human
aggugcuugcuaaggaacagaaugacccagagucaaggccaagucugcagggaccuguugaaag

SEQ ID NO: 186981 - RNA, 64 nt, Human
gcugucucuucggcagggaggugaauacucuugaaaggccaacagcaaguguuugugggacaca

SEQ ID NO: 186982 - RNA, 64 nt, Human
auaauguaaaggguucuaguagaaauaguguccuaaggccaauuaccuaccauacuaacaauca

SEQ ID NO: 186983 - RNA, 64 nt, Human
uccugccguccugcgccugcuggggccuccaggcaaggccaagugggguuggggguggggcugg

SEQ ID NO: 186984 - RNA, 64 nt, Human
auuucccugccuuuuuuuuucuuuuuuuacaucugauuuuaaugcuucguuaacuucaaaagga

SEQ ID NO: 186985 - RNA, 63 nt, Human
cuuuucauuaccugaugguagaaauaaaauaauugauuuuaaauuccuuugcuuuucuugacu

SEQ ID NO: 186986 - RNA, 64 nt, Human
agaguaguuuuaacuuuauuuuuauuuguuuagagauuuuaaguuggaacaguauuuucccauu

SEQ ID NO: 186987 - RNA, 64 nt, Human
ccuuuacuucauggaugagauugaugcagcccuugauuuuaaaaauguguccauuguugcauuu

SEQ ID NO: 186988 - RNA, 64 nt, Human
cagccaguuaaugugauucaguugugaccugugggauuuuaaaauuuuccugcccucauaauuu

SEQ ID NO: 186989 - RNA, 64 nt, Human
uuucuucucaagcguuuucaagaucuagcauguggauuuuaaaagauuugcccucauuaacaag

SEQ ID NO: 186990 - RNA, 64 nt, Human
aagcuuccuccaucaauuggcagaaccuaaagaagauuuuaaggggcaaaaguaauuacaauaa

SEQ ID NO: 186991 - RNA, 64 nt, Human
cuggaggauuuuagucuuucuuacacauaugugugauuuuaaacgaauauucucagaccacagg

SEQ ID NO: 186992 - RNA, 64 nt, Human
guaguaucuccuucugacaagcauucccuauugggauuuuaaagcuaugugcacagaauauuag

SEQ ID NO: 186993 - RNA, 64 nt, Human
uuacuuuuguguuugggggaaaauacgagggauugauuuuaaauaaaaaacauuccaucuuuca

SEQ ID NO: 186994 - RNA, 64 nt, Human
cuguagaugucuguauuauugaggggcaacucaggauuuuaaguuccauaaaguauugaaccaa

SEQ ID NO: 186995 - RNA, 64 nt, Human
ucuagggagaaaccauuguuaauucaaauaagcugauuuuaaugacguuuucaacugguuuuua

SEQ ID NO: 186996 - RNA, 64 nt, Human
uccuggcuugguuuauguucugauuugacacacugauuuuaaucuucgaaucaugacacugagu

SEQ ID NO: 186997 - RNA, 64 nt, Human
ccuuaugauguguauauugagauguacucagugugauuuuaaaccaaauugucuuccuguaguc

SEQ ID NO: 186998 - RNA, 64 nt, Human
auguaaaaacugccaucuggcaucuuccuuccuugauuuuaagucuucagcuucuuggccaacu

SEQ ID NO: 186999 - RNA, 64 nt, Human
ucuugugacuuccaucccugcugaauggggcugcaaggccaaggcuccuuaggggagagguccu

SEQ ID NO: 187000 - RNA, 64 nt, Human
cuguggguuucuaaagcugccagccgagauagccaaggccaaaggaagcacaugccucucucag

SEQ ID NO: 187001 - RNA, 64 nt, Human
uccccaugaucagauauuugauggaaaguccugaaaggccaaugaguuggauggcaagaaugca

SEQ ID NO: 187002 - RNA, 64 nt, Human
uggccagaacugcugucgaagaaaaucaggccggaaggccaagaaggcgcuaagggggauggga

SEQ ID NO: 187003 - RNA, 64 nt, Human
guagaauuguuauagacugccgugcauuagcacagauuuuaauugucaugguuacaaacuacag

SEQ ID NO: 187004 - RNA, 64 nt, Human
guaaaugcuuccuccauuucuccugagagugggugauuuuaauucuaucucugacccugguccu

SEQ ID NO: 187005 - RNA, 64 nt, Human
guagucauugagugagggggagauauaagccaaggauuuuaaauugacccuuagcuauagagaa

SEQ ID NO: 187006 - RNA, 64 nt, Human
guacucaaacaaguuacuuucaguuguccugcuggauuuuaaaaaaauagaaaaagaaucucaa

SEQ ID NO: 187007 - RNA, 64 nt, Human
uucuuagaucaaauuuaugccaauuauaugaaaagauuuuaacuccgagacaggagucuuucag

SEQ ID NO: 187008 - RNA, 64 nt, Human
gauuacuuguuacuuaugucauauaauuaaccuggauuuuaaacacuguuggaagaagaguuuu

SEQ ID NO: 187009 - RNA, 64 nt, Human
guucuauuaguuuuuuggccuugcucuucuccuugauuuuaaaauuccuucuauagcuagagcu

SEQ ID NO: 187010 - RNA, 64 nt, Human
uauuaugaauagugcugcgauaaacagugcaggugauuuuaaaauauaauuuccuuuggguaga

SEQ ID NO: 187011 - RNA, 64 nt, Human
auuaaguacaaccaaccaccuuuccagccauagagauuuuaauuagcccaacuagaagccuagu

SEQ ID NO: 187012 - RNA, 64 nt, Human
gcaccccaaagaggcuccaggaucaggagugaaagauuuuaaagcagccuccgaagcuuaacaa

SEQ ID NO: 187013 - RNA, 64 nt, Human
acuugugauucaaacaauuuugugguuaaaacuggauuuuaaauuuaaaaaucaauaaaaauuu

SEQ ID NO: 187014 - RNA, 64 nt, Human
uuuauggguguuaauugaaauuuauacaccaauugauuuuaaaccauaaaaagcugaccacagg

SEQ ID NO: 187015 - RNA, 64 nt, Human
uauuguuaaaaugaacuguugcuauugugagauggauuuuaacugaccuauuaaggguuucuuu

SEQ ID NO: 187016 - RNA, 64 nt, Human
agaauuacuggguuaaauugugggaaaggguccagauuuuaaaggugcuuuaagguugcccucu

SEQ ID NO: 187017 - RNA, 64 nt, Human
cccuggagaacugcgaacgagcugcagaaaaccagauuuuaaaauguagaagucguugggcugc

SEQ ID NO: 187018 - RNA, 64 nt, Human
aaaaggccugugauccaggaaagaugucccacagggaccacauccaccccagccccacugcccu

SEQ ID NO: 187019 - RNA, 64 nt, Human
gccugguccacugggaacucaaaagcccacgucaggaccacagaccccccaggcccagcagaag

SEQ ID NO: 187020 - RNA, 64 nt, Human
aaaucuaugagauuuugaaaaucuaccaacucauggaccacaguaacauggacugcuucaucug

SEQ ID NO: 187021 - RNA, 64 nt, Human
agcacagggcuaaggagggauagaguaggacccuggaccacauucggaaggggaacuuagagau

SEQ ID NO: 187022 - RNA, 64 nt, Human
uauaugaaguguaaauacucgauauauaaguauagauuuuaaagauaugggacuuuauuuucac

SEQ ID NO: 187023 - RNA, 64 nt, Human
cugaagagaauagucaucaaauuuauaucucgaagauuuuaauuaaggaauugcuuauuguuga

SEQ ID NO: 187024 - RNA, 64 nt, Human
aagccuugguauaauuuucuuguuuaaauuuggggauuuuaaaucagauuauaguuuagaauau

SEQ ID NO: 187025 - RNA, 64 nt, Human
cagucacgguuagaagaagcuaauauuugaaacagauuuuaaaaacuugaaaaauuacagguga

SEQ ID NO: 187026 - RNA, 64 nt, Human
ucagcaugucaacuccauugaaaaacccugcugggauuuuaauagaacuuacagcucacgccug

SEQ ID NO: 187027 - RNA, 64 nt, Human
ugaaucuaucucuccggagauaauuucauacagagauuuuaagaaaacaucuuuauauuaaaaa

SEQ ID NO: 187028 - RNA, 64 nt, Human
uugcuuuuguuuuccugcugguaauaucgggaaagauuuuaaugaaaccaggguagaauuguuu

SEQ ID NO: 187029 - RNA, 64 nt, Human
ccugcuuauggacauauaugauguuggagugugggauuuuaaaguuuacuuucuacaaacucuc

SEQ ID NO: 187030 - RNA, 64 nt, Human
uuacuuuaacauuuuaaaauuaugguguuuuccugauuuuaaaagcaauauuuuccuuacugua

SEQ ID NO: 187031 - RNA, 64 nt, Human
gacaguauucuaccauucaguaauuuugguuaaugauuuuaacacuucucaguguauuuaauuu

SEQ ID NO: 187032 - RNA, 64 nt, Human
uuugucugaaaaccuuugaauagaauggcaugaagauuuuaaucaauuacuuauaaacaaaguc

SEQ ID NO: 187033 - RNA, 64 nt, Human
uuuuuuuggcaaaugaauguaccauuucaacuuugauuuuaauagugcuaguugauauugguaa

SEQ ID NO: 187034 - RNA, 64 nt, Human
gcauuuuugcugaauagguuuaagucagauaauagauuuuaaaaaagcaaaugaggcaaugugu

SEQ ID NO: 187035 - RNA, 64 nt, Human
aaaaacuaauacuuaucuuuaaaauaguaaauaggauuuuaaacagagaauuuuaucaguaaua

SEQ ID NO: 187036 - RNA, 64 nt, Human
acuaaauccuauuaaaauaugcaaaaauaagucagauuuuaaggcaaauaaagugacauaaggu

SEQ ID NO: 187037 - RNA, 63 nt, Human
acaccauguucuccaucaagcuaaagaaaucacgugccugaaacugugcuuaaguuuuggggg

SEQ ID NO: 187038 - RNA, 63 nt, Human
gagaacuacuucuaugugccagaccugggccaggugccugagauugauguuccauccuaccug

SEQ ID NO: 187039 - RNA, 63 nt, Human
ggacagcaugauuuccuaaaaaggggaaaaaaagugccugaagcaaaucuugguugccuucua

SEQ ID NO: 187040 - RNA, 63 nt, Human
acagugggccuggcccguggagcugccacgcaggugccugagggccaggugccacgcaggugu

SEQ ID NO: 187041 - RNA, 64 nt, Human
uuaaaaaggauucuuuauacauaugugcugaauugauuuuaagaaaguugcaugauccuguagg

SEQ ID NO: 187042 - RNA, 64 nt, Human
aaugcuaacuuuauaguauuucuaauuguucaaggauuuuaaaauucuauuucagggaguauau

SEQ ID NO: 187043 - RNA, 64 nt, Human
uggcucccucuccucccugagcaccugcugcugcgauuuuaaagggaacuguacuacucgcagu

SEQ ID NO: 187044 - RNA, 64 nt, Human
aauaaguugaaaaagaaauccauaacuauuaaaagauuuuaacuuuuuuauuuuauuaaaaugc

SEQ ID NO: 187045 - RNA, 64 nt, Human
auuaggaaaaccaaauauugcaaauggucaauucgauuuuaauuucucaaaagauacucuguua

SEQ ID NO: 187046 - RNA, 64 nt, Human
augcugugguaggcaacagaaaaaaacuucuauugauuuuaauuuaauaugaauacuuuaaaga

SEQ ID NO: 187047 - RNA, 64 nt, Human
cccuggauauguuucauugucagauuuugugcuugauuuuaagaauggaauuguggguaucuuu

SEQ ID NO: 187048 - RNA, 64 nt, Human
gcuaguuacacuuguaaguuuuccauaaugacaugauuuuaaacauaaagaguucauaagaauc

SEQ ID NO: 187049 - RNA, 64 nt, Human
agccaugggauuauugaggcuuucacauaucagugauuuuaaaauaucaguguuuuuugcuacu

SEQ ID NO: 187050 - RNA, 64 nt, Human
ucuuuuuaaaaugcuguuuuguuuuaauuuuugugauuuuaauuugauacaaaaugcugaggua

SEQ ID NO: 187051 - RNA, 64 nt, Human
gguuauuugaggggaaaaaaccccauagugccuugauuuuaauucaggugauaacucaccaucu

SEQ ID NO: 187052 - RNA, 64 nt, Human
auacuuuugugauuugagccaucauuucacuucugauuuuaagacaacucaugauuguuagcuu

SEQ ID NO: 187053 - RNA, 64 nt, Human
gugaaagaacuucugauauuuguguuauccuuaugauuuuaaauaaacaaaauaaaucaaguug

SEQ ID NO: 187054 - RNA, 64 nt, Human
auguuggaaguaguaguuuguuuauagugucauggauuuuaaaaucaaacucaguuuuuauuuc

SEQ ID NO: 187055 - RNA, 64 nt, Human
auuacucugaaauuguaacuaaaguuagaaaguugauuuuaagaauccaaacguuaagaauugu

SEQ ID NO: 187056 - RNA, 63 nt, Human
aaacuagacuuuuuccaaaccuggccgaguguggugccugagcugugagaaguguccucagcc

SEQ ID NO: 187057 - RNA, 63 nt, Human
aauaaauaaaacaaaacaaaacaaaaaaaacuugugccugauaagcuaaggcucauuuauuuu

SEQ ID NO: 187058 - RNA, 63 nt, Human
uuuggcucaagcucacaacucugauaacugucagugccugagguugugauuggugacauucug

SEQ ID NO: 187059 - RNA, 63 nt, Human
cccuuccccauuuguuggauggcugcaaucucagugccugagggaagaugccuaguagaggaa

SEQ ID NO: 187060 - RNA, 64 nt, Human
guuucagccuaugcuuaaugcaagcuaggauagugauuuuaaauaaucacuaaaaucacuagau

SEQ ID NO: 187061 - RNA, 64 nt, Human
uauaauauauauuaaaaaugaaacaauuaaucuagauuuuaacauuuucagaaacuuagugaua

SEQ ID NO: 187062 - RNA, 55 nt, Human
augaaaaucucuuguuuugaacgaagauuuuaaagaacucaacuuuccagcaucc

SEQ ID NO: 187063 - RNA, 64 nt, Human
uuuaaucagagugccauuuuuuuuuuguucaaaugauuuuaauuauuggaaugcacaauuuuuu

SEQ ID NO: 187064 - RNA, 64 nt, Human
auugucuuugcuguacucuugcugauggcugcuagauuuuaauuuauuuguuucccuacuugau

SEQ ID NO: 187065 - RNA, 64 nt, Human
uugauugaguugacuguuuuuaaaaaacuguuuggauuuuaauugugaugcagaaguuauagua

SEQ ID NO: 187066 - RNA, 64 nt, Human
ugaucaucuucagggcccacaaaaauguugucaagauuuuaaagguuuauaauucugcuuaagc

SEQ ID NO: 187067 - RNA, 64 nt, Human
cugaaauuacuaaauuggguaagaugauuuaaaugauuuuaauuuuaacauuuuauuucuagaa

SEQ ID NO: 187068 - RNA, 64 nt, Human
ccuuuauaggauagugaaaaaugcuggcugaguggauuuuaagagaaauaauuguauuuguuaa

SEQ ID NO: 187069 - RNA, 64 nt, Human
uauuuuuaaaacacaaguagaaugauuuaaauaggauuuuaaugaauuuuuggcaaguggcugu

SEQ ID NO: 187070 - RNA, 64 nt, Human
agcucaugcuuuuuuauguaggacuagcuuaccugauuuuaaugaaaaucacauuuugauacaa

SEQ ID NO: 187071 - RNA, 64 nt, Human
aauguauuauacagauaaaguauuacauguguuugauuuuaaaagggcggacauuuuauuaaaa

SEQ ID NO: 187072 - RNA, 64 nt, Human
cuauguauaaauguuacucugaguuauuaauguggauuuuaaaauuguaagcaauagaauagga

SEQ ID NO: 187073 - RNA, 64 nt, Human
acuuuucguauaauagauacguucuuuggauuaugauuuuaagaaauuauuaauuuaugaaaug

SEQ ID NO: 187074 - RNA, 64 nt, Human
uuugaaacuaacauuuuacacugaauuauuuugagauuuuaaagaaguaauuaagugcaaaaug

SEQ ID NO: 187075 - RNA, 63 nt, Human
ccgucccaaggcugucacuaguauuucucugaagugccugaagguaggaaugggccggcgauu

SEQ ID NO: 187076 - RNA, 63 nt, Human
ugagggugucucugugaggcuccacugcggucugugccugacuggccacaucuaacucucugu

SEQ ID NO: 187077 - RNA, 63 nt, Human
gggaaagugucucucacgggcauuggugugggcgugccugacauacguguucagucccuugca

SEQ ID NO: 187078 - RNA, 63 nt, Human
guacgucucaucacagcugguagagacccaggagugccugauugucccacagggguggcgcac

SEQ ID NO: 187079 - RNA, 64 nt, Human
aagagauuuauagucauaauuauuuuauuguaaagauuuuaacuaaaguuuuuccuuuucucuc

SEQ ID NO: 187080 - RNA, 64 nt, Human
ccaguauuuucccugagcuagaggagaagucuuagauuuuaagaguaauacaacccaucuaucu

SEQ ID NO: 187081 - RNA, 64 nt, Human
agcaggcaagcauguugaauguaucuaguggucugauuuuaauuugggcaucucuagagaacgc

SEQ ID NO: 187082 - RNA, 64 nt, Human
uuggaaaggaauacuaaaaucauuacaagguauggauuuuaaauggaugaaacuucaaauuauc

SEQ ID NO: 187083 - RNA, 64 nt, Human
aucauagaucauuuuuccauaugacacugguuccgauuuuaaaaauuauuuuuaaauaaccgau

SEQ ID NO: 187084 - RNA, 64 nt, Human
augacaacuuuuaaagaaaaauaugauacucucagauuuuaagggggaaaacuguucucuuuaa

SEQ ID NO: 187085 - RNA, 64 nt, Human
gccucuacuuguagagucagcuaaaggaaugugagauuuuaaauuauugaccaccuguuugauu

SEQ ID NO: 187086 - RNA, 64 nt, Human
auuuuuaaucuguuaugcuuuguuuaucaaccuugauuuuaauuaagacuuuuauaagacuagc

SEQ ID NO: 187087 - RNA, 64 nt, Human
uaguuauuuuauaaucaaugaauuuguucuuucugauuuuaaguuugcagauuuauuuagugaa

SEQ ID NO: 187088 - RNA, 64 nt, Human
uguauguauuauuauuaaagaaaaaugcaaucaggauuuuaaacauguaaauacaaauuuugua

SEQ ID NO: 187089 - RNA, 64 nt, Human
uauauugaaagaaauaggccagcagagacuuagggauuuuaaauuggcuugcuuuuuagcuguu

SEQ ID NO: 187090 - RNA, 64 nt, Human
uuaagauugcagaaugauagugauuauucaauuagauuuuaaguaaggauugugauauuagagg

SEQ ID NO: 187091 - RNA, 64 nt, Human
ucugcacuuagguauaccucuuuaugccaauaaugauuuuaaugaaggcucuuuucagauguaa

SEQ ID NO: 187092 - RNA, 64 nt, Human
accgauggccauguaaauaagaugauuuaauguugauuuuaauccuguauauaaaauaaaaagu

SEQ ID NO: 187093 - RNA, 64 nt, Human
uugguaguacuuugcuuuagcuuuuaaauggcuugauuuuaaaggagaaauucuauuuauuaau

SEQ ID NO: 187094 - RNA, 63 nt, Human
cuggccccuggugugagcauuagaccagccacagugccugauugguauagccuuaugugcuuu

SEQ ID NO: 187095 - RNA, 63 nt, Human
ucugcaaaggggcaucggagaagugcagcugcugugccugaugugggaacagcucuucuccca

SEQ ID NO: 187096 - RNA, 63 nt, Human
ucugcaaagggacgucggagaagugcagcugcugugccugaugugggaacagcucuucuccca

SEQ ID NO: 187097 - RNA, 63 nt, Human
ccugaaaaggggcauuggagaagugcagcugccgugccugauguugggacagcccugcgucca

SEQ ID NO: 187098 - RNA, 64 nt, Human
guaugaaaguucaauguugcuguucuugcucagugauuuuaaagaaauugaguaguuccuaugu

SEQ ID NO: 187099 - RNA, 64 nt, Human
ugauucagaauuauagaaaacuugauaaauacuugauuuuaaccaaugagacuacaggcagaug

SEQ ID NO: 187100 - RNA, 64 nt, Human
cagugcauaacuaaguauuuuccuuaauacuaaagauuuuaaauaauaaauaguggcuagcggu

SEQ ID NO: 187101 - RNA, 64 nt, Human
acuaaaugaaucagcaguggauguagggauagcugauuuuaaaacacucggcugggcacagugg

SEQ ID NO: 187102 - RNA, 64 nt, Human
auuuguaacugcagaagacuaucuuaaaauacaggauuuuaacauuuaagucaugcacauuuaa

SEQ ID NO: 187103 - RNA, 64 nt, Human
cuuuaccuuugcccuaccuucuguuuguaaggaugauuuuaauauuaauuccaggaacacaugu

SEQ ID NO: 187104 - RNA, 64 nt, Human
uagagcuuccaacuguauauuuuuuacuuuuauagauuuuaaaacuaugauccuuuauaugugu

SEQ ID NO: 187105 - RNA, 64 nt, Human
uuacuagcgaggucaguguuaggcuugcaauagggauuuuaaaauacacuaacuaguuccuuag

SEQ ID NO: 187106 - RNA, 64 nt, Human
aucagaagugaugauuaucauaugauaccucagugauuuuaaaagccauagaagaaacuugacu

SEQ ID NO: 187107 - RNA, 64 nt, Human
caaaaucuauuuagguucucuguguaugaauccugauuuuaacugcuaggauucagcuaaauuu

SEQ ID NO: 187108 - RNA, 64 nt, Human
acguuuacuccuuucuagaugaaaaccaagcacagauuuuaaaacuucuaagauuauucuccuc

SEQ ID NO: 187109 - RNA, 64 nt, Human
cugcuguguucauuaggugccaaugugaagucuggauuuuaauuggcauguuauuggguaucaa

SEQ ID NO: 187110 - RNA, 64 nt, Human
uuugggauuuucaaauauuuaauucuaaauuccagauuuuaaggaagauuuuucaagaaacugc

SEQ ID NO: 187111 - RNA, 64 nt, Human
uuuuacuuucaggcucuuguuuugguucagaggagauuuuaaauauugaaugacacuucuacag

SEQ ID NO: 187112 - RNA, 64 nt, Human
gcaaacauggagaaaucuacugaauuggcuuccagauuuuaaauuuuaugucauagaaauauug

SEQ ID NO: 187113 - RNA, 63 nt, Human
aaugacuguauuuuuaaaggaauaaaucccagugugccugauuugacauucuugucagcaaaa

SEQ ID NO: 187114 - RNA, 63 nt, Human
ugcccugaccaaaaauaucugccaugaauaaaggugccugaaauccugcuaugaagcuuccuu

SEQ ID NO: 187115 - RNA, 63 nt, Human
acagcaucccaaggugcucagccggacucccuggugccugauccugcuggggccugggggucu

SEQ ID NO: 187116 - RNA, 63 nt, Human
gucugggggguggaggccugagcugagggcagggugccugaccugugugccggcugcucacug

SEQ ID NO: 187117 - RNA, 64 nt, Human
aaguaaagcuaaaaugauuuuaucugugaauucagauuuuaaaaagucuucacucucugaagau

SEQ ID NO: 187118 - RNA, 64 nt, Human
auauaguauuauuaaggauugagacaaaaacugugauuuuaauacuuaaauugcuaaagaauaa

SEQ ID NO: 187119 - RNA, 64 nt, Human
guuuacuuuucaauauuuucauauuucuuaaccagauuuuaaagaaauuuguuguuaguuacgu

SEQ ID NO: 187120 - RNA, 64 nt, Human
uagauuaguucauaaacaaaaugguaucaauaaagauuuuaaauaucauuuugguuacugauuu

SEQ ID NO: 187121 - RNA, 64 nt, Human
cuugaguuguacaacagaacacuuguacaaaauagauuuuaaggcuaacuucuuuucacuguug

SEQ ID NO: 187122 - RNA, 64 nt, Human
uuucugccagucauccagcugauacacaccugaugauuuuaaagaaagccacacagagcugaau

SEQ ID NO: 187123 - RNA, 64 nt, Human
acuaauuuuuucuuguauauaaacuaauugguuugauuuuaaauauuucuggcuuuuauuaaua

SEQ ID NO: 187124 - RNA, 64 nt, Human
agaaacaugauaaaugcaagaaagaaaacauuuugauuuuaacucauugucacucugauguuca

SEQ ID NO: 187125 - RNA, 64 nt, Human
cuuagaaaaacuucuaggaacagggugaaccacugauuuuaauuugccuaauuaucuuaugaca

SEQ ID NO: 187126 - RNA, 64 nt, Human
gauaacauuaagguaaaauauaggcuuagaguaugauuuuaacaaugauguaacacuagguaau

SEQ ID NO: 187127 - RNA, 64 nt, Human
caaggaacacaauuucccucccuaucaacaagaggauuuuaacagcaaagaagagaggcagcac

SEQ ID NO: 187128 - RNA, 64 nt, Human
cacugacaauaguuaugccuguacuaaggagcaugauuuuaagaggcuuuggcccaaugccuau

SEQ ID NO: 187129 - RNA, 64 nt, Human
guuuuucuaucuguguacuuuuuuuuaagggaaagauuuuaauauuaaaccuggugcuucucac

SEQ ID NO: 187130 - RNA, 64 nt, Human
guuuuuagguuuacuuacauacagugacucuccagauuuuaaguugacaacucagugaauaauu

SEQ ID NO: 187131 - RNA, 64 nt, Human
ucauaugcuauuuuuuaaaauuuggcuuuccuaggauuuuaagaacaaugaaaguuagcuucac

SEQ ID NO: 187132 - RNA, 63 nt, Human
ugcccccuggcccuggcucucgugugcauggacgugccugagggguccgggcacggccauacg

SEQ ID NO: 187133 - RNA, 63 nt, Human
ccuugccuggccuggucugcggguccaucgucagugccugagcggccagcagaaggggggcag

SEQ ID NO: 187134 - RNA, 63 nt, Human
uggcgucugguguggaauggccuuccucucuaggugccugagguguccgcugacggguggccu

SEQ ID NO: 187135 - RNA, 63 nt, Human
guguguguguguguguguguguguguccaggaugugccugaaguauugauaggucuucucaga

SEQ ID NO: 187136 - RNA, 64 nt, Human
aacuaucucaugccagugccuuauuacccaggaagauuuuaaaggaccucauuaauaauuugcu

SEQ ID NO: 187137 - RNA, 64 nt, Human
aaauaaagccauauuuaguauaccagagaagguagauuuuaagaauggucucaguguuaauacu

SEQ ID NO: 187138 - RNA, 64 nt, Human
gauaugaggcaacacaagcacagacaguugcauagauuuuaauuuauacauaucaagaaaagug

SEQ ID NO: 187139 - RNA, 64 nt, Human
guuguuuuuuaaauaaaguagccauauguaacgggauuuuaaaaauauauacauuuuacaacau

SEQ ID NO: 187140 - RNA, 64 nt, Human
uuaauuucugucugcauauuagcuuuuaaugugugauuuuaagagagaauacuuugacaccugu

SEQ ID NO: 187141 - RNA, 64 nt, Human
cuucuccuggucucuccucaaaagaauuuuacaugauuuuaaaauaauaauagcuuucauuuac

SEQ ID NO: 187142 - RNA, 64 nt, Human
uccagacagacacagacuacaccacaggagagaagauuuuaaccugugucuuacuuccucagcu

SEQ ID NO: 187143 - RNA, 64 nt, Human
ucaaugcgaacgucacagcgccuucgagggcgcagauuuuaacugccacguauuuuuaaguugu

SEQ ID NO: 187144 - RNA, 64 nt, Human
uugcccuuacggagugucuguuuuuagaaauuuagauuuuaaaaggcgugggacauacgaccag

SEQ ID NO: 187145 - RNA, 64 nt, Human
ugguaccuuuuagcuauauuugcagauucucugggauuuuaaggaacugagaaaacagcaaagu

SEQ ID NO: 187146 - RNA, 64 nt, Human
cugguuuuggagaacuugucuacaaccagggauugauuuuaaagaugucuuuuuuuauuuuacu

SEQ ID NO: 187147 - RNA, 64 nt, Human
guuagguagugugauuauagcacuacuacugucagauuuuaaauuguauguguacuugcaucua

SEQ ID NO: 187148 - RNA, 64 nt, Human
gauuauuaaaauauuguccauuaacuaguucauagauuuuaaaaguaaaauacuucugacuguu

SEQ ID NO: 187149 - RNA, 64 nt, Human
auuauguauguuaauuucagcaauuaaaagaauugauuuuaaugacuuugaauucuuaauuucu

SEQ ID NO: 187150 - RNA, 64 nt, Human
uauuucuuuuaaaaguauguuuuggaaaaucaaugauuuuaaugcauagcaguauguuugaaaa

SEQ ID NO: 187151 - RNA, 63 nt, Human
gguuccucauguguuuucaccaaaaccaccccagugccugagauugaaaauauuguaacuuuc

SEQ ID NO: 187152 - RNA, 63 nt, Human
ucucaugaagcccuuagggagagcaccuguugugugccugacaccacgcuggagcuguguacc

SEQ ID NO: 187153 - RNA, 63 nt, Human
cuuuaacuuacgaaagauguacuaauugugggggugccugagucaggcggagcugacccaggg

SEQ ID NO: 187154 - RNA, 63 nt, Human
cuaccuucaggggugugucagggaugaggacgggugccugagcuuagguuguggaguggcuga

SEQ ID NO: 187155 - RNA, 64 nt, Human
uugggcauuccaaaauacagccuuugguucaguagauuuuaaugcuuuaaauagacugacgucg

SEQ ID NO: 187156 - RNA, 64 nt, Human
uacauuucccccaaaaccuuagacauucauaguagauuuuaauuaguuagcuuucuaacuaguc

SEQ ID NO: 187157 - RNA, 64 nt, Human
acuggcucuagguauuugaggagcacaauacagagauuuuaaaaagugauuuuguaaaaucuac

SEQ ID NO: 187158 - RNA, 64 nt, Human
ggaaugggaaccuuccuguuaaauucgguguauggauuuuaagaaaggaaucuagccaaugagg

SEQ ID NO: 187159 - RNA, 64 nt, Human
gguuaucuccucuuugagauguagaaaauggccagauuuuaauaaacguuguuacccauguccu

SEQ ID NO: 187160 - RNA, 64 nt, Human
gucuucagacaguuugaaggaaugaaaaccuagagauuuuaaaucaugaauugaacauguaaaa

SEQ ID NO: 187161 - RNA, 64 nt, Human
acaaaucccauggauucugauuucugggucuuaggauuuuaaaagugaagggauauuuuucuua

SEQ ID NO: 187162 - RNA, 64 nt, Human
auuuuaaaggggucugaaauuugugauggaaucagauuuuaacagcucucuucaaugacauaga

SEQ ID NO: 187163 - RNA, 64 nt, Human
uaucugggcagcgcugcccauuuauuuauauguagauuuuaaacacugcuguugacaaguuggu

SEQ ID NO: 187164 - RNA, 64 nt, Human
augacuacagcugugacacuuaagauugauuggagauuuuaaaacuggaggaugcauuuagagg

SEQ ID NO: 187165 - RNA, 64 nt, Human
uagcuaaaaaaagauuuugacauaaaagagccuugauuuuaaaaaaaaaagagagagagaugua

SEQ ID NO: 187166 - RNA, 64 nt, Human
uaagcaacuaaaugagaccuaauaauuggccuucgauuuuaaauauuuguucuuauaaaccuug

SEQ ID NO: 187167 - RNA, 64 nt, Human
gguuggagggaaggugaaguucaaugaugcucuugauuuuaaucccacaucauguaucacuuuu

SEQ ID NO: 187168 - RNA, 64 nt, Human
cuuuaguaucucaggccuccaaggauuccaugaugauuuuaaugucuuucucaaaacucugaua

SEQ ID NO: 187169 - RNA, 64 nt, Human
uaucagaguuacaguugucagugaaacuacuuuggauuuuaaccucuuagaggaagaaaaaagg

SEQ ID NO: 187170 - RNA, 63 nt, Human
cauugcccggcuccugaauuaaacucuguucuggugccugagcucagggguuuucagagaaug

SEQ ID NO: 187171 - RNA, 63 nt, Human
uuuccacaaacucucaucucaggcccuccccuugugccugauaccugcacuccggcuuccuag

SEQ ID NO: 187172 - RNA, 64 nt, Human
cuggcauuggccacugaaggguacaaaggcaaaaggaccacagcaccacuuagguguagcaugg

SEQ ID NO: 187173 - RNA, 64 nt, Human
agugauccucccaccucagccucucaaguggcugggaccacagaagugcaccaccaugccuggc

SEQ ID NO: 187174 - RNA, 64 nt, Human
uucuuuggucgucguccucgguagcaagaccccugauuuuaagcuuugcacauguccacccaaa

SEQ ID NO: 187175 - RNA, 64 nt, Human
cauuccacuggggaaagagagagagaaaagagcagauuuuaaaaaaaagauaugacugagcauu

SEQ ID NO: 187176 - RNA, 64 nt, Human
uucaagcagguacuucucugugcauuauagaauagauuuuaauaaucuuauagcauuguauauu

SEQ ID NO: 187177 - RNA, 64 nt, Human
ugcuauaguucaguagcuucugcuaaauuucacugauuuuaaucaugcuggagaccuuaacucc

SEQ ID NO: 187178 - RNA, 64 nt, Human
uuguuaauuauuuaccaguuuuuaacuuaagccugauuuuaacaacuugauaaugguguaauac

SEQ ID NO: 187179 - RNA, 64 nt, Human
cuuauggaaaaaaauauaaaagaucacauauacugauuuuaaaggcuccucagucauuuggagc

SEQ ID NO: 187180 - RNA, 64 nt, Human
aaacauaaaugaaaugccuaaauauauuguuacagauuuuaauacuguggaucaaggaaagaua

SEQ ID NO: 187181 - RNA, 64 nt, Human
uuaauggaaaaaaauggauuuagaauaauaaauggauuuuaaacuauccucuaagcuuuaucuu

SEQ ID NO: 187182 - RNA, 64 nt, Human
uaaucaguggugcuuuuguaccuagguuuuaugugauuuuaaugaaacauggauaguuguggcc

SEQ ID NO: 187183 - RNA, 64 nt, Human
uuguacuuccaaagagaauugggcuguuuauaaugauuuuaauagagaaagaucccagggaucg

SEQ ID NO: 187184 - RNA, 64 nt, Human
aguuguuuuaaugguaagaauuaagacauuuguagauuuuaaagaaaaauaugaaauuguccau

SEQ ID NO: 187185 - RNA, 64 nt, Human
acuaugguuuaucuuuucaaagcucuuuuaauaggauuuuaauguuuuagaaacaggauuccag

SEQ ID NO: 187186 - RNA, 64 nt, Human
gugcuuuccuuuuuuaaaaaugcaaauccuaugugauuuuaacucugucuucaccugauucaac

SEQ ID NO: 187187 - RNA, 64 nt, Human
aaacacacauguaugacccuuacaagugcuuuaagauuuuaaaaaugugauguuuuguccacag

SEQ ID NO: 187188 - RNA, 64 nt, Human
agcagcuguuguaccuguuacacuugugcagaaagauuuuaauguggggggugggagacuuuua

SEQ ID NO: 187189 - RNA, 63 nt, Human
acucuucugucuuguccccacccaugcgccuucgugccugagaccaggguggccacacaggca

SEQ ID NO: 187190 - RNA, 63 nt, Human
uguauaucaauaauuaaucaggaauggguuuuggugccugaaaaauuggccauggaggcacac

SEQ ID NO: 187191 - RNA, 63 nt, Human
cagaugcccaagggagguccccacagagccagagugccugaggcuuccugcuugagaaccugc

SEQ ID NO: 187192 - RNA, 63 nt, Human
cagucccguggacccagccuuugucaguggcaggugccugaacagaggguggaugggggggau

SEQ ID NO: 187193 - RNA, 64 nt, Human
uuauuaaaauguucuugaaaguacuauucccagggauuuuaaugcacaaaccauauugugacaa

SEQ ID NO: 187194 - RNA, 64 nt, Human
uaauccugaacauuagaacccuaauguucaggaagauuuuaaucuaagcauuuuuauggaaaua

SEQ ID NO: 187195 - RNA, 64 nt, Human
auauaguuaaaauccuggucuuucuugguaaacagauuuuaaaugucugauauaaaacaugcca

SEQ ID NO: 187196 - RNA, 64 nt, Human
aaaaaucuuuagaaagaguuucccauuuaauuuugauuuuaaagaauuauauuggauaaggugg

SEQ ID NO: 187197 - RNA, 64 nt, Human
uuuaggccagaaguacaaaacaaaaaaaccaauggauuuuaaccaaaaugauuugaaauauagg

SEQ ID NO: 187198 - RNA, 64 nt, Human
uugcuggauugacuauaacuuaagugcugauugugauuuuaaaaugauaguaccguaaagcauu

SEQ ID NO: 187199 - RNA, 64 nt, Human
acugcauuugaaaaguuuuauggagaauaugcaugauuuuaaaucugugauaauguuacaugca

SEQ ID NO: 187200 - RNA, 64 nt, Human
uaauuuaaugauacuaucuuuccaaacuuuguuagauuuuaaauguauuauugaccugagaccu

SEQ ID NO: 187201 - RNA, 64 nt, Human
auuucacuuuuacccucaaguccgauuugucugugauuuuaaacuaacuguguauguauugaug

SEQ ID NO: 187202 - RNA, 64 nt, Human
cagaaagaaaaaaaacaaaaagggagcuauuccagauuuuaaaaauaaaagauauaguaacuaa

SEQ ID NO: 187203 - RNA, 64 nt, Human
cauuucgacucggucugcugaucugagguuuuuagauuuuaaauauuuauguggaauuaauuaa

SEQ ID NO: 187204 - RNA, 62 nt, Human
cccucaagcuccuuaagugaauugccguaacugauuuuaaaggguuuagauuuuaagaaugg

SEQ ID NO: 187205 - RNA, 64 nt, Human
aagugaauugccguaacugauuuuaaaggguuuagauuuuaagaauggugcucuuucaugccua

SEQ ID NO: 187206 - RNA, 64 nt, Human
cggaggcaaucccggaaaccucuuuuauaagugugauuuuaaaaauguggauuaaacucucgau

SEQ ID NO: 187207 - RNA, 64 nt, Human
gcauuaauauuauuagcaugaaauuuuuacuucagauuuuaagcucaugaauaaagauauaucu

SEQ ID NO: 187208 - RNA, 63 nt, Human
guuuaggguugcuggaggccgggcuaccgucuugugccugaaaaccacggggccuguccccag

SEQ ID NO: 187209 - RNA, 63 nt, Human
ucugucccugccccuagucaccuagcugugagggugccugaggcugaauggcuccaccccucc

SEQ ID NO: 187210 - RNA, 63 nt, Human
ggggcaggcucugaagccucagcccgacucagagugccugaacccugccgcgccagucccccg

SEQ ID NO: 187211 - RNA, 63 nt, Human
gcccguuggggaucucagcaguggggcaggagggugccugauuucggggaguccugacccgag

SEQ ID NO: 187212 - RNA, 64 nt, Human
aacaugcaaaagcaaugcagccggaaagaacggagauuuuaauuuuuaacaaacaacaaauuaa

SEQ ID NO: 187213 - RNA, 64 nt, Human
auauucauaaggaauauaagcuuccaucaauagugauuuuaaauuugauuuuuuucuuaacucu

SEQ ID NO: 187214 - RNA, 64 nt, Human
acuuugucaaauuuguggaguuagguggaagccagauuuuaaaaguugccaaccaggagauuua

SEQ ID NO: 187215 - RNA, 64 nt, Human
guugucaucuauuuacuagauacauguuuuuaaugauuuuaauguaagcuuuuauuaauacuga

SEQ ID NO: 187216 - RNA, 64 nt, Human
cgggcaaauaugauagugucuuacauugggccuugauuuuaaguuguuauauuuguacaaucga

SEQ ID NO: 187217 - RNA, 64 nt, Human
auucaauggauauacauuuuuuucugaagauuaagauuuuaauuauucaacuuaaaaaguagaa

SEQ ID NO: 187218 - RNA, 64 nt, Human
cuuuucuacugaaucuauauuuccauuuguaagugauuuuaaguuaacauaugaaggcagggaa

SEQ ID NO: 187219 - RNA, 64 nt, Human
uacauuuauuuaucuguuguacagauuugauuaugauuuuaauguuugaaagauugcacuuguu

SEQ ID NO: 187220 - RNA, 64 nt, Human
uaugauuuagacuucaaggaauuccaaugaugaagauuuuaaggaaaguauuuuauauucaaca

SEQ ID NO: 187221 - RNA, 64 nt, Human
gaaucaauauguaaaaaguauaaugaaugauuuagauuuuaagugccuuuucacugggagaauc

SEQ ID NO: 187222 - RNA, 64 nt, Human
cuaagaauggaauugugguauuuuuuucuguauugauuuuaacagaaaauuucaauuuauagag

SEQ ID NO: 187223 - RNA, 64 nt, Human
cauuagcucuuuacucuuucucaaccccuuuuaugauuuuaauaauucucacuuaacuaauuuu

SEQ ID NO: 187224 - RNA, 64 nt, Human
gaagauaaugcugcauuucuggguuucuuguguggauuuuaaaauaaauugugccuacaaauau

SEQ ID NO: 187225 - RNA, 64 nt, Human
auugagaugugcugucaguauaaaauacauaccagauuuuaaagauguaccaaaaaauguaaac

SEQ ID NO: 187226 - RNA, 64 nt, Human
gaacgaauuaaaauaugauagagaacuauaugcagauuuuaaaaucuagucaguacuagcaucu

SEQ ID NO: 187227 - RNA, 63 nt, Human
guuguccguuuucaaauucaucaacagccuagagugccugagauauaagaugaaacacaaauc

SEQ ID NO: 187228 - RNA, 63 nt, Human
cacccagguggccgcguugggcugucagccaaggugccugaaacgauacgugugcccacucca

SEQ ID NO: 187229 - RNA, 63 nt, Human
aaacgauacgugugcccacuccacugucacagugugccugaggaaggcugcuagggauguuag

SEQ ID NO: 187230 - RNA, 63 nt, Human
caaccuugaguauucuacacaaugugaauucaagugccugauuaauugagguggcaacauagu

SEQ ID NO: 187231 - RNA, 64 nt, Human
augcaagucaauucauuuaaugugccaagagguagauuuuaaacauagucuaucguggaaguuc

SEQ ID NO: 187232 - RNA, 64 nt, Human
cguugccuguuguucgguugugugacuaauuguggauuuuaagcugcuauuauuguauuucagu

SEQ ID NO: 187233 - RNA, 64 nt, Human
aauaaguuuuaugaaauggugaaauaauaugcaugauuuuaaguauugccauuuuuguaauuug

SEQ ID NO: 187234 - RNA, 64 nt, Human
ggcuaauucggcuguuacagccacugguuggcuggauuuuaaaccauaaaacuugaagauuacc

SEQ ID NO: 187235 - RNA, 64 nt, Human
acugcauuauaaauuuuauaacagaauuaaaguagauuuuaaaagauaaaauguguaauuuugu

SEQ ID NO: 187236 - RNA, 64 nt, Human
acuugcuauagguuuagggaguguaccucagauagauuuuaaaaaaaagaauagaaagccuuua

SEQ ID NO: 187237 - RNA, 64 nt, Human
gugccacacggcagccuucccgaaacauaguauggauuuuaaaaauguguuuauuuuuguuucu

SEQ ID NO: 187238 - RNA, 64 nt, Human
aaacuuuucauuccauaacagucuuuucacauuggauuuuaaacaaaguggcucuggguuauaa

SEQ ID NO: 187239 - RNA, 64 nt, Human
cagagauugccuguggcucuaauaugcaccucaagauuuuaaggagauaauguuuuuagagaga

SEQ ID NO: 187240 - RNA, 64 nt, Human
uuccuguuugggggugugagggaaaaucagcgcggauuuuaaaaagauggcuguggccugcccg

SEQ ID NO: 187241 - RNA, 64 nt, Human
agaguauuaaaacuuaaaaccauuuuuugacucugauuuuaaguacauuuuuauaugucaguug

SEQ ID NO: 187242 - RNA, 64 nt, Human
uucuccacagugcuugcuuugcccuguugguaaggauuuuaaauaaccaugcucaaaagagcug

SEQ ID NO: 187243 - RNA, 64 nt, Human
ccuuuuauucauugauaucuuuucccaaguacuggauuuuaaaucuguauguaucuguuugauu

SEQ ID NO: 187244 - RNA, 64 nt, Human
auauauucauaauauauaaaagaaauauaucugugauuuuaaaauuuugcuaccaaagaaugca

SEQ ID NO: 187245 - RNA, 64 nt, Human
cauuaaaagacuguuuucagaccuuugucugaaggauuuuaaaugcuguaugucauuaaagugc

SEQ ID NO: 187246 - RNA, 63 nt, Human
aggagcaguugugacucuacccaggaacaaacugugccugaaccugaggugcccaaccccaaa

SEQ ID NO: 187247 - RNA, 64 nt, Human
uaucuaaguggaacuaauugcccgagggcucagcaaggccaagaggagacagccgugacgguaa

SEQ ID NO: 187248 - RNA, 64 nt, Human
aaaaguuucacgucuucgccaaucacagugcagcaaggccaauucucgcagaaacccccacgug

SEQ ID NO: 187249 - RNA, 64 nt, Human
guuuaggcugaaugccuuccacgugauggaggaaaaggccaacucuguccuggucuugcugugg

SEQ ID NO: 187250 - RNA, 64 nt, Human
uuuauuuccaagaaaacuuagggucucaaagcaagauuuuaaagugauuuuugagaagacuugg

SEQ ID NO: 187251 - RNA, 64 nt, Human
auggaaagaaaacuuuugaugaugaaacaauaaagauuuuaaauaucuauuuuaguuugugggu

SEQ ID NO: 187252 - RNA, 64 nt, Human
uuuugcaggcaacaaaaugugccugggagugauggauuuuaaugugcuccagaguccuuucaga

SEQ ID NO: 187253 - RNA, 64 nt, Human
cuagguuuugaaagauuacaugauucaagcgagggauuuuaaaguaaagauguauuuauucuga

SEQ ID NO: 187254 - RNA, 64 nt, Human
acaguugugagccaccacaccuggcuugaauguagauuuuaauaauugaauuuauucugccgug

SEQ ID NO: 187255 - RNA, 64 nt, Human
uguuaaggcugugauuauguuugauauucaccuggauuuuaauacaagccaauaucagcuuccc

SEQ ID NO: 187256 - RNA, 64 nt, Human
aaaaauugccaaaaauuucuaccacuuuuuacuagauuuuaaaaagcuacuuucuuuuauauug

SEQ ID NO: 187257 - RNA, 64 nt, Human
ggauuuaagaguauuuuaagaagacauacugcuugauuuuaauacauugaucaggccauccagg

SEQ ID NO: 187258 - RNA, 64 nt, Human
agggguguuagcauuagugccaugauaucuacuggauuuuaaguagggagacuuuauuuuuaaa

SEQ ID NO: 187259 - RNA, 64 nt, Human
acgauuucagaacucugagcucagagagacuccagauuuuaaaaaauaauuugagugcuuggaa

SEQ ID NO: 187260 - RNA, 64 nt, Human
augugccaagugaucaugauucugcuggaaagaggauuuuaaauauugugggaguucucccacc

SEQ ID NO: 187261 - RNA, 64 nt, Human
ucucuuaaaauuuaauccacucuagccuccuuaugauuuuaauuuguauuugcccacugaauaa

SEQ ID NO: 187262 - RNA, 64 nt, Human
uuuugcucuucuugucuuuguaaucuauuuaguugauuuuaauuacuuucugaauaacggaagg

SEQ ID NO: 187263 - RNA, 64 nt, Human
ggguggcccaaauagaacaagaugcacucgcugugauuuuaagacaagcuguauaaacagaacu

SEQ ID NO: 187264 - RNA, 64 nt, Human
uggaaauaccaucuugguuugagaugcauuugaggauuuuaauuuauggaaagcacaacauaug

SEQ ID NO: 187265 - RNA, 63 nt, Human
ucuguacacucuggggguaaaacagggaaggcagugccugagcauggggacaggugagguggg

SEQ ID NO: 187266 - RNA, 63 nt, Human
caccguguccucgcugaggagagaaagggaggcgugccugagaagguagccugugcaucuggu

SEQ ID NO: 187267 - RNA, 55 nt, Human
augagaaaacauacauguaaaguaugugccugacgcaaaguaaguccuugauaac

SEQ ID NO: 187268 - RNA, 63 nt, Human
cccuucccaccugccugugagaauuggagguuagugccugaagcucagagcuacacauuuuua

SEQ ID NO: 187269 - RNA, 64 nt, Human
guguacguauccaaacuucuuuuaauuguucacagauuuuaaaagcgguagcaccacaugguug

SEQ ID NO: 187270 - RNA, 64 nt, Human
aagacuggaaagggggauuccuuguuaaaggucagauuuuaaauugcauauaaaaugaagugag

SEQ ID NO: 187271 - RNA, 64 nt, Human
accugguuuccugggauucaaaccugcauauugugauuuuaauuugaccagaaaauaugauaua

SEQ ID NO: 187272 - RNA, 64 nt, Human
ucaaaaaaaaaaaggaacuguaauuugauugacugauuuuaagaucagccauaaguaaucagca

SEQ ID NO: 187273 - RNA, 64 nt, Human
aaauguacauaauuuugagguagcuuaugaauuugauuuuaauuauuauguucacaagcuugga

SEQ ID NO: 187274 - RNA, 64 nt, Human
ucaaaauauuugaaaauaaaaaguauucccaagugauuuuaauuuaaaaacaaauuggcuuugu

SEQ ID NO: 187275 - RNA, 64 nt, Human
ugugauuuuuacauacuaaugaauauaaacaggugauuuuaaaauauuacugugcuucuuuggu

SEQ ID NO: 187276 - RNA, 64 nt, Human
uguaaucauauagcuaaagugauaagauagccuugauuuuaaaagcugauucauuaauaucaaa

SEQ ID NO: 187277 - RNA, 64 nt, Human
uaugaauuucaccucuuacauguaaaggguauaagauuuuaauguaauaggucaaaaaucagau

SEQ ID NO: 187278 - RNA, 55 nt, Human
auuuaaaaaggagaagauaacugaggauuuuaaaaagaagccauggaaaaacuuc

SEQ ID NO: 187279 - RNA, 64 nt, Human
uuugaccuccucccuguuauuuucaaguagcugggauuuuaaacuagaugaccucauuaaccga

SEQ ID NO: 187280 - RNA, 64 nt, Human
gcccuagccaauucacaaguuacacugccauucugauuuuaaaacuuacaauuggcacuaaaga

SEQ ID NO: 187281 - RNA, 64 nt, Human
uuuaagauuucugaauuauuuuaucuuaaauugugauuuuaaacgagcuauuaugguacggaac

SEQ ID NO: 187282 - RNA, 64 nt, Human
auggagaaaacagcaccccaaggacucagaagaugauuuuaacaguucagaacagaugugugca

SEQ ID NO: 187283 - RNA, 64 nt, Human
uucguagaagaaauguucaguuuaauuagcuuuggauuuuaacauguuuuucugaaugaccaga

SEQ ID NO: 187284 - RNA, 64 nt, Human
aaacauuuuuauaauucuaauuuggguuaauaaagauuuuaaauauuucuugguuuacuuuugu

SEQ ID NO: 187285 - RNA, 63 nt, Human
cagagccuguggcccucucugccaggccucagggugccugagacacucaccucucugccucgc

SEQ ID NO: 187286 - RNA, 63 nt, Human
cuaauuuuccaaguauuucucuugaaacugccagugccugaacuguuggggccaggauuuucc

SEQ ID NO: 187287 - RNA, 63 nt, Human
gccauuugccaggaagguaucuaacuuggcuuugugccugaagaacuguuucuugucuuucgc

SEQ ID NO: 187288 - RNA, 64 nt, Human
cugcaaaauauuuuaucagcuguuauuggaaagugauuuuaagcaauugcuuccucagugucag

SEQ ID NO: 187289 - RNA, 64 nt, Human
gucauguacuaauccuaguccuuuuccugagguagauuuuaaacaguauuuuuaaaguccaaga

SEQ ID NO: 187290 - RNA, 64 nt, Human
uugcaacuaccucaggacagaaaagauuuauggggauuuuaaaaaucauugaauaacuaguuaa

SEQ ID NO: 187291 - RNA, 64 nt, Human
auacagccuacauaaagacuguuaugaucgcuuugauuuuaaaguucauuggaacuaccaacuu

SEQ ID NO: 187292 - RNA, 64 nt, Human
aaaaguaaacuuuuaagaaaaacauuuuuaaugagauuuuaauaguaauucuagucagucauac

SEQ ID NO: 187293 - RNA, 64 nt, Human
aagcagaaaauaaaggaagcaaguuuucuuccaugauuuuaaauugugaucgaguuuuaaauug

SEQ ID NO: 187294 - RNA, 64 nt, Human
cuaaaaaauuauagaguaauauugccguucugcugauuuuaaauauacaauacaucauacauac

SEQ ID NO: 187295 - RNA, 64 nt, Human
auaucuaucuuuucaucaugucuauaguuccugagauuuuaaaaaaauuugcuuaguaaagguu

SEQ ID NO: 187296 - RNA, 64 nt, Human
cauaucugauuaacauuuuuaauaacuuagaggagauuuuaacuuuauuuaaaaauagguaaaa

SEQ ID NO: 187297 - RNA, 64 nt, Human
ucugauuuuucagaauauuugcaauaagagucuggauuuuaaaaaacacaugcauacacacaau

SEQ ID NO: 187298 - RNA, 64 nt, Human
uuuaaucuucguaacauguuuaaaaaaaaacagugauuuuaacugcauauuugaaccuacaaac

SEQ ID NO: 187299 - RNA, 64 nt, Human
ugaccagugggcauguauuccuauuuuauccuaagauuuuaaugagcaaaaaggggagagaauu

SEQ ID NO: 187300 - RNA, 64 nt, Human
uuaguuguucagcaacugucuuauuuaauggggagauuuuaaguaacauaacuaguggcucuca

SEQ ID NO: 187301 - RNA, 64 nt, Human
ccuggagagaggccuagccaacaacgaagggacggauuuuaaaacagcgagaacugggugccaa

SEQ ID NO: 187302 - RNA, 64 nt, Human
caaucacugugcauaugucuuuucuuagcaaaaggauuuuaaaacuugagcccuggaccuuuug

SEQ ID NO: 187303 - RNA, 63 nt, Human
ggucaucccccacuguaaagccaguuggcuucugugccugacucugugcugagcacagagaaa

SEQ ID NO: 187304 - RNA, 63 nt, Human
gguggggguggaaaaacagaccgggguucccgugugccugagcggaccuucccagcuagaauu

SEQ ID NO: 187305 - RNA, 63 nt, Human
cuuggugguggguuuuuuuguuuuuuuaauucagugccugaucuuuaaugcuuccauaaggca

SEQ ID NO: 187306 - RNA, 63 nt, Human
uugacugggugcugugaggacacaccugggucugugccugagauugccaggcaagauuaagga

SEQ ID NO: 187307 - RNA, 64 nt, Human
agcuaagcaucuccuuacagucacuaauauaguagauuuuaaagacaaaauuuuucuuuucuug

SEQ ID NO: 187308 - RNA, 64 nt, Human
auuuuccccuaaucugcauaaaugaauuagaacugauuuuaauaaaaauauucuguguaaaaag

SEQ ID NO: 187309 - RNA, 64 nt, Human
uuuccuuucuuuuuuuucuugguguuugggccacgauuuuaaaaugacuuuuauuauggguaug

SEQ ID NO: 187310 - RNA, 64 nt, Human
cacauuuagcuugugguaaaugacucacaaaacugauuuuaaaaucaaguuaaugugaauuuug

SEQ ID NO: 187311 - RNA, 64 nt, Human
agucuuaucuaccacacauccccauagauuuaaggauuuuaauagaaagacaugauguauguau

SEQ ID NO: 187312 - RNA, 64 nt, Human
gaccugugaggaguauaacuucuuucagcccucagauuuuaaauacaagcaaauaaacucacua

SEQ ID NO: 187313 - RNA, 64 nt, Human
ucauacggcauugugguucauguuugaaauuacagauuuuaaaugccauguucauuaagaaauc

SEQ ID NO: 187314 - RNA, 64 nt, Human
auaaaccaguugaaucauugaggauccaaguugagauuuuaauucugugacauuuuuacaaggg

SEQ ID NO: 187315 - RNA, 64 nt, Human
aaaaaugauuguuuuagaaguuaaagucaauauugauuuuaaauauaaguaaugaaggcauauu

SEQ ID NO: 187316 - RNA, 64 nt, Human
aauuuaagguuuuguugaaccuuggaaauaugcugauuuuaaagaguguuagaaagccuuuagc

SEQ ID NO: 187317 - RNA, 64 nt, Human
ggggaacuuuuuugcccaugugucuuuuaagugugauuuuaaaaaaaugagugguucaguucau

SEQ ID NO: 187318 - RNA, 64 nt, Human
cuggacagucagaaccacaggucugcuguuaagggauuuuaaauugugcauuuuuaacccuaca

SEQ ID NO: 187319 - RNA, 64 nt, Human
aaauuauuuguaaagaacaucuuuccuacuuuuugauuuuaacaaaugcaaauuuaguucucua

SEQ ID NO: 187320 - RNA, 64 nt, Human
ccauugguuauuuaaaguuuccuuuaaaauaaacgauuuuaaguuauaaaaggugaaucuauug

SEQ ID NO: 187321 - RNA, 64 nt, Human
ugagcucuuggaagacauugucauaaaagccagugauuuuaagaaaaagagugguucuggaauc

SEQ ID NO: 187322 - RNA, 63 nt, Human
cccucgcccaucagugccagccccugcuggcuggugccugagccccucagacagcccccugcc

SEQ ID NO: 187323 - RNA, 63 nt, Human
uguccugacagcacuccucggcaggcauggcuggugccugaagaccccagaugugagggcacc

SEQ ID NO: 187324 - RNA, 63 nt, Human
agccaagcuuguuuuucaguaguuuaaugucaagugccugauacagucgacugcaagucuaaa

SEQ ID NO: 187325 - RNA, 63 nt, Human
ccgagcaaaagacucaguggaugaacuggugcagugccugacagaauaaagaacaguauuaau

SEQ ID NO: 187326 - RNA, 64 nt, Human
uaaaacacauguuuuuauacaaaauaagaacgaggauuuuaauuuuuuuuaguauuuauuuaug

SEQ ID NO: 187327 - RNA, 64 nt, Human
cagcaaauuuuaaaacauuuuuagguuuuacagagauuuuaaccuuuaaacaacagaucuuuaa

SEQ ID NO: 187328 - RNA, 64 nt, Human
uacuuccaaaaacaguuugagaaaaaaacugucugauuuuaagucucuagaggucuguaauagu

SEQ ID NO: 187329 - RNA, 64 nt, Human
gggugagcuguaucuggaugccuuuuuacaauuugauuuuaacuuuuaaaauaaauuuaaaaca

SEQ ID NO: 187330 - RNA, 64 nt, Human
auuagugauggguagcugaugucagcuucauguggauuuuaagcacucuagaaacaaugaagcu

SEQ ID NO: 187331 - RNA, 64 nt, Human
gucauucgcaugcauaggauuuguucuacagguagauuuuaaaaacacguuaaagggccuuaag

SEQ ID NO: 187332 - RNA, 64 nt, Human
ucugagaccugguaacccacgcucuugcauuguggauuuuaaaauguauacucuguacgguucu

SEQ ID NO: 187333 - RNA, 64 nt, Human
ugacaagacugaauguuaccuuuucuuucugacagauuuuaaaaauugauaugauaaaagcaca

SEQ ID NO: 187334 - RNA, 64 nt, Human
gaaaagugauuuaaauaagcagguuaucuuuauagauuuuaaagaaaacuagaaaguuuuaaug

SEQ ID NO: 187335 - RNA, 64 nt, Human
cuuuuccuguggguuucauuuguuaaauucauuggauuuuaauaauauaaaaguauagcuaauu

SEQ ID NO: 187336 - RNA, 64 nt, Human
ucuguuuacuaugaaacaagagucauuuuuagaggauuuuaacagguucauguucuaugaugua

SEQ ID NO: 187337 - RNA, 64 nt, Human
uuuuguagccuuccuccacauccuuucuaaacaagauuuuaaagacauguagguguuuguucau

SEQ ID NO: 187338 - RNA, 64 nt, Human
uaagcacacacauuuucaauucucauguuugagugauuuuaaaauguuuuggugaaugugaaaa

SEQ ID NO: 187339 - RNA, 64 nt, Human
aguuuauuauagaaaaucaacacuaauguuuuuagauuuuaauuguccuauugaugaggcuagc

SEQ ID NO: 187340 - RNA, 64 nt, Human
aaccugaaaccccagaacuugagccuuguguauagauuuuaaaagaauauauauaucagccggg

SEQ ID NO: 187341 - RNA, 63 nt, Human
gaaaaaugagacuaugcguuuuuauaaaaaauggugccugauucggcugucucagacucuuuu

SEQ ID NO: 187342 - RNA, 64 nt, Human
ccuaccuuucccaauuuuaguuucaugcaauaaaaaggccaaacuuuuuauuccauaaaacaag

SEQ ID NO: 187343 - RNA, 64 nt, Human
aguaagcuuuuaaaguauauuucucuuuuggugaaaggccaauggagacauugugaauuuaagu

SEQ ID NO: 187344 - RNA, 64 nt, Human
acgcugccugcuauuaggaaucugagcugaguggaaggccaacuauuaaaccuacauuguaaua

SEQ ID NO: 187345 - RNA, 64 nt, Human
ggagugucuggaauuguggcuauccugauuauaggauuuuaacuuaacugaaaugccugcuuug

SEQ ID NO: 187346 - RNA, 64 nt, Human
uuuucuucagguuaaaaaaaaaguuuaaaaaaaagauuuuaaaauaaagcauuuaugaaggcuu

SEQ ID NO: 187347 - RNA, 64 nt, Human
gaucccugucguaguguugaugauguuaguacaugauuuuaaagguuagaaccccuucuaaaug

SEQ ID NO: 187348 - RNA, 64 nt, Human
aaaaaaagcuuuaugauuuucauaacuuauugcugauuuuaauggauuguuaauuucaguccug

SEQ ID NO: 187349 - RNA, 64 nt, Human
uuuuaugcucuugaaauauucagaaauucuccaggauuuuaauuucaggaaaauguauugauuc

SEQ ID NO: 187350 - RNA, 64 nt, Human
ggaucuuucuuugcccuuccucuccuagcugcuagauuuuaacuaccuuuuacaaauguuacaa

SEQ ID NO: 187351 - RNA, 64 nt, Human
uugagauuaaugugcuuaaaaguccuacgugacugauuuuaaacauugugauaaaauuaauuuu

SEQ ID NO: 187352 - RNA, 64 nt, Human
uuugcagcuacauuugaaagugauagaauaaagagauuuuaaugaguuaucacuuuuucagcug

SEQ ID NO: 187353 - RNA, 64 nt, Human
ucauuuuacaacacaaaaauaagccugugucaaagauuuuaaaaucauggaaaguuaaaaucua

SEQ ID NO: 187354 - RNA, 64 nt, Human
ggcaagaacuggccugagcagggauuuuugccuugauuuuaagucacuggguuccauuguccug

SEQ ID NO: 187355 - RNA, 64 nt, Human
uuuuugcagaauugugcagccaucaccacugucugauuuuaaaacacuuucauaccccaaaaug

SEQ ID NO: 187356 - RNA, 64 nt, Human
ucaccaccgagauaugcuaauuuaacuuacaaaugauuuuaauaaaaucuugaguuuguaucac

SEQ ID NO: 187357 - RNA, 64 nt, Human
augaaaagaaacaaguccagaaaucauauuacaagauuuuaauucaaauuuuucuucuuaaaaa

SEQ ID NO: 187358 - RNA, 64 nt, Human
agguaucucgugcaugaagcugacagcuaaagaagauuuuaaaaauugaguuaaagaugacugu

SEQ ID NO: 187359 - RNA, 64 nt, Human
ucuccguuuuauaagacauuuccuaauuuauggggauuuuaauugaaaauaaacuugaguccca

SEQ ID NO: 187360 - RNA, 63 nt, Human
uuuauguuuucaaacaugccauaaggaaaacgagugccugaacugcaugauuuauuaguuucu

SEQ ID NO: 187361 - RNA, 63 nt, Human
gacaucuuauccuaugaagcauauugcugaguggugccugaaaauugugucuguccgugucuu

SEQ ID NO: 187362 - RNA, 63 nt, Human
agccuccgucuuuguaucccagccccuagcccagugccugacacaggaacugugcacaauaaa

SEQ ID NO: 187363 - RNA, 63 nt, Human
gcuucuauuuuuggccaaaugagaauuaagccagugccugagacugucagaaguugaccuuug

SEQ ID NO: 187364 - RNA, 64 nt, Human
auuuuuaguucagugaugcuuuuguauuuguggcgauuuuaauaaaaaggauauggccuuccca

SEQ ID NO: 187365 - RNA, 64 nt, Human
uccucuggagccacuuggacuucaaaaauaguuugauuuuaaugcaaacuguuguuucugcuuu

SEQ ID NO: 187366 - RNA, 64 nt, Human
aaaaccuuguauaucuuguuuuggugguuuuagugauuuuaauaauauauuuuaaauauuuuuu

SEQ ID NO: 187367 - RNA, 64 nt, Human
aagacuguuuauguugauguauggaaaagagcaugauuuuaaaaaaucaaucauaggaggaaaa

SEQ ID NO: 187368 - RNA, 64 nt, Human
auuauaauguuuguauaugcaaaacugcuagcuugauuuuaaaaaaaaacaaaucuuuaaaauc

SEQ ID NO: 187369 - RNA, 64 nt, Human
gcaaggugaguccucuguggaauugugauugaaggauuuuaaagcaggggaggagaguaggggg

SEQ ID NO: 187370 - RNA, 64 nt, Human
ccuuaugauguacuuuguaaaaaaauugauugaagauuuuaaauaaacaggaaauuagaagugu

SEQ ID NO: 187371 - RNA, 64 nt, Human
uaaaaaccaggaaauuucuacaaucauggagacagauuuuaauuugcaugcucuccuuuauuua

SEQ ID NO: 187372 - RNA, 64 nt, Human
cauuuuucuucugggguuuacugaucaguguggugauuuuaacuucauuuaguaauuacucuag

SEQ ID NO: 187373 - RNA, 64 nt, Human
aagcucucaauuaaguguugggaacuaauuucaagauuuuaaaaaauguuaugcaggcuuaacg

SEQ ID NO: 187374 - RNA, 64 nt, Human
aauuuuucaaaaauugaauuuuaaaauuucuuaugauuuuaaauaccuugacauugauuuugcu

SEQ ID NO: 187375 - RNA, 53 nt, Human
cagcugugaaagcaacauaaauggauuuuaaacugucuacgguucuuaaccuc

SEQ ID NO: 187376 - RNA, 64 nt, Human
cacaguagaauagaaauguuugugaaauaaaacugauuuuaacuggaaggagaaacagguuaau

SEQ ID NO: 187377 - RNA, 64 nt, Human
uacugagaauuaaguuuguacuuccauaagcuuggauuuuaaacacugauaguaucucaugagu

SEQ ID NO: 187378 - RNA, 64 nt, Human
uugaauuuuuaaaguuuuuaguuacuuaaaauaugauuuuaaauuacauauuaauuuagaaaau

SEQ ID NO: 187379 - RNA, 64 nt, Human
uuaagggaagaguuauuuaauauaaauagucucugauuuuaaguucuguuuaauguucauucuc

SEQ ID NO: 187380 - RNA, 63 nt, Human
ugaaaggaccugcauagacuaugucugugcaaagugccugagugucugcuuucaccucagucu

SEQ ID NO: 187381 - RNA, 63 nt, Human
uuuaauguggcaugguacaagauaaagaagucugugccugaaugaauacacgcagcaaaauuc

SEQ ID NO: 187382 - RNA, 63 nt, Human
uauuaaaugaguaaauggaaacagcuuagaauagugccugacauauauuauguucucuguagu

SEQ ID NO: 187383 - RNA, 64 nt, Human
cuccaauauuaccaggcccaacucagucuucagugauuuuaaacagcauugacaucaucuguaa

SEQ ID NO: 187384 - RNA, 64 nt, Human
uguuuucgaugaugaugaugaucaugaugaugaugauuuuaacaguuuuacuucuggccuuucc

SEQ ID NO: 187385 - RNA, 64 nt, Human
uauuauauauuuacaaggaguuauuuuuuguauugauuuuaaauggaugucccaaugcaccuag

SEQ ID NO: 187386 - RNA, 64 nt, Human
aauguaucugugagaaucucauaguuaauauaaagauuuuaaaacugcauuaugaccuagcccc

SEQ ID NO: 187387 - RNA, 64 nt, Human
ucaucagguuuacaagaucaucagagaaacagaggauuuuaauuuuuaguucuggccggcuaca

SEQ ID NO: 187388 - RNA, 64 nt, Human
uaaaauucuuugaaguccaauaaagcauguaggagauuuuaaccacugcuggcuuugacucuca

SEQ ID NO: 187389 - RNA, 64 nt, Human
caaacuucuuuuccauucagaguccucugauucagauuuuaauguuaacauuuuggaagacagu

SEQ ID NO: 187390 - RNA, 64 nt, Human
cuaauguuaggucaagcuauuucucuggaucuaugauuuuaagauagaacaggcugguucugag

SEQ ID NO: 187391 - RNA, 64 nt, Human
guaugacagaugauguauucuuuugauguuaaaagauuuuaaguaagaguagauacauuguacc

SEQ ID NO: 187392 - RNA, 64 nt, Human
ggaugcucucucgguuugcuuuugccacuuucaagauuuuaacuucucagguuauuaaucaaaa

SEQ ID NO: 187393 - RNA, 64 nt, Human
ccuuggagccuccccuagcuuacacaguuaacuugauuuuaaaauccaaggccaggagagaaga

SEQ ID NO: 187394 - RNA, 64 nt, Human
uggcugugacuggguggggcagcaugcagcuucugauuuuaaagaggcaucuagggaauuguca

SEQ ID NO: 187395 - RNA, 64 nt, Human
uuaauagaaucuacuaucuggaagauaaaugaaggauuuuaauaaaauuuucaauagaauaaac

SEQ ID NO: 187396 - RNA, 64 nt, Human
uccagggacuaucacagaagaagcaggcauguaagauuuuaaggacugguuucgaggggucgag

SEQ ID NO: 187397 - RNA, 64 nt, Human
ugagacuauugucuuggggccaaaaauaaucagggauuuuaaauugggcaagggacaaggugcu

SEQ ID NO: 187398 - RNA, 63 nt, Human
uuuucacaaaauaguaaccaggagauguuuaaugugccugauuuaauguuuuuaauaaucaca

SEQ ID NO: 187399 - RNA, 63 nt, Human
gacaagagccugcagcggaagggacucugggcugugccugaggcuggcugggggcaggacaac

SEQ ID NO: 187400 - RNA, 63 nt, Human
uagaugugauaaagcuaaacuuggccaaagugugugccugaauuauuagaccuuuuuauuagu

SEQ ID NO: 187401 - RNA, 63 nt, Human
aauuaauaguuuuaucuggguacaaauaaacaggugccugaacuaguucacagacaaggaaac

SEQ ID NO: 187402 - RNA, 64 nt, Human
aaccaugcuguuucucuaucaagaagaagacagagauuuuaaacagauguuaaccaagagggac

SEQ ID NO: 187403 - RNA, 64 nt, Human
ggccuucccuccuucgcuccuuuuuuauauuagugauuuuaaaggggacucuucagggacuugu

SEQ ID NO: 187404 - RNA, 64 nt, Human
cccacauacuucucagauggcucccacauuuuaagauuuuaaaaaugaaaccaaaaaauaaauu

SEQ ID NO: 187405 - RNA, 64 nt, Human
uccccggggcguuucuuugccgauuuuugaaugugauuuuaaagagugaaaaaugagacuaugc

SEQ ID NO: 187406 - RNA, 64 nt, Human
uauauuuuaugauuuaaaaaauaaauauaauugggauuuuaaaaacaugagaaaugugaacugu

SEQ ID NO: 187407 - RNA, 64 nt, Human
auuuugcuuucaagauuugcuuuucgggccugaugauuuuaaagcaaaaaucacccucuaguug

SEQ ID NO: 187408 - RNA, 64 nt, Human
uuuagguuauuuauacaaagggaauaaauaggcugauuuuaauuugguaaguugaucuuuuuau

SEQ ID NO: 187409 - RNA, 64 nt, Human
augagaaaaggaaauuacaauaauaaaguuuuaugauuuuaaauaagucauauguuuguauccu

SEQ ID NO: 187410 - RNA, 64 nt, Human
ugcuucuugguuguauuggguagcauugggauaagauuuuaacuggguauucuugaauugcuuu

SEQ ID NO: 187411 - RNA, 64 nt, Human
caaauuguucaaacauugcucaguauaauaacuggauuuuaauggugaccuaaaaaugguauua

SEQ ID NO: 187412 - RNA, 64 nt, Human
ugcuugaacuaaacugacuaguucugcuaaauaagauuuuaaacuaauucauauguaaaaagug

SEQ ID NO: 187413 - RNA, 64 nt, Human
uuguauauuuggacaguuucauauagggcuuagagauuuuaaggacaugauaaaugaacuuuuc

SEQ ID NO: 187414 - RNA, 64 nt, Human
caguguuauucacagacagaacuuuguuuccugugauuuuaaaauaccgcgucuguuccuccau

SEQ ID NO: 187415 - RNA, 64 nt, Human
auagaugauccacugaaaucuuuuccagcucuaagauuuuaaauuguccuuuuagauuagacuu

SEQ ID NO: 187416 - RNA, 64 nt, Human
gccacuuauugaugacagaauuucuggauaguaggauuuuaauaggcgagcaaauaaaauucaa

SEQ ID NO: 187417 - RNA, 63 nt, Human
gcccacagcuccauuuuggaggcaggcagguuggugccugacagacaaccacuacgcgggccg

SEQ ID NO: 187418 - RNA, 63 nt, Human
ugugccccacagagaacgaugaucgucaccucugugccugaguucucccuguugucucaaagc

SEQ ID NO: 187419 - RNA, 63 nt, Human
aaauccagccccucgcccugugccaccccaacugugccugauagaccugccccagcguuccug

SEQ ID NO: 187420 - RNA, 63 nt, Human
cgggccgcggaggaggcaggcggcccccacacugugccugaggcccggaaccguucgcacccg

SEQ ID NO: 187421 - RNA, 64 nt, Human
uauuucuaccucuaguaaugggcuuuaugugcuagauuuuaauauccuugagccugggcaagug

SEQ ID NO: 187422 - RNA, 64 nt, Human
cugucugucugauuugcugaacuuucucaguccugauuuuaaaacaguuaagagaguccuugug

SEQ ID NO: 187423 - RNA, 64 nt, Human
aguagacauucuuacuagcucaauuuaaauaauugauuuuaaauaggaagaaaagaggauauau

SEQ ID NO: 187424 - RNA, 64 nt, Human
auugucccuugcuacuugauauauuaaagauguagauuuuaaaguguuucauuuucuugucuca

SEQ ID NO: 187425 - RNA, 64 nt, Human
aggagagggugagauauaagacauacauacuuuagauuuuaaauuauuaaagucaaaaauccau

SEQ ID NO: 187426 - RNA, 64 nt, Human
gaauuuuugaaucuauuuuuaaaaucauaacauugauuuuaaaaauacauuuuuguuuauuuaa

SEQ ID NO: 187427 - RNA, 64 nt, Human
ccuucaguguauuuuuguuuuucaagaggaaguagauuuuaacuggacaacuuugaguacugac

SEQ ID NO: 187428 - RNA, 64 nt, Human
uuuaaaaaagaaauuaaaagggugguuuuuuuaagauuuuaaaguuugcuaacauauuaaaaau

SEQ ID NO: 187429 - RNA, 64 nt, Human
uguaggugcuuccucuauaucaagugaguuugcugauuuuaaaaucuuaggaauauaaauaaag

SEQ ID NO: 187430 - RNA, 64 nt, Human
agagaauggucaguuuccauucacccaucugaaagauuuuaagaugagguugaauucuaguuua

SEQ ID NO: 187431 - RNA, 64 nt, Human
ugaaaauguuacaagcuaagaguuuacaguuuaagauuuuaaguauuguuuccugagcauaacu

SEQ ID NO: 187432 - RNA, 64 nt, Human
gugaacuacaacuugucuuccuaaaauuuauagugauuuuaaaggauuuugccuuuucuuugaa

SEQ ID NO: 187433 - RNA, 64 nt, Human
cuaggagaguuuacugaugaaacagccucugcaagauuuuaaaaguuuuguucuuuuauagacu

SEQ ID NO: 187434 - RNA, 64 nt, Human
uggcucccaccugaguccuguucccugaaacugggauuuuaaaaugagccuggaauugagcccc

SEQ ID NO: 187435 - RNA, 64 nt, Human
uauccagaguugugggaaucucaggauuggaagagauuuuaaaggccacauaggccagcuagug

SEQ ID NO: 187436 - RNA, 63 nt, Human
cccaaaguguugggauuacaggugugugucacugugccugacagcugacaguuuuaacugaca

SEQ ID NO: 187437 - RNA, 63 nt, Human
guccuuccuccuuccuccccggauuggcuugcugugccugacggaugggcuguagaauggggu

SEQ ID NO: 187438 - RNA, 63 nt, Human
accucgaaacgaacaguuaaauugaaaugcuaugugccugacccaaugguaggcacauaguag

SEQ ID NO: 187439 - RNA, 63 nt, Human
agaaggugccccuucaggcaccuaggggagagcgugccugacaacccagagagauucgacagu

SEQ ID NO: 187440 - RNA, 64 nt, Human
gugaacauuuauauccgauaaggggugggagugugauuuuaaaugcucuuuugggagaacaaag

SEQ ID NO: 187441 - RNA, 64 nt, Human
ccuauuaguuucuaauauuaaucuccagguguaagauuuuaaagugcaauuaaaugccaaaauc

SEQ ID NO: 187442 - RNA, 64 nt, Human
guuggaaucuaagaugugucccuucucccaaagggauuuuaaucauucuuggccucucuacuca

SEQ ID NO: 187443 - RNA, 64 nt, Human
uaagccaaauaccugauguauugugaaagccacugauuuuaagaauggagagaaagggauuuuu

SEQ ID NO: 187444 - RNA, 64 nt, Human
gccaaagucaauaauugggacaaaugguaaagaugauuuuaaaaucuguuguauuuaggucccu

SEQ ID NO: 187445 - RNA, 64 nt, Human
ugaaccaaaaucuucccaggaauaguacuuaauagauuuuaauguuaauuuauauucauuguag

SEQ ID NO: 187446 - RNA, 64 nt, Human
ugauuucuuuuuuuaauuuuauugggaggguuuggauuuuaacuuuuuuuaauguuguuaaaua

SEQ ID NO: 187447 - RNA, 64 nt, Human
uugucccugcccccacccuucugaguccuuccuggauuuuaaggucugagaccuggccuccgug

SEQ ID NO: 187448 - RNA, 64 nt, Human
uggaggcgggacacagggccaguaggagcaauaggauuuuaauaaacagaacccaucccaaagc

SEQ ID NO: 187449 - RNA, 64 nt, Human
gaguuucagauaaccgaauguaaauccuuuaucagauuuuaacuugugcaguacuugaagugaa

SEQ ID NO: 187450 - RNA, 64 nt, Human
acaaagcuguuguuuuuaccaugcaguauugcaugauuuuaaguuauguggaauuaacauaacu

SEQ ID NO: 187451 - RNA, 64 nt, Human
guuauuugaaaauaaaauuauuuuccuguucauugauuuuaaacauuuuauuccuacuuucaga

SEQ ID NO: 187452 - RNA, 64 nt, Human
cagugugagacuuuuucauuaaauaauauugaaagauuuuaaaauucauuugaaagucugaugg

SEQ ID NO: 187453 - RNA, 64 nt, Human
uuccaaaggcucuacuuucaaagguuaagaaugagauuuuaaaauuggauuuuugccuggacuu

SEQ ID NO: 187454 - RNA, 64 nt, Human
gagaauaaagcgcuagcaagauacaucacuuacugauuuuaaaaauacagaaagauuuugagua

SEQ ID NO: 187455 - RNA, 63 nt, Human
aauguuguucauuauuggaggguaaaugauguggugccugaggucuguacguuaccucuuaac

SEQ ID NO: 187456 - RNA, 63 nt, Human
uuguaauguugauuaagauguaaaauaaaaagugugccugauuauuuuugcaaauagauugug

SEQ ID NO: 187457 - RNA, 63 nt, Human
uuaagacugaauauuuuaaaagagcuuagaauggugccugacaaaugagaaacaauaaauacu

SEQ ID NO: 187458 - RNA, 63 nt, Human
uaggugaucguaaaauauugaauaaugcgaauagugccugaauuuguucucuuuuugggugau

SEQ ID NO: 187459 - RNA, 64 nt, Human
auuaaauaugcacaauauuccauagcucacugaggauuuuaaaauuauaagcauaggauuuuau

SEQ ID NO: 187460 - RNA, 64 nt, Human
ggucaagauuauuuuuagagguuauuuuauuggggauuuuaagaacuaauaacaucuugaguua

SEQ ID NO: 187461 - RNA, 64 nt, Human
agugaagguguauuuucagugcuacccgcuagcugauuuuaacuuuaggaauaaaauuaguuuu

SEQ ID NO: 187462 - RNA, 64 nt, Human
agaugggauuugggggugaauuugucaauaucuggauuuuaauccagacaucucugcuaacaag

SEQ ID NO: 187463 - RNA, 64 nt, Human
uuuguaaacaucagcauuuguacuugaauaguaggauuuuaaagggcauugauagcauaccaaa

SEQ ID NO: 187464 - RNA, 64 nt, Human
uacaaacauaacaaaguguuuuuagguguuuuaugauuuuaacuuucagacagaguuuggauuu

SEQ ID NO: 187465 - RNA, 64 nt, Human
ucaaagauuucuuccauucauaaggagacucaaugauuuuaauugaucuagacagaauuauuua

SEQ ID NO: 187466 - RNA, 64 nt, Human
agaaacaauuucguuuaaugggaucuguacaacugauuuuaaaaaaaugcuacaaaaagcccca

SEQ ID NO: 187467 - RNA, 64 nt, Human
ucagcuuuuuugaaaacacaucaguagaaaccaagauuuuaaaaugaagugucaagacaaaggc

SEQ ID NO: 187468 - RNA, 64 nt, Human
uugaaugguuuaacaaaagauuuguuuuuguagagauuuuaaagggggagaauucuagaaauaa

SEQ ID NO: 187469 - RNA, 64 nt, Human
uuacaugcuacuaaauuuuuauaauaauugaaaagauuuuaacaaguauaaaaaauucucauag

SEQ ID NO: 187470 - RNA, 64 nt, Human
guuaaaaacauguucuaagucauguauaggcuaagauuuuaagaagaucugggggaauaaaaag

SEQ ID NO: 187471 - RNA, 64 nt, Human
uccugugccucccuucauauuaauauuugauaaagauuuuaauuuauguaaaacuucuaaagca

SEQ ID NO: 187472 - RNA, 64 nt, Human
caauaaauaaggaaagaagcuguugcauuacugggauuuuaaaaguuugauuuacauuuauauu

SEQ ID NO: 187473 - RNA, 64 nt, Human
cacaaggaacaauauuuuaaaaaauauuuacagagauuuuaaucuaauaauucuuaagcaaaug

SEQ ID NO: 187474 - RNA, 63 nt, Human
uuacacauguuaaacagauacuuguuaagcauagugccugacacacggcauuagcuguuauuu

SEQ ID NO: 187475 - RNA, 63 nt, Human
auagagagagagugagagagucguguuucguaagugccugagcuuaggaaguuuucuucugga

SEQ ID NO: 187476 - RNA, 63 nt, Human
gaaaaauuucuauucuuuuuuuugcauccaauugugccugaacuuuuaaaauauguaaaugcu

SEQ ID NO: 187477 - RNA, 63 nt, Human
cacccuagaaacaacauauugucccaugagcaggugccugagacacagaccccuuugcauuca

SEQ ID NO: 187478 - RNA, 64 nt, Human
ucuuaccuagucugaaacauuuuuauucaauaaagauuuuaauuaaaauuugaacuuuucaaug

SEQ ID NO: 187479 - RNA, 64 nt, Human
agaucaguuuugaaguuucuaaaggagauagaaugauuuuaaccucaaugaguugcccuguaaa

SEQ ID NO: 187480 - RNA, 64 nt, Human
cugaucauguaugcaucccccaaggaugaaaucagauuuuaacuaauaaugcuggauggccuga

SEQ ID NO: 187481 - RNA, 64 nt, Human
ggaccuucuguuuagcuuccucuugcuucccaaagauuuuaagcauuuuguaaauguauaaacu

SEQ ID NO: 187482 - RNA, 64 nt, Human
uuguuaggccaauauuuugugacauuuuuguagcgauuuuaacguuuaugguuuugguucuaca

SEQ ID NO: 187483 - RNA, 64 nt, Human
augcccagugugaacuuaguacuuaacacauuuugauuuuaauuaaauaaauuggguuuccuuc

SEQ ID NO: 187484 - RNA, 64 nt, Human
acauuguuuguagugcuauccauuccucuccugagauuuuaacuuacuacuggaaauccuuaac

SEQ ID NO: 187485 - RNA, 64 nt, Human
aauuucaacugauugucgaaaggguaauaugaaagauuuuaaaugaaaaaaauuuguuggauga

SEQ ID NO: 187486 - RNA, 64 nt, Human
auaaauaaagagaaaaacucauucagaaaucauggauuuuaaaaauauuuuacugcagccaagu

SEQ ID NO: 187487 - RNA, 64 nt, Human
guaccuacuacaugcuguauuguaugacugucaggauuuuaagauuauacaagugaagcauuaa

SEQ ID NO: 187488 - RNA, 64 nt, Human
aucuuuuucaugaaugauuuuaaagaaaaauuuggauuuuaaagguauuaaaauauuuuuguuu

SEQ ID NO: 187489 - RNA, 64 nt, Human
uguuaauucugacuugagaaucuuuuucaugaaugauuuuaaagaaaaauuuggauuuuaaagg

SEQ ID NO: 187490 - RNA, 64 nt, Human
ucuucccaggcaaaagcaacaucugguugaccaugauuuuaauccagaacuuccucauaaaaug

SEQ ID NO: 187491 - RNA, 64 nt, Human
uacguuuuugugcaaaaauaaaugaauggcaauagauuuuaaaaaaucuuauuauguacuucug

SEQ ID NO: 187492 - RNA, 64 nt, Human
ccacccagcaguagguuuuguuaacaacaaacuggauuuuaaaaguucugccauguuaaguggc

SEQ ID NO: 187493 - RNA, 63 nt, Human
uuagccgugaugaaagcagcguuacuucugaccgugccugaguaagagaaugcugaugccaua

SEQ ID NO: 187494 - RNA, 63 nt, Human
gucacagggucaggggucaggugguuguagucugugccugaagucuguguuuguguugucgug

SEQ ID NO: 187495 - RNA, 63 nt, Human
agguuuuuauaccaaaccuggaagcagcagcaggugccugaacucguaacuagagaagaguua

SEQ ID NO: 187496 - RNA, 63 nt, Human
uucuucacuaugggaucuucugugcccagcacagugccugacacauagaaaacaaucaaauau

SEQ ID NO: 187497 - RNA, 64 nt, Human
gcuuuuacuucucuauacaaaaugauuuugaagagauuuuaaagacguucccuuuuguauucuc

SEQ ID NO: 187498 - RNA, 64 nt, Human
cuuuacuagguguuuuccauuagaauuagaccuugauuuuaaauccaagcaagcuugaagcccc

SEQ ID NO: 187499 - RNA, 64 nt, Human
aaugaggaaugcuguaaguaagacucaucaaacagauuuuaaccauuuuauuauccuguguguc

SEQ ID NO: 187500 - RNA, 64 nt, Human
ccggcggagaggccgcgugugggagcguguugaagauuuuaaguggucucuacacccaaauagu

SEQ ID NO: 187501 - RNA, 64 nt, Human
guuaaaaagaaaauuauugcauuugaucuggauggauuuuaaaagaauauaauguucaauauua

SEQ ID NO: 187502 - RNA, 64 nt, Human
gagguugucuaaaagucuuuuuaauuaauagaaagauuuuaauauccaagaguagucaaauuaa

SEQ ID NO: 187503 - RNA, 64 nt, Human
acccaggguccuacagauagauauggugugcccagauuuuaaaaauaccuucaaaaauaaaaaa

SEQ ID NO: 187504 - RNA, 64 nt, Human
ugugccaaacuuuccaggguuuuguagucaccuagauuuuaagcugauagcauagugcuucagc

SEQ ID NO: 187505 - RNA, 64 nt, Human
acuuaaauacauuacacggguuguaaggacaaaggauuuuaaaaucugagcacuuaggugaagg

SEQ ID NO: 187506 - RNA, 64 nt, Human
uuguacauacuacuuuauaaaaauucucaccuuugauuuuaaaucccaguaccuaguuauaucu

SEQ ID NO: 187507 - RNA, 64 nt, Human
aaucaaaagacaguuuuaggaagucuuauuuauugauuuuaaaaguuuuacauguaggagugug

SEQ ID NO: 187508 - RNA, 64 nt, Human
ugcaauugguggugcuuccuuucuucaaaauacagauuuuaaaaaaucauuucuagauuauuuu

SEQ ID NO: 187509 - RNA, 64 nt, Human
aaauugcuaaaugucaauguauuuuuggcacugcgauuuuaaccauuuauuaaauaaaaauuuu

SEQ ID NO: 187510 - RNA, 64 nt, Human
acugaacaaaaugagaugaaagccgagcuggaccgauuuuaacauucacauugcccugccucug

SEQ ID NO: 187511 - RNA, 64 nt, Human
cuuaacuaaugaagacauuucagaacucugggaugauuuuaaucuugaaguaguaggugguaua

SEQ ID NO: 187512 - RNA, 63 nt, Human
uugguuuucaaauuggguacuuuuaacacuuuagugccugacugcuguucuuuacugacuuga

SEQ ID NO: 187513 - RNA, 63 nt, Human
gccugccuuggaggggucacaugagggagaccugugccugauuucauuaggaaauccauucug

SEQ ID NO: 187514 - RNA, 63 nt, Human
acacacccacacgaugccacaggucagggggcugugccugacuagggagcccucccauugccu

SEQ ID NO: 187515 - RNA, 63 nt, Human
aacaguguagaccagacugccucucucagauaugugccugauauuuuguggauaccuccccug

SEQ ID NO: 187516 - RNA, 64 nt, Human
uugaaauacacuggauaauuacuuuugugauuuagauuuuaauuuguugcugguuuuuauuuaa

SEQ ID NO: 187517 - RNA, 64 nt, Human
agaucagguuuugaaagcuuugggggucuuuuuagauuuuaaucccuacuuucuuuaugguaca

SEQ ID NO: 187518 - RNA, 64 nt, Human
uuaauaauugaaaaaauuuaccacagccuugucugauuuuaagaauagauugugugaagauuua

SEQ ID NO: 187519 - RNA, 64 nt, Human
aaacauauuuucauauucuuuauguggaagaauagauuuuaaaguacaagccaaaugauuuuca

SEQ ID NO: 187520 - RNA, 64 nt, Human
cauaacaguuguuccguaacuagaagcauucuuugauuuuaaauuugaagcuguucaguuugca

SEQ ID NO: 187521 - RNA, 64 nt, Human
aacauggauguuacagcucaaaagauuuauaaaagauuuuaaccuauuuucucccuuauuaucc

SEQ ID NO: 187522 - RNA, 64 nt, Human
uaguaauaaucagguaccuuacaagcugcugguggauuuuaaaaaauuaagauaguugaaggug

SEQ ID NO: 187523 - RNA, 64 nt, Human
gaggggcgagaaggggaaaaaugggaaauagucugauuuuaaugaaaucaaauguauguaucau

SEQ ID NO: 187524 - RNA, 64 nt, Human
gcucuuaaccccacccaccuuuuuaaucacacuagauuuuaagaucaaucccuuuuugaaacaa

SEQ ID NO: 187525 - RNA, 64 nt, Human
ugaaaaacauuuauuuuaugagugaugaauuauagauuuuaaaaucaaggccgggcgugguggc

SEQ ID NO: 187526 - RNA, 64 nt, Human
aauuaacauuugccaccccccguggaaguuugaagauuuuaaaaauagaaauguacauuuuuca

SEQ ID NO: 187527 - RNA, 64 nt, Human
auguggguccuuugucuccaggauccacacccuagauuuuaacacugcauucucacuauaacgu

SEQ ID NO: 187528 - RNA, 64 nt, Human
uuuaugcagaauuuaauucucuuuuuacgguuaagauuuuaagauuuucuuacuugcacauaaa

SEQ ID NO: 187529 - RNA, 64 nt, Human
aauauucuuucugaaaguaaguacaguuauaacagauuuuaaaucaauguguauucuuuacugg

SEQ ID NO: 187530 - RNA, 64 nt, Human
aguggaauuucugauagacaaaccacaggacuuugauuuuaagccaaauccaucuccaucccuu

SEQ ID NO: 187531 - RNA, 63 nt, Human
ucaugauaguaaaaucaggauggaaauaagagggugccugauaaauggagucaguguggaauu

SEQ ID NO: 187532 - RNA, 63 nt, Human
ugcccugcacucacaggagccaauggggucacggugccugaagagggccugacacuucacaga

SEQ ID NO: 187533 - RNA, 63 nt, Human
uggggcaccuguugcccacaggguagaggccaggugccugaggacagcacugaaggccgugca

SEQ ID NO: 187534 - RNA, 63 nt, Human
auucaaaguuuuguacaaaauuauauggauuuugugccugaaaauaauagagcuugagcuguc

SEQ ID NO: 187535 - RNA, 64 nt, Human
uucagaacuuguaacuaaaguauuuaaagaaacugauuuuaaaugcaaauuaaagggcagauau

SEQ ID NO: 187536 - RNA, 64 nt, Human
ugcuggauauuuucaaauuguaucuagugcagcugauuuuaacaauaacuacuguguuccuggc

SEQ ID NO: 187537 - RNA, 64 nt, Human
guuuuaaaugugggcaaaaaggcauuuucuccaagauuuuaaaacuaauucuuauuuuuaaaug

SEQ ID NO: 187538 - RNA, 64 nt, Human
aauguaauucaggaagacagacgcugcaaucacagauuuuaaaaaauuguuugcacuuaaaaau

SEQ ID NO: 187539 - RNA, 64 nt, Human
aaaaauguagcucuuugaaucucagaaaaaaguagauuuuaauaaagugugaaaguugucaauc

SEQ ID NO: 187540 - RNA, 64 nt, Human
uuauauuucuguucaaccuguugguuucuacaaugauuuuaaacauuggaaagccagccuugug

SEQ ID NO: 187541 - RNA, 64 nt, Human
gaguucucuaucucuaaauauuuauuuagagaaugauuuuaaaagggaaugauaugcuuguuua

SEQ ID NO: 187542 - RNA, 64 nt, Human
aaauauuuugauuuaaauaacaaaaauaauaccagauuuuaagccguggaaaauguucuugauc

SEQ ID NO: 187543 - RNA, 64 nt, Human
cguuuuccaaacauuuaaaggagcuaggagacaugauuuuaaaaaaggaaucaauagaugcuuu

SEQ ID NO: 187544 - RNA, 64 nt, Human
uguauauuucaucuuagccauucuauccuagaaagauuuuaaugugagcuuaagauguaaauaa

SEQ ID NO: 187545 - RNA, 64 nt, Human
gaaagacuguuuucauauguuauacucagauaaagauuuuaaaugguauuacguauaaauuaau

SEQ ID NO: 187546 - RNA, 64 nt, Human
acuuaaaaguuuacuauuucuuauuugguaaauagauuuuaagccaauucuaguaagaaauuaa

SEQ ID NO: 187547 - RNA, 64 nt, Human
auagucguuuccaacaaaguuuuacuuuuuguaggauuuuaaaaauaaugauuuuuaccaggaa

SEQ ID NO: 187548 - RNA, 64 nt, Human
uagucacuaucguaaacauucaugauagggcaaggauuuuaaaacaggauucuugcuucuguag

SEQ ID NO: 187549 - RNA, 64 nt, Human
auauaacacuccugaaugccugaggcacgaucuggauuuuaaaugugugguauucauugaaaag

SEQ ID NO: 187550 - RNA, 64 nt, Human
auacuuuugaaaugcaggauaugaugagugggaugauuuuaaaaaugccucuuuaauaaacuac

SEQ ID NO: 187551 - RNA, 63 nt, Human
gguuuuuuuaggguugcggggagggaacugcaagugccugaggaccagaguggccucuagccc

SEQ ID NO: 187552 - RNA, 63 nt, Human
uuuaaaaauugcuugggaaauuauuaaaugaaugugccugaugauuugaaauagacaaggggc

SEQ ID NO: 187553 - RNA, 63 nt, Human
agauuccacguucuuguuccgauacucugagaagugccugauguugauguacuuacagacaca

SEQ ID NO: 187554 - RNA, 64 nt, Human
uuuauguguggcauauacuuauuucuugagagaagauuuuaacuuauuguuuuuauuuuauggu

SEQ ID NO: 187555 - RNA, 64 nt, Human
cagccguuucacuuuuuguuggagaaaaauaguagauuuuaauuugacucacaguuugaagcau

SEQ ID NO: 187556 - RNA, 64 nt, Human
augcaucauccuccuaauuuuaaauguuggcucugauuuuaaaguggugcauuugauuccagcc

SEQ ID NO: 187557 - RNA, 64 nt, Human
uuaaucagaaaacaaaauagaggcagcuuuuguagauuuuaaauggguugugcaagcauuaaaa

SEQ ID NO: 187558 - RNA, 64 nt, Human
ucaguucaggacugagaaaggaaagaucagugcugauuuuaaucagacuguaauguaccaacua

SEQ ID NO: 187559 - RNA, 64 nt, Human
aaaaggaagagaaucauuaaagaaaaagaaaaaagauuuuaagaccguugaaaucaauuaucaa

SEQ ID NO: 187560 - RNA, 64 nt, Human
uuaagaauaacuuacugagauuuauugauuugaagauuuuaaagaugaaugguaaaacacacuc

SEQ ID NO: 187561 - RNA, 64 nt, Human
uaaguaaaaucauuacaaauauaaguauuuacaggauuuuaaaguuagaauauauuugaaugca

SEQ ID NO: 187562 - RNA, 64 nt, Human
acauaguauaaaauuacauguuaauacaaugccagauuuuaaauaaagaccuuuaguuuuccuc

SEQ ID NO: 187563 - RNA, 64 nt, Human
auugaguauucuuuuuuaaaauaugaagcuauuagauuuuaaguguugaggagcagaggugaga

SEQ ID NO: 187564 - RNA, 64 nt, Human
aauuucucuaaauguacacugauucugugugugugauuuuaaaaggagaauaugguucaagcaa

SEQ ID NO: 187565 - RNA, 64 nt, Human
cagcagcccagggcuugucuggaucagcaccaacgauuuuaaagaaaaaaggaagaguuucuua

SEQ ID NO: 187566 - RNA, 64 nt, Human
ugaaucaacauaguaacugaaaugaaaucuucuugauuuuaaauaauauacgaauggugcuauu

SEQ ID NO: 187567 - RNA, 64 nt, Human
cugugcuggagaauuccaguuguauuugaagacugauuuuaaaacuuuucugcauuugguaaag

SEQ ID NO: 187568 - RNA, 64 nt, Human
uuaguguauaacaauugauguuuguuuucuguuugauuuuaaacagagaaaaaauaaaaggggg

SEQ ID NO: 187569 - RNA, 63 nt, Human
aaaaauacaaaaauuagcugggcaugguggugcgugccugaagucccagcuacucgggaagcu

SEQ ID NO: 187570 - RNA, 63 nt, Human
ccgggaccucgaucaugacaggcucaucagccugugccugacccuucucagcgugaccccaga

SEQ ID NO: 187571 - RNA, 63 nt, Human
gagauccagugcacgccgaugcugcuaaacucagugccugagcccggcccugcagccccagcc

SEQ ID NO: 187572 - RNA, 63 nt, Human
ccucgccuccuguccggcccuggguuucuagcggugccugaggcaucacucuggcccauugac

SEQ ID NO: 187573 - RNA, 64 nt, Human
aggcugauucacugggucugggaaggagccuggggauuuuaauuuuucacaagugccccagaug

SEQ ID NO: 187574 - RNA, 64 nt, Human
auagaguuuuuauuaauuacuuacuuauuaccuagauuuuaaauagacaauccaaagucucccc

SEQ ID NO: 187575 - RNA, 64 nt, Human
uguuauuguuguuugguuguuguuuuuuuaaguugauuuuaauuuuuuguuugguugauuuuuu

SEQ ID NO: 187576 - RNA, 64 nt, Human
ugggcaacaugaccagagagaagauuuuugucaugauuuuaaauacacugacacgcuacuguug

SEQ ID NO: 187577 - RNA, 64 nt, Human
ucaugauuuccacaugaaagcacuuuaaggcacugauuuuaagauaauguuuuuggaaaaccca

SEQ ID NO: 187578 - RNA, 62 nt, Human
uaaaaucuugaauccacaaauaaaguucuauucugauuuuaaaaaacaaaacaaaacugugg

SEQ ID NO: 187579 - RNA, 64 nt, Human
uccagccuguuggcaacuccauaaaaacauuucagauuuuaauccgaauuuagcuaaugagacu

SEQ ID NO: 187580 - RNA, 64 nt, Human
uuuccuuguucuagcugacucuucaugccccuaagauuuuaaguacgauggugaacguucuaau

SEQ ID NO: 187581 - RNA, 64 nt, Human
gcagauugauauuuauacacuuuuuuauaaagcagauuuuaaaauauaguaacauccauuuuuu

SEQ ID NO: 187582 - RNA, 64 nt, Human
cauuccauggauuuauguacugaaauggauuucagauuuuaaagagaggaaugcucuacgugcu

SEQ ID NO: 187583 - RNA, 64 nt, Human
aauucuauuagcaaccuucuggguugguuagauugauuuuaauguauauauuagacauuuguau

SEQ ID NO: 187584 - RNA, 64 nt, Human
gaaugaagaaaugggugaaugagcuugucaaugugauuuuaaaaaauugacuaccuggaggaau

SEQ ID NO: 187585 - RNA, 64 nt, Human
uuuuuguuauauagggaucaaccagcuaagaaaagauuuuaaucaaguugaauugaggggauua

SEQ ID NO: 187586 - RNA, 64 nt, Human
gccuuuguaaaaugcaaaauauuuaauuaaaagagauuuuaacauaaugagagccacucauuac

SEQ ID NO: 187587 - RNA, 64 nt, Human
ggggcaacguggaggaagggccagggaugcaugggauuuuaauuguuucaucacaccuuccccg

SEQ ID NO: 187588 - RNA, 63 nt, Human
agaaaaccagguuucuucuccccauaccacguugugccugaagaacaagccuucccguccuug

SEQ ID NO: 187589 - RNA, 63 nt, Human
gcccccggggcugguguuggcagccggggggaggugccugaggguccccacgguuccuuucug

SEQ ID NO: 187590 - RNA, 63 nt, Human
cugugcuugcaugagggcaagcaaggaauggcugugccugaggcugcucugggaaacuccuug

SEQ ID NO: 187591 - RNA, 63 nt, Human
ugguggcacaugccugcagucccaguuacuugggugccugaggcaggagaaucucuuaaacca

SEQ ID NO: 187592 - RNA, 64 nt, Human
ucaucuacaaugguuaccauaaaaaaucuggcaggauuuuaaaacucaaucagucuuuccuuug

SEQ ID NO: 187593 - RNA, 64 nt, Human
uauguagguugcuaaaaaggauuuucuuaacucagauuuuaagccaaauaaccauuuaacacua

SEQ ID NO: 187594 - RNA, 64 nt, Human
acuugaauuuguacuguuaacagcacauuuggaagauuuuaaaacuuuuuauugucuuauaaau

SEQ ID NO: 187595 - RNA, 64 nt, Human
gguuggagcuaccgugggacuauauacuguuaaugauuuuaauauauauggcuuaugacauacu

SEQ ID NO: 187596 - RNA, 64 nt, Human
uuaaggaagacuuagaguguucauugauguuuacgauuuuaauauuucugaaggccauuacagu

SEQ ID NO: 187597 - RNA, 64 nt, Human
uuccuaccuggacaugucccauuaaaaaguggaagauuuuaaauaauuucuuuacagauguuuu

SEQ ID NO: 187598 - RNA, 64 nt, Human
aauuugcaugucugccuuaauuaacuuaaagacugauuuuaaucugacuaugacacugagcaua

SEQ ID NO: 187599 - RNA, 64 nt, Human
accugucuucuguuaccaucccuggacagugacagauuuuaagccagccaccagaauucuuuuc

SEQ ID NO: 187600 - RNA, 64 nt, Human
uuggaccuuaccuuaugugccuuucuucauugcugauuuuaaucuguauccuuucacuguaaua

SEQ ID NO: 187601 - RNA, 64 nt, Human
accaugccuggccaggacauauuugaaauggggagauuuuaaaaauucugaugauuagacugaa

SEQ ID NO: 187602 - RNA, 64 nt, Human
uuaggauugcaaaccaaggaaagaacgcauuugagauuuuaagaugucacuuauaaggggagaa

SEQ ID NO: 187603 - RNA, 64 nt, Human
uauguaauaaugugaaucaugguuuuucuuaguagauuuuaaaaguuauuaauauuuuaauuua

SEQ ID NO: 187604 - RNA, 64 nt, Human
aaaacagcauuucuaagggugguaaccacaggucgauuuuaauacgaguccuuuuucuuguaga

SEQ ID NO: 187605 - RNA, 64 nt, Human
agggcuucaugugcugguaccaauaggacaggaagauuuuaaucagcuuuacuaucuauguuuu

SEQ ID NO: 187606 - RNA, 64 nt, Human
ucugucucccugucuucuuuagaucggucugauugauuuuaaaaguggacccaaacuuagggaa

SEQ ID NO: 187607 - RNA, 63 nt, Human
uucuucucugggcuuaauuuucucuugggguacgugccugacaguguuuaagguguccguuga

SEQ ID NO: 187608 - RNA, 63 nt, Human
gcucugcucggccugugagccccguuccuaccugugccugacccuccgcuccagguaccacac

SEQ ID NO: 187609 - RNA, 63 nt, Human
cuguccagauuccucuuguaaaauaacccacuagugccugagcucagugcugcuggaugauga

SEQ ID NO: 187610 - RNA, 63 nt, Human
ugcuccagcagugcugggcccagccgggguggggugccugagcccgaauuucucacucccuuu

SEQ ID NO: 187611 - RNA, 64 nt, Human
cuuuuuggguagguaaaagacuaaaagccauauggauuuuaacugauaacaaugaaagugguaa

SEQ ID NO: 187612 - RNA, 64 nt, Human
auagaacacuucagacacaggaaaaauaaacguggauuuuaaaaaaucaaucaauggugcaaaa

SEQ ID NO: 187613 - RNA, 64 nt, Human
auucccaugagaaauguugaauuuaugaagaauagauuuuaaggcuuugaaaaugguuaauuuc

SEQ ID NO: 187614 - RNA, 64 nt, Human
gccuaacagcucaaagauguuuuguuaauagaaggauuuuaauacguuuugcaaaugcaucaug

SEQ ID NO: 187615 - RNA, 64 nt, Human
cauugcuuuuggacaaggaaggacagaggguuuugauuuuaaaaagaagaaaaaaaaaccuuau

SEQ ID NO: 187616 - RNA, 64 nt, Human
ugccuugcagugaccccucuggaacucaggacucgauuuuaaggacccaggagguggggcagaa

SEQ ID NO: 187617 - RNA, 64 nt, Human
gauuuguuugccuuuuacauuuuguuuaauuccugauuuuaaagccugcucuaucugguacagg

SEQ ID NO: 187618 - RNA, 64 nt, Human
ccuccccucccacacccccaaucuaccuggugaugauuuuaaguuugcgcgugucuuggguugg

SEQ ID NO: 187619 - RNA, 64 nt, Human
agacgccuauuuuuuuuuuuuuuuuuuaaaccaugauuuuaauacgcaagcuguuucuaaggcg

SEQ ID NO: 187620 - RNA, 64 nt, Human
uugcaaaaguguggacacuuuugacagcuuggcagauuuuaacuccagaagcacuuuaugaaau

SEQ ID NO: 187621 - RNA, 64 nt, Human
ggccucuucugcuuucucgggaauuuucaucuaggauuuuaagggaaggggaaggauaggguga

SEQ ID NO: 187622 - RNA, 64 nt, Human
gggaggaggauggggaguaggacauaccagcuuagauuuuaagguuuuuacugugagggauguu

SEQ ID NO: 187623 - RNA, 64 nt, Human
auuuaccuguuggauggaagguagacagcaacaagauuuuaaucaccuggucaccagacccuca

SEQ ID NO: 187624 - RNA, 64 nt, Human
aaggaaacuugacuucuuaaccuuaauuugauaugauuuuaauucauuacagaaagaaacccug

SEQ ID NO: 187625 - RNA, 64 nt, Human; identical to SEQ ID NO: 187597

SEQ ID NO: 187626 - RNA, 63 nt, Human
ucucugccugcagaugucccaguucaucguccagugccugaacccuuaccggaaaccugacug

SEQ ID NO: 187627 - RNA, 63 nt, Human
cagggcaaggggaacgggaaauaggucuccuaggugccugaagcgcugagcaaccuggguacc

SEQ ID NO: 187628 - RNA, 63 nt, Human
aaacuguugggaugaugugguuugcagguugcugugccugauucacaguguauguuguauaag

SEQ ID NO: 187629 - RNA, 63 nt, Human
ucccacaguguaugggagccccugacuccucacgugccugaucugugcccuuggucccagguc

SEQ ID NO: 187630 - RNA, 64 nt, Human
acuaucuuuuuagucuggauuucugcccugcuuagauuuuaaaaguauaagcauggauugccaa

SEQ ID NO: 187631 - RNA, 64 nt, Human
guuauuacuaaaguuucuaugaaacacuuaaguagauuuuaagaauaaauguuucuggaaaaga

SEQ ID NO: 187632 - RNA, 64 nt, Human
gccucuuuuguggcugguuauuccaguucccugggauuuuaaauucuuuggucuauuaaguauc

SEQ ID NO: 187633 - RNA, 64 nt, Human
cccucacccccaaccuccagucuccgcguuuugcgauuuuaauuuuggcgggaggggaagugga

SEQ ID NO: 187634 - RNA, 64 nt, Human
uccuaggggcauuuucuuuaacuuccagaauagugauuuuaaaaguaaaaauaaaaauaaaccu

SEQ ID NO: 187635 - RNA, 64 nt, Human
gcagaacucuucucccuauacaagguggauggcugauuuuaaccugaaauuuuaaauccacaga

SEQ ID NO: 187636 - RNA, 64 nt, Human
uauaaaaucuguccauucccauuaaaaaguggaagauuuuaaauaauuucuuuacagauguuuu

SEQ ID NO: 187637 - RNA, 64 nt, Human
guuuaaaagaguugcauucuuauuauguaaggaugauuuuaacaacuuuuuaauauguaauucu

SEQ ID NO: 187638 - RNA, 64 nt, Human
ccuguuugauaaaagaauauuggccaguauugcagauuuuaacugauuuggcugauccuccagg

SEQ ID NO: 187639 - RNA, 64 nt, Human
ccugcccuccuccucucacccgauguccaggugggauuuuaaagucugcauugguuauaauaac

SEQ ID NO: 187640 - RNA, 64 nt, Human
uuuucuuagagcuuugcacauuccuauucacugagauuuuaaaaauuucaccuuuauucgaggg

SEQ ID NO: 187641 - RNA, 64 nt, Human
ucaucucgauauauuugauauuucucugucuguugauuuuaauucuaaaugugcaggaugcugc

SEQ ID NO: 187642 - RNA, 64 nt, Human
uaacauucccacgugcccagggcuguucaugcaagauuuuaauggugacuuguccuggcuuacu

SEQ ID NO: 187643 - RNA, 64 nt, Human
ggcacuuuagauaagccuuuuuaaaauucuuucugauuuuaaauaaugcgucaaaaaaugugca

SEQ ID NO: 187644 - RNA, 64 nt, Human
ggaaauuuguggguuuccucacauacugaucuaggauuuuaaauuauuucauugcaaaguaauu

SEQ ID NO: 187645 - RNA, 63 nt, Human
aauccguuuuuauccuuuguacuggaugacauggugccugaauucuuucuuuucgccgacacg

SEQ ID NO: 187646 - RNA, 63 nt, Human
ugaaaacacugcuguguuaagcuguucaugcacgugccugacgcuuccaggaagcuguagaga

SEQ ID NO: 187647 - RNA, 63 nt, Human
gggaggugccuugcaaacuuucacauuaagaaugugccugaggcugcuuuacucuggaauagu

SEQ ID NO: 187648 - RNA, 63 nt, Human
uucgcucauuuuacgcugucucugacauaaggagugccugaauagcuuggaaaaguaacaucu

SEQ ID NO: 187649 - RNA, 64 nt, Human
uguauaucauucuacagaauaauccaguauugcugauuuuaaaggcagagaaguucucaaaguu

SEQ ID NO: 187650 - RNA, 64 nt, Human
gcuaacgaaaugguuugaaguauuuucauguuuggauuuuaauaauaaacugccucucauuuuu

SEQ ID NO: 187651 - RNA, 64 nt, Human
cuaugaagauuuuagaguuuaccuucauauguuugauuuuaaaucaguguauaaucuagauggu

SEQ ID NO: 187652 - RNA, 64 nt, Human
ucaggauauaauucuuaacuaucauuauuuaccugauuuuaaucaucagauucgaaauucugug

SEQ ID NO: 187653 - RNA, 64 nt, Human
augauugacguacguugauuuaacaaucuuacuagauuuuaauucuuaaggauuucaaaugaaa

SEQ ID NO: 187654 - RNA, 64 nt, Human
cuuuaucacaggauuuguuuuuggaggcuaucuggauuuuaaccugcacuugauauaagcaaua

SEQ ID NO: 187655 - RNA, 64 nt, Human
cugcucccaggggccuagguagcugccaguccgugauuuuaauugcugucuugaaguuaacaag

SEQ ID NO: 187656 - RNA, 64 nt, Human
aucuagcaauucacaaaaaugcccuagaaauauagauuuuaaucaccauuacauaaugacaaac

SEQ ID NO: 187657 - RNA, 64 nt, Human
ucaccauuucagacagacuucugacuuagauacugauuuuaaugccaguaucugcucuaaauau

SEQ ID NO: 187658 - RNA, 64 nt, Human
gcauuguaaaaguuccauuccaacugccaguguagauuuuaaaaguguuaaauagugacucccu

SEQ ID NO: 187659 - RNA, 64 nt, Human
uuagccagagaugacuaauuuaaauuuagaaccagauuuuaauuuaaauuaauauuuccauuaa

SEQ ID NO: 187660 - RNA, 64 nt, Human
ucuagaaauacucucccauuaaagaggaagagaagauuuuaaagacuuaaugaugucuuauugg

SEQ ID NO: 187661 - RNA, 64 nt, Human
aaauauuguccgaagcucuaaauaccagaguauugauuuuaaagucugccaagacaauaauaca

SEQ ID NO: 187662 - RNA, 64 nt, Human
cuucaacugacagaaaccuucacuugaaaacaaugauuuuaauauaucucuuucuuuuucuucc

SEQ ID NO: 187663 - RNA, 64 nt, Human
aucugaucgagucaguaugucuucagcuugaucagauuuuaaaaucaguuuugaaagugguucc

SEQ ID NO: 187664 - RNA, 63 nt, Human
ccacagguggugccccugcgggcugugguggccgugccugagcugcagcucuccaccagcugg

SEQ ID NO: 187665 - RNA, 63 nt, Human
gagggcucgaggggugggcugguaucucagaaagugccugacacacuaaccaagcugaguuuc

SEQ ID NO: 187666 - RNA, 63 nt, Human
cccgggaaggucaccagcaccaacaccacgguagugccugaaauuucaccauugcugucaagu

SEQ ID NO: 187667 - RNA, 63 nt, Human
aaaccugugguccgcccagaagagauuccuccagugccugagaaccgauuuuuacugagaaga

SEQ ID NO: 187668 - RNA, 64 nt, Human
cgcuauggacggggcauuccagcugagacacugugauuuuaaauuaaaucuuuguggucuuugc

SEQ ID NO: 187669 - RNA, 64 nt, Human
gcccgucuggcaacuggaaagagggaguuggccugauuuuaagccuuuugccgcuccggggacc

SEQ ID NO: 187670 - RNA, 64 nt, Human
ccuuccuuauggguaugcuguggcauaucccugagauuuuaauucgcauuuuccagugacuaag

SEQ ID NO: 187671 - RNA, 64 nt, Human
acaaacacacacacacacacauuuuucucuuguagauuuuaauuuuuuaagugggaaagaacuc

SEQ ID NO: 187672 - RNA, 64 nt, Human
uguugggaugccagugcagaucacuaaguaguaagauuuuaaucaaacacgaccagguccgaaa

SEQ ID NO: 187673 - RNA, 64 nt, Human
gugugauauuaguacauuaguagguaaaugagcagauuuuaaagaauagaauauccagaagcag

SEQ ID NO: 187674 - RNA, 64 nt, Human
uuuuuacuuccccuugacucauauguuuuaacaugauuuuaacaaacugcacuuauuaagaaau

SEQ ID NO: 187675 - RNA, 64 nt, Human
accucugcucuagaguagagaaaaauguauaaaagauuuuaauuuuaugagggcaauacaacug

SEQ ID NO: 187676 - RNA, 64 nt, Human
cagaucuaacuuuccuaguggaacaguauauauagauuuuaaugaggaacauuuauuuaauagc

SEQ ID NO: 187677 - RNA, 64 nt, Human
gccucugcacucaacuggaaccaauuuucaccaugauuuuaaaaauuaaaaaaaccuggcagag

SEQ ID NO: 187678 - RNA, 64 nt, Human
gcucucucuaaauauuuucuugcuuuacuggacugauuuuaacccgcugcacaacaccaacuaa

SEQ ID NO: 187679 - RNA, 64 nt, Human
agugaucaaauugugcaguacuuugugcauucuggauuuuaaaaguuuuuuauuaugcauuaua

SEQ ID NO: 187680 - RNA, 64 nt, Human
uuuccccccaacuccuuaauuuuauucuccgcuagauuuuaacguccagccuucccucagcuga

SEQ ID NO: 187681 - RNA, 63 nt, Human
agccagcaccuuugguaaauaaagcagcaucugagauuuuaaaaagcccugccuccaccucgu

SEQ ID NO: 187682 - RNA, 64 nt, Human
ugaaaauggguauacagcauuaaaaccuuagacugauuuuaaauauauuaauuucuuuuaaacu

SEQ ID NO: 187683 - RNA, 51 nt, Human
aagacuguggccucuucugaggugccugaauucaugcgugucagucacccu

SEQ ID NO: 187684 - RNA, 63 nt, Human
ccccaccccaccaugguagccuuagggugcugagugccugauacugccugacaagugccugac

SEQ ID NO: 187685 - RNA, 63 nt, Human
uuagggugcugagugccugauacugccugacaagugccugacacgcagccuaguuccuuccug

SEQ ID NO: 187686 - RNA, 63 nt, Human
agacacucuuuggauuugauucagaugaugaaagugccugaugaaaacgguucagaaagaucu

SEQ ID NO: 187687 - RNA, 64 nt, Human
uaaugaaugugggaaugccuucauuuguuuuuuugauuuuaauagacaucagagaauucacaaa

SEQ ID NO: 187688 - RNA, 64 nt, Human
caaaacucacuuguauaauaaacaguuuuugagggauuuuaaaguuucaagaacuguguguggc

SEQ ID NO: 187689 - RNA, 64 nt, Human
accagccucaccccuguggugggcuuuuuaagaggauuuuaacugguuguggggagggaagaga

SEQ ID NO: 187690 - RNA, 64 nt, Human
gucugugugauaucuguauauauugcauuuuguugauuuuaauagaaaacaaagcguuauuuuc

SEQ ID NO: 187691 - RNA, 64 nt, Human
gcuugcauugaauauuuucaaggagcuaaaagaagauuuuaaauggucucacaaaaacagauaa

SEQ ID NO: 187692 - RNA, 64 nt, Human
gugaaauaccgacacccgcuuugccuuccaccaugauuuuaaccuuccugaggcuucccuagag

SEQ ID NO: 187693 - RNA, 64 nt, Human
uuagcaacacagugagacacaauugcuacaaaaagauuuuaaaauuaguuugacgggguggcgu

SEQ ID NO: 187694 - RNA, 64 nt, Human
auggaaguauuuaauuggaaagauuaaacauauugauuuuaauuaauauuuuugacuuguuagg

SEQ ID NO: 187695 - RNA, 64 nt, Human
ucaugugcaacuccugauucucaggagaaagauggauuuuaacccaaaauuaugagugagcugu

SEQ ID NO: 187696 - RNA, 64 nt, Human
ugcugcuuaaaauucagggcuaagcauuuugggugauuuuaaacuaggugagugcucucuguug

SEQ ID NO: 187697 - RNA, 64 nt, Human
uuuugcaagaucaaaaauuagauguuaaguaucagauuuuaagcuuguuuuaauggucaaaaaa

SEQ ID NO: 187698 - RNA, 64 nt, Human
ugaguugauuuauaaagauuuuuguuaagcucaggauuuuaaauuacacaguucacaaacagua

SEQ ID NO: 187699 - RNA, 64 nt, Human
aaggcuugauaacauuccuguuacuuuucuagcagauuuuaacaaauaaucaaggacauuuuau

SEQ ID NO: 187700 - RNA, 64 nt, Human
uuguaacuuuaaaauauucuauaauuaugcaugugauuuuaacauuuaauauucaaaaauaaau

SEQ ID NO: 187701 - RNA, 64 nt, Human
ugcaaaugacuagucagaaccuugcuuaacaugagauuuuaacacaacaaugaaauuugccuug

SEQ ID NO: 187702 - RNA, 63 nt, Human
ucuugaagcaccagcucccugccccacccuccagugccugaggcagcuaggggcuucugcucu

SEQ ID NO: 187703 - RNA, 63 nt, Human
gggaucagggaagguggauucuaggaaaagggagugccugagguaggccuuagaaggggauga

SEQ ID NO: 187704 - RNA, 63 nt, Human
cggagcaagucccguucuguuaguaggucucccgugccugagaagagccagaaacgugguucu

SEQ ID NO: 187705 - RNA, 63 nt, Human
cugugagguaauguauguaaagcaccgagucaggugccugauacgcaguaggugcuuagcaaa

SEQ ID NO: 187706 - RNA, 64 nt, Human
accaggcucugagaccaugcaggaggaaagaaacgauuuuaaaucauuaaaaacacaaaaacua

SEQ ID NO: 187707 - RNA, 64 nt, Human
gggggacaaggucaguauuuaccaaaguguaucugauuuuaaaaauuccuuuagucuguaaaac

SEQ ID NO: 187708 - RNA, 64 nt, Human
cuccuuagagcucugaaggggucuccuaguuccagauuuuaauuuggggaacagaucuggguuc

SEQ ID NO: 187709 - RNA, 64 nt, Human
ggguauuuuaagugaugucauuugagcaggacuggauuuuaagccgaagggcaauaucuacgug

SEQ ID NO: 187710 - RNA, 64 nt, Human
uuaaaaaaacgagcaauuugaagagaaucuuuuggauuuuaagcaguccgaaauaauagcaauu

SEQ ID NO: 187711 - RNA, 64 nt, Human
aaaauuuaacaguugugucauguuguuucugucugauuuuaauugcugucuaaugacggggaaa

SEQ ID NO: 187712 - RNA, 64 nt, Human
gguauuauuuugugccccccacuuaauauggauagauuuuaaugggaaaauuauaauucagauu

SEQ ID NO: 187713 - RNA, 64 nt, Human
aacaguaucaaaagaagaaucggaagaugcuugugauuuuaauauuauuugucaucaucauugu

SEQ ID NO: 187714 - RNA, 64 nt, Human
ugagagucacugcagguguucuuucaucccaucugauuuuaacccaugguugagacguuccaag

SEQ ID NO: 187715 - RNA, 64 nt, Human
uguuugcauaaugacauagcuuuaagcacuacaugauuuuaaucugcucacauuauaacaggac

SEQ ID NO: 187716 - RNA, 64 nt, Human
uguauauacguauagagagguagauagguagguagauuuuaaauugcauucugaauacaaacuc

SEQ ID NO: 187717 - RNA, 64 nt, Human
uugucagccuugacuaucuuuugaauaaagauuugauuuuaaacaaaacccuguccgcaaaggu

SEQ ID NO: 187718 - RNA, 64 nt, Human
caguucauaguccacaguugaugcagcauccugagauuuuaaauccugaaguguggguggcgca

SEQ ID NO: 187719 - RNA, 64 nt, Human
aucccaggguuccguuugcugaaguaaaaacacugauuuuaaaaucccaguggguaccuuugua

SEQ ID NO: 187720 - RNA, 64 nt, Human
ugaagguauuugguuaaaauacaaagacuuuuaagauuuuaaggcccuuucuuccaacagcuuu

SEQ ID NO: 187721 - RNA, 63 nt, Human
cuuagucaauuuuuuucccuugagaugaggucugugccugauguacaacggauacuccauaaa

SEQ ID NO: 187722 - RNA, 63 nt, Human
ucuucauuauuuucagcuggaggacagagcucagugccugacugccuagggucucauggacug

SEQ ID NO: 187723 - RNA, 63 nt, Human
ccauccugcacuuggcccacguugaacuccauggugccugagagagacuaguuaaggguuggu

SEQ ID NO: 187724 - RNA, 63 nt, Human
gaggccccacaaggccucaucuccuuaaggcuagugccugaggucacuguauagggggaugug

SEQ ID NO: 187725 - RNA, 64 nt, Human
ugaauuugcugauguucuuccaacucaguugagugauuuuaagguuuuccaaaucuucuauggc

SEQ ID NO: 187726 - RNA, 64 nt, Human
cauaagcagccuuuuuauugucagaccauugccugauuuuaauauaauaaaaaaaaagugugcg

SEQ ID NO: 187727 - RNA, 64 nt, Human
aacuugcugucaugaggcgagaucaaucccucaagauuuuaaauccugaagaaauugagaagua

SEQ ID NO: 187728 - RNA, 64 nt, Human
aagcccugauuuuuccagcaaugccagaaaccuggauuuuaagucuuccaauuugauucaaaaa

SEQ ID NO: 187729 - RNA, 64 nt, Human
gcauauuguaucuaucaaaauauguuuggguuuagauuuuaaguugucuacugagcagauuucu

SEQ ID NO: 187730 - RNA, 64 nt, Human
gguugcaaaaacggaauaaaugacugaguguugagauuuuaaauaaaauuuaaaguaaagucgg

SEQ ID NO: 187731 - RNA, 64 nt, Human
aaacaaagaaggcaauaaggaacccauccuaguugauuuuaagacagaccgaaaagguaacaag

SEQ ID NO: 187732 - RNA, 64 nt, Human
ggcaccgcagugccagagaagaugcuugagguuagauuuuaaggaguggggaauugugaagccc

SEQ ID NO: 187733 - RNA, 64 nt, Human
uuguccacguuguuucacaucugguuagggggcagauuuuaaaauguaguuuuguaauguuaca

SEQ ID NO: 187734 - RNA, 64 nt, Human
ggaugaauuccacaauaggauccuuuuuaaaaucgauuuuaaauuguugccuaguccugccaag

SEQ ID NO: 187735 - RNA, 64 nt, Human
uuacuagagaauguucccaauuugaauuuagggugauuuuaaagaacagugagaaagggcauac

SEQ ID NO: 187736 - RNA, 64 nt, Human
ucaacaaaguuaauuguauuuauguauguaaauagauuuuaagcuucauuauaaaauauuguua

SEQ ID NO: 187737 - RNA, 64 nt, Human
uuuugaucuaaacauagguucugcauaucuguuagauuuuaaaaaugacugguguuuugucuuc

SEQ ID NO: 187738 - RNA, 64 nt, Human
caaaaaacaaagcuaaccauauggcacuaauuuugauuuuaacauuaguguaacaaauaagguc

SEQ ID NO: 187739 - RNA, 64 nt, Human
gugugaaauguaggcuuuaaaauguaaaugucuggauuuuaaucccaggcaucccuccuaacuu

SEQ ID NO: 187740 - RNA, 63 nt, Human
augucugcauauugcauagccuuguccuccugugugccugagcuccucccuuuucaauaagau

SEQ ID NO: 187741 - RNA, 63 nt, Human
agauguuaccuaagguagugacccugcauuguggugccugagcccuggcagaagcucuuguaa

SEQ ID NO: 187742 - RNA, 63 nt, Human
cacaaaacaaaugccacacaucacccuuaccaugugccugauccagccucuccccugauuaca

SEQ ID NO: 187743 - RNA, 63 nt, Human
cccaaagugcugggauuacaggcgugagccacugugccugaccugucauuuuuauagaaugaa

SEQ ID NO: 187744 - RNA, 64 nt, Human
aaaacaaaauauuuugaagauggugaaagugacugauuuuaauaaugagauaggucacuuaaaa

SEQ ID NO: 187745 - RNA, 64 nt, Human
ugccaguacuuugaaauagcacagcuauugaugagauuuuaagcugcuguuccuggccaguugc

SEQ ID NO: 187746 - RNA, 64 nt, Human
uaauuauguguauuuaacucuuuaaaaucucuuagauuuuaauuuauccuguaaauuucuguau

SEQ ID NO: 187747 - RNA, 64 nt, Human
ugggccacauaccaacccaccauggagcaaagcugauuuuaaguggugguagagauacaguuuc

SEQ ID NO: 187748 - RNA, 64 nt, Human
aauaaaaauuggaagaagagcuuaaaaaagauaagauuuuaaagagucccaaguuauuuaaguu

SEQ ID NO: 187749 - RNA, 64 nt, Human
uuaaaaagaggguaagaaacgauuccggugggaugauuuuaacaugcaaaaugucccugggggu

SEQ ID NO: 187750 - RNA, 64 nt, Human
ugggaagauuacggcgaauuaugcucaauggucugauuuuaacucacccgauguuaaucaaugc

SEQ ID NO: 187751 - RNA, 64 nt, Human
agcuuguccugucaacuaugaaauauggugacuagauuuuaauucauaaccguaaaguuuuuua

SEQ ID NO: 187752 - RNA, 64 nt, Human
caaggacaucagagugaagugucaguugucagaugauuuuaaaaguuaugucuucagagaaaaa

SEQ ID NO: 187753 - RNA, 64 nt, Human
uuaggcgcacauggaaaugagagcccggcgcauggauuuuaauguuuuucuaacaacuguggag

SEQ ID NO: 187754 - RNA, 64 nt, Human
aaagaaaauauuuucaauauauauaccuggaacagauuuuaauaauuaucagaguaauaccauu

SEQ ID NO: 187755 - RNA, 64 nt, Human
aggacacccccaccccaaauuucaguucuuacgugauuuuaaccauucaacaugcuguuggguu

SEQ ID NO: 187756 - RNA, 64 nt, Human
ucauuugcagugcuuguauugguuuaaaauguaagauuuuaagauccucuaacacuguacuaaa

SEQ ID NO: 187757 - RNA, 64 nt, Human
uuaaucagagugccauuuuuuuuuuuguucaaaugauuuuaauuauuggaaugcacaauuuuuu

SEQ ID NO: 187758 - RNA, 64 nt, Human
guuguuugagaugcuaagcaggauaauaaauuuagauuuuaaaauguucccuguaaaagucagc

SEQ ID NO: 187759 - RNA, 63 nt, Human
ccccaagcuauuugcucacauuaacaaauuaaagugccugaagcauaauucauucuuuaccug

SEQ ID NO: 187760 - RNA, 63 nt, Human
guguaugugugggagagugggggggugucuuuggugccugaagucugcgcggcauggagggug

SEQ ID NO: 187761 - RNA, 63 nt, Human
ccuaacauugaggccuuaaaaccugaggcuccugugccugauggaauucuuguaacauacacu

SEQ ID NO: 187762 - RNA, 63 nt, Human
uugcauuuauaaggggggaaaugugguuuaauggugccugauaucucaaagucuuuuguacau

SEQ ID NO: 187763 - RNA, 64 nt, Human
ccaccugaaagccaaaagauaaaauaaauaaguugauuuuaaugauauaagcaucacacaauuu

SEQ ID NO: 187764 - RNA, 64 nt, Human
agcccugaacaacagcauuugacaguguccuuuagauuuuaauuuuuucaauggauugcuuuaa

SEQ ID NO: 187765 - RNA, 64 nt, Human
cacguuaaaaucugcaaaugguuuuuacaccucugauuuuaacaugaacuuauacuaauguuug

SEQ ID NO: 187766 - RNA, 64 nt, Human
agucagccccacuccacaguuaggccaagaauuagauuuuaaaacuucaucugucugucccagu

SEQ ID NO: 187767 - RNA, 64 nt, Human
aaggacagucauuuggcuucugaauguuugaaacgauuuuaaaaaauaaguagugcuaugguug

SEQ ID NO: 187768 - RNA, 64 nt, Human
cuccaccuccuaauaccaucacauugaggauuaggauuuuaacauaugaauuuugggggggaug

SEQ ID NO: 187769 - RNA, 64 nt, Human
guacacggacacuagcugccccaggaaguugugugauuuuaaaucacuucugucuuugcuggaa

SEQ ID NO: 187770 - RNA, 64 nt, Human
auguuccugaguuaugauccuugaguaaugcuuugauuuuaauaguugguucuguguugcaaca

SEQ ID NO: 187771 - RNA, 64 nt, Human
ucuuaagagcauauauguuauuaauauuugauaugauuuuaaagucagaauaguacagauugcu

SEQ ID NO: 187772 - RNA, 64 nt, Human
acucgggauuacagaaacacggaguuuccauuuggauuuuaaacaaaauuuaugucauuuucag

SEQ ID NO: 187773 - RNA, 64 nt, Human
cagagguguuuaagagcccagaaaaacauaauuugauuuuaacauuaaaauuuccaaaaguuua

SEQ ID NO: 187774 - RNA, 64 nt, Human
cauuaacuagaacugcugagaggacuguauauaugauuuuaaaccuaaguugauuuuuuuucuc

SEQ ID NO: 187775 - RNA, 64 nt, Human
uuccacugaaauuuguuauguuuaaggaaauuaagauuuuaagcuugaaauuauacaagcagaa

SEQ ID NO: 187776 - RNA, 64 nt, Human
caagguauggccacaaggaagaauaguguacagagauuuuaauuaaugcaaguucugggaccuu

SEQ ID NO: 187777 - RNA, 64 nt, Human
ucugucagcaggacccuagaggagacucucauucgauuuuaaagaagcacaacgggucauuuuc

SEQ ID NO: 187778 - RNA, 63 nt, Human
uauuauuuuaaaaauugcauuuuuaccuuucaugugccugaaggcuauccacuacauucugaa

SEQ ID NO: 187779 - RNA, 63 nt, Human
uccagugcuguggaaguuaagguguugaccacugugccugaaaugaaaccacaaggcuugaga

SEQ ID NO: 187780 - RNA, 63 nt, Human
auacauuccaaaacauguuuugagucuuacucugugccugaccuugugcuugauaacagggau

SEQ ID NO: 187781 - RNA, 63 nt, Human
cuaaggacuucugcuuugcucuucaagaaaucugugccugagaacaccagagaccucaaauua

SEQ ID NO: 187782 - RNA, 64 nt, Human
aaugggcuaauaaaaaacauguguuucucuuauggauuuuaauaagcuccaguauuauucaaau

SEQ ID NO: 187783 - RNA, 64 nt, Human
auggaaacacauugcucuacccugcuacuuaguugauuuuaaagugaauuuacagugaugagaa

SEQ ID NO: 187784 - RNA, 64 nt, Human
ucugaaaccagguagaaggaagccuagauuguaagauuuuaaacauuuguaauaguucuauaaa

SEQ ID NO: 187785 - RNA, 64 nt, Human
agaagaauguugcuuaagaaagaacaucaccauugauuuuaaauacaaguagcaggguauugcc

SEQ ID NO: 187786 - RNA, 64 nt, Human
aagucuuacuguuuugugcggugugucuccagcugauuuuaacuuuuuugaugguagaaauuuu

SEQ ID NO: 187787 - RNA, 64 nt, Human
ccaauaugugauuuuuuuucccauuuagaauggugauuuuaaaugugugagugcauguacuauc

SEQ ID NO: 187788 - RNA, 64 nt, Human
uuaaacucugaauuuaucuuugauaacagggauugauuuuaaaauguacauguauuaaauuaca

SEQ ID NO: 187789 - RNA, 64 nt, Human
agggggugugggcauaaagaauggugggaggccugauuuuaaacuucaggccagaacccccaau

SEQ ID NO: 187790 - RNA, 64 nt, Human
cauuggcagacuuuuugcuggcucugggagccaugauuuuaaucacauucugcaaggugacaaa

SEQ ID NO: 187791 - RNA, 64 nt, Human
cgucaaaaauaguuugccuuaggucacgccuuaggauuuuaaaaaaauuacauugaaacaucaa

SEQ ID NO: 187792 - RNA, 64 nt, Human
aauucacuuaggaucgcaggaaucaggggaaagugauuuuaaaggugguuucuccagcacauuu

SEQ ID NO: 187793 - RNA, 64 nt, Human
cuaaaaugaaacauaaaaccuuuuauuuucuucugauuuuaacaaggaaucuauuuaaauagaa

SEQ ID NO: 187794 - RNA, 64 nt, Human
auuuaaaccuaguaccauccaaaaccauguaauggauuuuaagaaucuguuaggccuucuuagc

SEQ ID NO: 187795 - RNA, 64 nt, Human
uuaaucagcgugccauuuuuguuguuguuugaaagauuuuaauuuuuggaaugcacaguuuuua

SEQ ID NO: 187796 - RNA, 64 nt, Human
aauauauacagaaaccucgauauauaauuguauagauuuuaaaaguuuuauuuuuuacaucuau

SEQ ID NO: 187797 - RNA, 63 nt, Human
uuuuaccauuccuguucacaaaagguucucauggugccugacagguuacccuugagggcuugu

SEQ ID NO: 187798 - RNA, 63 nt, Human
ggguugagggucacagaccucccucccaucugggugccugaguuuugacuccaaucagugaua

SEQ ID NO: 187799 - RNA, 64 nt, Human
ccgagaauuaggcgcccaccguguccccuccagcgcgcgcgaagaagcuugggagucguggcgg

SEQ ID NO: 187800 - RNA, 64 nt, Human
cccaauggcaauaaaggcacugacgauagcuggcgcgcgcgacgucacacaccauuuucagaug

SEQ ID NO: 187801 - RNA, 64 nt, Human
gagagcugggucccgggagauggaagccucccaggcgcgcgaggcuucccgggcgcucugaggc

SEQ ID NO: 187802 - RNA, 56 nt, Human; identical to SEQ ID NO: 100692

SEQ ID NO: 187803 - RNA, 64 nt, Human
gcggccccagcuuuccgccugcacccgcgaggacgcgcgcgagcacacgcggcgccccgccagg

SEQ ID NO: 187804 - RNA, 64 nt, Human
cccgccgcacgcacgcgcgccugcgugcggggaugcgcgcgagugugugcgugcucgcgugugu

SEQ ID NO: 187805 - RNA, 64 nt, Human
cacugacagccuuugauggaggaacccaagaaaggcgcgcgacaaugguagaagugagagcuuu

SEQ ID NO: 187806 - RNA, 64 nt, Human
uggccacgucuccuugagaaccaauaccaaacgagcgcgcgaaccuugaaaugucacgggcuuc

SEQ ID NO: 187807 - RNA, 64 nt, Human
gcaggacaggcaggagagauucuuccuaaagccucccccauaaaaagggagcuguggauccacu

SEQ ID NO: 187808 - RNA, 64 nt, Human
gggggaguaguggggcacggcuccuaagauccagcccccauacugacagacggacagacagaca

SEQ ID NO: 187809 - RNA, 63 nt, Human
ugaggcugagcaaaaggucugcaaaucuccccugugccugaucuguguguuccccaggaagag

SEQ ID NO: 187810 - RNA, 63 nt, Human
agcagagcuagagccaugagacccacagacuuggugccugagcgcagcuccagggaagcccca

SEQ ID NO: 187811 - RNA, 63 nt, Human
accugugaggggcccugcuguagauggccacaggugccugacuaggagccccuagguccccag

SEQ ID NO: 187812 - RNA, 64 nt, Human
ccuacucucuguucuugucccugccaacccccaccccccauaaucugacucacaacuucaccau

SEQ ID NO: 187813 - RNA, 64 nt, Human
gguuagccggaauacuggggccugcccucagcaucccccauagcucccagcagccccaggguga

SEQ ID NO: 187814 - RNA, 64 nt, Human
cagcacauuccuccuacuucccuuuccuccacuccccccauaucuuuaaaguguggaagcagaa

SEQ ID NO: 187815 - RNA, 64 nt, Human
acguuugauaguucuaauuuaaauuucuuccuuucccccauauucaaucauugaauccuuauag

SEQ ID NO: 187816 - RNA, 64 nt, Human
uucuccuuccucuaggagccauguuauccucugucccccauagagucaagccuagugcuugaag

SEQ ID NO: 187817 - RNA, 64 nt, Human
cuccugggcucaagcauuccuccugccucagccucccccauagcugggacuaggggugcaugcc

SEQ ID NO: 187818 - RNA, 64 nt, Human
cguguagccagccaggugcaugccgggaccauggcccccauacuuggcugcuuccugugacagu

SEQ ID NO: 187819 - RNA, 64 nt, Human
gaugccaagcaaagacccuuccccagaggccuaccccccauauguccucagagaggcugagugu

SEQ ID NO: 187820 - RNA, 64 nt, Human
caaagggucgcuuaaggaaucugccccacagcuucccccauagaaggauuucaugagcagauca

SEQ ID NO: 187821 - RNA, 64 nt, Human
gcuuuagaagcagccaggucuggugagaaaugggcccccauaccaacuguggacuuggaauauc

SEQ ID NO: 187822 - RNA, 64 nt, Human
cgucuugacuguuuucccuacuugcugacuuaaccccccauagugugggggaccugcagagaac

SEQ ID NO: 187823 - RNA, 64 nt, Human
ccucccucacccugagccccuuccuugcucugcacccccauauggucauagcccagaucagcuc

SEQ ID NO: 187824 - RNA, 64 nt, Human
caaugguccugacauaauaaggaucuuugauuaacccccauaaggcauguguguguauacaaau

SEQ ID NO: 187825 - RNA, 64 nt, Human
ccucacuucaggagcuuuuaaaaauacugagacccccccauaaccagagauucagauucaaaga

SEQ ID NO: 187826 - RNA, 64 nt, Human
uagcucagaaauuaagaaagaaugguauaaugaacccccauauacccuuccuucuggauucacc

SEQ ID NO: 187827 - RNA, 64 nt, Human
cuguuucaggguauccagcuguagauguucuuaucccccauacuugugaguucuugggguugcu

SEQ ID NO: 187828 - RNA, 63 nt, Human
gauuugacaacugggcccuguugguggagaccagugccugaacuggacccugugaaaucuguc

SEQ ID NO: 187829 - RNA, 63 nt, Human
aaugaaugagaacugcaggaguuucuccucugggugccugaagcuauagugcaaugguuccca

SEQ ID NO: 187830 - RNA, 63 nt, Human
agccugaguccacgaccuaggcaguaggccggugugccugacugcccagcauuuggguaauuu

SEQ ID NO: 187831 - RNA, 64 nt, Human
cguaagagcuuugaauuugaagugaguuuuuuuccccccauaaguuauuuauuccuuuuuucug

SEQ ID NO: 187832 - RNA, 64 nt, Human
agccgccuaaggcccgcggcucaugugcugcccgcccccauauuuauucacugauagagaaucu

SEQ ID NO: 187833 - RNA, 64 nt, Human
ugugggagggggccggaacggggagggcgaguggcccccauacuugcccucccuugcucccccu

SEQ ID NO: 187834 - RNA, 64 nt, Human
uaacauuuucuuuucuuaguccuccugcucucaacccccauauuuugccuuugaauacgugggu

SEQ ID NO: 187835 - RNA, 64 nt, Human
aggucauuuguauucagaguaaaucagugguccacccccauaaaacuguaagacaagccuccug

SEQ ID NO: 187836 - RNA, 64 nt, Human
cucugagcccugcuagccuugaggcgcggacccucccccauaccucccacaguaucccagcgcc

SEQ ID NO: 187837 - RNA, 64 nt, Human
uugguuucauuuuuaauuuuaugguucugugcgucccccauauuuaauauuuauuauucaaacg

SEQ ID NO: 187838 - RNA, 64 nt, Human
aucccuaugacaacacuuuguaaaagccgcggggcccccauacagcgagugaccuugcaacugu

SEQ ID NO: 187839 - RNA, 64 nt, Human
cuggcucuucccucccucacuuuuacuuucccuucccccauaaguuggaggauaaaauggguau

SEQ ID NO: 187840 - RNA, 64 nt, Human
aaaccucaaaguggauucacuuucugauaguuaacccccauaaaugugcacguaccugugucuu

SEQ ID NO: 187841 - RNA, 64 nt, Human
auauuucauauaacauauauauuuauuuauuucccccccauagaaggcaaaauggcuuucagca

SEQ ID NO: 187842 - RNA, 64 nt, Human
aagacuuaguauauuuucuuuuccucugucccuucccccauaagccuccauuuaguucuuuguu

SEQ ID NO: 187843 - RNA, 64 nt, Human
gcaaguuuggcugaaaacaguugacaacaaagggcccccauacacuuaucccucaaauuuuaag

SEQ ID NO: 187844 - RNA, 64 nt, Human
uuuguggcaugggguaguggagcuucccuccccacccccauauguaucagugaagccuuugaaa

SEQ ID NO: 187845 - RNA, 64 nt, Human
ccucaggaagccuaaggucgugcuaguguggugacccccauacauuccucccugcuccccacug

SEQ ID NO: 187846 - RNA, 64 nt, Human
cuucagaagucuaagucuagugaagguacccugacccccauauaaacaacccuugaggccggug

SEQ ID NO: 187847 - RNA, 63 nt, Human
uuuaaaaccugugccuucucgaaacaagaauuugugccugaggugaaaaaaguuuguaaguua

SEQ ID NO: 187848 - RNA, 63 nt, Human
agaaaaaaccaagcuuaggguauuuuuccucccgugccugagucccaauuacauucacgacag

SEQ ID NO: 187849 - RNA, 63 nt, Human
aaaguaaaaagggcuacaggucacagaucgucagugccugagaaagaacauugacuuacucua

SEQ ID NO: 187850 - RNA, 64 nt, Human
acgccgccuucacuccacagccucaccccucccacccccauacugguacugcuguaaugagcca

SEQ ID NO: 187851 - RNA, 64 nt, Human
ccugguuugcgggagauuuccuccccucagucaacccccauaaccuggggauugggcagugugg

SEQ ID NO: 187852 - RNA, 64 nt, Human
ggcccuauggccguucuuuuccacccuguuucuucccccauaggaagaacccaccuguagcccu

SEQ ID NO: 187853 - RNA, 64 nt, Human
uggccaccauacgggccauccucagugaggcagccccccauaggcuuccgccaagcucuggucc

SEQ ID NO: 187854 - RNA, 64 nt, Human
uugcuggcauuaaaaauaagcacacuuacauaagcccccauacauagagugggacucuuggaau

SEQ ID NO: 187855 - RNA, 64 nt, Human
acuccccaaacccaggcucccauauguaccccaucccccauacucaccucuuuccauuuugagu

SEQ ID NO: 187856 - RNA, 64 nt, Human
ggcauuuuucuacaagaagcagucagccuucucucccccauaaggacuggcuguaaccuuaagc

SEQ ID NO: 187857 - RNA, 64 nt, Human
ggcagaagagacgucccgcuucugugauuuggugcccccauaucagacaaugaauuuggaagug

SEQ ID NO: 187858 - RNA, 64 nt, Human
uucaaguuggcugucccccccgccgccccccccacccccauauguacagaugauaauagggugu

SEQ ID NO: 187859 - RNA, 64 nt, Human
agaacuccacaaaccuuccaaaucuggaggagggcccccauacauuacaauuccucccuugcuc

SEQ ID NO: 187860 - RNA, 64 nt, Human
uccucaggcagugcccuuuccucccacuuuuccucccccauagccacaggccucugcuccugcu

SEQ ID NO: 187861 - RNA, 64 nt, Human
caguauaacagauauucuaauucuucuuaauauucccccauaaugccagaaauuggcuuaauga

SEQ ID NO: 187862 - RNA, 64 nt, Human
gaucuuugcuugcagcccuccguccugcugaaaacccccauaagccagugaacacagagcagcu

SEQ ID NO: 187863 - RNA, 64 nt, Human
uaugugauuuugggguacuaaagcacaaaaaaaucccccauaaaauaaaccuuccugaaaagac

SEQ ID NO: 187864 - RNA, 64 nt, Human
gggcuccccagggcugacccugcagcuuugggcucccccauagugacugugccauaggaaagca

SEQ ID NO: 187865 - RNA, 64 nt, Human
auauuuuuguaucaguauugaauuuuggacagugcccccauauaaggaaguuacuguuuuaaaa

SEQ ID NO: 187866 - RNA, 63 nt, Human
uucauccuagaguuucagguaggcuaaugcuuagugccugaguauuuaaauuuucuuuucaaa

SEQ ID NO: 187867 - RNA, 63 nt, Human
uuuaaaaacaaaacaaaaaaaaauaaaaaaguugugccugaaaugaaucuuguuuuuuuuuau

SEQ ID NO: 187868 - RNA, 63 nt, Human
uuguucuuugcuggaccaucaagggucauggcagugccugaacauggcagucuagggugaaca

SEQ ID NO: 187869 - RNA, 64 nt, Human
uauguugugaauuauggaucaggguucuuuuuuucccccauacaaguauccagucauuguaaca

SEQ ID NO: 187870 - RNA, 64 nt, Human
aucaaguaaggauguauguggugaaaacuuaccacccccauacuaugguuuucauuuacucuaa

SEQ ID NO: 187871 - RNA, 64 nt, Human
uccagcccuuuuaugccugugugaucccaccccacccccauaguuguauaaaggucauagugaa

SEQ ID NO: 187872 - RNA, 64 nt, Human
guuuucagaauucucucaauuuuuaaguuuuucucccccauauuuugugaaaagcagugguaug

SEQ ID NO: 187873 - RNA, 64 nt, Human
uccaagggucgcugccgcucccugguggagcugacccccauagcagcagugcaugggcgcuggu

SEQ ID NO: 187874 - RNA, 64 nt, Human
ugagagggggcuuggccuucuuaggugacaaugucccccauaucuguaugucaccaggauggca

SEQ ID NO: 187875 - RNA, 64 nt, Human
ucaacuaggggaggagagagggucuccaguguuccccccauagagaccaggagggagagccucu

SEQ ID NO: 187876 - RNA, 64 nt, Human
cacaggcuucugccgccccccucaucuccacccucccccauaucuguuugcauuaggaguucca

SEQ ID NO: 187877 - RNA, 64 nt, Human
uaaauauacacuauuuuugauagcacacauggggcccccauaucucuuggccuugguuuugaug

SEQ ID NO: 187878 - RNA, 64 nt, Human
acuugcauauuuuuaauuuccuuugguuaaaggucccccauacuucucuguucggagacaugag

SEQ ID NO: 187879 - RNA, 64 nt, Human
cagugagagauaauuugaaucaagggggcgguuucccccauauuguucuugugguagugaauaa

SEQ ID NO: 187880 - RNA, 64 nt, Human
aauauaaagauuuuaaaacugcauuaugaccuagcccccauaauugggauuuaucauuuuggag

SEQ ID NO: 187881 - RNA, 64 nt, Human
uggagggugggggacagaagauggggcuacauuucccccauaccuacuauuuuuuuauaucccg

SEQ ID NO: 187882 - RNA, 64 nt, Human
caauggcugcuuugaacuuacucaggaaagccagcccccauaauauuguauuaccaaacaguau

SEQ ID NO: 187883 - RNA, 64 nt, Human
cucccuuucuccucuccuuuuucucuucacaucucccccauagcacccugcccucaugggaccu

SEQ ID NO: 187884 - RNA, 64 nt, Human
agacccaggcaauuuugccccucuuucccacaugcccccauaugucugagccaaacugcacugg

SEQ ID NO: 187885 - RNA, 63 nt, Human
uuuucuuuaaaaaagcgguuucuaccucucuaugugccugagugaugauacaaucgcuguuua

SEQ ID NO: 187886 - RNA, 63 nt, Human
gagaaagaugacccagaaguggauucagccauugugccugaaaucaguguuuaaaaaaaaaaa

SEQ ID NO: 187887 - RNA, 63 nt, Human
auuguucugcacuggaugcauucagcugaggaugugccugauagugcaggcuugcgccucaac

SEQ ID NO: 187888 - RNA, 64 nt, Human
aguugacuuuccucccauuuuaccacuuuaaacacccccauaacaauucccccauccuucagug

SEQ ID NO: 187889 - RNA, 64 nt, Human
ucuuagguuacacaugaaauccuaccgucacuagcccccauacaccaguguugcuggcugaaga

SEQ ID NO: 187890 - RNA, 64 nt, Human
ccuauacacacugacagagacagcaauaccccaccccccauauuaaauaaaugucuucaccaag

SEQ ID NO: 187891 - RNA, 64 nt, Human
ugaaacaugagggaggugagguguccguccacuucccccauaaaggugugcauuucaguuaggc

SEQ ID NO: 187892 - RNA, 64 nt, Human
ggaggucccuuauuuccuucagaaugauccccaucccccauagucgccagacuuucucauguuc

SEQ ID NO: 187893 - RNA, 64 nt, Human
acugccuucucugacauccccaccuuccucugugcccccauagcacuguguauaccgcuacuac

SEQ ID NO: 187894 - RNA, 64 nt, Human
auguagaugauauguuucguggguugaauugugucccccauaaaagauauguugaaguucuaac

SEQ ID NO: 187895 - RNA, 64 nt, Human
uuaaauggaauaaaaccaacuuuauucuuuuuuucccccauacugguagauaaagcaaacuuua

SEQ ID NO: 187896 - RNA, 64 nt, Human
agcagcuucacucccaccacggaccaaugccuuucccccauaggccccaagaagagcggcuguc

SEQ ID NO: 187897 - RNA, 64 nt, Human
acauuucccccuuccuuucccagaagccacuggccccccauagcacccagugcauccuuuuuac

SEQ ID NO: 187898 - RNA, 64 nt, Human
ggaaaccacuuccccaggcuucucccuccccccacccccauaggaacaggauuuggccuuagcu

SEQ ID NO: 187899 - RNA, 64 nt, Human
gguagcaagaggaguacccaguuagggguuggagcccccauauaacaucuuccugucagaagac

SEQ ID NO: 187900 - RNA, 64 nt, Human
ccgcacccugaucucucuucucuaugccuaccuccccccauacccugcugaucucccugagccu

SEQ ID NO: 187901 - RNA, 64 nt, Human
auaagauccaaguuauuuuccccaacucuuguuucccccauaaaguuaggcaugaggaggagca

SEQ ID NO: 187902 - RNA, 64 nt, Human
uuucuuuuaaaauugaauucauucugaugcuugacccccauacucccaaccuuguccaguggag

SEQ ID NO: 187903 - RNA, 64 nt, Human
uuucuuuuaaaauugaauucauucugaugcuuggcccccauacccccaaccuuguccaguggag

SEQ ID NO: 187904 - RNA, 63 nt, Human
gccaguuuggccuuucacugcacuauucugauggugccugacugaauccaaauauccuagcug

SEQ ID NO: 187905 - RNA, 63 nt, Human
caugcuccaccgucaggggggaguaugagcagagugccugaguuuagggucaaggacaaaaaa

SEQ ID NO: 187906 - RNA, 63 nt, Human
uaccccuguaccugugaaggauuggcagugcuugugccugaccucaucaaaaaauaaagcucc

SEQ ID NO: 187907 - RNA, 64 nt, Human
cagccacuccagcgccuccccuccgcuccccacgcccccauauuggcaacacccccagcgccac

SEQ ID NO: 187908 - RNA, 64 nt, Human
ggggaauacgggcaacagcagucaggagggguaccccccauacuggcuuacuuccaccuccugc

SEQ ID NO: 187909 - RNA, 64 nt, Human
cuacucugccccuaagcuggcuguaccuguuccucccccauaaaaugauccugccaaucuaaug

SEQ ID NO: 187910 - RNA, 64 nt, Human
gcuacaacaagcucucccucaaugaggaaggaaucccccauaaccccauggucaaugcuggugc

SEQ ID NO: 187911 - RNA, 64 nt, Human
ugaccaaccaaccaaacuccacacuucaucugaucccccauagacuuggggauggacagcuguu

SEQ ID NO: 187912 - RNA, 64 nt, Human
uagcuuuccuagaauuccauuaauaaaugcugcucccccauauagucuucccuucuguauaauu

SEQ ID NO: 187913 - RNA, 64 nt, Human
guaauucuaaauaaaccucuucccauacaccuuucccccauaagaugugucuucaacacuauaa

SEQ ID NO: 187914 - RNA, 64 nt, Human
ucugcaagugggagagacccgagcauccuccccacccccauagcuccagugcacgccacccccg

SEQ ID NO: 187915 - RNA, 64 nt, Human
uuauaagcaugacauguuuacuauaaaccuuuugcccccauaauuucuuuuuuuaaaggaaauu

SEQ ID NO: 187916 - RNA, 64 nt, Human
aacuccggggagccauaaucugcaacuucauuuucccccauagaagagaaaaaagagcaccacc

SEQ ID NO: 187917 - RNA, 64 nt, Human
agccccuuggaugugaugguacacagugggugggcccccauaauaaguuccuaaagcaugggau

SEQ ID NO: 187918 - RNA, 64 nt, Human
uuugaccccagcagcuuggauggggugccgggcucccccauaguucacugacugucuccuuugg

SEQ ID NO: 187919 - RNA, 64 nt, Human
gacuuugccacugacuucucccacccuucugucucccccauaauaguuuauuugguuggucugg

SEQ ID NO: 187920 - RNA, 64 nt, Human
ccagggagccgcugauguacaauaaccuugaggucccccauacugaaaacugaccaaggccugu

SEQ ID NO: 187921 - RNA, 64 nt, Human
aguaccuguugaaaaaaacugguucuccaccccucccccauacaaaauccacaacaaagcgcag

SEQ ID NO: 187922 - RNA, 64 nt, Human
gugaggcgaugcuguuccaucugcacaugaaggacccccauacagccugucucccaccccugac

SEQ ID NO: 187923 - RNA, 63 nt, Human
auuuuuuuacuucacuguucaugguguaauugugugccugacggcuguagcuacuaacuuggc

SEQ ID NO: 187924 - RNA, 63 nt, Human
cacacggaagucugacucucaacuccccccaaagugccugacuuuagugaaccuagaggugau

SEQ ID NO: 187925 - RNA, 63 nt, Human
uaacagauuuuuuuuggacuguuuuguugggcagugccugauaagcuucaaagcugcuuuauu

SEQ ID NO: 187926 - RNA, 64 nt, Human
auccuccuauaccgcacauaaauagauuucagagcccccauacaaugggcagugucugcuauag

SEQ ID NO: 187927 - RNA, 57 nt, Human
auuccaauucugugaauuagcaccccacccccauaccccuucuuccacccccagacu

SEQ ID NO: 187928 - RNA, 64 nt, Human
gcugaggggagaggaaaacauggauuauucacuccccccauacucuuugugauacacaugugac

SEQ ID NO: 187929 - RNA, 64 nt, Human
ggcgagcaggcuucuuggauggacagugcugagacccccauaucccagaguccccagccucccu

SEQ ID NO: 187930 - RNA, 64 nt, Human
acuccggggccugugccgccagaaccgggcucugcccccauacgcugcccucgcagccuggcgg

SEQ ID NO: 187931 - RNA, 64 nt, Human
gcuaagggguggggcugcggggguuccguguccacccccauacauuuauuucuguaaauaaugu

SEQ ID NO: 187932 - RNA, 64 nt, Human
acccaguggcacagaaccgaggagcugccauuaccccccauagggggcagugucuuguuccugc

SEQ ID NO: 187933 - RNA, 64 nt, Human
gguuagaagacauacagaaacagggcuggugugucccccauagucugcaugcugugccggaaca

SEQ ID NO: 187934 - RNA, 64 nt, Human
aguuuuaggccuuucuccuucuaagugccccccacccccauagccugcauguccacucccagac

SEQ ID NO: 187935 - RNA, 64 nt, Human
guaaaaugccagcaauuuaaaacuaggacuuuuccccccauaagccaaggagguagaauuacua

SEQ ID NO: 187936 - RNA, 64 nt, Human
cuccucuuugcuuccuucccucucucuccucccacccccauaggaucaguguguaccagguaca

SEQ ID NO: 187937 - RNA, 64 nt, Human
gagauaucauccuuuucuucugccucgccugaaucccccauaaacaccagaugauugagucuac

SEQ ID NO: 187938 - RNA, 64 nt, Human
gaucuggugcauagaugaacaucuauccccuccucccccauacacaccuaggcuugaaaugccc

SEQ ID NO: 187939 - RNA, 64 nt, Human
gagcugcccccacccccggccucagccaccagcacccccauagggcccccagacaccacacaca

SEQ ID NO: 187940 - RNA, 64 nt, Human
acccagcgauuuuuccuuggaggucagcccguuacccccauaacugauuuaccuacuuaccaua

SEQ ID NO: 187941 - RNA, 64 nt, Human
gcccugccccugccccauuuccuccucaucugaucccccauagguggcugagcaucggagugga

SEQ ID NO: 187942 - RNA, 63 nt, Human
ucuguacauaagcaaaugagagauucgaucagugugccugaaaccuuacuacaagggaccuuc

SEQ ID NO: 187943 - RNA, 63 nt, Human
ucauaagccaggaaaugaaacaaaggaaaacaggugccugaauuuccuggggaaacauggcuu

SEQ ID NO: 187944 - RNA, 63 nt, Human
aggauguggcaggggcaguggccuggaugcacagugccugaugggaguaggcuccagacagga

SEQ ID NO: 187945 - RNA, 64 nt, Human
ccuaagucuucugauuccaugagcagucccccuucccccauacccugcugucuccacggaggga

SEQ ID NO: 187946 - RNA, 64 nt, Human
gagaugcuggaggugggggugcuguguuuuagaccccccauauuaucccaguguccccugcccc

SEQ ID NO: 187947 - RNA, 64 nt, Human
cagaagggugacccggacagccuagcugggggcucccccauauucccaggcccagaagacagac

SEQ ID NO: 187948 - RNA, 64 nt, Human
uuccccacccccggucccccauugaggcccgccacccccauaacuuugggagcgagggcccagc

SEQ ID NO: 187949 - RNA, 64 nt, Human
caggccccagucccagccugggggcuggcagaggcccccauauacucugcuacagcuccuauca

SEQ ID NO: 187950 - RNA, 64 nt, Human
cuccugaccugugacccccugccacaauccuuagcccccauaucuggcuguccuuggguaacag

SEQ ID NO: 187951 - RNA, 64 nt, Human
gacagcggcugccugucccuucuucacccccucacccccauaauuugucuagaucuauuuccau

SEQ ID NO: 187952 - RNA, 64 nt, Human
uugugcuuguuagcagguuuuucuguuaguuuuucccccauaacauuuaauuauuacuaaaauu

SEQ ID NO: 187953 - RNA, 64 nt, Human
cuauccuguucugugggggggggggucuguuuuccccccauauuuguauuccuuuucauaacuu

SEQ ID NO: 187954 - RNA, 64 nt, Human
gucuggcugccccaugggccugcgcuguagacgucccccauaggucgccccagggccucugccc

SEQ ID NO: 187955 - RNA, 64 nt, Human
cccacccccucggggcagaguuugcacaaagucccccccauaauacagggggagccacuugggc

SEQ ID NO: 187956 - RNA, 64 nt, Human
uuauuaccuggaggccuguccagcacccacccuacccccauaaagcauuguuuacaccuguguc

SEQ ID NO: 187957 - RNA, 64 nt, Human
cucuucccugccucuucccucgcccaccugccugcccccauacucccccagcggagagcaugau

SEQ ID NO: 187958 - RNA, 64 nt, Human
gauaauggaggagguaaagguugaauuauauuuucccccauauuauugacccauagugacacca

SEQ ID NO: 187959 - RNA, 64 nt, Human
cagcaucauccucugcugaccuguuccuugagcucccccauaucagcagcccagaguguggguc

SEQ ID NO: 187960 - RNA, 64 nt, Human
caaccggcgggggggugucucccugcccccgacccccccauacccccuucucugugacacacac

SEQ ID NO: 187961 - RNA, 63 nt, Human
gcagagucagucacuuuucuucuagauuccaaagugccugauccacuugguuguggauuccug

SEQ ID NO: 187962 - RNA, 63 nt, Human
aguaaauauuaauguauuacauuucaaauaauggugccugacauauugaauaauuauuuucua

SEQ ID NO: 187963 - RNA, 63 nt, Human
guuggggugacagauacugaauguauacguauugugccugagcucaccagcaaacagaagcau

SEQ ID NO: 187964 - RNA, 64 nt, Human
aagcauuuuuugcauguguuuggaggagcuuuuacccccauacagacauuugacagcgucuugu

SEQ ID NO: 187965 - RNA, 64 nt, Human
aggggggugucaggaacuaguccuugcacccccucccccauagacacacuaguggucauggcau

SEQ ID NO: 187966 - RNA, 56 nt, Human
augcccggggugagguguaggcagagcccccauacggggagcuuggcagaaggggu

SEQ ID NO: 187967 - RNA, 64 nt, Human
acccacuccuugggccccuaggaugacccaacuacccccauaacuuucugcuucccacagguuu

SEQ ID NO: 187968 - RNA, 64 nt, Human
gcuacaucccuugcccccuguccauuuauuuaagcccccauaggugcccuucacccccaaaacc

SEQ ID NO: 187969 - RNA, 64 nt, Human
ggcuccgaacacccucgaagcgcgccacucgcuucccccauagccaccccagaaauggugaaaa

SEQ ID NO: 187970 - RNA, 64 nt, Human
ucugcucuuugucauucuuagcccccuacuguggcccccauagccccauaacccagagagggag

SEQ ID NO: 187971 - RNA, 64 nt, Human
uaagcuagauccaaauaaaagaaaguucaguuuucccccauaacuauucuugggucaugaacuu

SEQ ID NO: 187972 - RNA, 64 nt, Human
gacccacuuuuuccuuugaaaauacaauaaaauucccccauaccggugugcauuuaaauguucu

SEQ ID NO: 187973 - RNA, 64 nt, Human
augaccccuccagccaggacucuccuacauguggcccccauaggccucuguggcugcaaggcgg

SEQ ID NO: 187974 - RNA, 64 nt, Human
acuccagcugggcucggucccccacagucagggacccccauaaaggacacccccuucucucuag

SEQ ID NO: 187975 - RNA, 64 nt, Human
ccuggaagugaaagccgccuccuucccguuaugccccccauacaggagccucgguuuuucagca

SEQ ID NO: 187976 - RNA, 64 nt, Human
gguuuagggauaaauguuucuggaacccuguggucccccauaauguugauagaauaucauaugc

SEQ ID NO: 187977 - RNA, 64 nt, Human
aaucacguucuuuugugauagacugucagugguucccccauaucugucccugccuugcuaaauu

SEQ ID NO: 187978 - RNA, 64 nt, Human
gguaguuaguuguucagccacuaaugccuuuuaucccccauaugggcgcugagcuguggcuguu

SEQ ID NO: 187979 - RNA, 64 nt, Human
gaggggucagugacucugggggucuccucagugacccccauaccucaucaugaacccuugggua

SEQ ID NO: 187980 - RNA, 63 nt, Human
ccuuagagacuuauuuauuugcaggaacaaauggugccugaauauuaacaguguucugauuaa

SEQ ID NO: 187981 - RNA, 63 nt, Human
accaguggaguuauuucaccacaaaucaacaaugugccugaggugcaugggaaauauaguuag

SEQ ID NO: 187982 - RNA, 63 nt, Human
ccaaagaaguauauuuaugaaucagcaaauguggugccugauuauagaaauuugugauccuau

SEQ ID NO: 187983 - RNA, 64 nt, Human
gucuauuaggucaguuuagcaagaacaccuaacccccccauaucuguucaaccucaguaucuga

SEQ ID NO: 187984 - RNA, 64 nt, Human
uucacuacauuuaauaguucuccuauuucccgcucccccauaucaauuuuccuuuugucuccgg

SEQ ID NO: 187985 - RNA, 64 nt, Human
uuuucaugguuaucauuauaucuaacuauaaccucccccauaguuaugaagaguaaccugaaau

SEQ ID NO: 187986 - RNA, 64 nt, Human
cucccuuucuagaucccauucauuuucugcaccucccccauaggcuuguuucucuccauugcua

SEQ ID NO: 187987 - RNA, 64 nt, Human
agcugggcuggaagguuccauaacuggccagcugcccccauaacuggcagcauucccagaccca

SEQ ID NO: 187988 - RNA, 64 nt, Human
ccagaacucuuccuccaaggacagaaggcuccugcccccauaguggccucgaacuccuggcacu

SEQ ID NO: 187989 - RNA, 64 nt, Human
caccacacaauaggaucccccuucuugcccuccacccccauaagauugugaaggguuuacugcu

SEQ ID NO: 187990 - RNA, 64 nt, Human
gaucccaagacaaugaaaguuugcacuguaugcuggacggcauuccugcuuaucaauaaaccug

SEQ ID NO: 187991 - RNA, 64 nt, Human
augcuaugggcucccuggccucccaggccaccaaggacggcaagaaggacaagaaggaggaaga

SEQ ID NO: 187992 - RNA, 64 nt, Human
ggcaggcauagaggcuucuccgccagccuccucuggacggcaggcucacugccaggccagccuc

SEQ ID NO: 187993 - RNA, 64 nt, Human
aaauaaugagauucccuaucuccuuuuagaccugggacggcaaaagggaagggaaggaaacuua

SEQ ID NO: 187994 - RNA, 64 nt, Human
ggcucugauuagccaggccuggucaggguccuggggacggcacccagauaugcagagucacccu

SEQ ID NO: 187995 - RNA, 64 nt, Human
ccugggaccccgggaaccucuccugccggaagccggacggcagggaugggccccaacuucgccc

SEQ ID NO: 187996 - RNA, 64 nt, Human
acaaccugcacuucugccaaggccagggccagcaggacggcaggacucuagggagggguguggc

SEQ ID NO: 187997 - RNA, 63 nt, Human
cuuuuuggauuaucaaugaaagcaauuuuaugugugccugaagcaagaaaauagcguuuuugg

SEQ ID NO: 187998 - RNA, 63 nt, Human
guaaaugugcauugucacaauccugggcacaaagugccugaugucaaaaugaagauaguaaaa

SEQ ID NO: 187999 - RNA, 63 nt, Human
ucuuagcauauaacugaacacaguugaaaaauugugccugauuauaauguauguauaauggua

SEQ ID NO: 188000 - RNA, 64 nt, Human
uggauuucuucaugguguccauuuuauuuagcaaggacggcacccacacacaaagaggaugauu

SEQ ID NO: 188001 - RNA, 53 nt, Human
agucagagggcucuaccugagaaggacggcaaggcugagguggcuaaggggga

SEQ ID NO: 188002 - RNA, 64 nt, Human
gauagucuuucaagcccccacaucacaggcuuagggacggcacuaacuuucucccagggaucua

SEQ ID NO: 188003 - RNA, 64 nt, Human
acugggaggguccccuccuccuucccuacuccugggacggcagcaaggacaugggggcugcugu

SEQ ID NO: 188004 - RNA, 64 nt, Human
aaucaaagaaaauggaugugacgucugugcagguggacggcaguccgaggggcuuauuucacuu

SEQ ID NO: 188005 - RNA, 64 nt, Human
ccuuguccaugugaguagcaugggcgggugguggggacggcaguggugaugaagggggugcacc

SEQ ID NO: 188006 - RNA, 64 nt, Human
gcguucccaguggacagcguggugagccguggccggacggcaggaggagaggggagcccccucu

SEQ ID NO: 188007 - RNA, 64 nt, Human
ucugugugccgccuccgaacacagaacauuguuuggacggcagccccacugcacauaacagacc

SEQ ID NO: 188008 - RNA, 64 nt, Human
ugcauccaguaacaccacuggggaugugcuggcuggacggcaccacccuuuccugggaagagau

SEQ ID NO: 188009 - RNA, 64 nt, Human
gagaaugaguguggauguguacaguacacgcacuggacggcagcgggaggcugggacuuuccau

SEQ ID NO: 188010 - RNA, 64 nt, Human
gccccucacacgccuucauccugaaacaggaagaggacggcaccaaguugggggugcuggauga

SEQ ID NO: 188011 - RNA, 64 nt, Human
aacaggcccacuccucugauuaccuccgggggauggacggcaaacagguaaggaguuccaugca

SEQ ID NO: 188012 - RNA, 64 nt, Human
ccaggacacuacccugagaucugcacagucagaaggacggcaggaguguccuggcugugaaugc

SEQ ID NO: 188013 - RNA, 64 nt, Human
gcagggguggcugaccccaugcucagccucuaggggacggcaggccaucaggcugggggcugug

SEQ ID NO: 188014 - RNA, 64 nt, Human
gcccucugcuccccaaugccuuagagagaggaggggacggcacggccgcucaccggaaggcugu

SEQ ID NO: 188015 - RNA, 64 nt, Human
gcugcuggccuccugcccagguggaggguccuggggacggcagaggauaaagcccccuccucac

SEQ ID NO: 188016 - RNA, 63 nt, Human
guccauucuuauaguuuguuugucacugagacggugccugauuuaauauauuuaagcugcuua

SEQ ID NO: 188017 - RNA, 63 nt, Human
cuaugccaaugaggcucgguggggggcucucaagugccugauccugcccugggcucagagcca

SEQ ID NO: 188018 - RNA, 63 nt, Human
cacuugaucaucuugugccaagauaugcuguuggugccugauagggauuagucuuuuaggugc

SEQ ID NO: 188019 - RNA, 64 nt, Human
uuaaucuuuauguugggacacagaccacauauuuggacggcagccaugcauccaucgcugaagg

SEQ ID NO: 188020 - RNA, 64 nt, Human
auggcaagacuuggccccuccaccugucccuaacggacggcaggucaggaaagccaggacucag

SEQ ID NO: 188021 - RNA, 64 nt, Human
gggcaggggacaccuuggcuccucagcagcccaaggacggcaccauccagcaccuccgucauuc

SEQ ID NO: 188022 - RNA, 64 nt, Human
ccuccuggccgccccgcagggggcuuggagggcuggacggcaaguccgucuagcucacgggccc

SEQ ID NO: 188023 - RNA, 64 nt, Human
cugggccgcuccaccucaccggugcagugacccaggacggcaucagcagcccagugagcaccag

SEQ ID NO: 188024 - RNA, 64 nt, Human
ccccgcuucccagggcuggccaagagagaagacuggacggcagggaggucaacauuaacgagug

SEQ ID NO: 188025 - RNA, 64 nt, Human
uuucagguguuccuagcauuucugccuccaggcaggacggcaggggugagcagcuuugggagag

SEQ ID NO: 188026 - RNA, 64 nt, Human
ccuugccuuuugaagaagagcccgcauaaugaguggacggcagacagcuauauuuaguggugcc

SEQ ID NO: 188027 - RNA, 64 nt, Human
gcacaugagcagugcccaggggcucccugcgugaggacggcaaggugcgauguaugucuaacuu

SEQ ID NO: 188028 - RNA, 64 nt, Human
acgcagaggugacagugggagcuggccugggccaggacggcagguggcccuggagaugggaaag

SEQ ID NO: 188029 - RNA, 64 nt, Human
gaggagggcccucagcuggcccuccccacacacaggacggcaggggcacugugaggcuuuucuu

SEQ ID NO: 188030 - RNA, 64 nt, Human
ucaagaaaccaagaugguuugggguaugggguggggacggcaaaagggguaagagcuggcuucu

SEQ ID NO: 188031 - RNA, 64 nt, Human
uaaaagucagagcugaagggagucgcuggggccaggacggcaugcaggccuguacccuguuccc

SEQ ID NO: 188032 - RNA, 64 nt, Human
aaggcuuccuggcagcucucacuacggccaaccaggacggcagggucauccugagccgccaagg

SEQ ID NO: 188033 - RNA, 64 nt, Human
uggcagccauguauuacagcuacuacaugcuaccggacggcacuuacugccuggcgccgccccc

SEQ ID NO: 188034 - RNA, 64 nt, Human
ccaauugcugcauggaaauugauguacauucaggggacggcaaaaauagcuguaaaauagugaa

SEQ ID NO: 188035 - RNA, 63 nt, Human
agcugcaaacacuacaaugcuuugagggggucugugccugaagcucaggaguguggaucagac

SEQ ID NO: 188036 - RNA, 63 nt, Human
aaagcagcuaccagguguucuacacucaucuuagugccugagaguauuuaggcagauugaaaa

SEQ ID NO: 188037 - RNA, 63 nt, Human
gacaggucaggaagucccccaggguccacaaaggugccugaggcucugguaagggugaagaua

SEQ ID NO: 188038 - RNA, 64 nt, Human
guggcgucuucugggaaagccugaccguguguucggacggcacuggcuccuuuccgaaguucuc

SEQ ID NO: 188039 - RNA, 64 nt, Human
acuucuacccccuggaggggggccgggugcugcuggacggcaagcccaucagcgccuacgacca

SEQ ID NO: 188040 - RNA, 64 nt, Human
ugagccccugaugccgcuuauuugccgugaguuuggacggcaccccugcuggcggauagcaaga

SEQ ID NO: 188041 - RNA, 64 nt, Human
ggaaccuggaugugugcacgugugucccagguagggacggcacaggagggugcauggggcgugg

SEQ ID NO: 188042 - RNA, 64 nt, Human
ggaaaaggaagugcuucugaaaacaaaccuuucuggacggcagagcccaaguuucaagcuuucc

SEQ ID NO: 188043 - RNA, 64 nt, Human
aggacaaggggcgggcccgcggccucacccggagggacggcagccccggucgcgcgcuggcccc

SEQ ID NO: 188044 - RNA, 64 nt, Human
cgcuccuucccagacacacccccacgcccccacuggacggcauuggaggaagggacagcugcuu

SEQ ID NO: 188045 - RNA, 64 nt, Human
ccucgccccggccuccgggucugggaaauugaggggacggcaggcccggcugcccuggaacugg

SEQ ID NO: 188046 - RNA, 50 nt, Human
ugaagcccgaacccaccugaggacggcagugaggaugagcaccucuagca

SEQ ID NO: 188047 - RNA, 64 nt, Human
accuucaaagcugacugugccccgcugcgggaggggacggcaccccagugguggcagagcuugg

SEQ ID NO: 188048 - RNA, 64 nt, Human
ccugcuucccuucuggcccuggaagacugagucuggacggcagaguggagggacugggaggcug

SEQ ID NO: 188049 - RNA, 64 nt, Human
aaaacccguuccggagccgccugcucccggaaccggacggcacagggcguucuugcccacccca

SEQ ID NO: 188050 - RNA, 64 nt, Human
ucugcuuaggagguggggacuugggcugggauggggacggcauaccccucccaggccucucccu

SEQ ID NO: 188051 - RNA, 64 nt, Human
ugaacacaagcugcugccggggacuguccuggguggacggcaggugaacacaagcggcugccgc

SEQ ID NO: 188052 - RNA, 64 nt, Human
uguccucccgcgaggaccaggcaucgcugugugaggacggcacggccagcgccugcugugagug

SEQ ID NO: 188053 - RNA, 64 nt, Human
acugcgccagugacacauaguuacuuccuggcugggacggcaccuauagaaacuaggguacaaa

SEQ ID NO: 188054 - RNA, 63 nt, Human
cacuaaaguuacaaacagaccaccaccaggacugugccugaacaauuuuguauugagagaaua

SEQ ID NO: 188055 - RNA, 63 nt, Human
uaaaauuguaaauaaauaauguuauguaucagugugccugaaccuugcauauccuucacauau

SEQ ID NO: 188056 - RNA, 63 nt, Human
gagaaccaguggugugaagagaagugaaauguugugccugacacuguaacacuguaaggauug

SEQ ID NO: 188057 - RNA, 64 nt, Human
cugcugggccacaccccaagaucaggggcccuggggacggcaagugaauaaagcacauuuccac

SEQ ID NO: 188058 - RNA, 64 nt, Human
gcugggugcccggaggcggccauggugucucgauggacggcagccaggauggagcacccauggg

SEQ ID NO: 188059 - RNA, 64 nt, Human
auggugcccgccggccugccgggcucccaccccuggacggcagaggcaaggacggacgggagcu

SEQ ID NO: 188060 - RNA, 64 nt, Human
gcaaagggcacagccaugcaaaggcccuggggcaggacggcaccugguaugcgggaggaacaga

SEQ ID NO: 188061 - RNA, 64 nt, Human
cuguccccggggagccaucgccuucagugugcagggacggcaccgaggagucugagccgggggc

SEQ ID NO: 188062 - RNA, 64 nt, Human
cauucccucuuccaggcccuugucuccccaguugggacggcagagagacaaguucuuauaucug

SEQ ID NO: 188063 - RNA, 64 nt, Human
gcaauaaaacagucuugucggccagcugcccaggggacggcagcuacagcagccucugcguccu

SEQ ID NO: 188064 - RNA, 64 nt, Human
ugagcagguguugguccucaggagcuccaaccccggacggcagaugccuuccucagucucgagc

SEQ ID NO: 188065 - RNA, 64 nt, Human
gcuccacugacugugccgaggggcgggggcaggaggacggcaagaccuauuuauaauauuuagc

SEQ ID NO: 188066 - RNA, 64 nt, Human
ucgggacccacagucucaccacgucuccuccagaggacggcagaggguacaggugguggccugg

SEQ ID NO: 188067 - RNA, 64 nt, Human
ucugugagaauuggccauccugaggacacagccaggacggcagaggccuccuggccucagggca

SEQ ID NO: 188068 - RNA, 64 nt, Human
agaggccacgugaacccacggccacagagaggcaggacggcagagccaugauuucccaccgagc

SEQ ID NO: 188069 - RNA, 64 nt, Human
aaaacccacccuaccacaguccgcucuuccaaguggacggcagaccugggaggggacgccugug

SEQ ID NO: 188070 - RNA, 64 nt, Human
gccuagacugagugugguuucgucgugaguggauggacggcaagcuuagcaagccuaagucccc

SEQ ID NO: 188071 - RNA, 64 nt, Human
gcaucgggccuaaguguccuggggagauuggaggggacggcagcguucugcaugauggaggcgc

SEQ ID NO: 188072 - RNA, 64 nt, Human
cucccugggagccacgugcuggccauguggccagggacggcaugagcaggaggcggggacgugg

SEQ ID NO: 188073 - RNA, 63 nt, Human
acugaauguauccaucaggacaugcgucuucaggugccugaucuuuguagucaggcuguggga

SEQ ID NO: 188074 - RNA, 63 nt, Human
ccgcuugagccagaugacucaaucagaugaaaugugccugaggccaacgauguacacuugcuc

SEQ ID NO: 188075 - RNA, 63 nt, Human
ccugucagcugccuccagaagggaagguagccagugccugagaagacagucccuuuucuaccc

SEQ ID NO: 188076 - RNA, 64 nt, Human
uucgcccccacgugcucgacaggggaacccgcccggacggcaucgccaggcacuggcuggggug

SEQ ID NO: 188077 - RNA, 64 nt, Human
accaucuggacacagcagagccagggcggcccagggacggcaggagagcucgcggcaccuuccu

SEQ ID NO: 188078 - RNA, 64 nt, Human
cuccccugcgaccaugccaggcacgcugggaggaggacggcagcugcucguguccugccccugc

SEQ ID NO: 188079 - RNA, 64 nt, Human
cagcagaacuccuaaaaaguuacagccauaugcaggacggcaguacucagcauggucuuaugca

SEQ ID NO: 188080 - RNA, 63 nt, Human
cagcggaucgcuccgggccaccaagccgcaccugugccugagacuccggauggacgacacagu

SEQ ID NO: 188081 - RNA, 63 nt, Human
agaacaggccaaacuggacugucuguucauagcgugccugaauaagaaggccucuuagggagc

SEQ ID NO: 188082 - RNA, 63 nt, Human
agggauaaaguagaagaaaccacaaauuaucuugugccugaaauccauuaagaggccugauag

SEQ ID NO: 188083 - RNA, 63 nt, Human
agggugcguggggaagaugcuuccugccagcacgugccugaagguuucacaugaagcauggga

SEQ ID NO: 188084 - RNA, 63 nt, Human
cuuaccuggaguaaccggacaccuuagacggaggugccugaggguggggugggauuugcaggg

SEQ ID NO: 188085 - RNA, 63 nt, Human
uucguuccuggccauaccccggacugcccuccugugccugauguccccagcuggggucagucu

SEQ ID NO: 188086 - RNA, 63 nt, Human
gugaaagaggauccagcccugagcaucacccaagugccugaugccucaggugacagaaggcag

SEQ ID NO: 188087 - RNA, 63 nt, Human
auagugaugugcugguggucauuucuugcuugugugccugaugaaaaacuggguuccuguaag

SEQ ID NO: 188088 - RNA, 63 nt, Human
accagaaggcagagggaacuccagggcagggaugugccugaaagagucaacaguccccugauc

SEQ ID NO: 188089 - RNA, 63 nt, Human
gugaaguuaauaggaugucucuaauuucuagaugugccugagcuucuguucuuuuccucuuuc

SEQ ID NO: 188090 - RNA, 63 nt, Human
uuauccccaggaaucaauaauuuuuuugccuaggugccugacuccuuucagauucccucuuua

SEQ ID NO: 188091 - RNA, 63 nt, Human
ccaagccuuuucugggagcaaagccagggccuggugccugauuuucugaagccaggagcccuc

SEQ ID NO: 188092 - RNA, 63 nt, Human
uagaaccgucaugccagggucccaaaagugugggugccugacuuccucucugugcagcacucu

SEQ ID NO: 188093 - RNA, 63 nt, Human
aaaagcauaaaaauuagccaagugugguagagugugccugaagucccagauacuuggggggcu

SEQ ID NO: 188094 - RNA, 63 nt, Human
gugcuggccuggguucuagaucucugggaaccagugccugagucacagcugucagugcagcca

SEQ ID NO: 188095 - RNA, 63 nt, Human
accugugacagccucaggagguccugacaacaggugccugagguggcuggggauacaguuugc

SEQ ID NO: 188096 - RNA, 63 nt, Human
auuaauuccuguuuuucuuucugcuaucuguuggugccugacuugauggccucauuuggggaa

SEQ ID NO: 188097 - RNA, 63 nt, Human
cauguccaugacauuggagacuccccuagcagggugccugacguguggggaacccucaguaaa

SEQ ID NO: 188098 - RNA, 63 nt, Human
ccggcccuagcuccaggcguuuugaggcgucuggugccugaugguagguaugguguguuuguu

SEQ ID NO: 188099 - RNA, 63 nt, Human
agaggcacggguuuuucugggagcgaauaucaagugccugagagcaacuacaggacuaacugu

SEQ ID NO: 188100 - RNA, 63 nt, Human
cugucaagacucucagaagaaccuggaguaauugugccugaagcucagcgugaagucugaaau

SEQ ID NO: 188101 - RNA, 63 nt, Human
ggaguccgccagcaggcauggggcuacauuccagugccugacuauagggaggcacuccugauu

SEQ ID NO: 188102 - RNA, 63 nt, Human
ccaggcgcccaguguagcacggaagaugcccacgugccugagccaccaauccacccagacaau

SEQ ID NO: 188103 - RNA, 63 nt, Human
caccccaccugucuucaucgugaggcugccacagugccugacuacuuguggcccaggcaggcu

SEQ ID NO: 188104 - RNA, 63 nt, Human
uggcgcuuagagaagccuuggaaucagcugaaggugccugacuuccaggagcgugaaagcauc

SEQ ID NO: 188105 - RNA, 63 nt, Human
uuugucuuccucaggguggcagggguacagagagugccugauuggaaaaaaaaaaaaaagaga

SEQ ID NO: 188106 - RNA, 63 nt, Human
cuggaacuagaaacagagguggcugcugugcuagugccugagaugcacgaugcuggggucaaa

SEQ ID NO: 188107 - RNA, 63 nt, Human
ccagcuuccgaagcaggaaccagcacugucucugugccugacucacagcauauaggucaggaa

SEQ ID NO: 188108 - RNA, 63 nt, Human
gcugcugauaugcacggggaguugaaagggugggugccugaagauguugugcccugagucauu

SEQ ID NO: 188109 - RNA, 63 nt, Human
caagaggcugcuaauggauggcuacuuugcucagugccugagauugaaaaagucaacauagaa

SEQ ID NO: 188110 - RNA, 63 nt, Human
cucuccgugcaggcgauggggcaagacagaaaagugccugagcuggggaagccgggguguaac

SEQ ID NO: 188111 - RNA, 63 nt, Human
gcggcggcggcgcaucgagaucgcgcacgcccugugccugacggagaggcagaucaagauaug

SEQ ID NO: 188112 - RNA, 63 nt, Human
uaccaggugucccaguagagcacugacaugugugugccugagugccagccaccgugugaacuc

SEQ ID NO: 188113 - RNA, 63 nt, Human
uaacauggugaugggcucccuccccuaaccuuggugccugauccauccccagaccaggacagc

SEQ ID NO: 188114 - RNA, 63 nt, Human
cccuacugguuugaccagagccuuaguaaguacgugccugaaacugaaaccaugugcacuuua

SEQ ID NO: 188115 - RNA, 63 nt, Human
gucaccgaaaacacagguuccaaagucuaccuggugccugagagcccagggcccuuccuccgu

SEQ ID NO: 188116 - RNA, 63 nt, Human
gcaccagucaguucucccuugaaguaaaccucagugccugagacuuuucuaccaagccacaca

SEQ ID NO: 188117 - RNA, 63 nt, Human
augaauggacuuuaacaauuguuguuacaaacugugccugaaucuuauuauuuaaaucacuuc

SEQ ID NO: 188118 - RNA, 63 nt, Human
uaaggaacuaaaacuugaggcagagucuucuuugugccugaguggccuguaguccaucuccag

SEQ ID NO: 188119 - RNA, 63 nt, Human
caccaaauauuucucauugaguuucuuguuuuggugccugaccgaaccaacgacagccccaau

SEQ ID NO: 188120 - RNA, 63 nt, Human
uggcauauuuuaaucauuauuugagacuguccugugccugauuauuuuagcuaaauucaggga

SEQ ID NO: 188121 - RNA, 63 nt, Human
ugacacauccauuggguauguaugcaugugauggugccugagaccccugccuuagaaacagaa

SEQ ID NO: 188122 - RNA, 63 nt, Human
acaccacaggcccccgugccugcagcacuacuggugccugaaacaccuggccugcuaggaggc

SEQ ID NO: 188123 - RNA, 63 nt, Human
gccccaggugguuuugaggcucgcucuugcgcggugccugagaagagggugaaggagcugggg

SEQ ID NO: 188124 - RNA, 63 nt, Human
cauaagugaauuucaagcagugaggauuuuguggugccugagauggccgagggcacagggagu

SEQ ID NO: 188125 - RNA, 63 nt, Human
ccugagucacuggucacccuuaauauuuauuaagugccugagacacccgguuaccuuggccgu

SEQ ID NO: 188126 - RNA, 63 nt, Human
gacaaggggcccccgcacagcaugaaauaaaaagugccugagaagugugugcaugggacgccu

SEQ ID NO: 188127 - RNA, 63 nt, Human
cgguuaaagagaaaugggcucgucccgaggguagugccugaucaaugagggcggggccuggcg

SEQ ID NO: 188128 - RNA, 63 nt, Human
cccaaagugcugggacuacagacaugagccauugugccugaccuaguucugcuuuuuauguuc

SEQ ID NO: 188129 - RNA, 63 nt, Human
guauguuucacuaugguaauaugguggugugcagugccugagucacgugauagauuaaaguac

SEQ ID NO: 188130 - RNA, 63 nt, Human
gggugggugauugaugaguugucaaaaugauaggugccugagggcagacucgggcugucuagg

SEQ ID NO: 188131 - RNA, 63 nt, Human
uauguaaaccagggacaggacccaccuuguguagugccugacccaaagccuggcccugcacac

SEQ ID NO: 188132 - RNA, 63 nt, Human
gccaugcggcugguggugccacagagccucaccgugccugaguggcaugcccaggaggccgcu

SEQ ID NO: 188133 - RNA, 63 nt, Human
uccaugcaccugcgcacacccuucaccuaccgugugccugaggacaccuggggcugcuucuuc

SEQ ID NO: 188134 - RNA, 63 nt, Human
ggaggugggcagcucagacuccacaugcugguggugccugaggucugauggccucuaauaaac

SEQ ID NO: 188135 - RNA, 63 nt, Human
aaaugaauuaagaucgauaaagugcuuagaauugugccugacaugauaaauacauacucacug

SEQ ID NO: 188136 - RNA, 63 nt, Human
ggagaugguccucgcgaacgagcuacagcuaccgugccugacagcagugguggaggggguggu

SEQ ID NO: 188137 - RNA, 63 nt, Human
gacaugaagcucccagagauaaaacuccccaaggugccugagauggcugugcccgaugugcac

SEQ ID NO: 188138 - RNA, 63 nt, Human
cugccaaaagucucagagaugaaacuccccaaggugccugaaauggccgugcccgaugugcac

SEQ ID NO: 188139 - RNA, 63 nt, Human
gagaugaaagucccugagaugaagcuuccaaaggugccugagaugaaacuuccugagaugaaa

SEQ ID NO: 188140 - RNA, 63 nt, Human
agggaugugagcacccacucccugugcuaguuagugccugauucucuggggggggccucagua

SEQ ID NO: 188141 - RNA, 63 nt, Human
cagaacuuauuccucuugucaaacugaaaaugcgugccugaugaccaaacucucccuuucucc

SEQ ID NO: 188142 - RNA, 63 nt, Human
auuuguuuauggggcuuuuaaucgaacgcgugugugccugaacauucuugcucaaguugauga

SEQ ID NO: 188143 - RNA, 63 nt, Human
uugaagaagugguggaggauggcaugggaaagagugccugaggauccuugccuggaacaaguu

SEQ ID NO: 188144 - RNA, 63 nt, Human
gaaaagacuugcuccagucuccuccucaguucugugccugagaaccacugcugcauauauuug

SEQ ID NO: 188145 - RNA, 63 nt, Human
agagaacccauuucuccagacuuuuaccuacccgugccugagaaagcauacuugacaacugug

SEQ ID NO: 188146 - RNA, 63 nt, Human
ugcuuguccuuuuuguccccacuugccugcaccgugccugacucauccaguggggaaggugac

SEQ ID NO: 188147 - RNA, 63 nt, Human
cugcuccuagauggaucucagcggcauuaagcugugccugagcgaguuuguagugacucacug

SEQ ID NO: 188148 - RNA, 63 nt, Human
uucagaguggacuacauccugagugugaugaacgugccugacuuugacuucccucccguaagc

SEQ ID NO: 188149 - RNA, 63 nt, Human
uuuccagugccugccagccuccagaagagccaggugccugacuaguacauggggagcuacaga

SEQ ID NO: 188150 - RNA, 63 nt, Human
ggagagugugugacugcggcgagggugccaccugugccugaggaggccguguggguaggggua

SEQ ID NO: 188151 - RNA, 63 nt, Human
acugcgaaucacuuuucugcugugagggugauggugccugaugcggugucucgccuaucuccu

SEQ ID NO: 188152 - RNA, 63 nt, Human
gcgggcccgggccaccucacguuuccauaccuagugccugaguuuggggaugggaugcucugc

SEQ ID NO: 188153 - RNA, 63 nt, Human
uagacacauagaacauccaguuaaguuccguaagugccugaaaaacaaacacaaguuucaaca

SEQ ID NO: 188154 - RNA, 63 nt, Human
gaacugggccaacucaccugagucacccuaccugugccugacccuacuucuuuugcucuuagc

SEQ ID NO: 188155 - RNA, 63 nt, Human
ucagccccucaucagccuuuucagcagguuccagugccugacuugggauaggacugaguggua

SEQ ID NO: 188156 - RNA, 63 nt, Human
gauuuggcucauaauccaggccucucuccacgugugccugauugaugcuccaaauuggcuucc

SEQ ID NO: 188157 - RNA, 63 nt, Human
aaaugugagguuuguuacugguauuuuuuucacgugccugagaccagccugguaccaggaccu

SEQ ID NO: 188158 - RNA, 63 nt, Human
ccgagcucuccugggccagggucucgucaggaggugccugagagcagaaugaauaauugaggu

SEQ ID NO: 188159 - RNA, 63 nt, Human
ugauggcgcaugccuauaaucccagcuacucgagugccugaggcaggagaauugcaugaaccc

SEQ ID NO: 188160 - RNA, 63 nt, Human
cccggugugugcagggagacgguaaagcuggaggugccugagaccagggcuuccauggagcgg

SEQ ID NO: 188161 - RNA, 63 nt, Human
uuaaaugugaagaccguuuaugcauaccuucaugugccugacagucuuggcuuuugaagauuu

SEQ ID NO: 188162 - RNA, 63 nt, Human
cugggggcccgccugcuuccugccccucugggugugccugaugcgggaggcccugccccaggg

SEQ ID NO: 188163 - RNA, 63 nt, Human
ugcuaguagcaacugauguuucuuaguuuuacugugccugaucuaaugcaagcugcuucucuc

SEQ ID NO: 188164 - RNA, 63 nt, Human
acuccaguguagauggccauuccuaacuuguuugugccugaagauggacuugauucaaauggu

SEQ ID NO: 188165 - RNA, 63 nt, Human
cugugcguccaaggccaugcucucugcgggucagugccugagucucgccucccugcugguccc

SEQ ID NO: 188166 - RNA, 63 nt, Human
ccacgccccuccggccucagcucccuccccaaagugccugagcgccgccucugugcccagguc

SEQ ID NO: 188167 - RNA, 63 nt, Human
aaaggaaacagagccagagcagccacagaagcugugccugaagggugaguguggagcuugccc

SEQ ID NO: 188168 - RNA, 63 nt, Human
acuugcuguauaaguuuuccuuuuguccugggggugccugauugauccuaucucuucacccuu

SEQ ID NO: 188169 - RNA, 63 nt, Human
ugcccacggagcaccucacagaagauugagaaagugccugaugcccgcgucagagaccagagg

SEQ ID NO: 188170 - RNA, 63 nt, Human
ugugggggaggcucaggugucuggaggggguuugugccugauaacguaauaacaccaguggag

SEQ ID NO: 188171 - RNA, 63 nt, Human
gcagggauuccacucagaaccucucuggaauuugugccugaugugccuuccacuggauuuugg

SEQ ID NO: 188172 - RNA, 63 nt, Human
ccucaauucccccuggccaccaccccccacucugugccugaccuugaggagucuugugugcau

SEQ ID NO: 188173 - RNA, 63 nt, Human
gaacuuauugcauaaaacuuuucuagucagcaagugccugauaugccaauagcauacaaacuc

SEQ ID NO: 188174 - RNA, 63 nt, Human
gacuugcuuuucagaacauagggaugaaguaaggugccugaaaaguuugggggaaaaguuucu

SEQ ID NO: 188175 - RNA, 63 nt, Human
aaaccuguagcuucaaucaugucugguaaccgggugccugagccccaaucuggguugugagga

SEQ ID NO: 188176 - RNA, 63 nt, Human
ggcaaaaggcucagauaugauucucuaucucuugugccugaggccuggagccuaaggagcugu

SEQ ID NO: 188177 - RNA, 63 nt, Human
uaguggcuucugagcaaaggccaagaaauuauugugccugaaauuucccgagagaauuaagac

SEQ ID NO: 188178 - RNA, 63 nt, Human
cuauuaucuggugacuuuggguaaugugaaucagugccugaggaccuuugcuguguccuuggu

SEQ ID NO: 188179 - RNA, 63 nt, Human
guaaauaaauaacacaucagugucuucuagaaggugccugaccagguucaccuuuuaaacgac

SEQ ID NO: 188180 - RNA, 63 nt, Human
gacucugacagacucgugugcggguggaugggggugccugagugcugugaccaagggacugaa

SEQ ID NO: 188181 - RNA, 64 nt, Human; identical to SEQ ID NO: 138827

SEQ ID NO: 188182 - RNA, 64 nt, Human; identical to SEQ ID NO: 138828

SEQ ID NO: 188183 - RNA, 64 nt, Human; identical to SEQ ID NO: 138829

SEQ ID NO: 188184 - RNA, 64 nt, Human; identical to SEQ ID NO: 138830

SEQ ID NO: 188185 - RNA, 64 nt, Human; identical to SEQ ID NO: 138831

SEQ ID NO: 188186 - RNA, 64 nt, Human; identical to SEQ ID NO: 138832

SEQ ID NO: 188187 - RNA, 64 nt, Human; identical to SEQ ID NO: 138833

SEQ ID NO: 188188 - RNA, 64 nt, Human; identical to SEQ ID NO: 138834

SEQ ID NO: 188189 - RNA, 64 nt, Human; identical to SEQ ID NO: 138835

SEQ ID NO: 188190 - RNA, 64 nt, Human; identical to SEQ ID NO: 138836

SEQ ID NO: 188191 - RNA, 64 nt, Human; identical to SEQ ID NO: 138837

SEQ ID NO: 188192 - RNA, 64 nt, Human; identical to SEQ ID NO: 138838

SEQ ID NO: 188193 - RNA, 64 nt, Human; identical to SEQ ID NO: 138839

SEQ ID NO: 188194 - RNA, 64 nt, Human; identical to SEQ ID NO: 138840

SEQ ID NO: 188195 - RNA, 64 nt, Human; identical to SEQ ID NO: 138841

SEQ ID NO: 188196 - RNA, 64 nt, Human; identical to SEQ ID NO: 138842

SEQ ID NO: 188197 - RNA, 64 nt, Human; identical to SEQ ID NO: 138843

SEQ ID NO: 188198 - RNA, 64 nt, Human; identical to SEQ ID NO: 138844

SEQ ID NO: 188199 - RNA, 64 nt, Human; identical to SEQ ID NO: 138845

SEQ ID NO: 188200 - RNA, 64 nt, Human; identical to SEQ ID NO: 138846

SEQ ID NO: 188201 - RNA, 64 nt, Human; identical to SEQ ID NO: 138847

SEQ ID NO: 188202 - RNA, 64 nt, Human; identical to SEQ ID NO: 138848

SEQ ID NO: 188203 - RNA, 64 nt, Human; identical to SEQ ID NO: 138849

SEQ ID NO: 188204 - RNA, 64 nt, Human; identical to SEQ ID NO: 138850

SEQ ID NO: 188205 - RNA, 64 nt, Human; identical to SEQ ID NO: 138851

SEQ ID NO: 188206 - RNA, 64 nt, Human; identical to SEQ ID NO: 138852

SEQ ID NO: 188207 - RNA, 64 nt, Human; identical to SEQ ID NO: 138853

SEQ ID NO: 188208 - RNA, 61 nt, Human; identical to SEQ ID NO: 138854

SEQ ID NO: 188209 - RNA, 64 nt, Human; identical to SEQ ID NO: 138855

SEQ ID NO: 188210 - RNA, 64 nt, Human; identical to SEQ ID NO: 138856

SEQ ID NO: 188211 - RNA, 64 nt, Human; identical to SEQ ID NO: 138857

SEQ ID NO: 188212 - RNA, 64 nt, Human; identical to SEQ ID NO: 138858

SEQ ID NO: 188213 - RNA, 64 nt, Human; identical to SEQ ID NO: 138859

SEQ ID NO: 188214 - RNA, 64 nt, Human; identical to SEQ ID NO: 138860

SEQ ID NO: 188215 - RNA, 64 nt, Human; identical to SEQ ID NO: 138861

SEQ ID NO: 188216 - RNA, 64 nt, Human; identical to SEQ ID NO: 138862

SEQ ID NO: 188217 - RNA, 64 nt, Human; identical to SEQ ID NO: 138863

SEQ ID NO: 188218 - RNA, 64 nt, Human; identical to SEQ ID NO: 138864

SEQ ID NO: 188219 - RNA, 64 nt, Human; identical to SEQ ID NO: 138865

SEQ ID NO: 188220 - RNA, 64 nt, Human; identical to SEQ ID NO: 138866

SEQ ID NO: 188221 - RNA, 64 nt, Human; identical to SEQ ID NO: 138867

SEQ ID NO: 188222 - RNA, 64 nt, Human; identical to SEQ ID NO: 138868

SEQ ID NO: 188223 - RNA, 64 nt, Human; identical to SEQ ID NO: 138869

SEQ ID NO: 188224 - RNA, 64 nt, Human; identical to SEQ ID NO: 138870

SEQ ID NO: 188225 - RNA, 64 nt, Human; identical to SEQ ID NO: 138871

SEQ ID NO: 188226 - RNA, 64 nt, Human; identical to SEQ ID NO: 138872

SEQ ID NO: 188227 - RNA, 64 nt, Human; identical to SEQ ID NO: 138873

SEQ ID NO: 188228 - RNA, 64 nt, Human; identical to SEQ ID NO: 138874

SEQ ID NO: 188229 - RNA, 64 nt, Human; identical to SEQ ID NO: 138875

SEQ ID NO: 188230 - RNA, 64 nt, Human; identical to SEQ ID NO: 138876

SEQ ID NO: 188231 - RNA, 64 nt, Human; identical to SEQ ID NO: 138877

SEQ ID NO: 188232 - RNA, 64 nt, Human; identical to SEQ ID NO: 138878

SEQ ID NO: 188233 - RNA, 64 nt, Human; identical to SEQ ID NO: 138879

SEQ ID NO: 188234 - RNA, 64 nt, Human; identical to SEQ ID NO: 138880

SEQ ID NO: 188235 - RNA, 64 nt, Human; identical to SEQ ID NO: 138881

SEQ ID NO: 188236 - RNA, 64 nt, Human; identical to SEQ ID NO: 138882

SEQ ID NO: 188237 - RNA, 64 nt, Human; identical to SEQ ID NO: 138883

SEQ ID NO: 188238 - RNA, 64 nt, Human; identical to SEQ ID NO: 138884

SEQ ID NO: 188239 - RNA, 64 nt, Human; identical to SEQ ID NO: 138885

SEQ ID NO: 188240 - RNA, 64 nt, Human; identical to SEQ ID NO: 138886

SEQ ID NO: 188241 - RNA, 64 nt, Human; identical to SEQ ID NO: 138887

SEQ ID NO: 188242 - RNA, 64 nt, Human; identical to SEQ ID NO: 138888

SEQ ID NO: 188243 - RNA, 64 nt, Human; identical to SEQ ID NO: 138889

SEQ ID NO: 188244 - RNA, 57 nt, Human; identical to SEQ ID NO: 138890

SEQ ID NO: 188245 - RNA, 64 nt, Human; identical to SEQ ID NO: 138891

SEQ ID NO: 188246 - RNA, 64 nt, Human; identical to SEQ ID NO: 138892

SEQ ID NO: 188247 - RNA, 64 nt, Human; identical to SEQ ID NO: 138893

SEQ ID NO: 188248 - RNA, 64 nt, Human; identical to SEQ ID NO: 138894

SEQ ID NO: 188249 - RNA, 57 nt, Human; identical to SEQ ID NO: 138895

SEQ ID NO: 188250 - RNA, 64 nt, Human; identical to SEQ ID NO: 138896

SEQ ID NO: 188251 - RNA, 64 nt, Human; identical to SEQ ID NO: 138897

SEQ ID NO: 188252 - RNA, 64 nt, Human; identical to SEQ ID NO: 138898

SEQ ID NO: 188253 - RNA, 64 nt, Human; identical to SEQ ID NO: 138899

SEQ ID NO: 188254 - RNA, 64 nt, Human; identical to SEQ ID NO: 138900

SEQ ID NO: 188255 - RNA, 64 nt, Human; identical to SEQ ID NO: 138901

SEQ ID NO: 188256 - RNA, 64 nt, Human; identical to SEQ ID NO: 138902

SEQ ID NO: 188257 - RNA, 64 nt, Human; identical to SEQ ID NO: 138903

SEQ ID NO: 188258 - RNA, 64 nt, Human; identical to SEQ ID NO: 138904

SEQ ID NO: 188259 - RNA, 64 nt, Human; identical to SEQ ID NO: 138905

SEQ ID NO: 188260 - RNA, 60 nt, Human; identical to SEQ ID NO: 138906

SEQ ID NO: 188261 - RNA, 64 nt, Human; identical to SEQ ID NO: 138907

SEQ ID NO: 188262 - RNA, 64 nt, Human; identical to SEQ ID NO: 138908

SEQ ID NO: 188263 - RNA, 64 nt, Human; identical to SEQ ID NO: 138909

SEQ ID NO: 188264 - RNA, 64 nt, Human; identical to SEQ ID NO: 138910

SEQ ID NO: 188265 - RNA, 64 nt, Human; identical to SEQ ID NO: 138911

SEQ ID NO: 188266 - RNA, 64 nt, Human; identical to SEQ ID NO: 138912

SEQ ID NO: 188267 - RNA, 64 nt, Human; identical to SEQ ID NO: 138913

SEQ ID NO: 188268 - RNA, 64 nt, Human; identical to SEQ ID NO: 138914

SEQ ID NO: 188269 - RNA, 64 nt, Human
cggggugccaccuacaggcccaggccugugucccaagcaguacccaggcuuugcagaccacgcg

SEQ ID NO: 188270 - RNA, 64 nt, Human
gcaguuuuauaaacccgcaaucugcuccagauucaagcaguaauauuucagcaagaggaggugg

SEQ ID NO: 188271 - RNA, 64 nt, Human
uugaauaagucugggugaccgcaccuaaaaugguaagcaguacccuccggcuuuuucuuagugc

SEQ ID NO: 188272 - RNA, 64 nt, Human
aagguauaguaguuaucuuaaaauauacacuccuaagcaguauuauuuuaaaauccuuuacccu

SEQ ID NO: 188273 - RNA, 64 nt, Human
aaugacugugcaagguaguaucuaagcaccugagaagcaguagugcuuugucgccggcucacgg

SEQ ID NO: 188274 - RNA, 64 nt, Human
aucaugacuaauaugguaaaaagauaaagcaucaaagcaguauuucucauuccugccuccucaa

SEQ ID NO: 188275 - RNA, 64 nt, Human
cuuugcuuaagaguauacuuuaaccuggcuuuuaaagcaguaguaacugccccaccaaaggucu

SEQ ID NO: 188276 - RNA, 64 nt, Human
agcaagaguuuggccgcacugggcuuccugaccuaagcaguaugacugaggaagagcagauugc

SEQ ID NO: 188277 - RNA, 64 nt, Human
guguucuuaacacugaguugugaauuuuuucuuaaagcaguacuguaguacugaauauuccuuu

SEQ ID NO: 188278 - RNA, 64 nt, Human
gcacuggccgcacuugcaggaaaagugcaacuuaaagcaguaccuucauucaugaagcuacuuu

SEQ ID NO: 188279 - RNA, 64 nt, Human
auuaucucgaccuuacauaggaggagaauacuugaagcaguaugcugcugugguuagaagcaga

SEQ ID NO: 188280 - RNA, 64 nt, Human
ccacuucucguugcugcucuguggcacauaucggaagcaguacagcgcgcggcucuacacgcuu

SEQ ID NO: 188281 - RNA, 64 nt, Human
acagacuuucugggaccuugauggaguggggaacaagcaguagagugggacugggggagaccca

SEQ ID NO: 188282 - RNA, 64 nt, Human
uuaaaagcaauauagguucauaaaaguaaauucaaagcaguagagaaaaauguaagauaggaag

SEQ ID NO: 188283 - RNA, 64 nt, Human
uggacccagucucacuccuccaccccacacacugaagcaguagcuucugggccaaaggucaggg

SEQ ID NO: 188284 - RNA, 64 nt, Human
uagccaaacuccuuggucaccugcuccaagaaggaagcaguagcugagcaccugcccucacauu

SEQ ID NO: 188285 - RNA, 64 nt, Human
ucgauuaaaaucacucucagugcuucuuacuauuaagcaguaaaaacuguucucuauuagacuu

SEQ ID NO: 188286 - RNA, 64 nt, Human
ucuacucuuuuuugauuagcuacauuaccuugugaagcaguacacauuguccuuuuuuuaagac

SEQ ID NO: 188287 - RNA, 64 nt, Human
caggguaugguaggauuggggaaaggggagagagaagcaguagauacacuccuuauccucccca

SEQ ID NO: 188288 - RNA, 64 nt, Human
aggaaugcagacccuccagauguauccuugggaaaagcaguaaaccaacuaauauuuauugaag

SEQ ID NO: 188289 - RNA, 64 nt, Human
ucugccuggcuuccuccauccccagaggcacuaaaagcaguauuuuaagguuggugucuuacuc

SEQ ID NO: 188290 - RNA, 64 nt, Human
ggcgcagaccugaucuuuauaggguugacauagaaagcaguaguugugggugaaagggcagguu

SEQ ID NO: 188291 - RNA, 64 nt, Human
uuguggaggugagaaaaggggcauugagacuauaaagcaguagacaauccccacauaccaucug

SEQ ID NO: 188292 - RNA, 64 nt, Human
agcaagaauuugggaaacacagauggccugagauaagcaguacaaguagguuuuugagacaauc

SEQ ID NO: 188293 - RNA, 64 nt, Human
uauacaugaugcugauuucuuaaaaccuacauauaagcaguaguacuuuuucucuauuauaaag

SEQ ID NO: 188294 - RNA, 64 nt, Human
aaaguguauuaagaauguuccuuaaagguuuaagaagcaguaagcagcaucugaagccacaauc

SEQ ID NO: 188295 - RNA, 64 nt, Human
gucaaccccauuuuauuuguccuuauuccuguggaagcaguauauguuuucuuccugaaugcuc

SEQ ID NO: 188296 - RNA, 64 nt, Human
caugaaaguaauuuggaaguaaguuuauccaauaaagcaguauuucuacccuuuuagauuugau

SEQ ID NO: 188297 - RNA, 64 nt, Human
caaaaaucacugaauuccuaagaguuccuuaaauaagcaguacuaguuacaaaucacaguauaa

SEQ ID NO: 188298 - RNA, 64 nt, Human
gauccuccaacagcugucacaacuuguguugagcaagcaguagcauuugcuuccucccaacaag

SEQ ID NO: 188299 - RNA, 64 nt, Human
aaggacuauuuugagaagaguagcugugguuguaaagcaguacccuacccugauuguagggucu

SEQ ID NO: 188300 - RNA, 64 nt, Human
caaauagugugaaauauauuacuuaacuguccguaagcaguauauuaguauuaucuuguucagg

SEQ ID NO: 188301 - RNA, 64 nt, Human
auacacccaaacacuuacaccaaacuacugaaugaagcaguauuuugguaaccaggccauuuuu

SEQ ID NO: 188302 - RNA, 64 nt, Human
augaauuuuacaacaaacuagugcaugauucaccaagcaguacuacagaacaaaggcaaauuaa

SEQ ID NO: 188303 - RNA, 64 nt, Human
ccuccuccuccucuuccucuacugagacuucagaaagcaguagugagagugagaguaacaauaa

SEQ ID NO: 188304 - RNA, 64 nt, Human
ucuauuagccacaaaauugggaaaggaguagaaaaagcaguaacugacaacuugaauaauacac

SEQ ID NO: 188305 - RNA, 64 nt, Human
agaaaaaauuaaaaccacccauaacuuuacucugaagcaguaacaguggcauguuuccuccuag

SEQ ID NO: 188306 - RNA, 64 nt, Human
uuacuuaggauuccuugacuuuucagaagucgggaagcaguauguuugccuguuguagaccuac

SEQ ID NO: 188307 - RNA, 64 nt, Human
ccugaugaaaacgguucagaaagaucugucaaucaagcaguagugugaaaaaagcacuauaaga

SEQ ID NO: 188308 - RNA, 64 nt, Human
ugcauacaugaauauauccacccaccuagauuuuaagcaguaaauaaaacauuucgcaaaagau

SEQ ID NO: 188309 - RNA, 64 nt, Human
gauuagaacugaucuuccauuuaacuauuacagaaagcaguaacuauugcaacuaucuaauagu

SEQ ID NO: 188310 - RNA, 64 nt, Human
accugguacugcacauuuuguacaaagauaugcuaagcaguagucgucaaguugcagaucuuuu

SEQ ID NO: 188311 - RNA, 64 nt, Human
guuauuaaaaauauaucucacugcaaaaaaaaaaaagcaguaucuucacucaaaagucuugcuu

SEQ ID NO: 188312 - RNA, 64 nt, Human
uucucuuaacaccugaaacuuguuuuaaaacaaaaagcaguauucacuucaaaucauaaacuua

SEQ ID NO: 188313 - RNA, 64 nt, Human
aucugcugugcacagagcuuccauggucacugcuaagcaguagccagccaucgggcauuaauug

SEQ ID NO: 188314 - RNA, 64 nt, Human
uuuuuaaauaaaguugccuuaaauaaguguauguaagcaguaguaguugcuauguacugauuua

SEQ ID NO: 188315 - RNA, 64 nt, Human
uaacuuuuaugauaguuauuccaaauucaagaagaagcaguauuaacaucaauugaucgacaca

SEQ ID NO: 188316 - RNA, 64 nt, Human
auagccccacucagcugcuucggaaagcgugacgaagcaguaguccucaguguguguguaagug

SEQ ID NO: 188317 - RNA, 64 nt, Human
guucuuccuggcuuugcaccugguggcuauuacaaagcaguacugcaguaugucuuggaccugg

SEQ ID NO: 188318 - RNA, 64 nt, Human
ggauugaaaauuuuauauuguaauguagagauaaaagcaguaggagaaacaaaugacauaauau

SEQ ID NO: 188319 - RNA, 64 nt, Human
uuuuuuaaucugucuuucaaguuuacagaaaagaaagcaguaaaugcauugaugucauuuuauu

SEQ ID NO: 188320 - RNA, 64 nt, Human
uuuuaaucuggcacaacacuaauuaccauuuuuaaagcaguauuaaguuguaauuuaaaccuug

SEQ ID NO: 188321 - RNA, 64 nt, Human
aauguaauggcagaucagcuuugagagugguccuaagcaguaaacuggaugauguugcauuaga

SEQ ID NO: 188322 - RNA, 64 nt, Human
gauccucaaguauuuucuaaagaaguucagacagaagcaguagacaaugaaccaccugauuaca

SEQ ID NO: 188323 - RNA, 64 nt, Human
aaaauaguuuguuuuaaaagagguuuguuuaagaaagcaguagguacauuauguuuacuagaca

SEQ ID NO: 188324 - RNA, 64 nt, Human
cuaggugggguucucuuuguugccuaccaggagaaagcaguaggcuuccuuucuaagauacgga

SEQ ID NO: 188325 - RNA, 64 nt, Human
uuaaaaugagaucguuguuuacaguguauguacuaagcaguaagcuaucuucaaaugucuaagg

SEQ ID NO: 188326 - RNA, 64 nt, Human
ucugacauguaagacgaaugauuuagguacgucaaagcaguagucaaggaggaaagggauaguc

SEQ ID NO: 188327 - RNA, 64 nt, Human
aacuuucuuugacugcucuaccugaauuuagacuaagcaguaaauaguuuaauaaaagaucacu

SEQ ID NO: 188328 - RNA, 64 nt, Human
gcugugcgcuuccacguuacuuuggccuguauuaaagcaguagagcagcaucaguuauuauagu

SEQ ID NO: 188329 - RNA, 64 nt, Human
aaauauuuggggucaccuagccauugaaagcagaaagcaguagugacacagcuuucccuucaaa

SEQ ID NO: 188330 - RNA, 64 nt, Human
gcuugcagcauuuaugaguuuuccaaaauauagaaagcaguaggucaguaggagcaaacuagcc

SEQ ID NO: 188331 - RNA, 64 nt, Human
aauauaggguuuuguuugguugguugguuugauaaagcaguauuuggggucauauuguuuccug

SEQ ID NO: 188332 - RNA, 51 nt, Human
uagggauuguagauggcuaacaagcaguauuaaaauuucaggagccaaguc

SEQ ID NO: 188333 - RNA, 64 nt, Human
guaugcucaucccugcacugagcacagauaugacaagcaguagccaugggggaggugggugaca

SEQ ID NO: 188334 - RNA, 64 nt, Human
uaccuagaaguuuguuuugcuuuuaauuuaaaggaagcaguaaccacaaagcuuccgcucaggg

SEQ ID NO: 188335 - RNA, 64 nt, Human
uauuccauuugcaacuuauccccaacagguggugaagcaguauuuuccaauuugaagauucauu

SEQ ID NO: 188336 - RNA, 64 nt, Human
gagcgaggcugauucaauuggugauuuggguagaaagcaguauguuuugcugacauuaagaugu

SEQ ID NO: 188337 - RNA, 64 nt, Human
auuaaauacaccugcuuuggguaaaacucuuugcaagcaguaauuaacacuaguaacagugaaa

SEQ ID NO: 188338 - RNA, 64 nt, Human
gauaggauaaaagugagugugagaucacccagggaagcaguaaaauaucaauuuucauuuuaag

SEQ ID NO: 188339 - RNA, 64 nt, Human
gaagaaaaauaugaaaauaauuaagacuagaaucaagcaguagauaauugaauccaaucuuggg

SEQ ID NO: 188340 - RNA, 64 nt, Human
agcaaagcaaaaacuguauagagagauuuuucaaaagcaguaaucccucaauuuuaaaaaagga

SEQ ID NO: 188341 - RNA, 64 nt, Human
auagaacauuuuccagaaguucuucuguuguagaaagcaguacaguaucuuaagugucaaccag

SEQ ID NO: 188342 - RNA, 64 nt, Human
uaacuaauuuccuuucuguaucccaugguggucaaagcaguaaaggaguuuagagauacuuagc

SEQ ID NO: 188343 - RNA, 64 nt, Human
guguauuuuugggaaagaaaauuuaaaugaacuaaagcaguauugaguugcugcucuucuuaaa

SEQ ID NO: 188344 - RNA, 64 nt, Human
cagcuccugagccagguggacaugccagagagaaaagcaguagagguccuccaugccagcccca

SEQ ID NO: 188345 - RNA, 64 nt, Human
uccuuuuuuaagaagaaguaauuuuccauuuaugaagcaguaugaauuagauguauuuucaaaa

SEQ ID NO: 188346 - RNA, 64 nt, Human
gagagucuuggagaacaggcuguuuccagucucaaagcaguaaccuuauacacuacuuauaagu

SEQ ID NO: 188347 - RNA, 64 nt, Human
cuauaaauguugucuuuuuuauauuuuuaugaaaaagcaguagaaaauuacuuuugaagaaaac

SEQ ID NO: 188348 - RNA, 64 nt, Human
aauggcuucuucaaggcuaauaucaauaguuuauaagcaguauauuucaccuacacuaaauaug

SEQ ID NO: 188349 - RNA, 64 nt, Human
ccagcuuuucucaaguuaguuauaggauguacuuaagcaguaagcguauuuagguaaaagcagu

SEQ ID NO: 188350 - RNA, 64 nt, Human
uguucuugagauuuuguauauuuaggaaaaccucaagcaguaauuaauaucuccuggaacacua

SEQ ID NO: 188351 - RNA, 64 nt, Human
uucuggcuuuuuaucuucuuagcucaucuuaaauaagcaguacacuuggaugcagugcgucuga

SEQ ID NO: 188352 - RNA, 64 nt, Human
gaagugaggaagccagguccacggucuguucuugaagcaguagccuaacacacuccaagauaug

SEQ ID NO: 188353 - RNA, 64 nt, Human
ccagugaugggcuaccugagcucaucuagucgccaagcaguaucuccugcuugcugcugcuuua

SEQ ID NO: 188354 - RNA, 64 nt, Human
guguguagugcccagguguggugguggcauccugaagcaguaggaccauuagugugcgugcaca

SEQ ID NO: 188355 - RNA, 64 nt, Human
cuuugaugauauauguuguauauuuuuaguuguaaagcaguaaucuuuaacuguagcauuccuc

SEQ ID NO: 188356 - RNA, 64 nt, Human
cuguauguaauauuuacauaaagacugugcugagaagcaguauaagccuuuuuaaccuuccaag

SEQ ID NO: 188357 - RNA, 64 nt, Human
auuaugguuaauuucauuucuugcuuugccaccuaagcaguaaaacaugauauugaccacuugg

SEQ ID NO: 188358 - RNA, 64 nt, Human
accaccucgcuuucaugucccguguguuuuggaaaagcaguauggugugucaugucuagcggcg

SEQ ID NO: 188359 - RNA, 64 nt, Human
ggcuuuauuuauuuauuuuuaccacaauaguuugaagcaguaagggggaaggagggugauuaua

SEQ ID NO: 188360 - RNA, 64 nt, Human
uaaaacauaaccacagauaaaugagaaucaugauaagcaguagacaaggcuuuuuucuuuuucu

SEQ ID NO: 188361 - RNA, 64 nt, Human
uaucagaauuuauauuguuuauuauaucuuuuaaaagcaguaagcaguuuucaucugacagcgu

SEQ ID NO: 188362 - RNA, 64 nt, Human
uaggugugcugguuggaugugcaggaacuucagcaagcaguagguuuuacuaagcagauggucg

SEQ ID NO: 188363 - RNA, 64 nt, Human
auauagauuauuguaaccuuucaaccugaaaaucaagcaguaugagaguuuaguuauuuguaug

SEQ ID NO: 188364 - RNA, 64 nt, Human
auaauuguggauauuuggcuguuuuuaaucugacaagcaguaacuucauaugguuugccuuaau

SEQ ID NO: 188365 - RNA, 64 nt, Human
uucuuaaugccugaaauuuucuccauuggcccgaaagcaguaaaaauuguucauuaaucuuccg

SEQ ID NO: 188366 - RNA, 64 nt, Human
uucugacucaauacaucugggauuucuacuuucaaagcaguacaugugauuuuaugcccuuaaa

SEQ ID NO: 188367 - RNA, 64 nt, Human
agggacggaacuccuauucagcaguuuuuguggaaagcaguaaugcuugcaaaacguguguguc

SEQ ID NO: 188368 - RNA, 64 nt, Human
ugaagucuuaaaugugaaaccaagaaauguaaucaagcaguaaaaacaucugaauguagaccau

SEQ ID NO: 188369 - RNA, 64 nt, Human
uuugaguuaagaguguugauguaggcuuuauuuuaagcaguaauggguuacuucugaaacauca

SEQ ID NO: 188370 - RNA, 64 nt, Human
ggcagaaaacucuuuuuuggagauaucuuccaucaagcaguacucgugcccauauacaaucucu

SEQ ID NO: 188371 - RNA, 64 nt, Human
aauucuugaaaaguuaacguagaaaauauccaaaaagcaguauuucuagaaaguguccaaaaag

SEQ ID NO: 188372 - RNA, 64 nt, Human
auccaaaaagcaguauuucuagaaaguguccaaaaagcaguauuucuuucccuugguugugaga

SEQ ID NO: 188373 - RNA, 64 nt, Human
gucccucaacuguacuuggagaaaucguguuuuaaagcaguaguccacaaaguauucugcucau

SEQ ID NO: 188374 - RNA, 64 nt, Human
cuuuugccucagccucgcggauagcuaggaccacaagcaguagagacaagaucuccguauguua

SEQ ID NO: 188375 - RNA, 64 nt, Human
agcaauacuuuaaguuaaaaaaaaucucauaauuaagcaguagagcaucuaugauuaggaaaug

SEQ ID NO: 188376 - RNA, 64 nt, Human
aaccccauguccucagcauuucuuuucuggccaaaagcaguaaauuugcuagcaguaaaagaug

SEQ ID NO: 188377 - RNA, 64 nt, Human
augucauuggcaagaggaagaacugguguuuugaaagcaguauggauucuuuaaaugccucuca

SEQ ID NO: 188378 - RNA, 64 nt, Human
aaggccguugggcuucaggaucaauuuuguuggcaagcaguaaaaauaagcuaucuaccuaugg

SEQ ID NO: 188379 - RNA, 64 nt, Human
aaaaaccgccuuguaaguucuggggagcauuccaaagcaguauauugguuccaauuagaguuua

SEQ ID NO: 188380 - RNA, 64 nt, Human
ggcacaauuucauucaguacaagagaaguacuguaagcaguaccuagaaauaaucucuaaaauu

SEQ ID NO: 188381 - RNA, 64 nt, Human
cuaaaguuuagaugcauuguauaaaaaaaccuaaaagcaguaucuguuauuuagcuguaaacca

SEQ ID NO: 188382 - RNA, 64 nt, Human
ucauaagaaauaauuuaaaagguuuuguugcugaaagcaguaaguggugcaguaaaauacuuaa

SEQ ID NO: 188383 - RNA, 64 nt, Human
aagccugaugacuugccccaagggccacccgaggaagcaguauuaucugcgguggggggaggag

SEQ ID NO: 188384 - RNA, 64 nt, Human
uaagccuuguguggcagauagaucuuaaagggcaaagcaguauauugguaguugucaauauagc

SEQ ID NO: 188385 - RNA, 64 nt, Human
caaggaggcagggaagaaagggggccugcaaaggaagcaguagagugacuuaaacaucuugcga

SEQ ID NO: 188386 - RNA, 64 nt, Human
uuauuuguuuuauuauagcaauuaugccuaauuaaagcaguauuuaaugcaauuuccaguuauu

SEQ ID NO: 188387 - RNA, 64 nt, Human
aaggcuauacaauugaaugaggaagcacuaacaaaagcaguaguucaguacaguggacagcuua

SEQ ID NO: 188388 - RNA, 64 nt, Human
gcaauacuuuauaaagaaugaacaaaauuacuggaagcaguauuguaaguaaugagguaguauu

SEQ ID NO: 188389 - RNA, 64 nt, Human
cuguacauaaauuccagaggacucugcuuaaacaaagcaguauauaauaacuuuauugcauaua

SEQ ID NO: 188390 - RNA, 64 nt, Human
cuuuuccgauagaaauuucuuaccucauuuuuuuaagcaguaaggcuugaagugaugaaaccca

SEQ ID NO: 188391 - RNA, 64 nt, Human
gucugucaaaaucagaacuccugaacaacuuugaaagcaguaauauuaacugguauucaaaaau

SEQ ID NO: 188392 - RNA, 64 nt, Human
ccguuagaugugacagaaugagauaauuuauguaaagcaguagaguaccuggcacaaagcaaac

SEQ ID NO: 188393 - RNA, 64 nt, Human
agacgccauagcuguuuuucccuuuguaauaucaaagcaguaauaucuucucuggaggccuguu

SEQ ID NO: 188394 - RNA, 64 nt, Human
uagaauuugaaaggguuuacauauuauuauacuaaagcaguacuggacuggccauuggaccauu

SEQ ID NO: 188395 - RNA, 64 nt, Human
ucuuuuguauguguguguguuuuuuucacuauuaaagcaguacuggggaauuuuguacaauaaa

SEQ ID NO: 188396 - RNA, 64 nt, Human
caugugcaguaaauauaaauaaguguagcaucagaagcaguaggaauggccguauacaaccauc

SEQ ID NO: 188397 - RNA, 64 nt, Human
agguuguaaaauagacuccauggagacucuuaggaagcaguagauucccgggggcugugccuuu

SEQ ID NO: 188398 - RNA, 64 nt, Human
uccaagaaaaguauuuugggcggacagucagaucaagcaguaaaauuagcucuuucaaaucuuc

SEQ ID NO: 188399 - RNA, 64 nt, Human
gagcacuuuuccuuucccuggagaaugggaugugaagcaguagaccgcagccacgccgaugguu

SEQ ID NO: 188400 - RNA, 64 nt, Human
agugcuaccaaaggggauacacaagcccuuuaggaagcaguaccucucgccuggaggaucugug

SEQ ID NO: 188401 - RNA, 64 nt, Human
aucucuuuagauuuuguuggcaaaagccuuauagaagcaguaagaggcuugaccacgccggaag

SEQ ID NO: 188402 - RNA, 64 nt, Human
cugaguggccuugaggacgaaccccgcagggagcaagcaguacaguggcauucccagggggacc

SEQ ID NO: 188403 - RNA, 64 nt, Human
gguagcauguaacaguguuugacaaagaguaaguaagcaguauucuugggagucaguguuaugu

SEQ ID NO: 188404 - RNA, 64 nt, Human
uugcuauuuguuugaacuauuauugaugcuagccaagcaguauacuugaugugaagaugucaug

SEQ ID NO: 188405 - RNA, 64 nt, Human
cagcuacagagccucuggaacacuauggucuuacaagcaguacuaaaaucaacccucagccucu

SEQ ID NO: 188406 - RNA, 64 nt, Human
cuaaugcaagauauuuuuucuuuuuuauagugugaagcaguauucuggaaaguuuuucuaagac

SEQ ID NO: 188407 - RNA, 64 nt, Human
ggaaaguguuucuuggguuuggaauguucagaggaagcaguauuguacagaacacgguauuguu

SEQ ID NO: 188408 - RNA, 64 nt, Human
caaaagaugugaaagcacuaaaaauaccauuuuuaagcaguacuuuaccuguuuuuucuuuagc

SEQ ID NO: 188409 - RNA, 64 nt, Human
cuauuccucacucaagauuaagacauuuuuugaaaagcaguagaguuugcuuaaaauacaaauu

SEQ ID NO: 188410 - RNA, 64 nt, Human
gccccucauuugaccuuucaccucugucuguuggaagcaguacuuuuuacugccucauugucuu

SEQ ID NO: 188411 - RNA, 55 nt, Human
aaucuucacagaacucaugagagacaagcaguaagaaacuucuuuuggagaaaca

SEQ ID NO: 188412 - RNA, 64 nt, Human
ccucaauaggcauauguaucuauuaaauaaaccaaagcaguaauuaauaaccuuccaaggccag

SEQ ID NO: 188413 - RNA, 64 nt, Human
aauaagcugaguccauauacuugucuaacuaagaaagcaguacagaggaaaacaggaaccugau

SEQ ID NO: 188414 - RNA, 64 nt, Human
gugcuuuuuggauauggcagcacuuguaaaaauaaagcaguaagcaaaauccuuuuaaacacag

SEQ ID NO: 188415 - RNA, 64 nt, Human
aacagcagcacuuaggcucaaaaucgccccuacaaagcaguaguuguuucuuaauugcuaagua

SEQ ID NO: 188416 - RNA, 64 nt, Human
accaaccuugggagcugugugccaguuccaguguaagcaguaauaccauguuguaagagggaac

SEQ ID NO: 188417 - RNA, 64 nt, Human
uaugaauucagagugugacuuaagggucaauucaaagcaguauuuugacuuuucauuuguaaaa

SEQ ID NO: 188418 - RNA, 64 nt, Human
aauaauuuucuaagacccgugugaaugugaagaaaagcaguauguuacugguuguuguuguugu

SEQ ID NO: 188419 - RNA, 64 nt, Human
uucuagaagaauguacaccaaaauaaaacaugugaagcaguauugauucuuuauugggaguaca

SEQ ID NO: 188420 - RNA, 64 nt, Human
auuuuuuguguauguauucuaauuagugugaauaaagcaguaacauuaaugcauuuuuuaagca

SEQ ID NO: 188421 - RNA, 64 nt, Human
aaaaaaagacacauucaaucuugcauccuaauacaagcaguacggaagaugcguauggucucag

SEQ ID NO: 188422 - RNA, 64 nt, Human
agggccaugcugguguacuguguugugaugauggaagcaguaaaucaaaauuauggaaauuugc

SEQ ID NO: 188423 - RNA, 64 nt, Human
acugucacucucccuaaugaaauguacuucagagaagcaguauuuuguuaaauaaauacauaac

SEQ ID NO: 188424 - RNA, 64 nt, Human
gaaugguuuuuacauaaauuaugcaaagguuaacaagcaguaacacugcacuccucaaaaagug

SEQ ID NO: 188425 - RNA, 64 nt, Human
ucucaguaggcauauauaucuauuaaauaaauugaagcaguaauuaauaaccuuccaagaccag

SEQ ID NO: 188426 - RNA, 64 nt, Human
cccuuucccuccuuugggcucccuggagguuuuuaagcaguacgugccuccaaguuaccuccag

SEQ ID NO: 188427 - RNA, 64 nt, Human
uuacauaauuaaacuauuucugcuauuauuuuuaaagcaguauuauuuuauaaccaauucuaaa

SEQ ID NO: 188428 - RNA, 64 nt, Human
gaaugggaaaugucgcuggucugugugguauucaaagcaguaguaucaugaugagcguaacgac

SEQ ID NO: 188429 - RNA, 59 nt, Human
aaaaacuuguaaaccugugaauggaccccaagcaguacacuugcuggucuagguauuaa

SEQ ID NO: 188430 - RNA, 64 nt, Human
gugcauguuguccuuuuuaucugaucugugauuaaagcaguaauauuuuaagauggacugggaa

SEQ ID NO: 188431 - RNA, 64 nt, Human
ccauccauggucaagaccucuccuagcuccacacaagcaguagagucucagcuccacagcuuua

SEQ ID NO: 188432 - RNA, 64 nt, Human
cucagcaauucaaauucuaguuguuauuugguggaagcaguagcccaaccccaguuuaggggaa

SEQ ID NO: 188433 - RNA, 64 nt, Human
gugccuuaacauuuucugcuuguccuuugggacaaagcaguauuuuacucauucuuugaauguu

SEQ ID NO: 188434 - RNA, 64 nt, Human
cguggauaaagaagaagauaagaaagagcgucaaaagcaguaccugagacauagacgacuuuuc

SEQ ID NO: 188435 - RNA, 64 nt, Human
cccuguggcguuaacagacagcaagcagcugaacaagcaguaccgucaguacccacuugcuuua

SEQ ID NO: 188436 - RNA, 64 nt, Human
cugauuuuuuauucaacaaaccuuaaacacccagaagcaguaauaaucaucgagguauguuuau

SEQ ID NO: 188437 - RNA, 64 nt, Human
uggagggagcagggggugggacaguguaucaaauaagcaguauuuaaucaccucuggcgggggc

SEQ ID NO: 188438 - RNA, 64 nt, Human
ccccaguucugagccuccccacauuacacuuaacaagcaguaaaggagugagcacuuugggucc

SEQ ID NO: 188439 - RNA, 64 nt, Human
augguccccagacccuguaccugccuguaacucuaagcaguaucccuguguuccagcguggagg

SEQ ID NO: 188440 - RNA, 64 nt, Human
uuaaugcugacugugggucuuaaaagguucuggaaagcaguaaguucauuuuucuaaaaacuau

SEQ ID NO: 188441 - RNA, 64 nt, Human
cuuuuuguuuuuucuuuccuguaaagaccuugaaaagcaguaacuuggguccaguauuuacgga

SEQ ID NO: 188442 - RNA, 64 nt, Human
uuuuuaaauuaugucaaaacuuacauuacuugccaagcaguaugauguuauaggaaacauaaau

SEQ ID NO: 188443 - RNA, 64 nt, Human
uuucuaaaaagcuuuaacuguagugccuccuaauaagcaguauguuuguuucauugugagauug

SEQ ID NO: 188444 - RNA, 64 nt, Human
uaguggauucugugagacauaccugcuggaguugaagcaguaaauagcauguccuuccccuccc

SEQ ID NO: 188445 - RNA, 64 nt, Human
ggcuacuugguaacuggaagaagcuggaggacagaagcaguacucaacuugcuguuauuccagu

SEQ ID NO: 188446 - RNA, 64 nt, Human
uuuacauuuguuuuaauugugugccuacaguuaaaagcaguauuuuuaauguauuuuauaagaa

SEQ ID NO: 188447 - RNA, 64 nt, Human
cuuaaguucuucaugcuacucuuaaccucccaaaaagcaguaucuaagucacauacaugauguc

SEQ ID NO: 188448 - RNA, 64 nt, Human
caaccuacccucucucugccucagccuuacacccaagcaguaggucugugcucucccugucucu

SEQ ID NO: 188449 - RNA, 64 nt, Human
aaagaaacugagccuuaaagagaugaaauaaauuaagcaguagauccaggaugcaaaauccucc

SEQ ID NO: 188450 - RNA, 64 nt, Human
aaaguagucuuguuuuaugaggaugucugcauuaaagcaguaaaauaagcuuuccauuuuauuc

SEQ ID NO: 188451 - RNA, 64 nt, Human
aaauuuuuagaaaucugauggucaaaauagcugaaagcaguaaacaagagauuggcuauuaaau

SEQ ID NO: 188452 - RNA, 64 nt, Human
ugacagagaauaacucagaauauugucugccuuaaagcaguaccccccuaccacacacaccccu

SEQ ID NO: 188453 - RNA, 64 nt, Human
gauggcccuuagggaaagacuggaccucugugccaagcaguaucccuguucagcccaccuuaaa

SEQ ID NO: 188454 - RNA, 64 nt, Human
auaaucugaauaucuugaucauuuguauuuaaagaagcaguaauuauauacuugaaaguacaua

SEQ ID NO: 188455 - RNA, 64 nt, Human
gacuaguaauggcuaccacgggaaagggaaggggaagcaguagcacuaaugcuauguaguuguc

SEQ ID NO: 188456 - RNA, 64 nt, Human
uuauuuuguauaaacauucaucugagaacaaucaaagcaguagccacauggugcuggcuccuuu

SEQ ID NO: 188457 - RNA, 64 nt, Human
uaauacgaauuguuucacaaacagaaaacauguaaagcaguauuaaaauuuggccaaacaagug

SEQ ID NO: 188458 - RNA, 64 nt, Human
auugauuugaaaagaauuuguuaggauagaucuuaagcaguaaucugucaguguuuguauuugu

SEQ ID NO: 188459 - RNA, 64 nt, Human
gaaagcagagcauguuauuuauauaacugcauuuaagcaguaccaagacugaaaaaaaagguaa

SEQ ID NO: 188460 - RNA, 64 nt, Human
ugacauaguaauugugauucuuuuaauaccaguuaagcaguauuuggcaacuuaaacuuccugg

SEQ ID NO: 188461 - RNA, 64 nt, Human
agaaauuuuucauucccauaucuaccuaagaaggaagcaguaaauccauaauuuaccuuuuggg

SEQ ID NO: 188462 - RNA, 64 nt, Human
uaauugggacguuuguaacacaaaugaaugcuugaagcaguagauacacccugauguaauuauu

SEQ ID NO: 188463 - RNA, 64 nt, Human
uucagauccuggugugcuuucaaguuuuguauauaagcaguagauacagauuguauuugugugu

SEQ ID NO: 188464 - RNA, 64 nt, Human
augaauucaugcccuuccuuuacucuauuagcauaagcaguaaauuuuuuuauuuuaauauagc

SEQ ID NO: 188465 - RNA, 64 nt, Human
uuucaaaaagcacagugcaucaugagcaacagaaaagcaguagaauccuaaaggacauaacagu

SEQ ID NO: 188466 - RNA, 64 nt, Human
guauauuugcuucaacaacuuugugcuuuccugaaagcaguaaccaagaguuaagauaucccua

SEQ ID NO: 188467 - RNA, 64 nt, Human
gguuuauuuaucauacaggcuuugaaacauuaagaagcaguauuuuuauuaacuuuuugagaca

SEQ ID NO: 188468 - RNA, 64 nt, Human
ucagcaucuuuuuaaaauaaucuaagcaucauugaagcaguaacacaaaaaaaagguucaguau

SEQ ID NO: 188469 - RNA, 64 nt, Human
gugucuguaauucaaucuucgcugugugugguagaagcaguagucacuuuuguaagccagucuc

SEQ ID NO: 188470 - RNA, 64 nt, Human
cuccuuucuuugaauaaaauaauuucucauaauuaagcaguagaagaucuaucuucacaaagua

SEQ ID NO: 188471 - RNA, 64 nt, Human
cuagcugugucuaccauguguauguauucuugacaagcaguauaaaauaccugugauuuuucuu

SEQ ID NO: 188472 - RNA, 64 nt, Human
uggaaaugaggacucaucugauagaauccccugaaagcaguagccaccauguucaaccaucugu

SEQ ID NO: 188473 - RNA, 64 nt, Human
ggcuuaagccuuaagugccaaaucacaagagaaaaagcaguaacaguuuacagaagcaacuuag

SEQ ID NO: 188474 - RNA, 64 nt, Human
gucacuagguuguaguuuuuuuuaaauaaaggaaaagcaguauuguccugguuuuaaaccuaug

SEQ ID NO: 188475 - RNA, 64 nt, Human
acuucuucauuugaaggauaagcugguuuguguuaagcaguauaguauugguugggucauuugc

SEQ ID NO: 188476 - RNA, 64 nt, Human
uggguccaggaacuucccaggagagccagcugggaagcaguacuggaccauccggccaugagga

SEQ ID NO: 188477 - RNA, 64 nt, Human
cucaaaaugguguugagauuuacguggaacccuaaagcaguaaaauaaaaaaccugguugcagc

SEQ ID NO: 188478 - RNA, 64 nt, Human
ucacuauuuggcuuuuguuuugcaugauuuuuaaaagcaguacuccuagggaaauggccucuga

SEQ ID NO: 188479 - RNA, 64 nt, Human
aauuuuugguuaaauaagaguaagguucaaacacaagcaguacauguucuguuucauuaugcuc

SEQ ID NO: 188480 - RNA, 64 nt, Human
aagaaucuacuuuuuagaaaucgcuuuguuuuccaagcaguaaguacuacauacaguacuugua

SEQ ID NO: 188481 - RNA, 64 nt, Human
uuuagguaucucucggugaccguuggauuccuggaagcaguagcuguucuguuuggaucuggua

SEQ ID NO: 188482 - RNA, 64 nt, Human
aacuuguuuggccuauuccauucuggauuuugucaagcaguagacaagcaauuagacaagaacu

SEQ ID NO: 188483 - RNA, 64 nt, Human
gccuuauugaaaugauacuggcauaucugacuguaagcaguagguugaagauaucauuuuauga

SEQ ID NO: 188484 - RNA, 64 nt, Human
cauuuuuggaaaaguguacuuuaucauuuuaacaaagcaguaugguugggaaugagacaauucu

SEQ ID NO: 188485 - RNA, 64 nt, Human
uuuagauuuauuuuuucaucucauuuuuaagaacaagcaguacgauuuguuuucuucaacaugu

SEQ ID NO: 188486 - RNA, 64 nt, Human
gaagaauuccuucuucaaacauuaaagauccacaaagcaguauuucuaaauaugccuugaagaa

SEQ ID NO: 188487 - RNA, 64 nt, Human
gcaucagaaaaugucaccauauuuucgcuagcucaagcaguaccccaaguaauaacugaaggag

SEQ ID NO: 188488 - RNA, 64 nt, Human
cuggcuucaguauauuuucugcuggggcuuaauaaagcaguagacagggcuuguuccaucccuc

SEQ ID NO: 188489 - RNA, 64 nt, Human
uagaaacauuggcagcauggucuuccaaaacaaaaagcaguaacaugcauguuuaauugcauac

SEQ ID NO: 188490 - RNA, 64 nt, Human
acuaaagaaaccggaugcugccaccguaggauuuaagcaguagugcuuccaugcucuuaagacu

SEQ ID NO: 188491 - RNA, 64 nt, Human
uugacuuguugcagaaauuccuaucuacuuuauuaagcaguauugaucugacuguggaaacauc

SEQ ID NO: 188492 - RNA, 64 nt, Human
ugccaaagauugauggcaaaaagauggcagacacaagcaguacggaugaagacucugagucuga

SEQ ID NO: 188493 - RNA, 64 nt, Human
ccagaggacaaaauuuuaauaaaggucuuagcuuaagcaguaauccuacuucauuaagccuucc

SEQ ID NO: 188494 - RNA, 64 nt, Human
agggcaggaggcccuccuggccaggccagcagugaagcaguauggcuggcuggaucagcaccga

SEQ ID NO: 188495 - RNA, 64 nt, Human
ugccgagaugcgggagcaguucuaccacuccugcaagcaguauggcaucacggugagcggcggc

SEQ ID NO: 188496 - RNA, 64 nt, Human
auuagagcgccaaaugguuuucuucucaaucuuaaagcaguauaccuuuccacaggcucgucug

SEQ ID NO: 188497 - RNA, 64 nt, Human
uuucauucaacuaacaaacauauuccaauaauaaaagcaguauauacauauuuccuuucuacag

SEQ ID NO: 188498 - RNA, 64 nt, Human
uaaugagacccaaaugacucucucuuaacaauucaagcaguagacaaaguugcucacaaauaca

SEQ ID NO: 188499 - RNA, 64 nt, Human
guccgcaacacuggcucccgagcagcuuuuguuaaagcaguagguuuuaaggauucucagaaaa

SEQ ID NO: 188500 - RNA, 64 nt, Human
cagacuuuucuuccucucgacauaguuuggggagaagcaguacuagaaacuuuccaaggagucu

SEQ ID NO: 188501 - RNA, 64 nt, Human
agucuaacagagaugccgaugucagcacagcccuaagcaguaagucauauuggcauuuccacgu

SEQ ID NO: 188502 - RNA, 64 nt, Human
gccugugaacucaggaaugcacaguugacuugggaagcaguauuacuagaucuggaggcaacca

SEQ ID NO: 188503 - RNA, 64 nt, Human
acgacuuucuuuaacauaucauucagaaugugcaaagcaguauguacaggcugagacacagccc

SEQ ID NO: 188504 - RNA, 64 nt, Human
ccuuggaaaagaccacucucuugugggacguuucaagcaguacauguuuuaauguagugaacac

SEQ ID NO: 188505 - RNA, 64 nt, Human
gccugccccaaacaaauaugcaaaagguucacuaaagcaguagaaauaauaugcauugucagug

SEQ ID NO: 188506 - RNA, 64 nt, Human
aguugcuucuuaugcagauagaugugugaaaucuaagcaguaauguacuuucucccuuuguaaa

SEQ ID NO: 188507 - RNA, 64 nt, Human
aaggacucacacuggagaaaaacccuaugaauguaagcaguaugggaaagcguucagaccugac

SEQ ID NO: 188508 - RNA, 64 nt, Human
aagcacucacacuuggcagaaacucuaugaauguaagcaguaugggaaagccuucagaucggcu

SEQ ID NO: 188509 - RNA, 64 nt, Human
acacaaauuagguggaauaaugacucgagcaggaaagcaguagaagaggauuccuucaccacag

SEQ ID NO: 188510 - RNA, 64 nt, Human
accaaacuuguaauaaaaggaauuccaaauggacaagcaguaaugauauuuaaauauuuugagu

SEQ ID NO: 188511 - RNA, 64 nt, Human
cccuccccuucucugugcaguagcaucaccuugaaagcaguagcaucaccaucuguaaaaggaa

SEQ ID NO: 188512 - RNA, 64 nt, Human
ugauguaaauuauuuuuaaacagugcauucuugaaagcaguauggcagucauaaaaauuuugga

SEQ ID NO: 188513 - RNA, 64 nt, Human
ugauggaugcguuggucuuucucccuugguuuguaagcaguacaagggcgugugcucccagaau

SEQ ID NO: 188514 - RNA, 64 nt, Human
ucauuuaaacaauguauuaccaagugaauaaaucaagcaguaguaagauagugagcauucauac

SEQ ID NO: 188515 - RNA, 64 nt, Human
uccaccaagcaucaaguuggagaaaagggaacccaagcaguagagagcgauauuggagucuuuu

SEQ ID NO: 188516 - RNA, 64 nt, Human
caggcagguuccaucgcuuucgacucucacuccaaagcaguagggccgcguugcugcucacucu

SEQ ID NO: 188517 - RNA, 64 nt, Human
gcaaggucagugaggggccaguagacccccggagaagcaguaccgacaaugacgaagauaccag

SEQ ID NO: 188518 - RNA, 64 nt, Human
ccaaaauaaugugucacuugauuuggaacuauucaagcaguaaaaguaaaugaaucccaccuuu

SEQ ID NO: 188519 - RNA, 64 nt, Human
uccagacccaccaccagaguggaucuuauuuucaaagcaguauagacaauuaugaguuugcccu

SEQ ID NO: 188520 - RNA, 64 nt, Human
gcuugugugaguucuuuuuuauuuaaugauuugaaagcaguauuuuugcacagucgugaccgug

SEQ ID NO: 188521 - RNA, 64 nt, Human
gaaccccuuugugcccccuuuguguuccucaaggaagcaguaccuuugaagagaucucugcugc

SEQ ID NO: 188522 - RNA, 64 nt, Human
gaccucaguuauuuucccauuuuugguuguuuugaagcaguaacauuuuucucagugcacaugc

SEQ ID NO: 188523 - RNA, 64 nt, Human
guggcuucuuuuggaaaguacuaugaacgucucgaagcaguauucuagugauaagaauucuuaa

SEQ ID NO: 188524 - RNA, 64 nt, Human
uuaccuguccaggaucaaaagaagccuagaaaagaagcaguaaucuaccucugccgauaaccug

SEQ ID NO: 188525 - RNA, 64 nt, Human
ugcuuucuccuuuaauuguaaaguaaaagcuauaaagcaguauuuuucuugacaaauggcauau

SEQ ID NO: 188526 - RNA, 64 nt, Human
caaaagucuuugaguccagugugcacgagucgacaagcaguaccuggcaugcaggagcacucau

SEQ ID NO: 188527 - RNA, 64 nt, Human
agauccauuuaaaacaagcugauaguguuucguuaagcaguacaucuugugcaugcaaaaauga

SEQ ID NO: 188528 - RNA, 64 nt, Human
gcugacuccggauucaacguugcuggggagagaaaagcaguauagacuccaccuuccaggaugu

SEQ ID NO: 188529 - RNA, 64 nt, Human
caccaccaucuccagcugcucacagacgccagcaaagcaguaugcucccgaucaaguagauuuu

SEQ ID NO: 188530 - RNA, 64 nt, Human
uguguuuguuuuuuuccagggaggucuaauuccgaagcaguauuccagguuuucucuuuguuuu

SEQ ID NO: 188531 - RNA, 64 nt, Human
acuuuuagaagacagaaaccacacucacaguccaaagcaguagaagaaaaaugaauucaaaagu

SEQ ID NO: 188532 - RNA, 64 nt, Human
agucagucuguuauaaauuuuuuuuuagucccauaagcaguagacucccacagaaaauuucuuc

SEQ ID NO: 188533 - RNA, 64 nt, Human
gauaaucaguuuccacuacauucggaggucaagaaagcaguauauauucuuucacaaggcaucc

SEQ ID NO: 188534 - RNA, 64 nt, Human
aguuauaaaugcuggcaacaaaucacaguaguaaaagcaguaccugggauuuucccaccaauac

SEQ ID NO: 188535 - RNA, 64 nt, Human
cuuaccugggcacaaacagaauuuuccauuuauuaagcaguacaaauguuuuucauccauuccu

SEQ ID NO: 188536 - RNA, 64 nt, Human
ccuauuaaaacccuuuacucacaguuugaaacugaagcaguaaacuuguuuccagacaucuuuu

SEQ ID NO: 188537 - RNA, 64 nt, Human
uuccucaaguuaguuauguuguaggaguguaccuaagcaguaagcguauuuagguuaaugcagu

SEQ ID NO: 188538 - RNA, 64 nt, Human
aaauaugccaaauauauauugcuauaauacacucaagcaguauuaaucaauaugguaucacaau

SEQ ID NO: 188539 - RNA, 64 nt, Human
ccuugugaacaucagaagguauuuuuuaacucccaagcaguagcaggacgaugauagggcugga

SEQ ID NO: 188540 - RNA, 64 nt, Human
acuuuacugauuaagugaccaauauguucauauuaagcaguacagaguguaggcaagagaaaga

SEQ ID NO: 188541 - RNA, 64 nt, Human
cuguaucuuaggcuuauauacguagggauagaguaagcaguacaaaguguauauuuuggaaaag

SEQ ID NO: 188542 - RNA, 64 nt, Human
gaguauuuuauuucuguauugaaaauguuacacaaagcaguaaaguuuuugagaacuagugaag

SEQ ID NO: 188543 - RNA, 64 nt, Human
agcuguggugcuacagaaaguacccuagacuuagaagcaguaauacugguuucuaguucuauuu

SEQ ID NO: 188544 - RNA, 64 nt, Human
uaucauguuaucuuauuaaaagaaaaagcccaaaaagcaguaaaauuuccauuucucccuguua

SEQ ID NO: 188545 - RNA, 64 nt, Human
uguaauauuaauuggccucuuugggugggacucuaagcaguauuugcagaaauaugcuucuggu

SEQ ID NO: 188546 - RNA, 64 nt, Human
aagaaagacucuauaggcuuuuacacagcacaugaagcaguaauccagaaagaaggaaaugcag

SEQ ID NO: 188547 - RNA, 64 nt, Human
ccuuucuuucucugggaucccugcccagcaccuuccuauagagaugacuuuaaaaggaaaaaaa

SEQ ID NO: 188548 - RNA, 64 nt, Human
acauucaugguaaauuugcacuucaucuuuccugccuauagaaaaucuuucuaauugccaacaa

SEQ ID NO: 188549 - RNA, 64 nt, Human
ugaccaugcaccuuacaauuucugaacaguuaacccuauagaagcaugcuuuauaugagugucu

SEQ ID NO: 188550 - RNA, 64 nt, Human
gugccccuugagugaggcuaaucuuuagguuuuuccuauagaaaacauucuuccuccaucagua

SEQ ID NO: 188551 - RNA, 64 nt, Human
gucugacuccagagucugagcccccggcuaguacccuauagagagggggcucuccaaaggggcu

SEQ ID NO: 188552 - RNA, 64 nt, Human
augaaaaggagggugauuagccuucauaagaugaccuauagagcaaagaaaggugacuggaagg

SEQ ID NO: 188553 - RNA, 64 nt, Human
auacaaugucuaaauggguuagaaaauuauuauaccuauagaagcgaaacuuggaaauuaauag

SEQ ID NO: 188554 - RNA, 64 nt, Human
aaccagguaaugccaguuugccagcagcuauuugccuauagagaugagucuguccuggucauaa

SEQ ID NO: 188555 - RNA, 64 nt, Human
aaacuuugauuggcaguuucuucgguuaauuauuccuauagaauguauuuuaagaaaucuauac

SEQ ID NO: 188556 - RNA, 64 nt, Human
aggguguccacauauguuaacaucaguuggaucuccuauagaaguuucugcugcucucuuuccu

SEQ ID NO: 188557 - RNA, 64 nt, Human
ugauuucagacaaaugcuguguggaaacaucuauccuauagaucauccuauucuuaugugucuu

SEQ ID NO: 188558 - RNA, 64 nt, Human
agauaacugcucuuuuacuaagacauagucucuaccuauagaaauguauuuugaaaacacuuau

SEQ ID NO: 188559 - RNA, 64 nt, Human
cugugcacauuuccucuaguucaugucuguagucccuauagaaugaucuguaauaaaauaguau

SEQ ID NO: 188560 - RNA, 64 nt, Human
cccuuuuggacauuucuuuguugcacaggauacaccuauagacugaauaaguucaguauuuccg

SEQ ID NO: 188561 - RNA, 64 nt, Human
agcgauucuucugccucagccucccgaguagcugggaccacaggugccuaccaccaugccaggc

SEQ ID NO: 188562 - RNA, 64 nt, Human
ggauggccacuuggcuggaccuuguauccccaaaggaccacacguguaauuuuugauauuauuu

SEQ ID NO: 188563 - RNA, 64 nt, Human
ccuuaagcagcucaguggaaggaugagcugcugcggaccacagccagccacugcaucugcugca

SEQ ID NO: 188564 - RNA, 64 nt, Human
uuucuguucaucaccagucuguaaaauacauguaccuauagaaauagaacacugccucugaguu

SEQ ID NO: 188565 - RNA, 64 nt, Human
uggaaaaaauauuuuaaaaacaaaauuugugaaaccuauagacgauguuuuaauguaccuucag

SEQ ID NO: 188566 - RNA, 64 nt, Human
aggggaguuuccaaagauguggguggcaaaugccccuauagaaacaccaguaccugaaagcacu

SEQ ID NO: 188567 - RNA, 64 nt, Human
auugaacuuuuagauuucaaaaauaucacugcauccuauagaagauaauccuauugaagagauu

SEQ ID NO: 188568 - RNA, 64 nt, Human
aggugcuccgccucccagcuuuucucaaaauaguccuauagauacugguaaucuggaaaugaag

SEQ ID NO: 188569 - RNA, 64 nt, Human
uauuuucaucaucgauuugaaaauaucuguaacuccuauagauccuauaggcagagaguuuucc

SEQ ID NO: 188570 - RNA, 64 nt, Human
uaacucagcuuggguucugugcuccuccucucuuccuauagaacacugugcauaccuugaauaa

SEQ ID NO: 188571 - RNA, 64 nt, Human
uuuacaugauuuugaaauagacuagaaagcuuucccuauagacauauuaauauuccaaucauaa

SEQ ID NO: 188572 - RNA, 64 nt, Human
aucaaaagaagaaaaaacugaagguacuuuacucccuauagagaaaccauugccaucauuguag

SEQ ID NO: 188573 - RNA, 64 nt, Human
auuccauucauauuguaaaaaaagaaucuuaucuccuauagaaaacagcaacauauaaauucaa

SEQ ID NO: 188574 - RNA, 64 nt, Human
accuguaguguuuuauaaaguguggucagaggccccuauagaauguauuguuugaaaguguagu

SEQ ID NO: 188575 - RNA, 64 nt, Human
uauuucuauccugaguaguaaucucacacuucauccuauagagucaaccaccacagauaggaau

SEQ ID NO: 188576 - RNA, 64 nt, Human
auuagauucuucuauaaaagucaccauauuguauccuauagaaaaguuaaggucugagugcaug

SEQ ID NO: 188577 - RNA, 64 nt, Human
ugacaacacuuaauuucuuuucuaauaaaaaaaaccuauagaugauucagugauuuuuguccaa

SEQ ID NO: 188578 - RNA, 64 nt, Human
gccugacacuucacagaguggggacccaccagagccuauagaaucaauuccuuggucucacagc

SEQ ID NO: 188579 - RNA, 64 nt, Human
uuaacugugaauggcauucauuaagcuccuuuauccuauagauucuaucuuuauguucaucuga

SEQ ID NO: 188580 - RNA, 64 nt, Human
cccaggugaccggcgacugagggccugagcuggcaaggccaaggacacccaacacaauuuuugc

SEQ ID NO: 188581 - RNA, 64 nt, Human
uacaaaacaaaccucaucaguauaauauaauuaaaaggccaauuuuuucuggcaacuguaaaug

SEQ ID NO: 188582 - RNA, 64 nt, Human
gggcgcacuggugucugacacuaaggaggguguaaaggccaaggucagcauagacugaggcaca

SEQ ID NO: 188583 - RNA, 64 nt, Human
cagagugcuuccugcaagcuggcguugagcugugccuauagaagcucuuuucaacauucuuuau

SEQ ID NO: 188584 - RNA, 64 nt, Human
ucauuguaaaucacuuguuuuauugacugucuuuccuauagacuguaagcuccaugagggcagg

SEQ ID NO: 188585 - RNA, 64 nt, Human
ccucagugucugugggggauugguuccaguuaccccuauagauaccaaaaucugcagaugcuca

SEQ ID NO: 188586 - RNA, 64 nt, Human
aaaaacaugacugagcagcuuugaaggcugcaguccuauagaaugcauaccuuccucccucuag

SEQ ID NO: 188587 - RNA, 64 nt, Human
aagugcauguauauguggagggagggaaaaggguccuauagaaugagggaagacaaaaauguuu

SEQ ID NO: 188588 - RNA, 64 nt, Human
uuucucuagcccaaagugcauuacagaagauacaccuauagaaccauuaccuucugcuaugugu

SEQ ID NO: 188589 - RNA, 64 nt, Human
uccuuccaacagugaagagaagauuuaagaagcaccuauagacuugaacuccuaagugccacca

SEQ ID NO: 188590 - RNA, 64 nt, Human
cuuuucucacauuuacucaaaugcauugucuugcccuauagacucaggaguugcuucucaagaa

SEQ ID NO: 188591 - RNA, 64 nt, Human
auaauuguacaguuuaugccaccauaauuugaggccuauagauuuagcuuaagagaacacuguu

SEQ ID NO: 188592 - RNA, 64 nt, Human
aacaaacgugagaaucugcugacauuaacaugagccuauagaagaagucauuuuucuuucuugu

SEQ ID NO: 188593 - RNA, 64 nt, Human
agguagccuuuugggcuuuuuaaugaauaugaccccuauagaaaagucaagaaaaaaaaacccu

SEQ ID NO: 188594 - RNA, 64 nt, Human
uggugagauggugggaugugauaaccaagauugcccuauagaaugguuccauuauggcugcguu

SEQ ID NO: 188595 - RNA, 64 nt, Human
uauuguacaauuugaaaauuaugucgggacauacccuauagaauuacuaaccuuacugccccuu

SEQ ID NO: 188596 - RNA, 64 nt, Human
aagcagcugaacucaccggccacuucucuguuugccuauagacaaagacugugugugugugugu

SEQ ID NO: 188597 - RNA, 64 nt, Human
uuuuaaaauauacuaugauuuuauauguauauuuccuauagacucuuuaagauguauuuauaau

SEQ ID NO: 188598 - RNA, 64 nt, Human
uuaguauauaggcaucaaacaaccuuggcuguaaccuauagaaucucuauccacguaucagguu

SEQ ID NO: 188599 - RNA, 64 nt, Human
uuaugggauuugggugugggacuaggguacaaugaaggccaagagcaucucagacauagaguua

SEQ ID NO: 188600 - RNA, 64 nt, Human
cuguuucagggcugcccgucuugggaucacaaugaaggccaagcuugcucgccuagaggcccag

SEQ ID NO: 188601 - RNA, 64 nt, Human
cacaaaaacuugaaaaaucugaaacagagaacagaaggccaagagccagcuucugcguucucaa

SEQ ID NO: 188602 - RNA, 64 nt, Human
cgaauuucaacacuagaaugacuaaaacuaucuaccuauagaacuaucuguagauaguauacua

SEQ ID NO: 188603 - RNA, 64 nt, Human
ggggcuuuccugauguugguaucuaaggcuuaggccuauagauugauuuaccuuuggaauugug

SEQ ID NO: 188604 - RNA, 64 nt, Human
ggcaaaaagaauaguuaagucaggaaugguccugccuauagaagagcuuugagagaggugggcc

SEQ ID NO: 188605 - RNA, 64 nt, Human
accucacaaaccuacagcccagaaaccagaagccccuauagaggccccagucccaacuccagua

SEQ ID NO: 188606 - RNA, 64 nt, Human
cggggucauuugcuauuccccucugauauucaacccuauagaaggagccuggacucugaucccu

SEQ ID NO: 188607 - RNA, 64 nt, Human
gagaguuugaaagaaauuuucagauguucuguucccuauagagggccuauuccaggaucuaaau

SEQ ID NO: 188608 - RNA, 64 nt, Human
aaaaaauugauuauuuuuauuagauaauuucucaccuauagacuuaaacugucaauuugcucua

SEQ ID NO: 188609 - RNA, 64 nt, Human
uucuggaauauaacuuuguguaaauuaacagccaccuauagaagaguccaucugcugugaagga

SEQ ID NO: 188610 - RNA, 64 nt, Human
ggaagaagaaacagaacuucauggccaaaguagaccuauagauuuugauuggguucuuuguuaa

SEQ ID NO: 188611 - RNA, 64 nt, Human
gugggcuugcaagccugugccuuuuccacuaacuccuauagacuccuggagcuagaagcacuug

SEQ ID NO: 188612 - RNA, 64 nt, Human
ccucuugcuguuuaugaaucuaagacaaggaaguccuauagaagccaaagggacagggacggaa

SEQ ID NO: 188613 - RNA, 64 nt, Human
ggcgaugagcacuaaaugcuuuuuugacuauuuuccuauagauuuuuuuuaaaacuuuuuuuuc

SEQ ID NO: 188614 - RNA, 64 nt, Human
uucaguucguuuguauucuaccuuuguaaaacagccuauagaugaugauguguuugggauacug

SEQ ID NO: 188615 - RNA, 64 nt, Human
uauguauuuaguagaguauaaagaaaagcagaugccuauagaugucuggagcauauuuucauuu

SEQ ID NO: 188616 - RNA, 64 nt, Human
ugaagaaaaugugugugaucuuuaauaacacaucccuauagaaaguggauaaaagauauaccaa

SEQ ID NO: 188617 - RNA, 64 nt, Human
aauggguuuuaaacuuugguaugcaucagaauucccuauagaucuuuuugaaaauauagguacc

SEQ ID NO: 188618 - RNA, 64 nt, Human
cagagaguccucuggauggcaccagaggcugcagaaggccaagaaucaagcuagaaggccacau

SEQ ID NO: 188619 - RNA, 64 nt, Human
cucagugaguucaucagggccacacccaguagagaaggccaagcaaccuccacuucuucagcac

SEQ ID NO: 188620 - RNA, 64 nt, Human
ggcaggucccccuucacucagccccccagugucgaaggccaagguuggggaggggaacaggaga

SEQ ID NO: 188621 - RNA, 64 nt, Human
uuaacaagccuaaccuugacucaaacagugaaugccuauagaaauaauaaaugaaaaaaacuag

SEQ ID NO: 188622 - RNA, 64 nt, Human
ccagauuugaaugggucuuuccccugggccuuauccuauagaggcauuuguaauauggagaaaa

SEQ ID NO: 188623 - RNA, 64 nt, Human
cgacucugagauuagcuggcuucuccacggccguccuauagacaggauuucuaaagcucaaaga

SEQ ID NO: 188624 - RNA, 64 nt, Human
uuuuauauuugcaaaggaaacauaucuaauccuuccuauagaaagaacaguauugcuguaauuc

SEQ ID NO: 188625 - RNA, 64 nt, Human
gagaugagaucauggagagagaacacagccauccccuauagaaaggcacagcuuuugggcuucu

SEQ ID NO: 188626 - RNA, 64 nt, Human
gccacacaggauuuuuuuuuuuuuuuaagaaaaaccuauagaugaaaaauuacuaaugaaacug

SEQ ID NO: 188627 - RNA, 64 nt, Human
ugcuccagggucucuuuuugguccaaaggcuagaccuauagaguuggaucacuuuuuuucuuuc

SEQ ID NO: 188628 - RNA, 64 nt, Human
aguucuuagacauuuaaauagaaaguugugugccccuauagaaaauauuugagaauuucuuaua

SEQ ID NO: 188629 - RNA, 64 nt, Human
cugccucucccgcccacgcccugcugucuccaggccuauagacguuucucuccaaggcccuauc

SEQ ID NO: 188630 - RNA, 64 nt, Human
gaaagaaagaaaccuccagcguauuuuaucacuaccuauagaaagaaauccugcuuugagagua

SEQ ID NO: 188631 - RNA, 64 nt, Human
aaacuacuauuccaguucuccugugucagucuugccuauagauuuugccaucguuuucugucaa

SEQ ID NO: 188632 - RNA, 64 nt, Human
uugaguuucacaguggaauuggcuuuggaucuggccuauagauuagugacauaaaauauuuucu

SEQ ID NO: 188633 - RNA, 64 nt, Human
uguugucaguaucgguguuuugaauuggugccugccuauagagauauauucacaguucaaaagu

SEQ ID NO: 188634 - RNA, 64 nt, Human
aaauuggugucccauaccagcuuuuaaugguggaccuauagaauccaguacuuuuaaugguggg

SEQ ID NO: 188635 - RNA, 64 nt, Human
caaaugaaauuugaaaucuucuagaaaguagacuccuauagacucaaagcugaauugagaucag

SEQ ID NO: 188636 - RNA, 64 nt, Human
aucacacugcgguaggucauucuuuugccacaucccuauagaccacuggguuuggcaaaacuca

SEQ ID NO: 188637 - RNA, 64 nt, Human
ugggccgcuucuggccucuuggagccaugggccaaaggccaaggggaugggcagaggucugugu

SEQ ID NO: 188638 - RNA, 64 nt, Human
uuguuuuuuuaucuugcccaaagagcucccucucaaggccaacuauaggcuccucuugcccugu

SEQ ID NO: 188639 - RNA, 64 nt, Human
gcccagcccucccagcuggugucacucugccucuaaggccaaggccucaggagagcaucaccac

SEQ ID NO: 188640 - RNA, 64 nt, Human
auuuaaguaucccgaauuuucuugaauugcuuucccuauagauuaauuacaauuggauuucauc

SEQ ID NO: 188641 - RNA, 64 nt, Human
ucacaaggucaaaguucugguccacaaacccuucccuauagaaguucaauggcugcgaaagaau

SEQ ID NO: 188642 - RNA, 64 nt, Human
uugugagacuggcuuauggcaugaguuguggacaccuauagaguguucuucucuaagaccugga

SEQ ID NO: 188643 - RNA, 64 nt, Human
accaccuugcacuauuggacuuuggaaggaggugccuauagaaaacgauuuugaacauacuuca

SEQ ID NO: 188644 - RNA, 64 nt, Human
acugaccuguccuccuucagggacaugagcauucccuauagauuaggguucuucuuauccuccu

SEQ ID NO: 188645 - RNA, 64 nt, Human
gucaauauugaugucacugaauuaauuacaguguccuauagaaaaugccauuaauaaauuauau

SEQ ID NO: 188646 - RNA, 64 nt, Human
cauaaaauaaucaugugucaugugacuuuggcacccuauagacauacuuaguuuuaacuuuuca

SEQ ID NO: 188647 - RNA, 64 nt, Human
guggcuucugaauuugguauuugaacuaggagucccuauagaggggcugcuuuaugggaaguuu

SEQ ID NO: 188648 - RNA, 64 nt, Human
cauagcagcuagugcggggcauccucauccuguaccuauagaguucgugcacucccccauccau

SEQ ID NO: 188649 - RNA, 64 nt, Human
ucccaacugacuagagacucaggcccugcagggcccuauagaaccuguggccaucccugagcac

SEQ ID NO: 188650 - RNA, 64 nt, Human
uauguaugauaggacuuuuuuuaguccaaauguuccuauagauuuucuggguuuuuuuuuuuuu

SEQ ID NO: 188651 - RNA, 64 nt, Human
aacauuugacuccagugagggcucaaguuagaucccuauagaaagaggacacuucaucuuacuu

SEQ ID NO: 188652 - RNA, 64 nt, Human
gaccuucuaucugccucccaacuccucaaggucaccuauagaagcgagcuaccaaaagacgucu

SEQ ID NO: 188653 - RNA, 64 nt, Human
ccaggugacacugcacacaaagccaagggcaaacccuauagaguaaagcugcagccacccugug

SEQ ID NO: 188654 - RNA, 64 nt, Human
uggaguagaguaugugauaguaucugcuucaagaccuauagaaaaguacauuccaguuugaucc

SEQ ID NO: 188655 - RNA, 64 nt, Human
uuuuaaaaggccugaacuauacuuugaagaaaccccuauagaaaaggaaagcuccagcuaaaua

SEQ ID NO: 188656 - RNA, 64 nt, Human
caggggggaugauggggccaccgagaggccgaagaaggccaaggaggagcggcgcauggaccag

SEQ ID NO: 188657 - RNA, 64 nt, Human
gauguuucauuuguaugaguuuggagcagugcugaaggccaaagccgccuacugguuuguaguu

SEQ ID NO: 188658 - RNA, 64 nt, Human
ggaugcaaaagaaaugaugauaacauuuugagauaaggccaaggagacguggaguagguauuuu

SEQ ID NO: 188659 - RNA, 64 nt, Human
agugacacauaguuacuuccuggcugggacggcaccuauagaaacuaggguacaaaucucccaa

SEQ ID NO: 188660 - RNA, 64 nt, Human
aacagcuugcugcuaaaugggacccaauuuuuggccuauagacacuuauguauuguuuucgaau

SEQ ID NO: 188661 - RNA, 64 nt, Human
acacccagccaggcagagcugggauugaaggaccccuauagagaagggcuuggcccccaugggg

SEQ ID NO: 188662 - RNA, 64 nt, Human
ccaggagaagcugucccaggagggcuguuaacucccuauagagccaggagacaggauagggguu

SEQ ID NO: 188663 - RNA, 64 nt, Human
gacucuguaauuccacuucuagguauauauacauccuauagaaacucacaaauaaugcauaaga

SEQ ID NO: 188664 - RNA, 64 nt, Human
auuuauugacaguaagccugugauaaacauuauuccuauagauuguagaucagcuauaaguauu

SEQ ID NO: 188665 - RNA, 64 nt, Human
agacacagugacaacacacaccaugacaacgacaccuauagauauggcaccaacaucacaugca

SEQ ID NO: 188666 - RNA, 64 nt, Human
acuccaaggacuggauguaagcagaucuuuuuuuccuauagaugucucagauguucaguuuucc

SEQ ID NO: 188667 - RNA, 64 nt, Human
cagacaccccucuuucagcuuagaauuuggggaaccuauagagaagucacagaaucccaugaaa

SEQ ID NO: 188668 - RNA, 64 nt, Human
cuugguugcaaggcucauauuuuuuuguaccuuuccuauagauucuguagcauuugaguguggc

SEQ ID NO: 188669 - RNA, 64 nt, Human
gaaaguuggagcucuguccuucaaaccuuuuagcccuauagaugauaaauaucacuggguuaua

SEQ ID NO: 188670 - RNA, 64 nt, Human
agguagaaagguggaacauucccuuucagucaggccuauagaauuauuugcacaaguacaagua

SEQ ID NO: 188671 - RNA, 64 nt, Human
cgucucgugugugcuagacgcaccccuacucguuccuauagaacacagaggacauaggaaaccc

SEQ ID NO: 188672 - RNA, 64 nt, Human
caacucauugagucuuaugguucacaucuuguuuccuauagaaauauucuguauucugggauca

SEQ ID NO: 188673 - RNA, 64 nt, Human
caacucauugagucuuaugguucacaucuuguuuccuauagaaauguucuguauucucggauca

SEQ ID NO: 188674 - RNA, 64 nt, Human
aaacucauugaguccuaugguucacaucuuguuuccuauagaaauguccuguauucugggauca

SEQ ID NO: 188675 - RNA, 64 nt, Human
auguucugaccauuuuaggauaccuuuacuuuaaggaccacacagucccagaggacacaucccu

SEQ ID NO: 188676 - RNA, 64 nt, Human
caacagcaacaacacgaagaugauaccaaaacaaggaccacaaaacaacuagccaugaugggag

SEQ ID NO: 188677 - RNA, 64 nt, Human
uuuuaacaagcaccccagucacuaggaugcagauggaccacacuuugagaaacaccacccauuu

SEQ ID NO: 188678 - RNA, 64 nt, Human
aaauaacuugcaaggaugaaagauggaggaugaaccuauagauuuaaagagacuuaagagacau

SEQ ID NO: 188679 - RNA, 64 nt, Human
cauaucuggaaacuugugacguuuugacaccuuuccuauagaugauauaggaaugaaccaauac

SEQ ID NO: 188680 - RNA, 64 nt, Human
gcugcauuccuaaacuguuuauuugcacuaugagccuauagacuaucaguucccuuugggcgga

SEQ ID NO: 188681 - RNA, 64 nt, Human
aauguaauuuauauuuuuuuuagauccucccuuuccuauagagauaaaagugauuuaucuuggc

SEQ ID NO: 188682 - RNA, 64 nt, Human
uuuuaaaaauuuccccuuuaaguuaugauggcugccuauagaauuuagacuguuucucacccug

SEQ ID NO: 188683 - RNA, 64 nt, Human
uucaaaaacauuacuguaaugaauaacugaguuuccuauagaagaaccugaauaauuacuuuug

SEQ ID NO: 188684 - RNA, 64 nt, Human
ccagggaacccccuggggccccggcccucacucuccuauagagauugugugugugugugugugc

SEQ ID NO: 188685 - RNA, 64 nt, Human
cauaucuggaaacuugugaaguuuugacaccuuuccuauagauauaggaaugaaccaauacgcu

SEQ ID NO: 188686 - RNA, 64 nt, Human
gaaugccagggagggcaccagcccugauccacagaccucggaaagaugccccuguuccuuuguu

SEQ ID NO: 188687 - RNA, 64 nt, Human
guaaacacaaauauuucuucaaggggugaugaaaaccucggaaguuuuaauuugagguuaucug

SEQ ID NO: 188688 - RNA, 64 nt, Human
gccagacuuggaaucauggagggaaaacauuguuaccucggaucuccugguuacccagcacaua

SEQ ID NO: 188689 - RNA, 64 nt, Human
ggccaaccagcccgacagugccauccccaccuucaccucggagggauggagaaagaaguggaga

SEQ ID NO: 188690 - RNA, 64 nt, Human
ugggcugcuuugugugcacaaaauugcuuuuuccaccucggaaaugcagcuuucccuaggggga

SEQ ID NO: 188691 - RNA, 64 nt, Human
agggcucugccucaacuuuccuaggaaagagcccaccucggagauagcuacgguuuucucuggu

SEQ ID NO: 188692 - RNA, 64 nt, Human
gcuggugaacuguggcacgguugcucaacacaucaccucggacaaauucaggaagcauuucuuu

SEQ ID NO: 188693 - RNA, 64 nt, Human
gaacgagccuggaagcacuacagagcaucccacaggaccacacgcaggccucccugccucagcu

SEQ ID NO: 188694 - RNA, 64 nt, Human
accagucuccacuuugcacgccggaacugccuugggaccacaguuacagaaaaaauguaaacuc

SEQ ID NO: 188695 - RNA, 64 nt, Human
gaugaggcagaaggaaggguaagggaaaggauggggaccacaaggaagagccaggugcugcuca

SEQ ID NO: 188696 - RNA, 64 nt, Human
uuccuugccccacaguuguguucaugcugaauccaccucggagcaugguguuuucauucccccu

SEQ ID NO: 188697 - RNA, 64 nt, Human
ugcccgcucugcagacugcugcuagagccagcaacuccacuaagguggauuuucaucaggggcc

SEQ ID NO: 188698 - RNA, 64 nt, Human
uaacugguuaauuauacugcagaaaccuuuucaccuccacuagucugauacaguacaucuguac

SEQ ID NO: 188699 - RNA, 64 nt, Human
cgagaccauccuggccaacacggugaaaccucgucuccacuaaaaauaccaaaaaaauuagcug

SEQ ID NO: 188700 - RNA, 64 nt, Human
caccggccccucugaacgugaugggaccugccuucuccacuaguagcugggcagcucacaauuc

SEQ ID NO: 188701 - RNA, 64 nt, Human
caccuagacacguccuggcagggggccucgggcacuccacuaccaacccagcuccacccagcag

SEQ ID NO: 188702 - RNA, 64 nt, Human
agcuuguuugugucugucguguuauuagagggaacuccacuauauauggucacuugaaauuaug

SEQ ID NO: 188703 - RNA, 64 nt, Human
uuuuugccuccaccuuuuagcccacaucauuuaacuccacuacugugaaagcuugcuuaaagaa

SEQ ID NO: 188704 - RNA, 64 nt, Human
uacacaaaauuccaccccaugaucaagaauccugcuccacuaagaauggugcuaaaguaaaacu

SEQ ID NO: 188705 - RNA, 64 nt, Human
cucccaacugucuguccucaaugcccuaccccaacuccacuagugacccucagagucuucuccc

SEQ ID NO: 188706 - RNA, 64 nt, Human
cauggucugcaggcucaucuguguccgccuuucacuccacuaaugcugucucaguguuuucucu

SEQ ID NO: 188707 - RNA, 64 nt, Human
cauccuaacuccacucacgcagacccaaccuaaccuccacuagcuccaaaaucccugcuccugc

SEQ ID NO: 188708 - RNA, 64 nt, Human
gauucuccugccucagccucccgaguagcugggacuccacuaaaaguacaaaaauuagcugggc

SEQ ID NO: 188709 - RNA, 64 nt, Human
cgagaccagccugaccaucauggugaaaccucaucuccacuaaaaauacaaaaauuagccaggc

SEQ ID NO: 188710 - RNA, 64 nt, Human
ucucuuccuguggccccaccuuggcccccacccccuccacuaucuccugccgcccccacucugg

SEQ ID NO: 188711 - RNA, 64 nt, Human
agugauccuccuaccucagccucccaaguaguugggaccacaggugugcaccccauauccagcu

SEQ ID NO: 188712 - RNA, 64 nt, Human
aaccagaugcccaggacaggugcucuagccauuaggaccacaaauggacaugucaguuauugcu

SEQ ID NO: 188713 - RNA, 64 nt, Human
ggggccccaggugaugucauugcugcuggucccaggaccacauuuuaacaaucaauguuuucag

SEQ ID NO: 188714 - RNA, 64 nt, Human
cgcauuugauuuucauuucgacaacagaaaaaggaccucggacugcagggagccagucuucuag

SEQ ID NO: 188715 - RNA, 64 nt, Human
agaauuacagaaaacaauucuggacaacuaaacuaccucggaucaagccaccaaauauggcaua

SEQ ID NO: 188716 - RNA, 64 nt, Human
ggggcugggggagcacccaggcggaucugcaagcaccucggagcacccaccgcugggucugcgg

SEQ ID NO: 188717 - RNA, 64 nt, Human
uggacacacacucacacaaguaacaccacagcagaccucggaguacugcuaaguguaccugugu

SEQ ID NO: 188718 - RNA, 64 nt, Human
uuuuuuaauuuguuguuguuguuacuguuuugauaccucggaaacaccuccguugacaguuguu

SEQ ID NO: 188719 - RNA, 64 nt, Human
gcucgguggacgagagugucugacucagauaucuaccucggagggaguuucugcuacuuuaggg

SEQ ID NO: 188720 - RNA, 64 nt, Human
uccgugauauggcucuucgcaugcugaguacuggaccucggaccagagccauguaagaaaaggc

SEQ ID NO: 188721 - RNA, 64 nt, Human
ucuaagugggacauucaaaaaacucucucccaggaccucggaugaccauacucagacgugugac

SEQ ID NO: 188722 - RNA, 64 nt, Human
ccgcacgcagggcguggagggggaccacugcgugaccucggacccagccacgucgccccugguc

SEQ ID NO: 188723 - RNA, 64 nt, Human
ccccagcccccucccaccgcugccucguagagugaccucggacagagccccccuagcaauacag

SEQ ID NO: 188724 - RNA, 64 nt, Human
agaaaggcccagggcaguggggacgggucccagcaccucggagcccccuucacacgcccccuac

SEQ ID NO: 188725 - RNA, 64 nt, Human
aaccgguugaccagaaaaugggcagagagagaugaccucggaagcauuuccacagaugguguca

SEQ ID NO: 188726 - RNA, 64 nt, Human
ucucagaaauaaagaucuuuuguccguuuuuuuaaccucggauucuguaauugguucuuauagu

SEQ ID NO: 188727 - RNA, 64 nt, Human
uuauaaaagggcaaauccagauucauaaacuaucaccucggauuucuuguaaucuacauguuug

SEQ ID NO: 188728 - RNA, 64 nt, Human
agccauccccugugaugacuggcagcuaaggaggaccucggaguggacccgagccaggaauaac

SEQ ID NO: 188729 - RNA, 64 nt, Human
aaaucaaugccuuugcauagaaaaucaaauucagggaccacaaagaauuuucagugggaauguc

SEQ ID NO: 188730 - RNA, 64 nt, Human
aaggcugcagcccacaggaguccagggaaggcggggaccacagaggcacagaguccagcacuug

SEQ ID NO: 188731 - RNA, 64 nt, Human
cuuaaccaaagaaauugaucuuuuucaagcccgaggaccacauuuuaaccccagcgcuauucau

SEQ ID NO: 188732 - RNA, 64 nt, Human
cuaggcugugugguauagccauuauaaucuuaugggaccacauaguauaagugguccguuguug

SEQ ID NO: 188733 - RNA, 64 nt, Human
cgcguguguuccaggggaccucaucucccgccugaccucggacaccaccauggucagcgaccug

SEQ ID NO: 188734 - RNA, 64 nt, Human
cacauuuaccuuuaucacugcuucagugucacaaaccucggaaggucuucuaggaagaaccauc

SEQ ID NO: 188735 - RNA, 64 nt, Human
auugaguccagaagccagaucagcaaauggaggaaccucggaggugaccagaaagaucuccauc

SEQ ID NO: 188736 - RNA, 64 nt, Human
gugagaacauccccuugacaguugcagccucuugaccucggauaacaauaagagagcucaucuc

SEQ ID NO: 188737 - RNA, 64 nt, Human
ccgcuccugauggcugacgggcucccagacccucaccucggacaugguggugggggaaggacgg

SEQ ID NO: 188738 - RNA, 64 nt, Human
caauguccaggucacaggcauccgcugcgcucccaccucggacaccaucuugggauuccucccc

SEQ ID NO: 188739 - RNA, 64 nt, Human
augcuaggcgugacaccguucccuccaaaagcagaccucggaaucacugccaaauaaguaacua

SEQ ID NO: 188740 - RNA, 64 nt, Human
ccaggacaucugcacccccuccccaccuccacggaccucggaccuccaggcggcucagugcugc

SEQ ID NO: 188741 - RNA, 64 nt, Human
gacccgugggauggugcccagggguugccuugggaccucggaucuccucuggggggcuuggcug

SEQ ID NO: 188742 - RNA, 64 nt, Human
ucuuugggccgcagcccugaccuggaaugucuccaccucggauucugaucugauccuuaggggg

SEQ ID NO: 188743 - RNA, 64 nt, Human
cccuccagagucccucaccuuugacauggaguugaccucggagugcgcuaccucccccauguga

SEQ ID NO: 188744 - RNA, 64 nt, Human
ucaagguuuuucaagaguugguuuugcguuuccaaccucggagaauuccaggcacuccccuucc

SEQ ID NO: 188745 - RNA, 64 nt, Human
gcggugcaagcgcccagcuccccagagcuccccaaccucggaccucaccgcaggggcgcugggc

SEQ ID NO: 188746 - RNA, 64 nt, Human
gaccaucucuguccccuccacccucacuccauccaccucggagaccacccucccccagccagau

SEQ ID NO: 188747 - RNA, 64 nt, Human
ccuguuggacugccugagagaggggaagagagagaccucggaccugcaugucaagauggauuuu

SEQ ID NO: 188748 - RNA, 64 nt, Human
ggcuuuuguccucuaugaggaugugaaaaacuagggaccacaaaagggaacaagcaaaaaaguu

SEQ ID NO: 188749 - RNA, 64 nt, Human
uggagggaagagagaccuguguguuuagaggccaggaccacaguuaggauuggguuguuucaau

SEQ ID NO: 188750 - RNA, 64 nt, Human
ggugguccuuccaccucagccucccaaguagcugggaccacaagugugcauuaccacacucagc

SEQ ID NO: 188751 - RNA, 64 nt, Human
aggacauaagguauagccauaaaucauaacccagggaccacacucaacccuagggaaauugucu

SEQ ID NO: 188752 - RNA, 64 nt, Human
gggacagacccaccccagcccagggcccucacccaccucggagaggcguccccaccaucggauc

SEQ ID NO: 188753 - RNA, 64 nt, Human
cacucuucucuuccucucuuuuuuggggggagaaaccucggaauuucuaugagaccucccccag

SEQ ID NO: 188754 - RNA, 64 nt, Human
ccaggcuaccuagaggggcaucgggccagggaaaaccucggauuagcaagcaauaaaaacauga

SEQ ID NO: 188755 - RNA, 64 nt, Human
uggcucucccggcccugcucugauuaggacagcgaccucggauagcacagccagcuacuccacc

SEQ ID NO: 188756 - RNA, 64 nt, Human
aguuuggggcuucaagguuuauucuggcaagaacaccucggagccacugcauuguuuugccaaa

SEQ ID NO: 188757 - RNA, 64 nt, Human
gguggccaguaaaugccagccauuucucaaacccaccucggaccacccagaguuuccucuuggu

SEQ ID NO: 188758 - RNA, 64 nt, Human
cuguccagggcucccgggagccaggggagaugcuaccucggaagcugaagcggauccuccggca

SEQ ID NO: 188759 - RNA, 64 nt, Human
cccucucucuggguucgucgugguugagaugauuaccucggacgucuacggaaacgagcgggcg

SEQ ID NO: 188760 - RNA, 64 nt, Human
ucuuuccuugucccaggauggagcugauccaguaaccucggagacgggacccugcccagagcug

SEQ ID NO: 188761 - RNA, 64 nt, Human
guuuguaaaauaucuuuaaucauucacauuagguaccucggaguugcgggucucaaauguggau

SEQ ID NO: 188762 - RNA, 64 nt, Human
aggucuaggcuaaccuuuggucauuuguaacaagaccucggaacagacacguguguggcauggu

SEQ ID NO: 188763 - RNA, 64 nt, Human
gagcaagacagagaaugaaaagaguugauuuuggaccucggaccuugccguggcuaaaucuuua

SEQ ID NO: 188764 - RNA, 64 nt, Human
ccucccccuucugggagcuccucccccuccccagaaggccaagggaugugggggcugggggacu

SEQ ID NO: 188765 - RNA, 64 nt, Human
ccguuccgccgcccacccucugcuagacacagccaaggccaacgaggcaagcagaagcagcggc

SEQ ID NO: 188766 - RNA, 64 nt, Human
aaugcugcugagugaaugaguaaauaaacucuucaaggccaagggacaguggucuaauucaacu

SEQ ID NO: 188767 - RNA, 64 nt, Human
gaucccuccccgguggcuggaccugacuguugugaaggccaaggggcagccagacuugccagag

SEQ ID NO: 188768 - RNA, 64 nt, Human
aucaguguuuuaaauaagaaagguaauaguugguaaggccaauguuauuuaaaugaaaguaguu

SEQ ID NO: 188769 - RNA, 64 nt, Human
acuauaaguaguugguuuguaugagaugguuaaaaaggccaaagauaaaagguuucuuuuuuuu

SEQ ID NO: 188770 - RNA, 64 nt, Human
gcagcgccaucuuuccguuucagggguugugaugaaggccaaggaaaaacauuuaucuuuacua

SEQ ID NO: 188771 - RNA, 64 nt, Human
acagggacaagggcaagaggacugaggccagagcaaggccaaugucagagacccccgggauggg

SEQ ID NO: 188772 - RNA, 64 nt, Human
uuuucacuuuucacuucuggcuuuuuuguggcccaaggccaauauaggauuaauaucuguguuc

SEQ ID NO: 188773 - RNA, 64 nt, Human
guuguacacuuucaaucaacacuuuuucagacuaaaggccaaaaccuaaucguacgcaucgugu

SEQ ID NO: 188774 - RNA, 64 nt, Human
uuaaugaaccaugaaagacaggaugaccuuggacaaggccaaacuguccuccaagacuccuuaa

SEQ ID NO: 188775 - RNA, 64 nt, Human
ucugucaucacuguacccaagugaugucacuaccaaggccaaaugauggugggcuaaauuuuaa

SEQ ID NO: 188776 - RNA, 64 nt, Human
ccagcuuagucagaagaugguuccauggaagaaaaaggccaaggaguuugaagauuuuucuucu

SEQ ID NO: 188777 - RNA, 64 nt, Human
gcuuaguuuugcuuuccuuugacacaguaaggcaaaggccaagcuuucaaaagaguaaaggaua

SEQ ID NO: 188778 - RNA, 64 nt, Human
agucggaacaauuccuagcaccugucggaaggucaaggccaaaggcaaauucaaggccagacug

SEQ ID NO: 188779 - RNA, 64 nt, Human
ucuacauguaaaugaagcaauagaauucuaacauaaggccaagaaaugagacgaauguuugggg

SEQ ID NO: 188780 - RNA, 64 nt, Human
auaugagggcagauucaagagccagcaggucaaaaaggccaacacaaccauaagcagccagacc

SEQ ID NO: 188781 - RNA, 64 nt, Human
gggcugcagggcugggucagggguacacagagcuaaggccaaugggcuagagggugccggaaag

SEQ ID NO: 188782 - RNA, 64 nt, Human
gaagaaagaaaaugcaagcuaguuuugagaaaggaaggccaaauugggucgggggaggguggga

SEQ ID NO: 188783 - RNA, 64 nt, Human
ccugaaaaaacaacacugggggagggggacggugaaggccaaguucccaaugagggugagauug

SEQ ID NO: 188784 - RNA, 64 nt, Human
uccacccuaccuagguucccuccuugcuggcauaaaggccaagcagugaaaugaaccuuggguu

SEQ ID NO: 188785 - RNA, 64 nt, Human
aaggcauuccucccugcccaaucccagugcagucaaggccaaccuaggcagcagccaccuucuc

SEQ ID NO: 188786 - RNA, 64 nt, Human
auguaauuuaucucuuguuugaaucugucauucaaaggccaauaauuuaaguugcuaucagcug

SEQ ID NO: 188787 - RNA, 64 nt, Human
acuagguggugucuacugcuagggagauuauaugaaggccaaaauaaugacuucagcaagagug

SEQ ID NO: 188788 - RNA, 64 nt, Human
accccagagacccugcccuuccacccggaggccaaaggccaacuguacucccaaaggcauggga

SEQ ID NO: 188789 - RNA, 64 nt, Human
cagaauuguucuuugcuuuuuauugaaugcuccaaaggccaaacuucuggggcuggggguuggu

SEQ ID NO: 188790 - RNA, 64 nt, Human
ggagccacagcagccacuuugcuaccaugacaaaaaggccaagagaaucacagagucauugacc

SEQ ID NO: 188791 - RNA, 64 nt, Human
ccaaaugcaaccuuacagagaaugcugaaugaggaaggccaauuccuuacaaugauggcagaac

SEQ ID NO: 188792 - RNA, 64 nt, Human
gcucuuccuaaguagauccaggccuguggcagccaaggccaagcaggcccaucucacaacccug

SEQ ID NO: 188793 - RNA, 64 nt, Human
caauagagcaaguccccauuacuaaaaaacccaaaaggccaaaaaacaaaaaaguuagaguucg

SEQ ID NO: 188794 - RNA, 64 nt, Human
auaaauucuccacuugaaugcgcucaugaaaaauaaggccaaaacaagaguucugggccacagc

SEQ ID NO: 188795 - RNA, 64 nt, Human
gccacagcaggacaggccgggacaggccucacccaaggccaaggcuggcaucagccaaucauuc

SEQ ID NO: 188796 - RNA, 64 nt, Human
ccuggacuaguccuagaugcaaacucaagagcccaaggccaaggggauguggggaagauggcag

SEQ ID NO: 188797 - RNA, 64 nt, Human
cuauggcaaugugcaagucgcacugaaauccugaaaggccaagccuggagcccguccaggcuuu

SEQ ID NO: 188798 - RNA, 64 nt, Human
aaacacuaugcuaagugaaauaagccagacacaaaaggccaaauaugaugccacuuuuaugagg

SEQ ID NO: 188799 - RNA, 64 nt, Human
uuuuugcuuuuugacauacgaaaaugucaagagaaaggccaaagauuuguacuuuuucacuuac

SEQ ID NO: 188800 - RNA, 64 nt, Human
gacccgcugcuccugcugcucccggggauggagcaaggccaaggcugcgggaggcugggagccc

SEQ ID NO: 188801 - RNA, 64 nt, Human
ucacaguaaaauaacagcucuauuauuauucagcaaggccaaagacuuuugagaauguguaugg

SEQ ID NO: 188802 - RNA, 64 nt, Human
cucaacagugaaaguagcagggaaagagcugggcaaggccaagaccaucuuuuguaccguuggu

SEQ ID NO: 188803 - RNA, 64 nt, Human
uccguaauauuuccuuuauuucaaugauucucagaaggccaauucaaacaaacccacauuuaag

SEQ ID NO: 188804 - RNA, 64 nt, Human
uaagguaaaaaugcauuugcaaagggagaaaaugaaggccaaacagaagcaggcuccagcuucu

SEQ ID NO: 188805 - RNA, 64 nt, Human
uuauaguaucuacuucugguacuaauauacacaaaaggccaaaaccaugccuauucugcaggug

SEQ ID NO: 188806 - RNA, 64 nt, Human
ugcuccaccagugggccuuggaaaaugcaucaagaaggccaaaccagcuugacccuggcucaca

SEQ ID NO: 188807 - RNA, 64 nt, Human
ccuguggagugaucccauggcucaagagggcugcaaggccaacacuauucgaggaggaggcugu

SEQ ID NO: 188808 - RNA, 64 nt, Human
uuacaggaugccucauagacgaugaggggucugaaaggccaacccgaggcuggcagaucugacc

SEQ ID NO: 188809 - RNA, 64 nt, Human
uacuuuaucuucacugaaccacucacucuguguaaaggccaacagauuuuuaaugugguuuuca

SEQ ID NO: 188810 - RNA, 64 nt, Human
uggccuuuuuugaucauaagaguugguacuguuuaaggccaaaaguaacaguuuuuauagaucu

SEQ ID NO: 188811 - RNA, 64 nt, Human
uuuuuaaaauuuuuguuguauugaaaagcuaaacaaggccaaaagguuaaauuuuuugaauauu

SEQ ID NO: 188812 - RNA, 64 nt, Human
aaaauagaaacugaaccggggcgguggucaggcuaaggccaaguguuuaagaaguagaguguag

SEQ ID NO: 188813 - RNA, 64 nt, Human
cauaaacuuaccuggagcucauguggaggaacagaaggccaagauccuugcuuugggggugccu

SEQ ID NO: 188814 - RNA, 64 nt, Human
aggaaggucccuuuuccucuguuuuguguuugccaaggccaaacucccacucucugccccccuu

SEQ ID NO: 188815 - RNA, 64 nt, Human
gccgugacacccuucauccuacccuuggaaccccaaggccaaguugguucaaacuguuggagaa

SEQ ID NO: 188816 - RNA, 64 nt, Human
ccccuccuuugccuuucaagagcagggccugggcaaggccaagaaccaugcagaagccuuccug

SEQ ID NO: 188817 - RNA, 64 nt, Human
caauugagcaguugugaaaauugcuaauggugccaaggccaagcaaagaguuucagaaaaugac

SEQ ID NO: 188818 - RNA, 64 nt, Human
guagaucuuuguacaguugacuuuuugacauagcaaggccaaaaauaacuuucugaauauuuuu

SEQ ID NO: 188819 - RNA, 64 nt, Human
uagcuucucuucuuucugaagaucaauuucucccaaggccaagauuguccuuuucucccauuuc

SEQ ID NO: 188820 - RNA, 64 nt, Human
aaaaaggaccagagaauucuuagauuggcccggaaaggccaauaaagaguuagaaugaaaacuc

SEQ ID NO: 188821 - RNA, 51 nt, Human
cccuguguggcuaucacuagcaaggccaagccccggguacccucagugaug

SEQ ID NO: 188822 - RNA, 64 nt, Human
uugagguguuaggaaccugcuggucaugguguggaaggccaaaugaagcugccacaggguuucu

SEQ ID NO: 188823 - RNA, 64 nt, Human
gaugugauucuugaaagggaauuuagaauauguuaaggccaaguagguuaacuggugaacauuu

SEQ ID NO: 188824 - RNA, 54 nt, Human
acccuacugcauaccuguaaaucgaaggccaauggucagaucuucaaaauaaaa

SEQ ID NO: 188825 - RNA, 64 nt, Human
gggcucuagggacugccaggcuguuucagccaggaaggccaaaaucaagagugagauguagaaa

SEQ ID NO: 188826 - RNA, 64 nt, Human
cuuugaacuugccugccagccuucagcaucaggaaaggccaaguccugggugugaguguuccug

SEQ ID NO: 188827 - RNA, 64 nt, Human
ucugaguuaaagaaacaaaguauuugcuuuguaaaaggccaaaauucuauuuccuacaaacuuu

SEQ ID NO: 188828 - RNA, 64 nt, Human
ucuccacagacccccuaugggggacccccaacucaaggccaaggacugggcguaucggaugcuc

SEQ ID NO: 188829 - RNA, 64 nt, Human
cuccagccuggguaacagacgcugucucaaaaaaaaggccaagagaaaguaagggagacagauu

SEQ ID NO: 188830 - RNA, 64 nt, Human
aaauuaaagaugaauaaauaaaauaaaaugacacaaggccaaaaacaaauggguuuaacugacc

SEQ ID NO: 188831 - RNA, 64 nt, Human
cuccuugaugccugucggcacuucugaaaggcacaaggccaagaacuccuggccaggacugcaa

SEQ ID NO: 188832 - RNA, 64 nt, Human
cuccuuuucuacccuccucuccguccauaccuacaaggccaaggacaaacgccaucuucauccu

SEQ ID NO: 188833 - RNA, 64 nt, Human
uaugauuauuucaacacaauggaagagcacaguuaaggccaacuaacguaaaaugcacugaagc

SEQ ID NO: 188834 - RNA, 64 nt, Human
acuuuggaaaaugcauuguaucgauguuauguaaaaggccaaaccucuguucaguguaaauagu

SEQ ID NO: 188835 - RNA, 64 nt, Human
acacaccucuaagcugcuggccgaagaugucaccaaggccaaagacacaguauuaugaagguuu

SEQ ID NO: 188836 - RNA, 64 nt, Human
uauaggauuuuucugcaggacuuuaaagcuuugaaaggccaauaucccauaggcuaacuuuaaa

SEQ ID NO: 188837 - RNA, 64 nt, Human
gcaggggcaugcgccuagaaucccagcuacucggaaggccaaggcaggaggaccgcuugagucc

SEQ ID NO: 188838 - RNA, 64 nt, Human
ccaaggcaggaggaccgcuugaguccagggauucaaggccaaccugggcaauagagcgagaccc

SEQ ID NO: 188839 - RNA, 64 nt, Human
aauuguaguucuugucugauuggcucacccaagcaaggccaaaauuaccaaaaaucuugggggg

SEQ ID NO: 188840 - RNA, 64 nt, Human
caagguggaagccauugagcaucuccucuucuugaaggccaaccuggagcaguuccccaacuac

SEQ ID NO: 188841 - RNA, 64 nt, Human
caggggagggggagcccagagugauguuucuccuaaggccaaaccccaggggugggucauuuga

SEQ ID NO: 188842 - RNA, 64 nt, Human
uggugggacaagagcaaagcccacugccaguaagaaggccaaagggcccuuccauccuagcccu

SEQ ID NO: 188843 - RNA, 64 nt, Human
ugcccggcuacaucagccuucaagaaucagaagaaaggccaaggugcuggacuguuacugacuu

SEQ ID NO: 188844 - RNA, 64 nt, Human
acagcuccuccugcacccagaaugggaaggaaagaaggccaagggaauucagauucugaccagc

SEQ ID NO: 188845 - RNA, 64 nt, Human
auuucagaaucuaagaaaucaggcaagugcuuaaaaggccaacgguccaagggauuacaucugc

SEQ ID NO: 188846 - RNA, 64 nt, Human
aaaaguuucuauuuaguuauuuaagaagaaugagaaggccaauaguuuuagauuauuuuaucug

SEQ ID NO: 188847 - RNA, 64 nt, Human
uauaguuguuuucuaacccagcccuccacugccaaaggccaaaagcucagacaguuggcagacg

SEQ ID NO: 188848 - RNA, 64 nt, Human
auuuauuagauuguguugaaggucugauucuacaaaggccaacucuacauauuugguagcccua

SEQ ID NO: 188849 - RNA, 64 nt, Human
gccuugcuguuggucaugugggucuuccagggggaaggccaaggggagucaccuucccuugcca

SEQ ID NO: 188850 - RNA, 64 nt, Human
ccuaggcagcucuaacaucaucugauauggacacaaggccaacaguuuccuuauuuacauccuu

SEQ ID NO: 188851 - RNA, 64 nt, Human
acuggcagccauugcagcuccaaacugcagaggcaaggccaauuuuaacuuuucaauuuacagu

SEQ ID NO: 188852 - RNA, 64 nt, Human
uugcugaaggaaaaaucggacugcaaaucauuccaaggccaaacugcaacugagccacccacuc

SEQ ID NO: 188853 - RNA, 64 nt, Human
ugaacauuuugaaguuuauagcuuccagauuacaaaggccaaggguaauagaaaugcauaccag

SEQ ID NO: 188854 - RNA, 64 nt, Human
ccauuucuguuugcugccugaaagcaggaugaggaaggccaaggagaguccuugcacccgugag

SEQ ID NO: 188855 - RNA, 64 nt, Human
uuaaagcauucaacauuguguaaaugaaucuuggaaggccaaagcuacugaauuuagcgaauuu

SEQ ID NO: 188856 - RNA, 64 nt, Human
agcacuucggcucuggaguuacagaucuggguucaaggccaaauuccaccacuuacuagguuug

SEQ ID NO: 188857 - RNA, 64 nt, Human
auuagauguuaggcaucuccuguauguaagacacaaggccaaccacaacacagaacgauguuga

SEQ ID NO: 188858 - RNA, 64 nt, Human
acauacuagguugaaagagaguugaggaaaccagaaggccaaguggaucugcuggcaaacccug

SEQ ID NO: 188859 - RNA, 64 nt, Human
caaaaacuuagaugagcagaaugacaaaaaaaaaaaggccaaugagaacucaacuccuggcucc

SEQ ID NO: 188860 - RNA, 64 nt, Human
auauuuuaacuuuuuguuuuuauuucuuuuagaaaaggccaauauaccuaucacacuuuggaag

SEQ ID NO: 188861 - RNA, 64 nt, Human
gacagucaaagaagcagcccaguggaaccacaaaaaggccaauuucagaugguagguaaugauu

SEQ ID NO: 188862 - RNA, 64 nt, Human
agaagaaugaauaaauuuacgugaugagcucuacaaggccaaaaauuuuuuuucuuaucuaccu

SEQ ID NO: 188863 - RNA, 64 nt, Human
aagcagaggaucagagaugggaaaggacuagcccaaggccaacauuaacaagcccucuaacaaa

SEQ ID NO: 188864 - RNA, 64 nt, Human
aaugcuggugaaacuggccaaacagaacaccaacaaggccaaagacucuuuacggaagguucgc

SEQ ID NO: 188865 - RNA, 64 nt, Human
aauggccggcgguggcugcagugguagccugaggaaggccaagcugcccucccugggaaucacu

SEQ ID NO: 188866 - RNA, 64 nt, Human
acuggaggaugacaguuucccaacucacaaaaggaaggccaaaguauccaucauuagucagcca

SEQ ID NO: 188867 - RNA, 64 nt, Human
gggaggguagggagugggugggggggagggggguaaggccaagacugggguagaauuuuaaaga

SEQ ID NO: 188868 - RNA, 64 nt, Human
cuaaacagagaaggcuuauaaaaguaaaugcauuaaggccaagugcaguggcucacaccgguaa

SEQ ID NO: 188869 - RNA, 64 nt, Human
aagucaccugucuacauagaccaaauggagcaccaaggccaagcggacagaggggccauggguu

SEQ ID NO: 188870 - RNA, 64 nt, Human
ucuacagauaagaaaacauugaaauucaaagauuaaggccaaaaauaucucacuugcaauuuua

SEQ ID NO: 188871 - RNA, 64 nt, Human
cugaggaugggccuagcagaugaagcuugccagcaaggccaaagcaaacgguuucuccugugga

SEQ ID NO: 188872 - RNA, 64 nt, Human
gguuaaagaugguugcagcuggagggggcggaaaaaggccaaaacuccauauauguuagucuuc

SEQ ID NO: 188873 - RNA, 64 nt, Human
accagcuuuauuuuuuaacaugaaagcugaugccaaggccaaaagaaguuuaaagcaucuguaa

SEQ ID NO: 188874 - RNA, 64 nt, Human
ggcucaggagccgccucuccuaaaagaggguuucaaggccaaauggguuugucaacggugcugu

SEQ ID NO: 188875 - RNA, 64 nt, Human
uccuaacccuuccccuucuuggacacugaaggaaaaggccaacuaggguguuagcccucugggc

SEQ ID NO: 188876 - RNA, 64 nt, Human
ggucuguuacuuuaauguuucuguuuuuaaugugaaggccaagcaggcccugggaugggagugg

SEQ ID NO: 188877 - RNA, 64 nt, Human
ggaccucaggggaaaaaagugaaaaaggguagcaaaggccaaugucuucuagcugcuuccucaa

SEQ ID NO: 188878 - RNA, 64 nt, Human
gacggaccucaggguagguucucgggacugaaggaaggccaagccauuacgggagcacagcaug

SEQ ID NO: 188879 - RNA, 64 nt, Human
uaaaacaucguuuaaggaaacguuuacuaguccaaaggccaaagcuaauuuauuuccacuuuag

SEQ ID NO: 188880 - RNA, 64 nt, Human
gcaucucccagauaaugugaaaaugguccaggagaaggccaauuccuauacgcagcgugcuuua

SEQ ID NO: 188881 - RNA, 64 nt, Human
caggacuuuguaaguucuuauucugggagaacauaaggccaauaaucaugaccucuuccaggca

SEQ ID NO: 188882 - RNA, 64 nt, Human
acacagaucacagcuucagccaggagcugggcagaaggccaagaggcuguucccaccaggcugc

SEQ ID NO: 188883 - RNA, 64 nt, Human
ucugcccaccugccggcaacaccagugccaggaaaaggccaaaagaaugucuguuucuaacaaa

SEQ ID NO: 188884 - RNA, 64 nt, Human
agauacacaugaggccccuacuucucaagcugggaaggccaagagccuuccuucagccuuucug

SEQ ID NO: 188885 - RNA, 64 nt, Human
ccugucuuccuuccagagcaccuggcuggaguuuaaggccaaggcuuucuccaaaagugagccc

SEQ ID NO: 188886 - RNA, 64 nt, Human
uuuuuuucucuucauaggucccaacuccaucuccaaggccaaggguuuucaccccucagucauc

SEQ ID NO: 188887 - RNA, 64 nt, Human
gaagccccagguaucccccuucccugcuaugggaaaggccaagcugcuggguggggacagaagc

SEQ ID NO: 188888 - RNA, 64 nt, Human
uuguucaaauguaaaaacgcuggcaggaaaacacaaggccaaaucaaucauuuaaaaaaucauu

SEQ ID NO: 188889 - RNA, 64 nt, Human
uuucugguuuuuuucuccugcucaaggggucccaaaggccaaggcaguggguggcucucgcugc

SEQ ID NO: 188890 - RNA, 64 nt, Human
agaccaagcucaacgccuccaagaccagcaggccaaggccaagcccugccccagauccucauag

SEQ ID NO: 188891 - RNA, 64 nt, Human
uggguguguguaaguuaaaguggccacauuuaagaaggccaagcuuuguagugguugcacaguc

SEQ ID NO: 188892 - RNA, 64 nt, Human
auuccugcagaaaagacauauguugcuuuacaagaaggccaaagaacuauggggccuucccagc

SEQ ID NO: 188893 - RNA, 64 nt, Human
cuaagucauuuaaacugggucuuuauaaaaguaaaaggccaacauuuaauuauuuugcaaagca

SEQ ID NO: 188894 - RNA, 64 nt, Human
caagcaaaccuggaagggcaaaucugagagugggaaggccaaaggccgaggcccagauuuagua

SEQ ID NO: 188895 - RNA, 64 nt, Human
uccagaacacucugauucacagccaaggauccagaaggccaaggucuuguuaaggggcuacugg

SEQ ID NO: 188896 - RNA, 64 nt, Human
ccucaugcacaucacucaucuccugcugcaggccaaggccaaaauugggcuaguccuggccagg

SEQ ID NO: 188897 - RNA, 64 nt, Human
uugcuuguucagauuccaagacagaaggcuucacaaggccaacgccuggaaaaugggcaucucu

SEQ ID NO: 188898 - RNA, 64 nt, Human
uuuaaguuuguuuaauuauuuguuaagauugucuaaggccaaaggcaauugcgaaaucaagucu

SEQ ID NO: 188899 - RNA, 64 nt, Human
aggcuuugacaaccaggcguuccucccugaccacaaggccaacugggcgcccguccccagcccc

SEQ ID NO: 188900 - RNA, 64 nt, Human
cuccccuaauuccaaaaaaaagaggaacucuacaaaggccaagaucacagaguacagucuugga

SEQ ID NO: 188901 - RNA, 64 nt, Human
uccgcauacccauacccucuguuuuugaaaggcaaaggccaaucaguccccauuuguagcaugg

SEQ ID NO: 188902 - RNA, 64 nt, Human
ggccagauaaggaacagcucgggccacucuucugaaggccaacguggaggaaagggagcagcca

SEQ ID NO: 188903 - RNA, 64 nt, Human
ggaaggauuuauuuacaguguguuguaauuuuguaaggccaacuauuuacaaguuuuaaaaauu

SEQ ID NO: 188904 - RNA, 64 nt, Human
auagcaaaaggaaaaaaaacacccaucccucaaaaaggccaaggucccgucccccuguugucgg

SEQ ID NO: 188905 - RNA, 64 nt, Human
ugcgugccaaccucagaugccaacucaggucaucaaggccaaggaccaguggcgaaagugaguc

SEQ ID NO: 188906 - RNA, 64 nt, Human
gccaguuuaccugggcaucuggcugagaggaagaaaggccaaccugauccugaggggacccaga

SEQ ID NO: 188907 - RNA, 64 nt, Human
cuccccacaccccagcagggugucuucuagccauaaggccaagggaguggcagaacugggccgc

SEQ ID NO: 188908 - RNA, 64 nt, Human
gguuuucuugucuaccagauaaaccaaaacugggaaggccaaguacagucucuguggugcguau

SEQ ID NO: 188909 - RNA, 64 nt, Human
acucuacuauuaaguuugaaaauaguuaccuucaaaggccaagagaauucuauuugaagcaugc

SEQ ID NO: 188910 - RNA, 64 nt, Human
uuauuaaaaaaggaaaaauaugguuuccagagaaaaggccaauaccuaagcauuuuuuccauga

SEQ ID NO: 188911 - RNA, 64 nt, Human
cuggacagagagugggggagggagggacagacagaaggccaaggcccgauguggugugcagagg

SEQ ID NO: 188912 - RNA, 64 nt, Human
ccaucugaucacuggauugggcugagcagagaacaaggccaaccauggaaauggauaaauggua

SEQ ID NO: 188913 - RNA, 64 nt, Human
cagauugcauagccauuuccuugacuacugaguaaaggccaaggcuaagauuuaguaagccuag

SEQ ID NO: 188914 - RNA, 64 nt, Human
gcugcaguacguggagcgauacgggaagcguuugaaggccaagaaccugauguaccugaagcag

SEQ ID NO: 188915 - RNA, 64 nt, Human
agggagcguggucguggaagaaacaacccaccugaaggccaaaugccagagauuugggguuggg

SEQ ID NO: 188916 - RNA, 64 nt, Human
ucaggcuccuccuugcccccaccuugccccaggaaaggccaaaguccaggugacugcccuccuu

SEQ ID NO: 188917 - RNA, 64 nt, Human
ggaucccaagccuccugcugccacaauguuuauaaaggccaaaugauagcgggggcuaaguugg

SEQ ID NO: 188918 - RNA, 64 nt, Human
cucaaggauggcacucagaucuccauggcccagcaaggccaagauaaaucuaccaccccaggca

SEQ ID NO: 188919 - RNA, 64 nt, Human
ucuggacgaacagaagucacuuuggcuguucaguaaggccaauguuaacaacacguuuagagga

SEQ ID NO: 188920 - RNA, 64 nt, Human
gcaucugcaacuccaaguccaugcagaacucuggaaggccaaguucaucgcagcauguucacca

SEQ ID NO: 188921 - RNA, 64 nt, Human
gugcaggcagggagcacaguuugagaucaugcugaaggccaagcaggcccggaacucccaguuu

SEQ ID NO: 188922 - RNA, 64 nt, Human
aauagcuuccuuugcuccaauaagcuuugcaaucaaggccaaagaaaaugaucugcuuccccug

SEQ ID NO: 188923 - RNA, 64 nt, Human
gaugaugacagugaugaugaugaagaaagcaaagaaggccaagaaaguucuaguagugcugcaa

SEQ ID NO: 188924 - RNA, 64 nt, Human
gcaucugcuggaccuaaguaaggcaugucugucuaaggccaagucugcccggcuuaaggaugcu

SEQ ID NO: 188925 - RNA, 64 nt, Human
ggaguggacccgagccaggaauaacgaaugacccaaggccaaggaagggaggacagagaggccc

SEQ ID NO: 188926 - RNA, 64 nt, Human
ugacaucuuaagcucucaccuggcugcaguaggaaaggccaaacugacgacaaaaaaaaaauuc

SEQ ID NO: 188927 - RNA, 64 nt, Human
cauuuggcccacuccccccaucagccggcucugcaaggccaacuccguguccgcugcccacagc

SEQ ID NO: 188928 - RNA, 64 nt, Human
uggggguaguuuaagccuauggggcccagggggaaaggccaaacagaaacccaacuacccccua

SEQ ID NO: 188929 - RNA, 64 nt, Human
ggagcuuuggucuauuaguuugugacaauauucaaaggccaaaacacuacucagacacuuuccu

SEQ ID NO: 188930 - RNA, 64 nt, Human
aauccucccuguguugcacacuuuauaagcaauuaaggccaauugaauuaaguuuccaaagagu

SEQ ID NO: 188931 - RNA, 64 nt, Human
ugcugcacugaaauagagcaguaagcuugugauaaaggccaauuccagguagcucuugaaggug

SEQ ID NO: 188932 - RNA, 64 nt, Human
aagcuuucaaauauaauuuuacuggaacugauuaaaggccaaguauuuuauuacuaccauuuga

SEQ ID NO: 188933 - RNA, 64 nt, Human
aacagcaguuguaaggcugcccuggaggaaccgaaaggccaaauucccuccucccuucuacugc

SEQ ID NO: 188934 - RNA, 64 nt, Human
gggcuuccuaaaaagcagcagcagcuggaauuccaaggccaaguccugcaggacugguuggguc

SEQ ID NO: 188935 - RNA, 64 nt, Human
ugugccuuucgagauggugguggaggccgcacagaaggccaaugcccacggcuucaucauggaa

SEQ ID NO: 188936 - RNA, 64 nt, Human
aucauuuccuacuauuugcauuaagaauauuugaaaggccaacauugggaacauauuucuuaac

SEQ ID NO: 188937 - RNA, 64 nt, Human
cuccacacaggaccagcuggaagcagaaagaagaaaggccaauuucacagggcaccaaacaagu

SEQ ID NO: 188938 - RNA, 64 nt, Human
aauaagauaauucucauuuguguuugucuuuuaaaaggccaauaaaauaucuuucaguaucauu

SEQ ID NO: 188939 - RNA, 64 nt, Human
aggguaggagugcaucccauauaggccauuuuagaaggccaaggagagccacaccgaaaaagga

SEQ ID NO: 188940 - RNA, 64 nt, Human
uaaauuguccugaacuuuguuaaguguucuggacaaggccaagcuuuucuuuauuaaaaccuca

SEQ ID NO: 188941 - RNA, 64 nt, Human
gguaauuugcugcuaauagaguccucaaaggguuaaggccaauuugcaauuuuuuuuuaaacuu

SEQ ID NO: 188942 - RNA, 64 nt, Human
uugggaacacauagaacugauggaggcuuuuccuaaggccaaggauaauguacuaguuguuaaa

SEQ ID NO: 188943 - RNA, 64 nt, Human
caguuuuagacucagcauugugacacuucccaagaaggccaaaccucuaaccgacauuccugaa

SEQ ID NO: 188944 - RNA, 64 nt, Human
ucuuacgaaaacuauucuaaaggaggcaggagccaaggccaaaagugaacguacagguuugaaa

SEQ ID NO: 188945 - RNA, 64 nt, Human
auaugaaauguaaacaaauuuguuuuuuaagguuaaggccaaauguaacaauaaaacccugucg

SEQ ID NO: 188946 - RNA, 64 nt, Human
aaauuuuaguacuuaaagguuuuuaauuaucucgaaggccaagcauugcauuuguaaacagucc

SEQ ID NO: 188947 - RNA, 64 nt, Human
acagcucugguuuuauaauaucuuggguaucucuaaggccaauaaggauaacauuaucuaccca

SEQ ID NO: 188948 - RNA, 64 nt, Human
ccaauccaugccauaaugaacagggaccaaggagaaggccaacccuaaaggauuguccucuugg

SEQ ID NO: 188949 - RNA, 64 nt, Human
uugguugucuuuuucuagacuugggaucugcaagaaggccaauugccuaaaauuucugagaaca

SEQ ID NO: 188950 - RNA, 64 nt, Human
cuucagaaucaggacacucaagcucuggcagaggaaggccaaguuacuuucauggucuuacccu

SEQ ID NO: 188951 - RNA, 64 nt, Human
guggaaauuggaaggauaccaggagguauuugggaaggccaauggcguggcuccuuugaggaaa

SEQ ID NO: 188952 - RNA, 64 nt, Human
aguggaagcccuaaaaugcuagaauaauaauaaaaaggccaaaaauaaaauuguuucucucuca

SEQ ID NO: 188953 - RNA, 64 nt, Human
ccuagccaccuuucuggccucccacuugcccugaaaggccaagaucaagaugucccccaggcau

SEQ ID NO: 188954 - RNA, 64 nt, Human
gugaguuauccuggacauuucgaugguuuuugguaaggccaaacucugauaagcaaaacagaga

SEQ ID NO: 188955 - RNA, 64 nt, Human
uuggaucuauuugguuuaaaaaguauucuaucuuaaggccaacuaauauaaaauaccauuguua

SEQ ID NO: 188956 - RNA, 64 nt, Human
ggccgcguuuagaccaaggaacaaaaaaaccacaaaggccaaacugcuggacgucuuucuuuuu

SEQ ID NO: 188957 - RNA, 64 nt, Human
uccacuuacuucccauccaggucucagaggucucaaggccaaccuuggaauccuuauuuaacca

SEQ ID NO: 188958 - RNA, 64 nt, Human
gccauuucaaggaaggaucgaauacuugaugguaaaggccaagucccccuguauugggaagugu

SEQ ID NO: 188959 - RNA, 64 nt, Human
agcaaaagucaguagggacauugcagaagcuugaaaggccaauaccagaacacaggcugaugcu

SEQ ID NO: 188960 - RNA, 64 nt, Human
ugccacugugaguacugacauuuagaguuguuuaaaggccaagaacuggaaacagccuuuuccc

SEQ ID NO: 188961 - RNA, 64 nt, Human
ucauggagaauacucacccuucagaaacagaccaaaggccaaaaccugcugauuuuucuauuga

SEQ ID NO: 188962 - RNA, 64 nt, Human
gcuagaguccauccgccaagcugggggcaucggcaaggccaagcugcgcagcaugaaggagcga

SEQ ID NO: 188963 - RNA, 51 nt, Human
ucccccagaagaacuccuaagaaggccaagaaggaggaugaagcccagccu

SEQ ID NO: 188964 - RNA, 64 nt, Human
uuugucugcagaaggagaucaagaggcuggggguaaggccaagaagguaggaggaaaauggcag

SEQ ID NO: 188965 - RNA, 64 nt, Human
aggacgccccgugcgcugucaccuuccaccccacaaggccaaccuuuuucuguggcuuuagcag

SEQ ID NO: 188966 - RNA, 64 nt, Human
gaugaugcacauucugcugugaggaggcccagaaaaggccaaccagggcccaaccgugcaugau

SEQ ID NO: 188967 - RNA, 64 nt, Human
gcccagcaggaacuggaauacaguguucggggagaaggccaaaugauauccuugagagcagaga

SEQ ID NO: 188968 - RNA, 64 nt, Human
caguccccacgggagauggcagggcaccuuggggaaggccaagugggaggcugggaggcugccc

SEQ ID NO: 188969 - RNA, 64 nt, Human
guauugggguaauauuuccuccuuuuccaagaccaaggccaagaggcugggccaggcuucaguu

SEQ ID NO: 188970 - RNA, 64 nt, Human
ccuuuuggcauguggaaagcugucaaugcaguguaaggccaacguguguguggcuucuaugugu

SEQ ID NO: 188971 - RNA, 64 nt, Human
gccagccuuggcauauggcugggagucccuuagcaaggccaacccugaagaggcccuuugaggc

SEQ ID NO: 188972 - RNA, 64 nt, Human
ccaaauaguuccccccaaaauacacaaagcaaauaaggccaaaauguucauuguugaaucugca

SEQ ID NO: 188973 - RNA, 64 nt, Human
uuccccuuccucuuuggggcugaggaggagguuaaaggccaaaugcuguuucccaacaccccaa

SEQ ID NO: 188974 - RNA, 64 nt, Human
cugggaagagacaggaauucuaccuacacauaggaaggccaagguugauccacuuaaccuuguu

SEQ ID NO: 188975 - RNA, 64 nt, Human
cuccaauucacacaggcuugguauuaauagaaucaaggccaagcuagguuaggaaaagggaaga

SEQ ID NO: 188976 - RNA, 64 nt, Human
aaacuuuuucuauugcuaggagccugccagaacaaaggccaauauauaauguugugacaucaua

SEQ ID NO: 188977 - RNA, 64 nt, Human
auagcaucagaccugcauugaacaguccuguggaaaggccaagcagugaccaggaagagggaga

SEQ ID NO: 188978 - RNA, 64 nt, Human
uuuguuauuuugggguuuucaagcauuggaaccaaaggccaaauaauaaacagccuuuaguuuu

SEQ ID NO: 188979 - RNA, 64 nt, Human
cuguagccacagaccccuugcucgggccucacccaaggccaaacuccaaacacaaucagaacca

SEQ ID NO: 188980 - RNA, 55 nt, Human
gucuggacgugccagugugaaccagaaggccaaguccgcagaagcccugaugugu

SEQ ID NO: 188981 - RNA, 64 nt, Human
uacuaauaccagguauauuguggaauuuaguauaaaggccaaucuguccugaaguccaucuaau

SEQ ID NO: 188982 - RNA, 64 nt, Human
auaaugguuacuggguccuucucucaaggguagcaaggccaagcugauggcugcuuguuuagga

SEQ ID NO: 188983 - RNA, 64 nt, Human
gggcccgccccggcacaaagcacccaugggaauaaaggccaagccgcgacagucagcacggggg

SEQ ID NO: 188984 - RNA, 64 nt, Human
acagugccagagccagagaaggggccccaccaccaaggccaagcuugaccaggucagcauugcc

SEQ ID NO: 188985 - RNA, 64 nt, Human
ucuugauaugauccaccugugaacugaaucaugcaaggccaauuggacaaccucaguuccaacc

SEQ ID NO: 188986 - RNA, 64 nt, Human
gcccaucuggucuugccuucucagcgccacagggaaggccaagcuguucuagugguggaagugc

SEQ ID NO: 188987 - RNA, 64 nt, Human
agagacucagagacccgggagggccuuccucugaaaggccaagccaagccaugcuuggcagggu

SEQ ID NO: 188988 - RNA, 64 nt, Human
accucgcuuccacugcacaggcccaggaaggagaaaggccaagccaaagugggccccacccugc

SEQ ID NO: 188989 - RNA, 64 nt, Human
uugggagaguuccaugggcagauuucccuuccugaaggccaaaacggagaacugcucucuuuaa

SEQ ID NO: 188990 - RNA, 64 nt, Human
gaaucuccugcucugugaaugcuaucagaccccaaaggccaaccuugggcugggucuauguacg

SEQ ID NO: 188991 - RNA, 64 nt, Human
gcagcuggcgaggaguugguugaggcacuucuucaaggccaagggggaacacaguguuuuguuu

SEQ ID NO: 188992 - RNA, 64 nt, Human
uguaccuacccaaaagcuguagucacacauccuaaaggccaagcaaacccaccgggaugguggg

SEQ ID NO: 188993 - RNA, 64 nt, Human
gcugugaaugugauccgcucacugacacucuguaaaggccaaucaaugcacugucugucucucc

SEQ ID NO: 188994 - RNA, 64 nt, Human
ggucgguuuaccacuggacgggugcugcaucggcaaggccaaguugaacaccggauggugccaa

SEQ ID NO: 188995 - RNA, 64 nt, Human
ugugaccuuagcccagcaagccaggcccuucaugaaggccaagaaggcugccaccauucccugc

SEQ ID NO: 188996 - RNA, 64 nt, Human
cagcacuggggcuggaaugaucuuuaaugggcccaaggccaacaggcauaugccucacuacugc

SEQ ID NO: 188997 - RNA, 64 nt, Human
auaguggcucacaccuguaaucccaauacuuuagaaggccaaggcuggaggacugcuugagucc

SEQ ID NO: 188998 - RNA, 64 nt, Human
caugcaagguucugggaaggagugagaaguagugaaggccaaggggcccccaucacaggccgau

SEQ ID NO: 188999 - RNA, 64 nt, Human
agcuuuuuggccuggagaagggagggcgggcuagaaggccaaaagaaggaugaggaggacaaua

SEQ ID NO: 189000 - RNA, 64 nt, Human
gggaguuuucccgcaguucaguuccugacugugcaaggccaacagggcaggggaggggaagacc

SEQ ID NO: 189001 - RNA, 64 nt, Human
cacguaaccuaugucagacacuacaugaugacucaaggccaauaauaaagacauuuccuaccug

SEQ ID NO: 189002 - RNA, 64 nt, Human
ucuguuuuguuuuuuguuuuuuguuuuuuuaaaaaaggccaagcuuguuggcucaugccuauag

SEQ ID NO: 189003 - RNA, 64 nt, Human
ccucaguugugggguuugguuucauguguuagauaaggccaagacuuagagaaucagugggaaa

SEQ ID NO: 189004 - RNA, 64 nt, Human
auuuuuuaauucuuggagggggaaauaagggaauaaggccaaggaagauguauagcuuuagcuu

SEQ ID NO: 189005 - RNA, 64 nt, Human
gacuggccccuuaauucccacaggcccccccagcaaggccaaagggaggccccuggguauuguc

SEQ ID NO: 189006 - RNA, 64 nt, Human
cucuaugggaaacaaggaggaaaguuagccacugaaggccaaaacaccaugugggguggacaga

SEQ ID NO: 189007 - RNA, 64 nt, Human
uuuuggcauuccuugggagccucaguuguuguucaaggccaaaguuaucuccgugcugcaaggu

SEQ ID NO: 189008 - RNA, 64 nt, Human
uccagcaacuacaugugacugauagcuuuucccaaaggccaaggaagggaugguguagguucaa

SEQ ID NO: 189009 - RNA, 64 nt, Human
ucagacugaccccucgggcacauaccaugccuggaaggccaaugccauaggucggggugccaag

SEQ ID NO: 189010 - RNA, 64 nt, Human
uuccaaggcccggaguacuggggauugauguuucaaggccaaucaaugggaugcuucguuuucu

SEQ ID NO: 189011 - RNA, 64 nt, Human
uaugaaucauacucauuacuuuucagcuuuuuaaaaggccaauuuuuguccaguuuucucucuu

SEQ ID NO: 189012 - RNA, 64 nt, Human
ucuguucacggaggugcgguguggaugcaccuacaaggccaacucucugaucagggugagggag

SEQ ID NO: 189013 - RNA, 64 nt, Human
augaguacagacuggucaaaauguuuaugcagucaaggccaaagccugcccugagcccagacac

SEQ ID NO: 189014 - RNA, 64 nt, Human
aauacauaaaggacacagacaaggaacuugcugaaaggccaaccauuucaggaucagucaaagg

SEQ ID NO: 189015 - RNA, 64 nt, Human
cuaguccuaugauuucauagauguagcuuaggauaaggccaagguagguguugccuauauaagg

SEQ ID NO: 189016 - RNA, 58 nt, Human
aggugcugcugcagacguagggcaggugaaggccaaagcggguguugguggucaggcc

SEQ ID NO: 189017 - RNA, 64 nt, Human
auuuguuagaacucugcccuuuugucugaaacucaaggccaaggagaaugauaggagacuuagg

SEQ ID NO: 189018 - RNA, 64 nt, Human
uugucuuucaacaacagaaccggccacaccgcugaaggccaaagaggccacaaagaagaaaaag

SEQ ID NO: 189019 - RNA, 64 nt, Human
ggaucuggggcagccaccuugcuaccaugaaggaaaggccaagacaaucauccacagcuauucc

SEQ ID NO: 189020 - RNA, 64 nt, Human
caggagcacccaagaccacagaaaagagaaaggaaaggccaaaaaaaagaggaaaagaaaaaug

SEQ ID NO: 189021 - RNA, 64 nt, Human
agaggcaggaacugcucugucuuuguaacuacucaaggccaacugucacaugaaggaaugaaua

SEQ ID NO: 189022 - RNA, 64 nt, Human
acacggacuuauuuuugucauuagcaagggggaaaaggccaaaggacaagggccucuucuccca

SEQ ID NO: 189023 - RNA, 64 nt, Human
ucaacauagacugccuguaccaggcugccuggcaaaggccaaaacccuuacucacaugaggaug

SEQ ID NO: 189024 - RNA, 64 nt, Human
ggcugcagagccugcagggugaccugcuuccccaaaggccaacagcauuggccuggccagacca

SEQ ID NO: 189025 - RNA, 64 nt, Human
gcuggggcaugguuggccuccaaugauuucauucaaggccaaaguccugagcccccuccgcugg

SEQ ID NO: 189026 - RNA, 64 nt, Human
ccauuuaugauuuauucuccuaugugucauaugaaaggccaaggggcuuuaucuuuuacuagua

SEQ ID NO: 189027 - RNA, 64 nt, Human
ggcucagggauuuaucuuguuaccaaugugucugaaggccaaaauauauauccagaagcacaau

SEQ ID NO: 189028 - RNA, 64 nt, Human
accacgcaugagucgaagcccccgggaagagccaaaggccaaagugcccaacucuuugggauga

SEQ ID NO: 189029 - RNA, 64 nt, Human
guugaguggggcagagggacagggcagccagaccaaggccaagccuucucacccuuggccagcu

SEQ ID NO: 189030 - RNA, 64 nt, Human
aggauuguuucacaauaguaagcacauaauuuuuaaggccaaggcacauuugacuccugagaug

SEQ ID NO: 189031 - RNA, 64 nt, Human
auauucuauauuaaacacuaauuuaaauguaauaaaggccaaaggccucuguaugaaauuggau

SEQ ID NO: 189032 - RNA, 64 nt, Human
cccuggcacagccaacccccccagugcaaaccccaaggccaagccaagccggaucagcaccgug

SEQ ID NO: 189033 - RNA, 64 nt, Human
ccaaacaugguuuauuggugaguuaggaacauguaaggccaaguacacugagagccuuuuugaa

SEQ ID NO: 189034 - RNA, 64 nt, Human
gcaacuaccugugaugucugaccagaacauuagcaaggccaaggaacuuuaaccacaguauaac

SEQ ID NO: 189035 - RNA, 64 nt, Human
caaaccugaaagacacuaaugguucauccucuauaaggccaacaaagaaaacaaauuaauguga

SEQ ID NO: 189036 - RNA, 64 nt, Human
ucugcauuaguacuuuguuauuuuuccaucacuaaaggccaaucagaauuuggaaccaugcugc

SEQ ID NO: 189037 - RNA, 64 nt, Human
uucuuugauucccugggauaguggcuucugagcaaaggccaagaaauuauugugccugaaauuu

SEQ ID NO: 189038 - RNA, 64 nt, Human
uguagggcauguugaggaaggaggagggcugaucaaggccaagcuggucuagccugacauccua

SEQ ID NO: 189039 - RNA, 64 nt, Human
cggaaggaagaccuacuagaucagcucaaacaggaaggccaagugggccauuacgagcuuguua

SEQ ID NO: 189040 - RNA, 64 nt, Human
uguaaagaauggaaguagcuguaugagcaguucaaaggccaagccguggaaugguagcaauggg

SEQ ID NO: 189041 - RNA, 64 nt, Human; identical to SEQ ID NO: 189040

SEQ ID NO: 189042 - RNA, 64 nt, Human
acgaagaggauacuaaagagaggggaacgggaaugcccgcgacagaguccacauugccuguuuc

SEQ ID NO: 189043 - RNA, 64 nt, Human
ggauggauggauggauggaugagcgagaacccgcgcccgcgaacaaagagcgaaccaaagcgau

SEQ ID NO: 189044 - RNA, 64 nt, Human
uggcuccuuggggucugccugcccacccacaugagcccgcgaguauggcagcaggacaagccag

SEQ ID NO: 189045 - RNA, 55 nt, Human
cucacauauugagggagugaccggugcccgcgagacagaaagaacaaugucagcc

SEQ ID NO: 189046 - RNA, 54 nt, Human
aggaccuggagccgcugugacgccgcccgcgagaacgccgccgcggggccgcuc

SEQ ID NO: 189047 - RNA, 60 nt, Human
ucggaaacagaacccucccacagcacauccuacccggaagaccagccucagaggguccuu

SEQ ID NO: 189048 - RNA, 64 nt, Human
acugccaagcacaccucgcucccagcacaccacagcccgcgaccucagggcagggagcagagca

SEQ ID NO: 189049 - RNA, 64 nt, Human
cuccuccacucgcucgggcucaccccaagccccagcccgcgaggccuccccuccgccugauuuc

SEQ ID NO: 189050 - RNA, 64 nt, Human
gcagccugccagggaaucacagagacaucggggugcccgcgauggcccucaugaagccaugccu

SEQ ID NO: 189051 - RNA, 64 nt, Human
uguggaagagugacugcuaagucccuuugcuccugcccgcgagagacugucgggaaguugaccc

SEQ ID NO: 189052 - RNA, 60 nt, Human
cccuucugaacagagccugaggcggaugcagcccgcgacgccagaggaagcacgugcacu

SEQ ID NO: 189053 - RNA, 64 nt, Human
ucuuccagaucugggccaaucauccuggacagaggcccgcgaggcagcuuugcccuguccaccu

SEQ ID NO: 189054 - RNA, 64 nt, Human
gugagcuggggcccacguggcaucgauccucccugcccgcgaagugacaguuuacaaaauuauu

SEQ ID NO: 189055 - RNA, 64 nt, Human
ggucagggcgcgcacagcccagcagcccgaggccgcccgcgacuagcccccaccguaguauuua

SEQ ID NO: 189056 - RNA, 64 nt, Human
ccuguggccaugacccugccucucccaggcaggggcccgcgauguggaacugcugccacugagg

SEQ ID NO: 189057 - RNA, 64 nt, Human
aggcgaggccaccccccuccauccugggggaagcgcccgcgaaaaccguggagagaagccgccg

SEQ ID NO: 189058 - RNA, 64 nt, Human
cauaggaccaacagggucaccaagcagacagggagcccgcgagaaucauucaaaacauccccag

SEQ ID NO: 189059 - RNA, 64 nt, Human
accacgaggcugcuuccgcagggaacccuggccugcccgcgacuucgcaucagggaccgcaugc

SEQ ID NO: 189060 - RNA, 60 nt, Human
ugcgucguuuucaacagcaguggggcuaauuacccggaauacggucucaccgaugcaguu

SEQ ID NO: 189061 - RNA, 60 nt, Human
cuaggaggaaaaagaaaugcauucgguacuuacccggagaaggccgcugccccagccccg

SEQ ID NO: 189062 - RNA, 60 nt, Human
ggcguccucuucagcguagcucuccaccucuacccggaacacacccucucacagacguac

SEQ ID NO: 189063 - RNA, 60 nt, Human
uaaaauuucuucuagugaagaacaaaaugauacccggaagcaacuuuccaaggaacagaa

SEQ ID NO: 189064 - RNA, 60 nt, Human
aaguuguuccccaucuucagccugcaggcauacccggaggcgggcacgaucgagggccug

SEQ ID NO: 189065 - RNA, 60 nt, Human
cacacuucccagaucaccgcaggcggguuuuacccggagagcucugggccguucggccuc

SEQ ID NO: 189066 - RNA, 60 nt, Human
aaauauauauagaauaccagaaaugccguuuacccggagaauuuuuuucuccccauuugu

SEQ ID NO: 189067 - RNA, 60 nt, Human
ggcccuccggauuguggugacaauauguuguacccggacauucccaaauuuaaauuuggc

SEQ ID NO: 189068 - RNA, 60 nt, Human
auuacuucuaccuuagguuuaggaguaauauacccggaaaucuaagcucauggaaacaug

SEQ ID NO: 189069 - RNA, 60 nt, Human
gaaggccgcuuccuuucucagcugaaccccuacccggagcccccagcagggcccuccgag

SEQ ID NO: 189070 - RNA, 60 nt, Human
aucucuaaaaccaguaaaucagccagcgaauacccggaagcaagaugcacaggcgggcgg

SEQ ID NO: 189071 - RNA, 60 nt, Human
uccgagguugcauuuauuuauuuauuuauuuacccggaagcaugugcgcucccgggaggg

SEQ ID NO: 189072 - RNA, 60 nt, Human
aaugccauugauuguuccaugcacugugcauacccggaagaaagaccuauaugaugcggu

SEQ ID NO: 189073 - RNA, 60 nt, Human
gcuggcccugccccaaggacucacugcauguacccggaccccuaggccuggccuuugcag

SEQ ID NO: 189074 - RNA, 60 nt, Human
aaccccgucuauacuaaaaaauucaaaaauuacccggacgugguggcgcaugccuguaau

SEQ ID NO: 189075 - RNA, 60 nt, Human
uuuuuaaaaaugacauauuugguacaaaauuacccggaugugauggcacaugccuguaau

SEQ ID NO: 189076 - RNA, 60 nt, Human
gacccucauuccagagagggugcugccccauacccggaaggaggaacgcugcacagagag

SEQ ID NO: 189077 - RNA, 60 nt, Human
gaaugagugaggaagagcagaguauguggauacccggaaacacacacacacacacaucau

SEQ ID NO: 189078 - RNA, 60 nt, Human
gaguuuagcugaaaugcucaugaguaagaauacccggacuucagauacguuaagcaagca

SEQ ID NO: 189079 - RNA, 60 nt, Human
cacaggaagggacuggugaugggcugucucuacccggagcgugcgggauucagcaccagg

SEQ ID NO: 189080 - RNA, 60 nt, Human
gcugaggggagcugagaggagcugaggugcuacccggagccccauucacccccaccugcc

SEQ ID NO: 189081 - RNA, 60 nt, Human
ggccuggcagggcaguaccacuuggagcgguacccggacaguuacgaguccaugugugag

SEQ ID NO: 189082 - RNA, 64 nt, Human
cccagacccaagugagucacgcuuccugauuccucggcgcaaaggagacguuuauccuuucaaa

SEQ ID NO: 189083 - RNA, 64 nt, Human
cucccaccuuuccccacagggugcccgguccccacggcgcaaggaggccaagcucagcugugug

SEQ ID NO: 189084 - RNA, 64 nt, Human
cuugccugaauggcauccgccaacccagggaccucggcgcaacauaggccuuguccuugcugca

SEQ ID NO: 189085 - RNA, 64 nt, Human
aacagauucucuucuuucccgccucucuccuuuccggcgcaacuuccagaguggugggagacgg

SEQ ID NO: 189086 - RNA, 64 nt, Human
ccucauuuucuguuuauugcugcugcuguguuuucggcgcaacccacaaacccagugaugggua

SEQ ID NO: 189087 - RNA, 64 nt, Human
gccucuccugccccaggaggacaucucacggcugcggcgcaagcuggaaaagcagaggaaggug

SEQ ID NO: 189088 - RNA, 64 nt, Human
uguacuucagugacuucuggaauaagcuggacgucggcgcaaucuugcucuucguggcagggcu

SEQ ID NO: 189089 - RNA, 64 nt, Human
ucccagagccuggggaggccaggguagaggcugacggcgcaagaccagcuuuagccgacaacag

SEQ ID NO: 189090 - RNA, 64 nt, Human
agcacaaccucuuuccccacagugcaauucagaauaugcucagggaaugccagccaccuuguaa

SEQ ID NO: 189091 - RNA, 64 nt, Human
gaugccuugaauauuuauucagugacuucuggcuuaugcucagaagccagucugcgucaggcac

SEQ ID NO: 189092 - RNA, 64 nt, Human
gguguuugggggaacagcugcagaccugcugcucuaugcucacccccgccccauucugggccaa

SEQ ID NO: 189093 - RNA, 64 nt, Human
uucucucccaagccaggucccggcauggguggguuaugcucaugcuggcaauacuugaaacggg

SEQ ID NO: 189094 - RNA, 64 nt, Human
uaguuuucagaauuaugcaaguaauaagugcauguaugcucacugucaaaaauucccaacacua

SEQ ID NO: 189095 - RNA, 64 nt, Human
uaaaauuacauauuugaaacagaagauauuauguuaugcucaguaaauaauuaagagauggcau

SEQ ID NO: 189096 - RNA, 64 nt, Human
uuuaaaaugaguacauauauaggcaauaaauauauaugcucagaucaauauacuuguuuagaaa

SEQ ID NO: 189097 - RNA, 64 nt, Human
aaagcaaaaaauaauuugaaagcccgucuauuccuaugcucaauaaaguuaaguuuuucuucau

SEQ ID NO: 189098 - RNA, 64 nt, Human
ggugggauggggacauuugaacauguuuaauggguaugcucaggucaacugaccugaccccauu

SEQ ID NO: 189099 - RNA, 64 nt, Human
agaaguuccuuugacuaggcugcaaucccaccuauaugcucagcccuaagagcugugguuuccu

SEQ ID NO: 189100 - RNA, 64 nt, Human
aguuaaguagugggugauguaguuacaaagauaauaugcucaguuuggaccuuuuuuucaguua

SEQ ID NO: 189101 - RNA, 64 nt, Human
caaaaaacaaguuucuuguuauccugaaacuuucuaugcucaguggaaaguaucugccagccac

SEQ ID NO: 189102 - RNA, 64 nt, Human
gacagacauuaagcaaacucacaaauacauaaaauaugcucauaaaaggccuuuaugaagaaaa

SEQ ID NO: 189103 - RNA, 64 nt, Human
auuaugccauauuucccuucauuauaguaaaauauaugcucacgaaucaaugcugauuuuuaaa

SEQ ID NO: 189104 - RNA, 64 nt, Human
ggaugugauuauauguacgaaaaucguguaacacuaugcucaugcuaagaaccgacauaacaga

SEQ ID NO: 189105 - RNA, 64 nt, Human
uuucuucagacaaaacugcucuugugcaauauuuuaugcucagugagcaaauuguguauuuaug

SEQ ID NO: 189106 - RNA, 64 nt, Human
ugaggcuuucucuaaaguuuccuuuguauaggaguaugcucacuuaaauuuacagaaagaggug

SEQ ID NO: 189107 - RNA, 64 nt, Human
aauaacauuuuauuuucucuuuccuugcaauaccuaugcucauuuauuuuuuauguuuacccau

SEQ ID NO: 189108 - RNA, 64 nt, Human
uguguccaguggcccacaggacacgccuccaccauaugcucauccuuccugccugaaauugcug

SEQ ID NO: 189109 - RNA, 64 nt, Human
agucuaauacuuuuaaaagcauguguuuuguguauaugcucacaaaaugucugugaagagauuu

SEQ ID NO: 189110 - RNA, 64 nt, Human
uuuagaggggcauaauaauccaggauucuaagcauaugcucagcuauuuuaaagaggaaauuaa

SEQ ID NO: 189111 - RNA, 64 nt, Human
guaaaguuuccaguacuagucccagaauuuagaauaugcucaacacaaaguaaacagcauuaua

SEQ ID NO: 189112 - RNA, 64 nt, Human
aacuucaaaacugugcuugaauagacuaauaauauaugcucauaucagaugucaguuuucauuu

SEQ ID NO: 189113 - RNA, 64 nt, Human
aguagccuuauuuuguugauggaauacuguaucauaugcucaacucugaaaaccuugaacacgg

SEQ ID NO: 189114 - RNA, 64 nt, Human
gugaguuuacauguugaggaaaaaaauggcccaauaugcucaucacugauaaaugcucccuggc

SEQ ID NO: 189115 - RNA, 64 nt, Human
cauuuaauuggaguaucuaaagccaguggcaguguaugcucauacuuggacaguuagggaaggg

SEQ ID NO: 189116 - RNA, 64 nt, Human
gaucuucauggcuguuuccacugaaauggacacauaugcucauguugcuuuuuuuguuuuagaa

SEQ ID NO: 189117 - RNA, 64 nt, Human
cagcacccagcaugcccggcugugccccucuggguaugcucacaugcacauauauggacauaca

SEQ ID NO: 189118 - RNA, 64 nt, Human
uauaugugcauguuuuguuuccucugacuugguauaugcucaucugagugacggauaugugaaa

SEQ ID NO: 189119 - RNA, 64 nt, Human
aaucugcaguuuaacaaaauccucaggugauuuguaugcucauugaacuuuaagaagcaguguu

SEQ ID NO: 189120 - RNA, 64 nt, Human
cagcggcuguuacacuguucuuugccacugugccuaugcucagaauaugcucacugcuaagcua

SEQ ID NO: 189121 - RNA, 64 nt, Human
acacuguucuuugccacugugccuaugcucagaauaugcucacugcuaagcuacaaacucggac

SEQ ID NO: 189122 - RNA, 64 nt, Human
caaucauuguugccucuccguuuauuauaaacuguaugcucacaacuuaguguaauauaccagc

SEQ ID NO: 189123 - RNA, 64 nt, Human
augaaagaaauauuuguuuuauuugccuuauagauaugcucaagguuacugggcuugcuacuau

SEQ ID NO: 189124 - RNA, 64 nt, Human
uguuuauguaugagugugaagaugcuagcgaaccuaugcucagauauucaucguaagucucccu

SEQ ID NO: 189125 - RNA, 64 nt, Human
gaaauguaguggguguaaaaccagagauuauuuguaugcucaaaauaguuauauauucauuaau

SEQ ID NO: 189126 - RNA, 64 nt, Human
aaaaguauuuauuuuuuaaguaggguaucuuaauuaugcucauuucuuccccuaaaccacauua

SEQ ID NO: 189127 - RNA, 64 nt, Human
aagguucaacacugucuacccuaaauaauuuuuauaugcucaaggcaaagcagggaauagaggc

SEQ ID NO: 189128 - RNA, 64 nt, Human
ucucuaaaauuucaacaaguagcuaaagucuggcuaugcucacagucucacaucugguuggggu

SEQ ID NO: 189129 - RNA, 64 nt, Human
gcaguuugaccccauuuggguccugagcaaacccuaugcucaucucucucuccuuccuggggug

SEQ ID NO: 189130 - RNA, 64 nt, Human
agccaccgcgcccgcccugccccuuuccaagagauaugcucagcauaaugagagaucaaccgug

SEQ ID NO: 189131 - RNA, 64 nt, Human
gccaagcagggcuuaggauaucccagccuaccaauaugcucauucgacuaacuaggagggugag

SEQ ID NO: 189132 - RNA, 64 nt, Human
uauaauguaaacggacuuguuaaccuaaccuaauuaugcucaguggacuucuauagaugguuuu

SEQ ID NO: 189133 - RNA, 64 nt, Human
gggguggacuaagaccacccccaaaguuuaaaaauaugcucauucaacuugaaucuucugagga

SEQ ID NO: 189134 - RNA, 64 nt, Human
ugucugcugucuguaauucaguuugcguguauuuuaugcucaugcaccaacccauacagaguaa

SEQ ID NO: 189135 - RNA, 64 nt, Human
uguacacauauguaugcaaguauguauauauguguaugcucagauuaacuuccauagguacaua

SEQ ID NO: 189136 - RNA, 64 nt, Human
gcucugggcuacaccuggcaugacacuugcuuuguaugcucaguguguugugaaaguuuggaag

SEQ ID NO: 189137 - RNA, 64 nt, Human
guaaaugaaaugcugacuucgccucuuccugcuguaugcucaucccugcacugagcacagauau

SEQ ID NO: 189138 - RNA, 64 nt, Human
acaacgggugaucucacaaaacugguaaguuucuuaugcucaugagcccucccuuuuuuuuuuu

SEQ ID NO: 189139 - RNA, 64 nt, Human
cacuguuagagauuugagguuacaugauaugcuuuaugcucauaacugauguggcuggagaauu

SEQ ID NO: 189140 - RNA, 64 nt, Human
guuguaaguaauaucuauuauuauaaaaauaauauaugcucaaccagaaaacuuagaaauaaga

SEQ ID NO: 189141 - RNA, 64 nt, Human
augauuacuauauuuuguucacacuaauaaagcuuaugcucagaaaugccauacacacacacac

SEQ ID NO: 189142 - RNA, 64 nt, Human
uucacuuccuuauuuuauugacuuuucucuccuuuaugcucauuccacauucuucaguuccuuc

SEQ ID NO: 189143 - RNA, 64 nt, Human
cagucugugguacuccuccuaacccuaaacccucuaugcucaggggcuggaacuggggaaugga

SEQ ID NO: 189144 - RNA, 64 nt, Human
aucauguauuuaaaaagaaauauuucucuacuacuaugcucaugacaaaaugaaacaaagcaua

SEQ ID NO: 189145 - RNA, 64 nt, Human
ucuuuuguucuuguaaucccaacuagauaggcuuuaugcucacaucauugucccauacccaccc

SEQ ID NO: 189146 - RNA, 64 nt, Human
ccaacuuauguaggggugaaauuuggauaggcgguaugcucaaagcagccagcaaugagugcuc

SEQ ID NO: 189147 - RNA, 64 nt, Human
uaaagguuucgugucaauucucuagcauacuggguaugcucacacugacggggggaccuaguga

SEQ ID NO: 189148 - RNA, 64 nt, Human
aaaaaauuguauaaucauuaccaauacuauuuauuaugcucaaauauaucuuggcuuugaccuu

SEQ ID NO: 189149 - RNA, 64 nt, Human
acuucgcuuuuguggcaagugacaaagauagcuguaugcucaagugccauguguuuugcuguga

SEQ ID NO: 189150 - RNA, 64 nt, Human
uuuuuuauuuuauguagccaacauugcaguacuguaugcucaaacacaaaucuuaaaguaucgg

SEQ ID NO: 189151 - RNA, 64 nt, Human
ugugccuuauaaauggaaauguaugaacacaauauaugcucauguagaauuuucuguucugggu

SEQ ID NO: 189152 - RNA, 64 nt, Human
ugcagagaggcuugacugccacagcaucuguggcuaugcucagaggguuaugauuuuccuuucu

SEQ ID NO: 189153 - RNA, 64 nt, Human
accucuucauucuccuuuucaguauaaccuccccuaugcucaugcccacacagacaaaaaaaca

SEQ ID NO: 189154 - RNA, 64 nt, Human
auaaaaaugagacuuagaagacagacuggucuaauaugcucacuggucaucacauucagcuuau

SEQ ID NO: 189155 - RNA, 64 nt, Human
caagcuaguuccccaaccuccuaugacugcuuucuaugcucacagccuuuuuuccauaagaacc

SEQ ID NO: 189156 - RNA, 64 nt, Human
ggaauggugucuuacauucauuucuacacuuuauuaugcucaggauugcaccuucuuuacagag

SEQ ID NO: 189157 - RNA, 64 nt, Human
cugguauaacaugccuucaguauacuaacacucauaugcucaguuuuguuuuguuuuggcaguu

SEQ ID NO: 189158 - RNA, 64 nt, Human
caagagcuagagaauugguuuccuugcuucccuguaugcucagaaaacauugauuugagcauag

SEQ ID NO: 189159 - RNA, 64 nt, Human
uucuguggacugcagaugaggccugagcccugccuaugcucaaagccagcaggguugggggucc

SEQ ID NO: 189160 - RNA, 64 nt, Human
aacucagauguacuagauuuucauuguucauugauaugcucaguaugcugccacauaagaugaa

SEQ ID NO: 189161 - RNA, 64 nt, Human
caaucuaaauauuuacauauacccaaaauuaacuuaugcucauauauuaggaugugagaauauc

SEQ ID NO: 189162 - RNA, 64 nt, Human
caucugucugggguuccuuuagucuugaaugucuuaugcucaauuauuugguguugagccucuc

SEQ ID NO: 189163 - RNA, 64 nt, Human
uguaaauccaaaucucuguggcuucaugcuuguauaugcucacagcagggcacaaaauccaaga

SEQ ID NO: 189164 - RNA, 64 nt, Human
cagucaagcaaccacagucuguuaaucauuucucuaugcucagaugucagauccucuuguuauu

SEQ ID NO: 189165 - RNA, 64 nt, Human
guguuauuuacacuguuuuguauuguacaauauauaugcucagcacugcccccuucucugauug

SEQ ID NO: 189166 - RNA, 64 nt, Human
agggaaauauauuugaaauauaaaauauuaaaauuaugcucauuucuauuuuuaaaaauaauuu

SEQ ID NO: 189167 - RNA, 64 nt, Human
ugacugccaauaacauucuucgaucucugggauuuaugcucaugaacuaaauuuaagcuuaagc

SEQ ID NO: 189168 - RNA, 64 nt, Human
gcaguagugaaugagugaaggacuguaaucauaauaugcucacuacuugcucuuguuuuuguuu

SEQ ID NO: 189169 - RNA, 64 nt, Human
cugugaaggaaaauauaaaaaaaaagucgacugcuaugcucaaaaaguaaaaaaagcucaacag

SEQ ID NO: 189170 - RNA, 64 nt, Human
aucccauccucuguuccaaggccccugucugcucuaugcucauuuuuauuuucucuuauucuuc

SEQ ID NO: 189171 - RNA, 64 nt, Human
cuugaagccugaacccaagaugcaagaaggaggcuaugcucaggggcccuggagcagccacccc

SEQ ID NO: 189172 - RNA, 64 nt, Human
gcagcuacauuguugaguuagugaugauauuguauaugcucauggucuuaacuggauuacaaaa

SEQ ID NO: 189173 - RNA, 64 nt, Human
uguagucgcuucccuuuuuaggaagcccuguuaauaugcucauugaaaacauggcauugaagca

SEQ ID NO: 189174 - RNA, 64 nt, Human
ccuacucuccauuuauauucuauggacccaagucuaugcucaguuccacagaaugucaggacca

SEQ ID NO: 189175 - RNA, 64 nt, Human
ugaauaauguuuacauucgucccccggggaaauguaugcucagccaccauucaagagaugacug

SEQ ID NO: 189176 - RNA, 64 nt, Human
cuauaggagaaagaaguucugauaaaccucuuaguaugcucagccuccuucuuugcuauguccc

SEQ ID NO: 189177 - RNA, 64 nt, Human
aucuuuuuuaagggagaaaaaucucaaccaaaguuaugcucauccagacaagcugaccuuugag

SEQ ID NO: 189178 - RNA, 64 nt, Human
guacuaaauucauuaucguuaagcaaauguacaauaugcucaggcaccgcagagagcugggcac

SEQ ID NO: 189179 - RNA, 64 nt, Human
aauuaugguauauuuuauguaacauuuuaauguuuaugcucauaaaacuuagugaacacacugu

SEQ ID NO: 189180 - RNA, 64 nt, Human
cauccagauguguuggaagcuuccccuccugccuuaugcucaccuguggacaccgaggaugccc

SEQ ID NO: 189181 - RNA, 64 nt, Human
gcugaguugugucuccauuuugauaaggaaaggauaugcucagacucuugcuuguucagauucc

SEQ ID NO: 189182 - RNA, 64 nt, Human
cucacuauguugcccagggcuggucuugaacuccuaugcucaagugauccucccaccucagccu

SEQ ID NO: 189183 - RNA, 64 nt, Human
ccaauucaaugaucuauaacaacagagcaaagucuaugcucauuugcagacuggaaucauuaag

SEQ ID NO: 189184 - RNA, 64 nt, Human
ggcucugugauuuggcaaucuauuucuugcaguauaugcucaucuuuauggaaaaagcuuugug

SEQ ID NO: 189185 - RNA, 64 nt, Human
gaauuuauuucuuauaccaacagguauaugaaaauaugcucaauaucacuaauaacugggaaaa

SEQ ID NO: 189186 - RNA, 64 nt, Human
uaaaacuaauuucuagcuaauuguuaauuauaauuaugcucagaagucuauuuaaugagcucug

SEQ ID NO: 189187 - RNA, 64 nt, Human
caggggaagcacccucuuucuuucuagacuggauuaugcucacaugcucccuugcccugacauu

SEQ ID NO: 189188 - RNA, 64 nt, Human
uucaaauggccacauauuuucaagauauuuuuguuaugcucaggaaucucuuguauauuuuacu

SEQ ID NO: 189189 - RNA, 64 nt, Human
guuuuuugcucacugucacauucccagcaccuaguaugcucaguaaauguuuguggaauaagug

SEQ ID NO: 189190 - RNA, 64 nt, Human
cacuagggagaaauuuaucagcuuuaguucuaaauaugcucaugagguauaaaagcuauuucuu

SEQ ID NO: 189191 - RNA, 64 nt, Human
aaucuucaacuucagacauauauuuguguguuuauaugcucacagguggacugagaaaucaguu

SEQ ID NO: 189192 - RNA, 64 nt, Human
augucagugcugcugugaacuaaaguaugucauuuaugcucaaaguuuaauucuucuucuuggg

SEQ ID NO: 189193 - RNA, 64 nt, Human
uuauaauuaaaucaugugauauuccacguuuggauaugcucauuuaauuucuacagaaaaaauu

SEQ ID NO: 189194 - RNA, 64 nt, Human
uuguugccguuugaaguaaaaaauuuccaaaauguaugcucaacaauaaucauuaaaauguuug

SEQ ID NO: 189195 - RNA, 64 nt, Human
uuuuauuuuuguuuucuuaaugauguuaagcauuuaugcucacuggaaacaaacaaaaagcagc

SEQ ID NO: 189196 - RNA, 64 nt, Human
aaaagaauuuuacaaaugcuuuccaagugaugaauaugcucaguuaauuucauaugcuccugga

SEQ ID NO: 189197 - RNA, 64 nt, Human
guuuacaagcaugucucaagcuaguguguuccauuaugcucacagcaguaaaugccuaccucug

SEQ ID NO: 189198 - RNA, 64 nt, Human
caagucaccuccaguaacaagauggcaaaccaaguaugcucagauaagcuuuuuucauaauuca

SEQ ID NO: 189199 - RNA, 64 nt, Human
gggcuccucguaugcauggaacccccagaauaaauaugcucagccacccugugggccgggcaau

SEQ ID NO: 189200 - RNA, 64 nt, Human
uuauaauuuuguuggggguuaauuuuaugaaaauuaugcucaauaagaguuguauauuuaauau

SEQ ID NO: 189201 - RNA, 64 nt, Human
gcuggcugagccuauggccaaugaguauuccugcuaugcucagggccaaggaagacaaaucuag

SEQ ID NO: 189202 - RNA, 64 nt, Human
gugcgguucgggcaaagccgggguagaccugggcuaugcucaguuagggguugcgggauccccg

SEQ ID NO: 189203 - RNA, 64 nt, Human
accguuaauucagcaacccucaguacauacuaaguaugcucagugcugugaaaguggauuacac

SEQ ID NO: 189204 - RNA, 64 nt, Human
cagauuuucuggagguaugacaauaguauuuuuuuaugcucagauuaaaaaucagcuuuucacc

SEQ ID NO: 189205 - RNA, 64 nt, Human
aggggcccacucccagcugggagaguguaggggauaugcucacaccacauuagcagcaaccaau

SEQ ID NO: 189206 - RNA, 64 nt, Human
cuuaaguauaacuaauuugcucugugguaagagauaugcucauuauuaccacuuagaagauguu

SEQ ID NO: 189207 - RNA, 64 nt, Human
aauggguccacgucauucaaggaccugaauuuuuuaugcucaggagcauuggaauccucuucuu

SEQ ID NO: 189208 - RNA, 64 nt, Human
cgccugcugcucccagguggccugcggccacugcuaugcucaaggaccuggaaacccaugcuuc

SEQ ID NO: 189209 - RNA, 64 nt, Human
guauaugaugaucuggauccaccaagacuuguuuuaugcucagggucaauuucuuuuuucuuuu

SEQ ID NO: 189210 - RNA, 64 nt, Human
ccaaccaauucuuggauugaguuuggccuccaaauaugcucaccaaacacuauguugcuacccu

SEQ ID NO: 189211 - RNA, 64 nt, Human
cucacccuuuccuuccugggggucuguuccuuccuaugcucacccagagaacucucugaugugc

SEQ ID NO: 189212 - RNA, 64 nt, Human
acagcaaugaaucugacaauguuuuucaaaaauguaugcucaggguuauuuguuucaagucaua

SEQ ID NO: 189213 - RNA, 64 nt, Human
caacuuucauacugacgcgucuguaaucuguucuuaugcucauuuuguauuuuccuuucaacuc

SEQ ID NO: 189214 - RNA, 64 nt, Human
aguauauaucaaacaugugcugagggugacaggauaugcucacuuaaauuguugaaaaccauaa

SEQ ID NO: 189215 - RNA, 64 nt, Human
aaagaauugcagcccugagguccauggguugacuuaugcucacaaauauguuucguuugcucaa

SEQ ID NO: 189216 - RNA, 64 nt, Human
uucccgacuucuuugcuuugggagaauuuggucuuaugcucauaagcaguucaugagugacaag

SEQ ID NO: 189217 - RNA, 64 nt, Human
gcaugcguugccuccugagaucgaggcugcaggauaugcucagacucuagaggcguggaccaag

SEQ ID NO: 189218 - RNA, 64 nt, Human
acuacaagugcaaacaauguggcaaaacuuaauuuaugcucacaccuuacugcacagaaaagaa

SEQ ID NO: 189219 - RNA, 64 nt, Human
gccccauuuacugaccccgcccccuuuucgagguuaugcucaccuggucagcuccucacguaau

SEQ ID NO: 189220 - RNA, 64 nt, Human
ucccuacccccagcugacacuggaccccaacauguaugcucaguagcugcucuggcuucuguga

SEQ ID NO: 189221 - RNA, 64 nt, Human
gauaggcgaugcagacucgcgauucaaugaucgauaugcucauaaaagugcucaauuauauuuu

SEQ ID NO: 189222 - RNA, 64 nt, Human
ggcccgacucggcgguuugcggaggaugcagggauaugcucacagcgcccgacacaacccccuc

SEQ ID NO: 189223 - RNA, 64 nt, Human
gcauucacuuaauaaagacacuguuaagcacuguuaugcucagucauacacgcgaaagguacaa

SEQ ID NO: 189224 - RNA, 64 nt, Human
cugagauaaccaguauguguauuucuucuuccuuuaugcucaaacaaccuguacacagaaagca

SEQ ID NO: 189225 - RNA, 63 nt, Human
ugggguugggcguuagaauucauaaaagucuuuauaugcucagauucugcagcuccauccucu

SEQ ID NO: 189226 - RNA, 64 nt, Human
uugugcuguucacucccauucuccccuacaguuuuaugcucagacauggaggucagagccacaa

SEQ ID NO: 189227 - RNA, 64 nt, Human
cugccugagagcccugaggugacaauaaaacauuuaugcucaaggggaagccacagccugcuga

SEQ ID NO: 189228 - RNA, 64 nt, Human
cacugguaagcagacacugcacugaaccaacugcuaugcucagaauguaccagaaacccaaaca

SEQ ID NO: 189229 - RNA, 64 nt, Human
guauuuuuaaauuucaugccuuuaauauuucaaauaugcucaaauuuaaacugucagaaacuuc

SEQ ID NO: 189230 - RNA, 64 nt, Human
gggaagugacaccaguucuuuuaaaauaaauuuguaugcucaauuauuuugcauuuuuucuuuu

SEQ ID NO: 189231 - RNA, 64 nt, Human
ccagaaaacacauuucugguuuauaaucuccuuuuaugcucaccugacauuaauuaucuauccu

SEQ ID NO: 189232 - RNA, 64 nt, Human
ggaugggggaaucagcaggugucagcgugcccuguaugcucagggcagcuguuuccacuggaca

SEQ ID NO: 189233 - RNA, 64 nt, Human
aauaccccacacauuccccagccucucugcccaguaugcucauccacaggguuuucucacugcu

SEQ ID NO: 189234 - RNA, 64 nt, Human
uuucucuuauguuccaaguacacaauaguaagauuaugcucaauauucucagaauaauuuucaa

SEQ ID NO: 189235 - RNA, 64 nt, Human
uuucucuuauguuccaaguguacaagaguaagauuaugcucaauauucccagaauaguuuucaa

SEQ ID NO: 189236 - RNA, 64 nt, Human
ggcuaaucucaggacugggaagauuacggcgaauuaugcucaauggucugauuuuaacucaccc

SEQ ID NO: 189237 - RNA, 64 nt, Human
auggggcccauaaaaauucccaguaugcauguuuuaugcucaccauuaugaauuggggucuuca

SEQ ID NO: 189238 - RNA, 64 nt, Human
uuuggguuuuuuaaaaauuguuuuuggagggguuuaugcucaauccauguucuauuucagugcc

SEQ ID NO: 189239 - RNA, 64 nt, Human
ggcuaaaguaacuugaccauauuugaugcuuuucuaugcucauuucaacuuggcuuuuugucuu

SEQ ID NO: 189240 - RNA, 64 nt, Human
cagaugagagaacccagaaauaaacccauauaaauaugcucagcugauuuugaaaaagugaaaa

SEQ ID NO: 189241 - RNA, 64 nt, Human
agcacugugcugcacaacuccaggaacuccaugguaugcucacaauuuucugcaaguugccucc

SEQ ID NO: 189242 - RNA, 64 nt, Human
ccuccuggcaucacagggcaaccguugucaaggcuaugcucacgggaggcugggcaccacagug

SEQ ID NO: 189243 - RNA, 64 nt, Human
agacuucacaguuuucuacagguguauuucuugcuaugcucagugggaaccagggagcagaaaa

SEQ ID NO: 189244 - RNA, 64 nt, Human
uuauauuuaucuguaccuucuuugcuacuuaaaauaugcucacaguuuguagucauguagaaaa

SEQ ID NO: 189245 - RNA, 64 nt, Human
aaggagggcauguucaguuuucugugaauuaaaauaugcucaugugugggcacacacgcacaaa

SEQ ID NO: 189246 - RNA, 64 nt, Human
gugcaguggugcaugcacugucucagccaacccgcuccacuacccggcaggguacacauucgca

SEQ ID NO: 189247 - RNA, 64 nt, Human
acuauaguuuuauuacagcauaauucauuuugagcuccacuaugacauuucaaagacugcccag

SEQ ID NO: 189248 - RNA, 64 nt, Human
cugagccugcuuuugugauugcucauccauuguccuccacuagaggggcuaagcuugacugccc

SEQ ID NO: 189249 - RNA, 64 nt, Human
ggugguauggauuuucaacuggccaacccuuugccuccacuauugaauuuuuuucagaccccca

SEQ ID NO: 189250 - RNA, 64 nt, Human
uagaguccccccgaccagauccuuuuccaucccacuccacuauguugucuauuuuuucugagga

SEQ ID NO: 189251 - RNA, 64 nt, Human
gucagguuaaugcuaaaucagugcggaaauauagcuccacuaggaaaauauuauuaaauuuaua

SEQ ID NO: 189252 - RNA, 64 nt, Human
acggacagaacgguucuuguauauuuaaacugaucuccacuaugaagaaauuuaggaacuaauc

SEQ ID NO: 189253 - RNA, 64 nt, Human
aguucuugccccuacucuccaacucacuucccuccuccacuacuccaggcagguucagucuucu

SEQ ID NO: 189254 - RNA, 64 nt, Human
gaggcucugaagagauacccacagaguguggucccuccacuaggaguuaacuacccuacaccuc

SEQ ID NO: 189255 - RNA, 64 nt, Human
agggcccauuucaucauagccuccuucccccgugcuccacuacaaucgccgcauucuuucuagc

SEQ ID NO: 189256 - RNA, 64 nt, Human
ggcucacggugggcugucuggggagggugggugccuccacuaugauccuuaaaggauuccucug

SEQ ID NO: 189257 - RNA, 64 nt, Human
ccagaccagucugggaaacaaagcgagacccugucuccacuaaacauaaaaacaaaauuacugg

SEQ ID NO: 189258 - RNA, 64 nt, Human
uucaguccaaauggaagaauauugggaaauaaaccuccacuauccuuuauagccagggacuuuu

SEQ ID NO: 189259 - RNA, 54 nt, Human
ugcccccugucaacacaugagaacggaccacacccucucuccccagcauggaug

SEQ ID NO: 189260 - RNA, 64 nt, Human
aaaagaacuguguggagccuggaaaaaaaaauuaggaccacaugugagauguuuacaagacacc

SEQ ID NO: 189261 - RNA, 64 nt, Human
aagcuugaccugcacaaaugccauauuucuauuuggaccacauauucuccauuuugcauugagc

SEQ ID NO: 189262 - RNA, 64 nt, Human
cccuggcugccaaaacugcucagcaguugggccacuccacuauuccaccucucuaaaagaaggu

SEQ ID NO: 189263 - RNA, 64 nt, Human
ucagagauaaggaaaaauauuuugcacagauuuacuccacuauggaaaagggaugcuguagguu

SEQ ID NO: 189264 - RNA, 64 nt, Human
caagaccagccuggccaacauggugaaaccccgucuccacuaaaaacaaaaacaauuagcuggg

SEQ ID NO: 189265 - RNA, 64 nt, Human
gcaucuccagugcuccccaauuauaucucccccacuccacuacucucuuccuccacuucauuuu

SEQ ID NO: 189266 - RNA, 64 nt, Human
guuuuugcuggaucugcucccucucgcucucucacuccacuacuuuuuggaacaaagugauggc

SEQ ID NO: 189267 - RNA, 64 nt, Human
caagaccauccuggcuaacacagugaaaccccgucuccacuaaaaaauacaaaaaaauuagcca

SEQ ID NO: 189268 - RNA, 64 nt, Human
aaagucaaugugagcuucucacagguuuuuaaagcuccacuaaaaauaauuauccacuugucuu

SEQ ID NO: 189269 - RNA, 64 nt, Human
ccuaacugccuguccucugguuaggccccucccucuccacuaguggugaaugcaugugucuguc

SEQ ID NO: 189270 - RNA, 59 nt, Human
ggaggaagaucuccagauaacagagacuacuccacuaaugcgcaguguuuauuaaagga

SEQ ID NO: 189271 - RNA, 64 nt, Human
aaagaacucaccacaagccaccuuuuguaguguucuccacuaauacugguuauccugugcuaca

SEQ ID NO: 189272 - RNA, 64 nt, Human
aguaaaagaacaaaacuuuugcugaggucuuggacuccacuacuuguuaguuauguuggccugg

SEQ ID NO: 189273 - RNA, 64 nt, Human
gggggauugggauggggguauguguggauuuuuccuccacuaaaucugcaggaaacauguugaa

SEQ ID NO: 189274 - RNA, 64 nt, Human
uggggucuggaggacgguggcccucuucucacagcuccacuaggcagugccccaguagggacuc

SEQ ID NO: 189275 - RNA, 64 nt, Human
gaucuucuguggugcuuaaggaaacuuacuagagcuccacuaacagucucauaaggaggcagcc

SEQ ID NO: 189276 - RNA, 64 nt, Human
aaacuuuggaaauguuaauguucagacugaaaaucuccacuacauguaacuuucuuccucugga

SEQ ID NO: 189277 - RNA, 64 nt, Human
ucaccuuaaggguuaauaauguagagaggagggaggaccacauugaugaccagaaccuacuggu

SEQ ID NO: 189278 - RNA, 64 nt, Human
aagaagaagaugaugacuaagcaguacucugaauggaccacaguguuugcacauauuugcaauu

SEQ ID NO: 189279 - RNA, 64 nt, Human
uguauaggacuugaaaaaggaagcccuacuucugggaccacauuuuacgaccaccuagcugagu

SEQ ID NO: 189280 - RNA, 64 nt, Human
gccggcuuuauuaacaaaaacucuaacaagucaccuccacuaugugggucuuccuuuccccuca

SEQ ID NO: 189281 - RNA, 64 nt, Human
gauuugauguuuuuuuuuagauuuauuuuucuuacuccacuaaacuauaaagaaaauaauuacu

SEQ ID NO: 189282 - RNA, 64 nt, Human
uugcucuucuagacaacucacaucaaagcccucacuccacuaauggagaauccuagccccacua

SEQ ID NO: 189283 - RNA, 64 nt, Human
uugcaucauuugucuaggaucuaugcaaauauagcuccacuaaaggaccauagggaagagccag

SEQ ID NO: 189284 - RNA, 64 nt, Human
cagacccaaggcaccucaggucucuuugcugugccuccacuauauugucguguggguguguguc

SEQ ID NO: 189285 - RNA, 64 nt, Human
caagaccagccuggccaacauggugaaaccccgucuccacuaaaaauacaaaaauuagccgggc

SEQ ID NO: 189286 - RNA, 64 nt, Human
cgagaucagccugaccaacauggugaaaugccaucuccacuaaaaauauaaaaauuagccaggc

SEQ ID NO: 189287 - RNA, 64 nt, Human
agcuuaguugauguguguguguguguucugauuacuccacuaacugaugguuccccaucucucu

SEQ ID NO: 189288 - RNA, 64 nt, Human
gcuccaaaacgaaagcaagcauuucacuggcagccuccacuagaauuuggugaagaggaggagg

SEQ ID NO: 189289 - RNA, 64 nt, Human
gccucugaaguaucuuucuacaaacgcagacaagcuccacuaccccuaaccugccaggaugcuc

SEQ ID NO: 189290 - RNA, 64 nt, Human
cuguuacagucagcccaggagguuacagugagcucuccacuaagaaucuggaagaaaugcauca

SEQ ID NO: 189291 - RNA, 64 nt, Human
uccuauuccuuccucuuuaucucacaauuuuugucuccacuaagcaagaaguaaacuaacacuu

SEQ ID NO: 189292 - RNA, 64 nt, Human
gaagauauugaaaaagaaagacauuaugcccuuucuccacuauagccaacacucagucaagcag

SEQ ID NO: 189293 - RNA, 64 nt, Human
cugaaauauucauguuuuccuuuuguagucccaucuccacuauuuagaaauguucucagacuuu

SEQ ID NO: 189294 - RNA, 64 nt, Human
acauccccaaggugaggggguggagucuggucugcuccacuaaccagggucuccuccuccucuu

SEQ ID NO: 189295 - RNA, 64 nt, Human
auacguucagaggugcagcuggaggcugcuguggggaccacacugauccuggagaaaagggaug

SEQ ID NO: 189296 - RNA, 64 nt, Human
agcuauccuuccaccuccgccuccugaguagcugggaccacagguucacauaaccaugccuggc

SEQ ID NO: 189297 - RNA, 64 nt, Human
gaguucaaguuccuuugcauucgauuguccaucgggaccacacuaggaagcugcagagagugau

SEQ ID NO: 189298 - RNA, 64 nt, Human
cuguuuuaaaauaucuuccugcacuggcuaaaaccuccacuauaauguugagcagaacagugag

SEQ ID NO: 189299 - RNA, 64 nt, Human
cgagaccagccuggccaacauggugaaauccugucuccacuaaaaacacaaaaauuagucaggc

SEQ ID NO: 189300 - RNA, 64 nt, Human
aacuggaaugaaagaauaguuugauucagaccugcuccacuauguguugcuaaaacacaugcua

SEQ ID NO: 189301 - RNA, 64 nt, Human
caugaccagccuggccagcaugguaaaacccugucuccacuaaaaauacaaaaauuagccaggc

SEQ ID NO: 189302 - RNA, 64 nt, Human
agccugccagauaauccacaugcucccuccccagcuccacuaagauuuucacuuuagccauauu

SEQ ID NO: 189303 - RNA, 64 nt, Human
uaccuguacagugagaugcucagugggcucaauccuccacuacaggucccgguaccugaggaac

SEQ ID NO: 189304 - RNA, 64 nt, Human
acucaccaggccauuuagaaguuuuaaauaaugccuccacuauuuuuuuucuuagacauagcuu

SEQ ID NO: 189305 - RNA, 64 nt, Human
aucauuguuuacacauggggaucagagcagacuucuccacuacugugcaauagagauacagcuc

SEQ ID NO: 189306 - RNA, 64 nt, Human
uuugacuguugagaauuuuacugccgaaguuuaccuccacuaguucuuuguagcagaguacaua

SEQ ID NO: 189307 - RNA, 64 nt, Human
gggagucugcuccaagcagacacugguggucccgcuccacuacaacgaguccuacagccaacca

SEQ ID NO: 189308 - RNA, 64 nt, Human
ccugccagguagcuagaucugcaggcgugacccacuccacuaggcccuuuuucugguuucuuga

SEQ ID NO: 189309 - RNA, 64 nt, Human
gcuuuaucccuacuaggcuugcuccacuuucauccuccacuauagauacaacggacuuugacua

SEQ ID NO: 189310 - RNA, 64 nt, Human
acacuccucugcugaggaugucuacauugaaagccuccacuaguuucaucguuugucaaaguuc

SEQ ID NO: 189311 - RNA, 53 nt, Human
uggagaugucauccaccugagaacuccacuacccuuuucccucccagaccacg

SEQ ID NO: 189312 - RNA, 64 nt, Human
guuucccuccuucccaaaagagugguucugcuuucuccacuaccccaagguugcagacucucuc

SEQ ID NO: 189313 - RNA, 64 nt, Human
agaugggguggagggggccaccggggcagggagggggcggcaaggggggaaugggaguugucuc

SEQ ID NO: 189314 - RNA, 64 nt, Human
caauuguguccauucugaggucucuccagugggagggcggcagcuccugucccuggguucaggc

SEQ ID NO: 189315 - RNA, 64 nt, Human
acaagaggcucaacuucaucacugaguacaucaagggcggcacgcuccggggcaucaucaagag

SEQ ID NO: 189316 - RNA, 64 nt, Human
caucgacgugaagucccacguguccggugugcuugggcggcaucgcaucaacgcgcagaccuaa

SEQ ID NO: 189317 - RNA, 64 nt, Human
cugguuuuauuuuucucccaggccagaaguauuacuccacuagaucaccuuacuuaauugggca

SEQ ID NO: 189318 - RNA, 64 nt, Human
cgagaucagccuggccaacauggcgaaaccccgucuccacuaaaaaugcaaaaaaaaaauuaac

SEQ ID NO: 189319 - RNA, 64 nt, Human
ugcugguuaaggaacaggaagccugaccaucucccuccacuaccucuucccugugcuguuacac

SEQ ID NO: 189320 - RNA, 64 nt, Human
cagaauuuuuaaggaauagaacuccaagccuuuucuccacuacuauacaagaaagaauucagca

SEQ ID NO: 189321 - RNA, 64 nt, Human
gcccaaaggaaauaaaauccuaucuaauccuacucuccacuacacagagguaaucacuauuagu

SEQ ID NO: 189322 - RNA, 64 nt, Human
agccccuauuuucagggguagugagaggguguggcuccacuaauuuccaguuuguuuuucuauu

SEQ ID NO: 189323 - RNA, 64 nt, Human
aacuguaaacagucacacucccauuaccccccuucuccacuaaaaacaauaaucccaaagugag

SEQ ID NO: 189324 - RNA, 64 nt, Human
cagguggccugggagguggcccccucgaggaugacuccacuagcgcccugggaccccaaguaug

SEQ ID NO: 189325 - RNA, 64 nt, Human
gaguuggaaguggacagccuaauuuuuaucucaccuccacuaggacuuugaccuucccaggggu

SEQ ID NO: 189326 - RNA, 64 nt, Human
ggaccuacagugaugagaauuuaaugauuaucuccuccacuauaauccucuuuagggugauuuu

SEQ ID NO: 189327 - RNA, 64 nt, Human
gacaguucccucgaauuuuuggaaaggugcucuucuccacuaacucgaucuucugggaguucuc

SEQ ID NO: 189328 - RNA, 64 nt, Human
uaaugagguacgcugaggccugggagucucuugacuccacuacuuaauuccguuuagugagaaa

SEQ ID NO: 189329 - RNA, 64 nt, Human
cgagaccagccuggccaacauggcggaaccccaucuccacuaaaaguacaaaaaauuagcuggg

SEQ ID NO: 189330 - RNA, 64 nt, Human
uacugucuuguguaaauauauucaaggaaaacaccuccacuaccucacugacuucauaauugga

SEQ ID NO: 189331 - RNA, 64 nt, Human
aaugaauaagacuacuucuaauguaacuaagcaucuccacuauggugugugccuuuuauaaagg

SEQ ID NO: 189332 - RNA, 64 nt, Human
agaagaggccauagcugcuccagccggggcuccggggcggcagcagagcuggcacaccgauucu

SEQ ID NO: 189333 - RNA, 64 nt, Human
gguacaucgugagcaaggagccugcauucccagggggcggcagggacagcauguaaggucuuag

SEQ ID NO: 189334 - RNA, 64 nt, Human
gugggcagcuguggcagagcagcgacccgcggcggggcggcauccccagcugguucgggccgug

SEQ ID NO: 189335 - RNA, 64 nt, Human
ccacgugcagguggagcucugggaugcuauguuggggcggcaagcggugggccgagggccgggu

SEQ ID NO: 189336 - RNA, 64 nt, Human
ucgucauuggaggugaacaagcaaacccagacggcuccacuaggacuucaaauuggggguugga

SEQ ID NO: 189337 - RNA, 64 nt, Human
uauguggccguagcauguuacaguucaaacaugucuccacuacccuguuaagagcagccuggga

SEQ ID NO: 189338 - RNA, 64 nt, Human
cgaagguaccaacaaguuaauaacgucaccuacucuccacuaauagaugcuaugcuaagagaag

SEQ ID NO: 189339 - RNA, 64 nt, Human
ccugccugcauccccgagcaccccacccuccaggcuccacuaaggagggaggggcugucugcag

SEQ ID NO: 189340 - RNA, 64 nt, Human
ggguguguggggaagucacugucccacuaugggucuccacuacccagucacugacccugggaga

SEQ ID NO: 189341 - RNA, 64 nt, Human
aggagaguauuggaaaaggaauccagaagacccucuccacuacucaggcagccacuauucaucu

SEQ ID NO: 189342 - RNA, 64 nt, Human
cccagggugcccugaggccccaggcagcugcugccuccacuaucgaugccuccugacugcacac

SEQ ID NO: 189343 - RNA, 64 nt, Human
uaaagguucuggggcugggccugagccuaacucccuccacuaccgcuauuucuccuuggauggc

SEQ ID NO: 189344 - RNA, 64 nt, Human
uucuuccucacuaugacacugagcaagaucuugucuccacuaaaugagcuccugcgggaguagu

SEQ ID NO: 189345 - RNA, 64 nt, Human
ugggugucaagagcccuguguuccauucuggcuccuccacuaaauugcugugugacuucaggca

SEQ ID NO: 189346 - RNA, 64 nt, Human
cagacagauugccuucagaagaguggaagaaaaucuccacuaucaaugaacccagacucuuguc

SEQ ID NO: 189347 - RNA, 64 nt, Human
uuucaucugguugugacucuaagcucagugcucucuccacuaccccacaccagccuuggugcca

SEQ ID NO: 189348 - RNA, 64 nt, Human
aguuauuaaaagcuguuuaauuuuuccuagaaaacuccacuacagaaugacuuuuagaagaaaa

SEQ ID NO: 189349 - RNA, 64 nt, Human
accacugccucaugcuuccuggggccuccagcagcuccacuaauggaggagaggcaguagccuc

SEQ ID NO: 189350 - RNA, 64 nt, Human
auuucaggggagucaaaaaccuugcaacuuccuucuccacuaacccaggacuaaaaauggacag

SEQ ID NO: 189351 - RNA, 64 nt, Human
cuccuaccuggggacuccucaaaccacuugccuggggcggcaugaacccucuugccauccugau

SEQ ID NO: 189352 - RNA, 64 nt, Human
ccgggcguggaccacccgcccuggcaguugaauggggcggcaauugcggggcccaccuuagacc

SEQ ID NO: 189353 - RNA, 64 nt, Human
uguguggucguuccaaacugccccagggcuuugggggcggcacuugggguuucugggaaugaca

SEQ ID NO: 189354 - RNA, 64 nt, Human
cacgagaaaagccaguggagaaagcgcccuuccagggcggcagcagcgggagccacgcagaccc

SEQ ID NO: 189355 - RNA, 64 nt, Human
ucuuucuaugauaagaggguuguguugguggcaccuccacuacucuuuucuguuuguugaguuu

SEQ ID NO: 189356 - RNA, 64 nt, Human
aaggaagacaaaguuuaacaccuucacucaagcacuccacuaauauauuuacguugcauucaga

SEQ ID NO: 189357 - RNA, 64 nt, Human
aggguggaaacacucugaucugaagcccagcugacuccacuacuaauuugcuguaaagcuuugg

SEQ ID NO: 189358 - RNA, 64 nt, Human
aaaaccgaccggacaucuagcgggcaggggaagacuccacuaaagacuuccacaaagaccuccc

SEQ ID NO: 189359 - RNA, 64 nt, Human
cuuggcuccuaacucuggaucugucuuaaggugucuccacuagcaaucugagugauggaaucuu

SEQ ID NO: 189360 - RNA, 64 nt, Human
guguguauauuuguaauauaugauauuuuucaugcuccacuauuuuauuaaaaauaaaauaugu

SEQ ID NO: 189361 - RNA, 64 nt, Human
ugcuuauaauguaguacaauuaaaaacaacacaucuccacuaccagugcuaacccauuuuuaag

SEQ ID NO: 189362 - RNA, 64 nt, Human
ccucugucucuggggcucaucuuacuaguauccccuccacuaucccaugggcucucucugcccc

SEQ ID NO: 189363 - RNA, 64 nt, Human
ggacucaauuugaaguacuaaugcuucucaaguucuccacuaugagaguuacccuguauuagac

SEQ ID NO: 189364 - RNA, 64 nt, Human
uccuaccccucuuaaaacucaguucagguagcagcuccacuaggaagccuuggcugaccauaau

SEQ ID NO: 189365 - RNA, 64 nt, Human
auuugaugaaggugaauauuuuauaaauuagaaucuccacuacuuauccaaugguguuuuauuu

SEQ ID NO: 189366 - RNA, 64 nt, Human
uaguagcugggugagaccuguccgcccaccuucccuccacuacagaaccugcagccgcaaaucc

SEQ ID NO: 189367 - RNA, 64 nt, Human
auuccuaguuccauaccuuugcacaugcccuacucuccacuaauuauacuuaaaaguccaaaaa

SEQ ID NO: 189368 - RNA, 64 nt, Human
gccugcccaugaagcccuggaauuccagcuccaccuccacuaccacuccaagccuggccccacc

SEQ ID NO: 189369 - RNA, 64 nt, Human
ucuaauagcucaguguggcugagaaagugcggaacuccacuaaaaacucugaaacuucaguaua

SEQ ID NO: 189370 - RNA, 64 nt, Human
cuuuucuagcugaauaaaccacaucaaaggaaagggaccacaguauuugaauguuugaaagucu

SEQ ID NO: 189371 - RNA, 64 nt, Human
aucccugaccuccuggagacaccaccugcuuuccgggcggcacugugaugggagcugguggcga

SEQ ID NO: 189372 - RNA, 64 nt, Human
uggaggcacacagcugcagagacagagaggacgugggcggcagagaggacuguugacauccaag

SEQ ID NO: 189373 - RNA, 64 nt, Human
gcuuucagccucugggucugagucauggccgggugggcggcacagccuucuccacuggccggag

SEQ ID NO: 189374 - RNA, 64 nt, Human
cauccagccccaggcacgccaccugcuccugagccuccacuaucucccugugacgggugaacuu

SEQ ID NO: 189375 - RNA, 64 nt, Human
cugcuuguucucucaccccuaacccuaguaguuccuccacuaacuuucucacuaagugagaaug

SEQ ID NO: 189376 - RNA, 64 nt, Human
ucauuuucuuccauuacuuaggaaagaguggaaacuccacuaaaauuucucuguguuguuacag

SEQ ID NO: 189377 - RNA, 64 nt, Human
ccugggcuggcuccugccgccucuucccuaccuccuccacuagccgcaggaagggccuccagca

SEQ ID NO: 189378 - RNA, 64 nt, Human
uaggacugauggucaucuucaugacaggcggcaucuccacuaagccuguguaacuguucccucu

SEQ ID NO: 189379 - RNA, 64 nt, Human
cagugccaccuaccaagcugugaaacuaaaccuucuccacuaaacgucguuagggccucaguuc

SEQ ID NO: 189380 - RNA, 64 nt, Human
aggcaccugugacacgagugcugcucuccaggaucuccacuacauguuccagguuggagugagg

SEQ ID NO: 189381 - RNA, 64 nt, Human
caagaccagccugaccaacguggagaaacuccgucuccacuaaaauacaaaauuagcugggugu

SEQ ID NO: 189382 - RNA, 64 nt, Human
uugcuguuaacaauaauucucccggccaucuccacuccacuacucaaaaaugccugaauccuug

SEQ ID NO: 189383 - RNA, 64 nt, Human
uuaugaugauuauuguuauuaauaauuauuguuacuccacuaauauuuagcuagccuacaugua

SEQ ID NO: 189384 - RNA, 64 nt, Human
gauucuugggauuuggggguuuucucccccaccucuccacuaguuggaccaagguuucuagcua

SEQ ID NO: 189385 - RNA, 64 nt, Human
gggugagcgaagcccccacuacuaaauggccucucuccacuaccccgacuaucccugcacauaa

SEQ ID NO: 189386 - RNA, 64 nt, Human
ucaggcuggaggaggagggauuaagauccccuugcuccacuaaggcccaagcucuuucucucgg

SEQ ID NO: 189387 - RNA, 64 nt, Human
caagaccagccuggccaacauggugaaacccuaucuccacuaaaaauacaaaauuagcugggug

SEQ ID NO: 189388 - RNA, 64 nt, Human
gaccuuuguucacuuguugaucugcugaccuucccuccacuauuguccuaugacccugccaaau

SEQ ID NO: 189389 - RNA, 64 nt, Human
cgccauucuccugccucagccucccgaguagcugggaccacaggggcccaccaccgcgcccggc

SEQ ID NO: 189390 - RNA, 64 nt, Human
ucuagccuacagagaacauacagcagccuucuuuggaccacagucuuauccgaggggucugugg

SEQ ID NO: 189391 - RNA, 64 nt, Human
auguggcagaggggucucagucgugcuaggcaucgggcggcagcgccgacagcccuucccucgc

SEQ ID NO: 189392 - RNA, 64 nt, Human
caagaucagccugggcaacacagugagaccucaucuccacuaaaaauaaaaaaaaauuggcugg

SEQ ID NO: 189393 - RNA, 64 nt, Human
ugaaggcugcaguccuauagaaugcauaccuuccucccucuagacaucccuccaccagaagaga

SEQ ID NO: 189394 - RNA, 64 nt, Human
agugccccucagccagaucaccaccccuuacaauucccucuacuguguggaaaugguccauuga

SEQ ID NO: 189395 - RNA, 64 nt, Human
auuugugaguuuuuuccuuuaaugauaacuaaaaucccucuaauuucucauuuaugcuuuuguc

SEQ ID NO: 189396 - RNA, 64 nt, Human
ugucccuucuaggguuauugcauuuggauuggggucccucuaaaauuuaaugcaugauagacac

SEQ ID NO: 189397 - RNA, 64 nt, Human
ggcccaauacaaacuacugaaucaucuucuaauuucccucuaaaauauuuauagaaauauguaa

SEQ ID NO: 189398 - RNA, 64 nt, Human
gcuguucuggggccgcuauuguaaaagccugggcucccucuaguagcuugcgccacccccccuc

SEQ ID NO: 189399 - RNA, 64 nt, Human
ggguucuaucuuaggguugaaaucuggucauuauucccucuacccuuggaaucagagcaaugug

SEQ ID NO: 189400 - RNA, 64 nt, Human
gccagacccccuggagacuaaccccaccacacccucccucuacugggagccuacccacccccag

SEQ ID NO: 189401 - RNA, 64 nt, Human
guuauagcacaaauuagcacccuauauuucugcuucccucuauuuucuccaaguuagaggucaa

SEQ ID NO: 189402 - RNA, 64 nt, Human
uagcaguaccccuaaaaucccaccagaauacgggucccucuaacccaguggcuggaagaaccac

SEQ ID NO: 189403 - RNA, 64 nt, Human
uguaaaagcauuauuugguaguuuauuauaaucaucccucuauuauucuuaaaugccaguagua

SEQ ID NO: 189404 - RNA, 64 nt, Human
uuuaaagaaaccuuuuuugcuauugacuguuuuuucccucuaaguuuacacuaacaucuaccca

SEQ ID NO: 189405 - RNA, 64 nt, Human
cuuauuuuugucaaaaguugguguugacauacauucccucuaauuugaacugguauuguuuacg

SEQ ID NO: 189406 - RNA, 64 nt, Human
uuaaccaguauggauuaguucagggaugaacugcucccucuagccuuacuggcucugauccaca

SEQ ID NO: 189407 - RNA, 64 nt, Human
cccgacccaaacaccucauuguuucccccacgucucccucuauacccccucgaagacucgagag

SEQ ID NO: 189408 - RNA, 64 nt, Human
gggugggagucgggguguggcaggccgcgguggggggcggcaguggcuccgcgcacucacccgg

SEQ ID NO: 189409 - RNA, 52 nt, Human
ggaugaccaugagcgugugauggggcggcagccccgggccucucugcgggcc

SEQ ID NO: 189410 - RNA, 64 nt, Human
ccgucuccgggccauggcguucacugcagggcgggggcggcaccgcuccccugugacugcaucc

SEQ ID NO: 189411 - RNA, 64 nt, Human
ugcaacuucagacauuccagcucccccacucgcccuccacuaccucugagagcccagccacgcc

SEQ ID NO: 189412 - RNA, 64 nt, Human
ugaggcuggccccaucucagaagaugagcaggagcuccacuacgcuguccuacacuuccacaag

SEQ ID NO: 189413 - RNA, 64 nt, Human
auaauuauuauuauggagucgaguugacucucggcuccacuagggaggcgccgggagguugccu

SEQ ID NO: 189414 - RNA, 64 nt, Human
cgagaccauccuggccaacauggugaaaccccgucuccacuaaaaauacaaaauuagcugggcg

SEQ ID NO: 189415 - RNA, 64 nt, Human
cuaagcagacagcugcagaugagagggucagcaucuccacuaguggcugcucugugugccccuu

SEQ ID NO: 189416 - RNA, 64 nt, Human
aucgcgaccauccuggcuaacagugaaacccugucuccacuaaaaauacaaaaaauuagccggg

SEQ ID NO: 189417 - RNA, 64 nt, Human
uugagccagccuggccaacauggugaaaccccaucuccacuaaaaauagaaaaauuagccgggc

SEQ ID NO: 189418 - RNA, 64 nt, Human
uuagaacaguuggauacaggagaagaaacagcggcuccacuacagacccagccccagguucaau

SEQ ID NO: 189419 - RNA, 64 nt, Human
agguucucccaaccccacuuucuuccuuccccagcuccacuaaauucccuccugccuuaacuga

SEQ ID NO: 189420 - RNA, 64 nt, Human
uuagaacuuuuggauacagcagaagaaacagcggcuccacuaccgaccugcccccgguucgaug

SEQ ID NO: 189421 - RNA, 64 nt, Human
uuagaacuguuggauacaggagaagaaacagcggcuccacuaaagacccgccccccgguuggau

SEQ ID NO: 189422 - RNA, 64 nt, Human
uuagaacuguuggauacaggagaagaaacagcagcuccacuaccgacccccccccagguuugau

SEQ ID NO: 189423 - RNA, 64 nt, Human
ucauucuuugucugagaaacagcccccaguccuccuccacuacaaccuccaugaccuugagacg

SEQ ID NO: 189424 - RNA, 64 nt, Human
uaacugauacauugauuauuuauugcauuucuuccuccacuauucuucucuaacagaugaccaa

SEQ ID NO: 189425 - RNA, 64 nt, Human
gcauauauuuuuaaauguucauauugcguagaaucuccacuaggaagucuuuauuugaaauagu

SEQ ID NO: 189426 - RNA, 64 nt, Human
ggcccuucuccguuucucaagauggggcgagccaggaccacagagcuccuggcccuggccagaa

SEQ ID NO: 189427 - RNA, 64 nt, Human
ggguccaggcauguuggacucugagcucauuuggggaccacagaggcuguggucagagagggaa

SEQ ID NO: 189428 - RNA, 64 nt, Human
uaaccaggcccagccaguugguggggccaggccaggaccacacaguccccagacucagcuggaa

SEQ ID NO: 189429 - RNA, 64 nt, Human
gaaguuggcuggugucccuugucuuugccaaguucuccacuagcuauggugucauaggcucuuu

SEQ ID NO: 189430 - RNA, 64 nt, Human
aaauucuccacucuguccaucagauacuaugguucuccacuauggcaacuaacucacucaauuu

SEQ ID NO: 189431 - RNA, 64 nt, Human
uuguuauuucacaggccaggguucaguucugcuccuccacuauaagucuaauguucugacucuc

SEQ ID NO: 189432 - RNA, 64 nt, Human
uaugcagaagauagauacagccuuuucagaagaucuccacuaguuuuuguuccaaaaauucaag

SEQ ID NO: 189433 - RNA, 64 nt, Human
agaauacaauugucaucuuuauauugccucauuucuccacuaauacuuagcaaauaaaaggcaa

SEQ ID NO: 189434 - RNA, 64 nt, Human
uuuuuuuuuuuuuuuuuugagacagucuugcucuaucgcccaggcuggagugcaguggcgcauu

SEQ ID NO: 189435 - RNA, 64 nt, Human
uuauuuuuuuauuuuuuagauggugucucacgcuaucgcccaggcuggagugcaguggcgcgaa

SEQ ID NO: 189436 - RNA, 64 nt, Human
ggcugaaccugcagauaugcgcccagagauauggaucgcccaagaguugcggcguauuggagac

SEQ ID NO: 189437 - RNA, 64 nt, Human
ugggcggagaggggaccucaccaguuuuuuuaguaucgcccacgcccaguucccuggccaaguc

SEQ ID NO: 189438 - RNA, 64 nt, Human
gccucccccaucuccaucaggaaaaauacaccccaucgcccagcaccccugcugauaccaccag

SEQ ID NO: 189439 - RNA, 64 nt, Human
gucguugggcugcauuccuccgaggaccagucugaucgcccaggacuaagaguggcagcguaug

SEQ ID NO: 189440 - RNA, 64 nt, Human
uugaacagaggcacccuauggccuaggggcccugaucgcccaccugccuggaagccccugggcu

SEQ ID NO: 189441 - RNA, 64 nt, Human
uuuucuuucuuuuuuugagaaagagucuugcuccaucgcccaggcugcagugcagugacacgau

SEQ ID NO: 189442 - RNA, 64 nt, Human
uuuuuuuuuuuuuuuaaagacagggucucgcuuuaucgcccaggcuggaguacagugaugcaau

SEQ ID NO: 189443 - RNA, 64 nt, Human
ggaaucgcccgaucacagacgagcggccaccggaaucgcccaaucacagacaagcagucaucgg

SEQ ID NO: 189444 - RNA, 64 nt, Human
gugacuuggagcccugaagaagggaccaaucaugggaccacagccacugugcccugccguuucc

SEQ ID NO: 189445 - RNA, 64 nt, Human
accaucucauggacugaaagguagauagacagauggaccacaaugggaaauaggauguccauuu

SEQ ID NO: 189446 - RNA, 64 nt, Human
uaauauccuuguucucauuuacacccugcaguuuggaccacauuugaccucauaaguuuuuccu

SEQ ID NO: 189447 - RNA, 64 nt, Human
ugcuggugcagaugcuaccccacaagcuugucagaucgcccaggugacgggccaggcgcagcca

SEQ ID NO: 189448 - RNA, 64 nt, Human
cguaugcaugcuaaauuauuauuuagcuucucccaucgcccacgauggaauguaaaauaaauug

SEQ ID NO: 189449 - RNA, 64 nt, Human
ggggugaugugaaaaaggacuauggccacauucaaucgcccaacuacccagacgauuaccggcc

SEQ ID NO: 189450 - RNA, 64 nt, Human
uacuuaacugacgcccucuuccuccaacugaaggaucgcccaacguuuuuggauuauagaauua

SEQ ID NO: 189451 - RNA, 64 nt, Human
ugggcggagaggggaccucaccaguuuuuuuaguaucgcccacgcccaguucccuggccaacuc

SEQ ID NO: 189452 - RNA, 64 nt, Human
cagcucuccugcuuugugccuuaucuacaggagcaucgcccauuggacuuccugaccucuucug

SEQ ID NO: 189453 - RNA, 64 nt, Human
cauauugcccaggcuggucuucuggcuucuggauaucgcccaccuuggccucccaaagugcugg

SEQ ID NO: 189454 - RNA, 64 nt, Human
cacugggcacuagacuuuucuauuggccugugccaucgcccaguauuagcacaaguuagggagg

SEQ ID NO: 189455 - RNA, 64 nt, Human
cuuggcauaauuacucccuuaaagacuucuuugaaucgcccauugguuuuggugaaccaguaca

SEQ ID NO: 189456 - RNA, 64 nt, Human
uguuuuguuuuuuuuugagaugaaguuucauucuaucgcccaggcuggagugcaauggcacaau

SEQ ID NO: 189457 - RNA, 64 nt, Human
cugaggcguggccacgaucucccucccaggugguaucgcccaccugaaaaaauccugagaauuu

SEQ ID NO: 189458 - RNA, 64 nt, Human
ccuaguccggguuccauucuuuucaccagcacccaucgcccaagggguaccgaggggggcaagg

SEQ ID NO: 189459 - RNA, 64 nt, Human
aacgugauaggcacacgaggaugaguggcuuuguaucgcccagagaggugcuuguccagauuuc

SEQ ID NO: 189460 - RNA, 64 nt, Human
uuauugcuagaaagaaggcagacuucauauucucaucgcccauuuuucaaacuuguuacauuga

SEQ ID NO: 189461 - RNA, 64 nt, Human
gccucccaaagugcugggauuacaggcaugagccaucgcccagcccagaagcuaauuuuuuaau

SEQ ID NO: 189462 - RNA, 64 nt, Human
auaaauugugguuauguuaccuuuaucuuguugaggaccacaacauuagcacggugccuugugc

SEQ ID NO: 189463 - RNA, 64 nt, Human
ccacucugcucuugcccacaaagcugacccgaauggaccacagcagugggcuccuaugccuccu

SEQ ID NO: 189464 - RNA, 57 nt, Human
uggucuccuggaacuggugaggccgcagggcggcaccuggggcuacccucgacuuug

SEQ ID NO: 189465 - RNA, 64 nt, Human
ccagaggggugggucagagcaguggaggggagacaucgcccaugugcuucugcuacugguccuu

SEQ ID NO: 189466 - RNA, 64 nt, Human
uggucaguccccagcccugugggcccccaccuccaucgcccagccuuuuauuacacacucugag

SEQ ID NO: 189467 - RNA, 64 nt, Human
cuuuuuuuuuuucuuuuaaacggagucuugcuauaucgcccaggcucaagugauucuccugccu

SEQ ID NO: 189468 - RNA, 64 nt, Human
aggugaucgauaggaauccagaccuaggcugaggaucgcccacuggagccaguggcauggagga

SEQ ID NO: 189469 - RNA, 64 nt, Human
cucccugccauuuuuuaagagacaguuucgcuccaucgcccaggccugggaugcagugauguga

SEQ ID NO: 189470 - RNA, 64 nt, Human
caaagaugccuucaagggcugcacugugcugaccaucgcccaccgccucaacacaguucucaac

SEQ ID NO: 189471 - RNA, 51 nt, Human
acgaaggccacggggauugacaucgcccaccuccgacacccagugggcgcc

SEQ ID NO: 189472 - RNA, 64 nt, Human
cucgugcccccauuagugugccucuuuggaaauuaucgcccacauuuguaauauagucgccauu

SEQ ID NO: 189473 - RNA, 64 nt, Human
ucugcuuaaagcuucccucucagcugcugggacgaucgcccaggcuggagcuggccccgcuugg

SEQ ID NO: 189474 - RNA, 64 nt, Human
uggccugcaugcgccccucacgccccuggagcgcaucgcccaugagaacaccugcccccaggcc

SEQ ID NO: 189475 - RNA, 64 nt, Human
gacugggaagaugcacaaccaagggguuacaggcaucgcccaugcuccucaccuguauuuugua

SEQ ID NO: 189476 - RNA, 64 nt, Human
cgugauagcugugacuuacuugucuuacugccaaaucgcccaaauuuggaacugcuugucccau

SEQ ID NO: 189477 - RNA, 64 nt, Human
uccagacaccuccacgcccaccugguccucucccaucgcccacaaaagggggggcacgagggac

SEQ ID NO: 189478 - RNA, 64 nt, Human
accaaggcaggcagccccgacaucugcuuccucuaucgcccaaugcaaaaucgaugaaaugggg

SEQ ID NO: 189479 - RNA, 64 nt, Human
gaaggaaaccuacuacugaccucagccccaccacaucgcccaucucuuccccgucccccaggcc

SEQ ID NO: 189480 - RNA, 64 nt, Human
aggguuucccacuaaagguauuaauaaguccaguggaccacagagggcccaaucccucuuggcc

SEQ ID NO: 189481 - RNA, 64 nt, Human
cuguucccaccagggcucugggacagacuggaaaggaccacagaccuggccaucccugggcagc

SEQ ID NO: 189482 - RNA, 64 nt, Human
guaaccauuucucacuagugucaggcccccagugggaccacaugccacugccugcaccuuucgg

SEQ ID NO: 189483 - RNA, 64 nt, Human
gugggggagggagggagggaguuggcaguuucaaaucgcccaagugaugaauaaaguaucuggc

SEQ ID NO: 189484 - RNA, 64 nt, Human
ucuacugguaaccaaggcaaucaggccuaccagaaucgcccaguggcugcuaauaccuuggacu

SEQ ID NO: 189485 - RNA, 64 nt, Human
ugacugggacaaucagggaccuggauuggacgggaucgcccaacuucacugggacuggacaggg

SEQ ID NO: 189486 - RNA, 64 nt, Human
uuuuuuuuuuuuuuuugagauggagucucgcucuaucgcccaggauggagugcaguggcucaau

SEQ ID NO: 189487 - RNA, 64 nt, Human
auuuuugcuuuggcuauauuuacacgugacuuuaaucgcccaacugugacuagucauugcagcu

SEQ ID NO: 189488 - RNA, 64 nt, Human
ugcacagugccagcggaggcugcacugagccuucaucgcccauugcuuuaggccuggagacuuu

SEQ ID NO: 189489 - RNA, 64 nt, Human
cgugcuaauaagagagagucuuaccugaauggcaaucgcccagauuaacaguggagacaguaau

SEQ ID NO: 189490 - RNA, 64 nt, Human; identical to SEQ ID NO: 189246

SEQ ID NO: 189491 - RNA, 64 nt, Human; identical to SEQ ID NO: 189247

SEQ ID NO: 189492 - RNA, 64 nt, Human; identical to SEQ ID NO: 189248

SEQ ID NO: 189493 - RNA, 64 nt, Human; identical to SEQ ID NO: 189249

SEQ ID NO: 189494 - RNA, 64 nt, Human; identical to SEQ ID NO: 189250

SEQ ID NO: 189495 - RNA, 64 nt, Human; identical to SEQ ID NO: 189251

SEQ ID NO: 189496 - RNA, 64 nt, Human
guuaaacauggcaccuacucagcaaugccuuccuggaccacaaccccuaucccccugccccacc

SEQ ID NO: 189497 - RNA, 64 nt, Human
gcucaggcgauccuucaagccucccggggagcugggaccacaggcacgugccaccacacccagc

SEQ ID NO: 189498 - RNA, 62 nt, Human
uggaacccaagcaaugcugagcaccccggugcggaccacagagcagacccuggcgccaggaa

SEQ ID NO: 189499 - RNA, 64 nt, Human; identical to SEQ ID NO: 189252

SEQ ID NO: 189500 - RNA, 64 nt, Human; identical to SEQ ID NO: 189253

SEQ ID NO: 189501 - RNA, 64 nt, Human; identical to SEQ ID NO: 189254

SEQ ID NO: 189502 - RNA, 64 nt, Human; identical to SEQ ID NO: 189255

SEQ ID NO: 189503 - RNA, 64 nt, Human; identical to SEQ ID NO: 189256

SEQ ID NO: 189504 - RNA, 64 nt, Human; identical to SEQ ID NO: 189257

SEQ ID NO: 189505 - RNA, 64 nt, Human; identical to SEQ ID NO: 189258

SEQ ID NO: 189506 - RNA, 64 nt, Human; identical to SEQ ID NO: 189262

SEQ ID NO: 189507 - RNA, 64 nt, Human; identical to SEQ ID NO: 189263

SEQ ID NO: 189508 - RNA, 64 nt, Human; identical to SEQ ID NO: 189264

SEQ ID NO: 189509 - RNA, 64 nt, Human; identical to SEQ ID NO: 189265

SEQ ID NO: 189510 - RNA, 64 nt, Human; identical to SEQ ID NO: 189266

SEQ ID NO: 189511 - RNA, 64 nt, Human; identical to SEQ ID NO: 189267

SEQ ID NO: 189512 - RNA, 64 nt, Human; identical to SEQ ID NO: 189268

SEQ ID NO: 189513 - RNA, 64 nt, Human; identical to SEQ ID NO: 189269

SEQ ID NO: 189514 - RNA, 64 nt, Human
ugaugcugaggucaugugcuggaaugcuguauuuggaccacacauuucaaaguugcccuaugga

SEQ ID NO: 189515 - RNA, 64 nt, Human
cgaggccuugucaauuuuaagguggaaauaggaaggaccacaacaugacccguaagucaagaag

SEQ ID NO: 189516 - RNA, 64 nt, Human
uguaaucccagcacuuugggaggccaagguggguggaccacaugaggucaggaguuugagauca

SEQ ID NO: 189517 - RNA, 59 nt, Human; identical to SEQ ID NO: 189270

SEQ ID NO: 189518 - RNA, 64 nt, Human; identical to SEQ ID NO: 189271

SEQ ID NO: 189519 - RNA, 64 nt, Human; identical to SEQ ID NO: 189272

SEQ ID NO: 189520 - RNA, 64 nt, Human; identical to SEQ ID NO: 189273

SEQ ID NO: 189521 - RNA, 64 nt, Human; identical to SEQ ID NO: 189274

SEQ ID NO: 189522 - RNA, 64 nt, Human; identical to SEQ ID NO: 189275

SEQ ID NO: 189523 - RNA, 64 nt, Human; identical to SEQ ID NO: 189276

SEQ ID NO: 189524 - RNA, 64 nt, Human; identical to SEQ ID NO: 189280

SEQ ID NO: 189525 - RNA, 64 nt, Human; identical to SEQ ID NO: 189281

SEQ ID NO: 189526 - RNA, 64 nt, Human; identical to SEQ ID NO: 189282

SEQ ID NO: 189527 - RNA, 64 nt, Human; identical to SEQ ID NO: 189283

SEQ ID NO: 189528 - RNA, 64 nt, Human; identical to SEQ ID NO: 189284

SEQ ID NO: 189529 - RNA, 64 nt, Human; identical to SEQ ID NO: 189285

SEQ ID NO: 189530 - RNA, 64 nt, Human; identical to SEQ ID NO: 189286

SEQ ID NO: 189531 - RNA, 64 nt, Human; identical to SEQ ID NO: 189287

SEQ ID NO: 189532 - RNA, 64 nt, Human
ucacacacaaaugaugcuucagacccgaaugagaggaccacauuuugcuuaauguaaaggagcc

SEQ ID NO: 189533 - RNA, 64 nt, Human
ggggugacucggagcagcagguguggccccgggcgggcggcaccgcguccagggcagccucccu

SEQ ID NO: 189534 - RNA, 64 nt, Human
aagaagggggcacugcccggcccggcugugaggagggcggcagggggcacggccuccagcuucc

SEQ ID NO: 189535 - RNA, 64 nt, Human
cccauccacuauuaaugcacuaggugggaggagagggcggcaaugacacugcaccucuccuuuc

SEQ ID NO: 189536 - RNA, 64 nt, Human; identical to SEQ ID NO: 189288

SEQ ID NO: 189537 - RNA, 64 nt, Human; identical to SEQ ID NO: 189289

SEQ ID NO: 189538 - RNA, 64 nt, Human; identical to SEQ ID NO: 189290

SEQ ID NO: 189539 - RNA, 64 nt, Human; identical to SEQ ID NO: 189291

SEQ ID NO: 189540 - RNA, 64 nt, Human; identical to SEQ ID NO: 189292

SEQ ID NO: 189541 - RNA, 64 nt, Human; identical to SEQ ID NO: 189293

SEQ ID NO: 189542 - RNA, 64 nt, Human; identical to SEQ ID NO: 189294

SEQ ID NO: 189543 - RNA, 64 nt, Human; identical to SEQ ID NO: 189298

SEQ ID NO: 189544 - RNA, 64 nt, Human; identical to SEQ ID NO: 189299

SEQ ID NO: 189545 - RNA, 64 nt, Human; identical to SEQ ID NO: 189300

SEQ ID NO: 189546 - RNA, 64 nt, Human; identical to SEQ ID NO: 189301

SEQ ID NO: 189547 - RNA, 64 nt, Human; identical to SEQ ID NO: 189302

SEQ ID NO: 189548 - RNA, 64 nt, Human; identical to SEQ ID NO: 189303

SEQ ID NO: 189549 - RNA, 64 nt, Human; identical to SEQ ID NO: 189304

SEQ ID NO: 189550 - RNA, 64 nt, Human; identical to SEQ ID NO: 189305

SEQ ID NO: 189551 - RNA, 64 nt, Human
aaucgagauuuaguaaauccuauuauguguucaaggaccacauguguucucuauuuugccuuua

SEQ ID NO: 189552 - RNA, 64 nt, Human
ugucuauaaaaucccacaguccuugggaaguuggggaccacauacacuguugggauguacauug

SEQ ID NO: 189553 - RNA, 64 nt, Human
gagagaaguuugcuggcuugcccaggccagagcaggaccacagauacuggacaagcugguacag

SEQ ID NO: 189554 - RNA, 64 nt, Human; identical to SEQ ID NO: 189306

SEQ ID NO: 189555 - RNA, 64 nt, Human; identical to SEQ ID NO: 189307

SEQ ID NO: 189556 - RNA, 64 nt, Human; identical to SEQ ID NO: 189308

SEQ ID NO: 189557 - RNA, 64 nt, Human; identical to SEQ ID NO: 189309

SEQ ID NO: 189558 - RNA, 64 nt, Human; identical to SEQ ID NO: 189310

SEQ ID NO: 189559 - RNA, 53 nt, Human; identical to SEQ ID NO: 189311

SEQ ID NO: 189560 - RNA, 64 nt, Human; identical to SEQ ID NO: 189312

SEQ ID NO: 189561 - RNA, 64 nt, Human; identical to SEQ ID NO: 189317

SEQ ID NO: 189562 - RNA, 64 nt, Human; identical to SEQ ID NO: 189318

SEQ ID NO: 189563 - RNA, 64 nt, Human; identical to SEQ ID NO: 189319

SEQ ID NO: 189564 - RNA, 64 nt, Human; identical to SEQ ID NO: 189320

SEQ ID NO: 189565 - RNA, 64 nt, Human; identical to SEQ ID NO: 189321

SEQ ID NO: 189566 - RNA, 64 nt, Human; identical to SEQ ID NO: 189322

SEQ ID NO: 189567 - RNA, 64 nt, Human; identical to SEQ ID NO: 189323

SEQ ID NO: 189568 - RNA, 64 nt, Human; identical to SEQ ID NO: 189324

SEQ ID NO: 189569 - RNA, 64 nt, Human
acuccaccuuugacacauuacuaguaacaagaggggaccacauagucucuguuggcauuucuuu

SEQ ID NO: 189570 - RNA, 64 nt, Human
uaauaacaugaguccccaagcuccucuggcugugggaccacagaugagucuuucagaggcagga

SEQ ID NO: 189571 - RNA, 64 nt, Human
cuuucuucuguuuuugagaagaguuucauaugcuggaccacauuuuagcuuuuauuguuuuuuu

SEQ ID NO: 189572 - RNA, 64 nt, Human; identical to SEQ ID NO: 189325

SEQ ID NO: 189573 - RNA, 64 nt, Human; identical to SEQ ID NO: 189326

SEQ ID NO: 189574 - RNA, 64 nt, Human; identical to SEQ ID NO: 189327

SEQ ID NO: 189575 - RNA, 64 nt, Human; identical to SEQ ID NO: 189328

SEQ ID NO: 189576 - RNA, 64 nt, Human; identical to SEQ ID NO: 189329

SEQ ID NO: 189577 - RNA, 64 nt, Human; identical to SEQ ID NO: 189330

SEQ ID NO: 189578 - RNA, 64 nt, Human; identical to SEQ ID NO: 189331

SEQ ID NO: 189579 - RNA, 64 nt, Human; identical to SEQ ID NO: 189336

SEQ ID NO: 189580 - RNA, 64 nt, Human; identical to SEQ ID NO: 189337

SEQ ID NO: 189581 - RNA, 64 nt, Human; identical to SEQ ID NO: 189338

SEQ ID NO: 189582 - RNA, 64 nt, Human; identical to SEQ ID NO: 189339

SEQ ID NO: 189583 - RNA, 64 nt, Human; identical to SEQ ID NO: 189340

SEQ ID NO: 189584 - RNA, 64 nt, Human; identical to SEQ ID NO: 189341

SEQ ID NO: 189585 - RNA, 64 nt, Human; identical to SEQ ID NO: 189342

SEQ ID NO: 189586 - RNA, 64 nt, Human; identical to SEQ ID NO: 189343

SEQ ID NO: 189587 - RNA, 64 nt, Human
cuccauacauccccaucccucuacuuuccccagaggaccacaccuuccucccuggaguuuggcu

SEQ ID NO: 189588 - RNA, 64 nt, Human
ucuaauacaaaauuauaaagccuucagaggguuuggaccacaucucuuuggaaaauaguuugca

SEQ ID NO: 189589 - RNA, 64 nt, Human
agugauccucccaccucagccuaccaaguagccaggaccacaggcaagugcaccaccaugacug

SEQ ID NO: 189590 - RNA, 64 nt, Human; identical to SEQ ID NO: 189344

SEQ ID NO: 189591 - RNA, 64 nt, Human; identical to SEQ ID NO: 189345

SEQ ID NO: 189592 - RNA, 64 nt, Human; identical to SEQ ID NO: 189346

SEQ ID NO: 189593 - RNA, 64 nt, Human; identical to SEQ ID NO: 189347

SEQ ID NO: 189594 - RNA, 64 nt, Human; identical to SEQ ID NO: 189348

SEQ ID NO: 189595 - RNA, 64 nt, Human; identical to SEQ ID NO: 189349

SEQ ID NO: 189596 - RNA, 64 nt, Human; identical to SEQ ID NO: 189350

SEQ ID NO: 189597 - RNA, 64 nt, Human; identical to SEQ ID NO: 189355

SEQ ID NO: 189598 - RNA, 64 nt, Human; identical to SEQ ID NO: 189356

SEQ ID NO: 189599 - RNA, 64 nt, Human; identical to SEQ ID NO: 189357

SEQ ID NO: 189600 - RNA, 64 nt, Human; identical to SEQ ID NO: 189358

SEQ ID NO: 189601 - RNA, 64 nt, Human; identical to SEQ ID NO: 189359

SEQ ID NO: 189602 - RNA, 64 nt, Human; identical to SEQ ID NO: 189360

SEQ ID NO: 189603 - RNA, 64 nt, Human; identical to SEQ ID NO: 189361

SEQ ID NO: 189604 - RNA, 64 nt, Human; identical to SEQ ID NO: 189362

SEQ ID NO: 189605 - RNA, 64 nt, Human
uucuccaccuagacuguaaaccucucgagggcagggaccacacccuguacuguucugugucuuu

SEQ ID NO: 189606 - RNA, 64 nt, Human
caggcuccacagaguaccaagauguugcccucugggaccacacuuagcucagagaauauggggu

SEQ ID NO: 189607 - RNA, 64 nt, Human
uguaagagacccuaaaaccuuggugcagugguggggaccacaaaacaaccagggaggaagagau

SEQ ID NO: 189608 - RNA, 64 nt, Human; identical to SEQ ID NO: 189363

SEQ ID NO: 189609 - RNA, 64 nt, Human; identical to SEQ ID NO: 189364

SEQ ID NO: 189610 - RNA, 64 nt, Human; identical to SEQ ID NO: 189365

SEQ ID NO: 189611 - RNA, 64 nt, Human; identical to SEQ ID NO: 189366

SEQ ID NO: 189612 - RNA, 64 nt, Human; identical to SEQ ID NO: 189367

SEQ ID NO: 189613 - RNA, 64 nt, Human; identical to SEQ ID NO: 189368

SEQ ID NO: 189614 - RNA, 64 nt, Human; identical to SEQ ID NO: 189369

SEQ ID NO: 189615 - RNA, 64 nt, Human; identical to SEQ ID NO: 189374

SEQ ID NO: 189616 - RNA, 64 nt, Human; identical to SEQ ID NO: 189375

SEQ ID NO: 189617 - RNA, 64 nt, Human; identical to SEQ ID NO: 189376

SEQ ID NO: 189618 - RNA, 64 nt, Human; identical to SEQ ID NO: 189377

SEQ ID NO: 189619 - RNA, 64 nt, Human; identical to SEQ ID NO: 189378

SEQ ID NO: 189620 - RNA, 64 nt, Human; identical to SEQ ID NO: 189379

SEQ ID NO: 189621 - RNA, 64 nt, Human; identical to SEQ ID NO: 189380

SEQ ID NO: 189622 - RNA, 64 nt, Human; identical to SEQ ID NO: 189381

SEQ ID NO: 189623 - RNA, 64 nt, Human
cucccccgcuuccucccucugcggggaggacccgggaccacagcugcuggccaggguagacuug

SEQ ID NO: 189624 - RNA, 64 nt, Human
aggggagcaaaaucgaugcagugcuuccaaggauggaccacacagaggcugccucucccaucac

SEQ ID NO: 189625 - RNA, 64 nt, Human
aguuggagguguggagaguucaggagaggguucuggaccacagauguugaggugggagucauua

SEQ ID NO: 189626 - RNA, 64 nt, Human; identical to SEQ ID NO: 189382

SEQ ID NO: 189627 - RNA, 64 nt, Human; identical to SEQ ID NO: 189383

SEQ ID NO: 189628 - RNA, 64 nt, Human; identical to SEQ ID NO: 189384

SEQ ID NO: 189629 - RNA, 64 nt, Human; identical to SEQ ID NO: 189385

SEQ ID NO: 189630 - RNA, 64 nt, Human; identical to SEQ ID NO: 189386

SEQ ID NO: 189631 - RNA, 64 nt, Human; identical to SEQ ID NO: 189387

SEQ ID NO: 189632 - RNA, 64 nt, Human; identical to SEQ ID NO: 189388

SEQ ID NO: 189633 - RNA, 64 nt, Human; identical to SEQ ID NO: 188697

SEQ ID NO: 189634 - RNA, 64 nt, Human; identical to SEQ ID NO: 188698

SEQ ID NO: 189635 - RNA, 64 nt, Human; identical to SEQ ID NO: 188699

SEQ ID NO: 189636 - RNA, 64 nt, Human; identical to SEQ ID NO: 188700

SEQ ID NO: 189637 - RNA, 64 nt, Human; identical to SEQ ID NO: 188701

SEQ ID NO: 189638 - RNA, 64 nt, Human; identical to SEQ ID NO: 188702

SEQ ID NO: 189639 - RNA, 64 nt, Human; identical to SEQ ID NO: 188703

SEQ ID NO: 189640 - RNA, 64 nt, Human; identical to SEQ ID NO: 188704

SEQ ID NO: 189641 - RNA, 64 nt, Human
cggaaccugggaggggagggaacacugggguuuaggaccacaacucagaggcugcuuggcccuc

SEQ ID NO: 189642 - RNA, 64 nt, Human
cugcaggcagcuguugaacacuggagggucccccggaccacacuggggugggcuccugaggacg

SEQ ID NO: 189643 - RNA, 64 nt, Human
ugggccccuccuugccacaucaugagcugaggugggaccacaguccccaggcugcaucggccug

SEQ ID NO: 189644 - RNA, 64 nt, Human; identical to SEQ ID NO: 188705

SEQ ID NO: 189645 - RNA, 64 nt, Human; identical to SEQ ID NO: 188706

SEQ ID NO: 189646 - RNA, 64 nt, Human; identical to SEQ ID NO: 188707

SEQ ID NO: 189647 - RNA, 64 nt, Human; identical to SEQ ID NO: 188708

SEQ ID NO: 189648 - RNA, 64 nt, Human; identical to SEQ ID NO: 188709

SEQ ID NO: 189649 - RNA, 64 nt, Human; identical to SEQ ID NO: 188710

SEQ ID NO: 189650 - RNA, 64 nt, Human; identical to SEQ ID NO: 189392

SEQ ID NO: 189651 - RNA, 64 nt, Human; identical to SEQ ID NO: 189411

SEQ ID NO: 189652 - RNA, 64 nt, Human; identical to SEQ ID NO: 189412

SEQ ID NO: 189653 - RNA, 64 nt, Human; identical to SEQ ID NO: 189413

SEQ ID NO: 189654 - RNA, 64 nt, Human; identical to SEQ ID NO: 189414

SEQ ID NO: 189655 - RNA, 64 nt, Human; identical to SEQ ID NO: 189415

SEQ ID NO: 189656 - RNA, 64 nt, Human; identical to SEQ ID NO: 189416

SEQ ID NO: 189657 - RNA, 64 nt, Human; identical to SEQ ID NO: 189417

SEQ ID NO: 189658 - RNA, 64 nt, Human; identical to SEQ ID NO: 189418

SEQ ID NO: 189659 - RNA, 64 nt, Human
uguuccucauagugccaguguguuuacauuuauaggaccacauaucccugguuucugggggagg

SEQ ID NO: 189660 - RNA, 64 nt, Human
uguguuucacaagcacguaguucaacccagauagggaccacagagauucuggggccagccaggg

SEQ ID NO: 189661 - RNA, 64 nt, Human
agguugaccuaaaauuagccuuacaaaggagaaaggaccacauugcuuacuugaaacagacaau

SEQ ID NO: 189662 - RNA, 64 nt, Human; identical to SEQ ID NO: 189419

SEQ ID NO: 189663 - RNA, 64 nt, Human; identical to SEQ ID NO: 189420

SEQ ID NO: 189664 - RNA, 64 nt, Human; identical to SEQ ID NO: 189421

SEQ ID NO: 189665 - RNA, 64 nt, Human; identical to SEQ ID NO: 189422

SEQ ID NO: 189666 - RNA, 64 nt, Human; identical to SEQ ID NO: 189423

SEQ ID NO: 189667 - RNA, 64 nt, Human; identical to SEQ ID NO: 189424

SEQ ID NO: 189668 - RNA, 64 nt, Human; identical to SEQ ID NO: 189425

SEQ ID NO: 189669 - RNA, 64 nt, Human; identical to SEQ ID NO: 189429

SEQ ID NO: 189670 - RNA, 64 nt, Human; identical to SEQ ID NO: 189430

SEQ ID NO: 189671 - RNA, 64 nt, Human; identical to SEQ ID NO: 189431

SEQ ID NO: 189672 - RNA, 64 nt, Human; identical to SEQ ID NO: 189432

SEQ ID NO: 189673 - RNA, 64 nt, Human; identical to SEQ ID NO: 189433

SEQ ID NO: 189674 - RNA, 64 nt, Human; identical to SEQ ID NO: 189434

SEQ ID NO: 189675 - RNA, 64 nt, Human; identical to SEQ ID NO: 189435

SEQ ID NO: 189676 - RNA, 64 nt, Human; identical to SEQ ID NO: 189436

SEQ ID NO: 189677 - RNA, 64 nt, Human
agcgauucuccugccucagccuccugaguagcugggaccacaggcgacugccaccacacccagc

SEQ ID NO: 189678 - RNA, 64 nt, Human
uucucucuccuuugcuuuccuugaagucagcuuuggaccacaauaauuucacuguagaugauau

SEQ ID NO: 189679 - RNA, 64 nt, Human
gagcuuucaaagaaggaauucuaggcaucccaggggaccacaccucccugaaccaucccugaug

SEQ ID NO: 189680 - RNA, 64 nt, Human; identical to SEQ ID NO: 189437

SEQ ID NO: 189681 - RNA, 64 nt, Human; identical to SEQ ID NO: 189438

SEQ ID NO: 189682 - RNA, 64 nt, Human; identical to SEQ ID NO: 189439

SEQ ID NO: 189683 - RNA, 64 nt, Human; identical to SEQ ID NO: 189440

SEQ ID NO: 189684 - RNA, 64 nt, Human; identical to SEQ ID NO: 189441

SEQ ID NO: 189685 - RNA, 64 nt, Human; identical to SEQ ID NO: 189442

SEQ ID NO: 189686 - RNA, 64 nt, Human; identical to SEQ ID NO: 189443

SEQ ID NO: 189687 - RNA, 64 nt, Human; identical to SEQ ID NO: 189447

SEQ ID NO: 189688 - RNA, 64 nt, Human; identical to SEQ ID NO: 189448

SEQ ID NO: 189689 - RNA, 64 nt, Human; identical to SEQ ID NO: 189449

SEQ ID NO: 189690 - RNA, 64 nt, Human; identical to SEQ ID NO: 189450

SEQ ID NO: 189691 - RNA, 64 nt, Human; identical to SEQ ID NO: 189451

SEQ ID NO: 189692 - RNA, 64 nt, Human; identical to SEQ ID NO: 189452

SEQ ID NO: 189693 - RNA, 64 nt, Human; identical to SEQ ID NO: 189453

SEQ ID NO: 189694 - RNA, 64 nt, Human; identical to SEQ ID NO: 189454

SEQ ID NO: 189695 - RNA, 64 nt, Human
aagaacugauaaauauuuauaaaaugacaaacuuggaccacaggcuuucuugaccuuguacagu

SEQ ID NO: 189696 - RNA, 64 nt, Human
uuccugcauggauauacuuaccauuugaauaaagggaccacaacuuggauaauuuaauuuuagg

SEQ ID NO: 189697 - RNA, 64 nt, Human
cagcaccugagccucccucacuuggacacucaggggaccacacagagaaguggauggacacuuc

SEQ ID NO: 189698 - RNA, 64 nt, Human; identical to SEQ ID NO: 189455

SEQ ID NO: 189699 - RNA, 64 nt, Human; identical to SEQ ID NO: 189456

SEQ ID NO: 189700 - RNA, 64 nt, Human; identical to SEQ ID NO: 189457

SEQ ID NO: 189701 - RNA, 64 nt, Human; identical to SEQ ID NO: 189458

SEQ ID NO: 189702 - RNA, 64 nt, Human; identical to SEQ ID NO: 189459

SEQ ID NO: 189703 - RNA, 64 nt, Human; identical to SEQ ID NO: 189460

SEQ ID NO: 189704 - RNA, 64 nt, Human; identical to SEQ ID NO: 189461

SEQ ID NO: 189705 - RNA, 64 nt, Human; identical to SEQ ID NO: 189465

SEQ ID NO: 189706 - RNA, 64 nt, Human; identical to SEQ ID NO: 189466

SEQ ID NO: 189707 - RNA, 64 nt, Human; identical to SEQ ID NO: 189467

SEQ ID NO: 189708 - RNA, 64 nt, Human; identical to SEQ ID NO: 189468

SEQ ID NO: 189709 - RNA, 64 nt, Human; identical to SEQ ID NO: 189469

SEQ ID NO: 189710 - RNA, 64 nt, Human; identical to SEQ ID NO: 189470

SEQ ID NO: 189711 - RNA, 51 nt, Human; identical to SEQ ID NO: 189471

SEQ ID NO: 189712 - RNA, 64 nt, Human; identical to SEQ ID NO: 189472

SEQ ID NO: 189713 - RNA, 64 nt, Human
gcagcaucgccuuggcucuugggaagaggagauuggaccacaugaucuuauaggaaccccucag

SEQ ID NO: 189714 - RNA, 64 nt, Human
cgccccagccccugacacacacucggaccccccgggaccacaaagccaccgccgcuguuaccgc

SEQ ID NO: 189715 - RNA, 64 nt, Human
acaugacagccaucacuauggccugggcccgccuggaccacaaguuugaccugauguaugccaa

SEQ ID NO: 189716 - RNA, 64 nt, Human; identical to SEQ ID NO: 189473

SEQ ID NO: 189717 - RNA, 64 nt, Human; identical to SEQ ID NO: 189474

SEQ ID NO: 189718 - RNA, 64 nt, Human; identical to SEQ ID NO: 189475

SEQ ID NO: 189719 - RNA, 64 nt, Human; identical to SEQ ID NO: 189476

SEQ ID NO: 189720 - RNA, 64 nt, Human; identical to SEQ ID NO: 189477

SEQ ID NO: 189721 - RNA, 64 nt, Human; identical to SEQ ID NO: 189478

SEQ ID NO: 189722 - RNA, 64 nt, Human; identical to SEQ ID NO: 189479

SEQ ID NO: 189723 - RNA, 64 nt, Human; identical to SEQ ID NO: 189483

SEQ ID NO: 189724 - RNA, 64 nt, Human; identical to SEQ ID NO: 189484

SEQ ID NO: 189725 - RNA, 64 nt, Human; identical to SEQ ID NO: 189485

SEQ ID NO: 189726 - RNA, 64 nt, Human; identical to SEQ ID NO: 189486

SEQ ID NO: 189727 - RNA, 64 nt, Human; identical to SEQ ID NO: 189487

SEQ ID NO: 189728 - RNA, 64 nt, Human; identical to SEQ ID NO: 189488

SEQ ID NO: 189729 - RNA, 64 nt, Human; identical to SEQ ID NO: 189489

SEQ ID NO: 189730 - RNA, 64 nt, Human
ucguuauccaugacucuccaguguuuuuucuguuggaccacacccgucacaguucacaguucca

SEQ ID NO: 189731 - RNA, 64 nt, Human
ggggagccgcguucccucccagggcuggagcagaggaccacaaggcagcagaaagcgcgggucc

SEQ ID NO: 189732 - RNA, 64 nt, Human
agcaauucuccugccucagccuccuuaguagcugggaccacagacaucugucaccacacccagc

SEQ ID NO: 189733 - RNA, 64 nt, Human
cuccccaccucugcaagaugggauacacucuucaggaccacaguuugaaaugucuuucauaaaa

SEQ ID NO: 189734 - RNA, 64 nt, Human
caggagagaccagagccucuggaggcuacccaggggaccacaccaaguccuugccugugccggg

SEQ ID NO: 189735 - RNA, 64 nt, Human
ccugggagcuggaagagcacuuggagauccuaagggaccacacccuuccuccuuccccugccca

SEQ ID NO: 189736 - RNA, 64 nt, Human
guugguuucuuagauugcuagcuuuuccuccaggggaccacagcaggugaagcucaagagcgca

SEQ ID NO: 189737 - RNA, 64 nt, Human
uccagcagggacuaccuuucuuauaaacccagggggaccacacacacacacacacacacacaca

SEQ ID NO: 189738 - RNA, 64 nt, Human
aagcaucagugugcaucuacgcagcccagguccaggaccacauccuggccagcugcuggcagaa

SEQ ID NO: 189739 - RNA, 64 nt, Human
gccugaguggguagacgcaggcggcagaggugcuggaccacaucuccgccaagucacugcccag

SEQ ID NO: 189740 - RNA, 64 nt, Human
uccccuuccuuucauuccacucauggguggacagggaccacaaagacucauggggcuuccccag

SEQ ID NO: 189741 - RNA, 64 nt, Human
aaguccccaggucaugcugcuguugcuggacugaggaccacacuuugagaaccugugcucuaag

SEQ ID NO: 189742 - RNA, 64 nt, Human
uccagucauuggccaccagccaccucugcaguggggaccacacuagcagcccugacuccacacu

SEQ ID NO: 189743 - RNA, 64 nt, Human
uacaggaaagagacugagauugguaaucugaaaaggaccacaagcauagcugguaggcaaauug

SEQ ID NO: 189744 - RNA, 64 nt, Human
uguucuguagcauuggucagggaaauaugaauuaggaccacaaugagauuccauuuuauaucca

SEQ ID NO: 189745 - RNA, 64 nt, Human
cccaagagcauaugggcaauucggauuuccugcuggaccacaagguucuguugauauuacauag

SEQ ID NO: 189746 - RNA, 64 nt, Human
gcuuacguaugccaugcauaccuccugccccgcgggaccacaauaaaaaccuuggcagacggga

SEQ ID NO: 189747 - RNA, 64 nt, Human
gcucuuuugguggggagcacuugcguccugcagaggaccacaguggguggcaccuccugagaag

SEQ ID NO: 189748 - RNA, 64 nt, Human
acauacauaacauugaaacagaaggaaaugcuguggaccacagaacuccaagaauuguuuaaaa

SEQ ID NO: 189749 - RNA, 64 nt, Human
acuauaaugaguuauugugacccacagcugugugggaccacaucacuuguuaauaacacaaccu

SEQ ID NO: 189750 - RNA, 64 nt, Human
ggugauccuuccaccucagcuuccuaaguagcugggaccacaggcaugcgccaccauccccagg

SEQ ID NO: 189751 - RNA, 64 nt, Human
agcaauccucucaccucagccucccgaguagggaggaccacaggugugagccaccacaccuggc

SEQ ID NO: 189752 - RNA, 64 nt, Human
cagauggggagaaccuaucugcauggaccucuguggaccacagcguaccugccccuuucugccc

SEQ ID NO: 189753 - RNA, 64 nt, Human
guaucuggugugagcguugccccugcgacauuugggaccacacaggugggcuuccuuauucccu

SEQ ID NO: 189754 - RNA, 64 nt, Human
guugggagggaauggggcgugggggguuagagcaggaccacagccuggugaguccccgggcagc

SEQ ID NO: 189755 - RNA, 64 nt, Human
uguugggauuaggaguggaaugaggaauaguuuaggaccacaagagauuuggccuccuuggaac

SEQ ID NO: 189756 - RNA, 64 nt, Human
guuugugugugugugucugucuauuuuguauccuggaccacaaguuccuaaguagagcaagaau

SEQ ID NO: 189757 - RNA, 64 nt, Human
agaaagaacuggaauuucgcucuggaggggauguggaccacaguacucuagucacccucuucaa

SEQ ID NO: 189758 - RNA, 64 nt, Human
accuccccaucauccacgccaaguggaagccacuggaccacaggaggugugauagagccuuuga

SEQ ID NO: 189759 - RNA, 64 nt, Human
gaugugugcccagugggaguuccuuccagccccaggaccacagcagcagccaggugccgagugg

SEQ ID NO: 189760 - RNA, 64 nt, Human
agcgguccuuuugccucagccucgcggauagcuaggaccacaagcaguagagacaagaucuccg

SEQ ID NO: 189761 - RNA, 64 nt, Human
gauuccugaggauccuccccgagccaggcacgggggaccacagggcugccgugagcacccaccc

SEQ ID NO: 189762 - RNA, 64 nt, Human
aucauccaggaaacccccuacccccaccccagagggaccacagucagcgugaagcaguuauuuu

SEQ ID NO: 189763 - RNA, 64 nt, Human
gguuuuucucuaaaauaugaauuuuauaauugaaggaccacaauuuguuuaaucaagauaggca

SEQ ID NO: 189764 - RNA, 64 nt, Human
aaaaaaguaaauauauaaauguagauggcauuuaggaccacagcuugcuggauuuguguuagcu

SEQ ID NO: 189765 - RNA, 64 nt, Human
caaccacaggagcugccaguauccagcaguaucuggaccacaggcaaagaaaaccacuaggacc

SEQ ID NO: 189766 - RNA, 64 nt, Human
agugauccucccaccucagccuccagaguaaguaggaccacaggcaugcacaagcaugccuggc

SEQ ID NO: 189767 - RNA, 64 nt, Human
cucugcaccgcguggcccggucuugccucccugaggaccacacuggcugcaacccaaacucgac

SEQ ID NO: 189768 - RNA, 64 nt, Human
agcgauucucccaccucagccauccaaauagcugggaccacaggugugcaccaccacgcccggc

SEQ ID NO: 189769 - RNA, 64 nt, Human
accgccgguuuauaugaucuucauaccuuucccuggaccacaggcguuucucggcuuuuagucu

SEQ ID NO: 189770 - RNA, 64 nt, Human
uccugaccugucaccgugagcagcuuuggaaacaggaccacaaaaaugaaagcaugucucaaua

SEQ ID NO: 189771 - RNA, 64 nt, Human
aagccaagcuguauggaaaagcugcacucaccaaggaccacaaugcccccggccuaaaguacug

SEQ ID NO: 189772 - RNA, 64 nt, Human
ucccuaccccagccuguuucuuuuggcuugguuuggaccacaguccucugcuacccaggguuuu

SEQ ID NO: 189773 - RNA, 64 nt, Human
augacaucuucucagagcuucacaauaaugucagggaccacauuuaaugcuuuuuaaucuccca

SEQ ID NO: 189774 - RNA, 64 nt, Human
aguggcacuucugaguuccugcugauguuacaagggaccacacuuuugagaaucugugcuuuaa

SEQ ID NO: 189775 - RNA, 64 nt, Human
cuaggacuuaccuguucccccagaucuugccuugggaccacauuugcugcuacuuuuccugcug

SEQ ID NO: 189776 - RNA, 64 nt, Human
cuuguccccaaguagagacuaguacuacaaaaagggaccacauuuuucaaguauuucuaaguau

SEQ ID NO: 189777 - RNA, 64 nt, Human
gcuccaggugccucagccccgugcccugacccggggaccacagggacacccucugagacgugcu

SEQ ID NO: 189778 - RNA, 64 nt, Human
gcugacaucuaggacuucauuauucuauaauucaggaccacaguggaguaugaucccuaacucc

SEQ ID NO: 189779 - RNA, 64 nt, Human
caggaagaggugagaagaucagaugguccaaaguggaccacacuugguccauuuuacacuuuuu

SEQ ID NO: 189780 - RNA, 64 nt, Human
uucuugauuucaccaaaaccaaauuuaauuuaaaggaccacauuaauuuuucaaagggaaagag

SEQ ID NO: 189781 - RNA, 64 nt, Human
uagaggccuccguccccauggccgccaccgcucuggaccacaggcggggaggaagcaugcucaa

SEQ ID NO: 189782 - RNA, 64 nt, Human
aguucaguaggauguguggcuuaaaaauuuaucaggaccacaaaaaagaaaacaaaaauauuug

SEQ ID NO: 189783 - RNA, 64 nt, Human
uuacugcaggccgguguauauaccauacaaaagaggaccacacaucuguuggucacagaguuca

SEQ ID NO: 189784 - RNA, 64 nt, Human
ugccgcugccuaugaccgccacuaguuaccgcggggaccacaucaagcuucaggccgacagcuu

SEQ ID NO: 189785 - RNA, 64 nt, Human
caaagaaaagcugcuaaaucuauagccaaccaggggaccacaguagugggcaagagugaucugc

SEQ ID NO: 189786 - RNA, 64 nt, Human
auggccaacaauggacaccuccagagccuccaggggaccacacaguagacuaucccuacucuaa

SEQ ID NO: 189787 - RNA, 64 nt, Human
acagaaucagccauccacgucuagguaucagagaggaccacaaauacaacauucuccaucugcu

SEQ ID NO: 189788 - RNA, 64 nt, Human
agcgauccuccugccucagccuucugaguagcugggaccacaggcgugcaccaccaugcccacc

SEQ ID NO: 189789 - RNA, 64 nt, Human
gaaaggaaguucucgacaccagaaaugcaucggaggaccacaaucaguucuaugcugccaaaga

SEQ ID NO: 189790 - RNA, 64 nt, Human
caauuucuacaaaauccugaugagguuucuacugggaccacauugagucuaucaaucaacuuau

SEQ ID NO: 189791 - RNA, 64 nt, Human
gacagcagcaucucuaccuucuccccagcucccaggaccacaggcucaggcaggggccuccaug

SEQ ID NO: 189792 - RNA, 64 nt, Human
agaaaaaucaagaggacccaaggggauggagacaggaccacaggaaugggccaaggagcaacgu

SEQ ID NO: 189793 - RNA, 64 nt, Human
gagagcaggaggcccucauguucaccagggaacaggaccacaccggccacuggaggagggcagg

SEQ ID NO: 189794 - RNA, 64 nt, Human
augucugccaagcacagagcaucucaguuggacuggaccacagugcucccgagagccugccuuu

SEQ ID NO: 189795 - RNA, 64 nt, Human
aauccacaguuucugacacaguuuagaauuucuuggaccacauuaugcuauuguaauuuaacac

SEQ ID NO: 189796 - RNA, 64 nt, Human
ugauccuguauucagacagaugaggcuuuccaugggaccacaacuauuuucagaugugaaccau

SEQ ID NO: 189797 - RNA, 64 nt, Human
gggcugcugcggcccuaggccuggcugggcucggggaccacaucuggcccccggcccgcgccau

SEQ ID NO: 189798 - RNA, 64 nt, Human
aguugagggaaaagcucaagugccuuaggcccguggaccacagucuuggcugagaucaaaggga

SEQ ID NO: 189799 - RNA, 64 nt, Human
cccucuugccccaacccccagcacccgggcucagggaccacagcaaggcaccugcagguugggc

SEQ ID NO: 189800 - RNA, 64 nt, Human
cuuccguggugccuuugcugccggcagcccuuggggaccacaggccugaccagggccugcacag

SEQ ID NO: 189801 - RNA, 64 nt, Human
gaagcguccugaugggccgcugcuuugcgcugguggaccacaggcaucuacacagccuggacuu

SEQ ID NO: 189802 - RNA, 64 nt, Human
cucccacuugagagcagccucuaccugacccccuggaccacagagagccacucugacccucagc

SEQ ID NO: 189803 - RNA, 64 nt, Human
ggugauccuucugucucagccuuccgaguagcugggaccacaggcaugcacaaccacgccuggc

SEQ ID NO: 189804 - RNA, 64 nt, Human
uguguggauuuuuaacaucaccgugagucugaaaggaccacagguuuuucugcagcuauuuucu

SEQ ID NO: 189805 - RNA, 64 nt, Human
aauaguauacuucuuaacuagguuuacaacugguggaccacacaccaggcacuaaucaccuggu

SEQ ID NO: 189806 - RNA, 64 nt, Human
ggccagggcagcggcgucgcuccucugcucaacaggaccacaaccccugccagcagcccuggga

SEQ ID NO: 189807 - RNA, 64 nt, Human
ccacccugaacuccccagcccccucagaguacuaggaccacagaagcccuguugcucacugacc

SEQ ID NO: 189808 - RNA, 64 nt, Human
uuaucuaacugugcucaagagguucucgacuggaggaccacacucaagccgacuuaugcccacc

SEQ ID NO: 189809 - RNA, 64 nt, Human
ggacaaaccuugggucacagggcaaguagaucauggaccacagaacagcagaugagaaaagacu

SEQ ID NO: 189810 - RNA, 64 nt, Human
cuuuccaguuuagaaaaggcucugugccaaggagggaccacaggagcugggaccugccugcccc

SEQ ID NO: 189811 - RNA, 64 nt, Human
uguacagaagcuggaggcagcauaaaggacucaaggaccacagccucugcccaccagcauguuc

SEQ ID NO: 189812 - RNA, 64 nt, Human
ccacuuccgcuacacacuacccgucuuccugcauggaccacaccgggucuggggccucacagcu

SEQ ID NO: 189813 - RNA, 64 nt, Human
gccucaggauuggccccacaucaccacgccaacaggaccacagcgcacuggcuccaccccaucu

SEQ ID NO: 189814 - RNA, 64 nt, Human
ucuuucugggacuagcccugcuguuuaggaccugggaccacaaugggguaccugccgagggggu

SEQ ID NO: 189815 - RNA, 64 nt, Human
gacaaggagaaagcagggcagaaugaugccuagaggaccacaucaggcauggcugacagcuugu

SEQ ID NO: 189816 - RNA, 64 nt, Human
aggaggcccaugggcagaagauagagauuccccuggaccacaccuccgugguucacuuugguca

SEQ ID NO: 189817 - RNA, 64 nt, Human
uguguccucacuugguauagguugugcccucuuaggaccacauagauuauuacauuucuggccc

SEQ ID NO: 189818 - RNA, 64 nt, Human
gcaugggacuguucuuuuacaagacaggacccugggaccacagagggcaggaacuugcacaaaa

SEQ ID NO: 189819 - RNA, 64 nt, Human
ccccaugcugcccgcuucucacccuaugugggugggaccacagacucacauccugaccuugcac

SEQ ID NO: 189820 - RNA, 64 nt, Human
uuuuacuccaacacccccucaacccuuuucucagggaccacaccucuucuucccaaggucccug

SEQ ID NO: 189821 - RNA, 64 nt, Human
uagucuagauugucuuugagguagaauauaugauggaccacauaguuuaagauuacaagguacu

SEQ ID NO: 189822 - RNA, 64 nt, Human
cuugaagcugagaaggcacagggcaaggagccaaggaccacagagccucagccagcccaggauc

SEQ ID NO: 189823 - RNA, 64 nt, Human
auaaagagaaucuggaccacuacccgggcaccagggaccacagcacugguuuggaccguuacuc

SEQ ID NO: 189824 - RNA, 64 nt, Human
gcugugggcacugccucagccgcccaaguaucugggaccacaggcgugcaccaccaugcauagc

SEQ ID NO: 189825 - RNA, 64 nt, Human
ccuggagugacgaccaccgccccaccaccuccugggaccacaccacuaccgcccccaaccacag

SEQ ID NO: 189826 - RNA, 64 nt, Human
agaugcuugguuaguuugggacauggggggacauggaccacauugagaccuuagucaucaagua

SEQ ID NO: 189827 - RNA, 64 nt, Human
gugaacaagaauccacgccccccugcccugcuggggaccacauaaugaucccuuugggggaagu

SEQ ID NO: 189828 - RNA, 64 nt, Human
auuguccuuugggcuagguaggcacauaucaguuggaccacaucugcaauacuggauuuuacug

SEQ ID NO: 189829 - RNA, 64 nt, Human
auuuccccugccaugugugcugauccugcuggcaggaccacauuucuuugccacugaucucaau

SEQ ID NO: 189830 - RNA, 64 nt, Human
ugcaacaccgagguuuuggguguugacauaaaguggaccacacaccacaucugcugccgucuug

SEQ ID NO: 189831 - RNA, 57 nt, Human
aaacaaccaccaaacauugaugcuuaaggaccacacugaaggaaaaaaaaagagggg

SEQ ID NO: 189832 - RNA, 64 nt, Human
uagagaauaaucauauauaugcauacguaaaaauggaccacagugacuuauuuguaguuguuag

SEQ ID NO: 189833 - RNA, 64 nt, Human
uaucguuucuuuuucuuggaaaaaaaguugauuaggaccacagauuugguuuagaaaggguaau

SEQ ID NO: 189834 - RNA, 64 nt, Human
accaaagaagcauuaaggcagguugaugcugauaggaccacaaaauauuuuuacacucaaccug

SEQ ID NO: 189835 - RNA, 64 nt, Human
auaauaauaagugaaauaauaagugggaguccuuggaccacauccuaaccugagacaaugccga

SEQ ID NO: 189836 - RNA, 64 nt, Human
cuuggucuggauucccagaagcauagcuuagaugggaccacagugggcaauuuugaccuguccu

SEQ ID NO: 189837 - RNA, 64 nt, Human
guuuuuggagaagguuaucaaaaauuucauggaaggaccacauuuuauauuuauugugcuucga

SEQ ID NO: 189838 - RNA, 64 nt, Human
auuuacaagugcugguacaucuuuuuucuuuuguggaccacaggaaggaagauuuauuuugaua

SEQ ID NO: 189839 - RNA, 64 nt, Human
uuauauuuuaacuuuggugggggaaagaguuauaggaccacagucuucacuucugauacuugua

SEQ ID NO: 189840 - RNA, 64 nt, Human
uccuuuucccuccugcuucccuucagucucuucaggaccacaggauggauaugcagacaugugg

SEQ ID NO: 189841 - RNA, 64 nt, Human
ggggaaagacuuaagccuuugagcucuccagcuuggaccacacauugcccuuuucucagggaag

SEQ ID NO: 189842 - RNA, 64 nt, Human
guaaacuuauucuugcauguugcugucugggaauggaccacacuacagcagguaguucuggggg

SEQ ID NO: 189843 - RNA, 64 nt, Human
ccaacgaagccuaggugaaaaucuauuuauaaauggaccacaacucuggggugucguuuuugug

SEQ ID NO: 189844 - RNA, 64 nt, Human
gugauuuaaggaagaaaacagacuuuucucaaauggaccacaucaucucucacucacagugaca

SEQ ID NO: 189845 - RNA, 64 nt, Human
uguccagccagguugagccuaggggccaguugggggaccacaggacaauuuucauauggccuaa

SEQ ID NO: 189846 - RNA, 64 nt, Human
gguuucaacauaugaauugggggaggacacauuuggaccacagcaugaaccuuuagaacagggu

SEQ ID NO: 189847 - RNA, 64 nt, Human
aggagguuuuacccaugaacuggccauccuacuaggaccacaagggaccaagggaaucagggac

SEQ ID NO: 189848 - RNA, 64 nt, Human
agugagugaugaucaugccacugcacuucagccuggaccacagagcaagacccuguguaaaaaa

SEQ ID NO: 189849 - RNA, 64 nt, Human
uccccacacaugggcaaggacagguggaaugucgggaccacacugugcggcuucucggcacaaa

SEQ ID NO: 189850 - RNA, 64 nt, Human
gccucccugccucagccugggaccugaguagcugggaccacaggcaugcgccaccacuccuggc

SEQ ID NO: 189851 - RNA, 64 nt, Human
ccgaagaaaugagaagucaaggacucucuuaaagggaccacauuuuuuaccuaaaaugcacaga

SEQ ID NO: 189852 - RNA, 64 nt, Human
agcaauccuccugccucagccuccugaacagcugggaccacaggugcacgccaccacaccuggc

SEQ ID NO: 189853 - RNA, 64 nt, Human
agcuauccuugcaccucagccucccaaguagcugggaccacaggcaugcaccacuacgcaugac

SEQ ID NO: 189854 - RNA, 64 nt, Human
ccuugggaggcccccguggauguggcccugugugggaccacacugucaucucgcugcuggcaga

SEQ ID NO: 189855 - RNA, 64 nt, Human
cgaucucccuccccaccuccgaagucuccuccguggaccacagguggaucuuugugcgaacaac

SEQ ID NO: 189856 - RNA, 64 nt, Human
gggagauccuccauagcuggcuuugaggacacggggaccacagccaugagcggccucuaagagc

SEQ ID NO: 189857 - RNA, 64 nt, Human
cuguucccaggcgaguggcugccaugagaccugaggaccacacuugggggaccaaucauguccu

SEQ ID NO: 189858 - RNA, 64 nt, Human
cauuccccaggcaguucccaugcaggugauccacggaccacauguugagaaacugcagucaccc

SEQ ID NO: 189859 - RNA, 64 nt, Human
agugauccuccugccucagccucccaaguagcuaggaccacaggugcgugucaccaugcuuggc

SEQ ID NO: 189860 - RNA, 64 nt, Human
agauccugcaucugggugaagaaacgggagcuguggaccacaggccagccagugaaccuccugg

SEQ ID NO: 189861 - RNA, 64 nt, Human
ccugcucagaggucagagggucugggcagaggagggaccacauuccccugccuugccccugagc

SEQ ID NO: 189862 - RNA, 64 nt, Human
caguggauguucucugaaugcuuacugggugccaggaccacagagagauguuagucacugccca

SEQ ID NO: 189863 - RNA, 64 nt, Human
uuucccgauucccccacccucccucuacacuugaggaccacaguuggggguguagggaccaccc

SEQ ID NO: 189864 - RNA, 64 nt, Human
cgucccagggccugugcugugaucaccugccuuuggaccacauuuguguuugcucuuagagauc

SEQ ID NO: 189865 - RNA, 64 nt, Human
cccuuccuugggcgucucccccagagugcugucgggaccacaucuguccucacccugugggacc

SEQ ID NO: 189866 - RNA, 64 nt, Human
ucgagcaguccugccucagccuccggaguagcugggaccacagguucaugccaccauggccagc

SEQ ID NO: 189867 - RNA, 64 nt, Human
uuaugagaguguuuuagccuacuggaauagacagggaccacauccucugggaagcagauaagca

SEQ ID NO: 189868 - RNA, 64 nt, Human
guccccugguuccugucuguuauuuguaaacugaggaccacaauaaagaaaucuuuauauuuau

SEQ ID NO: 189869 - RNA, 64 nt, Human
aaaccauacaaaguguuggcaacguagggaugguggaccacagaaggcuauaaaggccaccaua

SEQ ID NO: 189870 - RNA, 64 nt, Human
gguccugaagcccucugucuaccugggagaccagggaccacaggccuuagggauacaggggguc

SEQ ID NO: 189871 - RNA, 64 nt, Human
ccaucugcuggcaccugaggagagugagcagccuggaccacaagcccaguggucaccccugugu

SEQ ID NO: 189872 - RNA, 64 nt, Human
caccccagacccauccugccacuucuaugucucuggaccacaggauggugguggcauugcaggu

SEQ ID NO: 189873 - RNA, 64 nt, Human
aauggucaguacagagaagagaaaagcugcuuugggaccacauggucaguaggcacacugcccc

SEQ ID NO: 189874 - RNA, 64 nt, Human
agcaauccuccugccucugccucccaaguagcugggaccacaggugggcagcaccacaccuggc

SEQ ID NO: 189875 - RNA, 64 nt, Human
uggcuaaggcagacacacugacaccucccgaaguggaccacaagaaacgcaaagugagggaagc

SEQ ID NO: 189876 - RNA, 64 nt, Human
cccccaucaccaauuuugagggcagccagucucaggaccacaguggaaucuuuggccugguaac

SEQ ID NO: 189877 - RNA, 64 nt, Human
uuuuuguuucuguuuuuguuuuacauuagucauuggaccacagccauucaggaacuacccccug

SEQ ID NO: 189878 - RNA, 64 nt, Human
acugccugagaggacacaaugggggaggggcuucggaccacagcaggagccccgacugcccacc

SEQ ID NO: 189879 - RNA, 64 nt, Human
cgggggauccgggcugcugggcagcaggucggcgggaccacaugccugggucucacccucagcu

SEQ ID NO: 189880 - RNA, 64 nt, Human
ggcaagcaguguaaacggaggacuuggggaaaaaggaccacauaguccaucgaagaagaguccu

SEQ ID NO: 189881 - RNA, 64 nt, Human
cgcuccugccucacagcccacacucccuggggcuggaccacaacucagcccuucaccugugcac

SEQ ID NO: 189882 - RNA, 64 nt, Human
gauuaaauauauuuuauuugaucuggguauuuuuggaccacauuauuaaauuaauuguuaagcu

SEQ ID NO: 189883 - RNA, 64 nt, Human
gccucgugcagggacgcucaggcugcucccagcgggaccacaguuuuggccucugaaacacagc

SEQ ID NO: 189884 - RNA, 64 nt, Human
aggugaucuucccacucagacuccugcguagcugggaccacagggguaugccaccacaccuggc

SEQ ID NO: 189885 - RNA, 64 nt, Human
gcaaaaccuaggaaggcucauguucccagagaagggaccacaugagccuucucccaugcaaagc

SEQ ID NO: 189886 - RNA, 64 nt, Human
gcagccggaauucgugugagcugggguggggcugggaccacagguggcuucucucuugccugcu

SEQ ID NO: 189887 - RNA, 64 nt, Human
ggugauccucccaucucagccucucgaguagcugggaccacaguugugugccaccacacuuggc

SEQ ID NO: 189888 - RNA, 64 nt, Human
ggccauccaggaagaacuguacuggccaagccugggaccacacgucugcagagauccugcucug

SEQ ID NO: 189889 - RNA, 64 nt, Human
gaagcaaacaauuugugggccagugucaacacauggaccacacuuuauauagcacuguaacgga

SEQ ID NO: 189890 - RNA, 64 nt, Human
gugcaggggggcugggagcacugguguucacgugggaccacaggcugcaccauaagacccacuc

SEQ ID NO: 189891 - RNA, 64 nt, Human
ccaucuggaggcugcaggguccuugggguaacagggaccacagaccccucaccacucacagauu

SEQ ID NO: 189892 - RNA, 64 nt, Human
uccggcccucagugcccugcccucucccuuaccaggaccacagcucuguuccuucggccucugg

SEQ ID NO: 189893 - RNA, 64 nt, Human
ggcauuuuguugggaccagugaccccuggcauggggaccacacccuggagcccggugcugggga

SEQ ID NO: 189894 - RNA, 64 nt, Human
agccacccacacccaccccagcacaccucacacgggaccacagccgcgcugccgagggccaagc

SEQ ID NO: 189895 - RNA, 64 nt, Human
acaucucugauccugaagugaauucuggaacuauggaccacauuagacugggcagagauucgcc

SEQ ID NO: 189896 - RNA, 64 nt, Human
agcgauccucccaccucagccucucgaguagccgggaccacaggugcgagccccuacaccugga

SEQ ID NO: 189897 - RNA, 64 nt, Human
cucccguacggcgccccuccugacucccugccugggaccacacaccccugggauagaaagaccc

SEQ ID NO: 189898 - RNA, 64 nt, Human
agcgaucuucccacaucagccucccgaguagcugggaccacaaaugugagccaccaugccuggc

SEQ ID NO: 189899 - RNA, 64 nt, Human
caaacguaacaugcaugcugagacuauuacuccuggaccacaacuguaggugaggauucauagg

SEQ ID NO: 189900 - RNA, 64 nt, Human
cccugcacacuguggaugacaugguacccuggcuggaccacauacuggccucuuucuucaaccu

SEQ ID NO: 189901 - RNA, 64 nt, Human
gccaccaaaaacccacaaaggccccggagcugggggaccacaaacaaacaggguccuuagcugg

SEQ ID NO: 189902 - RNA, 64 nt, Human
cuucugaauacuugggagauacggaacggaccaaggaccacacuccagggugcauucguugcuc

SEQ ID NO: 189903 - RNA, 64 nt, Human
uucuucaauaaauaaaacacuuugaaacuccggaggaccacaucuuucaagacuucugaugggu

SEQ ID NO: 189904 - RNA, 64 nt, Human
gaauugccccuguucagagcagccggaguuugcuggaccacaaggaagaagagaagagacuugc

SEQ ID NO: 189905 - RNA, 64 nt, Human
gaacaauagggcagaaucaggagucaccuuagcaggaccacaucuuuggagccucgggauaaaa

SEQ ID NO: 189906 - RNA, 64 nt, Human
aggagaacuguuccuugugguuuccgucccuuggggaccacaggcaucagcagucccauucaag

SEQ ID NO: 189907 - RNA, 64 nt, Human
ugaugcauuauugaagcacuuuagcugaagcauuggaccacaaacacuucuccuuggaagugug

SEQ ID NO: 189908 - RNA, 64 nt, Human
cacccucgccgcaggcagcugcagcccccagaggggaccacaagcccaaaaaggacaaaaaugg

SEQ ID NO: 189909 - RNA, 64 nt, Human
uuuggacaucuaacgagcagcugugccagaggcuggaccacacaggagaagcucggacuuggca

SEQ ID NO: 189910 - RNA, 64 nt, Human
gagcuagagcccuuuauuucuuccaaccuugcaaggaccacacuccccauacccuucagugcag

SEQ ID NO: 189911 - RNA, 64 nt, Human
ucuuuucuuugguauucaggacacuaaggcaggaggaccacaugaguucugguugguaaguguc

SEQ ID NO: 189912 - RNA, 64 nt, Human
aaagugucaucuucugcccucccugucccaauagggaccacaucuuauuugucucaaacaggga

SEQ ID NO: 189913 - RNA, 64 nt, Human
agcgauucucaugccucagcccuccgaguagcugggaccacagguguacgacaucaugacuggc

SEQ ID NO: 189914 - RNA, 64 nt, Human
agcaagggacuccccaggugcggcccaaggcuccggaccacacuggcccccugcggcggaggcc

SEQ ID NO: 189915 - RNA, 64 nt, Human
agcgauucucuugccucagcuuccccaguagcugggaccacaggugcccgccaccacacccaac

SEQ ID NO: 189916 - RNA, 64 nt, Human
agugagcucugauggaaccacugcacuauagccuggaccacagagcaggccccugucucaaaaa

SEQ ID NO: 189917 - RNA, 64 nt, Human
uugaguaccagaccucaugggaccagaccccuugggaccacauggcacaaugggaccucuguug

SEQ ID NO: 189918 - RNA, 64 nt, Human
cuguuuaccugcucacuggcucuagccagcccagggaccacaucaaugugagaggaagccucca

SEQ ID NO: 189919 - RNA, 64 nt, Human
gcuggguuucucuucccuuuuuaucugcugguguggaccacaccugggccuggccggaggaaga

SEQ ID NO: 189920 - RNA, 64 nt, Human
cucuggaaagccaaagcagcucaucccuuccuggggaccacacugcucugcuccaccagaccac

SEQ ID NO: 189921 - RNA, 64 nt, Human
aggaugaauggggggaucucaaggcccaaaugcuggaccacaucuccugcuguucuggguaacc

SEQ ID NO: 189922 - RNA, 64 nt, Human
gaccaauccccuugccaccacuuugcaucaccugggaccacagauuuggacaggaagggcucug

SEQ ID NO: 189923 - RNA, 64 nt, Human
caggugaaagggcagcuuuaauggugguuuuuauggaccacauuaucagagagcacugugcaag

SEQ ID NO: 189924 - RNA, 64 nt, Human
aagcauauccucccccaguuuagccuuuagaugaggaccacagccaaauagcuugacuguaagc

SEQ ID NO: 189925 - RNA, 64 nt, Human
cgaaccaggaacucaaucaaaaugcgccacagcaggaccacaagggcaaggagaccaccgccuu

SEQ ID NO: 189926 - RNA, 64 nt, Human
cgaacgaggaacucaaucaaaaugagccauagcgggaccacaagggcaaggagaccaccaccuu

SEQ ID NO: 189927 - RNA, 64 nt, Human
caaagcuuccucagaauuguggcugugccacgcuggaccacagggucccccucaagcaucucgg

SEQ ID NO: 189928 - RNA, 64 nt, Human
auauguuacuguauugcaaaaucuguuaagagcaggaccacaucgauaguauuuaauaauuugu

SEQ ID NO: 189929 - RNA, 64 nt, Human
gccccauuaacugcuuccuauaauuuugauagugggaccacauacguaaaaaucucucauuugu

SEQ ID NO: 189930 - RNA, 64 nt, Human
accucauugggugaaaguuccagggcucaauccaggaccacacucuuauuggccaggcaggggc

SEQ ID NO: 189931 - RNA, 64 nt, Human
uuuugugauaggagggauauuuacauauuuuaguggaccacauuuuaaguuggauggugugcuc

SEQ ID NO: 189932 - RNA, 64 nt, Human
augcuaggcaguggcugcuccaugagcccuuuguggaccacauguuaaaggccugggguuuagg

SEQ ID NO: 189933 - RNA, 64 nt, Human
ugaaggugccccgcauccagaaagacgcacuccuggaccacaaccggcggcuaccucagcccca

SEQ ID NO: 189934 - RNA, 62 nt, Human
aggcuccccugugagccguggcuugucuggucuucgcccacgggaggcuggacagaggcugu

SEQ ID NO: 189935 - RNA, 64 nt, Human
uggggacauguaggaugggcucuuaccccagggagggcggcaggcuccacuucggcgagagguu

SEQ ID NO: 189936 - RNA, 64 nt, Human
gggacagccauaacacccccgggacaguaggucugggcggcaccacugggaacucuggacuuga

SEQ ID NO: 189937 - RNA, 64 nt, Human
cccacccagggcucccuccuggagcaucccaggcgggcggcacgccaacagccccccccuugaa

SEQ ID NO: 189938 - RNA, 64 nt, Human
cccacgagaauaugucacuugcccagauaaaacugggcggcagccagaguucccugaaguggga

SEQ ID NO: 189939 - RNA, 62 nt, Human
cacccuacagauauaagagguuaaaauaacaguucgcccaauuuaagcccaguagugucagu

SEQ ID NO: 189940 - RNA, 62 nt, Human
uuuuuuuuuuuuuugagacggagucucgcucuuucgcccaggcuggagugcaguggcgcaau

SEQ ID NO: 189941 - RNA, 62 nt, Human
ccuacagcagugccugcacgcccggcugcaaauucgcccagccaauggggacguugcggccc

SEQ ID NO: 189942 - RNA, 62 nt, Human
acuugaguucggaagggcuguggccaccucguuucgcccaucuacuuuucaccuugccguau

SEQ ID NO: 189943 - RNA, 62 nt, Human
caggcuggucucaaacuccugaccucaggugauucgcccaccucagccucccaaagugcugg

SEQ ID NO: 189944 - RNA, 62 nt, Human
aagugagccuccgccuuggaggagacuacugguucgcccaucuguuuggaguuucuguuguu

SEQ ID NO: 189945 - RNA, 62 nt, Human
uuuuuuguuuuuuugagauggagucucacucuuucgcccaggcuggagugcagugguaugau

SEQ ID NO: 189946 - RNA, 62 nt, Human
uugguauuucccugacagagagaaccagcaguuucgcccaaauccuacucugcugggaaauc

SEQ ID NO: 189947 - RNA, 62 nt, Human
auagaaaaaaaugcauuauauuugagagcuacuucgcccaaauuacaaaaugaguguuuuua

SEQ ID NO: 189948 - RNA, 62 nt, Human
cgaggacuccacuucuggggacgccugguucguucgcccaccaggccuaggcuacgcuccau

SEQ ID NO: 189949 - RNA, 62 nt, Human
aagugggcagagaacaucagaugauugaaauguucgcccaggggucuccagcaacuuuggaa

SEQ ID NO: 189950 - RNA, 62 nt, Human
auuuauuuuuucugagacggaguuucgcccuuuucgcccaggcugaguacaguggugcaauc

SEQ ID NO: 189951 - RNA, 62 nt, Human
acgcacaguguuaaggagccaagaggagccacuucgcccagacuuuguuuccccaccgccug

SEQ ID NO: 189952 - RNA, 62 nt, Human
gaaauugcuccauuccugaguaaacagauauuuucgcccaccuaaagggaagcccugacaac

SEQ ID NO: 189953 - RNA, 62 nt, Human
cacucuagcacagcauacaagugugugcucuguucgcccaggucuccaugguuaguugaagc

SEQ ID NO: 189954 - RNA, 54 nt, Human
caacgccauauuuccuuugaggccuucgcccauccugcugacccauuuuucugc

SEQ ID NO: 189955 - RNA, 64 nt, Human
uagaauuuagcagacagcuguuccacgcgggccagggcggcaugaagaagucccgccgcuacgu

SEQ ID NO: 189956 - RNA, 64 nt, Human
uggcuccagaacuccugugccaggcgggagggaagggcggcacuggagagaugggcccaucauu

SEQ ID NO: 189957 - RNA, 64 nt, Human
acaugcagaagcaaauaucaggccugucgcacacgggcggcauuuaaauaggaauuucuauuuu

SEQ ID NO: 189958 - RNA, 53 nt, Human
gccgcaccacggagcccugacccuucgcccagcaccgcgguuccgcuuuggga

SEQ ID NO: 189959 - RNA, 62 nt, Human
aaagccaggauuuggggcuaggcgggaagauguucgcccaauugcuugggggguugggggga

SEQ ID NO: 189960 - RNA, 62 nt, Human
uguguacgcuaguuuucauuuuugcagugugguucgcccaguagucuuguggaugccagaga

SEQ ID NO: 189961 - RNA, 62 nt, Human
uaggacagaugcagcaagauauuaggacagauuucgcccauuauucaggcugcacaacacag

SEQ ID NO: 189962 - RNA, 62 nt, Human
aaacagacucgcuagcacucaagacccgguuauucgcccacccgaguaccuccagucacacu

SEQ ID NO: 189963 - RNA, 62 nt, Human
accggaauaugaauuucugcaccguuucagacuucgcccacccaucccuccccucgucuccu

SEQ ID NO: 189964 - RNA, 62 nt, Human
cacucuccacuucccaguuugcaaauguggcuuucgcccaccaagugaaagcggacugagag

SEQ ID NO: 189965 - RNA, 62 nt, Human
auuguauggauauagcauaguauguuuauccauucgcccauuaaaggaaaucuugauugcuu

SEQ ID NO: 189966 - RNA, 62 nt, Human
auaggucagugaggcccagggagaggccaugauucgcccaaagccagacagcaacggggagg

SEQ ID NO: 189967 - RNA, 62 nt, Human
gccgccugggacuuaaccugcucaggcgggccuucgcccagcugcaaauagggaugcguuag

SEQ ID NO: 189968 - RNA, 62 nt, Human
aaacaguaaaagcugaagagagcguauuauuauucgcccauuccgagagaaaguugaagaug

SEQ ID NO: 189969 - RNA, 62 nt, Human
caagguuuuuaaauaagaaaaccaacccugccuucgcccaugcccgccccugcccgcaguug

SEQ ID NO: 189970 - RNA, 62 nt, Human
uucguuuguuuuuugagacugaguuucacucuuucgcccaggcuggagugcauuggcaugau

SEQ ID NO: 189971 - RNA, 62 nt, Human
acgaguuauuuaaaacaguuacacugcaggguuucgcccaauaaagguggacugacauuccc

SEQ ID NO: 189972 - RNA, 62 nt, Human
gcccucugggagcuguuaucaucucagaucucuucgcccaucuauggcuguguugucacauc

SEQ ID NO: 189973 - RNA, 62 nt, Human
ggaacuauggaccacauuagacugggcagagauucgcccaaccccuagcacuccggcucugg

SEQ ID NO: 189974 - RNA, 64 nt, Human
ugaccagcaggcagccucaucuggucgggggcgggggcggcaggagcagaagcggggucuccgu

SEQ ID NO: 189975 - RNA, 64 nt, Human
gaaagccccguucacugcuccugugagagguugguggugacaggauggggaaccgaccucuuca

SEQ ID NO: 189976 - RNA, 64 nt, Human
cacccgugcauauguugaccuuugcaaaaugaccuggugacauggcaagucaguggggacagga

SEQ ID NO: 189977 - RNA, 62 nt, Human
guauacaggaaucuacaucccucugugacugcuucgcccaguagaauaugguagacguacug

SEQ ID NO: 189978 - RNA, 62 nt, Human
uuuuuuuuuuuuuugagacggagucucgcucuuucgcccaggcuggcgugcaguggcacagu

SEQ ID NO: 189979 - RNA, 62 nt, Human
gcucuggugaauugugacauguugguuaccuguucgcccagugccacgucugcaugugaagc

SEQ ID NO: 189980 - RNA, 62 nt, Human
ccccccauccucacaccuaaccugcauggggcuucgcccacaaccauucuguaccccuuccc

SEQ ID NO: 189981 - RNA, 62 nt, Human
gcaaguauucugcccgccucccaccaucagccuucgcccaaggggcccuucugccucugcuu

SEQ ID NO: 189982 - RNA, 62 nt, Human
ggcuuuguggccguccaagugccaauuggcuuuucgcccaaauaagggcugguauuucuccu

SEQ ID NO: 189983 - RNA, 62 nt, Human
ugcggcacuuccugcugauggaggacggcgaguucgcccagucccucagcgaccugcucuuu

SEQ ID NO: 189984 - RNA, 62 nt, Human
cgggcuugugaggccggaauccgggcuccccuuucgcccacagucugacuuccccgcauucc

SEQ ID NO: 189985 - RNA, 62 nt, Human
aacaaagcaccaauuagcagucucuucccauuuucgcccaacuuaucccccaccuccauccc

SEQ ID NO: 189986 - RNA, 64 nt, Human
gagcccaccccggcuguaucucaggucuggguccucccucuagccgaggaggccaccugcagcc

SEQ ID NO: 189987 - RNA, 64 nt, Human
cuguuuuuauuaaaccagugauuacaccuggccaucccucuaaauguucuaggaaggcaugucu

SEQ ID NO: 189988 - RNA, 64 nt, Human
aucucaggcuuggguucacaccaucacccuuucuucccucuagguggggggaaagggugaguca

SEQ ID NO: 189989 - RNA, 64 nt, Human
cauuuuacuuucugcaagcuguuucccuagcagcucccucuaggggagaggugaaaucuugcaa

SEQ ID NO: 189990 - RNA, 64 nt, Human
aaaaaaaaagaaaaagaaaaaacuaaacaaaaaaucccucuagguaguuuaggugaaaaauguc

SEQ ID NO: 189991 - RNA, 64 nt, Human
uaacacugguuuugagacagacuuuauucagcuaucccucuauauaauagguaccaccgauaau

SEQ ID NO: 189992 - RNA, 64 nt, Human
ggggucucauuccuuucuguuccccagugccccggggcggcauuuuacugcucagaauuuggag

SEQ ID NO: 189993 - RNA, 64 nt, Human
uauuuccucaucuuuuuguuguugucauggaugguggugacauggacuuguuuauagaggacag

SEQ ID NO: 189994 - RNA, 64 nt, Human
gggcuggccuuggaaaaaccccaaaacaggacuguggugacaacucuggucaggugugauuuga

SEQ ID NO: 189995 - RNA, 64 nt, Human
cucuucccaaaaaguguuaucuuuuccuuaaauaucccucuagagguauuuuuccuaaguggua

SEQ ID NO: 189996 - RNA, 64 nt, Human
auggaauauuuugcuagcugugguguucaccgcaucccucuagucuuagaagagaagauuauuc

SEQ ID NO: 189997 - RNA, 64 nt, Human
gcacagcacugcuaauguaaauuucaguuguuuuucccucuaggacaaacacuuaccaaaauau

SEQ ID NO: 189998 - RNA, 64 nt, Human
uucugugagcaaaacuuuuuaguacgcguauauaucccucuaguaaucacaacauuuuaggauu

SEQ ID NO: 189999 - RNA, 64 nt, Human
uagguggcccgucucaucugugaacuugacucugucccucuacaugucucuuuaauggggugag

SEQ ID NO: 190000 - RNA, 64 nt, Human
cagaguuguuauuuuucuuagaaggagccucuuuucccucuauuuuuuaaauugaaauauaaua

SEQ ID NO: 190001 - RNA, 64 nt, Human
ccugcacuuugugauuuaaauccacucuaaaccuucccucuaaguguagagggaagacccuuac

SEQ ID NO: 190002 - RNA, 64 nt, Human
uaggacacaguggccauugagcugggagcauucuucccucuaccgcuuaagccacugauggcug

SEQ ID NO: 190003 - RNA, 64 nt, Human
ccugcugcaaccgcugugaaugcugcugagaaccucccucuauggggauggcuauuuuauuuuu

SEQ ID NO: 190004 - RNA, 64 nt, Human
cuugucacuaaucaccaaggagucauuaacuuccucccucuaugcccaccccugacacuucacc

SEQ ID NO: 190005 - RNA, 64 nt, Human
gggaaaaccaggcaccagccucugcagcaaugggucccucuagccuguggacaccagcuggggg

SEQ ID NO: 190006 - RNA, 64 nt, Human
gaacuugacugggugagacccaaagcggucccugucccucuagugccuucuuuagacccucggg

SEQ ID NO: 190007 - RNA, 64 nt, Human
ugagagaaguauguggacaucucuucuuuuccugucccucuagaagaacauucucccuugcuug

SEQ ID NO: 190008 - RNA, 64 nt, Human
cugcucuucccucagcucugccggggcucuaaggucccucuauuuauuucucaacccuggcugg

SEQ ID NO: 190009 - RNA, 64 nt, Human
ggccagacaggguuaccuggugaggugcagagagucccucuaguggccauuuuguaugguaguu

SEQ ID NO: 190010 - RNA, 64 nt, Human
ugcaggcccuccugccuggguuucauucuggcuaucccucuaaggcgcaaggugaagaagcuuc

SEQ ID NO: 190011 - RNA, 64 nt, Human
ugcauuaauugacuuggaauccuuagaaauggaguggugacaugucaguaugagaacaggcaaa

SEQ ID NO: 190012 - RNA, 64 nt, Human
uuuuuaccugugaaauaacagugacuuuuuaaaauggugacaguguuggcaaggaaacagcaac

SEQ ID NO: 190013 - RNA, 64 nt, Human
uauguaauuguuguaagaguuaaauacaaaaucauggugacacuuccaauuaagugcacuaaau

SEQ ID NO: 190014 - RNA, 64 nt, Human
ucugucauuguacccuuaagucacccuagcccucucccucuaggcucugccuucgaggucagag

SEQ ID NO: 190015 - RNA, 64 nt, Human
aacugggaugggagguugauuugcucucuaaacuucccucuaguuggcaagucucacauauuca

SEQ ID NO: 190016 - RNA, 64 nt, Human
ggugagauggccuuggguugcccuuggcuucuccucccucuacucagccuuaaaaagggcuucu

SEQ ID NO: 190017 - RNA, 64 nt, Human
uccuguccuuccuugaaauugcugauuguucugcucccucuacagauauuuauaucaauuccua

SEQ ID NO: 190018 - RNA, 64 nt, Human
ugggccagaaaccaaagcugagcuuuuaacuuucucccucuaugacacaaaugaauugagggua

SEQ ID NO: 190019 - RNA, 64 nt, Human
ccuaacagugccucacaaggcuugggggcuggacucccucuacucccucuggccauagccccuc

SEQ ID NO: 190020 - RNA, 64 nt, Human
uuuccucuuaaguacaccuucaacuauauucccaucccucuauuuuaaucuguuaugaaggaag

SEQ ID NO: 190021 - RNA, 64 nt, Human
acgcuuucuagcuguugagcuguuuucccugaccucccucuaauuuaucuugucucugggcuug

SEQ ID NO: 190022 - RNA, 64 nt, Human
caagccuuggaaagcugacacugucucuuuuuccucccucuauacgaaggauguauuuaaauga

SEQ ID NO: 190023 - RNA, 64 nt, Human
gaaauauuucuagaacacacagagagggaauaagucccucuaucacccuuauuaccaagccuug

SEQ ID NO: 190024 - RNA, 64 nt, Human
cuaagagggggcagaaaugaaugaccagguuaaaucccucuacaugugguuucuguuugaaaaa

SEQ ID NO: 190025 - RNA, 64 nt, Human
cuucaccucuaaguuauguacaacucaaccugcaucccucuaaaaguccuauauccauauucac

SEQ ID NO: 190026 - RNA, 64 nt, Human
aaaugaaguggugagcuuaacccuggaaaaugaaucccucuaucucuaaagaaaaucucuguga

SEQ ID NO: 190027 - RNA, 64 nt, Human
cuauccuuuucagagcacuucauccacuugcuccucccucuacccucggcacccugggugggaa

SEQ ID NO: 190028 - RNA, 64 nt, Human
aaucauuuggaauaccuaaagauuguagagucauucccucuaucacugacacaucagugacgau

SEQ ID NO: 190029 - RNA, 64 nt, Human
gguacagguuacacauauggccauuuauguaaagucccucuaagacuacauacuuuuuguuuaa

SEQ ID NO: 190030 - RNA, 64 nt, Human
ugaacacuaaagaauaauauauaagcacacaaauuggugacagaauuucaauuacgugaacgca

SEQ ID NO: 190031 - RNA, 64 nt, Human
gaaacaauagauuauuuuauauuauuauuucugauggugacaaguuugucuugaggucacauuu

SEQ ID NO: 190032 - RNA, 64 nt, Human
agcauggaacacaagcuccucuggauccugcagcuggugacauggaacuguuuucugguccaca

SEQ ID NO: 190033 - RNA, 64 nt, Human
cugcucccccaaaggcccgcucuaggccuuauccucccucuagguccugccacaaccugucccu

SEQ ID NO: 190034 - RNA, 64 nt, Human
ccaugagagcguuccuugaguccguacaccguccucccucuagaagcuggcaucacacucaugc

SEQ ID NO: 190035 - RNA, 64 nt, Human
gacauuaccaugaguaauaagggggcuccaggacucccucuaaguggaauagccucccuguaac

SEQ ID NO: 190036 - RNA, 64 nt, Human
uuagcucccuuucaccauuuauucagcuacaucaucccucuauuaaccccaccccaucaggcac

SEQ ID NO: 190037 - RNA, 64 nt, Human
ucaucagcaguugcugugagaaaacuuugccuggucccucuagcugcuggugguucuuucacag

SEQ ID NO: 190038 - RNA, 64 nt, Human
auauccuauauuuaaguacccauaauaaaucauuucccucuauaaguguuauugauuauuuuaa

SEQ ID NO: 190039 - RNA, 64 nt, Human
auuaauauuuuucccuauuagaaaccacaauuacucccucuauuaacccuucacuuacuagacc

SEQ ID NO: 190040 - RNA, 64 nt, Human
cuagugacacacaaagccuuaugagaguauuccuucccucuagggcccaaagaggcugcuaacc

SEQ ID NO: 190041 - RNA, 64 nt, Human
guucuagcagcaggaaaaguuucucuauauccucucccucuaccuguaacaauuuuguuuucua

SEQ ID NO: 190042 - RNA, 64 nt, Human
cacaccacugccugaauuggagccccccagagugucccucuacccagaguuuuuauuucuuuaa

SEQ ID NO: 190043 - RNA, 64 nt, Human
cucuggcccagacaugaauaccucguguuccuccucccucuauuacuguuucaccagagcuguc

SEQ ID NO: 190044 - RNA, 64 nt, Human
cuauugauaggaguggggacugggugggggcuucucccucuacccagggcugggcugauccccc

SEQ ID NO: 190045 - RNA, 64 nt, Human
uuccauuuuauucuucugagugucuauguuaacuucccucuaucccgcuuauaaaaaaauucuc

SEQ ID NO: 190046 - RNA, 64 nt, Human
uagaugcauuagaagucagccagcgcauaggugcucccucuauauuauggagaaagcaaaaccc

SEQ ID NO: 190047 - RNA, 64 nt, Human
ugcauguuauacuuuuauguaggauuccaaaccuucccucuaaaugggauuuaacccacaucug

SEQ ID NO: 190048 - RNA, 64 nt, Human
uuuuuguggcugcuuuuucuacacauccagauggucccucuaacugggcuuucucuaauuuugu

SEQ ID NO: 190049 - RNA, 64 nt, Human
ucugcugggaucuaguuuuccaaguaacauuuuguggugacagaagccuaaaaaaagcuaaaau

SEQ ID NO: 190050 - RNA, 64 nt, Human
uuuaguuucaacucaaauguaaagcaaaguaguuuggugacauuuugcuuuuaugugaaauagu

SEQ ID NO: 190051 - RNA, 64 nt, Human
cccugacuccaccccagggacauucaaaaaugucuggugacaguuuucauugucaugacuuggg

SEQ ID NO: 190052 - RNA, 64 nt, Human
gucuuacccauccccuggauaugcucuuguuuuuucccucuaauagcuauggaaagaugcauag

SEQ ID NO: 190053 - RNA, 64 nt, Human
acugagaaccguauugauuuuuauuuuaguuaccucccucuaguuuuaugugaaauuaguagaa

SEQ ID NO: 190054 - RNA, 64 nt, Human
ugaagccaaacacauccuuucaucagaagcccauucccucuauaaggcguuauuacauuuauga

SEQ ID NO: 190055 - RNA, 64 nt, Human
ugaaggggcguccauucuccuccauacauccccaucccucuacuuuccccagaggaccacaccu

SEQ ID NO: 190056 - RNA, 64 nt, Human
acugucaugguucuacagaaaugcccuccaugugucccucuaauguugcauguuucaguggguu

SEQ ID NO: 190057 - RNA, 64 nt, Human
cccugcucggccgguguaaauauguuucacccugucccucuaauaaagcuccucugcuccaccu

SEQ ID NO: 190058 - RNA, 64 nt, Human
acuguaaaauuucagaaauugugggcucauucccucccucuaguuuauuuauuugcucaucuuu

SEQ ID NO: 190059 - RNA, 64 nt, Human
aauggggagggauagagggugggggcucaugguuucccucuacuuugggagagggcacagauug

SEQ ID NO: 190060 - RNA, 64 nt, Human
uucccacucccccuugaccccaggccccugcuucucccucuaggagccuaaagaacccuccugg

SEQ ID NO: 190061 - RNA, 64 nt, Human
ugcauccaggccuuuugucuugguguucaugaucucccucuaagcacauuccaaacuuuagcaa

SEQ ID NO: 190062 - RNA, 64 nt, Human
ucaacagcccgggcgcgccuuuuggcucugcgggucccucuauuuaugcaaagccgaccuaugc

SEQ ID NO: 190063 - RNA, 64 nt, Human
cagcucauugcuacaaccaguccagagguuuuauucccucuacuccgagcaaugaaauagaccu

SEQ ID NO: 190064 - RNA, 64 nt, Human
cggcuaagugggacauuaguaacugcacacuauuucccucuacugaguaaacccuaucugugau

SEQ ID NO: 190065 - RNA, 64 nt, Human
cccacgcuuuucucucuuccuuccccucucauucucccucuaauguguggugcuuuggugagca

SEQ ID NO: 190066 - RNA, 64 nt, Human
agacacggagcccagcccuccccauggagccagcucccucuauuuauguuugcacuugugauua

SEQ ID NO: 190067 - RNA, 64 nt, Human
aaaagcucuugguaggauuaguugguucuaaggaucccucuagggaccucauuauuucaagagg

SEQ ID NO: 190068 - RNA, 64 nt, Human
uaacucuguccugaagagugggacaaaugcagccgggcggcagaucuagcgggagcucaaaggg

SEQ ID NO: 190069 - RNA, 64 nt, Human
cuuucaaaaauuagugaaguucuuuuacuguaauuggugacaaugucacauaaugaaugcuauu

SEQ ID NO: 190070 - RNA, 64 nt, Human
cccagugacggagcgggacccgcccucaucccauuggugacacauguuggugucacagcccuca

SEQ ID NO: 190071 - RNA, 64 nt, Human
uggggacggcagaggauaaagcccccuccucacaucccucuauugcggauccacaguggccuua

SEQ ID NO: 190072 - RNA, 64 nt, Human
agaguggccugggacccaagcugccgcagcugaguggccccagcggacaccuccucaggcuuaa

SEQ ID NO: 190073 - RNA, 64 nt, Human
guguuaaccaucccuuuuugagcgugacuuguuuuggccccauuucuuacaacuucagaaaucu

SEQ ID NO: 190074 - RNA, 64 nt, Human
auuacuuaacuucacacacacacagagaagaguguggccccaccccuccuagugaacuaacgcu

SEQ ID NO: 190075 - RNA, 64 nt, Human
ucaccauggguuuagaacaaagacguucaagaaauggccccauccucaaagaaguagcaguacc

SEQ ID NO: 190076 - RNA, 64 nt, Human
acugcccuuuuaaauggcaugacaaggugugcaguggccccauccagcaugugugugucucuau

SEQ ID NO: 190077 - RNA, 64 nt, Human
uguguaaagccuaacauagcccugcaaagagaucuggccccagcagugaacacaaacucaguaa

SEQ ID NO: 190078 - RNA, 64 nt, Human
auggugaaacccaggaaaauuaaguacuugugcauggccccacuaucaauaacacaaagucugu

SEQ ID NO: 190079 - RNA, 64 nt, Human
uguucccugagaaacccaccagccuaagaagcucuggccccaggcuugucacuagcagcugcag

SEQ ID NO: 190080 - RNA, 64 nt, Human
ucccagguaguugcucugaagaguuucaguagaguggccccagggugauagcucagggaacaac

SEQ ID NO: 190081 - RNA, 64 nt, Human
uaaaaagcugucaaacauuuacugaaaauagaauuggccccauggcuugaugugaagacagcaa

SEQ ID NO: 190082 - RNA, 64 nt, Human
ugggggugccucacgaagcaucccuguagacauuuggccccagcuucacugcuuggaagcaugu

SEQ ID NO: 190083 - RNA, 64 nt, Human
cgccaaagcucauaagggcugugacccacccauauggccccaguuuuuucugucucuucuguuc

SEQ ID NO: 190084 - RNA, 64 nt, Human
uccugguuuuauauuucggagggaaaggauuauuuggccccauuaagaauuaagaggcugggug

SEQ ID NO: 190085 - RNA, 64 nt, Human
gcgacuugccugccccugaagcccuuguucccauuggccccaguuugcauucugcagguuuucc

SEQ ID NO: 190086 - RNA, 64 nt, Human
cuuuccaauggugccuugcuuggugcucuccugguggugacauaacauugguucuacagaaucg

SEQ ID NO: 190087 - RNA, 64 nt, Human
aucaaaucucacagacaucaggcaaauuauagccuggugacaaaaguguucauagugaauuagu

SEQ ID NO: 190088 - RNA, 64 nt, Human
uuuuuuugccuuccauucugugagauuugacagauggugacaauaagaaaaugagcugauugua

SEQ ID NO: 190089 - RNA, 64 nt, Human
auucgaguaucacagagguuuucaaaagcccuuauggugacaucuaccuagguaaaagccugac

SEQ ID NO: 190090 - RNA, 64 nt, Human
cccauuccagcggagacuuauguaggagggaccuucccucuaccucccccaguuagugacagga

SEQ ID NO: 190091 - RNA, 64 nt, Human
aucagccccuugcuugaggcuugaggucauaauaucccucuaggacuuaccuguucccccagau

SEQ ID NO: 190092 - RNA, 64 nt, Human
ccacaaaaguggaccucccuaucaugcuuccccuucccucuagcaugugggaagggacugcugu

SEQ ID NO: 190093 - RNA, 64 nt, Human
aagguguacauaccuauacauccuguacaaauuaucccucuauauuuauauuuuuuaagacuaa

SEQ ID NO: 190094 - RNA, 64 nt, Human
gucguuuaaaacuggagcuucagugucucuucccucccucuaauaguaaugguucaguaagcac

SEQ ID NO: 190095 - RNA, 64 nt, Human
gaucacuggaaaggugucucagucacaaaacuucucccucuacuacuggaugaaaugucugcau

SEQ ID NO: 190096 - RNA, 64 nt, Human
cacucaucucugaggagcuaugaacugguuuuggucccucuaaugauccuccagccucaucuaa

SEQ ID NO: 190097 - RNA, 64 nt, Human
ugcaggaauaaagcaacccccuaaccacaaaauaucccucuaaauuaguucccuagcuuucuca

SEQ ID NO: 190098 - RNA, 64 nt, Human
uuuucagccacuuaggcucguugcgguuuaaagaucccucuaggucacugagaaaugccacaga

SEQ ID NO: 190099 - RNA, 64 nt, Human
gccugcagacuucuccagcacuaaauauauuuguucccucuauaaaccauucaucuuucggaca

SEQ ID NO: 190100 - RNA, 64 nt, Human
cuuugcaaugcaagcccuuucugguguuaugaagucccucuaugucgucguuuucaccagcaac

SEQ ID NO: 190101 - RNA, 64 nt, Human
gguaggggcgggaagccugagugcaaaugucauuucccucuacugccucuuccugccucucccc

SEQ ID NO: 190102 - RNA, 64 nt, Human
caggagcuacaaugauagcuguuuccuggauuccucccucuauccagaacuagcugauguccag

SEQ ID NO: 190103 - RNA, 64 nt, Human
cuuuuccagcuggaugagaauuugagugcucugaucccucuacagagcuucccugacucauucu

SEQ ID NO: 190104 - RNA, 64 nt, Human
caaauuggcggggugggaaguccugagugcuccgucccucuagcaucacuccugagcugcggga

SEQ ID NO: 190105 - RNA, 64 nt, Human
uuuagaagguuacugaaagcucugccuuccggaaucccucuaagucugcuugauagaguggaua

SEQ ID NO: 190106 - RNA, 55 nt, Human
ucugcaacucggaacucugaacccagggcggcagggcggaaggugcuccucaggc

SEQ ID NO: 190107 - RNA, 64 nt, Human
acgggggcuggagaaggccuggauaaagacagaagggcggcaacacaccaccccagcccccacc

SEQ ID NO: 190108 - RNA, 64 nt, Human
ccgaagucagucggaguacuugaagaaggcccacgggcggcacggaguuccugagcccuuucug

SEQ ID NO: 190109 - RNA, 64 nt, Human
uucuauccaaguagaauguacgccaggagcuccuucccucuagcaauuucuacuaaaaugucca

SEQ ID NO: 190110 - RNA, 64 nt, Human
acagagaaagagaggcuguucauugauccacuauucccucuauuuuccucuaagguaaauauuu

SEQ ID NO: 190111 - RNA, 64 nt, Human
cucugggguaggagaacagccauuccacauguguucccucuauccguccugcuuccugggcagc

SEQ ID NO: 190112 - RNA, 64 nt, Human
uuccuuuuuuuuuccugccacugucccaacucuuucccucuacgucucucuagaaugacaucuu

SEQ ID NO: 190113 - RNA, 64 nt, Human
caauacuacuaaagccauacaauaucaagcacccucccucuagguccagggacuaucacagaag

SEQ ID NO: 190114 - RNA, 64 nt, Human
ucagaaggggaaaagcuaaacccagagcugucagucccucuaucccuucuccuguccaggggcc

SEQ ID NO: 190115 - RNA, 64 nt, Human
ggaaguuacuuuaagaaaaccaguguggccuuuuucccucuagcuuuaaaagggccgcuuuugc

SEQ ID NO: 190116 - RNA, 64 nt, Human
cuuagaaaggggcuucaggaagggaugugcuguuucccucuacgugcccaguccuagccucgcu

SEQ ID NO: 190117 - RNA, 64 nt, Human
ccuuuucccucuguggccuccuggcuugcacugcucccucuagaaagauuccuucaggucugga

SEQ ID NO: 190118 - RNA, 64 nt, Human
ucucacuccaccaaaggagcccagccucucuuugucccucuauccaugcaacagucuucucugu

SEQ ID NO: 190119 - RNA, 64 nt, Human
ccuggggccagaacagccuaccccaggacaggagucccucuaguugucucccuaccacccuaua

SEQ ID NO: 190120 - RNA, 64 nt, Human
cacaucuggaauuaaggucaaacuaauucucacaucccucuaaaaguaaacuacuguuaggaac

SEQ ID NO: 190121 - RNA, 64 nt, Human
acuauuaugcaaaguaacuguauuaaaguuuacuucccucuaagcaaauaugcuugacaugccu

SEQ ID NO: 190122 - RNA, 64 nt, Human
gcacuuggaguuagaucuagguccuucuaucucgucccucuacagauguauuuuccacuugcau

SEQ ID NO: 190123 - RNA, 64 nt, Human
uaucccacauccaacuccagcaacuucuucuccaucccucuaaugagacugaccauauugugcu

SEQ ID NO: 190124 - RNA, 64 nt, Human
ugaauaaauaauuauaaauugagcacugauggaaucccucuacaggucaagaaauagcgcagug

SEQ ID NO: 190125 - RNA, 64 nt, Human
cuggcugaccccuggccggcccaggccuccacgggggcggcaggcuggguucauuccccggccc

SEQ ID NO: 190126 - RNA, 64 nt, Human
uggcgagcuccuaggccucuggcuuccugguagagggcggcaugccgaagggucugcugggugu

SEQ ID NO: 190127 - RNA, 64 nt, Human
aacuguaaguccuguuugguuguuguuggacgcagggcggcacaugaguguuuuugguuagagc

SEQ ID NO: 190128 - RNA, 64 nt, Human
ccuuucuuuucccccuuugugcacauuuauuuccucccucuaccccaauuucggauuuuuucca

SEQ ID NO: 190129 - RNA, 64 nt, Human
ccuugcuguggagcucuggaacacucucuaaauuucccucuauuaaaaaucacugcccuaacua

SEQ ID NO: 190130 - RNA, 64 nt, Human
gagcuucugcacaucaugaugacuuuaccuccauucccucuacccagaacccuaaauuauucug

SEQ ID NO: 190131 - RNA, 64 nt, Human
aucccccaggacuguccuuuacucuuugauaguaucccucuauuuucuucccaauucucuaaau

SEQ ID NO: 190132 - RNA, 64 nt, Human
auuuggccuuagcuucugggccuaucggcugccuucccucuacuuccuaccaccucuucugccu

SEQ ID NO: 190133 - RNA, 64 nt, Human
guaauaugaguucucaaagccuacauucaggaucucccucuaggaugugauagaucuggucccu

SEQ ID NO: 190134 - RNA, 64 nt, Human
ucagcccaacauggggccccucucaucacugaaaucccucuaccuucucugggucuggcauuau

SEQ ID NO: 190135 - RNA, 64 nt, Human
uuaaguccagaauugucacagugucccuucuacuucccucuauugaugaugaugaugaugauga

SEQ ID NO: 190136 - RNA, 64 nt, Human
uuuuccucuccugcucugagccaggguggggcauucccucuagauucagguuugggcagggguc

SEQ ID NO: 190137 - RNA, 64 nt, Human
ugagagcaaagugaccugguuaaacaaaccagaaucccucuacauggacucagagaaaagagau

SEQ ID NO: 190138 - RNA, 64 nt, Human
gguuaaaauguaaaguaugaucuuuaugauuuuuucccucuaauuauagaaaguuaaauaaugu

SEQ ID NO: 190139 - RNA, 64 nt, Human
cucucaccugcuuccucagacgacucuggaagcuucccucuaccacugggcacugagacgaagc

SEQ ID NO: 190140 - RNA, 64 nt, Human
agaagagcuacacgcacuaagagagccccauggcucccucuacccugccuugaggccuguuugc

SEQ ID NO: 190141 - RNA, 64 nt, Human
ucucuccuuuuuccugucccccaucuucucugggucccucuaacaucucccauggcucuccccg

SEQ ID NO: 190142 - RNA, 64 nt, Human
gaaacuugcauguugccuggauugauuucuucuuucccucuauccaaaggagcuugguaagugc

SEQ ID NO: 190143 - RNA, 64 nt, Human
uuuuuuuuaauuauuucucuuagcagaucagcaaucccucuagggaccuaaauacuaggucagc

SEQ ID NO: 190144 - RNA, 64 nt, Human
gggggcucggggcagaggggcggugucuuguagcgggcggcagcgccagcgccccucugucagg

SEQ ID NO: 190145 - RNA, 64 nt, Human
aaccuguugcuccaggaugcauucugauaggagggggcggcagggcugggccuugugacaaucu

SEQ ID NO: 190146 - RNA, 64 nt, Human
ugugcaggugacguccgggcugccgucccagcaggggcggcaggagagagaggcuggccuacac

SEQ ID NO: 190147 - RNA, 64 nt, Human
cucuucgucuuuucuuugcuuuucuucuaacuuuucccucuagccucuccucgccacaauuugc

SEQ ID NO: 190148 - RNA, 64 nt, Human
aagcagagcuguuuggcagacuggcuggagaaauucccucuaggagacuugccugugcugugcu

SEQ ID NO: 190149 - RNA, 64 nt, Human
gccccgucgcugccugcuggguccccaccagggcucccucuaggaaugcgccauggcugcuaug

SEQ ID NO: 190150 - RNA, 64 nt, Human
aaugucaagaacagacgggagauauuagugucuuucccucuaucauuaaagguguuuuaaccaa

SEQ ID NO: 190151 - RNA, 64 nt, Human
cagcaguucacccaguacuccucagagacugguuucccucuaaacccaucccgggcacauacca

SEQ ID NO: 190152 - RNA, 64 nt, Human
caugcaaacugccacuuucaaccuuugccaguauucccucuacccccgugagagcuaucugggg

SEQ ID NO: 190153 - RNA, 64 nt, Human
gcacucacuuguaauuuuaguuuuuaaacccaagucccucuaacuuugccuuugauaccaaaca

SEQ ID NO: 190154 - RNA, 64 nt, Human
uccugacccaggccgcagcucuugcccuucccugucccucuaaagcaauaauggucccauccag

SEQ ID NO: 190155 - RNA, 64 nt, Human
cuucaggcauuuuuguaaugagccauuaguucugucccucuaaaacuagaaaaggaagggcagg

SEQ ID NO: 190156 - RNA, 64 nt, Human
ugggaguuaauggugucaauaaaaggauugauggucccucuaaugaaacccaguagauguuugu

SEQ ID NO: 190157 - RNA, 64 nt, Human
guuuuauugcuuuaugaacuguuuaacccugaaaucccucuagguuaucuauacuguauaaaaa

SEQ ID NO: 190158 - RNA, 64 nt, Human
gacagcugauuucuguugaaaaaguaaaaggugaucccucuaagaaagaaaugaagaaagaaaa

SEQ ID NO: 190159 - RNA, 64 nt, Human
aaaaaaaaguugccagagacgaguaugcccaugcucccucuaccucacugccaccacuccugcu

SEQ ID NO: 190160 - RNA, 64 nt, Human
uuuccaaaaacuuacuuacaaacaaaaagccuaaucccucuauuuuaagauuucugaaaaaaca

SEQ ID NO: 190161 - RNA, 64 nt, Human
ggcagugcccuccccgucccaugcucggcgagccucccucuacucggcacuguccuugcugccc

SEQ ID NO: 190162 - RNA, 64 nt, Human
agaggccuugggagcucaucccucucacccagaaucccucuaaccccuugggugcgguuugcuc

SEQ ID NO: 190163 - RNA, 64 nt, Human
guauagacagaacccaggguugagaacagaaggugggcggcaggaucagagugaaagcagaggc

SEQ ID NO: 190164 - RNA, 64 nt, Human
caccuggugagcccuagcagggcugagacccccagggcggcagccugucugcugcugagugauu

SEQ ID NO: 190165 - RNA, 64 nt, Human
cacaaauuccuaagggggaagaggagaggguauggggcggcagacccuaucaucaacuguccag

SEQ ID NO: 190166 - RNA, 64 nt, Human
uauccaaguguaugguugcuuugccuaagaggaaucccucuauuucaccuguucuggaggcacc

SEQ ID NO: 190167 - RNA, 64 nt, Human
cugagugcuccaggacuccuagggagcaagguccucccucuaagguguuucuagucuucucuuu

SEQ ID NO: 190168 - RNA, 64 nt, Human
uggaguauuucaacaccaaccacauuucccuuccucccucuaauucuacccacaugaucuuuau

SEQ ID NO: 190169 - RNA, 64 nt, Human
aaggaaaccucuucccgcagccuggcuccuguguucccucuauccagccaaugccuguuuacac

SEQ ID NO: 190170 - RNA, 64 nt, Human
caugaacggugcuguucugaagucuucaaauuuuucccucuaauaggaaacaguauaaauuuua

SEQ ID NO: 190171 - RNA, 64 nt, Human
accaacuucucuacuuuggguuuguuugguuuuuucccucuauuuuucuggcugguuuuuugcu

SEQ ID NO: 190172 - RNA, 64 nt, Human
aaccaucugacuuggucucuguuaaugacgucucucccucuaaaccccauuaaggacugggaga

SEQ ID NO: 190173 - RNA, 64 nt, Human
gugcuuuuccuaacuugauuuuguuugacgugguucccucuaagagaaugguaggaauugaaac

SEQ ID NO: 190174 - RNA, 64 nt, Human
gccccucagcccccgcugggcacucucugucccaucccucuaggacagggaagcuggccugguc

SEQ ID NO: 190175 - RNA, 64 nt, Human
uugaaaguuauguuucuuugcuuacuucauuuuuucccucuaauuauuuaagauuggaacaaaa

SEQ ID NO: 190176 - RNA, 64 nt, Human
cacccucagccgcucuuugcuccagaccugccccucccucuagaggcugccugggccuguucac

SEQ ID NO: 190177 - RNA, 64 nt, Human
agcagcuggcagccuggggcgugcuucaggcuccucccucuaaggggcgccaugggaacaggcu

SEQ ID NO: 190178 - RNA, 64 nt, Human
aggcaagccagucauggaaucuugcugcaggcccucccucuacucuuccuguccuaaaaauagg

SEQ ID NO: 190179 - RNA, 64 nt, Human
uuuuuugaccuugccuaugauugauuaggauagcucccucuagggguagcagccggugugacuc

SEQ ID NO: 190180 - RNA, 64 nt, Human
aaaguuugcuucucuuuucaacagugccucacccucccucuaggauuaaagugcuucugcccuu

SEQ ID NO: 190181 - RNA, 64 nt, Human
auuuuugguguuguucaagugaaggaagagauguucccucuaauuucucucuagcccauuauaa

SEQ ID NO: 190182 - RNA, 64 nt, Human
ugggcugugcggugcggagggugaugaggaugucuggugacagccgugcggacaccacuccucu

SEQ ID NO: 190183 - RNA, 64 nt, Human
aguagaggcuaaauacauaucuaauuuuuaccaauggugacauuaagccuaauuuuccaaacua

SEQ ID NO: 190184 - RNA, 64 nt, Human
cugcccccagccauggugaggaagccccaagccauggugacacacagcagcacugcagauagcc

SEQ ID NO: 190185 - RNA, 64 nt, Human
cuauuuugauuauugagaaaggaguaguuuucuaucccucuaagaguauacuugaaucagacau

SEQ ID NO: 190186 - RNA, 64 nt, Human
ucccuucccucccgauuucccgauucccccacccucccucuacacuugaggaccacaguugggg

SEQ ID NO: 190187 - RNA, 64 nt, Human
uucccauuucuuaguacuaaugauucuuugauucucccucuauuaugucuuaauucacuuuccu

SEQ ID NO: 190188 - RNA, 64 nt, Human
ucugccacaucugagucggccugagauagacuuuucccucuaaacugggagaauaucacagugg

SEQ ID NO: 190189 - RNA, 64 nt, Human
cacccccaggccacauagggccagugguagggguucccucuaugucgggcagugcugagggcug

SEQ ID NO: 190190 - RNA, 64 nt, Human
accaaaauggggacuuccuggguagggaggucacucccucuacucacugagcuaggauuaggga

SEQ ID NO: 190191 - RNA, 64 nt, Human
uacuuccuuuauuuugugguuuacacgguuguccucccucuaaacuuacucucaggggcuucuc

SEQ ID NO: 190192 - RNA, 64 nt, Human
agcacuuacaccaccugggaaccccuccgucuuuucccucuacucucauccuaggaauaaagca

SEQ ID NO: 190193 - RNA, 64 nt, Human
gauggggaagccgucucuucugcaugguuuauuuucccucuauccuuuuauuuaaugcucuuuu

SEQ ID NO: 190194 - RNA, 64 nt, Human
uauccccauuuugauuucccuaaguuccuuguucucccucuaaaaagagaaugauugcacccug

SEQ ID NO: 190195 - RNA, 64 nt, Human
gaaagggagagccauacugcacggacguagcguuucccucuacaagcacuaggagcaccuuucu

SEQ ID NO: 190196 - RNA, 64 nt, Human
acauauuaauaccagucaccaggagcccaccaccucccucuaggaugcccccucaggggcuggc

SEQ ID NO: 190197 - RNA, 64 nt, Human
uuguccaacaaacaauuucuggcuuggggaggagucccucuagguagaacacaguaagugucaa

SEQ ID NO: 190198 - RNA, 64 nt, Human
acuccugaacaaggacaugagcagugaggagcagucccucuacuacaggcaguggaccuuggcc

SEQ ID NO: 190199 - RNA, 64 nt, Human
cuugugucgugggggaaaacauaaggucauuuucucccucuacucacaauacuaaagggaaaaa

SEQ ID NO: 190200 - RNA, 64 nt, Human
auggacaguguuugcagagaguugcucacgaguuucccucuaauccuaaaugucuucaugucua

SEQ ID NO: 190201 - RNA, 64 nt, Human
augacacaguagccaccgguggaugacagcccacgggcggcacagucacuucugccuguugcuc

SEQ ID NO: 190202 - RNA, 64 nt, Human
ccccucugcacaggccucccgaaguccugaagcugggcggcagugaggugucaccccccuccag

SEQ ID NO: 190203 - RNA, 64 nt, Human
ccccagggcccacccccaggaaggccacagugcugggcggcaucccugcagaggaaagacagga

SEQ ID NO: 190204 - RNA, 64 nt, Human
accugacagcacaccacugucuuccccagucagcucccucuaaaauacucagcggccagggcgg

SEQ ID NO: 190205 - RNA, 64 nt, Human
uccuuggacuccccugggggugucccacucuucuucccucuaaacugccccaccuccuaaccua

SEQ ID NO: 190206 - RNA, 60 nt, Human
aggaccgggaccuccagugacaccggccccucccucuacccacccccuucccccgcaugc

SEQ ID NO: 190207 - RNA, 64 nt, Human
cacugauucugagauggcuuuugcugcucuguucucccucuacauuucucugcagaacucgcgu

SEQ ID NO: 190208 - RNA, 64 nt, Human
ucuccauauguaucucccuguauuucgggcccauucccucuaugucaagaguaaauagaggcac

SEQ ID NO: 190209 - RNA, 64 nt, Human
ccuaauauucaguaaguauuuuccucuguguaacucccucuaauagguguagucaacaaagcug

SEQ ID NO: 190210 - RNA, 64 nt, Human
gggccgcgcccgcaccccgggagccuccucaggcucccucuauuaaagccgaucugacuccgcc

SEQ ID NO: 190211 - RNA, 64 nt, Human
ccccucuucccugccccaucgccauucugccaucucccucuauauccccaagcccucaacugug

SEQ ID NO: 190212 - RNA, 64 nt, Human
ggucucagucagucuccucccugucuccacucuuucccucuauuuauuucacucucuuguuugg

SEQ ID NO: 190213 - RNA, 64 nt, Human
ccucaguuuccuaaagugugaaaugucaggcacuucccucuaacuggcaugcaacagccccacc

SEQ ID NO: 190214 - RNA, 64 nt, Human
guuugaucaucuuuguugagguaggacuaucaguucccucuaaauguauauguugauuuaugag

SEQ ID NO: 190215 - RNA, 64 nt, Human
ccagcugggaugaccuucccuggguuaaucaauuucccucuagacaacacaaacugcaggcaug

SEQ ID NO: 190216 - RNA, 64 nt, Human
gcuggagcgguugagugcagaagggugcgccucuucccucuacccccgcaccaccugcugugug

SEQ ID NO: 190217 - RNA, 64 nt, Human
aaggggaggaggggugugggguugauaccccaacucccucuacccuugagcaagggcagggguc

SEQ ID NO: 190218 - RNA, 64 nt, Human
acacuguauaacuuauuuucuuauuaucuucuucucccucuagaauauaaauuuaugaaaauac

SEQ ID NO: 190219 - RNA, 64 nt, Human
aacuuggguacaucuuguaagacacauaaugaggucccucuagcuuuagcuggagggagauaaa

SEQ ID NO: 190220 - RNA, 64 nt, Human
ggcagaaaaaggagaagcaggcaccuuuuucacagggcggcaggaugaaaaugacugccagcag

SEQ ID NO: 190221 - RNA, 64 nt, Human
cuccagggagaaggaccucaaaucgccacucuuugggcggcaggugcgguccccacggccggcu

SEQ ID NO: 190222 - RNA, 64 nt, Human
caggcccucugagugagccccacgggguccaggcgggcggcagcagcccaggggccccaggccu

SEQ ID NO: 190223 - RNA, 64 nt, Human
ccuugaaaucugggcccuggugccugcugaagauucccucuaucccugaguacuuagucuucuc

SEQ ID NO: 190224 - RNA, 64 nt, Human
uauaagcuaucucugggaugccucuaggcccccuucccucuacacaccucugggaaaagauuac

SEQ ID NO: 190225 - RNA, 64 nt, Human
cuuucaucucuguccuauggccccaccccaccauucccucuaggcccagaccaucaucauggcc

SEQ ID NO: 190226 - RNA, 64 nt, Human
cacuuuuggauucuuauggacugugaguuagucuucccucuacacggagucacaggaaggguau

SEQ ID NO: 190227 - RNA, 64 nt, Human
ugacccccuccauugccauaacauccugcuccauucccucuaagauguaggaagaauucggauc

SEQ ID NO: 190228 - RNA, 64 nt, Human
cugaaguaggagucagaugaccugaacucagaucucccucuaucacaugcuugccaccacugua

SEQ ID NO: 190229 - RNA, 64 nt, Human
uguucuuuugacuuaaucucauuugguuugauuuucccucuacuaaggcuuuccuaccuucuuc

SEQ ID NO: 190230 - RNA, 64 nt, Human
ugacucauccagcuguccuucaaauagcuccgucucccucuacccagaacugauuuuuaaaaag

SEQ ID NO: 190231 - RNA, 64 nt, Human
gugaaguaggcaagggaaucuguuuacucccucuucccucuacugaauaauuuucccucuacug

SEQ ID NO: 190232 - RNA, 64 nt, Human
cuguuuacucccucuucccucuacugaauaauuuucccucuacugaauaauuuucccucuaaga

SEQ ID NO: 190233 - RNA, 64 nt, Human
ucuacugaauaauuuucccucuacugaauaauuuucccucuaagaauugcuguggguaauacca

SEQ ID NO: 190234 - RNA, 64 nt, Human
gcuaguccaagcgaacagcaaccuccugcuacccucccucuaugaaaauagccaugcagacaag

SEQ ID NO: 190235 - RNA, 64 nt, Human
cagucccgggagcccgcuccacagcguggagacgucccucuaacaagaacuugucucagcacau

SEQ ID NO: 190236 - RNA, 64 nt, Human
uugugcugcucuuuaugcaaagguaaaucaaaguucccucuauaaauuaugauuuacaaaagac

SEQ ID NO: 190237 - RNA, 64 nt, Human
accuuuauuaaacacaucuugaaagauguagaagucccucuauagucuaguauaguuuacaaua

SEQ ID NO: 190238 - RNA, 64 nt, Human
uaauugcuagcaaauccccccgauuccggccuuuucccucuauuucuuuguuagaaguuuucug

SEQ ID NO: 190239 - RNA, 64 nt, Human
agucugucuggauugaguccuacagugucagauagggcggcaaaugccaaagcagggaaacagg

SEQ ID NO: 190240 - RNA, 64 nt, Human
ugagugcccccgcgugccugcguguugagugugugggcggcagugccguuccggaggccugguc

SEQ ID NO: 190241 - RNA, 64 nt, Human
gcaggcccacaggggccaccgcagagccgagucggggcggcaucgugcuggugccucuggcccc

SEQ ID NO: 190242 - RNA, 64 nt, Human
ugcugcauugcagcaugaggcagggcaaacacuuucccucuagaucccuggggccucacccugu

SEQ ID NO: 190243 - RNA, 64 nt, Human
caagggugaugcacagcaaaagcaauggaccccaucccucuaaagccugcccuccuuugccuuc

SEQ ID NO: 190244 - RNA, 64 nt, Human
uuuguaauucuaauaaugcacucaguuuacucucucccucuacuaauuuccugcugaaaauaac

SEQ ID NO: 190245 - RNA, 64 nt, Human
uuucauagugaggauuuuauuuugcacggcgcccucccucuaaauaccuacccuagaugauuuc

SEQ ID NO: 190246 - RNA, 64 nt, Human
cuguuuuuccaagcaauaucugggaagagauuucucccucuagcacuugcuaccucucuucugc

SEQ ID NO: 190247 - RNA, 64 nt, Human
gacugcugcuaaaagacacaagaauuauacaguuucccucuauaagugaauccaaaauucacug

SEQ ID NO: 190248 - RNA, 64 nt, Human
uguuguauaacuuuuauucuuuauuauugguaacacgcccuaacuauccugugugagaauggga

SEQ ID NO: 190249 - RNA, 64 nt, Human
acaacagacuuacguuaaacuucauuucuaguacacgcccuauuuaaaaaagagcaguacaucc

SEQ ID NO: 190250 - RNA, 64 nt, Human
gucuguucuggaggucacaucaccaacaaagcucacgcccuaugcaguucugagaagguggagg

SEQ ID NO: 190251 - RNA, 64 nt, Human
acacacacacacacacacacacacacacacacacacgcccuacucuucauuugcuaggggaagg

SEQ ID NO: 190252 - RNA, 64 nt, Human
cccgcuuccaguuuccuugaagcgcccgccgcacacgcccuauucagcaccagcuccgcggaca

SEQ ID NO: 190253 - RNA, 64 nt, Human
guguccacuucaccaggucaccacagcccacacuacgcccuaucacuucccacaaugaggcuga

SEQ ID NO: 190254 - RNA, 64 nt, Human
caucaaggagucaggggaaagugacuggaagcaaacgcccuaaaaguuacccaucacguuucag

SEQ ID NO: 190255 - RNA, 64 nt, Human
caauacuuugauugcauauuagacauucuuaacagggcggcagucuaguguugaaaguuuuauu

SEQ ID NO: 190256 - RNA, 64 nt, Human
gggcugggucuggggccgccacaggccccucacggggcggcagaggcaacuucagugucccugu

SEQ ID NO: 190257 - RNA, 64 nt, Human
cgugcccagcuguccccccaggccucuccucagagggcggcacaggcugggcuccagcaggugg

SEQ ID NO: 190258 - RNA, 64 nt, Human
aaaaauaacuaccaagaggcccugucuguaccuaacgcccuauuuuugcaauggcuauauggca

SEQ ID NO: 190259 - RNA, 64 nt, Human
cuuaaaaggggcccaagccccaucucauccuggcacgcccuacuccacugcccuggcagcagca

SEQ ID NO: 190260 - RNA, 64 nt, Human
caaguagugucugucagcccucuuaacucugugcacgcccuauuucagucuuuuacauuuguuc

SEQ ID NO: 190261 - RNA, 64 nt, Human
ggagacagaaacggagugaccgccgugaauguagacgcccuaggaggagaacuugaacaaaguc

SEQ ID NO: 190262 - RNA, 64 nt, Human
uucacuguguuggaguuuucuggagugagcacucacgcccuaagcgcacauucaugugggcauu

SEQ ID NO: 190263 - RNA, 64 nt, Human
uaaacuggaacuggacccaggaugcuuugcagcaacgcccuaggauuugcagugaauguccaaa

SEQ ID NO: 190264 - RNA, 64 nt, Human
uaaacuggaacuggacccaggaugcuuugcagcaacgcccuaggguuugcagugaauguccaaa

SEQ ID NO: 190265 - RNA, 64 nt, Human
gucccaaaauaaauccuuucagaauguagcacucacgcccuaauaaggagcgaauccuacaucc

SEQ ID NO: 190266 - RNA, 54 nt, Human
ugcugccuggaaucuucuaagggcacgcccuagggagaagcccuguggggcugu

SEQ ID NO: 190267 - RNA, 64 nt, Human
cgugccagauauaacugucuuguuucagugagagacgcccuauuucuaugucauuuuuaaugua

SEQ ID NO: 190268 - RNA, 64 nt, Human
gcaaagugucagugagaucauuuacuuccccggcacgcccuaguuaagcagcugacauaagaca

SEQ ID NO: 190269 - RNA, 64 nt, Human
cggauguuacuguccugcuccuucccccagccccacgcccuaccagagggggcaaagggcacgu

SEQ ID NO: 190270 - RNA, 64 nt, Human
ccgcauuccaggcucagggucugaggaggcugugacgcccuaugaccgcagagaucuagacagu

SEQ ID NO: 190271 - RNA, 64 nt, Human
gucauuuuugagaaucuuggguuccugaaaaagaacgcccuaguuggauggcuugccagggccu

SEQ ID NO: 190272 - RNA, 64 nt, Human
uccagcaaucauaguuaauacaguacuuggugacacgcccuacccccuucucuuccaaguuucc

SEQ ID NO: 190273 - RNA, 64 nt, Human
gagcagcaccucgaguuagaacccggcccacguagggcggcacucacacgcgaaaguaucacca

SEQ ID NO: 190274 - RNA, 64 nt, Human
uggcgauucuaguuaauaaaaaggggggagaugugggcggcaagccacccaggcaccgaggcaa

SEQ ID NO: 190275 - RNA, 64 nt, Human
aaggagccggccugcugggcagcguggccacaaggggcggcacuccucaggccgggggagccac

SEQ ID NO: 190276 - RNA, 64 nt, Human
uugcuggggcuguccugguugcagccaucguccugggcggcacgggcuggggauuuaaguaaga

SEQ ID NO: 190277 - RNA, 64 nt, Human
aguacaauggcagcuacuucgacagaggagccaagggcggcagccgccucugcacaccggaagg

SEQ ID NO: 190278 - RNA, 64 nt, Human
gugaguggucuucaaacgagggucccgauccccggggcggcaggaagggggccgacuccacgcu

SEQ ID NO: 190279 - RNA, 64 nt, Human
auaggauguaacauaaugaaacacaccugucuaggggcggcaaucaacagucuuacacagagag

SEQ ID NO: 190280 - RNA, 64 nt, Human
gauccucagcgggcagcggaagcucgagauggaggggcggcagguggugagucucgaccccgca

SEQ ID NO: 190281 - RNA, 64 nt, Human
cgcugugacaguuuccccggugugagcccggugagggcggcaggcagggguuauccggccccac

SEQ ID NO: 190282 - RNA, 64 nt, Human
cuuaagaacacaaagcggggggaggguuggggaggggcggcaggagggagguuugugagagcga

SEQ ID NO: 190283 - RNA, 64 nt, Human
ugcagccacugccugacuucacucgggcgggggagggcggcagucggucggcucgcucugggcg

SEQ ID NO: 190284 - RNA, 64 nt, Human
aggcccugggcaaggggauggggcugugggggcggggcggcaugggcuucagaaguaucugcac

SEQ ID NO: 190285 - RNA, 64 nt, Human
ggacucagccuucagacagagaggacuguagggagggcggcaggggccuggagauccuccugca

SEQ ID NO: 190286 - RNA, 64 nt, Human
ccuuucccagagggcaccacgcaagggcagagcugggcggcauccacagccagagaggcagagg

SEQ ID NO: 190287 - RNA, 64 nt, Human
aacaggauaacccuugaauguagcagccccgggagggcggcacaggucgggcgcaggauucagc

SEQ ID NO: 190288 - RNA, 64 nt, Human
acgccgugccccuccuggcccauacgccuugccagggcggcaggauugucacaccguuuuagga

SEQ ID NO: 190289 - RNA, 64 nt, Human
acagauggcccggcuagccgccuggacugcaggggggcggcagcagcggcgguggcagugggug

SEQ ID NO: 190290 - RNA, 50 nt, Human
gucgucugaagaagcucugagggcggcaggaccagccagcagcagcccaa

SEQ ID NO: 190291 - RNA, 64 nt, Human
cugcgaggccugcccuccaaaccugacuggggaugggcggcacugugcgggugagccgggaaca

SEQ ID NO: 190292 - RNA, 64 nt, Human
gaucaggacgaaggaccaccgucgguccucagcagggcggcagccuccuccuggcuguccgggg

SEQ ID NO: 190293 - RNA, 64 nt, Human
gcguguguggccuaauccaccugguggcccugcggggcggcauccgagccccuguuucuccucc

SEQ ID NO: 190294 - RNA, 64 nt, Human
uuugauaugucugcaugcaaaguggaacagaguugggcggcaaugacagaagagcuuccuuggc

SEQ ID NO: 190295 - RNA, 64 nt, Human
acuagcuagacuuccacauagucccaccccaagugggcggcaguguuccuggcaugaccaggau

SEQ ID NO: 190296 - RNA, 64 nt, Human
ccuuccagaaacuuuauauggguagaggaagccagggcggcaaaugcgagaccaaauaucauuu

SEQ ID NO: 190297 - RNA, 64 nt, Human
uggcccuggcaggacccagggccuccagacgugcgggcggcacaugccuuggggacauccugcc

SEQ ID NO: 190298 - RNA, 64 nt, Human
ccuuuugccauggaggucugggagagagagcagagggcggcagggcuaaguuggugaucauugg

SEQ ID NO: 190299 - RNA, 64 nt, Human
aaccaacaacacagcuggggcgggcccuguggcugggcggcagccaguccagcucuugcuuccu

SEQ ID NO: 190300 - RNA, 64 nt, Human
acccgaggaggccggacucagacacauaggcggggggcggcaccuggcaucagcaauacgcagu

SEQ ID NO: 190301 - RNA, 64 nt, Human
ucucggacgugagugcaacuggggcuaggucaucgggcggcacccugcacagagcuccugggcc

SEQ ID NO: 190302 - RNA, 64 nt, Human
cagagagcgcacccuacucuuuccgugacgaugagggcggcaaaaacagacauuucuuccuuca

SEQ ID NO: 190303 - RNA, 50 nt, Human
agagccacauccaggccugagggcggcaccccagcccugcccuugcuucc

SEQ ID NO: 190304 - RNA, 64 nt, Human
ggugcgccccaaaacacggccccgacacuuaguguggccccaggccccagcgagccucgcccuc

SEQ ID NO: 190305 - RNA, 64 nt, Human
cgggccgcacuuguggcccccgggaccccaccucuggccccaccucccucaagucugcgccccg

SEQ ID NO: 190306 - RNA, 64 nt, Human
gacacauagcccauucuggccaccagagcccacuuggccccaccccucaauaaaccguguggcu

SEQ ID NO: 190307 - RNA, 64 nt, Human
uuaaacagugugucuguguguucccaaauccagcuggccccaccagcucagauuccauuuuuuu

SEQ ID NO: 190308 - RNA, 64 nt, Human
cucuuaggggucugcagugcuccaucuccauugguggccccagcucaguaacuauaccugguac

SEQ ID NO: 190309 - RNA, 64 nt, Human
uuacuguuggggcaguccauuucuaauccugacuuggugacaguaucauguguauuuauaaaac

SEQ ID NO: 190310 - RNA, 64 nt, Human
gugcuucaccaugagguuugccuuuguggaaaacuggugacagugagaauauaaacucaaugug

SEQ ID NO: 190311 - RNA, 64 nt, Human
ugucuuaaguaaauuagcauuugguagucugaaauggugacagauuacuuguuaaaauugugaa

SEQ ID NO: 190312 - RNA, 58 nt, Human
agcugcugccuccugucuaacuagucgcuggccccagugcaguaccccagcucauggg

SEQ ID NO: 190313 - RNA, 64 nt, Human
aacccucacgaccugcaaggggccagcagggacguggccccacgccacacacaaccucuccaca

SEQ ID NO: 190314 - RNA, 64 nt, Human
aaaauguuuuaugggagacuagguuuuaacuggguggccccaugacuugauugccuucuacugg

SEQ ID NO: 190315 - RNA, 64 nt, Human
caguguggugguguaggaggccacagugagcagguggccccagcuggguuucccaggucaggaa

SEQ ID NO: 190316 - RNA, 64 nt, Human
ugaggggcugagcacuggaaugcuguggcugcacuggccccaguccauagaggggucaacuaug

SEQ ID NO: 190317 - RNA, 64 nt, Human
uguccuacuucacugccuuugucuguguuacuaguggccccaguauaccugggauggacaucca

SEQ ID NO: 190318 - RNA, 64 nt, Human
uggccggggaccgaaaaacucccgugggagauuuuggccccaacccacacaggccaaugcaaga

SEQ ID NO: 190319 - RNA, 64 nt, Human
gaagaggccaaauugaggcacccaagugauccacuggccccacgucacacaguuacagugaagc

SEQ ID NO: 190320 - RNA, 64 nt, Human
caaauaguaaaggccacccucucgcuucccuggcuggccccagggcuaccacugguauuccuga

SEQ ID NO: 190321 - RNA, 64 nt, Human
uugucuuuuucucaguggagggaguguauggaccuggccccauggcuuugcauguuagagaccu

SEQ ID NO: 190322 - RNA, 64 nt, Human
cccaggaggagugcugguucuucagucuuuguacuggccccauccucuccucacuguaauguga

SEQ ID NO: 190323 - RNA, 64 nt, Human
guuguucacacuuaagggaaguuuauaaagcuacuggccccagaugcucaggguaaggagcacc

SEQ ID NO: 190324 - RNA, 64 nt, Human
guccuguucccacaugggccuggucccucccuccuggccccagccacagcugccaggccugaca

SEQ ID NO: 190325 - RNA, 64 nt, Human
uuaggcagcacuucccaaagugcacugaggaagguggccccaagagaagcucucuaaacaaagg

SEQ ID NO: 190326 - RNA, 64 nt, Human
uagaacuugauuuuuauuuguuacagguuuccaauggccccauaggaauaagcaauaauguaga

SEQ ID NO: 190327 - RNA, 64 nt, Human
aguaccuacugugugccaggggcuggugggacaguggugacauagucucugcccucauagaguu

SEQ ID NO: 190328 - RNA, 64 nt, Human
ucacucuuguacugccugccaccgcggaggaggcuggugacaggccaaaggccaguggaagaaa

SEQ ID NO: 190329 - RNA, 64 nt, Human
gcuaucaaguggagaugugcuuugacugcaugcauggugacaucuuuggaaauucauuugugug

SEQ ID NO: 190330 - RNA, 64 nt, Human
cccgggcuuggacgcgcccuucuccggaaggcucuggccccaagcuggccggcccgcaggagcc

SEQ ID NO: 190331 - RNA, 64 nt, Human
ucuacaccaucucuccagaacucucuggccuugguggccccaugcucuggcugcuguccccagc

SEQ ID NO: 190332 - RNA, 64 nt, Human
ccucccuaggccuguuugugugugauccuucuccuggccccaggucgaccuggaaggcguuucu

SEQ ID NO: 190333 - RNA, 64 nt, Human
cuacacgauuuggcugaguggcuuugugugaccguggccccaggccaaggggaucauggcccug

SEQ ID NO: 190334 - RNA, 64 nt, Human
ggcacccucuccccaaccuccuuacaagacuuuguggccccaggcccaauggcagagcuagugc

SEQ ID NO: 190335 - RNA, 64 nt, Human
uaucagcugggaaggaacugugccucugucugacuggccccacuuccuaagcacugcccugccc

SEQ ID NO: 190336 - RNA, 64 nt, Human
cacuuuuuaggcgucacgccaaaggccagccuccuggccccaauacccauuuuggaagccccug

SEQ ID NO: 190337 - RNA, 64 nt, Human
aagguggugagccacgggacguccaaggggaggcuggccccagcgcgcccauacugccugccuc

SEQ ID NO: 190338 - RNA, 64 nt, Human
aaaaggaggcccagagcugaucucucauccgcucuggccccaagcacuauuucuuccuuuucca

SEQ ID NO: 190339 - RNA, 64 nt, Human
uggggucauggcgguuguggcagcuggggagguuuggccccaacagcccuccugugccugcuuc

SEQ ID NO: 190340 - RNA, 64 nt, Human
gccucaacaccacccugcuguccaguccccagccuggccccaccagcccaagccugggacuggg

SEQ ID NO: 190341 - RNA, 64 nt, Human
aaaaaauaaaaauaagccacaaaacuaaaaggccuggccccauucuggaaaaggcaaagcugca

SEQ ID NO: 190342 - RNA, 64 nt, Human
ccaaaaaacuguaagugaggcccucagcaagcccuggccccaacucggaguccuccagugaucu

SEQ ID NO: 190343 - RNA, 64 nt, Human
cccuccccauugggugcacagugcagaggggccguggccccaugugauggugcgcagagaggaa

SEQ ID NO: 190344 - RNA, 64 nt, Human
cuccaggcauuauccccaggugcugaaauggcuguggccccagcaccugaggcagggguacgcu

SEQ ID NO: 190345 - RNA, 64 nt, Human
uggguagaguucuugauggcuccaaggugacuucuggugacagccagaucaucccucgaguccc

SEQ ID NO: 190346 - RNA, 64 nt, Human
agcuaacaggcaaauuaagauuuuuacuucuggcuggugacaguaaagcuggaaaauuaauuuc

SEQ ID NO: 190347 - RNA, 64 nt, Human
ccaaugaaaugaauuuacagaacaguuuaagaaguggugacauuuugcaugaugaaugaccuga

SEQ ID NO: 190348 - RNA, 64 nt, Human
aggccaggauggugguguggggaggggugccugcuggccccauguccuccccuguacauagucu

SEQ ID NO: 190349 - RNA, 64 nt, Human
cugccuuaaaacuugggagaggagcacucagggcuggccccacaaagggucucguggccuuuuu

SEQ ID NO: 190350 - RNA, 64 nt, Human
aggcaaggcccaccuuccugaccuccccucauuguggccccacacccagucugcuucucccugu

SEQ ID NO: 190351 - RNA, 64 nt, Human
ucagugcuucccacuuaccugauuugucugucgguggccccauauggaaacccugcgugucugu

SEQ ID NO: 190352 - RNA, 64 nt, Human
gggguuacaauucacauuccuuauucugagaauuuggccccagcuguuugccuuugacucccug

SEQ ID NO: 190353 - RNA, 64 nt, Human
uccaaugagggcaccucaucaccaucccucuucuuggccccaucccccaccaccauuccuuucc

SEQ ID NO: 190354 - RNA, 64 nt, Human
ugacuaaugagagggaagugggcagacaagaggcuggccccagucccaaggaacaagagauggu

SEQ ID NO: 190355 - RNA, 64 nt, Human
aagcugauacuucuccuuuugcucacagcugccuuggccccaccccugggagauguagcaaauu

SEQ ID NO: 190356 - RNA, 64 nt, Human
ucacccaggaccauccaaggggccaccgcagcauuggccccaucaccacguccucacccaacuc

SEQ ID NO: 190357 - RNA, 64 nt, Human
uuguuucaccucuuuccagcucuucccuagagccuggccccaaguuccagagucaaaucccagu

SEQ ID NO: 190358 - RNA, 64 nt, Human
ucuucaacacuggccacuccucugcuuccucuguuggccccagauggacaguaaggggaaccuc

SEQ ID NO: 190359 - RNA, 64 nt, Human
aggggaagaugggaucuauagagucucugggcccuggccccagggaggagcacauuuuucuuga

SEQ ID NO: 190360 - RNA, 64 nt, Human
cgcuaagccaaaggccgcccaugcugagcucaucuggccccaucuuagagagccgccaaacauu

SEQ ID NO: 190361 - RNA, 64 nt, Human
ugaggcagcacaucucaggacccaggcaauagacuggccccaacucaggcuggacuaaggugug

SEQ ID NO: 190362 - RNA, 64 nt, Human
cucccuggccaggcuuuggggaggccuggagucauggccccacagggcuugaagcccggggccg

SEQ ID NO: 190363 - RNA, 59 nt, Human
cagguccccaacagcgauacugcuguuucucgagguaagagauucagccauccaauugg

SEQ ID NO: 190364 - RNA, 59 nt, Human
uacaccacgauuccuuccucuucacuggcucgagguaaacccuuuucaaggaaaaacaa

SEQ ID NO: 190365 - RNA, 59 nt, Human
gugggaguacugggaguaaaauaaaaauaucgagguauagacuagcauccacauagagc

SEQ ID NO: 190366 - RNA, 59 nt, Human
cuagcaauugcuucucuaaaacagcacuaucgagguauuugguaacuugcugugaaaug

SEQ ID NO: 190367 - RNA, 64 nt, Human
ucucugcuagaggguaggagagagccuggaucucuggccccaacccccaccagaccucaugccc

SEQ ID NO: 190368 - RNA, 64 nt, Human
aucccacugggagugaauggaucaugaggugggauggccccaucuggauguucugcagaucccc

SEQ ID NO: 190369 - RNA, 64 nt, Human
uacaccagagcaccaagagcccacuugccugggauggccccacacugucacucagcuguucuuu

SEQ ID NO: 190370 - RNA, 64 nt, Human
ccacucucuccccuucauuggcugcccaggccacuggccccaguucucagugucccuugggucc

SEQ ID NO: 190371 - RNA, 64 nt, Human
ugggcacucagcgugcugggcagagcaggugcgauggccccaguccuagcagcccucgcccaug

SEQ ID NO: 190372 - RNA, 64 nt, Human
uuugguauuugucuuccuuaccaagugaacuccauggccccaaagcaccagaugaauguuguua

SEQ ID NO: 190373 - RNA, 64 nt, Human
gggcuccauugcugagugccccauccuggaggauuggccccaagaucuccuagaacaggauaau

SEQ ID NO: 190374 - RNA, 64 nt, Human
uaaucuucccagcagguuuuugccuuagacgugcuggccccaggacagugaugaagacagagcc

SEQ ID NO: 190375 - RNA, 64 nt, Human
ccagggcgaguggcaugucugccugagcaggguguggccccagaaagcugaggagugugggcug

SEQ ID NO: 190376 - RNA, 64 nt, Human
ccacgcccuuugcuuuaucuugcucuugaaauuuuggccccaacuccagggacuggggauuugu

SEQ ID NO: 190377 - RNA, 64 nt, Human
agggagaggaugguugucccuggggagggcccucuggccccaggcaaccuuagccccucagaac

SEQ ID NO: 190378 - RNA, 64 nt, Human
acccagcccgggaggcagaaccaggcagccucccuggccccaggcagcccuuuucccuccagug

SEQ ID NO: 190379 - RNA, 64 nt, Human
aagccccaucuucuaaauggcaaaggaagguggauggccccagcacagcuugaccugaggcugu

SEQ ID NO: 190380 - RNA, 64 nt, Human
cuccauccaaggccagguucuccguuagcuccuguggccccacccugggcccugggcuggaauc

SEQ ID NO: 190381 - RNA, 64 nt, Human
uaaaugaauuuuaauaaauuuuugcuuuagcacuuggccccauuguagauugcccugugcagua

SEQ ID NO: 190382 - RNA, 64 nt, Human
ccagcugauaugcaaggucauggcgugcccaggguggugacaguugaacaaaguguauaguacg

SEQ ID NO: 190383 - RNA, 59 nt, Human
gacacgucugcauuugaauuucuagauuuucgagguaaggaguuuuuuuuaauugguug

SEQ ID NO: 190384 - RNA, 60 nt, Human
uaucacaucucuuauuucucuuuuccccuuacucucuaccauuuccuuuauguggggaaa

SEQ ID NO: 190385 - RNA, 60 nt, Human
ucuacuugaaagcaaagaccuuucucuuucacucucuaguuauuuccuucccccucaccu

SEQ ID NO: 190386 - RNA, 64 nt, Human
ccuuugcaaaaggaugguuguuugcaguuagcccuggccccauccuuccuauuucuguaguaug

SEQ ID NO: 190387 - RNA, 64 nt, Human
acagccaggccuagacagacaggccuggggacacuggccccaugaggggaggaaggcaggcgca

SEQ ID NO: 190388 - RNA, 64 nt, Human
cccgcccauccccuugccgccugacugggucggauggccccaguggguuuagucagggcuucug

SEQ ID NO: 190389 - RNA, 64 nt, Human
ugccugccaugggacggcuccucugaguguucccuggccccacgugugugguguuugugugucu

SEQ ID NO: 190390 - RNA, 64 nt, Human
aggaugggacucugcccuccaggcaaggaguaaauggccccagcagauggaaaacuaaagcaaa

SEQ ID NO: 190391 - RNA, 64 nt, Human
gauuauaaagagacauuugguugauauucauuaauggccccauggacuuaaagugaucaggccc

SEQ ID NO: 190392 - RNA, 64 nt, Human
guagcagugucucccuugcgaccucgcaauaaauuggccccacggggugauuuugacagucugu

SEQ ID NO: 190393 - RNA, 64 nt, Human
guuucucccuugcccuuuuauucccaagccuccuuggccccaguauaaguguugggaacucucu

SEQ ID NO: 190394 - RNA, 64 nt, Human
cuugugguuuuucauuuaacuuuugacuacagcauggccccauggcauccacaccaagagggug

SEQ ID NO: 190395 - RNA, 64 nt, Human
gugcagggacccgagggccagguuagcacagcgcuggccccagcauggagggaagcccuguggg

SEQ ID NO: 190396 - RNA, 64 nt, Human
gggauuuugaguugaacuuuacugggggugucccuggccccacaagccaggaccugcuguguga

SEQ ID NO: 190397 - RNA, 64 nt, Human
cuagcggauggaccagauuccucuggcuaacguauggccccauaggucacugggucauacagag

SEQ ID NO: 190398 - RNA, 64 nt, Human
gccugcccagauuuacugaccccauuugucgacauggccccagacaggagggauccacuucucu

SEQ ID NO: 190399 - RNA, 64 nt, Human
augcuccuggauauucauuuacgaccuuccucuauggccccaagaguaguccuaggaagcccac

SEQ ID NO: 190400 - RNA, 64 nt, Human
aucucccacaggcacugguggugucaucaccugcuggccccacuacagccugaguaggccugag

SEQ ID NO: 190401 - RNA, 60 nt, Human
uuuauguuucucaucuaaucaaauagaguuacucucuaagccagaagcuguaaacucauc

SEQ ID NO: 190402 - RNA, 60 nt, Human
uuaccuauuugauucaguugcuguuuucucacucucuauauccauuugaaauugauuuau

SEQ ID NO: 190403 - RNA, 60 nt, Human
cagauugcagucacaaauguagucauuuuuacucucuaacuguugaguugauuaagagac

SEQ ID NO: 190404 - RNA, 53 nt, Human
gcuguugccaugucaucugacuguggccccaucuggccgcuagcacgcuuccu

SEQ ID NO: 190405 - RNA, 64 nt, Human
ccucauaggaugguaccaagcauuuagugcacaguggccccaucauagccugcagccucaucau

SEQ ID NO: 190406 - RNA, 64 nt, Human
aaccccaggacccuaucagcccccugggacucccuggccccaaccugccaccucaccaaagcuc

SEQ ID NO: 190407 - RNA, 64 nt, Human
gccaacgucacugagggcccugccccagcggcccuggccccaggcucuauuaaccuaaaaugua

SEQ ID NO: 190408 - RNA, 64 nt, Human
gcagccuacaucuccccucagccucuccucacuauggccccagugccuugaggcccaggccagg

SEQ ID NO: 190409 - RNA, 64 nt, Human
cuuauccaaccccucuucagagaaaggugucccauggccccaaaaagaacugccaaguuuuggu

SEQ ID NO: 190410 - RNA, 64 nt, Human
ggcaggcacuugauggcuacaaauaaaugucccguggccccagcccacucuacuggugucucuc

SEQ ID NO: 190411 - RNA, 64 nt, Human
uugcuuuauuaccuuucaaauauuuacuguugcuuggccccaagaauggccuuguacaacuuau

SEQ ID NO: 190412 - RNA, 64 nt, Human
uaccgauuggcucugcagcccccuaaccugccucuggccccaguucguuuccucugcccacuaa

SEQ ID NO: 190413 - RNA, 64 nt, Human
gauuccuagacccagggcucugcacucucaaggcuggccccaugugcucaaggggaucuaaugu

SEQ ID NO: 190414 - RNA, 64 nt, Human
aguccugccccacagggaucuagccacccuucaguggccccaaggccagacugaggcucaucca

SEQ ID NO: 190415 - RNA, 64 nt, Human
uaucaccagagagggacugacacccauguuucucuggccccaagggcaaaauucccagggaagu

SEQ ID NO: 190416 - RNA, 64 nt, Human
cugaccuugucugacccuugugccucuaaacccguggccccaccucucuugguuccuaugucag

SEQ ID NO: 190417 - RNA, 64 nt, Human
aucagaccuucuggaagcaagaccugggccuccauggccccaaaaacucccuaggugauccgau

SEQ ID NO: 190418 - RNA, 64 nt, Human
aaguauggguucgagauggagcugcauauuuuuauggccccaucuucauucacccagaagaaac

SEQ ID NO: 190419 - RNA, 60 nt, Human
uccauccccugugaaauaacacaaaauuucacucucuaaaagcaacagcauguaaacuag

SEQ ID NO: 190420 - RNA, 60 nt, Human
gcuggagaaggagucgaaagucaacaagcgacucucuauggaaaacgaggagcuucugug

SEQ ID NO: 190421 - RNA, 60 nt, Human
caccagaagccagcaggcguggggugugauacucucuauagccacuacagggcgcgcgca

SEQ ID NO: 190422 - RNA, 64 nt, Human
caccuuggaagcaccaauaaagaggaugcccacguggccccagcaaucagaagguguugguugg

SEQ ID NO: 190423 - RNA, 64 nt, Human
gcuuuguucaugaaauaaggcaucucugagaaaguggccccagggagagaauggaggacuggga

SEQ ID NO: 190424 - RNA, 64 nt, Human
cuuagcaaacgguugaaaauaugucuguccucuguggccccaaauccagugaaagaaauucucc

SEQ ID NO: 190425 - RNA, 64 nt, Human
cuacuuauccuauucuuuaaggcacuccauugccuggccccaauuuacuaauccugucuuauuu

SEQ ID NO: 190426 - RNA, 64 nt, Human
uggcccccacaagcugagucuggccuucuccagcuggccccaaaaaaggccuuugcuacauccu

SEQ ID NO: 190427 - RNA, 64 nt, Human
caaagugaugauguggagucuucugucuucauuuuggccccagcauucuuaauuucaaagcuuu

SEQ ID NO: 190428 - RNA, 64 nt, Human
gagcaaauuaauuaggcuucagucuggggccaucuggccccacucucuaggcccuacuccaguu

SEQ ID NO: 190429 - RNA, 64 nt, Human
aggccagacaccaccccccaccccacugucgugguggccccagaucucuguaauuuuauguaga

SEQ ID NO: 190430 - RNA, 64 nt, Human
cuuccuuggcccucuuggaaaggaggggcucguguggccccaggccagugucugucaggauggu

SEQ ID NO: 190431 - RNA, 64 nt, Human
ccagugcauguugccaugaggccuuuccccaguguggccccagcccgacaggcaugcaccagug

SEQ ID NO: 190432 - RNA, 64 nt, Human
aaagagcgggauucaacuuuguuuucuuuuccuguggccccagugaaaccuccugcccucccug

SEQ ID NO: 190433 - RNA, 64 nt, Human
cacugugguuaugcagaagcagagaugaggaggcuggccccagagaugaucuugcccuuccuaa

SEQ ID NO: 190434 - RNA, 51 nt, Human
cuauuucaucuguaucuuaaauggccccaggcaucugccucuggaaaacua

SEQ ID NO: 190435 - RNA, 64 nt, Human
acaaaauuuagccgagugugguggcacaugccuguggccccagccacucugaacgcugagaugg

SEQ ID NO: 190436 - RNA, 64 nt, Human
cugcacagaggacccugacccucggccagcaggguggccccagguccauguugggcacuagggc

SEQ ID NO: 190437 - RNA, 60 nt, Human
uguacaauuaggaaauuuuuuuaagugaggacucucuacccuugccguaucuaaggagcu

SEQ ID NO: 190438 - RNA, 60 nt, Human
aauguguauuuuagucucugugaagccuuuacucucuaggugccuuauaauguuucaggg

SEQ ID NO: 190439 - RNA, 60 nt, Human
ugaaguauuaaaauguuauuaguuuuauuaacucucuacacuugaauguguguuuuuuaa

SEQ ID NO: 190440 - RNA, 64 nt, Human
gggcagugugcaugcaacacacuuaggggaggaguggccccagaauucagcacgcacacaacac

SEQ ID NO: 190441 - RNA, 64 nt, Human
uaguccauuauuuguuguuaaaaaugcuucaaaagguuuucagugucagucugagaugccuggu

SEQ ID NO: 190442 - RNA, 58 nt, Human
uuucuuacuguauucgaugacugauaaagguuuucaugccucugggauugagauuaga

SEQ ID NO: 190443 - RNA, 64 nt, Human
guugggcagaucaagagacagcuacaaaaaugaagguuuucauaaugcaauguaacauaguacu

SEQ ID NO: 190444 - RNA, 64 nt, Human
ucacucuguguaaaggccaacagauuuuuaaugugguuuucauaucaaaagaucauguugggau

SEQ ID NO: 190445 - RNA, 64 nt, Human
gccauuuccagugucccaacuacugucaucgugagguuuucaucggcugugccauuucccaacg

SEQ ID NO: 190446 - RNA, 64 nt, Human
uuguccugcucugaccacagaguuuuaauguuuugguuuucacuucuuuuaaacuggacaacaa

SEQ ID NO: 190447 - RNA, 64 nt, Human
augaagucagauagccagaagaaauuccauugcugguuuucacgaaauucacuugucuuuugcu

SEQ ID NO: 190448 - RNA, 64 nt, Human
uuacagucuuuuauguaaaauuuauuauaucacugguuuucaaagcaaaacauaaaauauuguu

SEQ ID NO: 190449 - RNA, 64 nt, Human
augauaaugaacagaacauagacagaagaaacaagguuuucaguccccacagauaacugaaaau

SEQ ID NO: 190450 - RNA, 64 nt, Human
gucuccugggggagcuuaaaacgggggaaacacugguuuucacagaugcuccacauggcugucu

SEQ ID NO: 190451 - RNA, 64 nt, Human
cagugauaaaugagcuagauggcucaauauguaagguuuucaguaguuuacccuccggaaccca

SEQ ID NO: 190452 - RNA, 64 nt, Human
uugauacaaguuucugugguggaaaauuuaugcagguuuucacgaauccuuuuuuuuuuuuuuu

SEQ ID NO: 190453 - RNA, 64 nt, Human
cugggauuacaggugcgagccacugcgccuggcugguuuucaugaaucuugauagacaucuaua

SEQ ID NO: 190454 - RNA, 64 nt, Human
gugaauugcaccuuugugccauguuucugaaucugguuuucaaauccaguggagccuuucagug

SEQ ID NO: 190455 - RNA, 64 nt, Human
aaggagcccagaaaaccuccaguaguggacaacagguuuucaccauagccuacguuaacccauu

SEQ ID NO: 190456 - RNA, 60 nt, Human
ggcugaauuuccugggcacuucucaguggaacucucuagccuccugguucggaaugucaa

SEQ ID NO: 190457 - RNA, 60 nt, Human
cuucguuuggaacugaaguccagccagcagacucucuagcuccaucuccccugugccacc

SEQ ID NO: 190458 - RNA, 60 nt, Human
uguuuagcaggaaaccagucucaguguccaacucucuaaccuuggaacugugagaacucu

SEQ ID NO: 190459 - RNA, 64 nt, Human
cccacuuggagcagugggaggaaaucuggguuuguggccccacaaaggcuguauauguaaagau

SEQ ID NO: 190460 - RNA, 64 nt, Human
aucugcaggccaaacaaggugcaggacccagcuuuggccccaugccccuguaggucccucuggg

SEQ ID NO: 190461 - RNA, 64 nt, Human
agugucuggguuggagacagugcaggccccuucuuggccccacccucuaccccauuccuuccug

SEQ ID NO: 190462 - RNA, 64 nt, Human
cgccccucaggccagcaguugagguccaucgggcuggccccagcccaucugcuggcaucaguac

SEQ ID NO: 190463 - RNA, 64 nt, Human
ccagacacagccaagggagagugcucccgacagguggccccagcuuccucuccggagccugcgc

SEQ ID NO: 190464 - RNA, 64 nt, Human
uacacccucggacuccugcccuccucggccucccuggccccagcgcggcuccacccugggcugc

SEQ ID NO: 190465 - RNA, 64 nt, Human
gcuaaccccaaccagcaggcaacuaacacggaauuggccccacaccggacgugggaggugucug

SEQ ID NO: 190466 - RNA, 64 nt, Human
uucaugucaugugguuugggaugaaccaggggucuggccccaucgggucacaggugauggcaaa

SEQ ID NO: 190467 - RNA, 64 nt, Human
aaguguugggauuauaagcgugagccaccaugccuggccccaauuuaaaauguggaauucaguu

SEQ ID NO: 190468 - RNA, 64 nt, Human
cugaauuuugaucucaaaggacacagaaaaaaaauggccccaggagaucugaucacacuuccuc

SEQ ID NO: 190469 - RNA, 64 nt, Human
agucccagcccuuccauucagccugugccaucccuggccccaaggcuaggaucaaaguggcugc

SEQ ID NO: 190470 - RNA, 64 nt, Human
ccaugccuguagcuuuccuggucccucacccccauggccccaggcccacagcgugggaacucac

SEQ ID NO: 190471 - RNA, 64 nt, Human
aaagagaagugggugggcacacugaacuguuugguggccccaaccacaggaagcugcaauucuc

SEQ ID NO: 190472 - RNA, 64 nt, Human
ccaccccagucaucucuggugucagcugcugcuguggccccagcagguucucaaagcucccaag

SEQ ID NO: 190473 - RNA, 64 nt, Human
gguccgcucccucaguggggccgguggagauccuuggccccaggaugggcagacagagcaccau

SEQ ID NO: 190474 - RNA, 60 nt, Human
gguggacccagggaacagccacuccccuccacucucuaccagauaacugaggaggggaga

SEQ ID NO: 190475 - RNA, 60 nt, Human
uuuuuaaaaagcuaauauugcugugauucaacucucuaguuacuugaugcuauuucuuca

SEQ ID NO: 190476 - RNA, 60 nt, Human
cuuccuguuucuaaguggccugcaggggccacucucuacugguaggaagagguaccacag

SEQ ID NO: 190477 - RNA, 64 nt, Human
gaggcaggccucccacucagagucugggucucacuggccccaagucucccacccagaacucugg

SEQ ID NO: 190478 - RNA, 64 nt, Human
cugcagccccagguacccccuuccuggaugcugcuggccccaggagauagcuuuccggugacag

SEQ ID NO: 190479 - RNA, 64 nt, Human
cccuguaccccagcuuccuuccccuggccuuuucuggccccagugcuccuccuuuacauagacu

SEQ ID NO: 190480 - RNA, 64 nt, Human
uuuucuaagccacguccuauaggacagaggagacuggccccacuucuaugggucugagcugugg

SEQ ID NO: 190481 - RNA, 64 nt, Human
ggccaccuggaggcuggggugcuggggcuugggguggccccaggguagguaacagucuuaggac

SEQ ID NO: 190482 - RNA, 64 nt, Human
cacaccaggccagagcuauauuuccaaaggcugcuggccccaggcacacuccucaucaauucuc

SEQ ID NO: 190483 - RNA, 64 nt, Human
cuuaucuccccuucacaugauuccuucugugcccuggccccagguauuauucugaggcugccuu

SEQ ID NO: 190484 - RNA, 64 nt, Human
cugacugcacuggugggccggcuggggggcucuuuggccccacuggcggccuugcuggauggag

SEQ ID NO: 190485 - RNA, 64 nt, Human
gagggcaggcacauguuguucucauugaccgugcuggccccagugccuagaugcauggcuggca

SEQ ID NO: 190486 - RNA, 64 nt, Human
auaagaguucacugaaugcaccuauuauaaucuguggccccagcaguauaauucuuuuaucuuu

SEQ ID NO: 190487 - RNA, 64 nt, Human
uuuuuuuuauuuuuuucugauaaaauacaaauguuggccccagauucuuuuaacgucaaggaaa

SEQ ID NO: 190488 - RNA, 56 nt, Human
ugaagcucagcuccgugugacccacauggccccaggccgggggacaccagaggcuc

SEQ ID NO: 190489 - RNA, 64 nt, Human
ucggcucagacuuuugguuggaaaaagaucuucauggccccaaauccccugagacaugccuugu

SEQ ID NO: 190490 - RNA, 64 nt, Human
cggagucucgcucugucacgaggcuggagugcaguggccccaucucggcucacugcaaccuccg

SEQ ID NO: 190491 - RNA, 64 nt, Human
cugccaaauuuuagauuuaccuuguuagaagagguggccccauauuaacaaauugcauuugugg

SEQ ID NO: 190492 - RNA, 58 nt, Human
cuccugcguuugguggaugauuucuuguuggugacaccucaccucacccacgcgaaaa

SEQ ID NO: 190493 - RNA, 60 nt, Human
uaucuguguuagcauguaguauuuucagcuacucucuauuguuauaaaauguaguacuaa

SEQ ID NO: 190494 - RNA, 60 nt, Human
cuccuaggggaggggagauaagaaacccucacucucuacagguuuggguacaaguggcaa

SEQ ID NO: 190495 - RNA, 64 nt, Human
gguguugugguggacagggaagccccugcugucauggccccacaugggguaagggggguugggg

SEQ ID NO: 190496 - RNA, 64 nt, Human
uuaguuacaguuauuuuacaauaaugguggguaauggccccaccucuguuaugagauaauguuc

SEQ ID NO: 190497 - RNA, 64 nt, Human
ccaugagggcuccuuuccuuuuugaccacgaccuuggccccagcucugcacucucuggaauaag

SEQ ID NO: 190498 - RNA, 64 nt, Human
aucugagaauacugucuuuccauauggcuaaguguggccccaccacccucucugcccucccggg

SEQ ID NO: 190499 - RNA, 64 nt, Human
ugaauguggauacagcgccacuccugcccccucuuggccccauccauggacucuugccucggug

SEQ ID NO: 190500 - RNA, 64 nt, Human
ggaucaacaucuguccuacggguccccucuuuuuuggccccaguauucauggcaggguuuguug

SEQ ID NO: 190501 - RNA, 64 nt, Human
uuuccaugucuguaccacaagaggguugaccagauggccccagguuuuccuuuaggucugacau

SEQ ID NO: 190502 - RNA, 64 nt, Human
agacuugcuacccucuugagcagcucuucugagauggccccagugaaccagcuucuagaugaca

SEQ ID NO: 190503 - RNA, 64 nt, Human
uccugcccgccugagaacugcacacccugcccgcuggccccaggaccugcacucccaauccugc

SEQ ID NO: 190504 - RNA, 64 nt, Human
cacuuaagcaugggguggggagcuucucccagaguggccccaggggguuagaggaggggugaag

SEQ ID NO: 190505 - RNA, 64 nt, Human
gcucuguugaaauuccuggaggcaaaauugaccuuggccccaaagauauuccucaauagauuuc

SEQ ID NO: 190506 - RNA, 64 nt, Human
uccucaggcuguuucugcaauuugacaugaggccuggccccagggaaaccaguggggccucauc

SEQ ID NO: 190507 - RNA, 64 nt, Human
gagagagcagcuucccuuggcucuggggccguguuggccccagccacguuuacaggaaggugug

SEQ ID NO: 190508 - RNA, 62 nt, Human
ucacguccacgcggcuguagcgggugggacccuggccccagcguccccugccagcauccucg

SEQ ID NO: 190509 - RNA, 64 nt, Human
gggcagagcgaccugccgggaccuugacaacaccuggccccacccacacguccugcaauauuca

SEQ ID NO: 190510 - RNA, 64 nt, Human
ucauugacuaucaaacugaagccagaaauaaaguuggugacagauaggccugauuguauuuguc

SEQ ID NO: 190511 - RNA, 64 nt, Human
gcuaugcuguaucugugcuuugcccacaugcccuuggugacagcugagcacccagcucugucuu

SEQ ID NO: 190512 - RNA, 64 nt, Human
cuggugcagcccagcuggcggaggggcgaagcuuuggugacagacggagagugggggacuagcu

SEQ ID NO: 190513 - RNA, 64 nt, Human
cuuaagaguaacagcagccaccgcccaguuccaguggccccacgaagcccccaguggcuggcug

SEQ ID NO: 190514 - RNA, 64 nt, Human
guuuuauucuaauccaucagggaaaugagcugaauggccccagcaccauccaaguugacacagc

SEQ ID NO: 190515 - RNA, 64 nt, Human
ggcucuucccagcagccugugcaaauucugaugauggccccacccccgcacacgcacacgcaca

SEQ ID NO: 190516 - RNA, 64 nt, Human
acugcaaaacacuaaagauccaagaaggccuucauggccccagcaggccggaucgguacuguau

SEQ ID NO: 190517 - RNA, 64 nt, Human
uggauggggacgagggaugagaaggguguggguuuggccccaugucacuggccggaaggaugug

SEQ ID NO: 190518 - RNA, 64 nt, Human
gcugcuucagcugccuccucgcccagcuacccuuuggccccauugggcccucgucugccucucc

SEQ ID NO: 190519 - RNA, 64 nt, Human
gaggggaccucagccugucacuggcccugaagacuggccccacuucuggucucugucccucugc

SEQ ID NO: 190520 - RNA, 50 nt, Human
uccucaagaucuggaacuaauggccccacccccacugggcccaggccagg

SEQ ID NO: 190521 - RNA, 64 nt, Human
gcugacccuuugacacccuucuuguccuccucucuggccccauccaggcaaccaaauaaaguuu

SEQ ID NO: 190522 - RNA, 64 nt, Human
gugagcugaagaacaagcugcucauggcaagggcuggccccagaacccugcaagagaggccuuc

SEQ ID NO: 190523 - RNA, 64 nt, Human
aggaaaagaggcucuucaacagccccaguuauccuggccccaugaccguggccacagcccugcu

SEQ ID NO: 190524 - RNA, 64 nt, Human
gcccaagagcgguggggcgacccuccuuuuggcuuggccccaggaauuuccugugacuccacca

SEQ ID NO: 190525 - RNA, 64 nt, Human
guggaugggggggcucuggcguccugaggccaccuggccccaccugcuccucagggcagcccgg

SEQ ID NO: 190526 - RNA, 64 nt, Human
uuuccaagucgcauaagcccuggggcuuuccugguggccccacuggggcugcuccguccggaac

SEQ ID NO: 190527 - RNA, 64 nt, Human
gacucccaugaggccucccuucaaccaggcuuuuuggccccacaaauacuuuaagcaaaucauu

SEQ ID NO: 190528 - RNA, 64 nt, Human
uucaaacaccaaaaauauaccauuuuaaggcauguggugacaaugcuauuugccuuaguucauu

SEQ ID NO: 190529 - RNA, 64 nt, Human
uuauguuaauguuuuguaauguccuuuuaaugaguggugacauaaaagggcugcuuuguugucc

SEQ ID NO: 190530 - RNA, 64 nt, Human
auuacugccacaucuccaugcaucagcaaaauguuggugacauuuuucuagccuggcagaacag

SEQ ID NO: 190531 - RNA, 64 nt, Human
cuauaugccauggaugugaauuucccauagaagcuggugacauguuccuggaagcucugggcua

SEQ ID NO: 190532 - RNA, 64 nt, Human
uuuccucuccuucccccacccagcuuucuuuuuauggccccagggggagggggagagagcaagg

SEQ ID NO: 190533 - RNA, 64 nt, Human
cuaggaagaaugacugagggauaguauuggguauuggccccauggcaggaacagccacuugcau

SEQ ID NO: 190534 - RNA, 64 nt, Human
aaagauggagcugggccacaucagaauaaggccuuggccccauccucucacagccuaggugcuc

SEQ ID NO: 190535 - RNA, 64 nt, Human
aaugucugagauacacaauugcaggagauuuuauuggccccaugacauccagugacaguguggg

SEQ ID NO: 190536 - RNA, 64 nt, Human
ccugcagagccagccagggcggagagccauacccuggccccagcgcgccccgacacacaugcuu

SEQ ID NO: 190537 - RNA, 64 nt, Human
guugagaaaauccuauuaucaaauuuggauuuccuggccccagaacuucccaaagaccuguaaa

SEQ ID NO: 190538 - RNA, 64 nt, Human
aucccaaaggugcaccguugccccagccccuuucuggccccaugggguuucucugaugccuuca

SEQ ID NO: 190539 - RNA, 64 nt, Human
caagucuucaggauaaaguucaaaaccgcugucauggccccaugugaucucucccuccccuacc

SEQ ID NO: 190540 - RNA, 64 nt, Human
agcuacaagugcagcugugaccccggguacgagcuggccccagacaagcgccgcugugagggug

SEQ ID NO: 190541 - RNA, 64 nt, Human
caccuucuuagcgaucuaggccuggcaagagcucuggccccaaggccuccucuucccaggggcu

SEQ ID NO: 190542 - RNA, 64 nt, Human
agguccuccauuacagaggcccagcgcacaucgcuggccccacaaacguucagggguacagcca

SEQ ID NO: 190543 - RNA, 64 nt, Human
cuccuaaacagacaguuuaauuauaguugcggccuggccccauccucacuuccucuuuuuauuu

SEQ ID NO: 190544 - RNA, 64 nt, Human
ggaccuaggagcuugaguugucaggggccaggacuggccccacugcagugcccaggccagucuu

SEQ ID NO: 190545 - RNA, 64 nt, Human
ucugcccagcccagcaggggcuccaggccuuggcuggccccacaucgccuuuuccuccccgaca

SEQ ID NO: 190546 - RNA, 64 nt, Human
uccccagagaggcacucagugagccuccugugccuggccccagccugggccaucucuuagguga

SEQ ID NO: 190547 - RNA, 64 nt, Human
ggggaaggaaauagcuuggguagcgcacucuucauggugacacucgaggucgggcagcacaagu

SEQ ID NO: 190548 - RNA, 64 nt, Human
ccgcaaccagcgccgacaccaugcccccucuuccuggugacacccucaacaaccaggauuugcu

SEQ ID NO: 190549 - RNA, 64 nt, Human
aaaauauagccaccagugcuuuguuccaggaguuuggugacaaaguuuugguuugguguuuugg

SEQ ID NO: 190550 - RNA, 64 nt, Human
gcucuggacagcagaagccuccaagcacagagccuggccccaggccccagacagggugggcuuc

SEQ ID NO: 190551 - RNA, 64 nt, Human
gaguggagcuuggccugagggcguguugcagcccuggccccaccaguccacagaggcccccagg

SEQ ID NO: 190552 - RNA, 64 nt, Human
cccagggagguucuggagguuccuuucugucuccuggccccaccagggauuuccccauuucugu

SEQ ID NO: 190553 - RNA, 64 nt, Human
gcccugccuccccauugugugcccagaacaucccuggccccaccccgccacuucccucgggccc

SEQ ID NO: 190554 - RNA, 64 nt, Human
ccuuauguugcucuuucuaucauuuccauucugguggccccacuaaugucuuaaccuaaaccau

SEQ ID NO: 190555 - RNA, 64 nt, Human
ggauuuaugagauuuuaauaucuuuucccacuaguggccccaggccccagcaagccucccucca

SEQ ID NO: 190556 - RNA, 64 nt, Human
uuauauacaauaauaguuuuucuuacaacuaagcuggccccagccuugucuugauauuaauaca

SEQ ID NO: 190557 - RNA, 64 nt, Human
guggugauguaaaaaugcuuccacugcaagucuguggccccacaacgugggcuuaaagcagaag

SEQ ID NO: 190558 - RNA, 64 nt, Human
ccaauggcugcaucaaaugcaugcgugugcgugguggccccacccaggcaggggcuucccacag

SEQ ID NO: 190559 - RNA, 64 nt, Human
ccucuguuacccgcagauccugucccaugggcucuggccccaagauguuggggggccccacgga

SEQ ID NO: 190560 - RNA, 64 nt, Human
cccacaagauucaccugggccuccagucccacgcuggccccaacugcugcagcucucggcuucc

SEQ ID NO: 190561 - RNA, 64 nt, Human
ccuuguccucaagauuuuuaguuuggcccaaguguggccccauuagcgacacccuccucuacca

SEQ ID NO: 190562 - RNA, 64 nt, Human
ucuaagaugcucauagaagaggaagaaugggacauggccccaugcuuauuuuuguuuacaacgu

SEQ ID NO: 190563 - RNA, 64 nt, Human
aggagaguaaguccacucuucccucucaucaucauggccccaccggguacccugagcagcucca

SEQ ID NO: 190564 - RNA, 64 nt, Human
ccucuucucuggcugcuaccucagggcaugguuguggccccaccaacaccuauuuuccaaauaa

SEQ ID NO: 190565 - RNA, 64 nt, Human
cccucucagaaagggagaacgccagagcccuggcuggugacaugcuggcugggggugaauccga

SEQ ID NO: 190566 - RNA, 64 nt, Human
cagugagcugagaucacaccacugcacuccagccuggugacagagcaagacuccggcucuuaaa

SEQ ID NO: 190567 - RNA, 64 nt, Human
ggagucuugcucugucgcccaggcuggaacgcaguggugacaucucggcucacugcaaccucca

SEQ ID NO: 190568 - RNA, 64 nt, Human
aaguucaaauuccccaaaaaggcuuguccaaggcuggccccagaugugugggucugacccacac

SEQ ID NO: 190569 - RNA, 64 nt, Human
cagggggcuuucaaaaccaggcagggccaagccuuggccccacuggagguagagcaccuucugu

SEQ ID NO: 190570 - RNA, 64 nt, Human
uacugaugguguauuagcaugagcagcguggcccuggccccacacucccaaaucugccacucca

SEQ ID NO: 190571 - RNA, 64 nt, Human
cccggggaccacagggacacccucugagacgugcuggccccaggaggauacaggcacacgggca

SEQ ID NO: 190572 - RNA, 64 nt, Human
ugagugacccugaggccuuaagcuuccccagucuuggccccaaaugcagucaccagcaaguuuu

SEQ ID NO: 190573 - RNA, 64 nt, Human
ucccucccugcugagccugggguuccccuggcauuggccccagccuucugaaagccggcgcugc

SEQ ID NO: 190574 - RNA, 64 nt, Human
aggcguucauuggcagcccccuaggacugcacgcuggccccacgguaacccccccucccccacc

SEQ ID NO: 190575 - RNA, 64 nt, Human
ggaauucuccuuaagggaggagagcaagcagguguggccccagcuucuggaaauggcagaagag

SEQ ID NO: 190576 - RNA, 64 nt, Human
uggggucucugagcaguggggagcgggggcuaacuggccccaggcggaggggcuuggagcagag

SEQ ID NO: 190577 - RNA, 64 nt, Human
cccgcagcaccagccugagccacaguggggcccauggccccagcuggcugggucgccccuccuc

SEQ ID NO: 190578 - RNA, 64 nt, Human
uaccagcccucaguguggaggcugagcuggugccuggccccagucuuaucugugccuuuacugc

SEQ ID NO: 190579 - RNA, 64 nt, Human
ccuacuacacaggcaugcccagugccuuccaguauggccccaccauguuugugaguauuucaga

SEQ ID NO: 190580 - RNA, 64 nt, Human
auuaacgaguggggggaucacaaagccaggggcuuggccccaccccagcgaagccaugaacucc

SEQ ID NO: 190581 - RNA, 64 nt, Human
aucuccuguuuguuucaguuggcagaacauuuacuggccccaacuguggcaucauccucucagc

SEQ ID NO: 190582 - RNA, 64 nt, Human
aaugaaaauggggcauucaggaaagcaccuguccuggccccacaguaugucagcuguauaggca

SEQ ID NO: 190583 - RNA, 64 nt, Human
cuccccuauccagaaaauguugucagugucccaguggugacaucucaguuugggaagugggaug

SEQ ID NO: 190584 - RNA, 64 nt, Human
ugggacgcccagacccugcccgccgcccaccugguggugacaagcuccagcagccagugggucc

SEQ ID NO: 190585 - RNA, 64 nt, Human
accccauccucugcugcagaagcuauggucuguguggugacagccagauucucuacucuuaugu

SEQ ID NO: 190586 - RNA, 64 nt, Human
ccugcucacguccucuuggccacugguagucauguggccccaccuggaugcagaggaggccagg

SEQ ID NO: 190587 - RNA, 64 nt, Human
gccuguuccuguagcucuggggccaggucagccguggccccaccuaccagaacugugcucugcu

SEQ ID NO: 190588 - RNA, 64 nt, Human
ucccccaagggccucagccuggcugugggcuggguggccccauccuaccaggcccugaggucag

SEQ ID NO: 190589 - RNA, 64 nt, Human
ucaccuucccugaauucagaacagacccugugccuggccccagugugcccaggcaauuccccag

SEQ ID NO: 190590 - RNA, 59 nt, Human
augacaccugccggcaguagcccccacgcuggccccagccucagaccccacccagcacc

SEQ ID NO: 190591 - RNA, 64 nt, Human
uggcagccccugcccacucccaugcugguggcccuggccccacugagcacgccugagccuccgg

SEQ ID NO: 190592 - RNA, 64 nt, Human
gcagagcgucgguggggcugggccgucguggagguggccccaggagucauauggccauacucag

SEQ ID NO: 190593 - RNA, 64 nt, Human
cucagggcucccucuggcucccgggucacucuuguggccccaguggguggucccugcagucaug

SEQ ID NO: 190594 - RNA, 64 nt, Human
acacugccuuuuuauuuauauguacuguuuuaucuggccccagguagaaacuuuuaucuauucu

SEQ ID NO: 190595 - RNA, 64 nt, Human
ucacccugcugcugaacaaauuuaggguggaagauggccccagugaguucgcacucuacaucgu

SEQ ID NO: 190596 - RNA, 64 nt, Human
aagaggagaaugagcuggagcgccagcaccacgauggccccaggacguuguuuaagaucugaga

SEQ ID NO: 190597 - RNA, 64 nt, Human
ccccagcucuccucuguggguuuuaccggaaagguggccccagcuguugacuuccagucacugu

SEQ ID NO: 190598 - RNA, 64 nt, Human
gcugcagauccacuuaggccccaggguccacggauggccccaaaggcugagggccccaaagcca

SEQ ID NO: 190599 - RNA, 64 nt, Human
guaugaggaaacagacagcggacugaggaagcgauggccccagagaaagggccccuguagccug

SEQ ID NO: 190600 - RNA, 64 nt, Human
gccagagaggcugccuguacagccagggucaguuuggccccaaacagggauucagaaaccaaau

SEQ ID NO: 190601 - RNA, 64 nt, Human
uaagacaguuucugcccaaagucauguuaccaguuggugacagagcuggaaauacguagagauc

SEQ ID NO: 190602 - RNA, 64 nt, Human
aaaauacuacucucauaaaugggugggaguauuuuggugacaaccuacuuugcuuggcugagug

SEQ ID NO: 190603 - RNA, 64 nt, Human
cagcaaccauuguuguuaugaucugcagucuuccuggugacacuggaaucucucucucugccgc

SEQ ID NO: 190604 - RNA, 64 nt, Human
ccuagacgcccaggaccggcccugugagccgugcuggccccacccgaggccgcgggggccccag

SEQ ID NO: 190605 - RNA, 64 nt, Human
acacaaauucagaacgugccucuuuccagaucgcuggccccagaacccugucccccacacccag

SEQ ID NO: 190606 - RNA, 64 nt, Human
gcugugcagguggggagacugggcugagggagccuggccccauggucagcccuaggguggagag

SEQ ID NO: 190607 - RNA, 64 nt, Human
gcaagugggggcugaaguccugugcaggcugcgcuggccccaccugccuugugcccuggagugg

SEQ ID NO: 190608 - RNA, 64 nt, Human
gaagagcaugcccugcccucuggggaggcuggccuggccccagcccucagcugcugaccuugag

SEQ ID NO: 190609 - RNA, 64 nt, Human
uggccauccugaggauagggcagagugcccaggguggccccagggcuucuaaaaccccaccuag

SEQ ID NO: 190610 - RNA, 64 nt, Human
gggagaccuugcugcugaccauccuaggcugggcuggccccacccucacccccacccccagggu

SEQ ID NO: 190611 - RNA, 64 nt, Human
aaggcuguaacucacagccccuguccacccuauguggccccacaacacagauuuagagauacaa

SEQ ID NO: 190612 - RNA, 64 nt, Human
ucuugccaggccucagccccgucuacccuaagccuggccccaaagguuucucuuucuuccuccu

SEQ ID NO: 190613 - RNA, 64 nt, Human
caggcuggccgcgcaccggggcucgggcacccucuggccccacacuggcaaugaugccacaccu

SEQ ID NO: 190614 - RNA, 64 nt, Human
gcagcaggcagacagcucacccccaccagcaugauggccccagcugggggcaguggcaggagcc

SEQ ID NO: 190615 - RNA, 64 nt, Human
gcccggagcagccuguuccugcacuccacccugcuggccccaggacuucugaucucaguccucu

SEQ ID NO: 190616 - RNA, 64 nt, Human
ccccauggcugcugcugagucagccaccuagcgcuggccccaugcagccucccugggcugggcu

SEQ ID NO: 190617 - RNA, 64 nt, Human
aagaggcagccggagcuucugcacaggaugucccuggccccagguccugcagcaccuuagucca

SEQ ID NO: 190618 - RNA, 64 nt, Human
ccuucaggaacuggggccuugccuugcagccacauggccccaucccaguuggggaagccaggug

SEQ ID NO: 190619 - RNA, 64 nt, Human
auguuacagcaguuugccaaggcggggaccuaacuggugacaauugagccucuugacugguacu

SEQ ID NO: 190620 - RNA, 64 nt, Human
uuaucuugcauagaacauaauaaguaugugucuuuggugacacuaauguucuacuauagcuuau

SEQ ID NO: 190621 - RNA, 64 nt, Human
ccagaggcaguuaacccuguagcacuuacuagacuggugacaacuggcuggauguggagaauaa

SEQ ID NO: 190622 - RNA, 64 nt, Human
gcgcuggaggagccgggucuuggcauccuggagguggccccacugguccuggugcuccaggcgg

SEQ ID NO: 190623 - RNA, 64 nt, Human
caugcaugaaugagcauucccagggaaacugccuuggccccagggcgccucucugugccaggga

SEQ ID NO: 190624 - RNA, 64 nt, Human
ggggaugggccugagugagaggggaggccaagaguggccccaccuggcccucucugaaggaggc

SEQ ID NO: 190625 - RNA, 64 nt, Human
cugucucuccuucccucccuuccuucaagauaacuggccccaagaguggggcaugggaagggcu

SEQ ID NO: 190626 - RNA, 64 nt, Human
ugggguccauccccuucccccaucccuaccacuguggccccaagaggggcgggcucagagcuuu

SEQ ID NO: 190627 - RNA, 64 nt, Human
caguguccucccgugccccuccccgcuguccucuuggccccaggggagaagaugaggccaucag

SEQ ID NO: 190628 - RNA, 64 nt, Human
uucuucccugagguuguggcugacagagccugcuuggccccacuguuaguccagcgagcuccua

SEQ ID NO: 190629 - RNA, 64 nt, Human
ugaccuuuccuagccucagaucuguuaauucuuuuggccccagcccugucccucacuguccucu

SEQ ID NO: 190630 - RNA, 64 nt, Human
gacacaggccagccccaucuugguccugucacccuggccccaacuauuaaagugccauuuccug

SEQ ID NO: 190631 - RNA, 64 nt, Human
gcuuaggacccccagagccaagguggcugggaucuggccccacagauggggaaagauggggaag

SEQ ID NO: 190632 - RNA, 64 nt, Human
ucagcugggcagugccagccaaucccuggccauuuggccccaggggacgugggcccugcaggcu

SEQ ID NO: 190633 - RNA, 64 nt, Human
cucugugcuggguguuucugcugcagguggcagguggccccaggccuguuuggaggaugggcug

SEQ ID NO: 190634 - RNA, 64 nt, Human
agcugcaagcugagguggcagcucugaccaccucuggccccaggcccucagggagaaaggagca

SEQ ID NO: 190635 - RNA, 64 nt, Human
aacggccaccuugggugcccaggauacuggugccuggccccacguacacccacauacuucucag

SEQ ID NO: 190636 - RNA, 64 nt, Human
gcacaaucagccagggagaacugggcggguuuaguggccccaggcccacuccucaugcagcagu

SEQ ID NO: 190637 - RNA, 64 nt, Human
guagggggcugcuuugggcuuugcaccugcacuuuggugacauuguucuucuguguucccuuua

SEQ ID NO: 190638 - RNA, 64 nt, Human
ucaucauguuggcaagugauguggcaauuaucucuggugacaaaagaguaaaaucaaauauuuc

SEQ ID NO: 190639 - RNA, 64 nt, Human
ugaaucuuccugagaucccaagaaauauuaacauuggugacaucaguauaaaagugccaaaccu

SEQ ID NO: 190640 - RNA, 64 nt, Human
aaagguuuuauuuuguaauuauugugauuucccguggccccagccuggcccagcucccccggga

SEQ ID NO: 190641 - RNA, 64 nt, Human
cucagagccccucccugcuaccaaggcccagcuauggccccaggguugaaaaguuaugaggguc

SEQ ID NO: 190642 - RNA, 64 nt, Human
uuggcagaggggaggggccugugcccgucaccccuggccccauuccuugguaauuagccacacc

SEQ ID NO: 190643 - RNA, 64 nt, Human
gcugggcaucaguggccacaugggcaucaggggcuggccccacagagaccccacagggcaguga

SEQ ID NO: 190644 - RNA, 64 nt, Human
cagucugggcacuuuucugcaaguccacuggggcuggccccagccaggcccugcagggcugguc

SEQ ID NO: 190645 - RNA, 64 nt, Human
ggcccugagugccucccuugccucacucugauccuggccccauaauguccucaguggaagguga

SEQ ID NO: 190646 - RNA, 64 nt, Human
aauucugcccacuuuuuauaaaaacuuacagcgauggccccaccaaggccuagacacggcacug

SEQ ID NO: 190647 - RNA, 64 nt, Human
cugaccaaugccgcgguggaaacgggcuuggagcuggccccauaagggcuggcggcuuccuccg

SEQ ID NO: 190648 - RNA, 64 nt, Human
ucgaguuuccagagcaggaggcccuacagacauuuggccccaaaucccugacucaauaaaguaa

SEQ ID NO: 190649 - RNA, 64 nt, Human
agggguuccuugcugagacccacauugcuucaccuggccccaccauggcugcuugccuggccca

SEQ ID NO: 190650 - RNA, 64 nt, Human
ggccucccagccacccggaucuccaggcccagccuggccccaaauguucuuuccuuucauccuc

SEQ ID NO: 190651 - RNA, 55 nt, Human
cuuuccaccugguccggugacccccuggccccagauggcacugaguuuuucauuc

SEQ ID NO: 190652 - RNA, 64 nt, Human
gggcugcgugugggaggcuggggacccagacuuuuggccccagcgcuggcccccccagccccac

SEQ ID NO: 190653 - RNA, 64 nt, Human
ucaggcaaagcacuaaagggccaguaccagugaguggccccaccuguguccccgaugcugaccu

SEQ ID NO: 190654 - RNA, 64 nt, Human
ccagaucacggugaugaaccucuggccucaggauuggccccacaucaccacgccaacaggacca

SEQ ID NO: 190655 - RNA, 64 nt, Human
ugacauugcuuccucugccacaaagacaauacucuggugacacaugucuagacccagcacaggc

SEQ ID NO: 190656 - RNA, 64 nt, Human
aguguugcuuuucuguugguagagcucucccauuuggugacauggaaaauaccuuuccauuauc

SEQ ID NO: 190657 - RNA, 64 nt, Human
uuccaggagcugcugggaagcuggccuucauuguuggugacagggcaaccaugggacuaggagg

SEQ ID NO: 190658 - RNA, 64 nt, Human
ugcaggggcugcaggccguuaaguggacaggaaguggccccacauagcccgagcagggucugga

SEQ ID NO: 190659 - RNA, 64 nt, Human
uucaaguguuaguagcugggauuacaaaagcauguggccccacgcccagcuaaguuuuguauuu

SEQ ID NO: 190660 - RNA, 61 nt, Human
ggaagaaaaguggagguuagcaacacaccuguggccccaaaggacaaccaucuuguuaacu

SEQ ID NO: 190661 - RNA, 64 nt, Human
cuccugccauggugacagcccuccucuccucaccuggccccagcuccugccccauuaaaccucu

SEQ ID NO: 190662 - RNA, 64 nt, Human
agccauauacgacuggguguuugucccccuacuuuggccccaggaguaaaaaaacuucuccuuu

SEQ ID NO: 190663 - RNA, 64 nt, Human
cuuccugucccuuuaccggucccaggcugcugacuggccccacacugugccaccggacaaucga

SEQ ID NO: 190664 - RNA, 64 nt, Human
uuuucuguuucuggaguacuucagggguggccucuggccccagagccuuugccacagugcuccc

SEQ ID NO: 190665 - RNA, 64 nt, Human
acaagauccaggcagaaggagauggguuuggggcuggccccauccuggcccagccucuuaaccu

SEQ ID NO: 190666 - RNA, 64 nt, Human
gccagucuccucucaagcaagccuccugaaccacuggccccaaccaacccacuggugggguggg

SEQ ID NO: 190667 - RNA, 64 nt, Human
gugagaggaaagaggcgggggcgggugaggagacuggccccaggccccagccacggcugcagag

SEQ ID NO: 190668 - RNA, 64 nt, Human
ugagggguggaagggaucucuggggucuggaauuuggccccaaaccagagaauguaccuuaagg

SEQ ID NO: 190669 - RNA, 64 nt, Human
ccacccuauucuaaggaaccacaauaacuuacucuggccccaguguuaaaacgaucuuucagau

SEQ ID NO: 190670 - RNA, 64 nt, Human
cauuccaaccaaagcaggguuggggaaucccgaauggccccaauucuugccucauccuaugacc

SEQ ID NO: 190671 - RNA, 64 nt, Human
cggggagggccggaggcccaaggagggcgcgccuuggccccacaccaacccccagggccucccc

SEQ ID NO: 190672 - RNA, 64 nt, Human
agacucagcccggguggggcugcagaaaaaugauuggccccaguccccuuguuugucccuucua

SEQ ID NO: 190673 - RNA, 51 nt, Human
uguuucaaaaugucauguaacuggugacacucagccauucagcucucagag

SEQ ID NO: 190674 - RNA, 64 nt, Human
gugggaggcuggggcucuucuucuuccaucuccuuggugacacccagcccaggggcacccccuu

SEQ ID NO: 190675 - RNA, 64 nt, Human
acgucaugcccuucucaugugggcagcuucugaguggugacacagcaagccuuuguuccugucc

SEQ ID NO: 190676 - RNA, 64 nt, Human
ccaaaaagggacaggaggcaugggauagcaggucuggugacacagcuagggucuuccuagcagc

SEQ ID NO: 190677 - RNA, 64 nt, Human
cugugucccuacacuaccuggcuacccccuuccauggccccagcucugccuacauucugauaua

SEQ ID NO: 190678 - RNA, 64 nt, Human
ugaugcaagagcccagggggcuauuguaaaaacuuggccccagaugcuugucccuucugggcug

SEQ ID NO: 190679 - RNA, 64 nt, Human
gucuuuggcaauggccacccugguguuggcauauuggccccacuguaacuuuugggggcuuccc

SEQ ID NO: 190680 - RNA, 62 nt, Human
cccaccugggccaggucugaggggucccauccuggccccaaagaccccugagaggcccaugg

SEQ ID NO: 190681 - RNA, 64 nt, Human
acaggaucccugugcaagggcugggggcacgcucuggccccaggcuugugccccacccuggcau

SEQ ID NO: 190682 - RNA, 64 nt, Human
guucccaagcaguucaugauacagccucaccuuuuggccccaucucugguuuuugaaaauuugg

SEQ ID NO: 190683 - RNA, 64 nt, Human
ucccucugugcagccacagccagagggcccagaauggccccacucuguucccaagcaguucaug

SEQ ID NO: 190684 - RNA, 58 nt, Human
uucccuugguggagagcuaggcccugcauggccccagcaaugcagucacccagggccu

SEQ ID NO: 190685 - RNA, 64 nt, Human
cgaaaaugguauccucuagcucacacuuuccuaauggccccaucuccugcagaagccaggugag

SEQ ID NO: 190686 - RNA, 64 nt, Human
aagugcugggauuacagaugugagccaccacaccuggccccaagcuugaauuuucauucugcca

SEQ ID NO: 190687 - RNA, 64 nt, Human
cagacuucacacugcaagagccuugguguccaccuggccccaugucucucagaauucuucaggu

SEQ ID NO: 190688 - RNA, 64 nt, Human
gguucuauuucauuuaaaaauguauucauuucccuggccccacagaugcuucccuccauacuuu

SEQ ID NO: 190689 - RNA, 64 nt, Human
agccaccccuuagcacucccccgauuauucugccuggccccauguccucuuggaggauuuuucu

SEQ ID NO: 190690 - RNA, 64 nt, Human
agacugggagccugaucccaagaggcugcugaacuggccccagucacccaccuaugugccagag

SEQ ID NO: 190691 - RNA, 64 nt, Human
gauucagugcauccagguccugccuugugagauguggccccagcuuccuaagcugccaccucug

SEQ ID NO: 190692 - RNA, 64 nt, Human
ucucaacaccuuggcucccccagaucagggccauuggugacaaugcuuguuuccccaggguucc

SEQ ID NO: 190693 - RNA, 64 nt, Human
uaaccuagacaaggauuccgcuuauuccuugguauggugacagugucucuccauggccugagca

SEQ ID NO: 190694 - RNA, 59 nt, Human
ggccgccaggggagcuguaagcagccggguggugacaaggagaaaagccuucuaggguc

SEQ ID NO: 190695 - RNA, 64 nt, Human
uuuuuauauuucagaucauaucuacugaaugauuuggugacagaaauuugcauugcuuuuaccu

SEQ ID NO: 190696 - RNA, 64 nt, Human
guguguguuuguguguguguuuugccaugaacuguggccccaguguauaguguuucaguggggg

SEQ ID NO: 190697 - RNA, 64 nt, Human
uuggcagcaucagcugggcugcuuucuuuguguguggccccaggugucaaaaugacaccagcug

SEQ ID NO: 190698 - RNA, 64 nt, Human
agugccuucugggguguccccccacacccugcuuuggccccagaggcgagggaccaguggaggu

SEQ ID NO: 190699 - RNA, 64 nt, Human
cuggagucucaccuguuugcauggagaaaugggcuggccccacagccucacaggagcaguuugu

SEQ ID NO: 190700 - RNA, 64 nt, Human
augucaugucagcuccgccccuugaacaugaccguggccccaaauuugcuauucccaugcauuu

SEQ ID NO: 190701 - RNA, 64 nt, Human
gauguauauaggugugugagacuacuaagaggcauggccccaacgguacacgacucaguaucca

SEQ ID NO: 190702 - RNA, 64 nt, Human
aucaggauguucagagggagccagcucuuuauguuggccccaggccaguacuaagcaaauuaaa

SEQ ID NO: 190703 - RNA, 64 nt, Human
gaguaacuggaacaugagacaguaucugcaggacuggccccaugguggccgagucagaagucug

SEQ ID NO: 190704 - RNA, 64 nt, Human
acauggaugugccacaugacaggcaauaauauauuggccccauuagcccuuccuggagcaguca

SEQ ID NO: 190705 - RNA, 64 nt, Human
ugcccuuuugugcuaagggcccugguugacugaguggccccagucagaugagaggcaaguccua

SEQ ID NO: 190706 - RNA, 64 nt, Human
accaccugccugauugccaagggugcccagcacguggccccagaccaaucugagugacuuagug

SEQ ID NO: 190707 - RNA, 64 nt, Human
cagaaaaaugggugaaggauaaaccguugagacguggccccacugguaggaugguccucuugua

SEQ ID NO: 190708 - RNA, 64 nt, Human
acuacggcggggcugagacaccggcuggcagggcuggccccagggcacccuguggcccuggcuc

SEQ ID NO: 190709 - RNA, 64 nt, Human
ccugaccgucgaccuuggggcucuccacccgcucuggccccagucgaacugggggcuagccacc

SEQ ID NO: 190710 - RNA, 64 nt, Human
gugagcaccgccagcauuagacgucacauccagguggccccacggccccuacaggcuggcccug

SEQ ID NO: 190711 - RNA, 64 nt, Human
uguacaacuaacaacaguaacuagcccuuaauuauggugacaguuccuuauuggugugugugag

SEQ ID NO: 190712 - RNA, 64 nt, Human
agugccccaacucaacccuuggggcgacuggccauggugacauuguggacuguauccagaggug

SEQ ID NO: 190713 - RNA, 64 nt, Human
uaagcuuggaagugucugugugauuguaaucacauggugacaacacucagaaucuaaauuggac

SEQ ID NO: 190714 - RNA, 64 nt, Human
cugcccuacuuccguuacccugagagucgguguguggccccaucuccaugugccucccgucugg

SEQ ID NO: 190715 - RNA, 64 nt, Human
cggggaauuccaggcccaccaggacacgugccaauggccccauucagauggcaagggaggaggu

SEQ ID NO: 190716 - RNA, 64 nt, Human
aauuccagcuccaccuccacuaccacuccaagccuggccccaccagugcuguuuggccuaggaa

SEQ ID NO: 190717 - RNA, 64 nt, Human
caacuuugggauucuugucagcgggaggcgucacuggccccagagugacuccgacucuccgcug

SEQ ID NO: 190718 - RNA, 64 nt, Human
uucggggaagcugcacaugugccacacagugacuuggccccagacgcauagacugagguauaaa

SEQ ID NO: 190719 - RNA, 64 nt, Human
uucucguuccugaagccacucccuccgugaccacuggccccaggcuuucccacauggaaggugg

SEQ ID NO: 190720 - RNA, 64 nt, Human
aagugcugggauuacaggugugagccaccacgccuggccccaguccaaaauauuuaaagauugu

SEQ ID NO: 190721 - RNA, 64 nt, Human
acagcagagucgagucauugcaacaaagagcauauggccccacagugccuaaaauauugaccag

SEQ ID NO: 190722 - RNA, 64 nt, Human
ugaacagcugugucugccaaacacauuuacccuuuggccccacuuugaagggcaagaaauggcg

SEQ ID NO: 190723 - RNA, 64 nt, Human
agugccagacggcaugacguggugcggggcagcguggccccaccggacuagcacaugaugaaug

SEQ ID NO: 190724 - RNA, 64 nt, Human
cgaagcuccuaccacccagacacccaaacagccguggccccagagguccuggccaaauaugggg

SEQ ID NO: 190725 - RNA, 64 nt, Human
cugcaguuccuggugugggccagcugguguuggguggccccagggagucacacagucuguaccc

SEQ ID NO: 190726 - RNA, 64 nt, Human
ccuuuuuaucaguuugaggaaguggcugucccuguggccccauccaaccacuguacacacccgc

SEQ ID NO: 190727 - RNA, 64 nt, Human
aagacuauggacuggaaggcagaaagugggauccuggccccacucugccuuuccuauugagcaa

SEQ ID NO: 190728 - RNA, 64 nt, Human
agggugcguguacacauacacacacacacacaccuggccccagguggggguuguagugagagcu

SEQ ID NO: 190729 - RNA, 64 nt, Human
auuucccugcaggagcucagccaccacugugccauggugacacaggccaaggcagacauuggcc

SEQ ID NO: 190730 - RNA, 64 nt, Human
agacuggagaggguggggaggggcccagcggccuuggugacaggcccagggugggaggggucgg

SEQ ID NO: 190731 - RNA, 64 nt, Human
cagugagcagagaucacaacauugcacuucagccuggugacaugagcaaaacuguugucucaac

SEQ ID NO: 190732 - RNA, 64 nt, Human
guccgugggggccugaagagacagugagugccauuggccccauucgcagaugugggagacucug

SEQ ID NO: 190733 - RNA, 64 nt, Human
ggagauaaugaauggccuaguacuagauaauauauggccccacaagcucuugacuucuguccuu

SEQ ID NO: 190734 - RNA, 64 nt, Human
acaccaguccagguaguguugagacccaggccuguggccccaccgagcuggagcggagaggaag

SEQ ID NO: 190735 - RNA, 64 nt, Human
agugggacagcccagagccuggcugcccaucauguggccccacccaaucaagggaagaaggagg

SEQ ID NO: 190736 - RNA, 64 nt, Human
gagaagccuccuuaaggagccacaggaugguaccuggccccaaaaggaauccuggagaggagga

SEQ ID NO: 190737 - RNA, 64 nt, Human
gcauugugaguggcuuccaacuagcaacccucucuggccccaugugugaggagccucucauggg

SEQ ID NO: 190738 - RNA, 64 nt, Human
cacccagggaaggugcugaaugggacccuguugauggccccaucuggauguaaauccugagcuc

SEQ ID NO: 190739 - RNA, 64 nt, Human
caccccagccacacagggaggcauccuuggggcuuggccccaggcagggcaaccccggggcgcu

SEQ ID NO: 190740 - RNA, 64 nt, Human
acccgcugcgugugugugcgcgcgcguguacguguggccccacauccgccgccuuccacgcuag

SEQ ID NO: 190741 - RNA, 64 nt, Human
aagacacuggccuccugcuccagcuucccuguccuggccccaccuguccuguugcugccagcag

SEQ ID NO: 190742 - RNA, 64 nt, Human
ccuccacccuggccugagggccccacucccuugcuggccccagcccugcuggggauccccgccu

SEQ ID NO: 190743 - RNA, 64 nt, Human
ugccccugccaaguucccccagucccucagcaccuggccccaggacugagguccugagaagggg

SEQ ID NO: 190744 - RNA, 64 nt, Human
ggcuucugagggauuccuuucuccccucuuuguguggccccagccagggcggugggcaguccug

SEQ ID NO: 190745 - RNA, 64 nt, Human
gauaccccagccuggagucagggccagggaggcauggccccacuuguauccagaaguucccagg

SEQ ID NO: 190746 - RNA, 64 nt, Human
gggccaccucuggaggguguccugcuguuccuguuggccccagcugcacucgcagggccuuccu

SEQ ID NO: 190747 - RNA, 64 nt, Human
aagacaacugccagauacuggcaauacuccagccuggugacagagugagacucugucucaaaaa

SEQ ID NO: 190748 - RNA, 64 nt, Human
gagggugggaccacugcaagcucgagaccuugcuuggugacaugugccacuuuggccaccaccc

SEQ ID NO: 190749 - RNA, 64 nt, Human
aagaucgaugaguucugagugucgggcugcccacuggugacaccgggaucgggcugagcaggag

SEQ ID NO: 190750 - RNA, 64 nt, Human
gggugagagggggaccaugaguggccccugucccuggccccacagacucugagaagcgaagacc

SEQ ID NO: 190751 - RNA, 64 nt, Human
auuugaguuggcuuuauucuugggcuucacaguguggccccacagcaccaguuauugauaaaaa

SEQ ID NO: 190752 - RNA, 64 nt, Human
caaaagacuugaagaaccaugguaugaaggugauuggccccacugacguuggccuaacacuggg

SEQ ID NO: 190753 - RNA, 64 nt, Human
gcaccuucugacgcagccugagaaugaccugcccuggccccagcccuacucuguguaauagaau

SEQ ID NO: 190754 - RNA, 64 nt, Human
cugugcccccaucuccuccccaccccaggucuaguggccccacccuccauuccggaccccaugg

SEQ ID NO: 190755 - RNA, 64 nt, Human
uggggaggagucugggugguccagcccugaugauuggccccaccuccugcugccccauaacccu

SEQ ID NO: 190756 - RNA, 64 nt, Human
agggaagucugguuguagagccugaauaggcuccuggccccaugaccccuucuccuguccccag

SEQ ID NO: 190757 - RNA, 64 nt, Human
guuccaggggcccugauuuccucggaugugcuauuggccccaggacugaagcugccucccuuca

SEQ ID NO: 190758 - RNA, 64 nt, Human
acaugccuggcaucugucuccccuuguuccugaguggccccacauggggcucugagcaggcugu

SEQ ID NO: 190759 - RNA, 64 nt, Human
aaacacauguaucacauucauauauauuguuucuuggccccacugccaaaggaagucagucagu

SEQ ID NO: 190760 - RNA, 64 nt, Human
auggcagucuggaauaaagcccccuaguugccuuuggccccaccuuugcaaaguuccagagggc

SEQ ID NO: 190761 - RNA, 64 nt, Human
cacauagcccagugauuaaaccccgguuucacucuggccccaggaguggagccuggccacuccu

SEQ ID NO: 190762 - RNA, 64 nt, Human
aucuuuauaauaaucuggucacagugguagucgcuggccccaggacccccuccugauuuuggcu

SEQ ID NO: 190763 - RNA, 64 nt, Human
ccccugggcucccccugccaucgugugcuucacguggccccaugcaugcccgccucucugcaug

SEQ ID NO: 190764 - RNA, 64 nt, Human
acacacagucuauauauuuauauacacuguuuccuggccccagagcucauuuggguucaggcgc

SEQ ID NO: 190765 - RNA, 64 nt, Human
cuggagccuaagcugccugcuacugggcuuuacauggugacagacauuuccgugggauagggaa

SEQ ID NO: 190766 - RNA, 64 nt, Human
aagaaggugagugcuugucauggaaaauguccuguggugacaggcccaguggaacagucacccu

SEQ ID NO: 190767 - RNA, 64 nt, Human
aauucaaagccaagucguggggugcagauuguuauggugacaggcacacacauuuuucuacccu

SEQ ID NO: 190768 - RNA, 64 nt, Human
auacuguaagugagcaaucagaguauaauguuuauggugacaaaauuaaaggcuuucuuauaug

SEQ ID NO: 190769 - RNA, 64 nt, Human
cccaccuuuccuggugcuccaagcuaggaggcuguggccccagccugaggaggguguccuggcc

SEQ ID NO: 190770 - RNA, 64 nt, Human
gagaguauaaggggauagcagcaaaccaccuaucuggccccaacacaccugagagaauucagca

SEQ ID NO: 190771 - RNA, 64 nt, Human
ggccccacucccaccauccugugagccccacuccuggccccacucacaccauccuaugagccca

SEQ ID NO: 190772 - RNA, 64 nt, Human
cggccccacucacucuauccugugagaccacgccuggccccacucccaccauccugugagcccc

SEQ ID NO: 190773 - RNA, 64 nt, Human
ccagccuccuccagggcccaggugggcgggcuucuggccccaccccacagcgcuuggagcaucc

SEQ ID NO: 190774 - RNA, 64 nt, Human
uaaaugaagccagugacucccaguucucaacacauggccccagucaagacagaacaccauggaa

SEQ ID NO: 190775 - RNA, 64 nt, Human
acccgcccuccccacggggccucgggaccucagguggccccaguucaaucucccgcugcugcug

SEQ ID NO: 190776 - RNA, 64 nt, Human
gaugacagagugaggagggcccagagcagaauucuggccccagaacucugugcccaggagccau

SEQ ID NO: 190777 - RNA, 64 nt, Human
ugacugugcuggcuggcucuggcuggcccuccacuggccccagggcuggagcugcccugcccuc

SEQ ID NO: 190778 - RNA, 64 nt, Human
ccugagcaccguguuaccucccuggcccucuggcuggccccaggagccuuugguucaguaaacg

SEQ ID NO: 190779 - RNA, 64 nt, Human
cagaccccgaggcgcaccugcuggcucuuguguguggccccaguuucuagcggcuuuugcagca

SEQ ID NO: 190780 - RNA, 64 nt, Human
agcuacucuucucccucuucccucuuucuccccauggccccacugcagaauuaaagaaggaaga

SEQ ID NO: 190781 - RNA, 64 nt, Human
agucacauaacauccugccuccgagagcgcggucuggccccacccugguccaucacuuacgacg

SEQ ID NO: 190782 - RNA, 64 nt, Human
caagguugcacagcgagucaguagaagcccuggcuggccccacuugguaccaauccaccaggca

SEQ ID NO: 190783 - RNA, 64 nt, Human
gggaggcccugccugacccaucccuuuuccuuucuggccccagccuagguggaggcaaguggaa

SEQ ID NO: 190784 - RNA, 64 nt, Human
aguagggcagccccuucccugcaggagugaggcauggugacagcaguccccuaugugcccccaa

SEQ ID NO: 190785 - RNA, 64 nt, Human
ggcccggucccuuccagggcaacucccagggauguggugacaugcaggguucaaguguucuugg

SEQ ID NO: 190786 - RNA, 64 nt, Human
cccuauuuuuuaaguaccuuggaggaggagagguuggugacaugcaugguggggaucuauggcc

SEQ ID NO: 190787 - RNA, 64 nt, Human
gugccaguugggcucgcacugcccacaugggaccuggccccaggcugucacccuccaccgagcc

SEQ ID NO: 190788 - RNA, 64 nt, Human
uggcuccgccccuagugcccccuccucaccacacuggccccaggucucaggagggguguccugg

SEQ ID NO: 190789 - RNA, 64 nt, Human
cuugauaaagucucgguuccauggaggacuugaguggccccaaaggcugccacggugcccucac

SEQ ID NO: 190790 - RNA, 64 nt, Human
ggguccccgaggccugugggcaggccgaucaguguggccccagaucaagucaugggaggaagcu

SEQ ID NO: 190791 - RNA, 64 nt, Human
ccagcuugcucagauauucuccuccuccccucacuggccccacaccccuggcucucccagucac

SEQ ID NO: 190792 - RNA, 64 nt, Human
acgucugugacaaaugguugaaaaggagucaacauggccccaacuauagugccggaaccuuuuc

SEQ ID NO: 190793 - RNA, 64 nt, Human
cuucccucagugccuggagcugguacugggccccuggccccaugagcaguuugccuucuugagu

SEQ ID NO: 190794 - RNA, 64 nt, Human
ccuucauuucuuugucuuaaaaaguagcagcaacuggccccacaacuccugucauuguaaguua

SEQ ID NO: 190795 - RNA, 64 nt, Human
cucuggggacuuguagucugucaccugcuggauuuggccccaaguucaaggcccuauuugcacc

SEQ ID NO: 190796 - RNA, 64 nt, Human
caucuucuuuguauccauugggaggcucugagacuggccccacuugguccuaagaaucccaagg

SEQ ID NO: 190797 - RNA, 64 nt, Human
ggacagcuaggauugguucacccuugcucugaguuggccccaaagcgagcuaugcugaacucuu

SEQ ID NO: 190798 - RNA, 64 nt, Human
gucuguggaggccccgcccaccuccucuugucaauggccccaucugccaggaagguugaggacu

SEQ ID NO: 190799 - RNA, 64 nt, Human
gcucccugccggacucuuccacguggccuuugccuggccccacgugcucucaggaaccuggucc

SEQ ID NO: 190800 - RNA, 64 nt, Human
uguaugugagaguugugaaauuuuagugucucacuggccccauaaauuccacgcuucaggaagu

SEQ ID NO: 190801 - RNA, 64 nt, Human
gacccaggacaaggaacagcaagcucaggugggauggccccagugcuggaaagaagcaagagcc

SEQ ID NO: 190802 - RNA, 50 nt, Human
aauaccaaacccgcuacugauggugacagcuguacaucaacucugccccu

SEQ ID NO: 190803 - RNA, 64 nt, Human
cuccaggccugacuacccaucaggguggaggagcuggugacacucaucucccugagugcucccu

SEQ ID NO: 190804 - RNA, 64 nt, Human
cccccuaaauugaaguuuagcaauaugacauucuuggugacaguggaaucuuugucucuucacc

SEQ ID NO: 190805 - RNA, 64 nt, Human
cuggaagaggcagaugggggucaaaccacugccuuggccccaggaaggggccauagguaggucu

SEQ ID NO: 190806 - RNA, 64 nt, Human
ucuucccuucccagagggucuuacuguuccaggguggccccagggcaggcaggggccacacuau

SEQ ID NO: 190807 - RNA, 56 nt, Human
cagaccacaugcuggccuaggcggccuggccccaguacggcccccucuuugcaggc

SEQ ID NO: 190808 - RNA, 64 nt, Human
ccacaccgcucaagcuugggaagccuggugccgauggccccacccucaccagccugggcagcag

SEQ ID NO: 190809 - RNA, 64 nt, Human
ccucggauucugaucugauccuuagggggugcccuggccccacggacccgacucagcuugagac

SEQ ID NO: 190810 - RNA, 64 nt, Human
ccaaaagaagggcaugggcacccccaggagaggauggccccaaaaaccuuauuuuuauacauga

SEQ ID NO: 190811 - RNA, 64 nt, Human
gacuucagugagcuccaacccuggggcccugagauggccccagcuccucuuguccucagcccac

SEQ ID NO: 190812 - RNA, 64 nt, Human
ucagagccccuagcucuucucuagccuggggccuuggccccauuaggagaaggagaaaugacug

SEQ ID NO: 190813 - RNA, 64 nt, Human
cggcccuggccuuaacucauaucuuaggcauuccuggccccagggcccuaauaaaccugcuuuu

SEQ ID NO: 190814 - RNA, 64 nt, Human
aacacucugaggacaguguggcuggccgagcgguuggccccaugggugguggggugugagaagc

SEQ ID NO: 190815 - RNA, 64 nt, Human
acuccccacagaggcagaagagggucuccaccuauggccccaggccuuugcgaucuugcuucac

SEQ ID NO: 190816 - RNA, 64 nt, Human
uuuuacucuguugugaggggaagagacugcauuguggccccagacuuuuaaaacagcacuaaau

SEQ ID NO: 190817 - RNA, 64 nt, Human
ccucacccuuauccaggacccacacagaagccuguggccccacuuaccucggggagucaugugc

SEQ ID NO: 190818 - RNA, 64 nt, Human
uccuucccuccacuccacccucuucugggauggcuggccccacaagccacucaguuccaaggga

SEQ ID NO: 190819 - RNA, 64 nt, Human
uguuccccucucggggcugggcuggggccgcucuuggccccaagguugccccgggccagcagcc

SEQ ID NO: 190820 - RNA, 64 nt, Human
cauagaacugacuccuggaagccuggagagaagguggugacacccauggguucucaacuguaag

SEQ ID NO: 190821 - RNA, 64 nt, Human
acuaaaaaauuauuuuaaaaggcuggaggcaagguggugacaggcagcaggguggcgacaugga

SEQ ID NO: 190822 - RNA, 64 nt, Human
acacgcucugaaaacugagauuuugucauugaacuggugacaggaugugagacgguuauuagaa

SEQ ID NO: 190823 - RNA, 64 nt, Human
ggagauccucucuaaggccucuggggucuuugccuggccccaucccuagggggcggggagggga

SEQ ID NO: 190824 - RNA, 64 nt, Human
cccuugggcucacacucucacugagccuugcugguggccccaagacacgcaaugucaggccaug

SEQ ID NO: 190825 - RNA, 64 nt, Human
guagggucgggggcuuagaggcugggauggcuccuggccccaccgccagggggcagcgcaggcc

SEQ ID NO: 190826 - RNA, 64 nt, Human
ggugggaacugcacacaaguccacuggccuggcuuggccccaggcauugcaauugacagacauu

SEQ ID NO: 190827 - RNA, 64 nt, Human
ugggaacguuucuucuggagaauuggaacauguguggccccaagcucaacagaaaccaguuguu

SEQ ID NO: 190828 - RNA, 64 nt, Human
acaagcugaccaggccucacaggugcucugcucguggccccaaagaaccaucucuacuugccag

SEQ ID NO: 190829 - RNA, 64 nt, Human
aggcggggcuccccaggcccagggcucaacuucauggccccagcuauauccccccaguuccaca

SEQ ID NO: 190830 - RNA, 64 nt, Human
uggccuccuaaggggcugugcacccccagcgggcuggccccagcaccuucugcccuucccagca

SEQ ID NO: 190831 - RNA, 64 nt, Human
gcaugugcuugagacugagccaacccccaguguguggccccacccauguuauuuuuguuuuugu

SEQ ID NO: 190832 - RNA, 64 nt, Human
cacgacaguccuuguucccccaggaagggccugguggccccagcacacacuugggauuaugugu

SEQ ID NO: 190833 - RNA, 64 nt, Human
acuugcaaaaggagaaagauaaaauacagaagacuggccccagagagaccucagaucaguauug

SEQ ID NO: 190834 - RNA, 64 nt, Human
cugguuuuaauaacaguaaaugugcccagccucuuggccccagaacuguacaguauuguggcug

SEQ ID NO: 190835 - RNA, 64 nt, Human
agcccugauggaccgaaggcucuggugucugguuuggccccacagcagugugggccgauccugu

SEQ ID NO: 190836 - RNA, 64 nt, Human
uuugguugcguugccuuuuuuuuuuuagugggguuggccccaugaagugggugccccacucacu

SEQ ID NO: 190837 - RNA, 64 nt, Human
uccagaugccagaaaaccucugucagacgcccacuggccccagaucucauccugccucauccug

SEQ ID NO: 190838 - RNA, 64 nt, Human
uauauguguguauacaaacaguucgaauguauuuuggugacaguaauaaaucaaugugaggaug

SEQ ID NO: 190839 - RNA, 64 nt, Human
aaaacugagcacucuucugugcacuagccauagcuggugacaaacagaugguugcucagggaca

SEQ ID NO: 190840 - RNA, 64 nt, Human
aaggaaugagagggaaaguuuggaccugucacuuuggugacagggaaaguccaggucacuuuau

SEQ ID NO: 190841 - RNA, 64 nt, Human
gcacugucccaggauccuggagagggagaacuccuggccccaggggaaagaggggggggucucc

SEQ ID NO: 190842 - RNA, 64 nt, Human
ccugccugcaacacucauggagagggacacuuccuggccccaccugcuaaauaccuccaaacuc

SEQ ID NO: 190843 - RNA, 64 nt, Human
ggucaaagacacucccaguugcagggaggguagauggccccacccagaccgagagacacaguga

SEQ ID NO: 190844 - RNA, 64 nt, Human
ugccacacuccugaaugccuuaacauuucuuccauggccccacaccauggcauccgggggucuu

SEQ ID NO: 190845 - RNA, 64 nt, Human
gcugagggcaccccauccucagugcccaaugcuguggccccaccaggcccagagccugguuggc

SEQ ID NO: 190846 - RNA, 64 nt, Human
aagugcugggaucacaggcgugagcuaucacaccuggccccagaaguguuucaacauggaaauu

SEQ ID NO: 190847 - RNA, 64 nt, Human
cucuuccgccaccaggggcaagcacagguccugguggccccacgccacauguuagccccccugg

SEQ ID NO: 190848 - RNA, 64 nt, Human
cgucucaaaaaaauaaauaaauaaacuugugagcuggccccaaccccuccuaggaaucacagcu

SEQ ID NO: 190849 - RNA, 58 nt, Human
uggaccugaccaagcuguaggccuccacuggccccaucacugccaacugcagggggcc

SEQ ID NO: 190850 - RNA, 64 nt, Human
gcgcagggccccgcaccggugaggaaggugcuuuuggccccauugcgaggggccuuggccagga

SEQ ID NO: 190851 - RNA, 64 nt, Human
ccuguaaaaugggucucagaugcuccgcccugcuuggccccagcuugucugucucuggguccug

SEQ ID NO: 190852 - RNA, 64 nt, Human
aaaauagagagagagguauuuaacugcaauaaacuggccccauguggcccccgccuugucugcu

SEQ ID NO: 190853 - RNA, 64 nt, Human
cccuagccaggcgccccccccucuaaggguccucuggccccacggacagcaggacccggacacc

SEQ ID NO: 190854 - RNA, 64 nt, Human
gggccccagcagcacuguggccugcaggagggcauggccccagguagggggacuguucuagcca

SEQ ID NO: 190855 - RNA, 64 nt, Human
cucugcuccagacucacuugccauugccaggagauggccccaacaagcaccccgcuuuugcagc

SEQ ID NO: 190856 - RNA, 64 nt, Human
auuaaacuuuucuagagaagacaaaagcuuacacuggugacauggauaagugagauggugucua

SEQ ID NO: 190857 - RNA, 64 nt, Human
guuucauagcuuuuccucccccauuuauguguauuggugacaguggguauaaaacagccugaaa

SEQ ID NO: 190858 - RNA, 64 nt, Human
gugguaaugauaauugaggcaaauguauuuauuuuggugacauuuugcauauaugaagauuuuc

SEQ ID NO: 190859 - RNA, 64 nt, Human
aggcagggcagggucugugaagcuuaagagcagauggugacaaguucucugggcagguggccau

SEQ ID NO: 190860 - RNA, 64 nt, Human
caccucugaggucuguggaagucaccugauauucuggccccaggggugggagggaggggagcuu

SEQ ID NO: 190861 - RNA, 64 nt, Human
aagucugaagggccuugggagaccagguagcaccuggccccaucaugaugcagggguuuugggg

SEQ ID NO: 190862 - RNA, 64 nt, Human
cggggucaugccacccagagacugucgcugucuauggccccaacucaugcucccucucuuggcu

SEQ ID NO: 190863 - RNA, 64 nt, Human
ucagguggcagagaggcccagccucacaggccuguggccccacacaccagucccagcaagguga

SEQ ID NO: 190864 - RNA, 64 nt, Human
caccccagcgccugugcugaggacucccuccauguggccccaggugccaccaauaaaaauccua

SEQ ID NO: 190865 - RNA, 64 nt, Human
ugacugagucucccagcccagacccagggacccuuggccccaagcucagcucuaagaaccgccc

SEQ ID NO: 190866 - RNA, 64 nt, Human
aucugagccuccaccacauagacugaaacuccccuggccccagcccucuccugccuggccuggc

SEQ ID NO: 190867 - RNA, 64 nt, Human
cagcagccggugucuccugcgcccgccucccccauggccccaugcagccccaggggcuuccccc

SEQ ID NO: 190868 - RNA, 64 nt, Human
ccugugcccaagcaguccucacuuugcuuaacaguggccccagagagcaggaguagugaugcug

SEQ ID NO: 190869 - RNA, 64 nt, Human
aucggguucuggcagggagaaccugcccugccacuggccccauugcugggacugcccagggagg

SEQ ID NO: 190870 - RNA, 64 nt, Human
uguggcuacauagugcauauaacuaccccaguguuggccccaggaccugaucugaguucugcug

SEQ ID NO: 190871 - RNA, 64 nt, Human
ccacuccccugguggccugacucccacucccugguggccccaucccccaguuccucacgauaug

SEQ ID NO: 190872 - RNA, 64 nt, Human
ggggcugcgguaggcgggccuagcccggccuccauggccccaacggaggcgcccucggaggugg

SEQ ID NO: 190873 - RNA, 64 nt, Human
ugacaggcacugcugccaugcugccuccccaggcuggccccagaggagcgagcaccagcacccg

SEQ ID NO: 190874 - RNA, 64 nt, Human
gcuccuggcccugccccuaggucugggugggcaguggccccauagccucuggaacugugcguuc

SEQ ID NO: 190875 - RNA, 64 nt, Human
aguuuauagaaaaauaagagcuaguggcuuauaauggugacagguucucauguggcaccccuag

SEQ ID NO: 190876 - RNA, 64 nt, Human
cuugucccucuucuuaguggaaaugcauuugagauggugacagggcuggaugaacgugugaccc

SEQ ID NO: 190877 - RNA, 64 nt, Human
cauggaaauaaccauuguuuacagagcugagcauuggugacagggucugacauggucagucuac

SEQ ID NO: 190878 - RNA, 64 nt, Human
gugggacgagccacccgcuuucagcccugugcucuggccccagaacggccacucgagaccccgg

SEQ ID NO: 190879 - RNA, 64 nt, Human
guggugggcgccucugaaaccauacagccacuccuggccccaaacacugguuugcaucccaggu

SEQ ID NO: 190880 - RNA, 64 nt, Human
agccaggagcccugaccccacccgguggggcccuuggccccagaggaccgagagaguggagagu

SEQ ID NO: 190881 - RNA, 64 nt, Human
uugcugagccgcugccacuucacccugugggaaguggccccagccaucuccucuagaccaaggc

SEQ ID NO: 190882 - RNA, 64 nt, Human
gugcaggguguguguccacgagcgacgaucgugguggccccagcggccugggcguuggcugagc

SEQ ID NO: 190883 - RNA, 64 nt, Human
uggacaaacccuccucugcuggaacccuggacuuuggccccagucccuuuaagagcugaaaggg

SEQ ID NO: 190884 - RNA, 64 nt, Human
gauggggaaccugccacagccagaacugaggggcuggccccaggcagcucccaggggguagaac

SEQ ID NO: 190885 - RNA, 64 nt, Human
uguaugggcucugugggcucugucccuggcugaauggccccagacugguugcagcugggcuuga

SEQ ID NO: 190886 - RNA, 64 nt, Human
ccaaaacgggagugugcagucagggccugcggucuggccccaugagucuccuuccguccucagc

SEQ ID NO: 190887 - RNA, 64 nt, Human
cauuauuuuauuuuugguuuguauuauuuuuauuuggccccauuauuuuaaauaggaaaaacag

SEQ ID NO: 190888 - RNA, 64 nt, Human
aagugcugggauuacaaaugugagccaccacaucuggccccauuauuuuauuuuugguuuguau

SEQ ID NO: 190889 - RNA, 64 nt, Human
uguugggaacaggcccccaaaucuggccauaaacuggccccaaaacuggccauaaacaaaauau

SEQ ID NO: 190890 - RNA, 64 nt, Human
uuuguauucuggggggaggagcccucucuuccuguggccccaccuuggcccccacccccuccac

SEQ ID NO: 190891 - RNA, 64 nt, Human
ccuguuuccccagcaauuaaaacggacucaucucuggccccauggccuugaucucagcacacgg

SEQ ID NO: 190892 - RNA, 64 nt, Human
uuugauucugaugacucguuuuucuucuacucuguggccccaauuuuuauaaaguguuuuugag

SEQ ID NO: 190893 - RNA, 64 nt, Human
auuuauauauguaaacuuuuuuuguaagaaaaguuggugacaacuaaaccaacuuuuuccaaag

SEQ ID NO: 190894 - RNA, 64 nt, Human
agauuauaggaacugagguuuacauacguuuguguggugacauuuuagaaugucaauaaauuug

SEQ ID NO: 190895 - RNA, 64 nt, Human
ugcucugcccuuuuauauuccuuuaugcugcaaguggugacauguucagauuucuaauuugguu

SEQ ID NO: 190896 - RNA, 64 nt, Human
gucccgacaacuuguucccugacccccucagggauggccccaaacugucccugccucuggcacc

SEQ ID NO: 190897 - RNA, 64 nt, Human
uuccuccccaagaauagcuggcaucucuucucccuggccccagccauccugaccccucucauua

SEQ ID NO: 190898 - RNA, 53 nt, Human
guuucagaccacccugcugaggcuggccccaucucagaagaugagcaggagcu

SEQ ID NO: 190899 - RNA, 64 nt, Human
ccaaagagcaauaaaugccacuuggagcuguaucuggccccaaaguuuagggauugaaaacaug

SEQ ID NO: 190900 - RNA, 64 nt, Human
cuaguaagaggugggacaguaaugguccuccugcuggccccagcaaggcccaugagugacugcc

SEQ ID NO: 190901 - RNA, 64 nt, Human
gaccaggacugaaauccagagagggucaggaauuuggccccaugaugaagccaaaucugaaccc

SEQ ID NO: 190902 - RNA, 64 nt, Human
cugaagcccccuucccugccugccugcugacccguggccccagcucacucauugcccucagcag

SEQ ID NO: 190903 - RNA, 64 nt, Human
caugggacaggucaaagcauuagggccaccuccauggccccagacagacuaaagcugcccuccu

SEQ ID NO: 190904 - RNA, 64 nt, Human
cacaggggcaaugcaccuuugcagggguaccuucuggccccaacccuugacucaacggggacaa

SEQ ID NO: 190905 - RNA, 64 nt, Human
gguaauuuuuauuuugaauguucagggccuuaguuggccccaguaauucuccuuggaggacuug

SEQ ID NO: 190906 - RNA, 64 nt, Human
cuuagagcucaaaauacuagcugcuguuucaagcuggccccagacauuaaacucagacuagggc

SEQ ID NO: 190907 - RNA, 64 nt, Human
agaccugaaggccagagccacguggcacaauugcuggccccaggaaugggcaagguggagaugg

SEQ ID NO: 190908 - RNA, 64 nt, Human
gcagcccugaggugucuggcuguggcucaagauuuggccccaugcagacccucccaaaggauac

SEQ ID NO: 190909 - RNA, 64 nt, Human
ugaacugaccucugaacagcaucugucaaauaccuggccccauuuguguugaguuuccucuuag

SEQ ID NO: 190910 - RNA, 64 nt, Human
uuaggcauuauccccauuuuauagauggagaaacuggccccaaaaggugggaacuuguccaaga

SEQ ID NO: 190911 - RNA, 64 nt, Human
caccagcccugcccuggcucaacgugucagcagauggugacaacgugcaucugguucugaaugu

SEQ ID NO: 190912 - RNA, 64 nt, Human
ugccagcuccucggacaccaagcagaauucugcauggugacagucucccccaaacauggccugc

SEQ ID NO: 190913 - RNA, 64 nt, Human
aaaacagugacuaaacagagagaaacuagguccuuggugacaucuuuugagccacuagaccaag

SEQ ID NO: 190914 - RNA, 64 nt, Human
uggggccagugaguugccucuuucccuccuugucuggccccaguggucuggggagcccccaggc

SEQ ID NO: 190915 - RNA, 64 nt, Human
ucuuaauguuuuuaaggaugguugugaaucccccuggccccauaauaaauuguaauuuuauacu

SEQ ID NO: 190916 - RNA, 64 nt, Human
agcaagccuguuagggccuucacugcuacgccccuggccccaaaacagagagcaagacaguugu

SEQ ID NO: 190917 - RNA, 64 nt, Human
ugugaccccaccugcucuuuccucccucccaguauggccccaccugcucuuuccucccccgagg

SEQ ID NO: 190918 - RNA, 64 nt, Human
ggccccaccugcucuuuccuccccccccaagguguggccccaccuguucuuuccuccccugccg

SEQ ID NO: 190919 - RNA, 64 nt, Human
guggccccgccugcucuuuccucccccaccaguauggccccaccugcucuuuccucccccccca

SEQ ID NO: 190920 - RNA, 64 nt, Human
ccuggggcuggguggguagggggcugcuugaguguggccccaccuccugggaccugagcccaag

SEQ ID NO: 190921 - RNA, 64 nt, Human
gcaccucaaaggcagcagccucaaggagcagccauggccccagacuugucgcacggaugcagaa

SEQ ID NO: 190922 - RNA, 64 nt, Human
aguccuaucauccucugcucagcagugaccucccuggccccacuuugcccagaguuuggggucc

SEQ ID NO: 190923 - RNA, 64 nt, Human
cgggucacgccaggggccggcacgcacuggcaccuggccccaggagcggggccgugugaacggu

SEQ ID NO: 190924 - RNA, 64 nt, Human
ccugucaagagacgcagagggccccugccaggguuggccccagggacccugggacgaggcugca

SEQ ID NO: 190925 - RNA, 64 nt, Human
ccccaccgugggcagggagcggccggccagccccuggccccaggaccuggcugccauacuuucc

SEQ ID NO: 190926 - RNA, 64 nt, Human
cagacuuccaagaguuacuguccacccggugguguggccccauagcgaagucuaaaugccugua

SEQ ID NO: 190927 - RNA, 64 nt, Human
cagacgugccuccgcaccucagcaguuugggguguggccccagggcgguucuuggauguaaaag

SEQ ID NO: 190928 - RNA, 64 nt, Human
caggacggcgacacuaaugcagggagagggagucuggccccagcuuuuccuaucagaggcgauu

SEQ ID NO: 190929 - RNA, 64 nt, Human
aguaaaggccuccucccccaccccuuaggccccguggugacauuucccaagucagacagauguc

SEQ ID NO: 190930 - RNA, 64 nt, Human
cuguuauguuugaccagaauuauaugacaagaacuggugacaguuuagugccucugcccauugu

SEQ ID NO: 190931 - RNA, 64 nt, Human
agugugccaagaucauaccacugcacuccagcccuggugacagaggagaccccgucucaaaaau

SEQ ID NO: 190932 - RNA, 64 nt, Human
gaaguggccucuuggauaccagcucaggggacacuggccccacaggaguugugagcccucuagg

SEQ ID NO: 190933 - RNA, 64 nt, Human
acgggcauccuacccacugccuccccauccccgcuggccccagacccgccaaggaucauccugc

SEQ ID NO: 190934 - RNA, 64 nt, Human
cuuucugcuauauuaggccuguguguaagcugacuggccccagggacucuuguuaacaguaacu

SEQ ID NO: 190935 - RNA, 64 nt, Human
gcauuugggauaccaagauaaauugcaugcggcauggccccagccaugaaggaacuuaaccgcu

SEQ ID NO: 190936 - RNA, 64 nt, Human
gccugauuccugccuuacccaggaggagggugccuggccccaguacccaggguggcacgacugg

SEQ ID NO: 190937 - RNA, 64 nt, Human
aagaaugucccccaccccuuggccucugccuccuuggccccacauuucugcaaacauaaauauu

SEQ ID NO: 190938 - RNA, 64 nt, Human
gcccaaccugccccuucacuuugccuuccugaguuggccccacuccacuugggggucugcauug

SEQ ID NO: 190939 - RNA, 64 nt, Human
aauugugggaccaaaaugugcccugccucaacucuggccccaggcccuguucuguuauccaauc

SEQ ID NO: 190940 - RNA, 64 nt, Human
gcccacuggagaggcggggcgggguggggcaggauggccccacuggggcuccuacagagcugug

SEQ ID NO: 190941 - RNA, 64 nt, Human
gcugucauaugggguuuauugggaacuauccuccuggccccacccugccccuucuuuuugguuu

SEQ ID NO: 190942 - RNA, 64 nt, Human
cuggggcggggcuuggccagugccuucagggagguggccccagaugcccacugugcgcaucucc

SEQ ID NO: 190943 - RNA, 64 nt, Human
gcucaggacagagggagcuagcagcuggccuccauggccccacagccuccuucgaggcugugcu

SEQ ID NO: 190944 - RNA, 64 nt, Human
cuaagcuccacagugccaguuccuugccccaaccuggccccauccaaguacagaagaccuuccu

SEQ ID NO: 190945 - RNA, 64 nt, Human
gaguggcaaagcuggcccugacgccuggguuucuuggccccagcugcccagcaggugccucgau

SEQ ID NO: 190946 - RNA, 64 nt, Human
gagauaccaagggcauggguggucccugcuucgauggccccaaagcugggccagaguuaaggga

SEQ ID NO: 190947 - RNA, 64 nt, Human
ccugugguagugguagcaguuuucucaaauaauguggugacagucacuagauccucacaugcug

SEQ ID NO: 190948 - RNA, 64 nt, Human
uucgggaagaaggggacaauggcagaacagguguuggugacaauugucaccaauuggauaaagc

SEQ ID NO: 190949 - RNA, 64 nt, Human
guagggcagaaacuugaaagaaggcaggagaucauggugacaguggaugggaaaaagugagggu

SEQ ID NO: 190950 - RNA, 64 nt, Human
gauggagagcagcuccaaggcugagcuggggcucuggccccaggugagguccccagcuccugag

SEQ ID NO: 190951 - RNA, 64 nt, Human
uucugagccacgggucagggugccacccugcugcuggccccacugugucacagagcugccuggc

SEQ ID NO: 190952 - RNA, 64 nt, Human
gcucaagugaggccccggcggcucagggcggggcuggccccacccccaugaccacugcccugga

SEQ ID NO: 190953 - RNA, 64 nt, Human
ggccuuggcccaggggucagcagagcuucagagguggccccaccugagcccccacccgggagca

SEQ ID NO: 190954 - RNA, 64 nt, Human
ugccccaccccagcucauccaugugcuuguacccuggccccacggggaggcuugcccuucccug

SEQ ID NO: 190955 - RNA, 64 nt, Human
gucaccuccucagugcaguuagccugagcuccccuggccccaggugccuccaucagagcauuua

SEQ ID NO: 190956 - RNA, 64 nt, Human
agcuggucccgggcugcuaaaaggccuugugagguggccccacccuccaggggagcuggugaag

SEQ ID NO: 190957 - RNA, 64 nt, Human
aagcccagaacucugaucuucacagcccuagguauggccccagcaccccacugcccucucuccu

SEQ ID NO: 190958 - RNA, 64 nt, Human
gagcucacaggugacaggcucaggguucucauccuggccccaccagggccuugggcaaguccug

SEQ ID NO: 190959 - RNA, 64 nt, Human
cuacuaagacacugcucugcccagagcugaagucuggccccaccaugaguccuguguccaggcc

SEQ ID NO: 190960 - RNA, 64 nt, Human
uggcucugagucgcucucccacccagccuggacuuggccccaugggacccauccucagugcucc

SEQ ID NO: 190961 - RNA, 64 nt, Human
gcucugacuucuaggagcacaagagaggagccuguggccccaugcagaugaaaaggacgggcag

SEQ ID NO: 190962 - RNA, 64 nt, Human
ucggccguccuugucauuaguggucauaugaaaauggccccaagaaggagaugauucuuucaag

SEQ ID NO: 190963 - RNA, 64 nt, Human
uucgucuagugaaacuccuuucaucucuguccuauggccccaccccaccauucccucuaggccc

SEQ ID NO: 190964 - RNA, 64 nt, Human
aaugguacacugaauucucuggguggcuuucuuguggccccaugggaugcagcgugggggcugu

SEQ ID NO: 190965 - RNA, 64 nt, Human
aaugaguauugagaagccacagaaauaucaaaaauggugacaucacuauuaggaugaaaauuuu

SEQ ID NO: 190966 - RNA, 64 nt, Human
cagugagccaagaucgugccacugcacuccagccuggugacagagugagacucuguuucaaaaa

SEQ ID NO: 190967 - RNA, 64 nt, Human
uagaaaguguuuuuauagggcuucaauacccagguggugacagagcagaagaaccgguuuuuuu

SEQ ID NO: 190968 - RNA, 64 nt, Human
caucucgcacucagcccugggugccugugaagccuggccccacugccugccggggguuccugca

SEQ ID NO: 190969 - RNA, 64 nt, Human
caaggcuuuguaaaccggcuggaccacgucucccuggccccagugaccgggggaagcugagccc

SEQ ID NO: 190970 - RNA, 64 nt, Human
ccggcucggccucuugagagccccaccccugaacuggccccagcuccucuuccugccucucuca

SEQ ID NO: 190971 - RNA, 64 nt, Human
cccagacgcggaaaccggguggcagcgcccagccuggccccaagcauggaaacgcacaaccccu

SEQ ID NO: 190972 - RNA, 64 nt, Human
acaaauucuccuugaagaccuucucccuuuuauguggccccauauuuuauguugcuuuaucuuu

SEQ ID NO: 190973 - RNA, 64 nt, Human
guggaggguggaaggaaccguuugccuccagagauggccccagggagaacacagggacgugcca

SEQ ID NO: 190974 - RNA, 64 nt, Human
uacuccagcccagaaggaaaggggggcagcucaguggccccaagagggagcugauaucaugagg

SEQ ID NO: 190975 - RNA, 64 nt, Human
cagggccccucuacccacuucucccagucaguuguggccccagccccucucccugugcugugug

SEQ ID NO: 190976 - RNA, 64 nt, Human
gggaaaagggacugggaaguaaagggaaaccauauggccccagggaauggacccuuggagacuc

SEQ ID NO: 190977 - RNA, 64 nt, Human
gagccaccuggaggaacugcuugugcacuggauguggccccacccuuuccucuuaauucccaau

SEQ ID NO: 190978 - RNA, 64 nt, Human
uccucagccuucacccaaccuuuccaguuuccacuggccccacauuccucaacuaguauuauuu

SEQ ID NO: 190979 - RNA, 64 nt, Human
ucuccugccuagacauccaccuccagagcaacacuggccccacaguaaaagaggaagucuugua

SEQ ID NO: 190980 - RNA, 64 nt, Human
agaaggucccaggccccaggaacacagggcuucuuggccccagauggcaccucccugcaccccg

SEQ ID NO: 190981 - RNA, 64 nt, Human
uuuuccccgagagaaaguguuaacauugagacucuggccccagauugguaucuucuaugaagau

SEQ ID NO: 190982 - RNA, 64 nt, Human
uccaaaggcuuuuggucccagagcugggguauguuggccccagcccccagccuguggcucccaa

SEQ ID NO: 190983 - RNA, 64 nt, Human
gggcugaggcagacuauuagggcagggcugacuuuggugacacugcccauucccucucaggcca

SEQ ID NO: 190984 - RNA, 64 nt, Human
cagcaagccgagauugugccacuguacuccagccuggugacagagcgagacucccucucaaaaa

SEQ ID NO: 190985 - RNA, 64 nt, Human
aucuuccacuugagugucaagcugaccuugcugauggugacauugcaccuggauguacuaucca

SEQ ID NO: 190986 - RNA, 64 nt, Human
ucuacccuucgcgugcuuugucugggaagucuuuuggccccaugucaguuucuauugcauugag

SEQ ID NO: 190987 - RNA, 64 nt, Human
gaaucagaggacgaggcugcucuaaagacuguucuggccccagacacaggguagucuuugcuag

SEQ ID NO: 190988 - RNA, 64 nt, Human
cagccagcccucucacccgaggaucccuacccccuggccccacaauaaacaugaucugaagcag

SEQ ID NO: 190989 - RNA, 64 nt, Human
ggccccuggccuccuugcccuagcacacugggacuggccccacucucccagcuggacuccugca

SEQ ID NO: 190990 - RNA, 64 nt, Human
uuugccccaaggcugcucagaggggccccgguccuggccccagcccccaccuccgccccagaca

SEQ ID NO: 190991 - RNA, 64 nt, Human
uugaugcacuuggugggugggacccugcuuguguuggccccacguggggcagugcuuccucucu

SEQ ID NO: 190992 - RNA, 64 nt, Human
aauugaaauacaagccuguaccaagcaagcagccuggccccacacagguauuagcaaauaugug

SEQ ID NO: 190993 - RNA, 64 nt, Human
ggccuugaauucauuuuugccuaauauuaaaaucuggccccagcuuucuuucuguuagcauuuu

SEQ ID NO: 190994 - RNA, 64 nt, Human
gucccucccugauaccaaguaugucgagaaccgauggccccacccucuggcuggugcugggccg

SEQ ID NO: 190995 - RNA, 64 nt, Human
uuacaaaacucacgggccucuuuggucugcaugauggccccaugcguuucauaggcuguccacu

SEQ ID NO: 190996 - RNA, 64 nt, Human
gaccacagcccccaggggaggaugguacuggaucuggccccaucuucuggcccuuagcuggugc

SEQ ID NO: 190997 - RNA, 64 nt, Human
ggccugugcgaucccacccgugguggcucaagucuggccccacaccagccccaauccaaaacug

SEQ ID NO: 190998 - RNA, 63 nt, Human
ggcccaccuucuagaugaccccuuaauaaagugauggccccacagaagaaaugccuucagaug

SEQ ID NO: 190999 - RNA, 64 nt, Human
ggcucacaccccacacccgggcaggagcgcucccuggccccaacacaucggggcuccgaggcag

SEQ ID NO: 191000 - RNA, 64 nt, Human
uucugaggugugccauuggggccucagccuucucuggugacagaggcucagcuguggccaccaa

SEQ ID NO: 191001 - RNA, 64 nt, Human
guguucucccuguuaaugcguuuguauauagauuuggugacauuucccauguaccuauuaugau

SEQ ID NO: 191002 - RNA, 64 nt, Human
ugaacaaagugcuagacuuucuggagugauaaucuggugacaaauauucucucuguagcuguaa

SEQ ID NO: 191003 - RNA, 64 nt, Human
ccucuguucaauuccuaacgcaaacuacaauaaauggugacacacguucagaagaaaucuucuu

SEQ ID NO: 191004 - RNA, 64 nt, Human
guggccugggucccuggagcccuguugaaggagcuggugacauucugaugcuggaggcagguga

SEQ ID NO: 191005 - RNA, 64 nt, Human
uauuuccucaucuuuuuguuguugucauugauuuuggugacauggacuuguuuguagaggacag

SEQ ID NO: 191006 - RNA, 64 nt, Human
guggaugcagaggggaauccgaggccaucaaccuuggugacagcagcgcagugccaaugcugau

SEQ ID NO: 191007 - RNA, 64 nt, Human
ggguagugcccaagccuggucguguugccaggaguggugacaagaaaugcagcuuacaucaaac

SEQ ID NO: 191008 - RNA, 64 nt, Human
uuguuucuacaaaucucucucaaauguauuauuuuggugacaaaaaugaaggagcuuuguaaau

SEQ ID NO: 191009 - RNA, 64 nt, Human
caggacccagacccuuggcaagggauaggcucguuggugacauugugaauuucagauuuguuuu

SEQ ID NO: 191010 - RNA, 64 nt, Human
gaagggguggggagccaaggguggacuuuaagcauggugacagaugguauuuugggcagaaagc

SEQ ID NO: 191011 - RNA, 64 nt, Human
augcagagagcugcuauacaugugaaaaguaaaguggugacaugaaacuagagucuagugugug

SEQ ID NO: 191012 - RNA, 64 nt, Human
caccagcuccuugggacaauggaauaucccaggguggugacagcagauggagcuacuuggggga

SEQ ID NO: 191013 - RNA, 64 nt, Human
ccccauacuaugaggagaaguuuuguggugccgcuggugacaaggaacucacagaaagguuucu

SEQ ID NO: 191014 - RNA, 64 nt, Human
agucacagcaagcuguguaugaacuuguguuuuguggugacacauuaauaaucaaauugcuaaa

SEQ ID NO: 191015 - RNA, 64 nt, Human
uguuuuuuuugacucuaaucaacauuccuuuuguuggugacauuugugauuuucaguaaucuga

SEQ ID NO: 191016 - RNA, 64 nt, Human
guggucucuugccauugagccuugaagcugccuuuggugacacacugagugaaagggacugggc

SEQ ID NO: 191017 - RNA, 64 nt, Human
ugugucuacaaaaaauuuaaaaauuagccaaguauggugacaggcaccuaugguuccagcuacu

SEQ ID NO: 191018 - RNA, 64 nt, Human
caaggucaagagauuaagaucauccuggccaacauggugacaccccgucucuacuaaaaauaca

SEQ ID NO: 191019 - RNA, 64 nt, Human
augucuugguaaauacuaacaaauuuguuagguuuggugacaucauuuacagauuauuucuuua

SEQ ID NO: 191020 - RNA, 64 nt, Human
uagacucgaaguuugauaaaaguaccuuuucauguggugacaguuguguguugauuggcuaggu

SEQ ID NO: 191021 - RNA, 63 nt, Human
gacgaagacagaagaaguagagaggcagggccguggugacaguaucagugagugccauacaga

SEQ ID NO: 191022 - RNA, 64 nt, Human
ugcguaaccuucugccuaccuuccugagagugguuggugacagcagccggggcuagaaaccucg

SEQ ID NO: 191023 - RNA, 64 nt, Human
cacugccucauguggccccuuucccaguggcagcuggugacacuaacgauugcuacucgguuca

SEQ ID NO: 191024 - RNA, 64 nt, Human
caaaagaugugcaaaugcccuucagcacaggaccuggugacaugacauaaacuccaagacagaa

SEQ ID NO: 191025 - RNA, 64 nt, Human
cagugagccgagaucgcaccacugcacuccagccuggugacagagcaaaaaaaaaaaaauugaa

SEQ ID NO: 191026 - RNA, 64 nt, Human
gcaggcuggguaagaagcuggguuguguacuuucuggugacacuccugggcuccuccccauccc

SEQ ID NO: 191027 - RNA, 64 nt, Human
gaggguaagugacuugcccaaggucagagccacuuggugacagagccaggaugagaacaaagau

SEQ ID NO: 191028 - RNA, 64 nt, Human
uugugguucaguauuucccaccuacauuucuguuuggugacauugcucauuuuaacaaauauga

SEQ ID NO: 191029 - RNA, 64 nt, Human
uucaaaucuuucagggcagaguccgagcagcgcuuggugacagccuguccucuccugcucucca

SEQ ID NO: 191030 - RNA, 64 nt, Human
cacuggauguacauucagaaauguucuuugaauuuggugacacuuucaugguccagaaagcuga

SEQ ID NO: 191031 - RNA, 64 nt, Human
uguauuagcccagacaucuguaauguuuuugcacuggugacagacaaaaucuguuuuaaaauca

SEQ ID NO: 191032 - RNA, 64 nt, Human
ucagaggaaguccagaucuccugaguagugauuuuggugacaaguuuuucucuuugaaaucaaa

SEQ ID NO: 191033 - RNA, 64 nt, Human
aacccuugagggacucccaaacuguuuuccaauguggugacacaauuuuauaucccaucaacag

SEQ ID NO: 191034 - RNA, 64 nt, Human
gucaugauguugggaaggguguagugcccuagguuggugacagaagggacagacacuugugcac

SEQ ID NO: 191035 - RNA, 64 nt, Human
ccuacuggaagccugcaagucuaagaucuccaucuggugacagugggaugggugggguucgugu

SEQ ID NO: 191036 - RNA, 64 nt, Human
uauugcuuuaaucaccauauaaaaggaaaaaaauuggugacagagcacaaauagaaaaccuauu

SEQ ID NO: 191037 - RNA, 64 nt, Human
guucaccagugcuugcuugugaaucuuaacauuuuggugacaguuuccagaugcuaucacagac

SEQ ID NO: 191038 - RNA, 64 nt, Human
cuuggccuuugcccucaauauagguguuuuaggauggugacaaaccauggcugcugcuuucugc

SEQ ID NO: 191039 - RNA, 64 nt, Human
ugcaaaagugaugagaccccacacuuuacacucguggugacaaugaagcuauuaaguaacagcu

SEQ ID NO: 191040 - RNA, 64 nt, Human
uuaacauguggaagaaaacaagacaugaaaagaguggugacaaaucaagaauaaacacugguug

SEQ ID NO: 191041 - RNA, 64 nt, Human
auagaugccaccugguuagcaccgaaucugacuuuggugacaguccuaaagcacaguuggugau

SEQ ID NO: 191042 - RNA, 64 nt, Human
auaauguacaaggcaggaaaagggauggaauugauggugacagcuaagucugucuuuuuucuua

SEQ ID NO: 191043 - RNA, 64 nt, Human
caccccaagucuggcuccauuccuggccuucuguuggugacagacccccccccuaaggugcucg

SEQ ID NO: 191044 - RNA, 64 nt, Human
cuggaacuacuucaagugagaaaauaaaaaaaaauggugacaaagcuguacagauagagauaau

SEQ ID NO: 191045 - RNA, 64 nt, Human
agguguggaccaccggaaaguucuuaaaaguugcuggugacauuucuugccaauucuaacacug

SEQ ID NO: 191046 - RNA, 64 nt, Human
gauuuugugcaagcuaauuuggccacauuuggccuggugacagaacuguucauaaggaaguaau

SEQ ID NO: 191047 - RNA, 64 nt, Human
ccaccccuccuacucuguuggcuuagcccugagauggugacaggcuggccugcagucagcauca

SEQ ID NO: 191048 - RNA, 64 nt, Human
uaaaguguguaaguuaccaguuucaauaaaggauuggugacaaacacagaacuccugcuccauu

SEQ ID NO: 191049 - RNA, 64 nt, Human
uauuaguauaagaucagaauugaauuuaaguuguuggugacaucugcaucauuucauaggauua

SEQ ID NO: 191050 - RNA, 64 nt, Human
gccgccuccgcaucugacugucccaacggcaugcuggugacaccccccugcccuucgcuucugu

SEQ ID NO: 191051 - RNA, 64 nt, Human
ccagcccaguuacugcagggcagcuuuccccaccuggugacaggcugugcgcagcagccccagg

SEQ ID NO: 191052 - RNA, 64 nt, Human
uaguugggaaggaggcagacaugcaccagugauguggugacaggugcucugaaggaggucacca

SEQ ID NO: 191053 - RNA, 64 nt, Human
uuucucauuagugguacuggggugggaucuuggauggugacauugaaacuacacuaaauccccu

SEQ ID NO: 191054 - RNA, 64 nt, Human
ggaugggcgcagcccugccacuuaacuuguuuguuggugacacaguuguucagaguggggagaa

SEQ ID NO: 191055 - RNA, 64 nt, Human
uaacccucagaggcagcgccuuugucugucuaucuggugacaagagagagacaaguaaaugggg

SEQ ID NO: 191056 - RNA, 64 nt, Human
ugcaugaggucugccagaaggcccugcguguggauggugacacagaggauggcucuaugcuggu

SEQ ID NO: 191057 - RNA, 64 nt, Human
ggagaugucugcuggcagcaggcaggguucauucuggugacacagcaacagaugccuggccugg

SEQ ID NO: 191058 - RNA, 64 nt, Human
cacuaacuuccccgugcuguggugugaccugaguuggugacacaggccacagaccccagagcuu

SEQ ID NO: 191059 - RNA, 64 nt, Human; identical to SEQ ID NO: 191056

SEQ ID NO: 191060 - RNA, 64 nt, Human
ugugaugaagaaaaauacauggccgacuccaggguggugacauuuagagcuagucuugaaaccu

SEQ ID NO: 191061 - RNA, 64 nt, Human
uacaauuaauagugauauuuuggacaaggaguucuggugacaagcuauaccuaauuauaagcua

SEQ ID NO: 191062 - RNA, 64 nt, Human
gccaagagucucugucaacucucucauugcccaguggugacaugugcucuucuccacacuguug

SEQ ID NO: 191063 - RNA, 64 nt, Human
uccuccccagacuaugaaaucccuggagaauuuuuggugacaugcacugagccaaggugaugga

SEQ ID NO: 191064 - RNA, 64 nt, Human
gacauugugugaggucucaccugaaggaacuugguggugacauuugggaggguggagggaggca

SEQ ID NO: 191065 - RNA, 64 nt, Human
ccaaaaagcucugaaaacaagguuuccauaagcuuggugacaaaauucauuugcuugcaaucua

SEQ ID NO: 191066 - RNA, 64 nt, Human
caggcauccaggaaaaguggggaaugcugccaucuggugacagcauguagauuugggcagugaa

SEQ ID NO: 191067 - RNA, 64 nt, Human
cuucaucuaaagacucucaugucaauguggaccuuggugacaauccugcuuuguuaaagcaaaa

SEQ ID NO: 191068 - RNA, 64 nt, Human
gcuaccuuugcuuagggcuggggugggaggcacauggugacagguauaugucgugggacugggg

SEQ ID NO: 191069 - RNA, 64 nt, Human
gcccuucccugccuuuaaggagaagagaucuucauggugacauuugagaugauggaaacuagau

SEQ ID NO: 191070 - RNA, 64 nt, Human
ggugggcagcuuuucugcuuuuucccuuccucuguggugacaacggaggaaauauccaacagaa

SEQ ID NO: 191071 - RNA, 64 nt, Human
gcucuggacuugccuccagagacugcuccagaguuggugacacagcugucccaagggccccucu

SEQ ID NO: 191072 - RNA, 64 nt, Human
agugagccgagaucgcaccagugcacuccagccuuggugacaaugggagacuccaucucaaaaa

SEQ ID NO: 191073 - RNA, 64 nt, Human
caaugagccaagauugggccacugcauuccagccuggugacagagcgagacugucucaaaaaaa

SEQ ID NO: 191074 - RNA, 64 nt, Human
ugccucccccguccuuuuucccuugccaguucccuggugacaguuaccagcuuuccugaaugga

SEQ ID NO: 191075 - RNA, 64 nt, Human
aggcagcuccccugccuccaggacccuguugcuauggugacacagcguuucuaggacagagggg

SEQ ID NO: 191076 - RNA, 64 nt, Human
ggagcuuggaccuugguacuaccucagcugaggguggugacacaaccccuuccauuugucagca

SEQ ID NO: 191077 - RNA, 64 nt, Human
gcaagcucauucuucaguggauccuucaguggaguggugacacgugccagcggucacucugcca

SEQ ID NO: 191078 - RNA, 64 nt, Human
uuauuccaauaauuuuuguuuuuccuaaguaccuuggugacaagucauuucuuguuuuuauaca

SEQ ID NO: 191079 - RNA, 64 nt, Human
cccauagacacaagggaagugagaaacagugcucuggugacaugauaaauauaugugucaacca

SEQ ID NO: 191080 - RNA, 64 nt, Human
uccaagagcaugguaccagcaucugcuuggcaucuggugacagcuuucuugcugcaucauuaca

SEQ ID NO: 191081 - RNA, 64 nt, Human
caagaaggacuuacgcccugagcacaggugccaauggugacaagacuggcaagacgugagggca

SEQ ID NO: 191082 - RNA, 64 nt, Human
cucucccugccccgcccuggccaugugaucguguuggugacagacccugaugugcuggugcugu

SEQ ID NO: 191083 - RNA, 64 nt, Human
gggaauacaggguucagagaggagaggaggaagauggugacaugauuugguuagaagcacaagc

SEQ ID NO: 191084 - RNA, 64 nt, Human
uuuauuguguuuguucaagcuaagugguucaucauggugacagcaugaaaggaaugaguguaug

SEQ ID NO: 191085 - RNA, 64 nt, Human
ccacgcugguccugguauugauacaagacccagcuggugacaaagccuccaauccugggggucc

SEQ ID NO: 191086 - RNA, 64 nt, Human
caggaguguguucaagugggucauguuuuugcuguggugacacaugguacaggcuuggagcuug

SEQ ID NO: 191087 - RNA, 64 nt, Human
ugccuuuuacuuaaauuccucugacuuuuaaaaauggugacacucuuaucguaaagcuucuuau

SEQ ID NO: 191088 - RNA, 64 nt, Human
cuucaugcaaaacuguuuucuucuuccuucucaauggugacauuugaagaggcagagcaccuug

SEQ ID NO: 191089 - RNA, 64 nt, Human
uccagucgucaucucauucaaguauggcuuuacuuggugacacuggccauagcuaaguuaacuu

SEQ ID NO: 191090 - RNA, 64 nt, Human
cccuaauggggcagagaguauagcccuagcccaguggugacaugaccacucccuuugggaggcc

SEQ ID NO: 191091 - RNA, 64 nt, Human
ugucucuacuaaaaauacaaaaauuagccggggguggugacaugugccuguaaucccagcuacu

SEQ ID NO: 191092 - RNA, 64 nt, Human
ccgccucccaccucuucugugucugcuguguauuuggugacacuucauaaggacuagucccuuc

SEQ ID NO: 191093 - RNA, 64 nt, Human
acaagagcgaaacuccauuucaaaaaaaaaaaauuggugacagacucaaugauggaaugauuug

SEQ ID NO: 191094 - RNA, 64 nt, Human
agccucccccaaccaccugcccuccccgccuucuuggugacaaauagugagggcuccuauaccu

SEQ ID NO: 191095 - RNA, 64 nt, Human
acuacuaggccccccagggguccagcaggguggcuggugacaggccugggccucugcaacugcc

SEQ ID NO: 191096 - RNA, 64 nt, Human
gugcagcagauucccaacaguaaccuccuccuccuggugacagaccccaccugugacugcagca

SEQ ID NO: 191097 - RNA, 64 nt, Human
caucucuacuaaaaauacaaaaauuagccgggcguggugacacgugccuguagucccagcuacu

SEQ ID NO: 191098 - RNA, 64 nt, Human
gaggagggaaaaagugaaggagaggcuuuggaccuggugacagagugaucagaugacagagggg

SEQ ID NO: 191099 - RNA, 64 nt, Human
cuuuucagaaccugaugcccaguagggguuguccuggugacaccccuccuuuuuccagugccca

SEQ ID NO: 191100 - RNA, 64 nt, Human
augcuggacauuggauucuagcacuggguuuaucuggugacauagucuccugugggucuugagu

SEQ ID NO: 191101 - RNA, 64 nt, Human
ucuguaugcagggagccagggugagggcagaguguggugacagccgaacuuggaguaauguccg

SEQ ID NO: 191102 - RNA, 64 nt, Human
gucuuuuauuuaaguuuuuuaaguuaagaaaagcuggugacauauuuauacguuuuugugcaaa

SEQ ID NO: 191103 - RNA, 64 nt, Human
cugugucaguggcauggcuuguaugcuuguccuguggugacaguuugugacauucugucuucau

SEQ ID NO: 191104 - RNA, 64 nt, Human
auuuuacagaaacuaauugugauguacauaucaguggugacauauuauuacuuuuuuggggacg

SEQ ID NO: 191105 - RNA, 64 nt, Human
cugaugaggagaaaggggccccaccggggucuaauggugacaguccaaaccacuccacuggccu

SEQ ID NO: 191106 - RNA, 64 nt, Human
ccuugcuguugugauuauagucuugguuuaccuguggugacaaccggguguuggggacacaugu

SEQ ID NO: 191107 - RNA, 64 nt, Human
ugcaucuacugcagugaaggcacuuguagcauuauggugacagcugccucgggaagccaaguug

SEQ ID NO: 191108 - RNA, 64 nt, Human
caauggaugacacaaaacuaugagagugacaaaauggugacagguagcugggaccuaggcuauc

SEQ ID NO: 191109 - RNA, 64 nt, Human
ccagggaugauucaagccauuccaaaguucaacuuggugacacucuauaagauuccaaaaagca

SEQ ID NO: 191110 - RNA, 64 nt, Human
cugcagucuccaguuuagaauaaauauuccauaguggugacaugucagcugcccacugauacuc

SEQ ID NO: 191111 - RNA, 64 nt, Human
agucacaguauuaaugaaugagaucuuaagcaucuggugacaucagaacucugugucagccacu

SEQ ID NO: 191112 - RNA, 64 nt, Human
ggaccacugugugguuaguaaugcacuugccauuuggugacacagacugaaggcuauccuacac

SEQ ID NO: 191113 - RNA, 64 nt, Human
aagaaacaaccauaugguguuguauauuauaaacuggugacauucuacuauugaauuauguaca

SEQ ID NO: 191114 - RNA, 64 nt, Human
aauuuacugaauuaaaggauuaaauuaggugacauggugacaucuaucccuuuauuuugacacu

SEQ ID NO: 191115 - RNA, 64 nt, Human
gucaugaguccaugagucuaaguauagccacugauggugacaggugugagucuggcuggaacac

SEQ ID NO: 191116 - RNA, 64 nt, Human
aaaaacucaaugaaaucagcaaacugggaauuucuggugacauagaccucaccagugcuucaua

SEQ ID NO: 191117 - RNA, 64 nt, Human
uguaccacagguuccugaauaauuccugcagggcuggugacagacauaacagcucugguuuuau

SEQ ID NO: 191118 - RNA, 64 nt, Human
uucucccuguccccucaugggucccggguuagccuggugacaggcagacacaugcuguuggccu

SEQ ID NO: 191119 - RNA, 64 nt, Human
uaagaaaacaaauguugaaccucacacuuuuauguggugacaguguaauuuaauuaaaaggugu

SEQ ID NO: 191120 - RNA, 64 nt, Human
uagccgucugcgauuuuggcggcccuccggauuguggugacaauauguuguacccggacauucc

SEQ ID NO: 191121 - RNA, 64 nt, Human
agggaccagugccaggcacugggggguggaaguguggugacacagugaaugggagguggaggag

SEQ ID NO: 191122 - RNA, 64 nt, Human
uuucucugauauuaagcaggaaggcauuuuaauguggugacaucagauguuauuuuuccuagau

SEQ ID NO: 191123 - RNA, 64 nt, Human
uguuuuccauuaacgcuguuguaugaacaauauuuggugacauguugucuuuuuguccuguaga

SEQ ID NO: 191124 - RNA, 64 nt, Human
ucaggacgucgguguucccaacuccaaggggaccuggugacagacgaggcugcaggcugccucc

SEQ ID NO: 191125 - RNA, 64 nt, Human
gaccgcagcaggcaggccccagcgccgagacuccuggugacagguggcaccugucccacagccc

SEQ ID NO: 191126 - RNA, 64 nt, Human
aguaagccaagaucgugccacugcacuccagccuuggugacagagcaagacuccgucuccaaaa

SEQ ID NO: 191127 - RNA, 64 nt, Human
aacucugauaacugucagugccugagguugugauuggugacauucugacacugcccaaggcaac

SEQ ID NO: 191128 - RNA, 64 nt, Human
uggaagacuucagaagaucaccaagggcucauguuggugacaucauguaaaauuuuccugggua

SEQ ID NO: 191129 - RNA, 64 nt, Human
gacaggacauggucagggagaggacccugugaguuggugacauauauguggcagagaugguagu

SEQ ID NO: 191130 - RNA, 64 nt, Human
uaguuacugguuuucuccauugcauuguuaggcauggugacaagugacagaguucuugcccucu

SEQ ID NO: 191131 - RNA, 64 nt, Human
ggacauacguuguucuccccucucuggaucaagguggugacaggcagccugcugccguaugcuu

SEQ ID NO: 191132 - RNA, 64 nt, Human
caguaagcugagaucgugccacugcacuccagccuggugacagagugagacuccgucucaaaaa

SEQ ID NO: 191133 - RNA, 64 nt, Human
acagaggagaagggaaaggcagagggugugauuauggugacaauagcugccuuccccuaucgaa

SEQ ID NO: 191134 - RNA, 64 nt, Human
cucccgaagaaugaacccaagagcaagggcuugauggugacagcugcaagccagggaugaagaa

SEQ ID NO: 191135 - RNA, 64 nt, Human
ugccaccuguuggagccaagaauguauuaguuuguggugacacuggguuagcucagcauggauu

SEQ ID NO: 191136 - RNA, 64 nt, Human
uggcacccugccucucugugcccaggcccagcccuggugacauggcaccacucagcagugcugu

SEQ ID NO: 191137 - RNA, 64 nt, Human
caccaagcuccacaccuccuccuggugcuggcuuuggugacaucacaaggccccuccaggugca

SEQ ID NO: 191138 - RNA, 64 nt, Human
cuucauuucugucauucaagcucaacggcuauuguggugacauuuuuauguuuuucauugccaa

SEQ ID NO: 191139 - RNA, 64 nt, Human
cuucuagagccgugaugccucccuguugaagcucuggugacaccagccuuucucccaggccagg

SEQ ID NO: 191140 - RNA, 64 nt, Human
agccccauccucuguacagagcccacgcccccacuggugacaugucuuuucuugcaugaggcua

SEQ ID NO: 191141 - RNA, 64 nt, Human
ucccaccacuccaaggacugagacugaccuccucuggugacacuggccuagggccugacacucu

SEQ ID NO: 191142 - RNA, 64 nt, Human
cugcacuuggugcuccugcccacaccagccacuuuggugacaaugacccuuccaagaaucuuug

SEQ ID NO: 191143 - RNA, 64 nt, Human
ccugaaguggaagcuggggccuuagacucugcccuggugacaccagcaauuaugacuuugucua

SEQ ID NO: 191144 - RNA, 64 nt, Human
uagugagccaugucauccuccuuucauuuuuggauggugacagcauuuuuccccucugugcugg

SEQ ID NO: 191145 - RNA, 64 nt, Human
ccaucucuacuaaaaaaaaaaaaaaaauuagguguggugacacauggcugugguccuaguuacu

SEQ ID NO: 191146 - RNA, 64 nt, Human
ggacagaagcaagcuccacuguggacaugagugauggugacagcugcuuucaaauucugcaucu

SEQ ID NO: 191147 - RNA, 64 nt, Human
uagcuguguaucgcucuucccagaguuguuaauguggugacaugcaccaacagccguaugugua

SEQ ID NO: 191148 - RNA, 64 nt, Human
acugccggggucccaggacccuucccccuucaccuggugacaggaacacuccuuuccugguaug

SEQ ID NO: 191149 - RNA, 64 nt, Human
ucaagggcuuucuuccccuuuaacucucuccuucuggugacacauccugcagcagcugaggggg

SEQ ID NO: 191150 - RNA, 64 nt, Human
gucgcgucacugauuuugagguucuuuuuucucuuggugacaauaggugacccacguggcucug

SEQ ID NO: 191151 - RNA, 64 nt, Human
aucuggaugaugaaauaaucuguacaacaaacccuggugacaugcaauuuaccuauauagcaag

SEQ ID NO: 191152 - RNA, 64 nt, Human
agcuggggaaccucaaccuccccccugccucgguuggugacagagggggugggacaggggcggg

SEQ ID NO: 191153 - RNA, 64 nt, Human
aggaguuaaggugaucuugugagaagagucaugcuggugacaucaggagggguacauggcugug

SEQ ID NO: 191154 - RNA, 64 nt, Human
ccucuagggguagcagccggugugacucccuuucuggugacagacagggccccagcagcccugu

SEQ ID NO: 191155 - RNA, 64 nt, Human
ccaccagagccgggaggaaaaggccccugcaauguggugacaccucccccuuucacacuggauc

SEQ ID NO: 191156 - RNA, 64 nt, Human
uagguauuuugucuuucaaacuacaaauggaauguggugacauaaacuagacauggggugcccu

SEQ ID NO: 191157 - RNA, 64 nt, Human
uucaugaccuacuucaaaccccuacugaccuggcuggugacagaacaugcagcaaggggacauc

SEQ ID NO: 191158 - RNA, 64 nt, Human
cuucccuuuguugacuggccuucacagccauggcuggugacaacagaggaucguugagauugag

SEQ ID NO: 191159 - RNA, 64 nt, Human
acuccucaaaaaaagaacuuuggcugauuccuuguggugacacucagaggggucugaacagacu

SEQ ID NO: 191160 - RNA, 64 nt, Human
ccccuguccccucccccuucccucacaccgcgucuggugacaaccgaguggcugucaucagccu

SEQ ID NO: 191161 - RNA, 64 nt, Human
ccccuguccccuccaccuucccucacagugugucuggugacaaccgaguggcugucaucggccu

SEQ ID NO: 191162 - RNA, 64 nt, Human
aguguuuuggcuuaagaaauccauaggccucucuuggugacacaucucuaguacuuuuugucau

SEQ ID NO: 191163 - RNA, 56 nt, Human
gaucucgcucucguacauaagaugauuggugacacuuuuuguagaacccauguugu

SEQ ID NO: 191164 - RNA, 64 nt, Human
caaaaacaagacugccucccucucuuccgggagcuggugacagccuugggccuuucagucccaa

SEQ ID NO: 191165 - RNA, 64 nt, Human
ggucacaccccccgcccaccccaggcgaggauccuggugacaugcuccucucccuggcuccggg

SEQ ID NO: 191166 - RNA, 64 nt, Human
gaggcuuugaggcuucucuagaucggaaccucuuuggugacauucccgaccagcccugcaagag

SEQ ID NO: 191167 - RNA, 64 nt, Human
cuaggaagggaaggauuuuggagguagguggcuuuggugacacacucacuucuuucucagccuc

SEQ ID NO: 191168 - RNA, 64 nt, Human
caguagaagauguagcuaaaaaaaguucaggaucuggugacaaaugugcucccuuuggaaguua

SEQ ID NO: 191169 - RNA, 64 nt, Human
uaaaacuguguauuugaccuuuuuuuuacaacacuggugacagucauaugguuuugaaaaaaaa

SEQ ID NO: 191170 - RNA, 64 nt, Human
uaugucuauaacucagaucgcaccaaacuuccuguggugacagacucuuccauuucagacuggu

SEQ ID NO: 191171 - RNA, 64 nt, Human
ugcccucuccccucagccucuccccugccugcccuggugacaucagguuuuucccggacuuaga

SEQ ID NO: 191172 - RNA, 64 nt, Human
gccauugaaacagugauuaaguuugaucaagccauggugacacaaaaaugcauugaucaugaau

SEQ ID NO: 191173 - RNA, 64 nt, Human
ugugagacccgaggggcggcggcgcgguuuuuuauggugacacaaauguauauuuugcuaacag

SEQ ID NO: 191174 - RNA, 64 nt, Human
guggaugcuccaggcugugccuacacagcagugcuggugacauguccaggguuccagggcccgg

SEQ ID NO: 191175 - RNA, 64 nt, Human
gguagggaaauggcgaagccagccaccaggucgcuggugacagggccaggguuaugcaggaagg

SEQ ID NO: 191176 - RNA, 64 nt, Human
ccgggaaccagagccccacagccauacagcccauuggugacaagguccugagaacacaguggcc

SEQ ID NO: 191177 - RNA, 64 nt, Human
uagugagccaugauugugccacugcacuccagcuuggugacagagugagauccugucucuaaau

SEQ ID NO: 191178 - RNA, 64 nt, Human
cucacaccacgaagcucuuggggccugauccuucuggugacacuucacuugucccauugguuaa

SEQ ID NO: 191179 - RNA, 64 nt, Human
acugaggcaguuuugguggaugggggaccuccacuggugacagagaagacaccaggguuugggg

SEQ ID NO: 191180 - RNA, 64 nt, Human
ggcuacagcaggagcugaugacccucaugaugccuggugacaaaagaauuucugccuacccuga

SEQ ID NO: 191181 - RNA, 64 nt, Human
gggcaacuuagcgagacuccaucucuacaaaauguggugacacaugccuguagucccagcuacu

SEQ ID NO: 191182 - RNA, 64 nt, Human
agcgagcugagaucacaccacugcacuccagccuuggugacagagugagacucugucucaaaaa

SEQ ID NO: 191183 - RNA, 64 nt, Human
uaguguugaagauaugaaauauggcuauuuuuaauggugacaauuaugacuuuuagucacuauu

SEQ ID NO: 191184 - RNA, 64 nt, Human
auuacaaguguguuugucuuuagugaacucauaguggugacauaccuuuccuuuugaguauaac

SEQ ID NO: 191185 - RNA, 64 nt, Human
uuucaaacuugaauaaacaucagacaauucacacuggugacaaacccuaugaauguaaagauug

SEQ ID NO: 191186 - RNA, 55 nt, Human
aguuuaucaauagagaauaguuauguggugacacuacuucaagagaaccucugca

SEQ ID NO: 191187 - RNA, 64 nt, Human
gacuuccagagcucaacccccuccuuucucccaguggugacaagauaucaauaaacuuauuuuu

SEQ ID NO: 191188 - RNA, 64 nt, Human
cagugagccgagauugcaccacugcacuccagccuggugacagagcgagacuccgucucaaaaa

SEQ ID NO: 191189 - RNA, 64 nt, Human
ucucuggagcagcuguggcuuccccguggcugcuuggugacauggauuagcgcuacgugggcug

SEQ ID NO: 191190 - RNA, 64 nt, Human
gacaaggcagaacuuuuggaaaaacaaagacuguuggugacaggguguguguguaucugugcgu

SEQ ID NO: 191191 - RNA, 64 nt, Human
gguggccacgaggacuugcaggcuauaguuaugguggugacaugcaugaggugggcugguagag

SEQ ID NO: 191192 - RNA, 64 nt, Human
uucccugccuucuagagaaagagccuggagacaauggugacaaugucuguggguacuuuucuca

SEQ ID NO: 191193 - RNA, 64 nt, Human
aguucauuccagcaaucauaguuaauacaguacuuggugacacgcccuacccccuucucuucca

SEQ ID NO: 191194 - RNA, 64 nt, Human
uacacuuugcagaguaagggaucauugaggcuucuggugacaucauucaagggagugaagacaa

SEQ ID NO: 191195 - RNA, 64 nt, Human
gagcacucaaauagggagccaggagccagggagcuggugacacuugugugcuguggggcagcug

SEQ ID NO: 191196 - RNA, 64 nt, Human
agccaacaggccuaagugccagguucccuggcguuggugacaugcugcagccuggaacucugau

SEQ ID NO: 191197 - RNA, 64 nt, Human
agaggcaguucugaaucauucucucauucaccaguggugacauccuucagucccucacaucucu

SEQ ID NO: 191198 - RNA, 64 nt, Human
cagugagccgagaucacgccacugcacuccagccuggugacagcgugagacucuuuaaaaaaag

SEQ ID NO: 191199 - RNA, 64 nt, Human
caucugagaacccacucucugccggagaaccccauggugacacauuuucaucuuucugaccaga

SEQ ID NO: 191200 - RNA, 64 nt, Human
aucaagcagggaaaauccagggagauuaaauucauggugacaaguccugggcaguucugguaaa

SEQ ID NO: 191201 - RNA, 64 nt, Human
uucgagugucccccaaccccgggcagguggcaccuggugacaccuccuucagucccacucagcu

SEQ ID NO: 191202 - RNA, 64 nt, Human
gcuguauguacuuccaguauccugaaacaguguuuggugacauaaugccaaggguaaacaagcc

SEQ ID NO: 191203 - RNA, 64 nt, Human
caucuccacuaaaaauagaaaaauuagccgggcauggugacacaugccuguaguccuagcuacu

SEQ ID NO: 191204 - RNA, 64 nt, Human
cguuuucuuccguugugaaugccgcguccuguccuggugacaggagaacaauguuggugaacgu

SEQ ID NO: 191205 - RNA, 64 nt, Human
gagcaggcacgggggugaugcugccacagggggcuggugacacccagagcccccuccccagccc

SEQ ID NO: 191206 - RNA, 64 nt, Human
cguugccuccugacauaccaagcuucaaccucauuggugacagccugucuuucgacuucaaaga

SEQ ID NO: 191207 - RNA, 64 nt, Human
gcacccaguguagggaaacacagccagaccacuguggugacagacuuucuuuauaaacauuugg

SEQ ID NO: 191208 - RNA, 64 nt, Human
gaggccaugcuugacucugcugaaagcugcuaacuggugacaggguggaucauggugaggacua

SEQ ID NO: 191209 - RNA, 64 nt, Human
uaauguauauuuuacagaguggggguuggcaggauggugacauugaacaugauugcucucuguc

SEQ ID NO: 191210 - RNA, 64 nt, Human
aaaaaaaagaagaagaauacagucauguaucucuuggugacagggacgcauucugauaaaugug

SEQ ID NO: 191211 - RNA, 64 nt, Human
gccuacugggcauccggccugugcugggcauggguggugacauuggcagaaauggccacuggaa

SEQ ID NO: 191212 - RNA, 64 nt, Human
caucuguggugaaccaagugaagguggugacuucuggugacauaguaauaaagugaagacucag

SEQ ID NO: 191213 - RNA, 64 nt, Human
aauaaaagcuggggucggggggcuuuugcagcucuggugacauucucuccacggggcacauuug

SEQ ID NO: 191214 - RNA, 64 nt, Human
cagugagcuaagacugcaccacugcacuccagccuggugacagaacgagacucugucuuaaaaa

SEQ ID NO: 191215 - RNA, 64 nt, Human
uuuuaaagauaugauguuuuauuguuuuaacucuuggugacaguagaugcucucuggagcgcag

SEQ ID NO: 191216 - RNA, 64 nt, Human
gaaacugugaauguaauggaaacguaggagcaucuggugacagccuuucuugcccucugaccuc

SEQ ID NO: 191217 - RNA, 64 nt, Human
uuuugaauggguaugucagaaaaggaugaguuuguggugacaguuggugcuaauaagaauuugc

SEQ ID NO: 191218 - RNA, 64 nt, Human
gccccugcugugccugguaugcuggcaguggugauggugacaacacaaugaggccaaguagcaa

SEQ ID NO: 191219 - RNA, 64 nt, Human
aagcaaagagcuguggacugccgugguccuaguguggugacaaugcagcacuggcaugcauguc

SEQ ID NO: 191220 - RNA, 64 nt, Human
cugccuuuuguguaaugcggggaagacuaaugcauggugacaccuaguuuuccucaacaggaca

SEQ ID NO: 191221 - RNA, 64 nt, Human
uugguucucccaggagcucagggccugucagaccuggugacaagugccaaaggccacaggcaug

SEQ ID NO: 191222 - RNA, 64 nt, Human
acacuuuaagucuuguauuuauuuuuaguaaaaauggugacaguuucauugugaaccccucuca

SEQ ID NO: 191223 - RNA, 64 nt, Human
aaucaacaugauuucauaaggugcaaauaaaaguuggugacagauuuaauauaauuuugaucac

SEQ ID NO: 191224 - RNA, 64 nt, Human
cuagcccaggcuggggaucucgacucagacaagauggugacaaugccuugagucugaggcaucc

SEQ ID NO: 191225 - RNA, 64 nt, Human
uccccaagcucuccagucaacacagggcucccuguggugacaccaguggagaugagggaacggg

SEQ ID NO: 191226 - RNA, 64 nt, Human
aaauaacauuccuucaaaucugaggcuugccugcuggugacaagcagagcgccugugauuuggc

SEQ ID NO: 191227 - RNA, 64 nt, Human
caugagaguuggagucaaagccauuguuaucuuuuggugacacccuuaaauuuuaagucuucca

SEQ ID NO: 191228 - RNA, 64 nt, Human
uccaaagguuugagcuuggcuagaaccgguaagauggugacauuguugaucaagacugggaaua

SEQ ID NO: 191229 - RNA, 64 nt, Human
ugcugucuuagggaagaaaugguucaaauccauguggugacauugcauuagucucccuuucacu

SEQ ID NO: 191230 - RNA, 64 nt, Human
ccuuuagagaaagcauuugagcgaaagucauguuuggugacaugauucauacagaccucuugag

SEQ ID NO: 191231 - RNA, 64 nt, Human
uagcaugggcaguuucaguuucagccuaagagacuggugacauccacaaaugcaguuuuagaag

SEQ ID NO: 191232 - RNA, 64 nt, Human
agcauuuguggggcacucaauaaauuuaaauucauggugacagugacaaggauguuucugcuag

SEQ ID NO: 191233 - RNA, 64 nt, Human
caaacagaugcucugagagcaaacuggcuugaauuggugacauuuagucccucaagccaccaga

SEQ ID NO: 191234 - RNA, 64 nt, Human
aagaagccguuuugauuuucaaagaagcagguucuggugacauuauuuucuuccuuggacaaag

SEQ ID NO: 191235 - RNA, 64 nt, Human
caggcaucauauauuagcugucuugcucccaaaauggugacauuacaaacuuuuccacuauucc

SEQ ID NO: 191236 - RNA, 64 nt, Human
acuuguucucaaaacauuuucuaauugauugguagguuuucauaagcauuguuucuuuaaggca

SEQ ID NO: 191237 - RNA, 60 nt, Human
ugaaacuuucuguauaacuuguauuauuagacucucuaguuuuaucuuaacacugaaacu

SEQ ID NO: 191238 - RNA, 56 nt, Human
agaauuguuguugggcugggcgcaguggaucgcaccuguaaucccagucacuggga

SEQ ID NO: 191239 - RNA, 56 nt, Human
cagcaaauuugacuugaauucacuuaggaucgcaggaaucaggggaaagugauuuu

SEQ ID NO: 191240 - RNA, 64 nt, Human
gauuuuauaugcacauuucuggauuuuuuuauacgguuuucauugacacucuucccuccuccca

SEQ ID NO: 191241 - RNA, 64 nt, Human
gggaccuacagaauaaagggggggauggacaggggguuuucaaaaggaacauggcucacucaga

SEQ ID NO: 191242 - RNA, 64 nt, Human
cuccuuuucucucuuugccucacucucuccaguugguuuucagcuggggcuugaaaugcauuuu

SEQ ID NO: 191243 - RNA, 64 nt, Human
caugccuaauuuuuuucuauuuuuaggagagaccgguuuucaccacguuggccaggauggucuc

SEQ ID NO: 191244 - RNA, 64 nt, Human
auguugccacuuggaguaugaacaaugggcacgggguuuucagccacaguucccucgaggccag

SEQ ID NO: 191245 - RNA, 64 nt, Human
uguaccuugcaaacuuaugaaccaaaccauauuggguuuucaaagugccuuuguauccaaaaau

SEQ ID NO: 191246 - RNA, 64 nt, Human
aaagaauaaaaauauauuacugucucuuuaguaugguuuucagugcaauuaaaccgagagaugu

SEQ ID NO: 191247 - RNA, 64 nt, Human
caugauaaaguggcgggggucugguccugcucaggguuuucauccuuccuccucucccuccucu

SEQ ID NO: 191248 - RNA, 64 nt, Human
aucaccuagcagccucaaaacgggucaguauuaagguuuucaaccggaaggaggccaaccagcc

SEQ ID NO: 191249 - RNA, 64 nt, Human
aagacauguuugcauugagaaauuaacccuaaaggguuuucaauaggguguagaccuccaguac

SEQ ID NO: 191250 - RNA, 64 nt, Human
uuuccagugagcuuaucaugcugucuuuacaugggguuuucaauuuugcaugcucgauuauucc

SEQ ID NO: 191251 - RNA, 64 nt, Human
ucuauuguaaauuaugugacuuguagcuuccucugguuuucaaguaaacucaacaagguggagu

SEQ ID NO: 191252 - RNA, 64 nt, Human
augugaaucccucaauaccccuaguaucuggcuggguuuucaggggcuuuggaagcucuguugc

SEQ ID NO: 191253 - RNA, 64 nt, Human
gcaguccguaccguucuuagguuagccagagacagguuuucauuaucaggucacugugaaaucu

SEQ ID NO: 191254 - RNA, 64 nt, Human
ccagccuauuucccgccuccauuugauguuuccagguuuucaaaacugcauuuaaccugcgcca

SEQ ID NO: 191255 - RNA, 64 nt, Human
cacauucuuaauguaaauggugucuuucuucugggguuuucaguuauugcaaagaaaugaagag

SEQ ID NO: 191256 - RNA, 59 nt, Human
cuccuggauacuucauuuaaauuugauuuucgagguagugagaugucggcaagguuugu

SEQ ID NO: 191257 - RNA, 64 nt, Human
aagcaauuugggaaagccuucagaucugucaaaaaucuucgauuucauaaaaggacacacacug

SEQ ID NO: 191258 - RNA, 64 nt, Human
uagaaauagacacaauauuauuucuaaggaaucggguuuucauuuacucuggacuggugaaaau

SEQ ID NO: 191259 - RNA, 64 nt, Human
ccuuuuuuguaaauguaauaaaauguauaaauaugguuuucagaaaacaucaagugcuguaaau

SEQ ID NO: 191260 - RNA, 64 nt, Human
uguuaggcaaaggccucccugcauuugaagagcagguuuucauuuauauguauuuuugggauaa

SEQ ID NO: 191261 - RNA, 64 nt, Human
cuucuaugaugauggaacaggucucuaagcuagugguuuucaaacugguacacauuagacucac

SEQ ID NO: 191262 - RNA, 64 nt, Human
ugcuaguucaaaauaagacugcucaguuuccaaggguuuucaagccuacuuaccuuuauaaagg

SEQ ID NO: 191263 - RNA, 64 nt, Human
guggucuucuccaccagccccucacaggcuuggggguuuucaaugugaaacacaugccaguuuu

SEQ ID NO: 191264 - RNA, 64 nt, Human
gacaccuuacuuauaaugaaguacuugggaaagugguuuucaagaguauaaauauccuguauuc

SEQ ID NO: 191265 - RNA, 64 nt, Human
cuagccccagcuagaaguauuguuucugccuguggguuuucaccaagaccuguuugggggcgcu

SEQ ID NO: 191266 - RNA, 64 nt, Human
aaggagagaugccucaggcuucagaccuuaccuggguuuucagggcaaacauaaauguaaauac

SEQ ID NO: 191267 - RNA, 64 nt, Human
uaaggggaaaauucauuccauagagcugaaaucugguuuucaaggccucuguggcuuucuucug

SEQ ID NO: 191268 - RNA, 64 nt, Human
uucccggcuaauuuuuguauuuuugguagagauggguuuucaccauguuggccaggcuggucuc

SEQ ID NO: 191269 - RNA, 64 nt, Human
uguacuguauuguauauuacuugggaggacacuagguuuucaaagaagucuggcagcacuuggg

SEQ ID NO: 191270 - RNA, 64 nt, Human
uaaauacaccaacaugagacaucaguagucaguugguuuucaguaaagcuuguuccaaguuguu

SEQ ID NO: 191271 - RNA, 64 nt, Human
ucaaauguaaacacuauauuguagauuuacuguagguuuucaaccuuuuuuagauuuaugcaug

SEQ ID NO: 191272 - RNA, 64 nt, Human
aaaauuucaaauccuaaaucacuucuuguaggaggguuuucauuaacugcaguauauacaguuc

SEQ ID NO: 191273 - RNA, 64 nt, Human
agcuaauauaaaauaguuauguaacugugauuuugguuuucaguuaugugacuuguuuuuucca

SEQ ID NO: 191274 - RNA, 64 nt, Human
uugaaaauccugugacuugccuguuucuccccgcuccaacgaaaucauuaacucuccuaaaaug

SEQ ID NO: 191275 - RNA, 64 nt, Human
ugcuccccuuugcuugaagagacccccucccccuuccaacgagcuuccggacuugucugcaccc

SEQ ID NO: 191276 - RNA, 64 nt, Human
gggccacuccgcggcugugcacucguuugcuuucuccaacgacucacggaggugagugaauccg

SEQ ID NO: 191277 - RNA, 64 nt, Human
uuuaucuuaccauuaauuuuaaaucuaguggauugguuuucaacaucgugccugccgauaugcc

SEQ ID NO: 191278 - RNA, 64 nt, Human
cagccucccgagcugcggcgcccgcagcggaggagguuuucaguggcugauugaaacucacugc

SEQ ID NO: 191279 - RNA, 64 nt, Human
uuuuuacauaucaguaauuguuuuuauaauuugugguuuucaugaaacauugcuaugcauuuau

SEQ ID NO: 191280 - RNA, 64 nt, Human
cuguuacuugacacaaauguguguguuauucagagguuuucagucuggacacuccauaggugag

SEQ ID NO: 191281 - RNA, 64 nt, Human
guugguaaugugauuaugugguaccuuggcuuuagguuuucauucgcacggaacaccuuuuggc

SEQ ID NO: 191282 - RNA, 64 nt, Human
uuaaaaucuuccucauuuggauuugcuuucaguugguuuucaauuugcucacuggccagagaca

SEQ ID NO: 191283 - RNA, 64 nt, Human
aagguauuuuuuuuaaguucuguuggcuagcuaugguuuucaguacauuuccuacuuuaagagu

SEQ ID NO: 191284 - RNA, 64 nt, Human
aggcgagaagagagaaugugcugucuaucuuccugguuuucaguccacagagucgguagaccag

SEQ ID NO: 191285 - RNA, 64 nt, Human
cauuaaaggcuuagcauuuaaguagcaacauugcgguuuucagacacauggugagguccauggc

SEQ ID NO: 191286 - RNA, 64 nt, Human
gcgaucuguuauuaacugggaagcauuugguguugguuuucauuccauuucgacgagcauguua

SEQ ID NO: 191287 - RNA, 64 nt, Human
auuuuuaaaucccacauucagaguuuaaaacacugguuuucaauguguuuuuuaguguugucac

SEQ ID NO: 191288 - RNA, 64 nt, Human
ccaaguaagaaguguaucugccuuuccaucuuuugguuuucauuugggcaugugcuauuaccag

SEQ ID NO: 191289 - RNA, 64 nt, Human
uccagauauccuaaagcucaauuguuuggucucugguuuucauccuuagagaagccauggagaa

SEQ ID NO: 191290 - RNA, 64 nt, Human
ucauucacuuccagggcuguauuucugcaguuucgguuuucauuugcuucagcuuacuaagaag

SEQ ID NO: 191291 - RNA, 64 nt, Human
auaugacuguugagugugcucuuucacagaacuugguuuucaaauaaauauaagaucuccagau

SEQ ID NO: 191292 - RNA, 64 nt, Human
gacgugaugcugggcuguguuuacuaaacccacggguuuucagccucuuaagcccagcuccgau

SEQ ID NO: 191293 - RNA, 63 nt, Human
aggucaucgccuccaacugaacauuuuccugaguccaacgaccuucccaaaaugguucuuaga

SEQ ID NO: 191294 - RNA, 64 nt, Human
auugcauuuaucaaacuauucaugcuagcauuuuuccaacgagggaacuuauuccgcacgggcc

SEQ ID NO: 191295 - RNA, 64 nt, Human
ccauguugcucaggcugaucucaaacuccugggcuccaacgaucugcccaccuuggccucccaa

SEQ ID NO: 191296 - RNA, 64 nt, Human
uauguuuguggauuuaauuaaaguauuuuaauaugguuuucagugcuaaaauuggagucagaua

SEQ ID NO: 191297 - RNA, 64 nt, Human
aguuucugagcaaaaacuucaauuucaaaauaaagguuuucagggguucacuuaaguguaucac

SEQ ID NO: 191298 - RNA, 64 nt, Human
ggaugaggcucccccaaugucacauuaaauucaugguuuucauucaaggcaucuguugucucuc

SEQ ID NO: 191299 - RNA, 64 nt, Human
ccuuagaguguuuuuuaaaaaauuguaaagucaagguuuucaugaaaaaugggaagaucagaca

SEQ ID NO: 191300 - RNA, 64 nt, Human
ccaguuggaagaaggauccuaaggaugugacacugguuuucaacaacaugcuuagagaacucau

SEQ ID NO: 191301 - RNA, 64 nt, Human
cucgaucuuggcucucuccaaucuccgccuugcagguuuucaagcaauucuccugccucagccu

SEQ ID NO: 191302 - RNA, 64 nt, Human
acuguuacuccuuauuuaauuuugcgucugccaugguuuucagaaucugaauaguauuuauacu

SEQ ID NO: 191303 - RNA, 64 nt, Human
uuuauaugauugucuaugggcaguuugaauuucugguuuucaauuuauuuuuuaaugauuaauu

SEQ ID NO: 191304 - RNA, 64 nt, Human
aaccucaaucuuuuuuuuuuuucgccuuuaagaagguuuucagugauuauaccucagguauuuc

SEQ ID NO: 191305 - RNA, 64 nt, Human
uuuaguucucagagguagggacaaaaccacaucagguuuucagaaggaaaaaacauuuaaaaac

SEQ ID NO: 191306 - RNA, 64 nt, Human
ggaugucucuuguaauacuaaccgcgugauaauggguuuucagacaugaugaaaaaaaaaaacu

SEQ ID NO: 191307 - RNA, 64 nt, Human
uuugauggaggugaaaucucuuuguaauccacuagguuuucaucguaaaaccaucuuaugccug

SEQ ID NO: 191308 - RNA, 64 nt, Human
ccauucuggucuuucugggccagauuuuuauauugguuuucaguaaaugucuaucuauaauauu

SEQ ID NO: 191309 - RNA, 64 nt, Human
aaggaggggaggaggcagcagggaagcaacccuggguuuucagaagguccuucugauggcuagg

SEQ ID NO: 191310 - RNA, 50 nt, Human
ggcaugcuaaaaauaauugagguuuucaugauucagcaccugcuuuuguu

SEQ ID NO: 191311 - RNA, 64 nt, Human
aaugccauuuguuagacacuucaauauuuuacaugguuuucaauguacacuguaccaaaauuuc

SEQ ID NO: 191312 - RNA, 64 nt, Human
uuugggaacaucuuaacuguauaugaacauuucacgaggacaauaaaaauaagacauugaagga

SEQ ID NO: 191313 - RNA, 64 nt, Human
cccuguuggugcuuuaccaccgcuuggagucucccgaggacacaaacaggcagagagggacgug

SEQ ID NO: 191314 - RNA, 64 nt, Human
cuaggcaucacaugcucaaugacucucuggugagcgaggacauucucugaccuacucgagggac

SEQ ID NO: 191315 - RNA, 64 nt, Human
uggauaaugauggcuguaacaaaucauguuagaugguuuucaguugggguguagaaauaggaag

SEQ ID NO: 191316 - RNA, 64 nt, Human
aguauuaagcaguucauucuaccaagcugucacagguuuucagagaauuaucucaaguaaaaca

SEQ ID NO: 191317 - RNA, 64 nt, Human
ugugcaacauuucggugagaacuuuauugucagagguuuucaguacauauuuacaaguucuuac

SEQ ID NO: 191318 - RNA, 64 nt, Human
accgacuuuaagcaaaccgucaacaaaggcuauugguuuucaguuccgcuauugcuaagcauug

SEQ ID NO: 191319 - RNA, 64 nt, Human
augacucucaugauuuuuccuuugugaaaucccugguuuucagcuggaagcgguggguaaauga

SEQ ID NO: 191320 - RNA, 64 nt, Human
gaguggcugucaugagcaugucaguucuaaaagggguuuucauuauccuggaaauguauaaacu

SEQ ID NO: 191321 - RNA, 64 nt, Human
uccaguuuccaaagggcaguaaaguuuucgugccgguuuucagcuauuagcaacugugcuacac

SEQ ID NO: 191322 - RNA, 64 nt, Human
gcuggguugagaaaagucuguuacaguugcuagagguuuucauuaaaacuuaucagaugagagg

SEQ ID NO: 191323 - RNA, 64 nt, Human
ugcacaucaagucaaaaacauguuugggaaagaugguuuucaauucugaaguuauaccuaguga

SEQ ID NO: 191324 - RNA, 64 nt, Human
cauuggacaguugucuagagauauauauacuugugguuuucaaauuggacuuucaaaauuaaau

SEQ ID NO: 191325 - RNA, 64 nt, Human
caguuuuuguguuuuuccuugccccuuuccaagugguuuucaagugucaggcaguguucugaga

SEQ ID NO: 191326 - RNA, 64 nt, Human
caggagaauaaauaacuguuuuguguugguuggugguuuucauaaucuuauuucuguacuggaa

SEQ ID NO: 191327 - RNA, 64 nt, Human
acuaggaagccacuauuacaggaagaaaagauuugguuuucauggcagucuguuuuuuuaaaaa

SEQ ID NO: 191328 - RNA, 64 nt, Human
ugcuucugcuuccauuuuuagcauuuuaguuucugguuuucauuuuuggagauuccuugccuuu

SEQ ID NO: 191329 - RNA, 64 nt, Human
cuggcucacccacaggugccaugugcacacuccugguuuucaaacaauucucuggauuuauuua

SEQ ID NO: 191330 - RNA, 64 nt, Human
uuuaugugggucuauaauaauuguauuuucaagagguuuucacuauauuuguauuggccugguu

SEQ ID NO: 191331 - RNA, 64 nt, Human
ccaagcucugcgauguggcucagcagcgcaacugcgaggacaugauccagauguuccaggugag

SEQ ID NO: 191332 - RNA, 64 nt, Human
ucccucagcagccccggaagccugccucacccgacgaggacagcgagcggcccggcuccuuucu

SEQ ID NO: 191333 - RNA, 64 nt, Human
uguguucugggcuggggccaccuuugugcagcuucgaggacaggaaaggccccaaucuugccca

SEQ ID NO: 191334 - RNA, 64 nt, Human
ucuagaaaccacuaucauaguugcuaaaaaaaaugguuuucaaaugucaaauacaugaguaucu

SEQ ID NO: 191335 - RNA, 64 nt, Human
ccauuucugagaucucacauuccaucuaucacaggguuuucaaagagaugcugaggguaacaag

SEQ ID NO: 191336 - RNA, 64 nt, Human
uccuuuaaauauuuuuaguugaccuuuuuccuuugguuuucaaauguucaacaugaaucagaau

SEQ ID NO: 191337 - RNA, 64 nt, Human
cugcuuggcaguugcagugcugcugucucggggggguuuucaucuaugaggguguuuccucuaa

SEQ ID NO: 191338 - RNA, 64 nt, Human
gacaagcagaugaagaaauucaaaggauugaagagguuuucacucucugcuaaagugguagaug

SEQ ID NO: 191339 - RNA, 64 nt, Human
cacccguuuucucagcauucagcccagggaaugugguuuucacuucuucgucagauaagaccaa

SEQ ID NO: 191340 - RNA, 64 nt, Human
acuucucuucaggccaugagccuaacacccugccgguuuucaugcccgcugcaguaauggacgu

SEQ ID NO: 191341 - RNA, 64 nt, Human
gcauuuauuugucaauaaacugccuuuuguaagggguuuucacauaacauagaggagcuucccu

SEQ ID NO: 191342 - RNA, 58 nt, Human
cagcaacaggcuuuuauuaaaacauacugguuuucauguuucugauuaguuggguuuu

SEQ ID NO: 191343 - RNA, 59 nt, Human
aggauaaguacaugaagugagauggcugagguuuucagcaguaagagacuccccaggug

SEQ ID NO: 191344 - RNA, 64 nt, Human
uuugcccugggacgguuucuaucuaucaaaggaagguuuucaccuguagaaagcccccugccuc

SEQ ID NO: 191345 - RNA, 64 nt, Human
ugagacugugaauuauuuaaaacugcauucuuaagguuuucaagguauucuguagaaugucaga

SEQ ID NO: 191346 - RNA, 64 nt, Human
aauuuuguagauauguuuccuauaauauuccugugguuuucaguaugucaguccaagaaacaaa

SEQ ID NO: 191347 - RNA, 64 nt, Human
auaguuugcuuugcuuuuuaauugaggacagccugguuuucacauacacucaaacaaucaugag

SEQ ID NO: 191348 - RNA, 64 nt, Human
auaagucuuagaagcuuuauggugauuauuuugagguuuucauucucgcauaaagcacaaugcu

SEQ ID NO: 191349 - RNA, 64 nt, Human
aaggacacucugcucuugaagguguauuacaucagguuuucaaaccagcccugguguagcagac

SEQ ID NO: 191350 - RNA, 64 nt, Human
agcugaauccagaucauuccucagaaugaggacccgaggacaguggcagacagacgcguuggca

SEQ ID NO: 191351 - RNA, 59 nt, Human
ggcugguccagaguuccuagcacuggccccgaggacagccaagggccauuucuucucag

SEQ ID NO: 191352 - RNA, 64 nt, Human
agcagauuugaaagccaggauggcgccuccagaccgaggacagcuguccgccaugcccgcagcu

SEQ ID NO: 191353 - RNA, 64 nt, Human
uucauuagauuaugguguuugccuaauuuauaccgguuuucacuguauauuuuaaugaacuuug

SEQ ID NO: 191354 - RNA, 64 nt, Human
cuuugccuguuaauuucacucugccuguuagguggguuuucaaacccugauuuaggauuacacc

SEQ ID NO: 191355 - RNA, 64 nt, Human
uauauuguaauuuuauacuuucuauagacagaaagguuuucagagaaaaagaaaugguuaaaua

SEQ ID NO: 191356 - RNA, 64 nt, Human
caaaaucuaauuuagcauucugagaugagugucagguuuucaggagagaaugaguuggggugag

SEQ ID NO: 191357 - RNA, 64 nt, Human
agcauaucucuguuugcaugguuugcaggaggucgguuuucauggucauucaguuccacagauc

SEQ ID NO: 191358 - RNA, 64 nt, Human
acuuggaauauaaauaauuuuauaauucaacaaagguuuucacauuuuauaagguugauuuuuc

SEQ ID NO: 191359 - RNA, 64 nt, Human
uuaaguuugucacugugacaacacaggaaaaguugguuuucaggugagauugaaaaugaagcaa

SEQ ID NO: 191360 - RNA, 64 nt, Human
gagcuuugguuguguucuuguuaguccuaauauugguuuucaguuuggaauuaauaaagcaguu

SEQ ID NO: 191361 - RNA, 64 nt, Human
agguuuagagcccauguugagucuucuuuucauggguuuucauaauauuuuaaaacuauuuguu

SEQ ID NO: 191362 - RNA, 64 nt, Human
augccaccagaacuuacgauucuucacuucuugggguuuucaguaugaaccuaacuccccaccc

SEQ ID NO: 191363 - RNA, 64 nt, Human
caggccagggguugauuugaaacgugaaggauuggguuuucaggcccucugcuccaccccuccu

SEQ ID NO: 191364 - RNA, 64 nt, Human
aaaaucgaacaaaacauagccuuucuuuuccgaugguuuucaaacugauuauuuuuaaaagaga

SEQ ID NO: 191365 - RNA, 64 nt, Human
aggaugccacugacucugcuaugugauuuaucaggguuuucaucuacugacuucuuucucauua

SEQ ID NO: 191366 - RNA, 64 nt, Human
uaaccacuuugaugucaguacaacuucagcaauugguuuucaaaauagaugagaauaugguaca

SEQ ID NO: 191367 - RNA, 64 nt, Human
guuauaguucauaguuggaaauauuugcguaaaugguuuucaacaagccugaaaguaauuucaa

SEQ ID NO: 191368 - RNA, 64 nt, Human
gcucugcauguuacauaagauaaaugugcugaaugguuuucaaaauaaaaaugagguacucucc

SEQ ID NO: 191369 - RNA, 64 nt, Human
ggcaggaacugggguggcuaucaauauuggauggcgaggacagcguggcacuggcugcgagugu

SEQ ID NO: 191370 - RNA, 64 nt, Human
gaccaugccgaccacaaaggugucugcggaaacucgaggacauucaccacgaugauuuuccucu

SEQ ID NO: 191371 - RNA, 64 nt, Human
ugggagcaggcccagugggaggcuguggacaccccgaggacaguguccugucucgaggcagggc

SEQ ID NO: 191372 - RNA, 64 nt, Human
ccuacucugggcugcugaacacuggugcuguggugguuuucaagguuaauuccuaggcuaaccg

SEQ ID NO: 191373 - RNA, 59 nt, Human
ugugguuugacucuccuuagaaccaccgcccaccagaaacauaaaggauuaaaaucaca

SEQ ID NO: 191374 - RNA, 59 nt, Human
guggugggggggacaaaagacaaaaaaauccaccagagcuuuguauuuuuguuacguac

SEQ ID NO: 191375 - RNA, 59 nt, Human
gggagacuguagagaaaaugaaaaaagauccaccagaggacaucuuggggagggggagg

SEQ ID NO: 191376 - RNA, 59 nt, Human
ggugcacagacaagcccuugagaagccaaccaccagaugcuggacacccucuucccauc

SEQ ID NO: 191377 - RNA, 59 nt, Human
guauuagcuacccauuauucucgcacuaaccaccagaagacuugaaaaucuuaaaaaaa

SEQ ID NO: 191378 - RNA, 59 nt, Human
agcacugggaaguaaugggguguggggugccaccagaccaacacccccagacuucccca

SEQ ID NO: 191379 - RNA, 59 nt, Human
gcaggggaauuucccaguguccuaguuuuccaccagaggaauauguguaaguagcaaag

SEQ ID NO: 191380 - RNA, 59 nt, Human
ucaucuuccccuccaagggggcagaaauuccaccagaaaucaccacauauuuggaaucu

SEQ ID NO: 191381 - RNA, 59 nt, Human
cucuggggagcucauggguggaggagucuccaccagagggaggcucaggggacugguug

SEQ ID NO: 191382 - RNA, 59 nt, Human
caacucacuuccagugcccaaaagggcacccaccagaaauuccaguaaauccucauuug

SEQ ID NO: 191383 - RNA, 59 nt, Human
ccagauugaccuuauaaauaaaagaaugcccaccagauugaaauccuagaaauacagaa

SEQ ID NO: 191384 - RNA, 59 nt, Human
gagagagccuggaucucuggccccaacccccaccagaccucaugcccuggacacugcug

SEQ ID NO: 191385 - RNA, 59 nt, Human
caccccaucgcccagcaccccugcugauaccaccagacagagagagagagcacuugauu

SEQ ID NO: 191386 - RNA, 59 nt, Human
aggaugggacgaugugcccagggagggacccaccagagcacaagagaagguggcuaccu

SEQ ID NO: 191387 - RNA, 59 nt, Human
aaaguauuacuuggaaaugaggcaucagaccaccagauguuaccgcucgguugaaugug

SEQ ID NO: 191388 - RNA, 59 nt, Human
uuuuuuuuaaguacauugauguugauguuccaccagaaacaccuuaaguguauacuguu

SEQ ID NO: 191389 - RNA, 59 nt, Human
uccuuucuuuccucaccccaaccuuuacuccaccagagaaacuuccuuuugaacucagu

SEQ ID NO: 191390 - RNA, 59 nt, Human
ccccuggggugugcugugucccaccuggcccaccagaggcucacgacgauggcaccuga

SEQ ID NO: 191391 - RNA, 64 nt, Human
ugauaaauuugaauccaaaauccuuuuaacuauggguuuucaacuacauguuucuuccuagcgg

SEQ ID NO: 191392 - RNA, 64 nt, Human
uagaagucuugggaaacuauucgaguaucacagagguuuucaaaagcccuuauggugacaucua

SEQ ID NO: 191393 - RNA, 64 nt, Human
uaaaauuauuucugaauacaguuggagauaggcugguuuucaugaggaagcuggcuuggcuuua

SEQ ID NO: 191394 - RNA, 64 nt, Human
ugaaaaugguuagaauaaaacuaugacucuauaagguuuucaaacaucugaggcaugauaaauu

SEQ ID NO: 191395 - RNA, 64 nt, Human
uccucccaacagcugucuccaguucuaguuccuugguuuucaggcacagugggggauguucugc

SEQ ID NO: 191396 - RNA, 64 nt, Human
auccuaacuugcccauauucuaaaucaucugguugguuuucagccuagaauuugauacgcuuuu

SEQ ID NO: 191397 - RNA, 64 nt, Human
gggccaucuugguuuucuucuggaugugcucuuugguuuucagaagacugugacaaguucuggc

SEQ ID NO: 191398 - RNA, 64 nt, Human
cuugcagauucuaagauuacauuguaaaauuccagguuuucauaauguuaaaauaggaaaguag

SEQ ID NO: 191399 - RNA, 64 nt, Human
uccuauucuguuaguacuuauuagaggaggagaugguuuucauugcauagugacauuuucuuag

SEQ ID NO: 191400 - RNA, 64 nt, Human
auuccauuaaauccauacuaggagcgucagugaggguuuucauagcuuuuggaaauacuuuggu

SEQ ID NO: 191401 - RNA, 64 nt, Human
ggggaugggaggugguguguguuuuucuccucuugguuuucauuugcucaagcacacaaaaggg

SEQ ID NO: 191402 - RNA, 64 nt, Human
accuccacacugacuaggguaguggggugcauuugguuuucaaauuggguacuuuuaacacuuu

SEQ ID NO: 191403 - RNA, 64 nt, Human
uuauuuagaaacaaugugucuaguuuaagaaagugguuuucaguauugugacaauacaacguuu

SEQ ID NO: 191404 - RNA, 64 nt, Human
aaggaaccccuugguagauauuaaccuuaaaaaggguuuucauucucaaacaagaugcuuuguu

SEQ ID NO: 191405 - RNA, 64 nt, Human
guacaugccauccauuauuuuaaauaaacuaauagguuuucagaauuaugaauuuuucagaacu

SEQ ID NO: 191406 - RNA, 64 nt, Human
uauccacagugguaaucuaauaccuuaccucacagguuuucauucuuuugaacucuggugcacu

SEQ ID NO: 191407 - RNA, 59 nt, Human
aaaguucuagucacuucuguuggccugagccaccagauuaugauguugccagaauucac

SEQ ID NO: 191408 - RNA, 59 nt, Human
guacugguuuauguggacaagccauuauaccaccagacugcaaugccaguuuccucuac

SEQ ID NO: 191409 - RNA, 59 nt, Human
ugucagugaaaaauaauuacccacaaaugccaccagaacuuacgauucuucacuucuug

SEQ ID NO: 191410 - RNA, 64 nt, Human
gcacucucaacaugaguagcgaacacuuaaauuggguuuucaacagucccagcuuucacugcca

SEQ ID NO: 191411 - RNA, 64 nt, Human
ucucuuggccccucucuaccccuuacugggauccgguuuucauuuuccgguccuuuugccauac

SEQ ID NO: 191412 - RNA, 64 nt, Human
aguuuauauucugucacaggauuaauuaauugccgguuuucauacucuagaaggcugaaacuga

SEQ ID NO: 191413 - RNA, 64 nt, Human
auuucacaugccuucaagacugaacaccgacuaagguuuucauacuauuagccaaugcuguaga

SEQ ID NO: 191414 - RNA, 64 nt, Human
caggguuuguuccaaugcauccgugauuugaaccgguuuucauuauagauuaaugaacugcugg

SEQ ID NO: 191415 - RNA, 64 nt, Human
ucugucuaucaugggcaguauuagaaaacacacugguuuucacuaucugguuuacaaacacuau

SEQ ID NO: 191416 - RNA, 64 nt, Human
cuggucaugugagacauuuccagaaaagcauuaugguuuucagaacacuucaaguugacuuggg

SEQ ID NO: 191417 - RNA, 64 nt, Human
gaagcucuuugacgguuugaauacuauggcucaagguuuucauaugcagcucggauggacauuu

SEQ ID NO: 191418 - RNA, 64 nt, Human
cagagaggaauucucuuuguagucggcuugucaggguuuucaaguuuuucuaugguuauuuuua

SEQ ID NO: 191419 - RNA, 64 nt, Human
uauuuuccugaccaagacugagggaugggcuggagguuuucaacuuugcuacccaaauaaauug

SEQ ID NO: 191420 - RNA, 64 nt, Human
uuaugucaggaccaaaaugagcaauacagauuacgguuuucaaaccagaaugcacauaagaacu

SEQ ID NO: 191421 - RNA, 64 nt, Human
cagggaaauccuucagcaauucuaauccacuuuggguuuucagcuguuuuuacaucuaaagcaa

SEQ ID NO: 191422 - RNA, 64 nt, Human
gcuguuccuuuucaccuaacuguucagucauucugguuuucaagcagugcuuuaucucaugucc

SEQ ID NO: 191423 - RNA, 64 nt, Human
ggcauuucuugucuuauuucuuuccagagaacgugguuuucauuuauuuuucccucaaaagaga

SEQ ID NO: 191424 - RNA, 64 nt, Human
ggcugaaacuugaccacacuauugcugauuguaugguuuucaccuggacaccguguagaaugcu

SEQ ID NO: 191425 - RNA, 64 nt, Human
gggguucccagcaccucagccacauugcaugcuggguuuucauugucauuguugcaaaugaaau

SEQ ID NO: 191426 - RNA, 59 nt, Human
cauguguuuuugugccauaacaacuauugccaccagaauaacuuuuuuuuugcaacugu

SEQ ID NO: 191427 - RNA, 59 nt, Human
accccugaccacccccuggguccugucccccaccagagccccagcuccugucugugggg

SEQ ID NO: 191428 - RNA, 59 nt, Human
guucccagcuggccugagcagggggccugccaccagacccacccacgcucugacgagag

SEQ ID NO: 191429 - RNA, 64 nt, Human
aagaaacccauccagcugucaugguauguuacaagguuuucagcagacuuugcuccuaauggcu

SEQ ID NO: 191430 - RNA, 64 nt, Human
ugcuauuuuuaauuuagaacuuugaccuaauuuggguuuucaaaaccauuuuggcuacuuguau

SEQ ID NO: 191431 - RNA, 64 nt, Human
cuuaccuaggauucucauuauagaugcuuaucuagguuuucauaaaugggaauguaacaauauc

SEQ ID NO: 191432 - RNA, 64 nt, Human
aucaucaucaaaagauuaaauuauguuuggguuagguuuucaagcuaagcuuauugaauucuuu

SEQ ID NO: 191433 - RNA, 64 nt, Human
cugauuuguauugagcauuucaauauuauugaaugguuuucauuuuaaucugcaaugucucaua

SEQ ID NO: 191434 - RNA, 64 nt, Human
uuugaagagcacauucuccucagugagcucaugagguuuucauuuuuauucuuccuuccaacgu

SEQ ID NO: 191435 - RNA, 64 nt, Human
aauuuugauuuuaaagaauuauauuggauaaggugguuuucaccauaagcuaauuuacucucug

SEQ ID NO: 191436 - RNA, 64 nt, Human
guuuaacuuauaauauugagugauccaugaaguagguuuucagagcaauauucuucugcauuau

SEQ ID NO: 191437 - RNA, 64 nt, Human
ccuggcuaacuuuuuuguauuuuuaguagagacggguuuucaccguguuagccaggauggucuu

SEQ ID NO: 191438 - RNA, 64 nt, Human
guuugaagcacagugaucaaguuauuuuuaauuugguuuucacauuggaaacaagucagucauu

SEQ ID NO: 191439 - RNA, 64 nt, Human
cacccagcuaauuuuuguauuuuuaguagagacagguuuucaccauguuagccaggcuggucuc

SEQ ID NO: 191440 - RNA, 64 nt, Human
ccccaaggcuuugcacagugccuugcucauaguagguuuucaauaaaugauuauuaaauaaaua

SEQ ID NO: 191441 - RNA, 64 nt, Human
caccauggcaggauuccacauuucauagaauacagguuuucaagcaaaccccuguugaccaugc

SEQ ID NO: 191442 - RNA, 64 nt, Human
ugggauuacaggcgugagccaccaggcccugccugguuuucaaauucagaaaucuuauuauuua

SEQ ID NO: 191443 - RNA, 64 nt, Human
aaaguuagacaaccaaagacgacuuuaguggacugguuuucaaaacuugagcagcugaaaagca

SEQ ID NO: 191444 - RNA, 64 nt, Human
uggauaaacuaccuucccaaaagagaacaucagagguuuucauugcugaaaagaaaaucguaaa

SEQ ID NO: 191445 - RNA, 59 nt, Human
gcuuaagaugggugcuuccuuguacccggccaccagaaaaccccuggaacuccucuuuc

SEQ ID NO: 191446 - RNA, 59 nt, Human
gauguaagaggagagaggaauccacaggaccaccagagaggagagggaaccagauaugc

SEQ ID NO: 191447 - RNA, 59 nt, Human
uuacuagcauuuuaggauccagaagaauuccaccagauugcaugaguuagauugggaaa

SEQ ID NO: 191448 - RNA, 64 nt, Human
ucauguguguacuauucuaucauuauuguauaacgguuuucaaaccagugggcacacagagaac

SEQ ID NO: 191449 - RNA, 64 nt, Human
uuguauuuauugggaaaugaguaauauacaaaaagguuuucauguauuuguggcugagagggcg

SEQ ID NO: 191450 - RNA, 64 nt, Human
guuaauccagcugucuuucaagaauaaaaguugggguuuucaaggaucgccucuucuauauuuu

SEQ ID NO: 191451 - RNA, 64 nt, Human
ucugucucuaauuuaacuuauugcuagauaauaggguuuucagaugaaaagaaaacuuaaagag

SEQ ID NO: 191452 - RNA, 64 nt, Human
ggagccccauuuuaggucuuucuuuuagguuuuugguuuucauuacuccaaguaauccuugacc

SEQ ID NO: 191453 - RNA, 64 nt, Human
caacccauguaccugcugcaacugaaccagacuggguuuucaaggcucccagacguagaguagg

SEQ ID NO: 191454 - RNA, 64 nt, Human
caguuuugugguucccauuuuuagcuaguucagugguuuucaaugggcauuucugccuuuuuuu

SEQ ID NO: 191455 - RNA, 64 nt, Human
uuuguuacugauugagaauuguuacuggugaauugguuuucagguuuugagcauacauauacaa

SEQ ID NO: 191456 - RNA, 64 nt, Human
uauuuguauaauuaauuacuggcaugguuaaagugguuuucacuuuuuaaauggagaaaauuuc

SEQ ID NO: 191457 - RNA, 64 nt, Human
uugggggauuaaagaugugaagaccacagucuuggguuuucauaucuggagaagacuauuugcc

SEQ ID NO: 191458 - RNA, 64 nt, Human
aacacuuuaacacaaaguugacucuucucguaaugguuuucaucagcgcaucugcccuuauacu

SEQ ID NO: 191459 - RNA, 64 nt, Human
ugccaucuugagccugaaauauaagaaauggucugguuuucauaaugagaaggcuggaauugag

SEQ ID NO: 191460 - RNA, 64 nt, Human
uuucauaaaagcagcuuuaaauugucaguauuaagguuuucauguggaaaggugucauucaaaa

SEQ ID NO: 191461 - RNA, 64 nt, Human
uguaugcuuggaaacagcauagauauguugcugugguuuucagaauuuucucuuuuaaucacaa

SEQ ID NO: 191462 - RNA, 64 nt, Human
gcauuauucauauacauuuauuuuagccuaaagugguuuucaaauccaguucuucaagccauaa

SEQ ID NO: 191463 - RNA, 64 nt, Human
uuccuaucuggaggguacagaggugaauggcuuugguuuucauuucucuucuucacugccuuuu

SEQ ID NO: 191464 - RNA, 59 nt, Human
ugguuccuggccuugccugcagaauagaaccaccagaguccuuuaaaaaguauugcugc

SEQ ID NO: 191465 - RNA, 59 nt, Human
gcuagcacuauuguaccuugaaaggauuuccaccagacugucuugaguagugacuucuu

SEQ ID NO: 191466 - RNA, 59 nt, Human
gaauaaguuugacuuguguuuuaucuuaaccaccagaucauuccuucuguagcucagga

SEQ ID NO: 191467 - RNA, 64 nt, Human
uucuguuuuauuuaaagaaagcccaacauuaaaggguuuucauugcaagcgugcuggggagggc

SEQ ID NO: 191468 - RNA, 64 nt, Human
auuuaauauuucugcaugcuauugcaagugguaagguuuucaaaaagcuguuuucuaguuauug

SEQ ID NO: 191469 - RNA, 64 nt, Human
ugccguaggugggcuuuuagaaacuaacgggacugguuuucaaagcaguuaucuugggaaacug

SEQ ID NO: 191470 - RNA, 64 nt, Human
aauuucauuuuuuaaaagaaaucuucgaaggugugguuuucauuucucagucaccaacagauga

SEQ ID NO: 191471 - RNA, 64 nt, Human
gccaugugacccaaggagggauccuuaccaaguggguuuucaccauccucuugcucucugucug

SEQ ID NO: 191472 - RNA, 64 nt, Human
agaugucucggauaaaaguccuggauuuuccauugguuuucauaauggguguuuauaugaaacu

SEQ ID NO: 191473 - RNA, 64 nt, Human
uauauuggugauguagcagcaauuguguuggcaggguuuucauauauuauuaguaauuaacacu

SEQ ID NO: 191474 - RNA, 64 nt, Human
aaguuuuuaaauaucauccuuugucuuuccauaugguuuucauaaccaaauacaugacuauagc

SEQ ID NO: 191475 - RNA, 64 nt, Human
cucucgucguaacugcagcugaucugggcacagugguuuucacagccacugcaggauucaucuu

SEQ ID NO: 191476 - RNA, 64 nt, Human
uguauguggugaaaacuuaccacccccauacuaugguuuucauuuacucuaaaaacugauugaa

SEQ ID NO: 191477 - RNA, 64 nt, Human
cauuguuggaguuaacuaauuauccccauuucaugguuuucaguggcaacuuacugacccuugu

SEQ ID NO: 191478 - RNA, 64 nt, Human
aagagagagcagugacucucucuucuagagaagagguuuucaauaacagggcuuggaaaugaac

SEQ ID NO: 191479 - RNA, 64 nt, Human
caguauuaauccuaggugcauguguuaagauuucgguuuucaucgagcugcuuauacugauagu

SEQ ID NO: 191480 - RNA, 64 nt, Human
acuuccuuagcuccuccuuccauucugaucucaggguuuucacucuucaaacucccaaacacau

SEQ ID NO: 191481 - RNA, 64 nt, Human
ggcaacuuuuucuaaaaugcaaaaaaaagccacugguuuucaggaaaauguuccugucccugac

SEQ ID NO: 191482 - RNA, 64 nt, Human
auaguccccccuacaacauacugucauacugcuggguuuucauggguaggaaagcuuguccuga

SEQ ID NO: 191483 - RNA, 59 nt, Human
uggggacgagggccugggccgcggugaggccaccagaggcaggaguggcccuggggguc

SEQ ID NO: 191484 - RNA, 59 nt, Human
gcucucucaaguucugaaaagagaaucugccaccagaucgaauuucgaccccugagcuu

SEQ ID NO: 191485 - RNA, 59 nt, Human
ggacagaaagucagguugaaacaggaaaaccaccagacucuaaucucagcccuuuaacg

SEQ ID NO: 191486 - RNA, 64 nt, Human
auuuuaaucguauuccaaagcccaauuaugugaugguuuucagguuucugcaaauuacagaaga

SEQ ID NO: 191487 - RNA, 64 nt, Human
cauugucauuugugacaucaucuauauuaaauaugguuuucacauuaguuauuugucacuuacu

SEQ ID NO: 191488 - RNA, 64 nt, Human
aaaaauugaaaucauauguugggaaugguaaaaagguuuucaaaugguuuauuuuuccucuuuu

SEQ ID NO: 191489 - RNA, 64 nt, Human
gugcaaacauguacauauuuccccuagaagcaaugguuuucagccuugguggugaccuuauaga

SEQ ID NO: 191490 - RNA, 64 nt, Human
ggggcuuuuguuuccguugcuguuuaucgaugcugguuuucagaauuccuguguggcccuccug

SEQ ID NO: 191491 - RNA, 64 nt, Human
uccugcguaauggcagcaugaggacuuaaaaggugguuuucauuuugaagauggcuauguagcu

SEQ ID NO: 191492 - RNA, 64 nt, Human
cuggaauauagagaacacuugagaaguuuguaaugguuuucauuugaaauagacugcugaaagu

SEQ ID NO: 191493 - RNA, 64 nt, Human
aacuucggugccuaaagccuccuguuccaccucagguuuucacaggugcucccaccccaguuga

SEQ ID NO: 191494 - RNA, 64 nt, Human
uuauuagaguccgaaaguauuuuuauaaguuacugguuuucacccacgcuuuugugggagagaa

SEQ ID NO: 191495 - RNA, 64 nt, Human
uuagggaaagcaacaaccaucccuguaagccauggguuuucaugcggaggaaggagagggcuag

SEQ ID NO: 191496 - RNA, 64 nt, Human
uuuguuuacaagaagaaauuuaaacucuacguuugguuuucacauacagcagcucuauugaaua

SEQ ID NO: 191497 - RNA, 64 nt, Human
gugaggugacagauuggcagggcccaaggccccagguuuucauuuuucaugagaaaagcuuucc

SEQ ID NO: 191498 - RNA, 64 nt, Human
gucuauaaauuuugaaugauacugugccuuaauugguuuucauaguuuaaguguguaucauuau

SEQ ID NO: 191499 - RNA, 64 nt, Human
auuguuacucacacuuaugucuuacuggguugcugguuuucaucguaacacagaacgagguuau

SEQ ID NO: 191500 - RNA, 64 nt, Human
gguaugucucaugaauguucacacagaaggaguugguuuucaugucaucuacagcauaugagaa

SEQ ID NO: 191501 - RNA, 64 nt, Human
aggaagccucucccuugcccucuccagcucuagggguuuucaggaggcccaacugcaauaaugg

SEQ ID NO: 191502 - RNA, 59 nt, Human
uuugauuuuaugaaguauauacccuuuacccaccagagacaguacagaaucccugcccu

SEQ ID NO: 191503 - RNA, 59 nt, Human
gaugucccagugcucaccagcccugcagcccaccagacgucaggcccugacuccucugg

SEQ ID NO: 191504 - RNA, 59 nt, Human
uugccuuugagaaaagaagggcugcaaugccaccagagaacgugaugucagacaccauc

SEQ ID NO: 191505 - RNA, 64 nt, Human
gcaccacagauaagccugaaacagccucuccaaggguuuucaccuuagcaacaaugggagcugu

SEQ ID NO: 191506 - RNA, 64 nt, Human
cucaacuugcugggacacugacaggcguuccugagguuuucagccacuuaggcucguugcgguu

SEQ ID NO: 191507 - RNA, 64 nt, Human
gguuggagggcugggugcagccugggaguccgaugguuuucagcaggagacgggguguccccug

SEQ ID NO: 191508 - RNA, 64 nt, Human
uuuugggagguuguugugggagaugguugauuuagguuuucaaaagcuagaaauaaaauuuaca

SEQ ID NO: 191509 - RNA, 64 nt, Human
aaauucauguaagacuuuuuaagaguauuuuuuagguuuucacucaaucuuuccugucacagua

SEQ ID NO: 191510 - RNA, 64 nt, Human
uuaaaucaugcaaccuuuccuuaggaagacauuugguuuucaucaugauuaagaugauuccuag

SEQ ID NO: 191511 - RNA, 64 nt, Human
auuauacuucaugagucuuagcaauaugggagcagguuuucacugaauucugagggugccucug

SEQ ID NO: 191512 - RNA, 64 nt, Human
uggguaccuggagauucugaagugccuuugcugugguuuucaaaauaauaaagauuuguauuca

SEQ ID NO: 191513 - RNA, 64 nt, Human; identical to SEQ ID NO: 191511

SEQ ID NO: 191514 - RNA, 64 nt, Human
cucccugugcaagggaucaagcaugucuggccuggguuuucaaaaaaagagggauccucaugac

SEQ ID NO: 191515 - RNA, 64 nt, Human
auuaaauucuucccccuuuaaaaaaacaguuagugguuuucacuauuuauaaaaaauuaauuuu

SEQ ID NO: 191516 - RNA, 64 nt, Human
ggaaguugcaauaaaaauuccuuaugaaauauaugguuuucaucuguaauugaaggaaaucaua

SEQ ID NO: 191517 - RNA, 64 nt, Human
acacaucccagcccaauccagguacgcacagacagguuuucacauaaaugcagcccauuucucc

SEQ ID NO: 191518 - RNA, 64 nt, Human
cugaccacuuggaagaaacaccuugguuaucugugguuuucaugccuugucccugccucuaccc

SEQ ID NO: 191519 - RNA, 64 nt, Human
uuucuuugucuuaaaauuguuucuccuuaucuuugguuuucagcagucugugcugugccuggau

SEQ ID NO: 191520 - RNA, 64 nt, Human
aagucuuuuguauguuucucagaacuauuuuugugguuuucaguaaaguguucuugcacauccu

SEQ ID NO: 191521 - RNA, 59 nt, Human
gguuuauucucugauagacugagcuccuuccaccagaaggcacugccugcaggaagaag

SEQ ID NO: 191522 - RNA, 59 nt, Human
uguuuucuauucuuuauuuuuccugcaacccaccagaccccaggccucaccggaggccc

SEQ ID NO: 191523 - RNA, 59 nt, Human
cuggaagcccuggagacccucgcccaacuccaccagauagcagagggguaagagaggau

SEQ ID NO: 191524 - RNA, 64 nt, Human
uuuacacuuuaaauuaguaauucuuuguuugcaagguuuucaucccuaugcuguuguuuucuac

SEQ ID NO: 191525 - RNA, 64 nt, Human
ucccaaggccugguuggucaaacucugggcaaaggguuuucaggaugaggaggucaagacagga

SEQ ID NO: 191526 - RNA, 64 nt, Human
cuucauaggucccaacuccaucuccaaggccaaggguuuucaccccucagucaucaccagcgau

SEQ ID NO: 191527 - RNA, 64 nt, Human
ugaauuaaacucuguucuggugccugagcucagggguuuucagagaaugaauaagagacugucc

SEQ ID NO: 191528 - RNA, 64 nt, Human
gguaaaaugccaugaugccucugucuucuggacugguuuucacauuagaagacaauugacaaca

SEQ ID NO: 191529 - RNA, 64 nt, Human
gguaaguacaguauuucaagagcacgcuaagggugguuuucauuuuacagggcuguugaugaug

SEQ ID NO: 191530 - RNA, 64 nt, Human
ucacagagguuucagggggacccaaaucacugcugguuuucaauuuuuuuuuaacaauacauuu

SEQ ID NO: 191531 - RNA, 64 nt, Human
aggucucagucucguuucugaguagcagcaauaggguuuucaucauucaucauagugacaacug

SEQ ID NO: 191532 - RNA, 64 nt, Human
cauuggauagaaaucuguuugaaggaauuuuccugguuuucagaugaagccauaaggcuuugga

SEQ ID NO: 191533 - RNA, 64 nt, Human
uauaugcaucugauuugaaaggaguauugaggaagguuuucauauaugaucuaucuuuggauua

SEQ ID NO: 191534 - RNA, 64 nt, Human
cuguauaauugcaccaaaguacauuugaaaggaagguuuucaauaguguaauacugcagcgaug

SEQ ID NO: 191535 - RNA, 64 nt, Human
cagccagugaggccaggaaagaaauuggucuugugguuuucauuuuuuucccccuugauugauu

SEQ ID NO: 191536 - RNA, 64 nt, Human
aaucagcugaguugagacuuuggaauaagacacugguuuucaugcgcuguuuuuguuuuaaagu

SEQ ID NO: 191537 - RNA, 64 nt, Human
ccgccacuggccacucgcuggcgacccgauggaagguuuucaggcuccucacaaaggagagagg

SEQ ID NO: 191538 - RNA, 64 nt, Human
uuugacaauuauuagugugaccaaaguauuaggcgguuuucauacauuuuucaccuuguacaaa

SEQ ID NO: 191539 - RNA, 64 nt, Human
ccgaagcaugcuaauuguuuacuguaccuugugagguuuucacucauaaauuuaaaccagugua

SEQ ID NO: 191540 - RNA, 59 nt, Human
ggggcucugcaggucacuugggacggacgccaccagacuugucuccaaaaaucaccacc

SEQ ID NO: 191541 - RNA, 59 nt, Human
aguuggggcaggugcaauuccaagcauaaccaccagauggcagagugaccgcgcauacc

SEQ ID NO: 191542 - RNA, 59 nt, Human
cuuucuuauacagaugguguccauuugcuccaccagacaggaguuaaaaaccuuuaaag

SEQ ID NO: 191543 - RNA, 64 nt, Human
cauugagcccuugguugccugggcccaggcuggggguuuucaguauuuguaagcauuucagcag

SEQ ID NO: 191544 - RNA, 64 nt, Human
gguuuggugugaccgcuuggcggcuggugggugggguuuucaagugggugacggcgcucuccgg

SEQ ID NO: 191545 - RNA, 64 nt, Human
cugugggaagcucccagaguuugguuuggucccugguuuucagucuugcugagacucugucugg

SEQ ID NO: 191546 - RNA, 64 nt, Human
gaacugccaagcccagaaguaccuuugcacuccugguuuucaguggacagaggaagcuuuagau

SEQ ID NO: 191547 - RNA, 64 nt, Human
guguucuuacuuuagaaacugagacuuuauuugugguuuucacacuauuucagcagcaaaaacu

SEQ ID NO: 191548 - RNA, 64 nt, Human
aauacggaacagaccuaugcucuaagcaaaauuagguuuucaaaaaugugagaacaguacaaag

SEQ ID NO: 191549 - RNA, 64 nt, Human
gguggcuuucuucuugaacccaccuguguaaagagguuuucaguuccguggguuuccccuuuga

SEQ ID NO: 191550 - RNA, 64 nt, Human
aaggggaggaaggaggucacaccaauaugaugaugguuuucaugacuuugaaugauauauuuuu

SEQ ID NO: 191551 - RNA, 64 nt, Human
aacaccucagagcuguccucuucucuagaguggagguuuucaaagugcaucaucagcauuaccu

SEQ ID NO: 191552 - RNA, 64 nt, Human
uucaauaaaccuuccaggcugcaauaaccagcaagguuuucaguuaaagcccuaucugcacuuu

SEQ ID NO: 191553 - RNA, 64 nt, Human
uugcagaaacugcugcuaacuuuuaaaguuguuugguuuucaaggcacugauaauggauaugua

SEQ ID NO: 191554 - RNA, 64 nt, Human
gcuuaaagcuucuuguccauggcuuuuguuugaugguuuucaauagaggugacugagauuguag

SEQ ID NO: 191555 - RNA, 64 nt, Human
cccaggcccucugcugagcgguacuaaacggucggguuuucaaucacacugaauuggcaggaua

SEQ ID NO: 191556 - RNA, 64 nt, Human
ugacuggguaauaagugugaaaauuuuaauuugugguuuucauuuauuaaugucugcccaucug

SEQ ID NO: 191557 - RNA, 64 nt, Human
uaauuacccaugguagccaacccuacaaaagacagguuuucacaaauugagguggaggugggcg

SEQ ID NO: 191558 - RNA, 64 nt, Human
uagaaaagagaacaaacugcagguuuagaaaaaugguuuucauauucaccauucuuccaccuca

SEQ ID NO: 191559 - RNA, 59 nt, Human
aucuuaggaucccaucagcuucccaucccccaccagacagccacaguacccucacuuuc

SEQ ID NO: 191560 - RNA, 59 nt, Human
uuuuccaacagacauuuaaagucugaaguccaccagaacuuggaagaaagcuguuaacu

SEQ ID NO: 191561 - RNA, 59 nt, Human
ugaguuagggcuccuuuuccccuucccucccaccagauugcucucccaccuuucauuuc

SEQ ID NO: 191562 - RNA, 64 nt, Human
aaaaccugucuccauuugcuauccugauaauuaagguuuucauaauaccuagggccugucucug

SEQ ID NO: 191563 - RNA, 64 nt, Human
gagauaguaaaacacuuauucccucauccuuucagguuuucagguugcccauuuauauucauuu

SEQ ID NO: 191564 - RNA, 64 nt, Human
ccugggaagggcuggaauaggauagaaagcuggggguuuucagagcccuauguguggggagggg

SEQ ID NO: 191565 - RNA, 64 nt, Human
ugacgcuugcaaacugucugaauuugccaugcaagguuuucaaacaauuugcauguuuuucaga

SEQ ID NO: 191566 - RNA, 64 nt, Human
ugaacacuguugacagugaagaacuuuucuuaaugguuuucaguauaacuaauaaggaugugaa

SEQ ID NO: 191567 - RNA, 64 nt, Human
ggucagacugcucgcugguggccucgcuuuagaagguuuucaucaagccccgcccuuucucucu

SEQ ID NO: 191568 - RNA, 64 nt, Human
augugugugucacaucacauauugugcagcuguugguuuucauguagugcccugcgauggaaau

SEQ ID NO: 191569 - RNA, 64 nt, Human
cccggcagcccccaggaaucaaggauagggcuaagguuuucaccuuaacugugaaggcaggagg

SEQ ID NO: 191570 - RNA, 64 nt, Human
acgaguuuuauauaauuaauuuaaauuuguuacagguuuucauguucaggauaaaccauacuuc

SEQ ID NO: 191571 - RNA, 64 nt, Human
caccaugcccacauacaacauaccuaucagaaaugguuuucauuaagggaguagaauagucacu

SEQ ID NO: 191572 - RNA, 64 nt, Human
agcuacucacccgcuauuagaguauggaggaagggguuuucauugcauugcauuucugaaacau

SEQ ID NO: 191573 - RNA, 64 nt, Human
gugucgggcucauuuugcucaacaugguauuugugguuuucagccuuucuaaaaguugcauguu

SEQ ID NO: 191574 - RNA, 64 nt, Human; identical to SEQ ID NO: 191573

SEQ ID NO: 191575 - RNA, 64 nt, Human
guucaacuauccuugccacuggaagaccaaacaagguuuucacugcuuuuucuuuuacauaaua

SEQ ID NO: 191576 - RNA, 64 nt, Human
uggagugcauaaauuagaaacuucuaagugcacugguuuucaaagagauauauauaaugcauuu

SEQ ID NO: 191577 - RNA, 64 nt, Human
gggcugccugugugcacuacucuuuguguuccuggguuuucaauaaacuugccaagcucaccuc

SEQ ID NO: 191578 - RNA, 59 nt, Human
cugcagaugcuuaccuaccacggccgucuccaccagaaaaccaucgccaacuccugcga

SEQ ID NO: 191579 - RNA, 59 nt, Human
aaauauauaauauguaauuuuuuuaaaaaccaccagauacagaaaugugcuuuaacauc

SEQ ID NO: 191580 - RNA, 59 nt, Human
gagggcuuggggcugcaccuccuacccucccaccagaacgcaccccacugggagagcug

SEQ ID NO: 191581 - RNA, 64 nt, Human
cacaguacaauguuucagaagccccauuugcacagguuuucagcaacucagaaugcucuacuuc

SEQ ID NO: 191582 - RNA, 64 nt, Human
aaucuauuuucagauuauaaaaggugucuuuacugguuuucauuccuuuuaucuacauguaauu

SEQ ID NO: 191583 - RNA, 64 nt, Human
uggugcaacaugcuuuauggcuccugucaaaauugguuuucacucauuugauugguuugagccc

SEQ ID NO: 191584 - RNA, 64 nt, Human
auauuaggacugacaacuucagcucuuuuguuuagguuuucaauuauuuuugguaagaguaugu

SEQ ID NO: 191585 - RNA, 64 nt, Human
uuguggcuauguugaagguaucacuugucuugaggguuuucaauauuucaggaucaugcuggug

SEQ ID NO: 191586 - RNA, 64 nt, Human
uuguuuuucugauguuccaaaaacaacguaacuugguuuucauguguuuuuccgugguauaugu

SEQ ID NO: 191587 - RNA, 64 nt, Human
uuuucaaguuuugaagggaauuugagguugaucugguuuucaagauguaguuaaaggaauaaau

SEQ ID NO: 191588 - RNA, 64 nt, Human
gaaguguuuacaaugccuuuuuucccccaguauugguuuucaauaccuguuuucauauacaauu

SEQ ID NO: 191589 - RNA, 64 nt, Human
uauauuuauuuuucauuuaguuuuuauugggaaugguuuucaaagaacucucaguucugccuag

SEQ ID NO: 191590 - RNA, 64 nt, Human
aagaacauguauuugaaggaaggucuaaccaggggguuuucaggggcauugucugaccacauuc

SEQ ID NO: 191591 - RNA, 64 nt, Human
auguggaaaaaagugaaugagaccucugauaggggguuuucagaaccuuguucacaccaaaaug

SEQ ID NO: 191592 - RNA, 64 nt, Human
auauauauauauauauauauauauaguuuuacuagguuuucauggauaaguuuuuaaauguaag

SEQ ID NO: 191593 - RNA, 64 nt, Human
cucuccacuuguaugggaacuacauuucacucuugguuuucaggauauaacagcacuucaccga

SEQ ID NO: 191594 - RNA, 64 nt, Human
uguuuugaaaaggugcucaagcucugacauuuuugguuuucauagucgugaaguauuuaucauu

SEQ ID NO: 191595 - RNA, 64 nt, Human
ccuugugguuaugguuuggcguuuccuucuguuugguuuucagagccccaugucuauauagucc

SEQ ID NO: 191596 - RNA, 64 nt, Human
uuauggauucuggugguagggguuguuugguuuugguuuucacugucucugucucaucuaguac

SEQ ID NO: 191597 - RNA, 59 nt, Human
gguguccugucagcuuccucuuuaggaacccaccagagggcagcaagcuccuuucacuu

SEQ ID NO: 191598 - RNA, 59 nt, Human
cccaaagacccuucaaccuccccagucccccaccagacccacccucucccugaaucuac

SEQ ID NO: 191599 - RNA, 59 nt, Human
uccucggguggguccagcaggggcccugcccaccagaacacaguccgugcugugcugcg

SEQ ID NO: 191600 - RNA, 64 nt, Human
ggucucugacuugcucaggacaaacuaggccagugguuuucaaacugcuuggcagagcccugaa

SEQ ID NO: 191601 - RNA, 64 nt, Human
ggaagcugguguccugucauuuucucucaggaaagguuuucaaaguucugcccauuucuggagg

SEQ ID NO: 191602 - RNA, 64 nt, Human
accacuguuuccucaacugcccuucauaugucaugguuuucagauccauuccaaccugacugaa

SEQ ID NO: 191603 - RNA, 64 nt, Human
auagaaguaaaucauucggaugugauuuuuauuugguuuucauggaaaguuaaagugauaaagu

SEQ ID NO: 191604 - RNA, 64 nt, Human
cacauaguucuuuccccgccccgaaugugacaaugguuuucauagugguuuaauuuuguagccu

SEQ ID NO: 191605 - RNA, 64 nt, Human
cacaggccacauggccccugauggcgucccugcugguuuucaauucucugaagccuuguguagc

SEQ ID NO: 191606 - RNA, 64 nt, Human
agagacucacugccagaaaagccuuacccauuuugguuuucacuauugagaccgcaacugcuug

SEQ ID NO: 191607 - RNA, 64 nt, Human
auccuucaacaagauaaauauugcugucagagaagguuuucauuuucauuuuuaaagaucuagu

SEQ ID NO: 191608 - RNA, 64 nt, Human
ucuuuaagugaauuaauuauugauguuuuagaaugguuuucaucaguugggaucagcuauaugg

SEQ ID NO: 191609 - RNA, 64 nt, Human
ugcagcucccaccucaguuuaguuuuuaauucaggguuuucaaccuguaacacauuaaagcugu

SEQ ID NO: 191610 - RNA, 64 nt, Human
cuuaaugaacauaauuuguuaaauucucaagcaagguuuucacuuuuauauuggccauucugua

SEQ ID NO: 191611 - RNA, 64 nt, Human
uuugucucccuaaaacugaacuguaauuuugggagguuuucauuaguggaagcucuucauuuau

SEQ ID NO: 191612 - RNA, 64 nt, Human
gaugagacaaaaggccagacagaaauuggacuuugguuuucagacaugggacucucauguuaac

SEQ ID NO: 191613 - RNA, 64 nt, Human
cacaguacuucuugucaaaaugauucuccuucaagguuuucaaaaccuuuagcacaaagagagc

SEQ ID NO: 191614 - RNA, 64 nt, Human
uccuggagucuuuggaagguagucugaauagaaggguuuucaggugcaggcaucugaaagcugu

SEQ ID NO: 191615 - RNA, 64 nt, Human
uggugugugcagggaugaaacccagcaucagagagguuuucagcaaaccuuccaugcucaccuu

SEQ ID NO: 191616 - RNA, 59 nt, Human
caauccacaguccaugaaauugugacacuccaccagauuaaguuagggcauaacauuaa

SEQ ID NO: 191617 - RNA, 59 nt, Human
uaucuuaaucgacauucccaguccuuucaccaccagaaccaacuccucuuucaaacaca

SEQ ID NO: 191618 - RNA, 59 nt, Human
gggggcuucaaguacagauugggcacacuccaccagaccccagcaaggucagcugcccc

SEQ ID NO: 191619 - RNA, 64 nt, Human
guuguuuucucugaucacaacuuuucugcuaccugguuuucauuauuuucccacaauucuuuug

SEQ ID NO: 191620 - RNA, 64 nt, Human
ggugugcagugugaggcagcuccuuggcuuuccugguuuucacaacaagcuagagauuuucaaa

SEQ ID NO: 191621 - RNA, 64 nt, Human
uagaugacugccugccaacguacaacaaucaacugguuuucaccaaguccaaccaccgcaauga

SEQ ID NO: 191622 - RNA, 64 nt, Human
uaguauuuucuuucucaauucauacgcuuagauugguuuucauaugucauguuuaguguuuuca

SEQ ID NO: 191623 - RNA, 64 nt, Human
agugggaagaguugagacugaaaguuaagagaaggguuuucaagucccggcucaucucacccca

SEQ ID NO: 191624 - RNA, 64 nt, Human
agcccaggacugggagaaucgcacaugccccagggguuuucaccaaggauuuucaagacaaacu

SEQ ID NO: 191625 - RNA, 64 nt, Human
cuuaucaagcagccaagggaugaaagagaagguggguuuucaucaagacuggaagguggggaca

SEQ ID NO: 191626 - RNA, 64 nt, Human
agcaacccaugacuuccucuucucucaaguugcagguuuucaacaguuuuauaagguauuugca

SEQ ID NO: 191627 - RNA, 64 nt, Human
cugggccacagagucuacuuugaaggcaccucaugguuuucaggaugcugacagcugcaagcaa

SEQ ID NO: 191628 - RNA, 64 nt, Human
ggucacacuagcccaccccaagcuccgacauugagguuuucaucucugcagggagagguuccaa

SEQ ID NO: 191629 - RNA, 64 nt, Human
gguauacacuuuuggguuuucuguuuguuugguugguuuucauuguaggggagggauuuuuuau

SEQ ID NO: 191630 - RNA, 64 nt, Human
gcaaguagagagcugcucuagguucuugagguuugguuuucauuauuaauuuuuaggguauggg

SEQ ID NO: 191631 - RNA, 64 nt, Human
cccuuacaugccugccuacacuuaaccagauguugguuuucaaugucuaauuugucauuaguuu

SEQ ID NO: 191632 - RNA, 64 nt, Human
aaguucucuugccccaugccugcuggggacagaagguuuucaugaacucuuuuuacugaaaaug

SEQ ID NO: 191633 - RNA, 64 nt, Human
uggaaaagccaugucucacucucgaaucucagcugguuuucacugaaauuccuggagggcucau

SEQ ID NO: 191634 - RNA, 64 nt, Human
ucaccuggcugcuguggguaccagugcaggucccgguuuucaggcaccugcucagcugcccguc

SEQ ID NO: 191635 - RNA, 59 nt, Human
ggccacagcuuugcucuuugguccucaggccaccagaccccucacagcauggcccuugg

SEQ ID NO: 191636 - RNA, 59 nt, Human
aucaaauagcauucagaguauuugaauguccaccagacaccagccccggggggcacaga

SEQ ID NO: 191637 - RNA, 59 nt, Human
agcccauguguguccugguguucccagccccaccagagccccgugccgggagcugacag

SEQ ID NO: 191638 - RNA, 64 nt, Human
ugcaauuacacaauccgugcaaauggcugucucggguuuucauagaacaagacgaugacaugcu

SEQ ID NO: 191639 - RNA, 64 nt, Human
ccuuucauccugucuguguuauguggguggagaugguuuucauucuuucauuacuguuuuguuu

SEQ ID NO: 191640 - RNA, 64 nt, Human
gccuacuguaagcaugcuuggaaugacuuguuuugguuuucagcugauaggaucuaugccucug

SEQ ID NO: 191641 - RNA, 64 nt, Human
ccacucgggcugcaaaaggugaaaagcaccaagagguuuucagauggaagugagaggugacagu

SEQ ID NO: 191642 - RNA, 64 nt, Human
uaccgcucccuguuuuagauauucagauuuaaaagguuuucaaagaauuacuuucuuccauguu

SEQ ID NO: 191643 - RNA, 64 nt, Human
cagucaccucuucuacccucaucaucauagguaagguuuucaagguggcaauuggggcggagcc

SEQ ID NO: 191644 - RNA, 64 nt, Human
uucacacccaccagauuguuacuacaguggguuggguuuucauacagacguaaauuuugagaga

SEQ ID NO: 191645 - RNA, 64 nt, Human
aucauuccagauaccucuuuucuucuuuccaaaugguuuucacauguguuugaaauauuuguac

SEQ ID NO: 191646 - RNA, 64 nt, Human
aggacgccuucucccaugguuacugaucuccacggguuuucacaucucuguacugugccugccu

SEQ ID NO: 191647 - RNA, 64 nt, Human
aauuuccacacaugaucucugcaaacaggcacuggguuuucaguguccuuuuugaagggucaua

SEQ ID NO: 191648 - RNA, 64 nt, Human
uguacagaaaaaaaauguuuuggguauaaaucuggguuuucaaaaccagcuuuuuucuauauau

SEQ ID NO: 191649 - RNA, 64 nt, Human
cuggggagugguuaggcagcaagcuuugguuuaugguuuucauucauuggugaaguaaauuagg

SEQ ID NO: 191650 - RNA, 64 nt, Human
gugggaggaagggagaugaguuuuguuauuuugggguuuucaagcauuggaaccaaaggccaaa

SEQ ID NO: 191651 - RNA, 64 nt, Human
uccugcccuccggaggagcagccucgaggcuggugguuuucagagcaggaggccgacguuuucu

SEQ ID NO: 191652 - RNA, 64 nt, Human
uggauucaucauccaggagguucaaaaguaagaugguuuucaaaucauuuuugagacugguugc

SEQ ID NO: 191653 - RNA, 64 nt, Human
ucacuguccagguaggaaacaauucuuucaacuggguuuucagcauaaaugggaacugauguag

SEQ ID NO: 191654 - RNA, 59 nt, Human
cuguuguaacugcccaaggcauguuuugcccaccagaucauggcccacguggaggccca

SEQ ID NO: 191655 - RNA, 59 nt, Human
aggccucuucuccccggcacuuccgagauccaccagaucgacuugaucgugcagcugcu

SEQ ID NO: 191656 - RNA, 59 nt, Human
ucaaucaccagccaagaugguugcuuuguccaccagaggucaaguucaccucucuggug

SEQ ID NO: 191657 - RNA, 64 nt, Human
auacaaauccacaagaaacaaagaggacacggcugguuuucauugugaaagauagcuacaccuc

SEQ ID NO: 191658 - RNA, 60 nt, Human
acucacugagcuuccucugaagccuugaaggguuuucagauccaaggaacaaaggggaaa

SEQ ID NO: 191659 - RNA, 64 nt, Human
acuagccaggaggugaguuccucuuuagggcuuugguuuucauuccuuuuuguuuggcuuggcc

SEQ ID NO: 191660 - RNA, 64 nt, Human
ccuaaaucggaaccuuuuucuauguugcacacaugguuuucagaugacccagccaucuacaaga

SEQ ID NO: 191661 - RNA, 64 nt, Human
auuuuucuguuuuuaauuaaaaaaaaaaaaaaaagguuuucaguugcuuuugucucccuaggag

SEQ ID NO: 191662 - RNA, 64 nt, Human
gccgagaccgagucuccuaaguccccgucagugugguuuucaccacaggacugucucuugucgu

SEQ ID NO: 191663 - RNA, 64 nt, Human
agccacuuguuucaagaugacuacuuugggguuggguuuucaucuaaacacauuuuuccagucu

SEQ ID NO: 191664 - RNA, 64 nt, Human
cucgcucuuggaggcugcucuuuauccugccugugguuuucagcucagagcuggacuucuauuu

SEQ ID NO: 191665 - RNA, 64 nt, Human
augucuucaguuucuugaggagacuccuaguuuugguuuucaaauuacuuggagggcugccuag

SEQ ID NO: 191666 - RNA, 64 nt, Human
gacaacugacagccucauuucauuccuacaaguugguuuucaguaaucucuuccuuccccccag

SEQ ID NO: 191667 - RNA, 64 nt, Human
aauauauuccugagauuuccuccuggccuuuccugguuuucaucaggaaggaaaugacaccaaa

SEQ ID NO: 191668 - RNA, 64 nt, Human
ccgugaagcugaucugguggguauguuuauucuugguuuucaguagggaaauagcaguucagag

SEQ ID NO: 191669 - RNA, 64 nt, Human
ccgccuccaaccaguuccaccacccucuagcgaggguuuucaaugaacuuuuuuuuuuuuuuuu

SEQ ID NO: 191670 - RNA, 64 nt, Human
gguuuggcucgcccggcccgcgggcuccaccucagguuuucacuuuucgcuccggagcgagaac

SEQ ID NO: 191671 - RNA, 64 nt, Human
ugagguuagaagacugcagcuuggagucucucuagguuuucaacuauuucuucacaauuugaac

SEQ ID NO: 191672 - RNA, 64 nt, Human
cgcucugccucaagcaucccccacacagggcucugguuuucacucgcuucguccuagauaguuu

SEQ ID NO: 191673 - RNA, 59 nt, Human
ugcccagcaggaaaaucauguaaguuauaccaccagaaagcaaaaggagcaugguuugg

SEQ ID NO: 191674 - RNA, 59 nt, Human
uccgcugcuccuuuuuggaaugcgagcucccaccagaagaagguuccggcacgaauccc

SEQ ID NO: 191675 - RNA, 59 nt, Human
agccuguguaggcagucauggcaccaaagccaccagacugacaaauguguaucggaugc

SEQ ID NO: 191676 - RNA, 64 nt, Human
ucuuuuaugugauuuuuagcuaaguggugugccagguuuucagugacauaccaaauggaaauaa

SEQ ID NO: 191677 - RNA, 64 nt, Human
uguuaguguuuuagauguuugggugcuuggcuuugguuuucagggucuaacguagcuguccuca

SEQ ID NO: 191678 - RNA, 64 nt, Human
gguaaggccuccaguauuggacagcacacagaaagguuuucaucaucaagagaguucugcuggu

SEQ ID NO: 191679 - RNA, 64 nt, Human
aagaacuuggggucggggaguguguuugucacuugguuuucacuaguaaugauauugucaggua

SEQ ID NO: 191680 - RNA, 64 nt, Human
gggagccacuuuuuuuguacagggguaaguuggggguuuucagggagccuguuaggugccuccu

SEQ ID NO: 191681 - RNA, 53 nt, Human
ccgauguaaagccaugcuaaggugguuuucagauuccacacaaaaugucacac

SEQ ID NO: 191682 - RNA, 64 nt, Human
gcgcagcccugaggaggcagguggaggagcugcggguuuucacagggccgcgucgccacggcuc

SEQ ID NO: 191683 - RNA, 64 nt, Human
agauaaaagugcuuuuuauaccauccaguccugggguuuucagaugcacauucaguguugcuuc

SEQ ID NO: 191684 - RNA, 64 nt, Human
uuggccacgcugcagaaaugagcuggagcucauggguuuucagcuacauuuuucauaacuuugu

SEQ ID NO: 191685 - RNA, 64 nt, Human
gagugugaaaaguugaguaaaacuauuugcaacugguuuucagaaaagagaaaagaaacaacaa

SEQ ID NO: 191686 - RNA, 64 nt, Human
uucuuucccaguuacucagguuaugaaugaauuagguuuucaacaugggaagcaugaaauccac

SEQ ID NO: 191687 - RNA, 64 nt, Human
uuuguuuucugccccuccccccauuuauaggugugguuuucauuuuucuaagugauagaauccc

SEQ ID NO: 191688 - RNA, 64 nt, Human
uuuuggcuuuuucucccuccccaugucuguucuggguuuucacgugcuucagagaagaggggcu

SEQ ID NO: 191689 - RNA, 64 nt, Human
uuuucuuuuuaaggaagugcuguuuuuuuuugaggguuuucaaaacauuuugaaaagcauuuac

SEQ ID NO: 191690 - RNA, 64 nt, Human
agaaggugacauuuuagcuuucccagguaaaagugguuuucauccucacaccaauuuuauggac

SEQ ID NO: 191691 - RNA, 64 nt, Human
cgucauguuagaguucaaaaaguuucagauuuuggguuuucagauuaggaauacccaaccugua

SEQ ID NO: 191692 - RNA, 59 nt, Human
ggaccccccagcuggccucugaagcuggcccaccagagcugccauuugucuccagcccc

SEQ ID NO: 191693 - RNA, 59 nt, Human
uccucucugcaaugaccuucaacaaccggccaccagaugucgcccuacucaccugagcg

SEQ ID NO: 191694 - RNA, 59 nt, Human
caugggcccguucugauugaaggugaagcccaccagauuauuuuucaaagucuuagguu

SEQ ID NO: 191695 - RNA, 64 nt, Human
aagauuagaauggugcucuucacguuuugacggugguuuucaaaauguuguucuucaaccagca

SEQ ID NO: 191696 - RNA, 64 nt, Human
uuagcaccugacucagcggcagcuucugccgcuggguuuucauuucacuguggauaucccugag

SEQ ID NO: 191697 - RNA, 64 nt, Human
ggggguggggggugugaucugagugccucaagaugguuuucaaaaaaauuuuuuuaaagaaaau

SEQ ID NO: 191698 - RNA, 64 nt, Human
gggccagcauggggauggcguggcccccagggcggguuuucacuccgcugccugggcuuccaga

SEQ ID NO: 191699 - RNA, 64 nt, Human
uaguuccuuacacuauaacuguauuuggacauaggguuuucaaacaggugaguaacuucaaaug

SEQ ID NO: 191700 - RNA, 64 nt, Human
uaaacugugugggaaaacuuacuugucuccuuuagguuuucaagcacaugaaaguacucacacu

SEQ ID NO: 191701 - RNA, 64 nt, Human
uaaacaauguggaaaaaccuacauaucuucuguagguuuucaagcacaugaaagaacucacacu

SEQ ID NO: 191702 - RNA, 64 nt, Human
ccugucucauauuuuggaaauacaugacuaguuugguuuucaccgguucggagcugaagaagaa

SEQ ID NO: 191703 - RNA, 64 nt, Human
acaaaacuuugacuugacuugcgaagugaagcaggguuuucauuuuuacucuccuugguuuagg

SEQ ID NO: 191704 - RNA, 64 nt, Human
acccaacuacccccauaacuuucugcuucccacagguuuucagcauucuaucguccuguugugc

SEQ ID NO: 191705 - RNA, 64 nt, Human
aauuugcaguuuuaugucuuuuaccaaacuuagagguuuucagccuaauuucuaaaaauacuuu

SEQ ID NO: 191706 - RNA, 64 nt, Human
augccucucuacccccgugcacuuuuucugacaugguuuucaggucuaaauaguggcugcucca

SEQ ID NO: 191707 - RNA, 64 nt, Human
agaaauacuuuccucuggcaaaccccuguggcaggguuuucaguaaaauguuuugccucaucgu

SEQ ID NO: 191708 - RNA, 64 nt, Human
ugaaaugcuuuuucuccauguauugagaugaugugguuuucaucuuucauuauguucaaguggu

SEQ ID NO: 191709 - RNA, 64 nt, Human
gagagaaaccauacaaguauaauaaauguggcaagguuuucagucacaauucacuccuacacag

SEQ ID NO: 191710 - RNA, 64 nt, Human
acgaguacaccacaccaugcccggccaaauacuugguuuucaguaccacaagagcuaugagcug

SEQ ID NO: 191711 - RNA, 59 nt, Human
aguucaaaccuuugccucaaagccaucccccaccagacugcuuagcgucugagauccgc

SEQ ID NO: 191712 - RNA, 59 nt, Human
ggcagcaccaggggacacaccugccaaacccaccagauggaggggcccucccuggucuc

SEQ ID NO: 191713 - RNA, 59 nt, Human
ccccaggucccugcgcagccaccagggccccaccagaccauggguuccuuauucuggac

SEQ ID NO: 191714 - RNA, 64 nt, Human
auguagaggaccuaccaagcccacugagggacuagguuuucaugucucuagucauaccuagaau

SEQ ID NO: 191715 - RNA, 64 nt, Human
guuucagcccugagauguuacaguugaagagcuugguuuucauugagcauuucucuauuuuucc

SEQ ID NO: 191716 - RNA, 64 nt, Human
ggcuuaguccuuaucucccuacggggcuugccuugguuuucagucuucucucucuuucucucuu

SEQ ID NO: 191717 - RNA, 64 nt, Human
ggcgagaagccgcggcggggccagcuugccugccgguuuucaggaaucuaaacucucaucuugu

SEQ ID NO: 191718 - RNA, 64 nt, Human
cccuauuauuugcccuaggcuuucuccuaaugaagguuuucauuugccauucauguccuguaau

SEQ ID NO: 191719 - RNA, 64 nt, Human
acaccuggcugauuuuguauuuuuaguagacacggguuuucaccauguuggucaggcuggucuc

SEQ ID NO: 191720 - RNA, 64 nt, Human
aaccagauugcaagauuccugaaauuuaacaauugguuuucagggcccaguccaagccugcugc

SEQ ID NO: 191721 - RNA, 64 nt, Human
guucacacugccacguaugucuacguggauuuuugguuuucagcuucccccaccccacuggcuc

SEQ ID NO: 191722 - RNA, 64 nt, Human
gugucauuccagcauuccucucagaagggagagagguuuucaggcuggugccaugcgauuggaa

SEQ ID NO: 191723 - RNA, 64 nt, Human
gggacucgcuguugccauccucuuuguuguaucugguuuucaucacuagacucagcaacccuuc

SEQ ID NO: 191724 - RNA, 64 nt, Human
aucuauagccacagccugaagcuuugaccacugcgguuuucagagcccuuucuccacacucauu

SEQ ID NO: 191725 - RNA, 64 nt, Human
ccuacuauaauagaaauucuguuuuguuuucugugguuuucaaguuaaaaaaaaaaaaguuaaa

SEQ ID NO: 191726 - RNA, 64 nt, Human
uuacaucucucuuagacuccgcucuuguucuccagguuuucaccagauagauuugggguuggcg

SEQ ID NO: 191727 - RNA, 64 nt, Human
agaggaggaccuucucaaccacguacagaacacggguuuucauggcugccuuugguuugguuuu

SEQ ID NO: 191728 - RNA, 64 nt, Human
ggagcacaaggcuucacgcuuuaagaccaucugugguuuucagugaacaagcgcugagcaccag

SEQ ID NO: 191729 - RNA, 64 nt, Human
uaggaaacuuuuuccaccuuucugaauggaaagagguuuucacaaauguuuuaaacucaucguu

SEQ ID NO: 191730 - RNA, 59 nt, Human
caccacccugggaccccccccccccccgcccaccagaccuguucugaccucaugagugu

SEQ ID NO: 191731 - RNA, 59 nt, Human
accaggaggaucugcgcacggugcacagcccaccagagcacuacagccuuuuauugagu

SEQ ID NO: 191732 - RNA, 59 nt, Human
cucugccuucccuucuacccacccgccucccaccagaucccaucuggaaaucauaauaa

SEQ ID NO: 191733 - RNA, 64 nt, Human
uagagauuuuauuuuuacugguugaucucuuggugguuuucaacuuccugcuggaaacuagagg

SEQ ID NO: 191734 - RNA, 64 nt, Human
aaccauauccauguugcugacuuuuccaaauaaagguuuucacuccucucccugugguuaucuu

SEQ ID NO: 191735 - RNA, 64 nt, Human
ucaauauaaauaaaagagcagaaaaauaugucuugguuuucauuugcuuaccaaaaaaacaaca

SEQ ID NO: 191736 - RNA, 64 nt, Human
acacugacuacuaaacuuuaaguuuuaaaaaauagguuuucauuuauggcuuuuugugguuuua

SEQ ID NO: 191737 - RNA, 64 nt, Human
ucagcucccaggucggucgugcugggccaggccugguuuucacaggggcugaaggaucccaguc

SEQ ID NO: 191738 - RNA, 64 nt, Human
auuuugaguuuuccauuaacuuccaaagaauucugguuuucaaaacaggagccagaguuggaga

SEQ ID NO: 191739 - RNA, 64 nt, Human
cccacauacacacgcagcguuuugauaaauuauugguuuucaacgauccugacuccucucugcg

SEQ ID NO: 191740 - RNA, 64 nt, Human
uggguguccucacugcugcccugaguccagccaugguuuucagggggacaguggacagggacuc

SEQ ID NO: 191741 - RNA, 64 nt, Human
uauccaaacccuuaccuacuagguauccugcuaggguuuucaauuccaauucuuguauuaaguu

SEQ ID NO: 191742 - RNA, 64 nt, Human
gggacugccagggcaccacuucaucaugaaugcugguuuucacaccuuuuccuuauuuuauugc

SEQ ID NO: 191743 - RNA, 64 nt, Human
acacguugcuggggaggccuggagucagguuugggguuuucagauaucagaaauccccuugggg

SEQ ID NO: 191744 - RNA, 64 nt, Human
ugcuccuuggaacgcaaagggccgaggagcaucugguuuucauggcaaagcucuacuccagagc

SEQ ID NO: 191745 - RNA, 64 nt, Human
ucaaggagaugugguccaggaaagugagccucaugguuuucagagaagucauuguucuguuuac

SEQ ID NO: 191746 - RNA, 64 nt, Human
caaauccuuugccuugaaagaacagcccuaaagugguuuucaacccucagaaacaagcuuuagg

SEQ ID NO: 191747 - RNA, 64 nt, Human
cacccagcugauuuuugcauuuuuaguagagacagguuuucaccauguuggcgaggcugguauc

SEQ ID NO: 191748 - RNA, 64 nt, Human
gacuggcucugugauaaaaagaccccucccgcuggguuuucagaccccauguuguuggucaaug

SEQ ID NO: 191749 - RNA, 55 nt, Human; identical to SEQ ID NO: 46366

SEQ ID NO: 191750 - RNA, 59 nt, Human
gcccugcagccccccaccuucuggcccucccaccagaggcccagcuaccaaggccacau

SEQ ID NO: 191751 - RNA, 59 nt, Human
aagacugcagccucuuccucccucagaucccaccagacccaccaggugccauaauaaag

SEQ ID NO: 191752 - RNA, 64 nt, Human
ggauggaggucaaaaaccacucccagauaaguuugguuuucaacauuuaguaacuugucucagg

SEQ ID NO: 191753 - RNA, 64 nt, Human
cuuuucuuccucuucaaaguauuuaaauuuccuagguuuucaugaaaaagcuggaaagcgauca

SEQ ID NO: 191754 - RNA, 64 nt, Human
gaucugaauuuugagguauuauuuuaaaacaucugguuuucauguuaacuguaucuggcuuaac

SEQ ID NO: 191755 - RNA, 64 nt, Human
ucccuugugugagggcaaaccaggcugcaggugggguuuucacuuccuaggguaguuuaauuuu

SEQ ID NO: 191756 - RNA, 64 nt, Human
agauuuuauuacuauucugaaggguaguguuguugguuuucaucuucaagaaguugauuccaaa

SEQ ID NO: 191757 - RNA, 64 nt, Human
ucuugaaguucuguucuuaugcucucugcucacugguuuucaauaccaccaagaggaaaauauu

SEQ ID NO: 191758 - RNA, 64 nt, Human
uuaauaaaucuaauccuauuucuucuuaaaguuugguuuucagacagugcuggugcuucugcuu

SEQ ID NO: 191759 - RNA, 64 nt, Human
aaauaggcuuaauguugaaauaauagauuaguuggguuuucacaugcaaacauucaaaaugaau

SEQ ID NO: 191760 - RNA, 52 nt, Human
aauccacuggagcaccuugauagguuuucaaaaauaccuggcaagaaaucug

SEQ ID NO: 191761 - RNA, 64 nt, Human
cuaauucuugcauauuuuguaacuuccaugugaggguuuucagcauugauauuugugcauuuuc

SEQ ID NO: 191762 - RNA, 64 nt, Human
cugccucucaacaucacuugaauccuagggccuggguuuucauguuuuugaaacagaaccauaa

SEQ ID NO: 191763 - RNA, 64 nt, Human
gacuuauuuauuuaaugcccuuucuuaugccguggguuuucaaguuuacucauuucuaugguug

SEQ ID NO: 191764 - RNA, 64 nt, Human
uuuuaaguuacugcauguuuuuauuaaggccauugguuuucaaaauaacaaguccuuacaaagu

SEQ ID NO: 191765 - RNA, 64 nt, Human
uagagaagaggagagaggacagugaaugggguaggguuuucaugucugcauuuuuggucaggua

SEQ ID NO: 191766 - RNA, 64 nt, Human
gucuuauugacaguugugcaggagguagccuggugguuuucaaccucuagaauuuuaagccuuu

SEQ ID NO: 191767 - RNA, 64 nt, Human
cucaggcacugagacuaccgcucaaccccagggugguuuucaggaguccgagguagccuucaau

SEQ ID NO: 191768 - RNA, 59 nt, Human
ggaaauaugagggaaaucucugcauugcaccaccagaggggcauaaauuugaaaguucu

SEQ ID NO: 191769 - RNA, 59 nt, Human
ccaggugcaccucaggcugcacaaauaccccaccagaaugucacaaucauucauugcuc

SEQ ID NO: 191770 - RNA, 59 nt, Human
ccuacagauggggcauauccuaucccaucccaccagaggauugauucuccauuucacaa

SEQ ID NO: 191771 - RNA, 64 nt, Human
acagggcacauugggggcauggaagugccagggugguuuucaggagcucuggugaagugggugg

SEQ ID NO: 191772 - RNA, 64 nt, Human
uggacaagcauagaaagugauuuauauuuuuaaugguuuucaaguggaaguuccuuugaauuug

SEQ ID NO: 191773 - RNA, 64 nt, Human
auuuaguugaagaguuaagcauucaguuccauuagguuuucacauguguuaaucucauuuacag

SEQ ID NO: 191774 - RNA, 64 nt, Human
caggccaaaugacuuggcaaauaauugacaaagugguuuucacgugugucuaucuuugcuagca

SEQ ID NO: 191775 - RNA, 64 nt, Human
guuuggguaguggggaggggcuacuuuguuucaggguuuucaagcuuuuacucuuaauuccuaa

SEQ ID NO: 191776 - RNA, 64 nt, Human
cuuuuuuggggcuuucuuuuugauuuuuguuugugguuuucaguuuuuuuguuguuguuaguga

SEQ ID NO: 191777 - RNA, 64 nt, Human
uucugcugugccuuuggaagcuuucuucuaagaugguuuucacagguacauguggaacagcguu

SEQ ID NO: 191778 - RNA, 62 nt, Human
cccaaaacaucagcauuucuaaaauaguccuaaagcuugaaaguaaguugcuuccaugagca

SEQ ID NO: 191779 - RNA, 62 nt, Human
gaaagcuuuagaaaacuugagugaaauggagcaagcuugaaggaguuagaaucuucugugcu

SEQ ID NO: 191780 - RNA, 62 nt, Human
ucuuucacuaccuuucuuacccuuaaugugccaagcuugaaacaggauuugauuuccugagc

SEQ ID NO: 191781 - RNA, 62 nt, Human
agagaaccucugagguggcuguauuuucuccuaagcuugagauagggggcugugguccuucc

SEQ ID NO: 191782 - RNA, 62 nt, Human
auuuuuucauaguuucauuuguucuugcccacaagcuugaaauccagguuaagguauccagc

SEQ ID NO: 191783 - RNA, 62 nt, Human
gucuaauaaucugguauuaaauccuuaagagaaagcuugagaaauagauuuuuuuuaucuua

SEQ ID NO: 191784 - RNA, 62 nt, Human
uugcucauccauuguccuccacuagaggggcuaagcuugacugcccuuagccaggcaagcac

SEQ ID NO: 191785 - RNA, 62 nt, Human
auuauuaguuuaaaaaucuuucugugcucucaaagcuugagccuugcagcucaagcuuguug

SEQ ID NO: 191786 - RNA, 62 nt, Human
gccugguguuccauggagagggagaaaggaacaagcuugaccaauucauucaacuccuuaua

SEQ ID NO: 191787 - RNA, 64 nt, Human
caggacacagggacagguucugucaugggugacacgaggacacagggacagguucuaucauggg

SEQ ID NO: 191788 - RNA, 64 nt, Human
caggggcagccacaccacugccauuacccagugccgaggacaugcaugacacuuccaaagacuc

SEQ ID NO: 191789 - RNA, 62 nt, Human
auucugccugaauagcugagagguuccagcaaaagcuugaagucuugccuggagaaucccuc

SEQ ID NO: 191790 - RNA, 62 nt, Human
agcacuaaagucuacaucuaagcuauagauuuaagcuugaagcuacagauuauaucacuauc

SEQ ID NO: 191791 - RNA, 62 nt, Human
uaacgguccuuugcuuccccgcaggggagaaaaagcuugacgaacuucacagaagaguucaa

SEQ ID NO: 191792 - RNA, 62 nt, Human
gcaagagcacagacuuacaaggauuucaacuuaagcuugacuugggguuuguagcgggaccc

SEQ ID NO: 191793 - RNA, 62 nt, Human
gugugccuucagggaggaagagggagguggucaagcuugaaaaacuggcuuuaggaugguuc

SEQ ID NO: 191794 - RNA, 62 nt, Human
agcugucuaaucccuucaagaacuguuuauagaagcuugagaaugggguaaaaauuucugcu

SEQ ID NO: 191795 - RNA, 62 nt, Human
gaucggaccagccacuguggcagaugggagccaagcuugaggacugcuggugaccugggaag

SEQ ID NO: 191796 - RNA, 62 nt, Human
uugucaucuuuaugaacucaugacaggauaauaagcuugaagaccugcuguaguuagauaug

SEQ ID NO: 191797 - RNA, 62 nt, Human
uacagucuacaugaauacaaaccucaauagcuaagcuugacguauuugugcacaaguagauc

SEQ ID NO: 191798 - RNA, 62 nt, Human
aagaaaaccuaaacuaaugucauuggaaacaaaagcuugaaagaaacacaucgcaucuacau

SEQ ID NO: 191799 - RNA, 62 nt, Human
uauuccccugccuuccuggcuugauugaaggaaagcuugaaaaggcgcagagcccuauaccu

SEQ ID NO: 191800 - RNA, 62 nt, Human
uucacuuuaucaacugagacuuuggggccuguaagcuugaggcaagacagaaauaagagaau

SEQ ID NO: 191801 - RNA, 62 nt, Human
ucuguugaaagaagccaggguuugccacugugaagcuugauuucugcuggugacuucugacc

SEQ ID NO: 191802 - RNA, 62 nt, Human
cguucccuugaguaaaugucugggaaagcaugaagcuugaugcaagaacccuguuguacugg

SEQ ID NO: 191803 - RNA, 62 nt, Human
ucuauucauaucugugcagaacacgguguuuuaagcuugagugaaaggagggugaggcugcc

SEQ ID NO: 191804 - RNA, 62 nt, Human
aauuaaaaacacaguuaaacuaauauguuuauaagcuugaguuuucuuccuaccauaucacu

SEQ ID NO: 191805 - RNA, 64 nt, Human
uguugagggccagucuaggcugacacauccuacccgaggacaagccuguucuccauuucuucac

SEQ ID NO: 191806 - RNA, 64 nt, Human
aagccugggccacacgggacacucucuucuuuaucgaggacacuuggaaaggugacugauaugg

SEQ ID NO: 191807 - RNA, 64 nt, Human
acgugacagagugccuuuucgagacuggcagggacgaggacaaauauggaugagguggagagug

SEQ ID NO: 191808 - RNA, 62 nt, Human
augggauucuaaccucacuaccaaaugagugaaagcuugauuaagaguucuuccauauacua

SEQ ID NO: 191809 - RNA, 62 nt, Human
cauuuuucuuaacuaaaauuacuuuuuacuuuaagcuugaauaaaaaucuucauugguaacu

SEQ ID NO: 191810 - RNA, 62 nt, Human
cuaguucuagaaguuccgcugcaaggccaggaaagcuugagaaagguauuguggaagaagca

SEQ ID NO: 191811 - RNA, 62 nt, Human
aaggacugggaacgugccagggggaacaaaguaagcuugaugggcuggaacuuuugacuuug

SEQ ID NO: 191812 - RNA, 62 nt, Human
uaaucauaacuguuaauucucagccaucuuugaagcuugaaagaagagucuuugguauuuug

SEQ ID NO: 191813 - RNA, 62 nt, Human
acaaaauagagauuaauuuuaacuuaaauuuuaagcuugaagauuagguacuaucugugaag

SEQ ID NO: 191814 - RNA, 62 nt, Human
gaaauucaaagagucuccugccagcaccaagcaagcuugauggacaauggagugggauugag

SEQ ID NO: 191815 - RNA, 62 nt, Human
ucaaaccagcaucggaaagacuucccagcaccaagcuugagcugugucguuucguggagggg

SEQ ID NO: 191816 - RNA, 62 nt, Human
aacccaggaguggauaacacuggcuucaggcaaagcuugaaucaggacucaaucuacaggcc

SEQ ID NO: 191817 - RNA, 62 nt, Human
cuaagacaauauagucuggaguauaagugggaaagcuugauuuaaauacugugaacucuaau

SEQ ID NO: 191818 - RNA, 62 nt, Human
ucagcagaggaaaggccagccaagcuuggggcaagcuugaugcaguaggagagacuccuuau

SEQ ID NO: 191819 - RNA, 62 nt, Human
guaaguagggcaugcuacaauggauaauuuaaaagcuugauagcugggacugaauagaagaa

SEQ ID NO: 191820 - RNA, 62 nt, Human
ugguuauauccaacuuuuuguaaauauacuggaagcuugauaauaaaauguauuuccuauca

SEQ ID NO: 191821 - RNA, 62 nt, Human
ccaauuauucaccuuaucgugccgcuucauggaagcuugaguauguucucccuuuuccauuu

SEQ ID NO: 191822 - RNA, 62 nt, Human
gagaaagagaaacuugagaaggcuugugcccaaagcuugaagaaagauuguaauagcauuua

SEQ ID NO: 191823 - RNA, 62 nt, Human
aaaacucucuguuguuuguaauauucucuuaaaagcuugaaaauaaaacuucuuucccuacc

SEQ ID NO: 191824 - RNA, 64 nt, Human
gcagcacacuggccgcccagcacugcugcuaugacgaggacagccggcugcugacccguggcaa

SEQ ID NO: 191825 - RNA, 64 nt, Human
gguggugaccucugccugaagucacacagugagucgaggacagggaggugaccccagguuucua

SEQ ID NO: 191826 - RNA, 64 nt, Human; identical to SEQ ID NO: 191350

SEQ ID NO: 191827 - RNA, 62 nt, Human
acuaguguuccaggcagcccugggcuaaacaaaagcuugaacuugccacuucagcggggaga

SEQ ID NO: 191828 - RNA, 62 nt, Human
uuguguggaccugaggcugcuuucuguucccaaagcuugaccuguguacagagauaauuccu

SEQ ID NO: 191829 - RNA, 62 nt, Human
guuuauagacuguagguggauauauaauuuaaaagcuugauuuaauaaacauuuaacccccu

SEQ ID NO: 191830 - RNA, 62 nt, Human
aaaaaagaaaaaaauagaaaaaaaaaaaaaaaaagcuugaucucuaucagacuuccuuucaa

SEQ ID NO: 191831 - RNA, 62 nt, Human
aacgaacguucugaugacacuguuucaaauauaagcuugauagaccaaaagaugccugacau

SEQ ID NO: 191832 - RNA, 62 nt, Human
caggaagggcugggggaguguguguggcaauaaagcuugaaggcaccgugggagcaugagcc

SEQ ID NO: 191833 - RNA, 62 nt, Human
gauuuuguguguaaugccaucaguuuuuaugaaagcuugaugagguauaggucauuuguuuu

SEQ ID NO: 191834 - RNA, 62 nt, Human
uuuugaggaagggagggugggcaguggucuggaagcuugaugcagagcagugugggucccac

SEQ ID NO: 191835 - RNA, 62 nt, Human
aguuaagagguuuuuaagccaggcgggcugggaagcuugaagugcaccuugagcagguucuc

SEQ ID NO: 191836 - RNA, 62 nt, Human
auauagaaaagagauacgugaauuuuuuagcuaagcuugacagauugaaagacaagugucau

SEQ ID NO: 191837 - RNA, 62 nt, Human
aguuuuguuugguuuacuuucaaaagaguagaaagcuugaaaagauucugaaaccacaguuu

SEQ ID NO: 191838 - RNA, 62 nt, Human
uccagcuguacguuacaaguuuggucauuuugaagcuugacauuuuaguuugccauuauguu

SEQ ID NO: 191839 - RNA, 62 nt, Human
uugagcacgacgaagcaaccuuguuucugaggaagcuugaguucugacucacugaaaugcgu

SEQ ID NO: 191840 - RNA, 62 nt, Human
aagugaacuugguuugaucuuacucaacuagaaagcuugaaaacaucccuggggauucugaa

SEQ ID NO: 191841 - RNA, 62 nt, Human
aaaaguucugcaucuuauaaugguaaccaauuaagcuugagauuguucugaaaguaucaauu

SEQ ID NO: 191842 - RNA, 62 nt, Human
gcgugguuguggugcuguaugugaacgcaugcaagcuugauucaccuucagggggcugauaa

SEQ ID NO: 191843 - RNA, 64 nt, Human
agcugcuuuugugcuacgagucagcguccgugcgcgaggacacugagccgggcuggcucuccuu

SEQ ID NO: 191844 - RNA, 64 nt, Human
ccccacccccuccaggcccggggcugaaacagcccgaggacagccccaggggcuggcuuucacc

SEQ ID NO: 191845 - RNA, 64 nt, Human
gaugucuuaacgaauaaaggucccaugcuccacccgaggacaguucuucgugccugagacuuuc

SEQ ID NO: 191846 - RNA, 62 nt, Human
aacaugugacugguauucaugaauauaaugauaagcuugauucuaguucagcugcugucaca

SEQ ID NO: 191847 - RNA, 62 nt, Human
cccauaauuuucuucaugcaaugacaucuucaaagcuugaagaucguuaguaucuaacaugu

SEQ ID NO: 191848 - RNA, 62 nt, Human
uagcucuugguauacucacuguugcaagucagaagcuugauuucaucauugauguuuuucuc

SEQ ID NO: 191849 - RNA, 62 nt, Human
gagcaaaaacauuaaccagcugcccaggguucaagcuugagccuuuaggugaucuuuaaacu

SEQ ID NO: 191850 - RNA, 62 nt, Human
cugaauuugcucauaggcugugcaucagacaaaagcuugaauauuuguguuguaugcuuguu

SEQ ID NO: 191851 - RNA, 62 nt, Human
aaucuacggacauuuugcuuucagggugaagcaagcuugaauuuggauugccugcucucuuu

SEQ ID NO: 191852 - RNA, 62 nt, Human
augaguuugaguuuaguuucaguaacugaaauaagcuugaauacugcauaugccaaauagcu

SEQ ID NO: 191853 - RNA, 62 nt, Human
aauauuaugaagaacauuucccaugcaucuacaagcuugagaaauaggauuuucacaguggg

SEQ ID NO: 191854 - RNA, 62 nt, Human
guguguggauguggauggugggggcauggacaaagcuugacacaucaaguuaucaaggccuu

SEQ ID NO: 191855 - RNA, 62 nt, Human
gagcucugggguuggggauggguuagggacgcaagcuugaguucuagcccuugcucucauuc

SEQ ID NO: 191856 - RNA, 62 nt, Human
uuuucuugcuucauuagaguaagucugucagaaagcuugaauauuuuugacauucauuuuga

SEQ ID NO: 191857 - RNA, 62 nt, Human
uacacugcgaccaccuugccgcuuuucaucacaagcuugaauauuuaaauucuguacuuaua

SEQ ID NO: 191858 - RNA, 62 nt, Human
agugcguuuuuuguaauuuaugauuguuaaguaagcuugacuuauaaauugacauuguaauu

SEQ ID NO: 191859 - RNA, 62 nt, Human
caauaaaccuccauucauaagguggauguuguaagcuugauggugguugugaaagugauuua

SEQ ID NO: 191860 - RNA, 62 nt, Human
acuguccuggacagaguccaaguuacccacuaaagcuugagguggauguuggcuucacuccu

SEQ ID NO: 191861 - RNA, 62 nt, Human
uauucaacugcaaaaucucaaucuugaaaaucaagcuugaaauuucauagguagaaauauua

SEQ ID NO: 191862 - RNA, 64 nt, Human
cuucagggccacaacaggcuguagaaggggaugacgaggacaucagagguuagacuuacccucc

SEQ ID NO: 191863 - RNA, 62 nt, Human
ccuagauuauauuaaaauauuuuuaauuuuuuaagcuugacaaaugcacugauuguuauacu

SEQ ID NO: 191864 - RNA, 62 nt, Human
uuuguagucauguugucaacagaggcaaaguuaagcuugaugaugguuaaaaucgguuugau

SEQ ID NO: 191865 - RNA, 62 nt, Human
ugagcagguugagauguggauaucuccaugggaagcuugaaccaggcuagaacagcugucug

SEQ ID NO: 191866 - RNA, 62 nt, Human
uggugcaacucaccagcaggugugcaguaggcaagcuugaagguggcccaugcuucucuguu

SEQ ID NO: 191867 - RNA, 62 nt, Human
agccauuugugaaggcucugccagacaccuccaagcuugagagcucagcaccaugcaccaag

SEQ ID NO: 191868 - RNA, 62 nt, Human
aucaggcuaaucaugugguccaugucucuucaaagcuugaccugcacaaaugccauauuucu

SEQ ID NO: 191869 - RNA, 62 nt, Human
gauuuguaaaaauauuuuucaugauaucuguaaagcuugaguauuuugugauguucguuuuu

SEQ ID NO: 191870 - RNA, 62 nt, Human
ccgcacccuaccucauuuucuguaacaaagcuaagcuugaacacuguugauguucuugaggg

SEQ ID NO: 191871 - RNA, 62 nt, Human
ucuuauucuuaaauuuacauauaagaucuauuaagcuugacacaucugugucaucacgcacu

SEQ ID NO: 191872 - RNA, 62 nt, Human
uauaugauuaaagaaaauaugcauaaucagacaagcuugaauauuguuuuugcaccagacga

SEQ ID NO: 191873 - RNA, 62 nt, Human
uauaaauaugcguuuauuuaaaaggagaacaaaagcuugacucugauucacaguuuuguaug

SEQ ID NO: 191874 - RNA, 62 nt, Human
gaagauaauacaauauaagaagggaucacuggaagcuugaccccaugcacauuuuggugaaa

SEQ ID NO: 191875 - RNA, 62 nt, Human
auguaugcuuauuggaauucugccacagcaggaagcuugagucaaaauguguuuccccuuug

SEQ ID NO: 191876 - RNA, 62 nt, Human
uguuuucugcuggaaaauaaguguggacauugaagcuugagcucucaaagcaguuggcugga

SEQ ID NO: 191877 - RNA, 62 nt, Human
cugaaggauuaaaaggauuuucucuuuuggaaaagcuugacugauuucacacuuaucuauag

SEQ ID NO: 191878 - RNA, 62 nt, Human
ccucagacagcgaagacugauuguguuuguaaaagcuugaugaaaggacaguuaaguauuuu

SEQ ID NO: 191879 - RNA, 60 nt, Human
gagaugggcgcucccgacacagcgcagacccaccaggaggaaagaggcccagcucucagc

SEQ ID NO: 191880 - RNA, 60 nt, Human
uccagccuagacaccaguaacucuuguguucaccaggacccagacccuuggcaagggaua

SEQ ID NO: 191881 - RNA, 60 nt, Human
ccuggucugacugcaguguagggaauaggucaccaggaggagcccuucauccuggcaggc

SEQ ID NO: 191882 - RNA, 62 nt, Human
aagaccaagaugggaaacguaacauggaauacaagcuugaaucugggaaacaagcucaaaaa

SEQ ID NO: 191883 - RNA, 62 nt, Human
uacaggcucuguacaacucaaucaagaaugagaagcuugaaugggcaguguaagugugcugg

SEQ ID NO: 191884 - RNA, 62 nt, Human
gcaucuagaaagcuuugaaugcagaagcaaacaagcuugauuuuucuagcauccucuuaaug

SEQ ID NO: 191885 - RNA, 62 nt, Human
gcuuauuagaaagccaaaguagaguucuguuuaagcuugaaagagguaugaaguaaucugua

SEQ ID NO: 191886 - RNA, 62 nt, Human
cuuuuuuucuuuuggauuucugguugugaaacaagcuugauuucagugcuuauugugucuuc

SEQ ID NO: 191887 - RNA, 62 nt, Human
guggaauguuucuguaggacuuuguucuccacaagcuugaauuaaagcaggauucaguuugc

SEQ ID NO: 191888 - RNA, 62 nt, Human
ucuugugacgugcacugugaauccuggcaagaaagcuugagucucaaggguggcaggucacu

SEQ ID NO: 191889 - RNA, 62 nt, Human
uaaaugaaauaucuugguuuuuauuucccaggaagcuugagagaaaugaguuuauacagagc

SEQ ID NO: 191890 - RNA, 62 nt, Human
ccuuugggacuaagcugcggaaucuucuuacuaagcuugaagaguggagaggcgagagguga

SEQ ID NO: 191891 - RNA, 62 nt, Human
agauuggguaaauugguugaauuauuguauugaagcuugagcuguagcuaaaaguaauuuag

SEQ ID NO: 191892 - RNA, 62 nt, Human
ugauauuuuauauuuauacauuuuagaugacaaagcuugauauuuauugcuguugcacauuu

SEQ ID NO: 191893 - RNA, 62 nt, Human
aggaaacuucggagaaaggcauuagaucuggaaagcuugagccuccuuggguucgucuacaa

SEQ ID NO: 191894 - RNA, 62 nt, Human
gguggggccgugaggcuggaccaggacuagagaagcuugagcacccccgaguugcugcucau

SEQ ID NO: 191895 - RNA, 62 nt, Human
cuugggacagaagaagguggaauuucagacagaagcuugacugggucuucaaugacaggcuu

SEQ ID NO: 191896 - RNA, 62 nt, Human
aauguuacaaaaaguuauacuccagagacccaaagcuugacauuuaccuaauguaugagaaa

SEQ ID NO: 191897 - RNA, 62 nt, Human
ugaacuguuggacuggguagaaaucuuucaagaagcuugaaaauaaggccauaaaggagggg

SEQ ID NO: 191898 - RNA, 60 nt, Human
ggcaucuccuuuacgccagggugaggaagacaccaggacaaugacagcaucggguguugu

SEQ ID NO: 191899 - RNA, 60 nt, Human
ggccaugagcaguugaguggcacagccuggcaccaggagcagguccuuguaauggaguua

SEQ ID NO: 191900 - RNA, 60 nt, Human
uggagccggcccucggugaugggucugggccaccaggaucagccaggagggcguucuuag

SEQ ID NO: 191901 - RNA, 62 nt, Human
uacaguguucuggaaaagaugccauucuuuuuaagcuugaaacugcagaagaaauucacagg

SEQ ID NO: 191902 - RNA, 62 nt, Human
uaagccacccccaccccccacucugcuuucccaagcuugacuggcauauaccuaggccugug

SEQ ID NO: 191903 - RNA, 62 nt, Human
cuaacuacuuaauucccuggauuuauccuguuaagcuugaguagaaugaaggccugcuagca

SEQ ID NO: 191904 - RNA, 62 nt, Human
gacaugcuacaauuuucauuuuuguaaaaauaaagcuugauuguucacagaucugguuccuc

SEQ ID NO: 191905 - RNA, 62 nt, Human
cauaaaauaaucauuuuugaaccuguguaauaaagcuugaaagcagggaaaagaauuuccuu

SEQ ID NO: 191906 - RNA, 62 nt, Human
gcccaaaguggggagggacaagggauucugggaagcuugagccucccccaaagcaaugugag

SEQ ID NO: 191907 - RNA, 62 nt, Human
cucagccccucguggcaggacuugacaagggcaagcuugaccaggaagcugccaucagggau

SEQ ID NO: 191908 - RNA, 62 nt, Human
uuaaaaggauaaucuaaaucaccauuuagauuaagcuugacuugcaaacuaggaagaagcac

SEQ ID NO: 191909 - RNA, 62 nt, Human
aauauggaaaaguuaaccauuauagaaaagcaaagcuugaguuuccuaaauguaagcuuuua

SEQ ID NO: 191910 - RNA, 62 nt, Human
ugcaucuuaguuggagagaggggugugggaggaagcuugaguuugaugcagggaggaggaag

SEQ ID NO: 191911 - RNA, 62 nt, Human
aauuuucaggagagggagaagggccuucucagaagcuugaaggcucuggcuuaacagagaaa

SEQ ID NO: 191912 - RNA, 62 nt, Human
uguugauuaaaccugucacuuuacacaugaaaaagcuugaaacuuagagaaagauaaaaugu

SEQ ID NO: 191913 - RNA, 62 nt, Human
uuauacugucuucccccacccccggggaggggaagcuugagcugcugcugucacuccuccac

SEQ ID NO: 191914 - RNA, 62 nt, Human
gaugauucuuucuuggcccuggccaucucgggaagcuugauggcaauccuggaaggguuuaa

SEQ ID NO: 191915 - RNA, 62 nt, Human
auaugaggggcaaggaggaggaugcauuucaaaagcuugauugauguguucagagcuaaauu

SEQ ID NO: 191916 - RNA, 62 nt, Human
aggauguguuucauucugguggucuguuuugcaagcuugauaacagaauguccgugccauug

SEQ ID NO: 191917 - RNA, 60 nt, Human
acagggaaggagcagcaucugguaugcagccaccaggacaaggacugaaaauaaugucua

SEQ ID NO: 191918 - RNA, 60 nt, Human
ugcugaagcgagaaccccauucugccaccccaccaggaugcccauucuccaggacuucuc

SEQ ID NO: 191919 - RNA, 60 nt, Human
gugugaaagguuacuuaauuaaauuacaaccaccaggaaauugacugcuuuuuuuuuuuu

SEQ ID NO: 191920 - RNA, 62 nt, Human
gaaaaagauuccaguucaguauuugcagcaagaagcuugaaugcuguucuuuuuaucgcauu

SEQ ID NO: 191921 - RNA, 62 nt, Human
gauuacagaugugagccaccacaccuggccccaagcuugaauuuucauucugccauugacuu

SEQ ID NO: 191922 - RNA, 62 nt, Human
aguagaucccuagacauggaaucagggcagccaagcuugaguuuuuauuuuuuauuuauuua

SEQ ID NO: 191923 - RNA, 62 nt, Human
ccccuuuuuauuuuaaaauuugacuccucuucaagcuugaaaacccucugaacucagucuuc

SEQ ID NO: 191924 - RNA, 62 nt, Human
cuguuuagacauuuuuugucccagaaauacagaagcuugaaaugcuaugaaggcagagcuuc

SEQ ID NO: 191925 - RNA, 62 nt, Human
uaauaaugggauguuuuauuuucugauguacaaagcuugauuaccauagaaaaccaugauuu

SEQ ID NO: 191926 - RNA, 62 nt, Human
aguucacccuuagccugcacuaagggccguggaagcuugaccagcgugcugacuggccuagg

SEQ ID NO: 191927 - RNA, 62 nt, Human
uuggaucauggcuccacugggauugggguggaaagcuugaggggaguaggguuccagcucug

SEQ ID NO: 191928 - RNA, 62 nt, Human
acacaaacacacagacacaccuuuugauauguaagcuugaccuaaagucaaaggaccugugu

SEQ ID NO: 191929 - RNA, 62 nt, Human
uguuacugauauauuacaauuuucaaggugauaagcuugagcuauuaaauaauaaaaaguau

SEQ ID NO: 191930 - RNA, 62 nt, Human
agucuaacuuuauuuagacgcuguagauggacaagcuugauuguuggaaccaaaaugggaac

SEQ ID NO: 191931 - RNA, 62 nt, Human
gaauagggcucaaaguaaaacuuuugguucagaagcuugacucauaaacuauacuauauauu

SEQ ID NO: 191932 - RNA, 62 nt, Human
ggacaggcccagggcgggaaauggagccggagaagcuugagccucucucuuggacaggacaa

SEQ ID NO: 191933 - RNA, 62 nt, Human
auuagaauuagaccuugauuuuaaauccaagcaagcuugaagccccuuggcuuacagcauuu

SEQ ID NO: 191934 - RNA, 62 nt, Human
gagaaacccuauugaggcagugacuguugaaaaagcuugaauugaggagucaagagucacua

SEQ ID NO: 191935 - RNA, 62 nt, Human
cuuuggaaaaaucuuuuuuuuuuuuuuuggucaagcuugaggcugaauaaagccuuugaugc

SEQ ID NO: 191936 - RNA, 60 nt, Human
guuacccaagggugccucacucaucugcgccaccaggaagaugaacugugagggcuccua

SEQ ID NO: 191937 - RNA, 51 nt, Human
ccgaagucucccuggucugaccaccaggaucccaggggcccaaggcggccc

SEQ ID NO: 191938 - RNA, 60 nt, Human
caagugcaccugaucccugcgcaacagccacaccaggagaacaggcuguccuuggcggca

SEQ ID NO: 191939 - RNA, 62 nt, Human
uaaaacugaaggcacuauauauuuuuacauaaaagcuugaacauacagaugaauuauaaccu

SEQ ID NO: 191940 - RNA, 62 nt, Human
gccgaggggagagagggacucaagggaaaggcaagcuugaggccaagauggcugcugccugc

SEQ ID NO: 191941 - RNA, 62 nt, Human
aaaaaaagcuugcaaaauauuuuaugguuuccaagcuugauauccuuuaaaauuauuuucau

SEQ ID NO: 191942 - RNA, 62 nt, Human
ccauaacuccaagugagucuguaauguuugugaagcuugacuguaaccauguuuuuucuguu

SEQ ID NO: 191943 - RNA, 62 nt, Human
aagucuggcugaggucugggcaggggcagggcaagcuugaccucucacuguugacccuuugg

SEQ ID NO: 191944 - RNA, 62 nt, Human
aacuuugucucucuuugacauguagucagcugaagcuugacuguguagagacauuuuccaca

SEQ ID NO: 191945 - RNA, 62 nt, Human
aaagcuguuuguuauaugcugcuuaauaaaguaagcuugaaauuuaucauuuuaucaugaaa

SEQ ID NO: 191946 - RNA, 62 nt, Human
agguccagcaaaagucaguagggacauugcagaagcuugaaaggccaauaccagaacacagg

SEQ ID NO: 191947 - RNA, 62 nt, Human
uucauucuuagcagaaagguaaaugcuugagaaagcuugagucaaauuuguuaaaagaauuu

SEQ ID NO: 191948 - RNA, 62 nt, Human
cacugaagacauuagacuggccauagaaaaguaagcuugaacucccaauugaugugaccaca

SEQ ID NO: 191949 - RNA, 62 nt, Human
ucaguccuguguaggagaggaaagggaaucaaaagcuugagcacaaacagauaccucagccc

SEQ ID NO: 191950 - RNA, 62 nt, Human
ucucaaagaccguagaagacauuuaauuucuaaagcuugaagugccccgaggagcagguaga

SEQ ID NO: 191951 - RNA, 60 nt, Human
aguccaagccagaaaacugauccuguaccaaagcuugagugucagguucaggcuuuauug

SEQ ID NO: 191952 - RNA, 62 nt, Human
acagcccuucuacuaauagugagugugaaggcaagcuugaugcaaaaccuccugaccuuucc

SEQ ID NO: 191953 - RNA, 62 nt, Human
agucauuuucuguucaccugccgcacagggacaagcuugacuucuauuuucuguguagugaa

SEQ ID NO: 191954 - RNA, 62 nt, Human
agggccuccucccaaguguggcuuuaaggaguaagcuugaggaugauguuuuuuaauuauug

SEQ ID NO: 191955 - RNA, 60 nt, Human
guaggagccagagagcuguagagacaggaccaccaggaugcuucauguccauaacacaag

SEQ ID NO: 191956 - RNA, 60 nt, Human
gugagagggagagcccuucccauccuuacccaccaggaacuagagccccaaccacagcag

SEQ ID NO: 191957 - RNA, 60 nt, Human
gcucugaaucuuuaacugaaaugcacauggcaccaggaggugucucucauaguugguugc

SEQ ID NO: 191958 - RNA, 62 nt, Human
aucuucauuuucagaggaugugaagccacugaaagcuugacucagggaaaagaaauguggga

SEQ ID NO: 191959 - RNA, 62 nt, Human
gugacgauaauucaaagucauauuuugccucuaagcuugaucauguuaccuuuaugauuaaa

SEQ ID NO: 191960 - RNA, 62 nt, Human
cccauuagguuucaauacuuugcacuucuacuaagcuugauagggcaggagugcaaucuaca

SEQ ID NO: 191961 - RNA, 62 nt, Human
cuauucaggucugugagaacuccugacgucugaagcuugacucccaaguuuccauagcaaca

SEQ ID NO: 191962 - RNA, 62 nt, Human
gagugaaacgagcaaaagucaccugcccaauaaagcuugacaagacacucgcuggccugucg

SEQ ID NO: 191963 - RNA, 62 nt, Human
gucugcagagucccaucugcccaaaggucuugaagcuugacaggauguuuucauuacucagu

SEQ ID NO: 191964 - RNA, 62 nt, Human
cucacccaagccugcucugugucuguguugugaagcuugagacucuggaaagaaauggggag

SEQ ID NO: 191965 - RNA, 62 nt, Human
guccuguuuuucgggaggguggggguugggggaagcuugaccuugugucuucgucaauaaac

SEQ ID NO: 191966 - RNA, 62 nt, Human
uuaaaaaugaaaauuacguucuuacaagcuuaaagcuugauuugaucuuuguuuaaaugcca

SEQ ID NO: 191967 - RNA, 62 nt, Human
agagccagagaaggggccccaccaccaaggccaagcuugaccaggucagcauugccauggcc

SEQ ID NO: 191968 - RNA, 62 nt, Human
agagcucuguuacagcccacuguguccuuuagaagcuugaaaggaacccaacucuuugcugc

SEQ ID NO: 191969 - RNA, 62 nt, Human
cuauuuuuaguguccaaaauuuacuaauacagaagcuugacaagcauguccucacccucccc

SEQ ID NO: 191970 - RNA, 62 nt, Human
acuugccccuacuauugcccuuuuaagggccaaagcuugaccccauuggccauugccuggcu

SEQ ID NO: 191971 - RNA, 62 nt, Human
cuacuugaccuaagggacucccacaacaacaaaagcuugaagcuguggagggccacgguggc

SEQ ID NO: 191972 - RNA, 62 nt, Human
gaccuugggccaagaugcuaaaugggaaugcaaagcuugagcugcucugcaagagaaaauaa

SEQ ID NO: 191973 - RNA, 62 nt, Human
acuguuguuuuggcaagacgguccugauguacaagcuugauugaaauucacugcucacuuga

SEQ ID NO: 191974 - RNA, 60 nt, Human
gccugaaggaaucaccugagccuguccguccaccaggaguggggagaugcccccauccag

SEQ ID NO: 191975 - RNA, 60 nt, Human
uguaaauaguuuuauaaaauacagucgaaucaccaggaaccuuugagcugcuuuuaaaau

SEQ ID NO: 191976 - RNA, 60 nt, Human
auccacgucggagccggcaggugcuucucacaccaggagccucugggggcaggggcuggc

SEQ ID NO: 191977 - RNA, 62 nt, Human
uuccuuuccuuggagcacugagcaccauuuggaagcuugagagaaaccaaaauuaaagagag

SEQ ID NO: 191978 - RNA, 62 nt, Human
uugaaggacacaagagagaaaagcucacuaagaagcuugaaucuacuuuuuuuuuuuuuuga

SEQ ID NO: 191979 - RNA, 62 nt, Human
cuugguggggggaggggcgccaaccauuaccaaagcuugaauaggugguuuuccccucacag

SEQ ID NO: 191980 - RNA, 62 nt, Human
aacccaauuuucaauuauguuggcuuuuuauaaagcuugaguuauguaagauuuaaauaaaa

SEQ ID NO: 191981 - RNA, 62 nt, Human
ucugcaaaucuugaaucguccucaaaaugacgaagcuugaauuguccucaagauggauguga

SEQ ID NO: 191982 - RNA, 62 nt, Human
uuggugauuuaaaugaaucucacauuaaaagaaagcuugacaguguuaugaaagccaccaga

SEQ ID NO: 191983 - RNA, 62 nt, Human
gaagcacuucuggaagugaacacucguuuugaaagcuugauuuuguagcuuuggaagcugga

SEQ ID NO: 191984 - RNA, 62 nt, Human
uuuaauugagacaggguuggucucuguugcccaagcuugagggcaguggugcaaucauaacu

SEQ ID NO: 191985 - RNA, 62 nt, Human
agaacagucugugcccugggacuccuaucaggaagcuugacaggcagcugggcaucagugca

SEQ ID NO: 191986 - RNA, 62 nt, Human
auuucuaauagccuuggguuuauuugcaaaggaagcuugaaaaauaugagaaaaguugcuug

SEQ ID NO: 191987 - RNA, 62 nt, Human
ucuuggucagggcuggauagauuaucuaagucaagcuugagaaugaauguauguaauuuucc

SEQ ID NO: 191988 - RNA, 62 nt, Human
uaagcguuguaguaaaugcgugcuuauccucuaagcuugaagaagggagacgaaaauccauu

SEQ ID NO: 191989 - RNA, 62 nt, Human
gaaaguaaagaaggaauaaucuacccugacuaaagcuugaaaugcuacauuuccaaggugaa

SEQ ID NO: 191990 - RNA, 62 nt, Human
uuuacuagaacaugagaaucuuuuucccuuggaagcuugaauuauaaaugugguguuuggcc

SEQ ID NO: 191991 - RNA, 62 nt, Human
ugagcuuuccagccguguuguagcuaauuaggaagcuugauuugcuuugugauugaaaaauu

SEQ ID NO: 191992 - RNA, 62 nt, Human
uaaauaucacugaaauaaaaaguaggaaaaagaagcuugaauuuuaagacugaggcugcucu

SEQ ID NO: 191993 - RNA, 60 nt, Human
agccagugauaguacauucugaaaugcuggcaccaggagacggccacagacacacacugc

SEQ ID NO: 191994 - RNA, 60 nt, Human
ggagacagggacagguucugucgggggugacaccaggagagagggacagguucugucagg

SEQ ID NO: 191995 - RNA, 60 nt, Human
gcauuggaggauggggguccugguaugucucaccaggaaauucuguuuauguucuugcag

SEQ ID NO: 191996 - RNA, 62 nt, Human
caugggacugauucuguuguguucaccagagaaagcuugaggccauggcgagauacugcaug

SEQ ID NO: 191997 - RNA, 62 nt, Human
ccacuccuauccuccauuccugcaagaguuuuaagcuugagagagcugaccacagggccccc

SEQ ID NO: 191998 - RNA, 62 nt, Human
uauuuauuguuuugguauuucauguuacuccuaagcuugaaagcucuuuuuucuauauacag

SEQ ID NO: 191999 - RNA, 62 nt, Human
ggggagaagcuauagaaagaggagcccacacaaagcuugaaagccugugccagauggagccu

SEQ ID NO: 192000 - RNA, 62 nt, Human
ucugaauccaguuuuuccucugucaguccuggaagcuugaauagaauuauauuguugaagcc

SEQ ID NO: 192001 - RNA, 62 nt, Human
gcagaauucagaacuucaauuucagugacgccaagcuugauguguuucuguuauuguuuuga

SEQ ID NO: 192002 - RNA, 62 nt, Human
aaggaacucauacagcacaagagaaaacuacuaagcuugacaucugugagugacugagggag

SEQ ID NO: 192003 - RNA, 62 nt, Human
aggcaugaugauaagcuaugcagauuauuaaaaagcuugauacauuugauuuuucauuagau

SEQ ID NO: 192004 - RNA, 62 nt, Human
gcauauagcuauagauauaggcuuuuccuugaaagcuugaaaaaaauucgccaguaaaauaa

SEQ ID NO: 192005 - RNA, 62 nt, Human
cagggauuguuucuguuuaacuucuuauaggaaagcuugaguaaaauaaauauugucuuuuu

SEQ ID NO: 192006 - RNA, 62 nt, Human
aaauuuguuauguuuaaggaaauuaagauuuuaagcuugaaauuauacaagcagaaucuaau

SEQ ID NO: 192007 - RNA, 62 nt, Human
augcauaagacuuuucacuagggaaacugauaaagcuugagucaacuaaaucugccuucaua

SEQ ID NO: 192008 - RNA, 62 nt, Human
auagaaaacaaucuucauuugaaaacaucccuaagcuugaauaaauggauaccauagauagc

SEQ ID NO: 192009 - RNA, 62 nt, Human
cuugguacuuggaauugauauauaccuuauuaaagcuugaaaacauuuagcauuugaauagu

SEQ ID NO: 192010 - RNA, 62 nt, Human
uuucaaaaacuuugguucaaucugaagaaaggaagcuugaacuguuuguucuuggugccuug

SEQ ID NO: 192011 - RNA, 60 nt, Human
ccagauacacuaaaguuacaaacagaccaccaccaggacugugccugaacaauuuuguau

SEQ ID NO: 192012 - RNA, 60 nt, Human
cccuccggcgcugaaaauacacgcaccacccaccaggagccuugggaucauaaacacccc

SEQ ID NO: 192013 - RNA, 60 nt, Human
agcugccaagugcuccccaaggagaucggucaccaggagagcagccacaaaggucaagaa

SEQ ID NO: 192014 - RNA, 64 nt, Human
ggggguggacguccauccggugaacagugaaggcguuugugaggucuuucuggucccagcauga

SEQ ID NO: 192015 - RNA, 64 nt, Human
accacgccuggguccaaaaccacggugcuggccuguuugugaugaucagcucagcggcccagcu

SEQ ID NO: 192016 - RNA, 64 nt, Human
uuucaagacaacauacuuuuuuuuucuuuucucuguuugugauaucacuuuaauuuuucuuggg

SEQ ID NO: 192017 - RNA, 64 nt, Human
uaagcagcaguguuuuuggauacuuuuuuuuucuguuugugaauaaggccagcacucaagaugg

SEQ ID NO: 192018 - RNA, 64 nt, Human
ucccccaccuccacccucaacccaucuuccuaguguuugugaaauaaacuugguauuugucugg

SEQ ID NO: 192019 - RNA, 64 nt, Human
uaaaaguuucggaguugaacuauuguguaguuuuguuugugaaagauugugcccauauccucag

SEQ ID NO: 192020 - RNA, 64 nt, Human
gaccaauaucuaguguggacucaguguucucuagguuugugagcaguugugguaagagaaugga

SEQ ID NO: 192021 - RNA, 64 nt, Human
uucaccuuuuuaaaaagaugcauuuuauuugcagguuugugaaguucuugcaaacucuuacuac

SEQ ID NO: 192022 - RNA, 64 nt, Human
caaaguguuuaccagauauuugaugaggugcuauguuugugaaaaacauaucauguaauucaaa

SEQ ID NO: 192023 - RNA, 64 nt, Human
accacggacuccuggguggcgcccuggcgaacuuguuugugauaguuggguuugcagccuuugc

SEQ ID NO: 192024 - RNA, 64 nt, Human
uaaugaaaaagguuucagaguugcuaaagcuucaguuugugacauuaaguuuaugaaauucuaa

SEQ ID NO: 192025 - RNA, 64 nt, Human
uuucacugcuccaguggcagccauggggaaggcaguuugugagggcuuggggcacagaccuggg

SEQ ID NO: 192026 - RNA, 64 nt, Human
gacugaaauguaucccucguuuaucauccccuuuguuugugauugcugcuaaagucaguaguau

SEQ ID NO: 192027 - RNA, 64 nt, Human
ggggggaggguuggggaggggcggcaggagggagguuugugagagcgaggcugagccuacagau

SEQ ID NO: 192028 - RNA, 60 nt, Human
gggccccugcuggccuuccugccauugcugcaccaggacugcaaggaguccccacaccuu

SEQ ID NO: 192029 - RNA, 60 nt, Human
gcugucuaguauucauuuacauuuaggguucaccaggacuaaugauuuuuauaaaccguu

SEQ ID NO: 192030 - RNA, 60 nt, Human
gcuguggaaagaagucacaaaacacugggccaccaggaacacaccuguagcccagcaaag

SEQ ID NO: 192031 - RNA, 64 nt, Human
aauaagaaccaauuccauuuguuugaaauauggaguuugugacuacccaaauugcuaauuauuc

SEQ ID NO: 192032 - RNA, 64 nt, Human
uguaacagacuugcgguuaauuaugcaaaugauaguuugugauaauugguccaguuuuacgaac

SEQ ID NO: 192033 - RNA, 64 nt, Human
cuccuauucaugagcauggaauguuuuuccauuuguuugugacaucucuuauuucuuucagggg

SEQ ID NO: 192034 - RNA, 64 nt, Human
auugguaaagauugugaguaaaugacauuuuuugguuugugaacauggcguuuuauagaauaau

SEQ ID NO: 192035 - RNA, 64 nt, Human
uuauuuucugaaccaaagagaaagauggacugguguuugugaaacauuuuuaaaaauguaguuu

SEQ ID NO: 192036 - RNA, 64 nt, Human
guuuccugugaauucugugacuccuaauaggccaguuugugauaagcuuacucuaugagucuuc

SEQ ID NO: 192037 - RNA, 64 nt, Human
gcauucuacuucucgaguguucacuugccccucaguuugugaccaaguuguggguauucugaga

SEQ ID NO: 192038 - RNA, 64 nt, Human
uagagaaacuuuguaaaagaagaauccaagagaaguuugugaggauccuacaaacccaggccca

SEQ ID NO: 192039 - RNA, 64 nt, Human
ugacacauacagaccucaagccugaaaauauucuguuugugaauucagacuaugagcucaccua

SEQ ID NO: 192040 - RNA, 64 nt, Human
ucucucaaaagacuuuguuguugugugguuuuuuguuugugauuuuuuuccuuaugcaaaucau

SEQ ID NO: 192041 - RNA, 64 nt, Human
uuacgcuaucuuguuugggaaugauguuucauagguuugugaugaucuuuacguucaggacuca

SEQ ID NO: 192042 - RNA, 64 nt, Human
uaguguugauagauaaauuagaauguauagauagguuugugaaagucuaaauaaugguuguaua

SEQ ID NO: 192043 - RNA, 64 nt, Human
auguucuuauucuuugcaccucuuccuauuuuugguuugugaacagaaguaaaaauaaauacaa

SEQ ID NO: 192044 - RNA, 64 nt, Human
cugaugauuauugaggacagaaggcucagaaacaguuugugacagaaaaugcaguguuucauuu

SEQ ID NO: 192045 - RNA, 60 nt, Human
ggcuggaucuuugccuugagagcuccgugucaccaggauggaagggggugccucucggag

SEQ ID NO: 192046 - RNA, 60 nt, Human
aggcgagugccaggacuccccaggccaggccaccaggauggcccuucccacuggagguca

SEQ ID NO: 192047 - RNA, 60 nt, Human
ucauucacaacugauuucaagagucaccuucaccaggaagucuuccuugaccaccaucau

SEQ ID NO: 192048 - RNA, 64 nt, Human
aaagaggcuagugccucagagagaacuguacgggguuugugacuggaaaaaguuacguucccau

SEQ ID NO: 192049 - RNA, 64 nt, Human
gugggucuuuaauaaaacaacaacaaaaacagcaguuugugauauagcagagguuuaaauguac

SEQ ID NO: 192050 - RNA, 64 nt, Human
uuuuaaaucucucuuuucucuaacaguguuagaaguuugugauucuccaaauaugccuagauuu

SEQ ID NO: 192051 - RNA, 64 nt, Human
uuugacuuuguuacuccauguucagcuaauuuagguuugugagauuaacuuuaggauuuuuugu

SEQ ID NO: 192052 - RNA, 64 nt, Human
uuuucuuucuuuuuuuuuuuguaguugggaguaaguuugugaauggaaacaaacuuguuuaaac

SEQ ID NO: 192053 - RNA, 64 nt, Human
uaaaacauaggaaggguauuuuucuugauccaaaguuugugaauuuggcuuugcuaccucaauu

SEQ ID NO: 192054 - RNA, 64 nt, Human
auugaaauaaaauugcaguauauauauguugcuuguuugugacacuuagauaaucuucugaaau

SEQ ID NO: 192055 - RNA, 64 nt, Human
agucacaguuuaccuuauugauauuggucugaugguuugugaacucuugcugggaaucaaaauu

SEQ ID NO: 192056 - RNA, 64 nt, Human
uacuguuccaaaaagaauuccaaccgaccagcuuguuugugaaacaaaaaaguguucccuuuuc

SEQ ID NO: 192057 - RNA, 64 nt, Human
ucacauuugaggacuuuucucggguaucuugaggguuugugauccugaacccuuaaacagugcu

SEQ ID NO: 192058 - RNA, 64 nt, Human
gcuguaaaucuggaaauuugauagacuugacuguguuugugaaaacugagcauuaaagguuuug

SEQ ID NO: 192059 - RNA, 64 nt, Human
aauguaagcaaaggcucugaaauaaaaugccauaguuugugaauccuugauuuuuguuucuaaa

SEQ ID NO: 192060 - RNA, 64 nt, Human
cuaccaaacugcucuagaaggucauuuccauuuuguuugugauauuuagacgcgcagacuucag

SEQ ID NO: 192061 - RNA, 64 nt, Human
auuuucagauaaagagacuccaagguugacuuuaguuugugaguuacucaugugacuauuugag

SEQ ID NO: 192062 - RNA, 60 nt, Human
ucagaaucugacaccuugccuugcucuugccaccaggacaccuaugucaacaggccaaac

SEQ ID NO: 192063 - RNA, 60 nt, Human
ccggaagggggcaaugccagugccuggacccaccaggaugcagggcaagcugggaucggg

SEQ ID NO: 192064 - RNA, 60 nt, Human
ugcaaauuccuuuacuguuaucccccccaccaccaggaccauguagggugcagucuuuac

SEQ ID NO: 192065 - RNA, 64 nt, Human
agcaaauuuguuuuugagaauaaacugguaaccaguuugugaugacucucagaagccuuuuggc

SEQ ID NO: 192066 - RNA, 64 nt, Human
gagucaaaugagcagacuuccaaggaguugaccaguuugugacuagucuggucaccuuuccagu

SEQ ID NO: 192067 - RNA, 64 nt, Human
acacauuuuaaagauuacgugcuucuugguacagguuugugaaugacaguuuaucgucaugcug

SEQ ID NO: 192068 - RNA, 64 nt, Human
ccaacugcugugcugucugcuagggucaccuccuguuugugaaaggggaccuucuuguucgggg

SEQ ID NO: 192069 - RNA, 64 nt, Human
ucaauaacgguccccccucacuccacacuggcacguuugugagaagaaaugacauuuugcuagg

SEQ ID NO: 192070 - RNA, 64 nt, Human
cuguugauguacugauugagaaguucauugucucguuugugauucuuccagaugugaugcuuga

SEQ ID NO: 192071 - RNA, 64 nt, Human
cugugugcaauaauaugauuugcagggcauuucuguuugugacaaaaguuuuuaauaauaguuu

SEQ ID NO: 192072 - RNA, 64 nt, Human
accacagaauaggauucgagauuuacauaugccuguuugugauuuuaucucagaauauaacaac

SEQ ID NO: 192073 - RNA, 64 nt, Human
guaagauauguuaauaaaaaccugcugucauuugguuugugaaagguccuuaaaauguuuacug

SEQ ID NO: 192074 - RNA, 64 nt, Human
ggagcucaucucuuuggggucacaguucuauuuuguuugugaguuuguauuauuauuauuauua

SEQ ID NO: 192075 - RNA, 64 nt, Human
acgggauauggaacgaaaacugcuuuguaaugcaguuugugacauuaauaguauuguaaaguua

SEQ ID NO: 192076 - RNA, 64 nt, Human
cugcuuaccccauagccacauuuguggaugagugguuugugauuaaaagggauguucuugaacu

SEQ ID NO: 192077 - RNA, 64 nt, Human
ccgcguaauaucauuggaguacauucuuuauacuguuugugaaauuaauacuagcauauuaagu

SEQ ID NO: 192078 - RNA, 64 nt, Human
ucacauguuacuucauuuucuuaucaaauuaaauguuugugacauaguauuauuauuaccuucc

SEQ ID NO: 192079 - RNA, 60 nt, Human
cggccuauuuccuugccaggccuguuuccccaccaggaaaugagauaggaggacuggaug

SEQ ID NO: 192080 - RNA, 60 nt, Human
ugcccacuacauccagccuguggcuuugcccaccaggacuuuugagcuggggcugacucc

SEQ ID NO: 192081 - RNA, 60 nt, Human
gcccuccugcaguugcuggauggauagggacaccaggaagaggacaaacugcauggacuc

SEQ ID NO: 192082 - RNA, 64 nt, Human
cucaguucuucagagagcuuccaccagcugcugaguuugugaagacaguggaguucacaagacu

SEQ ID NO: 192083 - RNA, 64 nt, Human
uuuauuuuuguaaugcacauggcaaagcaaagacguuugugaugaaggaacugcucaucuaagc

SEQ ID NO: 192084 - RNA, 64 nt, Human
acgcuagcagaucuuacuccacguauacuuuuugguuugugaaggcaucgguuaagggcacaaa

SEQ ID NO: 192085 - RNA, 64 nt, Human
uacugaugaggcuugugaggccaaucaaaauaauguuugugaucucuacuacuguugauuuugc

SEQ ID NO: 192086 - RNA, 64 nt, Human
uugaaauguguucuccgugauaagcuauccauguguuugugauaagagugcuugucaaccauga

SEQ ID NO: 192087 - RNA, 64 nt, Human
augagugaaggaaagaauaguagcagaaagcacaguuugugaguaaagcugucuggaauuaagu

SEQ ID NO: 192088 - RNA, 64 nt, Human
auuuuuuucuuaccaaaauucacuaaucuugaauguuugugauauuaaauuucaaaugcagaau

SEQ ID NO: 192089 - RNA, 64 nt, Human
uuuuuuuuuuuuacacaagacgugguuaagaacuguuugugaacugaaguuccucauaguguca

SEQ ID NO: 192090 - RNA, 64 nt, Human
ccccuuucuaagccgauaucaacaagacuggaauguuugugauaucaggggcaagaguuaucau

SEQ ID NO: 192091 - RNA, 64 nt, Human
gauuuagauuguaacccgcacacaaaagcacgguguuugugaauauaacaccugucagccaacu

SEQ ID NO: 192092 - RNA, 64 nt, Human
auaccagaugaacauuucaaauugaauuugcacgguuugugagagcccagucauuguacuguuu

SEQ ID NO: 192093 - RNA, 64 nt, Human
uucuagguugcaagguuuugaaauuuucuguacaguuugugaggaccuuugcacuuugccaucu

SEQ ID NO: 192094 - RNA, 64 nt, Human
guacugaugaaccccacuuagcacagcugaagggguuugugaauacucccgccuaaaucccuuc

SEQ ID NO: 192095 - RNA, 64 nt, Human
cuuccuuggauuuacucaugaacuuugccuaguuguuugugauuuuuggcuuucucuggucguu

SEQ ID NO: 192096 - RNA, 60 nt, Human
uaggugacaaugucccccauaucuguaugucaccaggauggcagagagccagggcagaga

SEQ ID NO: 192097 - RNA, 60 nt, Human
ccuuucccucuccugcugagaaccagaacccaccaggagcaccacagaguccuccucuug

SEQ ID NO: 192098 - RNA, 60 nt, Human
aaguacagagugcccgugggggagaagucccaccaggaugcccccccuccccugagaagc

SEQ ID NO: 192099 - RNA, 64 nt, Human
ugcagcaucucuaagggccccuccagcauaggugguuugugaaacucacaggugguccccaggc

SEQ ID NO: 192100 - RNA, 64 nt, Human
cuagucagccagacgugcucuguauucagcaauaguuugugaaugaauaaauuacuaauccucc

SEQ ID NO: 192101 - RNA, 64 nt, Human
uuaugcaucacuucccccaguauaaaucaggaauguuugugagaaaccauugggaacuauacuc

SEQ ID NO: 192102 - RNA, 64 nt, Human
gagauuaaauucauaagacuuaauuuguacaauaguuugugaaauaucuuguuacugcuuuuau

SEQ ID NO: 192103 - RNA, 64 nt, Human
guaaguugagggccagggguagggauauuuuuuaguuugugauuuuacauuuaucuguacauac

SEQ ID NO: 192104 - RNA, 64 nt, Human
uuuaagauaagucugcuaggauguagaaauauuuguuugugauuucuauauagcuauuagagau

SEQ ID NO: 192105 - RNA, 64 nt, Human
agcagcugagcucaaguuugcugucuuuagaaugguuugugaaaauaugguauaaagguguuuu

SEQ ID NO: 192106 - RNA, 64 nt, Human
guguacacuggaaaacacugaaucaauacaaugcguuugugauuaucauuaguaagguaagucu

SEQ ID NO: 192107 - RNA, 64 nt, Human
auauauggcuuugccuuaauauacccccuuuuuuguuugugacuuucaacuguaaucaguuaau

SEQ ID NO: 192108 - RNA, 64 nt, Human
cucauacauaucauuaucguggaacacguugaauguuugugauucuguguggccuuuuuggggc

SEQ ID NO: 192109 - RNA, 64 nt, Human
ucuugaaauaccuaauggcuugaaauucuagucuguuugugaaagauggguacuaucaugauuu

SEQ ID NO: 192110 - RNA, 64 nt, Human
agaaacaaucuaaacaaguuucuguugcauauguguuugugaacuuguauuuguauuuaguagg

SEQ ID NO: 192111 - RNA, 64 nt, Human
gagugcuuaaaauuuaagguuguuuuagaguggaguuugugaguaaaagaggagcccagggaga

SEQ ID NO: 192112 - RNA, 64 nt, Human
aaggugugcuacaauauaggaggcacagucaucaguuugugacauacauuauuuacugccuauu

SEQ ID NO: 192113 - RNA, 60 nt, Human
ccaucucugcugauugaaugucccuccaggcaccaggaucucaucauuuccccaucagag

SEQ ID NO: 192114 - RNA, 60 nt, Human
ugcugugggaugugccaguguccccaccaacaccaggaauuuagaccuuuucccugcacc

SEQ ID NO: 192115 - RNA, 60 nt, Human
gcagaucagguuugucuggccaacuaaggacaccaggaggguugugggcacaccugggau

SEQ ID NO: 192116 - RNA, 64 nt, Human
ucuuuagacuauuuguacccucucuacccacacuguuugugauuuaucaucugucucuuuagug

SEQ ID NO: 192117 - RNA, 64 nt, Human
auauuauuuccagaauuuuagacauuauuacaggguuugugaggaccuuugacucagugacaau

SEQ ID NO: 192118 - RNA, 64 nt, Human
ugcaggucuggaaaaugauaucggaggcccuggaguuugugagcuuggcucuagucccaagaag

SEQ ID NO: 192119 - RNA, 64 nt, Human
uugaaauguguacuacuuaauuuuauauaauuugguuugugaaauuaaagacaucaauaaaaau

SEQ ID NO: 192120 - RNA, 64 nt, Human
gggccugucuccugcacagaguaagccgguaaauguuugugaaaucaaugcguggauaaaggaa

SEQ ID NO: 192121 - RNA, 64 nt, Human
ucucuuccuaaaguauuuguauaugggaguccuuguuugugaauguuuccuggauuagggaggu

SEQ ID NO: 192122 - RNA, 64 nt, Human
cuguaacaggagaccauuuauuauaagcguaccuguuugugaacuuaauuauucugauuccaua

SEQ ID NO: 192123 - RNA, 64 nt, Human
uuuacacacuuugaauaacugcaaaggauuuacgguuugugaaaaauguguacuguggaaaaga

SEQ ID NO: 192124 - RNA, 64 nt, Human
uuugaaugaugguauuauaccaugauuguauacaguuugugaaauuguugcaagggcaaagaua

SEQ ID NO: 192125 - RNA, 64 nt, Human
cuuucuccaucggccaaaaacauuuugacacaauguuugugaaacaccuuuggagaggugcacu

SEQ ID NO: 192126 - RNA, 64 nt, Human
aaguacaccguaauauacauauaaauacauucauguuugugagagaaggaaagaguaaguaauu

SEQ ID NO: 192127 - RNA, 64 nt, Human
gguuuacuguuugagccaauauaaauguuuaacuguuugugauggcaguauuccuaaaguacau

SEQ ID NO: 192128 - RNA, 64 nt, Human
ucaguaauuauuguauggugcucuugucuucuuuguuugugacccaugcuugaaaacuugaagg

SEQ ID NO: 192129 - RNA, 64 nt, Human
auauccugguggaaugccaugguuauuaaaguguguuugugauagugucgucaaaaaaaagguu

SEQ ID NO: 192130 - RNA, 60 nt, Human
acuccugaagaagggagugugaccugcagucaccaggagaugaggguuaggugugcccag

SEQ ID NO: 192131 - RNA, 60 nt, Human
cuggccuggagggugacaccaugucacccucaccaggacucgucucuccauucccgucag

SEQ ID NO: 192132 - RNA, 60 nt, Human
ucuaacccagcauugcccaaacuauuuugacaccaggaccuuuuucuccuuugggauacu

SEQ ID NO: 192133 - RNA, 64 nt, Human
ugauuuaauucuagaaacaauuugauuaccucuuguuugugacaagacuaagcauuaagaugag

SEQ ID NO: 192134 - RNA, 64 nt, Human
ugugguaggcuagcaauauuuugguuaaaaucauguuugugacuguaaccauuuguaugaauua

SEQ ID NO: 192135 - RNA, 64 nt, Human
cugucugauuucuuuuuuuuuccuguuggacuauguuugugaacauaauugucauaaguuaugu

SEQ ID NO: 192136 - RNA, 64 nt, Human
cuuuuuuaugcaugcaaaucauuguuuuuacagaguuugugauaacucauaauuauuuuaaugg

SEQ ID NO: 192137 - RNA, 64 nt, Human
auuagugaucguuuccauuuauccuuaacccucuguuugugaucuuccugauuccaccuacaag

SEQ ID NO: 192138 - RNA, 64 nt, Human
gaaaaaaucucaucuucuuuuccaguagaaaauaguuugugaaaugaugagggcauuuuaucug

SEQ ID NO: 192139 - RNA, 64 nt, Human
gucuuuaguugacaguucacaaacuuguguaaagguuugugaaaugcaucuucuuacugcauca

SEQ ID NO: 192140 - RNA, 64 nt, Human
caacauccacuguuagcacauugauaaaagcauuguuugugauauuucguguacugcaaagugu

SEQ ID NO: 192141 - RNA, 64 nt, Human
cuauauuauaguauuucaguuccgugucuuaacaguuugugauaauuucuaaaacugucuuuuc

SEQ ID NO: 192142 - RNA, 64 nt, Human
aggauuuguauugcauugaguuuauaaacuuuugguuugugaacuucauauuugaucuuuucuc

SEQ ID NO: 192143 - RNA, 64 nt, Human
ugguggcauauaucauguaagacacuuaaaguaaguuugugaauuugucaacuuucgagcauca

SEQ ID NO: 192144 - RNA, 64 nt, Human
aaucuuaauggugauucuucucuguugaacugaaguuugugagaguaguuuuccuuugcuacuu

SEQ ID NO: 192145 - RNA, 64 nt, Human
uggcaugacuacuuaauuuuuuaaaaaaauugugguuugugaauugcaccuuugugccauguuu

SEQ ID NO: 192146 - RNA, 64 nt, Human
caagugauggaaaauaagagucaaauaccuugauguuugugaucucuaacucaaaaaauuugaa

SEQ ID NO: 192147 - RNA, 60 nt, Human
gaggcaguugcauaggucucccucucugggcaccaggacucaguccagcccaagacuacu

SEQ ID NO: 192148 - RNA, 60 nt, Human
gguaggucaaggaaaagagccccuuugauccaccaggagcaauuaagaaagguccuucag

SEQ ID NO: 192149 - RNA, 60 nt, Human
agccagacccugggcccucucuccucacugcaccaggaccugaugccaagaaagugagga

SEQ ID NO: 192150 - RNA, 64 nt, Human
ugacuauagacuuuacugaagugucaacacauuaguuugugagccucauguaagaacaugaugg

SEQ ID NO: 192151 - RNA, 64 nt, Human
ccagguagccguggccaccacagccagacugaacguuugugaaagcugggacaucccaccacac

SEQ ID NO: 192152 - RNA, 64 nt, Human
gugagaaccaccugacuuaguggaugugaaagcuguuugugaucaguaaagcuaccacagauau

SEQ ID NO: 192153 - RNA, 64 nt, Human
ggggaugagucaguccuugcccauccacaauuuuguuugugaacuuauaacaggaauaagcaaa

SEQ ID NO: 192154 - RNA, 64 nt, Human
gaaguggggacggaauagacucacauuagguuuaguuugugaaaacuccauccagcuaagcgau

SEQ ID NO: 192155 - RNA, 64 nt, Human
uuuagcaguauuguucguucugauaugugaauuuguuugugacaacuaaacaaggcauucagca

SEQ ID NO: 192156 - RNA, 64 nt, Human
acaaagguaucagaaaggguaacucgaguugaagguuugugaauagaaggggaaaugugauaga

SEQ ID NO: 192157 - RNA, 64 nt, Human
guacuuauaucuguaaaauagccaggaauuuccuguuugugaucuauuaugccuuuuuacaaaa

SEQ ID NO: 192158 - RNA, 64 nt, Human
aaccauuucuccauggugucuuuauacuuuacugguuugugaauuuuauacaauugaaagucuu

SEQ ID NO: 192159 - RNA, 64 nt, Human
caauauuuaauauaaauauaccauauaauauauuguuugugaauuauugagaaauguaacauuc

SEQ ID NO: 192160 - RNA, 64 nt, Human
auuuuagaaagucuacuauuguaagaguucuucuguuugugaagaaaaaaacaaguuaaaaacu

SEQ ID NO: 192161 - RNA, 64 nt, Human
aaaaaacaagauuuauacaacaauuacuuaggauguuugugaucugccgaccuugcuauagaug

SEQ ID NO: 192162 - RNA, 64 nt, Human
ggcuccaggauuugcugaaagagaaaaagauaugguuugugaacuggggcaucaaucaucuuuu

SEQ ID NO: 192163 - RNA, 64 nt, Human
ccaugaaccacucccauucccccguccccaauguguuugugaguuuccaguugauuuguagcaa

SEQ ID NO: 192164 - RNA, 60 nt, Human
guucagccuugacccaccuugagagagagccaccaggaaggcgcaucuuagcagauggga

SEQ ID NO: 192165 - RNA, 60 nt, Human
caaagguuccucgaacucugcaccuuccuccaccaggagccugggauauggcuccaucug

SEQ ID NO: 192166 - RNA, 60 nt, Human
agugugacagagcagagccagggccaggcgcaccaggagaggcguuucuggggcuccaga

SEQ ID NO: 192167 - RNA, 64 nt, Human
guuuuucaucaaaacguuugggggcuuccaaguuguuugugagaucugaaaacuuaacuuugcc

SEQ ID NO: 192168 - RNA, 64 nt, Human
uugccaugugucaucgagucgcuccccaacagauguuugugauguuuuuguggcugucaccaug

SEQ ID NO: 192169 - RNA, 64 nt, Human
gaauaagccaauuauagguuaauauaaguagaauguuugugaaaaauaaguaugguauccaaag

SEQ ID NO: 192170 - RNA, 64 nt, Human
guagaaaguauuuggcucuaggaaacauuuacuuguuugugaaaacaauaccccaagguaauag

SEQ ID NO: 192171 - RNA, 64 nt, Human
uuaauuucugaauuguauuucaguguuauuuuuuguuugugaccacuaagcuucugucuuaaua

SEQ ID NO: 192172 - RNA, 64 nt, Human
cagagaugaggucaauuucaaauuuuagccaucuguuugugauuucugucauaagcauuuuguu

SEQ ID NO: 192173 - RNA, 64 nt, Human
uucuaauguucuuguguugccccuucuucguacuguuugugaacuuugguuaccuucacauucc

SEQ ID NO: 192174 - RNA, 64 nt, Human
uacgcaguuguaugcaguuaugguuggggggaauguuugugagggucuugaacuauuuaugaga

SEQ ID NO: 192175 - RNA, 64 nt, Human
guuguggaauugugugugguuuuagaggguuucuguuugugaaauguauguauuaaaaauaaua

SEQ ID NO: 192176 - RNA, 64 nt, Human
uuaaaagaaaggguucuguaaaauggaaaacuuaguuugugaauugauuuugaggagugguuuu

SEQ ID NO: 192177 - RNA, 64 nt, Human
gcucugaacauauuuuauuuuuuaaaaaaacuauguuugugaauuuugcguauacuggcaagcu

SEQ ID NO: 192178 - RNA, 64 nt, Human
uucacaaauuccucaugucuuugagauuugaucaguuugugaauauuuuaugcuuugaugauau

SEQ ID NO: 192179 - RNA, 64 nt, Human
ucuacacuacggucucuguuucuccaaaguaaguguuugugauuuguuccucauacugcaguga

SEQ ID NO: 192180 - RNA, 64 nt, Human
accugcacacaguuuuuuuuccuuuucuaaauuuguuugugaucauugacagauuuaaggguug

SEQ ID NO: 192181 - RNA, 60 nt, Human
ggguuggcugagucaagggaccccagagggcaccaggaauaaaaucuucuugaacagaug

SEQ ID NO: 192182 - RNA, 60 nt, Human
ucaagagugagggccccugcugggcccagccaccaggacagcaggaaccagggccuacuc

SEQ ID NO: 192183 - RNA, 60 nt, Human
cagccuucauauuugccauuguguccggggcaccaggagccccaccaaccccaaaccaug

SEQ ID NO: 192184 - RNA, 64 nt, Human
ggaaucauguuggaagcuccacauguccauggaaguuugugauguacggccgacccuacaggca

SEQ ID NO: 192185 - RNA, 64 nt, Human
cugugagcuaaguuuaaaaacugcaaucaugaauguuugugauauuuuaaauaucuacuacagc

SEQ ID NO: 192186 - RNA, 64 nt, Human
gaauauauuccaaaacauuuuugugaauaucuaaguuugugaaacuacuagggcaugauacagu

SEQ ID NO: 192187 - RNA, 64 nt, Human
ccgcaacaacuugguaggaaagauucauccaguuguuugugacagcaaagaugagcccacagag

SEQ ID NO: 192188 - RNA, 64 nt, Human
ugacuugugggagacacccugcagauccucauggguuugugacagccccugcgugcucagugcc

SEQ ID NO: 192189 - RNA, 64 nt, Human
gggggaaggagggugauuauauugcuuuguaaugguuugugauacuugaaacaucacggugcau

SEQ ID NO: 192190 - RNA, 64 nt, Human
gccagagacaucaguaacaaauagcaccuguguuguuugugagcuguuucagucccaguccuga

SEQ ID NO: 192191 - RNA, 64 nt, Human
aacaaauggcagagccuuucccaaggauuugauuguuugugaauuaucugcaugugugcuuuuu

SEQ ID NO: 192192 - RNA, 64 nt, Human
auugucugccauuguugauaaacuguucuaauugguuugugaaagaacucugagaauuagcuaa

SEQ ID NO: 192193 - RNA, 64 nt, Human
gcaguucaaaacaaaacaaaacaaaaagucuuuuguuugugaacacugaugcaagaaacuuguu

SEQ ID NO: 192194 - RNA, 64 nt, Human
ucuguuucucucuuuucccuuuuauguuuucucuguuugugauacaauuagaaaauauaaaauc

SEQ ID NO: 192195 - RNA, 64 nt, Human
ccaguuucagaguuagcuuucuggggagguguguguuugugaaaggaauucaaguguugcagga

SEQ ID NO: 192196 - RNA, 64 nt, Human
cucuaucucagauguaguaaauuauuuccuuucaguuugugaaagcaggauuugacucugaaag

SEQ ID NO: 192197 - RNA, 64 nt, Human
uuaaauugaagagcuccagacacuuuugagcaggguuugugaauagcuuugaaugcuuuccuuu

SEQ ID NO: 192198 - RNA, 60 nt, Human
aucuccagcagagacaacggaggaggcucccaccaggacgguucucauuauuuauauguu

SEQ ID NO: 192199 - RNA, 64 nt, Human
ccaccuccgccuccaaguagcugggacuacaggcgugcgccaccaugcccggcuacuucuugua

SEQ ID NO: 192200 - RNA, 64 nt, Human
aucucuguaucaguguugcucaugcugugucuuugugcgccauggugugucagugucugugugu

SEQ ID NO: 192201 - RNA, 64 nt, Human
gcccaauuuugacccugguuuuuggauuaaauuaguuugugaaggauuauggaaaaauaaaacu

SEQ ID NO: 192202 - RNA, 64 nt, Human
gugagucauuaucaaugguagauaaaauaucaauguuugugaugaauuuacuguaaaaaaauua

SEQ ID NO: 192203 - RNA, 64 nt, Human
gacuuugacuuaggugcuuugggaucuaagugugguuugugacuauccccauuauuuaagcauu

SEQ ID NO: 192204 - RNA, 64 nt, Human
auucugacgauagaaauuuuuauuugcuguuuagguuugugacugaauugugagaauucaguug

SEQ ID NO: 192205 - RNA, 64 nt, Human
ggaacagugaacguagagaauuguuuuuagcagaguuugugaccaaagucagaguggaucaugg

SEQ ID NO: 192206 - RNA, 64 nt, Human
ccaccgccgcugcuauauaguuuagguuucugagguuugugagccuguccugcuuugcauucuu

SEQ ID NO: 192207 - RNA, 64 nt, Human
uugucaguaauuuaacaucacuacaaaaagaagaguuugugacuauucucaucucuguuuugga

SEQ ID NO: 192208 - RNA, 64 nt, Human
uagucaaggugcucaauaaauauuuguuugggugguuugugagccuugcugccaaguccugccu

SEQ ID NO: 192209 - RNA, 64 nt, Human
gcagucagggacugaguucuuccugagggcaguuguuugugauugccuucccuugucccaguac

SEQ ID NO: 192210 - RNA, 64 nt, Human
cccccaggcacuugcucccugcuccauacuuaagguuugugaugccaacauuuggauucucucu

SEQ ID NO: 192211 - RNA, 64 nt, Human
gauauuccgagguaguaagaauacagauaguucuguuugugacaaaccaagcuguuacuuccuc

SEQ ID NO: 192212 - RNA, 64 nt, Human
auuuucuagaaauacacuuuuuuccaaaguguaaguuugugaauagauuuuagcaugaugaaac

SEQ ID NO: 192213 - RNA, 64 nt, Human
ugugagucuaccauuuuuaauuuaugguucaacuguuugugagacugaauucuugcaaugcaua

SEQ ID NO: 192214 - RNA, 64 nt, Human
aauucuaaaagcauacacaauguguaacugaaugguuugugaaaaauauauugauauauauacu

SEQ ID NO: 192215 - RNA, 59 nt, Human
aaccaaauuuuuaaguagucagagacauaucgagguaguuacauaaaauuauuuuguuu

SEQ ID NO: 192216 - RNA, 60 nt, Human
aggacgguugacggcccugcuuggauccaccaccaggacgcugugcucggccauggcgcg

SEQ ID NO: 192217 - RNA, 60 nt, Human
aaagcugccuccguccagaaaugccucucacaccaggagcucggcccucucuuuguagcu

SEQ ID NO: 192218 - RNA, 64 nt, Human
cccuaugaagguucccuuaggcugcugaguuuggguuugugauuuaucuuuaguuuguuuuaaa

SEQ ID NO: 192219 - RNA, 64 nt, Human
cucuuauacaaauuauacauguauuuuuguguauguuugugagaguuguauguaugugaaugug

SEQ ID NO: 192220 - RNA, 64 nt, Human
aauaauccucuagaaagaacccuguuagaucuugguuugugauaaaaauauaaagacagaagac

SEQ ID NO: 192221 - RNA, 64 nt, Human
aaaaaaaaaaagugucuuuguuuaaaauuacuugguuugugaauccaucuugcuuuuuccccau

SEQ ID NO: 192222 - RNA, 64 nt, Human
aaaauuuagcaauagaauguaaauuguauaaaaaguuugugaauaacucaaggguuuaaauuuu

SEQ ID NO: 192223 - RNA, 64 nt, Human
gagaguggaaccuccuauaucauuauuuagcaccguuugugacaguaaccauuucaguguauug

SEQ ID NO: 192224 - RNA, 64 nt, Human
auuggcuuugacuuuuuguaaucuaggagcagcaguuugugagauguuuauucaaaguguuagc

SEQ ID NO: 192225 - RNA, 64 nt, Human
uuuuuuaauuuagugugacuaaggcuuuauuuauguuugugaaacuguuaagguccuuucuaaa

SEQ ID NO: 192226 - RNA, 64 nt, Human
uaauauccaucccuggacuuuuuguauuccaaauguuugugaugcugagaagugaaguucauuu

SEQ ID NO: 192227 - RNA, 64 nt, Human
ggaccaaaccuuuuugucuuuagaguuguucauuguuugugauugcauguuuccuuccuucaac

SEQ ID NO: 192228 - RNA, 64 nt, Human
guauugaccaccaguacuucuauaaugguagauuguuugugaauucagacuuuuaagcauuaaa

SEQ ID NO: 192229 - RNA, 64 nt, Human
gaggcugaggcggguggaucaccugaggucaggaguuugugaccagccuggccaacauagugaa

SEQ ID NO: 192230 - RNA, 64 nt, Human
uuuguuuuaacauaaauaaacaaaucguaucaguguuugugaauaaaauacaaaaaugauuguu

SEQ ID NO: 192231 - RNA, 64 nt, Human
uaguuaagaauagauuguacucauuccuuuuugaguuugugaccucaaaccauuguuuuuauuc

SEQ ID NO: 192232 - RNA, 59 nt, Human
acagagcauuuccuugggugaucauaguuucgagguagaguuuaugaucauucauagcu

SEQ ID NO: 192233 - RNA, 59 nt, Human
uuuuacuaggcuuccugcguguguaaaagucgagguauugcuggcauucagggugacau

SEQ ID NO: 192234 - RNA, 59 nt, Human
aaggccuuaguaacagcaugcuacacugcucgagguacgguaugucccaucgcccugug

SEQ ID NO: 192235 - RNA, 64 nt, Human
ggucacuaagucacuuagacaucucaccguggaaguuugugagccugcauuaggagauagacug

SEQ ID NO: 192236 - RNA, 64 nt, Human
cagagcucuggccacuucugcccacuucauuaggguuugugaacuuuguccuucaccucuuuuc

SEQ ID NO: 192237 - RNA, 64 nt, Human
cacuggggagcacugccaaaaauacagcuuucugguuugugagcccauaaaugacuuaaaucag

SEQ ID NO: 192238 - RNA, 64 nt, Human
uuuguuuuauaccauauaagacucuguacaguauguuugugaaagauugaacuagaauaaugaa

SEQ ID NO: 192239 - RNA, 64 nt, Human
uauauuuugaaauauggcugagaacaugucauugguuugugaggccuaaggugaagcacuccug

SEQ ID NO: 192240 - RNA, 64 nt, Human
cugggacaagcugagcaagcuguaugaacgccacguuugugaagagcugaggguaucaggaggg

SEQ ID NO: 192241 - RNA, 64 nt, Human
caggaaccugacacauaguaggcacacaguaaacguuugugaaugaaugggagucauccagucc

SEQ ID NO: 192242 - RNA, 64 nt, Human
augaaaauaauguauuuauaaguauuuucuuaagguuugugaagaguauuugcauugugucuuc

SEQ ID NO: 192243 - RNA, 64 nt, Human
uucacuuaauaaacacguuuaugccuaucagcauguuugugauggaugagacuauggacugcuu

SEQ ID NO: 192244 - RNA, 64 nt, Human
uuugacacuguuaacuuguuaaauacagugaaaaguuugugagugaagaaugcugagaagauug

SEQ ID NO: 192245 - RNA, 64 nt, Human
accaauaaauguuuguuauuuacacuggucuaauguuugugagaagcuucuaauuagaucaauu

SEQ ID NO: 192246 - RNA, 64 nt, Human
gaaucauuugccguaggcuaaaucagacuguaggguuugugauggauuuauggaguaugugggu

SEQ ID NO: 192247 - RNA, 64 nt, Human
aaaguaaucuugcauaaacuugucaugucauacaguuugugaaaggacaccuuguaaagaagcc

SEQ ID NO: 192248 - RNA, 64 nt, Human
uaguagugguuacauuaucaggcccaucccagauguuugugauguccugaaacaauuuaaaagg

SEQ ID NO: 192249 - RNA, 64 nt, Human
ggacgcaucugcauggcggugguggggaggaggggugcgccauggccuggaggggagugugugu

SEQ ID NO: 192250 - RNA, 64 nt, Human
ccucggagcagccgccgccgcucaacgggcagcugugcgccaagcaggcgcucgccagccucgg

SEQ ID NO: 192251 - RNA, 64 nt, Human
ugccucagccuccugaguagcugggacuacaggugugcgccaccaugcccgacuaauuuuugua

SEQ ID NO: 192252 - RNA, 64 nt, Human
gggcuuugaauuccccagauacugaacaauuuguguuugugacugauggagaauuucaggaaug

SEQ ID NO: 192253 - RNA, 64 nt, Human
ucugccugcagacccugagcacugagucaacaagguuugugaugaugucuguacuaguuagcua

SEQ ID NO: 192254 - RNA, 64 nt, Human
uguuuguuuuucuuuugaacuaugaaaagacccuguuugugaauauauuuuagaaagagaggaa

SEQ ID NO: 192255 - RNA, 64 nt, Human
cuuuuucgcuguuuucagcucugucacaugcucaguuugugacccagggaaaagacuauugcuu

SEQ ID NO: 192256 - RNA, 64 nt, Human
aaaggaagaacucagaaaugucuuguuuauuuguguuugugaccaagcagccucucccuucacc

SEQ ID NO: 192257 - RNA, 64 nt, Human
gauggggcauuuucugagcuaagcuuugucauuaguuugugaagcaccuggucagcaaccugcc

SEQ ID NO: 192258 - RNA, 64 nt, Human
gaggaagguggcugguugguccucccuucccccuguuugugaccugaauuuacaggaaguguuu

SEQ ID NO: 192259 - RNA, 64 nt, Human
uaaucaaacuaagucuugcaucauaaauucuaugguuugugauaaaagcaagugacaaagagaa

SEQ ID NO: 192260 - RNA, 64 nt, Human
ugaacuggauugugguguucacaagaaaaucuuaguuugugaugauuacauugcuuuuuguugu

SEQ ID NO: 192261 - RNA, 64 nt, Human
uagaggaagcugggggacccauuuugcaccaugaguuugugaaaaaucuggauuaaaaaauuac

SEQ ID NO: 192262 - RNA, 64 nt, Human
gcaaaaccacuaacugaaguucagauaauggaugguuugugacuauaguguaaauaaauacuuu

SEQ ID NO: 192263 - RNA, 64 nt, Human
cuauauagcuguuuuguauuauaguguauaugauguuugugaaaaugccagauuuaaaaugaug

SEQ ID NO: 192264 - RNA, 64 nt, Human
aauagaucauaacuggacaucuggaaaacggggaguuugugaugaaauuacccugcuaaugcca

SEQ ID NO: 192265 - RNA, 64 nt, Human
ccugguauuuccacucucacaguagaauagaaauguuugugaaauaaaacugauuuuaacugga

SEQ ID NO: 192266 - RNA, 59 nt, Human
aguagcuauuugacuuuggaauuuugcauucgagguauacugucauuucuugaaaucuu

SEQ ID NO: 192267 - RNA, 60 nt, Human
uuugcaaugaaugacucuuccugagccuggcaccaggagcccuaggcaggccgccgucuc

SEQ ID NO: 192268 - RNA, 64 nt, Human
gcugaauagaaagauaagguuuucgagaggagaagugcgccaauguugucuuuucuuuccacgu

SEQ ID NO: 192269 - RNA, 64 nt, Human
cauucaucacugccugaaaauuugcuguucuaauguuugugaauuuucacucauuaccuagagu

SEQ ID NO: 192270 - RNA, 50 nt, Human
ggcugcggaaaaugagaugaguuugugaaaaaaugcaauaagcccggggg

SEQ ID NO: 192271 - RNA, 64 nt, Human
gguuaauugacauaucuaaauuaucucagucugaguuugugaggaagugugcccugcaguggaa

SEQ ID NO: 192272 - RNA, 64 nt, Human
ucuaauucaccuuaugggggaaaugcuucuuuuuguuugugauagcuauuuuaucauuuccuuc

SEQ ID NO: 192273 - RNA, 64 nt, Human
cauaacaaaacuaauuacuggauuuauuuuuaguguuugugauuaaauucauugugauugcaca

SEQ ID NO: 192274 - RNA, 64 nt, Human
uuucuaguagucugauguauuuuucugaggaauaguuugugauuccaaugcaggugucuucauu

SEQ ID NO: 192275 - RNA, 64 nt, Human
cuaaugcagcugcuggggccugaugcccugaguuguuugugauucaauaaagaauccauaagau

SEQ ID NO: 192276 - RNA, 64 nt, Human
cuauugcugggaagguguguuucucccacaauuuguuugugaauauucacuuguuuuauaaaug

SEQ ID NO: 192277 - RNA, 64 nt, Human
gaaagcuggagccccuggaguuggcugugucuguguuugugacugauuacuggcugugucuugg

SEQ ID NO: 192278 - RNA, 64 nt, Human
caguuuuagcagggauagcagcauucuuauagcuguuugugaugaugccaguauuuggcgcugg

SEQ ID NO: 192279 - RNA, 64 nt, Human
guaauuugcauauaucuuuaauuauuucuguggaguuugugauuuuuuuaucagaaauaauuuu

SEQ ID NO: 192280 - RNA, 64 nt, Human
aaugucauuucaauuuuauuguucugcucauuguguuugugacaaacucuuugcaauauggcuu

SEQ ID NO: 192281 - RNA, 64 nt, Human
uggggguaaacaggccagaagagugugccaaguuguuugugaaucauuccaagcaccucagaug

SEQ ID NO: 192282 - RNA, 64 nt, Human
uaaaauaaggauuuuucucuuauuucucccccuaguuugugagaaacaucucaauaaagugcuu

SEQ ID NO: 192283 - RNA, 60 nt, Human
cccuagaggagacaguuuugaccucuucagcaccaggaaggaagcucugaggaugguugc

SEQ ID NO: 192284 - RNA, 64 nt, Human
gaaaggcuuuugaaaggacggaagcguauucacugugcgccaguacuccuggcugugcuguggu

SEQ ID NO: 192285 - RNA, 64 nt, Human
agccgaucugacuccgcccagccagaugucccgagugcgccaaggacuguccucucacccacuc

SEQ ID NO: 192286 - RNA, 64 nt, Human
augauucccugaguaacaaagggaaaugaaaacuguuugugaucuuccguauucacugaaaaau

SEQ ID NO: 192287 - RNA, 64 nt, Human
cuaguucuucacaguguggcagcugcacuaaucuguuugugagggaauauccauucccucacuc

SEQ ID NO: 192288 - RNA, 64 nt, Human
cguccccuucgcagcgacgagacuucccugccguguuugugacccccuccugcccagcaaccug

SEQ ID NO: 192289 - RNA, 64 nt, Human
aguuccaguuguaaauguauuuguuuaccaguagguuugugaaauugguucuuuguauggggga

SEQ ID NO: 192290 - RNA, 64 nt, Human
ggccuaauguuagcuuuagcuuuagaaaauaacaguuugugaacuuacuucccuauauuugcag

SEQ ID NO: 192291 - RNA, 64 nt, Human
cagcaugaccugguguagacuuaaaaaacuacauguuugugaauauuuuauaauguggaaugau

SEQ ID NO: 192292 - RNA, 64 nt, Human
caggaagaauagaauuguaugcuuuuuucugcauguuugugaucacugugagucucagaugauu

SEQ ID NO: 192293 - RNA, 64 nt, Human
accccuuguaauuuauuacuucauauccucuggaguuugugauuuuaguauaaauuugagacaa

SEQ ID NO: 192294 - RNA, 64 nt, Human
uaauauuagaaacucuuuaauaguuuuccuuucaguuugugagcucuucucugucgcccugaag

SEQ ID NO: 192295 - RNA, 64 nt, Human
aaaucagaaauaggaagauuaaaaccacagaacaguuugugauuucuauugcuguagcuaggua

SEQ ID NO: 192296 - RNA, 64 nt, Human
uuccauguuguaauguuacagagagugugauuugguuugugauauauauauauugugcucuacu

SEQ ID NO: 192297 - RNA, 64 nt, Human
aagcgccuagggcuggagaauagcgcugaguuggguuugugacucuucccucucccugccucac

SEQ ID NO: 192298 - RNA, 64 nt, Human
cacugcagagaccuuaagugcuaaacuuaguggaguuugugaccagagaauuggcauuuucuac

SEQ ID NO: 192299 - RNA, 64 nt, Human
gaaaguugcuuuauuuaaauuuguacuguagaauguuugugauacaguauuuguaaaauugaua

SEQ ID NO: 192300 - RNA, 64 nt, Human
gacuggcaccugugcagagugccgugugcuuguggugcgccaucugaagcaagaguccagcguu

SEQ ID NO: 192301 - RNA, 64 nt, Human
augcacacucagaccucuuugcuuuaccagugguguuugugaguugcucaguaguaaaaacugg

SEQ ID NO: 192302 - RNA, 64 nt, Human
uuccuaagacugcugcugaauuuauaaaaauuaaguuugugaaugugacuacuuagugguguau

SEQ ID NO: 192303 - RNA, 64 nt, Human
cuucagaccuagaauaauacuagucuuauaauagguuugugacuuuccuaaaucaauucuauua

SEQ ID NO: 192304 - RNA, 64 nt, Human
gcuggaauuucuuucuuuuaauuguggcauauagguuugugacacaagaagucauacuuuggug

SEQ ID NO: 192305 - RNA, 64 nt, Human
auugucaacagcaaaauaauauuuugcccacccuguuugugacauugaguugugacuucuauau

SEQ ID NO: 192306 - RNA, 64 nt, Human
ugggugagcuguucacggucuuauacuauuguuuguuugugauuaaaagugcuucaacccaccu

SEQ ID NO: 192307 - RNA, 64 nt, Human
aggcccauauauccuggggagcuuuggucuauuaguuugugacaauauucaaaggccaaaacac

SEQ ID NO: 192308 - RNA, 64 nt, Human
acauacauccaaaaguauaguuucauugucuaaaguuugugaaaacuuuuccaucccuuaaaac

SEQ ID NO: 192309 - RNA, 64 nt, Human
uauuuucuuguaacuggaucagucauauucauugguuugugaccuacucuuaucuccgugggug

SEQ ID NO: 192310 - RNA, 64 nt, Human
guggcauggcuuguaugcuuguccuguggugacaguuugugacauucugucuucaugaggucuc

SEQ ID NO: 192311 - RNA, 64 nt, Human
uuuuuuaaagaaaccuuuuuuaaacuauuucuagguuugugaaugugaagccccaggccgcagg

SEQ ID NO: 192312 - RNA, 64 nt, Human
uagguaaugguuuuuagacauaggacaagcacagguuugugauccucaggagacugcagacaga

SEQ ID NO: 192313 - RNA, 64 nt, Human
uuuaucuucucauguauuauccaugguuuucucuguuugugacagauuaguaaaauuuaaugag

SEQ ID NO: 192314 - RNA, 64 nt, Human
gcuccuaaauagagaaagagcaaauaaagagauaguuugugaaagauucccuugugaacaacuu

SEQ ID NO: 192315 - RNA, 59 nt, Human
gaccgagcgcuuucuggaaaagaggaguuucgagguagaguuugaaggaggugagggau

SEQ ID NO: 192316 - RNA, 59 nt, Human
uaaaagaaagcuugacaguguuaugaaagccaccagacucagccaguguguccccaugg

SEQ ID NO: 192317 - RNA, 59 nt, Human
gcuggccuccuguggggccacuauagcagccaccagaagccgcgaggcccucagggaag

SEQ ID NO: 192318 - RNA, 64 nt, Human
uacugaucaauauaacucugcagacuugcuguguguuugugaagcugccugguguuaggucucu

SEQ ID NO: 192319 - RNA, 64 nt, Human
cuuuaaugaguaucuucaugguaugauaguguguguuugugagugcgaaguaccaauuaaggug

SEQ ID NO: 192320 - RNA, 64 nt, Human
gaaaaaaaauauuauaaauauguaacuaacgccuguuugugaaauuagcuuaucaggcugaaau

SEQ ID NO: 192321 - RNA, 64 nt, Human
auuuuguacuuugcaguauuucucuuguauaccaguuugugauguuuucucuaaaaacuugaag

SEQ ID NO: 192322 - RNA, 64 nt, Human
uaguauucugccucauuuucagggcagaauauguguuugugacccaaaaugacaaaguuaccaa

SEQ ID NO: 192323 - RNA, 64 nt, Human
gaacacuuuucuauuuuauacugaaaucacacagguuugugaucuaagugccagaaccauggag

SEQ ID NO: 192324 - RNA, 64 nt, Human
uucuuagucccaggagccacagguaaucgagaauguuugugaacucuauccacauccccucccc

SEQ ID NO: 192325 - RNA, 64 nt, Human
ggggugcauugcuuauugaaguacauuuuugucgguuugugagggguguuugaugacuuugaca

SEQ ID NO: 192326 - RNA, 64 nt, Human
uaaagcaacacagacacuccuaggcaaaguuuuuguuugugaauaguacuugcaaaacuuguaa

SEQ ID NO: 192327 - RNA, 64 nt, Human
uuguuucuuuuuaaauguauauauuuugacuaauguuugugaaugaaguuggcuaacauguauu

SEQ ID NO: 192328 - RNA, 64 nt, Human
caguuacaaccaauaggaacaacaaaaagaaaaaguuugugacauuguaguagggaguguguac

SEQ ID NO: 192329 - RNA, 64 nt, Human
auugauguauaaugacaguauaaaaugcuuucauguuugugaugucuagugauguggaaaauau

SEQ ID NO: 192330 - RNA, 64 nt, Human
agcgggaagugcgguacagucugggcauucugauguuugugauuguuuuucucacggugaugaa

SEQ ID NO: 192331 - RNA, 64 nt, Human
gacuaaggagauuuuuuuuuucacaguugaguuaguuugugaaaauaaagaacucuguagcuca

SEQ ID NO: 192332 - RNA, 59 nt, Human
ucccagagaggacaaaaaagcccaacuugccaccagaugcuaaaugagacuugacagcu

SEQ ID NO: 192333 - RNA, 63 nt, Human
uaagaaaauucuugugcccgcauugguauuaaauccucgcauucagucuuccugccucuacuu

SEQ ID NO: 192334 - RNA, 63 nt, Human
guccagauucugccagucaucacuggacacgucuccucgcagcugcccuagcaaggggagaca

SEQ ID NO: 192335 - RNA, 64 nt, Human
uuuuguaguuuaccaaauauauucuaauuacaguguuugugaccaaaggaccaacuaugugauu

SEQ ID NO: 192336 - RNA, 64 nt, Human
ugggggcgggggguugguacagaaacuugaagcuguuugugauauguacaacucagauguuucu

SEQ ID NO: 192337 - RNA, 64 nt, Human
acaauccauuccuacuguauuucuguaugaauguguuugugaauguauguguaaaagucuuucu

SEQ ID NO: 192338 - RNA, 64 nt, Human
uuacuuguuccauaacuccaagugagucuguaauguuugugaagcuugacuguaaccauguuuu

SEQ ID NO: 192339 - RNA, 64 nt, Human
gaccagcccaggcguuggguguuagucugcaugaguuugugagaggaaauagcuggguguccug

SEQ ID NO: 192340 - RNA, 64 nt, Human
aagucacuucaccucccugagccccaauucccaaguuugugaaauggcaacaauaccuaugugu

SEQ ID NO: 192341 - RNA, 64 nt, Human
agguuauacuccuuaaguuaucccaaagccguguguuugugauguuuuggaguacauauauaug

SEQ ID NO: 192342 - RNA, 64 nt, Human
uucucaaauauccuugauuuuggauguucaguauguuugugagagagguuucugggaagacucu

SEQ ID NO: 192343 - RNA, 64 nt, Human
agacauuaucauggcaugacuuaagggaacauugguuugugaaggaaaaacagauuaucuaaag

SEQ ID NO: 192344 - RNA, 64 nt, Human
aauugcuaagcauguucagguuuacuuuguugauguuugugaagcaaaacaaugggaaacugac

SEQ ID NO: 192345 - RNA, 64 nt, Human
aaaugaguuaaguuguuggcuuggggcaagugaaguuugugacuaugcuugauuuaauaagcug

SEQ ID NO: 192346 - RNA, 64 nt, Human
ggugucgggggggaugggguguauuuuguugcaaguuugugaggggaaaauguuuugguuuguu

SEQ ID NO: 192347 - RNA, 64 nt, Human
auuacguauagcagaggauguaagcaauauuauuguuugugaaguuuuguuuuuaaugucuuga

SEQ ID NO: 192348 - RNA, 64 nt, Human
acuucauuuuacccugggucacuugcugccagcaguuugugaauggugucuuucaaauaacuua

SEQ ID NO: 192349 - RNA, 59 nt, Human
caucuagaacucccagacccuggacuuagccaccagagagcuacauuuuaaaggcuguc

SEQ ID NO: 192350 - RNA, 59 nt, Human
ugccacauggaaaaacaggacaccagagcccaccagacagugccggccagcagagaagc

SEQ ID NO: 192351 - RNA, 59 nt, Human
agggguuacgauuauagcaauuuaagggcccaccagaagcaggccucgaggagucaauu

SEQ ID NO: 192352 - RNA, 64 nt, Human
uaaauaggucauuuuugucuguggcauuuuuacuguuugugaaaguaugaaacagauuuguuaa

SEQ ID NO: 192353 - RNA, 64 nt, Human
ccccugcaaugcgucuugugaaauuguguagaguguuugugagcuuuuuguucccucauucugc

SEQ ID NO: 192354 - RNA, 64 nt, Human
uccuucacgaggagggagcuacccuucgccagaaguuugugagaauguggccgcccuuuuccug

SEQ ID NO: 192355 - RNA, 64 nt, Human
uuugauaaauccucuauugacuggguagagguauguuugugaaagacauguaacuuggggauuu

SEQ ID NO: 192356 - RNA, 64 nt, Human
cacccaagaacuuugggagugugugucuguuuugguuugugagaaaguagcugccccucauucu

SEQ ID NO: 192357 - RNA, 64 nt, Human
ugacccauacagacuugaaaccagagaacauccuguuugugaauucugaguuugaaacccucua

SEQ ID NO: 192358 - RNA, 64 nt, Human
gaaccauggucggaaaacaugcuacacacugcauguuugugauugacgggacuguugguauugg

SEQ ID NO: 192359 - RNA, 64 nt, Human
cuuaaaauguuuacacacuguggugcaaucuacuguuugugaaugucuguauuaucaggaaaca

SEQ ID NO: 192360 - RNA, 64 nt, Human
gcuauggaaaaccaggccagagggucacugucugguuugugauuugguggacaaaacacucgcu

SEQ ID NO: 192361 - RNA, 64 nt, Human
cuguaagaaaaaguugagacuuuuguuuugcuuuguuugugagagauguguauguauuucugcu

SEQ ID NO: 192362 - RNA, 64 nt, Human
aaacaggauuuugccacaauuauuuaaauauuauguuugugaacuaucuaagcaugagaaaaua

SEQ ID NO: 192363 - RNA, 64 nt, Human
aagcagcuuaccucaguauuucagggcagcaaguguuugugaagcaaggaugagcagcaugaag

SEQ ID NO: 192364 - RNA, 64 nt, Human
uucuuccuugaauauauuuucuguagcugaaaauguuugugaaguggcugucaacuacacaucg

SEQ ID NO: 192365 - RNA, 64 nt, Human
acugagcugugugcacugugccagggacaggaggguuugugaacugccugucaggguaccuguu

SEQ ID NO: 192366 - RNA, 59 nt, Human
gagaugaaugucuuuccucucccugccucccaccagacuuccuccuggaaaacgcuuug

SEQ ID NO: 192367 - RNA, 59 nt, Human
ccaaggggucaucaucucuggccaccacuccaccagaugggcagagcagcuaugaccgc

SEQ ID NO: 192368 - RNA, 59 nt, Human
gcuggccaggagguagguggagggcaaggccaccagaccuggcuucgcgcuguccacug

SEQ ID NO: 192369 - RNA, 64 nt, Human
gauaggagaaagugccagcccugaagcuggagccguuugugaauaaacuguucuucaucauuga

SEQ ID NO: 192370 - RNA, 64 nt, Human
aguuguugcaguugcucaucaucuugggaaagguguuugugacuuuucagagcccagauuccug

SEQ ID NO: 192371 - RNA, 64 nt, Human
uuugaagucuccgggaggauguucgucucaguuuguuugugagcaggcugugaguuugggcccc

SEQ ID NO: 192372 - RNA, 64 nt, Human
aacacaccaaucagcacccugugucuagcucaguguuugugaaugcaccaauccacacucugua

SEQ ID NO: 192373 - RNA, 64 nt, Human
cucuggggcugucauggcccacgcguuuugcaaaguuugugacucaccauucaaggccccgagu

SEQ ID NO: 192374 - RNA, 64 nt, Human
uuggggcugucuguguuucccagguggagcucauguuugugauccucuaucuggacagcucucc

SEQ ID NO: 192375 - RNA, 64 nt, Human
aguuacauucugaagcucauaaauguaugagaagguuugugauuuugcacaagguguguguagu

SEQ ID NO: 192376 - RNA, 64 nt, Human
cuccucugacaugcggucagauaagucccgucuuguuugugaguaccacagaaacgccugagag

SEQ ID NO: 192377 - RNA, 64 nt, Human
cugacaugaggaaugcagguucacacuguaaagaguuugugaaagguuucagucuaacuggggu

SEQ ID NO: 192378 - RNA, 64 nt, Human
caucaagcccauuuccuuccccaaccacaaagguguuugugauuccucaccccgggaaaccaag

SEQ ID NO: 192379 - RNA, 64 nt, Human
acauuuacauauaagucuguuuaauuucaaaggaguuugugaaaaaaaauccauggugaaaaug

SEQ ID NO: 192380 - RNA, 64 nt, Human
aggcugccacacaaaguagcagaaauaggaugauguuugugagcaccagacucaagaccaugac

SEQ ID NO: 192381 - RNA, 64 nt, Human
auaagcucuuucuuuccuuuuguuacuguauuuaguuugugauaaauuuuucacugugugauau

SEQ ID NO: 192382 - RNA, 54 nt, Human
uuucccuccagucauuguaguauuguuugugacccugagaaggcaaaagaaaga

SEQ ID NO: 192383 - RNA, 59 nt, Human
auguuauggagcuucaagaaucgaguuacccaccagaacccuaaugguaaagcuaugau

SEQ ID NO: 192384 - RNA, 59 nt, Human
ucccuuccuggggaccacacugcucugcuccaccagaccacacuaugaaauaggaauaa

SEQ ID NO: 192385 - RNA, 59 nt, Human
agcaaacucuggacugguggaagaauuccccaccagaucuccuugaagcagaaguaggg

SEQ ID NO: 192386 - RNA, 64 nt, Human
ccaucauccuggccagcuggagcgcccuggcgguguuugugaagagggcuguccuggccgaaag

SEQ ID NO: 192387 - RNA, 64 nt, Human
aaggaauggauucaggauguuguuggagaaacaaguuugugauuaguccuuaaaacuuagcucc

SEQ ID NO: 192388 - RNA, 64 nt, Human
gaggaauuuguaacgaucggugugaccugaaaggguuugugauacagcggucacuauuuucucu

SEQ ID NO: 192389 - RNA, 64 nt, Human
aaaaaaagcccacaucuuauacuccaaugaguguguuugugaguuuuuauccuguuugaauuuu

SEQ ID NO: 192390 - RNA, 64 nt, Human
agaagauagaccaacuuuuuaugucgguuuggguguuugugaguuuggggagcaauuuuuauaa

SEQ ID NO: 192391 - RNA, 64 nt, Human
gucuaaaauccaauguuguggguagagagaaugaguuugugacuaggagagacuaaacuuuugu

SEQ ID NO: 192392 - RNA, 64 nt, Human
uauauuugucucauuuuguauguauguguaguguguuugugaguaugugugguuuauaaucuga

SEQ ID NO: 192393 - RNA, 64 nt, Human
gugugcacgugugcgugugcgugcguguguguguguuugugagcaugggugugcccuuggggua

SEQ ID NO: 192394 - RNA, 64 nt, Human
ggcaggcuguggccauguagccccaucacacuguguuugugauugucugugugucugucucccc

SEQ ID NO: 192395 - RNA, 64 nt, Human
aucuugagguggggaaggaggugaugaaacauuaguuugugaaauccaaggcccuggcuugcuu

SEQ ID NO: 192396 - RNA, 64 nt, Human
uuuggugggcuuuggagcugucccaccugcacacguuugugagcucccagccggcaggccugga

SEQ ID NO: 192397 - RNA, 64 nt, Human
acccucaagagucacugcuuugucugugcugguaguuugugagaagugacccgcacgcuuccau

SEQ ID NO: 192398 - RNA, 64 nt, Human
aggaaaaaagaaaguauccucuuuggugguuaagguuugugauaaagaguuuuaacacacucgc

SEQ ID NO: 192399 - RNA, 64 nt, Human
aaucgcugucucucugucucuuugcuuuguaucuguuugugaguugauccuggcuucucucucu

SEQ ID NO: 192400 - RNA, 59 nt, Human
aagaugauggagugccacuuccgauuccgccaccagauggcacuaggugacugacggga

SEQ ID NO: 192401 - RNA, 59 nt, Human
uacagacacuauucaacuuuggcaucuugccaccagaagacccgagggaggcucagcuc

SEQ ID NO: 192402 - RNA, 60 nt, Human
uaaaugacacccuuggaucugaacaauacacaccaggacaauugugugcaacaguucuac

SEQ ID NO: 192403 - RNA, 64 nt, Human
gcucaguuuuuacagacuguaaaggagauguguuguuugugaagauggagcagagucaaaucug

SEQ ID NO: 192404 - RNA, 64 nt, Human
caccucugggauuggccuaccuggggauuucuugguuugugaaaacaggagaggagaaauaucu

SEQ ID NO: 192405 - RNA, 64 nt, Human
gcuuguucuagaaucauguauuuuguaaacugauguuugugauggucucugguucuugaacagc

SEQ ID NO: 192406 - RNA, 64 nt, Human
auuggugacgauggguguugcuguuuuucuugucguuugugaacgcugugaugcugugugccca

SEQ ID NO: 192407 - RNA, 64 nt, Human
auuaugaucccuucccccugcugaucaaucugcaguuugugaacuucacaagaauggugugugc

SEQ ID NO: 192408 - RNA, 64 nt, Human
gacacaggcggaagccuaggagagccgaaucaguguuugugaagaggcaggacuggccagagug

SEQ ID NO: 192409 - RNA, 64 nt, Human
cugccuccacccaggagacugaugcacaagaucuguuugugaaagccugauuuaaaaagaaaaa

SEQ ID NO: 192410 - RNA, 64 nt, Human
ucuuccgucucacaacucacaagaaacuuucuggguuugugacauacagagguugaauugagua

SEQ ID NO: 192411 - RNA, 64 nt, Human
caugggacucucugcuacauucaguucuugugucguuugugaaaguucuuaaccugcccaaaaa

SEQ ID NO: 192412 - RNA, 64 nt, Human
uaguuuuuguaauuuauuuucgauuucacaguguguuugugauuguuugcucugagaguucccc

SEQ ID NO: 192413 - RNA, 64 nt, Human
uaguuuuuauaauuuauuuuugauuucacaguguguuugugauuguuugcucugagaguucccc

SEQ ID NO: 192414 - RNA, 64 nt, Human
auguagcuucccagaaagaaugaaugaggaauguguuugugaaugccucaugacauaagcaucu

SEQ ID NO: 192415 - RNA, 64 nt, Human
ccauccacucuagcuuugugaccaugggacugaaguuugugauggcuuuuuuaucaaguagauu

SEQ ID NO: 192416 - RNA, 64 nt, Human
acuuaguaaagucuuggagacuagaagcaagauaguuugugacacauaagcuucccaaaaacua

SEQ ID NO: 192417 - RNA, 59 nt, Human
gcuaugucuuuuaggaagccacucuuagcccaccagagucugcccuuuggcccaaaauu

SEQ ID NO: 192418 - RNA, 59 nt, Human
gcaauaucaggggaauaugcuaaauguuaccaccagagggcacaagcauaucacuuuua

SEQ ID NO: 192419 - RNA, 59 nt, Human
uuguuucuucugcuuguuucuguacagggccaccagacuccuggagagaucaagcaagg

SEQ ID NO: 192420 - RNA, 64 nt, Human
uuagaucaccccagauggccugaugacaacaagaguuugugaaguuaugauuucaugauuucuu

SEQ ID NO: 192421 - RNA, 64 nt, Human
augaccucuccaccuuauaguuuaugaaugucuuguuugugaaagugacuauaacccaaacuuu

SEQ ID NO: 192422 - RNA, 64 nt, Human
aaauggauuuauaaaucaguuuucuauugaaaauguuugugauauuuugcuuuugcaccuuuaa

SEQ ID NO: 192423 - RNA, 64 nt, Human
auaauuaaaaaaugagcuuuuauaugcagaacugguuugugaggaaacaugcaugcagcugugg

SEQ ID NO: 192424 - RNA, 64 nt, Human
gauccuggguucuguuuauaugaaguucuucccaguuugugaauucuaguacagcagccaugca

SEQ ID NO: 192425 - RNA, 64 nt, Human
ggccagcuguccagcccagcccugugugugaaucguuugugacgugugcaaaugggaaaggagg

SEQ ID NO: 192426 - RNA, 64 nt, Human
uuaaauucugauacaugccuucuuuguagguggaguuugugauugcagugaauagaacaaauuc

SEQ ID NO: 192427 - RNA, 64 nt, Human
aauaccguaucuucuaaauuugaaauauaauucuguuugugaccuguuuuaaaugaaccaaacc

SEQ ID NO: 192428 - RNA, 64 nt, Human
aauuagcgguguauuucuugaaguuuaauauuguguuugugauacugaaguauuugcuuuaauu

SEQ ID NO: 192429 - RNA, 64 nt, Human
auauauauauauuucuauuuaaagaggauccugaguuugugaauggacuuuuuuagaggaguug

SEQ ID NO: 192430 - RNA, 64 nt, Human
acugggaagacgaggcguucucaucccauaggagguuugugagaacucacgccgggggugaaaa

SEQ ID NO: 192431 - RNA, 64 nt, Human
uuccauauuuauacagcagagaagcuguaggacuguuugugacuggcccuguccuggcaucagu

SEQ ID NO: 192432 - RNA, 64 nt, Human
gggugggcuaugggcuguauuuauugugaaucuaguuugugaggcuguggccccgagcuggcgg

SEQ ID NO: 192433 - RNA, 64 nt, Human
acuaacuuguucuuuuuguuccuggcuuucaucaguuugugagauuucucuauuuuuuuuaaau

SEQ ID NO: 192434 - RNA, 59 nt, Human
gaugucaucccccgaccccacccuguuuuccaccagaguucugacacugugacucugua

SEQ ID NO: 192435 - RNA, 59 nt, Human
gugcagugcuaagugucacaugucugcuuccaccagaggcuaggaauagugauccugcu

SEQ ID NO: 192436 - RNA, 59 nt, Human
aaggaauggaagauggacaccaccggacaccaccagacacuaggaugggauggaugguu

SEQ ID NO: 192437 - RNA, 64 nt, Human
ccuucauggcaggcaucgccauucuugcugaaccguuugugauugccauuugagcucuggaagc

SEQ ID NO: 192438 - RNA, 64 nt, Human
guggggcugugagcuuucccagccuccugcccguguuugugaauaucauucuguccucagcugc

SEQ ID NO: 192439 - RNA, 64 nt, Human
caccaagcuaggaaguggcaggaguuugccgguuguuugugaggggaaaaauuuuuuuuucaga

SEQ ID NO: 192440 - RNA, 64 nt, Human
uggccugggaaaguacuugccucauguugcucugguuugugauaauaaaggcuuuacaguuuaa

SEQ ID NO: 192441 - RNA, 64 nt, Human
auagugauuccuuuuguauuaauuucuaguguauguuugugauauaaacauuuaauaaauaucc

SEQ ID NO: 192442 - RNA, 64 nt, Human
ggccccacccaugagugaugguucuggcugauuuguuugugauguuguuagccgccugugaggg

SEQ ID NO: 192443 - RNA, 64 nt, Human
ggccccacccgggagugaugguucuggcugauuuguuugugauguuguuagccgccugugaggg

SEQ ID NO: 192444 - RNA, 64 nt, Human
caccauguuagacaggauggucuccaucuccugaguuugugaucugcccgccuuggccucccaa

SEQ ID NO: 192445 - RNA, 64 nt, Human
gaaucuuuuaguaucugggcuguuacaccuguggguuugugaauuugugucuguccaccuguau

SEQ ID NO: 192446 - RNA, 64 nt, Human
ggccauaaacaaaauaucugcagcacugugacauguuugugauggccaugacccccacccugaa

SEQ ID NO: 192447 - RNA, 64 nt, Human
augucgaaagcauuauaacuguaacguucuuugaguuugugauugauccacauuuuucccccug

SEQ ID NO: 192448 - RNA, 64 nt, Human
agucagccuugguuuggcuuccuauucucaagagguuugugaagauuuaaucucagauuccuua

SEQ ID NO: 192449 - RNA, 64 nt, Human
aauucacacuggagaaaagccauagaaauguaagguuugugacaaggcuuucgggaaugauuca

SEQ ID NO: 192450 - RNA, 64 nt, Human
aauucacauugaagagaaaccauacagagguaagguuugugacaagguuuuugcauauaaugca

SEQ ID NO: 192451 - RNA, 59 nt, Human
uguagguucagucagauccaaccauggauucgagguauuauacuguauaacccuacaaa

SEQ ID NO: 192452 - RNA, 59 nt, Human
cacaaacauggugcucuaccaggaaggauucgagguagauaggcucaggccacacuuua

SEQ ID NO: 192453 - RNA, 59 nt, Human
acuguuuugggaaggaagaguaccucuuaucgagguaguauaaaacacauagggucuug

SEQ ID NO: 192454 - RNA, 64 nt, Human
auuccauuguuugagguuucucaaaaaggcuacuguuugugacuuucaaccugaacuauggauc

SEQ ID NO: 192455 - RNA, 64 nt, Human
cuauugggauggaccgcuggacagcaaugcucgaguuugugaauuuggagagauacucaaaaga

SEQ ID NO: 192456 - RNA, 64 nt, Human
auuuaauguugcgcuugugcacuguguuaauauuguuugugauggauuggacguugugacucuu

SEQ ID NO: 192457 - RNA, 64 nt, Human
auguaauauuaaauuccuccugucuccucugucaguuugugaagugauugacauuuuguagcua

SEQ ID NO: 192458 - RNA, 64 nt, Human
uuguggauguuggcgauagacugucaauuagguuguuugugauccaacaagaacauuuccaaaa

SEQ ID NO: 192459 - RNA, 64 nt, Human
ccaagggcaacuuuagccacgcaagguagcugagguuugugaaacaguaggauucucuuuuggc

SEQ ID NO: 192460 - RNA, 64 nt, Human
acuccucacccccuugcuccccuggucuucuggaguuugugacauugauuugaaauggauggug

SEQ ID NO: 192461 - RNA, 64 nt, Human
aguuuucuaacauagcuauaagguccuuguugcuguuugugauaacugauagauaacucauugg

SEQ ID NO: 192462 - RNA, 64 nt, Human
gcaggugggcugccugcuguguuaagaggacuuaguuugugauguaaggcacugucaggaaugg

SEQ ID NO: 192463 - RNA, 64 nt, Human
uuuuuuguaggucacaacaacucauuuuuacagaguuugugaagcuaaauauuuaacauuguug

SEQ ID NO: 192464 - RNA, 64 nt, Human
acucuccuugaaaauacugaacauagcuguauagguuugugauuauuagagaauauguuaauaa

SEQ ID NO: 192465 - RNA, 64 nt, Human
guuuacaggauacuuuccugaauguguucuugguguuugugaaaauccuauaagauuuaaagaa

SEQ ID NO: 192466 - RNA, 64 nt, Human
aagaaugaaggaagaagaaaaaaggauccuugauguuugugacaagaaaaugagaaaguuagua

SEQ ID NO: 192467 - RNA, 64 nt, Human
cugaaguucagcucaagacuacccuaccugcuguguuugugagaagaguaggaucacacacaca

SEQ ID NO: 192468 - RNA, 59 nt, Human
cuggaccggcacaagaaacugcuuucuucucgagguauaaccgucggcagaagaaaagg

SEQ ID NO: 192469 - RNA, 59 nt, Human
ucuaccuacuccgaguguccuccccugccccaccagauugcugcaggggcgcggugugc

SEQ ID NO: 192470 - RNA, 59 nt, Human
gcggauuagcuaucuuccaacaaugcugaccaccagacaauuacugcauuuuuccagaa

SEQ ID NO: 192471 - RNA, 64 nt, Human
ugaauguugagcaaagcuuaggccaacaugaauuguuugugaagugugguugauggugcuuugu

SEQ ID NO: 192472 - RNA, 64 nt, Human
acuaucagcagcggcagcagcagcagcagcagcaguuugugaucuguccuuccaaccuguucac

SEQ ID NO: 192473 - RNA, 64 nt, Human
auaugagaaaaguugcuugaagugcauuacagguguuugugaagucacauaaucuacggggcua

SEQ ID NO: 192474 - RNA, 64 nt, Human
ggcauggggggcuguaguguagcuacaguugugcguuugugaaauggcuuagcuuuccauguug

SEQ ID NO: 192475 - RNA, 64 nt, Human
agcucauuaaauucuuccagcauucuaaaggaggguuugugauugucaccauuuacugaugagg

SEQ ID NO: 192476 - RNA, 64 nt, Human
uuccuugugaacuaacuauauuuuagccauaacuguuugugauguacacaauguuaagggauuu

SEQ ID NO: 192477 - RNA, 64 nt, Human
acuaacauaaaagauauaaaaggcaauaacuauuguuugugagcaacuuuuuuauaacuuccaa

SEQ ID NO: 192478 - RNA, 64 nt, Human
acagauaaaaaauguaucugcagcaacucugcagguuugugaaauaggaugaaacucaaucuuu

SEQ ID NO: 192479 - RNA, 64 nt, Human
aucgccugccugggcccagagcaggggaacuggaguuugugagugagcagagcagguuaugugc

SEQ ID NO: 192480 - RNA, 64 nt, Human
auagccccuuagccaguuguauauuauucuugugguuugugacccaauuaaguccuacuuuaca

SEQ ID NO: 192481 - RNA, 64 nt, Human
auaaagugacuugggaguuuggucagugggguugguuugugauccaggaauaaaccuugcggau

SEQ ID NO: 192482 - RNA, 64 nt, Human
ucuuugggguuugggcuuuuuuauacucuucucaguuugugaaacgcuaacugcacacgaagcc

SEQ ID NO: 192483 - RNA, 64 nt, Human
ccccugggacaugaacccaccugcguggaaugcuguuugugaggugucuacaggguuuauagua

SEQ ID NO: 192484 - RNA, 64 nt, Human
caggguaccagguaagcuuaacuccaucuuggguguuugugacaggcccugccugccacccuag

SEQ ID NO: 192485 - RNA, 59 nt, Human
aguguuaauaucaaacauucuuuacgugcucgagguauugcuuuuaacauucuacuuug

SEQ ID NO: 192486 - RNA, 59 nt, Human
uccucuuguagaacugccucuuugaaauuucgagguaaucuacuuuggagacucugccu

SEQ ID NO: 192487 - RNA, 59 nt, Human
uucacagaguuccagugugugguauucuuucgagguauucuuuccaggccgagauugag

SEQ ID NO: 192488 - RNA, 64 nt, Human
gaggcggaagucuagagcugcaugaucugauaggguuugugacagggcggggguggcggcggcc

SEQ ID NO: 192489 - RNA, 64 nt, Human
gcgaccugugugguggccuugagcugcuuucuguguuugugaggacugacucccauuuccuaaa

SEQ ID NO: 192490 - RNA, 64 nt, Human
ugaaaaaaacauugcugaaaaccuaaaaaugaaaguuugugaguguuuauugguuuucuuaaga

SEQ ID NO: 192491 - RNA, 64 nt, Human
cccugcuauccccacagccucauuccugcagaagguuugugacguagcugugccuguaccuggg

SEQ ID NO: 192492 - RNA, 64 nt, Human
agguuuuucuuaguucuucugcuuuugcaauuguguuugugaaauuugaauacuugcaggcuuu

SEQ ID NO: 192493 - RNA, 64 nt, Human
accuuuuccagauacaaacuugccuuauuuucuaguuugugaacaagaacgaaugaaguacuau

SEQ ID NO: 192494 - RNA, 64 nt, Human
augcagaauaauauuuuuaagaguauugauugaaguuugugauauucaucaauaaaaaugaguu

SEQ ID NO: 192495 - RNA, 64 nt, Human
cauucuccuagguagagccuccaucuucaguuguguuugugaagguauuuuuugcuuuuuaaau

SEQ ID NO: 192496 - RNA, 64 nt, Human
aaaaugaugaacauacaguauucauuaaugcagcguuugugaaaacaaaagauuggaagcuguu

SEQ ID NO: 192497 - RNA, 64 nt, Human
aggccccauggaggguauacugaggggucuauagguuugugauuaaaauaauaaaagcuaggcg

SEQ ID NO: 192498 - RNA, 64 nt, Human
uaguaaugaaucaaugaauaaauaaugagcuaggguuugugaggcuuucuacaaauaggucagc

SEQ ID NO: 192499 - RNA, 64 nt, Human
uguauggauggaauaucccuuuucuucaagugcaguuugugauguguuuuguuuuuuuuuuuuu

SEQ ID NO: 192500 - RNA, 64 nt, Human
uuguuggucugaguuucccggaugagcucuggguguuugugaguuugguuucucugcccugccc

SEQ ID NO: 192501 - RNA, 59 nt, Human
uuugguagcuugugaaugugccagguguuucgagguaggcuugccuucuggcagcaugg

SEQ ID NO: 192502 - RNA, 59 nt, Human
ccuuaaacacccagaagcaguaauaaucaucgagguauguuuauauuuauuauauaagu

SEQ ID NO: 192503 - RNA, 59 nt, Human
uauuugcccgcauccuccucuauccuguuucgagguagagagcuuggcacuucuguuac

SEQ ID NO: 192504 - RNA, 64 nt, Human
caguuauauucugagucaaaguuggggcuuuuuacggcauaauuauggaauuuuuauuuacugg

SEQ ID NO: 192505 - RNA, 64 nt, Human
gauaguuuuuaagguuucaauucaaucuucugaacggcauaaguccuauuuuagccuuaccucc

SEQ ID NO: 192506 - RNA, 64 nt, Human
ucugcguugaguggacggacuuauuccugugaagcggcauaauuugucuccauugaaaaauggc

SEQ ID NO: 192507 - RNA, 64 nt, Human
aacccagaugguguuaacuggccgccccacuuuccggcauaacuuuuuagaaaacagaaaugcc

SEQ ID NO: 192508 - RNA, 64 nt, Human
cacuuggauuccaucucuucucugaggagcucgacggcauaaaucagaagcaagcacagaguuu

SEQ ID NO: 192509 - RNA, 59 nt, Human
cacgccuguaaucccagcaguuugggaggucgagguagguggaucaccugaggucggga

SEQ ID NO: 192510 - RNA, 59 nt, Human
ccuccccagugaccugcgaaaguggagcaucgagguaggagggaaacggcaaccaggga

SEQ ID NO: 192511 - RNA, 59 nt, Human
uaaaaagcugagcuguaaaauauuuuacaucgagguauaauaaauaaucauguacaugu

SEQ ID NO: 192512 - RNA, 59 nt, Human
cacaccuguaauuccagcacuuugggaggucgagguaggcagaucaccgagcccaagag

SEQ ID NO: 192513 - RNA, 64 nt, Human
auugcccugcuaaggaggaucaagacccguaauccggcauaacacccugggguuuuccacucuu

SEQ ID NO: 192514 - RNA, 64 nt, Human
aagaauuagauaaaaccuguuguuuauuauuauucggcauaauggacuugguaguuuuucuauu

SEQ ID NO: 192515 - RNA, 64 nt, Human
gaaggugaugguaauuucauuagucccaaaacaccggcauaagaaauuugacauuucacagaug

SEQ ID NO: 192516 - RNA, 64 nt, Human
uuuuauaaacguuggcaguuugauguuucuguuucggcauaacguaauccauuucacuguagcc

SEQ ID NO: 192517 - RNA, 64 nt, Human
uucugagcaccagcacuuccagcgcuucacuuaacggcauaaagcaaaacaggaccuuggcaca

SEQ ID NO: 192518 - RNA, 64 nt, Human
aguauaugauacucuguaacauuucuauuuauaucggcauaaauuucauuuuuuuucuucauau

SEQ ID NO: 192519 - RNA, 64 nt, Human
uuuggcuacagagagggaagggaaagccugaggccggcauaaggggaggccuuggaaccugagc

SEQ ID NO: 192520 - RNA, 64 nt, Human
aagguaaacgcagauuguaucuuuuuuaaugguacggcauaaaaaguaacccucaagugaagug

SEQ ID NO: 192521 - RNA, 64 nt, Human
cagugccuuuccauuuauuuaacccccaccugaacggcauaaacugaguguucagcugguguuu

SEQ ID NO: 192522 - RNA, 64 nt, Human
uacuguucgaagauuuuuggaagaauacugagaacggcauaaagugaagaucgacauuuaaaaa

SEQ ID NO: 192523 - RNA, 64 nt, Human
auaacagguuaugaggaaaugagcgauauaugaacggcauaaaaacagaaauuacccaguaaaa

SEQ ID NO: 192524 - RNA, 64 nt, Human
cagcugguccuuugugaagaacguagagagaaugcggcauaaccaccaauaaaggagucuugau

SEQ ID NO: 192525 - RNA, 64 nt, Human
aaauaguccuaaucaguauaugcuaguugagcaucggcauaauuuucuuuccucuggcugaucc

SEQ ID NO: 192526 - RNA, 64 nt, Human
accuaagcagaccagaagcaaaaugucuucuucacggcauaaggacaucuccacuuuucucugu

SEQ ID NO: 192527 - RNA, 59 nt, Human
acccucagggccucucggaauguaguugcucgagguaaccgcuagagggugcgcaccug

SEQ ID NO: 192528 - RNA, 59 nt, Human
ggggaaggcccucggagcucguuuccagaucgagguaagagggacuuucuuaaaggccu

SEQ ID NO: 192529 - RNA, 59 nt, Human
gaagaucuaggucugguucuauaaaaggaucgagguauuuccaguauguaacacuuuuu

SEQ ID NO: 192530 - RNA, 64 nt, Human
aaauaagcaaauguggcaggcuuugcuuucuggaucccaggauuaaaacuaaccgugaccacua

SEQ ID NO: 192531 - RNA, 64 nt, Human
uccugcacuccuccagcuggagucucaccgcggaucccaggaauaccugcuguucccacagggc

SEQ ID NO: 192532 - RNA, 64 nt, Human
agaaugcaccugacuuaugaaauggggauaauacucccaggaaauagcgcaggacaucacaagg

SEQ ID NO: 192533 - RNA, 64 nt, Human
ggacccccagggccacacuguacccuccagcgagucccaggagagugacucuggucauaggacu

SEQ ID NO: 192534 - RNA, 64 nt, Human
ccuugcucacucacucacuccaagaccaccagggucccaggaagccggugccuggguggccauc

SEQ ID NO: 192535 - RNA, 64 nt, Human
acucacaccuccuuuucuucuagcuuuguuguccucccaggaaccaaaaaaccccagcuauuuu

SEQ ID NO: 192536 - RNA, 64 nt, Human
agccagagcucugccaaaggccccgcagucccucucccaggaggacccuagaggcaauuaaaug

SEQ ID NO: 192537 - RNA, 64 nt, Human
uuucccuucuaguuuugagagacuuccucuuggcucccaggaggagggauucccugacuuugac

SEQ ID NO: 192538 - RNA, 64 nt, Human
ugggggcaggagccgagccuuuuuguugcuccgcucccaggagagugagggugacgcaauugau

SEQ ID NO: 192539 - RNA, 64 nt, Human
guuaugagcaaaguuguuacugauuucuuguaucucccaggauuccuguugcuuuacccacaac

SEQ ID NO: 192540 - RNA, 64 nt, Human
aaccuucauaaagcaggucagcguggccugauugucccaggaccugaagggagcaaggauggcc

SEQ ID NO: 192541 - RNA, 64 nt, Human
ucagcuugggaaugauggcugccaacucccaaucucccaggaaggcagggggcagaaucuuuuu

SEQ ID NO: 192542 - RNA, 64 nt, Human
cccucagcagggaagggauccccggggaggcaggucccaggagcagacccugcccccagccccc

SEQ ID NO: 192543 - RNA, 64 nt, Human
auuccgcagcuugcagcaagcacagagugugaccucccaggauuugcugacagcgguagaugcc

SEQ ID NO: 192544 - RNA, 64 nt, Human
cacuuugggaggccaaggugggaagaucacuugaucccaggaauucuagaucagcuuggacaau

SEQ ID NO: 192545 - RNA, 58 nt, Human
ccucccaggagcuccagugacagccccaucccaggaugggugucuggggagggucaag

SEQ ID NO: 192546 - RNA, 59 nt, Human
aucaggcuuucucaagcccuccaucggccccaccagaucuccauucuuugccaugaggg

SEQ ID NO: 192547 - RNA, 60 nt, Human
acccuuccaggccacaguaggcugaagcagcaccaggauccuggccuggccuggccugua

SEQ ID NO: 192548 - RNA, 60 nt, Human
ccugcucaguguggcuggagguugaaaugccaccaggaaaaugccacuucauaauugaaa

SEQ ID NO: 192549 - RNA, 60 nt, Human
cuuuugcagauaucagcugguuggauuucucaccaggauugucuauagaaguuaacugau

SEQ ID NO: 192550 - RNA, 64 nt, Human
uauguauucaccaagcccaaaaauagauuguggcucccaggauuccaauuuuaauuggagagcu

SEQ ID NO: 192551 - RNA, 64 nt, Human
gacuccccuuucccuucccaaagaggauaggaccucccaggaugcuucccagccucuccucagu

SEQ ID NO: 192552 - RNA, 64 nt, Human
caaagggugugccucguccugcccgcacugccucucccaggaacuggaaaagcccuguccggug

SEQ ID NO: 192553 - RNA, 64 nt, Human
gggaagccugggauguaggcgcuggagcuccaguucccaggagcaggggcagguguuccuagau

SEQ ID NO: 192554 - RNA, 64 nt, Human
ggcaagaugaccuugcugccuggggccugcucucucccaggaauucucaugugggauuccccuu

SEQ ID NO: 192555 - RNA, 64 nt, Human
agggacacuuggucacuccagaguuuuuaauagcucccaggaggugauauuauuuucagugcuc

SEQ ID NO: 192556 - RNA, 64 nt, Human
uucucuguauguuuacguccuuuggacuggcuucucccaggauucuuuucuguuuuuguuuuuu

SEQ ID NO: 192557 - RNA, 64 nt, Human
uugcagcuagacccuuugagacuuaagagcugcaucccaggaucagaagccagggcuaauuggg

SEQ ID NO: 192558 - RNA, 64 nt, Human
cccccucccuuccagcccugagccgggaaccaucucccaggaccuugcccugcucacccuaugu

SEQ ID NO: 192559 - RNA, 64 nt, Human
acaguguuucaagagacccuaaaaaaccugccugucccaggacccuaugguaaugaacaccaaa

SEQ ID NO: 192560 - RNA, 64 nt, Human
cuccugcuucccuuaccagucgugcaccgcugacucccaggaagucuuuccugaagucugacca

SEQ ID NO: 192561 - RNA, 64 nt, Human
caaauauggauucuagggcucuggaacugauugcucccaggaucuccugccagcccagcuggcc

SEQ ID NO: 192562 - RNA, 64 nt, Human
gagaugaacuuucccuccaaagcuagaacuuucuucccaggauaacugaagucuuuugacuuuu

SEQ ID NO: 192563 - RNA, 64 nt, Human
acagccccgguccagacagcagccuguacauccaucccaggacacagcccagccccuccccaca

SEQ ID NO: 192564 - RNA, 64 nt, Human
ccuucugccuccauauauccugaacaucaaacuaucccaggaaaaccaucuagaguaguuuguu

SEQ ID NO: 192565 - RNA, 64 nt, Human
aucaauggcuugaauaaaaaccagagaagguuuuucccaggacgucucauguuuggcccuuuag

SEQ ID NO: 192566 - RNA, 64 nt, Human
gccugcugugagucaauugagggaguguuuggggucccaggagacuuggacggggggaguuugg

SEQ ID NO: 192567 - RNA, 64 nt, Human
ggaaaaggcagacuaaggccuccuuucucugaccucccaggaagaaaauagcuucuccuacagu

SEQ ID NO: 192568 - RNA, 64 nt, Human
gaguucucagucacugugcaauaugcccccugggucccaggagggucuggaggaaaacuggcua

SEQ ID NO: 192569 - RNA, 64 nt, Human
cuuucaagcuacauguacuaaauugucgaaggucucccaggagcucuguacugaggcagacaca

SEQ ID NO: 192570 - RNA, 64 nt, Human
ugccugugcuccuggccccccuagcaucaugcuaucccaggaguaucaggaccagacacaucca

SEQ ID NO: 192571 - RNA, 64 nt, Human
aucuuccucucgcagcuugaugagccccggugugucccaggagucggagaagcuggaaagugug

SEQ ID NO: 192572 - RNA, 64 nt, Human
uucaaaaguaacggaaucagcaucugugaugccaucccaggaugugagugggucugaagauaca

SEQ ID NO: 192573 - RNA, 64 nt, Human
ccagcgacccacacauuccucacguagcuucugcucccaggaagguaguuuaaauccuguauau

SEQ ID NO: 192574 - RNA, 64 nt, Human
ggcccggugacaccugcagcccucacuccugucaucccaggacacuugaggcccaaggaggugg

SEQ ID NO: 192575 - RNA, 64 nt, Human
cuggccagauggcguggcugguugccuuaauaugucccaggaccccugacagggcugccuggcc

SEQ ID NO: 192576 - RNA, 64 nt, Human
aauauauugucagaaacacaaggcuugauuugguucccaggacagugaaacauaguaauaccac

SEQ ID NO: 192577 - RNA, 64 nt, Human
uccccagcgaagaauccggcugccccugggccagucccaggaccuuugcacaggacugaugggu

SEQ ID NO: 192578 - RNA, 64 nt, Human
uugcucaaauuccugggcccccaaguuagcccccucccaggaguggucagcgggucacagcugc

SEQ ID NO: 192579 - RNA, 64 nt, Human
aguccgauuuuguggugguaaugggagaaggacaucccaggagcagggucuggugggaggaaag

SEQ ID NO: 192580 - RNA, 64 nt, Human
gaugccuuucuguaggcugguguuguugccucccucccaggaucccuuuggugaguaugguguu

SEQ ID NO: 192581 - RNA, 64 nt, Human
cagagcucccuguugcccuccuuuucccguuuagucccaggaacaaaaaagggcauuuugggua

SEQ ID NO: 192582 - RNA, 64 nt, Human
auacugagucuuccuuuccuuuucugacccuucucgaggacauuugcuuuccucacacuuuugu

SEQ ID NO: 192583 - RNA, 63 nt, Human
aaggacugaaaaucaggagguguaauaaaauguuccucgcauucccccccgcuuuuuuuuuuu

SEQ ID NO: 192584 - RNA, 63 nt, Human
gccccagggcagaggggaauggcaaaauguagguccucgcaggagcucuucuucccacucugg

SEQ ID NO: 192585 - RNA, 63 nt, Human
ugauacuguagguucacccauuuuuuuuuaauuuccucgcaaauaacaagacccacagaagug

SEQ ID NO: 192586 - RNA, 64 nt, Human
uccucaccuuucagacguauuuucuuuauucacaucccaggagcauccauuuuaaggaacuauu

SEQ ID NO: 192587 - RNA, 64 nt, Human
acugugguagaaggaagacagaacucacacaugcucccaggauuggggacagggacagaggagg

SEQ ID NO: 192588 - RNA, 64 nt, Human
uuuauccagcaaugccucaaggauguugcauugcucccaggaacuggcuauuagguaugucuug

SEQ ID NO: 192589 - RNA, 64 nt, Human
ccaccucccaaccugaugaccucucuggcuggccucccaggaggagggacacuccagccccccu

SEQ ID NO: 192590 - RNA, 64 nt, Human
gaagaugcucuucagcccagaagagauggaccucucccaggagcagccccuggaugcccagcag

SEQ ID NO: 192591 - RNA, 64 nt, Human
cacacuaaucgaacuaugaacuacaaagcuucuaucccaggagguggcuauggccacccguucu

SEQ ID NO: 192592 - RNA, 64 nt, Human
gugucugaacuugcugccuccucgcuccuugcucucccaggaucaauuguaucuugaguuaaaa

SEQ ID NO: 192593 - RNA, 64 nt, Human
aauaugcuuauagugguaagaaauggacuugaggucccaggagauuucauuuuauucacccugg

SEQ ID NO: 192594 - RNA, 64 nt, Human
gauaguaauaauaauaaauguaggcucagcucuuucccaggauuuucaucaaaaagcuuuaagu

SEQ ID NO: 192595 - RNA, 64 nt, Human
gggacaggaggaagagaugccaccagggcuggucucccaggaguagagaccaugggaaaugggg

SEQ ID NO: 192596 - RNA, 64 nt, Human
gaaauugguuuuccagaggccuguuuuggggcuuucccaggagaaagaugaaacugaaagcaca

SEQ ID NO: 192597 - RNA, 64 nt, Human
auuugugaccugccaucuuucagugcuucuugguucccaggaugccacuuccuccacgaauagc

SEQ ID NO: 192598 - RNA, 64 nt, Human
agagcgugucuuuacucauugugcugcuuagccuucccaggagucgguucucaauuaggcuguu

SEQ ID NO: 192599 - RNA, 64 nt, Human
ccaugaaacaacaagauccaguggcucuucuuacucccaggacuccaucaucuucccuucagcu

SEQ ID NO: 192600 - RNA, 64 nt, Human
agcuuucuaauucuucucaugcauaugcauucacucccaggaauacucauucgucuacucugau

SEQ ID NO: 192601 - RNA, 64 nt, Human
cuuuggacuuuuugcuuuagauaaaagaaagacaucccaggagaaggacaaaccagaggaguga

SEQ ID NO: 192602 - RNA, 60 nt, Human
accaaagauauauacacaggauccuauucucaccaggaaggggguccacccagcaaagag

SEQ ID NO: 192603 - RNA, 60 nt, Human
ccugacucugacugcuguuauccugguucucaccaggaggugucgcacugccucccaccc

SEQ ID NO: 192604 - RNA, 60 nt, Human
ugggucucaagugggaggauaaggcuucaccaccaggagauuccccucugcccgaugacu

SEQ ID NO: 192605 - RNA, 60 nt, Human
cagucagucagacgcugcaggcaccacuaucaccaggaguggccaaguaaaccgagacac

SEQ ID NO: 192606 - RNA, 64 nt, Human
gacaagaaaaccccaaaguggccugcuuuucccaucccaggagcucauuauccagucugugcca

SEQ ID NO: 192607 - RNA, 64 nt, Human
caugcugagaauaaacacacgucccaggcucaucucccaggacugaaacuuucuugcucucuuu

SEQ ID NO: 192608 - RNA, 64 nt, Human
gacuuuucaugaucacacagcuaauaagugguggucccaggauucaacccaagaagucuguuag

SEQ ID NO: 192609 - RNA, 64 nt, Human
aagaggugaaagagaagccuggcucuguucacggucccaggagcuguccuugcugcaugcccug

SEQ ID NO: 192610 - RNA, 64 nt, Human
uugcaccccgaggggagaugccuucucccccaccucccaggaccugcaucccagcucagaaggc

SEQ ID NO: 192611 - RNA, 64 nt, Human
gcaaugauccuguuucuaccaacacugcaccuuaucccaggaaccugcccuagaccuccagaga

SEQ ID NO: 192612 - RNA, 64 nt, Human
ggggaaagaugagcuuuucuaggcuacaauuuucucccaggaagcuuugauuuuuaccguuucu

SEQ ID NO: 192613 - RNA, 64 nt, Human
cgugugacgggggaaagccaaggucuggagaagcucccaggaacaaucgauggccuugcagcac

SEQ ID NO: 192614 - RNA, 64 nt, Human
uuaugccugcgcagcaggagcccuguccucacguucccaggagggcggcuucacccuucguaac

SEQ ID NO: 192615 - RNA, 64 nt, Human
ugugggguucugcugggaccuuggagagccugcaucccaggaugcuggguggcccugcagccuc

SEQ ID NO: 192616 - RNA, 64 nt, Human
gagaacaagcaaaguaugcaggcccccugcagccucccaggacaggcuggcaagggaggagggc

SEQ ID NO: 192617 - RNA, 53 nt, Human
aacccaagaccgaggcuuaagggucccaggaguacugcagggacagccccaga

SEQ ID NO: 192618 - RNA, 64 nt, Human
gaccagagggaugggagagucaagggaaggacaaucccaggaaguccuaagaaguggggcagau

SEQ ID NO: 192619 - RNA, 64 nt, Human
uguccaggccaggcacaguggcucacaccuguaaucccaggacuucgggaggcugaggcuggag

SEQ ID NO: 192620 - RNA, 64 nt, Human
guccaagaggaguaaaggucaugacagaauuuacucccaggacaaucuaaguucugccacaagu

SEQ ID NO: 192621 - RNA, 64 nt, Human
agccugcagcuuucuggaaauucuucccugggggucccaggauccccugcuacuccacugaccu

SEQ ID NO: 192622 - RNA, 58 nt, Human
uuacguggaagaaacgcuaaggguuugcucccaggaaaggagaggaagagcuauauau

SEQ ID NO: 192623 - RNA, 59 nt, Human
gccagcgccaaaacaagccaaagagccucccaccagagccgggaggaaaaggccccugc

SEQ ID NO: 192624 - RNA, 59 nt, Human
ugcugaauaaauuaggccucaggccucuaccaccagagagcuggagaauggguccacgu

SEQ ID NO: 192625 - RNA, 59 nt, Human
gggccuucccucccugccugggugucgggccaccagaaggcucugccggacgccaagaa

SEQ ID NO: 192626 - RNA, 64 nt, Human
uacaccaaagauguauuuggaucugggcacccccucccaggaucccuguacucacgugccaguc

SEQ ID NO: 192627 - RNA, 64 nt, Human
ccuucucacccuuuccaucuucaguuugaaugacucccaggaaggccuagagcagacccuuuag

SEQ ID NO: 192628 - RNA, 64 nt, Human
caacuuccgcugccuucggacauagggacccaguucccaggagcggggagguaggguuggggcu

SEQ ID NO: 192629 - RNA, 64 nt, Human
ggaccugccccugaccaaugauacccacaccuccucccaggaagacugcccaggccuuuguuag

SEQ ID NO: 192630 - RNA, 64 nt, Human
cccccugccugauccccugcuggcugggggcagcucccaggauauccugccuuccaacuguuuc

SEQ ID NO: 192631 - RNA, 64 nt, Human
uuuaauaaaaguugugccucaccauacuugaagcucccaggacaaggguugagaggcucaaccc

SEQ ID NO: 192632 - RNA, 64 nt, Human
ugggagcgguaccuuucccuugggcagccuggggucccaggaacaagccagggcgaguggcaug

SEQ ID NO: 192633 - RNA, 64 nt, Human
guccucacugcucccugaagccagccuucuuccaucccaggacaccacacccagccucaguccu

SEQ ID NO: 192634 - RNA, 64 nt, Human
gugucugguaucaucggaucugguuuugaauaauucccaggaguccugggucccuggccuccaa

SEQ ID NO: 192635 - RNA, 64 nt, Human
gccccaggcaaccuuagccccucagaacagggagucccaggacccagggagaguguggggacag

SEQ ID NO: 192636 - RNA, 64 nt, Human
acugagacggcagagaccccaggaucccagagcuucccaggaucccucccagauccucugcuga

SEQ ID NO: 192637 - RNA, 64 nt, Human
cgggaacaccucucaccugaacccgggggucccaucccaggaagaagggccaucucaggacaug

SEQ ID NO: 192638 - RNA, 64 nt, Human
ugacagccaggcuugaggguggacggcgugccucucccaggagccuuccccauguccuugccuu

SEQ ID NO: 192639 - RNA, 64 nt, Human
ccugcuaggccccaguucuuccuccuucccccuuucccaggaaaggccagcccaguccauggcc

SEQ ID NO: 192640 - RNA, 64 nt, Human
uggcugccaggggccugcagggucugggugggucucccaggagaggaauacugagugggagauc

SEQ ID NO: 192641 - RNA, 64 nt, Human
aaaaggcuuggcuauggcccugugugacuccaggucccaggaaccuugccuucgucaucugugg

SEQ ID NO: 192642 - RNA, 59 nt, Human
aguaugagaauguuguacccaucuccaggccaccagaacccugaugaccuugaauuugg

SEQ ID NO: 192643 - RNA, 59 nt, Human
ccuuugugcuuugcacaaaccugaaucccccaccagagaggaugugugugaggagccag

SEQ ID NO: 192644 - RNA, 59 nt, Human
cccccuuuaugaacuguacuggcuguugaccaccagacaccugaccgcaaauaucuuuu

SEQ ID NO: 192645 - RNA, 59 nt, Human
gucuauuguuuaacuguaccauccagagcccaccagaagcuauugaucauuaaaauuau

SEQ ID NO: 192646 - RNA, 64 nt, Human
acacuguauuuaccuuuguuuggacucgguuuguucccaggaccucuggucuggcuccuccuac

SEQ ID NO: 192647 - RNA, 64 nt, Human
uccuccccccaauucccccccccaucaccuuaucucccaggacacacuugagaaguagcuuuuu

SEQ ID NO: 192648 - RNA, 64 nt, Human
aggucaaggcuuccccugaguaagguccauuucuucccaggaauccaaucuccuguggauggag

SEQ ID NO: 192649 - RNA, 64 nt, Human
gcugucuuccccucccucaaccccaauaggaggaucccaggauaaacacugcugggcaggcggg

SEQ ID NO: 192650 - RNA, 64 nt, Human
cugcgcugcuuggugugacccacggaggauccacucccaggaugacgugcuccguagcucugcu

SEQ ID NO: 192651 - RNA, 64 nt, Human
gcugcauccugaaaagcaugccugugggcuguccucccaggacaagccaaggagccaacgaggg

SEQ ID NO: 192652 - RNA, 64 nt, Human
ccgcaacaucucagcgaggagugaaggacccaugucccaggaaccgcgcugcgccaccugcacu

SEQ ID NO: 192653 - RNA, 64 nt, Human
gaaaauuggagucuaaucuuucaaggaggugggcucccaggaugguaccauugcucuuuccuag

SEQ ID NO: 192654 - RNA, 64 nt, Human
ccaggauguggcaaucaaugacacuauugggguuucccaggauggauuggucagggggagaaag

SEQ ID NO: 192655 - RNA, 64 nt, Human
gugacacacggcccccuuccuccuguccccacacucccaggagaaacucccgguguguuucuga

SEQ ID NO: 192656 - RNA, 64 nt, Human
ggaacugccagaggaagaucuggcgucacauggcucccaggaaagugcugugcccuauccccac

SEQ ID NO: 192657 - RNA, 64 nt, Human
ggcaccaggaaaggccugcacccucuuccugcucucccaggaagccagcucccugagcuccuga

SEQ ID NO: 192658 - RNA, 64 nt, Human
uguaacuuugaucaugucuguuccuguuccauucucccaggagcuucucugcagacugacacac

SEQ ID NO: 192659 - RNA, 64 nt, Human
ggcaccagcauacacacguuuuucuagguacagcucccaggaacagcuaggugggaaaguccca

SEQ ID NO: 192660 - RNA, 64 nt, Human
uugcccugcuaggaauuagaagacagacaccaugucccaggacaguguuacuucuucugcauga

SEQ ID NO: 192661 - RNA, 64 nt, Human
gaaugcugauucagagugcaccucuuugacuaggucccaggauccccuugucccuggaguaggg

SEQ ID NO: 192662 - RNA, 59 nt, Human
ggccuguguaggcagucauggcaccaaagccaccagacugacaaauguguaucagaugc

SEQ ID NO: 192663 - RNA, 59 nt, Human
cuggggcugggcagccugguauucaguggccaccagaagagcagggccagccccgguca

SEQ ID NO: 192664 - RNA, 59 nt, Human
ggagaaguugggaagcuacguucuguuggccaccagacuugcauuucagccucugucau

SEQ ID NO: 192665 - RNA, 59 nt, Human
ccaccccucugcugcaggaggcguggccaccaccagaugcucccugucuggggcaggca

SEQ ID NO: 192666 - RNA, 64 nt, Human
gggcaggaaagcaucucucuuuuccugucuuuuaucccaggaggcaggacaacacugagacugg

SEQ ID NO: 192667 - RNA, 64 nt, Human
uccuuuauucugcuacugcucucauucugucucaucccaggaauccagucccaagugcugccug

SEQ ID NO: 192668 - RNA, 64 nt, Human
uacgcuugggcuuuucuguuaccaaacagcacuaucccaggaacuauugucugccugggaacac

SEQ ID NO: 192669 - RNA, 64 nt, Human
gacaugggcugggugcaguggcucacuccuguagucccaggacuuugggaggccgaggugggaa

SEQ ID NO: 192670 - RNA, 64 nt, Human
aacuaaaaugccagggccaggcuguguauuucuuucccaggaaauuagcuuuccagccccuuua

SEQ ID NO: 192671 - RNA, 64 nt, Human
cucuuaacucccuuauuaccuaaacuugucuggcucccaggaacagccuuauagagagagggag

SEQ ID NO: 192672 - RNA, 64 nt, Human
uuucaaaggcauucuauuugguuuagaaguugauucccaggagugccauauuucagcuacugua

SEQ ID NO: 192673 - RNA, 64 nt, Human
auuaaaauucuuacuagauagauauauuccuuccucccaggaguauuagacuagcuaauaguaa

SEQ ID NO: 192674 - RNA, 64 nt, Human
cguuuuaggacucugugccacuuugagagacuguucccaggaggcccaaccgcagaccuggcaa

SEQ ID NO: 192675 - RNA, 57 nt, Human
uucggaagccccgucucuaaaagggguucccaggagaccugauucccuguggugaua

SEQ ID NO: 192676 - RNA, 64 nt, Human
uucagaaggugagcuguuguuuuucuaaaccucuucccaggaaggggacauugacacuugaauu

SEQ ID NO: 192677 - RNA, 64 nt, Human
cguuuccucugcccacuaaucccugcgcaggacuucccaggaccccuuuugucucugggaccag

SEQ ID NO: 192678 - RNA, 64 nt, Human
cugggaagagcccccaacuccaacaggauuauuuucccaggaggaguuacagaugcagccacag

SEQ ID NO: 192679 - RNA, 64 nt, Human
uccagugcuugguccugcucuggucacuggggcuucccaggaggcagcagggucuggucauaau

SEQ ID NO: 192680 - RNA, 64 nt, Human
auauguuuuaaguuauauuuuggcaaguguagacucccaggagagacuuguagguacaaucuag

SEQ ID NO: 192681 - RNA, 64 nt, Human
cagcugaguccugggguuggggagggggucggggucccaggaccugagccuggccauguccuca

SEQ ID NO: 192682 - RNA, 59 nt, Human
cgcccacgccgcggccaccgggcccacggccaccagaaugcaauugagaaaucguuuau

SEQ ID NO: 192683 - RNA, 60 nt, Human
uucaaucaaguuauugauuccaaagaacuccaccaggaauuccugugacggccuguugau

SEQ ID NO: 192684 - RNA, 60 nt, Human
agcuacucccuguuauugugugcaaguuuacaccaggaugcucacuugauuugugaauau

SEQ ID NO: 192685 - RNA, 60 nt, Human
caauccagucaacaccuacuauguaccaggcaccaggaagccagaagcucagggcccagc

SEQ ID NO: 192686 - RNA, 64 nt, Human
ccuugcugcccgaaugcucggaaacaggagccuuucccaggaacucuuuuuuaugccagaacgc

SEQ ID NO: 192687 - RNA, 64 nt, Human
caaguagugggugccacccagcacucagccccgcucccaggacccgcuuauuuauagaaaguac

SEQ ID NO: 192688 - RNA, 64 nt, Human
auccuaagccauagacaggcuaauugcccaccacucccaggaauauugaaauagcuacaugacc

SEQ ID NO: 192689 - RNA, 64 nt, Human
aguguaccugucuugccagcacugccagcgucagucccaggaguccacacugguccauccugcc

SEQ ID NO: 192690 - RNA, 64 nt, Human
gcccagagaugcccugggcucagaucuguaauucucccaggagcugugauagagcaggccacac

SEQ ID NO: 192691 - RNA, 64 nt, Human
cagcucccacaaggguuccaggaauuccugguguucccaggacaccagacugcaauaacuggag

SEQ ID NO: 192692 - RNA, 64 nt, Human
aguuccuggcccguggauguuaaagcugcucgauucccaggaucucggcugccuuuuccucuau

SEQ ID NO: 192693 - RNA, 64 nt, Human
cccagccagacacucauucccauugaccaucuggucccaggagcucaggaggaggaccccaggg

SEQ ID NO: 192694 - RNA, 64 nt, Human
uucuacagugauucuacuucugaggagucuucugucccaggaagagauaccuucuuuacaggag

SEQ ID NO: 192695 - RNA, 64 nt, Human
uuaaaaaaaucugugcaauaauuuuaaaaugugcucccaggaauagacacaaauguuuugagua

SEQ ID NO: 192696 - RNA, 64 nt, Human
aguaggauacauuauuagaaacuguuagggucuuucccaggacauuuuuuuuucuguaucaugu

SEQ ID NO: 192697 - RNA, 64 nt, Human
gucaaaauucaucucuuucuuuaagcccaucaacucccaggacgguuugaguuacucaguuacc

SEQ ID NO: 192698 - RNA, 64 nt, Human
cuccaccgccugcaccaacagccucaguguuacuucccaggauuugcucugccccaaacgagcu

SEQ ID NO: 192699 - RNA, 64 nt, Human
ugaagcaggaggagcacucaaggggguuuggucuucccaggaagagggccugagguucuccuag

SEQ ID NO: 192700 - RNA, 64 nt, Human
ucuuuuuucaguuucacauaccuuaucuaagguuucccaggauuuaaacagaaacuacuucuau

SEQ ID NO: 192701 - RNA, 64 nt, Human
cugccguaaauccuggggcaagggaucagccucuucccaggaaccaucgccuucuauaaaccgu

SEQ ID NO: 192702 - RNA, 60 nt, Human
uucaacaacucuccagcucugaauggagaaacucucuaggccauccccucuucuaccucc

SEQ ID NO: 192703 - RNA, 60 nt, Human
gaaaaggcccgauuauuacccauaaggcacacucucuaaggccuuuuaaggggccuacaa

SEQ ID NO: 192704 - RNA, 60 nt, Human
gcacuguaauacgugcuuaacuuugcuuaaacucucuaauucccaauuucugaguuacau

SEQ ID NO: 192705 - RNA, 64 nt, Human
ccgcccccccaacgcgcacacacacguccucuccucccaggaaccucauucaaauauuuacccg

SEQ ID NO: 192706 - RNA, 64 nt, Human
caagcaaauaucaaauacugcaaaaauccccuugucccaggauacccuaaaauagaagugcuua

SEQ ID NO: 192707 - RNA, 64 nt, Human
guuacuggccaggagcggcggcucaugccuguaaucccaggacuuugguaggccaagacaagca

SEQ ID NO: 192708 - RNA, 64 nt, Human
gauuuuuuauguuacuagaagagauuauuugacuucccaggaauuuucugucuguaaucacuaa

SEQ ID NO: 192709 - RNA, 64 nt, Human
ucuaguuuugguuccuuuugcagagugaaaugccucccaggaaaaaaauacauauguauuuuuu

SEQ ID NO: 192710 - RNA, 64 nt, Human
gaccaccacagggagcucagaccccaacccuggaucccaggagaaaggaguggaccgaggaagg

SEQ ID NO: 192711 - RNA, 64 nt, Human
cccccauuucucauuagugcaaugucauaucugaucccaggaagccuggaaaauaaaagacgau

SEQ ID NO: 192712 - RNA, 64 nt, Human
uuaauuuguucuguuucugccaaacuucuuuaacucccaggaaggguagaauuuugaaaccuug

SEQ ID NO: 192713 - RNA, 64 nt, Human
aagccuuauuaaacguggacguuguuuucugccuucccaggauucuuccuucagugcugaggca

SEQ ID NO: 192714 - RNA, 64 nt, Human
gcuucuucccuuuccaaagguuucugaggacuucucccaggagaagacugcccgccucagaacu

SEQ ID NO: 192715 - RNA, 64 nt, Human
ucuuggagcucugugucaacuuugauccuuugucucccaggaaggugugaccucuccuuugccu

SEQ ID NO: 192716 - RNA, 64 nt, Human
aucuccaggaugccugugaagaaagaucccuggaucccaggaugauuauaggacaaguuguuca

SEQ ID NO: 192717 - RNA, 64 nt, Human
caggaagcaaagccuuggugccugugagcucaucucccaggauggugacuaaguagcuuagcua

SEQ ID NO: 192718 - RNA, 64 nt, Human
uggaccuuugauagcagcacauguauuguaaaugucccaggaucagagaccuguugaauuugag

SEQ ID NO: 192719 - RNA, 64 nt, Human
uagcgucucugcacgugaccucugacaaagcccaucccaggagacggggugaagcuauucccca

SEQ ID NO: 192720 - RNA, 64 nt, Human
agucuugcaagacccagggagaacccacugcuuuucccaggaggcuccaggauuaggaaaugug

SEQ ID NO: 192721 - RNA, 60 nt, Human
uuuccaugaaaauuucuaagaaaacuccaaacucucuaaauaguagcuaacuuuuauuuu

SEQ ID NO: 192722 - RNA, 60 nt, Human
aaauuuauacaaaguuucagagaacuaccaacucucuaguuaauuuugaugaagauguuu

SEQ ID NO: 192723 - RNA, 60 nt, Human
uuacuuaaaaauggaaugcucugaauaggcacucucuacauuaaagguauggaaggcgau

SEQ ID NO: 192724 - RNA, 64 nt, Human
agccagccuauggcaauuauauuuuaagagguguucccaggacuuuugggaccuacuaaaacaa

SEQ ID NO: 192725 - RNA, 64 nt, Human
ggcuucuugagguagagagcccuccccagugucuucccaggauaaguagaaauaugaucacaga

SEQ ID NO: 192726 - RNA, 64 nt, Human
gguaggguggguaagaguccaugggggugcccagucccaggaaaggggacaaugaagggacagg

SEQ ID NO: 192727 - RNA, 64 nt, Human
ccagggacuuuuuauuugacccaacaacacaguaucccaggauauggaggcaaggggaacaaag

SEQ ID NO: 192728 - RNA, 64 nt, Human
gugaaauaugauugauuugcauucuggaaagcucucccaggaggaagcauuccccaccccaccu

SEQ ID NO: 192729 - RNA, 64 nt, Human
gcuguaaccugcuggaugggacuccauagcuccuucccaggaccccucagcuccccggcacugc

SEQ ID NO: 192730 - RNA, 64 nt, Human; identical to SEQ ID NO: 192716

SEQ ID NO: 192731 - RNA, 64 nt, Human
cugauaacaugcuguggcaagcuauguccgcaguucccaggaauuuguccaguugauauuaccc

SEQ ID NO: 192732 - RNA, 64 nt, Human
aacaucuuauugagauuugaaacuggugguaguuucccaggaaggcacagguggaguuauuugu

SEQ ID NO: 192733 - RNA, 64 nt, Human
acaacgugucuguccaggucugucccccugcucaucccaggaugccacucacauuuuuuucuuc

SEQ ID NO: 192734 - RNA, 64 nt, Human
uaauggucucagagaggguccuacuuuuagguuuucccaggacaggacaguccccauuuauacu

SEQ ID NO: 192735 - RNA, 64 nt, Human
acaugauauccuucauucagggcauauuuuuucuucccaggaucaaacugaaaacauguuaagg

SEQ ID NO: 192736 - RNA, 64 nt, Human
aggacacucuucccucucgggaugugugaugaacucccaggagagggaagaugggagccagggc

SEQ ID NO: 192737 - RNA, 64 nt, Human
ggagcacuggacuaaaggcuucaguggcugcgugucccaggacaggucauggccccucucuggg

SEQ ID NO: 192738 - RNA, 64 nt, Human
ucaccuugaagcauccuguucuccuucugugcugucccaggaagugucuggcgggcgugggcag

SEQ ID NO: 192739 - RNA, 64 nt, Human
acuucaaaaauguuaaacccuuaccaacagcuuuucccaggagaccauuuguauuaccauuacu

SEQ ID NO: 192740 - RNA, 52 nt, Human
guaaccgaaaacauggauaagaucccaggaagacaagugcuucuaaaccuuc

SEQ ID NO: 192741 - RNA, 60 nt, Human; identical to SEQ ID NO: 191237

SEQ ID NO: 192742 - RNA, 64 nt, Human
acguucacuaaaguaccaagcacaauacaaaugcaucuucgaguucuuugggccucacuuuccc

SEQ ID NO: 192743 - RNA, 64 nt, Human
uucccucgcaaacuggggucuucucuaccgaacuucccaggauuucaucucaccauaucugugu

SEQ ID NO: 192744 - RNA, 64 nt, Human
ugcccaaucuccaucugucaacaggggcgugaggucccaggaaguggccaaaagcuagacagau

SEQ ID NO: 192745 - RNA, 64 nt, Human
agcugaggauagagcuccagaaacagcacuagggucccaggagaggggcauuucuagagcagug

SEQ ID NO: 192746 - RNA, 64 nt, Human
ggugcuggcgggaugugguagcucaugccuauaaucccaggacuuugggaagcugagguggacg

SEQ ID NO: 192747 - RNA, 64 nt, Human
ucccaccugccugggcgaaucuccuccaaggaagucccaggaggauggggaccaggaaggcugu

SEQ ID NO: 192748 - RNA, 64 nt, Human
ugagggcugagucugguucccuaggggacccucaucccaggaacaacauuccagccccacccuc

SEQ ID NO: 192749 - RNA, 64 nt, Human
uguguaccugaggggcacccuugggccugggcuuucccaggaaggagaugaagguagaagcacc

SEQ ID NO: 192750 - RNA, 64 nt, Human
ucaguuucucuuuaaaggugugccccuccugcucucccaggagcagugaguugugaguggaaag

SEQ ID NO: 192751 - RNA, 64 nt, Human
gccguuucucauacuacaggauauuuacuauuacucccaggaucagcagaagauugcguagcuc

SEQ ID NO: 192752 - RNA, 64 nt, Human
aagcgcccccaaagagugcagcugcuaauuuuagucccaggaccagacauccccagacuccaca

SEQ ID NO: 192753 - RNA, 64 nt, Human
ugagaacacaaauuggauaauccacugucucccaucccaggagguggugaguuggcuacaagag

SEQ ID NO: 192754 - RNA, 64 nt, Human
cucugcaaggagcuuugucccaucgugcuuccauucccaggagggggagcuuggagcgagucag

SEQ ID NO: 192755 - RNA, 64 nt, Human
uaggaagaacccaccuguagcccugagguucuuuucccaggauggcuccaggauaaggaucacu

SEQ ID NO: 192756 - RNA, 64 nt, Human
caggaagagcccacauguagcccugagguuuccuucccaggacagcugcaggguagagaucauu

SEQ ID NO: 192757 - RNA, 64 nt, Human
cugguuuuugaagauuguucuugauucccuugauucccaggagagauucucugacauucacgug

SEQ ID NO: 192758 - RNA, 64 nt, Human
acaaaagaaagcagcuuguuuugaaagaagaaacucccaggaauuggaauucagcaccuguucc

SEQ ID NO: 192759 - RNA, 56 nt, Human
cuuccugcugagcucuucuggacucaggaucgcagauccggggcacaaagagggug

SEQ ID NO: 192760 - RNA, 56 nt, Human
ccccaccuacaaggcccucucccaagggaucgcagggccuaggugccuggacccag

SEQ ID NO: 192761 - RNA, 56 nt, Human
cuccccuuguuucuuugggugagaagggaucgcaguuuggaaacuccggcggcugc

SEQ ID NO: 192762 - RNA, 56 nt, Human
caaagcgccagggaaaugacccacagggaucgcagcugcagggagggccagggagg

SEQ ID NO: 192763 - RNA, 64 nt, Human
cacuuugggaagccaaggugggcugaucacuugaucccaggaguuugagaccagccugggcacc

SEQ ID NO: 192764 - RNA, 64 nt, Human
caacuauuggggaggcuaagguaggaucacuugaucccaggaggcggagguugcagugaguugc

SEQ ID NO: 192765 - RNA, 64 nt, Human
ccugggcacccaagaccugguuuccuuucauucaucccaggagaccccucccagcuuuguuuga

SEQ ID NO: 192766 - RNA, 64 nt, Human
ucugccuggccuccugcugaugaggacucuaaguucccaggauacaaaagggguggcaguguau

SEQ ID NO: 192767 - RNA, 64 nt, Human
gguggccuggugacuccaugauggacgaucuugcucccaggaccugccucuucccaggcuuccu

SEQ ID NO: 192768 - RNA, 64 nt, Human
aggcuccgagcuuuccuggcauaggucaaucaggucccaggaugaauaauccaggcuucagcaa

SEQ ID NO: 192769 - RNA, 64 nt, Human
uugaggaauuaucaugggaaaagaccagggcuuuucccaggaauaucccaaacuucggaaacaa

SEQ ID NO: 192770 - RNA, 64 nt, Human
ugacgagguuucugauugucccagcacagccuugucccaggacccuugggugcaugagccacaa

SEQ ID NO: 192771 - RNA, 64 nt, Human
ccaacuccugccgcccucugggacugccccucagucccaggagagcuaugaggccucacugggg

SEQ ID NO: 192772 - RNA, 64 nt, Human
ccaucuucccguggaguguggggaagcugcugucucccaggaagugccuuacucaucccgcaac

SEQ ID NO: 192773 - RNA, 64 nt, Human
acuuguauauuuuuaguaccauacagaaguaaaaucccaggaacuaugaacacuagaccuuaug

SEQ ID NO: 192774 - RNA, 64 nt, Human
gaaguggggccccaggugaugucauugcugcuggucccaggaccacauuuuaacaaucaauguu

SEQ ID NO: 192775 - RNA, 64 nt, Human
uaaguuuaguguugauguuccaucauucuggaccucccaggaguuguuuaagaaugaaucucuu

SEQ ID NO: 192776 - RNA, 64 nt, Human
gggucagguucuacccuccaugugagaauauuuuucccaggacuagagcacaacauaauuuuua

SEQ ID NO: 192777 - RNA, 64 nt, Human
agagaggucagaaauagcaagcaaaaagcaggacucccaggagccacaagaaaagagcacaggc

SEQ ID NO: 192778 - RNA, 64 nt, Human
auuaaaggguuaauguguggcauauggaagggacucccaggacccugugcccagcuuccaugcu

SEQ ID NO: 192779 - RNA, 59 nt, Human
agcagccuugaacccacccagcugggacaccaccagaagguccagggcucuccccauga

SEQ ID NO: 192780 - RNA, 59 nt, Human
gcguguagcacaaagaaaaagccccuucuccaccagauauuugcuuccuaagaauaguu

SEQ ID NO: 192781 - RNA, 59 nt, Human
ccugagccugcugcuagcccugccugguuccaccagacuggcgugucauuggacagaua

SEQ ID NO: 192782 - RNA, 64 nt, Human
agccccgggcggggacuuguucccggucagccugucccaggacagcccacuccagaggcacagg

SEQ ID NO: 192783 - RNA, 64 nt, Human
aaaagcacaagcgguguaggcuccaaugcugcuuucccaggagggugaagauggugcugugcug

SEQ ID NO: 192784 - RNA, 64 nt, Human
aucuggucucacucaguccucugcaucccaacauucccaggacaugcaugaucaccagcauuua

SEQ ID NO: 192785 - RNA, 64 nt, Human
gcuaauaagagguugggugaaagagugcaucuccucccaggauuccacaacaaaauucuuaucu

SEQ ID NO: 192786 - RNA, 64 nt, Human
cucauucucaugccuguagguuuccauugcucugucccaggacacuugcgugccagagacgcca

SEQ ID NO: 192787 - RNA, 64 nt, Human
ucacaugcacuaaaaaaccaggcaaacaucugacucccaggauaaagugacugagagcaguaga

SEQ ID NO: 192788 - RNA, 64 nt, Human
caaacaccucccuugaauaaauuuauacuccuguucccaggaucuugagcuuuagugugcuaua

SEQ ID NO: 192789 - RNA, 64 nt, Human
ugaaaaaguauuuaaggauaugguuaaaaaaaaaucccaggacccacccauguuuucacuaucc

SEQ ID NO: 192790 - RNA, 64 nt, Human
aaccagccacuggcuuuccugcccaggcuuggccucccaggacaucuggccugaggggauuuga

SEQ ID NO: 192791 - RNA, 64 nt, Human
aucccuauacauagugugaauuuauauccagguuucccaggaucaauauugacaagacgacuuu

SEQ ID NO: 192792 - RNA, 64 nt, Human
uauccccuggagcacugcccuccagagcugcccuucccaggaaggaauuugguuggauucuguc

SEQ ID NO: 192793 - RNA, 64 nt, Human
cuugguuccauuuccauccaugacagguacagcaucccaggagcccggccugaggggcuggacc

SEQ ID NO: 192794 - RNA, 64 nt, Human
ccuugcucccaauggugcuuggagggggaagagaucccaggaggugcaguggagggggcaagcu

SEQ ID NO: 192795 - RNA, 64 nt, Human
ucuacacaguacuuagauuuuuuuuacuuuccagucccaggaagugucaauguuuguugagugg

SEQ ID NO: 192796 - RNA, 64 nt, Human
gaaaggcugggaggagaagggaggggcuggggguucccaggagccaugcguggccugcagaguc

SEQ ID NO: 192797 - RNA, 64 nt, Human
aucagggcagaggccaaguuccaggugucuguguucccaggaaccaaauggggagucuggggcc

SEQ ID NO: 192798 - RNA, 59 nt, Human
guuugugauugucugugugucugucucccccaccagacugugagcuccaugagggcagg

SEQ ID NO: 192799 - RNA, 59 nt, Human
cacucucaauccuacaucaggugccaccaccaccagacucaggcccugguguaagaagc

SEQ ID NO: 192800 - RNA, 59 nt, Human
acaaaccaccaaaaacugaaaccccagacccaccagaaagacaagugucuagcaaugcc

SEQ ID NO: 192801 - RNA, 59 nt, Human
caggcuaauauuagggacuggggaggggaccaccagaggggagagggaagcugcuuacu

SEQ ID NO: 192802 - RNA, 64 nt, Human
ucccuucaucgguucaugucacagggauuuucuuucccaggaagcggacacggagagucagccc

SEQ ID NO: 192803 - RNA, 64 nt, Human
aggccucacugcucuccagaggcuaguguuccuaucccaggauggcuguugggauuaggagugg

SEQ ID NO: 192804 - RNA, 64 nt, Human
gauacccuaacaaagcagaguauauuuauuuguuucccaggaaggccauugcaguuugacuggc

SEQ ID NO: 192805 - RNA, 64 nt, Human
agcucccgggccucagccucccaucuccucuccuucccaggaauccuugaucucaugacuauua

SEQ ID NO: 192806 - RNA, 64 nt, Human
uacuccacaaacaugggugguaacaagaguuccaucccaggaggccaaacggugcaacagaagg

SEQ ID NO: 192807 - RNA, 64 nt, Human
uacugcagcacucugugccgccaccucuaccuguucccaggacacccucccacaugaugucacc

SEQ ID NO: 192808 - RNA, 64 nt, Human
ugugugaccagcccccaguuccucccccaguuccucccaggaagcccaggagccucacuggggc

SEQ ID NO: 192809 - RNA, 64 nt, Human
aaacaacauuagaaaauggcgcaaaaucguuaggucccaggagagaaugugggggcgcaaaccc

SEQ ID NO: 192810 - RNA, 64 nt, Human
cuggaucuuccccccacuccucacaccucacaugucccaggagcugccuucauucaggcgggua

SEQ ID NO: 192811 - RNA, 64 nt, Human
caugcugguggccuucugaaucacugcauggaugucccaggaggcagcucuccccacacagcag

SEQ ID NO: 192812 - RNA, 64 nt, Human
gaagagcagauaacuagcgcugcucuggcauuaaucccaggaaccacuagcaguaguggggcgc

SEQ ID NO: 192813 - RNA, 64 nt, Human
auacccacaagagagguaugucacucaucuuacuucccaggacauccacccugagaauaauuug

SEQ ID NO: 192814 - RNA, 64 nt, Human
augguuuccccugggagaggccaggagggccugaucccaggagacaccagggccagagugacca

SEQ ID NO: 192815 - RNA, 64 nt, Human
ugcauuuucuaagugggacauucaaaaaacucucucccaggaccucggaugaccauacucagac

SEQ ID NO: 192816 - RNA, 64 nt, Human
uauagcaacucauuggugguagccaucaagcacuucccaggaucugcuccaacagaauauugcu

SEQ ID NO: 192817 - RNA, 64 nt, Human
gagaaagaccaugcauuuaaaguauucuccauccucccaggaaccgaacauaucauuugugaag

SEQ ID NO: 192818 - RNA, 59 nt, Human
ccacccuaaaaagguuaucccugagaacuccaccagacuugggagcccaagugcagugc

SEQ ID NO: 192819 - RNA, 59 nt, Human
guuggucuguauuugcauguaaaagugggccaccagagaacccuuauugauuacuuaag

SEQ ID NO: 192820 - RNA, 52 nt, Human; identical to SEQ ID NO: 46333

SEQ ID NO: 192821 - RNA, 59 nt, Human
accuggggaagccgcgccugccaaggaggccaccagagggcagugcaggcuucugccug

SEQ ID NO: 192822 - RNA, 64 nt, Human
cuacuugggaggcugaggcaggagaaucgcuugaucccaggaaggcagagguggcagugagcug

SEQ ID NO: 192823 - RNA, 64 nt, Human
ucugguagauagauagcauguaagggggugguugucccaggaggcagcugcugacagguuugcu

SEQ ID NO: 192824 - RNA, 64 nt, Human
ugcuccaacucgggccuggggcacugcucgcugcucccaggaaggggguggcgugacaggcagg

SEQ ID NO: 192825 - RNA, 64 nt, Human
acccacucugcaaggcaugugucuauucaggguuucccaggaggaggaggccccugaaggggug

SEQ ID NO: 192826 - RNA, 64 nt, Human
gcuucuccuguagggcaccucccugccccuagccucccaggaaauggugcucuccuggcccugc

SEQ ID NO: 192827 - RNA, 64 nt, Human
aaggccagggguucacauagggccccagcgaguuucccaggaguuagagggaugcgaggcuaac

SEQ ID NO: 192828 - RNA, 64 nt, Human
uuaaauaguucauuggaugaggcugggugacauuucccaggacagcauggugaacauuaccagg

SEQ ID NO: 192829 - RNA, 64 nt, Human
accuugccaggacaagaaccaagaacucuaacugucccaggaaucuugugaauuuucacccaua

SEQ ID NO: 192830 - RNA, 64 nt, Human
cguccagcccggggcagucugacugucggugcccucccaggaacggggaaggccuccgucugug

SEQ ID NO: 192831 - RNA, 64 nt, Human
agaaaccuacaaaaugucaaaccagcuucccgacucccaggagcucaagccaagcccagaggca

SEQ ID NO: 192832 - RNA, 64 nt, Human
uuccagacuccagggcuccccgggcugcucuggaucccaggacuccggcuuucgccgagccgca

SEQ ID NO: 192833 - RNA, 64 nt, Human
ccugcccucucgccacauuucccccaaguuacauucccaggaggaccuuuuuaauguucucaau

SEQ ID NO: 192834 - RNA, 64 nt, Human
cccaccagacgucaggcccugacuccucuggcuuucccaggagauggguccaggggucugucug

SEQ ID NO: 192835 - RNA, 64 nt, Human
ucucugaagaguuuuuaaucuucagcucaucaugucccaggaaguggcaucauaaaaggaaaua

SEQ ID NO: 192836 - RNA, 64 nt, Human
aagaagggguaauauggugaaagcaaauucccuuucccaggagucaagagaauuuaugugaggu

SEQ ID NO: 192837 - RNA, 64 nt, Human
agacccaguggaucauguuggaaaugcaacugcaucccaggaacuugguuaugguugucucaag

SEQ ID NO: 192838 - RNA, 60 nt, Human
guaugaugugcuuccaccucuucucuucauacucucuaccuuccuuaccaugauucagcc

SEQ ID NO: 192839 - RNA, 56 nt, Human
ucuuucauagauauuuuugucuauuuggaucgcauuaauuguuuccaguaaaacuc

SEQ ID NO: 192840 - RNA, 59 nt, Human
gugguguguucacauacagugacccuuggccaccagaccacagaggauggagccuggga

SEQ ID NO: 192841 - RNA, 60 nt, Human
ccaguaauuggcuccaauucauaauauguucaccaggagauuacaauuuuuugcucuucu

SEQ ID NO: 192842 - RNA, 64 nt, Human
gcagcuguggguuuuaccaccgucugucucagagucccaggaccuugagugucauuaguuacuu

SEQ ID NO: 192843 - RNA, 64 nt, Human
agagacgaagacaugcucaccggacaaggguuccucccaggauacgcccgagcggaagaagcgg

SEQ ID NO: 192844 - RNA, 64 nt, Human
guauuuucucggagguuguuuuucuccuucuccuucccaggaaggucuuuguaugucgaaucca

SEQ ID NO: 192845 - RNA, 64 nt, Human
ggaagaugccuauauucugagagacaggacaguuucccaggaagaugggcagagacuugagugg

SEQ ID NO: 192846 - RNA, 64 nt, Human
acuggaguuaacuaacccuuccuuguaucugucuucccaggagagaaugaagcaaaacaggaau

SEQ ID NO: 192847 - RNA, 64 nt, Human
cucaccuugcaggcugccugcgugggaggcgaagucccaggacagcccagaggggggcuacaga

SEQ ID NO: 192848 - RNA, 64 nt, Human
uaagacuacaaaugcgggggccagggcucaaggcucccaggauaguugcacugagcacugugag

SEQ ID NO: 192849 - RNA, 64 nt, Human
ucccugaucagccagcacucuggaagcuuugggaucccaggaaccauggaauuauucccaaaug

SEQ ID NO: 192850 - RNA, 64 nt, Human
caagaagaaguugcaguauggauaucuuucacccucccaggaaacucuuucaaaccuaaucugu

SEQ ID NO: 192851 - RNA, 64 nt, Human
ggcugucgcuuauugaauccacuuguguccaaccucccaggauuguuuuauccuaaugucaccu

SEQ ID NO: 192852 - RNA, 64 nt, Human
uggaacaugcccacaacuugucacccaaagccugucccaggacucacccuccacaaagcaaagg

SEQ ID NO: 192853 - RNA, 64 nt, Human
ucaggacccccggagccccgcgaaaacaucugccucccaggagggugccgagcugccucaccag

SEQ ID NO: 192854 - RNA, 64 nt, Human
gaaaagaguucauggccaagcgucuaaccuaaagucccaggauuggcuccaggcagcaauuaua

SEQ ID NO: 192855 - RNA, 64 nt, Human
uuuugcagcaguguaauaaagucaauuaaaaacuucccaggauuucuuuggacccaggaaacag

SEQ ID NO: 192856 - RNA, 64 nt, Human
uguggguccuuucugugcacuaugaacgcuucuuucccaggacagaaaauguguagucuaccuu

SEQ ID NO: 192857 - RNA, 64 nt, Human
ccuucuuuggccagaugugugauucugugacuugucccaggaccagaauguaccuaagucagau

SEQ ID NO: 192858 - RNA, 59 nt, Human
uccccuugguuuuucgugcuggaacauccccaccagagccucucugccauaacugccag

SEQ ID NO: 192859 - RNA, 59 nt, Human
gcccucccgucauuugcccugggucucccccaccagaaugggagccaggagucccagcc

SEQ ID NO: 192860 - RNA, 59 nt, Human
ucuccacaccugaacaguuggcucaagggccaccagaagcauuucuuuauuauuauuau

SEQ ID NO: 192861 - RNA, 59 nt, Human
aggaaggaaucugaauggagaaucaccaaccaccagagaaaaaagacuguggggcccuc

SEQ ID NO: 192862 - RNA, 64 nt, Human
ucuucucacuaauugagucugcuuccacguccucucccaggaacauucuuagcucggacucuug

SEQ ID NO: 192863 - RNA, 64 nt, Human
ucacucagaugccccaagauguccguugggaagcucccaggacagcacuuuuuauacagaggac

SEQ ID NO: 192864 - RNA, 64 nt, Human
uguuguaauuauugauugugauuaaaauauuugcucccaggagaacuccugaccagugggcaug

SEQ ID NO: 192865 - RNA, 64 nt, Human
agguggaccacccuggcugaaaugacacaccuacucccaggaacagcagagguggaggcaagca

SEQ ID NO: 192866 - RNA, 64 nt, Human
ggccccuugggcuggacccuccaaugccagcgacucccaggagcccuugggggacgugagggga

SEQ ID NO: 192867 - RNA, 64 nt, Human
cacuuugggaggcagaggugggaggauugcuuggucccaggaguucaagaccagccuguggaac

SEQ ID NO: 192868 - RNA, 64 nt, Human
uuccaggggcgcuuggcaucucccauggacugauucccaggaagaaaagcccaaagggaaaccc

SEQ ID NO: 192869 - RNA, 63 nt, Human
cuccuccuggacuccccucccugccgaacacacaucccaggagucugggaaggagggacuguu

SEQ ID NO: 192870 - RNA, 64 nt, Human
gugggcugucacugcuugagggagaauccucccuucccaggaggugcagacuucuuaaaaggag

SEQ ID NO: 192871 - RNA, 64 nt, Human
cagggagggauggaccccgaaaggagaaaaguacucccaggaaacagacgcgugaaaacugagc

SEQ ID NO: 192872 - RNA, 64 nt, Human
ugcaaagaauaaaugaaauaucuugguuuuuauuucccaggaagcuugagagaaaugaguuuau

SEQ ID NO: 192873 - RNA, 64 nt, Human
uccuggacaaggaauguaggaagugagugcugugucccaggaagcugcucacacucuuaaaaug

SEQ ID NO: 192874 - RNA, 64 nt, Human
acgcaggaggccacucuugucucucagcagcuguucccaggaggcagcucccuccuggcacaug

SEQ ID NO: 192875 - RNA, 64 nt, Human
gggggugucagcucggucaccaagagaagugacuucccaggagcaccaguccccucacagaggu

SEQ ID NO: 192876 - RNA, 64 nt, Human
gaccaggccaccaucuguacccugcuucccaaacucccaggaccuggagacaggauugucuggg

SEQ ID NO: 192877 - RNA, 64 nt, Human
ccuggggauguggcuggagcaugagccagcucugucccaggauggucccagcggaugcugccag

SEQ ID NO: 192878 - RNA, 59 nt, Human
ccucggacugcgggugacggcccugcccgccaccagaccccuaaaucuuggccaucgug

SEQ ID NO: 192879 - RNA, 59 nt, Human
gcauagcagaccacacagaagggugugggccaccagagaauuuugguaaaaauuuggcc

SEQ ID NO: 192880 - RNA, 59 nt, Human
ucccccaacccuccacagagcccccagacccaccagaacuuccacagacgcccccacua

SEQ ID NO: 192881 - RNA, 59 nt, Human
cuaaagaaagcugaaggugcccaccugggccaccagaaggugacacccccagaaucccu

SEQ ID NO: 192882 - RNA, 64 nt, Human
ugugugcacacaugcagaggugagacccgcaggcucccaggaccagcagccacaagggcagggc

SEQ ID NO: 192883 - RNA, 64 nt, Human
accaauuucccagggacuccaggguccugaggccucccaggagggccuugggggugaugacccc

SEQ ID NO: 192884 - RNA, 64 nt, Human
caggacacccucugaguccuugacgcuggcucugucccaggaucuccacagaccucggccucuc

SEQ ID NO: 192885 - RNA, 64 nt, Human
ccauccauucucacaggucccaaauggcccugggucccaggacccuggacccagccagaacuug

SEQ ID NO: 192886 - RNA, 64 nt, Human
ccuucaggagccuagguuugaacagcagaugcugucccaggaagggcuagggacaucggagggg

SEQ ID NO: 192887 - RNA, 64 nt, Human
caaugguguugaugcuucuguggagcgcggacauucccaggagcaggugcgugccagccauggc

SEQ ID NO: 192888 - RNA, 64 nt, Human
gagggacuguggcgaccgugccucugugccagcgucccaggaaggaagccaacccugagcgagc

SEQ ID NO: 192889 - RNA, 64 nt, Human
cagccaccuaagguggaggugggggaauaguguuucccaggaagcucauugaguugugugcggg

SEQ ID NO: 192890 - RNA, 64 nt, Human
aaaccucuacuaaaaagaaggaaaaugaucugagucccaggagcugcccagaguugcugggagc

SEQ ID NO: 192891 - RNA, 64 nt, Human
uauuauuagcucgagaaauaccacaugccagucuucccaggaaggugaccugccugaccaugaa

SEQ ID NO: 192892 - RNA, 64 nt, Human
gccgcgggcggagcugaggacaggccuuggcuggucccaggaugagcgacgaguuugguuuuag

SEQ ID NO: 192893 - RNA, 64 nt, Human
cugcaacauccugagaccaaagaccuugugcccuucccaggagccgcggaggaggacagugagg

SEQ ID NO: 192894 - RNA, 64 nt, Human
aaguuaaauuuaaaaaugaaaaugaaagacagcuucccaggaguuuugugccugucugcgccuc

SEQ ID NO: 192895 - RNA, 64 nt, Human
ccugccugucgugccuuggacccagggcccagcuucccaggagagaccaaaggcuucugagcag

SEQ ID NO: 192896 - RNA, 64 nt, Human
uuguuuugauacagucauuauauuugauuaguauucccaggaauacccccaccuaguuacucaa

SEQ ID NO: 192897 - RNA, 64 nt, Human
caagggcacuccugcagguggcccggccugagguucccaggagcagcaaaggggccugcugagc

SEQ ID NO: 192898 - RNA, 60 nt, Human
accaaggauuugauaaaguuuaaauaauuuacucucuacuuuuauccauuuuauccauuu

SEQ ID NO: 192899 - RNA, 59 nt, Human
ucacugugggucccauucggcuguuucccccaccagaccccagggaagccggggcccac

SEQ ID NO: 192900 - RNA, 59 nt, Human
cacuggaucccagauucccaagccuucacccaccagauucuggcuccuaaaacaagugc

SEQ ID NO: 192901 - RNA, 59 nt, Human
ucacgaguagcuggaauuacaggcaggcgccaccagacccggcuaauuuuuuguauuuu

SEQ ID NO: 192902 - RNA, 64 nt, Human
ucauagagagcccuauucaucgcugcccaggccuucccaggaaaaucauuuuuucugggcugau

SEQ ID NO: 192903 - RNA, 64 nt, Human
uggucaggcaacagggugaccagcuguccugguuucccaggacauggaacuuucaaugcuaaaa

SEQ ID NO: 192904 - RNA, 64 nt, Human
ucuugccaggccgucucuugcucccuaauucauuucccaggaagcugugauacagggugaaaua

SEQ ID NO: 192905 - RNA, 64 nt, Human
ucaugccauucuccugcuucagccucccgaguagucccaggaguagcugggacuacaggugccc

SEQ ID NO: 192906 - RNA, 61 nt, Human
cuggggcagggcaccagugaacaggcacaggucccaggaccaaggagagguggaacaucca

SEQ ID NO: 192907 - RNA, 64 nt, Human
ccaccaaucagagaaguugaagaugaauguugacucccaggagaccagaacuauuuuuuuaaag

SEQ ID NO: 192908 - RNA, 64 nt, Human
ccucugacagcagcaucucuaccuucuccccagcucccaggaccacaggcucaggcaggggccu

SEQ ID NO: 192909 - RNA, 64 nt, Human
gagugugccuaggagggggcuggcugccuuuaugucccaggaugacucuuuaugggugggauua

SEQ ID NO: 192910 - RNA, 64 nt, Human
ucaugugcacuaugaaaacgagcugacagcacacucccaggagaaauguuuccagacaacuccc

SEQ ID NO: 192911 - RNA, 64 nt, Human
ccuuggcaccuucccauccuagcccuuaucagggucccaggacacagaauauaagugacuacag

SEQ ID NO: 192912 - RNA, 64 nt, Human
cugggacuuuggagcuuaccagagaugcagucccucccaggaaccuguuggagaggcaggaccu

SEQ ID NO: 192913 - RNA, 64 nt, Human
agcacagacguggggcauccccagaaagacuccaucccaggaccagguuccccugcgugcucuu

SEQ ID NO: 192914 - RNA, 64 nt, Human
uccugcaucuuuccuuaagggaagccccauccucucccaggaccaggaguuuaugaccaggcga

SEQ ID NO: 192915 - RNA, 64 nt, Human
ggggcagggcgcucccuggccgcagcagaugcccucccaggaguggaggggcuggagaggggga

SEQ ID NO: 192916 - RNA, 64 nt, Human
cccuguggcuuaagccuaagucucuucagccaccucccaggaagaucuggccuccguccuaugc

SEQ ID NO: 192917 - RNA, 64 nt, Human
uaggaagugcauucuccauccucauccucugcccucccaggaagucagugauugucuuuuuggg

SEQ ID NO: 192918 - RNA, 60 nt, Human
auguuuagguuacuaaaacagggugggcaaacucucuaaacugguacaauuuuauaggug

SEQ ID NO: 192919 - RNA, 60 nt, Human
auugucaggggaagguccccgcuccugcacacucucuauggauacuuggguugugggggc

SEQ ID NO: 192920 - RNA, 60 nt, Human
ugaaaacuacagaccucccccggacagcccacucucuaucacgagccuaacccgcgggag

SEQ ID NO: 192921 - RNA, 64 nt, Human
gggccugcuggggagugggguuuggggggcccucucccaggacacugccucuucugggcagaag

SEQ ID NO: 192922 - RNA, 64 nt, Human
acgagcagcugugagugaggggacaaggggcaggucccaggagccacacacucccuuccucacu

SEQ ID NO: 192923 - RNA, 64 nt, Human
cagagcuugucauccccagccuggugucccgcagucccaggaagccgcuucuugccuucauggc

SEQ ID NO: 192924 - RNA, 64 nt, Human
uuccaugugucuucauucugccugaagaaggcuuucccaggaugcacguccucagagggagcag

SEQ ID NO: 192925 - RNA, 64 nt, Human
uuuuucauuuuaagugguguggagauuccagcacucccaggacaguggagucagcaguaagccc

SEQ ID NO: 192926 - RNA, 64 nt, Human
guugcccucgugcccaucaagugcagucgggaccucccaggacaagcacgaggccucaggucgg

SEQ ID NO: 192927 - RNA, 64 nt, Human
uccugacaucuguucauuuaggcuucaguuccacucccaggaacuuugccugucccacgaggga

SEQ ID NO: 192928 - RNA, 64 nt, Human
gaccuggccgcagugaggcggauugagaaggagcucccaggaggggcuucugggcagacucugg

SEQ ID NO: 192929 - RNA, 64 nt, Human
ccacuggcccugagcacgacagcccuucuuacccucccaggaaugccgugaaaggagacaaggu

SEQ ID NO: 192930 - RNA, 64 nt, Human
cucagaccugcccccaguucaguacuugaccacaucccaggauuuauggugucugucuauggcc

SEQ ID NO: 192931 - RNA, 64 nt, Human
ugcagggugagcagcgugggcugcagugugucagucccaggagugagggaguggcaagcaccac

SEQ ID NO: 192932 - RNA, 64 nt, Human
gagggcaucucucccaggugacccuucuuuucugucccaggaggguggguaauucccuuuggga

SEQ ID NO: 192933 - RNA, 64 nt, Human
uucucuggcagacuaucaguguuugccucccaaaucccaggaccaggaugacaucaaaaaucag

SEQ ID NO: 192934 - RNA, 64 nt, Human
auggccccaccaaggccuagacacggcacuggccucccaggagggcaggggcauugggaauggg

SEQ ID NO: 192935 - RNA, 64 nt, Human
gauuuaggccgggcaaaggggcucaccccuauaaucccaggacuuugggaggccaaggcaggag

SEQ ID NO: 192936 - RNA, 64 nt, Human
cuuggcaaaaagggccgaggucuggugaugugguucccaggaucuggaaccucucccaccccuc

SEQ ID NO: 192937 - RNA, 60 nt, Human
aauuaauuacccuccguuucccacauccccacucucuaggggauuagcuugugcguguca

SEQ ID NO: 192938 - RNA, 60 nt, Human
aacuuccacuuacuuuccacuggcucucaaacucucuaacuuauaaguguugugaacccc

SEQ ID NO: 192939 - RNA, 59 nt, Human
ugacugcacuaauaauaaaccuuuuacucaacucucuaaauucuucagcauuacucccu

SEQ ID NO: 192940 - RNA, 64 nt, Human
uccuccaagccagcccaccucugccuucaucauaucccaggauacuguuuguaaauaaucugcu

SEQ ID NO: 192941 - RNA, 64 nt, Human
acagccuucuccagccugugugauacaaguuugaucccaggaacuugaguucuaagcagugcuc

SEQ ID NO: 192942 - RNA, 64 nt, Human
aguggugugaucacugcucagugcaaccucugccucccaggaucaagcaauucugacucagccu

SEQ ID NO: 192943 - RNA, 64 nt, Human
uuaccugaucaauguuaaauguaagcaccccugaucccaggacauaaggaaagaugcccaauug

SEQ ID NO: 192944 - RNA, 64 nt, Human
ucccaguugguuuucucauggacaucucuuccucucccaggaagcuuacaauuuucuucucucu

SEQ ID NO: 192945 - RNA, 64 nt, Human
aggguggggggagggcaccggagccuugccaccaucccaggacuuugggcaagucacccgcacu

SEQ ID NO: 192946 - RNA, 64 nt, Human
aggggaggacccugagggcucagccagggaggggucccaggacucaacugggccccguuucuag

SEQ ID NO: 192947 - RNA, 64 nt, Human
cagccccagggcccugcucaggccucaccuggcuucccaggacccugggucaccuuccugggca

SEQ ID NO: 192948 - RNA, 64 nt, Human
gcaggccuccaggaguauggguccugcccugcccucccaggaguccagccaggggcugccucca

SEQ ID NO: 192949 - RNA, 64 nt, Human
ggccugagugccagcccuggcagacugaggagccucccaggagcagcggggcaguguggggcuu

SEQ ID NO: 192950 - RNA, 64 nt, Human
gaccuggugggagcaccugccagaggaugcucuuucccaggacggaugggcccuaugucucagg

SEQ ID NO: 192951 - RNA, 64 nt, Human
ccccaucccccauagucgccagacuuucucauguucccaggaagcucagaaguauggcagcuaa

SEQ ID NO: 192952 - RNA, 64 nt, Human
cugguagaccgaagccuugugcauaaggauuuuuucccaggaaaagauagacuuuauaaacagu

SEQ ID NO: 192953 - RNA, 64 nt, Human
cuucggagagcgacugagguguucaaaucgaaucucccaggaggcuuccuuccagcccccuauu

SEQ ID NO: 192954 - RNA, 64 nt, Human
ggucucucuacuuuuaacacaucucucaucccuuucccaggauuccuuccaagucaguuacagg

SEQ ID NO: 192955 - RNA, 64 nt, Human
agaaauguguucacaugcugugggaaccccuuuaucccaggaaguccucuuccuugugccuuaa

SEQ ID NO: 192956 - RNA, 60 nt, Human
guccagcuaccaugggaacgcaaggcagcaacucucuaauuaaccaggucauaaaaacga

SEQ ID NO: 192957 - RNA, 60 nt, Human
gacuucugugagacuggggccagccacacuacucucuaggccucaggggucaaggagcuc

SEQ ID NO: 192958 - RNA, 60 nt, Human
aaaauuuaugucauuuucagauccuuccaaacucucuagugcaggaaaaggcugcagcua

SEQ ID NO: 192959 - RNA, 64 nt, Human
acuacuuucuuaauaucacuuuggucuccauuuuucccaggacaggaaauaugucccccccuaa

SEQ ID NO: 192960 - RNA, 64 nt, Human
gccacuccaaucacccuacaagaugccaaggaggucccaggaaguccagcuccuuaaacugacg

SEQ ID NO: 192961 - RNA, 64 nt, Human
ucauuuuuuuggucacccuuuaaguguccuucucucccaggaugagugaggagcugugcugaug

SEQ ID NO: 192962 - RNA, 64 nt, Human
aguuggaggggugggcuucucuagcccugcccccucccaggagcccagccccucuggccaggac

SEQ ID NO: 192963 - RNA, 64 nt, Human
uguuuuuucuccuuuguccaaaggccagagaccaucccaggaagaguggugggugguuuauaca

SEQ ID NO: 192964 - RNA, 64 nt, Human
gaauacuucugauaauuuauugucuuuauuuuuaucccaggaaauaaaagguuaccuuguugag

SEQ ID NO: 192965 - RNA, 64 nt, Human
ugaucagagagauuuuuuuuuuaaacuaccauggucccaggauuccauccugaaauuuauuuuu

SEQ ID NO: 192966 - RNA, 64 nt, Human
uuuugccccaagcauuucuauauuuaaagcaauaucccaggagaauauguuagacuuaggauga

SEQ ID NO: 192967 - RNA, 64 nt, Human
uauuucagccaugauaagaacagagugccugcauucccaggaaaauacgaaaaucccaugagau

SEQ ID NO: 192968 - RNA, 64 nt, Human
cccuuaaaaaaauaaaaccucugaaccaaaaucuucccaggaauaguacuuaauagauuuuaau

SEQ ID NO: 192969 - RNA, 64 nt, Human
ccuuagccgucugagugagcuguguaugaacaagucccaggaguuccaagagucuagagugguu

SEQ ID NO: 192970 - RNA, 64 nt, Human
ucugggcgguggcuucacuccugagucugcaaaaucccaggaaacuugggucuugcugcccauc

SEQ ID NO: 192971 - RNA, 64 nt, Human
agauaguuuucuucaggugucaauggcguuagacucccaggaagacuagcccugcccacagggc

SEQ ID NO: 192972 - RNA, 64 nt, Human
ugccuacaggugcuacgccaccuggcgcuucggcucccaggacauggcugacuuugccaaccug

SEQ ID NO: 192973 - RNA, 64 nt, Human
agcuuccucccccgaccaaaccccaagaccuggaucccaggagacaacagucuccacagugaga

SEQ ID NO: 192974 - RNA, 64 nt, Human
acucugauaauugucuccccuccauaggaauuucucccaggaaagaaauauauccccaucuccg

SEQ ID NO: 192975 - RNA, 60 nt, Human
ucauuauauuccuucagucagaaaauuauuacucucuauggcacuguuuuuuaucacaaa

SEQ ID NO: 192976 - RNA, 60 nt, Human
ggugauggacguugcuugauugagcuuauuacucucuauuuugagaagguagaagguaag

SEQ ID NO: 192977 - RNA, 60 nt, Human
agagugauuuucuguuacauucaauuucaaacucucuaauuguggguuuucuccugaaga

SEQ ID NO: 192978 - RNA, 64 nt, Human
aguagguacccaguaaaaguguuauuaaauauugucccaggagcccuuaggagagugguuuaac

SEQ ID NO: 192979 - RNA, 64 nt, Human
auuuuaggccagccaugguggcucacgucuguaaucccaggacuuugggaggcugaggcaggug

SEQ ID NO: 192980 - RNA, 64 nt, Human
agaccaagccaauugcagaaccacauucuuugguucccaggagagccccauucccagccccugg

SEQ ID NO: 192981 - RNA, 64 nt, Human
ccaguucacccugauuuaggagaagccaggaauuucccaggacccugaaggggccaugauggca

SEQ ID NO: 192982 - RNA, 64 nt, Human
aacuaagguuuagugcuuuuuuaaaggaaaguugucccaggauucauccuaaagaaagcaaaag

SEQ ID NO: 192983 - RNA, 64 nt, Human
accaaccaggguugaggaaccaucucagccauccucccaggaagcccaccccugacccuuacua

SEQ ID NO: 192984 - RNA, 64 nt, Human
ugaccacggccccaagcccagggcuggaggcaggucccaggacgcgccgcucccucaugcugcc

SEQ ID NO: 192985 - RNA, 64 nt, Human
ugaccgcggccccgagccuggggcuggacgcaggucccaggacgugcugcucccuugugugagu

SEQ ID NO: 192986 - RNA, 64 nt, Human
ugaccgcggccccgagccuggggcuggacgcaggucccaggacaugcugcucccuugugugagu

SEQ ID NO: 192987 - RNA, 64 nt, Human
ucuauuuuucuaaugaugcaguaauuaaauugcaucccaggagauuuauaaaguuuugauauuu

SEQ ID NO: 192988 - RNA, 64 nt, Human
uuauugggaaaugaaaaugcauuucuaucuagcuucccaggaauauuucuacccaaaauagaaa

SEQ ID NO: 192989 - RNA, 56 nt, Human
ugaccccagucgugucuugaugacucucccaggaaucagaaagauaguauuuacua

SEQ ID NO: 192990 - RNA, 64 nt, Human
cccuggggauuucauguuuucacucuguucuuagucccaggagccacagguaaucgagaauguu

SEQ ID NO: 192991 - RNA, 64 nt, Human
aaugucuuuggacuguaaucagugcauccacaccucccaggauccagugcucccucucagcuca

SEQ ID NO: 192992 - RNA, 64 nt, Human
uuccuugguggaggccgucuaggaaaccaaaaacucccaggaugccccggugugaccgccgggg

SEQ ID NO: 192993 - RNA, 64 nt, Human
aagaaucaucuagggugacauuccuugaaguaaaucccaggagaaucuaggccaaagagaugag

SEQ ID NO: 192994 - RNA, 60 nt, Human
gguaagcugggauagaaaggccaccucuucacucucuauagaauauaguaaccuuuauga

SEQ ID NO: 192995 - RNA, 60 nt, Human
gaguuuacuuauaaagagagauauuuauguacucucuaagaagacaaaugaggucauaaa

SEQ ID NO: 192996 - RNA, 60 nt, Human
cuguccuguccaaugcgggggcacugcagaacucucuagaaaugucaugauugagcuuca

SEQ ID NO: 192997 - RNA, 64 nt, Human
aauggcugcgaaagaauuuguaguaaaccaggccucccaggauggcgagcuccaguaagaugau

SEQ ID NO: 192998 - RNA, 64 nt, Human
uuauuugcugccacaccugagccagccugcuccuucccaggaguggaggaggccugggggcagg

SEQ ID NO: 192999 - RNA, 64 nt, Human
guugggaaacaagcugauuucuugccaagaggucucccaggagauauuugggaaaugugaaguu

SEQ ID NO: 193000 - RNA, 64 nt, Human
guaauguaugucuacuggugggagacugugaggaucccaggauucaguauuccuggcccagagg

SEQ ID NO: 193001 - RNA, 64 nt, Human
guggaaaaagcacauggcucuuucuucuccgagaucccaggacuaucuuauuuuccucagaggg

SEQ ID NO: 193002 - RNA, 64 nt, Human
uuucccuucuaguuuugagagacuuccucuuggcucccaggaggagggauuuccugacuuugac

SEQ ID NO: 193003 - RNA, 64 nt, Human
cuuuuccuuccuugagucauagaacguauccaucucccaggaaauguccuucucuggcgucugc

SEQ ID NO: 193004 - RNA, 64 nt, Human
cgucagaccagguucggauacaaucaucugcucaucccaggaauaguuucuugggggacucacu

SEQ ID NO: 193005 - RNA, 64 nt, Human
uggggaacagagaggcacgcuaugcugccagaauucccaggagggcauaucagcaacugcccag

SEQ ID NO: 193006 - RNA, 64 nt, Human
cugugggggacacugaaucucccaguguucagucucccaggacucugcugccucagccagagcc

SEQ ID NO: 193007 - RNA, 64 nt, Human
ccacugcaaagauuccagccuggguccaggaacuucccaggagagccagcugggaagcaguacu

SEQ ID NO: 193008 - RNA, 64 nt, Human
acagacauacuuuuccuaaaguugaagcauuuguucccaggauuuauuuuacuuugcauuucuu

SEQ ID NO: 193009 - RNA, 64 nt, Human
cugccacugacugcagggacacgggcagccuggcucccaggacacgacuuguaaugaaaguuug

SEQ ID NO: 193010 - RNA, 64 nt, Human
aaaauuauuuuauguuaaaaugugugcuaaacuaucccaggaaaguauuuaauccaacauugua

SEQ ID NO: 193011 - RNA, 64 nt, Human
ccucaccuagcaggaaaggagaugaaggcccuccucccaggagguagggucuuggcugccccga

SEQ ID NO: 193012 - RNA, 64 nt, Human
auuaacuccccaucgccagcugaugacucaagauucccaggaguucugcucauucuaaugaugg

SEQ ID NO: 193013 - RNA, 60 nt, Human
uggccucuucagggacuucuuauuuacuguacucucuaucacugacaaaugcaggcugga

SEQ ID NO: 193014 - RNA, 60 nt, Human
uagcauuuuuuugcagaaggugaaaauuccacucucuaccaccgggccagccaauagauc

SEQ ID NO: 193015 - RNA, 60 nt, Human
ccggagggccgaguuagagcggccggccugacucucuaugcaacaccccauccuugccgc

SEQ ID NO: 193016 - RNA, 64 nt, Human
uuuuccuucugguuuugagagacuuccucuugggucccaggaagagggauucccugacuuugau

SEQ ID NO: 193017 - RNA, 54 nt, Human
cuaaaacccugaaacucugaauauucccaggaggauaacucaacauuuccagaa

SEQ ID NO: 193018 - RNA, 64 nt, Human
gcagguaucugugcauucauagaacuuauaaaggucccaggaucacuuuuaagggauuuuuauu

SEQ ID NO: 193019 - RNA, 64 nt, Human
uggccugggccuccucacaacauggugucuggauucccaggaugagcaucccaggaucgcaaga

SEQ ID NO: 193020 - RNA, 64 nt, Human
ucacaacauggugucuggauucccaggaugagcaucccaggaucgcaagagccauguagaagcu

SEQ ID NO: 193021 - RNA, 64 nt, Human
gaagagcagggguggccaggagauagugagcagcucccaggaggcauggagggauccagaaccu

SEQ ID NO: 193022 - RNA, 64 nt, Human
ccuggggguuauucgggaugguucagccagggccucccaggaagagugcuguggagccacggug

SEQ ID NO: 193023 - RNA, 64 nt, Human
cuggagaaaugcgcaugggggugggccugguaagucccaggaaccacaggaagugagcuaaggc

SEQ ID NO: 193024 - RNA, 64 nt, Human
gugggaaggcugggguggugcaggggccuugggcucccaggacaggugaacagggagggaccuc

SEQ ID NO: 193025 - RNA, 64 nt, Human
guagguauaaaccucuguaugaagagaagauuucucccaggaaaucuuuguacagcuuuaaguu

SEQ ID NO: 193026 - RNA, 58 nt, Human
cugcucagcgccacaagugaccagugccucccaggaguccucaggcccuggggacucu

SEQ ID NO: 193027 - RNA, 64 nt, Human
ucaagaguccucagcacuccacauucccaaaaaaucccaggaacuccuaaaccuuccccuguga

SEQ ID NO: 193028 - RNA, 64 nt, Human
gccugggcuguccucucugaaugccuuggagggaucccaggaagccccaguaggagggagcuuc

SEQ ID NO: 193029 - RNA, 64 nt, Human
uucccugcuuggaagcguggggucucccuggcucucccaggauaccaugcuguccucuuaguga

SEQ ID NO: 193030 - RNA, 64 nt, Human
guggggcugggaccuggugggugaaccugagcucucccaggagacaacuuagcugccagucacc

SEQ ID NO: 193031 - RNA, 64 nt, Human
agaacauuaucugagaaaagaguucacuuccugcucccaggauauuucucuuuucuguuuauga

SEQ ID NO: 193032 - RNA, 59 nt, Human
uaagugaauccugauuauuuccagacccaccaccagaguggaucuuauuuucaaagcag

SEQ ID NO: 193033 - RNA, 59 nt, Human
guuggcucuaacaucucuggucuuuagagccaccagaucucucuggcccauacagauau

SEQ ID NO: 193034 - RNA, 59 nt, Human
gcaaccaguuggcuaggggagcagggggcccaccagagcuguggagaggggacccuaag

SEQ ID NO: 193035 - RNA, 59 nt, Human
cuugaauuggugacauuuagucccucaagccaccagaugugacaguguugagaacuacc

SEQ ID NO: 193036 - RNA, 64 nt, Human
ccaggcgaccuuccccguguuugaguaaagccucucccaggagcagccuucuugccgugcucuc

SEQ ID NO: 193037 - RNA, 64 nt, Human
accacucagcagugcugucacuguaagcauggacucccaggagacagugugggaaacgcuccug

SEQ ID NO: 193038 - RNA, 64 nt, Human
cauggagcagaggcggggacagcuggccaccgugucccaggaccguaccguccgcaucugggac

SEQ ID NO: 193039 - RNA, 64 nt, Human
aaaggaggcccugucccagccacccaccccccacucccaggacuugcggucugagccuuuuugg

SEQ ID NO: 193040 - RNA, 64 nt, Human
uugcaagucaaaggcaagacaggcuuccauaaagucccaggaggucccuccuguagggcacaag

SEQ ID NO: 193041 - RNA, 64 nt, Human
acuugggucuggguggaaucagaacgugcaggucucccaggauguacacucacugcgcccuuuc

SEQ ID NO: 193042 - RNA, 64 nt, Human
gaaaaggaugggcuagauugggcuucaggcugcaucccaggacuccaaacagggaucugucucu

SEQ ID NO: 193043 - RNA, 64 nt, Human
cucaggcucugcccugcccuagcuccacacccucucccaggacccaucacgccugugcaguggc

SEQ ID NO: 193044 - RNA, 64 nt, Human
gcuugugcugggcuaggaccucaaccccagggauucccaggaagcagaacucuccagaagaagg

SEQ ID NO: 193045 - RNA, 64 nt, Human
uccugguggccuuaacuacaguggagguggaacuucccaggaggggaagggacagaccagcccc

SEQ ID NO: 193046 - RNA, 64 nt, Human
cuacuuuugccauugacuucuucccaagauucaaucccaggauguacaaggacagccccuccuc

SEQ ID NO: 193047 - RNA, 64 nt, Human
guaaaucugugccucugccuccuaggacuuauuuucccaggaggccauuuacaaggggaucugg

SEQ ID NO: 193048 - RNA, 64 nt, Human
cuuccuucauggugccuccagggagccuuccuggucccaggaccucugguggagggccauggcg

SEQ ID NO: 193049 - RNA, 64 nt, Human
cagcuuuagcuuucuccaccagauaaccagcuaaucccaggaauuugcugccccccaccagugg

SEQ ID NO: 193050 - RNA, 64 nt, Human
agcauuuuuccccucugugcuggauacagacuucucccaggauccucucuuugggagcgaagcc

SEQ ID NO: 193051 - RNA, 64 nt, Human
acacugucaucucgcugcuggcagaaaagccugaucccaggaggcccugcaguucccccgaccc

SEQ ID NO: 193052 - RNA, 60 nt, Human
ggucaccccagcaugagugcugagauauggacucucuaaggaaggggccgaacgcuugua

SEQ ID NO: 193053 - RNA, 60 nt, Human
acauaaagaaaauaacuucugcuagguauuacucucuacuccuaaaguuauuuacuauuu

SEQ ID NO: 193054 - RNA, 60 nt, Human
cuuacaacaugagccaguaacccuuuaggaacucucuauggagaacaggccuggugggaa

SEQ ID NO: 193055 - RNA, 64 nt, Human
uccaggccucugcuaucugcaucugcagugggcuucccaggaacuugacugucuuucauuugau

SEQ ID NO: 193056 - RNA, 64 nt, Human
cagaugccucagugcuacaccacagugggccuggucccaggacaggaaugcgguucaaacccag

SEQ ID NO: 193057 - RNA, 64 nt, Human
uuaggguucccggagcuccgggaagacccgcccaucccaggacuccagaugccaggagcccugc

SEQ ID NO: 193058 - RNA, 64 nt, Human
gggcauccggugguaggggcugcaggaccaggacucccaggaggccguguccaugugugacagc

SEQ ID NO: 193059 - RNA, 64 nt, Human
aggguggggggucauagccacaggggagggcaguucccaggaagguaaccagaugucucuuuug

SEQ ID NO: 193060 - RNA, 64 nt, Human
gucugcugcagggagcccugcuguaccccagccuucccaggacguggucuccagcuucuucauc

SEQ ID NO: 193061 - RNA, 64 nt, Human
cccaugucuuuguuaccccaggggcuguggcaugucccaggagggugugcaugugugugugugu

SEQ ID NO: 193062 - RNA, 64 nt, Human
aguuagcuauugggagcaaucuggaaaaacuugcucccaggagggcuuugugucuggccagcuu

SEQ ID NO: 193063 - RNA, 64 nt, Human
ucugugugucaggcugcuggaaagaagacuccauucccaggacagaggcccuugaguacagggg

SEQ ID NO: 193064 - RNA, 64 nt, Human
ugucaguagaugaccaaagaugguucaauuagagucccaggauugcaagagcuaauaggaacaa

SEQ ID NO: 193065 - RNA, 64 nt, Human
gccccuuccuccucguaaccaaaacccucacugcucccaggacggucuuauuuauaaaccagau

SEQ ID NO: 193066 - RNA, 64 nt, Human
ugacaccccuccccgaggccucccacugccggggucccaggacccuucccccuucaccugguga

SEQ ID NO: 193067 - RNA, 64 nt, Human
caguuuggaaggccagggcagguggaucgcuugaucccaggaggucgagaccagccuggggaac

SEQ ID NO: 193068 - RNA, 64 nt, Human
gggggugggggaucugggcaaggugggugauuccucccaggaggugcuugaggccccgauggac

SEQ ID NO: 193069 - RNA, 64 nt, Human
ugucagcuucggaagcaucucucgaggacucuggucccaggaugucucccaggacaagccaguc

SEQ ID NO: 193070 - RNA, 64 nt, Human
aagcaucucucgaggacucuggucccaggaugucucccaggacaagccagucugccucuuccuc

SEQ ID NO: 193071 - RNA, 60 nt, Human
gaucagcucacuaccacaucaaaggugccaacucucuaaaacguagacucugugcagcuu

SEQ ID NO: 193072 - RNA, 60 nt, Human
gugaaggguauucaaaaacauaacucaucaacucucuauuucaaguacacuuauccuuug

SEQ ID NO: 193073 - RNA, 60 nt, Human
uuccgucuguguccugcccucccauccagcacucucuauggaaauaguugucauuuccuc

SEQ ID NO: 193074 - RNA, 64 nt, Human
gcuccucuaggggcagccuccgucauccaugcccucccaggacccuccacucacugcugugagu

SEQ ID NO: 193075 - RNA, 64 nt, Human
accaggaacgcacucggugguggaggccccauguucccaggagccaagauucguagcauccuug

SEQ ID NO: 193076 - RNA, 64 nt, Human
aaagcuguccuuccuauggcaggaggggugggggucccaggacgugccucauacaugacuugag

SEQ ID NO: 193077 - RNA, 64 nt, Human
uccccagcuucuggggagggacacagcuuccccuucccaggaauugagugggccuagccccucc

SEQ ID NO: 193078 - RNA, 64 nt, Human
gcaccccacagcccuucaccuucgcuaucaaacaucccaggaaaggguaagaauuuagggccac

SEQ ID NO: 193079 - RNA, 64 nt, Human
gauucauguucaucaauaccugcugagaguacugucccaggaauauccaguggauggauucauc

SEQ ID NO: 193080 - RNA, 64 nt, Human
gccagugggcacuugugauaucuaaaaucuguuaucccaggacuguguacagaggggcaaccua

SEQ ID NO: 193081 - RNA, 64 nt, Human
ccacucaugcuguuccugaggccgcccucuccagucccaggagccgugucuagaguuccugacc

SEQ ID NO: 193082 - RNA, 64 nt, Human
agcaccuggggcuccagcugcuggaauccuaccaucccaggaggcaggcacagccagggagagg

SEQ ID NO: 193083 - RNA, 64 nt, Human
gcugguagaaauggaacuaaaccacagucuguaaucccaggagaauugcuugaacacaggaggc

SEQ ID NO: 193084 - RNA, 64 nt, Human
ucuacaguucacagaggucuuucagcucauuuaaucccaggaaagaggcaucaaagcuagaaug

SEQ ID NO: 193085 - RNA, 64 nt, Human
ucugagccuggcacauaggcacccagccugcaucucccaggaggaaguggaggggacaucgcug

SEQ ID NO: 193086 - RNA, 64 nt, Human
agugugggaggcugggggagcuguguccugcaguucccaggaccccauccucucagaagguagg

SEQ ID NO: 193087 - RNA, 64 nt, Human
acucuuccuguuccuuucucuaccacccuugccuucccaggacugcacgguuuaacacagcaga

SEQ ID NO: 193088 - RNA, 64 nt, Human
ggccucucccaugucucaguguugccugcauuucucccaggacuuggggguggggugaaaagcg

SEQ ID NO: 193089 - RNA, 64 nt, Human
acuuauuuaaaaaaaaagaaagaaaguuaucucuucccaggagaggcuagaaguagcuuuucug

SEQ ID NO: 193090 - RNA, 60 nt, Human
ggucagagcuaaauggcuccuuaaggaugaacucucuagagaagcaccuuccuccuacag

SEQ ID NO: 193091 - RNA, 60 nt, Human
uucuguuuacguaaccugcuuaguauugacacucucuaccaagagggucuuccuaagaag

SEQ ID NO: 193092 - RNA, 60 nt, Human
auguuuauuguuuuuuaaagaauguuuggcacucucuaacguccacuagcuuacugaguu

SEQ ID NO: 193093 - RNA, 64 nt, Human
ggaaccaaaagccucugccugcugcuauugcaauucccaggaucucuccuucccuggaucccuc

SEQ ID NO: 193094 - RNA, 64 nt, Human
gaguguggugagggaggggacuggguaggggucaucccaggaggagggguuuacauuggaacca

SEQ ID NO: 193095 - RNA, 64 nt, Human
gaaucccccaaccagagauguuaaagugagccugucccaggaaacaucuccacccaagacgucu

SEQ ID NO: 193096 - RNA, 64 nt, Human
cccugcugagcggaggcagcccaccuguccugccucccaggagcccuuggccaccucgcgccag

SEQ ID NO: 193097 - RNA, 64 nt, Human
ggcuuggaagggacuucucccgcaccccacucugucccaggacauagggcagggggccucacug

SEQ ID NO: 193098 - RNA, 64 nt, Human
gcaggacccuuggcaggcaagccccucccuucacucccaggaccuaccuucugcuaguaaagga

SEQ ID NO: 193099 - RNA, 64 nt, Human
cgucuagcacccagugaucccaugccuuugggaaucccaggaugcugcccaacgggaaauuugu

SEQ ID NO: 193100 - RNA, 64 nt, Human
agcaaacucuauaagaguguuuuaaaaauuaacuucccaggaagugaguuaaaaacaauaaaag

SEQ ID NO: 193101 - RNA, 64 nt, Human
ucccucuguccaccagcccauggcccugugcuaaucccaggauuaggccauaggaguccuaagu

SEQ ID NO: 193102 - RNA, 64 nt, Human
auucuuggaacuguaaagauuacaacccaaagucucccaggaagcuguggggagaccagaggau

SEQ ID NO: 193103 - RNA, 64 nt, Human
cccucccaccaugggccccucugcccauguuuccucccaggaagagcgggcagaguggcccagc

SEQ ID NO: 193104 - RNA, 64 nt, Human
cucaccccagggccuguggcugccugggcaccucucccaggaagugguggggcaccggucuccc

SEQ ID NO: 193105 - RNA, 64 nt, Human
ugauuucagacagagcugcuggguccgugccauaucccaggaggaccagcuggcccccugcugg

SEQ ID NO: 193106 - RNA, 64 nt, Human
aggaguuucacccugaccauugcccuagccagguucccaggaggccucaccauacucccuuuca

SEQ ID NO: 193107 - RNA, 64 nt, Human
ugagaggggagacagaggcagcuagggcuuggucucccaggacagagaguuacagaaaugggag

SEQ ID NO: 193108 - RNA, 64 nt, Human
gaccaggagggggcugggcgcugucccuucucuuucccaggagcccugccaggggcugugggcc

SEQ ID NO: 193109 - RNA, 60 nt, Human
guaugugggaagcauguguagcuauguuguacucucuaaaccugcccagggaccuuacca

SEQ ID NO: 193110 - RNA, 56 nt, Human
auuuuccguaaauacacacacaaaauggaucgcaucugugugacuaaugguuuauu

SEQ ID NO: 193111 - RNA, 59 nt, Human
cugcagccucacgcaccaucccccucuuuccaccagauggauguugacuuggugucugg

SEQ ID NO: 193112 - RNA, 59 nt, Human
aauucugagaguuguccugcaguuggaggccaccagagguaucugagcucccugcuucc

SEQ ID NO: 193113 - RNA, 64 nt, Human
cucgcagcagcaaggugggggcaagcagaaugccucccaggauuucacaccugagcccugcccc

SEQ ID NO: 193114 - RNA, 64 nt, Human
uguccccuuugggguacuugggggagacucuggcucccaggaucuguucccuauuucagugccu

SEQ ID NO: 193115 - RNA, 64 nt, Human
aaccacaacagguuggucaucaggauggccacccucccaggaucauccuuccucuguuccucuu

SEQ ID NO: 193116 - RNA, 64 nt, Human
gugcugcgcuagucccuucugccacccuucccagucccaggacgggcccuggagggagaaagga

SEQ ID NO: 193117 - RNA, 64 nt, Human
aaaacacaaacggaaguaagcagagcugccaggcucccaggagagcauggggacuaggaggaag

SEQ ID NO: 193118 - RNA, 64 nt, Human
uuaauggaagauuaucaauuguccuauuuuaugaucccaggacugaagacaguugugggauauc

SEQ ID NO: 193119 - RNA, 64 nt, Human
uguguugacugcugcuccccaccccuaccgauggucccaggaagcagggagaguuggggaaggc

SEQ ID NO: 193120 - RNA, 64 nt, Human
cccgcccacaggccugaggucugggaccuuucccucccaggaguccccuagguggcugggggag

SEQ ID NO: 193121 - RNA, 64 nt, Human
ucuccugcuggcugcccuggaggauuucaacaugucccaggauuugcuccacccucgagggcag

SEQ ID NO: 193122 - RNA, 53 nt, Human
cccuccacaaugagcugugaccaucccaggaggccugugcacacaucccaggc

SEQ ID NO: 193123 - RNA, 64 nt, Human
ccucggaguugcagcugugacacucauagguuacucccaggagugugcugagcagaaggcaagc

SEQ ID NO: 193124 - RNA, 64 nt, Human
aaaaggauucuauaucaugaccaaguggaauuuaucccaggaauucaagguugguucaacaucu

SEQ ID NO: 193125 - RNA, 64 nt, Human
aaagagaccuucaguaucagcccuaacucuucucucccaggaaggacuugcugggcucuguggc

SEQ ID NO: 193126 - RNA, 64 nt, Human
aaucccuucuuauuaaugaagugcauagugcugcucccaggagaccacugcugacagauacaca

SEQ ID NO: 193127 - RNA, 64 nt, Human
acagugaagauugauggaccagccucuuuccaggucccaggacuuugcaagagauggagacagg

SEQ ID NO: 193128 - RNA, 64 nt, Human
gcccaaacaggcugaagcuccuaaacuuggccauucccaggaggcuuggagacccccagauaac

SEQ ID NO: 193129 - RNA, 60 nt, Human
ucugugcaucuuuuuaggaaucucgcucucacucucuacguagccacucuccuuccccca

SEQ ID NO: 193130 - RNA, 60 nt, Human
uggaagaguggacagugacacaagguggacacucucuacagaucacugaggauaagcugg

SEQ ID NO: 193131 - RNA, 60 nt, Human
ggacugauuagaaaugcaaauucuugggucacucucuagaccaacugaugcagaaacagg

SEQ ID NO: 193132 - RNA, 64 nt, Human
accaggcgcccagcccugcggaggaggccggggcucccaggaagcggacgcccgguccccacac

SEQ ID NO: 193133 - RNA, 64 nt, Human
guagugacauuggugagacaacagcccuaacacuucccaggaacugaagugccucaugugauug

SEQ ID NO: 193134 - RNA, 64 nt, Human
gcaaaggucuucuucccucgccccuucuccaucgucccaggaaucccagggggcagcacagccg

SEQ ID NO: 193135 - RNA, 64 nt, Human
ggcugguucugcccaugcuagggggugggggagcucccaggacagaccagccuuguuucucaug

SEQ ID NO: 193136 - RNA, 64 nt, Human
cccucagacuucaugucucugcucaucagcacugucccaggauccuggagagggagaacuccug

SEQ ID NO: 193137 - RNA, 64 nt, Human
agagcagaggaggucccagauaccaaguggcgccucccaggaaaggcugggagaagagguggcc

SEQ ID NO: 193138 - RNA, 64 nt, Human
cuuguuucagggaccccaggaggugcccccuggcucccaggacuguguguggguccggggggug

SEQ ID NO: 193139 - RNA, 64 nt, Human
gcuccuguuuccauaggaaggggcgacaccuuccucccaggaagcugagaccuuuguggucuga

SEQ ID NO: 193140 - RNA, 64 nt, Human
ugccugugugcauggcuggaaggcacuggugaugucccaggagguagaccuccagcccugggua

SEQ ID NO: 193141 - RNA, 64 nt, Human
aaguccugggaaugugcggggccagucccugcccucccaggaggggugguagccguucccaccu

SEQ ID NO: 193142 - RNA, 64 nt, Human
acccugacaggcacaccccacugaagagccugagucccaggaggccuccuggaagcccaggacu

SEQ ID NO: 193143 - RNA, 64 nt, Human
uucugaauguaaaacuggagcccaggagaagcugucccaggagggcuguuaacucccuauagag

SEQ ID NO: 193144 - RNA, 64 nt, Human
gcugcaucucccuuuccucuguccuccauccuucucccaggauggugaagggggaccugguacc

SEQ ID NO: 193145 - RNA, 64 nt, Human
acaacuucugcacauacuggggcccugcuuauucucccaggacaggcuccuuaaagcagaggag

SEQ ID NO: 193146 - RNA, 64 nt, Human
gaaaaacacagggacucgugggagcaagcgaggcucccaggacccccacccucugggacaggcc

SEQ ID NO: 193147 - RNA, 64 nt, Human
cacacuggaaaacugggaaauggccagcugugugucccaggaaauuccuccccuuauucuuccu

SEQ ID NO: 193148 - RNA, 50 nt, Human
agaaagggaagaucuuuuaaacucucuauugaccaccaguuaacguauua

SEQ ID NO: 193149 - RNA, 60 nt, Human
uggccucacacugcugccugucugucugucacucucuaucugccagcuucuucagcuaaa

SEQ ID NO: 193150 - RNA, 60 nt, Human
auuucggaagugguggggacuaagggaagaacucucuaguucccucagugugaagccugu

SEQ ID NO: 193151 - RNA, 64 nt, Human
cuucccagacccucaugcaguugguuguaaauucucccaggagcuguuuuacugucuacuuuuc

SEQ ID NO: 193152 - RNA, 64 nt, Human
ccaguaucuauaaacguguuugcaugaguuuacaucccaggauuccaugauucuguaaaugccu

SEQ ID NO: 193153 - RNA, 64 nt, Human
ugggcugugauggggaugugcagggacagugggaucccaggaaacagaccuccauggugggaga

SEQ ID NO: 193154 - RNA, 64 nt, Human
cuucugagcacagauguucccccaucucgcucccucccaggacucugaccccagcauucucagg

SEQ ID NO: 193155 - RNA, 64 nt, Human
ucaagauugacucaugaggaccugaagggugacaucccaggaggggccucugaaauuucccaca

SEQ ID NO: 193156 - RNA, 64 nt, Human
agacaaauacaucugcccucauggaaggugacguucccaggagagggcaccuacacagucacgc

SEQ ID NO: 193157 - RNA, 64 nt, Human
agcccccuuccucccuggaccccacgggccccugucccaggaaccccgcccucugacuucuugc

SEQ ID NO: 193158 - RNA, 64 nt, Human
auuggugguggaguccugaccccaauccccaaccucccaggacuguguucuuucuggaguuuuc

SEQ ID NO: 193159 - RNA, 64 nt, Human
uugggcagaacaugccaaggaaucaaaugucaucucccaggaguuauucaagggugagcccuuu

SEQ ID NO: 193160 - RNA, 64 nt, Human
aaacugaaaggugacgugcaaaacugccuauuacucccaggaguggaggauaauuucauauuuc

SEQ ID NO: 193161 - RNA, 64 nt, Human
ggagggaggccccaagccacggggcaucccccucucccaggaagcagggagggggccgggaggu

SEQ ID NO: 193162 - RNA, 64 nt, Human
cagcgugguggagccucagggacagaucugaugaucccaggaggcucuggaggacaaucuagga

SEQ ID NO: 193163 - RNA, 64 nt, Human
uacccucaaacagaaaauaaugaagccuucuuccucccaggaaaggggacguucagcugagccg

SEQ ID NO: 193164 - RNA, 64 nt, Human
gaagaagaagcaccagccacaggggcagguguccucccaggaaguacagcuccccccuacaccu

SEQ ID NO: 193165 - RNA, 64 nt, Human
gggcuuggagagaccugcgcccaccccuccacucucccaggagucgcugaucacugggaccugg

SEQ ID NO: 193166 - RNA, 64 nt, Human
caauuaacacacuguuacugccgaagccugaaacucccaggacuuguccuugauccuuccagaa

SEQ ID NO: 193167 - RNA, 60 nt, Human
caaagugcagccgagagugagaaccaagugacucucuaggcuucggacacaaauaggcuc

SEQ ID NO: 193168 - RNA, 60 nt, Human
uccagccucagcuagcauuacccuucugacacucucuauguagccucccugaucuucuuu

SEQ ID NO: 193169 - RNA, 60 nt, Human
ucuuuccaaacacugaaggauuuauuucaaacucucuaaugcaccugccucagagauucc

SEQ ID NO: 193170 - RNA, 64 nt, Human
gucccagggcauggcccagcggccagauucuuuuucccaggauuaaaacucugaccccaggacc

SEQ ID NO: 193171 - RNA, 64 nt, Human
cuggcucagcucccgcggccccgcccguccccccucccaggacuggucuguugucuuuucaucu

SEQ ID NO: 193172 - RNA, 64 nt, Human
cuuuaacccccuugagcucuuccaaccuugacauucccaggaggagccccgcuucaccccuucu

SEQ ID NO: 193173 - RNA, 64 nt, Human
ugacacaucucccgcuccucuauggccccugccuucccaggaguacaccccaacagcacccucu

SEQ ID NO: 193174 - RNA, 60 nt, Human
augagaagaacgaggacugagcggcugcggucccaggaaggucuuacccccucuucuauu

SEQ ID NO: 193175 - RNA, 64 nt, Human
ugaggccagcccccaccuuccucuuucccaccugucccaggaccagaaucccagggacagagga

SEQ ID NO: 193176 - RNA, 64 nt, Human
uccccguauuucccccucucauaacuucuccccaucccaggaggaguucucaggccuggggugg

SEQ ID NO: 193177 - RNA, 64 nt, Human
uaguagguagacuuagaucccauuucuguccugcucccaggaagauucuuagguccucuucaau

SEQ ID NO: 193178 - RNA, 64 nt, Human
agucuuuccccacaccccagccaucgccgcccgcucccaggaggccagggcaggccugcguggg

SEQ ID NO: 193179 - RNA, 52 nt, Human
ucagcgcucugcugcagugagaucccaggaagcuggucagugaggagggggc

SEQ ID NO: 193180 - RNA, 64 nt, Human
cuaaaaugugucuugcugucauuuauauuccuuuucccaggaaagaagcauuucugauacuuuc

SEQ ID NO: 193181 - RNA, 64 nt, Human
gcccucacugagccucaauuuccucaucugggucucccaggacacaucacauacccacccuuac

SEQ ID NO: 193182 - RNA, 64 nt, Human
ucugucucaaaaaaaaaaaaaaaaaaaaagaaacucccaggagacagcagccuaguuuucgagu

SEQ ID NO: 193183 - RNA, 54 nt, Human
ccauccaggccaacuccugagucaucccaggacucagcacaccggcauccccac

SEQ ID NO: 193184 - RNA, 64 nt, Human
gucucuggggggcuggagaagccucccucauuccucccaggaauuaauaaaugugaagagaggc

SEQ ID NO: 193185 - RNA, 64 nt, Human
uuaaaacaaaauccaaguccucacaccccugucaucccaggagaucuuuccuuguggugguuuc

SEQ ID NO: 193186 - RNA, 60 nt, Human
gagucaggugucaagaaaggagggguaaguacucucuacuugcuggaaaaucauuguaag

SEQ ID NO: 193187 - RNA, 60 nt, Human
augagcuagggcaauauguuuugacagaaaacucucuaagauuuaguaagugaaaaaaag

SEQ ID NO: 193188 - RNA, 60 nt, Human; identical to SEQ ID NO: 192702

SEQ ID NO: 193189 - RNA, 64 nt, Human
gcuccuacaggcgcuccaggccacucucagagacucccaggaguuguugaacuauauuuggaga

SEQ ID NO: 193190 - RNA, 64 nt, Human
aagacucccuccagugaggagcugggaggagacaucccaggaaaagaauuugauacuccucugu

SEQ ID NO: 193191 - RNA, 64 nt, Human
cagguauuguacucgggaggcugaggugggaggaucccaggaguucaaauccugccugggcaac

SEQ ID NO: 193192 - RNA, 64 nt, Human
guuaggcacccaggagccccaggucggcggguguucccaggaagaggaaguaaaucugcaaccc

SEQ ID NO: 193193 - RNA, 64 nt, Human
aagaucaaaacugcauuugcaaagcccuccccugucccaggacaaagcugagacugacggguga

SEQ ID NO: 193194 - RNA, 64 nt, Human
aauaaaaaaaguaccuccccugucucgcacagugucccaggacccugcggugcaguagaggcgc

SEQ ID NO: 193195 - RNA, 64 nt, Human
uggcccugcgcaucauggacucucucagcuucccucccaggaucaguuucuacacaacucugug

SEQ ID NO: 193196 - RNA, 64 nt, Human
cugugaauggcuguucuccccucacugcugagucucccaggacccccuuuggagaugcccaugg

SEQ ID NO: 193197 - RNA, 64 nt, Human
gggagcuggacuucagggagccugagugaugcuuucccaggagcagggcagcuggcuggaccag

SEQ ID NO: 193198 - RNA, 64 nt, Human
ggaacuguggagacugguuaggaucugaggugagucccaggauguuucguccaccagggcccag

SEQ ID NO: 193199 - RNA, 64 nt, Human
aaaccagacucguucuucugggaacccugcccacucccaggaccaagauuggccugaggcugca

SEQ ID NO: 193200 - RNA, 64 nt, Human
gaggacaccgggaggcuguuagggggucacugaaucccaggagccaaccucccccuuugcaggg

SEQ ID NO: 193201 - RNA, 64 nt, Human
ggaaagcuuugagaguuuauguuuacucuuugagucccaggagaagccuggcacccucuuugca

SEQ ID NO: 193202 - RNA, 64 nt, Human
cuuaaagaaugcccuuuaugaugcacugauuccaucccaggaacccaacagagcucaggacagc

SEQ ID NO: 193203 - RNA, 64 nt, Human
gauuuguugggggcaaaggggguggcgggaccguucccaggagguaccagcaccugccucgauc

SEQ ID NO: 193204 - RNA, 64 nt, Human
guuuauauaguuuaaauuucuuacuacuguuagaucccaggaauucauuaauaaucauccuugg

SEQ ID NO: 193205 - RNA, 60 nt, Human
auccuuuugcaauguccagcuuuuaccccuacucucuacuuuuucacccaaacugauaac

SEQ ID NO: 193206 - RNA, 60 nt, Human
gaauaaaaugugauaguaacauaguagaguacucucuagcaguuaagugacaaauuaagu

SEQ ID NO: 193207 - RNA, 60 nt, Human
aaaaaacccagcgcaccuguuagagucgucacucucuauugucauggggaucaauuuuca

SEQ ID NO: 193208 - RNA, 64 nt, Human
gcgauggugccuggucucugaguaagaugccaggucccaggaacucaggcuucaggugagaagg

SEQ ID NO: 193209 - RNA, 64 nt, Human
cuuaagaaggucgccuaagccuaagagaagacagucccaggagaagcuggccgggaccagccag

SEQ ID NO: 193210 - RNA, 64 nt, Human
guccccuugcagccgacacggucucggaucaggcucccaggagccugcccagcccccuggucuu

SEQ ID NO: 193211 - RNA, 64 nt, Human
agguugcucuagauugagagaagagacaaacaccucccaggagacaguucaagaaagcuucaaa

SEQ ID NO: 193212 - RNA, 64 nt, Human
ccccacuuauuccccauucuuccuaguuuucuccucccaggaacugggccaacucaccugaguc

SEQ ID NO: 193213 - RNA, 64 nt, Human
acaugcugcccccucccccguggacaccagcuguucccaggaguugacauaucaguggcugagc

SEQ ID NO: 193214 - RNA, 64 nt, Human
ugggcugagagcccuuucucccauccauuggaggucccaggagugucacccauggagaggcuau

SEQ ID NO: 193215 - RNA, 64 nt, Human
ccugagccugguccuggccgucccuaagcaugugucccaggagcaggaccuacuaggagagggg

SEQ ID NO: 193216 - RNA, 64 nt, Human
agguccagggagacagacucugaaugggacugagucccaggaaacagugcuuuccgaugagacu

SEQ ID NO: 193217 - RNA, 64 nt, Human
uaguccggccaggcgcuguggcucacgccuguaaucccaggacuuugggaggccaaggcgggca

SEQ ID NO: 193218 - RNA, 64 nt, Human
gacaauauuuuuccaccauuguaucucacauuuuucccaggagguuacccauaacagaagagac

SEQ ID NO: 193219 - RNA, 64 nt, Human
gccuguucuuagcucaugcauaguccuuacagagucccaggaccggggguggagaggagccuca

SEQ ID NO: 193220 - RNA, 64 nt, Human
ccuccccugcuaaaguucuucaugguagugagccucccaggaucacucaugcuguccugagaaa

SEQ ID NO: 193221 - RNA, 64 nt, Human
agggcaugggugcagguaguuuguuugagagauuucccaggacauacaagauggggagugagau

SEQ ID NO: 193222 - RNA, 64 nt, Human
cauaagcuguagaacucugcaggcagauuuacugucccaggagcaaaugcuggaugagcaacuc

SEQ ID NO: 193223 - RNA, 64 nt, Human
aacccaacaugaaaaggugacaagccuggguuucucccaggauaggugaaaggguuaaaaugag

SEQ ID NO: 193224 - RNA, 50 nt, Human
acuuagaaaccaaagacuaaacucucuaggggauccugcugcuuugcuuu

SEQ ID NO: 193225 - RNA, 60 nt, Human
uuauuagauacacuuaaauguuuccaaggcacucucuacauuacccuuguuuuucucuuu

SEQ ID NO: 193226 - RNA, 60 nt, Human
cgcucugcgcacaaaagccaaacgcauccgacucucuaaaugugauuuauuucuugcuuu

SEQ ID NO: 193227 - RNA, 64 nt, Human
uggcauaucuggggccacgcaguuuagucucuugucccaggagaauuguuagugaccccucuuu

SEQ ID NO: 193228 - RNA, 64 nt, Human
cugccaucagccccugcugcuccucggccagagcucccaggacgcagggagacccugggagagu

SEQ ID NO: 193229 - RNA, 64 nt, Human
caaaaucaaauuccagaaugauuuuacggagauaucccaggaaaauuaaggcuucucuuaaaca

SEQ ID NO: 193230 - RNA, 64 nt, Human
acuggagagaugggcccaucauuaggggccagcaucccaggaacuggaccuuuccccagagccu

SEQ ID NO: 193231 - RNA, 64 nt, Human
uauuacuguuugauuuucuuguaucugguucuacucccaggaugaaauuauccaacuacauaua

SEQ ID NO: 193232 - RNA, 64 nt, Human
gccaacaaugccuccaauuccagcucggagucaaucccaggaaaauaugcgaaguucuccaaac

SEQ ID NO: 193233 - RNA, 64 nt, Human
ugauacagaguaucuuggcauuauaaauucaguaucccaggaccuaaaccuuuaugcuacauuu

SEQ ID NO: 193234 - RNA, 64 nt, Human
ccaugacccugaaagccuagcccuggccuugaccucccaggagcgcccuccccgcccucucccg

SEQ ID NO: 193235 - RNA, 64 nt, Human
aucgucuauccccaggggaauccacacagcccgcucccaggagcuaaugguagagcguccuuga

SEQ ID NO: 193236 - RNA, 64 nt, Human
ucuggcaggcaggcaaagcuaggcagaagaggauucccaggauccugggucuguucccugcccc

SEQ ID NO: 193237 - RNA, 64 nt, Human
cgacuucuuagagaaggcccuccaugugacuuccucccaggagccagaugcgauccucaggcug

SEQ ID NO: 193238 - RNA, 64 nt, Human
auccaggcccaccugugucccugacucaggguggucccaggacuggcaccuacucuuuagagag

SEQ ID NO: 193239 - RNA, 64 nt, Human
cccuccaacuagugcccuccccaccaugccuccuucccaggacccaggucugcugcccaggaac

SEQ ID NO: 193240 - RNA, 64 nt, Human
agcccucagcacccccucccuccccaccuggcccucccaggacagcucucgccccccacaaagg

SEQ ID NO: 193241 - RNA, 64 nt, Human
cugcucuuauugugccaauaugcccuccaaacccucccaggauucaaagcuagguuuggcuguc

SEQ ID NO: 193242 - RNA, 64 nt, Human
ccagcaggugccucgauucccugcccuugugaccucccaggaaacagaacugaucugggacacu

SEQ ID NO: 193243 - RNA, 60 nt, Human
ucaaacuuuguguauaaguuguauuauuagacucucuaguuuuaucuuaaacuguucuuc

SEQ ID NO: 193244 - RNA, 60 nt, Human
aaccaaaaugcuaagcaaugaauauuaaggacucucuagcugccugggcauuacuguugc

SEQ ID NO: 193245 - RNA, 60 nt, Human
ucugcagaaaccuguuguauaacuguagacacucucuaaugguucucaaaggaggaaaug

SEQ ID NO: 193246 - RNA, 64 nt, Human
gauucucuaaggagcacgaaagggggaaugccccucccaggaguuuaugggagaagggacuggg

SEQ ID NO: 193247 - RNA, 64 nt, Human
cuuuuacacaggccuaggguccccucagucuuggucccaggagaugggggccacucgugaggcu

SEQ ID NO: 193248 - RNA, 64 nt, Human
cucuucauguuccaguucaucccagaaguagacaucccaggacccauucugugucaaggugaau

SEQ ID NO: 193249 - RNA, 64 nt, Human
cuuuaaagaccagaccuucuuucucagccagguuucccaggaugcccugaggagaaccaucuuc

SEQ ID NO: 193250 - RNA, 64 nt, Human
cuccucuuuucugccuggauuugugaccaugaauucccaggaagagcugggccccugggagcug

SEQ ID NO: 193251 - RNA, 64 nt, Human
caacacuggucugcuguuccagugguaagcuaugucccaggaaucaguuuaaaagcacgacagu

SEQ ID NO: 193252 - RNA, 64 nt, Human
auguggaacugcagccucagcccaucuggcagagucccaggaacucggagacuggcacagcugc

SEQ ID NO: 193253 - RNA, 64 nt, Human
ccucacuuuaggcagcuguaacagcggcagggugucccaggagcccugauccggggguccaggg

SEQ ID NO: 193254 - RNA, 64 nt, Human
agaagaggccucugugcccagccugauucucugcucccaggagccagugacaugaggugcagag

SEQ ID NO: 193255 - RNA, 64 nt, Human
gagaaagggaagucaggguucuagggguuauucgucccaggaaauagaagugaaauugucuuua

SEQ ID NO: 193256 - RNA, 64 nt, Human
cuuucaucccuccuucuagggccuauggcaguucucccaggauguguggcgagagccugggcca

SEQ ID NO: 193257 - RNA, 64 nt, Human
uccuccacuacaaccuccaugaccuugagacgcaucccaggaggugacgaggcaggggcuccag

SEQ ID NO: 193258 - RNA, 64 nt, Human
aggggcugcaccuucccccaggaaugacccucuaucccaggaccugagaagggccugcucaccc

SEQ ID NO: 193259 - RNA, 64 nt, Human
aagcucuggugacccugggcuucgcagggguagaucccaggacucggcaguggaugggaugcag

SEQ ID NO: 193260 - RNA, 64 nt, Human
ucuccccuuuccccauccucuaucuaucccucuuucccaggaacaaaucaaaagguggauuauc

SEQ ID NO: 193261 - RNA, 64 nt, Human
acccuucauucuuucaacaaacaugccaucuaucucccaggacauuuauucccuucuauucaag

SEQ ID NO: 193262 - RNA, 60 nt, Human
uuaggcuucagucuggggccaucuggccccacucucuaggcccuacuccaguuaaaucaa

SEQ ID NO: 193263 - RNA, 60 nt, Human
auagauucugcuugggauauauauccaggcacucucuaaggucuaggguugauauuaaca

SEQ ID NO: 193264 - RNA, 60 nt, Human
gaaagcccagaccugcagcagaacucuccaacucucuaucagcuuucaggguuuucucuc

SEQ ID NO: 193265 - RNA, 64 nt, Human
ggucucuuuguugcuauguuuuuuuguuugaaguucccaggaauauuugagggguuccggugau

SEQ ID NO: 193266 - RNA, 64 nt, Human
aaagggugucugaugugggguggggcuggcauccucccaggaagguucuaggugggaccccguc

SEQ ID NO: 193267 - RNA, 64 nt, Human
ccgacugaucauccagacacaaaggucuugguucucccaggagcucagggccugucagaccugg

SEQ ID NO: 193268 - RNA, 64 nt, Human
gugcucuggucugugggucaguccucuuuccuugucccaggauggagcugauccaguaaccucg

SEQ ID NO: 193269 - RNA, 55 nt, Human
guugugccgugaaauccuaagggaaucccaggaguaaccaaggaggggguaguug

SEQ ID NO: 193270 - RNA, 64 nt, Human
uggcccugccccucccucgccccccuugccaccuucccaggacugcuuguccgcuaucaucacu

SEQ ID NO: 193271 - RNA, 64 nt, Human
cagaaugcuuuuaaauuuuccagggccuuucuccucccaggaucugggaaagcuugggaaccac

SEQ ID NO: 193272 - RNA, 64 nt, Human
aacaggagaaucugggcccuaggagcccuguaacucccaggagagaccacugaaaauacuggag

SEQ ID NO: 193273 - RNA, 64 nt, Human
ugauucuuggaaguugguauggaccagaaagcauucccaggacauuuaggcuauggcugaguuc

SEQ ID NO: 193274 - RNA, 64 nt, Human
ugggauugcagcugaggugggaguggagaaugguucccaggaagacaguuccaccucuaagguc

SEQ ID NO: 193275 - RNA, 64 nt, Human
cugagcagcuccuccccggagucccccagcacagucccaggagaugacaggaaggaagcaccag

SEQ ID NO: 193276 - RNA, 64 nt, Human
acucaaagaaggccguguuuccaacauccucucaucccaggacauuuggggcaagugaguuagg

SEQ ID NO: 193277 - RNA, 64 nt, Human
gaucugaacuggaagcagagguugagauucugccucccaggagagggauuuaccugcccccuag

SEQ ID NO: 193278 - RNA, 64 nt, Human
cagaggauaugacagcuuaccagcuaagaguaccucccaggaaacagucugacuaauguggaac

SEQ ID NO: 193279 - RNA, 64 nt, Human
cacaaccagucacugggccucucugcagaccucuucccaggagacccuacaccuucuuggucua

SEQ ID NO: 193280 - RNA, 64 nt, Human
gagggggcuuucuccccuuuugcuugagcaggguucccaggagggagaaagagaagacaagagc

SEQ ID NO: 193281 - RNA, 60 nt, Human
caaugauugucauuggguauauauguauuuacucucuauuauugggcauaaagguggcuu

SEQ ID NO: 193282 - RNA, 60 nt, Human
ucccucugggcuggagcucagugagggacaacucucuagggacaccuguaccagccccac

SEQ ID NO: 193283 - RNA, 60 nt, Human
aaagcugaaucauugaaaacguaccuugaaacucucuaucucuggacacuccaggguaga

SEQ ID NO: 193284 - RNA, 64 nt, Human
gggagggugcugggccugacauggcuauauacccucccaggaguaaaagccaagcaagagguug

SEQ ID NO: 193285 - RNA, 64 nt, Human
ugacguagaauaugugcugucugugagaccguguucccaggagcacugacugcaguugagagag

SEQ ID NO: 193286 - RNA, 64 nt, Human
cacauguuaaaggccugggguuuaggaagcuaagucccaggaaaacauaccuacagacaggaca

SEQ ID NO: 193287 - RNA, 64 nt, Human
ggaacggguguggauuugaauguggacuucggaaucccaggaggcaggggccgggcucuccucc

SEQ ID NO: 193288 - RNA, 64 nt, Human
ccagggugagaauaaagacgucuccucaggacccucccaggagaguacauggcauugagacauc

SEQ ID NO: 193289 - RNA, 64 nt, Human
uugggcugcuaugggggauggcaccucucagcccucccaggaaacacacagagcucugggccca

SEQ ID NO: 193290 - RNA, 60 nt, Human
gagaauuuuuacgcaagaagagccaaauugacucucuaaaucugguguauggguauuaaa

SEQ ID NO: 193291 - RNA, 60 nt, Human
caaagcacuauuuaaauucugccucuuccuacucucuaacccaaauaugcacaaacucuc

SEQ ID NO: 193292 - RNA, 60 nt, Human
cuuccuacucucuaacccaaauaugcacaaacucucuauggccuugagaagcaguuggag

SEQ ID NO: 193293 - RNA, 60 nt, Human
guuuugagggcuauucagccauuccauuuuacucucuauuuaaaggccgugagcaagcuu

SEQ ID NO: 193294 - RNA, 60 nt, Human
uccccuauuucugaccuacaacuauaaacuacucucuauuaggagaacuagaccacuuuc

SEQ ID NO: 193295 - RNA, 60 nt, Human
caggagagccuugauuuaggcuacggccucacucucuauggccacccuaagaggaaaggc

SEQ ID NO: 193296 - RNA, 60 nt, Human
gcccuccugcccacgggaggacaagcaauaacucucuacaggaauauauuuuuuaaacga

SEQ ID NO: 193297 - RNA, 60 nt, Human
uagauguaaaaaucuuuagaaacaaauaaaacucucuauauauguguaugucuguguaca

SEQ ID NO: 193298 - RNA, 60 nt, Human
acaggaagagcuaaucuucagagagcucagacucucuaaugaugcugaaggagcaaaggc

SEQ ID NO: 193299 - RNA, 60 nt, Human
uggaguaauucugaaaaaaauuauuccuaaacucucuaaguguggacggagaaugagcaa

SEQ ID NO: 193300 - RNA, 60 nt, Human
ccauuucccaccccugcuucagcgaaagggacucucuaacagggcagucacuguugacuc

SEQ ID NO: 193301 - RNA, 60 nt, Human
auugaaugcaagcguggaaauuuaggcugaacucucuaucaaaaggaaaaauguggagga

SEQ ID NO: 193302 - RNA, 60 nt, Human
aggaguccaaugcuuccuguaaugaaauccacucucuaugugugggaaaagaggcaggga

SEQ ID NO: 193303 - RNA, 60 nt, Human
uuuccuauaucuucuauucuagagugguaaacucucuauaaguguucaguguugacauag

SEQ ID NO: 193304 - RNA, 60 nt, Human
uuucauauuuguaucagcuuuugugcuaaaacucucuaaguacauccaccuguguaauag

SEQ ID NO: 193305 - RNA, 60 nt, Human
ugagccagagggacugaucaggccccauucacucucuacucauuaaaagguccugagcca

SEQ ID NO: 193306 - RNA, 60 nt, Human
ucuauggcuuuaaauaaauuaagauccuaaacucucuagcuuaaguguaaaugaaguaca

SEQ ID NO: 193307 - RNA, 60 nt, Human
uaaauggaauagagcuauccauuuguucuuacucucuagggagacaaucuuccaaaacag

SEQ ID NO: 193308 - RNA, 60 nt, Human
ucaguuaauauuaguacuuuuuaaaucuuuacucucuaucuugaagcauuagauguuaag

SEQ ID NO: 193309 - RNA, 60 nt, Human
cccagacuucucuuucuuauuuuguaauaaacucucuagggccaaaaccugguaugguca

SEQ ID NO: 193310 - RNA, 60 nt, Human
ccacacgcugucucuugagaauuuggauacacucucuagcuuuaggggaccaugaagaga

SEQ ID NO: 193311 - RNA, 60 nt, Human
augauaaucuauauuuguuauuacucagugacucucuaauuucacaucagcauguucagc

SEQ ID NO: 193312 - RNA, 60 nt, Human
gccuacagucuguauuguuuacauuaagaaacucucuauuauuguguugcuauuuuccau

SEQ ID NO: 193313 - RNA, 60 nt, Human
ccaggaaaauaacacguaauaagacuguucacucucuaaguacccuaaagguauuuggug

SEQ ID NO: 193314 - RNA, 60 nt, Human
ccuguucaugaaucacccuugcucaaauaaacucucuaaaaugcuaaugugccuaaguug

SEQ ID NO: 193315 - RNA, 60 nt, Human
auaaaaaaaaaaucccuaaaaacucucuauacucucuauaacaauacuuuaucaagaacu

SEQ ID NO: 193316 - RNA, 60 nt, Human
acuucaaaaauaaaaaaaaaaucccuaaaaacucucuauacucucuauaacaauacuuua

SEQ ID NO: 193317 - RNA, 60 nt, Human
auugauucauauucuccuagggcucaaacuacucucuauugguuccaggauaaugacaaa

SEQ ID NO: 193318 - RNA, 60 nt, Human
aaaggaagaauucuugccugccauacagaaacucucuagcacucccugaccuuaagcuuu

SEQ ID NO: 193319 - RNA, 60 nt, Human
agcggccuuuucuaaacaucgacuucuacuacucucuagccuuaaaauaccuucugcuua

SEQ ID NO: 193320 - RNA, 60 nt, Human
uuaccuaccaauacuaucugcuacugaauaacucucuaaauauguagaccucacuaauaa

SEQ ID NO: 193321 - RNA, 60 nt, Human
gguagcucuugucacguuccuuccuuccucacucucuauuucucuuucccucucccuguc

SEQ ID NO: 193322 - RNA, 60 nt, Human
uaaagugcagcagcagcuccucucaagcucacucucuaggucuccaggguaggaguguuu

SEQ ID NO: 193323 - RNA, 60 nt, Human
agaggcucaaacaagaaauucacuguguacacucucuaagacauucuccaaauugauuuu

SEQ ID NO: 193324 - RNA, 60 nt, Human
aggaauuguuuuaaccauuuccuuuucuaaacucucuagcuuucaacuuuacuuaaacau

SEQ ID NO: 193325 - RNA, 60 nt, Human
aaucucuugguggaaacuuucaguugcuuaacucucuauuggaagauuuuuuuaauguuc

SEQ ID NO: 193326 - RNA, 60 nt, Human
aaaaguuugaucauaccaaacauuuccuaaacucucuaguuagauaucugacuugggagu

SEQ ID NO: 193327 - RNA, 60 nt, Human
uugauguccccuucccccaccuuccuccucacucucuaccucccugccgcuuuccaacca

SEQ ID NO: 193328 - RNA, 60 nt, Human
ucuuaaaacauuauuagauuuugaggaaagacucucuagauauauuuucuaauguucagu

SEQ ID NO: 193329 - RNA, 60 nt, Human
aaagaagauacaguuugaagacagaaguguacucucuacaaugcaauuuacuguacaguu

SEQ ID NO: 193330 - RNA, 60 nt, Human
aauuccaguguggcugcaguuuaacuuugcacucucuaugcauaugagguuuccuaaaua

SEQ ID NO: 193331 - RNA, 60 nt, Human
ugaggugcugaugagugauugacacacagcacucucuaaaucuuccuugugaggauuaug

SEQ ID NO: 193332 - RNA, 60 nt, Human
aacuuugcuuuuagguugaaggcaaaaccaacucucuacuacacaggccugauaacucug

SEQ ID NO: 193333 - RNA, 60 nt, Human
uaggccaugcuguacugugagccccuccucacucucuaccaacccuaaacccugaggaca

SEQ ID NO: 193334 - RNA, 60 nt, Human
ccuucagccucuuccuguccuuuagaccugacucucuaccagauguuuggagggaagggc

SEQ ID NO: 193335 - RNA, 60 nt, Human
uuccauauccuugcuguggagcucuggaacacucucuaaauuucccucuauuaaaaauca

SEQ ID NO: 193336 - RNA, 60 nt, Human
aaauaaguaggacugaguauuuaugugaaaacucucuagaagguaaaaauaaagauaauu

SEQ ID NO: 193337 - RNA, 60 nt, Human
uuuaaagagguuaauaaaaacaaacuauaaacucucuagacugggcugacaguaaaagca

SEQ ID NO: 193338 - RNA, 60 nt, Human
gggaagaggagaagaggguaagggggcuucacucucuagaucagccugcuaggagccucu

SEQ ID NO: 193339 - RNA, 56 nt, Human
ccucgccuaggccugugagguaacugggaucgcaccuuuuauaccagagaccugag

SEQ ID NO: 193340 - RNA, 56 nt, Human
gcugacgguguccuugucacagacguggaucgcaaguggagcuuuugcugaugugu

SEQ ID NO: 193341 - RNA, 56 nt, Human
aacugcagccagaacaauggcuggguggaucgcacguaaagcuugccacuaaaaau

SEQ ID NO: 193342 - RNA, 56 nt, Human
ucuuuucauucucugcccagguuuugggaucgcaaagggauuguucuuauaaaagu

SEQ ID NO: 193343 - RNA, 56 nt, Human
guucaggcugccccgccuccacugggggaucgcaccugugaauuaccugagguaug

SEQ ID NO: 193344 - RNA, 56 nt, Human
gacucuccuccuuuccagagagaaucggaucgcaccacguguggcagccugcggcg

SEQ ID NO: 193345 - RNA, 56 nt, Human
auguuuaagcccuuggacugagggugggaucgcagcuccgaagacggagaggaggg

SEQ ID NO: 193346 - RNA, 56 nt, Human
aggucgucggcugcaaccacacacuuggaucgcacgugcaauguccuuugauuuuu

SEQ ID NO: 193347 - RNA, 56 nt, Human
agaacauuuuuaaaaagagaguauauggaucgcaagaaaaaugaaggguuaucaua

SEQ ID NO: 193348 - RNA, 56 nt, Human
uuuuuauaucuggaaugagccuguugggaucgcauugcauaccuucgggguacaag

SEQ ID NO: 193349 - RNA, 56 nt, Human
auguacgucuagcuccucagggcuucggaucgcagcucacucgaggccuggggaag

SEQ ID NO: 193350 - RNA, 56 nt, Human
ggccuggacaguggaaaccaagagcaggaucgcaaaguaacagcaucagacucuuc

SEQ ID NO: 193351 - RNA, 56 nt, Human
guugcccucuccuuccauucacuagaggaucgcaucgucaaaagauuuuugcuugg

SEQ ID NO: 193352 - RNA, 56 nt, Human
gccccagccugugccccggagaggcaggaucgcaguggucagaauccacgugcuuu

SEQ ID NO: 193353 - RNA, 56 nt, Human
ggaacagagacccgccuuaagagacuggaucgcacaccuuugcaacagauguguuc

SEQ ID NO: 193354 - RNA, 56 nt, Human
ucuggauucccaggaugagcaucccaggaucgcaagagccauguagaagcugcauc

SEQ ID NO: 193355 - RNA, 56 nt, Human
uggguccacgcacaggaucgcgcgcgggaucgcagguagagcaggacgcugcagcg

SEQ ID NO: 193356 - RNA, 56 nt, Human
uuuuuuugcaggggugagcacagacaggaucgcagggagaggccguauuaauuagc

SEQ ID NO: 193357 - RNA, 64 nt, Human
aguggucuaauucaacucugugucccagcaccuggcacaccagaagugccaugcucagaaaugu

SEQ ID NO: 193358 - RNA, 64 nt, Human
ugccucagccucccaaguagcugggaugacaggcgcacaccaccacgcccagcaaauuuuuugu

SEQ ID NO: 193359 - RNA, 64 nt, Human
augugugacugagaccagagauggcaaaugaauggcacaccauuucuccuucuccugccccagg

SEQ ID NO: 193360 - RNA, 64 nt, Human
ugccucggccucccuaguagcugggauuacaggcgcacaccaccacacacagcuaauuuuuuuu

SEQ ID NO: 193361 - RNA, 64 nt, Human
aacucuaguaugugcauaguuugacgugcagcaugcacaccaggccuuaagaugggaauguagc

SEQ ID NO: 193362 - RNA, 64 nt, Human
ugccucuguucccuuuucucuccuugaaaguccagcacaccauucuuguccuuccccaguuucc

SEQ ID NO: 193363 - RNA, 64 nt, Human
aaggaagccauagaauugcucuggucaaaaccaagcacaccauagccuuaacugaauauuuagg

SEQ ID NO: 193364 - RNA, 64 nt, Human
gucagggguucugucuaccuggggaccccugucugcacaccagggaucaauaagagccaaagug

SEQ ID NO: 193365 - RNA, 64 nt, Human
gaagcagguugcagugagccgagauugcgccacugcacaccagucuggagacagagugagaguc

SEQ ID NO: 193366 - RNA, 64 nt, Human
gucuguguugcagcagcauucucaucgggggugcgcacaccaucguuacugucgggcaguaacu

SEQ ID NO: 193367 - RNA, 64 nt, Human
cuagcugcuuaggaguacccccacgauacgcacagcacaccacugucccuucacugcacuuucu

SEQ ID NO: 193368 - RNA, 64 nt, Human
ggcagcugggccccaccuacuugugacugaaggggcacaccacugcccugccugcccacuuagc

SEQ ID NO: 193369 - RNA, 64 nt, Human
ucagagauccgcccagaccccucuccugcccucugcacaccagcagcaggcaugaaccuugggu

SEQ ID NO: 193370 - RNA, 64 nt, Human
gguggagguugcagucagccaagaucgugccacugcacaccauccuggaugacagagcaagacu

SEQ ID NO: 193371 - RNA, 64 nt, Human
cuccaucuggggacaguccuacuccaagaacacugcacaccagcuccucacacagaucccacuu

SEQ ID NO: 193372 - RNA, 63 nt, Human
aagcuggugucauugacuaaccacauccacaaagcacaccauuaauccacuaugaucaaguug

SEQ ID NO: 193373 - RNA, 59 nt, Human
gguucuaccagagaggaaaauuccacaucccaccagaagacagggguguuggcaggcau

SEQ ID NO: 193374 - RNA, 59 nt, Human
agguugucaguuuccagcaaggcugacauccaccagacugauuucuccgauguugcacu

SEQ ID NO: 193375 - RNA, 59 nt, Human
uuaccugccccgagggaaguccagcagcuccaccagauagagaucuggagaugcuucuc

SEQ ID NO: 193376 - RNA, 59 nt, Human
gaacucugcgugaagggccuuaaugucacccaccagaaaacuaacuccaaauaaacgcu

SEQ ID NO: 193377 - RNA, 64 nt, Human
ggaucaauauuuugcacaccuguaauaggccauggcacaccagccaagaugcucugcucacagu

SEQ ID NO: 193378 - RNA, 64 nt, Human
gcaacugcuuuauaugacugaugauggcuuccuugcacaccacauauacagugcgcaugcuuac

SEQ ID NO: 193379 - RNA, 64 nt, Human
gaagcugcaggggcaggagaggcugggcuggguggcacaccacccgaggggggccccgggaccc

SEQ ID NO: 193380 - RNA, 64 nt, Human
auauucuugucauuuggagucaguggaaaauccagcacaccaagcaccagucuucuucugaggc

SEQ ID NO: 193381 - RNA, 64 nt, Human
cgucucagccuccugaguagcugagacuacaggugcacaccaccaagccuggcuuuauguauuu

SEQ ID NO: 193382 - RNA, 64 nt, Human
uaccacucucuccuggggccgacacguugggacagcacaccauagcauaaagcuaggggaugca

SEQ ID NO: 193383 - RNA, 64 nt, Human
acacacacauacacacaugcacgcacgcacgcaugcacaccaauuuauguuuuuauuaagugcc

SEQ ID NO: 193384 - RNA, 64 nt, Human
guuggaggcugcagugcgcuacgaucacaccacugcacaccagccuggggauagagugagaucc

SEQ ID NO: 193385 - RNA, 64 nt, Human
acuuagcaccaagugcugaggcuggaagaaaaacgcacaccagacgggcaacaaacagucuggg

SEQ ID NO: 193386 - RNA, 64 nt, Human
augccggguggaggagacaggcaaggugccguuggcacaccagcucagacaggggccugcgcag

SEQ ID NO: 193387 - RNA, 64 nt, Human
gugugaacgagauugccaggcccuuuucuccuaugcacaccaggauagacaaggcaggggauac

SEQ ID NO: 193388 - RNA, 64 nt, Human
uuuuccuauuuauuugaggucaguguuuguuuuugcacaccauuuuguaaaugaaacuuaagaa

SEQ ID NO: 193389 - RNA, 64 nt, Human
uucauauggauaugauuccagucaaaaauaaaaugcacaccaaaauguauacauguaguuggau

SEQ ID NO: 193390 - RNA, 64 nt, Human
aucaacuuuucugagcugguguaagccaguuccagcacaccauugcaugaauucacaaacaaau

SEQ ID NO: 193391 - RNA, 64 nt, Human
ucugaccucagcagagcuccugggccugcugccugcacaccacaucgccuaccuacaaugccaa

SEQ ID NO: 193392 - RNA, 64 nt, Human
uaccucagccucccaaguagcugggacuaugggugcacaccaccacgccuggcuaauuuuugua

SEQ ID NO: 193393 - RNA, 59 nt, Human
ccuccauaagcacaaauggaauugugcaaccaccagaaaaacacuacuguggcaaacug

SEQ ID NO: 193394 - RNA, 59 nt, Human
cacauaaacaaaaagcauggaaaauuuauccaccagaauuugcuguggagauacuuuuu

SEQ ID NO: 193395 - RNA, 59 nt, Human
gcuuaaacuucauuaccuucaugguaaauccaccagagggccgguuagaugcuggcccc

SEQ ID NO: 193396 - RNA, 59 nt, Human
caguccaugugauuucaguauauacaacuccaccagaccccuccaacccauauaacacc

SEQ ID NO: 193397 - RNA, 64 nt, Human
uaaauucucuuagccuacugauugguuuggaugagcacaccagcugcaggugugugcugaauug

SEQ ID NO: 193398 - RNA, 64 nt, Human
gacgaacaucugccccuucagggaggacccccgcgcacaccagaaccucuggcaagccgcccga

SEQ ID NO: 193399 - RNA, 64 nt, Human
gaugccacccugggcugcccuggcaccuagcaaggcacaccaagaacagcuuuugagucuguau

SEQ ID NO: 193400 - RNA, 64 nt, Human
ccaucuaagcccccaaguagcuaggacuacaggagcacaccaccacaccuggcuaauuuuugua

SEQ ID NO: 193401 - RNA, 64 nt, Human
ugugcugucagccucccacaggugguacagccgugcacaccagugucgugucugcuguuguggg

SEQ ID NO: 193402 - RNA, 64 nt, Human
gugccgagaugggacagcaaagaugaugggcucugcacaccaacuccaggaaacucauucuggg

SEQ ID NO: 193403 - RNA, 64 nt, Human
gaccucguuccaugacaucaggauagcuguguuugcacaccaugcuccauguucauucggagcc

SEQ ID NO: 193404 - RNA, 59 nt, Human
agauguacacgugcaagugagccccgugugcacaccacccucccgcugcaagucagauu

SEQ ID NO: 193405 - RNA, 64 nt, Human
gcugacagagaaaaaucgucaguugucagauuuugcacaccacaauaaauguaccaccacacac

SEQ ID NO: 193406 - RNA, 64 nt, Human
caggccuggcccacgcaucgacaugugugaauuugcacaccacugccugaauuggagcccccca

SEQ ID NO: 193407 - RNA, 64 nt, Human
ucggagucacuuaggaggcagcaugagaacaguggcacaccaccagugaggcacauguugccuu

SEQ ID NO: 193408 - RNA, 64 nt, Human
gguaggaggggcucccugauuccccuaaagcuaugcacaccacaaggggcucugcucuucuguc

SEQ ID NO: 193409 - RNA, 64 nt, Human
cccaccuggggggcuaguggaagcccuccugccugcacaccaugucugcaucuuggacgcccuc

SEQ ID NO: 193410 - RNA, 64 nt, Human
uugcaauagcucagauuuuucuuccuuuuucuuugcacaccagcucuacucuuuaguaaaauug

SEQ ID NO: 193411 - RNA, 64 nt, Human
uugcuuaagugucauacuuuacuggcuuugcccugcacaccaauauuccuuuuaaaccauaaau

SEQ ID NO: 193412 - RNA, 64 nt, Human
agagucucauguagcuggagacguuaagagcugagcacaccacaggaaaggagggaggaugcug

SEQ ID NO: 193413 - RNA, 59 nt, Human
agcaucuuucccacauucaauaugaagcaccaccagauggcuaccaaaugauaagaaca

SEQ ID NO: 193414 - RNA, 59 nt, Human
ugaacccuuuuaaugaagaccuaacuccuccaccagaaauuuaaguuuauguucuuacu

SEQ ID NO: 193415 - RNA, 59 nt, Human
agaaccagaguuggaaggcacuugacuggccaccagaccaacucugcuguuacugacau

SEQ ID NO: 193416 - RNA, 59 nt, Human
ccccuaaaauucucccuguagucaauguuccaccagaggagcggacagugaaauguaau

SEQ ID NO: 193417 - RNA, 64 nt, Human
ucccuguuuggaaaguuugccccagcuuucccgggcacaccaccuuuugucccaagugucugcc

SEQ ID NO: 193418 - RNA, 64 nt, Human
cgagaguaaaagacauguccucuucugaugcauggcacaccauagucaccaagcaaauaacaga

SEQ ID NO: 193419 - RNA, 64 nt, Human
cuaauauccuauugguaaaaauguagucacaugggcacaccaccuaucugcauggaaggcuggg

SEQ ID NO: 193420 - RNA, 64 nt, Human
guucagccauuuagcagcugaaaaaggaaacagugcacaccaaugggaggcagccugcguagcc

SEQ ID NO: 193421 - RNA, 64 nt, Human
uacuuuuccauaugguauaccuugaaaaaaauuagcacaccaugguuauuuuucuaccuuuuau

SEQ ID NO: 193422 - RNA, 64 nt, Human
uccuagcgccacugccaagcacaccucgcucccagcacaccacagcccgcgaccucagggcagg

SEQ ID NO: 193423 - RNA, 64 nt, Human
ggugaaucuggaagcaagaggaccugagccagaugcacaccaucucugauggccucccaaacca

SEQ ID NO: 193424 - RNA, 64 nt, Human
cacggccucgagaaaagagccaagcgcaucgggagcacaccagaaaccggcccugagcacgaga

SEQ ID NO: 193425 - RNA, 64 nt, Human
ugccucagccuucugaguagcugggacuacagaugcacaccaccacaccuggcuaauuuuugug

SEQ ID NO: 193426 - RNA, 64 nt, Human
ugcugcugauggauacuuuucccucacugccauggcacaccagucauggaucuuguaaucaugc

SEQ ID NO: 193427 - RNA, 64 nt, Human
ucuuccaccugugcccucaccaccacacuacacagcacaccagccgcugcagggcucccauggg

SEQ ID NO: 193428 - RNA, 64 nt, Human
ccaaagauggccccugacaccucccccagccccagcacaccagccugcaccucuuaucccgugu

SEQ ID NO: 193429 - RNA, 64 nt, Human
gugguccgaagaccuucauaccuagaccuguuccgcacaccacggcuccgacacaucucacugu

SEQ ID NO: 193430 - RNA, 55 nt, Human
ugcagagucuguuaaaguagauguugcacaccagccuuacagcugggagccuuug

SEQ ID NO: 193431 - RNA, 64 nt, Human
cuggccaucaccuuaaccaagugacaaaguccuagcacaccauuaaugguaggauaacugacau

SEQ ID NO: 193432 - RNA, 64 nt, Human
augaggaaaauguucugaaaauauggugaugguugcacaccauugugaauguacugaaugccau

SEQ ID NO: 193433 - RNA, 59 nt, Human
acccuccauccagaaaggcacccuucauuccaccagaacuuuacccaggaagaacacga

SEQ ID NO: 193434 - RNA, 59 nt, Human
acucaagugggaacgacugggcacugccaccaccagaaagcuguucgacgagacggucg

SEQ ID NO: 193435 - RNA, 59 nt, Human
cccuguggccuggacucuaggggaugccgccaccagaaaccccucugccaaucccuacc

SEQ ID NO: 193436 - RNA, 59 nt, Human
gccgcaagcacugucucaccaucccgcacccaccagacaacagccagggcuggagucca

SEQ ID NO: 193437 - RNA, 64 nt, Human
aguuuuuagguccugacacugacaucaaauacaugcacaccagaaaggcauuuccaccaccguc

SEQ ID NO: 193438 - RNA, 64 nt, Human
gagcuguguggccacccccccaaccuugcccccggcacaccaaaguguccacauuguaccaaag

SEQ ID NO: 193439 - RNA, 64 nt, Human
aguuuuauugaugcuugcugcagcaagagagacugcacaccacuggggucuaugggugcuucuc

SEQ ID NO: 193440 - RNA, 64 nt, Human
gguuuauuucucauacaguguauuggcaacuuuggcacaccagaauuuguaaacuccaccaguc

SEQ ID NO: 193441 - RNA, 64 nt, Human
gucacacccacccccugccugguucuaggcugcugcacaccaaggcccugcaucugucugcucu

SEQ ID NO: 193442 - RNA, 64 nt, Human
ggcucaagccucccgaauagcugggacuacaggcgcacaccaccauccccggcuaauuuuugua

SEQ ID NO: 193443 - RNA, 64 nt, Human
accaauuucaaauguaacccuccagugguggaaggcacaccauggcuuccucugcuugguuuga

SEQ ID NO: 193444 - RNA, 64 nt, Human
gccuggcuccucggaggaggcagaggccacgaaggcacaccacgcccuggagcagguaggcagc

SEQ ID NO: 193445 - RNA, 64 nt, Human
cauuaaaauuguuaccacugguaacaugugacaagcacaccacaauucucccuaucuugugaag

SEQ ID NO: 193446 - RNA, 64 nt, Human
uccuggaguucuucccauugagguccuaggauuugcacaccacugucccacaagagcuuuccug

SEQ ID NO: 193447 - RNA, 64 nt, Human
gagccagccccgcgugagaacgugcauaaugagugcacaccaucaugucaaggugcauacuuag

SEQ ID NO: 193448 - RNA, 64 nt, Human
ugggucuuugaguauuguaugaaagauccuucgugcacaccacacacagucaugauuuuguuaa

SEQ ID NO: 193449 - RNA, 64 nt, Human
cccggagccacagcacaaucaucucaguggcgaagcacaccacuugauucuauuuuuuuuuaac

SEQ ID NO: 193450 - RNA, 64 nt, Human
ugcugucugcugagaugccaggcuaguggagagggcacaccaugugcccaaauggugugaugcu

SEQ ID NO: 193451 - RNA, 64 nt, Human
gcacaaggggccaaggucagggagcaagaggugugcacaccaaagcuauuggagauuugcgugg

SEQ ID NO: 193452 - RNA, 64 nt, Human
cuucacuuaauccauuuagcacuauuuaaaauaagcacaccaaguuauaugacuaauauaacuu

SEQ ID NO: 193453 - RNA, 59 nt, Human
gucacucuccacccagccaguaccucgcgccaccagaacgcgccgcccgcgccggccuc

SEQ ID NO: 193454 - RNA, 59 nt, Human
aggcccuucuggggguuucuaucuuucuuccaccagacuccaagcccacucuccuccaa

SEQ ID NO: 193455 - RNA, 59 nt, Human
cucuuagucacacagcgaguaggccucuuccaccagaagcuguucgugcagcuggggag

SEQ ID NO: 193456 - RNA, 59 nt, Human
cagguuugcuuaguuuggggacaccguuaccaccagaauggcugcucugacaauaugcc

SEQ ID NO: 193457 - RNA, 64 nt, Human
gcaagucagaguggcuggcaggcacaaccuccuggcacaccagaggcaggucuucaauacccac

SEQ ID NO: 193458 - RNA, 64 nt, Human
gcacagcucacucauggggucugaggggagagaagcacaccaggggcgcccucugccuuccaua

SEQ ID NO: 193459 - RNA, 64 nt, Human
cuuucuaaacgcauuucaaaugucaaccaggaaggcacaccacuguauuaguuuuauacugccg

SEQ ID NO: 193460 - RNA, 64 nt, Human
cagcugcuccgugagcugagucucccacugcccugcacaccaccacauuggaccugugcugucc

SEQ ID NO: 193461 - RNA, 64 nt, Human
auggguuuuggugccugaaaaauuggccauggaggcacaccaaagcuucaagcacaagucuugu

SEQ ID NO: 193462 - RNA, 64 nt, Human
ucaagacucagcagcucucauucuccaguggugagcacaccauuugugcugcugcuguugucgu

SEQ ID NO: 193463 - RNA, 64 nt, Human
ugugcuguacagagagacgcguguggagagagccgcacaccagcgccacccaggaaaggcggag

SEQ ID NO: 193464 - RNA, 64 nt, Human
accugcuagaccgagggcacuuccugagcggcuggcacaccaucuaccugcccgacugccggcc

SEQ ID NO: 193465 - RNA, 64 nt, Human
ugacucagccucccgaguagcugggaguacaggugcacaccaccaugccuggcuaauuucugua

SEQ ID NO: 193466 - RNA, 64 nt, Human
uggcugugucguuuguguuguguguaugguacuagcacaccacugcaugucucuagaaugcugu

SEQ ID NO: 193467 - RNA, 64 nt, Human
accacaugggcauugcccagaauuacaggaguuagcacaccagcucuacagauaagaaaacauu

SEQ ID NO: 193468 - RNA, 64 nt, Human
uucuucucucuaaacagcaaagccaaagcacucugcacaccaaaucaccuguucagagguuuau

SEQ ID NO: 193469 - RNA, 64 nt, Human
ggcagagguugcagugagcugagaucuugccacugcacaccagccugggcaacacagcaagacu

SEQ ID NO: 193470 - RNA, 64 nt, Human
gcauuucaacagagcuaacaccaccuucagauaggcacaccaugcauaacucuugggaaguuga

SEQ ID NO: 193471 - RNA, 64 nt, Human
ggaccuaaacacaaugacaccucaguaacaguaagcacaccaacugccaaguuauuaguuccua

SEQ ID NO: 193472 - RNA, 64 nt, Human
gcaggcacgcucucgcguaguuaccuaucugaaugcacaccaagcacaugcgugcacacucugc

SEQ ID NO: 193473 - RNA, 59 nt, Human
auaccagacauuugagugaaauuuuggauccaccagaccagccaccagcuaaaugccag

SEQ ID NO: 193474 - RNA, 59 nt, Human
cuggaacccagccagugggagggccuggcccaccagaguccugcucccucacuccucgc

SEQ ID NO: 193475 - RNA, 59 nt, Human
cugacucgggagcagacggaacguuugucccaccagaucaccucccgcguggucucggc

SEQ ID NO: 193476 - RNA, 59 nt, Human
agggaauaaaagcuggcgagcgcggcaccccaccagagucugcuuccacgcugugggag

SEQ ID NO: 193477 - RNA, 64 nt, Human
uuuucccucagcaaccuguguguucaaagguuaggcacaccauugcuguuacuaaaauacaugc

SEQ ID NO: 193478 - RNA, 64 nt, Human
gccccacagagagcugauugugaaacaucuacuagcacaccacugccagacaugacugugugug

SEQ ID NO: 193479 - RNA, 64 nt, Human
ugccucagccucccuaguagcugggauuacaggugcacaccaccacaccuggcuaauuuuugua

SEQ ID NO: 193480 - RNA, 64 nt, Human
cucaguuuaagauagcagaucaucucagcaguaagcacaccaacagaacugaguuccagaaagg

SEQ ID NO: 193481 - RNA, 64 nt, Human
ccuuuccuuccaggcccuaagcacgugcagcaaagcacaccacagcaccuuugauaaccucucu

SEQ ID NO: 193482 - RNA, 64 nt, Human
aaggccccucgaggcagagacccuccgcccucuugcacaccagggccgcucgugggacuccaca

SEQ ID NO: 193483 - RNA, 64 nt, Human
ccacagguuuacacugccuucccagcaauuauaagcacaccagauucagggagacugaccacca

SEQ ID NO: 193484 - RNA, 64 nt, Human
ugccucagucuccugaguagcugggaucacaggugcacaccaccacgccuggcuaauuuuuuua

SEQ ID NO: 193485 - RNA, 64 nt, Human
gucacugaucggugggcgcuggggggguaggguagcacaccagcugucccaggcuuugcuccgg

SEQ ID NO: 193486 - RNA, 64 nt, Human
agugacuaauccagggccguggcauucccagacagcacaccacugugguccccuccacacucac

SEQ ID NO: 193487 - RNA, 64 nt, Human
aauauuuuugcuauucauggaguguaauauuuaugcacaccaucaaauaguuucuguacuuuuu

SEQ ID NO: 193488 - RNA, 62 nt, Human
accaggcagaugcucucuagccuggaucugaggcacaccagcagcaugacaaacucaugaaa

SEQ ID NO: 193489 - RNA, 64 nt, Human
agguugaggcugcagugagcuguguuucgccacugcacaccagccugggugacagugugagacc

SEQ ID NO: 193490 - RNA, 64 nt, Human
cagcagagggagggaucaggcagcaguguuuagagcacaccacacuggccacuguaaacugaga

SEQ ID NO: 193491 - RNA, 64 nt, Human
gguccaggccgcaaugagauguguuugugccauugcacaccagucugggugacagagaaagacc

SEQ ID NO: 193492 - RNA, 55 nt, Human
ccgccaaagccaagaaauagcccccgcacaccacccugugccccagaugauggau

SEQ ID NO: 193493 - RNA, 59 nt, Human
caucugcccauuucccaccuucccuucucccaccagaagcuugccugagcuguuuggac

SEQ ID NO: 193494 - RNA, 59 nt, Human
cucgcccugcuugcccugccgcaggccccccaccagaagccaucucccccgcugugugu

SEQ ID NO: 193495 - RNA, 59 nt, Human
cuuggaagcaacggggagcuuccauauucccaccagagugugggaaugcuguggccaug

SEQ ID NO: 193496 - RNA, 59 nt, Human
uagagcuuuuaaccaaacaacauugcagaccaccagaguccuuggacucccccuggguc

SEQ ID NO: 193497 - RNA, 64 nt, Human
uccucugaguccugcuguuuccuccagucucacugcacaccacugccucaugcuuccuggggcc

SEQ ID NO: 193498 - RNA, 64 nt, Human
cuauugcgauaauguaugugugcccucccugugggcacaccaccugggcauuaggacugaaauu

SEQ ID NO: 193499 - RNA, 64 nt, Human
ugcccguguauaugcacccacaccaugugcccgugcacaccagugacuacgcaguccccccuuu

SEQ ID NO: 193500 - RNA, 64 nt, Human
cugucuuucucagauauuccaggaaccuaagagcgcacaccagguggagcaggugcugcuggca

SEQ ID NO: 193501 - RNA, 64 nt, Human
uguguccacuuuuucuaaaguaaccccacccccagcacaccauuguuggcaccucucaagguug

SEQ ID NO: 193502 - RNA, 64 nt, Human
ugcccugaggguuuccuucggggaccagcccacagcacaccaagguggcccggaagaaccagaa

SEQ ID NO: 193503 - RNA, 64 nt, Human
cucucuacauacaucucucagguggugccaagaggcacaccagguagagcaaacuuagcagcuc

SEQ ID NO: 193504 - RNA, 64 nt, Human
ucucagagaaauaaaugcuuuguguaacaucugugcacaccauccauuccgcucgcugagcgau

SEQ ID NO: 193505 - RNA, 64 nt, Human
gaagagcugggggcggaugguggcccaggagacagcacaccaccaggcuccacacgugcaugcu

SEQ ID NO: 193506 - RNA, 64 nt, Human
uaaaaaucuauaaaggcauauuuuuagaaaaacagcacaccacugcuucuuuugaaaauagucu

SEQ ID NO: 193507 - RNA, 64 nt, Human
auauacuaacguaaaugacgaguuaaugggugcagcacaccaacauggcacauguauacauaug

SEQ ID NO: 193508 - RNA, 64 nt, Human
aagcaauuauuuucuuuagaggacuuuaucuauugcacaccacacuacaucuuugagcaagugc

SEQ ID NO: 193509 - RNA, 64 nt, Human
gcagaauggcaauaacccccaaaaggucaaaugggcacaccacaguucugcucuguggaucauc

SEQ ID NO: 193510 - RNA, 64 nt, Human
ggccuccucaaaagcagcagcaagucgucaagaagcacaccaauucuaacccacaagauuccau

SEQ ID NO: 193511 - RNA, 64 nt, Human
ucugugaucuuugcacagaugaauggaaguugaugcacaccaacaagaggcaacuugucacuuu

SEQ ID NO: 193512 - RNA, 64 nt, Human
agucuguacauaguguauauugcucuacccggccgcacaccacguccugcucuggcuuuugccu

SEQ ID NO: 193513 - RNA, 59 nt, Human
agccaccagugccccggcacccuuuaacaccaccagauggguguuuucccccauccacc

SEQ ID NO: 193514 - RNA, 59 nt, Human
gcauuacaggugugagccaccgugcccggccaccagaauccuuugguauagccaagccu

SEQ ID NO: 193515 - RNA, 59 nt, Human
acauccccucaggcugaagccccccacccccaccagagacacacugggaaccgucagag

SEQ ID NO: 193516 - RNA, 59 nt, Human
aggccuccauggagggagcugcuauguccccaccagauuggccccgugcggcugcuggc

SEQ ID NO: 193517 - RNA, 64 nt, Human
ugccucagccuccugaguagcugggacuacaugcgcacaccaccacguccggcuaauuuuugua

SEQ ID NO: 193518 - RNA, 64 nt, Human
ggucuguaaggccggaugaucuggauuucaguaggcacaccacuuacuggcuauuacuuaaucu

SEQ ID NO: 193519 - RNA, 64 nt, Human
auguaacaucuggcuuggagcaaguggguguucugcacaccaggcagcugcaccucacuggauc

SEQ ID NO: 193520 - RNA, 64 nt, Human
gcgcuggccaugccaggagagaacccacgcacaugcacaccacaacacacaacacaccucaccu

SEQ ID NO: 193521 - RNA, 64 nt, Human
ugccucagccuccugaguagcugggaauauaggugcacaccaccaugccuggcuaauuuuugua

SEQ ID NO: 193522 - RNA, 64 nt, Human
uaguccacuccagaaaucaugcucgcuucccuuggcacaccaguguucuccugccaaaugaccc

SEQ ID NO: 193523 - RNA, 64 nt, Human
uaaccccaaagccaucaugggagacauccagauggcacaccagaacuuaaugcuggaucccaug

SEQ ID NO: 193524 - RNA, 64 nt, Human
gcgcaacccugcugacuguuucaguuaauaugcugcacaccacacacuuguuuagugaaccaaa

SEQ ID NO: 193525 - RNA, 64 nt, Human
guugcccaggcuggugugcaauggcgugaucucggcacaccacaaccuucaccuccccgguuca

SEQ ID NO: 193526 - RNA, 64 nt, Human
ccugggaaugggggguacucacgcaccccgcuuugcacaccacagagugcccucacccacucca

SEQ ID NO: 193527 - RNA, 64 nt, Human
cagaauucauaugcugaagccucuguccacacaugcacaccagaugagggccaugugcgcacac

SEQ ID NO: 193528 - RNA, 64 nt, Human
ucccucacaugccccuucccuucuguugugggcugcacaccaaagccuccuccccuccccacuu

SEQ ID NO: 193529 - RNA, 64 nt, Human
cagacagcagcugucuggcccuugcugggugagggcacaccacugccaggggucagccucgcac

SEQ ID NO: 193530 - RNA, 64 nt, Human
guguucuucucuuaagaggcuuccagagaaaacggcacaccaaucaauaaagaacugagcagaa

SEQ ID NO: 193531 - RNA, 64 nt, Human
gcuuggucaggaggaugugcaccaucuugccuuugcacaccagucaccugaacaaggaaacuug

SEQ ID NO: 193532 - RNA, 64 nt, Human
guuuggggcuucaguggggagcugacagcugugagcacaccacuguccccucauccaccucggc

SEQ ID NO: 193533 - RNA, 59 nt, Human
uugaugggguccagagagccucccugcagccaccagacuuggccuccagcuguucuuag

SEQ ID NO: 193534 - RNA, 59 nt, Human
uauuuuauuauagaaaaaguauuuuuucuccaccagacaaauggaaaaaaagaggaaag

SEQ ID NO: 193535 - RNA, 59 nt, Human
agcugacccccaggaacagcuuggcuguuccaccagagcagagggaaucauugcuggac

SEQ ID NO: 193536 - RNA, 59 nt, Human
cauuucucacgugcacauuccccuaagagccaccagacugcuuccugccagccugugcu

SEQ ID NO: 193537 - RNA, 64 nt, Human
ugccucagccucccaaguagcugggauuacuggugcacaccaccacacucagcuaauuuuugca

SEQ ID NO: 193538 - RNA, 64 nt, Human
gacggagguugcagugagcugaaauccugccacugcacaccagccugggugacagagcgagacu

SEQ ID NO: 193539 - RNA, 64 nt, Human
cccuguuccuuucuugcacgcgcucccugccugggcacaccaaacugguugaaacacagcuuuc

SEQ ID NO: 193540 - RNA, 64 nt, Human
gcuuuucccugacucccuuugcuuggagucagcugcacaccaguaguauggcaugcuacgauca

SEQ ID NO: 193541 - RNA, 64 nt, Human
guuggauuuucuaugacagcacaggggacagguggcacaccaugagaggucugcccaggguggg

SEQ ID NO: 193542 - RNA, 64 nt, Human
uaagaaaaagguaagaacugucucaaaaacgaaagcacaccacccaagacacaguacccaguca

SEQ ID NO: 193543 - RNA, 64 nt, Human
gccaagcccacuccuugcagcauggguacugguggcacaccagacagugacacugccccacaaa

SEQ ID NO: 193544 - RNA, 64 nt, Human
ccgcacguagaucgcagcaggcgugauuacacaugcacaccaacaugcaugccgccggcacaug

SEQ ID NO: 193545 - RNA, 56 nt, Human
cugccgaguuuuucgguugaagugaugcacaccaccaacauucuuggcauuacgca

SEQ ID NO: 193546 - RNA, 64 nt, Human
cccucccuggucuugaaagaagacuaaucagugggcacaccaagggcccugaggggcagggaga

SEQ ID NO: 193547 - RNA, 64 nt, Human
aggagccucaucucuucugacgggaccugccacugcacaccagcccagcucccguguaaauaau

SEQ ID NO: 193548 - RNA, 64 nt, Human
auauuuggggaaggagggaggaaauaugucccuugcacaccaccccugaagcacauggcaguag

SEQ ID NO: 193549 - RNA, 64 nt, Human
gcugagggccaauacccuacuguggggagagauggcacaccagaugcuuuugugagaaagggau

SEQ ID NO: 193550 - RNA, 64 nt, Human
gcaccuuuccucuaauccagcaaagugauucccugcacaccagagacaagcagaguaacaggau

SEQ ID NO: 193551 - RNA, 64 nt, Human
gccccugaagcucuaugccaagaacacagcuaccgcacaccacccugaaacagccacagccaag

SEQ ID NO: 193552 - RNA, 64 nt, Human
gucaagugaggugacacuccaguugcagaccaucgcacaccaaauuuggcaaaacagcccucag

SEQ ID NO: 193553 - RNA, 59 nt, Human
gggagugaaaccaauucucagagaacaacccaccagagacuuuuaaagagaggccaggc

SEQ ID NO: 193554 - RNA, 59 nt, Human
ugggcagcagcaucugguugaccagauggccaccagaacccacuguucauucuuaucuu

SEQ ID NO: 193555 - RNA, 59 nt, Human
uggaacugcccacgucugcacagaacagaccaccagacgccagggcugauugguggggg

SEQ ID NO: 193556 - RNA, 59 nt, Human
aggauacacauggagaagacuguguggauccaccagaagauggccaucuacaagccaag

SEQ ID NO: 193557 - RNA, 64 nt, Human
uuuuugggggacuuugacagccauaucccucccagcacaccaggcgccaggugagcugguucag

SEQ ID NO: 193558 - RNA, 64 nt, Human
agaguagucagugaagagaguagaucacacuugggcacaccaggauucacauaaacauuguauc

SEQ ID NO: 193559 - RNA, 64 nt, Human
gcucucaccaccauggcgucacuccgcgaccacagcacaccagaaacacucagcauuauggaug

SEQ ID NO: 193560 - RNA, 64 nt, Human
ugugcuauaaagauaaaggugaggggaagacaaagcacaccauauguccacuguucuguucuca

SEQ ID NO: 193561 - RNA, 64 nt, Human
uccccgaccaugagagccccuggcccuggccccugcacaccaguaggcccagaauaaccgccac

SEQ ID NO: 193562 - RNA, 64 nt, Human
ugccucagccucuugaguagcugggacuacaggcgcacaccaccacgccaggcuaauuuuugua

SEQ ID NO: 193563 - RNA, 64 nt, Human
ugaacggcacagggaccccucgaggaacaagguugcacaccagcuuucagccaccaugacugug

SEQ ID NO: 193564 - RNA, 64 nt, Human
ccugcccacccggguuccgcacuguccgaccccugcacaccacucaugucaccacggcgugcau

SEQ ID NO: 193565 - RNA, 64 nt, Human
agccccacucuaaggggagcagggggaccugacagcacaccacugucuuccccagucagcuccc

SEQ ID NO: 193566 - RNA, 64 nt, Human
uuaaaaauaaaaaugauuggccgagcaugguggugcacaccaguauucccagcuacucuggagg

SEQ ID NO: 193567 - RNA, 64 nt, Human
cauagagauucacagcccagagcaggaggacgcugcacaccaugcaggaugacaugggggaugc

SEQ ID NO: 193568 - RNA, 64 nt, Human
uuugucuugugcuggugggcaagggguuugucuagcacaccagcauauaaugagaugcuugaug

SEQ ID NO: 193569 - RNA, 64 nt, Human
cucccccuaauguaaaugacgaguuaauggugcagcacaccaacauggcacauguauacauaug

SEQ ID NO: 193570 - RNA, 64 nt, Human
ccauuucacauuucaccccuaccaccuggcaggugcacaccaugugcaugagucacuuccccac

SEQ ID NO: 193571 - RNA, 64 nt, Human
cgaccgggagcacauagcggccgggagcccggcugcacaccaggcugcugcuuuguccgucuau

SEQ ID NO: 193572 - RNA, 64 nt, Human
caggaggagagcagugaugcggauggguacccgggcacaccagcccucagagaccugagcucuu

SEQ ID NO: 193573 - RNA, 59 nt, Human
aagaucccugaccccagcuuuagcuuucuccaccagauaaccagcuaaucccaggaauu

SEQ ID NO: 193574 - RNA, 59 nt, Human
ucuuggccggcuggagcaagaccuggcucccaccagagggacgugugugugccugcaga

SEQ ID NO: 193575 - RNA, 59 nt, Human
cucuaagcgcugagcauugggccccuuccccaccagaccuuuguagcuccuccagccuc

SEQ ID NO: 193576 - RNA, 59 nt, Human
cagagcucuguguauacacagcuucacacccaccagauuguuacuacaguggguugggu

SEQ ID NO: 193577 - RNA, 64 nt, Human
ggaacugaccaccuagguggcugccacccccucugcacaccauggacccugcccugcgcucccc

SEQ ID NO: 193578 - RNA, 64 nt, Human
ggcauggcacagcaccacugccaggccuccccaggcacaccacucugcccagggaaugggggcu

SEQ ID NO: 193579 - RNA, 64 nt, Human
ugccucagccuacugaguagcugagauuacaggugcacaccaccacguccggcugacuuuugua

SEQ ID NO: 193580 - RNA, 64 nt, Human
uuguaacaaggcuuuugggagugauucacaccuggcacaccauacuagaauucacacuggagag

SEQ ID NO: 193581 - RNA, 64 nt, Human
gccagggacucucccacgcacgagcuagugaguggcacaccagagccaucugcagggaagggcg

SEQ ID NO: 193582 - RNA, 64 nt, Human
caguacaauucuuuguugcuuaaucuagagcuaugcacaccaaauugcugagauguuuaguagc

SEQ ID NO: 193583 - RNA, 64 nt, Human
gagaacuauuuaaagacgcaaucccagguuccuugcacaccauggcagccucuccuugcaccuu

SEQ ID NO: 193584 - RNA, 64 nt, Human
uuuuuucacuuuagcuauguggauuagcuagaaugcacaccaaaaaaauacuugagcuguauau

SEQ ID NO: 193585 - RNA, 64 nt, Human
aaugcucugcagccucucugcucuuugagaaagggcacaccaugcgcucggcaaccauucaaau

SEQ ID NO: 193586 - RNA, 64 nt, Human
gcgugcucauuucaugcuggguaugacgccgagcgcacaccacuggcgugagacagcgcuuggu

SEQ ID NO: 193587 - RNA, 64 nt, Human
ucauuugucaccauuuuuaaaacucuguaugcuagcacaccaaacucuugucuauauuuaccuu

SEQ ID NO: 193588 - RNA, 64 nt, Human
uccaugaacgccucuaguagcaaaccauucuuuugcacaccacaauguuucccucagugcccuu

SEQ ID NO: 193589 - RNA, 64 nt, Human
uuaaaaauaucaaauuaauugugugaacuuggaagcacaccaaucuuacuuuguaaauucugau

SEQ ID NO: 193590 - RNA, 64 nt, Human
ugggucccucuccugcuggguggugcuuucucuugcacaccacucccaccacggggggagagcc

SEQ ID NO: 193591 - RNA, 64 nt, Human
agcuccccaacuuggacccccaccuuguggcucugcacaccaaggagcccccucccagacagga

SEQ ID NO: 193592 - RNA, 64 nt, Human
ugccucagcuucccaaguagcugagauuacaggcgcacaccaccacgcccaacugauuuuugua

SEQ ID NO: 193593 - RNA, 59 nt, Human
ucuguuuugucuucuaguucgcucuccagccaccagagcagccucucugcacaugcagc

SEQ ID NO: 193594 - RNA, 59 nt, Human
agucccaugaagucucaccuuguugacuuccaccagaacaaaaccuguuaauucagcuu

SEQ ID NO: 193595 - RNA, 59 nt, Human
acuugugauuauguuuuuaacuaaauuuaccaccagauacaaacaauacuucuuacaca

SEQ ID NO: 193596 - RNA, 59 nt, Human
auucuaagacccaagguuuggaucugcuaccaccagacuccuaacauagaaaacuugaa

SEQ ID NO: 193597 - RNA, 64 nt, Human
caccucagccucccgaguagcugggacuacaggugcacaccaccacaccuggcuaauuuuuugu

SEQ ID NO: 193598 - RNA, 64 nt, Human
gagaaucaaggccguguccccuuguucuaaugcugcacaccaguuacuguucauggcacccggg

SEQ ID NO: 193599 - RNA, 64 nt, Human
uggguuuguuuugguggaaaacaucacaaaccuggcacaccauuugaauaucccuaauaucauu

SEQ ID NO: 193600 - RNA, 64 nt, Human
ccucagccucccaaguagcugggacugcaggcgcgcacaccacgcccagcuaauuuuuguauuu

SEQ ID NO: 193601 - RNA, 64 nt, Human
cacuagagguaugucugccccucgucacccugcugcacaccaaucuguggcccuucaucaugcu

SEQ ID NO: 193602 - RNA, 64 nt, Human
gcaguccccacucuugaggcuuaaggcgcauguggcacaccacuccuuccagcaguagucgcuu

SEQ ID NO: 193603 - RNA, 64 nt, Human
ugaagacguggacuccucuugguggguguggccagcacaccaaguggcugggugcccucucagg

SEQ ID NO: 193604 - RNA, 64 nt, Human
agggauggaaaaggauucuucacagagcacucuggcacaccauaucggagaaaacuugauagau

SEQ ID NO: 193605 - RNA, 64 nt, Human
gagcggggaacgcgacguaccccagugcgccucggcacaccauugcuccccgaaacuggggugu

SEQ ID NO: 193606 - RNA, 64 nt, Human
auggaaauagaaugaauagaggggcauucacaaggcacaccagugcaagcagaugacaaaaagg

SEQ ID NO: 193607 - RNA, 64 nt, Human
ccauggacagccguuuucagagccuccagcauuugcacaccacuacucacccucucugcugcug

SEQ ID NO: 193608 - RNA, 64 nt, Human
caaugaugaguggacauguggucaauuaucuacugcacaccaacuguuuauagaauacacaaaa

SEQ ID NO: 193609 - RNA, 64 nt, Human
cugcuucagccuccagagaguugggaccauaggugcacaccaccacaccuagcuaauuuuuugg

SEQ ID NO: 193610 - RNA, 64 nt, Human
aguucaccaugauucucuucugucaccucugcuggcacaccaguggcaaggcccagaauggcga

SEQ ID NO: 193611 - RNA, 64 nt, Human
ggcggagguuguagugagccaagaucgcaccauugcacaccaaccugcgugacagagcaagauu

SEQ ID NO: 193612 - RNA, 64 nt, Human
cccgcuuugccccuggaggagccacuauuccagaaggcuccacccugccguccugcgggagccu

SEQ ID NO: 193613 - RNA, 59 nt, Human
ucccagcgcugcuguugcaccugugagccccaccagacucauuuguaaauagcgcuccu

SEQ ID NO: 193614 - RNA, 59 nt, Human
ucggugcuggaguggacguuaauugucagccaccagacugucccggcaccuacagagaa

SEQ ID NO: 193615 - RNA, 59 nt, Human
gaugagucugguuaagcgaggucagacauccaccagaaucaacucagccucaggcaucc

SEQ ID NO: 193616 - RNA, 59 nt, Human
acccagaguauuucugagccaugaggggcccaccagauugguucugaauuggauucaug

SEQ ID NO: 193617 - RNA, 64 nt, Human
gcgagcccaguuguccucgcccacaggguccugcaggcuccaucagucaccgcuuucuauggcg

SEQ ID NO: 193618 - RNA, 64 nt, Human
agguugggggcagaggcccaucuggccugaacugaggcuccagcaucuagugguggaccggccg

SEQ ID NO: 193619 - RNA, 64 nt, Human
ugcugcuuggugggugcucaucgcaauguucugaaggcuccagggccacuuuguuuguaaguau

SEQ ID NO: 193620 - RNA, 64 nt, Human
caggccccugaacgauaagcaccaagagaccccaaggcuccagauggaacacugagggugaccg

SEQ ID NO: 193621 - RNA, 64 nt, Human
uguacgacuaccuguugggaaggacaaagggaugaggcuccagagagaguuggcugccacagcc

SEQ ID NO: 193622 - RNA, 64 nt, Human
aagcuuuucuccuccucuugcagggcauggggccaggcuccacucccaaaugagacuggccccc

SEQ ID NO: 193623 - RNA, 64 nt, Human
ucagcaucucggaugaaagggcucccuuguccucaggcuccacgggagcggggcugcuggagag

SEQ ID NO: 193624 - RNA, 64 nt, Human
auugugcccgaugucuggcuccccugcaggagggaggcuccaggguaagacagggcuggcagga

SEQ ID NO: 193625 - RNA, 64 nt, Human
gggagggggugguuaucgccccaagaugggguccaggcuccauccuuccucugugcagauaaua

SEQ ID NO: 193626 - RNA, 64 nt, Human
agaccuugggccggcacgcgugacacggcacuucaggcuccacgcacagaaucucgcagauagu

SEQ ID NO: 193627 - RNA, 64 nt, Human
cucggggaacacauuccgggagagaugccuggccaggcuccacggaucccgccagaaacaccaa

SEQ ID NO: 193628 - RNA, 64 nt, Human
ugaugggagaaccaguuacuaccuucucuaacacaggcuccauccuaucucuucaucucuucuu

SEQ ID NO: 193629 - RNA, 64 nt, Human
cccaggugggugugagagagaccucauucucugcaggcuccagcguggccacagcuaaggccca

SEQ ID NO: 193630 - RNA, 64 nt, Human
cagcuuagacuugggcugcuccuucuagcaaagcaggcuccaguggggccucaucauacaggau

SEQ ID NO: 193631 - RNA, 64 nt, Human
ccacacugaggccaaaguggcaaccugggaaugaaggcuccauaaaccauggcauguuggguuu

SEQ ID NO: 193632 - RNA, 64 nt, Human
caucagagucaucagcaaacuguccaaguaggcuaggcuccagauuuaugaggaaagaaaggga

SEQ ID NO: 193633 - RNA, 59 nt, Human
ccugugaccagcagcugaugccuccuuggccaccagaccaugggccaagagccgccgug

SEQ ID NO: 193634 - RNA, 59 nt, Human
ccgggucugcaccuccagagcccacccuaccaccagacacagagccuggaccaccugga

SEQ ID NO: 193635 - RNA, 59 nt, Human
caauuucaggcagguguaacaguuccuuuccaccagauuuaauauuuuuauacuuccug

SEQ ID NO: 193636 - RNA, 64 nt, Human
ucuuggggccccuuuggcucucccucacucucugaggcuccagcugguccugggacaugcagcc

SEQ ID NO: 193637 - RNA, 64 nt, Human
ggcuccuuccuguggguggggcuucucugggaccaggcuccaauggggcggggcuucucuccgc

SEQ ID NO: 193638 - RNA, 64 nt, Human
cuacgugguggccgguagaauucuccaucuauccaggcuccaggagaccccugggcaucuccca

SEQ ID NO: 193639 - RNA, 64 nt, Human
auugaaccaccuucuuuccuggggcaagagcaccaggcuccagggcacucggaggcuggugggg

SEQ ID NO: 193640 - RNA, 64 nt, Human
agcaauacuaagggcuuccucaugggagggcaugaggcuccacucauugucuugugacuuccau

SEQ ID NO: 193641 - RNA, 64 nt, Human
ugucacagggccaaauugggucuguccauuccugaggcuccagaucccauaaagggggucucuu

SEQ ID NO: 193642 - RNA, 64 nt, Human
uccuuuucccugcaauggguuuuugguaugaaaaaggcuccaguaaauggagccaagucuuggu

SEQ ID NO: 193643 - RNA, 64 nt, Human
augcacauucgaaucaccugggggcacaaugccuaggcuccaaccccagacacucuuauuucau

SEQ ID NO: 193644 - RNA, 64 nt, Human
uucugcuggccuggaucuccccacucuaggggucaggcuccauuaggauuugccccuucccauc

SEQ ID NO: 193645 - RNA, 64 nt, Human
ccguucagcgucacaucugcaguggagccugaaaaggcuccacauuaggucaccugugcacagc

SEQ ID NO: 193646 - RNA, 64 nt, Human
agccugaagggugccuaguugacuuacugacaaaaggcuccaguugggcugaacaugugugugg

SEQ ID NO: 193647 - RNA, 64 nt, Human
caagagcaagaaacaaaaagaagccaaaagcagaaggcuccaauaugaacaagauaaaucuauc

SEQ ID NO: 193648 - RNA, 64 nt, Human
cuccucaagaagcagaggccuccucuggagugagaggcuccacccacuacagcacaggcgggaa

SEQ ID NO: 193649 - RNA, 64 nt, Human
ugaguauacaaguauaucuccucuuuugcuauggaggcuccauguucaaggcaauggcuuuuua

SEQ ID NO: 193650 - RNA, 64 nt, Human
acagaaccaguguuaauuugaagggccuccacucaggcuccaaauguggcagccaaagagaaca

SEQ ID NO: 193651 - RNA, 64 nt, Human
gcaguggccuggaugcacagugccugaugggaguaggcuccagacaggaggagugggacagaca

SEQ ID NO: 193652 - RNA, 59 nt, Human
cucaacauaaccacaggccaauuuguuggccaccagaaaaccgcuuuuuaaaaaaacac

SEQ ID NO: 193653 - RNA, 59 nt, Human
ccuguuucuggugccucccauccccagacccaccagacaccacacagcagacaauacac

SEQ ID NO: 193654 - RNA, 59 nt, Human
ggccuagggcuguaucucucccugggcugccaccagagaaggugcuugguguucgccug

SEQ ID NO: 193655 - RNA, 64 nt, Human
ccuuaaacaauugacccucugucaggcauaugucaggcuccacucuuaaggagucagugaccau

SEQ ID NO: 193656 - RNA, 64 nt, Human
aaguauauuuuucaauuccagauuuuuaauuuuaaggcuccaggaaagaaaggagaguagaaca

SEQ ID NO: 193657 - RNA, 64 nt, Human
ccuccccugcggagcugcauggacgccuggcuccaggcuccaggcugacugggggccucugccu

SEQ ID NO: 193658 - RNA, 64 nt, Human
ugaacucacccccaugauccaaucaccucccaccaggcuccaccucgaauacuggggauuacca

SEQ ID NO: 193659 - RNA, 64 nt, Human
agaguguuguuugaauuuugagccuccagguuagaggcuccaagcagacaaagaagaaaguuug

SEQ ID NO: 193660 - RNA, 64 nt, Human
aauucaguuaagguguuacuuaauaauaguuuuuaggcuccaugaauuggcuccuguaaauacu

SEQ ID NO: 193661 - RNA, 64 nt, Human
guggggugagggcuugaggacuugggcgggacacaggcuccaaacuggagcuugaaauaguguc

SEQ ID NO: 193662 - RNA, 64 nt, Human
agcugagucuccgccuugcuggggcuuguccuagaggcuccagcucuggcacagugguuccugg

SEQ ID NO: 193663 - RNA, 64 nt, Human
ccaccuggcugaggcgccacccuucuucaggcccaggcuccagaggaagacuccugaaacccuc

SEQ ID NO: 193664 - RNA, 64 nt, Human
ccauacucccugccuccuuucuucugccuaccagaggcuccagaguugagcuuguccuuaucua

SEQ ID NO: 193665 - RNA, 64 nt, Human
agggcuucacccucaugaccuaaacaucuccauuaggcuccaccuuccaaugcaacaguuagca

SEQ ID NO: 193666 - RNA, 64 nt, Human
cuaggaauggaggaggggagacuuucaaugguuaaggcuccauuucucauuuucccaacuuuua

SEQ ID NO: 193667 - RNA, 64 nt, Human
uucuccacuugguuuggaaaaucacacaguuuucaggcuccaucuguuuggagaaaauacauuc

SEQ ID NO: 193668 - RNA, 64 nt, Human
ugucucagauuuagcuuguguguguuuuggacagaggcuccacagcgguggcucuugaggaauc

SEQ ID NO: 193669 - RNA, 64 nt, Human
ugucaacuacaugagcuuuggcauggggauagagaggcuccaucuaggcucugccaacucaugu

SEQ ID NO: 193670 - RNA, 64 nt, Human
agaaguggauauugaaguuuugacaucaaugaugaggcuccaguugucuauucauugacugaug

SEQ ID NO: 193671 - RNA, 59 nt, Human
gcagccgggcccagcucuucuguccuuggccaccagagacugcagcccacaacccuugg

SEQ ID NO: 193672 - RNA, 59 nt, Human
ugcacugguuagcaaccccaauacagagaccaccagaucagguauagacuccugaaaga

SEQ ID NO: 193673 - RNA, 59 nt, Human
ccugccaucuacaggcuugucacaucucaccaccagaaacaggcuuccucaggcuucuc

SEQ ID NO: 193674 - RNA, 64 nt, Human
gagaaauugaaagggaaaaaagacaaaaagcauaaggcuccaaaacgaaagcaagcauuucacu

SEQ ID NO: 193675 - RNA, 64 nt, Human
ugacauggaacuguuuucugguccacaugaacacaggcuccauccaggcccagcuccuacccac

SEQ ID NO: 193676 - RNA, 64 nt, Human
cugcuuugcuuggcacaaaauaaauguaaccuggaggcuccaaguauucacacauugguguggu

SEQ ID NO: 193677 - RNA, 64 nt, Human
gaguagcugauauugacauaucugaggagggaggaggcuccaauacgacuacucccaauucaca

SEQ ID NO: 193678 - RNA, 64 nt, Human
cuucggucucagucuggcaagacgcugggucuucaggcuccaugccaacagagccccuggugca

SEQ ID NO: 193679 - RNA, 64 nt, Human
auauaugcauauauauauauguggcucuagccucaggcuccagccccagugggguacuguacag

SEQ ID NO: 193680 - RNA, 64 nt, Human
gcuuauaucgcauugcucauuuagaguuugcaggaggcuccauacuagguucagucugaaagaa

SEQ ID NO: 193681 - RNA, 64 nt, Human
ccauuucaagcuucuagaggcuggcugcauucccaggcuccaguggcuggucaagcuuuucuca

SEQ ID NO: 193682 - RNA, 64 nt, Human
gggugccccagcucuaccugguguggcagggcugaggcuccaugugcaucugugagcaugcgug

SEQ ID NO: 193683 - RNA, 58 nt, Human
cuccacugagccacauuuaaggccacagaggcuccaauaccugggaauguucacaaag

SEQ ID NO: 193684 - RNA, 64 nt, Human
cccuccgggccuuuacgcuggacucuggcuuggcaggcuccaggcaggguccucugggaaguua

SEQ ID NO: 193685 - RNA, 64 nt, Human
ccccaaagucugccaaaggcagugcaaagaaggaaggcuccaaacggaaaaucaacaugagugg

SEQ ID NO: 193686 - RNA, 64 nt, Human
ccuguggcaggccugggcccucaggauguuucaaaggcuccacagcuccaccgcuccaccuggc

SEQ ID NO: 193687 - RNA, 64 nt, Human
gaaauccagauguucauauuagacucgaaaaaauaggcuccaggccuaggugcccaggcuauga

SEQ ID NO: 193688 - RNA, 64 nt, Human
caaggacucugugcaucuugacugcaccccaaagaggcuccaggaucaggagugaaagauuuua

SEQ ID NO: 193689 - RNA, 64 nt, Human
cagcagguuggguucuagggcugaaccaggcgccaggcuccagaggacgaagggacucuguugc

SEQ ID NO: 193690 - RNA, 59 nt, Human
gaguggacuuagggcugggcaggcaguagccaccagagggcagcagcgaacuaggccag

SEQ ID NO: 193691 - RNA, 59 nt, Human
uugggcuucaagcaauccuccugugucagccaccagaguagcugagacuacagggguau

SEQ ID NO: 193692 - RNA, 59 nt, Human
ucccuggacagugacagauuuuaagccagccaccagaauucuuuucgaguuaaccauuu

SEQ ID NO: 193693 - RNA, 64 nt, Human
gcuggcccugggacccccaggaacgcuaagacacaggcuccaguaggggcuguugccuccaaua

SEQ ID NO: 193694 - RNA, 64 nt, Human
gaucuuauauucuagggaaaugcuuuaaauggucaggcuccagucggaauuuuuuuaagaaaaa

SEQ ID NO: 193695 - RNA, 64 nt, Human
ccgaagauguuuacuacaaaagcaugccaaaccuaggcuccagaaaccacguccaucagcugca

SEQ ID NO: 193696 - RNA, 64 nt, Human
cucugaugcaauguaaaacauguauuagacauucaggcuccacaauaaauuuuaaugagcacua

SEQ ID NO: 193697 - RNA, 64 nt, Human
aauugguacuuuaauuacuuguguguuugcaaauaggcuccauuuuccauguugaguagauuau

SEQ ID NO: 193698 - RNA, 64 nt, Human
agccuccuccuccugcaggauaaagucauccccaaggcuccagcuacucuaaauuaugucuccu

SEQ ID NO: 193699 - RNA, 64 nt, Human
ucugcccagaguggccucagcugcacgacuccagaggcuccacgacugagcucugaggccagug

SEQ ID NO: 193700 - RNA, 64 nt, Human
caggaagagaaggagcagagcugauggagaaggaaggcuccaucuccagugggaacucuucaag

SEQ ID NO: 193701 - RNA, 64 nt, Human
uugcaaagggagaaaaugaaggccaaacagaagcaggcuccagcuucugcaaaaacuuggauuc

SEQ ID NO: 193702 - RNA, 64 nt, Human
uauauucccacauaacuagacguucaaacaggccaggcuccagcacuucaguacgucaccaggg

SEQ ID NO: 193703 - RNA, 64 nt, Human
aucaguucacaacagccauuuguuuucaaggucaaggcuccaggcagguuguuacugguguuug

SEQ ID NO: 193704 - RNA, 64 nt, Human
cggaggccagagcugagcccucagcccgggaggcaggcuccaggccucagcaggugcggagccg

SEQ ID NO: 193705 - RNA, 64 nt, Human
ggcucagaccagcccacuguagagaaucacucugaggcuccaacuuccuuccuuccuucggggc

SEQ ID NO: 193706 - RNA, 64 nt, Human
caagacccagggagaacccacugcuuuucccaggaggcuccaggauuaggaaauguguguauuu

SEQ ID NO: 193707 - RNA, 64 nt, Human
gguggguauggugugugcuuggaugggaaagaaaaggcuccacucaccuauaggagauuauuuu

SEQ ID NO: 193708 - RNA, 64 nt, Human
cagcaccuaaguccucauugaauguucugguucaaggcuccaccucagaaauucugaaaugggu

SEQ ID NO: 193709 - RNA, 59 nt, Human
guaacuguuuugguuguguucuaucaaccccaccagaguucccuaaacuugcuucaguu

SEQ ID NO: 193710 - RNA, 59 nt, Human
gacaaauacagaaaugacccauucccugcccaccagaaacucagaggugauuggggaga

SEQ ID NO: 193711 - RNA, 59 nt, Human
ucauagcucucugcuuugggcucugcaggccaccagauacacaugaggccccuacuucu

SEQ ID NO: 193712 - RNA, 64 nt, Human
aaauuguauuccuuauugugaaauuaauacccucaggcuccauuuuacugcuuugcucuuuguc

SEQ ID NO: 193713 - RNA, 64 nt, Human
caagccccaaaugguugggggaggggccuagacaaggcuccaggccccaccuccuccuccauac

SEQ ID NO: 193714 - RNA, 64 nt, Human
uuuuaaucaguuguuuaauaauuuacagguucuuaggcuccauccuguuuguaugaaauuauaa

SEQ ID NO: 193715 - RNA, 64 nt, Human
gacauucagaaaacuucaagacaucaccaucagcaggcuccaguugaacacuagucuguguaac

SEQ ID NO: 193716 - RNA, 64 nt, Human
agugaauucuaaggaacucagggggcacguggucaggcuccaccgcacagaagagccacagucu

SEQ ID NO: 193717 - RNA, 64 nt, Human
ggcacggcaagcccagcaucgccucagcccagacaggcuccaccaggagaucaagcaagggcug

SEQ ID NO: 193718 - RNA, 64 nt, Human
uuaacauuaggaaucucagugcagagguccucagaggcuccagcaucucuaguacuaccugaag

SEQ ID NO: 193719 - RNA, 64 nt, Human
gacgugcagggcucagcccagggcauccaggaacaggcuccagggcaggaaccugggcccagga

SEQ ID NO: 193720 - RNA, 64 nt, Human
ugcauuucuaacacauucucagcugaugcaguccaggcuccaugcuuugaaaaccacuggucua

SEQ ID NO: 193721 - RNA, 64 nt, Human
cuggcuggacuccuguuuacuucuagaccuggucaggcuccauccccucccccaccugccccug

SEQ ID NO: 193722 - RNA, 64 nt, Human
ccccguuccugacaucacagcagccuccaacacaaggcuccaagaccuaggcucauggacgaga

SEQ ID NO: 193723 - RNA, 64 nt, Human
cagucccugaacugagcuguuuacaggacuggggaggcuccacccagaaggcuuucauuuguac

SEQ ID NO: 193724 - RNA, 64 nt, Human
uuucuaugugauuuucaaucauagcaagcaagaaaggcuccagugucaagguaguucagcucuu

SEQ ID NO: 193725 - RNA, 64 nt, Human
uuggcuccuacagcccaaaagggagaauggagggaggcuccaggcuuugcuggaggggccuggg

SEQ ID NO: 193726 - RNA, 64 nt, Human
ugcaggcucccuugggaaagcccugcuuugcuccaggcuccaagaucuccuggcuaagucagca

SEQ ID NO: 193727 - RNA, 64 nt, Human
uccccauuuuucaggugaggaaaugcuucagaugaggcuccaccuuguuaaauaaauuggaugu

SEQ ID NO: 193728 - RNA, 59 nt, Human
ccacguaaucauuuucuuagacguuugcuccaccagauuuaaccaaauguaacucccac

SEQ ID NO: 193729 - RNA, 59 nt, Human
gugaaagcugcucagcaacaaacguacuuccaccagauguguccccagauccacagcag

SEQ ID NO: 193730 - RNA, 59 nt, Human
acacuaagaccccagacccaaagccaaguccaccagaguggcugcaggccaggccugga

SEQ ID NO: 193731 - RNA, 64 nt, Human
uggccuggaucugcugcaguguccuuuccuguggaggcuccacucaaagcuggcauccuccuau

SEQ ID NO: 193732 - RNA, 64 nt, Human
acacacacauaagcacugaaaucacuuuaccugcaggcuccaugcaccucccuucccucccuga

SEQ ID NO: 193733 - RNA, 64 nt, Human
ccuucagagaagcagccucaaauuccagaaguggaggcuccagccuccccgcgaggguccagcc

SEQ ID NO: 193734 - RNA, 64 nt, Human
cagcagcacaguguguggcauuuacaugguacccaggcuccacagaguaccaagauguugcccu

SEQ ID NO: 193735 - RNA, 64 nt, Human
aucacuuuaguauucugcaguucucagcuuggugaggcuccaaaagagaauaugucagauguau

SEQ ID NO: 193736 - RNA, 64 nt, Human
gcuggccccguggugaggccauguucucauaaucaggcuccagccagaaaaauaagaaacaccg

SEQ ID NO: 193737 - RNA, 64 nt, Human
ucccgccagcuccucagccugcucccugggaggcaggcuccagaagcaccccgacggggggccu

SEQ ID NO: 193738 - RNA, 64 nt, Human
gagcguaggucucuggguuucagaugaagugcccaggcuccaggaaguugagggacccacagga

SEQ ID NO: 193739 - RNA, 64 nt, Human
ccaccuuuagaggaauuucgucagaaaaauguggaggcuccauauuaaugcauuauuuuuuaaa

SEQ ID NO: 193740 - RNA, 64 nt, Human
uuucuuacccuggugagaaaagcacaagcgguguaggcuccaaugcugcuuucccaggagggug

SEQ ID NO: 193741 - RNA, 64 nt, Human
ccugauucauggaugcaucucaauauagggacauaggcuccaucuauuuuguggcucugccacc

SEQ ID NO: 193742 - RNA, 64 nt, Human
ucccguugggccaggccagcccagcccagagcacaggcuccagcaauaugucugcauugaaaag

SEQ ID NO: 193743 - RNA, 64 nt, Human
ucagaaaacuucauguugucagaaaaacagcugcaggcuccaaagacagccuaaccucucaacu

SEQ ID NO: 193744 - RNA, 64 nt, Human
ucguggauccuuuacauuuagcaacaacagugugaggcuccacuucuguugaauaugagcggcu

SEQ ID NO: 193745 - RNA, 64 nt, Human
ccagaacauuuacccagguauauguuacuaaaacaggcuccaccucaguuuaucaacauuauaa

SEQ ID NO: 193746 - RNA, 53 nt, Human
gcacaccgccuugcacauagcagaggcuccaggcugacuccuuccugguggga

SEQ ID NO: 193747 - RNA, 59 nt, Human
gccgagcgaauagcaucuccucccaccucccaccagagacguccuguuugagcugucag

SEQ ID NO: 193748 - RNA, 59 nt, Human
ucccagggguccaccucccuuuauaaaccccaccagaaccacaucauuaaaagguuuga

SEQ ID NO: 193749 - RNA, 59 nt, Human
agagcuuggugaaggugucuccaucaccaccaccagagccuccugcccagcccuggcca

SEQ ID NO: 193750 - RNA, 64 nt, Human
aucuuuguacacuuugucucacagaauaguucugaggcuccaugacaggguuuugucauuguug

SEQ ID NO: 193751 - RNA, 64 nt, Human
cagaacucucccugcuggacucaccugaggaaagaggcuccagcauggggugggucagagaugu

SEQ ID NO: 193752 - RNA, 64 nt, Human
aaucaccccuacuagcagcacgacugagggcaggaggcuccauccuucuccccaaggucugugg

SEQ ID NO: 193753 - RNA, 64 nt, Human
ucaggagcccagcagugacacacuuaucacgccuaggcuccaguuugcaaaaauugcaccuuau

SEQ ID NO: 193754 - RNA, 64 nt, Human
ggcugcugagaugcaggucggaagaggcaggggaaggcuccaggccuaacuuggagcaugucac

SEQ ID NO: 193755 - RNA, 64 nt, Human
gcuacuagccugaacgacagugccuuggaaaggcaggcuccaugcggcagcaacaggauugucu

SEQ ID NO: 193756 - RNA, 64 nt, Human
agcgcagggaggaugccacagccccacagcacccaggcuccauggggaagugcuccccacacgu

SEQ ID NO: 193757 - RNA, 64 nt, Human
cugggacucacaugaucguuggaugaccaaguucaggcuccaggagccaugccugagacucccu

SEQ ID NO: 193758 - RNA, 64 nt, Human
aauucucaaucuugcacugcagccucgaccucccaggcuccagugacucucccaccucagccuc

SEQ ID NO: 193759 - RNA, 64 nt, Human
gggugguuggcaaacucaucgugucuguccugagaggcuccacaaugcccacccgcaucgccau

SEQ ID NO: 193760 - RNA, 64 nt, Human
ucaccaaggcaaaguuggggcuggucccagccugaggcuccagcugaugcccucagcucccaga

SEQ ID NO: 193761 - RNA, 64 nt, Human
agacugugcucuucugagaagcagagcuacgcuuaggcuccaguaaggauuggaggcacuuucc

SEQ ID NO: 193762 - RNA, 64 nt, Human
gugggggcuccugauccgcauccaagcuuaaccaaggcuccaauaaacgugcuaggaagcaagc

SEQ ID NO: 193763 - RNA, 64 nt, Human
cccgccacuucccucgggcccuuaugaaggacugaggcuccagggugagaaggcucacuucugc

SEQ ID NO: 193764 - RNA, 64 nt, Human
ucucucaugaccagcucucugccucccuuccaggaggcuccaucccacacuguucacccaggcu

SEQ ID NO: 193765 - RNA, 64 nt, Human
uguuguuguuuguuguuauuguuguuuuguugccaggcuccaacucacaaaauacgaguuuaaa

SEQ ID NO: 193766 - RNA, 59 nt, Human
ucagggaauggugucugugcucagcccauccaccagaagagucugcucacaagccagag

SEQ ID NO: 193767 - RNA, 59 nt, Human
uccuuggcccuuuuucuuuauugacuagaccaccagaggaggaugugugggauuguagg

SEQ ID NO: 193768 - RNA, 59 nt, Human
acuggagagaucaagagagaguauggcggccaccagaaggcuguugucugccuggccuu

SEQ ID NO: 193769 - RNA, 64 nt, Human
acagcagcaagaaaaaaaaaugccauaauacaaaaggcuccauauauauauauauauauauaua

SEQ ID NO: 193770 - RNA, 64 nt, Human
gaacuuggcuauacugaaaucuguuauuuuagugaggcuccaaaaugagcaaagcuaggccuga

SEQ ID NO: 193771 - RNA, 64 nt, Human
ugucccaagugggcuacauuugaagaauucacccaggcuccagcuagaucaucaguuaauuuaa

SEQ ID NO: 193772 - RNA, 64 nt, Human
ucuuucagacccaacucuuagagggcacaucaccaggcuccacaucacgggaagugagauggau

SEQ ID NO: 193773 - RNA, 64 nt, Human
cuggagcaaaaacuuucagcauuaaauauuucagaggcuccauucacagcuuucagauaaacug

SEQ ID NO: 193774 - RNA, 64 nt, Human
caggcugugguuuguugauggccagguuuuccucaggcuccaacaacugugcuuauaccaagca

SEQ ID NO: 193775 - RNA, 64 nt, Human
aacgagaccugugugccaggggcagauggccuggaggcuccagugacugaggggccuggcuccg

SEQ ID NO: 193776 - RNA, 64 nt, Human
gacuguguugcugucucuuagauuaaccgugcugaggcuccacauagcuccuggaccugugucu

SEQ ID NO: 193777 - RNA, 64 nt, Human
ggucuggaggggcugccgugacuccagaggccugaggcuccagggcuggcucugguguuuacaa

SEQ ID NO: 193778 - RNA, 64 nt, Human
gcugcuccccaucccaaagugggccugggcagucaggcuccagggcccuaugccaaccugccuu

SEQ ID NO: 193779 - RNA, 64 nt, Human
aggaaagguagcuguaggguucucccauuuccagaggcuccauccacaccugccuucccacauu

SEQ ID NO: 193780 - RNA, 64 nt, Human
ucugagagcucuccagccugagggcauugagcugaggcuccacccugagcucuccugcagggug

SEQ ID NO: 193781 - RNA, 64 nt, Human
cggggcuauucccauuuugcagacaggacagcagaggcuccagacaaugccuuuccuuucuuuu

SEQ ID NO: 193782 - RNA, 64 nt, Human
uucauuuccagaaguagcaaagcuuacuagccaaaggcuccacauuuaucaacucuuaagagcu

SEQ ID NO: 193783 - RNA, 64 nt, Human
cccgccccauucuggcgacacuuggagccaucucaggcuccacucccugaguaauucacggcau

SEQ ID NO: 193784 - RNA, 64 nt, Human
gccccugccugcauccccgagcaccccacccuccaggcuccacuaaggagggaggggcugucug

SEQ ID NO: 193785 - RNA, 59 nt, Human
gucagcaaugcuauuaucucuaauuagugccaccagacuagaccuguaucauucauggu

SEQ ID NO: 193786 - RNA, 59 nt, Human
aaaaacagcuuuauugagguauaauucacccaccagacuuuuuuaaacaucaaauaauu

SEQ ID NO: 193787 - RNA, 59 nt, Human
caaauagaaauuuaaugauguguucaacuccaccagaaauuaccucgagucagcauuga

SEQ ID NO: 193788 - RNA, 64 nt, Human
cugagaaaucaucauaauugugcuuucacuucccaggcuccaugugucuuggagccgucacccc

SEQ ID NO: 193789 - RNA, 64 nt, Human
cuguugaguucagcuuuuaccagccucaguguggaggcuccaucccagcacacaggccuggggc

SEQ ID NO: 193790 - RNA, 64 nt, Human
agggaagaaccacaaaggcuugcaaagauaggagaggcuccaucucuaaugcauguagaagcuc

SEQ ID NO: 193791 - RNA, 64 nt, Human
gggccaggacaucuucugagccaggacgucccugaggcuccaccuccaagcucagacagggccc

SEQ ID NO: 193792 - RNA, 64 nt, Human
ggaggacgcucucuggccuucggccuccauccugaggcuccacuuggucugugagaugcuagaa

SEQ ID NO: 193793 - RNA, 64 nt, Human
aagagaaucguuuaagggaacccggcgcccagccaggcuccaguggcccgaacggggcggcgag

SEQ ID NO: 193794 - RNA, 64 nt, Human
gagccucacgcucacccaagauccugcaggggccaggcuccaucucacuggcucugagggcagg

SEQ ID NO: 193795 - RNA, 64 nt, Human
accugggcgccugcccucaggagccugggcugcgaggcuccauaggagggcugguggcugggag

SEQ ID NO: 193796 - RNA, 64 nt, Human
cccccucuguccaggcacugagauaccagcgaggaggcuccagagggcacucugcuuguuauua

SEQ ID NO: 193797 - RNA, 64 nt, Human
gcagagugggcccccuacuccauuucccagcaaaaggcuccagcuggagggauggguugugggg

SEQ ID NO: 193798 - RNA, 64 nt, Human
cagaggauuuuaauuuuuaguucuggccggcuacaggcuccauuucucugccuucccauuggaa

SEQ ID NO: 193799 - RNA, 64 nt, Human
cccugccuccuggagcuucccauuccaggagaaaaggcuccacuucccagcccuuccuugcccc

SEQ ID NO: 193800 - RNA, 64 nt, Human
acuagggccucuuuccagggccccacacucacaaaggcuccaggccuccccacagaggacccug

SEQ ID NO: 193801 - RNA, 64 nt, Human
ccugccacuuaguccccuacccucuccauuccccaggcuccacccgugcugcucaggugcaaau

SEQ ID NO: 193802 - RNA, 64 nt, Human
uggacaagucugaaaaccucacaacuccuuaccaaggcuccagguuggggggaucguaggauua

SEQ ID NO: 193803 - RNA, 64 nt, Human
ugccaucagggaucuuccccugccccgcaaagcuaggcuccagcugcaggcgggcucccacccu

SEQ ID NO: 193804 - RNA, 59 nt, Human
ugaugguuucuccuugccccauuucugccccaccagaucuuugcuccuuucccuuugag

SEQ ID NO: 193805 - RNA, 59 nt, Human
agaaacagggguaccuuucccagggguguccaccagaagaguugaagaagaggugagaa

SEQ ID NO: 193806 - RNA, 59 nt, Human
acccaaaucuaguucuuugaccaccucuaccaccagaacccagcagacacucacaucuc

SEQ ID NO: 193807 - RNA, 64 nt, Human
gggcucccgggcccgaggaggaaaaggauugccaaggcuccagggcaccccucaaagcagcgcc

SEQ ID NO: 193808 - RNA, 64 nt, Human
aaggcgucagaauguaagguucuuauuggaacccaggcuccagggucccugguuuucugugaca

SEQ ID NO: 193809 - RNA, 64 nt, Human
cuuugccaauccuguuggcccuaaacuaucaaggaggcuccauuucaccauuugauuuuuugca

SEQ ID NO: 193810 - RNA, 64 nt, Human
uuggaggccucagacaggucccugaaggagucugaggcuccagaggaugucauaugggaguuuu

SEQ ID NO: 193811 - RNA, 64 nt, Human
guccuguguggcucuuugaaucagcgugaaacugaggcuccagcucccuguguugugugugugu

SEQ ID NO: 193812 - RNA, 64 nt, Human
acaucuugcagaucagaaugggauggaauccaccaggcuccagcucaucccuccaaggcccugu

SEQ ID NO: 193813 - RNA, 64 nt, Human
gggagggcuggacggcgagcugggagccagccccaggcuccagggccacggcggagucaugguu

SEQ ID NO: 193814 - RNA, 64 nt, Human
gcccagucugaguaccuuggcuagacucuaggucaggcuccaggagcaugagaauugaucccca

SEQ ID NO: 193815 - RNA, 64 nt, Human
uuugggauagaacuugggccagggcuaggaacacaggcuccacggugacaugucauuugauugu

SEQ ID NO: 193816 - RNA, 64 nt, Human
augauagguaugauuccaguuuauuauccaucaaaggcuccaacugcuacaguucuccaacuuc

SEQ ID NO: 193817 - RNA, 64 nt, Human
augaaguaaccaccauucccaccuuucacugccuaggcuccaagucugaauacauuuuugaaau

SEQ ID NO: 193818 - RNA, 64 nt, Human
gcgugaucauagcucacugcagccuugaauuccuaggcuccagugauccucucaccucagcuuc

SEQ ID NO: 193819 - RNA, 64 nt, Human
gcaucagugccugcuccugccugcccuggcccugaggcuccaccacuucuuccuccacccagga

SEQ ID NO: 193820 - RNA, 64 nt, Human
ggaaagagaagaaccgcgccgcccggaggcagagaggcuccauggccgugcugcugggccaucc

SEQ ID NO: 193821 - RNA, 64 nt, Human
gcccuuugccuccuuccucuccccuggggcugggaggcuccauccgaccaaugucuguaaagug

SEQ ID NO: 193822 - RNA, 64 nt, Human
cgccaauauguauucuacaaaagagaaugguuuuaggcuccaguguuauacuuuuuuuuauaua

SEQ ID NO: 193823 - RNA, 59 nt, Human
agaaacagagaggggcaaaguugcucugcccaccagaacugaagaggaggggcugccca

SEQ ID NO: 193824 - RNA, 59 nt, Human
aggccaggauccccuuagcaggguccuucccaccagacucagggaagggaugccccauu

SEQ ID NO: 193825 - RNA, 59 nt, Human
gugagguggagggccugcccccccucccuccaccagacacuccuuccaggccugagccc

SEQ ID NO: 193826 - RNA, 64 nt, Human
ccaaacaagugggagagccaggagccaaacuaucaggcuccaaagcuuuuuuuuagugcaucac

SEQ ID NO: 193827 - RNA, 64 nt, Human
cuucuuagguucuuuuccauuaugucaaagguccaggcuccaguaggagagaaagaacuccuca

SEQ ID NO: 193828 - RNA, 64 nt, Human
agauagaacaacuuucucuacauuguguuuuaaaaggcuccagggaauccugcauucuaauugg

SEQ ID NO: 193829 - RNA, 64 nt, Human
agagccuuccagccuucugguguguucuaagagcaggcuccaccugggagccagccccaguuca

SEQ ID NO: 193830 - RNA, 64 nt, Human
gggcggaugguggcccaggagacagcacaccaccaggcuccacacgugcaugcuuuccccaaga

SEQ ID NO: 193831 - RNA, 64 nt, Human
ggcucugcaaaccccagacuuugcacacagccucaggcuccacacagaaaugugaacuuggccu

SEQ ID NO: 193832 - RNA, 64 nt, Human
caguguggcauccucauguuugcacacuuuccccaggcuccaguggccuggaugucaauguuua

SEQ ID NO: 193833 - RNA, 64 nt, Human
cacccacagacacaaucuuggacauuaaccccugaggcuccaccacccacccuuucauuucccc

SEQ ID NO: 193834 - RNA, 64 nt, Human
ggguguugaagucacaggguuugguuucgaaucuaggcuccacuuguuagagccucggugauca

SEQ ID NO: 193835 - RNA, 64 nt, Human
gagaagccuaugccagcugggagugauugcuaagaggcuccagucuuugcauuccaaagccuuu

SEQ ID NO: 193836 - RNA, 64 nt, Human
caggggcaggaguuggaaauuuuuuaaaguuagaaggcuccauuguuuuguuggcucucaaacu

SEQ ID NO: 193837 - RNA, 64 nt, Human
gcuccuaucucuugauguuuucuugucaucuugaaggcuccauggaaugagauaaagcauugac

SEQ ID NO: 193838 - RNA, 64 nt, Human
guaccugcugacccaggaccuacaaccacacugaaggcuccagugcggcagagccucgugcaag

SEQ ID NO: 193839 - RNA, 64 nt, Human
guguugaccuugaggggccuggcugggggcccccaggcuccaugccuucuugggaggguggccg

SEQ ID NO: 193840 - RNA, 64 nt, Human
ccaagggauguaucagggaugaucagcugaugagaggcuccagaaggauuucuagaucgcuuca

SEQ ID NO: 193841 - RNA, 64 nt, Human
auggcuaccaaaugauaagaacaacagcaacaaaaggcuccaaaacacacaugccucuuuguuu

SEQ ID NO: 193842 - RNA, 59 nt, Human
uuaguuucucuccuaaaaugaauguaugcccaccagagcagacaucuuccacguggaga

SEQ ID NO: 193843 - RNA, 59 nt, Human
agucaguucuaaucccaugugugucugggccaccagaccgaaaugguugcugagaaacu

SEQ ID NO: 193844 - RNA, 59 nt, Human
uaaauccacucugcaggaaauaggcccaaccaccagaugagaauuaggcccuggaugag

SEQ ID NO: 193845 - RNA, 64 nt, Human
gcuauuacuguccacauuuuacaggcaaggaaacaggcuccaagaggcugaggacuuugcccag

SEQ ID NO: 193846 - RNA, 64 nt, Human
ccucucgcagccccugggugagggugucucugugaggcuccacugcggucugugccugacuggc

SEQ ID NO: 193847 - RNA, 64 nt, Human
ugaugguaauaaacugcucaaugaccagugcuucaggcuccagagcucuuuggagagauggguu

SEQ ID NO: 193848 - RNA, 64 nt, Human
accuuuuaaaaaaaugauuuauaagugaacuguuaggcuccagugauuucaguguuuuguucau

SEQ ID NO: 193849 - RNA, 64 nt, Human
uucaauaguuauccccaggccuggcacgucaaagaggcuccagaaauguuugcugagugaguga

SEQ ID NO: 193850 - RNA, 64 nt, Human
agcguaccauaaaccugcagagagaagucucgaaaggcuccaccagguaccaagggcagcugcu

SEQ ID NO: 193851 - RNA, 64 nt, Human
guuucuuguccaccgcuucacuggcaagagucccaggcuccaaggacacccucccugcacauga

SEQ ID NO: 193852 - RNA, 64 nt, Human
gacugacuugaacgauggcuucuccucaagcuguaggcuccagagcuuccuaaccuaguaaaau

SEQ ID NO: 193853 - RNA, 64 nt, Human
accugcugcuccacgaggaagcucaggccugcacaggcuccaccaggccuuggaugcccucuag

SEQ ID NO: 193854 - RNA, 64 nt, Human
ugggagcccaagagccaguggcugagcucugagaaggcuccaucucccaccugcccuugagcgc

SEQ ID NO: 193855 - RNA, 64 nt, Human
guacuucucugaugaauggcaauguaaaugaacaaggcuccaugugacuggagcauggaaguga

SEQ ID NO: 193856 - RNA, 64 nt, Human
ggaguagcgaggaaucugauuccaagcaaaaaccaggcuccaucuacucuuugaagcuucugcc

SEQ ID NO: 193857 - RNA, 64 nt, Human
cccuuuuccuccugcuucuccuuguccugccuggaggcuccaggccacacccagcugguggggc

SEQ ID NO: 193858 - RNA, 64 nt, Human
cuggcauccguguuuccaaaagugccuuuggcccaggcuccacggcgacaguugggcccaaauc

SEQ ID NO: 193859 - RNA, 64 nt, Human
aaccaugggaagcacuuugcaguguucagaagagaggcuccauuuguggcuauuauguagaacu

SEQ ID NO: 193860 - RNA, 64 nt, Human
aaauuagcacacccuucucagauggccacgauguaggcuccacuuugccaacuucccgagaaca

SEQ ID NO: 193861 - RNA, 59 nt, Human
gcaccuaugagcaguugccuaccauguguccaccagaggcuauuuaauucaugccaacu

SEQ ID NO: 193862 - RNA, 59 nt, Human
aagcaccuauagacuugaacuccuaagugccaccagaauauauaaaaagggaauuuagg

SEQ ID NO: 193863 - RNA, 59 nt, Human
acaauuucauguuaaucugguuugucuguccaccagagacagaucuucugugacagccu

SEQ ID NO: 193864 - RNA, 64 nt, Human
cagacauugagaguuuggacguguccgucuguccaggcuccauucagguccugcuguacucugg

SEQ ID NO: 193865 - RNA, 64 nt, Human
ggcacccuagccuggcugggauccucaggaccugaggcuccacagagagaaauuccuggaaucu

SEQ ID NO: 193866 - RNA, 64 nt, Human
ggccggcagcaaggacacagaugcagccacaguaaggcuccaucaggacugggucagugauggc

SEQ ID NO: 193867 - RNA, 64 nt, Human
ugugagacugaguauguguucuuuuuuccaggaaaggcuccagugguucuuacuugauccaaaa

SEQ ID NO: 193868 - RNA, 64 nt, Human
uuuucaagagggacgguauuuaugaaucaggguuaggcuccauauuuaaagauagagccaguuu

SEQ ID NO: 193869 - RNA, 64 nt, Human
agacccugggagcuguggcugucuucuguggaggaggcuccagcauucccaaagcucuuaauuc

SEQ ID NO: 193870 - RNA, 62 nt, Human
cagcucacucggaacaguagccagugucuggcaggcuccagaggguggacggagcggggccc

SEQ ID NO: 193871 - RNA, 64 nt, Human
uuauuguaaaucauuaccucauuuccagccucccaggcuccauccaucccagcaucuuuuauuc

SEQ ID NO: 193872 - RNA, 64 nt, Human
uugguacccuaggcucccagggcaggugaggagcaggcuccacagacuguccuggggcccagag

SEQ ID NO: 193873 - RNA, 64 nt, Human
uuaccauaggauucuccacaguggcuuccgacucaggcuccaauggaccaaauaaaagcguuuu

SEQ ID NO: 193874 - RNA, 64 nt, Human
gcaagacaagccccucagcaggagagaggcccagaggcuccagcuggccaccgugccccacaag

SEQ ID NO: 193875 - RNA, 64 nt, Human
ggagugccggaugaaaccagcucugucccugugcaggcuccaggcucccgccugacaaacaggc

SEQ ID NO: 193876 - RNA, 64 nt, Human
aacuugguuucuuugaaaaucaggcaauagagacaggcuccagaugaggaauccuccauuuucu

SEQ ID NO: 193877 - RNA, 64 nt, Human
aggggcauucuuuucugguacauggugagaguucaggcuccagagacucaaaacggaaugguuu

SEQ ID NO: 193878 - RNA, 64 nt, Human
cacagcuggauccaagggcacaaaugaugucaucaggcuccaguuauucuccaucucccagcuc

SEQ ID NO: 193879 - RNA, 64 nt, Human
uuccaccacugcacuccagccuggcgacagagcaaggcuccacucaaaaaaaagauuuaaaggg

SEQ ID NO: 193880 - RNA, 59 nt, Human
ggacugagccagaccuucggagaguaaugccaccagauccccuaggaaagaggaggcaa

SEQ ID NO: 193881 - RNA, 59 nt, Human
acaacuaaaauacccauuuggaccaaaagccaccagauugcuuagugccugacacagaa

SEQ ID NO: 193882 - RNA, 59 nt, Human
cccuguccccaccucuggagaauccacccccaccagauuccuccgcgggagguggcccu

SEQ ID NO: 193883 - RNA, 64 nt, Human
cuggaggccccugcaaggguaggggacaagauguaggcuccagcuccccucagaccuccucauc

SEQ ID NO: 193884 - RNA, 64 nt, Human
cucucuucuggcuuucugagcaggaagcgagcagaggcuccacaggcuuacgcugcucuccuga

SEQ ID NO: 193885 - RNA, 64 nt, Human
aguaccugguaacuuguuagaaauguacauucucaggcuccacagcaggccgccugaaucaaau

SEQ ID NO: 193886 - RNA, 64 nt, Human
agggcuccagacacauguccaagaagcccaggaaaggcuccaggagcagccacauuccugaugc

SEQ ID NO: 193887 - RNA, 64 nt, Human
ggacuguguggccaugcuggucaucggcuugcccaggcuccagccucuccagauucugaggggu

SEQ ID NO: 193888 - RNA, 64 nt, Human
augaaaauggguucaccaucucaagggaaaauggaggcuccagcagcauauuguaccgcuaccc

SEQ ID NO: 193889 - RNA, 64 nt, Human
auugcugucacagcaccuuguaugauggcaggacaggcuccagcagagagaacugcacagugac

SEQ ID NO: 193890 - RNA, 64 nt, Human
augagaaugugccaugcaugaagcaaaggauuccaggcuccagaaaaaaugaaugaacucaccu

SEQ ID NO: 193891 - RNA, 64 nt, Human
uccucucccacauuauuucuuaaucugaacaugaaggcuccauuagcaacacuaaaacuugauc

SEQ ID NO: 193892 - RNA, 64 nt, Human
ugcagagggagugugcgaaucaagccugaccaagaggcuccagaauaaaguaugauuuguguuc

SEQ ID NO: 193893 - RNA, 64 nt, Human
gucuuacagauugacuugaugcaaaacaucacaaaggcuccauguuacacaguaugcgauuuuu

SEQ ID NO: 193894 - RNA, 64 nt, Human
gggcugggugauuccugggccuacauucuucccgaggcuccaggccgcugucucuggaaguaaa

SEQ ID NO: 193895 - RNA, 64 nt, Human
ccacuuuuaaaguucaugggugagggauaaaaugaggcuccaauacaugggaagcuuugcugaa

SEQ ID NO: 193896 - RNA, 64 nt, Human
auuccuaacauuugacaaacuggaguugaacuaaaggcuccacgggaaaguuucuggucuuacu

SEQ ID NO: 193897 - RNA, 64 nt, Human
auaagugccggugacaagcugucugucaggggagaggcuccagaaccuggguucguccccagug

SEQ ID NO: 193898 - RNA, 64 nt, Human
aaaccaagcugccggccacugucuccagaacgcaaggcuccaggcccgugugucugaagcagug

SEQ ID NO: 193899 - RNA, 59 nt, Human
gagggccugacacuucacagaguggggacccaccagagccuauagaaucaauuccuugg

SEQ ID NO: 193900 - RNA, 59 nt, Human
gccucugcccagaagggggccucgccguuccaccagaagcucagcuccaggcccuggag

SEQ ID NO: 193901 - RNA, 59 nt, Human
aaacuggggaaggauuuaugaauacaccaccaccagaguggauaaugcuuagaauucuu

SEQ ID NO: 193902 - RNA, 64 nt, Human
ggcccaugauuuucccuacacuucucccuggcccaggcuccagccacaggcaccucuccugccc

SEQ ID NO: 193903 - RNA, 58 nt, Human
guaacccgaaggccaagugagaagcuggaggcuccaggacuccacuggacagacccag

SEQ ID NO: 193904 - RNA, 64 nt, Human
agcucagcaaaggcugagacugcccaugaccugaaggcuccagguggcuuuaaagcgcuauguu

SEQ ID NO: 193905 - RNA, 64 nt, Human
aggguaggcugagggggcccuaagggagggacuaaggcuccaaggcaggucacuuuuccuuagg

SEQ ID NO: 193906 - RNA, 64 nt, Human
cagagucucaggacagaaccacugagucuuuuggaggcuccaagccucaaagugcccgcagagc

SEQ ID NO: 193907 - RNA, 64 nt, Human
ccacguaucuagcuaauauguaugugucaguaguaggcuccaaggauugacaaauauauuuaug

SEQ ID NO: 193908 - RNA, 64 nt, Human
ccgcaucaucggccaccaagggcacaagaggcggaggcuccagucccugcugggcugccucagu

SEQ ID NO: 193909 - RNA, 64 nt, Human
uucagaggguaagaaagcacccuccaauaaacccaggcuccaggccgugggggcugcugaaggc

SEQ ID NO: 193910 - RNA, 64 nt, Human
uucucagaugcccugcuuaaaucaggggcacuucaggcuccacaggcgucauguuggacugaga

SEQ ID NO: 193911 - RNA, 64 nt, Human
gccccccaaaggauagcuucuuuuucaugaugccaggcuccaguccuuuauucccuucugcaua

SEQ ID NO: 193912 - RNA, 56 nt, Human
uggaggcaaacagucagugagaguggaggcuccagucagacccgccagauccuugg

SEQ ID NO: 193913 - RNA, 64 nt, Human
aggguuggauuagagggguuaaacaacuugucuuaggcuccacagcugggaacaaguggggcug

SEQ ID NO: 193914 - RNA, 64 nt, Human
gcuuugcagaucacagugcuggaagcaggaacccaggcuccagaagguguugccaggggcccag

SEQ ID NO: 193915 - RNA, 64 nt, Human
gggacuggaaaacuucacuugcuuggauuaggcaaggcuccacucauuguugauauuugcccag

SEQ ID NO: 193916 - RNA, 64 nt, Human
augccccauucugggccuguggugcucguggcugaggcuccacagggcugcaagugcccugcca

SEQ ID NO: 193917 - RNA, 64 nt, Human
ucaagaagacugagagcuuccaaaaugcccaggcaggcuccaacccuaagaaggucgaccucau

SEQ ID NO: 193918 - RNA, 59 nt, Human
ugucggguucacuuaaaggauuugacuuaccaccagagcauagaaaagcaugcaaggaa

SEQ ID NO: 193919 - RNA, 59 nt, Human
cagcagccccagacugcccaaaaacuugcccaccagaccaagggcagugccccaaggcc

SEQ ID NO: 193920 - RNA, 59 nt, Human
cuacaugcuuccccccuuccaguagcgagccaccagaagcuuucuugucucuaugcagu

SEQ ID NO: 193921 - RNA, 64 nt, Human
ggaugaggccuuugacuguuggauggaucagagcaggcuccagucagacccugguucugaaugu

SEQ ID NO: 193922 - RNA, 64 nt, Human
uaaacuuuugaaaauuuuaaucaucaagcuauagaggcuccaagugcaauuaauaauaacucau

SEQ ID NO: 193923 - RNA, 64 nt, Human
agaacccgaccaaaguaggcuggugaggaaguccaggcuccaggggaacagacgcugcccagug

SEQ ID NO: 193924 - RNA, 50 nt, Human
cccagagcuucccccagugaaggcuccacaggcugcacagucucugauaa

SEQ ID NO: 193925 - RNA, 64 nt, Human
gacacccugaccccacggcugcccugaccccaggaggcuccaguucugggcugggagcugugac

SEQ ID NO: 193926 - RNA, 64 nt, Human
cgaguggcugcaguacaggaucugacucuggcucaggcuccagggacuuguggggugggagggg

SEQ ID NO: 193927 - RNA, 64 nt, Human
aaaaaagacauauaagguugauuaaagggaaaaaaggcuccaguuuguuuuacagguuuuaaag

SEQ ID NO: 193928 - RNA, 64 nt, Human
ccuggaaaagggagaggggacccugccaaagaugaggcuccagcugcccuggggggaggguggu

SEQ ID NO: 193929 - RNA, 64 nt, Human
uaacucaaccuauaucucccuugaaaauacuuucaggcuccaccaaaacguagaacugaaagca

SEQ ID NO: 193930 - RNA, 64 nt, Human
gcaugcucucagcucacugcagcccugacugccuaggcuccagcaaucuucuuacgucagccuc

SEQ ID NO: 193931 - RNA, 64 nt, Human
acaaagucauuccuacucaaauguaauaaaauugaggcuccacggaggcccguguccacaucag

SEQ ID NO: 193932 - RNA, 64 nt, Human
guuguugagggcugugacuccguggggcucagccaggcuccagcagggucagacgugcuguuaa

SEQ ID NO: 193933 - RNA, 64 nt, Human
cacuacuggugccugaaacaccuggccugcuaggaggcuccaauaaagcuaacccggaccagac

SEQ ID NO: 193934 - RNA, 64 nt, Human
cccagucaaccaauggcauccagagagggcauggaggcuccauacaaccucuuccacccccaca

SEQ ID NO: 193935 - RNA, 64 nt, Human
gguccccugggcuguguagacccggugucccaccaggcuccaggcucccaccaucuacagaggg

SEQ ID NO: 193936 - RNA, 64 nt, Human
uucccucccucccucccucccucccucucugccaaggcuccagcuucuucccccagcugcuccc

SEQ ID NO: 193937 - RNA, 59 nt, Human
aaccaaaggcaacagagucuagcucauggccaccagaccaaaagcauccagcuucugug

SEQ ID NO: 193938 - RNA, 59 nt, Human
accccagacccacgccggagggcaucccuccaccagaagauuccgccaccucaagugaa

SEQ ID NO: 193939 - RNA, 59 nt, Human
ucccaauuggcuaggacugcaggcacacaccaccagacccagcuaauguaauuucuauc

SEQ ID NO: 193940 - RNA, 64 nt, Human
gcagccagaaagccaaagcagccaucgguggcccaggcuccacgugcuuacugaggacaucagg

SEQ ID NO: 193941 - RNA, 64 nt, Human
acuucuugugguucuguaaugccaaaaggaaugaaggcuccagggauacagaguuguccauuac

SEQ ID NO: 193942 - RNA, 64 nt, Human
caccgggcagcgggguugcaacccagcaccugguaggcuccauuucuucccaagcccgagcaga

SEQ ID NO: 193943 - RNA, 64 nt, Human
cccagucaaccaauggcacccagagagggcauggaggcuccacgcaaccccuuccacccccaca

SEQ ID NO: 193944 - RNA, 64 nt, Human
accaacccugucuccaccuugauauugcacuuccaggcuccagaacugugaggcaauaaauuuc

SEQ ID NO: 193945 - RNA, 64 nt, Human
agggcuggguuugucccccacccuggggggggccaggcuccagagagggggcaccuccccacac

SEQ ID NO: 193946 - RNA, 64 nt, Human
cccaccuagaggcuuucuuggucagugccugucaaggcuccaguccugcugagccaaaggcuuu

SEQ ID NO: 193947 - RNA, 64 nt, Human
augagcacauacagacacaccucagagauauugcaggcuccacuccagaucaccacaauaaugu

SEQ ID NO: 193948 - RNA, 64 nt, Human
gcaucugcccuaagucagauugaagccuccuccuaggcuccaggaggagcaugugcaggaaggg

SEQ ID NO: 193949 - RNA, 52 nt, Human
cuuccugcccuaguggcugaggaggcuccaggccugaggaccaagggauggc

SEQ ID NO: 193950 - RNA, 64 nt, Human
ccuuuggcucuuggcaggcagacuuuccaggaagaggcuccauguggcuccugcuucacuuucc

SEQ ID NO: 193951 - RNA, 64 nt, Human
cuuugggccgggccgggccggggaagggccgagcaggcuccaggaggccuccagagucagcugg

SEQ ID NO: 193952 - RNA, 64 nt, Human
gcacaggugcuggacaaguucauucacguggcacaggcuccaccagcugcagaauuucaacacg

SEQ ID NO: 193953 - RNA, 64 nt, Human
uuggucaggagccucucaagauuuuuuuugucagaggcuccaaauagaaaauaagaaaagguuu

SEQ ID NO: 193954 - RNA, 57 nt, Human
ggcacguccuguacccauaaaaaccccaggcuccacuggcagacggcagacaagggg

SEQ ID NO: 193955 - RNA, 64 nt, Human
ggacagcuaugcagucccuguccgguggugcuggaggcuccacucuccuuagguucauagucuc

SEQ ID NO: 193956 - RNA, 59 nt, Human
uccauccuuuuucucuaauuggucgccucccaccagacucaccugcuuuucaacuuuuu

SEQ ID NO: 193957 - RNA, 59 nt, Human
gggaauauggauaagcauaguaacaaaacccaccagaaucuaagcaguuuucacccccu

SEQ ID NO: 193958 - RNA, 59 nt, Human
uucuacagugagaugugaucuugccaaagccaccagaccuuggcuuccaggcccuccug

SEQ ID NO: 193959 - RNA, 64 nt, Human
cagauguuaugcuccugcugauccagaugcccagaggcuccaucguccauccucuuccucccca

SEQ ID NO: 193960 - RNA, 64 nt, Human
agccgcuagugauggagagcagagggagagggccaggcuccagacucccacacgcccacacagc

SEQ ID NO: 193961 - RNA, 64 nt, Human
cggccuggucccagcagguaugggcaguugcuugaggcuccagacauacucaccucuaccucga

SEQ ID NO: 193962 - RNA, 64 nt, Human
auguaggaugggcucuuaccccagggagggcggcaggcuccacuucggcgagagguucguccau

SEQ ID NO: 193963 - RNA, 64 nt, Human
ccuuuucagagaaagggagguaucccugugccaaaggcuccaggccucuccccugcaacucagg

SEQ ID NO: 193964 - RNA, 64 nt, Human
ucccgcaucuaugcaaaggugcaggcugccugugaggcuccaggcgguggaggugcggcagcug

SEQ ID NO: 193965 - RNA, 64 nt, Human
ccuggcugcagcccacacuguaacaucccuagugaggcuccagccuaaugagccccuuauuuuc

SEQ ID NO: 193966 - RNA, 64 nt, Human
cuccaucucccaaggcugccagacauggaccuccaggcuccagcacaucccccucuccucuccc

SEQ ID NO: 193967 - RNA, 64 nt, Human
ccccguccuguccccuccuuccagccugagauguaggcuccaccuuaacugugcucagauacac

SEQ ID NO: 193968 - RNA, 64 nt, Human
aauguacuguaacugagcccuuucccacaugucuaggcuccaaugucuccuguagguccaccua

SEQ ID NO: 193969 - RNA, 64 nt, Human
guuccagaggaauccaugaagaauucccaugcccaggcuccaugugucauguggaaaccuccac

SEQ ID NO: 193970 - RNA, 64 nt, Human
cuuuccaauagcaaauucaaagcaagcaacuugcaggcuccauggaacuuuuaaugaaggacag

SEQ ID NO: 193971 - RNA, 64 nt, Human
cugaggugcauuuccuguuguacacacaagggccaggcuccauucucccucccuuuccaccagu

SEQ ID NO: 193972 - RNA, 64 nt, Human
ugggcaaacuacucccuacuuaagggaauaggccaggcuccauccggaggcagggaccaugcca

SEQ ID NO: 193973 - RNA, 64 nt, Human
gacaaagcugagacugacgggugauguugcucauaggcuccagcucugcauaagaccuuggcuu

SEQ ID NO: 193974 - RNA, 64 nt, Human
auccccaguaggcaucugccaagaagggugcugaaggcuccagccagcuguccuggguuuccgu

SEQ ID NO: 193975 - RNA, 59 nt, Human
gaauuuuccuagaucccuccaaaugccacccaccagagucacuggugaccccagaaaau

SEQ ID NO: 193976 - RNA, 59 nt, Human
accaccuaaccagcgugaaagccugagucccaccagaaggaccuucccagauaccccuu

SEQ ID NO: 193977 - RNA, 59 nt, Human
ccuauaaugucuuaggugcaacacggaccccaccagagcucuuggauaccccccuagau

SEQ ID NO: 193978 - RNA, 64 nt, Human
gaccgcagagaucuagacagucguaacaguccccaggcuccagcugggcaauccaccacuuccu

SEQ ID NO: 193979 - RNA, 64 nt, Human
auggucuccccugccccagggcacauaagagcaaaggcuccaauggucaguggaugacucugca

SEQ ID NO: 193980 - RNA, 64 nt, Human
gaaaaagcuggcgccuccuuggucucuaggauccaggcuccacagagcacaugacuagccaggc

SEQ ID NO: 193981 - RNA, 64 nt, Human
ccuuugcuggcugggaggugcacacgcgagguauaggcuccagacuccucaccaagaugggcua

SEQ ID NO: 193982 - RNA, 64 nt, Human
ugcccaugggagcugguuagaaaugcagaauccuaggcuccaccccauccaguucaugagaauc

SEQ ID NO: 193983 - RNA, 64 nt, Human
agcagagcagcacaauaaaugaggccacugugccaggcuccagguggccucccuggccugucuc

SEQ ID NO: 193984 - RNA, 64 nt, Human
gcugucugucuccccugccccacugcuggaacagaggcuccaagaaaacagggaccuuauuauu

SEQ ID NO: 193985 - RNA, 64 nt, Human
acauuuucauaguucugccuauuguccuucccugaggcuccauugcugcuugguggccauucuc

SEQ ID NO: 193986 - RNA, 64 nt, Human
cccgcucccaggagcuaaugguagagcguccuugaggcuccauuauucguucauucagcauuua

SEQ ID NO: 193987 - RNA, 64 nt, Human
agcagagcagcacaauaaaugaggccacugugccaggcuccagguggccucccugcccugucuc

SEQ ID NO: 193988 - RNA, 64 nt, Human
acccacccuggggggcugcaagggcaagaagaggaggcuccaggguuggggcgagggccgaccu

SEQ ID NO: 193989 - RNA, 64 nt, Human
auauauauuuucuauauauaagauguauaauauaaggcuccacaaauauaucugugugugugug

SEQ ID NO: 193990 - RNA, 64 nt, Human
cagguguucuaggcaaagggaugggcaugagcgaaggcuccaggguccacagagcagggagugu

SEQ ID NO: 193991 - RNA, 64 nt, Human
agcagagcagcauaauaaaugaggccacugugccaggcuccagguggccucccuggccugucuc

SEQ ID NO: 193992 - RNA, 64 nt, Human
gggggcagcccccagaguccugugcauucugccaaggcuccauagcuuugccaaaugcacggag

SEQ ID NO: 193993 - RNA, 64 nt, Human
uaucaccugguggucugauucauacccuagccugaggcuccacuggaagaucucgcagccucag

SEQ ID NO: 193994 - RNA, 59 nt, Human
cugaaacgacgggacuuucacugugauuuccaccagagaaauuauagcagaguggcuga

SEQ ID NO: 193995 - RNA, 59 nt, Human
gcuggcuugauuucacaggggaguuggagccaccagauccucuugcaagauugccccaa

SEQ ID NO: 193996 - RNA, 59 nt, Human
cugaucaagacaccgcagugauggagaagccaccagaggcuccuugcagccacagagca

SEQ ID NO: 193997 - RNA, 64 nt, Human
cugggugagcuugaacaaguccuguaacuuccccaggcuccauucccccauccaagaguugggg

SEQ ID NO: 193998 - RNA, 64 nt, Human
ccugucuggcuccuggggcccaugcuuagagcccaggcuccagcccugagugcuuccgagcugg

SEQ ID NO: 193999 - RNA, 64 nt, Human
gagggaggcccuugggagcaggugcuuguggacaaggcuccacaagcguugagccuuggaaagg

SEQ ID NO: 194000 - RNA, 64 nt, Human
ccaggggaccagguggaccaggugguggccagagaggcuccaggggcuagacucccucaggagg

SEQ ID NO: 194001 - RNA, 64 nt, Human
ggcucacugcccugaugacccacccgccccauccaggcuccagcagcaaagccccaggagaaca

SEQ ID NO: 194002 - RNA, 64 nt, Human
auugguauucauucacaaugcaguugaagggggaaggcuccacugcauucuuuggcuaaggccu

SEQ ID NO: 194003 - RNA, 64 nt, Human
ucuccugagcagcagguggcucgaggcgguuagcaggcuccagcagcucccuucuuccuucccu

SEQ ID NO: 194004 - RNA, 64 nt, Human
cacaggcaugagggguggccgugcacaggugcccaggcuccaaggacagcuccggcagcagguc

SEQ ID NO: 194005 - RNA, 64 nt, Human
agguagaaaccugggcugggaggccucggaccccaggcuccaucccuggcuuccccagccugcg

SEQ ID NO: 194006 - RNA, 64 nt, Human
aguucuccacccacauuaccuaacuaccacccaaaggcuccaccuccuaauaccaucacauuga

SEQ ID NO: 194007 - RNA, 50 nt, Human
uccuuggcuggagugucuagaggcuccagacucuccuguuaacccuccau

SEQ ID NO: 194008 - RNA, 64 nt, Human
ccacaugugaacccaucauuccuaaacccuggguaggcuccaugccaaguaacagcagagggag

SEQ ID NO: 194009 - RNA, 64 nt, Human
uuuuuucucguucacucccaaacccaaguguccaaggcuccaguccuaggagaacagucccugg

SEQ ID NO: 194010 - RNA, 64 nt, Human
gugaaacuauggcuuaauacuguuaaagaccccaaggcuccacucuguagccaggugcaccuca

SEQ ID NO: 194011 - RNA, 59 nt, Human
ugccgaauugaagaggccugauuucagcuccaccagaugcagauuuguguuuuguuuuc

SEQ ID NO: 194012 - RNA, 59 nt, Human
uauaugacaggauguuuguccugggacacccaccagauuguacauacuguguuuggcug

SEQ ID NO: 194013 - RNA, 59 nt, Human
aggcucccugcugcccggagcagguacauccaccagagcaaagggaaccacuuuuauuu

SEQ ID NO: 194014 - RNA, 64 nt, Human; identical to SEQ ID NO: 76682

SEQ ID NO: 194015 - RNA, 64 nt, Human; identical to SEQ ID NO: 76683

SEQ ID NO: 194016 - RNA, 64 nt, Human; identical to SEQ ID NO: 76684

SEQ ID NO: 194017 - RNA, 64 nt, Human; identical to SEQ ID NO: 76685

SEQ ID NO: 194018 - RNA, 64 nt, Human; identical to SEQ ID NO: 76686

SEQ ID NO: 194019 - RNA, 64 nt, Human; identical to SEQ ID NO: 76687

SEQ ID NO: 194020 - RNA, 64 nt, Human; identical to SEQ ID NO: 76688

SEQ ID NO: 194021 - RNA, 64 nt, Human; identical to SEQ ID NO: 76689

SEQ ID NO: 194022 - RNA, 64 nt, Human; identical to SEQ ID NO: 76690

SEQ ID NO: 194023 - RNA, 64 nt, Human; identical to SEQ ID NO: 76691

SEQ ID NO: 194024 - RNA, 64 nt, Human; identical to SEQ ID NO: 76692

SEQ ID NO: 194025 - RNA, 64 nt, Human; identical to SEQ ID NO: 76693

SEQ ID NO: 194026 - RNA, 59 nt, Human
gacuccaaggccggccugcgcacuugcugccaccagaaacuggaggacaugauccagga

SEQ ID NO: 194027 - RNA, 59 nt, Human
ccuuuaacaagguuguaaauauuuuaugcccaccagagauguggucauaagaucugauc

SEQ ID NO: 194028 - RNA, 59 nt, Human
cccgaggcauuauuugaccggaucuacacccaccagagugaugugugaguuuguaauag

SEQ ID NO: 194029 - RNA, 59 nt, Human
auguaauucagcaaaauaauacaguacugccaccagauuuuuuauuacaucauuugaaa

SEQ ID NO: 194030 - RNA, 64 nt, Human; identical to SEQ ID NO: 76694

SEQ ID NO: 194031 - RNA, 62 nt, Human; identical to SEQ ID NO: 76695

SEQ ID NO: 194032 - RNA, 64 nt, Human; identical to SEQ ID NO: 76696

SEQ ID NO: 194033 - RNA, 64 nt, Human; identical to SEQ ID NO: 76697

SEQ ID NO: 194034 - RNA, 64 nt, Human; identical to SEQ ID NO: 76698

SEQ ID NO: 194035 - RNA, 64 nt, Human; identical to SEQ ID NO: 76699

SEQ ID NO: 194036 - RNA, 64 nt, Human; identical to SEQ ID NO: 76700

SEQ ID NO: 194037 - RNA, 64 nt, Human; identical to SEQ ID NO: 76701

SEQ ID NO: 194038 - RNA, 64 nt, Human; identical to SEQ ID NO: 76702

SEQ ID NO: 194039 - RNA, 64 nt, Human; identical to SEQ ID NO: 76703

SEQ ID NO: 194040 - RNA, 64 nt, Human; identical to SEQ ID NO: 76704

SEQ ID NO: 194041 - RNA, 64 nt, Human; identical to SEQ ID NO: 76705

SEQ ID NO: 194042 - RNA, 64 nt, Human; identical to SEQ ID NO: 76706

SEQ ID NO: 194043 - RNA, 64 nt, Human; identical to SEQ ID NO: 76707

SEQ ID NO: 194044 - RNA, 64 nt, Human; identical to SEQ ID NO: 76708

SEQ ID NO: 194045 - RNA, 64 nt, Human; identical to SEQ ID NO: 76709

SEQ ID NO: 194046 - RNA, 59 nt, Human
uaccuagcguggagcuaugcaagaagcagccaccagagggccccaaguggcagcaacug

SEQ ID NO: 194047 - RNA, 59 nt, Human
cagccguccauagcaguaccccuaaaaucccaccagaauacgggucccucuaacccagu

SEQ ID NO: 194048 - RNA, 59 nt, Human
cugucaucuucccaaagcucauuuaugagccaccagaggcuccuaccccaaagauuuuc

SEQ ID NO: 194049 - RNA, 64 nt, Human; identical to SEQ ID NO: 76710

SEQ ID NO: 194050 - RNA, 64 nt, Human; identical to SEQ ID NO: 76711

SEQ ID NO: 194051 - RNA, 64 nt, Human; identical to SEQ ID NO: 76712

SEQ ID NO: 194052 - RNA, 64 nt, Human; identical to SEQ ID NO: 76713

SEQ ID NO: 194053 - RNA, 64 nt, Human; identical to SEQ ID NO: 76714

SEQ ID NO: 194054 - RNA, 64 nt, Human; identical to SEQ ID NO: 76715

SEQ ID NO: 194055 - RNA, 64 nt, Human; identical to SEQ ID NO: 76716

SEQ ID NO: 194056 - RNA, 64 nt, Human; identical to SEQ ID NO: 76717

SEQ ID NO: 194057 - RNA, 64 nt, Human; identical to SEQ ID NO: 76718

SEQ ID NO: 194058 - RNA, 64 nt, Human; identical to SEQ ID NO: 76719

SEQ ID NO: 194059 - RNA, 64 nt, Human; identical to SEQ ID NO: 76720

SEQ ID NO: 194060 - RNA, 64 nt, Human; identical to SEQ ID NO: 76721

SEQ ID NO: 194061 - RNA, 64 nt, Human; identical to SEQ ID NO: 76722

SEQ ID NO: 194062 - RNA, 64 nt, Human; identical to SEQ ID NO: 76723

SEQ ID NO: 194063 - RNA, 64 nt, Human; identical to SEQ ID NO: 76724

SEQ ID NO: 194064 - RNA, 64 nt, Human; identical to SEQ ID NO: 76725

SEQ ID NO: 194065 - RNA, 59 nt, Human
uguuuauuagcuaguuccuguaagcauuuccaccagaacuugaggcaaaucguaaggaa

SEQ ID NO: 194066 - RNA, 59 nt, Human
cagacuccaccaagccuggucagcccaaaccaccagaagcccagaauaaacuggcagcu

SEQ ID NO: 194067 - RNA, 59 nt, Human
ccacagggcacaaugagcucucccuucuaccaccagaaagucccuggucaggucucagg

SEQ ID NO: 194068 - RNA, 64 nt, Human; identical to SEQ ID NO: 76726

SEQ ID NO: 194069 - RNA, 64 nt, Human; identical to SEQ ID NO: 76727

SEQ ID NO: 194070 - RNA, 64 nt, Human; identical to SEQ ID NO: 76728

SEQ ID NO: 194071 - RNA, 64 nt, Human; identical to SEQ ID NO: 76729

SEQ ID NO: 194072 - RNA, 64 nt, Human; identical to SEQ ID NO: 76730

SEQ ID NO: 194073 - RNA, 64 nt, Human; identical to SEQ ID NO: 76731

SEQ ID NO: 194074 - RNA, 50 nt, Human; identical to SEQ ID NO: 76732

SEQ ID NO: 194075 - RNA, 64 nt, Human; identical to SEQ ID NO: 76733

SEQ ID NO: 194076 - RNA, 64 nt, Human; identical to SEQ ID NO: 76734

SEQ ID NO: 194077 - RNA, 64 nt, Human; identical to SEQ ID NO: 76735

SEQ ID NO: 194078 - RNA, 64 nt, Human; identical to SEQ ID NO: 76736

SEQ ID NO: 194079 - RNA, 64 nt, Human; identical to SEQ ID NO: 76737

SEQ ID NO: 194080 - RNA, 64 nt, Human; identical to SEQ ID NO: 76738

SEQ ID NO: 194081 - RNA, 64 nt, Human; identical to SEQ ID NO: 76739

SEQ ID NO: 194082 - RNA, 64 nt, Human; identical to SEQ ID NO: 76740

SEQ ID NO: 194083 - RNA, 64 nt, Human; identical to SEQ ID NO: 76741

SEQ ID NO: 194084 - RNA, 59 nt, Human
ugaauggagccuuaaagaguuaggaugagccaccagaauaugccugcucaaaauuaaua

SEQ ID NO: 194085 - RNA, 59 nt, Human
gcuuguuuugguuugggggcagccauccuccaccagaaagggggagcuccuuccgcugc

SEQ ID NO: 194086 - RNA, 59 nt, Human
agcacacaucacuuuagaggggcugcgccccaccagauaggaaggggaggauuuucucc

SEQ ID NO: 194087 - RNA, 64 nt, Human; identical to SEQ ID NO: 76742

SEQ ID NO: 194088 - RNA, 64 nt, Human; identical to SEQ ID NO: 76743

SEQ ID NO: 194089 - RNA, 64 nt, Human; identical to SEQ ID NO: 76744

SEQ ID NO: 194090 - RNA, 64 nt, Human; identical to SEQ ID NO: 76745

SEQ ID NO: 194091 - RNA, 64 nt, Human; identical to SEQ ID NO: 76746

SEQ ID NO: 194092 - RNA, 64 nt, Human; identical to SEQ ID NO: 76747

SEQ ID NO: 194093 - RNA, 64 nt, Human; identical to SEQ ID NO: 76748

SEQ ID NO: 194094 - RNA, 64 nt, Human; identical to SEQ ID NO: 76749

SEQ ID NO: 194095 - RNA, 64 nt, Human; identical to SEQ ID NO: 76750

SEQ ID NO: 194096 - RNA, 64 nt, Human; identical to SEQ ID NO: 76751

SEQ ID NO: 194097 - RNA, 64 nt, Human; identical to SEQ ID NO: 76752

SEQ ID NO: 194098 - RNA, 64 nt, Human; identical to SEQ ID NO: 76753

SEQ ID NO: 194099 - RNA, 64 nt, Human; identical to SEQ ID NO: 76754

SEQ ID NO: 194100 - RNA, 64 nt, Human; identical to SEQ ID NO: 76755

SEQ ID NO: 194101 - RNA, 64 nt, Human; identical to SEQ ID NO: 76756

SEQ ID NO: 194102 - RNA, 63 nt, Human; identical to SEQ ID NO: 76757

SEQ ID NO: 194103 - RNA, 59 nt, Human
ccuucggcgccagcagcuccaaaacuggaccaccagagaauggacaccauccaggaaga

SEQ ID NO: 194104 - RNA, 59 nt, Human
uuucugugcccacccagacuugguuugggccaccagaggcugaaguguauuuccugugc

SEQ ID NO: 194105 - RNA, 59 nt, Human
acugccugcaccuuucggcagaggaacccccaccagacaucacccuuugccuuagcagg

SEQ ID NO: 194106 - RNA, 64 nt, Human; identical to SEQ ID NO: 76758

SEQ ID NO: 194107 - RNA, 64 nt, Human; identical to SEQ ID NO: 76759

SEQ ID NO: 194108 - RNA, 64 nt, Human; identical to SEQ ID NO: 76760

SEQ ID NO: 194109 - RNA, 64 nt, Human; identical to SEQ ID NO: 76761

SEQ ID NO: 194110 - RNA, 64 nt, Human; identical to SEQ ID NO: 76762

SEQ ID NO: 194111 - RNA, 64 nt, Human; identical to SEQ ID NO: 76763

SEQ ID NO: 194112 - RNA, 64 nt, Human; identical to SEQ ID NO: 76764

SEQ ID NO: 194113 - RNA, 64 nt, Human; identical to SEQ ID NO: 76765

SEQ ID NO: 194114 - RNA, 64 nt, Human; identical to SEQ ID NO: 76766

SEQ ID NO: 194115 - RNA, 64 nt, Human; identical to SEQ ID NO: 76767

SEQ ID NO: 194116 - RNA, 64 nt, Human; identical to SEQ ID NO: 76768

SEQ ID NO: 194117 - RNA, 64 nt, Human; identical to SEQ ID NO: 76769

SEQ ID NO: 194118 - RNA, 64 nt, Human; identical to SEQ ID NO: 76770

SEQ ID NO: 194119 - RNA, 64 nt, Human; identical to SEQ ID NO: 76771

SEQ ID NO: 194120 - RNA, 64 nt, Human; identical to SEQ ID NO: 76772

SEQ ID NO: 194121 - RNA, 64 nt, Human; identical to SEQ ID NO: 76773

SEQ ID NO: 194122 - RNA, 59 nt, Human
gagacacugacugaggcgaugggagcugcccaccagagugccucugagcagcucacagu

SEQ ID NO: 194123 - RNA, 59 nt, Human
acccagaacaggacuccacacagcguuugccaccagaaaccacaagcaaaaucuggauc

SEQ ID NO: 194124 - RNA, 59 nt, Human
ucccaaguagcuggguuuauaggugcccgccaccagacccggcuaauuuuuuaguuuua

SEQ ID NO: 194125 - RNA, 64 nt, Human; identical to SEQ ID NO: 76774

SEQ ID NO: 194126 - RNA, 64 nt, Human; identical to SEQ ID NO: 76775

SEQ ID NO: 194127 - RNA, 64 nt, Human; identical to SEQ ID NO: 76776

SEQ ID NO: 194128 - RNA, 64 nt, Human; identical to SEQ ID NO: 76777

SEQ ID NO: 194129 - RNA, 64 nt, Human; identical to SEQ ID NO: 76778

SEQ ID NO: 194130 - RNA, 64 nt, Human; identical to SEQ ID NO: 76779

SEQ ID NO: 194131 - RNA, 64 nt, Human; identical to SEQ ID NO: 76780

SEQ ID NO: 194132 - RNA, 64 nt, Human; identical to SEQ ID NO: 76781

SEQ ID NO: 194133 - RNA, 64 nt, Human; identical to SEQ ID NO: 76782

SEQ ID NO: 194134 - RNA, 64 nt, Human; identical to SEQ ID NO: 76783

SEQ ID NO: 194135 - RNA, 64 nt, Human; identical to SEQ ID NO: 76784

SEQ ID NO: 194136 - RNA, 64 nt, Human; identical to SEQ ID NO: 76785

SEQ ID NO: 194137 - RNA, 64 nt, Human; identical to SEQ ID NO: 76786

SEQ ID NO: 194138 - RNA, 64 nt, Human; identical to SEQ ID NO: 76787

SEQ ID NO: 194139 - RNA, 64 nt, Human; identical to SEQ ID NO: 76788

SEQ ID NO: 194140 - RNA, 64 nt, Human; identical to SEQ ID NO: 76789

SEQ ID NO: 194141 - RNA, 59 nt, Human
uuuugaggcauucacugcccuagacaaugccaccagagauagugggggaaaugccagau

SEQ ID NO: 194142 - RNA, 59 nt, Human
accugcccagguaugccuuccagugaugcccaccagagaauacauucucuauuaguuuu

SEQ ID NO: 194143 - RNA, 59 nt, Human
agcuucgaugagccagagugauaucauaaccaccagaaaucauacucuccuuucuuagu

SEQ ID NO: 194144 - RNA, 64 nt, Human; identical to SEQ ID NO: 76790

SEQ ID NO: 194145 - RNA, 64 nt, Human; identical to SEQ ID NO: 76791

SEQ ID NO: 194146 - RNA, 64 nt, Human; identical to SEQ ID NO: 76792

SEQ ID NO: 194147 - RNA, 57 nt, Human; identical to SEQ ID NO: 76793

SEQ ID NO: 194148 - RNA, 64 nt, Human; identical to SEQ ID NO: 76794

SEQ ID NO: 194149 - RNA, 64 nt, Human; identical to SEQ ID NO: 76795

SEQ ID NO: 194150 - RNA, 64 nt, Human; identical to SEQ ID NO: 76796

SEQ ID NO: 194151 - RNA, 64 nt, Human; identical to SEQ ID NO: 76797

SEQ ID NO: 194152 - RNA, 64 nt, Human; identical to SEQ ID NO: 76798

SEQ ID NO: 194153 - RNA, 64 nt, Human; identical to SEQ ID NO: 76799

SEQ ID NO: 194154 - RNA, 64 nt, Human; identical to SEQ ID NO: 76800

SEQ ID NO: 194155 - RNA, 64 nt, Human; identical to SEQ ID NO: 76801

SEQ ID NO: 194156 - RNA, 64 nt, Human; identical to SEQ ID NO: 76802

SEQ ID NO: 194157 - RNA, 64 nt, Human; identical to SEQ ID NO: 76803

SEQ ID NO: 194158 - RNA, 64 nt, Human; identical to SEQ ID NO: 76804

SEQ ID NO: 194159 - RNA, 64 nt, Human; identical to SEQ ID NO: 76805

SEQ ID NO: 194160 - RNA, 59 nt, Human
agcaaacucuggacugguggaagaauuccccaccagaucuccuugaagcagaauuaggg

SEQ ID NO: 194161 - RNA, 59 nt, Human
uggcuuacauguuugucucuuugagaucgccaccagaaccauuugugaacugauuugug

SEQ ID NO: 194162 - RNA, 59 nt, Human
caggauguuccagugucccuggucucugcccaccagaugccagcacucccaccauucgu

SEQ ID NO: 194163 - RNA, 64 nt, Human; identical to SEQ ID NO: 76806

SEQ ID NO: 194164 - RNA, 64 nt, Human; identical to SEQ ID NO: 76807

SEQ ID NO: 194165 - RNA, 64 nt, Human; identical to SEQ ID NO: 76808

SEQ ID NO: 194166 - RNA, 64 nt, Human; identical to SEQ ID NO: 76809

SEQ ID NO: 194167 - RNA, 64 nt, Human; identical to SEQ ID NO: 76810

SEQ ID NO: 194168 - RNA, 64 nt, Human; identical to SEQ ID NO: 76811

SEQ ID NO: 194169 - RNA, 64 nt, Human; identical to SEQ ID NO: 76812

SEQ ID NO: 194170 - RNA, 64 nt, Human; identical to SEQ ID NO: 76813

SEQ ID NO: 194171 - RNA, 64 nt, Human; identical to SEQ ID NO: 76814

SEQ ID NO: 194172 - RNA, 64 nt, Human; identical to SEQ ID NO: 76815

SEQ ID NO: 194173 - RNA, 64 nt, Human; identical to SEQ ID NO: 76816

SEQ ID NO: 194174 - RNA, 64 nt, Human; identical to SEQ ID NO: 76817

SEQ ID NO: 194175 - RNA, 64 nt, Human; identical to SEQ ID NO: 76818

SEQ ID NO: 194176 - RNA, 64 nt, Human; identical to SEQ ID NO: 76819

SEQ ID NO: 194177 - RNA, 64 nt, Human; identical to SEQ ID NO: 76820

SEQ ID NO: 194178 - RNA, 62 nt, Human; identical to SEQ ID NO: 76821

SEQ ID NO: 194179 - RNA, 59 nt, Human
caccugugucgccuccacuggcagucacgccaccagagccacccuggcucccucuccuc

SEQ ID NO: 194180 - RNA, 59 nt, Human
cuggccaaguuugagacuacacaaauaaaccaccagaaaaaugucuguguaauaauaga

SEQ ID NO: 194181 - RNA, 59 nt, Human
cacaguaaaucuucagcaacucauugucuccaccagauaguauuuuucuguaaaugaaa

SEQ ID NO: 194182 - RNA, 64 nt, Human; identical to SEQ ID NO: 76822

SEQ ID NO: 194183 - RNA, 64 nt, Human; identical to SEQ ID NO: 76823

SEQ ID NO: 194184 - RNA, 59 nt, Human; identical to SEQ ID NO: 76824

SEQ ID NO: 194185 - RNA, 64 nt, Human; identical to SEQ ID NO: 76825

SEQ ID NO: 194186 - RNA, 64 nt, Human; identical to SEQ ID NO: 76826

SEQ ID NO: 194187 - RNA, 64 nt, Human; identical to SEQ ID NO: 76827

SEQ ID NO: 194188 - RNA, 64 nt, Human; identical to SEQ ID NO: 76828

SEQ ID NO: 194189 - RNA, 64 nt, Human; identical to SEQ ID NO: 76829

SEQ ID NO: 194190 - RNA, 64 nt, Human; identical to SEQ ID NO: 76830

SEQ ID NO: 194191 - RNA, 64 nt, Human; identical to SEQ ID NO: 76831

SEQ ID NO: 194192 - RNA, 61 nt, Human; identical to SEQ ID NO: 76832

SEQ ID NO: 194193 - RNA, 64 nt, Human; identical to SEQ ID NO: 76833

SEQ ID NO: 194194 - RNA, 64 nt, Human; identical to SEQ ID NO: 76834

SEQ ID NO: 194195 - RNA, 64 nt, Human; identical to SEQ ID NO: 76835

SEQ ID NO: 194196 - RNA, 64 nt, Human; identical to SEQ ID NO: 76836

SEQ ID NO: 194197 - RNA, 64 nt, Human; identical to SEQ ID NO: 76837

SEQ ID NO: 194198 - RNA, 59 nt, Human
ugccacucugagcacauguccggggguugccaccagagacggcuuuguucucccagcua

SEQ ID NO: 194199 - RNA, 59 nt, Human
acuggcgaccucacgguugcacuuccauuccaccagaaugaccugaugaggaaaucuuc

SEQ ID NO: 194200 - RNA, 59 nt, Human
aggccagcucugccccaggggcugagcugccaccagagguccugggacccucacuuuag

SEQ ID NO: 194201 - RNA, 64 nt, Human; identical to SEQ ID NO: 76838

SEQ ID NO: 194202 - RNA, 64 nt, Human; identical to SEQ ID NO: 76839

SEQ ID NO: 194203 - RNA, 64 nt, Human; identical to SEQ ID NO: 76840

SEQ ID NO: 194204 - RNA, 64 nt, Human; identical to SEQ ID NO: 76841

SEQ ID NO: 194205 - RNA, 64 nt, Human; identical to SEQ ID NO: 76842

SEQ ID NO: 194206 - RNA, 64 nt, Human; identical to SEQ ID NO: 76843

SEQ ID NO: 194207 - RNA, 64 nt, Human; identical to SEQ ID NO: 76844

SEQ ID NO: 194208 - RNA, 64 nt, Human; identical to SEQ ID NO: 76845

SEQ ID NO: 194209 - RNA, 64 nt, Human; identical to SEQ ID NO: 76846

SEQ ID NO: 194210 - RNA, 64 nt, Human; identical to SEQ ID NO: 76847

SEQ ID NO: 194211 - RNA, 64 nt, Human; identical to SEQ ID NO: 76848

SEQ ID NO: 194212 - RNA, 64 nt, Human; identical to SEQ ID NO: 76849

SEQ ID NO: 194213 - RNA, 64 nt, Human; identical to SEQ ID NO: 76850

SEQ ID NO: 194214 - RNA, 64 nt, Human; identical to SEQ ID NO: 76851

SEQ ID NO: 194215 - RNA, 64 nt, Human; identical to SEQ ID NO: 76852

SEQ ID NO: 194216 - RNA, 64 nt, Human; identical to SEQ ID NO: 76853

SEQ ID NO: 194217 - RNA, 59 nt, Human
ugauuccggacccuguagauugggcgccaccaccagaucccccucccaggccuuccucc

SEQ ID NO: 194218 - RNA, 59 nt, Human
auuguguuuucucuaagaagcacuacaugccaccagaauugugcacugaaagauaauac

SEQ ID NO: 194219 - RNA, 59 nt, Human
guuuggauacauuucaagugcauuucaagccaccagagugucccauugcugccaaaaau

SEQ ID NO: 194220 - RNA, 64 nt, Human; identical to SEQ ID NO: 76854

SEQ ID NO: 194221 - RNA, 64 nt, Human; identical to SEQ ID NO: 76855

SEQ ID NO: 194222 - RNA, 64 nt, Human; identical to SEQ ID NO: 76856

SEQ ID NO: 194223 - RNA, 64 nt, Human; identical to SEQ ID NO: 76857

SEQ ID NO: 194224 - RNA, 64 nt, Human; identical to SEQ ID NO: 76858

SEQ ID NO: 194225 - RNA, 64 nt, Human; identical to SEQ ID NO: 76859

SEQ ID NO: 194226 - RNA, 64 nt, Human; identical to SEQ ID NO: 76860

SEQ ID NO: 194227 - RNA, 64 nt, Human; identical to SEQ ID NO: 76861

SEQ ID NO: 194228 - RNA, 64 nt, Human; identical to SEQ ID NO: 76862

SEQ ID NO: 194229 - RNA, 64 nt, Human; identical to SEQ ID NO: 76863

SEQ ID NO: 194230 - RNA, 64 nt, Human; identical to SEQ ID NO: 76864

SEQ ID NO: 194231 - RNA, 64 nt, Human; identical to SEQ ID NO: 76865

SEQ ID NO: 194232 - RNA, 64 nt, Human; identical to SEQ ID NO: 76866

SEQ ID NO: 194233 - RNA, 64 nt, Human; identical to SEQ ID NO: 76867

SEQ ID NO: 194234 - RNA, 64 nt, Human; identical to SEQ ID NO: 76868

SEQ ID NO: 194235 - RNA, 64 nt, Human; identical to SEQ ID NO: 76869

SEQ ID NO: 194236 - RNA, 59 nt, Human
uacacacacacacacacacacaccugaggccaccagaagacacuuccaucccucgggcc

SEQ ID NO: 194237 - RNA, 59 nt, Human
cucugaaauccagcaaggaggucugccucccaccagacccucuccaguguacuucccca

SEQ ID NO: 194238 - RNA, 59 nt, Human
uccaggcugacgaggcaagacaaagccucccaccagacuuggagauugaaguucuuaaa

SEQ ID NO: 194239 - RNA, 64 nt, Human; identical to SEQ ID NO: 76870

SEQ ID NO: 194240 - RNA, 64 nt, Human; identical to SEQ ID NO: 76871

SEQ ID NO: 194241 - RNA, 64 nt, Human; identical to SEQ ID NO: 76872

SEQ ID NO: 194242 - RNA, 64 nt, Human; identical to SEQ ID NO: 76873

SEQ ID NO: 194243 - RNA, 64 nt, Human; identical to SEQ ID NO: 76874

SEQ ID NO: 194244 - RNA, 64 nt, Human; identical to SEQ ID NO: 76875

SEQ ID NO: 194245 - RNA, 64 nt, Human; identical to SEQ ID NO: 76876

SEQ ID NO: 194246 - RNA, 64 nt, Human; identical to SEQ ID NO: 76877

SEQ ID NO: 194247 - RNA, 64 nt, Human; identical to SEQ ID NO: 76878

SEQ ID NO: 194248 - RNA, 64 nt, Human; identical to SEQ ID NO: 76879

SEQ ID NO: 194249 - RNA, 64 nt, Human; identical to SEQ ID NO: 76880

SEQ ID NO: 194250 - RNA, 64 nt, Human; identical to SEQ ID NO: 76881

SEQ ID NO: 194251 - RNA, 64 nt, Human; identical to SEQ ID NO: 76882

SEQ ID NO: 194252 - RNA, 64 nt, Human; identical to SEQ ID NO: 76883

SEQ ID NO: 194253 - RNA, 64 nt, Human; identical to SEQ ID NO: 76884

SEQ ID NO: 194254 - RNA, 64 nt, Human; identical to SEQ ID NO: 76885

SEQ ID NO: 194255 - RNA, 59 nt, Human
cccugcugucugucugugcccaagcccuuccaccagaaaagcuagucuaggugugagag

SEQ ID NO: 194256 - RNA, 59 nt, Human
ugcccuuccugcauccuucccccaaccacccaccagaggaguucugguccccaaaccaa

SEQ ID NO: 194257 - RNA, 59 nt, Human
caaucccagggaucuacagaacuauuucaccaccagauaugaccuaguuuuauauuucu

SEQ ID NO: 194258 - RNA, 64 nt, Human; identical to SEQ ID NO: 76886

SEQ ID NO: 194259 - RNA, 64 nt, Human; identical to SEQ ID NO: 76887

SEQ ID NO: 194260 - RNA, 64 nt, Human; identical to SEQ ID NO: 76888

SEQ ID NO: 194261 - RNA, 64 nt, Human; identical to SEQ ID NO: 76889

SEQ ID NO: 194262 - RNA, 64 nt, Human; identical to SEQ ID NO: 76890

SEQ ID NO: 194263 - RNA, 64 nt, Human; identical to SEQ ID NO: 76891

SEQ ID NO: 194264 - RNA, 64 nt, Human; identical to SEQ ID NO: 76892

SEQ ID NO: 194265 - RNA, 64 nt, Human; identical to SEQ ID NO: 76893

SEQ ID NO: 194266 - RNA, 64 nt, Human; identical to SEQ ID NO: 76894

SEQ ID NO: 194267 - RNA, 64 nt, Human; identical to SEQ ID NO: 76895

SEQ ID NO: 194268 - RNA, 64 nt, Human; identical to SEQ ID NO: 76896

SEQ ID NO: 194269 - RNA, 64 nt, Human; identical to SEQ ID NO: 76897

SEQ ID NO: 194270 - RNA, 64 nt, Human; identical to SEQ ID NO: 76898

SEQ ID NO: 194271 - RNA, 64 nt, Human; identical to SEQ ID NO: 76899

SEQ ID NO: 194272 - RNA, 64 nt, Human; identical to SEQ ID NO: 76900

SEQ ID NO: 194273 - RNA, 64 nt, Human; identical to SEQ ID NO: 76901

SEQ ID NO: 194274 - RNA, 59 nt, Human
ccugccccuccuggucugugucaguauuaccaccagacugacuccaggacucacugccc

SEQ ID NO: 194275 - RNA, 58 nt, Human; identical to SEQ ID NO: 46066

SEQ ID NO: 194276 - RNA, 59 nt, Human
guugguuucugguucagagugcucucccaccaccagagacaaguggguaaaaaggucag

SEQ ID NO: 194277 - RNA, 64 nt, Human; identical to SEQ ID NO: 76902

SEQ ID NO: 194278 - RNA, 64 nt, Human; identical to SEQ ID NO: 76903

SEQ ID NO: 194279 - RNA, 64 nt, Human; identical to SEQ ID NO: 76904

SEQ ID NO: 194280 - RNA, 64 nt, Human; identical to SEQ ID NO: 76905

SEQ ID NO: 194281 - RNA, 64 nt, Human; identical to SEQ ID NO: 76906

SEQ ID NO: 194282 - RNA, 64 nt, Human; identical to SEQ ID NO: 76907

SEQ ID NO: 194283 - RNA, 64 nt, Human; identical to SEQ ID NO: 76908

SEQ ID NO: 194284 - RNA, 54 nt, Human; identical to SEQ ID NO: 76909

SEQ ID NO: 194285 - RNA, 64 nt, Human; identical to SEQ ID NO: 76910

SEQ ID NO: 194286 - RNA, 64 nt, Human; identical to SEQ ID NO: 76911

SEQ ID NO: 194287 - RNA, 64 nt, Human; identical to SEQ ID NO: 76912

SEQ ID NO: 194288 - RNA, 64 nt, Human; identical to SEQ ID NO: 76913

SEQ ID NO: 194289 - RNA, 64 nt, Human; identical to SEQ ID NO: 76914

SEQ ID NO: 194290 - RNA, 64 nt, Human; identical to SEQ ID NO: 76915

SEQ ID NO: 194291 - RNA, 64 nt, Human; identical to SEQ ID NO: 76916

SEQ ID NO: 194292 - RNA, 64 nt, Human; identical to SEQ ID NO: 76917

SEQ ID NO: 194293 - RNA, 59 nt, Human
cucuuuuguuguccuugccccacuccucuccaccagacgccuuccucucuggauacugc

SEQ ID NO: 194294 - RNA, 59 nt, Human
uauaccucccuaaccucaccccuggaaagccaccagauuggaggucaccagcaugauga

SEQ ID NO: 194295 - RNA, 59 nt, Human
cuuuacacacacauucccguuccuaccaaccaccagaacuggaugguggcaccccuaau

SEQ ID NO: 194296 - RNA, 64 nt, Human; identical to SEQ ID NO: 76918

SEQ ID NO: 194297 - RNA, 64 nt, Human; identical to SEQ ID NO: 76919

SEQ ID NO: 194298 - RNA, 64 nt, Human; identical to SEQ ID NO: 76920

SEQ ID NO: 194299 - RNA, 64 nt, Human; identical to SEQ ID NO: 76921

SEQ ID NO: 194300 - RNA, 64 nt, Human; identical to SEQ ID NO: 76922

SEQ ID NO: 194301 - RNA, 64 nt, Human; identical to SEQ ID NO: 76923

SEQ ID NO: 194302 - RNA, 64 nt, Human; identical to SEQ ID NO: 76924

SEQ ID NO: 194303 - RNA, 64 nt, Human; identical to SEQ ID NO: 76925

SEQ ID NO: 194304 - RNA, 64 nt, Human; identical to SEQ ID NO: 76926

SEQ ID NO: 194305 - RNA, 64 nt, Human; identical to SEQ ID NO: 76927

SEQ ID NO: 194306 - RNA, 64 nt, Human; identical to SEQ ID NO: 76928

SEQ ID NO: 194307 - RNA, 64 nt, Human; identical to SEQ ID NO: 76929

SEQ ID NO: 194308 - RNA, 64 nt, Human; identical to SEQ ID NO: 76930

SEQ ID NO: 194309 - RNA, 64 nt, Human; identical to SEQ ID NO: 76931

SEQ ID NO: 194310 - RNA, 64 nt, Human; identical to SEQ ID NO: 76932

SEQ ID NO: 194311 - RNA, 64 nt, Human; identical to SEQ ID NO: 76933

SEQ ID NO: 194312 - RNA, 59 nt, Human
ccacuuuaggacaagaggcagcuugccuuccaccagacgccagccucggccuuccuucc

SEQ ID NO: 194313 - RNA, 59 nt, Human
gagcccucucucccuuacccucucacucuccaccagauguuuacuaaacagggcauguu

SEQ ID NO: 194314 - RNA, 59 nt, Human
ggaaaugucuguauugguuggaugaaacuccaccagagcacagcuuagcuggggcgaga

SEQ ID NO: 194315 - RNA, 64 nt, Human; identical to SEQ ID NO: 76934

SEQ ID NO: 194316 - RNA, 64 nt, Human; identical to SEQ ID NO: 76935

SEQ ID NO: 194317 - RNA, 64 nt, Human; identical to SEQ ID NO: 76936

SEQ ID NO: 194318 - RNA, 64 nt, Human; identical to SEQ ID NO: 76937

SEQ ID NO: 194319 - RNA, 64 nt, Human; identical to SEQ ID NO: 76938

SEQ ID NO: 194320 - RNA, 64 nt, Human; identical to SEQ ID NO: 76939

SEQ ID NO: 194321 - RNA, 64 nt, Human; identical to SEQ ID NO: 76940

SEQ ID NO: 194322 - RNA, 64 nt, Human; identical to SEQ ID NO: 76941

SEQ ID NO: 194323 - RNA, 64 nt, Human; identical to SEQ ID NO: 76942

SEQ ID NO: 194324 - RNA, 64 nt, Human; identical to SEQ ID NO: 76943

SEQ ID NO: 194325 - RNA, 64 nt, Human; identical to SEQ ID NO: 76944

SEQ ID NO: 194326 - RNA, 64 nt, Human; identical to SEQ ID NO: 76945

SEQ ID NO: 194327 - RNA, 64 nt, Human; identical to SEQ ID NO: 76946

SEQ ID NO: 194328 - RNA, 64 nt, Human; identical to SEQ ID NO: 76947

SEQ ID NO: 194329 - RNA, 64 nt, Human; identical to SEQ ID NO: 76948

SEQ ID NO: 194330 - RNA, 64 nt, Human; identical to SEQ ID NO: 76949

SEQ ID NO: 194331 - RNA, 59 nt, Human
aguuuugagaggguggauggguuacuugcccaccagaaacagcccuagucccaacuccu

SEQ ID NO: 194332 - RNA, 59 nt, Human
cuccaaagucauaauugcauugacuuuccccaccagaugcugaaaauguccuugugaug

SEQ ID NO: 194333 - RNA, 59 nt, Human
ucacagcaacccauugaaaacugcccuccccaccagaacgugcuacguucuuucuucau

SEQ ID NO: 194334 - RNA, 64 nt, Human; identical to SEQ ID NO: 76950

SEQ ID NO: 194335 - RNA, 64 nt, Human; identical to SEQ ID NO: 76951

SEQ ID NO: 194336 - RNA, 64 nt, Human; identical to SEQ ID NO: 76952

SEQ ID NO: 194337 - RNA, 64 nt, Human; identical to SEQ ID NO: 76953

SEQ ID NO: 194338 - RNA, 64 nt, Human; identical to SEQ ID NO: 76954

SEQ ID NO: 194339 - RNA, 64 nt, Human; identical to SEQ ID NO: 76955

SEQ ID NO: 194340 - RNA, 64 nt, Human; identical to SEQ ID NO: 76956

SEQ ID NO: 194341 - RNA, 64 nt, Human; identical to SEQ ID NO: 76957

SEQ ID NO: 194342 - RNA, 64 nt, Human; identical to SEQ ID NO: 76958

SEQ ID NO: 194343 - RNA, 64 nt, Human; identical to SEQ ID NO: 76959

SEQ ID NO: 194344 - RNA, 64 nt, Human; identical to SEQ ID NO: 76960

SEQ ID NO: 194345 - RNA, 64 nt, Human; identical to SEQ ID NO: 76961

SEQ ID NO: 194346 - RNA, 64 nt, Human; identical to SEQ ID NO: 76962

SEQ ID NO: 194347 - RNA, 64 nt, Human; identical to SEQ ID NO: 76963

SEQ ID NO: 194348 - RNA, 64 nt, Human; identical to SEQ ID NO: 76964

SEQ ID NO: 194349 - RNA, 64 nt, Human; identical to SEQ ID NO: 76965

SEQ ID NO: 194350 - RNA, 59 nt, Human
gagaccccaggaacaauaagugucuccucccaccagacacuugccuuauuucuucuucu

SEQ ID NO: 194351 - RNA, 59 nt, Human
uuaacuggugaaacuagccuggaauaaugccaccagagacugaguggaaaucgccccuu

SEQ ID NO: 194352 - RNA, 59 nt, Human
gccacagccucuaguacacuuuagcaauaccaccagacuaguuagaguuccccacucac

SEQ ID NO: 194353 - RNA, 55 nt, Human; identical to SEQ ID NO: 76966

SEQ ID NO: 194354 - RNA, 64 nt, Human; identical to SEQ ID NO: 76967

SEQ ID NO: 194355 - RNA, 64 nt, Human; identical to SEQ ID NO: 76968

SEQ ID NO: 194356 - RNA, 64 nt, Human; identical to SEQ ID NO: 76969

SEQ ID NO: 194357 - RNA, 64 nt, Human; identical to SEQ ID NO: 76970

SEQ ID NO: 194358 - RNA, 64 nt, Human; identical to SEQ ID NO: 76971

SEQ ID NO: 194359 - RNA, 64 nt, Human; identical to SEQ ID NO: 76972

SEQ ID NO: 194360 - RNA, 64 nt, Human; identical to SEQ ID NO: 76973

SEQ ID NO: 194361 - RNA, 64 nt, Human; identical to SEQ ID NO: 76974

SEQ ID NO: 194362 - RNA, 64 nt, Human; identical to SEQ ID NO: 76975

SEQ ID NO: 194363 - RNA, 64 nt, Human; identical to SEQ ID NO: 76976

SEQ ID NO: 194364 - RNA, 64 nt, Human; identical to SEQ ID NO: 76977

SEQ ID NO: 194365 - RNA, 64 nt, Human; identical to SEQ ID NO: 76978

SEQ ID NO: 194366 - RNA, 64 nt, Human; identical to SEQ ID NO: 76979

SEQ ID NO: 194367 - RNA, 64 nt, Human; identical to SEQ ID NO: 76980

SEQ ID NO: 194368 - RNA, 64 nt, Human; identical to SEQ ID NO: 76981

SEQ ID NO: 194369 - RNA, 59 nt, Human
cuauccuggauauguacuaacgaauauuaccaccagagaagagagcuuucuacaaaagu

SEQ ID NO: 194370 - RNA, 59 nt, Human
agccuggacaguggccaggaccgucgagaccaccagagcuaccuccccggggacagccc

SEQ ID NO: 194371 - RNA, 59 nt, Human
ucagcuacagaaagccuccgugacaccguccaccagagcucuggggucucgaacauaac

SEQ ID NO: 194372 - RNA, 64 nt, Human; identical to SEQ ID NO: 76982

SEQ ID NO: 194373 - RNA, 64 nt, Human; identical to SEQ ID NO: 76983

SEQ ID NO: 194374 - RNA, 64 nt, Human; identical to SEQ ID NO: 76984

SEQ ID NO: 194375 - RNA, 64 nt, Human; identical to SEQ ID NO: 76985

SEQ ID NO: 194376 - RNA, 62 nt, Human; identical to SEQ ID NO: 76986

SEQ ID NO: 194377 - RNA, 61 nt, Human; identical to SEQ ID NO: 76987

SEQ ID NO: 194378 - RNA, 64 nt, Human; identical to SEQ ID NO: 76988

SEQ ID NO: 194379 - RNA, 64 nt, Human; identical to SEQ ID NO: 76989

SEQ ID NO: 194380 - RNA, 64 nt, Human; identical to SEQ ID NO: 76990

SEQ ID NO: 194381 - RNA, 64 nt, Human; identical to SEQ ID NO: 76991

SEQ ID NO: 194382 - RNA, 64 nt, Human; identical to SEQ ID NO: 76992

SEQ ID NO: 194383 - RNA, 64 nt, Human; identical to SEQ ID NO: 76993

SEQ ID NO: 194384 - RNA, 64 nt, Human; identical to SEQ ID NO: 76994

SEQ ID NO: 194385 - RNA, 64 nt, Human; identical to SEQ ID NO: 76995

SEQ ID NO: 194386 - RNA, 64 nt, Human; identical to SEQ ID NO: 76996

SEQ ID NO: 194387 - RNA, 64 nt, Human; identical to SEQ ID NO: 76997

SEQ ID NO: 194388 - RNA, 59 nt, Human
ugaagugcucuaaagacagagacccucugccaccagagaccguccucaccccuguccuc

SEQ ID NO: 194389 - RNA, 59 nt, Human
uuaaugaugagguuacaugcugcuugccuccaccagauguccacaacaauaugaaguac

SEQ ID NO: 194390 - RNA, 59 nt, Human
gauucgguuagaaagugucaaguccucagccaccagacuguuauacugcaccacgggag

SEQ ID NO: 194391 - RNA, 64 nt, Human; identical to SEQ ID NO: 76998

SEQ ID NO: 194392 - RNA, 64 nt, Human; identical to SEQ ID NO: 76999

SEQ ID NO: 194393 - RNA, 64 nt, Human; identical to SEQ ID NO: 77000

SEQ ID NO: 194394 - RNA, 64 nt, Human; identical to SEQ ID NO: 77001

SEQ ID NO: 194395 - RNA, 64 nt, Human; identical to SEQ ID NO: 77002

SEQ ID NO: 194396 - RNA, 64 nt, Human; identical to SEQ ID NO: 77003

SEQ ID NO: 194397 - RNA, 64 nt, Human; identical to SEQ ID NO: 77004

SEQ ID NO: 194398 - RNA, 64 nt, Human; identical to SEQ ID NO: 77005

SEQ ID NO: 194399 - RNA, 64 nt, Human; identical to SEQ ID NO: 77006

SEQ ID NO: 194400 - RNA, 64 nt, Human; identical to SEQ ID NO: 77007

SEQ ID NO: 194401 - RNA, 64 nt, Human; identical to SEQ ID NO: 77008

SEQ ID NO: 194402 - RNA, 64 nt, Human; identical to SEQ ID NO: 77009

SEQ ID NO: 194403 - RNA, 64 nt, Human; identical to SEQ ID NO: 77010

SEQ ID NO: 194404 - RNA, 64 nt, Human; identical to SEQ ID NO: 77011

SEQ ID NO: 194405 - RNA, 64 nt, Human; identical to SEQ ID NO: 77012

SEQ ID NO: 194406 - RNA, 64 nt, Human; identical to SEQ ID NO: 77013

SEQ ID NO: 194407 - RNA, 59 nt, Human
uguuaaaaucaggauuuuagugcuugccaccaccagaugagaaguuaagcagccuuucu

SEQ ID NO: 194408 - RNA, 59 nt, Human
ugcccuugggacuuccgaagugaaccauuccaccagaaccuuugauucugcacaagauu

SEQ ID NO: 194409 - RNA, 59 nt, Human
uuucuuuaucacccucagucuuaauccauccaccagagucuagaaggccagacgggccc

SEQ ID NO: 194410 - RNA, 64 nt, Human; identical to SEQ ID NO: 77014

SEQ ID NO: 194411 - RNA, 64 nt, Human; identical to SEQ ID NO: 77015

SEQ ID NO: 194412 - RNA, 64 nt, Human; identical to SEQ ID NO: 77016

SEQ ID NO: 194413 - RNA, 64 nt, Human; identical to SEQ ID NO: 77017

SEQ ID NO: 194414 - RNA, 64 nt, Human; identical to SEQ ID NO: 77018

SEQ ID NO: 194415 - RNA, 64 nt, Human; identical to SEQ ID NO: 77019

SEQ ID NO: 194416 - RNA, 64 nt, Human; identical to SEQ ID NO: 77020

SEQ ID NO: 194417 - RNA, 64 nt, Human; identical to SEQ ID NO: 77021

SEQ ID NO: 194418 - RNA, 64 nt, Human; identical to SEQ ID NO: 77022

SEQ ID NO: 194419 - RNA, 64 nt, Human; identical to SEQ ID NO: 77023

SEQ ID NO: 194420 - RNA, 64 nt, Human; identical to SEQ ID NO: 77024

SEQ ID NO: 194421 - RNA, 64 nt, Human; identical to SEQ ID NO: 77025

SEQ ID NO: 194422 - RNA, 64 nt, Human; identical to SEQ ID NO: 77026

SEQ ID NO: 194423 - RNA, 64 nt, Human; identical to SEQ ID NO: 77027

SEQ ID NO: 194424 - RNA, 64 nt, Human; identical to SEQ ID NO: 77028

SEQ ID NO: 194425 - RNA, 62 nt, Human; identical to SEQ ID NO: 77029

SEQ ID NO: 194426 - RNA, 59 nt, Human
cacuggcuuuggugcuguccacacagugcccaccagaaggcagagggaacuccagggca

SEQ ID NO: 194427 - RNA, 59 nt, Human
ugguucugcccucugcccuccagcuuuacccaccagaguaagcaaucuuuucuuuuuag

SEQ ID NO: 194428 - RNA, 59 nt, Human
gauguuaaggauucuuagaaaaacagcaaccaccagaauagcauauaucugaaaguagu

SEQ ID NO: 194429 - RNA, 64 nt, Human; identical to SEQ ID NO: 77030

SEQ ID NO: 194430 - RNA, 64 nt, Human; identical to SEQ ID NO: 77031

SEQ ID NO: 194431 - RNA, 64 nt, Human; identical to SEQ ID NO: 77032

SEQ ID NO: 194432 - RNA, 64 nt, Human; identical to SEQ ID NO: 77033

SEQ ID NO: 194433 - RNA, 64 nt, Human; identical to SEQ ID NO: 77034

SEQ ID NO: 194434 - RNA, 64 nt, Human; identical to SEQ ID NO: 77035

SEQ ID NO: 194435 - RNA, 64 nt, Human; identical to SEQ ID NO: 77036

SEQ ID NO: 194436 - RNA, 64 nt, Human; identical to SEQ ID NO: 77037

SEQ ID NO: 194437 - RNA, 64 nt, Human; identical to SEQ ID NO: 77038

SEQ ID NO: 194438 - RNA, 64 nt, Human; identical to SEQ ID NO: 77039

SEQ ID NO: 194439 - RNA, 64 nt, Human; identical to SEQ ID NO: 77040

SEQ ID NO: 194440 - RNA, 64 nt, Human; identical to SEQ ID NO: 77041

SEQ ID NO: 194441 - RNA, 64 nt, Human; identical to SEQ ID NO: 77042

SEQ ID NO: 194442 - RNA, 64 nt, Human; identical to SEQ ID NO: 77043

SEQ ID NO: 194443 - RNA, 64 nt, Human; identical to SEQ ID NO: 77044

SEQ ID NO: 194444 - RNA, 64 nt, Human; identical to SEQ ID NO: 77045

SEQ ID NO: 194445 - RNA, 59 nt, Human
aguuuacugcucuuucagggauuucuaagccaccagaaucucacaugagaugugugggu

SEQ ID NO: 194446 - RNA, 59 nt, Human
auguggauauuuauauauuacauauauaaccaccagacuccauuuuauauauuagcauu

SEQ ID NO: 194447 - RNA, 59 nt, Human
ccgggucugcaccuccagagcccacccuaccaccagacacagagcccggaccaccugga

SEQ ID NO: 194448 - RNA, 64 nt, Human; identical to SEQ ID NO: 77046

SEQ ID NO: 194449 - RNA, 64 nt, Human; identical to SEQ ID NO: 77047

SEQ ID NO: 194450 - RNA, 64 nt, Human; identical to SEQ ID NO: 77048

SEQ ID NO: 194451 - RNA, 64 nt, Human; identical to SEQ ID NO: 77049

SEQ ID NO: 194452 - RNA, 64 nt, Human; identical to SEQ ID NO: 77050

SEQ ID NO: 194453 - RNA, 64 nt, Human; identical to SEQ ID NO: 77051

SEQ ID NO: 194454 - RNA, 64 nt, Human; identical to SEQ ID NO: 77052

SEQ ID NO: 194455 - RNA, 64 nt, Human; identical to SEQ ID NO: 77053

SEQ ID NO: 194456 - RNA, 64 nt, Human; identical to SEQ ID NO: 77054

SEQ ID NO: 194457 - RNA, 64 nt, Human; identical to SEQ ID NO: 77055

SEQ ID NO: 194458 - RNA, 64 nt, Human; identical to SEQ ID NO: 77056

SEQ ID NO: 194459 - RNA, 64 nt, Human; identical to SEQ ID NO: 77057

SEQ ID NO: 194460 - RNA, 64 nt, Human; identical to SEQ ID NO: 77058

SEQ ID NO: 194461 - RNA, 64 nt, Human; identical to SEQ ID NO: 77059

SEQ ID NO: 194462 - RNA, 64 nt, Human; identical to SEQ ID NO: 77060

SEQ ID NO: 194463 - RNA, 64 nt, Human; identical to SEQ ID NO: 77061

SEQ ID NO: 194464 - RNA, 59 nt, Human
uggucucuuaacuccugcccucaagugauccaccagagaggagauccucggccucccca

SEQ ID NO: 194465 - RNA, 59 nt, Human
ucagcaagguucucaacugccucgaguacccaccagaccaagaaggccugcggcagagc

SEQ ID NO: 194466 - RNA, 59 nt, Human
gaugagagaggagagaggaauccacaggaccaccagaagggagagggaaccagauaugc

SEQ ID NO: 194467 - RNA, 64 nt, Human; identical to SEQ ID NO: 77062

SEQ ID NO: 194468 - RNA, 64 nt, Human; identical to SEQ ID NO: 77063

SEQ ID NO: 194469 - RNA, 64 nt, Human; identical to SEQ ID NO: 77064

SEQ ID NO: 194470 - RNA, 64 nt, Human; identical to SEQ ID NO: 77065

SEQ ID NO: 194471 - RNA, 64 nt, Human; identical to SEQ ID NO: 77066

SEQ ID NO: 194472 - RNA, 64 nt, Human; identical to SEQ ID NO: 77067

SEQ ID NO: 194473 - RNA, 64 nt, Human; identical to SEQ ID NO: 77068

SEQ ID NO: 194474 - RNA, 64 nt, Human; identical to SEQ ID NO: 77069

SEQ ID NO: 194475 - RNA, 64 nt, Human; identical to SEQ ID NO: 77070

SEQ ID NO: 194476 - RNA, 64 nt, Human; identical to SEQ ID NO: 77071

SEQ ID NO: 194477 - RNA, 64 nt, Human; identical to SEQ ID NO: 77072

SEQ ID NO: 194478 - RNA, 64 nt, Human; identical to SEQ ID NO: 77073

SEQ ID NO: 194479 - RNA, 64 nt, Human; identical to SEQ ID NO: 77074

SEQ ID NO: 194480 - RNA, 64 nt, Human; identical to SEQ ID NO: 77075

SEQ ID NO: 194481 - RNA, 64 nt, Human; identical to SEQ ID NO: 77076

SEQ ID NO: 194482 - RNA, 64 nt, Human; identical to SEQ ID NO: 77077

SEQ ID NO: 194483 - RNA, 59 nt, Human
uaggaagucaugcucuucccacccuccacccaccagaguggaacccgcugcaaaauccc

SEQ ID NO: 194484 - RNA, 59 nt, Human
ggggagcucagcuuggucucagagucuccccaccagauacuguuuaaaaaaguagcacu

SEQ ID NO: 194485 - RNA, 59 nt, Human
gacucuauuauuuaauaucuuacauaccuccaccagacuggacuugcuuuuugaauuuu

SEQ ID NO: 194486 - RNA, 64 nt, Human; identical to SEQ ID NO: 77078

SEQ ID NO: 194487 - RNA, 64 nt, Human; identical to SEQ ID NO: 77079

SEQ ID NO: 194488 - RNA, 64 nt, Human; identical to SEQ ID NO: 77080

SEQ ID NO: 194489 - RNA, 64 nt, Human; identical to SEQ ID NO: 77081

SEQ ID NO: 194490 - RNA, 64 nt, Human; identical to SEQ ID NO: 77082

SEQ ID NO: 194491 - RNA, 64 nt, Human; identical to SEQ ID NO: 77083

SEQ ID NO: 194492 - RNA, 64 nt, Human; identical to SEQ ID NO: 77084

SEQ ID NO: 194493 - RNA, 64 nt, Human; identical to SEQ ID NO: 77085

SEQ ID NO: 194494 - RNA, 64 nt, Human; identical to SEQ ID NO: 77086

SEQ ID NO: 194495 - RNA, 64 nt, Human; identical to SEQ ID NO: 77087

SEQ ID NO: 194496 - RNA, 64 nt, Human; identical to SEQ ID NO: 77088

SEQ ID NO: 194497 - RNA, 64 nt, Human; identical to SEQ ID NO: 77089

SEQ ID NO: 194498 - RNA, 64 nt, Human; identical to SEQ ID NO: 77090

SEQ ID NO: 194499 - RNA, 64 nt, Human; identical to SEQ ID NO: 77091

SEQ ID NO: 194500 - RNA, 64 nt, Human; identical to SEQ ID NO: 77092

SEQ ID NO: 194501 - RNA, 64 nt, Human; identical to SEQ ID NO: 77093

SEQ ID NO: 194502 - RNA, 64 nt, Human
cagguggucggcgucggggugcgguggguaggggcgaggacaacgcagggugcgcuggguuggg

SEQ ID NO: 194503 - RNA, 64 nt, Human
cagacacggguuucgcagccauguuuccuggcuccgaggacacggguggcaggcccguugcagc

SEQ ID NO: 194504 - RNA, 64 nt, Human
aguuccagcaaaagcagcggcccgagcagaagaucgaggacaucagcaauaaguaugggggcuc

SEQ ID NO: 194505 - RNA, 60 nt, Human; identical to SEQ ID NO: 77094

SEQ ID NO: 194506 - RNA, 64 nt, Human; identical to SEQ ID NO: 77095

SEQ ID NO: 194507 - RNA, 64 nt, Human; identical to SEQ ID NO: 77096

SEQ ID NO: 194508 - RNA, 64 nt, Human; identical to SEQ ID NO: 77097

SEQ ID NO: 194509 - RNA, 64 nt, Human; identical to SEQ ID NO: 77098

SEQ ID NO: 194510 - RNA, 64 nt, Human; identical to SEQ ID NO: 77099

SEQ ID NO: 194511 - RNA, 64 nt, Human; identical to SEQ ID NO: 77100

SEQ ID NO: 194512 - RNA, 64 nt, Human; identical to SEQ ID NO: 77101

SEQ ID NO: 194513 - RNA, 64 nt, Human; identical to SEQ ID NO: 77102

SEQ ID NO: 194514 - RNA, 64 nt, Human; identical to SEQ ID NO: 77103

SEQ ID NO: 194515 - RNA, 64 nt, Human; identical to SEQ ID NO: 77104

SEQ ID NO: 194516 - RNA, 64 nt, Human; identical to SEQ ID NO: 77105

SEQ ID NO: 194517 - RNA, 64 nt, Human; identical to SEQ ID NO: 77106

SEQ ID NO: 194518 - RNA, 64 nt, Human; identical to SEQ ID NO: 77107

SEQ ID NO: 194519 - RNA, 64 nt, Human; identical to SEQ ID NO: 77108

SEQ ID NO: 194520 - RNA, 64 nt, Human; identical to SEQ ID NO: 77109

SEQ ID NO: 194521 - RNA, 64 nt, Human
ggccccagccaugaaggaacuuaaccgcuagugccgaggacacguuaaacgaacaggaugggcc

SEQ ID NO: 194522 - RNA, 64 nt, Human
ggagguucgugccguccccagccugccacgggugcgaggacagccaaguccugagugacucaag

SEQ ID NO: 194523 - RNA, 64 nt, Human
ugucucaagugcaaugcccccuccccuccuuuaccgaggacagccugccucugccacagcaagg

SEQ ID NO: 194524 - RNA, 64 nt, Human; identical to SEQ ID NO: 77110

SEQ ID NO: 194525 - RNA, 64 nt, Human; identical to SEQ ID NO: 77111

SEQ ID NO: 194526 - RNA, 64 nt, Human; identical to SEQ ID NO: 77112

SEQ ID NO: 194527 - RNA, 64 nt, Human; identical to SEQ ID NO: 77113

SEQ ID NO: 194528 - RNA, 64 nt, Human; identical to SEQ ID NO: 77114

SEQ ID NO: 194529 - RNA, 64 nt, Human; identical to SEQ ID NO: 77115

SEQ ID NO: 194530 - RNA, 64 nt, Human; identical to SEQ ID NO: 77116

SEQ ID NO: 194531 - RNA, 64 nt, Human; identical to SEQ ID NO: 77117

SEQ ID NO: 194532 - RNA, 64 nt, Human; identical to SEQ ID NO: 77118

SEQ ID NO: 194533 - RNA, 64 nt, Human; identical to SEQ ID NO: 77119

SEQ ID NO: 194534 - RNA, 64 nt, Human; identical to SEQ ID NO: 77120

SEQ ID NO: 194535 - RNA, 64 nt, Human; identical to SEQ ID NO: 77121

SEQ ID NO: 194536 - RNA, 64 nt, Human; identical to SEQ ID NO: 77122

SEQ ID NO: 194537 - RNA, 64 nt, Human; identical to SEQ ID NO: 77123

SEQ ID NO: 194538 - RNA, 64 nt, Human; identical to SEQ ID NO: 77124

SEQ ID NO: 194539 - RNA, 64 nt, Human; identical to SEQ ID NO: 77125

SEQ ID NO: 194540 - RNA, 64 nt, Human; identical to SEQ ID NO: 191862

SEQ ID NO: 194541 - RNA, 64 nt, Human
ugccagaggaccaaugcuugcauggagaaugggacgaggacauuugugggcaagcagaugacag

SEQ ID NO: 194542 - RNA, 64 nt, Human
ccugccacaggcuccucauccggacugaggaagacgaggacagggaggaggaaaaggaggaaga

SEQ ID NO: 194543 - RNA, 64 nt, Human; identical to SEQ ID NO: 77126

SEQ ID NO: 194544 - RNA, 64 nt, Human; identical to SEQ ID NO: 77127

SEQ ID NO: 194545 - RNA, 64 nt, Human; identical to SEQ ID NO: 77128

SEQ ID NO: 194546 - RNA, 64 nt, Human; identical to SEQ ID NO: 77129

SEQ ID NO: 194547 - RNA, 64 nt, Human; identical to SEQ ID NO: 77130

SEQ ID NO: 194548 - RNA, 64 nt, Human; identical to SEQ ID NO: 77131

SEQ ID NO: 194549 - RNA, 64 nt, Human; identical to SEQ ID NO: 77132

SEQ ID NO: 194550 - RNA, 64 nt, Human; identical to SEQ ID NO: 77133

SEQ ID NO: 194551 - RNA, 64 nt, Human; identical to SEQ ID NO: 77134

SEQ ID NO: 194552 - RNA, 64 nt, Human; identical to SEQ ID NO: 77135

SEQ ID NO: 194553 - RNA, 64 nt, Human; identical to SEQ ID NO: 77136

SEQ ID NO: 194554 - RNA, 64 nt, Human; identical to SEQ ID NO: 77137

SEQ ID NO: 194555 - RNA, 64 nt, Human; identical to SEQ ID NO: 77138

SEQ ID NO: 194556 - RNA, 64 nt, Human; identical to SEQ ID NO: 77139

SEQ ID NO: 194557 - RNA, 64 nt, Human; identical to SEQ ID NO: 77140

SEQ ID NO: 194558 - RNA, 64 nt, Human; identical to SEQ ID NO: 77141

SEQ ID NO: 194559 - RNA, 59 nt, Human
ccaguguuggcacaggcccaccccuggcuccaccagagccagaagcagagguagaauca

SEQ ID NO: 194560 - RNA, 59 nt, Human
ugcauaccuuccucccucuagacaucccuccaccagaagagacaucuauuuaaaggcac

SEQ ID NO: 194561 - RNA, 59 nt, Human
gauguucaccucucuccugaaaacuauucccaccagaccguuuagccucugcuucaagc

SEQ ID NO: 194562 - RNA, 60 nt, Human; identical to SEQ ID NO: 77142

SEQ ID NO: 194563 - RNA, 64 nt, Human; identical to SEQ ID NO: 77143

SEQ ID NO: 194564 - RNA, 64 nt, Human; identical to SEQ ID NO: 77144

SEQ ID NO: 194565 - RNA, 64 nt, Human; identical to SEQ ID NO: 77145

SEQ ID NO: 194566 - RNA, 64 nt, Human; identical to SEQ ID NO: 77146

SEQ ID NO: 194567 - RNA, 64 nt, Human; identical to SEQ ID NO: 77147

SEQ ID NO: 194568 - RNA, 64 nt, Human; identical to SEQ ID NO: 77148

SEQ ID NO: 194569 - RNA, 64 nt, Human; identical to SEQ ID NO: 77149

SEQ ID NO: 194570 - RNA, 64 nt, Human; identical to SEQ ID NO: 77150

SEQ ID NO: 194571 - RNA, 64 nt, Human; identical to SEQ ID NO: 77151

SEQ ID NO: 194572 - RNA, 64 nt, Human; identical to SEQ ID NO: 77152

SEQ ID NO: 194573 - RNA, 64 nt, Human; identical to SEQ ID NO: 77153

SEQ ID NO: 194574 - RNA, 64 nt, Human; identical to SEQ ID NO: 77154

SEQ ID NO: 194575 - RNA, 64 nt, Human; identical to SEQ ID NO: 77155

SEQ ID NO: 194576 - RNA, 64 nt, Human; identical to SEQ ID NO: 77156

SEQ ID NO: 194577 - RNA, 64 nt, Human; identical to SEQ ID NO: 77157

SEQ ID NO: 194578 - RNA, 64 nt, Human; identical to SEQ ID NO: 191825

SEQ ID NO: 194579 - RNA, 64 nt, Human; identical to SEQ ID NO: 77158

SEQ ID NO: 194580 - RNA, 64 nt, Human; identical to SEQ ID NO: 77159

SEQ ID NO: 194581 - RNA, 64 nt, Human; identical to SEQ ID NO: 77160

SEQ ID NO: 194582 - RNA, 64 nt, Human; identical to SEQ ID NO: 77161

SEQ ID NO: 194583 - RNA, 64 nt, Human; identical to SEQ ID NO: 77162

SEQ ID NO: 194584 - RNA, 64 nt, Human; identical to SEQ ID NO: 77163

SEQ ID NO: 194585 - RNA, 64 nt, Human; identical to SEQ ID NO: 77164

SEQ ID NO: 194586 - RNA, 64 nt, Human; identical to SEQ ID NO: 77165

SEQ ID NO: 194587 - RNA, 64 nt, Human; identical to SEQ ID NO: 77166

SEQ ID NO: 194588 - RNA, 64 nt, Human; identical to SEQ ID NO: 77167

SEQ ID NO: 194589 - RNA, 64 nt, Human; identical to SEQ ID NO: 77168

SEQ ID NO: 194590 - RNA, 64 nt, Human; identical to SEQ ID NO: 77169

SEQ ID NO: 194591 - RNA, 64 nt, Human; identical to SEQ ID NO: 77170

SEQ ID NO: 194592 - RNA, 64 nt, Human; identical to SEQ ID NO: 77171

SEQ ID NO: 194593 - RNA, 64 nt, Human; identical to SEQ ID NO: 77172

SEQ ID NO: 194594 - RNA, 64 nt, Human; identical to SEQ ID NO: 77173

SEQ ID NO: 194595 - RNA, 58 nt, Human; identical to SEQ ID NO: 46029

SEQ ID NO: 194596 - RNA, 59 nt, Human
cgaggacugugacacauagcccauucuggccaccagagcccacuuggccccaccccuca

SEQ ID NO: 194597 - RNA, 59 nt, Human
gacacugggccauccaggcggcucugcucccaccagacaggagcuaggccucacuggca

SEQ ID NO: 194598 - RNA, 64 nt, Human; identical to SEQ ID NO: 77174

SEQ ID NO: 194599 - RNA, 64 nt, Human; identical to SEQ ID NO: 77175

SEQ ID NO: 194600 - RNA, 64 nt, Human; identical to SEQ ID NO: 77176

SEQ ID NO: 194601 - RNA, 64 nt, Human; identical to SEQ ID NO: 77177

SEQ ID NO: 194602 - RNA, 64 nt, Human; identical to SEQ ID NO: 77178

SEQ ID NO: 194603 - RNA, 64 nt, Human; identical to SEQ ID NO: 77179

SEQ ID NO: 194604 - RNA, 64 nt, Human; identical to SEQ ID NO: 77180

SEQ ID NO: 194605 - RNA, 64 nt, Human; identical to SEQ ID NO: 77181

SEQ ID NO: 194606 - RNA, 64 nt, Human; identical to SEQ ID NO: 77182

SEQ ID NO: 194607 - RNA, 64 nt, Human; identical to SEQ ID NO: 77183

SEQ ID NO: 194608 - RNA, 64 nt, Human; identical to SEQ ID NO: 77184

SEQ ID NO: 194609 - RNA, 64 nt, Human; identical to SEQ ID NO: 77185

SEQ ID NO: 194610 - RNA, 64 nt, Human; identical to SEQ ID NO: 77186

SEQ ID NO: 194611 - RNA, 64 nt, Human; identical to SEQ ID NO: 77187

SEQ ID NO: 194612 - RNA, 64 nt, Human; identical to SEQ ID NO: 77188

SEQ ID NO: 194613 - RNA, 64 nt, Human; identical to SEQ ID NO: 77189

SEQ ID NO: 194614 - RNA, 59 nt, Human
agucugcauccuugccuagaccauucuccccaccagauggacuucuccuccagggagcc

SEQ ID NO: 194615 - RNA, 59 nt, Human
ugugugauuucucucccaccuccuuccccccaccagaccuuugcugggccuaaaggucu

SEQ ID NO: 194616 - RNA, 64 nt, Human; identical to SEQ ID NO: 77190

SEQ ID NO: 194617 - RNA, 64 nt, Human; identical to SEQ ID NO: 77191

SEQ ID NO: 194618 - RNA, 64 nt, Human; identical to SEQ ID NO: 77192

SEQ ID NO: 194619 - RNA, 64 nt, Human; identical to SEQ ID NO: 77193

SEQ ID NO: 194620 - RNA, 64 nt, Human; identical to SEQ ID NO: 77194

SEQ ID NO: 194621 - RNA, 64 nt, Human; identical to SEQ ID NO: 77195

SEQ ID NO: 194622 - RNA, 64 nt, Human; identical to SEQ ID NO: 77196

SEQ ID NO: 194623 - RNA, 64 nt, Human; identical to SEQ ID NO: 77197

SEQ ID NO: 194624 - RNA, 64 nt, Human; identical to SEQ ID NO: 77198

SEQ ID NO: 194625 - RNA, 64 nt, Human; identical to SEQ ID NO: 77199

SEQ ID NO: 194626 - RNA, 64 nt, Human; identical to SEQ ID NO: 77200

SEQ ID NO: 194627 - RNA, 64 nt, Human; identical to SEQ ID NO: 77201

SEQ ID NO: 194628 - RNA, 64 nt, Human; identical to SEQ ID NO: 77202

SEQ ID NO: 194629 - RNA, 64 nt, Human; identical to SEQ ID NO: 77203

SEQ ID NO: 194630 - RNA, 64 nt, Human; identical to SEQ ID NO: 77204

SEQ ID NO: 194631 - RNA, 64 nt, Human; identical to SEQ ID NO: 77205

SEQ ID NO: 194632 - RNA, 64 nt, Human
ggcuucaggcccggcuaacucuggcaccccggaucgaggacaagugagagagcaaguggggguc

SEQ ID NO: 194633 - RNA, 59 nt, Human
agggccuuguccagcugagagcuucauguccaccagauucugagaggugucagcagcac

SEQ ID NO: 194634 - RNA, 59 nt, Human
ccagcaggcaggcacuguggcccuucuguccaccagacccaccuggagcccgcuucaag

SEQ ID NO: 194635 - RNA, 64 nt, Human; identical to SEQ ID NO: 77206

SEQ ID NO: 194636 - RNA, 64 nt, Human; identical to SEQ ID NO: 77207

SEQ ID NO: 194637 - RNA, 64 nt, Human; identical to SEQ ID NO: 77208

SEQ ID NO: 194638 - RNA, 64 nt, Human; identical to SEQ ID NO: 77209

SEQ ID NO: 194639 - RNA, 64 nt, Human; identical to SEQ ID NO: 77210

SEQ ID NO: 194640 - RNA, 64 nt, Human; identical to SEQ ID NO: 77211

SEQ ID NO: 194641 - RNA, 64 nt, Human; identical to SEQ ID NO: 77212

SEQ ID NO: 194642 - RNA, 64 nt, Human; identical to SEQ ID NO: 77213

SEQ ID NO: 194643 - RNA, 64 nt, Human; identical to SEQ ID NO: 77214

SEQ ID NO: 194644 - RNA, 64 nt, Human; identical to SEQ ID NO: 77215

SEQ ID NO: 194645 - RNA, 64 nt, Human; identical to SEQ ID NO: 77216

SEQ ID NO: 194646 - RNA, 64 nt, Human; identical to SEQ ID NO: 77217

SEQ ID NO: 194647 - RNA, 64 nt, Human; identical to SEQ ID NO: 77218

SEQ ID NO: 194648 - RNA, 64 nt, Human; identical to SEQ ID NO: 77219

SEQ ID NO: 194649 - RNA, 64 nt, Human; identical to SEQ ID NO: 77220

SEQ ID NO: 194650 - RNA, 64 nt, Human; identical to SEQ ID NO: 77221

SEQ ID NO: 194651 - RNA, 64 nt, Human
agucuccauggugggccugucccagcccuggcugcgaggacagguugucuuucucuccccaguu

SEQ ID NO: 194652 - RNA, 64 nt, Human
guggagaagccggacccauccccgagguccccagcgaggacacacacuccacgagagcagcccc

SEQ ID NO: 194653 - RNA, 64 nt, Human; identical to SEQ ID NO: 191845

SEQ ID NO: 194654 - RNA, 64 nt, Human; identical to SEQ ID NO: 77222

SEQ ID NO: 194655 - RNA, 64 nt, Human; identical to SEQ ID NO: 77223

SEQ ID NO: 194656 - RNA, 64 nt, Human; identical to SEQ ID NO: 77224

SEQ ID NO: 194657 - RNA, 64 nt, Human; identical to SEQ ID NO: 77225

SEQ ID NO: 194658 - RNA, 64 nt, Human; identical to SEQ ID NO: 77226

SEQ ID NO: 194659 - RNA, 64 nt, Human; identical to SEQ ID NO: 77227

SEQ ID NO: 194660 - RNA, 64 nt, Human; identical to SEQ ID NO: 77228

SEQ ID NO: 194661 - RNA, 64 nt, Human; identical to SEQ ID NO: 77229

SEQ ID NO: 194662 - RNA, 64 nt, Human; identical to SEQ ID NO: 77230

SEQ ID NO: 194663 - RNA, 64 nt, Human; identical to SEQ ID NO: 77231

SEQ ID NO: 194664 - RNA, 64 nt, Human; identical to SEQ ID NO: 77232

SEQ ID NO: 194665 - RNA, 64 nt, Human; identical to SEQ ID NO: 77233

SEQ ID NO: 194666 - RNA, 64 nt, Human; identical to SEQ ID NO: 77234

SEQ ID NO: 194667 - RNA, 64 nt, Human; identical to SEQ ID NO: 77235

SEQ ID NO: 194668 - RNA, 64 nt, Human; identical to SEQ ID NO: 77236

SEQ ID NO: 194669 - RNA, 64 nt, Human; identical to SEQ ID NO: 77237

SEQ ID NO: 194670 - RNA, 59 nt, Human
ucagacaccgagacacugaacuuccugagccaccagacaggaaaggguagcagaaaaca

SEQ ID NO: 194671 - RNA, 59 nt, Human
ggccauccuccuggaauguggucugcccuccaccagagcuccugccugccaggacugga

SEQ ID NO: 194672 - RNA, 59 nt, Human
ggauuuauaguauagcccuuccuccacucccaccagacuugcucauuuuucgaguuuuu

SEQ ID NO: 194673 - RNA, 64 nt, Human; identical to SEQ ID NO: 77238

SEQ ID NO: 194674 - RNA, 64 nt, Human; identical to SEQ ID NO: 77239

SEQ ID NO: 194675 - RNA, 64 nt, Human; identical to SEQ ID NO: 77240

SEQ ID NO: 194676 - RNA, 64 nt, Human; identical to SEQ ID NO: 77241

SEQ ID NO: 194677 - RNA, 64 nt, Human; identical to SEQ ID NO: 77242

SEQ ID NO: 194678 - RNA, 64 nt, Human; identical to SEQ ID NO: 77243

SEQ ID NO: 194679 - RNA, 64 nt, Human; identical to SEQ ID NO: 77244

SEQ ID NO: 194680 - RNA, 64 nt, Human; identical to SEQ ID NO: 77245

SEQ ID NO: 194681 - RNA, 64 nt, Human; identical to SEQ ID NO: 77246

SEQ ID NO: 194682 - RNA, 64 nt, Human; identical to SEQ ID NO: 77247

SEQ ID NO: 194683 - RNA, 64 nt, Human; identical to SEQ ID NO: 77248

SEQ ID NO: 194684 - RNA, 64 nt, Human; identical to SEQ ID NO: 77249

SEQ ID NO: 194685 - RNA, 64 nt, Human; identical to SEQ ID NO: 77250

SEQ ID NO: 194686 - RNA, 64 nt, Human; identical to SEQ ID NO: 77251

SEQ ID NO: 194687 - RNA, 64 nt, Human; identical to SEQ ID NO: 77252

SEQ ID NO: 194688 - RNA, 64 nt, Human; identical to SEQ ID NO: 77253

SEQ ID NO: 194689 - RNA, 64 nt, Human
aguuguggaggaaacauucacacugaucugcuaguccaacgaucucuucagugucauccaauaa

SEQ ID NO: 194690 - RNA, 64 nt, Human
agagagcugcccuaacagaacacuucauccucacuccaacgagaaaucuacagaugcccagagg

SEQ ID NO: 194691 - RNA, 64 nt, Human
acaccucggccguacaucucugugagagacccccuccaacgauuagcuuuugcaacauggucca

SEQ ID NO: 194692 - RNA, 64 nt, Human; identical to SEQ ID NO: 77254

SEQ ID NO: 194693 - RNA, 64 nt, Human; identical to SEQ ID NO: 77255

SEQ ID NO: 194694 - RNA, 64 nt, Human; identical to SEQ ID NO: 77256

SEQ ID NO: 194695 - RNA, 64 nt, Human; identical to SEQ ID NO: 77257

SEQ ID NO: 194696 - RNA, 64 nt, Human; identical to SEQ ID NO: 77258

SEQ ID NO: 194697 - RNA, 64 nt, Human; identical to SEQ ID NO: 77259

SEQ ID NO: 194698 - RNA, 64 nt, Human; identical to SEQ ID NO: 77260

SEQ ID NO: 194699 - RNA, 64 nt, Human; identical to SEQ ID NO: 77261

SEQ ID NO: 194700 - RNA, 64 nt, Human; identical to SEQ ID NO: 77262

SEQ ID NO: 194701 - RNA, 64 nt, Human; identical to SEQ ID NO: 77263

SEQ ID NO: 194702 - RNA, 64 nt, Human; identical to SEQ ID NO: 77264

SEQ ID NO: 194703 - RNA, 64 nt, Human; identical to SEQ ID NO: 77265

SEQ ID NO: 194704 - RNA, 64 nt, Human; identical to SEQ ID NO: 77266

SEQ ID NO: 194705 - RNA, 64 nt, Human; identical to SEQ ID NO: 77267

SEQ ID NO: 194706 - RNA, 64 nt, Human; identical to SEQ ID NO: 77268

SEQ ID NO: 194707 - RNA, 64 nt, Human; identical to SEQ ID NO: 77269

SEQ ID NO: 194708 - RNA, 64 nt, Human; identical to SEQ ID NO: 191824

SEQ ID NO: 194709 - RNA, 64 nt, Human
cugcugcgguuguacccugauacggccuggccaucgaggacaccugcccauccggccucugugu

SEQ ID NO: 194710 - RNA, 59 nt, Human
gguccacagccaugcccuugaggagccggccaccagaugcugaauccccuaucccauuc

SEQ ID NO: 194711 - RNA, 64 nt, Human; identical to SEQ ID NO: 77270

SEQ ID NO: 194712 - RNA, 64 nt, Human; identical to SEQ ID NO: 77271

SEQ ID NO: 194713 - RNA, 64 nt, Human; identical to SEQ ID NO: 77272

SEQ ID NO: 194714 - RNA, 64 nt, Human; identical to SEQ ID NO: 77273

SEQ ID NO: 194715 - RNA, 64 nt, Human; identical to SEQ ID NO: 77274

SEQ ID NO: 194716 - RNA, 64 nt, Human; identical to SEQ ID NO: 77275

SEQ ID NO: 194717 - RNA, 64 nt, Human; identical to SEQ ID NO: 77276

SEQ ID NO: 194718 - RNA, 64 nt, Human; identical to SEQ ID NO: 77277

SEQ ID NO: 194719 - RNA, 64 nt, Human; identical to SEQ ID NO: 77278

SEQ ID NO: 194720 - RNA, 64 nt, Human; identical to SEQ ID NO: 77279

SEQ ID NO: 194721 - RNA, 64 nt, Human; identical to SEQ ID NO: 77280

SEQ ID NO: 194722 - RNA, 64 nt, Human; identical to SEQ ID NO: 77281

SEQ ID NO: 194723 - RNA, 64 nt, Human; identical to SEQ ID NO: 77282

SEQ ID NO: 194724 - RNA, 64 nt, Human; identical to SEQ ID NO: 77283

SEQ ID NO: 194725 - RNA, 64 nt, Human; identical to SEQ ID NO: 77284

SEQ ID NO: 194726 - RNA, 64 nt, Human; identical to SEQ ID NO: 77285

SEQ ID NO: 194727 - RNA, 64 nt, Human
aagaggauaaggaugcuuaaaauggaaaucauucuccaacgauauacaaauuggacuuguucaa

SEQ ID NO: 194728 - RNA, 64 nt, Human
gaccauuggugaggauagauauaaaaucacuucuuccaacgaagccuaggugaaaaucuauuua

SEQ ID NO: 194729 - RNA, 64 nt, Human
cccaaaguauuaaugcaacugaagcugugauauuuccaacgacuguaggaggaaaaauuaaggg

SEQ ID NO: 194730 - RNA, 64 nt, Human; identical to SEQ ID NO: 77286

SEQ ID NO: 194731 - RNA, 64 nt, Human; identical to SEQ ID NO: 77287

SEQ ID NO: 194732 - RNA, 64 nt, Human; identical to SEQ ID NO: 77288

SEQ ID NO: 194733 - RNA, 64 nt, Human; identical to SEQ ID NO: 77289

SEQ ID NO: 194734 - RNA, 64 nt, Human; identical to SEQ ID NO: 77290

SEQ ID NO: 194735 - RNA, 64 nt, Human; identical to SEQ ID NO: 77291

SEQ ID NO: 194736 - RNA, 64 nt, Human; identical to SEQ ID NO: 77292

SEQ ID NO: 194737 - RNA, 64 nt, Human; identical to SEQ ID NO: 77293

SEQ ID NO: 194738 - RNA, 64 nt, Human; identical to SEQ ID NO: 77294

SEQ ID NO: 194739 - RNA, 64 nt, Human; identical to SEQ ID NO: 77295

SEQ ID NO: 194740 - RNA, 64 nt, Human; identical to SEQ ID NO: 77296

SEQ ID NO: 194741 - RNA, 64 nt, Human; identical to SEQ ID NO: 77297

SEQ ID NO: 194742 - RNA, 64 nt, Human; identical to SEQ ID NO: 77298

SEQ ID NO: 194743 - RNA, 64 nt, Human; identical to SEQ ID NO: 77299

SEQ ID NO: 194744 - RNA, 64 nt, Human; identical to SEQ ID NO: 77300

SEQ ID NO: 194745 - RNA, 64 nt, Human; identical to SEQ ID NO: 77301

SEQ ID NO: 194746 - RNA, 64 nt, Human
cgcccuggccuuccgcacccucgucacccgcaucuccaacgaccucgagcucugagccaccacg

SEQ ID NO: 194747 - RNA, 64 nt, Human
gaucuuggcucacugcaaccuccgccuccuggguuccaacgauucuccugccucagccucccga

SEQ ID NO: 194748 - RNA, 64 nt, Human
ggaggaugaaggagugcgugccugcuacgaacgcuccaacgaguaccagcugauugacugugcc

SEQ ID NO: 194749 - RNA, 64 nt, Human; identical to SEQ ID NO: 77302

SEQ ID NO: 194750 - RNA, 64 nt, Human; identical to SEQ ID NO: 77303

SEQ ID NO: 194751 - RNA, 64 nt, Human; identical to SEQ ID NO: 77304

SEQ ID NO: 194752 - RNA, 64 nt, Human; identical to SEQ ID NO: 77305

SEQ ID NO: 194753 - RNA, 64 nt, Human; identical to SEQ ID NO: 77306

SEQ ID NO: 194754 - RNA, 64 nt, Human; identical to SEQ ID NO: 77307

SEQ ID NO: 194755 - RNA, 64 nt, Human; identical to SEQ ID NO: 77308

SEQ ID NO: 194756 - RNA, 64 nt, Human; identical to SEQ ID NO: 77309

SEQ ID NO: 194757 - RNA, 64 nt, Human; identical to SEQ ID NO: 77310

SEQ ID NO: 194758 - RNA, 64 nt, Human; identical to SEQ ID NO: 77311

SEQ ID NO: 194759 - RNA, 64 nt, Human; identical to SEQ ID NO: 77312

SEQ ID NO: 194760 - RNA, 64 nt, Human; identical to SEQ ID NO: 77313

SEQ ID NO: 194761 - RNA, 64 nt, Human; identical to SEQ ID NO: 77314

SEQ ID NO: 194762 - RNA, 64 nt, Human; identical to SEQ ID NO: 77315

SEQ ID NO: 194763 - RNA, 64 nt, Human; identical to SEQ ID NO: 77316

SEQ ID NO: 194764 - RNA, 64 nt, Human; identical to SEQ ID NO: 77317

SEQ ID NO: 194765 - RNA, 64 nt, Human
aaucucagcucacugcaagcucugccucccagguuccaacgauugucuugucucagccuccuga

SEQ ID NO: 194766 - RNA, 64 nt, Human
uggguaaccggaccaggccaagggucuacaauucuccaacgaauagcuccucuacccaagauuc

SEQ ID NO: 194767 - RNA, 59 nt, Human
agggagaggaugacuuucucaaucaagugccaccagauaaaaacaacugcagaggcugg

SEQ ID NO: 194768 - RNA, 64 nt, Human; identical to SEQ ID NO: 77318

SEQ ID NO: 194769 - RNA, 64 nt, Human; identical to SEQ ID NO: 77319

SEQ ID NO: 194770 - RNA, 64 nt, Human; identical to SEQ ID NO: 77320

SEQ ID NO: 194771 - RNA, 64 nt, Human; identical to SEQ ID NO: 77321

SEQ ID NO: 194772 - RNA, 64 nt, Human; identical to SEQ ID NO: 77322

SEQ ID NO: 194773 - RNA, 64 nt, Human; identical to SEQ ID NO: 77323

SEQ ID NO: 194774 - RNA, 64 nt, Human; identical to SEQ ID NO: 77324

SEQ ID NO: 194775 - RNA, 64 nt, Human; identical to SEQ ID NO: 77325

SEQ ID NO: 194776 - RNA, 64 nt, Human; identical to SEQ ID NO: 77326

SEQ ID NO: 194777 - RNA, 61 nt, Human; identical to SEQ ID NO: 77327

SEQ ID NO: 194778 - RNA, 64 nt, Human; identical to SEQ ID NO: 77328

SEQ ID NO: 194779 - RNA, 64 nt, Human; identical to SEQ ID NO: 77329

SEQ ID NO: 194780 - RNA, 64 nt, Human; identical to SEQ ID NO: 77330

SEQ ID NO: 194781 - RNA, 64 nt, Human; identical to SEQ ID NO: 77331

SEQ ID NO: 194782 - RNA, 64 nt, Human; identical to SEQ ID NO: 77332

SEQ ID NO: 194783 - RNA, 64 nt, Human; identical to SEQ ID NO: 77333

SEQ ID NO: 194784 - RNA, 64 nt, Human
gccacuucccaggguggagacaguggaaaagaaccgaggacaggaaaggauuggguaggugaag

SEQ ID NO: 194785 - RNA, 64 nt, Human; identical to SEQ ID NO: 191805

SEQ ID NO: 194786 - RNA, 64 nt, Human
cgggugcccggcacaccugaaaguucuaaggggccgaggacaucagugaagcagcagugaaacc

SEQ ID NO: 194787 - RNA, 64 nt, Human; identical to SEQ ID NO: 77334

SEQ ID NO: 194788 - RNA, 64 nt, Human; identical to SEQ ID NO: 77335

SEQ ID NO: 194789 - RNA, 64 nt, Human; identical to SEQ ID NO: 77336

SEQ ID NO: 194790 - RNA, 64 nt, Human; identical to SEQ ID NO: 77337

SEQ ID NO: 194791 - RNA, 64 nt, Human; identical to SEQ ID NO: 77338

SEQ ID NO: 194792 - RNA, 64 nt, Human; identical to SEQ ID NO: 77339

SEQ ID NO: 194793 - RNA, 64 nt, Human; identical to SEQ ID NO: 77340

SEQ ID NO: 194794 - RNA, 64 nt, Human; identical to SEQ ID NO: 77341

SEQ ID NO: 194795 - RNA, 64 nt, Human; identical to SEQ ID NO: 77342

SEQ ID NO: 194796 - RNA, 64 nt, Human; identical to SEQ ID NO: 77343

SEQ ID NO: 194797 - RNA, 64 nt, Human; identical to SEQ ID NO: 77344

SEQ ID NO: 194798 - RNA, 64 nt, Human; identical to SEQ ID NO: 77345

SEQ ID NO: 194799 - RNA, 64 nt, Human; identical to SEQ ID NO: 77346

SEQ ID NO: 194800 - RNA, 64 nt, Human; identical to SEQ ID NO: 77347

SEQ ID NO: 194801 - RNA, 64 nt, Human; identical to SEQ ID NO: 77348

SEQ ID NO: 194802 - RNA, 64 nt, Human; identical to SEQ ID NO: 77349

SEQ ID NO: 194803 - RNA, 64 nt, Human
agggggacgugaaaucacugccuguuguggucuccgaggacacaugguaauggugaugcugugc

SEQ ID NO: 194804 - RNA, 64 nt, Human; identical to SEQ ID NO: 191806

SEQ ID NO: 194805 - RNA, 64 nt, Human
aacgggaagcacaugagaggugggcacccggugccgaggacauggacgagggacugguggcugg

SEQ ID NO: 194806 - RNA, 64 nt, Human; identical to SEQ ID NO: 77350

SEQ ID NO: 194807 - RNA, 64 nt, Human; identical to SEQ ID NO: 77351

SEQ ID NO: 194808 - RNA, 64 nt, Human; identical to SEQ ID NO: 77352

SEQ ID NO: 194809 - RNA, 64 nt, Human; identical to SEQ ID NO: 77353

SEQ ID NO: 194810 - RNA, 64 nt, Human; identical to SEQ ID NO: 77354

SEQ ID NO: 194811 - RNA, 64 nt, Human; identical to SEQ ID NO: 77355

SEQ ID NO: 194812 - RNA, 64 nt, Human; identical to SEQ ID NO: 77356

SEQ ID NO: 194813 - RNA, 64 nt, Human; identical to SEQ ID NO: 77357

SEQ ID NO: 194814 - RNA, 64 nt, Human; identical to SEQ ID NO: 77358

SEQ ID NO: 194815 - RNA, 64 nt, Human; identical to SEQ ID NO: 77359

SEQ ID NO: 194816 - RNA, 64 nt, Human; identical to SEQ ID NO: 77360

SEQ ID NO: 194817 - RNA, 64 nt, Human; identical to SEQ ID NO: 77361

SEQ ID NO: 194818 - RNA, 64 nt, Human; identical to SEQ ID NO: 77362

SEQ ID NO: 194819 - RNA, 64 nt, Human; identical to SEQ ID NO: 77363

SEQ ID NO: 194820 - RNA, 64 nt, Human; identical to SEQ ID NO: 77364

SEQ ID NO: 194821 - RNA, 64 nt, Human; identical to SEQ ID NO: 77365

SEQ ID NO: 194822 - RNA, 64 nt, Human
gguggaggagaugcagggccaccugaagcgggccuccaacgagagcacccgccagaggcugcag

SEQ ID NO: 194823 - RNA, 64 nt, Human
ccgggauuuucuacccagagaccugcauguucucuccaacgaccagaauauucuacccaaaugu

SEQ ID NO: 194824 - RNA, 64 nt, Human
uucugaguaucugaccuaccuaauuggccuggagcgaggacagcugccaugagucagcucuaau

SEQ ID NO: 194825 - RNA, 64 nt, Human; identical to SEQ ID NO: 77366

SEQ ID NO: 194826 - RNA, 64 nt, Human; identical to SEQ ID NO: 77367

SEQ ID NO: 194827 - RNA, 64 nt, Human; identical to SEQ ID NO: 77368

SEQ ID NO: 194828 - RNA, 64 nt, Human; identical to SEQ ID NO: 77369

SEQ ID NO: 194829 - RNA, 64 nt, Human; identical to SEQ ID NO: 77370

SEQ ID NO: 194830 - RNA, 64 nt, Human; identical to SEQ ID NO: 77371

SEQ ID NO: 194831 - RNA, 64 nt, Human; identical to SEQ ID NO: 77372

SEQ ID NO: 194832 - RNA, 64 nt, Human; identical to SEQ ID NO: 77373

SEQ ID NO: 194833 - RNA, 64 nt, Human; identical to SEQ ID NO: 77374

SEQ ID NO: 194834 - RNA, 64 nt, Human; identical to SEQ ID NO: 77375

SEQ ID NO: 194835 - RNA, 64 nt, Human; identical to SEQ ID NO: 77376

SEQ ID NO: 194836 - RNA, 64 nt, Human; identical to SEQ ID NO: 77377

SEQ ID NO: 194837 - RNA, 64 nt, Human; identical to SEQ ID NO: 77378

SEQ ID NO: 194838 - RNA, 64 nt, Human; identical to SEQ ID NO: 77379

SEQ ID NO: 194839 - RNA, 64 nt, Human; identical to SEQ ID NO: 77380

SEQ ID NO: 194840 - RNA, 64 nt, Human; identical to SEQ ID NO: 77381

SEQ ID NO: 194841 - RNA, 64 nt, Human
aguugcaguagccccuacugcuuuagcuuuggccuccaacgauucugugcuauagauacagcac

SEQ ID NO: 194842 - RNA, 64 nt, Human
ggccggagggcggguacaaggcugucugguuuggcgaggacaucgggacggaggcagacguggu

SEQ ID NO: 194843 - RNA, 64 nt, Human
aggcacagcagccuguaucucugaggaagaggagcgaggacaacguuggcccagaugggggcug

SEQ ID NO: 194844 - RNA, 64 nt, Human; identical to SEQ ID NO: 77382

SEQ ID NO: 194845 - RNA, 64 nt, Human; identical to SEQ ID NO: 77383

SEQ ID NO: 194846 - RNA, 64 nt, Human; identical to SEQ ID NO: 77384

SEQ ID NO: 194847 - RNA, 64 nt, Human; identical to SEQ ID NO: 77385

SEQ ID NO: 194848 - RNA, 64 nt, Human; identical to SEQ ID NO: 77386

SEQ ID NO: 194849 - RNA, 57 nt, Human; identical to SEQ ID NO: 77387

SEQ ID NO: 194850 - RNA, 64 nt, Human; identical to SEQ ID NO: 77388

SEQ ID NO: 194851 - RNA, 64 nt, Human; identical to SEQ ID NO: 77389

SEQ ID NO: 194852 - RNA, 64 nt, Human; identical to SEQ ID NO: 77390

SEQ ID NO: 194853 - RNA, 64 nt, Human; identical to SEQ ID NO: 77391

SEQ ID NO: 194854 - RNA, 55 nt, Human; identical to SEQ ID NO: 77392

SEQ ID NO: 194855 - RNA, 64 nt, Human; identical to SEQ ID NO: 77393

SEQ ID NO: 194856 - RNA, 64 nt, Human; identical to SEQ ID NO: 77394

SEQ ID NO: 194857 - RNA, 64 nt, Human; identical to SEQ ID NO: 77395

SEQ ID NO: 194858 - RNA, 64 nt, Human; identical to SEQ ID NO: 77396

SEQ ID NO: 194859 - RNA, 64 nt, Human; identical to SEQ ID NO: 77397

SEQ ID NO: 194860 - RNA, 64 nt, Human
ugacguggucucagauauugaugcaaaaaauuuuuccaacgaacuccgcauuguccauuaguga

SEQ ID NO: 194861 - RNA, 59 nt, Human
ccccugccgccucccgggaagcauccuccccaccagagcugccuccccaauccauuugg

SEQ ID NO: 194862 - RNA, 59 nt, Human
aggcagcgccuguccccucacagacucuuccaccagagcaggggcugcugggggcuccc

SEQ ID NO: 194863 - RNA, 64 nt, Human; identical to SEQ ID NO: 77398

SEQ ID NO: 194864 - RNA, 64 nt, Human; identical to SEQ ID NO: 77399

SEQ ID NO: 194865 - RNA, 64 nt, Human; identical to SEQ ID NO: 77400

SEQ ID NO: 194866 - RNA, 64 nt, Human; identical to SEQ ID NO: 77401

SEQ ID NO: 194867 - RNA, 64 nt, Human; identical to SEQ ID NO: 77402

SEQ ID NO: 194868 - RNA, 64 nt, Human; identical to SEQ ID NO: 77403

SEQ ID NO: 194869 - RNA, 64 nt, Human; identical to SEQ ID NO: 77404

SEQ ID NO: 194870 - RNA, 64 nt, Human; identical to SEQ ID NO: 77405

SEQ ID NO: 194871 - RNA, 64 nt, Human; identical to SEQ ID NO: 77406

SEQ ID NO: 194872 - RNA, 64 nt, Human; identical to SEQ ID NO: 77407

SEQ ID NO: 194873 - RNA, 64 nt, Human; identical to SEQ ID NO: 77408

SEQ ID NO: 194874 - RNA, 64 nt, Human; identical to SEQ ID NO: 77409

SEQ ID NO: 194875 - RNA, 64 nt, Human; identical to SEQ ID NO: 77410

SEQ ID NO: 194876 - RNA, 64 nt, Human; identical to SEQ ID NO: 77411

SEQ ID NO: 194877 - RNA, 64 nt, Human; identical to SEQ ID NO: 77412

SEQ ID NO: 194878 - RNA, 64 nt, Human; identical to SEQ ID NO: 77413

SEQ ID NO: 194879 - RNA, 64 nt, Human
uuucgaagcauuauuuuuuuaaagaguguuuuacuccaacgauugaaacauuuuccuauuuaaa

SEQ ID NO: 194880 - RNA, 64 nt, Human
accggccuguuuaugaggggaaggaugguaccaucgaggacaucaucacagguggggcccuuuu

SEQ ID NO: 194881 - RNA, 64 nt, Human
cagugguguccaucacauauauuauagaagcaagcgaggacauuccacccuagaaaugguucag

SEQ ID NO: 194882 - RNA, 64 nt, Human; identical to SEQ ID NO: 77414

SEQ ID NO: 194883 - RNA, 64 nt, Human; identical to SEQ ID NO: 77415

SEQ ID NO: 194884 - RNA, 64 nt, Human; identical to SEQ ID NO: 77416

SEQ ID NO: 194885 - RNA, 64 nt, Human; identical to SEQ ID NO: 77417

SEQ ID NO: 194886 - RNA, 64 nt, Human; identical to SEQ ID NO: 77418

SEQ ID NO: 194887 - RNA, 64 nt, Human; identical to SEQ ID NO: 77419

SEQ ID NO: 194888 - RNA, 64 nt, Human; identical to SEQ ID NO: 77420

SEQ ID NO: 194889 - RNA, 64 nt, Human; identical to SEQ ID NO: 77421

SEQ ID NO: 194890 - RNA, 64 nt, Human; identical to SEQ ID NO: 77422

SEQ ID NO: 194891 - RNA, 64 nt, Human; identical to SEQ ID NO: 77423

SEQ ID NO: 194892 - RNA, 64 nt, Human; identical to SEQ ID NO: 77424

SEQ ID NO: 194893 - RNA, 64 nt, Human; identical to SEQ ID NO: 77425

SEQ ID NO: 194894 - RNA, 64 nt, Human; identical to SEQ ID NO: 77426

SEQ ID NO: 194895 - RNA, 64 nt, Human; identical to SEQ ID NO: 77427

SEQ ID NO: 194896 - RNA, 64 nt, Human; identical to SEQ ID NO: 77428

SEQ ID NO: 194897 - RNA, 64 nt, Human; identical to SEQ ID NO: 77429

SEQ ID NO: 194898 - RNA, 64 nt, Human
auguacagaacuuuaaacaauauaguauuuauggcgaggacagcuguagucuguugugauauuu

SEQ ID NO: 194899 - RNA, 64 nt, Human
gggagggaccuagggccucuuuggaugcugucuucgaggacagcaaugcagagagggcauagga

SEQ ID NO: 194900 - RNA, 64 nt, Human
accccagugcaacaccaaacuucaggggcacaagcgaggacacaucuaagggaccagaauaaga

SEQ ID NO: 194901 - RNA, 64 nt, Human; identical to SEQ ID NO: 77430

SEQ ID NO: 194902 - RNA, 64 nt, Human; identical to SEQ ID NO: 77431

SEQ ID NO: 194903 - RNA, 64 nt, Human; identical to SEQ ID NO: 77432

SEQ ID NO: 194904 - RNA, 64 nt, Human; identical to SEQ ID NO: 77433

SEQ ID NO: 194905 - RNA, 64 nt, Human; identical to SEQ ID NO: 77434

SEQ ID NO: 194906 - RNA, 64 nt, Human; identical to SEQ ID NO: 77435

SEQ ID NO: 194907 - RNA, 64 nt, Human; identical to SEQ ID NO: 77436

SEQ ID NO: 194908 - RNA, 64 nt, Human; identical to SEQ ID NO: 77437

SEQ ID NO: 194909 - RNA, 64 nt, Human; identical to SEQ ID NO: 77438

SEQ ID NO: 194910 - RNA, 64 nt, Human; identical to SEQ ID NO: 77439

SEQ ID NO: 194911 - RNA, 64 nt, Human; identical to SEQ ID NO: 77440

SEQ ID NO: 194912 - RNA, 64 nt, Human; identical to SEQ ID NO: 77441

SEQ ID NO: 194913 - RNA, 64 nt, Human; identical to SEQ ID NO: 77442

SEQ ID NO: 194914 - RNA, 64 nt, Human; identical to SEQ ID NO: 77443

SEQ ID NO: 194915 - RNA, 64 nt, Human; identical to SEQ ID NO: 77444

SEQ ID NO: 194916 - RNA, 64 nt, Human; identical to SEQ ID NO: 77445

SEQ ID NO: 194917 - RNA, 64 nt, Human
cagccccaacgcagucuguguaugauuccugggauccaacgagcccuccuauuuucacaguguu

SEQ ID NO: 194918 - RNA, 64 nt, Human
aaguuuuacagagaggauacauuuaauaaaacugcgaggacaucaaagugguaaauacugugaa

SEQ ID NO: 194919 - RNA, 64 nt, Human
cuugaugccagugcagagaccagagucagaugcccgaggacaguggguaggaauuucaucaaca

SEQ ID NO: 194920 - RNA, 64 nt, Human; identical to SEQ ID NO: 77446

SEQ ID NO: 194921 - RNA, 64 nt, Human; identical to SEQ ID NO: 77447

SEQ ID NO: 194922 - RNA, 64 nt, Human; identical to SEQ ID NO: 77448

SEQ ID NO: 194923 - RNA, 64 nt, Human; identical to SEQ ID NO: 77449

SEQ ID NO: 194924 - RNA, 64 nt, Human; identical to SEQ ID NO: 77450

SEQ ID NO: 194925 - RNA, 64 nt, Human; identical to SEQ ID NO: 77451

SEQ ID NO: 194926 - RNA, 64 nt, Human; identical to SEQ ID NO: 77452

SEQ ID NO: 194927 - RNA, 64 nt, Human; identical to SEQ ID NO: 77453

SEQ ID NO: 194928 - RNA, 64 nt, Human; identical to SEQ ID NO: 77454

SEQ ID NO: 194929 - RNA, 64 nt, Human; identical to SEQ ID NO: 77455

SEQ ID NO: 194930 - RNA, 64 nt, Human; identical to SEQ ID NO: 77456

SEQ ID NO: 194931 - RNA, 64 nt, Human; identical to SEQ ID NO: 77457

SEQ ID NO: 194932 - RNA, 64 nt, Human; identical to SEQ ID NO: 77458

SEQ ID NO: 194933 - RNA, 64 nt, Human; identical to SEQ ID NO: 77459

SEQ ID NO: 194934 - RNA, 64 nt, Human; identical to SEQ ID NO: 77460

SEQ ID NO: 194935 - RNA, 64 nt, Human; identical to SEQ ID NO: 77461

SEQ ID NO: 194936 - RNA, 64 nt, Human
ccacgcauguuugaccaaagcccucauugugguccgaggacagccuuuuccccaggccucagag

SEQ ID NO: 194937 - RNA, 59 nt, Human
cuucccuagaaaggccugacccuccuuacccaccagaacagggguuuugaugcccucac

SEQ ID NO: 194938 - RNA, 64 nt, Human; identical to SEQ ID NO: 77462

SEQ ID NO: 194939 - RNA, 64 nt, Human; identical to SEQ ID NO: 77463

SEQ ID NO: 194940 - RNA, 64 nt, Human; identical to SEQ ID NO: 77464

SEQ ID NO: 194941 - RNA, 64 nt, Human; identical to SEQ ID NO: 77465

SEQ ID NO: 194942 - RNA, 64 nt, Human; identical to SEQ ID NO: 77466

SEQ ID NO: 194943 - RNA, 64 nt, Human; identical to SEQ ID NO: 77467

SEQ ID NO: 194944 - RNA, 64 nt, Human; identical to SEQ ID NO: 77468

SEQ ID NO: 194945 - RNA, 64 nt, Human; identical to SEQ ID NO: 77469

SEQ ID NO: 194946 - RNA, 64 nt, Human; identical to SEQ ID NO: 77470

SEQ ID NO: 194947 - RNA, 64 nt, Human; identical to SEQ ID NO: 77471

SEQ ID NO: 194948 - RNA, 64 nt, Human; identical to SEQ ID NO: 77472

SEQ ID NO: 194949 - RNA, 64 nt, Human; identical to SEQ ID NO: 77473

SEQ ID NO: 194950 - RNA, 64 nt, Human; identical to SEQ ID NO: 77474

SEQ ID NO: 194951 - RNA, 64 nt, Human; identical to SEQ ID NO: 77475

SEQ ID NO: 194952 - RNA, 64 nt, Human; identical to SEQ ID NO: 77476

SEQ ID NO: 194953 - RNA, 64 nt, Human; identical to SEQ ID NO: 77477

SEQ ID NO: 194954 - RNA, 64 nt, Human
caucugaaucccuagacccaucugaugaagaggcaucuucgagcccaaaggagucacgcuggca

SEQ ID NO: 194955 - RNA, 64 nt, Human
agagcagggcgcuucucuugggguggugagaaggaucuucgagaaaucguguucaguauuucaa

SEQ ID NO: 194956 - RNA, 64 nt, Human
gcagcuccaccuuguaaaaaugcugccuuugggaaucuucgaaauauguacacagagaaaauca

SEQ ID NO: 194957 - RNA, 64 nt, Human; identical to SEQ ID NO: 77478

SEQ ID NO: 194958 - RNA, 64 nt, Human; identical to SEQ ID NO: 77479

SEQ ID NO: 194959 - RNA, 64 nt, Human; identical to SEQ ID NO: 77480

SEQ ID NO: 194960 - RNA, 64 nt, Human; identical to SEQ ID NO: 77481

SEQ ID NO: 194961 - RNA, 64 nt, Human; identical to SEQ ID NO: 77482

SEQ ID NO: 194962 - RNA, 64 nt, Human; identical to SEQ ID NO: 77483

SEQ ID NO: 194963 - RNA, 64 nt, Human; identical to SEQ ID NO: 77484

SEQ ID NO: 194964 - RNA, 64 nt, Human; identical to SEQ ID NO: 77485

SEQ ID NO: 194965 - RNA, 64 nt, Human; identical to SEQ ID NO: 77486

SEQ ID NO: 194966 - RNA, 64 nt, Human; identical to SEQ ID NO: 77487

SEQ ID NO: 194967 - RNA, 64 nt, Human; identical to SEQ ID NO: 77488

SEQ ID NO: 194968 - RNA, 64 nt, Human; identical to SEQ ID NO: 77489

SEQ ID NO: 194969 - RNA, 64 nt, Human; identical to SEQ ID NO: 77490

SEQ ID NO: 194970 - RNA, 64 nt, Human; identical to SEQ ID NO: 77491

SEQ ID NO: 194971 - RNA, 64 nt, Human; identical to SEQ ID NO: 77073

SEQ ID NO: 194972 - RNA, 64 nt, Human; identical to SEQ ID NO: 77493

SEQ ID NO: 194973 - RNA, 64 nt, Human
cguccuuguugaagcaguuaccuaguuccuucauuccaacgacugagugaggucuuuauugcca

SEQ ID NO: 194974 - RNA, 64 nt, Human
uacaaaagagaaaagaagaaccucucagugcuuuuccaacgaauguaaaguggguuuaaaaguu

SEQ ID NO: 194975 - RNA, 64 nt, Human; identical to SEQ ID NO: 77494

SEQ ID NO: 194976 - RNA, 64 nt, Human; identical to SEQ ID NO: 77495

SEQ ID NO: 194977 - RNA, 64 nt, Human; identical to SEQ ID NO: 77496

SEQ ID NO: 194978 - RNA, 64 nt, Human; identical to SEQ ID NO: 77497

SEQ ID NO: 194979 - RNA, 64 nt, Human; identical to SEQ ID NO: 77498

SEQ ID NO: 194980 - RNA, 64 nt, Human; identical to SEQ ID NO: 77499

SEQ ID NO: 194981 - RNA, 64 nt, Human; identical to SEQ ID NO: 77500

SEQ ID NO: 194982 - RNA, 64 nt, Human; identical to SEQ ID NO: 77501

SEQ ID NO: 194983 - RNA, 64 nt, Human; identical to SEQ ID NO: 77502

SEQ ID NO: 194984 - RNA, 64 nt, Human; identical to SEQ ID NO: 77503

SEQ ID NO: 194985 - RNA, 64 nt, Human; identical to SEQ ID NO: 77504

SEQ ID NO: 194986 - RNA, 64 nt, Human; identical to SEQ ID NO: 77505

SEQ ID NO: 194987 - RNA, 64 nt, Human; identical to SEQ ID NO: 77506

SEQ ID NO: 194988 - RNA, 64 nt, Human; identical to SEQ ID NO: 77507

SEQ ID NO: 194989 - RNA, 64 nt, Human; identical to SEQ ID NO: 77508

SEQ ID NO: 194990 - RNA, 64 nt, Human; identical to SEQ ID NO: 77509

SEQ ID NO: 194991 - RNA, 64 nt, Human; identical to SEQ ID NO: 191807

SEQ ID NO: 194992 - RNA, 64 nt, Human
gaggggacuuucuauguucacgucccaccuucuucgaggacaugaccaagggacaggaucauac

SEQ ID NO: 194993 - RNA, 64 nt, Human
gugagaucaacacguacuggggccugcuggacagcgaggacagcaggcaaguuccacaguuacu

SEQ ID NO: 194994 - RNA, 64 nt, Human; identical to SEQ ID NO: 77510

SEQ ID NO: 194995 - RNA, 64 nt, Human; identical to SEQ ID NO: 77511

SEQ ID NO: 194996 - RNA, 64 nt, Human; identical to SEQ ID NO: 77512

SEQ ID NO: 194997 - RNA, 64 nt, Human; identical to SEQ ID NO: 77513

SEQ ID NO: 194998 - RNA, 64 nt, Human; identical to SEQ ID NO: 77514

SEQ ID NO: 194999 - RNA, 64 nt, Human; identical to SEQ ID NO: 77515

SEQ ID NO: 195000 - RNA, 64 nt, Human; identical to SEQ ID NO: 77516

SEQ ID NO: 195001 - RNA, 64 nt, Human; identical to SEQ ID NO: 77517

SEQ ID NO: 195002 - RNA, 64 nt, Human; identical to SEQ ID NO: 77518

SEQ ID NO: 195003 - RNA, 64 nt, Human; identical to SEQ ID NO: 77519

SEQ ID NO: 195004 - RNA, 64 nt, Human; identical to SEQ ID NO: 77520

SEQ ID NO: 195005 - RNA, 64 nt, Human; identical to SEQ ID NO: 77521

SEQ ID NO: 195006 - RNA, 64 nt, Human; identical to SEQ ID NO: 77522

SEQ ID NO: 195007 - RNA, 64 nt, Human; identical to SEQ ID NO: 77523

SEQ ID NO: 195008 - RNA, 64 nt, Human; identical to SEQ ID NO: 77524

SEQ ID NO: 195009 - RNA, 64 nt, Human; identical to SEQ ID NO: 77525

SEQ ID NO: 195010 - RNA, 64 nt, Human
ggccuauuuccauagauagcuuuuuuuguuuguuuccaacgaagcugcuguuaaacgaaacuga

SEQ ID NO: 195011 - RNA, 64 nt, Human
uuccaugaguuuuuuaguuucacaguuuuacagauccaacgacacaaucuuuuaaucuuugguc

SEQ ID NO: 195012 - RNA, 64 nt, Human
gaguucuuguuuuccucuguucuuucaaguugucuccaacgaacagaaaacuauaaacuuacug

SEQ ID NO: 195013 - RNA, 64 nt, Human; identical to SEQ ID NO: 77526

SEQ ID NO: 195014 - RNA, 64 nt, Human; identical to SEQ ID NO: 77527

SEQ ID NO: 195015 - RNA, 64 nt, Human; identical to SEQ ID NO: 77528

SEQ ID NO: 195016 - RNA, 64 nt, Human; identical to SEQ ID NO: 77529

SEQ ID NO: 195017 - RNA, 64 nt, Human; identical to SEQ ID NO: 77530

SEQ ID NO: 195018 - RNA, 64 nt, Human; identical to SEQ ID NO: 77531

SEQ ID NO: 195019 - RNA, 64 nt, Human; identical to SEQ ID NO: 77532

SEQ ID NO: 195020 - RNA, 64 nt, Human; identical to SEQ ID NO: 77533

SEQ ID NO: 195021 - RNA, 64 nt, Human; identical to SEQ ID NO: 77534

SEQ ID NO: 195022 - RNA, 64 nt, Human; identical to SEQ ID NO: 77535

SEQ ID NO: 195023 - RNA, 64 nt, Human; identical to SEQ ID NO: 77536

SEQ ID NO: 195024 - RNA, 64 nt, Human; identical to SEQ ID NO: 77537

SEQ ID NO: 195025 - RNA, 64 nt, Human
cugaucuccaccucaaaugacaauaaaaaacugguccaacgaagacacugcucagcacuucagc

SEQ ID NO: 195026 - RNA, 64 nt, Human; identical to SEQ ID NO: 194690

SEQ ID NO: 195027 - RNA, 64 nt, Human
accuccugaggcugugggccacagccaccucugcaucuucgaacucagccauguggucaacauc

SEQ ID NO: 195028 - RNA, 64 nt, Human
cucagcagucggaggcacagaagcugcaaaagggaucuucgaaacugggcagagaaaaaauaaa

SEQ ID NO: 195029 - RNA, 64 nt, Human
cuaccucagagggauuuggugaagcaaacuguuaaucuucgaaaacgaccauuucacuucuugg

SEQ ID NO: 195030 - RNA, 64 nt, Human
uugguuuauguucugauuugacacacugauuuuaaucuucgaaucaugacacugagugcagagg

SEQ ID NO: 195031 - RNA, 64 nt, Human
uuuggauuuacaaugacaggguaauauuuuauuuaucuucgaauuccauggacaaaauuaggcu

SEQ ID NO: 195032 - RNA, 64 nt, Human
cccagcuuucgggacccucccgcgugccgaacugaucuucgagcugcauggaccuaaucacaga

SEQ ID NO: 195033 - RNA, 64 nt, Human
ucgaaacaaacagacuugacuguugcucaaucuaaucuucgauggaaauucuaaaaauuaauac

SEQ ID NO: 195034 - RNA, 64 nt, Human
uuagaaaugagaccacacaccuauaauuuuuuugaucuucgaugaaccugacaaaaacaagcaa

SEQ ID NO: 195035 - RNA, 64 nt, Human
guuguaguuaaaggaauuucauuuuuuaaaagaaaucuucgaaggugugguuuucauuucucag

SEQ ID NO: 195036 - RNA, 64 nt, Human
guggauguagugauugauccuuaccuuguauaucaucuucgaccacaucagaaagaaggaauca

SEQ ID NO: 195037 - RNA, 64 nt, Human
gaauuuugugugauuggcuuaaauccaguuuucaaucuucgacagcugggcuggaacgugaacu

SEQ ID NO: 195038 - RNA, 64 nt, Human
uuacacagcacauaccacagguucuggaauucucaucuucgaaccuagagaaauaggugcuaua

SEQ ID NO: 195039 - RNA, 64 nt, Human
cuuaguucccaaauaaaucaauccugucuuucccaucuucgauguugcuaauauuaaggcuuca

SEQ ID NO: 195040 - RNA, 64 nt, Human
agcucugagugaaaaaucaaaagagacaaaagacaucuucgaauccauauuucaagccugguag

SEQ ID NO: 195041 - RNA, 64 nt, Human
agccugccugcugccucggaacugugacacccccaucuucgacuucagagucuucuuccaaggu

SEQ ID NO: 195042 - RNA, 64 nt, Human
aaguuuauuuuuaaaagcugacaacuuuuuaugaaucuucgaguugacaguuccuaaaagcgua

SEQ ID NO: 195043 - RNA, 64 nt, Human
gcugacucaaaacuagauagaaaaauauaaaauaaucuucgaccacuugauagcucucaaauau

SEQ ID NO: 195044 - RNA, 64 nt, Human
ccacgguugugccuuauuguuccauuaaaauuguaucuucgauccaucaauaaauacuuguggu

SEQ ID NO: 195045 - RNA, 64 nt, Human
ucccgucagccacccagucugagaugcugacguuaucuucgacuauucuucccuguccugccuu

SEQ ID NO: 195046 - RNA, 64 nt, Human
gucacccccaccccgcggaucacagcucacccacgcggcgcacaccccuccugccguugucauc

SEQ ID NO: 195047 - RNA, 64 nt, Human
gggccaccgagaggccgaagaaggccaaggaggagcggcgcauggaccagguaggccugcggcu

SEQ ID NO: 195048 - RNA, 64 nt, Human
acagggaugcucacgggugcaccaggagccaggugcggcgcagccaacccugagccugcaggga

SEQ ID NO: 195049 - RNA, 64 nt, Human
uaccugggcacgccagucugcaccaugugucccugcggcgcaugagugacuggcguauuuagcc

SEQ ID NO: 195050 - RNA, 64 nt, Human
acuaaaaaugcaaaaaaaaauuuagcuaggcauggcggcgcaugccugcaaucccagcuacuug

SEQ ID NO: 195051 - RNA, 64 nt, Human
agggccaaagcacagcugggcaugccaugucugagcggcgcagagcccuccaggccugcagggg

SEQ ID NO: 195052 - RNA, 64 nt, Human
aucaaguagcugcuggauguugacgaaggaagcggcggcgcagcucagggaucuccgagucagg

SEQ ID NO: 195053 - RNA, 64 nt, Human
ccuagagugcuguggacuggacccaggagccccggcggcgcagcugcaagguugccaggaccca

SEQ ID NO: 195054 - RNA, 64 nt, Human
ggccucuccugccccaggaggacaucucacggcugcggcgcaagcuggaaaagcagaggaaggu

SEQ ID NO: 195055 - RNA, 64 nt, Human
ccaucugcaccgacgccugcccccgucccaccucgcggcgcagccccuggagcuccugcugggg

SEQ ID NO: 195056 - RNA, 64 nt, Human
ggugugcagccucucaucucacacugugaguccagcggcgcagggugguaccaggaaagaggau

SEQ ID NO: 195057 - RNA, 64 nt, Human
aggaguuucacuacaaucgcuaccugacgcggcggcggcgcaucgagaucgcgcacgcccugug

SEQ ID NO: 195058 - RNA, 64 nt, Human
ggggggcgugcucucgggggggccucacgcacccgcggcgcaggagcuucaguggucuggggcc

SEQ ID NO: 195059 - RNA, 64 nt, Human
cuaagccagcccacccugggcugggcccaggugcgcggcgcagagccuuugggaauaaaaagcc

SEQ ID NO: 195060 - RNA, 64 nt, Human
uggacagcgagcugggcaccugggagcaccagcugcggcgcauggagauggauaagaccagggg

SEQ ID NO: 195061 - RNA, 64 nt, Human
aaaauuuuuuuuuauagcaauggcaacaagugaacgaggacaaccaccaccauguucuaacaug

SEQ ID NO: 195062 - RNA, 64 nt, Human; identical to SEQ ID NO: 191843

SEQ ID NO: 195063 - RNA, 64 nt, Human
cgggaagggaagauggauguaaagugugggagaccgaggacacaguggagcccacgagcacgag

SEQ ID NO: 195064 - RNA, 64 nt, Human
cagccauuccugcagccaagggcacugggccagggcggcgcacgcgcaagaggcgcgcuucgag

SEQ ID NO: 195065 - RNA, 64 nt, Human
uuuuuugaggagagugaaagagaguaccaugcuggcggcgcagagggaaggggccuacacccgu

SEQ ID NO: 195066 - RNA, 64 nt, Human
aagggguggggccgaggaugcaaguccaggcagagcggcgcaggcagcugugagcuuuucucca

SEQ ID NO: 195067 - RNA, 64 nt, Human
cgcguggagacuuaugacucgucgugggcgcauggcggcgcaccugcugcaggagcggccacgu

SEQ ID NO: 195068 - RNA, 64 nt, Human
agacgcaggccucuccauuguccaggggagccuggcggcgcaucccuccucucccaccuccugg

SEQ ID NO: 195069 - RNA, 64 nt, Human
ccaugccagggaaaggaagagcuccccugaaucccgaggacacaguccccugcguacuugcuca

SEQ ID NO: 195070 - RNA, 64 nt, Human
cagagcauucugugcccagggacaggacagaucucgaggacaccacaguccaccuguucccguc

SEQ ID NO: 195071 - RNA, 64 nt, Human; identical to SEQ ID NO: 191844

SEQ ID NO: 195072 - RNA, 64 nt, Human
ccucgaaggagcagccugggcagccaucacaccacgaggacaggaagcaccagcacguuucaca

SEQ ID NO: 195073 - RNA, 64 nt, Human
aggaagaggaggaggaggaggaggaggaggaaggcgaggacaguggcacuucagcugccagcuc

SEQ ID NO: 195074 - RNA, 64 nt, Human
cgggcagcuggggggcugagagcacccagaggaccgaggacaggggccggacauuggggcauua

SEQ ID NO: 195075 - RNA, 64 nt, Human
aaagagucgacuauacaaaaaucaaucaccaccacgaggacaagagggcaaaagcaaaacagac

SEQ ID NO: 195076 - RNA, 64 nt, Human
agagucaccgucauucugaggucaaaucauggcccgaggacaagggcuguaagacagggagccc

SEQ ID NO: 195077 - RNA, 64 nt, Human
auuuaucgcaaaaacugaagguuugcgcaagagacgaggacagcggaaaguggaccugccaggc

SEQ ID NO: 195078 - RNA, 64 nt, Human
acagcaccugcacgaacacccgccgaaacugcugcgaggacaccguguacaggagcggguugau

SEQ ID NO: 195079 - RNA, 64 nt, Human
ucacggaaagugccugcaaaaacagagguggauacgaggacagguuggagcugcagggacuggc

SEQ ID NO: 195080 - RNA, 64 nt, Human
gugaggaugucaggaugagaugggaccagguagccgaggacagugaggcaugucugagccacuu

SEQ ID NO: 195081 - RNA, 64 nt, Human
cugagggaccuuggagagcucaggauggcucagacgaggacacucgcuugccgggccugggccu

SEQ ID NO: 195082 - RNA, 64 nt, Human; identical to SEQ ID NO: 192582

SEQ ID NO: 195083 - RNA, 64 nt, Human; identical to SEQ ID NO: 191787

SEQ ID NO: 195084 - RNA, 64 nt, Human
caccuagccaggagggguagcaaaaauaaagucacgaggacauaguggucaccacugucaguua

SEQ ID NO: 195085 - RNA, 64 nt, Human
uaaaugccugucuccccgcggaucaugggcuccucgaggacagggacuggccugucuguccacu

SEQ ID NO: 195086 - RNA, 64 nt, Human
cgucacugucuccacgccgugauggcagcgcugccgaggacauaggaaccacgacuggaaagau

SEQ ID NO: 195087 - RNA, 61 nt, Human
ccuaugucauucggaucugaggcuccccaaacgaggacacgacggccaagguggcaguuug

SEQ ID NO: 195088 - RNA, 64 nt, Human
gaaggaggcagagcuguccgugggagguggaggccgaggacauuuuccugaagggcagggguug

SEQ ID NO: 195089 - RNA, 64 nt, Human; identical to SEQ ID NO: 191788

SEQ ID NO: 195090 - RNA, 63 nt, Human
gaccagccucugaaaccuaacuaugcagcagugcgaggacaaaagaucauggaguggucaaaa

SEQ ID NO: 195091 - RNA, 64 nt, Human
uccuaaaccaaaagugcuuuaaaaaccagccuggcgaggacagcccuggacccacuccacuguc

SEQ ID NO: 195092 - RNA, 64 nt, Human; identical to SEQ ID NO: 94676

SEQ ID NO: 195093 - RNA, 64 nt, Human; identical to SEQ ID NO: 94677

SEQ ID NO: 195094 - RNA, 59 nt, Human; identical to SEQ ID NO: 94678

SEQ ID NO: 195095 - RNA, 64 nt, Human; identical to SEQ ID NO: 94679

SEQ ID NO: 195096 - RNA, 64 nt, Human; identical to SEQ ID NO: 94680

SEQ ID NO: 195097 - RNA, 64 nt, Human; identical to SEQ ID NO: 94681

SEQ ID NO: 195098 - RNA, 64 nt, Human; identical to SEQ ID NO: 94682

SEQ ID NO: 195099 - RNA, 64 nt, Human; identical to SEQ ID NO: 94683

SEQ ID NO: 195100 - RNA, 64 nt, Human; identical to SEQ ID NO: 94684

SEQ ID NO: 195101 - RNA, 64 nt, Human; identical to SEQ ID NO: 94685

SEQ ID NO: 195102 - RNA, 64 nt, Human; identical to SEQ ID NO: 94686

SEQ ID NO: 195103 - RNA, 64 nt, Human; identical to SEQ ID NO: 94687

SEQ ID NO: 195104 - RNA, 64 nt, Human; identical to SEQ ID NO: 94688

SEQ ID NO: 195105 - RNA, 64 nt, Human; identical to SEQ ID NO: 94689

SEQ ID NO: 195106 - RNA, 64 nt, Human; identical to SEQ ID NO: 94690

SEQ ID NO: 195107 - RNA, 64 nt, Human; identical to SEQ ID NO: 94691

SEQ ID NO: 195108 - RNA, 63 nt, Human
ccccacccuccaacacgugcucaccugucccccuccucgcagcagccucgggacaaaacaaug

SEQ ID NO: 195109 - RNA, 63 nt, Human
gggaugcacggcggcagggugggggagggagguuccucgcaggucucagcccgggacaggguc

SEQ ID NO: 195110 - RNA, 63 nt, Human
cagccuuaagaaccaucugccaaaaauuacugauccucgcaugauggcagccauagugcauag

SEQ ID NO: 195111 - RNA, 63 nt, Human
caguaguuguccgugauaaucguguccugaaaauccucgcacacacuggcugguggagaacuc

SEQ ID NO: 195112 - RNA, 64 nt, Human; identical to SEQ ID NO: 94692

SEQ ID NO: 195113 - RNA, 64 nt, Human; identical to SEQ ID NO: 94693

SEQ ID NO: 195114 - RNA, 64 nt, Human; identical to SEQ ID NO: 94694

SEQ ID NO: 195115 - RNA, 64 nt, Human; identical to SEQ ID NO: 94695

SEQ ID NO: 195116 - RNA, 64 nt, Human; identical to SEQ ID NO: 94696

SEQ ID NO: 195117 - RNA, 64 nt, Human; identical to SEQ ID NO: 94697

SEQ ID NO: 195118 - RNA, 64 nt, Human; identical to SEQ ID NO: 94698

SEQ ID NO: 195119 - RNA, 64 nt, Human; identical to SEQ ID NO: 94699

SEQ ID NO: 195120 - RNA, 64 nt, Human; identical to SEQ ID NO: 94700

SEQ ID NO: 195121 - RNA, 64 nt, Human; identical to SEQ ID NO: 94701

SEQ ID NO: 195122 - RNA, 64 nt, Human; identical to SEQ ID NO: 94702

SEQ ID NO: 195123 - RNA, 64 nt, Human; identical to SEQ ID NO: 94703

SEQ ID NO: 195124 - RNA, 64 nt, Human; identical to SEQ ID NO: 94704

SEQ ID NO: 195125 - RNA, 64 nt, Human; identical to SEQ ID NO: 94705

SEQ ID NO: 195126 - RNA, 64 nt, Human; identical to SEQ ID NO: 94706

SEQ ID NO: 195127 - RNA, 64 nt, Human; identical to SEQ ID NO: 94707

SEQ ID NO: 195128 - RNA, 60 nt, Human
ccagcccagccugcauacuugccacuuggccaccaggacuccuuguucugcucuggcaag

SEQ ID NO: 195129 - RNA, 60 nt, Human
uggaccacaggcaaagaaaaccacuaggaccaccaggagcacacaaccccagacccacgc

SEQ ID NO: 195130 - RNA, 60 nt, Human
uauaguugaacaagauuucccuaaaaauuccaccaggauuaaucucuaaaauucuagucu

SEQ ID NO: 195131 - RNA, 60 nt, Human
aauuaauuuuaacuuagcuaaugaacucaucaccaggacaguuggaggggguaggccgag

SEQ ID NO: 195132 - RNA, 64 nt, Human; identical to SEQ ID NO: 94708

SEQ ID NO: 195133 - RNA, 64 nt, Human; identical to SEQ ID NO: 94709

SEQ ID NO: 195134 - RNA, 64 nt, Human; identical to SEQ ID NO: 94710

SEQ ID NO: 195135 - RNA, 64 nt, Human; identical to SEQ ID NO: 94711

SEQ ID NO: 195136 - RNA, 64 nt, Human; identical to SEQ ID NO: 94712

SEQ ID NO: 195137 - RNA, 64 nt, Human; identical to SEQ ID NO: 94713

SEQ ID NO: 195138 - RNA, 64 nt, Human; identical to SEQ ID NO: 94714

SEQ ID NO: 195139 - RNA, 64 nt, Human; identical to SEQ ID NO: 94715

SEQ ID NO: 195140 - RNA, 64 nt, Human; identical to SEQ ID NO: 94716

SEQ ID NO: 195141 - RNA, 64 nt, Human; identical to SEQ ID NO: 94717

SEQ ID NO: 195142 - RNA, 64 nt, Human; identical to SEQ ID NO: 94718

SEQ ID NO: 195143 - RNA, 64 nt, Human; identical to SEQ ID NO: 94719

SEQ ID NO: 195144 - RNA, 64 nt, Human; identical to SEQ ID NO: 94720

SEQ ID NO: 195145 - RNA, 64 nt, Human; identical to SEQ ID NO: 94721

SEQ ID NO: 195146 - RNA, 64 nt, Human; identical to SEQ ID NO: 94722

SEQ ID NO: 195147 - RNA, 64 nt, Human; identical to SEQ ID NO: 94723

SEQ ID NO: 195148 - RNA, 60 nt, Human
cagcccugcugccaucauuggcugaagcaccaccaggauucacggcacccaacugcuuca

SEQ ID NO: 195149 - RNA, 60 nt, Human
gaaggacaaagccacucucacaagaaagggcaccaggacugcucuccaaggaacuggacc

SEQ ID NO: 195150 - RNA, 60 nt, Human
ucaacgaugacaccaucucauugauuauggcaccaggaagucugaagguuuccacauucg

SEQ ID NO: 195151 - RNA, 60 nt, Human
gcccagggcugggacugggcaugagguggucaccaggauugagcuuccucagcacccagu

SEQ ID NO: 195152 - RNA, 64 nt, Human; identical to SEQ ID NO: 94724

SEQ ID NO: 195153 - RNA, 64 nt, Human; identical to SEQ ID NO: 94725

SEQ ID NO: 195154 - RNA, 64 nt, Human; identical to SEQ ID NO: 94726

SEQ ID NO: 195155 - RNA, 64 nt, Human; identical to SEQ ID NO: 94727

SEQ ID NO: 195156 - RNA, 64 nt, Human; identical to SEQ ID NO: 94728

SEQ ID NO: 195157 - RNA, 64 nt, Human; identical to SEQ ID NO: 94729

SEQ ID NO: 195158 - RNA, 64 nt, Human; identical to SEQ ID NO: 94730

SEQ ID NO: 195159 - RNA, 64 nt, Human; identical to SEQ ID NO: 94731

SEQ ID NO: 195160 - RNA, 64 nt, Human; identical to SEQ ID NO: 94732

SEQ ID NO: 195161 - RNA, 64 nt, Human; identical to SEQ ID NO: 94733

SEQ ID NO: 195162 - RNA, 64 nt, Human; identical to SEQ ID NO: 94734

SEQ ID NO: 195163 - RNA, 64 nt, Human; identical to SEQ ID NO: 94735

SEQ ID NO: 195164 - RNA, 64 nt, Human; identical to SEQ ID NO: 94736

SEQ ID NO: 195165 - RNA, 64 nt, Human; identical to SEQ ID NO: 94737

SEQ ID NO: 195166 - RNA, 64 nt, Human; identical to SEQ ID NO: 94738

SEQ ID NO: 195167 - RNA, 64 nt, Human; identical to SEQ ID NO: 94739

SEQ ID NO: 195168 - RNA, 60 nt, Human
aggugccuacggugaacugaaguccagucccaccaggacccagacgccucccugggugga

SEQ ID NO: 195169 - RNA, 60 nt, Human
ucccgccgcaccucugcaucuccugggcgucaccaggaaggcucugaagucccgggcugc

SEQ ID NO: 195170 - RNA, 60 nt, Human
ugaagacucuggacucauugcugauuggaacaccaggaggagguuggauuucugccagug

SEQ ID NO: 195171 - RNA, 60 nt, Human
ccacugaggcaggugcggccccaggaccaucaccaggaaugcgaggccacccuggaccag

SEQ ID NO: 195172 - RNA, 64 nt, Human; identical to SEQ ID NO: 94740

SEQ ID NO: 195173 - RNA, 64 nt, Human; identical to SEQ ID NO: 94741

SEQ ID NO: 195174 - RNA, 64 nt, Human; identical to SEQ ID NO: 94742

SEQ ID NO: 195175 - RNA, 64 nt, Human; identical to SEQ ID NO: 94743

SEQ ID NO: 195176 - RNA, 64 nt, Human; identical to SEQ ID NO: 94744

SEQ ID NO: 195177 - RNA, 64 nt, Human; identical to SEQ ID NO: 94745

SEQ ID NO: 195178 - RNA, 64 nt, Human; identical to SEQ ID NO: 94746

SEQ ID NO: 195179 - RNA, 64 nt, Human; identical to SEQ ID NO: 94747

SEQ ID NO: 195180 - RNA, 64 nt, Human; identical to SEQ ID NO: 94748

SEQ ID NO: 195181 - RNA, 64 nt, Human; identical to SEQ ID NO: 94749

SEQ ID NO: 195182 - RNA, 64 nt, Human; identical to SEQ ID NO: 94750

SEQ ID NO: 195183 - RNA, 64 nt, Human; identical to SEQ ID NO: 94751

SEQ ID NO: 195184 - RNA, 64 nt, Human; identical to SEQ ID NO: 94752

SEQ ID NO: 195185 - RNA, 64 nt, Human; identical to SEQ ID NO: 94753

SEQ ID NO: 195186 - RNA, 64 nt, Human; identical to SEQ ID NO: 94754

SEQ ID NO: 195187 - RNA, 64 nt, Human; identical to SEQ ID NO: 94755

SEQ ID NO: 195188 - RNA, 60 nt, Human
aaauuagagaucacucuuggcugauuucagcaccaggaacuguauuacaguuuuagagau

SEQ ID NO: 195189 - RNA, 60 nt, Human
uugcucccgcuccugcggaggagguguggucaccaggaggcggcagugcaacaaccccag

SEQ ID NO: 195190 - RNA, 60 nt, Human
guugcagacaggaaucuuaagguguagccacaccaggauagagacuggaacacuagacaa

SEQ ID NO: 195191 - RNA, 60 nt, Human
ccccugugugcaucuuugaggguccugggccaccaggaggggcagggucuuauagcuggg

SEQ ID NO: 195192 - RNA, 64 nt, Human; identical to SEQ ID NO: 94756

SEQ ID NO: 195193 - RNA, 64 nt, Human; identical to SEQ ID NO: 94757

SEQ ID NO: 195194 - RNA, 64 nt, Human; identical to SEQ ID NO: 94758

SEQ ID NO: 195195 - RNA, 64 nt, Human; identical to SEQ ID NO: 94759

SEQ ID NO: 195196 - RNA, 64 nt, Human; identical to SEQ ID NO: 94760

SEQ ID NO: 195197 - RNA, 64 nt, Human; identical to SEQ ID NO: 94761

SEQ ID NO: 195198 - RNA, 64 nt, Human; identical to SEQ ID NO: 94762

SEQ ID NO: 195199 - RNA, 64 nt, Human; identical to SEQ ID NO: 94763

SEQ ID NO: 195200 - RNA, 64 nt, Human; identical to SEQ ID NO: 94764

SEQ ID NO: 195201 - RNA, 64 nt, Human; identical to SEQ ID NO: 94765

SEQ ID NO: 195202 - RNA, 64 nt, Human; identical to SEQ ID NO: 94766

SEQ ID NO: 195203 - RNA, 64 nt, Human; identical to SEQ ID NO: 94767

SEQ ID NO: 195204 - RNA, 64 nt, Human; identical to SEQ ID NO: 94768

SEQ ID NO: 195205 - RNA, 64 nt, Human; identical to SEQ ID NO: 94769

SEQ ID NO: 195206 - RNA, 64 nt, Human; identical to SEQ ID NO: 94770

SEQ ID NO: 195207 - RNA, 64 nt, Human; identical to SEQ ID NO: 94771

SEQ ID NO: 195208 - RNA, 60 nt, Human
agacaugagcagggcaggggagggcccccucaccaggaaugucaggcaaccaucagguga

SEQ ID NO: 195209 - RNA, 60 nt, Human
uacacauucaaaagauaagcugaguguucccaccaggaagucacgcgcagagaggagagu

SEQ ID NO: 195210 - RNA, 60 nt, Human
ugauguggugacaggugcucugaaggaggucaccaggaccugaccucuuugaaggaucag

SEQ ID NO: 195211 - RNA, 60 nt, Human
gcugaggcccagaaggcccgcauaguuccucaccaggagggucucccuccagcacagguc

SEQ ID NO: 195212 - RNA, 64 nt, Human; identical to SEQ ID NO: 94772

SEQ ID NO: 195213 - RNA, 64 nt, Human; identical to SEQ ID NO: 94773

SEQ ID NO: 195214 - RNA, 64 nt, Human; identical to SEQ ID NO: 94774

SEQ ID NO: 195215 - RNA, 64 nt, Human; identical to SEQ ID NO: 94775

SEQ ID NO: 195216 - RNA, 64 nt, Human; identical to SEQ ID NO: 94776

SEQ ID NO: 195217 - RNA, 64 nt, Human; identical to SEQ ID NO: 94777

SEQ ID NO: 195218 - RNA, 64 nt, Human; identical to SEQ ID NO: 94778

SEQ ID NO: 195219 - RNA, 64 nt, Human; identical to SEQ ID NO: 94779

SEQ ID NO: 195220 - RNA, 64 nt, Human; identical to SEQ ID NO: 94780

SEQ ID NO: 195221 - RNA, 64 nt, Human; identical to SEQ ID NO: 94781

SEQ ID NO: 195222 - RNA, 64 nt, Human; identical to SEQ ID NO: 94782

SEQ ID NO: 195223 - RNA, 64 nt, Human; identical to SEQ ID NO: 94783

SEQ ID NO: 195224 - RNA, 64 nt, Human; identical to SEQ ID NO: 94784

SEQ ID NO: 195225 - RNA, 64 nt, Human; identical to SEQ ID NO: 94785

SEQ ID NO: 195226 - RNA, 64 nt, Human; identical to SEQ ID NO: 94786

SEQ ID NO: 195227 - RNA, 64 nt, Human; identical to SEQ ID NO: 94787

SEQ ID NO: 195228 - RNA, 52 nt, Human
gugagagcgauggugacuaguccaccaggaguucccagcggggugacagucu

SEQ ID NO: 195229 - RNA, 60 nt, Human
auuuucaguuuguuggacauuuuacagcuucaccaggagaaugugcaacuuuauuccagc

SEQ ID NO: 195230 - RNA, 60 nt, Human
uuguaguuucucgacauuaauagugaaccacaccaggagaacaaauacccaaguaucauu

SEQ ID NO: 195231 - RNA, 60 nt, Human
agcagacacacacagggaugcucacgggugcaccaggagccaggugcggcgcagccaacc

SEQ ID NO: 195232 - RNA, 64 nt, Human; identical to SEQ ID NO: 94788

SEQ ID NO: 195233 - RNA, 64 nt, Human; identical to SEQ ID NO: 94789

SEQ ID NO: 195234 - RNA, 64 nt, Human; identical to SEQ ID NO: 94790

SEQ ID NO: 195235 - RNA, 64 nt, Human; identical to SEQ ID NO: 94791

SEQ ID NO: 195236 - RNA, 64 nt, Human; identical to SEQ ID NO: 94792

SEQ ID NO: 195237 - RNA, 64 nt, Human; identical to SEQ ID NO: 94793

SEQ ID NO: 195238 - RNA, 64 nt, Human; identical to SEQ ID NO: 94794

SEQ ID NO: 195239 - RNA, 64 nt, Human; identical to SEQ ID NO: 94795

SEQ ID NO: 195240 - RNA, 64 nt, Human; identical to SEQ ID NO: 94796

SEQ ID NO: 195241 - RNA, 64 nt, Human; identical to SEQ ID NO: 94797

SEQ ID NO: 195242 - RNA, 64 nt, Human; identical to SEQ ID NO: 94798

SEQ ID NO: 195243 - RNA, 64 nt, Human; identical to SEQ ID NO: 94799

SEQ ID NO: 195244 - RNA, 64 nt, Human; identical to SEQ ID NO: 94800

SEQ ID NO: 195245 - RNA, 64 nt, Human; identical to SEQ ID NO: 94801

SEQ ID NO: 195246 - RNA, 64 nt, Human; identical to SEQ ID NO: 94802

SEQ ID NO: 195247 - RNA, 64 nt, Human; identical to SEQ ID NO: 94803

SEQ ID NO: 195248 - RNA, 60 nt, Human
gccaugggcacugggcucgccuugcacgcccaccaggagggccaggggcauacgcagucc

SEQ ID NO: 195249 - RNA, 60 nt, Human
uuggauaugaaaguguaccccauuugguuucaccaggaacccaaauuuagaauauugaaa

SEQ ID NO: 195250 - RNA, 60 nt, Human
ccuuguuccuguucucagggugacgacugccaccaggagaugcaguucuaguucuuaaaa

SEQ ID NO: 195251 - RNA, 60 nt, Human
aauuucaauaaccuuucacuuaaguauugucaccaggauuacuagucaaacaaaaaagaa

SEQ ID NO: 195252 - RNA, 64 nt, Human; identical to SEQ ID NO: 94804

SEQ ID NO: 195253 - RNA, 64 nt, Human; identical to SEQ ID NO: 94805

SEQ ID NO: 195254 - RNA, 64 nt, Human; identical to SEQ ID NO: 94806

SEQ ID NO: 195255 - RNA, 64 nt, Human; identical to SEQ ID NO: 94807

SEQ ID NO: 195256 - RNA, 64 nt, Human; identical to SEQ ID NO: 94808

SEQ ID NO: 195257 - RNA, 64 nt, Human; identical to SEQ ID NO: 94809

SEQ ID NO: 195258 - RNA, 64 nt, Human; identical to SEQ ID NO: 94810

SEQ ID NO: 195259 - RNA, 64 nt, Human; identical to SEQ ID NO: 94811

SEQ ID NO: 195260 - RNA, 64 nt, Human; identical to SEQ ID NO: 94812

SEQ ID NO: 195261 - RNA, 64 nt, Human; identical to SEQ ID NO: 94813

SEQ ID NO: 195262 - RNA, 64 nt, Human; identical to SEQ ID NO: 94814

SEQ ID NO: 195263 - RNA, 64 nt, Human; identical to SEQ ID NO: 94815

SEQ ID NO: 195264 - RNA, 64 nt, Human; identical to SEQ ID NO: 94816

SEQ ID NO: 195265 - RNA, 64 nt, Human; identical to SEQ ID NO: 94817

SEQ ID NO: 195266 - RNA, 64 nt, Human; identical to SEQ ID NO: 94818

SEQ ID NO: 195267 - RNA, 64 nt, Human; identical to SEQ ID NO: 94819

SEQ ID NO: 195268 - RNA, 60 nt, Human
ccccgaagcccgcucaaugcucucgaugggcaccaggaagcgcuccagugggauggccuc

SEQ ID NO: 195269 - RNA, 60 nt, Human
ccuggaucuugcccagcugccagcuccccccaccaggacugugguuccucaguuucuccu

SEQ ID NO: 195270 - RNA, 60 nt, Human
gauguggccacccuauucccacauggggagcaccaggagcccuggagccccuuccaccca

SEQ ID NO: 195271 - RNA, 60 nt, Human
uugggaagcccguuagcccagggugggucccaccaggacaguagggaaacaguuguuucc

SEQ ID NO: 195272 - RNA, 64 nt, Human; identical to SEQ ID NO: 94820

SEQ ID NO: 195273 - RNA, 64 nt, Human; identical to SEQ ID NO: 94821

SEQ ID NO: 195274 - RNA, 64 nt, Human; identical to SEQ ID NO: 94822

SEQ ID NO: 195275 - RNA, 64 nt, Human; identical to SEQ ID NO: 94823

SEQ ID NO: 195276 - RNA, 64 nt, Human; identical to SEQ ID NO: 94824

SEQ ID NO: 195277 - RNA, 64 nt, Human; identical to SEQ ID NO: 94825

SEQ ID NO: 195278 - RNA, 64 nt, Human; identical to SEQ ID NO: 94826

SEQ ID NO: 195279 - RNA, 64 nt, Human; identical to SEQ ID NO: 94827

SEQ ID NO: 195280 - RNA, 64 nt, Human; identical to SEQ ID NO: 94828

SEQ ID NO: 195281 - RNA, 64 nt, Human; identical to SEQ ID NO: 94829

SEQ ID NO: 195282 - RNA, 64 nt, Human; identical to SEQ ID NO: 94830

SEQ ID NO: 195283 - RNA, 64 nt, Human; identical to SEQ ID NO: 94831

SEQ ID NO: 195284 - RNA, 64 nt, Human; identical to SEQ ID NO: 94832

SEQ ID NO: 195285 - RNA, 64 nt, Human; identical to SEQ ID NO: 94833

SEQ ID NO: 195286 - RNA, 64 nt, Human; identical to SEQ ID NO: 94834

SEQ ID NO: 195287 - RNA, 64 nt, Human; identical to SEQ ID NO: 94835

SEQ ID NO: 195288 - RNA, 60 nt, Human
gacucagggccccagcacuaaagcaguggacaccaggagucccugguaauaaguacugug

SEQ ID NO: 195289 - RNA, 60 nt, Human
aagaaacccuucuucuguaucccaauaauccaccaggauaaaggagaaacuagaaauaug

SEQ ID NO: 195290 - RNA, 60 nt, Human
agcccuuggcucccucuugcucguuguucucaccaggaaaguacacgggccugaggcagg

SEQ ID NO: 195291 - RNA, 60 nt, Human
ggagagagggacagguucuguugggggugacaccaggacacaggaauagguucugucggg

SEQ ID NO: 195292 - RNA, 64 nt, Human; identical to SEQ ID NO: 94836

SEQ ID NO: 195293 - RNA, 64 nt, Human; identical to SEQ ID NO: 94837

SEQ ID NO: 195294 - RNA, 64 nt, Human; identical to SEQ ID NO: 94838

SEQ ID NO: 195295 - RNA, 64 nt, Human; identical to SEQ ID NO: 94839

SEQ ID NO: 195296 - RNA, 64 nt, Human; identical to SEQ ID NO: 94840

SEQ ID NO: 195297 - RNA, 64 nt, Human; identical to SEQ ID NO: 94841

SEQ ID NO: 195298 - RNA, 64 nt, Human; identical to SEQ ID NO: 94842

SEQ ID NO: 195299 - RNA, 64 nt, Human; identical to SEQ ID NO: 94843

SEQ ID NO: 195300 - RNA, 64 nt, Human; identical to SEQ ID NO: 94844

SEQ ID NO: 195301 - RNA, 64 nt, Human; identical to SEQ ID NO: 94845

SEQ ID NO: 195302 - RNA, 64 nt, Human; identical to SEQ ID NO: 94846

SEQ ID NO: 195303 - RNA, 64 nt, Human; identical to SEQ ID NO: 94847

SEQ ID NO: 195304 - RNA, 64 nt, Human; identical to SEQ ID NO: 94848

SEQ ID NO: 195305 - RNA, 64 nt, Human; identical to SEQ ID NO: 94849

SEQ ID NO: 195306 - RNA, 64 nt, Human; identical to SEQ ID NO: 94850

SEQ ID NO: 195307 - RNA, 64 nt, Human; identical to SEQ ID NO: 94851

SEQ ID NO: 195308 - RNA, 60 nt, Human
ggacacagggacagguucuaucaugggugacaccaggagagagggacagguucuguuggg

SEQ ID NO: 195309 - RNA, 60 nt, Human
ggacacagggacagguucugucgggggugacaccaggacacagggacagguucugucaug

SEQ ID NO: 195310 - RNA, 60 nt, Human
ggagagagggacagguucugucaggggugacaccaggacacagggacagguucugucggg

SEQ ID NO: 195311 - RNA, 60 nt, Human
ggacgagggacacugaggagaggugcugggcaccaggacgcugccuccuggucccugguu

SEQ ID NO: 195312 - RNA, 64 nt, Human; identical to SEQ ID NO: 94852

SEQ ID NO: 195313 - RNA, 64 nt, Human; identical to SEQ ID NO: 94853

SEQ ID NO: 195314 - RNA, 64 nt, Human; identical to SEQ ID NO: 94854

SEQ ID NO: 195315 - RNA, 64 nt, Human; identical to SEQ ID NO: 94855

SEQ ID NO: 195316 - RNA, 64 nt, Human; identical to SEQ ID NO: 94856

SEQ ID NO: 195317 - RNA, 64 nt, Human; identical to SEQ ID NO: 94857

SEQ ID NO: 195318 - RNA, 64 nt, Human; identical to SEQ ID NO: 94858

SEQ ID NO: 195319 - RNA, 64 nt, Human; identical to SEQ ID NO: 94859

SEQ ID NO: 195320 - RNA, 58 nt, Human; identical to SEQ ID NO: 94860

SEQ ID NO: 195321 - RNA, 64 nt, Human; identical to SEQ ID NO: 94861

SEQ ID NO: 195322 - RNA, 64 nt, Human; identical to SEQ ID NO: 94862

SEQ ID NO: 195323 - RNA, 64 nt, Human; identical to SEQ ID NO: 94863

SEQ ID NO: 195324 - RNA, 64 nt, Human; identical to SEQ ID NO: 94864

SEQ ID NO: 195325 - RNA, 64 nt, Human; identical to SEQ ID NO: 94865

SEQ ID NO: 195326 - RNA, 64 nt, Human; identical to SEQ ID NO: 94866

SEQ ID NO: 195327 - RNA, 64 nt, Human; identical to SEQ ID NO: 94867

SEQ ID NO: 195328 - RNA, 60 nt, Human
guuguuuguaaauagaauugaauuuaaauacaccaggauaaaucuuauuuaaaggaagcc

SEQ ID NO: 195329 - RNA, 60 nt, Human
gacugugcucgcuggguggugcaggccuggcaccaggaggcuugcacccgccuuuccuuc

SEQ ID NO: 195330 - RNA, 60 nt, Human
gcccagcaucgccucagcccagacaggcuccaccaggagaucaagcaagggcugccuuuc

SEQ ID NO: 195331 - RNA, 60 nt, Human
aucauuugaucuggcagcagggcagaggugcaccaggaguaaaaaccuuucaaaaaagag

SEQ ID NO: 195332 - RNA, 64 nt, Human; identical to SEQ ID NO: 94868

SEQ ID NO: 195333 - RNA, 64 nt, Human; identical to SEQ ID NO: 94869

SEQ ID NO: 195334 - RNA, 64 nt, Human; identical to SEQ ID NO: 94870

SEQ ID NO: 195335 - RNA, 64 nt, Human; identical to SEQ ID NO: 94871

SEQ ID NO: 195336 - RNA, 64 nt, Human; identical to SEQ ID NO: 94872

SEQ ID NO: 195337 - RNA, 64 nt, Human; identical to SEQ ID NO: 94873

SEQ ID NO: 195338 - RNA, 64 nt, Human; identical to SEQ ID NO: 94874

SEQ ID NO: 195339 - RNA, 64 nt, Human; identical to SEQ ID NO: 94875

SEQ ID NO: 195340 - RNA, 64 nt, Human; identical to SEQ ID NO: 94876

SEQ ID NO: 195341 - RNA, 64 nt, Human; identical to SEQ ID NO: 94877

SEQ ID NO: 195342 - RNA, 64 nt, Human; identical to SEQ ID NO: 94878

SEQ ID NO: 195343 - RNA, 64 nt, Human; identical to SEQ ID NO: 94879

SEQ ID NO: 195344 - RNA, 64 nt, Human; identical to SEQ ID NO: 94880

SEQ ID NO: 195345 - RNA, 64 nt, Human; identical to SEQ ID NO: 94881

SEQ ID NO: 195346 - RNA, 64 nt, Human; identical to SEQ ID NO: 94882

SEQ ID NO: 195347 - RNA, 64 nt, Human; identical to SEQ ID NO: 94883

SEQ ID NO: 195348 - RNA, 60 nt, Human
ccaucaauuuuaguugucaaugggaaaaaacaccaggauuuaaguuucacagcacuuaca

SEQ ID NO: 195349 - RNA, 60 nt, Human
uauauuauaugccacccguaaccauaaaaacaccaggauuuagguuccuugaagguaaug

SEQ ID NO: 195350 - RNA, 60 nt, Human
gaacagagggguagggagggugcaccagugcaccaggaaggcugugugggucuggagccc

SEQ ID NO: 195351 - RNA, 60 nt, Human
uaaaugacaucagaacucuucagguaccagcaccaggaagacugaauauccuuuuuaaug

SEQ ID NO: 195352 - RNA, 64 nt, Human; identical to SEQ ID NO: 94884

SEQ ID NO: 195353 - RNA, 64 nt, Human; identical to SEQ ID NO: 94885

SEQ ID NO: 195354 - RNA, 64 nt, Human; identical to SEQ ID NO: 94886

SEQ ID NO: 195355 - RNA, 64 nt, Human; identical to SEQ ID NO: 94887

SEQ ID NO: 195356 - RNA, 64 nt, Human; identical to SEQ ID NO: 94888

SEQ ID NO: 195357 - RNA, 64 nt, Human; identical to SEQ ID NO: 94889

SEQ ID NO: 195358 - RNA, 64 nt, Human; identical to SEQ ID NO: 94890

SEQ ID NO: 195359 - RNA, 64 nt, Human; identical to SEQ ID NO: 94891

SEQ ID NO: 195360 - RNA, 64 nt, Human; identical to SEQ ID NO: 94892

SEQ ID NO: 195361 - RNA, 64 nt, Human; identical to SEQ ID NO: 94893

SEQ ID NO: 195362 - RNA, 64 nt, Human; identical to SEQ ID NO: 94894

SEQ ID NO: 195363 - RNA, 64 nt, Human; identical to SEQ ID NO: 94895

SEQ ID NO: 195364 - RNA, 64 nt, Human; identical to SEQ ID NO: 94896

SEQ ID NO: 195365 - RNA, 64 nt, Human; identical to SEQ ID NO: 94897

SEQ ID NO: 195366 - RNA, 64 nt, Human; identical to SEQ ID NO: 94898

SEQ ID NO: 195367 - RNA, 64 nt, Human; identical to SEQ ID NO: 94899

SEQ ID NO: 195368 - RNA, 57 nt, Human
ugcugaaggagcugagaugaggccccacaccaggacuggacugggaugccgcuagug

SEQ ID NO: 195369 - RNA, 60 nt, Human
gaugcuaacuggacauucuggggaacugggcaccaggagugccuucauacacuguacccc

SEQ ID NO: 195370 - RNA, 60 nt, Human
uugcaggcccgcuucucaaugaaugagauacaccaggauaugcacgugcaucugagaacc

SEQ ID NO: 195371 - RNA, 60 nt, Human
cuguggacuuggaaugaggccaacaggguucaccaggaugagagaggagagaggaaucca

SEQ ID NO: 195372 - RNA, 64 nt, Human; identical to SEQ ID NO: 94900

SEQ ID NO: 195373 - RNA, 64 nt, Human; identical to SEQ ID NO: 94901

SEQ ID NO: 195374 - RNA, 64 nt, Human; identical to SEQ ID NO: 94902

SEQ ID NO: 195375 - RNA, 64 nt, Human; identical to SEQ ID NO: 94903

SEQ ID NO: 195376 - RNA, 64 nt, Human; identical to SEQ ID NO: 94904

SEQ ID NO: 195377 - RNA, 64 nt, Human; identical to SEQ ID NO: 94905

SEQ ID NO: 195378 - RNA, 64 nt, Human; identical to SEQ ID NO: 94906

SEQ ID NO: 195379 - RNA, 64 nt, Human; identical to SEQ ID NO: 94907

SEQ ID NO: 195380 - RNA, 64 nt, Human; identical to SEQ ID NO: 94908

SEQ ID NO: 195381 - RNA, 64 nt, Human; identical to SEQ ID NO: 94909

SEQ ID NO: 195382 - RNA, 64 nt, Human; identical to SEQ ID NO: 94910

SEQ ID NO: 195383 - RNA, 64 nt, Human; identical to SEQ ID NO: 94911

SEQ ID NO: 195384 - RNA, 64 nt, Human; identical to SEQ ID NO: 94912

SEQ ID NO: 195385 - RNA, 64 nt, Human; identical to SEQ ID NO: 94913

SEQ ID NO: 195386 - RNA, 64 nt, Human; identical to SEQ ID NO: 94914

SEQ ID NO: 195387 - RNA, 64 nt, Human; identical to SEQ ID NO: 94915

SEQ ID NO: 195388 - RNA, 60 nt, Human
cugugcaccccacccuguaacagcaccaaccaccaggauuggacaucaccgaggaacagc

SEQ ID NO: 195389 - RNA, 60 nt, Human
uguaucgguuuuauauuaccuguucugcuucaccaggagaucaugcugcugugauacuga

SEQ ID NO: 195390 - RNA, 60 nt, Human
uuagccccuuguucuucccaaugucauauccaccaggaccuggccacagcuggccugugg

SEQ ID NO: 195391 - RNA, 60 nt, Human
gggccaucagaacuugaauccuuuaacauccaccaggaaguuuuaugaagagugggugau

SEQ ID NO: 195392 - RNA, 64 nt, Human; identical to SEQ ID NO: 94916

SEQ ID NO: 195393 - RNA, 64 nt, Human; identical to SEQ ID NO: 94917

SEQ ID NO: 195394 - RNA, 64 nt, Human; identical to SEQ ID NO: 94918

SEQ ID NO: 195395 - RNA, 64 nt, Human; identical to SEQ ID NO: 94919

SEQ ID NO: 195396 - RNA, 64 nt, Human; identical to SEQ ID NO: 94920

SEQ ID NO: 195397 - RNA, 64 nt, Human; identical to SEQ ID NO: 94921

SEQ ID NO: 195398 - RNA, 64 nt, Human; identical to SEQ ID NO: 94922

SEQ ID NO: 195399 - RNA, 64 nt, Human; identical to SEQ ID NO: 94923

SEQ ID NO: 195400 - RNA, 64 nt, Human; identical to SEQ ID NO: 94924

SEQ ID NO: 195401 - RNA, 64 nt, Human; identical to SEQ ID NO: 94925

SEQ ID NO: 195402 - RNA, 64 nt, Human; identical to SEQ ID NO: 94926

SEQ ID NO: 195403 - RNA, 64 nt, Human; identical to SEQ ID NO: 94927

SEQ ID NO: 195404 - RNA, 64 nt, Human; identical to SEQ ID NO: 94928

SEQ ID NO: 195405 - RNA, 64 nt, Human; identical to SEQ ID NO: 94929

SEQ ID NO: 195406 - RNA, 64 nt, Human; identical to SEQ ID NO: 94930

SEQ ID NO: 195407 - RNA, 64 nt, Human; identical to SEQ ID NO: 94931

SEQ ID NO: 195408 - RNA, 60 nt, Human
uugcaguucugcccuccaccuugcuaucugcaccaggaggcucuccaccuggcagccaga

SEQ ID NO: 195409 - RNA, 60 nt, Human
ggagagagggacagguucugucaggggugacaccaggagagagggacagguucuguuggg

SEQ ID NO: 195410 - RNA, 60 nt, Human
gaggaggugaucgaggacugguacaggaaccaccaggaggaagaccugacugaauuccuc

SEQ ID NO: 195411 - RNA, 60 nt, Human
aacucaggaggggcaggugucagaacugggcaccaggacuggagcccccuccggagacca

SEQ ID NO: 195412 - RNA, 64 nt, Human; identical to SEQ ID NO: 94932

SEQ ID NO: 195413 - RNA, 64 nt, Human; identical to SEQ ID NO: 94933

SEQ ID NO: 195414 - RNA, 64 nt, Human; identical to SEQ ID NO: 94934

SEQ ID NO: 195415 - RNA, 64 nt, Human; identical to SEQ ID NO: 94935

SEQ ID NO: 195416 - RNA, 64 nt, Human; identical to SEQ ID NO: 94936

SEQ ID NO: 195417 - RNA, 64 nt, Human; identical to SEQ ID NO: 94937

SEQ ID NO: 195418 - RNA, 64 nt, Human; identical to SEQ ID NO: 94938

SEQ ID NO: 195419 - RNA, 64 nt, Human; identical to SEQ ID NO: 94939

SEQ ID NO: 195420 - RNA, 64 nt, Human; identical to SEQ ID NO: 94940

SEQ ID NO: 195421 - RNA, 64 nt, Human; identical to SEQ ID NO: 94941

SEQ ID NO: 195422 - RNA, 64 nt, Human; identical to SEQ ID NO: 94942

SEQ ID NO: 195423 - RNA, 64 nt, Human; identical to SEQ ID NO: 94943

SEQ ID NO: 195424 - RNA, 64 nt, Human; identical to SEQ ID NO: 94944

SEQ ID NO: 195425 - RNA, 64 nt, Human; identical to SEQ ID NO: 94945

SEQ ID NO: 195426 - RNA, 64 nt, Human; identical to SEQ ID NO: 94946

SEQ ID NO: 195427 - RNA, 64 nt, Human; identical to SEQ ID NO: 94947

SEQ ID NO: 195428 - RNA, 60 nt, Human
ccccagcucuggucugugcagacucauggccaccaggaggccugcagauccagccuuccu

SEQ ID NO: 195429 - RNA, 60 nt, Human
auauggacuuggaaugaggccuacaggguucaccaggauguaagaggagagaggaaucca

SEQ ID NO: 195430 - RNA, 60 nt, Human
ggccuccguggccuccuccugugugagucccaccaggagccacgugcccggccuugcccu

SEQ ID NO: 195431 - RNA, 60 nt, Human
guuuagaagcaaaacaugaagggcuagcgccaccaggauaguuagcagaaauauugucug

SEQ ID NO: 195432 - RNA, 64 nt, Human; identical to SEQ ID NO: 94948

SEQ ID NO: 195433 - RNA, 64 nt, Human; identical to SEQ ID NO: 94949

SEQ ID NO: 195434 - RNA, 64 nt, Human; identical to SEQ ID NO: 94950

SEQ ID NO: 195435 - RNA, 64 nt, Human
ugugcuggucaagccagggcagucacagcugcuuggggcccacagcacugcugccuggucucca

SEQ ID NO: 195436 - RNA, 64 nt, Human
cauguacugacccgaaaggcucggccgcagagccggggcccagcgaaucacgcagagaaaucuu

SEQ ID NO: 195437 - RNA, 64 nt, Human
agaagcaccugcggcagaggcgcacgggaagcccggggcccaggcucaugcaacacgacgcuca

SEQ ID NO: 195438 - RNA, 64 nt, Human
ugaucucaagucaggcugaaggcagcgaagccucggggcccaagccccuccccagcccccucuc

SEQ ID NO: 195439 - RNA, 64 nt, Human
accccacgccuacugagccagaaucucuggggguggggcccagccauuuggcuuuucacaaguu

SEQ ID NO: 195440 - RNA, 64 nt, Human
gcaacaccucucccaaaaagcagcccacaaggcaggggcccagcagcccagccaucacucaucu

SEQ ID NO: 195441 - RNA, 64 nt, Human
caccccaugcugacuuggagaaccccagaucucuggggcccagccaggcagggugugggggcag

SEQ ID NO: 195442 - RNA, 64 nt, Human
uggcggcccguguccccuuccuccauccuugcugggggcccauggcuuguggcaguucagcuuc

SEQ ID NO: 195443 - RNA, 60 nt, Human
aacaguacuagaaauuacagugccaagagccaccaggaggcccagccaauaagcauagau

SEQ ID NO: 195444 - RNA, 60 nt, Human
caaaggaauugauggacaaaaugagauucucaccaggacuucagguuggauaacauguca

SEQ ID NO: 195445 - RNA, 60 nt, Human
cauuuguucaaaaguuagaacaucuggcugcaccaggaaaaaaaaaaaaaaaaaguccug

SEQ ID NO: 195446 - RNA, 60 nt, Human
ucuagaauagcugggacuacaggcacaugccaccaggacuggcaaacuguuuuauuuuua

SEQ ID NO: 195447 - RNA, 64 nt, Human
gcaguauuggaggggcuacaggcagcuggagaaaggggcccagccgcugacccacucacucagg

SEQ ID NO: 195448 - RNA, 64 nt, Human
guccagcuuuccuucugcccuuccuccaggagaaggggcccaagguccccguggauggucucca

SEQ ID NO: 195449 - RNA, 64 nt, Human
agaagggagagcaggaguauuggggcugggcccuggggcccaaggaccagcuggguccccuuug

SEQ ID NO: 195450 - RNA, 64 nt, Human
uuggguguuucaagguucuguucagaucccuaugggggcccagcuggcuccacgguuccagaau

SEQ ID NO: 195451 - RNA, 64 nt, Human
cgcugucucccacuggacagaggaggcuggccauggggcccaggggucaggcccagcuuuugag

SEQ ID NO: 195452 - RNA, 64 nt, Human
auaaaauuugccuccugguaacccuguaauggauggggcccagaaaugaaauauuugagaaaaa

SEQ ID NO: 195453 - RNA, 64 nt, Human
ccgcuccgagucagccugugugggucaugaggcuggggcccaggagacacggucccaggcacug

SEQ ID NO: 195454 - RNA, 64 nt, Human
acaggacugguggaaaaucucccaugcgacccucggggcccagagccaucugggucugauguuc

SEQ ID NO: 195455 - RNA, 64 nt, Human
ucuugaaauuucuuagccagcaacuuguucugcaggggcccacugaagcagaagguuuuucucu

SEQ ID NO: 195456 - RNA, 64 nt, Human
acagaaaucaguauuucuucuacuuagaaggcuuggggcccaggguaaugaggcaccagaugaa

SEQ ID NO: 195457 - RNA, 64 nt, Human
aggcauggcucuacccauuucuuugcacaaguauggggcccaugugguaguccccauaccccuc

SEQ ID NO: 195458 - RNA, 64 nt, Human
gggauuugguaugaucaaauccucaagccagcugggggcccaggcugaagaccuggggacaggu

SEQ ID NO: 195459 - RNA, 64 nt, Human
uccccaagaagcaacagcaugggguccagcaguuggggcccaaaagacagucugaagaggaagg

SEQ ID NO: 195460 - RNA, 64 nt, Human
gccaccggaucugcucugaccgcacuugaaggcuggggcccaggcaccugugccggccauucgu

SEQ ID NO: 195461 - RNA, 64 nt, Human
cggagcucccggcuccucagcgggugggaaccucggggcccagggguggagcuggcguccgcgg

SEQ ID NO: 195462 - RNA, 60 nt, Human
cucaucugcugcuucuucgugcgccucuuccaccaggacugcugcugggcacugagcugc

SEQ ID NO: 195463 - RNA, 60 nt, Human
ugcagugggucgagcgccugagauccuguucaccaggacuccacagagcuggcucugcuc

SEQ ID NO: 195464 - RNA, 60 nt, Human
gggucugggaaaaagcuuuaaccugcagggcaccaggacccaaggcaggcuguuccuugg

SEQ ID NO: 195465 - RNA, 60 nt, Human
uugacccaucuaucugccaccauguugccccaccaggagcucagcucuguggaguuuucc

SEQ ID NO: 195466 - RNA, 64 nt, Human
uaggaauagugcuuccagauguggucucccguguggggcccagcaaugggggccccugaugcca

SEQ ID NO: 195467 - RNA, 64 nt, Human
ugucuagacuccacugggaagaguccuuugcuuuggggcccagugacucggggcacuugaguuc

SEQ ID NO: 195468 - RNA, 64 nt, Human
uccagcaccugcugugcugggaaggccgaggaugggggcccagcacuguccaggccugcugggg

SEQ ID NO: 195469 - RNA, 64 nt, Human
gucugaaguuugagacgagggauuauuucaggguggggcccaaugugaucuaaugcccagcugg

SEQ ID NO: 195470 - RNA, 64 nt, Human
ccauguuccagggcaggucuggguuuccaagggaggggcccaggcuacauccuugguuucccca

SEQ ID NO: 195471 - RNA, 64 nt, Human
cccccagaugcagagagacuggagaggguggggaggggcccagcggccuuggugacaggcccag

SEQ ID NO: 195472 - RNA, 64 nt, Human
aggaccuggggcgacuggaggaagccaggcgaguggggcccaggacugguuccagugagagaaa

SEQ ID NO: 195473 - RNA, 64 nt, Human
ucccgacugagcagagccagacagacauuccugaggggcccagaaauggggccgguuggagggc

SEQ ID NO: 195474 - RNA, 64 nt, Human
gugguacugagcucacguggacucccagugcgaaggggcccauggguugggcugcaggccuggc

SEQ ID NO: 195475 - RNA, 64 nt, Human
agaaggcaaaggccaguuuccccguuaucaugaaggggcccacucaggacaggaacaaggacaa

SEQ ID NO: 195476 - RNA, 64 nt, Human
cccuuucuccaccacagccaaggccuggagacugggggcccagcagagccugcucccacccucc

SEQ ID NO: 195477 - RNA, 64 nt, Human
aacugcugugcccaacccauggacaggcccagcuggggcccacaugcugacacagacucacuca

SEQ ID NO: 195478 - RNA, 64 nt, Human
uucuuaaguugauuuuuguaugcagaguaagcugggggcccaguuucaaucuucugcauauggc

SEQ ID NO: 195479 - RNA, 64 nt, Human
ugauaaaaacaucuccuuuuuauucuacuuacuuggggcccaggucaguauaauuuagucaacu

SEQ ID NO: 195480 - RNA, 64 nt, Human
guucuuuccacaggccauccucuuauuccguucuggggcccaggaaguggggaagaguagguuc

SEQ ID NO: 195481 - RNA, 60 nt, Human
gcuuugcaccccuguguagccgauggccagcaccaggagaggagucaggccgcgacugug

SEQ ID NO: 195482 - RNA, 60 nt, Human
ccuucucccuugaaauccuugcugcgugcccaccaggauuuccugugagggcccaggaau

SEQ ID NO: 195483 - RNA, 60 nt, Human
cucagcacagagagccagaacucuaucgggcaccaggauaacaucucucagugaacagag

SEQ ID NO: 195484 - RNA, 60 nt, Human
aagaucuugccuguuggugaucaugcuccucaccaggacagagacuguauaggcugacca

SEQ ID NO: 195485 - RNA, 64 nt, Human
aggaugcccagcgaaugagggguagagccacucuggggcccagccugccugccgcaccccugug

SEQ ID NO: 195486 - RNA, 64 nt, Human
cucccugcugccuccucaguggggcagugggcaaggggcccaggggcagccgaagcacgggguc

SEQ ID NO: 195487 - RNA, 64 nt, Human
cacguuguacacauaugcugcaggaaggggguggggggcccaauaaggccuuugggaaaggaca

SEQ ID NO: 195488 - RNA, 64 nt, Human
uguuuggugaugacacugggguccuuccaucucuggggcccacucucuucugucuucccauggg

SEQ ID NO: 195489 - RNA, 64 nt, Human
cagacaucucuggagccagagagaacaacaggcaggggcccacuuggggccuucccccuugugg

SEQ ID NO: 195490 - RNA, 64 nt, Human
auuuuuuuuaauagaccaaacccuaaucucuacaggggcccaguacaguuguuuggccuaccug

SEQ ID NO: 195491 - RNA, 64 nt, Human
acgugggugcagaagacccaugggaggaggagguggggcccacucaacacaccuaagccagugg

SEQ ID NO: 195492 - RNA, 64 nt, Human
gugugggaaaauggcagaaagauggagaggcaugggggcccaaaggggagcguggggaggggcu

SEQ ID NO: 195493 - RNA, 64 nt, Human
guuucguuuucuagcuauaggaacuaucuggggaggggcccaguggguccucggccagagcccu

SEQ ID NO: 195494 - RNA, 64 nt, Human
aaagccuccgccugcuguguggacuucaucucaaggggcccagccuccucuggacuccaccuug

SEQ ID NO: 195495 - RNA, 64 nt, Human
gucaacccugccugcauacaugggcuccugucauggggcccagagucccuugcagauauagaaa

SEQ ID NO: 195496 - RNA, 64 nt, Human
guuccuggcuugaaucugccaccacgggccgguuggggcccacagucuucucacgcccucuccu

SEQ ID NO: 195497 - RNA, 64 nt, Human
ugggucugggaggagggaggcugggaggccgcucggggcccagcgugccagccccggaguucag

SEQ ID NO: 195498 - RNA, 64 nt, Human
aguccuuucugccuuggccucggcgggcuuuucuggggcccaggaagcccacacuaugcacaga

SEQ ID NO: 195499 - RNA, 64 nt, Human
agcucucuggcauggggguggggccucagaugcuggggcccagucugccccaucuucauuccug

SEQ ID NO: 195500 - RNA, 60 nt, Human
uuuaaggacucuaagccagaauggaaaauucaccaggacuccauucuuaagccuaugcga

SEQ ID NO: 195501 - RNA, 60 nt, Human
cugaccucaggccucugagucacugaaugucaccaggagaggugggggagggaaaguggg

SEQ ID NO: 195502 - RNA, 60 nt, Human
cuuuuaaucaaguagaacaaaaacuauuaucaccaggauuuauacauacagagauuguag

SEQ ID NO: 195503 - RNA, 60 nt, Human
augaggcugaggcugaggggcagucaccagcaccaggaagaaggugguaggaggaguccu

SEQ ID NO: 195504 - RNA, 64 nt, Human
cguucagugaacccauguuucugggugggugaaaggggcccaacccugcccacuucagcccagc

SEQ ID NO: 195505 - RNA, 64 nt, Human
uaaaaaucaaaacuucuuuaagcugguaaagugaggggcccaccagcagugaucuccugaugcc

SEQ ID NO: 195506 - RNA, 64 nt, Human
acaaagccaagccagcuagccaccaggccugaggggggcccacugcccuuugcagcuguuuguu

SEQ ID NO: 195507 - RNA, 64 nt, Human
acugcuauuuucugaauggaacaagcugggccaaggggcccaggcccuguccucugucccucac

SEQ ID NO: 195508 - RNA, 64 nt, Human
agacagagugggagagauuacggcauggcauggaggggcccaaggagcaggggcuguugacaaa

SEQ ID NO: 195509 - RNA, 64 nt, Human
accucccuguaccagagcugugaucucucgguggggggcccaucucugcugaccuggguguggc

SEQ ID NO: 195510 - RNA, 64 nt, Human
acugggcuaauucuacaccccugugccccuccuaggggcccaugagucagagaggcuugcccca

SEQ ID NO: 195511 - RNA, 64 nt, Human
uccuggcccccagccaguucucagaaacguggcuggggcccagcacagcagccugcaagggccc

SEQ ID NO: 195512 - RNA, 52 nt, Human
gcacugagggcauuguguaggcggggcccaggcugcccgcgggugcacccag

SEQ ID NO: 195513 - RNA, 64 nt, Human
uggugaccgccacacugugccuuaaugucugccgggggcccaggcugugcugucccugcagcac

SEQ ID NO: 195514 - RNA, 64 nt, Human
ggaagucagggucaacucccaggccucagaugcaggggcccagaacaccugcucucaccugagc

SEQ ID NO: 195515 - RNA, 64 nt, Human
gggaacaccugcucucaccugaaccccaggugaaggggcccagaacaccugcucucaccugagc

SEQ ID NO: 195516 - RNA, 64 nt, Human
gcacuauaaggaccagcccaaccccaugggcgggggggcccauauggaccaggggaccuugccu

SEQ ID NO: 195517 - RNA, 64 nt, Human
aaaggagacagacaagaagaggaagagaaaaaaaggggcccacgaggacugugaugaggaggug

SEQ ID NO: 195518 - RNA, 64 nt, Human
ggcggaauugcucucccagcccuugcauugcagaggggcccaugaaagaggacaggcuaccccu

SEQ ID NO: 195519 - RNA, 60 nt, Human
uuuauuucucucaucuguuacacaaagaaccaccaggaaagcaaaucaguuugguuggua

SEQ ID NO: 195520 - RNA, 60 nt, Human
caacccacacugugucugagggugaaaggacaccaggagucacuucuauaccucccuaac

SEQ ID NO: 195521 - RNA, 60 nt, Human
gcuccagcuaucaggaugucccugaaacuucaccaggaccaguucacuugcccugacgag

SEQ ID NO: 195522 - RNA, 60 nt, Human
uguauuuuaaauauauguaguugcaaauagcaccaggaauuagauuucuguacaccccua

SEQ ID NO: 195523 - RNA, 64 nt, Human
caaggguccucuuuuccuggcagcugcuguggguggggcccagacaccagccuagccuggcucu

SEQ ID NO: 195524 - RNA, 54 nt, Human
ucacugagagggucccaugacggcggggcccaggcagccuccgggcgugugaag

SEQ ID NO: 195525 - RNA, 64 nt, Human
aggguaggguuaccuugaacgaaacagaacuugaggggcccaagccuuaucucagccuuuccuc

SEQ ID NO: 195526 - RNA, 64 nt, Human
uuucgaggaagaaccugucccaggucuucuccaaggggcccagcucacguguauucuauuuugc

SEQ ID NO: 195527 - RNA, 64 nt, Human
ggugggcaggaaggacaugcaccgagaccaggcaggggcccaacuuucacguccagcccuggcc

SEQ ID NO: 195528 - RNA, 64 nt, Human
ggauuagaagggcuggacaaagagagaauucaauggggcccaaauuagaaugcuuauaaugaga

SEQ ID NO: 195529 - RNA, 64 nt, Human
uagcugcaacccaagcuggcccauaaucagcaguggggcccagcagcacaggaggggcggacgg

SEQ ID NO: 195530 - RNA, 64 nt, Human
acuguccuucccaguuccuguucagguucuggcaggggcccagggauccaggggaccugguucc

SEQ ID NO: 195531 - RNA, 64 nt, Human
gcccccagaggaguguccuggccgcuguccucccggggcccaugauggccauagauuugccuug

SEQ ID NO: 195532 - RNA, 64 nt, Human
ccaaauuggugaccaccagucaugccuaggaccuggggcccaaaagccgggcaaccucuggcua

SEQ ID NO: 195533 - RNA, 64 nt, Human
cuaaugcuucuuccuucagaaaguagaggaacuaggggcccaauuagcaucaucuaggggaauc

SEQ ID NO: 195534 - RNA, 64 nt, Human
ccgaagucucccuggucugaccaccaggaucccaggggcccaaggcggccccucccgccccuuc

SEQ ID NO: 195535 - RNA, 64 nt, Human
aacugaccaaucucccgcagcucuccugccccugggggcccacgacucaccuggugggccuggg

SEQ ID NO: 195536 - RNA, 64 nt, Human
ccccucauucccuccuugcacagaugcauacacuggggcccagcagcugccuccugaggugaca

SEQ ID NO: 195537 - RNA, 64 nt, Human
uccugccucagccucccgaguagcugggaccacaggggcccaccaccgcgcccggcuaauuuuu

SEQ ID NO: 195538 - RNA, 60 nt, Human
gauuucccaugcaugcugccagaauaaaaccaccaggaaugaauucacuccccacuucuc

SEQ ID NO: 195539 - RNA, 60 nt, Human
agaaacugcagucccagguauccagacagccaccaggauggucccucgccccacccccac

SEQ ID NO: 195540 - RNA, 60 nt, Human
acucaguguaagaucugcugggaacagggccaccaggaguggcuggaucucagucucucu

SEQ ID NO: 195541 - RNA, 60 nt, Human
caucccaugucagcucccuaggagccacagcaccaggaagggaugcugccuucaucuaac

SEQ ID NO: 195542 - RNA, 64 nt, Human
gcagucuuaccaaaauguuuaaagugaucucagaggggcccauggauuaacgcccucaucccaa

SEQ ID NO: 195543 - RNA, 64 nt, Human
uguguuccuaccucggcaagaucaccagcacugaggggcccagcuggagaaugauucugcuaca

SEQ ID NO: 195544 - RNA, 64 nt, Human
caccgacugcugcaaacaguguccaguggggucgggggcccacccccagcugggggaccccaug

SEQ ID NO: 195545 - RNA, 64 nt, Human
ugcccgcccccaggaagggggaaauggggcauuuggggcccagaccuacacuuggagcccaggu

SEQ ID NO: 195546 - RNA, 64 nt, Human
gcgcaaguggauguugaugguaguacaaaaagcaggggcccagccccagcuguuggcuacauga

SEQ ID NO: 195547 - RNA, 64 nt, Human
uggcuguuccuuguuauuccgaaagcccugguuuggggcccauguucacacuggcucucagucu

SEQ ID NO: 195548 - RNA, 64 nt, Human
agaccaguauuuccuggagcugugccucagugaaggggcccagccugaggaacccuggcucuuu

SEQ ID NO: 195549 - RNA, 64 nt, Human
cuauuccacccccaaguugaucugaguaucgucaggggcccaaaguacagaauuguucuuugcu

SEQ ID NO: 195550 - RNA, 64 nt, Human
ccugcccuuuaacuuucagaggcaauagguaaauggggcccauuaggucccucacuccacagag

SEQ ID NO: 195551 - RNA, 64 nt, Human
agcaagaagccacccuccuugcaggaugcccggcggggcccaggacggggcacaagugucaggc

SEQ ID NO: 195552 - RNA, 64 nt, Human
ugagccaaggcaaggauuugccaaaaauguucugggggcccagcaaaugcaggagccgaccugg

SEQ ID NO: 195553 - RNA, 64 nt, Human
cacugccagguagcugggggaguggcauggggcaggggcccaguucucagcagcagacacucug

SEQ ID NO: 195554 - RNA, 64 nt, Human
agggggcagaggagggguggucaggaugggcuggggggcccacuagcagcccccagcaucuccc

SEQ ID NO: 195555 - RNA, 64 nt, Human
gagccgccuacccucucacuggcugaaaagcaaaggggcccacaccaccauggcagaugcccuc

SEQ ID NO: 195556 - RNA, 64 nt, Human
uggaugcccuguagccccugcccgcauccuccagggggcccagggugccugcacuuugcugugg

SEQ ID NO: 195557 - RNA, 60 nt, Human
ugguggugcccacgggguugggcaagggcucaccaggaccucaacgggcaaaguugugca

SEQ ID NO: 195558 - RNA, 60 nt, Human
gaucucccaugcaugcugccagaauaaaaccaccaggaaugaauucacuccccacuucuc

SEQ ID NO: 195559 - RNA, 60 nt, Human
aggacagcaaauaagaacuuuguagaaucccaccaggacuuugcuaacaauaauguuugg

SEQ ID NO: 195560 - RNA, 60 nt, Human
gucaaaugucacauaggcaaagcaaucaagcaccaggaaguguuuaugaggaaacaacac

SEQ ID NO: 195561 - RNA, 64 nt, Human
acaaagcaaauuucuaucagccuugcuaaagcuaggggcccacuaaauauuuuuaucggcuagg

SEQ ID NO: 195562 - RNA, 64 nt, Human
acccucuugaagcuguucagaagccgcuugccgcggggcccacuaggcggggcggggguuggga

SEQ ID NO: 195563 - RNA, 64 nt, Human
ggaguaaugacaugaauggggccauauucuuccuggggcccaaaugcuggcuggccuugugguc

SEQ ID NO: 195564 - RNA, 64 nt, Human
caccuucaaugggcugggggacuuccugcuggucggggcccaagacgggaacuccuccuuccug

SEQ ID NO: 195565 - RNA, 64 nt, Human
ccugcagggccauggcucaggguggucucuucuuggggcccagugcaugguggccagagguguc

SEQ ID NO: 195566 - RNA, 64 nt, Human
ucugacugcuccauagguuuugacuggugaaacaggggcccagaugacaaccucuccuucgcuc

SEQ ID NO: 195567 - RNA, 64 nt, Human
caccuggagccggcucaaguggcuaaagcauccuggggcccagagccaggugauaggucccucu

SEQ ID NO: 195568 - RNA, 64 nt, Human
ccucugauaaauccaagcccgcccaggcccacggggggcccacgggaccccccgggacuccccg

SEQ ID NO: 195569 - RNA, 64 nt, Human
acagggacagacauggcgagcacagugcaggcccggggcccacgggcaacauggaacccuggga

SEQ ID NO: 195570 - RNA, 64 nt, Human
aacaaaccauuuuuuuucucuuuuuuuggaguugggggcccagggagaagggacaagacuuuua

SEQ ID NO: 195571 - RNA, 64 nt, Human
accacaugcuccaaccucccacugcucccugucaggggcccaggcugccaucacuggaggcugc

SEQ ID NO: 195572 - RNA, 64 nt, Human
auuuucagucguacgcauagacgccccaggauggggggcccacuguggcggaagggggucccug

SEQ ID NO: 195573 - RNA, 61 nt, Human
ucgacugguacgacagcuagccagggccacgggggcccagcacgagaguccucaugggcac

SEQ ID NO: 195574 - RNA, 64 nt, Human
uuuacuucauggacuuccacugccauccucccaaggggcccaaauucuuucaguggcuaccuac

SEQ ID NO: 195575 - RNA, 64 nt, Human
gaaggaggacccugaauuugagauccccggggcuggggcccagcacaacugcuguuuagugaac

SEQ ID NO: 195576 - RNA, 60 nt, Human
cucccacuucccucuuugacuuacaaagcccaccaggaagauccaggauaaucucuccau

SEQ ID NO: 195577 - RNA, 60 nt, Human
cucggcuccaccccagggccagcuuuuccucaccaggagcccggcuuccacuccccacau

SEQ ID NO: 195578 - RNA, 60 nt, Human
ucccagggagcucacagcaacacccccuaccaccaggaugggcaguaauaugugacagag

SEQ ID NO: 195579 - RNA, 60 nt, Human
uaauaugcuuuccagcuagaggggagaaaacaccaggaaagaggaacccugggucauaaa

SEQ ID NO: 195580 - RNA, 64 nt, Human
ggaaacuccuccuuccaacaagcagugggaucccggggcccagggcgggccgguguuggccgcu

SEQ ID NO: 195581 - RNA, 64 nt, Human
gaccccauggcagggguggcgucuucaugagggaggggcccaaagcccuugugggcggaccucc

SEQ ID NO: 195582 - RNA, 64 nt, Human
ugugaggcagcaccauuugacagguuaggaugcuggggcccagagagguuaagugucuugcccg

SEQ ID NO: 195583 - RNA, 64 nt, Human
ccccugcugcccugggcucaggcugcuacccucuggggcccaaagcugucccuucucagugcuu

SEQ ID NO: 195584 - RNA, 64 nt, Human
ucacagccuccauggccaggggccugucaagccaggggcccacacaccuggugccaggguccac

SEQ ID NO: 195585 - RNA, 64 nt, Human
cgugugggucgaggauucugugccuccaggaccaggggcccacccucugcccagggaguccuug

SEQ ID NO: 195586 - RNA, 64 nt, Human
uccauccaccccggugagcaggcccaaggcagcgggggcccacaccccucacacgcaaaacugg

SEQ ID NO: 195587 - RNA, 64 nt, Human
cuuccuuagagguauuuauucucaauaccugacaggggcccaugggaaugacuucagaagcauc

SEQ ID NO: 195588 - RNA, 64 nt, Human
ccuuggaaaugcacauucuuguauccaucuuacaggggcccaagaugauaaauaguaaacucaa

SEQ ID NO: 195589 - RNA, 64 nt, Human
aagagggcagggggccuacggugcuauugcuuuaggggcccaccacgggcaggggccugcuccc

SEQ ID NO: 195590 - RNA, 64 nt, Human
gaggaggcuucuauugauaaauccagagccucaaggggcccagccacgucaaacuucucucccu

SEQ ID NO: 195591 - RNA, 64 nt, Human
agaacccugccugaagcucuggaaacuuguggguggggcccagggaggauggggagggaguggc

SEQ ID NO: 195592 - RNA, 64 nt, Human
ggcccuaggcgcgguucaggucagggcuauggauggggcccaggggcuuugguggccccucccc

SEQ ID NO: 195593 - RNA, 64 nt, Human
acccagcuccagggagcagagugucgaggauggaggggcccagccuggacugacugcuacuucc

SEQ ID NO: 195594 - RNA, 64 nt, Human
ggcccccaccucccaugccauggacugagcagcaggggcccagcaucccuuggauaugguggcu

SEQ ID NO: 195595 - RNA, 60 nt, Human
cauauuccaaaaaccacuucugucccauuucaccaggaugacuaaggcaagcucccugug

SEQ ID NO: 195596 - RNA, 60 nt, Human
cuauuuauuucucaacccuggcuggccucucaccaggaguuuaggcugaaugccuuccac

SEQ ID NO: 195597 - RNA, 60 nt, Human
aauaauuuucuauguauuuaaagaaaaaugcaccaggauggugucugugcacgugacuau

SEQ ID NO: 195598 - RNA, 60 nt, Human
ccugugccaaaguccugucaggcuggugggcaccaggaaaggccugcacccucuuccugc

SEQ ID NO: 195599 - RNA, 64 nt, Human
cuggaggcuucggggcucucccgccugccuucucggggcccagacgcaaggcaccgauugggcc

SEQ ID NO: 195600 - RNA, 64 nt, Human
gcugcugccgcuggggacaagccgccaagacccaggggcccagagcuucuuccuuugggugagu

SEQ ID NO: 195601 - RNA, 64 nt, Human
aguggggccugggaggguuccccuggccuuaaaaggggcccaagccccaucucauccuggcacg

SEQ ID NO: 195602 - RNA, 64 nt, Human
ccugccccuaggaugcugcagcagagugagcaagggggcccaaaucgaccauaaaggguguagg

SEQ ID NO: 195603 - RNA, 64 nt, Human
cuuacuaggagagggagcugagguccuggugccaggggcccaggcccuccaaccauaaacaguc

SEQ ID NO: 195604 - RNA, 64 nt, Human
ccucccugcagacuccaauggggccagcacuggaggggcccacccacaugacuuuuccauugac

SEQ ID NO: 195605 - RNA, 64 nt, Human
agaacauucauccguaaauggaaucugauaaucuggggcccaaauucuguuuacuuaacaugug

SEQ ID NO: 195606 - RNA, 64 nt, Human
gcagccuugcgcugucccaggcaugcagcugccuggggcccaaguugcagugagcagggugggg

SEQ ID NO: 195607 - RNA, 64 nt, Human
uaggaggcaguaaauccagucacagugccugggaggggcccauccuuccaaaauguaaauccag

SEQ ID NO: 195608 - RNA, 64 nt, Human
aagaaaggaaauggcccuacuguagacagcuuauggggcccagaaaggcacugggcuuuaaaga

SEQ ID NO: 195609 - RNA, 64 nt, Human
ugaggcaggcgagaguaguacuggagggccuugaggggcccacagacagaucccauccaucagc

SEQ ID NO: 195610 - RNA, 64 nt, Human
gaggcauguggugcuggggauuggcagccauccuggggcccacacaggugugucuugcuccauu

SEQ ID NO: 195611 - RNA, 64 nt, Human
gggaguguccgguugggguuggacugaggacagaggggcccacacuuccuugccccuuuguguc

SEQ ID NO: 195612 - RNA, 64 nt, Human
cugucuugugcagagggccagagaauggcuuaugggggcccagguuggauggggaaaggcuaau

SEQ ID NO: 195613 - RNA, 64 nt, Human
cccaguguucuccuugggggcaggaaccuggggaggggcccagagcaaagggcaucagggagaa

SEQ ID NO: 195614 - RNA, 60 nt, Human
gauuuguguuuguuuuguuaaaguuguuggcaccaggaugcagagaaucagacuggccug

SEQ ID NO: 195615 - RNA, 60 nt, Human
cuucaucugggucuugcaggaggcaggcaacaccaggagcagaaaugaaagaggcaagaa

SEQ ID NO: 195616 - RNA, 60 nt, Human
ccuccauggguuuccaacccccaucacuggcaccaggaucucccacaggcacugguggug

SEQ ID NO: 195617 - RNA, 60 nt, Human
acauacuuugggagaagaacuuggugcaggcaccaggauuuuuuuuuuugcccacguguu

SEQ ID NO: 195618 - RNA, 64 nt, Human
uaaaggcaauuucaccaaauucacacauuuguacggggcccauuucuuuucaaacugaagaaua

SEQ ID NO: 195619 - RNA, 64 nt, Human
ugugcagacagcauggacacaaagaugaccacaaggggcccaaaacagaaaagagaaacacaag

SEQ ID NO: 195620 - RNA, 64 nt, Human
ucugcuguuccuucgaggguuccaggcuguguguggggcccaagcaugccccacccaccccucc

SEQ ID NO: 195621 - RNA, 64 nt, Human
caggagaggacucagccuccuguguuuuggagaaggggcccaauguguguugacgauggcuggg

SEQ ID NO: 195622 - RNA, 64 nt, Human
auuaguuucaucugcuucccugggaacuuacuaaggggcccagagcacuguuggaagucugguu

SEQ ID NO: 195623 - RNA, 64 nt, Human
uaaacaguguugugacugucucaugggaagagcuggggcccagagggaccuugagucagaaaug

SEQ ID NO: 195624 - RNA, 64 nt, Human
uuuuaacuguccagaacuuuccuccaacuucaugggggcccacgggugugggcgcuggcagucu

SEQ ID NO: 195625 - RNA, 64 nt, Human
gggaaaugguaugagcugaggggggccgugcccaggggcccacagggaacccugcuugcacuuu

SEQ ID NO: 195626 - RNA, 64 nt, Human
ucuaccccaaaccuaauaacccaaauuuggggauggggcccaggaauaugcauuuuuaaaaagu

SEQ ID NO: 195627 - RNA, 64 nt, Human
cuuuguuuguguuggcuuggugaggacagcaggaggggcccacaccucaagccuggaccagcca

SEQ ID NO: 195628 - RNA, 64 nt, Human
auguaggugggggaggcgucugcaggucaccuggggggcccagcccucucccagccuugccugg

SEQ ID NO: 195629 - RNA, 64 nt, Human
uggguagcaaggcagccgagagcaucucccuggaggggcccacgguugggccaagggcagaggg

SEQ ID NO: 195630 - RNA, 64 nt, Human
uggcucacguuccugcccuggaugggaugugaguggggcccacaucguggagcugugguggggc

SEQ ID NO: 195631 - RNA, 64 nt, Human
ugcaagagacagagcccccaagccucugccccaaggggcccacaaaggggagaagggccagccc

SEQ ID NO: 195632 - RNA, 64 nt, Human
uccagggacauguuuuuggaggcauauggagaagggggcccaggcgagguggcucacaccugua

SEQ ID NO: 195633 - RNA, 60 nt, Human
cgucacuuccucguuuuaacucagcugaaacaccaggacccaauagagagggcaagcuga

SEQ ID NO: 195634 - RNA, 60 nt, Human
cggguuagccguggcaccguugggaccucccaccaggacuccaaucacccaccucucuug

SEQ ID NO: 195635 - RNA, 60 nt, Human
cccuacaccuucccccagccacagccaucccaccaggagcagcgccugugcagaaugaac

SEQ ID NO: 195636 - RNA, 60 nt, Human
cuucuugagauuuucauacuaucauuuaaccaccaggaagcugaagugugugaaguacaa

SEQ ID NO: 195637 - RNA, 64 nt, Human
cagccacggcuuugcgggccgggcagucgacuucggggcccagggaccaaccugcauggacugu

SEQ ID NO: 195638 - RNA, 64 nt, Human
auuuuguagagaggaucuauauuuguagggguucggggcccaggccgggucccuaucucugugu

SEQ ID NO: 195639 - RNA, 64 nt, Human
uuucacuauggccuccuuugcccaaguugaaacaggggcccaucaucaugucuguuuccagaac

SEQ ID NO: 195640 - RNA, 64 nt, Human
gugaugcagucagaggcaccugcggguuagcccaggggcccaagcccuggauuuggccugcgga

SEQ ID NO: 195641 - RNA, 64 nt, Human
agacauuuuguucuugaaucugugagacccagaaggggcccacugagcccacucacuccagccu

SEQ ID NO: 195642 - RNA, 64 nt, Human
uggcuagaaauaucaagaguugaauccauaguguggggcccaugacucuagcugggcaccuugg

SEQ ID NO: 195643 - RNA, 64 nt, Human
uuggcgccaccuaguguccaguuuggcccauggcggggcccauucacggggcaacacugggcuu

SEQ ID NO: 195644 - RNA, 64 nt, Human
uuccgcaucaccccauccaccuuacagggaccagggggcccacguaaccaggacccagagggug

SEQ ID NO: 195645 - RNA, 64 nt, Human
caggagcccaguagccauguggccagucuaccauggggcccaggaguuggggaaacacaauaaa

SEQ ID NO: 195646 - RNA, 64 nt, Human
caccagggggccgcaggggucucuccacccugcaggggcccagacugccugcaggucaggcaca

SEQ ID NO: 195647 - RNA, 64 nt, Human
gaauaucugacuaccccugaauccacccagaaagggggcccaacacccuuguccauuuaugggu

SEQ ID NO: 195648 - RNA, 64 nt, Human
guugagagccaguggcgggugauggccagccccuggggcccagccccuguuuacugguucuugc

SEQ ID NO: 195649 - RNA, 64 nt, Human
uuugcgagccgcaaucgucgucugccugugugggggggcccagggccugccuugcacguugcag

SEQ ID NO: 195650 - RNA, 64 nt, Human
gcgaaggccagguugggggcaguguuguggcccuggggcccagccccaaacugggggcucugua

SEQ ID NO: 195651 - RNA, 64 nt, Human
aggcuauuccagcgagcugggacauuuccccaugggggcccacuccccucucuuccccagcagg

SEQ ID NO: 195652 - RNA, 60 nt, Human
ugggggccugagcagacacagaggugcaggcaccaggauucuccacuucuuccagcccug

SEQ ID NO: 195653 - RNA, 60 nt, Human
caagcugcaguagcuuccugaugccucauucaccaggauggguaacuuuaaagacaaguu

SEQ ID NO: 195654 - RNA, 60 nt, Human
cccaggugcaggccaccaccuccgggucggcaccaggacugcccucggugcucauaggga

SEQ ID NO: 195655 - RNA, 60 nt, Human
ugaugaaagauauccaaauaccagauaauccaccaggaaggcuuuuguuuaggaauuugu

SEQ ID NO: 195656 - RNA, 64 nt, Human
ggagucuugccucaaucugcugccguccaagccuggggcccaucgugccugccgccccuucagg

SEQ ID NO: 195657 - RNA, 64 nt, Human
cagugagcccaccuugcugcaacauugguucugaggggcccaagagauggcgucuuggucauuu

SEQ ID NO: 195658 - RNA, 64 nt, Human
gcuguuucuccaguggcauugccauugcccaggaggggcccagucaccaugagagcucccuugc

SEQ ID NO: 195659 - RNA, 64 nt, Human
aucucugaggugcaaagaaugcacuuuucccuauggggcccagaguuugccuuuucugccaggc

SEQ ID NO: 195660 - RNA, 64 nt, Human
aacagccugcccaguguggaugucucuuacagagggggcccaaggaaucaccaccccgcuucag

SEQ ID NO: 195661 - RNA, 64 nt, Human
cagggccuguggcagccuaacagggagaggccacggggcccaaaaacgcaacacgucucaaggc

SEQ ID NO: 195662 - RNA, 64 nt, Human
cagggcccuguaagguggacucuggccucgaaggggggcccaggucugagggguccagcucugg

SEQ ID NO: 195663 - RNA, 64 nt, Human
guccaaccccuuaaaauucauagaggagcaaacuggggcccauugaagggugaagaguuacuca

SEQ ID NO: 195664 - RNA, 64 nt, Human
gggccccgugggguccccacugccccgguacgagggggcccaagacccuggcaggucaggggcc

SEQ ID NO: 195665 - RNA, 64 nt, Human
gcguuugccuaggcagugguggcugccaucccucggggcccaggcccucacccgaagggcugcc

SEQ ID NO: 195666 - RNA, 64 nt, Human
caucaucucacuccuuugccugcacugccaggguggggcccaccaagauuccugaucaugacgg

SEQ ID NO: 195667 - RNA, 64 nt, Human
cacuugcaagcaacaucugcucuguuccucagguggggcccagagcccuuccccgagacugcug

SEQ ID NO: 195668 - RNA, 64 nt, Human
agggaggggauggcagaaacucagggaggggcuuggggcccauuguaucuggagagccuggauu

SEQ ID NO: 195669 - RNA, 64 nt, Human
ucaggcuuaucuccagagggaggugcccuggacuggggcccagauguucagggacccugccuac

SEQ ID NO: 195670 - RNA, 64 nt, Human
cccacuccccagccccccagcagcccccagccgaggggcccagggcccacagccagcgguggag

SEQ ID NO: 195671 - RNA, 64 nt, Human; identical to SEQ ID NO: 195070

SEQ ID NO: 195672 - RNA, 60 nt, Human
cccauccccacaaaggcuguugaaccacagcaccaggaagccugagaaugaauccugagg

SEQ ID NO: 195673 - RNA, 60 nt, Human
ucaccgcccucugccccagccacucccggccaccaggacaugcuucaaugccuggugcca

SEQ ID NO: 195674 - RNA, 60 nt, Human
ccagugguacuauuauaauaaggaagaagacaccaggaaggacuguaaaaggacauacca

SEQ ID NO: 195675 - RNA, 64 nt, Human
cuaugccaggccuccugggucugcagugagucugggggcccauggggacagggacaggugaggg

SEQ ID NO: 195676 - RNA, 64 nt, Human
cugggagaauggggcugagaggaggcuucggguuggggcccaagggagguguggugucaucugg

SEQ ID NO: 195677 - RNA, 64 nt, Human
ccauccuucccgcagcaccagccugagccacaguggggcccauggccccagcuggcugggucgc

SEQ ID NO: 195678 - RNA, 64 nt, Human
gauuuucuucuuuguggucuuuuuccugaaaguuggggcccaguccuuggcuguauccauguaa

SEQ ID NO: 195679 - RNA, 64 nt, Human
ugccaccaucagauuauaagcuccugaugcugggggggcccagccaucccccuccccccagcac

SEQ ID NO: 195680 - RNA, 64 nt, Human
ugugcgugccacuaccaaagccuucugggcugucggggcccaaccugcccaaccccagcacucc

SEQ ID NO: 195681 - RNA, 64 nt, Human
gaccagcacaaggaaggaggcuggcuggcucagaggggcccaccuugcguggaaugaaaacgcc

SEQ ID NO: 195682 - RNA, 64 nt, Human
ugcccucaugcccucuuccugcucacaugcuagcggggcccagcagcccugggugguuuugcca

SEQ ID NO: 195683 - RNA, 58 nt, Human
ggggcuccugccucuucugacuucacugggggcccagaggcagaugggugggugggug

SEQ ID NO: 195684 - RNA, 64 nt, Human
auuccacagggacaacgguuuagcuaugaaauuuggggcccaaaauuucacacuucaugugccu

SEQ ID NO: 195685 - RNA, 64 nt, Human
ucugccccaccugccggcugguuccagcagcgcuggggcccagcuggggggccgggaugggggc

SEQ ID NO: 195686 - RNA, 64 nt, Human
ugcagucuucucucuggcucaggugugggugggaggggcccacaggaagcucagccuucuccuc

SEQ ID NO: 195687 - RNA, 64 nt, Human
ggccaguguccacccaccucgcucagcggcucccggggcccagcaccagcucagaauaaagcga

SEQ ID NO: 195688 - RNA, 64 nt, Human
cauaguucugaggucccuguguguaggcuggggcggggcccaggagaccacggggagcaaacca

SEQ ID NO: 195689 - RNA, 64 nt, Human
gcuccaucccagcacacaggccuggggcuuggcaggggcccagcuggggcugggcccuggguuu

SEQ ID NO: 195690 - RNA, 64 nt, Human; identical to SEQ ID NO: 194992

SEQ ID NO: 195691 - RNA, 64 nt, Human; identical to SEQ ID NO: 194993

SEQ ID NO: 195692 - RNA, 64 nt, Human; identical to SEQ ID NO: 194709

SEQ ID NO: 195693 - RNA, 59 nt, Human; identical to SEQ ID NO: 191351

SEQ ID NO: 195694 - RNA, 64 nt, Human
uuaagcaucuaaggacaagguaaggagggucacuggggcccaagagucuggggaccagcuuggc

SEQ ID NO: 195695 - RNA, 64 nt, Human
cagguugccuugaauguggacucuggaagagccaggggcccagaaugccgggggaggcuucuga

SEQ ID NO: 195696 - RNA, 64 nt, Human
cagccggucucucugugcucgguugucuugggguggggcccauccgccgagguggggaccgaua

SEQ ID NO: 195697 - RNA, 64 nt, Human
ucaggucuuuccaagguugggacccaaggaucggggggcccagcagcccgcaccgaucgagccg

SEQ ID NO: 195698 - RNA, 64 nt, Human
agagaagcugagaccaggaccggugggguacaaaggggcccaugcaggagaugcccuggccagu

SEQ ID NO: 195699 - RNA, 64 nt, Human
agaaggcucaguguguaggaccuacaaaccuauaggggcccaucauaacguucucuuuaauuua

SEQ ID NO: 195700 - RNA, 64 nt, Human
gacgauagguggcaaaaccuuaagauuguguacuggggcccagaauuuuuauuucuaggaaugu

SEQ ID NO: 195701 - RNA, 64 nt, Human
cagacacagagcacagcucaugggcaacaucacuggggcccagagagagcuguccgccagugca

SEQ ID NO: 195702 - RNA, 64 nt, Human
ccccuccccaccaaauuauucggucucuuucuggggggcccagcuuacuguauguuacaagucu

SEQ ID NO: 195703 - RNA, 64 nt, Human
cgguggccucaggauucagggcccagccccugcaggggcccaggcugccucucaucuccaccca

SEQ ID NO: 195704 - RNA, 64 nt, Human
uccgugcccugguauuuaggccaucacauaugguggggcccaagagagccccauaugcacacug

SEQ ID NO: 195705 - RNA, 64 nt, Human
cccagccuuggugaggacaguguugggaggcccaggggcccaguaaagugcauuugacauugaa

SEQ ID NO: 195706 - RNA, 64 nt, Human
cucgcacagccucgcacaaaccacauugccugguggggcccaguguacugaaauaaagucguuc

SEQ ID NO: 195707 - RNA, 64 nt, Human
uucaggaaguguggcgaccagaaagcguagacccggggcccagggucugcccgccccugcagcc

SEQ ID NO: 195708 - RNA, 64 nt, Human
gccaccaaacugccaggggcugccguccacccguggggcccaggggcuggggccacagccuugc

SEQ ID NO: 195709 - RNA, 60 nt, Human
gacugccaccccccauugaagagacuggaccaccaggaaggucguuucacauucuguagu

SEQ ID NO: 195710 - RNA, 60 nt, Human
uggaggcacugugcauauuuucaaccagaucaccaggagcugagaucuucuucagucccu

SEQ ID NO: 195711 - RNA, 60 nt, Human
aguuuucucaguggggcagucucauaaaaucaccaggacauugaccaccugaccuccccu

SEQ ID NO: 195712 - RNA, 64 nt, Human
acucagaccccaaagcaagcagggggccaguggcggggcccagcgcccagcaggacacccaugc

SEQ ID NO: 195713 - RNA, 64 nt, Human
ugucccccaagaaacuaguaucucuggccuccugggggcccauucugcaugcccuccccacuuc

SEQ ID NO: 195714 - RNA, 64 nt, Human
gcgagaccgacacugugaucccugugcuggguccggggcccaguguagcgccuguccccagcca

SEQ ID NO: 195715 - RNA, 64 nt, Human
uuuuuugucccuaccauuuccuuacauuucccuuggggcccaucucuggcuccuugcuuuuugu

SEQ ID NO: 195716 - RNA, 64 nt, Human
gacagguugacuguguacccccaaccaaggagcuggggcccaaggccaguccugccccagagac

SEQ ID NO: 195717 - RNA, 64 nt, Human
ccccagcccagccccaccacagaucccagagauaggggcccagucuccaugggggcaaggagca

SEQ ID NO: 195718 - RNA, 64 nt, Human
gagcugucagucccucuaucccuucuccuguccaggggcccagagagaaacacaccuaccccug

SEQ ID NO: 195719 - RNA, 64 nt, Human
aggacacgaggcugccuaggcuggggucccagguggggcccagccaggaggugggguguggacc

SEQ ID NO: 195720 - RNA, 64 nt, Human
aggacagcucaaaaaggagaggacaggccuggcaggggcccacuggugcccagcaccaaggcga

SEQ ID NO: 195721 - RNA, 64 nt, Human
ugggcuggaccucaggacaggcauggaggccacaggggcccagcagcccacccuuuccucuccc

SEQ ID NO: 195722 - RNA, 64 nt, Human
cuagaccaaugauuacaaggugucugugguuuagggggcccagcccaucauuccuuuuccccuu

SEQ ID NO: 195723 - RNA, 64 nt, Human
uuuaagcacauccccuaggggagggggugagugaggggcccagagcccucuuuguggcuucccc

SEQ ID NO: 195724 - RNA, 64 nt, Human
cucucuuucucuucuuauacagacccucauuacuggggcccaagaugugggauacuacuguuag

SEQ ID NO: 195725 - RNA, 64 nt, Human
gcucucccuggacgaccggccucgaggcaacccuggggcccaccagccccugccaugcucucac

SEQ ID NO: 195726 - RNA, 64 nt, Human
uuucuggugggcuccucagcucccaccccaggcuggggcccagauugugaggucugugugcaug

SEQ ID NO: 195727 - RNA, 64 nt, Human; identical to SEQ ID NO: 195063

SEQ ID NO: 195728 - RNA, 64 nt, Human; identical to SEQ ID NO: 194652

SEQ ID NO: 195729 - RNA, 64 nt, Human; identical to SEQ ID NO: 191352

SEQ ID NO: 195730 - RNA, 64 nt, Human; identical to SEQ ID NO: 195069

SEQ ID NO: 195731 - RNA, 64 nt, Human
ccucgcccggcccggacacagggaggacgcucccggggcccagaggcaggacuguggcgggccg

SEQ ID NO: 195732 - RNA, 64 nt, Human
ccccacgccuuagcugcaggcccuuuugggcaaaggggcccauccuagaccagaggagcccagg

SEQ ID NO: 195733 - RNA, 64 nt, Human
aaccuguagguccccccagcucaccugcccuacuggggcccaacacuguacccagcugguuggg

SEQ ID NO: 195734 - RNA, 64 nt, Human
gauaagcaggaaggauggcaagcacgggacaggaggggcccacaauggagugggagaucagcca

SEQ ID NO: 195735 - RNA, 64 nt, Human
gagggccugaucaaggcaccuccucugcccacucggggcccagcugugauuuuuaucaguaaug

SEQ ID NO: 195736 - RNA, 64 nt, Human
ccuggagucuuuuuuuccucugcccugaucaacuggggcccaggaaaagcaaugucucuucacg

SEQ ID NO: 195737 - RNA, 64 nt, Human
agagcagauuucuaugguacccuguguuaguaaaggggcccagaaaucugggauguacuguuug

SEQ ID NO: 195738 - RNA, 55 nt, Human
cggauuucaugucccugugacugguggggcccauggaggagacaggaagccucaa

SEQ ID NO: 195739 - RNA, 64 nt, Human
gugugccucaaacuccugcccuccccaggccucuggggcccacuggaaagggcucugacccccu

SEQ ID NO: 195740 - RNA, 64 nt, Human
cccuacccuggcaggcacaggcgcagcuggcuggggggcccacuccaggcaggguggcguuaga

SEQ ID NO: 195741 - RNA, 64 nt, Human
cuucucaucuuuucacuggaggacaggaggcuauggggcccagcuacgcaccuggagauccuga

SEQ ID NO: 195742 - RNA, 64 nt, Human
gucgguuccuggcuggugucugcugagggaguggggggcccagccccuucucuucucccccgcc

SEQ ID NO: 195743 - RNA, 64 nt, Human
ggugugggcucccgccuggauggucuucgaaaccggggcccagguugcaccugggauucucuac

SEQ ID NO: 195744 - RNA, 64 nt, Human
ccaucuccccucagcucggcucagcucgguacccggggcccagggcaagcuccgcaggacuucc

SEQ ID NO: 195745 - RNA, 64 nt, Human
ucagccugcuaggagccucuaccagcaucauccuggggcccagcucaggccugggcauauggaa

SEQ ID NO: 195746 - RNA, 64 nt, Human; identical to SEQ ID NO: 194632

SEQ ID NO: 195747 - RNA, 64 nt, Human; identical to SEQ ID NO: 191369

SEQ ID NO: 195748 - RNA, 64 nt, Human; identical to SEQ ID NO: 194502

SEQ ID NO: 195749 - RNA, 64 nt, Human; identical to SEQ ID NO: 194503

SEQ ID NO: 195750 - RNA, 64 nt, Human
ccuccuccggcccuggagggagcaucucgggcugggggcccaccccucucugugccggcgccac

SEQ ID NO: 195751 - RNA, 64 nt, Human
uauacuaaagaaagaaauucaaaaguagcuauuuggggcccacaaaaauaacuauuauuuuagc

SEQ ID NO: 195752 - RNA, 64 nt, Human
guauggucaggaaugugacuguaaacuggacuuuggggcccaggcauaagucccuuccuccagg

SEQ ID NO: 195753 - RNA, 64 nt, Human
ucccguuucuccucugccccuggaagggaaugugggggcccacuuuuuuguacauguaccaccu

SEQ ID NO: 195754 - RNA, 64 nt, Human
ucugggagcuuccaagcccuugagguccagcuguggggcccaaaugacagccuuacaaggguuc

SEQ ID NO: 195755 - RNA, 64 nt, Human
gagacuggaaggguucccuuguccuagacauugaggggcccagauaagaccaaaaccaagcaua

SEQ ID NO: 195756 - RNA, 64 nt, Human
ggcggagguggggguggggguaguuuaagccuauggggcccagggggaaaggccaaacagaaac

SEQ ID NO: 195757 - RNA, 64 nt, Human
uuuguuucaaauaagccaucugauuguggugacuggggcccauguccaagacaauuccuggcau

SEQ ID NO: 195758 - RNA, 64 nt, Human
gcagagagguccugcaugaacagcuucaccugggggggcccagcacgaagucacaucccagccc

SEQ ID NO: 195759 - RNA, 64 nt, Human
agcgcccacgugcucagccacccucuggcucagcggggcccagacccaccucggcacggacacc

SEQ ID NO: 195760 - RNA, 64 nt, Human
cagacagaccucacgacagcacugacagggcccgggggcccaggugccgauugcaccagggagg

SEQ ID NO: 195761 - RNA, 64 nt, Human
acccgcccuggcaguugaauggggcggcaauugcggggcccaccuuagaccgaaggggaaaacc

SEQ ID NO: 195762 - RNA, 64 nt, Human
ugcuccucacacuuuuggaaccaugccuuccgggggggcccaucucuucuggccguccuugucu

SEQ ID NO: 195763 - RNA, 64 nt, Human
gacagcgauucccuguguagcucucacaugcacaggggcccauggacucuucagucuggagggu

SEQ ID NO: 195764 - RNA, 64 nt, Human
ggaaaugagcacaaagacacgaagucaugggccuggggcccagggccaggguggggcccaggcc

SEQ ID NO: 195765 - RNA, 64 nt, Human; identical to SEQ ID NO: 194504

SEQ ID NO: 195766 - RNA, 64 nt, Human; identical to SEQ ID NO: 191370

SEQ ID NO: 195767 - RNA, 64 nt, Human; identical to SEQ ID NO: 194521

SEQ ID NO: 195768 - RNA, 64 nt, Human; identical to SEQ ID NO: 194522

SEQ ID NO: 195769 - RNA, 64 nt, Human
acgaagucaugggccuggggcccagggccaggguggggcccaggccacuggcuccagagcccug

SEQ ID NO: 195770 - RNA, 64 nt, Human
cgguuucagcucccagccuccacccgggugagcuggggcccacguggcaucgauccucccugcc

SEQ ID NO: 195771 - RNA, 64 nt, Human
caguguuccauuccauuaagcuuccuugcaggguggggcccacuccaugaagacagcagucaug

SEQ ID NO: 195772 - RNA, 64 nt, Human
cuugcuuuaugagcccauuagcacuuugguucaaggggcccaccaagucuuggacgggaaggcg

SEQ ID NO: 195773 - RNA, 64 nt, Human
cgugucaccgccaccccgcaccccgcguguccccggggcccaggggaggcggcacuccaaccua

SEQ ID NO: 195774 - RNA, 64 nt, Human
gcccgcacauuccacucccauucucccuccaagaggggcccagcauuguauuucccugugaccc

SEQ ID NO: 195775 - RNA, 64 nt, Human
ggagaugagagaggagauaggcagauguggguauggggcccagugugagaaggaagacagagaa

SEQ ID NO: 195776 - RNA, 64 nt, Human
agcaggcccugcuccccgggcagccucccgccgaggggcccagcccccaacccacaggcacgga

SEQ ID NO: 195777 - RNA, 64 nt, Human
uaccacaggccucuggaaucagaaucuucaggguggggcccagcagucuguguuuuaacagguu

SEQ ID NO: 195778 - RNA, 64 nt, Human
gcucccuuguacccccucgccacaucccugucuuggggcccagcugcagccugcugccugcccu

SEQ ID NO: 195779 - RNA, 64 nt, Human
aagcuauguggcaggcuuguuugaaggacccagaggggcccagcugaccugucucacugcuccu

SEQ ID NO: 195780 - RNA, 64 nt, Human
cauuggacugucccauuugcugguuaaaaggauuggggcccaaauccucuggccuagcauuucu

SEQ ID NO: 195781 - RNA, 64 nt, Human
cagugucuggcaggcuccagaggguggacggagcggggcccauucucaggucaaaagcaagauu

SEQ ID NO: 195782 - RNA, 64 nt, Human
aucugccagcucuguccugcaugccuggcgagcuggggcccagggcagcaugaaggagagcccu

SEQ ID NO: 195783 - RNA, 64 nt, Human
ggccugcagccacaugggaggaaggcccagggguggggcccauggggucucugcaucuucaguc

SEQ ID NO: 195784 - RNA, 60 nt, Human
gacaagccuucuguucugcccaggccuucccaccaggaaucuccgaggcuccccagggcc

SEQ ID NO: 195785 - RNA, 60 nt, Human
ggagaacaucaugugugucaacaagacgggcaccaggaucaagcucaucgacuuuggucu

SEQ ID NO: 195786 - RNA, 60 nt, Human
uucuggggccacagaggagaggccacuucccaccaggacccccaacaugaagucuaggcc

SEQ ID NO: 195787 - RNA, 60 nt, Human
gguugcaggggcuccugcccugcuguaucccaccaggagggggccccacugcccuuccgg

SEQ ID NO: 195788 - RNA, 64 nt, Human
gcacagucaguggagagagccaggggcuggagguggggcccaccccagccucuggucccagcuc

SEQ ID NO: 195789 - RNA, 64 nt, Human
uggcugucucccugcaggcuccacagacuguccuggggcccagaggagcuggugcugaccuagc

SEQ ID NO: 195790 - RNA, 64 nt, Human
cucccgccucauuucagcccagggugcucauccaggggcccagaacagucccaccugugcugcu

SEQ ID NO: 195791 - RNA, 64 nt, Human
uguggcagggccguccaucagcgcugaccuuccgggggcccagagcuucccagcccugagucaa

SEQ ID NO: 195792 - RNA, 64 nt, Human
accuacccuggggccccagggagcaggacgcuccggggcccagcacguugcccugggccugugg

SEQ ID NO: 195793 - RNA, 64 nt, Human
cguggcuugguucccagggacagucagggccucgggggcccagcuauguacaacgaagcugucg

SEQ ID NO: 195794 - RNA, 64 nt, Human
gugacuaguacaagcagcccaagaaacucugaacggggcccaauggaggcaaacuugagcaaau

SEQ ID NO: 195795 - RNA, 64 nt, Human
gccgaggguuucacccacacugccagccuggguuggggcccaaggaugugaccuugagugucaa

SEQ ID NO: 195796 - RNA, 64 nt, Human
cggacuggugcccuccucacucccaccugcaucuggggcccauacugguuggcucccgcggugc

SEQ ID NO: 195797 - RNA, 64 nt, Human
ccagccuucccaaagcagcaggcgccuccaggcuggggcccaaccuagaaggcaggggucaauc

SEQ ID NO: 195798 - RNA, 64 nt, Human
cucggcgccuggguggcuugccgcccacacuucaggggcccagacuuacacccugacuguccca

SEQ ID NO: 195799 - RNA, 64 nt, Human
uccuggcuccccuucucccggccuuccucugccuggggcccacugcaucugauuggcagucacu

SEQ ID NO: 195800 - RNA, 64 nt, Human
cugcugauccucccaggcuuccgugugggucaguggggcccauggaugugcuuguuaacugagu

SEQ ID NO: 195801 - RNA, 64 nt, Human
gucauuuuaaccucagguggcacccagggcgaauggggcccagggcagaccuucagggccagag

SEQ ID NO: 195802 - RNA, 64 nt, Human
cuuucugggggcggaggggggaggggguggggagggggcccacaagcacgcccagcccccgccg

SEQ ID NO: 195803 - RNA, 64 nt, Human; identical to SEQ ID NO: 194843

SEQ ID NO: 195804 - RNA, 64 nt, Human; identical to SEQ ID NO: 191371

SEQ ID NO: 195805 - RNA, 64 nt, Human; identical to SEQ ID NO: 194541

SEQ ID NO: 195806 - RNA, 64 nt, Human; identical to SEQ ID NO: 194542

SEQ ID NO: 195807 - RNA, 64 nt, Human
ucggcuguuucccccaccagaccccagggaagccggggcccacuccgauccgccugggcucagc

SEQ ID NO: 195808 - RNA, 64 nt, Human
gcugaacccagcaccaguguccccuugugcccagggggcccagucuucuguggggugcacagcc

SEQ ID NO: 195809 - RNA, 64 nt, Human
ccucugggauuugcccacguacccaggucuggguggggcccaggcccggaugcagaggccugca

SEQ ID NO: 195810 - RNA, 64 nt, Human
cgcugcagugacaagaagggcagagggcagucauggggcccaggaccaugccacuggcccugcu

SEQ ID NO: 195811 - RNA, 64 nt, Human
ugggaugugacgggccugacaucuccccagggccggggcccagggcugcguuugcuccuggccc

SEQ ID NO: 195812 - RNA, 64 nt, Human
gggccuccuguucucagggaucacaccugggugaggggcccaagccccucccggaaccaaaggu

SEQ ID NO: 195813 - RNA, 58 nt, Human
acuuugaccucuacaccugagccugcugggggcccaguuuggugggcccuucuuuccu

SEQ ID NO: 195814 - RNA, 64 nt, Human
gaauuuccugcaugcucacacagcccuucccucuggggcccaacaaugccacagccuguucuau

SEQ ID NO: 195815 - RNA, 64 nt, Human
gccuugucuuuagaggacuucagcguccaagacuggggcccacccuucucaccagcacuaaaug

SEQ ID NO: 195816 - RNA, 64 nt, Human
aucccgcagggugccugggcggagaugucuuuuaggggcccaagaaaaugucuucagaucuuaa

SEQ ID NO: 195817 - RNA, 64 nt, Human
uccggccuuuugaccagaacgcacaccucgucggggggcccaguccagccaccccccagcacuu

SEQ ID NO: 195818 - RNA, 64 nt, Human
gaggcacgcaccacugcuucccacuggggccggcggggcccacgcacgacgucagccucuuacc

SEQ ID NO: 195819 - RNA, 64 nt, Human
ugccucaguccuguccccuugggcacugaggagaggggcccauucaccuuucuccuagaaugcu

SEQ ID NO: 195820 - RNA, 64 nt, Human
ugucccucagcagcuuacgccccuggagucuuggggggcccagccuggcccuggggccuuuucc

SEQ ID NO: 195821 - RNA, 64 nt, Human
agccagcccuacccagaguauuucugagccaugaggggcccaccagauugguucugaauuggau

SEQ ID NO: 195822 - RNA, 64 nt, Human
ggggacgggcgccaggcauuguccagaccuggucggggcccacuggaagcauccagaacagcac

SEQ ID NO: 195823 - RNA, 64 nt, Human
gacagagacagcaaggcagacaguggcuggcaggggggcccaggcccgggacgaggccuccccu

SEQ ID NO: 195824 - RNA, 64 nt, Human
cauauucgcuaguguuuaaaaggcuaagaauaguggggcccagccgaugugguaggugauaaag

SEQ ID NO: 195825 - RNA, 64 nt, Human
gcuacccugucucaccaugugcugguguggaaacggggcccagccagcacgccucaagguagau

SEQ ID NO: 195826 - RNA, 64 nt, Human
uaagcaaucccacccaagccuggaugcuucuagaggggcccacucccagcugggagaguguagg

SEQ ID NO: 195827 - RNA, 64 nt, Human
gccugcaagugugugugugugugaaagagagaggggggcccagaggccgccuuuugaaauguuu

SEQ ID NO: 195828 - RNA, 64 nt, Human
ugucucuuccuggcagcuccagaagguguugccaggggcccagaugcccugacacugcuugaau

SEQ ID NO: 195829 - RNA, 64 nt, Human
gagugcacugcauuccugugcccuagaugcacguggggcccacugcucguggacugugcuggug

SEQ ID NO: 195830 - RNA, 64 nt, Human
uggcaccauuggaguaggaggggguggaacacagggggcccauccugaucaggccccaucucaa

SEQ ID NO: 195831 - RNA, 64 nt, Human
accgccacuaugggcccgagcucaucgaccugagggggcccaucccugcccaccuccuggguaa

SEQ ID NO: 195832 - RNA, 64 nt, Human
ggaggcagagccagcagguggacagguguuugcaggggcccaacuuccccuggagcucagaggu

SEQ ID NO: 195833 - RNA, 64 nt, Human
cucagaaucuggccuuuuuccauggcaaugagguggggcccagccuccucuaaagugacuuugu

SEQ ID NO: 195834 - RNA, 64 nt, Human
gagccuccucagcuacuccauccuugcaccccugggggcccagcccacccgcaugcacagagca

SEQ ID NO: 195835 - RNA, 64 nt, Human
uugugcaaggccggaucugggccagguggcgaaaggggcccagucguucuugggcccaggaugg

SEQ ID NO: 195836 - RNA, 64 nt, Human
ccaguuggcccaggccccuggcagugcucccggaggggcccaggaaggccugggcagagacccu

SEQ ID NO: 195837 - RNA, 64 nt, Human; identical to SEQ ID NO: 194523

SEQ ID NO: 195838 - RNA, 64 nt, Human
ugacaggggacugugucugcagugccggcuacugggggcccagcugcaacgccuccugcccagc

SEQ ID NO: 195839 - RNA, 64 nt, Human
gggcuccgaucaaagccggccgugcugcuggccgggggcccagguggguacaagcuccuuugug

SEQ ID NO: 195840 - RNA, 64 nt, Human
aaggguuaguuuacaaucagccacauucuagguaggggcccacuucaccguacuaaccagggaa

SEQ ID NO: 195841 - RNA, 64 nt, Human
guccugcuggggaggggggcugggcucccaccauggggcccaugccgaguggaugccccccacc

SEQ ID NO: 195842 - RNA, 64 nt, Human
ucuuguuuguuuaggcccagguucugcccagaccggggcccagcagagcucucaggaggcugag

SEQ ID NO: 195843 - RNA, 64 nt, Human
uuucuuuugucucugccuuuccauuuguuagaugggggcccacucuuccuuagcucugucucug

SEQ ID NO: 195844 - RNA, 64 nt, Human
cagccuucacugugugugagaggucuccuggguuggggcccagccccucuagaguagcuggugg

SEQ ID NO: 195845 - RNA, 50 nt, Human
ucacacucccagaccccugaggggcccacggucaggacugguggggacug

SEQ ID NO: 195846 - RNA, 64 nt, Human
uccuuggagccugggccagcucaaggugggcacgggggcccagacaguacucuccaguucuggg

SEQ ID NO: 195847 - RNA, 64 nt, Human
gguagccuggcuuuucuggcuggggauggccgauggggcccacauuaggggguuuguugcacag

SEQ ID NO: 195848 - RNA, 64 nt, Human
gagccaggagaccugcucuccggcgcagacaggcggggcccagcgcucuccuggacgcccccgc

SEQ ID NO: 195849 - RNA, 64 nt, Human
gccuggaugcugaccccagcgcggcgggcagagcggggcccacucuucuuagcuuuucuacuca

SEQ ID NO: 195850 - RNA, 64 nt, Human
uggccuuucaccggguugcugguuucuuuucuguggggcccagacuucuguaaagcacacagau

SEQ ID NO: 195851 - RNA, 64 nt, Human
augcugcggguggugcuuccaggcagagugggugggggcccaccgggcaccgcccuuucuuccu

SEQ ID NO: 195852 - RNA, 64 nt, Human
cucccauggccgggacagcccaucagaggcugccggggcccacaggcagcccugccaccagugg

SEQ ID NO: 195853 - RNA, 60 nt, Human
ccacgugugaucccuuucacuccaucaggacaccaggacuguccuuaggaaaauguccuu

SEQ ID NO: 195854 - RNA, 60 nt, Human
agcgcaggccccucgggcgcaggcagcucacaccaggaagagacuguauugcagggugaa

SEQ ID NO: 195855 - RNA, 60 nt, Human
caggaacuuuauuccaaugcuaauggcagacaccaggaaggaggagaggaaccauuugug

SEQ ID NO: 195856 - RNA, 60 nt, Human
gcaucugaacaagugggucucucccuugagcaccaggagugggugccagccggccccgag

SEQ ID NO: 195857 - RNA, 64 nt, Human
gagcuggcggugcccagcgcaagggcgggaaggaggggcccaggcugcggagaacccagguggg

SEQ ID NO: 195858 - RNA, 64 nt, Human
cuccccccgccacgaagguugagaacaaagccagggggcccagaggagcaauagcccugggcca

SEQ ID NO: 195859 - RNA, 64 nt, Human
ccccuuuucguagugacaccagcuguguuggauuggggcccacccugcuccagcauggccuaau

SEQ ID NO: 195860 - RNA, 64 nt, Human
agccccuuggggcgcgaccuugugcgaggcccucggggcccacccacagcggcccagggccaga

SEQ ID NO: 195861 - RNA, 61 nt, Human
ccagagaggccuguggcuaguuugcccugggggggcccagcacagccccagcccggagccc

SEQ ID NO: 195862 - RNA, 64 nt, Human
auggggggggcgggggcagcugugucaucuuucuggggcccaggaggaucugggcugguuuguc

SEQ ID NO: 195863 - RNA, 64 nt, Human
ggcaggaccuuuguggggcuucgugcccugcucuggggcccaggcggggcugguccacauuccc

SEQ ID NO: 195864 - RNA, 64 nt, Human
acaggguuagaguuuggagagagcagacuggcggggggcccauuggggggaaggggacccuccg

SEQ ID NO: 195865 - RNA, 64 nt, Human
cuccggccgcgggucuccccgggcgccccucccuggggcccagcaccccuccucgccccauccc

SEQ ID NO: 195866 - RNA, 64 nt, Human
gccccucaacccgguggcauucugggggaggaguggggcccacagcucuccagcacccggaaua

SEQ ID NO: 195867 - RNA, 64 nt, Human
guugauggacacccacugugugccaggccccagcggggcccaugggggaggugaccugggugag

SEQ ID NO: 195868 - RNA, 64 nt, Human
uuggggggccccucuccccaggacgucaggggguggggcccauaaauaaauggaagcugguuuu

SEQ ID NO: 195869 - RNA, 64 nt, Human
gucagggcucaagacaccacccccuccagcuucuggggcccaggagccucucccugcuacaggg

SEQ ID NO: 195870 - RNA, 64 nt, Human
ugaugagcagggaagucugaggcccagaggacggggggcccagcgguaagggaugucccgcacu

SEQ ID NO: 195871 - RNA, 64 nt, Human
ugcacguuaccucaggaaugggccccaccaugaaggggcccaucugucagcagcgucuucuagg

SEQ ID NO: 195872 - RNA, 64 nt, Human; identical to SEQ ID NO: 195088

SEQ ID NO: 195873 - RNA, 60 nt, Human
caggggcauuugacauccccuccugguucucaccaggaaaacauccaaagcuuuggagga

SEQ ID NO: 195874 - RNA, 60 nt, Human
gcacuuugcaaacauccuggccaccaugggcaccaggacacagggauggauaccaccuac

SEQ ID NO: 195875 - RNA, 60 nt, Human
agcaccuaaaaguacaggaauuucacuucccaccaggacuugagcacauaacucuauguc

SEQ ID NO: 195876 - RNA, 64 nt, Human
cucucaccagccuugaacuguggccaccuagaaaggggcccauucagccucgucucuuuacaga

SEQ ID NO: 195877 - RNA, 64 nt, Human
gaaagcccagaaaaggacagaaacgaaguagaaaggggcccaguccuggccuggcuucuccuuu

SEQ ID NO: 195878 - RNA, 64 nt, Human
cagcccauccagcaaucgcccccuuucugcccugggggcccaggauguagauauuguacaaagg

SEQ ID NO: 195879 - RNA, 64 nt, Human
cccaggguccuuggccuaggagaggagcaguggaggggcccaggcucugagcuccacaggucug

SEQ ID NO: 195880 - RNA, 64 nt, Human
uucagcucaccuguucuccaggaccagcccugcuggggcccaggcccaggcucugagaggccgu

SEQ ID NO: 195881 - RNA, 64 nt, Human
ccugaggagagggagcugugggccacgccugggaggggcccagcugggguuacuggccccgcau

SEQ ID NO: 195882 - RNA, 64 nt, Human
gaauucuggacagcaugagaugcgugugcugaugggggcccagggacucugaacccuccugaug

SEQ ID NO: 195883 - RNA, 64 nt, Human
aggcugcucccuccccuuuuuccugcccagucgcggggcccaagucuuccuucuucguccgaaa

SEQ ID NO: 195884 - RNA, 64 nt, Human
ugacccuacccuguccccagaugcacuaacagauggggcccagcccccuuccucccuggacccc

SEQ ID NO: 195885 - RNA, 64 nt, Human
cauguuguuuguggggugcagagaugggagggguggggcccacccuggaagaguggacagugac

SEQ ID NO: 195886 - RNA, 64 nt, Human
ccaucuccuagagaaacuguguucucccugcucgggggcccauguuuuuuuacacgccugccuc

SEQ ID NO: 195887 - RNA, 64 nt, Human
ggggauccccacccccagugcccuuccccuuccuggggcccacucacacuacacccucuuccuu

SEQ ID NO: 195888 - RNA, 64 nt, Human
acguggcggccaugcaugguuuguggcggaagacggggcccagcggcucccccagcgcugaagc

SEQ ID NO: 195889 - RNA, 64 nt, Human
gcccgacccgggcccccaccuggucagcccuggcggggcccacucaggacagcugggggccggg

SEQ ID NO: 195890 - RNA, 64 nt, Human
cagggcuuauuccucggaguagaaggguguacagggggcccagacuccacagugacuugccaca

SEQ ID NO: 195891 - RNA, 64 nt, Human; identical to SEQ ID NO: 194803

SEQ ID NO: 195892 - RNA, 60 nt, Human
aggguuucaccauguuggcuaggauaguuucaccaggaucucuuggccucaugaucagcc

SEQ ID NO: 195893 - RNA, 60 nt, Human
cccagcacauggccauagaggcccaggcaccaccaggagcagcagccagcaccaccuaca

SEQ ID NO: 195894 - RNA, 60 nt, Human
ggauaaauccuagagaaacucauacauguacaccaggagauguguacaagaauauucaua

SEQ ID NO: 195895 - RNA, 64 nt, Human
ggccacccccucauggugcuacagacccugcccuggggcccacacacuccugccaggaagcccu

SEQ ID NO: 195896 - RNA, 64 nt, Human
cagguuauguuuaccaacuggggcggggguggggggggcccagggagcagggcuuaggggcuag

SEQ ID NO: 195897 - RNA, 64 nt, Human
agagagagagagaaagagagagagagagagagaaggggcccaagagagacagcacaggcagccc

SEQ ID NO: 195898 - RNA, 64 nt, Human
aaggaaugugcuuauuaaggcccacuguuuuacuggggcccauuguaugagggugaaguuuggc

SEQ ID NO: 195899 - RNA, 64 nt, Human
ggacagggaaugcugaggccucgaggggccucccggggcccaggacucuggcuucucuccucag

SEQ ID NO: 195900 - RNA, 64 nt, Human
uagcuauuuauuuauuuauugaagaugucccccaggggcccaggcuccccugcccgccccaagc

SEQ ID NO: 195901 - RNA, 64 nt, Human
cuauagggcaaagaacuuugagggucgagcagcaggggcccauucagucccagggagcagagac

SEQ ID NO: 195902 - RNA, 64 nt, Human
agguagagguggcaggggccgaccucaaguucaaggggcccagguuugcucuccccaaguuugg

SEQ ID NO: 195903 - RNA, 64 nt, Human
gggccaaggucucaugggggcuagggccaaguugggggcccaggaggcggggagggaggaggag

SEQ ID NO: 195904 - RNA, 64 nt, Human
aaugcuguacucaccuccaucacccuccaacuuuggggcccaugucuuccuugggccaaggucu

SEQ ID NO: 195905 - RNA, 64 nt, Human
ggaugcuacuagccccaacgccggggcuuugcauggggcccaggggaggccugagcuuggauuu

SEQ ID NO: 195906 - RNA, 64 nt, Human
ugccugccucaccuucaucaggggguggccaggaggggcccagacugugaauccugugcucugc

SEQ ID NO: 195907 - RNA, 64 nt, Human
ucccuguggaauuguaaucuccaguauuggagguggggcccauugggaggugauugaaucaugg

SEQ ID NO: 195908 - RNA, 53 nt, Human
ugcugaagacucggcugugacccggggcccaaagccaccaccguccuuccaaa

SEQ ID NO: 195909 - RNA, 64 nt, Human
gccuugcucaucuuuaugccccagcacuagguacggggcccaacacgugguaggcacuccauca

SEQ ID NO: 195910 - RNA, 60 nt, Human
augaggagggugcccuccuagcuccacccucaccaggaugaaggcgugcaaggggcucag

SEQ ID NO: 195911 - RNA, 60 nt, Human
aaugggugcccuacggggcccuccuucccccaccaggaacagauggaaccugccacccag

SEQ ID NO: 195912 - RNA, 60 nt, Human
uggacccagccuggucugcacugcaaccuccaccaggaccaggauccugggccacaggcu

SEQ ID NO: 195913 - RNA, 60 nt, Human
cucccacacucccccagacugcucgucuaucaccaggaucgcuuuguacuuugugcaaaa

SEQ ID NO: 195914 - RNA, 64 nt, Human
uuauccccggagcgcuagggcccgccccuccgcuggggcccacccccuucgugcgcaugcuuaa

SEQ ID NO: 195915 - RNA, 64 nt, Human
ugcugggucaccaagggcccacgcuggggcccugggggcccaggagacaccagcgggggcugcc

SEQ ID NO: 195916 - RNA, 64 nt, Human
guucuugccuaacucugugguuuuuggaccccauggggcccagacagagcacaggagcaugggc

SEQ ID NO: 195917 - RNA, 51 nt, Human
gcggcggcucccagcucugagggggcccauucuggcagcggcgccugcggc

SEQ ID NO: 195918 - RNA, 64 nt, Human
cccucugcuuccuugggucccuccaagacucccuggggcccaacuguguugcuccacccggacc

SEQ ID NO: 195919 - RNA, 64 nt, Human
ugucguggaacuggguagacccccugcagcguuaggggcccauuugugggcucgccaccuucag

SEQ ID NO: 195920 - RNA, 64 nt, Human
aacuuaagcgucuguuuaccaaagaccgggaacaggggcccaaacauguccaguccucuucuuc

SEQ ID NO: 195921 - RNA, 64 nt, Human
ccccccguccccaggugaaccaagggucugcuccggggcccauuuccagcuuggccgccgucug

SEQ ID NO: 195922 - RNA, 64 nt, Human
ucaguuuugaauucuuuuagcaacuuggauuagaggggcccauaugucagaagcucccagcacc

SEQ ID NO: 195923 - RNA, 64 nt, Human
aaaagggacugugaguaauggcugucacuugucgggggcccaaguggggugcucuggucugacc

SEQ ID NO: 195924 - RNA, 64 nt, Human
cucccugacucgccccuucaggccuggcaagcugggggcccaucgccguggggagucccuccca

SEQ ID NO: 195925 - RNA, 64 nt, Human
caacuccccuccgucugugacauggaggguguucggggcccaucccucugauguaguccucgcc

SEQ ID NO: 195926 - RNA, 64 nt, Human
gccaccuggugccuuaguccuugggcugggggagggggcccacccuuaaaggcggcgggagggg

SEQ ID NO: 195927 - RNA, 64 nt, Human
ugugggaugcuccauggggcccugcuggcuccauggggcccaggugcaaaggguuucugaaaaa

SEQ ID NO: 195928 - RNA, 64 nt, Human
aaaccccaacccugagggagacuggauuggucuuggggcccaggacccagacgcaggacagagu

SEQ ID NO: 195929 - RNA, 60 nt, Human
cgagauugccaggcccuuuucuccuaugcacaccaggauagacaaggcaggggauacugg

SEQ ID NO: 195930 - RNA, 60 nt, Human
cgugugaaagaagaacuccaaguuacuggacaccaggacaaaccagguagaucacugcau

SEQ ID NO: 195931 - RNA, 60 nt, Human
cuggagggauggccuaggacaccagggucacaccaggaacaugggagggccgugcuuguc

SEQ ID NO: 195932 - RNA, 60 nt, Human
aaugcaaagcauauuuggcaagcaguucaucaccaggacacuagcuaugauucuagaagu

SEQ ID NO: 195933 - RNA, 64 nt, Human
caggguaccaugcccaccuuuccuucagaacccuggggcccagggccacccagagguaagagga

SEQ ID NO: 195934 - RNA, 64 nt, Human
ccgauuaugugaaauuuuggccuuuaaacaaagaggggcccauucauaagaaaguguuauaucu

SEQ ID NO: 195935 - RNA, 64 nt, Human
gggcagcuuugcaaggauccggagccagcucccaggggcccagagccccccacuugaagaggag

SEQ ID NO: 195936 - RNA, 64 nt, Human
uugccgucccgucauggggcagggaauccauagcggggcccacaggcagggguaugagugcguc

SEQ ID NO: 195937 - RNA, 64 nt, Human
guaacugaguguggcgggaagggugggcccuggaggggcccaugugggcugaaggaugggggcu

SEQ ID NO: 195938 - RNA, 64 nt, Human
ccuucaggggcugcuggagggcagcccaaagccaggggcccaccccgccccaccccaccccacc

SEQ ID NO: 195939 - RNA, 64 nt, Human
acggcuggagagaaauagggagaugcaggaagugggggcccauggggcccccaagaagcggacu

SEQ ID NO: 195940 - RNA, 61 nt, Human
uggaacucacuggaaagugacgcgcauggacggggcccagcuaggcgccaggacuuggccu

SEQ ID NO: 195941 - RNA, 64 nt, Human
ggcucaugcacauuuuuaccaucaguaagacgcuggggcccaagaucaucauugugaagcggau

SEQ ID NO: 195942 - RNA, 64 nt, Human
accuuacuccaccgggcacaucccaaccugcacuggggcccacucgagcgcuuguucuggucuc

SEQ ID NO: 195943 - RNA, 64 nt, Human
gugucugggccugucccauggcuggggcagugagggggcccagucagccucuuuggggcacccu

SEQ ID NO: 195944 - RNA, 64 nt, Human
auccaaggaggggcacgugcaccugauucuccuuggggcccagaggaagcugaugucauggcug

SEQ ID NO: 195945 - RNA, 64 nt, Human
cagaacccugcugcccuuucuaggcagccuccuuggggcccaagcucugcucccuggaucugcc

SEQ ID NO: 195946 - RNA, 64 nt, Human
ucccugagcaguccuggcccccggccacugucucggggcccaccucucgccccucaucuuggua

SEQ ID NO: 195947 - RNA, 64 nt, Human
cgggcugacuuccaccucccaguggugagcagugggggcccaaacccaguuuccuucucauuuu

SEQ ID NO: 195948 - RNA, 64 nt, Human; identical to SEQ ID NO: 195084

SEQ ID NO: 195949 - RNA, 64 nt, Human; identical to SEQ ID NO: 195085

SEQ ID NO: 195950 - RNA, 64 nt, Human; identical to SEQ ID NO: 195086

SEQ ID NO: 195951 - RNA, 61 nt, Human; identical to SEQ ID NO: 195087

SEQ ID NO: 195952 - RNA, 64 nt, Human
gccauaagggacagggagguaugggagagcgcugggggcccaucccccuguccacccagugucc

SEQ ID NO: 195953 - RNA, 64 nt, Human
agccuccagcuuuaacuucugucugcuccuaaugggggcccaaagcucagggcuggggagccug

SEQ ID NO: 195954 - RNA, 64 nt, Human
ucccuuuauuacacaggacagccaggggaggaggggggcccagcccugggaggcuggugggagg

SEQ ID NO: 195955 - RNA, 64 nt, Human
cacgccagcgcguggcccauguaugaggagugaaggggcccaacgcaauaaccacgucccccac

SEQ ID NO: 195956 - RNA, 64 nt, Human
gugaggguggcacauggaacuucacgggucacugggggcccacucuuccagggucaucgaugca

SEQ ID NO: 195957 - RNA, 64 nt, Human
agcuguacacccagcagaggacuccagccuucucggggcccaggccugggccagaagcuguuga

SEQ ID NO: 195958 - RNA, 64 nt, Human
accuuacuccaccgggcacaucccaaccugcacuggggcccacccgagcgcuuguucuggucuc

SEQ ID NO: 195959 - RNA, 64 nt, Human
ggguccagaugugggggccuguccaaggguggcuggggcccagggcaucgcuaaacccaaaugg

SEQ ID NO: 195960 - RNA, 64 nt, Human
agcugggugaggguccugguuccagcagagcacuggggcccauccaaguuuguucugccaccac

SEQ ID NO: 195961 - RNA, 64 nt, Human
gcccuuccugcugccucccuccugucuggcuccuggggcccaugcuuagagcccaggcuccagc

SEQ ID NO: 195962 - RNA, 64 nt, Human
ccucagagugcuuggcugcuguaucuuuaaugcuggggcccaaguaagggcacagaucccccca

SEQ ID NO: 195963 - RNA, 64 nt, Human
caggaccagauuuuguuuggagccucagcaugccggggcccagaugauggagcauaacgggucc

SEQ ID NO: 195964 - RNA, 64 nt, Human
ucucccccuccaggggcuccaggacucucccuggggggcccaccucuugcccccuaaccucuuu

SEQ ID NO: 195965 - RNA, 64 nt, Human
cgguaguugcuuuucucucuccugaugcuagguuggggcccacccugcucccuguuccugcuag

SEQ ID NO: 195966 - RNA, 64 nt, Human
gcccuaaaggggacuggcugcugugaucuucuaaggggcccagggccaacccuguaggcuuccc

SEQ ID NO: 195967 - RNA, 63 nt, Human; identical to SEQ ID NO: 195090

SEQ ID NO: 195968 - RNA, 64 nt, Human; identical to SEQ ID NO: 195091

SEQ ID NO: 195969 - RNA, 64 nt, Human; identical to SEQ ID NO: 194651

SEQ ID NO: 195970 - RNA, 64 nt, Human; identical to SEQ ID NO: 191312

SEQ ID NO: 195971 - RNA, 64 nt, Human
uuccaguccuguaggggagacaaaaccagauuggggggcccaaggggagcauggaaaaggccgg

SEQ ID NO: 195972 - RNA, 52 nt, Human
agacagcucaugaggcgugaccggggcccacaucugugugucgugacuucug

SEQ ID NO: 195973 - RNA, 64 nt, Human
gcugcagcagggagagcugggcagaagcagcgagggggcccagcuggcgagacuguagcccccu

SEQ ID NO: 195974 - RNA, 64 nt, Human
agcggggagcuccaggugcaggagggcaccggccggggcccacgcccucugcccgccucccugg

SEQ ID NO: 195975 - RNA, 64 nt, Human
agccucagcuggggcucucagcaccaaagaacgaggggcccaggucuuguuggcaccccgggag

SEQ ID NO: 195976 - RNA, 64 nt, Human
ucugcccuggaaagggggugaccucuugccucgaggggcccagggaagccugggugucaagugc

SEQ ID NO: 195977 - RNA, 64 nt, Human
caagacauucauguacagucuggaauguauauauggggcccauaaaaauucccaguaugcaugu

SEQ ID NO: 195978 - RNA, 64 nt, Human
ccaccgugauggggccaacagcaagggagggguaggggcccauacaggaguccuccuuucugag

SEQ ID NO: 195979 - RNA, 55 nt, Human
cugcugcugacgagccauaagaccuggggcccaacugccucuccagcauuggccu

SEQ ID NO: 195980 - RNA, 64 nt, Human
gaggggaagaagaaggccucacuuuugcugcugcggggcccacacagccgcugcuacuuugggg

SEQ ID NO: 195981 - RNA, 64 nt, Human
ucuacuuugcuccguggaggaagcugggguacaaggggcccagugcuggccacacagcagcgca

SEQ ID NO: 195982 - RNA, 64 nt, Human
aggcaggugagcaaccaguuggcuaggggagcagggggcccaccagagcuguggagaggggacc

SEQ ID NO: 195983 - RNA, 64 nt, Human
cucucaucccaggacauuuggggcaagugaguuaggggcccaggggcaauuuucccucugaaua

SEQ ID NO: 195984 - RNA, 64 nt, Human
ccccacaucuuugccagaggugugacauggucagggggcccaucugcuacucuuucccaccagc

SEQ ID NO: 195985 - RNA, 64 nt, Human
acgaguccucagcacucugccggcagugggggugggggcccaugcccgcgggggagagaaggag

SEQ ID NO: 195986 - RNA, 64 nt, Human; identical to SEQ ID NO: 194936

SEQ ID NO: 195987 - RNA, 64 nt, Human; identical to SEQ ID NO: 195061

SEQ ID NO: 195988 - RNA, 60 nt, Human
augacuuauaaagcagcaacagcugaggcgcaccaggacacagcuuccauuucuuuaacg

SEQ ID NO: 195989 - RNA, 64 nt, Human
cugggaaugcagguucuagaaggggugggggcauggggcccaggagguugcuagagauaggaaa

SEQ ID NO: 195990 - RNA, 64 nt, Human
gcuggagcccgaucacagucccgcgguuugucagggggcccaccuucuagaugaccccuuaaua

SEQ ID NO: 195991 - RNA, 64 nt, Human
cacggggugggagggaaccguggcgucccugcguggggcccaugggugagacacuccaguacug

SEQ ID NO: 195992 - RNA, 64 nt, Human; identical to SEQ ID NO: 20268

SEQ ID NO: 195993 - RNA, 64 nt, Human; identical to SEQ ID NO: 20269

SEQ ID NO: 195994 - RNA, 64 nt, Human; identical to SEQ ID NO: 20270

SEQ ID NO: 195995 - RNA, 64 nt, Human; identical to SEQ ID NO: 194786

SEQ ID NO: 195996 - RNA, 64 nt, Human; identical to SEQ ID NO: 194824

SEQ ID NO: 195997 - RNA, 64 nt, Human; identical to SEQ ID NO: 191313

SEQ ID NO: 195998 - RNA, 64 nt, Human; identical to SEQ ID NO: 20271

SEQ ID NO: 195999 - RNA, 64 nt, Human; identical to SEQ ID NO: 20272

SEQ ID NO: 196000 - RNA, 54 nt, Human; identical to SEQ ID NO: 20273

SEQ ID NO: 196001 - RNA, 64 nt, Human; identical to SEQ ID NO: 20274

SEQ ID NO: 196002 - RNA, 59 nt, Human; identical to SEQ ID NO: 20275

SEQ ID NO: 196003 - RNA, 64 nt, Human; identical to SEQ ID NO: 20276

SEQ ID NO: 196004 - RNA, 64 nt, Human; identical to SEQ ID NO: 20277

SEQ ID NO: 196005 - RNA, 64 nt, Human; identical to SEQ ID NO: 20278

SEQ ID NO: 196006 - RNA, 64 nt, Human; identical to SEQ ID NO: 20279

SEQ ID NO: 196007 - RNA, 64 nt, Human; identical to SEQ ID NO: 20280

SEQ ID NO: 196008 - RNA, 64 nt, Human; identical to SEQ ID NO: 20281

SEQ ID NO: 196009 - RNA, 59 nt, Human; identical to SEQ ID NO: 20282

SEQ ID NO: 196010 - RNA, 64 nt, Human; identical to SEQ ID NO: 20283

SEQ ID NO: 196011 - RNA, 64 nt, Human; identical to SEQ ID NO: 20284

SEQ ID NO: 196012 - RNA, 64 nt, Human; identical to SEQ ID NO: 20285

SEQ ID NO: 196013 - RNA, 64 nt, Human; identical to SEQ ID NO: 20286

SEQ ID NO: 196014 - RNA, 64 nt, Human; identical to SEQ ID NO: 194805

SEQ ID NO: 196015 - RNA, 64 nt, Human; identical to SEQ ID NO: 194842

SEQ ID NO: 196016 - RNA, 64 nt, Human; identical to SEQ ID NO: 191314

SEQ ID NO: 196017 - RNA, 64 nt, Human; identical to SEQ ID NO: 20287

SEQ ID NO: 196018 - RNA, 64 nt, Human; identical to SEQ ID NO: 20288

SEQ ID NO: 196019 - RNA, 64 nt, Human; identical to SEQ ID NO: 20289

SEQ ID NO: 196020 - RNA, 64 nt, Human; identical to SEQ ID NO: 20290

SEQ ID NO: 196021 - RNA, 64 nt, Human; identical to SEQ ID NO: 20291

SEQ ID NO: 196022 - RNA, 64 nt, Human; identical to SEQ ID NO: 20292

SEQ ID NO: 196023 - RNA, 64 nt, Human; identical to SEQ ID NO: 20293

SEQ ID NO: 196024 - RNA, 64 nt, Human; identical to SEQ ID NO: 20294

SEQ ID NO: 196025 - RNA, 64 nt, Human; identical to SEQ ID NO: 20295

SEQ ID NO: 196026 - RNA, 64 nt, Human; identical to SEQ ID NO: 20296

SEQ ID NO: 196027 - RNA, 64 nt, Human; identical to SEQ ID NO: 20297

SEQ ID NO: 196028 - RNA, 64 nt, Human; identical to SEQ ID NO: 20298

SEQ ID NO: 196029 - RNA, 64 nt, Human; identical to SEQ ID NO: 20299

SEQ ID NO: 196030 - RNA, 64 nt, Human; identical to SEQ ID NO: 20300

SEQ ID NO: 196031 - RNA, 64 nt, Human; identical to SEQ ID NO: 20301

SEQ ID NO: 196032 - RNA, 64 nt, Human; identical to SEQ ID NO: 20302

SEQ ID NO: 196033 - RNA, 64 nt, Human; identical to SEQ ID NO: 194784

SEQ ID NO: 196034 - RNA, 64 nt, Human; identical to SEQ ID NO: 191331

SEQ ID NO: 196035 - RNA, 64 nt, Human; identical to SEQ ID NO: 194880

SEQ ID NO: 196036 - RNA, 64 nt, Human; identical to SEQ ID NO: 20303

SEQ ID NO: 196037 - RNA, 64 nt, Human; identical to SEQ ID NO: 20304

SEQ ID NO: 196038 - RNA, 64 nt, Human; identical to SEQ ID NO: 20305

SEQ ID NO: 196039 - RNA, 64 nt, Human; identical to SEQ ID NO: 20306

SEQ ID NO: 196040 - RNA, 64 nt, Human; identical to SEQ ID NO: 20307

SEQ ID NO: 196041 - RNA, 64 nt, Human; identical to SEQ ID NO: 20308

SEQ ID NO: 196042 - RNA, 55 nt, Human; identical to SEQ ID NO: 20309

SEQ ID NO: 196043 - RNA, 60 nt, Human; identical to SEQ ID NO: 20310

SEQ ID NO: 196044 - RNA, 64 nt, Human; identical to SEQ ID NO: 20311

SEQ ID NO: 196045 - RNA, 64 nt, Human; identical to SEQ ID NO: 20312

SEQ ID NO: 196046 - RNA, 57 nt, Human; identical to SEQ ID NO: 20313

SEQ ID NO: 196047 - RNA, 64 nt, Human; identical to SEQ ID NO: 20314

SEQ ID NO: 196048 - RNA, 64 nt, Human; identical to SEQ ID NO: 20315

SEQ ID NO: 196049 - RNA, 64 nt, Human; identical to SEQ ID NO: 20316

SEQ ID NO: 196050 - RNA, 64 nt, Human; identical to SEQ ID NO: 20317

SEQ ID NO: 196051 - RNA, 64 nt, Human; identical to SEQ ID NO: 20318

SEQ ID NO: 196052 - RNA, 64 nt, Human; identical to SEQ ID NO: 194900

SEQ ID NO: 196053 - RNA, 60 nt, Human
guguuuccagugugggaaaaaacacagcuucaccaggagguucuccacugugguggucug

SEQ ID NO: 196054 - RNA, 60 nt, Human
gguuggaugggagugggcaccucagaaagucaccaggacuuggggucaggaacaguggcu

SEQ ID NO: 196055 - RNA, 64 nt, Human; identical to SEQ ID NO: 20319

SEQ ID NO: 196056 - RNA, 64 nt, Human; identical to SEQ ID NO: 20320

SEQ ID NO: 196057 - RNA, 64 nt, Human; identical to SEQ ID NO: 20321

SEQ ID NO: 196058 - RNA, 64 nt, Human; identical to SEQ ID NO: 20322

SEQ ID NO: 196059 - RNA, 64 nt, Human; identical to SEQ ID NO: 20323

SEQ ID NO: 196060 - RNA, 64 nt, Human; identical to SEQ ID NO: 20324

SEQ ID NO: 196061 - RNA, 64 nt, Human; identical to SEQ ID NO: 20325

SEQ ID NO: 196062 - RNA, 64 nt, Human; identical to SEQ ID NO: 20326

SEQ ID NO: 196063 - RNA, 64 nt, Human; identical to SEQ ID NO: 20327

SEQ ID NO: 196064 - RNA, 64 nt, Human; identical to SEQ ID NO: 20328

SEQ ID NO: 196065 - RNA, 64 nt, Human; identical to SEQ ID NO: 20329

SEQ ID NO: 196066 - RNA, 64 nt, Human; identical to SEQ ID NO: 20330

SEQ ID NO: 196067 - RNA, 64 nt, Human; identical to SEQ ID NO: 20331

SEQ ID NO: 196068 - RNA, 59 nt, Human; identical to SEQ ID NO: 20282

SEQ ID NO: 196069 - RNA, 64 nt, Human; identical to SEQ ID NO: 20333

SEQ ID NO: 196070 - RNA, 64 nt, Human; identical to SEQ ID NO: 20334

SEQ ID NO: 196071 - RNA, 64 nt, Human; identical to SEQ ID NO: 191332

SEQ ID NO: 196072 - RNA, 64 nt, Human; identical to SEQ ID NO: 194898

SEQ ID NO: 196073 - RNA, 64 nt, Human; identical to SEQ ID NO: 194899

SEQ ID NO: 196074 - RNA, 64 nt, Human; identical to SEQ ID NO: 194881

SEQ ID NO: 196075 - RNA, 64 nt, Human; identical to SEQ ID NO: 191333

SEQ ID NO: 196076 - RNA, 64 nt, Human; identical to SEQ ID NO: 194918

SEQ ID NO: 196077 - RNA, 64 nt, Human; identical to SEQ ID NO: 194919

SEQ ID NO: 196078 - RNA, 64 nt, Human; identical to SEQ ID NO: 195072

SEQ ID NO: 196079 - RNA, 64 nt, Human; identical to SEQ ID NO: 195073

SEQ ID NO: 196080 - RNA, 64 nt, Human; identical to SEQ ID NO: 195074

SEQ ID NO: 196081 - RNA, 64 nt, Human; identical to SEQ ID NO: 195075

SEQ ID NO: 196082 - RNA, 64 nt, Human; identical to SEQ ID NO: 195076

SEQ ID NO: 196083 - RNA, 64 nt, Human; identical to SEQ ID NO: 195077

SEQ ID NO: 196084 - RNA, 64 nt, Human; identical to SEQ ID NO: 195078

SEQ ID NO: 196085 - RNA, 64 nt, Human; identical to SEQ ID NO: 195079

SEQ ID NO: 196086 - RNA, 64 nt, Human; identical to SEQ ID NO: 195080

SEQ ID NO: 196087 - RNA, 64 nt, Human; identical to SEQ ID NO: 195081

SEQ ID NO: 196088 - RNA, 60 nt, Human
caacuuuuaaaagugaauuugauuuguacccaccaggagaaauacaguugggaaggguga

SEQ ID NO: 196089 - RNA, 60 nt, Human
uagugguaggucagaagaagaugcugugaacaccaggacuuuaaucuuaugcuuaaaaug

SEQ ID NO: 196090 - RNA, 60 nt, Human
gacguguagggccagagcccguccagaggccaccaggagcugagacagugccaccaccag

SEQ ID NO: 196091 - RNA, 60 nt, Human
aauuuaggugaagacauauuaaauaugagacaccaggacuugaaacuuaucucaacccgu

SEQ ID NO: 196092 - RNA, 55 nt, Human
ccuggagccuucaucccuaagucaacaccaggagagcuucucccaaacuccccgu

SEQ ID NO: 196093 - RNA, 60 nt, Human
ugcccuguccaccuguugggugggcagagccaccaggaacccagacaccaccuccaacuc

SEQ ID NO: 196094 - RNA, 60 nt, Human
cuuggguuggagugaaauucuggucucagacaccaggagaccagagucucugaggaugaa

SEQ ID NO: 196095 - RNA, 60 nt, Human
uuuuaggcaccuacugugugcauagcauuccaccaggacucaucucccuuccuucucagg

SEQ ID NO: 196096 - RNA, 60 nt, Human
cccccucucuuccccacuggguucugccaccaccaggaggauuucaagaaagcaccaaag

SEQ ID NO: 196097 - RNA, 60 nt, Human
ugcucuaacuggagcacauucacuuacgaacaccaggaaaccacagggcccuugucgccc

SEQ ID NO: 196098 - RNA, 60 nt, Human
cuguucccugcugggugggaaugcgcucuucaccaggaagaaggcccgggaggaggaucc

SEQ ID NO: 196099 - RNA, 60 nt, Human
gugggguggggcaagugccccaacuccccucaccaggagaggcaccugcuuggugccgcc

SEQ ID NO: 196100 - RNA, 60 nt, Human
ugcuagggucuguugccaaggucaacccaucaccaggaacugucacuggggacgagucca

SEQ ID NO: 196101 - RNA, 60 nt, Human
caggccuccuccugagggcagccccuggagcaccaggaagcguugccgcuggcugugccc

SEQ ID NO: 196102 - RNA, 60 nt, Human
gcggcuugugcuuugccuucacuuggaagccaccaggaacagaaggucuggccacccugg

SEQ ID NO: 196103 - RNA, 60 nt, Human
guagcuggagaagauggcgcacccaucccccaccaggauaaagcagagccugcugccugc

SEQ ID NO: 196104 - RNA, 60 nt, Human
auuuugcauugggguugguuccauuucggccaccaggacugccccucccccacuccuccc

SEQ ID NO: 196105 - RNA, 60 nt, Human
aaaguguugaaccugggacccugaggaauucaccaggaguaaauggcuuucauguauuug

SEQ ID NO: 196106 - RNA, 60 nt, Human
uaacuaacagccucccaccccauuaagacucaccaggagaggucugagggccauucagaa

SEQ ID NO: 196107 - RNA, 60 nt, Human
agcgggccagcagcccagggaaccccugcccaccaggauugcuggaagugugacggagca

SEQ ID NO: 196108 - RNA, 60 nt, Human
acauuuaauaauggaccaaauucaacagaacaccaggaaggucaagacgcucuccaaagg

SEQ ID NO: 196109 - RNA, 60 nt, Human
ugauauggauugaaucugguuggucauuuccaccaggaaucagaggcagcuguuaccagg

SEQ ID NO: 196110 - RNA, 60 nt, Human
ggagaccagcagaagccugggguaccuagucaccaggaucuccaggacucccagggagca

SEQ ID NO: 196111 - RNA, 60 nt, Human
ugggccccgcaggcgaaagcacguuccagccaccaggaggccaccuauuguuucaaaaua

SEQ ID NO: 196112 - RNA, 60 nt, Human
uucaguaacacacccucccugcuccaagugcaccaggaugcaaaugcacagaauucacca

SEQ ID NO: 196113 - RNA, 60 nt, Human
ccuaccuaccaagauauaccugauauauuccaccaggauauccucccuccagauauacuu

SEQ ID NO: 196114 - RNA, 60 nt, Human
uaccuucugcuuccaaggaauaugacagaucaccaggaugcugcucgucgugaggauuua

SEQ ID NO: 196115 - RNA, 60 nt, Human
acguguucaaguccugaaacaggcuccccucaccaggacagucacccccaaacuugaccc

SEQ ID NO: 196116 - RNA, 60 nt, Human
gcaguguggucaccgagugaggacccuccucaccaggaaccgcaucccugugcugccucc

SEQ ID NO: 196117 - RNA, 60 nt, Human
gaagggaaacugucuaggauucagcugaaccaccaggaaccuggcaacaucacgauuuaa

SEQ ID NO: 196118 - RNA, 60 nt, Human
uuguuucacccuacuucaaguacacuuccacaccaggaaaacagacccaaauuccauaaa

SEQ ID NO: 196119 - RNA, 60 nt, Human
guuuggggaaugcggccgcauucccugagucaccaggaauguuaaagucagugggaacgu

SEQ ID NO: 196120 - RNA, 60 nt, Human
cuccaauccaggcagugaggaauccugaaacaccaggagaggcgucagaaguaggaaggg

SEQ ID NO: 196121 - RNA, 60 nt, Human
cucgccagucccgggggccugcccugcucccaccaggagagagggcaaagggaugagccu

SEQ ID NO: 196122 - RNA, 60 nt, Human
ggcauuuuuagucauuaaaaaaaaucuagucaccaggaggaucccuaugacucaaaauaa

SEQ ID NO: 196123 - RNA, 60 nt, Human
acgucuccacggagcccucgggaccugcugcaccaggaaagccacuccaccaguagugcu

SEQ ID NO: 196124 - RNA, 60 nt, Human
aucaagugaccugggaagaaccgaguuuaacaccaggauguguuuccuuagauuuccuuu

SEQ ID NO: 196125 - RNA, 60 nt, Human
cugugacucccccucuuucacuucauagcucaccaggacuguuuuauaaacugcuguauu

SEQ ID NO: 196126 - RNA, 60 nt, Human
gaacccccacauucucucacugaaguuucccaccaggaugaccccacagccagagucccu

SEQ ID NO: 196127 - RNA, 60 nt, Human
gucagagaagacuggcgucagcagccaaaacaccaggaaacacauuucuguggccuuagc

SEQ ID NO: 196128 - RNA, 60 nt, Human
ugaaaucaggcauuuaacauacuaugaaaacaccaggagucaaugauuaaugaaagguga

SEQ ID NO: 196129 - RNA, 60 nt, Human
ucuaagaagugcccuucaucacccugaugacaccaggauuugaaauaagacaggaauaaa

SEQ ID NO: 196130 - RNA, 60 nt, Human
auaacuggcuucugcuugucauccacacaacaccaggacuuaagacaaaugggacugaug

SEQ ID NO: 196131 - RNA, 60 nt, Human
uuuucagagugaagaucugucuggcuuuaucaccaggaugucacaugucagagaguauca

SEQ ID NO: 196132 - RNA, 60 nt, Human
ugaguucucuguaagacugugguggaguugcaccaggaggugccucugccucucgacuug

SEQ ID NO: 196133 - RNA, 60 nt, Human
aaauaauuccugcuaccaacaacagagcuucaccaggaaguugaguuuucaagaugccuu

SEQ ID NO: 196134 - RNA, 60 nt, Human
gaggcaggcagaucucacccagcacuaggacaccaggaggccagguaacuuucugcagcu

SEQ ID NO: 196135 - RNA, 60 nt, Human
cugcugucaccucccaucaucccacucucucaccaggaucaaggguacaguaacacgaau

SEQ ID NO: 196136 - RNA, 60 nt, Human
gauuugacccugugugggaaaugcugaaagcaccaggaggaagccgguucccgugagaua

SEQ ID NO: 196137 - RNA, 60 nt, Human
uccgucucccauuuguuacagccucaccugcaccaggauagaaagcacgugauggaaucu

SEQ ID NO: 196138 - RNA, 60 nt, Human
aauaggagggauguuccaguggaugagggccaccaggaagcacagguccaaggcuggucc

SEQ ID NO: 196139 - RNA, 60 nt, Human
uagaugccacucccaaauccccuucauacccaccaggaugugugcccagccaggccucca

SEQ ID NO: 196140 - RNA, 60 nt, Human
acguggggcugagcuuggaguacguguggucaccaggacugagucgcuuggaacagcaga

SEQ ID NO: 196141 - RNA, 60 nt, Human
uuguugagaaaaaaaguggcauugcgcucacaccaggaugcuggagcagagcugacaugc

SEQ ID NO: 196142 - RNA, 60 nt, Human
uggaccaaucuacucggggaauuccaggcccaccaggacacgugccaauggccccauuca

SEQ ID NO: 196143 - RNA, 60 nt, Human
ugccuaaggagcccgaagaauucugcugcucaccaggacccagcucugggagugcagcug

SEQ ID NO: 196144 - RNA, 60 nt, Human
agcacuguggcuggacugccgcgccacgggcaccaggaccccuaagaccaagugacaacu

SEQ ID NO: 196145 - RNA, 60 nt, Human
ccaguauugcuggagccccaacacaguacccaccaggacggggcacuccgcccccacccg

SEQ ID NO: 196146 - RNA, 60 nt, Human
cccggccuggacugggaaauggggguagggcaccaggagagaaauccuccuggguacucc

SEQ ID NO: 196147 - RNA, 60 nt, Human
uacgucaucgugcccuccaccuacgagccccaccaggagggggaauucauccuccggguc

SEQ ID NO: 196148 - RNA, 60 nt, Human
gaaagccagggggcagugccaaacacgcggcaccaggagauggaggaugucaucaggcug

SEQ ID NO: 196149 - RNA, 60 nt, Human
aagugagccuggacaacaacguggagccugcaccaggagcggccagggaggguucucccc

SEQ ID NO: 196150 - RNA, 57 nt, Human
acgcuaucacaacagcaugacgaccuucaccaggaccugacuucaaaccugagucug

SEQ ID NO: 196151 - RNA, 60 nt, Human
ugggcuaacaggcugacacuucggcagggucaccaggaggcacagcuaggggcaugcuca

SEQ ID NO: 196152 - RNA, 60 nt, Human
gugagggugggcugcccucuucacauggggcaccaggaacaccgucuggaacaggaagga

SEQ ID NO: 196153 - RNA, 60 nt, Human
caugaaucuugggagucuacauuuucuuaucaccaggagcuggacugccaucuccuuaua

SEQ ID NO: 196154 - RNA, 60 nt, Human
uccccaaagugucagcaacuuugaggagggcaccaggaaacaaagaugccuccccagccc

SEQ ID NO: 196155 - RNA, 60 nt, Human
auggaaauauuagcugccccgucugccauucaccaggaaaaauuucuauggcaauuuugu

SEQ ID NO: 196156 - RNA, 60 nt, Human
cagagcgcacagggagugcacauauccaggcaccaggacuagggcuggagugaggggggg

SEQ ID NO: 196157 - RNA, 60 nt, Human
agacauaccucccagaggggcauggacugccaccaggacugacccuggcgucggggagaa

SEQ ID NO: 196158 - RNA, 60 nt, Human
agagccaauaaagagaauuaaaaaccugugcaccaggagcaucuuuuaaauacacuagcc

SEQ ID NO: 196159 - RNA, 60 nt, Human
ggugggaggaggcagcgcccaucucagcagcaccaggacugccugggacucccuggcaac

SEQ ID NO: 196160 - RNA, 60 nt, Human
cucugccuccucccugccaggcgccagggacaccaggaauucgggggccccacgcaccac

SEQ ID NO: 196161 - RNA, 60 nt, Human
caccagggucuggcuuugaaggguaguggacaccaggauccuuuggauuaauccucugcc

SEQ ID NO: 196162 - RNA, 60 nt, Human
ucucccuccuuuccuuacaggcacuaggagcaccaggaacccagggccuggccuucucuc

SEQ ID NO: 196163 - RNA, 60 nt, Human
gggauuagccuaaccccacucugucacccacaccaggaucgggugggaccuggagcuagg

SEQ ID NO: 196164 - RNA, 60 nt, Human
gacaucucacuccacuccuaccucccuuaccaccaggagcauucaagcucuggauugggc

SEQ ID NO: 196165 - RNA, 60 nt, Human
uggcugcacuguaaacgccaaucggggggucaccaggaucaaccgcaggcuuucuucagu

SEQ ID NO: 196166 - RNA, 60 nt, Human
ccauccagauucagugagcggugcccauggcaccaggagccccucgccggcuccgccuac

SEQ ID NO: 196167 - RNA, 60 nt, Human
ccucuugguuggccaggcccaccaggaagucaccaggacaguccacccgcccuguuggca

SEQ ID NO: 196168 - RNA, 60 nt, Human
aggccacuuggccucuugguuggccaggcccaccaggaagucaccaggacaguccacccg

SEQ ID NO: 196169 - RNA, 60 nt, Human
cggagggguguguggccagguacuaggaggcaccaggaaaucccgcgggguggcccaugc

SEQ ID NO: 196170 - RNA, 60 nt, Human
cuguguucucaggccccccugcuuuugucucaccaggacccauaccuuucaccuuguucc

SEQ ID NO: 196171 - RNA, 60 nt, Human
gaggaaagggaggaagucuacacagaggagcaccaggacggcuggaauuuccauaugugc

SEQ ID NO: 196172 - RNA, 60 nt, Human
gccggcuuugccuggugaggcuggagggagcaccaggaccugcugucugcugucagcccc

SEQ ID NO: 196173 - RNA, 60 nt, Human
ugccaacuugauguuccaccugccacaaaccaccaggacugaaagaagaaaacaguacag

SEQ ID NO: 196174 - RNA, 60 nt, Human
gugagacagggagacaagugaaugagaugucaccaggauaagaccacagggaagcaaaga

SEQ ID NO: 196175 - RNA, 60 nt, Human
ggucaccagaccuccaaauauggcugccaccaccaggaccuuuccaguuacuccuuauau

SEQ ID NO: 196176 - RNA, 60 nt, Human
cugcucaacauaggccugcucagccucuagcaccaggacucaggugaugaggaucaaggg

SEQ ID NO: 196177 - RNA, 60 nt, Human
gugugucagagcccaggggagaaugcagcccaccaggagcaccuggacccccugcccgcc

SEQ ID NO: 196178 - RNA, 60 nt, Human
gggagucccuguaggcucugccaucaucagcaccaggagagccgaccccucccgggaccc

SEQ ID NO: 196179 - RNA, 60 nt, Human
gcugcugccuggugacggcacccggaggcccaccaggacgcgccaccggugaaugugccu

SEQ ID NO: 196180 - RNA, 53 nt, Human
gcaaucauguaaacuucugacaccaccaggagcugacucacaccugaacugaa

SEQ ID NO: 196181 - RNA, 60 nt, Human
cuugcugcugagugcaccacuucaagugaccaccaggaggugcuaucgcaccacugugua

SEQ ID NO: 196182 - RNA, 60 nt, Human
gccacaggacacagucagauuuccagucuccaccaggaaccucuucagaaagugugcuuu

SEQ ID NO: 196183 - RNA, 60 nt, Human
gacaaggaagguggaauguucuguuuuggccaccaggaaaugggguggggugggcauaca

SEQ ID NO: 196184 - RNA, 60 nt, Human
cuguggguggggagcuggggcaagaugaggcaccaggaaaggggugguagucagaggagg

SEQ ID NO: 196185 - RNA, 60 nt, Human
cacuguugccucccagugacccugcugggacaccaggacaaggaagacaguuucgccucu

SEQ ID NO: 196186 - RNA, 60 nt, Human
ccaccaccucaccaguuuccaggugguaagcaccaggacgcccucgagguugcucuggga

SEQ ID NO: 196187 - RNA, 60 nt, Human
agaaauuacuggaaggcuuccacuaggguccaccaggaguucucccaccaccucaccagu

SEQ ID NO: 196188 - RNA, 60 nt, Human
ucaggucucccccuacauauuaauaccagucaccaggagcccaccaccucccucuaggau

SEQ ID NO: 196189 - RNA, 60 nt, Human
gaugccucccuagcccagauggcaccuggacaccaggaugggacugcaaccucaggucuc

SEQ ID NO: 196190 - RNA, 60 nt, Human
aggaauacccagcagggacaggucagcucucaccaggagagugaggccccuggcugcugc

SEQ ID NO: 196191 - RNA, 60 nt, Human
aacgaaugccaaaucagacuccaccuagagcaccaggaaacagcuuguacccugguaggg

SEQ ID NO: 196192 - RNA, 60 nt, Human
aguucuaaaccacagucuauaagcccgagucaccaggacggccugucuggccacagacag

SEQ ID NO: 196193 - RNA, 60 nt, Human
ucagugaagagaguagaucacacuugggcacaccaggauucacauaaacauuguaucuuc

SEQ ID NO: 196194 - RNA, 60 nt, Human
guggcuggccuuuuaaaucgacgucucucucaccaggauuugguguuuagcuguuucucu

SEQ ID NO: 196195 - RNA, 60 nt, Human
uuuuuaguaagguuauaguaaauagcuuuacaccaggauggauucugaaauauaaauucu

SEQ ID NO: 196196 - RNA, 60 nt, Human
gucucugugagcagugacuugaaccaaacacaccaggaauaauccauucuuuggggccuc

SEQ ID NO: 196197 - RNA, 60 nt, Human
acuguuuuccaacgugacauuuuauauucccaccaggaauguuuaaaacuagugucuuca

SEQ ID NO: 196198 - RNA, 50 nt, Human
guguaccauacaacaaauaacaccaggaaacucuggaaugaacaguauca

SEQ ID NO: 196199 - RNA, 60 nt, Human
uccugccaagguuugcuguggauucagaagcaccaggagcaagagaccagaaggaugauc

SEQ ID NO: 196200 - RNA, 60 nt, Human
ccgcugcuggccgcucucuucucugccucucaccaggacagccgccccccaggguacucc

SEQ ID NO: 196201 - RNA, 60 nt, Human
gccgcgcgacaguggagccaaggguuagggcaccaggaggggccagguggcgucggcagc

SEQ ID NO: 196202 - RNA, 60 nt, Human
uggacggucuccuacauguucaguggaggccaccaggagcauccaugagcggggaagggg

SEQ ID NO: 196203 - RNA, 60 nt, Human
gagcuaggggcccgccccgcggacugacagcaccaggaaaccaaaugaugucccugcccg

SEQ ID NO: 196204 - RNA, 60 nt, Human
cgggcagggggugcaggggaggaaacuccucaccaggagagccaaagacaggguugugcc

SEQ ID NO: 196205 - RNA, 60 nt, Human
ccuccacccucccucccugaucccgugugccaccaggagggaguggcagcuauagucugg

SEQ ID NO: 196206 - RNA, 60 nt, Human
gcuuuguggccucacugcaacacaaagcuccaccaggaggcugguucacguccccuacca

SEQ ID NO: 196207 - RNA, 60 nt, Human
ugaccaaggccacagagcuaugggugucagcaccaggauuugaagccaggugaauccgag

SEQ ID NO: 196208 - RNA, 60 nt, Human
ccguguugguggcgaugucccagacaaucccaccaggacggcccagacaucccuacuggc

SEQ ID NO: 196209 - RNA, 60 nt, Human
gaggaggggccggcccgcgggagccgcggccaccaggaggccccgcuccgucccaucggg

SEQ ID NO: 196210 - RNA, 60 nt, Human
ggagagcugggaggaggcauugucacuucccaccaggaugcaggacuugggguugaggug

SEQ ID NO: 196211 - RNA, 60 nt, Human
gagagaaggcuggcauuggcaggaggagagcaccaggacgaggaugggaagcgaccucca

SEQ ID NO: 196212 - RNA, 60 nt, Human
agagccugauccuggggucuucugagacuccaccaggagccggagagggcagggagccaa

SEQ ID NO: 196213 - RNA, 60 nt, Human
ggcccuggcuucaucccuucuaaggcuguccaccaggagcccggugcuaggggaagcauc

SEQ ID NO: 196214 - RNA, 60 nt, Human
ugccaaccauuagucucguucauauuuuuacaccaggagucaacaaacuguggccauugg

SEQ ID NO: 196215 - RNA, 60 nt, Human
aaaccacaaugugcugucacucuagacagucaccaggaugauuaaauuuaaaucacaaua

SEQ ID NO: 196216 - RNA, 60 nt, Human
ggggagcuggcaagaggagcugcuuguucccaccaggaccagaggaggcugcguuucccc

SEQ ID NO: 196217 - RNA, 60 nt, Human
cagccaggacacggggccucaguccacagccaccaggagguggacucuuccgaccuccag

SEQ ID NO: 196218 - RNA, 60 nt, Human
aggugccacccaccuuggcccuaaaacagccaccaggaaagcagccggagagccggacag

SEQ ID NO: 196219 - RNA, 60 nt, Human
uagcauguuccucauuccccaaugacaccucaccaggaucacccuuaccaaccuuacuuc

SEQ ID NO: 196220 - RNA, 60 nt, Human
guucugcccucccgucaccccuguuucuggcaccaggaauccccaacaugcacugauguu

SEQ ID NO: 196221 - RNA, 60 nt, Human
ugagggagaggcccagcccugagccucccccaccaggacugggccuccccggcagcaaga

SEQ ID NO: 196222 - RNA, 60 nt, Human
gcuucucucaccaggaacauucgcuucucucaccaggaacauuuaugguaguaugagggg

SEQ ID NO: 196223 - RNA, 60 nt, Human
gagccaggagaugcacaccuucgcuucucucaccaggaacauucgcuucucucaccagga

SEQ ID NO: 196224 - RNA, 60 nt, Human
ggaagcagcccagccuguggcugcccccgacaccaggaggagggccaggagaguuccagg

SEQ ID NO: 196225 - RNA, 60 nt, Human
cgagccgcccgccaaggcugcagggagcaccaccaggagcccagugucugacggccucca

SEQ ID NO: 196226 - RNA, 60 nt, Human
cacuguccccucccugauccaggguuccaccaccaggagggcagacccagccacauacca

SEQ ID NO: 196227 - RNA, 60 nt, Human
guggagggcacgggugccacccacaaaccacaccaggaggcgcugcagccaccagggccc

SEQ ID NO: 196228 - RNA, 60 nt, Human
cucccagacaccucaagcccuauucacaggcaccaggaaaccccacacaggaauucccau

SEQ ID NO: 196229 - RNA, 60 nt, Human
augaaggacuucugagcaucagauaauccacaccaggaagaaacuuccaaaaauugcuuu

SEQ ID NO: 196230 - RNA, 59 nt, Human
ugucuugcaguuauggcugaucagucauccaccaggaacgaagauuuccugaagaagac

SEQ ID NO: 196231 - RNA, 60 nt, Human
aagugaaugggccuguggcccacccggggucaccaggaaaggaucugaauaaagaggacc

SEQ ID NO: 196232 - RNA, 60 nt, Human
cacccuugccugcgcuggcccaguggaaaccaccaggaucuugaugcaacuuggcauuug

SEQ ID NO: 196233 - RNA, 60 nt, Human
cacaucgggcuguuuugcauuuagugguagcaccaggacccaaaggaaauagcagugggg

SEQ ID NO: 196234 - RNA, 60 nt, Human
ggagaucauuccauuacacuccagccugggcaccaggaacgaaacucguucucaaaaaac

SEQ ID NO: 196235 - RNA, 60 nt, Human
ccccagccagccuggaccccuaacaaagaccaccaggacauccugggaacucugggacuc

SEQ ID NO: 196236 - RNA, 60 nt, Human
uggugaacucaugaccccaggccccugcuccaccaggaugucccccagguccugccagcu

SEQ ID NO: 196237 - RNA, 60 nt, Human
ccaucccuggaucccaagaguggugcgauccaccaggagugccgcccccuuguggggggg

SEQ ID NO: 196238 - RNA, 60 nt, Human
uuguaguuuaaacagcguucacagcaucuucaccaggaguaaauuccaccucaugaaacc

SEQ ID NO: 196239 - RNA, 60 nt, Human
uccaaagagcugauucuaccaauccaauuucaccaggaaaauuccaucagggauuggaug

SEQ ID NO: 196240 - RNA, 60 nt, Human
uguguuuaagcuauugagagccccaggccacaccaggacuugcaguggugggaauccauu

SEQ ID NO: 196241 - RNA, 60 nt, Human
ccuguucugccgguguguacagccucagcgcaccaggagacccuagagugguuuccaucu

SEQ ID NO: 196242 - RNA, 60 nt, Human
ccucuucagcaagaccacagccaugacaaacaccaggaugcaugcuccuuguccccuccc

SEQ ID NO: 196243 - RNA, 60 nt, Human
aggcucuuuuucucccuggccuccagugcccaccaggaggaucugcgcacggugcacagc

SEQ ID NO: 196244 - RNA, 60 nt, Human
guuuccagccaggccucggggucaucuuuucaccaggagcaaacccaagucuuaguugcu

SEQ ID NO: 196245 - RNA, 60 nt, Human
gauuuccuuugcccauuugggccagaaggucaccaggaguucaucacugcuuagugucaa

SEQ ID NO: 196246 - RNA, 60 nt, Human
gugaaagaggacguguuacccacugccaugcaccaggacuggcuguguaaccuugggugg

SEQ ID NO: 196247 - RNA, 60 nt, Human
ucaaaacgaucugaccaccucugcccuguccaccaggauaagugacaccuaggacccagg

SEQ ID NO: 196248 - RNA, 60 nt, Human
accgagaacuccagagacccagauguuggacaccaggaaggggccccacagccgagacga

SEQ ID NO: 196249 - RNA, 58 nt, Human
gcugacagaaauacugcugacaucucugcaccaggaccucuuaaggaaaccacuguac

SEQ ID NO: 196250 - RNA, 60 nt, Human
agaaggugagaaacacuccaaaucuaaacacaccaggacuucucccauccgucgccuugg

SEQ ID NO: 196251 - RNA, 60 nt, Human
agaaggcgagaaacaugccaaaucuaaacacaccaggacucccauccaucgccuugagac

SEQ ID NO: 196252 - RNA, 60 nt, Human
uucuccugcugcucuuggaugcagggaucacaccaggacagccugggguuccccugaggg

SEQ ID NO: 196253 - RNA, 60 nt, Human
ugccuuggggaaggucuccccaugugccugcaccaggagacagacagagaaggcagcagg

SEQ ID NO: 196254 - RNA, 60 nt, Human
cacccugggggaggucuccucaugcgccugcaccaggagacagacacagaagguggcagg

SEQ ID NO: 196255 - RNA, 60 nt, Human
ggcugacaagcaauccaggaacaaaauacucaccaggacgaggaagaggacuuuggggga

SEQ ID NO: 196256 - RNA, 60 nt, Human
ccaccacauccuccguccagccgccauugccaccaggagaaccacuacaugcagcccaug

SEQ ID NO: 196257 - RNA, 60 nt, Human
cauugguugacuguuuacagaagacucacucaccaggauaaacauugcuguauguuacag

SEQ ID NO: 196258 - RNA, 60 nt, Human
ucaucuccagcuagccuugggaggccgucccaccaggaaaucucucuauuccguagccug

SEQ ID NO: 196259 - RNA, 60 nt, Human
ccauuaauuugccucucuguguuuaaagagcaccaggaccgaauggauuuucacuucagg

SEQ ID NO: 196260 - RNA, 60 nt, Human
uugcggccagcucuccuggggguagggggccaccaggacucaccucccucuucauuuagg

SEQ ID NO: 196261 - RNA, 60 nt, Human
aucccaugccaugcucuacccucugccucucaccaggagacacucugggccuccaggaca

SEQ ID NO: 196262 - RNA, 60 nt, Human
gcuuuuaagugaaaauggucgagaaagaggcaccaggaagccguccuggcgccuggcagu

SEQ ID NO: 196263 - RNA, 60 nt, Human
ggagacuggggcgugugccacauugccagccaccaggaaagcuuuucuuuuucuuuuuuu

SEQ ID NO: 196264 - RNA, 60 nt, Human
uucagacgcucggccgggaacgaaucccaccaccaggaggaaugccaaggcugggcccac

SEQ ID NO: 196265 - RNA, 60 nt, Human
ugcugcccaagaaaaugagcccaaccaguacaccaggaguggggcuccauaucagccccu

SEQ ID NO: 196266 - RNA, 60 nt, Human
cagaagacgugcacccauguuaacuacccucaccaggacgcagccaguguguccgccgga

SEQ ID NO: 196267 - RNA, 60 nt, Human
ggcugacaagcaauccagggacaagauacucaccaggaccaggaaggggacucuggggga

SEQ ID NO: 196268 - RNA, 60 nt, Human
cggaagcagagggugcuguuucaacgccaccaccaggagagaggcagaggggcugugccg

SEQ ID NO: 196269 - RNA, 60 nt, Human; identical to SEQ ID NO: 196267

SEQ ID NO: 196270 - RNA, 58 nt, Human
ugcggcaggcccugugcuagcguguucgcaccaggaacgcaggugcugggcugucggg

SEQ ID NO: 196271 - RNA, 60 nt, Human
auagacucaaggugugugaaagauguuauacaccaggagcugccacugcaugucccaacc

SEQ ID NO: 196272 - RNA, 60 nt, Human
ccaagaacugugaccacagggcagggcagccaccaggagagauaugccuggcaggggcca

SEQ ID NO: 196273 - RNA, 60 nt, Human
caugcguuaauucagcugguugggaaaugacaccaggaagcccagugcagagggucccuu

SEQ ID NO: 196274 - RNA, 60 nt, Human
ggggguggggggggcaggacccugagaugccaccaggaccugaugggccaggaagggcgu

SEQ ID NO: 196275 - RNA, 60 nt, Human
ggcagccaaagggcacagaacccugugccccaccaggauuggccugcugcuaggggccag

SEQ ID NO: 196276 - RNA, 60 nt, Human
ggcugacaagcaauccagggacaagauacucaccaggaugaggaagaggacuuuggggga

SEQ ID NO: 196277 - RNA, 60 nt, Human
aaauuacaauccacucauccaccugcccuccaccaggagugggcaccccauaaggguuua

SEQ ID NO: 196278 - RNA, 60 nt, Human
uuccaccacuguuugaucucucuggccucccaccaggaaugccguuuccuuuuuauggau

SEQ ID NO: 196279 - RNA, 60 nt, Human
ccagcagaaagggagcagagcccagagcaucaccaggagugccugcuaguguacuggcag

SEQ ID NO: 196280 - RNA, 60 nt, Human
guauuucgguacagaagagguuucuuucugcaccaggaggaggcgugcucaaguaucggu

SEQ ID NO: 196281 - RNA, 60 nt, Human
gaagaauuccucuaaguuucauuucagacgcaccaggauguugccgguuaguggcgcauu

SEQ ID NO: 196282 - RNA, 60 nt, Human
aguggaccuuccaggcaguugcguccaugacaccaggaagaugucaguguguguuuuuca

SEQ ID NO: 196283 - RNA, 60 nt, Human
ugggacccagaagugcccccgccaucccgccaccaggacugcuccccgccagcacgucca

SEQ ID NO: 196284 - RNA, 60 nt, Human
gcacuucccucuggaaaucacaguguugugcaccaggaacacaaagaugagucaaaucuu

SEQ ID NO: 196285 - RNA, 60 nt, Human
gggccauguuuauuguggauugguaagaaucaccaggaaaccauuaagccccaauagcua

SEQ ID NO: 196286 - RNA, 62 nt, Human
cuugauggccgggccucgaaggccacaaacaaggcgucgaggaauuggaaagauuugcacac

SEQ ID NO: 196287 - RNA, 62 nt, Human
acuucaaaagccauaacuugaaaaauacugguggcgucgauggugagugauuuuuaucccac

SEQ ID NO: 196288 - RNA, 62 nt, Human
uggacagaucccccacagccuggggcagaagaggcgucgagggcgccagaaguggcggcagc

SEQ ID NO: 196289 - RNA, 62 nt, Human
guuggccauuccaccuuggaguuggaacccugggcgucgagacaggaaggcagggcgcagug

SEQ ID NO: 196290 - RNA, 62 nt, Human
uugacuucauguuaaaaacccucaacaaaccaggcgucgaaggaacauaccucaaaauaaua

SEQ ID NO: 196291 - RNA, 62 nt, Human
ugaggcuggccgagccacacugucuccccaggggcgucgaccuggcccagcuggguccccag

SEQ ID NO: 196292 - RNA, 62 nt, Human
aaggcuuucuacaaaaccaaauucagaauccaggcgucgaccugguggggcccggggccaag

SEQ ID NO: 196293 - RNA, 62 nt, Human
ggguuuagaagaaacgcaggaacauucuggguggcgucgaaggagccuuucccgaucaucau

SEQ ID NO: 196294 - RNA, 64 nt, Human; identical to SEQ ID NO: 38790

SEQ ID NO: 196295 - RNA, 64 nt, Human; identical to SEQ ID NO: 38791

SEQ ID NO: 196296 - RNA, 64 nt, Human; identical to SEQ ID NO: 38792

SEQ ID NO: 196297 - RNA, 64 nt, Human; identical to SEQ ID NO: 38793

SEQ ID NO: 196298 - RNA, 63 nt, Human
guggcugccugugggaccaucccccaaccccuuuccucgcaccuccuuguccucacccaguuc

SEQ ID NO: 196299 - RNA, 63 nt, Human
aauggcggugggaggaggacucuucucacgaccuccucgcaagaccgcucugggagagaaaua

SEQ ID NO: 196300 - RNA, 63 nt, Human
uugaagcuguggagggccacgguggcguggcucuccucgcagguguucugggcuccguuguac

SEQ ID NO: 196301 - RNA, 64 nt, Human; identical to SEQ ID NO: 38794

SEQ ID NO: 196302 - RNA, 64 nt, Human; identical to SEQ ID NO: 38795

SEQ ID NO: 196303 - RNA, 64 nt, Human; identical to SEQ ID NO: 38796

SEQ ID NO: 196304 - RNA, 64 nt, Human; identical to SEQ ID NO: 38797

SEQ ID NO: 196305 - RNA, 64 nt, Human; identical to SEQ ID NO: 38798

SEQ ID NO: 196306 - RNA, 64 nt, Human; identical to SEQ ID NO: 38799

SEQ ID NO: 196307 - RNA, 64 nt, Human; identical to SEQ ID NO: 38800

SEQ ID NO: 196308 - RNA, 64 nt, Human; identical to SEQ ID NO: 38801

SEQ ID NO: 196309 - RNA, 64 nt, Human; identical to SEQ ID NO: 38802

SEQ ID NO: 196310 - RNA, 64 nt, Human; identical to SEQ ID NO: 38803

SEQ ID NO: 196311 - RNA, 64 nt, Human; identical to SEQ ID NO: 38804

SEQ ID NO: 196312 - RNA, 64 nt, Human; identical to SEQ ID NO: 38805

SEQ ID NO: 196313 - RNA, 64 nt, Human; identical to SEQ ID NO: 38806

SEQ ID NO: 196314 - RNA, 64 nt, Human; identical to SEQ ID NO: 38807

SEQ ID NO: 196315 - RNA, 64 nt, Human; identical to SEQ ID NO: 38808

SEQ ID NO: 196316 - RNA, 55 nt, Human
ccaagagugucuucggcugagaagugugcgccacuccccuugcugcccgaaugcu

SEQ ID NO: 196317 - RNA, 63 nt, Human
cccauggugguuucaugaugcccccuccccaauuccucgcacuuuauucuccugggugguuuc

SEQ ID NO: 196318 - RNA, 63 nt, Human
ucuagagggcccguccccagcccgggccguccauccucgcauugcuguugaauggugagcacg

SEQ ID NO: 196319 - RNA, 64 nt, Human; identical to SEQ ID NO: 38809

SEQ ID NO: 196320 - RNA, 64 nt, Human; identical to SEQ ID NO: 38810

SEQ ID NO: 196321 - RNA, 64 nt, Human; identical to SEQ ID NO: 38811

SEQ ID NO: 196322 - RNA, 64 nt, Human; identical to SEQ ID NO: 38812

SEQ ID NO: 196323 - RNA, 64 nt, Human; identical to SEQ ID NO: 38813

SEQ ID NO: 196324 - RNA, 64 nt, Human; identical to SEQ ID NO: 38814

SEQ ID NO: 196325 - RNA, 64 nt, Human; identical to SEQ ID NO: 38815

SEQ ID NO: 196326 - RNA, 64 nt, Human; identical to SEQ ID NO: 38816

SEQ ID NO: 196327 - RNA, 64 nt, Human; identical to SEQ ID NO: 38817

SEQ ID NO: 196328 - RNA, 64 nt, Human; identical to SEQ ID NO: 38818

SEQ ID NO: 196329 - RNA, 64 nt, Human; identical to SEQ ID NO: 38819

SEQ ID NO: 196330 - RNA, 64 nt, Human; identical to SEQ ID NO: 38820

SEQ ID NO: 196331 - RNA, 64 nt, Human; identical to SEQ ID NO: 38821

SEQ ID NO: 196332 - RNA, 64 nt, Human; identical to SEQ ID NO: 38822

SEQ ID NO: 196333 - RNA, 64 nt, Human; identical to SEQ ID NO: 38823

SEQ ID NO: 196334 - RNA, 63 nt, Human
ucgaggaggccccucgggggcagcacaucuuccuccucgcaggagggaccaggcggggcucca

SEQ ID NO: 196335 - RNA, 64 nt, Human
ccuuccuucuucuguccuguuuccagccuugcaagaaggcuauucacaauuaggccuggcugcu

SEQ ID NO: 196336 - RNA, 64 nt, Human
gucucuugucaagugggaccucauacuauucucagaaggcuaacuugagagguuuggggccuug

SEQ ID NO: 196337 - RNA, 64 nt, Human; identical to SEQ ID NO: 38824

SEQ ID NO: 196338 - RNA, 64 nt, Human; identical to SEQ ID NO: 38825

SEQ ID NO: 196339 - RNA, 64 nt, Human; identical to SEQ ID NO: 38826

SEQ ID NO: 196340 - RNA, 64 nt, Human; identical to SEQ ID NO: 38827

SEQ ID NO: 196341 - RNA, 64 nt, Human; identical to SEQ ID NO: 38828

SEQ ID NO: 196342 - RNA, 64 nt, Human; identical to SEQ ID NO: 38829

SEQ ID NO: 196343 - RNA, 64 nt, Human; identical to SEQ ID NO: 38830

SEQ ID NO: 196344 - RNA, 64 nt, Human; identical to SEQ ID NO: 38831

SEQ ID NO: 196345 - RNA, 64 nt, Human; identical to SEQ ID NO: 38832

SEQ ID NO: 196346 - RNA, 64 nt, Human; identical to SEQ ID NO: 38833

SEQ ID NO: 196347 - RNA, 64 nt, Human; identical to SEQ ID NO: 38834

SEQ ID NO: 196348 - RNA, 64 nt, Human; identical to SEQ ID NO: 38835

SEQ ID NO: 196349 - RNA, 64 nt, Human; identical to SEQ ID NO: 38836

SEQ ID NO: 196350 - RNA, 64 nt, Human; identical to SEQ ID NO: 38837

SEQ ID NO: 196351 - RNA, 64 nt, Human; identical to SEQ ID NO: 38838

SEQ ID NO: 196352 - RNA, 64 nt, Human
gcuuuucagugucuucucagaaacaaccagccuugaaggcuacaacugaugagaaagauucugu

SEQ ID NO: 196353 - RNA, 64 nt, Human
guaguucuugugcauguuuacuuuauuagaguaggaaggcuacuggcauuaauuauuaauacca

SEQ ID NO: 196354 - RNA, 64 nt, Human
uuuuucauauuucagguuugacuuguucuuuucagaaggcuaaagucagaggaaugggggcugg

SEQ ID NO: 196355 - RNA, 64 nt, Human; identical to SEQ ID NO: 38839

SEQ ID NO: 196356 - RNA, 64 nt, Human; identical to SEQ ID NO: 38840

SEQ ID NO: 196357 - RNA, 64 nt, Human; identical to SEQ ID NO: 38841

SEQ ID NO: 196358 - RNA, 64 nt, Human; identical to SEQ ID NO: 38842

SEQ ID NO: 196359 - RNA, 55 nt, Human; identical to SEQ ID NO: 38843

SEQ ID NO: 196360 - RNA, 64 nt, Human; identical to SEQ ID NO: 38844

SEQ ID NO: 196361 - RNA, 64 nt, Human; identical to SEQ ID NO: 38845

SEQ ID NO: 196362 - RNA, 64 nt, Human; identical to SEQ ID NO: 38846

SEQ ID NO: 196363 - RNA, 64 nt, Human; identical to SEQ ID NO: 38847

SEQ ID NO: 196364 - RNA, 64 nt, Human; identical to SEQ ID NO: 38848

SEQ ID NO: 196365 - RNA, 64 nt, Human; identical to SEQ ID NO: 38849

SEQ ID NO: 196366 - RNA, 64 nt, Human; identical to SEQ ID NO: 38850

SEQ ID NO: 196367 - RNA, 64 nt, Human; identical to SEQ ID NO: 38851

SEQ ID NO: 196368 - RNA, 64 nt, Human; identical to SEQ ID NO: 38852

SEQ ID NO: 196369 - RNA, 64 nt, Human; identical to SEQ ID NO: 38853

SEQ ID NO: 196370 - RNA, 64 nt, Human
gguagggcaaaggggugaagcgcaggccuugcuggaaggcuauuuacuuccaugcuucuccuuu

SEQ ID NO: 196371 - RNA, 64 nt, Human
uuuguguguggacaagaggugguugguggguggugaaggcuaauggcagaguuagcaccccacu

SEQ ID NO: 196372 - RNA, 64 nt, Human
guacuaagacccacaaacugccuguuaagucugagaaggcuaaagaagacacacagccaacguu

SEQ ID NO: 196373 - RNA, 64 nt, Human; identical to SEQ ID NO: 38854

SEQ ID NO: 196374 - RNA, 64 nt, Human; identical to SEQ ID NO: 38855

SEQ ID NO: 196375 - RNA, 64 nt, Human; identical to SEQ ID NO: 38856

SEQ ID NO: 196376 - RNA, 64 nt, Human; identical to SEQ ID NO: 38857

SEQ ID NO: 196377 - RNA, 64 nt, Human; identical to SEQ ID NO: 38858

SEQ ID NO: 196378 - RNA, 64 nt, Human; identical to SEQ ID NO: 38859

SEQ ID NO: 196379 - RNA, 64 nt, Human; identical to SEQ ID NO: 38860

SEQ ID NO: 196380 - RNA, 64 nt, Human; identical to SEQ ID NO: 38861

SEQ ID NO: 196381 - RNA, 64 nt, Human; identical to SEQ ID NO: 38862

SEQ ID NO: 196382 - RNA, 64 nt, Human; identical to SEQ ID NO: 38863

SEQ ID NO: 196383 - RNA, 64 nt, Human; identical to SEQ ID NO: 38864

SEQ ID NO: 196384 - RNA, 64 nt, Human; identical to SEQ ID NO: 38865

SEQ ID NO: 196385 - RNA, 64 nt, Human; identical to SEQ ID NO: 38866

SEQ ID NO: 196386 - RNA, 64 nt, Human; identical to SEQ ID NO: 38867

SEQ ID NO: 196387 - RNA, 64 nt, Human; identical to SEQ ID NO: 38868

SEQ ID NO: 196388 - RNA, 64 nt, Human
uaguguugggcacugucugaccauguugcauuuggaaggcuaaauggggccaugaagaaggcug

SEQ ID NO: 196389 - RNA, 64 nt, Human
uagggaauauugaagggccugacauggggaaagggaaggcuaaaaauacuuggucaaauuuuaa

SEQ ID NO: 196390 - RNA, 64 nt, Human
agggggcuguggacgucuuuggaauuuguuaggggaaggcuaugugguaagcucuacuaaaugu

SEQ ID NO: 196391 - RNA, 64 nt, Human; identical to SEQ ID NO: 38869

SEQ ID NO: 196392 - RNA, 64 nt, Human; identical to SEQ ID NO: 38870

SEQ ID NO: 196393 - RNA, 64 nt, Human; identical to SEQ ID NO: 38871

SEQ ID NO: 196394 - RNA, 64 nt, Human; identical to SEQ ID NO: 38872

SEQ ID NO: 196395 - RNA, 64 nt, Human; identical to SEQ ID NO: 38873

SEQ ID NO: 196396 - RNA, 64 nt, Human; identical to SEQ ID NO: 38874

SEQ ID NO: 196397 - RNA, 64 nt, Human; identical to SEQ ID NO: 38875

SEQ ID NO: 196398 - RNA, 64 nt, Human; identical to SEQ ID NO: 38876

SEQ ID NO: 196399 - RNA, 64 nt, Human; identical to SEQ ID NO: 38877

SEQ ID NO: 196400 - RNA, 64 nt, Human; identical to SEQ ID NO: 38878

SEQ ID NO: 196401 - RNA, 64 nt, Human; identical to SEQ ID NO: 38879

SEQ ID NO: 196402 - RNA, 64 nt, Human; identical to SEQ ID NO: 38880

SEQ ID NO: 196403 - RNA, 64 nt, Human; identical to SEQ ID NO: 38881

SEQ ID NO: 196404 - RNA, 64 nt, Human; identical to SEQ ID NO: 38882

SEQ ID NO: 196405 - RNA, 64 nt, Human; identical to SEQ ID NO: 38883

SEQ ID NO: 196406 - RNA, 64 nt, Human
uaguucccaugacuccuggaucuauguguaugcagaaggcuacauauacauaguugcuucuuuc

SEQ ID NO: 196407 - RNA, 64 nt, Human
ucagaauucuauuucucaugguucugaaggcuuagaaggcuaagaucaaggugucagcagguuc

SEQ ID NO: 196408 - RNA, 64 nt, Human
guguuaaguuaauuugcuauguuucuugcauuaugaaggcuacaucugugcuuuguaaguacca

SEQ ID NO: 196409 - RNA, 64 nt, Human; identical to SEQ ID NO: 38884

SEQ ID NO: 196410 - RNA, 64 nt, Human; identical to SEQ ID NO: 38885

SEQ ID NO: 196411 - RNA, 64 nt, Human; identical to SEQ ID NO: 38886

SEQ ID NO: 196412 - RNA, 64 nt, Human; identical to SEQ ID NO: 38887

SEQ ID NO: 196413 - RNA, 64 nt, Human; identical to SEQ ID NO: 38888

SEQ ID NO: 196414 - RNA, 64 nt, Human; identical to SEQ ID NO: 38889

SEQ ID NO: 196415 - RNA, 64 nt, Human; identical to SEQ ID NO: 38890

SEQ ID NO: 196416 - RNA, 64 nt, Human; identical to SEQ ID NO: 38891

SEQ ID NO: 196417 - RNA, 64 nt, Human; identical to SEQ ID NO: 38892

SEQ ID NO: 196418 - RNA, 64 nt, Human; identical to SEQ ID NO: 38893

SEQ ID NO: 196419 - RNA, 64 nt, Human; identical to SEQ ID NO: 38894

SEQ ID NO: 196420 - RNA, 64 nt, Human; identical to SEQ ID NO: 38895

SEQ ID NO: 196421 - RNA, 64 nt, Human; identical to SEQ ID NO: 38896

SEQ ID NO: 196422 - RNA, 64 nt, Human; identical to SEQ ID NO: 38897

SEQ ID NO: 196423 - RNA, 64 nt, Human; identical to SEQ ID NO: 38898

SEQ ID NO: 196424 - RNA, 64 nt, Human
cacugcagggcuuucugcacugaaaguggaagcagaaggcuaaugggucacauuguguaaaggu

SEQ ID NO: 196425 - RNA, 64 nt, Human
uguuuugcuacagaaaaucuucauagaagaacuggaaggcuauauaagaaagggaaucaauucu

SEQ ID NO: 196426 - RNA, 64 nt, Human
agcuccaggcugcuuggcagcccagccuggaggagaaggcuaaugacggaggggccccucgcug

SEQ ID NO: 196427 - RNA, 64 nt, Human; identical to SEQ ID NO: 38899

SEQ ID NO: 196428 - RNA, 64 nt, Human
aauaucauguucaauuucaguaguuugaucaguugaaggcuagaagugugaagugcagaugagu

SEQ ID NO: 196429 - RNA, 64 nt, Human
aagaugccacaacagauugagugggagauggaaggaaggcuauuacauuauuuccgaauuuuua

SEQ ID NO: 196430 - RNA, 64 nt, Human
ccagacaucuauucccaguccaucagagugaaaugaaggcuauuugccaucccugccuuagaca

SEQ ID NO: 196431 - RNA, 64 nt, Human
uuguuucaaccaguuugaaccaagaacuuuccaggaaggcuaaagggaaaccgaauuuucacag

SEQ ID NO: 196432 - RNA, 64 nt, Human
uaaaaccuagacauuugccacaucuagcugcaaagaaggcuagggaaugucuuuauuauugauu

SEQ ID NO: 196433 - RNA, 64 nt, Human
guggcauuauucuuuuuuggauuucucauuuauggaaggcuaacccucuguugacuguaagccu

SEQ ID NO: 196434 - RNA, 64 nt, Human
uuacugauaugacacuacaugugaucugccuggugaaggcuaucuggggcaggcacaaauuggu

SEQ ID NO: 196435 - RNA, 64 nt, Human
augcugaaguucuaggagaguaaugauuacaucagaaggcuagguucagcaaaauaaguguauc

SEQ ID NO: 196436 - RNA, 64 nt, Human
ccugggagaacaccaacauccaugggguuguagggaaggcuaaggacaggaguggggaguggua

SEQ ID NO: 196437 - RNA, 64 nt, Human
ucagccauguuucucugugcaucuccaguaagcagaaggcuacccauuccauuccucaacccaa

SEQ ID NO: 196438 - RNA, 64 nt, Human
auuucuuaagcaguuaugcucuuaaugcuuaaaagaaggcuagcauuguuugcacaaaaaguug

SEQ ID NO: 196439 - RNA, 64 nt, Human
aguggcuggaucugugaggggcucucucaugauagaaggcuauggggauagauguguggacaca

SEQ ID NO: 196440 - RNA, 64 nt, Human
guuuguagcaauguuauuucuguguaugucaugagaaggcuaaauaucaguguuaauuucuugu

SEQ ID NO: 196441 - RNA, 64 nt, Human
gaggaagugaacauuucggugacuuccgcaucaggaaggcuagaguuacccagagcaucaggcc

SEQ ID NO: 196442 - RNA, 64 nt, Human
uucuggccccaggggugggagggaggggagcuuggaaggcuaguccuguagcuccaguccucug

SEQ ID NO: 196443 - RNA, 64 nt, Human
agacugacagcugacuuuuuuaggagcaauauuggaaggcuaaaugcaauagaaagaugucuuu

SEQ ID NO: 196444 - RNA, 64 nt, Human
ugauaguagccaaaguuaaauguaucacauugaagaaggcuagaaaaaaagaaugaguaaugug

SEQ ID NO: 196445 - RNA, 64 nt, Human
ggcucuagucacuggcaucucacuuuaugauagggaaggcuacuaccuagggcacuuuaaguca

SEQ ID NO: 196446 - RNA, 64 nt, Human; identical to SEQ ID NO: 38900

SEQ ID NO: 196447 - RNA, 64 nt, Human; identical to SEQ ID NO: 38901

SEQ ID NO: 196448 - RNA, 64 nt, Human; identical to SEQ ID NO: 38902

SEQ ID NO: 196449 - RNA, 64 nt, Human; identical to SEQ ID NO: 38903

SEQ ID NO: 196450 - RNA, 64 nt, Human; identical to SEQ ID NO: 38904

SEQ ID NO: 196451 - RNA, 64 nt, Human; identical to SEQ ID NO: 38905

SEQ ID NO: 196452 - RNA, 64 nt, Human; identical to SEQ ID NO: 38906

SEQ ID NO: 196453 - RNA, 64 nt, Human; identical to SEQ ID NO: 38907

SEQ ID NO: 196454 - RNA, 64 nt, Human; identical to SEQ ID NO: 38908

SEQ ID NO: 196455 - RNA, 64 nt, Human; identical to SEQ ID NO: 38909

SEQ ID NO: 196456 - RNA, 64 nt, Human; identical to SEQ ID NO: 38910

SEQ ID NO: 196457 - RNA, 64 nt, Human; identical to SEQ ID NO: 38911

SEQ ID NO: 196458 - RNA, 64 nt, Human; identical to SEQ ID NO: 38912

SEQ ID NO: 196459 - RNA, 64 nt, Human; identical to SEQ ID NO: 38913

SEQ ID NO: 196460 - RNA, 64 nt, Human; identical to SEQ ID NO: 38914

SEQ ID NO: 196461 - RNA, 64 nt, Human; identical to SEQ ID NO: 189049

SEQ ID NO: 196462 - RNA, 64 nt, Human; identical to SEQ ID NO: 189051

SEQ ID NO: 196463 - RNA, 64 nt, Human; identical to SEQ ID NO: 189056

SEQ ID NO: 196464 - RNA, 64 nt, Human; identical to SEQ ID NO: 38915

SEQ ID NO: 196465 - RNA, 64 nt, Human; identical to SEQ ID NO: 38916

SEQ ID NO: 196466 - RNA, 64 nt, Human; identical to SEQ ID NO: 38917

SEQ ID NO: 196467 - RNA, 64 nt, Human; identical to SEQ ID NO: 38918

SEQ ID NO: 196468 - RNA, 64 nt, Human; identical to SEQ ID NO: 38919

SEQ ID NO: 196469 - RNA, 64 nt, Human; identical to SEQ ID NO: 38920

SEQ ID NO: 196470 - RNA, 64 nt, Human; identical to SEQ ID NO: 38921

SEQ ID NO: 196471 - RNA, 64 nt, Human; identical to SEQ ID NO: 38922

SEQ ID NO: 196472 - RNA, 64 nt, Human; identical to SEQ ID NO: 38923

SEQ ID NO: 196473 - RNA, 64 nt, Human; identical to SEQ ID NO: 38924

SEQ ID NO: 196474 - RNA, 64 nt, Human; identical to SEQ ID NO: 38925

SEQ ID NO: 196475 - RNA, 64 nt, Human; identical to SEQ ID NO: 38926

SEQ ID NO: 196476 - RNA, 64 nt, Human; identical to SEQ ID NO: 38927

SEQ ID NO: 196477 - RNA, 64 nt, Human; identical to SEQ ID NO: 38928

SEQ ID NO: 196478 - RNA, 64 nt, Human; identical to SEQ ID NO: 38929

SEQ ID NO: 196479 - RNA, 54 nt, Human; identical to SEQ ID NO: 189046

SEQ ID NO: 196480 - RNA, 64 nt, Human; identical to SEQ ID NO: 38930

SEQ ID NO: 196481 - RNA, 64 nt, Human; identical to SEQ ID NO: 38931

SEQ ID NO: 196482 - RNA, 64 nt, Human; identical to SEQ ID NO: 38932

SEQ ID NO: 196483 - RNA, 64 nt, Human; identical to SEQ ID NO: 38933

SEQ ID NO: 196484 - RNA, 64 nt, Human; identical to SEQ ID NO: 38934

SEQ ID NO: 196485 - RNA, 64 nt, Human; identical to SEQ ID NO: 38935

SEQ ID NO: 196486 - RNA, 64 nt, Human; identical to SEQ ID NO: 38936

SEQ ID NO: 196487 - RNA, 64 nt, Human; identical to SEQ ID NO: 38937

SEQ ID NO: 196488 - RNA, 64 nt, Human; identical to SEQ ID NO: 38938

SEQ ID NO: 196489 - RNA, 64 nt, Human; identical to SEQ ID NO: 38939

SEQ ID NO: 196490 - RNA, 64 nt, Human; identical to SEQ ID NO: 38940

SEQ ID NO: 196491 - RNA, 64 nt, Human; identical to SEQ ID NO: 38941

SEQ ID NO: 196492 - RNA, 64 nt, Human; identical to SEQ ID NO: 38942

SEQ ID NO: 196493 - RNA, 64 nt, Human; identical to SEQ ID NO: 38943

SEQ ID NO: 196494 - RNA, 64 nt, Human; identical to SEQ ID NO: 38944

SEQ ID NO: 196495 - RNA, 58 nt, Human
uaggaagcggaaggggaaucgcgggaagcuggcccaggucagguccgcaaaggcuucu

SEQ ID NO: 196496 - RNA, 58 nt, Human
gcgaugucaggccagggccauggccacacuggcccacacauuccuuucuacagagaau

SEQ ID NO: 196497 - RNA, 64 nt, Human; identical to SEQ ID NO: 38945

SEQ ID NO: 196498 - RNA, 64 nt, Human; identical to SEQ ID NO: 38946

SEQ ID NO: 196499 - RNA, 64 nt, Human; identical to SEQ ID NO: 38947

SEQ ID NO: 196500 - RNA, 64 nt, Human; identical to SEQ ID NO: 38948

SEQ ID NO: 196501 - RNA, 64 nt, Human; identical to SEQ ID NO: 38949

SEQ ID NO: 196502 - RNA, 64 nt, Human; identical to SEQ ID NO: 38950

SEQ ID NO: 196503 - RNA, 64 nt, Human; identical to SEQ ID NO: 38951

SEQ ID NO: 196504 - RNA, 64 nt, Human; identical to SEQ ID NO: 38952

SEQ ID NO: 196505 - RNA, 64 nt, Human; identical to SEQ ID NO: 38953

SEQ ID NO: 196506 - RNA, 64 nt, Human; identical to SEQ ID NO: 38954

SEQ ID NO: 196507 - RNA, 64 nt, Human; identical to SEQ ID NO: 38955

SEQ ID NO: 196508 - RNA, 64 nt, Human; identical to SEQ ID NO: 38956

SEQ ID NO: 196509 - RNA, 64 nt, Human; identical to SEQ ID NO: 38957

SEQ ID NO: 196510 - RNA, 64 nt, Human; identical to SEQ ID NO: 38958

SEQ ID NO: 196511 - RNA, 58 nt, Human; identical to SEQ ID NO: 38959

SEQ ID NO: 196512 - RNA, 58 nt, Human
gggcagccaagggugcacugacuauuagcuggcccauaggauaucuguaaggcuggug

SEQ ID NO: 196513 - RNA, 58 nt, Human
ccagcagcuccccaggcugaaagcagcccuggcccagggucuccaugguucuaggcag

SEQ ID NO: 196514 - RNA, 58 nt, Human
gagagggcaggggagcccacaucuggggcuggcccacaauaccugcucccccgacccc

SEQ ID NO: 196515 - RNA, 64 nt, Human; identical to SEQ ID NO: 38960

SEQ ID NO: 196516 - RNA, 64 nt, Human; identical to SEQ ID NO: 38961

SEQ ID NO: 196517 - RNA, 64 nt, Human; identical to SEQ ID NO: 38962

SEQ ID NO: 196518 - RNA, 64 nt, Human; identical to SEQ ID NO: 38963

SEQ ID NO: 196519 - RNA, 64 nt, Human; identical to SEQ ID NO: 38964

SEQ ID NO: 196520 - RNA, 64 nt, Human; identical to SEQ ID NO: 38965

SEQ ID NO: 196521 - RNA, 64 nt, Human; identical to SEQ ID NO: 38966

SEQ ID NO: 196522 - RNA, 64 nt, Human; identical to SEQ ID NO: 38967

SEQ ID NO: 196523 - RNA, 64 nt, Human; identical to SEQ ID NO: 38968

SEQ ID NO: 196524 - RNA, 64 nt, Human; identical to SEQ ID NO: 38969

SEQ ID NO: 196525 - RNA, 64 nt, Human; identical to SEQ ID NO: 38970

SEQ ID NO: 196526 - RNA, 64 nt, Human; identical to SEQ ID NO: 38971

SEQ ID NO: 196527 - RNA, 64 nt, Human; identical to SEQ ID NO: 38972

SEQ ID NO: 196528 - RNA, 64 nt, Human; identical to SEQ ID NO: 38973

SEQ ID NO: 196529 - RNA, 64 nt, Human; identical to SEQ ID NO: 38974

SEQ ID NO: 196530 - RNA, 58 nt, Human
agggcaguaccccacaacgaaaaauaaucuggcccaaaaugucaguuguacugaguuu

SEQ ID NO: 196531 - RNA, 58 nt, Human
acuuuuuaaggaacagauguggaauacacuggcccauauuucaaccuuaacagcugaa

SEQ ID NO: 196532 - RNA, 58 nt, Human
uaaaccauggcauguuggguuugcaggacuggcccacacaguccccugcagguggcag

SEQ ID NO: 196533 - RNA, 64 nt, Human; identical to SEQ ID NO: 38975

SEQ ID NO: 196534 - RNA, 64 nt, Human; identical to SEQ ID NO: 38976

SEQ ID NO: 196535 - RNA, 64 nt, Human; identical to SEQ ID NO: 38977

SEQ ID NO: 196536 - RNA, 64 nt, Human; identical to SEQ ID NO: 38978

SEQ ID NO: 196537 - RNA, 64 nt, Human; identical to SEQ ID NO: 38979

SEQ ID NO: 196538 - RNA, 64 nt, Human; identical to SEQ ID NO: 38980

SEQ ID NO: 196539 - RNA, 64 nt, Human; identical to SEQ ID NO: 38981

SEQ ID NO: 196540 - RNA, 64 nt, Human; identical to SEQ ID NO: 38982

SEQ ID NO: 196541 - RNA, 64 nt, Human; identical to SEQ ID NO: 38983

SEQ ID NO: 196542 - RNA, 64 nt, Human; identical to SEQ ID NO: 38984

SEQ ID NO: 196543 - RNA, 64 nt, Human; identical to SEQ ID NO: 38985

SEQ ID NO: 196544 - RNA, 64 nt, Human; identical to SEQ ID NO: 38986

SEQ ID NO: 196545 - RNA, 64 nt, Human; identical to SEQ ID NO: 38987

SEQ ID NO: 196546 - RNA, 64 nt, Human; identical to SEQ ID NO: 38988

SEQ ID NO: 196547 - RNA, 64 nt, Human; identical to SEQ ID NO: 38989

SEQ ID NO: 196548 - RNA, 58 nt, Human
agcugguguggccauuccccaagugccacuggcccauggaugggggugggugcuggug

SEQ ID NO: 196549 - RNA, 58 nt, Human
gaguggcucuguguggaccagucccucacuggcccauucuuuuuuugacgcagccaau

SEQ ID NO: 196550 - RNA, 58 nt, Human
gggcugaagucucccuuuguuacggacccuggcccaggaguugaaugccugaggacgu

SEQ ID NO: 196551 - RNA, 64 nt, Human; identical to SEQ ID NO: 38990

SEQ ID NO: 196552 - RNA, 64 nt, Human; identical to SEQ ID NO: 38991

SEQ ID NO: 196553 - RNA, 64 nt, Human; identical to SEQ ID NO: 38992

SEQ ID NO: 196554 - RNA, 64 nt, Human; identical to SEQ ID NO: 38993

SEQ ID NO: 196555 - RNA, 64 nt, Human; identical to SEQ ID NO: 38994

SEQ ID NO: 196556 - RNA, 64 nt, Human; identical to SEQ ID NO: 38995

SEQ ID NO: 196557 - RNA, 64 nt, Human; identical to SEQ ID NO: 38996

SEQ ID NO: 196558 - RNA, 64 nt, Human; identical to SEQ ID NO: 38997

SEQ ID NO: 196559 - RNA, 64 nt, Human; identical to SEQ ID NO: 38998

SEQ ID NO: 196560 - RNA, 62 nt, Human; identical to SEQ ID NO: 38999

SEQ ID NO: 196561 - RNA, 64 nt, Human; identical to SEQ ID NO: 39000

SEQ ID NO: 196562 - RNA, 64 nt, Human; identical to SEQ ID NO: 39001

SEQ ID NO: 196563 - RNA, 64 nt, Human; identical to SEQ ID NO: 39002

SEQ ID NO: 196564 - RNA, 64 nt, Human; identical to SEQ ID NO: 39003

SEQ ID NO: 196565 - RNA, 64 nt, Human; identical to SEQ ID NO: 39004

SEQ ID NO: 196566 - RNA, 58 nt, Human
aagcaggcaccacuaacuuaugaaaaggaggaggaacaggaccaaggggugagcugca

SEQ ID NO: 196567 - RNA, 58 nt, Human
gagcagagagcuggcaugaguauagggaaggaggaaggacacauuuucaauccucugc

SEQ ID NO: 196568 - RNA, 58 nt, Human
caaagccuuuguguuuuucacugguggcaggaggaaaauugauaaaucagaggugcua

SEQ ID NO: 196569 - RNA, 64 nt, Human; identical to SEQ ID NO: 39005

SEQ ID NO: 196570 - RNA, 64 nt, Human; identical to SEQ ID NO: 39006

SEQ ID NO: 196571 - RNA, 64 nt, Human; identical to SEQ ID NO: 39007

SEQ ID NO: 196572 - RNA, 64 nt, Human; identical to SEQ ID NO: 39008

SEQ ID NO: 196573 - RNA, 64 nt, Human; identical to SEQ ID NO: 39009

SEQ ID NO: 196574 - RNA, 64 nt, Human; identical to SEQ ID NO: 39010

SEQ ID NO: 196575 - RNA, 64 nt, Human; identical to SEQ ID NO: 39011

SEQ ID NO: 196576 - RNA, 64 nt, Human; identical to SEQ ID NO: 39012

SEQ ID NO: 196577 - RNA, 64 nt, Human; identical to SEQ ID NO: 39013

SEQ ID NO: 196578 - RNA, 64 nt, Human; identical to SEQ ID NO: 39014

SEQ ID NO: 196579 - RNA, 64 nt, Human; identical to SEQ ID NO: 39015

SEQ ID NO: 196580 - RNA, 64 nt, Human; identical to SEQ ID NO: 39016

SEQ ID NO: 196581 - RNA, 64 nt, Human; identical to SEQ ID NO: 39017

SEQ ID NO: 196582 - RNA, 64 nt, Human; identical to SEQ ID NO: 39018

SEQ ID NO: 196583 - RNA, 64 nt, Human; identical to SEQ ID NO: 39019

SEQ ID NO: 196584 - RNA, 58 nt, Human
gaacaaggccugguaaaguuguuugugucuggcccacagugacucucugugcacgacu

SEQ ID NO: 196585 - RNA, 58 nt, Human
cgcuguucccucauucccgcugaccucacuggcccacuggcaaauccaaccagcaacc

SEQ ID NO: 196586 - RNA, 58 nt, Human
acuccuagggcugguggcagccaggauucuggcccagggcgccuccucccgacugagc

SEQ ID NO: 196587 - RNA, 64 nt, Human; identical to SEQ ID NO: 39020

SEQ ID NO: 196588 - RNA, 64 nt, Human; identical to SEQ ID NO: 39021

SEQ ID NO: 196589 - RNA, 64 nt, Human; identical to SEQ ID NO: 39022

SEQ ID NO: 196590 - RNA, 64 nt, Human; identical to SEQ ID NO: 39023

SEQ ID NO: 196591 - RNA, 64 nt, Human; identical to SEQ ID NO: 39024

SEQ ID NO: 196592 - RNA, 64 nt, Human; identical to SEQ ID NO: 39025

SEQ ID NO: 196593 - RNA, 64 nt, Human; identical to SEQ ID NO: 39026

SEQ ID NO: 196594 - RNA, 64 nt, Human; identical to SEQ ID NO: 39027

SEQ ID NO: 196595 - RNA, 64 nt, Human; identical to SEQ ID NO: 39028

SEQ ID NO: 196596 - RNA, 64 nt, Human; identical to SEQ ID NO: 39029

SEQ ID NO: 196597 - RNA, 64 nt, Human; identical to SEQ ID NO: 39030

SEQ ID NO: 196598 - RNA, 64 nt, Human; identical to SEQ ID NO: 39031

SEQ ID NO: 196599 - RNA, 61 nt, Human; identical to SEQ ID NO: 39032

SEQ ID NO: 196600 - RNA, 64 nt, Human; identical to SEQ ID NO: 39033

SEQ ID NO: 196601 - RNA, 64 nt, Human; identical to SEQ ID NO: 39034

SEQ ID NO: 196602 - RNA, 58 nt, Human
uguaauaccaugggacaagagaagcuuacuggcccagcccuaauggcuguugagcagg

SEQ ID NO: 196603 - RNA, 58 nt, Human
ggaguggggcucccagucugaaagaucuaggaggaacugggaucaaagcuacaaaguc

SEQ ID NO: 196604 - RNA, 58 nt, Human
gagauuuaaguuuuaagggcauuuaaucaggaggaaagguuuggaaaacuaacucagg

SEQ ID NO: 196605 - RNA, 64 nt, Human; identical to SEQ ID NO: 39035

SEQ ID NO: 196606 - RNA, 64 nt, Human; identical to SEQ ID NO: 39036

SEQ ID NO: 196607 - RNA, 64 nt, Human; identical to SEQ ID NO: 39037

SEQ ID NO: 196608 - RNA, 64 nt, Human; identical to SEQ ID NO: 39038

SEQ ID NO: 196609 - RNA, 64 nt, Human; identical to SEQ ID NO: 39039

SEQ ID NO: 196610 - RNA, 64 nt, Human; identical to SEQ ID NO: 39040

SEQ ID NO: 196611 - RNA, 64 nt, Human; identical to SEQ ID NO: 39041

SEQ ID NO: 196612 - RNA, 64 nt, Human; identical to SEQ ID NO: 39042

SEQ ID NO: 196613 - RNA, 64 nt, Human; identical to SEQ ID NO: 39043

SEQ ID NO: 196614 - RNA, 64 nt, Human; identical to SEQ ID NO: 39044

SEQ ID NO: 196615 - RNA, 64 nt, Human; identical to SEQ ID NO: 39045

SEQ ID NO: 196616 - RNA, 64 nt, Human; identical to SEQ ID NO: 39046

SEQ ID NO: 196617 - RNA, 64 nt, Human; identical to SEQ ID NO: 39047

SEQ ID NO: 196618 - RNA, 64 nt, Human; identical to SEQ ID NO: 39048

SEQ ID NO: 196619 - RNA, 64 nt, Human; identical to SEQ ID NO: 39049

SEQ ID NO: 196620 - RNA, 61 nt, Human
aaugcgcccggaggccguuaggcuguggagggcgaggaaggcgguccagaggcggccggca

SEQ ID NO: 196621 - RNA, 61 nt, Human
acucuugggucgagaucccuuuggagccacagcgaggaacccugugguccucaggcaggug

SEQ ID NO: 196622 - RNA, 61 nt, Human
uuccuuccuuccccgagaaggccucaauguggcgaggaagaugcuggggccgguagggcug

SEQ ID NO: 196623 - RNA, 64 nt, Human; identical to SEQ ID NO: 39050

SEQ ID NO: 196624 - RNA, 64 nt, Human; identical to SEQ ID NO: 39051

SEQ ID NO: 196625 - RNA, 64 nt, Human; identical to SEQ ID NO: 39052

SEQ ID NO: 196626 - RNA, 64 nt, Human; identical to SEQ ID NO: 39053

SEQ ID NO: 196627 - RNA, 64 nt, Human; identical to SEQ ID NO: 39054

SEQ ID NO: 196628 - RNA, 64 nt, Human; identical to SEQ ID NO: 39055

SEQ ID NO: 196629 - RNA, 64 nt, Human; identical to SEQ ID NO: 39056

SEQ ID NO: 196630 - RNA, 64 nt, Human; identical to SEQ ID NO: 39057

SEQ ID NO: 196631 - RNA, 64 nt, Human; identical to SEQ ID NO: 39058

SEQ ID NO: 196632 - RNA, 64 nt, Human; identical to SEQ ID NO: 39059

SEQ ID NO: 196633 - RNA, 64 nt, Human; identical to SEQ ID NO: 39060

SEQ ID NO: 196634 - RNA, 64 nt, Human; identical to SEQ ID NO: 39061

SEQ ID NO: 196635 - RNA, 51 nt, Human; identical to SEQ ID NO: 39062

SEQ ID NO: 196636 - RNA, 64 nt, Human; identical to SEQ ID NO: 39063

SEQ ID NO: 196637 - RNA, 64 nt, Human; identical to SEQ ID NO: 39064

SEQ ID NO: 196638 - RNA, 61 nt, Human
uuccaacagcauucacugccaguucuaauaggcgaggaaaaugcccgaggcgcugucuucu

SEQ ID NO: 196639 - RNA, 61 nt, Human
uacauuuauguuccuauauauuacaacaucggcgaggaaaugaaagcgauucuccuugagu

SEQ ID NO: 196640 - RNA, 61 nt, Human
aaucugcucaagauaaaauguaacuuggaaagcgaggaaacacuaaacauguuuuuaccug

SEQ ID NO: 196641 - RNA, 64 nt, Human; identical to SEQ ID NO: 39065

SEQ ID NO: 196642 - RNA, 64 nt, Human; identical to SEQ ID NO: 39066

SEQ ID NO: 196643 - RNA, 64 nt, Human; identical to SEQ ID NO: 39067

SEQ ID NO: 196644 - RNA, 64 nt, Human; identical to SEQ ID NO: 39068

SEQ ID NO: 196645 - RNA, 64 nt, Human; identical to SEQ ID NO: 39069

SEQ ID NO: 196646 - RNA, 64 nt, Human; identical to SEQ ID NO: 39070

SEQ ID NO: 196647 - RNA, 64 nt, Human; identical to SEQ ID NO: 39071

SEQ ID NO: 196648 - RNA, 64 nt, Human; identical to SEQ ID NO: 39072

SEQ ID NO: 196649 - RNA, 64 nt, Human; identical to SEQ ID NO: 39073

SEQ ID NO: 196650 - RNA, 64 nt, Human; identical to SEQ ID NO: 39074

SEQ ID NO: 196651 - RNA, 64 nt, Human; identical to SEQ ID NO: 39075

SEQ ID NO: 196652 - RNA, 64 nt, Human; identical to SEQ ID NO: 39076

SEQ ID NO: 196653 - RNA, 62 nt, Human; identical to SEQ ID NO: 39077

SEQ ID NO: 196654 - RNA, 64 nt, Human; identical to SEQ ID NO: 39078

SEQ ID NO: 196655 - RNA, 64 nt, Human; identical to SEQ ID NO: 39079

SEQ ID NO: 196656 - RNA, 64 nt, Human
ugaaugggauuuaaccauucuaggcaacaccccugaagggcauaccuaaccucaauaguguugg

SEQ ID NO: 196657 - RNA, 64 nt, Human
uccuggugcacagguucugaacggguggaacacugaagggcaaggaggcuaaacaaaguuaagc

SEQ ID NO: 196658 - RNA, 64 nt, Human
cauuuuuuuaaauacacccgaggagcccaagggggaagggcaaugccuacccccagcguuauuu

SEQ ID NO: 196659 - RNA, 64 nt, Human; identical to SEQ ID NO: 39080

SEQ ID NO: 196660 - RNA, 64 nt, Human; identical to SEQ ID NO: 39081

SEQ ID NO: 196661 - RNA, 64 nt, Human; identical to SEQ ID NO: 39082

SEQ ID NO: 196662 - RNA, 64 nt, Human; identical to SEQ ID NO: 39083

SEQ ID NO: 196663 - RNA, 64 nt, Human; identical to SEQ ID NO: 39084

SEQ ID NO: 196664 - RNA, 64 nt, Human; identical to SEQ ID NO: 39085

SEQ ID NO: 196665 - RNA, 64 nt, Human; identical to SEQ ID NO: 39086

SEQ ID NO: 196666 - RNA, 64 nt, Human; identical to SEQ ID NO: 39087

SEQ ID NO: 196667 - RNA, 64 nt, Human; identical to SEQ ID NO: 39088

SEQ ID NO: 196668 - RNA, 64 nt, Human; identical to SEQ ID NO: 39089

SEQ ID NO: 196669 - RNA, 64 nt, Human; identical to SEQ ID NO: 39090

SEQ ID NO: 196670 - RNA, 64 nt, Human; identical to SEQ ID NO: 39091

SEQ ID NO: 196671 - RNA, 64 nt, Human; identical to SEQ ID NO: 39092

SEQ ID NO: 196672 - RNA, 64 nt, Human; identical to SEQ ID NO: 39093

SEQ ID NO: 196673 - RNA, 64 nt, Human; identical to SEQ ID NO: 39094

SEQ ID NO: 196674 - RNA, 64 nt, Human
uuguucccugguggggucugugguaagggucagggaagggcauauaggcaccagagcuuuaucc

SEQ ID NO: 196675 - RNA, 64 nt, Human
acccauguagauucgcagauggccuggaugggaggaagggcagacgguacaugucccagcccac

SEQ ID NO: 196676 - RNA, 64 nt, Human
cgggggaaugggccagauggaccugcuagauuuggaagggcaccgagggaguuuucugggugua

SEQ ID NO: 196677 - RNA, 64 nt, Human; identical to SEQ ID NO: 39095

SEQ ID NO: 196678 - RNA, 64 nt, Human; identical to SEQ ID NO: 39096

SEQ ID NO: 196679 - RNA, 64 nt, Human; identical to SEQ ID NO: 39097

SEQ ID NO: 196680 - RNA, 64 nt, Human; identical to SEQ ID NO: 39098

SEQ ID NO: 196681 - RNA, 64 nt, Human; identical to SEQ ID NO: 39099

SEQ ID NO: 196682 - RNA, 64 nt, Human; identical to SEQ ID NO: 39100

SEQ ID NO: 196683 - RNA, 64 nt, Human; identical to SEQ ID NO: 39101

SEQ ID NO: 196684 - RNA, 64 nt, Human; identical to SEQ ID NO: 39102

SEQ ID NO: 196685 - RNA, 64 nt, Human; identical to SEQ ID NO: 39103

SEQ ID NO: 196686 - RNA, 64 nt, Human; identical to SEQ ID NO: 39104

SEQ ID NO: 196687 - RNA, 64 nt, Human; identical to SEQ ID NO: 39105

SEQ ID NO: 196688 - RNA, 64 nt, Human; identical to SEQ ID NO: 39106

SEQ ID NO: 196689 - RNA, 64 nt, Human; identical to SEQ ID NO: 39107

SEQ ID NO: 196690 - RNA, 64 nt, Human; identical to SEQ ID NO: 39108

SEQ ID NO: 196691 - RNA, 62 nt, Human; identical to SEQ ID NO: 39109

SEQ ID NO: 196692 - RNA, 64 nt, Human
ggcagcaccuccuaagaaggcaccucucuggguugaagggcaguguucccuggggcuuuaacuc

SEQ ID NO: 196693 - RNA, 64 nt, Human
auguucauagcugccuuucuuaccauuuugguuugaagggcagucuucucuggcuuguuuuuuu

SEQ ID NO: 196694 - RNA, 64 nt, Human
ucccccaucugccgucuugguucaucucaccacagaagggcauuuaguccuacccagccaucgg

SEQ ID NO: 196695 - RNA, 64 nt, Human; identical to SEQ ID NO: 39110

SEQ ID NO: 196696 - RNA, 64 nt, Human; identical to SEQ ID NO: 39111

SEQ ID NO: 196697 - RNA, 64 nt, Human; identical to SEQ ID NO: 39112

SEQ ID NO: 196698 - RNA, 64 nt, Human; identical to SEQ ID NO: 39113

SEQ ID NO: 196699 - RNA, 64 nt, Human; identical to SEQ ID NO: 39114

SEQ ID NO: 196700 - RNA, 64 nt, Human; identical to SEQ ID NO: 39115

SEQ ID NO: 196701 - RNA, 64 nt, Human; identical to SEQ ID NO: 39116

SEQ ID NO: 196702 - RNA, 64 nt, Human; identical to SEQ ID NO: 39117

SEQ ID NO: 196703 - RNA, 64 nt, Human; identical to SEQ ID NO: 39118

SEQ ID NO: 196704 - RNA, 64 nt, Human; identical to SEQ ID NO: 39119

SEQ ID NO: 196705 - RNA, 64 nt, Human; identical to SEQ ID NO: 39120

SEQ ID NO: 196706 - RNA, 64 nt, Human; identical to SEQ ID NO: 39121

SEQ ID NO: 196707 - RNA, 64 nt, Human; identical to SEQ ID NO: 39122

SEQ ID NO: 196708 - RNA, 64 nt, Human; identical to SEQ ID NO: 39123

SEQ ID NO: 196709 - RNA, 64 nt, Human; identical to SEQ ID NO: 39124

SEQ ID NO: 196710 - RNA, 58 nt, Human
gggagaagaugacccguggaacacuugccuggcccacucagaauccacggugaccucu

SEQ ID NO: 196711 - RNA, 58 nt, Human
gccaaagccuccuccagccgccaugcuccuggcccacugcaucguuucaucuuccaac

SEQ ID NO: 196712 - RNA, 64 nt, Human; identical to SEQ ID NO: 39125

SEQ ID NO: 196713 - RNA, 64 nt, Human; identical to SEQ ID NO: 39126

SEQ ID NO: 196714 - RNA, 64 nt, Human; identical to SEQ ID NO: 39126

SEQ ID NO: 196715 - RNA, 64 nt, Human; identical to SEQ ID NO: 39126

SEQ ID NO: 196716 - RNA, 64 nt, Human; identical to SEQ ID NO: 39129

SEQ ID NO: 196717 - RNA, 64 nt, Human; identical to SEQ ID NO: 39130

SEQ ID NO: 196718 - RNA, 64 nt, Human; identical to SEQ ID NO: 39131

SEQ ID NO: 196719 - RNA, 64 nt, Human; identical to SEQ ID NO: 39132

SEQ ID NO: 196720 - RNA, 64 nt, Human; identical to SEQ ID NO: 39133

SEQ ID NO: 196721 - RNA, 64 nt, Human; identical to SEQ ID NO: 39134

SEQ ID NO: 196722 - RNA, 64 nt, Human; identical to SEQ ID NO: 39135

SEQ ID NO: 196723 - RNA, 64 nt, Human; identical to SEQ ID NO: 39136

SEQ ID NO: 196724 - RNA, 64 nt, Human; identical to SEQ ID NO: 39137

SEQ ID NO: 196725 - RNA, 64 nt, Human; identical to SEQ ID NO: 39138

SEQ ID NO: 196726 - RNA, 64 nt, Human; identical to SEQ ID NO: 39139

SEQ ID NO: 196727 - RNA, 62 nt, Human
agccucucauuucuucucccuccacuugugagcgcccccagcuuugcggcgccccccacccc

SEQ ID NO: 196728 - RNA, 62 nt, Human
uauccaaguuggacuggguugcguccugacggcgcccccagugugcacgagugggaaggacu

SEQ ID NO: 196729 - RNA, 62 nt, Human
uggugcugcccccucaccuugguacugaucagcgcccccacccaggacauaccuuccccagg

SEQ ID NO: 196730 - RNA, 64 nt, Human; identical to SEQ ID NO: 39140

SEQ ID NO: 196731 - RNA, 64 nt, Human; identical to SEQ ID NO: 39141

SEQ ID NO: 196732 - RNA, 64 nt, Human; identical to SEQ ID NO: 39142

SEQ ID NO: 196733 - RNA, 64 nt, Human; identical to SEQ ID NO: 39143

SEQ ID NO: 196734 - RNA, 64 nt, Human; identical to SEQ ID NO: 39144

SEQ ID NO: 196735 - RNA, 64 nt, Human; identical to SEQ ID NO: 39145

SEQ ID NO: 196736 - RNA, 64 nt, Human; identical to SEQ ID NO: 39146

SEQ ID NO: 196737 - RNA, 64 nt, Human; identical to SEQ ID NO: 39147

SEQ ID NO: 196738 - RNA, 64 nt, Human; identical to SEQ ID NO: 39148

SEQ ID NO: 196739 - RNA, 64 nt, Human; identical to SEQ ID NO: 39149

SEQ ID NO: 196740 - RNA, 64 nt, Human; identical to SEQ ID NO: 39150

SEQ ID NO: 196741 - RNA, 64 nt, Human; identical to SEQ ID NO: 39151

SEQ ID NO: 196742 - RNA, 64 nt, Human; identical to SEQ ID NO: 39152

SEQ ID NO: 196743 - RNA, 64 nt, Human; identical to SEQ ID NO: 39153

SEQ ID NO: 196744 - RNA, 64 nt, Human; identical to SEQ ID NO: 39154

SEQ ID NO: 196745 - RNA, 60 nt, Human; identical to SEQ ID NO: 189052

SEQ ID NO: 196746 - RNA, 64 nt, Human; identical to SEQ ID NO: 189053

SEQ ID NO: 196747 - RNA, 64 nt, Human; identical to SEQ ID NO: 189054

SEQ ID NO: 196748 - RNA, 64 nt, Human; identical to SEQ ID NO: 39155

SEQ ID NO: 196749 - RNA, 64 nt, Human; identical to SEQ ID NO: 39156

SEQ ID NO: 196750 - RNA, 64 nt, Human; identical to SEQ ID NO: 39157

SEQ ID NO: 196751 - RNA, 64 nt, Human; identical to SEQ ID NO: 39158

SEQ ID NO: 196752 - RNA, 64 nt, Human; identical to SEQ ID NO: 39159

SEQ ID NO: 196753 - RNA, 64 nt, Human; identical to SEQ ID NO: 39160

SEQ ID NO: 196754 - RNA, 64 nt, Human; identical to SEQ ID NO: 39161

SEQ ID NO: 196755 - RNA, 64 nt, Human; identical to SEQ ID NO: 39162

SEQ ID NO: 196756 - RNA, 64 nt, Human; identical to SEQ ID NO: 39163

SEQ ID NO: 196757 - RNA, 64 nt, Human; identical to SEQ ID NO: 39164

SEQ ID NO: 196758 - RNA, 64 nt, Human; identical to SEQ ID NO: 39165

SEQ ID NO: 196759 - RNA, 64 nt, Human; identical to SEQ ID NO: 39166

SEQ ID NO: 196760 - RNA, 64 nt, Human; identical to SEQ ID NO: 39167

SEQ ID NO: 196761 - RNA, 64 nt, Human; identical to SEQ ID NO: 39168

SEQ ID NO: 196762 - RNA, 64 nt, Human; identical to SEQ ID NO: 39169

SEQ ID NO: 196763 - RNA, 64 nt, Human; identical to SEQ ID NO: 189055

SEQ ID NO: 196764 - RNA, 64 nt, Human; identical to SEQ ID NO: 189057

SEQ ID NO: 196765 - RNA, 64 nt, Human; identical to SEQ ID NO: 189058

SEQ ID NO: 196766 - RNA, 64 nt, Human; identical to SEQ ID NO: 39170

SEQ ID NO: 196767 - RNA, 64 nt, Human; identical to SEQ ID NO: 39171

SEQ ID NO: 196768 - RNA, 64 nt, Human; identical to SEQ ID NO: 39172

SEQ ID NO: 196769 - RNA, 64 nt, Human; identical to SEQ ID NO: 39173

SEQ ID NO: 196770 - RNA, 64 nt, Human; identical to SEQ ID NO: 39174

SEQ ID NO: 196771 - RNA, 64 nt, Human; identical to SEQ ID NO: 39175

SEQ ID NO: 196772 - RNA, 64 nt, Human; identical to SEQ ID NO: 39176

SEQ ID NO: 196773 - RNA, 64 nt, Human; identical to SEQ ID NO: 39177

SEQ ID NO: 196774 - RNA, 64 nt, Human; identical to SEQ ID NO: 39178

SEQ ID NO: 196775 - RNA, 64 nt, Human; identical to SEQ ID NO: 39179

SEQ ID NO: 196776 - RNA, 64 nt, Human; identical to SEQ ID NO: 39180

SEQ ID NO: 196777 - RNA, 64 nt, Human; identical to SEQ ID NO: 39181

SEQ ID NO: 196778 - RNA, 64 nt, Human; identical to SEQ ID NO: 39182

SEQ ID NO: 196779 - RNA, 64 nt, Human; identical to SEQ ID NO: 39183

SEQ ID NO: 196780 - RNA, 64 nt, Human; identical to SEQ ID NO: 39184

SEQ ID NO: 196781 - RNA, 58 nt, Human
cuaggauuacaggagugagccacugcgccuggcccacuuuucuuucuuuccuucuuau

SEQ ID NO: 196782 - RNA, 58 nt, Human
ccccagaggcuuccccacccuccauugccuggcccaggugagcagcuuggcaggucuc

SEQ ID NO: 196783 - RNA, 58 nt, Human
gcagccugcccuggcccuggcucuggcccuggcccacauugcacauggaaacccaaag

SEQ ID NO: 196784 - RNA, 64 nt, Human; identical to SEQ ID NO: 39185

SEQ ID NO: 196785 - RNA, 64 nt, Human; identical to SEQ ID NO: 39186

SEQ ID NO: 196786 - RNA, 64 nt, Human; identical to SEQ ID NO: 39187

SEQ ID NO: 196787 - RNA, 64 nt, Human; identical to SEQ ID NO: 39188

SEQ ID NO: 196788 - RNA, 64 nt, Human; identical to SEQ ID NO: 39189

SEQ ID NO: 196789 - RNA, 64 nt, Human; identical to SEQ ID NO: 39190

SEQ ID NO: 196790 - RNA, 64 nt, Human; identical to SEQ ID NO: 39191

SEQ ID NO: 196791 - RNA, 64 nt, Human; identical to SEQ ID NO: 39192

SEQ ID NO: 196792 - RNA, 64 nt, Human; identical to SEQ ID NO: 39193

SEQ ID NO: 196793 - RNA, 64 nt, Human; identical to SEQ ID NO: 39194

SEQ ID NO: 196794 - RNA, 64 nt, Human; identical to SEQ ID NO: 39195

SEQ ID NO: 196795 - RNA, 64 nt, Human; identical to SEQ ID NO: 39196

SEQ ID NO: 196796 - RNA, 64 nt, Human; identical to SEQ ID NO: 39197

SEQ ID NO: 196797 - RNA, 64 nt, Human; identical to SEQ ID NO: 39198

SEQ ID NO: 196798 - RNA, 64 nt, Human; identical to SEQ ID NO: 39199

SEQ ID NO: 196799 - RNA, 64 nt, Human; identical to SEQ ID NO: 189059

SEQ ID NO: 196800 - RNA, 64 nt, Human; identical to SEQ ID NO: 39200

SEQ ID NO: 196801 - RNA, 64 nt, Human; identical to SEQ ID NO: 39201

SEQ ID NO: 196802 - RNA, 64 nt, Human; identical to SEQ ID NO: 39202

SEQ ID NO: 196803 - RNA, 64 nt, Human; identical to SEQ ID NO: 39203

SEQ ID NO: 196804 - RNA, 64 nt, Human; identical to SEQ ID NO: 39204

SEQ ID NO: 196805 - RNA, 64 nt, Human; identical to SEQ ID NO: 39205

SEQ ID NO: 196806 - RNA, 64 nt, Human; identical to SEQ ID NO: 39206

SEQ ID NO: 196807 - RNA, 64 nt, Human; identical to SEQ ID NO: 39207

SEQ ID NO: 196808 - RNA, 64 nt, Human; identical to SEQ ID NO: 39208

SEQ ID NO: 196809 - RNA, 64 nt, Human; identical to SEQ ID NO: 39209

SEQ ID NO: 196810 - RNA, 64 nt, Human; identical to SEQ ID NO: 39210

SEQ ID NO: 196811 - RNA, 64 nt, Human; identical to SEQ ID NO: 39211

SEQ ID NO: 196812 - RNA, 64 nt, Human; identical to SEQ ID NO: 39212

SEQ ID NO: 196813 - RNA, 64 nt, Human; identical to SEQ ID NO: 39213

SEQ ID NO: 196814 - RNA, 64 nt, Human; identical to SEQ ID NO: 39214

SEQ ID NO: 196815 - RNA, 64 nt, Human
uacaaaagccaaaaaaggauaaaauaagcauuaggaaggcuagccaguuauucaauagcaccuu

SEQ ID NO: 196816 - RNA, 64 nt, Human; identical to SEQ ID NO: 39215

SEQ ID NO: 196817 - RNA, 64 nt, Human; identical to SEQ ID NO: 39216

SEQ ID NO: 196818 - RNA, 64 nt, Human; identical to SEQ ID NO: 39217

SEQ ID NO: 196819 - RNA, 64 nt, Human; identical to SEQ ID NO: 39218

SEQ ID NO: 196820 - RNA, 64 nt, Human; identical to SEQ ID NO: 39219

SEQ ID NO: 196821 - RNA, 64 nt, Human; identical to SEQ ID NO: 39220

SEQ ID NO: 196822 - RNA, 64 nt, Human; identical to SEQ ID NO: 39221

SEQ ID NO: 196823 - RNA, 64 nt, Human; identical to SEQ ID NO: 39222

SEQ ID NO: 196824 - RNA, 64 nt, Human; identical to SEQ ID NO: 39223

SEQ ID NO: 196825 - RNA, 50 nt, Human; identical to SEQ ID NO: 39224

SEQ ID NO: 196826 - RNA, 64 nt, Human; identical to SEQ ID NO: 39225

SEQ ID NO: 196827 - RNA, 64 nt, Human; identical to SEQ ID NO: 39226

SEQ ID NO: 196828 - RNA, 64 nt, Human; identical to SEQ ID NO: 39227

SEQ ID NO: 196829 - RNA, 64 nt, Human; identical to SEQ ID NO: 39228

SEQ ID NO: 196830 - RNA, 64 nt, Human; identical to SEQ ID NO: 39229

SEQ ID NO: 196831 - RNA, 50 nt, Human; identical to SEQ ID NO: 39230

SEQ ID NO: 196832 - RNA, 64 nt, Human; identical to SEQ ID NO: 39231

SEQ ID NO: 196833 - RNA, 64 nt, Human; identical to SEQ ID NO: 39232

SEQ ID NO: 196834 - RNA, 64 nt, Human; identical to SEQ ID NO: 39233

SEQ ID NO: 196835 - RNA, 64 nt, Human; identical to SEQ ID NO: 39234

SEQ ID NO: 196836 - RNA, 64 nt, Human; identical to SEQ ID NO: 39235

SEQ ID NO: 196837 - RNA, 64 nt, Human; identical to SEQ ID NO: 39236

SEQ ID NO: 196838 - RNA, 64 nt, Human; identical to SEQ ID NO: 39237

SEQ ID NO: 196839 - RNA, 64 nt, Human; identical to SEQ ID NO: 39238

SEQ ID NO: 196840 - RNA, 64 nt, Human; identical to SEQ ID NO: 39239

SEQ ID NO: 196841 - RNA, 64 nt, Human; identical to SEQ ID NO: 39240

SEQ ID NO: 196842 - RNA, 64 nt, Human; identical to SEQ ID NO: 39241

SEQ ID NO: 196843 - RNA, 64 nt, Human; identical to SEQ ID NO: 39242

SEQ ID NO: 196844 - RNA, 64 nt, Human; identical to SEQ ID NO: 39243

SEQ ID NO: 196845 - RNA, 64 nt, Human; identical to SEQ ID NO: 39244

SEQ ID NO: 196846 - RNA, 58 nt, Human
ggcagaccggacccagguuuccugacuccuggcccaagucucuuccuccuauccugcg

SEQ ID NO: 196847 - RNA, 58 nt, Human
gaaagcucgggcccuggaggcugcggcucuggcccacugagccaccgcgcccuccugc

SEQ ID NO: 196848 - RNA, 58 nt, Human
aggaaggggugauugacaagagacaagucuggcccaguuaaugcuuucugcagugggu

SEQ ID NO: 196849 - RNA, 64 nt, Human; identical to SEQ ID NO: 39245

SEQ ID NO: 196850 - RNA, 64 nt, Human; identical to SEQ ID NO: 39246

SEQ ID NO: 196851 - RNA, 64 nt, Human; identical to SEQ ID NO: 39247

SEQ ID NO: 196852 - RNA, 64 nt, Human; identical to SEQ ID NO: 39248

SEQ ID NO: 196853 - RNA, 64 nt, Human; identical to SEQ ID NO: 39249

SEQ ID NO: 196854 - RNA, 64 nt, Human; identical to SEQ ID NO: 39250

SEQ ID NO: 196855 - RNA, 64 nt, Human; identical to SEQ ID NO: 39251

SEQ ID NO: 196856 - RNA, 64 nt, Human; identical to SEQ ID NO: 39252

SEQ ID NO: 196857 - RNA, 64 nt, Human; identical to SEQ ID NO: 39253

SEQ ID NO: 196858 - RNA, 64 nt, Human; identical to SEQ ID NO: 39254

SEQ ID NO: 196859 - RNA, 64 nt, Human; identical to SEQ ID NO: 39255

SEQ ID NO: 196860 - RNA, 64 nt, Human; identical to SEQ ID NO: 39256

SEQ ID NO: 196861 - RNA, 64 nt, Human
gugggcaccggagcuugagagagggcgggagugggaaggcuaagaaucugcuuaguaaaugguu

SEQ ID NO: 196862 - RNA, 58 nt, Human
uugguguagggggagaggggaaaggggucuggcccaucgaggggccccuucugccagg

SEQ ID NO: 196863 - RNA, 58 nt, Human
uaagaccaccugugaacuugaucauuaucuggcccaaauaugaagauaaacuauaacu

SEQ ID NO: 196864 - RNA, 64 nt, Human
gcugcaggcgggaagccaggcggguggagcccaugggagcaagggcgaguggccgguccccgcu

SEQ ID NO: 196865 - RNA, 64 nt, Human
cagcggcuccgguguccuccacguggcugcccuggggagcaaucccagcggaucgcuccgggcc

SEQ ID NO: 196866 - RNA, 64 nt, Human
aggcaucucuuauccuugguuuuaaauuccugcugggagcaaggccugguaugagcgcccuggg

SEQ ID NO: 196867 - RNA, 64 nt, Human
aggucagcguggccugauugucccaggaccugaagggagcaaggauggccucagggccugguga

SEQ ID NO: 196868 - RNA, 64 nt, Human
aagguaguuugcauucuauuuaaaaaagggaguggggagcaaaugaaaaucaaaugugggggga

SEQ ID NO: 196869 - RNA, 64 nt, Human
uagaguauuagaagauuuuuacauuuugaagaaggggagcaaaucuaaaaaaaauucaguugaa

SEQ ID NO: 196870 - RNA, 64 nt, Human
uuugaggagggcaguccucuguccagauuggggugggagcaagggacagggagcagggcagggg

SEQ ID NO: 196871 - RNA, 64 nt, Human
cugggcauaggcuuccugauuccaagccuuuucugggagcaaagccagggccuggugccugauu

SEQ ID NO: 196872 - RNA, 64 nt, Human
auuaagaaaccuacauggguggcauggggcucuggggagcaagcccuuacuugcucagcacugg

SEQ ID NO: 196873 - RNA, 64 nt, Human
cucuuguaccagcccaggcaauaguguugaggaggggagcaaggcugcuaaguggaagacagag

SEQ ID NO: 196874 - RNA, 64 nt, Human
guccaauuuuccuaaguuucuuugaggguuccaugggagcaaauaucuaaauaauggccuggua

SEQ ID NO: 196875 - RNA, 64 nt, Human
agacguuuggcuagcaccccaggaagaugugagagggagcaagcaagguuagcaacugugaaca

SEQ ID NO: 196876 - RNA, 64 nt, Human
agaauuaaaguugugugggaguuucaggacaaaggaaggcuaaaaguuugucaagacguugagc

SEQ ID NO: 196877 - RNA, 58 nt, Human
ggccucagggcuuggggcaggcaugggacuggcccaggcacacaggucccggggcauc

SEQ ID NO: 196878 - RNA, 58 nt, Human
uacugggacuuggcauuuaggauuccaucuggcccagccccugaagguccuggggaag

SEQ ID NO: 196879 - RNA, 58 nt, Human
ugggaagggagcggcagcccagccaggccuggcccauaaaaggcucccaugcugagca

SEQ ID NO: 196880 - RNA, 64 nt, Human
agagaaacuacccagguauuacacaagccaaaaugggagcaaggccuucucuccagacuaucgu

SEQ ID NO: 196881 - RNA, 64 nt, Human
uaaaaaguuauauauaauuaucccuuuaauuaaagggagcaaaggggcguuccacauggacaga

SEQ ID NO: 196882 - RNA, 64 nt, Human
gggaaacggagccagcgugucacauggugagagagggagcaagagacagacaggggaggaaauu

SEQ ID NO: 196883 - RNA, 64 nt, Human
ucugggggcagcagcaggguccuugagagaacaggggagcaagccugccccaguacccaaaaaa

SEQ ID NO: 196884 - RNA, 64 nt, Human
ccuguuuuauaguucuaugugauguaaaggucuagggagcaauaaccagcccuuuuuuuucuga

SEQ ID NO: 196885 - RNA, 64 nt, Human
gaaauguucauuuuuagauuguuaauagaaauuggggagcaacuuuugaguaucuuuaguuucc

SEQ ID NO: 196886 - RNA, 64 nt, Human
gagcugagguuuagaugugcaaccuguggcucaggggagcaagcuuacacaagaagugagggaa

SEQ ID NO: 196887 - RNA, 64 nt, Human
guugcagcaaaguuuuaaguuuaccuugugucaagggagcaaugcuugguuuggggagugugug

SEQ ID NO: 196888 - RNA, 64 nt, Human
gaggggcaguuagagggagaacaggggugggaaagggagcaaggggcagauagcucagcaagga

SEQ ID NO: 196889 - RNA, 64 nt, Human
ccuuucuccccagcauacagugagcugccuuuuggggagcaaugccaugauaaggagcauacgu

SEQ ID NO: 196890 - RNA, 64 nt, Human
ccuuuucucucguggaagauaaaaccuggacucagggagcaaccacaggcucuccacuuugaaa

SEQ ID NO: 196891 - RNA, 64 nt, Human
ccucugcucccccaaagcuguuucugauccugcugggagcaacuaacuaguuauuaugcacauc

SEQ ID NO: 196892 - RNA, 64 nt, Human
gauaugcauuuauauaggcaacucgauauaggaugggagcaaacuaggaaugaauuggguagcu

SEQ ID NO: 196893 - RNA, 64 nt, Human
ggaacaaaguggugauuaaaauuccuaaugguuugggagcaauacuuucugcauaguggccuug

SEQ ID NO: 196894 - RNA, 58 nt, Human
uuuuugucauguagcuguuuuaagaaaucuggcccaggguguuugcagcugugagaag

SEQ ID NO: 196895 - RNA, 58 nt, Human
ugugacugagucccuucaggcgugcaagcuggcccaggccaaugguuggugugucaug

SEQ ID NO: 196896 - RNA, 58 nt, Human
cugcccgugaggagcuucccgcagccgccuggcccagccugggcacguucuccgaggc

SEQ ID NO: 196897 - RNA, 58 nt, Human
cccagcaaggagggucaugggcccugagcuggcccaggagacccuggcccugcccugu

SEQ ID NO: 196898 - RNA, 64 nt, Human
aaaccgucaguucggaaggcugguuagaacaugugggagcaacaugaauguucuacaaaaguuu

SEQ ID NO: 196899 - RNA, 64 nt, Human
ucuauaagcagcaggaagauuuuuuccaaggacugggagcaaacuugcaggcucugccauguac

SEQ ID NO: 196900 - RNA, 64 nt, Human
uccuccucauggggcauuacacuucaaaacaguggggagcaacuuuuccaccaaagcuacaaac

SEQ ID NO: 196901 - RNA, 64 nt, Human
uuggcccucuccacagggaacucuagaauaucaagggagcaagaggaagccaagaaaacuuggg

SEQ ID NO: 196902 - RNA, 64 nt, Human
uuaauuaccaugcuucacaauguuaaguuauauggggagcaacagcaaacaggugcuaauuugu

SEQ ID NO: 196903 - RNA, 64 nt, Human
accagagaaagccaggcuggaucgucacaugccggggagcaauguggauggccuggggacuccu

SEQ ID NO: 196904 - RNA, 64 nt, Human
agacagaaggcacuaaaaaagaagaaugaauuaagggagcaauuuuuauuacuuccagagaucc

SEQ ID NO: 196905 - RNA, 64 nt, Human
gugaguauggggaaggauacggguucuucugacggggagcaagggccuccgucuucccuuccuu

SEQ ID NO: 196906 - RNA, 64 nt, Human
gauugcaguuuaaaucaucauaugacgugugggugggagcaaccaaaguuauuuuuacagggac

SEQ ID NO: 196907 - RNA, 64 nt, Human
cuacauuacuucaaacugagauccuuccuuuugagggagcaaguccuucccuuucauuuuuucc

SEQ ID NO: 196908 - RNA, 64 nt, Human
acugcugcaaggccuuucugugugugaugugcaugggagcaacuuguucgugggucaucgggaa

SEQ ID NO: 196909 - RNA, 64 nt, Human
uguuuuaaguuucagaguuguuaaggguuguuaagggagcaaaaaccguaaaaauccuuccuau

SEQ ID NO: 196910 - RNA, 64 nt, Human
ggaccuucuucucuucagaagauaauuuucaaaagggagcaaugcugugaaugcagcuugcuuc

SEQ ID NO: 196911 - RNA, 64 nt, Human
cugcugaaggagaauuuggaauucuacuugaugcgggagcaacaaacagcucagggccaaacca

SEQ ID NO: 196912 - RNA, 58 nt, Human
ccagcccagcacccuggacuucagucgccuggcccaaccccaugauuauggaacgucu

SEQ ID NO: 196913 - RNA, 58 nt, Human
acuggguguagcccaacaccgugaggcacuggcccacuugcggaaccugacucaggcu

SEQ ID NO: 196914 - RNA, 58 nt, Human
caggagccuucaggacugcuggccuggccuggcccacccugcuccuccaggugcuggg

SEQ ID NO: 196915 - RNA, 64 nt, Human
aagaguaguccuaggaagcccacugauccccaacgggagcaagacuucuaacggcugauuggua

SEQ ID NO: 196916 - RNA, 64 nt, Human
gacagccuccgccaagaucuacaggacaaagggagggagcaagcccuacucggauggggcacgg

SEQ ID NO: 196917 - RNA, 64 nt, Human
gaguguauuuucuugagcaaacugaaguauuucugggagcaaaaacauaguaauuacacaauuu

SEQ ID NO: 196918 - RNA, 64 nt, Human
acagaaauugggugggaaaggagucuuuaucuuggggagcaaaagcugacuuuuaaacuugacc

SEQ ID NO: 196919 - RNA, 64 nt, Human
aaaguugacaggacaggaugauugauuaaaagaggggagcaagggaauuugaaauaauuccagg

SEQ ID NO: 196920 - RNA, 64 nt, Human
uuaaagcagagacuauuuugguggauaggugggagggagcaaggggaguuugagggaaucagag

SEQ ID NO: 196921 - RNA, 64 nt, Human
aaaauaaauuucuucuugaggugggguggagguggggagcaagaauuugaccuggcucugaucc

SEQ ID NO: 196922 - RNA, 64 nt, Human
uccuuaaacauucagucauguucccaggucugaggggagcaauggccagaccaguuucaguauc

SEQ ID NO: 196923 - RNA, 64 nt, Human
ugacagaaugagaccaaacgcagccagccagaucgggagcaaaccaaagaccaucugaggaaug

SEQ ID NO: 196924 - RNA, 64 nt, Human
aaugauaucugcauguugaauugggguggauggggggagcaagcauaauuuuuaagugugaagc

SEQ ID NO: 196925 - RNA, 64 nt, Human
uugucuggguuauuggacaauuuauaagaacuaugggagcaauaugaaggugcuugagaaaaga

SEQ ID NO: 196926 - RNA, 64 nt, Human
augacucucugcuaucccacuguauagauccacagggagcaaacacuuagaaaugauagagaac

SEQ ID NO: 196927 - RNA, 58 nt, Human
ggucuaaaagaucuccuuaaaaccagaggggagcaaaaucgaugcagugcuuccaagg

SEQ ID NO: 196928 - RNA, 64 nt, Human
uguaaaauuggaaccaucagcugauaaccucguagggagcaaccccaggauagcuaaguguuau

SEQ ID NO: 196929 - RNA, 58 nt, Human
ccgugggaagccuccgcccugagguccgcuggcccaccaccccugggugcucaguuuc

SEQ ID NO: 196930 - RNA, 58 nt, Human
acaccuuggaaaccuuucccaagccuuccuggcccacaguggccagugccauaggcag

SEQ ID NO: 196931 - RNA, 58 nt, Human
cuucaugucaucaaaaucugcacagucacuggcccaaccagaacuuucuguccuaauc

SEQ ID NO: 196932 - RNA, 64 nt, Human
ccuauuuaugguuauucguuuuaguaaguucugugggagcaagguauuuaaaaucaaaacuaau

SEQ ID NO: 196933 - RNA, 64 nt, Human
ggggggcagggagugaugauuugggggaggcuuugggagcaaaauaaggaagagggcugagcug

SEQ ID NO: 196934 - RNA, 64 nt, Human
cgcagucuuaauuccgccuuuuuuuuuucuaauggggagcaaaaagaaauucacugucuuuuaa

SEQ ID NO: 196935 - RNA, 64 nt, Human
agguuggcccuccucaaggucagccuucagauuugggagcaaacuucagagaaggcagaggaag

SEQ ID NO: 196936 - RNA, 64 nt, Human
gggcagguuucucuuuagcccucuuccugcacuugggagcaaaggcacuaccaguagagaaggg

SEQ ID NO: 196937 - RNA, 64 nt, Human
uuggucaaacugcuuuuguuucaacugcaggcaggggagcaaaaggacgccaugugagcauuag

SEQ ID NO: 196938 - RNA, 64 nt, Human
ccuacugugugccaagccauguuagagauacagugggagcaaaaccagauguguuuucugcccu

SEQ ID NO: 196939 - RNA, 64 nt, Human
uggcuggcgcucacggacaugcagucacgguagcgggagcaaucacaaaacuguaauuuacuua

SEQ ID NO: 196940 - RNA, 64 nt, Human
ugguguggcacugggagcugcuccuaaggaagcagggagcaaaucccaccuuuaccccaccuuc

SEQ ID NO: 196941 - RNA, 64 nt, Human
caugauaagaggaaugaacgugucugcaacuaaugggagcaagauaguacacuuuaacucuuuc

SEQ ID NO: 196942 - RNA, 64 nt, Human
ggaccugggucucugggagaggaaggaagagggagggagcaaagagauugggguauguccccug

SEQ ID NO: 196943 - RNA, 64 nt, Human
ucuguggaguaaauauugggauuggggggaaagagggagcaacggcccauagccuugggguugg

SEQ ID NO: 196944 - RNA, 64 nt, Human
cugggucagagugaaaggaccuuugggggugggugggagcaaagggcccaccugcugguuggug

SEQ ID NO: 196945 - RNA, 64 nt, Human
uccacagccuuguccagaguuccuguguagcacggggagcaaugauggagggagccccugagag

SEQ ID NO: 196946 - RNA, 64 nt, Human
aggcagguucauuguggaauaguuuaacagucaggaaggcuaaacuggucaguauuaaugugua

SEQ ID NO: 196947 - RNA, 58 nt, Human
gaugagaugugagcuggaacagaccuuccuggcccacuuccugaucacaaggaauccu

SEQ ID NO: 196948 - RNA, 64 nt, Human
ggaccuuaaacacaucugcaggagcucacaaaaugggagcaaaagaggcauuccagaaagaaga

SEQ ID NO: 196949 - RNA, 64 nt, Human
ugguuucuccacaggaauaugguuccauuaggcugggagcaaaaacaauguuuuuuaagauuga

SEQ ID NO: 196950 - RNA, 64 nt, Human
uauaaaucagaacuagcagaaguagcagagugaugggagcaaaauaggcacugaauucgucaac

SEQ ID NO: 196951 - RNA, 64 nt, Human
uugauuaccaucugaggucaagaaaugagauagugggagcaaaugggucacaaauagcucagcu

SEQ ID NO: 196952 - RNA, 64 nt, Human
cuguguuuacaggggggaggggagggguucguacgggagcaauaaaggagaaacugagguaccc

SEQ ID NO: 196953 - RNA, 64 nt, Human
uccagaccuguucccacaacuggggagguaggcugggagcaaaaggagagggugggacccaguu

SEQ ID NO: 196954 - RNA, 64 nt, Human
cccguguguccucaucugcggcaggcaggagagggggagcaaacaggaaauuccacagcugccu

SEQ ID NO: 196955 - RNA, 64 nt, Human
uugcucuggcuucagaagugaacuaugggcugcugggagcaacuagugacuuugauucccaugg

SEQ ID NO: 196956 - RNA, 64 nt, Human
ggcacaauacauaugaacgcuuuuagagaacuuugggagcaaagcaacugauguccugcgugga

SEQ ID NO: 196957 - RNA, 64 nt, Human
agaauucaggugcaggucuuugccgguuaaguaagggagcaacacguaaaaugggagaggagug

SEQ ID NO: 196958 - RNA, 64 nt, Human
caguuuggcccugcuggccuuagcagggagacaggggagcaaagaacgccaagccggaggcccg

SEQ ID NO: 196959 - RNA, 64 nt, Human
gguuucccuucuauaauaguuuuuuccucuaacggggagcaaucuuucucucgaaacugcuaau

SEQ ID NO: 196960 - RNA, 64 nt, Human
uagccagccgcgcagaggaugccgagcacuuuccgggagcaaucggacuccuggucuccuccgg

SEQ ID NO: 196961 - RNA, 64 nt, Human
gggugcucauagaguugcccagcccagggggaaagggagcaagaguuguccagagaagacagug

SEQ ID NO: 196962 - RNA, 64 nt, Human
gaagagggugauaaaugaggcuagagaggcagaggaaggcuagucaauaagcuaaggaggcucc

SEQ ID NO: 196963 - RNA, 64 nt, Human
cuggccaggggcgugccugcugguccuauggggggaaggcuacucugcaucucagccaccuucc

SEQ ID NO: 196964 - RNA, 64 nt, Human
uuuuaaguguacaaaaaauaaccuguuaauuguugaaggcuacuuuucuguucuuuuuuuuuuu

SEQ ID NO: 196965 - RNA, 64 nt, Human
uggccauuuucuugccugaggcucaagaggcccagggagcaaugggagggggcuccauggagga

SEQ ID NO: 196966 - RNA, 64 nt, Human
uucuccguugcaaagaauguuuccuaaauuguaugggagcaauaguauuuuugauguuuuaaug

SEQ ID NO: 196967 - RNA, 64 nt, Human
ccuuuccugcucauccccagugagcuaguggagagggagcaagggaggccgcagagggaaaaaa

SEQ ID NO: 196968 - RNA, 64 nt, Human
gacaugcaguuauauauuuuguuuuuaaaagggggggagcaaaagaaacaccaguguuagcuua

SEQ ID NO: 196969 - RNA, 64 nt, Human
gauagcacugcucuggggccaucugaucaccaucgggagcaaaucucugaccuccuugccugca

SEQ ID NO: 196970 - RNA, 64 nt, Human
aggguucucugcagccacacaaucagcccggcucgggagcaaacuccccuggaagaacggaguu

SEQ ID NO: 196971 - RNA, 64 nt, Human
gaauaauagacacuggggagguaggguggggagcgggagcaagagcugaaaaacuuaccuacug

SEQ ID NO: 196972 - RNA, 64 nt, Human
cacuacuuccagaagcaucuccucauuccccgccgggagcaacaucucucuucucgagacccca

SEQ ID NO: 196973 - RNA, 64 nt, Human
gacuguggcccccuccgugauccauccaucuccagggagcaagacagagacgcaggaauggaaa

SEQ ID NO: 196974 - RNA, 64 nt, Human
gugucucuaugaaaagcacaaggggccaaggucagggagcaagaggugugcacaccaaagcuau

SEQ ID NO: 196975 - RNA, 64 nt, Human
gagaaacagcagccuuugucucuucccucuuguggggagcaaggaggggaugagcgguaccuug

SEQ ID NO: 196976 - RNA, 64 nt, Human
ccuguacugcccugccaucucaggccaaagggaggggagcaaguggggaccuggccauggcccc

SEQ ID NO: 196977 - RNA, 64 nt, Human
uggggcaagcggggaaguugggaugagugcgugugggagcaaagaguuaaaaaucacuaugcua

SEQ ID NO: 196978 - RNA, 64 nt, Human
cugaaaauggacccaugagaguauauuuuuaugagggagcaaaaguuagacugagaacaaacgu

SEQ ID NO: 196979 - RNA, 64 nt, Human
cccaacugggcauuacccaccauuguagccaccugugcgccaugaccaugcuggcagagucuuu

SEQ ID NO: 196980 - RNA, 64 nt, Human
ugcgggaaaauaaaccacuggucccagagcagaggaaggcuacuugagccggacaccaagcccg

SEQ ID NO: 196981 - RNA, 64 nt, Human
ggcccuaucccuaggcaguggugcuaggaggacagaaggcuauaugggcguggcagaggcuggu

SEQ ID NO: 196982 - RNA, 64 nt, Human
cagaagcuccaugacgguagaagacuucucauuggggagcaacuuuuugacgcacaacuuuugg

SEQ ID NO: 196983 - RNA, 64 nt, Human
ccacugcugaguggccuugaggacgaaccccgcagggagcaagcaguacaguggcauucccagg

SEQ ID NO: 196984 - RNA, 64 nt, Human
caaccuuccuuuuuuuaaauuuucuccagucccugggagcaaguugcagucuuuuuuuuuuuuu

SEQ ID NO: 196985 - RNA, 64 nt, Human
aucuucagaaggacccaugucaggucugaccauugggagcaaagccauguucacacugaccuaa

SEQ ID NO: 196986 - RNA, 64 nt, Human
uggacaccaauccugggaggugggagcuggaauggggagcaaugagaggagggagugagacugu

SEQ ID NO: 196987 - RNA, 64 nt, Human
ccuagcuccagugcuucuaguaggagggcugaaagggagcaacuuuuccuccaauccuggaaau

SEQ ID NO: 196988 - RNA, 64 nt, Human
guguguaggcuggggcggggcccaggagaccacggggagcaaaccagcuuguucugggcucagg

SEQ ID NO: 196989 - RNA, 64 nt, Human
auggagaaaaaccuuauuuucuuuuguaagagcugggagcaaacacguuuaugagugugucgga

SEQ ID NO: 196990 - RNA, 64 nt, Human
ggugugagcagcacccauccaccguccccucccagggagcaagggcagggacagggccggucgg

SEQ ID NO: 196991 - RNA, 64 nt, Human
cagggugugagggaggugcagaggcauccggggcgggagcaagccccagguugugacaggugca

SEQ ID NO: 196992 - RNA, 64 nt, Human
cacucuaagugauuccuccagggugggaagcacggggagcaauggaaucagauggcucauucuc

SEQ ID NO: 196993 - RNA, 64 nt, Human
aguuccauuuuaaugauucuguuggggugaacuugggagcaaugagauguuugggaaguauugu

SEQ ID NO: 196994 - RNA, 64 nt, Human
cuuuguaaaaucaguagccguccugcaggcaggugggagcaacaggggcuucaguagcuucauu

SEQ ID NO: 196995 - RNA, 64 nt, Human
auguaggagcccgaggaccagcaggcugggaauggggagcaagucacgucagcucugucauucc

SEQ ID NO: 196996 - RNA, 64 nt, Human
ugccuuagccuccuaaguagcugagacuacagacgugcgccaccacacccaguucauuuuugua

SEQ ID NO: 196997 - RNA, 64 nt, Human
cagugccuucuccauggccccgcccuccccgcgugugcgccaggcuugggguccccgggagagc

SEQ ID NO: 196998 - RNA, 64 nt, Human
ugcuucagccucccaaguagcugggauuacaggugugcgccaccacgcccaggaaauuauugua

SEQ ID NO: 196999 - RNA, 64 nt, Human
caccagaggacugugucucauuaaagugauugcugggagcaaaaacuagaaugauacaaagaaa

SEQ ID NO: 197000 - RNA, 64 nt, Human
cuaacacuauuccugggcugcaugauauuccccugggagcaaagugacaggcacuuagaugcag

SEQ ID NO: 197001 - RNA, 64 nt, Human
acaaauuggggcugucgggggcuguggauggguggggagcaaaucaucugcauuccugaugacc

SEQ ID NO: 197002 - RNA, 64 nt, Human
aguuaucaguccuuugacaaggacagguggggcagggagcaagacagguaggcuggaagaacag

SEQ ID NO: 197003 - RNA, 64 nt, Human
cacuuuaugaaugaggaaacugaaauggccuuaagggagcaaguuauuucuuuuuuuuugacac

SEQ ID NO: 197004 - RNA, 64 nt, Human
ggcuuugugaacauggugcaaggccaggaauuuugggagcaaaaaccaaguauccuugugguuc

SEQ ID NO: 197005 - RNA, 64 nt, Human
uguggcacccgcugggcgcgggcagcagggaagagggagcaaggcauuguccacagacugcugg

SEQ ID NO: 197006 - RNA, 64 nt, Human
uucucuccaguucuccuucccuuaccaaggagaggggagcaaaugguuuugggcaagggcuuug

SEQ ID NO: 197007 - RNA, 64 nt, Human
guugcucugaguuuggagacugguccucgcuccggggagcaaguggggggcgugcagaugugcc

SEQ ID NO: 197008 - RNA, 64 nt, Human
caaaguuuuaacuuuuccuuaagaggcuuccauggggagcaagcauuugauaauucauccuuua

SEQ ID NO: 197009 - RNA, 64 nt, Human
cucauagagcugccucccccaggauggugaaguugggagcaaaauggggcuucuguaaguagag

SEQ ID NO: 197010 - RNA, 64 nt, Human
ggacugaggaggaguggagggaagcagggagggagggagcaagugugaagggcacagcugcugg

SEQ ID NO: 197011 - RNA, 64 nt, Human
acaaaauuagagcaaagcugaccuggagcccucagggagcaaaacaucaucuccaccugacucc

SEQ ID NO: 197012 - RNA, 64 nt, Human
guggccauuuggacagaagcccacuuaguuucuugggagcaacagcacguaucagaagccagac

SEQ ID NO: 197013 - RNA, 64 nt, Human
ccaauuaucuuugacugcuguucucaaccacguagugcgccagucaucacugguagcaaagauu

SEQ ID NO: 197014 - RNA, 64 nt, Human
ucauaggguuguccuggggauccaguaugaugaagugcgccaggggcuuggcauggugcccggc

SEQ ID NO: 197015 - RNA, 64 nt, Human
cgucucuccacagcaccuuugugaacucaggaaugugcgccagugggaagggcucucuugacag

SEQ ID NO: 197016 - RNA, 64 nt, Human
uuguuauuuuuuaaauuauugauuuuuaaauuaugggagcaaauccaucuccaaacaugauacu

SEQ ID NO: 197017 - RNA, 64 nt, Human
guaaccaauccugccagaccuguuuggggcaguggggagcaaaccuagauaaggaccuguuugg

SEQ ID NO: 197018 - RNA, 64 nt, Human
agcaaaccuagauaaggaccuguuuggggcagcagggagcaaaaucuccuuuaacaaccaagca

SEQ ID NO: 197019 - RNA, 64 nt, Human
ugguggggugggaggagcaccacucacuucugcagggagcaaggguccagagcagauauggacc

SEQ ID NO: 197020 - RNA, 64 nt, Human
cuggcuuaaucuggcaaaguucuucagacgacuugggagcaaaauggcugcuugagcuacucug

SEQ ID NO: 197021 - RNA, 64 nt, Human
ucccuauaaccauguuuagggaugugccucaguugggagcaaggagaaaaaugggaagaaccag

SEQ ID NO: 197022 - RNA, 64 nt, Human
aaauaaauacacaugcacacauuacauuagccaugggagcaauaaugucaccacacacacuuca

SEQ ID NO: 197023 - RNA, 64 nt, Human
aauuuucacagccaugauucuuuugcccacacuugggagcaaaagauucuacaaagcucuuuug

SEQ ID NO: 197024 - RNA, 64 nt, Human
ugaucuuugucucuguucuaaaauggaggcaguagggagcaaaacuauucuucucaagcauccu

SEQ ID NO: 197025 - RNA, 64 nt, Human
ggugcuuuuccucaggcucuucauugguuuccaagggagcaaauccucaguggggauacaagac

SEQ ID NO: 197026 - RNA, 64 nt, Human
gcuuuuuucccuccuaccacauacaccauucuuagggagcaaugagguaacaggucuguguugu

SEQ ID NO: 197027 - RNA, 64 nt, Human
cgcccaggggcgggcggggguacgagggaggaaggggagcaagacuugggcucacaggcugguu

SEQ ID NO: 197028 - RNA, 64 nt, Human
cugaaggucccacccccaccccuacagaaaaaaugggagcaagaacuugugcuugggagcuggu

SEQ ID NO: 197029 - RNA, 64 nt, Human
auguaguaguguguuauuuuauuacacgaaaugagggagcaauaacuucaaccaauguaaucac

SEQ ID NO: 197030 - RNA, 64 nt, Human
uaccucagccuccugaguagcuggaacugcagaugugcgccaccaugcccggcuaauuuuugua

SEQ ID NO: 197031 - RNA, 64 nt, Human
cuccugcugagaaccuuccccuaggcccugugcagaaggcuacugccccuuaggccucagcugg

SEQ ID NO: 197032 - RNA, 64 nt, Human
gcuagagcuucaagucugugccuggagcuccugggaaggcuacucaccuugaacaccacgcuug

SEQ ID NO: 197033 - RNA, 64 nt, Human
ccuaguguuugcugggcacuaugcuaagcacuuugggagcaagaaccuccuaccuuccaguuua

SEQ ID NO: 197034 - RNA, 64 nt, Human
aagcuuauaauaauauacaguauauguauauguagggagcaauuggucaaaaguggcuuuuugu

SEQ ID NO: 197035 - RNA, 64 nt, Human
gcgcacccaugccucccgcaguccaggugagcaggggagcaacugagcaggaagaggauggauc

SEQ ID NO: 197036 - RNA, 64 nt, Human
acucugaaguugguugugauugacagaacccuuugggagcaaacuaguagaguuggauuaaauu

SEQ ID NO: 197037 - RNA, 64 nt, Human
guaccggggacuugggagagugagacccaguggagggagcaagaggagagggaugucggggggg

SEQ ID NO: 197038 - RNA, 64 nt, Human
cacaaucccaaaacuagaguuggggggaacuggagggagcaaaacacugauuugauacuaguca

SEQ ID NO: 197039 - RNA, 64 nt, Human
guuccuccaugcccaaacuggcagaugcuucucugggagcaaggccacaugggcugaugcagcu

SEQ ID NO: 197040 - RNA, 64 nt, Human
cgcagccuggauacuuaccuggcccuccucccuagggagcaagugccuuccacuuacuucccau

SEQ ID NO: 197041 - RNA, 64 nt, Human
aagaaccaaacguauuuuauuuuauuuuuuaaaugggagcaacauaucagucgugucaccagcu

SEQ ID NO: 197042 - RNA, 64 nt, Human
aucauucccaaugguguacaauguaaggguuuuagggagcaacaguauuuaacuggaagaaaga

SEQ ID NO: 197043 - RNA, 64 nt, Human
uggaggcaccauaucagccugcgggacuaggguggggagcaaacaggccagcgguggaggucug

SEQ ID NO: 197044 - RNA, 64 nt, Human
auaaauacugauauucuccaaaccuagugguguagggagcaagagaaugcagcuggaaggcaca

SEQ ID NO: 197045 - RNA, 64 nt, Human
aaaaagauguuuccuuucuaaagauuaauuucuugggagcaaaugaguauuuguugcauuuguu

SEQ ID NO: 197046 - RNA, 64 nt, Human
auccccauggaacguuucacuuuaacccugacuggggagcaauauguucugugaaaauaucuug

SEQ ID NO: 197047 - RNA, 64 nt, Human
gggcgucagcccuggccugcaugauggguugccugugcgccagagugacucacacccugggaaa

SEQ ID NO: 197048 - RNA, 64 nt, Human
agcacagcaggggagggguuacucaagauggcaagugcgccaaggagaaggcagaaaugcuggg

SEQ ID NO: 197049 - RNA, 64 nt, Human
uauaugcuaaaaugacuuccccacauugacauuugugcgccaccuuuaaucacucuggggcaac

SEQ ID NO: 197050 - RNA, 64 nt, Human
auaauugccucuccccucucccauuuucucucuugggagcaauggucacagucccugguaccug

SEQ ID NO: 197051 - RNA, 64 nt, Human
cuggcccacucaugauggagaaguguggucagaggggagcaaugggcuuugcugcuuaugagca

SEQ ID NO: 197052 - RNA, 64 nt, Human
agaggagcuuagaguuuauugcaguguagcuuaggggagcaacccauggcucacaggucacuaa

SEQ ID NO: 197053 - RNA, 64 nt, Human
auguaauacuuacaugaauguugcaugugugcaugggagcaacugaguagcaauaguaaauuua

SEQ ID NO: 197054 - RNA, 64 nt, Human
agugccuaggguugcccgcuguggccugcuuccagggagcaacagagaggccaccaagcagagg

SEQ ID NO: 197055 - RNA, 64 nt, Human
auugaguuauuucuuaacaaguuucgagagagaagggagcaagacaagagcaagcaacggcuau

SEQ ID NO: 197056 - RNA, 64 nt, Human
ugagcgccugagcugaauacagagggaagaggcugggagcaaggccgggugcuggggccggcag

SEQ ID NO: 197057 - RNA, 64 nt, Human
uccuacugcccgggcagccccagcccagcccgccgggagcaaggauggugcuaggucauucaug

SEQ ID NO: 197058 - RNA, 64 nt, Human
caaagccucagggcuuauguccaacggucccauugggagcaacagugauuguuuauaguuuuuu

SEQ ID NO: 197059 - RNA, 64 nt, Human
augcacuuuguggcugagugcuccaggacuccuagggagcaagguccucccucuaagguguuuc

SEQ ID NO: 197060 - RNA, 64 nt, Human
cagaaucccggcugucaagggguguucaguuaaggggagcaacagaggacaugaaaaauugcua

SEQ ID NO: 197061 - RNA, 64 nt, Human
ucugauaguuggagcucccagaccaggcagugcugggagcaaccaccuuuguuuuuuaccuucu

SEQ ID NO: 197062 - RNA, 64 nt, Human
acuuaacagcucugggucccuguuuuaccauccugggagcaaggcccugcagcuccacgagacc

SEQ ID NO: 197063 - RNA, 64 nt, Human
ggcacagggccuaucaguggcaggauuuaaucuggggagcaaauuccagcucugaaauggaguu

SEQ ID NO: 197064 - RNA, 64 nt, Human
uauuuugcacacugcuuuauuuucuagaggcucugggagcaaauuacauucaucacauuaccuc

SEQ ID NO: 197065 - RNA, 64 nt, Human
ccuucucucucccagacccuucccccaccacaucgggagcaauacccccaccaccccuuucacu

SEQ ID NO: 197066 - RNA, 64 nt, Human
ccucagggggcugucggccaagagccuggagaaagggagcaagcugcccccuccuugcccccaa

SEQ ID NO: 197067 - RNA, 64 nt, Human
cugaaaaaugccugcugcugccaaguuagcuauugggagcaaucuggaaaaacuugcucccagg

SEQ ID NO: 197068 - RNA, 64 nt, Human
caauaauuccuuucccgaguauaaccacucaagggggagcaaauuuggauggauuuacgacuuc

SEQ ID NO: 197069 - RNA, 64 nt, Human
gccugcaucugugccucccagcccccugcacugagggagcaaguugcccacaugcccgccagcc

SEQ ID NO: 197070 - RNA, 64 nt, Human
acuuuuuaugucgguuuggguguuugugaguuuggggagcaauuuuuauaaaagaaaaacuuua

SEQ ID NO: 197071 - RNA, 64 nt, Human
uacaaagguguagcuaagaagauggcccauuggugggagcaaugucacccugccuccagcuagc

SEQ ID NO: 197072 - RNA, 64 nt, Human
gcucuuucaccccacuccuaguccccuugggagugggagcaaaauugugaucuuuccuaggagu

SEQ ID NO: 197073 - RNA, 64 nt, Human
auucucccgcauugguggcuugggacuugggagagggagcaagccuuccuccauggcccaucac

SEQ ID NO: 197074 - RNA, 64 nt, Human
gagaggguuucuuuuacuucaaaaucuuucuucagggagcaagacaugaacugacuaauuggua

SEQ ID NO: 197075 - RNA, 64 nt, Human
cuucugcaaauucaauccauugagcuaacuguuggggagcaauuugguaguuguagacauuugc

SEQ ID NO: 197076 - RNA, 64 nt, Human
ggaccaagaaagaguaggaagaaggggacgagccgggagcaaaaccaccucagacacccgggcc

SEQ ID NO: 197077 - RNA, 64 nt, Human
ggggucuuggccuggaaccuuccagagaggaggcgggagcaauuuuagccccacccugcuccca

SEQ ID NO: 197078 - RNA, 64 nt, Human
ggcacaguggccucaccucccgucgggcacuggcgggagcaaggucgggggcaggcgcugccca

SEQ ID NO: 197079 - RNA, 64 nt, Human
acugagcccccugaggcccacagccacccaggcagggagcaaguggccuggucacuucugguuc

SEQ ID NO: 197080 - RNA, 64 nt, Human
caaaaaauagcucacaaggggagagccaguaugggggagcaaauuugacaaaugggaauuagag

SEQ ID NO: 197081 - RNA, 64 nt, Human
uccugugcccauauuuuaauguaauuguauaacugggagcaaaaauauauucugcuuuucaacu

SEQ ID NO: 197082 - RNA, 64 nt, Human
agcugcugagaaggccuugagggaaguagaggcugggagcaaaugccccaugcggugagaggau

SEQ ID NO: 197083 - RNA, 64 nt, Human
uccaccgugggguugggggugggcaacagaggaggggagcaaguagggaaggggguggccuuga

SEQ ID NO: 197084 - RNA, 64 nt, Human
aguuugcaaagucccagccgcacugggagccauggggagcaagugugcucuccuggggcgccug

SEQ ID NO: 197085 - RNA, 64 nt, Human
uuuuuuccuuuccuuuggguauuugcacuauuuugggagcaaguuuucuaugugggagccacuu

SEQ ID NO: 197086 - RNA, 64 nt, Human
aggaagccuggagccaagaaccuucuggcucugagggagcaagagcuggcaggcggcagggcug

SEQ ID NO: 197087 - RNA, 64 nt, Human
ggcugcaaugucucuaccacaucccagcaccagggggagcaaacccugccccugcccgccucuc

SEQ ID NO: 197088 - RNA, 64 nt, Human
caaugggcuggagggugagacccagccaauccuugggagcaagcagcacuaaaucacaucaggg

SEQ ID NO: 197089 - RNA, 64 nt, Human
ggagcugcauugaugaauuggcucaguauuuaaagggagcaaacuuuuugauaauaaaucuuuu

SEQ ID NO: 197090 - RNA, 64 nt, Human
uugcuacguguuuauggaacugaaagcucaacaggggagcaauaaaccgagaaaucaugagaaa

SEQ ID NO: 197091 - RNA, 64 nt, Human
caggcucggccugcccccaccccauucccgcagugggagcaaacugcaugcccagagacccagc

SEQ ID NO: 197092 - RNA, 64 nt, Human
gcgagaagacccagcuggaguucaugucgcaacagugcgccaggaccgacggccagccgcugcg

SEQ ID NO: 197093 - RNA, 64 nt, Human
uuugggauguggacagaggggcagggggcugggagaaggcuaagccgagggguccuguuugugc

SEQ ID NO: 197094 - RNA, 64 nt, Human
aauugucaaguuguuggcuuuuauuguauugaaugaaggcuauaauacugagugccagagaagu

SEQ ID NO: 197095 - RNA, 64 nt, Human
uugauuauaugugauugacaauguguauuuuugagggagcaaagauuucuguacauauuucuua

SEQ ID NO: 197096 - RNA, 64 nt, Human
cccgggcauccuccugucccuggcuccucauccugggagcaacagggcucugaggacgugagga

SEQ ID NO: 197097 - RNA, 64 nt, Human
uacagucagcucagccaaaggagaugccccaagugggagcaacauggccacccaauaugcccac

SEQ ID NO: 197098 - RNA, 64 nt, Human
aucucgugacuuuuagaaaaacacagggacucgugggagcaagcgaggcucccaggacccccac

SEQ ID NO: 197099 - RNA, 64 nt, Human
ggggcccaggcucugagcuccacaggucugagcagggagcaacucaggcccccacccaagccug

SEQ ID NO: 197100 - RNA, 64 nt, Human
ccuucauucuucccagauggaugccaugggcuaugggagcaaauugcccuggaccuuugccuga

SEQ ID NO: 197101 - RNA, 64 nt, Human
uuuuaggcacagcaaauggcacauacaagggccagggagcaagagagaggacagguccucaaca

SEQ ID NO: 197102 - RNA, 64 nt, Human
aggugccacaggcagcccugggacauaggaagcugggagcaaggaaagggucuuagucacugcc

SEQ ID NO: 197103 - RNA, 64 nt, Human
gagccauccgccccccucagccccuuccuccccagggagcaaagccauaaggggcaggggccac

SEQ ID NO: 197104 - RNA, 64 nt, Human
ggccuggagggucagaugggagaccaggucccaagggagcaagaccucgcgaagcgcagcagcc

SEQ ID NO: 197105 - RNA, 64 nt, Human
aguagccgugagggaggcggggaccagccagaccgggagcaaaccgucccuuguccccgucucc

SEQ ID NO: 197106 - RNA, 64 nt, Human
gcccuccccgauggcggggaucugggagggucgggggagcaaaaggcggugagagaggauuuau

SEQ ID NO: 197107 - RNA, 64 nt, Human
gcccucccuggucuggcccccuccuccggguuaggggagcaaggauugggggucgugcagccca

SEQ ID NO: 197108 - RNA, 64 nt, Human
ugcaaacucaccgcuccaaugccuacugaguagggggagcaaaucgugccuugucauuuuauuu

SEQ ID NO: 197109 - RNA, 64 nt, Human
caucagcuuccuuuuuugagaacauauagaagaagaaggcuaagagauggugaagagacugcau

SEQ ID NO: 197110 - RNA, 64 nt, Human
ugcugauuuccucaguuccauuuugaggaauggggaaggcuauucuaaagaaaaaaaugggauu

SEQ ID NO: 197111 - RNA, 64 nt, Human
acugaggccgcagaugcaugaaauuugggccugggaaggcuaugcugguuuuggaguguuuggg

SEQ ID NO: 197112 - RNA, 64 nt, Human
aucaaucagaauaaacucaaaaaaaaaagguagggggagcaaaaccaucaaccaccaggcagcc

SEQ ID NO: 197113 - RNA, 64 nt, Human
ugauagaggcuuacucagccugugggagggcuaggggagcaaaagacagggacacugccaucga

SEQ ID NO: 197114 - RNA, 64 nt, Human
acggugggagcaugggcuuaggaugugaaugccagggagcaauaaagguauccgugguaucggc

SEQ ID NO: 197115 - RNA, 64 nt, Human
gaagagcagcuggaggguggauggggaggccagagggagcaaugagggguggucccagcucugc

SEQ ID NO: 197116 - RNA, 64 nt, Human
guuaauaagugcuauaaagaaauauaaaggguuugggagcaaaaagagggaguggaucuauuuu

SEQ ID NO: 197117 - RNA, 64 nt, Human
ucuuccaauuucugcuucugaaugauucaauguugggagcaauagaaauaacauucccuuugcc

SEQ ID NO: 197118 - RNA, 64 nt, Human
gcggcacgccaacagccccccccuugaaucugcagggagcaacucuccacuccauauuuauuua

SEQ ID NO: 197119 - RNA, 64 nt, Human
ggguuagaagcgagggcaccagcaguuguggguggggagcaagggaagagagaaacucuucagc

SEQ ID NO: 197120 - RNA, 64 nt, Human
uucuguccgaggagggguaagggaauaggagguggggagcaaagagggcagccugacuagaugc

SEQ ID NO: 197121 - RNA, 64 nt, Human
uacaauguucccuuguggccaaauuucccucccagggagcaauuucagugcuaggaucauugga

SEQ ID NO: 197122 - RNA, 64 nt, Human
uucuguaugacauuuuuuuuuuuuucagagggcagggagcaauuuuucuauggcaugugacaga

SEQ ID NO: 197123 - RNA, 64 nt, Human
gagaaaucaauuauucccacaggauuuuaggucagggagcaaaaaucucagaacuugaccauga

SEQ ID NO: 197124 - RNA, 64 nt, Human
uaccagccaaaguuauacuaaauaagagacuugggggagcaaauguuuuucagccuucagaaau

SEQ ID NO: 197125 - RNA, 64 nt, Human
uggauccuccagauagccacugccuuuuccucaagggagcaacguuagcuuuccugaaugauga

SEQ ID NO: 197126 - RNA, 64 nt, Human
ccacuggcuccacauccaccccacuggaucuucagaaggcuagagggcgacucugguggugcuu

SEQ ID NO: 197127 - RNA, 64 nt, Human
ugugggugcugacguuguagaagcgaguggccucgaaggcuacgggacgaggguggcgggugac

SEQ ID NO: 197128 - RNA, 64 nt, Human
aagccuggacguagggucauuagcuuugggaauagaaggcuacacagaagcacacuguuuuuga

SEQ ID NO: 197129 - RNA, 64 nt, Human
aaacacgacauauuuaaagaagguucuuucaccugggagcaaaugaacaauagcuaagugucuu

SEQ ID NO: 197130 - RNA, 64 nt, Human
guaaauuauuuguggcuuugcugagugaaggaaggggagcaagggguggugccccuggucccag

SEQ ID NO: 197131 - RNA, 64 nt, Human
cuagacauacacuagagacaccuuguaguauuuugggagcaaaaaaauuauuuucucuuaacaa

SEQ ID NO: 197132 - RNA, 64 nt, Human
agauauucaugagggugggucacuacagauguuggggagcaagggcuaggaucacuuuuuaaaa

SEQ ID NO: 197133 - RNA, 64 nt, Human
acaggaaugauuucuccuuaauugcuuaaggccggggagcaaagugucuuaacuucugucuuug

SEQ ID NO: 197134 - RNA, 64 nt, Human
aagauacucucaagccuguaucccugccccacuggggagcaaugacuuucaaagcacuguguau

SEQ ID NO: 197135 - RNA, 64 nt, Human
ugcuuccaacuggcucaauuggccgggaaaacaugggagcaagagaagcugaaauauauuucug

SEQ ID NO: 197136 - RNA, 64 nt, Human
gacaagccauauuuuuagaaaguagucuacugaugggagcaacaguuauggcaugcugggggaa

SEQ ID NO: 197137 - RNA, 64 nt, Human
ucuguuaccaauauaguuuucuaacuccuguuuggggagcaaguguuaauaauaacuuauuccu

SEQ ID NO: 197138 - RNA, 58 nt, Human
aacccuuggugugggucugaggucuugacucaacgagagcacuugaaaaugaaaugac

SEQ ID NO: 197139 - RNA, 64 nt, Human
gagucuccuaccucccccaacccugcccgccccugaaggcuaccuggcgccuugggggcugucc

SEQ ID NO: 197140 - RNA, 64 nt, Human
cuucuguguucacucuacguugguuacuggauuugaaggcuagagaccuucaagucauaggacu

SEQ ID NO: 197141 - RNA, 64 nt, Human
uauaguuuuuaaaaaaguaauuuccuuaaauccagaaggcuaaaaaugaagcugaaacuuaaag

SEQ ID NO: 197142 - RNA, 64 nt, Human
ucaccucgccaucccugccgucccaaggcucucucucaacgaugguagggaaagccccgccucc

SEQ ID NO: 197143 - RNA, 64 nt, Human
gguaaauuccaugugccucuggguacaaaagugccucaacgacaugcucuggaaaucccaaaug

SEQ ID NO: 197144 - RNA, 64 nt, Human
aggggcuugugauggcuacaauggcuccuagacacucaacgacuucaucuguggcagggagaga

SEQ ID NO: 197145 - RNA, 64 nt, Human
gaagaucugguugaaaauuguauuucuauguaaacucaacgauauguuugguuuuccugaaaau

SEQ ID NO: 197146 - RNA, 64 nt, Human
cucugccaaacaacacccaguccuauuccaaacucucaacgauucuaucuuguuccuguuuuuc

SEQ ID NO: 197147 - RNA, 64 nt, Human
cugacucugucuuguccgacucucuugagaauuucucaacgauugcucaugccugucaguauca

SEQ ID NO: 197148 - RNA, 64 nt, Human
aaacaaaaaagaggcacuagucuaucugcaauuacucaacgaggcauuuucauaggaaacagac

SEQ ID NO: 197149 - RNA, 64 nt, Human
aggggucaaaaagcuuauuucuuuuaaucucuuacucaacgaacacaucuucugaugauuuccc

SEQ ID NO: 197150 - RNA, 64 nt, Human
uauucaguucccuuuuucccuuuuaaaaugcuuccucaacgaaggggaacaaauaccuggauaa

SEQ ID NO: 197151 - RNA, 64 nt, Human
cgcccgcaggguggagaucgcugcaucccugcagcucaacgagacccaagugaagaucugguuc

SEQ ID NO: 197152 - RNA, 64 nt, Human
auauauagugugugauguguaaaucaggucaaaccucaacgacaauugaaaguuguuauugucc

SEQ ID NO: 197153 - RNA, 64 nt, Human
acucuccccucaaagaaaagacauucagguguuucucaacgacaucuucuguccagcaagcucg

SEQ ID NO: 197154 - RNA, 64 nt, Human
agggcugggcacucccugagacccaaagacccaccucaacgacgaguggcguugagccacuucc

SEQ ID NO: 197155 - RNA, 64 nt, Human
cccgcuccagcggcaccacguccggcacugcgugcucaacgagcuggcccagcugggccuggag

SEQ ID NO: 197156 - RNA, 64 nt, Human
ggugaccgaguucggcaauaaguacuggcucaugcucaacgagaaggaggcccagcaaguguau

SEQ ID NO: 197157 - RNA, 64 nt, Human
uuucauucugaaacuucuuaucaauuaccuaaaucucaacgaaaaacaauuuacugaagccgac

SEQ ID NO: 197158 - RNA, 64 nt, Human
agucaaaaagccaaggaaaaaacagagcagaccugaaggcuaaucuuauuuuugccacuaacuu

SEQ ID NO: 197159 - RNA, 64 nt, Human
uauuguccuuuaugcauuuucaaugaaauggaaugaaggcuaauaugcuugcuuuauuuacuuu

SEQ ID NO: 197160 - RNA, 64 nt, Human
uacauuuuuuuccuuugcaaauucuguaauuucacucaacgauuaagucuaccaaagaacacac

SEQ ID NO: 197161 - RNA, 64 nt, Human
gaaaauuuccagauaagacaugucaccauuaauucucaacgacugcucuauuuuguuguacggu

SEQ ID NO: 197162 - RNA, 64 nt, Human
ggagaaagagaucuccgugcccuacagaccuuuucucaacgaaugugggaaggaccuggcuuua

SEQ ID NO: 197163 - RNA, 64 nt, Human
uuucuauaggcaaaguagaaaauucgaaaagguccucaacgaguuuguacagcugcucccacuc

SEQ ID NO: 197164 - RNA, 64 nt, Human
cagggaacaagaguuguaguguuagugcaacugucucaacgaugcuguguggcuucagacccaa

SEQ ID NO: 197165 - RNA, 64 nt, Human
gcugccuacccuuuucucuccucugguucucaaccucaacgaguucaaaucaguuguccuuuuu

SEQ ID NO: 197166 - RNA, 64 nt, Human
guaaagcagggccgagacagaaagaaaauagauucucaacgagauuucacuguggcuucuccag

SEQ ID NO: 197167 - RNA, 64 nt, Human
gcuugggggaggacucaguucacaaaaugcaaaacucaacgaucagauucacggacccagagcu

SEQ ID NO: 197168 - RNA, 64 nt, Human
ggccgacgagauggccaaggcgcuggaggcggagcucaacgaccucaugugagcgcgggcagcg

SEQ ID NO: 197169 - RNA, 64 nt, Human
gccacagucaccacuccaugacaucccugucuuccucaacgacuucuuccucgacaucuuccuc

SEQ ID NO: 197170 - RNA, 64 nt, Human
cagaacuucagggacugggagcagaggccccucacucaacgacguuugugcgacauaguauugu

SEQ ID NO: 197171 - RNA, 64 nt, Human
aaccuaaaaauaucugugaauggagcaaguucaggggucuuauggagguggcccggccccuccc

SEQ ID NO: 197172 - RNA, 64 nt, Human
gcccaacugacugucuggcuuccaacccagccaggggucuuagguguccccuccuagcccugug

SEQ ID NO: 197173 - RNA, 64 nt, Human
aagaaagcagugugauguaguggagagagcccaugggucuuauuuaugggauaugguccucuua

SEQ ID NO: 197174 - RNA, 64 nt, Human
guuaggggugggagggaauauuugagggagggcugggucuuagggaaaggaauggggaagcaac

SEQ ID NO: 197175 - RNA, 64 nt, Human
uuuuuuuuuuuuuuuuuuuuuuuuuucugagacagggucuuacucugucgcccagacuggaaug

SEQ ID NO: 197176 - RNA, 64 nt, Human
ugccucagccuuccaaguagcugggauuacaggugugcgccaguacgccuggcuaguuuuagua

SEQ ID NO: 197177 - RNA, 64 nt, Human
cugccucagcccccaaguagcugggauuacaagugugcgccaccacacccagcuaauuuuuuau

SEQ ID NO: 197178 - RNA, 64 nt, Human
ugccucagccuccugaguagcugggauuacaggugugcgccaccacgcccagcuaauuuuuugu

SEQ ID NO: 197179 - RNA, 64 nt, Human
gcccccuuccucccuugcuggcccugaugggguggggucuuaggacgggaggcuguguccgugg

SEQ ID NO: 197180 - RNA, 64 nt, Human
aaaugcuuuuggucuccuacccaaauacucacaagggucuuaucagacgcccgucuuaaagucc

SEQ ID NO: 197181 - RNA, 64 nt, Human
gagagggauuaaccugugcugccugggacccucagggucuuagguuggggagugugaauaggag

SEQ ID NO: 197182 - RNA, 64 nt, Human
gaaucaucaauaaaaacucaauauaacuuucuuugggucuuaaagcaggagaauccaaaguaaa

SEQ ID NO: 197183 - RNA, 64 nt, Human
aaguuucugccaucuagcuuuuugaagucuaugggggucuuacucaaguacuaguaauuuaacu

SEQ ID NO: 197184 - RNA, 64 nt, Human
gaguccauauagcuacauuccacccuuguauccugggucuuagagacccuaucucagacaguga

SEQ ID NO: 197185 - RNA, 64 nt, Human
ucugaguacugcucucaucacacccccacagagggggucuuaccacacaaagggagagugggcc

SEQ ID NO: 197186 - RNA, 64 nt, Human
cauagcuauugucucgggcauccuucccaggguugggucuuacacaaauagaaggcucuugcuc

SEQ ID NO: 197187 - RNA, 64 nt, Human
acugaaggcauaugcacagucaaggucacuuaaagggucuuaugaaacaauuugagccagagag

SEQ ID NO: 197188 - RNA, 64 nt, Human
auucuuccacgaauagguaauugauagaguuuaugggucuuagucuuaaggguaacagagugaa

SEQ ID NO: 197189 - RNA, 64 nt, Human
aaugcaggguaacuauuauugcgcauuuucauuugggucuuaacuuauuggaacuguagagcau

SEQ ID NO: 197190 - RNA, 64 nt, Human
guugcuuuugcaucuucuguuccuggguaauggugggucuuaauggaggcuggguggaccacug

SEQ ID NO: 197191 - RNA, 64 nt, Human
auuccugugugugccuguaguguccccagcauaggggucuuaggcauagggcugaacaguccuu

SEQ ID NO: 197192 - RNA, 64 nt, Human
aaaugcuuuuuuuuuuuuuuuuuaaauggagauagggucuuaacucuuguccaggcuggaggag

SEQ ID NO: 197193 - RNA, 64 nt, Human
cuucaucuauguuuaccggccaccaaacaccuuagggucuuagacucugcugauacuggacuuc

SEQ ID NO: 197194 - RNA, 64 nt, Human
uacugucuucacaacauaauguccguuugugcaagggucuuauuuuucuuauucaugucuguau

SEQ ID NO: 197195 - RNA, 64 nt, Human
agucagcgugaagcaguuauuuucuacgcuaccugugcgccauaaggaauuucaaaggaauauu

SEQ ID NO: 197196 - RNA, 58 nt, Human
ggucucugcccagcacaggaagcugacccuggcccagcucuaccgaaucaggaccacc

SEQ ID NO: 197197 - RNA, 58 nt, Human
gcagccccacugggaaccagacugcagccuggcccauggcuguuuucccaaggaucag

SEQ ID NO: 197198 - RNA, 64 nt, Human
aaagacaguuuaggggaccucuguagaacaacaagggucuuauuuugugaauuauauauuucaa

SEQ ID NO: 197199 - RNA, 64 nt, Human
aauuuuuacuuuagaaauguucauguuagugcuugggucuuaaggguccauaggauaaaugauu

SEQ ID NO: 197200 - RNA, 64 nt, Human
cugaguguucuuagaugggguuauucugagaugagggucuuagccuacaguucuuuuugaaaug

SEQ ID NO: 197201 - RNA, 64 nt, Human
cuguccugagucauaaguaauauggguggggcgagggucuuauuucuguagaaaucgugugacu

SEQ ID NO: 197202 - RNA, 64 nt, Human
uagaaaguaguaagucguuaacuuaguguaagaagggucuuagagaacaucuaaccuucuagga

SEQ ID NO: 197203 - RNA, 64 nt, Human
caggcagacgaagcucucuuacaaaccccugccugggucuuagcauugaucagugacacaccuc

SEQ ID NO: 197204 - RNA, 64 nt, Human
uaguacugccagucauguaaauugauucugcugagggucuuauaagaauugagauauaacaaug

SEQ ID NO: 197205 - RNA, 64 nt, Human
uguuuuccucucagacuuuauggauaaugugaccgggucuuaugcaaauuuucuauuucuaaaa

SEQ ID NO: 197206 - RNA, 64 nt, Human
cacggguuuuggcacuuuagaaaaagccugaugugggucuuacauaaaugaaugucuguauaag

SEQ ID NO: 197207 - RNA, 64 nt, Human
gaauaugaauugacagacuguuuucguagagagagggucuuacucuuucacucaggcuggaaug

SEQ ID NO: 197208 - RNA, 64 nt, Human
gaagggagcucuagggaagccguuucauucuucugggucuuacagucuuuggcugaaauucuga

SEQ ID NO: 197209 - RNA, 64 nt, Human
gugaaauuuaaaauaaauaaauuuuuaaugaccugggucuuaaggauuuaggaaaaauaugcau

SEQ ID NO: 197210 - RNA, 64 nt, Human
uuucuuucuuuuuuuuuuuuuccuuuuugagacagggucuuacucuugucacccaggcuggagu

SEQ ID NO: 197211 - RNA, 64 nt, Human
aagucaacguaaaaacugguuucuugguuugguugggucuuauuugaguuaguuuguuucucag

SEQ ID NO: 197212 - RNA, 64 nt, Human
ucccagagucgaaucuagaucucaucugucauccgggucuuauccuuugcucuguuuuucucuu

SEQ ID NO: 197213 - RNA, 64 nt, Human
ggaaauuuuuuuuuuaaucucuuuuucugagacagggucuuacucugucgcccaggcuggagug

SEQ ID NO: 197214 - RNA, 64 nt, Human
ugccucagucuccugaguagcuggaacuacaggugugcgccaccacgcccagcuaauuuuugua

SEQ ID NO: 197215 - RNA, 64 nt, Human
gagggccaagaugcuguccccccauccaaaacccgugcgccacugcagugaguguugagggcac

SEQ ID NO: 197216 - RNA, 64 nt, Human
ugccucagccucccgagcagcugggacuacaggcgugcgccaccaugccuggcuaauuuuugua

SEQ ID NO: 197217 - RNA, 64 nt, Human
cuuuacuaaacaaaucccauggauucugauuucugggucuuaggauuuuaaaagugaagggaua

SEQ ID NO: 197218 - RNA, 64 nt, Human
uccuauugccagcauaaggaugaggagggggaaagggucuuaauucuauguacagcagagacau

SEQ ID NO: 197219 - RNA, 64 nt, Human
cuuguuuuuugcuugggagggugggggugggggagggucuuauuuuaucuuaucuuuucugugg

SEQ ID NO: 197220 - RNA, 64 nt, Human
cuuuuauauauauuuauauauauauauaaaaauugggucuuagauuuugauuuacuagugugac

SEQ ID NO: 197221 - RNA, 64 nt, Human
gcauagaccauaccagaccuaauuugcaaguauugggucuuaaacuucaagugcaauguauaug

SEQ ID NO: 197222 - RNA, 64 nt, Human
cagaggauugaacaacugcagagagaaaggcggcgggucuuagaagaaaaucauguggagcacc

SEQ ID NO: 197223 - RNA, 64 nt, Human
auccuggagugauaugauccagagcagaguuuacgggucuuaggaugucuguaauaaauaaaua

SEQ ID NO: 197224 - RNA, 63 nt, Human
aucaguugccagagucauaauauuuucuuaugugggucuuaugcuuccauuaacaaaugcucu

SEQ ID NO: 197225 - RNA, 64 nt, Human
uaaauaauuccuguuguauaugucuauucacauugggucuuacagaaccaucuggcuucauucu

SEQ ID NO: 197226 - RNA, 64 nt, Human
auugccauuuuucgggugaaacgccacaccuccagggucuuaagagucaggcuccggcuguagu

SEQ ID NO: 197227 - RNA, 64 nt, Human
cacaucaacaguauuuaucauguguuaaagucaugggucuuaugugcagauuuuuuuaaugccu

SEQ ID NO: 197228 - RNA, 64 nt, Human
cuggagugcugcccucuggggacaugcggagugggggucuuaucccugugcugagcccugaggg

SEQ ID NO: 197229 - RNA, 64 nt, Human
cuucugaggccaugggcuucguuggcuaaguugggggucuuagccuugcaugcguugugggcau

SEQ ID NO: 197230 - RNA, 64 nt, Human
gaaauucagagcaaguuccugagugcguggaucugggucuuaguucugguugauucacucaaga

SEQ ID NO: 197231 - RNA, 64 nt, Human
acuguaucuaaugggcaagucaguggcuccagaggggucuuaggccaaagcccaaacucucuuu

SEQ ID NO: 197232 - RNA, 64 nt, Human
uugcaacuuuuaaaaaaccgaguguggaaacauugggucuuaauucaacacaggaucgguaaaa

SEQ ID NO: 197233 - RNA, 64 nt, Human
gagagugcguggcaauccuuacucccagccgacugugcgccaagaugcuucuaaacccaucacc

SEQ ID NO: 197234 - RNA, 64 nt, Human
caaaguguuggcaacguagggaugguggaccacagaaggcuauaaaggccaccauagaaagcug

SEQ ID NO: 197235 - RNA, 64 nt, Human
uucuuagcaugagagugcuucaucagucuuugaggaaggcuauucgguaccagcaagagacaca

SEQ ID NO: 197236 - RNA, 64 nt, Human
uacgccaugucaccgagccccauugauucccagagggucuuaguccuggaaagucaggccaaca

SEQ ID NO: 197237 - RNA, 64 nt, Human
gguaagucuuucuaaaaaccauuuaaagcuaacugggucuuagcauccuccuguguauggaaga

SEQ ID NO: 197238 - RNA, 64 nt, Human
uugugggucucuccugcagagggugggggucucagggucuuaggugauacgggagagaaagaac

SEQ ID NO: 197239 - RNA, 64 nt, Human
caucuuugaggguccugggccaccaggaggggcagggucuuauagcuggggacuuggcuuccgc

SEQ ID NO: 197240 - RNA, 64 nt, Human
uuuuuuuuuuuuuugguggggggagcgggggacagggucuuacucugucacucaggccagagua

SEQ ID NO: 197241 - RNA, 64 nt, Human
aggccaaucaguccccauuuguagcauggcaccagggucuuaggccuaguccucucauuccucc

SEQ ID NO: 197242 - RNA, 64 nt, Human
uggucagccuaggugagacucaccuguccuucuggggucuuacuccuccucaaggagucuguag

SEQ ID NO: 197243 - RNA, 64 nt, Human
cacucccuguaucuugcacuaaauuuuucuaacagggucuuagugguuaaugaucagaagaugu

SEQ ID NO: 197244 - RNA, 64 nt, Human
cuccaugucugguaaugccaacccaagucgacaugggucuuaggacacugaccaccucacaugc

SEQ ID NO: 197245 - RNA, 64 nt, Human
gaaaauaggaaaaaugauuguuaaugcugacugugggucuuaaaagguucuggaaagcaguaag

SEQ ID NO: 197246 - RNA, 64 nt, Human
cguguugaggagaugaggugcagacuccacacuggggucuuagaggcaccagugggaaagcagg

SEQ ID NO: 197247 - RNA, 64 nt, Human
cagauuccuuguaucacuugcucgcuacuuucuagggucuuaauaguagucaagaaaagggauc

SEQ ID NO: 197248 - RNA, 64 nt, Human
ugucucucuccagaccaucacugcacuuuaaccagggucuuagguacaaaauccuacuuuucag

SEQ ID NO: 197249 - RNA, 64 nt, Human
uccgcgaaguauuaugcacuguguggcuuugguggggucuuaaguuguggucugacacacacug

SEQ ID NO: 197250 - RNA, 64 nt, Human
auaaaguuugguguuuuuacagaggagaagcaaugggucuuagcucuuucucuauuauguuauc

SEQ ID NO: 197251 - RNA, 64 nt, Human
caauggcuuucuacaccaacucuaauccauaaacgggucuuaugacaucuaugaaguaguagca

SEQ ID NO: 197252 - RNA, 64 nt, Human
ggggcugcagagcuggagggugggcgugguacgugugcgccaggacucgggcgcugagggccac

SEQ ID NO: 197253 - RNA, 64 nt, Human
cagugcuucgugaaugaguuucuuagcuuuuauagugcgccauguuucucaaaguuuguuuuug

SEQ ID NO: 197254 - RNA, 64 nt, Human
ugccuuagccuccugaguagcugggauuacaggcgugcgccacuaugccugacuaauuuuguag

SEQ ID NO: 197255 - RNA, 64 nt, Human
aagugccaaaacauauagaaauguuugaaugcaugggucuuaucuaacuuaucucuucuggacc

SEQ ID NO: 197256 - RNA, 64 nt, Human
uguuuuuccgugguauaugugagauugaugcuacgggucuuacggacucacacccguucccacu

SEQ ID NO: 197257 - RNA, 64 nt, Human
caaagggcagaauaaauaagcaaaaugccaaaaggggucuuaauugaaaugaaaauuuaauuuu

SEQ ID NO: 197258 - RNA, 64 nt, Human
gagaugaauucugaguuaaauuuguacuuauuaggggucuuacagagggagaaucuggccuuga

SEQ ID NO: 197259 - RNA, 64 nt, Human
cucugucgugguagcagauggucccauuauucuagggucuuacucuuuguaugaugaaaagaau

SEQ ID NO: 197260 - RNA, 64 nt, Human
ugugccaucacaccuggcuuuacauuuuucuguggggucuuacuauauugcccaagccggucuc

SEQ ID NO: 197261 - RNA, 64 nt, Human
gaccuagaucacagcuacuuuucuugucccuguggggucuuacagaugugucucugaguaguaa

SEQ ID NO: 197262 - RNA, 64 nt, Human
uuggcagggggucagcugaagaccucacuggagugggucuuaauuuuuaaaaagugucucacua

SEQ ID NO: 197263 - RNA, 64 nt, Human
uauagccuuuagcuugugaguuuggaaguuuggggggucuuauguuuguuuugccucuucuguu

SEQ ID NO: 197264 - RNA, 64 nt, Human
guccauccacgucuggagucuggggagaggagcagggucuuaggacucucagcucugagcaucc

SEQ ID NO: 197265 - RNA, 64 nt, Human
cuuugggagagacagcccacaccugugggaccgcgggucuuagucacggcggcaggggcuuucu

SEQ ID NO: 197266 - RNA, 64 nt, Human
guggagggaagcugcugacugugauuaggugcuggggucuuagcguccagcgcagcccgggggc

SEQ ID NO: 197267 - RNA, 64 nt, Human
cagaauuucuuuuuuuuaaaaaaaaacagagauggggucuuacuauguugcccaggcugguguc

SEQ ID NO: 197268 - RNA, 64 nt, Human
uggcacgaauccagaucuggauccuacaucuguugggucuuaggccuccuucccuccucagugu

SEQ ID NO: 197269 - RNA, 64 nt, Human
uuggagggguaaggaacacagggugauaggggaggggucuuaguuccuuuuucuguaucagaag

SEQ ID NO: 197270 - RNA, 64 nt, Human
agccaccuucugccagaacugcaggccugcggcugggucuuaggcucccgcugccauuugggua

SEQ ID NO: 197271 - RNA, 64 nt, Human
cucagaugucugcacugagccaguucagucacuagugcgccagccaggccaggagggagugcag

SEQ ID NO: 197272 - RNA, 64 nt, Human
ccagggaggcugggagagcagcaagggggaccaggugcgccaucaggaggagagaagcuaaacc

SEQ ID NO: 197273 - RNA, 64 nt, Human
guccgucccggcauccauggcagcccgcgguuaggugcgccaggguuugcugauguugucuugu

SEQ ID NO: 197274 - RNA, 64 nt, Human
agauucuuuaauauuagcacagaauaauaucuuugggucuuacuauuuuuacccauaaaaguga

SEQ ID NO: 197275 - RNA, 64 nt, Human
aggggaaccaguagguugaggacaggagagggaagggucuuaacacuuacacccuuuuguacau

SEQ ID NO: 197276 - RNA, 64 nt, Human
auggccccuccuugcaaccaggcagcugagaccagggucuuaccucucugggaccuagggggac

SEQ ID NO: 197277 - RNA, 64 nt, Human
ggaacacaagccuaggugaggcccagucuuucuugggucuuauuauuugugaaggucucucugc

SEQ ID NO: 197278 - RNA, 64 nt, Human
gugcuggcugacucaacugugcgucccagguucagggucuuacagagcuccacccccugggguc

SEQ ID NO: 197279 - RNA, 64 nt, Human
ccagguucagggucuuacagagcuccacccccuggggucuuaccucacugggaauguguuuuga

SEQ ID NO: 197280 - RNA, 64 nt, Human
gucgucagggaagcccgugaucgcucguuuucaggggucuuaccggucagcaaccuuggcauug

SEQ ID NO: 197281 - RNA, 64 nt, Human
ccaaaagaugcagaaaagguagacuggggccacugggucuuaagaggagcugugaaguugugug

SEQ ID NO: 197282 - RNA, 62 nt, Human
aauuucuacacaauaaaugcaguuuaugucuuuugggucuuaauagucucaaaaauauuuca

SEQ ID NO: 197283 - RNA, 64 nt, Human
auuuuuauauuuauauuuuuauuuuuuugagauagggucuuacucugucacccaggcuggagug

SEQ ID NO: 197284 - RNA, 64 nt, Human
cuuauggcugggucugguuucuucccuucccagagggucuuacuguuccaggguggccccaggg

SEQ ID NO: 197285 - RNA, 64 nt, Human
uggcuaauuuuuuaaauuuuuuuuuauagagacagggucuuaccauuugccccagcuggucuca

SEQ ID NO: 197286 - RNA, 50 nt, Human
ugauacauaaucuacaauaagggucuuagugcuuuagaaaaaaguuaaaa

SEQ ID NO: 197287 - RNA, 64 nt, Human
ucuaggagagggagagcuggaaaaggagcugauggggucuuauccuggccucugaggguucagc

SEQ ID NO: 197288 - RNA, 64 nt, Human
uguuuauuuuaacauuuuauuaaacuuucuauuugggucuuaacccaugguucucagcuggggu

SEQ ID NO: 197289 - RNA, 64 nt, Human
uggcuagugugucuaguucacgaagcaauuaacugggucuuacuaucauuguagugugauuucu

SEQ ID NO: 197290 - RNA, 64 nt, Human
ggaagagaauagacucuauuuucucugauucggugugcgccaagaagaaaaggugaaaauggaa

SEQ ID NO: 197291 - RNA, 64 nt, Human
gucaacgagagccuucgcugacuccaccgaagaggugcgccacugggagccaccccagcgccag

SEQ ID NO: 197292 - RNA, 64 nt, Human
gcaugcugcagguguccugcccuuccgcccacgagugcgccauguuucagcggagcggcgugug

SEQ ID NO: 197293 - RNA, 64 nt, Human
auauauuugaugucuguaauaaaagugggaaggugggucuuaaaacagaccaaaccccgccccg

SEQ ID NO: 197294 - RNA, 64 nt, Human
guucucuguucgauuuuucauccccuaugaaccugggucuuauucuguccuucugaugccucca

SEQ ID NO: 197295 - RNA, 64 nt, Human
uucucuuguguauauacuuaggaguggaaucgcugggucuuagagcauguguguauucagucag

SEQ ID NO: 197296 - RNA, 64 nt, Human
agcccugggacauaggaagcugggagcaaggaaagggucuuagucacugccucccgaaguugcu

SEQ ID NO: 197297 - RNA, 64 nt, Human
ccuccaguguauaggaugggauccucucuggggagggucuuaagacccacaauuagaaaggcaa

SEQ ID NO: 197298 - RNA, 64 nt, Human
uuuaauaguuaugcuuuuauuuguuuuucagacagggucuuacucugucacccaggcuggagug

SEQ ID NO: 197299 - RNA, 64 nt, Human
cccauggggagaaauuggccaauuuaauucagaggggucuuaaagcagggcugggccggagggu

SEQ ID NO: 197300 - RNA, 64 nt, Human
cagcugaaggcucacccuagaaaccgggccuggugggucuuacccggcucacucccucccuugu

SEQ ID NO: 197301 - RNA, 64 nt, Human
ucuucuuacauuuuccuuugccuuuauacuuuaggggucuuacuccauuaauucauuuguuaca

SEQ ID NO: 197302 - RNA, 64 nt, Human
uuccuuggguguggagcacuccccauuucuucucgggucuuaaaguguguggacauuuucaucc

SEQ ID NO: 197303 - RNA, 64 nt, Human
gggcuuccuggagaaggggacguccauuccugcugggucuuaacaagcauaaaaaggaaaaaaa

SEQ ID NO: 197304 - RNA, 64 nt, Human
uuaagcuuugugaaagaaugugcuuugauucgaagggucuuaaagaauuuuuuuaaucgucaac

SEQ ID NO: 197305 - RNA, 64 nt, Human
uauggccucagcugggggaaagacccuggccuaggggucuuagccacuccccacccuaggguau

SEQ ID NO: 197306 - RNA, 64 nt, Human
cccagccccguuugcugcguuguguaagggcuuggggucuuagaagcugcucuuuagcccagau

SEQ ID NO: 197307 - RNA, 64 nt, Human
ugaaaacaaggagaccuggggugggugugguugggggucuuaaaacuaauaaaagcuggggucg

SEQ ID NO: 197308 - RNA, 64 nt, Human
auaguuucccaguuuuuugacacuaaugcuguuugggucuuaccugacacacaccagugugcaa

SEQ ID NO: 197309 - RNA, 64 nt, Human
ugccucagccuucggaguggcugggauuacaggugugcgccaccaugcccggcuaauuuuugua

SEQ ID NO: 197310 - RNA, 64 nt, Human
ccacguggaggagcugggggucgccggaaacaucgugcgccacaucccggaccgcggugagugg

SEQ ID NO: 197311 - RNA, 64 nt, Human
aguccagagaggaaacuguggaauggaaaaagcagaaggcuaggaauuuuagcaguccugguuu

SEQ ID NO: 197312 - RNA, 64 nt, Human
ggagaguguguagggucucccaacgucgugggccgggucuuaggccuucgcccgugggaagguc

SEQ ID NO: 197313 - RNA, 64 nt, Human
ccaccuuuccuggggucuccacauucccacuagugggucuuaugugugucugugucuucuccuu

SEQ ID NO: 197314 - RNA, 64 nt, Human
agguagcucuuguggaggacuugggagaaggauggggucuuaggaaggaggugacagcacuugc

SEQ ID NO: 197315 - RNA, 64 nt, Human
cagucgucguguuacuugugcacaaacagaagcugggucuuacccgcagcacgagugucucggg

SEQ ID NO: 197316 - RNA, 64 nt, Human
cagggcagcggucuucuccaucuccgcuguuuuggggucuuaggguacagcccaggcggucacu

SEQ ID NO: 197317 - RNA, 64 nt, Human
acaggguauuucugaagcccuugggaucuaccuugggucuuacuugaguuccauauuuuucaca

SEQ ID NO: 197318 - RNA, 64 nt, Human
cucugagagauuuggggcuaaagacugaucucaggggucuuaccuugaacugaaggccacuuga

SEQ ID NO: 197319 - RNA, 64 nt, Human
accuucauuguacauccuuuucuuuucuccccuugggucuuauuauaaaagaagacaauguacg

SEQ ID NO: 197320 - RNA, 64 nt, Human
acugauguaaaaaucaugcuggcauccaugaacacaccgguaaauaaaacauaguccaagugga

SEQ ID NO: 197321 - RNA, 64 nt, Human
aaguucguuuacaccuggcagcacggcagccacacaccgguauuccaaaccuuaacaaugaagg

SEQ ID NO: 197322 - RNA, 64 nt, Human
uagagaacuugagcuuacuuacguacuucaaugccaccgguaacuuagguuuuaccaccaaaug

SEQ ID NO: 197323 - RNA, 64 nt, Human
uaaaauacaaaaauuauccgggcaugggggcacacaccgguaaucccagcuacucaggaggcug

SEQ ID NO: 197324 - RNA, 64 nt, Human
auccccucucaccacagccaggagaggccuuucccaccgguagagaaacuuccagaccagcccc

SEQ ID NO: 197325 - RNA, 64 nt, Human
agagaucuccacaacuccuuggcuuaaacagcuccaccgguaaaaaaaaaaaaaaaaaaaaaaa

SEQ ID NO: 197326 - RNA, 64 nt, Human
uucgcggagagagggcauaaguuguacugagggugugcgccaacuuaaaccaaaggcucuuuuc

SEQ ID NO: 197327 - RNA, 64 nt, Human
cggcccauugacguggcgccucaccccugcugaagugcgccaggugcuggcccugcggauagac

SEQ ID NO: 197328 - RNA, 64 nt, Human
augaagggccaccagccaagggcccuggccacgugugcgccaccuuacuuuggaagucucuggc

SEQ ID NO: 197329 - RNA, 64 nt, Human
caugccugagugccugcagcccaggaggcccgcacaccgguacacucguggacaccuacacacu

SEQ ID NO: 197330 - RNA, 64 nt, Human
gauaacgagacuuugggucggaugcaggggcucacaccgguaaucccagcacuuugagaggcug

SEQ ID NO: 197331 - RNA, 64 nt, Human
aaguaaaugcauuaaggccaagugcaguggcucacaccgguaaucccagcacuuugggaggccg

SEQ ID NO: 197332 - RNA, 64 nt, Human
uacccugggcucuggucuguagguuuguaguagccaccgguaauaagccaagggcuaggcucuu

SEQ ID NO: 197333 - RNA, 64 nt, Human
agugccucgcuccauuggcaccaacgcccagcuccaccgguacuggcucccugcuccaucggca

SEQ ID NO: 197334 - RNA, 64 nt, Human
gccugguacuacaugugaagcacccaucaugccacaccgguacccuccucccgacugaccacug

SEQ ID NO: 197335 - RNA, 64 nt, Human
cagguaauucugcugcacacucaaguucaggaaccaccgguauagaccauuaccuuaguggauu

SEQ ID NO: 197336 - RNA, 64 nt, Human
aacuugugccucccaucccuggaguacugacuggcaccgguaagacagaaucucuuugaaucca

SEQ ID NO: 197337 - RNA, 64 nt, Human
cccaucuuccuuugcccccaggaaaggacgcauccaccgguagcggccccagcugacugucgcc

SEQ ID NO: 197338 - RNA, 64 nt, Human
uucuaucuuggagauaaaaucuguaugugcaauucaccgguauuaccaguuuauuauguaaaca

SEQ ID NO: 197339 - RNA, 64 nt, Human
ugacuauacagaaccaggccuggcguugcuuccgcaccgguagcaguuguggaugucagugugc

SEQ ID NO: 197340 - RNA, 64 nt, Human
agacaacaacuaccugcccuaccccauccaccaagugcgccacauggccuuccagcugugccag

SEQ ID NO: 197341 - RNA, 64 nt, Human
caccucagucuccugaguagcugagacuacagcugugcgccaccacaucuggcuaauuuuauuu

SEQ ID NO: 197342 - RNA, 64 nt, Human
accaguggagcugccuucccagggagaaggagccgugcgccagggcagggcccgugccuuagac

SEQ ID NO: 197343 - RNA, 64 nt, Human
cagccaucaggugggggauuagagccugguguaagugcgccagacucuuccgguuuccaaaguu

SEQ ID NO: 197344 - RNA, 64 nt, Human
ugccucagcuucccgaguagcugggauuacaggcgugcgccaacaugucuggcuaauuuuugua

SEQ ID NO: 197345 - RNA, 64 nt, Human
uacccuggccucccaaguagcuggaauuacaggugugcgccaucacaacuagcugguggucagu

SEQ ID NO: 197346 - RNA, 64 nt, Human
ugccucagccucccaaguagcugggauuauaggugugcgccaccacaccagcuaauuuuuguau

SEQ ID NO: 197347 - RNA, 64 nt, Human
caguggugcuccugcaggcugcccguuaagaugguggcggcacacgcucccucccgcagcacca

SEQ ID NO: 197348 - RNA, 64 nt, Human
cacccgccucuuccccuuucugucccgggauaccuggcggcaagagacuucuuggcuauugucc

SEQ ID NO: 197349 - RNA, 64 nt, Human
cuuugucauguguacauuuuuaaucuguuauaguuggcggcaguauuaaaauggugaguaaaga

SEQ ID NO: 197350 - RNA, 64 nt, Human
caucucuacuaaaaaugcaaaaauuagccgggcguggcggcacaugccuguaaucccagcuaca

SEQ ID NO: 197351 - RNA, 64 nt, Human
guucaaccgucuaaacaguguugugcagucgcaguggcggcagcagcggcagccguccgucacu

SEQ ID NO: 197352 - RNA, 64 nt, Human
ugcccauguggcauuguggcacuguugccccccauggcggcaugggcaagaugaccuuccauua

SEQ ID NO: 197353 - RNA, 64 nt, Human
ggaugcggaaggauugcaaugcccgccagcacaguggcggcaacauugaagacguggacggagg

SEQ ID NO: 197354 - RNA, 64 nt, Human
uuggcucacaguucugcaggcuguaugggaagcauggcggcaucugcuucuggggacaccucag

SEQ ID NO: 197355 - RNA, 64 nt, Human
cagcacacggugccucaaccaacuggacaagggauggcggcagaccaggggccaggccaaagca

SEQ ID NO: 197356 - RNA, 64 nt, Human
cuucggguuuugggaaaagaaucagucugacaacuggcggcacaagaaugggcagacugaagac

SEQ ID NO: 197357 - RNA, 64 nt, Human
uuggcgcuccccuccucucccgcucuggcuucuguggcggcagugguggguaagcacuccagug

SEQ ID NO: 197358 - RNA, 64 nt, Human
acccaucuauacaaaaaauuuuuaaaaauuagcauggcggcacacaucuguaauccuagcuacu

SEQ ID NO: 197359 - RNA, 64 nt, Human
gcgcaacagccacaccaggagaacaggcuguccuuggcggcaguaggagcaggcgccagguuuc

SEQ ID NO: 197360 - RNA, 64 nt, Human
gugaaugaaucagucccagggaagcauuuggugguggcggcaguggaggauugcccggugaacc

SEQ ID NO: 197361 - RNA, 64 nt, Human
accuguugaggaagggcuggcucacuguccaccguggcggcaucuuuaacuggccuccacucaa

SEQ ID NO: 197362 - RNA, 64 nt, Human
uauauccacccccagcccaaccgagggcggcccuuggcggcaacaugcaagaaggagggacugu

SEQ ID NO: 197363 - RNA, 64 nt, Human
ugaaauccauguuaaugaugcuuaagaaacucuugaaggcuauuuguguuguuuuuccacaaug

SEQ ID NO: 197364 - RNA, 64 nt, Human
aaguucagcagaugaaagcccaggccagggaggagaaggcuagaaagcaggugagcacaaccuu

SEQ ID NO: 197365 - RNA, 64 nt, Human
aacaccaggucucuagcaccgcuggaugaaaggagaaggcuagaggcugagggaggaaagagca

SEQ ID NO: 197366 - RNA, 64 nt, Human
ggggaagaauccuuccuuggcucuuuuuagcuuguggcggcagugggcaguccguggcauuccc

SEQ ID NO: 197367 - RNA, 64 nt, Human
gaggaggagggaggcgcugcugguguucuuauucuggcggcagcgccuuuccugccauguuuag

SEQ ID NO: 197368 - RNA, 64 nt, Human
auuaaggacaauuuuuuuuuuuaacuaaaaaaguuggcggcaggggugggggguggcaaucauu

SEQ ID NO: 197369 - RNA, 64 nt, Human
gccggcguuggcuccgaagacuuagcgacgccacuggcggcaccuucuccugcgcccagugaug

SEQ ID NO: 197370 - RNA, 64 nt, Human
aaucgaguuuggaggaagaguugaguuguaugaguggcggcauguugguagugccggacuuccu

SEQ ID NO: 197371 - RNA, 64 nt, Human
uugucuacuaaaaauacaaaaaauuagcugggcauggcggcaugcgccuguagucccagcuacu

SEQ ID NO: 197372 - RNA, 64 nt, Human
agugaauuguuggagaauguaaaccgccuccacguggcggcagacuuccuaaggccccagcucg

SEQ ID NO: 197373 - RNA, 64 nt, Human
gccucuagagggcuggugauugaggggcccgggcuggcggcaaagagggguuuggucucggggc

SEQ ID NO: 197374 - RNA, 64 nt, Human
ucagggacagccugggcccaggcacccagggggauggcggcagcuuccugcaccuuucagauuu

SEQ ID NO: 197375 - RNA, 64 nt, Human
ucucaggcccagcagcccauugacagcauuagacuggcggcauggugcuuuucugagcagauca

SEQ ID NO: 197376 - RNA, 64 nt, Human
gcgaggaggcgcggccucccgaggaggggcccgguggcggcagggccaggcugguccgagcuga

SEQ ID NO: 197377 - RNA, 64 nt, Human
aaaugugauagaagucugggggggaguugggggauggcggcagauguuagccaggucugcccuc

SEQ ID NO: 197378 - RNA, 64 nt, Human
gcccuccccgggagccucagaguuugcuucuggcuggcggcaagggaaagggacgauggagaag

SEQ ID NO: 197379 - RNA, 64 nt, Human
uggugggaaggaggccaggacggaggagaugaaguggcggcagugggcggacgacuggcuggug

SEQ ID NO: 197380 - RNA, 64 nt, Human
gaaucauggugggaggcaaaaagcacuucuuacauggcggcagcaagagaaaaugagaaagaag

SEQ ID NO: 197381 - RNA, 64 nt, Human
cuuugauaccuggggucgucgagaggcugcgggcuggcggcagucccaggggagagacaccaca

SEQ ID NO: 197382 - RNA, 64 nt, Human; identical to SEQ ID NO: 189042

SEQ ID NO: 197383 - RNA, 64 nt, Human; identical to SEQ ID NO: 189043

SEQ ID NO: 197384 - RNA, 64 nt, Human; identical to SEQ ID NO: 189044

SEQ ID NO: 197385 - RNA, 64 nt, Human
auggccugggagcuuggaagggaggggugguggguggcggcaucuugacugcccccuguugucc

SEQ ID NO: 197386 - RNA, 64 nt, Human
agcucuccuaacccaaggcggagaaugaaggugguggcggcagaggaggagggcagcagcugag

SEQ ID NO: 197387 - RNA, 64 nt, Human
cagccacgaggugggugggagcuggcagucuugguggcggcaggggccgcgggcccugaccacc

SEQ ID NO: 197388 - RNA, 64 nt, Human
uuauacagguuuauuaauagcaagugcaacuaacuggcggcaugccuugcaacacauuuugaua

SEQ ID NO: 197389 - RNA, 64 nt, Human
uagccuggaugugggccaaguccacuguccuccuuggcggcaaaagcccauugaagaagaacca

SEQ ID NO: 197390 - RNA, 55 nt, Human
ugggaagcucuggaagcugagacacuggcggcaggcaccuagcuaugugaccacu

SEQ ID NO: 197391 - RNA, 64 nt, Human
ccucugggcagccagucaucaaagcagagagacguggcggcaugugggcagcaugcccagguuc

SEQ ID NO: 197392 - RNA, 64 nt, Human
gaagcgucaggugaccgaguucagcuccguaagguggcggcaccugaggaggaagcagccagga

SEQ ID NO: 197393 - RNA, 64 nt, Human
gugggcaggcaaccccgacgagagcuuaucccuguggcggcaucaggaguggcuguacauugaa

SEQ ID NO: 197394 - RNA, 64 nt, Human
aagagaagugcaagaauugguugcuggugcuacauggcggcagcuuugacauuuucucuggguu

SEQ ID NO: 197395 - RNA, 64 nt, Human
gacgggccacacguggcuggcggccucguuccaguggcggcacguccuugggcgucucuaaugu

SEQ ID NO: 197396 - RNA, 64 nt, Human
gucugcccgucacuuuggaucauagcccugggccuggcggcacagcagcacuugcguucucggg

SEQ ID NO: 197397 - RNA, 64 nt, Human
auccagggccacuuucccucagugggggugagccuggcggcaggcccgaagguguggaccccuc

SEQ ID NO: 197398 - RNA, 64 nt, Human
gcugugcagaugcccugacagagucgguuuccuuuggcggcauucccuuucccucauucagcac

SEQ ID NO: 197399 - RNA, 64 nt, Human
gcguggcacugggacguaaguggcgcagucugaauggcggcacgcugaaggaaacgugcgaagc

SEQ ID NO: 197400 - RNA, 64 nt, Human
uggcccugugucgucagaggcuugugauuaacuguggcggcagacacagcuuguccacagcuug

SEQ ID NO: 197401 - RNA, 63 nt, Human
ucgacagcaguguuuucucuccuuuucugggccuccucgcaaaugcccaggcccugcauuuuc

SEQ ID NO: 197402 - RNA, 64 nt, Human
gggaaggccguguuucagcccugaugggccaagggaaggcuaucagagacccuggugcugccac

SEQ ID NO: 197403 - RNA, 64 nt, Human
ugaucuguaagaaguacaaugccaucugucugccgaaggcuagcaugguuuuagguuuaucuuc

SEQ ID NO: 197404 - RNA, 64 nt, Human
acccuccacccugucccccagcucuggugagucuuggcggcagcagccaucauaggaagggacc

SEQ ID NO: 197405 - RNA, 64 nt, Human
aagggcugccguuuggucccucuuccgugaggacuggcggcaccagcaccuucgcuuugcaucu

SEQ ID NO: 197406 - RNA, 64 nt, Human
uaccugaacauuggcgccugccuucuggccacgcuggcggcagccaugcucaucuggaacauuc

SEQ ID NO: 197407 - RNA, 64 nt, Human
ggugggcaucuguuaacagaggagaacgucuggguggcggcagcagcuuugcucugagugccua

SEQ ID NO: 197408 - RNA, 64 nt, Human
ccuggggcagaagaggcgucgagggcgccagaaguggcggcagcagcagccgcagcagccaaag

SEQ ID NO: 197409 - RNA, 64 nt, Human
ggcauucucggaggaguagacguuuaauacgaaguggcggcauagcccugccgagaugucggug

SEQ ID NO: 197410 - RNA, 64 nt, Human
caccucgugcucacggauuuuauuacacagauaguggcggcaauggccucagcccagcccaccc

SEQ ID NO: 197411 - RNA, 64 nt, Human
cuccacaguggggggacgggcgcaguauguggcauggcggcaguuacauauuauuauuuuaaaa

SEQ ID NO: 197412 - RNA, 64 nt, Human
ccuuccugcuccccaguccuggcagugccguggauggcggcaggaagucucacaucauagagga

SEQ ID NO: 197413 - RNA, 64 nt, Human
agaccccacuucaggcacuaagaggggcuggaccuggcggcaggaagccaaagagacugggccu

SEQ ID NO: 197414 - RNA, 64 nt, Human
gccgccuccuuuugcuacucaaaacagcaaugcuuggcggcagccuuccaugaggcagaagggg

SEQ ID NO: 197415 - RNA, 64 nt, Human
uuucuccgagagacuuuccauuuccuuggaguuauggcggcaaguaaguaucauaguauuaaga

SEQ ID NO: 197416 - RNA, 64 nt, Human
ccacucggaguuaggggcaugggcaauagcaagcuggcggcagaguccagcccagcauaugacu

SEQ ID NO: 197417 - RNA, 64 nt, Human
acaaaacaacaaaaggaacagauccuugaccgcauggcggcagcccaccuugguaagggcccca

SEQ ID NO: 197418 - RNA, 64 nt, Human
cauccucaagugaccccgcacggcgagacgcggguggcggcagggcgucccagggugcggcacc

SEQ ID NO: 197419 - RNA, 64 nt, Human
gggccuggaggggcagggcuggggcaacccggcuuggcggcaaagcccagccccuucucagacc

SEQ ID NO: 197420 - RNA, 64 nt, Human
cuugagacuccugauguacacugugauauugaccgaaggcuacauacagaucugugaaucuugg

SEQ ID NO: 197421 - RNA, 64 nt, Human
gucccuuucccuugcgugaaggacacgccccacagaaggcuacggggaggacugagaggacagg

SEQ ID NO: 197422 - RNA, 64 nt, Human
gugagucguguacauaaggagggaacaugguacagaaggcuagaaggaauuauaggucuuauuc

SEQ ID NO: 197423 - RNA, 64 nt, Human
uuccaaacuugugaacucgugacaaucacaaacuuggcggcaaaguggcgacucaaccuugggg

SEQ ID NO: 197424 - RNA, 64 nt, Human
cugggccugccuguggcucuguugcccuccucuguggcggcaggaccuuuguggggcuucgugc

SEQ ID NO: 197425 - RNA, 64 nt, Human
gaggacacagagacacacagagaagaaagccauguggcggcagaggcagagaugggagugaugc

SEQ ID NO: 197426 - RNA, 64 nt, Human
ucuggggccagccccuccccgccuccucccugccuggcggcaggggucgcgaugaugggcugga

SEQ ID NO: 197427 - RNA, 64 nt, Human
uuuucuaaccaauugcacaacuccguucucgggguggcggcaggcaggggaggcuuggacgccg

SEQ ID NO: 197428 - RNA, 64 nt, Human
ugucucuacuaaaaauacaaaaauuagcugggcguggcggcacgugccuguagucucagcuacu

SEQ ID NO: 197429 - RNA, 64 nt, Human
ugugguagcguguucauccaggggccggaugggcuggcggcagcucuggugaauugugacaugu

SEQ ID NO: 197430 - RNA, 64 nt, Human
ccaagcggcgccgcacguagacccucagcccugguggcggcagagaagcgggcgaggcacugug

SEQ ID NO: 197431 - RNA, 64 nt, Human
cuuuucaugucggaggcugcgugugagccggugguggcggcagcugucuguguuucuccuguuc

SEQ ID NO: 197432 - RNA, 64 nt, Human
gcuucucugucucuguggaaaagccaucucagguuggcggcagacacauugucaucagagggga

SEQ ID NO: 197433 - RNA, 64 nt, Human
cgucucuacaaaaaaugcaaaaauuagccagauguggcggcaugucccuguggucccagcuacu

SEQ ID NO: 197434 - RNA, 64 nt, Human
ugugacccccugggggacagcugccagacacagcuggcggcagcaccagaugcuaagcgcuuca

SEQ ID NO: 197435 - RNA, 64 nt, Human
cugagcagaucgugccguggagcuuggagcccccuggcggcagggguuggcagcgccucgcccc

SEQ ID NO: 197436 - RNA, 64 nt, Human
agugaugaggagacugagcguccccagccccaccuggcggcauggacacagaaaagcuacgccg

SEQ ID NO: 197437 - RNA, 64 nt, Human
ugucccaccucauuccccaccucuaccuuucuaauggcggcaugauguguaaacucugugcagg

SEQ ID NO: 197438 - RNA, 64 nt, Human
uucucaaaucauguguaagaguuuggagaugucauggcggcacaaaagagagcuguuuucucua

SEQ ID NO: 197439 - RNA, 64 nt, Human
ucaacuacugcaggaucucaggacuaaggagagagaaggcuaaauagagaggaguuuagaggaa

SEQ ID NO: 197440 - RNA, 64 nt, Human
cccaaagcauacaccgcugagcucaacugccagggaaggcuaaggaaauggggauuugagcaca

SEQ ID NO: 197441 - RNA, 64 nt, Human
uccuuggugugacacuugaacuagucgauuuuuugaaggcuauaaccuaaccucgacuauuugu

SEQ ID NO: 197442 - RNA, 64 nt, Human
ggcugagaugccacccuuugaagggugaacagcauggcggcaucugggccccacaguaacaccu

SEQ ID NO: 197443 - RNA, 64 nt, Human
cuagugacacauccuaaagaugcaaagauccuccuggcggcaguagccuugacaagggccaccu

SEQ ID NO: 197444 - RNA, 64 nt, Human
uguugcaagcucaggccuuuaaggacugcugaugcccccucaggccucccccaaguuugcuggg

SEQ ID NO: 197445 - RNA, 64 nt, Human
auaauggccaucuuuucuuuccuauccuuucuuccccccucacugugaaaaauaacaguccacc

SEQ ID NO: 197446 - RNA, 64 nt, Human
ccgugacagaugccaacuucccacacggcagccccccccucaaggggcagggaggugggggccu

SEQ ID NO: 197447 - RNA, 64 nt, Human
gcugcccccuccccagcccccaguucucuccccacccccucaccccacccggggcucacucagc

SEQ ID NO: 197448 - RNA, 64 nt, Human
aggaauuuuuagaugucaguuuggaggcucuuuccccccucaauugagagcucuuguuauucag

SEQ ID NO: 197449 - RNA, 64 nt, Human
uccugaaacucucaagccucucaucucugcccagcccccucaguggcgcugcuaugcaaggcuu

SEQ ID NO: 197450 - RNA, 64 nt, Human
uguccagcgucuggcugccuguggccuggagggacccccucaagaggagacaaagccuaaguuu

SEQ ID NO: 197451 - RNA, 64 nt, Human
ggaagcgcugagggaacaaaugguuggcaugcagcccccucaggcgccccgagaccucaucuuc

SEQ ID NO: 197452 - RNA, 64 nt, Human
gugacagaaggcaggacguuccaugccgaggcugcccccucacccagaagucugagcccagccu

SEQ ID NO: 197453 - RNA, 64 nt, Human
agauucuucuggugauguuuacuuaaaaagugaucccccucaacaacggauacagcgugcuuau

SEQ ID NO: 197454 - RNA, 64 nt, Human
gaugagcuuuuggggcacaacaucccaccgcagucccccucacccgacaacaccuccuaccugg

SEQ ID NO: 197455 - RNA, 64 nt, Human
uaauuuaaaaauguauuuauuugagugucuuucccccccucacccucaccaucugaggggcucc

SEQ ID NO: 197456 - RNA, 64 nt, Human
agcuaguuucuacagaacauaauuugccucuauagaaggcuauucuuagaucaugucucaaugg

SEQ ID NO: 197457 - RNA, 64 nt, Human
uauacaagaagcucuacuuugauggcagaucuaagaaggcuauaggccuuuguuuguaggaagc

SEQ ID NO: 197458 - RNA, 64 nt, Human
uuuuucuauaaguaaucaguugcuuuuaaaaucagaaggcuauauuauucuaaugacccuauuc

SEQ ID NO: 197459 - RNA, 64 nt, Human
ugguagcauuuuucaccuucauagcauacuccuucccccucaggugauacuaugaccaugagua

SEQ ID NO: 197460 - RNA, 64 nt, Human
aggggaaguuugggauauaccccaaaguccucuacccccucacuuuuauggcccuuucccuaga

SEQ ID NO: 197461 - RNA, 64 nt, Human
uguuccucuauucccuucuuccgaauuaaaaauacccccucagagcgaucuagccucccgaauu

SEQ ID NO: 197462 - RNA, 64 nt, Human
cuggggucuauaugcugggugcugagacacugaucccccucauuugaugagcaaaugagcuacu

SEQ ID NO: 197463 - RNA, 64 nt, Human
caggcucccacgcuuuguccgugaugccccccuacccccucacucuccccgucuccaugguccc

SEQ ID NO: 197464 - RNA, 64 nt, Human
uguaaauaauauaaaauguuucaagcgcuuaacucccccucauucacaaaguauaacaauuaaa

SEQ ID NO: 197465 - RNA, 64 nt, Human
uccuuucuauccuuuuauauuuuucccuuccccacccccucacucaaugguauaaaagcuagga

SEQ ID NO: 197466 - RNA, 64 nt, Human
uaacggcacuugagauaugugcaguggguggucucccccucagucuuacuuugagcugcuguua

SEQ ID NO: 197467 - RNA, 64 nt, Human
cuucaacauggagggcugacuugaagcucccugucccccucacucuugccccaagaaaagaggc

SEQ ID NO: 197468 - RNA, 64 nt, Human
uccguccccugcccaugcugggagcccacgcucacccccucaccccuccaagcucacuccccaa

SEQ ID NO: 197469 - RNA, 64 nt, Human
cccuguccacugccuacacaugacagacaaguaacccccucaugggggauggggaccuaccugg

SEQ ID NO: 197470 - RNA, 64 nt, Human
guuuguccugagauggaaaaguguccuucuugcucccccucaauagaucuccagcgucagcugc

SEQ ID NO: 197471 - RNA, 64 nt, Human
aacaguccuccugaggcccugaggguggcccugacccccucagggcucauuccuggugggcaug

SEQ ID NO: 197472 - RNA, 64 nt, Human
gaaaucauaggguucugaucacauugcacgccuccccccucacuuguccuccugauccugacac

SEQ ID NO: 197473 - RNA, 64 nt, Human
agaccucugagaccaaaauuuugucccaucucuacccccucacaacugcuuacagaauggauca

SEQ ID NO: 197474 - RNA, 64 nt, Human
agauucuuuccuugugaucugaaugucuccuuuucccccucagagggcaaagaggugaacauaa

SEQ ID NO: 197475 - RNA, 64 nt, Human
uucagauggauaugguaaaucuuacccaauuaaggaaggcuaauuuuagaguucuucuaauuug

SEQ ID NO: 197476 - RNA, 64 nt, Human
acugcaauaccauaacagucaaacugauuauagagaaggcuacuaagugacucaugggcgagga

SEQ ID NO: 197477 - RNA, 55 nt, Human; identical to SEQ ID NO: 189045

SEQ ID NO: 197478 - RNA, 64 nt, Human
uccuuugcuuccuccaagacuuacccaacuccuucccccucagagaaccaaauagccugaggaa

SEQ ID NO: 197479 - RNA, 64 nt, Human
cuuauagcacuggaggaggaaaacaaauucuugucccccucagaaugagaguggcucuuucuga

SEQ ID NO: 197480 - RNA, 64 nt, Human
acuauuccauccacacaguuuccacccucaccugcccccucauacggaguuggaugggggccga

SEQ ID NO: 197481 - RNA, 64 nt, Human
cuugcuuguguccccaggcaccaguaguuugagccccccucaaaagacaugaaggggguugggg

SEQ ID NO: 197482 - RNA, 64 nt, Human
gugggaggcugcagccaggauugccucagcuccucccccucaggcugggaggauagcacaggcu

SEQ ID NO: 197483 - RNA, 64 nt, Human
ccccccaccaccucaguggaacacaccauucucccccccucaacagcacacucagugcagcaag

SEQ ID NO: 197484 - RNA, 64 nt, Human
ccaggguugaugcaggucugcaggucuucugcaccccccucaaugaggagucccucccagaaag

SEQ ID NO: 197485 - RNA, 64 nt, Human
cagugucauuucucauccacauacccugaccuggcccccucaguguugucaccagaucugauuu

SEQ ID NO: 197486 - RNA, 64 nt, Human
cuaugauaugguaaaaguuacuuauucuagauuacccccucauuguuuauuaacaaauuauguu

SEQ ID NO: 197487 - RNA, 64 nt, Human
uugguugagggggcuagagggagaaugggaaccacccccucaguccccugcacugacucacucc

SEQ ID NO: 197488 - RNA, 64 nt, Human
agaccuuucucuuucacucucuaguuauuuccuucccccucaccuuuuggccauggggagaauu

SEQ ID NO: 197489 - RNA, 64 nt, Human
gcccuccgagcccacugucacgcugccugguguucccccucagcagcaagcacuucucuuaggg

SEQ ID NO: 197490 - RNA, 64 nt, Human
uccgccuggggcggccucacccuggcuggugcugcccccucaccuugguacugaucagcgcccc

SEQ ID NO: 197491 - RNA, 64 nt, Human
acuggauuucuggaguuguuuaccuuaccccacacccccucaacauguagacuaaugcagccau

SEQ ID NO: 197492 - RNA, 64 nt, Human
gccuacuauccaaugucaguuaauuggugucuuccccccucauuugcucucuucccuaaaaugu

SEQ ID NO: 197493 - RNA, 64 nt, Human
uaaaaauacugcuuuacaaagcauuucagccuuucccccucaguuuugcauugauuuuuugaca

SEQ ID NO: 197494 - RNA, 63 nt, Human
ucucugcggguccauccuccccaccgggguccguccucgcaggcccugcccggccucucugca

SEQ ID NO: 197495 - RNA, 63 nt, Human
acgccaccugugcacaccugcucagagcacggcuccucgcaggggugaaggggcagaccaacg

SEQ ID NO: 197496 - RNA, 64 nt, Human
aguucccuucaccgcauccgucgccugccaaacugaaggcuacugcaggucacugaguugccug

SEQ ID NO: 197497 - RNA, 64 nt, Human
aggcuugaggccuugacuguugugucacccagagcccccucaagccuucugcuccccaauucuc

SEQ ID NO: 197498 - RNA, 64 nt, Human
guucugaguacuugauuucaggucaauaacgguccccccucacuccacacuggcacguuuguga

SEQ ID NO: 197499 - RNA, 64 nt, Human
uguguaagaaugguguuuacaugcaguguguuuucccccucaccuucaauaagguuuuucaaaa

SEQ ID NO: 197500 - RNA, 64 nt, Human
cucuaagaaggcugcuguacugguugaauugugucccccucaaauucacauccuucuuggaauc

SEQ ID NO: 197501 - RNA, 64 nt, Human
caacaguauauaaggcuguaaaaugagaauucugcccccucaccucuuaccccaguacuauucu

SEQ ID NO: 197502 - RNA, 64 nt, Human
ucccccaugcgcugggaggggacccuccauuucucccccucacccaugcugaguguagagccgg

SEQ ID NO: 197503 - RNA, 64 nt, Human
uguccacccugccuccucuguucugaaauuccaucccccucagcuuaggggaaugcaccuuuuu

SEQ ID NO: 197504 - RNA, 64 nt, Human
auccuucauuugagaauaaguuucacuuuaaagacccccucaauauccuccucagauuugcccu

SEQ ID NO: 197505 - RNA, 64 nt, Human
acccuguugguacuguuccagaaaaacuguuacucccccucacccacucccuccuuccccaguu

SEQ ID NO: 197506 - RNA, 64 nt, Human
cagucuaucccugggccccaaacccucaccgguucccccucaccugguguucagacaccccaug

SEQ ID NO: 197507 - RNA, 64 nt, Human
gucccaggaaccgcgcugcgccaccugcacucaccccccucacauucucuuaagcacccggugg

SEQ ID NO: 197508 - RNA, 64 nt, Human
uucaacccucccucuuucugcccauuuccucccacccccucacucccauuuccuagcaaaauca

SEQ ID NO: 197509 - RNA, 64 nt, Human
ugugauaacugagcggucgcauggcagaggacaucccccucagagugggcacaagugcccucua

SEQ ID NO: 197510 - RNA, 64 nt, Human
uagugagacagggcugccacggcaaccgccaagccccccucaaggugggacaguaccccggacc

SEQ ID NO: 197511 - RNA, 64 nt, Human
ggccuggacccucaaccccugcaaccuucccuagcccccucaauagaugagcaggucaggcugu

SEQ ID NO: 197512 - RNA, 64 nt, Human
cccgaugccugugccuguuccaccuggacgguggcccccucagccuggcagccucuggacagag

SEQ ID NO: 197513 - RNA, 64 nt, Human
cugacucauuccugaccucuugucauuuuggccugaaggcuacaaauucagggucagcuguaug

SEQ ID NO: 197514 - RNA, 64 nt, Human
acuuguuacuaagcagauuuaagggucagugggggaaggcuaucaacccauugucagaucagca

SEQ ID NO: 197515 - RNA, 64 nt, Human
uuaaagugcaauuuuaaaacuguaaauuacaucugaaggcuauauauccuuuaaucacauuuua

SEQ ID NO: 197516 - RNA, 64 nt, Human
aguuuuaaaccaucuggcuggaucucguggccuucccccucagacuacccaugucuccacgaag

SEQ ID NO: 197517 - RNA, 64 nt, Human
gaagggguacagguggguucccucaucuggaguucccccucaauaaagcaaggucuggaccugc

SEQ ID NO: 197518 - RNA, 64 nt, Human
ggcauuuuuaauuagauaauccacucauguauuucccccucacugcaguugucugcauuuuuag

SEQ ID NO: 197519 - RNA, 64 nt, Human
aagacuuucuuguagcaaucucguaagcagugaacccccucagaucaguagaauauaguaucug

SEQ ID NO: 197520 - RNA, 64 nt, Human
accuucuguaccaugccuucagaaaccuucuuaucccccucaucucuggggcccccuguggauc

SEQ ID NO: 197521 - RNA, 64 nt, Human
cuacaaaauggcaaacauuuagcuagauugaccacccccucaaaagacucaaauuacuagaauc

SEQ ID NO: 197522 - RNA, 64 nt, Human
ucccugccugugccuagaucagaggcccagagggcccccucaguugccugagcagcugguggcu

SEQ ID NO: 197523 - RNA, 64 nt, Human
gcuccgcuuacaauaguccucccucuguuccugacccccucacacacacuggaaagugagggug

SEQ ID NO: 197524 - RNA, 64 nt, Human
cuugucaggaaugaaggaugcuugcacacaugcacccccucacucucacacuugcacacauaca

SEQ ID NO: 197525 - RNA, 64 nt, Human
ugucccaccccuagccaccaguguccuccaagugcccccucaccucuccaggugcucauuguaa

SEQ ID NO: 197526 - RNA, 64 nt, Human
cggagccucaguccccagcagagccugugucucacccccucacaggacagagcuguaucugcau

SEQ ID NO: 197527 - RNA, 64 nt, Human
aguccgucugugucagcccagcucugccucgcagcccccucagcaugggugcccccagaaguaa

SEQ ID NO: 197528 - RNA, 64 nt, Human
uucugcuucaacuaccaaaauguuaucuccacuucccccucacccguagaggauccuggccaca

SEQ ID NO: 197529 - RNA, 64 nt, Human
ucagcugauuguaguacaccugcuagcucuguugcccccucaaaacugcacccagagcagggcc

SEQ ID NO: 197530 - RNA, 64 nt, Human
cccaaccucccaccccuucaauguggggacgagacccccucaucucagaguaaugggaagaacc

SEQ ID NO: 197531 - RNA, 64 nt, Human
caucagcacagacuacgggaggggcuggcucccucccccucagacccucacuuccuguaccuag

SEQ ID NO: 197532 - RNA, 63 nt, Human
ggguaagacucugcugucuaagcugaagccucuuccucgcagcgagggucuuccuaggaacau

SEQ ID NO: 197533 - RNA, 64 nt, Human
gucccccaaagccagaaucugcucauggaggaaggaaggcuaagaacuguccuugaggaacuuc

SEQ ID NO: 197534 - RNA, 64 nt, Human
acaguaccuaauuucucucuguccccugagaucugaaggcuaccuugggaagaggcaucagcca

SEQ ID NO: 197535 - RNA, 64 nt, Human
aguucuuaaaucagcaguauuaugaaaaaaaauucccccucauuagaauguuuaagaaaucuuu

SEQ ID NO: 197536 - RNA, 64 nt, Human
uucagcagcccacaagauguagcacuauuagugucccccucagaggcuuaauguugccugugga

SEQ ID NO: 197537 - RNA, 64 nt, Human
gccccagacccagccccgguggcugaagaggcugcccccucagcugucgaggagggggccgccg

SEQ ID NO: 197538 - RNA, 64 nt, Human
uggggaggagagagggggagaccccuuugccuuccccccucagcaaggggcugcuucuggggcu

SEQ ID NO: 197539 - RNA, 64 nt, Human
ugccgcccagaggcaugcaggcugcugggcaccacccccucauccagggaacgagugugucuca

SEQ ID NO: 197540 - RNA, 64 nt, Human
ccccgaauggauuccauuaaacugcauuaagaaacccccucauggaucugcauaaccgcacaga

SEQ ID NO: 197541 - RNA, 64 nt, Human
guaagcucucaugguuuacaggaaggcucugguucccccucacaggaugagcaugcucaguugg

SEQ ID NO: 197542 - RNA, 64 nt, Human
uuaaauaacuaucaauauccauuuccauucaucucccccucaaaucauagccuaacagaacacu

SEQ ID NO: 197543 - RNA, 64 nt, Human
uuaacaggcugaggcaacauggaucagugugugucccccucaggaauguauccacaguggccuu

SEQ ID NO: 197544 - RNA, 64 nt, Human
cauauauuuuucuucuuuagucauggagaacucccccccucaucucuucccuauuaucuuuccc

SEQ ID NO: 197545 - RNA, 64 nt, Human
cugcccucuccuucuuucuccuucaagguucuuucccccucaguuuuguuguugucuuacucug

SEQ ID NO: 197546 - RNA, 64 nt, Human
uacagugauggacaaaacagguaaaaaaucgcugcccccucagagcugacauucugggguggga

SEQ ID NO: 197547 - RNA, 64 nt, Human
ccacacacccaagugccccucacaccucgugccucccccucacaggguggccaccugcaccagc

SEQ ID NO: 197548 - RNA, 64 nt, Human
cugggccccucucugucccaccuugcacaaaggacccccucagaccaggcccuugucugugccc

SEQ ID NO: 197549 - RNA, 64 nt, Human
ccuucucacugaccugaccgcccaccaccuccuucccccucaucacaugacaaaggauaaugug

SEQ ID NO: 197550 - RNA, 64 nt, Human
caggaaaguauguaaccagaauugguuagugugacccccucaaguagcaagugauggaaaauaa

SEQ ID NO: 197551 - RNA, 63 nt, Human
gucucugaaguauuccaugccuuuuggacccuuuccucgcaacuaacugucaacuguugauca

SEQ ID NO: 197552 - RNA, 63 nt, Human
ccagcaccgcgguuccgcuuugggagccgaccauccucgcaguugcaugugacagccacagcc

SEQ ID NO: 197553 - RNA, 63 nt, Human
aguugcuucauggcucugugcacucccuuuucuuccucgcagccucccuaagaugacuccagu

SEQ ID NO: 197554 - RNA, 64 nt, Human
cccggagucaguccuaggcuggaugggaggguggcccccucaagaggacucccagccuccacau

SEQ ID NO: 197555 - RNA, 64 nt, Human
accuguaccuauuuacacccagaacuuuccagcucccccucaucaugccuccuccuuccuaccu

SEQ ID NO: 197556 - RNA, 64 nt, Human
cugcaacccugguccccaccccuaaccuccugcucccccucaagccaacuaugcagcccacaag

SEQ ID NO: 197557 - RNA, 64 nt, Human
ggccucugccccucuucccuggccaggggcuucucccccucagcucucccucacaccucccuuc

SEQ ID NO: 197558 - RNA, 64 nt, Human
caaugugucagugccuggggggaggggaggagcacccccucagccccccugaaccugaccaaaa

SEQ ID NO: 197559 - RNA, 64 nt, Human
auauuuuuuuauuguugaaucauuuugugaaugucccccucaaaaaaagcuaauggaauauuug

SEQ ID NO: 197560 - RNA, 64 nt, Human
uuuauuuauacagugccuugcucggcgcccaccacccccucaagccccagcagcccucaacagg

SEQ ID NO: 197561 - RNA, 64 nt, Human
ccaaaagaaucaucaagaaagcuauuuauauaaacccccucagucauuuugaaauaaaauuaau

SEQ ID NO: 197562 - RNA, 64 nt, Human
ggcguucuuuuuacucuaauguucuuuugguuuccccccucagaagaaucaugaauuugcaaca

SEQ ID NO: 197563 - RNA, 64 nt, Human
gcaaacccuggguuuuuaagagcaaauucugucccccccucacucccccaagugacaagauacu

SEQ ID NO: 197564 - RNA, 64 nt, Human
caacagcccaaguggggucaacuccuaagccccacccccucacacacaccgccuucccuguuuu

SEQ ID NO: 197565 - RNA, 64 nt, Human
gaggcucccaccccgccacaucccaacuucauuucccccucacuguagcccauuuccaccccac

SEQ ID NO: 197566 - RNA, 64 nt, Human
agaccaaucccuuccuuugguccuuugguacgcacccccucagagcugagauggaagacauggc

SEQ ID NO: 197567 - RNA, 60 nt, Human; identical to SEQ ID NO: 28416

SEQ ID NO: 197568 - RNA, 64 nt, Human
cagaaauuauggccuaacuuccugagagaccgaacccccucaccugaaucccccucuaucaaac

SEQ ID NO: 197569 - RNA, 64 nt, Human
gcaacaucucauuucuuccuuuugcuguugcuuccccccucacacacuugguuuuguucuaucc

SEQ ID NO: 197570 - RNA, 63 nt, Human
gccugaggaccacucggcuagacuaucucuucauccucgcaaagccagcuccaccgcccucuc

SEQ ID NO: 197571 - RNA, 63 nt, Human
acaucugagaaaugagugcucagguggauuuuauccucgcaagcauguuguuauaagaauugu

SEQ ID NO: 197572 - RNA, 63 nt, Human
agcccuaagacgucccuuuuuucucugaguaucuccucgcaagcuggguaaucgaugggggag

SEQ ID NO: 197573 - RNA, 64 nt, Human
gucuaauauggauucugacucuuaagugcuuccgcccccucacuaccuccuuuaauacaaauuc

SEQ ID NO: 197574 - RNA, 64 nt, Human
cucccuccccaccccacucccagccuuaucuauccccccucacuguccccuuuucuccacuccc

SEQ ID NO: 197575 - RNA, 64 nt, Human
gcacuuucagcaucggcucuucagcagauccaaacccccucagcaacuugcagaggaccugucc

SEQ ID NO: 197576 - RNA, 64 nt, Human
ggugagggccugaggguacauuucuccaccugugcccccucauguucacagaggauuucagcag

SEQ ID NO: 197577 - RNA, 64 nt, Human
uugugugucuggguugcuuauuucccucaucuugcccccucaucucacugcccaguuucuuuuu

SEQ ID NO: 197578 - RNA, 64 nt, Human
cucucccaaacugaccaggcugaugucaaccuaacccccucaggggcagggaacaggggagggc

SEQ ID NO: 197579 - RNA, 64 nt, Human
ggaaggagaaaggaggggagaaagcgggcucucacccccucaggagugggcacgggagcccuuc

SEQ ID NO: 197580 - RNA, 64 nt, Human
uuguuauuguugaggggaagaccacaugguucuucccccucagccaucuuugagcaguaaauug

SEQ ID NO: 197581 - RNA, 64 nt, Human
augcccacaaggcagcugacccugaaagcagccucccccucauggagagucagcagcuugggca

SEQ ID NO: 197582 - RNA, 64 nt, Human
ggccuuggggacgagggagaggacugauucagggcccccucagcugucuccucccucccucugg

SEQ ID NO: 197583 - RNA, 64 nt, Human
cucagacuggagcucccugaagauggggcugugucccccucagacuggggcugccugaggauga

SEQ ID NO: 197584 - RNA, 64 nt, Human
cuuugugcucuguuccuuaucaaaaacagcacaacccccucaaucugcccauuuaaaaauuggu

SEQ ID NO: 197585 - RNA, 64 nt, Human
gacaucacuccagggagcacccgcaggagcugggcccccucacgccugccuuccugggccagcu

SEQ ID NO: 197586 - RNA, 64 nt, Human
guagcuagucagacaugagcagggcaggggagggcccccucaccaggaaugucaggcaaccauc

SEQ ID NO: 197587 - RNA, 64 nt, Human
cauuuucccuuuuccccagcugaugaggagccggcccccucaguucccacuugcuuggguuccu

SEQ ID NO: 197588 - RNA, 64 nt, Human
aucugucccuucacuguuuagagcaugacacucucccccucaacagccuccugagaaggaaagg

SEQ ID NO: 197589 - RNA, 63 nt, Human
aaaggggcagaaccugaguugagacuugcauguuccucgcaugugucuaaugucagcacuaga

SEQ ID NO: 197590 - RNA, 63 nt, Human
ggacagaaagccagucagacuaauuuccuucuuuccucgcacuucuccccacucgucaucuuu

SEQ ID NO: 197591 - RNA, 63 nt, Human
guauuuuugaggauuccuguauucuguauccucuccucgcaucuccucacauggaaagaaaua

SEQ ID NO: 197592 - RNA, 64 nt, Human
uguucuagguaaguuuguuccugucaauugggaacccccucaaccacuuccauuccccaaauac

SEQ ID NO: 197593 - RNA, 64 nt, Human
cccggccaaacgccggacccucagucgcuccaggcccccucacccucaaaguguagcgccccca

SEQ ID NO: 197594 - RNA, 64 nt, Human
accuccuacugucuugucugugggacaguugccucccccucaucuccagugacucagccuacac

SEQ ID NO: 197595 - RNA, 64 nt, Human
cugaaagggaugcagauuauccuguuccucacgacccccucagcuaacaacaguucugaagggu

SEQ ID NO: 197596 - RNA, 64 nt, Human
gccggcuccccaccccaccuuugauggccucuuccccccucacccuagggugucccgagaugac

SEQ ID NO: 197597 - RNA, 64 nt, Human
aagugccuuagcccagguuccugggcuucugcugcccccucaggaccccagcuaaccucagaac

SEQ ID NO: 197598 - RNA, 64 nt, Human
cugagaaauagugcacuccaagaaacguggaucucccccucauccaacuccgaaagucugaauc

SEQ ID NO: 197599 - RNA, 64 nt, Human
cauucucaauaaagccaaaaaucuuucucuuucucccccucaggccaccuccuguccucacucc

SEQ ID NO: 197600 - RNA, 64 nt, Human
cuucuccuacacuucucagcccauugcuuugccacccccucaugugccagggcaucccauucca

SEQ ID NO: 197601 - RNA, 64 nt, Human
acuuuauucucuggggagggccagcggcucgcaucccccucaucuccagcugcagcucggaugg

SEQ ID NO: 197602 - RNA, 64 nt, Human
gggcagcacagggaccccggaugaagacucuguccccccucaggcauucagcugcccacaaguu

SEQ ID NO: 197603 - RNA, 64 nt, Human
cauggugcuuugucccagcuccugcacccacaggcccccucagggcuccuugccuuuccccccc

SEQ ID NO: 197604 - RNA, 64 nt, Human
guaacaaaacccaccagaaucuaagcaguuuucacccccucagaaaccacugucauuaguuuac

SEQ ID NO: 197605 - RNA, 64 nt, Human
ggugguguagggcccccagccccugagaccuaaucccccucaugcuagccuagucccuggagga

SEQ ID NO: 197606 - RNA, 64 nt, Human
aagaugagcauuccuaguucuacacuucuuuuuucccccucauguguaaaaugaaaagaaaacu

SEQ ID NO: 197607 - RNA, 64 nt, Human
aacaagaguugucuuguccccucuugacccaucucccccucacugaaugccucaaugugaccag

SEQ ID NO: 197608 - RNA, 63 nt, Human
ccucugucagaaucaaagacuaagcuuaagaguuccucgcauauaucguugugcacaggauca

SEQ ID NO: 197609 - RNA, 63 nt, Human
gcccgcuggcagagccgcggguugacgacgguguccucgcagugucgccgccaccccagcgua

SEQ ID NO: 197610 - RNA, 63 nt, Human
ucccauccauccccaacuccaauaaucccccacuccucgcaggucucagugucaugcugucuu

SEQ ID NO: 197611 - RNA, 64 nt, Human
ccuuugaucuucaggaugcacgguuucuguucugcccccucagggaugugggaaucucccagac

SEQ ID NO: 197612 - RNA, 64 nt, Human
auguccgcgucccacuagcaggcggagccccccacccccucagcagggccggagaccuagguaa

SEQ ID NO: 197613 - RNA, 64 nt, Human
uaagcaguguuugagagggucugcuuuaccauuacccccucaauaucaugaucauccaaucuca

SEQ ID NO: 197614 - RNA, 64 nt, Human
auccugcggagaacacccuugguggcuuaugggucccccucagcaagcccuacagagcugugga

SEQ ID NO: 197615 - RNA, 64 nt, Human
ccccacuuuucugucuuagaaaauugugggaauccccccucacucugccuauguugcacucucu

SEQ ID NO: 197616 - RNA, 64 nt, Human
gcaucagaaggguucauggcccuuuccccuccuccccccucagcugggccuggggaggagucga

SEQ ID NO: 197617 - RNA, 64 nt, Human
gaagugcccaacaucucccagccuccccaggugccccccucaccuugaugggugcguucccgca

SEQ ID NO: 197618 - RNA, 64 nt, Human
gccgguaacugggggaaggugauggggcgggggucccccucaaccgcagacuucaggcugcuuu

SEQ ID NO: 197619 - RNA, 64 nt, Human
ccaagcgcucggagcccccccaggacacucugcacccccucaccccgguccuccucauuagggu

SEQ ID NO: 197620 - RNA, 64 nt, Human
ggagcacacugaugggaagcuucccucucccaggcccccucaggagaagguggaagagaaaggg

SEQ ID NO: 197621 - RNA, 64 nt, Human
auaucaagacuauuuagugacucucucugcaugucccccucacccgccaacccuccguuucauu

SEQ ID NO: 197622 - RNA, 64 nt, Human
caucagggcggccucccaggucccauaaggguagcccccucaucugcaggacagagggaagcca

SEQ ID NO: 197623 - RNA, 64 nt, Human
cugcaguccccggcagugagcuauggacuuucuucccccucacaaggcugggggccuccugcuc

SEQ ID NO: 197624 - RNA, 64 nt, Human
uugaaaaguccugcgcugcggaggacaggaagcacccccucaauagccagcacccacagugagc

SEQ ID NO: 197625 - RNA, 64 nt, Human
uaagagcuggcagcugcugaugguguuucccaaccccccucacuucccaagacaacccccagcu

SEQ ID NO: 197626 - RNA, 64 nt, Human
ugugcccaagagccuuaccgggcauucccugaagcccccucauaggcagugauccuagaccaaa

SEQ ID NO: 197627 - RNA, 64 nt, Human
ggacaauucuggacuaaugagaaagaccugaagugaaggcuagagaguugauuuuuuuuuuuuu

SEQ ID NO: 197628 - RNA, 64 nt, Human
aaaaccaguuccauuucuaauguuguccucacaagaaggcuaauugguggugagacagcagggg

SEQ ID NO: 197629 - RNA, 64 nt, Human
cagcaugcaaaaaauaauaauguuuuuaacuaaugaaggcuacuggaguuacuaagaaucaccu

SEQ ID NO: 197630 - RNA, 64 nt, Human
cccuugcuucaagauucaaacagagacucccagucccccucagcaucuucccugaaucacagcc

SEQ ID NO: 197631 - RNA, 64 nt, Human
uuccauucaagagggcacugccugcauucccuuccccccucaaaggcccggcccugcuauuauc

SEQ ID NO: 197632 - RNA, 64 nt, Human
cucccuggggugggcuucucugagcaggacccagcccccucagcugccuccuggcugcugcugc

SEQ ID NO: 197633 - RNA, 64 nt, Human
ccuuuaauuaagaauagcuacacucacaaaaauacccccucaugaaauaacuguucucuuggau

SEQ ID NO: 197634 - RNA, 64 nt, Human
gucauuuaaaauuguaauagaucuuaaccauuuucccccucacccuaacucucuuauucugccg

SEQ ID NO: 197635 - RNA, 64 nt, Human
gcagcaauuuuuagugggaaagaacagcucaucucccccucaugugaaagauuaaauuguaaag

SEQ ID NO: 197636 - RNA, 64 nt, Human
ggaccaaaguucugggaauuucuagcuuauucugcccccucauagcccuuggccuaucuaucuu

SEQ ID NO: 197637 - RNA, 64 nt, Human
uuagccaauguccuugucucuugucuuuggccagcccccucagcccagcccaccccacccgcug

SEQ ID NO: 197638 - RNA, 64 nt, Human
cccaucucugaccagcugggaaccugcuuggggucccccucaaaccugugucuggggugugggc

SEQ ID NO: 197639 - RNA, 64 nt, Human
cagggaggcucugguugucugagcaccaugggggcccccucaccuugucccuccucagccagca

SEQ ID NO: 197640 - RNA, 64 nt, Human
aggugggccaugcagcuaacccacccaccaaagacccccucacccuggccccuugggcuggacc

SEQ ID NO: 197641 - RNA, 64 nt, Human
cugcuaugcaagugccccuguggcuuguccccaacccccucagcaacaaagcucagcuggggaa

SEQ ID NO: 197642 - RNA, 64 nt, Human
auaugugggaaauuaagauuacagaugcuuugggcccccucaaacaguacauugcuacaguuca

SEQ ID NO: 197643 - RNA, 64 nt, Human
gugagagcuuugugucgcuucucacuccucaaagcccccucaggagcacccaguccucagcugc

SEQ ID NO: 197644 - RNA, 64 nt, Human
ggugcggggccugggaugcccgcgccacccgcagcccccucacucggcggaaacccgcgagccg

SEQ ID NO: 197645 - RNA, 64 nt, Human
ggaggucccagaagucuucuguucucuggccucacccccucagucgccauagagcugggccugg

SEQ ID NO: 197646 - RNA, 63 nt, Human
uguuaugagcuuugguggaugucacuccuuuaauccucgcaacacccugucggguagucucau

SEQ ID NO: 197647 - RNA, 63 nt, Human
guguuuguuguguacuuacugugcugagagcuuuccucgcagaggcccucccaacgaacagcu

SEQ ID NO: 197648 - RNA, 63 nt, Human
augacccggcccccgcccucugcccccagcugcuccucgcaguucgguuaauugguuaaucac

SEQ ID NO: 197649 - RNA, 64 nt, Human
uuaccccugugccugugucucuacacacuccacacccccucaaacucuguuuaucuguucucug

SEQ ID NO: 197650 - RNA, 64 nt, Human
ugagccguuuccaauucuaaaacagacucaaugucccccucacccccaccucaaggucaggaug

SEQ ID NO: 197651 - RNA, 64 nt, Human
gguccugucccaaggagcugggaacuugguguugcccccucaauuuccagcaccagaaagagag

SEQ ID NO: 197652 - RNA, 64 nt, Human
gggucugucaggucccaguugccuuucugacggccccccucagagggacggcgaugagcacuaa

SEQ ID NO: 197653 - RNA, 64 nt, Human
uugggagagagccucuacaacaugcuggcaacuucccccucacugauucaaauguuaaucuccu

SEQ ID NO: 197654 - RNA, 64 nt, Human
cugaucuccgggcagccaccaccuccucggucugcccccucauuaaaauucacguucccacccu

SEQ ID NO: 197655 - RNA, 64 nt, Human
ucucuucccagccuuccucacaggcuucugccgccccccucaucuccacccucccccauaucug

SEQ ID NO: 197656 - RNA, 64 nt, Human
cuggccugggcucucccagccucccagcccucugcccccucagauggcuuuuuguuuuuguuuu

SEQ ID NO: 197657 - RNA, 64 nt, Human
uaagauuuagauucugagcccauaauggcaacagcccccucaccuaugggaagcugacuucccu

SEQ ID NO: 197658 - RNA, 64 nt, Human
acagggauugccaugccccagucuucgcaccucgcccccucacccccuaacucacagcacaaac

SEQ ID NO: 197659 - RNA, 64 nt, Human
uuugaauuccugccccucuuuaccaccucuuccucccccucaaaggaaaaacauuucauccaag

SEQ ID NO: 197660 - RNA, 64 nt, Human
cagucauugcacagcaaagccaugugcagggcgucccccucaacccugcccugaacaugcccca

SEQ ID NO: 197661 - RNA, 64 nt, Human
cugagucuccucacagcagagagacccaccggagcccccucaacuuugcagaugcccaccugga

SEQ ID NO: 197662 - RNA, 64 nt, Human
gcugguccaggggucugggcacuguacauaccugcccccucauccuuggguccuucauuauuau

SEQ ID NO: 197663 - RNA, 64 nt, Human
cgucccugugggagaugcaccccauucuugggcccccccucauucccuuuccgaaaaaggaaaa

SEQ ID NO: 197664 - RNA, 64 nt, Human
ugcagggaacuccagagcugcccaccucccacugcccccucagcacacacacaguccccaggcg

SEQ ID NO: 197665 - RNA, 63 nt, Human
augaggaguggaccaagcagcaguggcgguuucuccucgcaucuuuuuuuuuuuaagcuuuaa

SEQ ID NO: 197666 - RNA, 63 nt, Human
aacccggugucgcugcacccgcccgagccccgcuccucgcagccgccucucccgcuccggauc

SEQ ID NO: 197667 - RNA, 63 nt, Human
cuucccucacucuuccucauccugcuucucuuuuccucgcagaugauaaaaggaaucuggcau

SEQ ID NO: 197668 - RNA, 64 nt, Human
cccacucccucugucuuaugacuccccuccccaacccccucaucuaaagacaccuuccuuucca

SEQ ID NO: 197669 - RNA, 64 nt, Human
uccaccccauaccacacuggggggucugagccaccccccucagccccguucggcucagaccgac

SEQ ID NO: 197670 - RNA, 60 nt, Human; identical to SEQ ID NO: 28501

SEQ ID NO: 197671 - RNA, 64 nt, Human
ggcagccagucaccagagcgcccaccuggcacaccccccucaccccagcccugcgcaugggccu

SEQ ID NO: 197672 - RNA, 64 nt, Human
cucugugcccaugggcacugcuggguggcccauccccccucaccaggggcaggcacagcacagg

SEQ ID NO: 197673 - RNA, 64 nt, Human
ggcgccucaacaguagcccccgggcccccgucagcccccucaaguucuccccuuuugagggguu

SEQ ID NO: 197674 - RNA, 64 nt, Human
ccgcccucgaccaccgccccucuccccauccguccccccucagggaccaagaaguccaagaggg

SEQ ID NO: 197675 - RNA, 58 nt, Human; identical to SEQ ID NO: 28506

SEQ ID NO: 197676 - RNA, 64 nt, Human
accaggccccagcucuccacccugaacuccccagcccccucagaguacuaggaccacagaagcc

SEQ ID NO: 197677 - RNA, 64 nt, Human
uagaacucugccuucuccguugucaauaaagccucccccucaugaccuaaacucugggcuuuuc

SEQ ID NO: 197678 - RNA, 64 nt, Human
aaagaauuguuccuuauuaccaaacucccaguaacccccucaaagaauaauugccccuugcuua

SEQ ID NO: 197679 - RNA, 64 nt, Human
ugaugugugaaucuuuuuccaccugccacugcuccccccucagcaucuccaaauauauuuaugc

SEQ ID NO: 197680 - RNA, 64 nt, Human
auaccuccuuuccuugggucucuuggccuccagacccccucaauagacacugacuaaagucagg

SEQ ID NO: 197681 - RNA, 64 nt, Human
gccugcccuccugguacuguugucuuccccucggcccccucacauguguauucagcagcccuau

SEQ ID NO: 197682 - RNA, 64 nt, Human
gaaauuagaaucuguuugcaaauuguccaacccacccccucaacaugaggggcuuccauuuucu

SEQ ID NO: 197683 - RNA, 64 nt, Human
ccucgugccccuggcccaggggucucuuccccugcccccucaguuuuccacuuuugggguuuuu

SEQ ID NO: 197684 - RNA, 63 nt, Human
uggguuugcuuuggaaauccucuaggaggcuccuccucgcauggccugcagucuggcagcagc

SEQ ID NO: 197685 - RNA, 63 nt, Human
gauauucccaagcugguggaagaugguucaucuuccucgcacaguguggguucuuggaguuca

SEQ ID NO: 197686 - RNA, 61 nt, Human
guucccgguuggaaccugcaauaaacucgcuguuccucgcaccuggcucuaacgguggccc

SEQ ID NO: 197687 - RNA, 64 nt, Human
cuccccuuccuccugcaucuccccuucuuuccuucccccucaggagagagaaaacuuagugcuu

SEQ ID NO: 197688 - RNA, 62 nt, Human
ccugcagaaccagcgugugauggggugcagaccccccucauggaguauggggcgcuggacac

SEQ ID NO: 197689 - RNA, 64 nt, Human
ugucuuauuuuccaagaguccuccauuuuuugcacccccucaccgccaacucuguuauucagua

SEQ ID NO: 197690 - RNA, 64 nt, Human
ggggaggaagaagaguguuuacaaaguccuguagcccccucaccuuucuguuuucacuuuugcc

SEQ ID NO: 197691 - RNA, 64 nt, Human
uuuggagcaugccauuggaaaacccacccccacccccccucaaaaaaacagaacaguaaaccaa

SEQ ID NO: 197692 - RNA, 64 nt, Human
aacuuccauuugguacaaaauuuuuacuccaacacccccucaacccuuuucucagggaccacac

SEQ ID NO: 197693 - RNA, 64 nt, Human
ccuguggucccaagguucugggagaaacaggggacccccucaccuccugggcagugaccccuac

SEQ ID NO: 197694 - RNA, 64 nt, Human
ucccuuuucaugucccgauaagaagccaaugauccccccucaggacaaaucuacuccagccacg

SEQ ID NO: 197695 - RNA, 64 nt, Human
ugcuaggggugguccgugugaggugucauccugucccccucauaauuacuaauagcuggaacug

SEQ ID NO: 197696 - RNA, 64 nt, Human
ccucaagugaggggcccuuugcauagcucuccuucccccucacugaagcuggguagccuauugg

SEQ ID NO: 197697 - RNA, 64 nt, Human
agggauccuuaaaucuccauucuguuugugguugcccccucaaccuccccuacacccuuccuau

SEQ ID NO: 197698 - RNA, 64 nt, Human
ucacaugggggcuucugggaacccccguauucuucccccucacccaagggcagugggcaugaau

SEQ ID NO: 197699 - RNA, 64 nt, Human
cuggaaaccucccuaccaaaaagacagagacccgcccccucacacacaaacacacauguccugu

SEQ ID NO: 197700 - RNA, 64 nt, Human
aggaauaagauccuuaaaauaaacucuugggcaucccccucaccagcugacuggcuuuccggag

SEQ ID NO: 197701 - RNA, 64 nt, Human
accagaaauuacuuaccugacauccacccccauucccccucauccugcugggguugaaaguucc

SEQ ID NO: 197702 - RNA, 64 nt, Human
auaguuggggcaaggcaaaacuaacuuagaguuucccccucaacaacauccaaguccaaacccu

SEQ ID NO: 197703 - RNA, 64 nt, Human
agaauaagauguuaacgcugaguuauuaggacuggaaggcuaugaaaagaacuugaaauugucg

SEQ ID NO: 197704 - RNA, 64 nt, Human; identical to SEQ ID NO: 189048

SEQ ID NO: 197705 - RNA, 64 nt, Human; identical to SEQ ID NO: 189050

SEQ ID NO: 197706 - RNA, 64 nt, Human
acuugauuuuucauucugccacuccaucuucaaacccccucaccuuucccauccuacuccugcc

SEQ ID NO: 197707 - RNA, 64 nt, Human
caccuccacagugaggagccagccagacaucucucccccucacccccuguggacaucacgguuc

SEQ ID NO: 197708 - RNA, 64 nt, Human
ccaggacuaaugcaugugguaugaguagguuuggcccccucacuaucucuagagugagaaucug

SEQ ID NO: 197709 - RNA, 64 nt, Human
aguggccgcaggcugugcccccgagcugcccccacccccucacagggucccucagauuauaggu

SEQ ID NO: 197710 - RNA, 64 nt, Human
ccaccccuaaaucacuuugagccugggaaauaagcccccucaacuaccauuccuucuuuaaaca

SEQ ID NO: 197711 - RNA, 64 nt, Human
cuuucaucuuuugccuuacugauaauaccauaaucccccucaauucagaccuucugauugagug

SEQ ID NO: 197712 - RNA, 64 nt, Human
cggggauccccaauccacgcccuucuaguccaaccccccucaaugagagaggcaggcagaucuc

SEQ ID NO: 197713 - RNA, 64 nt, Human
ggcccugccucuucuggccuggugucuccucaugcccccucagugaggaucuucauguaccugc

SEQ ID NO: 197714 - RNA, 64 nt, Human
gcuggucuugaacuccugggcucaagcaauucaucccccucagccucccaaagugcuaggauua

SEQ ID NO: 197715 - RNA, 64 nt, Human
aggcagggugccauucauugucuuucucuccuagcccccucaggaaagaaggacuauauuugua

SEQ ID NO: 197716 - RNA, 64 nt, Human
uuucccccagcaccucagaaugugcccucccucucccccucauaaccccaccuaacauaaggac

SEQ ID NO: 197717 - RNA, 64 nt, Human
aggaaaaagagucucccccuuaaauuuccugguacccccucaccuaugccugaaagcauuucac

SEQ ID NO: 197718 - RNA, 64 nt, Human
aagcaacagcaacaaauccaccuccaccccaucucccccucauaucccugacccaaagcaaagg

SEQ ID NO: 197719 - RNA, 64 nt, Human
uccucaaucgaagcaucugccucccaccccucggcccccucaagcccaccaucugcuucugagu

SEQ ID NO: 197720 - RNA, 64 nt, Human
agccgucauuacuguccuccaugccuucagcagccccccucacagcuaagguacauaccacccc

SEQ ID NO: 197721 - RNA, 64 nt, Human
gugugcagagggcucagcagagaacaguaugggacccccucaccaggccuggaacaccuccagc

SEQ ID NO: 197722 - RNA, 63 nt, Human
aacccccgcaaaccacauagcagacccccgccauccucgcagagugggagaggcugcagcaag

SEQ ID NO: 197723 - RNA, 63 nt, Human
ccggcugcugggcaccugggagagcuuccagaauccucgcagacagcccagagccugccgcua

SEQ ID NO: 197724 - RNA, 63 nt, Human
cacacaugcacacacacacgcgugcaugcacacuccucgcacuuccagccuuggagcccuucu

SEQ ID NO: 197725 - RNA, 64 nt, Human
gucugaggccugcccccugggcuggggccucagacccccucagccuugggaccgugcccacgag

SEQ ID NO: 197726 - RNA, 64 nt, Human
ucacaguucuuggugacugucccaccgggagccucccccucagaugaucucuccacgguagcac

SEQ ID NO: 197727 - RNA, 64 nt, Human
cugcccuucagccuacugggccaggccggaccugcccccucagugucucucccucccgaguccc

SEQ ID NO: 197728 - RNA, 64 nt, Human
cuugaaaguccuccuucuaccaacuccaccuccacccccucauuccccuucucccaaaguacua

SEQ ID NO: 197729 - RNA, 64 nt, Human
uguuccacagccacuauuugcauugcugucccugcccccucaucacucccccugccaagacaaa

SEQ ID NO: 197730 - RNA, 64 nt, Human
gcuuccagguguaauuauugcuuucauuccuuaccccccucaagcaaaugugaaaaguauacug

SEQ ID NO: 197731 - RNA, 64 nt, Human
agaccagagcgcccucugaugagcccacugcccacccccucaagccaauccccuccuugggcac

SEQ ID NO: 197732 - RNA, 64 nt, Human
gugcccugguggagaaagcacugaccugucaugccccccucaaaccuccucuucugacgugccu

SEQ ID NO: 197733 - RNA, 64 nt, Human
ccucaggagaccugccccucccccccgaccuccacccccucagacuccaucccccacccccagg

SEQ ID NO: 197734 - RNA, 64 nt, Human
uucacgcuguggaagcagccaaggcacuuccucacccccucagcgccacggaccucucugggga

SEQ ID NO: 197735 - RNA, 64 nt, Human
gccuuccaggggaauuaguccuccucucuucucucccccucagccuuucucucgccugccuucu

SEQ ID NO: 197736 - RNA, 64 nt, Human
cucucacuacccagcagcaggcuggggaccuccucccccucaaaaaagguauuuuuuuauucua

SEQ ID NO: 197737 - RNA, 64 nt, Human
caguuacaguuguaacaagccuacuucauauuggcccccucaguuagccuuuuugaggcaaugc

SEQ ID NO: 197738 - RNA, 64 nt, Human
agagcuuugggccaaaagcaggcguugggggguccccccucaaguuuggagccguuuccguggu

SEQ ID NO: 197739 - RNA, 64 nt, Human
gugcuuucaucuucaggcagaagccucugcccaucccccucaagggcugcaggcccaguucuca

SEQ ID NO: 197740 - RNA, 64 nt, Human
gguuuacaggcaugagccaccacacccagcuccucccccucaaacuucugugcacaaagugcuc

SEQ ID NO: 197741 - RNA, 63 nt, Human
gugcauccucuuccggcccaucacuagccagcuuccucgcaucuucaccagcauuggagagga

SEQ ID NO: 197742 - RNA, 63 nt, Human
uucagagggcagaggggacaccuucauugccucuccucgcacagaaauggugggcucucucug

SEQ ID NO: 197743 - RNA, 63 nt, Human
cuggcuuggggcgccugccucccugcuccucuguccucgcacagcgaaccugggcuccugccc

SEQ ID NO: 197744 - RNA, 64 nt, Human
ugaacagggacagaccagaggcccugcaaggacucccccucagaccuccaaagggcaacagaag

SEQ ID NO: 197745 - RNA, 64 nt, Human
cauucucuacaaaugugccguuuuaagaauaaaacccccucaaaucucucccccgaggccuguu

SEQ ID NO: 197746 - RNA, 64 nt, Human
gcuuuguauaucaaaagcuccaaccauguccucucccccucagccuguggguggcacgagcaag

SEQ ID NO: 197747 - RNA, 64 nt, Human
uguucggguguggguucuacagccuugucccccucccccucaaccccaccauaugaauuguaca

SEQ ID NO: 197748 - RNA, 64 nt, Human
gugcaugcagaggcuccuggaucugggaagcccgcccccucacaaaugcugagccguucuugcu

SEQ ID NO: 197749 - RNA, 64 nt, Human
agccugguggcguguuaguuucugcccaguucuacccccucaugugcuucuucugaauacugaa

SEQ ID NO: 197750 - RNA, 64 nt, Human
ccacccgaggcuagcaccgugucugugucugucucccccucagaggagcucucucaaaaugggg

SEQ ID NO: 197751 - RNA, 64 nt, Human
cugcaaacuaaggagugacuagguggguuggggacccccucaggauuguuucucggcaccagug

SEQ ID NO: 197752 - RNA, 64 nt, Human
gaaaaaugagcauguaauaauacaagaacuguuucccccucaaaaccugaaccugaauuauuug

SEQ ID NO: 197753 - RNA, 64 nt, Human
ccucucgaggccucuucugaccucaagggucacacccccucaaagauccucucacccaugguag

SEQ ID NO: 197754 - RNA, 64 nt, Human
uauauaggguggccacacuagggcgggguccuuccccccucacagcuuuggccccuuucagaga

SEQ ID NO: 197755 - RNA, 64 nt, Human
uagacucgucuuuaggcaaaaccuacagcgcccccccccucaccccagaccuacagaaucagag

SEQ ID NO: 197756 - RNA, 64 nt, Human
ggggcgcugaguagggacucagggccaugccugccccccucaucucauucaaaccccacccuag

SEQ ID NO: 197757 - RNA, 64 nt, Human
aggauggacgaagacccccuccagagcaaggaggcccccucagcccugugguuacagccgcuga

SEQ ID NO: 197758 - RNA, 64 nt, Human
aguggagccugccgcccccgccugggcaccgggacccccucaccauccagugggcccggagaaa

SEQ ID NO: 197759 - RNA, 64 nt, Human
cucucuccucuccgcgcccuccgaccucucucggcccccucaccccagcuccgaccucucucag

SEQ ID NO: 197760 - RNA, 63 nt, Human
caccagcagguucugagcccuggcugcuuguccuccucgcaacccccccaggccggagcuucc

SEQ ID NO: 197761 - RNA, 64 nt, Human
cucugaggccagccuggccuccugccucuacugggaaggcuacuucggggcugggaagucgucc

SEQ ID NO: 197762 - RNA, 64 nt, Human
ucuaucccuucuguuucagagaugcaucuacaaagaaggcuaaugucauucuuccaguagaauc

SEQ ID NO: 197763 - RNA, 64 nt, Human
gaauugggaagcugggggaaggguggucugagcacccccucauuccccucgugugacucucuug

SEQ ID NO: 197764 - RNA, 64 nt, Human
caauuuauuugacguuuuauuuugguuuuccccacccccucaaucugucggggagccccugccc

SEQ ID NO: 197765 - RNA, 64 nt, Human
gagguuuuuuuuugccacccuggacacauguuggcccccucaaagaauuucuguggggauuugu

SEQ ID NO: 197766 - RNA, 64 nt, Human
uucuacuucuggcuuguugcaagaggaguagaugcccccucacccacacaaaccccacucaguc

SEQ ID NO: 197767 - RNA, 64 nt, Human
gccuccucucugaccaugacccaggcauccuugucccccucacccacccagagcuaggggcggg

SEQ ID NO: 197768 - RNA, 64 nt, Human
aauccugaacaucuaggcuggaaccugcacaccucccccucagcuccgucgugaaugggacaac

SEQ ID NO: 197769 - RNA, 64 nt, Human
uggauccaaauguuaccucuuaggggaaguuaugcccccucaacuauugucuuauuauaaugaa

SEQ ID NO: 197770 - RNA, 64 nt, Human
gggugucucccucgggggcucuuccccuagaccucccccucacuuacauaaagcucccuugaag

SEQ ID NO: 197771 - RNA, 64 nt, Human
ggaaaaugacuuuauugcuuaauuucugccuuuccccccucacacaugcacuuuugggccuuuu

SEQ ID NO: 197772 - RNA, 64 nt, Human
uuacugguuggcccaagcccugccugacugaccacccccucagagcacagaucagggaccucac

SEQ ID NO: 197773 - RNA, 64 nt, Human
cguguuuuuaucacaccugcuccccagauucccacccccucaauguuccucucacacgaaaccc

SEQ ID NO: 197774 - RNA, 64 nt, Human
ccuggcacugaggcacagaucgucaaggcagguacccccucaacccuucuuccacuggagcccc

SEQ ID NO: 197775 - RNA, 64 nt, Human
cagagcugggagggguuuucgaagcucagcccaccccccucauuuuggauauaggucagugagg

SEQ ID NO: 197776 - RNA, 64 nt, Human
gauuggcaaguacaguauccuuugggaaggccaucccccucaggacuguccuggcuccgaccuu

SEQ ID NO: 197777 - RNA, 64 nt, Human
cagggcugucacuuuucugccagggguacugggucccccucagcacccuccacagcacaggccu

SEQ ID NO: 197778 - RNA, 64 nt, Human
uuggggugguaggagccacacagacucuucugagcccccucacucacuuccuucccccugugcc

SEQ ID NO: 197779 - RNA, 63 nt, Human
agugcggccagcaaguuugagaccugcccgcccuccucgcagcucugcucuguguccucagga

SEQ ID NO: 197780 - RNA, 63 nt, Human
cuggcccgugucacugccucugucacccagcuauccucgcacucaaagccauccaaccucagc

SEQ ID NO: 197781 - RNA, 63 nt, Human
gcuguuucaggugcccacaucacccucauuuccuccucgcaguagcccugcaccguggccaga

SEQ ID NO: 197782 - RNA, 64 nt, Human
cucaaaauccugggcacuaugaaggaacccccugcccccucaccuuuuuggguagguaaaagac

SEQ ID NO: 197783 - RNA, 64 nt, Human
ucuuuuuuuguucuuccuuccuuucuucccuccucccccucauccuucccuuucuccuucuuuu

SEQ ID NO: 197784 - RNA, 64 nt, Human
cucagggaaaauggggguccuugccucucguguacccccucaaggcugaccccuuagauggccc

SEQ ID NO: 197785 - RNA, 64 nt, Human
auugaggauaaaaaggaaggagagaugaccccuacccccucaucccccaguuuugaaaaggucu

SEQ ID NO: 197786 - RNA, 64 nt, Human
uggugucgcuuggcuaagugacucccagcccaagcccccucaagagucugggucgggggaggag

SEQ ID NO: 197787 - RNA, 64 nt, Human
ggaaggcagggaagcccugagcacagguacgggccccccucagccccugccuccaucugccuga

SEQ ID NO: 197788 - RNA, 64 nt, Human
caaagggccugcagagggagauguggcccuuccucccccucauugaggacuuaauaaauuggau

SEQ ID NO: 197789 - RNA, 64 nt, Human
uuugggccaguccauuuuuggaggucacucuuuccccccucauccccucaccuccuucucuuua

SEQ ID NO: 197790 - RNA, 64 nt, Human
caacucucuccacagugugagugcacgugugaagcccccucacucuuccgcuagggauaaagca

SEQ ID NO: 197791 - RNA, 64 nt, Human
aggaaaugcccauguccacagcuuguacacacugcccccucacuaucuuguuauccaguggcau

SEQ ID NO: 197792 - RNA, 58 nt, Human; identical to SEQ ID NO: 28605

SEQ ID NO: 197793 - RNA, 64 nt, Human
aguggccagcauccuccugcugcaggaaguggaucccccucagccaccucaauucuucaaaaga

SEQ ID NO: 197794 - RNA, 64 nt, Human
ugcauugggggagguacauuccugcaucuucucacccccucaaccaggaacuggggauuuggga

SEQ ID NO: 197795 - RNA, 64 nt, Human
ccaggcccugaggaaucccgggcgccggcaaggccccccucagcccgccagcugagggguccca

SEQ ID NO: 197796 - RNA, 64 nt, Human
cugccauagcauguucauuaggggauuccuuccucccccucaucucacaggggaagggagagga

SEQ ID NO: 197797 - RNA, 64 nt, Human
gccugccaaagacguguccgaccuacguuccuggcccccucauucagagacugcccuucucacg

SEQ ID NO: 197798 - RNA, 63 nt, Human
uguuuuucuuuuuagucguuccccaucaggaaguccucgcagaagugcaaguccugaaagaau

SEQ ID NO: 197799 - RNA, 63 nt, Human
ggccguuccccuccccgcucuucuuccaacuccuccucgcacgcccgagggccggccuccggu

SEQ ID NO: 197800 - RNA, 63 nt, Human
ucccucuuggucuucccaggcuggggcugaccuuccucgcagagaggccaggugcagguuggg

SEQ ID NO: 197801 - RNA, 64 nt, Human
ccaacccggaaacagacaagcaacccaaacugaacccccucaaaagccaaaaaaugggagacaa

SEQ ID NO: 197802 - RNA, 64 nt, Human
cauaagcaagucuauaaauaucggcugcagccaucccccucauuuuaaauguugcccuaauaau

SEQ ID NO: 197803 - RNA, 64 nt, Human
cuucgggccccagguugauccugugacugaggcucccccucauguagccuccccaggcccaggg

SEQ ID NO: 197804 - RNA, 64 nt, Human
cccaccccaccagccccuuucaucccuccuuccucccccucaguuuuuguuggaaagauuaucu

SEQ ID NO: 197805 - RNA, 64 nt, Human
agucaccaggagcccaccaccucccucuaggaugcccccucaggggcuggccaggcccugcuca

SEQ ID NO: 197806 - RNA, 64 nt, Human
gcaaccuugugucccagcccugcccuucuucccacccccucaaucugcuagucccugaagccuu

SEQ ID NO: 197807 - RNA, 64 nt, Human
ccuuagaggacagcggcugccugucccuucuucacccccucacccccauaauuugucuagaucu

SEQ ID NO: 197808 - RNA, 64 nt, Human
acugggcuucuacaugcuauccuuaagagcuucucccccucacccauuccuagugcucuuggua

SEQ ID NO: 197809 - RNA, 64 nt, Human
cacuguucccucauuugcacugcucuguaagccucccccucaccuccauucauaacccagucuc

SEQ ID NO: 197810 - RNA, 64 nt, Human
uaaaaucagcccuucucccaggccugugcacacacccccucagcacucccuaugcacuuuccug

SEQ ID NO: 197811 - RNA, 64 nt, Human
uaguuguccaccucgcaggagccgccccccgggccccccucagccccccacuucccguacccgu

SEQ ID NO: 197812 - RNA, 64 nt, Human
ccugagaugggcuucccaagggcugccggggcagcccccucacaguauugcucacccagugccc

SEQ ID NO: 197813 - RNA, 64 nt, Human
cggcggggcagcccccuccgcgcccccggccguccccccucaucgccccgcgcccacccccauc

SEQ ID NO: 197814 - RNA, 64 nt, Human
caaggcaggggaguggggccugagcugagcacugcccccucacccccccaccaccccuucccau

SEQ ID NO: 197815 - RNA, 64 nt, Human
uccuggcaggguagggaaggaggaccccgggcaccccccucagggccugacucacguacuguag

SEQ ID NO: 197816 - RNA, 64 nt, Human
ggcuucccaguugccccuuugccauauuccaagucccccucagacuucaugucucugcucauca

SEQ ID NO: 197817 - RNA, 63 nt, Human
auggcagccaggcaugggggcucacaacuguaauccucgcacuuugggaggcucaggcuaagg

SEQ ID NO: 197818 - RNA, 63 nt, Human
ccaggcuggucucaaacccccagccucaacugauccucgcaucucagccuccugaguagcugg

SEQ ID NO: 197819 - RNA, 63 nt, Human
ugggaggggccgccugaggccugugcgcuguuguccucgcagauguacuuauuuuuguucaug

SEQ ID NO: 197820 - RNA, 64 nt, Human
gugacauggaagcaacuccgucugcugcagcugacccccucacacugaguucacagugcgcccu

SEQ ID NO: 197821 - RNA, 64 nt, Human
ucucucaguuuuggacaagugacaaaccauuuugcccccucacucuucuuuuuuaacuguuaaa

SEQ ID NO: 197822 - RNA, 64 nt, Human
augcccagccuggcugagcccgagauucgcuccucccccucaugccaaccccacacaggucccg

SEQ ID NO: 197823 - RNA, 64 nt, Human
agugaaggagcugggggcagccugcguggcugaccccccucaggacccucgcuggcccccacug

SEQ ID NO: 197824 - RNA, 64 nt, Human
gacuauguauuccugaacuggagccccagacccgcccccucacugccuugcuauaggagucacc

SEQ ID NO: 197825 - RNA, 64 nt, Human
caggcacuggggagggggcuucaaggagggagugcccccucagacucccugcuucccuggaagc

SEQ ID NO: 197826 - RNA, 64 nt, Human
agggaccccugagaagaugccaggacuuauaguacccccucaggacauggacaguauguggggg

SEQ ID NO: 197827 - RNA, 64 nt, Human
uuaaguuauuacaccccgacccuccuccugucagcccccucaccugcagccuguugcccaauaa

SEQ ID NO: 197828 - RNA, 64 nt, Human
cucggggugggguggggccgaguggcugcccugccccccucauuugcauggcuccucccccacu

SEQ ID NO: 197829 - RNA, 64 nt, Human
gucccugugugaacgcaggcaaaagcagcccagucccccucacugcuugagcuaacacugccac

SEQ ID NO: 197830 - RNA, 64 nt, Human
gggcuaggugguccuguccaggcuccugcagcgccccccucacuuugacacuggacuaggaugc

SEQ ID NO: 197831 - RNA, 64 nt, Human
guuucagguguccacugcgggucuucaaacguaccccccucaggugagaggggacugcuguaca

SEQ ID NO: 197832 - RNA, 64 nt, Human
cugccccagccucaggacugcaggagccauccgccccccucagccccuuccuccccagggagca

SEQ ID NO: 197833 - RNA, 64 nt, Human
ccguccuccucugcggggcucuccggacccccuucccccucaccuccaggcagggacagaauaa

SEQ ID NO: 197834 - RNA, 64 nt, Human
ggccugggcgacugcggggagcuugcucuucccucccccucaucacaguggccuucucauggca

SEQ ID NO: 197835 - RNA, 64 nt, Human
agguccuggcugcaaccugcacggaugcuggauucccccucaccccaccucugcauggccaccc

SEQ ID NO: 197836 - RNA, 63 nt, Human
agccacuggaaggaacagagcaauacuauaccuuccucgcaacuaccugugaugucugaccag

SEQ ID NO: 197837 - RNA, 64 nt, Human
gcuuuuccauuuaacacauggagcccuucccccagaaggcuacuuccuuguuuuagaggaaggu

SEQ ID NO: 197838 - RNA, 64 nt, Human
cucauagguugagcaauuucccccuaaaccaacugaaggcuaaaaagcaacaggccauugugaa

SEQ ID NO: 197839 - RNA, 64 nt, Human
ugcccgccccaggggcaccccgacauccaggccacccccucauggugcuacagacccugcccug

SEQ ID NO: 197840 - RNA, 64 nt, Human
guguagggcaguaguuccguaaguggaagcccagcccccucaacaucugguaccagcacuccgc

SEQ ID NO: 197841 - RNA, 64 nt, Human
ccagauaaucagagggacagaaacaccagcugcucccccucauccccuucacccuccugccccc

SEQ ID NO: 197842 - RNA, 64 nt, Human
cucuagggccgccgccaccuccccugggaccccgcccccucauccugccuccaguucccggcca

SEQ ID NO: 197843 - RNA, 64 nt, Human
uugaguccccacugucaucuaccaagacuugcaccccccucauuaucuaccaugacugucucuc

SEQ ID NO: 197844 - RNA, 64 nt, Human
ccaaagacaguggugguccgguggagggaagacccccccucaccccaggacccuaggagggggu

SEQ ID NO: 197845 - RNA, 64 nt, Human
gugggugucccccaggucucagcccccaaggcugcccccucagcagaggcagcugguggcuuug

SEQ ID NO: 197846 - RNA, 62 nt, Human
aggcggccggcgaggccugagcccaggaaagccccccucacugucccugguaccgcugccaa

SEQ ID NO: 197847 - RNA, 64 nt, Human
uaaggaaaugcaguguguugcaguggccuuuucucccccucaccuucuaaggucagcucuagcu

SEQ ID NO: 197848 - RNA, 64 nt, Human
gucuuugcccacgucccgacaacuuguucccugacccccucagggauggccccaaacugucccu

SEQ ID NO: 197849 - RNA, 64 nt, Human
cucuggacacuaagacuccgccccugaggcuccgcccccucacgaggucaagcaagacacaguc

SEQ ID NO: 197850 - RNA, 64 nt, Human
ggcagacuauaaaagccuuuggugggaagauaaacccccucagaagugaucauagaucaugaau

SEQ ID NO: 197851 - RNA, 64 nt, Human
uuccuggacccaggaguugaagccuccaucgacucccccucaacuuugagacuguagagucagg

SEQ ID NO: 197852 - RNA, 64 nt, Human
ccgcgcagccugcccccuccuggacgugcccauccccccucagauccagacaugccccuccccc

SEQ ID NO: 197853 - RNA, 64 nt, Human
cugcugcaccuuccccacccccuccugggaagugcccccucaccucagggcacccgcaaccugg

SEQ ID NO: 197854 - RNA, 64 nt, Human
uauguuugcucacauucuuucagccuucugucaccccccucaacaccaaacuuucuuccuugug

SEQ ID NO: 197855 - RNA, 63 nt, Human
uuuuauccucccuuugguaccuuaauuugacuguccucgcagagaaugugaacaugugugugu

SEQ ID NO: 197856 - RNA, 63 nt, Human
cagccagcuaccccucaaggaaucauagcucucuccucgcacuuuuauccacccaggagcuag

SEQ ID NO: 197857 - RNA, 63 nt, Human
gcugccucagggaugcuccaaccacccucguucuccucgcaguggcccuggcucccaccuccc

SEQ ID NO: 197858 - RNA, 64 nt, Human
gugggcagccugguaggggucgccagccuccaugcccccucaucuuccaguucuugcuuagugg

SEQ ID NO: 197859 - RNA, 64 nt, Human
uuuccaucucacagagaaucagacagggccacagcccccucaggcagccaggucaucugaguau

SEQ ID NO: 197860 - RNA, 64 nt, Human
uacugcauuccagccugggugacagagugagacucccccucaaaaaaaaaaaaaaaaaaaaaaa

SEQ ID NO: 197861 - RNA, 64 nt, Human
agaggagugugaagcaaggagcuuagauaagacacccccucaaacccauucccucuccaggaga

SEQ ID NO: 197862 - RNA, 64 nt, Human
uuccuccugcuccaaacuuugcccauccucuuugcccccucaggagugcugagggccaguguug

SEQ ID NO: 197863 - RNA, 61 nt, Human; identical to SEQ ID NO: 28664

SEQ ID NO: 197864 - RNA, 64 nt, Human
cuggccugaugauggugggugggugggaugaguacccccucaaacccugcccuccuuagaccug

SEQ ID NO: 197865 - RNA, 64 nt, Human
ccgucccccaaacauguuguacauuucaccauggcccccucaucauagcaauaacauucccacu

SEQ ID NO: 197866 - RNA, 64 nt, Human
ucacucugucucuaaaccucucucucucucccuucccccucaguacuuagucuacagaccuaug

SEQ ID NO: 197867 - RNA, 64 nt, Human
gcacacacaccccagcccugucccaggggccuggcccccucagccaucucagggugaggagcug

SEQ ID NO: 197868 - RNA, 64 nt, Human
cccaugacacccugugcaccagcugcacuggcuucccccucagcaccaggguaccaggugagcc

SEQ ID NO: 197869 - RNA, 64 nt, Human
accugccugccuggauugcaccuuucugcccuuucccccucauuauuaaauguuucuuuuugcc

SEQ ID NO: 197870 - RNA, 64 nt, Human
ggcuuugaguagcaguguuccucgucacccauuucccccucaggauuacaacaccugcuaucaa

SEQ ID NO: 197871 - RNA, 64 nt, Human
uccuaggauuauaggcaugagccacugugccuggcccccucaucugauagaaaauuagauuuug

SEQ ID NO: 197872 - RNA, 64 nt, Human
ucaagcucucugggcacagagaccugcugucaaccccccucauuaaaauucaugugccugcuac

SEQ ID NO: 197873 - RNA, 64 nt, Human
ucugcaauucuguuuuucuccaaguacauuaugacccccucauccuucucuugaacuggagagg

SEQ ID NO: 197874 - RNA, 63 nt, Human
cgggacugagugugaaucuguaaaaggggaaaauccucgcaagaggucuacgagaaggaugag

SEQ ID NO: 197875 - RNA, 56 nt, Human
ggaugcaggagagucccugaaaggucuccucgcacccuucgcaaggaccuucuugg

SEQ ID NO: 197876 - RNA, 63 nt, Human
auaucugaaguggcucugaugccuuugccacacuccucgcaucucugggacaucccuuccgca

SEQ ID NO: 197877 - RNA, 64 nt, Human
cuccacaucccagcagcccaagcuuaauagcccucccccucaaccucaccauugugaagcaccu

SEQ ID NO: 197878 - RNA, 64 nt, Human
cucccagggaagcugggugggguggguguugagacccccucagaccagcacagagaccuguccu

SEQ ID NO: 197879 - RNA, 64 nt, Human
agcaauaacaacaccuggggguggucagugagggcccccucaaugauuuucuuguuuguucugu

SEQ ID NO: 197880 - RNA, 64 nt, Human
gugugagaguccucucccuucuggccagcuccagcccccucacccuugcugggggcauaucucu

SEQ ID NO: 197881 - RNA, 64 nt, Human
uuagcuauuuauccugaugcuuucccucccccugcccccucaacaguccacguguucucauugu

SEQ ID NO: 197882 - RNA, 64 nt, Human
agggcgggccuccaggugcagggcgggccagaagcccccucaucggcccgcagcuggcuggccc

SEQ ID NO: 197883 - RNA, 64 nt, Human
ccuccuuuuucuaggaaucauauguuguccaucccccccucaggcuugaaaguccucaaagaga

SEQ ID NO: 197884 - RNA, 64 nt, Human
uuaacagggcugucuggacggggcucuuuugcuucccccucaaucuggggucuagaguugugca

SEQ ID NO: 197885 - RNA, 64 nt, Human
ggcaaguuccccggagagucgggguccccuguggcccccucaggccuaugucugugaggaaggg

SEQ ID NO: 197886 - RNA, 64 nt, Human
ugcucucuacagaggcugcaggcuccgccgaguccccccucaguguuauuuuauuuaugacuua

SEQ ID NO: 197887 - RNA, 64 nt, Human
cuuacauuggccuuuguuugccaaaauuauucaacccccucauacgacuucagcuccucacuug

SEQ ID NO: 197888 - RNA, 64 nt, Human
cauggcauuuuacucagaagucauaaguuuuugccccccucauuuaccucguauuaccaagaaa

SEQ ID NO: 197889 - RNA, 64 nt, Human
ccuuuguaaccucagugcuggggacugaggcgagcccccucaggucgcuggagugcaccagucu

SEQ ID NO: 197890 - RNA, 64 nt, Human
ugccugagucucgccucccugcuggucccugaagcccccucagaagcccugccugucacgucgg

SEQ ID NO: 197891 - RNA, 64 nt, Human
cgccuucuccaccggggccccucugcucacagagcccccucaccucccuggggaugaggggcca

SEQ ID NO: 197892 - RNA, 64 nt, Human
agcagugccucagggguccucagggucagggagccccccucacccucuuggcccguuacccuuu

SEQ ID NO: 197893 - RNA, 63 nt, Human
cuccucuagcucuggugggaggcccggggcccuuccucgcacagggcaugccuggccugagga

SEQ ID NO: 197894 - RNA, 63 nt, Human
auucacguucccacccuguguccacuucaugauuccucgcaagcugggcccaguccucucauc

SEQ ID NO: 197895 - RNA, 63 nt, Human
ggcgugacccgaccuggccgcggagccugcauuuccucgcagccucucagugcccuccagccc

SEQ ID NO: 197896 - RNA, 64 nt, Human
uggauuuaccagcacaucaaagcugcuucgcaagcccccucauuagcagggcuuaucuggggga

SEQ ID NO: 197897 - RNA, 64 nt, Human
ugacugcccugccucugaccagucuguuccggggcccccucagccaggugggaaugacggacac

SEQ ID NO: 197898 - RNA, 64 nt, Human
cccgaaauaacaccuucuccuauagcaggccuggcccccucagugucucccugucaauuucuac

SEQ ID NO: 197899 - RNA, 64 nt, Human
ggaggaggaguccacuaacaggaaacacuucucacccccucacacaggcccaggggagccccug

SEQ ID NO: 197900 - RNA, 64 nt, Human
agguggagaauaauauugacacuugcuuuucugccccccucagggguguguggaaggcaguggg

SEQ ID NO: 197901 - RNA, 64 nt, Human
ccaccccuccaccucucucucgauuucucucucucccccucagcaucuucccgcugagaguggu

SEQ ID NO: 197902 - RNA, 64 nt, Human
accaggcccuuccucucccccugucuguuuccuucccccucaaccuuaccccaccccucuguua

SEQ ID NO: 197903 - RNA, 64 nt, Human
uugcacaugcuauucccuggggcugcugugcgcucccccucaucuaggugacaaacuucccuga

SEQ ID NO: 197904 - RNA, 64 nt, Human
ccuaugcccugccccagcccuggcucuuuccuaacccccucaacggugggaggaacuggcagag

SEQ ID NO: 197905 - RNA, 64 nt, Human
gggcuccccgucuguaagauggcaaaaaugcugccccccucacagggugaccaugaggaccagu

SEQ ID NO: 197906 - RNA, 64 nt, Human
ugcuuuucuccacugccauguguccuggucaagccccccucacucuguuuccuguucagcaugu

SEQ ID NO: 197907 - RNA, 64 nt, Human
cugcuuuucccauugccaugcguccuggucaagccccccucacucuguuuccuguucagcaugu

SEQ ID NO: 197908 - RNA, 64 nt, Human
cugcuuuucccauugccgugcauccuggucaagccccccucacucuguuuccuguucagcaugu

SEQ ID NO: 197909 - RNA, 64 nt, Human
gggaauggacccuuggagacucccauccucucuucccccucaccaagugcccaggagaccccug

SEQ ID NO: 197910 - RNA, 64 nt, Human
caguggggguucucuagcucugaccucugggugacccccucaguuguugauugcucucacuccc

SEQ ID NO: 197911 - RNA, 64 nt, Human
aggguggccccccuccucacgccuucuucacugccccccucagagugcacaauacgaguuuguu

SEQ ID NO: 197912 - RNA, 63 nt, Human
auuccucugugcucuccuagagcucugucugaauccucgcagccacaccuaggucugagaacu

SEQ ID NO: 197913 - RNA, 63 nt, Human
ccguccaccgccuccacgccgcaccuggaggccuccucgcaggcccgugccccgccucccugg

SEQ ID NO: 197914 - RNA, 64 nt, Human
auucagagcccuuauugcucuuaucaaaacagaagaaggcuacauuugugggaguguugucaua

SEQ ID NO: 197915 - RNA, 64 nt, Human
uauggguuuggaaacuugcaugaaaauauuuuagcccccucagauguuccugcagugcugaaau

SEQ ID NO: 197916 - RNA, 64 nt, Human
agaauuguggcugugccacgcuggaccacagggucccccucaagcaucucggggcccuauucuc

SEQ ID NO: 197917 - RNA, 64 nt, Human
agggggugacuggcacagagcgggccguaggggacccccucacacaccaccgagauggacaggg

SEQ ID NO: 197918 - RNA, 64 nt, Human
cccaacugcuuuuccccauguguccuggucaagccccccucacucuguuuccuguucagcaugu

SEQ ID NO: 197919 - RNA, 64 nt, Human
ugcuuuuccccauugccaugcguccuggucaagccccccucacucuguuuccuguucagcaugu

SEQ ID NO: 197920 - RNA, 64 nt, Human
ugcuuuucuccauugccaugcgaccuggucaagccccccucacucuguuuccuguucagcaugu

SEQ ID NO: 197921 - RNA, 64 nt, Human
gaagcuuggaggaggguuguaaaagcauauuguacccccucauuuguuuaucugauuuuuuuau

SEQ ID NO: 197922 - RNA, 64 nt, Human
agggccaucuguucaucacacacacccccuuccucccccucaucacccauaaucgugggccccu

SEQ ID NO: 197923 - RNA, 64 nt, Human
ucagagguccugucuggauggaggcuggaggcuccccccucaaccccucugcucagugccugug

SEQ ID NO: 197924 - RNA, 63 nt, Human
cccaucccccaaauggaaauuccgaaggaggccuccucgcaccugcccuccgcugcuccucag

SEQ ID NO: 197925 - RNA, 63 nt, Human
aacagugccauguaccacacagauguuccugucuccucgcaugggcauagggacccaucauug

SEQ ID NO: 197926 - RNA, 63 nt, Human
uggugagggagccucguccaaggcaguucuguguccucgcacugcccagggaagcccucggcc

SEQ ID NO: 197927 - RNA, 63 nt, Human
cugacacaaaacuugagccacuuggauguuuacuccucgcacuuaaguauuugagucuuuucc

SEQ ID NO: 197928 - RNA, 63 nt, Human
aaccccuccagggccggccugcggaggagccgauccucgcacccuccgcucccuccacuggcc

SEQ ID NO: 197929 - RNA, 63 nt, Human
ugacacacaucaauggcaauaacuucuuccaacuccucgcagaagugggagaggccggcagcc

SEQ ID NO: 197930 - RNA, 64 nt, Human
uccuugucucagaaugaccaggggccagccagugucugaccaaggucaaggggcaggugcagag

SEQ ID NO: 197931 - RNA, 64 nt, Human
ugauggugcaggugcagggaggugaccauguaacucugaccaaucugggaaguggagggugggc

SEQ ID NO: 197932 - RNA, 64 nt, Human
gaucgauauuauaugcuguaaccaugugucuccgucugaccauucuuguuauuguuaaaaugca

SEQ ID NO: 197933 - RNA, 64 nt, Human
uguccucccaggaaccaaaaaaccccagcuauuuucugaccaaaauguguuucauaacaaacca

SEQ ID NO: 197934 - RNA, 64 nt, Human
cucuugcccuucuucuagcagucugugccuccucucugaccaguuuggagggcacugaagaaag

SEQ ID NO: 197935 - RNA, 64 nt, Human
auuccaaagugggaucaacuguacgccuuugguaucugaccauaaagucuuuugcuccgcugac

SEQ ID NO: 197936 - RNA, 64 nt, Human
cuugucaugagcaaauaugucaagggagucaauuucugaccaaucaaguacacuaaauuagaau

SEQ ID NO: 197937 - RNA, 64 nt, Human
aauccuacaaauuuaaggacaguugugacaguaaucugaccacuaucuauaaauacauuggaca

SEQ ID NO: 197938 - RNA, 64 nt, Human
gaggaagcaguuuaaauagcccuguucucauuacucugaccacauacaucauagggugcuaaag

SEQ ID NO: 197939 - RNA, 64 nt, Human
uucugcaggaggaaggggccccagcugucgccuuucugaccagcaggccuggagggcaggggca

SEQ ID NO: 197940 - RNA, 64 nt, Human
aggugucagucccuguggccuuccuuggggcuucucugaccacaugugcccaacuucaauaaga

SEQ ID NO: 197941 - RNA, 64 nt, Human
acugaucugccauuuucaccucuaaauccccaugucugaccauuaguuuucuucucuuuccuuc

SEQ ID NO: 197942 - RNA, 64 nt, Human
cuuauuguuuuuguaacuugcauuuuacaagaguucugaccagcaccagauaagcuucagugcu

SEQ ID NO: 197943 - RNA, 59 nt, Human
acuggcuccugcaaaccugaggcugcucaucugaccacugggcaccuuagugccaaccu

SEQ ID NO: 197944 - RNA, 64 nt, Human
ugcaccgcugacucccaggaagucuuuccugaagucugaccaccuuucuucuugcuucaguugg

SEQ ID NO: 197945 - RNA, 64 nt, Human
ccugucaaacgagcccauuuucuccaaaguggaaucugaccaagcaugagagagaucugucuau

SEQ ID NO: 197946 - RNA, 64 nt, Human
gugcccuuuagccagaugcuaggcugucugcgaagaaggcuaggaguucauagaagggaguggg

SEQ ID NO: 197947 - RNA, 64 nt, Human
uuaguaaugcacuugccauuuggugacacagacugaaggcuauccuacaccugggccuuaccuc

SEQ ID NO: 197948 - RNA, 54 nt, Human
cucagcccaucuggcaguagggaugaaggcuaguuccagccccaguccaaaaua

SEQ ID NO: 197949 - RNA, 54 nt, Human
ccaugauggaugaguuauagcuguucugaccaggcguccucugcccccagggag

SEQ ID NO: 197950 - RNA, 64 nt, Human
ccaggggucauuugagagguuugacaguaucuuuucugaccaguugccacaugacuugcuugac

SEQ ID NO: 197951 - RNA, 64 nt, Human
gagugaugacagcucagcguccccacucaguguaucugaccauguguguaagugcacaaaaaug

SEQ ID NO: 197952 - RNA, 64 nt, Human
ugaaaacuuuuucauuguccuaaaucacccugacucugaccagucuuucaguucuccaaaagcc

SEQ ID NO: 197953 - RNA, 64 nt, Human
acauuuggaaacucacugccuuguucuguuucucucugaccaccagugcaugcagccccuguca

SEQ ID NO: 197954 - RNA, 64 nt, Human
aaguucucagaauaacuaccuccucacuuggcugucugaccagagaaugcaccucuuguuacuc

SEQ ID NO: 197955 - RNA, 64 nt, Human
uucagccuucuuuccuguagccuagcauggagaaucugaccagaccccauuuugagaaggucag

SEQ ID NO: 197956 - RNA, 64 nt, Human
ccugacacauucugaguaacaucagcaggaaugcucugaccaugagguggggguuuuggggugg

SEQ ID NO: 197957 - RNA, 64 nt, Human
agaaaugugcaagcacccugaucucacucccagcucugaccaaauacagaauuuuagagaacau

SEQ ID NO: 197958 - RNA, 64 nt, Human
uacuggccuuuguuucacauguccucauucucagucugaccagaaugcagggcccugcuggacu

SEQ ID NO: 197959 - RNA, 64 nt, Human
uugccacugugaagcuugauuucugcuggugacuucugaccauaagcuagaaccauggucgcca

SEQ ID NO: 197960 - RNA, 64 nt, Human
ugccccagcuaggaagcaagaucgcugugcuaggucugaccaaaaccagagggcagucuagucc

SEQ ID NO: 197961 - RNA, 64 nt, Human
cugggcaguguccgagagagcaccccucucugcaucugaccacgugcuacccccaugcuggagg

SEQ ID NO: 197962 - RNA, 64 nt, Human
ccagggaagccucggugccagaguggugggcagaucugaccauccccacagaccagaaacaagg

SEQ ID NO: 197963 - RNA, 64 nt, Human
uagggguggauugggaggugaguggaggagagucucugaccagcugcagagccaaccccuauca

SEQ ID NO: 197964 - RNA, 64 nt, Human
uaaugcacucgucauuugcauacgacaguagcauucugaccacacuuguacgcuguaaccucau

SEQ ID NO: 197965 - RNA, 64 nt, Human
augauuucugauaaaauggucccuaacucaacuagaaggcuaaaaauacaagaaugaaagaaua

SEQ ID NO: 197966 - RNA, 64 nt, Human
uggucuuuuuacccccccuuuccccucccuccuugaaggcuaccccuugggaaggcuggugccc

SEQ ID NO: 197967 - RNA, 64 nt, Human
uguaugcugggauacccauuaaaaccauuuucuagaaggcuaccaugagcugcacuuuuugggg

SEQ ID NO: 197968 - RNA, 64 nt, Human
augcuuuuaaauucuuaaccuuauauguugugcuucugaccauuuucucuuuuccucucuuucc

SEQ ID NO: 197969 - RNA, 64 nt, Human
aaggugagggugagcagagauguguguggacaucucugaccauccaucgcuguauucaaaugga

SEQ ID NO: 197970 - RNA, 64 nt, Human
cacugugaggcacugaaauuuugccuucagagguucugaccagauuggcugcugaaauagcccc

SEQ ID NO: 197971 - RNA, 64 nt, Human
aggaggcauccuuugcccagagcugcuuagcuaaucugaccaaauguugggaaaaaugucucac

SEQ ID NO: 197972 - RNA, 64 nt, Human
gcagaauaaaaggagcagaauauaaaauccaaagucugaccaguuuguaaagaaaaacaaaugg

SEQ ID NO: 197973 - RNA, 64 nt, Human
aauauuuuuaaacuauagcuuacaaaauacauucucugaccacagucuccuccuugauauacaa

SEQ ID NO: 197974 - RNA, 64 nt, Human
gaggugaugucauccuggaaaacuggguaguucaucugaccaugggauguguuuguuaugaaga

SEQ ID NO: 197975 - RNA, 64 nt, Human
uuugaucaaaccaaaagcaacauuugucauguggucugaccauguggagauguuucuggacuug

SEQ ID NO: 197976 - RNA, 64 nt, Human
acaaagaauuaaaaacugguaacaccacaggcuuucugaccauccauucguuggguuuugcauu

SEQ ID NO: 197977 - RNA, 64 nt, Human
uuuuuccugggaaaacaacugucucuuggaauuaucugaccaugaacuugcucuucuagacaac

SEQ ID NO: 197978 - RNA, 64 nt, Human
cagcucuugguuaauuuagguucauggggaacccucugaccaccugaaugggaugucauagcuu

SEQ ID NO: 197979 - RNA, 64 nt, Human
auuggguaucuuggugcugccuguauuggucccuucugaccacucuccugccuccagagaaagc

SEQ ID NO: 197980 - RNA, 64 nt, Human
ucaaaaauuaaagaauuuuguuuguuauuguuguucugaccauauugaaaagagguucacuuuu

SEQ ID NO: 197981 - RNA, 64 nt, Human
uugugcuguagccauauggaacuccuuucaguucucugaccaugcccuuuccugccucagauuu

SEQ ID NO: 197982 - RNA, 64 nt, Human
uaauuuuacacaguacucaaagcuuguuaucuuuucugaccauuuuaguacagaauuaguacuu

SEQ ID NO: 197983 - RNA, 64 nt, Human
ccuucacguacugucccuaguucagccuagaaauucugaccagcaccucaguuucccucagagg

SEQ ID NO: 197984 - RNA, 64 nt, Human
auaaauauuaaauuaaacuguauuguuauuaguagaaggcuaauuguaaugaagacauuaauaa

SEQ ID NO: 197985 - RNA, 64 nt, Human
aaaaaaaaaaaaaaaaaggagagaagaaaauaaagaaggcuaauauauaauuuuucuuaauagc

SEQ ID NO: 197986 - RNA, 64 nt, Human
gcaauuccugauccguucacaugaaugcaaaccugaaggcuaugaauucugucacaaccgcaag

SEQ ID NO: 197987 - RNA, 64 nt, Human
cagucagcauuaaugaaacucauguuuaaacuucucugaccacaucgucaggauagaauucuaa

SEQ ID NO: 197988 - RNA, 64 nt, Human
ucuuucucauauuuccuaagcaaggauucucacuucugaccauauuuggguuagaguucuguuu

SEQ ID NO: 197989 - RNA, 64 nt, Human
gguauuguaaagaucuggggaccucugggucuguucugaccauucccuagucuccauggccaag

SEQ ID NO: 197990 - RNA, 64 nt, Human
gacuguauccuagggcgauccaguugugcagccuucugaccaucagccaagggaagcaggccuc

SEQ ID NO: 197991 - RNA, 64 nt, Human
ccauuucccacuacgggcaccuaaaagaagcaucucugaccagaagacaaaggcccaaauagca

SEQ ID NO: 197992 - RNA, 64 nt, Human
cgcacagcucucagaagcugcaggcggacgaacaucugaccaaagagguguggucgaggcuccu

SEQ ID NO: 197993 - RNA, 64 nt, Human
cuccaccuuggauuuuucucuccaucacaucauuucugaccauuugcucccuuccauucuugaa

SEQ ID NO: 197994 - RNA, 64 nt, Human
cagcucugagagcaacaguuucccauuaacucuuucugaccaauagugcuggcaccguugcuuc

SEQ ID NO: 197995 - RNA, 64 nt, Human
gaguuucuuauucuagaacacuuggagccugaacucugaccaggccccucacuugagccuuugc

SEQ ID NO: 197996 - RNA, 64 nt, Human
auuguagugaugaaaugugcagucuaagguuuaaucugaccaagaaauuggaauugaaaacagg

SEQ ID NO: 197997 - RNA, 64 nt, Human
ugcuaugcacaguuccucccagcaaccuucccucucugaccaauggggccucuaggcucugccc

SEQ ID NO: 197998 - RNA, 64 nt, Human
uacacaccccuaagaaaaggcaagacuugaacguucugaccaggugccccucuucuucuuugcc

SEQ ID NO: 197999 - RNA, 64 nt, Human
gauacaggguuuuagaucauuacaguuuaaguuuucugaccaauuaaaaaaacauagagaacaa

SEQ ID NO: 198000 - RNA, 64 nt, Human
caucucauugcucuggcugaguugugugccuguuucugaccaaucacugagucaggaggaugaa

SEQ ID NO: 198001 - RNA, 64 nt, Human
guuugcauuccugggauuuauccucaagugcauuucugaccauaaguaauuuuaauucauuuca

SEQ ID NO: 198002 - RNA, 64 nt, Human
ucauggacugaaacucagcagggacucugggaagucugaccaaguuggagcagaugguuuguua

SEQ ID NO: 198003 - RNA, 64 nt, Human
uaucaauaccaaauagcuucuguuuuguuuugcugaaggcuaaauucacagcgcuaugcaauuc

SEQ ID NO: 198004 - RNA, 64 nt, Human
uguggccuuuuuauggaaacagagcaagaucaaugaaggcuaauggcaagaauaagaaaaagag

SEQ ID NO: 198005 - RNA, 64 nt, Human
uuguuuaaaauuagaacuuuucagaaugccaaaugaaggcuaaaauuuuggccagaacauuaca

SEQ ID NO: 198006 - RNA, 64 nt, Human
acugcugaaaaacaaaggguuuaaggaugacauuucugaccauuuguguguuuguuguuguuac

SEQ ID NO: 198007 - RNA, 64 nt, Human
aggcccacggucacugugggcuggggugauggugucugaccaguggggagauuggaaugggauu

SEQ ID NO: 198008 - RNA, 64 nt, Human
auuaauggaauuggugucagaugcuggaauuuauucugaccaaugaacacagcugacucagggg

SEQ ID NO: 198009 - RNA, 64 nt, Human
uuuucucucauuuucuucccucucucccuccaucucugaccacccccacccuaaccccccaccc

SEQ ID NO: 198010 - RNA, 64 nt, Human
aucaggugcucaaucaucuucuccuggccaaggcucugaccaugcuuaguacuggaauagaggu

SEQ ID NO: 198011 - RNA, 60 nt, Human
acaccuuccuguggucgugagaacagugagucugaccaauggccagacacaugccugcaa

SEQ ID NO: 198012 - RNA, 64 nt, Human
uccucaguacacuucaugaagucuacuugcagguucugaccaagaacaaagacaaccacaaccu

SEQ ID NO: 198013 - RNA, 64 nt, Human
ccugcccacccuucgcucacgccccagcgcccucucugaccagccuccgcuugguggccuuccu

SEQ ID NO: 198014 - RNA, 64 nt, Human
aagcagagaaugacagcaaacagaucacuaggccucugaccacaggugcugaguacucagcagc

SEQ ID NO: 198015 - RNA, 64 nt, Human
ucaggaugauacacuaugaagauguuucaaaaaaucugaccaaaacaaacaaacagaaaacaga

SEQ ID NO: 198016 - RNA, 64 nt, Human
agccccccaaagacacuaccacuccccauccccgucugaccaagggcugacuucuccaggaccu

SEQ ID NO: 198017 - RNA, 64 nt, Human
ugaaucaggugucaagguaccauuugugccuggaucugaccaauagaccaagguaaaaaucuca

SEQ ID NO: 198018 - RNA, 64 nt, Human
auuaaagguaucacggucgccaccuggcauuccuucugaccacagcaucauuuugcauucaaau

SEQ ID NO: 198019 - RNA, 64 nt, Human
uuuagcaucugacugauuuuguuacgggguugauucugaccauaggaaguaugcaaugugaauc

SEQ ID NO: 198020 - RNA, 64 nt, Human
aaggaagcuguggugugaaaauguauggaugaauucugaccagagcuaugaaucugguugaugg

SEQ ID NO: 198021 - RNA, 64 nt, Human
gcauaugauuuugcaucagcuagacugaguugauucugaccagacuugaugguuuuaagucgga

SEQ ID NO: 198022 - RNA, 64 nt, Human
agacuguuauacugcaccacgggagugcugcugagaaggcuagaaggagauacagcucuacaag

SEQ ID NO: 198023 - RNA, 64 nt, Human
ccccuacaggguuuagaaccuaaguauuagagaggaaggcuauuuaauggaaguuaguguaagc

SEQ ID NO: 198024 - RNA, 64 nt, Human
auuauauugaaaugcugcccuagaaguacaauaggaaggcuaaauaauaauaaccuguuuucug

SEQ ID NO: 198025 - RNA, 64 nt, Human
aaggauucagauggugcacuggccccgggaggagucugaccaaaaauggagcccgcucuguggg

SEQ ID NO: 198026 - RNA, 64 nt, Human
gugccugaggcagcuaggggcuucugcucucaucucugaccagcagaauccacccggugaccag

SEQ ID NO: 198027 - RNA, 64 nt, Human
ugcacugaacugccuuugaaaggaaauugcauguucugaccauuuuaggauaccuuuacuuuaa

SEQ ID NO: 198028 - RNA, 64 nt, Human
uaaagcuuucuuuucuguaaguuuaaguuuuccaucugaccauagcagaaaaaccuagacccac

SEQ ID NO: 198029 - RNA, 64 nt, Human
auauuugaaaccauggauacucuaauuucucugaucugaccacuauaaauuauauguauugaaa

SEQ ID NO: 198030 - RNA, 64 nt, Human
ggugagagagaugcuuauuaugacuauuaucauuucugaccaagcuucuauuaauguuauuucu

SEQ ID NO: 198031 - RNA, 64 nt, Human
ggcccugcugucgggccccaggccguuguccugcucugaccacagaguuuuaauguuuugguuu

SEQ ID NO: 198032 - RNA, 64 nt, Human
caagacuguuagcccucaaacuugacucuacugaucugaccauuucccucucaucgccagacaa

SEQ ID NO: 198033 - RNA, 64 nt, Human
aauucuccacugugcacacccaccuuuggaaagcucugaccacuugaggccugaucugcccauc

SEQ ID NO: 198034 - RNA, 64 nt, Human
caaagagaaucccacauuagcuuguuaguaaugcucugaccaagccgagaugcccauucucuua

SEQ ID NO: 198035 - RNA, 64 nt, Human
gagugaagagaacagaccauugaaaagacuauuaucugaccagcggaggcagaaaagagaggaa

SEQ ID NO: 198036 - RNA, 59 nt, Human
gucucgacaugaugagcugacccgacuuuucugaccaugugcggagcagccuuuaucaa

SEQ ID NO: 198037 - RNA, 64 nt, Human
caucaguuuguuccuuuuguacuguaucuauucuucugaccaucuagugacucaggauauuagg

SEQ ID NO: 198038 - RNA, 64 nt, Human
gagucagggacugcagcugagcgcaacugccccaucugaccacugacucaaauacgaacugcuu

SEQ ID NO: 198039 - RNA, 62 nt, Human
aggcagaauauuuuacucuuuaaaauccugccuuucugaccaaaaaaaaaaaaaaaaauuca

SEQ ID NO: 198040 - RNA, 64 nt, Human
auauucauguuugaggucauaaaauugucucuggucugaccaaacagaagucaucuuuacagag

SEQ ID NO: 198041 - RNA, 64 nt, Human
ggugggaguaugucacucacagcaaacuuggaaagaaggcuaugacucccaagaggcagugaac

SEQ ID NO: 198042 - RNA, 64 nt, Human
agaaacacuaagcucucugggccuggguuccagggaaggcuaagcauggccuggacugacugca

SEQ ID NO: 198043 - RNA, 64 nt, Human
cagaugaugaaguacuggcagauuugcaggcugggaaggcuagacuuccucagcccgagggcug

SEQ ID NO: 198044 - RNA, 64 nt, Human
aggaccacaacucagaggcugcuuggcccuccccucugaccagggacauccugaguuugguggc

SEQ ID NO: 198045 - RNA, 64 nt, Human
gagauuacagaggaaguuauccucugccucccauucugaccacccuucucauuccaacagugag

SEQ ID NO: 198046 - RNA, 64 nt, Human
agugauuuggggugaguaggcuucaauucccagcucugaccagacuugcugugugaccuugggc

SEQ ID NO: 198047 - RNA, 64 nt, Human
uuccucuccuuuuccucauuuauuccuaaaggaaucugaccauuuuacgucucuacggcccaaa

SEQ ID NO: 198048 - RNA, 64 nt, Human
aguuuugcuuguugugugcuugaaagaaaauaucucugaccaacuucuguauucguggaccaaa

SEQ ID NO: 198049 - RNA, 64 nt, Human
ccguuccugcugcggccuggccguucuuggggaaucugaccacggcgugcaaacugggacugcc

SEQ ID NO: 198050 - RNA, 64 nt, Human
acuggguggaugguugugauuugggggcugcuucucugaccauucuuuuugacuguaaugaauc

SEQ ID NO: 198051 - RNA, 64 nt, Human
cacaauuccuccucuggccacaucuccuguggucucugaccaggugcuguuuuuguucuacucu

SEQ ID NO: 198052 - RNA, 64 nt, Human
ugauuucaagaccuucuccccauucugccuccauucugaccauuucaggggucgucaccaccuc

SEQ ID NO: 198053 - RNA, 64 nt, Human
ugagaggccagagggaccauaguguugggcacugucugaccauguugcauuuggaaggcuaaau

SEQ ID NO: 198054 - RNA, 64 nt, Human
gucaggcuaguggagagaugaccagguguacaguucugaccauccuguguuguaaguacccgug

SEQ ID NO: 198055 - RNA, 64 nt, Human
ucugcugacccaggguuuccccuuccccuucccuucugaccagccuuggaggcucagcaucugu

SEQ ID NO: 198056 - RNA, 64 nt, Human
uuuagcaugugcaauacuuucugugccaauagagucugaccagugugcuauauaguuaaagcuc

SEQ ID NO: 198057 - RNA, 64 nt, Human
cugguuggauggcucugauguggggggcugcugcucugaccauucauuuugccucuaaugaauc

SEQ ID NO: 198058 - RNA, 64 nt, Human
uuagcagacuuuggaguuccccauucugccacauucugaccaugagacgcggcuugcagugggg

SEQ ID NO: 198059 - RNA, 64 nt, Human
auuucgguggcuagucaagcuccuccucccugcaucugaccagcagcgccuuucccaacucuag

SEQ ID NO: 198060 - RNA, 64 nt, Human
cagacaguauacccaaacuuuuauauaauauacagaaggcuaucacacuugugaaauucucuug

SEQ ID NO: 198061 - RNA, 64 nt, Human
uccuucauauuuuuucugugaauuuauaggcuaggaaggcuauugaagccucaauuaugggucu

SEQ ID NO: 198062 - RNA, 64 nt, Human
aguaaguuuuuauaccaugauaggggaaaaccuggaaggcuaagagaugugcuguuuuccuuca

SEQ ID NO: 198063 - RNA, 64 nt, Human
uuuggaucagucuuugugauuucauagcgaguuuucugaccagcuuuugcggagauuuugaaca

SEQ ID NO: 198064 - RNA, 64 nt, Human
agaggaacuagaaaagagauuuuguugccuguuuucugaccaucuguguuauugucacugagaa

SEQ ID NO: 198065 - RNA, 64 nt, Human
gagcggaugcuuucaugcacccuuuacugcacuuucugaccaggagcuacuuugaguuuggugu

SEQ ID NO: 198066 - RNA, 64 nt, Human
gggccacaguccagcagcgccagaagcacucauuucugaccaccaggcuaugacguuccugcug

SEQ ID NO: 198067 - RNA, 64 nt, Human
ccuccugcagguagcagggcgccaagcagugacuucugaccaacagaguguggggagaagggau

SEQ ID NO: 198068 - RNA, 64 nt, Human
agcaguguguaaaguaaguaaucuuuaacugaacucugaccacuuaaaaaaaaaucuaaaaauu

SEQ ID NO: 198069 - RNA, 64 nt, Human
cagcauguugugcucggacaagcuguuuccuucuucugaccaacccaggugugaccuggggaug

SEQ ID NO: 198070 - RNA, 64 nt, Human
gggcuaacacuucacagagggucacaguccaugaucugaccaacuaagcuuuuaaaaaucaacu

SEQ ID NO: 198071 - RNA, 64 nt, Human
aaugggaaggaaagaaggccaagggaauucagauucugaccagccagguaaggcucaaggccug

SEQ ID NO: 198072 - RNA, 64 nt, Human
ccagugucgucgugagggugggacccugugaaggucugaccaccguuucgcuuuuguuaaugcc

SEQ ID NO: 198073 - RNA, 64 nt, Human
cccugcuggggaaaguacaaccugaauacccuuuucugaccaaagagaagcaaaaucuaccagg

SEQ ID NO: 198074 - RNA, 64 nt, Human
ggugguuuaaaaaaagggucagacuuuuaaacacucugaccauagaaauguuuuucaaaauggc

SEQ ID NO: 198075 - RNA, 64 nt, Human
agggagggcucagcuguccccagauccaggugccucugaccagccuggucaccuccugaggaau

SEQ ID NO: 198076 - RNA, 64 nt, Human
cuguccugguuccugaggcacauccuaacgcaagucugaccauguaugucugcgccccuguccc

SEQ ID NO: 198077 - RNA, 64 nt, Human
caauauauugccaugaggaccccaccuuggagggucugaccaucuucaccuguuccgcagagaa

SEQ ID NO: 198078 - RNA, 64 nt, Human
gcuuuucuguucuauuauaaaacugucgauguauucugaccaaggugcgacaaucuccuaaagg

SEQ ID NO: 198079 - RNA, 64 nt, Human
gcuuuucagugucuucucagaaacaaccagccuugaaggcuacaacugacgaggaagacucugu

SEQ ID NO: 198080 - RNA, 64 nt, Human
gugaacuguggcuguauaugcaugcucauugugugaaggcuagccuaacagaacaggagguauc

SEQ ID NO: 198081 - RNA, 64 nt, Human
uucugagaaacauaaauuuacauauuuuucaacagaaggcuaucaaaauuuuaauuaaguuuaa

SEQ ID NO: 198082 - RNA, 64 nt, Human
cccuguggaagaugcaugguugcauccuuuuccuucugaccaacacuuagucuuuaacuuugua

SEQ ID NO: 198083 - RNA, 64 nt, Human
gugaauguacaaacuguugguggcccugaauccaucugaccagcugcugguaucugccaggacu

SEQ ID NO: 198084 - RNA, 64 nt, Human
gaagagaggaggauuuguuuauugucacugggaaucugaccacuauacuguccuuuuuuuguau

SEQ ID NO: 198085 - RNA, 64 nt, Human
uccuucuuuucuucuccgaucuuuuuucuuggcuucugaccaaaaaccaagcucuaccccaucc

SEQ ID NO: 198086 - RNA, 64 nt, Human
agccaggauucugaggaaaguccuguggggagauucugaccacugucccauaggauucugauuu

SEQ ID NO: 198087 - RNA, 64 nt, Human
aucccaggaaccauggaauuauucccaaauggacucugaccagauuuuugccauacuggggggu

SEQ ID NO: 198088 - RNA, 64 nt, Human
aaauaaaauaaaaagucaauuuagaaugugaaauucugaccaccuuuuggcuuugaguauuuuc

SEQ ID NO: 198089 - RNA, 64 nt, Human
caucacuugaguauucuagcagucauucuccuaaucugaccacuuucagguuuaguuuaccugg

SEQ ID NO: 198090 - RNA, 64 nt, Human
uaauaaacacguggcuugccauucaagagaugagucugaccauucacuuucugugugccagaga

SEQ ID NO: 198091 - RNA, 64 nt, Human
gcucugaauauguccuuguccuuccugacccaucucugaccagcugggaaccugcuuggggucc

SEQ ID NO: 198092 - RNA, 64 nt, Human
auguuuuugacaguuuuaagagcagucuuuuggcucugaccauuucuuguucuguuuccaauga

SEQ ID NO: 198093 - RNA, 64 nt, Human
uuuuuucccuacaucucuuuuggccaaaagaauaucugaccaucacagagauccagagaacaga

SEQ ID NO: 198094 - RNA, 64 nt, Human
gccuucucugauucauucacaaaacuguggugguucugaccaccugugacgaggggggucauaa

SEQ ID NO: 198095 - RNA, 64 nt, Human
cugacccaccaucuucagaaggacccaugucaggucugaccauugggagcaaagccauguucac

SEQ ID NO: 198096 - RNA, 64 nt, Human
gagcacgcuccaugccaggaggcaucuguugauuucugaccauuaucaagaguuguaggaugca

SEQ ID NO: 198097 - RNA, 64 nt, Human
auacucuaaaaagcaugcagcauggugccccucuucugaccaacacacacacgaccccuccccc

SEQ ID NO: 198098 - RNA, 64 nt, Human
aaaugauauuaaauaugaacaucagaauuacuuugaaggcuacuauuaauaugcagacuuacuu

SEQ ID NO: 198099 - RNA, 64 nt, Human
uagaugcauccugguuaucuggaagcaugggaaagaaggcuacuuaucucuuuguauguggcuc

SEQ ID NO: 198100 - RNA, 64 nt, Human
aagaagguguuagcccagcuaacuuugcuucugggaaggcuaugucugaacauguugcucugua

SEQ ID NO: 198101 - RNA, 64 nt, Human
gacuugcugaucaacagaaggaaauggucugaagucugaccagcacaaggaaggaggcuggcug

SEQ ID NO: 198102 - RNA, 64 nt, Human
ggauuuuuuuuuuuuuuuucccacuaacuuuguuucugaccaaagugaauuggaggcacucugc

SEQ ID NO: 198103 - RNA, 64 nt, Human
uguugaaguuucugaagguugacgucacuggaagucugaccacaaacaaguuggcuguuacugu

SEQ ID NO: 198104 - RNA, 64 nt, Human
uaaugcugcuacaagauguuucuguuucuuagauucugaccaugacucauaagcuucuugucau

SEQ ID NO: 198105 - RNA, 64 nt, Human
uaguguggcaaauugugcagaguaguuuauuccuucugaccaucauagaggagacauuaaauaa

SEQ ID NO: 198106 - RNA, 64 nt, Human
caccucgcugcuguuccacugucugcucccguguucugaccacagcucuggugccguuucucaa

SEQ ID NO: 198107 - RNA, 64 nt, Human
ugacugcagcuugccaaaucuuuguguuucugggucugaccaauuagcuuaguucuucuccugc

SEQ ID NO: 198108 - RNA, 64 nt, Human
cucugggugccaaaugaugggaagaugagcuucaucugaccauuucuucucccugucuccuguu

SEQ ID NO: 198109 - RNA, 64 nt, Human
aguccaaauauuuaacaaucagaaggggcaaggcucugaccagugacagucagaccuccugcuu

SEQ ID NO: 198110 - RNA, 64 nt, Human
guggccggugguuuugugcuuuaaaaaugcaauaucugaccaagauucgccaaucucauacaag

SEQ ID NO: 198111 - RNA, 64 nt, Human
ccccacugcaucugggcugcagggccagagcuagucugaccauuaggucagucugccuccugac

SEQ ID NO: 198112 - RNA, 64 nt, Human
aaacacaauugugcugaaucugucugacuauaacucugaccacacagaaccagggcugccccug

SEQ ID NO: 198113 - RNA, 64 nt, Human
cguaaacuaaguaaauacacaaaauguugauuuuucugaccauaagacguauuuuauguccuuu

SEQ ID NO: 198114 - RNA, 59 nt, Human
ucacuguguuccccaagugagccagcagaucugaccacuguucuccagcaggccucugc

SEQ ID NO: 198115 - RNA, 64 nt, Human
agcggcagcucugcgccaucuaccggcugaacuuucugaccacagcccccagcaggggaggccc

SEQ ID NO: 198116 - RNA, 64 nt, Human
gaauucgguccugaaaaacacuaauuugcugcuuucugaccaaauguuuuuccaucuguguaca

SEQ ID NO: 198117 - RNA, 64 nt, Human
agauuaggagauauuuuaggccccugcaacuggggaaggcuacuguuuguuuuuguuugcuuau

SEQ ID NO: 198118 - RNA, 64 nt, Human
cuggcagccucugaccuuucccugggcuucaaaggaaggcuauggaguuugcugugggcccugc

SEQ ID NO: 198119 - RNA, 64 nt, Human
ugggaguagcuaguuugcuuuuugcguacacagagaaggcuauguaaacaaaccacagcaggau

SEQ ID NO: 198120 - RNA, 64 nt, Human
ggcagacgugcaccugggcccguggggagcuuguucugaccagacguacagauuuucauucuca

SEQ ID NO: 198121 - RNA, 64 nt, Human
uccuggacccuuuagccucucugcccuuccacucucugaccaccgcccccgcccuccccaccca

SEQ ID NO: 198122 - RNA, 64 nt, Human
gcacugaaaauaccaucaggccuaaucucauaccucugaccaacaggcuguucugcacugaaaa

SEQ ID NO: 198123 - RNA, 64 nt, Human
caguuaagacaacaggcauuuucuuucuuuuuucucugaccaccugcagccuguugaaggacua

SEQ ID NO: 198124 - RNA, 64 nt, Human
ccugccuuuggcagcugcaagcugagguggcagcucugaccaccucuggccccaggcccucagg

SEQ ID NO: 198125 - RNA, 64 nt, Human
uauggucaccuuggagggcagaccuaggagccccucugaccacugaauccgucuccacaccccu

SEQ ID NO: 198126 - RNA, 64 nt, Human
acaggcaagagccucacaagugggacucugggccucugaccagcugugcggcaugggcuaaguc

SEQ ID NO: 198127 - RNA, 64 nt, Human
uguaccaaauuuugugcauauauuuuuuauuuaaucugaccagccacccaaaccauggguauuu

SEQ ID NO: 198128 - RNA, 64 nt, Human
acagggugacaguggugggccccugauguaccaaucugaccaguggcauguggugggcaucguu

SEQ ID NO: 198129 - RNA, 64 nt, Human
ucuuuuggggcagccuguugaaacugaagcacagucugaccacucacgauaaagcagauuuuuc

SEQ ID NO: 198130 - RNA, 64 nt, Human
aacacaaaugggauugguacuuuauaguaauaaaucugaccagcagagggagggaucaggcagc

SEQ ID NO: 198131 - RNA, 64 nt, Human
ucucuaagggagcccucugcacucgugugcaggcucugaccaggcagaacaggcaagaggggag

SEQ ID NO: 198132 - RNA, 64 nt, Human
uuuuuuuguuuguuuuuuugccuaauuugcuuuuucugaccaagccuuguggcaccagcaaucu

SEQ ID NO: 198133 - RNA, 64 nt, Human
ucuggccuugcucucuuggcagggccccagccccucugaccacucugcagcucaccaugcagcu

SEQ ID NO: 198134 - RNA, 64 nt, Human
ggugaccaaugagcagugggcccuacucugcaccucugaccacaccuuggcaagucuuucccaa

SEQ ID NO: 198135 - RNA, 64 nt, Human
ucauucauucaacaaucauauacugauuagcuacucugaccagguccaguacuaacucugaaga

SEQ ID NO: 198136 - RNA, 64 nt, Human
ugcagcccucuggggagccugcggaaucuuuucugaaggcuacauggacccgcuggggaggaga

SEQ ID NO: 198137 - RNA, 64 nt, Human
uuggaguacacuuaucucuuguuuguguugaacugaaggcuaagucucaguggacauggaaaag

SEQ ID NO: 198138 - RNA, 64 nt, Human
ugaccucuuccuaaacuugaagcccugccucccugaaggcuaauuaaggguugcaguccuccuu

SEQ ID NO: 198139 - RNA, 64 nt, Human
aacaauucuuguaaaauacuuuuuugauuagccuucugaccaugauuaaaaugguguaccucaa

SEQ ID NO: 198140 - RNA, 64 nt, Human
cacccugaggacguguggagcuaaggucauaucaucugaccaggucuggaggcuggcgggaggc

SEQ ID NO: 198141 - RNA, 64 nt, Human
cugcaugauguuauuuuguaaacagaugacauuuucugaccaggcacaugccauccaauuuucu

SEQ ID NO: 198142 - RNA, 64 nt, Human
agagugaagaugaaccacaagcagauggaaguggucugaccacugccccuccaacucccaggga

SEQ ID NO: 198143 - RNA, 64 nt, Human
caagaccugggucaguucuuugcuggugguccccucugaccacaagcuucugccugaagauucc

SEQ ID NO: 198144 - RNA, 64 nt, Human
augcuugaggguauccaaguugaaaaagacaaaaucugaccaucagccagugacaguccuggca

SEQ ID NO: 198145 - RNA, 64 nt, Human
ucacaaucuguuuuguuuuuuuuuuuugucauugucugaccaaaauuccuucugcacaugaggc

SEQ ID NO: 198146 - RNA, 64 nt, Human
gggcccaggauccaaaggucaucaguccugcuuaucugaccaacuggcagugucuucuggcugc

SEQ ID NO: 198147 - RNA, 64 nt, Human
auuaauuuuugaugacauuuugaguuuuaagauuucugaccagcagucucuuaccuguauauuu

SEQ ID NO: 198148 - RNA, 64 nt, Human
uaagaauuccucacucugacaugacaguauuuuuucugaccaggagcugaaagacccugacauu

SEQ ID NO: 198149 - RNA, 64 nt, Human
gcgcaacaaagcaccacuuuuacuguugccuacuucugaccaagaagaaaaaggaccuuaguau

SEQ ID NO: 198150 - RNA, 64 nt, Human
cuucuguggcugacuguaauacuguacaacuguuucugaccauuaaaugcuguuguacucugug

SEQ ID NO: 198151 - RNA, 64 nt, Human
caagaccaagguauacaucuuccccuaaugccuaucugaccaaacuggauagaaccaccauagu

SEQ ID NO: 198152 - RNA, 64 nt, Human
uguuguacccuucauccaaaagucagcuugcuucucugaccacuuacagcuuucucacaugagu

SEQ ID NO: 198153 - RNA, 64 nt, Human
ucucaguuguuaaaaguauacccuggaccacccaucugaccaucuccuuaagguuucacccaaa

SEQ ID NO: 198154 - RNA, 64 nt, Human
acauucuggaacucucuccuuuccuggcuggggcucugaccacaaacuccccuccaggcugccc

SEQ ID NO: 198155 - RNA, 64 nt, Human
uaucaucuuuugaucuuuuaguuuuucccucagugaaggcuaaaugagauacacugauucuagg

SEQ ID NO: 198156 - RNA, 64 nt, Human
ccaggacucaggggagaagcaaacccccaggauugaaggcuaggguucuagggccuuugggugg

SEQ ID NO: 198157 - RNA, 64 nt, Human
auugacugucgauggauuguggugugguguaucugaaggcuauugaaugcaacuuacaaugcuu

SEQ ID NO: 198158 - RNA, 64 nt, Human
ggaaggucuaaccaggggguuuucaggggcauugucugaccacauucuuuuuguauccaaauag

SEQ ID NO: 198159 - RNA, 64 nt, Human
aaaauaaccauaagggagaaaccagaagaauuccucugaccacuuacaauuaaaauauuuuguc

SEQ ID NO: 198160 - RNA, 64 nt, Human
accaaaaagcuuuuccugagcuuugaauauuagaucugaccaauauggguaaccaaugcccuua

SEQ ID NO: 198161 - RNA, 64 nt, Human
guggcaucacagacuuuaucuacacacuuucgggucugaccacuaccucccacaauaccuagcc

SEQ ID NO: 198162 - RNA, 64 nt, Human
gggagacgcgggaaggguaggaaaauggacuguuucugaccagagacacuuaccuaaauauccu

SEQ ID NO: 198163 - RNA, 64 nt, Human
cuccuggacucagacugugcauguugggaaggggucugaccaggcaagcugugaucugaaagga

SEQ ID NO: 198164 - RNA, 64 nt, Human
gaaacauuaguacaucccugaaacugagcacauuucugaccauuuccagaaagcugcaaagauc

SEQ ID NO: 198165 - RNA, 64 nt, Human
aaacaaaaaaaaaaacccacaacccuuaucugguucugaccagugugcguguaacuuuaugauc

SEQ ID NO: 198166 - RNA, 64 nt, Human
gcuuggcauaggguggaaagggcuacccuggggcucugaccacacuguaguauguguggagggu

SEQ ID NO: 198167 - RNA, 64 nt, Human
ugcugcugguuuggcccauggcacagccagcuucucugaccaguaauccggggugacuugaggg

SEQ ID NO: 198168 - RNA, 64 nt, Human
cuggaugcauguuuuccagcuccucauccagggcucugaccaguuuaaccugaugcagucacgu

SEQ ID NO: 198169 - RNA, 64 nt, Human
cucucagugcgguguucugugacauccuuugcucucugaccaacuuaaugacuuuuguaugugu

SEQ ID NO: 198170 - RNA, 64 nt, Human
ugaacccaaauuugauagacugcuguuuuucuggucugaccaucgcaacccucaugaaguacaa

SEQ ID NO: 198171 - RNA, 64 nt, Human
aauguacauagacccucuuucuuguuugucagcaucugaccaucugugacuauaaagcuguuau

SEQ ID NO: 198172 - RNA, 64 nt, Human
ccccuacuuugauugacaaaggaaucaagguagaucugaccaguauuccccucucuucuccuug

SEQ ID NO: 198173 - RNA, 64 nt, Human
cggcccaguccucgcugcaguaaccccugggggcucugaccaccuaugggggccgggcaggagc

SEQ ID NO: 198174 - RNA, 64 nt, Human
caagugucuuaagcuguuuuauauuuguuacgaagaaggcuauugcuacaauauuuuuaaaggu

SEQ ID NO: 198175 - RNA, 64 nt, Human
gcauggaaucacuauuccugguuaucucaccaacgaaggcuaggaggcggcgucagaggugcug

SEQ ID NO: 198176 - RNA, 64 nt, Human
uaaaaccaaauauuaguuuuuauuaaacucaugggaaggcuaauauauuccaacguaaauuauu

SEQ ID NO: 198177 - RNA, 64 nt, Human
acgcacccucacuccccugcugccuucacuccuuucugaccaagcaacgcuaacuuuuguacag

SEQ ID NO: 198178 - RNA, 64 nt, Human
uacuauuuagucauuguccauuuacuauaauuuaucugaccauuucccuacuguaaaauacuua

SEQ ID NO: 198179 - RNA, 64 nt, Human
ggacccucugccccacucugggcuuuucagauacucugaccaaaaagccugcuuuaaaccgcaa

SEQ ID NO: 198180 - RNA, 64 nt, Human
uggcuucucucuggacugggagcucagugaggauucugaccagugacuuacacaaaaggcgcuc

SEQ ID NO: 198181 - RNA, 64 nt, Human
cccuauagaggggcugcuuuaugggaaguuuuucucugaccagguacaacaccugacuuuaaag

SEQ ID NO: 198182 - RNA, 64 nt, Human
ugggcucagaaaugucugugguauugggucagacucugaccacagguuuuaugcuguuuagcac

SEQ ID NO: 198183 - RNA, 64 nt, Human
uagagaguucuugcauuggaacuggcacuuauuuucugaccaucgcugcuguugcucugugagu

SEQ ID NO: 198184 - RNA, 64 nt, Human
ccaggagccggucagagauggaccuggccagaugucugaccacaccccaaucucagagcuaaca

SEQ ID NO: 198185 - RNA, 64 nt, Human
gagaccaagaaaucauugguaagaugaugguuagucugaccaguuucauguuaguaaauucacu

SEQ ID NO: 198186 - RNA, 64 nt, Human
acauugugaaacuucccggucuguucuguuccacucugaccaucggugcaugcagccccuguca

SEQ ID NO: 198187 - RNA, 64 nt, Human
uuuccuuggggaggggcacaggcucagccuccucucugaccaugacccaggcauccuugucccc

SEQ ID NO: 198188 - RNA, 53 nt, Human
ggaaauccaagaacuccuaguacucugaccagccagggccagggcagagaagc

SEQ ID NO: 198189 - RNA, 64 nt, Human
gcccugucagugcagcccguguggccccuucacuucugaccacacuuccuguccagagagagaa

SEQ ID NO: 198190 - RNA, 64 nt, Human
cccuguaucuaacuggggcugugaucaagaagguucugaccagcuucugcagaggauaaaauca

SEQ ID NO: 198191 - RNA, 64 nt, Human
guaugugcuaggcagucuggggacccccugugucucugaccaccccccugacccccgccauuac

SEQ ID NO: 198192 - RNA, 64 nt, Human
gaccccuucugcccccacugcccucauccaggccucugaccaguagccugagaggggcuuuuuc

SEQ ID NO: 198193 - RNA, 64 nt, Human
gccuuuggaacaccaagcucugugcugaaggguggaaggcuacccugacgcaccauaaucuaag

SEQ ID NO: 198194 - RNA, 64 nt, Human
gcugaaggaauggacgagcccugggaggagggcagaaggcuacgcagggcugaggaugaagaug

SEQ ID NO: 198195 - RNA, 64 nt, Human
ugaacacaucuugaguauuuaggaaaugggcagugaaggcuaagaaccugguguguuucuuggg

SEQ ID NO: 198196 - RNA, 64 nt, Human
agguggucacgucugggagcuagcuuguauggcuucugaccaguaucaggauuucuguucugag

SEQ ID NO: 198197 - RNA, 64 nt, Human
aucagugagacauaagccaacaagagaaaccaucucugaccacccccuccuccccaucccaccc

SEQ ID NO: 198198 - RNA, 64 nt, Human
ccuuuaguccucuaccucagagccccgagucauuucugaccaccccguucuguguccucacucu

SEQ ID NO: 198199 - RNA, 64 nt, Human
gacucccuuugccaccaaggcccccaccagggccucugaccaccgcucuggagaggacagugug

SEQ ID NO: 198200 - RNA, 64 nt, Human
ccguuucucuccccaucuuggcugcuguccugccucugaccaguggccgccccccacguuguug

SEQ ID NO: 198201 - RNA, 64 nt, Human
cucggucaccccaaccucuggcucugagcccuguucugaccaaaucaugaugaugaguauuugg

SEQ ID NO: 198202 - RNA, 64 nt, Human
agcacccucagagcccccgcccggcugugccccgucugaccaaaguuauaauaaaaacauuuuc

SEQ ID NO: 198203 - RNA, 51 nt, Human
cucuccccaggucucggugacucugaccacacccagcucaggacuggauuc

SEQ ID NO: 198204 - RNA, 64 nt, Human
ucuuccuggguuuugggauuugugcaguguggcuucugaccagcugcauagacauggcuccagg

SEQ ID NO: 198205 - RNA, 64 nt, Human
auauucaaacagaaagaauaagaacagccacugcucugaccacuucaaucuuagaugagguaaa

SEQ ID NO: 198206 - RNA, 64 nt, Human
ugccuuagaucuuuucagugaucuggauaaguguucugaccagggagugacagguuaugacauu

SEQ ID NO: 198207 - RNA, 64 nt, Human
acagugagaaggagcaggaaguugcuguuucuccucugaccagcccacacuccaaaggaaacag

SEQ ID NO: 198208 - RNA, 64 nt, Human
uugauccaaguguuuaacaauuggggcuguuaagucugaccauacaucacugugauagaaugug

SEQ ID NO: 198209 - RNA, 64 nt, Human
ccagacagguuuaauagcgaaucuaauuuugaauucugaccauggauacccaucacuuuggcau

SEQ ID NO: 198210 - RNA, 64 nt, Human
uuuaagacuuuucaaggaaaugguguuccucaguucugaccaaaccguuucacugucuugucug

SEQ ID NO: 198211 - RNA, 64 nt, Human
cuugaauaaaauguuacauuuauacuuugagaacucugaccaaaucuuucauacagauacaggu

SEQ ID NO: 198212 - RNA, 64 nt, Human
aaaaacaaugcauucuugcuuuaaaaaaaaaaaagaaggcuaaaaaauuaccucuuuuuaaauu

SEQ ID NO: 198213 - RNA, 64 nt, Human
gcuuuucagugucuucucagaaacaaccagcugagaaggcuacaagugacgacaaagauucugu

SEQ ID NO: 198214 - RNA, 64 nt, Human
gcuuuucagugucuucucagaaacaaccagcugagaaggcuacaagugacgagaaagauucugu

SEQ ID NO: 198215 - RNA, 64 nt, Human
aggucuuggcgccuuugcaaagugauagaaaagaucugaccaagugcaaaaaaaugcuuuuuaa

SEQ ID NO: 198216 - RNA, 64 nt, Human
cuuugggaggccgaggucaggaguuagagaccauucugaccaauaugaucaaaccccgucucua

SEQ ID NO: 198217 - RNA, 64 nt, Human; identical to SEQ ID NO: 198216

SEQ ID NO: 198218 - RNA, 64 nt, Human
uaugccucugcccuuguccuguggguugagggggucugaccaggaggccaccuacagcaggaag

SEQ ID NO: 198219 - RNA, 64 nt, Human
guguguugcgugaucugugaaaaauacaucucccucugaccacagacuccucaucuguggagaa

SEQ ID NO: 198220 - RNA, 64 nt, Human
uugcuucuuuaccaaggauauuuacagaaaagacucugaccagagaucgagaccauccuagcca

SEQ ID NO: 198221 - RNA, 64 nt, Human
uccccuucugguuccugugucucccaauaaacucucugaccaacccuagcugugcuucugcgag

SEQ ID NO: 198222 - RNA, 64 nt, Human
cggaggagaccccacuaacccagccugccugggcucugaccacuaacacucuuggccauggaca

SEQ ID NO: 198223 - RNA, 64 nt, Human
ugcuccagucuugcccagcucgaaggagagcagaucugaccacuugccagccccugucugcugu

SEQ ID NO: 198224 - RNA, 64 nt, Human
aggagccccggccacacacagcaagaaagauacaucugaccagccucaacgucaacguauuucc

SEQ ID NO: 198225 - RNA, 64 nt, Human
guagacauccgaggucauuuguugcguugaauuaucugaccauccuuuuuuacugugacucuuc

SEQ ID NO: 198226 - RNA, 64 nt, Human
auuccagaaagcaaaaggcuuacaaucccuguugucugaccacaguuuaaaauuaauuagaaac

SEQ ID NO: 198227 - RNA, 64 nt, Human
auuccuucccuuuucugacugauuacagcauacaucugaccaguuuuggccagaagggcccagc

SEQ ID NO: 198228 - RNA, 64 nt, Human
cuaauguggaaaagccuucagaagcuacucuguuucugaccagcccaggaaccuuugcagggcc

SEQ ID NO: 198229 - RNA, 64 nt, Human
ucugggcucagucagacacagacauucaucugugucugaccaaaucaggggacuuccccaccug

SEQ ID NO: 198230 - RNA, 64 nt, Human
cuauacauuaauacugguaucucgaggugacucuucugaccaagggugguuaagugacacauag

SEQ ID NO: 198231 - RNA, 64 nt, Human
ugcuucuuuuaugagguguacuuuauacuuugaugaaggcuaagguguaccuaacagcuuuuua

SEQ ID NO: 198232 - RNA, 64 nt, Human
ccucaucacucccccugccaagacaaaggguccagaaggcuaggacuuacuuaauagcacugug

SEQ ID NO: 198233 - RNA, 64 nt, Human
ggauggugucuuagaacccucauugcucagaccugaaggcuacuucuaggagcaugaaguuuga

SEQ ID NO: 198234 - RNA, 64 nt, Human
uucccuaccaaaugguggggacccugagcccagcucugaccagguagagccugugcagccuggg

SEQ ID NO: 198235 - RNA, 64 nt, Human
ccauuuuuagggaagggauuuuggcucaaaacgaucugaccaccucugcccuguccaccaggau

SEQ ID NO: 198236 - RNA, 64 nt, Human
cuucaacaguucggccaagcagaacugcuguaccucugaccacuuguguuaggaaaacuaucgg

SEQ ID NO: 198237 - RNA, 64 nt, Human
cuagaucuuuucucucgcuucucagcugaaucucucugaccauuccucuacuggagcccccaau

SEQ ID NO: 198238 - RNA, 64 nt, Human
cauuugacccucgucugugcccgcggagaccuccucugaccaaggggcacuaguaugccuugcg

SEQ ID NO: 198239 - RNA, 64 nt, Human
uaguuuguuucuacuuguuuaaagaaucuucuggucugaccacuuaaaguaaaaacuacaugau

SEQ ID NO: 198240 - RNA, 64 nt, Human
gcccagggcagugccugcucccagaaucuggugcucugaccaggccagguggggaggcuuuggc

SEQ ID NO: 198241 - RNA, 64 nt, Human
aggggugcagcuuuggagcccagaggugcgggauucugaccaacggcauuaaaacugaggcgag

SEQ ID NO: 198242 - RNA, 64 nt, Human
agaacuauacugacgaagccauugaaacagaugaucugaccauuaagcuggugaucaaggcacu

SEQ ID NO: 198243 - RNA, 64 nt, Human
gacugacacgaagccagcagaggucagaggggacucugaccacagcccgcucucuggcugucug

SEQ ID NO: 198244 - RNA, 64 nt, Human
gccggagaaccccauggugacacauuuucaucuuucugaccagaggcuguuuuuuuuuuuuuuu

SEQ ID NO: 198245 - RNA, 64 nt, Human
aguuuaacuguguuucuccgacagcucaccucucucugaccacccagccauuuccuuccugugc

SEQ ID NO: 198246 - RNA, 64 nt, Human
agcucucaccguacauacuccagucuaauuuaaaucugaccacaguugcauggucgcuuuacca

SEQ ID NO: 198247 - RNA, 64 nt, Human
caggaagaauucugccaaguaucuuuacugucauucugaccauagccucuuuguucccgcauuc

SEQ ID NO: 198248 - RNA, 64 nt, Human
aguccagcuuccagccgcucuggcucgaggguggucugaccacuuccuucugagugggcuucuc

SEQ ID NO: 198249 - RNA, 64 nt, Human
cacggccucaagguagugaggcuaggagguuuuuucugaccaauagcugaguucuugggagagg

SEQ ID NO: 198250 - RNA, 64 nt, Human
gcuuuucagugucuucucggaaaaaaccagccuugaaggcuacaagugaugagaaggauucuuu

SEQ ID NO: 198251 - RNA, 64 nt, Human
acuuuucagugucuucugagaaaccaccaggcuugaaggcuacaagugaugagaaagauucugu

SEQ ID NO: 198252 - RNA, 64 nt, Human
ugcuccuaaggacacagggcuggguugguaaagagaaggcuaugguugacuucuugcuugugcu

SEQ ID NO: 198253 - RNA, 64 nt, Human
ggaccggguuucucagccuuggcacuagugcuguucugaccauucucuguguuggggcuguccu

SEQ ID NO: 198254 - RNA, 64 nt, Human
ccucugggagccgcacccacaugacugcccugccucugaccagucuguuccggggcccccucag

SEQ ID NO: 198255 - RNA, 64 nt, Human
auuaaaaaaauuuaaguuuucccaagcuugcaucucugaccaaauuucacauaaaacauuggaa

SEQ ID NO: 198256 - RNA, 64 nt, Human
augcccccuuugcaaggccugcugcaguccccagucugaccagcaagucccggggucacccuug

SEQ ID NO: 198257 - RNA, 64 nt, Human
ggaacaagcgcagccagugaugagugaagaagaaucugaccaguaucuugcaguguugacguuu

SEQ ID NO: 198258 - RNA, 64 nt, Human
uccagguaagggccugccucagcgugguugggagucugaccagguaggacuugaaugauucggc

SEQ ID NO: 198259 - RNA, 64 nt, Human
aauuguucagggaauaagagagauaaccuuaaacucugaccaacagugagccugguggaacaga

SEQ ID NO: 198260 - RNA, 64 nt, Human
cugauugggcaccugaccacacgcccccacaggcucugaccagcagccuaugaggggguuuggc

SEQ ID NO: 198261 - RNA, 64 nt, Human
gccguggcuccauggccagaugacggaaacagggucugaccaagugccaggaagaccugugcua

SEQ ID NO: 198262 - RNA, 64 nt, Human
gggccucccggcuugucccagccccucuuuugcuucugaccacggaggcuuucucacagcccag

SEQ ID NO: 198263 - RNA, 64 nt, Human
cuacugguaguuaaaguaaaauucaguaacauuuucugaccaagagacauguuuuguuaaacaa

SEQ ID NO: 198264 - RNA, 64 nt, Human
cgaggaucuccaggcaggguucuccccucuggagucugaccaauuacuucauuuugcuucaaau

SEQ ID NO: 198265 - RNA, 64 nt, Human
accugcuuaugcauuuaucucuuuuguggacuugucugaccaccuucuauuugcccagaguuug

SEQ ID NO: 198266 - RNA, 64 nt, Human
acacacacacacaaacuucaaaaaugcuuaaccaucugaccauagugacuagccuauagugagu

SEQ ID NO: 198267 - RNA, 64 nt, Human
aaggaucucuagcauucauaacauucucaaagaaucugaccaaagaaagguaacaacuaucuuu

SEQ ID NO: 198268 - RNA, 64 nt, Human
cuugguuugguccccccacccgcugcucaguggcucugaccacacuccccucgcagcgucagug

SEQ ID NO: 198269 - RNA, 64 nt, Human
uuuuaaaaauugcauuuuuaccuuucaugugccugaaggcuauccacuacauucugaaggccuu

SEQ ID NO: 198270 - RNA, 64 nt, Human
gcaaccucuagcgauuaccauaauuuugcucauugaaggcuaucuccaguugaucauugggaug

SEQ ID NO: 198271 - RNA, 64 nt, Human
cugagccggagccauccuuucggugguaguuggggaaggcuaugcagauuugcucuguugugac

SEQ ID NO: 198272 - RNA, 64 nt, Human
cccaugaaacagcagcugaagccagcucccugaaucugaccacagacacuccuggggggccuga

SEQ ID NO: 198273 - RNA, 64 nt, Human
aaccagcagugaguagaucuucuuaauauagcugucugaccacauguggaaggcagcuagacuu

SEQ ID NO: 198274 - RNA, 64 nt, Human
uuuacugguugaaaaugggaagcaauaauauucaucugaccaguuuucucuuaaagccauuucc

SEQ ID NO: 198275 - RNA, 64 nt, Human
ugaggaauggagugggccaacacuauccagccacucugaccagccgaaccaggaacucaaucaa

SEQ ID NO: 198276 - RNA, 64 nt, Human
ugaggaauggagugggccaacacuauccagccacucugaccagccgaacgaggaacucaaucaa

SEQ ID NO: 198277 - RNA, 64 nt, Human
aauagcagcugcugccgugucauuaugcaaagccucugaccaguuugcugcagcauuuacaucu

SEQ ID NO: 198278 - RNA, 64 nt, Human
gacagagaccccccucggccucaaggauccucuuucugaccaucaagccugcuucuuggggggu

SEQ ID NO: 198279 - RNA, 64 nt, Human
caauacuauaccuuccucgcaacuaccugugaugucugaccagaacauuagcaaggccaaggaa

SEQ ID NO: 198280 - RNA, 64 nt, Human
aguguccauagauauaaagccauuuggucuuaauucugaccaauaaaaaaauaagucaggagga

SEQ ID NO: 198281 - RNA, 64 nt, Human
cucauuggcauuuuccaguauugugagaucaauuucugaccauaugaaaugugaaaaguauaug

SEQ ID NO: 198282 - RNA, 64 nt, Human
uuuaguuauuuuugguugagugcuaaauauuucagaaggcuacuuaacauguaagauaccaacu

SEQ ID NO: 198283 - RNA, 64 nt, Human
ucuacccggcugacagacaacacagaccugugccgaaggcuaauuuguggcuuuuacgacccua

SEQ ID NO: 198284 - RNA, 64 nt, Human
gaucauuuuaaauagcaagccaauaacgagcuuugaaggcuauuuuaccauuccuguucacaaa

SEQ ID NO: 198285 - RNA, 64 nt, Human
ggaaaagaggugcuuugugggaaaucacuaaugagaaggcuaaccugcagcaccagagaaaccu

SEQ ID NO: 198286 - RNA, 64 nt, Human
ucccuggauguguggggcaugguuccuucccugggaaggcuaaguucaguucuguuuuuuauuc

SEQ ID NO: 198287 - RNA, 64 nt, Human
uucuaauuagcuccuuuaaagcuugcaucuuugugaaggcuaacugaagauacgguuggaaagg

SEQ ID NO: 198288 - RNA, 58 nt, Human
aggaggagggacacuccagccccccucucuggcccacccaguccucugcccaagcccu

SEQ ID NO: 198289 - RNA, 58 nt, Human
acugcggagcagccuccagugcuggcugcuggcccacagcucugcuggaagaacugca

SEQ ID NO: 198290 - RNA, 58 nt, Human
cugggauuacagacaugagccacugcgccuggcccagcguuacuuuucuugauaagaa

SEQ ID NO: 198291 - RNA, 58 nt, Human
ccagaucagcccaaguuuacuauagagacuggcccaggcacugaaugucuaggacaug

SEQ ID NO: 198292 - RNA, 58 nt, Human
cugggauuacaggugugagccacagcgccuggcccaguguaauauuuuugaaagagga

SEQ ID NO: 198293 - RNA, 58 nt, Human
acccagcagacccugacuccagcagauucuggcccagggacaggaggaagagaugcca

SEQ ID NO: 198294 - RNA, 58 nt, Human
gggcaagaccuuugugcuuuugaucauucuggcccaugaaagcaacuuuggucuccuu

SEQ ID NO: 198295 - RNA, 58 nt, Human
gugcauuacaggauauuuagcagcaacccuggcccacucuaguuaugacaaccaaaaa

SEQ ID NO: 198296 - RNA, 58 nt, Human
ucuuuccugcccucugccaaccucccugcuggcccaggugagaggaggaagagggguc

SEQ ID NO: 198297 - RNA, 58 nt, Human
gggaccuaccccucccagggaccgaccccuggcccaagcuccccuugcuggcgggcgc

SEQ ID NO: 198298 - RNA, 58 nt, Human
caauaguaaucacgucugagccaaggagcuggcccauuggucauucacuucugcuaaa

SEQ ID NO: 198299 - RNA, 58 nt, Human
gggacuccuugccucucccuauggccugcuggcccaccucccuggaccccguuccacc

SEQ ID NO: 198300 - RNA, 58 nt, Human
acccugccccacagggaauggccuuggccuggcccagcccaagaucccagcguuaucu

SEQ ID NO: 198301 - RNA, 58 nt, Human
agcauauccugagacgccccucccuccucuggcccagccuacccuuguaccccauccc

SEQ ID NO: 198302 - RNA, 58 nt, Human
aaauccaguuuccauggcccuggauggucuggcccaccuccagccucagcuagcauua

SEQ ID NO: 198303 - RNA, 58 nt, Human
auagggacagccacaggccucuugcagacuggcccacccugccuacuucccuacugac

SEQ ID NO: 198304 - RNA, 58 nt, Human
cacagccugacauggccagguucucacacuggcccagagaaaagagccucagcaagag

SEQ ID NO: 198305 - RNA, 58 nt, Human
gaaccugagacucagagagugugagcuacuggcccaagauuauucaauuuauaccuag

SEQ ID NO: 198306 - RNA, 57 nt, Human
cagggugagccucgaaaaccccauagcacuggcccagagcacugcggucaauguccg

SEQ ID NO: 198307 - RNA, 58 nt, Human
ccucacagcuccuggggccuuccuggcucuggcccagaaagugauucauuuguaaauu

SEQ ID NO: 198308 - RNA, 58 nt, Human
gccacccaggcaggcccugccuucagcccuggcccagagcuggaacacucucugagau

SEQ ID NO: 198309 - RNA, 58 nt, Human
uuaacaaccccuucccuaacagguugggcuggcccagccuaggaaaacauccccauuu

SEQ ID NO: 198310 - RNA, 58 nt, Human
ccuccagacguccaccucagugcacgagcuggcccagaggcucucgggcagccggcuc

SEQ ID NO: 198311 - RNA, 58 nt, Human
cccagccagauuuuguguguguaaugggcuggcccaagaguguucuuuuacuuagaac

SEQ ID NO: 198312 - RNA, 58 nt, Human
gggacaggcuguucuguuggaagagucucuggcccagucaugcacaucuguagcccca

SEQ ID NO: 198313 - RNA, 58 nt, Human
uauuuaaggguggugaugggugagcgcucuggcccaggcugggccagacucccgccca

SEQ ID NO: 198314 - RNA, 58 nt, Human
agcaggcagaagcccguccuggguggugcuggcccaguuggugggaccccuguccaca

SEQ ID NO: 198315 - RNA, 58 nt, Human
aggggaugggcagaggucuguguuuggucuggcccaguuccccaucauuaaacucagc

SEQ ID NO: 198316 - RNA, 58 nt, Human
uccccuguccccaccccagugcacucuucuggcccaggcagcaagcaagcugugaaca

SEQ ID NO: 198317 - RNA, 58 nt, Human
uguggcugguaaggcaacugcuugaccacuggcccagcaagcagaggcgggcaggagg

SEQ ID NO: 198318 - RNA, 58 nt, Human
aaaucuaggcagugaacaagucuucauccuggcccaggaaauagccuauuaaaaaaug

SEQ ID NO: 198319 - RNA, 58 nt, Human
caugucaccacuggccaaaaagaagcuccuggcccaggugagcaagguggaggccuug

SEQ ID NO: 198320 - RNA, 58 nt, Human
accaacuggcuggcccuccuccucuucccuggcccauugaucaucccuucucacagag

SEQ ID NO: 198321 - RNA, 58 nt, Human
gguuccugggaugagccauacccuggaacuggcccacccacugugucuuccacguaag

SEQ ID NO: 198322 - RNA, 58 nt, Human
cuuguuacugcuacuacacuuugcuccucuggcccaaggcaugaggagagaggcugug

SEQ ID NO: 198323 - RNA, 58 nt, Human
ggcagggggagaggauggcccagcaggccuggcccagcucccaguucccccugcacca

SEQ ID NO: 198324 - RNA, 58 nt, Human
gguccugagcaggcggcagugaacagcacuggcccaccucccacucacagccccucug

SEQ ID NO: 198325 - RNA, 58 nt, Human
gacucccagcagagcccaccagccagcccuggcccaccccccagccuccagagaagcc

SEQ ID NO: 198326 - RNA, 58 nt, Human
cuggcuggggcugcuuugagcaaugacgcuggcccagagcagcuucccacaugacccc

SEQ ID NO: 198327 - RNA, 58 nt, Human
gccucuucugacccuuccaugcuggccccuggcccagcaggccugucuguggggacau

SEQ ID NO: 198328 - RNA, 58 nt, Human
cucccaacagccuggguucgguccuuggcuggcccaggcccaguuaagccuguggcca

SEQ ID NO: 198329 - RNA, 58 nt, Human
guggacagacccaggguggucuucaagccuggcccagugagagugaggcccccgcacg

SEQ ID NO: 198330 - RNA, 58 nt, Human
gcccucccccugccagaggccuggugcccuggcccagccuguggccucagcaucucau

SEQ ID NO: 198331 - RNA, 58 nt, Human
ucugguuccugggauccagugaucucuacuggcccagggcuucagcucuugguuaauu

SEQ ID NO: 198332 - RNA, 58 nt, Human
ccagcccccaggaagccugcuccccucucuggcccaugguccugcuucaugcuuuggg

SEQ ID NO: 198333 - RNA, 58 nt, Human
caacaacaaagugcaauacaggcugaaccuggcccaacagaaaaacccugccccaaug

SEQ ID NO: 198334 - RNA, 58 nt, Human
gcagggcuggccguagccagaccccaagcuggcccacugguccccucucuggcucugu

SEQ ID NO: 198335 - RNA, 58 nt, Human
guuuggacccacauagcugcaacccaagcuggcccauaaucagcaguggggcccagca

SEQ ID NO: 198336 - RNA, 58 nt, Human
cucuaugcccacugcccuccucccucuccuggcccagcaguauugcucacgggggcuc

SEQ ID NO: 198337 - RNA, 58 nt, Human
gacuucauccuuugcggcggcucugagccuggcccaucuuccuauucccacguguagc

SEQ ID NO: 198338 - RNA, 58 nt, Human
uuuccauugugucaagugcaaaacuacccuggcccaaaggaagggcagagaacauaau

SEQ ID NO: 198339 - RNA, 58 nt, Human
ccuccucgccgggccauucugauuggaccuggcccagugcaaucuguccagacaagcc

SEQ ID NO: 198340 - RNA, 58 nt, Human
cucauguagccaaaagaccaagaaaaaucuggcccacagauaaguugcagacugccuu

SEQ ID NO: 198341 - RNA, 58 nt, Human
cuugcuuauggaggcaggacaccacaaucuggcccauggcugucaccuccugccgagu

SEQ ID NO: 198342 - RNA, 58 nt, Human
acagaccacuguaagugagaacaaauuacuggcccagcccaacccacaccaaauaaga

SEQ ID NO: 198343 - RNA, 58 nt, Human
caggccugggaugagggggcgaugucugcuggcccaggggaagggaaaagacaaaugu

SEQ ID NO: 198344 - RNA, 58 nt, Human
gugggcuacugaguggguccuuaggauacuggcccagauuuugccacuggguauggca

SEQ ID NO: 198345 - RNA, 58 nt, Human
cucccauuucugcugccuuuggcccugccuggcccagccugcaccccuguggggugga

SEQ ID NO: 198346 - RNA, 58 nt, Human
ccaguucuuuccucuucagguggcuguucuggcccagccccuucccauccccaaggag

SEQ ID NO: 198347 - RNA, 58 nt, Human
ugcauaucuagagacagagacugagucacuggcccaucucuuugcucuugugccccag

SEQ ID NO: 198348 - RNA, 58 nt, Human
cagauggaggcaccaaacacccacauaccuggcccaaccagacuucucccgugagcca

SEQ ID NO: 198349 - RNA, 58 nt, Human
guacugaggaugauguuauucacagccccuggcccacccacuaauacuacugcacaga

SEQ ID NO: 198350 - RNA, 58 nt, Human
cauugggcacugccaugcagagacguggcuggcccagaauggccuguugccauagcaa

SEQ ID NO: 198351 - RNA, 58 nt, Human
acccugacccuaaaccuccuucagaucucuggcccaggcucaagcccuagagaugggc

SEQ ID NO: 198352 - RNA, 58 nt, Human
gcaggauggucuucacagguucucaaagcuggcccagaugcugauacacagcacacag

SEQ ID NO: 198353 - RNA, 58 nt, Human
gccuacagauguccuacgggaacgugggcuggcccagcauagggcuagcaaauuugag

SEQ ID NO: 198354 - RNA, 58 nt, Human
gaugauccaugaguuugcccugguuucacuggcccaagugguuugugcuaaccacguc

SEQ ID NO: 198355 - RNA, 58 nt, Human
ccccuacuagugcccaggggucugcugccuggcccacaugucccuuuuguaaacccug

SEQ ID NO: 198356 - RNA, 58 nt, Human
augaugaaagccugacgccgugccccuccuggcccauacgccuugccagggcggcagg

SEQ ID NO: 198357 - RNA, 58 nt, Human
cugggauuacaggugugggccacugcaccuggcccagaugauauaauuuaacuguguu

SEQ ID NO: 198358 - RNA, 58 nt, Human
ugacugaggauugaugacuccauggagccuggcccaggagaaccagagaugaucccga

SEQ ID NO: 198359 - RNA, 58 nt, Human
gagcaacuucaggcucucugggcagaggcuggcccacuguaguuugcagacaugcucu

SEQ ID NO: 198360 - RNA, 58 nt, Human
ccucccccuggggugugcugugucccaccuggcccaccagaggcucacgacgauggca

SEQ ID NO: 198361 - RNA, 58 nt, Human
cagacacacacauguuuuucacacaggccuggcccacgcaucgacaugugugaauuug

SEQ ID NO: 198362 - RNA, 58 nt, Human
gcagccuguucugggaggagcucccucacuggcccacccacuuguguugaagcaaaaa

SEQ ID NO: 198363 - RNA, 58 nt, Human
gugggguguggggcccuggauggcagcucuggcccagacaugaauaccucguguuccu

SEQ ID NO: 198364 - RNA, 58 nt, Human
cuaugauuauuaacgauguccaacccgucuggcccaccaggguccuuuugacacugcu

SEQ ID NO: 198365 - RNA, 58 nt, Human
cuagcaggccucagggccucugguggcucuggcccagacaguauuugcaguucuugug

SEQ ID NO: 198366 - RNA, 58 nt, Human
ugggccagggucugugugaaugugggcacuggcccagguucauaccuuauuugcuaau

SEQ ID NO: 198367 - RNA, 58 nt, Human
cauccuggugccugcauaccucuggcagcuggcccaggaagagccagcaagagcaagg

SEQ ID NO: 198368 - RNA, 58 nt, Human
guucuuucucucagagugggggcaguuucuggcccaggggucugagcugcggcagccc

SEQ ID NO: 198369 - RNA, 58 nt, Human
ugagcugugagagguggcauucacuuaacuggcccagcccucucugcuucgugauuuu

SEQ ID NO: 198370 - RNA, 58 nt, Human
gcggggugugguggccugugaggggccccuggcccaggaggaggauugugcugaugua

SEQ ID NO: 198371 - RNA, 58 nt, Human
aaaaggagaggcccuggcgguccuuggccuggcccauuuuauucccuggacccuuaac

SEQ ID NO: 198372 - RNA, 58 nt, Human
gccauuccucuugcuuuucagcaguagucuggcccaauucucuaccucaaaggaaagu

SEQ ID NO: 198373 - RNA, 58 nt, Human
uccuggaggcagggagaucacugccugccuggcccacgcugcugggacggcucguccu

SEQ ID NO: 198374 - RNA, 58 nt, Human
auggcaacgugugucuuucucuggacaacuggcccaguuuacagugaaauggagaauu

SEQ ID NO: 198375 - RNA, 58 nt, Human
ggccucagaccacaagagcggagcugcccuggcccaagcacugcagcugccugcaccc

SEQ ID NO: 198376 - RNA, 58 nt, Human
ggucacuguugccccauguucggagaaccuggcccaccugucuuggcuuucucauccu

SEQ ID NO: 198377 - RNA, 58 nt, Human
aggaccccugaugcagacucuggaaucccuggcccaaaggccugucugggcccaucug

SEQ ID NO: 198378 - RNA, 58 nt, Human
ccaaagggaacgugucauuugcucgacccuggcccacccuugccgcccagcuguugug

SEQ ID NO: 198379 - RNA, 58 nt, Human
aaggcccuugccucaucagggauuagaacuggcccauaugccagaaccuguacuaaau

SEQ ID NO: 198380 - RNA, 58 nt, Human
aaauagaucuuucuugccaaggaaugcucuggcccaggagcaagguggaauguuuccc

SEQ ID NO: 198381 - RNA, 58 nt, Human
cuggcauuacaggcaugagccaccaugccuggcccaaaguucuagaauuuuuuaaagg

SEQ ID NO: 198382 - RNA, 58 nt, Human
ggcucugguuuggccucaggaguguggccuggcccagccugcugcagccuccuggggg

SEQ ID NO: 198383 - RNA, 58 nt, Human
aaucaagaaccucugccuccgagacaggcuggcccacagugcuggcugggccccaaug

SEQ ID NO: 198384 - RNA, 58 nt, Human
uccuuccugacguccucuguccuuggggcuggcccauagcagugccugccgugccucu

SEQ ID NO: 198385 - RNA, 58 nt, Human
uccccuucccucugcacccucuggaacccuggcccaauuccucagaccccagaguggc

SEQ ID NO: 198386 - RNA, 58 nt, Human
gggagauggccagccugaagucacgguccuggcccagcacaggugggcagcagcgagc

SEQ ID NO: 198387 - RNA, 58 nt, Human
cugggauuacaggugugagccaccacgccuggcccaugaaccaaguguuuuuaaggaa

SEQ ID NO: 198388 - RNA, 58 nt, Human
gaagagcaaaugaaauaaacucuuuaggcuggcccagaaugccuucauugugaggaag

SEQ ID NO: 198389 - RNA, 58 nt, Human
gccauaacaaaggacugcauuguucuagcuggcccacugggcaggucugccaggcuac

SEQ ID NO: 198390 - RNA, 58 nt, Human
cugggauuacaggcuugagccuccaugccuggcccagguaacauguuuauugagcugu

SEQ ID NO: 198391 - RNA, 58 nt, Human
caacagugaaaucuagaguaaaaccaagcuggcccaagguguccugcaggcuguaaug

SEQ ID NO: 198392 - RNA, 58 nt, Human
cacauccccagaauccauaaauguguuccuggcccacucuguaauaguucaguagaau

SEQ ID NO: 198393 - RNA, 58 nt, Human
ugcacaaccaccaugugucuucuaggugcuggcccaccaccacacaucacaggcugau

SEQ ID NO: 198394 - RNA, 58 nt, Human
cccucugcccagcaugcccugugaucgccuggcccagcaggagcugcuucagccgaga

SEQ ID NO: 198395 - RNA, 58 nt, Human
ggacgagcagacacacugaucugaacaucuggcccaagugaagcauggcauauagugc

SEQ ID NO: 198396 - RNA, 58 nt, Human
gggggaaaaaaaguaaucuuuaaacuggcuggcccagaguuuacauucuaauuugcau

SEQ ID NO: 198397 - RNA, 58 nt, Human
uuugaaugaggguaugguagaaaaagaucuggcccaauggcauaaguuuggaauuuuu

SEQ ID NO: 198398 - RNA, 58 nt, Human
agugcuauggguguauuauucaugauagcuggcccacaggucaugaauugaggaggaa

SEQ ID NO: 198399 - RNA, 58 nt, Human
uguagcuggcgaggaauuacuuccacuucuggcccagcacaagcccugcuuuggccac

SEQ ID NO: 198400 - RNA, 58 nt, Human
agugcucgaccuugauagcauggggccccuggcccagaguugcugugccguguccaag

SEQ ID NO: 198401 - RNA, 58 nt, Human
aggagccacugccaaacucaaggcuccucuggcccagcuuggauggcugagggugguc

SEQ ID NO: 198402 - RNA, 58 nt, Human
auuauuuuugccaauuucacaaauuccucuggcccaucaugucagucauuauugagua

SEQ ID NO: 198403 - RNA, 58 nt, Human
aucacaaggucaagagaucgagaucacccuggcccacauggugagaccccaacucuac

SEQ ID NO: 198404 - RNA, 58 nt, Human
cuucccagcagccaggcuagcaccaguucuggcccagucuccucuucuucuggagauc

SEQ ID NO: 198405 - RNA, 58 nt, Human
uuugguuuucagaagacugugacaaguucuggcccaggauucgcucacugacccucaa

SEQ ID NO: 198406 - RNA, 58 nt, Human
ucagaaucagccacccaagcaagccucucuggcccacauaucuaucucuugccuuccc

SEQ ID NO: 198407 - RNA, 58 nt, Human
auuccuuaggauuucucucccuaucaagcuggcccagauacaaguaccaaacaguagu

SEQ ID NO: 198408 - RNA, 58 nt, Human
aaaccauccaucaaggucucuaguaguucuggcccaccucuuuccccacccuggcucc

SEQ ID NO: 198409 - RNA, 58 nt, Human
ggccuuguuuucccgugcugcuccuggacuggcccaccugccugccacaugcccacgc

SEQ ID NO: 198410 - RNA, 55 nt, Human
gcugcaccugcaucuucugaaucaccuggcccagaagccaggccagcagcccgag

SEQ ID NO: 198411 - RNA, 58 nt, Human
uccacaacccagucugcuccauagcacucuggcccacccugucugcaggugaaacagg

SEQ ID NO: 198412 - RNA, 58 nt, Human
caugucagcagaguggcgccugccugugcuggcccauggaacggagacagcauugggc

SEQ ID NO: 198413 - RNA, 58 nt, Human
ccccgcccuucuuuugaccccuuccugucuggcccaaaggaaguagcaggcccagcug

SEQ ID NO: 198414 - RNA, 58 nt, Human
uuccggcugaugccugcagcugugaggccuggcccaaggugucaucaguggggcuggc

SEQ ID NO: 198415 - RNA, 58 nt, Human
accagguggagcagugaccaggacgccucuggcccagugcugcccagccuccccgccc

SEQ ID NO: 198416 - RNA, 58 nt, Human
caaacacuaaucccuuuucuugucuucccuggcccagccaccuccucagccccaugug

SEQ ID NO: 198417 - RNA, 58 nt, Human
augccccagccaauacaaauuggaaaaucuggcccauuuuaggguuaccauuuuuucc

SEQ ID NO: 198418 - RNA, 58 nt, Human
gaggucguugugaccauuaguagcuguccuggcccacuuaaacaagguuacaaaaaau

SEQ ID NO: 198419 - RNA, 58 nt, Human
cuauuuucaacauaacugaaggcauaugcuggcccauaaacacccuguagguucuuga

SEQ ID NO: 198420 - RNA, 58 nt, Human
ggcucucuaacccacagguguuggcugccuggcccaugugcccacugucucuuccacu

SEQ ID NO: 198421 - RNA, 58 nt, Human
ugccauccuguggaagccaccaucaucucuggcccaagcuucuguaguagcucccuaa

SEQ ID NO: 198422 - RNA, 54 nt, Human
aguucgugcaccccaucugagugccuggcccagggccugaaacccgcccucagg

SEQ ID NO: 198423 - RNA, 58 nt, Human
uaaaggccacagaaaugggcacuaccuccuggcccacucccugggcaccaugcccucu

SEQ ID NO: 198424 - RNA, 58 nt, Human
gccuuccccucccaccagcccccuggggcuggcccacuguguccugaauguuuuuguu

SEQ ID NO: 198425 - RNA, 58 nt, Human
gcugaguagaaacuucaagaugaucauucuggcccagcccuuuuaucucuuuaucucc

SEQ ID NO: 198426 - RNA, 58 nt, Human
aacuuggaacugaccacggccuggaggacuggcccaggcagggggacagggaaaaugg

SEQ ID NO: 198427 - RNA, 58 nt, Human
auaggccccacaggugcuauuuguugugcuggcccaggcguggggcuaccaagcaaag

SEQ ID NO: 198428 - RNA, 58 nt, Human
ggaaugcugcgcugcugcugcugcgcaccuggcccaugcugucccuggcuuccaugcc

SEQ ID NO: 198429 - RNA, 58 nt, Human
auauaugaaaaguaaauuaaugugaaaccuggcccagcuugcuggaaagcagguuuua

SEQ ID NO: 198430 - RNA, 58 nt, Human
gcccacuuucgggacaccagugcgcaagcuggcccacguggggcgcagccagacucgc

SEQ ID NO: 198431 - RNA, 58 nt, Human
cacccccaaacuccacgggugccccuagcuggcccagagccggcagugugagcccaag

SEQ ID NO: 198432 - RNA, 58 nt, Human
ggacgugcuaccccucccggucccggcccuggcccagccagcccagcccucgaggcuc

SEQ ID NO: 198433 - RNA, 58 nt, Human
agugaaugggccugguugggagcagccccuggcccauugcccacccacccaucucacu

SEQ ID NO: 198434 - RNA, 58 nt, Human
cacccaccggcacugaucggggcaccgccuggcccagccuccaccagggaccccuccu

SEQ ID NO: 198435 - RNA, 58 nt, Human
ggcaggaaggcagcagccuucagccucucuggcccacucggacaacuucccaaggccg

SEQ ID NO: 198436 - RNA, 58 nt, Human
uuccuuugcuuucucuuuacuuuagacacuggcccaacuccaggcguuuccuuucauu

SEQ ID NO: 198437 - RNA, 58 nt, Human
ucacggcagcccuguggaguacgguguacuggcccagcuuacagaugcagaaagcgag

SEQ ID NO: 198438 - RNA, 58 nt, Human
gaaucgugagucccugaaauaugguagccuggcccagcuucuaaagaggaccuucgua

SEQ ID NO: 198439 - RNA, 58 nt, Human
gcuguggggcugggggccgccucccaggcuggcccaaggggagugccuccuucgucaa

SEQ ID NO: 198440 - RNA, 58 nt, Human
cuccaccaggcccuguuucggaugccaacuggcccacuccccaagcacuugcccccag

SEQ ID NO: 198441 - RNA, 58 nt, Human
uggucugccagcugagaugcuccucgggcuggcccaggugcugaccuugccacaggca

SEQ ID NO: 198442 - RNA, 58 nt, Human
ucucugaaauauuuagaagugcuaauuucuggcccacccccaacaggaauucuauagu

SEQ ID NO: 198443 - RNA, 58 nt, Human
aguggcccgccaccuccugaagcagggccuggcccacccaaggugccuggggcaggcg

SEQ ID NO: 198444 - RNA, 58 nt, Human
gguuucuagcggugccugaggcaucacucuggcccauugacagaugagaggucugaag

SEQ ID NO: 198445 - RNA, 58 nt, Human
cgcugcgguacacuggaugguucugaagcuggcccauugaaagagccucuuaaggcag

SEQ ID NO: 198446 - RNA, 58 nt, Human
aaagggcuucucagauacccuccaucuacuggcccauccccucuccuaaacaaaacuc

SEQ ID NO: 198447 - RNA, 58 nt, Human
auucucugcccugagccaccacccuggacuggcccagucuccagagcuggcacacccu

SEQ ID NO: 198448 - RNA, 58 nt, Human
guccacuccccucuugaugccuagagagcuggcccagccaacacagcucuuagcuggg

SEQ ID NO: 198449 - RNA, 58 nt, Human
ccaucuccgccuccacacugaccaagugcuggcccacccaguccaugcuccaggguca

SEQ ID NO: 198450 - RNA, 58 nt, Human
ggcucuauuggauuuguccaaacaggugcuggcccagcauggaaucugaugaaaauau

SEQ ID NO: 198451 - RNA, 58 nt, Human
ggcagcugaugaggggucagcaggaacacuggcccauugccccuggcacuccuugcag

SEQ ID NO: 198452 - RNA, 58 nt, Human
ugaucaagccuaacgccaaguguacaaacuggcccaaccacaggagcugccaguaucc

SEQ ID NO: 198453 - RNA, 58 nt, Human
ucgauggaccucagcaagcugcccagcccuggcccaggugccccgacugugggacuca

SEQ ID NO: 198454 - RNA, 58 nt, Human
uggucagggggcaggagugucccaagggcuggcccaccugcugucugucugcuccucc

SEQ ID NO: 198455 - RNA, 58 nt, Human
agcucaacggcuccaucaccagcccgggcuggcccaaggaguacccccccaacaagaa

SEQ ID NO: 198456 - RNA, 58 nt, Human
cuccuguguucagaaugugguauuggcucuggcccagccuucuccccuguuacccaua

SEQ ID NO: 198457 - RNA, 58 nt, Human
agguuguugaugguuaggcuaaccugcccuggcccaaagccagacauguacaagggcu

SEQ ID NO: 198458 - RNA, 58 nt, Human
uuccagcuggaguagccuccugaccagccuggcccacccugcuccacccacugggccc

SEQ ID NO: 198459 - RNA, 58 nt, Human
acccugggggcacagcuggaagagaggccuggcccaugcuccucucagggcaggcaca

SEQ ID NO: 198460 - RNA, 58 nt, Human
gucacugauuugccuagauucugagagucuggcccauagccaaccacauuuuccuuug

SEQ ID NO: 198461 - RNA, 58 nt, Human
acagacaagcaggcaggcagccugagagcuggcccagggguccccuggcaggggaaac

SEQ ID NO: 198462 - RNA, 58 nt, Human
cccaguguguacaggcgcaccccguggacuggcccaggaggacgugcaucaucacugc

SEQ ID NO: 198463 - RNA, 58 nt, Human
ccaggggugugugcgcaccuccccggcccuggcccaccuucuggagcgaacugcaccg

SEQ ID NO: 198464 - RNA, 58 nt, Human
uuauuuggagaaccguccagcaugcauccuggcccacggccugagcaagcugcagccc

SEQ ID NO: 198465 - RNA, 58 nt, Human
guuuuauucuucaguguucauauagcaccuggcccauuacauaucuaggcaacuaaaa

SEQ ID NO: 198466 - RNA, 58 nt, Human
ugauuuuuuuuucucccccauccccucacuggcccaucccucucacccucacuuuugu

SEQ ID NO: 198467 - RNA, 58 nt, Human
ugaacagaacuuacgguaacaggcacggcuggcccaaugccuggucuggagcuggagc

SEQ ID NO: 198468 - RNA, 58 nt, Human
cagacagccuguaucuugggggacagggcuggcccagcccugcuggccgccucacccc

SEQ ID NO: 198469 - RNA, 58 nt, Human
ucacugcccaucugagagaugauuuccucuggcccauauuugaauuuauuggaguaac

SEQ ID NO: 198470 - RNA, 58 nt, Human
ggcuuuucacagaaagggucaugaagcccuggcccaacaggacugugguacuaggggc

SEQ ID NO: 198471 - RNA, 58 nt, Human
gccagcccugaccuggucacugggcaggcuggcccagcagccugggggcugcagaaga

SEQ ID NO: 198472 - RNA, 58 nt, Human
cucgcccucuucuaccucccagcgagaccuggcccagaaagggugccgcagcaaggag

SEQ ID NO: 198473 - RNA, 58 nt, Human
cgcccccauucucugcugcguagaugcccuggcccagggcccugacuccuccauuccc

SEQ ID NO: 198474 - RNA, 58 nt, Human
ugacucuguugcucugugaauaaacacccuggcccaugagggcagcccaagcucccag

SEQ ID NO: 198475 - RNA, 58 nt, Human
ggccucgugccuucucucuuggccuagccuggcccacucaggaccugcccagccucug

SEQ ID NO: 198476 - RNA, 58 nt, Human
ucagcaacuggcacaggccuuugugagucuggcccagaucagcaauaaaagaggaguc

SEQ ID NO: 198477 - RNA, 58 nt, Human
uagccuggaugagcugaguggagccaggcuggcccagagcugagaugggagugcggua

SEQ ID NO: 198478 - RNA, 58 nt, Human
acccccaggcaagcaucugaccuguccccuggcccagcccuuaggcccagcuuucaac

SEQ ID NO: 198479 - RNA, 58 nt, Human
gcccagaaagucucucauucuaggccuccuggcccaggugaguccuagagcuacaggg

SEQ ID NO: 198480 - RNA, 58 nt, Human
ggccccagccugccucccuccugcccgccuggcccacaggucucccucuggucccugu

SEQ ID NO: 198481 - RNA, 58 nt, Human
ccacguccggcacugcgugcucaacgagcuggcccagcugggccuggagccaagggau

SEQ ID NO: 198482 - RNA, 58 nt, Human
uggugcucacguguccuuaacaccugaucuggcccaagcugggcucccuuuaagccaa

SEQ ID NO: 198483 - RNA, 58 nt, Human
ccugggcaguuggggcggcccacgccagcuggcccaguggguagugaauuggcuuccu

SEQ ID NO: 198484 - RNA, 58 nt, Human
gagauagcugaggcuaggggagaaggaucuggcccaagauugcauccuuagccgcuac

SEQ ID NO: 198485 - RNA, 58 nt, Human
ugccccucccauccaugcugggacccuccuggcccaccaaggcccaggcaccacugug

SEQ ID NO: 198486 - RNA, 58 nt, Human
cagacuuuucagacugaccccagaaauucuggcccagccaaucuagaggcaagccugg

SEQ ID NO: 198487 - RNA, 58 nt, Human
ggcacccauccgcuccgugaccuacacccuggcccagcuccccugcgccuccauggcu

SEQ ID NO: 198488 - RNA, 58 nt, Human
ccagguaccuguacgugaacagccgcgccuggcccaacggugcggugguggccgaccc

SEQ ID NO: 198489 - RNA, 58 nt, Human
caugcuagagaccaagguggccgagcugcuggcccagggccacaccaagccacccgag

SEQ ID NO: 198490 - RNA, 58 nt, Human
ggcagcgcccaggagcccaccuuccccucuggcccagccaccacugccucucagcuuc

SEQ ID NO: 198491 - RNA, 58 nt, Human
caugccucuccugcacuggagagcagugcuggcccagccccugcggcuuaggcuucau

SEQ ID NO: 198492 - RNA, 58 nt, Human
cuucucccucccucccuuccucccucuccuggcccacccugcucuucccucgcccugc

SEQ ID NO: 198493 - RNA, 58 nt, Human
cuccucagcagugagcagugagcuacuccuggcccaggcccuaggggaaauggaucag

SEQ ID NO: 198494 - RNA, 58 nt, Human
agcaguagaccccccacucuccccaccccuggcccacuguggugugugcugggcaaau

SEQ ID NO: 198495 - RNA, 58 nt, Human
ucuguccagagucuagggcaguccuccacuggcccagcacuccaguuuccuuucccug

SEQ ID NO: 198496 - RNA, 58 nt, Human
aggcuggcaaacccucccagaaacaucucuggcccagaaagccucucucucccucccu

SEQ ID NO: 198497 - RNA, 58 nt, Human
aaugacgauuacuacuagguccagagcucuggcccaugggggugggugagcggcuaua

SEQ ID NO: 198498 - RNA, 58 nt, Human
aggagaagaacaagaaauggauguaagccuggcccauaaugugaacauaaguaaucac

SEQ ID NO: 198499 - RNA, 58 nt, Human
gcugcagauguggggagcccggaaacaccuggcccaugccuguucaguccgucauggc

SEQ ID NO: 198500 - RNA, 58 nt, Human
gguguccucucucuagcccucucccuuacuggcccacuucucucuccguagagagccu

SEQ ID NO: 198501 - RNA, 58 nt, Human
uugacaaaugacaguccaucagacagaucuggcccacuacccauuuuuguauccugca

SEQ ID NO: 198502 - RNA, 58 nt, Human
ggcccagcccauagacggcacaggccaccuggcccauucccugggcauucccugcuuu

SEQ ID NO: 198503 - RNA, 58 nt, Human
cagccauuugggaggcaaugacuuucugcuggcccauguuucaguugccaguaagcuu

SEQ ID NO: 198504 - RNA, 58 nt, Human
cugccacacugaaccauaucgaugaggucuggcccagccucuuccugggagaugcgug

SEQ ID NO: 198505 - RNA, 58 nt, Human
acugauccugcuggugcugcuggaggcucuggcccaggcggacacacagaagauggug

SEQ ID NO: 198506 - RNA, 58 nt, Human
gaagaugacugagggugaguuggcuuaccuggcccaucaggguaggcuggaguuaggg

SEQ ID NO: 198507 - RNA, 58 nt, Human
aaagagugaguuuggagcccgcauugggcuggcccacuggguugcugugcuguagggu

SEQ ID NO: 198508 - RNA, 58 nt, Human
acaaggcugcagugggcccacccaugggcuggcccauaacuguauguuauguggaaga

SEQ ID NO: 198509 - RNA, 58 nt, Human
uagggcugggguucucaagccccuggcccuggcccagagauuuggauucccuuggcgg

SEQ ID NO: 198510 - RNA, 58 nt, Human
uccuuggucaucauugucuccuucccaccuggcccagagaugcuuaaauccaaguugu

SEQ ID NO: 198511 - RNA, 58 nt, Human
ggaggagcgcuuugcugaugccauuauccuggcccaggcuggggguacagaucugcug

SEQ ID NO: 198512 - RNA, 58 nt, Human
acucccaaaacacugcagccuccugcaucuggcccagggccuggcauuugguaggaau

SEQ ID NO: 198513 - RNA, 58 nt, Human
ccucccguccacacugccagcaaugccccuggcccagugagcccagacgcuccuccac

SEQ ID NO: 198514 - RNA, 58 nt, Human
ccuuucugccuggucagccccguggccucuggcccaccaagcucccugucacccagcc

SEQ ID NO: 198515 - RNA, 58 nt, Human
gcagccccugcagcacugggcagacaugcuggcccacgcccggcggcccauugcccag

SEQ ID NO: 198516 - RNA, 58 nt, Human
guugggacccaguggcagggcacagggccuggcccauguauggccaggaaguagcaca

SEQ ID NO: 198517 - RNA, 58 nt, Human
gaggcaugccucugauaugggacugagccuggcccauagaaacaugacacugaccuug

SEQ ID NO: 198518 - RNA, 58 nt, Human
gaugaagcuuuggcccucagugggcucccuggcccagccagccaggaacuggcuccuu

SEQ ID NO: 198519 - RNA, 58 nt, Human
gccguggguucuccagagaccccagcaacuggcccaggaugcaggcugcucuagagac

SEQ ID NO: 198520 - RNA, 58 nt, Human
ggcaccugucccucuggucucccagcaccuggcccagguaacagccuucugaaagcag

SEQ ID NO: 198521 - RNA, 58 nt, Human
ccgccagaggacaaggaagugggggccgcuggcccaggguaggggaggguggggcaau

SEQ ID NO: 198522 - RNA, 58 nt, Human
augaaguuagugcgggcuuugcugcucccuggcccaggaaagagggacuaccugaccc

SEQ ID NO: 198523 - RNA, 58 nt, Human
ccaaggagccccuggugucacauggggccuggcccacgcccucccucucccaggcccg

SEQ ID NO: 198524 - RNA, 58 nt, Human
gcccuccaggcuucuucccuucuucaggcuggcccaggucccaggccuggucaacucg

SEQ ID NO: 198525 - RNA, 58 nt, Human
uucccuuggcugacgcccagguacucagcuggcccacuccacagccaggccuggcccu

SEQ ID NO: 198526 - RNA, 58 nt, Human
gucugcaaacucccaccugcagccaaaucuggcccaccuccuuuuuaauguaagggcu

SEQ ID NO: 198527 - RNA, 58 nt, Human
ugggguguccugggcuccccaucuccuucuggcccaucugccugcugcccugagcccc

SEQ ID NO: 198528 - RNA, 58 nt, Human
aggguuacagauccagguuauaacuacucuggcccauaccuuuccugguugugguuuu

SEQ ID NO: 198529 - RNA, 58 nt, Human
aauuauugugauuucccguggccccagccuggcccagcucccccgggaggggcccgcu

SEQ ID NO: 198530 - RNA, 58 nt, Human
gcuggggccuaucagugugccccccauccuggcccaucaguguacccccgcccaggcu

SEQ ID NO: 198531 - RNA, 58 nt, Human
acuuuugaacaagcugaugauucugaaacuggcccaauuuccuaacaagccggaugcu

SEQ ID NO: 198532 - RNA, 58 nt, Human
accaaaaacuauuucuucagccccuucucuggcccagacccugugggcauggagaugg

SEQ ID NO: 198533 - RNA, 58 nt, Human
ucaaguuuguuuuucucaggauauuguccuggcccagcuacuccuuuaccugugagaa

SEQ ID NO: 198534 - RNA, 58 nt, Human
ucucuggagcauucugaaaacagauauucuggcccagggaauccagccaugaccccca

SEQ ID NO: 198535 - RNA, 58 nt, Human
cugacccucuggagaacacugccucccgcuggcccaggucuccucuccagucccccug

SEQ ID NO: 198536 - RNA, 58 nt, Human
gagggacucagacaccaccgaucacaggcuggcccaggugcucccucccuuccugcag

SEQ ID NO: 198537 - RNA, 58 nt, Human
caggggcuugcagcuucgugaggggucucuggcccaguuuccaaugaauaaaguucuc

SEQ ID NO: 198538 - RNA, 58 nt, Human
cuaggauuacaggugugagccaccacaccuggcccauaguuguauuuuuuuuagguca

SEQ ID NO: 198539 - RNA, 58 nt, Human
agucucagcaccggcccacccaaagauucuggcccaacuccaucgcugcgggggugcu

SEQ ID NO: 198540 - RNA, 58 nt, Human
agagaagaccacaccaaggaggcggccgcuggcccaggagagaacacggggagguuug

SEQ ID NO: 198541 - RNA, 58 nt, Human
uccaccagcuccagucuccacagccauccuggcccacacaggcaccccacacaaaccu

SEQ ID NO: 198542 - RNA, 58 nt, Human
ccaggccuaggccccacagacuuuuaggcuggcccagauauuccccaguggaugggca

SEQ ID NO: 198543 - RNA, 58 nt, Human
cagaggagagucccagagcaggaggccccuggcccagcggccccucccacacacaccc

SEQ ID NO: 198544 - RNA, 58 nt, Human
caaggauccagacucucauuccuuuccucuggcccagugaauuuggucucucccagcu

SEQ ID NO: 198545 - RNA, 58 nt, Human
gccaccaaaggccagggucacugaaggccuggcccacagcaggugcugagcaaaggga

SEQ ID NO: 198546 - RNA, 58 nt, Human
uucaccuggccccaccauggcugcuugccuggcccaaccuagcguucugugccaugcu

SEQ ID NO: 198547 - RNA, 58 nt, Human
uaguuugugggccuuacaaaucaggccacuggcccauugcuuguaguuaguugaucca

SEQ ID NO: 198548 - RNA, 58 nt, Human
ccugccuccggcccugccccacacaggccuggcccagccagcagguucucuccuguga

SEQ ID NO: 198549 - RNA, 58 nt, Human
ggugccaugagcagggcuccucgugccccuggcccaggggucucuuccccugcccccu

SEQ ID NO: 198550 - RNA, 58 nt, Human
accacccucugcuccuccuucuccuguccuggcccaggcauccuaggggcugaaaucc

SEQ ID NO: 198551 - RNA, 58 nt, Human
cugggugcugcccugcguggcugaccagcuggcccaggauuucacagucgaaaaggaa

SEQ ID NO: 198552 - RNA, 58 nt, Human
ccaucuugguuuuaggaaauggggccgccuggcccagccacucacugguguccugucu

SEQ ID NO: 198553 - RNA, 58 nt, Human
ggcuggaggcaagcuaugaacuugcucgcuggcccaccccuaagacugguacccauuu

SEQ ID NO: 198554 - RNA, 58 nt, Human
uagacuuggcucucaggaacucugcuuccuggcccagcgcucgugaccaaggauacac

SEQ ID NO: 198555 - RNA, 58 nt, Human
gcagguagaugagguguuugcacugccgcuggcccaccugcugcagacgcagaaucag

SEQ ID NO: 198556 - RNA, 58 nt, Human
uggaguuuugucaguuucacacuguuugcuggcccagguguacuguuuguggccuuug

SEQ ID NO: 198557 - RNA, 58 nt, Human
ggaggugcauggccugagcauuguuugucuggcccagaggagagagcuuggguuccca

SEQ ID NO: 198558 - RNA, 58 nt, Human
cugguccuucacuggcgccuucucggagcuggcccagggggccuggagcauggacagu

SEQ ID NO: 198559 - RNA, 58 nt, Human
ccuucuucagaauguucugcgggacccccuggcccacccuggggucugagccugcugg

SEQ ID NO: 198560 - RNA, 58 nt, Human
uaguuuagaguuagcagacuacccaaaucuggcccacugccaauaaagucucauugga

SEQ ID NO: 198561 - RNA, 58 nt, Human
cuggugucuugggaguugugcagggacucuggcccaggcaggggaaggaagaccaggc

SEQ ID NO: 198562 - RNA, 58 nt, Human
ccucuggcuccacugcuuggcugagauccuggcccauaguagaaucuguguagaggaa

SEQ ID NO: 198563 - RNA, 58 nt, Human
uugucaaaaacagucaauagggcuacugcuggcccaaagaccauuuagguccaccucc

SEQ ID NO: 198564 - RNA, 58 nt, Human
gggcugcaggcaaagcuggacaugugcccuggcccaggaggccauguugggcccucgu

SEQ ID NO: 198565 - RNA, 58 nt, Human
gggcccugugcccuugagcccuccaccccuggcccaagacccccccaaacugucugac

SEQ ID NO: 198566 - RNA, 58 nt, Human
ugauauaauccacccaugcaaauagcuacuggcccagcuaccauuuaccauuugccua

SEQ ID NO: 198567 - RNA, 58 nt, Human
cugggauuacaggccugagcaacugugccuggcccaaaaccagaccguuaacacauua

SEQ ID NO: 198568 - RNA, 58 nt, Human
ucuuaggaccacauagauuauuacauuucuggcccaauacccaaaaggguuuuaugga

SEQ ID NO: 198569 - RNA, 58 nt, Human
cugggauuacaggcgugagucaccacaccuggcccauggugggggauauguuuuaaga

SEQ ID NO: 198570 - RNA, 58 nt, Human
ggggcccacuggaaagggcucugacccccuggcccagccgggcucucuaguggugauc

SEQ ID NO: 198571 - RNA, 58 nt, Human
cccuaaaaugagaaguccaaggucaucucuggcccagugaccacagagagaucugcac

SEQ ID NO: 198572 - RNA, 58 nt, Human
uauuguaugucuucauccuugguagcggcuggcccauuuucccacauggacuuuauuu

SEQ ID NO: 198573 - RNA, 58 nt, Human
uuauuacuguagucggacacacucccagcuggcccaguuugugcaugaggugaagaag

SEQ ID NO: 198574 - RNA, 58 nt, Human
aggagauggguuuggggcuggccccauccuggcccagccucuuaaccucuucuuaccc

SEQ ID NO: 198575 - RNA, 58 nt, Human
uccuccaucucagacuguggaaccaaagcuggcccaguuguccaugacaaaagaggcu

SEQ ID NO: 198576 - RNA, 58 nt, Human
agaaugggaaucuggauuagcccuggggcuggcccaggucuucauugaguccaaagug

SEQ ID NO: 198577 - RNA, 58 nt, Human
ucuguccccuccucuccacgucccagaacuggcccagcugcaggcacuaagaagcucc

SEQ ID NO: 198578 - RNA, 58 nt, Human
ccagcaggcuugaagcaggguaagcaggcuggcccaggguaagggcuguugagguacc

SEQ ID NO: 198579 - RNA, 58 nt, Human
auaaggauguuuugcaacuuuccagaaucuggcccagaaauuagggcucaauuuccug

SEQ ID NO: 198580 - RNA, 58 nt, Human
uuagacccagaauuagagcagccagcagcuggcccaguguaaaaaugucccaagugua

SEQ ID NO: 198581 - RNA, 58 nt, Human
gacgacccagccuccccauaccgggccucuggcccagaccuaagcccugcccacaaag

SEQ ID NO: 198582 - RNA, 58 nt, Human
gaagucaccuguaccugagaugccaguacuggcccauccuuguuuuguccccaacccu

SEQ ID NO: 198583 - RNA, 55 nt, Human
cagucguccacaccaagugacacuacuggcccaggcuaccuucuccaucugguuu

SEQ ID NO: 198584 - RNA, 58 nt, Human
gggcaggugguggggcugggccauggagcuggcccagaggccccucagcccuuuguaa

SEQ ID NO: 198585 - RNA, 58 nt, Human
ugguggccuuucccccguggauuggucucuggcccagcccagucucuucucaggggca

SEQ ID NO: 198586 - RNA, 58 nt, Human
ucgccucgcagcugcugcccgggaaaagcuggcccaggcgucuaaggagucaaaagag

SEQ ID NO: 198587 - RNA, 58 nt, Human
agcucacugucuuccacacuggugcuaacuggcccaggcacuggaguggaauagaaug

SEQ ID NO: 198588 - RNA, 58 nt, Human
uaaugccuagauucuuuugugguuguugcuggcccaaugagucccuagucacaucccc

SEQ ID NO: 198589 - RNA, 58 nt, Human
cucgggagauagauugucucccuugccucuggcccagcagagccuaagcacugugcua

SEQ ID NO: 198590 - RNA, 58 nt, Human
uggggcagagaaaggaagggaacuggagcuggcccagggcugugacgugacuggggug

SEQ ID NO: 198591 - RNA, 58 nt, Human
uuuuccaaaaggcuccuugccuccuucccuggcccaccugaagccaagucccaggugu

SEQ ID NO: 198592 - RNA, 58 nt, Human
ggccuucacagccuggccuguucccacucuggcccaucucccuuucuuacugggaguu

SEQ ID NO: 198593 - RNA, 51 nt, Human
agauggaggccacagacugagcuggcccagagggguggaacugcugauggg

SEQ ID NO: 198594 - RNA, 58 nt, Human
caggacagaugccacacaaggauagaugcuggcccagggcccagagcccagcuccaag

SEQ ID NO: 198595 - RNA, 58 nt, Human
cugggauuacaggcacacaccaccacaccuggcccagcuaauucuuuuuuguauuuuu

SEQ ID NO: 198596 - RNA, 58 nt, Human
guacuugcacuggggagguggcugcuggcuggcccaagcagagagcugaggcauccaa

SEQ ID NO: 198597 - RNA, 58 nt, Human
cacaaacugggugauagggcggacuuaccuggcccagcccugccucccucagccaacc

SEQ ID NO: 198598 - RNA, 58 nt, Human
ccaucauccaccauuuaguaaaauguagcuggcccaggacauguaaaaaaaaaaaaaa

SEQ ID NO: 198599 - RNA, 58 nt, Human
auaauguaagcacuauccagguaaaacacuggcccaagauuugguaaagagauuucau

SEQ ID NO: 198600 - RNA, 58 nt, Human
gaccagaagaggugugcaguuuccaggccuggcccauacagaccuccaacaggugcuc

SEQ ID NO: 198601 - RNA, 58 nt, Human
cccgucuccaagcucaagcugggagacccuggcccaguuuccuuaucuccuugggccc

SEQ ID NO: 198602 - RNA, 58 nt, Human
aauugaaguauuuuaugacuccucauuccuggcccagaggguugucuuugaaacccug

SEQ ID NO: 198603 - RNA, 58 nt, Human
aagacccucaaugccaagaaacgugucccuggcccauauuaaucccucguguguccau

SEQ ID NO: 198604 - RNA, 58 nt, Human
uugugugggcucuggccuggccugguggcuggcccagggggcagcagugcuuagagcu

SEQ ID NO: 198605 - RNA, 58 nt, Human
cuuccccauaucuccugccucagccccccuggcccagugcuggggcgucagcuaaacc

SEQ ID NO: 198606 - RNA, 58 nt, Human
cuguuccccccacugugguaggacaggacuggcccacuuaguccucaagcucccaacc

SEQ ID NO: 198607 - RNA, 58 nt, Human
agugcagcagggcacccaccagcagcugcuggcccagggcggccucuacgccaagcug

SEQ ID NO: 198608 - RNA, 58 nt, Human
aucccuuugcagucaguucaucccuacccuggcccagaugaucacugaucuugucauu

SEQ ID NO: 198609 - RNA, 58 nt, Human
acuuuucuucagauauugaaccagaucucuggcccaucaggcuuucuaaauucuucaa

SEQ ID NO: 198610 - RNA, 58 nt, Human
caagauuauaaccuggauauucugacuccuggcccagugcuuuuucuuacuuuguagc

SEQ ID NO: 198611 - RNA, 58 nt, Human
uucggcucaacgcaggagggacauucugcuggcccacccugcgcgcugucaugcagag

SEQ ID NO: 198612 - RNA, 58 nt, Human
ugguacccuggucucaguauaugcuauucuggcccaaauguuccauuauucagcuggc

SEQ ID NO: 198613 - RNA, 58 nt, Human
acuacagagaggaagagccugcaugucgcuggcccaaggcuggacccugaagcugaug

SEQ ID NO: 198614 - RNA, 58 nt, Human
ucuuccucuuuucccauccccugcuacccuggcccagcacaggcacuuucuagauauu

SEQ ID NO: 198615 - RNA, 58 nt, Human
uaaucugacuuugccacugugcccagcucuggcccagaggguagagugccuccugugg

SEQ ID NO: 198616 - RNA, 58 nt, Human
agauggguuggggcagcuuacuccagcccuggcccaaggaggcccagaaguuggaaag

SEQ ID NO: 198617 - RNA, 58 nt, Human
uguuuggagcaaggguugugaagucugucuggcccaucaaaugaccaauggcuuuuaa

SEQ ID NO: 198618 - RNA, 58 nt, Human
cugggauuacaggcgugagccacugcuccuggcccaagaucugaugguuuuguaaggg

SEQ ID NO: 198619 - RNA, 58 nt, Human
caggcuggcugcuuuuuuuagccugccccuggcccaggcccaguccuuggugucaggg

SEQ ID NO: 198620 - RNA, 58 nt, Human
agggcccuucacaaaagcagaaggaacacuggcccaaacccccagcaccccggaagca

SEQ ID NO: 198621 - RNA, 58 nt, Human
uaugaguucgcaggucuacuagaagguucuggcccaucaauauucauuucauuuaauu

SEQ ID NO: 198622 - RNA, 58 nt, Human
gcccuccaggaagccccuucccugacuccuggcccacaggccaggccuaaaaaaaacu

SEQ ID NO: 198623 - RNA, 58 nt, Human
agcggccucugaguacccuggcgggaggcuggcccacacagaaagguggcaagaagau

SEQ ID NO: 198624 - RNA, 58 nt, Human
acugugaggaucccaggauucaguauuccuggcccagagggcccuugcuggcuacugg

SEQ ID NO: 198625 - RNA, 58 nt, Human
guguacuuauauccacacugcacacugccuggcccaaaacgucuuauugugguaggau

SEQ ID NO: 198626 - RNA, 58 nt, Human
cuuggaugacaggugcgagccacugcaccuggcccacauuuuuuaaagagacacuguc

SEQ ID NO: 198627 - RNA, 58 nt, Human
gcgacaagggcugagcgcgggagccaggcuggcccaguccugggccucggcccuuccc

SEQ ID NO: 198628 - RNA, 58 nt, Human
cagggagaaaauccaggucaugcaguuccuggcccaucaacuguauugggccuuuugg

SEQ ID NO: 198629 - RNA, 58 nt, Human
augaaaagauaacuucaugaagacuuaacuggcccagaagcugauuuucaugaaaauc

SEQ ID NO: 198630 - RNA, 58 nt, Human
gguuuuaagcacguucuuucaucagacccuggcccaauaccuauguaugcaaugcucc

SEQ ID NO: 198631 - RNA, 58 nt, Human
caaaaugcuggauuacaggcaugugugccuggcccagguuucuuaauaaaacagaauc

SEQ ID NO: 198632 - RNA, 58 nt, Human
cacuguucccugaucauuccaaaggcugcuggcccaaaagaugcagauguggucuaca

SEQ ID NO: 198633 - RNA, 58 nt, Human
gcaccaggagauggaggaugucaucaggcuggcccagaaggaggaggagaugaaggua

SEQ ID NO: 198634 - RNA, 58 nt, Human
gccccucuugccucuggccccucugacccuggcccagggaccccucacggggccaggg

SEQ ID NO: 198635 - RNA, 58 nt, Human
gaagacuaaggcagaugggcuuccaggacuggcccagaccagccagggcuccuuguag

SEQ ID NO: 198636 - RNA, 58 nt, Human
uacggggucgcccuuugcucacgucucucuggcccacucaugauggagaagugugguc

SEQ ID NO: 198637 - RNA, 58 nt, Human
agcugcugcuuaaugcccugcucucucccuggcccaccuuauagagagcccaaagagc

SEQ ID NO: 198638 - RNA, 58 nt, Human
gccccugggugggugguggggaggggcgcuggcccagccggccucucuggccucccac

SEQ ID NO: 198639 - RNA, 58 nt, Human
acacugaagcagcuggugugggcuggaacuggcccagcauugaccugggccgggcugg

SEQ ID NO: 198640 - RNA, 58 nt, Human
acaccaagugguaaugaaauuucggugacuggcccacacgugcauagaggucugggag

SEQ ID NO: 198641 - RNA, 58 nt, Human
uuucucugggucuucaauuagaauguggcuggcccauauugguuuguguuuaaaugcu

SEQ ID NO: 198642 - RNA, 58 nt, Human
uauauguauauaugggacauuuuaucuucuggcccaaagucagaacuuuauaaaaauc

SEQ ID NO: 198643 - RNA, 58 nt, Human
caagaaacagauggacaaguuggauccccuggcccauccucuccugcagugguaugga

SEQ ID NO: 198644 - RNA, 58 nt, Human
cuguggcgaaguuaccuggggauccuggcuggcccaccuuccuggcugcaguccaggc

SEQ ID NO: 198645 - RNA, 58 nt, Human
ucugaaggguucugaugaaaacugacugcuggcccagggccccugcugaggggcguca

SEQ ID NO: 198646 - RNA, 58 nt, Human
agcucuuuuaacaccccuuuucccccugcuggcccagagggagacccaggacugaacu

SEQ ID NO: 198647 - RNA, 58 nt, Human
uggaguagacuucuggcucccagcuccacuggcccauggggccuccauuguaugaagu

SEQ ID NO: 198648 - RNA, 58 nt, Human
caagccuguguugccagugcgggccaagcuggcccagccuggagcuggcgcugugcag

SEQ ID NO: 198649 - RNA, 58 nt, Human
ugcccuagucacauggcagacccacggccuggcccacuguauaaaauaaaccuguuug

SEQ ID NO: 198650 - RNA, 58 nt, Human
gcucuucagcuccugcucccagggcucccuggcccaguacagcugugcggacccccag

SEQ ID NO: 198651 - RNA, 58 nt, Human
uuguaaaaauaaaaaucuccacaaauuacuggcccaucucggacuugcugaaucaauu

SEQ ID NO: 198652 - RNA, 58 nt, Human
ccugugugguucccuuuaccuuggcuuccuggcccagucccugccucuccaccugcac

SEQ ID NO: 198653 - RNA, 58 nt, Human
cccugccucuccaccugcacccugcuuccuggcccagucccagguuggagucccucug

SEQ ID NO: 198654 - RNA, 58 nt, Human
ugaccgcuuccacgagaugcacguggcucuggcccagaaggaccaggagaucgccuuc

SEQ ID NO: 198655 - RNA, 58 nt, Human
ugcuccacacagcauggggcuucagcugcuggcccaaggccaggagcgcuggguucug

SEQ ID NO: 198656 - RNA, 58 nt, Human
uuagggaccuauuuuuaacacuagggggcuggcccacuaggagggcuggcccuaagau

SEQ ID NO: 198657 - RNA, 58 nt, Human
uguucugucucaggcuucuguggcaggacuggcccagggaggaggaagccagcagcac

SEQ ID NO: 198658 - RNA, 58 nt, Human
aguccuagcagaaaaauguguuaggggccuggcccaaagcaguguugguugcuuacag

SEQ ID NO: 198659 - RNA, 58 nt, Human
cuagagacugggagccgaggcaguggugcuggcccaagugaaggccagagugaggacu

SEQ ID NO: 198660 - RNA, 58 nt, Human
guccuccaugcccucaggcagcagagaacuggcccagagcccuuggaguguuggugga

SEQ ID NO: 198661 - RNA, 58 nt, Human
ggcaguauuuuugaaagcacuuucaccucuggcccaggagacugacccaaagugaagg

SEQ ID NO: 198662 - RNA, 58 nt, Human
acgaagggccugggccuaaccccuuggccuggcccagcuuccagagggacccugggcc

SEQ ID NO: 198663 - RNA, 58 nt, Human
cuggaacuacaagugugagccaccgcgccuggcccaagcccuccacauuuucaaucca

SEQ ID NO: 198664 - RNA, 58 nt, Human
cugauuggcagucacuucccaugagggccuggcccacccgcugcaguugcccuaagga

SEQ ID NO: 198665 - RNA, 58 nt, Human
gcccccacuccuguuccuugugcacccacuggcccaugagccucugccuggccccugc

SEQ ID NO: 198666 - RNA, 58 nt, Human
cuaaggaagagagaguuuauuuagucaacuggcccaaggcagcgaggcuucuacaguc

SEQ ID NO: 198667 - RNA, 58 nt, Human
gugguccaaaaaggcugcucucuuccaccuggcccagacccuguggggcagcggagcu

SEQ ID NO: 198668 - RNA, 58 nt, Human
gagguggcuggacccaucgcaucuaaaacuggcccaggacacuugguguaugcgugac

SEQ ID NO: 198669 - RNA, 58 nt, Human
cacauucuggugcuguccucacucgccccuggcccagaggcuccugaagaugcugggc

SEQ ID NO: 198670 - RNA, 58 nt, Human
cuuccucccaggcuacccugagccuuuccuggcccaguccucaccacaguccacagaa

SEQ ID NO: 198671 - RNA, 55 nt, Human
guggagaugggguggccuaguggaccuggcccaucugccacucuagucccugcag

SEQ ID NO: 198672 - RNA, 58 nt, Human
ccagacuccugccggccucagaggacaccuggcccagcacaggcagcuagaagggccg

SEQ ID NO: 198673 - RNA, 58 nt, Human
cuggggacgugcuuccuauggguuucagcuggcccaagccccucccgaaucucucugc

SEQ ID NO: 198674 - RNA, 58 nt, Human
ccccucuuucccucagccaagaacaggccuggcccaaggugccacccccuagcaccuu

SEQ ID NO: 198675 - RNA, 58 nt, Human
cccucaaaguggggaccugucccaaggacuggcccagccguggggagaucaccuucag

SEQ ID NO: 198676 - RNA, 58 nt, Human
gugggagacgaacggaaggguuggugggcuggcccagccaacugccccgggugccuca

SEQ ID NO: 198677 - RNA, 58 nt, Human
ccagagcuuccugccuagucccacugggcuggcccaccaggccucugacccaggcugc

SEQ ID NO: 198678 - RNA, 54 nt, Human
acuacaucccuaucuucuagcguccuggcccaaggcucucaauugcacucuuug

SEQ ID NO: 198679 - RNA, 58 nt, Human
cucguggcgcccuggcccuacacccagccuggcccagggccggcuuugccuggugagg

SEQ ID NO: 198680 - RNA, 58 nt, Human
cagccuuccacugaauacacgauugagucuggcccagugaauccgcauuuuuauguaa

SEQ ID NO: 198681 - RNA, 58 nt, Human
aggcccaugauuuucccuacacuucucccuggcccaggcuccagccacaggcaccucu

SEQ ID NO: 198682 - RNA, 55 nt, Human
gggaguaugugcccagaugauaggccuggcccacgccgccgcccccgcugaguga

SEQ ID NO: 198683 - RNA, 58 nt, Human
uguucuccacuugugcuguuagaacucacuggcccagugguguucucacuccuacccc

SEQ ID NO: 198684 - RNA, 58 nt, Human
caugggcagcagggcuccauucucuggccuggcccaggccucuacauacuuacuccag

SEQ ID NO: 198685 - RNA, 58 nt, Human
cugggauuacaggugggagccacuacagcuggcccagcagcucuguuucugauagagg

SEQ ID NO: 198686 - RNA, 58 nt, Human
ucagauagcaggaggaacuuucaaaagucuggcccacugugcaguggagcagaaggca

SEQ ID NO: 198687 - RNA, 58 nt, Human
cucagcccgagggucuccaggauguugccuggcccaggacuugggacaguggccuugu

SEQ ID NO: 198688 - RNA, 58 nt, Human
cagcaggacuaagguggcuuucccacuccuggcccacagccccagagagccugucugu

SEQ ID NO: 198689 - RNA, 58 nt, Human
cucacccacaccauaagcuacugccauccuggcccagggcaucugggaggaaccgagg

SEQ ID NO: 198690 - RNA, 58 nt, Human
ggugcugugccucaggcuccuuccuggucuggcccagcuggcuuccccagccccucag

SEQ ID NO: 198691 - RNA, 58 nt, Human
aggugugccaguuuucauguaaucuuuacuggcccaacuugggaguggggaaauugcu

SEQ ID NO: 198692 - RNA, 58 nt, Human
auggagcuagagaggggccucuggcugccuggcccagggaggaauugggguuucuggu

SEQ ID NO: 198693 - RNA, 58 nt, Human
ucugacuauggcagcagaacaccagggccuggcccaguggauuucauggugaucauua

SEQ ID NO: 198694 - RNA, 58 nt, Human
cacccucugggucggacacugggacccacuggcccagucuuggcugcugcuuaccccu

SEQ ID NO: 198695 - RNA, 58 nt, Human
ggcuggcccugggcggggccacugugugcuggcccacugugaccugacccgaccuugu

SEQ ID NO: 198696 - RNA, 58 nt, Human
cccaccugugaggcagccuucugauggccuggcccaccuuccccagaaccaggggagg

SEQ ID NO: 198697 - RNA, 58 nt, Human
aaggauuuugggguucaccagaugcuuccuggcccacgaugaaaccugagaggggugu

SEQ ID NO: 198698 - RNA, 58 nt, Human
gagacuugcaccuuaacucugggaccugcuggcccagaguggagcuagggcuaggugu

SEQ ID NO: 198699 - RNA, 58 nt, Human
gacauucccuuguagcccccagaauugucuggcccaaauugaauagaagcagaaaaac

SEQ ID NO: 198700 - RNA, 58 nt, Human
agagcugaagguuguggccuuugcgcuccuggcccagccuuuguuccccacuggagca

SEQ ID NO: 198701 - RNA, 58 nt, Human
aggaaguccagggacagcucccuuauaccuggcccacguccuucucagccugcccucg

SEQ ID NO: 198702 - RNA, 58 nt, Human
agccagccaccccugccacucacccuuccuggcccaggccuugcugacucucugagcu

SEQ ID NO: 198703 - RNA, 58 nt, Human
gaugcccggagcugccucuuagacucgucuggcccaucuaccugcugacagagcauga

SEQ ID NO: 198704 - RNA, 58 nt, Human
caggggcugaggugucaggaggggacuucuggcccaccuugccuucagcccuggagug

SEQ ID NO: 198705 - RNA, 54 nt, Human
agaagugcaccgucuucuagagcccuggcccacccgagccugagggcuggcggg

SEQ ID NO: 198706 - RNA, 58 nt, Human
ggcaggcgcagugccccccucccaugggcuggcccaggaccgugggugaaaccugggu

SEQ ID NO: 198707 - RNA, 58 nt, Human
gagcugaugacgggggaggcccguccgccuggcccaccaacccgcccaccuugacugc

SEQ ID NO: 198708 - RNA, 58 nt, Human
ucccaaaggagcccaggcucaggcaggccuggcccagagucacgcuggcaaccacgag

SEQ ID NO: 198709 - RNA, 58 nt, Human
gcucuccuuucgcuuggcgugggcuuugcuggcccagugugugcuccuggcucagcag

SEQ ID NO: 198710 - RNA, 58 nt, Human
cuccugggaaguucccugcucugcagcucuggcccaggagcugcaggcugggaggggg

SEQ ID NO: 198711 - RNA, 58 nt, Human
uuagguagagggaguugucaagucucugcuggcccagccaaacccugucugacaaccu

SEQ ID NO: 198712 - RNA, 58 nt, Human
gcauguggggcucuuccuccauccagagcuggcccaagacccuuagaacccugagugc

SEQ ID NO: 198713 - RNA, 58 nt, Human
agaaaccgaggcccaguacagcucccagcuggcccaaauucagugucugaucgauaac

SEQ ID NO: 198714 - RNA, 58 nt, Human
ucucuacuccugugcuguagcaccuucacuggcccaucccuccccucuagugcugucc

SEQ ID NO: 198715 - RNA, 58 nt, Human
agagcuuuggaggcuuggauuccugggccuggcccagguggcuguuucccugaggacc

SEQ ID NO: 198716 - RNA, 52 nt, Human
ggucagacacguuccacugacccuggcccagggcccaggccugucuggggug

SEQ ID NO: 198717 - RNA, 58 nt, Human
ggaucugagucguucuucgggcccuguccuggcccaggccucugcccucugcccaccc

SEQ ID NO: 198718 - RNA, 58 nt, Human
uaucagacuaagccagcaccggaccagccuggcccaccccacccacuucugcacuugc

SEQ ID NO: 198719 - RNA, 58 nt, Human
gcccacuccaccaggguucccaaagaaccuggcccagucauaaucauucauccugaca

SEQ ID NO: 198720 - RNA, 58 nt, Human
uucagcauguaccgcauguguaaguagucuggcccacauuuucaaccuaguagaacaa

SEQ ID NO: 198721 - RNA, 58 nt, Human
cugggauuacaggugugagccacagugccuggcccauucuugaguuuugauaaaguaa

SEQ ID NO: 198722 - RNA, 58 nt, Human
uccuggaccccccagcuggccucugaagcuggcccaccagagcugccauuugucucca

SEQ ID NO: 198723 - RNA, 58 nt, Human
uccccagggagguggcccaggaaggugccuggcccagaauaaggaacuggcauacugc

SEQ ID NO: 198724 - RNA, 58 nt, Human
aggggauugggccaucugucuccuggcccuggcccaucugccuccuggccuuccuguu

SEQ ID NO: 198725 - RNA, 58 nt, Human
uagauucucagcugaugaaaauuugggucuggcccauuucaggccaucuucaguugaa

SEQ ID NO: 198726 - RNA, 58 nt, Human
gcugcuguggcuccugcuguguccccuccuggcccauccucauccucaucuucauccu

SEQ ID NO: 198727 - RNA, 58 nt, Human
cugggcugcucugcacccacgggagaggcuggcccagcugcagacugcuuagggacuu

SEQ ID NO: 198728 - RNA, 58 nt, Human
ggucagagcagcgccugguggguguucccuggcccacucuccucucuccuucugcagu

SEQ ID NO: 198729 - RNA, 58 nt, Human
aguaugagaugccucuguaccgcaaguacuggcccaaccacaucaugcuggugcuucc

SEQ ID NO: 198730 - RNA, 58 nt, Human
aaucuugcagagguagcuccgaaaccaucuggcccaacuagccucaacugacagcuga

SEQ ID NO: 198731 - RNA, 58 nt, Human
uuuuuuuucuuuuuuuggcaaccuggcucuggcccaggcuagagugcaguggugcgau

SEQ ID NO: 198732 - RNA, 58 nt, Human
auauguucaacucuucauagauugugaacuggcccaucaauauggucaggaauauuug

SEQ ID NO: 198733 - RNA, 58 nt, Human
ggaaugcugcgcugauuuuagccagccacuggcccagcugaaaugauggggaaaggag

SEQ ID NO: 198734 - RNA, 58 nt, Human
gcccuuccucacagaguuaaauaugcaucuggcccaggaauuagagaagcugaaagga

SEQ ID NO: 198735 - RNA, 58 nt, Human
uaaaugcuuaucaucuaaagauguagcucuggcccagugggaaaaauuaggaagugau

SEQ ID NO: 198736 - RNA, 58 nt, Human
ccgaccguggagcgcuggcaagggcguccuggcccagcccugagcgcgcggcccuucc

SEQ ID NO: 198737 - RNA, 58 nt, Human
agcucccagggccgucaccugcuuggcccuggcccagcucccugcccugaguccugag

SEQ ID NO: 198738 - RNA, 58 nt, Human
ugcgaugagaggugcaggaggcaggagccuggcccagggggugcuggugccuccccgg

SEQ ID NO: 198739 - RNA, 58 nt, Human
gcauuggagaugaugaaaccgagcagaccuggcccauguggagcuggcaugggggaca

SEQ ID NO: 198740 - RNA, 58 nt, Human
cccuggccgucccuccacucacccacaccuggcccaguccacguugagguccaggacu

SEQ ID NO: 198741 - RNA, 58 nt, Human
ccuguuauggucaccuggaaacagccuucuggcccaacucuggaugccuguuauacug

SEQ ID NO: 198742 - RNA, 58 nt, Human
cauuagcaggagcuccccagcggcaagccuggcccagugggcucgguagugcccagcu

SEQ ID NO: 198743 - RNA, 58 nt, Human
ccggccauauuaaccacacagccugagccuggcccagccucggcugccagaggugccu

SEQ ID NO: 198744 - RNA, 58 nt, Human
gccacacugucuccccaggggcgucgaccuggcccagcuggguccccagggccagcac

SEQ ID NO: 198745 - RNA, 58 nt, Human
accuugugacccaggguggggacaggggcuggcccagggcugcaaugcagcauguugc

SEQ ID NO: 198746 - RNA, 58 nt, Human
gggccucucuggcagcagagauuaaaaacuggcccaacuucauuuccauacuucaggg

SEQ ID NO: 198747 - RNA, 58 nt, Human
gccaguuggagacgggggcugggugucccuggcccacucccgguccccugugcuuuac

SEQ ID NO: 198748 - RNA, 58 nt, Human
caugaagccaauaggagagcguguggcacuggcccacaaacugucccuguccugucuu

SEQ ID NO: 198749 - RNA, 58 nt, Human
cccgccccuccgggguaauguggcauuacuggcccacagagguuuugagccaaucagc

SEQ ID NO: 198750 - RNA, 58 nt, Human
accgagggugaggcuggaggguccaaagcuggcccagcgagcaccagggucccaggug

SEQ ID NO: 198751 - RNA, 58 nt, Human
cuggaauuacaggcaugagccaccaugccuggcccaguguuuguuuuuuaaauuuaua

SEQ ID NO: 198752 - RNA, 58 nt, Human
ccaacauguauaauacagcaacaacuaucuggcccaaacugcuuuggauuaauauugg

SEQ ID NO: 198753 - RNA, 58 nt, Human
gaggggcguugugcaauuuguggcaaggcuggcccagcuggaugccugggucccagua

SEQ ID NO: 198754 - RNA, 58 nt, Human
aaugggggugcaugcugggccuggcccccuggcccacccccacuuuccagggcaaaaa

SEQ ID NO: 198755 - RNA, 58 nt, Human
gccucccacugaugucguggucccgggccuggcccaggggccccuuuacaugcccucu

SEQ ID NO: 198756 - RNA, 52 nt, Human
cccccuuacucaagcacuaaugcuggcccauucuuugagaccuuuucuccuu

SEQ ID NO: 198757 - RNA, 58 nt, Human
aaucaaucaaguugcugcagccuaugcacuggcccagaauaaaaaacguggugauucu

SEQ ID NO: 198758 - RNA, 58 nt, Human
cuugcacuccgguacccgacccggcgcccuggcccaucccaugccggggggccagugg

SEQ ID NO: 198759 - RNA, 58 nt, Human
ucgaggugcccagcucuccagggagcuucuggcccaaggccgucugagggaucugcuc

SEQ ID NO: 198760 - RNA, 58 nt, Human
ggacggccccugccggauaggccuagcccuggcccagguggugagcgguuugcagugu

SEQ ID NO: 198761 - RNA, 58 nt, Human
aggaggggacccgagccuguccuggcugcuggcccauccugccugggcaucccuggug

SEQ ID NO: 198762 - RNA, 58 nt, Human
gcagagcuggguccccccaaaacuugggcuggcccagggcccaccagcagcugauguu

SEQ ID NO: 198763 - RNA, 58 nt, Human
gucauccuccuggugcccacagcaggggcuggcccacguagggggcucugggcggccc

SEQ ID NO: 198764 - RNA, 58 nt, Human
aauuuccccugguguagagcuuguuuuucuggcccauccuuggagcuuuaugagugag

SEQ ID NO: 198765 - RNA, 58 nt, Human
cugggauuacaggccugagccaccguaucuggcccaaaacacaaauuuauauucucac

SEQ ID NO: 198766 - RNA, 58 nt, Human
uuuccagggugcugggggcugggguucccuggcccaaggguccagccuccucucaccc

SEQ ID NO: 198767 - RNA, 58 nt, Human
cccgucuccucccuguucccguuccucccuggcccaccccacucacacuccccaaggc

SEQ ID NO: 198768 - RNA, 58 nt, Human
aauguaaguugugugggaaagcauuuuucuggcccaguuuauuucguaugcaugaaag

SEQ ID NO: 198769 - RNA, 58 nt, Human
uugauccaaagcuuucccacagaccucccuggcccaccuagaggcuuucuuggucagu

SEQ ID NO: 198770 - RNA, 58 nt, Human
cgucaagucagugcagcgcugcauggcccuggcccagcuccucguggagcagaacuuc

SEQ ID NO: 198771 - RNA, 58 nt, Human
ccucccaucucuccuuccaggcccaucccuggcccagagcaggagggagggagggacg

SEQ ID NO: 198772 - RNA, 58 nt, Human
gcaucugcagcucucgcucugccucuuccuggcccaccuccucuuccucguggggauu

SEQ ID NO: 198773 - RNA, 58 nt, Human
ucucuuauggagacugaauaaaccaccucuggcccauguaggcccaaguacucagucu

SEQ ID NO: 198774 - RNA, 58 nt, Human
agugguacuuucucuuccugguaauccucuggcccagccucauggcagaauagaggua

SEQ ID NO: 198775 - RNA, 58 nt, Human
cauaugugucaguggggcucucugaguccuggcccaaagaagcaaggaaccaaauuua

SEQ ID NO: 198776 - RNA, 52 nt, Human
aguacgcucccagcgccugaggcuggcccagagcugucaggaccaugaagcc

SEQ ID NO: 198777 - RNA, 58 nt, Human
agaauggaagaauugaccagcugagccccuggcccaaauuucugacccacaaaaacau

SEQ ID NO: 198778 - RNA, 58 nt, Human
gguuuacuggaacgagggcgaggaacaccuggcccacccagggcggaaaaccgcuuaa

SEQ ID NO: 198779 - RNA, 58 nt, Human
ucuccuaaacacagcagggcuuuggagucuggcccaugcuccuuggccagaaggacag

SEQ ID NO: 198780 - RNA, 58 nt, Human
ccaggaaagccagauuccagccugagugcuggcccaauuacugcugaguggcccugga

SEQ ID NO: 198781 - RNA, 58 nt, Human
accccuucauccccagcugcuccuaggacuggcccaugggcaggcggguggggggaug

SEQ ID NO: 198782 - RNA, 58 nt, Human
cacuuccuguucccaccacuggacugggcuggcccagccccuguuuuuccaacauucc

SEQ ID NO: 198783 - RNA, 58 nt, Human
acugcuggaacccagccagugggagggccuggcccaccagaguccugcucccucacuc

SEQ ID NO: 198784 - RNA, 58 nt, Human
ccuucuucccgcaccacccuugccugcgcuggcccaguggaaaccaccaggaucuuga

SEQ ID NO: 198785 - RNA, 58 nt, Human
uugagguuuucuugguuggaagcugcagcuggcccaagaaagaaaauaaaaaacaaca

SEQ ID NO: 198786 - RNA, 58 nt, Human
gaugggcgccgagaggccugccuuuugccuggcccaggcucacccccaccuugggccu

SEQ ID NO: 198787 - RNA, 58 nt, Human
ggggucucgggcgugagugcgcugucugcuggcccagacuuuuucgggccgccggugc

SEQ ID NO: 198788 - RNA, 58 nt, Human
aggagcagggagcccugcaccuuguguccuggcccaccugaccuuugguguucuccgg

SEQ ID NO: 198789 - RNA, 58 nt, Human
ggcaccugcaugcacugggagggggcggcuggcccagcccucggggcaggagcccccu

SEQ ID NO: 198790 - RNA, 58 nt, Human
gagaccaccggugugggucacgagggcccuggcccacaguguugaggguccucucuuu

SEQ ID NO: 198791 - RNA, 58 nt, Human
ggcccugggacugugguggccgguggcccuggcccagcucuggagugcaugugugugu

SEQ ID NO: 198792 - RNA, 58 nt, Human
ccacaucuuggcuugcuuuuggaacaggcuggcccagcaucauuugucaucaagucca

SEQ ID NO: 198793 - RNA, 58 nt, Human
ccagcagauaaggccgagcccacaccaucuggcccaggcuggcccccacccaccuucc

SEQ ID NO: 198794 - RNA, 58 nt, Human
cuauuucuugcugcucaauccauuuccucuggcccagcuucccagugcucacagaugg

SEQ ID NO: 198795 - RNA, 58 nt, Human
ggcccagcuucccagugcucacagauggcuggcccaugugcuggaagaugacacaguu

SEQ ID NO: 198796 - RNA, 58 nt, Human
ccuguguauuggcccuguguuuaccacucuggcccacuccucacccccuugcuccccu

SEQ ID NO: 198797 - RNA, 58 nt, Human
uauccugagguuccuagaucucacugaacuggcccagcuaaggagaccuggacucugg

SEQ ID NO: 198798 - RNA, 58 nt, Human
cugagccagcuuuauauuucaaccauggcuggcccaucugagagcaucuccccacucu

SEQ ID NO: 198799 - RNA, 58 nt, Human
gcaugccacuuccagcaggcaugcaguccuggcccagcucuaugggaaacaaggagga

SEQ ID NO: 198800 - RNA, 58 nt, Human
guccccucccagagggggaacccuggcacuggcccagcagccucuucucugagcucca

SEQ ID NO: 198801 - RNA, 58 nt, Human
guuaagggaugaaggcaaggcugcaggucuggcccaggggaauuaaaagccagccacu

SEQ ID NO: 198802 - RNA, 58 nt, Human
accuccaaguggacuucuugcaaagggucuggcccagggcagggcugccccacacaag

SEQ ID NO: 198803 - RNA, 58 nt, Human
aaggacagcucagcugcuggcagccugccuggcccauagacaucccccaaguagucuc

SEQ ID NO: 198804 - RNA, 58 nt, Human
uuucccuucaggagaccagcgagaggcccuggcccauucccuccagcggugcaaugaa

SEQ ID NO: 198805 - RNA, 58 nt, Human
ugaauuggcugccaagaguccaagccaucuggcccaacauacgcacugggcauugggu

SEQ ID NO: 198806 - RNA, 58 nt, Human
uuggugcacugcccacuucccagcuccacuggcccaagucugagccggaggcccuugu

SEQ ID NO: 198807 - RNA, 58 nt, Human
cuaguaugccuugcgcuaucaugacugacuggcccaguaugauucuguugucgcugau

SEQ ID NO: 198808 - RNA, 58 nt, Human
ccuucuggaaacaaguagaagccaucaccuggcccaugucccuacaaacccaugauug

SEQ ID NO: 198809 - RNA, 58 nt, Human
ggccagaggguuauauaccauccugucucuggcccacugugguaauuccacauccagg

SEQ ID NO: 198810 - RNA, 58 nt, Human
ugggggcucucggaaauggaaugugccccuggcccaucucagccuccugagccugugg

SEQ ID NO: 198811 - RNA, 58 nt, Human
cuccuaugguuugggaaggaauaacacacuggcccauuaguaagggugaaggcuggag

SEQ ID NO: 198812 - RNA, 58 nt, Human
gccagggagacucagcucuccuugggggcuggcccagcugacugaggguacacaggau

SEQ ID NO: 198813 - RNA, 58 nt, Human
cucuggucuuuagagccaccagaucucucuggcccauacagauaucagagcagacgga

SEQ ID NO: 198814 - RNA, 58 nt, Human
aucagcuggauccccacgugagcaacagcuggcccaggaaaggcugccugcagaggac

SEQ ID NO: 198815 - RNA, 58 nt, Human
ccuuuucacauuucagaaucggcaaugccuggcccacuccugagagcucuaguuuucu

SEQ ID NO: 198816 - RNA, 58 nt, Human
ggcaggugcugcugccuguugugguuuccuggcccagcuucuccuucucccucugcau

SEQ ID NO: 198817 - RNA, 58 nt, Human
ucagaagugcaagaguuccaaagagccucuggcccaggccccuccccaccagggcuuu

SEQ ID NO: 198818 - RNA, 58 nt, Human
ggcuuuggaggggagucuggcagcccggcuggcccaggcccugcagcggcagccuuuc

SEQ ID NO: 198819 - RNA, 58 nt, Human
gcuucccucccuucuccucugucuugcccuggcccacgcacgccugucucgucuuccu

SEQ ID NO: 198820 - RNA, 58 nt, Human
gacccugcgggaugccggggcggccaggcuggcccaacggacagacaggaccaggauc

SEQ ID NO: 198821 - RNA, 58 nt, Human
agaagcccccucaucggcccgcagcuggcuggcccagugcuccuggcugggggcucuu

SEQ ID NO: 198822 - RNA, 58 nt, Human
agcccgaccgcgcccuccagggucgucccuggcccaaggccaggggccacaaguuagu

SEQ ID NO: 198823 - RNA, 58 nt, Human
agcuucauuauuacguggcaaaaucccucuggcccacacagaucuguaauucacuagg

SEQ ID NO: 198824 - RNA, 58 nt, Human
gaagcuguucaugccaagaccgaaagugcuggcccaguaugaguccauucaguucaug

SEQ ID NO: 198825 - RNA, 58 nt, Human
cauugccucggcuggcuccccugcagcccuggcccaucauggggggagcacccugagg

SEQ ID NO: 198826 - RNA, 58 nt, Human
cuggcucccuuggccuugcagcgagccccuggcccacgccgagcgagggaugcuucuc

SEQ ID NO: 198827 - RNA, 58 nt, Human
ccuuuccaguauugguacaucuuggcuucuggcccaaaccccaagcagaaaagaaaau

SEQ ID NO: 198828 - RNA, 58 nt, Human
cuccagcccgcccccagccuguggacgccuggcccacccugagugugagucacagaga

SEQ ID NO: 198829 - RNA, 58 nt, Human
gccauccugcccggagaggcgccuguaccuggcccaggcuggccugagccugaugcug

SEQ ID NO: 198830 - RNA, 58 nt, Human
gggcacaggcugccuuuuggagggagggcuggcccauaggugcugcuggcuccccgcc

SEQ ID NO: 198831 - RNA, 58 nt, Human
ggggcaaaaagcccagauaccauuuuaacuggcccaguucauuuucuccuuucauuuu

SEQ ID NO: 198832 - RNA, 58 nt, Human
acagugccuuugaccuuaaaacauggcacuggcccaugugaccuuugccauuucccag

SEQ ID NO: 198833 - RNA, 58 nt, Human
gaugugcagaacaaccacucaggccuuucuggcccaccuggacagugcauuuaccugu

SEQ ID NO: 198834 - RNA, 58 nt, Human
cuccucgcacagaaauggugggcucucucuggcccagcguggugguucaugccuguaa

SEQ ID NO: 198835 - RNA, 58 nt, Human
ccagaucaccgaggaggaggcaaaacuucuggcccagaaggccgcagaggcugagcag

SEQ ID NO: 198836 - RNA, 58 nt, Human
ccuguggcuccacaggugcugcuucucacuggcccagacucugagcuccaccggccca

SEQ ID NO: 198837 - RNA, 58 nt, Human
uugcaacaaauacaggcgccugcacagccuggcccaccuguucauuaaugcacucaau

SEQ ID NO: 198838 - RNA, 52 nt, Human
cccgggacucaccucccuagcccuggcccagcccccugcagggggguguucu

SEQ ID NO: 198839 - RNA, 58 nt, Human
uucuguccacguuugucaaaagguggugcuggcccaccucugaaagcagaacacuugc

SEQ ID NO: 198840 - RNA, 58 nt, Human
gugaucccacccccagccauuugcauugcuggcccagcgccuggccuggggggcgggg

SEQ ID NO: 198841 - RNA, 58 nt, Human
cucugcuugggcuucugagcugguggcccuggcccagaggucuggcggaggcccaggc

SEQ ID NO: 198842 - RNA, 58 nt, Human
cuccugccagcggcugcugaaccuuccccuggcccacccucaccacccaaggggucau

SEQ ID NO: 198843 - RNA, 58 nt, Human
uccuaguugcugauggcgcugguaccugcuggcccauggcccggguguagagaaacca

SEQ ID NO: 198844 - RNA, 58 nt, Human
uucacucccaggcaggggugaggguggccuggcccaggaggccaggaaggagggcccu

SEQ ID NO: 198845 - RNA, 58 nt, Human
gggugggggccuugugaugggggguaggcuggcccaugugugaucuugugggguggag

SEQ ID NO: 198846 - RNA, 58 nt, Human
gcugcccuauacacugggggauucugcccuggcccaugcacacccgucuuuccaugau

SEQ ID NO: 198847 - RNA, 58 nt, Human
gugugacaccaccacugugucccagugucuggcccagccauggcuggaugugcaucug

SEQ ID NO: 198848 - RNA, 58 nt, Human
ucaagccugaagaggcuccgcccacaagcuggcccaugaaguuagcaaugccuguggc

SEQ ID NO: 198849 - RNA, 58 nt, Human
cugcgcuagucucccccgaggguuuaggcuggcccagcacauccuguccuccugagcu

SEQ ID NO: 198850 - RNA, 58 nt, Human
agucagacuggaauggcuuuguuaugcccuggcccacuugcugccgaauucccagaag

SEQ ID NO: 198851 - RNA, 58 nt, Human
ccgggauuacaggcaugagccuccacaccuggcccaugcuggguuuuugugcaucccu

SEQ ID NO: 198852 - RNA, 58 nt, Human
uccucacagcuggcuuguaaggcaggagcuggcccaggccacagcaccugcuggggug

SEQ ID NO: 198853 - RNA, 58 nt, Human
cucucagacgaggcagcugacgaggcagcuggcccagucuugggagucugcucaggac

SEQ ID NO: 198854 - RNA, 58 nt, Human
caccccagccgggcccgcucaggaugcccuggcccaggcuuggggcugcugggguugg

SEQ ID NO: 198855 - RNA, 58 nt, Human
ccugagcacugggcuucugcuuucugcucuggcccacaugugacucuugauauucucc

SEQ ID NO: 198856 - RNA, 58 nt, Human
auuuauuuucuuuacaguggcacucaggcuggcccagccagggcaggcagaagcuagg

SEQ ID NO: 198857 - RNA, 58 nt, Human
ucuuuuuuuaacggcugccgugcccuuccuggcccagcccuaaaccuaaauucaaauc

SEQ ID NO: 198858 - RNA, 58 nt, Human
uucagccaugcauggacugggguguucccuggcccauggucaccugugccccucgugu

SEQ ID NO: 198859 - RNA, 58 nt, Human
ggaugcccguuggacuuugccccucacacuggcccagccccucacacugccccacccc

SEQ ID NO: 198860 - RNA, 58 nt, Human
uguagcgguuugaauguugguuccaugccuggcccagccccaccucagucuccaggac

SEQ ID NO: 198861 - RNA, 58 nt, Human
ugcuguggaagucaccaggccuccccuccuggcccaggugugcugggggcaccgugcc

SEQ ID NO: 198862 - RNA, 58 nt, Human
gucgggauuuggguuuuaacgucuucugcuggcccagcccugcucuguuguggggagu

SEQ ID NO: 198863 - RNA, 58 nt, Human
guguuggauagaugccagggccccuccucuggcccaggacgccugcugcaagcccacc

SEQ ID NO: 198864 - RNA, 58 nt, Human
gcagcuugugcucugcccagcagugccccuggcccagcaccucagccugcucuucucu

SEQ ID NO: 198865 - RNA, 58 nt, Human
agccuggguuaaacuuuaccacugugcccuggcccaggcaucaccaacacggccuccc

SEQ ID NO: 198866 - RNA, 58 nt, Human
aagacauuccucccacacuuuucccuuccuggcccaagagagcauccagaaggcagua

SEQ ID NO: 198867 - RNA, 58 nt, Human
caggcaucccgggcacauccacaagcugcuggcccagcagcuggucuccccagugaag

SEQ ID NO: 198868 - RNA, 58 nt, Human
aacuuagugguuuaaaacaacacauuugcuggcccacaguuuuugagggucaggaguc

SEQ ID NO: 198869 - RNA, 58 nt, Human
cgacagugaaaucuagaguaaaaccaagcuggcccaagguguccugcaggcuguaaug

SEQ ID NO: 198870 - RNA, 58 nt, Human
aguagcuggggcuacaggugcuggccgccuggcccagcuuguaauaucuuuuuauguc

SEQ ID NO: 198871 - RNA, 58 nt, Human
agcagguguuagacgaaagaacagaugucuggcccauugucuccagucuguuccuguc

SEQ ID NO: 198872 - RNA, 58 nt, Human
uguuacacaguaauagguuaauaauacacuggcccagauuaggaagguucugccaucc

SEQ ID NO: 198873 - RNA, 58 nt, Human
aggcagccccuccccaggcuuugugagccuggcccaagccaguacaagagggccuggg

SEQ ID NO: 198874 - RNA, 58 nt, Human
gagggacuuaagcccaagugggucaggccuggcccagguccuuauacuccccuaucuu

SEQ ID NO: 198875 - RNA, 58 nt, Human
ucuagccucuggacuggaaagcacaagacuggcccagugccagcaaguccuuaggcua

SEQ ID NO: 198876 - RNA, 58 nt, Human
ugcacugaacauaccccaagagccccugcuggcccauugccuagaaaccuuugcauuc

SEQ ID NO: 198877 - RNA, 58 nt, Human
gacuugugacuaacgaagcugguugcugcuggcccagggcugggggcuuggggguaaa

SEQ ID NO: 198878 - RNA, 58 nt, Human
cgguuuuccuagaagccccucacccccacuggcccacugguggcuaggucuccccuua

SEQ ID NO: 198879 - RNA, 58 nt, Human
uagcaaaccaaacauaguucgagaacagcuggcccaggagcuaccacuggcuacucag

SEQ ID NO: 198880 - RNA, 58 nt, Human
cauuguugauuguuaugacugguacacucuggcccagccagagcuauaauuguuuuuu

SEQ ID NO: 198881 - RNA, 58 nt, Human
aaaagacuccugggcucaccuguuagcgcuggcccagcccaggccuugggaccugggg

SEQ ID NO: 198882 - RNA, 58 nt, Human
agaggcgggggacagcagaggcugcagacuggcccacuucccuccuccccagggaugc

SEQ ID NO: 198883 - RNA, 58 nt, Human
cgcaugucuggacacugaucaggcccugcuggcccaggucccugugcgcaugcacaug

SEQ ID NO: 198884 - RNA, 58 nt, Human
ggccucuacgagagguccucaucuccaucuggcccaacaauucccagauucugaagcu

SEQ ID NO: 198885 - RNA, 58 nt, Human
ggaggacagaaccaacgggucugugggacuggcccaccccucuucccccuuccccugc

SEQ ID NO: 198886 - RNA, 58 nt, Human
guuugucuuugcugccccucuccccuaccuggcccauucacugagucuucucagcaga

SEQ ID NO: 198887 - RNA, 58 nt, Human
cgcuccacauccugccugccccucagcccuggcccaggccccuuuuggaggcagcuga

SEQ ID NO: 198888 - RNA, 64 nt, Human
uaaaaagggagcuguggauccacuuagaucagggcggaaccaucuuucacccggccaagcuccu

SEQ ID NO: 198889 - RNA, 64 nt, Human
gacacagucagcaugcuucccagagggagcaggccggaaccacagggccagagggagcuggaac

SEQ ID NO: 198890 - RNA, 64 nt, Human
gagcgacggcugcugaaagaggcuguccaccuggcggaaccaccggagcccggaggcuuggggg

SEQ ID NO: 198891 - RNA, 64 nt, Human
gaaagaugcaagcaccugaauuucuguuugaaugcggaaccauagcugguuauuucucccuugu

SEQ ID NO: 198892 - RNA, 64 nt, Human
acucacuagaacuucccugugugcugugagccagcggaaccacuuguacaaugccagauuuguu

SEQ ID NO: 198893 - RNA, 64 nt, Human
cugauucgggguggggugggggacuaggcucagccggaaccagcaccuccaaggaguccgggag

SEQ ID NO: 198894 - RNA, 64 nt, Human
gaaauauuuuuuauuuuuccccaagaauugcaaccggaaccauuuuuuuuccuguuaccaucua

SEQ ID NO: 198895 - RNA, 64 nt, Human
cagaaaccagauacuuagccuucuacuguagcuacggaaccagauucuggugaauuuguccaca

SEQ ID NO: 198896 - RNA, 64 nt, Human
gggauaggaccgucucugucugauccuguccauucggaaccaggcccaccuggaaucccacaac

SEQ ID NO: 198897 - RNA, 64 nt, Human
uucagggacccaccgcccauuccccgagagcugucggaaccagaugcaacccggcagcccagag

SEQ ID NO: 198898 - RNA, 64 nt, Human
ucaauccugccucuugcaaugacagcugaucugucggaaccaggacacaaaagcagcaagaagc

SEQ ID NO: 198899 - RNA, 64 nt, Human
ugcagguagcggugccuuucccgccgccuuggcccggaaccaaggugggccaagguccgccuug

SEQ ID NO: 198900 - RNA, 64 nt, Human
cccccuucugggaguggaggucucaggcucaauccggaaccauguacguacaguuuugcuuauu

SEQ ID NO: 198901 - RNA, 64 nt, Human
uuuauggcauuuuaaaaugacacuguuaacccaacggaaccauuuuccaguuugauacagaaug

SEQ ID NO: 198902 - RNA, 64 nt, Human
accaggcacugcuggccuuucuccugcccggccucggaaccagcuuuucucucuuacgaugaag

SEQ ID NO: 198903 - RNA, 64 nt, Human
gccacaauccacgcuucuccggaucgcggugcgccggaaccacggaggaugaugccaguuacuu

SEQ ID NO: 198904 - RNA, 64 nt, Human
caugcccuggaauacaacucagagcuccaggcagcggaaccaucuauuguuuuguuugccagaa

SEQ ID NO: 198905 - RNA, 64 nt, Human
gucuguccgucuaugaacaugcgggggaaggauccggaaccaggacccagaagcaccuccuuug

SEQ ID NO: 198906 - RNA, 64 nt, Human
agagccgcuccuuacagaauggagccuccaucaccggaaccagcguggugacugugucacagau

SEQ ID NO: 198907 - RNA, 64 nt, Human
ucccggagccucugcccauggcgggguggagacccggaaccagcagcccccuccacuggcgaca

SEQ ID NO: 198908 - RNA, 64 nt, Human
agcugcucagaccuacuuccuugggagggggugacggaaccagcacuguguggagaccagcuuc

SEQ ID NO: 198909 - RNA, 64 nt, Human
acugccacacugguggggaccugggacccagacccggaaccagcccagauaucaccccugagga

SEQ ID NO: 198910 - RNA, 64 nt, Human
cuaacccagcaaaucuaagcccaaggaagaagggcggaaccagaaguagggccucgacuugcuu

SEQ ID NO: 198911 - RNA, 64 nt, Human
aaugggcuguuucacaggccuggccacgcucucacggaaccacuggcaucagauggugaaguga

SEQ ID NO: 198912 - RNA, 64 nt, Human
ggaucacaccugggugaggggcccaagccccucccggaaccaaaggugcaggcucaggccugcg

SEQ ID NO: 198913 - RNA, 64 nt, Human
ggcuguccuggccgaaagggaccuccagcgcugccggaaccacagggaggagucaguggcuguc

SEQ ID NO: 198914 - RNA, 64 nt, Human
uaggccccugagggccuggccacaugggaccaagcggaaccagaacaaggucccgacaggggua

SEQ ID NO: 198915 - RNA, 64 nt, Human
ugggccuugucuagcuguuggcuuuggccugaaccggaaccagucucagaugaccacggguuua

SEQ ID NO: 198916 - RNA, 56 nt, Human
uggauggcugugacuucuaggauggacggaaccaugcacagcaggcugggaaaugu

SEQ ID NO: 198917 - RNA, 63 nt, Human
gagaagagaugccccucuagccccucagaucugcggaaccagcccuacauccgcgcagacaca

SEQ ID NO: 198918 - RNA, 64 nt, Human
uacacacaaauuauauaucuaucuaucuauacagcggaaccacaagagagacugaggaaggccu

SEQ ID NO: 198919 - RNA, 64 nt, Human
gggguggguggguaagggggggagugggaggggacggaaccaacuuuuucuguauuuuguauug

SEQ ID NO: 198920 - RNA, 64 nt, Human
cuuaaauaaucaggugcuuuguaaccaagcacaucggaaccagaggguggagguugguguggaa

SEQ ID NO: 198921 - RNA, 64 nt, Human
aagccccucccugagugguccccaccuuucuggacggaaccacguacuuuuuacauacauugau

SEQ ID NO: 198922 - RNA, 64 nt, Human
gggugcuggggcucgggacccaccccccugcuugcggaaccaacuuuucucuguguguccagca

SEQ ID NO: 198923 - RNA, 64 nt, Human
ugcauccguggucaaaagucagcugccagcccugcggaaccagagccucaggcugggaugggga

SEQ ID NO: 198924 - RNA, 64 nt, Human
ggcgggucuauguucacguccccccagcagcaggcggaaccacccagccagggcacucagugca

SEQ ID NO: 198925 - RNA, 64 nt, Human
gcauauuaccacuaacacuaauacauauagagagcggaaccauaacucauugaauuuuggagag

SEQ ID NO: 198926 - RNA, 64 nt, Human
cucuuagcugagguucgggauauaccccgaggcgcggaaccauagauauaacagugguaacagu

SEQ ID NO: 198927 - RNA, 64 nt, Human
caaucuucuaauuacagugguuccuaucucagggauacuggacuuucugacgcagaugaacaau

SEQ ID NO: 198928 - RNA, 64 nt, Human
aaaauguagcuuuuggggagggaggggaaauguaauacuggaauaauuuguaaaugauuuuaau

SEQ ID NO: 198929 - RNA, 64 nt, Human
caaccgccaggcaccuucagaagaauccagccuaauacuggaauuugugcuauuaucuuccucu

SEQ ID NO: 198930 - RNA, 64 nt, Human
ugacaagaaauuugcaagcuuuucaaucucaggaauacuggauucuauagccaagaacucauga

SEQ ID NO: 198931 - RNA, 64 nt, Human
uuaggcaucaaaauccaagguagcuguaagaaaaauacuggagcuaacaaugaagaacagaagu

SEQ ID NO: 198932 - RNA, 64 nt, Human
uguuggcgauagccaagaccacaagcaaaagcacauacuggaaaugaugaguuagaaucugauu

SEQ ID NO: 198933 - RNA, 64 nt, Human
gucaaaaguuuaacuauauuccaaguacaaaaacauacuggauuacauugaggauguugaauag

SEQ ID NO: 198934 - RNA, 64 nt, Human
auugucguauaggcauguaaacagccucuuuuugauacuggaggaacacuugauggagugugag

SEQ ID NO: 198935 - RNA, 64 nt, Human
accaagcaauuuaauuacaauuguuaaaacugaaauacuggaagaagauauuuuuccugucauu

SEQ ID NO: 198936 - RNA, 64 nt, Human
uuccccuuuaaaggaaacuuugaaaggauugugaauacuggaaaaugacaaaacuaaagguaga

SEQ ID NO: 198937 - RNA, 64 nt, Human
auggguaaaggaaacauuuugccuuuuguaucuuauacuggaaugggaugucuguaaguccuag

SEQ ID NO: 198938 - RNA, 64 nt, Human
aaggccaggaggaccaggggugcagacagaacacauacuggaacacaggaggugcucaauuacu

SEQ ID NO: 198939 - RNA, 64 nt, Human
cucucgcacaaugcaugugcugucuccaugcuggauacuggacacacuaaacucuggggcuugu

SEQ ID NO: 198940 - RNA, 64 nt, Human
ggagaugauuggaggccauggccuauguacaaacauacuggaagaaaaccagcuuguuuuuaaa

SEQ ID NO: 198941 - RNA, 64 nt, Human
ggaaaauaaguuaaauuaagcccaaguaacaaaaauacuggaauuauuaaaacguauaguaugc

SEQ ID NO: 198942 - RNA, 64 nt, Human
acaaauuacuguguaccuaaguggugugauguaaauacuggaaacaaaaacagcaguugcauug

SEQ ID NO: 198943 - RNA, 64 nt, Human
gagguaaagcuguaucccccuaaacuuaggggagauacuggagcugaccauccugaccuccuau

SEQ ID NO: 198944 - RNA, 64 nt, Human
uugccuccgagguucuugggcacacucuauagccauacuggacaggaaccaggugccccgugua

SEQ ID NO: 198945 - RNA, 64 nt, Human
caucaggugcuauaaguguuugggauugagcaucauacuggaaagcaaacaccuuuccuccagc

SEQ ID NO: 198946 - RNA, 64 nt, Human
uuugauuugaggagguuugcacauguagagaagcauacuggagaagcauauccagagggcgaaa

SEQ ID NO: 198947 - RNA, 64 nt, Human
acugugcagggagccgauacguuugcugauagcaauacuggaaccaccgggugcgauggcagug

SEQ ID NO: 198948 - RNA, 64 nt, Human
ugguagggagcauuuggguuugaaucugaaugcuauacuggauacucugcuccggaaagaugag

SEQ ID NO: 198949 - RNA, 64 nt, Human
auaucuugaaaugaaaguauaacugaguuaaauuauacuggagaagucuuagacuugaaauacu

SEQ ID NO: 198950 - RNA, 64 nt, Human
aagugcaaugacaauuauauauuccuacucggucauacuggacuggcuucguucucuuaauaua

SEQ ID NO: 198951 - RNA, 64 nt, Human
gguaucuuuccugcccuuuuccuuuguguacucuauacuggaguucccuucuuccucuugcugu

SEQ ID NO: 198952 - RNA, 64 nt, Human
gaucauuuaauauauucauauuaccaagacuauuauacuggaagugguuuuuguguuauaaagg

SEQ ID NO: 198953 - RNA, 64 nt, Human
auauuuuuuugguuauauccaacuuuuuguaaauauacuggaagcuugauaauaaaauguauuu

SEQ ID NO: 198954 - RNA, 64 nt, Human
acguggcuggccuuguuauuucaccacucuggauauacuggaauagaaagcaacuuacauacaa

SEQ ID NO: 198955 - RNA, 64 nt, Human
aguucucaauggcuacgugugacuagugcuuaccauacuggacagcacagacacagaauauuuu

SEQ ID NO: 198956 - RNA, 64 nt, Human
ucuauuuaaaauguacugaggcacaacaaguauuauacuggaagacuugccaaacuggcaaagc

SEQ ID NO: 198957 - RNA, 64 nt, Human
guaaggagaaguucuccuuuguuugcaaguucaaauacuggaggcaauuguaaaauggacgucu

SEQ ID NO: 198958 - RNA, 64 nt, Human
guagucccuauagaaugaucuguaauaaaauaguauacuggacugugcaucaaagggauguaaa

SEQ ID NO: 198959 - RNA, 64 nt, Human
gccaccaaacaccuuagggucuuagacucugcugauacuggacuucuccauaaaguccugcugc

SEQ ID NO: 198960 - RNA, 64 nt, Human
aguagugaccaagaacacagugauuauauacacuauacuggagggauuucauuuuuaauucauc

SEQ ID NO: 198961 - RNA, 64 nt, Human
aaaaaaaugccuaaaauaagguuuucuugcauaaauacuggaaauugcacaugguacaaauuuu

SEQ ID NO: 198962 - RNA, 64 nt, Human
ucaaauaaauguuuacuuaucuuacaaagcucaaauacuggauuguaaccaugugaugaaguua

SEQ ID NO: 198963 - RNA, 64 nt, Human
gaaccuaagucucuucacuuugcuggcaccugcuauacuggaguauugcuaugucuuuaaaaaa

SEQ ID NO: 198964 - RNA, 64 nt, Human
guugccucagguucccaggggcccgggaguccaaauacuggaauggaggguuggaggcagccuu

SEQ ID NO: 198965 - RNA, 64 nt, Human
ucucaucucacguccuuagucucuguuaaugaacauacuggauguggaguuuaauaaauuaccu

SEQ ID NO: 198966 - RNA, 64 nt, Human
cacugccaaaacaucucagagacuucuuuuauguauacuggaguucaaagaucuuuaacuuacc

SEQ ID NO: 198967 - RNA, 64 nt, Human
cagccucucugcaaacauuuauuuugugugcuagauacuggagauauguugcuggauaaaacag

SEQ ID NO: 198968 - RNA, 64 nt, Human
aacacaaacucucucaauacagauaaacucacacauacuggagauauauauauaauagauauau

SEQ ID NO: 198969 - RNA, 64 nt, Human
agcucaauuuaugcagagauuaaaugacaucauaauacuggaugaaaacuugcauagaauucug

SEQ ID NO: 198970 - RNA, 64 nt, Human
aucuuuagaaauuuaugugaaaaaugguuuuccuauacuggauaaagcaauuccccuuaggaaa

SEQ ID NO: 198971 - RNA, 64 nt, Human
acccaagcagcaacgagcaacaaucggaaaccaaauacuggagagaaaaccaacguuuccaccc

SEQ ID NO: 198972 - RNA, 64 nt, Human
cucuuaccucaacuucuuggggugggaaucagugauacuggagauggcuaguugcuguguuacg

SEQ ID NO: 198973 - RNA, 64 nt, Human
auaaaggggacugaacucugugggaaucacauccauacuggagcccuggauuuuugcaguucug

SEQ ID NO: 198974 - RNA, 64 nt, Human
gcugagcacagcuugaccccucuagccccuguaaauacuggaucaaugaaugaauaaaacucuc

SEQ ID NO: 198975 - RNA, 64 nt, Human
cauuuaaaauauaauugcgaauaucagaaaacucauacuggaaaacuaaauuuuuuuuuucucu

SEQ ID NO: 198976 - RNA, 64 nt, Human
gugccacccuucuuggaagacccccuccagaagcauacuggaagccaccucuggaaaagccuca

SEQ ID NO: 198977 - RNA, 64 nt, Human
gacccccuaagucuuauuuucuaguaaacugaugauacuggaaauucuuuuacuucaaaugcaa

SEQ ID NO: 198978 - RNA, 64 nt, Human
aauagucaagaaaaaaauggaaacaguagcauccauacuggaaucuugccauauuuuuuucauu

SEQ ID NO: 198979 - RNA, 64 nt, Human
aauaaaagcagcaucugcuaauaaaacccaacagauacuggaaguuuugcauuuauggucaaca

SEQ ID NO: 198980 - RNA, 64 nt, Human
cauacuccaggcuucuuaaacauaaugagaacucauacuggaggaaagucuuacaaaugugaag

SEQ ID NO: 198981 - RNA, 64 nt, Human
gcugggagaaaccaacaugacgaaaagacaaagaauacuggagaagagagagggugggcagagc

SEQ ID NO: 198982 - RNA, 64 nt, Human
cgucuaacagccuagacaaucucgucagaugcucauacuggaccaucagccuccccauuuuagc

SEQ ID NO: 198983 - RNA, 64 nt, Human
uguuuuuauaaauaaacuguuucauaaauaauguauacuggaaaauugucaucacucuuguaaa

SEQ ID NO: 198984 - RNA, 64 nt, Human
uuaaauaauuuaaccauaaauuuucugucaugugauacuggaauaugggauacuuuucauguuu

SEQ ID NO: 198985 - RNA, 64 nt, Human
uccugguuuagcccccaucuagucaggaauuaauauacuggaauaccuaccuucuauuuguuau

SEQ ID NO: 198986 - RNA, 64 nt, Human
auggguuagagugccuuugagaagaaaucaguggauacuggauuugcuccugucaaugaaguuu

SEQ ID NO: 198987 - RNA, 64 nt, Human
uaaagcuaauuugugaccaaagauggcauccuucauacuggaugcuguauccaauacuuuguug

SEQ ID NO: 198988 - RNA, 64 nt, Human
guggaauaggugacucacugaaaugccuuuauaaauacuggaacaaauccugcugcaaaaauga

SEQ ID NO: 198989 - RNA, 64 nt, Human
ccuggaaaacuggcugggcagagccugugugaaaauacuggaauucaaagauaaggcaacaaaa

SEQ ID NO: 198990 - RNA, 64 nt, Human
agaauucugacuuugaaacuuauuaaauuaaugcauacuggaaguacuuugauacucaaguugu

SEQ ID NO: 198991 - RNA, 64 nt, Human
uuuaugccucccuuuuguguugacacuguagcucauacuggaaaagucgaucaauguuuugcag

SEQ ID NO: 198992 - RNA, 64 nt, Human
uugcuggcuugcccaggccagagcaggaccacagauacuggacaagcugguacagccaaccccc

SEQ ID NO: 198993 - RNA, 64 nt, Human
ccauuauuuaauaaaugacaaauguauuaaugcuauacuggaaauguaaaauugaaaauauguu

SEQ ID NO: 198994 - RNA, 64 nt, Human
guaugggacuguaaugcgcuuaguggucugacauauacuggaaauguauguauacuggcguacu

SEQ ID NO: 198995 - RNA, 64 nt, Human
uaggaguauuagagauaagaaaguauaugaaaauauacuggaaauauuggauucuuggagaaaa

SEQ ID NO: 198996 - RNA, 64 nt, Human
uguuuuugaaagaguaaaaguacugaugcuucugauacuggauguuuagcuucuuacugcaaaa

SEQ ID NO: 198997 - RNA, 64 nt, Human
uuuccucuccccagccccccuuaccuucacucccauacuggacaagacauuuuggacaugaguu

SEQ ID NO: 198998 - RNA, 64 nt, Human
uuucacacagcagcugagacuuaugggccagaagauacuggaagaugguguggccuucucuugc

SEQ ID NO: 198999 - RNA, 64 nt, Human
uuauuguuauuaauugcacuuaacauuuuuaguuauacuggauauugaguauggauuuucucua

SEQ ID NO: 199000 - RNA, 64 nt, Human
aaaucccucgguucuaagauacaauggauuccccauacuggaaggacucugaggcuuuauuccc

SEQ ID NO: 199001 - RNA, 64 nt, Human
cacauuuguuuugggcuuaaauuacuuuuuaaagauacuggauuuuccuaagauuucugauuua

SEQ ID NO: 199002 - RNA, 64 nt, Human
uuaagcauccgacaucuaaauagcaauauuuugaauacuggaaacucagguuaaagauuuuguu

SEQ ID NO: 199003 - RNA, 64 nt, Human
agacagccccucuguugagauauggaggggacagauacuggaaucgggggugggacuugcaguu

SEQ ID NO: 199004 - RNA, 64 nt, Human
uuuggagcuggacaacauuugacaccaaccaaucauacuggacaaggcccuuagaggacuugaa

SEQ ID NO: 199005 - RNA, 64 nt, Human
gaccugcugaugagaaaaugcaagacaauuuuugauacuggaacuaugcuuugaaauacaccuu

SEQ ID NO: 199006 - RNA, 64 nt, Human
uuuuguguagcaucuugucuaucauguuuuguaaauacuggagaagcuuugaccaauuugacuu

SEQ ID NO: 199007 - RNA, 64 nt, Human
uaagucagguucuuuacaaaugguauuuugauagauacuggauuguguuugugccauauuugug

SEQ ID NO: 199008 - RNA, 64 nt, Human
ugggugcauuugcccucauccugagaaggccagaauacuggagaccagcgugaacccucaccca

SEQ ID NO: 199009 - RNA, 64 nt, Human
ucaauuuuaacaacagcuggugcccugcuuucagauacuggauuguacuuugugcugggguuau

SEQ ID NO: 199010 - RNA, 64 nt, Human
aggaagaccgggcauugggcuggugucaugaagaauacuggaauauaggagguagggucuggag

SEQ ID NO: 199011 - RNA, 64 nt, Human
uaucagaaauauuugaugugugcauuguugaaaaauacuggauacaugucuugucagaauuguc

SEQ ID NO: 199012 - RNA, 64 nt, Human
aauauucccacauaauacaucugaaugguuaaaaauacuggaagaguugucagggcuacaauag

SEQ ID NO: 199013 - RNA, 64 nt, Human
ugauccuacaagcuuacuacacauaggaaaauucauacuggagagaaacuacaaaugugaagaa

SEQ ID NO: 199014 - RNA, 64 nt, Human
ugauccucaacuuuuacuaaacauaagguaauucauacuggagaaaagccauacaaaugagaag

SEQ ID NO: 199015 - RNA, 64 nt, Human
caguccucacaccuuucuacacauaagauaauuuauacuggagaggaacucuauaguugugaag

SEQ ID NO: 199016 - RNA, 64 nt, Human
uaaccaauccucauaccuuacuauacagaaauucauacuggagagaaagccuacaauugugaag

SEQ ID NO: 199017 - RNA, 64 nt, Human
cuuccuuaacccuuaacuguagauaagaaaauucauacuggaaagaaacccuacaaaugugaag

SEQ ID NO: 199018 - RNA, 64 nt, Human
ugauucucaacucuuacuacauguaagaguauuuauacuggaaagaaacccuacaaauguaaaa

SEQ ID NO: 199019 - RNA, 64 nt, Human
caguccgcaaagcucacugaacauaaguuaauucauacuggagaaaaacccuacaaauguaaag

SEQ ID NO: 199020 - RNA, 64 nt, Human
aaguccucaacucuuacugcacauaagaucauucauacuggagagaaaccuuacaaaugugagg

SEQ ID NO: 199021 - RNA, 64 nt, Human
caagucucaacacuuacuauacauaagauaauuuauacuggagcaaaaccuuggaaauucaaag

SEQ ID NO: 199022 - RNA, 64 nt, Human
aagucuucaacccuuucugcacauaauauaauucauacuggagagaaaccccacaaauaugaag

SEQ ID NO: 199023 - RNA, 64 nt, Human
cgguugucacacuugauuguauauaagauaauucauacuggagaaaacucccagaaguggaguu

SEQ ID NO: 199024 - RNA, 64 nt, Human
acaugauucagggagcuagaagacacuuuaaguuauacuggaaaauucaggugccacugaaagc

SEQ ID NO: 199025 - RNA, 64 nt, Human
ccaaagugcauucugaguuuuuucaaggaauguaauacuggagcuuuaagaacauacuuaguuu

SEQ ID NO: 199026 - RNA, 64 nt, Human
auauuaaaugugaauuuuuuaaauuuugcuucuuauacuggaaggaauuuuagccuucauauug

SEQ ID NO: 199027 - RNA, 64 nt, Human
ugauuuggggauuuucugaaucauuuguacuuagauacuggaguucagaagaugugauuuuugu

SEQ ID NO: 199028 - RNA, 64 nt, Human
gucucaugaaaaccuaaauauaaaaaaaaggaaaauacuggaguuuuuauuucucuugucuuug

SEQ ID NO: 199029 - RNA, 64 nt, Human
cucuaacgucuuuguuguuuauggaaaagcccagauacuggauauaucacuauguauuuuauga

SEQ ID NO: 199030 - RNA, 64 nt, Human
guuacaaaagauuuuuuccuguuuuaucugaaacauacuggauuuauauauguauaagcgccuc

SEQ ID NO: 199031 - RNA, 64 nt, Human
ccugcuacugcaaagugaauuuuauaaaggcaaaauacuggagcacuaaugcccaugagauuga

SEQ ID NO: 199032 - RNA, 64 nt, Human
uaaaucucaaacuuuacuaaacauaagaaaauuaauacuggaaacuuuacaaaccugaaagaug

SEQ ID NO: 199033 - RNA, 64 nt, Human
cauuucucaacccuuacuaaacauaagaugauucauacuggagagaaguuacacaaaugugaug

SEQ ID NO: 199034 - RNA, 64 nt, Human
ugauccucaaaacucauugaacacaagaaaauucauacuggagagaaaccuuacaagugugaag

SEQ ID NO: 199035 - RNA, 64 nt, Human
cgaucuucaacccuuauuggacauaagagaauucauacuggagagaaacccuacaaaugugaag

SEQ ID NO: 199036 - RNA, 64 nt, Human
ggaaacauugcuugucuuugagaaauugacugacauacuggaagagaacaccauuuuaucucag

SEQ ID NO: 199037 - RNA, 64 nt, Human
agauacaagguuaaauggccuuuuuaaguaugucauacuggaucuuuaaauaaagcaaggcuuu

SEQ ID NO: 199038 - RNA, 64 nt, Human
aaaccacuucuugagcuuuaucuuuuuugacaauauacuggagaaacuuugaagaacaaguuca

SEQ ID NO: 199039 - RNA, 64 nt, Human
aggcuguuccuacagacgggguuuauaaguacugauacuggacaggaugagaagggaguaggau

SEQ ID NO: 199040 - RNA, 64 nt, Human
auggaguccucauugacaccucuuuucugcacaaauacuggaauucaaugucaagagaaaauga

SEQ ID NO: 199041 - RNA, 64 nt, Human
aaaaguuucacugucagauauauuguaggugcuaauacuggauuucgucucagauuuaauuucu

SEQ ID NO: 199042 - RNA, 64 nt, Human
gaaugugugugaguguguauucacauacacauauauacuggaaccuauaguagaaaaggaaacu

SEQ ID NO: 199043 - RNA, 64 nt, Human
uucuuuugcacuuaaaguugcauugccuacuguuauacuggaaaaaauagaguucaagaauaau

SEQ ID NO: 199044 - RNA, 64 nt, Human
ugcuuaaaaugggauccccagagaccauuaaccaauacuggaacugguaucuagcuacugaugu

SEQ ID NO: 199045 - RNA, 64 nt, Human
guuugcuccucugcccuagcccucaccucuugcuauacuggaaccgauuuguacaaugugggaa

SEQ ID NO: 199046 - RNA, 64 nt, Human
guggcuguggauuuuuuuaacugcuaguaguggaauacuggaaaagcuucauuucugaagauga

SEQ ID NO: 199047 - RNA, 64 nt, Human
acuucccacuauuuuuuuccccucuuaggaagacauacuggaaagaaaauguuuagcaucuuag

SEQ ID NO: 199048 - RNA, 64 nt, Human
aacuggauuuggaugaagaagucuuaauacugacauacuggauuuuuaaugcacugguuuguua

SEQ ID NO: 199049 - RNA, 64 nt, Human
ugguagcuucaugguaaaugcauccgaauaagccauacuggauugcaguguuuguuucuguagg

SEQ ID NO: 199050 - RNA, 64 nt, Human
ugccuuuuuucuguauaaaugucuuuaaugcaauauacuggaaagcuuuucuauuuuaauaaaa

SEQ ID NO: 199051 - RNA, 64 nt, Human
cucucuucaaucaaaaugaaaacaaagcaaaugaauacuggacagucuuaacaauuuuauaagu

SEQ ID NO: 199052 - RNA, 64 nt, Human
cucuggcuuucugagcacacuacggaucuggaaaauacuggaaaaugugauacuuagaauacuu

SEQ ID NO: 199053 - RNA, 64 nt, Human
ucuuuaagaacauuugggauuuauguacaauuuaauacuggaguuagaacuuuuuccuuauuga

SEQ ID NO: 199054 - RNA, 64 nt, Human
cugcaugucuaucucaaaccgcagaaaggcuuuaauacuggaaaaaaagaauucaagacuacag

SEQ ID NO: 199055 - RNA, 64 nt, Human
agacuggcuuuccugagacuugagguuguggcuuauacuggaaugagaccacuguacguguagg

SEQ ID NO: 199056 - RNA, 64 nt, Human
cucaagccuccaaaccugccuacggcaacucuccauacuggacaaacuaaacccagaagagagg

SEQ ID NO: 199057 - RNA, 64 nt, Human
guauuacgcacuucccugccuuaguaaacagaguauacuggagaguauuuaaccuuuucuugau

SEQ ID NO: 199058 - RNA, 64 nt, Human
uagacacugaucugcuagugcuguaauauuguaaauacuggacucaggaacuuuuguuaggaaa

SEQ ID NO: 199059 - RNA, 64 nt, Human
uguacuuaugcauuuuguaccaguggaacuuuuuauacuggagauuaaaaaaaaaauggaaauu

SEQ ID NO: 199060 - RNA, 64 nt, Human
aauuggccugguauggcugcaguccuccgguugcauacuggacucuucaaaaacuguuuugggu

SEQ ID NO: 199061 - RNA, 64 nt, Human
uaucguuugaggcuuaaugcuaaauaugugcuaaauacuggauuaauagauuucaguaaagcuc

SEQ ID NO: 199062 - RNA, 64 nt, Human
uagaaauagagaugcuuuauaguagaucacuuaaauacuggaucuuuugcuagugugaaaacau

SEQ ID NO: 199063 - RNA, 64 nt, Human
ucuuuaaaguaggcuuuuuuuuuuuuuuuugagaauacuggaccaucauuaaauguguacugug

SEQ ID NO: 199064 - RNA, 64 nt, Human
ggguggccacccgaccugcccccagaacuuuuggauacuggaggcaguugcauaggucucccuc

SEQ ID NO: 199065 - RNA, 64 nt, Human
cagaccauuccuuaguaucucacaaagcagaguaauacuggaggcagaguagggggugguugga

SEQ ID NO: 199066 - RNA, 64 nt, Human
uuguguggggaaacaaaggugggagggguggggaauacuggaaauaaucagggcaauuuuuuuc

SEQ ID NO: 199067 - RNA, 64 nt, Human
ggcagcacacuaauauuacuuaaaacacugugauauacuggaguuuuaguuagcggaagucagu

SEQ ID NO: 199068 - RNA, 64 nt, Human
uucugcauauaucauagaugggauccuucugagaauacuggaauagggaauuaggacaccaagc

SEQ ID NO: 199069 - RNA, 64 nt, Human
agauaucccaagcuauaucagacuuuaccugaauauacuggaguuacuuauuaucccccauucu

SEQ ID NO: 199070 - RNA, 64 nt, Human
uuauuucuucuuuuucucuuuuuuagagccaccaauacuggauuuguuuguuuuucauuuuuuu

SEQ ID NO: 199071 - RNA, 64 nt, Human
aguaaguacacaggaugcacauguugaauagaguauacuggauuggugaaagaaaauaauaaua

SEQ ID NO: 199072 - RNA, 64 nt, Human
ugcugaaauacaccauuauuauuuguuguaugcaauacuggauuuauuuugauaacguauuguu

SEQ ID NO: 199073 - RNA, 64 nt, Human
ugugguugugguuguaaguagcuaagaugaggucauacuggagcagggcaggcccuuaauccaa

SEQ ID NO: 199074 - RNA, 64 nt, Human
ugaccuguccaggagaaggauuuacuccaaaauuauacuggaacaguuuucagaauucucacug

SEQ ID NO: 199075 - RNA, 64 nt, Human
guccauccagaguguucccugagcccccuccaccauacuggaaccccucuucaguguaggaagu

SEQ ID NO: 199076 - RNA, 64 nt, Human
cuccuguuauugcuacuuuauagguacauuaaauauacuggacacaaauauauaugggauauua

SEQ ID NO: 199077 - RNA, 64 nt, Human
ugacuaauaggaguuuuaaguauguuaaaaaucuauacuggacaguuacaagaaauuaccggag

SEQ ID NO: 199078 - RNA, 64 nt, Human
cugcaguuuuauugcuaaguuuuuaguaugggugauacuggagucuuaucauuugaaguguuug

SEQ ID NO: 199079 - RNA, 64 nt, Human
uuguauuacuagcauccagcagagugccuagcacauacuggaugcucaauaaacuuuugaugaa

SEQ ID NO: 199080 - RNA, 64 nt, Human
uauuuuguauuguuaauaucuucacauugugugaauacuggaagcugcagaucuuugcuaggac

SEQ ID NO: 199081 - RNA, 64 nt, Human
agucauucuuagcuguuucccuuccucuguccauauacuggaucaccucaacauacccuggugu

SEQ ID NO: 199082 - RNA, 64 nt, Human
cuguugacaaaaucucuuuagucuugaaggauggauacuggagacagaaucugguuuguguucu

SEQ ID NO: 199083 - RNA, 64 nt, Human
uuuauguggauccuaaaaacuugaaauaucgaccauacuggaaaaaauggguuaaucaaauacc

SEQ ID NO: 199084 - RNA, 64 nt, Human
guguagcaaaaucuccuuagauaucugaaaagucauacuggauggaaucuguaggaaacgguuc

SEQ ID NO: 199085 - RNA, 64 nt, Human
cauguacaguuaaaauuauaaaaugggguagggaauacuggagauauuuguacagaagaaaagg

SEQ ID NO: 199086 - RNA, 64 nt, Human
aaagcugaauuuauauuuaguaacuucuguguuaauacuggauagcaugaauucugcauugaga

SEQ ID NO: 199087 - RNA, 64 nt, Human
ucaaaaugaaauuauuuagauaccaauuuuuaaaauacuggagagaauuuauaugucuuuuucc

SEQ ID NO: 199088 - RNA, 64 nt, Human
ugugcaucuuuacuaggacuguguuauaguguggauacuggaaaauguauagcuuuuugauuag

SEQ ID NO: 199089 - RNA, 64 nt, Human
guuucagaccagaugguguuuaagguuucuccccauacuggaaugaaugauuucuuggugguau

SEQ ID NO: 199090 - RNA, 64 nt, Human
uaaaugugacaugaaauaauugugcugcuacauuauacuggaaauuaacaggggaaaagggaag

SEQ ID NO: 199091 - RNA, 64 nt, Human
acugugucuaucgggucauuugggaaugggcaggauacuggagcugggaggcuaauggggucca

SEQ ID NO: 199092 - RNA, 64 nt, Human
aaagggacaguggaauuuagccauaccaaggacuauacuggaaacagacuucugcugcugaaug

SEQ ID NO: 199093 - RNA, 64 nt, Human
uagguaggcacauaucaguuggaccacaucugcaauacuggauuuuacugaaaucuuguauuuu

SEQ ID NO: 199094 - RNA, 64 nt, Human
uuaaugucauugcuaaaaaauaaauaaaagcuagauacuggaaaccuaacugcaauguggaugu

SEQ ID NO: 199095 - RNA, 64 nt, Human
auuuuuuuuuaaaguucaguauguaacaaguucuauacuggauccuuucuuucucuaauaaucc

SEQ ID NO: 199096 - RNA, 64 nt, Human
gcugaaaauaacagcuacacaucuacagcuuaggauacuggagauuuaaugagaaaaaguacca

SEQ ID NO: 199097 - RNA, 64 nt, Human
ucaacucauaggcuuauuuccaauuuaauugaccauacuggauacuuaggucaaauuucuguuc

SEQ ID NO: 199098 - RNA, 64 nt, Human
cuguuuuccagacauacagguucuguggaauaagauacuggacuccucuucccaagauggcacu

SEQ ID NO: 199099 - RNA, 64 nt, Human
uauaucaauuuagauuucaucauuacuauuuugcauacuggaauuuauaaauguguaaauuauc

SEQ ID NO: 199100 - RNA, 64 nt, Human
uugguuuuuguaguauuggggcccucuuuuagugauacuggauuggcguuguuuguggcuguug

SEQ ID NO: 199101 - RNA, 64 nt, Human
gcagaauuacauaaacgaagcucucaaagcccacauacuggaugguaucaaucuuugcggauac

SEQ ID NO: 199102 - RNA, 64 nt, Human
aacgacuagcagcgaugcuaugcaaaaggcgcugauacuggaaggcuugaacaccguauguuaa

SEQ ID NO: 199103 - RNA, 64 nt, Human
aaagagauuuguagguuguugauuuuguuacuucauacuggaacuuuuaaaaagauuucaucaa

SEQ ID NO: 199104 - RNA, 64 nt, Human
guacagacguucccacauucuugucaaaaggaaaauacuggagacgaacgccgggugacgcgug

SEQ ID NO: 199105 - RNA, 64 nt, Human
auuacgcuucuauaccuuuuaggucuuccuugcaauacuggaacauaauucuuuuguguagcuc

SEQ ID NO: 199106 - RNA, 64 nt, Human
cccucuccaaaugcagcagugaaucccuuuauuaauacuggaaaucccucucugcugcuuuugu

SEQ ID NO: 199107 - RNA, 64 nt, Human
cuagauggcagauaggaacuuucuugucacaaaaauacuggaggaaaauguuguaaaaauagac

SEQ ID NO: 199108 - RNA, 64 nt, Human
uuaaaaacugaaaaaucugguucauucuucagauauacuggaacccuuuuaaaguugauauugg

SEQ ID NO: 199109 - RNA, 64 nt, Human
aaaaauuaauuauuccuuucugcuuagugaaugaauacuggaauccaucuguguugauacauaa

SEQ ID NO: 199110 - RNA, 64 nt, Human
aaugugggcuggggcagaggucuuuuuucauuuaauacuggaaaaauauugaagagcauccaug

SEQ ID NO: 199111 - RNA, 64 nt, Human
uuaaaaccaaauuuagguguucuuacauauuuaaauacuggaaagucauuauaauaguuuuggu

SEQ ID NO: 199112 - RNA, 64 nt, Human
auauuuuguugcugcagccgagugaccuccauaaauacuggacugaaaaaacauuguaauacua

SEQ ID NO: 199113 - RNA, 64 nt, Human
ugguugcuuucccuauuuguucaauagacugauaauacuggaauuuauagaguuugagccauua

SEQ ID NO: 199114 - RNA, 64 nt, Human
auugugagagacaacaguugccuccuuuugacaaauacuggauauuagcaguuuauuuaugaaa

SEQ ID NO: 199115 - RNA, 64 nt, Human
uguguuucuaaaguauuuauguauuaaccugaccauacuggaaucagacauaaauacuuauuua

SEQ ID NO: 199116 - RNA, 64 nt, Human
gguagcagggaagaaguaaaaaaagagaaggagaauacuggaagauaaugcacaaaaugaaggg

SEQ ID NO: 199117 - RNA, 64 nt, Human
aagaauuacauguaucuuacaguaaagaaacagaauacuggaaucguuagagaacccugaugug

SEQ ID NO: 199118 - RNA, 64 nt, Human
uuaccccaaccacagugaggaggaagauguucacauacuggaacuguccugccaaauaaauuuu

SEQ ID NO: 199119 - RNA, 64 nt, Human
aaaggaaacacucauaccuguaguuggaggaugaauacuggagacggguuaccaaugucagguu

SEQ ID NO: 199120 - RNA, 64 nt, Human
caaaggcagugcugggcacccacgggugugcuggauacuggaguuugagaggagggaggugcug

SEQ ID NO: 199121 - RNA, 64 nt, Human
uuuuagugaacuucucuaaagaagaggacagaauauacuggacuuaaccacgaauacccuugag

SEQ ID NO: 199122 - RNA, 64 nt, Human
aaaagaaucacacaacaaggagauuuuuagcaugauacuggaaauaaaauguccaagcugacaa

SEQ ID NO: 199123 - RNA, 64 nt, Human
uguggagacugauggccaggcaagugggaccaggauacuggacgcuguccugagaugagaggua

SEQ ID NO: 199124 - RNA, 64 nt, Human
cugcaccccacagaugguuugauggcugugcuguauacuggaggggagggcaggacucugggag

SEQ ID NO: 199125 - RNA, 64 nt, Human
aucugguauaacuauucuuguuuuauauuguauuauacuggaacagcucguguccuccgucucu

SEQ ID NO: 199126 - RNA, 64 nt, Human
cugccauuaaaauaaauuugccaacuaguaaugcauacuggaaaucaaaagauacugaaagaau

SEQ ID NO: 199127 - RNA, 64 nt, Human
cagggauuuuuuuaaaaagucaaucagaaaagggauacuggagcuucuucauguauguaacagc

SEQ ID NO: 199128 - RNA, 64 nt, Human
gcucuuaaauguuccuguuaccauccuaauguaaauacuggauuuuucugucauuuagcaccau

SEQ ID NO: 199129 - RNA, 64 nt, Human
aaauguauuaaaaauaggaucccaugagaacauuauacuggaaguuacaugugauacccagcua

SEQ ID NO: 199130 - RNA, 64 nt, Human
gauuuuuccuucuucaacagguugcuaauaauuuauacuggaaucuggcauuuuuccaagccaa

SEQ ID NO: 199131 - RNA, 64 nt, Human
uuuucugacuacagugauguaaguagauagcaaaauacuggauuuugcacaugcugcccuaaga

SEQ ID NO: 199132 - RNA, 64 nt, Human
ugaugaggaucugaaaacuuggcuggggcuauauauacuggaaguugaagguuaaaggaaaagc

SEQ ID NO: 199133 - RNA, 64 nt, Human
aguggcucccagcuuggaagaccaggguggguacauacuggagacagccaagagcugaguauau

SEQ ID NO: 199134 - RNA, 64 nt, Human
gacugauaaacugauacuuuugguucguauguacauacuggaagaaucuucauaauaaaugaga

SEQ ID NO: 199135 - RNA, 64 nt, Human
gacucuuacccacagcugacuagggccagcgcaaauacuggaaccuguaacagaauuaaaggug

SEQ ID NO: 199136 - RNA, 64 nt, Human
ugaggcagcucuuuaagacguucagagguaagaaauacuggauuuauaaagcaaauggcuguuu

SEQ ID NO: 199137 - RNA, 64 nt, Human
aagauggccuaggaucuucacugucuuacucaagauacuggacuaaguggaacguucucuaccu

SEQ ID NO: 199138 - RNA, 64 nt, Human
caggagaggagaaauaucucauacaagugaaaggauacuggagagagaaauuacccauuucuaa

SEQ ID NO: 199139 - RNA, 64 nt, Human
acugcucaguagauacgugugguuaguggcugccauacuggacagcucggggcauuuucacugu

SEQ ID NO: 199140 - RNA, 64 nt, Human
gaucacgagugugaugcugaguaccuuucugcauauacuggauuguacuuuguguaaaguaaac

SEQ ID NO: 199141 - RNA, 64 nt, Human
aucagucuugauaaacugcuugaugcuggucucuauacuggagaagugacugaaauuguaggag

SEQ ID NO: 199142 - RNA, 64 nt, Human
uuacuauuuccucuccuuccggcuuauuugugguauacuggaagcccauaaagcauucuugcuc

SEQ ID NO: 199143 - RNA, 64 nt, Human
gaaaaagaaaagccuuauuugacuuaugcuugugauacuggacuucuuaccaauccggagguuu

SEQ ID NO: 199144 - RNA, 64 nt, Human
ccacgcccagcccuucuggcaccccugggguucaauacuggaagugccuuauuuaaccagacca

SEQ ID NO: 199145 - RNA, 64 nt, Human
uggugcucacaccuuacucaacauuagaaaaucaauacuggauagaaaucccauauguguaaug

SEQ ID NO: 199146 - RNA, 64 nt, Human
gcuuucauggcagagcacgucaagauaaauggguauacuggaauccgaugccguuucuacagua

SEQ ID NO: 199147 - RNA, 64 nt, Human
uaaugcuuuuucaagaacuaacacaguuauuccuauacuggauuuuaggucucugaagaacugc

SEQ ID NO: 199148 - RNA, 53 nt, Human
uuuuaauuagcauaagauaauucauacuggagagaaacccuaugaaugugaug

SEQ ID NO: 199149 - RNA, 64 nt, Human
caauuuacaagucuuacuaaacauaagaaaauuuauacuggagagaaacuacuaaccugaaaga

SEQ ID NO: 199150 - RNA, 64 nt, Human
aagcccucaauucuuaacagacauaagauaauuuauacuggagagaaacucuacaaaucagaaa

SEQ ID NO: 199151 - RNA, 64 nt, Human
ugguugucacacuucauuguagguaagauaauucauacuggagaaaacgccuacaugugugaac

SEQ ID NO: 199152 - RNA, 64 nt, Human
cacuucucaacccugccuacacguaagauaauucauacuggaaggaaacccuacaaauaugagg

SEQ ID NO: 199153 - RNA, 64 nt, Human
aaauccucauccauuaguaaacauaagauaauucauacuggagagaaaaccuacaaaugugagg

SEQ ID NO: 199154 - RNA, 64 nt, Human
cugucccuccaauuuacugcacauaagauaauuuauacuggagagaagcccuacaaaugugaaa

SEQ ID NO: 199155 - RNA, 64 nt, Human
caauuuucaaaccuuacuaaacauaagauaacucauacuggagaaaaaucuuacaaaugugaag

SEQ ID NO: 199156 - RNA, 64 nt, Human
caguccucaauuuuuacuaaacauaagaaaauucauacuggagagaaacccuaugauugugaaa

SEQ ID NO: 199157 - RNA, 64 nt, Human
uuuaaaaguucucaacccuuauuacacauaauuuauacuggacagaaauccuaaagugugaaga

SEQ ID NO: 199158 - RNA, 64 nt, Human
aaguccucaauucuuaacagauauaagauguuucauacuggagcgaaacuacaauccugaauga

SEQ ID NO: 199159 - RNA, 64 nt, Human
ugauugucacacuugauuguagguaagauaauucauacuggagaaaacuaccagugugaacaac

SEQ ID NO: 199160 - RNA, 64 nt, Human
cauaggucgucccugcuucaacaucacaguauucauacuggagagaaaccuuacgaauguauua

SEQ ID NO: 199161 - RNA, 64 nt, Human
uguaguucaaaccuuacuguacaucagagaauucauacuggagaaaagccauauaaauguagug

SEQ ID NO: 199162 - RNA, 64 nt, Human
aggaugggaaugcuguaucuguggaagucauguuauacuggauucauuuccaauuaaauacuaa

SEQ ID NO: 199163 - RNA, 64 nt, Human
cagaaaucaaaccucacugaacaugagaaaauucauacuggagagaaaccuuaucauuguaauc

SEQ ID NO: 199164 - RNA, 64 nt, Human
cagagacaaaaucuucuugagcaugaaaaaauucauacuggagagaaaccauucaaauguaaug

SEQ ID NO: 199165 - RNA, 64 nt, Human
ccuggccaaaaaauuaacauucuaaaggauuuaaauacuggaauuugaaaagccaaacugugaa

SEQ ID NO: 199166 - RNA, 64 nt, Human
aagguucugccaugccuggugacccaccauggacauacuggaccuuaauuccucugcuucugug

SEQ ID NO: 199167 - RNA, 64 nt, Human
acacaaguuuuucuaauaacucauuagagaauuuauacuggagagacuucacaauuauaauaaa

SEQ ID NO: 199168 - RNA, 55 nt, Human
agccuugcaugucaucauagacuucauacuggagagaaaccuuacaaaugugaag

SEQ ID NO: 199169 - RNA, 64 nt, Human
cacagaucacgccuuaaaagacauaggagaauucauacuggagagaaaccuuacaaguguaaug

SEQ ID NO: 199170 - RNA, 64 nt, Human
caucguucauaccuugcaguucaucagugaacucauacuggagagaaaccuuacaaaugucaug

SEQ ID NO: 199171 - RNA, 64 nt, Human
gacagcuccacacucauuagucaugagagaguucauacuggagaaaagccuuaugagugcagug

SEQ ID NO: 199172 - RNA, 64 nt, Human
uuaagguccaaccucauucaccaucagcgaguucauacuggagaaaggcaugagugcgggcagu

SEQ ID NO: 199173 - RNA, 64 nt, Human
cacaguucuucguuccgucgccaucagagaguucauacuggaaugaggccuuauaagugaagca

SEQ ID NO: 199174 - RNA, 64 nt, Human
caacggugucaacuuacuaggcagcagagaauucauacuggagagaagcccugugaauguuaac

SEQ ID NO: 199175 - RNA, 64 nt, Human
cacgcaucucucuacacuuccuucucuccgugggauacuggacucgugccucugcgcccauucu

SEQ ID NO: 199176 - RNA, 64 nt, Human
auuuuaacgauuuucaaaguugauaugaaaguucauacuggaggguaguugcaugaauguaagu

SEQ ID NO: 199177 - RNA, 64 nt, Human
aguuccaguuauauucauauacaugaacgaauucauacuggagagaaacccuaugaauguaaag

SEQ ID NO: 199178 - RNA, 64 nt, Human
uacuacuacucagcucaaagacaugaaaggacucauacuggagagaaacccuacaaauguaagg

SEQ ID NO: 199179 - RNA, 64 nt, Human
uaucacaacucugcucaaagacaugaaaagacucauacuggagagaaacccuacaaaugcaagg

SEQ ID NO: 199180 - RNA, 64 nt, Human
uaccaccaaucugcucaaaaacaugaaaaggcucauacuggagagaaacccuacaaauguaagg

SEQ ID NO: 199181 - RNA, 64 nt, Human
cuucacguaaucuuuuaaagacaccugagaauauauacuggagagaaacuauaaagaaaauucu

SEQ ID NO: 199182 - RNA, 64 nt, Human
cuucacacagccuuuugagcacacaugagaauguauacuggagagaaacccuauaaauauuaag

SEQ ID NO: 199183 - RNA, 64 nt, Human
uguuccagcuccuucugaauacacaaaagaguucauacuggacagaagcugugugaauacaaac

SEQ ID NO: 199184 - RNA, 64 nt, Human
uauuuucaacuuuuauuaaaacacaagauaauucauacuggagagaaauccuacaaaugugaua

SEQ ID NO: 199185 - RNA, 64 nt, Human
ugguugucacacuugauuguagguaagguaaguuauacuggagaaaacuucuacaugugugaac

SEQ ID NO: 199186 - RNA, 64 nt, Human
caguccucaacucuuacuaaacauaaaaaaauucauacuggagggaacuccugugacugugaag

SEQ ID NO: 199187 - RNA, 64 nt, Human
aauggcugucacacuugauuguagguaagauaauauacuggagaaaacuacuagaauaaacaau

SEQ ID NO: 199188 - RNA, 64 nt, Human
caguccuuaaggcuuacuacauauaagacaacucauacuggagagaaaccaugcaugugugaag

SEQ ID NO: 199189 - RNA, 64 nt, Human
guuccucaauccuuacuaaacauucauguaauucauacuggagggaauuccuauaauugugugg

SEQ ID NO: 199190 - RNA, 64 nt, Human
uguuccucacaccuuacuacucauaaaagaauucauacuggaggaaaagcccuacaaaugugaa

SEQ ID NO: 199191 - RNA, 64 nt, Human
cgguccucaaaccuuguggaacauaagagaauucauacuggagagaaacccuacaaaugcgaag

SEQ ID NO: 199192 - RNA, 64 nt, Human
gcugauucucagucuaguaaacauaagaaaauucauacuggagagaaaaucuacaaaggugaag

SEQ ID NO: 199193 - RNA, 64 nt, Human
auuuaccgucaucccuaucccaucacuuugugucauacuggacaagacgcuuaacugcucugug

SEQ ID NO: 199194 - RNA, 64 nt, Human
gccagcgcgggggacuuucucugcaccauguagcauacuggacucccagcccugccugucccgg

SEQ ID NO: 199195 - RNA, 64 nt, Human
acccaggcaucaaaaccggaacaucacaggguuuauacuggagaguaacuacacaaagauaaug

SEQ ID NO: 199196 - RNA, 64 nt, Human
uagcauuaaagccuuguaagacauacaauaauuuauacuggagaaaaacuuugcaaguauaaug

SEQ ID NO: 199197 - RNA, 64 nt, Human
ucacguucacacgucauuagacaucagagaaucuauacuggacagaaaucuuacaaaugucauc

SEQ ID NO: 199198 - RNA, 64 nt, Human
gaucguucacauauugcaggucaucggugaacucauacuggagagaaaccuuacaaaugucaug

SEQ ID NO: 199199 - RNA, 64 nt, Human
acaagacuugggagugauucacaccuggaacaacauacuggacuucacacuggagagaaaccuu

SEQ ID NO: 199200 - RNA, 64 nt, Human
uuggaaaucacaccuuaaagacauaggagaauuuauacuggagagaaagcuuacaaauguaagg

SEQ ID NO: 199201 - RNA, 64 nt, Human
caucauucauacauugcaguucauugacacacucauacuggagagaaaccuuacaaaugucaug

SEQ ID NO: 199202 - RNA, 64 nt, Human
gucacaaaucacagcuugaaagacaggagaauucauacuggagaaaaaacauacaaauguaagg

SEQ ID NO: 199203 - RNA, 64 nt, Human
cacaauucaacccuuguaagucacaaagccauucauacuggagagaaacuuuacaaguguaaug

SEQ ID NO: 199204 - RNA, 64 nt, Human
caaaaagcaaccuuugcacaucaccauagacuucauacuggagagaaaccuuacaaaugggagg

SEQ ID NO: 199205 - RNA, 64 nt, Human
ucacaauucaacccuguaagucauaaggcaauucauacuggagagaaaccuuacaagcauaaug

SEQ ID NO: 199206 - RNA, 64 nt, Human
gaaacaucccgucucauuaaacacaggagaguucauacuggagaaaggccuuaugagugcuguc

SEQ ID NO: 199207 - RNA, 64 nt, Human
aggacucaccucccucuucauuuaggaucuccagauacuggauagccagcauccucucauuccc

SEQ ID NO: 199208 - RNA, 64 nt, Human
agguuaguuuguaaugaaagcaaaaaauuugugaauacuggaaguaacguggaaaucuaaugug

SEQ ID NO: 199209 - RNA, 64 nt, Human
caaacauuauuccaagaguaucccaguauuagcaauacuggaauauaggcacauuaccauucau

SEQ ID NO: 199210 - RNA, 64 nt, Human
agcuuugucaguauauggaaaaguugaagggaaaauacuggaaugcuucuucaaagguuaaaaa

SEQ ID NO: 199211 - RNA, 64 nt, Human
cuacugugaaauguuuugacuuguuguaaccuguauacuggaaucccucucuagcuguauuaaa

SEQ ID NO: 199212 - RNA, 64 nt, Human
gagaggaagccuccaccucauguuuucaaacuuaauacuggagacuggcugagaacuuacggac

SEQ ID NO: 199213 - RNA, 64 nt, Human
cuuuaaaauguuugcaaaugucuuuuuuuuuuuaauacuggaagaaaaaauauucuguuguguc

SEQ ID NO: 199214 - RNA, 64 nt, Human
ggagcccuguaacucccaggagagaccacugaaaauacuggagcaacaaugccccugcuuccau

SEQ ID NO: 199215 - RNA, 64 nt, Human
uaguacagauuuagguuuacauaacuacucugacauacuggaauugcauauagagauguucagu

SEQ ID NO: 199216 - RNA, 64 nt, Human
augauuuuuuuuuuuuuugcaaaggaaaaaauugauacuggaaaagauuguugugcauaguuau

SEQ ID NO: 199217 - RNA, 64 nt, Human
ccauaccucucugaguauuuagcuauuguucuauauacuggauacaucuauuaugggaacuuaa

SEQ ID NO: 199218 - RNA, 64 nt, Human
cugaguauuguuuguucaccuuucagacuuggugauacuggacaugucaguguaaauaacacua

SEQ ID NO: 199219 - RNA, 64 nt, Human
uugaugaccuuuguguauguaguucuugcauccuauacuggauaagccuguuuuaaccugcuau

SEQ ID NO: 199220 - RNA, 64 nt, Human
uuccaggcgcuuucagggcacuguaauuucaacaauacuggaaucauuuuggcgcugcuucuca

SEQ ID NO: 199221 - RNA, 64 nt, Human
acugcacuccggccuaggcaacgagagcaaaacuccaauacaaacaaacaaacaaacaccugug

SEQ ID NO: 199222 - RNA, 64 nt, Human
uaggucagucuggcacguaagaugaacaucccuaccaauacagagcucaccaucucuuauacuu

SEQ ID NO: 199223 - RNA, 64 nt, Human
gacaucaagaaucuucuguuccacauccacacagccaauacaauuagucaaaccacuguuauua

SEQ ID NO: 199224 - RNA, 64 nt, Human
auuaguuuguuaauugccuguuacuaguacuugaccaauacauugugcuauauguaaaugugua

SEQ ID NO: 199225 - RNA, 64 nt, Human
uagggucuguuuauuagcaaauuuccuauuuguuccaauacaaacucacuuuauucuaaaguau

SEQ ID NO: 199226 - RNA, 64 nt, Human
uagucuuugcacaggaaccugugguuuuaacaaaccaauacacauauugaagaagucauuuuaa

SEQ ID NO: 199227 - RNA, 64 nt, Human
gugcuccuguuggauggugaggucacuccauaugccaauacaaacaacaaugcgguggauugca

SEQ ID NO: 199228 - RNA, 64 nt, Human
aggugacuuaguauauuuguaauugguuuuaaaaccaauacaccauacuuucuuucugcaaaca

SEQ ID NO: 199229 - RNA, 64 nt, Human
aaugacugcauaggacagaucccaucuccuccacccaauacauuauuagacugaacugugaccu

SEQ ID NO: 199230 - RNA, 64 nt, Human
agccaugccacaucuguauauagaugggguuuuuccaauacagcugguucgugauaaacugcau

SEQ ID NO: 199231 - RNA, 64 nt, Human
ugaauuuguucuuuuacagaauucuguagcaaagccaauacaaaaaucagcuaaagcugccaca

SEQ ID NO: 199232 - RNA, 64 nt, Human
uucucccagcauguacucacugugggcagaugcaccaauacaugguaauccucuuacucauuuu

SEQ ID NO: 199233 - RNA, 64 nt, Human
uuguugagaggugguuuagggauuuuggcccuaaccaauacauugaauguaugaugacuauuug

SEQ ID NO: 199234 - RNA, 64 nt, Human
cgugccucuccuacuguguaggagccuccgcuucccaauacagccgugucugcagccacugccu

SEQ ID NO: 199235 - RNA, 64 nt, Human
ccacuguccccuuuccacuuccccagcuucugccccaauacacauaccucccuuaagccaggau

SEQ ID NO: 199236 - RNA, 58 nt, Human; identical to SEQ ID NO: 21984

SEQ ID NO: 199237 - RNA, 62 nt, Human
gucuuccuucuuaaucccauggcugguggccacgcccccaccaucaucagcugggaggaaag

SEQ ID NO: 199238 - RNA, 62 nt, Human
ugcccacuccuccacaaaccgugacccauagccgcccccaccccauaccuugaucuaccauc

SEQ ID NO: 199239 - RNA, 64 nt, Human
accaacuuugacuacuuccugucuuaguaauagaccaauacauggcucuauuuagcaaaguuuu

SEQ ID NO: 199240 - RNA, 64 nt, Human
guucugcauuuguaucuugcaaguuuguauaaacccaauacaggaaauaaaaugaaugguuugu

SEQ ID NO: 199241 - RNA, 64 nt, Human
uguguuuuagaguguucagccugaccccgccucaccaauacacggacacaaccaaaucauaaca

SEQ ID NO: 199242 - RNA, 64 nt, Human
ccgagacggagucuugcucugccacugugcccggccaauacauuauuauuaacuuaaggcugua

SEQ ID NO: 199243 - RNA, 64 nt, Human
uaaagcacuguuuggauaugagauguagcaaauuccaauacauuauuggacuuccauuuggaau

SEQ ID NO: 199244 - RNA, 64 nt, Human
agaggaagagugugugugucuacacaggauaaacccaauacauauuguacugcucagugauuaa

SEQ ID NO: 199245 - RNA, 64 nt, Human
uauuuuuccccuaugagaagauauuuugaucuccccaauacauugauuuugguauaauaaaugu

SEQ ID NO: 199246 - RNA, 64 nt, Human
gucacaaaaagaucaccacacuucuaaauaaagaccaauacaauucuaauaguaaagauugaaa

SEQ ID NO: 199247 - RNA, 64 nt, Human
auggagcuuacauucuacagggagaaagagauagccaauacauaggaauaaauauauacaaggu

SEQ ID NO: 199248 - RNA, 64 nt, Human
cagaggaaaaaacacuacuguaaauugugaauagccaauacauaacuguauuguaugcaaaucu

SEQ ID NO: 199249 - RNA, 64 nt, Human
uucacaauauccccuugaagggacagcucagcugccaauacauucaacccuuucucuuccuuca

SEQ ID NO: 199250 - RNA, 64 nt, Human
uuuuucugauuugauaacuacccaaaccaaacaaccaauacauacaugggaagagaggcccugu

SEQ ID NO: 199251 - RNA, 64 nt, Human
aaaagguaugcaguacagcaguauagaauccaugccaauacagagcauagggaaagguccacuu

SEQ ID NO: 199252 - RNA, 64 nt, Human
uugcacaucugaacugggacuguuaacacugaugccaauacaguguggggugccagaaaguguc

SEQ ID NO: 199253 - RNA, 64 nt, Human
ucuuuuccugucaucuccucuuuacuggauuguaccaauacauuuuagaagugaacuggacuug

SEQ ID NO: 199254 - RNA, 64 nt, Human
uuucuucucauccuggagcguauucaagaucuucccaauacaagaaaauuaauaaaaaauuuau

SEQ ID NO: 199255 - RNA, 58 nt, Human
caggacuguugaugaaagggacagauugaggaggaagugggcucugaggcugcagggc

SEQ ID NO: 199256 - RNA, 58 nt, Human
uucacuuagucgacaucaugaaauacacaggaggaacgccuuccgaaauaagguguaa

SEQ ID NO: 199257 - RNA, 58 nt, Human
agauggcaacugauucccaguuuaagauaggaggaaggagagcaauuucuaaguuuca

SEQ ID NO: 199258 - RNA, 58 nt, Human
ggggaaaaaaugaaaaagcagggacaacaggaggaaaugaaggcagagaaauauaguu

SEQ ID NO: 199259 - RNA, 64 nt, Human
ugaaaaucauuuguguccuacuauuggacuuaucccaauacagauguguguguuuuucuggagg

SEQ ID NO: 199260 - RNA, 64 nt, Human
ggacugacuuuauucauauuuccaucaaacuucuccaauacaguaagagauaguguugaaccag

SEQ ID NO: 199261 - RNA, 64 nt, Human
auauagaaauacaauucuuuuuaaauuuuuaggaccaauacaaaauaacaaaaauguaauggaa

SEQ ID NO: 199262 - RNA, 64 nt, Human
gaaugugugagaaaaacuaacuugauagggucuaccaauacaaaauguauuacgaaugccccug

SEQ ID NO: 199263 - RNA, 64 nt, Human
cugacauuugggauuuacuuuucuccaauaccugccaauacagaaaacuauuaucaguuguuau

SEQ ID NO: 199264 - RNA, 64 nt, Human
gucagggucacuuugaauugugcacauaagaaaaccaauacaaaaaacaauuuguauucaauau

SEQ ID NO: 199265 - RNA, 64 nt, Human
cuuuggcaauaucauauucuaaaaguaauaaauuccaauacaaguuacauacauuuaaaaaaca

SEQ ID NO: 199266 - RNA, 64 nt, Human
uuaggaggcuuggagcuauuaguuaaucuaucuuccaauacacuguuuaauauagcacugaaua

SEQ ID NO: 199267 - RNA, 64 nt, Human
ccucucagcucucuucccugggggcagauauuucccaauacauaccacuuugaauaggaugaua

SEQ ID NO: 199268 - RNA, 64 nt, Human
agucccuccagguggggcuggagccugcuggcgcccaauacaaaacccauacauccaggugggu

SEQ ID NO: 199269 - RNA, 64 nt, Human
gauggugggcggggccccgcccacagggccgaccccaauacaccagcgacucaaccuugaugcc

SEQ ID NO: 199270 - RNA, 64 nt, Human
auauuacagcuuauuuuuuucuacauaauugugaccaauacauuuguauuuugugaugaaucua

SEQ ID NO: 199271 - RNA, 64 nt, Human
uacauaacgaugaaaaauaauacaaauuuaaaaaccaauacaguauaacaacuauuuacauagu

SEQ ID NO: 199272 - RNA, 64 nt, Human
uguaaagacuugagaagucuaauucacaggcaaaccaauacagaauugacugcaguugaacaga

SEQ ID NO: 199273 - RNA, 64 nt, Human
ccuggaaaaaaauauauaauuuucucacaaacaaccaauacauaaccuauggcaguugguugaa

SEQ ID NO: 199274 - RNA, 64 nt, Human
guuuuuaagaauauuaacaauauauuaacaaacaccaauacaacuaauccuauuugguuuuaau

SEQ ID NO: 199275 - RNA, 58 nt, Human
gaaauagauuuccuuccaguggaaagaaaggaggaagggagaauugagaaaauauauu

SEQ ID NO: 199276 - RNA, 58 nt, Human
uuguuuaagauuuuggggaagagauuugaggaggaaagaaaggagauggggugagagg

SEQ ID NO: 199277 - RNA, 58 nt, Human
gaggaagggggagucauuuauauucugcaggaggaaggggccccagcugucgccuuuc

SEQ ID NO: 199278 - RNA, 58 nt, Human
uccuacuuauaguuggugagcaugagggaggaggaaucauggcuaccuucuccuggcc

SEQ ID NO: 199279 - RNA, 64 nt, Human
ucuauauguagagaugcaaauuauuaaguuguuuccaauacaauaaauaaaagcaucuguuuuu

SEQ ID NO: 199280 - RNA, 64 nt, Human
agugggaaauucucuccuucuguuggcugggugcccaauacaacaaaaaggcagaggaaaggca

SEQ ID NO: 199281 - RNA, 64 nt, Human
cugguaaaccaugucaucuuuacaauguugucuuccaauacaugaauaugguacagcucuucau

SEQ ID NO: 199282 - RNA, 64 nt, Human
ccaaaggcaaauaaugucuccauagaaucacuuuccaauacaacggcucuuuucagagccaccu

SEQ ID NO: 199283 - RNA, 64 nt, Human
uucucuuuauucccacguucgcccuuuguucaguccaauacaggguuguggggcccuuaacagu

SEQ ID NO: 199284 - RNA, 64 nt, Human
agcaacguaccuucaccccagccacaugccccagccaauacaaauuggaaaaucuggcccauuu

SEQ ID NO: 199285 - RNA, 64 nt, Human
ccaccaaauaacaguagugaggguuagaguccugccaauacagcuguugcauuuuccccaccac

SEQ ID NO: 199286 - RNA, 64 nt, Human
aagaaauccuauauagucuuauucaccaauauauccaauacacccacagcaaugguaccuuuuu

SEQ ID NO: 199287 - RNA, 64 nt, Human
auuggacuguuagcccuauugagagcaaggcuuuccaauacauaaauagugucuguuucuuaga

SEQ ID NO: 199288 - RNA, 64 nt, Human
cuugaagaggacgcaggcuuccagaggacaaaccccaauacaggagaagcacaagacagagaag

SEQ ID NO: 199289 - RNA, 64 nt, Human
aucagaauuuuuuaaugccauccucauuaguuuuccaauacaauauaaguugaaacaauguaca

SEQ ID NO: 199290 - RNA, 64 nt, Human
ccagugacucucagugucccccugauggccguuaccaauacaacacugaugugguguuugauuc

SEQ ID NO: 199291 - RNA, 64 nt, Human
uuauacaguuuucaaaaaaucaagacaaguaggcccaauacaaacuacugaaucaucuucuaau

SEQ ID NO: 199292 - RNA, 64 nt, Human
uauacauauauaaggagauaaaguuucccauuuuccaauacaguuucacauuugaacagcccua

SEQ ID NO: 199293 - RNA, 64 nt, Human
uaaaugggccccugggugcccagccuccccuccuccaauacauucucugauaaucugaccuugu

SEQ ID NO: 199294 - RNA, 64 nt, Human
gacuguaaauugcgauaaggaaauguacugauugccaauacaccccacccucauuacaucauca

SEQ ID NO: 199295 - RNA, 58 nt, Human
acaugaucauuagccauaagaaacucaaaggaggaagacauaauuagggaaagaaguc

SEQ ID NO: 199296 - RNA, 58 nt, Human
agccuugcccacugugacuucaaacccaaggaggaacucuugaucaagaugccgaacc

SEQ ID NO: 199297 - RNA, 58 nt, Human
ggggagagucaacaggaaaaaaggagggaggaggaaaagccacaagagacauucugua

SEQ ID NO: 199298 - RNA, 58 nt, Human
gcagagccuucagccucuccaaacauguaggaggaaaugaggaaaucgcuguguuguu

SEQ ID NO: 199299 - RNA, 64 nt, Human
auucacaucucacaaaaucuugacaucuuacauuccaauacauuaucaagcaagcacaaguaug

SEQ ID NO: 199300 - RNA, 64 nt, Human
caagccauugcuuaaaauauaacauguuuuggauccaauacacacauuguuacaacuaacacaa

SEQ ID NO: 199301 - RNA, 64 nt, Human
ggggugacuuuucuuauauuaauaauauuuacauccaauacacugaaucuuccuuuagagguaa

SEQ ID NO: 199302 - RNA, 64 nt, Human
ccuuuccaauagaaagaaacuaaacagaaaacucccaauacaaagaugacuggucccucauagc

SEQ ID NO: 199303 - RNA, 64 nt, Human
acagcacuugcaagaaauauaacccucccuucccccaauacacagaaccaccgccaccaccacc

SEQ ID NO: 199304 - RNA, 64 nt, Human
aguucaguccagucaagaaaagaaccuaauagcaccaauacaaauugaggacuuaauuuacuuu

SEQ ID NO: 199305 - RNA, 64 nt, Human
uguuagcauuuucaaugugauauaaacagcuucuccaauacagcaaaccuaauugcacaacaga

SEQ ID NO: 199306 - RNA, 64 nt, Human
uccugacgucaagugaucugccugccuuggucucccaauacaggcaugaaccacugcacccacc

SEQ ID NO: 199307 - RNA, 64 nt, Human
uaauaguuacuaguaguaguauucuuacuaagacccaauacaaauggauuauuuaaaccaaguu

SEQ ID NO: 199308 - RNA, 64 nt, Human
ugcagugggcgcgggucacggcugacuccaacuuccaauacaacagccaucacuagcacagugu

SEQ ID NO: 199309 - RNA, 64 nt, Human
agacccugagcagaauacuggucucaggccaagcccaauacagccauuaaagaugaccuacagu

SEQ ID NO: 199310 - RNA, 64 nt, Human
uuaauucagcuuuguccaaaggaaagcuuaaaacccaauacagucuaguuuccugguuccguuu

SEQ ID NO: 199311 - RNA, 64 nt, Human
cuuuuuucuuaccuuauugcacugguuagcaaccccaauacagagaccaccagaucagguauag

SEQ ID NO: 199312 - RNA, 64 nt, Human
uugcuacugcugugaggccauagguacuagacaaccaauacaugcaggguuggguuuucuaauu

SEQ ID NO: 199313 - RNA, 64 nt, Human
aaaaacaaaagaguaguggggagagaaaaacaauccaauacauauuuuucucucagaauagaaa

SEQ ID NO: 199314 - RNA, 64 nt, Human
ugacaguacaauguuuggauucuccuugauauuaccaauacauuuucccuguuaucuugcacug

SEQ ID NO: 199315 - RNA, 58 nt, Human
cugccaauccugccuuacucaggaaggcaggaggaaagagacugccucuccagagcaa

SEQ ID NO: 199316 - RNA, 58 nt, Human
aucaggaggguaguuagagguauaaaacaggaggaaauauuauggaaaaugaaaauag

SEQ ID NO: 199317 - RNA, 58 nt, Human
gaugaaaauguugaguuugacucugaugaggaggaaccaccugaucuccccuuggacu

SEQ ID NO: 199318 - RNA, 58 nt, Human
gccaccaaggacggcaagaaggacaagaaggaggaagacaagaagugagacuggaggg

SEQ ID NO: 199319 - RNA, 64 nt, Human
aagggaaaugcagccauagagggccugaugacauccaauacagaguucugguaaagauaaaauu

SEQ ID NO: 199320 - RNA, 64 nt, Human
aacagauaauucagcauuggcguauuugcuugucccaauacaagaaugccaaaggaggaaacag

SEQ ID NO: 199321 - RNA, 64 nt, Human
gagggcuaucaggccaaaauucauuauuguauuuccaauacaguuugucuugaaugucugucuc

SEQ ID NO: 199322 - RNA, 64 nt, Human
ugucagauaagauuuuuaccuggaaauuccaugaccaauacaugugcaaaagaaaaugaugggu

SEQ ID NO: 199323 - RNA, 64 nt, Human
ccauucucuuuuuuagggaacauuaagcaaaaucccaauacacagagucugucacagacaggua

SEQ ID NO: 199324 - RNA, 64 nt, Human
cagccuuuaaaguauugaaguaacuggagaauugccaauacagccagagagaaagggacuacag

SEQ ID NO: 199325 - RNA, 64 nt, Human
ggaaaaggguuugguucuugacuuuguauuccuuccaauacagcaauaaacuuugucucccuuu

SEQ ID NO: 199326 - RNA, 64 nt, Human
aauuauuucauucaguuuuuggagcucaguuaagccaauacauuuaaaguuuugcaugaggaac

SEQ ID NO: 199327 - RNA, 64 nt, Human
uuuaauaaauccuuucauuuuaaaaagagaauugccaauacagaaaaggaguauccaaacaaug

SEQ ID NO: 199328 - RNA, 64 nt, Human
cagggaaaauaaauaguuggccagaauuaagcaaccaauacaugauagacagggcuaaaacugg

SEQ ID NO: 199329 - RNA, 64 nt, Human
cuugcccuggcuucuccagugggaugugcugaguccaauacaauugcuuuuauaauugcuuuug

SEQ ID NO: 199330 - RNA, 64 nt, Human
aguucucacuuuagugagaacuuuucuagcuauuccaauacagaguucuuucuuauagggcuau

SEQ ID NO: 199331 - RNA, 64 nt, Human
uacaauuuguuucuauuaagcaaguaccaguuuaccaauacaugaguaacugaaguguaacugu

SEQ ID NO: 199332 - RNA, 64 nt, Human
agcuuuuucuuacaaauaaaugggacccuguuuuccaauacaaauguaccguguuuuuguuagg

SEQ ID NO: 199333 - RNA, 64 nt, Human
accuaccuucaaaaggugggauaguaguucuaauccaauacaaugcuaauaaaaugaaacccga

SEQ ID NO: 199334 - RNA, 64 nt, Human
cugauucaaagaacaauggucucuuuaauggcacccaauacaguauugaaaaucagaucaucaa

SEQ ID NO: 199335 - RNA, 58 nt, Human
uaagcagguuguauagggagccgguggcaggaggaaggcuguuuucacaaaugacuug

SEQ ID NO: 199336 - RNA, 58 nt, Human
ugguggacagaggauggggaaaggggucaggaggaaaaagcuugcauuucuguguguu

SEQ ID NO: 199337 - RNA, 58 nt, Human
uuuagcccaaaaccaagucaagugaaaaaggaggaagagaaaaaauauuuuccugcca

SEQ ID NO: 199338 - RNA, 58 nt, Human
auaggcaguagauauuuuugcccaccugaggaggaacucagucaagcuguugcuuaac

SEQ ID NO: 199339 - RNA, 64 nt, Human
aaaaugcuuccuuaagugcugacagccuuuuuaaccaauacauuuaaaauuguacagaacaaaa

SEQ ID NO: 199340 - RNA, 64 nt, Human
aacuaaacauaguauaguccaacauucguugaucccaauacaggcaaacaaccuggucaaccuu

SEQ ID NO: 199341 - RNA, 64 nt, Human
aaguagcacauugcaacaacaaucaugcuuaugaccaauacagucacuagguuguaguuuuuuu

SEQ ID NO: 199342 - RNA, 64 nt, Human
uuuugcaagaauaagucaugaccaagacaaacugccaauacaaaagcccacugauacuaauuau

SEQ ID NO: 199343 - RNA, 64 nt, Human
uaaggcuuuuuuauuuuaaaaaaacagaguuaucccaauacauuauccugugauuuaccuuacc

SEQ ID NO: 199344 - RNA, 64 nt, Human
aaaauaaaggcaaugauuuauuuuuuucccagugccaauacaauuuugagcuaagcacucaagg

SEQ ID NO: 199345 - RNA, 64 nt, Human
ugguagggccaccacucacuggguuuagggucccccaauacacugugaccucaucuuaacuaau

SEQ ID NO: 199346 - RNA, 64 nt, Human
ugagauccccucacccucaccccauccuuccccaccaauacacacaaauuuuuuaaucccauga

SEQ ID NO: 199347 - RNA, 64 nt, Human
uuuaaaguucaugggugagggauaaaaugaggcuccaauacaugggaagcuuugcugaaaaagu

SEQ ID NO: 199348 - RNA, 64 nt, Human
caggcuaagcugaauaaugacaaaguugaaaggaccaauacagccccuuuuauaaggauuuuga

SEQ ID NO: 199349 - RNA, 64 nt, Human
uuuacuuuguuuguacaaaaacaaagacauauagccaauacaaaucaaaugccggagguguuug

SEQ ID NO: 199350 - RNA, 64 nt, Human
ucuagcccucucccucaguccuuuauuguccauuccaauacauugaacacauuuccuuuacccu

SEQ ID NO: 199351 - RNA, 64 nt, Human
auuacacagcuggucccugugaugugucucgacaccaauacacaacccccuucccaccauccuu

SEQ ID NO: 199352 - RNA, 64 nt, Human
uucuugaaguauauuuuaagggaaacagugaucaccaauacauguuuucaguuuuuuuuuuuuu

SEQ ID NO: 199353 - RNA, 64 nt, Human
uuaaugugaguuugugccuuuuugucucaaucuuccaauacagguauauugagaaaaaaagcag

SEQ ID NO: 199354 - RNA, 64 nt, Human
gugaugaaaaugacccacauuuaugaaacagaggccaauacaugcuccugccagagagguuuaa

SEQ ID NO: 199355 - RNA, 58 nt, Human
ucuuuccagagcuaacugauaagaguggaggaggaaugccuucuccuaagagucaguu

SEQ ID NO: 199356 - RNA, 58 nt, Human
ggggagagccugcuggcacccaccguggaggaggaaggcaagaggggguggaggggug

SEQ ID NO: 199357 - RNA, 58 nt, Human
auaucggaggugguggaggaggaggaggaggaggaaggcaaagccccuggaaaugugc

SEQ ID NO: 199358 - RNA, 58 nt, Human
gaagaaggccugagcaagggggaggaagaggaggaagguuggaccuucaucagaccac

SEQ ID NO: 199359 - RNA, 64 nt, Human
gaaaagcagagaugggcuuucagcagaauaucaaccaauacauuuuucacaugcaaaacucauc

SEQ ID NO: 199360 - RNA, 64 nt, Human
caagaagagauaacuauccuaaauauauaugcacccaauacaggagcacccagauucauaaagc

SEQ ID NO: 199361 - RNA, 64 nt, Human
uuguuuaaaaaaauguuucaccaugugucuuuacccaauacacauacuuuuucuugauguggau

SEQ ID NO: 199362 - RNA, 64 nt, Human
auuguaaugcccggcuuuuccucacuccugguaaccaauacaagcugguuucugccuuaggcuc

SEQ ID NO: 199363 - RNA, 64 nt, Human
acugccccuucgccauccuagagugaggcucuguccaauacauggcucugcccuccagaacuuc

SEQ ID NO: 199364 - RNA, 64 nt, Human
cgucccucccccauccccccuccccacccccuccccaauacagcuacguuuguacaucaugguc

SEQ ID NO: 199365 - RNA, 64 nt, Human
aaguucucgccaagguuagugauccaagagaggaccaauacagaggccaaaauggcuuuuauga

SEQ ID NO: 199366 - RNA, 64 nt, Human
gugguguauucugcguguccauggcggggguucuccaauacacucacacuguccauguucuuuu

SEQ ID NO: 199367 - RNA, 64 nt, Human
gcaaauuaaacuuuaaaguaugucuuguuuguagccaauacaugguguauagcaccaaaaaaug

SEQ ID NO: 199368 - RNA, 64 nt, Human
acgagaaccucuucccccaauaguagacacaucuccaauacaaacacagguuuauaauaaguaa

SEQ ID NO: 199369 - RNA, 64 nt, Human
gguuugcuuucuucaggcucuagggcugugcuauccaauacaguaaccacaugcggcuguuuaa

SEQ ID NO: 199370 - RNA, 64 nt, Human
ggauauggauucuaaggauucuagccugucugaaccaauacaaaauuucacagauuauuugugu

SEQ ID NO: 199371 - RNA, 64 nt, Human
gcaggaaagguucacaaauguggagugucugcguccaauacacgcgugugcuccucuccuuacu

SEQ ID NO: 199372 - RNA, 64 nt, Human
uuaaacaaaacuggaacuguuguugaauccauagccaauacauuuacagcaaucuguguacuga

SEQ ID NO: 199373 - RNA, 64 nt, Human
ccugccaagguuauuaugugcaucuguuauuuuuccaauacauguaaacaguugcagcaugaug

SEQ ID NO: 199374 - RNA, 64 nt, Human
aaaaacaaaaaacuaugugaugccucuauuuuccccaauacagucacacaucagcucaaaauuu

SEQ ID NO: 199375 - RNA, 58 nt, Human
gcagagaacugucucguacuagaauucaaggaggaaagaagaagaaauaaaagaagcu

SEQ ID NO: 199376 - RNA, 58 nt, Human
agaggcaguaagaaagagaggccgacccaggaggaaacaaagggugaaugaagaagaa

SEQ ID NO: 199377 - RNA, 58 nt, Human
ugaagaagaacaaucaugaaauggaagaaggaggaagagcaugaaggaucuuauaaga

SEQ ID NO: 199378 - RNA, 58 nt, Human
aaaauaaacucuuuguaugauauuuauuaggaggaaagaggacugaaaauguucuugu

SEQ ID NO: 199379 - RNA, 64 nt, Human
gacuuagcaugcauucacucccccaucacauauuccaauacacacccuguccuaggcacugaga

SEQ ID NO: 199380 - RNA, 63 nt, Human
cuuugccaagguguauuagcggacggcccucuggccaccuacccgagagaucguagggucaca

SEQ ID NO: 199381 - RNA, 63 nt, Human
uuaaggccaucguuuguacccagagucggcauggccaccuaagucuucauuuaauuuauuguc

SEQ ID NO: 199382 - RNA, 63 nt, Human
gcugccugccaggggagaccugggaccuggacggccaccuaggacugaggacagagagugggg

SEQ ID NO: 199383 - RNA, 63 nt, Human
uuguccuguggguugagggggucugaccaggaggccaccuacagcaggaagugaggcugccau

SEQ ID NO: 199384 - RNA, 63 nt, Human
ggauaggcugaauuggauuaagaaaaguugaaugccaccuaugguaaucuauuugugauuuuc

SEQ ID NO: 199385 - RNA, 63 nt, Human
aaccucgcccucucucaccagccuugaacuguggccaccuagaaaggggcccauucagccucg

SEQ ID NO: 199386 - RNA, 59 nt, Human
ggcugccuaugggggacugaugccugagcgccaccuacugcauuuuggacaccucacac

SEQ ID NO: 199387 - RNA, 63 nt, Human
uccagccugccagucaugaaucucagacagccugccaccuauugcccugauuuguguuauaau

SEQ ID NO: 199388 - RNA, 63 nt, Human
guguuggacagagaagggcuccugcaggccacagccaccuaaacgguucaguuucuucugcgc

SEQ ID NO: 199389 - RNA, 63 nt, Human
uacugugagggugggcccugaggagaccugugggccaccuauugucuaauaaagugggcaguu

SEQ ID NO: 199390 - RNA, 63 nt, Human
aaccaaauuuaauuugaauucaacuuaauuuaagccaccuaaaugaccucuaucagggauuuc

SEQ ID NO: 199391 - RNA, 63 nt, Human
cagccccuccucccucagacccagcgguccaaugccaccuagacucucccuguacacagugcc

SEQ ID NO: 199392 - RNA, 63 nt, Human
auagcccccuucuacuacuuucccucucgcccugccaccuaguuccacauggaaccaacaagu

SEQ ID NO: 199393 - RNA, 63 nt, Human
auauguuaauaaaacuucuuguaacggcuaacugccaccuaaaauaugcuggguuuucuguug

SEQ ID NO: 199394 - RNA, 63 nt, Human
ccggccagcccggccuacgcccaguacccaccggccaccuaugaccaguacccauacgccgcc

SEQ ID NO: 199395 - RNA, 62 nt, Human
gugccaggaaugcgccaccccauccuccaccccgcccccaaaucgugacaaucaaaaaugcc

SEQ ID NO: 199396 - RNA, 62 nt, Human
uuuauaaaauugaaggcaacccccgcuccugccgcccccaaucuccccauugccuagagcgc

SEQ ID NO: 199397 - RNA, 62 nt, Human
gcggaacaugucauuucucuauuucugugacgcgcccccaugcccccaccccaccacaagag

SEQ ID NO: 199398 - RNA, 64 nt, Human
uuuuaaaaaacagcuucaaaauaugcagcaaaaaccaauacaacaaaacgaguggcacgauuua

SEQ ID NO: 199399 - RNA, 64 nt, Human
aucucccagacccucuucccuuugcccuucuccuccaauacauaaaggacacagacaaggaacu

SEQ ID NO: 199400 - RNA, 64 nt, Human
augcaaaaauucaucuuucggugauugugggcggccaauacauaccuucuguaacuccucccua

SEQ ID NO: 199401 - RNA, 64 nt, Human
ccugcugcuccagggagcaccagcugcagcugauccaauacaccaagccugugucucccucuuc

SEQ ID NO: 199402 - RNA, 64 nt, Human
agcuaccucauaggguuguugaggauuaagugaaccaauacauauacagugcuuagcacuuaau

SEQ ID NO: 199403 - RNA, 64 nt, Human
agcguugagccacuaagcagaggaccuuggguucccaauacaaaaauaccuacugcugagaggg

SEQ ID NO: 199404 - RNA, 64 nt, Human
cacaguaguaaaagcaguaccugggauuuucccaccaauacaaaccaguuacagcaacuguaau

SEQ ID NO: 199405 - RNA, 64 nt, Human
cagccuaguuucacucaguuugaccugagacuuuccaauacaaucuguuguuuuguuuuguuuu

SEQ ID NO: 199406 - RNA, 64 nt, Human
caugaacacagggauuggggagggaccagagcgcccaauacacacagcuccauuaugcaaucca

SEQ ID NO: 199407 - RNA, 64 nt, Human
ggccagucaacugcacaauacacaacuguauuucccaauacacuugagcaguugccugugaaug

SEQ ID NO: 199408 - RNA, 64 nt, Human
uagcccccccaaaaaauuacaauaauuuugucaaccaauacagaacaugagcccuuuuuaaaug

SEQ ID NO: 199409 - RNA, 64 nt, Human
ugauucuguuuccuuaaguauuauauaaacugugccaauacagacaaagcauaaucaauauaau

SEQ ID NO: 199410 - RNA, 64 nt, Human
uguguugucauuauuuguaguaguaacuacauauccaauacagcuguauguuucuuuuucuuuu

SEQ ID NO: 199411 - RNA, 58 nt, Human
acuugcguuugaaggcagcaguggucucaggaggaagaaacgggggcgggagagagug

SEQ ID NO: 199412 - RNA, 58 nt, Human
uaccccuccacggugggugcggaggcucaggaggaauuccugcggguccucggcucca

SEQ ID NO: 199413 - RNA, 58 nt, Human
uguuggaucacgggaaaucaagacacccaggaggaauugaaagaggcuuccucuucuc

SEQ ID NO: 199414 - RNA, 58 nt, Human
cugguguggaaacacugcccagggagaaaggaggaagcucacuguggacagucuucuu

SEQ ID NO: 199415 - RNA, 58 nt, Human
cuucgcuccuuaucacugcauugugaagaggaggaaaagugaaucacggagagagaaa

SEQ ID NO: 199416 - RNA, 58 nt, Human
ggcgcucccgacacagcgcagacccaccaggaggaaagaggcccagcucucagcugac

SEQ ID NO: 199417 - RNA, 58 nt, Human
ugcgggcugcccugugggcuggugcuucaggaggaauccagagaaguguucagaugcc

SEQ ID NO: 199418 - RNA, 58 nt, Human
uuaucucuguagggcucaggaagcuggaaggaggaagggaggguaaguggccugguga

SEQ ID NO: 199419 - RNA, 58 nt, Human
agcaagacaaaaacagagagaccgcagaaggaggaagauacugugguacugucauaaa

SEQ ID NO: 199420 - RNA, 58 nt, Human
gcuucuaaugagaaaugaagucagugcaaggaggaaugagagguggggaggggagauu

SEQ ID NO: 199421 - RNA, 58 nt, Human
cauucucccacaggauggugaggcugggaggaggaagacugagguagagauuccaggc

SEQ ID NO: 199422 - RNA, 58 nt, Human
auuuauauauauuauuuuuuuuuaagaaaggaggaaaagaaaccaaaaguuuuuuuua

SEQ ID NO: 199423 - RNA, 58 nt, Human
auagcacacgcccuccuggcugggccucaggaggaacagccaaggagaagaauggccc

SEQ ID NO: 199424 - RNA, 58 nt, Human
ccacgaacaccacuccuggaugaggaagaggaggaaaauccugacaaggcuucuaagu

SEQ ID NO: 199425 - RNA, 58 nt, Human
cagauucucagaugggaugaucuggaggaggaggaaaaagauacacucccuuggggcu

SEQ ID NO: 199426 - RNA, 58 nt, Human
auaaagaacuauaauuuuucucaaaagaaggaggaaaaggugucuugcuggcuugccu

SEQ ID NO: 199427 - RNA, 58 nt, Human
guccagcaaacucuugcauguggccacuaggaggaauguguaagaauguucauaguua

SEQ ID NO: 199428 - RNA, 58 nt, Human
aaaauugagcauaguaauuacccacagaaggaggaaguggaagggacaggagcacaua

SEQ ID NO: 199429 - RNA, 58 nt, Human
acgcacacaucaacccacagaccuuaggaggaggaaggcgagggcggggugacuucug

SEQ ID NO: 199430 - RNA, 58 nt, Human
auagccuaacacuaccccacccccaacuaggaggaaccucuguuuucaagagagaugc

SEQ ID NO: 199431 - RNA, 58 nt, Human
agaacccuuaaaggugggugacguuuucaggaggaaccugggauguccugaugcucaa

SEQ ID NO: 199432 - RNA, 58 nt, Human
gaggaggaagaggaggaggaggaggaggaggaggaaggcgaggacaguggcacuucag

SEQ ID NO: 199433 - RNA, 58 nt, Human
agccuggaagaggaggaggaugagcaggaggaggaagaggaggaggaggaggaggagg

SEQ ID NO: 199434 - RNA, 58 nt, Human
agcccugcaaggcagaaaugacagugcaaggaggaaaugcagggaaacucccgagguc

SEQ ID NO: 199435 - RNA, 58 nt, Human
cugaccuucugcugggaaagcagcccugaggaggaagaggaggcgagggaaucagaaa

SEQ ID NO: 199436 - RNA, 58 nt, Human
aagcaggcuguuugcucacuucuucaaaaggaggaaugauaacccaaaucugcccaag

SEQ ID NO: 199437 - RNA, 58 nt, Human
uacucuguugcuggcuuuagcagagaauaggaggaaccauaugaaaaagaucaggcuu

SEQ ID NO: 199438 - RNA, 58 nt, Human
ggaccccuucuacugaaccuuugaggaaaggaggaaggaagaaaugcguuuagaucuu

SEQ ID NO: 199439 - RNA, 58 nt, Human
aauuuccagguauggggguagccccaaaaggaggaaucuccuauggccaauaagguau

SEQ ID NO: 199440 - RNA, 58 nt, Human
ugaccuaccccagauauuuguguggaagaggaggaaucaccauuuacaagguggacaa

SEQ ID NO: 199441 - RNA, 58 nt, Human
ugacuccagcagauucuggcccagggacaggaggaagagaugccaccagggcuggucu

SEQ ID NO: 199442 - RNA, 58 nt, Human
ccaaauggcagggauacccagugaugucaggaggaauaguacagacagaaggugcuaa

SEQ ID NO: 199443 - RNA, 58 nt, Human
auuaugucauuccauaaugacugaaucaaggaggaaaauaugguguuuggaauguuag

SEQ ID NO: 199444 - RNA, 58 nt, Human
caaaggagaagaaauuacucccugcaacaggaggaauagaaaugaagcagugaguguu

SEQ ID NO: 199445 - RNA, 58 nt, Human
caaaacagcccuauaagaagguuggaaaaggaggaacuauauagcagccuuugcuauu

SEQ ID NO: 199446 - RNA, 58 nt, Human
ccuugaaaauauaucuucagcuuuggguaggaggaaucuugguguaugaaaucauugc

SEQ ID NO: 199447 - RNA, 58 nt, Human
agcagagagugggcaggauauuccugauaggaggaacuacaugaauaaagggguaaga

SEQ ID NO: 199448 - RNA, 58 nt, Human
aagcuggggaaagugguuagggagggagaggaggaagacugagaaaucucugcauccc

SEQ ID NO: 199449 - RNA, 58 nt, Human
ugccaaccucccugcuggcccaggugagaggaggaagaggggucuggaaagaaaccca

SEQ ID NO: 199450 - RNA, 58 nt, Human
ggcugaggcaggagaauugcuugaacccaggaggaagagguugcagugagccaagauc

SEQ ID NO: 199451 - RNA, 58 nt, Human
uagacacuaaaccucaugcccuaaggacaggaggaaagacccucuguuuggagcauua

SEQ ID NO: 199452 - RNA, 58 nt, Human
gguggacauaaaugagucaagugacaacaggaggaaauagacuuagacgaaagaaagg

SEQ ID NO: 199453 - RNA, 58 nt, Human
ggggcagaaauauuuucugggcugggguaggaggaagguuguugcagccaucuacugc

SEQ ID NO: 199454 - RNA, 58 nt, Human
aagaaggcaaggagguaggaagagagggaggaggaaaggaaggagagaugccucaggc

SEQ ID NO: 199455 - RNA, 58 nt, Human
ggggagaugccccuucuuauagcacuggaggaggaaaacaaauucuugucccccucag

SEQ ID NO: 199456 - RNA, 58 nt, Human
ggugggaacuguuggaaauuccaggguaaggaggaagaugccuguucucccugucuga

SEQ ID NO: 199457 - RNA, 58 nt, Human
aagaggagaagaugggggucuuggaggaaggaggaaaaggcaaggaggcugcaggcag

SEQ ID NO: 199458 - RNA, 58 nt, Human
aaaaagaaaaagaaaaggaggcagaaagaggaggaagaagcuacagcaucugaaagga

SEQ ID NO: 199459 - RNA, 58 nt, Human
gggcuggcucugcugccccaaccuuucaaggaggaaaccagacaccugagacaggagc

SEQ ID NO: 199460 - RNA, 58 nt, Human
uuuuucccauuugucaaacccucuucaaaggaggaacagauaagacugggucagccua

SEQ ID NO: 199461 - RNA, 58 nt, Human
gguggugaggcucacaguacugguuuccaggaggaagagccuuugugcauuugacuga

SEQ ID NO: 199462 - RNA, 58 nt, Human
uguggauaaagggaaccaugaaaaugagaggaggaaagacauccagaucagcuguuuu

SEQ ID NO: 199463 - RNA, 58 nt, Human
ucucugagccuucccaccugcgggguggaggaggaacuucccaagugcuuuuaaaaau

SEQ ID NO: 199464 - RNA, 58 nt, Human
agagguggucuuauggagauggcaagaaaggaggaaaugauuucuucagaucucaaag

SEQ ID NO: 199465 - RNA, 58 nt, Human
acccaccuggagacgaauguagccagagaggaggaaggagggaaacugaagacaccgu

SEQ ID NO: 199466 - RNA, 58 nt, Human
ugccaucagaggaggaugaccgugcuugaggaggaagaauggguucaagaucaucaua

SEQ ID NO: 199467 - RNA, 58 nt, Human
ggaggagggaguguguccuuugagcaagaggaggaacuccuggugccuuucugagccu

SEQ ID NO: 199468 - RNA, 58 nt, Human
gaucaacuucaaaucugugauugcuuacaggaggaagauaagcuacuaauugaaaaug

SEQ ID NO: 199469 - RNA, 58 nt, Human
auccugugaagggacacagagaacaggcaggaggaaaggcaggagccaguccgugcag

SEQ ID NO: 199470 - RNA, 58 nt, Human
gggccugacuaggaaaaguugggaguuaaggaggaaauuagcauuccuuaauguuuug

SEQ ID NO: 199471 - RNA, 58 nt, Human
cuucagaagggcuguucugaaauuccuaaggaggaauucuuaggaauuccuaaggaga

SEQ ID NO: 199472 - RNA, 58 nt, Human
agguucagacgguuucuccuuugcacccaggaggaacuuuggcugcgagaaugggggg

SEQ ID NO: 199473 - RNA, 58 nt, Human
gacagucccaguccuaugguaaugacuuaggaggaaugcagauaaaaguaccuuguaa

SEQ ID NO: 199474 - RNA, 58 nt, Human
augaugaguuucuggccuaauugagggaaggaggaaauucauaccagcaguuuucaaa

SEQ ID NO: 199475 - RNA, 58 nt, Human
ccuucagagagcagugcuuuuggcggggaggaggaaaucccuucauacuugaacguuu

SEQ ID NO: 199476 - RNA, 58 nt, Human
agacugaauuaucauaacuuauggcaucaggaggaaacuuuaaaauaucaaggaauca

SEQ ID NO: 199477 - RNA, 58 nt, Human
accuggggcagcagcaggaggccuggggaggaggaaaaucaggcagucggccuggagu

SEQ ID NO: 199478 - RNA, 58 nt, Human
ugaccccuaggcaaggggaugagaccgcaggaggaaauggcggggaggaggcauucuu

SEQ ID NO: 199479 - RNA, 58 nt, Human
guauggacaggacagaaaagcgagucgcaggaggaagggagaugcagccgcacagggg

SEQ ID NO: 199480 - RNA, 58 nt, Human
uuuucaucccgcuaaucuugggaauaagaggaggaagcggcuggcaacugaaggcugg

SEQ ID NO: 199481 - RNA, 58 nt, Human
guacaggcccucccuccccuuggccucuaggaggaaacaguuuuuuagacuggaaaaa

SEQ ID NO: 199482 - RNA, 58 nt, Human
cuggccucaggggacaggccaccuggucaggaggaauauuuuuccugcacuuuuucuc

SEQ ID NO: 199483 - RNA, 58 nt, Human
guggaccacugcccguccacucuucaacaggaggaacagcaugccaccauaguaacac

SEQ ID NO: 199484 - RNA, 58 nt, Human
agguuucuguaaccccugcccuggugugaggaggaaauggcucuggccuggcugccug

SEQ ID NO: 199485 - RNA, 58 nt, Human
uugaauacacuauaaacucacuggcugaaggaggaaauuuuagaaggaagcuacuaaa

SEQ ID NO: 199486 - RNA, 58 nt, Human
ucguagaugucgcguguuggaagggagcaggaggaaggacugauacuggcaaaucagu

SEQ ID NO: 199487 - RNA, 58 nt, Human
guugauguugugugcuguaaaggauuuuaggaggaauuugaaacaggauauuuaagag

SEQ ID NO: 199488 - RNA, 58 nt, Human
ggagcaguuccccaacaaaagaagcuacaggaggaacuuucugacuuaucagcaaugg

SEQ ID NO: 199489 - RNA, 58 nt, Human
cuugggcuuucuaaucagaauuuccaggaggaggaaagugugugcugaauauuuuaaa

SEQ ID NO: 199490 - RNA, 58 nt, Human
aucugaguuauuuugcuaaacuugggggaggaggaacaaauaaauggagucuuuauug

SEQ ID NO: 199491 - RNA, 58 nt, Human
uuagggaugaacagacuauaacuaggaaaggaggaaagguaucagggauuuuuaaguc

SEQ ID NO: 199492 - RNA, 58 nt, Human
uugugcugccuuugggcuuccauggagcaggaggaacauaccacagaacauggaucua

SEQ ID NO: 199493 - RNA, 58 nt, Human
cgacgacugaggcaagagggcgccagugaggaggaagggaaggcgguucagagauguu

SEQ ID NO: 199494 - RNA, 58 nt, Human
aucauguacaguuuuauuuuauaacgugaggaggaaaaacagucuuuggauuaacccu

SEQ ID NO: 199495 - RNA, 58 nt, Human
gauuucuagaguggaucucuuaugaaugaggaggaauguggaaaguuucacauuuagu

SEQ ID NO: 199496 - RNA, 58 nt, Human
gaucucuuccaaccugcccagucacagaaggaggaaugacucaaaugcccaaaaccaa

SEQ ID NO: 199497 - RNA, 58 nt, Human
cuggccugggaaaagggcaggagccuagaggaggaaaaaggcugguggacagacccag

SEQ ID NO: 199498 - RNA, 58 nt, Human
ugcccucagaaccucagccagaaaggcaaggaggaaaucagagcaggagccucauacu

SEQ ID NO: 199499 - RNA, 58 nt, Human
uuggacauuuaaauucacucugcugaauaggaggaagcuuuucuuuuuccugggaaaa

SEQ ID NO: 199500 - RNA, 58 nt, Human
ccugaccagguaagaaacugaaagcaagaggaggaagauaaaugcccggagauuccaa

SEQ ID NO: 199501 - RNA, 58 nt, Human
cuucuucccuugugccucauguaugggcaggaggaaaggugggagggggagugggaau

SEQ ID NO: 199502 - RNA, 58 nt, Human
ugggugacuuggcuaccugaaaaaucuuaggaggaauagcucacaauacaauaaaucu

SEQ ID NO: 199503 - RNA, 58 nt, Human
uuagagggaaagacugaaagagaaagauaggaggaaccacaauguuucuucauuucuc

SEQ ID NO: 199504 - RNA, 58 nt, Human
uucccuucccaagucucuggggguggaaaggaggaagagauacuaguuaaagauuuua

SEQ ID NO: 199505 - RNA, 58 nt, Human
gugccuccuaagggguuaauauaaaucaaggaggaaguuuauauuuaaggaagaauug

SEQ ID NO: 199506 - RNA, 58 nt, Human
auuucaagaauuuggguuuuuuggagggaggaggaaacuguuuacuuuuuuccuccac

SEQ ID NO: 199507 - RNA, 58 nt, Human
gaguggguggagggagggagcuacgggcaggaggaagaauuuuguagagcugccagcg

SEQ ID NO: 199508 - RNA, 58 nt, Human
agaauguggcaacuugcuugugccuaaaaggaggaauuggaacuagaaugugugacuc

SEQ ID NO: 199509 - RNA, 58 nt, Human
uuucauccuguaaaaguaagcauguagaaggaggaaguugugcuaaaaugccuuuguu

SEQ ID NO: 199510 - RNA, 58 nt, Human
uaaccuguuccauuccauggaaccauggaggaggaagacccucaguuauuuugucacc

SEQ ID NO: 199511 - RNA, 58 nt, Human
cggugaucagcagagagauugaacuuugaggaggaagcagaaucuuugcaagaaaguc

SEQ ID NO: 199512 - RNA, 58 nt, Human
uggcuucuggaccccuccucugccccgcaggaggaaguuccacggcagguggugcguu

SEQ ID NO: 199513 - RNA, 58 nt, Human
cacagacuucggguuggauuugucagcaaggaggaaaguuauggaaacuuuggccacu

SEQ ID NO: 199514 - RNA, 58 nt, Human
uuuaguaagagauuccugagccagugucaggaggaaggcuuacacccacaguggaaag

SEQ ID NO: 199515 - RNA, 58 nt, Human
ugcuuuuugucccauuugacaagguaccaggaggaaauuuuuuaagggaucaacugua

SEQ ID NO: 199516 - RNA, 58 nt, Human
cuucugcccugccuccuccuuucguuguaggaggaaucugugcucuacuuaccucuca

SEQ ID NO: 199517 - RNA, 58 nt, Human
aagugaacuugaacaugagagaagcagaaggaggaaacauaagaggaggccaaaaguu

SEQ ID NO: 199518 - RNA, 58 nt, Human
ucacagagcuucaccaaaucacagauucaggaggaauuuggcuuucacacuggacuca

SEQ ID NO: 199519 - RNA, 58 nt, Human
gaucaugaagacugggcuuccaauggggaggaggaaagaugcaauaugucucuuacac

SEQ ID NO: 199520 - RNA, 58 nt, Human
augaaucaaagcuuauauguaaacuucaaggaggaaugguaaaauguucagcccuccu

SEQ ID NO: 199521 - RNA, 58 nt, Human
cuacuugaauuugacacaagagaaaagcaggaggaaaaggggccauucuccaaaggac

SEQ ID NO: 199522 - RNA, 58 nt, Human
agaugugguauugcucugaggaccaggcaggaggaacucuacaaccugaguuugccuu

SEQ ID NO: 199523 - RNA, 58 nt, Human
ccuguaauccuagcacuuugggaggcugaggaggaaggaucacuugagcccagaaguu

SEQ ID NO: 199524 - RNA, 58 nt, Human
gcagcuucuucuuucuucugcucauaaaaggaggaacacuuuagauagagggcaaaua

SEQ ID NO: 199525 - RNA, 58 nt, Human
agagaguuaucuuaauuuuuauugcaguaggaggaaauauauuuaaaauauuuguaga

SEQ ID NO: 199526 - RNA, 58 nt, Human
agguaguaugagaaacuaaaagcccucaaggaggaagaauagucuuagccaguuuucc

SEQ ID NO: 199527 - RNA, 58 nt, Human
ucaaccuacaagacuuacuauuuaaauaaggaggaauauuaugugaauauacauauca

SEQ ID NO: 199528 - RNA, 58 nt, Human
caauagagauugcuuuggugaccaugauaggaggaaacgaaacuuguaagauuggaac

SEQ ID NO: 199529 - RNA, 58 nt, Human
agagauauugauauugaaggaauuugggaggaggaaaagaaaccuggggugaauacuu

SEQ ID NO: 199530 - RNA, 58 nt, Human
uuccaggcccagggauguaggagggggaaggaggaaacaggaagcccagagagggcaa

SEQ ID NO: 199531 - RNA, 58 nt, Human
guuccuuagcagggaggaggaagaggagaggaggaagcaaagaaucacaaggaaccuc

SEQ ID NO: 199532 - RNA, 58 nt, Human
guaccccuggagaaguuccuuagcagggaggaggaagaggagaggaggaagcaaagaa

SEQ ID NO: 199533 - RNA, 58 nt, Human
gcccgacaccuguaaagggucggugcugaggaggaauagugaaggagggaggccucuu

SEQ ID NO: 199534 - RNA, 58 nt, Human
acuguagacacucucuaaugguucucaaaggaggaaauguagccuucagucuccucau

SEQ ID NO: 199535 - RNA, 58 nt, Human
cccugaaccucaugagccucuaagggaaaggaggaacaauuaggacguggcaaugaga

SEQ ID NO: 199536 - RNA, 58 nt, Human
aggucagcuggucaaggcagaggaggagaggaggaaaggaugggggcugaagagcaga

SEQ ID NO: 199537 - RNA, 58 nt, Human
ccaggcucuggugaagcccucugagcccaggaggaagagaaagcauuguccagaggua

SEQ ID NO: 199538 - RNA, 58 nt, Human
agcacaggagcuuucucuggcagaauugaggaggaagagguggcccucugacuugaca

SEQ ID NO: 199539 - RNA, 58 nt, Human
aguauuacauuggccuugggggacagaaaggaggaaguucugacuuuucagggcuacc

SEQ ID NO: 199540 - RNA, 58 nt, Human
uuaugagcaaauguauugcuucuuuuagaggaggaagcauacaaccucuuuuguguga

SEQ ID NO: 199541 - RNA, 58 nt, Human
cugccucaugacaaguacauguuauuuaaggaggaaaaaauauuaaauuuugaauuga

SEQ ID NO: 199542 - RNA, 58 nt, Human
ugauuuagguacgucaaagcaguagucaaggaggaaagggauaguccaaagacuuaac

SEQ ID NO: 199543 - RNA, 58 nt, Human
ggccagugagcuuuacuugccguguaaaaggaggaaagggguggaaaaaaaccgacuu

SEQ ID NO: 199544 - RNA, 58 nt, Human
ucccucaugacaguugcccuuucaaagcaggaggaagaaaaggaagaaagaaaaacug

SEQ ID NO: 199545 - RNA, 58 nt, Human
agaauagugguugccagggacugcagggaggaggaaauggggggugggguuauuguuu

SEQ ID NO: 199546 - RNA, 58 nt, Human
cguguaaucccaacacuuugggaggcugaggaggaaggauagcuugaggccaggaguu

SEQ ID NO: 199547 - RNA, 58 nt, Human
ugcagacgaaggcaggggacccauggcgaggaggaauggccagcaccccaggcagucu

SEQ ID NO: 199548 - RNA, 58 nt, Human
gcacucggcuucccaauguuagagaaggaggaggaagcccauagacccccaagcccca

SEQ ID NO: 199549 - RNA, 58 nt, Human
aagcaugggugcuuagaaaguuuauuucaggaggaaaauggguucacacaaaaagcaa

SEQ ID NO: 199550 - RNA, 58 nt, Human
ucucuccucagccuuccaccuccaagagaggaggaaaaacaguugucugcugucugua

SEQ ID NO: 199551 - RNA, 58 nt, Human
cagugacaaauccaacugaccagaagggaggaggaagcucacugguggcuguuccuga

SEQ ID NO: 199552 - RNA, 58 nt, Human
uccugaugaaaggaaaaaaauucucuccaggaggaagccuuuuuccuucuugcccuuc

SEQ ID NO: 199553 - RNA, 58 nt, Human
guguucucagcuagauuugauuugguugaggaggaacuguggcccuccguaaguuauu

SEQ ID NO: 199554 - RNA, 58 nt, Human
ggcuuguugcagcccuccuuuaacccaaaggaggaaaggacugcuucagaaacuccca

SEQ ID NO: 199555 - RNA, 58 nt, Human
aaauuuaagaaacuguguucucaacucaaggaggaauaaaacucauaaaacaaaagcc

SEQ ID NO: 199556 - RNA, 58 nt, Human
uucaguuccucauuuuucuaguucccacaggaggaacacaaagggcccaugaugaaag

SEQ ID NO: 199557 - RNA, 58 nt, Human
aaauaaaugacuggggcaagcaaaauugaggaggaaauuagaaacuguuugacaaacu

SEQ ID NO: 199558 - RNA, 58 nt, Human
uuauaaacaguaauagcuacguuugggaaggaggaaacauuuaaauuauaaaggacug

SEQ ID NO: 199559 - RNA, 58 nt, Human
aagaaggcucagggcagacaaagucaagaggaggaaguuuuuguggacaaugaaaagu

SEQ ID NO: 199560 - RNA, 58 nt, Human
guuaaaggauacaaaguuacagcuugguaggaggaauaauuucugguguucuauacca

SEQ ID NO: 199561 - RNA, 58 nt, Human
guuuaaccauuagaaauauuucaugucaaggaggaaaacauuagggaaaacaaaaaug

SEQ ID NO: 199562 - RNA, 58 nt, Human
caguggcaaauccaacugaccagaaggaaggaggaagcuuauugguggcuguuccuga

SEQ ID NO: 199563 - RNA, 58 nt, Human
gaguccuguguguuuguggggagagggaaggaggaagucaguuauuugaguaagccuc

SEQ ID NO: 199564 - RNA, 58 nt, Human
uauaaaguuauuaauagccauuugaagaaggaggaauuuuagaagagguagagaaaau

SEQ ID NO: 199565 - RNA, 58 nt, Human
cuguggccguccaggugaaucacagcugaggaggaaauccagaugagaccaaugcacu

SEQ ID NO: 199566 - RNA, 58 nt, Human
caacgaaagcugaauaguguuggaacugaggaggaagccauagcucagggucaucaag

SEQ ID NO: 199567 - RNA, 58 nt, Human
auauuuugugccuugaagggaaugucacaggaggaaaaggaagacuaaagccugcaua

SEQ ID NO: 199568 - RNA, 58 nt, Human
aagcuucaaggacaauaagauguuaaaaaggaggaaauaauuauuuuuauuuugacac

SEQ ID NO: 199569 - RNA, 58 nt, Human
uaagugacagauacuaaagugaauaugcaggaggaaugcugucuccgauaucucaccg

SEQ ID NO: 199570 - RNA, 58 nt, Human
uguguguaaguggagaacuuggggauagaggaggaagcuccucguggcccuuccaagg

SEQ ID NO: 199571 - RNA, 58 nt, Human
aaaauuacccagauuggcuccauggaaaaggaggaacagcguuuccguaaaauugacu

SEQ ID NO: 199572 - RNA, 58 nt, Human
uagacuuuuuuuacaggcaaaaugaaagaggaggaagucuggguuuuaugaauagcau

SEQ ID NO: 199573 - RNA, 58 nt, Human
aagcccauccugugccagaggaaggaaaaggaggaaauuuccuuucucuuuuaggagg

SEQ ID NO: 199574 - RNA, 58 nt, Human
cuagccauuucggaagacaccgaggaagaggaggaagaugaagaccaggacuacagcu

SEQ ID NO: 199575 - RNA, 58 nt, Human
cucagaauuguagggauaauaugaaugcaggaggaaacauucugucaggcgguaugac

SEQ ID NO: 199576 - RNA, 58 nt, Human
uuuacagauaacucucuucacuauuccuaggaggaaaaagaaaugcauucgguacuua

SEQ ID NO: 199577 - RNA, 58 nt, Human
aggaugaagcauuagcuugaagcacuacaggaggaaugcaccacggcagcucuccgcc

SEQ ID NO: 199578 - RNA, 58 nt, Human
agcuucugccacggcuucagucagggccaggaggaacacgugaaggagaaagagaaau

SEQ ID NO: 199579 - RNA, 58 nt, Human
guaauaaaggcaauuggaugauaucuguaggaggaaaacaaugacuaauuucuuccuu

SEQ ID NO: 199580 - RNA, 58 nt, Human
ugauagcuggcccacaggucaugaauugaggaggaauuugcuuucaaaaagcaagaau

SEQ ID NO: 199581 - RNA, 58 nt, Human
cgcuagacacugccaggcccgggccucgaggaggaaaagacaguagggaagacauuau

SEQ ID NO: 199582 - RNA, 58 nt, Human
cuuuacagauguggauauuuaggccaaaaggaggaagugacuuguccaggggcagaca

SEQ ID NO: 199583 - RNA, 58 nt, Human
augcucaggcagaacgggguacauccacaggaggaaucggacgagaggaugugacauu

SEQ ID NO: 199584 - RNA, 58 nt, Human
gcagaagauccugcagacccuuaucuggaggaggaagagaagcaggagagagaaagcc

SEQ ID NO: 199585 - RNA, 58 nt, Human
auugauuugcauucuggaaagcucucccaggaggaagcauuccccaccccaccuugcc

SEQ ID NO: 199586 - RNA, 58 nt, Human
uacgcuguuguggggaggggggaagaaaaggaggaaccaauuaaauaggaccuuuuaa

SEQ ID NO: 199587 - RNA, 58 nt, Human
ucaagacauuucuuaaccaucagagcagaggaggaaagacucacuaccucagaaaaau

SEQ ID NO: 199588 - RNA, 58 nt, Human
ugugagaguguagaagggaaggcuucucaggaggaacgugacaguggauuggguggcu

SEQ ID NO: 199589 - RNA, 58 nt, Human
cagauaaugugggaaaaaaagagauaagaggaggaagcuaauaagagacugucaagau

SEQ ID NO: 199590 - RNA, 58 nt, Human
cagaagggcccauguacuuguugggaggaggaggaaagggaaggcuggcagguagguc

SEQ ID NO: 199591 - RNA, 58 nt, Human
agucaggggugggaggagaaggaggaagaggaggaaggccagacuggccugcccuuuc

SEQ ID NO: 199592 - RNA, 58 nt, Human
uggguggggagucaggggugggaggagaaggaggaagaggaggaaggccagacuggcc

SEQ ID NO: 199593 - RNA, 58 nt, Human
cugacagaaaaaggaucucugagccuaaaggaggaaaagucccaccaacuaccagacc

SEQ ID NO: 199594 - RNA, 58 nt, Human
aguuucaaugcugcugagagugaaagaaaggaggaaagucugccacucuacccugagc

SEQ ID NO: 199595 - RNA, 58 nt, Human
gagaccagagaccgccuacuggagagaaaggaggaaaaaagaaauaaaaauauuuuua

SEQ ID NO: 199596 - RNA, 58 nt, Human
agauccucucucccagggaauccgacacaggaggaaccccuucucugguugagcuggg

SEQ ID NO: 199597 - RNA, 58 nt, Human
gccugacuucugccggagcucccaguccaggaggaaagagccaaggcccacuuuuggg

SEQ ID NO: 199598 - RNA, 58 nt, Human
gcauuuguucauuuggagcuuagaguccaggaggaauacauuagauaaugacacaauc

SEQ ID NO: 199599 - RNA, 58 nt, Human
cuccuggcucuguucagggaggcugcccaggaggaagacuggccauuaugcauccccu

SEQ ID NO: 199600 - RNA, 58 nt, Human
cagcaagucaaugucaccgacagugaugaggaggaagaagaaaaagugcucagggauu

SEQ ID NO: 199601 - RNA, 58 nt, Human
aaacaaugcuuccaguggccacuuccuaaggaggaacaaccccgucugaucucagaau

SEQ ID NO: 199602 - RNA, 58 nt, Human
aaagaccgcuguucauaaggagagagaaaggaggaagagaugagaaaggaagacagag

SEQ ID NO: 199603 - RNA, 58 nt, Human
uuuuuucuuguugugagguagggaagugaggaggaaagccaugccgaagcaaauguua

SEQ ID NO: 199604 - RNA, 58 nt, Human
cccacucugcccagccggagggacgcggaggaggaagaggguagacaggggcgaccug

SEQ ID NO: 199605 - RNA, 58 nt, Human
uguuuuccauuguuggugaaaaaugucaaggaggaaagaacaauaaugauuccaucau

SEQ ID NO: 199606 - RNA, 58 nt, Human
ucacugccucaaguuacagccagaggaaaggaggaacuaaaacuuagcaaaucuauaa

SEQ ID NO: 199607 - RNA, 58 nt, Human
uuuggcgagagcuccacggaaagugaugaggaggaagaagagggcuguggucauacac

SEQ ID NO: 199608 - RNA, 58 nt, Human
cugugagggucugacuugcucaaaccagaggaggaaacagaaaccccugcacaucuuu

SEQ ID NO: 199609 - RNA, 58 nt, Human
ccacgucccuugggaccggugggacuggaggaggaacggucacccuccucccccaugg

SEQ ID NO: 199610 - RNA, 58 nt, Human
ggagagccugcagcugaguucagcagaaaggaggaauccuggcccucaggaagaagau

SEQ ID NO: 199611 - RNA, 58 nt, Human
gcaagggaaacuggggagauggggauggaggaggaaggcugauauccucuggggagca

SEQ ID NO: 199612 - RNA, 58 nt, Human
cuggggagcacaucaccugaaggugccaaggaggaaggcugagaggggggccacccca

SEQ ID NO: 199613 - RNA, 58 nt, Human
gugaucgaggacugguacaggaaccaccaggaggaagaccugacugaauuccucugcg

SEQ ID NO: 199614 - RNA, 58 nt, Human
guugacgggccgcaggagggaggcggggaggaggaacgggcagccacaggacugagcc

SEQ ID NO: 199615 - RNA, 58 nt, Human
uuccucccuagugccccaaccagucuucaggaggaagagaugcccaugaagcaggucc

SEQ ID NO: 199616 - RNA, 57 nt, Human
gugacaagccgaggcggugagccgggcaggaggaaggagccucccucaggguuucgg

SEQ ID NO: 199617 - RNA, 58 nt, Human
aucaugcauuugcaaaaaucuuagcugaaggaggaauacgagggcuuugggcaggcug

SEQ ID NO: 199618 - RNA, 58 nt, Human
uaaacacaaauaaaaagaaaauauuuauaggaggaaaugauuaauuugauauucuuua

SEQ ID NO: 199619 - RNA, 58 nt, Human
gagcagguggaagaggaacuuugagcacaggaggaaaugcaaccagucagggcccaga

SEQ ID NO: 199620 - RNA, 58 nt, Human
caggcucucccugcuccaggagaagacuaggaggaagaaugaggugcuccugccgugu

SEQ ID NO: 199621 - RNA, 58 nt, Human
cugaggccugccuccuaauaaagacucaaggaggaagucaauugggcaucugcuaaua

SEQ ID NO: 199622 - RNA, 58 nt, Human
ccaaaaagugcuucaucaggcgugcuacaggaggaaggagcuagaaauagaacaaucc

SEQ ID NO: 199623 - RNA, 58 nt, Human
gagaagugaugaagggaaauguucuuagaggaggaaauauccuuuguccuguucagag

SEQ ID NO: 199624 - RNA, 58 nt, Human
uccccucaugucacuacugaauuuugacaggaggaaggaauagaaugauagcuuguuu

SEQ ID NO: 199625 - RNA, 58 nt, Human
aaaugguugcugaacccaaaacauguuuaggaggaaaaccagaagaacagagcagugg

SEQ ID NO: 199626 - RNA, 58 nt, Human
caacauccuuauucucaucuuuaagguaaggaggaaguagagauagaaggaaauacgu

SEQ ID NO: 199627 - RNA, 58 nt, Human
cgagugacaguuuguuaaaaagcuuuagaggaggaaugaaaacaaagugaaguacacu

SEQ ID NO: 199628 - RNA, 58 nt, Human
cccccgcgagacggguuagggaaagcggaggaggaaagcgaggggguggggggcuucc

SEQ ID NO: 199629 - RNA, 58 nt, Human
accuuguuucugcccuagacauuugccaaggaggaaccuaaggaagauauugacgucu

SEQ ID NO: 199630 - RNA, 58 nt, Human
gacuaaccuuauuuauuugggaaaggggaggaggaaggaaaugauaugguacccagac

SEQ ID NO: 199631 - RNA, 58 nt, Human
gccaguccucuuucccgcagcugcagagaggaggaagacuauuaaaggacaguccuga

SEQ ID NO: 199632 - RNA, 58 nt, Human
uguucccuucccucuguugcagggaaccaggaggaaagggaaagauguugccauauuu

SEQ ID NO: 199633 - RNA, 58 nt, Human
guaucuuccugaugucuucuuagcuaagaggaggaaaaaaaggcugaaaaaauaggga

SEQ ID NO: 199634 - RNA, 58 nt, Human
uucugggguuaaagucacaucauaugugaggaggaaaaguuuaacaugaacuaacauu

SEQ ID NO: 199635 - RNA, 58 nt, Human
uccauucauugggaaaucacggggacagaggaggaauucacgggaucagagcacugag

SEQ ID NO: 199636 - RNA, 58 nt, Human
acguuuacaggaaggugugccccagaggaggaggaaucagcucccucgcuccaguggc

SEQ ID NO: 199637 - RNA, 58 nt, Human
gagcacugaaagaaacacaaagccagccaggaggaacaguaacucuuccuucgggugg

SEQ ID NO: 199638 - RNA, 58 nt, Human
cuucagaguucagaauuuucagauacuaaggaggaagaaaggauccacuacuucuugu

SEQ ID NO: 199639 - RNA, 58 nt, Human
augugugcgugagcuggucaguugccaaaggaggaaauaagguuagaagccugaaccg

SEQ ID NO: 199640 - RNA, 58 nt, Human
uguuuacauuggaauaaaaagcucuauaaggaggaaaggccuuuaucuaauucuuauc

SEQ ID NO: 199641 - RNA, 58 nt, Human
caggagagaggugagaacuauuuuuagaaggaggaaaaguagauacgcaaauugucac

SEQ ID NO: 199642 - RNA, 58 nt, Human
aguuuuccaggaggccggggggagcaggaggaggaaagguagcccccgagggaugucc

SEQ ID NO: 199643 - RNA, 58 nt, Human
accccaugggcccacacccaggugggggaggaggaagccacugcaucuguuggcucag

SEQ ID NO: 199644 - RNA, 58 nt, Human
cucaagcaguuuuucugaguaguuucugaggaggaacaaauuacaaguguacccaaua

SEQ ID NO: 199645 - RNA, 58 nt, Human
cgugaccagagagugcauuuacagaacgaggaggaagaggugaguccugggaaggaga

SEQ ID NO: 199646 - RNA, 58 nt, Human
gcaggcggccuauccugauccuuggaggaggaggaagaggaggccacuguggcccgug

SEQ ID NO: 199647 - RNA, 58 nt, Human
gguaauuugagagaaauaugaagaacugaggaggaaaaaaaaaaaaaagaaaagaacc

SEQ ID NO: 199648 - RNA, 58 nt, Human
cucucccaacccuggggccuagcuguauaggaggaauugccuaaggguggcccacucu

SEQ ID NO: 199649 - RNA, 58 nt, Human
aacacucaccuggcuggcuuugccuuccaggaggaagcuggcugaagcaagggugugg

SEQ ID NO: 199650 - RNA, 58 nt, Human
gggaugcuucgcggucuguuaucgcgucaggaggaaagaauugcuccaaaaaucugca

SEQ ID NO: 199651 - RNA, 58 nt, Human
aagcccaguucagcuuggggacaggggcaggaggaagggguaggauuacuaggugccc

SEQ ID NO: 199652 - RNA, 58 nt, Human
agcuuugaccuugaagggcuucugggagaggaggaauuucugcauggggcgugaaggc

SEQ ID NO: 199653 - RNA, 58 nt, Human
aaaaaagaauaguaauaucagaacaggaaggaggaauggcuugcuggggagcccaucc

SEQ ID NO: 199654 - RNA, 58 nt, Human
uuugaaggaaguuaaaagguggcuuugaaggaggaagacaccuugagccaaggaauga

SEQ ID NO: 199655 - RNA, 58 nt, Human
gugacuaaaauaagguuuacucugaaagaggaggaauuuuauucaaagcauucaaaca

SEQ ID NO: 199656 - RNA, 58 nt, Human
agaagggcugccaaaugagguuugcugcaggaggaaaguuuaaucccccauuccaaaa

SEQ ID NO: 199657 - RNA, 58 nt, Human
guuuuccuuucacuggacaaucuugaauaggaggaacgcuguugcuguaauaugcgua

SEQ ID NO: 199658 - RNA, 58 nt, Human
ccucaguccuuuagguuaaagcagcgccaggaggaagcugacagaagcagcguuccug

SEQ ID NO: 199659 - RNA, 58 nt, Human
cgcccggcccaagagaauaggggagccaaggaggaaauguggaaacgcaguugugugg

SEQ ID NO: 199660 - RNA, 58 nt, Human
cucucccugccccucaccccagagggugaggaggaaugaggggcauuggugguuaggc

SEQ ID NO: 199661 - RNA, 58 nt, Human
cacagguugccaagaggugacacgaaacaggaggaaacucagugaccucugccucucc

SEQ ID NO: 199662 - RNA, 58 nt, Human
aggggaaggagaagagggagaauggagcaggaggaaaagcagaguuggucuagagagg

SEQ ID NO: 199663 - RNA, 58 nt, Human
gauucuucuuccuugguaucauauucaaaggaggaaagaauggaugacacuuagggac

SEQ ID NO: 199664 - RNA, 58 nt, Human
uugaacaucauaucauauaggauaacaaaggaggaaguuaacuuaauucaccucagac

SEQ ID NO: 199665 - RNA, 58 nt, Human
ugaagaggucugacaccauguguggaggaggaggaacgaucagucaagagauguccug

SEQ ID NO: 199666 - RNA, 58 nt, Human
uucuucuaaagcaaagucauuggaugggaggaggaagaaaaagucccauaaaggaacu

SEQ ID NO: 199667 - RNA, 58 nt, Human
auguacacccauuauguuuucagguaacaggaggaaaaaugcagcacaauuuuuuuuc

SEQ ID NO: 199668 - RNA, 58 nt, Human
gguauuauaguuuguauauuuaacaguaaggaggaaacuguaaccaaaauuaguauuu

SEQ ID NO: 199669 - RNA, 58 nt, Human
uugugaauccuucuguuuuuucuucuuaaggaggaaaguuaaaggacacuacagguca

SEQ ID NO: 199670 - RNA, 58 nt, Human
guuuaauauugccaucggguauugagacaggaggaaguuucuguuuuucuccauuuag

SEQ ID NO: 199671 - RNA, 58 nt, Human
aaccccgagccauuucccuguuguccugaggaggaacuccaggccucccaucgugugc

SEQ ID NO: 199672 - RNA, 58 nt, Human
uugaugcaggucugcaggacugaccccaaggaggaacgugggcacaagagguauauca

SEQ ID NO: 199673 - RNA, 58 nt, Human
cacuuccuccucuuucuuuccccagcugaggaggaaccuggggcauuuagggcagagg

SEQ ID NO: 199674 - RNA, 58 nt, Human
caaaaauuuuggucacuuccaagcuagaaggaggaaucagauacccuuuaauauuuuu

SEQ ID NO: 199675 - RNA, 58 nt, Human
ccagaccccuacagcugugucuaagcucaggaggaaagggacccucccaucauucaug

SEQ ID NO: 199676 - RNA, 58 nt, Human
ugggcaagagacuuccucugguuuccucaggaggaaaugggcaaggcagaguaagcag

SEQ ID NO: 199677 - RNA, 58 nt, Human
cccgugagcgucaggaugaggaaaugacaggaggaagacguggguuuggguuaguggc

SEQ ID NO: 199678 - RNA, 58 nt, Human
aucuugagaagcaggcggguugggugggaggaggaagaaagggaagaauuagguuuga

SEQ ID NO: 199679 - RNA, 58 nt, Human
ccacugagaagcaggcggguugggugggaggaggaagaaagggaagaauuagguuuga

SEQ ID NO: 199680 - RNA, 58 nt, Human
ggcaucuacuggagcaccucagaagacaaggaggaaaacacuggcucauguuuucuuu

SEQ ID NO: 199681 - RNA, 58 nt, Human
aauauuucuaagcuuauuucuaacuauuaggaggaaugugcuuuuccaucuaaaauac

SEQ ID NO: 199682 - RNA, 58 nt, Human
ucagcaguggcagguguuuucagcuuggaggaggaaguacugcuaucucgcauucuuc

SEQ ID NO: 199683 - RNA, 58 nt, Human
caggggaggccuggcugcagagaggcggaggaggaagcuggcgcugggggaggcugag

SEQ ID NO: 199684 - RNA, 58 nt, Human
uuguguauuugucuguguuaaugcugucaggaggaacugacuaagauguuuuaauaug

SEQ ID NO: 199685 - RNA, 58 nt, Human
aauuuuaaugaacgaaugaaugacagagaggaggaaaaaagaugaggauugcauacau

SEQ ID NO: 199686 - RNA, 58 nt, Human
aguggauugaauaacugagucuacauggaggaggaaaugcuagagaacagcaggucua

SEQ ID NO: 199687 - RNA, 58 nt, Human
gaaaugcgcagccggcuguggacgggggaggaggaaggggacagagggagcagguagg

SEQ ID NO: 199688 - RNA, 58 nt, Human
cgaggauuucugggaccccgcaguugggaggaggaaguaguccagccuuccagguggc

SEQ ID NO: 199689 - RNA, 58 nt, Human
uucucccuggcauucagagaggagggagaggaggaagaggaaggggagggaagcuucc

SEQ ID NO: 199690 - RNA, 58 nt, Human
aaguuuccuccuuucucaaccuuccacgaggaggaaagaagugugcagucauuccaca

SEQ ID NO: 199691 - RNA, 58 nt, Human
acgccugccaaggacgcgacgaccagggaggaggaaucggcggacgcgggacaccuga

SEQ ID NO: 199692 - RNA, 58 nt, Human
ucaguuacauccaucugucaucugaagaaggaggaaaaaacccaacauuucuuggacc

SEQ ID NO: 199693 - RNA, 58 nt, Human
ccccucuguaccccaacucauuuaaaauaggaggaaucacuuuuugccuuacuuaacg

SEQ ID NO: 199694 - RNA, 58 nt, Human
uuucugaaucuagagaacaguauugggcaggaggaaaaggcuuggugucugcgggggg

SEQ ID NO: 199695 - RNA, 58 nt, Human
augccuugauaagugcauucagagcaauaggaggaaaaggaaagcguuuuuguagccc

SEQ ID NO: 199696 - RNA, 58 nt, Human
aucucagucuuggccuggcuaugaggggaggaggaaugggagagggggcucaggggcc

SEQ ID NO: 199697 - RNA, 58 nt, Human
cucucuagagcgagcaagagagggagagaggaggaaaaaauacacauaauacaaacau

SEQ ID NO: 199698 - RNA, 58 nt, Human
auggaccugacagcccaaacugucagagaggaggaaagcaggcauuugauuuugguaa

SEQ ID NO: 199699 - RNA, 58 nt, Human
ucuuugacacccagaagacccggcaacgaggaggaaggccucgcggugaggcagaaac

SEQ ID NO: 199700 - RNA, 58 nt, Human
guccuugcacuguucugacacuuuccccaggaggaaaacaaguacaaagguuacggug

SEQ ID NO: 199701 - RNA, 58 nt, Human
ggggccuuagcaauuugaaggguugggaaggaggaauuauauuugcaaaggggcuguc

SEQ ID NO: 199702 - RNA, 58 nt, Human
cccuuccccuucccucucguggcccacaaggaggaaggaagggcaaccuaaaagccca

SEQ ID NO: 199703 - RNA, 58 nt, Human
accccaaugugugagcugauggauggugaggaggaaggacuuaaggacagcaugucug

SEQ ID NO: 199704 - RNA, 58 nt, Human
uguaaaauguaauuaauauucaaagaaaaggaggaaaaucuucauuuguuggaaauga

SEQ ID NO: 199705 - RNA, 58 nt, Human
agcuuccccgagguuugcagggucagggaggaggaacggugggggugggcagucacug

SEQ ID NO: 199706 - RNA, 58 nt, Human
uaguaguauacacaagagaaaucuuugaaggaggaaacugaugacagauauacagggc

SEQ ID NO: 199707 - RNA, 58 nt, Human
ucguggaggaaguggacucgaauccuggaggaggaaauaaagggaaagggaagucgug

SEQ ID NO: 199708 - RNA, 58 nt, Human
augucucuacucaaacugugccugcaggaggaggaacagagaagccugggcugcuggg

SEQ ID NO: 199709 - RNA, 58 nt, Human
uuguauaaugcaucauuugaaaauaccaaggaggaaauacccuuuguuuuuaaugaug

SEQ ID NO: 199710 - RNA, 58 nt, Human
accccuuuccccaaaagucugaaaguguaggaggaaggaagagauacaaacaaggaga

SEQ ID NO: 199711 - RNA, 58 nt, Human
ggagaggacaggaggaggagccuuccccaggaggaacgaggagagguggccacguggc

SEQ ID NO: 199712 - RNA, 55 nt, Human
acucagagcaacugaacugagacagaggaggaaaacagagcaucagaagccugca

SEQ ID NO: 199713 - RNA, 58 nt, Human
ugaaauacugucuaucucuaauaaaaacaggaggaaacaagaugauggaaucuguuuu

SEQ ID NO: 199714 - RNA, 58 nt, Human
gggaacauguggcacaaguaaugggaugaggaggaauugggggugggggucuucuacc

SEQ ID NO: 199715 - RNA, 58 nt, Human
gggauguuuggaaaaaacucugaaggagaggaggaauuaguugggaugccaauuuccu

SEQ ID NO: 199716 - RNA, 58 nt, Human
cagcuggcagugcaaugcuuguagaaguaggaggaaacaguucucacugggaagaagc

SEQ ID NO: 199717 - RNA, 58 nt, Human
ggagauuaagaagaaaacgacuuucugcaggaggaagagcccgcugccgaaucccugg

SEQ ID NO: 199718 - RNA, 58 nt, Human
gcccuguucugggggagcaggguaaggcaggaggaagugggugagcuccgagaugaug

SEQ ID NO: 199719 - RNA, 58 nt, Human
gugcccaacccuaacaauuauuuuuaaaaggaggaauuuaaaugagcuguggauuauu

SEQ ID NO: 199720 - RNA, 58 nt, Human
aaaggugcauuucaagaacuuggggggcaggaggaaagcacaauguuucuuagccagg

SEQ ID NO: 199721 - RNA, 58 nt, Human
agacccccuguguggccugaguccccucaggaggaagguggacaacagagaaaugaga

SEQ ID NO: 199722 - RNA, 58 nt, Human
guccuaauuguuggagcucaguaaagguaggaggaagguggcugguugguccucccuu

SEQ ID NO: 199723 - RNA, 58 nt, Human
acuugaaggugucaugcccggugugugcaggaggaaacuaacaguucaguaaacucug

SEQ ID NO: 199724 - RNA, 58 nt, Human
caccacauuugugugcagauaccaaaagaggaggaaagaagaaaaaaauuaaugugug

SEQ ID NO: 199725 - RNA, 58 nt, Human
aaggaaauaaaaugcacauaaauuuggaaggaggaaauacaacugucuuuguucucaa

SEQ ID NO: 199726 - RNA, 58 nt, Human
caaaucauucuucaacuacauuuuagaaaggaggaaaucuaaaauaagguaagggagg

SEQ ID NO: 199727 - RNA, 58 nt, Human
aucagaggugaagggacagagagaggagaggaggaagauugagcugggggcaacagcc

SEQ ID NO: 199728 - RNA, 58 nt, Human
gacugauucaaucugcaugccagccuggaggaggaaagggagccugcucucccucccc

SEQ ID NO: 199729 - RNA, 58 nt, Human
aagagcaugauuuuaaaaaaucaaucauaggaggaaaagaaauucgcuuuucaaguag

SEQ ID NO: 199730 - RNA, 51 nt, Human
aacgccauguguggaacuaggaggaggaauauuccaucuuggcagaaacca

SEQ ID NO: 199731 - RNA, 58 nt, Human
ggagaagccagaggcccuggccaaagauaggaggaagaaagagaacucuccauagaau

SEQ ID NO: 199732 - RNA, 58 nt, Human
gcccuccccuuucuccaucccuccagcuaggaggaaauggagcaagaugaacaggcag

SEQ ID NO: 199733 - RNA, 58 nt, Human
ccucucugugcucaaggaguuccauuccaggaggaagagaucuauacccuaagcagau

SEQ ID NO: 199734 - RNA, 58 nt, Human
uaaaugccucaugccccaguucagcaaaaggaggaaaaugugccugccucacagucau

SEQ ID NO: 199735 - RNA, 58 nt, Human
uggaugguucugcuuagaaugagugucaaggaggaaagagagggagauggaggaugug

SEQ ID NO: 199736 - RNA, 58 nt, Human
agagaaaagagaccauguuuauuuggguaggaggaagccuugccuugcgccuuaggug

SEQ ID NO: 199737 - RNA, 58 nt, Human
aucguaugauagaaagacauucuuccccaggaggaauguuuaaaauggaggcaacauu

SEQ ID NO: 199738 - RNA, 58 nt, Human
gugguauuacuguuggucaaaaaucaugaggaggaacaguugaauccagccugaacgu

SEQ ID NO: 199739 - RNA, 58 nt, Human
ugaaaaccauggagauuauuuuuauuggaggaggaagcaucauucaugaaccgaucuu

SEQ ID NO: 199740 - RNA, 58 nt, Human
uuugacuuuuucuucguugaggcuucugaggaggaaaaacaaaccuaaaauagaaaua

SEQ ID NO: 199741 - RNA, 58 nt, Human
gcuccuugcucugacgcaggccuccuggaggaggaaguggaggccgcugcguagaccc

SEQ ID NO: 199742 - RNA, 58 nt, Human
cuggaaggacuucuugcuggugaagagcaggaggaacaucaccauggugucauauccu

SEQ ID NO: 199743 - RNA, 58 nt, Human
gaccuuaacaaggacggcugcaucaccaaggaggaaaugcuugacaucaugaagucca

SEQ ID NO: 199744 - RNA, 58 nt, Human
cuggacuggggguugguguuuucuauagaggaggaaaggcccucccucacccugcucc

SEQ ID NO: 199745 - RNA, 58 nt, Human
gcuggacgggaacacacguguguggcucaggaggaaaagcucagccuggacuguggca

SEQ ID NO: 199746 - RNA, 58 nt, Human
uuuggggaccauugccaaagguggacucaggaggaaagacacuuaaagacacuuuuac

SEQ ID NO: 199747 - RNA, 58 nt, Human
uggcaacuuugaaugcuaggugaaaucuaggaggaaggcauacuuggcaaaccacaug

SEQ ID NO: 199748 - RNA, 58 nt, Human
ccuguacagauugaaauuucaccuuguaaggaggaagugaaugaaauaaaggaucccc

SEQ ID NO: 199749 - RNA, 58 nt, Human
ucucucuuuguggacuuguaccuggagcaggaggaacuccaguccgucccggcaucca

SEQ ID NO: 199750 - RNA, 58 nt, Human
cuucugcccaugucugggaacacacgccaggaggaaugucugauacccucugcaucaa

SEQ ID NO: 199751 - RNA, 58 nt, Human
gagacuucuucuguucucuggagaaggcaggaggaaagcaaagaccuccauuuccaga

SEQ ID NO: 199752 - RNA, 58 nt, Human
ggagacggggccugggcucccgggcccgaggaggaaaaggauugccaaggcuccaggg

SEQ ID NO: 199753 - RNA, 58 nt, Human
caagagaaacaucauuuuagcaaaggccaggaggaaaaauagaaauaaauuugucuug

SEQ ID NO: 199754 - RNA, 58 nt, Human
uaaucucagcaauuugggaggccaaggaaggaggaaugcuugagcccaagaguuuuag

SEQ ID NO: 199755 - RNA, 58 nt, Human
uuugcuugucccaauacaagaaugccaaaggaggaaacaggaaaaauugccguccauu

SEQ ID NO: 199756 - RNA, 58 nt, Human
aaacacugaggacuccaaaaggggggcaaggaggaagaggggcagggguuaaaaagcu

SEQ ID NO: 199757 - RNA, 58 nt, Human
aggccacucgagcaucagagcuuccagcaggaggaagggcuguaggaauggaagcuuc

SEQ ID NO: 199758 - RNA, 58 nt, Human
gcagaaguuggguagagagguuaagaagaggaggaagugagacggggaagggaggagc

SEQ ID NO: 199759 - RNA, 58 nt, Human
uugggauuuggaacuuucuguaucucuuaggaggaacaaguaaaaaccaaaugguuac

SEQ ID NO: 199760 - RNA, 58 nt, Human
uugcucuccaaagcacuuuuggauacucaggaggaaagauaagauacauguuugaagu

SEQ ID NO: 199761 - RNA, 58 nt, Human
aaaaaaaaaaagccugaagagaugagauaggaggaaagaccucacagccagaucugcu

SEQ ID NO: 199762 - RNA, 58 nt, Human
uucacuguauagccaguucauucagaaaaggaggaaaggguaguuuaauuucaaaaaa

SEQ ID NO: 199763 - RNA, 58 nt, Human
gaugcaggaaggaggugcagacggaaggaggaggaaggaaggacggaagcaaggaagg

SEQ ID NO: 199764 - RNA, 58 nt, Human
ggggaggggugguacuuggcaccaauaaaggaggaaucagacccagacgcugggaguu

SEQ ID NO: 199765 - RNA, 58 nt, Human
caagugggucuucuguggaagaugcagaaggaggaaguuagugcuuacauuuuagucu

SEQ ID NO: 199766 - RNA, 58 nt, Human
gcccucccucgggugcugcuggccucaaaggaggaacucguggggggagggugugauu

SEQ ID NO: 199767 - RNA, 58 nt, Human
ucauccuccuggacccagcaggggcagaaggaggaagggacugguccaggcauggguc

SEQ ID NO: 199768 - RNA, 58 nt, Human
cuccauccccauguguuucagguggaacaggaggaacugguccaggccaggccucauc

SEQ ID NO: 199769 - RNA, 58 nt, Human
accugggaauacaggguucagagaggagaggaggaagauggugacaugauuugguuag

SEQ ID NO: 199770 - RNA, 58 nt, Human
agaccauuguaagugguggggcugggagaggaggaacagaaggaaagccauagcgcuc

SEQ ID NO: 199771 - RNA, 58 nt, Human
ggucccuucucagcguuccagucacuucaggaggaauuuaguuauugacuuagucuau

SEQ ID NO: 199772 - RNA, 58 nt, Human
agagcugcuggcugcaucagggaacaggaggaggaagagggucaggguggagaggaag

SEQ ID NO: 199773 - RNA, 58 nt, Human
acccucaguuaagcauguuaacauuuauaggaggaaaaaaaucacuuugggagaaaau

SEQ ID NO: 199774 - RNA, 58 nt, Human
aaguucuauuuuuguaaagacugcaaaaaggaggaaaaaaaaccuucaaaaacgcccc

SEQ ID NO: 199775 - RNA, 58 nt, Human
agcaaugaagaacccuugugaaguaaccaggaggaauggggaaagaagcaaguugggc

SEQ ID NO: 199776 - RNA, 58 nt, Human
agacacugggagaagagaaccucaaacuaggaggaaaagacagagccuccacuuaguu

SEQ ID NO: 199777 - RNA, 58 nt, Human
acagccacccugcccagucuggaagaagaggaggaagacucuggagccaaggcagagg

SEQ ID NO: 199778 - RNA, 58 nt, Human
cuacaggucuccggccacccacacaaggaggaggaagaggaaauggugacccaagugu

SEQ ID NO: 199779 - RNA, 58 nt, Human
auauuacucugcuuugugcacuuuauggaggaggaagcuagaggaaaaauggaaaugc

SEQ ID NO: 199780 - RNA, 58 nt, Human
guucagcuccguaagguggcggcaccugaggaggaagcagccaggaguggcuggggaa

SEQ ID NO: 199781 - RNA, 58 nt, Human
ggugccagggaaguugugggcaccugagaggaggaacagauguggaggaccugagggu

SEQ ID NO: 199782 - RNA, 58 nt, Human
aagaccccuucucagccccaaaaccugaaggaggaauuucgcccuacucuggccccuu

SEQ ID NO: 199783 - RNA, 58 nt, Human
agucucaaagcacaaggagguucagcccaggaggaagccagcugcaauguggagacac

SEQ ID NO: 199784 - RNA, 58 nt, Human
uuucauacauauaugcgugccuaguucuaggaggaaacggguuaaaaauuguuuuaaa

SEQ ID NO: 199785 - RNA, 58 nt, Human
auaccacuggugugugugggagggagggaggaggaauacuagcccuuuuuauauauuu

SEQ ID NO: 199786 - RNA, 58 nt, Human
caaaauuuugucuauauauauuugugugaggaggaaauucauaacuuuccucagauuu

SEQ ID NO: 199787 - RNA, 58 nt, Human
cagauugauccguuugauuuuuauuuccaggaggaagacuagugguggauuccaugac

SEQ ID NO: 199788 - RNA, 58 nt, Human
ugggaggaagcuugaguuugaugcagggaggaggaaggcugaggaaugacuuggcucc

SEQ ID NO: 199789 - RNA, 58 nt, Human
ccuuauuuuggaaguuuugaauuggccuaggaggaaacccagaaaugaaccaggggua

SEQ ID NO: 199790 - RNA, 58 nt, Human
aggacauccuugucuuguucaugaucuuaggaggaaagcauugucuuucaucuuuaag

SEQ ID NO: 199791 - RNA, 58 nt, Human
ucuuuugucccaguuugggaugaaggaaaggaggaagaggcgguggcuguguggcccc

SEQ ID NO: 199792 - RNA, 58 nt, Human
acuguugaaguccuggaagggagaucgaaggaggaagauugacuugguucuuucuuag

SEQ ID NO: 199793 - RNA, 58 nt, Human
aaaugccacuagcaccugagugugguacaggaggaauguuugguugggagaaucacag

SEQ ID NO: 199794 - RNA, 58 nt, Human
agaacuggagaaagggaaccacagagccaggaggaaugucugagcagagucaagcaac

SEQ ID NO: 199795 - RNA, 58 nt, Human
ugcuacagagugucuggguguguggcauaggaggaagguuugcuugugaaaugaggcu

SEQ ID NO: 199796 - RNA, 58 nt, Human
cauuuagcccaggucuuaauucuccaagaggaggaauacauaguaugguaaggcaagg

SEQ ID NO: 199797 - RNA, 58 nt, Human
cgaguucauggggaucugggggguggggaggaggaagccguugaaucugggagggaag

SEQ ID NO: 199798 - RNA, 58 nt, Human
gcucuguggaauucagugacaaaaugggaggaggaaagagaguuuguaaggucaugcu

SEQ ID NO: 199799 - RNA, 58 nt, Human
ucugccaccaucagggacaaacgggggcaggaggaaagucacugaugcccagauguuu

SEQ ID NO: 199800 - RNA, 58 nt, Human
agcaacucgagagcugggaaacucaaggaggaggaagaaaaucaaaaccacccuacuc

SEQ ID NO: 199801 - RNA, 58 nt, Human
agagaugcauucacagggguuggcugggaggaggaagaccauucugugaccaaaauac

SEQ ID NO: 199802 - RNA, 58 nt, Human
caagaugagaaaguccucaagugaggggaggaggaagcagauagaugguccagcaggc

SEQ ID NO: 199803 - RNA, 58 nt, Human
cugaauagguuccagagacuuuuggcccaggaggaauauuuacuuuuagcucuggaca

SEQ ID NO: 199804 - RNA, 58 nt, Human
guaaggccaauguuaacaacacguuuagaggaggaaaaguucaaccucaaguuaaaug

SEQ ID NO: 199805 - RNA, 58 nt, Human
accaugcaggaacagacuuuugguggugaggaggaagaacaaauaauagaagaaaaua

SEQ ID NO: 199806 - RNA, 58 nt, Human
ccuuguguauggaauugcacccguguaaaggaggaaauggucagugugcaugaaaucc

SEQ ID NO: 199807 - RNA, 58 nt, Human
cuaagguuuucaccuuaacugugaaggcaggaggaauaggugacugcuuccucccgcc

SEQ ID NO: 199808 - RNA, 58 nt, Human
cagcugcaagaccguguaaaugagcuccaggaggaagcccaggaggcugaugccugcc

SEQ ID NO: 199809 - RNA, 58 nt, Human
uugacuucauauucuagaauacuugauuaggaggaagauacaaccaugaugacuuuuu

SEQ ID NO: 199810 - RNA, 58 nt, Human
ggcacgaacccaccugcugagagacccaaggaggaaaaacagacaaaaacagccucac

SEQ ID NO: 199811 - RNA, 58 nt, Human
gcagcugagcaggugucacaagcuguaaaggaggaagggagucugcaggcccuucaca

SEQ ID NO: 199812 - RNA, 58 nt, Human
ccguguuagagcaaagugaagaguuuaaaggaggaagaagaaagaacugucuuacacc

SEQ ID NO: 199813 - RNA, 58 nt, Human
ucaguuugauucaguucuuaccucugucaggaggaauacaguuccuguucauccugug

SEQ ID NO: 199814 - RNA, 58 nt, Human
gucaguggcuggaacaaaguucugguuaaggaggaaauuagugccacccacggugaga

SEQ ID NO: 199815 - RNA, 58 nt, Human
gucuucaaaauuuuaaucugauuuauccaggaggaaggcuguacaguaaaacguaaga

SEQ ID NO: 199816 - RNA, 58 nt, Human
cccuccuauccccaccuacuccugggucaggaggaaaagacuaacaggagaaugcaca

SEQ ID NO: 199817 - RNA, 58 nt, Human
aggcuaauugguggugagacagcaggggaggaggaagagcugugguuuguaacuuguu

SEQ ID NO: 199818 - RNA, 58 nt, Human
auggaacuaccauuuccuccucauaugcaggaggaacaacaucaaagggaacucucuc

SEQ ID NO: 199819 - RNA, 58 nt, Human
ccuucgcgccuccgcguccacccagcccaggaggaagacugcucugagcgugcggccu

SEQ ID NO: 199820 - RNA, 58 nt, Human
aauucuauccacagucaaaaaucccccaaggaggaaagcugaaagaugcacugccaua

SEQ ID NO: 199821 - RNA, 58 nt, Human
uuucccccuuaaaucacagaaaacauucaggaggaauacuguugcagcugaaauuggu

SEQ ID NO: 199822 - RNA, 58 nt, Human
ucccugugcuguccccaugcuguguuggaggaggaaguggcucuccuuccaccaacaa

SEQ ID NO: 199823 - RNA, 58 nt, Human
ggagaucugcaaauggagggaggggugaaggaggaaucuuaagaccgagggagaagag

SEQ ID NO: 199824 - RNA, 58 nt, Human
uaaccacacucauuccuuucaaacacagaggaggaauuauugcuucaucugacuuuau

SEQ ID NO: 199825 - RNA, 58 nt, Human
uauaccgcaguggcucuagguggaggaaaggaggaaaaagugcuuauuaugugcaaca

SEQ ID NO: 199826 - RNA, 58 nt, Human
ggaagcccagaucaccaggcuucuauuaaggaggaaagcaacagaggaaacagugaag

SEQ ID NO: 199827 - RNA, 58 nt, Human
ucaaauauauucacaaugguaauaagguaggaggaaucugagacgauugcauugucua

SEQ ID NO: 199828 - RNA, 58 nt, Human
ucaguuguugagucuuaaugagggauacaggaggaaaaaucccuacuagaguccugug

SEQ ID NO: 199829 - RNA, 58 nt, Human
ccaacugugaaagcuggcuuuaauuuuuaggaggaaaagaaaagccugcauguguucu

SEQ ID NO: 199830 - RNA, 58 nt, Human
cuuggaaagagcuuuuuccuucucuacaaggaggaaucugaugcaacugacauccuca

SEQ ID NO: 199831 - RNA, 58 nt, Human
cugcgccacaguuugguccagaggagggaggaggaagggaagaccccaguggugggac

SEQ ID NO: 199832 - RNA, 58 nt, Human
acuaaucauacucugaugccugaacuugaggaggaaaauacauguauauuuuuguucc

SEQ ID NO: 199833 - RNA, 58 nt, Human
cagugagaggagauaaauauccuuuuucaggaggaacugauaucucuggcuaaauauu

SEQ ID NO: 199834 - RNA, 58 nt, Human
gaguccucuagcaggccuaagacaugugaggaggaaaaggaaaaaaagcaaaaagcaa

SEQ ID NO: 199835 - RNA, 58 nt, Human
uuccauuugcauuuguuuauguaauuucaggaggaauacugaacaucugaguccugga

SEQ ID NO: 199836 - RNA, 57 nt, Human
acgugaccacaagauugugauacuugaaggaggaagcguuuaccauacacauacgua

SEQ ID NO: 199837 - RNA, 58 nt, Human
ggacucgccucucuccucuccuccccccaggaggaacuugaaaggaggguaaaaagac

SEQ ID NO: 199838 - RNA, 58 nt, Human
ggcuuggaggaaaugguacugcccaaauaggaggaaaacacagccucccugagccugc

SEQ ID NO: 199839 - RNA, 58 nt, Human
aacuauuuguaccguaggacagaaugugaggaggaaguaacacacagaggaggaugug

SEQ ID NO: 199840 - RNA, 58 nt, Human
aggucuuauucaaagcccucauugacagaggaggaaacaggccaaggcaggacauggc

SEQ ID NO: 199841 - RNA, 58 nt, Human
uacuagucuuuugacauggaugauucugaggaggaagcuguuauugaauguauagaga

SEQ ID NO: 199842 - RNA, 58 nt, Human
uuucacgguaaaauuauguugguuugaaaggaggaaauagcaagguuaagauguguga

SEQ ID NO: 199843 - RNA, 58 nt, Human
cgcaaugagagaagcagcaguggguacaaggaggaagaaaaagggcuugcagagagug

SEQ ID NO: 199844 - RNA, 58 nt, Human
agggaagauuucuguauacuugcuggagaggaggaauguguauaguuacucauuuaga

SEQ ID NO: 199845 - RNA, 58 nt, Human
guggugugguuggugaacagugcaugccaggaggaagcagucccuccucaccagcucu

SEQ ID NO: 199846 - RNA, 58 nt, Human
gugaccaugggcugggaggagguggaggaggaggaagaggagaaggaaaagugacgaa

SEQ ID NO: 199847 - RNA, 58 nt, Human
uuuuuugugaaacucagaucagccacccaggaggaagagcgggcugaggaaacccaga

SEQ ID NO: 199848 - RNA, 58 nt, Human
acccugugugggaaaugcugaaagcaccaggaggaagccgguucccgugagauaaguu

SEQ ID NO: 199849 - RNA, 58 nt, Human
ugcccuuuagggccuccugaguuucaaaaggaggaaguguucgugcuugugucccuga

SEQ ID NO: 199850 - RNA, 58 nt, Human
auccggugcuaaaacauuacaguugccaaggaggaaaauacugaaugacugcuaagaa

SEQ ID NO: 199851 - RNA, 58 nt, Human
aggacccuaggaugccauucuugccaggaggaggaaugagagugauguuggccaacau

SEQ ID NO: 199852 - RNA, 58 nt, Human
uaaggagacuccuggaagcugaauggagaggaggaagaaaaugaagaaggagugauug

SEQ ID NO: 199853 - RNA, 58 nt, Human
ucaggguugggcgcgggaagaaaaggagaggaggaagcugaggcaacuuugggauucu

SEQ ID NO: 199854 - RNA, 58 nt, Human
uuuguccccauuccccuacuccugagcuaggaggaaaaaaugugaaucuuaccagcag

SEQ ID NO: 199855 - RNA, 58 nt, Human
ucuucucaugugccagauguuaagaugaaggaggaauacaacacauacucaagccuca

SEQ ID NO: 199856 - RNA, 58 nt, Human
uucauuccuugguucugaaacucuguggaggaggaagaugggagcugaugagaaucaa

SEQ ID NO: 199857 - RNA, 58 nt, Human
gaacagcgugagcugguggaucaugacaaggaggaaaaauguccccccaggcauuucu

SEQ ID NO: 199858 - RNA, 58 nt, Human
uaugaguaaaguuaccccaaccacagugaggaggaagauguucacauacuggaacugu

SEQ ID NO: 199859 - RNA, 58 nt, Human
gugaggggacgagaugggguucaugugaaggaggaagcgaugccgagguaggaaaggc

SEQ ID NO: 199860 - RNA, 58 nt, Human
gugaaggcacauaaagcaauugaggaggaggaggaaccccucgucccccuaggagcag

SEQ ID NO: 199861 - RNA, 58 nt, Human
auagagaguaguuagaugcuguuaaaagaggaggaaacuacuugaggagggacccaac

SEQ ID NO: 199862 - RNA, 58 nt, Human
ccgauggaaacagauugaugcagauggaaggaggaagggagacugggcccacugauuu

SEQ ID NO: 199863 - RNA, 58 nt, Human
augggacugcccauuuccucagcugcagaggaggaaagggaaaggguaggccuguaga

SEQ ID NO: 199864 - RNA, 58 nt, Human
acauucaugauuagggucucagaagguaaggaggaagagaguggaauggaaaaaguau

SEQ ID NO: 199865 - RNA, 58 nt, Human
uguuuuuuaaagcaaugugaguccacugaggaggaagagacccugggauuucacccuc

SEQ ID NO: 199866 - RNA, 58 nt, Human
ucucaucaggagcaucuggggugccuguaggaggaaggccacagggcauggaucagcc

SEQ ID NO: 199867 - RNA, 58 nt, Human
cccuacacccuguccaacaugaccuacaaggaggaagacuucgagcgccugcugcggc

SEQ ID NO: 199868 - RNA, 58 nt, Human
agcggggagggacugauuuuuauaggaaaggaggaaaaauaauggaaacacaucucau

SEQ ID NO: 199869 - RNA, 58 nt, Human
aagaggcuggggguaaggccaagaagguaggaggaaaauggcagaccugggcuggaga

SEQ ID NO: 199870 - RNA, 58 nt, Human
ucauuuccccaagcauaacugcaaggagaggaggaauuccuaggagccaaagaguuuu

SEQ ID NO: 199871 - RNA, 58 nt, Human
uugacagaguggcccaggguuucaagggaggaggaaccucccccuaccuaggacccuu

SEQ ID NO: 199872 - RNA, 58 nt, Human
cauguggccccacccaaucaagggaagaaggaggaaugcuggacuggaggccccugga

SEQ ID NO: 199873 - RNA, 58 nt, Human
cucuuggccaaagguuuuugcggggaggaggaggaaaccagcuuucugguuaagguua

SEQ ID NO: 199874 - RNA, 58 nt, Human
agugaccccuucugggugccaacuacugaggaggaauacuugcacuuuggggagaagg

SEQ ID NO: 199875 - RNA, 58 nt, Human
ggagcaagugaucuggcaaaagagggacaggaggaaaaugaaaccuguucugguggaa

SEQ ID NO: 199876 - RNA, 58 nt, Human
ggcacacuuccccaagggcggacccagcaggaggaagcccaggagcuggguccugccg

SEQ ID NO: 199877 - RNA, 58 nt, Human
gcgaggagccccucggaggagccuccagaggaggaaauccccaaggaggaugggaucu

SEQ ID NO: 199878 - RNA, 58 nt, Human
cugucucccuucaugggccucccagggaaggaggaagcccugcugugcagacaccucu

SEQ ID NO: 199879 - RNA, 58 nt, Human
guggggcauaagacaccgggaaugagggaggaggaagacaguuguguuuucucuuuaa

SEQ ID NO: 199880 - RNA, 58 nt, Human
aggcuucuguggcaggacuggcccagggaggaggaagccagcagcacaccuggggaau

SEQ ID NO: 199881 - RNA, 58 nt, Human
agggcuagaagcacaggcccgucaccccaggaggaaaagcccagggucuggggcagca

SEQ ID NO: 199882 - RNA, 58 nt, Human
cugccggcuagucccaagcaaacgggcuaggaggaaagauuaaaaaaacaacaacaac

SEQ ID NO: 199883 - RNA, 58 nt, Human
cuaccaaccaaggagccuccagaaggaaaggaggaagaaauguuuucuuaggggaauu

SEQ ID NO: 199884 - RNA, 58 nt, Human
ugugaggcgugggugugagccaggcugcaggaggaacugggccuccgcuucccagcaa

SEQ ID NO: 199885 - RNA, 58 nt, Human
cuggccaucugagccugccuggaggagaaggaggaacccccaugccaauguccagguc

SEQ ID NO: 199886 - RNA, 58 nt, Human
ugcgccuacugagugacccauuuccuccaggaggaaaggcaagacacgcuuacacggc

SEQ ID NO: 199887 - RNA, 58 nt, Human
gcagauuuaauuugcuaaauagacuaacaggaggaaaaaaacaaacagccuagcuuua

SEQ ID NO: 199888 - RNA, 58 nt, Human
aagugcacauuaaaaaggaaaguuugccaggaggaacaaagagauugugguggugcua

SEQ ID NO: 199889 - RNA, 58 nt, Human
ugaacaccagcugugaaggccuugggagaggaggaacaggcccuugggcagaugcagg

SEQ ID NO: 199890 - RNA, 58 nt, Human
caucagucuugcaaggacauugaauauuaggaggaaaaagucauggaaaaaauaaagc

SEQ ID NO: 199891 - RNA, 58 nt, Human
gcaggaacaggaagugacgggaaccuugaggaggaaacgccuguguuagggagagagu

SEQ ID NO: 199892 - RNA, 58 nt, Human
cugaagcugugauauuuccaacgacuguaggaggaaaaauuaaggggagagaggaaaa

SEQ ID NO: 199893 - RNA, 58 nt, Human
uguacugaugacacaccauggauuucagaggaggaaguacggagucguugcauaaucc

SEQ ID NO: 199894 - RNA, 58 nt, Human
acugccgggaauggacacuggaagugccaggaggaaggaaggcugguuugguggggua

SEQ ID NO: 199895 - RNA, 58 nt, Human
agaguuauugaaaaugcagaugguucugaggaggaaacggacacucgagacgcagacu

SEQ ID NO: 199896 - RNA, 58 nt, Human
gcaaaccgguuaaucaagaauuuggucaaggaggaacaagaaaaaucggagaaggugu

SEQ ID NO: 199897 - RNA, 58 nt, Human
uuguagagguccuggcggcugauucuagaggaggaagaggcucugugagaugaauagg

SEQ ID NO: 199898 - RNA, 58 nt, Human
acuggacugcuuggggugggggacgaucaggaggaagugagcagucgccugccugcag

SEQ ID NO: 199899 - RNA, 58 nt, Human
gccaagggacagugccauccuuggggacaggaggaaaagcagccugucucugcuaagg

SEQ ID NO: 199900 - RNA, 58 nt, Human
ugaagggcuggaccugacccauggaggcaggaggaagaccuggcuuucuugguuuguc

SEQ ID NO: 199901 - RNA, 58 nt, Human
caccuguggagaggacuggcugcccuggaggaggaaagggaggaagucuacacagagg

SEQ ID NO: 199902 - RNA, 58 nt, Human
agcuuuuucuccgucucccacaacaucgaggaggaagaauucaaugacuaugaggcca

SEQ ID NO: 199903 - RNA, 58 nt, Human
acuugaaucugucccucgugacaauuauaggaggaagguauuuaaaaccccagauuua

SEQ ID NO: 199904 - RNA, 58 nt, Human
aagacuuaucagggcccuagaaagugcuaggaggaagggguuaaaaaaaaaauuuguc

SEQ ID NO: 199905 - RNA, 58 nt, Human
cccgacagaauggggcugaaucagcuccaggaggaaccaggcccugcucuccugugua

SEQ ID NO: 199906 - RNA, 58 nt, Human
ggagucagugacuauggcccccacguucaggaggaaggugugaugccgucauacaguu

SEQ ID NO: 199907 - RNA, 58 nt, Human
ggcuccuagcaagcaggaaguuaagagcaggaggaagcguugcuaccuucacuucucc

SEQ ID NO: 199908 - RNA, 58 nt, Human
gaacaauaaaggagaaugguaccgaugcaggaggaagcaagcgugucuuccccugcag

SEQ ID NO: 199909 - RNA, 58 nt, Human
agcacacagcgacuugcguugacaaaggaggaggaaacgauuacucuguaaacaaagu

SEQ ID NO: 199910 - RNA, 58 nt, Human
agaagaagggcgggaagaacuuccuuucaggaggaagcuggaacuuacugacuguaag

SEQ ID NO: 199911 - RNA, 58 nt, Human
cacauugccuucuggagcugggagacaaaggaggaauuuacuuucuucaccaagugca

SEQ ID NO: 199912 - RNA, 58 nt, Human
cucugacacuuggguugggggcccuuccaggaggaaacccccuugggugccccacaca

SEQ ID NO: 199913 - RNA, 58 nt, Human
ggcagcaugcaaacuuggaucagauagcaggaggaacuuucaaaagucuggcccacug

SEQ ID NO: 199914 - RNA, 58 nt, Human
accaggcugggaggggaguguggcagggaggaggaagaggaaggugagaaugaguaga

SEQ ID NO: 199915 - RNA, 58 nt, Human
ggacugagaccuaacucacuggacucagaggaggaaucguggaaaacaagagcaaaac

SEQ ID NO: 199916 - RNA, 58 nt, Human
gcacauaggcacccagccugcaucucccaggaggaaguggaggggacaucgcuguucc

SEQ ID NO: 199917 - RNA, 58 nt, Human
gggacuggggaugugggagggagcagacaggaggaaucaugucaggccugugugugaa

SEQ ID NO: 199918 - RNA, 58 nt, Human
agggacaagccaccuugaccguaggggaaggaggaaugugggcugggggaagaugccc

SEQ ID NO: 199919 - RNA, 58 nt, Human
gggagaggcacuuaaucuguaacccccaaggaggaaauaacuaagagauucuucuagg

SEQ ID NO: 199920 - RNA, 58 nt, Human
cagcuuucgacacauaccuggcugucugaggaggaaggccuccuggaaacugggagcu

SEQ ID NO: 199921 - RNA, 58 nt, Human
gggcguccucauuucuuccucaaauauaaggaggaagauaccaauuaaaagcucauag

SEQ ID NO: 199922 - RNA, 58 nt, Human
ggugaacggaggcccagaguacuagggaaggaggaagggaggacaugccucuucuucc

SEQ ID NO: 199923 - RNA, 58 nt, Human
gaaaauuaaaguguuuucuuuauaucagaggaggaaauaguagaggucagugaagguc

SEQ ID NO: 199924 - RNA, 58 nt, Human
ggacagacccccacgaggccccccagagaggaggaagaucccacggaggaacacauga

SEQ ID NO: 199925 - RNA, 58 nt, Human
ccccagaagcaggcugaagaggaaaggcaggaggaaccugaguaugagaauguuguac

SEQ ID NO: 199926 - RNA, 58 nt, Human
uaggccuggccgcaguccaggggucagcaggaggaaaggguucacauaggcucucagg

SEQ ID NO: 199927 - RNA, 58 nt, Human
ucagccacuguucaucaccagggguuuuaggaggaaggcuuggcuccugucuucccag

SEQ ID NO: 199928 - RNA, 58 nt, Human
gugagcuucugccucuccugcccugaaaaggaggaaugauuggggccagcaacuuugc

SEQ ID NO: 199929 - RNA, 58 nt, Human
ggucuucuguagaggaaagcaugauaagaggaggaagacauaaaguuggggguggaga

SEQ ID NO: 199930 - RNA, 58 nt, Human
cagcugcuucaggcuaaaacccaggaugaggaggaacagguaagggcaggaugcuggg

SEQ ID NO: 199931 - RNA, 58 nt, Human
gaaguauuucgaauauuuucucaaucuuaggaggaaauaccaaaguuaagggacgugg

SEQ ID NO: 199932 - RNA, 58 nt, Human
gccccuuugccauagccugauuuuggggaggaggaaggggcgauuugagggagaaggg

SEQ ID NO: 199933 - RNA, 58 nt, Human
uucaaaagcaccuaaaaagaauaggcugaggaggaagucuucuaccaggcauauucau

SEQ ID NO: 199934 - RNA, 58 nt, Human
uugucucgguugcuauuccaagaacagaaggaggaaguuggccaauuacagcgugugu

SEQ ID NO: 199935 - RNA, 58 nt, Human
ggcauggccagcagcuugcguuagaaugaggaggaaggagagaaggggaggagggcgg

SEQ ID NO: 199936 - RNA, 58 nt, Human
agaggggaaggugcguauuuauucagggaggaggaaaaguggugcagggacagggaga

SEQ ID NO: 199937 - RNA, 58 nt, Human
cucagcgcgucucagcucagugccgaggaggaggaagaaaaacaggccgagugaaggu

SEQ ID NO: 199938 - RNA, 58 nt, Human
caggaaaggggugguagucagaggagggaggaggaauaaggggaaggaagagagaggg

SEQ ID NO: 199939 - RNA, 58 nt, Human
aauuugaauaaggcuguuugcugacaggaggaggaaguaguggagaucauuucaucuc

SEQ ID NO: 199940 - RNA, 58 nt, Human
gccaggcucccaggagagcauggggacuaggaggaaggguguggcauggcucagucug

SEQ ID NO: 199941 - RNA, 58 nt, Human
ccaauugagaauuuauaaaauugaguccaggaggaagcucuggcccuuguauuacaca

SEQ ID NO: 199942 - RNA, 58 nt, Human
accagcaagucccagacaaggagagcggaggaggaagucaugggaacgcagccuccag

SEQ ID NO: 199943 - RNA, 58 nt, Human
gcugcccugcaugcugcccagccacuccaggaggaagucgggaggcguggagggugac

SEQ ID NO: 199944 - RNA, 58 nt, Human
ccccccgcccacaugcuccccagcuugcaggaggaaucggugagguccuguccugagg

SEQ ID NO: 199945 - RNA, 58 nt, Human
auaaauuccaaauuaggaaguguuuccuaggaggaaaauuccauuagagaguggcaau

SEQ ID NO: 199946 - RNA, 58 nt, Human
gaugauggagagcccuguggccacacagaggaggaagacagcagccuggcagcagccu

SEQ ID NO: 199947 - RNA, 58 nt, Human
caauuaaaagguaaccuuuuaaucucguaggaggaaucucauuaagacauuuuuccug

SEQ ID NO: 199948 - RNA, 58 nt, Human
guauauaaagucaaagugcuccaacagaaggaggaagugaaaacaaacuauuaguauu

SEQ ID NO: 199949 - RNA, 58 nt, Human
gauuuuucucuuuccuaucuuugauggaaggaggaaguagaaagugguaaagaauuga

SEQ ID NO: 199950 - RNA, 58 nt, Human
auacuguucucaacauacuguaaucaaaaggaggaauuucagugggucucugugugug

SEQ ID NO: 199951 - RNA, 58 nt, Human
uaaacaauaaauauuucauaauuuacaaaggaggaacggaagaaaccuauugugaauu

SEQ ID NO: 199952 - RNA, 58 nt, Human
agaccuugccucugugccgcggagguccaggaggaaacggggcggccgcuaggccuca

SEQ ID NO: 199953 - RNA, 58 nt, Human
cacgcucaaugccccacgugccuucuccaggaggaacgaagcaggguuugaggguugg

SEQ ID NO: 199954 - RNA, 58 nt, Human
aagacaaaacacauagacgcacacacucaggaggaaaagaaaaaacaaaggcagaaga

SEQ ID NO: 199955 - RNA, 58 nt, Human
gccuccccggggucugggcggagagaacaggaggaauggcugggaaguggcugaggga

SEQ ID NO: 199956 - RNA, 58 nt, Human
ccccucccggccucccucgcacacugggaggaggaagccgccgagacugcagggagcc

SEQ ID NO: 199957 - RNA, 58 nt, Human
gugaggcaccccuguaacccuggggacuaggaggaagggggcagagagaguuaugacc

SEQ ID NO: 199958 - RNA, 58 nt, Human
ugaucacagccccccuaccuuuugcccuaggaggaagcaauaaugguguauacccuca

SEQ ID NO: 199959 - RNA, 58 nt, Human
uguccuuaaaagcuuucuccuggccgauaggaggaagcauauaucaaggagguucuuu

SEQ ID NO: 199960 - RNA, 58 nt, Human
uauauucugcucccagccugccaggcccaggaggaaauaaacaugccccaguugcuga

SEQ ID NO: 199961 - RNA, 58 nt, Human
ggugaugguauuugaagguagggccuuuaggaggaaauuaggucaugaggguggagcc

SEQ ID NO: 199962 - RNA, 58 nt, Human
caagaaggaaggcugaagcgcugucccuaggaggaauuucuccuucaggggagccuca

SEQ ID NO: 199963 - RNA, 58 nt, Human
acugaauagaaguauuucagucuugcagaggaggaaaugcucagagcuccgaggugcg

SEQ ID NO: 199964 - RNA, 58 nt, Human
ucuagacuacauccauuccuuccucaacaggaggaaaauuccugguacaguuuaacgu

SEQ ID NO: 199965 - RNA, 58 nt, Human
cgcaucucaaaggcagagcccugccugaaggaggaauccgugaguaaucuucaggucc

SEQ ID NO: 199966 - RNA, 58 nt, Human
uccucacacaaccaucccuguuuuauagaggaggaaguggcuuagagaauguaacuga

SEQ ID NO: 199967 - RNA, 58 nt, Human
gcggcgaagcccagccuuggagacacccaggaggaaggccgugcuccuggcucccucc

SEQ ID NO: 199968 - RNA, 58 nt, Human
agaauucaaacgagauucacccagcgcgaggaggaagaaacagcaguuccugggaacc

SEQ ID NO: 199969 - RNA, 58 nt, Human
guuccccaaaaagcgagaagggggguucaggaggaagccaucgcaggggaccugggag

SEQ ID NO: 199970 - RNA, 58 nt, Human
uccccagcaccuagguggggccugggguaggaggaacagguuuaaaaauccccaaaaa

SEQ ID NO: 199971 - RNA, 58 nt, Human
uuugaagauguggcugugaacuucacccaggaggaauggacuuugcuggauccuucac

SEQ ID NO: 199972 - RNA, 58 nt, Human
cagccagcaggagggacugaggcccucuaggaggaaagcccagagggagggggcccuc

SEQ ID NO: 199973 - RNA, 58 nt, Human
augucgagggacaaaagauagaagauggaggaggaaagacauuauacgugggcuuggc

SEQ ID NO: 199974 - RNA, 58 nt, Human
gagguggagcuggucacgcugggcgcccaggaggaagggagggcagagggggcugugg

SEQ ID NO: 199975 - RNA, 58 nt, Human
aauguaucuuauaauaaaaaggaaggacaggaggaagacaggcaaauguacuucucac

SEQ ID NO: 199976 - RNA, 58 nt, Human
ucaaccucagacuuuuacauaacaucucaggaggaaauguggcucucuccaucuugca

SEQ ID NO: 199977 - RNA, 58 nt, Human
cagucucucugucucuccaggacccacgaggaggaaccaggcuacuuuccccaguacu

SEQ ID NO: 199978 - RNA, 58 nt, Human
gcucuagcugagcaucagugcucucuuaaggaggaaaaaaacggugcggcugggagcg

SEQ ID NO: 199979 - RNA, 58 nt, Human
aacccagcaguccuucccucagcugccuaggaggaagggacccagcugggucugggcc

SEQ ID NO: 199980 - RNA, 58 nt, Human
ggaggcugacuccugguccuaggcuggaaggaggaagaauagggcccaugggagggag

SEQ ID NO: 199981 - RNA, 58 nt, Human
cagugaccgaugguaagugaggauuccuaggaggaauaacagucucugguuucccugu

SEQ ID NO: 199982 - RNA, 58 nt, Human
gaggggagaggaggggaaggggaggcagaggaggaacaucuggaaaaaaagcagccug

SEQ ID NO: 199983 - RNA, 58 nt, Human
cccugggaaucuaaacugggaauggccgaggaggaaggggcuccgugcacuugcaggc

SEQ ID NO: 199984 - RNA, 58 nt, Human
guauucuuugaauuuuuuuuuuuuuuggaggaggaagagagcaacaaauuugauuaua

SEQ ID NO: 199985 - RNA, 58 nt, Human
cgugagaaauggggagaacgcugcuguuaggaggaaguuguguccaguucagggugcc

SEQ ID NO: 199986 - RNA, 58 nt, Human
ggugcccaucguguuacuccauugucagaggaggaaacggggucaggcaggaaagcaa

SEQ ID NO: 199987 - RNA, 58 nt, Human
auuccuucaggcccuugucagcuaccgaaggaggaagacaguggcuucaccuguccuu

SEQ ID NO: 199988 - RNA, 58 nt, Human
gugggggugggauggcaggaggagccgcaggaggaaggagguugugcagggucuggac

SEQ ID NO: 199989 - RNA, 58 nt, Human
acaaacgggucacagguacuagucuuggaggaggaacuuuuuuuggucucugcugucu

SEQ ID NO: 199990 - RNA, 58 nt, Human
guuuagggauugaaaacaugcuucuuugaggaggaaaccccuuuagguucagaagaau

SEQ ID NO: 199991 - RNA, 58 nt, Human
uuccuucucauucuuuucuuugggguucaggaggaaaaacacaguccuagggacaaaa

SEQ ID NO: 199992 - RNA, 58 nt, Human
agaaucucacucacaguaauaagaaucuaggaggaauuccaaaccgaagcaggcaggg

SEQ ID NO: 199993 - RNA, 58 nt, Human
aaagaaaauuccccacuuggaaagaaagaggaggaacacuggauucuuacuuucugga

SEQ ID NO: 199994 - RNA, 58 nt, Human
aggcccagaccaggcucugagaccaugcaggaggaaagaaacgauuuuaaaucauuaa

SEQ ID NO: 199995 - RNA, 58 nt, Human
gaaggccccauuccggggcuguuccccgaggaggaagggaaggggcucugugugcccc

SEQ ID NO: 199996 - RNA, 58 nt, Human
ggaagggaaggggcucugugugccccccaggaggaagaggcccugaguccugggauca

SEQ ID NO: 199997 - RNA, 58 nt, Human
cagccucuacguuagguucugcggauaaaggaggaauaagacagagucaggagaacug

SEQ ID NO: 199998 - RNA, 58 nt, Human
caguccuggcccagcucuaugggaaacaaggaggaaaguuagccacugaaggccaaaa

SEQ ID NO: 199999 - RNA, 56 nt, Human
aaccaccaaaagccccaauaaagcauccaggaggaacaguugcuuuucauuucuaa

SEQ ID NO: 200000 - RNA, 58 nt, Human
gguaaacccucacaucagagugacauccaggaggaauaagcucccagggccugucuca

SEQ ID NO: 200001 - RNA, 58 nt, Human
gccaugguacaggagaacuguggcguguaggaggaauacuucaggaugagugaaggcu

SEQ ID NO: 200002 - RNA, 58 nt, Human
gcuucacuguuaccaggcauguaacagaaggaggaagacuaacacacacccccugccc

SEQ ID NO: 200003 - RNA, 58 nt, Human
ucuuguauguauuucuuuucuguucucaaggaggaaaauuggucuaggaagccuucua

SEQ ID NO: 200004 - RNA, 58 nt, Human
ccagagagggugcugccccauacccggaaggaggaacgcugcacagagaggccaagaa

SEQ ID NO: 200005 - RNA, 58 nt, Human
uugcuggacacgacgucuguguggagccaggaggaacacauguggugucuguauggcu

SEQ ID NO: 200006 - RNA, 58 nt, Human
guacuuaaaagcuucauucagaagcuccaggaggaagaagaucgggaaguaaagaagc

SEQ ID NO: 200007 - RNA, 58 nt, Human
gccacacagauaccccacguucuauauaaggaggaaaacgggaaagaauauaaaguua

SEQ ID NO: 200008 - RNA, 58 nt, Human
gcagagucuggguugguguggauagcaaaggaggaagucugagccccucauuggucuu

SEQ ID NO: 200009 - RNA, 58 nt, Human
acuccacacugugcucucuaguagcacaaggaggaaguuggacagaacauuggguagu

SEQ ID NO: 200010 - RNA, 58 nt, Human
cuucucuuccaaguuucccacucacuugaggaggaaaaauggcaaaagaaagcugucu

SEQ ID NO: 200011 - RNA, 58 nt, Human
ugaacucagagcauuguuuuaggguuggaggaggaacacgcuuucuuuacaucacuag

SEQ ID NO: 200012 - RNA, 58 nt, Human
ugccugucaaucaccaccuuuccuccagaggaggaaaauuaucuccccugcaaagccc

SEQ ID NO: 200013 - RNA, 58 nt, Human
cccuggggcaggaaguggguggacuuggaggaggaacggcaagggccgguccccacac

SEQ ID NO: 200014 - RNA, 58 nt, Human
uugacuggacugucauugugugaagucuaggaggaaauguccauuuuaauuguaugau

SEQ ID NO: 200015 - RNA, 58 nt, Human
ucgucugcaaguguucuccaagggaaggaggaggaaacugugguguuccuuucuucca

SEQ ID NO: 200016 - RNA, 58 nt, Human
gugauuguagacagaggggugaagaaggaggaggaagaggcagagaaggaggagacca

SEQ ID NO: 200017 - RNA, 58 nt, Human
uucuuggcucuucacagaucccaccaccaggaggaaugccaaggcugggcccacagcg

SEQ ID NO: 200018 - RNA, 58 nt, Human
uuuucucauucaaucuucuccugacauuaggaggaaucuacaaaaagcagcaauggga

SEQ ID NO: 200019 - RNA, 58 nt, Human
gucucugagacaggaucguugucccuacaggaggaacaguggccuugcuucuuagacg

SEQ ID NO: 200020 - RNA, 58 nt, Human
cuuuuuuauuaauauuuuccuuuguuaaaggaggaaccguaacucuccauagcuguac

SEQ ID NO: 200021 - RNA, 58 nt, Human
cacacuuucuugggacucccaccuuggaaggaggaagggcugaccuggguucucucca

SEQ ID NO: 200022 - RNA, 58 nt, Human
gaagaaaaaaaccccuggccuuugggccaggaggaaucuguuacucgaauccacccag

SEQ ID NO: 200023 - RNA, 58 nt, Human
cccugguguggucagccucucucacacaaggaggaacuugggugaaggcugaguguga

SEQ ID NO: 200024 - RNA, 58 nt, Human
cccucucacugugucccucucucuggaaaggaggaaggagccuauggcaucuucccca

SEQ ID NO: 200025 - RNA, 58 nt, Human
ggggcgcccugcuccccucagaucagucaggaggaagaugacuaaggggagggauccu

SEQ ID NO: 200026 - RNA, 58 nt, Human
ccaaagcugggccagaguuaagggaaagaggaggaaguccuaagcagagaaguagcac

SEQ ID NO: 200027 - RNA, 56 nt, Human
ggcucuguaaguagaugcauuuggguccaggaggaagcguggacaccucguaggga

SEQ ID NO: 200028 - RNA, 58 nt, Human
gugcaggacagcccacccuccuacagcuaggaggaacuaccacuuuguguucugguua

SEQ ID NO: 200029 - RNA, 58 nt, Human
auucuaucaaucacggaagaggcagucaaggaggaaggagagacauuaggagccgaua

SEQ ID NO: 200030 - RNA, 58 nt, Human
aaaagugaguggggcgggaggaaggggcaggaggaaggguugagguuacuuggggcga

SEQ ID NO: 200031 - RNA, 58 nt, Human
cagggucaugaacuuuuuucuuuagugaaggaggaauacaaucaaggguuuuguauuc

SEQ ID NO: 200032 - RNA, 58 nt, Human
cuuaacacagccgggcuugggggcagucaggaggaagcuggccauccguggaggaggg

SEQ ID NO: 200033 - RNA, 58 nt, Human
gggaggagaagcuggcagcccucacugcaggaggaaggguggagugggcgcaggcacg

SEQ ID NO: 200034 - RNA, 58 nt, Human
ucguuaaaaaugggcaugguuguaauaaaggaggaaagugcgacuuuugaaauguuug

SEQ ID NO: 200035 - RNA, 58 nt, Human
guuuccacugaggacauucagccugggaaggaggaagucaccagcucgaggcgugugg

SEQ ID NO: 200036 - RNA, 58 nt, Human
gcauuuuggauuaauucaugcaaaaugaaggaggaagccuggucuaagaagauacugu

SEQ ID NO: 200037 - RNA, 58 nt, Human
uugacaucugugagugacugagggagacaggaggaauaccagguuauucauggaauaa

SEQ ID NO: 200038 - RNA, 58 nt, Human
cuaccagacaguguucucaacuugguuaaggaggaagaaaacccagucaaugaaauuc

SEQ ID NO: 200039 - RNA, 58 nt, Human
ccccgaguccugcccuggaaccaaaggaaggaggaacacugaggggaauccugaagua

SEQ ID NO: 200040 - RNA, 58 nt, Human
agcugggggaagggcagaagacugguuuaggaggaaaaggaaauaaggagaaaagaga

SEQ ID NO: 200041 - RNA, 58 nt, Human
caacuauccgaauauguccauuucgcagaggaggaaagugaggcccagggagugcaga

SEQ ID NO: 200042 - RNA, 58 nt, Human
ucuuuguagaguuacuaagcauuagcaaaggaggaaaugcuauguaauagaaauauua

SEQ ID NO: 200043 - RNA, 58 nt, Human
uucugaggccagaaaggugugaggagagaggaggaaaagucuuccuaauugugccccu

SEQ ID NO: 200044 - RNA, 58 nt, Human
gagaagggaggguggccagcacuaguaaaggaggaauagugcuugcuggccacaagga

SEQ ID NO: 200045 - RNA, 58 nt, Human
ggcaagugagcuuuaauuaccauguuaaaggaggaaagagcuagaaaaaaaaaccuca

SEQ ID NO: 200046 - RNA, 58 nt, Human
uaguuagcugaaacugggaccuaauaaaaggaggaaauguuuucccacaguucuaggg

SEQ ID NO: 200047 - RNA, 58 nt, Human
ugaagggaagucuuuguugcaaaggaggaggaggaaaagggaggacuugguaggguuu

SEQ ID NO: 200048 - RNA, 58 nt, Human
auccggacugaggaagacgaggacagggaggaggaaaaggaggaagaggaggacaaaa

SEQ ID NO: 200049 - RNA, 58 nt, Human
gaggaagacgaggacagggaggaggaaaaggaggaagaggaggacaaaaagggggagg

SEQ ID NO: 200050 - RNA, 58 nt, Human
aagggggaggagaagguucuucguccaaaggaggaaggagaagaaguagaaagugcga

SEQ ID NO: 200051 - RNA, 58 nt, Human
gagagagugcaguucagggaaaaaggagaggaggaaacagugaggcagggagaaaggc

SEQ ID NO: 200052 - RNA, 58 nt, Human
gcuguagcaucuggucucacggacucugaggaggaauuggaaauuggucucuuuugag

SEQ ID NO: 200053 - RNA, 58 nt, Human
ccuuuucauuuucgauugcacagcggggaggaggaauggcuuuguggucgucguugug

SEQ ID NO: 200054 - RNA, 58 nt, Human
gaauggauuuuucccggagccggaagccaggaggaaacuacaccacacuaaaacauug

SEQ ID NO: 200055 - RNA, 58 nt, Human
gguaugcaucagguaucuaauagcagggaggaggaaggccuguugcugcaaucauugu

SEQ ID NO: 200056 - RNA, 58 nt, Human
cuaaucccaaccccaaccccaugggaggaggaggaagaggaggaggaggaggaggagg

SEQ ID NO: 200057 - RNA, 58 nt, Human
uuucugaacuuugggaguuauaggagacaggaggaacuucuccuccuccuccuccccu

SEQ ID NO: 200058 - RNA, 58 nt, Human
cucccuuccccugacuguuccacccaggaggaggaaacuucacauagccgugcucaca

SEQ ID NO: 200059 - RNA, 58 nt, Human
ucauuaagaugcugggcagcaguauaacaggaggaagagaucccucuccuuuggucag

SEQ ID NO: 200060 - RNA, 58 nt, Human
ccaucccugcaugaagcagcuuugagagaggaggaagagggagucugagcaugagcug

SEQ ID NO: 200061 - RNA, 58 nt, Human
cucagcaguaccuggaugauucccaccaaggaggaauggccaaaccagaugggugaga

SEQ ID NO: 200062 - RNA, 58 nt, Human
cggcuucugaaagugccuuggugugagaaggaggaaggggccgcuuggagagcugggc

SEQ ID NO: 200063 - RNA, 58 nt, Human
gcgcguccuuggaaaucuguggcccuggaggaggaacaggagggcccugggaccaggc

SEQ ID NO: 200064 - RNA, 58 nt, Human
ugcguaagagacccagaacuuccacagaaggaggaaaauuaaccuccugcuucucuag

SEQ ID NO: 200065 - RNA, 64 nt, Human
gggaguggucugaaugaacacagcugaccccuuucccgcgcacugaaagggcagaguaggccga

SEQ ID NO: 200066 - RNA, 64 nt, Human
cgcacacacacacacacgcacacaugcgugugcacccgcgcacgcacauacacacacacauaua

SEQ ID NO: 200067 - RNA, 64 nt, Human
agaaagcaaacccggggagcaggcggcugccgcacccgcgcaccccgggcccucaccacgcccu

SEQ ID NO: 200068 - RNA, 64 nt, Human
acacuacuccaaaucaaaaccacuaagaguuccucccgcgcagacugcugccccuucagcugcc

SEQ ID NO: 200069 - RNA, 53 nt, Human
gauucuucagccaucgcugaucucccgcgcagaccguuguuucccccaaggcc

SEQ ID NO: 200070 - RNA, 64 nt, Human
ucucggccccgccaccugcccagcgugcccuggcucuccagaaccuucuaucccacagucaggc

SEQ ID NO: 200071 - RNA, 64 nt, Human
gaaaacccaguguccaucuuuccacccucccugaucuccagaaccuucgacugacccccuuguc

SEQ ID NO: 200072 - RNA, 64 nt, Human
guuaggacgaacaucugccccuucagggaggacccccgcgcacaccagaaccucuggcaagccg

SEQ ID NO: 200073 - RNA, 64 nt, Human
gcgccccgcaucucgcgccugcuacaucaaagggcccgcgcacaaagcaguguuucuucgccac

SEQ ID NO: 200074 - RNA, 64 nt, Human
uuccuuuaggugcuauacauuauucaaaaagucucccgcgcauuugcacuaaugauggcugcau

SEQ ID NO: 200075 - RNA, 64 nt, Human
uuccacggcuccggccgcuaggacccugccaggucccgcgcaccaucccugcccugcccacgug

SEQ ID NO: 200076 - RNA, 64 nt, Human
cagcccucccucgauggccucuagcccagagaagcccgcgcaucuuggacccaccaagcaggcc

SEQ ID NO: 200077 - RNA, 64 nt, Human
gaggcgcgagugcgugugagaagaaccgacccaccccgcgcaaggggaagccuccugucucccc

SEQ ID NO: 200078 - RNA, 64 nt, Human
gaaaagaccgagcaggccacagaggcucggucuccccgcgcacagcguaggcacccgguguacu

SEQ ID NO: 200079 - RNA, 64 nt, Human
ccaucaccgaggccuccccagcgcacugaauguccccgcgcagagcagagggaaggcagcggaa

SEQ ID NO: 200080 - RNA, 64 nt, Human
gcucgggucaguccucaucgcucccccuccccaccccgcgcaggccacugagacggugggacac

SEQ ID NO: 200081 - RNA, 64 nt, Human
ugguguggagccccuuggccagggccaugggagucccgcgcagucagcuccacauuggccucug

SEQ ID NO: 200082 - RNA, 64 nt, Human
agguuuccacaccccuccccugggccgcugaggccccgcgcaccugugccuuaaucuucccucc

SEQ ID NO: 200083 - RNA, 64 nt, Human
gcuugcagaagggggagaucccaguucgaagacucccgcgcagagccuguggcccucucugcca

SEQ ID NO: 200084 - RNA, 64 nt, Human
gaacgaccccugaauauauaaaacacacacacaccccgcgcacucucacuccuuuuccagguuu

SEQ ID NO: 200085 - RNA, 64 nt, Human
uuggagggcugcaggucguccucucuguaugugccccgcgcauuuccuuggccucaucugagau

SEQ ID NO: 200086 - RNA, 64 nt, Human
gcucuggacugcugcccuuguccccgaggagugucccgcgcagccacaccuggcaacagcagug

SEQ ID NO: 200087 - RNA, 64 nt, Human
cugggugcugcccugcgcccugccgcacccgcggcccgcgcagcugccuaggauguucugggcu

SEQ ID NO: 200088 - RNA, 64 nt, Human
cccagugggcauggagccagugccugugguuguuucuccagagucaaaagggaagucgagggau

SEQ ID NO: 200089 - RNA, 64 nt, Human
aggaccugcacgggacuuguggaugggccuggacucuccagaaacuacuugggcagagcaaagg

SEQ ID NO: 200090 - RNA, 64 nt, Human
gaauaaaaucccacccaccugggacuugguaauuucuccagacaggaaagcuuuagaaaacuug

SEQ ID NO: 200091 - RNA, 64 nt, Human
ucucaaagccucuuauuuuucuagcgaacguauuucuccagacccagaggcccugaagccuccg

SEQ ID NO: 200092 - RNA, 64 nt, Human
ggaagccgagugcccgccgccgcgccagccucagcccgcgcagaaugugcucgcugccccgcgg

SEQ ID NO: 200093 - RNA, 64 nt, Human
gggggcucgggcgcggacuaagcaggggggaucucccgcgcaggggcggcggcggcggggaccg

SEQ ID NO: 200094 - RNA, 64 nt, Human
ugagugagcugugcugccagccaucgcagaggagcccgcgcacgacugugguggggccgucggu

SEQ ID NO: 200095 - RNA, 64 nt, Human
ccucaccggacugagcucacaggaggagccugcacccgcgcagaaggggagccggggccgagcc

SEQ ID NO: 200096 - RNA, 64 nt, Human
gccauugugggugagggucgagggccaccgaggucccgcgcaccgcugccugcccugcaguggc

SEQ ID NO: 200097 - RNA, 64 nt, Human
cgcccccugaggacgccuccacgccauucgccaucccgcgcaccuccagccuagcucgggccaa

SEQ ID NO: 200098 - RNA, 64 nt, Human
ccucuuccccuauaccuguucccacaaauggcaucccgcgcaugcuugcccuauuaaaggcagc

SEQ ID NO: 200099 - RNA, 64 nt, Human
gggccccucggaggccgaggcuggcaccccaucucccgcgcagccugcccccuccuggacgugc

SEQ ID NO: 200100 - RNA, 64 nt, Human
auuaacaaaaggacguaugccauggagaaacacacccgcgcacacagcugcucucuacagaggc

SEQ ID NO: 200101 - RNA, 64 nt, Human
gcgcccgacggccaggaucucgcuguaggucaggcccgcgcagccuccugcgcccagaagccca

SEQ ID NO: 200102 - RNA, 64 nt, Human
gcggccgugguggaggccuccaccccaggagcaccccgcgcacccucggaggacgggcuucggc

SEQ ID NO: 200103 - RNA, 64 nt, Human
ucugagggccgggcacggucacacggccacccgccccgcgcaccccacgcccuguucacgcuca

SEQ ID NO: 200104 - RNA, 64 nt, Human
ucccggaggagguugggagguggaggcccagcaucccgcgcagaugacaccaucaaccgccaga

SEQ ID NO: 200105 - RNA, 55 nt, Human
gcaggugugugcugcuaugaacaucucuccagagcccuuucugcacagcuggugu

SEQ ID NO: 200106 - RNA, 64 nt, Human
uuuaggcauguuaacuucuguuguguuuugaaucucuccagaguugcauguagauagcauuuau

SEQ ID NO: 200107 - RNA, 64 nt, Human
cacagaagcacaacccagccaaacaccacagccuucuccagagccggcacugucccggcaacca

SEQ ID NO: 200108 - RNA, 64 nt, Human
uugucuaauccuauggcacaggacgugcuuuacaucuccagaucuguucuucaccagauuaggu

SEQ ID NO: 200109 - RNA, 64 nt, Human
gccuuccuggugcccaccaggcacuacggcuuccucuccagaauguggcuuugccugagcacag

SEQ ID NO: 200110 - RNA, 64 nt, Human
agaagcacucccccaguugugacaaccaaaaauaucuccagaccuuggcaaauguuaucugugg

SEQ ID NO: 200111 - RNA, 64 nt, Human
gucccagcggaacucagggagucuauuuaugaagucuccagaccuugggccggcacgcgugaca

SEQ ID NO: 200112 - RNA, 64 nt, Human
agacuucauacauuuccaguacgacuuuaguaucucuccagagccauauuuucucaguccgaau

SEQ ID NO: 200113 - RNA, 64 nt, Human
ccaagguaucccagccuggacaggcauggaccugucuccagagagaggagccugaaguucgugg

SEQ ID NO: 200114 - RNA, 64 nt, Human
gcuucuugcuguucccaguagaaucgcuagcucuucuccagaggaaaaguacuaggauucuuaa

SEQ ID NO: 200115 - RNA, 64 nt, Human
uuuuuuaaaaaaccaaguagugucuuccuaccuaucuccagauacaugucaaaaaaagaaaggu

SEQ ID NO: 200116 - RNA, 64 nt, Human
aaucaagacuugagauaucgaagucaguuauuggucuccagagugcagcucugggagccuuuug

SEQ ID NO: 200117 - RNA, 64 nt, Human
ccuuacucaggaaggcaggaggaaagagacugccucuccagagcaaggcccagcugggcagagg

SEQ ID NO: 200118 - RNA, 64 nt, Human
aaugugaagacuuaccaaaugaauuuuagaucauucuccagaggagauuuuuuuugcucuucuc

SEQ ID NO: 200119 - RNA, 64 nt, Human
aggcauaccuuuuuagcuucuguuuguggaguugucuccagauaagaggagaugugccuuccca

SEQ ID NO: 200120 - RNA, 64 nt, Human
uccuccagccuuuguccuuguccuggccuccugcucuccagaucuguaaacugggcucaaggac

SEQ ID NO: 200121 - RNA, 64 nt, Human
gagagccuccccucccuccagacccggagcggccucuccagaccugccuucccagccgggggcu

SEQ ID NO: 200122 - RNA, 64 nt, Human
accuggguucugggacuuuuaaauucaaauuuuaucuccagauggaaugggguccuagcaaccu

SEQ ID NO: 200123 - RNA, 64 nt, Human
gagguagugccaaugacaggacauuugacaugagucuccagauagaugucguggacuccagcuc

SEQ ID NO: 200124 - RNA, 64 nt, Human
uccacaugcacauguauucuguuggccagcacguucuccagacucuagauguuuagaugagguu

SEQ ID NO: 200125 - RNA, 64 nt, Human
gaaggagacagaaggaaauugacccacucuccuaucuccagaccuuuaccuagccccuccaggu

SEQ ID NO: 200126 - RNA, 64 nt, Human
aaauaagauugacuuggguguuauauuucaucucucuccagacucuagguauauuuccaacuuu

SEQ ID NO: 200127 - RNA, 64 nt, Human
augcaauuaauuuuauuaacugauuucuggucuaucuccagagauaaaauaccauuccuucaca

SEQ ID NO: 200128 - RNA, 64 nt, Human
agauguacacccagccucagggggaaggcagcucucuccagacagagucucagggcccagcaag

SEQ ID NO: 200129 - RNA, 64 nt, Human
guaaggagcaccaaagcugaggcuggcucagagaucuccagagaagcugcagccugcccuggcc

SEQ ID NO: 200130 - RNA, 64 nt, Human
aaugcugaccccucgucguaugaacugugcauagucuccagagcuucaaaggcaacacaagcuc

SEQ ID NO: 200131 - RNA, 64 nt, Human
guuuaagugaccuccuucaucacauccugcaguaucuccagaagcagcacuaggguuugaguuu

SEQ ID NO: 200132 - RNA, 64 nt, Human
uuguuccucaugaauaucccccuuccucugcaauucuccagagugguaacagauggguagaggc

SEQ ID NO: 200133 - RNA, 64 nt, Human
guauuacacaagccaaaaugggagcaaggccuucucuccagacuaucguaaccuggugccuuac

SEQ ID NO: 200134 - RNA, 64 nt, Human
uuuuagccuuaccaccuuuuaaaaaauuuguuauucuccagaaacaguaaauaggugaguaggg

SEQ ID NO: 200135 - RNA, 64 nt, Human
agggauggagcgggucuccugauucuacaccaucucuccagaacucucuggccuugguggcccc

SEQ ID NO: 200136 - RNA, 64 nt, Human
ccaggggcccuggcguuugccuccuucgcuuaguucuccagacccucccucacacgcccagagc

SEQ ID NO: 200137 - RNA, 64 nt, Human
ggccuauccaguuuuccugguucccucacagguuucuccagaaaguacucccucaguaaagcau

SEQ ID NO: 200138 - RNA, 64 nt, Human
ggccugcuucacuugcagauaaguuuauuauaauucuccagaaaugugcaggaugugcauuagc

SEQ ID NO: 200139 - RNA, 64 nt, Human
cuguugcccugagagugucccaggggauucagagucuccagaaagauauggcugggccaacucu

SEQ ID NO: 200140 - RNA, 64 nt, Human
ggcgcacuuuccugaagccucuuauuaacucccaucuccagaagcaccucaacaaugucagugg

SEQ ID NO: 200141 - RNA, 64 nt, Human
cgcuuuggccugaguuauugagauuguccucauuucuccagauuaucuauuugugugugugugu

SEQ ID NO: 200142 - RNA, 64 nt, Human
ccacuuuauuucucugggaaaaauaggcugcaggucuccagagcauaucgaugcaguacuguac

SEQ ID NO: 200143 - RNA, 64 nt, Human
agauuuguggccagauugccuucaucauuucaccucuccagacuuccauuucuucacaaggaug

SEQ ID NO: 200144 - RNA, 64 nt, Human
uuauuuguauuuaaagucauuaacuugaucccuuucuccagacuggccaugccgccauauaccu

SEQ ID NO: 200145 - RNA, 64 nt, Human
cugcauuuuccuacaccccuuuccuggacugcucucuccagaaacagcacagcucauggagggu

SEQ ID NO: 200146 - RNA, 64 nt, Human
augucagucuuuguaauuauuuacacuuuaacuuucuccagaacucagacaugauuucaacaug

SEQ ID NO: 200147 - RNA, 64 nt, Human
ccaccuuauacagagaucuagaaucucuuuauguucuccagaggaagguggaagaaaccauggg

SEQ ID NO: 200148 - RNA, 54 nt, Human
uaaagcaggcagagcuuugauaacucuccagagaaccuuuagaauaucuuuuca

SEQ ID NO: 200149 - RNA, 64 nt, Human
accugauggugaaaccaaacaaauacaaaauccuucuccagaccccagaacuagaaaccccggg

SEQ ID NO: 200150 - RNA, 64 nt, Human
guucuagcucagguuuucuuacucugaauuuagaucuccagacccugccuggccacaauucaaa

SEQ ID NO: 200151 - RNA, 64 nt, Human
aacucucucuuccuucuccuuuucuuuccuucccucuccagagauguugguuucuacagcaacc

SEQ ID NO: 200152 - RNA, 64 nt, Human
gaauggagaaucuggauucucuccucuuccccauucuccagagggagggagguggugaggaaga

SEQ ID NO: 200153 - RNA, 64 nt, Human
uuuuucuguucucuccaaccacacaucauccaucucuccagacucugccuccuacgaggcuggg

SEQ ID NO: 200154 - RNA, 64 nt, Human
ggggccuggaucagugggguguauucagagcaccucuccagaugcaccaugcaugcucacaguc

SEQ ID NO: 200155 - RNA, 64 nt, Human
ucaaaauagaagaccuugcaagaagcagagucauucuccagaaggaacuugggagaugauggug

SEQ ID NO: 200156 - RNA, 64 nt, Human
aaggaauuguacugugcuacaauuaucucuagaaucuccagaaagguggagggcuguucgcccu

SEQ ID NO: 200157 - RNA, 64 nt, Human
guguuaucuucauaugauaugcugaacaccaaaaucuccagaaaugcauuuuauguaguucuaa

SEQ ID NO: 200158 - RNA, 64 nt, Human
uuauguucucaugcccucaaucuguaaauuuuugucuccagaaaaacccucccaggcaucccau

SEQ ID NO: 200159 - RNA, 64 nt, Human
ucccuccccuacccaucugucuggccagaccuguucuccagagcucaauucugcacucugggau

SEQ ID NO: 200160 - RNA, 64 nt, Human
gucuuuaauuuagggcacucuugcugggaugcuuucuccagagcuuauauauuucuucuuacua

SEQ ID NO: 200161 - RNA, 64 nt, Human
ucccccucucuccucccuuccuucccuccccgcaucuccagagagagccucucagcagcagggg

SEQ ID NO: 200162 - RNA, 64 nt, Human
aaagaaguguuugauggugccagagaggggcugcucuccagaaagcuaaaauuuaauuucuuuu

SEQ ID NO: 200163 - RNA, 64 nt, Human
gugcuuccuuaauuucagggaugauaccggggacucuccagagccaugacuagauccaauggau

SEQ ID NO: 200164 - RNA, 64 nt, Human
gagccuucccuacccugacgccucccagucaucaucuccagaacucccagcggggcucccugag

SEQ ID NO: 200165 - RNA, 64 nt, Human
aacugucauuacuucuuauuauaguugaaggcauucuccagauucuuuuuaaaagauuuguuca

SEQ ID NO: 200166 - RNA, 64 nt, Human
ggagaagccaaauggcugcacuggccgauucuggucuccagaggaccuugguguuugcucuccc

SEQ ID NO: 200167 - RNA, 64 nt, Human
gagcucccaucuagcuucagcagggcagaacccuucuccagauguguguaacuuaugucuugag

SEQ ID NO: 200168 - RNA, 64 nt, Human
caaccauaugaaguaggcacuguuaccaucugcaucuccagaugagcacccugagguuuagaga

SEQ ID NO: 200169 - RNA, 64 nt, Human
aauucugcccccucaccucuuaccccaguacuauucuccagagguaaucuauuaacaauuucuu

SEQ ID NO: 200170 - RNA, 64 nt, Human
aguuuguaagaacaaucauaaaaggacuuguuagucuccagaacaucugcuaaaaugcaaguau

SEQ ID NO: 200171 - RNA, 64 nt, Human
agauuguuuaacaguauguguggugaugucauuaucuccagagaggcuucaagaaauccuuugg

SEQ ID NO: 200172 - RNA, 64 nt, Human
uugaaauuucccaaaauaauuauggcuucugucaucuccagagauaaucuggcuugguuuaccc

SEQ ID NO: 200173 - RNA, 64 nt, Human
guaaauaccauauaugauccucgaaaugauaauaucuccagaauauuguuuucacccaaauuug

SEQ ID NO: 200174 - RNA, 64 nt, Human
guaccuauuuuugaggaccuugaaaaucuuaaucucuccagaagggauacugcauugguucuuc

SEQ ID NO: 200175 - RNA, 64 nt, Human
accauuugguuacccucgggauggccauccacugucuccagaaagagaccacuuagagggucuc

SEQ ID NO: 200176 - RNA, 64 nt, Human
ucaacggcaagaggaaaggaggggucucgggacaucuccagacccuaccaacugggaggguccc

SEQ ID NO: 200177 - RNA, 64 nt, Human
uuucacagaacuugguuuucaaauaaauauaagaucuccagauggacaagacauuuguuuuuca

SEQ ID NO: 200178 - RNA, 64 nt, Human
cggauauaaaggaagaauauuuccuuuauguguuucuccagaauggugccuguuucucucugug

SEQ ID NO: 200179 - RNA, 64 nt, Human
uauaauugugaaggagucagggcuaacaccuggaucuccagaaaccuagcccagcagguuaauc

SEQ ID NO: 200180 - RNA, 64 nt, Human
ccagcuccacucucugguuucuaauaaacagggaucuccagaacacuggugguggacacagcuu

SEQ ID NO: 200181 - RNA, 64 nt, Human
gcccaaugagggcgaaugacauuacagcuugaccucuccagaacacuaauauccuaaaauacag

SEQ ID NO: 200182 - RNA, 64 nt, Human
gaagagagagcacuuucuucccagagccccaugcucuccagaccaaugucugggcuucccuuuc

SEQ ID NO: 200183 - RNA, 64 nt, Human
ucuucacuuucaauuauauccagcaauaaguuguucuccagaaaagaaagcuuggaaacuuacc

SEQ ID NO: 200184 - RNA, 64 nt, Human
cuggugugaugcuguuaauuguauguaccacacaucuccagacguuaauaaaggacucaaagag

SEQ ID NO: 200185 - RNA, 64 nt, Human
uaaacaugcuguuaccagagccucuuugcuggagucuccagauguuaauuuacuuucugcaccc

SEQ ID NO: 200186 - RNA, 64 nt, Human
ggguuuuaguauauauagcccaaaaugguaacugucuccagaacagcaaccacauugaauucuu

SEQ ID NO: 200187 - RNA, 64 nt, Human
ccauagccaucuacaauaguaacugcccacaggcucuccagaaaacuacuacaauggccaagua

SEQ ID NO: 200188 - RNA, 64 nt, Human
aacagagagugaacagcaccucuccauugcuacaucuccagaauauuguucgguuauguucaug

SEQ ID NO: 200189 - RNA, 64 nt, Human
cuggaaacuuauuuuaaucacacccaugacaaacucuccagaucuguuuaccaucauucaggaa

SEQ ID NO: 200190 - RNA, 64 nt, Human
uguucugaugggggagggcggucuucccacuuccucuccagaacuccagaaagagcagugugcu

SEQ ID NO: 200191 - RNA, 64 nt, Human
agaaaacuucucuucugagccucuuuaacagcuuucuccagaaccagugucugaaccacccugg

SEQ ID NO: 200192 - RNA, 64 nt, Human
ugauaauaugcaaaugaacauuuuccuuuaugucucuccagauaauguuuauugucugagguaa

SEQ ID NO: 200193 - RNA, 64 nt, Human
aagacuauucccuucuaaccugaacugauggguuucuccagagggaauugcagaguacuggcug

SEQ ID NO: 200194 - RNA, 64 nt, Human
auaaauguguauauuuaauguuuuauuguuagcuucuccagaaaauugaugcaaauucugguaa

SEQ ID NO: 200195 - RNA, 64 nt, Human
cuuuguaucuuccauauuuggaagaaaaaaaucuucuccagauuuuucggaggccccacugaug

SEQ ID NO: 200196 - RNA, 64 nt, Human
aagcugcucucaggcacccccuucuucauugcucucuccagaaaggguugcuagccuuaacuuc

SEQ ID NO: 200197 - RNA, 64 nt, Human
agacaggaccucccggccuccuucaccuuucucaucuccagagcccugcccccaauacucuguc

SEQ ID NO: 200198 - RNA, 64 nt, Human
gggggggcgccuuagguacuuauuccagaugccuucuccagacaaaccagaagcaacagaaaaa

SEQ ID NO: 200199 - RNA, 64 nt, Human
gguaggagggggggagaggucucuguccuacugcucuccagagggcauuuccccuugcgccuuc

SEQ ID NO: 200200 - RNA, 64 nt, Human
uucaaggcacagcccuuguugggagggagaacccucuccagaaacccugccaccauggugucuu

SEQ ID NO: 200201 - RNA, 64 nt, Human
aggcaugaagcaaagagcugagugaguccucugcucuccagaggaccaagaaauaccuguguga

SEQ ID NO: 200202 - RNA, 64 nt, Human
ccuucccccugaguaugcaugugccuguucagagucuccagauaccuuuuuuauaaaaagaagu

SEQ ID NO: 200203 - RNA, 64 nt, Human
acucuguaccccaaagagaguucucaugaaauauucuccagaauguauucauuaucaagaaaau

SEQ ID NO: 200204 - RNA, 64 nt, Human
ugauucucuugaugccaccuucagauccuuuuauucuccagaauaauucuuaacagugguucaa

SEQ ID NO: 200205 - RNA, 64 nt, Human
gggugggggugggcuuuggucuuagcacuuuccuucuccagauccccccuacccaccccagucc

SEQ ID NO: 200206 - RNA, 64 nt, Human
gggaaguuucuucaaacaaaacccagcuccugagucuccagauguuguucugucaguugccaaa

SEQ ID NO: 200207 - RNA, 64 nt, Human
gauugugauagcuucaagguggaacauacuguaaucuccagaugcuaggaaguuagucuaauaa

SEQ ID NO: 200208 - RNA, 64 nt, Human
gcagaggcuggcccacuguaguuugcagacaugcucuccagaugguuuuacuaaguccccucuc

SEQ ID NO: 200209 - RNA, 64 nt, Human
gcagaaaaacacaaacaaaaacagacucccacugucuccagaagucguggccuuccagaacagu

SEQ ID NO: 200210 - RNA, 64 nt, Human
gagaagccagcaggcaccacuuuucugcucccuuucuccagaggcagaacacauguuuucagag

SEQ ID NO: 200211 - RNA, 64 nt, Human
uaccagcaaaucugcaaaccaagcacuuuguuaaucuccagagagagcaaauacagcaaucuag

SEQ ID NO: 200212 - RNA, 64 nt, Human
aguauuuacaguauugagcuuugcauuuaugauuucuccagaaauuuaccacaaaagcaaaauu

SEQ ID NO: 200213 - RNA, 64 nt, Human
acgcggaggaguuuucuguguggucuccagcuccucuccagacacagagacaugggagugggga

SEQ ID NO: 200214 - RNA, 64 nt, Human
acagcguuggucucuguuuggaaucacugugaggucuccagaaggaccuggccgccagccccuu

SEQ ID NO: 200215 - RNA, 54 nt, Human
uuccaggccagcuuccaugagugaucuccagaugucacuugguuuauuccugca

SEQ ID NO: 200216 - RNA, 64 nt, Human
ugguucugugcuauaaucagaauuguaauuauguucuccagaggccaauuucauuaacucugau

SEQ ID NO: 200217 - RNA, 64 nt, Human
auuauuucaccaagccaauaccagccgccauccuucuccagaauucuuguaaauaaaauaaauc

SEQ ID NO: 200218 - RNA, 55 nt, Human
ucccuggcaugacuccaugaauuugucuccagaacggcagcaggaaagucuuuuu

SEQ ID NO: 200219 - RNA, 64 nt, Human
aaucccagcacuaugggaggccagggagggaggaucuccagaggucaggaguucgagaccagcc

SEQ ID NO: 200220 - RNA, 64 nt, Human
uuucaagcugaaaauaauaguucuacugcccgugucuccagaauguagagcccaucaauauuuu

SEQ ID NO: 200221 - RNA, 64 nt, Human
uacugaagucucugcuguaauccuuauauaucuuucuccagagaacauaauauugucaaauaga

SEQ ID NO: 200222 - RNA, 64 nt, Human
aguaugacaacacauacacacuugccucuccccaucuccagaagaggggagcagaguccgagcu

SEQ ID NO: 200223 - RNA, 64 nt, Human
uggaauaaagcacuguccuugcagaugaaaaaagucuccagagcagacuucugacaggaaaggu

SEQ ID NO: 200224 - RNA, 64 nt, Human
uguguuaaugucaauaugaugagauuuuagccuuucuccagaacuaaggcauuaaagaaaauag

SEQ ID NO: 200225 - RNA, 64 nt, Human
gcuguggucaccugaggaugugguucagguggggucuccagaaggcugcuugcccccagagagc

SEQ ID NO: 200226 - RNA, 64 nt, Human
auacaguaagagauaguguugaaccagcaucaagucuccagaaacauggcagagcagacaggcc

SEQ ID NO: 200227 - RNA, 64 nt, Human
ccagcacucccaccauucguggcaaccaaggaugucuccagacacugccccguguccauggggu

SEQ ID NO: 200228 - RNA, 64 nt, Human
ugcguguuccuggugaagcaguuucacaucagucucuccagauagcacuacgauguauuccgcu

SEQ ID NO: 200229 - RNA, 64 nt, Human
uuccagauuuguuuccuuuuggccuccugcaaagucuccagaagaaaauuugccaaucuuuccu

SEQ ID NO: 200230 - RNA, 64 nt, Human
gcuaaaacuggcauuacugacucccagcuauauuucuccagacuugcauuuuuuuuuuuuuuuu

SEQ ID NO: 200231 - RNA, 64 nt, Human
uaauccuauaaacauaaagggguaaaauuggaacucuccagaugaacaaagacaucuaaauauc

SEQ ID NO: 200232 - RNA, 64 nt, Human
ucacauuaagcuauaguagaaggaauuggacacuucuccagauauuuggcuucaaaggaguacc

SEQ ID NO: 200233 - RNA, 64 nt, Human
ucauggcuggagagcugaucagccaggcacagaaucuccagaacaaccuagagagugaaugcua

SEQ ID NO: 200234 - RNA, 64 nt, Human
uuuaggagucuauuuugucuauaggugacaaacaucuccagacuaacaugucaguuuuaucaau

SEQ ID NO: 200235 - RNA, 64 nt, Human
gaguggucugugugaggcuguuccuucaguuucuucuccagacuguucuuugguugucacuaag

SEQ ID NO: 200236 - RNA, 64 nt, Human
gggcugaggcaggauuuggaaucaggccaugucuucuccagagcccacauccauccuuucucua

SEQ ID NO: 200237 - RNA, 64 nt, Human
gacugaaaauugaaugggcaaauaagugcuuuugucuccagaguaugcgggagacccuuccacc

SEQ ID NO: 200238 - RNA, 63 nt, Human
aauauuccgccggcauuuagaagacucuuggccucuccagagacgccccuuuccucguccgcu

SEQ ID NO: 200239 - RNA, 64 nt, Human
uuuaaugguacuuaguauuuugaucaaacuuuagucuccagaacuaaacaagucccuaaguuuc

SEQ ID NO: 200240 - RNA, 64 nt, Human
uuaaccuuucuuuauuauuaaagguuuucuauuuucuccagagaacuauaugaauguugcauag

SEQ ID NO: 200241 - RNA, 64 nt, Human
cccauccaaagauguccagauguccaugugcuagucuccagaacuuguaacuguguuguuaugu

SEQ ID NO: 200242 - RNA, 64 nt, Human
uguuauuucuaauaauacacuaucuugauuguacucuccagaaaauuuuucugucagugaaaau

SEQ ID NO: 200243 - RNA, 64 nt, Human
agucaaaagcuucagugaguuacaucucauucaaucuccagaagauugggauuaucgucuucua

SEQ ID NO: 200244 - RNA, 64 nt, Human
uucucccuuuugacacaguuguuucagaaagagcucuccagaagccaauauugagauguaauuc

SEQ ID NO: 200245 - RNA, 64 nt, Human
cagcagcgaggauccaucaucagaaucacagugcucuccagaccuccucucuaaacugcuucau

SEQ ID NO: 200246 - RNA, 64 nt, Human
cacauggaucucaaugccaauccuccauucuuccucuccagauauuuuugggagugacaaacau

SEQ ID NO: 200247 - RNA, 64 nt, Human
guagaagaaaaaaaaucuuucagauaagagguguucuccagaauggaggaacuacuuggcaugu

SEQ ID NO: 200248 - RNA, 64 nt, Human
guagaagaaaaaaaaucuuucagauaagagguguucuccagaauggaagaacgacuuggcaugu

SEQ ID NO: 200249 - RNA, 64 nt, Human
ccucacacugcugugcagccaucaccaccauucaucuccagaauuuguucucagucccaaacug

SEQ ID NO: 200250 - RNA, 64 nt, Human
ccaccaaagaagauggaaccagacuggaauucugucuccagagagaaacccagcuguuuggguc

SEQ ID NO: 200251 - RNA, 64 nt, Human
aauuaaguagauacuauuuagaaauguaaaauacucuccagaucuaccauuaauagaaaauaaa

SEQ ID NO: 200252 - RNA, 64 nt, Human
ugcaaauguaguuauacaaagaaaaauacagaugucuccagaccugaggacuuuuuaauagggc

SEQ ID NO: 200253 - RNA, 64 nt, Human
cugcaccuccagcuucuuucugaagcaugacccaucuccagagaugggauuugagaaaucagug

SEQ ID NO: 200254 - RNA, 64 nt, Human
caaaauaaggaagagggcugagcugagcuucgguucuccagaauguaagaaaacaaaaucuaaa

SEQ ID NO: 200255 - RNA, 64 nt, Human
ucauuagauuacauuguaguuaaacaaagcaauuucuccagacuuaaaacaugaugaguugagc

SEQ ID NO: 200256 - RNA, 64 nt, Human
caacuuucauagucccaaagauaggcagagaacaucuccagaaaugugugugugugugugugug

SEQ ID NO: 200257 - RNA, 64 nt, Human
cguggucaggcuccaccgcacagaagagccacagucuccagacucauggcguucccuccagaac

SEQ ID NO: 200258 - RNA, 64 nt, Human
ugagcuaacuuuuuuaaauugucacaaaagcgcaucuccagauuccagacccugccgcaugacu

SEQ ID NO: 200259 - RNA, 64 nt, Human
ccauaauuuucuucaaugaguuaauaaacagaaaucuccagaaccucugaaacacauucuugaa

SEQ ID NO: 200260 - RNA, 64 nt, Human
cacuauauuacagaaugauguaauaccugguaauucuccagaagauagacuucagacccuuaau

SEQ ID NO: 200261 - RNA, 64 nt, Human
uauuaauuguaaagccaagcuuaucaguugacucucuccagaauaaauaaucaucuguguggca

SEQ ID NO: 200262 - RNA, 64 nt, Human
ucaugcaguguacauuucagauaauuuccuucagucuccagauaggaguguauccaaacaucua

SEQ ID NO: 200263 - RNA, 64 nt, Human
cccucugugaggagcugugggaaguguggguuugucuccagaacagaagagaaugauggauauu

SEQ ID NO: 200264 - RNA, 64 nt, Human
aaugugcucaauugcaaugggccacauaccuagaucuccagaugucauuuccccucucuuauuu

SEQ ID NO: 200265 - RNA, 64 nt, Human
guuugcguuuuuagguuuacuuacauacagugacucuccagauuuuaaguugacaacucaguga

SEQ ID NO: 200266 - RNA, 64 nt, Human
ugccucuauaccaauaagucagucaccuugcuccucuccagaggcaaaguggaagagauccugc

SEQ ID NO: 200267 - RNA, 64 nt, Human
aauacuuccucuuaaaaaucuccaagaagcugggucuccagaucccauuuagaaccaaccaggu

SEQ ID NO: 200268 - RNA, 64 nt, Human
agaaauugacacaaguggaccuuaggccuuccucucuccagauguuuccagacuuccuugagac

SEQ ID NO: 200269 - RNA, 64 nt, Human
cccuuccuccaccacccugcucucaaaggccuccucuccagaccccuggaagggaggcuucccc

SEQ ID NO: 200270 - RNA, 64 nt, Human
gaagagggauuggggcaggggaggcagaaggggcucuccagaccccuuuuccaugaugacccac

SEQ ID NO: 200271 - RNA, 64 nt, Human
ccuucucccugacccugggcugcuuccugggggcucuccagaccccucucuaggaccaagucac

SEQ ID NO: 200272 - RNA, 64 nt, Human
gugaagcccaaaagcucuuaaggagaauuguauuucuccagaagcugcagcaagagguacagcu

SEQ ID NO: 200273 - RNA, 64 nt, Human
aaaucuuuuagaauuuuuuuggagguguuuguuuucuccagaauaaagguauuacuuuagaaua

SEQ ID NO: 200274 - RNA, 64 nt, Human
ucuaccccaaccccugaaacacacugaccccuauucuccagaugacagcacagcuguuugggac

SEQ ID NO: 200275 - RNA, 64 nt, Human
uggacaacuaacccgagcuggaccaacacaauucucuccagagacuuuugauuuuacuuuuaug

SEQ ID NO: 200276 - RNA, 64 nt, Human
ucuuggcuaaggugcuguuccuguuccugcaaggucuccagaaccccuuuggaaauggugaagg

SEQ ID NO: 200277 - RNA, 64 nt, Human
uuuucuguuugcuguuuuuuuguuuuguuuuuuuucuccagagcacuuuggucuagacuaggcu

SEQ ID NO: 200278 - RNA, 64 nt, Human
aguaacugagauggaauuuugugccuagcucaguucuccagaucuggcuaggagcagucaauga

SEQ ID NO: 200279 - RNA, 64 nt, Human
uuuaaacauuuuuuuuaaaaauuagccuugauauucuccagaccaaagcaaucauuaagugacu

SEQ ID NO: 200280 - RNA, 64 nt, Human
guuucuuucaucaucuucauugaacucuugggaaucuccagauaaucagauuauuucauuuggu

SEQ ID NO: 200281 - RNA, 64 nt, Human
auccagggcaaggacagacuaaaagagcauaucuucuccagaaguccuagaaacaucucaucau

SEQ ID NO: 200282 - RNA, 64 nt, Human
ggaacucucaguagauguuuguguuugucaagauucuccagacaaacuuccuuaaaaggauugg

SEQ ID NO: 200283 - RNA, 64 nt, Human
guauuuguaguccuaugaacagucuccucguguaucuccagagacugcaugugcaaaguaaaau

SEQ ID NO: 200284 - RNA, 64 nt, Human
gggggaugugagaaaugucucuucuguucauugcucuccagagaaugcuauggacaagaaucaa

SEQ ID NO: 200285 - RNA, 64 nt, Human
aauuuuccuuuuuucagcaccaguagguacuaagucuccagauggggaaauaacuaaaaugugu

SEQ ID NO: 200286 - RNA, 64 nt, Human
acugauuuaaaaguugauuuacuuuuuauuaaguucuccagagcugcacaacuaguuauguuuu

SEQ ID NO: 200287 - RNA, 64 nt, Human
gagauguuggcaccuuugaauucuacauccuguuucuccagaaugagaauuuguguacaaagau

SEQ ID NO: 200288 - RNA, 64 nt, Human
ucuggcuucugugauggugcaagaggcaggauggucuccagacaccuucuugcagagugauuuu

SEQ ID NO: 200289 - RNA, 64 nt, Human
gacgccaguagcaccccgaauugacaacccaaacucuccagacaucaccaacuguccccugcga

SEQ ID NO: 200290 - RNA, 64 nt, Human
ccaguagcacccccgcuagagcugugaaaaauucucuccagacauagucagaugucuccugggg

SEQ ID NO: 200291 - RNA, 64 nt, Human
ccccgccuuccccaaagcagaggggcugucugugucuccagaaaggggacaucgggggggaggg

SEQ ID NO: 200292 - RNA, 64 nt, Human
cugaguuugggcugcaagugcucacagcucuuguucuccagaaacuggagaauugcccucagga

SEQ ID NO: 200293 - RNA, 64 nt, Human
auuugugucgguuaaaaauucgaaggcuuaugggucuccagaaacucugccagccagccucagu

SEQ ID NO: 200294 - RNA, 64 nt, Human
ggcugacugguguagguuugguaggccucacugcucuccagaggcuaguguuccuaucccagga

SEQ ID NO: 200295 - RNA, 64 nt, Human
caacuuggcuacacauagacucuagucaguuuugucuccagaaccuuaggcuuuuguauuuuuu

SEQ ID NO: 200296 - RNA, 64 nt, Human
agagcaaacuaugaacgguuuuuuauucaagaugucuccagagugaagaugccgaggaugaacu

SEQ ID NO: 200297 - RNA, 64 nt, Human
ggaauaucaaguauaaugauguaguaaaaagauuucuccagaaaacacuuugagauacuuaaag

SEQ ID NO: 200298 - RNA, 64 nt, Human
gguaguucuguucuguggguuugugcuuccucuuucuccagaagccuucuggcugauuguuccg

SEQ ID NO: 200299 - RNA, 64 nt, Human
guuuuaucagaacacauucuuuuuuucuaccaacucuccagagcgugaguauaggagugccaug

SEQ ID NO: 200300 - RNA, 64 nt, Human
acuugauccccucccaccaauucuaaaguagcuuucuccagaucagacuuuaauuucucugcau

SEQ ID NO: 200301 - RNA, 64 nt, Human
cucugcccugagccaccacccuggacuggcccagucuccagagcuggcacacccugccuguuuu

SEQ ID NO: 200302 - RNA, 64 nt, Human
aagggugaaccaggccuuccacccugaccuugcaucuccagacuguuccagagaaggugcgggg

SEQ ID NO: 200303 - RNA, 64 nt, Human
ccucaaaccagcccaacccgagcuuuuggacagcucuccagaagcaugaacugcaguggagaug

SEQ ID NO: 200304 - RNA, 64 nt, Human
uguuucuuuucuauagagaaauguauaguuugacucuccagaauguacuauccaucuugaugag

SEQ ID NO: 200305 - RNA, 64 nt, Human
uggaucaggguggggacaaggacuggacccuccuucuccagaaggccuucagcucuugccuugc

SEQ ID NO: 200306 - RNA, 64 nt, Human
ucaauauaaauucuacagaaaauaguguucuuuuucuccagaaaaaugcuugugagaaucauua

SEQ ID NO: 200307 - RNA, 64 nt, Human
ccaggaacugauaagaagggaugaacucccguacucuccagaguacugaagauucuccccuccc

SEQ ID NO: 200308 - RNA, 64 nt, Human
ccuggcuccucacacuugccuccccuauggccgcucuccagacccuccuccuuucuucucccca

SEQ ID NO: 200309 - RNA, 64 nt, Human
accucuccaaccaccacacuccccgccguacaguucuccagaaucccaggcgaugacaagucug

SEQ ID NO: 200310 - RNA, 61 nt, Human
ggguuacuauuaaagcauagacaaguagcugucuccagacagugggaugugcuacauuguc

SEQ ID NO: 200311 - RNA, 64 nt, Human
gguuugguuuucuucuuaaagaguuuaguuuuccucuccagagggaucaggguccucuuaggga

SEQ ID NO: 200312 - RNA, 64 nt, Human
ccugcauugaauugaauaugaauuucucuaacucucuccagaaaauggauggagauaacuuguc

SEQ ID NO: 200313 - RNA, 64 nt, Human
ugugagauucuuuagccacuuuggggagccugucucuccagaagccuuucuuaguggugcccac

SEQ ID NO: 200314 - RNA, 64 nt, Human
agccaaagucagucugguguugucaguugacacaucuccagaguucaugacagcucaaccucuc

SEQ ID NO: 200315 - RNA, 64 nt, Human
gcaggcagcaacgcaagucaggcugaacauucagucuccagagacagcuguguggagcaaauca

SEQ ID NO: 200316 - RNA, 64 nt, Human
auccacuggccgaccgcagagugucccuaccuccucuccagagcaucauuccuuucuaucugcu

SEQ ID NO: 200317 - RNA, 64 nt, Human
aagugauaauuuuguguuuuucucauauaaguuuucuccagagcacccaccuucucuuccuucu

SEQ ID NO: 200318 - RNA, 64 nt, Human
agaguccacagucccuccucucaguucagucuugucuccagauggucguaggggagcguguggg

SEQ ID NO: 200319 - RNA, 64 nt, Human
cuggaggacaggagucgacgugaguuccugggagucuccagagauggggccuggaggccuggag

SEQ ID NO: 200320 - RNA, 64 nt, Human
ugauagggauccuggugggaggagagagggcacaucuccagaaaaaugaaaagcaauacaacuu

SEQ ID NO: 200321 - RNA, 64 nt, Human
ccccgggccagcacuuggcaggcaggaggugcggucuccagaguggugggccagggcgggcugg

SEQ ID NO: 200322 - RNA, 64 nt, Human
gcggcugggcuggugcagggagugugcugguuagucuccagacccucacagcagccacgccccc

SEQ ID NO: 200323 - RNA, 64 nt, Human
cuucauccucgccucucaggcuuuagauacgaaaucuccagaauggaaggggguggggauuuuc

SEQ ID NO: 200324 - RNA, 64 nt, Human
gacacugcaaaggcgcagugcuucucuacagacuucuccagacccaccacaccgcagaagcggg

SEQ ID NO: 200325 - RNA, 64 nt, Human
agaggacauguggauauccagccagaaugcccucucuccagaggacacacagcucuggauuucu

SEQ ID NO: 200326 - RNA, 64 nt, Human
uauuuuucuugaagaggcagcucaaaugucaccuucuccagaagcugcucuccacuugcuuuag

SEQ ID NO: 200327 - RNA, 64 nt, Human
agaggagaggagggggaggucauuuaucugagucucuccagaaguuuuuaaggcuacauuuugg

SEQ ID NO: 200328 - RNA, 64 nt, Human
uuguggaaaagaaauagaagucauggguguaaucucuccagaugacuucagcaguggcaggugu

SEQ ID NO: 200329 - RNA, 64 nt, Human
cccugagcaggucaggacucagaacagucuggcgucuccagacucucacaugcaguaugugcag

SEQ ID NO: 200330 - RNA, 64 nt, Human
uugcacuuuuuugggcugagcuguuagaggggcuucuccagaggcucgagagcaggccauuucc

SEQ ID NO: 200331 - RNA, 64 nt, Human
aacauugcgagaguagcuauuuugaaagaauaauucuccagaaguuaacaucuaauaucuagua

SEQ ID NO: 200332 - RNA, 64 nt, Human
ugacaacuuguugguaguuaggcacccaugaaugucuccagagacauccugagaggcaagauuc

SEQ ID NO: 200333 - RNA, 64 nt, Human
gcaaccuucauaccuuuaucuggaaaaugccuucucuccagacaauaagacaguucacaucugg

SEQ ID NO: 200334 - RNA, 64 nt, Human
caaaaucaccagcaccuugaucuuugacuucuaaucuccagaauagugagaaauaaauuucugu

SEQ ID NO: 200335 - RNA, 64 nt, Human
ggucccuccauggcacucuggguccucuccucacucuccagagacccucacauguccuuuugaa

SEQ ID NO: 200336 - RNA, 64 nt, Human
cagggauuaagugccuugcccaaggucaggcuuaucuccagagggaggugcccuggacuggggc

SEQ ID NO: 200337 - RNA, 64 nt, Human
cccugcuaagcaguuuauaguucuucuccauguuucuccagaauuaaucaguguuaguccucug

SEQ ID NO: 200338 - RNA, 64 nt, Human
agaagcccgagguagguggagggacuagaggacuucuccagacaugauucuucauagaguggua

SEQ ID NO: 200339 - RNA, 64 nt, Human
caaaagccuuggguuucucgcauucaguggccuaucuccagauugucugauuucugaauguaaa

SEQ ID NO: 200340 - RNA, 64 nt, Human
ucuacuagaccuccaggaacagacauggaccuucucuccagagcuccugaguggaaucaaguuc

SEQ ID NO: 200341 - RNA, 64 nt, Human
gaacacaugacgucagaucaaagaaaacagaucuucuccagauuggcagaaaguugauauaggu

SEQ ID NO: 200342 - RNA, 64 nt, Human
aaagagcagaugcauggccauuuuucuuugauguucuccagaguuuuacauuacacuugucugu

SEQ ID NO: 200343 - RNA, 64 nt, Human
ggacaguuuaaagaugaggcgccauaggcauccgucuccagagcccccaggaggcaggaaccag

SEQ ID NO: 200344 - RNA, 64 nt, Human
gagaacucaucagagugcggauugccaagacccuucuccagagauuaugggguuggggguggag

SEQ ID NO: 200345 - RNA, 64 nt, Human
aguaacagugcuuuugguuccuugaguucuccugucuccagauaccaaaugaccuugacuuuuc

SEQ ID NO: 200346 - RNA, 52 nt, Human
uugccugccucaucucuugaacucuccagaacaacucuaugaggaagaugcc

SEQ ID NO: 200347 - RNA, 64 nt, Human
ccccgugcuccuccuccuccuccucagggcugggucuccagagaguggggccuugguccugaga

SEQ ID NO: 200348 - RNA, 64 nt, Human
gaaucagcacagauaaaaaguggaauuucuuguuucuccagauuuuuaauacguuaauacgcag

SEQ ID NO: 200349 - RNA, 64 nt, Human
gacauggucacuuagagcuuaucuucccuaugaaucuccagaucugugagucgagcagauuuca

SEQ ID NO: 200350 - RNA, 64 nt, Human
uaagcugggaguaucacucuggaagaaaguaacaucuccagaugagaauuugaaacaagaaaca

SEQ ID NO: 200351 - RNA, 64 nt, Human
cuuagcaugguaaaccuggguuuuguucauauuuucuccagacagaaaugcaaagaucaaacug

SEQ ID NO: 200352 - RNA, 64 nt, Human
gcacagacagguuuucacauaaaugcagcccauuucuccagaacccauuugagggguggggggg

SEQ ID NO: 200353 - RNA, 64 nt, Human
ggggagugcguggugucagaucccauccugcuccucuccagaguuuccggucaccuccguguuc

SEQ ID NO: 200354 - RNA, 64 nt, Human
ggggagugcguggugucagaucccauccugcuccucuccagaguuuccucucaccuccguguuc

SEQ ID NO: 200355 - RNA, 64 nt, Human
aaaggguuuucaggaugaggaggucaagacaggaucuccagagcuaccgaguucaucugugggu

SEQ ID NO: 200356 - RNA, 64 nt, Human
cccagaccccaccugaucugcaucuuuguuugcaucuccagagacaccugaggccccagagcuu

SEQ ID NO: 200357 - RNA, 64 nt, Human
cccuuucacaggcagccagugcccugagccagggucuccagaaagccccacccaggccaggcau

SEQ ID NO: 200358 - RNA, 64 nt, Human
ucaguuccucuccuaaagacaaagguuagucugaucuccagacccgucagaauggaauacacag

SEQ ID NO: 200359 - RNA, 64 nt, Human
ccagcacaaacucucccuuccaccuuuacgacccucuccagaccagaccuggaguccucuucaa

SEQ ID NO: 200360 - RNA, 64 nt, Human
uuugcauaugaugccagccucacgcauuuguauaucuccagaaauucagguaugccucaccaau

SEQ ID NO: 200361 - RNA, 64 nt, Human
ugcuacucucauacaggggacccguauuuuaaaaucuccagacuugcuuacaucuagauuaucc

SEQ ID NO: 200362 - RNA, 64 nt, Human
ggucucauaaugcauguggcacuuagguccaaggucuccagagggugaaagcuggagucuguca

SEQ ID NO: 200363 - RNA, 64 nt, Human
aaguucuuguucuucaggagaugauucuguuuuuucuccagaccccaugccuuacgaaccaugc

SEQ ID NO: 200364 - RNA, 64 nt, Human
auccagacaugguuuuucccuccaggggccuuucucuccagagggcacuucggcugccucugcu

SEQ ID NO: 200365 - RNA, 64 nt, Human
uguggugugcacgugugcucugggcuccgaggcuucuccagagcugggagcuggcuggcguggc

SEQ ID NO: 200366 - RNA, 64 nt, Human
aauucacacaugacuaccuuugagcuaaugacugucuccagaaaauaacugugccccaagaagu

SEQ ID NO: 200367 - RNA, 64 nt, Human
aacucaggaugccaaguggcccucagauuacacuucuccagauagcugaaugagucugcuuuca

SEQ ID NO: 200368 - RNA, 64 nt, Human
uaguaccacuagcaccuauuccccacccagcgugucuccagauauugucaaauaucccaucggg

SEQ ID NO: 200369 - RNA, 64 nt, Human
cacugaaaauguuuuguuagcuuuuccuucuuucucuccagaagaaacauggauagaugauagc

SEQ ID NO: 200370 - RNA, 64 nt, Human
gccugcucuaauuucuuuugcccauauaugaguaucuccagaaugucuacaaauaguuuuugua

SEQ ID NO: 200371 - RNA, 64 nt, Human
auccucgccuggacucagggcaggugccguggguucuccagagaccccagcaacuggcccagga

SEQ ID NO: 200372 - RNA, 64 nt, Human
cagcucacuucucuguguucugccuccccucuggucuccagaguuuuccuguccucuagaggca

SEQ ID NO: 200373 - RNA, 64 nt, Human
aggggcacauggagugggacaggagggggcaccuucuccagaugaugucccuggagggggcagg

SEQ ID NO: 200374 - RNA, 64 nt, Human
cccaccguuccucagugugagcaagauuugggucucuccagaccucugggagguagggaguucc

SEQ ID NO: 200375 - RNA, 64 nt, Human
gauggcuuggcagagcaccuucgguuaacuugcaucuccagauugauuacucaagcagacagca

SEQ ID NO: 200376 - RNA, 64 nt, Human
uuggcagauuguauuggccagcaggaaagcaagcucuccagagaaugcccccaguuaaauaccu

SEQ ID NO: 200377 - RNA, 64 nt, Human
aauuacuauugaaagaccuuucaugaaauauaagucuccagagcacacaagaguauuucuucug

SEQ ID NO: 200378 - RNA, 64 nt, Human
uaggaacauugaugcugccucagacauccucuuuucuccagaguagggaagacucccacugauc

SEQ ID NO: 200379 - RNA, 64 nt, Human
cacugccucucuggacaccgggcuuuugcugggcucuccagagcugggcuuggcucuuccagcu

SEQ ID NO: 200380 - RNA, 64 nt, Human
ucugguuuuuaaaagauaaacaguuuagcccaucucuccagagagcaaacauaggaauaugacu

SEQ ID NO: 200381 - RNA, 64 nt, Human
aaagccagcagcugugguacuccagacaaaaggaucuccagaaagccgccuguccuuccagcau

SEQ ID NO: 200382 - RNA, 64 nt, Human
agaggacuuugacaaaagcaaggccccuuuucacucuccagauuuccuccuaccuaauggccua

SEQ ID NO: 200383 - RNA, 64 nt, Human
uacagaguuccuucucacccagacacacuagugcucuccagaaucucugcccaggaggcagggg

SEQ ID NO: 200384 - RNA, 64 nt, Human
augagagggccaccgcagagcccaggaggcagcaucuccagagcuggcccuucccaucuccccu

SEQ ID NO: 200385 - RNA, 64 nt, Human
uguggccuggaguauuuauauggugcuuaaugaaucuccagaaugccagccagaagccugauug

SEQ ID NO: 200386 - RNA, 64 nt, Human
agaauaaaauaagaacauguauaacaaaaagcucucuccagaucaucccugugaaugccaaagu

SEQ ID NO: 200387 - RNA, 64 nt, Human
uuacucauugcgucggaaagccaagccauuucugucuccagaguuguucucuuaaacugauaug

SEQ ID NO: 200388 - RNA, 64 nt, Human
uuuuauguugaacuaaaaaggauuaaaaaaaaaaucuccagacucaaguugcuaagaccuuuug

SEQ ID NO: 200389 - RNA, 64 nt, Human
uugagcuuccuccagcugugagaauaaguccuaaucuccagagaaaugguggggggaggaggag

SEQ ID NO: 200390 - RNA, 64 nt, Human
gaagaggauugagcuuugugucaccugccugcgcucuccagauaugaccccugcacccaccccc

SEQ ID NO: 200391 - RNA, 64 nt, Human
ccucuucuuucuccccagccuucucauuuccgccucuccagacacugcgcccuccacccucacu

SEQ ID NO: 200392 - RNA, 64 nt, Human
accacauuugccagaaaugcaguugcccugucccucuccagauguggggcuuucuccauauccu

SEQ ID NO: 200393 - RNA, 64 nt, Human
ggugcuaaggaggggagagggggcauccugucucucuccagaccaucacugcacuuuaaccagg

SEQ ID NO: 200394 - RNA, 64 nt, Human
aguugacacaaccccuucccccaauuuuuguggaucuccagagaggcccuucuuuggauucacc

SEQ ID NO: 200395 - RNA, 55 nt, Human
aagaggaagaggaggaguaauggugucuccagagacuuuacaucgguuccugucu

SEQ ID NO: 200396 - RNA, 64 nt, Human
uguguuuaagucgggauuuuuacagagggagcugucuccagacagcuccaucaggaaccaagca

SEQ ID NO: 200397 - RNA, 64 nt, Human
ccgugucuuuggggaucuuacaacuuuacuuuguucuccagaggccuggagaacacuuagggau

SEQ ID NO: 200398 - RNA, 64 nt, Human
agguaucaauccuugguuuuuaaacugugguccaucuccagacucuaccacuuacggacagaca

SEQ ID NO: 200399 - RNA, 64 nt, Human
cauggguucugugcuggagggugcacggccaagaucuccagacugcugguucccagggaacccu

SEQ ID NO: 200400 - RNA, 64 nt, Human
ccauggacagagaagaaaaugaccaggagugucaucuccagaauuauuggggucacauaugucc

SEQ ID NO: 200401 - RNA, 64 nt, Human
agucuucccaacuucuuacaccauugcuuuccauucuccagaacucuuuuuuccuuuuuacaaa

SEQ ID NO: 200402 - RNA, 64 nt, Human
caaagcauacaggucaauuaagaaagccccucucucuccagagccguuucccuagcuuuuggca

SEQ ID NO: 200403 - RNA, 64 nt, Human
gcaaaaggggcugggacacucugaacuccugcacucuccagaagugacuggucaugaagcucau

SEQ ID NO: 200404 - RNA, 64 nt, Human
ggaugcuuugaguuggacgugauacuguccauauucuccagaggauuaccuggcugaaccauug

SEQ ID NO: 200405 - RNA, 64 nt, Human
accuggacagugaagggagcccgggcagccaccgucuccagagcccugggcagcauuuuccagc

SEQ ID NO: 200406 - RNA, 64 nt, Human
gcacguggagggccuccuuccugcaauucuucccucuccagagucagggagggcugcccagccc

SEQ ID NO: 200407 - RNA, 64 nt, Human
gcagaucuugugguauaaaaaauaaccuuguaguucuccagauacuaagcuuguauaugauuau

SEQ ID NO: 200408 - RNA, 64 nt, Human
gcuacaggggcacauuuucugugguuaaaaaugaucuccagaauaaguguaaacugcaguuuuc

SEQ ID NO: 200409 - RNA, 64 nt, Human
aaaauguagcugcgucauaaggagacuucugucuucuccagaaggcaauaccaaccugaaaguu

SEQ ID NO: 200410 - RNA, 64 nt, Human
gaaagcugauagcuccuccauguugguaaaauccucuccagaaucuuggaacaccuggcaugug

SEQ ID NO: 200411 - RNA, 64 nt, Human
gccaugcaauuuuguuuacuagaauugauuacacucuccagagaucucuccauugugcaaauuu

SEQ ID NO: 200412 - RNA, 64 nt, Human
agugugaucauuguugaacuucagcuccagugucucuccagaauaagacauuggcauucaaaug

SEQ ID NO: 200413 - RNA, 64 nt, Human
uuguaaauuagcagaugacuuuuuuccauuguuuucuccagagagaaugugcuauauuuuugua

SEQ ID NO: 200414 - RNA, 64 nt, Human
ucaaagauuaaguaggaggagagggguuucuugcucuccagagcccaaagggacaaauagggac

SEQ ID NO: 200415 - RNA, 64 nt, Human
ucuaaaauugggcuugugauuuccauuucugaugucuccagauuggcaccccuuucuaguucaa

SEQ ID NO: 200416 - RNA, 64 nt, Human
auaauucucuacccucaccccacagagccaucucucuccagaccaaaagcuggaaggagaguug

SEQ ID NO: 200417 - RNA, 64 nt, Human
aauauaccuggggugaaauauaccaaauucugcaucuccagaggaaaauaagaaauaaagauga

SEQ ID NO: 200418 - RNA, 64 nt, Human
uugcaucauuuuaauuaugagucugacaaaaccuucuccagagaaucaagcaagaccuggaugu

SEQ ID NO: 200419 - RNA, 64 nt, Human
gagaaaugcuugcuuuauagcugcuccacccucaucuccagagauuuugugucuaugguugugg

SEQ ID NO: 200420 - RNA, 64 nt, Human
ucuucucuaucauggaaugaucuuuuuuauugaaucuccagauuuguauuugacagcuuggugg

SEQ ID NO: 200421 - RNA, 64 nt, Human
aucugcguggugcugggauguggggacucuggccucuccagacuaauguuccugucaccugcug

SEQ ID NO: 200422 - RNA, 64 nt, Human
caagggcagcaauaggcuggagcccgaagguauuucuccagauccacagggagaggucucaccc

SEQ ID NO: 200423 - RNA, 64 nt, Human
uccucaggccagcucuucugaggaggcucugcccucuccagaggugccagaccgcggauuuuau

SEQ ID NO: 200424 - RNA, 64 nt, Human
uccccucuaacuggacagccucuucugucccaagucuccagagagaaaucaggccugaugaggg

SEQ ID NO: 200425 - RNA, 64 nt, Human
uuaugauguggauccuacguauuuuuuaaaaaacucuccagauaauuuugaugucacgagucac

SEQ ID NO: 200426 - RNA, 64 nt, Human
ggaacaccagugaguguucaucugcagccuucccucuccagacagagcagcuacaccaguaaug

SEQ ID NO: 200427 - RNA, 64 nt, Human
aacguucaugucauuuuagaggauuauaugguugucuccagagaaauuaacuuacauuaucaaa

SEQ ID NO: 200428 - RNA, 64 nt, Human
acagaagcaagugcaaaaaugacacaagcacaacucuccagacguggcuccuucuccuuucuca

SEQ ID NO: 200429 - RNA, 64 nt, Human
uuuacucuuccgugucaacaaugugacuacauguucuccagauuagccacacaugcaaacauca

SEQ ID NO: 200430 - RNA, 64 nt, Human
cagugggaccuuguaaaaugcucccugucagagcucuccagaauaugcuuguuggagauccuuc

SEQ ID NO: 200431 - RNA, 64 nt, Human
auucauaaucagggguguccucuagcucccacggucuccagagcagcaaggccggcuauggagc

SEQ ID NO: 200432 - RNA, 64 nt, Human
uaacggugagggcugacucugaacugucucucagucuccagaaaguguucaagccuguuguguu

SEQ ID NO: 200433 - RNA, 64 nt, Human
ggcgguggaaauaauuaauaccauauuuuauacaucuccagagccuuucaucuugaggaucuca

SEQ ID NO: 200434 - RNA, 64 nt, Human
aguggcaaaaaaauagagcagaggguuucugcugucuccagacugucuaccaaagagaaggcga

SEQ ID NO: 200435 - RNA, 64 nt, Human
cagcauggcauauagugauauaugcuauuugcguucuccagauguuuauugaagauacagaucc

SEQ ID NO: 200436 - RNA, 64 nt, Human
gcugcugcauuuaucccaagaaaaacagcuuuaaucuccagaagaaaaccaaaauaccauggga

SEQ ID NO: 200437 - RNA, 64 nt, Human
uugaccuaaucagcuuacaguuugaaaaccuagcucuccagaacaugagaugagccagccgagc

SEQ ID NO: 200438 - RNA, 64 nt, Human
cugugaugaaaucuuguuaaccaccacuagggaaucuccagaugaacuauuaaugcacugucuu

SEQ ID NO: 200439 - RNA, 64 nt, Human
gaaaaucgcacuugucaaagacgacucaucuauuucuccagacuucaguaaagaaugaaaagua

SEQ ID NO: 200440 - RNA, 64 nt, Human
gaccucaaccccagggauucccaggaagcagaacucuccagaagaaggguuuugaucauuccag

SEQ ID NO: 200441 - RNA, 64 nt, Human
cuggaaagauauagcauagugguucucagcacagucuccagaacagaagcaucuguaguaccug

SEQ ID NO: 200442 - RNA, 64 nt, Human
uaaugaaggcucuggcccuaaccccucagcacugucuccagauaggaacaugcacaaagcaguu

SEQ ID NO: 200443 - RNA, 64 nt, Human
ccaugcuggucaucggcuugcccaggcuccagccucuccagauucugaggggucucagcccacc

SEQ ID NO: 200444 - RNA, 64 nt, Human
ggagcucauguuugugauccucuaucuggacagcucuccagaauccuguguugccccuguucug

SEQ ID NO: 200445 - RNA, 64 nt, Human
uacacuuuuauaaaaaucagauuuuucaguggucucuccagauauuaacaagaauuguugugua

SEQ ID NO: 200446 - RNA, 64 nt, Human
ccuccacugagccucugguucccauuucccagguucuccagagagcgggcauccagagaggagu

SEQ ID NO: 200447 - RNA, 64 nt, Human
ggggcggggcucgguccuugggggggcuuugagcucuccagacugugcccuuaccgccuucccc

SEQ ID NO: 200448 - RNA, 64 nt, Human
ugggcccgugggggcugcugccuggcaugacaucucuccagauuucuggcuuaaaaccaacuuu

SEQ ID NO: 200449 - RNA, 64 nt, Human
aacagagugaccagcucauugggagacaucccugucuccagagucuuucagaauccagcaggcu

SEQ ID NO: 200450 - RNA, 64 nt, Human
aucacacugggaguuggugcuucuugucucugggucuccagaguuugccccgccugugcacacc

SEQ ID NO: 200451 - RNA, 64 nt, Human
guuucagcugaguccaaguuguuuacucuguuccucuccagaggggcucucugucccaguuggg

SEQ ID NO: 200452 - RNA, 64 nt, Human
guugaucgucacgcucgcaucuauagauaacggcucuccagaccugagcuuuccgcgucagcaa

SEQ ID NO: 200453 - RNA, 64 nt, Human
gcacacggcgucaaaaccaagcugccggccacugucuccagaacgcaaggcuccaggcccgugu

SEQ ID NO: 200454 - RNA, 64 nt, Human
guucugcugagacugagcaccuuacagauauuuuucuccagaagauggugcuggguaauaaaau

SEQ ID NO: 200455 - RNA, 64 nt, Human
cucuccaucuaucggaccccaguuuccaucacuaucuccagagauguagcuauuaugcgcccgu

SEQ ID NO: 200456 - RNA, 64 nt, Human
cgaggugccgccuuggccgggcccccacgugucuucuccagaaugugucugucuuugccuggug

SEQ ID NO: 200457 - RNA, 64 nt, Human
aaugaucuguacuaucuagugucuaaaacacuauucuccagaaaaaucaaucauuuucuagccc

SEQ ID NO: 200458 - RNA, 64 nt, Human
gcuugaagccaagucagcuuugccuuccacgcugucuccagacccccaccccuuccccacugcc

SEQ ID NO: 200459 - RNA, 64 nt, Human
ucaaagaugaacaucggaauaacaaacauuguccucuccagaaaguccuuucuuucuccauacu

SEQ ID NO: 200460 - RNA, 64 nt, Human
agcguggaggcgugugcaggcuuggaagaagaacucuccagaacauggaacuuaacccucuuuu

SEQ ID NO: 200461 - RNA, 64 nt, Human
ugggcaggccagauuccuccccagcagccgggucucuccagacccugauucggugccuuucugu

SEQ ID NO: 200462 - RNA, 64 nt, Human
ucagcugguguuagccgggcggaguguguuagucucuccagagggaggcugguuccccagggaa

SEQ ID NO: 200463 - RNA, 64 nt, Human
agaguccuaacuaaugggauccagcagggccauuucuccagagggccaguauccuauuaggaga

SEQ ID NO: 200464 - RNA, 64 nt, Human
gaggguaacuggggggccaccaugaccccuucucucuccagaaacagcugcuucuccccccauc

SEQ ID NO: 200465 - RNA, 64 nt, Human
ugccuucuucauccuuccuuacgaucaaucacagucuccagaagaucagcucaauugcugugca

SEQ ID NO: 200466 - RNA, 64 nt, Human
cagggggcccuuaagaagguucagagaccagccuucuccagaggcugucacugcaggagccgug

SEQ ID NO: 200467 - RNA, 64 nt, Human
aaagagccuucccauugaauugaaggggagaacgucuccagacagaauucuacaucggucuaau

SEQ ID NO: 200468 - RNA, 64 nt, Human
ucuuacauacugauauuuagaaaggugcuuuuguucuccagacuccagugauucugcacugggc

SEQ ID NO: 200469 - RNA, 64 nt, Human
gaaauuucucucuuuuuucucuauaaauucugacucuccagacuugucuggcuauaaccccugu

SEQ ID NO: 200470 - RNA, 64 nt, Human
cacagcagcccugaacaaccaguaugugucuucuucuccagauagugaaaaagguguccagaua

SEQ ID NO: 200471 - RNA, 64 nt, Human
cuucccucauccacagcuucucacugccgaaguuucuccagauuucuccaauguguccugacag

SEQ ID NO: 200472 - RNA, 64 nt, Human
aaggugcuucagagacuagauguaucugagagggucuccagaccagguuacugcaaaaaugagg

SEQ ID NO: 200473 - RNA, 61 nt, Human
gaaaagguguccuuuuguaaaaaucagcaauucuccagaggacuaucucacauaagucauc

SEQ ID NO: 200474 - RNA, 64 nt, Human
aggaaggaaaaugaagagagccaguauuuccccuucuccagaagcagguacucagcuuucuggg

SEQ ID NO: 200475 - RNA, 64 nt, Human
gcgccacggcugguauucugcaggcugaaugcagucuccagacuggaaacgcagagcggcuccu

SEQ ID NO: 200476 - RNA, 64 nt, Human
cccaacccuggagacacccugaagguucacuggcucuccagauuagccucucuuccucugucag

SEQ ID NO: 200477 - RNA, 64 nt, Human
cauucacaaacuuugcaagcgugguccagggccuucuccagaucuguuccaacuuggaguguga

SEQ ID NO: 200478 - RNA, 64 nt, Human
ccauccuaucccuugacauacuuaaucauauaucucuccagagaacucaccugacaaaugucuc

SEQ ID NO: 200479 - RNA, 64 nt, Human
guuuuguguuuuuugguggguuucuuuccuuggcucuccagauuuacuuuuggggccuguucua

SEQ ID NO: 200480 - RNA, 64 nt, Human
ggaaucccccgcugcagggacacccacgcccuucucuccagaagccgggcaggcagaauccggc

SEQ ID NO: 200481 - RNA, 64 nt, Human
ucgagggagaggaggggguuggggaggacccaccucuccagaauggcgacuguccccauccgcc

SEQ ID NO: 200482 - RNA, 64 nt, Human
cccacacccggcccccccaccuaaccacagcgccucuccagaccuaccucgggaccuaauguuc

SEQ ID NO: 200483 - RNA, 64 nt, Human
cccuguguacagcgagugaauuaaaaugucugccucuccagacauuucuuaaugauuccacuua

SEQ ID NO: 200484 - RNA, 64 nt, Human
gcgugaaaaugaauggaaguggcuggaugggacaucuccagacuacaaguaaguacucagaagc

SEQ ID NO: 200485 - RNA, 64 nt, Human
uucuguccugcuuugccuuuugucacuagaauguucuccagaaaccccaguuucugucaucuua

SEQ ID NO: 200486 - RNA, 64 nt, Human
cuucagcgugaauuaauuuuuaaucaguuugcuuucuccagagaaauuuuaaaauaauagaaga

SEQ ID NO: 200487 - RNA, 64 nt, Human
ucauucucagaaaauccaaccauaucuuagaguaucuccagaaacuggcuuagaggagcuccaa

SEQ ID NO: 200488 - RNA, 56 nt, Human
uccagcguugcacgccauaaccauuuucuccagaagcguggaggaaagauuaugaa

SEQ ID NO: 200489 - RNA, 64 nt, Human
uggugauacuccaacaccguccaguuguggcagcucuccagaaguaauagcagcugacaacuuu

SEQ ID NO: 200490 - RNA, 64 nt, Human
cugccucucagugccccugcccuaggggugucugucuccagaggggagggacaaauccccuacu

SEQ ID NO: 200491 - RNA, 64 nt, Human
ggccacagccacaccucaccgcccaguccagcugucuccagaaggggacaggcaguccgcgguc

SEQ ID NO: 200492 - RNA, 63 nt, Human
cugucccagcuagcaccugagagcugggccuccucuccagaaucauguggaggggccagaggc

SEQ ID NO: 200493 - RNA, 64 nt, Human
uaauuuucucggaggugauaggcuuccacacaggucuccagaagcccugcauugaauauccauc

SEQ ID NO: 200494 - RNA, 64 nt, Human
ucucacccucuuucucuuuccuucccucccccauucuccagaucucccucugucuccuuuucuc

SEQ ID NO: 200495 - RNA, 64 nt, Human
ucuugcuagggcuucccccuucuccccaucccggucuccagagacccagcuucugagagacagg

SEQ ID NO: 200496 - RNA, 64 nt, Human
ugcagaggcucacagguggcacacaggcgcugucucuccagagccauccuucagaguggaccuc

SEQ ID NO: 200497 - RNA, 64 nt, Human
cuccagauggccuccugagcuggacgaccccaggucuccagacaucuagggaccagagcagguu

SEQ ID NO: 200498 - RNA, 64 nt, Human
cugcucccauucacgucaauaccaagaaccauguucuccagagaauaaauuuaauuuaugacag

SEQ ID NO: 200499 - RNA, 64 nt, Human
caucccagacgccacaccugcugugucccgagagucuccagaugggggcaucagggugaggucc

SEQ ID NO: 200500 - RNA, 64 nt, Human
ccagccucaacagugggcauggacaggguuaaugucuccagaguguacacugcaggcagccaca

SEQ ID NO: 200501 - RNA, 64 nt, Human
ggugggagguaggcuguggggugggcuggaguccucuccagagaggcucaacaaggaaaaaugc

SEQ ID NO: 200502 - RNA, 64 nt, Human
ggaggggcguuagagccagcagggaccucccaugucuccagauuccaggugcagguucuuagca

SEQ ID NO: 200503 - RNA, 64 nt, Human
cauacuaagugcuuaguaaauguuagauaaguauucuccagaauugauguaaauuauuuuuaaa

SEQ ID NO: 200504 - RNA, 64 nt, Human
auguuauauaaauuccacauuuuuaugcaacuaaucuccagaacauuuuuccucuuaccaagaa

SEQ ID NO: 200505 - RNA, 64 nt, Human
cuggaguggaagcugcaccuuugggaagaauuccucuccagaccuggcagagccuggugugggg

SEQ ID NO: 200506 - RNA, 64 nt, Human
cgaggcgggaggccggcugugcugcaggaacccaucuccagaugccaaaggacuugaggggcag

SEQ ID NO: 200507 - RNA, 64 nt, Human
ccucuccagaugagaguacaccccaacagcacccucuccagaugcagccccaucuccucagcac

SEQ ID NO: 200508 - RNA, 64 nt, Human
ccucuccagaugagaguacaccccaacagcacccucuccagaugagaguacaccccaacagcac

SEQ ID NO: 200509 - RNA, 64 nt, Human; identical to SEQ ID NO: 200508

SEQ ID NO: 200510 - RNA, 64 nt, Human
cccucuccagaugggagugcccccaacagcacccucuccagaugagaguacaccccaacagcac

SEQ ID NO: 200511 - RNA, 64 nt, Human
ccugccuucccaggaguacaccccaacagcacccucuccagaugggagugcccccaacagcacc

SEQ ID NO: 200512 - RNA, 64 nt, Human
caaaucacuugucucuguuccucagaguuguaggucuccagauauguccccagugcuccacauu

SEQ ID NO: 200513 - RNA, 64 nt, Human
gccaacuuccucccugcccagccuuccuuguaucucuccagacucggacaaucaaagggagaga

SEQ ID NO: 200514 - RNA, 64 nt, Human
aagagcagaguuaagaucuaccaaacugaaggggucuccagauuaucuuggaggggacaggagg

SEQ ID NO: 200515 - RNA, 64 nt, Human
auggcagucacagggggccugugucacagugccaucuccagacucaaggacucccaugcccacc

SEQ ID NO: 200516 - RNA, 64 nt, Human
auuugaaaaugugcugauucuuugaauguuuuauucuccagauuuaugcacuuuuuuucuucag

SEQ ID NO: 200517 - RNA, 64 nt, Human
auuugaaaaugugcugauucuuggaauguuucauucuccagauuuaugaacauuuuuucuugag

SEQ ID NO: 200518 - RNA, 64 nt, Human
auuugaaaaugugcugauucuuugaauguuuuauucuccagauuuaugaacuuuuuuucuugag

SEQ ID NO: 200519 - RNA, 64 nt, Human
auuggaaaaugugcugauucuuugaauguuuuauucuccagauuuaugaacuuuuuuucuucag

SEQ ID NO: 200520 - RNA, 64 nt, Human
gcacaggaaaccaggcagaggaggcacagggugcucuccagaacgagaagccagcuccuggagu

SEQ ID NO: 200521 - RNA, 64 nt, Human
uuccucaacacuugagggcccagaaagucugaucucuccagaaugaucagcccagaggaaugcu

SEQ ID NO: 200522 - RNA, 64 nt, Human
uaaauauaauaaacuaauuuaagaagugauaaagucuccagaugcaguagcucacacuguaauc

SEQ ID NO: 200523 - RNA, 64 nt, Human
uuugccuugaagaggaacagaugaauaugcaccuucuccagaguuaugugguuuuagaauuuag

SEQ ID NO: 200524 - RNA, 64 nt, Human
cuugcuuugucauugggcauggagagaacccauuucuccagacuuuuaccuacccgugccugag

SEQ ID NO: 200525 - RNA, 64 nt, Human
gaaaacgcaagggaaguuucauuccauuuauacuucuccagacccccugccauccucugcugcu

SEQ ID NO: 200526 - RNA, 64 nt, Human
ccauuggcuccaggggcuguaugggcagauucagucuccagaggguauucagaucaucugcuuc

SEQ ID NO: 200527 - RNA, 64 nt, Human
cggagacaagcauggugcugcugcuucugcugcuucuccagaaaaucccugggacaccuuuguu

SEQ ID NO: 200528 - RNA, 64 nt, Human
uguggggcaccggcugccuuuccccagggaauccucuccagaucuuaaccaagagccccuugca

SEQ ID NO: 200529 - RNA, 64 nt, Human
cuugcucagccaucccgucuucuccaacaccaccucuccagaggccaaggaggccuuggaaacg

SEQ ID NO: 200530 - RNA, 64 nt, Human
cucuuugcaggcguccaauccuagaaaccaauggucuccagaacucucacacaaguguuuuucu

SEQ ID NO: 200531 - RNA, 64 nt, Human
uuucgggaaugggaacuggugggcaguguccagcucuccagagggguguguguaugcgugugcg

SEQ ID NO: 200532 - RNA, 64 nt, Human
cugguuggaaaugucguuggaaacuugcaaagacucuccagaccuuagggaacaagaggcauca

SEQ ID NO: 200533 - RNA, 64 nt, Human
ucccacacuuuaggggguugguaucucgugcucuucuccagagauuacaaaaauguagcuucuc

SEQ ID NO: 200534 - RNA, 64 nt, Human
cuccugugugccccuggcuuucugggucugugccucuccagaaucuugucuuacccuccggugu

SEQ ID NO: 200535 - RNA, 64 nt, Human
uuagucuaauaauuucaguuaggcgcucaucaguucuccagagugguugaguuuguaauaccuu

SEQ ID NO: 200536 - RNA, 64 nt, Human
acacagagcuaguuagcuaguagcaaccguguuuucuccagaucugucuagauacaaaggucag

SEQ ID NO: 200537 - RNA, 64 nt, Human
uuuggaaacauuuaauuuauaccccucuccucugucuccagaagcuucuagcucuggggucugg

SEQ ID NO: 200538 - RNA, 64 nt, Human
ggauaccaugggaaggagccaucuccacucuccuucuccagaacccccuugaagggccuuuggg

SEQ ID NO: 200539 - RNA, 64 nt, Human
auagugggcccccuacauacgcauggauucugggucuccagauuggaacagaggauggagcuaa

SEQ ID NO: 200540 - RNA, 64 nt, Human
ggccaccaggacucaccucccucuucauuuaggaucuccagauacuggauagccagcauccucu

SEQ ID NO: 200541 - RNA, 64 nt, Human
cucacagggagcuggcaaugcccuaccugccuguucuccagauggagaaacaggcucugagauu

SEQ ID NO: 200542 - RNA, 64 nt, Human
ccaucuccuaccccacauccugucuuagccgcagucuccagaacccaugaugaacugugaucug

SEQ ID NO: 200543 - RNA, 64 nt, Human
caucucagauggggaaggcaccuucuuccucgccucuccagauuguccuggaaccuccaggauc

SEQ ID NO: 200544 - RNA, 64 nt, Human
agauuaccuacuauuuuaugauaaaauguaguugucuccagagcuuaaauauaauuuguaaagc

SEQ ID NO: 200545 - RNA, 64 nt, Human
aguggcacaaucacaguucacugcagccucaaccucuccagauucaagugauccucccaucuca

SEQ ID NO: 200546 - RNA, 64 nt, Human
uuucuauaacagaagugacauguguacugauuuuucuccagaaauauggaugcuguuguauuca

SEQ ID NO: 200547 - RNA, 64 nt, Human
uuccuaggccuuuucaugcuucauuucuuccacuucuccagaaaauggaagcuaugaagcaaca

SEQ ID NO: 200548 - RNA, 64 nt, Human
gguccggccggagaggccucccgcggacgccgucucuccagaacuccgcuuccaagagggagcc

SEQ ID NO: 200549 - RNA, 64 nt, Human
uguuuucaauuuauauuuucacaacuacuuucucucuccagagcuuucaucugauaucucacaa

SEQ ID NO: 200550 - RNA, 64 nt, Human
ucagauggaaaagggaggcagggugggcuuccguucuccagaucuguuugcucuuaacaggcag

SEQ ID NO: 200551 - RNA, 64 nt, Human
guagacaggcuggauuccaguguugggacagccaucuccagaaaccugacuuaagagaguaaga

SEQ ID NO: 200552 - RNA, 64 nt, Human
augcugguucccggaaugaaucagcugcugacugucuccagaagggcuggaaaggaugcugcca

SEQ ID NO: 200553 - RNA, 57 nt, Human
guaucucuuccugcugcugagcaugaaucuccagacccgcugcucccagugcagaug

SEQ ID NO: 200554 - RNA, 57 nt, Human
gcaccccuuccugcugcugagcaugaaucuccagacccgcugcucccagugcagaug

SEQ ID NO: 200555 - RNA, 64 nt, Human
cccugccucagcucccugcccagccagccuccugucuccagagaaguucuccauuaaaaaauaa

SEQ ID NO: 200556 - RNA, 64 nt, Human
caguaaaaugccuggggucccugcugccucucaaucuccagagccauguccauggggagguggg

SEQ ID NO: 200557 - RNA, 64 nt, Human
gucugccuucuggcugacaauccuggaaaucuguucuccagaauccaggccaaaaaguucacag

SEQ ID NO: 200558 - RNA, 64 nt, Human
ccugacccagccaguccagcucugccuugccggcucuccagaguagacauagugugugggguug

SEQ ID NO: 200559 - RNA, 64 nt, Human
guuggacucucuucuggagacccagacaauucagucuccagauuucuggcaguggcugucuuuu

SEQ ID NO: 200560 - RNA, 64 nt, Human
aucaccgaggcucccgugacuuugaacucccuacucuccagaauccaggggcuauagcgauggg

SEQ ID NO: 200561 - RNA, 64 nt, Human
ugggaucagugcucucuauugauguucuugcuggucuccagacacauuccuguugcauuaagac

SEQ ID NO: 200562 - RNA, 64 nt, Human
acaaaugcugcacuauugguucuuaaguuuuuuaucuccagauccuaauuuaugccuaugcaaa

SEQ ID NO: 200563 - RNA, 64 nt, Human
uucgugagcugaggcccucgcuuuggucauuugcucuccagauugggugugagcuucucuguga

SEQ ID NO: 200564 - RNA, 64 nt, Human
uuggagucccgugucgucuccacccagaggaaguucuccagaguucaccuuucccuuuuccuug

SEQ ID NO: 200565 - RNA, 64 nt, Human
gggcagccccuucugcccaccccauccuucuuccucuccagagaugccaggggggcguguaugc

SEQ ID NO: 200566 - RNA, 64 nt, Human
gcuuugccccuguuugaagaccucccuucuugccucuccagacguguuccccgaggagaucuuc

SEQ ID NO: 200567 - RNA, 64 nt, Human
ugggcucugggaacaggggacuacuuuggggcuuucuccagacuuuuguauguuguuauuaaaa

SEQ ID NO: 200568 - RNA, 64 nt, Human
cggcauggacacagaaaagcuacgccggcuggccucuccagaccaguucccaggcugggucugc

SEQ ID NO: 200569 - RNA, 64 nt, Human
uaccuuaaaauucacacauuuaaaguuuuuagugucuccagacacagugguucaugccugugag

SEQ ID NO: 200570 - RNA, 64 nt, Human
caugaaggagaaccugguggcauugccccagagcucuccagagaugagccuccccuauccccac

SEQ ID NO: 200571 - RNA, 64 nt, Human
ugugccccuaaagagcauccugauaccauucuauucuccagacauggaggggaugauaaaggaa

SEQ ID NO: 200572 - RNA, 64 nt, Human
ccuuagccuccagguccagacuacuacucuauguucuccagaagggugcuaagucaccuacuga

SEQ ID NO: 200573 - RNA, 64 nt, Human
gauggcucuuaagaaucaggcagucgcccacuucucuccagaugaagggaagacauucauaggu

SEQ ID NO: 200574 - RNA, 64 nt, Human
cugccuaugaggcaucuggccccugguagccagcucuccagaauuacuuguagguaauuccucu

SEQ ID NO: 200575 - RNA, 64 nt, Human
ggcaaggccagagacuucaagucuaucugaaaagucuccagaagucuaaccccagauaaauagc

SEQ ID NO: 200576 - RNA, 64 nt, Human
ggcaaggccagagacuucaagucuaucugaaaagucuccagaggucuaaccccagauaaauagc

SEQ ID NO: 200577 - RNA, 64 nt, Human
cucugccuaaggugauuuuguaguucuuaacaguucuccagagcaucuugaacaggaauauuaa

SEQ ID NO: 200578 - RNA, 64 nt, Human
ggaaagagagaaggaaagagagagagaaagaaagucuccagaccaggaauguuuuugucccacu

SEQ ID NO: 200579 - RNA, 64 nt, Human
ugcacccucccccaaguugagacaaccaaaaaugucuccagauauugccagcuaccccuugagg

SEQ ID NO: 200580 - RNA, 64 nt, Human
cuauaaagaaucauuagaaauuaugaguggaaauucuccagaaagauaguauuauagagucuuu

SEQ ID NO: 200581 - RNA, 64 nt, Human
agcugcucuccuguauuauccuccacaauaaaauucuccagaaaauaagucccagugucugcug

SEQ ID NO: 200582 - RNA, 64 nt, Human
ucagugagaggaagcugacuagccccuggauucuucuccagaccccccugcuucaggaacaccc

SEQ ID NO: 200583 - RNA, 64 nt, Human
gaaaaaggucaagauuucuaucacuuccccgucuucuccagaacuugugucuccagaggaguac

SEQ ID NO: 200584 - RNA, 64 nt, Human
uucuaucacuuccccgucuucuccagaacuugugucuccagaggaguacgccgacuucagcagc

SEQ ID NO: 200585 - RNA, 64 nt, Human
uuaacauuccgacauacaucauucugugauuaaaucuccagauuucuguaaaugauaccuacau

SEQ ID NO: 200586 - RNA, 64 nt, Human; identical to SEQ ID NO: 200585

SEQ ID NO: 200587 - RNA, 64 nt, Human; identical to SEQ ID NO: 187807

SEQ ID NO: 200588 - RNA, 64 nt, Human; identical to SEQ ID NO: 187808

SEQ ID NO: 200589 - RNA, 64 nt, Human; identical to SEQ ID NO: 187812

SEQ ID NO: 200590 - RNA, 64 nt, Human; identical to SEQ ID NO: 187813

SEQ ID NO: 200591 - RNA, 64 nt, Human; identical to SEQ ID NO: 187814

SEQ ID NO: 200592 - RNA, 64 nt, Human; identical to SEQ ID NO: 187815

SEQ ID NO: 200593 - RNA, 64 nt, Human; identical to SEQ ID NO: 187816

SEQ ID NO: 200594 - RNA, 64 nt, Human; identical to SEQ ID NO: 187817

SEQ ID NO: 200595 - RNA, 64 nt, Human; identical to SEQ ID NO: 187818

SEQ ID NO: 200596 - RNA, 64 nt, Human; identical to SEQ ID NO: 187819

SEQ ID NO: 200597 - RNA, 64 nt, Human; identical to SEQ ID NO: 187820

SEQ ID NO: 200598 - RNA, 64 nt, Human; identical to SEQ ID NO: 187821

SEQ ID NO: 200599 - RNA, 64 nt, Human; identical to SEQ ID NO: 187822

SEQ ID NO: 200600 - RNA, 64 nt, Human; identical to SEQ ID NO: 187823

SEQ ID NO: 200601 - RNA, 64 nt, Human; identical to SEQ ID NO: 187824

SEQ ID NO: 200602 - RNA, 64 nt, Human; identical to SEQ ID NO: 187825

SEQ ID NO: 200603 - RNA, 64 nt, Human; identical to SEQ ID NO: 187826

SEQ ID NO: 200604 - RNA, 64 nt, Human; identical to SEQ ID NO: 187827

SEQ ID NO: 200605 - RNA, 64 nt, Human; identical to SEQ ID NO: 187831

SEQ ID NO: 200606 - RNA, 64 nt, Human; identical to SEQ ID NO: 187832

SEQ ID NO: 200607 - RNA, 64 nt, Human; identical to SEQ ID NO: 187833

SEQ ID NO: 200608 - RNA, 64 nt, Human; identical to SEQ ID NO: 187834

SEQ ID NO: 200609 - RNA, 64 nt, Human; identical to SEQ ID NO: 187835

SEQ ID NO: 200610 - RNA, 64 nt, Human; identical to SEQ ID NO: 187836

SEQ ID NO: 200611 - RNA, 64 nt, Human; identical to SEQ ID NO: 187837

SEQ ID NO: 200612 - RNA, 64 nt, Human; identical to SEQ ID NO: 187838

SEQ ID NO: 200613 - RNA, 64 nt, Human; identical to SEQ ID NO: 187839

SEQ ID NO: 200614 - RNA, 64 nt, Human; identical to SEQ ID NO: 187840

SEQ ID NO: 200615 - RNA, 64 nt, Human; identical to SEQ ID NO: 187841

SEQ ID NO: 200616 - RNA, 64 nt, Human; identical to SEQ ID NO: 187842

SEQ ID NO: 200617 - RNA, 64 nt, Human; identical to SEQ ID NO: 187843

SEQ ID NO: 200618 - RNA, 64 nt, Human; identical to SEQ ID NO: 187844

SEQ ID NO: 200619 - RNA, 64 nt, Human; identical to SEQ ID NO: 187845

SEQ ID NO: 200620 - RNA, 64 nt, Human; identical to SEQ ID NO: 187846

SEQ ID NO: 200621 - RNA, 64 nt, Human; identical to SEQ ID NO: 187850

SEQ ID NO: 200622 - RNA, 64 nt, Human; identical to SEQ ID NO: 187851

SEQ ID NO: 200623 - RNA, 64 nt, Human; identical to SEQ ID NO: 187852

SEQ ID NO: 200624 - RNA, 64 nt, Human; identical to SEQ ID NO: 187853

SEQ ID NO: 200625 - RNA, 64 nt, Human; identical to SEQ ID NO: 187854

SEQ ID NO: 200626 - RNA, 64 nt, Human; identical to SEQ ID NO: 187855

SEQ ID NO: 200627 - RNA, 64 nt, Human; identical to SEQ ID NO: 187856

SEQ ID NO: 200628 - RNA, 64 nt, Human; identical to SEQ ID NO: 187857

SEQ ID NO: 200629 - RNA, 64 nt, Human; identical to SEQ ID NO: 187858

SEQ ID NO: 200630 - RNA, 64 nt, Human; identical to SEQ ID NO: 187859

SEQ ID NO: 200631 - RNA, 64 nt, Human; identical to SEQ ID NO: 187860

SEQ ID NO: 200632 - RNA, 64 nt, Human; identical to SEQ ID NO: 187861

SEQ ID NO: 200633 - RNA, 64 nt, Human; identical to SEQ ID NO: 187862

SEQ ID NO: 200634 - RNA, 64 nt, Human; identical to SEQ ID NO: 187863

SEQ ID NO: 200635 - RNA, 64 nt, Human; identical to SEQ ID NO: 187864

SEQ ID NO: 200636 - RNA, 64 nt, Human; identical to SEQ ID NO: 187865

SEQ ID NO: 200637 - RNA, 64 nt, Human; identical to SEQ ID NO: 187869

SEQ ID NO: 200638 - RNA, 64 nt, Human; identical to SEQ ID NO: 187870

SEQ ID NO: 200639 - RNA, 64 nt, Human; identical to SEQ ID NO: 187871

SEQ ID NO: 200640 - RNA, 64 nt, Human; identical to SEQ ID NO: 187874

SEQ ID NO: 200641 - RNA, 64 nt, Human; identical to SEQ ID NO: 187875

SEQ ID NO: 200642 - RNA, 64 nt, Human; identical to SEQ ID NO: 187877

SEQ ID NO: 200643 - RNA, 64 nt, Human; identical to SEQ ID NO: 187872

SEQ ID NO: 200644 - RNA, 64 nt, Human; identical to SEQ ID NO: 187873

SEQ ID NO: 200645 - RNA, 64 nt, Human; identical to SEQ ID NO: 187876

SEQ ID NO: 200646 - RNA, 64 nt, Human; identical to SEQ ID NO: 187878

SEQ ID NO: 200647 - RNA, 64 nt, Human; identical to SEQ ID NO: 187879

SEQ ID NO: 200648 - RNA, 64 nt, Human; identical to SEQ ID NO: 187880

SEQ ID NO: 200649 - RNA, 64 nt, Human; identical to SEQ ID NO: 187881

SEQ ID NO: 200650 - RNA, 64 nt, Human; identical to SEQ ID NO: 187882

SEQ ID NO: 200651 - RNA, 64 nt, Human; identical to SEQ ID NO: 187883

SEQ ID NO: 200652 - RNA, 64 nt, Human; identical to SEQ ID NO: 187884

SEQ ID NO: 200653 - RNA, 64 nt, Human; identical to SEQ ID NO: 187888

SEQ ID NO: 200654 - RNA, 64 nt, Human; identical to SEQ ID NO: 187889

SEQ ID NO: 200655 - RNA, 64 nt, Human; identical to SEQ ID NO: 187890

SEQ ID NO: 200656 - RNA, 64 nt, Human; identical to SEQ ID NO: 187891

SEQ ID NO: 200657 - RNA, 64 nt, Human; identical to SEQ ID NO: 187892

SEQ ID NO: 200658 - RNA, 64 nt, Human; identical to SEQ ID NO: 187893

SEQ ID NO: 200659 - RNA, 64 nt, Human; identical to SEQ ID NO: 187894

SEQ ID NO: 200660 - RNA, 64 nt, Human; identical to SEQ ID NO: 187895

SEQ ID NO: 200661 - RNA, 64 nt, Human; identical to SEQ ID NO: 187896

SEQ ID NO: 200662 - RNA, 64 nt, Human; identical to SEQ ID NO: 187897

SEQ ID NO: 200663 - RNA, 64 nt, Human; identical to SEQ ID NO: 187898

SEQ ID NO: 200664 - RNA, 64 nt, Human; identical to SEQ ID NO: 187899

SEQ ID NO: 200665 - RNA, 64 nt, Human; identical to SEQ ID NO: 187900

SEQ ID NO: 200666 - RNA, 64 nt, Human; identical to SEQ ID NO: 187901

SEQ ID NO: 200667 - RNA, 64 nt, Human; identical to SEQ ID NO: 187902

SEQ ID NO: 200668 - RNA, 64 nt, Human; identical to SEQ ID NO: 187903

SEQ ID NO: 200669 - RNA, 64 nt, Human; identical to SEQ ID NO: 187907

SEQ ID NO: 200670 - RNA, 64 nt, Human; identical to SEQ ID NO: 187908

SEQ ID NO: 200671 - RNA, 64 nt, Human; identical to SEQ ID NO: 187909

SEQ ID NO: 200672 - RNA, 64 nt, Human; identical to SEQ ID NO: 187910

SEQ ID NO: 200673 - RNA, 64 nt, Human; identical to SEQ ID NO: 187911

SEQ ID NO: 200674 - RNA, 64 nt, Human; identical to SEQ ID NO: 187912

SEQ ID NO: 200675 - RNA, 64 nt, Human; identical to SEQ ID NO: 187913

SEQ ID NO: 200676 - RNA, 64 nt, Human; identical to SEQ ID NO: 187914

SEQ ID NO: 200677 - RNA, 64 nt, Human; identical to SEQ ID NO: 187915

SEQ ID NO: 200678 - RNA, 64 nt, Human; identical to SEQ ID NO: 187916

SEQ ID NO: 200679 - RNA, 64 nt, Human; identical to SEQ ID NO: 187917

SEQ ID NO: 200680 - RNA, 64 nt, Human; identical to SEQ ID NO: 187918

SEQ ID NO: 200681 - RNA, 64 nt, Human; identical to SEQ ID NO: 187919

SEQ ID NO: 200682 - RNA, 64 nt, Human; identical to SEQ ID NO: 187920

SEQ ID NO: 200683 - RNA, 64 nt, Human; identical to SEQ ID NO: 187921

SEQ ID NO: 200684 - RNA, 64 nt, Human; identical to SEQ ID NO: 187922

SEQ ID NO: 200685 - RNA, 64 nt, Human; identical to SEQ ID NO: 187926

SEQ ID NO: 200686 - RNA, 57 nt, Human; identical to SEQ ID NO: 187927

SEQ ID NO: 200687 - RNA, 64 nt, Human; identical to SEQ ID NO: 187928

SEQ ID NO: 200688 - RNA, 64 nt, Human; identical to SEQ ID NO: 187929

SEQ ID NO: 200689 - RNA, 64 nt, Human; identical to SEQ ID NO: 187930

SEQ ID NO: 200690 - RNA, 64 nt, Human; identical to SEQ ID NO: 187931

SEQ ID NO: 200691 - RNA, 64 nt, Human; identical to SEQ ID NO: 187932

SEQ ID NO: 200692 - RNA, 64 nt, Human; identical to SEQ ID NO: 187933

SEQ ID NO: 200693 - RNA, 64 nt, Human; identical to SEQ ID NO: 187934

SEQ ID NO: 200694 - RNA, 64 nt, Human; identical to SEQ ID NO: 187935

SEQ ID NO: 200695 - RNA, 64 nt, Human; identical to SEQ ID NO: 187936

SEQ ID NO: 200696 - RNA, 64 nt, Human; identical to SEQ ID NO: 187937

SEQ ID NO: 200697 - RNA, 64 nt, Human; identical to SEQ ID NO: 187938

SEQ ID NO: 200698 - RNA, 64 nt, Human; identical to SEQ ID NO: 187939

SEQ ID NO: 200699 - RNA, 64 nt, Human; identical to SEQ ID NO: 187940

SEQ ID NO: 200700 - RNA, 64 nt, Human; identical to SEQ ID NO: 187941

SEQ ID NO: 200701 - RNA, 64 nt, Human; identical to SEQ ID NO: 187945

SEQ ID NO: 200702 - RNA, 64 nt, Human; identical to SEQ ID NO: 187946

SEQ ID NO: 200703 - RNA, 64 nt, Human; identical to SEQ ID NO: 187947

SEQ ID NO: 200704 - RNA, 64 nt, Human; identical to SEQ ID NO: 187948

SEQ ID NO: 200705 - RNA, 64 nt, Human; identical to SEQ ID NO: 187949

SEQ ID NO: 200706 - RNA, 64 nt, Human; identical to SEQ ID NO: 187950

SEQ ID NO: 200707 - RNA, 64 nt, Human; identical to SEQ ID NO: 187951

SEQ ID NO: 200708 - RNA, 64 nt, Human; identical to SEQ ID NO: 187952

SEQ ID NO: 200709 - RNA, 64 nt, Human; identical to SEQ ID NO: 187953

SEQ ID NO: 200710 - RNA, 64 nt, Human; identical to SEQ ID NO: 187954

SEQ ID NO: 200711 - RNA, 64 nt, Human; identical to SEQ ID NO: 187955

SEQ ID NO: 200712 - RNA, 64 nt, Human; identical to SEQ ID NO: 187956

SEQ ID NO: 200713 - RNA, 64 nt, Human; identical to SEQ ID NO: 187957

SEQ ID NO: 200714 - RNA, 64 nt, Human; identical to SEQ ID NO: 187958

SEQ ID NO: 200715 - RNA, 64 nt, Human; identical to SEQ ID NO: 187959

SEQ ID NO: 200716 - RNA, 64 nt, Human; identical to SEQ ID NO: 187960

SEQ ID NO: 200717 - RNA, 64 nt, Human; identical to SEQ ID NO: 187964

SEQ ID NO: 200718 - RNA, 64 nt, Human; identical to SEQ ID NO: 187965

SEQ ID NO: 200719 - RNA, 56 nt, Human; identical to SEQ ID NO: 187966

SEQ ID NO: 200720 - RNA, 64 nt, Human; identical to SEQ ID NO: 187967

SEQ ID NO: 200721 - RNA, 64 nt, Human; identical to SEQ ID NO: 187968

SEQ ID NO: 200722 - RNA, 64 nt, Human; identical to SEQ ID NO: 187969

SEQ ID NO: 200723 - RNA, 64 nt, Human; identical to SEQ ID NO: 187970

SEQ ID NO: 200724 - RNA, 64 nt, Human; identical to SEQ ID NO: 187971

SEQ ID NO: 200725 - RNA, 64 nt, Human; identical to SEQ ID NO: 187972

SEQ ID NO: 200726 - RNA, 64 nt, Human; identical to SEQ ID NO: 187973

SEQ ID NO: 200727 - RNA, 64 nt, Human; identical to SEQ ID NO: 187974

SEQ ID NO: 200728 - RNA, 64 nt, Human; identical to SEQ ID NO: 187975

SEQ ID NO: 200729 - RNA, 64 nt, Human; identical to SEQ ID NO: 187976

SEQ ID NO: 200730 - RNA, 64 nt, Human; identical to SEQ ID NO: 187977

SEQ ID NO: 200731 - RNA, 64 nt, Human; identical to SEQ ID NO: 187978

SEQ ID NO: 200732 - RNA, 64 nt, Human; identical to SEQ ID NO: 187979

SEQ ID NO: 200733 - RNA, 64 nt, Human; identical to SEQ ID NO: 187983

SEQ ID NO: 200734 - RNA, 64 nt, Human; identical to SEQ ID NO: 187984

SEQ ID NO: 200735 - RNA, 64 nt, Human; identical to SEQ ID NO: 187985

SEQ ID NO: 200736 - RNA, 64 nt, Human; identical to SEQ ID NO: 187986

SEQ ID NO: 200737 - RNA, 64 nt, Human; identical to SEQ ID NO: 187987

SEQ ID NO: 200738 - RNA, 64 nt, Human; identical to SEQ ID NO: 187988

SEQ ID NO: 200739 - RNA, 64 nt, Human; identical to SEQ ID NO: 187989

SEQ ID NO: 200740 - RNA, 64 nt, Human; identical to SEQ ID NO: 187991

SEQ ID NO: 200741 - RNA, 64 nt, Human; identical to SEQ ID NO: 187992

SEQ ID NO: 200742 - RNA, 64 nt, Human; identical to SEQ ID NO: 187994

SEQ ID NO: 200743 - RNA, 64 nt, Human; identical to SEQ ID NO: 187990

SEQ ID NO: 200744 - RNA, 64 nt, Human; identical to SEQ ID NO: 187993

SEQ ID NO: 200745 - RNA, 64 nt, Human; identical to SEQ ID NO: 187995

SEQ ID NO: 200746 - RNA, 64 nt, Human; identical to SEQ ID NO: 187996

SEQ ID NO: 200747 - RNA, 64 nt, Human; identical to SEQ ID NO: 188000

SEQ ID NO: 200748 - RNA, 53 nt, Human; identical to SEQ ID NO: 188001

SEQ ID NO: 200749 - RNA, 64 nt, Human; identical to SEQ ID NO: 188002

SEQ ID NO: 200750 - RNA, 64 nt, Human; identical to SEQ ID NO: 188003

SEQ ID NO: 200751 - RNA, 64 nt, Human; identical to SEQ ID NO: 188004

SEQ ID NO: 200752 - RNA, 64 nt, Human; identical to SEQ ID NO: 188005

SEQ ID NO: 200753 - RNA, 64 nt, Human; identical to SEQ ID NO: 188006

SEQ ID NO: 200754 - RNA, 64 nt, Human; identical to SEQ ID NO: 188007

SEQ ID NO: 200755 - RNA, 64 nt, Human; identical to SEQ ID NO: 188008

SEQ ID NO: 200756 - RNA, 64 nt, Human; identical to SEQ ID NO: 188009

SEQ ID NO: 200757 - RNA, 64 nt, Human; identical to SEQ ID NO: 188010

SEQ ID NO: 200758 - RNA, 64 nt, Human; identical to SEQ ID NO: 188039

SEQ ID NO: 200759 - RNA, 64 nt, Human; identical to SEQ ID NO: 188040

SEQ ID NO: 200760 - RNA, 64 nt, Human; identical to SEQ ID NO: 188043

SEQ ID NO: 200761 - RNA, 64 nt, Human; identical to SEQ ID NO: 188011

SEQ ID NO: 200762 - RNA, 64 nt, Human; identical to SEQ ID NO: 188012

SEQ ID NO: 200763 - RNA, 64 nt, Human; identical to SEQ ID NO: 188013

SEQ ID NO: 200764 - RNA, 64 nt, Human; identical to SEQ ID NO: 188014

SEQ ID NO: 200765 - RNA, 64 nt, Human; identical to SEQ ID NO: 188015

SEQ ID NO: 200766 - RNA, 64 nt, Human; identical to SEQ ID NO: 188019

SEQ ID NO: 200767 - RNA, 64 nt, Human; identical to SEQ ID NO: 188020

SEQ ID NO: 200768 - RNA, 64 nt, Human; identical to SEQ ID NO: 188021

SEQ ID NO: 200769 - RNA, 64 nt, Human; identical to SEQ ID NO: 188022

SEQ ID NO: 200770 - RNA, 64 nt, Human; identical to SEQ ID NO: 188023

SEQ ID NO: 200771 - RNA, 64 nt, Human; identical to SEQ ID NO: 188024

SEQ ID NO: 200772 - RNA, 64 nt, Human; identical to SEQ ID NO: 188025

SEQ ID NO: 200773 - RNA, 64 nt, Human; identical to SEQ ID NO: 188026

SEQ ID NO: 200774 - RNA, 64 nt, Human; identical to SEQ ID NO: 188027

SEQ ID NO: 200775 - RNA, 64 nt, Human; identical to SEQ ID NO: 188028

SEQ ID NO: 200776 - RNA, 64 nt, Human; identical to SEQ ID NO: 188029

SEQ ID NO: 200777 - RNA, 64 nt, Human; identical to SEQ ID NO: 188030

SEQ ID NO: 200778 - RNA, 64 nt, Human; identical to SEQ ID NO: 188032

SEQ ID NO: 200779 - RNA, 64 nt, Human; identical to SEQ ID NO: 188033

SEQ ID NO: 200780 - RNA, 64 nt, Human; identical to SEQ ID NO: 188038

SEQ ID NO: 200781 - RNA, 64 nt, Human; identical to SEQ ID NO: 188031

SEQ ID NO: 200782 - RNA, 64 nt, Human; identical to SEQ ID NO: 188034

SEQ ID NO: 200783 - RNA, 64 nt, Human; identical to SEQ ID NO: 188041

SEQ ID NO: 200784 - RNA, 64 nt, Human; identical to SEQ ID NO: 188042

SEQ ID NO: 200785 - RNA, 64 nt, Human; identical to SEQ ID NO: 188044

SEQ ID NO: 200786 - RNA, 64 nt, Human; identical to SEQ ID NO: 188045

SEQ ID NO: 200787 - RNA, 50 nt, Human; identical to SEQ ID NO: 188046

SEQ ID NO: 200788 - RNA, 64 nt, Human; identical to SEQ ID NO: 188047

SEQ ID NO: 200789 - RNA, 64 nt, Human; identical to SEQ ID NO: 188048

SEQ ID NO: 200790 - RNA, 64 nt, Human; identical to SEQ ID NO: 188049

SEQ ID NO: 200791 - RNA, 64 nt, Human; identical to SEQ ID NO: 188050

SEQ ID NO: 200792 - RNA, 64 nt, Human; identical to SEQ ID NO: 188051

SEQ ID NO: 200793 - RNA, 64 nt, Human; identical to SEQ ID NO: 188052

SEQ ID NO: 200794 - RNA, 64 nt, Human; identical to SEQ ID NO: 188053

SEQ ID NO: 200795 - RNA, 64 nt, Human; identical to SEQ ID NO: 188057

SEQ ID NO: 200796 - RNA, 64 nt, Human; identical to SEQ ID NO: 188058

SEQ ID NO: 200797 - RNA, 64 nt, Human; identical to SEQ ID NO: 188059

SEQ ID NO: 200798 - RNA, 64 nt, Human; identical to SEQ ID NO: 188060

SEQ ID NO: 200799 - RNA, 64 nt, Human; identical to SEQ ID NO: 188061

SEQ ID NO: 200800 - RNA, 64 nt, Human; identical to SEQ ID NO: 188062

SEQ ID NO: 200801 - RNA, 64 nt, Human; identical to SEQ ID NO: 188063

SEQ ID NO: 200802 - RNA, 64 nt, Human; identical to SEQ ID NO: 188064

SEQ ID NO: 200803 - RNA, 64 nt, Human; identical to SEQ ID NO: 188065

SEQ ID NO: 200804 - RNA, 64 nt, Human; identical to SEQ ID NO: 188066

SEQ ID NO: 200805 - RNA, 64 nt, Human; identical to SEQ ID NO: 188067

SEQ ID NO: 200806 - RNA, 64 nt, Human; identical to SEQ ID NO: 188068

SEQ ID NO: 200807 - RNA, 64 nt, Human; identical to SEQ ID NO: 188069

SEQ ID NO: 200808 - RNA, 64 nt, Human; identical to SEQ ID NO: 188070

SEQ ID NO: 200809 - RNA, 64 nt, Human; identical to SEQ ID NO: 188071

SEQ ID NO: 200810 - RNA, 64 nt, Human; identical to SEQ ID NO: 188072

SEQ ID NO: 200811 - RNA, 64 nt, Human; identical to SEQ ID NO: 188076

SEQ ID NO: 200812 - RNA, 64 nt, Human; identical to SEQ ID NO: 188077

SEQ ID NO: 200813 - RNA, 64 nt, Human; identical to SEQ ID NO: 188078

SEQ ID NO: 200814 - RNA, 64 nt, Human; identical to SEQ ID NO: 188079

SEQ ID NO: 200815 - RNA, 64 nt, Human
cggguuccgcugacgcagcgccccgccugggagccgcgggcaggcgagacuggcggagccccca

SEQ ID NO: 200816 - RNA, 64 nt, Human
cacucccugccuugugaguggccugcugccucaccucccgcaggccgccacacuuauugcaggu

SEQ ID NO: 200817 - RNA, 64 nt, Human
ggcugcccguuaagaugguggcggcacacgcucccucccgcagcaccacgccagcuggugcggc

SEQ ID NO: 200818 - RNA, 64 nt, Human
cccaccuggagcccgcuucaagcucucuguugcgcucccgcauuucucaugcuucuucucaugg

SEQ ID NO: 200819 - RNA, 60 nt, Human
ggcuggagcgcuaccugugagccugcgccgcgcgggcaggcaccugugcgaccugugccc

SEQ ID NO: 200820 - RNA, 64 nt, Human
gcugcugggcguaccccuggcaggcgggcugugccgcgggcacauuugccuuuugugaaggccg

SEQ ID NO: 200821 - RNA, 64 nt, Human
cggggcucuccguggaggaaguggugcgccgcagcgcgggcaugaacacugcucgcuacaagcu

SEQ ID NO: 200822 - RNA, 64 nt, Human
gcuuccagcuuccucugagccgcagggccugcuacgcgggcaagcgugcugccucucuucugug

SEQ ID NO: 200823 - RNA, 64 nt, Human
gcacacgaguguccgggguucggccauguccucacgcgggcaggggugggagcccucacaggca

SEQ ID NO: 200824 - RNA, 64 nt, Human
uccucucugcagcacugccucccagcgccagggucgcgggcacaucccacugagagcggggguc

SEQ ID NO: 200825 - RNA, 64 nt, Human
gcggcgggaaagagcuucggcugggccacgggcucgcgggcacucucggcggcagccucggggg

SEQ ID NO: 200826 - RNA, 64 nt, Human
gacuaauccagugccugguagacagcgggccucgcgcgggcaggagcggcucggcugacaagcc

SEQ ID NO: 200827 - RNA, 64 nt, Human
gcccgcuccugccgcagacgggcacagacacgcucgcgggcagcgggccaggcccgcaccccgg

SEQ ID NO: 200828 - RNA, 64 nt, Human
ugugaggcuguugcucagcaugcaggggcccugucgcgggcacagcccaaggcugccuccccac

SEQ ID NO: 200829 - RNA, 64 nt, Human
ccgugguccagcagaggcgcugggugggagggcacgcgggcaagccuaggagaguaggaagagc

SEQ ID NO: 200830 - RNA, 64 nt, Human
ggcgccucuggccccccaccucacggccaguucccgcgggcaccgccucgcccuccgcuggccg

SEQ ID NO: 200831 - RNA, 64 nt, Human
cccaaccaaagugauugugcccuugguuggggggcgcgggcauauaaccugucagaagcaaaca

SEQ ID NO: 200832 - RNA, 64 nt, Human
uguaccguuccacuguggcccacauucuugugcacgcgggcauuugcaggcacgcucucgcgua

SEQ ID NO: 200833 - RNA, 64 nt, Human
gaggccucucuuaagauguccagggccccaggcccgcgggcacagccagcccaaaccuugggcc

SEQ ID NO: 200834 - RNA, 64 nt, Human
uguuuccuugaugcaggagguggccuugccuggacgcgggcacccagccaacugccaugguguu

SEQ ID NO: 200835 - RNA, 64 nt, Human
ggacccuuaccgguggcucuuccugccugggacccucccgcagagucccacuagccagcggccu

SEQ ID NO: 200836 - RNA, 64 nt, Human
auaagguaccaggacucaggcuucucauccccuccucccgcaaagcgguuuucugacccucagg

SEQ ID NO: 200837 - RNA, 64 nt, Human
aaaagguucuuuacaagaugauaccuuaauuacacucccgcaacacagccauuauuuuauuguc

SEQ ID NO: 200838 - RNA, 64 nt, Human
auuccacgagcagcagccuguggcacccgcugggcgcgggcagcagggaagagggagcaaggca

SEQ ID NO: 200839 - RNA, 64 nt, Human
aucagaugcugcugcaugcggccacucggcaggccgcgggcauccggcugcaggaccagguggu

SEQ ID NO: 200840 - RNA, 64 nt, Human
cuuaguaaaacggugaaaaguacucccagacggacgcgggcacccgucaugcuuuugcugagag

SEQ ID NO: 200841 - RNA, 64 nt, Human
acugaaaacggcagcuauugcaaggagugggggccgcgggcagccgcucuucagcucgcggccc

SEQ ID NO: 200842 - RNA, 64 nt, Human
ccccaggcucuggcagucgggacacugcccucaucgcgggcagccuugugccucugcugcugcu

SEQ ID NO: 200843 - RNA, 60 nt, Human
gagcugcgcagcgggaaugagcggggaugccgcgggcagcagcuggagcuaaaggaaggg

SEQ ID NO: 200844 - RNA, 64 nt, Human
acucugcccccauuuccccgauguccccugcgggcgcgggcagccacccaagccugcuggcugc

SEQ ID NO: 200845 - RNA, 64 nt, Human
gcgcuggaggcggagcucaacgaccucaugugagcgcgggcagcgggcagggacugaagccuga

SEQ ID NO: 200846 - RNA, 64 nt, Human
acaguggggaggacgaggaugugggaccgccagccgcgggcacuggugggcccugaccuccccg

SEQ ID NO: 200847 - RNA, 64 nt, Human
ccccaaccaaaaugcugcaccaaagcucgggcgccgcgggcacggcugcugcagucucuuccca

SEQ ID NO: 200848 - RNA, 52 nt, Human
cccuggacgaggagagcugagccgcgggcagccaggcccagcccccgcccga

SEQ ID NO: 200849 - RNA, 64 nt, Human
ccucgguaaagggguggaguggcgcgcugguugccgcgggcacuggcaauuagaagggauuauu

SEQ ID NO: 200850 - RNA, 64 nt, Human
ucuccggauccuuuucagcccgaggccugacagacgcgggcagugaugagcccuguucuggagu

SEQ ID NO: 200851 - RNA, 64 nt, Human
gcacgccacccgccaugggagugugcucaggagucgcgggcagcguggacaucugucccagagg

SEQ ID NO: 200852 - RNA, 64 nt, Human
ccgccgugccccaggcccucucagccgcagcacccgcgggcaccacuuucgugcaguaccaggc

SEQ ID NO: 200853 - RNA, 55 nt, Human
gaauggaguacaucguauagcagaccgcgggcacugccgccgcuagguagagucu

SEQ ID NO: 200854 - RNA, 64 nt, Human
gagggaaugacggagguagggugcagggucagggcucccgcaggggccugcaucuggccagcag

SEQ ID NO: 200855 - RNA, 64 nt, Human
gaaaacuugaucaaugagcuuuuaaccacgauuucucccgcaauuuguuccuucuuuuuaccuu

SEQ ID NO: 200856 - RNA, 64 nt, Human
uacugagacucuguuuaucacuagccuucugucccucccgcagaagacuguuggauugaacaaa

SEQ ID NO: 200857 - RNA, 64 nt, Human
caugccgagugccccagaaaugccgcuguguccccgcgggcagugacgugaguggggaggagac

SEQ ID NO: 200858 - RNA, 64 nt, Human
cuucccuggccacgcuccaagacgccagcucugccgcgggcacuuuguucucacgguguccucc

SEQ ID NO: 200859 - RNA, 64 nt, Human
uucaccugcaagugaggccaggcccggaggcggccgcgggcacccuggaacccggcggcauuuu

SEQ ID NO: 200860 - RNA, 64 nt, Human
cucacggugacucagcagugcccaacugaccaaucucccgcagcucuccugccccugggggccc

SEQ ID NO: 200861 - RNA, 64 nt, Human
aauugguauucagcacuauaaauguguuuuuaaccucccgcauucugugcuuauuuaaaacaag

SEQ ID NO: 200862 - RNA, 64 nt, Human
uucccuaacauggaggcaaaauaccacauggcuucucccgcauaucgucacuggaaacuuccuc

SEQ ID NO: 200863 - RNA, 64 nt, Human
uuucuccucccgaaggaacagcugauucaugcuccucccgcaauugucacgucugugauuuauu

SEQ ID NO: 200864 - RNA, 64 nt, Human
caggcuuggguuccccagccuuauuggaaggcagcucccgcauaccaggauaacccccgcaaac

SEQ ID NO: 200865 - RNA, 64 nt, Human
gcaugccagccccacacucccugggucuggcuuccucccgcaaccucacucuaguagagccugu

SEQ ID NO: 200866 - RNA, 64 nt, Human
gcgacaaccaacacgugcucucacaaaccccugacucccgcacuuuccagugccaaaguacaaa

SEQ ID NO: 200867 - RNA, 64 nt, Human
ugugggagggagggagggcuggcucaggcaucgucucccgcaaugggcagagagagcagagaca

SEQ ID NO: 200868 - RNA, 64 nt, Human
aggaacacaguuggaggucaccucuccugcccagcucccgcacccugcguuuaggaguucaguc

SEQ ID NO: 200869 - RNA, 64 nt, Human
cgggacgcaguucucggacgccgaggggcuggcgcucccgcaggacggccucuauuaccucuac

SEQ ID NO: 200870 - RNA, 64 nt, Human
caguuuuaaaguucaugguaagauuugaccucaucucccgcaaauaaauguauuggugauuugg

SEQ ID NO: 200871 - RNA, 64 nt, Human
aagggccaaccccuugcaacagggcagcucucgccucccgcacacggcucuccugaucacagcu

SEQ ID NO: 200872 - RNA, 64 nt, Human
aaccuaccuuccacaagccagccccgcaucccugcucccgcaguguaagugcagagccugccuc

SEQ ID NO: 200873 - RNA, 64 nt, Human
gccccucccagaccucuguccuuccaccaaucgccucccgcagccccgagccgccacucccagu

SEQ ID NO: 200874 - RNA, 64 nt, Human
aagagcacauuccaaaucaaacuugcaaaugagacucccgcacgaaaacccuuaagagucccgg

SEQ ID NO: 200875 - RNA, 64 nt, Human
ccugcuccucagacucacagccccuccauguuaccucccgcaccuccucccuggggcagcugcu

SEQ ID NO: 200876 - RNA, 53 nt, Human
acuaugacguggugaacuaaccgcucccgcaccugucgguggcugccuuugau

SEQ ID NO: 200877 - RNA, 64 nt, Human
aacaaaaaagagaaagaaaaugaagagcauuugacucccgcacuuaaaaugaaguacacauaaa

SEQ ID NO: 200878 - RNA, 64 nt, Human
uccagcucuacuaccuacguuugcaccgccugcccucccgcaccuuccuccuccccgcuccguc

SEQ ID NO: 200879 - RNA, 64 nt, Human
ccucccuggcucagcccagugcggccuggcgcuccucccgcaggcucugcccccgggcuccggu

SEQ ID NO: 200880 - RNA, 64 nt, Human
uggggcacggucugcggccaugaggccaggccgccucccgcaccccuaccccguggcagcagca

SEQ ID NO: 200881 - RNA, 64 nt, Human
cacccagcggggcuuccaggccagccuguguccccucccgcaggccuccuguccacaccagcgc

SEQ ID NO: 200882 - RNA, 64 nt, Human
acacaaaggcuggccuguguguaagucaaagucacucccgcaaaccugaaucucgagcuaccua

SEQ ID NO: 200883 - RNA, 64 nt, Human
cucgggaaaccucccccgacgcucucucucggaacucccgcacccuccuuucucaccagcccgc

SEQ ID NO: 200884 - RNA, 64 nt, Human
cccaccaccagucacugccucgcagagcccuacacucccgcagccgcuccucagaggccugugc

SEQ ID NO: 200885 - RNA, 64 nt, Human
ccuggaggcagcugucucgcagacucagcuuggucucccgcaggcuucagaaaaacccaauugc

SEQ ID NO: 200886 - RNA, 64 nt, Human
ccuugucaucaucacccacugcacuggccuugcucucccgcacgaggacggagaacacaaacuc

SEQ ID NO: 200887 - RNA, 64 nt, Human
gucuggaugccugggcuucacacaagaaccaccucucccgcaguucccaaggacuugucauuuc

SEQ ID NO: 200888 - RNA, 64 nt, Human
ugcuucugaacucaagcugcguuuauuaaugccucucccgcaccaggccgggcuugggcccugc

SEQ ID NO: 200889 - RNA, 64 nt, Human
gacagaucugaccucgugauccgcccaucuccaccucccgcagugcugggauuacaggcaugag

SEQ ID NO: 200890 - RNA, 64 nt, Human
uggauggaucugcuccaugcagaucuagccaggccucccgcaugcugccugccuccggcccugc

SEQ ID NO: 200891 - RNA, 52 nt, Human
uccucugccuuccagccugaggcucccgcagcccacccugaccgggacuggu

SEQ ID NO: 200892 - RNA, 64 nt, Human
ccccagagauucccaagccaaaaaccuuagcucccucccgcaccccgauguggaccucuacuuu

SEQ ID NO: 200893 - RNA, 64 nt, Human
ugccuacguccccuuagaugggcagcagaggcaacucccgcauccuuugcucugccugucagug

SEQ ID NO: 200894 - RNA, 64 nt, Human
ggcccgaggcagaagggcccaccccgucccuccucucccgcaggucugaaguuggccccccagc

SEQ ID NO: 200895 - RNA, 64 nt, Human
ggaucuguccagcucauacuuuccuucgcugucccucccgcacuccuuaggcaagauuucccag

SEQ ID NO: 200896 - RNA, 64 nt, Human
cauaguguagaacagucccggucaguuggccaaccucccgcagccaaguagguucauccuuguu

SEQ ID NO: 200897 - RNA, 64 nt, Human
ggaucccaacaggcagcaccgcaccucugcccgccucccgcacugcagcuccgcccgccgggcu

SEQ ID NO: 200898 - RNA, 64 nt, Human
cuccucagcauggccucagugggcgcacccaugccucccgcaguccaggugagcaggggagcaa

SEQ ID NO: 200899 - RNA, 64 nt, Human
acucucacacugucuccugcaugacggguggcgccucccgcagcuucccuucucucuccagugc

SEQ ID NO: 200900 - RNA, 64 nt, Human
ccccucugaccccggccugggcuucagccgcuuccucccgcaagcagcccggguccgcacugcg

SEQ ID NO: 200901 - RNA, 64 nt, Human
cuggcgacacaacugcaccuucccucauuucagucucccgcacacuuauuccuccuccccucuu

SEQ ID NO: 200902 - RNA, 64 nt, Human
gacaguuucugacaggcgcaacuccuccauuuuccucccgcaggugagaacccuguggagauga

SEQ ID NO: 200903 - RNA, 64 nt, Human
ugaccccucccucagcuguccugugccccgcccucucccgcacacucagucccccugccuggcg

SEQ ID NO: 200904 - RNA, 64 nt, Human
ggguggaaacuaagacaccugaacccuccagggccucccgcaucaaggucagcaugaggacaga

SEQ ID NO: 200905 - RNA, 64 nt, Human
ggucguaggugaugccacugggcgugaugcacggcucccgcaucagcucaaagcugaucuugcc

SEQ ID NO: 200906 - RNA, 64 nt, Human
cuuccuucuuccccacaacagaagagaccagcgacucccgcaaagggacaagguuccucccucu

SEQ ID NO: 200907 - RNA, 64 nt, Human
cgaacgguggguggggggcucacccuggugcugccucccgcacaaggagaccuggacacaacag

SEQ ID NO: 200908 - RNA, 64 nt, Human
acaaauguguacuuuauugauuuucuuucuaauucucccgcauugguggcuugggacuugggag

SEQ ID NO: 200909 - RNA, 64 nt, Human
cccugacuuuagggaaggugaauguguucccguccucccgcagucagaaaggagacucugccuc

SEQ ID NO: 200910 - RNA, 64 nt, Human
gccuucaugcacuagccacuuccgcaggugcugacucccgcacucccuggcauuuuuugcagac

SEQ ID NO: 200911 - RNA, 64 nt, Human
ccgcccagguccccgcuuucuuuggaggcagcagcucccgcagggcugaagucuggcguaagau

SEQ ID NO: 200912 - RNA, 64 nt, Human
uggccuccuugaugggcaggcuuggaagggacuucucccgcaccccacucugucccaggacaua

SEQ ID NO: 200913 - RNA, 64 nt, Human
guauuccguuuucuuccugcaugaucccugggcccucccgcaggcugagcaagucuguaaacug

SEQ ID NO: 200914 - RNA, 64 nt, Human
acgggccaaggagacuccgggcuugagcccaggccucccgcacggcucagcugcugaauuuuuc

SEQ ID NO: 200915 - RNA, 64 nt, Human
acccccacccagccuccagaagcuggaaccauuucucccgcaggccugaguuccuaaggaaacc

SEQ ID NO: 200916 - RNA, 64 nt, Human
ugggccccagaagagccacaggaacaucauuccucucccgcaaccacucccaccccagggaggc

SEQ ID NO: 200917 - RNA, 64 nt, Human
guuggucugcgggggccuuggagcuccugcucuucucccgcaccuccauggaugcacugcugcc

SEQ ID NO: 200918 - RNA, 64 nt, Human
gcacgguacccggccgccguucugcaaugcaucacucccgcagaggggggugcagaucaggcgc

SEQ ID NO: 200919 - RNA, 64 nt, Human
ugguuguguagcuucuguugucauugaauacggccucccgcagcaucccacccccaaaccaccg

SEQ ID NO: 200920 - RNA, 64 nt, Human
uacaggagucuggaguccguugaaggguaaaggccucccgcaagcugccagucggcucuuuuuc

SEQ ID NO: 200921 - RNA, 64 nt, Human
gucacugaacagaacgucgcugauggagaaagggcucccgcagaaggaacggccuguaccgugc

SEQ ID NO: 200922 - RNA, 64 nt, Human
aggcgguuucggggcucccccuuccucucccucccucccgcagaaggggguuuuaggggccugg

SEQ ID NO: 200923 - RNA, 64 nt, Human
gaggggcuuccgagccccugagagcggacaucuccucccgcaggccuuuacuccgcacucccca

SEQ ID NO: 200924 - RNA, 64 nt, Human
uccggcaccccccaaucccccaacacgccugucccucccgcauggccaccaaggagcuggaccu

SEQ ID NO: 200925 - RNA, 64 nt, Human
cuccugccacuugccccugaccccccugccgugccucccgcagcccucccaugccguuccacuc

SEQ ID NO: 200926 - RNA, 64 nt, Human
cacacgggccaagguacccacaggaucccauccccucccgcacagcccugggccccagcaccuc

SEQ ID NO: 200927 - RNA, 64 nt, Human
ggacggggcccgccccaggccccagcagucuccgcucccgcagcgggcgcgggacaggacuugu

SEQ ID NO: 200928 - RNA, 64 nt, Human
uggggccuggccucgcccacgguggauccggggccucccgcacagucggccacgcccgcugcgg

SEQ ID NO: 200929 - RNA, 64 nt, Human
caggccggggaucuggggagggcuagcccaaaaccucccgcaucgggcaggcacccccugaagu

SEQ ID NO: 200930 - RNA, 64 nt, Human
uggccaaggaccagugccaccuuauggcaaagagcucccgcaguguuuguuagagugcacaucc

SEQ ID NO: 200931 - RNA, 64 nt, Human
gccgccggcgccgcccgggucccugcagcgcuuccucccgcagcccccgcgaccgauccgaccg

SEQ ID NO: 200932 - RNA, 64 nt, Human
cgagauuaacggugcuaaccccgucugcuccucccucccgcagagacuggggccuggacuggac

SEQ ID NO: 200933 - RNA, 64 nt, Human
aagacuccugagaacaggcagcccaguccugcgacucccgcauccccaggaccagacaccuggg

SEQ ID NO: 200934 - RNA, 64 nt, Human
cuugccucaguucuucccucugagcccccaggcccucccgcaucucagguuggggauggggaca

SEQ ID NO: 200935 - RNA, 64 nt, Human
cuggugcgcacagcccuugucggugccccggccccucccgcagcguuacugccuguguauagua

SEQ ID NO: 200936 - RNA, 64 nt, Human
ggccugcagcagaagugugcccagcguuucucggcucccgcaccccuuuucccuuauggcucug

SEQ ID NO: 200937 - RNA, 64 nt, Human
aggaccagccgcgugcacuggauugcggaggagccucccgcagcacugguccgggacaagauga

SEQ ID NO: 200938 - RNA, 64 nt, Human
gcuggccauccguggaggaggggccgguccuggacucccgcaggacuccucugaggcagggccu

SEQ ID NO: 200939 - RNA, 64 nt, Human
accaacuacccuuaggucuacagcucucaugagucucccgcacucagccuuuagcaauucauua

SEQ ID NO: 200940 - RNA, 64 nt, Human; identical to SEQ ID NO: 135816

SEQ ID NO: 200941 - RNA, 64 nt, Human; identical to SEQ ID NO: 135817

SEQ ID NO: 200942 - RNA, 52 nt, Human; identical to SEQ ID NO: 135818

SEQ ID NO: 200943 - RNA, 64 nt, Human; identical to SEQ ID NO: 135819

SEQ ID NO: 200944 - RNA, 64 nt, Human; identical to SEQ ID NO: 135820

SEQ ID NO: 200945 - RNA, 64 nt, Human; identical to SEQ ID NO: 135821

SEQ ID NO: 200946 - RNA, 64 nt, Human; identical to SEQ ID NO: 135822

SEQ ID NO: 200947 - RNA, 64 nt, Human; identical to SEQ ID NO: 135823

SEQ ID NO: 200948 - RNA, 64 nt, Human; identical to SEQ ID NO: 135824

SEQ ID NO: 200949 - RNA, 54 nt, Human; identical to SEQ ID NO: 135825

SEQ ID NO: 200950 - RNA, 64 nt, Human; identical to SEQ ID NO: 135826

SEQ ID NO: 200951 - RNA, 64 nt, Human
aauaauucggggagucucagccccauccaggugccgcggccagcucucuacaccucuauauauu

SEQ ID NO: 200952 - RNA, 64 nt, Human
gcccgggcccugcaaccgccggcgcgcaccggcgcgcggccaagaccaugguccugggguuccu

SEQ ID NO: 200953 - RNA, 64 nt, Human
caaagugcugggauuacaggcaugagccacugggcgcggccagauaaguuuuuaagguuccuuc

SEQ ID NO: 200954 - RNA, 64 nt, Human; identical to SEQ ID NO: 135827

SEQ ID NO: 200955 - RNA, 64 nt, Human; identical to SEQ ID NO: 135828

SEQ ID NO: 200956 - RNA, 64 nt, Human; identical to SEQ ID NO: 135829

SEQ ID NO: 200957 - RNA, 64 nt, Human; identical to SEQ ID NO: 135830

SEQ ID NO: 200958 - RNA, 64 nt, Human; identical to SEQ ID NO: 135831

SEQ ID NO: 200959 - RNA, 64 nt, Human; identical to SEQ ID NO: 135832

SEQ ID NO: 200960 - RNA, 64 nt, Human; identical to SEQ ID NO: 135833

SEQ ID NO: 200961 - RNA, 64 nt, Human; identical to SEQ ID NO: 135834

SEQ ID NO: 200962 - RNA, 64 nt, Human; identical to SEQ ID NO: 135835

SEQ ID NO: 200963 - RNA, 64 nt, Human; identical to SEQ ID NO: 135836

SEQ ID NO: 200964 - RNA, 64 nt, Human; identical to SEQ ID NO: 135837

SEQ ID NO: 200965 - RNA, 64 nt, Human; identical to SEQ ID NO: 135838

SEQ ID NO: 200966 - RNA, 64 nt, Human; identical to SEQ ID NO: 135839

SEQ ID NO: 200967 - RNA, 64 nt, Human; identical to SEQ ID NO: 135840

SEQ ID NO: 200968 - RNA, 59 nt, Human; identical to SEQ ID NO: 135841

SEQ ID NO: 200969 - RNA, 64 nt, Human
acauccuggagggcuacagcauccuggacaacaacgcggccaccaugcugcagguguuugaccu

SEQ ID NO: 200970 - RNA, 64 nt, Human
guccacccaccccauggcacugccgcgugauucccgcggccauucagaaguucaagccgagaug

SEQ ID NO: 200971 - RNA, 64 nt, Human
acgacgagcuggggggcagcccaggcagcaccagcgcggccacgugcacgcgccgccacuacga

SEQ ID NO: 200972 - RNA, 64 nt, Human; identical to SEQ ID NO: 135842

SEQ ID NO: 200973 - RNA, 64 nt, Human; identical to SEQ ID NO: 135843

SEQ ID NO: 200974 - RNA, 64 nt, Human; identical to SEQ ID NO: 135844

SEQ ID NO: 200975 - RNA, 64 nt, Human; identical to SEQ ID NO: 135845

SEQ ID NO: 200976 - RNA, 64 nt, Human; identical to SEQ ID NO: 135846

SEQ ID NO: 200977 - RNA, 59 nt, Human; identical to SEQ ID NO: 135847

SEQ ID NO: 200978 - RNA, 64 nt, Human; identical to SEQ ID NO: 135848

SEQ ID NO: 200979 - RNA, 64 nt, Human; identical to SEQ ID NO: 135849

SEQ ID NO: 200980 - RNA, 64 nt, Human; identical to SEQ ID NO: 135850

SEQ ID NO: 200981 - RNA, 64 nt, Human; identical to SEQ ID NO: 135851

SEQ ID NO: 200982 - RNA, 64 nt, Human; identical to SEQ ID NO: 135852

SEQ ID NO: 200983 - RNA, 64 nt, Human; identical to SEQ ID NO: 135853

SEQ ID NO: 200984 - RNA, 64 nt, Human; identical to SEQ ID NO: 135854

SEQ ID NO: 200985 - RNA, 64 nt, Human; identical to SEQ ID NO: 135855

SEQ ID NO: 200986 - RNA, 64 nt, Human; identical to SEQ ID NO: 135856

SEQ ID NO: 200987 - RNA, 64 nt, Human
cugccccagugaaggaggauggggcaggacaggacgcggccaccccaggccuuuccagagcaaa

SEQ ID NO: 200988 - RNA, 64 nt, Human
gaugguggugcggauagggcacugagggguggcgcgcggccaggagcacgcaugguauugacuu

SEQ ID NO: 200989 - RNA, 64 nt, Human
accugccggcgcccacagucaggcccgggcccagcgcggccagugcuccuccugcacgcggcgg

SEQ ID NO: 200990 - RNA, 64 nt, Human; identical to SEQ ID NO: 135857

SEQ ID NO: 200991 - RNA, 64 nt, Human; identical to SEQ ID NO: 135858

SEQ ID NO: 200992 - RNA, 64 nt, Human; identical to SEQ ID NO: 135859

SEQ ID NO: 200993 - RNA, 64 nt, Human; identical to SEQ ID NO: 135860

SEQ ID NO: 200994 - RNA, 64 nt, Human; identical to SEQ ID NO: 135861

SEQ ID NO: 200995 - RNA, 51 nt, Human
gcuucaucaagggcagauaaucgcggccaccaccuguaggaccuccuccca

SEQ ID NO: 200996 - RNA, 64 nt, Human
cccggcagacgccggggacagaggccugcccgggcgcggccagccccggcccugggcucggagg

SEQ ID NO: 200997 - RNA, 64 nt, Human
ggaaggggccgccuagcccgaguaggccccagggcgcggccacagacuggcgggccgcggaagg

SEQ ID NO: 200998 - RNA, 64 nt, Human
gacucuuuucacugaguuuccagaggaagacuagcgcggccaccgcgaagccgccaacccaccg

SEQ ID NO: 200999 - RNA, 64 nt, Human
caccuggccccaccugcuccucagggcagcccggcgcggccagguagggcccgagcuucagcuu

SEQ ID NO: 201000 - RNA, 54 nt, Human
ccucggccgccagcagaugagccgcgcggccacggccaacccgcccgccccggc

SEQ ID NO: 201001 - RNA, 64 nt, Human
ugggcggacggcuguggaccguggacaggcccagcgcggccagcgucccaggguacccgccuga

SEQ ID NO: 201002 - RNA, 64 nt, Human
guaugugcugcucuucggcaccgccuugggcucccgcggccacucgggucagugcuagcggcgg

SEQ ID NO: 201003 - RNA, 51 nt, Human
agcagccuguuuacaucugaccgcggccacacgcgguggcaugcauggagg

SEQ ID NO: 201004 - RNA, 64 nt, Human
cauuugggccccgagcucugacccucgugucugacgcggccaccucuuucuggaggggcugagg

SEQ ID NO: 201005 - RNA, 64 nt, Human
uccagugcugcaugcgauuaucuacccacguccacgcggccaccucacccucuccgcacaccuc

SEQ ID NO: 201006 - RNA, 64 nt, Human
uuuaacccgggugcaccguaucauccgcauggaccgcggccacgcccugcuggucgggguaggg

SEQ ID NO: 201007 - RNA, 64 nt, Human
cauggccucuccaggcgugcucaugcccacaacccgcggccagccccacguggugcugcucagc

SEQ ID NO: 201008 - RNA, 64 nt, Human
guggcggccccggcgggaggggcgggugggaggccgcggccaccgccaccugccggccucgaga

SEQ ID NO: 201009 - RNA, 64 nt, Human
cuucuagaaacagagacaagaaaggcagacacaccgcggccaggcacccaugugggcgcccacc

SEQ ID NO: 201010 - RNA, 64 nt, Human
cgccgccccuccacccauccaguggacucuggggcgcggccacaggggacgggaugaggagcgg

SEQ ID NO: 201011 - RNA, 64 nt, Human
aggcagcccagcuucgcgaaggcuguaggcacaccgcggccagcaggcaccuggcacccaccuu

SEQ ID NO: 201012 - RNA, 64 nt, Human
accucagacacccgggccuucucagccuucuccccgcggccagcugggucuccggggacccugg

SEQ ID NO: 201013 - RNA, 64 nt, Human
cuucccacugagcaccagcauccaggugcacccccgcggccacggcgccucugucccucuccug

SEQ ID NO: 201014 - RNA, 64 nt, Human
cauggauguguguggggggcgugccucucagaaacgcggccagaagacaagcagggaagugaaa

SEQ ID NO: 201015 - RNA, 64 nt, Human
cugcaugagugagcaggcguggguggacucuggccgcggccacacuuggugcucaccagcugcu

SEQ ID NO: 201016 - RNA, 64 nt, Human
cggggcccucccaccuccaacgccccgcccacgccgcggccaccgggcccacggccaccagaau

SEQ ID NO: 201017 - RNA, 64 nt, Human
aggagccccauccgcccacccacccugggacccacgcggccacuccagggaucauuguuguccu

SEQ ID NO: 201018 - RNA, 64 nt, Human
agagggagcggaggaggggccggcccgcgggagccgcggccaccaggaggccccgcuccguccc

SEQ ID NO: 201019 - RNA, 64 nt, Human
ccccccauacaggagccucgguuuuucagcaaaacgcggccaguccccuucuccacugcugccu

SEQ ID NO: 201020 - RNA, 64 nt, Human
ugaccacgcccuccaaacagagcaacaacaaguacgcggccagcagcuaccugagccugacgcc

SEQ ID NO: 201021 - RNA, 64 nt, Human
ccgaauugcacugaacacgcgugugugcaucgcacgcggccacgaccacagacacgcaugcaca

SEQ ID NO: 201022 - RNA, 64 nt, Human
gcguccugcacucaaccccgccuggagcuccuuccgcggccaccgugcuccgggcaccccggga

SEQ ID NO: 201023 - RNA, 63 nt, Human
cagcgcaggcagagccgccuagagcugugcagccggcucgaacgagaggccgcccgacuugca

SEQ ID NO: 201024 - RNA, 63 nt, Human
cccccgccguggggaggcgugcggcucagcggucggcucgacaugggacgucguccugguggu

SEQ ID NO: 201025 - RNA, 63 nt, Human
agccucggcauagacccccuucugguccgcccgcggcucgauucccgggauucauuccucagc

SEQ ID NO: 201026 - RNA, 63 nt, Human
aacucccaaccagauccauucuugaccagugaccggcucgaaucuggccuuuugugugagaug

SEQ ID NO: 201027 - RNA, 63 nt, Human
uguuuguuuccggaauuucaauaaagcucgauucggcucgaagaagaccccguucuuccggga

SEQ ID NO: 201028 - RNA, 63 nt, Human
ggucugaugugaaaauucaaucacgacguuaaccggcucgagagagcgccggccuagaggcuc

SEQ ID NO: 201029 - RNA, 63 nt, Human
cgugaucuuggcuuacugcagccuuugccuccccggcucgagcaguccugccucagccuccgg

SEQ ID NO: 201030 - RNA, 63 nt, Human
cuccuuccgaacuuccucuuucgcauucucucucggcucgagcuggcugagauuuuucuaaau

SEQ ID NO: 201031 - RNA, 63 nt, Human
aggggaagugaaaggaaagauggagguuuugugcggcucgauggggcauuuggaacuucuuuu

SEQ ID NO: 201032 - RNA, 63 nt, Human
ugcccugugcaaccucuuggccugaucagaccacggcucgauuucuccaggauuuccugcuuu

SEQ ID NO: 201033 - RNA, 62 nt, Human
gcaagaggcccugggucucuccaagcagcugcagaccccagcucgaauuuugcacauggcgg

SEQ ID NO: 201034 - RNA, 62 nt, Human
ggccuccucgcaccugcccuccgcugcuccucagaccccagcccccagcgagccgacguccc

SEQ ID NO: 201035 - RNA, 62 nt, Human
agugagguucuuggguuuugugccuuuggggcagaccccaggcaaggaugucugagaccacu

SEQ ID NO: 201036 - RNA, 62 nt, Human
cagagacaggccccugaacgauaagcaccaagagaccccaaggcuccagauggaacacugag

SEQ ID NO: 201037 - RNA, 62 nt, Human
accccgaagccucaaggccggggcuggagcggagaccccagggccucucaggagacagugag

SEQ ID NO: 201038 - RNA, 62 nt, Human
gccuggagaagcccuaggggggcgacccgcggagaccccagcagaggucgcagcccagcucc

SEQ ID NO: 201039 - RNA, 62 nt, Human
gauccuagaggacgaaccccacaguaaggaugagaccccacuguguacccuucuggacuggc

SEQ ID NO: 201040 - RNA, 62 nt, Human
aagaguucaagaucagccugggcaguauagcaagaccccaucuccauuuuuuuuuuaaugau

SEQ ID NO: 201041 - RNA, 62 nt, Human
auuaugcacacagaaaaucuguggagccuaucagaccccaagugucuugaaauguuuguaga

SEQ ID NO: 201042 - RNA, 62 nt, Human
cucugugucaaggccuuugaggcccagaacccagaccccaaagcgccuguggugcugcugag

SEQ ID NO: 201043 - RNA, 62 nt, Human
acagucaccaagaauguuuugaguuuuuugaaagaccccaauuuaagccuugcuuauuuuua

SEQ ID NO: 201044 - RNA, 62 nt, Human
cacugcacuugagccucuugggaaacauaacaagaccccaucuguaaauuaaaaaaaaaaaa

SEQ ID NO: 201045 - RNA, 62 nt, Human
agaggaaaaguacuaggauucuuaagauggcgagaccccaagagggaucucauagcacugcu

SEQ ID NO: 201046 - RNA, 62 nt, Human
aguaguucaagaccagccugggcaacauaguaagaccccaucucuaugaagaauaaaaaaau

SEQ ID NO: 201047 - RNA, 62 nt, Human
ccugcgagugccaucagccucccucacaugggagaccccaacccagcugacaauguggagcc

SEQ ID NO: 201048 - RNA, 62 nt, Human
gcagucccagcacagugggacaaaaagaauuuagaccccaaaaguguccucggcauggaucu

SEQ ID NO: 201049 - RNA, 62 nt, Human
ccagugauccagccccaccaaggggccuccagagaccccaggaacaauaagugucuccuccc

SEQ ID NO: 201050 - RNA, 62 nt, Human
aagacuuaccuuaguucaaggggaggggacaaagaccccacagcccaacagcaggacuguag

SEQ ID NO: 201051 - RNA, 62 nt, Human
uggaguuugagaccagccugagcaacauggugagaccccaucucuacaaaaaaaauauaaaa

SEQ ID NO: 201052 - RNA, 62 nt, Human
ugccacugcacuccacccugggcaacagagcaagaccccaucucaaaaauaaauaaauauau

SEQ ID NO: 201053 - RNA, 62 nt, Human
aaaaacagaaagcacaagacgaacucaguagcagaccccagacucuccccuugccagacgug

SEQ ID NO: 201054 - RNA, 62 nt, Human
cagcccuccugggccagcccagagggcccuucagaccccagcugucugcgcgucugacucuu

SEQ ID NO: 201055 - RNA, 62 nt, Human
cacgggcucuucccgccggguccucccuccccagaccccagagggagaggcccaccccgccc

SEQ ID NO: 201056 - RNA, 62 nt, Human
ucuuggaaaggggaggagcuucucccagugugagaccccaaagacucuggaggucaucuggc

SEQ ID NO: 201057 - RNA, 62 nt, Human
uuuuuauucuugcugcaguugguuaccaaggaagaccccaaagcacuggcuguugccuugaa

SEQ ID NO: 201058 - RNA, 62 nt, Human
ucucagcccagguucuagcccccacgcaccccagaccccagguggaccauccucccaaacua

SEQ ID NO: 201059 - RNA, 62 nt, Human
ucuguccguccagguggccgaccucacugcacagaccccacuccagccccuccaccccuucu

SEQ ID NO: 201060 - RNA, 62 nt, Human
aguucaggugagaaacuguuugauuauagaaaagaccccagacucagagggaaggcucucug

SEQ ID NO: 201061 - RNA, 62 nt, Human
agaaguuugaguccagcccaggcaacacagcaagaccccaucucuauaaaaagaaaaaauaa

SEQ ID NO: 201062 - RNA, 62 nt, Human
ucauuaaggacuccaccccucagagcucacucagaccccaaggacagaggugacuggggcuu

SEQ ID NO: 201063 - RNA, 62 nt, Human
gaagcccagccacaaguguuggagcugcagagagaccccaaagguaguagauugugccagau

SEQ ID NO: 201064 - RNA, 62 nt, Human
uaaaacucagcugcagccuggacaguagagcgagaccccaucuuaaaaauaaagaaggcugg

SEQ ID NO: 201065 - RNA, 62 nt, Human
cguaggagcaagaagggacagggaauuucaagagaccccaaauagccugcucaguagagggu

SEQ ID NO: 201066 - RNA, 62 nt, Human
agucaggccugcugcaggacaggaucccccagagaccccauuugccucucaacacucagacc

SEQ ID NO: 201067 - RNA, 62 nt, Human
ggacccaaggcaggcuguuccuuggggcggucagaccccagucaggagcaaugacugacugg

SEQ ID NO: 201068 - RNA, 62 nt, Human
cccucagaagcaggaaacccucaaacccagccagaccccaggccggggcauugccagggagg

SEQ ID NO: 201069 - RNA, 62 nt, Human
aaggcaaaucuuuucaccucuggcuauuccugagaccccaggaagucaggaaaagccuuuca

SEQ ID NO: 201070 - RNA, 62 nt, Human
agcccuuccuguucccagaugccuugguccaaagaccccaccccucugcugguccugccaac

SEQ ID NO: 201071 - RNA, 62 nt, Human
cuucucccuccucccaaccuacacccucaaguagaccccagugucucuuguucuccucugag

SEQ ID NO: 201072 - RNA, 62 nt, Human
ggcaaagucaaauggggaccagaauaaaucuuagaccccacaguccuucccauuuccagccc

SEQ ID NO: 201073 - RNA, 62 nt, Human
cccugcuugccuccacucccuucugacuuuccagaccccagguccagucugcagauccuacc

SEQ ID NO: 201074 - RNA, 62 nt, Human
ggugaaaccaaacaaauacaaaauccuucuccagaccccagaacuagaaaccccgggccauc

SEQ ID NO: 201075 - RNA, 62 nt, Human
aagggaauuggucccagguacaacagagagcaagaccccaaacagggcguggcugccacgau

SEQ ID NO: 201076 - RNA, 62 nt, Human
cuuuccuguagccuagcauggagaaucugaccagaccccauuuugagaaggucagccuacac

SEQ ID NO: 201077 - RNA, 62 nt, Human
aaacucacauaacuagcccagguaacacagcaagaccccaucucuacaaaaauauuaaaaau

SEQ ID NO: 201078 - RNA, 62 nt, Human
cuccuuuuccccugcuggcuggugacugucagagaccccaucacugaguuuugugugaugag

SEQ ID NO: 201079 - RNA, 62 nt, Human
ccagugacccagccccaccaaugggccuccagagaccccaggaacaauaaaaugucuucucc

SEQ ID NO: 201080 - RNA, 62 nt, Human
aaugcacuuucuuccuccccucuuucuccauaagaccccaggcagaggugggugccuccccu

SEQ ID NO: 201081 - RNA, 62 nt, Human
gacaagggugaacugggagaggacuuacucagagaccccaacaggugauacugcacaaagcc

SEQ ID NO: 201082 - RNA, 62 nt, Human
ugaccucugccugaaaaagcagguauuuucucagaccccagagcaguauuaaugaugcagag

SEQ ID NO: 201083 - RNA, 62 nt, Human
uugaguuugagacuagccugggcaacauagugagaccccaucucuauuuaaaaaaugaacaa

SEQ ID NO: 201084 - RNA, 62 nt, Human
gaugccucuucugugccuuaagcagagucaggagaccccaaggcaugugagcaucugcccag

SEQ ID NO: 201085 - RNA, 62 nt, Human
guguccagggagaaggcucugucccugccgccagaccccagugguugccacugaagaccuca

SEQ ID NO: 201086 - RNA, 55 nt, Human; identical to SEQ ID NO: 38843

SEQ ID NO: 201087 - RNA, 62 nt, Human
cgacucaagaggcugccaggaagcagagaugcagaccccaaggagacugggcuggggcuggu

SEQ ID NO: 201088 - RNA, 62 nt, Human
ggggaucaggccccagagcuugcuguccccugagaccccauccuggggagaggggaggacuc

SEQ ID NO: 201089 - RNA, 62 nt, Human
aggaguuugagaccagccugggcaauaucgugagaccccaucucuacaaaaauacaaauuaa

SEQ ID NO: 201090 - RNA, 62 nt, Human
cagguucgugcccugcugcggccagccugacuagaccccacccugagguccugcauuucuca

SEQ ID NO: 201091 - RNA, 62 nt, Human
aggaauuugagaccagccuaggugacauagugagaccccaucucuacaaaaaauaaaaaauu

SEQ ID NO: 201092 - RNA, 62 nt, Human
uccuggaggauuuccuacccccguccucuucgagaccccagucgugauguggaggaagagcc

SEQ ID NO: 201093 - RNA, 62 nt, Human
ggggaggggagagcucagcccccgacucacucagaccccaaggcccacuguccagcugcaga

SEQ ID NO: 201094 - RNA, 62 nt, Human
ccaagauuagccuguuauccuguuaucuacugagaccccaaauuucucaccaauguuuuggg

SEQ ID NO: 201095 - RNA, 62 nt, Human
gauccccugcugaacagauacacagaguucucagaccccacccccacccucaggugggcugg

SEQ ID NO: 201096 - RNA, 62 nt, Human
uggacccccagcaaaucaggaccuaucuaggcagaccccagccagacccccgccagacagac

SEQ ID NO: 201097 - RNA, 62 nt, Human
caggcugcugcaggaggccaggcccaggccagagaccccaggcagccugagcucuuggaugu

SEQ ID NO: 201098 - RNA, 62 nt, Human
aauacacacauauauauuacaagggauaauuuagaccccauacaaguuuauaaagagucauu

SEQ ID NO: 201099 - RNA, 62 nt, Human
ccagugugacccuugaagacagugccccucagagaccccaagaccuuagggauugacaccug

SEQ ID NO: 201100 - RNA, 62 nt, Human
accacugaugcgagggaaaggccaguggcuggagaccccaugugcaguucuuggauacucug

SEQ ID NO: 201101 - RNA, 62 nt, Human
cgcugcacacagacggccuagggguggcgcucagaccccacccuacgcucaucucuggaagg

SEQ ID NO: 201102 - RNA, 62 nt, Human
ugcuggcuucuguugcgccacugagacggcagagaccccaggaucccagagcuucccaggau

SEQ ID NO: 201103 - RNA, 62 nt, Human
cuggaccaccagagaauggacaccauccaggaagaccccagcacagacucacauauggacga

SEQ ID NO: 201104 - RNA, 62 nt, Human
aagacccagggacccagcgacuaugcccacccagaccccagagcguucccauaacccugaca

SEQ ID NO: 201105 - RNA, 62 nt, Human
gaggggccucagggcuugugggggguaggcugagaccccaccaccaaagguuaagugagguc

SEQ ID NO: 201106 - RNA, 62 nt, Human
agcagcugccggacgccugggucaggaauccaagaccccaccucuuaaggacugguuccuca

SEQ ID NO: 201107 - RNA, 62 nt, Human
ccugggugccgccagacccuucucuucuacaaagaccccagcaggagugggagggucugcaa

SEQ ID NO: 201108 - RNA, 62 nt, Human
gccagccucgcugggcagggcuggccguagccagaccccaagcuggcccacugguccccucu

SEQ ID NO: 201109 - RNA, 62 nt, Human
cagcacaaguggggcaaagccagcaugcaagcagaccccaccaccacagcccaccuccgucc

SEQ ID NO: 201110 - RNA, 62 nt, Human
uuguacauaugugauugcugugggcacaccccagaccccaugucauagcugccgucccgacg

SEQ ID NO: 201111 - RNA, 62 nt, Human
gcugucccacgugaugcugacaugagccucagagaccccaaucccaugccugggggagagac

SEQ ID NO: 201112 - RNA, 62 nt, Human
acucgcggaaggccccguccccagcagaguccagaccccacaacuucaggagcucuuucccg

SEQ ID NO: 201113 - RNA, 62 nt, Human
cgugaggcagggacaagucuuucuccucuuugagaccccagugccugcacaucaugagccuu

SEQ ID NO: 201114 - RNA, 62 nt, Human
uucuuggaagagccuagaagauuccuggauggagaccccauugguucagccucaagucuggc

SEQ ID NO: 201115 - RNA, 62 nt, Human
cagguggggaagcaguuuggcccagcccaaggagaccccaccuugagccuuauuuccuaaug

SEQ ID NO: 201116 - RNA, 62 nt, Human
gaggcccagaguggccugcccccgggagccaaagaccccaguggccacacugggauagggug

SEQ ID NO: 201117 - RNA, 62 nt, Human
aggaggugccuggagugcccacccugggagacagaccccaccuccuuggguagugagcagug

SEQ ID NO: 201118 - RNA, 62 nt, Human
aggaguucaagaccagccugggcaacacagcgagaccccaucucuuaaaaaauaacagacuu

SEQ ID NO: 201119 - RNA, 62 nt, Human
caguggggcuucucuucccuccaugagccuggagaccccaggggaggauccauuugggauga

SEQ ID NO: 201120 - RNA, 62 nt, Human
gggggccugggggugcgugcagccugucggggagaccccacucugacagugggcacacggca

SEQ ID NO: 201121 - RNA, 62 nt, Human
cgacacugcacuccagccuaggcgacagagcaagaccccauucucuuacaaagucucuauua

SEQ ID NO: 201122 - RNA, 62 nt, Human
ggguguaaacacugaugguauaucaguaucugagaccccaaacucuccaaauacugauggug

SEQ ID NO: 201123 - RNA, 62 nt, Human
cccgccaaaccuggugguccugggcggccccgagaccccaacacaugcuucuucgaggggca

SEQ ID NO: 201124 - RNA, 62 nt, Human
ccgcguccuacgcaggcucugccacagggguuagaccccagguccgacgcuugaccuuccug

SEQ ID NO: 201125 - RNA, 62 nt, Human
cuuuuuauuuguagcagcauaauuauuuccaaagaccccaguauuugcugcuauuuuuaaaa

SEQ ID NO: 201126 - RNA, 62 nt, Human
cucucaccuguucucaccccucugcagccccaagaccccacuggccaccccucccucugguc

SEQ ID NO: 201127 - RNA, 62 nt, Human
uuaguuccucuucccgagauggggccgccgagagaccccagcgccuuugaaaagcaagguuu

SEQ ID NO: 201128 - RNA, 62 nt, Human
augggucagggacuccaggccaaguccaacagagaccccaaacccaccacacaccagcagcc

SEQ ID NO: 201129 - RNA, 62 nt, Human
cucuuugagacgagacuccaaguaguaaucccagaccccaccuugcucaucccaaccuguuc

SEQ ID NO: 201130 - RNA, 62 nt, Human
ggagcuuaguuccaaugcauuuggcuccagaaagaccccagugccuuuugacaauggccagg

SEQ ID NO: 201131 - RNA, 62 nt, Human
ccaccucuaugcccugagcccugguaguccagagaccccaacucugcccuggcuucucuggu

SEQ ID NO: 201132 - RNA, 62 nt, Human
aguaggcuucuggaauagaaacagugguuugaagaccccacugccaccuuuauggacuggcc

SEQ ID NO: 201133 - RNA, 62 nt, Human
cccaauuaccauggcaaccuuugccagagcacagaccccagagucuugugguucucuaacuc

SEQ ID NO: 201134 - RNA, 62 nt, Human
agccacugcacuccagccugggcaauauagcaagaccccauccuuuaaaaaauuuuagaacu

SEQ ID NO: 201135 - RNA, 62 nt, Human
aacuauuggugaggagcucgagugguuuguauagaccccagauuuuuguuuacuuuaaugua

SEQ ID NO: 201136 - RNA, 62 nt, Human
gugaauaggcugcuuuuugcuuucuucuuuccagaccccacaguagagcacuuuucacuuau

SEQ ID NO: 201137 - RNA, 62 nt, Human
accaggccugacucaggcagguucugccccccagaccccacacacggccgccccacgugcug

SEQ ID NO: 201138 - RNA, 62 nt, Human
ugcacguggaggaggagcuggcuuucagccccagaccccacgcuagcacuuuccacgcugcu

SEQ ID NO: 201139 - RNA, 62 nt, Human
ugggagaggcugcagcaaggcuuugccucugcagaccccaucuuaguggcacggugcuuggg

SEQ ID NO: 201140 - RNA, 62 nt, Human
gugaggggcuuaaugaccaccacagggagcucagaccccaacccuggaucccaggagaaagg

SEQ ID NO: 201141 - RNA, 62 nt, Human
cugcacccucuggaacccuggcccaauuccucagaccccagaguggccugggacccaagcug

SEQ ID NO: 201142 - RNA, 62 nt, Human
cuggaugcuuucaauguuuuuaaugcuaacauagaccccaaaauuagauauaaagaauuggg

SEQ ID NO: 201143 - RNA, 62 nt, Human
gcugugauuaauuauugaaagugggguguugaagaccccaacuacuauuguagaguggucua

SEQ ID NO: 201144 - RNA, 62 nt, Human
cuaaagccuuuuuaagaaaugccagcugcuguagaccccaugagaaaagaugucuuaaucau

SEQ ID NO: 201145 - RNA, 62 nt, Human
gugcaccuccaucuccaagcacugcugcuggaagaccccauucccucuuuaucuaucaacuc

SEQ ID NO: 201146 - RNA, 62 nt, Human
aaaacugcagugccggucagguauccccccaaagaccccagaaguaacccuaggcucaaugg

SEQ ID NO: 201147 - RNA, 62 nt, Human
cuaagugggccuuuaaaaaccccagcugccagagaccccaacacuaagcccuaaaucugcug

SEQ ID NO: 201148 - RNA, 62 nt, Human
caccacugcacuccagccugggcaacagagcaagaccccauccuccaccccccccaaaaaau

SEQ ID NO: 201149 - RNA, 62 nt, Human
ccucugauauacaauuagagauauuuuuauauagaccccaagcauucugugcauaaaaguua

SEQ ID NO: 201150 - RNA, 62 nt, Human
cugggccugauacuuagcugacauggauuugcagaccccagggugggcagaugucuccagug

SEQ ID NO: 201151 - RNA, 62 nt, Human
gugaauuagcuggaguaggagucugggaguggagaccccaggaaacagcaugaggugagggu

SEQ ID NO: 201152 - RNA, 62 nt, Human
cccagcaaaugaaccuacggguggcuuuuccuagaccccaaagaggugaauugcauuuaaau

SEQ ID NO: 201153 - RNA, 62 nt, Human
uccuagccuggccagugaugcugcuggcguccagaccccagacucacuccaagcacucuugu

SEQ ID NO: 201154 - RNA, 62 nt, Human
acuggcucaagguguagagggagcagagacgaagaccccaggaagucauccugcaaugggag

SEQ ID NO: 201155 - RNA, 62 nt, Human
ccuaggcaauggaguccagauuuuaguaagucagaccccaugugugagaaggaaagcuggaa

SEQ ID NO: 201156 - RNA, 62 nt, Human
aagagaucgagaucacccuggcccacauggugagaccccaacucuacuaaaaauacaaaaau

SEQ ID NO: 201157 - RNA, 62 nt, Human
agacauucuugcuauaacuaagugcuucuccaagaccccaacugaguccccagcaccugcua

SEQ ID NO: 201158 - RNA, 62 nt, Human
cacuuguaaagugacuaccuuaauguguauagagaccccagucuacuauuauuugggaaaau

SEQ ID NO: 201159 - RNA, 62 nt, Human
guaccacugcauuccugcugagcaacagagugagaccccaucucaaaaaagaaaaaaaaagg

SEQ ID NO: 201160 - RNA, 62 nt, Human
gaggucaguggugaugccucuugcugcuccccagaccccaucucuccugaagaccugccacg

SEQ ID NO: 201161 - RNA, 62 nt, Human
aaggcacagggagaagggauaacccuacacccagaccccaggcuggacaugcugacuguccu

SEQ ID NO: 201162 - RNA, 62 nt, Human
auaugaacacuuuauaauuguauguucuuuuuagaccccauaaauccuguauacaucaaaga

SEQ ID NO: 201163 - RNA, 62 nt, Human
cugaacagacaucagcacaucagacgucuuuuagaccccaagacaauuuuucuguuucaguu

SEQ ID NO: 201164 - RNA, 62 nt, Human
gaacaagcuucuggacuugggcuuacagagcaagaccccacaacuguaggcugggggugggg

SEQ ID NO: 201165 - RNA, 62 nt, Human
accuggggauugggcaguguggaagaacguguagaccccagaaugaaacaugggguuggagu

SEQ ID NO: 201166 - RNA, 62 nt, Human
gaucaggaaccacacaauccccaggguuccugagaccccaggccuaaaccugagacuuccuc

SEQ ID NO: 201167 - RNA, 62 nt, Human
cuucucccaacagcccacuguuaggagguaguagaccccagccucaaggcucugaccuucuu

SEQ ID NO: 201168 - RNA, 62 nt, Human
aauagcagcaguccucccccuaccccgccccgagaccccaccccgagaccccaccccggacc

SEQ ID NO: 201169 - RNA, 62 nt, Human
cucccccuaccccgccccgagaccccaccccgagaccccaccccggaccaguuacauucguu

SEQ ID NO: 201170 - RNA, 62 nt, Human
aaacaaaggaaggagcuggguggccuugagggagaccccagccccgaggaggaugagggcau

SEQ ID NO: 201171 - RNA, 62 nt, Human
gggaguuugaguccagcaugggcaacauaacaagaccccaucccuuauuaaaagaaaaaaaa

SEQ ID NO: 201172 - RNA, 62 nt, Human
ugauuucuucccucucccuggugucucccccaagaccccaaauaaagcaauacacuguuaac

SEQ ID NO: 201173 - RNA, 62 nt, Human
cccuguauccucuggauguaaaaagcaaggagagaccccaacugucuccauggagaagaacu

SEQ ID NO: 201174 - RNA, 62 nt, Human
agacaccaggcuuauuggggcgugcacagccaagaccccaagaagugacuccuuguaaaaug

SEQ ID NO: 201175 - RNA, 62 nt, Human
ucugcaccuccuuaggcccugccucugggcucagaccccaaccuagucaaggggauucuccu

SEQ ID NO: 201176 - RNA, 62 nt, Human
aagagguggaaaccaucuugggcuacauagagagaccccaucucuacaaagaaagauuuaaa

SEQ ID NO: 201177 - RNA, 62 nt, Human
agccaagcccaggcaugagcucuggcaaagcaagaccccagauucuccauuuuugccugugg

SEQ ID NO: 201178 - RNA, 62 nt, Human
cugggcaugaagaagggagcacagcagcuacuagaccccauuagcaccucauuagcccacaa

SEQ ID NO: 201179 - RNA, 62 nt, Human
cccagguuggauggggaaaggcuaauggggucagaccccaccccgucuaccccuccagucag

SEQ ID NO: 201180 - RNA, 62 nt, Human
aaaugugaccagugguuucugcucggagcugcagaccccagggcucuugguggaggcagggg

SEQ ID NO: 201181 - RNA, 62 nt, Human
uuauaaauuuucuuaaagauuaagaaaauuuaagaccccauugaguuacuguaaugcaauuc

SEQ ID NO: 201182 - RNA, 62 nt, Human
gaugccgauacaggcccuugguguuuuaccacagaccccagcgucaggugggaguacugcaa

SEQ ID NO: 201183 - RNA, 62 nt, Human
cugugcuuucccuuccaagccagggcuuccaaagaccccacugccccggagcugaagccgac

SEQ ID NO: 201184 - RNA, 62 nt, Human
gcccugcaccccccagguccugggacuccugcagaccccacuccauucccgcuccuggaaca

SEQ ID NO: 201185 - RNA, 62 nt, Human
cuuuggggacuucugagaucagcguccuaccaagaccccagcccaacucaagcuacagcagc

SEQ ID NO: 201186 - RNA, 62 nt, Human
uuuaaaugcccuugaaucuagcuuugccuuggagaccccagugggugcugcuccugccguuu

SEQ ID NO: 201187 - RNA, 62 nt, Human
caccacugcacuccagccugggugauagagcaagaccccaacucaaaaaaaaaaaaaaggau

SEQ ID NO: 201188 - RNA, 62 nt, Human
aggcugacaaugacuccuguuuucacgcugagagaccccacuccccugcugagaucgcgcca

SEQ ID NO: 201189 - RNA, 62 nt, Human
aggaguuugagaccagccugggcaacauagcgagaccccaucucuacaaaagauuaaaaauu

SEQ ID NO: 201190 - RNA, 62 nt, Human
ugcagugagcuaugaucgcaccacugcauuccagaccccaucucgaaaaaaaaaaaaaaaaa

SEQ ID NO: 201191 - RNA, 62 nt, Human
cugcuggggcggccagcacccucuccacgugcagaccccaugcgucccggagccuggugugu

SEQ ID NO: 201192 - RNA, 62 nt, Human
gagccagugcccacuauggcccugggagagccagaccccaaggcccagacaggcucagguuu

SEQ ID NO: 201193 - RNA, 62 nt, Human
auggggguggugggaagaauuggccacguuggagaccccaugccaccccaccauggugagug

SEQ ID NO: 201194 - RNA, 62 nt, Human
gcaaggacuacgucuaagggacagacgcagggagaccccaccaccaccaccaccaccaacac

SEQ ID NO: 201195 - RNA, 62 nt, Human
caguucucagggugcugaccucucucucccacagaccccagacacccauuguccauagccuu

SEQ ID NO: 201196 - RNA, 62 nt, Human
ucauuaccccuacacaucucuccacggagcccagaccccagcacagauauccacacacccca

SEQ ID NO: 201197 - RNA, 62 nt, Human
gucccugaggacagcacagaggcgggacucagagaccccauuccucuucacgcagcccuuac

SEQ ID NO: 201198 - RNA, 62 nt, Human
aagaggugaguaacuugcccauuucuccacagagaccccauuuaaauaacacaaaauugacc

SEQ ID NO: 201199 - RNA, 62 nt, Human
gugcagaugagccuuagguuccagccgccugcagaccccaccccagcaggcucacucagcaa

SEQ ID NO: 201200 - RNA, 62 nt, Human
gcuuuggagacgagauggcucuuguucagucaagaccccagacucuggccacaaaaaugcca

SEQ ID NO: 201201 - RNA, 62 nt, Human
cuccaggaccgcugcgggugguaaccaguggaagaccccagcccccagggagaggaacccgu

SEQ ID NO: 201202 - RNA, 58 nt, Human; identical to SEQ ID NO: 38959

SEQ ID NO: 201203 - RNA, 62 nt, Human
uguggagcgagagggaggcagguggacgcugcagaccccagguucagugcggccccucggcu

SEQ ID NO: 201204 - RNA, 62 nt, Human
aaugucuuguuccugugcauugguggcaucacagaccccagcuggggcgcgaugucaaaggu

SEQ ID NO: 201205 - RNA, 62 nt, Human
gaucaaagaguuagaccaaugcuugaauaaguagaccccaagcauccuuuucuaaaaaguga

SEQ ID NO: 201206 - RNA, 62 nt, Human
gaggagcuugggugacagccaggugagcacccagaccccagacccucaugugcugugugccu

SEQ ID NO: 201207 - RNA, 62 nt, Human
agcggagaccauuuccaggccuuauugagaccagaccccaagucccccacccccauccugcu

SEQ ID NO: 201208 - RNA, 62 nt, Human
uuaauucaaaccagaugccuguacuaguuuuuagaccccaagucaaccuuucugagccacag

SEQ ID NO: 201209 - RNA, 62 nt, Human
aaaaagucaaccucccaguuuaaaggaugggaagaccccaaucaccagguuauuggaucugu

SEQ ID NO: 201210 - RNA, 62 nt, Human
auuccccgccgggagcaacaucucucuucucgagaccccagccccuccgcugucuacccaug

SEQ ID NO: 201211 - RNA, 62 nt, Human
ggcucuccccuugugauucuguccccuccccaagaccccaccucauaucaucuuauggguua

SEQ ID NO: 201212 - RNA, 62 nt, Human
gaaacuggaggacaugauccaggagcuucaggagaccccaucgcagacgucaguggucucug

SEQ ID NO: 201213 - RNA, 62 nt, Human
agaaguucgagaccagccugggcaauguagugagaccccaucacuacuaaaaauacauaaau

SEQ ID NO: 201214 - RNA, 62 nt, Human
ggaugauuuugcagguccaaugcaaacaucacagaccccacccaugcauaggagagacucua

SEQ ID NO: 201215 - RNA, 62 nt, Human
gcuuagagugaacaugucuauggacuuuaaaaagaccccacgcaauuugacuuuguggcaau

SEQ ID NO: 201216 - RNA, 62 nt, Human
ccaacaggcaaaacgugggugcaaaagugaugagaccccacacuuuacacucguggugacaa

SEQ ID NO: 201217 - RNA, 62 nt, Human
auggaaugcugaugacuuggagcaggccccacagaccccacagaggaugaagccaccccaca

SEQ ID NO: 201218 - RNA, 62 nt, Human
agucuuuuaaccuggguguuagcauuuuaaagagaccccacaggaguucuggccugugacua

SEQ ID NO: 201219 - RNA, 62 nt, Human
aggaguuugaaaccagucuggacaacauagggagaccccaucucuaccggaggaaaaaaaaa

SEQ ID NO: 201220 - RNA, 62 nt, Human
ccguuuuaaggacauuaaaagcuaucaggccaagaccccagcuucauuaugcagcugagguc

SEQ ID NO: 201221 - RNA, 62 nt, Human
auucucuuggcugguucucucauugaauuaucagaccccaagaggagauauuggaacaggcu

SEQ ID NO: 201222 - RNA, 62 nt, Human
ggacuggcccugcuccuguacugcuauccgccagaccccaagggccugccagggacccggcg

SEQ ID NO: 201223 - RNA, 62 nt, Human
ucccuccgcucccuccugucaccuaccagggcagaccccacuaagccguugagucucuuccu

SEQ ID NO: 201224 - RNA, 62 nt, Human
auucugcagcaccgccucuuggggcaguggucagaccccacacgcccucucugggcccacca

SEQ ID NO: 201225 - RNA, 62 nt, Human
uuguggcccccagcuucuguuucaagcugggcagaccccaggaucccuucccucccuaagga

SEQ ID NO: 201226 - RNA, 62 nt, Human
uuuucuauucuuuauuuuuccugcaacccaccagaccccaggccucaccggaggcccgguga

SEQ ID NO: 201227 - RNA, 62 nt, Human
cagauguuacagucuuagggauccgggaugggagaccccacuuuagaaagggucgucacucc

SEQ ID NO: 201228 - RNA, 62 nt, Human
ucaggaguucuagaccaaucugggcaacagagagaccccaucucuuuuaaauaaaaaguuaa

SEQ ID NO: 201229 - RNA, 62 nt, Human
gccauagcccagugagcagccuggagcccuggagaccccaccagccucaccagcgcuugaag

SEQ ID NO: 201230 - RNA, 62 nt, Human
gggcccgggguucggggauagaagccccgccgagaccccacagggaccucagucaccuuuga

SEQ ID NO: 201231 - RNA, 62 nt, Human
ucuggaccuggaaagccuggggaaggacugacagaccccaggaccagcccuggggcucaggg

SEQ ID NO: 201232 - RNA, 62 nt, Human
caaggcagcuuuccuuacccugacacagccccagaccccacaaagccuucuggaccuggaaa

SEQ ID NO: 201233 - RNA, 62 nt, Human
gcuggcggccucuuccugggagccaugaccucagaccccacccacacuccagaucgagaccc

SEQ ID NO: 201234 - RNA, 62 nt, Human
gccuggggcccucacuccugcccacgccucccagaccccagaacggagcuucaagucagaca

SEQ ID NO: 201235 - RNA, 62 nt, Human
ccggcaguagcccccacgcuggccccagccucagaccccacccagcaccuucccagacacgc

SEQ ID NO: 201236 - RNA, 62 nt, Human
cagggucgccagagccgcgagccacuccagcgagaccccaccuugcauggugccccuuccug

SEQ ID NO: 201237 - RNA, 62 nt, Human
accuucagagaguggaugggagcgaaguaaggagaccccaccugagcagauacaugguauug

SEQ ID NO: 201238 - RNA, 62 nt, Human
ugccacuguacucuagccuggaagacagagugagaccccaucucaggaaaaaagaaaaaaaa

SEQ ID NO: 201239 - RNA, 62 nt, Human
uggucacagagucuccugggcacagguuauacagaccccagccccauucccaucuacugaaa

SEQ ID NO: 201240 - RNA, 62 nt, Human
cucuuaucuuccuuuugugguuuuuaauuugaagaccccagagaauuccauuacauaaugau

SEQ ID NO: 201241 - RNA, 62 nt, Human
guggugugaccugaguuggugacacaggccacagaccccagagcuuggcuuuugaaacacaa

SEQ ID NO: 201242 - RNA, 62 nt, Human; identical to SEQ ID NO: 38999

SEQ ID NO: 201243 - RNA, 62 nt, Human
uugcuuuccccuugggugcuggccucaaugucagaccccacgcgcugccccuuccuggccug

SEQ ID NO: 201244 - RNA, 62 nt, Human
gccucugccuggcagcucugugggaaaguggaagaccccaugaugacaucauggggagccag

SEQ ID NO: 201245 - RNA, 62 nt, Human
cucaucuguggagcaagccaacucagugccccagaccccaccugaucugcaucuuuguuugc

SEQ ID NO: 201246 - RNA, 62 nt, Human
aggcagagacaacuucuaagaauuuggcugccagaccccaggccuggcugcugcugugugga

SEQ ID NO: 201247 - RNA, 62 nt, Human
uccaauuccuaguauguaacuagagguucaagagaccccaaauuccugccauuuuccccauu

SEQ ID NO: 201248 - RNA, 62 nt, Human
uguacggcuugagguuucagcauccaggcugcagaccccacgcagugucucauacaguggaa

SEQ ID NO: 201249 - RNA, 62 nt, Human
gauuacaugccaucugggacaggccaugugggagaccccaguugugccuuugcuacagaucu

SEQ ID NO: 201250 - RNA, 62 nt, Human
uguucuucaggagaugauucuguuuuuucuccagaccccaugccuuacgaaccaugccuucc

SEQ ID NO: 201251 - RNA, 62 nt, Human
ccucacagagcuccucuauccgaggccauuggagaccccaguuucucaagaauucagcucug

SEQ ID NO: 201252 - RNA, 62 nt, Human
acggccugcucaguggagccaggagcuaacucagaccccaaagcaagcagggggccaguggc

SEQ ID NO: 201253 - RNA, 62 nt, Human
acccagcagaggugugacgggaggcuggggagagaccccagcaccuugagcacacaggagcc

SEQ ID NO: 201254 - RNA, 62 nt, Human
uccaaauccugucuuuuccccacuauuccauuagaccccacaaauguuaguugugugugugu

SEQ ID NO: 201255 - RNA, 62 nt, Human
uggacucagggcaggugccguggguucuccagagaccccagcaacuggcccaggaugcaggc

SEQ ID NO: 201256 - RNA, 62 nt, Human
uaggccccaccuccacgucccggcugggccccagaccccagcuuccugcccuccaccgggag

SEQ ID NO: 201257 - RNA, 62 nt, Human
cacugccccucucccucaagccuaagacacuaagaccccagacccaaagccaaguccaccag

SEQ ID NO: 201258 - RNA, 62 nt, Human
uuauacuuggagucacaggggccaaaggccugagaccccacccugcccccaaacuggcuaag

SEQ ID NO: 201259 - RNA, 62 nt, Human
acagucucccagagcugagggcuugccucuggagaccccagccccagagggcuuuguggagg

SEQ ID NO: 201260 - RNA, 62 nt, Human
cuccaccauagacucaguggccuggccuccccagaccccagagccaagaacacuaagcacuc

SEQ ID NO: 201261 - RNA, 62 nt, Human
aggagugcaagaccugccugggcaauauacugagaccccauucuccacaaaaaggaaaaaua

SEQ ID NO: 201262 - RNA, 62 nt, Human
ggccacaugggcaucaggggcuggccccacagagaccccacagggcagugagcucugucuuc

SEQ ID NO: 201263 - RNA, 62 nt, Human
gggagaugugcucccagagccucucugcuguaagaccccagcuuuuccuggaagaugggacu

SEQ ID NO: 201264 - RNA, 62 nt, Human
aggaguuugagaccagccugggcaauguagcaagaccccaucucuauauaaaauauaaaaau

SEQ ID NO: 201265 - RNA, 62 nt, Human
cccucuuuauugaacauuagccagcccagcccagaccccagggcugccuaaggacacagaga

SEQ ID NO: 201266 - RNA, 62 nt, Human
ccaaccaaccacacccggugggggcacagcacagaccccagagccaggaaccucucagccga

SEQ ID NO: 201267 - RNA, 62 nt, Human
ccaaccagccacacccggugggggcacagcacagaccccagaggcaggaaccucucagccga

SEQ ID NO: 201268 - RNA, 62 nt, Human
ccaaccagccacacccagugggggcacagcacagaccccagagccaggaaccucucagccga

SEQ ID NO: 201269 - RNA, 62 nt, Human
ccaaccagccacucccgguggggacacagcacagaccccaaagccaggaaccucucagccga

SEQ ID NO: 201270 - RNA, 62 nt, Human
agaaauucaagacccgccugggcaucauaaugagaccccaucucuacaacaaaauuuaauaa

SEQ ID NO: 201271 - RNA, 62 nt, Human
auccagagcacagaucuguuucgugcauuggaagaccccacccaagcuuggcagccgagcuc

SEQ ID NO: 201272 - RNA, 62 nt, Human
gcucugggggacuccuuccuugaacccuaauaagaccccacuggagucucucucucuccauc

SEQ ID NO: 201273 - RNA, 62 nt, Human
ccaccccggcucccggacgccagcugggcgucagaccccaccggggcaaccuugcagaggac

SEQ ID NO: 201274 - RNA, 62 nt, Human
gagcaucuccuggcaggggucucuucccaaccagaccccacccaggcacauuagcgaccagg

SEQ ID NO: 201275 - RNA, 61 nt, Human; identical to SEQ ID NO: 39032

SEQ ID NO: 201276 - RNA, 62 nt, Human
uuguucaaaaaucaggaaaagaaaagauuugaagaccccaagucuugucaauaacuugcugu

SEQ ID NO: 201277 - RNA, 62 nt, Human
aggccauauccaccugugcccuggggcuugggagaccccauagggccgggacucuuggguca

SEQ ID NO: 201278 - RNA, 62 nt, Human
ugugucugauagugauguuggugaaaguucguagaccccaggaguagagaaaagcaacugga

SEQ ID NO: 201279 - RNA, 62 nt, Human
agaugcuccggagcugccugcucuaugcccugagaccccacugcugucauugucacaggaug

SEQ ID NO: 201280 - RNA, 62 nt, Human
cugaguggaugaucaggcccagagcaacccugagaccccagguacccacagcauuggcuguu

SEQ ID NO: 201281 - RNA, 62 nt, Human
cucuaggcccucugcuggugcuguggaggccaagaccccauuaagccuaaaggugauggguc

SEQ ID NO: 201282 - RNA, 62 nt, Human
aaaggauuaggugggcacauaagauuccgaucagaccccaaccaugcugcauguguaaagaa

SEQ ID NO: 201283 - RNA, 62 nt, Human
agcacuccucggcaggcauggcuggugccugaagaccccagaugugagggcaccaccaagaa

SEQ ID NO: 201284 - RNA, 62 nt, Human
auucugucacaaugaaagaaaacuguuuauauagaccccauuggaaaagcaaaacgcucuca

SEQ ID NO: 201285 - RNA, 62 nt, Human
uuucauccucagcaaauuucauccuggcucacagaccccacaaaaaagaucccaguacagau

SEQ ID NO: 201286 - RNA, 62 nt, Human
auuuggcucugagucgaggcaaccugcacacaagaccccaccaaggaaugugcaaggacuga

SEQ ID NO: 201287 - RNA, 62 nt, Human
ccaggcaaagacacccuuagcucaccuuuaauagaccccauaacccacuaugccuuccuguc

SEQ ID NO: 201288 - RNA, 62 nt, Human
accagcgccaaaaaguagauucaucaaacuagagaccccagcuccccuucucgccaucuucu

SEQ ID NO: 201289 - RNA, 62 nt, Human
acaucaugaucccuccaguuagcucuaauuacagaccccaccaguacagcuugacagcuccc

SEQ ID NO: 201290 - RNA, 62 nt, Human
cuugcccccaggcuggaagagaagagacagaaagaccccaugacccccccauguggaucccc

SEQ ID NO: 201291 - RNA, 62 nt, Human
gccauuauuccaaaaggucauuguuucucacuagaccccagggcaccagaugaauuuccaag

SEQ ID NO: 201292 - RNA, 62 nt, Human
ugcuggcugggugggccagggagcccgccagcagaccccacacagcauguccgccccagggc

SEQ ID NO: 201293 - RNA, 62 nt, Human
auucccaacaguaaccuccuccuccuggugacagaccccaccugugacugcagcaucuuccc

SEQ ID NO: 201294 - RNA, 62 nt, Human
ccuugucugccuccugcugcuucuguaacugcagaccccaggcccaauggcaagcccucggc

SEQ ID NO: 201295 - RNA, 62 nt, Human
cuaaagcacugguucucaaacuuuuuggucucagaccccacucuuagaaauugaggaucuca

SEQ ID NO: 201296 - RNA, 62 nt, Human
agcccaaccugcccacguucucuauuguuuugagaccccauugcuuucaggcugccccuucu

SEQ ID NO: 201297 - RNA, 62 nt, Human
uucauacuagucccuucccaauccaucaguaaagaccccaucugccuuguccaugccguuuc

SEQ ID NO: 201298 - RNA, 62 nt, Human
aggaguuugagaccgacaugggcaacaugacaagaccccaucucuacaaaaaaauuaaaaaa

SEQ ID NO: 201299 - RNA, 62 nt, Human
caagaugauauaauuggaguauuuuaaacacuagaccccaggagcuuggcugaacuggaaag

SEQ ID NO: 201300 - RNA, 62 nt, Human
cuggcagggugggauggaggagaagaauuuucagaccccagcggcugagucaugaucucccu

SEQ ID NO: 201301 - RNA, 62 nt, Human
gcuggcucaggaagccaagaaacuggaugccaagaccccaucccagcggaacaaguggcaac

SEQ ID NO: 201302 - RNA, 62 nt, Human
cccauucucucacuuccccaucuugucuuccuagaccccacagaguuaaaacuugggauucc

SEQ ID NO: 201303 - RNA, 62 nt, Human
aaacucaccucccucuccccaacgaggcauggagaccccagcucaacacgcccccucuccau

SEQ ID NO: 201304 - RNA, 62 nt, Human
uccagccacacuucccugggaaaccuaaguccagaccccaugagcucucagccagcucuuuu

SEQ ID NO: 201305 - RNA, 51 nt, Human; identical to SEQ ID NO: 39062

SEQ ID NO: 201306 - RNA, 62 nt, Human
caaggcacaaucaguuuucaggaagugcuucaagaccccaggugaaaugaaaaugcuaagua

SEQ ID NO: 201307 - RNA, 62 nt, Human
cacgggcucuccugggccaccccugagugcccagaccccauuccacagcucugggcuuccuc

SEQ ID NO: 201308 - RNA, 62 nt, Human
ucccuuagcucacucugccaucuguuuuggcaagaccccaccuccacgggcucuccugggcc

SEQ ID NO: 201309 - RNA, 62 nt, Human
cucuuugaaagggcuuuacagugggggcaccaagaccccaaagggcccaggccaggagacug

SEQ ID NO: 201310 - RNA, 62 nt, Human
gagugggcaccaggggacgcucuggcgagggcagaccccaggggaaagcaaagggcgucuca

SEQ ID NO: 201311 - RNA, 62 nt, Human
caguuugguccagaggagggaggaggaagggaagaccccaguggugggacccuggaccaggc

SEQ ID NO: 201312 - RNA, 62 nt, Human
uuaauuuucuuucacuuaaguuaguuccacugagaccccaggcuguuagggguuauuggugu

SEQ ID NO: 201313 - RNA, 62 nt, Human
gcgauaccucucgcucccaugcccaucacuacagaccccaagucaagaugaauaucauagcc

SEQ ID NO: 201314 - RNA, 62 nt, Human
agguaagaauuugagaccagccugggcaaaauagaccccaugucuacaaaaaaacucaaaac

SEQ ID NO: 201315 - RNA, 62 nt, Human
agaaggugcggucuagggaccagugaauaagaagaccccacuucaacuuccccucgaagacg

SEQ ID NO: 201316 - RNA, 62 nt, Human
uccauuuccugucccucugugguucugacuggagaccccagugugggggaggucuuaccauu

SEQ ID NO: 201317 - RNA, 62 nt, Human
cucacuccccagccuccucuggauagggaugaagaccccacugggguuggaagugcagaggc

SEQ ID NO: 201318 - RNA, 62 nt, Human
gaaaugaaaggugacaaaaggcagaaggagggagaccccaaaaagagguaaauuugguaucu

SEQ ID NO: 201319 - RNA, 62 nt, Human
cucugccuguggacgcugcaccugccacuuaaagaccccaaagacucuguugggaacuguug

SEQ ID NO: 201320 - RNA, 62 nt, Human; identical to SEQ ID NO: 39077

SEQ ID NO: 201321 - RNA, 62 nt, Human
gggcuucaaguacagauugggcacacuccaccagaccccagcaaggucagcugccccacgcc

SEQ ID NO: 201322 - RNA, 62 nt, Human
cugccuaggacccagugccgcaggccuggaucagaccccaggaucagaccuuggggucuucu

SEQ ID NO: 201323 - RNA, 62 nt, Human
caaugggcccacgaccaagacccuggguguucagaccccaaggccagggccuuucccgcugc

SEQ ID NO: 201324 - RNA, 62 nt, Human
cguggaugaaaaccacagggauuccggacgccagaccccauuuuauacuucacuuuucucua

SEQ ID NO: 201325 - RNA, 62 nt, Human
aaaaauuugccaagagccugagugacagagcaagaccccaucucaaaaaaaaaaacaaacaa

SEQ ID NO: 201326 - RNA, 62 nt, Human
cacauaccaucacuuggcaauuuuuuagaauaagaccccauuauuaucuauugcuauaaacc

SEQ ID NO: 201327 - RNA, 62 nt, Human
cuuuuuuaaaaauagagauuucacaucugcccagaccccacucaaaacgauuuggucagguu

SEQ ID NO: 201328 - RNA, 62 nt, Human
cugccuucagguucucucuggagaaagguuagagaccccaggacaaucaacaugugcaccgu

SEQ ID NO: 201329 - RNA, 62 nt, Human
cagccugugccuuugucagcucuucuuucaaaagaccccaccgacagaccgcauuccacccc

SEQ ID NO: 201330 - RNA, 62 nt, Human
ugccccaacccccagcauucccgggugggcccagaccccaucaccaagacuggccacccgcu

SEQ ID NO: 201331 - RNA, 62 nt, Human
cuagaaccugggcugugcugcuuuugagccucagaccccaggucagcaucucgguucugcgc

SEQ ID NO: 201332 - RNA, 62 nt, Human
cagcagguacccacuggcccccuccucaguggagaccccaaggagcugcagcugaacugcag

SEQ ID NO: 201333 - RNA, 62 nt, Human
ugugcugugcagcccgguuccuaacagaccacagaccccacaccaggucuaucucauuuggu

SEQ ID NO: 201334 - RNA, 62 nt, Human
cuagguucuuggaauuccuuugugcucaucagagaccccagccuggggaacacgcugcccgc

SEQ ID NO: 201335 - RNA, 62 nt, Human
cagagcccugucucacucaccccaccugucuuagaccccaguucccagccugacaagcuuuc

SEQ ID NO: 201336 - RNA, 62 nt, Human
cugcaucuagaaucgcucaaacaccuguuugcagaccccaugcaccagcuggaggggccgua

SEQ ID NO: 201337 - RNA, 62 nt, Human
gaacuggugccccggcagccugcuggacucccagaccccauccagccaggggaccgcaggcc

SEQ ID NO: 201338 - RNA, 62 nt, Human
ggcccacuggccguccugcauuucugguuuccagaccccaaugccucccauucggauggauc

SEQ ID NO: 201339 - RNA, 62 nt, Human
gacccucucugcaaaacucuccccuguccucuagaccccacccuggguguaugugagugugc

SEQ ID NO: 201340 - RNA, 62 nt, Human
uaggccccugguacucagucacggcagccaggagaccccaggugaguuucugagcgcauacg

SEQ ID NO: 201341 - RNA, 62 nt, Human
cccucacaguucacauucagcucagcagagcaagaccccagagaugcuuagagacaggacac

SEQ ID NO: 201342 - RNA, 62 nt, Human
acugugggucccauucggcuguuucccccaccagaccccagggaagccggggcccacuccga

SEQ ID NO: 201343 - RNA, 62 nt, Human
guccaugugugacagcagaaccacaugccccaagaccccagggcuucccccaaaauucugag

SEQ ID NO: 201344 - RNA, 62 nt, Human
gauuacuugaggccagacugggcaauauagcaagaccccaucucuaaaaaauuaggcauggu

SEQ ID NO: 201345 - RNA, 62 nt, Human
gccugccacaccacuccugccuggugcucggcagaccccacugugcccuggccuugggucug

SEQ ID NO: 201346 - RNA, 62 nt, Human
agcaguugaggcccgggcagggcccccacaccagaccccaacauagcuuccccacccaggca

SEQ ID NO: 201347 - RNA, 62 nt, Human
cuugcguguagaaaacccggccccugaggaaaagaccccacugguucucugaugaccuggga

SEQ ID NO: 201348 - RNA, 62 nt, Human
ccuggccccuucccgacccccacccgccauucagaccccauuaagaagguuggcuuggccag

SEQ ID NO: 201349 - RNA, 62 nt, Human
cacacuuuggaaagugggacccuccagccuggagaccccauggacugaugccuccacugcug

SEQ ID NO: 201350 - RNA, 62 nt, Human
aaauggauacagccuugacccucccagugaggagaccccaauucagcaauaagucucacccu

SEQ ID NO: 201351 - RNA, 62 nt, Human
cacuguacucugugggcaaggauggguccagaagaccccacuucaggcacuaagaggggcug

SEQ ID NO: 201352 - RNA, 62 nt, Human; identical to SEQ ID NO: 39109

SEQ ID NO: 201353 - RNA, 62 nt, Human
cugagccaccaccgagccauggcaggaucgggagaccccaacucccccugaacaauccuuuu

SEQ ID NO: 201354 - RNA, 62 nt, Human
ccagagagaugggacaugguagacuguggcccagaccccagagcagagaaacuuguucccau

SEQ ID NO: 201355 - RNA, 62 nt, Human
uaucucauccuagcuaagcucuauaaugcccaagaccccaaacaguacuuuuacuuuguuug

SEQ ID NO: 201356 - RNA, 62 nt, Human
aggaguucgagaagagccugggcaacauagugagaccccaucucuacaaagaaaaaaaaauu

SEQ ID NO: 201357 - RNA, 62 nt, Human
uccaaggacucuaaaagggggcuauucccuggagaccccagaguaggguugccaguccugca

SEQ ID NO: 201358 - RNA, 62 nt, Human
cccagugucggacccugccuuccucccacuccagaccccaccuugucuucccucccuggcgu

SEQ ID NO: 201359 - RNA, 62 nt, Human
cuccuccccuaaagcagcgcggggggcaaauaagaccccaccccucccugcagcuucacagg

SEQ ID NO: 201360 - RNA, 62 nt, Human
uauccuuguuuaugccucacuauuggcagaaaagaccccauuuaaaacccagagaacacugg

SEQ ID NO: 201361 - RNA, 62 nt, Human
aggcagggggcccugccccaccccauccagccagaccccacgcugaccaugcgucaggggcc

SEQ ID NO: 201362 - RNA, 62 nt, Human
uguggagcuuucuaauuuacaaaaugcuuuguagaccccauugucuuuaaaccauacaacau

SEQ ID NO: 201363 - RNA, 62 nt, Human
caaugcagcugcucugggccucgggagaggagagaccccaguccccugggcugcccuucccg

SEQ ID NO: 201364 - RNA, 62 nt, Human
gugggccaaucuacuugaaguuacucggacaaagaccccaaaguggggcaacaacuccagag

SEQ ID NO: 201365 - RNA, 62 nt, Human
ggaaagcaacagcuaucagagagagaagggccagaccccauagccucuuagauuccuggcag

SEQ ID NO: 201366 - RNA, 62 nt, Human
cccuguacagaaucgagugcuguagccuggccagaccccagagcccuugugccaucuuucuu

SEQ ID NO: 201367 - RNA, 62 nt, Human
uauuugaaaaggaaaaaacaaaaaacaaacccagaccccaccugaauugggcuuuuuaacuu

SEQ ID NO: 201368 - RNA, 62 nt, Human
ucaagcagugaaaggaauucccaucaggacucagaccccaggccgagaucuugcccugaaug

SEQ ID NO: 201369 - RNA, 62 nt, Human
agcucgagagagauucagagauggaacacaccagaccccagaucacaaagccaaccaugccc

SEQ ID NO: 201370 - RNA, 62 nt, Human; identical to SEQ ID NO: 201369

SEQ ID NO: 201371 - RNA, 62 nt, Human; identical to SEQ ID NO: 201369

SEQ ID NO: 201372 - RNA, 62 nt, Human
caaagacaaacugcaugaaaaggguacagcuuagaccccaaugggaaggcccacccucucuu

SEQ ID NO: 201373 - RNA, 62 nt, Human
acagauucuuucccaugggggcucucuuccccagaccccagauccaaggucccucacccugc

SEQ ID NO: 201374 - RNA, 62 nt, Human
ccauaaaauaaguaucuguuacgaguaacugaagaccccauucuccaagcaucagauccauu

SEQ ID NO: 201375 - RNA, 62 nt, Human
cuagaaacaguuaaagugucuaauaaugcugaagaccccaaagaucucauguuaaguggaga

SEQ ID NO: 201376 - RNA, 62 nt, Human
guacuuuugcuguuuuacacagagaaacagguagaccccacagaggagaaggaggggauuca

SEQ ID NO: 201377 - RNA, 62 nt, Human
uucucuacugagccuggggucucuagccagggagaccccaucuuauucaccauguccaagau

SEQ ID NO: 201378 - RNA, 62 nt, Human
uccuaagaaugugaugggccacaaggaaagagagaccccagucaagcuccuaguaugcccug

SEQ ID NO: 201379 - RNA, 62 nt, Human
gugguggggugugagaagccugcaauaccccaagaccccagagggcaguccuuaggaagcac

SEQ ID NO: 201380 - RNA, 62 nt, Human
gucuugcuccuggaugaaccaucuacgggcauagaccccacagggcagcagcaaauguggug

SEQ ID NO: 201381 - RNA, 62 nt, Human
aagggugaaucuccugcucugugaaugcuaucagaccccaaaggccaaccuugggcuggguc

SEQ ID NO: 201382 - RNA, 62 nt, Human
agccagaggaagugucagcacuuuaaaauucuagaccccaaaaaacuacaaaaucagaaaaa

SEQ ID NO: 201383 - RNA, 62 nt, Human
aggagaucgagaccauccuggcgaacauggugagaccccaucucuacuaaaaauacaaaaaa

SEQ ID NO: 201384 - RNA, 62 nt, Human
aggaauuauagaccucuaguagcugaaaugcaagaccccaagaggaaguucagaucuuaaua

SEQ ID NO: 201385 - RNA, 62 nt, Human
ccccacugcacuccagccugggcgacagaacgagaccccaucucaaaaaaaauaaguucugg

SEQ ID NO: 201386 - RNA, 62 nt, Human
cccccgagcaguguccccagccuagcccugugagaccccauggggacacgggugccuaugua

SEQ ID NO: 201387 - RNA, 62 nt, Human
uuugggucuucacagagaaucuuucccuugcuagaccccagaauuuuaaaugcauccgucuu

SEQ ID NO: 201388 - RNA, 62 nt, Human
caggacuugaguggcuucggacagggcuucucagaccccagccagcagccuccuuccuacgg

SEQ ID NO: 201389 - RNA, 62 nt, Human
agcuacccaccuggggaugggacgugaggccaagaccccagcagagaugccagaauggggga

SEQ ID NO: 201390 - RNA, 62 nt, Human
aggagcucgaaaccaguccgggccacacagcaagaccccaucucuaaaaaauuaauauaaau

SEQ ID NO: 201391 - RNA, 62 nt, Human
aggaguuugggaccagccugggcuauauagcaagaccccaucacuacaaauuuuuuacaaau

SEQ ID NO: 201392 - RNA, 62 nt, Human
aggaguucgagaucagccuggguaacauagcgagaccccaccucugccaaaaaaaaaaaaaa

SEQ ID NO: 201393 - RNA, 62 nt, Human
guggcagguauaagacuucugggggcaccccaagaccccagacacccaaguggcaucuuggg

SEQ ID NO: 201394 - RNA, 62 nt, Human
ugccacugcuuuccagccugggcaacauaguaagaccccaucucuuaaaaaaugaauuuggc

SEQ ID NO: 201395 - RNA, 62 nt, Human
gagaauaggcagccccacacuuugaagaauacagaccccaguaucuagucguggauauaauu

SEQ ID NO: 201396 - RNA, 62 nt, Human
aggaguucaagaccagccugggaaacauagcaagaccccaucucuuaaaaaaaaagaaauau

SEQ ID NO: 201397 - RNA, 62 nt, Human
ccagagucccccagcggcucgcaugucagcccagaccccaggguccuuggccuaggagagga

SEQ ID NO: 201398 - RNA, 62 nt, Human
aagaucuauguuccagccugcgcaacauagugagaccccaacucuacaaaaaauaaaaaauu

SEQ ID NO: 201399 - RNA, 62 nt, Human
ccucacccccagugacuuccgauugaggccaaagaccccaagcugcccgccagcucugacug

SEQ ID NO: 201400 - RNA, 62 nt, Human
aacuuguaccaaguuucccuucucccaguccaagaccccaaaucaccacaaaggacccaauc

SEQ ID NO: 201401 - RNA, 62 nt, Human
cucuccgcaguuccuucccuggcugccggaggagaccccacuaacccagccugccugggcuc

SEQ ID NO: 201402 - RNA, 62 nt, Human
cucuggccauccacuagcccagggggggacgcagaccccacacuccauggagucuggaaugc

SEQ ID NO: 201403 - RNA, 62 nt, Human
acucuggccauccacuaauccaggggggacccagaccccacaagccauggagacucaggacc

SEQ ID NO: 201404 - RNA, 62 nt, Human
cugccuucccuccugcggggugggggugggacagaccccagugggggccagggccacacuca

SEQ ID NO: 201405 - RNA, 62 nt, Human
guccacagggccuuggguucccugagcuguccagaccccaccaucucccggaccccagggag

SEQ ID NO: 201406 - RNA, 62 nt, Human
cauaguuggauucugagcuuaggaucaucuggagaccccauggagggacuuggaaaggggaa

SEQ ID NO: 201407 - RNA, 62 nt, Human
uuuugacccguguguaacuuccucugguaguuagaccccaggcagcuccgaauuugugaacc

SEQ ID NO: 201408 - RNA, 62 nt, Human
ucacccacaccgugugccuuacuccugucuagagaccccaccucugugaacuuauuuuucuu

SEQ ID NO: 201409 - RNA, 62 nt, Human
ugacuuggagcucucaccucgagacaccucccagaccccacauccccucagaacgcugcgcc

SEQ ID NO: 201410 - RNA, 62 nt, Human
aggaguuggagaccagacuggggaacauggcaagaccccaucucuacaaaaaaauuaaaaaa

SEQ ID NO: 201411 - RNA, 62 nt, Human
agcagcgagccgcggagccggggagugcccacagaccccagcccccgcgcccccgcccuccg

SEQ ID NO: 201412 - RNA, 62 nt, Human
aggaguucaagaccaaccuggacaacauagcaagaccccaucucuuaaaaaaaaaggaaaga

SEQ ID NO: 201413 - RNA, 62 nt, Human
ugauccauggacaaggccaucccggccgugggagaccccagucccgaagucuugccugcagg

SEQ ID NO: 201414 - RNA, 62 nt, Human
augcaagcacugagcuccucuuuuguccucugagaccccaucuccauucucacccaguuccu

SEQ ID NO: 201415 - RNA, 62 nt, Human
ggauguccuaggcccccuccccaacucuaaccagaccccaucccccuaagucccuuugucuu

SEQ ID NO: 201416 - RNA, 62 nt, Human
uauuuucccaauaauuuugugugagcuacagaagaccccauaccaaauaaacaaaaaaaucu

SEQ ID NO: 201417 - RNA, 62 nt, Human
ccccugugcccucaaguccuacagccccuagaagaccccaaugccguaacuccuaggacccc

SEQ ID NO: 201418 - RNA, 62 nt, Human
uaacagauacucccauaauaacccccaaauacagaccccaugucacccagaaagagauuccc

SEQ ID NO: 201419 - RNA, 62 nt, Human
agcuugggcuguuccuucucugauacgggaagagaccccaaucagauuuuucaaauuaaagc

SEQ ID NO: 201420 - RNA, 62 nt, Human
guauucgaugagguuuccauguauuuacuuacagaccccauaauguaaaggcucuaauaaua

SEQ ID NO: 201421 - RNA, 62 nt, Human
ggaaggggaacacagauuucuuuggggguccuagaccccaugccagccauuguaagaguucc

SEQ ID NO: 201422 - RNA, 62 nt, Human
ggaggggggagccccagaaaugcgguugcugaagaccccagucaccacauccuucugccugg

SEQ ID NO: 201423 - RNA, 62 nt, Human
cagcucugaucacauccccugucuacucauccagaccccaugccuguaggcuuaucagggag

SEQ ID NO: 201424 - RNA, 62 nt, Human
aggaguucaagaccagccugggcaacauggugagaccccaucucuacaaaaaauacaaaaau

SEQ ID NO: 201425 - RNA, 62 nt, Human
acugccagcuucgcuccacucagcccccuugcagaccccacccccugccugcucucuuuccc

SEQ ID NO: 201426 - RNA, 62 nt, Human
ucuuugacccccgcagcccacgucccgcuuucagaccccaggcccauuguaagccuagguca

SEQ ID NO: 201427 - RNA, 62 nt, Human
acucuggccauccacuagcccgggggguacgcagaccccacacucagcagaaggagacucag

SEQ ID NO: 201428 - RNA, 62 nt, Human
aggaguucaagaccagccugggcaacauagugagaccccaucucuacuuaaaauaaagaaga

SEQ ID NO: 201429 - RNA, 62 nt, Human
cacccuccauuugggauggaaggaaucuguggagaccccauccuccucccugcacacugugg

SEQ ID NO: 201430 - RNA, 62 nt, Human
aggaguuccagaucaaccugggcaacaugaugagaccccaucucuacaaacaauuuuuuaaa

SEQ ID NO: 201431 - RNA, 62 nt, Human
ugaaaaccgcagugccuucagcuaccauugcaagaccccagauugcaagggauggugcuucu

SEQ ID NO: 201432 - RNA, 62 nt, Human
aggguucgagaccaaccuugggcaacauagcaagaccccauuucuuaaaaaaaaaaaaaaaa

SEQ ID NO: 201433 - RNA, 62 nt, Human
gaggggagucaccuuggggcuggaggccucucagaccccauccugacagcagguugaguauu

SEQ ID NO: 201434 - RNA, 62 nt, Human
ggagaggugggcucugcuuuucagaggaacucagaccccagcccucagcuggcugcccauag

SEQ ID NO: 201435 - RNA, 62 nt, Human
accgguaccucugaauggggcuggauaaccggagaccccaugggaggucccugaagaucaga

SEQ ID NO: 201436 - RNA, 62 nt, Human
aaggacaaaaaugggcuggccuggaauggcccagaccccagccuccccuccucccucccauc

SEQ ID NO: 201437 - RNA, 62 nt, Human
cagacacccacaagaagaugacugaguucuagagaccccacaagcacuauggacgaagcgug

SEQ ID NO: 201438 - RNA, 62 nt, Human
uuuuuauuuauuaauuuuauacuauuucaacuagaccccacaccagggcacccuaagagggg

SEQ ID NO: 201439 - RNA, 62 nt, Human
ccaggagccagccacuggcuggacagggaagaagaccccaggagccaagcccaccccuucuu

SEQ ID NO: 201440 - RNA, 62 nt, Human
aguguccccuccccuccaucucucuuccccauagaccccauaaccccagaccaaagagguuc

SEQ ID NO: 201441 - RNA, 62 nt, Human
aaugauucgacagaggcuggaggagauagccgagaccccagcaacaaucugagccaugagaa

SEQ ID NO: 201442 - RNA, 62 nt, Human
agguguuugaggccagccagggcaacacagcaagaccccaucucuacaaaauauuaaaacau

SEQ ID NO: 201443 - RNA, 62 nt, Human
cgucuugucugugaucuuuguucuugaccucuagaccccaagaugugaacagugcacguguu

SEQ ID NO: 201444 - RNA, 62 nt, Human
cccaagaagcccaccuucuggucccaaccugcagaccccacagcagucaguuggucaggccc

SEQ ID NO: 201445 - RNA, 62 nt, Human
ugguuccuuccuaugcccagguaccacccuucagaccccaguucuaggggagaagagcccug

SEQ ID NO: 201446 - RNA, 62 nt, Human
uagugagcaaaauaugccccuucuugggccccagaccccagggcagggugggcagccuaugg

SEQ ID NO: 201447 - RNA, 62 nt, Human
ccuccugggcugggcagagugacagugcuagaagaccccagagagagggcaagggcuuuggg

SEQ ID NO: 201448 - RNA, 62 nt, Human
uuagcuucccuucuggaccaauagacgaggggagaccccauggauccucuggcugggaagcc

SEQ ID NO: 201449 - RNA, 62 nt, Human
ugcagacugagugcugcccuuguagcuuccccagaccccaacucacugcaguucaucugaac

SEQ ID NO: 201450 - RNA, 62 nt, Human
ccccucaugaaugaaaccagugcccuuauaagagaccccaaagagcugccuugcccuucugc

SEQ ID NO: 201451 - RNA, 62 nt, Human
ccccaaaaagagggaagagucacaaaaaguccagaccccagggacgguacuuucccucucua

SEQ ID NO: 201452 - RNA, 62 nt, Human
gcccccuccaguuugcuuuccuuuggccuuccagaccccaggaaguuggccuucccuuccua

SEQ ID NO: 201453 - RNA, 62 nt, Human
uccugcugagugguccacauucugcugcccccagaccccauccagccagggguggggauggg

SEQ ID NO: 201454 - RNA, 62 nt, Human
aacuggcuggcuguccguccagugagcggcccagaccccaccucugcgccauugucaccagg

SEQ ID NO: 201455 - RNA, 62 nt, Human
aaauguccuagcugcugcugaggcuugaacccagaccccagcacugugaugggaguccacgg

SEQ ID NO: 201456 - RNA, 62 nt, Human
uaucacugcacuccagccuagaugacagaacgagaccccaucucuaaugaauaaauaaauau

SEQ ID NO: 201457 - RNA, 62 nt, Human
guucaagaucaaccaaccuggguaacauggccagaccccaucucuauuuauauauauauaua

SEQ ID NO: 201458 - RNA, 62 nt, Human
uauuuguauucccuucccccuacaagauuaugagaccccagagggggaaggucugggucaaa

SEQ ID NO: 201459 - RNA, 62 nt, Human
gccugcucccgcgggucacccagcgagugcugagaccccauuuucugucgaggcgggccgag

SEQ ID NO: 201460 - RNA, 62 nt, Human
uccucccccaucugcacccccaucauagguagagaccccacccucccaucgguccuacaugg

SEQ ID NO: 201461 - RNA, 62 nt, Human
aggaccaggccauccuuggcuccagagcucgaagaccccaagacagcccucugcucucagcg

SEQ ID NO: 201462 - RNA, 62 nt, Human
agucaaauggggagggguauucuucaugcaggagaccccaggcccuggaggcugcaacauac

SEQ ID NO: 201463 - RNA, 62 nt, Human
ccugggcauuuaacccccuacucugucaucucagaccccaggcaggaggcccaguguuccaa

SEQ ID NO: 201464 - RNA, 62 nt, Human
ccuggaugugauggaccagcucagcuguccccagaccccaucccuucuccuuuuccuuugug

SEQ ID NO: 201465 - RNA, 62 nt, Human
ugccacugcacuccagucugggugucagaaugagaccccaucucaaaaaaaaaaaaaaaaaa

SEQ ID NO: 201466 - RNA, 62 nt, Human
ugccacuguacuccagacuggacaacagagugagaccccaucucuaaauaauaaucauuauu

SEQ ID NO: 201467 - RNA, 50 nt, Human; identical to SEQ ID NO: 39224

SEQ ID NO: 201468 - RNA, 62 nt, Human
ugugauaaaaagaccccucccgcuggguuuucagaccccauguuguuggucaaugaaauaaa

SEQ ID NO: 201469 - RNA, 62 nt, Human
uggagccuuuauuccacgucgcguggucuccaagaccccaccuaccucccugaugcugaaug

SEQ ID NO: 201470 - RNA, 62 nt, Human
cacagaaagcugcuccuggaugccccugcagaagaccccaauuaccugccccucccugagga

SEQ ID NO: 201471 - RNA, 62 nt, Human
aagcaccugcuggcugcuggaagcauaccccaagaccccaagccuugacuccagcugcgccc

SEQ ID NO: 201472 - RNA, 62 nt, Human
cccauagacggugcggggggccuggcugggccagaccccaggaaggugggguagacuggggg

SEQ ID NO: 201473 - RNA, 50 nt, Human; identical to SEQ ID NO: 39230

SEQ ID NO: 201474 - RNA, 62 nt, Human
gcagcccuaagguagaggccucauggcccaggagaccccaccucuggcagagccacauuacc

SEQ ID NO: 201475 - RNA, 62 nt, Human
uucccagcuccagccuggagggaaggggacaaagaccccaggaggccaaagggcugcaguca

SEQ ID NO: 201476 - RNA, 62 nt, Human
ucacaucaugguggggaccgagauagagagggagaccccauuccaagcucccucuuccuccg

SEQ ID NO: 201477 - RNA, 62 nt, Human
gaggagaggcugcugucacugguaccggaugcagaccccacccugucugcaggccaccccca

SEQ ID NO: 201478 - RNA, 62 nt, Human
ggaccccagcgcugcgccgcguccgaacgucgagaccccaccgagggcgggagggggacucu

SEQ ID NO: 201479 - RNA, 62 nt, Human
agcuccagcuccguucccaaggauacucgugaagaccccaucuguguucauggccuggaaag

SEQ ID NO: 201480 - RNA, 62 nt, Human
cauuagaguagaaauaucuuuggaaaugugaaagaccccauagugaaauauuugggaucaga

SEQ ID NO: 201481 - RNA, 62 nt, Human
uaucuauaaacccuuuucaggggagagaccggagaccccaucuuagauacugucaacucacu

SEQ ID NO: 201482 - RNA, 62 nt, Human
ucuccauucuuugccaugagggccaacacaugagaccccaccucccucccugccugccagcc

SEQ ID NO: 201483 - RNA, 62 nt, Human
cgagagggaagcccuugcugccugccauucccagaccccagcccuuugugcucacccugguu

SEQ ID NO: 201484 - RNA, 62 nt, Human
uccacagcaguaagccgaaaggaugaagaguuagaccccauggacccuagcucauacucaga

SEQ ID NO: 201485 - RNA, 62 nt, Human
cauaggguuggugcugaaauguuagguugugcagaccccaaccucccugacuuccuucagua

SEQ ID NO: 201486 - RNA, 62 nt, Human
cuuugguucauaaauauggcucuugaacccauagaccccaguugaagauggaauuuucagga

SEQ ID NO: 201487 - RNA, 62 nt, Human
ugagaccaguguuccucacacuggagggugauagaccccaaggggaacugaagaguggagcu

SEQ ID NO: 201488 - RNA, 62 nt, Human
uccccaugauucccuccucgucagucucucaaagaccccaugguccauccccugaggguggu

SEQ ID NO: 201489 - RNA, 62 nt, Human
agcugucugcggagccagcgccugcccgagagagaccccaccgccaccgugugccuuucccg

SEQ ID NO: 201490 - RNA, 62 nt, Human
guaacugugaaacuauggcuuaauacuguuaaagaccccaaggcuccacucuguagccaggu

SEQ ID NO: 201491 - RNA, 62 nt, Human
aggaguucgagaccgaccugggcagcauagcgagaccccaucucuauauaaaaaaaaagaug

SEQ ID NO: 201492 - RNA, 62 nt, Human
ggagaccuaugaaggggaugugcuggggguccagaccccauauuccucagacucaacaauuc

SEQ ID NO: 201493 - RNA, 62 nt, Human
ggcugcagagccgggccacaccucagugccaaagaccccaugggagugggagggaugacaag

SEQ ID NO: 201494 - RNA, 62 nt, Human
ucaaaucuugaacccuggaccaaagcuuuuccagaccccacccuaccuuccaacccagguca

SEQ ID NO: 201495 - RNA, 62 nt, Human
aaaaggccaguauaaaaauguaguagacuuaaagaccccacucgaccaugagacuuucucuu

SEQ ID NO: 201496 - RNA, 62 nt, Human
aaucacauuucuuuacagguuaaagacaaacaagaccccaggguuuuuaucuagaaaguuau

SEQ ID NO: 201497 - RNA, 62 nt, Human
uguccugugccuccuaauaucauuuguacugaagaccccaucuggggacuugagacuuuggu

SEQ ID NO: 201498 - RNA, 62 nt, Human
gggaguuugagacuggccugggcagcauagcgagaccccaucucuauauaaaaaaaaagaug

SEQ ID NO: 201499 - RNA, 62 nt, Human
gaccccacucagcuccaggcaguguucugccgagaccccaagaacucggggugucagagggc

SEQ ID NO: 201500 - RNA, 64 nt, Human
cucccaaagugcugggaugacaggugugagccacugcgcccagccugaaucauuucuuauaccu

SEQ ID NO: 201501 - RNA, 64 nt, Human
cucccagagugcugggauuacaggugugagcuacugcgcccagccccagaaaucucagugcugu

SEQ ID NO: 201502 - RNA, 64 nt, Human
ccuccuucucuuccagaggcuuuggcuacucuccugcgcccacgguaccuggaccugcuagucu

SEQ ID NO: 201503 - RNA, 64 nt, Human
ucccuccaggguuugggcaggagauggccaaucaugcgcccaccucuccagugcugccugcagu

SEQ ID NO: 201504 - RNA, 64 nt, Human
accaguugcccagcagagcucuuggccccgcugcugcgcccacacucucgccagaguccccagc

SEQ ID NO: 201505 - RNA, 64 nt, Human
cuccuaaagugcugggauuacaggcgugagccacugcgcccagcuauacuguauauuuuaagaa

SEQ ID NO: 201506 - RNA, 64 nt, Human
cucccaaagugcugggauuacaggcauaagccacugcgcccagccagaagaugcaugauuucuu

SEQ ID NO: 201507 - RNA, 64 nt, Human
gcagcuuccaugaggcaggcugaaccugcagauaugcgcccagagauauggaucgcccaagagu

SEQ ID NO: 201508 - RNA, 64 nt, Human
gcaccuccuauagucagcuaagggcuucccuuucugcgcccagcuuuugggugaagggugauuu

SEQ ID NO: 201509 - RNA, 64 nt, Human
cucccaaguagcuggaacuacaggcucaugccacugcgcccagcuaauuuuuguauuuuucgua

SEQ ID NO: 201510 - RNA, 64 nt, Human
uccuccccaccuguccuccaagaacagccuucccugcgcccaggcccccuccgggccucuguag

SEQ ID NO: 201511 - RNA, 54 nt, Human
gcagugccggccaguucugagcccugcgcccaccaaucgaauuguagagcugcu

SEQ ID NO: 201512 - RNA, 57 nt, Human
cugagucugccguggccugaggcugccugcgcccaccccgcucugcaugcggcccag

SEQ ID NO: 201513 - RNA, 58 nt, Human
ccagccagcccgugaggugaccugagcaugcgcccacccacucaucugucccugaccu

SEQ ID NO: 201514 - RNA, 64 nt, Human
ugagcacauuccagcagggaaacgaacuccgaugugcgcccauuguaaccaggucaucagguug

SEQ ID NO: 201515 - RNA, 64 nt, Human
ucuuuguagcuucuaaugugagguuugaguccagugcgcccacagcagcaugcccuucucaccc

SEQ ID NO: 201516 - RNA, 64 nt, Human
caccgccuccccugccugggcacucccuccucccugcgcccacagcccccaugccaaucuccgu

SEQ ID NO: 201517 - RNA, 64 nt, Human
cacaugugaacuuuuucuagguggcaggacaaauugcgcccauuuagaggauguggcuguaacc

SEQ ID NO: 201518 - RNA, 64 nt, Human
agccggcagagcaaggggcgcggccccagggcccugcgcccacuuugcacacccgcucuccggc

SEQ ID NO: 201519 - RNA, 64 nt, Human
uuccaaagugcugggauaucaggcacugagccacugcgcccagccaacaauccgcucugaggaa

SEQ ID NO: 201520 - RNA, 64 nt, Human
ccuugggaccgagaacugagaaucacaagggaguugcgcccaacaugcagaacaugaauccucu

SEQ ID NO: 201521 - RNA, 64 nt, Human
caaguggugcuuucagagaauugauucagccaucugcgcccaggccacgugucccgaucuggga

SEQ ID NO: 201522 - RNA, 64 nt, Human
aagacuuagcgacgccacuggcggcaccuucuccugcgcccagugauguuuccacggugccugu

SEQ ID NO: 201523 - RNA, 64 nt, Human
aucccaaagugcugggauuacaggcgugagccacugcgcccagcauguuagacaauuuuuaauu

SEQ ID NO: 201524 - RNA, 64 nt, Human
cucccaaagugcuaggauuacaggcaugagccacugcgcccagcccuuauaaauuuuuguauag

SEQ ID NO: 201525 - RNA, 64 nt, Human
ucccaucauccgcucgcccuccuuuccccugggcugcgcccacuugucuuccuggauauuuggg

SEQ ID NO: 201526 - RNA, 64 nt, Human
gacuccuuacgaaagucacuucauucuaacuagaugcgcccacuuccggucauuauuucguuug

SEQ ID NO: 201527 - RNA, 64 nt, Human
gccagcaggcugccgucccaccacacguggccucugcgcccagcacggugcucgccgacagugg

SEQ ID NO: 201528 - RNA, 64 nt, Human
caagauggccaaguaggagacgugcacuuggugcugcgcccagggaggaagccgcaccaccagc

SEQ ID NO: 201529 - RNA, 64 nt, Human
agccagucagcuacaacuccacaucaacuccacaugcgcccagcucgagacugaugaguggaau

SEQ ID NO: 201530 - RNA, 63 nt, Human
aggccuagccuucuugucuuuguaacccacagcagcugguacugugccuugccuauuguaggu

SEQ ID NO: 201531 - RNA, 63 nt, Human
agugaaucaggaagccaguaacugacuaggagaagcugguaucagaacagcuucccucacugu

SEQ ID NO: 201532 - RNA, 63 nt, Human
ugagauugguaaucugaaaaggaccacaagcauagcugguaggcaaauuguuaggcagaauaa

SEQ ID NO: 201533 - RNA, 63 nt, Human
uguguaugggaggcauggauauguuaugaaaucagcugguaauuccuccucaucacguuucuc

SEQ ID NO: 201534 - RNA, 64 nt, Human
ggugggggcgcuugcccaggagagggaccaggggugcgcccacagccugcuccauucuccaguc

SEQ ID NO: 201535 - RNA, 64 nt, Human
ccacuuaccgauucauucuuucacuguuuguaucugcgcccagaauucucagugacgugggggu

SEQ ID NO: 201536 - RNA, 64 nt, Human
uuucuuugucucauucacaggagaggacaugaugugcgcccauccucccuugcuuccagauugu

SEQ ID NO: 201537 - RNA, 64 nt, Human
cucccaaagugcugggauuacagacuugagccacugcgcccaaccuggaguguuuuuacauauu

SEQ ID NO: 201538 - RNA, 64 nt, Human
cuccuaaagugcugggaucacaggcgugagccacugcgcccagcccacugcuaguuugacuuuu

SEQ ID NO: 201539 - RNA, 64 nt, Human
uccuuucugaagcaguuguuucuggaagagucugugcgcccauggauggcugagcaccacuacg

SEQ ID NO: 201540 - RNA, 64 nt, Human
agccucgggaggggcacacagacuguggcagagcugcgcccaucccgcagaggccccuguccac

SEQ ID NO: 201541 - RNA, 64 nt, Human
uccacacuguaaccacugggucugggcuccauccugcgcccaaagacauccacccagaccucau

SEQ ID NO: 201542 - RNA, 64 nt, Human
cucugaaagugcugggauuacaggcgugagacacugcgcccagccucaucccugugaauuucuu

SEQ ID NO: 201543 - RNA, 64 nt, Human
caacccuguccucccgagcuccucuuccaugcugugcgcccagggcugggaggaaggacuuccc

SEQ ID NO: 201544 - RNA, 64 nt, Human
cucccaaagugcuggaauuccaggcaugagccacugcgcccagucuacacacuaauucuuguua

SEQ ID NO: 201545 - RNA, 64 nt, Human
cucccaaagugcugggauuacaggcguaagccacugcgcccagccacugccaucaucuuuagga

SEQ ID NO: 201546 - RNA, 64 nt, Human
acacaggcaucucccaggccaagcacacacaggcugcgcccaguuccgcaggagccgucccaca

SEQ ID NO: 201547 - RNA, 64 nt, Human
guggaccugcuguaaacccugugugcgcugugugugcgcccagugcccgcuucguaggacacca

SEQ ID NO: 201548 - RNA, 64 nt, Human
uguaugucacuauuuucacuagggcugaggggccugcgcccagagcuggccucccccaacaccu

SEQ ID NO: 201549 - RNA, 64 nt, Human
ucugcucugaucuaaaaugucuuuccuuuuaugcugcgcccagucuuggggcucaaagauuugc

SEQ ID NO: 201550 - RNA, 63 nt, Human
uaagaggacuaauucccuuuuucuaaggcacagagcugguaaaaugugaaguaauagugaacc

SEQ ID NO: 201551 - RNA, 63 nt, Human
ggcugcccaggaggccuuggauaccaggcuuggagcugguaaccuccagggcuuccagcacgg

SEQ ID NO: 201552 - RNA, 63 nt, Human
caguuaacaguguacucuuauaacaccguuauuagcugguacuuuggugauuucuauuacuag

SEQ ID NO: 201553 - RNA, 63 nt, Human
auuuaccucuguaucaacucaggaaaucucauaagcugguaccacucaggagaaguuuauucu

SEQ ID NO: 201554 - RNA, 64 nt, Human
cuggccugagggguccuagccuggagcaggcgccugcgcccagacccuggagagccuugaccca

SEQ ID NO: 201555 - RNA, 64 nt, Human
ggcuuuuaagguucagagacuguggcuuggcaccugcgcccaggcuuugugggccuuugccccu

SEQ ID NO: 201556 - RNA, 52 nt, Human
uccggcucuacgacauguagacugcgcccacgggaugcacagcggccaugcc

SEQ ID NO: 201557 - RNA, 64 nt, Human
uccagucugccacugccgugcccgggggacauccugcgcccaggcuggaggcccugccucgcug

SEQ ID NO: 201558 - RNA, 64 nt, Human
cuaacaucaacacaucuucaaggcggcagagcugugcgcccacccagcuauugaaaaggacuuu

SEQ ID NO: 201559 - RNA, 64 nt, Human
ggggaagcccgggggucuggggccucccuccgucugcgcccaccuuugcagaauaaacucucuc

SEQ ID NO: 201560 - RNA, 64 nt, Human
ccgcaaaccacacuggacuccggcccuccuacccugcgcccaguccuuccaccucgacguuuac

SEQ ID NO: 201561 - RNA, 64 nt, Human
ugagccgggggcgcgggcgccuuccgcagagaccugcgcccacaggugcugucuuaguggacug

SEQ ID NO: 201562 - RNA, 64 nt, Human
cccgcccucaccacacugaccacccucaacccauugcgcccaguccccaccacagugaccacac

SEQ ID NO: 201563 - RNA, 64 nt, Human
uucccaaagugcugggauugcagacgugagucacugcgcccagccauuccaugucucuuaaguc

SEQ ID NO: 201564 - RNA, 64 nt, Human
guaguugauuuuuccucuuuagucucccccgaccugcgcccagccccguggccccugccccucu

SEQ ID NO: 201565 - RNA, 63 nt, Human
gcggcugggaaggacagguccaauaaacgcccucugcgcccaggcccgcgucccugccgucgg

SEQ ID NO: 201566 - RNA, 64 nt, Human
gccccucuccaguguccaggggcuuggagagaccugcgcccaccccuccacucucccaggaguc

SEQ ID NO: 201567 - RNA, 64 nt, Human
uggcagagcccccaucccuugggggcuguggggaugcgcccaagcccccgagggagaggccugg

SEQ ID NO: 201568 - RNA, 64 nt, Human
cuaaaaguacaaaaauuagcugggcgugcaccacugcgcccagcuaauucuuguauuuuuggua

SEQ ID NO: 201569 - RNA, 64 nt, Human
gacaccucccagaccccacauccccucagaacgcugcgcccagccacacccacgaucaaguuac

SEQ ID NO: 201570 - RNA, 63 nt, Human
ccuuuucccuaccccagccccugugccaggcuaagcugguacaagagcugccaaccucacaga

SEQ ID NO: 201571 - RNA, 63 nt, Human
uaaugguaucuuugagcugauuguucuaaucagagcugguaccuacuuucaauaaauucuggu

SEQ ID NO: 201572 - RNA, 63 nt, Human
acuugaauacauaaucuaaaaauuauauaguaaagcugguagccuugaaaaugucagugugau

SEQ ID NO: 201573 - RNA, 63 nt, Human
aagcagaucagccaugacugaaacucaaggcuuagcugguaucuauguugugcuacauuaggu

SEQ ID NO: 201574 - RNA, 64 nt, Human
uccuucucuccgugggauacuggacucgugccucugcgcccauucucuucucacgcauauccau

SEQ ID NO: 201575 - RNA, 64 nt, Human
ccuccugaagugcugggauuacaggcguggccacugcgcccaggcacauuccucccuucugccc

SEQ ID NO: 201576 - RNA, 64 nt, Human
ccggaaacaucgugcgccacaucccggaccgcggugcgcccacccgggccucggagccugccuc

SEQ ID NO: 201577 - RNA, 64 nt, Human
ccccagccaccaccugccccgccucguccacgccugcgcccacuaucaucccugcuccagcugc

SEQ ID NO: 201578 - RNA, 64 nt, Human
cugguuucccuuacagggcccccucccccgggaaugcgcccaccaaggcccuagacucaucuug

SEQ ID NO: 201579 - RNA, 64 nt, Human
caaagugcugggauuaugggcgggugugagccauugcgcccagccuugaagucauguucuaaau

SEQ ID NO: 201580 - RNA, 64 nt, Human
ggaucucgcuguaggucaggcccgcgcagccuccugcgcccagaagcccacgccgccgccgucu

SEQ ID NO: 201581 - RNA, 64 nt, Human
cuagucuaugaaaaaacaaaccaaaauaugcucuugcgcccaggccaguggugaguuagaggua

SEQ ID NO: 201582 - RNA, 64 nt, Human
agcauaccccaagaccccaagccuugacuccagcugcgcccacaggaaguccagucccgacagu

SEQ ID NO: 201583 - RNA, 64 nt, Human
gcuuuaaauuuucauaaacuggaauccuuucacccgcuccuacagcuaacccucacaagcauga

SEQ ID NO: 201584 - RNA, 64 nt, Human
agcgcuaccaaaugaaugaauaaacaugagcuugcgcuccuagccuagagauaaauccugacug

SEQ ID NO: 201585 - RNA, 64 nt, Human
auggcugaggguagcuggauuccucaggcccgggcgcuccuacagcagugccugcacgcccggc

SEQ ID NO: 201586 - RNA, 64 nt, Human
gagaacuacuaaggaaaauaauauuauuuaaacucgcuccuaguguuucuuuguggucuguguc

SEQ ID NO: 201587 - RNA, 63 nt, Human
ccccgugaaucauauuuuuaagaucccacucuuagcugguaaaugaauuugaaucgacauagu

SEQ ID NO: 201588 - RNA, 63 nt, Human
acucucagcccagaugugaaaugggagccuaccagcugguauagaagggaauggguaggaggc

SEQ ID NO: 201589 - RNA, 63 nt, Human
ugagccaggaggucuagaacuggagcuuaguccagcugguacaauaccaacuccccuucuagu

SEQ ID NO: 201590 - RNA, 64 nt, Human
caccacauggcucagcaucugugccaaacauaggcgcuccuagucuggucagugccaagaggcu

SEQ ID NO: 201591 - RNA, 64 nt, Human
cacccaggacuuccucacccucuucuauacucuucgcuccuaugcucggggccuccggcuugag

SEQ ID NO: 201592 - RNA, 64 nt, Human
gaccuugugccaguccugguccucccuccccagccgcuccuaccaccuuuuggugccacacuuc

SEQ ID NO: 201593 - RNA, 64 nt, Human
gaaaacaccauuccaugacuucccaccgcgcccucgcuccuaccuccccacaccucucucugag

SEQ ID NO: 201594 - RNA, 64 nt, Human
guggcugcugucugccucagugacaaugucccagcgcuccuaucauguuuacagucacccuugg

SEQ ID NO: 201595 - RNA, 64 nt, Human
ucaucuuuuuccccuauccuguucuuccccuccccgcuccuaaugguacguggguacccaggcu

SEQ ID NO: 201596 - RNA, 64 nt, Human
uuucuacauuaacuugaaaauuuuuuaaccaagucgcuccuagguucuuaaggauaauuuuccu

SEQ ID NO: 201597 - RNA, 64 nt, Human
gccccgcgccuagucccauuuucacuuccuuugacgcuccuaguaguuuuguuaagucuuaccc

SEQ ID NO: 201598 - RNA, 64 nt, Human
uuuuuuuuuuuccuuuuucuaaaaagcuauguaucgcuccuauugaaagaccagauccuuagag

SEQ ID NO: 201599 - RNA, 64 nt, Human
uacuguggugugugagucucagcagccgcccacacgcuccuaacucugcugcauggcagaugcc

SEQ ID NO: 201600 - RNA, 64 nt, Human
auugaauauuuguuuaagcuuaguucagaagcaacgcuccuacaggacuugacauuugcuaguu

SEQ ID NO: 201601 - RNA, 64 nt, Human
gcagggggaggcagcgcugcaguugcucaggacacgcuccuauaggaccaagauggaugcgacc

SEQ ID NO: 201602 - RNA, 64 nt, Human
agcuccaugaggucccggagccccccucucaacccgcuccuaccccgcuggucccucugaaagc

SEQ ID NO: 201603 - RNA, 64 nt, Human
agugguggaggcugagaagaagccccacugcccucgcuccuaggcccugcugagcugcagcacc

SEQ ID NO: 201604 - RNA, 64 nt, Human
cccucugggccugcgcuaauuguaggagccacagcgcuccuagggugagaggcuuagccauccc

SEQ ID NO: 201605 - RNA, 64 nt, Human
gguacauguaacccugcugaggggcugugcaggccgcuccuacgguccuuuggccugaggcagg

SEQ ID NO: 201606 - RNA, 63 nt, Human
agaaguuucugcugcucucuuuccuucucccugagcugguaacugcaaugccaacuuccuggg

SEQ ID NO: 201607 - RNA, 63 nt, Human
gaauuuuuuuucuuuuaaacaagccaaccaccuagcugguaauuaaugagguucacuuaaaaa

SEQ ID NO: 201608 - RNA, 63 nt, Human
uccugugucugccuuguuauuggaaccaaugccagcugguaggaucccugagccccuugcgau

SEQ ID NO: 201609 - RNA, 64 nt, Human
ggguaguggaucuagguaguuccucaaugccccacgcuccuaggaggucccccuggggugggcg

SEQ ID NO: 201610 - RNA, 64 nt, Human; identical to SEQ ID NO: 201583

SEQ ID NO: 201611 - RNA, 64 nt, Human; identical to SEQ ID NO: 201584

SEQ ID NO: 201612 - RNA, 64 nt, Human; identical to SEQ ID NO: 201585

SEQ ID NO: 201613 - RNA, 64 nt, Human; identical to SEQ ID NO: 201586

SEQ ID NO: 201614 - RNA, 64 nt, Human; identical to SEQ ID NO: 201590

SEQ ID NO: 201615 - RNA, 64 nt, Human; identical to SEQ ID NO: 201591

SEQ ID NO: 201616 - RNA, 64 nt, Human; identical to SEQ ID NO: 201592

SEQ ID NO: 201617 - RNA, 64 nt, Human; identical to SEQ ID NO: 201593

SEQ ID NO: 201618 - RNA, 64 nt, Human; identical to SEQ ID NO: 201594

SEQ ID NO: 201619 - RNA, 64 nt, Human; identical to SEQ ID NO: 201595

SEQ ID NO: 201620 - RNA, 64 nt, Human; identical to SEQ ID NO: 201596

SEQ ID NO: 201621 - RNA, 64 nt, Human; identical to SEQ ID NO: 201597

SEQ ID NO: 201622 - RNA, 64 nt, Human; identical to SEQ ID NO: 201598

SEQ ID NO: 201623 - RNA, 63 nt, Human
guuugcugagaaauaaaaaucaaaacuucuuuaagcugguaaagugaggggcccaccagcagu

SEQ ID NO: 201624 - RNA, 63 nt, Human
uagagagauuaaaucacuugcccaaggugaaccagcugguaaaaggugaugccaggucuugaa

SEQ ID NO: 201625 - RNA, 63 nt, Human
agccaaaaacaaacaaacaaaaagcauauggggagcugguauuuucucuuuagcuuacuguug

SEQ ID NO: 201626 - RNA, 64 nt, Human; identical to SEQ ID NO: 201599

SEQ ID NO: 201627 - RNA, 64 nt, Human; identical to SEQ ID NO: 201600

SEQ ID NO: 201628 - RNA, 64 nt, Human; identical to SEQ ID NO: 201601

SEQ ID NO: 201629 - RNA, 64 nt, Human; identical to SEQ ID NO: 201602

SEQ ID NO: 201630 - RNA, 64 nt, Human; identical to SEQ ID NO: 201603

SEQ ID NO: 201631 - RNA, 64 nt, Human; identical to SEQ ID NO: 201604

SEQ ID NO: 201632 - RNA, 64 nt, Human; identical to SEQ ID NO: 201605

SEQ ID NO: 201633 - RNA, 64 nt, Human; identical to SEQ ID NO: 201609

SEQ ID NO: 201634 - RNA, 63 nt, Human
ggcuauguauccuuucggcauguggaggaaggcagcugguauauucagucucuguguaaucau

SEQ ID NO: 201635 - RNA, 63 nt, Human
ucuucacccucccaugaugcgcaguguucagaaagcugguaaguccuagggauuuccagaagu

SEQ ID NO: 201636 - RNA, 63 nt, Human
cucugugucucagacggggcccucccgucgagaagcugguagucagugagugagaacaagaga

SEQ ID NO: 201637 - RNA, 63 nt, Human
cugccuccagagaaagcucugcuucacccuggaagcugguaccuuuaccuccuccucugggag

SEQ ID NO: 201638 - RNA, 63 nt, Human
uguuuagcucuggcaaaaaaaaaaaauuuuaagagcugguacuaauaaaggauuauuaugacu

SEQ ID NO: 201639 - RNA, 63 nt, Human
cuuacuagcacuuugagaaugagucuccuguugagcugguaggauguaagccuggagcuaaug

SEQ ID NO: 201640 - RNA, 63 nt, Human
ugcuuuguaccggaucugcugaagcaucuguccagcugguauccugugaaaguuuguuauuuu

SEQ ID NO: 201641 - RNA, 63 nt, Human
uggagacaggaggugaugaaccuuuuuaugugcagcugguaugauagaaggaaauugggaaaa

SEQ ID NO: 201642 - RNA, 63 nt, Human
uggguacagcaggacacgccaccauuccaggguagcugguaccgccagaaacaggaguggguc

SEQ ID NO: 201643 - RNA, 63 nt, Human
guucuuucuagaaaauuugaagccauuacuuccagcugguauacaggauaaacuacauacacu

SEQ ID NO: 201644 - RNA, 63 nt, Human
cuggaaagaagaacugauauggcuaguucagcuagcugguacagauaauucaaaacugcuguu

SEQ ID NO: 201645 - RNA, 63 nt, Human
ucuucuuuuuucuggaccucaguuuccucagugagcugguaagaaugcacuaaccuuuugauu

SEQ ID NO: 201646 - RNA, 63 nt, Human
agcccuguugauuaaucucuacaucauuuuaacagcugguauggccuuaccuugggugaacua

SEQ ID NO: 201647 - RNA, 63 nt, Human
cuuuaggagauuuauuuuuuggacuucaaagcaagcugguauuuucauacaaauucuucuaau

SEQ ID NO: 201648 - RNA, 63 nt, Human
uuaagcuacaaauauaguauaagcauuauuagcagcugguacuucugcuagggguuguaaauu

SEQ ID NO: 201649 - RNA, 63 nt, Human
ggcauaaaggaaaaaaacagaguucauaguuugagcugguauuuacccccuggguuuaaaaau

SEQ ID NO: 201650 - RNA, 63 nt, Human
cccaggccagagcaggaccacagauacuggacaagcugguacagccaacccccuaggugugga

SEQ ID NO: 201651 - RNA, 63 nt, Human
ugcaccccucacaaauggcagaacaguauguaaagcugguaacaccucgguuucagugcacca

SEQ ID NO: 201652 - RNA, 63 nt, Human
gagaggucucucuuccugauuuagauaugcaaaagcugguauguucaguaggaacuguacaug

SEQ ID NO: 201653 - RNA, 63 nt, Human
guguugggauuacaggcgugagucaccgcgcccagcugguauugcuuuucuauucccuuugga

SEQ ID NO: 201654 - RNA, 63 nt, Human
ucuacacuugucuuagaucacaugcccugcuucagcugguaaugggacugcaucgguuccaag

SEQ ID NO: 201655 - RNA, 63 nt, Human
ucauagugaccacgagugaggcuguucugcuucagcugguagcugauaaggaccauccaaaau

SEQ ID NO: 201656 - RNA, 63 nt, Human
auuugaaaugauuagaaaaugucaaguauuauaagcugguauuuaagaugcuuguaaauacua

SEQ ID NO: 201657 - RNA, 63 nt, Human
uucuagacaaucgcaccuuuggguauauuaaacagcugguaucauaacaaagaauccaaauga

SEQ ID NO: 201658 - RNA, 63 nt, Human
aucugcccaaagugauggaacuagaaagucuagagcugguauucuagcccaaaucugucugac

SEQ ID NO: 201659 - RNA, 63 nt, Human
ggggcaagaggaggggccggccccuccucaggaagcugguaugaguaaggccuugagggugca

SEQ ID NO: 201660 - RNA, 63 nt, Human
aaacacauccaguuuauaaucaguacauuggaaagcugguauugauguagaaccagugcauaa

SEQ ID NO: 201661 - RNA, 63 nt, Human
acaucucccaaguucccaucacgucagauuuggagcugguagcgcuuacgaugcccccacgug

SEQ ID NO: 201662 - RNA, 63 nt, Human
cauguugccuuuucucuuaguaggauaacuaguagcugguacauaaucacugaggagcuauuu

SEQ ID NO: 201663 - RNA, 63 nt, Human
cugugacaguauugugugucauaguugagcaguagcugguagaauuaggcaguuggugauagu

SEQ ID NO: 201664 - RNA, 63 nt, Human
ggcuuucacgcccacccacccccuggcccugccagcugguaguccaucagcacaaugaaggag

SEQ ID NO: 201665 - RNA, 63 nt, Human
cgcccuauuuuugcaauggcuauauggcaagaaagcugguaaacuauuugucuuucaggaccu

SEQ ID NO: 201666 - RNA, 63 nt, Human
agacuacacacaugucaugcguuuauggcagguagcugguauuuauuccccaaaguaauaaug

SEQ ID NO: 201667 - RNA, 63 nt, Human
caucaaauuaaagccuauccuuucucaagcaggagcugguauuguagggaguggccggguauu

SEQ ID NO: 201668 - RNA, 63 nt, Human
ugucaaccugacuggauuaaggaauaccuagacagcugguacaacauuauuucuggguguguc

SEQ ID NO: 201669 - RNA, 63 nt, Human
uuuauugugaagaacugucauccugccuuugcuagcugguaccuucuaguaaucaaaauuaau

SEQ ID NO: 201670 - RNA, 63 nt, Human
acuuuaaaugaaaacccuugauuauaaauugauagcugguaguguuucuuuugcaagaaugca

SEQ ID NO: 201671 - RNA, 63 nt, Human
gaaaauaacacaaaaaaugccgagguuuggcguagcugguagcuggggacagugucuucguuu

SEQ ID NO: 201672 - RNA, 63 nt, Human
ugaacuaacuuggggaaacaauuucuagguugaagcugguaacacucaugucuguugagugcc

SEQ ID NO: 201673 - RNA, 63 nt, Human
ugcuccauguccuuguguggcugcuccagcgagagcugguaacuagguagacugcugcucuaa

SEQ ID NO: 201674 - RNA, 63 nt, Human
uuagaagaauauuguauuguuagauguuuguugagcugguaacaucguugcaaccacugcaau

SEQ ID NO: 201675 - RNA, 63 nt, Human
agucacuugguugcuggaaaaaucuuuggggaaagcugguauaagcuacacacugaccugucc

SEQ ID NO: 201676 - RNA, 63 nt, Human
aagcuuauugaauucuuuuaccacuuucauguaagcugguaggggauuuuugagaaaagaagg

SEQ ID NO: 201677 - RNA, 63 nt, Human
uuugaucaaaugacagugaacaaagccagcccaagcugguaaggugcuguucacuugaacagg

SEQ ID NO: 201678 - RNA, 63 nt, Human
ggaaagaugaaccaaauaacucaaugauggaugagcugguagaaaaaaagcugguggugaacc

SEQ ID NO: 201679 - RNA, 63 nt, Human
uuugcccucuuucccaaggagaugcugcuggggagcugguauggguggggucuuucccuuuac

SEQ ID NO: 201680 - RNA, 63 nt, Human
ugacaaaguguaaugaaaugacaagcugguugaagcugguaaucaaugcauggccauauuuau

SEQ ID NO: 201681 - RNA, 63 nt, Human
cuuugcuuuauaaagauucuaaacauguaucugagcugguaauauuuuaaaaucuccauuauu

SEQ ID NO: 201682 - RNA, 63 nt, Human
accaaaggaagcaaguuuccacgauuucugaagagcugguauaggaaguuucuuucuuccuuu

SEQ ID NO: 201683 - RNA, 63 nt, Human
gaacucuuuagaguaacuagcucaguauuggccagcugguaaauggcaguguugggauuaaaa

SEQ ID NO: 201684 - RNA, 63 nt, Human
uucaaacgauucuuguaccucagccugcugaguagcugguauacaggcacaucgccgccacac

SEQ ID NO: 201685 - RNA, 63 nt, Human
aaauaauacacagaauccugcaacuuuuugcacagcugguaucugucugguagcagugagacc

SEQ ID NO: 201686 - RNA, 63 nt, Human
caggguuuuaagagucagugcucaccugggcggagcugguaguacauuuugcuucuuagaaag

SEQ ID NO: 201687 - RNA, 63 nt, Human
aacagagaaagagauuuccauuucugcugccagagcugguauuugccugccugauucucugug

SEQ ID NO: 201688 - RNA, 63 nt, Human
caaugcaaaauacacauuaaguaaaagaauuccagcugguaaacaugaccuggacauuuguaa

SEQ ID NO: 201689 - RNA, 63 nt, Human
uccacucaguugcaacuuggacuuguccucagcagcugguaaucuugcucugcuugacaacau

SEQ ID NO: 201690 - RNA, 63 nt, Human
uuucaaugaucauuuagcauucaaugauggaacagcugguauaacauaaguuguuggcaugaa

SEQ ID NO: 201691 - RNA, 63 nt, Human
agccucuggagagacuguaaugauccauucaugagcugguaugaaaucagugggaagcagaac

SEQ ID NO: 201692 - RNA, 63 nt, Human
ugacauuuaggaauagucuguuaccacagcauaagcugguaaaaaaaaaaaaaaaaaucauac

SEQ ID NO: 201693 - RNA, 63 nt, Human
uguccuuccauuuucauucuguuaucucaggugagcugguagaggggagacauuagaaaaaaa

SEQ ID NO: 201694 - RNA, 63 nt, Human
uuuuuucuuuuaaauuuuaauaacagguucaccagcugguagaaaauagagacacaugaugau

SEQ ID NO: 201695 - RNA, 63 nt, Human
uuuaaaauauuacugugcuucuuugguugaaugagcugguauugauguaaaauacucugucau

SEQ ID NO: 201696 - RNA, 63 nt, Human
uucaguucaaaagccugaaaguuuagaucuagaagcugguaaaaaugacaauaucaaucacau

SEQ ID NO: 201697 - RNA, 63 nt, Human
uucauuguugcuuuuucuggugggggcaaggggagcugguauggauggaaugacaagaauuag

SEQ ID NO: 201698 - RNA, 63 nt, Human
uaaauaaagcaucagauacugaucugagcuguaagcugguagaaucugagccaaaguagacug

SEQ ID NO: 201699 - RNA, 63 nt, Human
ccuggguuguugcagaguaaaucccacgacauaagcugguaucagugguucgggggaaauagu

SEQ ID NO: 201700 - RNA, 63 nt, Human
ugauaaaauuggagcagagucucggaauuggagagcugguaagccagucagagugauacgcag

SEQ ID NO: 201701 - RNA, 63 nt, Human
guagauucauguuugcaaggggcuggggcuggaagcugguagugacugcuaaugggcaugagg

SEQ ID NO: 201702 - RNA, 63 nt, Human
cauugaagggugaagaguuacucaaggucaaacagcugguaacagaaucaagacuaagaccua

SEQ ID NO: 201703 - RNA, 63 nt, Human
acuacggcugcuggguugggauuucugccagcuagcugguacuggcuucuuguuucaagagau

SEQ ID NO: 201704 - RNA, 63 nt, Human
aaaagaauaacccacuccucuucugggcauuuaagcugguauguuagugcuacuuuuaagauu

SEQ ID NO: 201705 - RNA, 63 nt, Human
uuauagaaagcugucuacaacuguggaguugguagcugguaacauuguugucucaagaacaac

SEQ ID NO: 201706 - RNA, 63 nt, Human
uacagcccuggcuguggaauccuucaccgucucagcugguaucagccccagccugccuugugc

SEQ ID NO: 201707 - RNA, 63 nt, Human
ccauuccuauauccuuuaaaugacugagaaugcagcugguaaaguuggaagaauaaaguuaac

SEQ ID NO: 201708 - RNA, 63 nt, Human; identical to SEQ ID NO: 201701

SEQ ID NO: 201709 - RNA, 63 nt, Human
uuguacagauaacaggaguuucugacuaaucaaagcugguauuuccccgcaugucuuauucuu

SEQ ID NO: 201710 - RNA, 63 nt, Human
gaaagcucccacagugggaccuugaugcagcguagcugguauuaacaaccguggggacaccag

SEQ ID NO: 201711 - RNA, 63 nt, Human
auauuauacugccucuuagguguacucuuuauaagcugguaaaccaagaaucuagggaguggc

SEQ ID NO: 201712 - RNA, 63 nt, Human
guagugguggcugcuucaacccaaauauuauucagcugguacuaacgacauugugcccagcug

SEQ ID NO: 201713 - RNA, 63 nt, Human
auuuucaucugcauuccuuagaaucugcauaacagcugguauagagaagguacucaaaaaauc

SEQ ID NO: 201714 - RNA, 63 nt, Human
acggggcuucguugaaugcuccuuccccuaggcagcugguaauagagggguaaagcucugggc

SEQ ID NO: 201715 - RNA, 63 nt, Human
aagauucuuaccaagagugggcuuuguggaaacagcugguacugauguucaccuuuauauaug

SEQ ID NO: 201716 - RNA, 63 nt, Human
ccucagucaucaauaguuccuggggaaaaacagagcugguagacuugaagaggagcauugaug

SEQ ID NO: 201717 - RNA, 63 nt, Human
agggucuguacuagccaugcaaggagucgcucuagcugguacccguaaaaguugugggaauug

SEQ ID NO: 201718 - RNA, 63 nt, Human
gugagcugcuaacacggcauccaagaauggcccagcugguaggauccuugcuuuccccaucug

SEQ ID NO: 201719 - RNA, 63 nt, Human
gacaucccuuucuucccuugcacgcucgcuagcagcugguaaggucuucacacccugauuccu

SEQ ID NO: 201720 - RNA, 63 nt, Human
uucaagggauucucgugccucagccucccagguagcugguacuacaggcacggaccaccacgc

SEQ ID NO: 201721 - RNA, 63 nt, Human
gcaugagcuguguuucaggggccacuaaauaacagcugguacugaccccagaaaccgccuuca

SEQ ID NO: 201722 - RNA, 63 nt, Human
agcaaucaagauauuuuuguccauauccagguuagcugguaagaggauuuuuuuggagaaaaa

SEQ ID NO: 201723 - RNA, 63 nt, Human
gccuaggcccccagucgucugcaguaauucaaaagcugguauuuuucuuccuaaaugucacau

SEQ ID NO: 201724 - RNA, 63 nt, Human
aagcagaagauagauaaaaaaugauguaauugcagcugguaggaugucuggugccaauccagg

SEQ ID NO: 201725 - RNA, 63 nt, Human
cauugucauuugagagacugacacacuccuagcagcugguaaaggggugcuggaggccaugga

SEQ ID NO: 201726 - RNA, 63 nt, Human
gauuuuuacuuauauaauaguccuagaguuugcagcugguaaaaccagaggcuacauccagua

SEQ ID NO: 201727 - RNA, 63 nt, Human
cuuugauauaaucuguauacauccuguaugcugagcugguaaaauacauuguaaauuacauau

SEQ ID NO: 201728 - RNA, 63 nt, Human
uccagcagccagaggcacgugagaagcagaaagagcugguaaauaaagccuugggcaagcgac

SEQ ID NO: 201729 - RNA, 63 nt, Human
guugaccuccugcuuugggugaaggagacuguaagcugguacuugagaacgaauuugccagca

SEQ ID NO: 201730 - RNA, 63 nt, Human
ugugacacuugccaccaccaccuuccaguagcaagcugguagagcuguacuuuuucuucacag

SEQ ID NO: 201731 - RNA, 63 nt, Human
uccacgaccggcugaucagugaaacagacaagcagcugguacaacagcacauaggcagcuugg

SEQ ID NO: 201732 - RNA, 63 nt, Human
ugcacucaagacgcaucuccaguuuucgggggaagcugguauuugacauaguguguuaaacag

SEQ ID NO: 201733 - RNA, 63 nt, Human
cauucuguaugagggcaccaaauaaauccaucuagcugguaguuuuaucuagccaaauaauuu

SEQ ID NO: 201734 - RNA, 63 nt, Human
ggauccugaugucuuucauccauuuguaguaaaagcugguaaagcuuuucuuacuccugguuc

SEQ ID NO: 201735 - RNA, 63 nt, Human
ccuggcagcugaacucggguaguccaguggccuagcugguaccacaucuauucccauccagag

SEQ ID NO: 201736 - RNA, 63 nt, Human
uuuuccuuccagugagggcuggagggaugaauuagcugguaccugaagccccgcuuagcucug

SEQ ID NO: 201737 - RNA, 63 nt, Human
aaagcauaauuggaauccuuggauaaauuuuguagcugguacacucuggccugggucucugaa

SEQ ID NO: 201738 - RNA, 63 nt, Human
acguacagguuugaaauggcugugauaaggaccagcugguauuaacugauaacuuuaccuuug

SEQ ID NO: 201739 - RNA, 63 nt, Human
uccugcaaauaugcccaugcuggccuucuaaauagcugguacauccaucaccacugacgggcc

SEQ ID NO: 201740 - RNA, 63 nt, Human
ggaguguguauuguucccagugacacuucagagagcugguaguuaguagcauguugagccagg

SEQ ID NO: 201741 - RNA, 63 nt, Human
uugaugccuuacuuuuuggauaaauauuuuugaagcugguauuucuauuucuuuuggauuuuu

SEQ ID NO: 201742 - RNA, 63 nt, Human
auuuaggggcaugguaauuuuuaccaaaacugaagcugguaauuuuaaguaaagcaacuaaau

SEQ ID NO: 201743 - RNA, 63 nt, Human
uuuaaaugggagcaacauaucagucgugucaccagcugguauauuguguaaauauuaaagcuc

SEQ ID NO: 201744 - RNA, 63 nt, Human
aauagguaugcauauugugagaaaaacguuaggagcugguaguaaaaaaugagauucuaugcc

SEQ ID NO: 201745 - RNA, 63 nt, Human
uggagcugcuggaggcccugggguugguagggcagcugguagaggaguaccagcuggugugcc

SEQ ID NO: 201746 - RNA, 63 nt, Human
gauguggaaauauuuuuucgaaccugaaaaugcagcugguagaauuucaauggaagcauaauc

SEQ ID NO: 201747 - RNA, 63 nt, Human
cugccagacuacugccagacugagaaacccagaagcugguagucaugugggcuugccuucucu

SEQ ID NO: 201748 - RNA, 63 nt, Human
accuguacauuugucacuuuaaaauuaaaauugagcugguaugagagauaaguggcuuugcuu

SEQ ID NO: 201749 - RNA, 63 nt, Human
ucaaugauaugcuugcaaaaauauauuuuuaugagcugguacugacaguuacaucauaaauaa

SEQ ID NO: 201750 - RNA, 63 nt, Human
uaaugagacugauucuggugucuuuagucauuaagcugguaucuaguccuauaaugaacaaag

SEQ ID NO: 201751 - RNA, 63 nt, Human
uagcuagagucagaccagaaugaaaaugccaggagcugguacacuacagauguaguaagaacc

SEQ ID NO: 201752 - RNA, 63 nt, Human
gagguggcauauucagaggagccuguuggcaagagcugguauucccugcccagccgaccaaau

SEQ ID NO: 201753 - RNA, 63 nt, Human
gggcucagacccuccucuuguacgucucaucacagcugguagagacccaggagugccugauug

SEQ ID NO: 201754 - RNA, 63 nt, Human
cagcagagcucaagauuguagaaacucagcagaagcugguaaaaacauggggagcccggagga

SEQ ID NO: 201755 - RNA, 63 nt, Human
ucauauugagaacacuacacagugcugaaguccagcugguacacaccggggugacaccuuggc

SEQ ID NO: 201756 - RNA, 63 nt, Human
ucaugucugcaaucccagcgauuugggagguugagcugguaggaucacaauaggccacgaauu

SEQ ID NO: 201757 - RNA, 63 nt, Human
ccaccagcccuccaaggcauugcucgcccaagcagcugguaauuccauuucauguauuagaug

SEQ ID NO: 201758 - RNA, 63 nt, Human
gcuucuucugaauacugaaugugacuguuugaaagcugguagaauucaucccucuuacuguag

SEQ ID NO: 201759 - RNA, 63 nt, Human
uugauccacuuaaccuuguuauuguaauuuuaaagcugguaucgguagcugggaagcuuuaug

SEQ ID NO: 201760 - RNA, 63 nt, Human
aguugaaagaauuuauucagcaaccagaaaauaagcugguacuaguuaaacaauuggauaucu

SEQ ID NO: 201761 - RNA, 63 nt, Human
aguugaaagaauuuauucagcaaccagaaaauaagcugguacuaguuaaacaauuggauaaua

SEQ ID NO: 201762 - RNA, 63 nt, Human
uucaugauguggaggcccccaacuuccagaagcagcugguacucugcucacacaagcgacugg

SEQ ID NO: 201763 - RNA, 63 nt, Human
caacaaauggaccuauggcaucauggcuuuagaagcugguacauuuacugagcugauggacag

SEQ ID NO: 201764 - RNA, 63 nt, Human
uucucaaucaaauuggccacuuaagaaauaaagagcugguagaauugcauccucagaugauua

SEQ ID NO: 201765 - RNA, 63 nt, Human
ugcaccugccuacccacgacaaggagacagaggagcugguagccagccgccagaugagcuucc

SEQ ID NO: 201766 - RNA, 63 nt, Human
uguccccuaugccacuaagccaacgugugugucagcugguagcugggggcgcagaggacauca

SEQ ID NO: 201767 - RNA, 63 nt, Human
auuucugggaaugguuaaacacaaaaggcugauagcugguaucacauaguuggagucagugca

SEQ ID NO: 201768 - RNA, 63 nt, Human
cugcugccauucuucaucuccacugagagccagagcugguaggagccgagugccacaggcauu

SEQ ID NO: 201769 - RNA, 63 nt, Human
ucacauuuagacaucucaugggcugaugaauacagcugguaucuuuguggagcuuucuaauuu

SEQ ID NO: 201770 - RNA, 63 nt, Human
cuuugcaccuucuucucuucccucagugccuggagcugguacugggccccuggccccaugagc

SEQ ID NO: 201771 - RNA, 63 nt, Human
acacugacacaggggcccuuuccuugccccuuuagcugguaccucaguggggaggcuuccuua

SEQ ID NO: 201772 - RNA, 63 nt, Human
uccaaaccucuuguacccuccucucccucccccagcugguauguaagugucuugaaguucagu

SEQ ID NO: 201773 - RNA, 63 nt, Human
cugaggugggggaguggggaugccacucaaugcagcugguaucucugagcucugaggagaguc

SEQ ID NO: 201774 - RNA, 63 nt, Human
aagucuucuuuaugaauacucagagcauuguucagcugguacagagguaguaacuuguaacuc

SEQ ID NO: 201775 - RNA, 63 nt, Human
uucuuuccauuccuugauaggcgaguauuccaaagcugguaucguagcugcccuaauguugca

SEQ ID NO: 201776 - RNA, 63 nt, Human
uccuugccaccggcuuccuagagcagcguagacagcugguaaacugaagagcacaacuauauu

SEQ ID NO: 201777 - RNA, 63 nt, Human
aaugguuaaucaugcugugugcuagccagggccagcugguaccuucuuugccaugagcauuca

SEQ ID NO: 201778 - RNA, 63 nt, Human
guaccacagacacaauauguaugcuuuuuaccuagcugguagcauaaauaaaacugaaucuca

SEQ ID NO: 201779 - RNA, 63 nt, Human
gacuugacuugauccucugagcucaagcuauugagcugguaguggcagaggacugaggguacc

SEQ ID NO: 201780 - RNA, 63 nt, Human
agcucagauucaguucuuugccgaagcccucauagcugguaaguggcuuugcauauuagaacc

SEQ ID NO: 201781 - RNA, 63 nt, Human
aaauuuuaaaaaaucucuuacagguuuucuugcagcugguaccauccaugucucacagcccug

SEQ ID NO: 201782 - RNA, 63 nt, Human
ucacagccgaauucuaccagagguacaaggaggagcugguacuauuccuucugaaacuauucc

SEQ ID NO: 201783 - RNA, 63 nt, Human
uucaagugauucuccugccucagccucuggaggagcugguaucacaggcgucccccaccacgc

SEQ ID NO: 201784 - RNA, 63 nt, Human
agccugcuccuggcccccuggaagccuccccacagcugguaaucuggacuuaaggauugcugg

SEQ ID NO: 201785 - RNA, 63 nt, Human
guggacaugacccaccucuggccggaggagcugagcugguaucugcugggggcuuccugggaa

SEQ ID NO: 201786 - RNA, 63 nt, Human
guguggguuuuaugaagaacauugagaacaaucagcugguaauuauggauggaggaagaggga

SEQ ID NO: 201787 - RNA, 63 nt, Human
gacauggagggggcugagugacagagaugguucagcugguaccagaguagaaacaaggugcau

SEQ ID NO: 201788 - RNA, 63 nt, Human
agccaggcgaggcgggugcugaggucucagggaagcugguaacacuucccugucugcagccag

SEQ ID NO: 201789 - RNA, 63 nt, Human
uagaagagaaggaccugugaaacuacugaggccagcugguauuaguaaggaauuaccuucagc

SEQ ID NO: 201790 - RNA, 63 nt, Human
cucagccuaggaaaaaugguucaugggauaaacagcugguauuuguaucuaaaacucagauug

SEQ ID NO: 201791 - RNA, 63 nt, Human
ggauagaugggagguucuugaagccccaggcgaagcugguaccucuggcuacagcuugcucuc

SEQ ID NO: 201792 - RNA, 63 nt, Human
ucccuguucaucucccaacaugcugugcuccauagcugguaggagagggaaggcaaaaucuuu

SEQ ID NO: 201793 - RNA, 63 nt, Human
cucaauuuccccaagaccgguugcucugagaguagcugguaaagaggggcgaacuaaagaccu

SEQ ID NO: 201794 - RNA, 63 nt, Human
gaggaaguaccauagcauuguacuugccucuuuagcugguaugcaagauuugcuaagcaauaa

SEQ ID NO: 201795 - RNA, 63 nt, Human
gccuacuuccuucuugggacacccacuggcucuagcugguaaccuuucugcuauuuccuugac

SEQ ID NO: 201796 - RNA, 63 nt, Human
gauucccaguucuuacuaaauuguauuagcaggagcugguaauuacuuguauuaucacaugua

SEQ ID NO: 201797 - RNA, 63 nt, Human
cacuugccugcccgcaguggugguggauguguuagcugguagauuuggaaucagucaccaguc

SEQ ID NO: 201798 - RNA, 63 nt, Human
cauuaauggacaaauugacugcaauguaauacuagcugguauguuucauaaaugucaagcugu

SEQ ID NO: 201799 - RNA, 63 nt, Human
guggugugcaccuguagucccagcuacucgggaagcugguagaaagacugcuugagccuggaa

SEQ ID NO: 201800 - RNA, 63 nt, Human
cuguucugccagcgaagcuuccuccuccucuccagcugguagucacuugcgugaaugcugguc

SEQ ID NO: 201801 - RNA, 63 nt, Human
caggcaguaaauacccauuacuccuuuacucauagcugguaaaauuauucccacuguuuuauu

SEQ ID NO: 201802 - RNA, 63 nt, Human
gcaucuuaaccuuaccuuugccucugccucucaagcugguaccuccuaauuuacauccuaaga

SEQ ID NO: 201803 - RNA, 63 nt, Human
uuguagcugcucugaaguaaggauuucggauucagcugguagggaaagacucugcaccugcug

SEQ ID NO: 201804 - RNA, 63 nt, Human
uuuguucauagacccucucaagugcccucuccgagcugguaggcauuccagcuccuccgugcu

SEQ ID NO: 201805 - RNA, 63 nt, Human
aucugagagacaccugcaagcacacacugucccagcugguacccauaaugcugcuguuccugc

SEQ ID NO: 201806 - RNA, 63 nt, Human
aggaauucaguggaacuuaucuucauuaaauuuagcugguaccagguugauaugacuugucaa

SEQ ID NO: 201807 - RNA, 55 nt, Human
uuguuugccuuaacuuguagguaccagcugguacccuguggggcaaccucuccag

SEQ ID NO: 201808 - RNA, 63 nt, Human
caagggaugccaguaagucugcaggugcggggugccaccuacaggcccaggccugugucccaa

SEQ ID NO: 201809 - RNA, 62 nt, Human
uucacuuaaugcagccgcgccccggcccgcuccgcccccagcaccgccccgggggccgcccc

SEQ ID NO: 201810 - RNA, 62 nt, Human
ugggugcuuuauucucuucuuuuucuuuauuucgcccccacccccauccccugccuuuuuuu

SEQ ID NO: 201811 - RNA, 62 nt, Human
uccgugugagcaggcccaccuggcuccagacccgcccccaaccugagacagaaccaggcuga

SEQ ID NO: 201812 - RNA, 63 nt, Human
uucuaaggaaucaugaaccuugccuggacauuugccaccuaaacgaucaguguggugcugcgu

SEQ ID NO: 201813 - RNA, 63 nt, Human
aagucauuuuccccuuagagugcuugaagaaaugccaccuacagguuguguacuuuucauaau

SEQ ID NO: 201814 - RNA, 63 nt, Human
gccgcuuggaaagugcagccuucuacagguagagccaccuagaaaugcauauggcugcaaagg

SEQ ID NO: 201815 - RNA, 63 nt, Human
agaauauauuagaguuguggguaauuuuucacagccaccuauguacauacuaauuacccauug

SEQ ID NO: 201816 - RNA, 63 nt, Human
uuccagauggcgaggucacagcagagagauguggccaccuagccuuuccuuauccccuucccu

SEQ ID NO: 201817 - RNA, 63 nt, Human
cacucaaccugucagcuugcaccauccccaccugccaccuacagucaggccacaugccugguc

SEQ ID NO: 201818 - RNA, 63 nt, Human
gggaacccugaggguguggguagaguagcaggggccaccuaagagauuaaaaacagucuguuu

SEQ ID NO: 201819 - RNA, 63 nt, Human
augcgccuccuccucggagacagacgcaucggugccaccuaguggcuggugggaguaacagcu

SEQ ID NO: 201820 - RNA, 63 nt, Human
ucuccuguccuggccucucugaagcagacaagggccaccuaucccggggguggaugcugaguc

SEQ ID NO: 201821 - RNA, 63 nt, Human
ccugcagcgcggcccgugacacggcgcccacuugccaccuaggcgcucugguggcccuugcag

SEQ ID NO: 201822 - RNA, 63 nt, Human
uguaaagacacagaagaugcugaccucaccccugccaccuaucccaagaccucacuggucugu

SEQ ID NO: 201823 - RNA, 63 nt, Human
uuugauacuggaggaacacuugauggagugugagccaccuaagaucucgguuugccaaaauuc

SEQ ID NO: 201824 - RNA, 63 nt, Human
uguuuuccuaacuuuuuguauuuuucuuguauagccaccuagagaauucuucauagauuaaga

SEQ ID NO: 201825 - RNA, 61 nt, Human
gccccuuugauggacauaaaggcucuuuucagagccaccuacuaucucgagaaaagagccg

SEQ ID NO: 201826 - RNA, 63 nt, Human
cagauauuuuuguuucucaucuuaacuauccaagccaccuauuuuauuuguucuuucaucugu

SEQ ID NO: 201827 - RNA, 63 nt, Human
cauaucaggaugaccucgagagcugaggcucuagccaccuaaaaccacgugcccaaacccacc

SEQ ID NO: 201828 - RNA, 61 nt, Human
ggggucccuuuguugccaagacguuaggaaagcgaggaaagugcuuggauuaggagagucu

SEQ ID NO: 201829 - RNA, 61 nt, Human
acaagggauggggacgcgagggggaggggaggcgaggaacaaggagaaggggcaacuuucc

SEQ ID NO: 201830 - RNA, 61 nt, Human
aaucugcuagucgcuagcccugagaaguacugcgaggaaauguggagcaguuuucucuggu

SEQ ID NO: 201831 - RNA, 63 nt, Human
aacaaaaaacaagaccucuuuucuuuagauggugccaccuaugcccaccacaacagagauuuu

SEQ ID NO: 201832 - RNA, 63 nt, Human
auagcaaaacuuuuaaacuacagguaguuaagggccaccuacaauacaucugagguccuguga

SEQ ID NO: 201833 - RNA, 63 nt, Human
gcagggacuaggcugaagaugugucuucuccccgccaccuacuguaugacaccacauucuucc

SEQ ID NO: 201834 - RNA, 63 nt, Human
cugccugccaaucguccagcacccuccaccuuugccaccuauuucuuguuguaaaacagaugu

SEQ ID NO: 201835 - RNA, 63 nt, Human
aauauugcccuaaguacaacuaggcaagugauugccaccuaaaucagaagacguucuaaaguc

SEQ ID NO: 201836 - RNA, 63 nt, Human
ccguugagguuggagagggaaaauaaagaagcugccaccuaacaggagucacccaggaaagca

SEQ ID NO: 201837 - RNA, 63 nt, Human
guuuugcguuuuauacaugaggucagugcuacagccaccuagcaugaacuaacccagcuucca

SEQ ID NO: 201838 - RNA, 63 nt, Human
gcaagccuggauacaauuaaccauuuuauauuugccaccuacaaaaaaacacccaauaucuuc

SEQ ID NO: 201839 - RNA, 63 nt, Human
agaaauuacaaagcccgagcucuuucuuauaaugccaccuaucccuguaagcuaaacaaacaa

SEQ ID NO: 201840 - RNA, 63 nt, Human
uacaacuacaaggaaaaaaaugcauuuaaccaugccaccuaugagugccagugacuuauuuua

SEQ ID NO: 201841 - RNA, 63 nt, Human
aaaaucuaaaaauucuugcaaugaguaguauaagccaccuauuuuuacuuccuucucugaaau

SEQ ID NO: 201842 - RNA, 63 nt, Human
caaguauuccauuugcauuugguaauuuuucaugccaccuauuuaugaauauauaaaucuuua

SEQ ID NO: 201843 - RNA, 63 nt, Human
agcuuugcugcuauauagguguuauguguaaaugccaccuauuaauacgggacugaaaacguu

SEQ ID NO: 201844 - RNA, 63 nt, Human
uucuuucacgguuacuguuccugaaaagaaaaagccaccuagcccuaucaagccaaagauucc

SEQ ID NO: 201845 - RNA, 63 nt, Human
aaauuauacuggguucggauugugaaaacauuggccaccuaguagcaguggugaggaguggga

SEQ ID NO: 201846 - RNA, 63 nt, Human
uggcuauuuauuauaaaguacugaagucacauagccaccuauaaaacagcauagaaaugucug

SEQ ID NO: 201847 - RNA, 61 nt, Human
gaaagcaccauguggaguggagguggagggagcgaggaaccaugaaugaacucgcaggcag

SEQ ID NO: 201848 - RNA, 61 nt, Human
aucucuacgggaaagagagguaggagaggcugcgaggaagcuuggguucaagcgucacuca

SEQ ID NO: 201849 - RNA, 61 nt, Human
cgcguuuggguuugauggcgaguuucuaaaggcgaggaaaugguuuguaagaggggaaaga

SEQ ID NO: 201850 - RNA, 63 nt, Human
aacaaauuauguggucaaauaauauagucauuagccaccuaaacauuuuaauuccagauauua

SEQ ID NO: 201851 - RNA, 63 nt, Human
gugcggcuuucugggcacaggugucacugcucugccaccuaucacuauucuuuuucuguucag

SEQ ID NO: 201852 - RNA, 63 nt, Human
agccauacugggaaaacuuacuuuucauggagugccaccuaacagugaauguauuagaguaua

SEQ ID NO: 201853 - RNA, 61 nt, Human
ucaaucccaaaggaaccaaaggcucuuuucagagccaccuacaauuuuguggaagaacuga

SEQ ID NO: 201854 - RNA, 61 nt, Human
gaaucacuuuccaauacaacggcucuuuucagagccaccuacuauuucugcgggagagcug

SEQ ID NO: 201855 - RNA, 63 nt, Human
ccaaagaggaccccacucugaagccagccuggagccaccuaccucuggccucaggcugugggc

SEQ ID NO: 201856 - RNA, 63 nt, Human
uggagcaucugaucugucucuaugccaccacuggccaccuagagcccuuggcugugguaaucc

SEQ ID NO: 201857 - RNA, 63 nt, Human
ugcccuccccuuccccuuuacucagcccagcuggccaccuagaagucucccugcacagccucu

SEQ ID NO: 201858 - RNA, 63 nt, Human
gagcagggaguugcccuuccccucccucgggaagccaccuaagaauguuuacaugccaaacag

SEQ ID NO: 201859 - RNA, 63 nt, Human
uuguuccaguaugaaaguugggggagagcaccagccaccuaggaaaacuguauguuaccuuuu

SEQ ID NO: 201860 - RNA, 63 nt, Human
gaaauuugcacauuuaauugucccuaauagaaagccaccuauucuuuguuggauuucuucaag

SEQ ID NO: 201861 - RNA, 63 nt, Human
ugucuucuuuccaccucccacugccccuccccugccaccuaucaaugaugccuugguucaguc

SEQ ID NO: 201862 - RNA, 63 nt, Human
aaaucuauuaugguuaauuucauuucuugcuuugccaccuaagcaguaaaacaugauauugac

SEQ ID NO: 201863 - RNA, 63 nt, Human
uuguuggcaaaagaaucucaggaacggcccugggccaccuacuauauuaaucaugcuaguaac

SEQ ID NO: 201864 - RNA, 61 nt, Human
cugugucagaaaaaacaaaaggcucuuuucagagccaccuaccgucucagaaaaaggcugu

SEQ ID NO: 201865 - RNA, 61 nt, Human
guuucuucuaguaacccaacggcucuuuuaagagccaccuacgcauuucaggaaaagagcu

SEQ ID NO: 201866 - RNA, 61 nt, Human
aauguuugcaugaccuaccucaggaggggaggcgaggaagaguaauauuuagcauucagga

SEQ ID NO: 201867 - RNA, 61 nt, Human
gagguggaaaguucgagaggaggagcuauuugcgaggaagcccuguggcaauagagauagg

SEQ ID NO: 201868 - RNA, 61 nt, Human
uagccaccuguacuacggugccgaccgcaaugcgaggaaugugguggccacgcgauggagc

SEQ ID NO: 201869 - RNA, 62 nt, Human
aaaaucagccuaacagcaaaggcucuuuucagagccaccuacgacuuccauuaaaugagcug

SEQ ID NO: 201870 - RNA, 61 nt, Human
uaagcacuuccaaacccaaaggcucuuuucagagccaccuacuuugucacaaggagagcua

SEQ ID NO: 201871 - RNA, 61 nt, Human
uacacuaccgcaaaaccaacggcccuuuucagggccaccuauccacucaggagaaagagua

SEQ ID NO: 201872 - RNA, 61 nt, Human
accucgguccaaaccaaaaagguucuuuucagagccaccuacuuuuucaccaaguagagcu

SEQ ID NO: 201873 - RNA, 63 nt, Human
gugaggccaagauugaaauuugauacuaaaaaggccaccuagcuuuuugcagauaacaaacaa

SEQ ID NO: 201874 - RNA, 63 nt, Human
aguucccuucagaggcugcauuugccuucuucugccaccuaaauauuacuucccuucaaaucu

SEQ ID NO: 201875 - RNA, 63 nt, Human
auuuugccauuuugauccuuuuacuuuguuuuagccaccuauaguguuaccaaccaucuuuau

SEQ ID NO: 201876 - RNA, 63 nt, Human
aaccaguuacuuacuucuuuuguuguuuugcaggccaccuagaaauacaaaaugccaauucac

SEQ ID NO: 201877 - RNA, 63 nt, Human
caucuucucuaguucucauaagacuaucuccccgccaccuauaguuaguacccucaaguccuc

SEQ ID NO: 201878 - RNA, 63 nt, Human
aauguaacccuaaacacaucauguauuuuaaaugccaccuacauaaauaaaacauaagcauau

SEQ ID NO: 201879 - RNA, 63 nt, Human
aaaugaaauggauccaucaucaaagucuuuauugccaccuacugacacucgauuuaggccaga

SEQ ID NO: 201880 - RNA, 63 nt, Human
caagggccagauguauuuaagggguauucagaugccaccuacaugcuuauuuugucuagaaca

SEQ ID NO: 201881 - RNA, 63 nt, Human
gcacugggcauggggugguggugggagcuuaccgccaccuauucaagcucucagcuacuccug

SEQ ID NO: 201882 - RNA, 63 nt, Human
ggcgcuggucagaaacgggguagucucuuuggcgccaccuaguguccaguuuggcccauggcg

SEQ ID NO: 201883 - RNA, 63 nt, Human
cugcuuaagugguugcuauacaaacuuugaauagccaccuaauaaauaaaccuugcaugacaa

SEQ ID NO: 201884 - RNA, 63 nt, Human
gcaguggcgcgaucuuggcucacugcaacccccgccaccuagguucaagugauucucaugccu

SEQ ID NO: 201885 - RNA, 61 nt, Human
gucagugggacaaacuccagcacagaagccugcgaggaagccuauggaauaguuuccuguc

SEQ ID NO: 201886 - RNA, 61 nt, Human
cucuuuuaggaucagaucugugagcacguuggcgaggaaaaacaaaacaaacaaaaaaaag

SEQ ID NO: 201887 - RNA, 61 nt, Human
uaauaauuuguuuuauaauugaguaguacaagcgaggaaaaaauacggaggauaaccacua

SEQ ID NO: 201888 - RNA, 63 nt, Human
ugauucuggaauauaacuuuguguaaauuaacagccaccuauagaagaguccaucugcuguga

SEQ ID NO: 201889 - RNA, 63 nt, Human
gggacugauuccugugguuggaaaacugaggcagccaccuaagguggaggugggggaauagug

SEQ ID NO: 201890 - RNA, 63 nt, Human
ggaugguccugaaaccagacaagaccucugccagccaccuaagcccugcguacauucacaugc

SEQ ID NO: 201891 - RNA, 63 nt, Human
gccauagaaggaagcugucagcccggagugccugccaccuagacacugaugccauugugugcu

SEQ ID NO: 201892 - RNA, 63 nt, Human
cagucauccugaaccugaguucaaccaaccgcagccaccuacguuugaccccagcgagaucaa

SEQ ID NO: 201893 - RNA, 63 nt, Human
auugcagcuaaggaacaauggaaagagcugaaggccaccuacagggagcacguagaggccauc

SEQ ID NO: 201894 - RNA, 63 nt, Human
aucaccagcaacacccgggacaauaauacgggggccaccuacccccaccugaacuucagcauu

SEQ ID NO: 201895 - RNA, 63 nt, Human
gguguucucuguugcuaagugacagugggcccagccaccuauuuuaacaagcccucccaguga

SEQ ID NO: 201896 - RNA, 54 nt, Human
agccccauggcugcugcugagucagccaccuagcgcuggccccaugcagccucc

SEQ ID NO: 201897 - RNA, 63 nt, Human
uucauuugcagugguuagucaucagauauuuuagccaccuacacaaaagcaaacugcauuuuu

SEQ ID NO: 201898 - RNA, 63 nt, Human
ccaaagcaauagaggcagagugguccccucuuugccaccuaggccaguuuugacccuggcauu

SEQ ID NO: 201899 - RNA, 63 nt, Human
uaaaaauaaaaacaaauacuguguuucagaagcgccaccuauuggggaaaauuguaaaagaaa

SEQ ID NO: 201900 - RNA, 63 nt, Human
ugaggcacagcucugagcacagaggucccuucugccaccuaccaugcaccauguuccuugcca

SEQ ID NO: 201901 - RNA, 63 nt, Human
cagggcuggccacccuggucuugaggguuccuggccaccuagccugcuccucugcucucuggg

SEQ ID NO: 201902 - RNA, 63 nt, Human
accuccagggcccugacuuuuccagaggcugcugccaccuacuucuuaucaaagaagggggag

SEQ ID NO: 201903 - RNA, 63 nt, Human
gugaaugauuuuguuacaucaguguucacuguagccaccuaaguaggacauuauaugauuuca

SEQ ID NO: 201904 - RNA, 61 nt, Human
ucauccaccagucagacugaauguguagcuggcgaggaauuacuuccacuucuggcccagc

SEQ ID NO: 201905 - RNA, 61 nt, Human
augcaucuguuccaggaaagaagaaaagcgagcgaggaagacggaaaagacugccugccuu

SEQ ID NO: 201906 - RNA, 61 nt, Human
accaaaaaaauaauggaaugauugcaucacugcgaggaaguauacuuaauuaagaaaguug

SEQ ID NO: 201907 - RNA, 63 nt, Human
ccgcaggcgaaagcacguuccagccaccaggaggccaccuauuguuucaaaauaaagacuggg

SEQ ID NO: 201908 - RNA, 63 nt, Human
acuccgagguaucuaaaggguagaccuggaccugccaccuaugaguugugugauauagaaaaa

SEQ ID NO: 201909 - RNA, 63 nt, Human
uuguaguagucucauuacuuuugaaguaaucccgccaccuaucucgugggagagccauccaaa

SEQ ID NO: 201910 - RNA, 63 nt, Human
ccucagugaagauuguauuuuauuuuaucaaaagccaccuagcagucaucuguggagcacugg

SEQ ID NO: 201911 - RNA, 63 nt, Human
uuauuuuuauugcuauuaaaauauccacuagaugccaccuagagcuccaguucuuuauaacaa

SEQ ID NO: 201912 - RNA, 63 nt, Human
auuuuacuacauuuuugcugguauaauuccuuagccaccuauguacauacugcuuuaagaaau

SEQ ID NO: 201913 - RNA, 63 nt, Human
ugcuuugagaaaacauuucuuaaaacagugugugccaccuaaggcuggaugggaaagugcagu

SEQ ID NO: 201914 - RNA, 63 nt, Human
ccuccaccugcugagcccaccccaaguaugccugccaccuacgcccacaggcagggcacacug

SEQ ID NO: 201915 - RNA, 63 nt, Human
ccagcagccauggcuggcuggggcuuuagccaagccaccuacugccaggaauuggagccucag

SEQ ID NO: 201916 - RNA, 63 nt, Human
ugccuuccuucagcaggaccgucuaggugcgcagccaccuauggaugcgucccagccagcccc

SEQ ID NO: 201917 - RNA, 63 nt, Human
uccuuagagaaagucacuggggccugccaagcugccaccuaaagacaagagugagagggcuga

SEQ ID NO: 201918 - RNA, 63 nt, Human
acuucugcauuaucuuuauggcucuuuaaaccagccaccuagccaaucaagggcaauucccau

SEQ ID NO: 201919 - RNA, 63 nt, Human
ccuucagcaugaguucuguuucacaaguuuugggccaccuauuucaauaaaaaauaaaauaua

SEQ ID NO: 201920 - RNA, 63 nt, Human
guuguauuugaauugagauuuuuacuauacaaagccaccuagggccuggggauuugggucagu

SEQ ID NO: 201921 - RNA, 63 nt, Human
gaggaucagacggccugaaacuccggacugugggccaccuaguccggcaggaucuuccgccag

SEQ ID NO: 201922 - RNA, 63 nt, Human
acagaaucacuccugcugaaaaauacgcuuucugccaccuacacauuucuauuuaggaaguaa

SEQ ID NO: 201923 - RNA, 61 nt, Human
acucccuuaacaguguugaauucaacugaaggcgaggaauguuggugaugaagcugaguuc

SEQ ID NO: 201924 - RNA, 61 nt, Human
uggccgaccgcagcugugccguggcacgauggcgaggaagccagccccaaggaaacacuga

SEQ ID NO: 201925 - RNA, 50 nt, Human
aggacaucaugcugcagugagcgaggaagccccgggguuugucgucguug

SEQ ID NO: 201926 - RNA, 63 nt, Human
cuucagaagugaucuuggcucgcaggcaccagugccaccuaccaagcugugaaacuaaaccuu

SEQ ID NO: 201927 - RNA, 63 nt, Human
gccucccuaccauggugccaggggucucccuccgccaccuaggaaaggagggagaugugcgug

SEQ ID NO: 201928 - RNA, 63 nt, Human
ggagcacguggagauagugccagguggcucagugccaccuaugccuguggugaaguguggcug

SEQ ID NO: 201929 - RNA, 63 nt, Human
aguaucuccccuuguccccacccagucaccaaagccaccuacaugacaguccaucccuguuga

SEQ ID NO: 201930 - RNA, 63 nt, Human
uuguugaucccuuuucucaucuuaccccuuuaugccaccuacugaaaagaaaaacaaauagcu

SEQ ID NO: 201931 - RNA, 63 nt, Human
uauagaagaaaaacggguucaaaccccacuucugccaccuaccagcuauauggccuugaauga

SEQ ID NO: 201932 - RNA, 63 nt, Human
agcuuggcccgccuuccgccagccgcgcccugcgccaccuacccgggguccuccacagcggag

SEQ ID NO: 201933 - RNA, 63 nt, Human
gcaaaagaugaaguuaaacuccucuacuuaugugccaccuacaaagcacuagagacuguagga

SEQ ID NO: 201934 - RNA, 63 nt, Human; identical to SEQ ID NO: 201933

SEQ ID NO: 201935 - RNA, 63 nt, Human
uggacaccacgagacagaaguggggacugccuggccaccuagcgccuucccacuccuuaagca

SEQ ID NO: 201936 - RNA, 63 nt, Human
ugcaccuggggggaggguagggaggaggggcaugccaccuaaugaucaagcccuauaauuagc

SEQ ID NO: 201937 - RNA, 63 nt, Human
uuguauugcugcguagaaucugaacacacugaggccaccuagcaagguaguaacuagucuaac

SEQ ID NO: 201938 - RNA, 63 nt, Human
auucacucacucacucauuccuucacucauccagccaccuaaaaacauuuacugaccauguac

SEQ ID NO: 201939 - RNA, 63 nt, Human
cugccugucggcuggggcagagacugaaauacugccaccuaccuuuggcauuuaauguuccuc

SEQ ID NO: 201940 - RNA, 63 nt, Human
ccuucugccuguuucuguaagcaaaugccacaggccaccuauagcuacauacuccuggcauug

SEQ ID NO: 201941 - RNA, 63 nt, Human
cugcugcgcacgcccccuccccggacagcaccugccaccuagaaacuuucuuagcaaaaaaau

SEQ ID NO: 201942 - RNA, 61 nt, Human
aaaaguggcaacuuugguggcagccuagaccgcgaggaaguggaaucuuccuuaaagguga

SEQ ID NO: 201943 - RNA, 61 nt, Human
uuugaagauguucucuagccuuccaccagcagcgaggaauuaacccuguguccucagucgc

SEQ ID NO: 201944 - RNA, 61 nt, Human
ugcggggucaggggcuccagcauccgagcuggcgaggaaacaguacagggucugaguucug

SEQ ID NO: 201945 - RNA, 63 nt, Human
gaggauggagcuucuccucagcuccucugagcagccaccuaugugaucuuuaaauccaacccc

SEQ ID NO: 201946 - RNA, 64 nt, Human
uugucccucaaccugcucuggugccccacucucagcaccacagaaugauccggguucagguugc

SEQ ID NO: 201947 - RNA, 64 nt, Human
aaagaaggggaaaaacugacaacuaacaaaaccagcaccacaucgcuagguggugcuuacuaau

SEQ ID NO: 201948 - RNA, 64 nt, Human
agauugucccagggccuuguggaggacacgggccgcaccacacagugcucccugcccugccuca

SEQ ID NO: 201949 - RNA, 64 nt, Human
cagugaaugcuuuuccaggccucuguugcuuccugcaccacaccugguggggugggagcguccu

SEQ ID NO: 201950 - RNA, 64 nt, Human
acgugagcucccacacguacacaugcacauguacgcaccacaaacacaugcgcaggcuccugca

SEQ ID NO: 201951 - RNA, 64 nt, Human
cccuacccuaggcaugagguauauuuuauucugggcaccacacauuugccccauagauaacaau

SEQ ID NO: 201952 - RNA, 64 nt, Human
agcaugauggcacgcugucgcccaaagacagcuugcaccacagcgcuggggagagggaugaagg

SEQ ID NO: 201953 - RNA, 64 nt, Human
ggcagugucuccaugaggguuuuccuguugaggggcaccacauacaauagugugaaguagguau

SEQ ID NO: 201954 - RNA, 64 nt, Human
gaagccggguuuccggaagcucgcagcuuggccugcaccacacgcccuccccuuuuggcuucac

SEQ ID NO: 201955 - RNA, 64 nt, Human
acucucucuucuccuuccuaacccuuugucuagagcaccacaccgcucacaaacucuuuccaaa

SEQ ID NO: 201956 - RNA, 64 nt, Human
cucacaggaacuguucaguucccacccucagugggcaccacacaccccacuuccagcagagucc

SEQ ID NO: 201957 - RNA, 64 nt, Human
agcccucaacagccucccaggcuaucaguauccugcaccacaaugguacauuuguuacaaucaa

SEQ ID NO: 201958 - RNA, 64 nt, Human
ccccuugucucuaguggacauuugagaucagagagcaccacagggcuggcuuugugcccuaacc

SEQ ID NO: 201959 - RNA, 64 nt, Human
gacugccuugucucuaguaguguggccugugccagcaccacagccggucagaggagcgcaggca

SEQ ID NO: 201960 - RNA, 62 nt, Human
gauuacagagggguauugauuugccuugcccccgcccccaccaucacagugugucccugucc

SEQ ID NO: 201961 - RNA, 62 nt, Human
aaucuguacccuucgggagggcacucacaugccgcccccagcagcuccccugggggcuagca

SEQ ID NO: 201962 - RNA, 62 nt, Human
ccgccgccaggacuguguuuccaaagguuccccgcccccaaccccagcaucagccuguagcu

SEQ ID NO: 201963 - RNA, 62 nt, Human
cagcacaaucccggccccgcccucgcggcgggcgcccccagggccaggagagagagacaggg

SEQ ID NO: 201964 - RNA, 63 nt, Human
ugggcccccccagacucuagccugagcagugcagccaccuacugccccaccucagagaagugc

SEQ ID NO: 201965 - RNA, 63 nt, Human
cuugaagccaagaacucuucaaugccagcuacugccaccuaaaaaucaucuggcuuuauagug

SEQ ID NO: 201966 - RNA, 63 nt, Human
ccugagcagguguggugccgucccgccauugccgccaccuauuuauuguguuuuaucugaacg

SEQ ID NO: 201967 - RNA, 63 nt, Human
cuccuuggggcccaagcucugcucccuggaucugccaccuagcagacguggggagccugaccc

SEQ ID NO: 201968 - RNA, 63 nt, Human
cuuccaaucugaaaccucgugccuggcucgucugccaccuacauuucucuuuccagcugcugu

SEQ ID NO: 201969 - RNA, 63 nt, Human
cucucacagauagugagggucugacaugcccaugccaccuaugccacagugccuaagggcuag

SEQ ID NO: 201970 - RNA, 63 nt, Human
ugcaguguagagcuagauuaaaagcaacucuuugccaccuacucugcccuuuuggcaaaguua

SEQ ID NO: 201971 - RNA, 63 nt, Human
aacuggguuggaccuagugguguugucgugagugccaccuaaccaggaggccagagcgguuug

SEQ ID NO: 201972 - RNA, 63 nt, Human
cuuuugaggagcuggagggguggggagcuagaggccaccuaugccagugcucaagguuacugg

SEQ ID NO: 201973 - RNA, 63 nt, Human
uauagugucucaggguccgaagcaaguuuaaaugccaccuaggaggauccaaagucugaaucu

SEQ ID NO: 201974 - RNA, 63 nt, Human
gagucuuccccagccuugaaccuaggaccaagagccaccuacauccagccccaaaacuggggc

SEQ ID NO: 201975 - RNA, 63 nt, Human
cgagagcuggagagccauguauauggcuucaaagccaccuacggcagggacacacucgugagc

SEQ ID NO: 201976 - RNA, 61 nt, Human
agcagaggggugcggguaaacgaggaguggggcgaggaaagcgggaugggaacaaguggcc

SEQ ID NO: 201977 - RNA, 61 nt, Human
cacucagggccagacccaccauccuggacuggcgaggaagaucagugccuccugcucugcc

SEQ ID NO: 201978 - RNA, 61 nt, Human
uuucuggggccucaauccagucuugauaacagcgaggaaagagguauugaagaaacagggg

SEQ ID NO: 201979 - RNA, 61 nt, Human
ugaguacuugccuaggacugggaggaggauugcgaggaaauggagauucacugcuaaugag

SEQ ID NO: 201980 - RNA, 61 nt, Human
uccuagaugcccuuuuggccuuugugagggagcgaggaacaggcucgaaggcuccggggua

SEQ ID NO: 201981 - RNA, 61 nt, Human
auuugugucacuguacaguuuuguggacugagcgaggaaaaacaacaaauaauuuaaguug

SEQ ID NO: 201982 - RNA, 61 nt, Human
accacugggugagagaggaauaaggcccagagcgaggaaaggauuuuaccaaagcaucaau

SEQ ID NO: 201983 - RNA, 61 nt, Human
ccugaaaaacugccccaaugccacgguaaaggcgaggaagucuuggcuggcguugcugacu

SEQ ID NO: 201984 - RNA, 61 nt, Human
gauugaaaggugcauuuuccccauaaaaaaggcgaggaaaacccauggcugcuuuguguca

SEQ ID NO: 201985 - RNA, 61 nt, Human
uuaaaacucgcuuucuugagucggaguguuugcgaggaacugccugugugugagugcgugu

SEQ ID NO: 201986 - RNA, 61 nt, Human
ucugcccacauguaauuaccggcuaauucaagcgaggaaaaauguaagucauuuagaccaa

SEQ ID NO: 201987 - RNA, 61 nt, Human
gcccugucaccuucaccucccggaguaagcagcgaggaagagcagcacuggucccaagcag

SEQ ID NO: 201988 - RNA, 61 nt, Human
ucuacugcccuggcugcagucagugcccagggcgaggaauguggccaggggauccaggacc

SEQ ID NO: 201989 - RNA, 61 nt, Human
cugcugugcccaggacguggguucagcgugggcgaggaaagccuggcgagcguggcccugu

SEQ ID NO: 201990 - RNA, 61 nt, Human
cggggagaggaggcggcgagggucccggggcgcgaggaaggcgccugcccucucccagcuc

SEQ ID NO: 201991 - RNA, 61 nt, Human
cagcuuuggaaaugggucccgagugggccgugcgaggaaggcugucgaccucuacuccucc

SEQ ID NO: 201992 - RNA, 61 nt, Human
cggugagggcuuggaaggagacaggaauggggcgaggaaggagccaggcccggcaugagga

SEQ ID NO: 201993 - RNA, 61 nt, Human
auaaaaaagcuuucuaugaguuugguauggugcgaggaaaaucuuacaguuugaauuauga

SEQ ID NO: 201994 - RNA, 61 nt, Human
cugcagccuaggcaggggaugcacagcccaggcgaggaagccuggcuucucugugagcaca

SEQ ID NO: 201995 - RNA, 61 nt, Human
accaagaggugguuaaagccauauuggaguagcgaggaaucugauuccaagcaaaaaccag

SEQ ID NO: 201996 - RNA, 61 nt, Human
gcuggacaagagccucaauaaggacacccuggcgaggaagcuggcagugcucaccccaggc

SEQ ID NO: 201997 - RNA, 61 nt, Human
ucaggcccacuggguugccccggccaggccugcgaggaagggcugagguggggccggcagg

SEQ ID NO: 201998 - RNA, 58 nt, Human
cacaggaaacuucgcagugaugcaccaggcgaggaaacgagaccucuuucguuccuuc

SEQ ID NO: 201999 - RNA, 61 nt, Human
uuuguggaggaggcaccaagugucucaggcagcgaggaaauuggaggccauuuuucaguca

SEQ ID NO: 202000 - RNA, 60 nt, Human
uucaccaggucaccaaguaaugucccuggugcgaggaaacagagacaaccuuucugucuu

SEQ ID NO: 202001 - RNA, 61 nt, Human
ugucagcccccaucugacaagaaagccuggagcgaggaaggaaagcacagcgaacccaaug

SEQ ID NO: 202002 - RNA, 61 nt, Human
ccagaccacagaggauggagccugggaagcagcgaggaaaucacagcccccucgccccugc

SEQ ID NO: 202003 - RNA, 61 nt, Human
uuggagagagccuucuagaaugacagacugugcgaggaagcaggggcagggguuuccagcc

SEQ ID NO: 202004 - RNA, 61 nt, Human
ccugggccaucuugguuuuugcaagaaaaaagcgaggaaaucagagaaacucuuugggcug

SEQ ID NO: 202005 - RNA, 61 nt, Human
guuucauuuacuccaaaggauccugaagccugcgaggaaagguaauauaaaaauguuauaa

SEQ ID NO: 202006 - RNA, 52 nt, Human
ucacaaggguagagaucugauugcgaggaaccugggcucugacucgaacacc

SEQ ID NO: 202007 - RNA, 61 nt, Human
cccugaagguuguggguuuacuggaacgagggcgaggaacaccuggcccacccagggcgga

SEQ ID NO: 202008 - RNA, 61 nt, Human
caauuuuuguauccaaggaaauaaugugaaugcgaggaaaugucuuuagagcacagggaca

SEQ ID NO: 202009 - RNA, 61 nt, Human
gagcauaaucauugucugcaaaguguuuggugcgaggaagauuauugcuaauuuugugaaa

SEQ ID NO: 202010 - RNA, 61 nt, Human
uauggccagcgggacuccaaccgggguagccgcgaggaaggcgcuggcagaggacagaaau

SEQ ID NO: 202011 - RNA, 61 nt, Human
ugacacagaggagauuagcauggcccccugcgcgaggaagaucugcagauucaugcagcau

SEQ ID NO: 202012 - RNA, 61 nt, Human
ugacacagaggagauuagcauggcccccugcgcgaggaagauccgcagauucaugcagcau

SEQ ID NO: 202013 - RNA, 64 nt, Human
gagguugcagugagcugagauggcaccacuuauugcacuccagcccgggcgacagagcgagacu

SEQ ID NO: 202014 - RNA, 64 nt, Human
aauuucuaggaaacgugccuuuguuuuuuaauaugcacuccaaauuagaaggccggccccgucc

SEQ ID NO: 202015 - RNA, 64 nt, Human
gguggagguugcagugagccaagauugcaccauugcacuccagccuggcgacagagcaagacuc

SEQ ID NO: 202016 - RNA, 64 nt, Human
ggcacagguuccagugagccaagguugugccacugcacuccagccugggcaaaaaagcaaaacu

SEQ ID NO: 202017 - RNA, 64 nt, Human
ggcagagguugcaguaagccaagaucgugccauugcacuccagccugggugacagagcgagacu

SEQ ID NO: 202018 - RNA, 64 nt, Human
ggcagagguugcagugagccaagaucgcgcuauugcacuccagccugggugacagagcaagacu

SEQ ID NO: 202019 - RNA, 64 nt, Human
ggcagagcuugcagugagccgagaucacgccacugcacuccagccugggugacagagcgagacu

SEQ ID NO: 202020 - RNA, 64 nt, Human
gguugaggcugcagugagccaugaucgcaccacugcacuccagcuuaggcaauacagcgagacc

SEQ ID NO: 202021 - RNA, 64 nt, Human
agcggagguugcagggagccgagaucacgccacugcacuccagccugggcgacagagcgagagu

SEQ ID NO: 202022 - RNA, 64 nt, Human
ggcagagguugcagugagcugagaucgcaccacugcacuccagccugguuacagagcaagacuc

SEQ ID NO: 202023 - RNA, 64 nt, Human
cccaggagcugcagccauccgugaucgcgccacugcacuccagccugggugacaaagccagacu

SEQ ID NO: 202024 - RNA, 64 nt, Human
ggugaagguugcagugaccagagaugacgccauugcacuccagccugggugagaagagcgaaac

SEQ ID NO: 202025 - RNA, 64 nt, Human
aaaaagacaaaguauuuuguccauuugagauucugcacuccaugaaaaguucacuuggacgcug

SEQ ID NO: 202026 - RNA, 64 nt, Human
gauggagauugcaguaggccaagaugaugccacugcacuccagccugggcuacagagcgagaca

SEQ ID NO: 202027 - RNA, 64 nt, Human
ggcagagguugcagugagcugagaucacgucauugcacuccauccugagccacaagagcaaaac

SEQ ID NO: 202028 - RNA, 64 nt, Human
ggcggagguugcagugagcucagaucucaccauugcacuccagccugggcgacugagcgagacu

SEQ ID NO: 202029 - RNA, 64 nt, Human
ugggcaagagagugagacuccguuuugugccacugcacuccagccagggugacagagugagacu

SEQ ID NO: 202030 - RNA, 64 nt, Human
gguggagguuucagugagccaagauagcgccauugcacuccagcgugggcgacagcaagagacu

SEQ ID NO: 202031 - RNA, 64 nt, Human
gguggaaguugcagugagccgagaucaugccacugcacuccagccugggcgacggagugagacu

SEQ ID NO: 202032 - RNA, 64 nt, Human
ggcagagguugcacugagcugagauugugccacugcacuccagccugggcaacaagagcaaaac

SEQ ID NO: 202033 - RNA, 64 nt, Human
ucacucauagccacuuuuauguuaccuuuuauaagcacuccagggaagauuuuauauuuuuuug

SEQ ID NO: 202034 - RNA, 64 nt, Human
gguggagguugcagugagccaagaucgugccacugcacuccagccuggcgacacagugagacuc

SEQ ID NO: 202035 - RNA, 64 nt, Human
ggucaaggcugcagugagccgagauugcaccacugcacuccagccugggugacagagcaaguga

SEQ ID NO: 202036 - RNA, 64 nt, Human
gccuuaaagagggacaggcugaagagagggacaggcacuccaaaccugucuuggggccacuuuc

SEQ ID NO: 202037 - RNA, 64 nt, Human
ggcagagguugcagugagcugagauugugccacugcacuccagccugggugacagcgagacccu

SEQ ID NO: 202038 - RNA, 64 nt, Human
gguugaggcugcagugaauuaugauuguggcauugcacuccagccugggugguagaucaaggcu

SEQ ID NO: 202039 - RNA, 64 nt, Human
gggugagguugcagugagcugagaucaugccacugcacuccagccugggugacaggaaaagaaa

SEQ ID NO: 202040 - RNA, 64 nt, Human
ggcagagguugcagugagccgagagugcaccauugcacuccagccugggcaaaaagagcaaaac

SEQ ID NO: 202041 - RNA, 64 nt, Human
ggcggagcuugcagugagccgagaucccgccacugcacuccagccugggcgacagagcgagacu

SEQ ID NO: 202042 - RNA, 64 nt, Human
ggcggagcuugcagugagccuugaucacgccacugcacuccagccugggugacagagcaagacu

SEQ ID NO: 202043 - RNA, 64 nt, Human
ggcggagguugcagugaggcgagauugugccacugcacuccagcuugggcgacagagugagacu

SEQ ID NO: 202044 - RNA, 64 nt, Human
ggcagaaguugcagugagccgagaucgcaccacugcacuccagccuaggagacaaaacgagacu

SEQ ID NO: 202045 - RNA, 64 nt, Human
ggcggagcuugcagugagccgagauugugccacugcacuccagccugggugacacagcaagacu

SEQ ID NO: 202046 - RNA, 64 nt, Human
ggcagaggcugcagugacccaagauugugccacugcacuccacccugggcaacagagcaagacc

SEQ ID NO: 202047 - RNA, 64 nt, Human
agccccuccucccugcccucgggucuccccaccugcacuccauccagcuacaggagagauagaa

SEQ ID NO: 202048 - RNA, 64 nt, Human
ggcagagguugcagugagccgagauugcgccacugcacuccagccuggguaacagagcaagacu

SEQ ID NO: 202049 - RNA, 64 nt, Human
gagucuccccccggggagaggacacuggccccucgcacuccagaaaagccaugccagcugggcu

SEQ ID NO: 202050 - RNA, 64 nt, Human
ggcagagcuugcagugagcugagauugcgccacugcacuccagccugggcaacagagcgagacu

SEQ ID NO: 202051 - RNA, 64 nt, Human
ggcggagcuugcagggagccgagauagugucacugcacuccagccugggugacagagcgagacu

SEQ ID NO: 202052 - RNA, 64 nt, Human
agguggagguugcgugagcuaagaucgcgccacugcacuccagccugggcgacaagagugaaac

SEQ ID NO: 202053 - RNA, 64 nt, Human
cucggacgcugcagugagcugagaucgcaccacugcacuccagccugggugccagagcaagacu

SEQ ID NO: 202054 - RNA, 64 nt, Human
auucaagucuggagugagcuaugacugugccacugcacuccagccugggcgacagagcaaaccc

SEQ ID NO: 202055 - RNA, 64 nt, Human
ggcagagguuucagugagcccagaucgcgacacugcacuccagccugggcaacagagugacacu

SEQ ID NO: 202056 - RNA, 64 nt, Human
ggcagagcuugcagugagcugagaucacgccauugcacuccagccugggcaacaguguuaagac

SEQ ID NO: 202057 - RNA, 64 nt, Human
gguagaaguugcagugagccaaaaucacgccacugcacuccagccugggcaacagagugagacu

SEQ ID NO: 202058 - RNA, 64 nt, Human
ggcggagguugcagugagucaagaucgcgccacugcacuccagccugggugacagagcaagacu

SEQ ID NO: 202059 - RNA, 64 nt, Human
ggcgaagguugcagugagccgagauugcgccacugcacuccagccugggugacagagcgacacu

SEQ ID NO: 202060 - RNA, 64 nt, Human
auuugagguuguaguaagcuacgaucaugccacugcacuccacucugggcaacagaaugagauc

SEQ ID NO: 202061 - RNA, 64 nt, Human
cagcuauccacagggagacugggauguucacgcagcacuccauuacucaguaccuccauaccca

SEQ ID NO: 202062 - RNA, 64 nt, Human
agcagagguugcagugagccucgauuguaccacugcacuccagccugggcgacagagcaagacu

SEQ ID NO: 202063 - RNA, 64 nt, Human
ggcggagcuugcagugagucgagaucgcgccacugcacuccagccugggcgacagagcgaaacu

SEQ ID NO: 202064 - RNA, 64 nt, Human
ggcggaguuugcagugagccgagaucacgccauugcacuccagccugggcgacagagcgagacu

SEQ ID NO: 202065 - RNA, 64 nt, Human
ggcggagguuacagugagccgagaucacaucacugcacuccagccugggcgacagagcgagacu

SEQ ID NO: 202066 - RNA, 64 nt, Human
gguggagguuacagugagcagagaucacaccacugcacuccagccuggguggcagagcaacacu

SEQ ID NO: 202067 - RNA, 64 nt, Human
gguggagguugcagugagcugagaucgugcuauugcacuccagccugggcgacagagcaagacg

SEQ ID NO: 202068 - RNA, 64 nt, Human
ugcaugauaauuuaaaauggaagauuuaaacuuugcacuccaaaagcuuauuuggauuuuuuuc

SEQ ID NO: 202069 - RNA, 64 nt, Human
aaagucugcagaagagcucuucaguuguuggugugcacuccaagucaggauggacaauguguuu

SEQ ID NO: 202070 - RNA, 64 nt, Human
auuugaagcugcagugagcuguguucuugccacugcacuccaaucugggugacugagcaagacc

SEQ ID NO: 202071 - RNA, 64 nt, Human
ggcagagguugcagugagccgagaucacgccacugcacuccagccuggcuacagggcgagacuc

SEQ ID NO: 202072 - RNA, 64 nt, Human
gagggagguugcagugaggcgagaucaugccacugcacuccagccuggcugacagagcaagacu

SEQ ID NO: 202073 - RNA, 64 nt, Human
guuucaacgaaucacagcaaggcuuuugugccuugcacuccaugcauucugauaacggcagcuu

SEQ ID NO: 202074 - RNA, 64 nt, Human
guugagaaugcagugagcuuguaauugcaccacugcacuccagccugggugacagagcaagacc

SEQ ID NO: 202075 - RNA, 64 nt, Human
aguggagguugcagugagcugagaucacaccacugcacuccagccugggagagacagagugaga

SEQ ID NO: 202076 - RNA, 64 nt, Human
cccagcaccuggaggggcaccagguggaggguuugcacuccacacaucuuucuugaaugaauga

SEQ ID NO: 202077 - RNA, 64 nt, Human
aguugaggcugcagugaacuaugauuuuaccacugcacuccagcuugggcaacaaaaugagacc

SEQ ID NO: 202078 - RNA, 64 nt, Human
augguggcugcaguaagccaagaucacaccacuggcacuccagccugggcaacagagugagacc

SEQ ID NO: 202079 - RNA, 64 nt, Human
ggcagaggucauggugagccgagaucacgccacugcacuccagccugggcaacagagcgagacu

SEQ ID NO: 202080 - RNA, 64 nt, Human
ggcggagguugcagugagccgagaucaugccauugcacuccagccugggcgacagagugagacu

SEQ ID NO: 202081 - RNA, 64 nt, Human
ggcagagguugcagugagcugagaucgugccacugcacuccagccugagugacaggaguuaagc

SEQ ID NO: 202082 - RNA, 64 nt, Human
cuuucugagccugcgugggagaaccccaauucuagcacuccaggaaacugugggagaguguggg

SEQ ID NO: 202083 - RNA, 64 nt, Human
uguggaaaagcaaggauuucccuggccccgcccugcacuccagcucgccccuuucccgcgcgaa

SEQ ID NO: 202084 - RNA, 64 nt, Human
gccugagguugcagugagccgagcuugcacuacugcacuccagccugggugacagaguaagacu

SEQ ID NO: 202085 - RNA, 64 nt, Human
gguggagguugcggugagcugagaucgugccacugcacuccagccugggcaacaagagcaaaaa

SEQ ID NO: 202086 - RNA, 64 nt, Human
agcagagguugcagugagcugagaucacaccaccgcacuccagccugggugacagagugagacu

SEQ ID NO: 202087 - RNA, 64 nt, Human
ggcggagguugcagugagccaagaucgcaccacugcacuccagccuggcaacagagcgagacuc

SEQ ID NO: 202088 - RNA, 64 nt, Human
gauggagguugcagugagcagagaucgcaccacugcacuccagccugggcaagagugagacugu

SEQ ID NO: 202089 - RNA, 64 nt, Human
cuaauuaacuacugugucuucugugucacaaacagcacuccaggccagcucaagaagcaaagca

SEQ ID NO: 202090 - RNA, 64 nt, Human
gagggagguugcagugagccgugauugcaccacugcacuccagccugggcaacagagcaagacc

SEQ ID NO: 202091 - RNA, 64 nt, Human
gguggagguugcagugagccgagaucauaccauugcacuccagcccaggcaacaagagugaaac

SEQ ID NO: 202092 - RNA, 64 nt, Human
aauugcuugaggcuagugagcugugacucccacugcacuccagcucggggaacagagcgagacc

SEQ ID NO: 202093 - RNA, 64 nt, Human
guggagguugcaguugagccaagaucacgacacugcacuccagccugggcaacggagacucugu

SEQ ID NO: 202094 - RNA, 64 nt, Human
ggucgaggcugcagugagccaagauugugccacugcacuccagccugggugacagagcaggacc

SEQ ID NO: 202095 - RNA, 64 nt, Human
gaacaugaguuuaugggaaugccuuuucccucuggcacuccagaacaaaccucuauauguugcu

SEQ ID NO: 202096 - RNA, 64 nt, Human
auguagcuaagcugcuucagugaucuucacauuugcacuccaguuuuuuuuucuuuaaaaaagc

SEQ ID NO: 202097 - RNA, 64 nt, Human
ggcagaggcuguggugagccaagaugacacaacugcacuccagcuugggcaacagggcgagacc

SEQ ID NO: 202098 - RNA, 64 nt, Human
gcagaggguugcagugagccgagauagcaccauugcacuccagccugggcgacuccaucucaaa

SEQ ID NO: 202099 - RNA, 64 nt, Human
ggcagagguugcagugagccgagauugugccccugcacuccagccugagcgacagugagacucu

SEQ ID NO: 202100 - RNA, 64 nt, Human
cguggaguggggacggaagaugagcgcgggaaaggcacuccaaccucacucuucccgucugucu

SEQ ID NO: 202101 - RNA, 64 nt, Human
ggcggagguugcagugaaccaagauugcaccacugcacuccagccggggugacagagugagacu

SEQ ID NO: 202102 - RNA, 64 nt, Human
gguggagguugcagugagcuaaaauugugccacugcacuccagccugggugacagaggaagacu

SEQ ID NO: 202103 - RNA, 64 nt, Human
gacggugguugcagugagcgaagaucgagccacugcacuccagccugggcagcugaacaagacu

SEQ ID NO: 202104 - RNA, 64 nt, Human
agugccugagaagacagucccuuuucuacccaccgcacuccauaaccuccaucuucucccacac

SEQ ID NO: 202105 - RNA, 64 nt, Human
ccuugauaauagucuuauucccaccacauacuaggcacuccauaaauaucuguugaaccuucau

SEQ ID NO: 202106 - RNA, 64 nt, Human
gguggagguuguagugagccgagauugcgccauugcacuccagcucaggcaacaagagcaaaac

SEQ ID NO: 202107 - RNA, 64 nt, Human
aggucuugggcacagaccugcauuuguugaccuugcacuccaacuauagugccuugcaagugcu

SEQ ID NO: 202108 - RNA, 64 nt, Human
ggcagagguugcagugagccgagauugcaccacugcacuccagccugggugacagagcaagacu

SEQ ID NO: 202109 - RNA, 64 nt, Human
ggcagagcuugcagucagccgagaucacgccacugcacuccagccugggagacagagugagacu

SEQ ID NO: 202110 - RNA, 64 nt, Human
agugaagaaucuggucccugucuuuaaggaguuugcacuccaguagaagacagaaggaacguau

SEQ ID NO: 202111 - RNA, 64 nt, Human
gguggagguugcagugagccaagaucgugccauugcacuccagccuaggcaacaagagugaaac

SEQ ID NO: 202112 - RNA, 64 nt, Human
ucgcuugaggcuagugagcugugauuguaccacugcacuccagcucggggaacagagcgagacc

SEQ ID NO: 202113 - RNA, 64 nt, Human
uccucagccacucaucuuaauccuuaacaagacagcacuccagauaggcagccacgaccccaaa

SEQ ID NO: 202114 - RNA, 64 nt, Human
gguggaggcuacugugagccaugaucaugccacugcacuccagccugggcaacagagugagacc

SEQ ID NO: 202115 - RNA, 64 nt, Human
ggcagagguugcugugagccgagaucgugccacugcacuccagccugagcaacagagcaagacu

SEQ ID NO: 202116 - RNA, 64 nt, Human
ucgggacuucugggcucagaaccagcuggcucacgcacuccacuugucagcuggacuucugccu

SEQ ID NO: 202117 - RNA, 64 nt, Human
ggcggagcuugcagugagcugagauggcgccacugcacuccagccuaggcaacagagcaagacu

SEQ ID NO: 202118 - RNA, 64 nt, Human
gauauuuuuuuucuuugagacagggucuuucucugcacuccagccuaggcaacagagcaagacu

SEQ ID NO: 202119 - RNA, 64 nt, Human
ggcagagguuguggugagccaacaucacaccauugcacuccagccugggcaacaagaguaaaac

SEQ ID NO: 202120 - RNA, 64 nt, Human
ggcagagguugcagugaguggagguuguaccacugcacuccagccuggcugacagugagacacu

SEQ ID NO: 202121 - RNA, 64 nt, Human
ggcagagguugcagugagccaaggucauaccagugcacuccaggcgggugacagagcaagacug

SEQ ID NO: 202122 - RNA, 64 nt, Human
ggcagaaguugcagugagcugagauugugccacugcacuccagccugggcgacagagcgagacu

SEQ ID NO: 202123 - RNA, 64 nt, Human
aauauucuggcaauuuaauauacccccuacaaaagcacuccacagcuuuuacacuauuuugacu

SEQ ID NO: 202124 - RNA, 64 nt, Human
ccgcucuggcuucuguggcggcagugguggguaagcacuccaguguucucuuaaugaggcacuu

SEQ ID NO: 202125 - RNA, 64 nt, Human
ggcggagguugcggugagucgagaucacgccauugcacuccagccugugcgacaagagcgaaac

SEQ ID NO: 202126 - RNA, 64 nt, Human
auuggaggcugcagugagccaugaguaugccacugcacuccagccugggggacagagcaagacc

SEQ ID NO: 202127 - RNA, 64 nt, Human
gguggagguugccgugagccaagaucacgccacugcacuccagccugggcaacagagcaagacu

SEQ ID NO: 202128 - RNA, 64 nt, Human
ggcagagguugcagugagcugagaucaugccauugcacuccaaccugggugacagagugagacu

SEQ ID NO: 202129 - RNA, 64 nt, Human
ggcagagguugcagugagcugagaucgcaccacugcacuccagccugggcgacagagugagacu

SEQ ID NO: 202130 - RNA, 64 nt, Human
ggcggagguugcagugagccaggaucgcgccauugcacuccagccugggcaacaagagcgaaac

SEQ ID NO: 202131 - RNA, 64 nt, Human
guccugccccgacccaccccaucccuuuucucuggcacuccagucccaggccuugggccugaac

SEQ ID NO: 202132 - RNA, 64 nt, Human
acagagguugcagugagcugagaucguaccuauugcacuccauccuggaugaaagagccagacu

SEQ ID NO: 202133 - RNA, 64 nt, Human
gguggagguugcagugagcugaggucgcaccacugcacuccagccuggacaacagagcaagacu

SEQ ID NO: 202134 - RNA, 64 nt, Human
ggucgaggcugcagugagcugugacugugccacugcacuccagcuugagcaacacagugauacu

SEQ ID NO: 202135 - RNA, 64 nt, Human
cuucgaggcugcagugagcuaugauuacgacacugcacuccagccuaggcgacagagcaagacc

SEQ ID NO: 202136 - RNA, 64 nt, Human
gguuggggcugcagugagccaugaucacaccacugcacuccagccaggugacauagcgagaucc

SEQ ID NO: 202137 - RNA, 64 nt, Human
gagcaaaauugcuugcaaaaguggcacagaguuagcacuccauaccccuucaaacauguugcuu

SEQ ID NO: 202138 - RNA, 64 nt, Human
gccgcugccuguucccacgugucaccagcacgcugcacuccagaugaaauccuccuaggacagg

SEQ ID NO: 202139 - RNA, 64 nt, Human
ggcggagguugcagugugccaagaucauaccacugcacuccagcccuggugacagaggagaccc

SEQ ID NO: 202140 - RNA, 64 nt, Human
aggaagcaagcggagguugcagugaguugagaucgcacuccagccugggugacagagugagauu

SEQ ID NO: 202141 - RNA, 64 nt, Human
auugauaaucuuaaauuauugauuauuccuuaacgcacuccauucuccuuuuacauuuuaucau

SEQ ID NO: 202142 - RNA, 64 nt, Human
guucagggcugcagugagguacgaucaagccacugcacuccagccugggcgacagagcaagauc

SEQ ID NO: 202143 - RNA, 64 nt, Human
ucaaggcugcagugaaucaugaucgugcgcuacugcacuccagccugggccacagagcaagacu

SEQ ID NO: 202144 - RNA, 64 nt, Human
gauuaugauuuccucuccuauaauuauuucuguagcacuccacacugaucuuuggaaacuugcc

SEQ ID NO: 202145 - RNA, 64 nt, Human
uuggcccuaucaaaaacgaugaggaaaaaagauugcacuccaggauuaggaggugugagauauu

SEQ ID NO: 202146 - RNA, 64 nt, Human
gacggagguugcagugagccaagaucgugccacugcacuccagccuggugacagagugagacuc

SEQ ID NO: 202147 - RNA, 64 nt, Human
ggugccuuuggagguuaaggcuagguuaggcccugcacuccaccuggggacggccccucaucac

SEQ ID NO: 202148 - RNA, 64 nt, Human
agcagagguugcaguaagcugagaucccaccauugcacuccagccugggcaacagagugagacu

SEQ ID NO: 202149 - RNA, 64 nt, Human
agguggaguugcagugagccgagaucaugcgacugcacuccagccugggugacagagccagacu

SEQ ID NO: 202150 - RNA, 64 nt, Human
aagacaugaggcugcaccgcuuaccuggccacuggcacuccagggagcucugguagccuggccu

SEQ ID NO: 202151 - RNA, 64 nt, Human
ggcagagguuguagugaggcaagauugcgccacugcacuccagucugggugacagaugaagacu

SEQ ID NO: 202152 - RNA, 64 nt, Human
ggcagagggugcagugagccgagaucgugccauugcacuccagccugggcgacauucugucuca

SEQ ID NO: 202153 - RNA, 64 nt, Human
gucuugucauggggagucgggcauauucuuggcagcacuccacucaccuucagcuccugcaccg

SEQ ID NO: 202154 - RNA, 64 nt, Human
ugaggaaaggaaggcuguaaaggacaugguaauggcacuccauucgggauguauuaaaauaauu

SEQ ID NO: 202155 - RNA, 64 nt, Human
gauuaaacuugaacuacuuauccuauucuuuaaggcacuccauugccuggccccaauuuacuaa

SEQ ID NO: 202156 - RNA, 64 nt, Human
ugugccaugaugauugcaccugcgaauagccacugcacuccagccugggcaauauagcaagacc

SEQ ID NO: 202157 - RNA, 64 nt, Human
ggucaaggcuucagugagccaugaucaugccacugcacuccagucuggaugacagagagagacc

SEQ ID NO: 202158 - RNA, 64 nt, Human
ggcagagucugcagugagccgagauugcaccacugcacuccagccuggagagcagagcaagacu

SEQ ID NO: 202159 - RNA, 64 nt, Human
gguggagguugcagugagcugagauugugccacugcacuccagccugggugacagagugagacu

SEQ ID NO: 202160 - RNA, 64 nt, Human
ggcggagcuugcagugagccgagaucgcgccacugcacuccagccugggugacagagcgagacu

SEQ ID NO: 202161 - RNA, 64 nt, Human
ggcagagguugcagugagccgagauugugccacugcacuccagccuaggcgacagagugagacu

SEQ ID NO: 202162 - RNA, 64 nt, Human
ggcagagguugcaguaagccaagaucacaccacugcacuccagccugggugauagagugagaca

SEQ ID NO: 202163 - RNA, 64 nt, Human
gacacgugcuuugaacugcuuuucuauucauggagcacuccauagucucaaacugucccccuua

SEQ ID NO: 202164 - RNA, 64 nt, Human
ucuagcaagaagugccaagauuggcuuggcaucugcacuccagcccaggacuguggucugccau

SEQ ID NO: 202165 - RNA, 64 nt, Human
ugcccuggcugaugaccacuaguggggagccguggcacuccauacccucgaagauguuguacuc

SEQ ID NO: 202166 - RNA, 64 nt, Human
uagucaugcguacaugugugccuuggggugcucugcacuccacggcccuucucagccacacuuc

SEQ ID NO: 202167 - RNA, 64 nt, Human
ggucaaggguacagugagccgaggucaugccacugcacuccagccuggccugggcaacagagca

SEQ ID NO: 202168 - RNA, 64 nt, Human
gguggaggcugcggugagccaagaucaugccauugcacuccagccugggugacagaguaacacu

SEQ ID NO: 202169 - RNA, 64 nt, Human
ggcggagguugcagugagccuagaucaugccacugcacuccaaccugggcagcagagcaagacu

SEQ ID NO: 202170 - RNA, 64 nt, Human
cuuucauucuucaacagugccuugcauguaacaagcacuccagaaauguuuguugaaugaauga

SEQ ID NO: 202171 - RNA, 64 nt, Human
gggagagguugcagugagccaagaucguaccacugcacuccagccugggugacagagugagacu

SEQ ID NO: 202172 - RNA, 64 nt, Human
gacggaaguugcagugagcugagaucacaccacugcacuccagccuggugacagagcaagacuc

SEQ ID NO: 202173 - RNA, 64 nt, Human
ugggaaggucacuugagcccaggaccccaccacugcacuccagccuggaugacagagugagacc

SEQ ID NO: 202174 - RNA, 64 nt, Human
gcuccacuauguguugcuaaaacacaugcuaugagcacuccaggaaacacuauauuuuuuccaa

SEQ ID NO: 202175 - RNA, 64 nt, Human
ggcggagcuugcagugaguggaaauugcgccacugcacuccagccugggcaacaaagugagacu

SEQ ID NO: 202176 - RNA, 64 nt, Human
ggcagagguuccagugagccaagaucgcaccacugcacuccagccugggcaacaaagagcgaaa

SEQ ID NO: 202177 - RNA, 64 nt, Human
ggcggagguugcagugagcugagaucgcacuacugcacuccagccugggcgacagagcaagacc

SEQ ID NO: 202178 - RNA, 64 nt, Human
gacuuacuuacuccuucagugacuccgagcugcagcacuccaaggcugucagggcuucuguuug

SEQ ID NO: 202179 - RNA, 64 nt, Human
ugcauuugcuaacucauggaacugcagacagaaagcacuccaugcgaaaacagccauugccuuu

SEQ ID NO: 202180 - RNA, 64 nt, Human
guucaaggcuacagagagccaugauuaaaccaaggcacuccagccugggugacagagugagacu

SEQ ID NO: 202181 - RNA, 64 nt, Human
ugaggcuguggugauuugugauugcgccaccacugcacuccagccugggcaacagagugagacc

SEQ ID NO: 202182 - RNA, 64 nt, Human
gguggagguugcaaugagccgagguugagccaucgcacuccagcggugaaacaagagugaaacu

SEQ ID NO: 202183 - RNA, 64 nt, Human
gguggaggcugcggugagccgagauugcgccauugcacuccagccugggcaacgagugaaacuc

SEQ ID NO: 202184 - RNA, 64 nt, Human
uacuuuccaucuauuccuuuguuuuuccuuugaugcacuccagcuuuuguauagguuucuguuu

SEQ ID NO: 202185 - RNA, 64 nt, Human
ggucaaggcugcagugagcuuugaucacaccacugcacuccagccugggcaacagagcaagacc

SEQ ID NO: 202186 - RNA, 64 nt, Human
gcagagguugcagugagcugagaucgcgcaaauugcacuccagccucggugacaagagcgagac

SEQ ID NO: 202187 - RNA, 64 nt, Human
aguccagaacguagugagccuugauuauaccacugcacuccagccugggugacagagcgagacu

SEQ ID NO: 202188 - RNA, 64 nt, Human
agucagucacuggguuuccauuucugaauuuuaugcacuccaaccaugaauuuaaacuaaauuu

SEQ ID NO: 202189 - RNA, 64 nt, Human; identical to SEQ ID NO: 202041

SEQ ID NO: 202190 - RNA, 64 nt, Human
ggcagagucugcagugagccgagaucaugccacugcacuccagccugggugacagagccagacu

SEQ ID NO: 202191 - RNA, 64 nt, Human
ggcagagguugcagugagccgagauugcaccacugcacuccagcuugggugauaaaauaaaaua

SEQ ID NO: 202192 - RNA, 64 nt, Human
ggcggagguugcaaugagccgagaucacgucacugcacuccagcuugggcaacagagcaagacu

SEQ ID NO: 202193 - RNA, 64 nt, Human
gguggaaguugcagugagccgagaucgcaccacugcacuccagccugggugacaagagcgaaac

SEQ ID NO: 202194 - RNA, 64 nt, Human
gguggagguugcagugagccgagaucacgccacugcacuccagccuggcgacagagcgagacuc

SEQ ID NO: 202195 - RNA, 64 nt, Human
ggcggagguuccagugagccgagauggcgcuauugcacuccagucuggguaacagggagacugc

SEQ ID NO: 202196 - RNA, 64 nt, Human
gguugaggcugcagugagcugugauuaugccauugcacuccagccugggugacagagcaauacc

SEQ ID NO: 202197 - RNA, 64 nt, Human
gaggcagaagaaucugagccaagauaacaccauugcacuccagccugggcgacagagugagacu

SEQ ID NO: 202198 - RNA, 64 nt, Human
ggcggagguuguggugagccgagaucgcaccacugcacuccagccugggcgacagagcgagacu

SEQ ID NO: 202199 - RNA, 64 nt, Human
ggcggaaguugcggugagccaagauugugccauugcacuccagccugggcaacgagcgaaacua

SEQ ID NO: 202200 - RNA, 64 nt, Human
gguggagcuugcagugagccaagaucguaccacugcacuccagucugggcgacagagugagacu

SEQ ID NO: 202201 - RNA, 64 nt, Human
aaguaugcugugaucaugccugugaauaaccacugcacuccagccagggcaacauaacaagacu

SEQ ID NO: 202202 - RNA, 64 nt, Human
ggcagagguugcagugagccgagaucgugccacugcacuccagccugggcgacagagcaagacu

SEQ ID NO: 202203 - RNA, 64 nt, Human
aaaggaaagaaucaaauuucuugcccggucacuggcacuccagaagacagcgugccggaaccgg

SEQ ID NO: 202204 - RNA, 64 nt, Human
ggcagagguuguagugagccgagaucgcgccaucgcacuccagccugggugacaagagcaaaac

SEQ ID NO: 202205 - RNA, 64 nt, Human
ggcggagguuguggugagcugagaugacgccauugcacuccagccuaggcaauaagagcaaaac

SEQ ID NO: 202206 - RNA, 64 nt, Human
uuuuuuuuuuuuuuucuugagauggagucucucugcacuccagccugggugacagagcaagacu

SEQ ID NO: 202207 - RNA, 64 nt, Human
ggcagaguuugcagugagccgagauggcgccacugcacuccagccugggggacagagcgagacu

SEQ ID NO: 202208 - RNA, 64 nt, Human; identical to SEQ ID NO: 202190

SEQ ID NO: 202209 - RNA, 64 nt, Human
aggcuucucccugucggugaaggaucauguucaggcacuccaagugaaccaccccucuugguuc

SEQ ID NO: 202210 - RNA, 64 nt, Human
guucaaggcugcagugagucgugauugugccacugcacuccagccggggugacagaagagaccu

SEQ ID NO: 202211 - RNA, 64 nt, Human
gguggagcuugcagugagcggacaucgcgccacugcacuccagccugggcgacagagcaagacu

SEQ ID NO: 202212 - RNA, 64 nt, Human
acugccucuacugggcgugcugccaaggccaugugcacuccauccucauguauccuuuuucacg

SEQ ID NO: 202213 - RNA, 64 nt, Human
ggcggagcuugcagugagccaagaucgcgccacugcacuccagcccgggugacagagcaagacu

SEQ ID NO: 202214 - RNA, 64 nt, Human
gguggagguugcaguuagcugagauccugccacugcacuccagccugggcaacagagugagacu

SEQ ID NO: 202215 - RNA, 64 nt, Human
auucaaagcugcagugagcuguaauugcaucacugcacuccaaccugggcaacagaguaagacc

SEQ ID NO: 202216 - RNA, 64 nt, Human
gguggagguuacagugagcugagagugccccacugcacuccagccugggugacagagcgagacu

SEQ ID NO: 202217 - RNA, 64 nt, Human
ggcggagcuugcagugagcagagaucacgccacugcacuccagccuggaugacagagcgagacu

SEQ ID NO: 202218 - RNA, 64 nt, Human
ggcagagcuugcagugagccgagaucacgccacugcacuccagccugggagacagagcgagacu

SEQ ID NO: 202219 - RNA, 64 nt, Human
ucccauacaaacucagaaugcuauauuuuuaacagcacuccagcauuuuucuucauguaucacc

SEQ ID NO: 202220 - RNA, 64 nt, Human
uaccucacagguuuucauucuuuugaacucuggugcacuccaucuguaauccaugucuauaauc

SEQ ID NO: 202221 - RNA, 64 nt, Human
ggcggagguugcagugaguugcagucacaccccugcacuccagccugggugacagcuagacccu

SEQ ID NO: 202222 - RNA, 64 nt, Human
ccugcagaacgagcccugccuuggcuguggagaagcacuccaggccgcuagcagaugggacugg

SEQ ID NO: 202223 - RNA, 64 nt, Human
ggcagagguugcagugcaccaagacugcgccauugcacuccagcccgggcaacaagagcgaaac

SEQ ID NO: 202224 - RNA, 64 nt, Human
ugucccucggguuuggggcucuucucagagagcagcacuccauaucccuuacugucaccuucac

SEQ ID NO: 202225 - RNA, 64 nt, Human
ggcagagauugcagugagccaagauugcaccagugcacuccagcugggcgacagagcgagacuc

SEQ ID NO: 202226 - RNA, 64 nt, Human
ggcagagguuggagugagcugagaucgcgccaccgcacuccagccugggcaacagagcgagacu

SEQ ID NO: 202227 - RNA, 64 nt, Human
agugcccucucauuagaucuguguuaauuaguuagcacuccacugcacaugcuaaugacuuccu

SEQ ID NO: 202228 - RNA, 64 nt, Human
aagaauuauucaauuucaugaauaacucuuguuugcacuccagaaaacaacauacauguuuaaa

SEQ ID NO: 202229 - RNA, 64 nt, Human
guggagauugcaauugagcuaggaucaggccacugcacuccagccuggguaacagacgcugucu

SEQ ID NO: 202230 - RNA, 64 nt, Human
agguugcagugagccgagaucaugccacugcacugcacuccagccugggugacaaagcaagacu

SEQ ID NO: 202231 - RNA, 64 nt, Human
aguggagguugcagugagcugagaucaugccacugcacuccagccugggcgacagagcgagacu

SEQ ID NO: 202232 - RNA, 64 nt, Human
gguggaaguuguagugaacugagaucgcaccacugcacuccagccuggcaacagagcuagaauc

SEQ ID NO: 202233 - RNA, 64 nt, Human
ggcggacguugcagugagccaagauugcaccauugcacuccagacugggugacaagagugaaac

SEQ ID NO: 202234 - RNA, 64 nt, Human
guuugagguugcagugagcugugaucacaccacugcacuccagccugggugacagagugagacu

SEQ ID NO: 202235 - RNA, 64 nt, Human
uugcagugagucaagaugcugagaugccaccacugcacuccagccugggcaacagagcgagaac

SEQ ID NO: 202236 - RNA, 64 nt, Human
gacggaggcggcagugagccaagauugugccacugcacuccagccugggcgacagagugaaacu

SEQ ID NO: 202237 - RNA, 64 nt, Human
ggcggagguugcaaugagccgagaucgcgcuacugcacuccagccugggcaacagagagagacc

SEQ ID NO: 202238 - RNA, 64 nt, Human
ggcagagguugcagugagccgagaucgugccauugcacuccagccugggugacaaagcgagacu

SEQ ID NO: 202239 - RNA, 64 nt, Human
ggcggagguugcggugagcugagauggcaccacugcacuccagcuugggugacagagugagacu

SEQ ID NO: 202240 - RNA, 64 nt, Human
ggcagagguugcagugagccgagaucgcgccacugcacuccaaccugggugacagacucugucu

SEQ ID NO: 202241 - RNA, 64 nt, Human
agaugcuccagaaugaaagccuucucagaccugcgcacuccaucucccucccuuuucuucucuc

SEQ ID NO: 202242 - RNA, 64 nt, Human
guucaaggcugcagugagccaagauugcgccacugcacuccagccuaggugacagagugagacc

SEQ ID NO: 202243 - RNA, 64 nt, Human
gguggaggcugcagugagacgagaucgcgccacugcacuccagccuggcgacagagcgagacgc

SEQ ID NO: 202244 - RNA, 64 nt, Human
ggggccccuccccucccgaacacugagaaauagugcacuccaagaaacguggaucucccccuca

SEQ ID NO: 202245 - RNA, 64 nt, Human
gguggagguugcagugggccaagaucgcaccacugcacuccagccugggugacagagcgagacu

SEQ ID NO: 202246 - RNA, 64 nt, Human
ggcggagguugcagugagcggagauuguaccauggcacuccagccuggacaacaagagcgaaau

SEQ ID NO: 202247 - RNA, 64 nt, Human
gguggaaguugcagugaaccaagaucacgccacugcacuccagccugggcgauggagcgagacu

SEQ ID NO: 202248 - RNA, 64 nt, Human
ugaccuguccccaguguuuccagguaaugacuuggcacuccagagaaaguuucaugcuguugcg

SEQ ID NO: 202249 - RNA, 64 nt, Human
gguugagguugcagugagcacagaucacaccacugcacuccagccugggcaacagagugagacc

SEQ ID NO: 202250 - RNA, 64 nt, Human
ggcagagguugcagugagccaagaucacgccauugcacuccagccugggggacagagcaagacu

SEQ ID NO: 202251 - RNA, 64 nt, Human
gguggagguugcggugagcugagauugcacuauugcacuccagccugggcaacaggaguaaaac

SEQ ID NO: 202252 - RNA, 64 nt, Human
gcuuuucauguaaucaugauaauuuacucagguagcacuccagucacaaacaaugucacagaga

SEQ ID NO: 202253 - RNA, 64 nt, Human
gcuuuuucucgcgugccuggaaccugacgcacgcgcacuccaguuuuuuuaugaccuacgauuu

SEQ ID NO: 202254 - RNA, 64 nt, Human
gaaucggagguugcagagccaagaucgccccacugcacuccagccuggcaauagaccgagacuc

SEQ ID NO: 202255 - RNA, 64 nt, Human
auuucuaucauugaagggaaaaugugagcauuaagcacuccaggcuuucauaugcccaugucuu

SEQ ID NO: 202256 - RNA, 64 nt, Human
ccucaggguugggcucagggcuugcggccugcaggcacuccagccagcgcucaccuggccuuuc

SEQ ID NO: 202257 - RNA, 64 nt, Human
cgagaaguguuuagacaaacuccccuuaagaugugcacuccaucuuuaagaacguguuagccuu

SEQ ID NO: 202258 - RNA, 64 nt, Human
guucaagucugcagugagcuaugauugcaccacugcacuccagccugggugauagagcaagacc

SEQ ID NO: 202259 - RNA, 64 nt, Human
agagaccccacuccccugcugagaucgcgccacugcacuccagccugggcgacagagcaagacu

SEQ ID NO: 202260 - RNA, 64 nt, Human
ggcggagguugccgugagccaagaucgcaccacugcacuccagccugggcgacaaagugagacu

SEQ ID NO: 202261 - RNA, 64 nt, Human
gcuaaucuuugauucuauguuuuugauccuccuggcacuccagaccugggugaugugcaggaga

SEQ ID NO: 202262 - RNA, 64 nt, Human
ggcggagguugcagugagcagagaucgugccacugcacuccagccuggguggacagagcaagac

SEQ ID NO: 202263 - RNA, 64 nt, Human
gguggagauugcaguaagccgagaucgugccacugcacuccagccugggugauagagcaagacu

SEQ ID NO: 202264 - RNA, 64 nt, Human
ggcggagguugcagugagccgagauugcaccacugcacuccagccugggcgacagagcaggacu

SEQ ID NO: 202265 - RNA, 64 nt, Human
aggcagagguugcagugagccaagauugcacacugcacuccagccugggugacuagcaaaacuc

SEQ ID NO: 202266 - RNA, 64 nt, Human
ggcagagguugcagugagcugagauagcgccauugcacuccagccugggcaacaagagcaaaac

SEQ ID NO: 202267 - RNA, 64 nt, Human
ggcggagcuugcagugagccgaggucgugccacugcacuccagccugggcgacagagcaagacu

SEQ ID NO: 202268 - RNA, 64 nt, Human
agugagccgagauugugccacugaacuccaaccugcacuccagccugggcaacagagcgagacu

SEQ ID NO: 202269 - RNA, 64 nt, Human
aguggccuggcacauggaccggccugagcgaugugcacuccacccaagccaggcucccaggggg

SEQ ID NO: 202270 - RNA, 64 nt, Human
ggcggauguugcagugagcagagaucgugccauugcacuccagccugggaacaagagugaaacu

SEQ ID NO: 202271 - RNA, 64 nt, Human
ggcagagguugcagugagccaagauugugccacugcacuccagccugagcaacaaaagcaaaac

SEQ ID NO: 202272 - RNA, 64 nt, Human
gaacagugcagcaacaugcuagaaaauccucacugcacuccagcagaggcuagaggaaugccag

SEQ ID NO: 202273 - RNA, 64 nt, Human
ggcagagguugcagugagccaagaucgcgccacugcacuccagccugggcgacagagugagacu

SEQ ID NO: 202274 - RNA, 64 nt, Human
ggcggagguugcagugagccaagauugugccacugcacuccagccugggugacagagcaagacu

SEQ ID NO: 202275 - RNA, 64 nt, Human
gacguagguuguggugagcugagaucgcgccauugcacuccagccugggcaacaagagcaaaac

SEQ ID NO: 202276 - RNA, 64 nt, Human
gguggagguugcagugagccaagaucacaccauugcacuccagccugggcgacagagucuccau

SEQ ID NO: 202277 - RNA, 64 nt, Human
gacagagguuguagugagccaagaucgcaccacugcacuccagccugggucacagagugagacu

SEQ ID NO: 202278 - RNA, 64 nt, Human
aguuugaggcugcaaugagccaugauuucccacugcacuccagccugagugacagagcgagacu

SEQ ID NO: 202279 - RNA, 64 nt, Human
ggcagagguggcagugagcugagaacgcacaacugcacuccagccugggugacgagcaaaacuc

SEQ ID NO: 202280 - RNA, 64 nt, Human
ggcggaaguugcagugagcugagaucaugccacugcacuccagccugggcaacagagcgagacu

SEQ ID NO: 202281 - RNA, 64 nt, Human
ggcggauguugaagugagcugagauugcaccacugcacuccagucugggugagagugagacuca

SEQ ID NO: 202282 - RNA, 64 nt, Human
ggcggagacugcagugagccgagaucgcaccacugcacuccagccuggugacagagcaaaaaaa

SEQ ID NO: 202283 - RNA, 64 nt, Human
gauagaggcugcagugagcugugaucguaccacugcacuccagccugggcgacaaaaugagacc

SEQ ID NO: 202284 - RNA, 64 nt, Human
uguagcguccuccuugagccgagauugugccacugcacuccagccugggcgacaaaucaagacc

SEQ ID NO: 202285 - RNA, 64 nt, Human
caggggauuuuuuuaaaauccugaugcccaacuugcacuccacauuaauuaacaugucuaggag

SEQ ID NO: 202286 - RNA, 64 nt, Human
ucuugaacauuccgacguguaacucacagccgaagcacuccaucccagauuuguugucugggaa

SEQ ID NO: 202287 - RNA, 64 nt, Human
ggcagaggcugcagugagccaugcucacaccacugcacuccagccugggugacagagcaagauc

SEQ ID NO: 202288 - RNA, 64 nt, Human
ggcggagguugcagugagccaagaucgcaccacugcacuccagccugggcaacagagugagacu

SEQ ID NO: 202289 - RNA, 64 nt, Human
uggaggagugaagccaccaucgaggccacacucagcacuccaggaucccagcgaugucagacac

SEQ ID NO: 202290 - RNA, 64 nt, Human
ggcggagguugcagugagcugagaucgcaccacugcacuccagcacuccagccugggugacaga

SEQ ID NO: 202291 - RNA, 64 nt, Human
uugcagugagcugagaucgcaccacugcacuccagcacuccagccugggugacagagcaagacu

SEQ ID NO: 202292 - RNA, 64 nt, Human
ggcagagauugcagugagccgagaucacgccauugcacuccagccugggugacacagugagacu

SEQ ID NO: 202293 - RNA, 64 nt, Human
gguggagguugcagugagccgagaucacgccacugcacuccagccuguugacaaagcaagacuc

SEQ ID NO: 202294 - RNA, 64 nt, Human
ggucaaggcugcagugagccaugaucaugccacugcacuccauccugggugacagcaagaucuu

SEQ ID NO: 202295 - RNA, 64 nt, Human
gcaggagguugcagugagccgaggucgugccauugcacuccagccugggugacagugagacuuu

SEQ ID NO: 202296 - RNA, 64 nt, Human
ggcagagguugcagugagccaagaucgcgccacugcacuccagccucagcaauagagugagacu

SEQ ID NO: 202297 - RNA, 64 nt, Human
gauggagguugcagugagccaagaucaugccacugcacuccagacugggcaacagagggagacu

SEQ ID NO: 202298 - RNA, 64 nt, Human
agcagagguugcaaugagcugagauugcaucacugcacuccagcaugggcaacaaagcaagacu

SEQ ID NO: 202299 - RNA, 64 nt, Human
aggagcuggacugggccuuggcuucccugagcccgcacuccaaccagcagcuggauuccuggga

SEQ ID NO: 202300 - RNA, 64 nt, Human
gguagagguugcagugagccgagaucgagccacugcacuccagccugggugacagggcaagacu

SEQ ID NO: 202301 - RNA, 64 nt, Human
ggcagagguugcagugagcugagaucguaccauggcacuccagccugggcgacagagcaagacu

SEQ ID NO: 202302 - RNA, 64 nt, Human
gguggagguugcagugagcugagauugcaccauugcacuccagccugugcaacaagagugaaac

SEQ ID NO: 202303 - RNA, 64 nt, Human
gguggagguugcagugagcugagaucacaucauugcacuccagccugggcaacgggcgagacuc

SEQ ID NO: 202304 - RNA, 64 nt, Human
gauggaggcugcagcgagccaagaucgugccacugcacuccagccugggcaagaguuuuuuuaa

SEQ ID NO: 202305 - RNA, 64 nt, Human
aauggcguaaacccaggagguggauugcgccacugcacuccagccugggcaacagagugagacu

SEQ ID NO: 202306 - RNA, 64 nt, Human
cgcugauuuuuuuuugcauucuguagucgcauuugcacuccauuuuuacauuaauucgcaguug

SEQ ID NO: 202307 - RNA, 64 nt, Human
agcagagguugcagugagccgagaucgcaccacugcacuccagccugggcagcagagcaaguag

SEQ ID NO: 202308 - RNA, 64 nt, Human
guucgaggcugcagugggcugugaucacaccacugcacuccagccugggcaacagagugagacc

SEQ ID NO: 202309 - RNA, 64 nt, Human
ugcauuuggaaaacacagaaucagcccucagggugcacuccagccaccucagugcucuaagcuc

SEQ ID NO: 202310 - RNA, 64 nt, Human
uuuguuggggaaggguggcauucugcugaccacagcacuccaaccaaaagccaaaaaccaaagc

SEQ ID NO: 202311 - RNA, 64 nt, Human
ggcggagcuugcagugagccgagaucgcaccacugcacuccagccugggcgacagaccgagacu

SEQ ID NO: 202312 - RNA, 64 nt, Human
agcagagcuugcagugagacgagcuugugccacugcacuccagccugggcaacagaguaagacu

SEQ ID NO: 202313 - RNA, 64 nt, Human
ggcgaagguugcagugagccgagauuucaccagugcacuccagccugggugacagagcaagacu

SEQ ID NO: 202314 - RNA, 64 nt, Human
ggcagagggugcaguaagccgagauugcaccacugcacuccagccuaggcgacagagcgagacu

SEQ ID NO: 202315 - RNA, 64 nt, Human
ggcggagauugcagugagccaagaucgcaccgcugcacuccagccugggugacagagcgacccu

SEQ ID NO: 202316 - RNA, 64 nt, Human
cuugagaccuagcuccgaguugaacugugcgucagcacuccagucccaucaccugaaccuucag

SEQ ID NO: 202317 - RNA, 64 nt, Human
gguggagguugcagugagccaagaucgcgccacugcacuccagccuggaugacagagcaaaaaa

SEQ ID NO: 202318 - RNA, 64 nt, Human
ggucgaggcugcagugagccacgaucacaccacugcacuccagccuaggugacagagugagauc

SEQ ID NO: 202319 - RNA, 64 nt, Human
ggcggagguugcagugagccaagauggcgccauugcacuccagccugggugacaagagugaaac

SEQ ID NO: 202320 - RNA, 64 nt, Human
ggcggagguugcagugagccaagauggcgccauugcacuccagccugggcgacaagagcaaaac

SEQ ID NO: 202321 - RNA, 64 nt, Human
ggggagccccaggugaggagagaagcaucugggggcacuccaaaaggggccugugaugucagcc

SEQ ID NO: 202322 - RNA, 64 nt, Human
ggugggaguuguagugagccgagaucaugacacugcacuccagccugggcaacagagcgagacc

SEQ ID NO: 202323 - RNA, 64 nt, Human
ggcggagauugcagugagcugagauugcaccacugcacuccagccuggggacagagcaagacuc

SEQ ID NO: 202324 - RNA, 64 nt, Human
ggcagaguuugcagugagcugagauugugccacugcacuccagucugugugacagaaugagacc

SEQ ID NO: 202325 - RNA, 64 nt, Human
ggcagagguugcggugagcccagaucgcgccauugcacuccagccuggguaacaagagcaaaac

SEQ ID NO: 202326 - RNA, 64 nt, Human
gccugggaggucaaggcugcagugaaccaugauugcacuccaaccugggcgacagagacccugu

SEQ ID NO: 202327 - RNA, 64 nt, Human
gugagccgagaucacaccacuguacuccagcccggcacuccagccuggcgacaagagugagacu

SEQ ID NO: 202328 - RNA, 64 nt, Human
gguggagcuugcaaugagccaagauugcgccacugcacuccagccugggugacagagcaagacu

SEQ ID NO: 202329 - RNA, 64 nt, Human
ccucugcgccacaucucauccaugccuccuccaugcacuccaguccacacuccccguagcauca

SEQ ID NO: 202330 - RNA, 64 nt, Human
gguggagguugcagugggcugagaucacgccauugcacuccagccugggcgacagagugagacu

SEQ ID NO: 202331 - RNA, 64 nt, Human
uucuuccagagagacugcccccuucccuccagcggcacuccaagucccccccauguuggaaaga

SEQ ID NO: 202332 - RNA, 64 nt, Human
gguggaggcugcaaugagcugagaucaugccauugcacuccagccugggcaacgagagugaaac

SEQ ID NO: 202333 - RNA, 64 nt, Human
gguggagguugcagugagcugagauccugccacugcacuccagucugggugacagagcaagacu

SEQ ID NO: 202334 - RNA, 64 nt, Human
gacggagguugcagugagcugagaucgugccacugcacuccagccugggugacagagcaagacu

SEQ ID NO: 202335 - RNA, 64 nt, Human
aguggcaguugcagugagccgagacgacaccacugcacuccagccugggugacagagggagacu

SEQ ID NO: 202336 - RNA, 64 nt, Human
gguggagcuugcagugaaccgagaucgcuccacugcacuccagccugggugacagauccagacu

SEQ ID NO: 202337 - RNA, 64 nt, Human
cagacaucauucaauccaaccagaaucucgcucugcacuccagccugggugacagagggagacu

SEQ ID NO: 202338 - RNA, 64 nt, Human
gguggggguuucagugagcugagaucaugccacugcacuccagccugagugacagagagagauu

SEQ ID NO: 202339 - RNA, 64 nt, Human
uaaugcacuaugauugugcaugugaauagccacugcacuccagccugggcaacauagcaagacu

SEQ ID NO: 202340 - RNA, 64 nt, Human
uggcccugccaucuucccagcagggccacucccggcacuccaugcuuagucacugccugcagag

SEQ ID NO: 202341 - RNA, 64 nt, Human
ggaagagguugcagugagccaagauugcgccccugcacuccagccugggcaacagagcaagacu

SEQ ID NO: 202342 - RNA, 64 nt, Human
uguccagagucuagggcaguccuccacuggcccagcacuccaguuuccuuucccugccucuugu

SEQ ID NO: 202343 - RNA, 64 nt, Human
ggagucagguguuuggagcgaggcagggcaguuggcacuccacuccuauuuggagggacuucau

SEQ ID NO: 202344 - RNA, 64 nt, Human
aggccagcccagacaaaucugagggauggccagugcacuccaaugaugggacaggccuaacaac

SEQ ID NO: 202345 - RNA, 64 nt, Human
ugaaacacagggguaccucaaaaauagaacaagagcacuccauccaugugcggaugacugucaa

SEQ ID NO: 202346 - RNA, 64 nt, Human
guucaagguuacagugagcuaugauagugccacugcacuccagccugggugacagauuuugucu

SEQ ID NO: 202347 - RNA, 64 nt, Human
ggcggagguugcagugagcccagaucacgccacugcacuccagccugagcaacagagcgacucu

SEQ ID NO: 202348 - RNA, 64 nt, Human
gacggagcuugcagugagccgagaucgcgccacugcacuccagccugggcgacagagcgagacu

SEQ ID NO: 202349 - RNA, 64 nt, Human
ggcagagcuugcagugagccgaauaugcgccacugcacuccagccugggcaacagagcaagacu

SEQ ID NO: 202350 - RNA, 64 nt, Human
guucgaggcugcagucagucaugauggcaccacugcacuccagccugggcaacagagcaagauc

SEQ ID NO: 202351 - RNA, 64 nt, Human
gucggaacuuguagugagccaagaucacgccacugcacuccagcuggagugacagagccaaacu

SEQ ID NO: 202352 - RNA, 64 nt, Human
gguggugguugcagugagcugagauugugucauugcacuccagccugggcaacaagagcaaaac

SEQ ID NO: 202353 - RNA, 64 nt, Human
aggugagguugcagugagccgagaucgagccacugcacuccagccugggugacagagcgugaga

SEQ ID NO: 202354 - RNA, 64 nt, Human
ggcagagguugcacugagcugagauuaagccaccgcacuccagccugggcgacagagcaagauu

SEQ ID NO: 202355 - RNA, 64 nt, Human
gagguugcagugagccaagaucacaggagccacugcacuccagccugggugacagagugagacu

SEQ ID NO: 202356 - RNA, 64 nt, Human
gauggagguugcagugagcugagaucaugccacugcacuccagccugggcaacagagcaagacu

SEQ ID NO: 202357 - RNA, 64 nt, Human
ggcagagguugcagugagccgagaucgcaccacugcacuccagcuuggcaauagagugagacuc

SEQ ID NO: 202358 - RNA, 64 nt, Human
ggcggagcuugcagugagcugagauugcgccacugcacuccagccugggcgacggagcgagacu

SEQ ID NO: 202359 - RNA, 64 nt, Human
gaggcgaggaggcccugcaugccuuccugcucgugcacuccaagcugcuggcauucuacucuag

SEQ ID NO: 202360 - RNA, 64 nt, Human
gguggagguugcagugagccaagaucgcuccauugcacuccagccugggugacagugaaacucc

SEQ ID NO: 202361 - RNA, 64 nt, Human
ggaccaguucuuacuuccuuuuauuuuuagcucugcacuccaugugguuucaggguucagucug

SEQ ID NO: 202362 - RNA, 64 nt, Human
ggcggagguugcagugagccaggauugugccauugcacuccagccugggcaacaagaacaaaac

SEQ ID NO: 202363 - RNA, 64 nt, Human
ccaguaaccuggauggggaaaagcauuucccauagcacuccauguaauaugagugcucugugag

SEQ ID NO: 202364 - RNA, 64 nt, Human
gucaaggcugcaggugagccaugaucgugucacugcacuccagccuaggcaacagagcaagacc

SEQ ID NO: 202365 - RNA, 64 nt, Human
cugcagccuggccuccccgcacaggcuguggcuugcacuccagccgcucuagucucucaggaau

SEQ ID NO: 202366 - RNA, 64 nt, Human
caagcugccacacugcccggagcagccuguuccugcacuccacccugcuggccccaggacuucu

SEQ ID NO: 202367 - RNA, 64 nt, Human
gguuacuaguagccgcccauagccugcaaccuuugcacuccacugugcaaugcuggcccugcac

SEQ ID NO: 202368 - RNA, 64 nt, Human
acagaaagugccugcuuuacacucaugaguaaaagcacuccagacauuuuuauaauugcaagau

SEQ ID NO: 202369 - RNA, 64 nt, Human
accugggagguggagguugcgagaucacaccacugcacuccagugugagcaacagaacgagacu

SEQ ID NO: 202370 - RNA, 64 nt, Human
gguggagguuguagugaggcgagauugugccauugcacuccaaccugggcgacagagugagacu

SEQ ID NO: 202371 - RNA, 64 nt, Human
agcggagguugcagugagcugagaucgugcuacugcacuccagccugggggacagaaagagacu

SEQ ID NO: 202372 - RNA, 64 nt, Human
ggcggagguugcagugagccgagaucgcaccagugcacuccagccuuggugacaaugggagacu

SEQ ID NO: 202373 - RNA, 64 nt, Human
ggucaaagcugaggugagccaugauuacuccacugcacuccagccugggcaacagagccaggcc

SEQ ID NO: 202374 - RNA, 64 nt, Human
cagaaaccaccaagacuguugaugccuuagccuugcacuccagggcccuaccugcauuucccac

SEQ ID NO: 202375 - RNA, 64 nt, Human
ggcggagguugcagugagccgagaucgugccacugcacuccagccugggcgacagagcaagacu

SEQ ID NO: 202376 - RNA, 64 nt, Human
ggcagagguugcagugaucaggaauugugccacugcacuccaaccugagugacagagcaacacu

SEQ ID NO: 202377 - RNA, 64 nt, Human
gguggagguuacagugagccgagaucauaccacugcacuccagccuggcgacagagcaagacuc

SEQ ID NO: 202378 - RNA, 64 nt, Human
ggaugugccugcaaaaaguucccugagccuguaagcacuccagguggggaaguggacaggagcc

SEQ ID NO: 202379 - RNA, 64 nt, Human
gguggagauugcagugagucaagaucucaccacugcacuccagccugggcaacagagggagacu

SEQ ID NO: 202380 - RNA, 64 nt, Human
ggcagagguugcagugagccgagaccgcgccacugcacuccagccugggcaacagagcaaaacu

SEQ ID NO: 202381 - RNA, 64 nt, Human
gguggagguugcagugagccaagaucaugccacugcacuccagccugggcgacagagcgagacu

SEQ ID NO: 202382 - RNA, 64 nt, Human
gaagugcuguaaagcaaggagcugcugagaaggagcacuccacugugugccuggagaauggcuc

SEQ ID NO: 202383 - RNA, 64 nt, Human
gcggagcuugcaguggagccaagauugcgccacugcacuccagccugggcaacagagcgggacu

SEQ ID NO: 202384 - RNA, 64 nt, Human
gguggagguugcagugagccgagaucacaccacugcacuccagccugggagacagaacgagacu

SEQ ID NO: 202385 - RNA, 64 nt, Human
ggcggagguugcagucagccaagauagcaccacugcacuccaggcugggugacagagcgagacu

SEQ ID NO: 202386 - RNA, 64 nt, Human
ggucaagccugcagcgagcugagaucacaccacugcacuccagccuggggugauagaacaagac

SEQ ID NO: 202387 - RNA, 64 nt, Human
ggcggaucuugcagugagcggagauugcaccacugcacuccagccugggugacagagcaagacu

SEQ ID NO: 202388 - RNA, 64 nt, Human
cugaccugucucacccagcagccacugcccagccgcacuccaggcaagggccagugcgccugcu

SEQ ID NO: 202389 - RNA, 64 nt, Human
ggcagaaguugcagugagccgagaucacgccacugcacuccagccugggcgacagagcaaggcu

SEQ ID NO: 202390 - RNA, 64 nt, Human
gguggagguugcaguaagccaagaucacgccacugcacuccagccugggugacagagcaaggcu

SEQ ID NO: 202391 - RNA, 64 nt, Human
cuacgcugcuucccucacuccccuucuccuaagagcacuccaucaauaaaccacuugcacgaga

SEQ ID NO: 202392 - RNA, 64 nt, Human
gucuggaguuggagcaaggagaaaauugcacuaggcacuccaugaucugcagagcauguugcuu

SEQ ID NO: 202393 - RNA, 64 nt, Human
ggcagagguugcagugagcugagauuacaccacugcacuccagccugggugacagagugagacu

SEQ ID NO: 202394 - RNA, 64 nt, Human
gguggagcuugcagugagccgagaccgugccacugcacuccagccugggcaacacagcgagacu

SEQ ID NO: 202395 - RNA, 64 nt, Human
gguggagguugcagugagccaagauuaugccauugcacuccagccugggugacaaagcaagacu

SEQ ID NO: 202396 - RNA, 64 nt, Human
cguugagguugcagugagccgagaucacgccacugcacuccagccugggcgacagagagagacu

SEQ ID NO: 202397 - RNA, 64 nt, Human
ggcagaggcugcggugagccgagaucgugucacugcacuccagccugggugacagagacuccau

SEQ ID NO: 202398 - RNA, 64 nt, Human
ggcggagguugcagugagccgagauugcaccacugcacuccagccuggguggcagagugagacu

SEQ ID NO: 202399 - RNA, 64 nt, Human
gguggagguugcagugagccgagaucgcauuacugcacuccagccuggguaacagagugagacu

SEQ ID NO: 202400 - RNA, 64 nt, Human
aauaaggaagacaaaguuuaacaccuucacucaagcacuccacuaauauauuuacguugcauuc

SEQ ID NO: 202401 - RNA, 64 nt, Human
ggcggagguugcagugagccgagauugugccauugcacuccagccugggcgacagugcaagacu

SEQ ID NO: 202402 - RNA, 64 nt, Human
gguagagguugcagugagcugagaucgugccacugcacuccagccugggugacagagugagacu

SEQ ID NO: 202403 - RNA, 64 nt, Human
ggcggagguugcagugagccgagaucacgccacugcacuccagccugggcaacaagagugaaac

SEQ ID NO: 202404 - RNA, 64 nt, Human
ggcggaggcugcagugagcugagauugugccacugcacuccagccugggagacagagcaagacu

SEQ ID NO: 202405 - RNA, 64 nt, Human
cuguggccagggcuggcccccaccgcuguggccggcacuccauuccggaaccuccuggacccuc

SEQ ID NO: 202406 - RNA, 64 nt, Human
ggcggagcuugcaguuagccgagaucaugccacugcacuccagccuacaugacaaugugacacu

SEQ ID NO: 202407 - RNA, 64 nt, Human
ggcggagguugcagugagcugagcucauaccacugcacuccagccugaacagagugagauccug

SEQ ID NO: 202408 - RNA, 64 nt, Human
ggcggcgguugcagugagccgagaucguaccauugcacuccagccugggcaacaagagcgaaac

SEQ ID NO: 202409 - RNA, 64 nt, Human
ggcggagguugcaaugagccaagaucguaccacugcacuccagccugggcgacagagcaagaca

SEQ ID NO: 202410 - RNA, 64 nt, Human
ucagaaaacgggaagcgcucagaacaguaucuuugcacuccaaucauucacggagauaugaaga

SEQ ID NO: 202411 - RNA, 64 nt, Human
gguggagguugcauugagcugagaucgugccacugcacuccaggcugggugacagagcgagacu

SEQ ID NO: 202412 - RNA, 64 nt, Human
ccacggccacgccaggcaaagcgccagcagcccugcacuccacgcuggccaagaaggccuucca

SEQ ID NO: 202413 - RNA, 64 nt, Human
gguugaggcugcagugaacugagaucacgacacugcacuccagccugggcaacaguaaaaccug

SEQ ID NO: 202414 - RNA, 64 nt, Human
cuugccccugugcucaagcuguccaccaucccgggcacuccaaggcucagugcaccccaagccu

SEQ ID NO: 202415 - RNA, 64 nt, Human
ggcggagguugcagugagcuaagaucacgccacugcacuccagccugcggacagaccaagacuu

SEQ ID NO: 202416 - RNA, 64 nt, Human
ugaaugcugcuacuugauuucuuucucaucccacgcacuccaugagcaccccaaggcugcaguu

SEQ ID NO: 202417 - RNA, 64 nt, Human
ugaaugcugcuacuuaauuccuuucucaucccacgcacuccaugagcaccccaaggcugcgguu

SEQ ID NO: 202418 - RNA, 64 nt, Human
gguggagguugcaguaagcugagaucgugccguugcacuccagccugggcgacaagagcaagac

SEQ ID NO: 202419 - RNA, 64 nt, Human
ggcagagguugcagugagccgagauggcgccauugcacuccagccugggugacaaaagcaaaag

SEQ ID NO: 202420 - RNA, 64 nt, Human
gagaaaugagcuugaccuuuaagagaaaugagcugcacuccaugagugcagcucuggagguacg

SEQ ID NO: 202421 - RNA, 64 nt, Human
aacuagaaauuaccuuuauauucuaguauuuucagcacuccauaaauucuauuaccuaaauauu

SEQ ID NO: 202422 - RNA, 64 nt, Human
gauugaggcuacagugagccuugauugugucacugcacuccagcuugggugacagagacccugu

SEQ ID NO: 202423 - RNA, 64 nt, Human
gguggagguugcagugagccgagauugugccacugcacuccaaccugggugacaagagcgagac

SEQ ID NO: 202424 - RNA, 64 nt, Human
ucuacggcacugcuuucauuuaauugggcuuuaggcacuccauucgaaugcagaaccucaccuc

SEQ ID NO: 202425 - RNA, 64 nt, Human
ggcagagguugcagugagccaagaucgcgccauugcacuccagccuggacaacaagagcaaaac

SEQ ID NO: 202426 - RNA, 64 nt, Human
gguugaagcuacagugagccuugauugugucacugcacuccagccugggcaacagguaagacuc

SEQ ID NO: 202427 - RNA, 64 nt, Human
cagaguaaggcggcuggaccccaggaaccccagggcacuccacugcagcaggagggacuuaagc

SEQ ID NO: 202428 - RNA, 64 nt, Human
ggcagagguugcagugagccgagauugcaccccugcacuccaggcugggcaacaguacgagacu

SEQ ID NO: 202429 - RNA, 64 nt, Human
gguccucaucacacacaugucaucagggcccucugcacuccacaugaugaggucagacccacac

SEQ ID NO: 202430 - RNA, 64 nt, Human
agguugcagugagccaagaucacaucacugcacugcacuccagccggggugacagagcgaaccu

SEQ ID NO: 202431 - RNA, 64 nt, Human
ggcagagcuuacagugagccgagaucgugccacugcacuccagccugggcgacagagcaagacu

SEQ ID NO: 202432 - RNA, 64 nt, Human
ggcagagcuugcagugagccgagaucgcgccacugcacuccagccugaguggcaaagugagacu

SEQ ID NO: 202433 - RNA, 64 nt, Human
uuucaaggcugcauugagcuaugauuacaccacugcacuccagccuggguaacagagugaaauc

SEQ ID NO: 202434 - RNA, 64 nt, Human
ggcagagccuaaagugagccgagaucgcgccacugcacuccagccugggugacacagcaagacu

SEQ ID NO: 202435 - RNA, 64 nt, Human
gguggagguugcagugagcugagaucgcaccauugcacuccagccugggcaacaagagcgaaac

SEQ ID NO: 202436 - RNA, 64 nt, Human
augagcccaaguccaccugucuucauccuccccugcacuccagacugaucugccuaaagcacgc

SEQ ID NO: 202437 - RNA, 64 nt, Human
gguggagguugcagugagcugagauugcgccacugcacuccagccugggcaacaagagcaaaac

SEQ ID NO: 202438 - RNA, 64 nt, Human
agcggagguugcagugagccgagagcaugccgcugcacuccagccugggagacugcaucucaaa

SEQ ID NO: 202439 - RNA, 64 nt, Human
agcggagguugcagugagcugagaucgcaccacugcacuccagccugggagauacagcgagacu

SEQ ID NO: 202440 - RNA, 64 nt, Human
gguggggguugcagugagccgagaucacaccacugcacuccagccugggcaacaagagcaaaac

SEQ ID NO: 202441 - RNA, 64 nt, Human
uuguggcuguugcgcacaucccugcccuccuacagcacuccaccuugggaccuguuuagagaag

SEQ ID NO: 202442 - RNA, 64 nt, Human
ggcagagguugcagugaacugagauugugccacugcacuccagacugggugacacagcgagacu

SEQ ID NO: 202443 - RNA, 64 nt, Human
gguggagguugcagugagccgagaucaugccacugcacuccagccugggcaacagagcaagacu

SEQ ID NO: 202444 - RNA, 64 nt, Human
cgaauucuccagggaauuaaagagcuuggaaggagcacuccacagucggagguguaaucauauu

SEQ ID NO: 202445 - RNA, 64 nt, Human
gguagagguugcagugagccaagaucgcgccacugcacuccagucugggcaacagagugagacc

SEQ ID NO: 202446 - RNA, 64 nt, Human
aguggagguugcagugagccgagauugugcugcugcacuccagccugggugaaaaagacaggcu

SEQ ID NO: 202447 - RNA, 64 nt, Human
gguggagguuucagugagcugagauccugccacugcacuccagccugggcgcaagaccaagacu

SEQ ID NO: 202448 - RNA, 64 nt, Human
gguggagcuugcagugagcggagaucgcgccacugcacuccagccugggcgacagggcaagacu

SEQ ID NO: 202449 - RNA, 64 nt, Human
auguuucagaauuacuuuuuaauuguuuuaaaaagcacuccagauaauuuauagaguaacauag

SEQ ID NO: 202450 - RNA, 64 nt, Human
aaucauagcucacugcagcuaugaucaugucucagcacuccagcuuuggcaacagaacgagauc

SEQ ID NO: 202451 - RNA, 64 nt, Human
gucagaggcugcagagagccgagacugggccacugcacuccagccuggaugacagagugagacu

SEQ ID NO: 202452 - RNA, 64 nt, Human
ggcagagguugcagugagccaagaucgcgccacugcacuccagccugggugacagaacaagacu

SEQ ID NO: 202453 - RNA, 64 nt, Human
ggcggagguugcagugagccgagaucgcgccacugcacuccagccugggcaacagagugagacu

SEQ ID NO: 202454 - RNA, 64 nt, Human
gacggagguuacagugagucgagaucgcgccacugcacuccagccuggacgacagagugagauu

SEQ ID NO: 202455 - RNA, 64 nt, Human
gguagagguugcagugagccaaggucacaccauugcacuccaaccugggcgacagggcgagacu

SEQ ID NO: 202456 - RNA, 64 nt, Human
uuaaccucugaacucugaccucaggaggcucugggcacuccagcccugaaagccccagguguac

SEQ ID NO: 202457 - RNA, 64 nt, Human
gacugaggcugcagugagccaugauugugcuacugcacuccaaucuggcaacagagcgagaccu

SEQ ID NO: 202458 - RNA, 64 nt, Human
uggugugaacccagugagccgagaucgugccacugcacuccagccugggcaacagagugagacu

SEQ ID NO: 202459 - RNA, 64 nt, Human
cagggagguugugaugagccaaggucaugccacugcacuccagccugggagacagagcaagacu

SEQ ID NO: 202460 - RNA, 64 nt, Human
gggggagguugccgugagcugagcuugcaccauugcacuccagccugggcgacaagagugaaau

SEQ ID NO: 202461 - RNA, 64 nt, Human
guuugaggcugcaaugaacuaugaucacaccacugcacuccagccucggcgacagagcaagacc

SEQ ID NO: 202462 - RNA, 64 nt, Human
gucugaggcuuuagugaucuaagaucaugccacugcacuccagccugggcaacagagugagacc

SEQ ID NO: 202463 - RNA, 64 nt, Human
ggcaaagguugcagugagcugagaucacaccacugcacuccagccuggcgacagagagagacuc

SEQ ID NO: 202464 - RNA, 64 nt, Human
gcccuggggucagugacacugucaggccaaccaugcacuccacaaaggggagcauuuggaaaug

SEQ ID NO: 202465 - RNA, 64 nt, Human
guggagguugcccugagcugauuaucaugcuguugcacuccagcuugggcgacagagcgagacu

SEQ ID NO: 202466 - RNA, 64 nt, Human
ggcggagguugcagugagccaagauugcgccauugcacuccagccugggcaacaagagagaaac

SEQ ID NO: 202467 - RNA, 64 nt, Human
gcaccccgcguguccccggggcccaggggaggcggcacuccaaccuaaccugugucugcgaagu

SEQ ID NO: 202468 - RNA, 64 nt, Human
gagggaugccuuaaagcugucccuggcuggaggagcacuccaccuuggggauaguggagggggc

SEQ ID NO: 202469 - RNA, 64 nt, Human
ggcagagguugcagugagccaagaucgcaccacugcacuccagcccuggcgacagagugagacu

SEQ ID NO: 202470 - RNA, 64 nt, Human
uguuccucgggcagcugccccgggccggagcugggcacuccagcggcccuggcgcguggcuccu

SEQ ID NO: 202471 - RNA, 64 nt, Human
gguggagguugcagugagccgagaucgcgccauugcacuccaaccuaggugacaaagcuacacg

SEQ ID NO: 202472 - RNA, 64 nt, Human
ggcggagcuugcagcgagccaagaucgcgccacugcacuccagccugggugacagagcgagacu

SEQ ID NO: 202473 - RNA, 64 nt, Human
ggcagagguugcaguaagccaagaucgugccacugcacuccagccuuggugacagagcaagacu

SEQ ID NO: 202474 - RNA, 64 nt, Human
uaaucacaaacuagaugcagaggaggucuugccagcacuccaaaaucucuguguguccccucuu

SEQ ID NO: 202475 - RNA, 64 nt, Human
ggcggaaguuguggugagccgagaucgcgccacugcacuccagccugggcaacaagagugaaac

SEQ ID NO: 202476 - RNA, 64 nt, Human
ggcggagguugcggugagcugagaucacgccauugcacuccagccugggcaacaagagcaaaac

SEQ ID NO: 202477 - RNA, 64 nt, Human
uagccagagagagguguugacucugagagaccuugcacuccauacugaaaggagguggggucac

SEQ ID NO: 202478 - RNA, 64 nt, Human
uugcagugagcuuagaucaugccaccaugccacugcacuccagccugggugacacagccaaaaa

SEQ ID NO: 202479 - RNA, 64 nt, Human
gguggagguuguggugagcugagaucgcgccacugcacuccagccugggugacagagcgagacu

SEQ ID NO: 202480 - RNA, 64 nt, Human
gguagaaguugcagugagccaagaucauacuacugcacuccagccugggcgacaagagugaaac

SEQ ID NO: 202481 - RNA, 64 nt, Human
ggcagagauugcaguaagcugagaucgugccacugcacuccagccuggugacagagugagacuc

SEQ ID NO: 202482 - RNA, 64 nt, Human
gguggagguugcagugagccgaggucgcaccacugcacuccagucuggguaacagagcgagacu

SEQ ID NO: 202483 - RNA, 64 nt, Human
ggucgaggcugcagugagcugagaucacgccacugcacuccagucugggugacagagagagacc

SEQ ID NO: 202484 - RNA, 64 nt, Human
ggcagaaguugcagugagccgagaucgcaccacugcacuccagccugggcaacagagugagacu

SEQ ID NO: 202485 - RNA, 64 nt, Human
ggcagagcuugcagugagccgagaucgcgccacggcacuccagccugggagacagagcaagacu

SEQ ID NO: 202486 - RNA, 64 nt, Human
cugucacugcccucucccugccugggggcuaugugcacuccagaccccugcccaggcucaggcc

SEQ ID NO: 202487 - RNA, 64 nt, Human
ggcggagguugcagugagccaagaucucgccacugcacuccagcuugggcaauagcaagacucc

SEQ ID NO: 202488 - RNA, 64 nt, Human
auuccaacucagcuccucuuugcacuggaauggggcacuccaacaccccucagggaccacccuc

SEQ ID NO: 202489 - RNA, 64 nt, Human
uccuuaugugcuagggauaaaucaagaguccucagcacuccacauucccaaaaaaucccaggaa

SEQ ID NO: 202490 - RNA, 64 nt, Human
aaggcuacagugagccgcgacccaucgcacaccugcacuccaguccuggugcaacagauggaga

SEQ ID NO: 202491 - RNA, 64 nt, Human
ugagcagauguggggguggccagccaggcuggccgcacuccaucacuggcacugccugccuugg

SEQ ID NO: 202492 - RNA, 64 nt, Human
ggcggagguugcagugagucgagaucgcgccagugcacuccagccugggcaagaagagcgaaac

SEQ ID NO: 202493 - RNA, 64 nt, Human
acuuggacagccuucaaaguccuuccaucuggcugcacuccaaggcccccucuguccuuuucag

SEQ ID NO: 202494 - RNA, 64 nt, Human
cuccagagguggggcugcaccagacucagcacuagcacuccaucagcacuagcaccucacucca

SEQ ID NO: 202495 - RNA, 55 nt, Human
gacuucaccauggggacuaaaaggagcacuccaugcuuuagauucacacggaagg

SEQ ID NO: 202496 - RNA, 64 nt, Human
aguugaggcugcaaugagccgugaucaugccacugcacuccagccugggugacagagugagacc

SEQ ID NO: 202497 - RNA, 64 nt, Human
ugaauaugagaggcggagccaagaugaugccauugcacuccagccugggcaacaagagagaagg

SEQ ID NO: 202498 - RNA, 64 nt, Human
gguggaguuugcagugagcugagaucacaccauugcacuccagccugggcaaaaagagcaaaac

SEQ ID NO: 202499 - RNA, 64 nt, Human
ggcagagguugcagugagcugagacugugccauugcacuccagucggguuaacagagcaagaca

SEQ ID NO: 202500 - RNA, 64 nt, Human
cuagaaaugcaguauugcuuugaccugccauguggcacuccacaaugucaauugcaguuuacac

SEQ ID NO: 202501 - RNA, 64 nt, Human
ggcggagauugcagugagccaagguuccaccacugcacuccagccuggcgacagagcaaggcuc

SEQ ID NO: 202502 - RNA, 64 nt, Human
gaaguggagguugcagugagcugauggugccacugcacuccagccugggugauagagcgagacu

SEQ ID NO: 202503 - RNA, 64 nt, Human
gguggagguugcagugagccaagauugcgccauugcacuccagccugggcaacacagcgagacu

SEQ ID NO: 202504 - RNA, 64 nt, Human
ggcagagguugcagugagccgagauugcaccaccgcacuccagccugggugacagagcgagacu

SEQ ID NO: 202505 - RNA, 64 nt, Human
gguggagguugcagugagcugggaucgcgccauugcacuccagccuggcugacagagcgagacu

SEQ ID NO: 202506 - RNA, 64 nt, Human
ggucggggcugcagugagccaagaucacgccacugcacuccagcacccugggcgacagagugag

SEQ ID NO: 202507 - RNA, 64 nt, Human
gagucagacgccucuggagcgagcccuaugucaggcacuccaccuggggggcccuuccccagca

SEQ ID NO: 202508 - RNA, 64 nt, Human
ggcggagguugcggugagccaagaucgcaccauugcacuccagccugggcaacaagagugaaac

SEQ ID NO: 202509 - RNA, 64 nt, Human
agcagagcuugcagugagccaagauggugccauugcacuccagccugggcgugacagagugaga

SEQ ID NO: 202510 - RNA, 64 nt, Human
gguagaggcugcugugagcugaaauggcgccacugcacuccagccuggguaacagagcgagacc

SEQ ID NO: 202511 - RNA, 64 nt, Human
ggcggagauugcagugagccgagaucccgccacugcacuccagcccaggugacagagcgagacu

SEQ ID NO: 202512 - RNA, 64 nt, Human
ggcggagguugcagugagccaagauugcaccagugcacuccagcuugggcgacagaucaagacu

SEQ ID NO: 202513 - RNA, 64 nt, Human
cagcuugcagugagcgaagaucgcaccacugcacgcacuccagccugggugacagagcgagacu

SEQ ID NO: 202514 - RNA, 64 nt, Human
gguguagguugcagugagccgagauugcaccacugcacuccagccugggcgacagagcgagacu

SEQ ID NO: 202515 - RNA, 64 nt, Human
ugaaccugggaggcggagguugcagugagccacugcacuccagccugaugacagagcaagacuc

SEQ ID NO: 202516 - RNA, 64 nt, Human
cuucgaggcugcaaugagcuauaauugcaucauugcacuccagccugggcaacagagacccugu

SEQ ID NO: 202517 - RNA, 64 nt, Human
ggcggagcuugcagugagccgagauugugccacugcacuccagccugggcaacagagcuagacu

SEQ ID NO: 202518 - RNA, 64 nt, Human
gguggagguugcagugaguugagauugugccauugcacuccagccugggcaacagagcaagacu

SEQ ID NO: 202519 - RNA, 64 nt, Human
guucgaggcugcagugagccaggaucaugccacugcacuccagccugguccacagagagacacu

SEQ ID NO: 202520 - RNA, 64 nt, Human
gguggagguuacagugagcugagaucgugccacugcacuccauccuggacgacagagugagacu

SEQ ID NO: 202521 - RNA, 64 nt, Human
ggcggagguaguggugagcaaagaucguaccgcugcacuccagccugggugauagagcaagacc

SEQ ID NO: 202522 - RNA, 64 nt, Human
ugcagagguugaagugagccaagaucgugccacugcacuccagccuugagacagagcgagaccc

SEQ ID NO: 202523 - RNA, 64 nt, Human
ggcggagguuguggugagccgagaucgcgccauugcacuccauccuggacaacaggagugaaac

SEQ ID NO: 202524 - RNA, 64 nt, Human
gguggugguugcagugagccgagauccugccacugcacuccagccugggcaaccaagcgagacu

SEQ ID NO: 202525 - RNA, 64 nt, Human
cuacaggucaggccaagaagggugaaggccucuugcacuccagaccucauacgccccaacagcu

SEQ ID NO: 202526 - RNA, 64 nt, Human
ggcagagguugcagugagucaagaucacgccauugcacuccagccugggcaacaagagcgaaac

SEQ ID NO: 202527 - RNA, 64 nt, Human
cgucaucgcgccacuaagccaagaucgcgccacugcacuccagccugggcgacagagccagacu

SEQ ID NO: 202528 - RNA, 64 nt, Human
gguggagguugcaguaagccaagaucacaccacugcacuccaaccuggacaacagagcgagacu

SEQ ID NO: 202529 - RNA, 64 nt, Human
cacccacccacauaucuuacagccagaggaaccagcacuccaucacugagagcccgacuucguu

SEQ ID NO: 202530 - RNA, 64 nt, Human
gguggagguggcagugagccgagauugcgccauugcacuccagccugggcaaaaagagugagac

SEQ ID NO: 202531 - RNA, 64 nt, Human
uagcuuaaaaauuuaaucacgagauugcgccacugcacuccagccugggcgacagagccagacu

SEQ ID NO: 202532 - RNA, 64 nt, Human
ggcggaggcugcagugagccgagaucgugccacugcacuccagccuggucaacagagcaagacu

SEQ ID NO: 202533 - RNA, 64 nt, Human
ggcggagcuugcagugagccaagaucgcgccacugcacuccagccugggcgacagagugagacu

SEQ ID NO: 202534 - RNA, 64 nt, Human
gguggagacugcaguaagccaagaucaugccauugcacuccagccugggcaacacagggagacu

SEQ ID NO: 202535 - RNA, 64 nt, Human
gguggagguugcagugagccgagauugugccacugcacuccagccugggcgauagagcuagacu

SEQ ID NO: 202536 - RNA, 64 nt, Human
ggcagagguugcagucagccaagaucaugcuacugcacuccagccugggugacagagcgagacu

SEQ ID NO: 202537 - RNA, 64 nt, Human
ggcagaggcuguagugagccaagauagcaccacugcacuccagccugggagacagagugagacu

SEQ ID NO: 202538 - RNA, 64 nt, Human
ggcagagguugcagugagcugagauugugccacugcacuccagccugggcaacaaagcaagacu

SEQ ID NO: 202539 - RNA, 64 nt, Human
cuguccuagguuacaaagacaugggggccuuguggcacuccaaguaugagucggauacccugga

SEQ ID NO: 202540 - RNA, 64 nt, Human
gccggaggcugcagugagccaagaucgcaccauugcacuccagcugggagacacagcaagacuc

SEQ ID NO: 202541 - RNA, 64 nt, Human
gguggagguugcagggagccgaggccgcaccacugcacuccagccugggugacagagugagacu

SEQ ID NO: 202542 - RNA, 64 nt, Human
gguggagcuugcagugagccaagaucgugccacugcacuccagccugggcgacagagcaagacu

SEQ ID NO: 202543 - RNA, 64 nt, Human
ugaaaaugaauuugaagacaagccaacaaacccugcacuccaaaaaagcaaaacagacccuaau

SEQ ID NO: 202544 - RNA, 64 nt, Human
gagaauaucacagugguuuuuguuagcagaaaaugcacuccagccucuguacucaucuaagcug

SEQ ID NO: 202545 - RNA, 64 nt, Human
guuugaggcugcagugagcuaugauugcaccacugcacuccaaccugggugacagagugagacc

SEQ ID NO: 202546 - RNA, 64 nt, Human
cuugaaagacugcaauagaaaacucccaaacccagcacuccagacucgagggaagccagcuucc

SEQ ID NO: 202547 - RNA, 64 nt, Human
aguggagguugcagugagccaagaguacaccacugcacuccagccugggcaacagagcgagacu

SEQ ID NO: 202548 - RNA, 64 nt, Human
ggcugaggcugcagugagccaagaucgcacuacugcacuccagccugggugacagaguaagacc

SEQ ID NO: 202549 - RNA, 64 nt, Human
ggaagagcuugcagugagccgagaucgcgccacugcacuccagccugggugacagagccagacu

SEQ ID NO: 202550 - RNA, 64 nt, Human
ggcggagguugcagugagccgagaucgcuccacugcacuccagcccaggugacagugugagacu

SEQ ID NO: 202551 - RNA, 64 nt, Human
acggacaguguccacucuggcaaggugggaaaaggcacuccaagugcauccuccacuggcaaca

SEQ ID NO: 202552 - RNA, 64 nt, Human
ggcagagguugcagugagcugagaucgcgccauugcacuccagccugggugacagagcaagacu

SEQ ID NO: 202553 - RNA, 64 nt, Human
ggcggagguugcagugagccaagaucacgucauugcacuccagccuggucaacaagaguaaaac

SEQ ID NO: 202554 - RNA, 64 nt, Human
ugccggacaaaggccuccuggucacucugucccugcacuccauguauaguccucuuggguuggg

SEQ ID NO: 202555 - RNA, 64 nt, Human
ggcggagauugcagugaaccaagaucgggccacugcacuccagcuugggugacagagcaagacu

SEQ ID NO: 202556 - RNA, 64 nt, Human
cuuugagcauuaggauuugccccuuuggaauucugcacuccaguuacuuaacuuucccuucaga

SEQ ID NO: 202557 - RNA, 64 nt, Human
ggcggagcuugcagugagccgagaucgcgccacugcacuccagccugggcgacagagcgagacu

SEQ ID NO: 202558 - RNA, 64 nt, Human
ggcagagguugcagugagcucagauagugccacugcacuccagccugggugacagagcgagacu

SEQ ID NO: 202559 - RNA, 64 nt, Human
ggcggagcuugcagugagccgagaucgugccacugcacuccagccugggcgacagagugagacu

SEQ ID NO: 202560 - RNA, 64 nt, Human
ggcaaagguugcagugaacugagauugcgccaccgcacuccagccugggcgacagagcgagacu

SEQ ID NO: 202561 - RNA, 64 nt, Human
guugcagugagccaaaauugcaccacugcacacugcacuccauccugggcgacagucugagacu

SEQ ID NO: 202562 - RNA, 64 nt, Human
gguggagguugcagugagccaaggucgcgacacugcacuccagccugggugacagagugagacu

SEQ ID NO: 202563 - RNA, 64 nt, Human
cuacaccuagacacguccuggcagggggccucgggcacuccacuaccaacccagcuccacccag

SEQ ID NO: 202564 - RNA, 64 nt, Human; identical to SEQ ID NO: 202557

SEQ ID NO: 202565 - RNA, 64 nt, Human
acccgggagauggcgcuugcagugagcugagauugcacuccagccugggcgacaggcucaaaaa

SEQ ID NO: 202566 - RNA, 53 nt, Human
gcaccaucagcaggccuuagccugcacuccaggcuccuucuuggaccccaggc

SEQ ID NO: 202567 - RNA, 64 nt, Human
gguggagguugcggugagccaagaucgugccacugcacuccagccugggcuacaagauugaaaa

SEQ ID NO: 202568 - RNA, 64 nt, Human
ggcggagcuugcagugagccgagaucgcgccaaugcacuccagccugggcgacagagaaaaaaa

SEQ ID NO: 202569 - RNA, 64 nt, Human
ggcagaaguugcagugagcugagaucacaccacugcacuccagccugggugacagagagacucu

SEQ ID NO: 202570 - RNA, 64 nt, Human
guaguuacaucaauuugaugcaugcuuuccaucugcacuccagacggcuuucucaguuccaaga

SEQ ID NO: 202571 - RNA, 64 nt, Human
aguucuugaacucagaacuuaaauccugcacguggcacuccaccacugacuggaccgagcuggc

SEQ ID NO: 202572 - RNA, 64 nt, Human
guuugaggcugcagugagcuaugauuccaccauugcacuccagucugggcaacagagcaagacc

SEQ ID NO: 202573 - RNA, 64 nt, Human
gguggagcuugcagugagccaagaucacgccacugcacuccagccugggcaacggagugagacu

SEQ ID NO: 202574 - RNA, 64 nt, Human
ggaggaggcugcagugagcuaagauugcaccacugcacuccaaccugggcgacaagagugaaac

SEQ ID NO: 202575 - RNA, 64 nt, Human
gcccugagggagugaguucacauuugagacaacugcacuccaguguggacgugccuuugucuuc

SEQ ID NO: 202576 - RNA, 64 nt, Human
uuccucaaaaggucuugcugcugucagguguuaugcacuccauccaucauaacuguaugaaaca

SEQ ID NO: 202577 - RNA, 64 nt, Human
guuggaggcugcgaugagccaugaaugccccacugcacuccagccugggcgacagaacgagacc

SEQ ID NO: 202578 - RNA, 64 nt, Human
ggcggagguugcagugagccaagaucaugccacugcacuccagccugggcaacagagugagacu

SEQ ID NO: 202579 - RNA, 64 nt, Human
gaggcggagguugcagugagccgagauugccacugcacuccagccugggcaacaagagcgaaac

SEQ ID NO: 202580 - RNA, 64 nt, Human
uuuaaccugcggggggagccuagauugcgcuacugcacuccagccuaggcaacagagggagacu

SEQ ID NO: 202581 - RNA, 64 nt, Human
ugcauuccagccugggcgccgagauagcgccauugcacuccagccugggcgacugaauaaaacu

SEQ ID NO: 202582 - RNA, 64 nt, Human
aggcagagcuugcagugaguggagaugcgccacugcacuccagccugggcgacagagcgagacu

SEQ ID NO: 202583 - RNA, 64 nt, Human
aagagaugaacaguuugucugaaacaaacacagagcacuccaucaaaauuuaccugaucuuugu

SEQ ID NO: 202584 - RNA, 64 nt, Human
ggcagaaguggcagugagccgagauugagccacugcacuccaaucugugcgacagagugagacc

SEQ ID NO: 202585 - RNA, 64 nt, Human
gguggagcuugcagugagccgagaucgcaccacugcacuccagccugggagacagagcgagacu

SEQ ID NO: 202586 - RNA, 64 nt, Human
ggcagagguugcagugauccaagaucaugccacugcacuccagccugggcaacaagagcaaaac

SEQ ID NO: 202587 - RNA, 64 nt, Human
gguugaggcugcagucagcucagauugcaccacugcacuccagccugggcaacagagcgagacc

SEQ ID NO: 202588 - RNA, 64 nt, Human
agucgagguugcagugagccuugaucgugccacugcacuccagccugggggacagagcacgacc

SEQ ID NO: 202589 - RNA, 64 nt, Human
gguggagguugcagugagccaugaucgagccacugcacuccagccugggcaacagaugaagacc

SEQ ID NO: 202590 - RNA, 64 nt, Human
guucgaagcugcagggaccucugauugcaccacugcacuccaggcuggguaacagaaugagacc

SEQ ID NO: 202591 - RNA, 64 nt, Human
ggcagagguugcagugagccgagauugcgccacugcacuccagccugggcaacagagugaaacu

SEQ ID NO: 202592 - RNA, 64 nt, Human
gucagagguuucagugagccgagauugugccacugcacuccagccugggugaaagagcuagauu

SEQ ID NO: 202593 - RNA, 64 nt, Human
gguggagguugcagugagcugagaucuucccacugcacuccagccuggccaauaagaccugucu

SEQ ID NO: 202594 - RNA, 64 nt, Human
gaggcaucucccagccccucugcugccggacagcgcacuccagggcaggacgccgcccccgugg

SEQ ID NO: 202595 - RNA, 64 nt, Human
gguugugguugcagugagcuaugauuguaccacugcacuccagccugggcaacagagcaagacc

SEQ ID NO: 202596 - RNA, 64 nt, Human
ggcggagguugcggucagcugagauggugccacugcacuccagccugggcgaaagagcgacucu

SEQ ID NO: 202597 - RNA, 64 nt, Human
gauggagguugcagugagcagagaucgugccacugcacuccagccuggguaacagagggagacu

SEQ ID NO: 202598 - RNA, 64 nt, Human
agauugaggcugcagugagcaugaucgcgacacugcacuccagccugggugacggugagacuuu

SEQ ID NO: 202599 - RNA, 64 nt, Human
agguugaggcaggggaaucacuagaacccaggaggcacuccagccugggagacagagugagacu

SEQ ID NO: 202600 - RNA, 64 nt, Human
ggcagagguugaagugagcugagaucgcgccauugcacuccagccugggcaacaagaguggcac

SEQ ID NO: 202601 - RNA, 64 nt, Human
gcgccauugcacuccagccugggcaacaagaguggcacuccaucucagaaaaaaaaaaaaaaga

SEQ ID NO: 202602 - RNA, 64 nt, Human
gguggaaguugcagugagccaagauuguaccacugcacuccaguuuggcaacagagugagacuc

SEQ ID NO: 202603 - RNA, 64 nt, Human
auagaggcuugcagugagccgugauggcaccauugcacuccaaccggggugacagaugaggucc

SEQ ID NO: 202604 - RNA, 64 nt, Human
agguggagguugcaaugagcaagauugugccacugcacuccagccugggcaacagagcaagacu

SEQ ID NO: 202605 - RNA, 64 nt, Human
ggcggagguuacagugagcugagauugugccacugcacuccagccugggugacagagugagauu

SEQ ID NO: 202606 - RNA, 64 nt, Human
guuugaggcugcagugaguuaugauggcacugcugcacuccagccugcgggacagagugagacc

SEQ ID NO: 202607 - RNA, 64 nt, Human
acccaguaucuucugugccaugguucccacauucgcacuccauggccuccuguccuggacccca

SEQ ID NO: 202608 - RNA, 64 nt, Human
ggcagagguugcagugagccaagaucacacuauugcacuccagccugggcgacagggcaagacu

SEQ ID NO: 202609 - RNA, 64 nt, Human
gguugaagcugcagugagcugugaucgcaccacugcacuccagcuugguucauggagacccugu

SEQ ID NO: 202610 - RNA, 64 nt, Human
ccucauggcuuuagugagccaugauugugccacugcacuccagcuuggugacagagugagaucc

SEQ ID NO: 202611 - RNA, 64 nt, Human
gguggagauugcagugagcccagaucgcaccacugcacuccagucuggcaacagagcaagacuc

SEQ ID NO: 202612 - RNA, 64 nt, Human
ggcggagcuugcagugagccgagaucgcgccacugcacuccagccugggcgacagagugagacu

SEQ ID NO: 202613 - RNA, 64 nt, Human
gauugaggcugcagugagcuguguucacaccacugcacuccagucugggcaacagugcaagacc

SEQ ID NO: 202614 - RNA, 64 nt, Human
ggcggagguugcagugagcucagauugcgucacugcacuccaaccugggugacagagcgagacu

SEQ ID NO: 202615 - RNA, 64 nt, Human
gauugaggcugcacugaccuaugguagugcuacugcacuccagccagggcaacagagugagacc

SEQ ID NO: 202616 - RNA, 64 nt, Human
gguggagguugcugugagccaagaucgcaccauugcacuccagccugugcaacaagcgaaacuc

SEQ ID NO: 202617 - RNA, 64 nt, Human
ggcggagguugcagugagccaagauggugccgcugcacuccagucugggugacacagcaagacu

SEQ ID NO: 202618 - RNA, 64 nt, Human
ggcggugcuugcagggagccgagaucgugccacugcacuccaggcugggcgacagagugagagu

SEQ ID NO: 202619 - RNA, 64 nt, Human
ggcagaguuugcagugagcugagaucacgccauugcacuccagccugggcgacagagcaagacu

SEQ ID NO: 202620 - RNA, 64 nt, Human
ggcagagguugcagugagcugagaucucaccacugcacuccagccugggcaacagagcgagacu

SEQ ID NO: 202621 - RNA, 64 nt, Human
ggcggagguugcaaugagccaaggucgcgccauugcacuccagccugggcgacagagugacacu

SEQ ID NO: 202622 - RNA, 64 nt, Human
ggcggaaguugcagugagcugagauugcaccacugcacuccagcccaggcaacagagugagacu

SEQ ID NO: 202623 - RNA, 64 nt, Human
ggcguagcuugcagugagcugagaucacacuacugcacuccagccugggcaacagagcaagacu

SEQ ID NO: 202624 - RNA, 64 nt, Human
gguggagguugcggugagccaagaucgcaccauugcacuccagccugggcaacaagagcgaaac

SEQ ID NO: 202625 - RNA, 64 nt, Human
ggcggagguugcagugagccaagaucgcgccauugcacuccagccugggggacaagagugagac

SEQ ID NO: 202626 - RNA, 64 nt, Human
ggcagagguugcagugagcugagaucacgccacugcacuccagccugggcgacagagcgagacu

SEQ ID NO: 202627 - RNA, 64 nt, Human
gucggagguugcaguaagccgagaucgcgccacugcacuccagccuggacgacagagcaagacu

SEQ ID NO: 202628 - RNA, 64 nt, Human
gguggagguugcugugagcugacaccacgccacugcacuccagccugggugacagugagacucu

SEQ ID NO: 202629 - RNA, 64 nt, Human
ggcggagguugcagugagccgagaucacaccacugcacuccaaccugggaaacgcagugagacu

SEQ ID NO: 202630 - RNA, 64 nt, Human
ucucucuuuuuuuuuuuuugaugagucucacucugcacuccagccuggcgacagagcaagacuc

SEQ ID NO: 202631 - RNA, 64 nt, Human
agcagagguugcagugagcagagaucaugccacugcacuccagccugggcgauggagugagacu

SEQ ID NO: 202632 - RNA, 64 nt, Human
agcuggccuccuuccagcccagugccagaaaccagcacuccaugaagauaaacucugggcccgc

SEQ ID NO: 202633 - RNA, 64 nt, Human
guuugaggcuacagagagcuaugauugcaccacugcacuccagccugggcaacaaagcaagacc

SEQ ID NO: 202634 - RNA, 64 nt, Human
ggcggagguugcggugagccaagaucgcgccacugcacuccagccugggcagcaagagcaaaac

SEQ ID NO: 202635 - RNA, 64 nt, Human
gacggagauugcagugagcugagauggcgccacugcacuccagccuggcaacagagugagacuc

SEQ ID NO: 202636 - RNA, 64 nt, Human
gguggagguuucagcgagcugagaucacaccacugcacuccagccuuggugacagagugagacu

SEQ ID NO: 202637 - RNA, 64 nt, Human
cugggaggcagaaguuguggugagccgagauugugcacuccagccuggguaacagagcgagacu

SEQ ID NO: 202638 - RNA, 64 nt, Human
gguggagguugcagugagccgacaucaugccacugcacuccagccugggcgacagagcaagaca

SEQ ID NO: 202639 - RNA, 64 nt, Human
guuggaggcugaagagagcuaugacugcaucacugcacuccagccugggcaacacagcaagauc

SEQ ID NO: 202640 - RNA, 64 nt, Human
ggaagcgguugcagugagccaagauugcgccuuugcacuccagccugggcaagagagcaagacu

SEQ ID NO: 202641 - RNA, 64 nt, Human
ggcagagguuguagugagccgagauugcaccacugcacuccagccgggugacagagugagacuc

SEQ ID NO: 202642 - RNA, 64 nt, Human
caaccucuuuucgugaugggcagccugcuggucagcacuccaguagcgagagacggcacccaga

SEQ ID NO: 202643 - RNA, 64 nt, Human
ggcggagguugcagugagcugagaucacgccacugcacuccagccugggcgacagagcgagauu

SEQ ID NO: 202644 - RNA, 64 nt, Human
ggcggaguuuguggugaguugagaucgcgccacugcacuccagccuggguaacagagcaagagu

SEQ ID NO: 202645 - RNA, 64 nt, Human
ggcagaguuugcagugagcugagaucgugccacugcacuccagccugggugacagagugagacc

SEQ ID NO: 202646 - RNA, 64 nt, Human
ggcagagguugcagugagccgagaucacgccauugcacuccagccugggcaacaagagcaaaac

SEQ ID NO: 202647 - RNA, 64 nt, Human
gguugaggcuauagugagccaugaucauaccacugcacuccagccugggugacagagcgagacc

SEQ ID NO: 202648 - RNA, 64 nt, Human
ggcagaggcugcagugaaccaagaucaugccacugcacuccagccugggcaacacagcgagacu

SEQ ID NO: 202649 - RNA, 64 nt, Human
ggcggagguggcggugagccgagauugagccauugcacuccagccugggcaacaacagcaaaac

SEQ ID NO: 202650 - RNA, 64 nt, Human
guucgaggcugcagugagcuaugacugugccacugcacuccagccuggucaacaaagcaagacc

SEQ ID NO: 202651 - RNA, 64 nt, Human
ggcagagguugcaaugagccgagauugugccacggcacuccagccugggcagcagagugagacu

SEQ ID NO: 202652 - RNA, 64 nt, Human
ggcagagguugcaaugagccaagaucgcgccacugcacuccagccugggugacagagcgagacc

SEQ ID NO: 202653 - RNA, 64 nt, Human
cuccacccccuccagcuccaguuuccaaguuccugcacuccagaauccacaaagccgugccuuu

SEQ ID NO: 202654 - RNA, 64 nt, Human
ggcggagcuugcagugagccgagauugcgccacugcacuccagccugggcagcagagcaacacu

SEQ ID NO: 202655 - RNA, 64 nt, Human
gguagaggcugcauugagccaugauugcaccacugcacuccagccugggcaacagagggagccc

SEQ ID NO: 202656 - RNA, 64 nt, Human
aggagguguugcagugaaccaagaucacaccacugcacuccagccuaggcaacagagacucugu

SEQ ID NO: 202657 - RNA, 64 nt, Human
gguggagguugcagugagccgagaucgucccacugcacuccagccugggcaacagagugagacu

SEQ ID NO: 202658 - RNA, 54 nt, Human
ggaggcccccuggugugugauggugcacuccagggcaucacauccuggggcuca

SEQ ID NO: 202659 - RNA, 64 nt, Human
gguggagcuugccaugagcagagaucaugcuacugcacuccagccugggugacagagcgagacu

SEQ ID NO: 202660 - RNA, 64 nt, Human
ggcggagguuguggugagccaagaucaugccacugcacuccagccugggcaacaagaacaaaac

SEQ ID NO: 202661 - RNA, 64 nt, Human
ggcggagguugcagugagccaagaucgugccaaugcacuccauccugggcaaaaagagcaaaac

SEQ ID NO: 202662 - RNA, 64 nt, Human
aggcggagguugcagugagcgagaucaugccauugcacuccagccugggcaacaggagugaaac

SEQ ID NO: 202663 - RNA, 64 nt, Human
gguggagguugcagugagccgagaucgcgccacugcacuccagccugggcgacagagugggacu

SEQ ID NO: 202664 - RNA, 64 nt, Human
gguggagguugcagugagccgagauggcgccacugcacuccagccugggccacagacccugucu

SEQ ID NO: 202665 - RNA, 64 nt, Human
ggcggagcuugcagugagccaagaucgcgccacugcacuccagccuggguggccgagcgagacu

SEQ ID NO: 202666 - RNA, 64 nt, Human
uggugaggcugcagugagcuaugaucgugcuacugcacuccagccugggcgacacagcaaguuc

SEQ ID NO: 202667 - RNA, 64 nt, Human
ggcauagguugcagugagccgagauugcaccacugcacuccagccuggugacagagcgagacuc

SEQ ID NO: 202668 - RNA, 64 nt, Human
gguggagguugcagugagcuaagaucgcaccacugcacuccagccugggugacagagcgagacu

SEQ ID NO: 202669 - RNA, 64 nt, Human
cccagcacuagguacggggcccaacacgugguaggcacuccaucaguguuugcugaauugaaaa

SEQ ID NO: 202670 - RNA, 64 nt, Human
ccccugcccugcaccauccuguccagugcccugcgcacuccaugccgucucuuccaagccaccu

SEQ ID NO: 202671 - RNA, 64 nt, Human
gagguuacagugagccacaaucacaccaaucacugcacuccagccugggcaauaaaguaacucu

SEQ ID NO: 202672 - RNA, 64 nt, Human
gguggagguugcagugagcugagaucgucccacugcacuccagcccgggcaacagaguaagacc

SEQ ID NO: 202673 - RNA, 64 nt, Human
ccuaggccuaggcaguccacuucgggaggugggggcacuccacacuggggggcccugcagcucc

SEQ ID NO: 202674 - RNA, 64 nt, Human
ggcggagguugaagugagccgagauugcgcuauugcacuccagcucgggcgacaacugcaagac

SEQ ID NO: 202675 - RNA, 64 nt, Human
cugcagugcccugugguugcaccugugaauaacugcacuccagccugggcaacauagcgagacc

SEQ ID NO: 202676 - RNA, 64 nt, Human
ggcagagguugcagugagccgagaucacaccacugcacuccagccugggugacagagcgaggcu

SEQ ID NO: 202677 - RNA, 64 nt, Human
aacaguuucucauuagaugaguguuucuccugcagcacuccaaaacccacucugcacugcagca

SEQ ID NO: 202678 - RNA, 64 nt, Human
ggucaaggcugcagugagccgugauugcaccacugcacuccagccugagugacagagcgagacc

SEQ ID NO: 202679 - RNA, 64 nt, Human
guguccccggacaguucagacacccuuggggauggcacuccacacacgacagagaugcaggggc

SEQ ID NO: 202680 - RNA, 64 nt, Human
guucaacacugcagugagcuaugguggcaccacugcacuccagccugggugacagagcaagacc

SEQ ID NO: 202681 - RNA, 64 nt, Human
ggcagagguuacagugagccaagaucgcgccaucgcacuccagccugggcaacaagagcaaaac

SEQ ID NO: 202682 - RNA, 64 nt, Human
ucaauuugcugaguaugaaauaagaaaaguuagggcacuccacuuaugauaauccagcucuaag

SEQ ID NO: 202683 - RNA, 64 nt, Human
ccccucucaagaguacagaagcuuuagcaagugugcacuccagcuucggagggccccugugugg

SEQ ID NO: 202684 - RNA, 64 nt, Human
ggucgaggcuacagugagcaaagaucacgccacugcacuccagccugggcgacagugagacccu

SEQ ID NO: 202685 - RNA, 64 nt, Human
agcggagguuguggugagccaagguugcgccacugcacuccagccugggcaacaagaguaaaac

SEQ ID NO: 202686 - RNA, 64 nt, Human
uauggccuaaauagcuucaggauguaucuuagcugcacuccaacauugcauccuuucuggggug

SEQ ID NO: 202687 - RNA, 64 nt, Human
gguggagguugcagugaacugagacugcgccacggcacuccagccugggcgacagagcaagacu

SEQ ID NO: 202688 - RNA, 64 nt, Human
gguggagguugcagugagccgaaguugcaccauugcacuccacccugggcgacagagcaagauu

SEQ ID NO: 202689 - RNA, 64 nt, Human
gguggagcuuccagugagccgagaucgcgccacugcacuccaggcugggcgacagagcgagacu

SEQ ID NO: 202690 - RNA, 64 nt, Human
gguggagcuugcagugagccgagaucgcgccacugcacuccagccugggcgacagagcgagacu

SEQ ID NO: 202691 - RNA, 64 nt, Human
ggcgcaggcugcagugagcucugaugguaccacugcacuccagccugggugacagagcgagacc

SEQ ID NO: 202692 - RNA, 64 nt, Human
cugaacagagcuccacacaucugucagggugugagcacuccaaggccucgcguggagcauccuu

SEQ ID NO: 202693 - RNA, 64 nt, Human
ggucgaggcugcagugagccaagaucaugcuacugcacuccagcuuagguggcaaagugagacc

SEQ ID NO: 202694 - RNA, 64 nt, Human
auuugaggcugcagugagcuaugauuguaucacugcacuccagccuagaugacagaacgagacc

SEQ ID NO: 202695 - RNA, 64 nt, Human
ggcagagguuucagugagcugaaauugugccacugcacuccagccugagugacagagugagacu

SEQ ID NO: 202696 - RNA, 64 nt, Human
ggaggagguugcagugagccgagauagcggcacugcacuccagccugggugacaaagugagacu

SEQ ID NO: 202697 - RNA, 64 nt, Human
gguggagguugcagugagccgagaucacgccacugcacuccagccuggugacagcgugagacuc

SEQ ID NO: 202698 - RNA, 64 nt, Human
gguggaggcugcagugagccgagaucacgacacugcacuccagcugugugacagaaugagacca

SEQ ID NO: 202699 - RNA, 64 nt, Human
cagugcacuaugcuugcaccugugaauagccacugcacuccaucuugggcaacacagugagacc

SEQ ID NO: 202700 - RNA, 64 nt, Human
ggcagagguuguggugagcuaagaucacgccauugcacuccagccugggcaacgagagggaaac

SEQ ID NO: 202701 - RNA, 64 nt, Human
gguggagguugcagugagcugagauugcgccacugcacuccagucuggucggcaagagugagac

SEQ ID NO: 202702 - RNA, 64 nt, Human
ggcggagcuugcagugagccgagaucacgcuacugcacuccagccugggugacagcacgagaug

SEQ ID NO: 202703 - RNA, 64 nt, Human
ggcggagcuugcagugagcugagaucacgccacugcacuccagccugggcaacagagugagacu

SEQ ID NO: 202704 - RNA, 64 nt, Human
ggcagagguagcagugagcugaagucccgccacugcacuccagccugggcaacagagcgagacu

SEQ ID NO: 202705 - RNA, 64 nt, Human
auucagagcucaaaacaaggcgagcuugaguucugcacuccagauaugugccaaaacuaguaaa

SEQ ID NO: 202706 - RNA, 64 nt, Human
acagcgagacccccagcggcagaggccucccucggcacuccaggcuuauaauuucgaacucuuc

SEQ ID NO: 202707 - RNA, 64 nt, Human
gguggagguugcagugagcagagaucacgcaacugcacuccagcuugggcaacagagugagacu

SEQ ID NO: 202708 - RNA, 64 nt, Human
ggcggagguugcagugagcugagauaacgccacugcacuccaguguaggcaacagagugagacc

SEQ ID NO: 202709 - RNA, 64 nt, Human
cccuucguccaaggcaccggugugugugugucuugcacuccagagcugaccuccaccgcccagc

SEQ ID NO: 202710 - RNA, 64 nt, Human
gguggagcuugcagugagccgagauaucgccacugcacuccagccugggugacagagcgagacu

SEQ ID NO: 202711 - RNA, 64 nt, Human
ggcagagguuguagugagcugagaucgcaccacugcacuccagccugggcaacauagcaaaauc

SEQ ID NO: 202712 - RNA, 64 nt, Human
ggcagagcuugcggugagccgagauugcgcuacugcacuccagccugggcgacaguaccagacu

SEQ ID NO: 202713 - RNA, 64 nt, Human
ggcggagguuacagugagcugagaucgugccacugcacuccagccugggugacagagugagacc

SEQ ID NO: 202714 - RNA, 64 nt, Human
uguccauauuccacauuugcugacugugcucccugcacuccacucaaguugagaguucaaauag

SEQ ID NO: 202715 - RNA, 64 nt, Human
gguggagguugcagugagcugagcucaugcgacugcacuccagccugggugacugagcaagacu

SEQ ID NO: 202716 - RNA, 64 nt, Human
ggcagagcuugcagugagccaagaucgcgccacugcacuccagccugggugacagagcgagacu

SEQ ID NO: 202717 - RNA, 64 nt, Human
guuggagguugcagugagcuaagacugcaccacugcacuccagccuggugacagaacgagacuc

SEQ ID NO: 202718 - RNA, 64 nt, Human
gaugcaggcugcagugggcugugauugugccacugcacuccagccugggcaccaaugugagaac

SEQ ID NO: 202719 - RNA, 64 nt, Human
ggcggagguugcagugagcugagauugcgccauugcacuccagccugggcaacaagagcaaaau

SEQ ID NO: 202720 - RNA, 64 nt, Human
ggcggagguugcagugagccaagaucgcgccacugcacuccagccuggcaauagggcgagacuc

SEQ ID NO: 202721 - RNA, 64 nt, Human
cacggagguugcagugagcuaagaucaugccaucgcacuccagccugggggacaaaagugagac

SEQ ID NO: 202722 - RNA, 64 nt, Human
ggcggagguuguagugagcugagaucgugccacugcacuccagccugggcaacagagccagacu

SEQ ID NO: 202723 - RNA, 64 nt, Human
caacacagugaagaccccagccaccucuaccugugcacuccaaccccuucacacccaccccucu

SEQ ID NO: 202724 - RNA, 64 nt, Human
ggcagagauugcggugagccaagauggcaccacugcacuccagccuaggugacagagugagacu

SEQ ID NO: 202725 - RNA, 64 nt, Human
gguggagguugcagugagccgagaucacgccauugcacuccagccugggcaacagagcaagacu

SEQ ID NO: 202726 - RNA, 64 nt, Human
guuugagguuguagggagcuaugaucuugccauugcacuccagcugagagugugacccugucuc

SEQ ID NO: 202727 - RNA, 64 nt, Human
gacauagguugcaguguaaugggaucacgccacugcacuccagcuugggugacaaaguaagacc

SEQ ID NO: 202728 - RNA, 64 nt, Human
gguggagguugcggugagccaagauugcgccacugcacuccagccugggcaaacagagggagac

SEQ ID NO: 202729 - RNA, 64 nt, Human
ggcagagguugcagcgagcugagaucgcgccacugcacuccagccugggugauagagugagauu

SEQ ID NO: 202730 - RNA, 64 nt, Human
gguggagguugcagcgagccaagaucgcaccacugcacuccagccugggugacagagcgagaau

SEQ ID NO: 202731 - RNA, 64 nt, Human
aacugacaguguagcauuguucuugauuaguuuggcacuccauuacguggaggcagcacagugc

SEQ ID NO: 202732 - RNA, 64 nt, Human
ggauccagggcagcaggccagagaaagcaaaggugcacuccagacucuggggguggacaucuga

SEQ ID NO: 202733 - RNA, 64 nt, Human
agcggagguugcagugagccgagaucgugccuuugcacuccagcguggaagacagugagacucc

SEQ ID NO: 202734 - RNA, 64 nt, Human
ggcggaggcugcagugggccgggaucguacuacugcacuccagcauggaagacagcgagacucc

SEQ ID NO: 202735 - RNA, 64 nt, Human
gguggagguugcagugagccgagauugugccacugcacuccaaccugggugacagagugagauu

SEQ ID NO: 202736 - RNA, 64 nt, Human
aaaugcuguugcuucagguucuuaaaaucacucagcacuccaacuucuaaucaaauuuuuggag

SEQ ID NO: 202737 - RNA, 64 nt, Human
ggcagagcuugcagugagccgagaucucgccacugcacuccagccugggcaacagagcaagacu

SEQ ID NO: 202738 - RNA, 64 nt, Human
acuuuugacccaccccuuccuggaucacuccuuugcacuccacuccccucguucugucacuuug

SEQ ID NO: 202739 - RNA, 64 nt, Human
ggcagaggcugcaguaagccgagaucgugccacugcacuccagccugggccacagagcaagacu

SEQ ID NO: 202740 - RNA, 64 nt, Human
gguggugguugcagugagccaagaucacaccauugcacuccagccugggugacagagugagacu

SEQ ID NO: 202741 - RNA, 64 nt, Human
guuugagucugcagugagcuaugaucaugccacugcacuccagucugggugacagcaagacccu

SEQ ID NO: 202742 - RNA, 64 nt, Human
guuggagguugcagugagccaagaucuugccauugcacuccagccugggcaacaagagugaaau

SEQ ID NO: 202743 - RNA, 64 nt, Human
gguggagguugcaaugagccgagaucacaccacugcacuccagccugggcaacagugaaacucc

SEQ ID NO: 202744 - RNA, 64 nt, Human
gauggagguuucagugagccaagaucacaccacugcacuccagccuggcaacagagcgagacuc

SEQ ID NO: 202745 - RNA, 64 nt, Human
ggcagagguugcggugagccaagagcgcaccauugcacuccagccugggcgacaaaaacgaaac

SEQ ID NO: 202746 - RNA, 64 nt, Human
ggucaaggcugcagugagcugugaugacaccacugcacuccaaccuagguaacagagagacacc

SEQ ID NO: 202747 - RNA, 64 nt, Human
ggucgaggcugcagugagucaugauuguaugacugcacuccagccugggugacagagcaagacc

SEQ ID NO: 202748 - RNA, 64 nt, Human
gagcccccuggauguccccugucccaccaacucugcacuccauggccaccccgugccacccgua

SEQ ID NO: 202749 - RNA, 64 nt, Human
gguugaggcugcagugagcccugauugugccagugcacuccagccuggacgacagagcaagacc

SEQ ID NO: 202750 - RNA, 64 nt, Human
gguggagguugcagugagccaagacuacgccacugcacuccagccuggaggccagagugagacu

SEQ ID NO: 202751 - RNA, 64 nt, Human
ugggagguggagguugcaguaagcugagaucgcugcacuccagccugggcgacaagagcgagac

SEQ ID NO: 202752 - RNA, 62 nt, Human
agcaagaagggacuguuucuaggugggcugggcgcgagcagggacugucccgagcgguauag

SEQ ID NO: 202753 - RNA, 62 nt, Human
cccgcacgcugggcaccaacagagccacggagcgcgagcacaugcccgcccggggagcacaa

SEQ ID NO: 202754 - RNA, 62 nt, Human
acccugacacuggcauuuagcagcaguggaaccgcgagcaagucccuuccuuuuagagcgug

SEQ ID NO: 202755 - RNA, 62 nt, Human
uggcugcccguguuaaugaaggacagcgcuuccgcgagcacccugggaacugggucuugggu

SEQ ID NO: 202756 - RNA, 62 nt, Human
cccagcuuuccgccugcacccgcgaggacgcgcgcgagcacacgcggcgccccgccaggccu

SEQ ID NO: 202757 - RNA, 62 nt, Human
agagauuaaaccaauuauaacuuauuagcagucgcgagcacauguucauauagucaauguaa

SEQ ID NO: 202758 - RNA, 62 nt, Human
cuggggucucuccaccccagagucucaggcaccgcgagcauucccauguacccuggggcacc

SEQ ID NO: 202759 - RNA, 62 nt, Human
ccucagcccaccgccaguacucucccagcaaccgcgagcaauuucuugggaccaaagucaau

SEQ ID NO: 202760 - RNA, 62 nt, Human
ggccaaguugcccacccugcggagcuaggaggcgcgagcagagaacguguguguuaggagaa

SEQ ID NO: 202761 - RNA, 62 nt, Human
gccgggaccgggaucgugaccgugaccgugaccgcgagcacaaacggggggagcggggcagu

SEQ ID NO: 202762 - RNA, 62 nt, Human
agccucaacugcugagcgcccccacucccggccgcgagcaggcagggcuucggggacgcggg

SEQ ID NO: 202763 - RNA, 62 nt, Human
gcggacgugagcuuccacugcggcugcagagacgcgagcaaccucuucucaucggcucuuau

SEQ ID NO: 202764 - RNA, 62 nt, Human
gccggggaagccugcgugugccccuuucagagacggagcaccugagaugugggaggugcagc

SEQ ID NO: 202765 - RNA, 62 nt, Human
ucccaagccccuggccacucuaagcugggcagacggagcacgagcaccuauucaaggcacug

SEQ ID NO: 202766 - RNA, 62 nt, Human
gugcacaugguuuaaaggccaguccaaacaccacggagcauuuggcaaucaaggccccagag

SEQ ID NO: 202767 - RNA, 62 nt, Human
gcacugcugaggguuugccgugcacgccucggacggagcacggugggguggcggggagcaga

SEQ ID NO: 202768 - RNA, 62 nt, Human
acugcauggacccuggugaguggcuuccccagacggagcacuguguccaucugaccccaaag

SEQ ID NO: 202769 - RNA, 62 nt, Human
aagggguugugaguguggucagcggccuggggacggagcacugugcagccggggagcugagg

SEQ ID NO: 202770 - RNA, 62 nt, Human
cuucaauauuuaaaauguuucuuacaauacccacggagcacuuuuaugguuccagccgagcg

SEQ ID NO: 202771 - RNA, 62 nt, Human
cuaggaucugccccugcauuguagcuugcuuaacggagcacuucuccuuuuuccaaaggucu

SEQ ID NO: 202772 - RNA, 62 nt, Human
gcucaguguguuacugguuuaaggauagacauacggagcagaauaaagaguacagauaugaa

SEQ ID NO: 202773 - RNA, 62 nt, Human
uaaaacuguuuccugaacaauaagauguaugaacggagcagaaauaaauacuuuuucuaauu

SEQ ID NO: 202774 - RNA, 62 nt, Human
cauguaauuauucuuagaauugagauugcuacacggagcaguccuugacgaucguguuucug

SEQ ID NO: 202775 - RNA, 62 nt, Human
acuuggcuaagcuucagguguaaacuguggucacggagcaaaaacauuaaccagcugcccag

SEQ ID NO: 202776 - RNA, 62 nt, Human
ucuccgcaguuggcuuccucgguagcuuccacacggagcaugcccgagagccuggacagccc

SEQ ID NO: 202777 - RNA, 62 nt, Human
aauaaaucaacagucugaaaaccuaagcagacacggagcauuauccggaucagccacacacg

SEQ ID NO: 202778 - RNA, 62 nt, Human
cccaggauaaguagaaauaugaucacagagcaacggagcaaaggcuuucgggagugugaggc

SEQ ID NO: 202779 - RNA, 62 nt, Human
aaugauucccucugguccugcauaugcagaggacggagcaggcucagcccccuggaagauga

SEQ ID NO: 202780 - RNA, 62 nt, Human
gaagagaaggcgguggccugugggugaggggaacggagcaggcucaggcagaauugaguacg

SEQ ID NO: 202781 - RNA, 62 nt, Human
cuaaauaacuuaaaaaaaaacugaggcguacaacggagcaacaauaucgguucucagugucu

SEQ ID NO: 202782 - RNA, 62 nt, Human
acaguuauuaguuaaaucaaauguucaaaaauacggagcagugccuaguaucuggagagcag

SEQ ID NO: 202783 - RNA, 62 nt, Human
aaacuggaauaucgccuuaaaaaucaaacugcacggagcaagcugaaacugagacaagauua

SEQ ID NO: 202784 - RNA, 62 nt, Human
acaagcacauggcaaucucaaggcagcuuuccacggagcaggcuguucugcaagagucgcug

SEQ ID NO: 202785 - RNA, 62 nt, Human
gaggaaaccccuuccugggccugcugcccuccacggagcagcagcacccuccagcaggcagc

SEQ ID NO: 202786 - RNA, 62 nt, Human
cagcccagcauacaggaggaucaaaggaggugacggagcaucguggcacggcagucucaaug

SEQ ID NO: 202787 - RNA, 62 nt, Human
guguacuuuguagaugugaaugguacuauucaacggagcacaaucacauguuagcauuuggu

SEQ ID NO: 202788 - RNA, 62 nt, Human
cuguguucgagccacuacacuccagccuggggacggagcaaaacuuugccucaaaacaaauu

SEQ ID NO: 202789 - RNA, 62 nt, Human
aggcauugucucauuuuucaaugucacaaaccacggagcacucaucuacaaguucucuggau

SEQ ID NO: 202790 - RNA, 62 nt, Human
guguggggcuggagccaggcagcuagcccaggacggagcaagggaagaccccuccccagccc

SEQ ID NO: 202791 - RNA, 62 nt, Human
cauccccuccccagacugccugcugucaaaccacggagcagcuggagccugcccuguccacg

SEQ ID NO: 202792 - RNA, 64 nt, Human; identical to SEQ ID NO: 20268

SEQ ID NO: 202793 - RNA, 64 nt, Human; identical to SEQ ID NO: 20269

SEQ ID NO: 202794 - RNA, 62 nt, Human
aauucgcucguggucauugaauagagcaauaaacggagcauuuugagcaaaacuaaccuccu

SEQ ID NO: 202795 - RNA, 62 nt, Human
ccucccaggccgcacagguccugccaagccucacggagcacgggggagucugugguggccag

SEQ ID NO: 202796 - RNA, 62 nt, Human
aaccccugcccaccaggauugcuggaagugugacggagcaggcgggcugaggagaguggaaa

SEQ ID NO: 202797 - RNA, 62 nt, Human
ucccacccagcucuuuggauucacugaacgguacggagcaguguucucaucccgggagcagc

SEQ ID NO: 202798 - RNA, 62 nt, Human
gccaaaccgaaggauuucugaggaccuaaaucacggagcaucaaucuuacaaaguguugguc

SEQ ID NO: 202799 - RNA, 62 nt, Human
cauuccauauucaucuccaacuacacaggggaacggagcagauagagcugcgacugggaagc

SEQ ID NO: 202800 - RNA, 62 nt, Human
uagaauauauaauagcaguagcagcucuguuuacggagcauuaaccuuacguggaguuauuu

SEQ ID NO: 202801 - RNA, 62 nt, Human
ugauaccagcuccucccugccgugccccugccacggagcaggcauugugaacuggcuggugu

SEQ ID NO: 202802 - RNA, 62 nt, Human
ucugcagaggccgcccaggugcugggaauggcacggagcagagacucaggaacacuugauga

SEQ ID NO: 202803 - RNA, 62 nt, Human
uugucucuugccugccacugugugaaucggcgacggagcacugcaccugccuccagccgccg

SEQ ID NO: 202804 - RNA, 62 nt, Human
agacuuuucuuucgagcagcagaacuucguuuacggagcacagucauaaguggagguucagg

SEQ ID NO: 202805 - RNA, 62 nt, Human
ugcaugugcaugugugugagcuccuugaacgcacggagcaaaauaaaauuuucuuagcuaau

SEQ ID NO: 202806 - RNA, 62 nt, Human
auugucacuugcaucuucacaaaggauaaaccacggagcaacuggaaaaccaucagccaagc

SEQ ID NO: 202807 - RNA, 62 nt, Human
cuccugaaaugauaaaucagggaacuaaccaaacggagcagaauggucaagugaugaauauu

SEQ ID NO: 202808 - RNA, 62 nt, Human
ccucccucaccgucuggggcucuucugggagcacggagcauccccuguuccuguuucacucu

SEQ ID NO: 202809 - RNA, 62 nt, Human
acuuccagucacccgggccuugcauauaaauaacggagcauacagugagcacaucuagcuga

SEQ ID NO: 202810 - RNA, 62 nt, Human
ggaggacagguggacaugguccugagcucuggacggagcaggcacccugaucucauucugag

SEQ ID NO: 202811 - RNA, 62 nt, Human
ggucaagcaagacacagucgcgcccccucggaacggagcagggacacgcccuucagagcccg

SEQ ID NO: 202812 - RNA, 62 nt, Human
cgcugguggccucccguacaaacuuggacaacacggagcagggagagcucaccauggaauga

SEQ ID NO: 202813 - RNA, 62 nt, Human
guugagagcggggaugugacaugcccaaggccacggagcaguucagaguggaggcgggcuug

SEQ ID NO: 202814 - RNA, 62 nt, Human
cucagggucacaguugagucauuugccaguugacggagcaaguuugaccuugguucuguugc

SEQ ID NO: 202815 - RNA, 62 nt, Human
uucuuuauagcagugugagaaugggcuaauacacggagcaagcauuguuucuuuucauuugu

SEQ ID NO: 202816 - RNA, 62 nt, Human
uucuaugagaaacccagggucucugcuuuaccacggagcagggucaccaacccagaucucca

SEQ ID NO: 202817 - RNA, 62 nt, Human
ccugguaaccagcccaucagcacacggcucccacggagcaucucagaagauugggccgccuc

SEQ ID NO: 202818 - RNA, 62 nt, Human
agaggggcuccuguucugccguggagcugcccacggagcaccucacagaagauugagaaagu

SEQ ID NO: 202819 - RNA, 62 nt, Human
gaccuucuugauagcucccugcacuuuggaacacggagcagaugagagagggucggggcuug

SEQ ID NO: 202820 - RNA, 62 nt, Human
uuuauaugugcccacaacagagguggggagacacggagcacccuggguccuucccagcgcug

SEQ ID NO: 202821 - RNA, 64 nt, Human; identical to SEQ ID NO: 20270

SEQ ID NO: 202822 - RNA, 64 nt, Human; identical to SEQ ID NO: 20271

SEQ ID NO: 202823 - RNA, 64 nt, Human; identical to SEQ ID NO: 20272

SEQ ID NO: 202824 - RNA, 54 nt, Human; identical to SEQ ID NO: 20273

SEQ ID NO: 202825 - RNA, 64 nt, Human; identical to SEQ ID NO: 20274

SEQ ID NO: 202826 - RNA, 59 nt, Human; identical to SEQ ID NO: 20275

SEQ ID NO: 202827 - RNA, 64 nt, Human; identical to SEQ ID NO: 20276

SEQ ID NO: 202828 - RNA, 64 nt, Human; identical to SEQ ID NO: 20277

SEQ ID NO: 202829 - RNA, 64 nt, Human; identical to SEQ ID NO: 20278

SEQ ID NO: 202830 - RNA, 64 nt, Human; identical to SEQ ID NO: 20279

SEQ ID NO: 202831 - RNA, 64 nt, Human; identical to SEQ ID NO: 20280

SEQ ID NO: 202832 - RNA, 64 nt, Human; identical to SEQ ID NO: 20281

SEQ ID NO: 202833 - RNA, 59 nt, Human; identical to SEQ ID NO: 20282

SEQ ID NO: 202834 - RNA, 64 nt, Human; identical to SEQ ID NO: 20283

SEQ ID NO: 202835 - RNA, 64 nt, Human; identical to SEQ ID NO: 20284

SEQ ID NO: 202836 - RNA, 64 nt, Human; identical to SEQ ID NO: 20285

SEQ ID NO: 202837 - RNA, 64 nt, Human; identical to SEQ ID NO: 20286

SEQ ID NO: 202838 - RNA, 64 nt, Human; identical to SEQ ID NO: 20287

SEQ ID NO: 202839 - RNA, 64 nt, Human; identical to SEQ ID NO: 20288

SEQ ID NO: 202840 - RNA, 64 nt, Human; identical to SEQ ID NO: 20289

SEQ ID NO: 202841 - RNA, 64 nt, Human; identical to SEQ ID NO: 20290

SEQ ID NO: 202842 - RNA, 64 nt, Human; identical to SEQ ID NO: 20291

SEQ ID NO: 202843 - RNA, 64 nt, Human; identical to SEQ ID NO: 20292

SEQ ID NO: 202844 - RNA, 64 nt, Human; identical to SEQ ID NO: 20293

SEQ ID NO: 202845 - RNA, 64 nt, Human; identical to SEQ ID NO: 20294

SEQ ID NO: 202846 - RNA, 64 nt, Human; identical to SEQ ID NO: 20295

SEQ ID NO: 202847 - RNA, 64 nt, Human; identical to SEQ ID NO: 20296

SEQ ID NO: 202848 - RNA, 64 nt, Human; identical to SEQ ID NO: 20297

SEQ ID NO: 202849 - RNA, 64 nt, Human; identical to SEQ ID NO: 20298

SEQ ID NO: 202850 - RNA, 64 nt, Human; identical to SEQ ID NO: 20299

SEQ ID NO: 202851 - RNA, 64 nt, Human; identical to SEQ ID NO: 20300

SEQ ID NO: 202852 - RNA, 64 nt, Human; identical to SEQ ID NO: 20301

SEQ ID NO: 202853 - RNA, 64 nt, Human; identical to SEQ ID NO: 20302

SEQ ID NO: 202854 - RNA, 64 nt, Human; identical to SEQ ID NO: 20303

SEQ ID NO: 202855 - RNA, 64 nt, Human; identical to SEQ ID NO: 20304

SEQ ID NO: 202856 - RNA, 64 nt, Human; identical to SEQ ID NO: 20305

SEQ ID NO: 202857 - RNA, 64 nt, Human; identical to SEQ ID NO: 20306

SEQ ID NO: 202858 - RNA, 64 nt, Human; identical to SEQ ID NO: 20307

SEQ ID NO: 202859 - RNA, 64 nt, Human; identical to SEQ ID NO: 20308

SEQ ID NO: 202860 - RNA, 55 nt, Human; identical to SEQ ID NO: 20309

SEQ ID NO: 202861 - RNA, 60 nt, Human; identical to SEQ ID NO: 20310

SEQ ID NO: 202862 - RNA, 64 nt, Human; identical to SEQ ID NO: 20311

SEQ ID NO: 202863 - RNA, 64 nt, Human; identical to SEQ ID NO: 20312

SEQ ID NO: 202864 - RNA, 57 nt, Human; identical to SEQ ID NO: 20313

SEQ ID NO: 202865 - RNA, 64 nt, Human; identical to SEQ ID NO: 20314

SEQ ID NO: 202866 - RNA, 64 nt, Human; identical to SEQ ID NO: 20315

SEQ ID NO: 202867 - RNA, 64 nt, Human; identical to SEQ ID NO: 20316

SEQ ID NO: 202868 - RNA, 64 nt, Human; identical to SEQ ID NO: 20317

SEQ ID NO: 202869 - RNA, 64 nt, Human; identical to SEQ ID NO: 20318

SEQ ID NO: 202870 - RNA, 64 nt, Human; identical to SEQ ID NO: 20319

SEQ ID NO: 202871 - RNA, 64 nt, Human; identical to SEQ ID NO: 20320

SEQ ID NO: 202872 - RNA, 64 nt, Human; identical to SEQ ID NO: 20321

SEQ ID NO: 202873 - RNA, 64 nt, Human; identical to SEQ ID NO: 20322

SEQ ID NO: 202874 - RNA, 64 nt, Human; identical to SEQ ID NO: 20323

SEQ ID NO: 202875 - RNA, 64 nt, Human; identical to SEQ ID NO: 20324

SEQ ID NO: 202876 - RNA, 64 nt, Human; identical to SEQ ID NO: 20325

SEQ ID NO: 202877 - RNA, 64 nt, Human; identical to SEQ ID NO: 20326

SEQ ID NO: 202878 - RNA, 64 nt, Human; identical to SEQ ID NO: 20327

SEQ ID NO: 202879 - RNA, 64 nt, Human; identical to SEQ ID NO: 20328

SEQ ID NO: 202880 - RNA, 64 nt, Human; identical to SEQ ID NO: 20329

SEQ ID NO: 202881 - RNA, 64 nt, Human; identical to SEQ ID NO: 20330

SEQ ID NO: 202882 - RNA, 64 nt, Human; identical to SEQ ID NO: 20331

SEQ ID NO: 202883 - RNA, 59 nt, Human; identical to SEQ ID NO: 20282

SEQ ID NO: 202884 - RNA, 64 nt, Human; identical to SEQ ID NO: 20333

SEQ ID NO: 202885 - RNA, 64 nt, Human; identical to SEQ ID NO: 20334

SEQ ID NO: 202886 - RNA, 64 nt, Human
ggggcggugaccccagccucgcccgacagagcccggggcgcaggcgggcgccagggcgcuaauc

SEQ ID NO: 202887 - RNA, 64 nt, Human
cagagucuggcucugucgcccaggcuggagugcaggggcgcaaucucggcucauagcaagcucc

SEQ ID NO: 202888 - RNA, 64 nt, Human
uggagucagcccugcuuccccuccccaccagcagggggcgcacuggugucugacacuaaggagg

SEQ ID NO: 202889 - RNA, 55 nt, Human
augccucuccgacccacugaugcugggggcgcaggacucggucaagggaggggca

SEQ ID NO: 202890 - RNA, 64 nt, Human
guggucaucugccacgagggcgacccggccuggcggggcgcagugcuguccaacaaggaagagc

SEQ ID NO: 202891 - RNA, 64 nt, Human
cauccugcaguugggccagcugucgcaucucagcggggcgcacauguuauccacaagcaaugga

SEQ ID NO: 202892 - RNA, 64 nt, Human
cugaccuuuccacgagugucacaugggaauguguggggcgcaggggcgggugcggagagagcac

SEQ ID NO: 202893 - RNA, 64 nt, Human
cagcgaguggcuacaggaugggguguccgggcccggggcgcacggcccgcacgacgccuuccgc

SEQ ID NO: 202894 - RNA, 64 nt, Human
cccagcgaggggcagacuggcucuggccucagguggggcgcaggagagccaggggaaaagugcc

SEQ ID NO: 202895 - RNA, 64 nt, Human
caugcucuucgagaagugcgaggugaacggugcgggggcgcacccucucuucgccuuccugcgg

SEQ ID NO: 202896 - RNA, 50 nt, Human
caccugagguggucaugugaggggcgcauuccuccagcgccaagcgucag

SEQ ID NO: 202897 - RNA, 64 nt, Human
ggggaggugggugacaaagauaggaccccgggagggggcgcagguacaugcuaguuucaauuac

SEQ ID NO: 202898 - RNA, 64 nt, Human
agguuuuagugaugggucuugcugggugcuguguggggcgcauauuggagaaggguaaugccag

SEQ ID NO: 202899 - RNA, 64 nt, Human
gccaggggcugaggaaggccggacccagguuccaggggcgcaggcagugcggcuuuuggcugug

SEQ ID NO: 202900 - RNA, 64 nt, Human
cuuucgggacaccagugcgcaagcuggcccacguggggcgcagccagacucgcccgacggccac

SEQ ID NO: 202901 - RNA, 64 nt, Human
gacccggggcucagcccaugcccaggccucggccggggcgcagcgaucccccaaagccagcgcc

SEQ ID NO: 202902 - RNA, 64 nt, Human
ggcgcaaaaucguuaggucccaggagagaaugugggggcgcaaacccuuuuccucccagccuau

SEQ ID NO: 202903 - RNA, 64 nt, Human
aagagcaaaauccaaauucaaagaaacagggcguggggcgcacuuuuaaaagagaaagcgagac

SEQ ID NO: 202904 - RNA, 64 nt, Human
gugcuccucugcucccucuuuuucucccuucucuggggcgcaggagggagaaguugcuaagugc

SEQ ID NO: 202905 - RNA, 64 nt, Human
augugggugcacaaacguggguguugguguggacggggcgcagaucuccguggaugaacugcgu

SEQ ID NO: 202906 - RNA, 64 nt, Human
cuguggcagagccacugucacacagaaugccggaggggcgcagagcagauccaggccccagaaa

SEQ ID NO: 202907 - RNA, 64 nt, Human
ccgaaugaucagcaguuccagccccucgcugcugggggcgcaaccaccccuuccuuagguugau

SEQ ID NO: 202908 - RNA, 64 nt, Human
ugcuccguggcucccucgugucccgcgucugaugggggcgcagggccgugcgcacuguguuccg

SEQ ID NO: 202909 - RNA, 64 nt, Human
cccggccaaggacccaggcgcugcauacaggggaggggcgcaccccacagcuggggccgguuuu

SEQ ID NO: 202910 - RNA, 64 nt, Human
cugacgcccuggggguuccuguccaaccccagcaggggcgcagcgggaccagccccacauucca

SEQ ID NO: 202911 - RNA, 64 nt, Human
ugacagcuucccccuaaucaggaggggacagcugggggcgcaagcuggugugucaucagcaaag

SEQ ID NO: 202912 - RNA, 50 nt, Human
aguacgcggucaaggccugaggggcgcauugucaauaaagcacagcuggc

SEQ ID NO: 202913 - RNA, 64 nt, Human
aggagcagacgccgggauccaggagaaugcucgaggggcgcagagggcagcucccagaccggag

SEQ ID NO: 202914 - RNA, 64 nt, Human
ccggccuccugccacccgggggugccgacgcccuggggcgcagacuuccccgagccgucgcuga

SEQ ID NO: 202915 - RNA, 64 nt, Human
gggaccucagaaacuggacuccugcauguccuugggggcgcagcccuguggugcucaggcagag

SEQ ID NO: 202916 - RNA, 64 nt, Human
aacauuauuuaccaagaaggacuuaagggaguagggggcgcagauuagcauugcucaagaguau

SEQ ID NO: 202917 - RNA, 64 nt, Human
gguagguggucgcucucagaccccacuguccaccggggcgcagaccccugacucggggacuugg

SEQ ID NO: 202918 - RNA, 64 nt, Human
gugguugugggugcaggugugugcagggguguggggggcgcagggguguggcuuagcuggcccc

SEQ ID NO: 202919 - RNA, 64 nt, Human
guuugagacagggucuugcucugucacccaggcuggggcgcaauggcacgaucuuggcucacug

SEQ ID NO: 202920 - RNA, 64 nt, Human
ugggaggugggaggggacgucuuauuaacaaacgggggcgcauagcuaucaccuguagcucccu

SEQ ID NO: 202921 - RNA, 64 nt, Human
gugacagggcccgcgcggcccccgacacgccccuggggcgcagagacaccggguuggcuugggg

SEQ ID NO: 202922 - RNA, 64 nt, Human
acucuuggagggagucugcgggcuucucugagaaggggcgcagccugacaccugugcugucccu

SEQ ID NO: 202923 - RNA, 64 nt, Human
ggccgccgagagcaaggcacaaccucgaguucuuggggcgcagagaacuuaggagagaagcacg

SEQ ID NO: 202924 - RNA, 64 nt, Human
gagaccccggcgcugccaccggaacccgccuucaggggcgcacgcgcgcugggaccaugcgucg

SEQ ID NO: 202925 - RNA, 64 nt, Human
acugugcagucagcauacccugagugauggcucaggggcgcacuaccuauuuugucaccagagc

SEQ ID NO: 202926 - RNA, 54 nt, Human
acagaggccggacagccugacccuggggcgcaacuggacaugccacuccccggc

SEQ ID NO: 202927 - RNA, 64 nt, Human
gcccgggaggagagugcauggugcagagggggcuggggcgcacggagaagcaggucccuauauu

SEQ ID NO: 202928 - RNA, 64 nt, Human
gcccaggaggcgacugcaugguggagagggagcuggggcgcauggggaagcaggucccuacuau

SEQ ID NO: 202929 - RNA, 64 nt, Human
ccacuaagccaacgugugugucagcugguagcugggggcgcagaggacaucaccuggggugcug

SEQ ID NO: 202930 - RNA, 64 nt, Human
ggccucucuguguccucugcaguggggguuguggggggcgcagcauccacgccuugcugcccuu

SEQ ID NO: 202931 - RNA, 64 nt, Human
cagcccgcuccgaaagcccaagaggcucucccggggggcgcagucggguccugagggccgggaa

SEQ ID NO: 202932 - RNA, 64 nt, Human
guugcagugagcugagaucacaccaaaaugggguggggcgcaguggcucacgccuguaauccca

SEQ ID NO: 202933 - RNA, 64 nt, Human
acuagccccgcgcgccaggcaggcggagcggggcggggcgcacaagcucggccccgccccggcu

SEQ ID NO: 202934 - RNA, 64 nt, Human
aaagaccucucgccucuacguggcaccuggaauuggggcgcacagggaggggccgaugcugcca

SEQ ID NO: 202935 - RNA, 64 nt, Human
gcugcuuggcuucugcuggaggugccucccugugggggcgcagccugccuccugcucucaguuc

SEQ ID NO: 202936 - RNA, 64 nt, Human
uaaaucucccuauuuuaaaauguuggcuccuagcggggcgcaguggcucacgccuguaauccca

SEQ ID NO: 202937 - RNA, 64 nt, Human
gugcugcuucccaucaccagcagcugcucgacaaggggcgcaggguggcugucuuuguuccagc

SEQ ID NO: 202938 - RNA, 64 nt, Human
ccgugcuguggccguguccgugccccggggguagggggcgcagaauggcgcuuccccuucuccu

SEQ ID NO: 202939 - RNA, 64 nt, Human
gcucucagaagucccggucccauguagauagaggggggcgcaucuuaccaaagcauuuccuccu

SEQ ID NO: 202940 - RNA, 64 nt, Human
ccugcccugcaccccccucgucagaaguacaugaggggcgcagagaugagcacacagcuuuggg

SEQ ID NO: 202941 - RNA, 64 nt, Human
cuuuguacaccgcgccgcggaagggggcuccgagggggcgcagccucaaacccugccuuuccuu

SEQ ID NO: 202942 - RNA, 64 nt, Human
gggaaagggcagggccaagaccgggcuugggagaggggcgcagcuaagacugggggcaggaugg

SEQ ID NO: 202943 - RNA, 64 nt, Human
uccuucaccagagaucucgccccucgugaugucaggggcgcaguagcuccgcccacguggagcu

SEQ ID NO: 202944 - RNA, 64 nt, Human
cgcgccuccugcgccccucccuucccuggggggaggggcgcaccccuuuuauccccggagcgcu

SEQ ID NO: 202945 - RNA, 64 nt, Human
ccagucaucgaggggguugggaagggagggagagggggcgcagcucgcaggcguggcaacuuga

SEQ ID NO: 202946 - RNA, 64 nt, Human
gcugaagcugcgucggcggcucacggagcuccugggggcgcaggacggggcgcugcuggugcgg

SEQ ID NO: 202947 - RNA, 64 nt, Human
gagacuugaaguaagcucaugguucaguacucugggggcgcagggcugcgcaggacccuuggaa

SEQ ID NO: 202948 - RNA, 64 nt, Human
cgcgcuucuuagaagaggagugagaggaaggcggggggcgcagcaacgcaucguguggcccucc

SEQ ID NO: 202949 - RNA, 64 nt, Human
gccugcgcugggcucgggagcucugucgcgaggaggggcgcaggaccauggacugggggugggg

SEQ ID NO: 202950 - RNA, 64 nt, Human
ccguggagacccugcagcuuggagcccguuccuuggggcgcagccugucagcauguccccgguc

SEQ ID NO: 202951 - RNA, 64 nt, Human
cugccuguagauggccggggaaggcucuagaaaaggggcgcauugcgauccaaccaucggcagc

SEQ ID NO: 202952 - RNA, 64 nt, Human
gcuuggagagccgggggcgcagcuuggagauccaggggcgcauggagaggccacggugccagag

SEQ ID NO: 202953 - RNA, 64 nt, Human
guucugagucccgggggcgcagcuuggagagccgggggcgcagcuuggagauccaggggcgcau

SEQ ID NO: 202954 - RNA, 56 nt, Human
ggcaggagaguguguucugagucccgggggcgcagcuuggagagccgggggcgcag

SEQ ID NO: 202955 - RNA, 63 nt, Human
ugcagacugaacagacguuuaucuaucccauuuggcgacgaggacucguggcuggagagagcc

SEQ ID NO: 202956 - RNA, 63 nt, Human
agaagcucgcuaccuguucucucuggucagcagggcgacgagggaagguuuccgacgcaggca

SEQ ID NO: 202957 - RNA, 63 nt, Human
ugccagcagagggagguagaagccaucauggagggcgacgaggaggacagaggcugcugcugc

SEQ ID NO: 202958 - RNA, 63 nt, Human
cugaaugacucugucuugugggugucugacaguggcgacgaugaacaugccguugguuuuauu

SEQ ID NO: 202959 - RNA, 63 nt, Human
ggugagaaggcguccacaaaagaggggagaaaaggcgacgaaucaggacacagugaacuuggg

SEQ ID NO: 202960 - RNA, 63 nt, Human
cuuccuaucguguccuuggguucgggucacugcggcgacgacuugcucagacugucccggcgg

SEQ ID NO: 202961 - RNA, 63 nt, Human
cugagacgcucgccccgacgcauggacccgagaggcgacgacacgagugaauaaagugcacau

SEQ ID NO: 202962 - RNA, 58 nt, Human; identical to SEQ ID NO: 118176

SEQ ID NO: 202963 - RNA, 63 nt, Human
cgacccuuggucuacagcacggguucucagucgggcgacgauuuggcugucuaggcgucauuu

SEQ ID NO: 202964 - RNA, 64 nt, Human
ccuuacuaagcugagagaugucauugcugcaggcaggacguauaggcacauguagguuugaaug

SEQ ID NO: 202965 - RNA, 64 nt, Human
gacuuguguauauggucauaggcuuugggaagacaggacguaaaggaaaaugagagaaacaaaa

SEQ ID NO: 202966 - RNA, 64 nt, Human
uggggcuucaagacaguaggugagagaugcugucaggacguaucuucuucauaccaaagucacu

SEQ ID NO: 202967 - RNA, 64 nt, Human
caaagagacagacuauuaacuccacaguuaauuaaggacguauguuccauguuuauuuguuaaa

SEQ ID NO: 202968 - RNA, 64 nt, Human
ggaaacuaagguuagaaacauuuugauuuccucuaggacguauagcuaggaaguguuacuaucu

SEQ ID NO: 202969 - RNA, 64 nt, Human
aaucaaaaucucuccacuuucagcugucuuuuggaggacguacguaauaagguuuuaauuuagu

SEQ ID NO: 202970 - RNA, 64 nt, Human
uugccaugucccccagacccugcuucugauacuaaggacguauccaggaguaccacaaccacca

SEQ ID NO: 202971 - RNA, 64 nt, Human
cacauaggcgagguugagcugcuggucccagcugaggacguacuggucagccuggcuguguggc

SEQ ID NO: 202972 - RNA, 64 nt, Human
agauuugugaauccuauaauacugcucaagcuggaggacguagaauuucacuggaucagcaaug

SEQ ID NO: 202973 - RNA, 64 nt, Human
auggaauuuuuucaucuuauacugagcuccagaaaggacguaacuuagcauggaucaccaauca

SEQ ID NO: 202974 - RNA, 54 nt, Human
cacgagaagagcuaggguaagagaaggacguaaacagaaccugacaccagcucc

SEQ ID NO: 202975 - RNA, 64 nt, Human
uuaaaauucucuuuggucauugagggaccaaaaaaggacguaaaauuuacagucaaucuaugag

SEQ ID NO: 202976 - RNA, 64 nt, Human
gucuaaaucuguaggcauuguguuguuguucuuuaggacguauuuauuuaacuugcacauuuuu

SEQ ID NO: 202977 - RNA, 64 nt, Human
cgggacaccagugaaacuugaaccgggaagugggaggacguagagcagagaagagaacauuuuu

SEQ ID NO: 202978 - RNA, 64 nt, Human
aagugcccaguucuugauuucuuagauacugaagaggacguagucauuucauuuaucaaauaua

SEQ ID NO: 202979 - RNA, 64 nt, Human
accugcagaguaaacaaucucagaaguaucgacuaggacguaaauagcaguuccuuauauaaag

SEQ ID NO: 202980 - RNA, 64 nt, Human
uuacuggaaaguuacccaauagcaugaggugaacaggacguaguuaggccuuccuguaaacaga

SEQ ID NO: 202981 - RNA, 64 nt, Human
agacugcaaaucaaugaagguauuggcauuguuaaggacguagcguagacaacagcagucauaa

SEQ ID NO: 202982 - RNA, 64 nt, Human
cuggauuuugcagauuuuccuguccaugcaagcaaggacguaaaauuaaaaaauuacaauuaaa

SEQ ID NO: 202983 - RNA, 64 nt, Human
ugaggugucggaacgcugaaagcaugaggaaacgaggacguagggugugacugaaugguggcua

SEQ ID NO: 202984 - RNA, 64 nt, Human
uuucaggagaagggagcauaaguuuacagccuacaggacguacacaauauccugcugcugggaa

SEQ ID NO: 202985 - RNA, 64 nt, Human
caguguggccagggguggccauguaagucccaucaggacguagucaugccuccugcauuucgcu

SEQ ID NO: 202986 - RNA, 64 nt, Human
aguaaauuaugauguccagggggagaaggaagauaggacguauuuauaauagguauauagaaca

SEQ ID NO: 202987 - RNA, 64 nt, Human
acgagaccucuuucguuccuucuagaaggucuggaggacguagaguuauugaaaaugcagaugg

SEQ ID NO: 202988 - RNA, 64 nt, Human
augagggacacuggccuggcccucgggucuucggaggacguagggggcuggcaugggugccgac

SEQ ID NO: 202989 - RNA, 64 nt, Human
ugugcgugcguggcugggggaggccuuuucuuugaggacguaccucauuuccuucuuucuucug

SEQ ID NO: 202990 - RNA, 64 nt, Human
agauaccaauagagagguuuucuuaauuaacaaaaggacguaugccauggagaaacacacccgc

SEQ ID NO: 202991 - RNA, 64 nt, Human
gcugagggggaucugguucggcugcugucggaugaggacguagcgcucauggugcggcaggcuc

SEQ ID NO: 202992 - RNA, 64 nt, Human; identical to SEQ ID NO: 202964

SEQ ID NO: 202993 - RNA, 64 nt, Human; identical to SEQ ID NO: 202965

SEQ ID NO: 202994 - RNA, 64 nt, Human; identical to SEQ ID NO: 202966

SEQ ID NO: 202995 - RNA, 64 nt, Human; identical to SEQ ID NO: 202967

SEQ ID NO: 202996 - RNA, 64 nt, Human; identical to SEQ ID NO: 202968

SEQ ID NO: 202997 - RNA, 64 nt, Human; identical to SEQ ID NO: 202969

SEQ ID NO: 202998 - RNA, 64 nt, Human; identical to SEQ ID NO: 202970

SEQ ID NO: 202999 - RNA, 64 nt, Human; identical to SEQ ID NO: 202971

SEQ ID NO: 203000 - RNA, 64 nt, Human; identical to SEQ ID NO: 202972

SEQ ID NO: 203001 - RNA, 64 nt, Human; identical to SEQ ID NO: 202973

SEQ ID NO: 203002 - RNA, 54 nt, Human; identical to SEQ ID NO: 202974

SEQ ID NO: 203003 - RNA, 64 nt, Human; identical to SEQ ID NO: 202975

SEQ ID NO: 203004 - RNA, 64 nt, Human; identical to SEQ ID NO: 202976

SEQ ID NO: 203005 - RNA, 64 nt, Human; identical to SEQ ID NO: 202977

SEQ ID NO: 203006 - RNA, 64 nt, Human; identical to SEQ ID NO: 202978

SEQ ID NO: 203007 - RNA, 64 nt, Human; identical to SEQ ID NO: 202979

SEQ ID NO: 203008 - RNA, 64 nt, Human; identical to SEQ ID NO: 202980

SEQ ID NO: 203009 - RNA, 64 nt, Human; identical to SEQ ID NO: 202981

SEQ ID NO: 203010 - RNA, 64 nt, Human; identical to SEQ ID NO: 202982

SEQ ID NO: 203011 - RNA, 64 nt, Human; identical to SEQ ID NO: 202983

SEQ ID NO: 203012 - RNA, 64 nt, Human; identical to SEQ ID NO: 202984

SEQ ID NO: 203013 - RNA, 64 nt, Human; identical to SEQ ID NO: 202985

SEQ ID NO: 203014 - RNA, 64 nt, Human; identical to SEQ ID NO: 202986

SEQ ID NO: 203015 - RNA, 64 nt, Human; identical to SEQ ID NO: 202987

SEQ ID NO: 203016 - RNA, 64 nt, Human; identical to SEQ ID NO: 202988

SEQ ID NO: 203017 - RNA, 64 nt, Human; identical to SEQ ID NO: 202989

SEQ ID NO: 203018 - RNA, 64 nt, Human; identical to SEQ ID NO: 202990

SEQ ID NO: 203019 - RNA, 64 nt, Human; identical to SEQ ID NO: 202991

SEQ ID NO: 203020 - RNA, 64 nt, Human
accagggucucucuuuaccuccuaccccaugguggcaccacagaggcccucagccgaguccugc

SEQ ID NO: 203021 - RNA, 62 nt, Human
gccagcuggccuccccuuuggcccacgccggccgcccccauucucugcugcguagaugcccu

SEQ ID NO: 203022 - RNA, 64 nt, Human; identical to SEQ ID NO: 200085

SEQ ID NO: 203023 - RNA, 64 nt, Human; identical to SEQ ID NO: 200086

SEQ ID NO: 203024 - RNA, 64 nt, Human
ccucgccagcccugcaguauugaugugcaguauugcaccacagcucugcggaccuuggccauug

SEQ ID NO: 203025 - RNA, 64 nt, Human
ggcugcugcucauccugggcaagcugauccugcugcaccacaagcacccagaacggaagcaggc

SEQ ID NO: 203026 - RNA, 64 nt, Human
cugaaccacuugcagguuccagguuuuacuggcugcaccacaccccuuccccuagaugacugcc

SEQ ID NO: 203027 - RNA, 64 nt, Human
ugcugccuuugccugguccuccagguugcugggggcaccacagacaucaagauuccaguucauc

SEQ ID NO: 203028 - RNA, 64 nt, Human
gcuaaugaacaaacccaguaugcaaguuauucuugcaccacaugcucaaaucuucuugaggugc

SEQ ID NO: 203029 - RNA, 64 nt, Human
acuaugugccaguggacucuucccuuauaucucugcaccacaaguuguuggauguuuccucuuc

SEQ ID NO: 203030 - RNA, 64 nt, Human
agcugggccuccaaguaggauaaccccucacugagcaccacauucucuagcuucuuguugaggc

SEQ ID NO: 203031 - RNA, 64 nt, Human
gugggcauagggcagcucagucccuggccucuuagcaccacauuccuguuuuucagcuuauuug

SEQ ID NO: 203032 - RNA, 64 nt, Human
uguguuuggccgaggccugugugauucccggucugcaccacauggcgggguuggggggccgcug

SEQ ID NO: 203033 - RNA, 64 nt, Human
cuacacuccccaucaggcagcaucccaccagccugcaccacaggcuccccugggaggacgaggg

SEQ ID NO: 203034 - RNA, 64 nt, Human
cuacuacucugccaaucggcuaccccucgacucagcaccacauugccucauuucuuccucugca

SEQ ID NO: 203035 - RNA, 64 nt, Human
aaaacaaaaaaaucaacgacagcaguagacacaggcaccacauuccuuugcagggugugagggu

SEQ ID NO: 203036 - RNA, 64 nt, Human
gguuugccccagagaucuaaauuccagaaggagggcaccacaccuaggaagguaaauccaguau

SEQ ID NO: 203037 - RNA, 64 nt, Human
gacacauuccccuugggcuuuuuguaacugaaacgcaccacagaagacagggagucaucgaagg

SEQ ID NO: 203038 - RNA, 64 nt, Human
gcuggaggaagaggaagauuugugcagaccaagagcaccacagacuacaacugcccagcuucau

SEQ ID NO: 203039 - RNA, 64 nt, Human
ccuuggcugagcaaagccauccccucaauucagggaagggcaaggagccuuccucauucaggaa

SEQ ID NO: 203040 - RNA, 64 nt, Human
gaaucaugggauagggaaggcccccauggggucagaagggcacgguaguucuugcaauuauuuu

SEQ ID NO: 203041 - RNA, 64 nt, Human; identical to SEQ ID NO: 200092

SEQ ID NO: 203042 - RNA, 64 nt, Human
auuacaggggauaaauguaagcuuguuaaaguaagcaccacaccauguuucugucuccccagca

SEQ ID NO: 203043 - RNA, 64 nt, Human
caguagagaaggccaagcaaccuccacuucuucagcaccacacacacgcacacacacacacacg

SEQ ID NO: 203044 - RNA, 64 nt, Human
guuuguuuuuuguuuuuuuucuugguaaagccaugcaccacagacuucugggcagagcugagag

SEQ ID NO: 203045 - RNA, 64 nt, Human
aauguuuacaaaaaugguuuuguuacacuaaugcgcaccacauauuuaugguuuauuuuaagug

SEQ ID NO: 203046 - RNA, 64 nt, Human
ggaggcccugcccugugcugcccaggggcugugugcaccacaugagcacauuucccucuggccu

SEQ ID NO: 203047 - RNA, 64 nt, Human
uuucacccugccuuuccacaggaagcacucacaggcaccacacacguaucauguaacuuaucag

SEQ ID NO: 203048 - RNA, 64 nt, Human
ccauacugcuuuuuuaccccugcacuauuucagugcaccacagaauaggauucgagauuuacau

SEQ ID NO: 203049 - RNA, 64 nt, Human
uuaagaugugcucaaaucaggacuuaaaucauaggcaccacauuuuucaugucagacuaguuac

SEQ ID NO: 203050 - RNA, 64 nt, Human
ucccgacccccagagcgcugguacacaggucuaggcaccacacagugcuuuggaaauucucagu

SEQ ID NO: 203051 - RNA, 64 nt, Human
cuucucuccccuccuucccacccuuuuuucaaaggcaccacaaguauagacaguugcacuacau

SEQ ID NO: 203052 - RNA, 64 nt, Human
uccgcccacagaccuccagggacaggagcaaauugcaccacagcuccccgccuggccuggcccu

SEQ ID NO: 203053 - RNA, 64 nt, Human
ccucagccucccaaauaacuggggccacaggugugcaccacaacucucagcuaauuuuuaaaau

SEQ ID NO: 203054 - RNA, 64 nt, Human
aaucagugcacaagaauugggcugguuaggcccagcaccacacugaagugggcucagugguuuu

SEQ ID NO: 203055 - RNA, 64 nt, Human
ccugggcacuggcugugugaagggaucuggcagggcaccacagcgcccccuacugaaccaucag

SEQ ID NO: 203056 - RNA, 64 nt, Human
gauucaccgcgugcucugcgcggccgaggccggagcaccacauccaccucgccccagagaggcu

SEQ ID NO: 203057 - RNA, 64 nt, Human
auugugucaagugcaaaacuacccuggcccaaaggaagggcagagaacauaauuacaucuuagg

SEQ ID NO: 203058 - RNA, 64 nt, Human
guggugguagagaagcaaguaaaaaggcuaaauggaagggcaaguuuccaucaucuauagaaag

SEQ ID NO: 203059 - RNA, 60 nt, Human
uugagaucaucaacuccuaagggcuggcaagaagggcacugugucuacugucccuauuaa

SEQ ID NO: 203060 - RNA, 64 nt, Human
gggugguggggacggcaguggugaugaagggggugcaccacaggccucaugaagcaguucccac

SEQ ID NO: 203061 - RNA, 64 nt, Human
ggugucagcuagcucuuuaauaggugcccucagggcaccacagggcugacugcacaaagcugga

SEQ ID NO: 203062 - RNA, 64 nt, Human
cggcugcucggcuugaucacagcucccuagguaggcaccacagagaagaccuucuagugagccu

SEQ ID NO: 203063 - RNA, 64 nt, Human
uucuaacuuucagaaaaugccauacucuguuuuggcaccacacauguauauuucccccugguac

SEQ ID NO: 203064 - RNA, 64 nt, Human
cauccuuaugcuuugcaaagcacccucaaaagcugcaccacagccuggagaauaaaauauccuc

SEQ ID NO: 203065 - RNA, 64 nt, Human
uuccucuucagccugccuggggugagaggucagugcaccacagccgaggcuggagcacagggag

SEQ ID NO: 203066 - RNA, 64 nt, Human
ggcggcacauuggcagugugucacacugagcugggcaccacaggcugccucaugacccuccugu

SEQ ID NO: 203067 - RNA, 64 nt, Human
uugcccaaggacuucuaacaauaaacucucuuuugcaccacagacuucuuugaaaauauacaug

SEQ ID NO: 203068 - RNA, 64 nt, Human
gccucagccucccaaguagcugggauuacaggcagcaccacaccuggcuaauuuucauauuuuu

SEQ ID NO: 203069 - RNA, 64 nt, Human
ccugggggugggggguggugggcagggaugggacgcaccacacagaacugugauuguggaucag

SEQ ID NO: 203070 - RNA, 64 nt, Human
uguaccaucacuaaaugcuuggaacaguacacaugcaccacaacaaaggcucaucaaacaggua

SEQ ID NO: 203071 - RNA, 64 nt, Human
gaggugauggugcagcaguggaacaucucuugaugcaccacacuacuuguguucugugaaguga

SEQ ID NO: 203072 - RNA, 64 nt, Human
auauauccauccugccuaacccugaguuuuuggagcaccacaguuguccugggaguugguugca

SEQ ID NO: 203073 - RNA, 64 nt, Human
cugauauuuugauaacaaucucuaauuugcaugggcaccacauuucuuauauuaaaagaauuag

SEQ ID NO: 203074 - RNA, 64 nt, Human
auguucacuuaaaugaaauugaaaacgccauguggcaccacaaaagagcucucuguacuuuccc

SEQ ID NO: 203075 - RNA, 64 nt, Human
aauuuuucucuaacucagaaacaucaguuacucugaagggcaucaugcaucuuacugaagguaa

SEQ ID NO: 203076 - RNA, 64 nt, Human
cagcacacagggaaaggaagacagucucacagaggaagggcagguguccuacgaugacgucucu

SEQ ID NO: 203077 - RNA, 64 nt, Human
cuuuggccugaaaguugggaaugguugggggagagaagggcagcagcuuauugguggucuuuuc

SEQ ID NO: 203078 - RNA, 64 nt, Human
uuccuucaggucacgcagcccuguacuguauccagcaccacagaaaccucaguguuuuuccucu

SEQ ID NO: 203079 - RNA, 64 nt, Human
uuuguucuaaucaccacgugaaggaaugagauuagcaccacaaguuucaugccaauaaaagaga

SEQ ID NO: 203080 - RNA, 64 nt, Human
aagagagggugagaaacauaaauaauccaagcuugcaccacauucagcauuaaucacuagguca

SEQ ID NO: 203081 - RNA, 64 nt, Human
aaaaauauuuacuguacuuuaucucacuacaacagcaccacaaccuucuuugauaugguagaag

SEQ ID NO: 203082 - RNA, 64 nt, Human
gccauuccccuucuacucaccgacaucccucccagcaccacacaccccgccccugaaaggagau

SEQ ID NO: 203083 - RNA, 64 nt, Human
uaguugucaugcgacagccugagaacgcugggcagcaccacacccuccaauucacacugccuuc

SEQ ID NO: 203084 - RNA, 64 nt, Human
aauuuauuguuuauacggaugacugggaggcacugcaccacaacguaggacccuggcuccccuu

SEQ ID NO: 203085 - RNA, 64 nt, Human
ucacugggccuccaaccauguucccuucuucuuagcaccacaaauaaucaaaacccaacaugac

SEQ ID NO: 203086 - RNA, 64 nt, Human
aacacuccuagggccuggcuucugucugaucaaggcaccacacaacccagaaaggagcugaugg

SEQ ID NO: 203087 - RNA, 64 nt, Human
ugaacgcacccgcugguuguggaccgucugccaggcaccacagugagcauuguguucuuggcau

SEQ ID NO: 203088 - RNA, 64 nt, Human
ccucucucugcuccaucccccugccucccauucugcaccacaccuggcauggugcagggagaca

SEQ ID NO: 203089 - RNA, 64 nt, Human
cugggaacagugccucugugcugguuauauguaugcaccacaugugcacacacggguguuggug

SEQ ID NO: 203090 - RNA, 61 nt, Human
acccuuggcuuaacuccuaagccccugcccagcaccacagcagagaucacacacugacccu

SEQ ID NO: 203091 - RNA, 64 nt, Human
cggguugaggaagucaggcuguuggcgugucccagcaccacaccaccccuaaagugccagguga

SEQ ID NO: 203092 - RNA, 64 nt, Human
uuagccucccaaagugcugggauuacaagcauaagcaccacaccuggcugaacaucagauauuu

SEQ ID NO: 203093 - RNA, 64 nt, Human
ucugccuaaagcauuccucagaacugucccauuugaagggcaagcaaaccugggguauuuaucc

SEQ ID NO: 203094 - RNA, 64 nt, Human
auaaagaggcaaagggucacagaaguguucagaagaagggcaaagauaagaacaauauuagcug

SEQ ID NO: 203095 - RNA, 64 nt, Human
ugcaaacuaggaauugcagucugaggaucauuuagaagggcaaguucaagaggauaugaagauu

SEQ ID NO: 203096 - RNA, 64 nt, Human
ucacugacugugcacugugcuuagagacccugccgcaccacagugccaaugcuugucagacaca

SEQ ID NO: 203097 - RNA, 64 nt, Human
gacauauuuagucuucagauauauuauuuuaaaggcaccacacauguaaaacaguuauuacaaa

SEQ ID NO: 203098 - RNA, 64 nt, Human
ggugagguaccgucuacauuucacauuauucugggcaccacaaaauauacaaaacuuuaucagg

SEQ ID NO: 203099 - RNA, 64 nt, Human
gcguccacgccugcacaucccggcgcacgugugggcaccacagaggacacgugaggggaauggu

SEQ ID NO: 203100 - RNA, 64 nt, Human
gagcaccccugcugguggcucuguccucuguuaggcaccacacugguuggucaacuuggauguu

SEQ ID NO: 203101 - RNA, 64 nt, Human
gagggccuugagucccccaaaacaccggguuccagcaccacacucagcccucauuggcucuuga

SEQ ID NO: 203102 - RNA, 64 nt, Human
aacccuaauugagagcugucuuggcuaauacucugcaccacaauugugauguccuaguccuacc

SEQ ID NO: 203103 - RNA, 64 nt, Human
gccaccaaaaaaaaaaaaaaaaaaaaaaaaaaaugcaccacaguauuucuagcaugggggcugu

SEQ ID NO: 203104 - RNA, 64 nt, Human
caccucuaguccggucugccgguggccuccagcagcaccacagagcuccagaccaaccacccca

SEQ ID NO: 203105 - RNA, 64 nt, Human
augcuucgcuguuagugucuucuuccugcccucagcaccacagcucaagaaaaccuaaaguuuc

SEQ ID NO: 203106 - RNA, 64 nt, Human
cuuuuauuagugcuuugccagaggcugaugucaagcaccacaccccaaccccagcgucucguga

SEQ ID NO: 203107 - RNA, 64 nt, Human
acuugggcugauccccacccuuucugggccuacagcaccacaggccgcuguacccccuuagagc

SEQ ID NO: 203108 - RNA, 64 nt, Human
uucuuuuaauuguucacagauuuuaaaagcgguagcaccacaugguuguguagaucagaccugu

SEQ ID NO: 203109 - RNA, 64 nt, Human
ccugauccacuugguuguggauuccuggagccuagcaccacaccagaagcacgaggcccuugag

SEQ ID NO: 203110 - RNA, 64 nt, Human
ccaccccaaaucaacagaauauacauucuucucagcaccacaucacacuuauuuccacauugac

SEQ ID NO: 203111 - RNA, 64 nt, Human
gguguuggaaaacagguugauuaaggcaacagcagaagggcagggcaaggcugagcucugagau

SEQ ID NO: 203112 - RNA, 64 nt, Human
aacccuuggcccaaggacuugguacaggaagggagaagggcaggugggcagggagcagacaggg

SEQ ID NO: 203113 - RNA, 64 nt, Human
gaaauuaagaucggguuccuuuucugccagcuuggaagggcaaccccaugacugauugcgauuc

SEQ ID NO: 203114 - RNA, 64 nt, Human
uucggaaugccugcuuaccucuuuuucuguagaggcaccacagggaggugggugaagcacuucg

SEQ ID NO: 203115 - RNA, 64 nt, Human
gauuugcgggagggcucuugaaccacuucuggcugcaccacaauucuguacuugaguaucacag

SEQ ID NO: 203116 - RNA, 64 nt, Human
cgggcucccaaagugcugggauuacagacgugaggcaccacaaccagccuggaugauucuuaag

SEQ ID NO: 203117 - RNA, 64 nt, Human
uuauagaugccaauccaaaaccucagaauuucaggcaccacaaaaacagguaauuuucuauccc

SEQ ID NO: 203118 - RNA, 64 nt, Human
ucccucuccugcugagaaccagaacccaccaggagcaccacagaguccuccucuuggaaggcag

SEQ ID NO: 203119 - RNA, 64 nt, Human
ggugaaggacaaguagguaagaggacgccuucaggcaccacagauaagccugaaacagccucuc

SEQ ID NO: 203120 - RNA, 64 nt, Human
ggaagacccggcuuugcccucacaagucuuaugggcaccacagggaacauccuggacuuaaaaa

SEQ ID NO: 203121 - RNA, 64 nt, Human
ucuaaagcccccccugucgucugcucuucacccagcaccacagaggcaccugcugcacacacaa

SEQ ID NO: 203122 - RNA, 64 nt, Human
uggggcugggcccuggguuuugagaaacucgcuggcaccacagugggccccuggacccggccgc

SEQ ID NO: 203123 - RNA, 64 nt, Human
uacuaccuuuuaaaauauuuuagauaaaugcacagcaccacagcaccacaucuaagcauuagug

SEQ ID NO: 203124 - RNA, 64 nt, Human
uuuaaaauauuuuagauaaaugcacagcaccacagcaccacaucuaagcauuagugauggguag

SEQ ID NO: 203125 - RNA, 64 nt, Human
gggcccaugugucuacaucaucaguuacugucaugcaccacauuugugugcagauaccaaaaga

SEQ ID NO: 203126 - RNA, 64 nt, Human
gcccccggaguaccacugggcgugggggguccuggcaccacaugcccgguguggccgagggcac

SEQ ID NO: 203127 - RNA, 64 nt, Human
uucgccugcgccugcccuugccccacuccugaaugcaccacaugccucugucuccccgcugagc

SEQ ID NO: 203128 - RNA, 50 nt, Human
agagcgccaugggggugugagcaccacaggcacccuggauggcccggccc

SEQ ID NO: 203129 - RNA, 64 nt, Human
ucacagaaaaacuccaaguuaacuucauguuuuggaagggcaggucguuuuuaaaguauuucuu

SEQ ID NO: 203130 - RNA, 64 nt, Human
uccauccugaagguguuuuucauucacuuuaauagaagggcaaauauuuauaagcuauuucugu

SEQ ID NO: 203131 - RNA, 64 nt, Human
uuacugugcugagagguacccagaagguucccaugaagggcagcauguccaagccccugacccc

SEQ ID NO: 203132 - RNA, 64 nt, Human
uaaggcccccugguuucucuggccacacuccaaggcaccacagugcugccagugaggacagcug

SEQ ID NO: 203133 - RNA, 64 nt, Human
ggguuaaaugaaaauaaaaagaaaaugugaaacagcaccacagguacuugacaaugauguugcu

SEQ ID NO: 203134 - RNA, 64 nt, Human
cugacuuucauuucuugagguacucugcacauacgcaccacaucucuaucuggccuuugcaugg

SEQ ID NO: 203135 - RNA, 64 nt, Human
accagcgccgcauguagggccauccugggauggggcaccacagggagggagggagaaaagaggu

SEQ ID NO: 203136 - RNA, 64 nt, Human
ccaccaguggccaccuguucaauaaaauugccuagcaccacaguggagagucaucuacacccca

SEQ ID NO: 203137 - RNA, 64 nt, Human
cagugugucagucccaggagugagggaguggcaagcaccacagauuaccacguauguguggaag

SEQ ID NO: 203138 - RNA, 64 nt, Human
cuauauauguauuaucaaauauguaagaauacaggcaccacauacugaugacaauaaucuauac

SEQ ID NO: 203139 - RNA, 64 nt, Human
ugggucucugugcggacggugacaauguuuacaagcaccacauuuacacauccacacacgcaca

SEQ ID NO: 203140 - RNA, 64 nt, Human
uggacagacaggccauggaggcagcacugagccagcaccacacguccauccugggacagacggg

SEQ ID NO: 203141 - RNA, 64 nt, Human
aaaaauaaccccuccauccaggauauggaauccagcaccacagugcacaggucagggcucggag

SEQ ID NO: 203142 - RNA, 64 nt, Human
guggacugaccucucaccuccgccuguuguuccugcaccacaucagauaagcaugugaaggagg

SEQ ID NO: 203143 - RNA, 64 nt, Human
cagaggccugaagauucuuucuucugaaagccaagcaccacaaggaaaaaaaaaauuauuaaua

SEQ ID NO: 203144 - RNA, 64 nt, Human
uuucugacugacauuccuuucugcaacugcgguggcaccacaaauauccggucuuugugcuugc

SEQ ID NO: 203145 - RNA, 64 nt, Human
cccugaccccucugcaggaggcagaagcaaaauggcaccacauauucaccugaaaacuccaaac

SEQ ID NO: 203146 - RNA, 64 nt, Human
gcaccucaguagcggagcaucuccacgaaacggggcaccacaggaucccugugcaagggcuggg

SEQ ID NO: 203147 - RNA, 64 nt, Human
aauguaauggcaaaaccaauauuuucuauauugugaagggcaaagguuacagaaacggucccaa

SEQ ID NO: 203148 - RNA, 64 nt, Human
caccgaagauggaugcuuaccccuugaggccugagaagggcaggaucagaagggaccuuggcac

SEQ ID NO: 203149 - RNA, 64 nt, Human
caaggacaccugccuucaaagccacugaggggaggaagggcagggcagacugcagauggccuug

SEQ ID NO: 203150 - RNA, 64 nt, Human
ucauuaagccucaaaaucuccucuguucuacuuggcaccacaagcuauguccuauauauguauu

SEQ ID NO: 203151 - RNA, 64 nt, Human; identical to SEQ ID NO: 189246

SEQ ID NO: 203152 - RNA, 64 nt, Human; identical to SEQ ID NO: 189247

SEQ ID NO: 203153 - RNA, 64 nt, Human; identical to SEQ ID NO: 189248

SEQ ID NO: 203154 - RNA, 64 nt, Human; identical to SEQ ID NO: 189249

SEQ ID NO: 203155 - RNA, 64 nt, Human; identical to SEQ ID NO: 189250

SEQ ID NO: 203156 - RNA, 64 nt, Human; identical to SEQ ID NO: 189251

SEQ ID NO: 203157 - RNA, 64 nt, Human; identical to SEQ ID NO: 189252

SEQ ID NO: 203158 - RNA, 64 nt, Human; identical to SEQ ID NO: 189253

SEQ ID NO: 203159 - RNA, 64 nt, Human; identical to SEQ ID NO: 189254

SEQ ID NO: 203160 - RNA, 64 nt, Human; identical to SEQ ID NO: 189255

SEQ ID NO: 203161 - RNA, 64 nt, Human; identical to SEQ ID NO: 189256

SEQ ID NO: 203162 - RNA, 64 nt, Human; identical to SEQ ID NO: 189257

SEQ ID NO: 203163 - RNA, 64 nt, Human; identical to SEQ ID NO: 189258

SEQ ID NO: 203164 - RNA, 64 nt, Human; identical to SEQ ID NO: 189262

SEQ ID NO: 203165 - RNA, 62 nt, Human
guacacacgcacauucauuacacaccuacauacgcccccaacacacgcgcacggugaagagg

SEQ ID NO: 203166 - RNA, 62 nt, Human
ggggagcccgccagguggaccggcccgcgcuccgcccccagcgagccggggacccacccacc

SEQ ID NO: 203167 - RNA, 62 nt, Human
ucuaaccucugcccucgcugcucuuggaauugcgcccccaagaugcucucucccuucuccaa

SEQ ID NO: 203168 - RNA, 62 nt, Human
ggaaaaacaucuggccagggguagcuugauuucgcccccaaaaauacugaagacuaauccau

SEQ ID NO: 203169 - RNA, 64 nt, Human
cuuagcaagggcucugaaaugacaaagagaacgagcaccacaaaugagaacaggaucauuuuag

SEQ ID NO: 203170 - RNA, 64 nt, Human
gcccuugucgugggauggcauuuggucucaggcagcaccacacugggugcgucuccagucaucu

SEQ ID NO: 203171 - RNA, 64 nt, Human
uggcugacuuuggcagugccacauuugaccaugagcaccacaccaccauuguggccacccguca

SEQ ID NO: 203172 - RNA, 64 nt, Human
gguagggccaauuaaggauucuaacccuaacccagcaccacaaagccccccuggagcaucuucc

SEQ ID NO: 203173 - RNA, 64 nt, Human
cugaggggccucuuggaggaggagguguucaucugcaccacagagaguugaggcccuaacaaau

SEQ ID NO: 203174 - RNA, 64 nt, Human
uuccaugccagaguuugugugggcgggcgcaugugcaccacagagugcacucgaggggacuuuc

SEQ ID NO: 203175 - RNA, 64 nt, Human
ugagcaccuucucugaguagagucuucauccuuagcaccacagacuucugagguccugugcccu

SEQ ID NO: 203176 - RNA, 64 nt, Human
ccucagccuccugaguagcugggauuacaggcgugcaccacaacgccuggcuaaguuuuuguau

SEQ ID NO: 203177 - RNA, 64 nt, Human
aaacccccugcagcccaggccagucagacgccaggcaccacagccuccaaaaauggcagugacu

SEQ ID NO: 203178 - RNA, 64 nt, Human
gaaggaggcagacaugagcuguacuacucaguaugcaccacagaauaagaguuugccguguaaa

SEQ ID NO: 203179 - RNA, 64 nt, Human
ucaugcguacgucccacaaaugcagguguccugagcaccacacccagugggaagaguguggggg

SEQ ID NO: 203180 - RNA, 64 nt, Human
gcccuggguggggauaguuuacacccgggcagcagcaccacacaugaacccaaagacauguucu

SEQ ID NO: 203181 - RNA, 64 nt, Human
caccccaaaagccuguggcuucaguccugcgucugcaccacacauucaaaaggaucguuuuguu

SEQ ID NO: 203182 - RNA, 64 nt, Human
ggucccaccauguggacagacauagcccaaggaggcaccacaggucuaugugugcugggggaug

SEQ ID NO: 203183 - RNA, 64 nt, Human
acaucccauaaauguguguguggugugacuacgggcaccacaaacuccgcagccuugccucucu

SEQ ID NO: 203184 - RNA, 64 nt, Human
uagagaaaagcuccuaaagugaccuuccgggugggaagggcagcaguacacaugaccccauccu

SEQ ID NO: 203185 - RNA, 64 nt, Human
uacagacuuuggugaaccaagaauucaacaagaggaagggcaaaaucaaagguauuuuuauauu

SEQ ID NO: 203186 - RNA, 64 nt, Human
uucagccaggugaacuggaaugccuuggggcguggaagggcauuaggaguguuucauuugauau

SEQ ID NO: 203187 - RNA, 64 nt, Human
ccuuagcucaguuuccaggugguuccucugccuggcaccacagcuacaaagguguagcuaagaa

SEQ ID NO: 203188 - RNA, 64 nt, Human
uggaauagauggacaguuuguuuccugucugauagcaccacacgcaaaccaaccuuucugacau

SEQ ID NO: 203189 - RNA, 64 nt, Human
gccaucggucuccuucgcggaagguaccaaguuugcaccacagagucgccgaagcucaggggag

SEQ ID NO: 203190 - RNA, 64 nt, Human
ggaaucaagcucugagcagaggccugaagcggaagcaccacaucgucccugcccaucucacucu

SEQ ID NO: 203191 - RNA, 64 nt, Human
acuucaggacgacaccuggcuugccacccacagugcaccacaggccaaccuacgcccuucauca

SEQ ID NO: 203192 - RNA, 64 nt, Human
gcaggaagggaauacaaagguauccauggagguagcaccacaggaagcaggcaucacacuugag

SEQ ID NO: 203193 - RNA, 64 nt, Human
ggugggggcagucuagggaagucaacucagacuugcaccacaguccagcagcaaggcuccuugc

SEQ ID NO: 203194 - RNA, 64 nt, Human
cugccucccaaguagcugggaccacaggugggcagcaccacaccuggcuaauuuuuuaaauuuu

SEQ ID NO: 203195 - RNA, 64 nt, Human
agauauauguagagagagcaacaugacuggggcugcaccacacaaggguccccagggcccccag

SEQ ID NO: 203196 - RNA, 64 nt, Human
agccuauuuccuccagccaguuucacugaaugcugcaccacaugcuacaccaguucagcgugag

SEQ ID NO: 203197 - RNA, 64 nt, Human
gcagggccccuucccacucagcccgcggcugugggcaccacagcucuuguggggcagcccaccu

SEQ ID NO: 203198 - RNA, 64 nt, Human
cuuuuagagagcugucuagaacucgagaaucauggcaccacagacgugaaauggcaucugucau

SEQ ID NO: 203199 - RNA, 64 nt, Human
gugaccgcgccuucucaucggcggcggugcucaugcaccacagcaaggaggugcauggccggga

SEQ ID NO: 203200 - RNA, 64 nt, Human
agugaacgcaggguuugccauugcuaccaagcaagcaccacaagaaagggaggguacgccaggc

SEQ ID NO: 203201 - RNA, 64 nt, Human
acgguugaucuguuuucagugcacacccucaaaugcaccacaccaguuuuacgaucuaagcuuu

SEQ ID NO: 203202 - RNA, 64 nt, Human
agaccuggggcuugagggguggggaauggggagggaagggcauagccugcuccuccaugagucu

SEQ ID NO: 203203 - RNA, 64 nt, Human
agcuuagcucugcccuggaaccuaccagagcagagaagggcaggagaggaagauuugucuacuu

SEQ ID NO: 203204 - RNA, 64 nt, Human
uuggucauagaaccuagaagccaaaagccacacagaagggcaagaaucccaauuuaacucaugu

SEQ ID NO: 203205 - RNA, 64 nt, Human
guuaugucuuagucgagacaucaucaucugagaagcaccacauccuuucagacacauccucgga

SEQ ID NO: 203206 - RNA, 64 nt, Human
uccuuccucaaccuuugcuguaaaaauuucauuugcaccacaucaguacuacuuaauuuaacaa

SEQ ID NO: 203207 - RNA, 64 nt, Human
gagacaaagugcauguuuuuaucgaguacccugugcaccacauuauaucuggcaauucuuuuug

SEQ ID NO: 203208 - RNA, 64 nt, Human
acccaggaaguggagacugcagugagccgauaucgcaccacagcgcuccagccuggucgacaga

SEQ ID NO: 203209 - RNA, 64 nt, Human
cgcagcccccaaaucauggacgcaccuguggggagcaccacaucuccaccugcggccucacauc

SEQ ID NO: 203210 - RNA, 64 nt, Human
ccaccccaaauuaacagaauauacauuuuuuucagcaccacaccacaccuauuccaaaauugac

SEQ ID NO: 203211 - RNA, 64 nt, Human
uccaguuauucaucugacugccuaccugaggcaagcaccacacuuaccacuguauguguacuau

SEQ ID NO: 203212 - RNA, 64 nt, Human
ugagcgcagauccaaaguugucuucuguccacuagcaccacagucaggccuugaugggaucuuc

SEQ ID NO: 203213 - RNA, 64 nt, Human
ugagcccugauccaaaguugucuccugcccaugagcaccacagucaggccuugaggggaucuuc

SEQ ID NO: 203214 - RNA, 50 nt, Human
aaguugucuccugcccaugagcaccacagucaggccuugagggcgucuuc

SEQ ID NO: 203215 - RNA, 50 nt, Human
aaguugucuccugcccaugagcaccacagucaggccuugaggacgucuuc

SEQ ID NO: 203216 - RNA, 64 nt, Human
ugagcccagauccaaaguugucuucuguccacgagcaccacagucaggccuugaggggaucuuc

SEQ ID NO: 203217 - RNA, 64 nt, Human
uauauucauuccacccuggggagauuccugauaagcaccacauaugugggaggcuuucaugagg

SEQ ID NO: 203218 - RNA, 64 nt, Human
cugccucacccucaguagcugggauuauuggcaugcaccacaaaccuuagcuaaguuuguauuu

SEQ ID NO: 203219 - RNA, 52 nt, Human
ccuuccacauccgaaucugauggcaccacagaggagccgagcuauaggaggg

SEQ ID NO: 203220 - RNA, 64 nt, Human
uucaaaagggagaaaccacuauaaaagacaagaggaagggcagguacuagguguuucauuucca

SEQ ID NO: 203221 - RNA, 64 nt, Human
uuagagugcagaagcuggggggagaggcugcuucgaagggcaggacuggggauaaucagaaccu

SEQ ID NO: 203222 - RNA, 64 nt, Human
cucuuuccauucaaauaguccugguucauucccagaagggcacaaaaugaaugaauaaauaaau

SEQ ID NO: 203223 - RNA, 64 nt, Human
uuucacugcugggguugugauagaagccaugucagcaccacacacugcagcucuccaaagagug

SEQ ID NO: 203224 - RNA, 64 nt, Human
ugaaucugcacauauggagggcuggcuauaaagggcaccacaaggaagaagccaaacagaucca

SEQ ID NO: 203225 - RNA, 64 nt, Human
acaccccaaaaucugcauugccauugaugcauaugcaccacauuauuauauuuccacaucaguu

SEQ ID NO: 203226 - RNA, 64 nt, Human
cagggggagaagguauuuucgagauaaagcacaggcaccacaaauaaaagucgugaaguugcca

SEQ ID NO: 203227 - RNA, 64 nt, Human
ggaugucuugguguguaggagcaugcauuuguaggcaccacaauccggauacuucugacacaga

SEQ ID NO: 203228 - RNA, 64 nt, Human
cauggggaguaauaggaccagagcgguaucucuggcaccacacuagggacuaucagguaauaaa

SEQ ID NO: 203229 - RNA, 64 nt, Human
agccccggacucugcuuacccugauggcugcucagcaccacagagugcuugggcugagggacug

SEQ ID NO: 203230 - RNA, 64 nt, Human
cggcucgcgggccaggauccucucggugggaugggcaccacagacaggaggccccucaggcccg

SEQ ID NO: 203231 - RNA, 64 nt, Human
ugugcacuuaccguagguagggacacguguccacgcaccacagacacacccacgacaccugauc

SEQ ID NO: 203232 - RNA, 64 nt, Human
ucuggaacucacucucagccacagggagcugcaugcaccacaggggcaaugcaccuuugcaggg

SEQ ID NO: 203233 - RNA, 64 nt, Human
ucucagccucccaaguagcugggacuacaguugugcaccacaaugccuagcuaauuuuuuuugu

SEQ ID NO: 203234 - RNA, 64 nt, Human
uccuugugcagggaagagcugcccugggcaccuggcaccacaagaccauguuuucuaagaacca

SEQ ID NO: 203235 - RNA, 64 nt, Human
guuauaaaaacuuguaccauguuacauguacacugcaccacagucuaaauucagaccagcauuu

SEQ ID NO: 203236 - RNA, 60 nt, Human
agcuccgcauccgugacugagggucccugcgcaccacagccucucugcuccucacguccg

SEQ ID NO: 203237 - RNA, 64 nt, Human
cgcacuucugaggagaccagcagucaugcaucgugcaccacagugucaggccuccaacccacgc

SEQ ID NO: 203238 - RNA, 64 nt, Human
auguagaaauuggcuugggauggauagguauagggaagggcauucguugggaaauugaugaccg

SEQ ID NO: 203239 - RNA, 64 nt, Human
uagcuccauuucuuauuuuccaccaaauuuaauugaagggcauuaauuagaugucuucacccug

SEQ ID NO: 203240 - RNA, 64 nt, Human
aaaagucauauuuuaagugggauuuguuuuuccugaagggcauuugaaggaacaauaucuggga

SEQ ID NO: 203241 - RNA, 64 nt, Human
gaagagcaaggcccucaggacccguguccucagagcaccacacacugagcacccagagacagcg

SEQ ID NO: 203242 - RNA, 64 nt, Human
cuuucccgggucuccagccccaguccagaguugggcaccacaccggccagcaucuuccgcacac

SEQ ID NO: 203243 - RNA, 64 nt, Human
ugcccuccauccuuccucuguuccuucuggccgggcaccacagcacuggggcucaccucuuggu

SEQ ID NO: 203244 - RNA, 64 nt, Human
cuuccccugccacccugcacaccuccaagucagggcaccacaacacgccaccgggagagaugcu

SEQ ID NO: 203245 - RNA, 64 nt, Human
auaaucuuaaagaugagaaaagccaccccaucuggcaccacagcugcaucuugcuugugagaaa

SEQ ID NO: 203246 - RNA, 64 nt, Human
uggacagcugcacggcuugugaagugagcuaaaugcaccacaugaugagaugcuccugggcauu

SEQ ID NO: 203247 - RNA, 64 nt, Human
guauuaauauuuagaguaggaugcagccucuuaugcaccacaguuaaaucuagaacgaacaaaa

SEQ ID NO: 203248 - RNA, 64 nt, Human
ucccagguguuaaaaaaaaaauccauuuuacacagcaccacagugaauccagaccaaccuucca

SEQ ID NO: 203249 - RNA, 64 nt, Human
aaccguugucaaggcuaugcucacgggaggcugggcaccacaguguuuccaagagcaagcugga

SEQ ID NO: 203250 - RNA, 64 nt, Human
uguaaaaccuguucugucacaaauguuccugaaagcaccacagcuacucaagaagaucaaauuc

SEQ ID NO: 203251 - RNA, 64 nt, Human
acauggaagaucugggggaggaaguucaaggaaggcaccacaccagaaaugggaccuaaauuaa

SEQ ID NO: 203252 - RNA, 64 nt, Human
gugcauuucaaaaaguaaucauauaucaaacuaggcaccacacuaaguuccugauuauuuuguu

SEQ ID NO: 203253 - RNA, 64 nt, Human
uucacauuuauuugguagcccaccuggguuggaggaagggcacgguggagagaaagugacaugc

SEQ ID NO: 203254 - RNA, 64 nt, Human
aaaaauguaaaaccucucuugccagggaaugggggaagggcaagugaggaguucuuuaaugggu

SEQ ID NO: 203255 - RNA, 64 nt, Human
caggauuuccacaucuuggugaaguugccccugggaagggcagcugggggcaguggcgccaguu

SEQ ID NO: 203256 - RNA, 64 nt, Human
ggaggagguuagcagggacgguugccuuuccugggaagggcaguuugcagaaccagggguuuau

SEQ ID NO: 203257 - RNA, 64 nt, Human
uuguccccacuuacagaucuaucuccucccuugggaagggcagggaauggggacgguguaugga

SEQ ID NO: 203258 - RNA, 64 nt, Human
gggacagccuggcagcucgugccauugcagugcagaagggcaguaucggcaaccuccugggcuu

SEQ ID NO: 203259 - RNA, 64 nt, Human
ggucagcgagcagaagaugaaacggugguugggggaagggcacagcuuccucucuuguccccac

SEQ ID NO: 203260 - RNA, 64 nt, Human
gucaugggagaagagggguauaggacaagggguggaagggcaggagcucacaccgcaccgggcu

SEQ ID NO: 203261 - RNA, 64 nt, Human
aauaagggaaaggcccaagguauccaagccuggggaagggcaggccagccagcaccucugccuu

SEQ ID NO: 203262 - RNA, 64 nt, Human
ucagcuuaauuauaaacaaaggaacaaauaaguggaagggcagcuauuaccauucgcuuaguca

SEQ ID NO: 203263 - RNA, 64 nt, Human
agguccugguaccaucuuccccagaaacgaucaagaagggcaauggguugacagcccagauaug

SEQ ID NO: 203264 - RNA, 64 nt, Human
gguuguccaugcuugggauucugggggaaggagagaagggcagcucaggguggaugugaagcca

SEQ ID NO: 203265 - RNA, 64 nt, Human
aagugcacaccucaccauccuucagucuaaggaagaagggcaagcccugggaccaagagcucuc

SEQ ID NO: 203266 - RNA, 64 nt, Human
caugcuguguguccugguauugggagguuucugggaagggcagaggauaaauguggcccugccu

SEQ ID NO: 203267 - RNA, 64 nt, Human
ggcccuucacagggggcagcgggacaggcaucuugaagggcauauguccucggaagcuccgagc

SEQ ID NO: 203268 - RNA, 64 nt, Human
ccugugcucccaggggccuaggcuaccauggacugaagggcaguccccucccaccuggugccca

SEQ ID NO: 203269 - RNA, 64 nt, Human
ucuacacagaggucucuccuggcagaaagcaggcgaagggcaggaggagcugcuuggcagaagg

SEQ ID NO: 203270 - RNA, 64 nt, Human
ggagugugaauaggaguuugcagauggagaauaggaagggcauuccaggcagagggaaaccugu

SEQ ID NO: 203271 - RNA, 64 nt, Human
aguuaaaagucuauuuauuuacuuccuuguuggagaagggcaggagaguaccugggaaucauua

SEQ ID NO: 203272 - RNA, 64 nt, Human
aauaauuucaaauuuaauguccugcuuucacauugaagggcagagccuacaaaacauuguauau

SEQ ID NO: 203273 - RNA, 64 nt, Human
ugcccggcucauggucugggggaugcaggcaggggaagggcagagauggcuucucagauauggc

SEQ ID NO: 203274 - RNA, 64 nt, Human
uccuuuaauaugaaccaacaaucuggagcacaccgaagggcaaucuaaauuguggcuugaagga

SEQ ID NO: 203275 - RNA, 64 nt, Human
uuuuccugucuacaggcaggaaaaccaggauggagaagggcaacuugcuuauuaagaucaccca

SEQ ID NO: 203276 - RNA, 64 nt, Human
aaaaguucuuuuuuuuucuuuuuuuuuucuuaaagaagggcagccaagguaguaaccuaaaaau

SEQ ID NO: 203277 - RNA, 64 nt, Human
auauggugguuuuagucccuucuuaugguuggcagaagggcacugaacuguugggugaaaguua

SEQ ID NO: 203278 - RNA, 64 nt, Human
uuuuuugggacauauuucugccaauuaaagacuagaagggcacaacuuuuuuuuuaauuaccau

SEQ ID NO: 203279 - RNA, 64 nt, Human
gcuuuccaggccggaugccauaguggaacauccagaagggcaacugucuacugucugcuuauuu

SEQ ID NO: 203280 - RNA, 64 nt, Human
cgcccacccagcagcgcccgaggccagggccgccgaagggcagccccgcgaccaccccugugcg

SEQ ID NO: 203281 - RNA, 64 nt, Human
ccuaagcgugugaaaauaggggauggaugagugggaagggcaugggauauuccuggcaagaucu

SEQ ID NO: 203282 - RNA, 64 nt, Human
aguaguauaucuuauuuucaaggcauuuggaaaugaagggcaaacuaaugucuuguuuuaagaa

SEQ ID NO: 203283 - RNA, 64 nt, Human
auacagauaauggaaaauaagcuuuauguuucaagaagggcagacucacgaauuuuuuagaaaa

SEQ ID NO: 203284 - RNA, 64 nt, Human
uuauuuucuuccuaguucuggaggcugggaaggcgaagggcauggcacugacaucugccuugua

SEQ ID NO: 203285 - RNA, 64 nt, Human
caauuuccacucagaacccuauaaacaccagugggaagggcaacccacugcacgugggaaugca

SEQ ID NO: 203286 - RNA, 64 nt, Human
auacagguuucauagagaacaaaggugaucauuugaagggcaugcuguaauuucacacaauuuu

SEQ ID NO: 203287 - RNA, 64 nt, Human
augaccaaauuugaccugcccuuguuuauggcaagaagggcauuuuucucuucaauuuccaggg

SEQ ID NO: 203288 - RNA, 64 nt, Human
acuuccagaugcucagucggcuuggggaaggacugaagggcagcugccaagaccucaguuaccu

SEQ ID NO: 203289 - RNA, 64 nt, Human
aguaaccuacaagccuccuaguucugaaaaguuggaagggcaucaugaccucuuggccucuccu

SEQ ID NO: 203290 - RNA, 64 nt, Human
uaaaauuguaaaauuguauagagauaugcagaaggaagggcauccuucugccuuuuuuauuuuu

SEQ ID NO: 203291 - RNA, 64 nt, Human
cagacugauugcguggcucuuucagaagacccaggaagggcagcuccagccagaggaccuuccu

SEQ ID NO: 203292 - RNA, 64 nt, Human
cggccaccugcuucccccgcgggggccgcuggaggaagggcagccgacccggccgcugggggaa

SEQ ID NO: 203293 - RNA, 64 nt, Human
aaaaagcauuaaacuggcuccaucagaagacguugaagggcagugaagagcacagacucugugg

SEQ ID NO: 203294 - RNA, 64 nt, Human
cuuggacaauaccuaguuuggagggaggggaauggaagggcauggaaguuuuuuuaaauaauua

SEQ ID NO: 203295 - RNA, 64 nt, Human
aaggaggcugggggaucaccagccccaaggucccgaagggcaggucagagggagagaggcugga

SEQ ID NO: 203296 - RNA, 64 nt, Human
uugugggcuuccugcugggacugagaaggcucacgaagggcauccgcaauguugguuucacuga

SEQ ID NO: 203297 - RNA, 64 nt, Human
aagaccagcccaagugccgucuuagccauucagugaagggcaaacagcccauggguaguauggc

SEQ ID NO: 203298 - RNA, 64 nt, Human
gaugaguuccagaugucccuucuuugauaugguagaagggcauuuauuuauaugagagcaaaug

SEQ ID NO: 203299 - RNA, 64 nt, Human
ggaaguaacuuuauucaacuagaguugaauaaaagaagggcaaaaauaaucucacagagcuugg

SEQ ID NO: 203300 - RNA, 64 nt, Human
ugauuuguccucuuuguugguuuuuauuuguggggaagggcagcugagccaaaggggucagaaa

SEQ ID NO: 203301 - RNA, 64 nt, Human
ucucccagaccucuccucuuccaguguccccggggaagggcagaugacacucccuucccccuaa

SEQ ID NO: 203302 - RNA, 64 nt, Human
uggcugcauaaaugugguacaagcauucugucuugaagggcaggugcuucaggauaccauauac

SEQ ID NO: 203303 - RNA, 64 nt, Human
accggacucacaauuucuauuuccgggacuacaggaagggcagagaauacugacgguuaccagu

SEQ ID NO: 203304 - RNA, 64 nt, Human
agcgaaaguuucuuggucucagcuucauuuccgugaagggcaccgagaacucgaagcccuucca

SEQ ID NO: 203305 - RNA, 64 nt, Human
agucauggugucacugggguacaggagggugaaugaagggcaugcaggcccucagcccgggcug

SEQ ID NO: 203306 - RNA, 64 nt, Human
gaccacccucuuggugcuccaucaccagcuuccugaagggcauuucuuucuucaccaccuuguc

SEQ ID NO: 203307 - RNA, 64 nt, Human
ucaauggacuggaaggggaagggacacacaagaagaagggcacccuaguucuaccucaggcagc

SEQ ID NO: 203308 - RNA, 64 nt, Human
ccacagaagcucugcagcaggggcugggagagcagaagggcaggcccugcaacucaggcuggga

SEQ ID NO: 203309 - RNA, 64 nt, Human
uccugguuucagaugcaucuaaaccuuccuggaggaagggcacauauuuugaugcaaucauuac

SEQ ID NO: 203310 - RNA, 64 nt, Human
aguucuggaagaaauaugcaaaaguggguacuuggaagggcaaaaaucauccccuauuuuacuu

SEQ ID NO: 203311 - RNA, 64 nt, Human
uuuccacgagugucugucagugagcgggcgggaggaagggcacagcaggagcggucagggcucc

SEQ ID NO: 203312 - RNA, 64 nt, Human
agagugagagcagaaaccccaccucacaugaagggaagggcaucuccaugaugguggaucccaa

SEQ ID NO: 203313 - RNA, 64 nt, Human
ggacaggccaguagggggagggaaagggagaggggaagggcaggggacucaggaagcagggggu

SEQ ID NO: 203314 - RNA, 64 nt, Human
cucugaccccagcauuuccagagcagagccuacagaagggcagugacucgacaaaggccacagg

SEQ ID NO: 203315 - RNA, 64 nt, Human
acauguggcccccagguuccuggucuuuauggacgaagggcacaagguggaggggggauggggg

SEQ ID NO: 203316 - RNA, 64 nt, Human
acuuccaugaaagggcuaauacgaugcauauacugaagggcaaggacuuugaccaugucaauuu

SEQ ID NO: 203317 - RNA, 64 nt, Human
aggaaaaauugcauuaguugguugcaugaacuucgaagggcagauauuacugcacaaacugcca

SEQ ID NO: 203318 - RNA, 64 nt, Human
gaauguuuagaauugagcaaagauguaaauuuuugaagggcaguuuagaaaaauuaacuuugug

SEQ ID NO: 203319 - RNA, 64 nt, Human
auuuguaauggagugggaaauguguuucucuggagaagggcacauuuaucuaggggcauuucag

SEQ ID NO: 203320 - RNA, 64 nt, Human
ccccuugccuuuuuccuguucuguuuggaguggagaagggcagcaccucuguguuuaauggaaa

SEQ ID NO: 203321 - RNA, 64 nt, Human
guccgugggagguggaggccgaggacauuuuccugaagggcagggguuggcaacuuuucaacau

SEQ ID NO: 203322 - RNA, 64 nt, Human
aaccuugccacuuugagggaaggaaggguugggggaagggcaagcuuuaugggacccugguccu

SEQ ID NO: 203323 - RNA, 64 nt, Human
cucauuaccuuuccuuugucugccucagccccaggaagggcaaggcaagaugguggacagauag

SEQ ID NO: 203324 - RNA, 64 nt, Human
aaguguacuucuuggccacacaguaccacggaaggaagggcacugugaagcagugaggauuucu

SEQ ID NO: 203325 - RNA, 64 nt, Human
gguuaaauuuaguguacuacaacauugauuuacugaagggcacuaauguuucccccaggauuuc

SEQ ID NO: 203326 - RNA, 64 nt, Human
gacuacagauuuagguggaagagcagccauguuugaagggcacaugugaugaguggggggcagc

SEQ ID NO: 203327 - RNA, 64 nt, Human
cucuuuggcacaucagccccuaguucuugagagagaagggcaggguggucuacucaccaugucu

SEQ ID NO: 203328 - RNA, 64 nt, Human
agggccuggaaagcgcagugcaugcugggugcaugaagggcagccugggggacagacuguugug

SEQ ID NO: 203329 - RNA, 64 nt, Human
aguauuaguaaacccucuuaugaugauuaaaagagaagggcagcccucuccaccuuuugguacu

SEQ ID NO: 203330 - RNA, 64 nt, Human
accugccaaaugaauaagacaacaaagagaagcagaagggcagaagauuauuuacugacauaua

SEQ ID NO: 203331 - RNA, 64 nt, Human
aaagaacugugucaacuagcagagaguccaagcagaagggcagauggacuucuucaguguccuu

SEQ ID NO: 203332 - RNA, 64 nt, Human
ugugggucggcccgcagauggcacccaaggccgggaagggcaguaacugcacacgcggcgcugu

SEQ ID NO: 203333 - RNA, 64 nt, Human
cuacuuggcccuggauagaaauuguuuucaaagagaagggcagcugcuuagagugaacaugucu

SEQ ID NO: 203334 - RNA, 64 nt, Human
uuccgauuugaaauuguaucauuuccuucaaaaugaagggcagugcuuaguuaaauaaaagauu

SEQ ID NO: 203335 - RNA, 64 nt, Human
gcaugccugagcccggggcacuagcccuugcacagaagggcagagucugaggcgauggcuccug

SEQ ID NO: 203336 - RNA, 64 nt, Human
auacagaaacuauguauguauuuaggcuauuucugaagggcacagggaagggggaacaaauauc

SEQ ID NO: 203337 - RNA, 64 nt, Human
ugaccauuggaggagugguuuaagagugccaggcgaagggcaaacuguagaucgaucuuuaugc

SEQ ID NO: 203338 - RNA, 64 nt, Human
ugaucugcaguguaaaucuaccagucaugggccagaagggcaaaagcccagcuuucucuuugga

SEQ ID NO: 203339 - RNA, 64 nt, Human
ggcaugagggcaguggagcaccauguuugagggcgaagggcagagcguuuguguguucugggga

SEQ ID NO: 203340 - RNA, 64 nt, Human
gugcugaagacauguuucaagaaccgcauuucgggaagggcaugcacgggcaugcacacggcug

SEQ ID NO: 203341 - RNA, 64 nt, Human
uccugucuucuaaauaaucagugacgggaagauggaagggcaugaugaacucugccauagaaaa

SEQ ID NO: 203342 - RNA, 64 nt, Human
ccccauugguuucccaggggagggguguugucuggaagggcagguucagaugcagccuuccaga

SEQ ID NO: 203343 - RNA, 64 nt, Human
auuccuccaaccaaagcaagcacagcacaugggagaagggcauuuggcaucugcugcccccagg

SEQ ID NO: 203344 - RNA, 64 nt, Human
uuccccuucccucucguggcccacaaggaggaaggaagggcaaccuaaaagcccacuuagaaac

SEQ ID NO: 203345 - RNA, 64 nt, Human
gggaccugucuuuccaacuaaauuggaggcuuuggaagggcagcuuuguccuauacucucucca

SEQ ID NO: 203346 - RNA, 64 nt, Human
cugugaccagucacucuggggcaagcaucacugggaagggcauagccggagaccuuucuccuag

SEQ ID NO: 203347 - RNA, 64 nt, Human
acaaguggguugcaagacaggaagaaaggaaaaggaagggcagagugcugguuucuccagguug

SEQ ID NO: 203348 - RNA, 64 nt, Human
uacagauccuggacagaaagggcauaaugagucugaagggcaguccuccuucucuagguuacau

SEQ ID NO: 203349 - RNA, 64 nt, Human
ccuuucagccagugcugucagugccccugggagggaagggcaucccugaggcacccgaaugguc

SEQ ID NO: 203350 - RNA, 64 nt, Human
uggggagagggagugugccccucggggcaggagggaagggcaucuggggaagggcaggagggaa

SEQ ID NO: 203351 - RNA, 64 nt, Human
gugccccucggggcaggagggaagggcaucuggggaagggcaggagggaagagcuguccaugca

SEQ ID NO: 203352 - RNA, 64 nt, Human
gaagugacaaaagauaagcugcagaaggaccucagaagggcagagcaaagggugagccuacagu

SEQ ID NO: 203353 - RNA, 64 nt, Human
ugaacacacuguguccuggugcucucugccacuggaagggcagaguagccaggguguggcccug

SEQ ID NO: 203354 - RNA, 51 nt, Human
ucugcuucauuccugucugaagaagggcagauaguuuggcugcuccugugc

SEQ ID NO: 203355 - RNA, 64 nt, Human
cuuccuucugcuucucccacacccaguauuugcagaagggcaaagcugcuuaagagagaggauc

SEQ ID NO: 203356 - RNA, 64 nt, Human
uaaacaauuauuuauuagcaaacaauugaucccagaagggcaaauuguuugagucaguaaugag

SEQ ID NO: 203357 - RNA, 64 nt, Human
cccacuucuaaauagcaauuucgccguugaagaggaagggcaaaaccacuagaacucuccaucu

SEQ ID NO: 203358 - RNA, 64 nt, Human
guaucagcaggaagccauugccauucugagccuugaagggcaaggagggaaacaguguuaccag

SEQ ID NO: 203359 - RNA, 64 nt, Human
uguaacaugguauuggcuuaucguuuuuaucucugaagggcaguagccugaagauaacagugca

SEQ ID NO: 203360 - RNA, 64 nt, Human
guuuaucaguuuauuuucuuucuaaaagcucccugaagggcaauaucauuuggcuuggggugau

SEQ ID NO: 203361 - RNA, 64 nt, Human
cagccuggccugccagccauuggagguguuuaaggaagggcagauaaugugacucuuugcgggg

SEQ ID NO: 203362 - RNA, 64 nt, Human
ugcccacaaacccugccucugaggggagacugaggaagggcagagccagaagcaagccgugcca

SEQ ID NO: 203363 - RNA, 64 nt, Human
ugggaguguuauuagaaugaaaaguaauuaguuagaagggcauacaucucaguggcaugagcau

SEQ ID NO: 203364 - RNA, 64 nt, Human
gggccacugccagaaagagagucaagcaaaccuggaagggcaaaucugagagugggaaggccaa

SEQ ID NO: 203365 - RNA, 64 nt, Human
uggagucaggcagugcacuccuggagccaagagggaagggcaggguagagaggguauguccagu

SEQ ID NO: 203366 - RNA, 64 nt, Human
cugguggcugccuccuagaaguggaacagacugagaagggcaaacauuccugggagcugggcaa

SEQ ID NO: 203367 - RNA, 64 nt, Human
gagugagggaacccuggggcucacccucucagaggaagggcacagagaggaagggaagaauugg

SEQ ID NO: 203368 - RNA, 64 nt, Human
cugugguugccaccucauuaacuuacaaaaaaaugaagggcaugcugagcacucaaacaauuug

SEQ ID NO: 203369 - RNA, 64 nt, Human
agucuaacccacuaaucaguucuuagauucaggggaagggcaggcaccaacaacucagaauggg

SEQ ID NO: 203370 - RNA, 64 nt, Human
gcgugcuggagccugugccccugccccggaccaagaagggcagcuggcuggcagacaaggugaa

SEQ ID NO: 203371 - RNA, 64 nt, Human
aggucccuggagagguggcgucagugggggugaggaagggcaucuuccugacuccucugcccag

SEQ ID NO: 203372 - RNA, 64 nt, Human
aaucccguaaccacuauuuguugcacugugccuugaagggcagcaggcccaagugcugcucuga

SEQ ID NO: 203373 - RNA, 64 nt, Human
ggugacagcuuucuugcugcaucauuacaugguggaagggcaagagaaugcgagugagagcaag

SEQ ID NO: 203374 - RNA, 64 nt, Human
uugacuggggcccugcagacucuggcagagcugagaagggcagggaccuucucccuccuaggaa

SEQ ID NO: 203375 - RNA, 64 nt, Human
agugaguugggaguuauuacucaaguggcaccuagaagggcaggaguuccuuuggugacuucac

SEQ ID NO: 203376 - RNA, 64 nt, Human
uauuaaaacaaaugauguauggggagaggagaaggaagggcaaggaaggaauugacagauaaga

SEQ ID NO: 203377 - RNA, 64 nt, Human
cccagcccaacuuggcuaucaagaaagacauugggaagggcagccccagggugugggagauugg

SEQ ID NO: 203378 - RNA, 64 nt, Human
auaauagacuucccacucuagggcaguggagucggaagggcacacggggugcgucuccccggag

SEQ ID NO: 203379 - RNA, 63 nt, Human
caauucgacaucucaagugaagacauggccccugaagggcaauaaagcugcuaguuuauuaau

SEQ ID NO: 203380 - RNA, 64 nt, Human
aacaauauaaagagacacgggaaaugcuucucgugaagggcaaauguaacaccauaacaguagg

SEQ ID NO: 203381 - RNA, 64 nt, Human
cuaauguuauuuuuuaaaaccuggaccuuuucuggaagggcagcauauaaaaacaucagucccg

SEQ ID NO: 203382 - RNA, 64 nt, Human
uaagagaaagccaaggcacguagaguagggagaagaagggcaccauccucucuuuccuccccag

SEQ ID NO: 203383 - RNA, 64 nt, Human
aguggagggaagcagggagggagggagcaagugugaagggcacagcugcuggcaaaugccccau

SEQ ID NO: 203384 - RNA, 64 nt, Human
cagaagcagcaaaugaaagaaccggacaaauaaggaagggcacaagccuacccgacucuauuua

SEQ ID NO: 203385 - RNA, 64 nt, Human
cugaauggauuucaucaaggcggcagcauaauuugaagggcaauugcgugugaaaauugaugug

SEQ ID NO: 203386 - RNA, 64 nt, Human
agcaccgcagcuagugggccuggcugggggugcagaagggcaggguaguucuuuccauuucccc

SEQ ID NO: 203387 - RNA, 64 nt, Human
gcuacccugguacuuccacccuaccccaccccgagaagggcagagacgcaugugacucaccccu

SEQ ID NO: 203388 - RNA, 64 nt, Human
aggcuauacucugugcccaugagagcagagacuggaagggcaagaccaggugcuaaggagggga

SEQ ID NO: 203389 - RNA, 64 nt, Human
gaguucccccugcuccaucccccauugcaugggggaagggcauaaagaaucauuuauaugcacg

SEQ ID NO: 203390 - RNA, 64 nt, Human
auuuuuccccacuaugguagacaaccauuucguggaagggcagccuauuaucccacacugcauc

SEQ ID NO: 203391 - RNA, 64 nt, Human
aaccuagauauaccauuaucccuuuuauaccuaagaagggcaugcuaauaauuaccacugucaa

SEQ ID NO: 203392 - RNA, 64 nt, Human
ccgcuggaggauccggaaagaguuuccgaagagugaagggcaguacaguggcuucaagaguccu

SEQ ID NO: 203393 - RNA, 63 nt, Human
agucgcccaccugcgugugaacagggcuggagggaagggcacaggggcgcccggagcuaagau

SEQ ID NO: 203394 - RNA, 58 nt, Human
ccuucgccaaguucaucuagggucgcuggaagggcacccucuuuaacccaucccucag

SEQ ID NO: 203395 - RNA, 64 nt, Human
cugcuaugggaucgucaccugguucgggacgggggaagggcagagacaagggauuucuuugaug

SEQ ID NO: 203396 - RNA, 64 nt, Human
uucuggcuacaggccuccacugcaccuucuuagggaagggcaugccagccaucagcuccaaaca

SEQ ID NO: 203397 - RNA, 64 nt, Human
caaguggcuuuuggauauccugauuggggccuaagaagggcauucagacuugaauuuuaauagg

SEQ ID NO: 203398 - RNA, 64 nt, Human
gagagaucagcuaauacuucucucaacaaaaauggaagggcagaugcuagaauccccccuagac

SEQ ID NO: 203399 - RNA, 53 nt, Human
caggaagauucucaugcugaacagaagggcaagagagguggaucugugaggga

SEQ ID NO: 203400 - RNA, 64 nt, Human
aauccugaaacaccaggagaggcgucagaaguaggaagggcaggggaacaggaaugcaagauua

SEQ ID NO: 203401 - RNA, 64 nt, Human
gguaaaucagggacagggccaugggguagggugagaagggcagggguguccugaugcaaaggug

SEQ ID NO: 203402 - RNA, 64 nt, Human
acaugaucacacuguauaagcuacuuagaacuuugaagggcauuaugauccugacuuuuugaga

SEQ ID NO: 203403 - RNA, 64 nt, Human
gacugcaggcugcuaauugcaggaaaugacuuuggaagggcaggcucuuguccaguuucagggc

SEQ ID NO: 203404 - RNA, 64 nt, Human
ugccagcaguguccuugggaaaggcaauauuuaugaagggcagaagaggcagccccaagaaccu

SEQ ID NO: 203405 - RNA, 64 nt, Human
ccuuagaugagaucuggcauaugcacccgcaauagaagggcaccacuuggaugaccacaggcac

SEQ ID NO: 203406 - RNA, 64 nt, Human
caucaucugugaaaaggagcacuguauggccacagaagggcagcagcugcgucagccuaagaca

SEQ ID NO: 203407 - RNA, 64 nt, Human
uccucauauuucagcagugcagccggggggcagggaagggcaggcagggucuguuggggucucu

SEQ ID NO: 203408 - RNA, 64 nt, Human
gcagaagucuguuuuuaggaaaaguuucaagggagaagggcaaguuuaucaaaaacauuguuuc

SEQ ID NO: 203409 - RNA, 64 nt, Human
ccaguggccccuggggaugugccacugucacucagaagggcaagcuaggcagggcccauacaac

SEQ ID NO: 203410 - RNA, 64 nt, Human
uucuuaacuucuaauauauuaaaucugaagaugugaagggcacagaagugacuuugaauaagaa

SEQ ID NO: 203411 - RNA, 64 nt, Human
ugugaagcuaggggguguuucucagcacacugcagaagggcagcucagaagaaugcagggccca

SEQ ID NO: 203412 - RNA, 64 nt, Human
ggccugguccuguuggggugggggucuuuggagagaagggcauagucuuugagcuacuaaaaag

SEQ ID NO: 203413 - RNA, 64 nt, Human
ucaaaaaaaaaaauggauacaugguuaaaggauagaagggcaauauuuuaucauauguucuaaa

SEQ ID NO: 203414 - RNA, 64 nt, Human
uuaugcacuugcugcugccuccugggcucugauagaagggcagggcuguugagccuggaugggu

SEQ ID NO: 203415 - RNA, 64 nt, Human
gugacccaacccuaggaaguagggagaaaugaaggaagggcauaggaaaauuuucccaguaaau

SEQ ID NO: 203416 - RNA, 64 nt, Human
aggggugaaagagagggaauaguuucuccuuguugaagggcagugaagguagguuucagguuug

SEQ ID NO: 203417 - RNA, 64 nt, Human
aagcgcauccaaucucaaggaaucuuuaagcagagaagggcauaaaacagcuuuggggugucuu

SEQ ID NO: 203418 - RNA, 64 nt, Human
accaagguucuccugggacccaaaguuuaugggagaagggcaaagacuucaugggaagagagaa

SEQ ID NO: 203419 - RNA, 64 nt, Human
cuuggcucccaugaucgaucgaggcauagugaaagaagggcaaagacagcuuuccagagcuuug

SEQ ID NO: 203420 - RNA, 64 nt, Human
cuccagcagggcaggccuaggacuucuccuaagagaagggcacuuccccaccagugaucucucc

SEQ ID NO: 203421 - RNA, 64 nt, Human
ggcaaugggauuugggcuacccuaaagggagaaggaagggcagagaauggcugggucagggcca

SEQ ID NO: 203422 - RNA, 64 nt, Human
gaaggcucagcacggugaggccugacauccuggggaagggcaacagggagaccuacaggauguu

SEQ ID NO: 203423 - RNA, 64 nt, Human
gagcacauggggucuuucaggauccucucccuuggaagggcaaugugugagcuaaggacuguuu

SEQ ID NO: 203424 - RNA, 64 nt, Human
ccugaaucaucugcggcuuaaacucaucucgcuugaagggcagggagaaacccaugaaucucag

SEQ ID NO: 203425 - RNA, 64 nt, Human
ugagaacugcagcccugggucuucccuuagggaggaagggcagaugaacccagcaggcuuagga

SEQ ID NO: 203426 - RNA, 64 nt, Human
agugcccgccaggccugggccaggagagcuccaggaagggcacugagcgcugcuggcgcgaggc

SEQ ID NO: 203427 - RNA, 64 nt, Human
ucugccaaacacauuuacccuuuggccccacuuugaagggcaagaaauggcgucugcucuggug

SEQ ID NO: 203428 - RNA, 64 nt, Human
cuccucuggccucagccugcagggugugggcagagaagggcaucugggacguggugccagugag

SEQ ID NO: 203429 - RNA, 64 nt, Human
aacagauguuucagauacuguuggacccagaagagaagggcacugagaaaaagcaaaagguaua

SEQ ID NO: 203430 - RNA, 64 nt, Human
agccauuaguucugucccucuaaaacuagaaaaggaagggcaggaaaugauaacaacccaaggc

SEQ ID NO: 203431 - RNA, 64 nt, Human
auuuccuaucuuccuccagcuuccagcuaggccagaagggcaugcucuggaacccagcaggauc

SEQ ID NO: 203432 - RNA, 64 nt, Human
ugcugaaaggggcagcugccuguuuugcuucugugaagggcaguccuuaccgcacacccuaaau

SEQ ID NO: 203433 - RNA, 64 nt, Human
ggcuggccucuggggcaggggugguggagagauggaagggcaucagguguagggacccugccaa

SEQ ID NO: 203434 - RNA, 64 nt, Human
uuuuugggguggacucuguccccuagggucccuagaagggcaaagaccagagaguugacaaguc

SEQ ID NO: 203435 - RNA, 64 nt, Human
acagggggcaggaccuggggaccugggcuggagggaagggcagaagcuuccuacuuggcugaca

SEQ ID NO: 203436 - RNA, 64 nt, Human
agucggaccccuuccucacacuggccccuaugcagaagggcagacaguucuucugggguuggca

SEQ ID NO: 203437 - RNA, 64 nt, Human
ccugugcugugucguguggcuuuaucagcccgaggaagggcagguguauucuaauuugcacaaa

SEQ ID NO: 203438 - RNA, 64 nt, Human
ccccucucaucccacucccggcggcccaggcacagaagggcagggccauagggagggagauucg

SEQ ID NO: 203439 - RNA, 64 nt, Human
caugggccacagcugcggccacugcagcagccaugaagggcaguggguagaggagugcaggcac

SEQ ID NO: 203440 - RNA, 64 nt, Human
gugacaccggggggcucccagcccgugcacccuggaagggcaggucuggcggcuccauccgugg

SEQ ID NO: 203441 - RNA, 64 nt, Human
cggggucaaaaugacccacacgcugcagugacaagaagggcagagggcagucauggggcccagg

SEQ ID NO: 203442 - RNA, 64 nt, Human
uggaauggaaggguucuggcugccccaaccugcugaagggcagagguggaggguggggggcgcu

SEQ ID NO: 203443 - RNA, 64 nt, Human
guggcagguuuggcgagcacgaacuagaccaagcgaagggcagcccaccaccguauaucaaacc

SEQ ID NO: 203444 - RNA, 64 nt, Human
cacccucuugaccgaaauuuccuugugacacagagaagggcaaaggucugagcccagaguugac

SEQ ID NO: 203445 - RNA, 64 nt, Human
ccccuuggaggagcuguguaugcgggggugccaggaagggcauagcuccugcccccaggccuag

SEQ ID NO: 203446 - RNA, 64 nt, Human
ucaggcguggcaguggggaagccauggaggcugggaagggcaaaguguggagagaggagugacc

SEQ ID NO: 203447 - RNA, 64 nt, Human
cagcugaggucgugccagggagacagagucuggagaagggcagaggaauuuuggaaggaucccu

SEQ ID NO: 203448 - RNA, 64 nt, Human
ggaacgcugagcugccucaacagggcuguauucugaagggcaggccucaugcagcagccuccuu

SEQ ID NO: 203449 - RNA, 64 nt, Human
uucuggugucaaaguuuuguuacauuaugggugugaagggcauuugauauauuuuucuuaacua

SEQ ID NO: 203450 - RNA, 64 nt, Human
cuucagccccuggaaggugcuccaggauaacaaagaagggcagguugaagccccucauggaagg

SEQ ID NO: 203451 - RNA, 64 nt, Human
ccagcuuuccucaucaggccauugucccugaagagaagggcagggcugaggccucucauuccag

SEQ ID NO: 203452 - RNA, 64 nt, Human
gcucaugggaaaauugugaucaaaagggcuaugggaagggcagaccccgccaaugauuucucuu

SEQ ID NO: 203453 - RNA, 64 nt, Human
ucuguuggggaucagagggcuggcgggaacgcgagaagggcaccagcagcauuccacacccagc

SEQ ID NO: 203454 - RNA, 64 nt, Human
ugcugccugguggggaucagacagagauuggagagaagggcauuaaccugucugggggccagcg

SEQ ID NO: 203455 - RNA, 64 nt, Human
uggggcuucagggugaccugggcccaaagguucugaagggcaguuccuggcagccccaggcuug

SEQ ID NO: 203456 - RNA, 64 nt, Human
aauuaccaauuacacacagcuacuuauauuuuaugaagggcauuuuuuagaugaccucauccuc

SEQ ID NO: 203457 - RNA, 64 nt, Human
uuauucccuuuuaaagaauuuuugcccauaucuggaagggcacuauauuuuugggaggagccau

SEQ ID NO: 203458 - RNA, 64 nt, Human
ucuccucacugucauggugccaccagugucugaugaagggcagagugacccagacugcaggcag

SEQ ID NO: 203459 - RNA, 64 nt, Human
ugccucccuggucgcugggcuucaccccaccugggaagggcagugugcucugugggggcugcaa

SEQ ID NO: 203460 - RNA, 64 nt, Human
gagugagggcucccugcucccucccuccaccggggaagggcaugggcuagaagaggagaggggg

SEQ ID NO: 203461 - RNA, 64 nt, Human
ggacucugggguuuuacaagagggcugggguguggaagggcaagcugcaccaaagacgguggau

SEQ ID NO: 203462 - RNA, 64 nt, Human
cuucuugaagcaguuccaccaccaauaugauggggaagggcaggaacuuauggcagggugggga

SEQ ID NO: 203463 - RNA, 51 nt, Human
ucuuuuuucaauuuggcuaaugaagggcaaccacccagaacccagaaaaug

SEQ ID NO: 203464 - RNA, 64 nt, Human
ccuaaaaggucaccccucggcccccucuccaaaagaagggcaugggcacccccaggagaggaug

SEQ ID NO: 203465 - RNA, 64 nt, Human
cagguugccuggccagguggagagggggaaagaggaagggcaccguggguguaagaugccuuuc

SEQ ID NO: 203466 - RNA, 59 nt, Human
ccagagaagcccuccccugacugcauguggaagggcacacagcagcaggcagggaggag

SEQ ID NO: 203467 - RNA, 64 nt, Human
cccuucccucagaccucucccucauaauuccagagaagggcauuucugucuuuuuaagcacaga

SEQ ID NO: 203468 - RNA, 64 nt, Human
gcggggaugccgcgggcagcagcuggagcuaaaggaagggcaggcccacaggggccaccgcaga

SEQ ID NO: 203469 - RNA, 64 nt, Human
cuuuccccaccacaacccaccacggccaggcagagaagggcaacucccaagagccacugcacug

SEQ ID NO: 203470 - RNA, 64 nt, Human
cuggcaucuguggcauguguucuggucacuuggagaagggcauguguggggugugugugggaug

SEQ ID NO: 203471 - RNA, 64 nt, Human
gucgugcaccgaugagaacucuccuuauugcugugaagggcagacaaugcauggcugaucuacu

SEQ ID NO: 203472 - RNA, 64 nt, Human
gggagauuuugagguaaagauauggagaauugcugaagggcauucuuucccagugagucucugg

SEQ ID NO: 203473 - RNA, 64 nt, Human
uucauaaaaaagacucauaucuuugcaaacaaaagaagggcagauacugggcuucuacaugcua

SEQ ID NO: 203474 - RNA, 64 nt, Human
uuuguguaugcauugccuaauuagaguagggggagaagggcaacuauuauuaucccuauuuuac

SEQ ID NO: 203475 - RNA, 64 nt, Human
gaccccaggcuugaguuuuuaaaaugacuacccagaagggcacaagggggaaggaaaugguauu

SEQ ID NO: 203476 - RNA, 64 nt, Human
ugaaugaacauacauuuccugcauauauauguaugaagggcauguauauguaugaaugagcaaa

SEQ ID NO: 203477 - RNA, 64 nt, Human
ugaggauccgcaccccccggacuugcucucugaugaagggcaugucguucagugccccagcagu

SEQ ID NO: 203478 - RNA, 64 nt, Human
ugggcuccugggcggccugcgcagaugggccacagaagggcaggccggagcugcacacucuccc

SEQ ID NO: 203479 - RNA, 64 nt, Human
aucccagagggcucaggaugccccaggaaggaaagaagggcaacagacuacacgauuggacgug

SEQ ID NO: 203480 - RNA, 64 nt, Human
caagaagaaggucaaauaaggugguucuuuccuugaagggcagccuccugcccaggccccgugg

SEQ ID NO: 203481 - RNA, 64 nt, Human
cucuccuuuguuucccagcaucuggcugggaugugaagggcagcacucccuguccccauguccc

SEQ ID NO: 203482 - RNA, 64 nt, Human
ggacaggcccucccccauguucuucugucuccaggaagggcagcggcccucccaucacuggaag

SEQ ID NO: 203483 - RNA, 64 nt, Human
cugcucucugcuacucacacacacccucaugugugaagggcagagacacugucacaaacaggca

SEQ ID NO: 203484 - RNA, 64 nt, Human
ccuuggagaagcaaaaagccagggugugccaggagaagggcaugaagcgaggacccgagggcag

SEQ ID NO: 203485 - RNA, 64 nt, Human
gauguguugcccaaggugugcagggcaggucagggaagggcaggguccccuaaggaggagggcg

SEQ ID NO: 203486 - RNA, 64 nt, Human
caucagcauuaugccaaaggcccggggguccggggaagggcagaggucaccaggcuggucuacc

SEQ ID NO: 203487 - RNA, 64 nt, Human
ucuucaacuaacagguagcaugaaaauacaaggggaagggcaaccauuaacagauuaaaagaga

SEQ ID NO: 203488 - RNA, 64 nt, Human
ugaggaugaagagggagaaugucagaacucaagugaagggcaaucagggcagacugccuggagg

SEQ ID NO: 203489 - RNA, 64 nt, Human
gccacgggggcaccuuggaagaccaagagaggccgaagggcacgggguaggggguucucguagg

SEQ ID NO: 203490 - RNA, 64 nt, Human
cucagccugacaggagcaauggccaccagcaggugaagggcaucgcugccccaggccucaagcc

SEQ ID NO: 203491 - RNA, 64 nt, Human
guucuaggcccugcuuccuugccccuuugcugcagaagggcagcugaaggcucacccuagaaac

SEQ ID NO: 203492 - RNA, 64 nt, Human
gugaugucauuugagcaggacuggauuuuaagccgaagggcaauaucuacguguuuuucccccc

SEQ ID NO: 203493 - RNA, 64 nt, Human
gcaggugaggcgcucacagccucgcgaagguggagaagggcaggggcaggagagggcugcggag

SEQ ID NO: 203494 - RNA, 64 nt, Human
ccagucaggugucuaucccaacuggucagggagagaagggcagacccauucucaaagaccacca

SEQ ID NO: 203495 - RNA, 64 nt, Human
augggagccccagggucuucccuaccucaggcaggaagggcaggaaggagagccugcugcaugg

SEQ ID NO: 203496 - RNA, 64 nt, Human
cuucagcccaugacagaugagaaggggcuauauugaagggcaaagaggaacuguuguuugaauu

SEQ ID NO: 203497 - RNA, 64 nt, Human
uuugugggaccgcugcccacagauccagguguuggaagggcagcggguaagguucccaagccag

SEQ ID NO: 203498 - RNA, 64 nt, Human
ccaagaaaauaucuauugugauuaaagguagcaggaagggcaaaagucaugaagaagcucaugc

SEQ ID NO: 203499 - RNA, 64 nt, Human
ccaacaaagcuuacaacauuuaguuuaaacccaagaagggcacuaaacucagauugacuaaaua

SEQ ID NO: 203500 - RNA, 64 nt, Human
gaacuuaaguuuuaagaaaaagcacuucaaaacagaagggcaaauggaaaaggggaauauaaaa

SEQ ID NO: 203501 - RNA, 64 nt, Human
caggaaauauacuaaugcaggcccagacaccccagaagggcaagcucuccuggguauacauuuu

SEQ ID NO: 203502 - RNA, 64 nt, Human
ggaaggguagacccgugucuuuccagcccuaaaggaagggcagacccgugucuuuccaugcccg

SEQ ID NO: 203503 - RNA, 64 nt, Human
gacugggcagggaggcuuuggcaugacuuaagaggaagggcagucuugggcccgcuaugcaggu

SEQ ID NO: 203504 - RNA, 64 nt, Human
ggucaggaggccugucuaagucaagucagcacgggaagggcaucugacagauuccaggccuggg

SEQ ID NO: 203505 - RNA, 64 nt, Human
aggcuucaagaagcaguggcugcagggagucacagaagggcaggaccugaacgcugucugcuuc

SEQ ID NO: 203506 - RNA, 64 nt, Human
uuacuaaagggugcauguccccugcuugaacacugaagggcagguggugggccauggccauggu

SEQ ID NO: 203507 - RNA, 64 nt, Human
ggcuaauaauaaauauccagccagcuggaggaaggaagggcaggcugggcccaccuagccuuuc

SEQ ID NO: 203508 - RNA, 54 nt, Human
cuguggccucucagaauugagggugaagggcacggguccuuguuuuuggguuga

SEQ ID NO: 203509 - RNA, 64 nt, Human
ucugugguuccuggcaagguggcuuugcagucuggaagggcaggugggagcugugacacagugu

SEQ ID NO: 203510 - RNA, 64 nt, Human
cucugcagcucagggacuggcacacuggccuccagaagggcagcuccacagggcagggccucau

SEQ ID NO: 203511 - RNA, 64 nt, Human
ccggggguaggggccacccuggaauggggcaggggaagggcacacccccugcccaugcauggua

SEQ ID NO: 203512 - RNA, 64 nt, Human
uuuuugaccaaaaaaauaauaauaaguuagcucugaagggcagagggaauacccaagccccuga

SEQ ID NO: 203513 - RNA, 64 nt, Human
uucaaaaauggaagcccacuucucagauuuuucugaagggcauacaaugaaaagugaaggggaa

SEQ ID NO: 203514 - RNA, 64 nt, Human
gaacaaaccccgaaacaguaagaaauuggagugagaagggcaugguauugggacuaggaucggc

SEQ ID NO: 203515 - RNA, 64 nt, Human
ggccccgucuccaggccccagcuguugaaacuuugaagggcaacaaacaaccauccacacugcc

SEQ ID NO: 203516 - RNA, 64 nt, Human
uauuugcugauucuuugaagauugggaaggcucagaagggcagaguugaagaaggcauaccuuu

SEQ ID NO: 203517 - RNA, 64 nt, Human
uucgguaaugaggaagaaggagaaagagcugggggaagggcagaagacugguuuaggaggaaaa

SEQ ID NO: 203518 - RNA, 64 nt, Human
aaagcuuuuuuuuuuuuuccuggcuggggggcgggaagggcagacugcaaacuggggggcugcg

SEQ ID NO: 203519 - RNA, 64 nt, Human
agagaccguuuaguuccuaucaucuguggcaugugaagggcaaucacaguguuaaaagaagaca

SEQ ID NO: 203520 - RNA, 64 nt, Human
aauggugccuucaagaccuucaccaaacauacuagaagggcauuggccauucuauuguggcaag

SEQ ID NO: 203521 - RNA, 64 nt, Human
uuaacacaacagaaacuuauuugcuuacauuuuugaagggcagcaaagccaugcucccuccaga

SEQ ID NO: 203522 - RNA, 64 nt, Human
gacagguuuuggggggggcucaggucugggaugagaagggcacugcccucccucacccauauug

SEQ ID NO: 203523 - RNA, 64 nt, Human
cugugugagcucucugugagcucuggcuggcggagaagggcagguguccggagcugucggggug

SEQ ID NO: 203524 - RNA, 64 nt, Human
acauuucaaccccugcccuuguuuggagcuaagggaagggcaaaaggcucagauaugauucucu

SEQ ID NO: 203525 - RNA, 64 nt, Human
cccauuuuuaaaauaaauacaaauguuuauuucagaagggcaguuuugauuauaugugaauaca

SEQ ID NO: 203526 - RNA, 64 nt, Human
aagagcuuagaaacuggaaauacuagauuugggagaagggcagaguuacuugauaagggacuga

SEQ ID NO: 203527 - RNA, 64 nt, Human
uuugggggaggcggagaggggagaagaaggaagggaagggcagaaggaaggagggaagaaaaga

SEQ ID NO: 203528 - RNA, 64 nt, Human
aacuuggaacccucagcuccggguguucucggcagaagggcagcuggaagggacacaguggggc

SEQ ID NO: 203529 - RNA, 64 nt, Human
acugaaaauaggcauauagauauauuccaagccgccugacgaucuaauuguaaaaaguaaagca

SEQ ID NO: 203530 - RNA, 64 nt, Human
cugggcuguagggugaguggcuugcuuggugggaccugacgaguugguggcaugggaaggaugu

SEQ ID NO: 203531 - RNA, 64 nt, Human
gucccccauagagucaagccuagugcuugaagguccugacgacacccacaacauacaugagagu

SEQ ID NO: 203532 - RNA, 64 nt, Human
ccacacuucuucccaccaggaccaguucacuugcccugacgaguaugaagacccagcaguccuc

SEQ ID NO: 203533 - RNA, 64 nt, Human
ugcgcccucagggcuuccagcaggauugagucacccugacgaugaccggggagaagccgugugc

SEQ ID NO: 203534 - RNA, 64 nt, Human
gccaugggcaucuggccaccaaggaauuucgcacccugacgauuacucuugacacuuuuaugua

SEQ ID NO: 203535 - RNA, 64 nt, Human
cccaccccauaagcccugagacucccgccuuugaccugacgaucuucccccuucccgccuucag

SEQ ID NO: 203536 - RNA, 64 nt, Human
gaguauauaaaacuugagacauuuuuguaggaugccugacgagguguagccuuuuaucuuguuu

SEQ ID NO: 203537 - RNA, 64 nt, Human
guggcuggugccaguagaggucagucaagggaucccugacgagaauaaagagcccagaaacagg

SEQ ID NO: 203538 - RNA, 64 nt, Human
uucaggagagaguugaaccuaaacauagaaauugccugacgaacuccuugauuuuagccuucuc

SEQ ID NO: 203539 - RNA, 64 nt, Human
cugucggaaucuuuuuuguuuuaccauaaauucaccugacgagggcacucugagauagcacugc

SEQ ID NO: 203540 - RNA, 64 nt, Human
uguuuugguuguuuucuuaaaaaacaaguuaaaaccugacgauuucugcaggcuguguaagcau

SEQ ID NO: 203541 - RNA, 64 nt, Human
auauuuuugaaagcuacgcagacaagaacagccgccugacgaaauggaaacacacacagacaca

SEQ ID NO: 203542 - RNA, 64 nt, Human
cagccaggccaagcuauucuuuuaaaguaagcuuccugacgacaugaaauaauuggggguuuug

SEQ ID NO: 203543 - RNA, 64 nt, Human
ggauuccccggcugugacacucuacccuccagaaccugacgacugggccaugugacccaaggag

SEQ ID NO: 203544 - RNA, 64 nt, Human
ggccccggccggucacauugacugauggccaccgccugacgaaucgagugccugugugucuacc

SEQ ID NO: 203545 - RNA, 64 nt, Human
cauacauccaucggcuccccauggugucuucacaccugacgaugagccaggccugagccccaca

SEQ ID NO: 203546 - RNA, 64 nt, Human
cccagccuaugagcauccugagccccgcccucuuccugacgaaacuggccccggaucagagcag

SEQ ID NO: 203547 - RNA, 64 nt, Human
ugggcccaugugaggcuggggcucguaaauauucccugacgacacugaagaaucaagagggcag

SEQ ID NO: 203548 - RNA, 64 nt, Human
accgaugugaacgcaaaaugccuuguucauuauuccugacgagaucuugagguuguuugaugcu

SEQ ID NO: 203549 - RNA, 64 nt, Human
aaaaacaaaaaccuguaaaaauaauuuugagcuaccugacgacaaaucauaucuuuaaccagcc

SEQ ID NO: 203550 - RNA, 64 nt, Human
cagacaccccuuuccagccacaauccaccaucauccugacgaucccacaacugggacagaggcu

SEQ ID NO: 203551 - RNA, 64 nt, Human
cgaaugcucugcggcguagugcccuucugcccugccugacgauguaucgaaaagaugagaguga

SEQ ID NO: 203552 - RNA, 64 nt, Human
uggcuuugggauugaucaucuuguggauuuuauuccugacgauucccuugcugccuacccuuuu

SEQ ID NO: 203553 - RNA, 64 nt, Human
cucagcucccuccagugguggccgcccuguacucccugacgauuccacuguaacuaccaaucuu

SEQ ID NO: 203554 - RNA, 64 nt, Human
ccccaaaugccuuuccuggaguggcuaagccucuccugacgaggcuccucaugcggggagaggg

SEQ ID NO: 203555 - RNA, 64 nt, Human
ugguuucucaguugcugggcgagccuguacucugccugacgaggaacgcuggcuccgaagaggc

SEQ ID NO: 203556 - RNA, 64 nt, Human
ccggauucggaccacuuggggaucccagaaccucccugacgauauccuggaaggacugaggaag

SEQ ID NO: 203557 - RNA, 64 nt, Human
ccggcugccucccaccccagccucaaaaccucuuccugacgacccccgccccgugugauuuguu

SEQ ID NO: 203558 - RNA, 64 nt, Human
gcacaaugaaaaaagaaaacuucaggcugguacuccugacgaauauaggugccaaaauccucag

SEQ ID NO: 203559 - RNA, 62 nt, Human
accgccccucuucccaguagcucuucuaugacccugacgagugcgggcugaugaagaaggca

SEQ ID NO: 203560 - RNA, 64 nt, Human
caucugguuuucucuccaggggucuugcaaaauuccugacgagauaagcaguuaugugaccuca

SEQ ID NO: 203561 - RNA, 64 nt, Human
auccauggccuggaccaccccagaucccacauccccugacgaagcuuguccagauggcaggaag

SEQ ID NO: 203562 - RNA, 63 nt, Human
cuggcgccuggcggucaccuggugccuacuguccgacaggaugccuugauccucgugcgaccc

SEQ ID NO: 203563 - RNA, 63 nt, Human
agcggguuacauccacacugcugaucacaccaacgacaggagcugauaagcaagaaagcguca

SEQ ID NO: 203564 - RNA, 63 nt, Human
cggaugcccacagggccugggcaguugcuguggcgacaggaagagcuaaucuucagagagcuc

SEQ ID NO: 203565 - RNA, 63 nt, Human
aauaacggugcuugugucacuagcauagaauagcgacaggaauagaugugguccuuaggagac

SEQ ID NO: 203566 - RNA, 63 nt, Human
ggaggccugcagauccagccuuccugucaacagcgacaggaaaucucuagguuggugagugcu

SEQ ID NO: 203567 - RNA, 63 nt, Human
aguugucacuuuauuuuggaccugcugugaucucgacaggaaacgugccacagagcaguagug

SEQ ID NO: 203568 - RNA, 63 nt, Human
aaggugaggucugggaugcugcgugcggcgcgacgacaggagguaugaccuggguggggucag

SEQ ID NO: 203569 - RNA, 63 nt, Human
cauuguuguuuacuuuaguucuggaacugaaaccgacaggaagaaacuuuggaauaaggaaga

SEQ ID NO: 203570 - RNA, 63 nt, Human
uuccuugcucucacccacggauaaaaccagaagcgacaggaggccagcuccugggguuccugg

SEQ ID NO: 203571 - RNA, 63 nt, Human
aagauaaaaccagagcaggaaagaugaugcaagcgacaggaaaggcccucugcuuuucuuccc

SEQ ID NO: 203572 - RNA, 63 nt, Human
aggaacucuccuguggccugcucaucacccuuccgacaggagcacugcaugucagagcacuuu

SEQ ID NO: 203573 - RNA, 63 nt, Human
ucuguccacguggagagaaguugcccuccaggccgacaggaggccaugcccaccgccccugga

SEQ ID NO: 203574 - RNA, 63 nt, Human
gucccauggcuacauccugugggugggggcccucgacaggacagcaggacgguuuguuuucag

SEQ ID NO: 203575 - RNA, 63 nt, Human
accgucacuagcccagccaggcuucagucuguccgacaggaagcugcuggguggggguggggg

SEQ ID NO: 203576 - RNA, 63 nt, Human
uuuaauguugcccacauuaagcacuguggaucacgacaggaaaaagguuggagcagugcuuuu

SEQ ID NO: 203577 - RNA, 63 nt, Human
ugcuaggauggaauugcaauuugcaagcuucuucgacaggaaacuacaaguuccacacuuuaa

SEQ ID NO: 203578 - RNA, 63 nt, Human
ugugucccugaaguucccuguugcaugagccugcgacaggaccucacccccaccaccaggcuu

SEQ ID NO: 203579 - RNA, 63 nt, Human
ccaccaaucuggugaggauaaugguggcuccagcgacaggaggccaacccuggagaccaagaa

SEQ ID NO: 203580 - RNA, 63 nt, Human
gcuaguugggcgccccccacccucccccggacucgacaggagccuggaccuccggcuucauuu

SEQ ID NO: 203581 - RNA, 63 nt, Human
ggcugcuggacacgucggacagcgaaguauccccgacaggacgggcuugggcuuccauuugug

SEQ ID NO: 203582 - RNA, 63 nt, Human
ccagcaccagagcacaaugagaaacggcagcgccgacaggagcggcggcagaugaagcgguua

SEQ ID NO: 203583 - RNA, 63 nt, Human
aggcagcucccugaccauuuggacacauugccacgacaggagccuccaaguaugugggagggg

SEQ ID NO: 203584 - RNA, 63 nt, Human
gggcuccugggcugaacauggaccacgcaguugcgacaggaggccaggggaaaaaccccugcu

SEQ ID NO: 203585 - RNA, 63 nt, Human
cagccugcuuugagccucagugagaaguccuuccgacaggagcugacucaugucaggauggca

SEQ ID NO: 203586 - RNA, 63 nt, Human
ucagaaguugcugccaccaacucuuuaagaaggcgacaggaucaguccuucucucggguucug

SEQ ID NO: 203587 - RNA, 63 nt, Human
aggccaccuccaagccgcgggugcccccuagggcgacaggagccagcgggacgccgcacgcgg

SEQ ID NO: 203588 - RNA, 63 nt, Human
uaaaggaaagguacuggcuugaagucacaaccacgacaggaguaaggauuuggaauaaggauu

SEQ ID NO: 203589 - RNA, 63 nt, Human
caagggcugaauccaguggagcugggccaaguacgacaggaguccagauaaagguguaggggc

SEQ ID NO: 203590 - RNA, 63 nt, Human
cgaacacacgcugugagccaccaagaccuggggcgacaggagaaccgguccucucucugacgg

SEQ ID NO: 203591 - RNA, 63 nt, Human
cuuacaggugguugucugggguggguggaguggcgacaggauagagcugaaggacuaugcaaa

SEQ ID NO: 203592 - RNA, 63 nt, Human
caacacucuagaacuggagagagguccagauugcgacaggagccacaccagagugugcaggcu

SEQ ID NO: 203593 - RNA, 63 nt, Human
agaggacugucacucuagcaucuuugaggacugcgacaggaccgggacagcaggccccuugac

SEQ ID NO: 203594 - RNA, 63 nt, Human
agcugacccugugaucucugcccugucuucgggcgacaggagccagaaaaucagggacauggc

SEQ ID NO: 203595 - RNA, 63 nt, Human
uuugaggugucucaaucugaucugagugagaggcgacaggaguauuuuuuuuuuuuuacagcu

SEQ ID NO: 203596 - RNA, 63 nt, Human
ggggaagaacuaggggcuccauuguucuucaggcgacaggagaccguugcuccagugcauguc

SEQ ID NO: 203597 - RNA, 51 nt, Human; identical to SEQ ID NO: 39609

SEQ ID NO: 203598 - RNA, 63 nt, Human
gaaccggcgcugggcaacacgggccugcaaacucgacaggacccugcccgaggggcccucgcg

SEQ ID NO: 203599 - RNA, 64 nt, Human
cucacuccaaccacaagucgcccuugacugcggcggccgcgagcggggcgggggcugccggugc

SEQ ID NO: 203600 - RNA, 64 nt, Human
guguagccgauggccagcaccaggagaggagucaggccgcgacugugcaggagaugacuuuccc

SEQ ID NO: 203601 - RNA, 64 nt, Human
cccaucgucugagauguggggagcaccucugcccggccgcgaccccauuugggaggugaggagc

SEQ ID NO: 203602 - RNA, 64 nt, Human
ccuggcgcacgcggcacuucagagccccgcccggggccgcgaccccgaccgucccugcugcucc

SEQ ID NO: 203603 - RNA, 64 nt, Human
gugacguagauuuuguacggcucacgccggccggggccgcgaggccuggucugagccucaggga

SEQ ID NO: 203604 - RNA, 64 nt, Human
ccugcgcaccccguucccagcgcauggcgccccgggccgcgagcuuagcuuagaccgugguguc

SEQ ID NO: 203605 - RNA, 64 nt, Human
uggugggaagccaguuggccagcuggggugagaaggccgcgaagccaugggcagacaggaagug

SEQ ID NO: 203606 - RNA, 64 nt, Human
gugcccugugcgccuugugacauuuauugguguuggccgcgacccacacaccuuuggccucauc

SEQ ID NO: 203607 - RNA, 64 nt, Human
cucgccagccucccagcagcaggcgcgcccuuccggccgcgagcugucccgcgugcgggucccc

SEQ ID NO: 203608 - RNA, 64 nt, Human
cuggacagugcggugggcgauggcccagguggguggccgcgacgguggccuccugcagagcugg

SEQ ID NO: 203609 - RNA, 64 nt, Human
cggcacggguggcggggacagacguuugggacuuggccgcgacucucugcuucucuccagcucu

SEQ ID NO: 203610 - RNA, 64 nt, Human
ggucugugugaagccaccgugcuucucuuuggggggccgcgagaucuagcaucucugaaauccu

SEQ ID NO: 203611 - RNA, 64 nt, Human
gcggacgaccccgacuuccgugccaucccagacgggccgcgaaggcggggugucgccugugccc

SEQ ID NO: 203612 - RNA, 64 nt, Human
gaggggagccagauccccgagggaggacccugagggccgcgaagcauccgagcccccagcuggg

SEQ ID NO: 203613 - RNA, 64 nt, Human
uucgcacaaugcaugcccaccuguugaucuaaggggccgcgauggucagggccacggccaaggg

SEQ ID NO: 203614 - RNA, 64 nt, Human
cacuacuggaagggaacugggccucgguggccggggccgcgagcugugaccacagcacccucaa

SEQ ID NO: 203615 - RNA, 64 nt, Human
ugacaaauccuaguagauucugugcauguggagcggccgcgaagaggugacaccguuuggggcu

SEQ ID NO: 203616 - RNA, 64 nt, Human
aaagcaacgagaggccccggcacaccuggaagcuggccgcgaauucggccucugggccugugug

SEQ ID NO: 203617 - RNA, 50 nt, Human
uccggaugaugucccgcugaggccgcgagggccccuccaggacugccaag

SEQ ID NO: 203618 - RNA, 64 nt, Human
ccccgcggccggccuggcuucacuggcgcccuuuggccgcgaccacgggaaccagcggugaggc

SEQ ID NO: 203619 - RNA, 64 nt, Human
ggacgcacuugggacuccucgagaggggacucgcggccgcgauggcaaggcauccugugaauuc

SEQ ID NO: 203620 - RNA, 64 nt, Human
ugcgaaucaggccuccccuacaucugggggcguuggccgcgagauucccauugacaccuuuguu

SEQ ID NO: 203621 - RNA, 64 nt, Human
cccuuccaccccccggggaacugaagauuguccuggccgcgaccugagaccuccaugaguggag

SEQ ID NO: 203622 - RNA, 64 nt, Human
cgccccgucugggaugugaggagcuccucugcccggccgcgaccccgucugggaggugaggagc

SEQ ID NO: 203623 - RNA, 64 nt, Human
gucccccgacagacacugugaacggaagacagcaggccgcgaucagagucgcuguucauucagc

SEQ ID NO: 203624 - RNA, 64 nt, Human
ccgguuguccaccucccgcgaagcccaaucgcgaggccgcgagccgggccguccacccacccgc

SEQ ID NO: 203625 - RNA, 64 nt, Human
aagaggaggggcugaugugaacauccggcauucaggccgcgaugacaccucccgcuacgaugag

SEQ ID NO: 203626 - RNA, 64 nt, Human
ugcucagccucaacugcugagcgcccccacucccggccgcgagcaggcagggcuucggggacgc

SEQ ID NO: 203627 - RNA, 64 nt, Human
uuguaaggcccagggguugcacugagucugcagaggccgcgaccuccuagaacgcugugggugc

SEQ ID NO: 203628 - RNA, 64 nt, Human
accgcagaaaugacaccgcacgccagcgccccgcggccgcgauccggaccccaagcccacggcu

SEQ ID NO: 203629 - RNA, 64 nt, Human
gcccucuggcccgggcccgggcccugcaaccgccggcgcgcaccggcgcgcggccaagaccaug

SEQ ID NO: 203630 - RNA, 64 nt, Human
gggccgggcccccgccggcgcgcugcagggcgcgggcgcgcagcccgcccgcgcggccuggacu

SEQ ID NO: 203631 - RNA, 64 nt, Human
ucuacuaaaaauacaaaaauuagccgggcaugguggcgcgcaccuguaaucccagcuacuuggg

SEQ ID NO: 203632 - RNA, 64 nt, Human
agagauggguuuauggguuggggcgccgccguucggcgcgcacgaguuccgggccguuccccuc

SEQ ID NO: 203633 - RNA, 64 nt, Human
cucagacagaaaucagaugcuuccauguauucagggcgcgcauugugagcaguggaguaugagc

SEQ ID NO: 203634 - RNA, 64 nt, Human
ugcagaaccgacgcuuacugugcgagaaucggagggcgcgcacgcggaucccccgccuggccug

SEQ ID NO: 203635 - RNA, 64 nt, Human
agcaccgccccgggggccgccccgaggcccuuccggcgcgcacccggaccccggcgcccugccc

SEQ ID NO: 203636 - RNA, 52 nt, Human
accugguuuucaccuacugaagggcgcgcaggcagggagaagggccgggggg

SEQ ID NO: 203637 - RNA, 64 nt, Human
ucccaccucagccuccuaaguagcugggaguacaggcgcgcaccaccacgccuagcugauuuuu

SEQ ID NO: 203638 - RNA, 64 nt, Human
cgccccaguaggagccccgcggcccagcaggugcggcgcgcacggagcgccccggccggcggcu

SEQ ID NO: 203639 - RNA, 64 nt, Human
cagccgcgcucugccccuccguccccagggugcaggcgcgcaccgcccaacccccaccucccgg

SEQ ID NO: 203640 - RNA, 64 nt, Human
ugucuuuuccccaggucuggucucugauccagcuggcgcgcagauaccugcagaagggcuacac

SEQ ID NO: 203641 - RNA, 64 nt, Human
ccuccuuagcacauccagucccagcguggcccuuggcgcgcagcagcaggcgaacucccagaag

SEQ ID NO: 203642 - RNA, 64 nt, Human
guacagagccgggagggucggcgucuggggucagggcgcgcacagcccagcagcccgaggccgc

SEQ ID NO: 203643 - RNA, 64 nt, Human
ucacuggccccggcgggaugaggagaccaugccgggcgcgcacacacggcagcuucuguuugaa

SEQ ID NO: 203644 - RNA, 64 nt, Human
ggcccuggcccgcaccccagggagcggcgggggcggcgcgcagggcccacugugcccgggacaa

SEQ ID NO: 203645 - RNA, 64 nt, Human
cugcccuaaagccugacauucuugcacaggguggggcgcgcaguaggaaccucccccgcaggag

SEQ ID NO: 203646 - RNA, 64 nt, Human
cgguugaguucuggagucugacccaucgcgggguggcgcgcaaaccuuggaaggcagcaguauu

SEQ ID NO: 203647 - RNA, 64 nt, Human
cgccgcggcgggccugccagcugggggccuuugcggcgcgcaggggcgaagccuguaaucacug

SEQ ID NO: 203648 - RNA, 64 nt, Human
cagcucccggcguggcgggcaggcucaggggaggggcgcgcaugguccgccagggcugugggcc

SEQ ID NO: 203649 - RNA, 64 nt, Human
ucuacuaaaaauacaaaaaugagcugggcuugguggcgcgcaccuguagucccaguuacucggg

SEQ ID NO: 203650 - RNA, 64 nt, Human
acucuacgaaaauuaaaaguuagcccggugugguggcgcgcaccuguggcuuagcuacccugaa

SEQ ID NO: 203651 - RNA, 64 nt, Human
ccugguuuucaccuacugagcccaccgucagcggggcgcgcacgcccccaaaccagcuguuuac

SEQ ID NO: 203652 - RNA, 64 nt, Human
aguuaaacuuauguaagcuuuccguggcaugcggggcgcgcacccacguccccgcugcguaaga

SEQ ID NO: 203653 - RNA, 64 nt, Human
cugguucccccaggacccugaggguuuccaccuuggcgcgcagcccgggagauccgcccugggc

SEQ ID NO: 203654 - RNA, 64 nt, Human
aagucucugggacugugagaccuggccucgcacaggcgcgcacacaccgccaagcagcucagca

SEQ ID NO: 203655 - RNA, 64 nt, Human
uccugccucagccucccaaguagcugggacugcaggcgcgcacaccacgcccagcuaauuuuug

SEQ ID NO: 203656 - RNA, 64 nt, Human
ccccgcauggaccgcggcuuccgccggguagcgcggcgcgcaggcuccucggaacguccggcuc

SEQ ID NO: 203657 - RNA, 64 nt, Human
uccacacacaccuacacucacacacgcgcacaugggcgcgcacgaacuaccauucaggcaguca

SEQ ID NO: 203658 - RNA, 64 nt, Human
gaacgggccgcuccccgccagccgccuuccccagcagccgcagguggugccagccacuccacag

SEQ ID NO: 203659 - RNA, 64 nt, Human
gaagccugaccuagccagaagugccuguccgcugcagccgcacccuaccuugucuaagaaacca

SEQ ID NO: 203660 - RNA, 64 nt, Human
ugcaaggauggagugggugucucugcaucacccacagccgcagcuguaaggcacgcuggaaggc

SEQ ID NO: 203661 - RNA, 64 nt, Human
cucuuucugggccaaguuccucuagugcccuccacagccgcagccucccucugaccugcaggcc

SEQ ID NO: 203662 - RNA, 64 nt, Human
uuuccccccaccccccagcacaggagagcacccacagccgcagaaggggaauguguccuccugc

SEQ ID NO: 203663 - RNA, 64 nt, Human
agggccugggugaacucccuggaccuuuccuagccagccgcacagucuaggcccuuguggggug

SEQ ID NO: 203664 - RNA, 64 nt, Human
agaagauucugaaaauccuacccccaccccccaccagccgcacagauuguacuaccgcgagagg

SEQ ID NO: 203665 - RNA, 64 nt, Human
gugguuccuacgcccgaggcucccuucccuuccccagccgcacucaugcccugcuccugucuug

SEQ ID NO: 203666 - RNA, 64 nt, Human
auccugcuuuauuuauuugggucccaacaccccgcagccgcaugccccuuaugucccucuucuc

SEQ ID NO: 203667 - RNA, 64 nt, Human
uauaugguacugcugugacgcggcacauacaccccagccgcacagaugcgugugacccagaggc

SEQ ID NO: 203668 - RNA, 64 nt, Human
uuaaucguaguuuuuuugagaauuggucccaccucagccgcaccuugcuggaugcuucuccagu

SEQ ID NO: 203669 - RNA, 64 nt, Human
gggacuggacccagugcccucugcagaccccucccagccgcagcaccaagggcuugcugccuug

SEQ ID NO: 203670 - RNA, 64 nt, Human
caggggcuggcacccaugggacacccucugcccccagccgcagccugucagagcucugccuggc

SEQ ID NO: 203671 - RNA, 64 nt, Human
gcguggcaggacagaagcacuguaaagggcucuccagccgcagcucagcugcacugcguuccga

SEQ ID NO: 203672 - RNA, 64 nt, Human
uuaaaucuaguggauugguuuucaacaucgugccugccgauaugccuacagaaucaucuguaag

SEQ ID NO: 203673 - RNA, 64 nt, Human
ugaaauacaagcgugauuaaucaguaauucacauugccgauaugcauaugcaacuuauaaucaa

SEQ ID NO: 203674 - RNA, 64 nt, Human
uugugucaggaaaaaaugugggguaugccaaguaugccgauagaauaagugcuaaugaugccau

SEQ ID NO: 203675 - RNA, 64 nt, Human
gcuuccccuccguuccuaacuguuggcuuucccccagccgcacgggucccaggccccagagaag

SEQ ID NO: 203676 - RNA, 58 nt, Human
ucauccccagagagcucugacgacgcugcagccgcagggagggaggggcuggccagag

SEQ ID NO: 203677 - RNA, 64 nt, Human
gguaguuuagaagacauguuuugaugaaaaugaacagccgcauguucauucaagcugaagaugc

SEQ ID NO: 203678 - RNA, 64 nt, Human
uccaugggcguccuuugggugacucgccauaaaucagccgcaaggauccuucccuguaaauuug

SEQ ID NO: 203679 - RNA, 64 nt, Human
gacagaaaagcgagucgcaggaggaagggagaugcagccgcacaggggaugauuacccuccuag

SEQ ID NO: 203680 - RNA, 64 nt, Human
ccggggugaugcauaaaauccugugugccugggucagccgcaucacagacaaugacuugacaug

SEQ ID NO: 203681 - RNA, 64 nt, Human
cuccagcugcaucacagugauggccaagcugcaucagccgcacucuccuggacgccauauagcu

SEQ ID NO: 203682 - RNA, 64 nt, Human
uucacagcucauccacaaggaguggugguacagccagccgcagcagugacuacaauaguugcac

SEQ ID NO: 203683 - RNA, 64 nt, Human
cuuuuuacagaaagaugccgccuguagccagugacagccgcaacccuacaggccucaguuccuu

SEQ ID NO: 203684 - RNA, 64 nt, Human
aaugauggaugacuccuccaagaugaaaauggaccagccgcaguggcucacgccuguaauacca

SEQ ID NO: 203685 - RNA, 64 nt, Human
uuccagggaaacucauuucaagaugaaaauggaccagccgcaguggcucacgccuguaauacca

SEQ ID NO: 203686 - RNA, 64 nt, Human
aucuccauguagaauaaaugaagaaagggaggcccagccgcaggaaggcagaauaaauccuugg

SEQ ID NO: 203687 - RNA, 64 nt, Human
cuugugaccacucagugucccguccccaccccuccagccgcaguuuuuggcuacaaacugucac

SEQ ID NO: 203688 - RNA, 64 nt, Human
gcuccuuggucaccaggcaaugggagcuguagaccagccgcaugcacuugccccacauucacug

SEQ ID NO: 203689 - RNA, 64 nt, Human
gggcagccccugggcaggagacguggcugcugaacagccgcaaaccaucuucaccugggggcau

SEQ ID NO: 203690 - RNA, 64 nt, Human
aggacagaacuuuccccaauuacagggugacucacagccgcauuggugacucacuucaaugugu

SEQ ID NO: 203691 - RNA, 64 nt, Human
cuuuuuccauuaaagaauaaaauauuuuggacaaugccgauaaauguaugaaguuaguauccac

SEQ ID NO: 203692 - RNA, 64 nt, Human
guuaggaggacaaaaggaauguguaagucuuuaaugccgauaucuucagaaaaccuaagcaaac

SEQ ID NO: 203693 - RNA, 64 nt, Human
guccagauuuuaaaggugcuuuaagguugcccucugccgauacuguuugucuuucuacuguuuc

SEQ ID NO: 203694 - RNA, 64 nt, Human
cuaaacucagugccugagcccggcccugcagccccagccgcagugucugaaggccaccucccaa

SEQ ID NO: 203695 - RNA, 64 nt, Human
caccugagggcaagaaguacccaggaugcccaaacagccgcacagguguccugugcuuccugug

SEQ ID NO: 203696 - RNA, 64 nt, Human
uauuuauuuucacacauuuaauuccuauuaaguacagccgcaagaaagaaaaaaugaugaaguu

SEQ ID NO: 203697 - RNA, 64 nt, Human
gccuugcucuguuccucuuuggucccaagagcagcagccgcagccuccucgugauccucccuag

SEQ ID NO: 203698 - RNA, 64 nt, Human
gcacacccugccuguuuucucuuuuuagacacaacagccgcaguuuggccagccacuaaguccc

SEQ ID NO: 203699 - RNA, 64 nt, Human
cuccugccugggggaagagccaggcccugaggaacagccgcagcgugucacagguguuggugag

SEQ ID NO: 203700 - RNA, 64 nt, Human
gguggaaggaccgcgggugucgcaggugucgugucagccgcaauaaacagaagccagaagcccu

SEQ ID NO: 203701 - RNA, 64 nt, Human
aguuucuuuucuaaaacccauuugggugacucagcagccgcaucugcuaccugauuuuauccug

SEQ ID NO: 203702 - RNA, 64 nt, Human
uagcccuucacugaccccagcucuucccuugcugcagccgcaccugcagcuccagggaguuaac

SEQ ID NO: 203703 - RNA, 64 nt, Human
ucccuuucucuggggauuccacaccucucuuccccagccgcaacgggggugccaggagccccag

SEQ ID NO: 203704 - RNA, 64 nt, Human
ccgaugccugcccuuccagaggggccacuguccccagccgcagccaacugugucccacaggaau

SEQ ID NO: 203705 - RNA, 64 nt, Human
gaugggggggauaccggagggggucuugucuucccagccgcagucuaggaaugaugcggggggg

SEQ ID NO: 203706 - RNA, 64 nt, Human
agcugguccucugggaacagccagcucccgagcacagccgcacuccuguugacccuggauccca

SEQ ID NO: 203707 - RNA, 64 nt, Human
ccuugacggcguuggcggggccugggcacaggggcagccgcagggaggcagggauggcaaggcg

SEQ ID NO: 203708 - RNA, 64 nt, Human
gaggccccgccccaccgcuccgggagcugcucaucagccgcaacuuccugccgacccugaugcg

SEQ ID NO: 203709 - RNA, 64 nt, Human
ccccguaaagcagcccugcagccucugccucucucagccgcaucacccuguugcuuccuucaca

SEQ ID NO: 203710 - RNA, 64 nt, Human
ccugaugaaaauaaagaauggaaagcuucagugcugccgauaaagaugcugaguugcgacacac

SEQ ID NO: 203711 - RNA, 64 nt, Human
guggccugacaaugaacuacugcaggaauccagaugccgauacaggcccuugguguuuuaccac

SEQ ID NO: 203712 - RNA, 64 nt, Human
gagccguuugugucuugggaguuuguggcccacaugccgauagcacggucaucgcacaugacuc

SEQ ID NO: 203713 - RNA, 64 nt, Human
ccauaacguccuccgcauccacuuuccagcucagcagccgcacccgaggcucagccugaggggu

SEQ ID NO: 203714 - RNA, 64 nt, Human
ggccccauugccuggucuaguagcggaucucacucagccgcagacaaguaaucacuaacccguu

SEQ ID NO: 203715 - RNA, 64 nt, Human
uccuacaucuaaguggccccuccacccucucccccagccgcacgggcacuggaggucucgcucc

SEQ ID NO: 203716 - RNA, 64 nt, Human
uuccugggagugggagucaagugugccugcuauccagccgcaaauccauacccccugccccaga

SEQ ID NO: 203717 - RNA, 64 nt, Human
ugagacugaccugucucacccagcagccacugcccagccgcacuccaggcaagggccagugcgc

SEQ ID NO: 203718 - RNA, 64 nt, Human
cuccacagccuccuugugggcuccagccccuugucagccgcagccucucuugagggggacuccc

SEQ ID NO: 203719 - RNA, 64 nt, Human
gccuuaaucuacauaauucuucaucucgccaauucagccgcagccuuuaaagaguuaguguuaa

SEQ ID NO: 203720 - RNA, 64 nt, Human
acuuugagagggcugaagggagggccuugauuuccagccgcaaucuggcuccuccuggaaaauu

SEQ ID NO: 203721 - RNA, 64 nt, Human
agggcuucugagucagacuggcuggcgugucacucagccgcacccgugugcacuguaacuuuug

SEQ ID NO: 203722 - RNA, 64 nt, Human
auccucaugggaaauggcugaguggaucaaaccucagccgcagccuccgggggacaggcccagg

SEQ ID NO: 203723 - RNA, 64 nt, Human
cagccccagcuucucugcccacucauuucuaguccagccgcauuucagcagugccuucuggggu

SEQ ID NO: 203724 - RNA, 64 nt, Human
agggcuagaccuaagaccaggaaguuugagaaagcagccgcagcucaacucuuccagcuccgcc

SEQ ID NO: 203725 - RNA, 64 nt, Human
accacgagugagccagcgagggggcgggagaccucagccgcagccgccgcccccuccccugcag

SEQ ID NO: 203726 - RNA, 64 nt, Human
agaacggggaagacuccacucugucccgaggggccagccgcaggcguccccagggccacccugc

SEQ ID NO: 203727 - RNA, 64 nt, Human
cuguccgcccaccuucccuccacuacagaaccugcagccgcaaauccucugggcugcuucgucu

SEQ ID NO: 203728 - RNA, 64 nt, Human
ucuaauccccagucgugaugauuccacacuuccucagccgcauguugucuugccucauucauga

SEQ ID NO: 203729 - RNA, 64 nt, Human
ucaucugaagcugucacugcacacuccuagcugcugccgauacaccagauaccucagcuuauug

SEQ ID NO: 203730 - RNA, 64 nt, Human
gcacuuggcccaugggaaagaggguaugguggugugccgauaccuccucgccugcccuccaagc

SEQ ID NO: 203731 - RNA, 64 nt, Human
guucagaggucccugucuucuguccccaucuuccugccgauagcuauccccuguaugauguugg

SEQ ID NO: 203732 - RNA, 64 nt, Human
uucugucacauggaucccuugcacugcccuuuuacagccgcagccacaucccuuucuuauaccc

SEQ ID NO: 203733 - RNA, 64 nt, Human
aagugcugggauuacaggcaugagccaccgugcucagccgcaaaauucuuuaugaauuuuacac

SEQ ID NO: 203734 - RNA, 64 nt, Human
cuggccugaccccugaggagcgguccuuccacaccagccgcaacccaagcagaugacaggcaca

SEQ ID NO: 203735 - RNA, 64 nt, Human
uaacccaguggaggaugccaggccuggagacguccagccgcaggcggcugcugggccccaggug

SEQ ID NO: 203736 - RNA, 57 nt, Human
accccaucccucuggugugagccguggcagccgcagcgcagacuggcggagaaggag

SEQ ID NO: 203737 - RNA, 64 nt, Human
gcccggagcccucggcugccaugcucuucgugugcagccgcaguggccacaucuuggagauuga

SEQ ID NO: 203738 - RNA, 64 nt, Human
uguggggagaacccggacagcucaguccugccagcagccgcaaagagccgaggcugccaggccc

SEQ ID NO: 203739 - RNA, 64 nt, Human
cgcacagugccuaacccuagaaaagccaugucuucagccgcacaugcucaggcagcuaagggag

SEQ ID NO: 203740 - RNA, 64 nt, Human
gaggcgucgagggcgccagaaguggcggcagcagcagccgcagcagccaaagagaggcaagaga

SEQ ID NO: 203741 - RNA, 64 nt, Human
uugguggggguggggguggggguggggguggaagcagccgcaggagcaagggccccucccacau

SEQ ID NO: 203742 - RNA, 64 nt, Human
guggcccccgagcccggcccagccccaggccagucagccgcagacuuuggaaagcccaacgacc

SEQ ID NO: 203743 - RNA, 64 nt, Human
cguuugcaaccgcgacaaaauaacucuugacuaacagccgcagagcagccgguccugggguccc

SEQ ID NO: 203744 - RNA, 64 nt, Human
ggggcccaggaccaugccacuggcccugcucccccagccgcaggccucaccugcaggugcuccu

SEQ ID NO: 203745 - RNA, 64 nt, Human
gacagccggcagggaaucggaacccucagacccacagccgcaaggcacuggauucuggcagcac

SEQ ID NO: 203746 - RNA, 64 nt, Human
agagaugcaugcgcaggcucauaugcgucccaagcagccgcagcgcagccgccgggcaggccug

SEQ ID NO: 203747 - RNA, 64 nt, Human
ccacaggacugcuucaggccguggccacagguagcagccgcaaggggaaaugaagaaaacugag

SEQ ID NO: 203748 - RNA, 64 nt, Human
ggugggagguagaccuugaagacaaugaagagaaugccgauacucagacugcagcuggaccggc

SEQ ID NO: 203749 - RNA, 64 nt, Human
gucagaucucuuuaggaugacuguauuuuucaguugccgauacagcuuuuuguccucuaacugu

SEQ ID NO: 203750 - RNA, 64 nt, Human
gcauugaauuacguuuucaguaguacaggcuucuugccgauaugaagggaacuuuucagaaaga

SEQ ID NO: 203751 - RNA, 64 nt, Human
gaggguccaggaaagcucuugcccucuugcccagcagccgcaggcauaucucaacggaugccgu

SEQ ID NO: 203752 - RNA, 64 nt, Human
cucacacaucugggaguagccccacugccaccugcagccgcagccuggacugcugcccacgagu

SEQ ID NO: 203753 - RNA, 64 nt, Human
aacggagaaggcagcugacggggauugccuuccucagccgcagcagcaccuggggcuccagcug

SEQ ID NO: 203754 - RNA, 64 nt, Human
aaaacacaccacauugaaaauccugccacagcagcagccgcagccgccaacagcagcgcuguua

SEQ ID NO: 203755 - RNA, 64 nt, Human
agauugccaagugccagcagcugcagcaagaauacagccgcaaggaggaggagugccaggcagg

SEQ ID NO: 203756 - RNA, 64 nt, Human
ucgucccuagccugccaacagccaucugcccagacagccgcagugaggaugagcguccuggcag

SEQ ID NO: 203757 - RNA, 64 nt, Human
gcugacccucaccuccgagcccccacucccaccccagccgcacaguucccaccuccuggcaccu

SEQ ID NO: 203758 - RNA, 64 nt, Human
caccucucugcugugggaagacugugcaauggcacagccgcagagcuugguuugggagguugaa

SEQ ID NO: 203759 - RNA, 64 nt, Human
cgccccuguacgucugcucaugcaccaggcagcacagccgcaguuccucaguuguuguuuugac

SEQ ID NO: 203760 - RNA, 64 nt, Human
ucagaaucauggguagaaggugccauucagcucacagccgcacccagaauccuuugcagcccuc

SEQ ID NO: 203761 - RNA, 64 nt, Human
ucagccagaagucagagggcucucagccuucauccagccgcagcccuuuagaguuccugaagga

SEQ ID NO: 203762 - RNA, 64 nt, Human
cagcccucagcgucagacagcaaggaacugucaccagccgcacgcgugguaaaugacccagacc

SEQ ID NO: 203763 - RNA, 64 nt, Human
cuauuaggcaggaguuacaaaguuugcaaagucccagccgcacugggagccauggggagcaagu

SEQ ID NO: 203764 - RNA, 64 nt, Human
ugucccagucacuugcagaagggugacuucuugccagccgcaucgagaugccaugcauuggguu

SEQ ID NO: 203765 - RNA, 64 nt, Human
ggcacuuugcuggccccgagaaaggucgaugacacagccgcaaaucuaauccacguaguuccca

SEQ ID NO: 203766 - RNA, 64 nt, Human
caccugcccauccggccucugugucaagagguggcagccgcaccuuucugugagaacggaacuc

SEQ ID NO: 203767 - RNA, 64 nt, Human
caaaagucacagcuuagcugggcacaguggcucaugccgauaaucccagcaauucagaaagcug

SEQ ID NO: 203768 - RNA, 64 nt, Human
gcagcuaccuaggggaaacaagauguagugcuauugccgauaacaaguaagauuuuccacacua

SEQ ID NO: 203769 - RNA, 64 nt, Human
agcgggucagucuggcucgagcuguuuacagugaugccgauauuuucuugcuggaugacccacu

SEQ ID NO: 203770 - RNA, 64 nt, Human
aggcauuugccaaaccaagccagcuggagcgccacagccgcauacauacagguaacggggaagg

SEQ ID NO: 203771 - RNA, 64 nt, Human
uaggaaaugcaaaaaagaaaaaaaaaaaaggugacagccgcaguuggugcugugauggccguga

SEQ ID NO: 203772 - RNA, 64 nt, Human
agacagcaggccgcgaucagagucgcuguucauucagccgcagccucugggccggggcggcccc

SEQ ID NO: 203773 - RNA, 64 nt, Human
aaaugcugggauuacagauaugagccaucaugcccagccgcaacccuaauuuuucauucaguca

SEQ ID NO: 203774 - RNA, 64 nt, Human
gugugcgugugugcaagcuuugaaccuccuuccacagccgcaucuucucaugacacaaagcuuu

SEQ ID NO: 203775 - RNA, 64 nt, Human
cccaggaugaauacgacgacauugugguucacagcagccgcagccaaacccggcugccucccac

SEQ ID NO: 203776 - RNA, 64 nt, Human
gcugguguucagggcccuggacacagacacagagcagccgcaucucaaaggcagagcccugccu

SEQ ID NO: 203777 - RNA, 64 nt, Human
uaucccccucugaagacgaugggcagaggagugacagccgcagacacacgacagccggcagcaa

SEQ ID NO: 203778 - RNA, 64 nt, Human
aagcugaauagugacgcccucccccaagcccacccagccgcacacaggccuagagguaaccaau

SEQ ID NO: 203779 - RNA, 64 nt, Human
aaaaucccagggaccggagcccuggccucugcagcagccgcagucuccggauccaaagccaaag

SEQ ID NO: 203780 - RNA, 64 nt, Human
uacagcuacccugccgccgugccccaggcccucucagccgcagcacccgcgggcaccacuuucg

SEQ ID NO: 203781 - RNA, 64 nt, Human
gcugcagagcacacgcaacccagccucagcaucacagccgcagcucuguucagcggagcagcca

SEQ ID NO: 203782 - RNA, 64 nt, Human
gucccuggcugcagaccccgagcuggcccugggccagccgcaccucugaagguuuucugugugc

SEQ ID NO: 203783 - RNA, 64 nt, Human
agggagguggcacgggccagggcgcgggggccgccagccgcacuucugaggagaccagcaguca

SEQ ID NO: 203784 - RNA, 64 nt, Human
gccuggccgugugcauggccucccgggcugugggcagccgcaucugugaggugacucgugaaag

SEQ ID NO: 203785 - RNA, 64 nt, Human
gcaggggugggggcaccugccugggcccuggguccagccgcauccccaugcccagccuuucgcg

SEQ ID NO: 203786 - RNA, 64 nt, Human
gacguguaucugguagaaggcgaacaggcguugaugccgauaacaagaaucgccuuuaagguuc

SEQ ID NO: 203787 - RNA, 64 nt, Human
aucaaaaccugcuaccuccccaagacuuuacuagugccgauaaacuuucucaaagagcaaccag

SEQ ID NO: 203788 - RNA, 64 nt, Human
ucccugucacucccugaaacacuauuaauagcucugccgauagcugguguugucacaacugccu

SEQ ID NO: 203789 - RNA, 64 nt, Human
gaauccuuuucuacaugaugcccugcugaccaugcagccgcaccagagagagauucuuccccaa

SEQ ID NO: 203790 - RNA, 64 nt, Human
gaggugugggacucagaggagggggcugaggccacagccgcaucuugaucaggcuuucucaagc

SEQ ID NO: 203791 - RNA, 64 nt, Human
aagugcugcuguggagugagguguauugguguugcagccgcagagaaaugccccaguguuauuu

SEQ ID NO: 203792 - RNA, 54 nt, Human
aggagcaagagggagucugagcaccagccgcagccggggccaaaguuugugggg

SEQ ID NO: 203793 - RNA, 64 nt, Human
cacuuaauaaccagggaaccagccaaauacugugcagccgcagaauaugcauaucaaugaguug

SEQ ID NO: 203794 - RNA, 64 nt, Human
aucaaccuucgagaaauuccaguugucuuuuucccagccgcauccugccuguagauggccgggg

SEQ ID NO: 203795 - RNA, 64 nt, Human
guuggugcccauucugcaccaguuguuuuaccccugccgauaaccagcagucagagauucuuuu

SEQ ID NO: 203796 - RNA, 64 nt, Human
aaagaagccuagaaaagaagcaguaaucuaccucugccgauaaccuguuuaagaugacucagca

SEQ ID NO: 203797 - RNA, 64 nt, Human
aggagaaaggacuauuucucaguuagaaaacuuuugccgauaccuuguacacuuagcggauaca

SEQ ID NO: 203798 - RNA, 64 nt, Human
acucugcucucuaaugagaacaaaguuagaaaucugccgauaaccuaaaauaauuuagaaauga

SEQ ID NO: 203799 - RNA, 64 nt, Human
uccucaacguauuguuucggcagcacuuauuuaaugccgauauacucuagaugaaguuuuacau

SEQ ID NO: 203800 - RNA, 61 nt, Human
uaacggugcuugugucacuagcauagaauagcgacaggaauagaugugguccuuaggagac

SEQ ID NO: 203801 - RNA, 61 nt, Human
ccuugcucucacccacggauaaaaccagaagcgacaggaggccagcuccugggguuccugg

SEQ ID NO: 203802 - RNA, 64 nt, Human; identical to SEQ ID NO: 189263

SEQ ID NO: 203803 - RNA, 64 nt, Human; identical to SEQ ID NO: 189264

SEQ ID NO: 203804 - RNA, 64 nt, Human; identical to SEQ ID NO: 189265

SEQ ID NO: 203805 - RNA, 64 nt, Human; identical to SEQ ID NO: 189266

SEQ ID NO: 203806 - RNA, 64 nt, Human; identical to SEQ ID NO: 189267

SEQ ID NO: 203807 - RNA, 64 nt, Human; identical to SEQ ID NO: 189268

SEQ ID NO: 203808 - RNA, 64 nt, Human; identical to SEQ ID NO: 189269

SEQ ID NO: 203809 - RNA, 59 nt, Human; identical to SEQ ID NO: 189270

SEQ ID NO: 203810 - RNA, 64 nt, Human; identical to SEQ ID NO: 189271

SEQ ID NO: 203811 - RNA, 64 nt, Human; identical to SEQ ID NO: 189272

SEQ ID NO: 203812 - RNA, 64 nt, Human; identical to SEQ ID NO: 189273

SEQ ID NO: 203813 - RNA, 64 nt, Human; identical to SEQ ID NO: 189274

SEQ ID NO: 203814 - RNA, 64 nt, Human; identical to SEQ ID NO: 189275

SEQ ID NO: 203815 - RNA, 64 nt, Human; identical to SEQ ID NO: 189276

SEQ ID NO: 203816 - RNA, 64 nt, Human; identical to SEQ ID NO: 189280

SEQ ID NO: 203817 - RNA, 62 nt, Human
caguuaaaaaaauaagucgccccuccaaaacacgcccccaucccacagcgcuccgcagcuuc

SEQ ID NO: 203818 - RNA, 62 nt, Human
cccagcccggagagaacagagggaaggagccgcgcccccaccuggagcugaaucacaugacc

SEQ ID NO: 203819 - RNA, 62 nt, Human
gcccgcggauaccuuggacuacggugccuucccgcccccaccaguggacacuuccggguggc

SEQ ID NO: 203820 - RNA, 62 nt, Human
cucaaauagugccccuccuuaagcccaucccucgcccccagccugaggugaucuuucccucc

SEQ ID NO: 203821 - RNA, 64 nt, Human; identical to SEQ ID NO: 189281

SEQ ID NO: 203822 - RNA, 64 nt, Human; identical to SEQ ID NO: 189282

SEQ ID NO: 203823 - RNA, 64 nt, Human; identical to SEQ ID NO: 189283

SEQ ID NO: 203824 - RNA, 64 nt, Human; identical to SEQ ID NO: 189284

SEQ ID NO: 203825 - RNA, 64 nt, Human; identical to SEQ ID NO: 189285

SEQ ID NO: 203826 - RNA, 64 nt, Human; identical to SEQ ID NO: 189286

SEQ ID NO: 203827 - RNA, 64 nt, Human; identical to SEQ ID NO: 189287

SEQ ID NO: 203828 - RNA, 64 nt, Human; identical to SEQ ID NO: 189288

SEQ ID NO: 203829 - RNA, 64 nt, Human; identical to SEQ ID NO: 189289

SEQ ID NO: 203830 - RNA, 64 nt, Human; identical to SEQ ID NO: 189290

SEQ ID NO: 203831 - RNA, 64 nt, Human; identical to SEQ ID NO: 189291

SEQ ID NO: 203832 - RNA, 64 nt, Human; identical to SEQ ID NO: 189292

SEQ ID NO: 203833 - RNA, 64 nt, Human; identical to SEQ ID NO: 189293

SEQ ID NO: 203834 - RNA, 64 nt, Human; identical to SEQ ID NO: 189294

SEQ ID NO: 203835 - RNA, 64 nt, Human; identical to SEQ ID NO: 189298

SEQ ID NO: 203836 - RNA, 64 nt, Human; identical to SEQ ID NO: 189299

SEQ ID NO: 203837 - RNA, 62 nt, Human
gaagagcacagcugcagaucccaggccucuggcgcccccacucaagacuaccaaagccagga

SEQ ID NO: 203838 - RNA, 62 nt, Human
gcugguuagucuccagacccucacagcagccacgcccccaggcccaccgugcaugguguggg

SEQ ID NO: 203839 - RNA, 62 nt, Human
agcaaagccuggagaaguggggccggaggcuccgcccccaucaugugccugccaccccuucc

SEQ ID NO: 203840 - RNA, 64 nt, Human; identical to SEQ ID NO: 189300

SEQ ID NO: 203841 - RNA, 64 nt, Human; identical to SEQ ID NO: 189301

SEQ ID NO: 203842 - RNA, 64 nt, Human; identical to SEQ ID NO: 189302

SEQ ID NO: 203843 - RNA, 64 nt, Human; identical to SEQ ID NO: 189303

SEQ ID NO: 203844 - RNA, 64 nt, Human; identical to SEQ ID NO: 189304

SEQ ID NO: 203845 - RNA, 64 nt, Human; identical to SEQ ID NO: 189305

SEQ ID NO: 203846 - RNA, 64 nt, Human; identical to SEQ ID NO: 189306

SEQ ID NO: 203847 - RNA, 64 nt, Human; identical to SEQ ID NO: 189307

SEQ ID NO: 203848 - RNA, 64 nt, Human; identical to SEQ ID NO: 189308

SEQ ID NO: 203849 - RNA, 64 nt, Human; identical to SEQ ID NO: 189309

SEQ ID NO: 203850 - RNA, 64 nt, Human; identical to SEQ ID NO: 189310

SEQ ID NO: 203851 - RNA, 53 nt, Human; identical to SEQ ID NO: 189311

SEQ ID NO: 203852 - RNA, 64 nt, Human; identical to SEQ ID NO: 189312

SEQ ID NO: 203853 - RNA, 64 nt, Human; identical to SEQ ID NO: 189317

SEQ ID NO: 203854 - RNA, 64 nt, Human; identical to SEQ ID NO: 189318

SEQ ID NO: 203855 - RNA, 64 nt, Human; identical to SEQ ID NO: 189319

SEQ ID NO: 203856 - RNA, 62 nt, Human
ucugggacuggacagcuuugcuccgcucccaccgcccccaccccuuccccaggcccaccauc

SEQ ID NO: 203857 - RNA, 62 nt, Human
cgcggcuccgcccaggcaugguagccugagcgcgcccccaggguaguagggggcaccugagg

SEQ ID NO: 203858 - RNA, 62 nt, Human
cuggugcuuuucucuuuuguuuuagugccccccgcccccaucccuauaauaucuguaacuac

SEQ ID NO: 203859 - RNA, 64 nt, Human; identical to SEQ ID NO: 189320

SEQ ID NO: 203860 - RNA, 64 nt, Human; identical to SEQ ID NO: 189321

SEQ ID NO: 203861 - RNA, 64 nt, Human; identical to SEQ ID NO: 189322

SEQ ID NO: 203862 - RNA, 64 nt, Human; identical to SEQ ID NO: 189323

SEQ ID NO: 203863 - RNA, 64 nt, Human; identical to SEQ ID NO: 189324

SEQ ID NO: 203864 - RNA, 64 nt, Human; identical to SEQ ID NO: 189325

SEQ ID NO: 203865 - RNA, 64 nt, Human; identical to SEQ ID NO: 189326

SEQ ID NO: 203866 - RNA, 64 nt, Human; identical to SEQ ID NO: 189327

SEQ ID NO: 203867 - RNA, 64 nt, Human; identical to SEQ ID NO: 189328

SEQ ID NO: 203868 - RNA, 64 nt, Human; identical to SEQ ID NO: 189329

SEQ ID NO: 203869 - RNA, 64 nt, Human; identical to SEQ ID NO: 189330

SEQ ID NO: 203870 - RNA, 64 nt, Human; identical to SEQ ID NO: 189331

SEQ ID NO: 203871 - RNA, 64 nt, Human; identical to SEQ ID NO: 189336

SEQ ID NO: 203872 - RNA, 64 nt, Human; identical to SEQ ID NO: 189337

SEQ ID NO: 203873 - RNA, 64 nt, Human; identical to SEQ ID NO: 189338

SEQ ID NO: 203874 - RNA, 62 nt, Human
agcacccugggauccuggagggagaggccccacgcccccacucucccuccacacuuccaggg

SEQ ID NO: 203875 - RNA, 62 nt, Human
aaaagaggccagcucugcagcccccucggggacgcccccaccagcucaaauuccgagugcag

SEQ ID NO: 203876 - RNA, 62 nt, Human
gccgugggcgggacccucaggcccgggcccgccgcccccagccccgccugccgccccucccc

SEQ ID NO: 203877 - RNA, 62 nt, Human
ucugagagcauuuuccuguucccccuaucaaccgcccccagugauaacaucugugaagccag

SEQ ID NO: 203878 - RNA, 64 nt, Human; identical to SEQ ID NO: 189339

SEQ ID NO: 203879 - RNA, 64 nt, Human; identical to SEQ ID NO: 189340

SEQ ID NO: 203880 - RNA, 64 nt, Human; identical to SEQ ID NO: 189341

SEQ ID NO: 203881 - RNA, 64 nt, Human; identical to SEQ ID NO: 189342

SEQ ID NO: 203882 - RNA, 64 nt, Human; identical to SEQ ID NO: 189343

SEQ ID NO: 203883 - RNA, 64 nt, Human; identical to SEQ ID NO: 189344

SEQ ID NO: 203884 - RNA, 64 nt, Human; identical to SEQ ID NO: 189345

SEQ ID NO: 203885 - RNA, 64 nt, Human; identical to SEQ ID NO: 189346

SEQ ID NO: 203886 - RNA, 64 nt, Human; identical to SEQ ID NO: 189347

SEQ ID NO: 203887 - RNA, 64 nt, Human; identical to SEQ ID NO: 189348

SEQ ID NO: 203888 - RNA, 64 nt, Human; identical to SEQ ID NO: 189349

SEQ ID NO: 203889 - RNA, 64 nt, Human; identical to SEQ ID NO: 189350

SEQ ID NO: 203890 - RNA, 64 nt, Human; identical to SEQ ID NO: 189355

SEQ ID NO: 203891 - RNA, 64 nt, Human; identical to SEQ ID NO: 189356

SEQ ID NO: 203892 - RNA, 64 nt, Human; identical to SEQ ID NO: 189357

SEQ ID NO: 203893 - RNA, 62 nt, Human
gaaacacucaacaauaaagacugagacccguucgcccccaugugacuuuuaucuguagcaga

SEQ ID NO: 203894 - RNA, 62 nt, Human
cccgugagucauccagcccugccuuuccccugcgcccccauccucucacgucccgccccgcc

SEQ ID NO: 203895 - RNA, 62 nt, Human
cuggggaagccacaucccacuggauccacacccgcccccacuucuccaucuuagaaaccccu

SEQ ID NO: 203896 - RNA, 62 nt, Human
uauaaggacuccaacccuguucaugaggguuccgcccccaugacccaaucagcuccaaaggc

SEQ ID NO: 203897 - RNA, 64 nt, Human; identical to SEQ ID NO: 189358

SEQ ID NO: 203898 - RNA, 64 nt, Human; identical to SEQ ID NO: 189359

SEQ ID NO: 203899 - RNA, 64 nt, Human; identical to SEQ ID NO: 189360

SEQ ID NO: 203900 - RNA, 64 nt, Human; identical to SEQ ID NO: 189361

SEQ ID NO: 203901 - RNA, 64 nt, Human; identical to SEQ ID NO: 189362

SEQ ID NO: 203902 - RNA, 64 nt, Human; identical to SEQ ID NO: 189363

SEQ ID NO: 203903 - RNA, 64 nt, Human; identical to SEQ ID NO: 189364

SEQ ID NO: 203904 - RNA, 64 nt, Human; identical to SEQ ID NO: 189365

SEQ ID NO: 203905 - RNA, 64 nt, Human; identical to SEQ ID NO: 189366

SEQ ID NO: 203906 - RNA, 64 nt, Human; identical to SEQ ID NO: 189367

SEQ ID NO: 203907 - RNA, 64 nt, Human; identical to SEQ ID NO: 189368

SEQ ID NO: 203908 - RNA, 64 nt, Human; identical to SEQ ID NO: 189369

SEQ ID NO: 203909 - RNA, 64 nt, Human; identical to SEQ ID NO: 189374

SEQ ID NO: 203910 - RNA, 64 nt, Human; identical to SEQ ID NO: 189375

SEQ ID NO: 203911 - RNA, 64 nt, Human; identical to SEQ ID NO: 189376

SEQ ID NO: 203912 - RNA, 62 nt, Human
cccaaagugcugggauuauaggcgugagccaccgcccccagcugauuccaggcgaauucuuc

SEQ ID NO: 203913 - RNA, 62 nt, Human
acggcagcaggacuggggcugauagcccaccccgcccccacugcagcucccacaaagcacuc

SEQ ID NO: 203914 - RNA, 62 nt, Human
uaggagaaaugggcccaugaucuccucacagucgcccccaguccuuggcccugcuucccugu

SEQ ID NO: 203915 - RNA, 62 nt, Human
caggcuggagacuggaccgcugacugcaccagcgcccccagaacauacacugugaacucaau

SEQ ID NO: 203916 - RNA, 64 nt, Human; identical to SEQ ID NO: 189377

SEQ ID NO: 203917 - RNA, 64 nt, Human; identical to SEQ ID NO: 189378

SEQ ID NO: 203918 - RNA, 64 nt, Human; identical to SEQ ID NO: 189379

SEQ ID NO: 203919 - RNA, 64 nt, Human; identical to SEQ ID NO: 189380

SEQ ID NO: 203920 - RNA, 64 nt, Human; identical to SEQ ID NO: 189381

SEQ ID NO: 203921 - RNA, 64 nt, Human; identical to SEQ ID NO: 189382

SEQ ID NO: 203922 - RNA, 64 nt, Human; identical to SEQ ID NO: 189383

SEQ ID NO: 203923 - RNA, 64 nt, Human; identical to SEQ ID NO: 189384

SEQ ID NO: 203924 - RNA, 64 nt, Human; identical to SEQ ID NO: 189385

SEQ ID NO: 203925 - RNA, 64 nt, Human; identical to SEQ ID NO: 189386

SEQ ID NO: 203926 - RNA, 64 nt, Human; identical to SEQ ID NO: 189387

SEQ ID NO: 203927 - RNA, 64 nt, Human; identical to SEQ ID NO: 189388

SEQ ID NO: 203928 - RNA, 64 nt, Human; identical to SEQ ID NO: 188697

SEQ ID NO: 203929 - RNA, 64 nt, Human; identical to SEQ ID NO: 188698

SEQ ID NO: 203930 - RNA, 64 nt, Human; identical to SEQ ID NO: 188699

SEQ ID NO: 203931 - RNA, 64 nt, Human; identical to SEQ ID NO: 188700

SEQ ID NO: 203932 - RNA, 62 nt, Human
aggccuguguagugucucuccccugcugcgggcgcccccaccccgauuccucuccccagaag

SEQ ID NO: 203933 - RNA, 61 nt, Human
cgucacuagcccagccaggcuucagucuguccgacaggaagcugcuggguggggguggggg

SEQ ID NO: 203934 - RNA, 61 nt, Human
accaaucuggugaggauaaugguggcuccagcgacaggaggccaacccuggagaccaagaa

SEQ ID NO: 203935 - RNA, 64 nt, Human; identical to SEQ ID NO: 188701

SEQ ID NO: 203936 - RNA, 64 nt, Human
gucguuuagaucaggguaaggcagucaggcggguguucaccacugccuuuucuuccucugagcg

SEQ ID NO: 203937 - RNA, 64 nt, Human
cccucuccugguuuccacaccucagacacgcacaguucaccaagugccuucuguagucacauga

SEQ ID NO: 203938 - RNA, 64 nt, Human
aagagcugaggguuaacaaugugaccagcccugaguucaccaguguucagcauggcagucgugc

SEQ ID NO: 203939 - RNA, 64 nt, Human
auaaaauguugucaaaccaagggaaaaaaccacaguucaccauguggaguuuacuuuuuuuaua

SEQ ID NO: 203940 - RNA, 64 nt, Human
gccuguuugaacuaugguaauggguggaagaggaguucaccaguuucaaagaucagacucugua

SEQ ID NO: 203941 - RNA, 64 nt, Human
gcugguugaggccaaagguuaacauugcuccacuguucaccaaggaagggggcaguggccaucc

SEQ ID NO: 203942 - RNA, 64 nt, Human
aaccaucacagcugggaagacauuucugcacaugguucaccaugcagugggcccaagcaagggg

SEQ ID NO: 203943 - RNA, 64 nt, Human
gcuacuggccaagaucagacgucgcugaggggcuguucaccaccauccucguucuccaggguca

SEQ ID NO: 203944 - RNA, 64 nt, Human
cugccccuuuagucuccugcaccccugcccccugguucaccagagggagcggaugaaggauggc

SEQ ID NO: 203945 - RNA, 64 nt, Human
ccugggcuugggugcccauauaggaggucuguauguucaccaacagugcggaggggucacacau

SEQ ID NO: 203946 - RNA, 64 nt, Human
gguuggggaaguggggcucaagaaggauuuugggguucaccagaugcuuccuggcccacgauga

SEQ ID NO: 203947 - RNA, 64 nt, Human
gccaucaguaaucaugccacuacucaccaguguuguucaccaacacccacccccacacacacca

SEQ ID NO: 203948 - RNA, 64 nt, Human
aggagugguauuuccgcccucucggagggcugguguucaccaaguuucccuccucgcugcaacc

SEQ ID NO: 203949 - RNA, 64 nt, Human
ugccuaauguguauuuuucauguuaauucugacaguucaccaaauagcuagucauggagaaugc

SEQ ID NO: 203950 - RNA, 64 nt, Human
cugccagccaaccacacuauucaaaaagcaaaguguucaccacuaaagcuaaccauucaucugg

SEQ ID NO: 203951 - RNA, 61 nt, Human
gccugcuuugagccucagugagaaguccuuccgacaggagcugacucaugucaggauggca

SEQ ID NO: 203952 - RNA, 61 nt, Human
agggcugaauccaguggagcugggccaaguacgacaggaguccagauaaagguguaggggc

SEQ ID NO: 203953 - RNA, 61 nt, Human
aggacugucacucuagcaucuuugaggacugcgacaggaccgggacagcaggccccuugac

SEQ ID NO: 203954 - RNA, 64 nt, Human; identical to SEQ ID NO: 188702

SEQ ID NO: 203955 - RNA, 64 nt, Human; identical to SEQ ID NO: 188703

SEQ ID NO: 203956 - RNA, 64 nt, Human; identical to SEQ ID NO: 188704

SEQ ID NO: 203957 - RNA, 64 nt, Human; identical to SEQ ID NO: 188705

SEQ ID NO: 203958 - RNA, 64 nt, Human; identical to SEQ ID NO: 188706

SEQ ID NO: 203959 - RNA, 64 nt, Human; identical to SEQ ID NO: 188707

SEQ ID NO: 203960 - RNA, 64 nt, Human; identical to SEQ ID NO: 188708

SEQ ID NO: 203961 - RNA, 64 nt, Human; identical to SEQ ID NO: 188709

SEQ ID NO: 203962 - RNA, 64 nt, Human; identical to SEQ ID NO: 188710

SEQ ID NO: 203963 - RNA, 64 nt, Human; identical to SEQ ID NO: 189392

SEQ ID NO: 203964 - RNA, 64 nt, Human; identical to SEQ ID NO: 189411

SEQ ID NO: 203965 - RNA, 64 nt, Human; identical to SEQ ID NO: 189412

SEQ ID NO: 203966 - RNA, 64 nt, Human; identical to SEQ ID NO: 189413

SEQ ID NO: 203967 - RNA, 64 nt, Human; identical to SEQ ID NO: 189414

SEQ ID NO: 203968 - RNA, 64 nt, Human; identical to SEQ ID NO: 189415

SEQ ID NO: 203969 - RNA, 62 nt, Human
agccgccuaaggcccgcggcucaugugcugcccgcccccauauuuauucacugauagagaau

SEQ ID NO: 203970 - RNA, 62 nt, Human
uugggcgcacucuucagcgucuccuccuccugcgcccccacugcgucugcccaggaacagca

SEQ ID NO: 203971 - RNA, 62 nt, Human
agucuaagaugagagccugugacagguggcagcgcccccaggugggguacuggcaucagagc

SEQ ID NO: 203972 - RNA, 62 nt, Human
uuccguguggugagccuggcugcccgccugcacgcccccacugcccccgcacgaaucaccuc

SEQ ID NO: 203973 - RNA, 64 nt, Human; identical to SEQ ID NO: 189416

SEQ ID NO: 203974 - RNA, 64 nt, Human; identical to SEQ ID NO: 189417

SEQ ID NO: 203975 - RNA, 64 nt, Human; identical to SEQ ID NO: 189418

SEQ ID NO: 203976 - RNA, 64 nt, Human; identical to SEQ ID NO: 189419

SEQ ID NO: 203977 - RNA, 64 nt, Human; identical to SEQ ID NO: 189420

SEQ ID NO: 203978 - RNA, 64 nt, Human; identical to SEQ ID NO: 189421

SEQ ID NO: 203979 - RNA, 64 nt, Human; identical to SEQ ID NO: 189422

SEQ ID NO: 203980 - RNA, 64 nt, Human; identical to SEQ ID NO: 189423

SEQ ID NO: 203981 - RNA, 64 nt, Human; identical to SEQ ID NO: 189424

SEQ ID NO: 203982 - RNA, 64 nt, Human; identical to SEQ ID NO: 189425

SEQ ID NO: 203983 - RNA, 64 nt, Human; identical to SEQ ID NO: 189429

SEQ ID NO: 203984 - RNA, 64 nt, Human; identical to SEQ ID NO: 189430

SEQ ID NO: 203985 - RNA, 64 nt, Human; identical to SEQ ID NO: 189431

SEQ ID NO: 203986 - RNA, 64 nt, Human; identical to SEQ ID NO: 189432

SEQ ID NO: 203987 - RNA, 64 nt, Human; identical to SEQ ID NO: 189433

SEQ ID NO: 203988 - RNA, 62 nt, Human
uagauccagaugagauacagcucagagugccacgcccccagaaagaggaaucaggcaaguac

SEQ ID NO: 203989 - RNA, 62 nt, Human
accccaacacaugcuucuucgaggggcagcagcgcccccacggggcucgcugggcgcccaac

SEQ ID NO: 203990 - RNA, 62 nt, Human
ccguggucccgacaaccucccugucccuugcccgcccccaggaagggggaaauggggcauuu

SEQ ID NO: 203991 - RNA, 62 nt, Human
guuuguaaggcgcucgucggcaccugcugaaacgcccccaccugacagccccauccucaaag

SEQ ID NO: 203992 - RNA, 64 nt, Human; identical to SEQ ID NO: 189434

SEQ ID NO: 203993 - RNA, 64 nt, Human; identical to SEQ ID NO: 189435

SEQ ID NO: 203994 - RNA, 64 nt, Human; identical to SEQ ID NO: 189436

SEQ ID NO: 203995 - RNA, 64 nt, Human; identical to SEQ ID NO: 189437

SEQ ID NO: 203996 - RNA, 64 nt, Human; identical to SEQ ID NO: 189438

SEQ ID NO: 203997 - RNA, 64 nt, Human; identical to SEQ ID NO: 189439

SEQ ID NO: 203998 - RNA, 64 nt, Human; identical to SEQ ID NO: 189440

SEQ ID NO: 203999 - RNA, 64 nt, Human; identical to SEQ ID NO: 189441

SEQ ID NO: 204000 - RNA, 64 nt, Human; identical to SEQ ID NO: 189442

SEQ ID NO: 204001 - RNA, 64 nt, Human; identical to SEQ ID NO: 189443

SEQ ID NO: 204002 - RNA, 64 nt, Human; identical to SEQ ID NO: 189447

SEQ ID NO: 204003 - RNA, 64 nt, Human; identical to SEQ ID NO: 189448

SEQ ID NO: 204004 - RNA, 64 nt, Human; identical to SEQ ID NO: 189449

SEQ ID NO: 204005 - RNA, 64 nt, Human; identical to SEQ ID NO: 189450

SEQ ID NO: 204006 - RNA, 64 nt, Human; identical to SEQ ID NO: 189451

SEQ ID NO: 204007 - RNA, 62 nt, Human
ggcacuccaaccucacucuucccgucugucugcgcccccauuucuccauuucugccgggguc

SEQ ID NO: 204008 - RNA, 62 nt, Human
uuagagcuuuucagugcaucccaccucccugucgcccccaugcucggcuuccucacauucag

SEQ ID NO: 204009 - RNA, 61 nt, Human
accggcgcugggcaacacgggccugcaaacucgacaggacccugcccgaggggcccucgcg

SEQ ID NO: 204010 - RNA, 64 nt, Human
ggcaggucugggccagaugcugggcaggaaaccccagcggcagaugggccugugugcacccaac

SEQ ID NO: 204011 - RNA, 64 nt, Human; identical to SEQ ID NO: 189452

SEQ ID NO: 204012 - RNA, 64 nt, Human; identical to SEQ ID NO: 189453

SEQ ID NO: 204013 - RNA, 64 nt, Human; identical to SEQ ID NO: 189454

SEQ ID NO: 204014 - RNA, 64 nt, Human; identical to SEQ ID NO: 189455

SEQ ID NO: 204015 - RNA, 64 nt, Human; identical to SEQ ID NO: 189456

SEQ ID NO: 204016 - RNA, 64 nt, Human; identical to SEQ ID NO: 189457

SEQ ID NO: 204017 - RNA, 64 nt, Human; identical to SEQ ID NO: 189458

SEQ ID NO: 204018 - RNA, 64 nt, Human; identical to SEQ ID NO: 189459

SEQ ID NO: 204019 - RNA, 64 nt, Human; identical to SEQ ID NO: 189460

SEQ ID NO: 204020 - RNA, 64 nt, Human; identical to SEQ ID NO: 189461

SEQ ID NO: 204021 - RNA, 64 nt, Human; identical to SEQ ID NO: 189465

SEQ ID NO: 204022 - RNA, 64 nt, Human; identical to SEQ ID NO: 189466

SEQ ID NO: 204023 - RNA, 64 nt, Human; identical to SEQ ID NO: 189467

SEQ ID NO: 204024 - RNA, 64 nt, Human; identical to SEQ ID NO: 189468

SEQ ID NO: 204025 - RNA, 64 nt, Human; identical to SEQ ID NO: 189469

SEQ ID NO: 204026 - RNA, 62 nt, Human
accuuaacuaucuuucaauuccauacuucccccgcccccauuuuaaaggcuuauuguuguau

SEQ ID NO: 204027 - RNA, 62 nt, Human
auuuccuuugcuucaaauucaaggccuuccaacgcccccauccccuuuacuaucauucucag

SEQ ID NO: 204028 - RNA, 62 nt, Human
cuaguauuguccauaucagaccucugaucccucgcccccacaccccaucucucuucccuaau

SEQ ID NO: 204029 - RNA, 62 nt, Human
ugagaaggcccugugcccuaaaggacaccccucgcccccaucuucauggagggggucauuuc

SEQ ID NO: 204030 - RNA, 64 nt, Human; identical to SEQ ID NO: 189470

SEQ ID NO: 204031 - RNA, 51 nt, Human; identical to SEQ ID NO: 189471

SEQ ID NO: 204032 - RNA, 64 nt, Human; identical to SEQ ID NO: 189472

SEQ ID NO: 204033 - RNA, 64 nt, Human; identical to SEQ ID NO: 189473

SEQ ID NO: 204034 - RNA, 64 nt, Human; identical to SEQ ID NO: 189474

SEQ ID NO: 204035 - RNA, 64 nt, Human; identical to SEQ ID NO: 189475

SEQ ID NO: 204036 - RNA, 64 nt, Human; identical to SEQ ID NO: 189476

SEQ ID NO: 204037 - RNA, 64 nt, Human; identical to SEQ ID NO: 189477

SEQ ID NO: 204038 - RNA, 64 nt, Human; identical to SEQ ID NO: 189478

SEQ ID NO: 204039 - RNA, 64 nt, Human; identical to SEQ ID NO: 189479

SEQ ID NO: 204040 - RNA, 64 nt, Human; identical to SEQ ID NO: 189483

SEQ ID NO: 204041 - RNA, 64 nt, Human; identical to SEQ ID NO: 189484

SEQ ID NO: 204042 - RNA, 64 nt, Human; identical to SEQ ID NO: 189485

SEQ ID NO: 204043 - RNA, 64 nt, Human; identical to SEQ ID NO: 189486

SEQ ID NO: 204044 - RNA, 64 nt, Human; identical to SEQ ID NO: 189487

SEQ ID NO: 204045 - RNA, 64 nt, Human; identical to SEQ ID NO: 189488

SEQ ID NO: 204046 - RNA, 62 nt, Human
caggaguucugacgacacgacucucagauccacgcccccagccuaacagcaacaacaaagac

SEQ ID NO: 204047 - RNA, 62 nt, Human
cccgccgccucccucacccggcaaggggcgcgcgcccccaggacccccccaguccgccccgu

SEQ ID NO: 204048 - RNA, 62 nt, Human
gagacccagcuccugcagcccuccugcucccacgcccccagacagcuugguggaggguccug

SEQ ID NO: 204049 - RNA, 64 nt, Human; identical to SEQ ID NO: 189489

SEQ ID NO: 204050 - RNA, 64 nt, Human; identical to SEQ ID NO: 189246

SEQ ID NO: 204051 - RNA, 64 nt, Human; identical to SEQ ID NO: 189247

SEQ ID NO: 204052 - RNA, 64 nt, Human; identical to SEQ ID NO: 189248

SEQ ID NO: 204053 - RNA, 64 nt, Human; identical to SEQ ID NO: 189249

SEQ ID NO: 204054 - RNA, 64 nt, Human; identical to SEQ ID NO: 189250

SEQ ID NO: 204055 - RNA, 64 nt, Human; identical to SEQ ID NO: 189251

SEQ ID NO: 204056 - RNA, 64 nt, Human; identical to SEQ ID NO: 189252

SEQ ID NO: 204057 - RNA, 64 nt, Human; identical to SEQ ID NO: 189253

SEQ ID NO: 204058 - RNA, 64 nt, Human; identical to SEQ ID NO: 189254

SEQ ID NO: 204059 - RNA, 64 nt, Human; identical to SEQ ID NO: 189255

SEQ ID NO: 204060 - RNA, 64 nt, Human; identical to SEQ ID NO: 189256

SEQ ID NO: 204061 - RNA, 64 nt, Human; identical to SEQ ID NO: 189257

SEQ ID NO: 204062 - RNA, 62 nt, Human
aaugaagauuuucaugagucagcccccccgcccgcccccaccccacacccacauccucucuu

SEQ ID NO: 204063 - RNA, 62 nt, Human
uauggacagcaucuaagucugcccaggccggccgcccccaccccucggggcuccugaauauc

SEQ ID NO: 204064 - RNA, 62 nt, Human
gcccaccagcgcgcaccgucgccacggaucgccgcccccacccagccgggcgccccggaccc

SEQ ID NO: 204065 - RNA, 62 nt, Human
agcucccuugaccuaccuuccuccccgcaccccgcccccaccuugugccccuguguccagcc

SEQ ID NO: 204066 - RNA, 64 nt, Human; identical to SEQ ID NO: 189258

SEQ ID NO: 204067 - RNA, 64 nt, Human; identical to SEQ ID NO: 189262

SEQ ID NO: 204068 - RNA, 64 nt, Human; identical to SEQ ID NO: 189263

SEQ ID NO: 204069 - RNA, 64 nt, Human; identical to SEQ ID NO: 189264

SEQ ID NO: 204070 - RNA, 64 nt, Human; identical to SEQ ID NO: 189265

SEQ ID NO: 204071 - RNA, 64 nt, Human; identical to SEQ ID NO: 189266

SEQ ID NO: 204072 - RNA, 64 nt, Human; identical to SEQ ID NO: 189267

SEQ ID NO: 204073 - RNA, 64 nt, Human; identical to SEQ ID NO: 189268

SEQ ID NO: 204074 - RNA, 64 nt, Human; identical to SEQ ID NO: 189269

SEQ ID NO: 204075 - RNA, 59 nt, Human; identical to SEQ ID NO: 189270

SEQ ID NO: 204076 - RNA, 64 nt, Human; identical to SEQ ID NO: 189271

SEQ ID NO: 204077 - RNA, 64 nt, Human; identical to SEQ ID NO: 189272

SEQ ID NO: 204078 - RNA, 64 nt, Human; identical to SEQ ID NO: 189273

SEQ ID NO: 204079 - RNA, 64 nt, Human; identical to SEQ ID NO: 189274

SEQ ID NO: 204080 - RNA, 64 nt, Human; identical to SEQ ID NO: 189275

SEQ ID NO: 204081 - RNA, 62 nt, Human
agcagacacacugagggccuggcagggcucaucgcccccaccuucuaagaagcccuguggaa

SEQ ID NO: 204082 - RNA, 64 nt, Human; identical to SEQ ID NO: 200093

SEQ ID NO: 204083 - RNA, 64 nt, Human
gggagcugagguucuucugcccugagcccugcagcagcggcagucacagcuuccagaugagggg

SEQ ID NO: 204084 - RNA, 64 nt, Human
gagacaggcccguggacagugauucccagacgggcagcggcaccauccucacaccucugcauuc

SEQ ID NO: 204085 - RNA, 64 nt, Human; identical to SEQ ID NO: 189276

SEQ ID NO: 204086 - RNA, 64 nt, Human; identical to SEQ ID NO: 189280

SEQ ID NO: 204087 - RNA, 64 nt, Human; identical to SEQ ID NO: 189281

SEQ ID NO: 204088 - RNA, 64 nt, Human; identical to SEQ ID NO: 189282

SEQ ID NO: 204089 - RNA, 64 nt, Human; identical to SEQ ID NO: 189283

SEQ ID NO: 204090 - RNA, 64 nt, Human; identical to SEQ ID NO: 189284

SEQ ID NO: 204091 - RNA, 64 nt, Human; identical to SEQ ID NO: 189285

SEQ ID NO: 204092 - RNA, 64 nt, Human; identical to SEQ ID NO: 189286

SEQ ID NO: 204093 - RNA, 64 nt, Human; identical to SEQ ID NO: 189287

SEQ ID NO: 204094 - RNA, 64 nt, Human; identical to SEQ ID NO: 189288

SEQ ID NO: 204095 - RNA, 64 nt, Human; identical to SEQ ID NO: 189289

SEQ ID NO: 204096 - RNA, 64 nt, Human; identical to SEQ ID NO: 189290

SEQ ID NO: 204097 - RNA, 64 nt, Human; identical to SEQ ID NO: 189291

SEQ ID NO: 204098 - RNA, 64 nt, Human; identical to SEQ ID NO: 189292

SEQ ID NO: 204099 - RNA, 64 nt, Human; identical to SEQ ID NO: 189293

SEQ ID NO: 204100 - RNA, 62 nt, Human
gacaaguguuugcauggggguucagcugugcccgcccccaggcugugccccaccacagauuc

SEQ ID NO: 204101 - RNA, 62 nt, Human
ucccaggauuucaucucaccauaucugugugccgcccccagcaccccccacccaccucuggg

SEQ ID NO: 204102 - RNA, 62 nt, Human
ucuacaccccaggagcccuggccuggcccuaccgcccccagcccuaccagccgcccgcccug

SEQ ID NO: 204103 - RNA, 62 nt, Human
ugggcgcgggagugagcugaggaacuggggugcgcccccaugagauucccaaugccaugggc

SEQ ID NO: 204104 - RNA, 64 nt, Human; identical to SEQ ID NO: 189294

SEQ ID NO: 204105 - RNA, 64 nt, Human; identical to SEQ ID NO: 189298

SEQ ID NO: 204106 - RNA, 64 nt, Human; identical to SEQ ID NO: 189299

SEQ ID NO: 204107 - RNA, 64 nt, Human; identical to SEQ ID NO: 189300

SEQ ID NO: 204108 - RNA, 64 nt, Human; identical to SEQ ID NO: 189301

SEQ ID NO: 204109 - RNA, 64 nt, Human; identical to SEQ ID NO: 189302

SEQ ID NO: 204110 - RNA, 64 nt, Human; identical to SEQ ID NO: 189303

SEQ ID NO: 204111 - RNA, 64 nt, Human; identical to SEQ ID NO: 189304

SEQ ID NO: 204112 - RNA, 64 nt, Human; identical to SEQ ID NO: 189305

SEQ ID NO: 204113 - RNA, 64 nt, Human; identical to SEQ ID NO: 189306

SEQ ID NO: 204114 - RNA, 64 nt, Human; identical to SEQ ID NO: 189307

SEQ ID NO: 204115 - RNA, 64 nt, Human; identical to SEQ ID NO: 189308

SEQ ID NO: 204116 - RNA, 64 nt, Human; identical to SEQ ID NO: 189309

SEQ ID NO: 204117 - RNA, 64 nt, Human; identical to SEQ ID NO: 189310

SEQ ID NO: 204118 - RNA, 53 nt, Human; identical to SEQ ID NO: 189311

SEQ ID NO: 204119 - RNA, 64 nt, Human; identical to SEQ ID NO: 189312

SEQ ID NO: 204120 - RNA, 62 nt, Human
agcugaugacagagagaggcucuacaaagaagcgcccccaaagagugcagcugcuaauuuua

SEQ ID NO: 204121 - RNA, 62 nt, Human
cuggacaacacugauuccuggagagguggcugcgcccccagcuucucucucccugucacaca

SEQ ID NO: 204122 - RNA, 62 nt, Human
uucuucuauauuguacagaguggggcaaaacacgcccccaucugcugccuuuucuauugccc

SEQ ID NO: 204123 - RNA, 64 nt, Human; identical to SEQ ID NO: 189317

SEQ ID NO: 204124 - RNA, 64 nt, Human; identical to SEQ ID NO: 189318

SEQ ID NO: 204125 - RNA, 64 nt, Human; identical to SEQ ID NO: 189319

SEQ ID NO: 204126 - RNA, 64 nt, Human; identical to SEQ ID NO: 189320

SEQ ID NO: 204127 - RNA, 64 nt, Human; identical to SEQ ID NO: 189321

SEQ ID NO: 204128 - RNA, 64 nt, Human; identical to SEQ ID NO: 189322

SEQ ID NO: 204129 - RNA, 64 nt, Human; identical to SEQ ID NO: 189323

SEQ ID NO: 204130 - RNA, 64 nt, Human; identical to SEQ ID NO: 189324

SEQ ID NO: 204131 - RNA, 64 nt, Human; identical to SEQ ID NO: 189325

SEQ ID NO: 204132 - RNA, 64 nt, Human; identical to SEQ ID NO: 189326

SEQ ID NO: 204133 - RNA, 64 nt, Human; identical to SEQ ID NO: 189327

SEQ ID NO: 204134 - RNA, 64 nt, Human; identical to SEQ ID NO: 189328

SEQ ID NO: 204135 - RNA, 64 nt, Human; identical to SEQ ID NO: 189329

SEQ ID NO: 204136 - RNA, 64 nt, Human; identical to SEQ ID NO: 189330

SEQ ID NO: 204137 - RNA, 64 nt, Human; identical to SEQ ID NO: 189331

SEQ ID NO: 204138 - RNA, 62 nt, Human
ccccacccccguuugcugggggcuccuccagccgcccccaugggaagaggccugguaccgcc

SEQ ID NO: 204139 - RNA, 62 nt, Human
ucccucuuccggaugucggacuaagcgaacagcgcccccacugccggccgguagcagccgga

SEQ ID NO: 204140 - RNA, 62 nt, Human
ucgcuccaggcccccucacccucaaaguguagcgcccccaaccgagcaaccucgguuugguc

SEQ ID NO: 204141 - RNA, 62 nt, Human
ggacaugacuucuggacagaggacaugggccacgcccccaugcauccccacccccgccccuc

SEQ ID NO: 204142 - RNA, 64 nt, Human; identical to SEQ ID NO: 189336

SEQ ID NO: 204143 - RNA, 64 nt, Human; identical to SEQ ID NO: 189337

SEQ ID NO: 204144 - RNA, 64 nt, Human; identical to SEQ ID NO: 189338

SEQ ID NO: 204145 - RNA, 64 nt, Human; identical to SEQ ID NO: 189339

SEQ ID NO: 204146 - RNA, 64 nt, Human; identical to SEQ ID NO: 189340

SEQ ID NO: 204147 - RNA, 64 nt, Human; identical to SEQ ID NO: 189341

SEQ ID NO: 204148 - RNA, 64 nt, Human; identical to SEQ ID NO: 189342

SEQ ID NO: 204149 - RNA, 64 nt, Human; identical to SEQ ID NO: 189343

SEQ ID NO: 204150 - RNA, 64 nt, Human; identical to SEQ ID NO: 189344

SEQ ID NO: 204151 - RNA, 64 nt, Human; identical to SEQ ID NO: 189345

SEQ ID NO: 204152 - RNA, 64 nt, Human; identical to SEQ ID NO: 189346

SEQ ID NO: 204153 - RNA, 64 nt, Human; identical to SEQ ID NO: 189347

SEQ ID NO: 204154 - RNA, 64 nt, Human; identical to SEQ ID NO: 189348

SEQ ID NO: 204155 - RNA, 64 nt, Human; identical to SEQ ID NO: 189349

SEQ ID NO: 204156 - RNA, 64 nt, Human; identical to SEQ ID NO: 189350

SEQ ID NO: 204157 - RNA, 62 nt, Human
agaggcagcugggcugggccaaggcaggaaggcgcccccauguguguggccucagucucagc

SEQ ID NO: 204158 - RNA, 64 nt, Human
ucugagcugggaguccccuuccccagcccugggucagcggcauccucagucguuguuacuuacu

SEQ ID NO: 204159 - RNA, 64 nt, Human
agccuugcaacucaaaguguggucuguggaccagcagcggcagugacaccugggagcuuguuag

SEQ ID NO: 204160 - RNA, 64 nt, Human
gcacggcugaccgccugcucgugccuucauucugcagcggcauggucccucccauucuggcucc

SEQ ID NO: 204161 - RNA, 64 nt, Human; identical to SEQ ID NO: 189355

SEQ ID NO: 204162 - RNA, 64 nt, Human; identical to SEQ ID NO: 189356

SEQ ID NO: 204163 - RNA, 64 nt, Human; identical to SEQ ID NO: 189357

SEQ ID NO: 204164 - RNA, 64 nt, Human; identical to SEQ ID NO: 189358

SEQ ID NO: 204165 - RNA, 64 nt, Human; identical to SEQ ID NO: 189359

SEQ ID NO: 204166 - RNA, 64 nt, Human; identical to SEQ ID NO: 189360

SEQ ID NO: 204167 - RNA, 64 nt, Human; identical to SEQ ID NO: 189361

SEQ ID NO: 204168 - RNA, 64 nt, Human; identical to SEQ ID NO: 189362

SEQ ID NO: 204169 - RNA, 64 nt, Human; identical to SEQ ID NO: 189363

SEQ ID NO: 204170 - RNA, 64 nt, Human; identical to SEQ ID NO: 189364

SEQ ID NO: 204171 - RNA, 64 nt, Human; identical to SEQ ID NO: 189365

SEQ ID NO: 204172 - RNA, 64 nt, Human; identical to SEQ ID NO: 189366

SEQ ID NO: 204173 - RNA, 64 nt, Human; identical to SEQ ID NO: 189367

SEQ ID NO: 204174 - RNA, 64 nt, Human; identical to SEQ ID NO: 189368

SEQ ID NO: 204175 - RNA, 64 nt, Human; identical to SEQ ID NO: 189369

SEQ ID NO: 204176 - RNA, 62 nt, Human
cuggccugcgagugaccccagcagccccucagcgcccccagagcccgucagcgugggggaaa

SEQ ID NO: 204177 - RNA, 62 nt, Human
uugaggagcauggaacucgaggggagaagucgcgcccccagggaagccagguaaggaggccc

SEQ ID NO: 204178 - RNA, 60 nt, Human; identical to SEQ ID NO: 147348

SEQ ID NO: 204179 - RNA, 62 nt, Human
caaacaugcagcccccacaccccucgucugcccgcccccagaucuucccucugugcucccug

SEQ ID NO: 204180 - RNA, 64 nt, Human; identical to SEQ ID NO: 189374

SEQ ID NO: 204181 - RNA, 64 nt, Human; identical to SEQ ID NO: 189375

SEQ ID NO: 204182 - RNA, 64 nt, Human; identical to SEQ ID NO: 189376

SEQ ID NO: 204183 - RNA, 64 nt, Human; identical to SEQ ID NO: 189377

SEQ ID NO: 204184 - RNA, 64 nt, Human; identical to SEQ ID NO: 189378

SEQ ID NO: 204185 - RNA, 64 nt, Human; identical to SEQ ID NO: 189379

SEQ ID NO: 204186 - RNA, 64 nt, Human; identical to SEQ ID NO: 189380

SEQ ID NO: 204187 - RNA, 64 nt, Human; identical to SEQ ID NO: 189381

SEQ ID NO: 204188 - RNA, 64 nt, Human; identical to SEQ ID NO: 189382

SEQ ID NO: 204189 - RNA, 64 nt, Human; identical to SEQ ID NO: 189383

SEQ ID NO: 204190 - RNA, 64 nt, Human; identical to SEQ ID NO: 189384

SEQ ID NO: 204191 - RNA, 64 nt, Human; identical to SEQ ID NO: 189385

SEQ ID NO: 204192 - RNA, 64 nt, Human; identical to SEQ ID NO: 189386

SEQ ID NO: 204193 - RNA, 64 nt, Human; identical to SEQ ID NO: 189387

SEQ ID NO: 204194 - RNA, 64 nt, Human; identical to SEQ ID NO: 189388

SEQ ID NO: 204195 - RNA, 64 nt, Human; identical to SEQ ID NO: 188697

SEQ ID NO: 204196 - RNA, 62 nt, Human
cccugccacagggcacuggaauggacagcaggcgcccccagaugcagguaccucccuugguc

SEQ ID NO: 204197 - RNA, 62 nt, Human
gaccagggcgagcccuggagcgccggagcggacgcccccagggagcuggggacacccccaug

SEQ ID NO: 204198 - RNA, 62 nt, Human
auacuuggcucucacauacuaaaugcuaguagcgcccccacccccacgcccagucacgguga

SEQ ID NO: 204199 - RNA, 64 nt, Human; identical to SEQ ID NO: 188698

SEQ ID NO: 204200 - RNA, 64 nt, Human; identical to SEQ ID NO: 188699

SEQ ID NO: 204201 - RNA, 64 nt, Human; identical to SEQ ID NO: 188700

SEQ ID NO: 204202 - RNA, 64 nt, Human; identical to SEQ ID NO: 188701

SEQ ID NO: 204203 - RNA, 64 nt, Human; identical to SEQ ID NO: 188702

SEQ ID NO: 204204 - RNA, 64 nt, Human; identical to SEQ ID NO: 188703

SEQ ID NO: 204205 - RNA, 64 nt, Human; identical to SEQ ID NO: 188704

SEQ ID NO: 204206 - RNA, 64 nt, Human; identical to SEQ ID NO: 188705

SEQ ID NO: 204207 - RNA, 64 nt, Human; identical to SEQ ID NO: 188706

SEQ ID NO: 204208 - RNA, 64 nt, Human; identical to SEQ ID NO: 188707

SEQ ID NO: 204209 - RNA, 64 nt, Human; identical to SEQ ID NO: 188708

SEQ ID NO: 204210 - RNA, 64 nt, Human; identical to SEQ ID NO: 188709

SEQ ID NO: 204211 - RNA, 64 nt, Human; identical to SEQ ID NO: 188710

SEQ ID NO: 204212 - RNA, 64 nt, Human; identical to SEQ ID NO: 189392

SEQ ID NO: 204213 - RNA, 64 nt, Human; identical to SEQ ID NO: 189411

SEQ ID NO: 204214 - RNA, 62 nt, Human
ugccagcaaugcuguccucacagaggcauagucgcccccagcuggguugugcuccacuguga

SEQ ID NO: 204215 - RNA, 62 nt, Human
cacaauguuucaaguuaaaccuuuugugucaccgcccccaccaaccaccaccuccuaaaucc

SEQ ID NO: 204216 - RNA, 62 nt, Human
acuacaccuggcugagguuccucugccugccccgcccccaguccccaccccugcccccagcc

SEQ ID NO: 204217 - RNA, 62 nt, Human
gggcuuuggacaaucuagagguaauuuauauccgcccccagguggagcaacaugcgauucug

SEQ ID NO: 204218 - RNA, 64 nt, Human; identical to SEQ ID NO: 189412

SEQ ID NO: 204219 - RNA, 64 nt, Human; identical to SEQ ID NO: 189413

SEQ ID NO: 204220 - RNA, 64 nt, Human; identical to SEQ ID NO: 189414

SEQ ID NO: 204221 - RNA, 64 nt, Human; identical to SEQ ID NO: 189415

SEQ ID NO: 204222 - RNA, 64 nt, Human; identical to SEQ ID NO: 189416

SEQ ID NO: 204223 - RNA, 64 nt, Human; identical to SEQ ID NO: 189417

SEQ ID NO: 204224 - RNA, 64 nt, Human; identical to SEQ ID NO: 189418

SEQ ID NO: 204225 - RNA, 64 nt, Human; identical to SEQ ID NO: 189419

SEQ ID NO: 204226 - RNA, 64 nt, Human; identical to SEQ ID NO: 189420

SEQ ID NO: 204227 - RNA, 64 nt, Human; identical to SEQ ID NO: 189421

SEQ ID NO: 204228 - RNA, 64 nt, Human; identical to SEQ ID NO: 189422

SEQ ID NO: 204229 - RNA, 64 nt, Human; identical to SEQ ID NO: 189423

SEQ ID NO: 204230 - RNA, 64 nt, Human; identical to SEQ ID NO: 189424

SEQ ID NO: 204231 - RNA, 64 nt, Human; identical to SEQ ID NO: 189425

SEQ ID NO: 204232 - RNA, 64 nt, Human; identical to SEQ ID NO: 189429

SEQ ID NO: 204233 - RNA, 62 nt, Human
gccaacgggcucagagcuggaguugccgccgccgcccccacugcuguguccuuuccagacuc

SEQ ID NO: 204234 - RNA, 62 nt, Human
ggagggaaggggauuuggagggaggcugucgucgcccccaggaaagacgggccugggggagg

SEQ ID NO: 204235 - RNA, 62 nt, Human
aguguguugugccugcugaagugaucaccccccgcccccagcccugcaucaggccacagguc

SEQ ID NO: 204236 - RNA, 62 nt, Human
ucucgucuuuagaaagcuguuugaauuccccccgcccccaguuuggaccguguagauauaac

SEQ ID NO: 204237 - RNA, 64 nt, Human; identical to SEQ ID NO: 189430

SEQ ID NO: 204238 - RNA, 64 nt, Human; identical to SEQ ID NO: 189431

SEQ ID NO: 204239 - RNA, 64 nt, Human; identical to SEQ ID NO: 189432

SEQ ID NO: 204240 - RNA, 64 nt, Human; identical to SEQ ID NO: 189433

SEQ ID NO: 204241 - RNA, 64 nt, Human; identical to SEQ ID NO: 189434

SEQ ID NO: 204242 - RNA, 64 nt, Human; identical to SEQ ID NO: 189435

SEQ ID NO: 204243 - RNA, 64 nt, Human; identical to SEQ ID NO: 189436

SEQ ID NO: 204244 - RNA, 64 nt, Human; identical to SEQ ID NO: 189437

SEQ ID NO: 204245 - RNA, 64 nt, Human; identical to SEQ ID NO: 189438

SEQ ID NO: 204246 - RNA, 64 nt, Human; identical to SEQ ID NO: 189439

SEQ ID NO: 204247 - RNA, 64 nt, Human; identical to SEQ ID NO: 189440

SEQ ID NO: 204248 - RNA, 64 nt, Human; identical to SEQ ID NO: 189441

SEQ ID NO: 204249 - RNA, 64 nt, Human; identical to SEQ ID NO: 189442

SEQ ID NO: 204250 - RNA, 64 nt, Human; identical to SEQ ID NO: 189443

SEQ ID NO: 204251 - RNA, 64 nt, Human; identical to SEQ ID NO: 189447

SEQ ID NO: 204252 - RNA, 62 nt, Human
caauuaggcuguugggaauccgccucuuuacccgcccccacucccgccccacacgcgcccug

SEQ ID NO: 204253 - RNA, 62 nt, Human
guacaaauaguugcuucccacugccccccgcccgcccccagaaugauauuaauuuugccuuu

SEQ ID NO: 204254 - RNA, 62 nt, Human
ggaaacgagccgugucagaucgcacaucccugcgcccccaugccccucugagucacacagga

SEQ ID NO: 204255 - RNA, 62 nt, Human
gggaugugacaagaagcagauccuggcccucccgcccccaccccucagggauauuuaaaacu

SEQ ID NO: 204256 - RNA, 64 nt, Human; identical to SEQ ID NO: 189448

SEQ ID NO: 204257 - RNA, 64 nt, Human; identical to SEQ ID NO: 189449

SEQ ID NO: 204258 - RNA, 64 nt, Human; identical to SEQ ID NO: 189450

SEQ ID NO: 204259 - RNA, 64 nt, Human; identical to SEQ ID NO: 189451

SEQ ID NO: 204260 - RNA, 64 nt, Human; identical to SEQ ID NO: 189452

SEQ ID NO: 204261 - RNA, 64 nt, Human; identical to SEQ ID NO: 189453

SEQ ID NO: 204262 - RNA, 64 nt, Human; identical to SEQ ID NO: 189454

SEQ ID NO: 204263 - RNA, 64 nt, Human; identical to SEQ ID NO: 189455

SEQ ID NO: 204264 - RNA, 64 nt, Human; identical to SEQ ID NO: 189456

SEQ ID NO: 204265 - RNA, 64 nt, Human; identical to SEQ ID NO: 189457

SEQ ID NO: 204266 - RNA, 64 nt, Human; identical to SEQ ID NO: 189458

SEQ ID NO: 204267 - RNA, 64 nt, Human; identical to SEQ ID NO: 189459

SEQ ID NO: 204268 - RNA, 64 nt, Human; identical to SEQ ID NO: 189460

SEQ ID NO: 204269 - RNA, 64 nt, Human; identical to SEQ ID NO: 189461

SEQ ID NO: 204270 - RNA, 64 nt, Human; identical to SEQ ID NO: 189465

SEQ ID NO: 204271 - RNA, 62 nt, Human
ggcuugcgccaggacuuggcgugggcaccgggcgcccccaucccagugucugugugcgucca

SEQ ID NO: 204272 - RNA, 62 nt, Human
ccccccaaaaagauguccauugccugcacugccgcccccauuuuugugccacuugcuugggg

SEQ ID NO: 204273 - RNA, 62 nt, Human
uucuacuugagcccucucucucugccacccaccgcccccaaucuaucuuggcucacucgcuc

SEQ ID NO: 204274 - RNA, 59 nt, Human; identical to SEQ ID NO: 147302

SEQ ID NO: 204275 - RNA, 64 nt, Human; identical to SEQ ID NO: 189466

SEQ ID NO: 204276 - RNA, 64 nt, Human; identical to SEQ ID NO: 189467

SEQ ID NO: 204277 - RNA, 64 nt, Human; identical to SEQ ID NO: 189468

SEQ ID NO: 204278 - RNA, 64 nt, Human; identical to SEQ ID NO: 189469

SEQ ID NO: 204279 - RNA, 64 nt, Human; identical to SEQ ID NO: 189470

SEQ ID NO: 204280 - RNA, 51 nt, Human; identical to SEQ ID NO: 189471

SEQ ID NO: 204281 - RNA, 64 nt, Human; identical to SEQ ID NO: 189472

SEQ ID NO: 204282 - RNA, 64 nt, Human; identical to SEQ ID NO: 189473

SEQ ID NO: 204283 - RNA, 64 nt, Human; identical to SEQ ID NO: 189474

SEQ ID NO: 204284 - RNA, 64 nt, Human; identical to SEQ ID NO: 189475

SEQ ID NO: 204285 - RNA, 64 nt, Human; identical to SEQ ID NO: 189476

SEQ ID NO: 204286 - RNA, 64 nt, Human; identical to SEQ ID NO: 189477

SEQ ID NO: 204287 - RNA, 64 nt, Human; identical to SEQ ID NO: 189478

SEQ ID NO: 204288 - RNA, 64 nt, Human; identical to SEQ ID NO: 189479

SEQ ID NO: 204289 - RNA, 64 nt, Human; identical to SEQ ID NO: 189483

SEQ ID NO: 204290 - RNA, 64 nt, Human; identical to SEQ ID NO: 189484

SEQ ID NO: 204291 - RNA, 62 nt, Human
uaaccugaccgugggcggggccuugcgguauccgcccccaauaaaagcaauuccaaccuucc

SEQ ID NO: 204292 - RNA, 62 nt, Human
gggggcgcccggggacaggagggauguccugccgcccccagccaggccgaacuccgcacucg

SEQ ID NO: 204293 - RNA, 62 nt, Human
cucuaacagguaaugccaggggcccuucacuccgcccccaugacugggaagaggccuguggc

SEQ ID NO: 204294 - RNA, 64 nt, Human; identical to SEQ ID NO: 189485

SEQ ID NO: 204295 - RNA, 64 nt, Human; identical to SEQ ID NO: 189486

SEQ ID NO: 204296 - RNA, 64 nt, Human; identical to SEQ ID NO: 189487

SEQ ID NO: 204297 - RNA, 64 nt, Human; identical to SEQ ID NO: 189488

SEQ ID NO: 204298 - RNA, 64 nt, Human; identical to SEQ ID NO: 189489

SEQ ID NO: 204299 - RNA, 64 nt, Human
ucccagacccaagugagucacgcuuccugauuccucggcgcaaaggagacguuuauccuuucaa

SEQ ID NO: 204300 - RNA, 64 nt, Human
acuugccugaauggcauccgccaacccagggaccucggcgcaacauaggccuuguccuugcugc

SEQ ID NO: 204301 - RNA, 64 nt, Human
ccuggggacgcccacccacacccacugcuuccucucggcgcaccccaggggaguguuagcagcg

SEQ ID NO: 204302 - RNA, 64 nt, Human
gccagcaccaagcaccacgcucucauccugcaagucggcgcacacaguggaugaaggcaggaga

SEQ ID NO: 204303 - RNA, 64 nt, Human
ggggugccccagacccagagauuagccucccacuucggcgcagaaaacaaaagcccuuuguggg

SEQ ID NO: 204304 - RNA, 64 nt, Human
ggcagcgccccggcccgcggcccccgcggcccacucggcgcacucagccagcgucuccccugug

SEQ ID NO: 204305 - RNA, 64 nt, Human
cccucauuuucuguuuauugcugcugcuguguuuucggcgcaacccacaaacccagugaugggu

SEQ ID NO: 204306 - RNA, 64 nt, Human
uggacucagaagccaagcugcuucccgccuagacucggcgcagggccccgcaccggugaggaag

SEQ ID NO: 204307 - RNA, 64 nt, Human
uuguacuucagugacuucuggaauaagcuggacgucggcgcaaucuugcucuucguggcagggc

SEQ ID NO: 204308 - RNA, 62 nt, Human
cuccagggacuugccuggcccuccucccccuccgcccccaauggguucggucuccuuugcgc

SEQ ID NO: 204309 - RNA, 62 nt, Human
ccuucguaucccgagucugggacacaaaacuccgcccccagccuaugagcauccugagcccc

SEQ ID NO: 204310 - RNA, 62 nt, Human
acaggaagccuucacacuggaagggggaccugcgcccccacaucugaaaccuguaggucccc

SEQ ID NO: 204311 - RNA, 62 nt, Human
gacauaagggucccacaggcuuccccaccccccgcccccacucacugccccagggaccaacu

SEQ ID NO: 204312 - RNA, 62 nt, Human
ugcacgagugucugugaggcgcugcgcggacucgcccccaggaacgcucuccucgagcccuc

SEQ ID NO: 204313 - RNA, 62 nt, Human
auuuccuuccacuguagcuauuagcggcuccucgcccccaccaguguagcaucuuccucugc

SEQ ID NO: 204314 - RNA, 62 nt, Human
guaacaugugggucauaccuugaaccccccuccgcccccaugcucucuguggccuccaugcc

SEQ ID NO: 204315 - RNA, 62 nt, Human
ggcaucaggccugggacacugcucuccuuccccgcccccagccugcuaaguuaaguggacag

SEQ ID NO: 204316 - RNA, 62 nt, Human
cguuucuuuccaccuggagggaaagggggggacgcccccagugagauucaaaucacgcaucu

SEQ ID NO: 204317 - RNA, 62 nt, Human
caagugaggacuuggcucccccacuccuucgacgcccccacccccgccccccgugcagagag

SEQ ID NO: 204318 - RNA, 62 nt, Human
gguggggaagggagggucucuugauuccuaaccgcccccacauacugcuccaccgcugaacu

SEQ ID NO: 204319 - RNA, 62 nt, Human
cgccccaccaccuccugggaccacaccacuaccgcccccaaccacagcagagacuagcagcg

SEQ ID NO: 204320 - RNA, 62 nt, Human
cugacaugggaugcagcuaacugcaguugggucgcccccaggccaacgcuccucucaauccu

SEQ ID NO: 204321 - RNA, 62 nt, Human
auauucucuugucuggcugcaccccuuuuucccgcccccagauugauaaguaaugaaagugc

SEQ ID NO: 204322 - RNA, 62 nt, Human
ucuagguuugugcuucuagccaugcccauucccgcccccaccaugccucuuugcauugccca

SEQ ID NO: 204323 - RNA, 62 nt, Human
cagccacuccagcgccuccccuccgcuccccacgcccccauauuggcaacacccccagcgcc

SEQ ID NO: 204324 - RNA, 62 nt, Human
gcaggcaagagaccgagccgcccuccucucaccgcccccacucccugccgugcuacacccag

SEQ ID NO: 204325 - RNA, 62 nt, Human
aucucaggauugagauucuauccccccuuccccgcccccagcagugucgcuccaauucaaau

SEQ ID NO: 204326 - RNA, 62 nt, Human
cccaaagugcugggauuacaggcgugagccaccgcccccagccugagccuuuuuuuuuuucu

SEQ ID NO: 204327 - RNA, 62 nt, Human
cgccccccggagguggcagcagccccgagggacgcccccagaggaccgggaggcaccccacc

SEQ ID NO: 204328 - RNA, 62 nt, Human
gcucacuaucacaggaacagcauggaggaaaccgcccccaugauccaguuaccuccaccugg

SEQ ID NO: 204329 - RNA, 62 nt, Human
gcuuuuuacccuuuaaguagcuccucuucccucgcccccacccucuaccccacccccaccuu

SEQ ID NO: 204330 - RNA, 62 nt, Human
uggagacggccacugagcgcuaccugcacguacgcccccagccuuuggcuggagaggauccc

SEQ ID NO: 204331 - RNA, 54 nt, Human; identical to SEQ ID NO: 147410

SEQ ID NO: 204332 - RNA, 62 nt, Human
cucccagcacacccgcacacagccagcaccaccgcccccaccgugcacuucuccucucuggg

SEQ ID NO: 204333 - RNA, 62 nt, Human
cccaacacaguacccaccaggacggggcacuccgcccccacccgucggcagagcaaccccac

SEQ ID NO: 204334 - RNA, 62 nt, Human
ccuacaagaugggguacuaacaccacccccaccgcccccaccaccacccccagcuccugagg

SEQ ID NO: 204335 - RNA, 62 nt, Human
acaccccaaggcgguugccggagcuuaagccccgcccccagcagcgagaacaucccaccccu

SEQ ID NO: 204336 - RNA, 62 nt, Human
gcaaggagcccggguuaaaauaucccccuauucgcccccaaaaugcaauaaaagaagauaaa

SEQ ID NO: 204337 - RNA, 62 nt, Human
acccacccgcaagccuaccagccuuguggccacgcccccacccggcugccacaagaauccaa

SEQ ID NO: 204338 - RNA, 62 nt, Human
cuggccccucacucccggcagcgggccggccucgcccccacucccccuccuaccccggcagg

SEQ ID NO: 204339 - RNA, 62 nt, Human
caagcagaggcccguggggcugaggauggagccgcccccagccgacuccaagcccgcagagg

SEQ ID NO: 204340 - RNA, 62 nt, Human
acgaacagccugacacauacgcacggggccgccgcccccaguaguuggucuuguacaugcgc

SEQ ID NO: 204341 - RNA, 62 nt, Human
aacacacacagcccccugcaccgcccgccccccgcccccaccaaggccccagccucuggcca

SEQ ID NO: 204342 - RNA, 62 nt, Human
cccuggugcccugagacagacacacagccucacgcccccaggaaugcaagugguuuccuggu

SEQ ID NO: 204343 - RNA, 62 nt, Human
gaggaggccgcuccuucccagacacacccccacgcccccacuggacggcauuggaggaaggg

SEQ ID NO: 204344 - RNA, 62 nt, Human
cucccccagccccauccucuguacagagcccacgcccccacuggugacaugucuuuucuugc

SEQ ID NO: 204345 - RNA, 62 nt, Human
gacuaccugggaccuccaccguugguguucaccgcccccacccugagcgccuggguccaggg

SEQ ID NO: 204346 - RNA, 62 nt, Human
gugguucugagauggcucccaggggcucccuccgcccccagguaggggccccucucagcccu

SEQ ID NO: 204347 - RNA, 62 nt, Human
cgucuacccagacucagagaccgugagcgccccgcccccaccccuacagccugcacacaccu

SEQ ID NO: 204348 - RNA, 62 nt, Human
accgucccccccgcccgaccccaccgcccucccgcccccaccuggcguguaguacuguauaa

SEQ ID NO: 204349 - RNA, 62 nt, Human
agcauccuaucaacugaaagagcagccgccgccgcccccagccggagaccccuuucguuuga

SEQ ID NO: 204350 - RNA, 62 nt, Human
gcaucaggccccgcccaacggccucauguccccgcccccacgacuuccggccccgccccggg

SEQ ID NO: 204351 - RNA, 62 nt, Human
ccccagggccaggucccagcuauguagacccccgcccccaccuccaacacugcacccuucug

SEQ ID NO: 204352 - RNA, 62 nt, Human
gaugucucuuuuguguuuuggccaccuggggccgcccccaaccuccccaccccaagaggggu

SEQ ID NO: 204353 - RNA, 62 nt, Human
ccagguuuccugaaaggcgggagucagaccuccgcccccagccagagcaagcuuggggcacc

SEQ ID NO: 204354 - RNA, 62 nt, Human
ggaccuucaaagggcuuuguauuuuacaccugcgcccccaggcugcucacagucggcuugcu

SEQ ID NO: 204355 - RNA, 62 nt, Human
gaagagugugggggaggcgcacagugugagcccgcccccacgucgugggguaacaucuguua

SEQ ID NO: 204356 - RNA, 62 nt, Human
gcgaggaccgccucggcagguggcgguaaaagcgcccccaucaagucacauaacauccugcc

SEQ ID NO: 204357 - RNA, 62 nt, Human
gcaagggccagguguugacaccuuaaagcuggcgcccccagccccacucuuggcugugcugg

SEQ ID NO: 204358 - RNA, 58 nt, Human; identical to SEQ ID NO: 147437

SEQ ID NO: 204359 - RNA, 54 nt, Human; identical to SEQ ID NO: 147438

SEQ ID NO: 204360 - RNA, 62 nt, Human
uuugcucgcuuuccuccccugccggcccccuccgcccccacacacacucgggacgucuucau

SEQ ID NO: 204361 - RNA, 62 nt, Human
cccucuccugacuuguauuguggcagucugaacgcccccagaaaauugugccaaagaguuua

SEQ ID NO: 204362 - RNA, 62 nt, Human
uuuuguuguuccccuucccucacacccugccucgcccccacuuuucuaguuaacuuuuucca

SEQ ID NO: 204363 - RNA, 62 nt, Human
caccuucucucccuccucccgacccgcccccucgcccccaccccuguguguuucgccaguua

SEQ ID NO: 204364 - RNA, 62 nt, Human
aucucccugccaucccccucucacgccacccccgcccccaccgggcugcaggugcugcugau

SEQ ID NO: 204365 - RNA, 62 nt, Human
gcgaggucccgcccucccguggucacuggcuccgcccccagcaccaggcgcccaguggagcc

SEQ ID NO: 204366 - RNA, 62 nt, Human
gcaguggcaccaucuuggcucacuucaaccuccgcccccaagguucaagugauucuccugcc

SEQ ID NO: 204367 - RNA, 62 nt, Human
accacuccgaucgcaauagauaacauugccaucgcccccaccaguccccucaugccucuggg

SEQ ID NO: 204368 - RNA, 62 nt, Human
ccuuguuccgagcccuugcuccuuaggauccccgcccccaccugcccccaaugcacacacag

SEQ ID NO: 204369 - RNA, 62 nt, Human
cgcgcggacuggcgucuccccucccggcgauccgcccccagcacuggggaggcgccacugaa

SEQ ID NO: 204370 - RNA, 62 nt, Human
ccugccggggccugcuggccccuguaaggucccgcccccaaagacccuggggccagcggggc

SEQ ID NO: 204371 - RNA, 62 nt, Human
ccaggugggccuuguacccccagcucuggcagcgcccccaggauugaacguggggagcccca

SEQ ID NO: 204372 - RNA, 62 nt, Human
ggguggcuuaauccagaggcccugucauggcccgcccccagccaugggaaagcaaacuucau

SEQ ID NO: 204373 - RNA, 62 nt, Human
uucuagacauacguggucugcggacagggcagcgcccccagcccaugacaagggagucuugu

SEQ ID NO: 204374 - RNA, 62 nt, Human
accugcagccugaaacgcaccgcuccugcgugcgcccccaccugguccccggaugcccccac

SEQ ID NO: 204375 - RNA, 62 nt, Human
agcccggccccccaugcagccaugacuggaugcgcccccaucucgggggcuugcugcacugc

SEQ ID NO: 204376 - RNA, 62 nt, Human
aggugggucuuaaaacagaccaaaccccgccccgcccccaacaacucugcuuuuagggaggc

SEQ ID NO: 204377 - RNA, 62 nt, Human
accccccucccacccaccgccacaauaaagaucgcccccaccuccacccucacccucuccug

SEQ ID NO: 204378 - RNA, 62 nt, Human
gaccgagugagccacuccuugucccgagcucccgcccccacugggcccuccuuccuccuggu

SEQ ID NO: 204379 - RNA, 62 nt, Human
ucuaaucaagucacgugauucucccuucaccccgcccccagggccuucccuucugcccccag

SEQ ID NO: 204380 - RNA, 62 nt, Human
gaaggucccauggccugcugggcuuggcucggcgcccccaccccuggcuaccuugugggaau

SEQ ID NO: 204381 - RNA, 62 nt, Human
ccgccccagccggcggacugugcuguuuccuccgcccccacucccguguuuucugaccuccu

SEQ ID NO: 204382 - RNA, 62 nt, Human
gguccuguggaggccagcagcgguguggcccccgcccccaggcugccugugucuucaccugu

SEQ ID NO: 204383 - RNA, 62 nt, Human
ggcaggggaagcggagaccagggugcaggcuccgcccccacccaaggccgggcccagccaga

SEQ ID NO: 204384 - RNA, 62 nt, Human
gaggcagccccggccugaccggccccccgccccgcccccaccccgcccccaggccuaaaugu

SEQ ID NO: 204385 - RNA, 62 nt, Human
ggccugaccggccccccgccccgcccccaccccgcccccaggccuaaaugugcacagcaugc

SEQ ID NO: 204386 - RNA, 62 nt, Human
caguuaacaugucagcuggcccuccaggcccccgcccccaucccguccacguugcugugucg

SEQ ID NO: 204387 - RNA, 62 nt, Human
cgagggaggggagucgggccccaggucgcccccgcccccagcccugcaugcaggugcccucg

SEQ ID NO: 204388 - RNA, 62 nt, Human
uaguuuccuccccccuuucccggcgccccucccgcccccauucaacaucucucauccuaucc

SEQ ID NO: 204389 - RNA, 62 nt, Human
cgcgccccugcggcucccgaggguccaggccccgcccccaaaggaccaggacucgccccaaa

SEQ ID NO: 204390 - RNA, 62 nt, Human
agggucgacccugcccccuugggcucaggccccgcccccaggauccuacggauugagguccu

SEQ ID NO: 204391 - RNA, 62 nt, Human
acacucuccacccuguggucuuguuccguccccgcccccaucuagccccaccuuugagaacu

SEQ ID NO: 204392 - RNA, 62 nt, Human
gccccugcagacccucccugcacuggcucccucgcccccagccccggggccugagccguccc

SEQ ID NO: 204393 - RNA, 62 nt, Human
gcuccccagaguaucuucccacugagacacgccgcccccacagaggcacaguccccagccac

SEQ ID NO: 204394 - RNA, 62 nt, Human
gagcugaguaguggggauccagagaggacccccgcccccagagacuugguuuuggcuccagc

SEQ ID NO: 204395 - RNA, 62 nt, Human
agagcccccagacccaccagaacuuccacagacgcccccacuagcuacuccacgaagccccc

SEQ ID NO: 204396 - RNA, 62 nt, Human
ucugacugccccuugcgcucugggcuuccugccgcccccagcuuugccuggacacugacuuc

SEQ ID NO: 204397 - RNA, 62 nt, Human
gguccuuccagacagucucagccucuccccgccgcccccaacaggcugucaaacaaaaccgg

SEQ ID NO: 204398 - RNA, 62 nt, Human
aaacugcugcugauggagaccaggacagagcccgcccccacccggcccgcagccccuccugc

SEQ ID NO: 204399 - RNA, 62 nt, Human
gcugggggcacagccccuccccacuccggccacgcccccacccaccccgcguguuucugccc

SEQ ID NO: 204400 - RNA, 62 nt, Human
uucccauucucuuuggcaagaaguccccuucucgcccccaaaccagcaagggacucccccac

SEQ ID NO: 204401 - RNA, 62 nt, Human
ugcugcuuuguccgucuauccacccgcccacccgcccccaccccaccggcagcguccaggug

SEQ ID NO: 204402 - RNA, 62 nt, Human
ccaggauuuuguguuuuuucguuccccccacccgcccccagcagauggaaagaaagcaccug

SEQ ID NO: 204403 - RNA, 62 nt, Human
ccgguguccccacguuuggugucuggcuauggcgcccccaucugacuguccagcucucucuc

SEQ ID NO: 204404 - RNA, 62 nt, Human
uccccccaaccuaaccagaccuggugccuugacgcccccaccccagcugggacgguacagag

SEQ ID NO: 204405 - RNA, 62 nt, Human
gggcuggacaucacugcaguccagugcaaagccgcccccagagcccagguguccccccaacc

SEQ ID NO: 204406 - RNA, 62 nt, Human
ugcucacagcgcccgacacaacccccucccgccgcccccaaccacccagggccaccaucaga

SEQ ID NO: 204407 - RNA, 62 nt, Human
ugcucagagccaagggggcagagggcuuucagcgcccccaggccugcccugcuauuucaggc

SEQ ID NO: 204408 - RNA, 62 nt, Human
ccuuggcccccacccccuccacuaucuccugccgcccccacucuggcuggcuucucuccccu

SEQ ID NO: 204409 - RNA, 62 nt, Human
aaaaggccagcgggcggcgucugggucucuggcgcccccaugugguugcgacacucccaaag

SEQ ID NO: 204410 - RNA, 62 nt, Human
ggcccuggacugccccuuccucccccaucgcccgcccccagaaccccugaugcugguuagga

SEQ ID NO: 204411 - RNA, 62 nt, Human
accuacugagcccaccgucagcggggcgcgcacgcccccaaaccagcuguuuacauacagga

SEQ ID NO: 204412 - RNA, 62 nt, Human
gcccuggccgucuauccuaccccuuuagugaccgcccccaucccggcuuucugagcugaucc

SEQ ID NO: 204413 - RNA, 62 nt, Human
aacccgaguccgcgcugggggagccucgcccccgcccccaccgggugaaagugucgucuccg

SEQ ID NO: 204414 - RNA, 62 nt, Human
cugugccaggcugggaggcucggggcuccccacgcccccaugcagugaccgcuuccccgaug

SEQ ID NO: 204415 - RNA, 51 nt, Human; identical to SEQ ID NO: 147494

SEQ ID NO: 204416 - RNA, 62 nt, Human
gcuucugcgcucucucccuucuccccucaccccgcccccaccagcccagugcgcccugccgc

SEQ ID NO: 204417 - RNA, 62 nt, Human
aaaaguugugucucccuuagaugagaucuagacgcccccaaauccuugagauguggguauag

SEQ ID NO: 204418 - RNA, 62 nt, Human
gggugcagauccugaugggugccugccucccccgcccccagccggugcucagguggcccagg

SEQ ID NO: 204419 - RNA, 62 nt, Human
agaugcaacuuuuguuccuccucccccacccccgcccccagcuucaugcuucucuuccgcac

SEQ ID NO: 204420 - RNA, 52 nt, Human; identical to SEQ ID NO: 147499

SEQ ID NO: 204421 - RNA, 62 nt, Human
cagaggaagggacugucgggcacccccuuccccgcccccaccccugggacguuaaagugacc

SEQ ID NO: 204422 - RNA, 62 nt, Human
cccagccucgcacuguguccuuggggaaggcccgcccccauccuggccggugucacuguggc

SEQ ID NO: 204423 - RNA, 62 nt, Human
cgaaggcaaugcugcucccugaguccaguccccgcccccaaacccagcccaggugccuucag

SEQ ID NO: 204424 - RNA, 62 nt, Human
ccucacaccaggcccggcuggccacccacccucgcccccacuggccaccccucccucgcccc

SEQ ID NO: 204425 - RNA, 62 nt, Human
uggccaccuggggcugccacuguccuccagcccgcccccagccuguggacgccuggcccacc

SEQ ID NO: 204426 - RNA, 62 nt, Human
cccgcccgcauggccagccaguggcaagcugccgcccccacucuccgggcaccgucuccugc

SEQ ID NO: 204427 - RNA, 62 nt, Human
aauaaaaauugaugucagugcaggcccaggcccgcccccagauacacuaguuucuaggucug

SEQ ID NO: 204428 - RNA, 62 nt, Human
uggcuggugggguggcccgaguuccccuucaccgcccccagggaggguuucccaccucagag

SEQ ID NO: 204429 - RNA, 62 nt, Human
uccccaaccucuguccgcaugccuggggccuucgcccccacgugcucgacaggggaacccgc

SEQ ID NO: 204430 - RNA, 62 nt, Human
ugcccugcuggaggacagaggggcaccucagccgcccccaagcccagagcacagcaauaagg

SEQ ID NO: 204431 - RNA, 62 nt, Human
gaggggcugagcaggacgccgcuggugcuggccgcccccagcccccuccuggugccaccuca

SEQ ID NO: 204432 - RNA, 62 nt, Human
cagucgucagccucccugacgucugccaccagcgcccccacuccuccuccuuucuuugcugu

SEQ ID NO: 204433 - RNA, 62 nt, Human
cuugcucacagcugauugggcaccugaccacacgcccccacaggcucugaccagcagccuau

SEQ ID NO: 204434 - RNA, 62 nt, Human
gggacagucggccuggaccggaccucuccuuucgcccccacacccccuccccuugccagcug

SEQ ID NO: 204435 - RNA, 62 nt, Human
ucuggucaacccauuuuugucccucaucaccccgcccccaccuuucgcuccugcccucugcc

SEQ ID NO: 204436 - RNA, 62 nt, Human
ccaccugacacaaccguccccggccccugccccgcccccaagcucggaucacaugaaggaga

SEQ ID NO: 204437 - RNA, 57 nt, Human; identical to SEQ ID NO: 147516

SEQ ID NO: 204438 - RNA, 62 nt, Human
uccuaugagugagagggagggccucagucuuccgcccccagcccacucucaugguccacacu

SEQ ID NO: 204439 - RNA, 62 nt, Human
caguccacgcccucaccagaggaugccaccuccgcccccacccccgccgccagaggaguaca

SEQ ID NO: 204440 - RNA, 62 nt, Human
gucggugcccagaaagucucuucugccacugacgcccccaucagggauugggccuucuuucc

SEQ ID NO: 204441 - RNA, 62 nt, Human
gggugaggccagcuggagaacugcaacgccuacgcccccagucgugucgcgucuguuuuccu

SEQ ID NO: 204442 - RNA, 59 nt, Human
cuuuacacuuguguaaauuucaguuacuggucauagaaggcuuucaauguugaguggcc

SEQ ID NO: 204443 - RNA, 59 nt, Human
cuggcaaacugucucuuacuggucagaaugucauagaagugaugucggcugcuagcuuc

SEQ ID NO: 204444 - RNA, 59 nt, Human
uuuaucgacauuaugcaaagcuuaacuuugucauagaugauaguugcauaaacuucguc

SEQ ID NO: 204445 - RNA, 59 nt, Human
gucgauuguuguuggaaguguuuuuucaugucauagauuagcaauuuucaaauaauuau

SEQ ID NO: 204446 - RNA, 59 nt, Human
uggucagcugacagauuucccauuuaguagucauagaauacagaaauaguuuagggaca

SEQ ID NO: 204447 - RNA, 59 nt, Human
aagaauuuaagauuguucuaucucuacuagucauagaaaagaaacauuguuaaacaugu

SEQ ID NO: 204448 - RNA, 59 nt, Human
aaggaagagagugauacugaccuuuuuaagucauagaccaaagucugcuguagaacaaa

SEQ ID NO: 204449 - RNA, 59 nt, Human
cccuccccucccccuucccuucuggucgggucauagagcuaccguauuuucuaggacaa

SEQ ID NO: 204450 - RNA, 59 nt, Human
cuagucucuggcauguguagccucuccuggucauagaccagucucuuuguaaguuauug

SEQ ID NO: 204451 - RNA, 59 nt, Human
aaauaaggaugacuuuagaauaauauugugucauagaauuaauuuucagccauguggac

SEQ ID NO: 204452 - RNA, 59 nt, Human
gaacaggaaaguggccaguagccaggcaagucauagaauugauuacccgccgaauucau

SEQ ID NO: 204453 - RNA, 59 nt, Human
ugguuuggguccagagugcucaucaucaugucauagaacugcugggcccaggucuccug

SEQ ID NO: 204454 - RNA, 59 nt, Human
ugaaaguucagucuuaugcuacauccuaagucauagacaaugaccuuguuuucauuauu

SEQ ID NO: 204455 - RNA, 59 nt, Human
uaaagggcagaaggggaagauacugacuagucauagaaauaccucauucgccuguggga

SEQ ID NO: 204456 - RNA, 59 nt, Human
cacucaccacuaugcaggagagggagguggucauagagucagggaucuauggcccuugg

SEQ ID NO: 204457 - RNA, 59 nt, Human
ccuaacucuugaggucucuaacauaccuugucauagaggaaaagcacagauuauaccug

SEQ ID NO: 204458 - RNA, 59 nt, Human
gacauggacuuggaacucaggauggggcugucauagacagacccaccaguaggaacugu

SEQ ID NO: 204459 - RNA, 59 nt, Human
gauuaccaauuuaugaauguuagacucuggucauagaaacaauaaaugaguuagaaggg

SEQ ID NO: 204460 - RNA, 59 nt, Human
cuuuguacuaacuuuaucacacuuacugugucauagaauaucauacaguuuauacgcuc

SEQ ID NO: 204461 - RNA, 59 nt, Human
auuagcugcuucuauguuucauaguuggggucauagauguuuccuugccuuguugaugu

SEQ ID NO: 204462 - RNA, 59 nt, Human
ugauuucuauuagacacaucugugcuucagucauagauguuaauagaggaagcaguuuu

SEQ ID NO: 204463 - RNA, 59 nt, Human
auuuuaaugauuucuaacauuucuuaacagucauagauauauacauuuucauuuuuugu

SEQ ID NO: 204464 - RNA, 59 nt, Human
aagucaaauaaaaggugucuugguuugaugucauagaaugauccaaggagagaaaaaag

SEQ ID NO: 204465 - RNA, 59 nt, Human
gugacgauacuccaaccauauggauauuagucauagaagaacuagagguuuuaugauau

SEQ ID NO: 204466 - RNA, 59 nt, Human
auacagacuucaaauaugucaauaguuuggucauagaaccuagaagccaaaagccacac

SEQ ID NO: 204467 - RNA, 59 nt, Human
uuuaaacauugcagaucaguguagaacuggucauagaggaagagcuagaaauccaguag

SEQ ID NO: 204468 - RNA, 59 nt, Human
caugaccuugggcacagggaaguucuggugucauagauaucccguuuugugagguagag

SEQ ID NO: 204469 - RNA, 59 nt, Human
acaucauugaaguggagcccggcacaggggucauagagcccagugaggucggggauuuu

SEQ ID NO: 204470 - RNA, 59 nt, Human
ucaccauucccacaaguauacuugauguugucauagaacgaacauccuacucuaugauu

SEQ ID NO: 204471 - RNA, 59 nt, Human
ucauaguuaugucaauaaaguuuauuuaggucauagaauauccuaaaguaucacauagu

SEQ ID NO: 204472 - RNA, 59 nt, Human
guuuuuuucccccauuuuuuccccuuuaagucauagaccuuaucaguuugccauuggac

SEQ ID NO: 204473 - RNA, 59 nt, Human
aggguaacaguguccauaauuaacgcuuagucauagagucaaaaacauuuaagacugau

SEQ ID NO: 204474 - RNA, 59 nt, Human
ccuuugaggagcacccaggagaauaucuggucauagaucuuuuuuuaaaugcaguuuua

SEQ ID NO: 204475 - RNA, 59 nt, Human
uccauguccauaugcaucuacuuggcaaggucauagacaauuccuccagagacacugag

SEQ ID NO: 204476 - RNA, 59 nt, Human
ggcucucccuccaggcugcugcugggcaugucauagaugggaugaaugaccaucugggg

SEQ ID NO: 204477 - RNA, 59 nt, Human
aaucuuuaucuuugcuguuucaccucaaagucauagaucaucuggcuuuuuaggcaccu

SEQ ID NO: 204478 - RNA, 59 nt, Human
cucuuuuuuuuuuuuuuguagaaguagcugucauagagugaagaaaaggauaagacuuu

SEQ ID NO: 204479 - RNA, 59 nt, Human
uaccuaaagcuaaaaaaaagcaaggguuugucauagagggaaccucuaaauaauuucag

SEQ ID NO: 204480 - RNA, 59 nt, Human
uuauacauguuauuaaacucuuuaaauaugucauagaaaauaauacaaucauguaauga

SEQ ID NO: 204481 - RNA, 59 nt, Human
aaagccuucccuaaaaagagagcaugccagucauagagacacuaauuuggcacuuuucc

SEQ ID NO: 204482 - RNA, 59 nt, Human
gaaaaaaaugcauuuuauaaauucagaaagucauagauuucugaaggcgucaacgugca

SEQ ID NO: 204483 - RNA, 59 nt, Human
uguuugguccuccucuguuucauagaaaagucauagaauaucuaugauacauugaaaag

SEQ ID NO: 204484 - RNA, 59 nt, Human
gcugaguuauuuuugaaugucauguuuaugucauagacguaguuuucgcauccuugaau

SEQ ID NO: 204485 - RNA, 59 nt, Human
uauuuugauuuuauuuuagcuuccuuguggucauagaugcaaagagaugugucauccug

SEQ ID NO: 204486 - RNA, 59 nt, Human
ugguguuuugcuguugagcugguuuuugagucauagaucuuggcuuccuuuagaagcca

SEQ ID NO: 204487 - RNA, 59 nt, Human
acuagcaugcucaugaccaacacauacacgucauagaagaaaauaguggugcuucuuuc

SEQ ID NO: 204488 - RNA, 59 nt, Human
ucaguucauguauguucagaagaaauucugucauagaaagugccagaaaguguuuaacu

SEQ ID NO: 204489 - RNA, 59 nt, Human
ccuuuuccccucacccucugcccuucuaagucauagacuagguaggaaggcccuauauu

SEQ ID NO: 204490 - RNA, 59 nt, Human
uuuacuucuauuugauaucugcucaagaagucauagaagucuugggaaacuauucgagu

SEQ ID NO: 204491 - RNA, 59 nt, Human
uaaaauuaccaagaauuuuuuauuucuuugucauagacacaauuucucuucuguaugcc

SEQ ID NO: 204492 - RNA, 59 nt, Human
auuauguuucaacucuguagauguuuaacgucauagacaguuggcccucuguauccgug

SEQ ID NO: 204493 - RNA, 59 nt, Human
aggugcuguuuucaaaaccccagaugacagucauagaaaauuuggaacuuaggaaaaua

SEQ ID NO: 204494 - RNA, 59 nt, Human
uuuaaaauuaauuuuaauuuaauacuagugucauagauacuuuuuguacaucaaacaau

SEQ ID NO: 204495 - RNA, 59 nt, Human
gagggcauguaaauaaauguuuuccuguagucauagauuauucaggacuguccuuuagu

SEQ ID NO: 204496 - RNA, 59 nt, Human
cuaggauaauacaguccaugcaaaguagggucauagagaaauaaaagcaugcccucagc

SEQ ID NO: 204497 - RNA, 59 nt, Human
cacaguugggcaaucauagcuaauuuuuggucauagaaaaucugcaucaaaucaguuuc

SEQ ID NO: 204498 - RNA, 59 nt, Human
ugaauuggcuuccagauuuuaaauuuuaugucauagaaauauugacucaaaccauauuu

SEQ ID NO: 204499 - RNA, 59 nt, Human
agcagauaaaugccauguugggcaacuaugucauagauuucugcuccuccucucuuuua

SEQ ID NO: 204500 - RNA, 59 nt, Human
ucuucagguuuaggccauuggucuuugaugucauagauuccaggccugggagguguuau

SEQ ID NO: 204501 - RNA, 59 nt, Human
uuuucuauuuagauauucuaaguagaagagucauagacagaacaaaaacagaacucagc

SEQ ID NO: 204502 - RNA, 59 nt, Human
ggguagagugguagaguuucaaaacuuucgucauagauaucugggaccuuucucaggau

SEQ ID NO: 204503 - RNA, 59 nt, Human
uauaaaggguggaaugggagccauggcaggucauagaguccucucaaugggaaccugau

SEQ ID NO: 204504 - RNA, 59 nt, Human
ugggccaaaaaaagcaaucaaagucuuacgucauagaggaccaccuuuuggaucauaaa

SEQ ID NO: 204505 - RNA, 59 nt, Human
uuuuguuuuuugguuuuugaguuguucuugucauagacauaaaaagacaauucauuuuc

SEQ ID NO: 204506 - RNA, 59 nt, Human
agcuuucuuuuuaaagcuuuugauguggugucauagaauagcauguuguagauacaauc

SEQ ID NO: 204507 - RNA, 59 nt, Human
aaagugagaacaaauauauuuaaucucaggucauagacugugauucagaugaagccaag

SEQ ID NO: 204508 - RNA, 59 nt, Human
uuuguacauuuuggauuucuuuauauaaggucauagauucuugagcuguugugguuuuu

SEQ ID NO: 204509 - RNA, 59 nt, Human
agggcauaggauuacuugucucagaagcugucauagaauuucuugcugccaauuaaaaa

SEQ ID NO: 204510 - RNA, 59 nt, Human
uuaaaaaugacucucuuaagccuuaaaaagucauagauuugugcugcugccagaauuau

SEQ ID NO: 204511 - RNA, 59 nt, Human
gcagauuggagggcaggaccacugagggugucauagacauuagcucuauggaauucugc

SEQ ID NO: 204512 - RNA, 59 nt, Human
acaguuggagguaauaugcauauucugaagucauagauaauuuacacagaucucucuca

SEQ ID NO: 204513 - RNA, 59 nt, Human
acuaucuuaggaauagcaaauuauguccagucauagagaagaaagcuucauaauaauac

SEQ ID NO: 204514 - RNA, 59 nt, Human
uuaaagccaccagggcuucuggaacaccugucauagaagcaauaacucuaacucuauac

SEQ ID NO: 204515 - RNA, 59 nt, Human
ccaguccucuugcugcccaugguucauaggucauagaaggcagcaaugcacugacuggg

SEQ ID NO: 204516 - RNA, 59 nt, Human
uugccacuacacuucagaccaaugggacagucauagauggugugacaguguuuaaacgc

SEQ ID NO: 204517 - RNA, 59 nt, Human
ccaccccaucaaaagguauuccuagaaaugucauagaccuagguaacuuugaauugaau

SEQ ID NO: 204518 - RNA, 59 nt, Human
uggcacaaacauaguuuuuucaugcucuugucauagacuuuucuuuuuaaccuucugca

SEQ ID NO: 204519 - RNA, 59 nt, Human
ggagggauuuugugaugcagaauaucuaagucauagaaauagaagacagguggaauaag

SEQ ID NO: 204520 - RNA, 59 nt, Human
uuuugacugaauucuucaaaaaugucaaugucauagaagacaaagaaagguuguggaaa

SEQ ID NO: 204521 - RNA, 59 nt, Human
auuuguauaucccugauagcuauaauugggucauagaaauucuuuauacauucuagaug

SEQ ID NO: 204522 - RNA, 59 nt, Human
gcuugaguuauaaaccccaaggcagccaugucauagacuaguguuuacucuuguuuuga

SEQ ID NO: 204523 - RNA, 59 nt, Human
auuuuacauuuaaauaugcuaacaucacugucauagaauucccaaauuucauuuguaga

SEQ ID NO: 204524 - RNA, 59 nt, Human
uuugagggguuucagaauuuugcauugcagucauagaagagauuuauuuccuuuuuaga

SEQ ID NO: 204525 - RNA, 59 nt, Human
cuuuaggaugacacaaugaauaacaccuagucauagaaaucagucucucugguuuguuu

SEQ ID NO: 204526 - RNA, 59 nt, Human
gaauugggguguuaaggaagggaaagauugucauagaugguagggcuuugaaaaugcag

SEQ ID NO: 204527 - RNA, 59 nt, Human
uuaacuuuuaauguggcaaguuugcagaugucauagaggcuauccuggagacuuaauag

SEQ ID NO: 204528 - RNA, 59 nt, Human
aaguacuucaggauuaggaauuuggguuugucauagauguauucucuggugaggguggc

SEQ ID NO: 204529 - RNA, 59 nt, Human
uuggaccugucucuccucagucuauuccugucauagaugugggugucccugguagggaa

SEQ ID NO: 204530 - RNA, 59 nt, Human
agaauucuaauucccuguaauucgcauaagucauagaauucuaaucaggaauaauugua

SEQ ID NO: 204531 - RNA, 59 nt, Human
auuaccaaagugauauguauuccaaaaaagucauagaagaugaagcacuauaauauugu

SEQ ID NO: 204532 - RNA, 59 nt, Human
ccgaugccuucuucgacgcgcuggaccacgucauagacauacacggacacaucaucggc

SEQ ID NO: 204533 - RNA, 59 nt, Human
gugggagcugccucgggcuggguugcuuggucauagagccauagaaggaagcugucagc

SEQ ID NO: 204534 - RNA, 59 nt, Human
aauuauuagcuuugaugagaacaacuuuugucauagauuugauuuauuaaaccaaaauu

SEQ ID NO: 204535 - RNA, 59 nt, Human
uuucauauugugugcuucccaaagcuauagucauagauuucuuccagaaacuauuguca

SEQ ID NO: 204536 - RNA, 59 nt, Human
cucuauuuccuuuauagguuuuauuucuggucauagagagagaaggaccuuugacuuuu

SEQ ID NO: 204537 - RNA, 59 nt, Human
cuuggucuacauaaagaagacaugggucugucauagaauggggacauuagacugaaaac

SEQ ID NO: 204538 - RNA, 59 nt, Human
ccaaugaucugcuggacaucaugccccaugucauagagaauaaagcugaugauuguacc

SEQ ID NO: 204539 - RNA, 59 nt, Human
uagggaauugcaauuucuacuuucauagagucauagaauuuuagguggggaagaggcau

SEQ ID NO: 204540 - RNA, 59 nt, Human
auugguccuagaacuuccaaaggcugcuugucauagaagccauugcaucuauaaagcaa

SEQ ID NO: 204541 - RNA, 59 nt, Human
cuaucagugggcuuuaaauuguauaccgagucauagauacgccacugauaacuaaaacu

SEQ ID NO: 204542 - RNA, 59 nt, Human
gaggguucgccagcccuccccuccccagggucauagagggggccaugaggcuggaauug

SEQ ID NO: 204543 - RNA, 59 nt, Human
gaucagguauucugcacauucauuccaaggucauagauuuuuaaaaggaccuggauuug

SEQ ID NO: 204544 - RNA, 59 nt, Human
gggugggaggucuugcuagaaugggaagggucauagaaagggccuugacaucaguuccu

SEQ ID NO: 204545 - RNA, 59 nt, Human
agauagcaacaaaaaaugcauaguuaauggucauagacuuuauuccaaaacauaauugg

SEQ ID NO: 204546 - RNA, 59 nt, Human
cuguaaaaguugcagcaauuuauuggcuagucauagaaaauuuuugaacuuuuaacugu

SEQ ID NO: 204547 - RNA, 59 nt, Human
gauuaugcagagaauuggauugggucucugucauagauugaguaaucucuucccuuacc

SEQ ID NO: 204548 - RNA, 59 nt, Human
gugggguggcaauagcauugugccauuuugucauagaauguaaaaauugguuaacuuua

SEQ ID NO: 204549 - RNA, 59 nt, Human
gaaguugaccuuugcacuggcauuaaagagucauagaaaaagaaucauggauauuuaug

SEQ ID NO: 204550 - RNA, 59 nt, Human
uguacauccugaaccccaaagccgugagugucauagaacucuacggcauccuggaccca

SEQ ID NO: 204551 - RNA, 59 nt, Human
ccuaucccauucucccucucaaggcaggggucauagauccuaagccauaaaauaaauuu

SEQ ID NO: 204552 - RNA, 59 nt, Human
uucuucuuuguauauuuggugacuguaucgucauagauguacauauugugucgguaggg

SEQ ID NO: 204553 - RNA, 59 nt, Human
uuuuauauuugaauuaguaacuguaugaagucauagauaauaguacaugucaccuuagg

SEQ ID NO: 204554 - RNA, 59 nt, Human
auaacugcucucuagucugccuuauuugugucauagaguaagauauuccuugaaagccc

SEQ ID NO: 204555 - RNA, 59 nt, Human
uuacuccacaggaaaauguaagcuacuuugucauagaucacaaaagaaucauaaugcua

SEQ ID NO: 204556 - RNA, 59 nt, Human
agccaguuguucuugaugaaucuauaugagucauagaacacaaaucuauugacggaagu

SEQ ID NO: 204557 - RNA, 59 nt, Human
gggcuaaaguuuggcuuuuccuuccuugagucauagaacguauccaucucccaggaaau

SEQ ID NO: 204558 - RNA, 59 nt, Human
cagguggaaaccuuuuccuguggaaaccugucauagaauuuugugcaauauguaugugu

SEQ ID NO: 204559 - RNA, 59 nt, Human
auauugugauagggaaaaaaaucauugacgucauagaauauucuucuuccucucaggag

SEQ ID NO: 204560 - RNA, 59 nt, Human
cauuuauuugcucauuaaugauagcaguagucauagacuuaagacuauucuagagaucu

SEQ ID NO: 204561 - RNA, 52 nt, Human
acuuguccgaugaggacuaauagucauagaggaugcuuuacccaagagccac

SEQ ID NO: 204562 - RNA, 59 nt, Human
auccaaggguucuccauggauggauccaagucauagaggggaauguuugagacagggaa

SEQ ID NO: 204563 - RNA, 59 nt, Human
gagcucuaagaugauccuuuaagcaagcagucauagacuggucgggauuaaguaaaaga

SEQ ID NO: 204564 - RNA, 59 nt, Human
ucacucucagagaccacguuucccugacugucauagagaaucaucaucgccacugaaaa

SEQ ID NO: 204565 - RNA, 59 nt, Human
ugugucugcauguguguuuguacauagaagucauagaugcagaagugguucugcuggua

SEQ ID NO: 204566 - RNA, 59 nt, Human
ggcaggacaucaguaccaacuagaagugggucauagauagauuaccagggaugcagugg

SEQ ID NO: 204567 - RNA, 59 nt, Human
acgcagaacuaccagguggcaaaguacuugucauagacuccuuugcuaaugcuaugcaa

SEQ ID NO: 204568 - RNA, 59 nt, Human
cucugcaugcugucagcggcugccccgccgucauagacuuaaaggacugcaauaaaugu

SEQ ID NO: 204569 - RNA, 59 nt, Human
uagcuccccuuugguaaguuuucuuaauugucauagauuaacugaguuuccuggaugcu

SEQ ID NO: 204570 - RNA, 59 nt, Human
caauccaucagcaaugcuucucucauagugucauagacuugggaaacccaaccaguagg

SEQ ID NO: 204571 - RNA, 59 nt, Human
cggccacgugaccucuugccgugccccuugucauagacccaaggagcaacucugucccc

SEQ ID NO: 204572 - RNA, 59 nt, Human
gaugauggauuugauucgcccuccucccugucauagagcugcaggguggauuguuacag

SEQ ID NO: 204573 - RNA, 59 nt, Human
ugucuuugauaaauuguauuuuaagugaugucauagacaggauuguuuaaauuuaguua

SEQ ID NO: 204574 - RNA, 59 nt, Human
uauucccauuuuaaugaugaggaaacugagucauagaggauacagacuugcccaaagga

SEQ ID NO: 204575 - RNA, 59 nt, Human
aaaauggugaaguugccaugacaauaaaggucauagaaccugguagugucaaauuuaac

SEQ ID NO: 204576 - RNA, 59 nt, Human
caguuccuuaaaaucaguuuugaacuuuggucauagagucuucauauuucaguauuugg

SEQ ID NO: 204577 - RNA, 59 nt, Human
auauucacaaaacgccgcauguuuaaaaagucauagaugucaucuucucucugccccca

SEQ ID NO: 204578 - RNA, 59 nt, Human
accggggaggcugugucuugugcaaacaagucauagaaacuugaugggaguuggggagg

SEQ ID NO: 204579 - RNA, 59 nt, Human
accugaaaaggaaacuacagaaugggaaagucauagaagaucucucacagaaauauaaa

SEQ ID NO: 204580 - RNA, 59 nt, Human
uucgaagcucugguguaaaauauuucaaagucauagaaauaguuugagaaaugcauagc

SEQ ID NO: 204581 - RNA, 59 nt, Human
auccuugcuuauuucacaacuaaagcuuugucauagacuucaaaauauauauguauaua

SEQ ID NO: 204582 - RNA, 59 nt, Human
aaaagguauuaaauugauguugcuggacugucauagaaauuacacccaaagagguauuu

SEQ ID NO: 204583 - RNA, 59 nt, Human
gugaaauaacguguuaaauaaaugucauugucauagaacauaaaguuauguuauuggua

SEQ ID NO: 204584 - RNA, 59 nt, Human
agcuucugcuggaauuugcaaucacugaagucauagaaaauagguaacuaucuaauuag

SEQ ID NO: 204585 - RNA, 59 nt, Human
agcccuguuaaauggucguggccaauuaugucauagaaacuguaugaacaaccagauuu

SEQ ID NO: 204586 - RNA, 59 nt, Human
ucuuuugaauguuuugaacccaacuacuugucauagauguuugacugugucaaaagcug

SEQ ID NO: 204587 - RNA, 59 nt, Human
auuuaucuaaagaaauaacuucuauuacugucauagaccaaaggaaucugauucucccu

SEQ ID NO: 204588 - RNA, 59 nt, Human
uauucaaugccaaaauauuuucuuaaauagucauagaacuaacaagaaaaaauagauag

SEQ ID NO: 204589 - RNA, 59 nt, Human
cucuuuccccucuauuucuuuguaugacugucauagacacaugggugcuugaagaaagg

SEQ ID NO: 204590 - RNA, 59 nt, Human
ucuuuaauucagcaucucccuauguaugugucauagaauacuuaguucugcuagauauu

SEQ ID NO: 204591 - RNA, 59 nt, Human
uguguuccuacugugaugucuugguuuuugucauagacuuaaguuuauaaguuugaacu

SEQ ID NO: 204592 - RNA, 59 nt, Human
cagcucuaggaagagcucaagaucaauuggucauagaacagcauuugacgccuagaacu

SEQ ID NO: 204593 - RNA, 64 nt, Human
uucuaggucuuugcucugcaggaucgggaucagagcgugggaggagguggggguggacguccau

SEQ ID NO: 204594 - RNA, 64 nt, Human
ccugccuggaacaagggaccuggagaauguuuuugcgugggaugaugugcuggucaggagcccc

SEQ ID NO: 204595 - RNA, 64 nt, Human
gcagaugcacccagagccccaugcacaguguccugcgugggaaagagacacggucccccuggcu

SEQ ID NO: 204596 - RNA, 64 nt, Human
cagaauuuagacugaaacuacacauuggcaaauagcgugggauagauuuguuucuuaaugggug

SEQ ID NO: 204597 - RNA, 64 nt, Human
uuucucccagcuaccucccaaagcagccugaccugcgugggagaggcguagcgaggucggaggg

SEQ ID NO: 204598 - RNA, 64 nt, Human
augugauuuuucuccccggggauucgagagccaugcgugggacacuggacccuacugucuacac

SEQ ID NO: 204599 - RNA, 64 nt, Human
gagagacauaugcccccagagagagcaaaucgaagcgugggaggcacccccauugcucuccucc

SEQ ID NO: 204600 - RNA, 64 nt, Human
acaauagcacccugcagcuaugcuggaaaacugagcgugggacccugccagacugaagagcagg

SEQ ID NO: 204601 - RNA, 64 nt, Human
ucguacccucucccacccugguguuugggcaccugcgugggaugcacacggaugacagaaucaa

SEQ ID NO: 204602 - RNA, 64 nt, Human
gggguuggggggccgcuggaggccaccugccaaggcgugggaugggaugguccugccgguuuag

SEQ ID NO: 204603 - RNA, 64 nt, Human
cuccuguucucugguuauagcuggucccaggucagcgugggaggcaccuuuggguucccagugc

SEQ ID NO: 204604 - RNA, 64 nt, Human
agaaauuugccuugcugcagagagagaaggaauggcgugggaugggggaaagaaaagaaagaga

SEQ ID NO: 204605 - RNA, 64 nt, Human
acguggguguguugguaaacaguuuggaaaaguggcgugggagccagccucccuuugaugauua

SEQ ID NO: 204606 - RNA, 64 nt, Human
acagagcauugaccauuggcuucccucaucugaggcgugggagagcagacuggauagaugagaa

SEQ ID NO: 204607 - RNA, 64 nt, Human
gcuggauccaaucugguacaguuuguuaaaagcagcgugggauauaaucagcagugcuuacaug

SEQ ID NO: 204608 - RNA, 64 nt, Human
ggauccugccaucuguuaagggagcagcaauagggcgugggagauggcuacauugacuucaggu

SEQ ID NO: 204609 - RNA, 64 nt, Human
caagaggaggaacuccuggugccuuucugagccugcgugggagaaccccaauucuagcacucca

SEQ ID NO: 204610 - RNA, 64 nt, Human
ggagcugacugaccacguagcaugggggcaagaggcgugggauggggauuggggugagauggau

SEQ ID NO: 204611 - RNA, 64 nt, Human
aaauagcaaauggacacaaauuacaaaugugugugcgugggacgaagacaucuuugaaggucau

SEQ ID NO: 204612 - RNA, 64 nt, Human
cagcccaggcccagcuggggagaaggcgcuaccugcgugggacccucuucucuggaaaccuaau

SEQ ID NO: 204613 - RNA, 64 nt, Human
guuuuaucuuugugcgucuguuugcugaucuucagcgugggaauaauaacaguaccuacuugaa

SEQ ID NO: 204614 - RNA, 64 nt, Human
auugccugucccugcuucgagcugguugucuugugcgugggacaugggccuuccuaucuguguu

SEQ ID NO: 204615 - RNA, 64 nt, Human
aguaugaggggaacccccaccgcgucggcgggaagcgugggagguguagcuccuacuuuugcac

SEQ ID NO: 204616 - RNA, 64 nt, Human
accugcggguguggcgcagcccagggcucacacugcgugggagggacugggucacuauuguggu

SEQ ID NO: 204617 - RNA, 64 nt, Human
ggagaguuuuugugugugcgagaucucuaagccagcgugggagggagcgccucaggauaaguua

SEQ ID NO: 204618 - RNA, 64 nt, Human
ugggaccuugcuggcaugucuccuucacaaucaggcgugggaauaucuggcuuaggacuguuuc

SEQ ID NO: 204619 - RNA, 64 nt, Human
cucuagggcccuggaccucgggucaugauccucugcgugggagggcuugggggcagccugcucc

SEQ ID NO: 204620 - RNA, 64 nt, Human
caagcauuucucaggaaguccuggaagauagcaugcgugggaaguaacaguugcuaggcuucaa

SEQ ID NO: 204621 - RNA, 64 nt, Human
gccuccguugccacaugggcuauuuuuguccaucgcgugggacaaccuaguauugggggaaaac

SEQ ID NO: 204622 - RNA, 64 nt, Human
gccaggucaaguuagccgcgugacggacauccaggcgugggacguggucagggcagggcucauu

SEQ ID NO: 204623 - RNA, 64 nt, Human
cugagagugcgagugcaccaugcucacuguugcugcgugggagagucacaagccacuggcaagc

SEQ ID NO: 204624 - RNA, 64 nt, Human
ugggggugcggcagggacacccgaccacaccagagcgugggagacggugggccuuguccccugc

SEQ ID NO: 204625 - RNA, 64 nt, Human
gcgacacaucacagcagacuggaugcagaagcgugcgugggaaugcagcuguuuuccauggaac

SEQ ID NO: 204626 - RNA, 64 nt, Human
gccucccucccgaacugaaagcccauccguccucgcgugggaccgcaucuucucccucgcagcu

SEQ ID NO: 204627 - RNA, 64 nt, Human
ccuggucccucacccccauggccccaggcccacagcgugggaacucacuuucccuugugucaag

SEQ ID NO: 204628 - RNA, 64 nt, Human
ggguuuucuauaagggguuuccugcuggacaggggcgugggauugaauuaaaacagcugcgaca

SEQ ID NO: 204629 - RNA, 64 nt, Human
gagugucuguuuuuagaaauuuagauuuuaaaaggcgugggacauacgaccaggcccuauagcc

SEQ ID NO: 204630 - RNA, 64 nt, Human
guucuguacaacuuaacucacuggcgagaauacagcgugggacccuucagccacuacaacagaa

SEQ ID NO: 204631 - RNA, 64 nt, Human
agccuccgaaccaugccccauauaacgcuugggugcgugggagggcgcacaucagggcagaggc

SEQ ID NO: 204632 - RNA, 64 nt, Human
ggcaaaaugaggagcagaggcauggaggagggaggcgugggaugggaauagcagaaaccaacca

SEQ ID NO: 204633 - RNA, 64 nt, Human
ggccaucagccucaccagcaaagcagagaugagagcgugggaacuguguucuuuccucccugcc

SEQ ID NO: 204634 - RNA, 64 nt, Human
gggcaccacccaccccucaccuugcaggcugccugcgugggaggcgaagucccaggacagccca

SEQ ID NO: 204635 - RNA, 64 nt, Human
aacacucaugcugagcugagaaagcagagaaguggcgugggagccagcugggggugaagagcau

SEQ ID NO: 204636 - RNA, 64 nt, Human
ucucccaauaacucacccuugggauguguuuagagcgugggaggugccuuugagaacugcuuga

SEQ ID NO: 204637 - RNA, 64 nt, Human
ggcugcccuguggugcacacaggccugccauggggcgugggagcccaucccgcugccugacugg

SEQ ID NO: 204638 - RNA, 64 nt, Human
uaaacgguugugucuuguugggaguaagugccuugcgugggaauaaacuuccacagcauucgaa

SEQ ID NO: 204639 - RNA, 64 nt, Human
ccaaagcucucugucaauuacaaggcuucuccuggcgugggagacgucuacagggaagacacca

SEQ ID NO: 204640 - RNA, 64 nt, Human
ggccuugcggaagccauagggggcugcacgggaugcgugggaggcagaaaccuaucucagggag

SEQ ID NO: 204641 - RNA, 64 nt, Human
gagagaagugccucaucccugagccacacagggggcgugggagcaucccaguuaucccuggaaa

SEQ ID NO: 204642 - RNA, 64 nt, Human
uccucuugagcaguggagcaagggagaccugggagcgugggagccaggaucagcgcccccugcc

SEQ ID NO: 204643 - RNA, 64 nt, Human
ccuugcagguggagggaccucacuccagggcacggcgugggagggguagucgaagagcucuggu

SEQ ID NO: 204644 - RNA, 64 nt, Human
auacuguuacaguggcaaucgcauuucaacgugagcgugggaggggacaaacauucaaaccaua

SEQ ID NO: 204645 - RNA, 64 nt, Human
caggugccugggcuucuuaaggcuccugggcaaggcgugggaguuguccugacuugcuugggau

SEQ ID NO: 204646 - RNA, 64 nt, Human
ccagcgaaggcacuugggcugccaggaacaggaggcgugggaaacucuggcuuaggaaaacaug

SEQ ID NO: 204647 - RNA, 64 nt, Human
gcuggguuauuucaaagaggaacucugaugcucugcgugggaccaugccugaacuccccgaaua

SEQ ID NO: 204648 - RNA, 64 nt, Human
acccccuuuccuaacagacuuguccaagugcuuggcgugggacccaugaccaaagcccaggaug

SEQ ID NO: 204649 - RNA, 64 nt, Human
ugcccacuccaaaaacccagugugggggcaaagggcgugggaagagcagggcuugcccagcgac

SEQ ID NO: 204650 - RNA, 64 nt, Human
uugaaaaguuacacguaaaguagaagaaucuagugcgugggacaguaaaggauccuuucucgua

SEQ ID NO: 204651 - RNA, 64 nt, Human
uggaggaggagcaggggcguggagggcguggagggcgugggagcgugggaggcgggaguggagu

SEQ ID NO: 204652 - RNA, 64 nt, Human
gagcaggggcguggagggcguggagggcgugggagcgugggaggcgggaguggaguggaagaag

SEQ ID NO: 204653 - RNA, 64 nt, Human
agagguaguuggguagagaagccagcagggggcagcgugggacccauaucccagccccaggcgg

SEQ ID NO: 204654 - RNA, 64 nt, Human
uugggcuauauuuugaauuuugucaauuaaaaaagcgugggagcagugugaaggagaagaggca

SEQ ID NO: 204655 - RNA, 64 nt, Human
ucuugcugauaggaaugauagcaacacugaaagagcgugggaagguggagggugucaccagacc

SEQ ID NO: 204656 - RNA, 64 nt, Human
gggggcuccucucaggguucacccugucaccggggcgugggaccgaccugggaaauuuccacua

SEQ ID NO: 204657 - RNA, 64 nt, Human
uucaccuugggaugaugccucaugauaugucagggcgugggacaucuaguaggugcuugacaua

SEQ ID NO: 204658 - RNA, 64 nt, Human
gggccacaggggugcggggccagcucaggcacuggcgugggagcccugggagaccccuuccccc

SEQ ID NO: 204659 - RNA, 64 nt, Human
uagaguuguagacuuacacucaacccucaugugagcgugggagugaggguggcggucccuugcc

SEQ ID NO: 204660 - RNA, 64 nt, Human
gccuucaccuuccagcuuuugucuggccugugcugcgugggagccacuggucugugcacaucca

SEQ ID NO: 204661 - RNA, 64 nt, Human
uagauugauuguauuguugaaaaaguuuguuuuugcgugggagugugugccugcgugggugugu

SEQ ID NO: 204662 - RNA, 64 nt, Human
ggaaucaaucuugccugcccccagcucacacucagcgugggaccccgaauguuaagcaaugaua

SEQ ID NO: 204663 - RNA, 64 nt, Human
uuccccacccaggcacccccucccggggcagcaggcgugggagucagggcugcaugcuccuccc

SEQ ID NO: 204664 - RNA, 64 nt, Human
cgaacacuauaaacuccaggcuugauuccaacaggcgugggaucagauuuggugauggaaaaag

SEQ ID NO: 204665 - RNA, 64 nt, Human
uggccgugcccaaugagacguucuaaaccaggacgcgugggaacccuuauuuccaaaggaaaaa

SEQ ID NO: 204666 - RNA, 64 nt, Human
ccaggugugcacuggaagugaggucacaugagcagcgugggaagaagacucugucaagacucuc

SEQ ID NO: 204667 - RNA, 64 nt, Human
ccauguccauggugcccccuggucaacauaaggagcgugggauccgauggaaagguggagcuca

SEQ ID NO: 204668 - RNA, 60 nt, Human
agccgcccccuguguacugagcggcgguuagcgugggaagggggacagagagggcccucc

SEQ ID NO: 204669 - RNA, 64 nt, Human
ugugucacagggugagccccaaaauugggguucagcgugggaggccacguggauucuuggcuuu

SEQ ID NO: 204670 - RNA, 64 nt, Human
ggagugaaggggccaaggagggugagugcaaggggcgugggaguggccugaagaguccucugaa

SEQ ID NO: 204671 - RNA, 64 nt, Human
gguauggagaugcaauuugggacugcggucgcucgcgugggaguuuuguguguacguuggugcg

SEQ ID NO: 204672 - RNA, 64 nt, Human
ugccugacuucaucaugcucccugcacuuaggcugcgugggacaagggcuguguugucacagca

SEQ ID NO: 204673 - RNA, 64 nt, Human
aucucgacucagaaccuggucauguccucgucgggcgugggaggugacgcuagugucacgcuga

SEQ ID NO: 204674 - RNA, 64 nt, Human
gugcugccagucaaccaagggucugugagugucagcgugggaucaggcagcagagcuuuuuucc

SEQ ID NO: 204675 - RNA, 64 nt, Human
acuucgcagccccgggcggagccuucccgggcgggcgugggaggagggaggcggccuccaugca

SEQ ID NO: 204676 - RNA, 64 nt, Human
cggugcccaccccugccagcgucgcccccuuucugcgugggacaguuugaaaaggugggugggg

SEQ ID NO: 204677 - RNA, 64 nt, Human
cccugcccucaccugcaaaugaguuaaagaagaggcgugggaauccaggcagugguuuuuccuu

SEQ ID NO: 204678 - RNA, 64 nt, Human
ccuccgcccucugcauucgggaacacgcacguccgcgugggaagcuugcagcagggcguccgag

SEQ ID NO: 204679 - RNA, 64 nt, Human
uuaagaaggaagagucuguggauggaaauaggaagcgugggaggguccaguugccacccccaaa

SEQ ID NO: 204680 - RNA, 64 nt, Human
aggcuguuucucacugcuaacguugguguuucuggcgugggaagaaaugcacaggcgugcaugg

SEQ ID NO: 204681 - RNA, 64 nt, Human
gaguucuagagaccccacaagcacuauggacgaagcgugggaccccagcacgggcugcccucag

SEQ ID NO: 204682 - RNA, 64 nt, Human
uacaaaauauccaagcccagccuaucucucuucugcgugggaguauguuauuucucuggggucu

SEQ ID NO: 204683 - RNA, 64 nt, Human
ugugcugauuccaaugcuuucacguugguuccuggcgugggaacugcucuccuuugcagcccca

SEQ ID NO: 204684 - RNA, 64 nt, Human
agguggcggugaccgugguaaacccagggcgguggcgugggaucacggguccuuacgcugggcu

SEQ ID NO: 204685 - RNA, 64 nt, Human
guugugaccuguccuuccguacuuaauaaagugcgcgugggaguguucaccuguguuugagucu

SEQ ID NO: 204686 - RNA, 64 nt, Human
gagugccccgcggcuguggugccgggggcagggugcgugggaggacggagccugggagcggggc

SEQ ID NO: 204687 - RNA, 64 nt, Human
cgugcuugcguuugaagccucgcgucacucagucgcgugggaugaugaguccguuguugucugc

SEQ ID NO: 204688 - RNA, 64 nt, Human
cuuccacgugccugccugugggacaggagggggagcgugggaugcuguagcccccgggguuggg

SEQ ID NO: 204689 - RNA, 64 nt, Human
ugacuaacagccucagcacauccgacaccucccagcgugggaccccaagugaagacgaggccaa

SEQ ID NO: 204690 - RNA, 64 nt, Human
ugacaagcagggaugaguccugguucccuugcccgcgugggaccccaauagaacucagcccuuc

SEQ ID NO: 204691 - RNA, 64 nt, Human
acgaggcagccaggcagggugggagcaggggcuggcgugggaggucugggggacagacaaggau

SEQ ID NO: 204692 - RNA, 64 nt, Human
gagaagagucgagugauauggcuuguagggugaggcgugggauccagagagaagcaccccacca

SEQ ID NO: 204693 - RNA, 64 nt, Human
gacccugaaucucuccaaaaauaagcuggagucggcgugggaguugggcaaggugaaagggcug

SEQ ID NO: 204694 - RNA, 64 nt, Human; identical to SEQ ID NO: 164764

SEQ ID NO: 204695 - RNA, 64 nt, Human; identical to SEQ ID NO: 164765

SEQ ID NO: 204696 - RNA, 64 nt, Human; identical to SEQ ID NO: 164766

SEQ ID NO: 204697 - RNA, 64 nt, Human; identical to SEQ ID NO: 164767

SEQ ID NO: 204698 - RNA, 64 nt, Human; identical to SEQ ID NO: 164768

SEQ ID NO: 204699 - RNA, 64 nt, Human; identical to SEQ ID NO: 164769

SEQ ID NO: 204700 - RNA, 55 nt, Human; identical to SEQ ID NO: 164770

SEQ ID NO: 204701 - RNA, 64 nt, Human; identical to SEQ ID NO: 164771

SEQ ID NO: 204702 - RNA, 64 nt, Human; identical to SEQ ID NO: 164772

SEQ ID NO: 204703 - RNA, 64 nt, Human; identical to SEQ ID NO: 164773

SEQ ID NO: 204704 - RNA, 64 nt, Human; identical to SEQ ID NO: 164774

SEQ ID NO: 204705 - RNA, 64 nt, Human; identical to SEQ ID NO: 164775

SEQ ID NO: 204706 - RNA, 64 nt, Human; identical to SEQ ID NO: 164776

SEQ ID NO: 204707 - RNA, 64 nt, Human; identical to SEQ ID NO: 164777

SEQ ID NO: 204708 - RNA, 64 nt, Human; identical to SEQ ID NO: 164778

SEQ ID NO: 204709 - RNA, 64 nt, Human; identical to SEQ ID NO: 164779

SEQ ID NO: 204710 - RNA, 64 nt, Human; identical to SEQ ID NO: 164780

SEQ ID NO: 204711 - RNA, 64 nt, Human; identical to SEQ ID NO: 164781

SEQ ID NO: 204712 - RNA, 64 nt, Human; identical to SEQ ID NO: 164782

SEQ ID NO: 204713 - RNA, 64 nt, Human; identical to SEQ ID NO: 164783

SEQ ID NO: 204714 - RNA, 64 nt, Human; identical to SEQ ID NO: 164784

SEQ ID NO: 204715 - RNA, 64 nt, Human; identical to SEQ ID NO: 164785

SEQ ID NO: 204716 - RNA, 64 nt, Human; identical to SEQ ID NO: 164786

SEQ ID NO: 204717 - RNA, 64 nt, Human; identical to SEQ ID NO: 164787

SEQ ID NO: 204718 - RNA, 64 nt, Human; identical to SEQ ID NO: 164788

SEQ ID NO: 204719 - RNA, 64 nt, Human; identical to SEQ ID NO: 164789

SEQ ID NO: 204720 - RNA, 64 nt, Human; identical to SEQ ID NO: 164790

SEQ ID NO: 204721 - RNA, 64 nt, Human; identical to SEQ ID NO: 164791

SEQ ID NO: 204722 - RNA, 64 nt, Human; identical to SEQ ID NO: 164792

SEQ ID NO: 204723 - RNA, 64 nt, Human; identical to SEQ ID NO: 164793

SEQ ID NO: 204724 - RNA, 64 nt, Human; identical to SEQ ID NO: 164794

SEQ ID NO: 204725 - RNA, 64 nt, Human; identical to SEQ ID NO: 164795

SEQ ID NO: 204726 - RNA, 64 nt, Human; identical to SEQ ID NO: 164796

SEQ ID NO: 204727 - RNA, 64 nt, Human; identical to SEQ ID NO: 164797

SEQ ID NO: 204728 - RNA, 64 nt, Human; identical to SEQ ID NO: 164798

SEQ ID NO: 204729 - RNA, 64 nt, Human; identical to SEQ ID NO: 164799

SEQ ID NO: 204730 - RNA, 64 nt, Human; identical to SEQ ID NO: 164800

SEQ ID NO: 204731 - RNA, 64 nt, Human; identical to SEQ ID NO: 164801

SEQ ID NO: 204732 - RNA, 57 nt, Human; identical to SEQ ID NO: 164802

SEQ ID NO: 204733 - RNA, 64 nt, Human; identical to SEQ ID NO: 164803

SEQ ID NO: 204734 - RNA, 64 nt, Human; identical to SEQ ID NO: 164804

SEQ ID NO: 204735 - RNA, 64 nt, Human; identical to SEQ ID NO: 164805

SEQ ID NO: 204736 - RNA, 64 nt, Human; identical to SEQ ID NO: 164806

SEQ ID NO: 204737 - RNA, 64 nt, Human; identical to SEQ ID NO: 164807

SEQ ID NO: 204738 - RNA, 64 nt, Human; identical to SEQ ID NO: 164808

SEQ ID NO: 204739 - RNA, 64 nt, Human; identical to SEQ ID NO: 164809

SEQ ID NO: 204740 - RNA, 64 nt, Human; identical to SEQ ID NO: 164810

SEQ ID NO: 204741 - RNA, 64 nt, Human; identical to SEQ ID NO: 164811

SEQ ID NO: 204742 - RNA, 64 nt, Human; identical to SEQ ID NO: 164812

SEQ ID NO: 204743 - RNA, 64 nt, Human; identical to SEQ ID NO: 164813

SEQ ID NO: 204744 - RNA, 64 nt, Human; identical to SEQ ID NO: 164814

SEQ ID NO: 204745 - RNA, 64 nt, Human; identical to SEQ ID NO: 164815

SEQ ID NO: 204746 - RNA, 64 nt, Human; identical to SEQ ID NO: 164816

SEQ ID NO: 204747 - RNA, 64 nt, Human; identical to SEQ ID NO: 164817

SEQ ID NO: 204748 - RNA, 64 nt, Human; identical to SEQ ID NO: 164818

SEQ ID NO: 204749 - RNA, 64 nt, Human; identical to SEQ ID NO: 164819

SEQ ID NO: 204750 - RNA, 63 nt, Human
ccagccucgcccgacagagcccggggcgcaggcgggcgccagggcgcuaaucccggcgcgggu

SEQ ID NO: 204751 - RNA, 63 nt, Human
cagcaaaacgacacugcgcaucaccuaccccgagggcgccaugcagcggccugagcaguacga

SEQ ID NO: 204752 - RNA, 63 nt, Human
cccgcggcucugaguuggacugaggacaggugugggcgccagugugggugcaggcgcaggugc

SEQ ID NO: 204753 - RNA, 63 nt, Human
gucuguggcucuucucugcugauggaaacagaagggcgccaagccaugccuaaaaagaucucg

SEQ ID NO: 204754 - RNA, 63 nt, Human
ugucccccagaggccuugggcugcaguugcagggggcgccauggggcuauaggagccucccac

SEQ ID NO: 204755 - RNA, 63 nt, Human
gugaccucuaaauagcauucucaugacacaugggggcgccaaagagaaguaagagagauagcu

SEQ ID NO: 204756 - RNA, 63 nt, Human
ggguguguggagauggcgcccuguccugccaaggggcgccaggagcagagccagggccuggcg

SEQ ID NO: 204757 - RNA, 63 nt, Human
ggcuugagaggaacgcccacccacgaaggcccagggcgccagacggccccgaaaaggcgcucg

SEQ ID NO: 204758 - RNA, 63 nt, Human
cucuugguacuugggaccccagugccucguugagggcgccauucugaagaaaggaacugcagc

SEQ ID NO: 204759 - RNA, 63 nt, Human
agggugggcuggggacucuggcacagugaugccgggcgccaggacagcagcacucccgcugca

SEQ ID NO: 204760 - RNA, 57 nt, Human
ucuccaucuccgacgacugaggcaagagggcgccagugaggaggaagggaaggcggu

SEQ ID NO: 204761 - RNA, 63 nt, Human
gcauugaggggagucugggugcaucagauuggggggcgccagaggcgaggcugccuggcuccc

SEQ ID NO: 204762 - RNA, 63 nt, Human
cauacgcacugguauguguggaugaugcugccagggcgccaucgccaaguaagaaagugaagc

SEQ ID NO: 204763 - RNA, 63 nt, Human
caacuuccacccugauuccggacccuguagauugggcgccaccaccagaucccccucccaggc

SEQ ID NO: 204764 - RNA, 63 nt, Human
guuggacgggcugccaugcauugcgugcuuacugggcgccaggugcugugcugggcccuugug

SEQ ID NO: 204765 - RNA, 63 nt, Human
uuucagagagcuuguagcacaagggcuacacaugggcgccaagauggugguagauacaccuug

SEQ ID NO: 204766 - RNA, 63 nt, Human
ugggagaaggccaugccagccacguccgccgaggggcgccagccugaagcugccaggcccuga

SEQ ID NO: 204767 - RNA, 63 nt, Human
gguccuggaagaggguggcuucuuugaggagaagggcgccaucuucugcccaccaugcuauga

SEQ ID NO: 204768 - RNA, 63 nt, Human
acccaauggacaaaaccguuuuuguuuuugagagggcgccagauuugaaacagugagaggucc

SEQ ID NO: 204769 - RNA, 63 nt, Human
cgccucucccuaccacgggugcucgggacggcugggcgccagcuccggggcgaguucagcacu

SEQ ID NO: 204770 - RNA, 52 nt, Human
acuuccccuccugcagguagcagggcgccaagcagugacuucugaccaacag

SEQ ID NO: 204771 - RNA, 63 nt, Human
cugcaucguggcacuccucucgcaugguguggagggcgccaucuaugguguggaugggaaacu

SEQ ID NO: 204772 - RNA, 63 nt, Human
uaggucaaagcagagagcuggguguugcauccugggcgccacaugcucauggccagaaucuua

SEQ ID NO: 204773 - RNA, 63 nt, Human
ccugccucccaagcagcugaagggugacuaaacgggcgccaagacucaggggaucggcuggga

SEQ ID NO: 204774 - RNA, 63 nt, Human
gggggcacgcgccacguggccgggagacgcacagggcgccagcgucgccgcgaggccucuggg

SEQ ID NO: 204775 - RNA, 63 nt, Human
gagccgaugugcacuggccaccaccaggguugggggcgccacagcugcgagcccggccccugc

SEQ ID NO: 204776 - RNA, 63 nt, Human
guuuacaugggaccuauggaaacaaaggcuggcgggcgccagcugacuccagaguaagagagg

SEQ ID NO: 204777 - RNA, 63 nt, Human
gaaagucacacagcuccucuguaugagaccagugggcgccauuuaaaagaacaggaugagaau

SEQ ID NO: 204778 - RNA, 63 nt, Human
agugcccacuggugcuggcguccucaaagugccgggcgccaaguucagccccaggugcguuug

SEQ ID NO: 204779 - RNA, 63 nt, Human
uuguccggguguggucgggcgcggggguugugggggcgccaucuccucuuccggccccuggga

SEQ ID NO: 204780 - RNA, 63 nt, Human
gcaguggguguucgugaaugcggguggcuggaugggcgccaugugccuucugcacgccucgcu

SEQ ID NO: 204781 - RNA, 63 nt, Human
ggcaugacuguuucccaaccagcacccaaagacgggcgccauugccaagucacaggaugugau

SEQ ID NO: 204782 - RNA, 63 nt, Human
caacgggcauggcauggugcccugccugcccccgggcgccaccucuguacacuucccugacac

SEQ ID NO: 204783 - RNA, 63 nt, Human
cggcccagccccgggcacccgccucggacgcucgggcgccaggaggcuucgcuggaggggcug

SEQ ID NO: 204784 - RNA, 63 nt, Human
cuugauacugcaauaaauuauggcucuucaccugggcgccaacugcugaucaaugaaaugcuu

SEQ ID NO: 204785 - RNA, 63 nt, Human
aggcugugaccgccgaacuccacugcaacagacgggcgccaccaaagccaggcccugaggccu

SEQ ID NO: 204786 - RNA, 50 nt, Human
ugcgggacguggacaucugagggcgccaggcaggcgggcgccaccgccac

SEQ ID NO: 204787 - RNA, 63 nt, Human
cgggacguggacaucugagggcgccaggcaggcgggcgccaccgccacccgcagcgagggcgg

SEQ ID NO: 204788 - RNA, 63 nt, Human
ggcgcaaauuuccugggccucccucugacuucugggcgccagauccugccgugcccccauccu

SEQ ID NO: 204789 - RNA, 63 nt, Human
aggauucgcuugggaacgggcaggugguaguaggggcgccagcuugggcucuccuggcgcccc

SEQ ID NO: 204790 - RNA, 63 nt, Human
cgacccgccacgaugagaagugggaccagcagagggcgccaacuucaggaguccgcuuuccca

SEQ ID NO: 204791 - RNA, 51 nt, Human
agucugccgaagaggacuagggggcgccaacguucgauuucuaccucagca

SEQ ID NO: 204792 - RNA, 63 nt, Human
agacuauuuagaguugacauuugacauuuuaaugggcgccauggcucauuuuguagauugaga

SEQ ID NO: 204793 - RNA, 63 nt, Human
agggaaggccgggugcgaaagggacgguauccagggcgccagggugcugucgggauaacgugg

SEQ ID NO: 204794 - RNA, 63 nt, Human
aagguuuccugcuccaguguaucucaaaagaccgggcgccaggggcgggggaccuagggcgac

SEQ ID NO: 204795 - RNA, 63 nt, Human
ugugcccggcaagaagcagcuagacacacgccagggcgccaagcacggccagcuccgcggacc

SEQ ID NO: 204796 - RNA, 63 nt, Human
ccuccgccggcuaccuuagcuuagcgugucagcgggcgccacagcggaucagcgguuccgugu

SEQ ID NO: 204797 - RNA, 63 nt, Human
ucuccguccgccucccugcagccccaucuccuugggcgccagggucccuggcgcgcccucauc

SEQ ID NO: 204798 - RNA, 63 nt, Human
uggccugcugggcugagggaagucagagccccagggcgccacgaagcagccacugggauaccc

SEQ ID NO: 204799 - RNA, 63 nt, Human
ugaugaccgcaugaaugcucacacaaggggaaagggcgccaagccaaggagccggcgucaucc

SEQ ID NO: 204800 - RNA, 63 nt, Human
gugagaaaguuuugguuagugcauaccguggaagggcgccagggucuuuguggauugcauguu

SEQ ID NO: 204801 - RNA, 63 nt, Human
ccgccaggaucgaagccaugacugggugcaggcgggcgccaggcccgcugugggugggcacca

SEQ ID NO: 204802 - RNA, 63 nt, Human
cauacaaugacuagucaccuggggggguugggcgggcgccaucuuccauugccgccgcgggug

SEQ ID NO: 204803 - RNA, 63 nt, Human
aucccccacagccuggggcagaagaggcgucgagggcgccagaaguggcggcagcagcagccg

SEQ ID NO: 204804 - RNA, 63 nt, Human
cggcggcacccgccggacccgcauuauggcugggggcgccagcccaagaauggggaccauggg

SEQ ID NO: 204805 - RNA, 63 nt, Human
caauggcagagaccugggaugggagaaguccuggggcgccaggggauccagccuagagcagac

SEQ ID NO: 204806 - RNA, 63 nt, Human
ccugcgaggaagggcugagguggggccggcagggggcgccaggcagccgugaucacaggugac

SEQ ID NO: 204807 - RNA, 63 nt, Human
uucuugcguguguguagaugaggggcgggggacgggcgccaggcauuguccagaccuggucgg

SEQ ID NO: 204808 - RNA, 63 nt, Human
ccuagcgccgaggcagcgggcgggcgggcgggcgggcgccagggcggggccgagcgagagcgg

SEQ ID NO: 204809 - RNA, 63 nt, Human
gccuggggcgugcuucaggcuccucccucuaaggggcgccaugggaacaggcuccggagggag

SEQ ID NO: 204810 - RNA, 63 nt, Human
cuaguuuauguccccgguggggcacacagcggggggcgccagguuuuccuugucccccagcug

SEQ ID NO: 204811 - RNA, 63 nt, Human
ugaagcuucucagcacguuccucccuggagagcgggcgccacggcugguauucugcaggcuga

SEQ ID NO: 204812 - RNA, 60 nt, Human
ugaccgaugacaagcugugacuccagcugggggcgccacagcacccaccaccugccgccu

SEQ ID NO: 204813 - RNA, 63 nt, Human
ugcauguccgaggacggccccugcacuggagcugggcgccagagcugcagagcuaguguucgg

SEQ ID NO: 204814 - RNA, 63 nt, Human
uggccccacgccacauguuagccccccuggagggggcgccaguuggagacgggggcugggugu

SEQ ID NO: 204815 - RNA, 63 nt, Human
ggaacugccugggccaugcgaggggccagcagagggcgccaccaccaccugacggcuggggac

SEQ ID NO: 204816 - RNA, 63 nt, Human
acacuccacgccggcagccaacgcacaggaugggggcgccaggagaggggccccucucuccuc

SEQ ID NO: 204817 - RNA, 63 nt, Human
acagacugacagccagggcaggggaggagggaggggcgccagcaccugaugaucgccuacugu

SEQ ID NO: 204818 - RNA, 63 nt, Human
ucaaccugggaugaucaagcuugguggggggaggggcgccaaccauuaccaaagcuugaauag

SEQ ID NO: 204819 - RNA, 63 nt, Human
uggagaaaggagaucggacugggguucccgguggggcgccaggauggcuccugggggugcucc

SEQ ID NO: 204820 - RNA, 63 nt, Human
gaaauacuuggcucugccccaugggcacgggaggggcgccagccguggagcuguggaauuggg

SEQ ID NO: 204821 - RNA, 63 nt, Human
cgcauccuggggccugcuccauccaucccuccugggcgccagacccuccauccaagcccugug

SEQ ID NO: 204822 - RNA, 63 nt, Human
cgacgcgccaccccccguacgacacgcguccucgggcgccaccgggcgcucgcccaggacucc

SEQ ID NO: 204823 - RNA, 63 nt, Human
gguuugcacucagggaggggcugauggagggcugggcgccauggggucagggaggccccaggg

SEQ ID NO: 204824 - RNA, 63 nt, Human
agugggcagguggcaccgggggucagcaugcaggggcgccagaggcccaggcugcuggccgga

SEQ ID NO: 204825 - RNA, 63 nt, Human
cuugaauugcuccacccacaccuccaugaccaagggcgccagagugcugcaacuggggcgugg

SEQ ID NO: 204826 - RNA, 63 nt, Human
ggggcgggggaaggcaggcagagcccccucuccgggcgccauaaccaaacuuuccucagucug

SEQ ID NO: 204827 - RNA, 56 nt, Human
uacaacagagcaaugucugaucacaggggcgccauccagguuuaacccugcaagcu

SEQ ID NO: 204828 - RNA, 63 nt, Human
ccuggagagugcacaugccccuugguccuggcagggcgccaagucuggcaccauguuggccuc

SEQ ID NO: 204829 - RNA, 63 nt, Human
uagcaccuaggaagucgugugcaggagccagcagggcgccaaguggcccagugccugcagcuc

SEQ ID NO: 204830 - RNA, 63 nt, Human
agggaaaagcgggacagcucccaccacccugcugggcgccaguucuccacaaccacagggcag

SEQ ID NO: 204831 - RNA, 63 nt, Human
cuaaugugguggccugcaagccaggccaucccugggcgccacagacgagcuccgagccagguc

SEQ ID NO: 204832 - RNA, 64 nt, Human
uuguggugugcuuugcaggaggacuugaagcagaguucaccagugagcucaggugucucaaaga

SEQ ID NO: 204833 - RNA, 64 nt, Human
cucuccgcuugccaaaauaaccgaaggaaagaccguucaccagacuuggcuccucuaaacauuu

SEQ ID NO: 204834 - RNA, 64 nt, Human
cucccuauccagccuagacaccaguaacucuuguguucaccaggacccagacccuuggcaaggg

SEQ ID NO: 204835 - RNA, 64 nt, Human
acguaagacaaacacgugcucguccuuuaauggaguucaccagcacacuuguuaaccaguccug

SEQ ID NO: 204836 - RNA, 64 nt, Human
uucuaccugccgcaggguaggagggccaggcaaaguucaccagcuugcucuaagagcaagcagg

SEQ ID NO: 204837 - RNA, 64 nt, Human
gguguguguagcgugcugaucugugacucccaguguucaccaccuuccugaagaccacgcuccc

SEQ ID NO: 204838 - RNA, 64 nt, Human
gucaugucacuccucugcucagaaaccuucaaugguucaccauuaccaguggaaugaagucaau

SEQ ID NO: 204839 - RNA, 64 nt, Human
ugucaugaaauuuugccuuuccacgcuucccucaguucaccaaaguuaccaaaauguaaaauaa

SEQ ID NO: 204840 - RNA, 64 nt, Human
ccuuauuucucuuucaacccuguacaugacucguguucaccauccccuugaucaguguccaucc

SEQ ID NO: 204841 - RNA, 64 nt, Human
aaggucaugcagugggucgagcgccugagauccuguucaccaggacuccacagagcuggcucug

SEQ ID NO: 204842 - RNA, 64 nt, Human
aaaaaugucaaagaaaaauugagauaaacauuuuguucaccauuaaauguuugcaucugcaguc

SEQ ID NO: 204843 - RNA, 64 nt, Human
ucuguguuucacccauugucuguguuuaguccuuguucaccacuaaggcaaggaauucuuaacu

SEQ ID NO: 204844 - RNA, 64 nt, Human
aucauguccagaggggucuggagcuuuguuuccuguucaccagcaaaaaaugucucucccauuu

SEQ ID NO: 204845 - RNA, 64 nt, Human
ccugaggcccccagccacucccuccagcagccugguucaccacacaaacucugccuggacccca

SEQ ID NO: 204846 - RNA, 56 nt, Human
uagagacaagugaucaaugagaaucuguucaccaaaccaaauguggaaagaacaca

SEQ ID NO: 204847 - RNA, 56 nt, Human
aaucaauggacacuaguuagauguuuguucaccauggggaccauuacauaugacca

SEQ ID NO: 204848 - RNA, 64 nt, Human
gcgugggcagcaaggcagggcagcccagagguggcagcggcaggcaaucuggucacuaggucuu

SEQ ID NO: 204849 - RNA, 64 nt, Human
gaguaaagaauuguaugauauguuccuuuuuucaguucaccaaguuggaagccuuuugcagcuc

SEQ ID NO: 204850 - RNA, 64 nt, Human
aaguugggcuugcuauucugucccuagguguuuuguucaccauuauaaugaauuuagugagcau

SEQ ID NO: 204851 - RNA, 64 nt, Human
auauacaacuugauauguguauauacaguaaaguguucaccacaagcaagccaauuaacauauc

SEQ ID NO: 204852 - RNA, 64 nt, Human
caaaaauaagcuacauguuuuauuucuucaucguguucaccacuguaugccaaggcuuuucagu

SEQ ID NO: 204853 - RNA, 64 nt, Human
uaggaaacucgagugugcuuuuuguuuaaugagcguucaccaagcugagccggagccauccuuu

SEQ ID NO: 204854 - RNA, 64 nt, Human
guagcggcaucauggccaguagugucuuugaggaguucaccacuuagauuacugaguaauugug

SEQ ID NO: 204855 - RNA, 64 nt, Human
uccuggaccaugugacuggaagguggguaaccaaguucaccagcaauaaaacccagcgcccagg

SEQ ID NO: 204856 - RNA, 64 nt, Human
gaggaacauggcacucuagaucccucacauaccaguucaccauaugguucgcacuucuaugaga

SEQ ID NO: 204857 - RNA, 64 nt, Human
aauauauaccauuaauuuuuaggucuuucaaauuguucaccaaguuuuguguuugauauuuaug

SEQ ID NO: 204858 - RNA, 64 nt, Human
acuaugugccugugagcucuucagagcugguuggguucaccaccuucauaagaccugccucugu

SEQ ID NO: 204859 - RNA, 64 nt, Human
ccugccagcugcaugcugccaguuccuguucuguguucaccacauccccacaccccauugccac

SEQ ID NO: 204860 - RNA, 64 nt, Human
gggccagacuuggcagcaugugcaccagguugguguucaccagcucaugucuuccccacaucuc

SEQ ID NO: 204861 - RNA, 64 nt, Human
uguacauuuaugauaaugcagaauuaggaaaacgguucaccaguguuuaguuuuauauugaggu

SEQ ID NO: 204862 - RNA, 64 nt, Human
agguauguagugguauuaauuguuuuaaucugcaguucaccaauaauauaugaauuuagcaucu

SEQ ID NO: 204863 - RNA, 64 nt, Human
acccuugagaagcugccauaucuucaggccauggguucaccagcccugaaggcaccugucaacu

SEQ ID NO: 204864 - RNA, 64 nt, Human
ucugugagauggagagccaaucucacauucaaguguucaccaaccacugauguguuuuuauuuc

SEQ ID NO: 204865 - RNA, 64 nt, Human; identical to SEQ ID NO: 200084

SEQ ID NO: 204866 - RNA, 64 nt, Human; identical to SEQ ID NO: 200087

SEQ ID NO: 204867 - RNA, 64 nt, Human
gacagagucucucucugucccccaggcugaagugcagcggcaugaucucagcucacugcaaccu

SEQ ID NO: 204868 - RNA, 64 nt, Human
ucccagucuucuccacauugcugucauggcgucaguucaccagacucauugauuuuguuuugcu

SEQ ID NO: 204869 - RNA, 64 nt, Human
uuuaauacaaagagcggagaauucugccuuguuuguucaccauuauuaguuuggcgauuugaug

SEQ ID NO: 204870 - RNA, 64 nt, Human
agaaauugacagaauucauagguguggguguagaguucaccaagauaagauuaugaauauaauu

SEQ ID NO: 204871 - RNA, 64 nt, Human
ugcuuugugccaaaacaguaauuuccaaacuucuguucaccaugaaaaggcaaucuuaaaguuc

SEQ ID NO: 204872 - RNA, 64 nt, Human
agagggcugagccauggggguuuggggcuaagaaguucaccagcccugagccauggcggccccu

SEQ ID NO: 204873 - RNA, 64 nt, Human
ggcacauggaacacagugcuauucaugaagguggguucaccaugccccagacgccagaagguca

SEQ ID NO: 204874 - RNA, 64 nt, Human
ccaaauccuccaccccuccaauugggaggggacuguucaccaccuugugguaagggacaacacc

SEQ ID NO: 204875 - RNA, 64 nt, Human
caaacaaaacugaaccacaaaaaaaaaggcugguguucaccaaaaccaaacuuguucauuuaga

SEQ ID NO: 204876 - RNA, 64 nt, Human
cccuuggccucacuuuuucccagcaauaagugggguucaccacccgccucgggaauacuuuccc

SEQ ID NO: 204877 - RNA, 64 nt, Human
aaaauacugcuggaaaauuuccaauuucuacuacguucaccaucucuaguaagaucugacauau

SEQ ID NO: 204878 - RNA, 64 nt, Human
agagauaguuuuggagccaggcauugauguagagguucaccaaacauauuuagggauaauagau

SEQ ID NO: 204879 - RNA, 64 nt, Human
agaugacagaguuuugucacagcuugugaauucuguucaccaagugcuggaaucuaaucugcug

SEQ ID NO: 204880 - RNA, 64 nt, Human
ccuuuagcacauucuggugcccuggccucuuaguguucaccaguuguacugcaauauagacaag

SEQ ID NO: 204881 - RNA, 64 nt, Human
uauagcuuucauuuuauugcuauuugaagcagauguucaccaaugucagcaagaacucaaccug

SEQ ID NO: 204882 - RNA, 64 nt, Human
cucaaguuuagaccaagaggacuauggucucaagguucaccaugagaaauguguugaacauuuu

SEQ ID NO: 204883 - RNA, 64 nt, Human
auacggaucauuuguauuuuggggugauaaaauaguucaccauggguaugagauauuuauucuu

SEQ ID NO: 204884 - RNA, 64 nt, Human
ugguaacaaacgccaccuuacacucugcaggcugcagcggcagcuccagauggccuccugagcu

SEQ ID NO: 204885 - RNA, 64 nt, Human
ggccuggacccccagugggcagggcaggagguggcagcggcagcagcuguguuucugcaccauu

SEQ ID NO: 204886 - RNA, 64 nt, Human
cuuggcucagacaccuagacucuaaaacuaucagcagcggcagcagcagcagcagcagcaguuu

SEQ ID NO: 204887 - RNA, 64 nt, Human
ugauguagguaaaaauauauaccuucgggucgcaguucaccauuuauaugugguauuaaaaauu

SEQ ID NO: 204888 - RNA, 64 nt, Human
acucuuuuucuagggagaccagcacuggauuagaguucaccaugauccaauaugaccucaucuu

SEQ ID NO: 204889 - RNA, 64 nt, Human
gcagcaauuaauuagaucaacacuuuucuccaggguucaccaugcaggcaacauuaccuugucu

SEQ ID NO: 204890 - RNA, 64 nt, Human
ugagaugucugacuugcuuucacuuauuaaacauguucaccaugggaugaugucuguaacauca

SEQ ID NO: 204891 - RNA, 64 nt, Human
ugccucagccugccaaguagcuaggacuacaggcguucaccacugcgcccgcaaaguuuuuuug

SEQ ID NO: 204892 - RNA, 64 nt, Human
ugggguggauggggaagacuuacucugaauguucguucaccauccgugggcaccaggucugugc

SEQ ID NO: 204893 - RNA, 64 nt, Human
augauacucuuuucugcauuagccccaccauuguguucaccaaugcuuggaacacugccugaag

SEQ ID NO: 204894 - RNA, 64 nt, Human
cucaacccccugugagaagaguccauuauuugguguucaccaacgugggagacuucaccggaac

SEQ ID NO: 204895 - RNA, 64 nt, Human
ccagaugcuguggacuuggaaugaggccaacaggguucaccaggaugagagaggagagaggaau

SEQ ID NO: 204896 - RNA, 64 nt, Human
ccagaagauauggacuuggaaugaggccuacaggguucaccaggauguaagaggagagaggaau

SEQ ID NO: 204897 - RNA, 64 nt, Human
guuauaguucugugggagaaauaauuuugucaguguucaccagcuuguaaaaacuuagugcgag

SEQ ID NO: 204898 - RNA, 64 nt, Human
ucaaauuagaaauguaaccaaaaaaauguuaaguguucaccaggguauuaaaauacagaggagu

SEQ ID NO: 204899 - RNA, 64 nt, Human
gcaaagauuuacaaaggcguaucagacuaugauuguucaccaaaauaggggaaugguuugaucc

SEQ ID NO: 204900 - RNA, 64 nt, Human
cauuuuggcugucuaguauucauuuacauuuaggguucaccaggacuaaugauuuuuauaaacc

SEQ ID NO: 204901 - RNA, 64 nt, Human
ugggccugggcuuuagucugggcuacgguuccauguucaccaagauuugguggguccacacggu

SEQ ID NO: 204902 - RNA, 64 nt, Human
uuccccgcagaccgccgcgcgucccucuugugcgguucaccacaguuguauuuaagugaucgug

SEQ ID NO: 204903 - RNA, 64 nt, Human
ggggagucuggcagcccggcuggcccaggcccugcagcggcagccuuuccacagggcgcagcgg

SEQ ID NO: 204904 - RNA, 64 nt, Human
agcugguuauccaaauccuaaggggagcuacagccagcggcauauacuuguuuuugugauuauu

SEQ ID NO: 204905 - RNA, 64 nt, Human
uaaccuaaaaaucaaucacuugaaagugaacaaucagcggcauuuaguacauccagaaaguugu

SEQ ID NO: 204906 - RNA, 64 nt, Human
gccauugcuccccucucccugccacccuuccccaguucaccaaaccuuacauguugcaaaagag

SEQ ID NO: 204907 - RNA, 64 nt, Human
gaugaugccagcugucucccacguguguauuaugguucaccagggggaacuggcaaaagugugu

SEQ ID NO: 204908 - RNA, 64 nt, Human
guaugcuaauuucccugaaaucaaugccuucuauguucaccacagggauacaagccuguuaugu

SEQ ID NO: 204909 - RNA, 64 nt, Human
aauucagcaauaaucuuaaggccagagagaacagguucaccauugcauagacaagaaaacagau

SEQ ID NO: 204910 - RNA, 64 nt, Human
auaguccuuuugauuuucaaaguuuauaugugaaguucaccauguauguggugaauuucguaag

SEQ ID NO: 204911 - RNA, 64 nt, Human
cgccuucagaaaccugcugcacuuuucugauauaguucaccacuuuucugucuucacagcuuug

SEQ ID NO: 204912 - RNA, 64 nt, Human
cugugcauuccgauggaauuucaguucaucagauguucaccauggccaccgcagaacaccgaag

SEQ ID NO: 204913 - RNA, 64 nt, Human
aucugugccaugcucuagaaccuugaccuugauaguucaccaccucugauggaucccuguuuua

SEQ ID NO: 204914 - RNA, 64 nt, Human
ccaaccuauuuuuguauuuuuuaguagagacgggguucaccauguuggccaggcuugucucaaa

SEQ ID NO: 204915 - RNA, 64 nt, Human
augcauaccaguaauuggcuccaauucauaauauguucaccaggagauuacaauuuuuugcucu

SEQ ID NO: 204916 - RNA, 64 nt, Human
uuaauugauuuuuucuuuuaaauuuuaauaacagguucaccagcugguagaaaauagagacaca

SEQ ID NO: 204917 - RNA, 64 nt, Human
guggugguagaaaugauucaccagguccaauguuguucaccagugcuugcuugugaaucuuaac

SEQ ID NO: 204918 - RNA, 64 nt, Human
gcagaucuuaaucaucccaguuccuaggcaacuuguucaccagguacgcaagggccgaauaguu

SEQ ID NO: 204919 - RNA, 64 nt, Human
guaaaauaauuuugugauuauaacaguaagccagguucaccagaggaaauguggaauaccuaag

SEQ ID NO: 204920 - RNA, 64 nt, Human
uguucugcauuugagguguagugaaaucuuugcuguucaccagauguaauguuuuaguuccuua

SEQ ID NO: 204921 - RNA, 64 nt, Human
ucuuguuuggcugugcgugugaacacgugugugaguucaccauguacuguacugugauuuuuuu

SEQ ID NO: 204922 - RNA, 64 nt, Human
cccccccuucucaccuucccuucuccccgaccccaccccccaaaaaagcuacuucuucauuccg

SEQ ID NO: 204923 - RNA, 64 nt, Human
ggaagagucuuccaaggccagaaggagggggacaaccccccaagaccaucccugaagacgagca

SEQ ID NO: 204924 - RNA, 64 nt, Human
cugacccucccacucccaucuccuuaccucuggaaccccccaggcccuacaaugcucauguccc

SEQ ID NO: 204925 - RNA, 64 nt, Human
uuaauaacauuaauaacucuaaaguuaguauacaaccccccacugcuaaauuuggcuauaaaaa

SEQ ID NO: 204926 - RNA, 64 nt, Human
acccagcuaauuuuuguauuuuuaguagagacggguucaccauguugcccaggagggucucgaa

SEQ ID NO: 204927 - RNA, 64 nt, Human
aaggaaauaccaguucugggcaaucaguguuaccguucaccaguugccguugaggguuucagag

SEQ ID NO: 204928 - RNA, 64 nt, Human
ugggaaaaccuuucaucagaagucagcucuaauuguucaccacagaacucauauaagacagaaa

SEQ ID NO: 204929 - RNA, 64 nt, Human
gggugcagccucccuggucuuccuccacacaguuguucaccaacagaccagaccuccuuuaacc

SEQ ID NO: 204930 - RNA, 64 nt, Human
ugaguauggccgacagacauggacaaggagcuguguucaccaucggacucaugugcagucagcu

SEQ ID NO: 204931 - RNA, 64 nt, Human
agcuuuuuauuuauagcauuguuuacucagucaaguucaccauggccguaauccuucuaaggga

SEQ ID NO: 204932 - RNA, 64 nt, Human
agacuggagucaggagagagcaggaggcccucauguucaccagggaacaggaccacaccggcca

SEQ ID NO: 204933 - RNA, 64 nt, Human
cacccugauuccugagaggccagagaggaaguuuguucaccagagacaggcuucagauggcuuu

SEQ ID NO: 204934 - RNA, 64 nt, Human
ucucgcaaccgaccaaaauuuugacaacgaugauguucaccagaaggaaaaaaaaaaaucaguu

SEQ ID NO: 204935 - RNA, 64 nt, Human
uccaaaccacuuuuugcagcuuucucuaguucaaguucaccagacucuauaaauaaaaccugac

SEQ ID NO: 204936 - RNA, 64 nt, Human
ggacagaauuucccacagucuuugcccucaaggaguucaccaguuuauggggcuagaagagcga

SEQ ID NO: 204937 - RNA, 64 nt, Human
gaugauggaugccauuccuuuugcccaguuaaauguucaccaaucauuuuaacuaaauacucag

SEQ ID NO: 204938 - RNA, 64 nt, Human
aagccucuuccuacuagaacauuuuauuuuccuuguucaccauacaaucauguacucuuuaaca

SEQ ID NO: 204939 - RNA, 64 nt, Human
uaaacgcccgugcugggcccugugaagccagcauguucaccacuggucguucagcagccacgac

SEQ ID NO: 204940 - RNA, 64 nt, Human
uucaacagccuuucuauaucaucgugugauaauuguucaccaaugaaugaguccuuagcccugu

SEQ ID NO: 204941 - RNA, 64 nt, Human
aucuuaguagggugagggauaagcaaaagaggauguucaccauaacccaggaaugaagauacca

SEQ ID NO: 204942 - RNA, 64 nt, Human
ugaaagcuguuggauuucagugauuuuuccccccaccccccagcacaggagagcacccacagcc

SEQ ID NO: 204943 - RNA, 64 nt, Human
ucuccagggcuucuuuccaaacccccagcuccacaccccccagacccagcugguucuggaguuc

SEQ ID NO: 204944 - RNA, 64 nt, Human
uugccuuucuucaaggauuuuccuuuuucuuuuuaccccccagugaccacucugcucuuuagga

SEQ ID NO: 204945 - RNA, 64 nt, Human
gguacccccaggccaaagcaaguaagcgguuagcaccccccaaucccagaggcaacaauagaga

SEQ ID NO: 204946 - RNA, 64 nt, Human
cccauuccccuuucagcucccaugagcaugcauaguucaccagaccaauggccuagccauucuc

SEQ ID NO: 204947 - RNA, 64 nt, Human
aaguugcucugagcccauuuauuuaaacucuuuaguucaccaucagauggaccuuucucucaca

SEQ ID NO: 204948 - RNA, 64 nt, Human
gaauuaguacaacucuuaacugugccaguccccaguucaccagcuuuguauccagucgucaucu

SEQ ID NO: 204949 - RNA, 64 nt, Human
uucuuacugcaugaagagaacaagagucacacaaguucaccacuuugcacuucauagagaaggu

SEQ ID NO: 204950 - RNA, 64 nt, Human
aacaaugcagauucauccauaaucccuuucugcuguucaccaccacccaugauccaucugugua

SEQ ID NO: 204951 - RNA, 64 nt, Human
guaguugaacugauaguuacuguugugaccugaaguucaccauuaaaagggauuacccaagcaa

SEQ ID NO: 204952 - RNA, 64 nt, Human
uauauaaagcauaaacaccuugaauuugauuuuaguucaccacauucaaggauccaggaugcca

SEQ ID NO: 204953 - RNA, 64 nt, Human
agaugguugaccaaggugcuuuucuucggcuugaguucaccaucucuucauucaaacugcacuu

SEQ ID NO: 204954 - RNA, 64 nt, Human
ugugaucuaugagaauuggagacacuucuuuacuguucaccaaagaaauggguaaucugugcug

SEQ ID NO: 204955 - RNA, 64 nt, Human
gcagaacucuggaaggccaaguucaucgcagcauguucaccauaucccagccuccaaaucuauc

SEQ ID NO: 204956 - RNA, 64 nt, Human
ugcuucuuguguucuguucucuuugcccuccucaguucaccaucugcuuuccaccaugaguuga

SEQ ID NO: 204957 - RNA, 64 nt, Human
cagggauaugcuuuuuuuuuuaaagacugaauguguucaccauuuagccuguagauuuauuucc

SEQ ID NO: 204958 - RNA, 64 nt, Human
caugcguaagaagcacauucuaacgcuacuaaauguucaccagugcucuuaacauaacugaagc

SEQ ID NO: 204959 - RNA, 64 nt, Human
cuuucaacuuuuuaucacucacaaguaguguacuguucaccaaauugugaauuugggggugcag

SEQ ID NO: 204960 - RNA, 64 nt, Human
cuccagaggauuaccuggcugaaccauuggcucuguucaccagugacagaugguuuccccaucc

SEQ ID NO: 204961 - RNA, 64 nt, Human
acuuauagacuucuuguucugaugucacguccuuguucaccaaacagcuagcacucuagcuugc

SEQ ID NO: 204962 - RNA, 64 nt, Human
gugugccagaaaguccccccucgccccaaaguugcucaccgacucaccugcgcaagugccuggg

SEQ ID NO: 204963 - RNA, 64 nt, Human
gccaguuagagaggugagaauguuuggacucuaacucaccgauugcuuugcagacaaaggucuu

SEQ ID NO: 204964 - RNA, 64 nt, Human
uaggccuugauaucaccucugggacugugccuugcucaccgaaacccgcgcccaggaguauggc

SEQ ID NO: 204965 - RNA, 64 nt, Human
aagagaggaaccaauaccuucaaggcucuucuuccucaccgagcaugcuucccuaggaucccgu

SEQ ID NO: 204966 - RNA, 64 nt, Human
uauugaaagaaguggaaguuaucuuaaugccacgguucaccaucaauuuaaaaguaaaaaaaac

SEQ ID NO: 204967 - RNA, 64 nt, Human
uccucccuucccuuccacucuuuaaaguucugcaguucaccaacugguaguccauuaaauucuc

SEQ ID NO: 204968 - RNA, 64 nt, Human
aaauaugaaccacaaacacacagagaaacaaccuguucaccacuccugggugcaugauugaggg

SEQ ID NO: 204969 - RNA, 64 nt, Human
acugagauccagagaggcuggaugacuugcucaaguucaccagcaugguaguggcaaagagagg

SEQ ID NO: 204970 - RNA, 64 nt, Human
gcccuagaagagugugaaaaggaauggcaaugguguucaccaucggcagugccagggcagcacu

SEQ ID NO: 204971 - RNA, 64 nt, Human
aaggggucagcuggagagacccaagacccuaucuguucaccagggacccaaaauccaaggggau

SEQ ID NO: 204972 - RNA, 64 nt, Human
gaauuuguauuucauuuuauugucagauggugguguucaccagccuguaucuugucugagacug

SEQ ID NO: 204973 - RNA, 64 nt, Human
ucuuucauuggcagaucuugguagcacuuuauauguucaccaaugggaggucaauauuuaucua

SEQ ID NO: 204974 - RNA, 64 nt, Human
uagggagaagaaucugcaggcugcuuguaggacuguucaccaagggggauaccagcagcaagag

SEQ ID NO: 204975 - RNA, 64 nt, Human
uaacagaaugauugauuuuucuuucaaucagcauguucaccaaaaauagaaaaguucuucuaag

SEQ ID NO: 204976 - RNA, 64 nt, Human
cuggcuaauuuuuguauuuuuaguagagacggggguucaccaaguuggccaggauggucucgau

SEQ ID NO: 204977 - RNA, 64 nt, Human
cugagguuuuuaccacaggcagugaaugaccuugguucaccaaauuugccucuguuuugagggg

SEQ ID NO: 204978 - RNA, 64 nt, Human
ccgggggaggcccagccacggcacauccugcuuuguucaccacugggacucuccuuccaucugu

SEQ ID NO: 204979 - RNA, 64 nt, Human
gucauuggagcaguguuuugcagaaugagccagaguucaccaagcaggcaaggcaaggaagggu

SEQ ID NO: 204980 - RNA, 64 nt, Human
ggcugcaaaagugagggcuugucauuaccagacgguucaccagccucucuugguuuccuuccuu

SEQ ID NO: 204981 - RNA, 64 nt, Human
aagaggugaggcuuacuauucacuaugaaaauggguucaccaucucaagggaaaauggaggcuc

SEQ ID NO: 204982 - RNA, 64 nt, Human
guaaucuacaucuggaccauuccuuaaguuuuuccucaccgacaguaccaucaugccuugagug

SEQ ID NO: 204983 - RNA, 64 nt, Human
ggcgccucugacccuggcgcugccuuuccccacccucaccgaagccccuaauaaaugaagcugc

SEQ ID NO: 204984 - RNA, 64 nt, Human
ccuggaggauggucgugucgaguacagaguggcccucaccgaggaccggcugccccgccuggag

SEQ ID NO: 204985 - RNA, 64 nt, Human
aacugauguccuagcaauaaccucuugaucccuacucaccgaguguugagcccaaggggggauu

SEQ ID NO: 204986 - RNA, 64 nt, Human
aaacuacguauucccucuugacacucacaaucucguucaccacgugggccuggaacucuaacuc

SEQ ID NO: 204987 - RNA, 63 nt, Human
ccagcucugccaggacggcugcaagaccagcuggcccgggaggggacaacgggcuguugcggg

SEQ ID NO: 204988 - RNA, 63 nt, Human
accggugaggugggaugauuucaggaggucccagcccgggacugcccgccccucugcccuggg

SEQ ID NO: 204989 - RNA, 63 nt, Human
uacacggaagacgagaucuaugagcuuucuuaugcccgggagccgcguugucccaagagccug

SEQ ID NO: 204990 - RNA, 63 nt, Human
uacucgggaggcugaggcaggagaauugcuugagcccgggaggcagaggcugcagugaaccaa

SEQ ID NO: 204991 - RNA, 63 nt, Human
gcaucagggggcguggucugguccccauugcgggcccgggaggggaaugguuucuauggccaa

SEQ ID NO: 204992 - RNA, 63 nt, Human
gaaagagaacuccgagugaggggucuggccuaggcccgggaucggaccaggcucccucaggac

SEQ ID NO: 204993 - RNA, 63 nt, Human
cagauaucuacugagggccuggaggggccuggggcccgggaccggaggcugacgaggcuggac

SEQ ID NO: 204994 - RNA, 63 nt, Human
gucuccucagggcagcuggacaggcuuggcacugcccgggaagugcagcaggcagcuuuucuu

SEQ ID NO: 204995 - RNA, 63 nt, Human
ccaggacccugaggguuuccaccuuggcgcgcagcccgggagauccgcccugggcucuggguu

SEQ ID NO: 204996 - RNA, 63 nt, Human
guacaccgagugucugcagcuggggacacaacugcccgggacucuaacuuccaggaauuaaag

SEQ ID NO: 204997 - RNA, 63 nt, Human
gugcacgggacggccccacgacagagggagucagcccgggaggucaggagcgcggcgggcgag

SEQ ID NO: 204998 - RNA, 63 nt, Human
cgaaggaagaugcaaacugugcagugugcgacagcccgggagaccucuuagaucaguucuuuu

SEQ ID NO: 204999 - RNA, 51 nt, Human
gcgccugucgggucaacuagccucaccgaggugccggagagggagcgcugg

SEQ ID NO: 205000 - RNA, 64 nt, Human
acgcuguuuccuuucaaaguucugggaggacgaacucaccgaggcgagaaguguaacauucucu

SEQ ID NO: 205001 - RNA, 64 nt, Human
uuuacaguuugcaaagcucuuccauacccacucucucaccgaagccuaauugaggcucuuggaa

SEQ ID NO: 205002 - RNA, 64 nt, Human
ggcauuguaagcaugaacuauggaagaggcgccgguucaccaauucaacugaagcuuucucaug

SEQ ID NO: 205003 - RNA, 64 nt, Human
uccauugcauggaaaagaccuauuuuauuucuagguucaccaguugagggacauuuggauuguu

SEQ ID NO: 205004 - RNA, 64 nt, Human
aucucuagcugccgucuuguagauaugaacgaauguucaccaagcauguauuuuguauuuuguu

SEQ ID NO: 205005 - RNA, 64 nt, Human
aaagagaaaagugugcgcuccauucucaguggggguucaccacaaaacacgggccccaggaggg

SEQ ID NO: 205006 - RNA, 64 nt, Human
gcagaauccacuucccaaacagagccccacgcagguucaccaugaaccucagggucagggaaug

SEQ ID NO: 205007 - RNA, 64 nt, Human
augccugcccccgugaagcugguuggggagggcaguucaccagcauccauagaguaauaaaguc

SEQ ID NO: 205008 - RNA, 64 nt, Human
aauuagagguuuuucuucgggugcauuuaugagaguucaccagauuuuggaaauauuuucuauu

SEQ ID NO: 205009 - RNA, 64 nt, Human
caccuuucucagcaucaggacgggguugcccuguguucaccacgaguguggcugcuggaucagg

SEQ ID NO: 205010 - RNA, 64 nt, Human
ggguccccugacucccgucuccaucugucacgugguucaccaucaucaggcaccaggcgcaaac

SEQ ID NO: 205011 - RNA, 64 nt, Human
acaucacccacgacccugccacuguuuuugcuguguucaccacaucucugauccugaagugaau

SEQ ID NO: 205012 - RNA, 64 nt, Human
ccccuaggcuuuuccuuguggacaacggggcccuguucaccaagcuguugccauagagacuguc

SEQ ID NO: 205013 - RNA, 64 nt, Human
aagcugcaaggucaagaugguucauuauggcuguguucaccauagcaaacuggaaacaaucuag

SEQ ID NO: 205014 - RNA, 64 nt, Human
uggcuccccugcaucagcaccgucccaccaccaaguucaccagguucaccagacacggccucca

SEQ ID NO: 205015 - RNA, 64 nt, Human
ugcaucagcaccgucccaccaccaaguucaccagguucaccagacacggccuccacaauagcca

SEQ ID NO: 205016 - RNA, 64 nt, Human
ugucuguguuuagagagggaagaggguucuccagguucaccauuuggguuguuuauauguuggu

SEQ ID NO: 205017 - RNA, 64 nt, Human
cucuguuuaacaguccuuggaccauucugauccaguucaccaguagguuggacagcauauaauu

SEQ ID NO: 205018 - RNA, 64 nt, Human
gugggaccuucugugggguuuggggaucuccaggaagcccgaccaagcuguccccuuccccugu

SEQ ID NO: 205019 - RNA, 64 nt, Human
gaacaauaucugggaagguacuagagaaauuacaaagcccgagcucuuucuuauaaugccaccu

SEQ ID NO: 205020 - RNA, 64 nt, Human
cuccaagcugcauggcaaguucugugguucugagaagcccgaggucaucaccucccaguacaac

SEQ ID NO: 205021 - RNA, 64 nt, Human
ucaaaaaggcuuauaaaacagaguaaucuuguugguucaccauugagaccgugaagauacuuug

SEQ ID NO: 205022 - RNA, 64 nt, Human
cuggagaguagggucuauggcgagggaaaaggguguucaccaugauaaccuagugccuccauag

SEQ ID NO: 205023 - RNA, 64 nt, Human
agcagaguuaaaccaugggacaaacccauaacauguucaccauaguuucacguauguguauuuu

SEQ ID NO: 205024 - RNA, 64 nt, Human
acucaaucaugcuguccaggacuucuggcccuguguucaccacugggaaaacguacuucagacu

SEQ ID NO: 205025 - RNA, 64 nt, Human
cagaggacuaagggggugcucugcaagcgagaggguucaccagagggagcuugggugcagguuc

SEQ ID NO: 205026 - RNA, 64 nt, Human
acgccaagauggaagagcaacugaggcacgccaaguucaccaucacggagugcuucauaucaga

SEQ ID NO: 205027 - RNA, 64 nt, Human
cuagacagugugugguuaguaggaaucucucauuguucaccaugugacccccaggagguauucg

SEQ ID NO: 205028 - RNA, 64 nt, Human
gcugcccguuuguacaugggacugauucuguuguguucaccagagaaagcuugaggccauggcg

SEQ ID NO: 205029 - RNA, 64 nt, Human
uaaaagaucuucuuccaagaaaugcaaacagaccguucaccaccaucuccagcugcucacagac

SEQ ID NO: 205030 - RNA, 64 nt, Human; identical to SEQ ID NO: 205029

SEQ ID NO: 205031 - RNA, 64 nt, Human
uaaaagaucuucuuccaagaaaugcaaacaggcuguucaccaccaucuccagcugaucacagac

SEQ ID NO: 205032 - RNA, 64 nt, Human
cauaggccucugcuaccugccagucagcggggaaguucaccagauuucggcugcuggggccagg

SEQ ID NO: 205033 - RNA, 64 nt, Human
cugcucagggugucucagaggcugcaauguagguguucaccagagacauaggcaucacuggggu

SEQ ID NO: 205034 - RNA, 64 nt, Human
caccauuagcuauuugcuguaaugucaagaaaauguucaccagaugcaagaauguaccuuuucu

SEQ ID NO: 205035 - RNA, 64 nt, Human
cugcaagauacugugaggagaauugacagcaaaaguucaccaccuacucuuauuuacugcccau

SEQ ID NO: 205036 - RNA, 64 nt, Human
caaagaauacugugccccuuucuccuaaaccuuaguucaccaucacuacguagguuuagacuua

SEQ ID NO: 205037 - RNA, 64 nt, Human
uuaaagcauuuaaauggaaaccaggggaguuuuaaagcccgagaaaccacacauaaucuuuugu

SEQ ID NO: 205038 - RNA, 64 nt, Human
cacucuacaguaaaaucucuacacuaacaguuuaaagcccgaaagcugaagcauucagccucug

SEQ ID NO: 205039 - RNA, 64 nt, Human
gggggcggggaggggacguaaaucccuaaucuuuaagcccgacuugaggcugagagcagcugga

SEQ ID NO: 205040 - RNA, 64 nt, Human
cuaagugaugggauuuucaauuauacugaagcuaguucaccacguuaacugcauuuuacacauu

SEQ ID NO: 205041 - RNA, 64 nt, Human
aucagccaacuaaguuguccuuuucugguuucguguucaccauggaacauuuugauuauaguua

SEQ ID NO: 205042 - RNA, 64 nt, Human
aaagucaugugggccacacaagugcaguagugcaguucaccaugagggaagaauaaagagcugu

SEQ ID NO: 205043 - RNA, 64 nt, Human
ccuucuagaccacaugauagggcuagacagcucaguucaccaugauucucuucugucaccucug

SEQ ID NO: 205044 - RNA, 64 nt, Human; identical to SEQ ID NO: 200065

SEQ ID NO: 205045 - RNA, 64 nt, Human; identical to SEQ ID NO: 200066

SEQ ID NO: 205046 - RNA, 64 nt, Human; identical to SEQ ID NO: 200067

SEQ ID NO: 205047 - RNA, 64 nt, Human; identical to SEQ ID NO: 200068

SEQ ID NO: 205048 - RNA, 64 nt, Human; identical to SEQ ID NO: 200072

SEQ ID NO: 205049 - RNA, 64 nt, Human; identical to SEQ ID NO: 200073

SEQ ID NO: 205050 - RNA, 64 nt, Human; identical to SEQ ID NO: 200074

SEQ ID NO: 205051 - RNA, 64 nt, Human; identical to SEQ ID NO: 200075

SEQ ID NO: 205052 - RNA, 64 nt, Human; identical to SEQ ID NO: 200076

SEQ ID NO: 205053 - RNA, 64 nt, Human; identical to SEQ ID NO: 200077

SEQ ID NO: 205054 - RNA, 64 nt, Human; identical to SEQ ID NO: 200078

SEQ ID NO: 205055 - RNA, 64 nt, Human; identical to SEQ ID NO: 200079

SEQ ID NO: 205056 - RNA, 64 nt, Human; identical to SEQ ID NO: 200080

SEQ ID NO: 205057 - RNA, 64 nt, Human; identical to SEQ ID NO: 200081

SEQ ID NO: 205058 - RNA, 64 nt, Human; identical to SEQ ID NO: 200082

SEQ ID NO: 205059 - RNA, 64 nt, Human; identical to SEQ ID NO: 200083

SEQ ID NO: 205060 - RNA, 64 nt, Human; identical to SEQ ID NO: 200094

SEQ ID NO: 205061 - RNA, 64 nt, Human; identical to SEQ ID NO: 200095

SEQ ID NO: 205062 - RNA, 64 nt, Human; identical to SEQ ID NO: 200096

SEQ ID NO: 205063 - RNA, 64 nt, Human; identical to SEQ ID NO: 200097

SEQ ID NO: 205064 - RNA, 64 nt, Human; identical to SEQ ID NO: 200098

SEQ ID NO: 205065 - RNA, 64 nt, Human; identical to SEQ ID NO: 200099

SEQ ID NO: 205066 - RNA, 64 nt, Human; identical to SEQ ID NO: 200100

SEQ ID NO: 205067 - RNA, 64 nt, Human; identical to SEQ ID NO: 200101

SEQ ID NO: 205068 - RNA, 64 nt, Human; identical to SEQ ID NO: 200102

SEQ ID NO: 205069 - RNA, 53 nt, Human; identical to SEQ ID NO: 200069

SEQ ID NO: 205070 - RNA, 64 nt, Human; identical to SEQ ID NO: 200103

SEQ ID NO: 205071 - RNA, 64 nt, Human; identical to SEQ ID NO: 200104

SEQ ID NO: 205072 - RNA, 64 nt, Human
gggguauaucaacuucccauuagcaggagcuccccagcggcaagccuggcccagugggcucggu

SEQ ID NO: 205073 - RNA, 64 nt, Human
auaacagaauuuguacaggugagaagccuaaugaaagcccgauauguguaaagaucuacucuca

SEQ ID NO: 205074 - RNA, 64 nt, Human
cgcugcccaaccgcgcucuccgccuaccuccgcugcucgggaagcugcuggccuggcccuccug

SEQ ID NO: 205075 - RNA, 64 nt, Human
gcccucuuugcccaggauacugaggagggcuggagcucgggaaguuguccuuccugggccaggg

SEQ ID NO: 205076 - RNA, 64 nt, Human; identical to SEQ ID NO: 50550

SEQ ID NO: 205077 - RNA, 64 nt, Human; identical to SEQ ID NO: 50551

SEQ ID NO: 205078 - RNA, 64 nt, Human; identical to SEQ ID NO: 50552

SEQ ID NO: 205079 - RNA, 62 nt, Human; identical to SEQ ID NO: 50553

SEQ ID NO: 205080 - RNA, 52 nt, Human; identical to SEQ ID NO: 50554

SEQ ID NO: 205081 - RNA, 55 nt, Human; identical to SEQ ID NO: 50555

SEQ ID NO: 205082 - RNA, 64 nt, Human; identical to SEQ ID NO: 50556

SEQ ID NO: 205083 - RNA, 64 nt, Human; identical to SEQ ID NO: 50557

SEQ ID NO: 205084 - RNA, 64 nt, Human; identical to SEQ ID NO: 50558

SEQ ID NO: 205085 - RNA, 64 nt, Human; identical to SEQ ID NO: 50559

SEQ ID NO: 205086 - RNA, 64 nt, Human; identical to SEQ ID NO: 50560

SEQ ID NO: 205087 - RNA, 64 nt, Human; identical to SEQ ID NO: 50561

SEQ ID NO: 205088 - RNA, 64 nt, Human; identical to SEQ ID NO: 50562

SEQ ID NO: 205089 - RNA, 64 nt, Human
ccaccaugaccagccucucccugaacucucucuugcucgggaccugccugagggcucccugcug

SEQ ID NO: 205090 - RNA, 64 nt, Human
ggguaggggcagggaaaggacugggccagggcaggcucgggagauagauugucucccuugccuc

SEQ ID NO: 205091 - RNA, 64 nt, Human
ucacaguagccaggcuuggguggguucagcacuagcucgggacggugugucacacgucuauagu

SEQ ID NO: 205092 - RNA, 64 nt, Human; identical to SEQ ID NO: 50563

SEQ ID NO: 205093 - RNA, 64 nt, Human; identical to SEQ ID NO: 50564

SEQ ID NO: 205094 - RNA, 64 nt, Human; identical to SEQ ID NO: 50565

SEQ ID NO: 205095 - RNA, 64 nt, Human; identical to SEQ ID NO: 50566

SEQ ID NO: 205096 - RNA, 64 nt, Human; identical to SEQ ID NO: 50567

SEQ ID NO: 205097 - RNA, 64 nt, Human; identical to SEQ ID NO: 50568

SEQ ID NO: 205098 - RNA, 64 nt, Human; identical to SEQ ID NO: 50569

SEQ ID NO: 205099 - RNA, 64 nt, Human; identical to SEQ ID NO: 50570

SEQ ID NO: 205100 - RNA, 64 nt, Human; identical to SEQ ID NO: 50571

SEQ ID NO: 205101 - RNA, 64 nt, Human; identical to SEQ ID NO: 50572

SEQ ID NO: 205102 - RNA, 64 nt, Human; identical to SEQ ID NO: 50573

SEQ ID NO: 205103 - RNA, 64 nt, Human; identical to SEQ ID NO: 50574

SEQ ID NO: 205104 - RNA, 64 nt, Human; identical to SEQ ID NO: 50575

SEQ ID NO: 205105 - RNA, 64 nt, Human; identical to SEQ ID NO: 50576

SEQ ID NO: 205106 - RNA, 64 nt, Human; identical to SEQ ID NO: 50577

SEQ ID NO: 205107 - RNA, 64 nt, Human; identical to SEQ ID NO: 50578

SEQ ID NO: 205108 - RNA, 64 nt, Human
gaauuccacucacuuccuggucacuucagcagcccagcggcauugagccaaaauauacaauucu

SEQ ID NO: 205109 - RNA, 64 nt, Human
gcggaacaagcccuaugacguguuuggcuguuggcucaccgagaccagccucaucucggggaac

SEQ ID NO: 205110 - RNA, 64 nt, Human
caaaauagcaggggcuuagguagaaguuccuucacucaccgacuugugucuucucuucuuaguu

SEQ ID NO: 205111 - RNA, 64 nt, Human
uggguuuuuaaucaauaaaaacuggggguuucuucucaccgacucuccacuugcccaaacugcc

SEQ ID NO: 205112 - RNA, 64 nt, Human; identical to SEQ ID NO: 50579

SEQ ID NO: 205113 - RNA, 64 nt, Human; identical to SEQ ID NO: 50580

SEQ ID NO: 205114 - RNA, 64 nt, Human; identical to SEQ ID NO: 50581

SEQ ID NO: 205115 - RNA, 64 nt, Human; identical to SEQ ID NO: 50582

SEQ ID NO: 205116 - RNA, 64 nt, Human; identical to SEQ ID NO: 50583

SEQ ID NO: 205117 - RNA, 64 nt, Human; identical to SEQ ID NO: 50584

SEQ ID NO: 205118 - RNA, 64 nt, Human; identical to SEQ ID NO: 50585

SEQ ID NO: 205119 - RNA, 64 nt, Human; identical to SEQ ID NO: 50586

SEQ ID NO: 205120 - RNA, 64 nt, Human; identical to SEQ ID NO: 50587

SEQ ID NO: 205121 - RNA, 64 nt, Human; identical to SEQ ID NO: 50588

SEQ ID NO: 205122 - RNA, 64 nt, Human; identical to SEQ ID NO: 50589

SEQ ID NO: 205123 - RNA, 64 nt, Human; identical to SEQ ID NO: 50590

SEQ ID NO: 205124 - RNA, 64 nt, Human; identical to SEQ ID NO: 50591

SEQ ID NO: 205125 - RNA, 64 nt, Human; identical to SEQ ID NO: 50592

SEQ ID NO: 205126 - RNA, 64 nt, Human; identical to SEQ ID NO: 50593

SEQ ID NO: 205127 - RNA, 64 nt, Human; identical to SEQ ID NO: 50594

SEQ ID NO: 205128 - RNA, 64 nt, Human; identical to SEQ ID NO: 50595

SEQ ID NO: 205129 - RNA, 64 nt, Human
augcugcaauucccaaugcagagaagcggaccgacagcggcagccgggugaugucugaugaaga

SEQ ID NO: 205130 - RNA, 64 nt, Human
cccucccgcagaugauccuggaguguggaggcagcagcggcaccucgagagagaagggcccgga

SEQ ID NO: 205131 - RNA, 64 nt, Human
cacacucgugucauccagaugugagcaccgcacccagcggcaaagagcccuccccccugcaggg

SEQ ID NO: 205132 - RNA, 64 nt, Human; identical to SEQ ID NO: 50596

SEQ ID NO: 205133 - RNA, 64 nt, Human; identical to SEQ ID NO: 50597

SEQ ID NO: 205134 - RNA, 64 nt, Human; identical to SEQ ID NO: 50598

SEQ ID NO: 205135 - RNA, 64 nt, Human; identical to SEQ ID NO: 50599

SEQ ID NO: 205136 - RNA, 64 nt, Human; identical to SEQ ID NO: 50600

SEQ ID NO: 205137 - RNA, 64 nt, Human; identical to SEQ ID NO: 50601

SEQ ID NO: 205138 - RNA, 64 nt, Human; identical to SEQ ID NO: 50602

SEQ ID NO: 205139 - RNA, 64 nt, Human; identical to SEQ ID NO: 50603

SEQ ID NO: 205140 - RNA, 64 nt, Human; identical to SEQ ID NO: 50604

SEQ ID NO: 205141 - RNA, 64 nt, Human; identical to SEQ ID NO: 50605

SEQ ID NO: 205142 - RNA, 64 nt, Human; identical to SEQ ID NO: 50606

SEQ ID NO: 205143 - RNA, 64 nt, Human; identical to SEQ ID NO: 50607

SEQ ID NO: 205144 - RNA, 64 nt, Human; identical to SEQ ID NO: 50608

SEQ ID NO: 205145 - RNA, 64 nt, Human; identical to SEQ ID NO: 50609

SEQ ID NO: 205146 - RNA, 64 nt, Human; identical to SEQ ID NO: 50610

SEQ ID NO: 205147 - RNA, 64 nt, Human; identical to SEQ ID NO: 50611

SEQ ID NO: 205148 - RNA, 64 nt, Human; identical to SEQ ID NO: 50612

SEQ ID NO: 205149 - RNA, 64 nt, Human
uggaugaauugucaaaacaagaugcuuccaguuacagcggcaggagcgggacugggagcacggg

SEQ ID NO: 205150 - RNA, 64 nt, Human
cauccugagaccuggugcagggccaguggggaggcagcggcaccagacucaccaggccgugcuc

SEQ ID NO: 205151 - RNA, 64 nt, Human
gaugucugggugaccucacuuuaggcagcuguaacagcggcagggugucccaggagcccugauc

SEQ ID NO: 205152 - RNA, 64 nt, Human; identical to SEQ ID NO: 50613

SEQ ID NO: 205153 - RNA, 64 nt, Human; identical to SEQ ID NO: 50614

SEQ ID NO: 205154 - RNA, 64 nt, Human; identical to SEQ ID NO: 50615

SEQ ID NO: 205155 - RNA, 64 nt, Human; identical to SEQ ID NO: 50616

SEQ ID NO: 205156 - RNA, 64 nt, Human; identical to SEQ ID NO: 50617

SEQ ID NO: 205157 - RNA, 64 nt, Human; identical to SEQ ID NO: 50618

SEQ ID NO: 205158 - RNA, 64 nt, Human; identical to SEQ ID NO: 50619

SEQ ID NO: 205159 - RNA, 64 nt, Human; identical to SEQ ID NO: 50620

SEQ ID NO: 205160 - RNA, 64 nt, Human; identical to SEQ ID NO: 50621

SEQ ID NO: 205161 - RNA, 64 nt, Human; identical to SEQ ID NO: 50622

SEQ ID NO: 205162 - RNA, 64 nt, Human; identical to SEQ ID NO: 50623

SEQ ID NO: 205163 - RNA, 64 nt, Human; identical to SEQ ID NO: 50624

SEQ ID NO: 205164 - RNA, 64 nt, Human; identical to SEQ ID NO: 50625

SEQ ID NO: 205165 - RNA, 64 nt, Human; identical to SEQ ID NO: 50626

SEQ ID NO: 205166 - RNA, 64 nt, Human; identical to SEQ ID NO: 50627

SEQ ID NO: 205167 - RNA, 64 nt, Human; identical to SEQ ID NO: 50628

SEQ ID NO: 205168 - RNA, 64 nt, Human; identical to SEQ ID NO: 50629

SEQ ID NO: 205169 - RNA, 64 nt, Human
ggacaccauuggagaagccccgcuuuuucuggaacagcggcaaccaagaggccuugcagcccug

SEQ ID NO: 205170 - RNA, 64 nt, Human
ccuccuagacgcaguggugcccuuccucccgcuccagcggcaccacguccggcacugcgugcuc

SEQ ID NO: 205171 - RNA, 64 nt, Human
ucugguucuuccagagagacugcccccuucccuccagcggcacuccaagucccccccauguugg

SEQ ID NO: 205172 - RNA, 64 nt, Human; identical to SEQ ID NO: 50630

SEQ ID NO: 205173 - RNA, 64 nt, Human; identical to SEQ ID NO: 50631

SEQ ID NO: 205174 - RNA, 64 nt, Human; identical to SEQ ID NO: 50632

SEQ ID NO: 205175 - RNA, 61 nt, Human; identical to SEQ ID NO: 50633

SEQ ID NO: 205176 - RNA, 64 nt, Human; identical to SEQ ID NO: 50634

SEQ ID NO: 205177 - RNA, 64 nt, Human; identical to SEQ ID NO: 50635

SEQ ID NO: 205178 - RNA, 64 nt, Human; identical to SEQ ID NO: 50636

SEQ ID NO: 205179 - RNA, 64 nt, Human; identical to SEQ ID NO: 50637

SEQ ID NO: 205180 - RNA, 64 nt, Human; identical to SEQ ID NO: 50638

SEQ ID NO: 205181 - RNA, 64 nt, Human; identical to SEQ ID NO: 50639

SEQ ID NO: 205182 - RNA, 64 nt, Human; identical to SEQ ID NO: 50640

SEQ ID NO: 205183 - RNA, 64 nt, Human; identical to SEQ ID NO: 50641

SEQ ID NO: 205184 - RNA, 52 nt, Human; identical to SEQ ID NO: 50642

SEQ ID NO: 205185 - RNA, 64 nt, Human; identical to SEQ ID NO: 50643

SEQ ID NO: 205186 - RNA, 64 nt, Human; identical to SEQ ID NO: 50644

SEQ ID NO: 205187 - RNA, 64 nt, Human; identical to SEQ ID NO: 50645

SEQ ID NO: 205188 - RNA, 64 nt, Human; identical to SEQ ID NO: 50646

SEQ ID NO: 205189 - RNA, 64 nt, Human
gauggagucuugcucuguugcccaggcuggagugcagcggcaugaucucgacucacugcagccu

SEQ ID NO: 205190 - RNA, 64 nt, Human
cuucgcagccaguggcucuggagggccugagugacagcggcaguccuguuuguuugagguuuaa

SEQ ID NO: 205191 - RNA, 64 nt, Human
agacaugcuggcccacgcccggcggcccauugcccagcggcacccccugcggccagccagggag

SEQ ID NO: 205192 - RNA, 64 nt, Human; identical to SEQ ID NO: 50647

SEQ ID NO: 205193 - RNA, 64 nt, Human; identical to SEQ ID NO: 50648

SEQ ID NO: 205194 - RNA, 64 nt, Human; identical to SEQ ID NO: 50649

SEQ ID NO: 205195 - RNA, 64 nt, Human; identical to SEQ ID NO: 50650

SEQ ID NO: 205196 - RNA, 64 nt, Human; identical to SEQ ID NO: 50651

SEQ ID NO: 205197 - RNA, 64 nt, Human; identical to SEQ ID NO: 50652

SEQ ID NO: 205198 - RNA, 64 nt, Human; identical to SEQ ID NO: 50653

SEQ ID NO: 205199 - RNA, 64 nt, Human; identical to SEQ ID NO: 50654

SEQ ID NO: 205200 - RNA, 64 nt, Human; identical to SEQ ID NO: 50655

SEQ ID NO: 205201 - RNA, 64 nt, Human; identical to SEQ ID NO: 50656

SEQ ID NO: 205202 - RNA, 64 nt, Human; identical to SEQ ID NO: 50657

SEQ ID NO: 205203 - RNA, 64 nt, Human; identical to SEQ ID NO: 50658

SEQ ID NO: 205204 - RNA, 64 nt, Human; identical to SEQ ID NO: 50659

SEQ ID NO: 205205 - RNA, 64 nt, Human; identical to SEQ ID NO: 50660

SEQ ID NO: 205206 - RNA, 64 nt, Human; identical to SEQ ID NO: 50661

SEQ ID NO: 205207 - RNA, 64 nt, Human; identical to SEQ ID NO: 50662

SEQ ID NO: 205208 - RNA, 64 nt, Human; identical to SEQ ID NO: 50663

SEQ ID NO: 205209 - RNA, 52 nt, Human
ccuucgucugcuccuucuaagccagcggcacggagacccugccagcagcucc

SEQ ID NO: 205210 - RNA, 64 nt, Human
caugaggacugucugccuuugagggcuugggcagcagcggcagccaucuugguuuuaggaaaug

SEQ ID NO: 205211 - RNA, 64 nt, Human
gcugcaggagccagagaagugacccccgcgggagcagcggcagguggaucuccacgguggcucg

SEQ ID NO: 205212 - RNA, 64 nt, Human; identical to SEQ ID NO: 50664

SEQ ID NO: 205213 - RNA, 64 nt, Human; identical to SEQ ID NO: 50665

SEQ ID NO: 205214 - RNA, 64 nt, Human; identical to SEQ ID NO: 50666

SEQ ID NO: 205215 - RNA, 64 nt, Human; identical to SEQ ID NO: 50667

SEQ ID NO: 205216 - RNA, 64 nt, Human; identical to SEQ ID NO: 50668

SEQ ID NO: 205217 - RNA, 64 nt, Human; identical to SEQ ID NO: 50669

SEQ ID NO: 205218 - RNA, 64 nt, Human; identical to SEQ ID NO: 50670

SEQ ID NO: 205219 - RNA, 64 nt, Human; identical to SEQ ID NO: 50671

SEQ ID NO: 205220 - RNA, 64 nt, Human; identical to SEQ ID NO: 50672

SEQ ID NO: 205221 - RNA, 64 nt, Human; identical to SEQ ID NO: 50673

SEQ ID NO: 205222 - RNA, 64 nt, Human; identical to SEQ ID NO: 50674

SEQ ID NO: 205223 - RNA, 64 nt, Human; identical to SEQ ID NO: 50675

SEQ ID NO: 205224 - RNA, 64 nt, Human; identical to SEQ ID NO: 50676

SEQ ID NO: 205225 - RNA, 64 nt, Human; identical to SEQ ID NO: 50677

SEQ ID NO: 205226 - RNA, 64 nt, Human; identical to SEQ ID NO: 50678

SEQ ID NO: 205227 - RNA, 64 nt, Human; identical to SEQ ID NO: 50679

SEQ ID NO: 205228 - RNA, 64 nt, Human; identical to SEQ ID NO: 50680

SEQ ID NO: 205229 - RNA, 64 nt, Human
caugcgauuaguuaaagucgugaacucagaaacacagcggcaggaaauuguagggaagaucgau

SEQ ID NO: 205230 - RNA, 64 nt, Human
ccccgucccccaaccagaacaacaacgccauagacagcggcaucuaccugaccacgcaugucac

SEQ ID NO: 205231 - RNA, 64 nt, Human
ccgccuccauacccgggcccagggaagcccgcggcagcggcagccuggauccaggggcccccgg

SEQ ID NO: 205232 - RNA, 64 nt, Human; identical to SEQ ID NO: 50681

SEQ ID NO: 205233 - RNA, 64 nt, Human; identical to SEQ ID NO: 50682

SEQ ID NO: 205234 - RNA, 64 nt, Human; identical to SEQ ID NO: 50683

SEQ ID NO: 205235 - RNA, 64 nt, Human; identical to SEQ ID NO: 50684

SEQ ID NO: 205236 - RNA, 64 nt, Human; identical to SEQ ID NO: 50685

SEQ ID NO: 205237 - RNA, 64 nt, Human; identical to SEQ ID NO: 50686

SEQ ID NO: 205238 - RNA, 64 nt, Human; identical to SEQ ID NO: 50687

SEQ ID NO: 205239 - RNA, 64 nt, Human; identical to SEQ ID NO: 50688

SEQ ID NO: 205240 - RNA, 64 nt, Human; identical to SEQ ID NO: 50689

SEQ ID NO: 205241 - RNA, 64 nt, Human; identical to SEQ ID NO: 50690

SEQ ID NO: 205242 - RNA, 64 nt, Human; identical to SEQ ID NO: 50691

SEQ ID NO: 205243 - RNA, 64 nt, Human; identical to SEQ ID NO: 50692

SEQ ID NO: 205244 - RNA, 64 nt, Human; identical to SEQ ID NO: 50693

SEQ ID NO: 205245 - RNA, 64 nt, Human; identical to SEQ ID NO: 50694

SEQ ID NO: 205246 - RNA, 64 nt, Human; identical to SEQ ID NO: 50695

SEQ ID NO: 205247 - RNA, 64 nt, Human; identical to SEQ ID NO: 50696

SEQ ID NO: 205248 - RNA, 64 nt, Human; identical to SEQ ID NO: 50697

SEQ ID NO: 205249 - RNA, 64 nt, Human
acuccucagccagcacccugggguguggaaucagcagcggcagaguccaccguguuuggagacu

SEQ ID NO: 205250 - RNA, 64 nt, Human
aacagggugagaguuaauuaugcagucuucuugacagcggcauuaauuuggaaggaaacugaca

SEQ ID NO: 205251 - RNA, 64 nt, Human
gguugccugcccuccugagccuccgccuucccagcagcggcaccaaggggccuuagggagcccc

SEQ ID NO: 205252 - RNA, 64 nt, Human; identical to SEQ ID NO: 50698

SEQ ID NO: 205253 - RNA, 64 nt, Human; identical to SEQ ID NO: 50699

SEQ ID NO: 205254 - RNA, 53 nt, Human; identical to SEQ ID NO: 50700

SEQ ID NO: 205255 - RNA, 64 nt, Human; identical to SEQ ID NO: 50701

SEQ ID NO: 205256 - RNA, 64 nt, Human; identical to SEQ ID NO: 50702

SEQ ID NO: 205257 - RNA, 64 nt, Human; identical to SEQ ID NO: 50703

SEQ ID NO: 205258 - RNA, 64 nt, Human; identical to SEQ ID NO: 50704

SEQ ID NO: 205259 - RNA, 64 nt, Human; identical to SEQ ID NO: 50705

SEQ ID NO: 205260 - RNA, 64 nt, Human; identical to SEQ ID NO: 50706

SEQ ID NO: 205261 - RNA, 64 nt, Human; identical to SEQ ID NO: 50707

SEQ ID NO: 205262 - RNA, 64 nt, Human; identical to SEQ ID NO: 50708

SEQ ID NO: 205263 - RNA, 64 nt, Human; identical to SEQ ID NO: 50709

SEQ ID NO: 205264 - RNA, 64 nt, Human; identical to SEQ ID NO: 50710

SEQ ID NO: 205265 - RNA, 64 nt, Human; identical to SEQ ID NO: 50711

SEQ ID NO: 205266 - RNA, 64 nt, Human; identical to SEQ ID NO: 50712

SEQ ID NO: 205267 - RNA, 64 nt, Human; identical to SEQ ID NO: 50713

SEQ ID NO: 205268 - RNA, 64 nt, Human; identical to SEQ ID NO: 50714

SEQ ID NO: 205269 - RNA, 61 nt, Human
ugucccugaaguucccuguugcaugagccugcgacaggaccucacccccaccaccaggcuu

SEQ ID NO: 205270 - RNA, 61 nt, Human
aaggaaagguacuggcuugaagucacaaccacgacaggaguaaggauuuggaauaaggauu

SEQ ID NO: 205271 - RNA, 64 nt, Human
gaggccaccgcugggacugcuccuagauggaucucagcggcauuaagcugugccugagcgaguu

SEQ ID NO: 205272 - RNA, 64 nt, Human; identical to SEQ ID NO: 50715

SEQ ID NO: 205273 - RNA, 64 nt, Human; identical to SEQ ID NO: 50716

SEQ ID NO: 205274 - RNA, 64 nt, Human; identical to SEQ ID NO: 50717

SEQ ID NO: 205275 - RNA, 64 nt, Human; identical to SEQ ID NO: 50718

SEQ ID NO: 205276 - RNA, 64 nt, Human; identical to SEQ ID NO: 50719

SEQ ID NO: 205277 - RNA, 64 nt, Human; identical to SEQ ID NO: 50720

SEQ ID NO: 205278 - RNA, 64 nt, Human; identical to SEQ ID NO: 50721

SEQ ID NO: 205279 - RNA, 64 nt, Human; identical to SEQ ID NO: 50722

SEQ ID NO: 205280 - RNA, 64 nt, Human; identical to SEQ ID NO: 50723

SEQ ID NO: 205281 - RNA, 64 nt, Human; identical to SEQ ID NO: 50724

SEQ ID NO: 205282 - RNA, 64 nt, Human; identical to SEQ ID NO: 50725

SEQ ID NO: 205283 - RNA, 64 nt, Human; identical to SEQ ID NO: 50726

SEQ ID NO: 205284 - RNA, 64 nt, Human; identical to SEQ ID NO: 50727

SEQ ID NO: 205285 - RNA, 64 nt, Human; identical to SEQ ID NO: 50728

SEQ ID NO: 205286 - RNA, 64 nt, Human; identical to SEQ ID NO: 50729

SEQ ID NO: 205287 - RNA, 64 nt, Human; identical to SEQ ID NO: 50730

SEQ ID NO: 205288 - RNA, 64 nt, Human; identical to SEQ ID NO: 50731

SEQ ID NO: 205289 - RNA, 61 nt, Human
aggccugcagauccagccuuccugucaacagcgacaggaaaucucuagguuggugagugcu

SEQ ID NO: 205290 - RNA, 61 nt, Human
uugucacuuuauuuuggaccugcugugaucucgacaggaaacgugccacagagcaguagug

SEQ ID NO: 205291 - RNA, 61 nt, Human
ggugaggucugggaugcugcgugcggcgcgacgacaggagguaugaccuggguggggucag

SEQ ID NO: 205292 - RNA, 64 nt, Human; identical to SEQ ID NO: 50732

SEQ ID NO: 205293 - RNA, 64 nt, Human; identical to SEQ ID NO: 50733

SEQ ID NO: 205294 - RNA, 64 nt, Human; identical to SEQ ID NO: 50734

SEQ ID NO: 205295 - RNA, 64 nt, Human; identical to SEQ ID NO: 50735

SEQ ID NO: 205296 - RNA, 64 nt, Human; identical to SEQ ID NO: 50736

SEQ ID NO: 205297 - RNA, 64 nt, Human; identical to SEQ ID NO: 50737

SEQ ID NO: 205298 - RNA, 64 nt, Human; identical to SEQ ID NO: 50738

SEQ ID NO: 205299 - RNA, 64 nt, Human; identical to SEQ ID NO: 50739

SEQ ID NO: 205300 - RNA, 64 nt, Human; identical to SEQ ID NO: 50740

SEQ ID NO: 205301 - RNA, 64 nt, Human; identical to SEQ ID NO: 50741

SEQ ID NO: 205302 - RNA, 64 nt, Human; identical to SEQ ID NO: 50742

SEQ ID NO: 205303 - RNA, 64 nt, Human; identical to SEQ ID NO: 50743

SEQ ID NO: 205304 - RNA, 64 nt, Human; identical to SEQ ID NO: 50744

SEQ ID NO: 205305 - RNA, 64 nt, Human; identical to SEQ ID NO: 50745

SEQ ID NO: 205306 - RNA, 64 nt, Human; identical to SEQ ID NO: 50746

SEQ ID NO: 205307 - RNA, 64 nt, Human; identical to SEQ ID NO: 50747

SEQ ID NO: 205308 - RNA, 64 nt, Human; identical to SEQ ID NO: 50748

SEQ ID NO: 205309 - RNA, 64 nt, Human
gauagggucuugcucuaucaccuaggcuggagugcagcggcaugacugcagccuugaacuccug

SEQ ID NO: 205310 - RNA, 64 nt, Human
uacucccuguugcaugucaaauccacacagaugucagcggcagcugcucggcagcccagcccug

SEQ ID NO: 205311 - RNA, 64 nt, Human
aggcaacgucgcguggucucagacguggagcagccagcggcagcucagagcagggcacuguguc

SEQ ID NO: 205312 - RNA, 64 nt, Human; identical to SEQ ID NO: 50749

SEQ ID NO: 205313 - RNA, 64 nt, Human; identical to SEQ ID NO: 50750

SEQ ID NO: 205314 - RNA, 64 nt, Human; identical to SEQ ID NO: 50751

SEQ ID NO: 205315 - RNA, 64 nt, Human; identical to SEQ ID NO: 50752

SEQ ID NO: 205316 - RNA, 64 nt, Human; identical to SEQ ID NO: 50753

SEQ ID NO: 205317 - RNA, 64 nt, Human; identical to SEQ ID NO: 50754

SEQ ID NO: 205318 - RNA, 64 nt, Human; identical to SEQ ID NO: 50755

SEQ ID NO: 205319 - RNA, 64 nt, Human; identical to SEQ ID NO: 50756

SEQ ID NO: 205320 - RNA, 64 nt, Human; identical to SEQ ID NO: 50757

SEQ ID NO: 205321 - RNA, 64 nt, Human; identical to SEQ ID NO: 50758

SEQ ID NO: 205322 - RNA, 64 nt, Human; identical to SEQ ID NO: 50759

SEQ ID NO: 205323 - RNA, 64 nt, Human; identical to SEQ ID NO: 50760

SEQ ID NO: 205324 - RNA, 64 nt, Human; identical to SEQ ID NO: 50761

SEQ ID NO: 205325 - RNA, 64 nt, Human; identical to SEQ ID NO: 50762

SEQ ID NO: 205326 - RNA, 64 nt, Human; identical to SEQ ID NO: 50763

SEQ ID NO: 205327 - RNA, 64 nt, Human; identical to SEQ ID NO: 50764

SEQ ID NO: 205328 - RNA, 64 nt, Human; identical to SEQ ID NO: 50765

SEQ ID NO: 205329 - RNA, 64 nt, Human
gaugugacgggguguguggcccgaggaagcuggacagcggcagugggccugcugaggccuucuc

SEQ ID NO: 205330 - RNA, 64 nt, Human
aaaugcuuccaaagccaccuuagccuguucuauucagcggcaaccccaaagcaccuguuaagac

SEQ ID NO: 205331 - RNA, 64 nt, Human
ccugugccauucucaauaagaauuuaugagaugccagcggcauagcccuucacacucucugucu

SEQ ID NO: 205332 - RNA, 64 nt, Human; identical to SEQ ID NO: 50766

SEQ ID NO: 205333 - RNA, 64 nt, Human; identical to SEQ ID NO: 50767

SEQ ID NO: 205334 - RNA, 64 nt, Human; identical to SEQ ID NO: 50768

SEQ ID NO: 205335 - RNA, 64 nt, Human; identical to SEQ ID NO: 50769

SEQ ID NO: 205336 - RNA, 64 nt, Human; identical to SEQ ID NO: 50770

SEQ ID NO: 205337 - RNA, 64 nt, Human; identical to SEQ ID NO: 50771

SEQ ID NO: 205338 - RNA, 64 nt, Human; identical to SEQ ID NO: 50772

SEQ ID NO: 205339 - RNA, 64 nt, Human; identical to SEQ ID NO: 50773

SEQ ID NO: 205340 - RNA, 64 nt, Human; identical to SEQ ID NO: 50774

SEQ ID NO: 205341 - RNA, 64 nt, Human; identical to SEQ ID NO: 50775

SEQ ID NO: 205342 - RNA, 64 nt, Human; identical to SEQ ID NO: 50776

SEQ ID NO: 205343 - RNA, 64 nt, Human; identical to SEQ ID NO: 50777

SEQ ID NO: 205344 - RNA, 64 nt, Human; identical to SEQ ID NO: 50778

SEQ ID NO: 205345 - RNA, 64 nt, Human; identical to SEQ ID NO: 50779

SEQ ID NO: 205346 - RNA, 64 nt, Human; identical to SEQ ID NO: 50780

SEQ ID NO: 205347 - RNA, 64 nt, Human; identical to SEQ ID NO: 50781

SEQ ID NO: 205348 - RNA, 64 nt, Human; identical to SEQ ID NO: 50782

SEQ ID NO: 205349 - RNA, 64 nt, Human
uuccuguuggcccuggccuggccggggaagguggcagcggcaccggacugaccugcagugaccc

SEQ ID NO: 205350 - RNA, 64 nt, Human
uuucauccagagucugcaguccaggucaccaagccagcggcacccgucggcaacccuguguuuu

SEQ ID NO: 205351 - RNA, 64 nt, Human
agccuuguccaggucucccuguuagcaccugacucagcggcagcuucugccgcuggguuuucau

SEQ ID NO: 205352 - RNA, 64 nt, Human; identical to SEQ ID NO: 50783

SEQ ID NO: 205353 - RNA, 64 nt, Human; identical to SEQ ID NO: 50784

SEQ ID NO: 205354 - RNA, 64 nt, Human; identical to SEQ ID NO: 50785

SEQ ID NO: 205355 - RNA, 64 nt, Human; identical to SEQ ID NO: 50786

SEQ ID NO: 205356 - RNA, 64 nt, Human; identical to SEQ ID NO: 50787

SEQ ID NO: 205357 - RNA, 64 nt, Human; identical to SEQ ID NO: 50788

SEQ ID NO: 205358 - RNA, 64 nt, Human; identical to SEQ ID NO: 50789

SEQ ID NO: 205359 - RNA, 64 nt, Human; identical to SEQ ID NO: 50790

SEQ ID NO: 205360 - RNA, 64 nt, Human; identical to SEQ ID NO: 50791

SEQ ID NO: 205361 - RNA, 64 nt, Human; identical to SEQ ID NO: 50792

SEQ ID NO: 205362 - RNA, 64 nt, Human; identical to SEQ ID NO: 50793

SEQ ID NO: 205363 - RNA, 64 nt, Human; identical to SEQ ID NO: 50794

SEQ ID NO: 205364 - RNA, 64 nt, Human; identical to SEQ ID NO: 50795

SEQ ID NO: 205365 - RNA, 64 nt, Human; identical to SEQ ID NO: 50796

SEQ ID NO: 205366 - RNA, 64 nt, Human; identical to SEQ ID NO: 50797

SEQ ID NO: 205367 - RNA, 64 nt, Human; identical to SEQ ID NO: 50798

SEQ ID NO: 205368 - RNA, 64 nt, Human; identical to SEQ ID NO: 50799

SEQ ID NO: 205369 - RNA, 61 nt, Human
gauaaaaccagagcaggaaagaugaugcaagcgacaggaaaggcccucugcuuuucuuccc

SEQ ID NO: 205370 - RNA, 61 nt, Human
gaacucuccuguggccugcucaucacccuuccgacaggagcacugcaugucagagcacuuu

SEQ ID NO: 205371 - RNA, 61 nt, Human
uguccacguggagagaaguugcccuccaggccgacaggaggccaugcccaccgccccugga

SEQ ID NO: 205372 - RNA, 64 nt, Human; identical to SEQ ID NO: 50800

SEQ ID NO: 205373 - RNA, 64 nt, Human; identical to SEQ ID NO: 50801

SEQ ID NO: 205374 - RNA, 64 nt, Human; identical to SEQ ID NO: 50802

SEQ ID NO: 205375 - RNA, 64 nt, Human; identical to SEQ ID NO: 50803

SEQ ID NO: 205376 - RNA, 64 nt, Human; identical to SEQ ID NO: 50804

SEQ ID NO: 205377 - RNA, 64 nt, Human; identical to SEQ ID NO: 50805

SEQ ID NO: 205378 - RNA, 64 nt, Human; identical to SEQ ID NO: 50806

SEQ ID NO: 205379 - RNA, 64 nt, Human; identical to SEQ ID NO: 50807

SEQ ID NO: 205380 - RNA, 64 nt, Human; identical to SEQ ID NO: 50808

SEQ ID NO: 205381 - RNA, 64 nt, Human; identical to SEQ ID NO: 50809

SEQ ID NO: 205382 - RNA, 64 nt, Human; identical to SEQ ID NO: 50810

SEQ ID NO: 205383 - RNA, 64 nt, Human; identical to SEQ ID NO: 50811

SEQ ID NO: 205384 - RNA, 64 nt, Human; identical to SEQ ID NO: 50812

SEQ ID NO: 205385 - RNA, 64 nt, Human; identical to SEQ ID NO: 50813

SEQ ID NO: 205386 - RNA, 64 nt, Human; identical to SEQ ID NO: 50814

SEQ ID NO: 205387 - RNA, 64 nt, Human; identical to SEQ ID NO: 50815

SEQ ID NO: 205388 - RNA, 58 nt, Human; identical to SEQ ID NO: 50816

SEQ ID NO: 205389 - RNA, 64 nt, Human
cccuguuuucuggcacauucuacccugagauauucagcggcauaugcacugaugaugcuccggc

SEQ ID NO: 205390 - RNA, 64 nt, Human
ugggacucucugcgauguacauaacuauuuaaugcagcggcagcggcgacagccuucccugaga

SEQ ID NO: 205391 - RNA, 64 nt, Human
ggauguaagccugaccauaggaucuugacuccaacagcggcaacccccacccccauuguggucc

SEQ ID NO: 205392 - RNA, 64 nt, Human; identical to SEQ ID NO: 50817

SEQ ID NO: 205393 - RNA, 64 nt, Human; identical to SEQ ID NO: 50818

SEQ ID NO: 205394 - RNA, 64 nt, Human; identical to SEQ ID NO: 50819

SEQ ID NO: 205395 - RNA, 64 nt, Human; identical to SEQ ID NO: 50820

SEQ ID NO: 205396 - RNA, 64 nt, Human; identical to SEQ ID NO: 50821

SEQ ID NO: 205397 - RNA, 64 nt, Human; identical to SEQ ID NO: 50822

SEQ ID NO: 205398 - RNA, 64 nt, Human; identical to SEQ ID NO: 50823

SEQ ID NO: 205399 - RNA, 64 nt, Human; identical to SEQ ID NO: 50824

SEQ ID NO: 205400 - RNA, 64 nt, Human; identical to SEQ ID NO: 50825

SEQ ID NO: 205401 - RNA, 64 nt, Human; identical to SEQ ID NO: 50826

SEQ ID NO: 205402 - RNA, 64 nt, Human; identical to SEQ ID NO: 50827

SEQ ID NO: 205403 - RNA, 64 nt, Human; identical to SEQ ID NO: 50828

SEQ ID NO: 205404 - RNA, 64 nt, Human; identical to SEQ ID NO: 50829

SEQ ID NO: 205405 - RNA, 64 nt, Human; identical to SEQ ID NO: 50830

SEQ ID NO: 205406 - RNA, 64 nt, Human; identical to SEQ ID NO: 50831

SEQ ID NO: 205407 - RNA, 64 nt, Human; identical to SEQ ID NO: 50832

SEQ ID NO: 205408 - RNA, 64 nt, Human; identical to SEQ ID NO: 50833

SEQ ID NO: 205409 - RNA, 61 nt, Human
uuguuguuuacuuuaguucuggaacugaaaccgacaggaagaaacuuuggaauaaggaaga

SEQ ID NO: 205410 - RNA, 61 nt, Human
uaauguugcccacauuaagcacuguggaucacgacaggaaaaagguuggagcagugcuuuu

SEQ ID NO: 205411 - RNA, 61 nt, Human
cuaggauggaauugcaauuugcaagcuucuucgacaggaaacuacaaguuccacacuuuaa

SEQ ID NO: 205412 - RNA, 64 nt, Human; identical to SEQ ID NO: 50834

SEQ ID NO: 205413 - RNA, 64 nt, Human; identical to SEQ ID NO: 50835

SEQ ID NO: 205414 - RNA, 64 nt, Human; identical to SEQ ID NO: 50836

SEQ ID NO: 205415 - RNA, 64 nt, Human; identical to SEQ ID NO: 50837

SEQ ID NO: 205416 - RNA, 64 nt, Human; identical to SEQ ID NO: 50838

SEQ ID NO: 205417 - RNA, 64 nt, Human; identical to SEQ ID NO: 50839

SEQ ID NO: 205418 - RNA, 64 nt, Human; identical to SEQ ID NO: 50840

SEQ ID NO: 205419 - RNA, 64 nt, Human; identical to SEQ ID NO: 50841

SEQ ID NO: 205420 - RNA, 64 nt, Human; identical to SEQ ID NO: 50842

SEQ ID NO: 205421 - RNA, 64 nt, Human; identical to SEQ ID NO: 50843

SEQ ID NO: 205422 - RNA, 64 nt, Human; identical to SEQ ID NO: 50844

SEQ ID NO: 205423 - RNA, 64 nt, Human; identical to SEQ ID NO: 50845

SEQ ID NO: 205424 - RNA, 64 nt, Human; identical to SEQ ID NO: 50846

SEQ ID NO: 205425 - RNA, 64 nt, Human; identical to SEQ ID NO: 50847

SEQ ID NO: 205426 - RNA, 64 nt, Human; identical to SEQ ID NO: 50848

SEQ ID NO: 205427 - RNA, 64 nt, Human; identical to SEQ ID NO: 50849

SEQ ID NO: 205428 - RNA, 61 nt, Human
uaguugggcgccccccacccucccccggacucgacaggagccuggaccuccggcuucauuu

SEQ ID NO: 205429 - RNA, 61 nt, Human
cugcuggacacgucggacagcgaaguauccccgacaggacgggcuugggcuuccauuugug

SEQ ID NO: 205430 - RNA, 61 nt, Human
agcaccagagcacaaugagaaacggcagcgccgacaggagcggcggcagaugaagcgguua

SEQ ID NO: 205431 - RNA, 61 nt, Human
gcagcucccugaccauuuggacacauugccacgacaggagccuccaaguaugugggagggg

SEQ ID NO: 205432 - RNA, 64 nt, Human; identical to SEQ ID NO: 50850

SEQ ID NO: 205433 - RNA, 64 nt, Human; identical to SEQ ID NO: 50851

SEQ ID NO: 205434 - RNA, 64 nt, Human; identical to SEQ ID NO: 50852

SEQ ID NO: 205435 - RNA, 64 nt, Human; identical to SEQ ID NO: 50853

SEQ ID NO: 205436 - RNA, 64 nt, Human; identical to SEQ ID NO: 50854

SEQ ID NO: 205437 - RNA, 64 nt, Human; identical to SEQ ID NO: 50855

SEQ ID NO: 205438 - RNA, 57 nt, Human; identical to SEQ ID NO: 50856

SEQ ID NO: 205439 - RNA, 64 nt, Human; identical to SEQ ID NO: 50857

SEQ ID NO: 205440 - RNA, 64 nt, Human; identical to SEQ ID NO: 50858

SEQ ID NO: 205441 - RNA, 64 nt, Human; identical to SEQ ID NO: 50859

SEQ ID NO: 205442 - RNA, 64 nt, Human; identical to SEQ ID NO: 50860

SEQ ID NO: 205443 - RNA, 64 nt, Human; identical to SEQ ID NO: 50861

SEQ ID NO: 205444 - RNA, 64 nt, Human; identical to SEQ ID NO: 50862

SEQ ID NO: 205445 - RNA, 64 nt, Human; identical to SEQ ID NO: 50863

SEQ ID NO: 205446 - RNA, 64 nt, Human; identical to SEQ ID NO: 50864

SEQ ID NO: 205447 - RNA, 64 nt, Human; identical to SEQ ID NO: 50865

SEQ ID NO: 205448 - RNA, 64 nt, Human; identical to SEQ ID NO: 50866

SEQ ID NO: 205449 - RNA, 51 nt, Human; identical to SEQ ID NO: 39609

SEQ ID NO: 205450 - RNA, 64 nt, Human
cugcugaauuguuuauaauggcaagaaauaggaaaccccccaaugucuguugaacagcuaucac

SEQ ID NO: 205451 - RNA, 64 nt, Human
caacgacaaagccaaacucugccagccacauccaaccccccaccugccauuugcacccuccgcc

SEQ ID NO: 205452 - RNA, 64 nt, Human; identical to SEQ ID NO: 50867

SEQ ID NO: 205453 - RNA, 64 nt, Human; identical to SEQ ID NO: 50868

SEQ ID NO: 205454 - RNA, 64 nt, Human; identical to SEQ ID NO: 50869

SEQ ID NO: 205455 - RNA, 64 nt, Human; identical to SEQ ID NO: 50870

SEQ ID NO: 205456 - RNA, 64 nt, Human; identical to SEQ ID NO: 50871

SEQ ID NO: 205457 - RNA, 64 nt, Human; identical to SEQ ID NO: 50872

SEQ ID NO: 205458 - RNA, 64 nt, Human; identical to SEQ ID NO: 50873

SEQ ID NO: 205459 - RNA, 64 nt, Human; identical to SEQ ID NO: 50874

SEQ ID NO: 205460 - RNA, 64 nt, Human; identical to SEQ ID NO: 50875

SEQ ID NO: 205461 - RNA, 64 nt, Human; identical to SEQ ID NO: 50876

SEQ ID NO: 205462 - RNA, 64 nt, Human; identical to SEQ ID NO: 50877

SEQ ID NO: 205463 - RNA, 64 nt, Human; identical to SEQ ID NO: 50878

SEQ ID NO: 205464 - RNA, 64 nt, Human; identical to SEQ ID NO: 50879

SEQ ID NO: 205465 - RNA, 64 nt, Human; identical to SEQ ID NO: 50880

SEQ ID NO: 205466 - RNA, 64 nt, Human; identical to SEQ ID NO: 50881

SEQ ID NO: 205467 - RNA, 64 nt, Human; identical to SEQ ID NO: 50882

SEQ ID NO: 205468 - RNA, 64 nt, Human; identical to SEQ ID NO: 50883

SEQ ID NO: 205469 - RNA, 61 nt, Human
gcuccugggcugaacauggaccacgcaguugcgacaggaggccaggggaaaaaccccugcu

SEQ ID NO: 205470 - RNA, 61 nt, Human
agaaguugcugccaccaacucuuuaagaaggcgacaggaucaguccuucucucggguucug

SEQ ID NO: 205471 - RNA, 61 nt, Human
gccaccuccaagccgcgggugcccccuagggcgacaggagccagcgggacgccgcacgcgg

SEQ ID NO: 205472 - RNA, 64 nt, Human; identical to SEQ ID NO: 50884

SEQ ID NO: 205473 - RNA, 64 nt, Human; identical to SEQ ID NO: 50885

SEQ ID NO: 205474 - RNA, 64 nt, Human; identical to SEQ ID NO: 50886

SEQ ID NO: 205475 - RNA, 64 nt, Human; identical to SEQ ID NO: 50887

SEQ ID NO: 205476 - RNA, 64 nt, Human; identical to SEQ ID NO: 50888

SEQ ID NO: 205477 - RNA, 64 nt, Human; identical to SEQ ID NO: 50889

SEQ ID NO: 205478 - RNA, 64 nt, Human; identical to SEQ ID NO: 50890

SEQ ID NO: 205479 - RNA, 64 nt, Human; identical to SEQ ID NO: 50891

SEQ ID NO: 205480 - RNA, 64 nt, Human; identical to SEQ ID NO: 50892

SEQ ID NO: 205481 - RNA, 64 nt, Human; identical to SEQ ID NO: 50893

SEQ ID NO: 205482 - RNA, 64 nt, Human; identical to SEQ ID NO: 50894

SEQ ID NO: 205483 - RNA, 64 nt, Human; identical to SEQ ID NO: 50895

SEQ ID NO: 205484 - RNA, 64 nt, Human; identical to SEQ ID NO: 50896

SEQ ID NO: 205485 - RNA, 64 nt, Human; identical to SEQ ID NO: 50897

SEQ ID NO: 205486 - RNA, 64 nt, Human; identical to SEQ ID NO: 50898

SEQ ID NO: 205487 - RNA, 64 nt, Human; identical to SEQ ID NO: 50899

SEQ ID NO: 205488 - RNA, 64 nt, Human; identical to SEQ ID NO: 50900

SEQ ID NO: 205489 - RNA, 61 nt, Human
cccauggcuacauccugugggugggggcccucgacaggacagcaggacgguuuguuuucag

SEQ ID NO: 205490 - RNA, 61 nt, Human
aacacacgcugugagccaccaagaccuggggcgacaggagaaccgguccucucucugacgg

SEQ ID NO: 205491 - RNA, 61 nt, Human
uacaggugguugucugggguggguggaguggcgacaggauagagcugaaggacuaugcaaa

SEQ ID NO: 205492 - RNA, 64 nt, Human; identical to SEQ ID NO: 50901

SEQ ID NO: 205493 - RNA, 64 nt, Human; identical to SEQ ID NO: 50902

SEQ ID NO: 205494 - RNA, 64 nt, Human; identical to SEQ ID NO: 50903

SEQ ID NO: 205495 - RNA, 64 nt, Human; identical to SEQ ID NO: 50904

SEQ ID NO: 205496 - RNA, 64 nt, Human; identical to SEQ ID NO: 50905

SEQ ID NO: 205497 - RNA, 64 nt, Human; identical to SEQ ID NO: 50906

SEQ ID NO: 205498 - RNA, 64 nt, Human; identical to SEQ ID NO: 50907

SEQ ID NO: 205499 - RNA, 53 nt, Human; identical to SEQ ID NO: 50908

SEQ ID NO: 205500 - RNA, 64 nt, Human; identical to SEQ ID NO: 50909

SEQ ID NO: 205501 - RNA, 64 nt, Human; identical to SEQ ID NO: 50910

SEQ ID NO: 205502 - RNA, 64 nt, Human; identical to SEQ ID NO: 50911

SEQ ID NO: 205503 - RNA, 64 nt, Human; identical to SEQ ID NO: 50912

SEQ ID NO: 205504 - RNA, 64 nt, Human; identical to SEQ ID NO: 50913

SEQ ID NO: 205505 - RNA, 64 nt, Human; identical to SEQ ID NO: 50914

SEQ ID NO: 205506 - RNA, 64 nt, Human; identical to SEQ ID NO: 50915

SEQ ID NO: 205507 - RNA, 64 nt, Human; identical to SEQ ID NO: 50916

SEQ ID NO: 205508 - RNA, 64 nt, Human; identical to SEQ ID NO: 50917

SEQ ID NO: 205509 - RNA, 61 nt, Human
cugacccugugaucucugcccugucuucgggcgacaggagccagaaaaucagggacauggc

SEQ ID NO: 205510 - RNA, 61 nt, Human
ugaggugucucaaucugaucugagugagaggcgacaggaguauuuuuuuuuuuuuacagcu

SEQ ID NO: 205511 - RNA, 61 nt, Human
ggaagaacuaggggcuccauuguucuucaggcgacaggagaccguugcuccagugcauguc

SEQ ID NO: 205512 - RNA, 64 nt, Human; identical to SEQ ID NO: 50918

SEQ ID NO: 205513 - RNA, 64 nt, Human; identical to SEQ ID NO: 50919

SEQ ID NO: 205514 - RNA, 64 nt, Human; identical to SEQ ID NO: 50920

SEQ ID NO: 205515 - RNA, 64 nt, Human; identical to SEQ ID NO: 50921

SEQ ID NO: 205516 - RNA, 64 nt, Human; identical to SEQ ID NO: 50922

SEQ ID NO: 205517 - RNA, 64 nt, Human; identical to SEQ ID NO: 50923

SEQ ID NO: 205518 - RNA, 64 nt, Human; identical to SEQ ID NO: 50924

SEQ ID NO: 205519 - RNA, 64 nt, Human; identical to SEQ ID NO: 50925

SEQ ID NO: 205520 - RNA, 64 nt, Human; identical to SEQ ID NO: 50926

SEQ ID NO: 205521 - RNA, 64 nt, Human; identical to SEQ ID NO: 50927

SEQ ID NO: 205522 - RNA, 64 nt, Human; identical to SEQ ID NO: 50928

SEQ ID NO: 205523 - RNA, 64 nt, Human; identical to SEQ ID NO: 50929

SEQ ID NO: 205524 - RNA, 54 nt, Human; identical to SEQ ID NO: 50930

SEQ ID NO: 205525 - RNA, 64 nt, Human; identical to SEQ ID NO: 50931

SEQ ID NO: 205526 - RNA, 64 nt, Human; identical to SEQ ID NO: 50932

SEQ ID NO: 205527 - RNA, 64 nt, Human; identical to SEQ ID NO: 50933

SEQ ID NO: 205528 - RNA, 64 nt, Human; identical to SEQ ID NO: 50934

SEQ ID NO: 205529 - RNA, 64 nt, Human
uagauuguaaaguguaaggcauuagguucugagacagcggcagagagagccaugcaaauguuua

SEQ ID NO: 205530 - RNA, 64 nt, Human
gagaugccuuagacgcaggaugggccacuccucccagcggcaaguggaaaucgaagaugucaug

SEQ ID NO: 205531 - RNA, 64 nt, Human
uuggucagcugcgugggugccugucuccugucuccagcggcagggcaugguucuuggcagccug

SEQ ID NO: 205532 - RNA, 64 nt, Human; identical to SEQ ID NO: 50935

SEQ ID NO: 205533 - RNA, 64 nt, Human; identical to SEQ ID NO: 50936

SEQ ID NO: 205534 - RNA, 64 nt, Human; identical to SEQ ID NO: 50937

SEQ ID NO: 205535 - RNA, 64 nt, Human; identical to SEQ ID NO: 50938

SEQ ID NO: 205536 - RNA, 64 nt, Human; identical to SEQ ID NO: 50939

SEQ ID NO: 205537 - RNA, 64 nt, Human; identical to SEQ ID NO: 50940

SEQ ID NO: 205538 - RNA, 64 nt, Human; identical to SEQ ID NO: 50941

SEQ ID NO: 205539 - RNA, 64 nt, Human; identical to SEQ ID NO: 50942

SEQ ID NO: 205540 - RNA, 64 nt, Human; identical to SEQ ID NO: 50943

SEQ ID NO: 205541 - RNA, 64 nt, Human; identical to SEQ ID NO: 50944

SEQ ID NO: 205542 - RNA, 64 nt, Human; identical to SEQ ID NO: 50945

SEQ ID NO: 205543 - RNA, 64 nt, Human; identical to SEQ ID NO: 50946

SEQ ID NO: 205544 - RNA, 64 nt, Human; identical to SEQ ID NO: 50947

SEQ ID NO: 205545 - RNA, 64 nt, Human; identical to SEQ ID NO: 50948

SEQ ID NO: 205546 - RNA, 64 nt, Human; identical to SEQ ID NO: 50949

SEQ ID NO: 205547 - RNA, 64 nt, Human; identical to SEQ ID NO: 50950

SEQ ID NO: 205548 - RNA, 64 nt, Human; identical to SEQ ID NO: 50951

SEQ ID NO: 205549 - RNA, 64 nt, Human; identical to SEQ ID NO: 50952

SEQ ID NO: 205550 - RNA, 64 nt, Human
cugcagugcugagaggcagcgaggacggagaggacagcggcaucucuaggcucuucugagaggg

SEQ ID NO: 205551 - RNA, 64 nt, Human
aggggcagauuuucugcagcaagcacugucaagacagcggcaggccugggauggagcccaucuc

SEQ ID NO: 205552 - RNA, 64 nt, Human; identical to SEQ ID NO: 50953

SEQ ID NO: 205553 - RNA, 64 nt, Human; identical to SEQ ID NO: 50954

SEQ ID NO: 205554 - RNA, 64 nt, Human; identical to SEQ ID NO: 50955

SEQ ID NO: 205555 - RNA, 64 nt, Human; identical to SEQ ID NO: 50956

SEQ ID NO: 205556 - RNA, 64 nt, Human; identical to SEQ ID NO: 50957

SEQ ID NO: 205557 - RNA, 64 nt, Human; identical to SEQ ID NO: 50958

SEQ ID NO: 205558 - RNA, 64 nt, Human; identical to SEQ ID NO: 50959

SEQ ID NO: 205559 - RNA, 64 nt, Human; identical to SEQ ID NO: 50960

SEQ ID NO: 205560 - RNA, 64 nt, Human; identical to SEQ ID NO: 50961

SEQ ID NO: 205561 - RNA, 64 nt, Human; identical to SEQ ID NO: 50962

SEQ ID NO: 205562 - RNA, 64 nt, Human; identical to SEQ ID NO: 50963

SEQ ID NO: 205563 - RNA, 64 nt, Human; identical to SEQ ID NO: 50964

SEQ ID NO: 205564 - RNA, 64 nt, Human; identical to SEQ ID NO: 50965

SEQ ID NO: 205565 - RNA, 64 nt, Human; identical to SEQ ID NO: 50966

SEQ ID NO: 205566 - RNA, 64 nt, Human; identical to SEQ ID NO: 50967

SEQ ID NO: 205567 - RNA, 64 nt, Human; identical to SEQ ID NO: 50968

SEQ ID NO: 205568 - RNA, 64 nt, Human; identical to SEQ ID NO: 50969

SEQ ID NO: 205569 - RNA, 61 nt, Human
acacucuagaacuggagagagguccagauugcgacaggagccacaccagagugugcaggcu

SEQ ID NO: 205570 - RNA, 64 nt, Human
cugucuugggaccaggcuucugcuccuccucagccagcggcagaagcagggcugaugcucaggg

SEQ ID NO: 205571 - RNA, 64 nt, Human
ggccccagaaccccaaagcagacagcgagacccccagcggcagaggccucccucggcacuccag

SEQ ID NO: 205572 - RNA, 64 nt, Human; identical to SEQ ID NO: 50970

SEQ ID NO: 205573 - RNA, 64 nt, Human; identical to SEQ ID NO: 50971

SEQ ID NO: 205574 - RNA, 64 nt, Human; identical to SEQ ID NO: 50972

SEQ ID NO: 205575 - RNA, 64 nt, Human; identical to SEQ ID NO: 50973

SEQ ID NO: 205576 - RNA, 64 nt, Human; identical to SEQ ID NO: 50974

SEQ ID NO: 205577 - RNA, 64 nt, Human; identical to SEQ ID NO: 50975

SEQ ID NO: 205578 - RNA, 64 nt, Human; identical to SEQ ID NO: 50976

SEQ ID NO: 205579 - RNA, 64 nt, Human; identical to SEQ ID NO: 50977

SEQ ID NO: 205580 - RNA, 61 nt, Human
ggcgccuggcggucaccuggugccuacuguccgacaggaugccuugauccucgugcgaccc

SEQ ID NO: 205581 - RNA, 61 nt, Human
cggguuacauccacacugcugaucacaccaacgacaggagcugauaagcaagaaagcguca

SEQ ID NO: 205582 - RNA, 61 nt, Human
gaugcccacagggccugggcaguugcuguggcgacaggaagagcuaaucuucagagagcuc

SEQ ID NO: 205583 - RNA, 64 nt, Human
ggguagcugggcggggcucgaggcuggugccaggcgcguguaaaugguuuuguuuugcacguuu

SEQ ID NO: 205584 - RNA, 64 nt, Human
ugcuuaauagguuauacaaaaaugccacaguggccgcguguauauuguuuucuuuuggugacgg

SEQ ID NO: 205585 - RNA, 64 nt, Human
cguccacgugucugcgaccuguguggagugucaccgcguguacauacuguaaauuauuuauuaa

SEQ ID NO: 205586 - RNA, 64 nt, Human
ccaagacuggccacccgcugcgugugugugcgcgcgcguguacguguggccccacauccgccgc

SEQ ID NO: 205587 - RNA, 64 nt, Human
uuuguuuauucuuuagugugugugugugugugcacgcguguauguguucaguguuguuugcaca

SEQ ID NO: 205588 - RNA, 64 nt, Human
gcggccgagccuauacauaguguacaggagacaucgcguguauuuuuaacguccccauauuuau

SEQ ID NO: 205589 - RNA, 64 nt, Human
cgugucuccaggggguuccuuucuucucacacgucgcguguacccauagcacucuuguguuucu

SEQ ID NO: 205590 - RNA, 64 nt, Human
uccgaccgcgucgcugccgcucugcucucucauacgcguguauguuugguuccaugucacagcc

SEQ ID NO: 205591 - RNA, 64 nt, Human
cucccaacuucgccagccuccaauguacaacuuccgcguguagugggcguugucaccacccacc

SEQ ID NO: 205592 - RNA, 64 nt, Human
caccuggcugcacaggugugcacgcauuacccuucgcguguacguucccaugugccccgugaaa

SEQ ID NO: 205593 - RNA, 64 nt, Human
gagcuauuuaaucuauguuacauuaaaaaagaaacgcguguacauuuuaaaagcaaugauguaa

SEQ ID NO: 205594 - RNA, 64 nt, Human
uuguuugguuugguauuaauuugacugugcaugacagcggcaaucuuuucuuuggucaaaguuu

SEQ ID NO: 205595 - RNA, 64 nt, Human
gagccgcucugagcaccgggggaugugacugccucagcggcagagcuggaagggcccucgaaug

SEQ ID NO: 205596 - RNA, 64 nt, Human
auuuugaauacacaucucugucagugugaaaauucagcggcaguguguccaucauauuaaaaau

SEQ ID NO: 205597 - RNA, 64 nt, Human
cccaggcagccaccaagcccaccccaggucaugccagcggcagaggacgugaggggcuggcagc

SEQ ID NO: 205598 - RNA, 64 nt, Human
cuucggcaaggcacggacgacugugcagacacagcagcggcaagaagcgagaacugcccucccc

SEQ ID NO: 205599 - RNA, 64 nt, Human
cagcugccagcuccccuaccaucaugcggaaaagcagcggcagccccgacucucagcacuggua

SEQ ID NO: 205600 - RNA, 64 nt, Human
aaccagcugucugcugaugaacggcccaucugcacagcggcagcaaggauuaccccaagggcag

SEQ ID NO: 205601 - RNA, 64 nt, Human
augccucauggcucuuagcugugguuucuuggaccagcggcauggacauuugucaguuugccuu

SEQ ID NO: 205602 - RNA, 64 nt, Human
ucuaaacaguguugugcagucgcaguggcggcagcagcggcagccguccgucacuccagagucu

SEQ ID NO: 205603 - RNA, 64 nt, Human
aagugugcugcauggagugagcaguagaagccugcagcggcacaaaugcaccucccaguuugcu

SEQ ID NO: 205604 - RNA, 64 nt, Human
accuagcccugggcgagcgccgcacccgggcccgcagcggcaccgcgcccagagcggccucucc

SEQ ID NO: 205605 - RNA, 64 nt, Human
caccugugagcgcaggagcgagccuaaggccacccagcggcagcgcccguguccugggcacuca

SEQ ID NO: 205606 - RNA, 64 nt, Human
guauauauauauguguauaaauauauguauaucccagcggcacuuuauacuguucacuguacaa

SEQ ID NO: 205607 - RNA, 64 nt, Human
uggggaagaggcgaaagcgugggggaggugagcgcagcggcaguucugccucggagcugauugc

SEQ ID NO: 205608 - RNA, 64 nt, Human
ggggcagguggagagggcgggcaggggagagacccagcggcacugaucgccuugugaccggaag

SEQ ID NO: 205609 - RNA, 64 nt, Human
accgcgcuuccuuuagcagugcugaguaagcaggcagcggcacucugagaucccggggcugggc

SEQ ID NO: 205610 - RNA, 64 nt, Human
cucaaagccaucccccuagccaucgugagcaucccagcggcaccgccauugucucaaccagccg

SEQ ID NO: 205611 - RNA, 64 nt, Human
uuuccugaggcaccuguuuggaaucugguuuucucagcggcagcuugacaugugcacccuuuug

SEQ ID NO: 205612 - RNA, 64 nt, Human
cuuuuggauaucugcuaggggguuagaguggucucagcggcagguggaggagagcaggaugcug

SEQ ID NO: 205613 - RNA, 64 nt, Human
caugacuguucuuuccguguaagcuaucccaccucagcggcacccucacugcuggugaccagcc

SEQ ID NO: 205614 - RNA, 64 nt, Human
acuuacgugaccugugcugucacugggcauaggacagcggcaucacgguugcauucccauugga

SEQ ID NO: 205615 - RNA, 64 nt, Human
agcacacgcagcuggagagggcuucugucccugucagcggcagagggcguuggggcuggccggg

SEQ ID NO: 205616 - RNA, 64 nt, Human
uuggcucucaaugcugaggcuugcagaggcaucccagcggcaccagccucccacugcacagcuu

SEQ ID NO: 205617 - RNA, 64 nt, Human
ccagugaguccauguggagagagcacugugugcgcagcggcagcagcacagacguccaugagga

SEQ ID NO: 205618 - RNA, 64 nt, Human
agcccaucuuacugcaagcagcguccugaggagacagcggcacguucuagcugcgucugcggcc

SEQ ID NO: 205619 - RNA, 64 nt, Human
gcuggcccagggcggccucuacgccaagcuggugcagcggcagaugcuggggcuucagcccgcc

SEQ ID NO: 205620 - RNA, 64 nt, Human
acgggggccaccuugucaucucaggccagaugaccagcggcaaccucaucgccuucaucaucua

SEQ ID NO: 205621 - RNA, 64 nt, Human
accccaccgucacccagugacccaccggguucugcagcggcagagcaauuccaggcugagccau

SEQ ID NO: 205622 - RNA, 64 nt, Human
auggcaauuugcucaauauucaguauuuucuuuucagcggcaacuuguuuuugauuuuuuuaaa

SEQ ID NO: 205623 - RNA, 53 nt, Human
auggcgcacgcuuauuuuagggccagcggcaggggacuccagccugcuggaca

SEQ ID NO: 205624 - RNA, 64 nt, Human
ugaacuuuauuuccuccucaccucuuuuuggcaucagcggcaaaucuuuucaugaagccccaag

SEQ ID NO: 205625 - RNA, 64 nt, Human
gugccgaugcagaaggcaaauuggaaacacgcgccagcggcaguggggcucaaagccgaccucc

SEQ ID NO: 205626 - RNA, 64 nt, Human
agccacagcagaggcaaggggugccaggaguccccagcggcauccucggggagaugcuggugag

SEQ ID NO: 205627 - RNA, 64 nt, Human
augcuccacuccauuggcacuaacgccccaacuccagcggcacuaaugacccgcuccuuugaca

SEQ ID NO: 205628 - RNA, 64 nt, Human
agcucaucccagugacucacaggacacagccauccagcggcaucuuuccuugucgaaugauacu

SEQ ID NO: 205629 - RNA, 64 nt, Human
ccaggccagagcuuguguccuucaacagagaggccagcggcaacugguccguuacuggccaagg

SEQ ID NO: 205630 - RNA, 64 nt, Human
gaccucccuaccgggcuaucggccucuugggagccagcggcagggccggcaccugcgugccugu

SEQ ID NO: 205631 - RNA, 64 nt, Human
aaguacugggauuacaggcgugagccaccucgcccagcggcaucaggcuuucuuaaagugagag

SEQ ID NO: 205632 - RNA, 64 nt, Human
cacccacgggggagacggagagauauaaaggucccagcggcaccaacaucaucauuggcuccau

SEQ ID NO: 205633 - RNA, 64 nt, Human
cgccucccuccagggcauuaaccugucugggggccagcggcagcgggucagucuggcucgagcu

SEQ ID NO: 205634 - RNA, 64 nt, Human
cccucagagguccccaaagauggacacacaaccccagcggcagcaggaaaaacauaugggaauu

SEQ ID NO: 205635 - RNA, 64 nt, Human
uuuaaugguuuugguugcuccucccccagcugccaccccccaccuuacccuuauuccucucugu

SEQ ID NO: 205636 - RNA, 64 nt, Human
ggaaccucaagaagauucugaaaauccuacccccaccccccaccagccgcacagauuguacuac

SEQ ID NO: 205637 - RNA, 64 nt, Human
gaccugcggcgccgcccucgagcgccccaucucuaccccccacccuggcuuggagcacacccug

SEQ ID NO: 205638 - RNA, 64 nt, Human
caagucuggguucugguguccacucacccaccccaccccccaaaaucagacaaaugcuacuuug

SEQ ID NO: 205639 - RNA, 64 nt, Human
accuugcugcuguuauuccccgaaugcgcaacauaccccccaucaauauaucucaguauuucau

SEQ ID NO: 205640 - RNA, 64 nt, Human
agccuacucucuguucuugucccugccaacccccaccccccauaaucugacucacaacuucacc

SEQ ID NO: 205641 - RNA, 64 nt, Human
agcaaggcuaaguuugccggcaggaacuucagaaaccccccagccaaguaagcugugggcaggc

SEQ ID NO: 205642 - RNA, 64 nt, Human
cccuuugagguagauugaccggcuuuagacgcccaccccccacccaccgcaagcuuugaguggg

SEQ ID NO: 205643 - RNA, 64 nt, Human
cugaugccaagcaaagacccuuccccagaggccuaccccccauauguccucagagaggcugagu

SEQ ID NO: 205644 - RNA, 64 nt, Human
uuuuuaaugaauagauuuugaauugauucuuuagaccccccaaaaagugucaguucuaaugggg

SEQ ID NO: 205645 - RNA, 64 nt, Human
gcucacugcagccuugacuucucaggcuuaggugaccccccaaccucauccucccagguggcug

SEQ ID NO: 205646 - RNA, 64 nt, Human
caaccucccaggcucaagcaguccuuucaccucaaccccccacauagcugggacuacaggugcu

SEQ ID NO: 205647 - RNA, 64 nt, Human
auccuacaucuucccuaagcacugccucucucucaccccccaaaacaaguugacgaaaggguuu

SEQ ID NO: 205648 - RNA, 64 nt, Human
ucuuuuccuuuuagccaagcuucaugguuccuggaccccccaguucuguguggcucuucucuag

SEQ ID NO: 205649 - RNA, 64 nt, Human
cagugucccucacacuaaaacggcguagauggcaaccccccacccccaccccgcugcucaacuc

SEQ ID NO: 205650 - RNA, 64 nt, Human
ugcacuggcuggcacaaaaagaaaccugcuguauaccccccaaagugucccuuucccuccuacc

SEQ ID NO: 205651 - RNA, 64 nt, Human
acuuuugguaacucucuuccuucuuuuucucccuaccccccaaccccuagcccaaccaaugcua

SEQ ID NO: 205652 - RNA, 64 nt, Human
uggcagagacugagacuaaagcaucacuuaauaaaccccccaagcccaaucccugucuccuggu

SEQ ID NO: 205653 - RNA, 64 nt, Human
uggagagggggaugcucucauccccucuuucuguaccccccaccauuuucacuggcuggggggc

SEQ ID NO: 205654 - RNA, 64 nt, Human
gauagaaucauccauucccaucgccgcacccccuaccccccaaacacacacacacacacacaca

SEQ ID NO: 205655 - RNA, 64 nt, Human
cucgucuugacuguuuucccuacuugcugacuuaaccccccauagugugggggaccugcagaga

SEQ ID NO: 205656 - RNA, 64 nt, Human
gcuuccuuuuuaucauaacgcggccucuaauuccaccccccaagugaaacgguuugagagacgc

SEQ ID NO: 205657 - RNA, 64 nt, Human
acuauccccuuccucauccauguaagguuaacccaccccccagcaagggacuggacgcccucau

SEQ ID NO: 205658 - RNA, 64 nt, Human
gauauuuuugcaacuauuuccaccuccucccacaaccccccacacuccacuccacacucuugag

SEQ ID NO: 205659 - RNA, 64 nt, Human
acugggaacucaaaagcccacgucaggaccacagaccccccaggcccagcagaagagccuccuu

SEQ ID NO: 205660 - RNA, 64 nt, Human
gccuuugccucgucuucuccaaaacugaauuuucaccccccaaaaagauguccauugccugcac

SEQ ID NO: 205661 - RNA, 64 nt, Human
gcuaaaaccagaaauuuccagacucaugaaagcaaccccccagccucuccccaacccugccgca

SEQ ID NO: 205662 - RNA, 64 nt, Human
ucugccucuuuugacguuggaagacacaugucuuaccccccaaagggagcccagcacugggagc

SEQ ID NO: 205663 - RNA, 64 nt, Human
gcacuagaauagcacuguugcaaaguauuuaagcaccccccaucucagcccuuuauuuuaucuu

SEQ ID NO: 205664 - RNA, 64 nt, Human
gauucacccucuuuggagaacaugcucucuuuucaccccccaccuccugagagccacuaaugua

SEQ ID NO: 205665 - RNA, 64 nt, Human
acucccagcagagcccaccagccagcccuggcccaccccccagccuccagagaagccccgcacg

SEQ ID NO: 205666 - RNA, 64 nt, Human
uaaccaaaagauuuucuguccagaagccuccccgaccccccaagcuauuugcucacauuaacaa

SEQ ID NO: 205667 - RNA, 64 nt, Human
aggauucagcaauuuaagcaguuuguguugcaguaccccccauucacccacaaaaugcagccca

SEQ ID NO: 205668 - RNA, 64 nt, Human
gaggucuuccugggcccucauugcugcuuaucguaccccccaucaccugcacaugggacagacc

SEQ ID NO: 205669 - RNA, 64 nt, Human
gccugaggcuguggccuccaaagggucugggcgcaccccccaggucgcaggugucugaggccag

SEQ ID NO: 205670 - RNA, 64 nt, Human
ccccucuccugccagacagcccacgaccgggucgaccccccaggggacgcccaugccaggcccg

SEQ ID NO: 205671 - RNA, 64 nt, Human
ucaguagccacacaugguuggaucauguauuuagaccccccaccuguguuccucaaucacacug

SEQ ID NO: 205672 - RNA, 64 nt, Human
cucagcagcugcuggugccugcuacuggacugccaccccccauugaagagacuggaccaccagg

SEQ ID NO: 205673 - RNA, 64 nt, Human
gcuacugaggaggggguuggacauccugccccucaccccccacccacacugcagguagaggagg

SEQ ID NO: 205674 - RNA, 64 nt, Human
uuucccccaccuccagggccaccgccgacuuuguaccccccaaccccugaggaagaugggggca

SEQ ID NO: 205675 - RNA, 64 nt, Human
caacucuaccccugcucugguaggcugaacagugaccccccaaaauggcagugucuuaaucacc

SEQ ID NO: 205676 - RNA, 64 nt, Human
agggaaaaguucuuuuuuauuccuacucaccccuaccccccaaacuacccucuuccugggaaag

SEQ ID NO: 205677 - RNA, 64 nt, Human
uacaaaacaagccaugaacaagcuucuuucccuuaccccccauccacaaugucugagcuuggau

SEQ ID NO: 205678 - RNA, 64 nt, Human
cucucucccuccaucucugaccacccccacccuaaccccccacccccaccauccuauuaaacau

SEQ ID NO: 205679 - RNA, 64 nt, Human
ucucugccaacaugaggacagaaggacuggugcgaccccccacccccgccccugggcuaccauc

SEQ ID NO: 205680 - RNA, 64 nt, Human
gaggauuuuaguauccucaggaguccuggaaccaaccccccacagauacggggacaacuuuaug

SEQ ID NO: 205681 - RNA, 64 nt, Human
uugggucacacacaggaaccgagaccuggcuuccaccccccagucacccacuuggguuaucugc

SEQ ID NO: 205682 - RNA, 64 nt, Human
ugcugaugaccacaccccguccaggccagacaccaccccccaccccacugucgugguggcccca

SEQ ID NO: 205683 - RNA, 64 nt, Human
gaauguggcugggaauugugaaucagaagauuauaccccccaauuguuuuucaauccccuuuuc

SEQ ID NO: 205684 - RNA, 64 nt, Human
agcagucccggcccccaccccuccggaaucucccaccccccacccuccucccgcugccccgggu

SEQ ID NO: 205685 - RNA, 64 nt, Human
aaggucagugacgacgcauuuccucccaguacagaccccccagccccccuugcuggacaugggg

SEQ ID NO: 205686 - RNA, 64 nt, Human
ggcugaaagauacugucgaaaucacccagucccaaccccccaauuuaaaauugauucuaguaaa

SEQ ID NO: 205687 - RNA, 64 nt, Human
uuuagauaucaauauuaacacuugacauuauuggaccccccauucuggauguauaucaagauca

SEQ ID NO: 205688 - RNA, 64 nt, Human
ugccggcugugugcccauggggagcccagcccccaccccccaccuccgacagcaaacagcaacu

SEQ ID NO: 205689 - RNA, 64 nt, Human
cggucugucauuuucccaccugccuccccuacccaccccccacccaccaccuggggcuuccucu

SEQ ID NO: 205690 - RNA, 64 nt, Human
guaacaccuagggaaacaugaggccccuuaugggaccccccaaauggaacaacuucacuuucuc

SEQ ID NO: 205691 - RNA, 64 nt, Human
uccccagaaguuucugggucuaccacacuccccaaccccccacuccuacuuccugaagggcccu

SEQ ID NO: 205692 - RNA, 64 nt, Human
cggaucgccgcccccacccagccgggcgccccggaccccccaggcgggcugcgggggaaccggc

SEQ ID NO: 205693 - RNA, 64 nt, Human
ucucacacacaccccccucccgggucacgcagacaccccccaaccacacacaucucaugcugua

SEQ ID NO: 205694 - RNA, 64 nt, Human
cacuggugggauguggagucaggagcaaccagagaccccccaauacuagaauggguuugagcuu

SEQ ID NO: 205695 - RNA, 64 nt, Human
acacacagcaacauccagaaauaaagaucucaggaccccccagcaagucguuuugugucuccuu

SEQ ID NO: 205696 - RNA, 64 nt, Human
uugaucuagaacauuaaauccgcccugcaaguuaaccccccauugcaaugguugccuuaaggug

SEQ ID NO: 205697 - RNA, 64 nt, Human
acauauucacauuacacaguuccagaguauguggaccccccaaaguccagagauugcccuaggg

SEQ ID NO: 205698 - RNA, 64 nt, Human
uuucaucucaccauaucugugugccgcccccagcaccccccacccaccucuggggggcccguga

SEQ ID NO: 205699 - RNA, 64 nt, Human
ggacagguggcagagccgaggcuuagggucuggcaccccccacagcuggagacggaggcucucc

SEQ ID NO: 205700 - RNA, 64 nt, Human
cuucccuucucccuugcccucccuuucucucuccaccccccacgucuguccuccuuucuuauuc

SEQ ID NO: 205701 - RNA, 64 nt, Human
uuuacugagaagacuccuuggauauuucccaagaaccccccacauacaccccucacaagccacc

SEQ ID NO: 205702 - RNA, 64 nt, Human
aagaggggugcagagggaguucccccagaucaguaccccccaccccuccccagcuaguagcaug

SEQ ID NO: 205703 - RNA, 64 nt, Human
uggcacggucuuuuucugcuugaaaucugaucacaccccccagccauugcccucccucucuuuu

SEQ ID NO: 205704 - RNA, 64 nt, Human
ucaauuacgccuaagaucauuuugcuguccuuaaaccccccagguuccuucuugcacaaaucca

SEQ ID NO: 205705 - RNA, 64 nt, Human
aaaagcuugugugaaauucccucuucaccuccccaccccccaaaaaauaaaagggggcauaaac

SEQ ID NO: 205706 - RNA, 64 nt, Human
cacaagccagccaggggccccaggaagauggggcaccccccagcacccuccagauugagagcaa

SEQ ID NO: 205707 - RNA, 64 nt, Human
cgcagccugguccucggcucucccacaggugggcaccccccacuuuggugcuaauagcucucca

SEQ ID NO: 205708 - RNA, 64 nt, Human
aaaagaaauguacuuguuaggaaguagcuuaauuaccccccauugcaguauuauuguuauauau

SEQ ID NO: 205709 - RNA, 64 nt, Human
ggcucuccuuccucacacaguucaucauaacccaaccccccacccccgggucaugaaaaucaca

SEQ ID NO: 205710 - RNA, 64 nt, Human
gcgcagguggguguccucagcgugcgagcccugcaccccccagguccugggacuccugcagacc

SEQ ID NO: 205711 - RNA, 64 nt, Human
agcugcucugaaaucuccuuuagccaucaccccaaccccccaaaauuaguuuguguuacuuaug

SEQ ID NO: 205712 - RNA, 64 nt, Human
gaggaagaaaugucagaugcgugcccagcucuucaccccccaaucucuugguggggaggggugu

SEQ ID NO: 205713 - RNA, 64 nt, Human
augucucaugccuccaaacaacacugaauuugaaaccccccauuuuuucuuuucaccacccugu

SEQ ID NO: 205714 - RNA, 64 nt, Human
aggaguucaagaccaaccugggcaacauagcaacaccccccaugucuacaaaaaugaaaaacca

SEQ ID NO: 205715 - RNA, 64 nt, Human
uucucguucucucuuccuuguccuccccuccuccaccccccagguugugaagggcguaacuuuu

SEQ ID NO: 205716 - RNA, 64 nt, Human
cggcugggaacugggccagcagagcauguuggacaccccccaccauggugggcuugugguggcu

SEQ ID NO: 205717 - RNA, 64 nt, Human
cugacagccuaggaguuaucuucccacugugguaaccccccauguggcacccagggacugaagg

SEQ ID NO: 205718 - RNA, 64 nt, Human
cggagagagaagggaaggggaguguccccagccaaccccccagaaacggccuuuuuuccugccu

SEQ ID NO: 205719 - RNA, 64 nt, Human
ugggagggaaccaacccccacccucccuccugggaccccccagcaguagacggcuugggggagu

SEQ ID NO: 205720 - RNA, 64 nt, Human
uuuggggguucugccauaauaggaggggaaaaucaccccccagccaccucggggaacuccagac

SEQ ID NO: 205721 - RNA, 64 nt, Human
uuggggggaagugggaggccccggacgggguagcaccccccauuggggcuauaacggucaacca

SEQ ID NO: 205722 - RNA, 64 nt, Human
uaauuuuucacuggauaagaccugaguaacccagaccccccaccgugguucuuuucacagcccu

SEQ ID NO: 205723 - RNA, 64 nt, Human
cucguuuucuggguuuuggugauguuggaggaguaccccccagcccaccgccccgauuccuuuu

SEQ ID NO: 205724 - RNA, 64 nt, Human
cugugguugccgcauuuauuccaccuccagcuggaccccccacugcaaauagagaacagcggug

SEQ ID NO: 205725 - RNA, 63 nt, Human
ccagcucaaauuccgagugcagaaaagaaaccggaccccccagugaggccugccaggccuccc

SEQ ID NO: 205726 - RNA, 64 nt, Human
cuccuugugaucgucccauccccacaucccgugcaccccccaggacccuggucucaucaguccc

SEQ ID NO: 205727 - RNA, 64 nt, Human
gcuuaggacuuggcccuguuaugagcugacccccaccccccaccccccaccccccccccccgcc

SEQ ID NO: 205728 - RNA, 64 nt, Human
acuuggcccuguuaugagcugacccccaccccccaccccccaccccccccccccgccaacuccu

SEQ ID NO: 205729 - RNA, 64 nt, Human
auuucuuaaagcaaccuuuuaauaugcagauaauaccccccaacuuuuuuagagacagccuguc

SEQ ID NO: 205730 - RNA, 64 nt, Human
cuggucccaguuucccgcaaagugccucugggggaccccccagccucccacccuggucccaggu

SEQ ID NO: 205731 - RNA, 64 nt, Human
cccacagugcugucugaucugugcuuuccagcucaccccccacacucacuccugagaccccugg

SEQ ID NO: 205732 - RNA, 64 nt, Human
cggggcguggguggggaaggggcucugggaccagaccccccacacuacugcgucuuuguuucua

SEQ ID NO: 205733 - RNA, 64 nt, Human
cugccagcuccaaaauauugggguacagcucaccaccccccacuccgccaacccauuccuaccu

SEQ ID NO: 205734 - RNA, 64 nt, Human
uuaaaaucugaagcaaagaggccaaagauuggaaaccccccacccccaccucuuuccagaacug

SEQ ID NO: 205735 - RNA, 64 nt, Human
acaggagcguccuuuucuaaugucuuccauuccuaccccccacccaaaaacaaaagaaauauuu

SEQ ID NO: 205736 - RNA, 64 nt, Human
cccaugaggccuugguucagagccccaggaauggaccccccaaucacuccccacucuccuggga

SEQ ID NO: 205737 - RNA, 64 nt, Human
agcagcagcagucucugucaucccgucgccccuuaccccccaccccaggccacugggccccucc

SEQ ID NO: 205738 - RNA, 64 nt, Human
gacugucugugcuuucacuuacacuccucuugccaccccccaucccugcuuacuuagaccucag

SEQ ID NO: 205739 - RNA, 64 nt, Human
uguuauuuaauuuacacugaucucugcuauuuuaaccccccaaauaaguuauuuguccuuuaag

SEQ ID NO: 205740 - RNA, 63 nt, Human
acaacaaggcuuacuucuaguguaugcccuaugaccccccaucuuuccuccgccccugacccc

SEQ ID NO: 205741 - RNA, 64 nt, Human
ccaaccaggcacccguccuugggaccagcaguagaccccccacucuccccaccccuggcccacu

SEQ ID NO: 205742 - RNA, 64 nt, Human
ugauugccaguggaggggcuucuucagcacagagaccccccacuguguccagggacccccucug

SEQ ID NO: 205743 - RNA, 64 nt, Human
ccgagaccuccgguccgagacccugccuggguucaccccccacaacccagacccagaaccgcuc

SEQ ID NO: 205744 - RNA, 64 nt, Human
cugaacugaccccuguuugcacuaagccacccccaccccccacucugcuuucccaagcuugacu

SEQ ID NO: 205745 - RNA, 64 nt, Human
caccccacuucagaccucggugggcauucacaccaccccccaugccaccggcuccacuuucccc

SEQ ID NO: 205746 - RNA, 64 nt, Human
uggcacaagcaccacugauaccuccccugaaaaaaccccccaaauggauuagaagaccaacagg

SEQ ID NO: 205747 - RNA, 64 nt, Human
ggccaagggaguaaaaaugaagaaauaguccccuaccccccaucauccugugccucauccuccu

SEQ ID NO: 205748 - RNA, 64 nt, Human
cuuggaaccugggccucugagacauguccugaccaccccccagggcauuugccuccaucuucac

SEQ ID NO: 205749 - RNA, 64 nt, Human
cuauguggccccacaacacagauuuagagauacaaccccccacccuucuccgccauucuucccu

SEQ ID NO: 205750 - RNA, 64 nt, Human
uccacucauggucucuaaccacuugacaccagaaaccccccagcugugauaacgcaaaaugucu

SEQ ID NO: 205751 - RNA, 64 nt, Human
cucaucugugguccaggccggcaucguccuggccaccccccagaucuggugccugcuggccggc

SEQ ID NO: 205752 - RNA, 64 nt, Human
ugucguccaccccaggacgagccaucagggacagaccccccacccccaaggcugcagccacacc

SEQ ID NO: 205753 - RNA, 64 nt, Human
ccucaucugugaaaugagaaugaucacgugacccaccccccagggcagguaucagggugaacug

SEQ ID NO: 205754 - RNA, 64 nt, Human
cccugcaaacaacuguggugggggcuggcagcagaccccccaccuggcagggcuucuaaugcuc

SEQ ID NO: 205755 - RNA, 64 nt, Human
guugaggacacagggccccagcccagcccucugcaccccccagcccggccaucugcgccccaca

SEQ ID NO: 205756 - RNA, 64 nt, Human
ugcucgggguuuuuuauuuauaaaaccucuccccaccccccaccccccaacuuccuggguuuuc

SEQ ID NO: 205757 - RNA, 64 nt, Human
gguuuuuuauuuauaaaaccucuccccaccccccaccccccaacuuccuggguuuucucauugu

SEQ ID NO: 205758 - RNA, 64 nt, Human
gcuguugcaccucuacuggcaucagucuuugguuaccccccagccccaguaggaggagagcagg

SEQ ID NO: 205759 - RNA, 64 nt, Human
gggaguucccuggcacuggcagcauucaguggggaccccccaguggcaugaugaauggagagga

SEQ ID NO: 205760 - RNA, 64 nt, Human
auccucagaaugacuccaugagguagcuacuaaaaccccccacuuaacagaugaggaaacugag

SEQ ID NO: 205761 - RNA, 64 nt, Human
accccuucugccaagggaagccccuucaggaaggaccccccaaagcugaggggcugaauguagc

SEQ ID NO: 205762 - RNA, 64 nt, Human
cguugugcacugaccuuugccgaccuccagcggaaccccccagggggcaccagccccccagcag

SEQ ID NO: 205763 - RNA, 64 nt, Human
acccuauacacacugacagagacagcaauaccccaccccccauauuaaauaaaugucuucacca

SEQ ID NO: 205764 - RNA, 64 nt, Human
agcuuccuuuugagggacaaauuuaaaacaaacaaccccccaucacaaacuuaaaggauugcaa

SEQ ID NO: 205765 - RNA, 64 nt, Human
ggccacgagccaccacugccucccgcugcugcccaccccccacaaaaaggaaaaaaugaaugag

SEQ ID NO: 205766 - RNA, 64 nt, Human
gaagcccuucuugcuuuugagagaggcugugaccaccccccauccuucucccuacacucccagc

SEQ ID NO: 205767 - RNA, 64 nt, Human
ggagggcaaucccuucaccccaguugccaaacagaccccccacccccuggauuuuccuucuccc

SEQ ID NO: 205768 - RNA, 64 nt, Human
ccuccugucuuccuccuuguccuaugaaggccacaccccccagcucuggggacuccuaggucac

SEQ ID NO: 205769 - RNA, 64 nt, Human
cucuccugcucucucagaaccucccucugcccccaccccccaucugucucuuccuccuaauuaa

SEQ ID NO: 205770 - RNA, 64 nt, Human
uugccccaucagaggcugccuccuccuucugauuaccccccauguugcauaucagggugcucaa

SEQ ID NO: 205771 - RNA, 64 nt, Human
augcccagaagccucacaccucgucaccaccaccaccccccaccccauccugaggcacugccug

SEQ ID NO: 205772 - RNA, 64 nt, Human
cugccugcgcucuccagauaugaccccugcacccaccccccacagccugcccuaccccaccuac

SEQ ID NO: 205773 - RNA, 64 nt, Human
uuagccuuggggagaaauggcccguggugggcugaccccccacccuccacacacacaguuccau

SEQ ID NO: 205774 - RNA, 64 nt, Human
cccagcgauggugccugcuuagcuucccguccccaccccccagccccuuggcccucuccugucu

SEQ ID NO: 205775 - RNA, 64 nt, Human
ggccagccuagagggaauuccuuuuuuuuuuuuaaccccccagggggguaguugggagugagac

SEQ ID NO: 205776 - RNA, 64 nt, Human
cucacugacaaaauguauaucagcccccaccuccaccccccaauauuccuugaacuuugaauug

SEQ ID NO: 205777 - RNA, 64 nt, Human
gaacaacaaaggcaauggugaaaagagauuaggaaccccccagccuguuuccauucucugccca

SEQ ID NO: 205778 - RNA, 64 nt, Human
cccuccccaucuuccucucucuaaaaacaacccuaccccccauugccaccuucacuccuguguc

SEQ ID NO: 205779 - RNA, 64 nt, Human
cuccccuccuuggcauucaugggggagcccaggaaccccccacaccuaugggguuagagcuccu

SEQ ID NO: 205780 - RNA, 64 nt, Human
ugggggaauacgggcaacagcagucaggagggguaccccccauacuggcuuacuuccaccuccu

SEQ ID NO: 205781 - RNA, 64 nt, Human
cacagaauacaagccacuaccuucugaccuccccaccccccaccaacccccaucuuuuaauaug

SEQ ID NO: 205782 - RNA, 64 nt, Human
ccugcuucucgcugucuuucuuuucccaccucccaccccccaguuuucagauuuucucucaucc

SEQ ID NO: 205783 - RNA, 64 nt, Human
caaaaaaugugugguuuuuucccauguguccccuaccccccaauuucuuguccccucuuaaaga

SEQ ID NO: 205784 - RNA, 64 nt, Human
aacuuaaaaaaacaaacacaaaaagaugagucccaccccccacuaccaccacacccaucaacca

SEQ ID NO: 205785 - RNA, 64 nt, Human
ggggccaagggaccucgagacgcuuuccuuccccaccccccagcgucaucuccccagccugcug

SEQ ID NO: 205786 - RNA, 64 nt, Human
gauuuggggcagagggacaggcuccucuggggaaaccccccagagcucuuuaccaaggaugaaa

SEQ ID NO: 205787 - RNA, 64 nt, Human
cagcggguggccauggcccgggcucuggugcggaaccccccaguccucauccuggaugaagcca

SEQ ID NO: 205788 - RNA, 64 nt, Human
cuccccccuccucccacugucucucaccucccccaccccccacucucucucaucucucgcugug

SEQ ID NO: 205789 - RNA, 64 nt, Human
cagaagauuagaaccagacuuacuaaccaauuccaccccccaccaacccccuucuacugccuac

SEQ ID NO: 205790 - RNA, 64 nt, Human
uucuaaaaagccuuucuucuaaaaacgaaaaaagaccccccacccaaaauguuucgagucaaca

SEQ ID NO: 205791 - RNA, 64 nt, Human
ggggcaccguccggaggagaccaggccucuacacaccccccacucuacuuaucaucccugcuca

SEQ ID NO: 205792 - RNA, 64 nt, Human
aauggaauuacagacucaguagccauaucuuccaaccccccaguauaaauuucugucuuucugc

SEQ ID NO: 205793 - RNA, 64 nt, Human
gcguuuccccgugagggccaaugcaccuccccccaccccccacccucccauguccacagugggu

SEQ ID NO: 205794 - RNA, 64 nt, Human
uaaucggucuugcccagaggaucacagugcugagaccccccaccaccagccgguaccugggaag

SEQ ID NO: 205795 - RNA, 64 nt, Human
uguugagagcugagccaugcacacaggugcagacaccccccaacucccaugcacacggcuaguc

SEQ ID NO: 205796 - RNA, 64 nt, Human
gaaaaagaacuuaguagcuugcugcucccucaccaccccccaccagguucaagacccuuuuucu

SEQ ID NO: 205797 - RNA, 64 nt, Human
ugacccccuugauucccaccguacaacccccuccaccccccacucagugccuccacaugcugcc

SEQ ID NO: 205798 - RNA, 64 nt, Human
gggagaacuugguauccaugacuguggaggggccaccccccaaagauguaaggaagauguaggg

SEQ ID NO: 205799 - RNA, 64 nt, Human
caauaguaaaauuucuccuccuuuaacuccuccuaccccccaagguaagaaacaaaaaacaaac

SEQ ID NO: 205800 - RNA, 64 nt, Human
aaaaauaaaagcuguuuucaccaccucccuccccaccccccaaaaaaggcguacagccaacucu

SEQ ID NO: 205801 - RNA, 64 nt, Human
aaugaccacuucucuaccauugucccccacccccaccccccagaauaacgcugacuguccccug

SEQ ID NO: 205802 - RNA, 64 nt, Human
gccgaugcccagagacacagcccccacggacaaaaccccccagauaucaucuaccuagauuuaa

SEQ ID NO: 205803 - RNA, 64 nt, Human
uccccaugacaauguuguagugucccccacccccaccccccaggccuuggugccucuuguaucc

SEQ ID NO: 205804 - RNA, 64 nt, Human
gcucucccauuaugagcauccuucaucugggcagaccccccacccugcagaugcuucuaauaaa

SEQ ID NO: 205805 - RNA, 64 nt, Human
caccaugccuggggcaggggcugugcacagacggaccccccacccccacacgcacuuuaugagg

SEQ ID NO: 205806 - RNA, 64 nt, Human
uggcuguggggguggagggaccuugccaggaugaaccccccagucccaggcacccucuagcucc

SEQ ID NO: 205807 - RNA, 64 nt, Human
gguggccucaaaggaggcccugucccagccacccaccccccacucccaggacuugcggucugag

SEQ ID NO: 205808 - RNA, 64 nt, Human
aaagaggucccagggaccugccccgaggaaggccaccccccagguccccuggaugauguggcag

SEQ ID NO: 205809 - RNA, 64 nt, Human
ucagccucccaaguagcugagacuacagguucacaccccccacaccuggcuuauuuuguauguu

SEQ ID NO: 205810 - RNA, 64 nt, Human
ugugagccaaccccacccgcuccacccuuuuuaaaccccccagcccugcucgugagauugggcu

SEQ ID NO: 205811 - RNA, 64 nt, Human
ucaccccugcccugggauguccacagaugccuccaccccccagaaccuguccuugcacacuccc

SEQ ID NO: 205812 - RNA, 64 nt, Human
aaccuccaauacccaggccuggccucuucagaguaccccccauuccacuuucccugccuccuuc

SEQ ID NO: 205813 - RNA, 64 nt, Human
aagaaccacugagugggugagcuaccuugggcaaaccccccacuccugacucugacugccacgu

SEQ ID NO: 205814 - RNA, 64 nt, Human
ccacccaguggcacagaaccgaggagcugccauuaccccccauagggggcagugucuuguuccu

SEQ ID NO: 205815 - RNA, 64 nt, Human
ccaguccgacugcccuccccaccccacccccgccaccccccacaugugaccacugcaacgaaga

SEQ ID NO: 205816 - RNA, 64 nt, Human
agacccuccuucugucccuacaccugcuccuuggaccccccagucuguggccacccugaagaau

SEQ ID NO: 205817 - RNA, 64 nt, Human
cuggccauauaggagggugggugaugcugaaaucaccccccaucuuaaguaauuacuuucugga

SEQ ID NO: 205818 - RNA, 64 nt, Human
ggccaagaugccuaaaaaagcuaaaggccaccccaccccccacccaccaccuccugccuccucu

SEQ ID NO: 205819 - RNA, 64 nt, Human
ugaccucuguuuccuccguccugauaagacguccaccccccagggccaggucccagcuauguag

SEQ ID NO: 205820 - RNA, 64 nt, Human
gggugcgaagggggcaugucacgacagcuccgccaccccccauugcccacccgcacuuucccga

SEQ ID NO: 205821 - RNA, 64 nt, Human
uccccaucucggcacuagaauucgccacucucccaccccccagcccccaccucugccuccaggu

SEQ ID NO: 205822 - RNA, 64 nt, Human
ugugucugugacccugugcgcugucucuguguguaccccccaccugcucccccccccuuuuuuu

SEQ ID NO: 205823 - RNA, 64 nt, Human
aggacccaggacaggauccaggccggcuugccacaccccccaccccuaggacuuauucccgcug

SEQ ID NO: 205824 - RNA, 64 nt, Human
ccugccugacucgcuagucccugcaaauaugcaaaccccccaucaucugcacacccgggcagug

SEQ ID NO: 205825 - RNA, 64 nt, Human
uucuuuuuuuucuuucuuguuuuucuucccccccaccccccacccccuucgguuaacuacuuuu

SEQ ID NO: 205826 - RNA, 64 nt, Human
gccaacaccacccucgugaguaaccuguauggucaccccccaggcuuuaucacugaugggaacu

SEQ ID NO: 205827 - RNA, 64 nt, Human
gaacgcacaccucgucggggggcccaguccagccaccccccagcacuuuauguagagaguguga

SEQ ID NO: 205828 - RNA, 64 nt, Human
cccugagcaggagcauggagcucuacaggaaugcaccccccaccgccauuggcauccccaccaa

SEQ ID NO: 205829 - RNA, 64 nt, Human
uccccaaguuccaaaagcacagacucaaagggaaaccccccagucacccacugucagcccccau

SEQ ID NO: 205830 - RNA, 64 nt, Human
uacugugcccuugggcagcugcgucuggggcucaaccccccaauccuguuccccucuccagcug

SEQ ID NO: 205831 - RNA, 52 nt, Human
ccccuguuauccuggucuaauaaccccccacacauacaccucuggugaccua

SEQ ID NO: 205832 - RNA, 64 nt, Human
auccacauucauuccuccauuuccuuucccagcaaccccccauuucuguuugggaauucauaug

SEQ ID NO: 205833 - RNA, 64 nt, Human
cccacaaaugacugagugcuccauuucuuccuuuaccccccauuuuuccuauuauucgcuccaa

SEQ ID NO: 205834 - RNA, 64 nt, Human
gacuugggacaguggccuugucuuuguccuccccaccccccagcccuagggacaccccaggcag

SEQ ID NO: 205835 - RNA, 64 nt, Human
uaacuaucuuaauagaauaguacaauaaaacacaaccccccacccagcauuaaaaaauaguuuu

SEQ ID NO: 205836 - RNA, 64 nt, Human
gaaaggaagcuccacugucacccuccaccucuucaccccccacucaccaguguccccuccacug

SEQ ID NO: 205837 - RNA, 64 nt, Human
ucugauaugcagaguauuucugccccacccaccuaccccccaaaaaaagcugaagccuauuuau

SEQ ID NO: 205838 - RNA, 64 nt, Human
cauuucacuccgucgaggagcaaagugagccccuaccccccaccccgauccccgcucccaacac

SEQ ID NO: 205839 - RNA, 64 nt, Human
uugagagaagccccagagggagcuauuuccuugcaccccccagaggugaaugagguauucuaua

SEQ ID NO: 205840 - RNA, 62 nt, Human
ugccagggacacagucuguuccuccucagaaaacaccccccaaaugcuaacaacauccccac

SEQ ID NO: 205841 - RNA, 64 nt, Human
ugguuugcggggggcaggcguaccagacugcaagaccccccaguaccucaccgugccaaauagg

SEQ ID NO: 205842 - RNA, 64 nt, Human
uggucugugagagguggcaggaauggggacccucaccccccaagcagccugugcccucuggccg

SEQ ID NO: 205843 - RNA, 64 nt, Human
ucccccuguccacauaccaaucccccuguccccgaccccccauccccgucccccaucuccgucc

SEQ ID NO: 205844 - RNA, 64 nt, Human
acaagugaccaucagauuauaucuucaacaccacaccccccaccccaucgugggugaggguauc

SEQ ID NO: 205845 - RNA, 64 nt, Human
caaucccccuuucaccagaugccacccucccugaaccccccaccacuaccagcucccuggccuc

SEQ ID NO: 205846 - RNA, 64 nt, Human
ggggccuccccugcuaucccuccucccauccuguaccccccauuucuggggccucaucacugug

SEQ ID NO: 205847 - RNA, 64 nt, Human
cuaggggggagggggguggcacagcagcuuggguaccccccaaccuccaggagcuaguggaggg

SEQ ID NO: 205848 - RNA, 64 nt, Human
gagagaugcuggaggugggggugcuguguuuuagaccccccauauuaucccaguguccccugcc

SEQ ID NO: 205849 - RNA, 64 nt, Human
agcaguccuccugcuucaacauacagcuacagguaccccccacuauacauuuuuaauaaggauu

SEQ ID NO: 205850 - RNA, 64 nt, Human
ccacugcugaaaagucacgcagcugcucccucggaccccccaaggaugguugcuguuagcagag

SEQ ID NO: 205851 - RNA, 64 nt, Human
cccugaggagugagcggccgagacgcugcuccccaccccccaccuccaugccucagccuuugcc

SEQ ID NO: 205852 - RNA, 64 nt, Human
gccuuagggauacaggggguccccuucuguuaccaccccccacccuccuccaggacaccacuag

SEQ ID NO: 205853 - RNA, 64 nt, Human
cgagucuccugcacugugucucccacacugagaaaccccccaacccacucccucuguagugagg

SEQ ID NO: 205854 - RNA, 64 nt, Human
ucauuuccccucccaauccucucuccccucugcaaccccccagcucgcuggcuuucucucuggc

SEQ ID NO: 205855 - RNA, 64 nt, Human
cccucgcgggcugggccuuccacgcaucccccccaccccccauggaacagaaagccauguuuuu

SEQ ID NO: 205856 - RNA, 64 nt, Human
ccgagaugugaguccuguugaagacuuccucucuaccccccaccuuggucccucucagauaccc

SEQ ID NO: 205857 - RNA, 64 nt, Human
agcugccuggcucauggcccaaccccuuuccuggaccccccagcuggccucugaagcuggccca

SEQ ID NO: 205858 - RNA, 64 nt, Human
aauccaaggaagagagcccaaggguaggggagaaaccccccacaacugaccccugccucccugu

SEQ ID NO: 205859 - RNA, 64 nt, Human
aguagggguggggcuuugggggugcuuucucuguaccccccagcccaugucccaaguugugcca

SEQ ID NO: 205860 - RNA, 64 nt, Human
ccagcccuaggugugcaccuaggccucauuccuuaccccccagccccugcccaccuucagcagg

SEQ ID NO: 205861 - RNA, 64 nt, Human
cucuggguguagaccacaccaccucccacugggcaccccccaacacgguguccugccacccagc

SEQ ID NO: 205862 - RNA, 64 nt, Human
cccacuccugggugcgugcagacccuuccccuccaccccccaggucuuccaagcucugcuuccu

SEQ ID NO: 205863 - RNA, 64 nt, Human
acccaaguguucagcuuauucaccccacccccccaccccccaucacacgugcuccugugaacuu

SEQ ID NO: 205864 - RNA, 64 nt, Human
uuagcuggaauucugccaccuuccuuugugccccaccccccacuguucccucauuugcacugcu

SEQ ID NO: 205865 - RNA, 64 nt, Human
cuauauggacucguaaaggcauggguauaaugguaccccccaguaaacuuccuaaugauuucuu

SEQ ID NO: 205866 - RNA, 64 nt, Human
ccugauuguguauauucauauauuuuggauacgcaccccccaacucccaauacuggcucugucu

SEQ ID NO: 205867 - RNA, 64 nt, Human
gagacaggacagacccgcuuuucccgagacaaggaccccccaugucacggcagcuucacagacg

SEQ ID NO: 205868 - RNA, 64 nt, Human
cccggccacaugccccgccaaguacugcacagggaccccccacccaggggaccugcuccgugag

SEQ ID NO: 205869 - RNA, 64 nt, Human
gaggggaggggccgcagugcgcagaacccaccccaccccccagugcagacuucggggucuccac

SEQ ID NO: 205870 - RNA, 64 nt, Human
gguccggcagcggccacaauugucuuguccccucaccccccaacucccccuggaacaccucucc

SEQ ID NO: 205871 - RNA, 64 nt, Human
gccagcucccccuugcccgccagccaguggccgaaccccccacucccugccaccgucacacagu

SEQ ID NO: 205872 - RNA, 64 nt, Human
cugggccugagaacacaggaaugauucauagcccaccccccaccuccaugcauacaccagagcu

SEQ ID NO: 205873 - RNA, 64 nt, Human
cagaggagggcagcagaaggggguggugucuccaaccccccagcacugaggaagaacggggcuc

SEQ ID NO: 205874 - RNA, 64 nt, Human
ucuugccuugauaguggugcugugucccucucagaccccccaccugagucuccacagagcccca

SEQ ID NO: 205875 - RNA, 64 nt, Human
caugaccgggagguugugaccccaacccaaggucaccccccaggggugccgcauacaggaggug

SEQ ID NO: 205876 - RNA, 57 nt, Human
ugcugaagggagaggaguaacagccagaccccccaucaguggacaaggggagagucc

SEQ ID NO: 205877 - RNA, 64 nt, Human
uuucaucuggcuccccccaccaccuccccaccccaccccccacccccugcuuccccucacugcc

SEQ ID NO: 205878 - RNA, 64 nt, Human
cagaacacaguccauuacgauagaaacacuaggcaccccccaggcgagagcuaguggggugcag

SEQ ID NO: 205879 - RNA, 64 nt, Human
aaggugaacacuuccuucuagggagcacccucccaccccccaccccccccacacacaccaucuu

SEQ ID NO: 205880 - RNA, 64 nt, Human
gaacauguaugugggaccccagaccaucccagccaccccccaucuuccuggccucuuuggcagc

SEQ ID NO: 205881 - RNA, 64 nt, Human
uuugcagcacauguguuacaugucaggcagugaaaccccccacagcagccuucccucucagagg

SEQ ID NO: 205882 - RNA, 64 nt, Human
cuagaaaaaauuaauaaauuccuugaaagauauaaccccccaagauugaaccaagaagaaauug

SEQ ID NO: 205883 - RNA, 64 nt, Human
uguuguuggggaagggaccccaguccugccuuccaccccccaaccaggccugagacugaucaaa

SEQ ID NO: 205884 - RNA, 64 nt, Human
aacuuucaacuauuauuucuucaaauauuuuuucaccccccagucuugucuuuuuuagggacuu

SEQ ID NO: 205885 - RNA, 64 nt, Human
cuggcccaaggccgucugagggaucugcuccuuaaccccccagugccuuggcgagggcagguuc

SEQ ID NO: 205886 - RNA, 64 nt, Human
cugagaggaugcugcucaggagccagcacaggacaccccccaccccaccccaccauguccccau

SEQ ID NO: 205887 - RNA, 64 nt, Human
cuguccugaaaacagcacgccccaggcccacagaaccccccacccuacauuugccuugggugga

SEQ ID NO: 205888 - RNA, 64 nt, Human
ccuuccagccggagcaccccgauccccauccggcaccccccaaucccccaacacgccugucccu

SEQ ID NO: 205889 - RNA, 64 nt, Human
uauauauauauauauuaaaaagucucuauucuucaccccccagccuuccugaaccugccucucu

SEQ ID NO: 205890 - RNA, 64 nt, Human
gugagggacccggagcccguccccccaaucccucaccccccacaccucagccacuggagacuga

SEQ ID NO: 205891 - RNA, 64 nt, Human
uucaccuuugaccuugccucaccuuucaccccccaccccccacagcgucagcuccuaccucuga

SEQ ID NO: 205892 - RNA, 64 nt, Human
gcugcaguucaccuuugaccuugccucaccuuucaccccccaccccccacagcgucagcuccua

SEQ ID NO: 205893 - RNA, 64 nt, Human
gcugcacuucaccgcugaccuugccucaccuuuaaccccccaccugagccccagcuccuaccuc

SEQ ID NO: 205894 - RNA, 62 nt, Human
ccagcagcugcagcugcuagagauggcccccaaccccccacccaccccucuccugccucggc

SEQ ID NO: 205895 - RNA, 57 nt, Human
accccaagguggcccuguagggggugcaccccccacccuauggaccagucaaauaaa

SEQ ID NO: 205896 - RNA, 64 nt, Human
uugcuuuuauacauuuuucugcagcuguaggcauaccccccaagucugcuuuuagcuucccuau

SEQ ID NO: 205897 - RNA, 64 nt, Human
auugauuuaggggcuuuggagaacuuugaaugcuaccccccaaguaaccauuguuggcaaccug

SEQ ID NO: 205898 - RNA, 64 nt, Human
aauauauauauggagaugcucccucccccugugaaccccccagugcccccguggggcugagucu

SEQ ID NO: 205899 - RNA, 64 nt, Human
gcaagugugggugugugagugugcguauguggggaccccccagggcaugguggggucugaggcg

SEQ ID NO: 205900 - RNA, 64 nt, Human
cccaacagggccccgggagggaacccugcccccaaccccccacagcaaggcuguacagucucgc

SEQ ID NO: 205901 - RNA, 64 nt, Human
ccccaaccccaggccagucaggcacaauccccccaccccccaaacguccuggacugcacagacc

SEQ ID NO: 205902 - RNA, 64 nt, Human
acaccaaaacaguccuggaagugcuaauuacaggaccccccaagucuuccuacccucugcaccc

SEQ ID NO: 205903 - RNA, 64 nt, Human
ugagggcugugggcaggggaccugugugccccgcaccccccaugcuucuuuugcugccuuaagc

SEQ ID NO: 205904 - RNA, 64 nt, Human
ugggucccccagggggcaggggccaaagguccagaccccccaaguccagugagggcaguaggga

SEQ ID NO: 205905 - RNA, 64 nt, Human
gaguaucagggauuguggggacaggagugagacaaccccccagguacagcacuggcuuuucuuu

SEQ ID NO: 205906 - RNA, 64 nt, Human
gucagggacugaagggggaccccaaaacuggcucaccccccagaacacccuccucccagggagg

SEQ ID NO: 205907 - RNA, 64 nt, Human
uccagccccuccucccucagacccaggaguccagaccccccagccccuccucccucagacccag

SEQ ID NO: 205908 - RNA, 64 nt, Human
cccagccccuccucccucagacccaggaguccagaccccccagccccuccucccucagacccag

SEQ ID NO: 205909 - RNA, 64 nt, Human
gaaugcaauuuuaaaauguaaaggcucuuuuauaaccccccaaaaaaucacacaaauauauuuu

SEQ ID NO: 205910 - RNA, 64 nt, Human
ugaguucucuggcacugucaaaagcagccaacccaccccccaguccacauggucaccacugcug

SEQ ID NO: 205911 - RNA, 64 nt, Human
auaacaagaguuauuuuuaaacagaacuccucuuaccccccaaaacagauaaaccucaguguac

SEQ ID NO: 205912 - RNA, 64 nt, Human
cugaagaaauagauuguugcauucauuccuccccaccccccauuuguaggcaguaaacaaagua

SEQ ID NO: 205913 - RNA, 64 nt, Human
gauaaagcacugaaaacaccacagugacccucccaccccccaccaauauguaauucuauuaaua

SEQ ID NO: 205914 - RNA, 64 nt, Human
caggccucaagccgggcacccaacccuggaugccaccccccagcggguaccagaggaaagcugg

SEQ ID NO: 205915 - RNA, 64 nt, Human
gggagggguagugcuccacagcuuuuccuuccccaccccccagccuuagaugccucgcucuuuu

SEQ ID NO: 205916 - RNA, 64 nt, Human
uacuccugcugucuaccucuccucacaccccagcaccccccauuuuuucaaaccuugguaucug

SEQ ID NO: 205917 - RNA, 64 nt, Human
uuugaaauggucuuuucacuuucauucagucaucaccccccaaaaugcucugcagccucucugc

SEQ ID NO: 205918 - RNA, 64 nt, Human
uggucgcugaggggguuggcugggucugagugccaccccccaggccacagugauaccaucccag

SEQ ID NO: 205919 - RNA, 64 nt, Human
guggccuacuggccccuugagaaggggcuggcuuaccccccaagccggcccuggugcuuucacu

SEQ ID NO: 205920 - RNA, 64 nt, Human
uaggcccccugcaaggcuggcagcccccacccccaccccccaggccgccuugagaagcacaguu

SEQ ID NO: 205921 - RNA, 64 nt, Human
uuaaugucgucacuugaaaacgagaaaaagaccgaccccccaccccugcuuucgugcauuuugu

SEQ ID NO: 205922 - RNA, 64 nt, Human
agcuggcauuacagcuggagaagacccuccccgcaccccccaagcuguuuucuucuauuccaug

SEQ ID NO: 205923 - RNA, 64 nt, Human
gaugagacucaagaaccaagaugggggaccagcaaccccccagggucauggaggacccaggacc

SEQ ID NO: 205924 - RNA, 64 nt, Human
cagccagcggcagaagcagggcugaugcucagggaccccccaacccucaaaccuugccuccgag

SEQ ID NO: 205925 - RNA, 64 nt, Human
ucccagaguggggaggaagauaugggugacccccaccccccaucugugagccaagccucccuug

SEQ ID NO: 205926 - RNA, 64 nt, Human
gccaaggaagggaugguguagguucaaaagggaaaccccccagggccugcuguggccuaggagc

SEQ ID NO: 205927 - RNA, 64 nt, Human
aggaaagaacggaauccaggcaaucuguuuagagaccccccacuccaaauuuauccuuuuccuu

SEQ ID NO: 205928 - RNA, 64 nt, Human
ucucaguaugaaacucuaugucuucaacuuucagaccccccauuuauuuguaugaaggcuucag

SEQ ID NO: 205929 - RNA, 64 nt, Human
gcacacagccgucugagcagggcaggugcccaacaccccccaccggaggacacgcugccccuca

SEQ ID NO: 205930 - RNA, 64 nt, Human
ucucgcggccccuccucugcuucccccugaacccaccccccacggaaaccagcccugcgggcua

SEQ ID NO: 205931 - RNA, 64 nt, Human
uuuucaacuuccugcuggaaacuagagguggggcaccccccaccccccagccucgcacuguguc

SEQ ID NO: 205932 - RNA, 64 nt, Human
cuuccugcuggaaacuagagguggggcaccccccaccccccagccucgcacuguguccuugggg

SEQ ID NO: 205933 - RNA, 64 nt, Human
gcggugccugcccugggccgggaccccccuccccaccccccaccuaggcuuuuuggguuuuguu

SEQ ID NO: 205934 - RNA, 64 nt, Human
gguucuucaggaccuucuauaucccuccucgguaaccccccagcccaaccccuuggaaucuuuc

SEQ ID NO: 205935 - RNA, 64 nt, Human
aaggggcaggggcagugggggcucgggcaggagcaccccccagacuccccgugcccgcagcccu

SEQ ID NO: 205936 - RNA, 64 nt, Human
gcucagccccacuggacucugggcugcagaggccaccccccaggugggggugcccgcagggaug

SEQ ID NO: 205937 - RNA, 64 nt, Human
uuucuucuuugcuugcuuucuuccuccuuacccuaccccccacucacacacacacacacacaca

SEQ ID NO: 205938 - RNA, 64 nt, Human
uuuggaauuccucccaagaccccuggccacccagaccccccauucuuccuaacacuggcaauaa

SEQ ID NO: 205939 - RNA, 64 nt, Human
cccacacugaaauccccucuagucacccauucccaccccccagggagcugccucccaggcaggg

SEQ ID NO: 205940 - RNA, 64 nt, Human
ccagccccaucccuguccucaugaccccucguccaccccccacacacacuauaaggcugagggc

SEQ ID NO: 205941 - RNA, 64 nt, Human
ggccgugccagccucccacacugaggccaggucuaccccccaucauaccagcccccaggaccac

SEQ ID NO: 205942 - RNA, 64 nt, Human
cugauccuccugaacaugagguagagcugguuggaccccccagccaaguggcagacgcugguuu

SEQ ID NO: 205943 - RNA, 64 nt, Human
ugcccacccuccacucuccucuuccaggcccccaaccccccauuucuuccccaccaaccccucc

SEQ ID NO: 205944 - RNA, 64 nt, Human
gaucuaugugucugucuguguguccaucccgccgaccccccagacuaaccuccaggcauggacu

SEQ ID NO: 205945 - RNA, 64 nt, Human
agcuuagagccucccucaauucccccuggccaccaccccccacucugugccugaccuugaggag

SEQ ID NO: 205946 - RNA, 64 nt, Human
cuauuugcccugcagagcugggaguuucacccccaccccccacccuguucucuccuuaccuuug

SEQ ID NO: 205947 - RNA, 64 nt, Human
ucccagugagguuaccacuuaaaucuucccccccaccccccacccuuuugcugauugauaauug

SEQ ID NO: 205948 - RNA, 64 nt, Human
agcuguucccacccagccagggcaugaaacaucaaccccccacaugugaacccaucauuccuaa

SEQ ID NO: 205949 - RNA, 52 nt, Human
cuacuucuguuuucuuuuagcgaccccccaccgccaggcugaucagaagcug

SEQ ID NO: 205950 - RNA, 64 nt, Human
auuugcugucagcaugauagaauaagaagcagaaaccccccagcagugggguaagauugcgcgc

SEQ ID NO: 205951 - RNA, 64 nt, Human
uccuggccccagcccccaccuccgccccagacacaccccccagucgagcccugcagccaaacag

SEQ ID NO: 205952 - RNA, 64 nt, Human
gagaaaugcucacugcacaaggagaccaagaaaaaccccccacgaaaucagccacaacuaaauc

SEQ ID NO: 205953 - RNA, 64 nt, Human; identical to SEQ ID NO: 174529

SEQ ID NO: 205954 - RNA, 64 nt, Human; identical to SEQ ID NO: 174530

SEQ ID NO: 205955 - RNA, 64 nt, Human; identical to SEQ ID NO: 174531

SEQ ID NO: 205956 - RNA, 64 nt, Human; identical to SEQ ID NO: 174532

SEQ ID NO: 205957 - RNA, 64 nt, Human; identical to SEQ ID NO: 174533

SEQ ID NO: 205958 - RNA, 64 nt, Human; identical to SEQ ID NO: 174534

SEQ ID NO: 205959 - RNA, 64 nt, Human; identical to SEQ ID NO: 174535

SEQ ID NO: 205960 - RNA, 64 nt, Human; identical to SEQ ID NO: 174536

SEQ ID NO: 205961 - RNA, 64 nt, Human; identical to SEQ ID NO: 174537

SEQ ID NO: 205962 - RNA, 64 nt, Human; identical to SEQ ID NO: 174538

SEQ ID NO: 205963 - RNA, 64 nt, Human; identical to SEQ ID NO: 174539

SEQ ID NO: 205964 - RNA, 64 nt, Human; identical to SEQ ID NO: 174540

SEQ ID NO: 205965 - RNA, 64 nt, Human; identical to SEQ ID NO: 174541

SEQ ID NO: 205966 - RNA, 64 nt, Human; identical to SEQ ID NO: 174542

SEQ ID NO: 205967 - RNA, 64 nt, Human; identical to SEQ ID NO: 174543

SEQ ID NO: 205968 - RNA, 64 nt, Human; identical to SEQ ID NO: 174544

SEQ ID NO: 205969 - RNA, 64 nt, Human; identical to SEQ ID NO: 174545

SEQ ID NO: 205970 - RNA, 64 nt, Human; identical to SEQ ID NO: 174546

SEQ ID NO: 205971 - RNA, 64 nt, Human; identical to SEQ ID NO: 174547

SEQ ID NO: 205972 - RNA, 64 nt, Human; identical to SEQ ID NO: 174548

SEQ ID NO: 205973 - RNA, 64 nt, Human; identical to SEQ ID NO: 174549

SEQ ID NO: 205974 - RNA, 64 nt, Human; identical to SEQ ID NO: 174550

SEQ ID NO: 205975 - RNA, 64 nt, Human; identical to SEQ ID NO: 174551

SEQ ID NO: 205976 - RNA, 64 nt, Human; identical to SEQ ID NO: 174552

SEQ ID NO: 205977 - RNA, 64 nt, Human; identical to SEQ ID NO: 174553

SEQ ID NO: 205978 - RNA, 64 nt, Human; identical to SEQ ID NO: 174554

SEQ ID NO: 205979 - RNA, 64 nt, Human; identical to SEQ ID NO: 174555

SEQ ID NO: 205980 - RNA, 53 nt, Human; identical to SEQ ID NO: 174556

SEQ ID NO: 205981 - RNA, 64 nt, Human; identical to SEQ ID NO: 174557

SEQ ID NO: 205982 - RNA, 64 nt, Human; identical to SEQ ID NO: 174558

SEQ ID NO: 205983 - RNA, 64 nt, Human; identical to SEQ ID NO: 174559

SEQ ID NO: 205984 - RNA, 64 nt, Human; identical to SEQ ID NO: 174560

SEQ ID NO: 205985 - RNA, 64 nt, Human; identical to SEQ ID NO: 174561

SEQ ID NO: 205986 - RNA, 64 nt, Human; identical to SEQ ID NO: 174562

SEQ ID NO: 205987 - RNA, 64 nt, Human; identical to SEQ ID NO: 174563

SEQ ID NO: 205988 - RNA, 64 nt, Human; identical to SEQ ID NO: 174564

SEQ ID NO: 205989 - RNA, 64 nt, Human; identical to SEQ ID NO: 174565

SEQ ID NO: 205990 - RNA, 64 nt, Human; identical to SEQ ID NO: 174566

SEQ ID NO: 205991 - RNA, 64 nt, Human; identical to SEQ ID NO: 174567

SEQ ID NO: 205992 - RNA, 64 nt, Human; identical to SEQ ID NO: 174568

SEQ ID NO: 205993 - RNA, 64 nt, Human; identical to SEQ ID NO: 174569

SEQ ID NO: 205994 - RNA, 64 nt, Human; identical to SEQ ID NO: 174570

SEQ ID NO: 205995 - RNA, 64 nt, Human; identical to SEQ ID NO: 174571

SEQ ID NO: 205996 - RNA, 52 nt, Human; identical to SEQ ID NO: 174572

SEQ ID NO: 205997 - RNA, 64 nt, Human; identical to SEQ ID NO: 174573

SEQ ID NO: 205998 - RNA, 64 nt, Human; identical to SEQ ID NO: 174574

SEQ ID NO: 205999 - RNA, 64 nt, Human; identical to SEQ ID NO: 174575

SEQ ID NO: 206000 - RNA, 64 nt, Human; identical to SEQ ID NO: 174576

SEQ ID NO: 206001 - RNA, 64 nt, Human; identical to SEQ ID NO: 174577

SEQ ID NO: 206002 - RNA, 64 nt, Human; identical to SEQ ID NO: 174578

SEQ ID NO: 206003 - RNA, 64 nt, Human; identical to SEQ ID NO: 174579

SEQ ID NO: 206004 - RNA, 64 nt, Human; identical to SEQ ID NO: 174580

SEQ ID NO: 206005 - RNA, 64 nt, Human; identical to SEQ ID NO: 174581

SEQ ID NO: 206006 - RNA, 64 nt, Human; identical to SEQ ID NO: 174582

SEQ ID NO: 206007 - RNA, 64 nt, Human; identical to SEQ ID NO: 174583

SEQ ID NO: 206008 - RNA, 64 nt, Human; identical to SEQ ID NO: 174584

SEQ ID NO: 206009 - RNA, 64 nt, Human; identical to SEQ ID NO: 174585

SEQ ID NO: 206010 - RNA, 64 nt, Human; identical to SEQ ID NO: 174586

SEQ ID NO: 206011 - RNA, 64 nt, Human; identical to SEQ ID NO: 174587

SEQ ID NO: 206012 - RNA, 64 nt, Human; identical to SEQ ID NO: 174588

SEQ ID NO: 206013 - RNA, 64 nt, Human; identical to SEQ ID NO: 174589

SEQ ID NO: 206014 - RNA, 64 nt, Human; identical to SEQ ID NO: 174590

SEQ ID NO: 206015 - RNA, 64 nt, Human; identical to SEQ ID NO: 174591

SEQ ID NO: 206016 - RNA, 64 nt, Human; identical to SEQ ID NO: 174592

SEQ ID NO: 206017 - RNA, 64 nt, Human; identical to SEQ ID NO: 174593

SEQ ID NO: 206018 - RNA, 64 nt, Human; identical to SEQ ID NO: 174594

SEQ ID NO: 206019 - RNA, 64 nt, Human; identical to SEQ ID NO: 174595

SEQ ID NO: 206020 - RNA, 64 nt, Human; identical to SEQ ID NO: 174596

SEQ ID NO: 206021 - RNA, 64 nt, Human; identical to SEQ ID NO: 174597

SEQ ID NO: 206022 - RNA, 64 nt, Human; identical to SEQ ID NO: 174598

SEQ ID NO: 206023 - RNA, 64 nt, Human; identical to SEQ ID NO: 174599

SEQ ID NO: 206024 - RNA, 64 nt, Human; identical to SEQ ID NO: 174600

SEQ ID NO: 206025 - RNA, 64 nt, Human; identical to SEQ ID NO: 174601

SEQ ID NO: 206026 - RNA, 64 nt, Human; identical to SEQ ID NO: 174602

SEQ ID NO: 206027 - RNA, 64 nt, Human; identical to SEQ ID NO: 174603

SEQ ID NO: 206028 - RNA, 64 nt, Human; identical to SEQ ID NO: 174604

SEQ ID NO: 206029 - RNA, 51 nt, Human; identical to SEQ ID NO: 174605

SEQ ID NO: 206030 - RNA, 64 nt, Human; identical to SEQ ID NO: 174606

SEQ ID NO: 206031 - RNA, 54 nt, Human; identical to SEQ ID NO: 174607

SEQ ID NO: 206032 - RNA, 64 nt, Human; identical to SEQ ID NO: 174608

SEQ ID NO: 206033 - RNA, 63 nt, Human; identical to SEQ ID NO: 174609

SEQ ID NO: 206034 - RNA, 64 nt, Human; identical to SEQ ID NO: 174610

SEQ ID NO: 206035 - RNA, 64 nt, Human; identical to SEQ ID NO: 174611

SEQ ID NO: 206036 - RNA, 64 nt, Human; identical to SEQ ID NO: 174612

SEQ ID NO: 206037 - RNA, 64 nt, Human; identical to SEQ ID NO: 174613

SEQ ID NO: 206038 - RNA, 64 nt, Human; identical to SEQ ID NO: 174614

SEQ ID NO: 206039 - RNA, 64 nt, Human; identical to SEQ ID NO: 174615

SEQ ID NO: 206040 - RNA, 64 nt, Human; identical to SEQ ID NO: 174616

SEQ ID NO: 206041 - RNA, 64 nt, Human; identical to SEQ ID NO: 174617

SEQ ID NO: 206042 - RNA, 64 nt, Human; identical to SEQ ID NO: 174618

SEQ ID NO: 206043 - RNA, 64 nt, Human; identical to SEQ ID NO: 174619

SEQ ID NO: 206044 - RNA, 64 nt, Human; identical to SEQ ID NO: 174620

SEQ ID NO: 206045 - RNA, 64 nt, Human; identical to SEQ ID NO: 174621

SEQ ID NO: 206046 - RNA, 64 nt, Human; identical to SEQ ID NO: 174622

SEQ ID NO: 206047 - RNA, 64 nt, Human; identical to SEQ ID NO: 174623

SEQ ID NO: 206048 - RNA, 64 nt, Human; identical to SEQ ID NO: 174624

SEQ ID NO: 206049 - RNA, 64 nt, Human; identical to SEQ ID NO: 174625

SEQ ID NO: 206050 - RNA, 64 nt, Human; identical to SEQ ID NO: 174626

SEQ ID NO: 206051 - RNA, 64 nt, Human; identical to SEQ ID NO: 174627

SEQ ID NO: 206052 - RNA, 64 nt, Human; identical to SEQ ID NO: 174628

SEQ ID NO: 206053 - RNA, 64 nt, Human; identical to SEQ ID NO: 174629

SEQ ID NO: 206054 - RNA, 64 nt, Human; identical to SEQ ID NO: 174630

SEQ ID NO: 206055 - RNA, 64 nt, Human; identical to SEQ ID NO: 174631

SEQ ID NO: 206056 - RNA, 64 nt, Human; identical to SEQ ID NO: 174632

SEQ ID NO: 206057 - RNA, 64 nt, Human; identical to SEQ ID NO: 174633

SEQ ID NO: 206058 - RNA, 64 nt, Human; identical to SEQ ID NO: 174634

SEQ ID NO: 206059 - RNA, 64 nt, Human; identical to SEQ ID NO: 174635

SEQ ID NO: 206060 - RNA, 64 nt, Human; identical to SEQ ID NO: 174636

SEQ ID NO: 206061 - RNA, 57 nt, Human; identical to SEQ ID NO: 174637

SEQ ID NO: 206062 - RNA, 64 nt, Human; identical to SEQ ID NO: 174638

SEQ ID NO: 206063 - RNA, 50 nt, Human; identical to SEQ ID NO: 174639

SEQ ID NO: 206064 - RNA, 64 nt, Human; identical to SEQ ID NO: 174640

SEQ ID NO: 206065 - RNA, 57 nt, Human; identical to SEQ ID NO: 174641

SEQ ID NO: 206066 - RNA, 64 nt, Human; identical to SEQ ID NO: 174642

SEQ ID NO: 206067 - RNA, 64 nt, Human; identical to SEQ ID NO: 174643

SEQ ID NO: 206068 - RNA, 64 nt, Human; identical to SEQ ID NO: 174644

SEQ ID NO: 206069 - RNA, 64 nt, Human; identical to SEQ ID NO: 174645

SEQ ID NO: 206070 - RNA, 64 nt, Human; identical to SEQ ID NO: 174646

SEQ ID NO: 206071 - RNA, 64 nt, Human; identical to SEQ ID NO: 174647

SEQ ID NO: 206072 - RNA, 64 nt, Human; identical to SEQ ID NO: 174648

SEQ ID NO: 206073 - RNA, 64 nt, Human; identical to SEQ ID NO: 174649

SEQ ID NO: 206074 - RNA, 64 nt, Human; identical to SEQ ID NO: 174650

SEQ ID NO: 206075 - RNA, 64 nt, Human; identical to SEQ ID NO: 174651

SEQ ID NO: 206076 - RNA, 63 nt, Human
aguaggugcagcugccgcagccgggggaggccugcccgggaaggcugcugccccugcccccug

SEQ ID NO: 206077 - RNA, 63 nt, Human
cuggagacucguggacuuaccgccuggaggcaggcccgggaaggcugcuguuuacucaucggg

SEQ ID NO: 206078 - RNA, 54 nt, Human
ugucgauggagauggacuaggcuggcccgggaggggagugacagagggacguuc

SEQ ID NO: 206079 - RNA, 63 nt, Human
aggggcuggaagccuugacacauggaaucaggggcccgggaugugauucaggacacuuuccau

SEQ ID NO: 206080 - RNA, 63 nt, Human
cgcccgagacccccaccucucacuuugcugugagcccgggaaccccagagaccacuccugugg

SEQ ID NO: 206081 - RNA, 63 nt, Human
gaaugugcacugccgaggagaaugccagccagggcccgggagagugugagguuucaggaaagu

SEQ ID NO: 206082 - RNA, 63 nt, Human
acccuugaagcuucacuuccgacaccugcacuggcccgggaagccaaucccaaggauggaggc

SEQ ID NO: 206083 - RNA, 63 nt, Human
aggaagcagccaugggagaggggaaggguucaagcccgggaugggcccgcgugacgucgaugg

SEQ ID NO: 206084 - RNA, 63 nt, Human
caauggcccggccccuccugacucauccgccuggcccgggaaugaauggggaggccgcugaac

SEQ ID NO: 206085 - RNA, 63 nt, Human
agggguggugcuguccguggccagcaccccggggcccgggaggggugggcuacuagagucaga

SEQ ID NO: 206086 - RNA, 63 nt, Human
uguacagaggcauagguuaccacccccaccccggcccgggauacugcccccggcccagauccu

SEQ ID NO: 206087 - RNA, 63 nt, Human
ccugcgucucccugcaggcagucaccuucuuaggcccgggaaaaugccggucuccuacucuuc

SEQ ID NO: 206088 - RNA, 63 nt, Human
uacuugggaggcugaggcaggagaauugcuugagcccgggagagggagguugcagugaggcga

SEQ ID NO: 206089 - RNA, 63 nt, Human
ccagcccucaggccugcgccuggggugagcugagcccgggacuccgccuugcaggcuccggaa

SEQ ID NO: 206090 - RNA, 63 nt, Human
guaagacuccucuauguugccugcuguccaggagcccgggagggaggggugugcaggagccgc

SEQ ID NO: 206091 - RNA, 50 nt, Human
gccuggcccugcaggucugagcccgggacuggacgagcaguagauccagc

SEQ ID NO: 206092 - RNA, 52 nt, Human
gagaagagaugucgggcuaagggcccgggacgggcggcgcccauccugcgac

SEQ ID NO: 206093 - RNA, 64 nt, Human
cuuaggcaaagcauuauucauucccaucagucugaagcccgaaggacuguuuuguauaauaccu

SEQ ID NO: 206094 - RNA, 63 nt, Human
ggacagccggggcugggugcugcaggggcuucagcccgggagagggggugggcguguucuuug

SEQ ID NO: 206095 - RNA, 63 nt, Human
uccaggccuggggacaggaaagccacugacccagcccgggaggcagaaccaggcagccucccu

SEQ ID NO: 206096 - RNA, 63 nt, Human
acaccugcucucaccugagccccaggugaaggggcccgggaacaccugcucucaccugagccc

SEQ ID NO: 206097 - RNA, 63 nt, Human
acaccugcucucaccugagccccaggugaaggggcccgggaacaccugcucucaccugaaccc

SEQ ID NO: 206098 - RNA, 63 nt, Human; identical to SEQ ID NO: 206096

SEQ ID NO: 206099 - RNA, 63 nt, Human; identical to SEQ ID NO: 206097

SEQ ID NO: 206100 - RNA, 63 nt, Human; identical to SEQ ID NO: 206096

SEQ ID NO: 206101 - RNA, 63 nt, Human
acaccuccugucaccugagccccaggugaaggggcccgggaacaccucucaccugaacccggg

SEQ ID NO: 206102 - RNA, 63 nt, Human
ccacccgcugugcucguggacugaggcugcgcugcccgggaggccuuacugcuuggugucaga

SEQ ID NO: 206103 - RNA, 63 nt, Human
accgugcgcucccgcguggggcgccucggaugggcccgggagggcugggggcucuucccugga

SEQ ID NO: 206104 - RNA, 63 nt, Human
gaucaccacagugagcuuggcucgccucggccggcccgggaugcacucuuacaacauguguga

SEQ ID NO: 206105 - RNA, 63 nt, Human
gucucgcccgaucccaucggcaucccggggagggcccgggagccuccgucaaccguccucuaa

SEQ ID NO: 206106 - RNA, 63 nt, Human
ucuguuuccccuuggggacuucugaaccuuccugcccgggagucuguaacacagcagcacagg

SEQ ID NO: 206107 - RNA, 63 nt, Human
aacacuggugugaccugagggcagaaagguucugcccgggaaggucaccagcaccaacaccac

SEQ ID NO: 206108 - RNA, 63 nt, Human
guugggagacagaguugccucagguucccaggggcccgggaguccaaauacuggaauggaggg

SEQ ID NO: 206109 - RNA, 63 nt, Human
aagcaaggcccgaggccuugacuggugagauuagcccgggaggugguggcucccuccugcucu

SEQ ID NO: 206110 - RNA, 60 nt, Human
acaucuucuucuuggauugacggaugacggcucaccgagagcauaucuaaaaaacacucu

SEQ ID NO: 206111 - RNA, 64 nt, Human
ggaccgcagguacgagguggcucgacugcucaaccucaccgagaggcaggucaagaucugguuc

SEQ ID NO: 206112 - RNA, 64 nt, Human
agacauggugugcccugccuguggccgccccgaccucaccgaugacacacaguugcucagcuac

SEQ ID NO: 206113 - RNA, 64 nt, Human
gcacugaggcgcgggcgcccuuccaaagcacauacucaccgaauguuuacagacuggcuguccu

SEQ ID NO: 206114 - RNA, 63 nt, Human
ggaaggagacugugguuuuuguguguguggacagcccgggagcuuugagacaggugccugggg

SEQ ID NO: 206115 - RNA, 63 nt, Human
ggcacuguggucaggcccagccucucuggcucagcccgggauccugauggcacccacacagag

SEQ ID NO: 206116 - RNA, 63 nt, Human
gacuggguugcagggacuguggucucuccuggggcccgggacccgccuggucuuucagccaug

SEQ ID NO: 206117 - RNA, 63 nt, Human
cuaccuucugcccucugcgacuccagugcucuggcccgggacuccccuauccgccccucacuu

SEQ ID NO: 206118 - RNA, 63 nt, Human
ggcauccagccggaggccagagcugagcccucagcccgggaggcaggcuccaggccucagcag

SEQ ID NO: 206119 - RNA, 63 nt, Human
ugcagugaacugugauggcacaacugcauuucagcccgggagacagcaagauucugucucaaa

SEQ ID NO: 206120 - RNA, 63 nt, Human
ugugaggcaggaggcaggcgggcagaaggcccugcccgggaccucacagucccuucuuagaag

SEQ ID NO: 206121 - RNA, 63 nt, Human
ccauacgucacuauacaucugagcuuuauaagcgcccgggaggaacaaugagcuugguggaca

SEQ ID NO: 206122 - RNA, 63 nt, Human
ccagggaggcugagugaggccacgcagccgccugcccgggagaacccugccugaagcucugga

SEQ ID NO: 206123 - RNA, 63 nt, Human
gaaggagacaucugucccgucuuugagugacaagcccgggacaacagccagugggcaucacgg

SEQ ID NO: 206124 - RNA, 63 nt, Human
uggagacgcuccuagccugaguagcgccgcggggcccgggaacgccgagugcgcgccgucggg

SEQ ID NO: 206125 - RNA, 63 nt, Human
ggaggcccaaugcuucagagucaucucuguccugcccgggaugcacuuuuaaaugaagaguua

SEQ ID NO: 206126 - RNA, 63 nt, Human
gucaaggcacuaguaucagauggcaagcucagugcccgggauacccacugcuggcaggagaag

SEQ ID NO: 206127 - RNA, 63 nt, Human
uccuaaccuuccaucauccucagcuagauguaugcccgggacagggccucuguucuccagcug

SEQ ID NO: 206128 - RNA, 63 nt, Human
uacuugggaggcugagaugggaggaugucuugagcccgggagguggagguugcaaugagccaa

SEQ ID NO: 206129 - RNA, 63 nt, Human
ggaacagggagcggugugcagaggagguggccugcccgggaagccggccuuggugcugggacu

SEQ ID NO: 206130 - RNA, 64 nt, Human
ggggaccugggccucaggccugcuccaccacugacucaccgaaugaccuugggcaaggcacugc

SEQ ID NO: 206131 - RNA, 64 nt, Human
ggguggagaguccauguaacaguguagaugcagacucaccgaccgggaccucagacgcgaggga

SEQ ID NO: 206132 - RNA, 64 nt, Human
cagccgugggaggaauggagucuuugguacauuccucaccgagguuagcagcucaguuuguggu

SEQ ID NO: 206133 - RNA, 63 nt, Human
gccugacuagggagcccucccauugccuuccuggcccgggauagaagaggggagguaagucug

SEQ ID NO: 206134 - RNA, 63 nt, Human
cagggaaggggaagcaggaugcggagggccaaagcccgggaccucuacuugaacaguucuacu

SEQ ID NO: 206135 - RNA, 63 nt, Human
uaggggugaaggugggggcacagggcccaccccgcccgggaccccgggagcagaagacgcgcc

SEQ ID NO: 206136 - RNA, 63 nt, Human
uacuugggaggcugaggcauaagaauuguuugagcccgggagacagagguugcagugagccaa

SEQ ID NO: 206137 - RNA, 63 nt, Human
aacacaaguaugauaaacaggaccuagcguuuagcccgggaaaggagaaugcugcuugucacc

SEQ ID NO: 206138 - RNA, 63 nt, Human
gaggaugggagugggcagagguggcgcccaggggcccgggaacuccugccacaacagaauaaa

SEQ ID NO: 206139 - RNA, 63 nt, Human
ugaacccugacucaggacuuggacgccauaguggcccgggaccgagaccuucagcaguugagg

SEQ ID NO: 206140 - RNA, 63 nt, Human
ccugcaggagacgagcgagcgggaaggcgccgggcccgggacuguccguucucggggccagag

SEQ ID NO: 206141 - RNA, 63 nt, Human
aguuauuuuggaagguaaagccugucacuuucagcccgggacugcccagaugacugucuaacc

SEQ ID NO: 206142 - RNA, 63 nt, Human
cccgccacucucacccgacccgugcacgacgcugcccgggagggcuuccuggacacgcuggug

SEQ ID NO: 206143 - RNA, 63 nt, Human
ccugccacucucacccgaccggugcaugaugcugcccgggagggcuuccuggacacgcuggug

SEQ ID NO: 206144 - RNA, 63 nt, Human
ccaucgcuuagcauagaaaucccaaaaccuccagcccgggaacacuauaagcuucgaccauuc

SEQ ID NO: 206145 - RNA, 63 nt, Human
accacucuguccggcucccccagcucucacucagcccgggaagcaggaagccccuucugucac

SEQ ID NO: 206146 - RNA, 63 nt, Human
acacuugcuagcgguugaaucuuagagaaaaaagcccgggagggguggggagaauuucgaaga

SEQ ID NO: 206147 - RNA, 63 nt, Human
ucccugcccuccagcguuuccacugucgcccgcgcccgggaacccugacgcucagcucccgcc

SEQ ID NO: 206148 - RNA, 63 nt, Human
gagcaagcagucagcacagccugggcugcccuggcccgggauugauguagccccgguagguuu

SEQ ID NO: 206149 - RNA, 64 nt, Human
ccugugaggcccaauuccaagacagacucucguccucaccgaagcuuaggcccacaucucccag

SEQ ID NO: 206150 - RNA, 64 nt, Human
uguaugcuaggcaacaauucucccgcuccagacccucaccgaccaccuguccugggaccaggcu

SEQ ID NO: 206151 - RNA, 64 nt, Human
ccuuagccaggaggccaggcucagcccugugccacucaccgaagccacuuucuacaggccagca

SEQ ID NO: 206152 - RNA, 63 nt, Human
ugauguccagugguacgggcaggaaaaagccaagcccgggacccucgugugagccagcccggc

SEQ ID NO: 206153 - RNA, 63 nt, Human
aaaucuaacucuuccucuacaucuuacuguucugcccgggauucguauuauaaugacagaaga

SEQ ID NO: 206154 - RNA, 63 nt, Human
gaggggcaggcugcuggagccgcccucugaguugcccgggaugguagugccucugaugccagc

SEQ ID NO: 206155 - RNA, 63 nt, Human
uggcccagccucuuccugggagaugcguacgcagcccgggacaagagcaagcugauccagcug

SEQ ID NO: 206156 - RNA, 63 nt, Human
cgcacacacgcagaguucugcucccugaggggggcccgggaggggcuccagcaggaggccgug

SEQ ID NO: 206157 - RNA, 63 nt, Human
agggugggggagggagguuccucgcaggucucagcccgggacagggucuugcaagcagccucc

SEQ ID NO: 206158 - RNA, 63 nt, Human
cagcgcagcaccugaggaaaugcacuguguggagcccgggagguaauugggggugaggaagau

SEQ ID NO: 206159 - RNA, 63 nt, Human
gagaauguuggcagcucacagagagcagggccggcccgggauggggggcagguacuccccacc

SEQ ID NO: 206160 - RNA, 63 nt, Human
cucccacagaaagcggugacuucaccucauggagcccgggaagcugcucgccucggcagccau

SEQ ID NO: 206161 - RNA, 63 nt, Human
gccucggggaacuagaaccuuccaggaucuggagcccgggagagccacacugugggcuuaaug

SEQ ID NO: 206162 - RNA, 63 nt, Human
ucggagcuacugugagccccgggccagagaagagcccgggagggccaggggcgugcaugccag

SEQ ID NO: 206163 - RNA, 63 nt, Human
cugggugggaaugcgcucuucaccaggaagaaggcccgggaggaggauccgggcuuuggacuc

SEQ ID NO: 206164 - RNA, 63 nt, Human
ugcgccccacugccagcugccccuccugggagggcccgggaggagggugccacccucucccug

SEQ ID NO: 206165 - RNA, 63 nt, Human
cccuuaacccaaggagcacaggucccaccuccagcccgggagccuaggaccacucagccccua

SEQ ID NO: 206166 - RNA, 63 nt, Human
uauuugggaggcugaggcaggagaaucgcuugagcccgggaagcagagguugcagugaacuga

SEQ ID NO: 206167 - RNA, 63 nt, Human
gcgcacgccuucacguguguguaugcugugugugcccgggacccccgucuccaggggugcccc

SEQ ID NO: 206168 - RNA, 64 nt, Human
auuuugcaccuuauucagaaaauagagcaucauacucaccgagucuagucaguguagugcuuuu

SEQ ID NO: 206169 - RNA, 64 nt, Human
gggacgagccagugccgggaaggaacugccgggacucaccgagcugcacuuaacuguucucuuu

SEQ ID NO: 206170 - RNA, 54 nt, Human
uccgcuugaaugcuguguaacacacucaccgagaggaaaaaggcuucuccacaa

SEQ ID NO: 206171 - RNA, 63 nt, Human
uggccaggagcccuggcccgcaagagggacagagcccgggagagacucgcucacucccauguu

SEQ ID NO: 206172 - RNA, 63 nt, Human
agcucuuccccaaagcuuggaggaacgggggaggcccgggaaugucccugucugcacgaccug

SEQ ID NO: 206173 - RNA, 63 nt, Human
augcugcuucgagugcacacggugccucuggaugcccgggauggcaaugagguggagccugau

SEQ ID NO: 206174 - RNA, 63 nt, Human
aagcaaaagcuggaagaucgccucgcagcugcugcccgggaaaagcuggcccaggcgucuaag

SEQ ID NO: 206175 - RNA, 63 nt, Human
cguggaggugccgugcuuuaaagaggccuuagugcccgggaugggcacaguguuuugaaggga

SEQ ID NO: 206176 - RNA, 63 nt, Human
acugaaguccucuucuggaagcugcagaugggggcccgggaggcacacacgagucugggacuc

SEQ ID NO: 206177 - RNA, 63 nt, Human
ucucaaaccuguggggaaggagguuuucucccugcccgggaagaggacagauaacugauuucc

SEQ ID NO: 206178 - RNA, 63 nt, Human
uggcagagggaccagaaccucccacucagacuggcccgggagguucucccagacauuuugccc

SEQ ID NO: 206179 - RNA, 63 nt, Human
agaggcacagacuaugaaaagcugaguuagugcgcccgggacgccaggcaagcagcuuuuaca

SEQ ID NO: 206180 - RNA, 63 nt, Human
cggugcgugugacgcugggcucuguggcucugugcccgggaggccugcuggccccgccucggc

SEQ ID NO: 206181 - RNA, 63 nt, Human
ccuuccccuaagccagcacugcugcucccuggagcccgggaaggaggcugccuggcuggaggc

SEQ ID NO: 206182 - RNA, 63 nt, Human
uggauugcagccccgaggcugagaccagacaaagcccgggaggcagaaagaugcuccaagaac

SEQ ID NO: 206183 - RNA, 63 nt, Human
ggcacuagaacgucucacacucagagccggcuggcccgggagcuccuugccugccacuucuuc

SEQ ID NO: 206184 - RNA, 63 nt, Human
gggaccucugcccgagaccugcucagagagauggcccgggacaagccacgccuccuagcugcc

SEQ ID NO: 206185 - RNA, 63 nt, Human
gcgcugcaguucaccgaccuggccuucaagcaggcccgggacggcugcccggagcccucggcu

SEQ ID NO: 206186 - RNA, 63 nt, Human
cuucugacacgggcuccaaccccaccugaccaagcccgggacagucaaggcuucucaauuugu

SEQ ID NO: 206187 - RNA, 64 nt, Human
acacagaggaggaagacagcagccuggcagcagccucaccgaagagaggaaccaccacacccag

SEQ ID NO: 206188 - RNA, 64 nt, Human
cugaaacacccacuguguuuugcucacucccucacucaccgaucaaaaccugcuaccuccccaa

SEQ ID NO: 206189 - RNA, 64 nt, Human
caccucugagauggaauugauaacauggucuuaacucaccgaaauaaacaagcacguggugaga

SEQ ID NO: 206190 - RNA, 63 nt, Human
ucuccaugcucccagauucucgaccuucccccggcccgggaggugcagccugcgucugccucu

SEQ ID NO: 206191 - RNA, 63 nt, Human
cccaccagagggacgugugugugccugcagacggcccgggagcugugugucuccgccagaguc

SEQ ID NO: 206192 - RNA, 63 nt, Human
ugugaagggugccgcgagccaggcugaccaggcgcccgggauccagcucauccccuuggcugg

SEQ ID NO: 206193 - RNA, 63 nt, Human
ccaagcggcucaagaauaaaauaugaauugagggcccgggacgguaggucaugucuguaaucc

SEQ ID NO: 206194 - RNA, 63 nt, Human
cggcagaugcuugcccaguaguucuggaggaaggcccgggaaucugcaaaugagcgcauuccc

SEQ ID NO: 206195 - RNA, 63 nt, Human
gagggcagggacagggagggagccacagucagugcccgggaaccuggaagcugcgcugcucug

SEQ ID NO: 206196 - RNA, 63 nt, Human
cuuccggcccaucuaucgggcaccggggcuccggcccgggacccaggaccagcaacccgcgac

SEQ ID NO: 206197 - RNA, 63 nt, Human
cgugcugcuccuuugcuucggaccuccgccucugcccgggagaaagcccaggccagccugcug

SEQ ID NO: 206198 - RNA, 63 nt, Human
auuaguggaggccacaguuguagcaggcgcuaggcccgggaggagagugcauggugcagaggg

SEQ ID NO: 206199 - RNA, 63 nt, Human
cuggccucucucugccccaggagcgugcaccgagcccgggaggcugcccugagcaggagcaug

SEQ ID NO: 206200 - RNA, 63 nt, Human
uuucccuuccuuccucuccugucucccuccucugcccgggagcucaggaaccgaggcagggaa

SEQ ID NO: 206201 - RNA, 63 nt, Human
ggagcggcgggggcggcgcgcagggcccacugugcccgggacaaccgcagcgucgccacagug

SEQ ID NO: 206202 - RNA, 63 nt, Human
gcaaggcagacaguggcuggcaggggggcccaggcccgggacgaggccuccccuucagcucag

SEQ ID NO: 206203 - RNA, 63 nt, Human
ccuugaaucucuacguggccacugaacugcugggcccgggagacuggacuacaacaccucaca

SEQ ID NO: 206204 - RNA, 63 nt, Human
cgcggcggcucuggaagcuggacgcggaccacggcccgggagcuagaaacugaacgcccgcau

SEQ ID NO: 206205 - RNA, 63 nt, Human
uccuuagccgggaagcuggcagaggagagccgugcccgggaauaggaggaggcagcaugccga

SEQ ID NO: 206206 - RNA, 64 nt, Human
agccggucgggucaucugccucugagggaccguccucaccgagcuccugcaucccuugaguguu

SEQ ID NO: 206207 - RNA, 64 nt, Human
ggagacgucucccacgaggccaaggccuccaaugcucaccgaugcccucugcgaagcuggggua

SEQ ID NO: 206208 - RNA, 64 nt, Human
auugauaauuguauuauuuucuccgaaaacuucacucaccgaaaggucgauagauugaggcuac

SEQ ID NO: 206209 - RNA, 63 nt, Human
augaugcagcuggcccgagagcugaagacccuggcccgggaccuuggcauggcagugguggug

SEQ ID NO: 206210 - RNA, 63 nt, Human
uacuagggaggcugagccaggaggaucacuugagcccgggagguugaggcugcaguggggggu

SEQ ID NO: 206211 - RNA, 63 nt, Human
cugggccacauggcagcccagggggcaggagaagcccgggagaggcccacuggcuaccagacu

SEQ ID NO: 206212 - RNA, 63 nt, Human
cagggcuccagcacuaccaaguuggaauuccacgcccgggagugggguagaggaagacgagac

SEQ ID NO: 206213 - RNA, 63 nt, Human
agagggcccugagagaggagcgugccacccacagcccgggaagccgggccccagcaccccucu

SEQ ID NO: 206214 - RNA, 63 nt, Human
uccacucccagggagaacgggaaguggaccccagcccgggagccugcuggaccccagaucguc

SEQ ID NO: 206215 - RNA, 63 nt, Human
augaacaggacauggggcuccuggaaagaaagggcccgggaaguucaaggaagaauaaaguug

SEQ ID NO: 206216 - RNA, 63 nt, Human
accagcugaggcugaggcaggagaaucccuugagcccgggaggcggagguugcagugagccaa

SEQ ID NO: 206217 - RNA, 63 nt, Human
uagguuuuuuuccuucugaaguguuucacgagagcccgggagcugcugcccugcggccccguc

SEQ ID NO: 206218 - RNA, 63 nt, Human
cuacuacugugacggcauuuccaucccuccccugcccgggaagggaccuugcagggaccucuc

SEQ ID NO: 206219 - RNA, 63 nt, Human
ucugccugggcaggacacgguuuccucuugcuggcccgggaggaguuaacuuugcgccggccg

SEQ ID NO: 206220 - RNA, 63 nt, Human
gccaguagggggccaggccucccacuccucccagcccgggagaugcuccgcguggcaccaccc

SEQ ID NO: 206221 - RNA, 63 nt, Human
gagggaggggaggacccauggcucuccccccuagcccgggagaccagggccuuccucuuccuc

SEQ ID NO: 206222 - RNA, 63 nt, Human
uucggggagcccuacccgccaaaccugcuguuggcccgggagagccccagaggcucccggaga

SEQ ID NO: 206223 - RNA, 63 nt, Human
uccccaccaccugugccccagagagcagggccugcccgggaagguggcguccuggagucgagu

SEQ ID NO: 206224 - RNA, 63 nt, Human
agagcccuggcccccagcccccagcaagccugagcccgggaagaaccagaggcccucccgaga

SEQ ID NO: 206225 - RNA, 64 nt, Human
uuagguuguggaguggcugagagggcccaggagggcucgggacagcugugugcugcaugggguu

SEQ ID NO: 206226 - RNA, 64 nt, Human
gcucugcccucuggguccacaugaggacagggaagcucgggaaggggaagggagacuggcccug

SEQ ID NO: 206227 - RNA, 64 nt, Human
gcgcgccuccuggacucaggguuccccguccugagcucgggagauguucagagucacacugccg

SEQ ID NO: 206228 - RNA, 64 nt, Human
ggucuagaaggacccacugcaccacccuccgcuggcucgggaagacaccgugcccgccccaaga

SEQ ID NO: 206229 - RNA, 63 nt, Human
cacggccccacccacagggaccucaacuucugggcccgggauuuuuucccuauucagcagcau

SEQ ID NO: 206230 - RNA, 64 nt, Human
gucuacguaugugcaaguauaucccagggcaugugccccgcaggggccuagagggugggggcca

SEQ ID NO: 206231 - RNA, 64 nt, Human
gccacgccugcgaggcguuggauaagccuggggagccccgcauggaccgcggcuuccgccgggu

SEQ ID NO: 206232 - RNA, 53 nt, Human
cuagccccccacacccuugauccgccccgcaggcagguacuucccggagcgag

SEQ ID NO: 206233 - RNA, 64 nt, Human
caggccuaaguauguggagcucugcuuuggcacugccccgcagaggccacgccuauuuauucug

SEQ ID NO: 206234 - RNA, 64 nt, Human
aaccuguccccaaauuggccucgguggcaggggagccccgcagagcuggacagcgacacgcagg

SEQ ID NO: 206235 - RNA, 64 nt, Human
aauauauuuuuuacaagccccagcuccucuucuugccccgcauauccagcuccucacucagcuc

SEQ ID NO: 206236 - RNA, 64 nt, Human
uccacccuuguuccccacccccacccccacucccgccccgcacccccaaguugggacgccuugu

SEQ ID NO: 206237 - RNA, 64 nt, Human
uuuugguacccgguugcuacggugaaaugaaggugccccgcauccagaaagacgcacuccugga

SEQ ID NO: 206238 - RNA, 64 nt, Human
uuuucuuuuuuucucugcauaaauggcuugagcauacuggcauuuacacagaaaugauauaugc

SEQ ID NO: 206239 - RNA, 64 nt, Human
ugugcccccuaugcccuguggcauuucugcgucuuacuggcaaccacacaacucagggaaagga

SEQ ID NO: 206240 - RNA, 64 nt, Human
uuguaguucacuuugacucuugaaugugucacuuuacuggcaagagacuuccuuugauuucuac

SEQ ID NO: 206241 - RNA, 64 nt, Human
cgggauccccaugcaccuuguccuucuccacugauacuggcagcucggcuccuggacccaagau

SEQ ID NO: 206242 - RNA, 64 nt, Human
gcaacccagcaccugguaggcuccauuucuucccaagcccgagcagagggucaugcgggcccca

SEQ ID NO: 206243 - RNA, 64 nt, Human
gccuguuugagggcucacgaccccugcagcaaagaagcccgagacugauuccuuuagaauuaac

SEQ ID NO: 206244 - RNA, 64 nt, Human
ugauggccagcaaaugaaauucugccuagaaauuaagcccgagcuguuguauauugagguguau

SEQ ID NO: 206245 - RNA, 63 nt, Human
cugcugacccccuccuccagagcagccagcccagcccgggaacaagacggacuuccucucccu

SEQ ID NO: 206246 - RNA, 63 nt, Human
acgccaagggcagguuucuggagacucccuugugcccgggauggcaagggcaccgggcuggcg

SEQ ID NO: 206247 - RNA, 63 nt, Human
ugcaggcugggagaccagguccucugugcaugggcccgggaggcagaccugccccaaggguga

SEQ ID NO: 206248 - RNA, 63 nt, Human
gacagaaaagcucagggcgggucuucuccuugugcccgggauugggcuaugcuggguaccacc

SEQ ID NO: 206249 - RNA, 63 nt, Human
uacucgggaggcugaggcaggagaaucgucuaagcccgggagguggagguugcagugagccca

SEQ ID NO: 206250 - RNA, 63 nt, Human
cacccccagggcaggauggggacaggaucaccugcccgggacaccaccauuaucauucuccuc

SEQ ID NO: 206251 - RNA, 63 nt, Human
ugggccgcccuucccggggaggcaagauugagggcccgggagagggaggcccgagcugccacc

SEQ ID NO: 206252 - RNA, 63 nt, Human
ccgcagcacgagugucucgggcugcccggagucgcccgggagcaggugcugcagccagaguua

SEQ ID NO: 206253 - RNA, 63 nt, Human
ccaccacccccuccccucaccgccucccagguggcccgggagcugcagguggggauggcuuug

SEQ ID NO: 206254 - RNA, 63 nt, Human
acagugagagcagggcugggcgccucuguccuggcccgggagccgcaggggccccuccuccag

SEQ ID NO: 206255 - RNA, 63 nt, Human
gcuggagagugcguggccauagggagccgacaugcccgggaggaaagguguugauuacaugga

SEQ ID NO: 206256 - RNA, 63 nt, Human
gaggcgucuugccaggaaccucaggaggagggggcccgggaccugugugggaccuguguccug

SEQ ID NO: 206257 - RNA, 63 nt, Human
ggccagugcaaggccacugccugccgaggacgugcccgggaccgugcagucugcgcuuuccuc

SEQ ID NO: 206258 - RNA, 63 nt, Human
ucuccccagcgagggccccagcgugaagccagggcccgggaagcaaaugcgagccuguaagau

SEQ ID NO: 206259 - RNA, 64 nt, Human
cuugagaugacugugguccccccuuagacucccuaagcccgagugagcucaggugucacccugu

SEQ ID NO: 206260 - RNA, 64 nt, Human
gaggagggauagagacgcagauuucagauguaagaagcccgauccacauugcauaaguggaccc

SEQ ID NO: 206261 - RNA, 64 nt, Human
cuggaguucccacgugucccggggcuuuuccaggaagcccgagcccaggaccuguuggcagagu

SEQ ID NO: 206262 - RNA, 64 nt, Human
aagagccuuggugucuguccuaauuccuuucucacucaccgaugcugaauacccaguugaauca

SEQ ID NO: 206263 - RNA, 58 nt, Human
gcaaaggaaguaaaauaugagccaucuucucaccgaacuuugaagcaugcacagcaug

SEQ ID NO: 206264 - RNA, 64 nt, Human
gcugugcuaaauuaggauuugagggugugggacccucaccgaauucauugauuacugaaaauug

SEQ ID NO: 206265 - RNA, 64 nt, Human
aaacaaaaaaaagauacauaugccuuguaaauggcucaccgaguggucaguagucacuucaacu

SEQ ID NO: 206266 - RNA, 64 nt, Human
gagaguucuugcucucgaccuagugguuucuacucucaccgacuuauucugauuucagaaauaa

SEQ ID NO: 206267 - RNA, 64 nt, Human
cccuuggaauugcaucccaaggcaaagcuuuuggcucaccgaaagcucacagauugcagaaauu

SEQ ID NO: 206268 - RNA, 64 nt, Human
uuaaccuuuuuugcacagcagucucugcaauuagcucaccgaccuucaacuuugcuguaaaccu

SEQ ID NO: 206269 - RNA, 64 nt, Human
gcaguacccuacccugauuguagggucucauuuucucaccgauauuaguccuacaccaauugaa

SEQ ID NO: 206270 - RNA, 61 nt, Human
gcaaggaggccuacaucuagggugggggccacucaccgacccgacacucucaccccccgac

SEQ ID NO: 206271 - RNA, 61 nt, Human
agaaaugcuuuaaacucugaagacaggauaccucaccgaagaagccacacugauccaagau

SEQ ID NO: 206272 - RNA, 64 nt, Human
aggcaguggcgggcuccccgaugggacauaaaaccucaccgaagauggaugcuuaccccuugag

SEQ ID NO: 206273 - RNA, 64 nt, Human
acccagcuucccuccacuuccagguggugcugggcucaccgagggagcacuggugggugcucug

SEQ ID NO: 206274 - RNA, 64 nt, Human
caacagcaguggggcuaauuacccggaauacggucucaccgaugcaguuuucauggacauagaa

SEQ ID NO: 206275 - RNA, 64 nt, Human
uguugcaguguauaagguggaagccuaaagaaaucucaccgaaacuuacugcugaaugauuaca

SEQ ID NO: 206276 - RNA, 64 nt, Human
cggagucucccacagggaggccauuccccuucuacucaccgacaucccucccagcaccacacac

SEQ ID NO: 206277 - RNA, 64 nt, Human
uuugagaaguaaacagauggcacuuugaaggggccucaccgagugggggcaucaucaaaaacuu

SEQ ID NO: 206278 - RNA, 64 nt, Human
guccccagccauggacucuauacagugagggccacucaccgaccugagucaguguccucugucu

SEQ ID NO: 206279 - RNA, 64 nt, Human
gcaucccccuccucucccuguuagaaauguuagugccccgcacugugccccaaguucuaggccc

SEQ ID NO: 206280 - RNA, 64 nt, Human
ucuguugguuccaucagccagagcucugccaaaggccccgcagucccucucccaggaggacccu

SEQ ID NO: 206281 - RNA, 64 nt, Human
aaugcaggugguaggggcacugacccaccccuacgccccgcacagucaaaaaucugcauauaac

SEQ ID NO: 206282 - RNA, 64 nt, Human
ggcugaagggaagcccagccugcaucuagcuggagccccgcagggaggggcaugguccugcuga

SEQ ID NO: 206283 - RNA, 64 nt, Human
agucucucucugucacccaaguuggagugcaguggccccgcaaucucggcucacugcaaccucu

SEQ ID NO: 206284 - RNA, 64 nt, Human
gcagcuggcauggucagguaacacuaguggcccagccccgcagacccacaagcccuacccgugc

SEQ ID NO: 206285 - RNA, 64 nt, Human
cuggacgcucuucaggacguuucaccgcccccucgccccgcaccuccagccuucccgacucgca

SEQ ID NO: 206286 - RNA, 64 nt, Human
ggaggccucggggaguggcuuuuccagcucucaugccccgcaguguggaacaaggcagaaaagg

SEQ ID NO: 206287 - RNA, 64 nt, Human
ucgugccguuuaagcuuugcuugcaagaguggaugccccgcaaucguuccugcucucccgggcc

SEQ ID NO: 206288 - RNA, 64 nt, Human
gcccugcagcccccacucagccggcagccagauggccccgcaaggccuccagggauggccccua

SEQ ID NO: 206289 - RNA, 64 nt, Human
ccugcuuaaugguaacugaccaguguuacccugagccccgcaggccaacccauccccaguugag

SEQ ID NO: 206290 - RNA, 64 nt, Human
agguugccggggguagggguggggccacacaaaucuccaggagccaccacucaacacaauggcc

SEQ ID NO: 206291 - RNA, 64 nt, Human
cuguccccagcggugacgggagguguccuggcugcuccaggacaaaagacaaucgucucugugg

SEQ ID NO: 206292 - RNA, 64 nt, Human
ugggggucuuccuccaccucccacuuuccaagggcuccaggaaucuggggccugaccacagauu

SEQ ID NO: 206293 - RNA, 64 nt, Human
gcaggguguugggauacugcagggccaggacugagccccgcagaccuccccagccccuagccca

SEQ ID NO: 206294 - RNA, 64 nt, Human
gccagcccuggcccaccccccagccuccagagaagccccgcacgggcugucuggguguccgcca

SEQ ID NO: 206295 - RNA, 64 nt, Human
uguaaaaaagaaaaacaaguuugcuagugacuaagccccgcauaugugagugaaaguacuucag

SEQ ID NO: 206296 - RNA, 64 nt, Human
uuuucuggcuguaaaugguuaccuuccuguaacugccccgcaccuggaggcauggaguugugug

SEQ ID NO: 206297 - RNA, 64 nt, Human
ggguggggcccagacaccagccuagccuggcucugccccgcagacggucugugugcuguuugaa

SEQ ID NO: 206298 - RNA, 64 nt, Human
gacuugacuccuguggcuucuggaccccuccucugccccgcaggaggaaguuccacggcaggug

SEQ ID NO: 206299 - RNA, 64 nt, Human
uugaaaaguggaggaaagaaaagcccuucuccuugccccgcacacauuucacucccacuguacu

SEQ ID NO: 206300 - RNA, 64 nt, Human
aucaccacugcccuaugacucucuugguuauaaugccccgcaucaucccuuugcugguuaccca

SEQ ID NO: 206301 - RNA, 64 nt, Human
gcucgcaagguaaucucgcuccgcgcagcugagcgccccgcaucucgcgccugcuacaucaaag

SEQ ID NO: 206302 - RNA, 64 nt, Human
gguauguauggauuuaaucuaaucuaauaauugugccccgcaguugugccaaagugcauagucu

SEQ ID NO: 206303 - RNA, 57 nt, Human
ucccugauaacugcgucuaagaccagagccccgcagccccuggggccccccggagcc

SEQ ID NO: 206304 - RNA, 64 nt, Human
cugugccaguagccuaggugucucaggccccugggccccgcagauggccauuuccggugccugc

SEQ ID NO: 206305 - RNA, 64 nt, Human
gugaugcuaccucuccucccgucccucuccaggggccccgcauacacacggccaugcacgcaca

SEQ ID NO: 206306 - RNA, 64 nt, Human
caaggacccagccugagauggucccaucugcagggccccgcaccaguuggagcagaugccuccc

SEQ ID NO: 206307 - RNA, 64 nt, Human
uaauccauccaccagagucuagaaggccagacgggccccgcaucugugaugagaauguaaaugu

SEQ ID NO: 206308 - RNA, 64 nt, Human
guggugacuuuguuuuccugcggggcucagcccccuccaggaugcagcccccucccccgcaccc

SEQ ID NO: 206309 - RNA, 64 nt, Human
cgggacacagcggagucagggccagagcccuucccuccaggaacugauccuugggaaaacagcc

SEQ ID NO: 206310 - RNA, 64 nt, Human
ugcccuccgcugcuccucuguccugcuagccuuccuccaggaagcacacugggugcagauaauc

SEQ ID NO: 206311 - RNA, 64 nt, Human
ggagucaggggcauggcucuggcaggccgggauggccccgcagccuucagccccuccuugccuu

SEQ ID NO: 206312 - RNA, 64 nt, Human
gccugcuucccucagaggaccuuccaauccauuugccccgcaacccuggcugcuccgacagggg

SEQ ID NO: 206313 - RNA, 64 nt, Human
ccucacacagaauugcuacaaucccaaagcgcucgccccgcaggguccaaaggccagcggugac

SEQ ID NO: 206314 - RNA, 64 nt, Human
aggcuaagccugcaguaggaucucagccacaagggccccgcaggauggagcugggucaaggacc

SEQ ID NO: 206315 - RNA, 64 nt, Human
ucaucgggcgggugaacgcagacccugacuaccugccccgcaccauggacuuuggccucaacgu

SEQ ID NO: 206316 - RNA, 64 nt, Human
cugcccuuuccuuccuuccuuuucucucuucuccgccccgcacuccguuucccgguuucccccc

SEQ ID NO: 206317 - RNA, 64 nt, Human
auuguuuagccccaagcaagauuuaucuccuccugccccgcauguguauggugggccucuguaa

SEQ ID NO: 206318 - RNA, 64 nt, Human
ccgugacuugcauguuugcuucugggacgucugugccccgcaaguguuugaguuuggccuccac

SEQ ID NO: 206319 - RNA, 64 nt, Human
cugagccgggagggucgaacgcccagggcacugcgccccgcaacugacgcuccugcaaggaaaa

SEQ ID NO: 206320 - RNA, 64 nt, Human
gccacucgaugccuaaccuaccuuccacaagccagccccgcaucccugcucccgcaguguaagu

SEQ ID NO: 206321 - RNA, 64 nt, Human
auacuguugucuauaauggggaaaaaggacauuggccccgcagugcccugccccagucagccug

SEQ ID NO: 206322 - RNA, 64 nt, Human
ugcaccugcagggaggcagccaggacggccggcugccccgcaccaucccucuccccagcugcaa

SEQ ID NO: 206323 - RNA, 64 nt, Human
ccagagcaucugccccagguacaccucccccugcgccccgcacgacugcgggagccagacuguc

SEQ ID NO: 206324 - RNA, 64 nt, Human
gggccccgcgcgcuccuggguccccggcaccccggccccgcagcgcgacucgcccuccagcccc

SEQ ID NO: 206325 - RNA, 64 nt, Human
cggugcuucccuccucgggcugugggcacauggggccccgcagguuccuuggaggagcccugag

SEQ ID NO: 206326 - RNA, 64 nt, Human
cugucuggaaguguuaaguggaaugggcuuuguccuccaggaggugggggaaugugguaacauu

SEQ ID NO: 206327 - RNA, 64 nt, Human
ccaucagcacaaggaaaaccaggagagagucugccuccaggacucugagccuucugccucguau

SEQ ID NO: 206328 - RNA, 64 nt, Human
ucaaguaugcaaccagaacacaggagaagaaaagcuccaggaucccuguccccaucuguccucu

SEQ ID NO: 206329 - RNA, 64 nt, Human
uguuuacaagcuggacucagggauccuccuggccgccccgcagggggcuuggagggcuggacgg

SEQ ID NO: 206330 - RNA, 64 nt, Human
ccuguuacacacagacccacaggcagccgucugugccccgcacacauuguugguccuauuugua

SEQ ID NO: 206331 - RNA, 64 nt, Human
aggcccggaaagguacgcaggugacgccuuagcagccccgcagcuggugcucugccccgcggua

SEQ ID NO: 206332 - RNA, 64 nt, Human
uuaaaaucacaccaguggcuuugauguuguuucugccccgcauuguauuuuauaggaauaguga

SEQ ID NO: 206333 - RNA, 64 nt, Human
cacuuuuccaccugggagccugugcccucagaccgccccgcaccagagccacgggcuguggggc

SEQ ID NO: 206334 - RNA, 64 nt, Human
ccaggcugggccugucacuggcauaggaaggccagccccgcaucucccacugccaacagcugaa

SEQ ID NO: 206335 - RNA, 64 nt, Human
auggagggaggccgaccgccuccucagucugugggccccgcaggugcagcagcccaggcccagg

SEQ ID NO: 206336 - RNA, 64 nt, Human
ccccuuugcccugcaguggaaugagggccccucagccccgcauugaucuaaauaaaggacugcc

SEQ ID NO: 206337 - RNA, 64 nt, Human
uuccuucuggccccucugaggauucccuagggcugccccgcagaggggcuuccccaagcucugu

SEQ ID NO: 206338 - RNA, 64 nt, Human
cuuggccucacucagguucacuucuggggagucggccccgcagcuucuuucacucaguuuuacu

SEQ ID NO: 206339 - RNA, 58 nt, Human
cgcccccgcccgcgcagugacgucuccagccccgcagcccggcccgggguaggugcgc

SEQ ID NO: 206340 - RNA, 51 nt, Human
ggaacagcuccguguacugaggccccgcagcucuggccacagggaccucug

SEQ ID NO: 206341 - RNA, 64 nt, Human
uugaccaggaagcugccaucagggaucuuccccugccccgcaaagcuaggcuccagcugcaggc

SEQ ID NO: 206342 - RNA, 64 nt, Human
cuccccuuaguccguccucccaccgccgggcccugccccgcaucccggccuuaugcacugcccc

SEQ ID NO: 206343 - RNA, 64 nt, Human
guucagggagaagggggugcaggaggcagagggugccccgcagggagcugguggcuccagcccc

SEQ ID NO: 206344 - RNA, 64 nt, Human
ccuaggcgggaugggcucgcugaaccucgaggaacuccaggacgaggaggacaugggacuugcg

SEQ ID NO: 206345 - RNA, 64 nt, Human
uugacauuuccuaccuuuugaggacuugauccuucuccaggaagaaggugcuuucugcuuacug

SEQ ID NO: 206346 - RNA, 64 nt, Human
ggagggggaggcgccaagguggaggagcuucccacuccaggacuguugaugaaagggacagauu

SEQ ID NO: 206347 - RNA, 64 nt, Human
gggguguggggggcgcagggguguggcuuagcuggccccgcacccaggccggggaggcucaagu

SEQ ID NO: 206348 - RNA, 59 nt, Human
ccaagcgcagacaugagugauggcgcccggccccgcaccugccauuugcacgcccggcc

SEQ ID NO: 206349 - RNA, 64 nt, Human
uugccucauuucauccuugcaacagcucugcagggccccgcagaugaggaaauccguaggcagg

SEQ ID NO: 206350 - RNA, 50 nt, Human
gccccaccaucaccgagugagccccgcagccggcugcggaccccaucggc

SEQ ID NO: 206351 - RNA, 64 nt, Human
cuggcuggugccugagccccucagacagcccccugccccgcaggccugccuucucagggacuuc

SEQ ID NO: 206352 - RNA, 64 nt, Human
agccuucaaagucuaccagcacaaagaccccugagccccgcaauugugaucccacaagacaugc

SEQ ID NO: 206353 - RNA, 50 nt, Human
ucgaggacuuuaccugcugagccccgcaggccgcugaaccaaaggccuag

SEQ ID NO: 206354 - RNA, 64 nt, Human
uuuuuccacagauccagugggguccggacacugggccccgcaggcgaaagcacguuccagccac

SEQ ID NO: 206355 - RNA, 64 nt, Human
cuguugaagcacuguacaaguuugugguuccuaagccccgcagugaauguucaaagccagagca

SEQ ID NO: 206356 - RNA, 64 nt, Human
cccagcgcacacacaucucccccagggucccaaggccccgcagcuuccucccccgaccaaaccc

SEQ ID NO: 206357 - RNA, 64 nt, Human
uaaaggaaguugagagucuuuagaccugugcacagccccgcaccaaggggugcuguaugcucua

SEQ ID NO: 206358 - RNA, 64 nt, Human
cuacucugcugggcucccugggucucugcccaaggccccgcacacacugggaccuagcauaguu

SEQ ID NO: 206359 - RNA, 64 nt, Human
cuuugguuuuaccgccugcaaccucacugugcccgccccgcaccaugcccuagccccaggucua

SEQ ID NO: 206360 - RNA, 64 nt, Human
ucuucacuuggaucaaaagcaaaacagucucuccgccccgcaccagaucaaguaguuuggacau

SEQ ID NO: 206361 - RNA, 64 nt, Human
aggcgagggccaauucaaccccauucuuuccagcgccccgcaccauagcaccugcccaccugag

SEQ ID NO: 206362 - RNA, 64 nt, Human
ugcugcauugaguccagcuuuccuucugcccuuccuccaggagaaggggcccaagguccccgug

SEQ ID NO: 206363 - RNA, 64 nt, Human
gcucccuuggauacugcaccuugggucccacuuucuccaggaugccaacugcacuagcugugug

SEQ ID NO: 206364 - RNA, 64 nt, Human
uccacggcucuagguggggcgggaaagccagugacuccaggagaggagcgggaccuguggcucu

SEQ ID NO: 206365 - RNA, 64 nt, Human
uauucacugcacccugucacacccagcaccccccgccccgcacauuauuugaaagacugggaau

SEQ ID NO: 206366 - RNA, 64 nt, Human
gcugaggggggccucuuuuucucucggcgaccccgccccgcacgcgcccuccccucugaccccg

SEQ ID NO: 206367 - RNA, 64 nt, Human
ccgccucucacacuccgauuucugcugcucugcugccccgcagucuuuucccuuuauuugcuuc

SEQ ID NO: 206368 - RNA, 64 nt, Human
caggccgagaggagcuaagcgcgcgggccccggcgccccgcaccuguacaguggaaccguugcc

SEQ ID NO: 206369 - RNA, 64 nt, Human
aacugccccucaaguucaaccccgggaccgcccagccccgcaaagcaaagacccugacuucucc

SEQ ID NO: 206370 - RNA, 64 nt, Human
uucaaggaccacucagcccccgguguccagcgcagccccgcagagcuccaggguggccaagugg

SEQ ID NO: 206371 - RNA, 64 nt, Human
cacggggugcagaucuccuggcguguccaccauggccccgcagaacgccagggaccgccugcug

SEQ ID NO: 206372 - RNA, 64 nt, Human
cacccggagggacggcagccccggucgcgcgcuggccccgcaggaccuuccuuuuccaggaaga

SEQ ID NO: 206373 - RNA, 51 nt, Human
agacaguccaggccaaguagagccccgcagggccuccagcagggucagcca

SEQ ID NO: 206374 - RNA, 64 nt, Human
cgccaaggacgccuaccccgaaaccggccccgacgccccgcagaggcccgccugaagccagccc

SEQ ID NO: 206375 - RNA, 64 nt, Human
cugugggcuuuucauacuugccuacugggcccuggccccgcagccuuccuaugagggauguuac

SEQ ID NO: 206376 - RNA, 64 nt, Human
caaaaguaagagacuccagcauggccuucuguuugccccgcaguaaaguaacuuccauauaaaa

SEQ ID NO: 206377 - RNA, 64 nt, Human
uaguccugaguccucccugccugagaggccacuggccccgcagcccuugggaggcccccgugga

SEQ ID NO: 206378 - RNA, 64 nt, Human
ccuccgaccacagucggcggcaccuucucagagugccccgcacucaccuggggguuggggcagu

SEQ ID NO: 206379 - RNA, 50 nt, Human
gcaaaugcaccauccugugagccccgcacccggccccucucacaccaucc

SEQ ID NO: 206380 - RNA, 64 nt, Human
uguggcucuacaacugaguccuuaaacagggcaucuccaggaaggcggggcuucaaccuugaga

SEQ ID NO: 206381 - RNA, 64 nt, Human
aaucagccaggcugagcccccaccccugccccagcuccaggaccugccccugagccgggccuuc

SEQ ID NO: 206382 - RNA, 64 nt, Human
aggcagcaccaggccccagcucccuccgggggcccuccaggaaccaccaagcucucucacgacc

SEQ ID NO: 206383 - RNA, 64 nt, Human
ucacagagcugaugguccaauaaggggggugugagccccgcagggacuggcccgcaccugccuu

SEQ ID NO: 206384 - RNA, 64 nt, Human
gcagacuuucugcauuugagaaacaugacaaagggccccgcagcccuucugcacccagcacagc

SEQ ID NO: 206385 - RNA, 64 nt, Human
guuugcaccucggcccuggcugcccaccaucagugccccgcagucagcagccauuccuggcagu

SEQ ID NO: 206386 - RNA, 64 nt, Human
gcccagagcugggugaguggggagacaccucagagccccgcaaaacccacugaccggaggcaaa

SEQ ID NO: 206387 - RNA, 64 nt, Human
ucacucgccggggcacggggcgucggcugcugcggccccgcagugugaacguuggcugcugccu

SEQ ID NO: 206388 - RNA, 64 nt, Human
gagcggggaugagcuaaagauacaauguuucccugccccgcaccgcuuccacaaaauagcaaug

SEQ ID NO: 206389 - RNA, 64 nt, Human
ggggguggcgcuucucagccggcugucccagccagccccgcagagcgcccacggacagugucca

SEQ ID NO: 206390 - RNA, 52 nt, Human
aggcgcagacccggcucugagcgccccgcagcccggccgccgccgccaagca

SEQ ID NO: 206391 - RNA, 64 nt, Human
gagacgcccagauggagggggaggcugaccaagggccccgcagggcgggcugcaacuuuucugu

SEQ ID NO: 206392 - RNA, 64 nt, Human
cccaggcccgcgcccgcacgcacgcacgcacacggccccgcacacagccccgccccaccccgca

SEQ ID NO: 206393 - RNA, 64 nt, Human
agccaagcugcuucccgccuagacucggcgcagggccccgcaccggugaggaaggugcuuuugg

SEQ ID NO: 206394 - RNA, 64 nt, Human
guuuggggaggggggcggugaggugggggcagcggccccgcaccccuccuccuugcugauuugc

SEQ ID NO: 206395 - RNA, 64 nt, Human
uuauuuuugcaaaacgucgaucuccuccucccccgccccgcauccgcgaaggcuuuuaauggga

SEQ ID NO: 206396 - RNA, 64 nt, Human
cucuuucuggagagccccaagggcccccuagccagccccgcacacacucaacucugauacucca

SEQ ID NO: 206397 - RNA, 64 nt, Human
gccacgccugggaggggcccagcugggguuacuggccccgcaugagccucggccaucucucccu

SEQ ID NO: 206398 - RNA, 64 nt, Human
ccacagccuggcuggcagcugcucuguggaggaccuccaggacugagacugggcucuguuuucc

SEQ ID NO: 206399 - RNA, 64 nt, Human
ggagaggcauggagaagaaacucucauucaggggcuccaggauccuucuccuugaggcuucuaa

SEQ ID NO: 206400 - RNA, 64 nt, Human
cucauuccuugugugugucuuggagugcauuugacuccaggaaaagccauuuugguuuuccuua

SEQ ID NO: 206401 - RNA, 64 nt, Human
ggggccgcuguggucuggcccccucccuguccaggccccgcaggaggcagaugcagucccaggc

SEQ ID NO: 206402 - RNA, 64 nt, Human
acacguuuugaggagaggcagugauuccccucccgccccgcacagagaccccgacucacugcca

SEQ ID NO: 206403 - RNA, 64 nt, Human
gcgacgcuggccaaguguugagagcugccugcgagccccgcaccaccccgcggagcacguaccc

SEQ ID NO: 206404 - RNA, 64 nt, Human
cucugaagcuccuuuccccuugcucuuggucccugccccgcaagcaaaccugcccccucugccu

SEQ ID NO: 206405 - RNA, 64 nt, Human
agacuccugagggcugugggcaggggaccugugugccccgcaccccccaugcuucuuuugcugc

SEQ ID NO: 206406 - RNA, 64 nt, Human
ccuaaacccccgcuccagaucugcacuggguguggccccgcagugcccccacccaguccgccaa

SEQ ID NO: 206407 - RNA, 64 nt, Human
gcucuguggaggcagggucugagccuugccuggggccccgcacugcauagggccuuuuguuugu

SEQ ID NO: 206408 - RNA, 64 nt, Human
ccuuuuuuuuuuuggucuccaccccccuccccccgccccgcacuccuaagggcccaucugccca

SEQ ID NO: 206409 - RNA, 64 nt, Human
cccagcccaccacaccguuuaccucccucgcccugccccgcaccguggggaugcccaacucaca

SEQ ID NO: 206410 - RNA, 64 nt, Human
ugcugcaccuaucaacccauuaccuggguauuaagccccgcaugcauuagcuauuuauccugau

SEQ ID NO: 206411 - RNA, 64 nt, Human
cccgccccgcccccgccccgcgcgccgguccggcgccccgcacccccgccaggcgcaugucugc

SEQ ID NO: 206412 - RNA, 64 nt, Human
gcugauucugucggcaguugaaggcccgucugaggccccgcaaugcgaggguccugugucccac

SEQ ID NO: 206413 - RNA, 64 nt, Human
ggggccugcugggaguggcuguuuuuaugccccagccccgcaaguuggggaguguuuguggggg

SEQ ID NO: 206414 - RNA, 64 nt, Human
augggaguccacggcuagggaggaggccaagcuggccccgcagcgccucuuggacccugcggga

SEQ ID NO: 206415 - RNA, 64 nt, Human
cggccccguccucugcugcuggccucugggucgugccccgcagacugagcugcgcuuggggguc

SEQ ID NO: 206416 - RNA, 64 nt, Human
uaacucauuaugccccuccugggggagauugcaucuccaggacaagcaucuaaaggaggccccu

SEQ ID NO: 206417 - RNA, 64 nt, Human
cugccccuccuccuuccagcaccugccagagcuucuccaggaggccaagcagaggcuccccuca

SEQ ID NO: 206418 - RNA, 64 nt, Human
uccaguaguugugaggccacugugucucaggggacuccaggaggagcagaagagggaucccacg

SEQ ID NO: 206419 - RNA, 64 nt, Human
gauguuuggagauucagcaauucugucuucauugcuccaggaucugguauacuguucucauaaa

SEQ ID NO: 206420 - RNA, 64 nt, Human
cacguggaugggcaaagcuugucaaagaugcccccuccaggagagagccaggaugcccagauga

SEQ ID NO: 206421 - RNA, 64 nt, Human
uucagccucuacaacagagcagcuucccagacuucuccaggaacccagaaacgggaugguuguc

SEQ ID NO: 206422 - RNA, 64 nt, Human
caagcagaacauuccauccaggacacuggaaguucuccaggauccagauccauggggacauuaa

SEQ ID NO: 206423 - RNA, 64 nt, Human
uuggaccuucaucagaccacucccuucccccauccuccaggagagggggcaagggcaacccacc

SEQ ID NO: 206424 - RNA, 64 nt, Human
uuuccccagauccaccuguccugacacucuaguccuccaggauagugcuccucccccagcucca

SEQ ID NO: 206425 - RNA, 64 nt, Human
cuuccagagcccauggcuucaggagagggucucucuccaggacugccaggcugcuggaggaccu

SEQ ID NO: 206426 - RNA, 64 nt, Human
aauaucuaaugucaaccaauggggagagccacaacuccaggagagguuccugagcugagucccu

SEQ ID NO: 206427 - RNA, 64 nt, Human
uguccucugauauaggugagucuugugguagccacuccaggauccugauuggggugccaagaga

SEQ ID NO: 206428 - RNA, 64 nt, Human
gccgucgaguugaccuucugaacaugagugucaacuccaggacuugcuuccaagcccuucccuc

SEQ ID NO: 206429 - RNA, 64 nt, Human
cccugcaagccuugaagccuccagcaacgucuaucuccaggagagcagggcagccuaugcaagu

SEQ ID NO: 206430 - RNA, 64 nt, Human
cccugugcucucuggcccccagcuggccacacuucuccaggagggacccuuggacuucuuugug

SEQ ID NO: 206431 - RNA, 64 nt, Human
ucugccugugagcucuucaaguucuaauccuuaacuccaggauuagcucccaagugcgcugaga

SEQ ID NO: 206432 - RNA, 64 nt, Human
uccaaggcaaauagugcuucacccugaccucucacuccaggacagccucuaagggauuugaucu

SEQ ID NO: 206433 - RNA, 64 nt, Human
gucuuggaccagggcaagugcaucuuugccucaacuccaggauuuaggccuuaacacacuggcc

SEQ ID NO: 206434 - RNA, 64 nt, Human
ucugguggcugggcugcuccugaaugaggcggagcuccaggauggggaggggcucugcguuggc

SEQ ID NO: 206435 - RNA, 64 nt, Human
gcugagaggggauguaggcccaugggcaccuggccuccaggagucgcuguguugggagagccgg

SEQ ID NO: 206436 - RNA, 64 nt, Human
uggugcuucaacugguaucuaugagguccuagagcuccaggacaaugauaagacucgcuauaug

SEQ ID NO: 206437 - RNA, 64 nt, Human
ugccagcaaagccucgcuaaccccauuacaacagcuccaggacaucucagcccagguucuagcc

SEQ ID NO: 206438 - RNA, 64 nt, Human
gguucuuaggggacugugaaaguguugggucuuccuccaggaugccugcaugggaccccacccg

SEQ ID NO: 206439 - RNA, 64 nt, Human
cacucguguccccagggacuucuaaagcuuggggcuccaggaaaucauccaguagaguuggaga

SEQ ID NO: 206440 - RNA, 64 nt, Human
guccagugggagaaacagaccugggcgcaaacaacuccaggacaaggcaggacaugauaaagau

SEQ ID NO: 206441 - RNA, 64 nt, Human
cgugguggccgguagaauucuccaucuauccaggcuccaggagaccccugggcaucucccaccu

SEQ ID NO: 206442 - RNA, 64 nt, Human
uguaaaccaggucccccuccugaccucugccccacuccaggaauggagcucuucccagccuccc

SEQ ID NO: 206443 - RNA, 64 nt, Human
uuaaacaguugacaaacugucauucaacaauuagcuccaggaaauaacaguuauuucaucauaa

SEQ ID NO: 206444 - RNA, 64 nt, Human
uucuaguguagagucugagacgggcaagugguugcuccaggauuacucccuccuccaaaaaagg

SEQ ID NO: 206445 - RNA, 64 nt, Human
cucacuugccugccaugcucugcucggcuucagucuccaggagacaguggucaccucucccugc

SEQ ID NO: 206446 - RNA, 64 nt, Human
ucagauuugcccugagcugcacuggacaaaaugccuccaggacccacuucgcgugcuacuuccg

SEQ ID NO: 206447 - RNA, 64 nt, Human
uccccccgccaaaaaaaaugggucuccuucugggcuccaggauugucuccccacuccagcaucc

SEQ ID NO: 206448 - RNA, 64 nt, Human
aaugauguccagaagaauauucaggacuuaacggcuccaggauuuuaacaaaagcaagacuguu

SEQ ID NO: 206449 - RNA, 56 nt, Human
gagccccagaacagacaugagaccuccuccaggacccugcggggcuggguacugug

SEQ ID NO: 206450 - RNA, 64 nt, Human
cugccccugguggaacauuugaaagcccuugggacuccaggagagagguuuuugcagcauguau

SEQ ID NO: 206451 - RNA, 64 nt, Human
gucauggcuacaaagugcucccucuuuucagugccuccaggaagcccgccaguggugagacugu

SEQ ID NO: 206452 - RNA, 64 nt, Human
cgaaguggcugaguucggcugucauuuaagagaacuccaggacacaauucagcccggguuccgc

SEQ ID NO: 206453 - RNA, 64 nt, Human
ccagaugggccucucagcucccacaaucucuggccuccaggaugagcuaucccaucuucaggag

SEQ ID NO: 206454 - RNA, 64 nt, Human
cuccuggucugugucaguauuaccaccagacugacuccaggacucacugcccuccagaaaacag

SEQ ID NO: 206455 - RNA, 64 nt, Human
agauucucacuucugcuagccuagccagggcuuacuccaggaaucuaaauagaugcccuagucc

SEQ ID NO: 206456 - RNA, 64 nt, Human
gggcugugaaaacagauacugugagcccugaacccuccaggaggcugcuuccccaugacacuag

SEQ ID NO: 206457 - RNA, 64 nt, Human
ugcaugcuuagcaauccaagugcagagcucuuugcuccaggagugaggagacugggaggugaaa

SEQ ID NO: 206458 - RNA, 64 nt, Human
auaaucaacacuguucucucuguaccaugagcuccuccaggagauuauuuaaguguauuguauc

SEQ ID NO: 206459 - RNA, 64 nt, Human
ucaucgccauuccauucccagcagcuuuggagaccuccaggauuauuucucugucagcccugcc

SEQ ID NO: 206460 - RNA, 64 nt, Human
gguugggggcagauuggguuggaaugcuuuccaucuccaggagacuuucaugcagccuaaagua

SEQ ID NO: 206461 - RNA, 64 nt, Human
agggggcaccuguggccaggccuccuccugggagcuccaggaccagccagcuguguucccugca

SEQ ID NO: 206462 - RNA, 64 nt, Human
uuucucauacuuagaaacaaaaagagcuuuccuucuccaggaauacugaacaugggagcucuug

SEQ ID NO: 206463 - RNA, 64 nt, Human
ucugagccugcgugggagaaccccaauucuagcacuccaggaaacugugggagaguguggggca

SEQ ID NO: 206464 - RNA, 64 nt, Human
caauuccauuuuuuaugaacacuugacaaggacccuccaggagucccucuguggagacuuaguu

SEQ ID NO: 206465 - RNA, 64 nt, Human
guuggcuuucagaaucuuuuaggaaauaaauccucuccaggacaaaaaugaacaugaauggagu

SEQ ID NO: 206466 - RNA, 64 nt, Human
uccuuuuuuuaaagauggauuuaaaccaagaugccuccaggaaagaggacgaaaugaguauauu

SEQ ID NO: 206467 - RNA, 64 nt, Human
uuuuccuuuauugccaaucuuugaacucauucaacuccaggacauggaagaggccucucucugc

SEQ ID NO: 206468 - RNA, 64 nt, Human
uauauuuuucaauuccagauuuuuaauuuuaaggcuccaggaaagaaaggagaguagaacauuu

SEQ ID NO: 206469 - RNA, 64 nt, Human
aaccccauucugccaccccaccaggaugcccauucuccaggacuucuccaacuuacuauuagac

SEQ ID NO: 206470 - RNA, 64 nt, Human
gagucuccagcccacagccaagguggacguaccucuccaggagccuuugccuuaauguaucucu

SEQ ID NO: 206471 - RNA, 64 nt, Human
cccagaaggaacccggucccaggccgcauggccccuccaggaacauucccacauaauacauucc

SEQ ID NO: 206472 - RNA, 64 nt, Human
ggcuccaggcuccaggcugacugggggccucugccuccaggagggcaucagcuuucccuggcuc

SEQ ID NO: 206473 - RNA, 64 nt, Human
ucaaaagcagccaugagaaggaaggauucaccaccuccaggaaaagguaaauuugccaauacaa

SEQ ID NO: 206474 - RNA, 64 nt, Human
agcuugaaaacucacuucaaugaacaaagggauucuccaggauuccaaaguuuugaagucaucu

SEQ ID NO: 206475 - RNA, 64 nt, Human
acagccagacgcauccugccacccacacagcagccuccaggauaccagcaaauggaugcgguga

SEQ ID NO: 206476 - RNA, 64 nt, Human
cccaggcagccugagcucuuggauguggucagcucuccaggagcaaguccuguguggcaaaacu

SEQ ID NO: 206477 - RNA, 64 nt, Human
agcuaaacaugcugccaaccagcuuguccaacaacuccaggaaaacuguuuuucaaaacgccau

SEQ ID NO: 206478 - RNA, 53 nt, Human
cuggaaaccccuuauuuugagagcuccaggaagcgcccucaccccagccccac

SEQ ID NO: 206479 - RNA, 64 nt, Human
cuugacagaacacugucuugaagacaauggcuuacuccaggagacccacagguaugaccuucua

SEQ ID NO: 206480 - RNA, 64 nt, Human
guucaucucucacgauccccucaaaggcccccuccuccaggaaggcaaccccugugccccuccc

SEQ ID NO: 206481 - RNA, 64 nt, Human
guaggaggugggaccuucugugggguuuggggaucuccaggaagcccgaccaagcuguccccuu

SEQ ID NO: 206482 - RNA, 64 nt, Human
aucccaaaacagggucagacacugcccagcuucccuccaggagguucuugucucuguguaaggg

SEQ ID NO: 206483 - RNA, 64 nt, Human
gugccagccuucauuccucccaguguccaagccccuccaggaggguccuggggugggccagaug

SEQ ID NO: 206484 - RNA, 64 nt, Human
agaugcagcgguagcaucugagcuccugucccagcuccaggaaggggaguucuggguggaggag

SEQ ID NO: 206485 - RNA, 64 nt, Human
guggauccucauggagcaggagaguagcucauggcuccaggagccugaggccaugcaguugaug

SEQ ID NO: 206486 - RNA, 64 nt, Human
caaccauuaugcuguacuaucuacccauaaauaccuccaggaaacauuccccucuugguaauuu

SEQ ID NO: 206487 - RNA, 64 nt, Human
gguaaaggagcuucguugcgaacuugaucagcuucuccaggauaaaauuaaaaacccaagcauu

SEQ ID NO: 206488 - RNA, 64 nt, Human
agaaguggaagaagaccuaaggcucucccuucaccuccaggaucaggauucugucaaagaugca

SEQ ID NO: 206489 - RNA, 64 nt, Human
uuaaacaugaggaaaugccucuuucuuccccagacuccaggaugacuuugcacguuaauuuuuc

SEQ ID NO: 206490 - RNA, 64 nt, Human
gauuggucagggggagaaaggaaaaggcaaaacacuccaggaccucucccggaucugucuccuc

SEQ ID NO: 206491 - RNA, 64 nt, Human
ggcccaaauuagaaugcuuauaaugagacccaaucuccaggaaaacaacacucacauaaguuua

SEQ ID NO: 206492 - RNA, 64 nt, Human
uagugaguauuucucauagugcagcuuuauuuaucuccaggauguuuuuguggcuguauuugau

SEQ ID NO: 206493 - RNA, 64 nt, Human
agccccgcucugggcaccaccugccuuccagccccuccaggacccggucccccugcugccccuc

SEQ ID NO: 206494 - RNA, 64 nt, Human
gaaugugcgugcuuuuuuguggacacaggagcuccuccaggagcaggcugggaucccaacuauc

SEQ ID NO: 206495 - RNA, 64 nt, Human
cuuucucucuggccuggacauucucuggcagcaccuccaggauacauaaauucaauggaucaau

SEQ ID NO: 206496 - RNA, 64 nt, Human
aggggaggaagaauuccugccaugccccagccuucuccaggacaaccugcuggaacgcaguggu

SEQ ID NO: 206497 - RNA, 64 nt, Human
agccacauggcgcaugaaggagagcccagucucccuccaggaaaggccugaggauguaagucag

SEQ ID NO: 206498 - RNA, 64 nt, Human
ccgugcacccgcuggggccuggagucagggcccacuccaggagggacccacugccuucccgggg

SEQ ID NO: 206499 - RNA, 64 nt, Human
uuuccuucccaucccagcugaaauacugaggggucuccaggaggagacuagauuuaugaauaca

SEQ ID NO: 206500 - RNA, 64 nt, Human
cuaauugagguugguggauucacacauggggguccuccaggaccucagcugcacccauuuucug

SEQ ID NO: 206501 - RNA, 64 nt, Human
aucuccgacccugccacagguuccuggaaagacucuccaggaaauggaagauacugauuuuuuu

SEQ ID NO: 206502 - RNA, 64 nt, Human
cuccuugucgcuugaaaccuucccacacucccugcuccaggagggaaaaacagauguuguugac

SEQ ID NO: 206503 - RNA, 64 nt, Human
ggcccagcaauacaggagaggaugaagggaggagcuccaggaggcgagggaagagcccuagcag

SEQ ID NO: 206504 - RNA, 64 nt, Human
aggcaaaaagacauuaccaugaguaauaagggggcuccaggacucccucuaaguggaauagccu

SEQ ID NO: 206505 - RNA, 64 nt, Human
ugggacagcaaagaugaugggcucugcacaccaacuccaggaaacucauucugggccagcucua

SEQ ID NO: 206506 - RNA, 64 nt, Human
gcuucuggcgaugacauuucuaagcuacagcguacuccaggagaagaaaagauuaauaccuuaa

SEQ ID NO: 206507 - RNA, 64 nt, Human
aaugcaugcccagucagaaaucuguucuauucugcuccaggaaaaucggaaaccugugagucag

SEQ ID NO: 206508 - RNA, 64 nt, Human
ggauagauugcuucagcaaagugaacugugagaucuccaggacagagggagaaagaucugaucc

SEQ ID NO: 206509 - RNA, 64 nt, Human
agaggcaggauggcuuggggcugccugggccccccuccaggaugccgccaggugucccucuccu

SEQ ID NO: 206510 - RNA, 64 nt, Human
gagcagucccucccucaggaacuggaggaggggacuccaggaauggggaaaugugacaccacca

SEQ ID NO: 206511 - RNA, 64 nt, Human
cgccugaguuucaagaauuaaagcugcaagaggacuccaggagcaaaagaaacacaauauagag

SEQ ID NO: 206512 - RNA, 64 nt, Human
ggaauaaugaaaaggguaaaaagaacaaggggugcuccaggaagaaagaguccccccagucuuc

SEQ ID NO: 206513 - RNA, 64 nt, Human
caagacagguggggccuggcuccccacccgccagcuccaggacugccccuuccugggccaacua

SEQ ID NO: 206514 - RNA, 64 nt, Human
augggacccaaaggggaaagaggauuucccgggccuccaggaagaugucuuuguggacccacua

SEQ ID NO: 206515 - RNA, 64 nt, Human
guccauccccugcagcuacuuggugacuuaacaacuccaggagcccugucagcugcccuccucc

SEQ ID NO: 206516 - RNA, 64 nt, Human
gcccuaucaaaaacgaugaggaaaaaagauugcacuccaggauuaggaggugugagauauuuua

SEQ ID NO: 206517 - RNA, 64 nt, Human
ccaggauggucucgaucuccaggauggucucgaucuccaggauggucucgaucuccugacgucg

SEQ ID NO: 206518 - RNA, 64 nt, Human
gggguuucacuguguuagccaggauggucucgaucuccaggauggucucgaucuccaggauggu

SEQ ID NO: 206519 - RNA, 64 nt, Human
cagaggaccgguugcagcuuacccagaaccacuccuccaggagagcuggauguuuugcgugcaa

SEQ ID NO: 206520 - RNA, 64 nt, Human
uugcccacuucccacugcucagcccacaccagaccuccaggagacauccccccuugaggcagag

SEQ ID NO: 206521 - RNA, 64 nt, Human
accugccugagggccuagcucaccacagcacauccuccaggaucuagccuucuaucuaccucuu

SEQ ID NO: 206522 - RNA, 64 nt, Human
gagggcgacagaggaucuaggcuaacaggagagacuccaggagugggggcagaucccaaggcag

SEQ ID NO: 206523 - RNA, 64 nt, Human
uuuuacccagaauacuugccgccugcuuuuuguccuccaggaaaccagaagcccggguaauuag

SEQ ID NO: 206524 - RNA, 64 nt, Human
ccuuccgcucccugccaccauccuccuuccugggcuccaggaaaguguuucugggaggucagga

SEQ ID NO: 206525 - RNA, 64 nt, Human
gaggggauuaaagaggggaggagagagugcagagcuccaggaaaggguaucagagcugcagcca

SEQ ID NO: 206526 - RNA, 64 nt, Human
ggcccccagcuagaggcccagggcugggagcauucuccaggagcagagguucagucugcuucau

SEQ ID NO: 206527 - RNA, 64 nt, Human
gagaaagccuuccauuauucucagcaagucucagcuccaggauacauuaauacaucuaauaaag

SEQ ID NO: 206528 - RNA, 64 nt, Human
caguauucuccaacuccaaacaagcucuagagugcuccaggaaaaguuauauucaguauaugaa

SEQ ID NO: 206529 - RNA, 64 nt, Human
guucucuuaauaaccugagauuucuaugguuugacuccaggaucaaaacacaagggacuuugua

SEQ ID NO: 206530 - RNA, 64 nt, Human
gucgguggauuggagaggggcaggccacugcccucuccaggaccaagccggguucuuggucccc

SEQ ID NO: 206531 - RNA, 64 nt, Human
gagggauggggggcacaggagcugggagccccgucuccaggaaaaggagagggguuaagaugca

SEQ ID NO: 206532 - RNA, 64 nt, Human
gcagugcccgcgccauggggugcucugugggcuucuccaggagcagggaggguggaggggaggg

SEQ ID NO: 206533 - RNA, 64 nt, Human
ggacucugugcaucuugacugcaccccaaagaggcuccaggaucaggagugaaagauuuuaaag

SEQ ID NO: 206534 - RNA, 64 nt, Human
cacuccccauccccgucugaccaagggcugacuucuccaggaccuagucgggggguggcugcca

SEQ ID NO: 206535 - RNA, 64 nt, Human
cgaugucugagcagaaucaguguuugggucaccccuccaggaaugaucucuucuuuuggcuucc

SEQ ID NO: 206536 - RNA, 64 nt, Human
augguuauuuucuuuucuuucaacuugcauccaacuccaggauagugggcaccccacugcaauc

SEQ ID NO: 206537 - RNA, 64 nt, Human
ccuccagacagagucccuucucacuuauagagcucuccaggacuggaaaaagugcugcuauuuu

SEQ ID NO: 206538 - RNA, 64 nt, Human
ugguguuuguuccugaugaaaggaaaaaaauucucuccaggaggaagccuuuuuccuucuugcc

SEQ ID NO: 206539 - RNA, 64 nt, Human
cggcagaugauauacauaucugacuucccaaaagcuccaggauuugugugcuguugccgaauac

SEQ ID NO: 206540 - RNA, 64 nt, Human
ccacuauguguugcuaaaacacaugcuaugagcacuccaggaaacacuauauuuuuuccaaaaa

SEQ ID NO: 206541 - RNA, 64 nt, Human
acucuaaauuaugucuccuuauaaguuauugcugcuccaggagauuguccuucaucguccaggg

SEQ ID NO: 206542 - RNA, 64 nt, Human
acgggccugcuucucucgugccugugcuucugaccuccaggaacuguaaacaggaacaccuaug

SEQ ID NO: 206543 - RNA, 64 nt, Human
cuuacccugcugcucagcuuucucagggaagcaacuccaggaacacuccuuccacuccccucuc

SEQ ID NO: 206544 - RNA, 64 nt, Human
aaauauuugaggcaaaaaaaaaaaaaaaaagugucuccaggaggcuguccagccucguggcucc

SEQ ID NO: 206545 - RNA, 64 nt, Human
cauuagauccaggagauacaacagaggagauaaucuccaggaugccugugaagaaagaucccug

SEQ ID NO: 206546 - RNA, 64 nt, Human
gcaaaagucaggagcaguaaucugagaaaguuaacuccaggauagguagguuucuauuguuaua

SEQ ID NO: 206547 - RNA, 64 nt, Human
auuugagaaaucagugagagcuuccuauaaagaacuccaggagacaggccugaacucuagaggg

SEQ ID NO: 206548 - RNA, 64 nt, Human
cagguggccuagcaggcacaggacaccuggccgccuccaggagccuacccccugaaagugacag

SEQ ID NO: 206549 - RNA, 64 nt, Human
ccuggagcaaucuucuucaggcagcugucuccaccuccaggauguccagcaggcugcaaggaga

SEQ ID NO: 206550 - RNA, 64 nt, Human
gacccagggagaacccacugcuuuucccaggaggcuccaggauuaggaaauguguguauuuagu

SEQ ID NO: 206551 - RNA, 64 nt, Human
guguguuccccauguguguguacaacacuggugacuccaggaaccauuuucaccuauuaccagu

SEQ ID NO: 206552 - RNA, 64 nt, Human
cuccaauucccgugaucccaaaagaagaggaagacuccaggagggguauagauugugccgucau

SEQ ID NO: 206553 - RNA, 64 nt, Human
acuugagcauggguccuuguucuuccuauuucaccuccaggaaagcaaaagugggagcagaaau

SEQ ID NO: 206554 - RNA, 64 nt, Human
agagguggugagaugcgcagggaagaccagcucucuccaggacaucgggcugcgugaaguccag

SEQ ID NO: 206555 - RNA, 64 nt, Human
gcugcgaggugcucaccucacagagucuggaggccuccaggaucaacugugggcaaagugccug

SEQ ID NO: 206556 - RNA, 64 nt, Human
aggccgcugcugcguggagcacuuaaaguccagccuccaggaccggaugccccuccugucuccc

SEQ ID NO: 206557 - RNA, 64 nt, Human
auguuucagggaggccaguucugcagggugucagcuccaggacccacagggccagaaccagcug

SEQ ID NO: 206558 - RNA, 64 nt, Human
gaucggggcuuucagccccacccugaugccugcccuccaggauggcugguuuagucugggucca

SEQ ID NO: 206559 - RNA, 64 nt, Human
agucuggguccaugucccagaccccucuauucugcuccaggacagcaggacuucaggucuuccu

SEQ ID NO: 206560 - RNA, 64 nt, Human
uccccaccccaccuugccucuguccugcgcugggcuccaggacggucaguccucccggaucccu

SEQ ID NO: 206561 - RNA, 64 nt, Human
ggucacauagucgugugggucgaggauucugugccuccaggaccaggggcccacccucugccca

SEQ ID NO: 206562 - RNA, 64 nt, Human
caaagaagagccagccuugcaggaggguuuacaucuccaggaagaugggcugccagcaacugca

SEQ ID NO: 206563 - RNA, 64 nt, Human
gcagaccacacucugccuggccuugagccgugaccuccaggaagggaccccacuggaauuuuau

SEQ ID NO: 206564 - RNA, 64 nt, Human; identical to SEQ ID NO: 206545

SEQ ID NO: 206565 - RNA, 64 nt, Human
aaggaauugggguggcacacgggacacccgagagcuccaggagccccgugaacccagaccaccc

SEQ ID NO: 206566 - RNA, 64 nt, Human
acaaaaaaaaaaaaaaaaaaauugaauaucacuccuccaggaggaggaucuuuugaaauuggaa

SEQ ID NO: 206567 - RNA, 64 nt, Human
cuucuggauuagaaugccgguuaaauuccauaugcuccaggaucuuugacugaaaaaaaaaaag

SEQ ID NO: 206568 - RNA, 64 nt, Human
ccuguucaagcuguguccagcuuuuccccuggggcuccaggaccuucccuaccuccaccaccaa

SEQ ID NO: 206569 - RNA, 64 nt, Human
caaauccugcuuuuccaguuuggcuccacaaguccuccaggacagagcccucaaagcaacuccc

SEQ ID NO: 206570 - RNA, 64 nt, Human
cauccggcuuugacccaccauccguugcagaagccuccaggagcagcaauccuaagagugggag

SEQ ID NO: 206571 - RNA, 64 nt, Human
uacacuaggaauucuugacguggggucucuggagcuccaggaaauucgggcacaucauaugucc

SEQ ID NO: 206572 - RNA, 64 nt, Human
caugucuggccgccucugagcuccucccacccuccuccaggaaccuccacaucuccaaaaaucu

SEQ ID NO: 206573 - RNA, 64 nt, Human
ucaccacuucacucaggcugcagcccucuuggggcuccaggauuugcugaaagagaaaaagaua

SEQ ID NO: 206574 - RNA, 64 nt, Human
caccuguagcccugagguucuuuucccaggauggcuccaggauaaggaucacuguaggugguug

SEQ ID NO: 206575 - RNA, 64 nt, Human
acagggauauuuuuaaucccguuauggacucugucuccaggagaggggucuauccaccccugcu

SEQ ID NO: 206576 - RNA, 64 nt, Human
ggaaaagcauuugcuguguuucguuagcaucuggcuccaggacagaccuucaacuuccaaauug

SEQ ID NO: 206577 - RNA, 64 nt, Human
uaggaucaagccgacccagagugggcaugggaugcuccaggaggucugggguaccagugggcuc

SEQ ID NO: 206578 - RNA, 64 nt, Human
acucugucguucucugagccccaccucagcaggucuccaggaucccucacauuuccccuguuug

SEQ ID NO: 206579 - RNA, 64 nt, Human
ucuugcccugaccccagcccgugcagcugcucuacuccaggaauggauguggggacucuuccug

SEQ ID NO: 206580 - RNA, 64 nt, Human
aaggacacgagagaaaggaaggggaagaacaggacuccaggacuguuuuauauuauagaaaagc

SEQ ID NO: 206581 - RNA, 64 nt, Human
guucagaaucaauaugugagaugaaaaggauccccuccaggaggauccugagcuguucagaaau

SEQ ID NO: 206582 - RNA, 64 nt, Human
cugcauauucuggacucuaauuuaguuuaauucacuccaggauggcacgcaggauuccuaauuc

SEQ ID NO: 206583 - RNA, 64 nt, Human
cgugggagcugaucccacgggcaggcucucccugcuccaggagaagacuaggaggaagaaugag

SEQ ID NO: 206584 - RNA, 64 nt, Human
gucugcuuuccaccgaguacuguguuuauucucucuccaggaaagcagaucaaaagaaaguuag

SEQ ID NO: 206585 - RNA, 64 nt, Human
gggauggguaauaggugagaguagaaacccuucccuccaggaggcccccgcugacucccacaga

SEQ ID NO: 206586 - RNA, 64 nt, Human
guacugagagaugaagcaucauauugacaacuuacuccaggaaaaaagguguguguauaggugu

SEQ ID NO: 206587 - RNA, 64 nt, Human
cugaagauuaaacaguaaucauuuuugucaaccacuccaggaagagucauuacuacauaugcua

SEQ ID NO: 206588 - RNA, 64 nt, Human
acgucucuauucugccccagcuggagcauugcagcuccaggaagaugaauacauggcuuggugu

SEQ ID NO: 206589 - RNA, 64 nt, Human
ccccagggauacugggcccucuucucaggggcgucuccaggacccagagcuguuccugcuuuga

SEQ ID NO: 206590 - RNA, 64 nt, Human
gguggagaaccacagcugcagaguaggcagcugccuccaggaugaguuacuugaaauuugccuu

SEQ ID NO: 206591 - RNA, 64 nt, Human
cuguccuucccccagcacaaagcacuggccuugccuccaggaccuugcuuccuucucaucuugc

SEQ ID NO: 206592 - RNA, 64 nt, Human
cguaggucucuggguuucagaugaagugcccaggcuccaggaaguugagggacccacaggagag

SEQ ID NO: 206593 - RNA, 64 nt, Human
uccaagucugaguucccacaggggacccagcagccuccaggaaguccauacccugggguggcug

SEQ ID NO: 206594 - RNA, 64 nt, Human
gcagaggaggggccgcugccacccaccucccugccuccaggaaccacaccacaucuaagccuga

SEQ ID NO: 206595 - RNA, 64 nt, Human
caggcugcugccaacccaccuggaggccaccucccuccaggagaucccagggugcaaaguggca

SEQ ID NO: 206596 - RNA, 64 nt, Human
uguuacucauaaaacagauaaucaaauagaucuucuccaggauucccaaaaagcuuuuggcagu

SEQ ID NO: 206597 - RNA, 64 nt, Human
gaagaaaauauaaguagauguuaaggucagugcucuccaggagauuucaauccaggcuaucugu

SEQ ID NO: 206598 - RNA, 64 nt, Human
uaccaacuuuucaaagcccaccaauccacauuuucuccaggaaauuaaauauuuaaguaaguga

SEQ ID NO: 206599 - RNA, 64 nt, Human
gggauuucgucaguugcucccaguauacaauauccuccaggacauagccagaaaucuccauucc

SEQ ID NO: 206600 - RNA, 64 nt, Human
uuuggacugcaguuugccacccugagaacaccuucuccaggacuggcauuucagaaucagauuc

SEQ ID NO: 206601 - RNA, 64 nt, Human
cuagaaagacuccuaaaguauaggauuacaaagacuccaggaagcguaagaaagagauuguguu

SEQ ID NO: 206602 - RNA, 64 nt, Human
ccugugcuccccuggggagguccccaccccuccccuccaggagcaggccuggugcagcccacuc

SEQ ID NO: 206603 - RNA, 64 nt, Human
gauggaagaugcuguuucuccggcagaaccaacccuccaggacgaaguuucagaauuggcugau

SEQ ID NO: 206604 - RNA, 64 nt, Human
cuacccuuuggccccauugggcccucgucugccucuccaggauuguauguuucaagccuugucc

SEQ ID NO: 206605 - RNA, 64 nt, Human
caucccaguagcugcccuauucaacugcaacagucuccaggaccaucaguauacugcauuucau

SEQ ID NO: 206606 - RNA, 64 nt, Human
ggucaaugggaugucaccuaccaaaauccaaauccuccaggaaaaacuacuacacuaaauggac

SEQ ID NO: 206607 - RNA, 64 nt, Human
uacguuaagggaaggaacucuggcuuccagguaucuccaggauugaagagcauugcauggacac

SEQ ID NO: 206608 - RNA, 64 nt, Human
ccuuuguacucugcuugcggagggcugggagacccuccaggacauucccacccucccccaugcu

SEQ ID NO: 206609 - RNA, 64 nt, Human
ucuguccagaggcugcaaggauucagcauuauuccuccaggaaggagcaaaacgccucuuuucc

SEQ ID NO: 206610 - RNA, 64 nt, Human
guggcuaccuugucuuucaaaagaacucagaauccuccaggaucuagaagaaggaagaaagugu

SEQ ID NO: 206611 - RNA, 64 nt, Human
ggacauuuacuggggaggugaguagcaggcccagcuccaggaucugaauuggaaucucagauuc

SEQ ID NO: 206612 - RNA, 64 nt, Human
gaacuguuuuauagagaauggggcagaggcacaacuccaggaauucucuagcuccuggucagga

SEQ ID NO: 206613 - RNA, 64 nt, Human
ggacucacaugaucguuggaugaccaaguucaggcuccaggagccaugccugagacucccuaug

SEQ ID NO: 206614 - RNA, 64 nt, Human
ccucuucuucugggagcugugaccucccuuccuccuccaggaagcccuccucuugugaugacua

SEQ ID NO: 206615 - RNA, 64 nt, Human
uccuuguaccccuugcccuucucccagcucauugcuccaggagagagaagaguucaaaaaauaa

SEQ ID NO: 206616 - RNA, 64 nt, Human
acucccuuuaaagagaguuugccacuccccuaaacuccaggauuuauaaagcaaauuacuccaa

SEQ ID NO: 206617 - RNA, 64 nt, Human
gccugcgcugcaccaacauugggggccuggagcucuccaggaaagccaagcuggcggccaccgc

SEQ ID NO: 206618 - RNA, 64 nt, Human
auccugaaggagacgcgggagcccacggagaacgcuccaggagggccuguccauccucgcuguc

SEQ ID NO: 206619 - RNA, 64 nt, Human
uuuguuuaugcauuuccuuaaaauuaauuguagacuccaggauacaaaccauaguaggcaauac

SEQ ID NO: 206620 - RNA, 64 nt, Human
aggucccuuucuuccugaccaccgauugagacgucuccaggaccuuaggggcagauccguuuuc

SEQ ID NO: 206621 - RNA, 64 nt, Human
aaacuuguaauacaugguuuuauugcuuguuucucuccaggauaguagagauuucucuauuuca

SEQ ID NO: 206622 - RNA, 64 nt, Human
uuucuucugcacugggggacuggaugcuagccaucuccaggagacaggaucaguuuuacggaaa

SEQ ID NO: 206623 - RNA, 64 nt, Human
cccgcagcuaagccagcacugagaugcguggugccuccaggaccgcugcgggugguaaccagug

SEQ ID NO: 206624 - RNA, 64 nt, Human
aggagugaagccaccaucgaggccacacucagcacuccaggaucccagcgaugucagacacucu

SEQ ID NO: 206625 - RNA, 64 nt, Human
uguucuagcugagagggccuggcccuggggugggcuccaggaaaacgcugguuaggccugggau

SEQ ID NO: 206626 - RNA, 64 nt, Human
ccugggggcggccauguuguccaggcccaggccccuccaggacuguggcugccuccccuccacg

SEQ ID NO: 206627 - RNA, 64 nt, Human
guaggacagcccugcaagacaaucaaccagaagccuccaggagcuucuaccuauggcuuauuca

SEQ ID NO: 206628 - RNA, 64 nt, Human
cuuauuuuguguaccauaagccaacaaccgcugacuccaggauugcauaagcccccugugaaau

SEQ ID NO: 206629 - RNA, 64 nt, Human
cuaucuuguuccccuaaauuaauaaaauguuuuucuccaggauuuuggugaggguuggcugugg

SEQ ID NO: 206630 - RNA, 62 nt, Human
accuguacugguuuaaauaaguuuaccuuuuccuccaggaaauauaaugauuucugggaaca

SEQ ID NO: 206631 - RNA, 64 nt, Human
auugauccuuuggcacuuaaauaaaugugaaauccuccaggaauuuuccugugauucuccuugu

SEQ ID NO: 206632 - RNA, 64 nt, Human
uugacccucgaccacaccugaaaaugucucaaaucuccaggaguaucuggaaugcauuuguuuc

SEQ ID NO: 206633 - RNA, 64 nt, Human
acccucauggcccccaggggcaggacugaguccccuccaggaagaagcaggggggaaucuauuu

SEQ ID NO: 206634 - RNA, 64 nt, Human
ccccugucccccacccugacccucccauggcccucuccaggacucccacccggcagaucggcuc

SEQ ID NO: 206635 - RNA, 64 nt, Human
gccugcacauccagaacugccuccuugccgcugccuccaggaagcccaccuugagccagaguca

SEQ ID NO: 206636 - RNA, 64 nt, Human
cguacacuugcucaaccuggaccagccccccagccuccaggaccagacacagaagaaguucgug

SEQ ID NO: 206637 - RNA, 64 nt, Human
cugugagcagcugcgggcgcagcagcggaguucgcuccaggagaaggcugcgcacccacacccg

SEQ ID NO: 206638 - RNA, 64 nt, Human
cuuucuaggacugugccucccugcuugaccuaugcuccaggacccugcccucaacccuugucag

SEQ ID NO: 206639 - RNA, 64 nt, Human
uccugcuguggcuugggugccgggcgucucccgccuccaggaucuccucucaccugcccccauu

SEQ ID NO: 206640 - RNA, 64 nt, Human
augccuggcugcaucuguaugaaaucaaggcacacuccaggaagacugccacgucgcgccaaca

SEQ ID NO: 206641 - RNA, 64 nt, Human
gcucccccuccccaggcuggagacccccccccaacuccaggaaagagcagucagaguccagugc

SEQ ID NO: 206642 - RNA, 64 nt, Human
gacuguagcacggaguguuggggcugggggccagcuccaggagggcuugagagcucagccugcc

SEQ ID NO: 206643 - RNA, 64 nt, Human
ugucagaugggaagacaugaaugcacacuagccucuccaggaaugccuccucccugggcagaaa

SEQ ID NO: 206644 - RNA, 64 nt, Human
uacuugucuuuaacauggacacucaugagucauccuccaggacgaccagugcauccucaagcuc

SEQ ID NO: 206645 - RNA, 64 nt, Human
uauuacacuuaaagcaacaaccaacuaguaacagcuccaggaaaggggaaugaaucaacucuug

SEQ ID NO: 206646 - RNA, 64 nt, Human
agggucuggcauccauaugaggaaaaaugcucagcuccaggaaagauggggaguccaaguggau

SEQ ID NO: 206647 - RNA, 64 nt, Human
agccagcuccugcacaaauggaacuccccagggccuccaggacuggggcuugccaggcuuguca

SEQ ID NO: 206648 - RNA, 64 nt, Human
cuccgccagcucugagucccaggcagcuggacaucuccaggaaaccaggccaucugggcaggag

SEQ ID NO: 206649 - RNA, 64 nt, Human
guccccagcuggugacugcucaggaguuugggggcuccaggacagugggcccggggccuggcag

SEQ ID NO: 206650 - RNA, 64 nt, Human
ggaaauaguuccauucuaugacucuugucuccuccuccaggaggacuguucuaacuaguaaucu

SEQ ID NO: 206651 - RNA, 64 nt, Human
ccucaguagaauuggauuuccaugucagcccccacuccaggaaggcagcccaaucccuagguga

SEQ ID NO: 206652 - RNA, 64 nt, Human
uuugugaccucugcauuaguauuuggagcagacccuccaggaaguccuuuuauacuagacugac

SEQ ID NO: 206653 - RNA, 64 nt, Human
agagcugcccaaguucacugggcuccacccccaccuccaggaggggaggagaggaccugacauc

SEQ ID NO: 206654 - RNA, 64 nt, Human
auugaguguaaagaugggaagagaacugggcugacuccaggaccuccaggaugaggcagaggca

SEQ ID NO: 206655 - RNA, 64 nt, Human
aaagaugggaagagaacugggcugacuccaggaccuccaggaugaggcagaggcaugaugcuuc

SEQ ID NO: 206656 - RNA, 64 nt, Human
gcaugaugcuuccugcucaccugggccacccucucuccaggacuugucagcuggugguucagcc

SEQ ID NO: 206657 - RNA, 64 nt, Human
gccccgccuggaggagauccgcaucuggggaccccuccaggaagaugcugacauccaggucagc

SEQ ID NO: 206658 - RNA, 61 nt, Human
gugaccuguaaacccaacagcucaccuccgccuccaggaagaccagacucccacccuucca

SEQ ID NO: 206659 - RNA, 64 nt, Human
gucccucgggcaugacaggcagaaacgagggcugcuccaggagaagggccuccugcuggccaga

SEQ ID NO: 206660 - RNA, 64 nt, Human
ccauaccaaagcccugugaguucaucagagucagcuccaggaaccaucaugguaagugguauuu

SEQ ID NO: 206661 - RNA, 52 nt, Human
caacacgcaggaucuacuagaccuccaggaacagacauggaccuucucucca

SEQ ID NO: 206662 - RNA, 64 nt, Human
acuucggacaccugccauggacacuucacccacccuccaggaccccagcaaguggauucugggc

SEQ ID NO: 206663 - RNA, 64 nt, Human
cuuuggugccgaguauguuucgguccccuccagacuccaggacacgcccauguauguccccugc

SEQ ID NO: 206664 - RNA, 64 nt, Human
gugucuucauuuuaauguguuugcaaucgcuccgcuccaggaagaacggaaaugcugucuugug

SEQ ID NO: 206665 - RNA, 64 nt, Human
ccuacuuuccuucacaccagacagccccucaugucuccaggacaggacaggacuacagacaacu

SEQ ID NO: 206666 - RNA, 64 nt, Human
gcugagggggccucucuaccuguguccccacucacuccaggagcacuggcuuuggucacgucuu

SEQ ID NO: 206667 - RNA, 64 nt, Human
ccucaucagcaagcgacucaagagcaggcaccgccuccaggacaacgugcgcgaggaccucuau

SEQ ID NO: 206668 - RNA, 64 nt, Human
cguaggugcggagcucaauuugcccaccugcugccuccaggaucagcaccuugaagaagugugu

SEQ ID NO: 206669 - RNA, 64 nt, Human
cccaccuggggccgccgucuuccguccuaggagacuccaggacacccucugaguccuugacgcu

SEQ ID NO: 206670 - RNA, 64 nt, Human
ggauuuccccucucuagaucccugccaggucccucuccaggaggccccucugcucuccugaagg

SEQ ID NO: 206671 - RNA, 64 nt, Human
gggccccagagcccagcugaggaagccacacagccuccaggacguggcacgguuccccuccacu

SEQ ID NO: 206672 - RNA, 64 nt, Human
ggcugccuguguuggcuggcgaccagcaggauugcuccaggauuuuguguuuaccucgcgugaa

SEQ ID NO: 206673 - RNA, 64 nt, Human
gagcaccagggcagguugcgcugacucugcggcccuccaggacggacaccgggugaccccuuag

SEQ ID NO: 206674 - RNA, 53 nt, Human
gggauaguuuuaaaguguagcaucuccaggaagaagaggaaaaggagggaacc

SEQ ID NO: 206675 - RNA, 64 nt, Human
uaugaaacagcuaaaagaaaacaucggggaaucucuccaggacauuggagugggcaaagauuuc

SEQ ID NO: 206676 - RNA, 64 nt, Human
agaagaacaagagcaaagaccaugaagccagagucuccaggacuccucacucaaccucggccau

SEQ ID NO: 206677 - RNA, 64 nt, Human
augucuucugggagccacugggcaauugccagggcuccaggaagggcucuggcucagguugcag

SEQ ID NO: 206678 - RNA, 64 nt, Human
aaauuuucagaauguuguuuuuuucauguagauacuccaggaagaguuaagcacugcuuucagu

SEQ ID NO: 206679 - RNA, 64 nt, Human
gcuaccuaccuugcccagugcugacccggaccuccuccaggauacagcacuggaguuggccacc

SEQ ID NO: 206680 - RNA, 64 nt, Human
acauuuuuuuaugcucuugaaauauucagaaauucuccaggauuuuaauuucaggaaaauguau

SEQ ID NO: 206681 - RNA, 64 nt, Human
ggagaugcccuguagccuucagaccagagguuuccuccaggacucaaucucugacccagcagaa

SEQ ID NO: 206682 - RNA, 64 nt, Human
uaaagacgacugagaagaggugcaaggaagcgggcuccaggagcaagcucaccaggccucucag

SEQ ID NO: 206683 - RNA, 64 nt, Human
aacaucccacguuggaagaagauacauuugggggcuccaggacuacaguagaaaaguauagagc

SEQ ID NO: 206684 - RNA, 64 nt, Human
auugagcucauguucccugcaagugccauuuccucuccaggaugggccucuaaagcugaggccu

SEQ ID NO: 206685 - RNA, 64 nt, Human
acuauaaccagguugccuuauuuuggguggauuacuccaggagaggccacccuccagcuuucuc

SEQ ID NO: 206686 - RNA, 64 nt, Human
agugaccaaagauggccagcuagagauucagcaucuccaggauccucaugugccucuccucaaa

SEQ ID NO: 206687 - RNA, 64 nt, Human
aacuaacagguccaacccuaagugagacauguuucuccaggaugccaaaggaaaugcuaccucg

SEQ ID NO: 206688 - RNA, 64 nt, Human
acuuuucugaaaaccuuugugaauuacuucguuucuccaggauucccgcaguguugaggaauuc

SEQ ID NO: 206689 - RNA, 64 nt, Human
caccuagaggagaccaugggcccugccccacccacuccaggauguuaggguccccucagccaaa

SEQ ID NO: 206690 - RNA, 64 nt, Human
ccagugcugcauuucaguucuggcugucccacagcuccaggaguuguguccccugaauuuugca

SEQ ID NO: 206691 - RNA, 64 nt, Human
cacucucaccuggaggcuccggggaagcaucugccuccaggaccauucaggcuguugacaaguc

SEQ ID NO: 206692 - RNA, 64 nt, Human
aaguuuacuucuugucuuguucuucuaaagcuuucuccaggacagauauuuucccugucuuaac

SEQ ID NO: 206693 - RNA, 62 nt, Human
gcagggaccuucaagccugagcagaugaaugacuccaggaagaagguaacuacccuaaugcu

SEQ ID NO: 206694 - RNA, 64 nt, Human
cacucaagcucuuuaacugaaaagcaacaagccacuccaggacaagguucaaaaugguuacaac

SEQ ID NO: 206695 - RNA, 64 nt, Human
acugcccuccaugggggcauucuggcacccccugcuccaggacaggccaugggcaagcugccuc

SEQ ID NO: 206696 - RNA, 64 nt, Human
gucugaaccugcccuuacuguguuuaaccuguugcuccaggaugcauucugauaggagggggcg

SEQ ID NO: 206697 - RNA, 64 nt, Human
ccuccgggcucuggguuccucugcccuggaagggcuccaggacccgucccaauaaccacccacg

SEQ ID NO: 206698 - RNA, 64 nt, Human
cacagcucacaggggcaggaggcagcuccccugccuccaggacccuguugcuauggugacacag

SEQ ID NO: 206699 - RNA, 52 nt, Human
ugaugcucucccgccacugaggcuccaggagggaauaucuguugccccugcg

SEQ ID NO: 206700 - RNA, 64 nt, Human
agccagacccaggcugcaggccucccccaggagccuccaggauggagauggagacccagcagcc

SEQ ID NO: 206701 - RNA, 64 nt, Human
gacucugagcgggaggcagaguuugccuuccuuucuccaggaccaauaaaauuucuaagagagc

SEQ ID NO: 206702 - RNA, 64 nt, Human
ccacaggcaucuacacagccuggacuuugguucucuccaggaagguagcccagcacugugaaga

SEQ ID NO: 206703 - RNA, 64 nt, Human
ugaguguguguucuuccccaagguccccccacagcuccaggacaccgcuguccuggcauuugug

SEQ ID NO: 206704 - RNA, 64 nt, Human
accccuagucacucauaucggagccuggacuggccuccaggaugaggauggggguggcaaugac

SEQ ID NO: 206705 - RNA, 64 nt, Human
cauuagacugauucuuccaccuauuuuuaugaaccuccaggaagaaaaacacuugccaaaacau

SEQ ID NO: 206706 - RNA, 64 nt, Human
ccuugccucuuagcauguuugauuuaagaaaagccuccaggaaaucuugagagccugucuuggc

SEQ ID NO: 206707 - RNA, 64 nt, Human
cuugcagcuccccagucucuaccugucaggaugacuccaggaagacagcuggaguacugcauuu

SEQ ID NO: 206708 - RNA, 64 nt, Human
cgcaaguaaggaggucugcccggagcagcagcuucuccaggaagcccagggcaccauccagcuc

SEQ ID NO: 206709 - RNA, 64 nt, Human
ggauugaagccaucuggaccuuuucuagauaugacuccaggacccuugaguguaaugcaaaaau

SEQ ID NO: 206710 - RNA, 64 nt, Human
aaaagaggaaaacaagugaggacacugguuuuaccuccaggaaacaugaaaaauaauccaaauc

SEQ ID NO: 206711 - RNA, 64 nt, Human
ggaccgcgacaaggacgacauucuguucuacacccuccaggaaaugacagcagucagugccgcc

SEQ ID NO: 206712 - RNA, 64 nt, Human
ccacaaaccucaguggguccuacagauccgggcucuccaggaaugauugcagcuguguccugaa

SEQ ID NO: 206713 - RNA, 64 nt, Human
ugagcacaagcugggcaaaucacugucccuuggacuccaggagaccaguguccuagucuugccu

SEQ ID NO: 206714 - RNA, 64 nt, Human
acuccaggcccccuccacaucccgcuucgccucccuccaggacuccaccccggcucccggacgc

SEQ ID NO: 206715 - RNA, 64 nt, Human
gugcguggucucugaucguccaucaccugaccuucuccaggacugucuucucacccuuccccac

SEQ ID NO: 206716 - RNA, 64 nt, Human
ggcagagcccgcccaccugggcccuaggcauacucuccaggauuguccacaaauguccucagag

SEQ ID NO: 206717 - RNA, 64 nt, Human
acucugagcccugacguccuccaccaaccacgggcuccaggaccccuuugcuggccauccccag

SEQ ID NO: 206718 - RNA, 61 nt, Human
gcggcccucaaggucccugagcuccgcaggccuccaggaguauggguccugcccugcccuc

SEQ ID NO: 206719 - RNA, 50 nt, Human
ugggacacacagccuccugacuccaggaagagccagagcugugcagggag

SEQ ID NO: 206720 - RNA, 64 nt, Human
ugggcuuccuguccugugucccuugguggguccccuccaggaaccaaggaguggcccuccaggu

SEQ ID NO: 206721 - RNA, 64 nt, Human
cagccccuggcuucacccugucaggccagcuccacuccaggacugaauaaaggucuuugacagc

SEQ ID NO: 206722 - RNA, 64 nt, Human
agccagccagcgugcaacugcccaagcuccaggucuccaggacaagagcaguugucugccauga

SEQ ID NO: 206723 - RNA, 64 nt, Human
accagcagagcggaguucuuuauaccgggaccuccuccaggagaaccccggagcuccuucuagc

SEQ ID NO: 206724 - RNA, 64 nt, Human
ggcuccgagccugcccccagagacgucccugccccuccaggaccugacagccccucccauccug

SEQ ID NO: 206725 - RNA, 64 nt, Human
cgucagccuuggggacuaggccaguguugggcaccuccaggaggaggccugacugguucauuac

SEQ ID NO: 206726 - RNA, 64 nt, Human
uccuuucccuuugaggacucccacccuuuggggucuccaggauccucauggaaggggaagguga

SEQ ID NO: 206727 - RNA, 64 nt, Human
cagucugaguaccuuggcuagacucuaggucaggcuccaggagcaugagaauugauccccagaa

SEQ ID NO: 206728 - RNA, 64 nt, Human
aguaaaauauugggaucacuuuucccugucuaaacuccaggauacaguauccaauuuauccaaa

SEQ ID NO: 206729 - RNA, 64 nt, Human
cugccuccuuugugucuguuuuaaaggagacuaacuccaggaguaggaaaugauucaucauccu

SEQ ID NO: 206730 - RNA, 64 nt, Human
ggcaguucccuggcugaggccuuuugcgccccaccuccaggaccaagggccauucuagacaggg

SEQ ID NO: 206731 - RNA, 64 nt, Human
uuccuguauuuccauuuuuaagaguaaauuuaaucuccaggauuuagaagugucuuuccagaga

SEQ ID NO: 206732 - RNA, 54 nt, Human
agaaaaaaucagaaugcugaacuccuccaggaccagccaugguguggaggucuc

SEQ ID NO: 206733 - RNA, 64 nt, Human
ccagcagaagccugggguaccuagucaccaggaucuccaggacucccagggagcagagucuucu

SEQ ID NO: 206734 - RNA, 64 nt, Human
gggaggaggaggagugugcucugcacuugccuugcuccaggaugggguggcagcagaggaaugu

SEQ ID NO: 206735 - RNA, 64 nt, Human
uggaaagguagauuuagccucaaguuguucuagucuccaggaggcugccagccccuccucuuau

SEQ ID NO: 206736 - RNA, 56 nt, Human
ugagggucacuacagucugaacuggacuccaggagcagggaucuugagucaaugca

SEQ ID NO: 206737 - RNA, 64 nt, Human
cgcccccugucucucagggccaggccucucccuccuccaggaagccuuccccuaccccuugucg

SEQ ID NO: 206738 - RNA, 64 nt, Human
uccggaugaugucccgcugaggccgcgagggccccuccaggacugccaagcucccaaaggcggg

SEQ ID NO: 206739 - RNA, 64 nt, Human
uggcuuugcucagaagccuccugucuccagcucucuccaggacaggcccaguccucugaggcac

SEQ ID NO: 206740 - RNA, 64 nt, Human
guuacaauccauagauagccagcaguggauguuacuccaggaaaaugcaggauuaaaauugucc

SEQ ID NO: 206741 - RNA, 64 nt, Human
ccaggaagagccugcggccucggcgucccccagucuccaggagccucucccuccgagauaccca

SEQ ID NO: 206742 - RNA, 64 nt, Human
ggugcggauccagcugcaagaccguguaaaugagcuccaggaggaagcccaggaggcugaugcc

SEQ ID NO: 206743 - RNA, 64 nt, Human
aacuggacuuuggggcccaggcauaagucccuuccuccaggaccuuuccuauuuauaugucccu

SEQ ID NO: 206744 - RNA, 64 nt, Human
gagcacaugugguuguaaaaccuuaacuuucuuucuccaggaggguggugauagaaacagaugg

SEQ ID NO: 206745 - RNA, 64 nt, Human
agggaguggaagggucucugcuucuguacaaaaucuccaggauuuacaaaaauguaaccugccu

SEQ ID NO: 206746 - RNA, 64 nt, Human
ugugacccuagucaccagaauucaggacugucuccuccaggaccaaaguggccagguaauagga

SEQ ID NO: 206747 - RNA, 64 nt, Human
ccguccaguuguucuccugauugacccgacuccacuccaggaaggccaucugacccugugacag

SEQ ID NO: 206748 - RNA, 64 nt, Human
auugauuaguccaaaucacaggcuaaggccugaucuccaggagggguaggggagacacuuuacc

SEQ ID NO: 206749 - RNA, 64 nt, Human
cagcugccacaugggaugguggcucaggcgcucccuccaggauucugccccugccuguccacag

SEQ ID NO: 206750 - RNA, 64 nt, Human
gggggggccgacccccaucuccaccccgcgggcucuccaggagccucagcccaccgccaguacu

SEQ ID NO: 206751 - RNA, 64 nt, Human
uuuaaaugucuuucuucaugaaugcuucauggggcuccaggaagccuguaucaccuguguaagu

SEQ ID NO: 206752 - RNA, 64 nt, Human
gggcccagacccaccucggcacggacaccccugucuccaggaggggcagguggcugaggcucuu

SEQ ID NO: 206753 - RNA, 64 nt, Human
acagaaggccaaugcccacggcuucaucauggaacuccaggacggcuacagcacagguguggag

SEQ ID NO: 206754 - RNA, 64 nt, Human
ugacuuugcugccauccagccccagaucgcuuuacuccaggaaaugcacguuacacauuuucgc

SEQ ID NO: 206755 - RNA, 64 nt, Human
augugccugucaugacuguaauucauuaugacugcuccaggaagggcuaauggggccaauauau

SEQ ID NO: 206756 - RNA, 64 nt, Human
gugcaagggaaggcauuaucggguggcucccuugcuccaggaacugaacgaggcccuuuucaua

SEQ ID NO: 206757 - RNA, 64 nt, Human
cuuacuguagccucagaugauuuccccccuccgccuccaggaagaaagaauguuacugccuuaa

SEQ ID NO: 206758 - RNA, 64 nt, Human
acuggcuugcucuuuggcugaccuucaauucccucuccaggacuccgcaccacuccccuacacc

SEQ ID NO: 206759 - RNA, 64 nt, Human
gaucugaaucccaugggugugagggugauggguacuccaggacuggccuaugcuguguuguggg

SEQ ID NO: 206760 - RNA, 64 nt, Human
gacgucacuggggacuuaucuguggagccuggugcuccaggauguggcuucucaugaagcucug

SEQ ID NO: 206761 - RNA, 64 nt, Human
aaaccucacuuucagagagauguggguccuuugucuccaggauccacacccuagauuuuaacac

SEQ ID NO: 206762 - RNA, 64 nt, Human
uuucuguuacauccaccuuugaggcuggucauaccuccaggaacaauacagagccagucaacuu

SEQ ID NO: 206763 - RNA, 64 nt, Human
ucaccugagcgcaccaccaccuggcguguagaaucuccaggaagccuggcugcagcuucccauu

SEQ ID NO: 206764 - RNA, 64 nt, Human
cucaguggguuaacaucaguuuuguuuacucauccuccaggaacugcaggucaaguugucaggu

SEQ ID NO: 206765 - RNA, 64 nt, Human
gagagggcacgagaacccaaagggaauagagauucuccaggaauuuccucuaugggaccuuccc

SEQ ID NO: 206766 - RNA, 64 nt, Human
agcccuggauacagcuagagagcaggacuucacccuccaggagcugacuggguguugcugaagc

SEQ ID NO: 206767 - RNA, 64 nt, Human
uucuccgucccugccccagcaagacaacuuagaucuccaggagaacugccauccagcuuuggug

SEQ ID NO: 206768 - RNA, 64 nt, Human
guguaccuaaagccauauuuccaagucugugguacuccaggauuccaggaguaagccuguagaa

SEQ ID NO: 206769 - RNA, 64 nt, Human
agcccccccugagccccaccuccuccagggagcccuccaggaagccccuucccugacuccuggc

SEQ ID NO: 206770 - RNA, 64 nt, Human
gggaggggcaggggagauguggggaaguccaggacuccaggaggugaaaaggaaaaaaaaaaaa

SEQ ID NO: 206771 - RNA, 64 nt, Human
accucccuccuccugagucggugugugugucucucuccaggaaucuuugucucuaucugugaca

SEQ ID NO: 206772 - RNA, 64 nt, Human
uguacuauacagaggccagauguuggcaccaccucuccaggaggauuggaaaggaggaguaaag

SEQ ID NO: 206773 - RNA, 64 nt, Human
uuuuccagauacguuugccagcaaagcugcugcccuccaggauguauaugcagacgccuccauu

SEQ ID NO: 206774 - RNA, 64 nt, Human
ugugauucccagagagcuggcagauugugacaaucuccaggagaaccuacagauuggaagcagc

SEQ ID NO: 206775 - RNA, 64 nt, Human
uucccuuuauuugcuucccccuccuccccucggccuccaggaagccaccguggccggccaagca

SEQ ID NO: 206776 - RNA, 64 nt, Human
uuauuuaugaaggcccugggagcagcguuaagggcuccaggauccagcucucuuugcauuuggu

SEQ ID NO: 206777 - RNA, 64 nt, Human
uccuagaguccagcugcagaaggaguggcuuuuccuccaggaaggggcuucuggguguccccuc

SEQ ID NO: 206778 - RNA, 64 nt, Human
uuggcucuuagcaaagcagguggcccacagugaccuccaggagguggcugauuuuccuuugugc

SEQ ID NO: 206779 - RNA, 64 nt, Human
ugaucugaugauuuauuuaaagagccguugaugccuccaggaaacuuaaguauuuuauuaauau

SEQ ID NO: 206780 - RNA, 64 nt, Human
cuaaagcuaguuaaugucagugacauuaaacuaacuccaggauucaggaguuuuaauguuagaa

SEQ ID NO: 206781 - RNA, 64 nt, Human
gggcccuccuggggagcccccgcuccagggcucgcuccaggaccuucuucacaagaugacuugc

SEQ ID NO: 206782 - RNA, 64 nt, Human
accacucacuuaguaaaugucauaacuacaccugcuccaggaccaaucagugaaaccugcucgg

SEQ ID NO: 206783 - RNA, 64 nt, Human
aaaggaaaacggaagcaggguucuugccugguagcuccaggacccagcucugcaggcacccaaa

SEQ ID NO: 206784 - RNA, 64 nt, Human
ugcacggaugguaaggaauauggauaacucacugcuccaggacucagaccucgaccccagaggc

SEQ ID NO: 206785 - RNA, 64 nt, Human
ggaagcagugcccgccaggccugggccaggagagcuccaggaagggcacugagcgcugcuggcg

SEQ ID NO: 206786 - RNA, 64 nt, Human
gagaugacuguggaugagggguccaugcaggcaucuccaggaugcccugacacugugcuuuagg

SEQ ID NO: 206787 - RNA, 64 nt, Human
aacuuuggcucccuuucccuucucucucugguagcuccaggaggccugugauccagcucccugc

SEQ ID NO: 206788 - RNA, 64 nt, Human
uugcucuucauccagggaacugagcacagggggccuccaggagacccuagaugugcucguacuc

SEQ ID NO: 206789 - RNA, 64 nt, Human
ggggccucaucugggccagcuuggacucugcuuccuccaggagcagcagggaagcucugggcca

SEQ ID NO: 206790 - RNA, 58 nt, Human
cugcuguuaagcugcauuaguaaagaugcuccaggagugugguccagccagcgcucuu

SEQ ID NO: 206791 - RNA, 64 nt, Human
uuucacugaucauuuaaagaguuugaccucagagcuccaggaucaucaguaaauuugucauguu

SEQ ID NO: 206792 - RNA, 64 nt, Human
cgagccccacagcccccuccucaaaaacgaccaccuccaggacucagugaucccuggggggcag

SEQ ID NO: 206793 - RNA, 64 nt, Human
aacccaaugccucccuuugcuccuggaugccccacuccaggaaucaugcuugcuccccugggcc

SEQ ID NO: 206794 - RNA, 64 nt, Human
cccccagaccucucuguguugugugcguggcagccuccaggaauaaacauucuuguuguccuuu

SEQ ID NO: 206795 - RNA, 64 nt, Human
guccuguggucauaaaacuccagggaccucuauccuccaggagucucagccuuucccugggcgc

SEQ ID NO: 206796 - RNA, 64 nt, Human
ucaccagccaggcaccugugacacgagugcugcucuccaggaucuccacuacauguuccagguu

SEQ ID NO: 206797 - RNA, 64 nt, Human
ggcuucuccccagaaugcacuuuguggcugagugcuccaggacuccuagggagcaagguccucc

SEQ ID NO: 206798 - RNA, 64 nt, Human
ugacugaggcggagcccagcccuccagcgucugccuccaggagcugcaagaaguccauauuguu

SEQ ID NO: 206799 - RNA, 64 nt, Human
gaagguggaggucuacgcagaugccgacgaaauccuccaggaggagaucaaggaguacaaggug

SEQ ID NO: 206800 - RNA, 64 nt, Human
ugguauacauuccaaacugauaguacauugccaucuccaggaagacuugacggcuuugggauuu

SEQ ID NO: 206801 - RNA, 64 nt, Human
ccuuuauucuggcagaggagggagcaucagugcccuccaggauagacuuuucccaagccuacuu

SEQ ID NO: 206802 - RNA, 64 nt, Human
gaagagccuacucugaugaccguggccuuggcuccuccaggaaggcucaggagcccuaccuccc

SEQ ID NO: 206803 - RNA, 64 nt, Human
gcuccagacacauguccaagaagcccaggaaaggcuccaggagcagccacauuccugaugcuuc

SEQ ID NO: 206804 - RNA, 64 nt, Human
acugcaggacugcgccuacugagugacccauuuccuccaggaggaaaggcaagacacgcuuaca

SEQ ID NO: 206805 - RNA, 64 nt, Human
aauguuuauuuagcucugaagcaagagugauauacuccaggacuuagaauagugccuaaagugc

SEQ ID NO: 206806 - RNA, 64 nt, Human
uccggcuguggagcuccccugccagccccuggagcuccaggagggccuguugguccccuguuca

SEQ ID NO: 206807 - RNA, 64 nt, Human
uuuucuuuuugugcauuguccucaugccuguauucuccaggaaacuuguccuucuggaaaucau

SEQ ID NO: 206808 - RNA, 64 nt, Human
cacugccaucuugccauguacaggcuugggguggcuccaggaagccucguccagugauauauuu

SEQ ID NO: 206809 - RNA, 64 nt, Human
cuugacuucaagugacagccccagguggccaggccuccaggaggcaccaggcaggcccuguauc

SEQ ID NO: 206810 - RNA, 64 nt, Human
aagaggcagggccagguuuugggauaggcuuugccuccaggaugggcugcuccugggccuggug

SEQ ID NO: 206811 - RNA, 64 nt, Human
cccuggcguacaggguuuccugcccgaggagcugcuccaggagccugcgcggcucgccuggaaa

SEQ ID NO: 206812 - RNA, 64 nt, Human
ucggcugacuuagcccccugcucacucuaggugccuccaggaggugagcccugggugcagcugg

SEQ ID NO: 206813 - RNA, 64 nt, Human
cagacccuucugaucacagcacccaggagcuugucuccaggaaggcggccccguccccuacuca

SEQ ID NO: 206814 - RNA, 64 nt, Human
guuuuaauuuucaaugaagucacugaaaauccaacuccaggagcuauggcaguguuaaugaaca

SEQ ID NO: 206815 - RNA, 62 nt, Human
auggaauguugcccccuuaaacaccauuuucccuccaggaccaccuugguuucuaggcacug

SEQ ID NO: 206816 - RNA, 64 nt, Human
gaguuccggugacccauuuccccagccgugucgucuccaggaccacccgauggaaauaacaggc

SEQ ID NO: 206817 - RNA, 64 nt, Human
ugcuuguaucccugcugauaagaggagggagucacuccaggaauaagacaaaaggagaggagga

SEQ ID NO: 206818 - RNA, 64 nt, Human
gcaccucugccccgacagaauggggcugaaucagcuccaggaggaaccaggcccugcucuccug

SEQ ID NO: 206819 - RNA, 61 nt, Human
guaacccgaaggccaagugagaagcuggaggcuccaggacuccacuggacagacccagguc

SEQ ID NO: 206820 - RNA, 64 nt, Human
guguugcccuugccccuaaccucagcccgagggucuccaggauguugccuggcccaggacuugg

SEQ ID NO: 206821 - RNA, 64 nt, Human
uuacuccuccuccaaugggacucaaggacuugaccuccaggaguaggccccuggucagaagugc

SEQ ID NO: 206822 - RNA, 64 nt, Human
guggcucuuucuguccuucagccccuggaaggugcuccaggauaacaaagaagggcagguugaa

SEQ ID NO: 206823 - RNA, 64 nt, Human
gcagccgccacauccccgcuggcugggggccucacuccaggaaggggcuggacuggcuguccuu

SEQ ID NO: 206824 - RNA, 64 nt, Human
ugcaucaacuucaagaaagggacaauuugugcagcuccaggaugggaagguggagugggugagc

SEQ ID NO: 206825 - RNA, 64 nt, Human
ccucccacaaagccaacacucugugaccaccacacuccaggaggcagccccauccccuuccagc

SEQ ID NO: 206826 - RNA, 64 nt, Human
cuugggccugggguggggggaagguguuagaggacuccaggagcuccugcaccccuccccaaau

SEQ ID NO: 206827 - RNA, 64 nt, Human
accggucagaagccgccucccucgcucccugcuccuccaggaauucccagcaggcucucuggug

SEQ ID NO: 206828 - RNA, 64 nt, Human
ugaaaggcagaagagucuaauugugccuggauuucuccaggacagcaguggccccucguuuuau

SEQ ID NO: 206829 - RNA, 64 nt, Human
cuguguguggaggacaaagcuucuuccugcguggcuccaggaaaagauguggcucacguaggug

SEQ ID NO: 206830 - RNA, 64 nt, Human
gcucaggugaccccagccuucacugucucccgcucuccaggagcuuaucuucgccccaucuccc

SEQ ID NO: 206831 - RNA, 64 nt, Human
gcugcaacccaaugacaccuguauuguuccagcgcuccaggacucuggguucuuaagauuucug

SEQ ID NO: 206832 - RNA, 53 nt, Human
cccacuaccgcuggugguagagucuccaggaggagcccagggcccucugccgc

SEQ ID NO: 206833 - RNA, 64 nt, Human
uuguaaagagggagcacauugacuugggaauuuccuccaggaaacucagggcuguuuucucuuc

SEQ ID NO: 206834 - RNA, 64 nt, Human
gggcucaggaggggcucucagggacuccuggugacuccaggaaaaugcugccaucguuaaacau

SEQ ID NO: 206835 - RNA, 64 nt, Human
ucucgcccugcccauggccaccccagacucugaucuccaggaaccccauagccccucuccaccu

SEQ ID NO: 206836 - RNA, 64 nt, Human
gaugagcaccaacaugugaggggugaaccuuggccuccaggacaucugcacccccuccccaccu

SEQ ID NO: 206837 - RNA, 64 nt, Human
uacacacacuccacagccaagcacugccacgguccuccaggaccugggaagcaaaggcacaggc

SEQ ID NO: 206838 - RNA, 64 nt, Human
gggggguggcacagcagcuuggguaccccccaaccuccaggagcuaguggagggguguguaaca

SEQ ID NO: 206839 - RNA, 64 nt, Human
aaacugcaccagcuagacuccauucugggaccaucuccaggaguccaugagaggcuuucuucuc

SEQ ID NO: 206840 - RNA, 64 nt, Human
ugggacuugcuggaaaacggggaugcuugccccucuccaggacuauugagcccagagagagcug

SEQ ID NO: 206841 - RNA, 64 nt, Human
gacagaagcccuggggcaaccuccucggccaccccuccaggacagucccucucuguggagaacu

SEQ ID NO: 206842 - RNA, 64 nt, Human
ccaaaugguguuccaaguugguugcugugacaaccuccaggaagagccacuuguuacccucuau

SEQ ID NO: 206843 - RNA, 51 nt, Human
ugguggggacugcucccuagacuccaggagccauaucccagaccuuugcca

SEQ ID NO: 206844 - RNA, 64 nt, Human
gucauggagaaugcaggcaguuaacuuaauaucccuccaggaaugguuccuacguuguguauua

SEQ ID NO: 206845 - RNA, 64 nt, Human
accccucaaccccaaguccucugcuuggggaguucuccaggagcuccggacccugagucaaugu

SEQ ID NO: 206846 - RNA, 64 nt, Human
aggggguccccuucuguuaccaccccccacccuccuccaggacaccacuagguggugcuggaug

SEQ ID NO: 206847 - RNA, 64 nt, Human
agcggcuuccaguuccccgcuccugacuccugaccuccaggaugucucccgguuucuucuuuca

SEQ ID NO: 206848 - RNA, 64 nt, Human
uuucuaaauugaaaacacgccccccuccccacaccuccaggaacuccacucccagucuuagagc

SEQ ID NO: 206849 - RNA, 64 nt, Human
gaccuugggagccugggcuugaaggacaguugcccuccaggagguuccucacacacaacuccag

SEQ ID NO: 206850 - RNA, 64 nt, Human
aaggaaaagcagaaguucaugggcaccucauggacuccaggauccuccuggagcagcagcugag

SEQ ID NO: 206851 - RNA, 64 nt, Human
acagcaucauuaacauccgucuccuuaguguguucuccaggagacacguccccaugugugagcg

SEQ ID NO: 206852 - RNA, 64 nt, Human
aggagagaagacgccacagauuuccuucccucuccuccaggagaccauaagauagaucccccau

SEQ ID NO: 206853 - RNA, 64 nt, Human
uccaccccaguggggacagccauuccccuaccugcuccaggagccuggauuggcuuuaaauggc

SEQ ID NO: 206854 - RNA, 64 nt, Human
ucccugccucacuccuccgugagcaccaccagggcuccaggagccucauccagccucagagauc

SEQ ID NO: 206855 - RNA, 64 nt, Human
ucuggauguccagccagcugcccccuuccagccccuccaggaccccuggacccacugccgcugc

SEQ ID NO: 206856 - RNA, 64 nt, Human
agugcccggaugcccucccugcacccuuccauuucuccaggagccuggcacugcuuccuccacc

SEQ ID NO: 206857 - RNA, 64 nt, Human
agcaagggaggcaaucacacugaagcgggucuuccuccaggaacggggucccacaggcguguug

SEQ ID NO: 206858 - RNA, 64 nt, Human
augccgggcacgggcgcuccugcugccgucucugcuccaggaagcugccuccucugggcccucu

SEQ ID NO: 206859 - RNA, 64 nt, Human
acauccuaccccagaugcuaaagugauucaaggacuccaggacaccucuuaagagccuuucuaa

SEQ ID NO: 206860 - RNA, 64 nt, Human
ccuacuggacgcugcccugcaugcugcccagccacuccaggaggaagucgggaggcguggaggg

SEQ ID NO: 206861 - RNA, 64 nt, Human
guggcuuuggugacacacucacuucuuucucagccuccaggacacuauggccuguuuuaagaga

SEQ ID NO: 206862 - RNA, 64 nt, Human
guggucgcacgcccugagggcaccccgacucugucuccaggagucucaucagcaaaccgcugac

SEQ ID NO: 206863 - RNA, 64 nt, Human
cccccaacacgguguccugccacccagcgccuggcuccaggaaaacacgcuugccuuccuuccc

SEQ ID NO: 206864 - RNA, 64 nt, Human
uaaggaaggcacugaaagaaacacggcggaaucucuccaggagaagcucggcguuacccccggc

SEQ ID NO: 206865 - RNA, 64 nt, Human
agugcucuugguauacacuugggaaaauaauguccuccaggagaaaguguuagagggaacuaac

SEQ ID NO: 206866 - RNA, 64 nt, Human
gcacuccggccuaggugacagagggaaacuccaucuccaggaaaaaaaaaaaaaaacccaauuu

SEQ ID NO: 206867 - RNA, 64 nt, Human
uggcuuguguugccugcuacgcauugacuuggaucuccaggaguccccugcacauaccuucucc

SEQ ID NO: 206868 - RNA, 64 nt, Human
cuguucuuaugcucauuuuguauuuuccuuucaacuccaggaauauccuugagcauaugagagu

SEQ ID NO: 206869 - RNA, 64 nt, Human
gcagggucaggccucagcaucucacauccaccaccuccaggaggggagaccacugguaaguccu

SEQ ID NO: 206870 - RNA, 64 nt, Human
auuacaaaagaucagaucaugaaaggcaguaacucuccaggacuggaauaucugauugcucagu

SEQ ID NO: 206871 - RNA, 64 nt, Human
aucagggcaaucccaacacaugucuagcuuucaccuccaggaucuauugagugaacagaauugc

SEQ ID NO: 206872 - RNA, 64 nt, Human
uguauugucgucccaacggaaggagagcuccugacuccaggaugggcugcagguugcagucagg

SEQ ID NO: 206873 - RNA, 64 nt, Human
gcugaaggcacacgcucaaugccccacgugccuucuccaggaggaacgaagcaggguuugaggg

SEQ ID NO: 206874 - RNA, 64 nt, Human
uuggggcugggcagagccuguccccuccccccuucuccaggagccagggggugacuggagagac

SEQ ID NO: 206875 - RNA, 64 nt, Human
ggcccggggggaccaggaugacaccuccauuucucuccaggaaguuuugaguuucucuccaccg

SEQ ID NO: 206876 - RNA, 64 nt, Human
gacccccuccggggaacaccgggaaggcucgacgcuccaggacaggaccagccacgcagacagg

SEQ ID NO: 206877 - RNA, 64 nt, Human
guccccagguccugucucugcacagaaacuugaacuccaggauggaauucuuccuccucugcug

SEQ ID NO: 206878 - RNA, 64 nt, Human
ugggaggggcuaggcugaccccauccuccucucccuccaggagcccccagcauguccugaccug

SEQ ID NO: 206879 - RNA, 64 nt, Human
ggccccagagaccugacccaacacccccgacggccuccaggaggggccugggcagccccacagu

SEQ ID NO: 206880 - RNA, 64 nt, Human
ccucugggacaggcccucccccauguucuucugucuccaggaagggcagcggcccucccaucac

SEQ ID NO: 206881 - RNA, 64 nt, Human
ggcugcugagcucuguggagccagcucaccuguucuccaggaccagcccugcuggggcccaggc

SEQ ID NO: 206882 - RNA, 64 nt, Human
aucucccugccagccccuaacuacccuccccagccuccaggaacuauccauccacucuuaucuc

SEQ ID NO: 206883 - RNA, 64 nt, Human
ccaacuucucccaccccuuggccccucacauccucuccaggaagggagugaggggcugugacau

SEQ ID NO: 206884 - RNA, 64 nt, Human
uggggaagagcaaaauacauggagacgacgcacccuccaggaugcucgcugggauucccacgcc

SEQ ID NO: 206885 - RNA, 64 nt, Human
acacagccccagaagggucccagagcugaccccacuccaggaccuaggcccagccccucagccu

SEQ ID NO: 206886 - RNA, 64 nt, Human
gauggggggguagugguuaccccgggcugggccccuccaggagucacagaugaggcccccgcag

SEQ ID NO: 206887 - RNA, 64 nt, Human
gacuuggguuguaaauuuauuuguggggagugcgcuccaggaagagccaccaucccugcccccg

SEQ ID NO: 206888 - RNA, 64 nt, Human
cagcccugguuaggcacugagggcucuggacgggcuccaggaacccugggcugaugggagcagu

SEQ ID NO: 206889 - RNA, 64 nt, Human
ucccggaccagcuccgccuccccugcccuccucucuccaggaaggagccagaacccucaccccu

SEQ ID NO: 206890 - RNA, 64 nt, Human
ggcaguggcugcagagggagccuccugcucccugcuccaggaugaaaccaagagggggauguca

SEQ ID NO: 206891 - RNA, 64 nt, Human
ccuucucacgucagugcaugucacaugcauccugcuccaggacugguuuccuagccucccgcua

SEQ ID NO: 206892 - RNA, 64 nt, Human
gaaaccgagaugcuucccgcagccguggacgauucuccaggacucuuuuuuuaccuugagcacu

SEQ ID NO: 206893 - RNA, 64 nt, Human
cggcgcacggacuggccaggccccgcgggccgggcuccaggaagggccugcacgaacccuacag

SEQ ID NO: 206894 - RNA, 64 nt, Human
ucugcccuaagucagauugaagccuccuccuaggcuccaggaggagcaugugcaggaaggguug

SEQ ID NO: 206895 - RNA, 64 nt, Human
gguuaacaucucagaaaacucugguaaaugaucacuccaggauauugacaagaauacacguuac

SEQ ID NO: 206896 - RNA, 64 nt, Human
ugggccgggccgggccggggaagggccgagcaggcuccaggaggccuccagagucagcuggacc

SEQ ID NO: 206897 - RNA, 64 nt, Human
ggggagaaggugugagaccucuaggggcugucuccuccaggaagcccuccgggaagcacagcaa

SEQ ID NO: 206898 - RNA, 64 nt, Human
cucccuuuggugaccugaagucacugugacaguucuccaggaaggaggagcuuccuacuuuuga

SEQ ID NO: 206899 - RNA, 64 nt, Human
caucagugcuaauguuccucuuuuggguauaguucuccaggagaacuuguccuauauuucuuug

SEQ ID NO: 206900 - RNA, 64 nt, Human
ucagacucuggcagggcucccagaggagcaucaacuccaggagaacagggauuucuaucaaugu

SEQ ID NO: 206901 - RNA, 64 nt, Human
cuuaccugaucucauguuaggccuaagaggcuuucuccaggaggauuagcuuggaguucucuau

SEQ ID NO: 206902 - RNA, 64 nt, Human
gagcgaccaggacuacauuucccaagaggcucugcuccaggaguccaggaaagacgaggcaccu

SEQ ID NO: 206903 - RNA, 64 nt, Human
cugcacacucuggggagccaggggccccagcacccuccaggacaggagaucugggaugccuggc

SEQ ID NO: 206904 - RNA, 64 nt, Human
ggcccaggcucacccccaccuugggccucaccuccuccaggaagccuucccagcuacccgaagc

SEQ ID NO: 206905 - RNA, 64 nt, Human
gguuaauaccagcuuaaaggcaguauuuuguguccuccaggagcuucuuguuuccuuguuaggg

SEQ ID NO: 206906 - RNA, 64 nt, Human
gcuuagauaagacacccccucaaacccauucccucuccaggagaccuacccuccacaggcacag

SEQ ID NO: 206907 - RNA, 64 nt, Human
ccaguggcuugccccacccccuuauagcaucucccuccaggaagcugcugccaccaccuaacca

SEQ ID NO: 206908 - RNA, 64 nt, Human
cuucuuucaagggcuaaggcugcagagauauuuccuccaggaaucguguuucaauuguaaccaa

SEQ ID NO: 206909 - RNA, 64 nt, Human
ugcaugcccucucugagucuggacuuugcuuccccuccaggagggaccacccucccugacuggc

SEQ ID NO: 206910 - RNA, 64 nt, Human
gagcuggaauucuaaaugcuggucuaggagcugucuccaggauggugcaggauggcuuugcgga

SEQ ID NO: 206911 - RNA, 64 nt, Human
uuucauuugccauucauguccuguaauacuucaccuccaggaacugucauggauguccaaaugg

SEQ ID NO: 206912 - RNA, 64 nt, Human
ugcagacagggaggccaccccaauaggaauucgucuccaggauuuuucccaugugucccccagu

SEQ ID NO: 206913 - RNA, 64 nt, Human
aguuucuuccccgaguggagcuucgacccacccacuccaggaacccagagccacauuagaaguu

SEQ ID NO: 206914 - RNA, 64 nt, Human
aacagauuuaaagacagguggccacugacagccacuccaggaacuugaacugcaggggcagagc

SEQ ID NO: 206915 - RNA, 64 nt, Human
cgagaugccgguacuuaaaagcuucauucagaagcuccaggaggaagaagaucgggaaguaaag

SEQ ID NO: 206916 - RNA, 64 nt, Human
ccuccgcacggcccgccagcuggcuucgaggaaccuccaggagagaagugccuguugguccagg

SEQ ID NO: 206917 - RNA, 64 nt, Human
gguggggugagggccaaaggcuaugguuuccugccuccaggagaauggagagaaagggcuucca

SEQ ID NO: 206918 - RNA, 51 nt, Human
auaaggaggagcuugaauaaccuccaggauuuggcucauaauccaggccuc

SEQ ID NO: 206919 - RNA, 64 nt, Human
aaagaccuccuggccaaguccugcccucuuaagucuccaggaacgcugcagggaaaacccagcu

SEQ ID NO: 206920 - RNA, 64 nt, Human
ccuucuuccucgccucuccagauuguccuggaaccuccaggauccuugacugagggcguuggga

SEQ ID NO: 206921 - RNA, 64 nt, Human
uacccucugccucucaccaggagacacucugggccuccaggacaauugcugcuugccggcucuu

SEQ ID NO: 206922 - RNA, 64 nt, Human
ccccguguccccaguuccgucucagcuaccuggacuccaggacccuggagaagggagaccuggc

SEQ ID NO: 206923 - RNA, 64 nt, Human
cuacuugggaggcugaggcaggagaaucgcuugacuccaggaggcgcaggcugcagugagcucu

SEQ ID NO: 206924 - RNA, 64 nt, Human
agaugggaggugggcgcgguggccuccuccuucccuccaggaccugcccgugugaagacccccc

SEQ ID NO: 206925 - RNA, 64 nt, Human
gacguccacgggcaggagaagguggauauuucagcuccaggaaagagagcuaauucacucucuc

SEQ ID NO: 206926 - RNA, 64 nt, Human
gcccugggucacccccacucugccucauuucugccuccaggaugccacugccucugcuuccagg

SEQ ID NO: 206927 - RNA, 64 nt, Human
aucuuuugcuacaaaccauguuugcguuugagcucuccaggauuuuacauuuuuggguaaccuc

SEQ ID NO: 206928 - RNA, 64 nt, Human
aaccucuuggccugaucagaccacggcucgauuucuccaggauuuccugcuuugggaagccgug

SEQ ID NO: 206929 - RNA, 64 nt, Human
uccuguuaagugucauauucuuguaaucugcauucuccaggaguuuuauguguuuaauagauga

SEQ ID NO: 206930 - RNA, 64 nt, Human
guuacuuuucacuccagcaccuucauacgcuuuucuccaggaggagguucuugcagcuggaaac

SEQ ID NO: 206931 - RNA, 64 nt, Human
gcuguggugcccauuugcagugacugugaagugacuccaggacggaccugcgggggcacccaga

SEQ ID NO: 206932 - RNA, 64 nt, Human
ugcuaaauugagaaucuuagggguaaagcacccccuccaggaccggguuucucagccuuggcac

SEQ ID NO: 206933 - RNA, 64 nt, Human
aguuaaagucagucaccuccccagaagggccacacuccaggaggaguguugagagucauuugag

SEQ ID NO: 206934 - RNA, 64 nt, Human
augcucccgccggaccgagccccagcaagggcuccuccaggauugcaaaaaaaaaaggaagaga

SEQ ID NO: 206935 - RNA, 53 nt, Human
gggagccugccggcuacugagugcuccaggaggacaaggcugacaagcaaucc

SEQ ID NO: 206936 - RNA, 64 nt, Human
uucuccacagcucccuucccuugccccuucgggccuccaggauauguuugcgggggugggugug

SEQ ID NO: 206937 - RNA, 53 nt, Human; identical to SEQ ID NO: 206935

SEQ ID NO: 206938 - RNA, 64 nt, Human
ccuccucuucacuuggccaguuucagcucacuuccuccaggaagucuuuccugauauaucaaac

SEQ ID NO: 206939 - RNA, 64 nt, Human
guccuaaaaguucaucacagggucuuucuuucuacuccaggacugguuuuguuuuuauauauau

SEQ ID NO: 206940 - RNA, 64 nt, Human
caggugcugggcugucggggaggccucaggccaccuccaggaacagaacacaguuuuaaguuug

SEQ ID NO: 206941 - RNA, 64 nt, Human
gggguucuuugcuucagcugcacaucggcugccucuccaggaagcguguucaacacauggaauc

SEQ ID NO: 206942 - RNA, 64 nt, Human
aaaagggaggcuugaccccgggcaccaugggccacuccaggaugggacacggccccucuuucuu

SEQ ID NO: 206943 - RNA, 64 nt, Human
cuggaaagcccauucccuuuauuuagaaaacgagcuccaggaagccgcuacuuuguguccauuu

SEQ ID NO: 206944 - RNA, 64 nt, Human
gggccugccuguggucagggccaaguguucccuccuccaggaaagccuuuacccuccucaugcc

SEQ ID NO: 206945 - RNA, 64 nt, Human
ggcagggcugccuggaacaccgcugccacuguggcuccaggaggcccuugggagcaugaggaga

SEQ ID NO: 206946 - RNA, 64 nt, Human
ugggaguuguguuccugugcaagggggagcuuugcuccaggacaggaugacugucuucccuauu

SEQ ID NO: 206947 - RNA, 64 nt, Human
ccgugacucagccuggacaccggacaugacugcccuccaggaauaaccccucccugagacauag

SEQ ID NO: 206948 - RNA, 64 nt, Human
auugauuacaaguucucugcugugguugcugcagcuccaggaaguccccgcaaugucucacguu

SEQ ID NO: 206949 - RNA, 64 nt, Human
caccaagccugugucucccucuucuaucaccucucuccaggaucucugcugucucuuggauccc

SEQ ID NO: 206950 - RNA, 64 nt, Human
cuuguuugccaggucucuagcaucuccagcaggacuccaggaugguucagcccagcaccaucca

SEQ ID NO: 206951 - RNA, 64 nt, Human
gucaccauaauuuugaagacuugcaugcagagggcuccaggaauuguagacauuaaggaauuuc

SEQ ID NO: 206952 - RNA, 64 nt, Human
gccaaucuacuagauaaauggccuucaggcagugcuccaggaauccuggggggucccaggccac

SEQ ID NO: 206953 - RNA, 64 nt, Human
gcaccccagcgcucccaccuagaugggucugauccuccaggauccccacccaaagccugauggc

SEQ ID NO: 206954 - RNA, 64 nt, Human
agagagugacagcugcucaggcccuaacccuuggcuccaggagacacagggcccagcacccagg

SEQ ID NO: 206955 - RNA, 64 nt, Human
uugagacgcaucccaggaggugacgaggcaggggcuccaggaaaggaaucagagacaauucaca

SEQ ID NO: 206956 - RNA, 64 nt, Human
uggggggacaggacaauuucucccccuccaggggcuccaggacucucccuggggggcccaccuc

SEQ ID NO: 206957 - RNA, 64 nt, Human
guugguuccaugccuggcccagccccaccucagucuccaggacauuccuuucccagcuccagcc

SEQ ID NO: 206958 - RNA, 64 nt, Human
aggcaggcaaaggggagaccagagggucuguguucuccaggagaaugaggguguuggucccaga

SEQ ID NO: 206959 - RNA, 64 nt, Human
cugggggaaaaggcugugggccguuaggaccauccuccaggacaggugaccucuaugaggucac

SEQ ID NO: 206960 - RNA, 64 nt, Human
aauagucucaggugggaacaccuucucuugcuagcuccaggaaggcuuugugggaaaugaguug

SEQ ID NO: 206961 - RNA, 64 nt, Human
aggcuguuucccaaugucaaguuauuaggguagacuccaggaggugggauucuucaacuaaaga

SEQ ID NO: 206962 - RNA, 64 nt, Human
cugaagggcuggauaagaacccugagaggggguacuccaggacugucuccauaacaucauuggg

SEQ ID NO: 206963 - RNA, 64 nt, Human
ucaaccaacuggacgggagagaguacugcuccuacuccaggacucucacaaagcugaugagcug

SEQ ID NO: 206964 - RNA, 64 nt, Human
uggauggccuccagcaacucagggauaacaugggcuccaggagggacccucugguccagcugcc

SEQ ID NO: 206965 - RNA, 64 nt, Human
gccggggacggacagggcagagggcagcgggcagcuccaggaacacgguggaacgggguucauu

SEQ ID NO: 206966 - RNA, 64 nt, Human
cuacguucagggcuguggccguggugaggaccgacuccaggaguccccuuucccugucccagcc

SEQ ID NO: 206967 - RNA, 64 nt, Human
ggucuagggaaugagacaggaccuaggauaucuucuccaggaugucaacugaccuaaaauuugc

SEQ ID NO: 206968 - RNA, 64 nt, Human
cugauuuuugucuuuuaauccauuucaggacucucuccaggagggcucggggugugucauuucu

SEQ ID NO: 206969 - RNA, 64 nt, Human
uccuuaugaugacuuuuagggacuacccagauuacuccaggauaaucuccucaccucaugaguc

SEQ ID NO: 206970 - RNA, 64 nt, Human
ccuucaaauucagucaccacuguuauauuaccuucuccaggaacccuccaguggggaaggcugc

SEQ ID NO: 206971 - RNA, 64 nt, Human
acaaauagcagcaccacuuuggauugauuuugcucuccaggacaucagcacauggcccugauca

SEQ ID NO: 206972 - RNA, 64 nt, Human
guuagcagaggccagccagcacugugcugcacaacuccaggaacuccaugguaugcucacaauu

SEQ ID NO: 206973 - RNA, 64 nt, Human
ucauuuccucccuccuuggggcuucugcccagggcuccaggaucagggauauuacuucucaacc

SEQ ID NO: 206974 - RNA, 56 nt, Human
ugaaggauaucguucucuaaaccagucuccaggaagaagagaaagaaaccacacug

SEQ ID NO: 206975 - RNA, 64 nt, Human
aaggaaggcaccaaaaggaaacaagcuggaaucgcuccaggaaaaacucugguuacaccuggaa

SEQ ID NO: 206976 - RNA, 64 nt, Human
ugggugcguaaggaugugugaguuuugcuuuugacuccaggaacaaaaagguaaaucccacauc

SEQ ID NO: 206977 - RNA, 61 nt, Human
uggugagaaacaagccauaaggggcaaagggcuccaggauuugaaucuucucuuggugagg

SEQ ID NO: 206978 - RNA, 64 nt, Human
uuuagaaauuaugcugucacugccaaacaguaaccuccaggagaaaacaagaugaauagcagag

SEQ ID NO: 206979 - RNA, 64 nt, Human
ugaucuuaggucucaugaucugagugcauacccucuccaggaaggaaacugcaccagugucuau

SEQ ID NO: 206980 - RNA, 64 nt, Human
gccccccagcuuucugguagcuucuuccagccuauacuggcaccaugugagcuggaagcugccu

SEQ ID NO: 206981 - RNA, 64 nt, Human
uguuaauuaauggguauaaaauuuaaaucaguauuacuggcagacguuauuuuaggaaaacacc

SEQ ID NO: 206982 - RNA, 64 nt, Human
agaugaagaagucuuugagcagaagcacguuaagaagcccgaagggcuuuucagaaaucgguuu

SEQ ID NO: 206983 - RNA, 64 nt, Human
augguauaaugguugacuggguuucucuguauaguacuggcaugguacggagauguuucacgaa

SEQ ID NO: 206984 - RNA, 64 nt, Human
uuuauuauaugcaaaaucucugucuauuaugagauacuggcauugaugagcuuugccuaaagau

SEQ ID NO: 206985 - RNA, 64 nt, Human
cuugggggguugggggauggugggaugugugugcuacuggcauccaguaaauagaagccagggg

SEQ ID NO: 206986 - RNA, 64 nt, Human
uuuuuuauagccuauuucuuuaauauuaaagauguacuggcauuacuuuuauggacagaucuug

SEQ ID NO: 206987 - RNA, 64 nt, Human
cuaauccuaaauuuuuaaaaggugaaaaaguuuuuacuggcaauuggguggccuugggaccugu

SEQ ID NO: 206988 - RNA, 64 nt, Human
uacccaauucuauaugaagaauucauggagaguguacuggcacuggaagaguuuaguguuucuu

SEQ ID NO: 206989 - RNA, 64 nt, Human
auaggccuucuacuagccagcaguucucucuggauacuggcaucagcaggucuccuuuuucuug

SEQ ID NO: 206990 - RNA, 64 nt, Human
auuuuagacuguguauuuccauaaauacccuacguacuggcauauuugaaacucuuuuuccagg

SEQ ID NO: 206991 - RNA, 64 nt, Human
gccucuacaauauugacuauauauuuuuauaaacuacuggcaaggaacuuacccagcuguuaua

SEQ ID NO: 206992 - RNA, 64 nt, Human
cccuuggggccuggcuugcuccagggucuugggcuacuggcagcuccucuccuugggcuccugg

SEQ ID NO: 206993 - RNA, 64 nt, Human
gacaguuuucuuccgcagcuuggcucuuaaauuuuacuggcagguguaugguuguuggaggguu

SEQ ID NO: 206994 - RNA, 64 nt, Human
caguggaaguagacaaguaagggcuugaaaaugauacuggcaagauacgauuggcucuagaucu

SEQ ID NO: 206995 - RNA, 64 nt, Human
uaggagacccggaugcacuggggcuaucuaacaguacuggcaucugauagguagaggucaggua

SEQ ID NO: 206996 - RNA, 64 nt, Human
uagccauuuugucaagucaucaacuguauuuuuguacuggcauuaacaaaaaaagagauaaaau

SEQ ID NO: 206997 - RNA, 64 nt, Human
gguaucauaguuuaggcccauuuaccuuccccuguacuggcaguucagccgcuuacaugcacuc

SEQ ID NO: 206998 - RNA, 64 nt, Human
uaggccccugggagaagagcagcuuagauuucccuacuggcaagguuuuuaaaaaugagguaaa

SEQ ID NO: 206999 - RNA, 64 nt, Human
gcugggaggaggggcuggggaggaucugcagcugaagcccgaggcaggguuggugugaugccaa

SEQ ID NO: 207000 - RNA, 64 nt, Human
uuucaggaaaacgaaguagguaauaaacaggaaaaagcccgagucugaugcuaagaagaacaua

SEQ ID NO: 207001 - RNA, 64 nt, Human
uuaugugaugcaacacuugaugguacaguaaauuuacuggcauuuuucuccuuaaaaauuaaaa

SEQ ID NO: 207002 - RNA, 64 nt, Human
ucugccacauaaaagacacagaacacagacgccuuacuggcaaccugcuuucaagaccccuguc

SEQ ID NO: 207003 - RNA, 64 nt, Human
gagaaucaucaagauaugaauugaaucgcugcgauacuggcauuucccuacuccccaacugagu

SEQ ID NO: 207004 - RNA, 64 nt, Human
auucucccucuggaaacugaguuacaaccaccaauacuggcagguucccuggauccagaucuuc

SEQ ID NO: 207005 - RNA, 64 nt, Human
cucuacucugcuuuuuuucuacuguuuuaauuuauacuggcaugcuaaagccuuccuauuuugc

SEQ ID NO: 207006 - RNA, 64 nt, Human
gaaggcuggcagacacccuggaacccuggggagcuacuggcaaacucuccuggauugggccuga

SEQ ID NO: 207007 - RNA, 64 nt, Human
gcuucacaucugccucaccccaagcgaggcucucuacuggcacaaacuugcagcaguuccuguu

SEQ ID NO: 207008 - RNA, 64 nt, Human
ugcuuaauaaaacaagcagguacuuacaaauaauuacuggcaguagguuauaauuggugguuua

SEQ ID NO: 207009 - RNA, 64 nt, Human
gcuuguuaaaggacgcguauguagggcccguaccuacuggcaguuggguucagggaaaugggau

SEQ ID NO: 207010 - RNA, 64 nt, Human
ugcguccacugcugucuucccuaccucaccaggcuacuggcagcagcaucccgagagcacauca

SEQ ID NO: 207011 - RNA, 64 nt, Human
guggcuaaagagaugagacaaacaugcaggucgcuacuggcauaguuucauaauuguguacucg

SEQ ID NO: 207012 - RNA, 64 nt, Human
cuugugcauguuuacuuuauuagaguaggaaggcuacuggcauuaauuauuaauaccaaauauu

SEQ ID NO: 207013 - RNA, 64 nt, Human
uacuuuaccaauuuuuaaugguaaucaacucugcuacuggcaugaugaaauaguacauaacugg

SEQ ID NO: 207014 - RNA, 64 nt, Human
ucgcguguuggaagggagcaggaggaaggacugauacuggcaaaucaguagagugaggugaucc

SEQ ID NO: 207015 - RNA, 64 nt, Human
gaagauauuugcuuuaauaaugucuuuuuaaaaauacuggcaccaaaagaaauagauccagauc

SEQ ID NO: 207016 - RNA, 64 nt, Human
cuccuaugcacaccaggauagacaaggcaggggauacuggcagccugcaucauccucccauugg

SEQ ID NO: 207017 - RNA, 61 nt, Human
ccagcgagccucgcccucccaguuuugcucugcccagcaguguuggugcccagagaugaca

SEQ ID NO: 207018 - RNA, 61 nt, Human
ucacgagccacagguggggcucauccaggccgcccagcagcugcugugugaugagcaggcc

SEQ ID NO: 207019 - RNA, 61 nt, Human
gcgccugguccuguccucuugagcugcccuugcccagcacugcacucuggagguggguggu

SEQ ID NO: 207020 - RNA, 64 nt, Human
agccugugacagguggcagcgcccccaggugggguacuggcaucagagccuggugcgccccuag

SEQ ID NO: 207021 - RNA, 64 nt, Human
guagauacaaacccugaaaagagaauccaugugcuacuggcaggcaacauuuuuuaaagcucuu

SEQ ID NO: 207022 - RNA, 64 nt, Human
cugcaggcucaagaguguuguccagauguuucuguacuggcauagaaaaaccaaauaaaaggcc

SEQ ID NO: 207023 - RNA, 64 nt, Human
auuauuaugacaccuuuggguugcaaucuggggauacuggcaaagcagaaaauuguacaaccug

SEQ ID NO: 207024 - RNA, 64 nt, Human
agcguacaggaggagcacgggcagcugcuugcgcuacuggcagagcugcugcgaggacccugug

SEQ ID NO: 207025 - RNA, 64 nt, Human
gcucauggcucugcaggcuuuacaggaagcaugguacuggcaucugcuugguuucuggggaggc

SEQ ID NO: 207026 - RNA, 64 nt, Human
aucccuuugccaaaugcaugaguugcagacuugcuacuggcaagagugaagcaagugggugagu

SEQ ID NO: 207027 - RNA, 64 nt, Human
ugaaggaauacacauccugaagaucucgugacuauacuggcauuucagauccaccccaccccca

SEQ ID NO: 207028 - RNA, 64 nt, Human
uguauuuauaguucuaugcuuacuguugugcauauacuggcaauaaaacuguacauaacauuac

SEQ ID NO: 207029 - RNA, 64 nt, Human
ugguuuuucaauccccagggucggguaggaccccuacuggcagccagccucuguuucugggagg

SEQ ID NO: 207030 - RNA, 64 nt, Human
cuuuuggcuaaaaaaaaaaaaaaaguguaaauaauacuggcacuuuagaacagauuaaucaaga

SEQ ID NO: 207031 - RNA, 64 nt, Human
gauguugugauaugcaaauaucccauucccugguuacuggcauuccuaagauucuucaugguau

SEQ ID NO: 207032 - RNA, 64 nt, Human
uuuuuaauguuuuaugacugccugucuguuugaauacuggcaaagggauaaauaauaaauugac

SEQ ID NO: 207033 - RNA, 64 nt, Human
aggaacuuccagagaggaaauccaaugacaaugguacuggcauacacagggagccucccuucaa

SEQ ID NO: 207034 - RNA, 64 nt, Human
cugaauauaaaaguugcuguucuacuauuuuaacuacuggcaaagccacuugcauuuuucauua

SEQ ID NO: 207035 - RNA, 64 nt, Human
ggguuggaaguuguguagcauucacucccuuaccuacuggcauucccagugcccucuguccaua

SEQ ID NO: 207036 - RNA, 61 nt, Human
ucaccccaagucuuccagcugguggaucugggcccagcaaagacuguucuccucccgaggg

SEQ ID NO: 207037 - RNA, 61 nt, Human
cuuggaccuuucuucuuugccgacaaccacugcccagcagccucugggaccucgggguccc

SEQ ID NO: 207038 - RNA, 61 nt, Human
cuccagccugugcgcaccugcccuccuugcagcccagcacaccugcagguguaagggacga

SEQ ID NO: 207039 - RNA, 64 nt, Human
acccuuucuuggaggccuucacagguaauacagauacuggcacugauuguaauuaaaaugagag

SEQ ID NO: 207040 - RNA, 64 nt, Human
aaauguacuaugaaaaaaauuauacgcuaugggauacuggcaaaagugcacauauuucauaacc

SEQ ID NO: 207041 - RNA, 64 nt, Human
uuuggauaguguagcuuuaaugugcugcacaugauacuggcagcccuagaguucauagauggac

SEQ ID NO: 207042 - RNA, 64 nt, Human
ugcuguagauuggcugugccagcuuccaacagguuacuggcaaugccagugaguuucuguaggc

SEQ ID NO: 207043 - RNA, 64 nt, Human
agugcauagccagucugugaagacaacugccagauacuggcaauacuccagccuggugacagag

SEQ ID NO: 207044 - RNA, 60 nt, Human
caaagaagcaaggacaguaguuacaaguuauacuggcaguuauugaagauacuuaagauc

SEQ ID NO: 207045 - RNA, 64 nt, Human
aaaguccauugccggcaaugggcaggccugcaaauacuggcacagagcauuaaucauacaccuu

SEQ ID NO: 207046 - RNA, 64 nt, Human
acugcguauucuuuacaaggaguauuguaaauuuuacuggcaauuauuauuguacuauucuaaa

SEQ ID NO: 207047 - RNA, 64 nt, Human
ugcccccuucuuucccaugcuugacucccgagaguacuggcagugcagcacccaucauugacgu

SEQ ID NO: 207048 - RNA, 64 nt, Human
uggaaaucccuuucccgaucuuuguagcaccaucuacuggcagaauggcagaguagcugcgaaa

SEQ ID NO: 207049 - RNA, 64 nt, Human
cuuugauuuuuauuaugguuauuuuauugauuauuacuggcaaaaacggccagguacaacaccu

SEQ ID NO: 207050 - RNA, 64 nt, Human
uaagucuccuuaauguauccugagguaaguuuccuacuggcagcagauuuuguaagaauuacuu

SEQ ID NO: 207051 - RNA, 64 nt, Human
gagaugccccauggugggcaggcagaugaugaaguacuggcagauuugcaggcugggaaggcua

SEQ ID NO: 207052 - RNA, 64 nt, Human
uagcugcgaguccagaaguccucuagagcauguguacuggcacugaguuggugagacaguugug

SEQ ID NO: 207053 - RNA, 64 nt, Human
aaguucuccuacugaggacucuugacuaacagcauacuggcaguuucaccuuaaccugcucguu

SEQ ID NO: 207054 - RNA, 64 nt, Human
uuuuuaaaaaaacuauguuugugaauuuugcguauacuggcaagcuuuugaaaauguauuuaau

SEQ ID NO: 207055 - RNA, 64 nt, Human
guuggcaucaacacggggacccucugcuucaccaaagcccgagcccucagccccuggggagaac

SEQ ID NO: 207056 - RNA, 61 nt, Human
ccucucccaaaaagcagcccacaaggcaggggcccagcagcccagccaucacucaucuuug

SEQ ID NO: 207057 - RNA, 54 nt, Human; identical to SEQ ID NO: 22030

SEQ ID NO: 207058 - RNA, 64 nt, Human
uugggcaccagcuuuucuggacagccuggcuucuuacuggcauuguccaacucaucccuucucg

SEQ ID NO: 207059 - RNA, 64 nt, Human
caguggcacucuuauaucagaagaaagaaguuucuacuggcauucugauuggauauuuaaagaa

SEQ ID NO: 207060 - RNA, 64 nt, Human
ugguuguccuggcaucgcgcacacuguauguacauacuggcaacgaugucaaauguaauuuauu

SEQ ID NO: 207061 - RNA, 64 nt, Human
uaacccuggugguugcuguuuuccucccuucugcuacuggcaaaaggaucuuuguggccaagga

SEQ ID NO: 207062 - RNA, 64 nt, Human
aaauaaugaugcccugaauuaguucuaugagaaguacuggcagacagcuguuaugucugcaggg

SEQ ID NO: 207063 - RNA, 64 nt, Human
uaacuucaaugacugaaagucaaugcugauaguuuacuggcaacauuaauugaagcaucaaaaa

SEQ ID NO: 207064 - RNA, 64 nt, Human
uucaaccaagugguuugucuaauauuuaaacauguacuggcacaauuugugaugaaaauauuag

SEQ ID NO: 207065 - RNA, 64 nt, Human
aaauacucaggaauugucucauaaaguccucaccuacuggcaaaaacaagauguucuacuccca

SEQ ID NO: 207066 - RNA, 64 nt, Human
caaugaaaguuuucucauucaccucugcaagugcuacuggcaacagccugagggcagcuguaga

SEQ ID NO: 207067 - RNA, 64 nt, Human
gacuaaugagucccucauccagaagaugccaauguacuggcagauuaacauacaaccuauguuu

SEQ ID NO: 207068 - RNA, 64 nt, Human
agauuuuugaaaauccugaauaaaccaguaucguuacuggcaccugaaauuaauuugugaauuu

SEQ ID NO: 207069 - RNA, 64 nt, Human
ccaggaauuugacuagucaaucagugacaccugguacuggcaguuuugggaguggcagcccagg

SEQ ID NO: 207070 - RNA, 64 nt, Human
auacuacaaggcuacaguaaccaaaacagcauaguacuggcacaaaaacacacguagacugaug

SEQ ID NO: 207071 - RNA, 64 nt, Human
agaacuucuuuuaaugcuucuuucaaggcaugucuacuggcaacuaauucucuuaauuuugguu

SEQ ID NO: 207072 - RNA, 64 nt, Human
auaaaggcccgccaccuccucacauuggucuaucuacuggcagcugauacguuuaacucauuuc

SEQ ID NO: 207073 - RNA, 64 nt, Human
aaaauguuuuaucauauauauuuguauaauuaauuacuggcaugguuaaagugguuuucacuuu

SEQ ID NO: 207074 - RNA, 64 nt, Human
agagaaaggaauguuuagcacaagacacagcggagcucgggauuggcuaaacucccauaguauu

SEQ ID NO: 207075 - RNA, 64 nt, Human
ccggagggguucucuguggggcccuguguccccugcucgggaguaaggcugguccugggguccu

SEQ ID NO: 207076 - RNA, 64 nt, Human
ucaaggaugagccugaucuggggagagggccggggcucgggacuggccaccacuguucagcaca

SEQ ID NO: 207077 - RNA, 64 nt, Human
cacccugcagcucaggcaccaagaaaacagccgauacuggcagccauugcagcuccaaacugca

SEQ ID NO: 207078 - RNA, 64 nt, Human
cucuggcuuuacugcagcgaucuucaaccuugucuacuggcauaagugcagcggggaucucuac

SEQ ID NO: 207079 - RNA, 64 nt, Human
auccucucaccucagccucucgaguagcugggacuacuggcaggugggcaccaugccuggcuac

SEQ ID NO: 207080 - RNA, 64 nt, Human
cuaaguauugaauuucagaaaaaaaaaaugcauuuacuggcaaggagaagagcaaaguuaaggc

SEQ ID NO: 207081 - RNA, 64 nt, Human
ugucauucauuuuucagaauauaaccacucaagcuacuggcacauagugaaagauuacuucuga

SEQ ID NO: 207082 - RNA, 64 nt, Human
caaucaugugaaauuuaggcagaguucgauaaauuacuggcaaaaacaaaacucuuuuauaaag

SEQ ID NO: 207083 - RNA, 64 nt, Human
uggaaauucauacaauuuucucaacaugguacucuacuggcaggaugcaguuuuaaauuuuaug

SEQ ID NO: 207084 - RNA, 64 nt, Human
gaaaaaaacgaguuuauaauccuauaaugaagaauacuggcacaggcaaugcucacucgaaaac

SEQ ID NO: 207085 - RNA, 64 nt, Human
guuaacaacuugauaucuauuguacaagauguguuacuggcauuuccauguauauauguauaua

SEQ ID NO: 207086 - RNA, 63 nt, Human
uucuggcccagcagagguagccuagucugugauuacuggcacuuggcuacagagagugcuuga

SEQ ID NO: 207087 - RNA, 64 nt, Human
ugcuuuaugccucaguuugguuuaaaaacuucuguacuggcaaauggugguauucaguguggga

SEQ ID NO: 207088 - RNA, 64 nt, Human
cggaaucuguccuggauggggccagcuuaaauaauacuggcaaccaagauucuguuaggauuuc

SEQ ID NO: 207089 - RNA, 64 nt, Human
gaucaaggacucucucacacaggaaacuucccuauacuggcagauacacuugugacugaaccau

SEQ ID NO: 207090 - RNA, 64 nt, Human
guguauauuauuuuaaugaagaaaauaaauugauuacuggcauuggaacaguauaaaauaccag

SEQ ID NO: 207091 - RNA, 64 nt, Human
gcucagcccugagagucccuuccugccccaccgauacuggcacuuuaaaaaggaagcugaccgc

SEQ ID NO: 207092 - RNA, 64 nt, Human
uuuuggaaauggcaguuccuuggggucauguuucuacuggcaaaauuugcaauaguguucuauu

SEQ ID NO: 207093 - RNA, 57 nt, Human; identical to SEQ ID NO: 6089

SEQ ID NO: 207094 - RNA, 64 nt, Human; identical to SEQ ID NO: 6095

SEQ ID NO: 207095 - RNA, 64 nt, Human; identical to SEQ ID NO: 6101

SEQ ID NO: 207096 - RNA, 64 nt, Human
auucaacagagcuacaguaaccaaaacagcaugauacuggcauaacaacagacacauaggaaca

SEQ ID NO: 207097 - RNA, 64 nt, Human
ucuuuuuauauuguacauagucuuuuauguaauuuacuggcauauguuuuguagacuguuuaau

SEQ ID NO: 207098 - RNA, 64 nt, Human
auggcacuuugauaaaauggucaggaaccaacuuuacuggcaaaaggguccauguaccaccaug

SEQ ID NO: 207099 - RNA, 64 nt, Human
auuacguaaaaaauucauaccaaaucaaugagaauacuggcaaggaauacauagggacuuucug

SEQ ID NO: 207100 - RNA, 64 nt, Human
ggcuccaggucauaaggaugagauauauuugggguacuggcagaggauggcagagcuggcuggc

SEQ ID NO: 207101 - RNA, 64 nt, Human
cgccaaagaugcaccauguagaauuuucacuuuguacuggcaggcucguuuuaccucauucuag

SEQ ID NO: 207102 - RNA, 64 nt, Human
uuucauacacaggacaacuccaugugguugauuuuacuggcaugucuuggugacgaagaguugg

SEQ ID NO: 207103 - RNA, 64 nt, Human
ggaagugauauucuguugaauaucagaugguuaauacuggcauaaaaccucacagauuuuuuug

SEQ ID NO: 207104 - RNA, 64 nt, Human
uuccucaguuucucauggguaauauagggauaauuacuggcaccugccucccaggccauucuga

SEQ ID NO: 207105 - RNA, 64 nt, Human
ugaaaaucuaucuagauuacagaugggcauuuauuacuggcaguggaaacaccagauagaagau

SEQ ID NO: 207106 - RNA, 64 nt, Human
cggcccuacuggaggguguuuucacgaauguuguuacuggcacaaggccuaagggaugggcacg

SEQ ID NO: 207107 - RNA, 64 nt, Human
acccagaagcagaggggcugggcuguugcaccucuacuggcaucagucuuugguuaccccccag

SEQ ID NO: 207108 - RNA, 64 nt, Human
caguucauaauuaguuuauaaacaccuagaauaauacuggcauuaaagaauccuuguuggaugg

SEQ ID NO: 207109 - RNA, 60 nt, Human
accaucucuucuaccugugauggcaugaacuacuggcaucacuagauggacaauccaaga

SEQ ID NO: 207110 - RNA, 64 nt, Human
cuacgccuugucauuggaaacacugccuuugucuuacuggcaaguucuggagcucuugugucau

SEQ ID NO: 207111 - RNA, 64 nt, Human
aagaaaguaauuaugcuuccugugaauugucuuuuacuggcaucuuuguuuuccucuuugaugu

SEQ ID NO: 207112 - RNA, 64 nt, Human; identical to SEQ ID NO: 6105

SEQ ID NO: 207113 - RNA, 64 nt, Human; identical to SEQ ID NO: 6109

SEQ ID NO: 207114 - RNA, 64 nt, Human; identical to SEQ ID NO: 6112

SEQ ID NO: 207115 - RNA, 64 nt, Human
acccaaaguauucuucuuuucuuaguuucagaaguacuggcaucacacgcagguuaccuuggcg

SEQ ID NO: 207116 - RNA, 62 nt, Human
aaggagccagccagguguaauacagucaaggcagcccccagccuagagacaaucugugaaau

SEQ ID NO: 207117 - RNA, 62 nt, Human
ggggacaaugaugagaagaccugaggauuugcagcccccagcccuggguucaagucccagcu

SEQ ID NO: 207118 - RNA, 62 nt, Human
gugacacccagcccaggggcacccccuuccccagcccccaccuggagagacauggccccugc

SEQ ID NO: 207119 - RNA, 62 nt, Human
cugccugggcacucccuccucccugcgcccacagcccccaugccaaucuccgucagcucuuu

SEQ ID NO: 207120 - RNA, 62 nt, Human
accacacaccccgccccugaaaggagaucaucagcccccacaauuugucagagcugaagcca

SEQ ID NO: 207121 - RNA, 62 nt, Human
ccgccucccaguucaagugauucuccugccucagcccccaaguagcugggauuacaagugug

SEQ ID NO: 207122 - RNA, 62 nt, Human
guccagguccucuccccucauuuccaucucccagcccccaggggccccuuccccuuuauggg

SEQ ID NO: 207123 - RNA, 62 nt, Human
cuugacuuagagugacagccgguguccuggaaagcccccagcagcugccccagggacauggg

SEQ ID NO: 207124 - RNA, 62 nt, Human
ccccacacagcuacagcuuucuugcucccuucagcccccagccccucccccaucucccaccc

SEQ ID NO: 207125 - RNA, 62 nt, Human
uccccuuaaaagaaugccuuccacuucccaacagcccccaucaagggaccccaagaggccac

SEQ ID NO: 207126 - RNA, 61 nt, Human
aguaugagccagaggcguaggggcccaggagagcccccaccagcagcacaauucugucccu

SEQ ID NO: 207127 - RNA, 62 nt, Human
ugaggagcugaaacugaccaguguccaguguuagcccccacauggggcugcucuugcuucua

SEQ ID NO: 207128 - RNA, 62 nt, Human
cagugccaagccuguggaucaggaauaucaacagcccccagagaguggugcuggcugagggu

SEQ ID NO: 207129 - RNA, 62 nt, Human
ggacgggcgcaccugcauggagggguccccagagcccccaaccagugccagcauacucagcg

SEQ ID NO: 207130 - RNA, 62 nt, Human
agccccauuggggagugaucucuuggacacagagcccccauucaaaauggggcagggcaagg

SEQ ID NO: 207131 - RNA, 64 nt, Human; identical to SEQ ID NO: 6117

SEQ ID NO: 207132 - RNA, 64 nt, Human; identical to SEQ ID NO: 6122

SEQ ID NO: 207133 - RNA, 64 nt, Human; identical to SEQ ID NO: 6127

SEQ ID NO: 207134 - RNA, 64 nt, Human; identical to SEQ ID NO: 6132

SEQ ID NO: 207135 - RNA, 64 nt, Human
augauugcuaaauauacuuucauauuucaugguuuacuggcaucggaaaucucuacaaguuuua

SEQ ID NO: 207136 - RNA, 64 nt, Human
gagcucaugcccuuccuuccucuuuauucgagcauacuggcaaugcauuggaaaacagacagcu

SEQ ID NO: 207137 - RNA, 63 nt, Human
acugugacugggguucaagaguuuaaacaggggcuacuggcagagucuuuuuguccauuucuu

SEQ ID NO: 207138 - RNA, 64 nt, Human
cuucccuggagaccccuucucucacacuuuuaucuacuggcaucacccaccccacauggcauau

SEQ ID NO: 207139 - RNA, 64 nt, Human
caaccaaaagguguuccucuuuaagggcuccggguacuggcagugggacgagcuagcccgaacu

SEQ ID NO: 207140 - RNA, 64 nt, Human
acauuuuaauaguugguuaggcuaaacuggugcauacuggcauuggcccuugguggggagcaca

SEQ ID NO: 207141 - RNA, 64 nt, Human
aauugaaaguucuaugggaucuagaaaugagacauacuggcauggagagugagaacgacaaagg

SEQ ID NO: 207142 - RNA, 64 nt, Human
cuuguugccaaacuggaaauguucuguagggauuuacuggcaugguaucauuccuagaagaaaa

SEQ ID NO: 207143 - RNA, 64 nt, Human
accaaacccaguugcauuuguacagauccacguguacuggcaccucagaagaccaaaucaugga

SEQ ID NO: 207144 - RNA, 64 nt, Human
ggcugcugugauaggaagucccuguuguucuccguacuggcauuucuauuucuagaaauaauau

SEQ ID NO: 207145 - RNA, 64 nt, Human
agcccuugauuccacugguugacauggcagcaguuacuggcaagagggagaaaggacgcugccg

SEQ ID NO: 207146 - RNA, 64 nt, Human
augcagaaugccucaaucuuugggagaguuucaguacuggcauagaauuuaaaugucaaaauuc

SEQ ID NO: 207147 - RNA, 64 nt, Human
ccgcugaugauauauucgggcaggacuguugugguacuggcaauaagauacacagcuccgagcu

SEQ ID NO: 207148 - RNA, 64 nt, Human
aggcuauccuacaccugggccuuaccucuuccucuacuggcauccuaauggcacucugacagca

SEQ ID NO: 207149 - RNA, 64 nt, Human
auccauacuugaauugguuuuuucguauuuugccuacuggcaaauauuuugccuauuuucaguc

SEQ ID NO: 207150 - RNA, 64 nt, Human
cauacucaauugucaguuuacgugguuuugugaauacuggcaaaagcaauuguuuuuaaauuaa

SEQ ID NO: 207151 - RNA, 64 nt, Human
uuuucugguccuuacugcuccucccacaacagggaagcccgaucaguucugucaguauaagguu

SEQ ID NO: 207152 - RNA, 64 nt, Human
gaucaucaucuuugaaaggggggaggaggaguaaaagcccgauuauaauggugaucaauucaag

SEQ ID NO: 207153 - RNA, 64 nt, Human
uuuuuuuuuuuuuucaaauggggucaguaccugaaagcccgaaaccccauaccaagcuuauagu

SEQ ID NO: 207154 - RNA, 64 nt, Human
gacauugguacuaacugcauguguaaauacaucauacuggcaaaccguaaaauauaaauuaugu

SEQ ID NO: 207155 - RNA, 64 nt, Human
aucuuguuggcauaaauguuaugaaaaggcagaauacuggcaagaaaugaggaagagagagaaa

SEQ ID NO: 207156 - RNA, 64 nt, Human
ugagugucaguauugcuaagcguggcauucacaauacuggcacuauaaagaacaaaauaaaaua

SEQ ID NO: 207157 - RNA, 64 nt, Human
auguguucaucaggugccuauggauuaaaucacauacuggcauauuuaagcugaaugucaaucu

SEQ ID NO: 207158 - RNA, 64 nt, Human
uauccaugacuguggaggggccaccccccaaagauacuggcauugcucggguaccacuugcugg

SEQ ID NO: 207159 - RNA, 64 nt, Human
acugguaggcacuguccucugauuaaacuuggccuacuggcaauggcuacuuaggauugaucua

SEQ ID NO: 207160 - RNA, 64 nt, Human
uagcuaaaaggugugacuugccuuauugaaaugauacuggcauaucugacuguaagcaguaggu

SEQ ID NO: 207161 - RNA, 64 nt, Human
auguguucaucaggugccuguggauuaaaucacauacuggcauauuuaagcugaaugucaaucu

SEQ ID NO: 207162 - RNA, 64 nt, Human
cugagaccuggggcacccgggccuuugcggcagcuacuggcagggccuggccaccucauaggac

SEQ ID NO: 207163 - RNA, 64 nt, Human
aagaaauuaauucaguuggauuaucauuaugugauacuggcagauugcagugcaaccuuaugcc

SEQ ID NO: 207164 - RNA, 64 nt, Human
gcugccaagagugaagggaagagacagcccaggauacuggcacagagguagucucacugcuuga

SEQ ID NO: 207165 - RNA, 64 nt, Human
uggggccugaggcagggagaaugagaggccaccuuacuggcaggaaggaucaggauggggucuu

SEQ ID NO: 207166 - RNA, 64 nt, Human
cugacaguugcugcaugcccagggcagggugugguacuggcacccaaguucagcauggcagagc

SEQ ID NO: 207167 - RNA, 64 nt, Human
caguuggauuuucuccaacagaaaguggauucacuacuggcacauuaacaagcaccaauagguu

SEQ ID NO: 207168 - RNA, 64 nt, Human
ugcauuuaguugugcacacacaaauaugcuccuauacuggcauuaggcgucuccucaucccuca

SEQ ID NO: 207169 - RNA, 64 nt, Human
gcacuagagucacccccccaggccuccagaaccuuacuggcacuguggcacugccaccagcaau

SEQ ID NO: 207170 - RNA, 64 nt, Human
ugugaggccucccccaucaguggaccagagggagaagcccgaugccccaucccggcuuucccgu

SEQ ID NO: 207171 - RNA, 64 nt, Human; identical to SEQ ID NO: 6135

SEQ ID NO: 207172 - RNA, 64 nt, Human; identical to SEQ ID NO: 6140

SEQ ID NO: 207173 - RNA, 64 nt, Human
auuuauuauuuucgcugucgugacuacacagaguuacuggcacaaguuuaucuucuuccagauu

SEQ ID NO: 207174 - RNA, 64 nt, Human
uggggggugggaaagaaccaagccaugcucugucuacuggcaaugggcucccuacccacacugg

SEQ ID NO: 207175 - RNA, 64 nt, Human
uucuccgcaauggcacaugcuuccacuccauccauacuggcauccucaaauaaacagauaugua

SEQ ID NO: 207176 - RNA, 64 nt, Human
uaagcuuccgccgucucaaccccucacaggagcuuacuggcaaacaugaaaaaucggcuuacca

SEQ ID NO: 207177 - RNA, 64 nt, Human
uucugggggacagagaaggcgcuucccaacuucauacuggcaggagggugaggagguucacuga

SEQ ID NO: 207178 - RNA, 64 nt, Human
acccccaggcuuggcguagguguuugcuuccuucuacuggcauucacugaagccacuggggugg

SEQ ID NO: 207179 - RNA, 64 nt, Human
gcggguccuguccuuuucucaagaccuucaccauuacuggcauuuuccugucuucucuuuagua

SEQ ID NO: 207180 - RNA, 64 nt, Human
uugaugaacauugaugugaaaauccucaauaaaauacuggcaaaccgaauccagcagcacauca

SEQ ID NO: 207181 - RNA, 64 nt, Human
gcugggucuuagagcauguguguauucagucagauacuggcagacaauucagaacuuucaccac

SEQ ID NO: 207182 - RNA, 64 nt, Human
cuuuuuccugaagagagcuggguguagccagagcuacuggcaccuaccccgagcaucucucucu

SEQ ID NO: 207183 - RNA, 64 nt, Human
ucaggaccucagaccucuguccuaugacuaauguuacuggcagagcaaauaaucuaaagguuuu

SEQ ID NO: 207184 - RNA, 64 nt, Human
gauucuuaugacauauuccuaugaaaauaauaaauacuggcacuuuuccuugcagaaagcacuc

SEQ ID NO: 207185 - RNA, 64 nt, Human
auccaccugucuuggccucccaaagugcugggauuacuggcaugagccacugugcccagcccgg

SEQ ID NO: 207186 - RNA, 64 nt, Human
gacuugccgcacaucucuuuguguacuuguacgguacuggcagaaaagucauuuuucaaaagcc

SEQ ID NO: 207187 - RNA, 64 nt, Human
ccacccuugcaaaauugccacauuuaaauuguuuuacuggcaguucuauaguaguccagacuuu

SEQ ID NO: 207188 - RNA, 64 nt, Human
uaaaagaaucauuugcaacaucuuggcuuuuaguuacuggcacugacagggacgagccucauca

SEQ ID NO: 207189 - RNA, 64 nt, Human
ccugcagguuaacuggcgguaagugcuagacuguaagcccgacaagggcagggcuuuugguuuu

SEQ ID NO: 207190 - RNA, 64 nt, Human
auugacugcuuaaccaaagaaauugaucuuuuucaagcccgaggaccacauuuuaaccccagcg

SEQ ID NO: 207191 - RNA, 64 nt, Human
ccccgcccauccgugcuaugacauggaggcacugaagcccgaggaagguguguggagauucuaa

SEQ ID NO: 207192 - RNA, 64 nt, Human
ggaaaaagugacuugcccaaggucguaagcaagcuacuggcauggcaagagcccagcuuccuga

SEQ ID NO: 207193 - RNA, 64 nt, Human
caucaacccaagugcugggucaagugucucaucauacuggcacuguugcuggggugacggcaga

SEQ ID NO: 207194 - RNA, 64 nt, Human
gagcccagagcaucaccaggagugccugcuaguguacuggcagcuugccacccccuccucuccc

SEQ ID NO: 207195 - RNA, 64 nt, Human
uggagaagaauuucauccaaauguuacccuguaauacuggcauuuaaaauucuuauuuaaccuu

SEQ ID NO: 207196 - RNA, 64 nt, Human
aagaucucagucauaugaauuacaacguaguauuuacuggcaagaaggagaaaguugaaggacu

SEQ ID NO: 207197 - RNA, 64 nt, Human
augggugagacuuuacauauuuugggugggaggcuacuggcauauauuuuuaaauguucauauu

SEQ ID NO: 207198 - RNA, 64 nt, Human
agugaacugcugagagacagagcuauucuccauguacuggcaagaccugauuucugagcauuua

SEQ ID NO: 207199 - RNA, 64 nt, Human
uauggccagaugcguauuucaauaaggaacuauuuacuggcaugauauuugcauuccucuuauc

SEQ ID NO: 207200 - RNA, 64 nt, Human
uuuuguuaacucuugagccauaugcauguguagauacuggcagggcuauguuuguuuaugaugc

SEQ ID NO: 207201 - RNA, 64 nt, Human
gcaguguaagaaaauuggacuguaaucauaucgcuacuggcaucuguuaucuaguaugcauuuc

SEQ ID NO: 207202 - RNA, 63 nt, Human
aaggaggcccggggcggagggggguucccgcgugcacacgagugcggcuggacgugccgacac

SEQ ID NO: 207203 - RNA, 63 nt, Human
ucagacagacugcuugcuaguuuuaugaauucagcacacgaauuaugcugcguugcucacauu

SEQ ID NO: 207204 - RNA, 63 nt, Human
gaugccuggacuaucaguaaccccacugcacaggcacacgaugcucugggacauaacuggugc

SEQ ID NO: 207205 - RNA, 63 nt, Human
gucuuuuuuuugaguaacugcucucugaguuuugcacacgaaguugcccucaucugcuggaga

SEQ ID NO: 207206 - RNA, 64 nt, Human
ccacuguccugggcgcccuggaagccggcggcccaagcccgacuugcuguuuuguucugugguu

SEQ ID NO: 207207 - RNA, 64 nt, Human
gcacuacucauauccuuuaaacuaaauuuugccaaagcccgagacaacauuaaggagaaauugu

SEQ ID NO: 207208 - RNA, 64 nt, Human
cauacacauaugcagacacaugccagggccccccaagcccgagcaccggaccacguugcugccc

SEQ ID NO: 207209 - RNA, 63 nt, Human
aggcaggacuaugugggaaaggguuuuuccuuagcacacgaaaaagccccuuccccuggauuc

SEQ ID NO: 207210 - RNA, 63 nt, Human
acagccuuagcagagcugggguuccugucuucugcacacgauugacuuucuugauggguaauu

SEQ ID NO: 207211 - RNA, 63 nt, Human
cgggugcuuuacauaaugaaaaaaccacuuguggcacacgaugggcaucuaacaucaucaucu

SEQ ID NO: 207212 - RNA, 63 nt, Human
uaugaggugccugcccugggcucuggaccccgggcacacgagggacggugcccugagcccguu

SEQ ID NO: 207213 - RNA, 63 nt, Human
ugcaggcagaauggcugugcagggguuuggagggcacacgaugugugcuccccaugccacugg

SEQ ID NO: 207214 - RNA, 63 nt, Human
guuuacugcaucugucagcaggcugcagggagugcacacgaugccagagagaacuuagcaggg

SEQ ID NO: 207215 - RNA, 63 nt, Human
uuaggugcagcucgauucuaaucuuuucaugcugcacacgauuccuuuaauguagcauccuua

SEQ ID NO: 207216 - RNA, 63 nt, Human
guugaauuugcugaagaacaucaccuaaagucugcacacgagcccauuuuuaccaagauuuga

SEQ ID NO: 207217 - RNA, 63 nt, Human
acaagcacaacuaaguauguauauacacaugacgcacacgaugccagggccuagaccucccaa

SEQ ID NO: 207218 - RNA, 63 nt, Human
cacagccggacaggggguagccccuggauucaggcacacgaccaccacacgagcacgugccac

SEQ ID NO: 207219 - RNA, 63 nt, Human
aaacagcccugcuucugagggccgcucaguucugcacacgaaaccaccuccugagggcucagc

SEQ ID NO: 207220 - RNA, 63 nt, Human
gcugccggucaccuugagcugugguggcucccggcacacgaguguccgggguucggccauguc

SEQ ID NO: 207221 - RNA, 63 nt, Human
cacaggcuccugugugcagggacugauuccucagcacacgaggcuuccacaacccagucugcu

SEQ ID NO: 207222 - RNA, 63 nt, Human
cguccaggagacaaggaagguagggcaccugcugcacacgauucuguccagagugagcacugg

SEQ ID NO: 207223 - RNA, 63 nt, Human
auacuagaaacuaacucagggcugagcgugguggcacacgacuguaaucccaguuacucagga

SEQ ID NO: 207224 - RNA, 63 nt, Human
gacauaaacuccaagacagaaccucaguuuacagcacacgaaaaaaauaucuugccaacauug

SEQ ID NO: 207225 - RNA, 64 nt, Human
acugaaucaguggaaagagaaugcuucccauagaaagcccgacauggugcuaguuuccucucuu

SEQ ID NO: 207226 - RNA, 64 nt, Human
gccggccaccaguccucgaugcuucugaacccugaagcccgaugacaucuuacgagguggacgu

SEQ ID NO: 207227 - RNA, 64 nt, Human
gcagcaccgucgucucgacuucggaggcaacaccaagcccgaccgggccaggccugggugaucu

SEQ ID NO: 207228 - RNA, 63 nt, Human
ugggcauugagcaagcuaugaggguccccgggagcacacgaacccugccaggcccccgcuggc

SEQ ID NO: 207229 - RNA, 63 nt, Human
cagaaagggugcaaacaaaaugccuacauccaggcacacgaccaagucagcgagagcuagccc

SEQ ID NO: 207230 - RNA, 63 nt, Human
augggcuucugccuggcacuggggguggagggugcacacgaauggcccgccuugaggggucau

SEQ ID NO: 207231 - RNA, 63 nt, Human
ccuucaggggaaguagagguggccgagguuggggcacacgaggaaaucguagucggggaagac

SEQ ID NO: 207232 - RNA, 63 nt, Human
cuugcaucuccagauugauuacucaagcagacagcacacgaaauacuauuuuucuccuaauau

SEQ ID NO: 207233 - RNA, 63 nt, Human
gccaccauggccaugcagcaggcuaugauggcugcacacgaugacucauuggaugggacagaa

SEQ ID NO: 207234 - RNA, 63 nt, Human
gaagaggauugcaaacacauggcuccaucuucugcacacgaaaggaaagucccucuccuuuuc

SEQ ID NO: 207235 - RNA, 63 nt, Human
guaaaaguauaagugcuaacacuacgaagaaaugcacacgaucauucuugcucacuucuauaa

SEQ ID NO: 207236 - RNA, 63 nt, Human
augcaggaagcucagggggcaguagcacacuuugcacacgauaaagcaaagacgauggauuga

SEQ ID NO: 207237 - RNA, 63 nt, Human
gaugggauccuauguguuuggaaaacgugauaggcacacgaggaugaguggcuuuguaucgcc

SEQ ID NO: 207238 - RNA, 63 nt, Human
uuuugcucuuguugcccagacuggagugcaauggcacacgaucucggcucaccgcaaccucug

SEQ ID NO: 207239 - RNA, 63 nt, Human
uccacacaugcacaccagaugagggccaugugcgcacacgagguggcugucuacaaggccaga

SEQ ID NO: 207240 - RNA, 63 nt, Human
cagauuauugcaacauuuaaccugaauuuaaaagcacacgaaacaaaggugucaaugggaauc

SEQ ID NO: 207241 - RNA, 63 nt, Human
gacgucacccgcgggggcucccccugcacauuugcacacgauccggagagccgaaggccgcgu

SEQ ID NO: 207242 - RNA, 63 nt, Human
gcgggcagcacccuccgacccucccaugcgggugcacacgaagggugaggcugacacagccac

SEQ ID NO: 207243 - RNA, 63 nt, Human
uuacguguacccguguauauguggggaggcugugcacacgagcgaggggugaguggccguggc

SEQ ID NO: 207244 - RNA, 64 nt, Human
guggggggggugacaugggcccuaggcagacugcaagcccgaccgagcacuuggacucgaacuc

SEQ ID NO: 207245 - RNA, 64 nt, Human
cucucuccuucugcaguucuaaaccacagucuauaagcccgagucaccaggacggccugucugg

SEQ ID NO: 207246 - RNA, 64 nt, Human
agggauuggccauuuauacugggcucgagcucagaagcccgaggaacucuuugcuccccugcuu

SEQ ID NO: 207247 - RNA, 63 nt, Human
cacaugcaugcauaaaccggcaugugugccaaugcacacgagugugccacucaccaccauucc

SEQ ID NO: 207248 - RNA, 63 nt, Human
ucuggcugcucuucauugaccuguguguucccagcacacgaacagugccccuaacggagauuu

SEQ ID NO: 207249 - RNA, 63 nt, Human
acgcacacgcacacagccugguuuuguccucaugcacacgaagcagccccugcucccaucugu

SEQ ID NO: 207250 - RNA, 63 nt, Human
cuuugaaaguaaauugguaucuuguaguuuugugcacacgaaaggagagaaagucucuccagu

SEQ ID NO: 207251 - RNA, 63 nt, Human
cuguccgacgaaggcggccacggacggacgccagcacacgaagucacgugcaagugccuuuga

SEQ ID NO: 207252 - RNA, 63 nt, Human
cuccuguugccccaccugugguugcuguggacugcacacgacagcagauucgcuguccccucg

SEQ ID NO: 207253 - RNA, 63 nt, Human
cuacguccauguggacacagaccacagaugugggcacacgaauccauccaccuguccacgugc

SEQ ID NO: 207254 - RNA, 63 nt, Human
ccgauccuccccuggacucccguguaggaaccugcacacgagcagacacccuuggagcucuga

SEQ ID NO: 207255 - RNA, 63 nt, Human
uuuauacucuucucaguuugugaaacgcuaacugcacacgaagccgccugacggcacccagcg

SEQ ID NO: 207256 - RNA, 63 nt, Human
cuucaccaaagagcauacacgcguggcaaacaagcacacgaaaagacguucagccgccgaugg

SEQ ID NO: 207257 - RNA, 63 nt, Human
ccaugggaaugauaguugggaagaaaacuauuugcacacgacagauuucuagauacuuuuugc

SEQ ID NO: 207258 - RNA, 63 nt, Human
gaugggauucacuuaacaaaagcaagaagaaaagcacacgaacaggugucuuaaugcauuugg

SEQ ID NO: 207259 - RNA, 64 nt, Human
ggcuuaagugauaacuuccguuucaguuaaaaggaagcccgaaguuguguuugugcugcccaca

SEQ ID NO: 207260 - RNA, 64 nt, Human
ggcauccccugccugaacgaagacuuccgccgcgaagcccgauagaucgggggaaaauggggcc

SEQ ID NO: 207261 - RNA, 64 nt, Human
gggagacuuccgcccuccucacugaggcaacaugaagcccgaggcccagaugggggcugaacag

SEQ ID NO: 207262 - RNA, 64 nt, Human
uuuuaaaaaguguuuaaugagaguuuacagacagaagcccgaaguggaaagaccuuaugguuuu

SEQ ID NO: 207263 - RNA, 64 nt, Human
cuuggcacgcuacccucaucaucuuacucaucuuaagcccgagccauggaucaacuaggagccc

SEQ ID NO: 207264 - RNA, 64 nt, Human
agacaugcucgucaugaaaaaagaaccauuucugaagcccgauuggggccaaacauuuacaccu

SEQ ID NO: 207265 - RNA, 54 nt, Human; identical to SEQ ID NO: 22031

SEQ ID NO: 207266 - RNA, 61 nt, Human
gcaggcgggcccaugaagaaagccccucguugcccagcacugucugcgucugcucuucugu

SEQ ID NO: 207267 - RNA, 61 nt, Human
cccguuaaugaccacagcagacagaauuugagcccagcaccuaaaaguacaggaauuucac

SEQ ID NO: 207268 - RNA, 61 nt, Human
ugcugggguucccccuccacccaguggccacgcccagcacccuauugauggcuauaggaca

SEQ ID NO: 207269 - RNA, 61 nt, Human
ggaauguguccuccugcucugcuuccucagggcccagcaggcggggguuugagcccuggac

SEQ ID NO: 207270 - RNA, 61 nt, Human
ggaaagaagaggcagagaggucgucgucgucgcccagcagcaagggcugcaaaauaguaga

SEQ ID NO: 207271 - RNA, 61 nt, Human
aaggagagcagcaaguuuccauuuggcauuagcccagcacagagccaccggaacaucaaga

SEQ ID NO: 207272 - RNA, 61 nt, Human
aguagcugggaugacaggcgcacaccaccacgcccagcaaauuuuuuguauuuuuaguaga

SEQ ID NO: 207273 - RNA, 61 nt, Human
ucaggcucuuagaagccauagauuuggacaagcccagcaagauggguguccuuccaggccu

SEQ ID NO: 207274 - RNA, 61 nt, Human
gucuuggacccuuucuuucucugggaucccugcccagcaccuuccuauagagaugacuuua

SEQ ID NO: 207275 - RNA, 61 nt, Human
augccacauuaccugcucccaucaccauccagcccagcacccuggacuucagucgccuggc

SEQ ID NO: 207276 - RNA, 61 nt, Human
agagccuagaacaucccugggcaaguggauggcccagcaggcaggcacuguggcccuucug

SEQ ID NO: 207277 - RNA, 61 nt, Human
aucacugaucuaagcaguggcaucugagugggcccagcacauggccauagaggcccaggca

SEQ ID NO: 207278 - RNA, 61 nt, Human
gaugccagagggccagcaggcuccuggcugugcccagcaggcccagcaugcaggugguggg

SEQ ID NO: 207279 - RNA, 61 nt, Human
gggccagcaggcuccuggcugugcccagcaggcccagcaugcagguggugggacacugggc

SEQ ID NO: 207280 - RNA, 61 nt, Human
gcagccugccuauggcuccagcugugcuguggcccagcagcauggccugcaucuggaagga

SEQ ID NO: 207281 - RNA, 61 nt, Human
uaucugugagcagcuguucccuguagccacugcccagcaccuccucaggccagccuggugc

SEQ ID NO: 207282 - RNA, 61 nt, Human
aggugcuggaccacaucuccgccaagucacugcccagcagccuucuccguccuguccccag

SEQ ID NO: 207283 - RNA, 61 nt, Human
uggauguauuaauuggcucuauaaacuaugugcccagcacuaugcugagcuuacacuaauu

SEQ ID NO: 207284 - RNA, 61 nt, Human
gaaggcagcucucuccagacagagucucagggcccagcaaggucagguuaucugcuuucau

SEQ ID NO: 207285 - RNA, 61 nt, Human
caggacaucucuggcaggugcauuugugccugcccagcaguuccagcuguggcaaaagucu

SEQ ID NO: 207286 - RNA, 61 nt, Human
gaaaaguaaacgauaaaauguggauuaaagugcccagcacaaagcagauccucaauaaaca

SEQ ID NO: 207287 - RNA, 61 nt, Human
ggacgggaggcuguguccgugggugugcagugcccagcacgggacccggcugcaggggacc

SEQ ID NO: 207288 - RNA, 61 nt, Human
cagagcgugaccucggcaggcuggacacacugcccagcacaggcagacccaccaggcuccu

SEQ ID NO: 207289 - RNA, 61 nt, Human
uccuccugccucucccgugagucuccagccugcccagcaccggcagcuguggagcacgugg

SEQ ID NO: 207290 - RNA, 61 nt, Human
uuccuuugagggccguggagggcuguggacagcccagcaaccugucgcucuuggaggcugg

SEQ ID NO: 207291 - RNA, 61 nt, Human
uagugcuuccagauguggucucccguguggggcccagcaaugggggccccugaugccaaga

SEQ ID NO: 207292 - RNA, 61 nt, Human
gcccgcaggugacaugguccugggaccaguugcccagcagagcucuugguaagggacauca

SEQ ID NO: 207293 - RNA, 61 nt, Human
gguccagccugagcccccaccaggggucucugcccagcacaggaagcugacccuggcccag

SEQ ID NO: 207294 - RNA, 61 nt, Human
accugcugugcugggaaggccgaggaugggggcccagcacuguccaggccugcuggggccu

SEQ ID NO: 207295 - RNA, 61 nt, Human
ggcaccguccaggccccaccggccaggccgcgcccagcagaggcguacuacccagcucugu

SEQ ID NO: 207296 - RNA, 61 nt, Human
cugacccagcauccucugccuucuaggaagugcccagcaagagggaaagcagaccccuuua

SEQ ID NO: 207297 - RNA, 61 nt, Human
agagaccacaggagccaaagcgagccuccaggcccagcaaugagggacuugggagaaaucu

SEQ ID NO: 207298 - RNA, 61 nt, Human
ucaaggguggcaaaggcacuuguccaaggucgcccagcagugcugcucugaugacuugugc

SEQ ID NO: 207299 - RNA, 61 nt, Human
ucagcgugggaggcaccuuuggguucccagugcccagcacuuuguagucucaucccagauu

SEQ ID NO: 207300 - RNA, 61 nt, Human
uaaaauggucguugaaggcgccugggccgcagcccagcaguaguuggagaggcaggcagag

SEQ ID NO: 207301 - RNA, 53 nt, Human; identical to SEQ ID NO: 22067

SEQ ID NO: 207302 - RNA, 61 nt, Human
ugccucagugggccugugggagccuacuggagcccagcacuuacucccccugagcagcgag

SEQ ID NO: 207303 - RNA, 61 nt, Human
gaggccaccagaagacacuuccaucccucgggcccagcaguacacacuugguuuccagagc

SEQ ID NO: 207304 - RNA, 61 nt, Human
acugauaaggggcccuaggguacagggugcugcccagcaggucgccaccgagugucuucuc

SEQ ID NO: 207305 - RNA, 61 nt, Human
cuccaccacagccaaggccuggagacugggggcccagcagagccugcucccacccuccucc

SEQ ID NO: 207306 - RNA, 61 nt, Human
uuuugcuccucaggcccaauauucucagacagcccagcagugugaacacacaaugccaggc

SEQ ID NO: 207307 - RNA, 61 nt, Human
gcugaucaccaaagucagugucacccuggaugcccagcagcccuguccugugucuugggcc

SEQ ID NO: 207308 - RNA, 61 nt, Human
gauggaccucucccaggagcagccccuggaugcccagcaggguccccccgaaccugcacaa

SEQ ID NO: 207309 - RNA, 61 nt, Human
auuucaccucuuaagagggaaucuuccacaagcccagcacaagcugccaggccugagcuac

SEQ ID NO: 207310 - RNA, 61 nt, Human
cuugcacugagguccuggaggccuugaugaggcccagcaaacaggcauucucacagcuggg

SEQ ID NO: 207311 - RNA, 61 nt, Human
gaaucuacagaccuggcuccucggaucugaagcccagcacaaaauaaucuccccguccaag

SEQ ID NO: 207312 - RNA, 61 nt, Human
cguguacauagugcauuguuucugugggcgggcccagcacuuuccgucaacguuguacugu

SEQ ID NO: 207313 - RNA, 61 nt, Human
cgaccuaggcaguaggccggugugccugacugcccagcauuuggguaauuuagauuguaaa

SEQ ID NO: 207314 - RNA, 61 nt, Human
uaagaaggcaugguacucugacaaagccagugcccagcaaugaagugaauucauggcacag

SEQ ID NO: 207315 - RNA, 61 nt, Human
acacuagggcuaucagaaggucuccuuuuuagcccagcacaggcccaggccacuuugucgu

SEQ ID NO: 207316 - RNA, 61 nt, Human
cuugggauuugacuagaguugcuggcucgaggcccagcacgaggacuuacccugggguuuu

SEQ ID NO: 207317 - RNA, 61 nt, Human
uaauccaguggcaaggugcucccacuccagggcccagcacaucuccuggauuccuuagugg

SEQ ID NO: 207318 - RNA, 61 nt, Human
acugcugggcccaggucuccugaaaugggaagcccagcaauaccacgcagucccuccacuu

SEQ ID NO: 207319 - RNA, 61 nt, Human
cucuggggcuuguccugugcuugcuuagagugcccagcagagguuugcugacaggugaugc

SEQ ID NO: 207320 - RNA, 61 nt, Human
ggggggugggggcuguccugcucaccugugugcccagcaccuggaggggcaccagguggag

SEQ ID NO: 207321 - RNA, 61 nt, Human
ucaggaacucagugucugggaggaaagcauggcccagcauucagcauguguuccuuucugc

SEQ ID NO: 207322 - RNA, 61 nt, Human
uugagaaagcagccccaguaguuccauucuugcccagcacuuucugcauuccaaacagcau

SEQ ID NO: 207323 - RNA, 61 nt, Human
agucaggagaccccaaggcaugugagcaucugcccagcaaccuguggagacaacccacacu

SEQ ID NO: 207324 - RNA, 50 nt, Human; identical to SEQ ID NO: 22090

SEQ ID NO: 207325 - RNA, 61 nt, Human
gcgaaggacaauguuaucugggauucaccgugcccagcacccgaagugccaaauuccagga

SEQ ID NO: 207326 - RNA, 61 nt, Human
caauagaagcuuaaugaugcuucuguuugaggcccagcaagcaccacuaaauuacuggaug

SEQ ID NO: 207327 - RNA, 61 nt, Human
cuugccccgaugaagccggggacacuccucugcccagcaaggagccuuggucauuuucaua

SEQ ID NO: 207328 - RNA, 61 nt, Human
acaaccccagugcgcaggccagagugagugagcccagcacggcgcuccgacuggcuuccuc

SEQ ID NO: 207329 - RNA, 61 nt, Human
augcagcuguccagccacugcccuuuaacaugcccagcacacaugggaggccuguggcccu

SEQ ID NO: 207330 - RNA, 61 nt, Human
aaagcccacgucaggaccacagaccccccaggcccagcagaagagccuccuucagcagcua

SEQ ID NO: 207331 - RNA, 61 nt, Human
uguggcugguaaggcaacugcuugaccacuggcccagcaagcagaggcgggcaggaggauc

SEQ ID NO: 207332 - RNA, 61 nt, Human
guccuuagagugggcuggagagaccuagagggcccagcauguggcugggaaacuguuggug

SEQ ID NO: 207333 - RNA, 61 nt, Human
agccccacucauccucucggauguucugcaggcccagcaaacucaucauguccaaagugaa

SEQ ID NO: 207334 - RNA, 61 nt, Human
ucccuccucuuccuguagugccccucccauggcccagcagcuuggcugagcccccucuccu

SEQ ID NO: 207335 - RNA, 61 nt, Human
ccuuagcagcucaggcgcagcccuagugggagcccagcacacugcuucucggaggccaggc

SEQ ID NO: 207336 - RNA, 61 nt, Human
uggaagacacaugucuuaccccccaaagggagcccagcacugggagccuucuugaugaucu

SEQ ID NO: 207337 - RNA, 61 nt, Human
acuuggaguuagagccaagcugucagacggugcccagcacacauuaauguuagcuucuuuc

SEQ ID NO: 207338 - RNA, 61 nt, Human
cccaucuccaucaggaaaaauacaccccaucgcccagcaccccugcugauaccaccagaca

SEQ ID NO: 207339 - RNA, 61 nt, Human
gcuaccugacgcgccagaagcacccagcccugcccagcaaccggccccagcagcagguccu

SEQ ID NO: 207340 - RNA, 61 nt, Human
ccgccccgucugauaaguaaggagccccucugcccagcagccgccccgucugagaagugag

SEQ ID NO: 207341 - RNA, 61 nt, Human
ccgccccgucugagaagugaggagccccucugcccagcagccacccugucugggaagugag

SEQ ID NO: 207342 - RNA, 61 nt, Human
ccuccaucuccucggagccccgcgagguccggcccagcaacuucccggcauccgcgcucua

SEQ ID NO: 207343 - RNA, 61 nt, Human
aguagcugggauuauaggcaugugccaccaugcccagcaaauuuuguauuuuuuuuuggua

SEQ ID NO: 207344 - RNA, 61 nt, Human
acgaaucauuggcuauaaccuccagccuccugcccagcacaggaaucgguggucuccaccu

SEQ ID NO: 207345 - RNA, 61 nt, Human
uucaaaaaaacauuucuugagcaccuucugugcccagcauaugcuaggcccaccagcuaag

SEQ ID NO: 207346 - RNA, 61 nt, Human
ccagcuccccucuuggcagggggagaggauggcccagcaggccuggcccagcucccaguuc

SEQ ID NO: 207347 - RNA, 61 nt, Human
cccccagccaguucucagaaacguggcuggggcccagcacagcagccugcaagggccccug

SEQ ID NO: 207348 - RNA, 61 nt, Human
cugggaggguggggccgucuaauuuauuacugcccagcauuccuuccaacgggaaguagau

SEQ ID NO: 207349 - RNA, 61 nt, Human
gccucuucugacccuuccaugcuggccccuggcccagcaggccugucuguggggacaucgg

SEQ ID NO: 207350 - RNA, 61 nt, Human
cagggcuaacaccuggaucuccagaaaccuagcccagcagguuaaucuucacacaucucug

SEQ ID NO: 207351 - RNA, 61 nt, Human
uguagccaagcaugggaaucuuugcucccaggcccagcaccgagcagaacagaccagagcc

SEQ ID NO: 207352 - RNA, 61 nt, Human
cagcccuggcagaacugaagagcggcaccgggcccagcaggcaaagagagaggccucccug

SEQ ID NO: 207353 - RNA, 61 nt, Human
acgggcaccugcucugucugggacagauacugcccagcacccacccggccaugaggaccug

SEQ ID NO: 207354 - RNA, 61 nt, Human
ggagaaaaggcuaaagauuugcaguuugacagcccagcagggaggaagcaucacacagcgu

SEQ ID NO: 207355 - RNA, 61 nt, Human
aaaaucagugcacaagaauugggcugguuaggcccagcaccacacugaagugggcucagug

SEQ ID NO: 207356 - RNA, 61 nt, Human
caacccaagcuggcccauaaucagcaguggggcccagcagcacaggaggggcggacgguua

SEQ ID NO: 207357 - RNA, 61 nt, Human
guuacaucgggucuggugcuccagaccuagggcccagcacuuucaucagauccugccuccu

SEQ ID NO: 207358 - RNA, 61 nt, Human
cucuaugcccacugcccuccucccucuccuggcccagcaguauugcucacgggggcuccag

SEQ ID NO: 207359 - RNA, 61 nt, Human
uucaucaucauagugagcccagagagccacugcccagcagcaugcucacaccaccuacccu

SEQ ID NO: 207360 - RNA, 61 nt, Human
gcuccgggauuccugagucuguaaauagugugcccagcagcugugaacuccccuuauagcc

SEQ ID NO: 207361 - RNA, 61 nt, Human
uaaguuuccagauuuaaaggacaugcugggugcccagcaggauggauucaagggaaaccua

SEQ ID NO: 207362 - RNA, 61 nt, Human
aguagagguggcuucagaaauggaacccccagcccagcagacaucaagcucaaggcaaugg

SEQ ID NO: 207363 - RNA, 54 nt, Human; identical to SEQ ID NO: 22129

SEQ ID NO: 207364 - RNA, 61 nt, Human
auucccuccuugcacagaugcauacacuggggcccagcagcugccuccugaggugacacag

SEQ ID NO: 207365 - RNA, 61 nt, Human
guguguacagcaaauucuauagugcuucugagcccagcagggcuuuaccugccccuggaga

SEQ ID NO: 207366 - RNA, 61 nt, Human
ucagcuuuacucuucuuccacacuaggcugggcccagcaauacaggagaggaugaagggag

SEQ ID NO: 207367 - RNA, 61 nt, Human
gugucuucugggucaguccuaggcacaugcugcccagcacauguccaccugggaaaugaga

SEQ ID NO: 207368 - RNA, 61 nt, Human
gccuacagauguccuacgggaacgugggcuggcccagcauagggcuagcaaauuugaguug

SEQ ID NO: 207369 - RNA, 61 nt, Human
ugguaggagcugcaguuggaggccguucugugcccagcagcggugagcggcucccaugggc

SEQ ID NO: 207370 - RNA, 61 nt, Human
cuuuagggaguccccucuuaggacaggcacugcccagcagcaagggcagcagaguugggug

SEQ ID NO: 207371 - RNA, 61 nt, Human
cucgaaggcauuggccuugaaaaccuggacagcccagcagccacuaaggcucagauuguua

SEQ ID NO: 207372 - RNA, 61 nt, Human
cuguguuucauccauggggaaguuccaagaagcccagcauggccaucagugaggacuucag

SEQ ID NO: 207373 - RNA, 61 nt, Human
ugaugagaaauagggaauacucccaguccaggcccagcaaaaccaaaaugcuaagcaauga

SEQ ID NO: 207374 - RNA, 61 nt, Human
ccugggcuggcuggguuacagcagcagggaggcccagcagcccacuggcagaggcgagagc

SEQ ID NO: 207375 - RNA, 61 nt, Human
cuugcugugauguuccuacuguggcccagcugcccagcauggaccuggugacucuccacag

SEQ ID NO: 207376 - RNA, 61 nt, Human
cugcuccaugcugucugugagcaggccccaugcccagcacgccagccaccgcaggauaccu

SEQ ID NO: 207377 - RNA, 61 nt, Human
uggcaaugagaccuggcagggcagaguacaagcccagcacccagugucccagccuuacugg

SEQ ID NO: 207378 - RNA, 61 nt, Human
aaggcaaggauuugccaaaaauguucugggggcccagcaaaugcaggagccgaccuggggc

SEQ ID NO: 207379 - RNA, 61 nt, Human
uuccagaggaccugaugccaagggguaaugggcccagcagugccucuggagcccaggcccc

SEQ ID NO: 207380 - RNA, 61 nt, Human
aaccugcaccccucccugcaagggguucagagcccagcacaggagcuuucucuggcagaau

SEQ ID NO: 207381 - RNA, 61 nt, Human
cuacuuuaugggcagggcccuagaagagcgagcccagcagcacagagaagcucugauagca

SEQ ID NO: 207382 - RNA, 61 nt, Human
cacagcuaccucugguggcaggagaagagaggcccagcacagcagcaggccaggccuuccu

SEQ ID NO: 207383 - RNA, 61 nt, Human
gcucggcccagcacccccucuccuggagggcgcccagcagccugccagcaguuacugugaa

SEQ ID NO: 207384 - RNA, 61 nt, Human
aggccgacaccacuccugccagcccggcucggcccagcacccccucuccuggagggcgccc

SEQ ID NO: 207385 - RNA, 61 nt, Human
cucccgggauggguggaccaaacccuuagcagcccagcauuucccgaaggccgacaccacu

SEQ ID NO: 207386 - RNA, 61 nt, Human
aggccagagagcuggucaggcucccccaucugcccagcacggccugcacugugcccaccca

SEQ ID NO: 207387 - RNA, 61 nt, Human
uucacgugugaaguuguucauuuuauauugugcccagcaaagaaacuuucacccaguucag

SEQ ID NO: 207388 - RNA, 61 nt, Human
cuucuuagagcagaggcacaaguuagagcaggcccagcauuugggccaacuuacugugggg

SEQ ID NO: 207389 - RNA, 61 nt, Human
gacuuuggguacugcggacagaccuggauaggcccagcauucguucugaagaucacaguuc

SEQ ID NO: 207390 - RNA, 61 nt, Human
agcuuggugucuuggcacuguuagugacagagcccagcaucccuucugcccccguuccagc

SEQ ID NO: 207391 - RNA, 61 nt, Human
ccaccuaguagcaguggugaggagugggagggcccagcaagcauuuaucagaaauagaauc

SEQ ID NO: 207392 - RNA, 61 nt, Human
aggcaccggacgcuggagacccugcgccccugcccagcaccuccuccgugggcagcuccuc

SEQ ID NO: 207393 - RNA, 61 nt, Human
accgaugcccaucuguagcagggccaggccugcccagcagccucugcucccuccuggggac

SEQ ID NO: 207394 - RNA, 61 nt, Human
aacaaaaagcaaaaaaguaaaaugcugcacugcccagcagcccgguuagggcuccuggagc

SEQ ID NO: 207395 - RNA, 61 nt, Human
cggcugcaggggccaacaagaggucagcuuugcccagcaggggacccggaggagccuggug

SEQ ID NO: 207396 - RNA, 61 nt, Human
acugguacgacagcuagccagggccacgggggcccagcacgagaguccucaugggcacuca

SEQ ID NO: 207397 - RNA, 61 nt, Human
gggagauggccagccugaagucacgguccuggcccagcacaggugggcagcagcgagcugg

SEQ ID NO: 207398 - RNA, 61 nt, Human
uguuuucuuucauugggcaacagcuaagagggcccagcaagguaauuuaugguugagcuga

SEQ ID NO: 207399 - RNA, 61 nt, Human
uucaggaggcugaggugggaggauugcuugagcccagcagguugaggcuguggugauuugu

SEQ ID NO: 207400 - RNA, 61 nt, Human
aagcucaggcaaguggcucaguaguuggccagcccagcaggguccucuguaugagugugca

SEQ ID NO: 207401 - RNA, 61 nt, Human
gaggggguggucaucacgaggaacagagauggcccagcagacauuuggccucuagauccuu

SEQ ID NO: 207402 - RNA, 61 nt, Human
uucuuuccuuaucacccccuuguuguaaaaagcccagcacuugaauuguuauuacuuuaaa

SEQ ID NO: 207403 - RNA, 61 nt, Human
cccucugcccagcaugcccugugaucgccuggcccagcaggagcugcuucagccgagaggg

SEQ ID NO: 207404 - RNA, 61 nt, Human
gugggaagaugaagccggccagagccccucugcccagcaugcccugugaucgccuggccca

SEQ ID NO: 207405 - RNA, 61 nt, Human
aguucuagauugaucucugaaugugaucgacgcccagcaaggacaagcuuuaaaaugucug

SEQ ID NO: 207406 - RNA, 61 nt, Human
ggacccugaauuugagauccccggggcuggggcccagcacaacugcuguuuagugaacagg

SEQ ID NO: 207407 - RNA, 61 nt, Human
caugagacaaagcugacuguucacacugauugcccagcacauaccgucuugccaguuucuu

SEQ ID NO: 207408 - RNA, 61 nt, Human
uccugagaugauuuggucagauugggauaaggcccagcaaucugcauuuuaacaagcaccc

SEQ ID NO: 207409 - RNA, 61 nt, Human
gaagugcugggauucaggugugagccacugugcccagcagggaugcuucaucuuucuaaga

SEQ ID NO: 207410 - RNA, 61 nt, Human
ggaggccaaggugggagggucccuuccuugagcccagcaguuugagaccaauguagugaga

SEQ ID NO: 207411 - RNA, 61 nt, Human
ucaauuuuagcacucuccaggcacaaggacagcccagcaccagcuuuacagggcaguguuu

SEQ ID NO: 207412 - RNA, 61 nt, Human
uguagcuggcgaggaauuacuuccacuucuggcccagcacaagcccugcuuuggccaccug

SEQ ID NO: 207413 - RNA, 61 nt, Human
cccacaagaaggcccugcgggcccccccauugcccagcacugucucauagaaggcucuggu

SEQ ID NO: 207414 - RNA, 61 nt, Human
ugucuuuaugagaaucacuguguccccugaggcccagcaguaccugcuucccuguaugugg

SEQ ID NO: 207415 - RNA, 61 nt, Human
aggcugaccuuccugaucauacacacacacagcccagcaaaagccucuccugaaccaaaca

SEQ ID NO: 207416 - RNA, 61 nt, Human
caaucaggucccagagcuugaaugcuaacaagcccagcauccccuggggcugugaucaugg

SEQ ID NO: 207417 - RNA, 61 nt, Human
gccagccaaaguaaugacacauuccagcccugcccagcaugcugaccuuuggccucuaacc

SEQ ID NO: 207418 - RNA, 61 nt, Human
ugcugccggguggccaggguauggggcaugugcccagcaauguggcuccuuggccccgcug

SEQ ID NO: 207419 - RNA, 60 nt, Human; identical to SEQ ID NO: 22185

SEQ ID NO: 207420 - RNA, 61 nt, Human
ccggacuccccucauaacaauagacacaugugcccagcaauaauccgccccuuccugugug

SEQ ID NO: 207421 - RNA, 61 nt, Human
cugaccccucccugcaggggcuacguuagcagcccagcacauagcuugccuaauggcuuuc

SEQ ID NO: 207422 - RNA, 61 nt, Human
gaggagguaggauuuuucacugauucuauaagcccagcauuaccugauaccaaaaccaggc

SEQ ID NO: 207423 - RNA, 61 nt, Human
gauguccuucgaaggaaccaggacccucagagcccagcauccaucucugucaucaucuuca

SEQ ID NO: 207424 - RNA, 61 nt, Human
ggacuucuggcaugagaucucggcacggcaagcccagcaucgccucagcccagacaggcuc

SEQ ID NO: 207425 - RNA, 61 nt, Human
aaaguguuuggccuagcacaauuacugcuaggcccagcacaaugaacagauuuaccauccc

SEQ ID NO: 207426 - RNA, 61 nt, Human
gaaacgcucccacucccacgggccaucgagggcccagcacggcugagcggcugaaaaaccg

SEQ ID NO: 207427 - RNA, 61 nt, Human
gauuaaaguauuuucauacauuuugcuucuugcccagcagggacagguggcagagccgagg

SEQ ID NO: 207428 - RNA, 52 nt, Human; identical to SEQ ID NO: 22194

SEQ ID NO: 207429 - RNA, 61 nt, Human
uuggacaagacuuggcccccggacaagacucgcccagcacuugcggcugggcccggggagc

SEQ ID NO: 207430 - RNA, 61 nt, Human
caccucccaugccauggacugagcagcaggggcccagcaucccuuggauaugguggcugug

SEQ ID NO: 207431 - RNA, 61 nt, Human
uccgucaccaaauuguaaccuggauguuauagcccagcaucuagaaauccuaugaaacgua

SEQ ID NO: 207432 - RNA, 61 nt, Human
aggcagggguccugcagguccuggugggucagcccagcaccugcucccagugggagcuucc

SEQ ID NO: 207433 - RNA, 61 nt, Human
cugcgggggggaagaaacacagggucggugagcccagcaugugcguugguuugagggggcg

SEQ ID NO: 207434 - RNA, 61 nt, Human
agagcagaagaauuacagcccugucacaugugcccagcacuccgccccaugccuugcuaaa

SEQ ID NO: 207435 - RNA, 61 nt, Human
gcugcuguagacagcuguguuccuacaauuggcccagcacccuggggcacgggagaagggu

SEQ ID NO: 207436 - RNA, 61 nt, Human
gagaauaaauaccuccccaaauucaaucugagcccagcaggagaggaugguaggguugcca

SEQ ID NO: 207437 - RNA, 56 nt, Human; identical to SEQ ID NO: 22203

SEQ ID NO: 207438 - RNA, 61 nt, Human
ccccccuccaccuucgccaccucccgcucgugcccagcacaagugagccugguguggaaac

SEQ ID NO: 207439 - RNA, 61 nt, Human
aggaugcagggucccccagaccccuccucuagcccagcagcggcuggggucuggcuccuuu

SEQ ID NO: 207440 - RNA, 61 nt, Human
ucccaagcccuggugaccagaccaaggcagggcccagcauaauuccuccaguuggaugaac

SEQ ID NO: 207441 - RNA, 61 nt, Human
gcugugcugaggaaaggggaugcagagcccugcccagcaccaccaccuccuaugcuccugg

SEQ ID NO: 207442 - RNA, 61 nt, Human
ucaucuaaaggccaccaggaacacaccuguagcccagcaaaguugaggccaucgacuggcu

SEQ ID NO: 207443 - RNA, 61 nt, Human
auuuuaaaggaauggaguuuuucagccuguggcccagcacuggucaagaaaacaagauggc

SEQ ID NO: 207444 - RNA, 61 nt, Human
guuuuguuuucuucacuaugggaucuucugugcccagcacagugccugacacauagaaaac

SEQ ID NO: 207445 - RNA, 61 nt, Human
ucuaagauaagaggccaggccagucaguuuggcccagcaaacauguggguacuucuccacc

SEQ ID NO: 207446 - RNA, 61 nt, Human
uccuccuguguagcugccaccuccccgcugggcccagcauggcucaccugucccgugggcu

SEQ ID NO: 207447 - RNA, 61 nt, Human
acccucaacaaccaggauuugcucgaucucagcccagcaggccaggcagacacaccccgcu

SEQ ID NO: 207448 - RNA, 61 nt, Human
uucaaguuaccaauguaacacuggccagcgggcccagcaaucuccauguguacuuauuaca

SEQ ID NO: 207449 - RNA, 61 nt, Human
ccccugggccuuuggcuccaguggccccugugcccagcaguccagcucuuggaaccucgcu

SEQ ID NO: 207450 - RNA, 61 nt, Human
cauuaauuuucaacucaaugaaauaugugaagcccagcaucucuguugcuaacacacagag

SEQ ID NO: 207451 - RNA, 61 nt, Human
cauuugcaagcagaaaaccacagagacaggugcccagcaggagggcauagguggccucugc

SEQ ID NO: 207452 - RNA, 61 nt, Human
gagcacacugauagaaauccuuguguccagugcccagcaacuccugccucagccucccgag

SEQ ID NO: 207453 - RNA, 61 nt, Human
aagugcugggauuacaggcgugagccacugcgcccagcauguuagacaauuuuuaauucau

SEQ ID NO: 207454 - RNA, 61 nt, Human
auagucugauuacaaaacgugcaauucaggagcccagcagugacacacuuaucacgccuag

SEQ ID NO: 207455 - RNA, 61 nt, Human
cauuuugaaacccagaaagaccuggaaaggagcccagcauguccaucuuuucaaagauaca

SEQ ID NO: 207456 - RNA, 61 nt, Human
ccguucuguaaauagcgacgucgguguugcugcccagcagcgugcuugcauugccggugca

SEQ ID NO: 207457 - RNA, 61 nt, Human
aggcugccgucccaccacacguggccucugcgcccagcacggugcucgccgacaguggugu

SEQ ID NO: 207458 - RNA, 61 nt, Human
agcaggcucagcccuucccacccugccccaugcccagcagcacaacacggagugagacagg

SEQ ID NO: 207459 - RNA, 61 nt, Human
uuggcagguuaaugggacuauaaaugcuggagcccagcacucacacuuaauuauauuuaug

SEQ ID NO: 207460 - RNA, 61 nt, Human
caggucccucugcaaaacuuccuggaguucagcccagcaaggccagaccaaggaggcagca

SEQ ID NO: 207461 - RNA, 61 nt, Human
acagcaggagcgugcgggcuugcaggaggaggcccagcagcugcgggaugagauugaggag

SEQ ID NO: 207462 - RNA, 61 nt, Human
ggcucuauuggauuuguccaaacaggugcuggcccagcauggaaucugaugaaaauauucu

SEQ ID NO: 207463 - RNA, 61 nt, Human
cccagcaggcucacucagcaaggagcucucugcccagcauauugcaggcccuguuuugagu

SEQ ID NO: 207464 - RNA, 61 nt, Human
gucuuguuugcugugccacgccugaugcccagcccagcagcaugcuuuguacacugauaua

SEQ ID NO: 207465 - RNA, 61 nt, Human
acaucuguggccaacaauccuauggaaaaaagcccagcaucacugaucauuagagaaaugc

SEQ ID NO: 207466 - RNA, 60 nt, Human; identical to SEQ ID NO: 22232

SEQ ID NO: 207467 - RNA, 61 nt, Human
caaggaggaaauguggaaacgcaguuguguggcccagcacgagccugggcgaccaccgggu

SEQ ID NO: 207468 - RNA, 61 nt, Human
uucaaucgcccaacuacccagacgauuaccggcccagcaaagucugcaucuggcggaucca

SEQ ID NO: 207469 - RNA, 61 nt, Human
uggaguguuuuuggcauggugaccugucugggcccagcauguugcagauguguauuuaugc

SEQ ID NO: 207470 - RNA, 61 nt, Human
cuauuaaucacuuguuagagcaacaugacaugcccagcaucccacuucccgaaaaugucua

SEQ ID NO: 207471 - RNA, 61 nt, Human
uuccucccgaguuuggcuggcacgagagcuagcccagcacaugaagcaggugauguuaagu

SEQ ID NO: 207472 - RNA, 61 nt, Human
cuggaggcccugcccagcccugcucugcccagcccagcaggggcuccaggccuuggcuggc

SEQ ID NO: 207473 - RNA, 61 nt, Human
cccuccaacccucucugcugcuguuuccauggcccagcauucuccacccuuaacccugugc

SEQ ID NO: 207474 - RNA, 61 nt, Human
ccagcaggagaggcuccugguguagugggcagcccagcacuucccgcugcugccugccugu

SEQ ID NO: 207475 - RNA, 61 nt, Human
cgugggcggugggccccagccccacagaccagcccagcauucagguuaguucuacuucuuc

SEQ ID NO: 207476 - RNA, 61 nt, Human
acccuccaccccgucccccacggugggcacugcccagcaccgcaugccacguguccggaau

SEQ ID NO: 207477 - RNA, 61 nt, Human
caagccacaggaaggaggggagagacaggcagcccagcaguguggagacccugccacagcc

SEQ ID NO: 207478 - RNA, 61 nt, Human
uccacggagcagcagcacccuccagcaggcagcccagcaugccaggggugugugcgcaccu

SEQ ID NO: 207479 - RNA, 61 nt, Human
agaaauagacaguauauuuauagucacaagagcccagcagggccucaaaguuggggcaggc

SEQ ID NO: 207480 - RNA, 61 nt, Human
gagucccuaccacccaucucaucacuuuccagcccagcacucuucaugcucauucauuuaa

SEQ ID NO: 207481 - RNA, 61 nt, Human
caggggaccaguagggugguuucccucucaggcccagcagcccauugacagcauuagacug

SEQ ID NO: 207482 - RNA, 61 nt, Human
agauuauaguaaaugccuuuuacuuaacugugcccagcaggcugggugcguuaaaaagccc

SEQ ID NO: 207483 - RNA, 61 nt, Human
gaucaugacaugucgggcgaugcuuggaagagcccagcauguauguaugcacacauugugu

SEQ ID NO: 207484 - RNA, 61 nt, Human
ccgcagaauggugcucuccuuugcccucccugcccagcagccugauaggacucuccuaguc

SEQ ID NO: 207485 - RNA, 61 nt, Human
ccccaaggcuggggccacagcuccuaccccugcccagcagcccugagcucagcugcaggaa

SEQ ID NO: 207486 - RNA, 61 nt, Human
gugaaccugccuugggccucaucugcuccuagcccagcagagagaguugaccccuccugaa

SEQ ID NO: 207487 - RNA, 61 nt, Human; identical to SEQ ID NO: 207486

SEQ ID NO: 207488 - RNA, 61 nt, Human
gcaggggagcagagcaccaggccgggcgccugcccagcaggagcugaugccggaggcagug

SEQ ID NO: 207489 - RNA, 61 nt, Human
gugcacacaaucuggcucaauguauauauuggcccagcaaggcaaagaacugaaguuccag

SEQ ID NO: 207490 - RNA, 61 nt, Human
ccaaguaguauauggacaguccagggcuuaugcccagcagcccacuggaggcauucuucag

SEQ ID NO: 207491 - RNA, 61 nt, Human
aaucaucccaaaccaggcugccccagccccagcccagcaacagugaacucccuugggucaa

SEQ ID NO: 207492 - RNA, 61 nt, Human
ucagccacugggguguugugcucacuucagggcccagcacaaaaauccuuguuugacaucu

SEQ ID NO: 207493 - RNA, 61 nt, Human
gccagcccugaccuggucacugggcaggcuggcccagcagccugggggcugcagaagacau

SEQ ID NO: 207494 - RNA, 61 nt, Human
ggagguaaagcaggacccuugcagacauguugcccagcacacaguaggcccucaauaaaag

SEQ ID NO: 207495 - RNA, 59 nt, Human; identical to SEQ ID NO: 22261

SEQ ID NO: 207496 - RNA, 61 nt, Human
gccuuagcagaugguaugcuugcggaccgcagcccagcaugccggugggcccacagcccga

SEQ ID NO: 207497 - RNA, 61 nt, Human
gguauacccuggcucugccacccaugaaccagcccagcauccagccagugagugggcaccc

SEQ ID NO: 207498 - RNA, 61 nt, Human
gcuggggcaucccagcccacacacccuggaugcccagcaaggccacagaaagagccugaug

SEQ ID NO: 207499 - RNA, 61 nt, Human
ugcccuggggccaccucggcugcugcagccugcccagcagcacauuccagucacugccccc

SEQ ID NO: 207500 - RNA, 61 nt, Human
ccaguuugcagguguggccuuguuucuccuugcccagcagugcugccuucagcggccguga

SEQ ID NO: 207501 - RNA, 61 nt, Human
acagcagagccaaucacagacccaccacacagcccagcagcccuucgugaauccugcacug

SEQ ID NO: 207502 - RNA, 61 nt, Human
cucccucugcccucccgucugugagcucccugcccagcaccaccuccugcacugcacuucu

SEQ ID NO: 207503 - RNA, 61 nt, Human
cccuguguccacugagacuuuccccucucgcgcccagcauuugguuuuacacaggaagaga

SEQ ID NO: 207504 - RNA, 61 nt, Human
gacacugacucuuccacuguacaaaaguacugcccagcauacuuaaaaaguagauccuugg

SEQ ID NO: 207505 - RNA, 61 nt, Human
gaagaaaauaauaagcccucuauacauaaaugcccagcacaauucauuguuaaaaaacaac

SEQ ID NO: 207506 - RNA, 61 nt, Human
caugcccucuuccugcucacaugcuagcggggcccagcagcccugggugguuuugccagca

SEQ ID NO: 207507 - RNA, 61 nt, Human
caauuuguagcuuccugccuggcuucagagagcccagcaaccuucuaggccugcuuuccag

SEQ ID NO: 207508 - RNA, 61 nt, Human
aaugggucaguagcccuuccuguucucuccagcccagcauacaggaggaucaaaggaggug

SEQ ID NO: 207509 - RNA, 61 nt, Human
acuggagguagagacggcccuuugagauggugcccagcaggccaaacccaccugccucugc

SEQ ID NO: 207510 - RNA, 61 nt, Human
cagcauggcauagccccggccccccgcgcucgcccagcaggagagacugagcagccgccag

SEQ ID NO: 207511 - RNA, 61 nt, Human
accgcgcagucccguuugacgguggugccgugcccagcaucgugccaaggacuccccuacu

SEQ ID NO: 207512 - RNA, 61 nt, Human
uaaguacuggcucaugcucaacgagaaggaggcccagcaaguguauggugggaaggaggcc

SEQ ID NO: 207513 - RNA, 61 nt, Human
acuucucagccccgcugagccccucauuugugcccagcauuuugugugcacacauggccuc

SEQ ID NO: 207514 - RNA, 61 nt, Human
uagucauuaaauggaagugucugccagcugggcccagcaccucgucuuggguugcgcguuc

SEQ ID NO: 207515 - RNA, 61 nt, Human
ucgggguacacccagcacuuugcgaccugcggcccagcaggcgcggaggauggcggggagg

SEQ ID NO: 207516 - RNA, 61 nt, Human
augaaaugucaccuugcugaggcccagcccagcccagcauagcccgagggcuggaaaaacg

SEQ ID NO: 207517 - RNA, 61 nt, Human
ccauacagcauggguggcaggguuuggacccgcccagcagcaccacggaccccagccacuc

SEQ ID NO: 207518 - RNA, 61 nt, Human
uguccacccaccucgcucagcggcucccggggcccagcaccagcucagaauaaagcgauuc

SEQ ID NO: 207519 - RNA, 61 nt, Human
gggagggucacagcccacgggcuggcagccagcccagcaccuacuuguaaaaauuuuguaa

SEQ ID NO: 207520 - RNA, 61 nt, Human
cuaguuacaguguaggcaccccggcccagcagcccagcagcccacauguguucaggacccu

SEQ ID NO: 207521 - RNA, 61 nt, Human
cuaugcugcuaguuacaguguaggcaccccggcccagcagcccagcagcccacauguguuc

SEQ ID NO: 207522 - RNA, 61 nt, Human
cuuagugguuaagcauuccuuucucuucagugcccagcagcacccaguguuggucuguguc

SEQ ID NO: 207523 - RNA, 61 nt, Human
cauggcauugagagggugcugcccgcucaaugcccagcagcagcucuggaaggcagugcuc

SEQ ID NO: 207524 - RNA, 61 nt, Human
guguguguguguguguguguuuuuccuguuugcccagcagugcauuguggguuccaagagu

SEQ ID NO: 207525 - RNA, 61 nt, Human
cucauguucuuucuuguugaugaguucugcggcccagcauauagaaauggcucagaacguu

SEQ ID NO: 207526 - RNA, 61 nt, Human
ccccaggccaggaggcuguuccaggaguccugcccagcagccucaguggccaagcccagac

SEQ ID NO: 207527 - RNA, 61 nt, Human
ucuguccagagucuagggcaguccuccacuggcccagcacuccaguuuccuuucccugccu

SEQ ID NO: 207528 - RNA, 61 nt, Human
cuuuccaagguugggacccaaggaucggggggcccagcagcccgcaccgaucgagccggac

SEQ ID NO: 207529 - RNA, 61 nt, Human
gcccucuuucucaccuacccccugccgcacagcccagcaggagggaggcggacagccagau

SEQ ID NO: 207530 - RNA, 61 nt, Human
uaccgaaggaaggccaggugcaguggcucacgcccagcacuuugggaggcugaggugggag

SEQ ID NO: 207531 - RNA, 61 nt, Human
gugggguccggaccguggcugcccccguugugcccagcauugcccgggugagggcucugcc

SEQ ID NO: 207532 - RNA, 61 nt, Human
ucacaugucaguaccuucaaacuagggccaagcccagcacugcuugaggaaaacaagcauu

SEQ ID NO: 207533 - RNA, 56 nt, Human; identical to SEQ ID NO: 22299

SEQ ID NO: 207534 - RNA, 61 nt, Human
gugagaccacuccaggguggaaagaagccacgcccagcagagcugccuucucggagccuuc

SEQ ID NO: 207535 - RNA, 61 nt, Human
agaacaaaggagggaccugagguggagagaggcccagcaccccaaaucucugccaucacac

SEQ ID NO: 207536 - RNA, 61 nt, Human
cuuaaacccuagcccugugagagcuuccugugcccagcaggaaggaagucaaauaaaccac

SEQ ID NO: 207537 - RNA, 61 nt, Human
agcaagcagggggccaguggcggggcccagcgcccagcaggacacccaugcaagaggcuga

SEQ ID NO: 207538 - RNA, 61 nt, Human
cagcuucaagugccuuuugcugcgcaccaaugcccagcaggggaggugaggggggcuggcg

SEQ ID NO: 207539 - RNA, 61 nt, Human
gucagcuuccccaggagcucucugcugagcagcccagcacaacccccaggaaacacaaaug

SEQ ID NO: 207540 - RNA, 61 nt, Human
aauagcugggauuacacgugcccaccaccaugcccagcauggugaaaccccauaucuacua

SEQ ID NO: 207541 - RNA, 61 nt, Human
ggugagcuggucauugucucguggccagagggcccagcagccacuguggaccuggggcguu

SEQ ID NO: 207542 - RNA, 61 nt, Human
ugaagccugaagacucgccccacccaccacugcccagcacccaguguccucccgugccccu

SEQ ID NO: 207543 - RNA, 61 nt, Human
cccuggcccugcugaggcauacagagcuucagcccagcacagaagcaagacaaaaucagug

SEQ ID NO: 207544 - RNA, 61 nt, Human
ccagccagggaggggcagcugcagugaccaggcccagcagggaggacuugugcagccgggc

SEQ ID NO: 207545 - RNA, 61 nt, Human
gagaggacaggccuggcaggggcccacuggugcccagcaccaaggcgagcuccgggcucag

SEQ ID NO: 207546 - RNA, 61 nt, Human
gucuccccccugggcacacgugcucacucaggcccagcaaugaccucugcucauuuuugca

SEQ ID NO: 207547 - RNA, 61 nt, Human
ccugcgggcagggggaggccagcaggcccgggcccagcaccccuucccuggcaccaggguc

SEQ ID NO: 207548 - RNA, 61 nt, Human
ggaccucaggacaggcauggaggccacaggggcccagcagcccacccuuuccucuccccac

SEQ ID NO: 207549 - RNA, 61 nt, Human
gcuauuucugaggaugaaaugggagacauaugcccagcaccugauguaaguuuauauaaug

SEQ ID NO: 207550 - RNA, 61 nt, Human
cccuccuuuccucucccuugagcuugguucugcccagcacucgugcuuguucacauaauua

SEQ ID NO: 207551 - RNA, 61 nt, Human
agccuggacuuugguucucuccaggaagguagcccagcacugugaagacccagcaggaagc

SEQ ID NO: 207552 - RNA, 56 nt, Human; identical to SEQ ID NO: 22318

SEQ ID NO: 207553 - RNA, 61 nt, Human
cagcugggacugugaggaccgagaagcaauggcccagcagacgagacagcaaagaccaagg

SEQ ID NO: 207554 - RNA, 61 nt, Human
cuauggaagucuagcaaagcaauacgacucagcccagcacucucugccccaggacucaugg

SEQ ID NO: 207555 - RNA, 61 nt, Human
cauugucacuguuuucacugucaugcagggagcccagcacuguggccaggauggcagagac

SEQ ID NO: 207556 - RNA, 61 nt, Human
gacuucccugccguguuugugacccccuccugcccagcaaccugccagcuacaggagcccc

SEQ ID NO: 207557 - RNA, 50 nt, Human; identical to SEQ ID NO: 22323

SEQ ID NO: 207558 - RNA, 61 nt, Human
ucccuugccaugcccauuugggauuuucuuugcccagcauaugugccauaaacagaacaaa

SEQ ID NO: 207559 - RNA, 61 nt, Human
ggauagaggcugagagaagaaggaagaaucagcccagcagguaugggcaucugggaaaccu

SEQ ID NO: 207560 - RNA, 61 nt, Human
ccuauguccuauuugaguggcagcagcgccagcccagcaagaaggcuggggguugucaagg

SEQ ID NO: 207561 - RNA, 61 nt, Human
agaaagaaggcuuaacauuaaguauuccuuggcccagcagcggcccagauugcggugugag

SEQ ID NO: 207562 - RNA, 61 nt, Human
gccucccuuuguaaugcugcuccucuccacugcccagcaccaugaguugggugcagacacc

SEQ ID NO: 207563 - RNA, 61 nt, Human
uucuaacauggaaaaagauucucagccugccgcccagcaugcagguggccucgcuuugccg

SEQ ID NO: 207564 - RNA, 61 nt, Human
ccucaguuuccucaucuguaaacuggagagagcccagcacuuggcagguguccaguaccua

SEQ ID NO: 207565 - RNA, 61 nt, Human
aggcccugguuccugcuguccugguggcugggcccagcaggggcccucacucuugaagucc

SEQ ID NO: 207566 - RNA, 61 nt, Human
cggcuccagcagggucugguuaagggguccagcccagcacuggaccauuccgucuccugcu

SEQ ID NO: 207567 - RNA, 61 nt, Human
cucuggccccuucucccauggggacaucucggcccagcaccccuaucccauuuccagaguu

SEQ ID NO: 207568 - RNA, 61 nt, Human
cauuugagcagccagaugauaaagcacagaugcccagcacugaaagaguuacuucgacaag

SEQ ID NO: 207569 - RNA, 61 nt, Human
cuacgugcucucucucguccuaccuaucaaugcccagcauggcagaaccugcagcccuugg

SEQ ID NO: 207570 - RNA, 61 nt, Human
ggacaaccugccccuccccagcccuuugcaggcccagcagacuugagucugaggccccagg

SEQ ID NO: 207571 - RNA, 60 nt, Human; identical to SEQ ID NO: 22337

SEQ ID NO: 207572 - RNA, 61 nt, Human
gcaaaguggaaaauaugaaaagaccacacaggcccagcaguccagaaacugggcaaaaaua

SEQ ID NO: 207573 - RNA, 61 nt, Human
gagacacucaguuucacaagugagcccucuugcccagcacacaccuauggcuggcugggca

SEQ ID NO: 207574 - RNA, 61 nt, Human
gguucaaaggcagcaaggcagugagcuaugagcccagcauggaugugucucaggcaccuca

SEQ ID NO: 207575 - RNA, 61 nt, Human
ccuuugccucuaccuggcccucaucccaacagcccagcaaggggagagagaaagagaauuc

SEQ ID NO: 207576 - RNA, 61 nt, Human
gcagcucaaggauggcacucagaucuccauggcccagcaaggccaagauaaaucuaccacc

SEQ ID NO: 207577 - RNA, 61 nt, Human
aaaauacagaaagauuuugaguaaauuuugugcccagcaagcuguuaguuuuauuuuugua

SEQ ID NO: 207578 - RNA, 61 nt, Human
ucuuuauuuagaaauugggugauguuuuugugcccagcaacaugcuguaggaauuuaacuc

SEQ ID NO: 207579 - RNA, 61 nt, Human
ucccaauaccucagcaugguaaggggacagagcccagcagaucccagcugugaagaggcca

SEQ ID NO: 207580 - RNA, 61 nt, Human
ccucccuguggcagcagcaggacaggugugugcccagcacccucccuaccugggccuggaa

SEQ ID NO: 207581 - RNA, 61 nt, Human
uuaggaaccccccagccuguuuccauucucugcccagcagucucuuaccuucccugaucuu

SEQ ID NO: 207582 - RNA, 61 nt, Human
aauggccccaucuccugcagaagccaggugagcccagcacuggacugaaguucuugcagac

SEQ ID NO: 207583 - RNA, 61 nt, Human
gaagggagaaaaauguuuuaguacauuauaggcccagcagcuuuuauucauguccaccagc

SEQ ID NO: 207584 - RNA, 61 nt, Human
guggccagggcccuggguaucauguccacaugcccagcaagagccuugccuccccugccuc

SEQ ID NO: 207585 - RNA, 61 nt, Human
cucgggagauagauugucucccuugccucuggcccagcagagccuaagcacugugcuaucc

SEQ ID NO: 207586 - RNA, 61 nt, Human
gaggucccugcagcucacuguguccagcugggcccagcacuggugucucugugcuuccuuc

SEQ ID NO: 207587 - RNA, 61 nt, Human
uagcuaaaaucaucuuauguaccacuaauaugcccagcacauuuuguaaaacaguccugau

SEQ ID NO: 207588 - RNA, 61 nt, Human
agguccugcaugaacagcuucaccugggggggcccagcacgaagucacaucccagccccag

SEQ ID NO: 207589 - RNA, 61 nt, Human
gccaggaaagcaugcaauagacuugcucggagcccagcacuccugggucucggggucgggg

SEQ ID NO: 207590 - RNA, 61 nt, Human
augcauuaaguugaagucgacugccaaagaggcccagcagagggcagcacccccaucauuu

SEQ ID NO: 207591 - RNA, 61 nt, Human
cucauuaacuuugcuuauaaugcuuuuuauagcccagcacagaauuuaaagccauaccacc

SEQ ID NO: 207592 - RNA, 61 nt, Human
uagugagugaauguuuguaaaacaggauagugcccagcacauacuaguaacaaauguaaaa

SEQ ID NO: 207593 - RNA, 61 nt, Human
ucuuuuagaguaggaaucagcauagugggaugcccagcaggcacaaaccauggguccaggg

SEQ ID NO: 207594 - RNA, 61 nt, Human
aucacuuauuaaaaauccuuauuuucuccaagcccagcaaacguugacuucugggcaaacc

SEQ ID NO: 207595 - RNA, 61 nt, Human
uucucucccaucauccggauuucugguuguggcccagcaauuaacaaaaacagcuucaacu

SEQ ID NO: 207596 - RNA, 61 nt, Human
gcucuuugcugagagccccuuuugacagaaagcccagcacgacccugcuggaagaacugac

SEQ ID NO: 207597 - RNA, 61 nt, Human
cugugcaggacguggaccagcuggagcugcugcccagcacagaggagagucgccgcagaug

SEQ ID NO: 207598 - RNA, 61 nt, Human
guucuuuccauccucuugugguacccguagugcccagcauccagaccuuugugccccugug

SEQ ID NO: 207599 - RNA, 61 nt, Human
ucuuccucuuuucccauccccugcuacccuggcccagcacaggcacuuucuagauauuucc

SEQ ID NO: 207600 - RNA, 61 nt, Human
gcagcauguggcccauggcaccacccccacggcccagcacaaccccuagagcaggaaagag

SEQ ID NO: 207601 - RNA, 61 nt, Human
gugcuacaccaccugccugauugccaagggugcccagcacguggccccagaccaaucugag

SEQ ID NO: 207602 - RNA, 61 nt, Human
cgugcauuccugcucuccggacccccaaagggcccagcauuggugggugcaccaguaucuu

SEQ ID NO: 207603 - RNA, 61 nt, Human
ggggaggccaguguacauguaaaugcccacagcccagcauuggguuucccucccaaggccc

SEQ ID NO: 207604 - RNA, 61 nt, Human
cugcuggaaaccagcacacgcaaaagaugacgcccagcacagcagcaggacacaccaugug

SEQ ID NO: 207605 - RNA, 61 nt, Human
gcuuuuccuguggccugaccugccugugagugcccagcaagccuugggcacaccccgcugg

SEQ ID NO: 207606 - RNA, 61 nt, Human
gcucagccaauaaauccuaaggagacaagcagcccagcagugaucagcaguagccaccuua

SEQ ID NO: 207607 - RNA, 61 nt, Human
ugcaauaauaaaguaaguagccaaccugggugcccagcagugcugagaccuggcugcucua

SEQ ID NO: 207608 - RNA, 61 nt, Human
ucacauuauucugguuugaauauguccauaagcccagcacagaaacagcuggauucuucua

SEQ ID NO: 207609 - RNA, 61 nt, Human
ccagaauucccaggagggcauaucagcaacugcccagcagagcuauauuuugggggagaag

SEQ ID NO: 207610 - RNA, 61 nt, Human
caugcugucuggggagagcagcacacuggccgcccagcacugcugcuaugacgaggacagc

SEQ ID NO: 207611 - RNA, 61 nt, Human
agggucggcgucuggggucagggcgcgcacagcccagcagcccgaggccgcccgcgacuag

SEQ ID NO: 207612 - RNA, 61 nt, Human
gacgugcacuuccccaagucggcacugaguggcccagcaccgccuagcccugccaccccac

SEQ ID NO: 207613 - RNA, 61 nt, Human
guuccaguucaccuaaaggcugauugugcaggcccagcacuguggcuggacugccgcgcca

SEQ ID NO: 207614 - RNA, 61 nt, Human
acauuccacucccauucucccuccaagaggggcccagcauuguauuucccugugaccccuu

SEQ ID NO: 207615 - RNA, 61 nt, Human
ucaugcaggacaccuaggagcacccaggcuugcccagcaaacccugcgugccauucuucua

SEQ ID NO: 207616 - RNA, 61 nt, Human
acugcccucacccucagccgucccaaggagugcccagcacuacucagcauguaguccagga

SEQ ID NO: 207617 - RNA, 61 nt, Human
aggccucuggaaucagaaucuucaggguggggcccagcagucuguguuuuaacagguucuc

SEQ ID NO: 207618 - RNA, 61 nt, Human
gccccuguggucugcuuguccuucagcccaugcccagcagauaccucucugacuggagacg

SEQ ID NO: 207619 - RNA, 61 nt, Human
gcucuccugucucugcagcucuacaggugaggcccagcagagggaguagggcucgccaugu

SEQ ID NO: 207620 - RNA, 61 nt, Human
ccacucccaggcagcccuacuucuuugcuuugcccagcauuuuacugauucauacauuauc

SEQ ID NO: 207621 - RNA, 61 nt, Human
accuuccuccacucuaagggauaucaacacugcccagcacaggggcccugaauuuaugugg

SEQ ID NO: 207622 - RNA, 61 nt, Human
cacagugauuuuuuucuuguaauuuaaacaggcccagcauugcugguucuauuuaauggac

SEQ ID NO: 207623 - RNA, 61 nt, Human
agaagagguaagggaggcuaaguggguaacagcccagcaucagggucacuguggcaacagc

SEQ ID NO: 207624 - RNA, 61 nt, Human
uuuggggaaggaacuggauaucucuccugcagcccagcaccgagauacccaggacgggccu

SEQ ID NO: 207625 - RNA, 61 nt, Human
acacugaagcagcuggugugggcuggaacuggcccagcauugaccugggccgggcugguuc

SEQ ID NO: 207626 - RNA, 61 nt, Human
gucuuugaugguggugagggugggugauggugcccagcaccaacaguuuuaguggccuguc

SEQ ID NO: 207627 - RNA, 50 nt, Human; identical to SEQ ID NO: 22393

SEQ ID NO: 207628 - RNA, 61 nt, Human
gauuccugauagaacagacuuuacuuuucuagcccagcauugaucuagaagcagaggaauc

SEQ ID NO: 207629 - RNA, 61 nt, Human
uuccgugggugccuuaugugguggugguugugcccagcacagaccuggcaggguucuugcc

SEQ ID NO: 207630 - RNA, 61 nt, Human
uaauauccucuugcguuuucccugugggaaugcccagcauuaauuaaguccauuucauuuu

SEQ ID NO: 207631 - RNA, 61 nt, Human
ugaugcuguugcagggcaggucugagagggugcccagcagcacccggugucagggccaccu

SEQ ID NO: 207632 - RNA, 61 nt, Human
ugggugaggggacacccugggccucucucccgcccagcauccucccugaguccccacacag

SEQ ID NO: 207633 - RNA, 61 nt, Human
ccucuaaaggggaggcauuaaaauucacugugcccagcacaugggugguacacuaauuaug

SEQ ID NO: 207634 - RNA, 61 nt, Human
agcccucuucgagcuagagaaaaauagauaagcccagcagccccagaagauggucugaaca

SEQ ID NO: 207635 - RNA, 61 nt, Human
acccagccuuugggccuccccagccagagcagcccagcaacaguguguccuguggucauaa

SEQ ID NO: 207636 - RNA, 61 nt, Human
ccuggggccccagggagcaggacgcuccggggcccagcacguugcccugggccuguggccg

SEQ ID NO: 207637 - RNA, 61 nt, Human
ccccaccuucaggucuuagugguucacaagagcccagcagccaggcuggcuuuuucauugu

SEQ ID NO: 207638 - RNA, 61 nt, Human
cgucugaacugaccucugaccucugccccacgcccagcacagccuugggggaaguguacag

SEQ ID NO: 207639 - RNA, 61 nt, Human
gccuaacacugggcugcagagacuggaccccgcccagcauugggcugggcucgccacaucc

SEQ ID NO: 207640 - RNA, 61 nt, Human
gcuuccaggccugggauuuacaccacgccuagcccagcagaggccuuagucccauuugggg

SEQ ID NO: 207641 - RNA, 61 nt, Human
agguagagaguuuuccuguucagauuacccugcccagcaggaacuggaauacaguguucgg

SEQ ID NO: 207642 - RNA, 61 nt, Human
uguccuggaccucagguucccagcgucccgagcccagcacugucucuucagugcccugauu

SEQ ID NO: 207643 - RNA, 58 nt, Human; identical to SEQ ID NO: 22409

SEQ ID NO: 207644 - RNA, 61 nt, Human
cucuccuaccaagaugguguuccacuguccagcccagcaugaguagcagguagagcacagc

SEQ ID NO: 207645 - RNA, 61 nt, Human
cacagccuccaaaaauggcagugacuccccagcccagcaccccuuccucgugggucccaga

SEQ ID NO: 207646 - RNA, 61 nt, Human
cuuuuccagcccacaaagggggacgaucacggcccagcaaaagcgaugcugagaggggaaa

SEQ ID NO: 207647 - RNA, 61 nt, Human
ccagacuccugccggccucagaggacaccuggcccagcacaggcagcuagaagggccggug

SEQ ID NO: 207648 - RNA, 61 nt, Human
ggaccagggauggggcagcgcacaggcccgggcccagcacagaacugcccaucgggacgcc

SEQ ID NO: 207649 - RNA, 61 nt, Human
ugccucugccgcuccuccacaucuugccgcugcccagcagagcuggcuucuggguccaccu

SEQ ID NO: 207650 - RNA, 61 nt, Human
ccuaccagccugaccugagucggcgccgugggcccagcaggccucgcgcagccuagcuccu

SEQ ID NO: 207651 - RNA, 61 nt, Human
cucuggcuccaucugaguccccugggagagagcccagcacccaagauccagcaggggacag

SEQ ID NO: 207652 - RNA, 61 nt, Human
agcuacaacagccaucuuagguccccgaggugcccagcaucacguaaaacaucgauaugcu

SEQ ID NO: 207653 - RNA, 61 nt, Human
gcuauaaagacauaugagcgaggccagcugagcccagcacugcggccaagucgaagacuuu

SEQ ID NO: 207654 - RNA, 61 nt, Human
auagcuuucauguccauugaagaauuaccaagcccagcaaguaaaaaaaauuacaauaaca

SEQ ID NO: 207655 - RNA, 61 nt, Human
agugaggguccaggaaagcucuugcccucuugcccagcagccgcaggcauaucucaacgga

SEQ ID NO: 207656 - RNA, 61 nt, Human
ccagcacuucccugccucccccaggccucaggcccagcacccaguuccuccucacauggca

SEQ ID NO: 207657 - RNA, 61 nt, Human
cugggauuacaggugggagccacuacagcuggcccagcagcucuguuucugauagaggugg

SEQ ID NO: 207658 - RNA, 61 nt, Human
cuuaccaccacaccacacgcacacuccacaugcccagcagaguggcacuugguggccagaa

SEQ ID NO: 207659 - RNA, 61 nt, Human
gugacccgccacacucacugucaguauuaaggcccagcagccuguugauaagcuacccugu

SEQ ID NO: 207660 - RNA, 61 nt, Human
ucacaccucuguucccagggccccgcucagggcccagcagagaguccguaggcuugaacau

SEQ ID NO: 207661 - RNA, 61 nt, Human
ccccuguauucccccucccagggcagccccugcccagcacaaaaccccaggacccuggcuc

SEQ ID NO: 207662 - RNA, 61 nt, Human
aauccaccaggcagcucagggcuccugcccagcccagcagcuucuguugucuaacguaugg

SEQ ID NO: 207663 - RNA, 61 nt, Human
cuguauuuauucccccaucuucaucccaacagcccagcaagaaggaggagacagagagcuc

SEQ ID NO: 207664 - RNA, 61 nt, Human
cugccuggccaccaccccaucugggaggugugcccagcagcucauugagaacgggccauga

SEQ ID NO: 207665 - RNA, 61 nt, Human
acaguugaguuucuucuaaagaggaagccuugcccagcaaggaccagugagacagccggau

SEQ ID NO: 207666 - RNA, 61 nt, Human
gccggagaacaucugccuugcugcaccugaggcccagcagagccguuccugggacugucag

SEQ ID NO: 207667 - RNA, 61 nt, Human
ugagcucuccggcuuccagggagaccuccccgcccagcagcccccagagacacaacaaccu

SEQ ID NO: 207668 - RNA, 61 nt, Human
agauacuuaaaagggcuccugggguacacaagcccagcagguccugagugaagccgugggc

SEQ ID NO: 207669 - RNA, 57 nt, Human; identical to SEQ ID NO: 22435

SEQ ID NO: 207670 - RNA, 61 nt, Human
uuaggcaaggcuccacucauuguugauauuugcccagcaggaaaaucauguaaguuauacc

SEQ ID NO: 207671 - RNA, 61 nt, Human
augggcaauagcaagcuggcggcagaguccagcccagcauaugacuugcccugaauggaag

SEQ ID NO: 207672 - RNA, 61 nt, Human
gucucuucguacucgguuauuaaauggccuagcccagcaaaugaucagccuugcaaauaau

SEQ ID NO: 207673 - RNA, 61 nt, Human
ucaggaggcugaggcggggaggauccauugagcccagcaguccaaccugggcaaaauagug

SEQ ID NO: 207674 - RNA, 61 nt, Human
aaguuuuccaagaaaaugccccgacaggggugcccagcacacugccugagggacaacagac

SEQ ID NO: 207675 - RNA, 61 nt, Human
guuggcaucaucugauggcauguccaagugugcccagcagcggaugcugaagcaccagagc

SEQ ID NO: 207676 - RNA, 61 nt, Human
ggacucuccaggcuccuccucccccuggcaggcccagcaacaugugccccagaucuggaag

SEQ ID NO: 207677 - RNA, 61 nt, Human
gacgcaggugaugccagccaggcccaggagugcccagcaucccccaacugaugacacagua

SEQ ID NO: 207678 - RNA, 61 nt, Human
gccugguggaugccaaccuggauaaccuguggcccagcauugacuguccacccagccuugc

SEQ ID NO: 207679 - RNA, 61 nt, Human
aagacaguggcaggcagcuggaguagagcgagcccagcagcccuaaaaggcugccuucaug

SEQ ID NO: 207680 - RNA, 61 nt, Human
agacacgcuagguucuuccaaagagucccaagcccagcaccugcuccuggggccacgaccu

SEQ ID NO: 207681 - RNA, 61 nt, Human
uccagucacugugcccagcagggugggcugugcccagcaggagucaggcuaagaaacgcca

SEQ ID NO: 207682 - RNA, 61 nt, Human
gacugugcagccuggaaccuccagucacugugcccagcagggugggcugugcccagcagga

SEQ ID NO: 207683 - RNA, 61 nt, Human
cucugucagcagccuggccuggucugugccugcccagcauguucccaaaucugugcuggac

SEQ ID NO: 207684 - RNA, 61 nt, Human
cuuccacagucauuucuucuagguuuucuuggcccagcacugcccaucccaccccaugagg

SEQ ID NO: 207685 - RNA, 61 nt, Human
gguggcaaguggcacagcuccauguccggaggcccagcacuccgucugaugggaggagucg

SEQ ID NO: 207686 - RNA, 61 nt, Human
uuguuuaggcccagguucugcccagaccggggcccagcagagcucucaggaggcugagaaa

SEQ ID NO: 207687 - RNA, 61 nt, Human
gaacagggcccaugguguauucuaggccacagcccagcacuccucugggcugcucucaaac

SEQ ID NO: 207688 - RNA, 61 nt, Human
gccagggagcacugccagcuugccaguuucugcccagcaaaagcacguaugcuucaggggc

SEQ ID NO: 207689 - RNA, 61 nt, Human
aaccugcccucggacgcuccuggagcuuugugcccagcacucggauucuccuggacaccau

SEQ ID NO: 207690 - RNA, 61 nt, Human
ggaugugcugcaggagcuccgaggcacuguggcccagcaggugacugguucuucaggaacu

SEQ ID NO: 207691 - RNA, 61 nt, Human
agucaugcacucaggcagacagcaggcuggagcccagcauucagggguggcuucugucugu

SEQ ID NO: 207692 - RNA, 61 nt, Human
caaagucagggagccuggaagccaaacaaaggcccagcagccuucugacaagcaagggcug

SEQ ID NO: 207693 - RNA, 61 nt, Human
ccucuuccagggccucugggagccugacagugcccagcaugaagguggggccagugcuggg

SEQ ID NO: 207694 - RNA, 61 nt, Human
uggggcaucccuuugccuuggcaucccuguagcccagcaacccugccccuccccagcaucc

SEQ ID NO: 207695 - RNA, 61 nt, Human
gaaguguauucuacauaaacucucagaggaugcccagcaggauggagucccaguugcccgc

SEQ ID NO: 207696 - RNA, 61 nt, Human
acaucuuucccugacucuuggauaugaaacugcccagcauuccugggagucuuaggauuuu

SEQ ID NO: 207697 - RNA, 61 nt, Human
ccccagagcagcaggccccgagccccuucaggcccagcacugccccagacucgcuggcacu

SEQ ID NO: 207698 - RNA, 61 nt, Human
uauucaccauguccaagauccugggaucugggcccagcaucucuuccuccuuuguagaugc

SEQ ID NO: 207699 - RNA, 61 nt, Human
ugggggagagaggaaaggagggaggggagaagcccagcagaagcugagccaggcagagggg

SEQ ID NO: 207700 - RNA, 61 nt, Human
aguggcccccacccucagcccgcuccugcccgcccagcacccccaggcccugggggaccug

SEQ ID NO: 207701 - RNA, 61 nt, Human
cccagaagacacaggaaacaauguauugucugcccagcaaucaaaggcaaugcucaaacac

SEQ ID NO: 207702 - RNA, 61 nt, Human
cucccauuuucucugcuggcguuucugcugugcccagcaguggcugcuggggaagcagcug

SEQ ID NO: 207703 - RNA, 61 nt, Human
gucucuaauuuggccucuguggcaagaccacgcccagcaaaaguggucggcugcagugcca

SEQ ID NO: 207704 - RNA, 61 nt, Human
cuagggggacggcgaugggccucacgggcccgcccagcacccugagaccacacuguugccu

SEQ ID NO: 207705 - RNA, 61 nt, Human
cucuuuagccccaggggagcagcucagcuuagcccagcaugaagagaugggcucugcucug

SEQ ID NO: 207706 - RNA, 61 nt, Human
gaaaaaauggauucaaagcuaggauuucagggcccagcaguguuccuccaucagcauguua

SEQ ID NO: 207707 - RNA, 61 nt, Human
aagcaggacagugugcgugcacgagcuccgagcccagcacagacaugccuggaacccccgc

SEQ ID NO: 207708 - RNA, 61 nt, Human
ucagcaaaaugcccuauaaacaauuaauuuugcccagcaagcuucugcacuaguaacugac

SEQ ID NO: 207709 - RNA, 61 nt, Human
cugcagguugcagucagggcuugaaguaggagcccagcaaagaaccaccugcuggacaguc

SEQ ID NO: 207710 - RNA, 61 nt, Human
cguguggggaccucagaacacugugaccuuagcccagcaagccaggcccuucaugaaggcc

SEQ ID NO: 207711 - RNA, 61 nt, Human
gggucuggcuggcuccugcccgugacgccuugcccagcagcaaggugcgcaacauggcugc

SEQ ID NO: 207712 - RNA, 61 nt, Human
gguagcuaguacuauaggugugcaccaccacgcccagcaaauuuuuaaauuuauuauagag

SEQ ID NO: 207713 - RNA, 61 nt, Human
gagaggccuguggcuaguuugcccugggggggcccagcacagccccagcccggagcccagc

SEQ ID NO: 207714 - RNA, 61 nt, Human
gugcuagagcccaggccagcucugagaccaagcccagcauugagaauaagcucuguucuaa

SEQ ID NO: 207715 - RNA, 61 nt, Human
guagccgaccugcaggagggccuacaaacgggcccagcaagagcugggcaacagcuggcuu

SEQ ID NO: 207716 - RNA, 61 nt, Human
ccgcgggucuccccgggcgccccucccuggggcccagcaccccuccucgccccauccccgu

SEQ ID NO: 207717 - RNA, 61 nt, Human
uccggcauaugaaggcgcaugguucuggacggcccagcagcuccuguggccacagcagcuu

SEQ ID NO: 207718 - RNA, 61 nt, Human
gaggaaccaagcccucuucaucuguucaugugcccagcauuuauuaagcaccugcuguaug

SEQ ID NO: 207719 - RNA, 61 nt, Human
acacaggcaaggaaauuggaacugccacccagcccagcaugguggcucaauugguugguug

SEQ ID NO: 207720 - RNA, 61 nt, Human
uccagcuccugggauccgggaguccaucccggcccagcacccccagcauccccguguaugg

SEQ ID NO: 207721 - RNA, 61 nt, Human
caacaucacacacaggugggggggccugauagcccagcacccaugauacagggccuaccaa

SEQ ID NO: 207722 - RNA, 61 nt, Human
ucagcccagcuauaaccaguaucagcaguaugcccagcaguggaaccaguacuaucagaac

SEQ ID NO: 207723 - RNA, 61 nt, Human
gccaaggcccuuugcacugcaucacccuggugcccagcaacaucagguaaccuucacugag

SEQ ID NO: 207724 - RNA, 61 nt, Human
ccucuguguuuccagccaucucgcccugccagcccagcaccacugggaaucauggugaagc

SEQ ID NO: 207725 - RNA, 61 nt, Human
gggagacggggaugucacgccgucccgcagggcccagcacagccccagacccgaaaaaagu

SEQ ID NO: 207726 - RNA, 61 nt, Human
aagugcccuggaccggcagcuggcgcaccaggcccagcagcagcuggaggaggaggaggag

SEQ ID NO: 207727 - RNA, 61 nt, Human
uucugagcaggggccccuggggacuucaacugcccagcaacauggaggaugguguccugag

SEQ ID NO: 207728 - RNA, 61 nt, Human
ggcugcccucccuccccagcuuacaccucaagcccagcacgcagugcaccuugaacagagg

SEQ ID NO: 207729 - RNA, 61 nt, Human
guaaauagaacccccuccaccaccccccgccgcccagcauccuaccuggacugcggugcua

SEQ ID NO: 207730 - RNA, 61 nt, Human
ugcaccuaucaacccauuaccuaguuauuaagcccagcaugcauuagcucuuuuuccugau

SEQ ID NO: 207731 - RNA, 61 nt, Human
ggugaagagcugugacaggccggacggggaggcccagcagggagagagggucucucuccua

SEQ ID NO: 207732 - RNA, 61 nt, Human
cggggagccaagugguucccaugcccacugagcccagcaagcuaagauccacuggcuugga

SEQ ID NO: 207733 - RNA, 61 nt, Human
uuagugucgccaccgcccauaaaggagcugagcccagcaggggcacugccuggggcccugu

SEQ ID NO: 207734 - RNA, 61 nt, Human
uucccaaaaccaaaggacaacugaggagacugcccagcacauaaugaauaaauaagaaaau

SEQ ID NO: 207735 - RNA, 61 nt, Human
cugucguaaucaguggugcugcuugacaccugcccagcauguuccugucucuccuuuuccu

SEQ ID NO: 207736 - RNA, 61 nt, Human
ggugugggcaggggcugcauuuuaugaaacugcccagcaagcugcgcucccuggggcccca

SEQ ID NO: 207737 - RNA, 61 nt, Human
ucuuucuuuuuggcuagggaaggugcagguggcccagcauucagggaggagucguaagauc

SEQ ID NO: 207738 - RNA, 61 nt, Human
acccacccuggcuuccuccagcucacauggcgcccagcacugggcuucagccaggugcucg

SEQ ID NO: 207739 - RNA, 61 nt, Human
cccucugcugcuugugcgcaugcgugcggccgcccagcaagcugugccuuuugcgccucuu

SEQ ID NO: 207740 - RNA, 61 nt, Human
ccauguagaauugugcuuggcucauaauagggcccagcaauuacugaagaaagugaagaaa

SEQ ID NO: 207741 - RNA, 61 nt, Human
ccacaucuuggcuugcuuuuggaacaggcuggcccagcaucauuugucaucaaguccacug

SEQ ID NO: 207742 - RNA, 61 nt, Human
aaaaaaacagucgcuaguuaacagcgacagagcccagcacccuggggucuuugugaauauc

SEQ ID NO: 207743 - RNA, 61 nt, Human
guccccucccagagggggaacccuggcacuggcccagcagccucuucucugagcuccaugu

SEQ ID NO: 207744 - RNA, 61 nt, Human
uaacugucccccccagucacuucucccacaggcccagcaggacgcaguccugaggaucagg

SEQ ID NO: 207745 - RNA, 61 nt, Human
gccuguuggugcuggcccuuggggagcuggagcccagcaugcuggggagugcggucagcuc

SEQ ID NO: 207746 - RNA, 61 nt, Human
ccacccccacagcgcccugcacccggccgcugcccagcaccgcgcuggcuggcacugaagg

SEQ ID NO: 207747 - RNA, 61 nt, Human
ccucaaaaggcccuagcuaauaaaccuguaagcccagcauuugagagaagguagggugugu

SEQ ID NO: 207748 - RNA, 61 nt, Human
agaaaagcaggugcccuaagauugcucuaaggcccagcaugugguuacaguucucugacuu

SEQ ID NO: 207749 - RNA, 61 nt, Human
aggcgccccuccccagagggaucccuaacgugcccagcauguagauucuggacuaacagac

SEQ ID NO: 207750 - RNA, 61 nt, Human
ggauuguguuacuaucacuaaguagcaaauugcccagcacauuaguccuaaacgucccaug

SEQ ID NO: 207751 - RNA, 61 nt, Human
acuacaaaaggcaagaaugcccauguaaggagcccagcagucuggacagauccuucuuccu

SEQ ID NO: 207752 - RNA, 61 nt, Human
cgcccugccgucggggcgcggcugcucacccgcccagcacacgccggggccccaggacaac

SEQ ID NO: 207753 - RNA, 61 nt, Human
ggcccucaggaagugucugcugaauggaauggcccagcauuagcccaguauuggaaaagac

SEQ ID NO: 207754 - RNA, 61 nt, Human
uuucauucaccacagucagcaugccccaagugcccagcauggggcggauggccaggaauga

SEQ ID NO: 207755 - RNA, 61 nt, Human
uguaaucgcauuucugcuugguagaggccgagcccagcaaagguggcuccuucugaaugug

SEQ ID NO: 207756 - RNA, 61 nt, Human
gcucacgaggcuuggaccugcuguggagggugcccagcagggggcugagcucugaggggug

SEQ ID NO: 207757 - RNA, 61 nt, Human
guucacaaggcuuggaccugccauggagggugcccagcagacguggugugagagggacagc

SEQ ID NO: 207758 - RNA, 61 nt, Human
gcucaugaggcuuggaccugccguggagggugcccagcagacgugguaugagagggauggc

SEQ ID NO: 207759 - RNA, 61 nt, Human
cggcucacgagacuuggaccugguggagggugcccagcagacguggugugagagggacggc

SEQ ID NO: 207760 - RNA, 61 nt, Human
gcucacgaggcuuggaccugcuguggagggugcccagcagacguggugugagaggaacggc

SEQ ID NO: 207761 - RNA, 61 nt, Human
aggccaaucccuucccucccagaagcuggccgcccagcaggagggacugaggccagacuca

SEQ ID NO: 207762 - RNA, 61 nt, Human
cccuguggcuugugcccaugcaccugccagggcccagcaggccaacccaucaucuagagua

SEQ ID NO: 207763 - RNA, 61 nt, Human
uccccaccggcacugggauuggcggguccaagcccagcaaccggcuucgcuccacaacaca

SEQ ID NO: 207764 - RNA, 61 nt, Human
auggcaagcuguuucaguuugcaaaaucacugcccagcauguuugaggucaguuggcaccu

SEQ ID NO: 207765 - RNA, 61 nt, Human
aaguuguggagagaaggagcaccggguuccugcccagcacugugcuugcgggaggcggugg

SEQ ID NO: 207766 - RNA, 61 nt, Human
gcaguguggggaggggauggggugcgucagggcccagcaucgccgccuggcaucucucugc

SEQ ID NO: 207767 - RNA, 61 nt, Human
aagugcugagauuacaggugugagccacugugcccagcaguuucccagaauauauuuaaau

SEQ ID NO: 207768 - RNA, 61 nt, Human
gggcucuuggcucugcagcgagaaagacacagcccagcagggcuggagacgcccaugucca

SEQ ID NO: 207769 - RNA, 61 nt, Human
cgacagaaccugacccguggagacugggagagcccagcaggcaccuguauugcagggcucc

SEQ ID NO: 207770 - RNA, 61 nt, Human
agaagggagccccaggcuggagcagcaugaggcccagcaagaagggcuuggguucugagga

SEQ ID NO: 207771 - RNA, 61 nt, Human
ccgggcgagcccgguguucugaagaccuguggcccagcagagccucugacaguaaaguuuu

SEQ ID NO: 207772 - RNA, 61 nt, Human
acagagcccaaaacagaagggggcugccccagcccagcagagcacagaguuucuggagcuc

SEQ ID NO: 207773 - RNA, 61 nt, Human
cuuaguugcucggugguuauggauaaacuuugcccagcaugauuuuuggguucaucuuauc

SEQ ID NO: 207774 - RNA, 61 nt, Human
uggggaccgccaccuuuucugcaggaaaugugcccagcagcucuuggucaaagcacuguug

SEQ ID NO: 207775 - RNA, 61 nt, Human
gcccugacgccuggguuucuuggccccagcugcccagcaggugccucgauucccugcccuu

SEQ ID NO: 207776 - RNA, 61 nt, Human
agaggcgcccugugaacccugaguguugcaggcccagcagacccugcugucccaagcccac

SEQ ID NO: 207777 - RNA, 61 nt, Human
agcaccagggagcaguugcccucaggccugugcccagcaugcccuccccuuuuuauacgaa

SEQ ID NO: 207778 - RNA, 50 nt, Human; identical to SEQ ID NO: 22544

SEQ ID NO: 207779 - RNA, 61 nt, Human
cagcgauggugagcauuuugguuuccuuaaggcccagcaagacuuccagggacaucucugg

SEQ ID NO: 207780 - RNA, 61 nt, Human
ggcccucuaggccuggcagggaugucccugugcccagcacagggugccuggcagggggaga

SEQ ID NO: 207781 - RNA, 61 nt, Human
aaucagacccaccugacaccaucacgcggaggcccagcagcaccugcacccacuuccagcu

SEQ ID NO: 207782 - RNA, 61 nt, Human
guuggccccucuguggccagccuggcccucagcccagcagagagggcaucaaccaaggaag

SEQ ID NO: 207783 - RNA, 61 nt, Human
ccugaggggcugcuggacugaccgaggggcugcccagcaagacugcagccucuuccucccu

SEQ ID NO: 207784 - RNA, 61 nt, Human
cugcgcuagucucccccgaggguuuaggcuggcccagcacauccuguccuccugagcucgc

SEQ ID NO: 207785 - RNA, 61 nt, Human
agccaaacucuugaagcacccccugggucaggcccagcagcggaguggccagccccaguuu

SEQ ID NO: 207786 - RNA, 61 nt, Human
cauccuuuguuccuccaccccugaccaaggugcccagcagccugucuucaccagucaagga

SEQ ID NO: 207787 - RNA, 61 nt, Human
gaacagcccuccugcacccaggcuggcgacagcccagcagugcccacacaggacugggccc

SEQ ID NO: 207788 - RNA, 61 nt, Human
agcaucuccagcaggacuccaggaugguucagcccagcaccauccaaagggugggagcaca

SEQ ID NO: 207789 - RNA, 61 nt, Human
cuaaauauucuagaacuuucccagccucguagcccagcacuucucaaacuuggaaaugcau

SEQ ID NO: 207790 - RNA, 61 nt, Human
ggcccuaacccuuggcuccaggagacacagggcccagcacccagguugcugucggcaggcu

SEQ ID NO: 207791 - RNA, 61 nt, Human
cgggucuccucccagcggccuccggcgucuugcccagcagcucaagaagaaaaagaaggac

SEQ ID NO: 207792 - RNA, 61 nt, Human
cucccccggcaggcaauguccuggcuucucagcccagcaccaucuguuccccuagacuucu

SEQ ID NO: 207793 - RNA, 61 nt, Human
gcagcuugugcucugcccagcagugccccuggcccagcaccucagccugcucuucucucug

SEQ ID NO: 207794 - RNA, 61 nt, Human
caaugcucccagguccugcagcuugugcucugcccagcagugccccuggcccagcaccuca

SEQ ID NO: 207795 - RNA, 61 nt, Human
caggcaucccgggcacauccacaagcugcuggcccagcagcuggucuccccagugaagugg

SEQ ID NO: 207796 - RNA, 61 nt, Human
aaaggcaccuggaagguuuccauguggcccagcccagcauggaagcagggugggaacucug

SEQ ID NO: 207797 - RNA, 61 nt, Human
cugcucuuccagacuggcugugccugccugugcccagcaaccugugcagccggcagugugc

SEQ ID NO: 207798 - RNA, 56 nt, Human; identical to SEQ ID NO: 22564

SEQ ID NO: 207799 - RNA, 61 nt, Human
ggcccacaguuuuugagggucaggaguccaggcccagcauaacuggguccucugcucaggg

SEQ ID NO: 207800 - RNA, 61 nt, Human
uuggggccacugaggcguggcgcccguggcugcccagcaccuucuucgacccaucucaccc

SEQ ID NO: 207801 - RNA, 61 nt, Human
cacugaauauugagaaaguuucuuuucaugugcccagcagguuaaguagcguuuucagaau

SEQ ID NO: 207802 - RNA, 61 nt, Human
agaauucuagucuucguguuagauguuuauagcccagcaucuugggaccuuuccaguuacu

SEQ ID NO: 207803 - RNA, 61 nt, Human
cucagguucagcuggacucugccaucugugggcccagcaucacucuguaaguuccuugaaa

SEQ ID NO: 207804 - RNA, 61 nt, Human
guacugucccggaggagguugggagguggaggcccagcaucccgcgcagaugacaccauca

SEQ ID NO: 207805 - RNA, 61 nt, Human
ugggggcacagggugcaaagccaggcacugugcccagcagugggcucccugccugccaccu

SEQ ID NO: 207806 - RNA, 61 nt, Human
ccuuaagugaagaaagagucaaugagauuuugcccagcacauggagcuguaauccagagag

SEQ ID NO: 207807 - RNA, 61 nt, Human
ccugugacuccuuaauaaggaccugugacaugcccagcaucaagggauaagaccguaaauu

SEQ ID NO: 207808 - RNA, 61 nt, Human
agccaggccccaccccuucccuauaggaacagcccagcacagguauuucaggugugaaaga

SEQ ID NO: 207809 - RNA, 61 nt, Human
cuacguaagccucuuuggcaaggguccuggugcccagcacccaggcuaaaauauccugucu

SEQ ID NO: 207810 - RNA, 61 nt, Human
cuuccauuaagccucggcugagugagggaaagcccagcacugcugcccucucggguaacuc

SEQ ID NO: 207811 - RNA, 59 nt, Human; identical to SEQ ID NO: 22577

SEQ ID NO: 207812 - RNA, 61 nt, Human
ugcaggaaaacuaccuggaguaccggcaggugcccagcagugaucccauaugcuaugaguu

SEQ ID NO: 207813 - RNA, 61 nt, Human
uccagccucugaagacaguugaggagaucaagcccagcaaugguggcagaaucuuacucca

SEQ ID NO: 207814 - RNA, 61 nt, Human
cuuugaauauugagaaaguuucuuuucaugugcccagcagguuaaguagcguuuucagaau

SEQ ID NO: 207815 - RNA, 61 nt, Human
aggcuucacucaggguagagaaacaagcaaagcccagcagcgcacagggugcuuguuaucc

SEQ ID NO: 207816 - RNA, 62 nt, Human
cuuccuccgggugaccccacagggccuuuccaagcccccauuugagcugcuccuuccugugu

SEQ ID NO: 207817 - RNA, 62 nt, Human
ucgcaccugcccuccgcugcuccucagaccccagcccccagcgagccgacguccccacccgu

SEQ ID NO: 207818 - RNA, 62 nt, Human
aagccaugggccagcaauaccugcuuuucugaagcccccaaggagggcucugacauucuuuu

SEQ ID NO: 207819 - RNA, 59 nt, Human
ucgggcccccgcugcccugacacccccugagcccccaucugcugaacccugacugguaa

SEQ ID NO: 207820 - RNA, 62 nt, Human
gcccggcccccucuggcuuggagagcauuccaagcccccaccccaccccuagaacugccauu

SEQ ID NO: 207821 - RNA, 62 nt, Human
agcucagggauugccugaaccaagaggccaggagcccccaugggccgcccaguaccaugcac

SEQ ID NO: 207822 - RNA, 62 nt, Human
gccucguucugcgaggggcucaugggucugagagcccccacccacuaggcuugauugcaucc

SEQ ID NO: 207823 - RNA, 62 nt, Human
ccucauucuucccuggccucuuucccacccacagcccccagaggcucuagaucaacaauguu

SEQ ID NO: 207824 - RNA, 53 nt, Human
ccaucuacacagacaccugaaggagcccccacaugcgccugcccauccagcac

SEQ ID NO: 207825 - RNA, 56 nt, Human
ugaaagagaagaggagguaggggccaagcccccaccccaucccacuccccuucccu

SEQ ID NO: 207826 - RNA, 56 nt, Human
ugaugggggaucgcaauuaaggagcaagcccccauuuucacccgauccugggcucu

SEQ ID NO: 207827 - RNA, 62 nt, Human
auauuccaaaagggacuuuacauuaaaggagaagcccccaagauguggccacccuuaaccau

SEQ ID NO: 207828 - RNA, 62 nt, Human
uuaaggucuugaagucaggcugcccccuccccagcccccaguucucuccccacccccucacc

SEQ ID NO: 207829 - RNA, 62 nt, Human
auugagaagccaaucagugaacccuuuggcaaagcccccauccacaccuggcacuccccucu

SEQ ID NO: 207830 - RNA, 62 nt, Human
gaccaauuuaguguccuuccaccugugagccaagcccccauuugaggacaucuaucguauuc

SEQ ID NO: 207831 - RNA, 62 nt, Human
acucugccacucuacccccagcccuacccaccagcccccaggugaggcuuccagcugggacc

SEQ ID NO: 207832 - RNA, 62 nt, Human
cugcccccuccccacaccaaucagccaggcugagcccccaccccugccccagcuccaggacc

SEQ ID NO: 207833 - RNA, 62 nt, Human
gccugggagccgcgggcaggcgagacuggcggagcccccagaccucccaguggggacggggc

SEQ ID NO: 207834 - RNA, 62 nt, Human
ggaggcaggucccaggagcagacccugcccccagcccccacagacacaccccaaucugaaag

SEQ ID NO: 207835 - RNA, 62 nt, Human
agagggaaggagggaggaggcaucuucccugaagcccccaaucuggccccccccuccccaga

SEQ ID NO: 207836 - RNA, 62 nt, Human
guuguccccgccaggccggggaagguuggagcagcccccagggaggggggcacuagguguca

SEQ ID NO: 207837 - RNA, 62 nt, Human
gggggaguaguggggcacggcuccuaagauccagcccccauacugacagacggacagacaga

SEQ ID NO: 207838 - RNA, 62 nt, Human
ccucuuaccacacuuuaccaguuaaccacugaagcccccaauucccacagcuuuuccauuaa

SEQ ID NO: 207839 - RNA, 62 nt, Human
caugggagaccccaacccagcugacaauguggagcccccagaacuucagaacuguguggagg

SEQ ID NO: 207840 - RNA, 62 nt, Human
ucuccccaccagcaccauggcuggcaucgcucagcccccagcccaauugccaucaagacucc

SEQ ID NO: 207841 - RNA, 62 nt, Human
gcacuccaaaccugucuuggggccacuuucagagcccccagcccugggaaccacucccacca

SEQ ID NO: 207842 - RNA, 62 nt, Human
uaaguggacugugccaguacaauacaugccucagcccccaagccuagaaggaccucuagucu

SEQ ID NO: 207843 - RNA, 64 nt, Human
uggucguccucgcgcgccucucccuaccacgggugcucgggacggcugggcgccagcuccgggg

SEQ ID NO: 207844 - RNA, 64 nt, Human; identical to SEQ ID NO: 6145

SEQ ID NO: 207845 - RNA, 64 nt, Human; identical to SEQ ID NO: 6149

SEQ ID NO: 207846 - RNA, 64 nt, Human; identical to SEQ ID NO: 6154

SEQ ID NO: 207847 - RNA, 62 nt, Human
guacaaagcucaccaagccccugcccauguacagcccccagacccucugcaauaucacuuuu

SEQ ID NO: 207848 - RNA, 62 nt, Human
acuuuaccucucugaaagccccagaggaccagagcccccagccuuaccucucaaccuguccc

SEQ ID NO: 207849 - RNA, 62 nt, Human
cugauacuaauggagcuucaugacccacggucagcccccaaaccaaaguugucccaacagag

SEQ ID NO: 207850 - RNA, 62 nt, Human
ggcauccaaagcggccacgcccacaauccgacagcccccaggagcagguccagggaugaugc

SEQ ID NO: 207851 - RNA, 62 nt, Human
aaacagggcuauuagggguaucagccacgucgagcccccagacucugugcacuucagaccag

SEQ ID NO: 207852 - RNA, 62 nt, Human
gggaccaggugucuagaggcaacaguguucugagcccccaccugccugaccaucccaugagc

SEQ ID NO: 207853 - RNA, 62 nt, Human
ugugucugcccccgucuucucuccauccucaaagcccccacuucucuccaggcuguuucuuu

SEQ ID NO: 207854 - RNA, 62 nt, Human
acuggcacugcgaucaggaagacuggacccccagcccccagggccccccuccccccacuuag

SEQ ID NO: 207855 - RNA, 62 nt, Human
gcccuaccuggggaaagccugaagggccucccagcccccaaccccaagaccaagcuuagucc

SEQ ID NO: 207856 - RNA, 62 nt, Human
cuguggagugcaggccagagcagggugugcguagcccccagcacccagguucuucugucaga

SEQ ID NO: 207857 - RNA, 62 nt, Human
ucuuccacaggauuugagaauaguuucaucucagcccccauuagagagaaguuggggugaau

SEQ ID NO: 207858 - RNA, 62 nt, Human
acaccccucucccaggggcuugguggcagcauagcccccaccccugcggccuuugcucacgg

SEQ ID NO: 207859 - RNA, 62 nt, Human
gcccucgggggccucucccaggguccagccugagcccccaccaggggucucugcccagcaca

SEQ ID NO: 207860 - RNA, 62 nt, Human
gcagaaccagcugcaacagcugcgugcacaggagcccccaggcagucagcagccccugcaga

SEQ ID NO: 207861 - RNA, 62 nt, Human
acagcugcagcugggccccaugcucugccccaagcccccaaccccgcggugcucuggcggcu

SEQ ID NO: 207862 - RNA, 62 nt, Human
ccagcugggggaugggggggagucauaggaaaagcccccaucucccaucugggauagggacc

SEQ ID NO: 207863 - RNA, 64 nt, Human; identical to SEQ ID NO: 6160

SEQ ID NO: 207864 - RNA, 64 nt, Human; identical to SEQ ID NO: 6164

SEQ ID NO: 207865 - RNA, 64 nt, Human; identical to SEQ ID NO: 6168

SEQ ID NO: 207866 - RNA, 64 nt, Human; identical to SEQ ID NO: 6173

SEQ ID NO: 207867 - RNA, 62 nt, Human
caacagcuccaggacaucucagcccagguucuagcccccacgcaccccagaccccaggugga

SEQ ID NO: 207868 - RNA, 62 nt, Human
cccuaccuuggaccaucccgcguagggguggcagcccccagcuccccucagugcugcuguca

SEQ ID NO: 207869 - RNA, 62 nt, Human
ggccaaggcagacauuggcccucccuucucccagcccccagaggccuggccuuggguucguc

SEQ ID NO: 207870 - RNA, 62 nt, Human
acugcccccacugucccccuacccaccgauggagcccccagauagagcuggguggccuguuu

SEQ ID NO: 207871 - RNA, 62 nt, Human
ugugguucccacaggaacaggguugucuuuugagcccccagugucugguuucauucaucuca

SEQ ID NO: 207872 - RNA, 62 nt, Human
cccucccccuaccgcauggcagcugggcccacagcccccaccccagcacagcuccuccccug

SEQ ID NO: 207873 - RNA, 62 nt, Human
guccuugccaauccccagagcuguucuuccaaagcccccaggcuggcuuagaaccccauaga

SEQ ID NO: 207874 - RNA, 62 nt, Human
gguggcgaguguggacacccugccaggacugcagcccccauggugaugcuguggcaucagac

SEQ ID NO: 207875 - RNA, 62 nt, Human
gacaggagccaggguugagcaauggagagcccagcccccacgucuuacagucgccauccucc

SEQ ID NO: 207876 - RNA, 62 nt, Human
caggcauuaggacuguccugagcaaggucugcagcccccagcucugcucaccccgaauccug

SEQ ID NO: 207877 - RNA, 60 nt, Human
ucaacagugcagcccagugacaccucugaaagcccccauucccugagaauccuguuguua

SEQ ID NO: 207878 - RNA, 62 nt, Human
uucuggaggcugcgagagcagcuggcacugucagcccccagcagggaacacguuacaggguc

SEQ ID NO: 207879 - RNA, 62 nt, Human
aagccauucccaguuugagucuucauccuguaagcccccaggggcagucccugcuuuacuga

SEQ ID NO: 207880 - RNA, 62 nt, Human
ccuggugagccuuccccuggugucugccuggcagcccccaccucccaccuaucaccccucac

SEQ ID NO: 207881 - RNA, 62 nt, Human
cacucagguucuucagggccaguccuccugggagcccccaccacaaacuucugcuggggauu

SEQ ID NO: 207882 - RNA, 62 nt, Human
agaaaaagaucaguaagccccaguguccccccagcccccaugcuuaugugaacaugcgcugu

SEQ ID NO: 207883 - RNA, 64 nt, Human; identical to SEQ ID NO: 6178

SEQ ID NO: 207884 - RNA, 64 nt, Human; identical to SEQ ID NO: 6183

SEQ ID NO: 207885 - RNA, 62 nt, Human
ccagccacaggcaccagcugguugggaccagcagcccccagcauccucuugcacuggcuggc

SEQ ID NO: 207886 - RNA, 62 nt, Human
uucaguggaacccuugcccccaaaugucgaccagcccccaaaugucgaagaauuuucuucuu

SEQ ID NO: 207887 - RNA, 62 nt, Human
gucuuuguucagaagggaucagguuggggggcagcccccagucccuuucugucccagcucag

SEQ ID NO: 207888 - RNA, 62 nt, Human
ucacagccuguagccaccaauguuucaagaggagcccccacccuguuccugcugcugucugg

SEQ ID NO: 207889 - RNA, 62 nt, Human
acugggcuuaugccuuacucucagggacaagcagcccccauugcugccuguagaugugagcu

SEQ ID NO: 207890 - RNA, 62 nt, Human
gcuuucuucccauuccccugcugucuauucuaagcccccagacucaagccucuagacucuug

SEQ ID NO: 207891 - RNA, 62 nt, Human
guaggucaugaacagucacccgugcuggcuguagcccccacagaggcaaucaugcccaauag

SEQ ID NO: 207892 - RNA, 62 nt, Human
aaagugcgguuucccaagccuuuguccaucucagcccccagaguauaucugugcuuggggaa

SEQ ID NO: 207893 - RNA, 62 nt, Human
ccagccucccgcucugggcgagccuccuccccagcccccaccccugggaugcgaagccagca

SEQ ID NO: 207894 - RNA, 62 nt, Human
uuugucugccauucuugaaagugcaucuugagagcccccauuuguuguguagagauauagca

SEQ ID NO: 207895 - RNA, 62 nt, Human
gcgggagagcagcugguccagaccagcccugcagcccccacucagccggcagccagauggcc

SEQ ID NO: 207896 - RNA, 62 nt, Human
uggcuaggugucucucacggcugcuccauccuagcccccacaagcuggggcuuccuccugua

SEQ ID NO: 207897 - RNA, 62 nt, Human
gaagguuuuacaagaagacugauagucuuucaagcccccacaucacaggcuuagggacggca

SEQ ID NO: 207898 - RNA, 62 nt, Human
agagaggaggcgcaggcaggccccugcccggcagcccccaucuucaagggcugcuucuacac

SEQ ID NO: 207899 - RNA, 62 nt, Human
uuccccugugaagaaacagguguucucggcugagcccccaacccucugcagaaccagguuga

SEQ ID NO: 207900 - RNA, 62 nt, Human
agaccagugcagccagagagaccaccaaacagagcccccaaaagacagacaucucugcuagc

SEQ ID NO: 207901 - RNA, 63 nt, Human
uaaauguguggguuauguugcagcuguugcagucccccagauaccuauuauuuuacacaauuu

SEQ ID NO: 207902 - RNA, 63 nt, Human
gggcaccagaaggcuccuggaccaugagcuucacccccagaauucccugcugacccugcccca

SEQ ID NO: 207903 - RNA, 63 nt, Human
cccuacccauuuggcucuggaagcugcuuggcccccccagaucagggccugggugaacucccu

SEQ ID NO: 207904 - RNA, 63 nt, Human; identical to SEQ ID NO: 89888

SEQ ID NO: 207905 - RNA, 62 nt, Human
acggacgccuauccagaagccagccggcuggcagcccccaucugcucaauaucacugcucug

SEQ ID NO: 207906 - RNA, 62 nt, Human
ccacugguucuucuuggucucagugucaaugcagcccccauuguggucacaggaaguagagg

SEQ ID NO: 207907 - RNA, 62 nt, Human
acccgucccagccuccccuccccaccccaugcagcccccagggggauagcccaugggccccu

SEQ ID NO: 207908 - RNA, 62 nt, Human
aggcugguuauaagccggaggcagcuuuaaccagcccccagggaugauugugaaggaggccc

SEQ ID NO: 207909 - RNA, 62 nt, Human
ugggccuccucaccaacggcagugccaaaaucagcccccacaucaaggugguguucucugug

SEQ ID NO: 207910 - RNA, 62 nt, Human
uggaaccugacuuuagauguuuugggaucaggagcccccaacacaggcaaguccaccccaua

SEQ ID NO: 207911 - RNA, 62 nt, Human
cucgagugccaucccugccaaacaacucucccagcccccacuaccucucuguguacugccgc

SEQ ID NO: 207912 - RNA, 62 nt, Human
cgcuguuuccaauggcucaggagacaaugaaaagcccccauuuaaaaaaauaacaaacauuu

SEQ ID NO: 207913 - RNA, 62 nt, Human
gagugaagaggaaggggucucuggucaaacccagcccccagggccuaggguugaaagccuuc

SEQ ID NO: 207914 - RNA, 62 nt, Human
gccgcucugcccgaugcacagccaccucagccagcccccagguagaaacguggguuaagcuc

SEQ ID NO: 207915 - RNA, 62 nt, Human
cucuccuaggccacagggccuuuggcaggugcagcccccacugccuuugaccugccucccuu

SEQ ID NO: 207916 - RNA, 62 nt, Human
aaaauauucuucugaacucaucaaaguagaagagcccccaaccuuuucucucugccuucaag

SEQ ID NO: 207917 - RNA, 62 nt, Human
uggcagggcugcuaccuccucagaguuucagaagcccccacaugggggcucuaggaaugccg

SEQ ID NO: 207918 - RNA, 62 nt, Human
ugcugaaaaagacaaaauugaagaagaaauguagcccccagccgguacccaccaaaggagag

SEQ ID NO: 207919 - RNA, 62 nt, Human
caccccaucugaggcagagaagacucgaguccagcccccaggaagccugcuccccucucugg

SEQ ID NO: 207920 - RNA, 62 nt, Human
ucuggcugcccccaaugccccgaggccuggggagcccccagcucacccaucuguagcucccu

SEQ ID NO: 207921 - RNA, 63 nt, Human
cugcccuuccucacccccacgccccaccccacucccccagaguacuccccacugugaaaagag

SEQ ID NO: 207922 - RNA, 63 nt, Human
ccuggaaaugugcuaaaguuggaaaguccccgucccccagaaccucaagucuagaaaccagua

SEQ ID NO: 207923 - RNA, 63 nt, Human
aacagggcuauuagggguaucagccacgucgagcccccagacucugugcacuucagaccagca

SEQ ID NO: 207924 - RNA, 63 nt, Human
aguaaugggguguggggugccaccagaccaacacccccagacuuccccaccuucagccaccau

SEQ ID NO: 207925 - RNA, 62 nt, Human
cuucuuuccuuccugcaguucccagcccucggagcccccaucccuuaucuuacccccaccgc

SEQ ID NO: 207926 - RNA, 62 nt, Human
uccucccaugagguggggagaggcaacagggcagcccccagaggaguguccuggccgcuguc

SEQ ID NO: 207927 - RNA, 62 nt, Human
guuauuacugguggaugcaccguguccacagcagcccccaaucccagcgaugcgucagaucu

SEQ ID NO: 207928 - RNA, 62 nt, Human
ucugugcaaagcaucagaaagaccugcuucccagcccccagcauuccagugcucuccaggcu

SEQ ID NO: 207929 - RNA, 62 nt, Human
cccguuucucccucaaguuugaguauuucgggagcccccaaaacagccugagcaaaaagacc

SEQ ID NO: 207930 - RNA, 62 nt, Human
caccuccugagcucaagugauccucccaucuaagcccccaaguagcuaggacuacaggagca

SEQ ID NO: 207931 - RNA, 62 nt, Human
caagaucaacagcuccuucuccaaacaacucaagcccccaauucccaucgcauuccauuugg

SEQ ID NO: 207932 - RNA, 62 nt, Human
gcgggaggccgggaggaggguggggaccuugcagcccccauccucuccgugcgcuuggagcc

SEQ ID NO: 207933 - RNA, 62 nt, Human
cgccagguuuccuggagcucuuggcuucagccagcccccagccagaguccuggcuaggacag

SEQ ID NO: 207934 - RNA, 62 nt, Human
ggccagaggagccagggacuauuuucugcaccagcccccagggcugccaccccuguuguguc

SEQ ID NO: 207935 - RNA, 62 nt, Human
cuaaauaucacuugcucugccacugcccgcccagcccccauggucuucuggaaggucccucg

SEQ ID NO: 207936 - RNA, 62 nt, Human
gagaggugagaccuuuaaggguuacuaggcagagcccccaugaauggauuaaugccauuauu

SEQ ID NO: 207937 - RNA, 62 nt, Human
gggaugagcccccuccccccaaugcacaagccagcccccaagacccuggggguggacaccac

SEQ ID NO: 207938 - RNA, 62 nt, Human
cucccagucucucccugcaguccugcagcagcagcccccacccccaagcuuggugcugagcc

SEQ ID NO: 207939 - RNA, 62 nt, Human
uccuccagccccugcacacucccacccaggacagcccccagcccaacuaggaaagggccaug

SEQ ID NO: 207940 - RNA, 62 nt, Human
ccagccucuuggcaccuccuguuuacuccccgagcccccagauucucaccuuugcccagagc

SEQ ID NO: 207941 - RNA, 63 nt, Human
agggcaucucauccagggauucucaaaccaugucccccagaggccuugggcugcaguugcagg

SEQ ID NO: 207942 - RNA, 63 nt, Human
cccaucagguuaaagacuucaucuagaugaugccccccagagaugccuuuaguguaaguagcu

SEQ ID NO: 207943 - RNA, 63 nt, Human
ugccaagaggaggugugaugacagcuauggaggcccccagaucucucucuccuggaggcuuua

SEQ ID NO: 207944 - RNA, 63 nt, Human
cuuucuucccauuccccugcugucuauucuaagcccccagacucaagccucuagacucuugga

SEQ ID NO: 207945 - RNA, 62 nt, Human
gccaagaauuucgggcuguuugacuuucugugagcccccagcgaggggaggcccagccuccg

SEQ ID NO: 207946 - RNA, 62 nt, Human
cagcagccccucagggcuucccaaggauguccagcccccacacccacacguuaacauaauga

SEQ ID NO: 207947 - RNA, 62 nt, Human
cucugcuuugggggugccccugccuccagcagagcccccaccauucacugugacaucuuucc

SEQ ID NO: 207948 - RNA, 62 nt, Human
uccaauggcaguguccuguuugagcacccugcagcccccacccaagauggccuggugagaug

SEQ ID NO: 207949 - RNA, 62 nt, Human
uuccugggccaacuaaccagacaacugggaagagcccccaacuccaacaggauuauuuuccc

SEQ ID NO: 207950 - RNA, 62 nt, Human
ucuugaagccacacauggcuggcggaacccagagcccccaccccagcccaccuggcucuuug

SEQ ID NO: 207951 - RNA, 62 nt, Human
uuaagggcuccuugauggaugccaucucuccuagcccccagcccuggugccacuggugggca

SEQ ID NO: 207952 - RNA, 62 nt, Human
gggguggacaaacuggagucuggagugggcagagcccccaggaagcccaggagggcauccau

SEQ ID NO: 207953 - RNA, 62 nt, Human
cuuaaauccuagcaggagagaggcucuggggcagcccccaugggcuccugccccuuucaggc

SEQ ID NO: 207954 - RNA, 62 nt, Human
gguguagauaaucuagaggcauagacugcuagagcccccagggaucugggguggucagggcu

SEQ ID NO: 207955 - RNA, 62 nt, Human
gguggucaggaugggcuggggggcccacuagcagcccccagcaucucccacccacccagcua

SEQ ID NO: 207956 - RNA, 62 nt, Human
uuucugcuuuagcguaauugcucagaguagagagcccccacaaaguuauuuaaaagaugccc

SEQ ID NO: 207957 - RNA, 62 nt, Human
caaggucugugggcucuaggcagcccggcagcagcccccagaggaacugcucccaccucucc

SEQ ID NO: 207958 - RNA, 62 nt, Human
gagcuacaagagucaaauaguccucugaauggagcccccaucacaaaacagugcccaggagg

SEQ ID NO: 207959 - RNA, 62 nt, Human
ugaaaaagaagaaaaacaauaaaguaaaccugagcccccacgucccaauuuuuuuaauagau

SEQ ID NO: 207960 - RNA, 62 nt, Human
caaagugaagaugacaguccuugcucucagggagcccccacuuuaaugggagacugauaaac

SEQ ID NO: 207961 - RNA, 55 nt, Human
aggccgaagaggaggccuaaggcagagcccccaucaccucaggcuucucaguucc

SEQ ID NO: 207962 - RNA, 63 nt, Human
ugaagugauccuuaacccccaaguaaucauuaacccccagaccagccucagaacugaaggaga

SEQ ID NO: 207963 - RNA, 63 nt, Human
cccacaaccggccaaguuaugucuuauuauacacccccagaaagagagaaagcugccuucugg

SEQ ID NO: 207964 - RNA, 62 nt, Human
ugucuacauguuugcuuagaggcggcuccaagagcccccagagcugccugcauagcacaccu

SEQ ID NO: 207965 - RNA, 62 nt, Human
cuagcuuuuagcuauaaaccacucaaagauucagcccccagaucccacagucagaacugaau

SEQ ID NO: 207966 - RNA, 62 nt, Human
gcgauggcuacaagggcuacgaccuggucuacagcccccagagcggcuucaccugcgugucc

SEQ ID NO: 207967 - RNA, 62 nt, Human
cacgggcccagugcugccccugcugcugcaggagcccccaggcgagguucggccuuccucuc

SEQ ID NO: 207968 - RNA, 62 nt, Human
cguggggccaugacucucugggaccuugccacagcccccauuccccugcuugcagucugcaa

SEQ ID NO: 207969 - RNA, 62 nt, Human
agggucaaauucaacauuauccugaucuagacagcccccauucucaauccacccuuuuccaa

SEQ ID NO: 207970 - RNA, 62 nt, Human
aauaaaugggggaauagguaguuuccugguuuagcccccaucuagucaggaauuaauauacu

SEQ ID NO: 207971 - RNA, 62 nt, Human
aggaaacaaagcaauagguuugggggacgcccagcccccacccccgucaccccgcucuuccc

SEQ ID NO: 207972 - RNA, 62 nt, Human
ccgcggaggccccugagggacgagcagagcgcagcccccacgccgauauaagccauagcccc

SEQ ID NO: 207973 - RNA, 62 nt, Human
cgggaggugggggaacaaggggucuuccgagcagcccccagcccuccccucccaucugugcc

SEQ ID NO: 207974 - RNA, 62 nt, Human
ccagcccuggacugaggauggaugguuccaugagcccccagaugaaaaccuggauucgacag

SEQ ID NO: 207975 - RNA, 62 nt, Human
uuccauuccugaguuacuucccuuaggauaacagcccccaguuccguccaaguugcugcaaa

SEQ ID NO: 207976 - RNA, 62 nt, Human
gcagcugccggcugugugcccauggggagcccagcccccaccccccaccuccgacagcaaac

SEQ ID NO: 207977 - RNA, 62 nt, Human
ccuacuucuuauaaugcagaguuaaggagcugagcccccaugauuuuguagcuguacuuuug

SEQ ID NO: 207978 - RNA, 62 nt, Human
cuacuuuuugcaccuuauuuucucuguuccugagcccccacauucucuaggagaaacuuaga

SEQ ID NO: 207979 - RNA, 62 nt, Human
acccccgccaggcugcccaucagggcccagggagcccccagaggacuuuauucggaccaagc

SEQ ID NO: 207980 - RNA, 63 nt, Human
acuucgagaguagcccugucuuguccccuccuacccccagauuagcaccaccccucucacucu

SEQ ID NO: 207981 - RNA, 60 nt, Human; identical to SEQ ID NO: 89940

SEQ ID NO: 207982 - RNA, 63 nt, Human
caccuuugcugggcuuuucuaucacucccaccucccccagagucagggcuccauugcugagug

SEQ ID NO: 207983 - RNA, 63 nt, Human
cagggcagggcccgugccuuagacuucucccgacccccagagcgcugguacacaggucuaggc

SEQ ID NO: 207984 - RNA, 62 nt, Human
aguaacccuaggcucagagacccaauuuuuuaagcccccagacuccuuagcccucagagccg

SEQ ID NO: 207985 - RNA, 63 nt, Human
gggcccggagcaggguggggaggugcaguggcacccccagagccaacagagggagcaggcaga

SEQ ID NO: 207986 - RNA, 63 nt, Human
agugcuggaaaugcagccacuggcagaucuggccccccagacgucaccgcagggccucugaag

SEQ ID NO: 207987 - RNA, 63 nt, Human
auuuaaaacaaaacaacacaaaaaaacaaugugcccccagaugucagaaugaggcgacuaggg

SEQ ID NO: 207988 - RNA, 63 nt, Human
ucauacugguuuaauuaagcucucuccugacaacccccagaauuaaaugaaccaugauuguga

SEQ ID NO: 207989 - RNA, 63 nt, Human
gauucccaaauacauagcuccaacccccaacuucccccagacuuuagaucuguauugguauua

SEQ ID NO: 207990 - RNA, 63 nt, Human
acauaucaaaauaggauuucuuaaauuuuucaacccccagaccauacugacucaacauggagu

SEQ ID NO: 207991 - RNA, 63 nt, Human
ugugaauuugcacaccacugccugaauuggagccccccagagugucccucuacccagaguuuu

SEQ ID NO: 207992 - RNA, 63 nt, Human
cccgcacaugggggucgcugcccuucacuccuacccccagaggccuuggccaagcugcugcuu

SEQ ID NO: 207993 - RNA, 63 nt, Human
cagcucugccucgcagcccccucagcaugggugcccccagaaguaagcagcucuuggacccac

SEQ ID NO: 207994 - RNA, 63 nt, Human
ggggcugagucuucccuggccccuuggaagaggcccccagaugcccaggcucacuucaguguu

SEQ ID NO: 207995 - RNA, 63 nt, Human
cgauggcuacaagggcuacgaccuggucuacagcccccagagcggcuucaccugcgugucccc

SEQ ID NO: 207996 - RNA, 63 nt, Human
uacaccucagcaaaugcugcaaaauccuguuuucccccagagagcuggagguuaaauacuacc

SEQ ID NO: 207997 - RNA, 63 nt, Human
cagcccuggacugaggauggaugguuccaugagcccccagaugaaaaccuggauucgacaggg

SEQ ID NO: 207998 - RNA, 63 nt, Human
uaaauaaccuacagcuugggucuauggcugugacccccagauucauggaggggcuuuagccau

SEQ ID NO: 207999 - RNA, 63 nt, Human
acccacugaacacuaauuaugagcccugucuuucccccagaaugccucccuggguuucacaaa

SEQ ID NO: 208000 - RNA, 63 nt, Human
cagggaaggaggcuggggugggaacacuggccucccccagaauaaaaccauguuuucuaccag

SEQ ID NO: 208001 - RNA, 63 nt, Human
agugagggaaugguaguuaaggcuucuuuuuugcccccagauacauggugaugguuagcauau

SEQ ID NO: 208002 - RNA, 63 nt, Human
agcaccaaaaggcagaagguggaagccguuuuucccccagagcccuguguuuuugugaaagcc

SEQ ID NO: 208003 - RNA, 63 nt, Human
aggugaaccagggaggggcagggcaaggcagggcccccagagcugggccacacagugggugcu

SEQ ID NO: 208004 - RNA, 63 nt, Human
auagucacauguuuuucuuccuuguccccacggcccccagaacaacauucucccugcuggcag

SEQ ID NO: 208005 - RNA, 62 nt, Human
cucaggggccuguggcugaagaaaaggugcccagcccccaccacuccucagcugccccccaa

SEQ ID NO: 208006 - RNA, 62 nt, Human
uugcuggcauuaaaaauaagcacacuuacauaagcccccauacauagagugggacucuugga

SEQ ID NO: 208007 - RNA, 62 nt, Human
ucugacccauuaggcuaaagagagacaagagaagcccccaaccugauucucaugacagcucc

SEQ ID NO: 208008 - RNA, 62 nt, Human
uaagcagauacucuccauuccuuccuuccuccagcccccagcaaccaccaaucugcuuucug

SEQ ID NO: 208009 - RNA, 62 nt, Human
agucagaaggcuggggcagaucacuucaagcaagcccccaugaugguucucaguccugcuuc

SEQ ID NO: 208010 - RNA, 62 nt, Human
gugaaggagacacuacugcccccaccccugacagcccccaccccauggcuuccaucuuuugc

SEQ ID NO: 208011 - RNA, 62 nt, Human
ccacggacguggcuuggugcugaggauagcagagcccccagccaucacugcuggcagccugg

SEQ ID NO: 208012 - RNA, 62 nt, Human
ggaucuagaucuuuccuccuugacaucaccugagcccccaccuagccauccaugggagagag

SEQ ID NO: 208013 - RNA, 62 nt, Human
gacuccugagaacacgguucucuccuagccucagcccccagcugggucucagaggagcuggg

SEQ ID NO: 208014 - RNA, 62 nt, Human
uguggauuauuacagugaagugccuggcccggagcccccagugaugaagcaggaacuugagu

SEQ ID NO: 208015 - RNA, 62 nt, Human
gugugcggugcccaggcccuaggagcucccccagcccccagguccuccugaccacuccccuc

SEQ ID NO: 208016 - RNA, 62 nt, Human
ccucugaugcugucugcagcucagucccugccagcccccaggagcgccuccagggccccgcc

SEQ ID NO: 208017 - RNA, 62 nt, Human
cucagccaccaaaugucccugacacccuccccagcccccacagauaacaucagcugagguuu

SEQ ID NO: 208018 - RNA, 62 nt, Human
gcagccaccgcccaguuccaguggccccacgaagcccccaguggcuggcuguccagcugggc

SEQ ID NO: 208019 - RNA, 62 nt, Human
ggggcaucuggcuggugccugcugccauggccagcccccacucucacccugcacaggggguc

SEQ ID NO: 208020 - RNA, 62 nt, Human
cccccacucucacccugcacagggggucuugcagcccccaggcccacagccucguugggagg

SEQ ID NO: 208021 - RNA, 63 nt, Human
gagauaaaaacaccuuuggggacugguuaaagucccccagaaacuacaauaaagaacaacuuu

SEQ ID NO: 208022 - RNA, 63 nt, Human
ugcuucccaucugaagaguggaaauggggaacucccccagagguggauacuggggggcaggcc

SEQ ID NO: 208023 - RNA, 63 nt, Human
acaaauuugauuucaaagagcaaugcaucuucucccccagaucaucacagaaaucacuuucag

SEQ ID NO: 208024 - RNA, 63 nt, Human
gccagcggaacaguuucuauuacccccucccugcccccagacccaugugauuucugcuuucuu

SEQ ID NO: 208025 - RNA, 62 nt, Human
cuugauugagguagcaugaaggaugaggcuucagcccccauugucuuauguagaauguggca

SEQ ID NO: 208026 - RNA, 62 nt, Human
guggggcccugacaccacguuaucaaacaugcagcccccacaccccucgucugcccgccccc

SEQ ID NO: 208027 - RNA, 62 nt, Human
agacuccucugggccuggggugcauccuccucagcccccaggccaggugagguccaccggcc

SEQ ID NO: 208028 - RNA, 62 nt, Human
ucugccuaguggaaaugagccacccccacugcagcccccaccuuuguguccuagagcucagc

SEQ ID NO: 208029 - RNA, 62 nt, Human
ccagagcaccucccagccaccguccccucaagagcccccagaacgagacccuguacucuguc

SEQ ID NO: 208030 - RNA, 62 nt, Human
ggucacaucaggcccgcuagguccagagagcgagcccccaaugcccggccaggcuaagccgc

SEQ ID NO: 208031 - RNA, 62 nt, Human
gcccggccaggcuaagccgcagagacccucucagcccccaccucagguuagggcucugcccg

SEQ ID NO: 208032 - RNA, 62 nt, Human
cccuugaaucccaaaagugccuccccagccucagcccccaccuccagccacacacacauuac

SEQ ID NO: 208033 - RNA, 50 nt, Human
ccauagcugccaacagcuaaagcccccaguaucucuucagucucuauacc

SEQ ID NO: 208034 - RNA, 62 nt, Human
ugggagccucgcccuuugucccaacuggguagagcccccaggugcuguuugcucaggaggcu

SEQ ID NO: 208035 - RNA, 52 nt, Human
ggaccuauagaccugugugaccagcccccaguuccucccccaguuccuccca

SEQ ID NO: 208036 - RNA, 62 nt, Human
gggcucagccugggggagccuacuggggacugagcccccaggagggccagcauguggagagu

SEQ ID NO: 208037 - RNA, 62 nt, Human
uucacgccucgguagauuugcauucugaugcaagcccccaaccucacggaccaagaggaucc

SEQ ID NO: 208038 - RNA, 62 nt, Human
cagggcccagucuggcucccgagcucagacacagcccccaggagccgcccaccacggcugug

SEQ ID NO: 208039 - RNA, 62 nt, Human
cgaggaagccccgggguuugucgucguugagcagcccccacggcugucggucagacucuugg

SEQ ID NO: 208040 - RNA, 62 nt, Human
cgagagcuauucauucauaagauggggcaaacagcccccaggcacuugcucccugcuccaua

SEQ ID NO: 208041 - RNA, 63 nt, Human
agcugcgccccaccuuuccagauacccacaaagcccccagacagaaucuagcaucgggacuau

SEQ ID NO: 208042 - RNA, 63 nt, Human
aaggaaagggaagaagagaucacgaaacugggacccccagaagggaggagugggcuuugaacu

SEQ ID NO: 208043 - RNA, 58 nt, Human; identical to SEQ ID NO: 90077

SEQ ID NO: 208044 - RNA, 63 nt, Human
gggcccugugcccuccuagaggagcaggcaccucccccagacuuggggugggggcccugccag

SEQ ID NO: 208045 - RNA, 62 nt, Human
gccaccguguccagccaguuucuguuguuugaagcccccaacuucuagauugggaaacgaag

SEQ ID NO: 208046 - RNA, 52 nt, Human
acaacucccccagccgcugaggagcccccagcagagcugggguugaagaggc

SEQ ID NO: 208047 - RNA, 62 nt, Human
ggauggacccucgcagcaggugcaagagacagagcccccaagccucugccccaaggggccca

SEQ ID NO: 208048 - RNA, 62 nt, Human
uucucuauaguucccgaguuggcccccauugcagcccccacccuguggguagucuuccagaa

SEQ ID NO: 208049 - RNA, 62 nt, Human
agauuguacugugggcucagaaaccgugagagagcccccaccguggacaccggcucuagggc

SEQ ID NO: 208050 - RNA, 62 nt, Human
aagcugcgccccaccuuuccagauacccacaaagcccccagacagaaucuagcaucgggacu

SEQ ID NO: 208051 - RNA, 60 nt, Human
cugacgguggaugcucguaaccacggugacagcccccacagcccagacaugagcuacgag

SEQ ID NO: 208052 - RNA, 62 nt, Human
gacccagguugaggaagugagauccagcccccagcccccagcuggccccugacuccaugugg

SEQ ID NO: 208053 - RNA, 55 nt, Human
gacccagguugaggaagugagauccagcccccagcccccagcuggccccugacuc

SEQ ID NO: 208054 - RNA, 62 nt, Human
gccuucagcucuccccugaacuccaucuuaacagcccccaugguuuguucaacaucuccacc

SEQ ID NO: 208055 - RNA, 62 nt, Human
cugcagccucagucccugccccuccagcccacagcccccaucccguagcccuuccuggaucu

SEQ ID NO: 208056 - RNA, 62 nt, Human
ugcccaccaagcccugcccccagcccaagaggagcccccacugccugcggggcagugauguc

SEQ ID NO: 208057 - RNA, 62 nt, Human
guguguccaaccagcuguucucuccucaaagcagcccccaagcaagucccuucucuagggug

SEQ ID NO: 208058 - RNA, 62 nt, Human
uaucauccuaaaaguggggguugccucaagacagcccccaggaacugauaagaagggaugaa

SEQ ID NO: 208059 - RNA, 62 nt, Human
aggccacccacguggcagccccaccucuugagagcccccagugccggagcagaaaggacccu

SEQ ID NO: 208060 - RNA, 62 nt, Human
accgcugcgggugguaaccaguggaagaccccagcccccagggagaggaacccguucuaucc

SEQ ID NO: 208061 - RNA, 63 nt, Human
gaagagccagccaagaucacccaggagcuugugcccccagaugggccaaagaaagagccuaug

SEQ ID NO: 208062 - RNA, 63 nt, Human
caccuugucccuucccgcagcauuuccugguuccccccagacccuugagcgcucuuugggacc

SEQ ID NO: 208063 - RNA, 63 nt, Human
ucccuguacaucuaauauauacugauuuguuugcccccagagaauuuuuaagguaucugccua

SEQ ID NO: 208064 - RNA, 63 nt, Human
ggaggcucugggcuuccugcuucuuccccgcuucccccagaguucacagauguugaaguuucu

SEQ ID NO: 208065 - RNA, 62 nt, Human
ccagugagcggcagccucaggggccucaggggagcccccaccccacggauguugucaggaau

SEQ ID NO: 208066 - RNA, 62 nt, Human
cugaguggaaguuucauucaucagugaugaauagcccccaaacagugggaguguguauguau

SEQ ID NO: 208067 - RNA, 62 nt, Human
gagggaggacccugagggccgcgaagcauccgagcccccagcugggaaggggcaggccggug

SEQ ID NO: 208068 - RNA, 62 nt, Human
ucugcuucucggaucucccucagucugcccccagcccccaaacuccuccuggcuagacugua

SEQ ID NO: 208069 - RNA, 62 nt, Human
uggaggaaugugggggauugaaacuagcucccagcccccauggggcagcagcugggccacaa

SEQ ID NO: 208070 - RNA, 62 nt, Human
accacacccaacacuuagacaugcgaacaagcagcccccagcgagggucuccuucgccuuca

SEQ ID NO: 208071 - RNA, 62 nt, Human
uucugagguugucgugugaguucuguacaaaaagcccccacaagucguccaguagaaaugca

SEQ ID NO: 208072 - RNA, 62 nt, Human
gauuuccugggcucaagcaauccucccaccucagcccccaaguagcugggccuacaggugcg

SEQ ID NO: 208073 - RNA, 62 nt, Human
uucauauguccccacuggcauuacucagcaggagcccccagcugccaaagguuggcagugau

SEQ ID NO: 208074 - RNA, 62 nt, Human
aaaauuugauaaacauuccuguugaugggaaaagcccccaguuaauacuccagagacaggga

SEQ ID NO: 208075 - RNA, 62 nt, Human
ggacagcaggguggaccccaguuuggaagcugagcccccagccacgaacauggaucugagga

SEQ ID NO: 208076 - RNA, 62 nt, Human
ggagaccaggcucuagcucugggcccuccuucagcccccaucaugggaauaaauuaauuuuc

SEQ ID NO: 208077 - RNA, 62 nt, Human
guugaggcuggggcuaguggucccagcagcccagcccccacccuccuggcagcagcgccagg

SEQ ID NO: 208078 - RNA, 62 nt, Human
ggccuuugugcugcgccugcaggcagagcuggagcccccagcagaggcaggcugggacggac

SEQ ID NO: 208079 - RNA, 62 nt, Human
gucccuaccugggcagucucauuugcacccauagcccccaucuauggacaggcugggacaga

SEQ ID NO: 208080 - RNA, 62 nt, Human
cagacucccaaagcgguggaauuagaggcgugagcccccaugcuuggccuuaccuuucuacu

SEQ ID NO: 208081 - RNA, 63 nt, Human
aucuguuuacauccagaguucugugacacaugccccccagauugcugcaaagaucccaaggca

SEQ ID NO: 208082 - RNA, 63 nt, Human
ucccucucaaccucaacccaccugcaugcaucucccccagaggaaacacugaggguaggggac

SEQ ID NO: 208083 - RNA, 63 nt, Human
gccagaguugccucuccuccuccucuuccccaacccccagaccaugaccagccuuagaaaauc

SEQ ID NO: 208084 - RNA, 63 nt, Human
ugcuaauacuuucucccuaauggaagcccugaucccccagagagcuacaggucugcucccgac

SEQ ID NO: 208085 - RNA, 62 nt, Human
ggugagcucagacuuggugcuucccuauccacagcccccaccccuuguuuuucaagauacua

SEQ ID NO: 208086 - RNA, 62 nt, Human
ggggcaggagauuguuucuucauucuucugacagcccccaucugacgcguaacugcccauuu

SEQ ID NO: 208087 - RNA, 62 nt, Human
accggacccagcccgaguagagggcaucccggagcccccagccugcccacuacauccagccu

SEQ ID NO: 208088 - RNA, 62 nt, Human
cuccuccaggcccccggacgcucagcccccacagcccccacagccuggcgccagggcucaca

SEQ ID NO: 208089 - RNA, 62 nt, Human
acggcugcccuccuccaggcccccggacgcucagcccccacagcccccacagccuggcgcca

SEQ ID NO: 208090 - RNA, 62 nt, Human
cacagaggaugaagccaccccacagaggaugcagcccccagcugcauggaagguggaggaca

SEQ ID NO: 208091 - RNA, 62 nt, Human
uccccgacugccauuggcaacaguggcccugcagcccccagcccuccccacccagguuuucg

SEQ ID NO: 208092 - RNA, 62 nt, Human
cuuccccaugggaagacgaggcccucgggcccagcccccacagugcugucugaucugugcuu

SEQ ID NO: 208093 - RNA, 62 nt, Human
agggucuuucuaaguuaauacugugagcauugagcccccauuaaaacucuuuuuuacuucag

SEQ ID NO: 208094 - RNA, 62 nt, Human
ggcuuguccgugagcuccgugcacuucaccaaagcccccaucccagcacacaggacccgugu

SEQ ID NO: 208095 - RNA, 62 nt, Human
cuuucucuguccucuccugagguucugccugcagcccccaggaggugggccugccccauccu

SEQ ID NO: 208096 - RNA, 62 nt, Human
caccucagccuggcacccccacuccccugcgcagcccccaggccucaggaccccaccccucu

SEQ ID NO: 208097 - RNA, 62 nt, Human
aaguugaaucugguuauuauuuaaaaacuagaagcccccaaaccagcagaucuuacugaaga

SEQ ID NO: 208098 - RNA, 62 nt, Human
uuaaaacacuaauugcugggccucaacccaaaagcccccaaaguggcacuucugaguuccug

SEQ ID NO: 208099 - RNA, 62 nt, Human
auagacccucaguagaauuggauuuccaugucagcccccacuccaggaaggcagcccaaucc

SEQ ID NO: 208100 - RNA, 62 nt, Human
cucccugcccccugugacggagggggcaagcaagcccccagaggcugugucucuggacagac

SEQ ID NO: 208101 - RNA, 64 nt, Human
ccgacggcugugacgcagccggagggaggcacuagucaccgacagcggccuugaagacagagca

SEQ ID NO: 208102 - RNA, 64 nt, Human
uuuguccugcuguguugcagcuucuaaagacauugucaccgagugugugugacucaaagaucaa

SEQ ID NO: 208103 - RNA, 64 nt, Human
gguacacucuggccugggucucugaauucagccugucaccgauggcugacugaugaaauggaca

SEQ ID NO: 208104 - RNA, 64 nt, Human
ccuggcaauucuguuuacaugaaauggggagaaagucaccgaaaugggugccgccggcccccac

SEQ ID NO: 208105 - RNA, 62 nt, Human
gacccaagaccaaacgcaucuaaaggauccccagcccccaagaccuagccuuugucugcgau

SEQ ID NO: 208106 - RNA, 62 nt, Human
aguuaagugaaaauuagucaacugcacguggaagcccccaccacuuuggggaucucuuuauu

SEQ ID NO: 208107 - RNA, 62 nt, Human
ccagccaggccugacucaucauggucacauccagcccccacccccggccaacuaaccacugc

SEQ ID NO: 208108 - RNA, 62 nt, Human
agggcggcugcaggagaggaaggggcucccacagcccccacugaugccgcugcaggccccug

SEQ ID NO: 208109 - RNA, 62 nt, Human
aggaugaaagcaaaggagggccuugaggaagcagcccccaggccuggcagccacgcagcggc

SEQ ID NO: 208110 - RNA, 62 nt, Human
cccugcccugggccccuuccccacugcccaggagcccccauccuaagcuccaagcaugucug

SEQ ID NO: 208111 - RNA, 62 nt, Human
uucagcaguucaucuucaugggaaauuugcugagcccccaccagggaaccggaugaugaaac

SEQ ID NO: 208112 - RNA, 62 nt, Human
gccaagggggcuugcccacccaccccgaccccagcccccagccucagccccgguccgggggc

SEQ ID NO: 208113 - RNA, 62 nt, Human
uguuuguggcucccacuccccagccccccagcagcccccagccgaggggcccagggcccaca

SEQ ID NO: 208114 - RNA, 62 nt, Human
uguggcuuggggcuuguugccuccccucucugagcccccauuuccuccuucauccuguggag

SEQ ID NO: 208115 - RNA, 62 nt, Human
caggcuggacugagccccucacgccgcccugcagcccccaugccccugcccaacaugcuggg

SEQ ID NO: 208116 - RNA, 62 nt, Human
ucacccuacaacuacuacuucuugggaccucaagcccccaacaucccaguccucaguccuca

SEQ ID NO: 208117 - RNA, 62 nt, Human
ggagucucaagucugcuaagauucacauccauagcccccauggcuuugaggagaauccucuc

SEQ ID NO: 208118 - RNA, 50 nt, Human
ugcuaaggaaaaugggcugaagcccccaauagccaaauaauaaagcagca

SEQ ID NO: 208119 - RNA, 62 nt, Human
cuccuuauuucuuuuuucuaucuguuccucuuagcccccaaacucccagguucucacuuccu

SEQ ID NO: 208120 - RNA, 62 nt, Human
uugcacagccaggcugggagcagccuagggagagcccccaucaugcccaccacccacucugg

SEQ ID NO: 208121 - RNA, 64 nt, Human
gcaggacaaggagcuccagacaggacguccauaagucaccgaggugugccacccagcaggugcu

SEQ ID NO: 208122 - RNA, 64 nt, Human
acacuuccacaaggugcaaccucaggaaccaaaggucaccgacacugaguacucagaaaucaag

SEQ ID NO: 208123 - RNA, 64 nt, Human
gugugggagcugcuaccuggcaguuucucgaggggucaccgagccucuggugggacaccugggc

SEQ ID NO: 208124 - RNA, 62 nt, Human
cagcauacuugagguuuccuuuuuuaaguguucgagguuauaacaagagacagccaaggacc

SEQ ID NO: 208125 - RNA, 62 nt, Human
aaagaugaggcgccauaggcauccgucuccagagcccccaggaggcaggaaccaggauaagg

SEQ ID NO: 208126 - RNA, 62 nt, Human
cccaguuucccuuuugguuacagggggauaguagcccccagggaucaugugaaagugagaaa

SEQ ID NO: 208127 - RNA, 62 nt, Human
aguguugagcccaaggggggauuuguagaacaagcccccaugagaaacagcuguuacucuac

SEQ ID NO: 208128 - RNA, 62 nt, Human
gcucagcuuccccaacacgcaggagcacacccagcccccacauccugugccuccaucagcua

SEQ ID NO: 208129 - RNA, 62 nt, Human
aauggaaacccccaucugaguauuuugggaggagcccccagcccucauccagcucuggcacg

SEQ ID NO: 208130 - RNA, 62 nt, Human
cugaaacgagaagugcccuuaaggaucaccccagcccccacagcccuggaauaaauuucgca

SEQ ID NO: 208131 - RNA, 62 nt, Human
uuaucucagaacagaagucaucagaucaucagagcccccagauggcuacagaccagagauuc

SEQ ID NO: 208132 - RNA, 62 nt, Human
ccuggggucaggcccucacugacccucaggggagcccccaaggugcugucugucuagacagg

SEQ ID NO: 208133 - RNA, 62 nt, Human
ccacaccucgcucccuguuagugccguaugacagcccccaucaaaugaccuuggccaaguca

SEQ ID NO: 208134 - RNA, 62 nt, Human
uaccuguuugggucagagagauguguuuuaaaagcccccaaggaaggaggcugggacugugc

SEQ ID NO: 208135 - RNA, 62 nt, Human
agucaaagaaaguccauuguacauaacaaaacagcccccaaacagcccagugccgacaccau

SEQ ID NO: 208136 - RNA, 62 nt, Human
ugcuuagaaagcugucuuuucagugguguugcagcccccagauguguggccaaccucugcug

SEQ ID NO: 208137 - RNA, 62 nt, Human
agcuaacagaauaaacgacucugaagaggagaagcccccaguuaggagaagacagaguggca

SEQ ID NO: 208138 - RNA, 62 nt, Human
aaccuggcagcccguuuuggggugcuuucuugagcccccaguucucuguccccuagcacuag

SEQ ID NO: 208139 - RNA, 62 nt, Human
gauugcagggguccagccuugccuguuuccgaagcccccacacugccuuucgcccuacugag

SEQ ID NO: 208140 - RNA, 62 nt, Human
acccacaggccauguccagccccacuucccucagcccccagggcuuccuucuggccccucug

SEQ ID NO: 208141 - RNA, 62 nt, Human
aaauagugcccaggcauaugagaguuguccuacgagguuaaagaacacacuguuccacugua

SEQ ID NO: 208142 - RNA, 62 nt, Human
cucaugaagguagaaccagcugcuguugacaccgagguuacaucuguaugucuauuuauaau

SEQ ID NO: 208143 - RNA, 62 nt, Human
ugguucaucauuuccugggcuguuaaacaaagcgagguuaagguuagacucuugggaaucag

SEQ ID NO: 208144 - RNA, 62 nt, Human
auggauuuaaagagcauaccuuaugauuaaaccgagguuauagaaggucaggggagagugaa

SEQ ID NO: 208145 - RNA, 62 nt, Human
gcuccaauuuggagagggaaugcugagcagauagcccccauuguuaauccaguauccuuaug

SEQ ID NO: 208146 - RNA, 62 nt, Human
gaguggccuggccccucccccucuaccucaguagcccccaggccugagauggcugagaaggg

SEQ ID NO: 208147 - RNA, 62 nt, Human
ugcgccaucuaccggcugaacuuucugaccacagcccccagcaggggaggcccacaccugcc

SEQ ID NO: 208148 - RNA, 62 nt, Human
auaggaccucaagauuccuggaaagaagccccagcccccaggggaaaccuccagaggaacaa

SEQ ID NO: 208149 - RNA, 62 nt, Human
uacccucccaguuggccagaaucugaggggagagcccccagagagcccccuuccccaucaga

SEQ ID NO: 208150 - RNA, 62 nt, Human
gagguccaugcagcucuuugacaaugucaucuagcccccaggagagggggucaguguuuccu

SEQ ID NO: 208151 - RNA, 62 nt, Human
aaagaauuuagcugcaaguggacaaaggaacaagcccccagaaaagaaagggaagaacugcc

SEQ ID NO: 208152 - RNA, 62 nt, Human
guauguagaagggucugucagcacacauggaaagcccccauuugcacagauguagaacuuua

SEQ ID NO: 208153 - RNA, 62 nt, Human
aauauaaagauuuuaaaacugcauuaugaccuagcccccauaauugggauuuaucauuuugg

SEQ ID NO: 208154 - RNA, 62 nt, Human
ggacggugccagcugaggcugaggcaugcagcagcccccagcuaccuuugcuuagggcuggg

SEQ ID NO: 208155 - RNA, 62 nt, Human
ucuuaaaaaucagcuuuaaggagcuggcagaaagcccccagccccacagcccugagagaugg

SEQ ID NO: 208156 - RNA, 62 nt, Human
cccaggcagggcuggggugugcuggcaucgacagcccccacucugggcacuaggugggcccu

SEQ ID NO: 208157 - RNA, 62 nt, Human
accagggccgcucgugggacuccacauccuccagcccccacaauccugucaggggcucccug

SEQ ID NO: 208158 - RNA, 62 nt, Human
ccaugggcaggagacuguggagacugcuccugagcccccagcuuccagcaggagggacaguc

SEQ ID NO: 208159 - RNA, 62 nt, Human
cccacaucacccugaagaugacuuccugagccagcccccagccacagccuuagagcugcggg

SEQ ID NO: 208160 - RNA, 62 nt, Human
caauggcugcuuugaacuuacucaggaaagccagcccccauaauauuguauuaccaaacagu

SEQ ID NO: 208161 - RNA, 62 nt, Human
ucaguaugcagucgcaauaacaugucugcucccgagguuaacauucaagcguuucuacuuug

SEQ ID NO: 208162 - RNA, 64 nt, Human
caaagaagcagaaguguaauuuuccuuuucccagcaugacgaaaaauuggaguucugccauuug

SEQ ID NO: 208163 - RNA, 64 nt, Human
ccugaggucaggaguucaagaccagccuggccaacaugacgaaaccccaucucuacuaaaaaga

SEQ ID NO: 208164 - RNA, 62 nt, Human
uguugcacccggggcugcaaacgucuccgugcagcccccagagagaggcccaugggcucaga

SEQ ID NO: 208165 - RNA, 62 nt, Human
uucuuccccgcccccugcacauucggggucucagcccccaggcugugagcuccuugggggca

SEQ ID NO: 208166 - RNA, 62 nt, Human
ggaacaaagaggagccugguaaaaaacagccaagcccccaagaccucagcccaggcagaagc

SEQ ID NO: 208167 - RNA, 62 nt, Human
cggccccuugaccugagcuuaugccgugaaacagcccccagcccccgucugucccccaaccc

SEQ ID NO: 208168 - RNA, 62 nt, Human
aggagccuccaggauggagauggagacccagcagcccccagacuacuucuaucccugaaaac

SEQ ID NO: 208169 - RNA, 62 nt, Human
gccccagccuguaccccagcccugcagcaggaagcccccagucccagcccuuugggacuguu

SEQ ID NO: 208170 - RNA, 62 nt, Human
uucagagaacaguuaaucaaggcaaaucagcaagcccccaaagugcuguaauuuaacaucau

SEQ ID NO: 208171 - RNA, 62 nt, Human
ucuuagguuacacaugaaauccuaccgucacuagcccccauacaccaguguugcuggcugaa

SEQ ID NO: 208172 - RNA, 62 nt, Human
gcuggcccagauauuccccaguggaugggcagagcccccaccuucaagucucuccagugugu

SEQ ID NO: 208173 - RNA, 62 nt, Human
ugccuaggccuuacgcauuugcugacugacucagcccccaugcuucuggggaccuuuccuac

SEQ ID NO: 208174 - RNA, 62 nt, Human
uaugauagcuucgcaugguggugugcaccuauagcccccacugccuggaaagcugagguggg

SEQ ID NO: 208175 - RNA, 53 nt, Human
ugggggcccauaccccaugaagaagcccccaccuucccuccaccugcuugugu

SEQ ID NO: 208176 - RNA, 62 nt, Human
gauuacuggauagaauucaggcuuuccccuccagcccccaaucauagcucacaaaccuuccu

SEQ ID NO: 208177 - RNA, 62 nt, Human
uauggguauauuuuucuuguguccuugcaguuagcccccaugucuuauguguguccugaaaa

SEQ ID NO: 208178 - RNA, 62 nt, Human
uuucagaagguggcacucaggucacccugaaaagcccccaggggcuugcaauucuggaaaau

SEQ ID NO: 208179 - RNA, 62 nt, Human
ucuucuuucucuuucugaagcuggagagcagaagcccccaucuuugaaaagcuccugagugc

SEQ ID NO: 208180 - RNA, 63 nt, Human
ugaagauuaguucaggggauggaccaagaauuucccccagagcuuuaaagaagugggacucag

SEQ ID NO: 208181 - RNA, 63 nt, Human
gcuuagaaagcugucuuuucagugguguugcagcccccagauguguggccaaccucugcugca

SEQ ID NO: 208182 - RNA, 63 nt, Human
ggccucucaucaggaucugccccccagagaccccccccagacacugcagggccuggugaugcu

SEQ ID NO: 208183 - RNA, 63 nt, Human
aguaaaggcuccuggccucucaucaggaucugccccccagagaccccccccagacacugcagg

SEQ ID NO: 208184 - RNA, 62 nt, Human
cugaguucagccccacggacaaagggacacacagcccccaauggagaccauuguaaguggug

SEQ ID NO: 208185 - RNA, 62 nt, Human
ccucacucaggagugggggguguaggcuggccagcccccagggcuuguccaccagucuucuc

SEQ ID NO: 208186 - RNA, 62 nt, Human
aucuuccccugccgcaccggcagucucagcccagcccccaccuuuggguuguagguugggcu

SEQ ID NO: 208187 - RNA, 62 nt, Human
cgccugccccgcggaagaccgcccagugagccagcccccaccuuccaggcgccuucgcccug

SEQ ID NO: 208188 - RNA, 62 nt, Human
gccaggcccccacagucuguggccguggucuuagcccccaguuccacucuggaugggccugu

SEQ ID NO: 208189 - RNA, 62 nt, Human
agccucaccaaaguguugggauuacuggugugagcccccacaccuggccgagccagcgcuuc

SEQ ID NO: 208190 - RNA, 62 nt, Human
gaacugcucacccugccuuuuucugggggcugagcccccacaaccugucuuuuccaagugga

SEQ ID NO: 208191 - RNA, 62 nt, Human
acugggcagcuccuggacagccucuuggcuccagcccccacccgaaaguggacacuggcucc

SEQ ID NO: 208192 - RNA, 62 nt, Human
auucccugacgacacugaagaaucaagagggcagcccccacuuuccuacaaaauggagggag

SEQ ID NO: 208193 - RNA, 62 nt, Human
guauauuccgugucguguguguguguggccaaagcccccaaggguggcaagugccaccuucg

SEQ ID NO: 208194 - RNA, 62 nt, Human
cacuucucaggaaauggcuuuucccaacccccagcccccacccggugguucuuccuguucug

SEQ ID NO: 208195 - RNA, 62 nt, Human
acugccccagguuuaagcaauccucccaccucagcccccagguaacugggacuacaggcaug

SEQ ID NO: 208196 - RNA, 62 nt, Human
ggccccagagccuuugccacagugcucccaccagcccccaccucauccgucuguuugcagag

SEQ ID NO: 208197 - RNA, 62 nt, Human
agacuacuagaaagaaacgacacccuuccccaagcccccacagcuacuccaacccaaacaac

SEQ ID NO: 208198 - RNA, 62 nt, Human
cguuagacuggcaucaggcuggcacuaggcucagcccccaaaacccccugcccagccccagc

SEQ ID NO: 208199 - RNA, 62 nt, Human
ggcauccccagggaagggguugcuguagagauagcccccacccaggggauggaggucuaccc

SEQ ID NO: 208200 - RNA, 63 nt, Human
ccaaaacuguucuuuuagguucaaaaccuaauucccccagauuaguauacucgagaauucaaa

SEQ ID NO: 208201 - RNA, 63 nt, Human
accaguaucugucccgagaggaaauuccccccacccccagaaguuuacagaaaacugccucuu

SEQ ID NO: 208202 - RNA, 63 nt, Human
uugcccauuucccugccccaaggcccagagcuccccccagacuggagagcaagcccagcccag

SEQ ID NO: 208203 - RNA, 63 nt, Human
cugccaccugagaagauggaaaggaaggagcugcccccagagcaucaguccuugaagagcagc

SEQ ID NO: 208204 - RNA, 62 nt, Human
uaccccaucuucgacucugauagccuucuugaagcccccagcccuaaucucacccucuccuc

SEQ ID NO: 208205 - RNA, 62 nt, Human
gguagcaagaggaguacccaguuagggguuggagcccccauauaacaucuuccugucagaag

SEQ ID NO: 208206 - RNA, 62 nt, Human
ucuagaaacgaguuggugucuuucgucucaguagcccccaccccaauaagcuguagacauug

SEQ ID NO: 208207 - RNA, 62 nt, Human
uucagcugcauccuggugucccacccaggucgagcccccaggcuucuggaaaagagugugug

SEQ ID NO: 208208 - RNA, 62 nt, Human
uggcugccauucucacugacaaaauguauaucagcccccaccuccaccccccaauauuccuu

SEQ ID NO: 208209 - RNA, 62 nt, Human
cacaggagcuuaaacagcuggucagcccccuaagcccccacuacaagugauccucaggcagg

SEQ ID NO: 208210 - RNA, 62 nt, Human
cugauugggcaauugugggcccaugggguggaagcccccagaugacugagcaguucuacaaa

SEQ ID NO: 208211 - RNA, 62 nt, Human
ccaggugugcaggggagcacacagggcccggcagcccccaggaaucaaggauagggcuaagg

SEQ ID NO: 208212 - RNA, 62 nt, Human
gcucguuccaaagggaaaaacucggaugaagaagcccccaagacugcccagaagaaguuaaa

SEQ ID NO: 208213 - RNA, 62 nt, Human
cuacccuggaucuuugcccaccucuuccucagagcccccacugaggggccguagcccuaucu

SEQ ID NO: 208214 - RNA, 62 nt, Human
ucuaaccugcugugucacccgcuuucccucccagcccccacauccuuaccauuuucccuccc

SEQ ID NO: 208215 - RNA, 62 nt, Human
cucaccccuccccguguuaaucuguaacuugcagcccccaggccaaaguccuuucucacacu

SEQ ID NO: 208216 - RNA, 62 nt, Human
ugggaccugguucucuucuaaccccuggcaauagcccccauuccugggucuuuagagauccu

SEQ ID NO: 208217 - RNA, 62 nt, Human
guccuggcugauugguguucgcuguucaucugagcccccaaaagcauuauuacugauacuug

SEQ ID NO: 208218 - RNA, 62 nt, Human
cuuugucuaggacccagaucauccccagagagagcccccacaagcuccucaggaaacaggau

SEQ ID NO: 208219 - RNA, 55 nt, Human
ugaccuucucuuuuagauaaagaugagcccccaccaccaccgacucucccaaccc

SEQ ID NO: 208220 - RNA, 63 nt, Human
aauucuguggcugugcugcguuucagaaaauaacccccagaggccuugggcuguggaccuggg

SEQ ID NO: 208221 - RNA, 63 nt, Human
ucagcccuacguccagagggagaggagccgacacccccagagccagugccccaucuuaagcau

SEQ ID NO: 208222 - RNA, 63 nt, Human
cuggcugcuucagcagguggauccauucuucgacccccagaugugacucuaaagaaggcugaa

SEQ ID NO: 208223 - RNA, 63 nt, Human
ggcccugugccauagggguggccacccgaccugcccccagaacuuuuggauacuggaggcagu

SEQ ID NO: 208224 - RNA, 62 nt, Human
ucuguccucagccuugccagagauccaaaagaagcccccagcuaagaaccuggaacuugggg

SEQ ID NO: 208225 - RNA, 62 nt, Human
uucucccugccuucuugcccugcccucucuguagcccccacccuccugccaagcugccucug

SEQ ID NO: 208226 - RNA, 62 nt, Human
gggugagggggaagaauacggggguucccagaagcccccaugugauccaaggguuuguauuu

SEQ ID NO: 208227 - RNA, 62 nt, Human
aaaugucuauaaauuaucagucugggugggaaagcccccaccuccauccauuuuccugcuua

SEQ ID NO: 208228 - RNA, 62 nt, Human
ucacugcccuacaugugacuauguccaaguuaagcccccaacacgagaggaaagcugcugac

SEQ ID NO: 208229 - RNA, 62 nt, Human
cacgggagcacuuccuacccccacgagggcacagcccccacgccuuccagaagacacaaacu

SEQ ID NO: 208230 - RNA, 62 nt, Human
ucuuuuaagucugauaacaugguuucaagcccagcccccagccuuucuuaccaaucaaggac

SEQ ID NO: 208231 - RNA, 62 nt, Human
ggugagcuguguccucuaggcugccagcucacagcccccaccccagggcccuguaagcugug

SEQ ID NO: 208232 - RNA, 62 nt, Human
ggggagcccaccgccuacacaguaggggcaguagcccccagcuccacgccuguugccaugug

SEQ ID NO: 208233 - RNA, 62 nt, Human
gaagucacaucccagccccagagucacuguccagcccccaccccucaacacgcgggggaggc

SEQ ID NO: 208234 - RNA, 62 nt, Human
ucuaugacucaccuugcucugccaucccuggcagcccccaccgguguccuguuccugccaca

SEQ ID NO: 208235 - RNA, 62 nt, Human
gggguuccugggggcuuccagcccaggcuagaagcccccauggcuucuggcagcuggacauc

SEQ ID NO: 208236 - RNA, 62 nt, Human
ucugcuccccugugaacccacugaaccuucugagcccccacugcuucuauggggcucucucu

SEQ ID NO: 208237 - RNA, 62 nt, Human
ccaucugaccaucuccuuaagguuucacccaaagcccccagugucagagacuugggauggga

SEQ ID NO: 208238 - RNA, 62 nt, Human
auaaaaucaugaagcagguaaagggaggggcaagcccccaaacugcuguggggacauuuuau

SEQ ID NO: 208239 - RNA, 62 nt, Human
gcgcucuggacagauggacgcaggcccuguccagcccccagugcgcucguuccgguccccac

SEQ ID NO: 208240 - RNA, 63 nt, Human
ggaagcugaccgcacaguguccagacgaauuggcccccagaagauggggaguucuguccugcc

SEQ ID NO: 208241 - RNA, 63 nt, Human
gccacuuuaggauggcgaugcaggugucuuuuccccccagaucuccucuuccuucagcaaagg

SEQ ID NO: 208242 - RNA, 63 nt, Human
acccucccaguuggccagaaucugaggggagagcccccagagagcccccuuccccaucagaag

SEQ ID NO: 208243 - RNA, 63 nt, Human
aagaauuuagcugcaaguggacaaaggaacaagcccccagaaaagaaagggaagaacugccuu

SEQ ID NO: 208244 - RNA, 62 nt, Human
gaugcugcugagcaucccgcaguguacaggacagcccccaaacaaggaauuauccagcccca

SEQ ID NO: 208245 - RNA, 62 nt, Human
acucgcggccuggaaggagaagguguccacggagcccccacccauccucggcgguucccauc

SEQ ID NO: 208246 - RNA, 62 nt, Human
ccuccugagucuggguaauuauaccucucccaagcccccauuguguguugaaauccugucau

SEQ ID NO: 208247 - RNA, 62 nt, Human
ccauuacugcaucauaauacaaggaaccucagagcccccauuuguucauuaaagaggcaacu

SEQ ID NO: 208248 - RNA, 62 nt, Human
gcaccggaaugccaauuaacuagagacccuccagcccccaaggggaggauuugggcagaacc

SEQ ID NO: 208249 - RNA, 62 nt, Human
uggagcccagacacgucuccuugggauucacuagcccccagcccgccaaaccccaccccagc

SEQ ID NO: 208250 - RNA, 62 nt, Human
auugaacgcugcacuccugggcuccuguccccagcccccauucagacacgcugacucaggag

SEQ ID NO: 208251 - RNA, 62 nt, Human
gaaucagccagugccuugcucuuggacuucccagcccccagaacugugagaaauaaauuucu

SEQ ID NO: 208252 - RNA, 62 nt, Human
agcccaggagguggcuggauugcagggcuggcagcccccacgugguggcauccugacaggca

SEQ ID NO: 208253 - RNA, 62 nt, Human
cccuggcccaggcccaguccuuggugucagggagcccccaggccgcagguggagggugauaa

SEQ ID NO: 208254 - RNA, 62 nt, Human
agucgaacugggggcuagccaccuccucguccagcccccaaaccuccccuuccuuucccccu

SEQ ID NO: 208255 - RNA, 62 nt, Human
gaaacccagcccugccccugccuccugcauccagcccccaacauggugccaaagcuuccaga

SEQ ID NO: 208256 - RNA, 62 nt, Human
cgcacccuacccagugucgauauccacaacccagcccccaggccugcacuuuggagauuucu

SEQ ID NO: 208257 - RNA, 62 nt, Human
uagacccagccucuagucuccugagccuguagagcccccaggagacugggacccaaagaacu

SEQ ID NO: 208258 - RNA, 62 nt, Human
uggaacucuuccagccuuucuacuugaucuccagcccccaggucuuugccagaugaugggaa

SEQ ID NO: 208259 - RNA, 62 nt, Human
caucacugcugucugcuagagcccuuccucucagcccccauguugggagaggggaguggauu

SEQ ID NO: 208260 - RNA, 63 nt, Human
ccaccuuugcaaagaaaggaaaaacacaaauugcccccagauuggcccaguggcaugccauua

SEQ ID NO: 208261 - RNA, 63 nt, Human
ucccacguacucuaucuuccauuccucgcccugcccccagaggccaggagcucugcccuugac

SEQ ID NO: 208262 - RNA, 63 nt, Human
gaggcacagccugugcagagagggugggucacccccccagauccaaggagaaacugcagguca

SEQ ID NO: 208263 - RNA, 63 nt, Human
cccacaugcaccccuggccucagcaucccgguucccccagacaagagagggcaagucagccag

SEQ ID NO: 208264 - RNA, 62 nt, Human
gggauggcgaguaagaggcgaccccgcccggcagcccccauccaucugugucugucuguugg

SEQ ID NO: 208265 - RNA, 62 nt, Human
agagccaccaaaaguuaggggacuucaguccuagcccccagauggccgcccugaagcucucu

SEQ ID NO: 208266 - RNA, 62 nt, Human
uggaagauguggggugcugggugagaggcaucagcccccacaaguauguuuuugugucuuaa

SEQ ID NO: 208267 - RNA, 62 nt, Human
uuccuccuacuggucuccaccaaggcuuuguuagcccccacccugccuggugugcagcuaac

SEQ ID NO: 208268 - RNA, 62 nt, Human
cacagcccagcagcccgaggccgcccgcgacuagcccccaccguaguauuuauaguuaaauu

SEQ ID NO: 208269 - RNA, 62 nt, Human
uuagauucugguggagagaagugagaauaggcagcccccaaauaaaaaauauucauggauuu

SEQ ID NO: 208270 - RNA, 62 nt, Human
uccuaagcagcuggccugaccucuuccugcccagcccccaacccagucucuggccucugccc

SEQ ID NO: 208271 - RNA, 62 nt, Human
acagagccaggagaagcucagcugcauuccgcagcccccacccccaagguucuccaacauca

SEQ ID NO: 208272 - RNA, 62 nt, Human
aaagguuaaugaacuucaggucccugcaacucagcccccaccacaaacacagcccuggaaac

SEQ ID NO: 208273 - RNA, 62 nt, Human
agcagaggugagcagcaaugcacugguucgggagcccccaucagccuccuugugcaaacugg

SEQ ID NO: 208274 - RNA, 62 nt, Human
cggccucgagaggggccgaugcccagagacacagcccccacggacaaaaccccccagauauc

SEQ ID NO: 208275 - RNA, 62 nt, Human
auccuccuauaccgcacauaaauagauuucagagcccccauacaaugggcagugucugcuau

SEQ ID NO: 208276 - RNA, 62 nt, Human
ugcuccccgggcagccucccgccgaggggcccagcccccaacccacaggcacggaggggcau

SEQ ID NO: 208277 - RNA, 62 nt, Human
ccagcucagacucuaagcucaacaagcccuugagcccccagaaggagaccgcuaacucucag

SEQ ID NO: 208278 - RNA, 62 nt, Human
uauauauauauauauguauaugucuguaccccagcccccaccuuucagauucugcucuuggc

SEQ ID NO: 208279 - RNA, 62 nt, Human
uguggugcuagauguguguuuagagcuaaaccagcccccacccccacccuccaccugccccu

SEQ ID NO: 208280 - RNA, 63 nt, Human
guugcacccggggcugcaaacgucuccgugcagcccccagagagaggcccaugggcucagacc

SEQ ID NO: 208281 - RNA, 63 nt, Human
gcuggggguccgcaucccuaccucagcuuaggacccccagagccaagguggcugggaucuggc

SEQ ID NO: 208282 - RNA, 63 nt, Human
aucugugguccaggccggcaucguccuggccaccccccagaucuggugccugcuggccggccc

SEQ ID NO: 208283 - RNA, 63 nt, Human
ggcacagugcugccccuugcaagccauaacgugcccccagaguguagggggccuugcggaagc

SEQ ID NO: 208284 - RNA, 62 nt, Human
uuucagcaguuugccacugugacugucuggcaagcccccagauggcguuauauuaauuggau

SEQ ID NO: 208285 - RNA, 62 nt, Human
caaagccuucauuuuaacagauggggaaagugagcccccaagaugggaaagaaccacacagc

SEQ ID NO: 208286 - RNA, 62 nt, Human
acgcacuuggagggcccaggugucucuccaccagcccccaugcaguagggacuggaagauau

SEQ ID NO: 208287 - RNA, 62 nt, Human
aguuuugggggaaagauggaguuccuauccagagcccccagauuuccagaaucgagugagcu

SEQ ID NO: 208288 - RNA, 62 nt, Human
ugaaaacagugugaugcaauuacugcuguucuagcccccaaagaguuuucugugcaaaaucu

SEQ ID NO: 208289 - RNA, 62 nt, Human
uggaaaaagaucaccucccagugaccucccucagcccccaggggaguaggucuguguccaaa

SEQ ID NO: 208290 - RNA, 62 nt, Human
caaauuuccacuccacaaagaaaacagcugcaagcccccagggacuuaccuggggcuggcau

SEQ ID NO: 208291 - RNA, 62 nt, Human
ggguuuauggauaggcuucaagagggucugugagcccccagaaauugugugugagacugagu

SEQ ID NO: 208292 - RNA, 62 nt, Human
gcuuccuuucucagcugaaccccuacucccggagcccccagcagggcccuccgagguggagc

SEQ ID NO: 208293 - RNA, 62 nt, Human
ccgcuuccuuucucagcugaaccccuacccggagcccccagcagggcccuccgagguggaac

SEQ ID NO: 208294 - RNA, 62 nt, Human
caggaagucacaguggugcccagggaugugucagcccccagccacggggacgcgggauucaa

SEQ ID NO: 208295 - RNA, 62 nt, Human
auagaaaaaucuaauucaauaaacucuguaucagcccccaacauauuauuuuucauuauuug

SEQ ID NO: 208296 - RNA, 62 nt, Human
uauaagggcacuaaccccauucaugagagcagagcccccauggccuaaucaccuuuccaagg

SEQ ID NO: 208297 - RNA, 62 nt, Human
gugaauuuuuuuauauuaaaagguugagccaaagcccccaguguuuguauuuugaagccaag

SEQ ID NO: 208298 - RNA, 62 nt, Human
cugauccucugcuuccuccucacaaccccaagagcccccagcccgguccauccacgucugga

SEQ ID NO: 208299 - RNA, 62 nt, Human
guaagggaaccccaggcaggcggcccugccacagcccccaaagacacuggccuccugcucca

SEQ ID NO: 208300 - RNA, 63 nt, Human
acagacacugaccucagaggccccacucuggugcccccagacccugggcccccagccucuggc

SEQ ID NO: 208301 - RNA, 63 nt, Human
agagagguggggugagggugagcuuacucagggcccccagaggaagcccucagccucugcccu

SEQ ID NO: 208302 - RNA, 63 nt, Human
uuaccugggaaaucuuaacagaaagguaaugggcccccagaaauacccacagcauagugaccu

SEQ ID NO: 208303 - RNA, 60 nt, Human; identical to SEQ ID NO: 90133

SEQ ID NO: 208304 - RNA, 62 nt, Human
gcaaggccuucacgccugccagggucagcugcagcccccacucugccaagguggggaguggu

SEQ ID NO: 208305 - RNA, 62 nt, Human
ggagugggcccuggaguccugucccucccagaagcccccagggugggauuucucaggcugcc

SEQ ID NO: 208306 - RNA, 62 nt, Human
gaccugcugggccaggcugcccugggacucucagcccccaguugcuuauccagaugugacag

SEQ ID NO: 208307 - RNA, 62 nt, Human
uuuggccacgcccugggccugggccacuccucagcccccaacuccauuaugaggcccuucua

SEQ ID NO: 208308 - RNA, 62 nt, Human
cuccuguagggcacaaggccaggcugccucccagcccccaggcccucucccaccuacagaga

SEQ ID NO: 208309 - RNA, 62 nt, Human
caacccugcaaucaccuugaucuugggcuuucagcccccaaaggugugagaaaauaaacuuc

SEQ ID NO: 208310 - RNA, 62 nt, Human
cugcaaccaguaucuccuuggaauucauccaaagcccccauggacgcauggacgcagggcga

SEQ ID NO: 208311 - RNA, 62 nt, Human
guggccagcaggacucugcccagaccacacguagcccccaggcugcuggacacgucggacag

SEQ ID NO: 208312 - RNA, 62 nt, Human
gggccugacacucuccuaagagguucucuccaagcccccaaauagcuccaggcgcccucggc

SEQ ID NO: 208313 - RNA, 62 nt, Human
ggagagucuguugcuggcauagcccuggaaggagcccccagccucuccccuccuccuccuug

SEQ ID NO: 208314 - RNA, 62 nt, Human
ggggcgcucggcagcccacagggccuggccucagcccccacuccuguuccuugugcacccac

SEQ ID NO: 208315 - RNA, 62 nt, Human
ugugccagagaacccagcccacccccggcagcagcccccagcucccaccuccccuugggccc

SEQ ID NO: 208316 - RNA, 62 nt, Human
ccuucucccugccuucucucuucucucgucugagcccccaggccuuuuccacuuugagggag

SEQ ID NO: 208317 - RNA, 62 nt, Human
gcuuccuggcgcccccuaucgggggugagcgaagcccccacuacuaaauggccucucuccac

SEQ ID NO: 208318 - RNA, 62 nt, Human
uucugugcucgcagagcaggggaacaggacucagcccccaucaccguggagccaaaguguuu

SEQ ID NO: 208319 - RNA, 62 nt, Human
gcuagaagggccggugggcaccggggccgggaagcccccaccucaccaccugagggccccug

SEQ ID NO: 208320 - RNA, 64 nt, Human
uuugagaacaggauuuugagaacagcuuggacaucaugacgaaaccccaucuccacaaaaaaau

SEQ ID NO: 208321 - RNA, 64 nt, Human
gugcacugaugugugagcucuuaagaccacucagcaugacgacugaguagacuuguuuacaucu

SEQ ID NO: 208322 - RNA, 61 nt, Human
gcugccgaagaaagaaauaaaaacccugaaacaugacgagaguguuguaaaguguggaaau

SEQ ID NO: 208323 - RNA, 64 nt, Human
ccagccuggagcagagcauuggggagugucuagccaugacgagaagauucccucugcaucacgg

SEQ ID NO: 208324 - RNA, 62 nt, Human
cggcacuagaauucgccacucucccaccccccagcccccaccucugccuccaggucucaucu

SEQ ID NO: 208325 - RNA, 62 nt, Human
ggccauagcaauuccccuacaucaaaugcucaagcccccagcuggaaguuaagagaaaguca

SEQ ID NO: 208326 - RNA, 62 nt, Human
uauuuagcauuucgaacaucucggccauucaaagcccccauguucucugcacuguuuggcca

SEQ ID NO: 208327 - RNA, 62 nt, Human
ccgagcccugacuccuggacuccggaggacugagcccccaccggaacugggcuggcgcuugg

SEQ ID NO: 208328 - RNA, 62 nt, Human
ccccgaucugccuccagccccaagaugccuacagcccccaggccccuucggcagcacugccu

SEQ ID NO: 208329 - RNA, 62 nt, Human
augagaggcagcgcccgccacccuguguccacagcccccaccuucccgcuucccuuagaacc

SEQ ID NO: 208330 - RNA, 62 nt, Human
cucuucucuaccagcugccgcggcgggggcaaagcccccagagccucacuggccccggcggg

SEQ ID NO: 208331 - RNA, 62 nt, Human
cacugcguuugguuuucuuuucagaacuugggagcccccagggaggggcuaguguugguagg

SEQ ID NO: 208332 - RNA, 62 nt, Human
cucaaagggaaaccccccagucacccacugucagcccccaucugacaagaaagccuggagcg

SEQ ID NO: 208333 - RNA, 62 nt, Human
ucuguuuagcuuuuaugaagagucaccguagcagcccccacggcuggaaagaggccuguacg

SEQ ID NO: 208334 - RNA, 62 nt, Human
guggagggaaggauaaagccacuucuggcuucagcccccaccaggggaaggaaggagggcac

SEQ ID NO: 208335 - RNA, 62 nt, Human
gcagcagcgucaguggacccagugcugagaaaagcccccacaucccggaaaacccacuuucc

SEQ ID NO: 208336 - RNA, 62 nt, Human
gcagaaguacccauucaucacaccugccccauagcccccacucugcuguacugauaggauuu

SEQ ID NO: 208337 - RNA, 62 nt, Human
cagcucuguccacgcuucgauaggccugacgcagcccccagcccagggccgcccuagcaacu

SEQ ID NO: 208338 - RNA, 53 nt, Human
gcgagaucacccugcucugacccagcccccagcccuccaguaccuucugccag

SEQ ID NO: 208339 - RNA, 62 nt, Human
agggcuacccacugcuuacucagggaccaggcagcccccauggcaguaaaagcagccuagac

SEQ ID NO: 208340 - RNA, 63 nt, Human
cccuucaccugcugucccuucuuaacacccaggcccccagagccagcugggccuguccagcag

SEQ ID NO: 208341 - RNA, 63 nt, Human
uggccugcgagugaccccagcagccccucagcgcccccagagcccgucagcgugggggaaagg

SEQ ID NO: 208342 - RNA, 63 nt, Human
cacagugucugcagcugcugcccuucucccaggcccccagacagaagagacccuguuuccccu

SEQ ID NO: 208343 - RNA, 63 nt, Human
ccagguggccacuuuauggaaaggaugcagggucccccagaccccuccucuagcccagcagcg

SEQ ID NO: 208344 - RNA, 62 nt, Human
cuccggcuuccagggagaccuccccgcccagcagcccccagagacacaacaaccuaccuucc

SEQ ID NO: 208345 - RNA, 62 nt, Human
gccucaggaccuuuuggucuucagccucccucagcccccaggaucuggguuagguggccgcu

SEQ ID NO: 208346 - RNA, 62 nt, Human
cucugcuucuuugccucccucagauagaaaacagcccccacuccaguccacuccugaccccu

SEQ ID NO: 208347 - RNA, 62 nt, Human
cucaacucacccccuacacacacaugagagagagcccccacccaguuccuuggccuaggucu

SEQ ID NO: 208348 - RNA, 62 nt, Human
ucccgucagggcccacaucaucuaggcuccccagcccccacugugaaggggcuggccagggg

SEQ ID NO: 208349 - RNA, 62 nt, Human
auaaguugguccucccucugccuuuccucucaagcccccaaagagcaaaggcaacagcaaga

SEQ ID NO: 208350 - RNA, 62 nt, Human
ccacagcagucugagcuggcaggucauggagcagcccccaaagagcuguggcuggggggaug

SEQ ID NO: 208351 - RNA, 62 nt, Human
ugcugcuuacacuccagguguggaccggccgcagcccccacugaccugcccauguccagagg

SEQ ID NO: 208352 - RNA, 62 nt, Human
uggauaccaaagguuucucauguuaauuucucagcccccaaagaagcaucuuacuccugaac

SEQ ID NO: 208353 - RNA, 62 nt, Human
cuuaucauuuucucccuaggacauucccuuguagcccccagaauugucuggcccaaauugaa

SEQ ID NO: 208354 - RNA, 62 nt, Human
ggcaucccaguucuaaggcugcugcuaauuacagcccccaaccuccaacccaccagcugacc

SEQ ID NO: 208355 - RNA, 62 nt, Human
uccacaagccuaguccauccugccugagcuccagcccccagcccccacugugcccagacaug

SEQ ID NO: 208356 - RNA, 62 nt, Human
gccuaguccauccugccugagcuccagcccccagcccccacugugcccagacaugugugcuc

SEQ ID NO: 208357 - RNA, 62 nt, Human
cggggugggguggcugcagccucaggacugggagcccccagccugucagauccaggagcucc

SEQ ID NO: 208358 - RNA, 62 nt, Human
ugaaacucaccagcgagaacaaacaccuccccagcccccagcccuccccgcagugggaagug

SEQ ID NO: 208359 - RNA, 62 nt, Human
ccuuaagcuuuccaggggccggggcaguggggagcccccaucccuucacaccgccaccaacu

SEQ ID NO: 208360 - RNA, 63 nt, Human
uugaaaucgguguaguauccugagguuuuuuuccccccagaagauaaagaggauagacaaccu

SEQ ID NO: 208361 - RNA, 63 nt, Human
acagcgcagaagccccugcccacgggauccggccccccagacaccgaccccacaggccguccc

SEQ ID NO: 208362 - RNA, 63 nt, Human
aaacaugcagcccccacaccccucgucugcccgcccccagaucuucccucugugcucccugcc

SEQ ID NO: 208363 - RNA, 63 nt, Human
aggcugagucuagugccccuauuauuaacaauucccccagaacauggaaauaaccauuguuua

SEQ ID NO: 208364 - RNA, 62 nt, Human
cacaggccaacccuggcacaggucaugucugcagcccccagaauguucuggacaugcaccac

SEQ ID NO: 208365 - RNA, 62 nt, Human
gcugcccagaagagaccagcaagccaaacuggagcccccauugcaggcugucgccaugugga

SEQ ID NO: 208366 - RNA, 62 nt, Human
gcucacuucgcucgcuccgcgucccccaugccagcccccaacgcagggcgcccggcgaagcc

SEQ ID NO: 208367 - RNA, 62 nt, Human
ggaggaaauccugaagcugacccucaccuccgagcccccacucccaccccagccgcacaguu

SEQ ID NO: 208368 - RNA, 62 nt, Human
ccauggggagggaaggacuuucucccaggggaagcccccagcccugugggucauggucugug

SEQ ID NO: 208369 - RNA, 62 nt, Human
ggcugggcaagugggaaccacuaucucuugggagcccccaaaagcugggaaaugcuggagga

SEQ ID NO: 208370 - RNA, 62 nt, Human
ccaucuaagcgucgccacccuuugguuauuucagcccccaucacccaagccacaagcugacc

SEQ ID NO: 208371 - RNA, 62 nt, Human
gagcaauauacuuaaccugaaucucuacucacagcccccaccagcucugaaugucuaaccug

SEQ ID NO: 208372 - RNA, 62 nt, Human
agccguuccuccaccucucagccauaucuuucagcccccacuccccuggauccgugugugug

SEQ ID NO: 208373 - RNA, 62 nt, Human
ccagacacaacaccauguggucuggaggucccagcccccacccuaaaaagguuaucccugag

SEQ ID NO: 208374 - RNA, 62 nt, Human
gacaaguguguguguggaccauccgcaccuccagcccccaccccacccucuuugucucagcg

SEQ ID NO: 208375 - RNA, 62 nt, Human
uuucuuuugccuuugcccgccccccuguccccagcccccagagcgcagggacacccccaucc

SEQ ID NO: 208376 - RNA, 62 nt, Human
uucucacugaacuccaccgaccaacugcccuaagcccccagggccuccagggcccagguucg

SEQ ID NO: 208377 - RNA, 62 nt, Human
cccaggccucugcccucugcccacccagcgucagcccccagaaaaaaggcaauaaagacgag

SEQ ID NO: 208378 - RNA, 62 nt, Human
uccccuaggucacaacucugggaaggauacagagcccccacccuucacugaguucucuggau

SEQ ID NO: 208379 - RNA, 62 nt, Human
cuccugaccugugacccccugccacaauccuuagcccccauaucuggcuguccuuggguaac

SEQ ID NO: 208380 - RNA, 63 nt, Human
caggcuguaagucuagaauuuagauauccugaucccccagauaccgcucuucugguuauacac

SEQ ID NO: 208381 - RNA, 63 nt, Human
cgagguggggacagugagugaguucucuuaguccccccagagcugguuguuaaagagccuggc

SEQ ID NO: 208382 - RNA, 63 nt, Human
uccgguuggggguccccaggguggggcagggaucccccagaucugucuggucugaauggacgc

SEQ ID NO: 208383 - RNA, 63 nt, Human
aaucacuagaccggacuugaggcacgcggugcacccccagacgcuggcgcuccaccgugcucg

SEQ ID NO: 208384 - RNA, 62 nt, Human
cccugcggguaucccggggggcacuggaugcgagcccccaggucugacguccuugggggugg

SEQ ID NO: 208385 - RNA, 62 nt, Human
gagccugcagucacuggcuuggcuuuacuuugagcccccaaccccccucucccagcccuggu

SEQ ID NO: 208386 - RNA, 62 nt, Human
gccaagggccauggggaagauggagcaaaccuagcccccaagccggugggcuagaaaguaca

SEQ ID NO: 208387 - RNA, 62 nt, Human
aaggguuuuaaagcccaugccccaacucugccagcccccaccugccaggacguucuagcagg

SEQ ID NO: 208388 - RNA, 62 nt, Human
ugggaagcagcuccugcugggagcauggccucagcccccagcaucuccuggggcccccaugg

SEQ ID NO: 208389 - RNA, 62 nt, Human
caaggugcuagaccaaugggcugcaguauuauagcccccaggccuggcaggcaugcgcuggg

SEQ ID NO: 208390 - RNA, 62 nt, Human
cuguuaagacuccugacccccaaguggcaugcagcccccaugcccaccgggaccuggucagc

SEQ ID NO: 208391 - RNA, 62 nt, Human
uggggagaaacaggcccuccuuguccuugugcagcccccacuuuuguccuggcugugggugg

SEQ ID NO: 208392 - RNA, 62 nt, Human
ccuggcccuuucaguuuuauaaguugguuuccagcccccaguguccugacuucugucugcca

SEQ ID NO: 208393 - RNA, 62 nt, Human
ccuaaggcguccucgagaugaagacgggggggagcccccagccagguggagaccccgcaggg

SEQ ID NO: 208394 - RNA, 62 nt, Human
guguggagggaaaugcccuggucuggccuccgagcccccagguccaccgucuccccuccccu

SEQ ID NO: 208395 - RNA, 62 nt, Human
ccucagcgguuagccugacucuucuuccccccagcccccacccacugcuguguugugugugc

SEQ ID NO: 208396 - RNA, 62 nt, Human
cggccucccaaaguacugggauuacaggcgugagcccccacgcuggccugcuuuacguauuu

SEQ ID NO: 208397 - RNA, 62 nt, Human
gggagcuugggcauccuccuccagccuccuccagcccccaggcagugccuuaccuguggugc

SEQ ID NO: 208398 - RNA, 62 nt, Human
caccgugcccagccccucaguagguuuuaaggagcccccagcccuccucccuucugggcccg

SEQ ID NO: 208399 - RNA, 62 nt, Human
aacucagggccgcugugagcaaagcugaccccagcccccacccccaguuaacacugcugcuu

SEQ ID NO: 208400 - RNA, 64 nt, Human
uucucccggaggaccuuuccuuggggcccugcuucaugacgaugcugccugugucacccucuac

SEQ ID NO: 208401 - RNA, 64 nt, Human
ggauucucugaaagugcugauggcuggauccaaucugguacaguuuguuaaaagcagcguggga

SEQ ID NO: 208402 - RNA, 64 nt, Human
agaacuccagucccaaacuaaucugucagguucacugguacauaaauaccuaggaaauauuuuu

SEQ ID NO: 208403 - RNA, 62 nt, Human
cccagcaaguccucuggcaagccggaggacgcagcccccaagaccagcggacagcgccagaa

SEQ ID NO: 208404 - RNA, 62 nt, Human
ccgcgccucugccggacacggaccggccccucagcccccaccgaggacgcagccacuggggg

SEQ ID NO: 208405 - RNA, 62 nt, Human
cccccuacccaauucugagcacacgguacuguagcccccaguuccucccuagccuuccaucc

SEQ ID NO: 208406 - RNA, 62 nt, Human
gguacccccaggaccagaagcucccccagcaaagcccccagagcccaggcucggccugcccc

SEQ ID NO: 208407 - RNA, 62 nt, Human
ugacgagugaugccaggaagccaggccaccgaagcccccacccuacccuuauuccaugaaag

SEQ ID NO: 208408 - RNA, 62 nt, Human
cuccacuuaccccaccccacccuugggcuaaaagcccccaggcgggcagggggugaccccug

SEQ ID NO: 208409 - RNA, 62 nt, Human
gcacugucuuccuggccggggccugaaaccuuagcccccagccggccugagugggggauauu

SEQ ID NO: 208410 - RNA, 62 nt, Human
ugaagugccaacgcccuccccacccugggccgagcccccaccccucccugggcccccaagug

SEQ ID NO: 208411 - RNA, 62 nt, Human
ggcuccgcaggugaggagcccauggggcgggcagcccccagaaagcgggcagcaggccccga

SEQ ID NO: 208412 - RNA, 62 nt, Human
caccccuagcucagccagauccuuacacguggagcccccagcaugggaaugaggggcucugc

SEQ ID NO: 208413 - RNA, 62 nt, Human
cuccugacuuuacguuggccccuccucugccaagcccccaggggagcccucccuggcguccg

SEQ ID NO: 208414 - RNA, 62 nt, Human
gaggccggcuggagccaggcccccucgcacgcagcccccaaaucauggacgcaccugugggg

SEQ ID NO: 208415 - RNA, 62 nt, Human
gagagcucagaguuucugggguccucauuaggagcccccaucccuguguuccccaagaauuc

SEQ ID NO: 208416 - RNA, 62 nt, Human
cggggggaccgggugagccagugacccccuguagcccccagcuucaggccucagugucugcc

SEQ ID NO: 208417 - RNA, 62 nt, Human
ccuuguagggaggccucuacacagaagaaagcagcccccaugucccagccacuucugggucc

SEQ ID NO: 208418 - RNA, 62 nt, Human
aucugagaggaggcugcugggccuucggggugagcccccagagcuggaccugagcuauucuc

SEQ ID NO: 208419 - RNA, 63 nt, Human
agagagaagggaaggggaguguccccagccaaccccccagaaacggccuuuuuuccugccucu

SEQ ID NO: 208420 - RNA, 63 nt, Human
ccagcgugcagccuugccucggaggccagcccacccccagaagccaggaagcccccgcgcugg

SEQ ID NO: 208421 - RNA, 63 nt, Human
ggggagccuaggcccagcuccuccgcgguuggccccccagaccauaccucugacccacccagc

SEQ ID NO: 208422 - RNA, 63 nt, Human
ccugccacagggcacuggaauggacagcaggcgcccccagaugcagguaccucccuugguccc

SEQ ID NO: 208423 - RNA, 62 nt, Human
cuaggcugaccccauccuccucucccuccaggagcccccagcauguccugaccugugcacgg

SEQ ID NO: 208424 - RNA, 62 nt, Human
ccccgggacccagcagagcugggggagggaucagcccccaaagaaaugggggugcaugcugg

SEQ ID NO: 208425 - RNA, 62 nt, Human
ugaugggggugggcagggggccaguugagccaagcccccagccccgaucugcagauccugcc

SEQ ID NO: 208426 - RNA, 62 nt, Human
gcugcuccuguggguugauggagcgucccugaagcccccagcccuggggauggggaaggaca

SEQ ID NO: 208427 - RNA, 62 nt, Human
uuagaaugccacagucccccaacccuccacagagcccccagacccaccagaacuuccacaga

SEQ ID NO: 208428 - RNA, 62 nt, Human
ucuggccuccuaaggcuccccaccccgaaaucagcccccagccuuguuucugaugacagugu

SEQ ID NO: 208429 - RNA, 62 nt, Human
ggcagggacuguggcagcuuauguccaaagggagcccccaugcacaggaagccacaggguuc

SEQ ID NO: 208430 - RNA, 62 nt, Human
ccccuccgcagccccuucccuugcucggggaaagcccccaauucugcccacacccauuuauu

SEQ ID NO: 208431 - RNA, 62 nt, Human
agacugagcccugcuggcggacuucaaggagaagcccccacaggggauuuugcuccuagagu

SEQ ID NO: 208432 - RNA, 62 nt, Human
guagggguggggaccggggagcaccugccuguagcccccaucagacccugccccaagcacca

SEQ ID NO: 208433 - RNA, 62 nt, Human
guggggucagugcuugggagccuguggccagcagcccccacugcaccccugcccccagguga

SEQ ID NO: 208434 - RNA, 62 nt, Human
acccagcgaggaggggcgggggcaggggcugcagcccccagcgcugccuuugcggauucugu

SEQ ID NO: 208435 - RNA, 62 nt, Human
ucacuccgcuggugacuucguaccugcucaggagcccccacugucccagucccacucaggcc

SEQ ID NO: 208436 - RNA, 56 nt, Human
gcccuggugauggccccugaggcuggagcccccauggccagcccagccuggcucug

SEQ ID NO: 208437 - RNA, 62 nt, Human
cuacggguggguucauuggccugggcccagcgagcccccaccugcauugaccuuaggcccau

SEQ ID NO: 208438 - RNA, 62 nt, Human
cuccuggaacuucugccuccaccucgcuggggagcccccagggcugcuguggccacagcccu

SEQ ID NO: 208439 - RNA, 63 nt, Human
uuguggguuaugaggacacagaagucccugaggcccccagaccuggcucagccaaccuccuuc

SEQ ID NO: 208440 - RNA, 63 nt, Human
gacuguuaaaagcagguuucuguacuuaagagucccccagaccuccugugaggugaggcucug

SEQ ID NO: 208441 - RNA, 63 nt, Human
cuaaauugcugcucuggaauaaggugauuucugcccccagauucuucccuagccgguagauac

SEQ ID NO: 208442 - RNA, 63 nt, Human
uucacucuaauuauaaacagggaguguaaacugcccccagauguuccugggcuggguaaaagc

SEQ ID NO: 208443 - RNA, 62 nt, Human
ggcaggaccugugagagccaccucacaggcagagcccccaccaggcagggcaaggagacucc

SEQ ID NO: 208444 - RNA, 62 nt, Human
ugccugaguugugugcauccaggggccuggugagcccccaggcugguggcauggccccccug

SEQ ID NO: 208445 - RNA, 62 nt, Human
ggcuggucaggcggaugaggucccuacucccgagcccccagccucacccacugcagggccag

SEQ ID NO: 208446 - RNA, 62 nt, Human
gcugagcacagaccagcagcgaccucccuuccagcccccagaaagcucggucacuugagugu

SEQ ID NO: 208447 - RNA, 62 nt, Human
ccuccuccacucccuuuuuguaacucccuuacagcccccagacccuucuugaaacgagagcc

SEQ ID NO: 208448 - RNA, 62 nt, Human
ugcucuuagaaacacuaauguuccucuggggcagcccccaccuccguccugacccgacgggg

SEQ ID NO: 208449 - RNA, 62 nt, Human
ccguggagcuguggaauugggccccguggcagagcccccaucccuugggggcuguggggaug

SEQ ID NO: 208450 - RNA, 62 nt, Human
cacaccucuaggucgccagagcccuggcccccagcccccagcaagccugagcccgggaagaa

SEQ ID NO: 208451 - RNA, 62 nt, Human
gggccaggacugcgcucaggaucccgccccggagcccccagcccgggggagagggggaggga

SEQ ID NO: 208452 - RNA, 62 nt, Human
uucuaaguuuuauuuuucaaaccaccccggacagcccccagcucugauuccuucaaggcccg

SEQ ID NO: 208453 - RNA, 62 nt, Human
ugaccuuguauuuaugaggccucugugaggccagcccccaccuuccucuuucccaccugucc

SEQ ID NO: 208454 - RNA, 62 nt, Human
ggguauggaaagaggggcucacgcuuaacuccagcccccacccacacccccaucccacccaa

SEQ ID NO: 208455 - RNA, 62 nt, Human
uccucaguaagguuuuccauuuaaugaaaagcagcccccaaaaucauuuucuuuucuaacaa

SEQ ID NO: 208456 - RNA, 62 nt, Human
acugcgaugggggucaccaggugaccagugggagcccccaccccgagucacaccagaaagcu

SEQ ID NO: 208457 - RNA, 62 nt, Human
cuuaggggugaccugggcccaagucucucaucagcccccaauccccuggguaccaggcuucu

SEQ ID NO: 208458 - RNA, 62 nt, Human
ccaggggcggaggugggugucccccaggucucagcccccaaggcugcccccucagcagaggc

SEQ ID NO: 208459 - RNA, 63 nt, Human
agugacacguggacaaaugcgggcucaucagcccccccagagagggucaggccgaaccccauu

SEQ ID NO: 208460 - RNA, 63 nt, Human
cugaguccagcuccccccaagaugagcugcagccccccagagagagcucugcacgucaccaag

SEQ ID NO: 208461 - RNA, 63 nt, Human
aagaggacugagaauacuuuggcuuaaauuuugcccccagaaucuuguuguuugccuacugaa

SEQ ID NO: 208462 - RNA, 63 nt, Human
auuuucauguguacaccucuuugccuguucccacccccagacuugaaauaacacuucagagua

SEQ ID NO: 208463 - RNA, 62 nt, Human
agggcuccuguggggaggccuuggccugugacagcccccaggccugggggcacagauccccc

SEQ ID NO: 208464 - RNA, 54 nt, Human
augcccggggugagguguaggcagagcccccauacggggagcuuggcagaaggg

SEQ ID NO: 208465 - RNA, 62 nt, Human
agcggaacacccugccccagggccggacuuccagcccccagagcccucucccugucacuccc

SEQ ID NO: 208466 - RNA, 62 nt, Human
ggagcaggucacaggucaccauggggaauucuagcccccacuggggggauguuacaacacca

SEQ ID NO: 208467 - RNA, 62 nt, Human
gcuacaucccuugcccccuguccauuuauuuaagcccccauaggugcccuucacccccaaaa

SEQ ID NO: 208468 - RNA, 62 nt, Human
ucccaccccaaacuccaaccuguaucagaugcagcccccaagcccuuagacucuaagcccag

SEQ ID NO: 208469 - RNA, 62 nt, Human
cccugccugcucucuuucccuacaacuaggucagcccccagccccgcuacggcggccgcacc

SEQ ID NO: 208470 - RNA, 62 nt, Human
uagccuaucuccugugccccugacugagcagaagcccccacagcuggccagcagccccgccu

SEQ ID NO: 208471 - RNA, 62 nt, Human
gagcaguugcuucaggcguuuucuccccaccaagcccccacccuugcugugucaccaucacu

SEQ ID NO: 208472 - RNA, 62 nt, Human
gcuugucuagccccccugcugggugcuuguucagcccccacucugggcuguggagugggugg

SEQ ID NO: 208473 - RNA, 62 nt, Human
gcccaggucaggaguguuuucuuggugguuccagcccccaucaauugaacuguuucugggcu

SEQ ID NO: 208474 - RNA, 62 nt, Human
cucuugcaauccacaaucugacauucucaggaagcccccaaguugauauuucuauuuccugg

SEQ ID NO: 208475 - RNA, 62 nt, Human
ugcuucuggauucaugggugaguucccugggcagcccccaggaaggccuuccagaucuggcu

SEQ ID NO: 208476 - RNA, 62 nt, Human
ucauccaugcgugcacauaugggugcuggcagagcccccaaggacucuggccucucgaguuc

SEQ ID NO: 208477 - RNA, 62 nt, Human
ggccauggguccuugcccccgacagacagagcagcccccacccgggagccuugauggggguc

SEQ ID NO: 208478 - RNA, 62 nt, Human
ucccucccaccacccucgccgcaggcagcugcagcccccagaggggaccacaagcccaaaaa

SEQ ID NO: 208479 - RNA, 63 nt, Human
uuuagauaccuuguugccaugguuugaaugugccccccagauuucaugugugugaaacuuaau

SEQ ID NO: 208480 - RNA, 63 nt, Human
guuaggccucccagguccuuaggaucaggguugcccccagaaccccuucccauauccuccauu

SEQ ID NO: 208481 - RNA, 63 nt, Human
uggggagguggggaagauucgggcaugugagugcccccagaacuguccuggcuccuuccguau

SEQ ID NO: 208482 - RNA, 63 nt, Human
ugugcaugcugguggccucagggacccucauaacccccagacucagagcccgagagcccuucc

SEQ ID NO: 208483 - RNA, 62 nt, Human
ggccagcacagaggggccuuccucccccacagagcccccaugacauagucugcucugggcgg

SEQ ID NO: 208484 - RNA, 62 nt, Human
cagcugaaucucucugaccauuccucuacuggagcccccaaugaaagccgcaaaccuauacc

SEQ ID NO: 208485 - RNA, 62 nt, Human
cccacccugucuucuccccuaggugguuccugagcccccacccccaaucccagugcuacacc

SEQ ID NO: 208486 - RNA, 62 nt, Human
aagguccagccuaggcccccugcaaggcuggcagcccccacccccaccccccaggccgccuu

SEQ ID NO: 208487 - RNA, 62 nt, Human
cugagguuggcgucuuccuacgucccagaagcagcccccaccccacacaugacccacaccgc

SEQ ID NO: 208488 - RNA, 62 nt, Human
aggaacauuuccucaguguagccuaacaaugcagcccccaaucuguuccuuuuuuuuuuuga

SEQ ID NO: 208489 - RNA, 62 nt, Human
aucggcggauugucugaaugacacauauacagagcccccacggauuucugcacacucugggu

SEQ ID NO: 208490 - RNA, 62 nt, Human
gccuaagggaccccugcucccagccugcugagagcccccaccuugaucccaauccuuauccc

SEQ ID NO: 208491 - RNA, 62 nt, Human
uucccuccuugucuggccccaguggucuggggagcccccaggcacaccuaagcgucguggag

SEQ ID NO: 208492 - RNA, 62 nt, Human
ccgagccugcuaccugguugccaaccuucccuagcccccaaaccgaagccaucugccaaauu

SEQ ID NO: 208493 - RNA, 62 nt, Human
uggacaacuggccuggccgcucccauccuguaagcccccaccacggggagacccucaucccu

SEQ ID NO: 208494 - RNA, 62 nt, Human
gcagcgagcuggucuggcgagggcaccucggcagcccccacggguuggcuccuacguuugcg

SEQ ID NO: 208495 - RNA, 62 nt, Human
uuuucaggaagaaagggaaauugcagccccucagcccccaggauugaccucuggggagugau

SEQ ID NO: 208496 - RNA, 62 nt, Human
uucugaggccagccaugcccacgccccuccccagcccccacccaugccagcgcagcgccagg

SEQ ID NO: 208497 - RNA, 62 nt, Human
ggauggccggagaggaccggcggcucggaggaagcccccaccgugggcagggagcggccggc

SEQ ID NO: 208498 - RNA, 62 nt, Human
caugggcacuacucuucaugugcggugacaccagcccccagaugccuugaauuaaguguccu

SEQ ID NO: 208499 - RNA, 63 nt, Human
caaugagagaccaggaguagguccuaucagugccccccagaguagagagcaauaagagcccag

SEQ ID NO: 208500 - RNA, 64 nt, Human
acuuggaaaggauuuaccguucugcaacaacggacugguacauacaggaugaucacaaugguaa

SEQ ID NO: 208501 - RNA, 64 nt, Human
cccgugccuuagacuucucccgacccccagagcgcugguacacaggucuaggcaccacacagug

SEQ ID NO: 208502 - RNA, 64 nt, Human
uaaggcagaggaugggaugugguggggcagggaucugguacagacauaggcgcuuccuuccagg

SEQ ID NO: 208503 - RNA, 62 nt, Human
aaagcaacgggaaaugugguccuauuuaagccagcccccaccuagggucuauuuguguggca

SEQ ID NO: 208504 - RNA, 62 nt, Human
ggacucccagacugcaggggagcacuuggggcagcccccagaaggaccacugcuggauccca

SEQ ID NO: 208505 - RNA, 62 nt, Human
guucuggucucagccgcucccuuggcagcugcagcccccaugcagaagaggcucccaggccc

SEQ ID NO: 208506 - RNA, 62 nt, Human
ggacuguucccgacccggagacgcggggccacagcccccagcugacccuaauuuauucucag

SEQ ID NO: 208507 - RNA, 62 nt, Human
caucacccagcaccccagaucaccgccaggccagcccccaaugguccccuuacggacagguc

SEQ ID NO: 208508 - RNA, 62 nt, Human
cuggcaccaaagagcuugggcccgugcugaccagcccccaaggcccucuggccggaccaugc

SEQ ID NO: 208509 - RNA, 62 nt, Human
ccagaggcccacauggaugccacuccccacacagcccccaggccugcccagcccaccuccuc

SEQ ID NO: 208510 - RNA, 62 nt, Human
ccgggggcuucuugccucaguucuucccucugagcccccaggcccucccgcaucucagguug

SEQ ID NO: 208511 - RNA, 62 nt, Human
ggaaggaggaagggcugaccuggguucucuccagcccccaggugcgccgggucacccgugcc

SEQ ID NO: 208512 - RNA, 62 nt, Human
gcuggcccgggccaugggcugcgcaaaucaccagcccccaacccagggaggaacuggccccu

SEQ ID NO: 208513 - RNA, 62 nt, Human
gccagggggguggggggccgcccucaucaggcagcccccagcccccugaggcccuguccauc

SEQ ID NO: 208514 - RNA, 62 nt, Human
gaucuggggcuuccuggccuggccagagcuggagcccccacaggguaaggaagagagagugg

SEQ ID NO: 208515 - RNA, 62 nt, Human
ggucagcagagcuucagagguggccccaccugagcccccacccgggagcaguguccugugcu

SEQ ID NO: 208516 - RNA, 62 nt, Human; identical to SEQ ID NO: 208505

SEQ ID NO: 208517 - RNA, 62 nt, Human
guucgauucugccucuguagcucaaggggggcagcccccagaguccugugcauucugccaag

SEQ ID NO: 208518 - RNA, 62 nt, Human
caugcagagcccuggccgcuggagacucuuaaagcccccacagcccuccagguccuccagcu

SEQ ID NO: 208519 - RNA, 63 nt, Human
ucccugcccccugugacggagggggcaagcaagcccccagaggcugugucucuggacagacgg

SEQ ID NO: 208520 - RNA, 63 nt, Human
gaggucauaauaucccucuaggacuuaccuguucccccagaucuugccuugggaccacauuug

SEQ ID NO: 208521 - RNA, 63 nt, Human
aaucuuaacuaccuacccaaaggauuugcauuacccccagauucugugccaacaaccuuuuaa

SEQ ID NO: 208522 - RNA, 63 nt, Human
gaggaccgaggcuacagcuccacacgccccggucccccagagcaucugccccagguacaccuc

SEQ ID NO: 208523 - RNA, 62 nt, Human
cagcucgaagaccauccuggccauagcagccaagcccccauucccagagcagacccucuccc

SEQ ID NO: 208524 - RNA, 62 nt, Human
gggugagacagcagggcccaggggaguggaccagcccccagcaaauuaucaccaucugugcc

SEQ ID NO: 208525 - RNA, 62 nt, Human
ugucccaguuuaucaggaacgcaggccuggggagcccccaguggcggggacagggccagauu

SEQ ID NO: 208526 - RNA, 62 nt, Human
cuguuccagaggugcagacaagagguggcgagagcccccaucaugccccucaaccuaucccg

SEQ ID NO: 208527 - RNA, 62 nt, Human
gugccaauaaccucauucuuugucugagaaacagcccccaguccuccuccacuacaaccucc

SEQ ID NO: 208528 - RNA, 62 nt, Human
ucccugagggccugccgggcugccucugccccagcccccagcaagggcacucccaggcuucc

SEQ ID NO: 208529 - RNA, 54 nt, Human
uugaccaucucgggaagugaggagagcccccauuggaccaguguuugcuuaggu

SEQ ID NO: 208530 - RNA, 62 nt, Human
ccacugcaucucacugggccagcagcccccccagcccccagccuugguggggaccaagcagc

SEQ ID NO: 208531 - RNA, 62 nt, Human
aaagcauuugcccaucugccuuucuuucccccagcccccacccgcuuugaauguagagaccc

SEQ ID NO: 208532 - RNA, 62 nt, Human
cagaagcacagacacuacagaccacagcauucagcccccauggaguuuggugugcuugccuu

SEQ ID NO: 208533 - RNA, 62 nt, Human
cagccccggcccucgacaguauugaggccccgagcccccagcacuuguguguacagcccccg

SEQ ID NO: 208534 - RNA, 62 nt, Human
acaacgagcagaaggcccuggcgacugggcugagcccccaagugaaacugagguucaggaga

SEQ ID NO: 208535 - RNA, 62 nt, Human
cggcuggagggaugccacaccccucacagggcagcccccaacuacaucuucccugcuuacuc

SEQ ID NO: 208536 - RNA, 62 nt, Human
acacugaggccaggucuaccccccaucauaccagcccccaggaccacuaccccacggccagc

SEQ ID NO: 208537 - RNA, 62 nt, Human
uaauguagccaugggaccaaaccuagccccuuagcccccacccacuucccugggcaaaugaa

SEQ ID NO: 208538 - RNA, 62 nt, Human
gagcaccucgcucuggugcccgucugugugggagcccccacuguaacacucuaauaaaucag

SEQ ID NO: 208539 - RNA, 63 nt, Human
cagcagcuccgcucccggcgccacccaccgacacccccagaacccucugggggccugcccagg

SEQ ID NO: 208540 - RNA, 63 nt, Human
aaggaauccucugggagcuucuuccguuucuuccccccagauacccaucuugaaaaacacuau

SEQ ID NO: 208541 - RNA, 63 nt, Human
uccuggggcagagccuccggcacccaguggccucccccagacagagccaccccugccguggga

SEQ ID NO: 208542 - RNA, 63 nt, Human
gauuggcaagaaacagggugucuuggagguggucccccagaucugcgccugggggucaggaca

SEQ ID NO: 208543 - RNA, 62 nt, Human
agggaggccaucuggggcuccuucuccaccccagcccccaaagcagcccuucccccagugcc

SEQ ID NO: 208544 - RNA, 62 nt, Human
uuuuggucccagagcugggguauguuggccccagcccccagccuguggcucccaaaaggccu

SEQ ID NO: 208545 - RNA, 62 nt, Human
uugggcccugcagggggaggggugacagggcgagcccccaccccagcagcagcaauaccccc

SEQ ID NO: 208546 - RNA, 62 nt, Human
gccagccccaaacuaagauaucccucacacccagcccccauuaccuagggacaagagucuuc

SEQ ID NO: 208547 - RNA, 62 nt, Human
aggcugcucagaggggccccgguccuggccccagcccccaccuccgccccagacacaccccc

SEQ ID NO: 208548 - RNA, 62 nt, Human
ccagcagcccucucuucccccaccuccccagcagcccccacccuugccccagcugggcucca

SEQ ID NO: 208549 - RNA, 62 nt, Human
gacaagaccuagaggguuugggacaaacugggagcccccaccccacacucuaguugcccaug

SEQ ID NO: 208550 - RNA, 62 nt, Human
guacuauucauugauucagugaugugaaauugagcccccaaaagguuguuucugaagcucga

SEQ ID NO: 208551 - RNA, 62 nt, Human
ucaugaaugauaagcuguuucugagggaugccagcccccaagagacucagagugccuucucc

SEQ ID NO: 208552 - RNA, 62 nt, Human
agauguggaggcccagggaauagacccucaagagcccccaagagacaggagagacuccgaac

SEQ ID NO: 208553 - RNA, 62 nt, Human
gaagugcccuccagccucagagcuagccacaaagcccccagagcugaauucauugaguauuu

SEQ ID NO: 208554 - RNA, 62 nt, Human
gggaaucgcuguguuauuugcaaagaaaaaacagcccccacuccuccuccugaguuccaggg

SEQ ID NO: 208555 - RNA, 62 nt, Human
uccaguuucuuaaggaaaccacuggaaucugcagcccccacaugcaucugucuaacgcaugc

SEQ ID NO: 208556 - RNA, 62 nt, Human
gccuccuguagcccgccucaugcacugaccacagcccccaggggaggaugguacuggaucug

SEQ ID NO: 208557 - RNA, 62 nt, Human
gugcccugagucuggggcccgugccagccggcagcccccaagccugccccgcuacccaagca

SEQ ID NO: 208558 - RNA, 62 nt, Human
ugaggccucugggucaagcuuucaucagccccagcccccacacuccaccaaaguucucaugc

SEQ ID NO: 208559 - RNA, 63 nt, Human
ggccccggggcaaagaggggugcagagggaguucccccagaucaguaccccccaccccucccc

SEQ ID NO: 208560 - RNA, 63 nt, Human
cagagcaccucccagccaccguccccucaagagcccccagaacgagacccuguacucugucuu

SEQ ID NO: 208561 - RNA, 63 nt, Human
cugccagccccggcauccuggaagucccgacuccccccagaccugccagccccggcguccugg

SEQ ID NO: 208562 - RNA, 63 nt, Human
gagggugaguguggucagaguaaagcugcuccacccccagauugcaaugcuaccaauaaagcc

SEQ ID NO: 208563 - RNA, 62 nt, Human
agugaugcggccacaagcccagggacaccuggagcccccaggagcugggagaggcaggaagg

SEQ ID NO: 208564 - RNA, 64 nt, Human
gaugaauauggaacaucuccuauguaccaggcacugugcuaagugcuggaauacauuaucucau

SEQ ID NO: 208565 - RNA, 63 nt, Human
uggcgggaaaacacugacugacuccuuggguuucccccagacauacuuucagagcgcuagcug

SEQ ID NO: 208566 - RNA, 63 nt, Human
cugcaggaacugaaaacaucagccauggccaggcccccagaagacaaaagaagggaccaggga

SEQ ID NO: 208567 - RNA, 63 nt, Human
uaucucagaacagaagucaucagaucaucagagcccccagauggcuacagaccagagauucca

SEQ ID NO: 208568 - RNA, 64 nt, Human
agguccaaaauaacuuguuuuuaaaguuugcccuugugcuaaagugccaguguauguauguuau

SEQ ID NO: 208569 - RNA, 64 nt, Human
gguguuuauugagcuguugcucuuuggcaagcucugugcuaagaacuuuguauacaucaucuca

SEQ ID NO: 208570 - RNA, 64 nt, Human
uaauuuaugagcuuuuccaucucugcugcagaccugugcuaaugcuuagugugugucacaauuc

SEQ ID NO: 208571 - RNA, 64 nt, Human
uuaaguacagauaaaagcuauugugugaguauauugugcuaaaaucauagaaauaaagauuaga

SEQ ID NO: 208572 - RNA, 64 nt, Human
aaaacaaaagaaggaaaacuguaggggggaguaaugugcuaaguaagcagaauugccucaaaaa

SEQ ID NO: 208573 - RNA, 64 nt, Human
aaaaaaacacaaagugcuucugugagaccaauuuugugcuaaugagcauugagacugaugcuuu

SEQ ID NO: 208574 - RNA, 64 nt, Human
aggaggaggaggaggaaggcaaagccccuggaaaugugcuaaaguuggaaaguccccguccccc

SEQ ID NO: 208575 - RNA, 64 nt, Human
uguaggaaacagccagaagccaacuggaauuuugugugcuaacuguucccagacagcagagcaa

SEQ ID NO: 208576 - RNA, 64 nt, Human
cagcuaacggauuauauacuucaggguuuggcuuugugcuaaaugugguuuuguguuuugcugu

SEQ ID NO: 208577 - RNA, 64 nt, Human
uguacuauugguguguuggugaauuuuuaaacugugugcuaacugcaauaaauuauaugaacug

SEQ ID NO: 208578 - RNA, 64 nt, Human
cuauacuuuuugggaagucuagagauguauauaaugugcuaaauucaaaguagcaaaucugaag

SEQ ID NO: 208579 - RNA, 64 nt, Human
auuuucaagcacucaguguucugccucuggcagcugugcuaacagcucagugcuguccugggag

SEQ ID NO: 208580 - RNA, 64 nt, Human
uuuaacacagcuauccaguaaggcuaucaugaugugugcuaaaauuuuauuuacuugaauuuug

SEQ ID NO: 208581 - RNA, 64 nt, Human
uuucuagguguuugcaauguacaaauaauacagcugugcuaaucucacauuuagccaugauaga

SEQ ID NO: 208582 - RNA, 63 nt, Human
gcuccauggaggaggugucccaagcuuugaauacccccagagaccuuuucucucccauaccau

SEQ ID NO: 208583 - RNA, 63 nt, Human
uuaugaaaaaaaaauagcaaauuaguucuuuuucccccagaggggaaaguuauguucugcaaa

SEQ ID NO: 208584 - RNA, 64 nt, Human
uuuuugucaguuacaguccuagauauacuuacugcugguacaguuguacucuaagauugguauu

SEQ ID NO: 208585 - RNA, 64 nt, Human
auaagaaauggaaucauuuggcugccucgucacuugugcuaauggucaguuguacacacaugac

SEQ ID NO: 208586 - RNA, 64 nt, Human
cccuuuccccucccacaauaagaccauuuaagugugugcuaaacaacuacggaauacuaaauaa

SEQ ID NO: 208587 - RNA, 64 nt, Human
gcaaauuuguauuaaauguauacagacuuccaagugugcuaauucuuuaccuccuaaacuuuua

SEQ ID NO: 208588 - RNA, 64 nt, Human
uuuucuuguuggccauuucuguauugcuggcaucugugcuaagcuuuacaguggcaaaaauaau

SEQ ID NO: 208589 - RNA, 64 nt, Human
ucugucuguuuuucuuuuuuugcuuuguuuuguuugugcuaauuugggaauuguguacuccgaa

SEQ ID NO: 208590 - RNA, 64 nt, Human
uaaugugguauaacuguuccgcugccuucuugucugugcuaauauaaauacugaguaccagcau

SEQ ID NO: 208591 - RNA, 64 nt, Human
guugcucugcaacucacccugcaucuccaagggcugugcuaagcagcuguguuguccccccggg

SEQ ID NO: 208592 - RNA, 64 nt, Human
gcacuuuaggcagacaccagcuguuugcaaacaaugugcuaauaugcaaaugaugugcuuauua

SEQ ID NO: 208593 - RNA, 64 nt, Human
cucagugaacuaauacacagcuugagcguuuccaugugcuaauguugcacacuuacuaaaaaac

SEQ ID NO: 208594 - RNA, 64 nt, Human
ugggacggcuccugcuuuuggggcucuugaucagugugcuaaccucacugccucauggcaucau

SEQ ID NO: 208595 - RNA, 64 nt, Human
ucugcuugcugugccuuguuauggcugcuuuuuuugugcuaauaaaguauguuugguguucucc

SEQ ID NO: 208596 - RNA, 64 nt, Human
aaauguguuugaguuuauguaagcauguauacacugugcuaaaagucacauguuucaguuugug

SEQ ID NO: 208597 - RNA, 64 nt, Human
cucugaauuuaguaugauauaaagaaaacuuuuuugugcuaaaaauacuuuuuaaaaucaauuu

SEQ ID NO: 208598 - RNA, 64 nt, Human
cuaaucacuucuucaauucuuuuugcugcaguucugugcuaaaaugggguugugguuaagugaa

SEQ ID NO: 208599 - RNA, 63 nt, Human
ccaggggagaggagagcugugagagcaccggcacccccagaagacucugcuucuuagcccaca

SEQ ID NO: 208600 - RNA, 63 nt, Human
gucuacauguuugcuuagaggcggcuccaagagcccccagagcugccugcauagcacaccuua

SEQ ID NO: 208601 - RNA, 63 nt, Human
uagcuuuuagcuauaaaccacucaaagauucagcccccagaucccacagucagaacugaaucu

SEQ ID NO: 208602 - RNA, 64 nt, Human
aggagggaaguguuacuugugcuauaacugcuuuugugcuaaauaugaauugucucaaaauuag

SEQ ID NO: 208603 - RNA, 64 nt, Human
ugugccaguuaaucauaggaucccauuaaauaagugugcuaacaucgaauauagagaaaacugg

SEQ ID NO: 208604 - RNA, 64 nt, Human
agagacugucaugcagauaguauaauuugguauaugugcuaaugcauugaguagaggauuauuu

SEQ ID NO: 208605 - RNA, 64 nt, Human
cacauggaucgaacacucaugaugugccaagugcugugcuaagugcuuuacgaacauucgucau

SEQ ID NO: 208606 - RNA, 64 nt, Human
auaugcugauuaaguuauuuacugggccagucauugugcuaaauaguugcucuuuuguguuuca

SEQ ID NO: 208607 - RNA, 64 nt, Human
uugaaaauugaaaaguacaacuaacgcaaccaagugugcuaaaaaugagcuugauuaaaucaac

SEQ ID NO: 208608 - RNA, 64 nt, Human
caccuuuccuaauuggcaaaugaucagacuaaugugugcuaauguuuuucuuccaugcuuucag

SEQ ID NO: 208609 - RNA, 64 nt, Human
uaaggggcuaugaaguaaauaugcugcaguuaauugugcuaaguuaaaauacaguuuaguuauu

SEQ ID NO: 208610 - RNA, 64 nt, Human
caucuuaacuuggcuaacauagcacaguauuuacugugcuaaugggcugcugucauuuuaugcu

SEQ ID NO: 208611 - RNA, 64 nt, Human
auuauuuagguagauguggcauguugguuuuuuaugugcuaaccuaacuguaaugaccuuuucu

SEQ ID NO: 208612 - RNA, 64 nt, Human
uaacaauggcuaaugauaauuuagcuuuauuauaugugcuaagcacucugguuuuacaugcauu

SEQ ID NO: 208613 - RNA, 64 nt, Human
gagaaacuuccuagggggcuaagacuuccuagacugugcuaagagaugucauggugcucauuuu

SEQ ID NO: 208614 - RNA, 64 nt, Human
uggccaaaacaccugauuuuuaaaugguagcaauugugcuaaauaaaauguguaaaaauuuuaa

SEQ ID NO: 208615 - RNA, 64 nt, Human
gauuguuauuauauuauuauuuuauuuuaguuguugugcuaaacucaauaaugcuguucuaacu

SEQ ID NO: 208616 - RNA, 63 nt, Human
ugggacaccaggccugacucaggcagguucugccccccagaccccacacacggccgccccacg

SEQ ID NO: 208617 - RNA, 63 nt, Human
ccaccgggucugggcucuggaaggagccagaugcccccagaaaggugggugguggagacggca

SEQ ID NO: 208618 - RNA, 63 nt, Human
aggcguggagguguccccaccccuuccaccugucccccagacccaaagcucucuccccacccu

SEQ ID NO: 208619 - RNA, 64 nt, Human
auccuguaaaaguaagcauguagaaggaggaaguugugcuaaaaugccuuuguuuuuuuguuau

SEQ ID NO: 208620 - RNA, 64 nt, Human
uauguuguggacuacuuaagucugcauuuguuacugugcuaauaaacaauauuaaaaaccaccu

SEQ ID NO: 208621 - RNA, 64 nt, Human
uauuuaaacaugaacugaugguaacuguacauuuugugcuaaaaugcauauuuauauguguaua

SEQ ID NO: 208622 - RNA, 64 nt, Human
ucgccucgaucaaguguggagucacaugcuaaugugugcuaaagaacuguaaguguuuuuucau

SEQ ID NO: 208623 - RNA, 64 nt, Human
gucugaacuauaggccccagugcugaagaccaguugugcuaagauaccggcauggagauugugc

SEQ ID NO: 208624 - RNA, 64 nt, Human
auuauuuauuucugguaacucacucaguuuaugcugugcuaaauaucaaucaagccauguauaa

SEQ ID NO: 208625 - RNA, 64 nt, Human
ccuggccauaccauagauuugggaugauguagucugugcuaaauauuuugcugaagaagcaguu

SEQ ID NO: 208626 - RNA, 64 nt, Human
ugaguuugcccugguuucacuggcccaagugguuugugcuaaccacgucugucuucacagcucu

SEQ ID NO: 208627 - RNA, 64 nt, Human
ucacagauuuucaccauguggcuucaucaauuuaugugcuaauacaauaaaauaaaaugcacuu

SEQ ID NO: 208628 - RNA, 64 nt, Human
ccugccaccucugacggagugggagaaguuagucugugcuaagauaguacugaguccccagaug

SEQ ID NO: 208629 - RNA, 63 nt, Human
guacgguugaagaaaacugagucuugggcaauuugugcuaaaacuaggugaguugccaaaccc

SEQ ID NO: 208630 - RNA, 64 nt, Human
ucuucuguaaagaugucuaggacgaaauauuuuaugugcuaaugcauguauuuguaaaccagau

SEQ ID NO: 208631 - RNA, 64 nt, Human
aggauggugguuugagccuugauuagacuuuugaugugcuaagccagacaggcagucuguacau

SEQ ID NO: 208632 - RNA, 64 nt, Human
auucagguuggcuugacaacacaccuuaggaacaugugcuaaggggcuaaggaggcaucagcug

SEQ ID NO: 208633 - RNA, 63 nt, Human
aaaaauuuuaaaaauuugcuuaugaaaauauaacccccagaaaguaacaaugacaaaguauua

SEQ ID NO: 208634 - RNA, 63 nt, Human
agacccagcuccugcagcccuccugcucccacgcccccagacagcuugguggaggguccugca

SEQ ID NO: 208635 - RNA, 63 nt, Human
ggcugccuggcauuacuccuccaaagacugcugcccccagaacaggcagggggugugggaggg

SEQ ID NO: 208636 - RNA, 64 nt, Human
auauguauagcuugaaaaguuuuuuuuuaaugacugugcuaaagaaaugauauuuuauugcuuu

SEQ ID NO: 208637 - RNA, 64 nt, Human
aagagaaaggucccaggugauuuuccacaaagaaugugcuaaaauguccacugaaaacaaagcc

SEQ ID NO: 208638 - RNA, 64 nt, Human
guaaggaagugguaucuagucaguccauaaagauugugcuaauuuuuuuguggaaaaguagcca

SEQ ID NO: 208639 - RNA, 64 nt, Human
caagugucuugguuaacuaauucuguuuuaugguugugcuaaauucauagcaggugccuuauuc

SEQ ID NO: 208640 - RNA, 64 nt, Human
gcuguaauuugaaugcauuguucucagggcuauuugugcuaaaagcugaaauuucauuauuuua

SEQ ID NO: 208641 - RNA, 64 nt, Human
cuuuaccucuaaauuuuuguuuuuauguugugaaugugcuaauaugugcaucaacuguaaagau

SEQ ID NO: 208642 - RNA, 64 nt, Human
auguaagcuguuuauuuuauauuaaaauaagcacugugcuaauaacagugcauauuccuuucua

SEQ ID NO: 208643 - RNA, 64 nt, Human
uuccuccauagccauaucuagagugaucucucgcugugcuaagagcaagccuacuucgcauuuc

SEQ ID NO: 208644 - RNA, 64 nt, Human
uauuuuuuaaaauggaaaagaucacuauguuuguugugcuaaccacuuauuugauucuguuuug

SEQ ID NO: 208645 - RNA, 64 nt, Human
acauccauccuuucucuauauugccucccacagaugugcuaaaauuuauuuaacuaauccuuua

SEQ ID NO: 208646 - RNA, 64 nt, Human
ucaccuauauuaggcaaauuccauuuuuuucccuugugcuaagguaaagauuuaauuaaauaau

SEQ ID NO: 208647 - RNA, 64 nt, Human
auacuggaugcuguauccaauacuuuguugugucugugcuaaccugggaacuggccaccuccau

SEQ ID NO: 208648 - RNA, 64 nt, Human
uaccuuaguccaggaagaaauuaauggaauauggugugcuaauuaucacuaccuauaacaugag

SEQ ID NO: 208649 - RNA, 64 nt, Human
uuauguaaccaaucagguacguaccaggcagugaugugcuaauacacugaucagguuuagacaa

SEQ ID NO: 208650 - RNA, 63 nt, Human
aaagagacagagccucagccagggagagugagucccccagaagaggcugggugguugcacagg

SEQ ID NO: 208651 - RNA, 63 nt, Human
guuuuaacauauuuaaauacaugugcaaucauccccccagacaaauuguguuuucuaaaggau

SEQ ID NO: 208652 - RNA, 63 nt, Human
gacuaugggaaaauaaauuaugauuguaugugacccccagaucacuaagcuugcauuuuggca

SEQ ID NO: 208653 - RNA, 64 nt, Human
agcacuguauuucuguguugacauuuguuggcagugugcuaaguaauguuuuuuaaagcacagg

SEQ ID NO: 208654 - RNA, 64 nt, Human
uacaguugaauuggacaaggcuaaaauucuguagugugcuaaaaugcucaaguuggcacauaaa

SEQ ID NO: 208655 - RNA, 64 nt, Human
aaacuaauuacaaaguuaacaauuucauuacaguugugcuaaaugcccguagugagaagaacag

SEQ ID NO: 208656 - RNA, 64 nt, Human
uaugucuuuagaaauguuuugccuuucuaagccuugugcuaaaggcguauaacgguggugccua

SEQ ID NO: 208657 - RNA, 64 nt, Human
auguucacaaccacaaugcaucugacugcaauaaugugcuaauaauuuaugucaguagucaccu

SEQ ID NO: 208658 - RNA, 64 nt, Human
aauaauaaagcuaccauuuaucaagcauuuaccaugugcuaauaaguuugaaauauauuauuuc

SEQ ID NO: 208659 - RNA, 64 nt, Human
uuuaacggugugaagcauagacagagcugcagucugugcuaacauuagguuauuuauugauuca

SEQ ID NO: 208660 - RNA, 64 nt, Human
uacugauuagacaauuauaccuacauggguaacaugugcuaaucaaaccugcugaugcuacaaa

SEQ ID NO: 208661 - RNA, 64 nt, Human
ugagccuuaaaaauuguaaaggggauacuauaaaugugcuaaguuauuugagacuuccucaguu

SEQ ID NO: 208662 - RNA, 64 nt, Human
guuuugcuaaauaacuccuguggauuuaggaaugugugcuaauagcaaucuuccuaauuuucau

SEQ ID NO: 208663 - RNA, 64 nt, Human
uuugauuuuuuaaaauauguguauaagucugucaugugcuaaacaaaauaauaugaaagaccua

SEQ ID NO: 208664 - RNA, 64 nt, Human
cgacugagcacacuuucauauuuguaucagcuuuugugcuaaaacucucuaaguacauccaccu

SEQ ID NO: 208665 - RNA, 64 nt, Human
ugaaauucuacaagugucccuuuuaaaaauagugugugcuaacuaagggcuauucauucugcca

SEQ ID NO: 208666 - RNA, 64 nt, Human
aaauauuuaaaaugcacaaugcuuuuaacuuaaaugugcuaacccuguuucugucuguuuugug

SEQ ID NO: 208667 - RNA, 63 nt, Human
auguguucagcucaagacuccacaggaauucaacccccagaaagacauaaacuuggaguccgu

SEQ ID NO: 208668 - RNA, 63 nt, Human
cagaugggccaguccagggccuaccccgccuugcccccagaucccacugggguccauuugggg

SEQ ID NO: 208669 - RNA, 63 nt, Human
accugcacccaggccucagaguuucagggcuaacccccagaauacugguaggggccaaggcca

SEQ ID NO: 208670 - RNA, 64 nt, Human
uauagcacaggauuuaauuucucaaucuguugcaugugcuaauuaugaguauuacuaguugaua

SEQ ID NO: 208671 - RNA, 64 nt, Human
gcugcccuucacucccaccugcugccaaagucccugugcuaaugggauuacaaauacaaaaagu

SEQ ID NO: 208672 - RNA, 64 nt, Human
uguccaaaauccauuucuuauugaucuuuaaagaugugcuaaaugacuuuuuuggccaaaggcu

SEQ ID NO: 208673 - RNA, 64 nt, Human
cuuuuuuaguuauuuguuuguuuacuucgucccaugugcuaacuaucuuauauauaaugagagc

SEQ ID NO: 208674 - RNA, 64 nt, Human
uuuucuuaaagagggagacaaauuauuugcaaaaugugcuaaagucaaugauuuuuacgggauu

SEQ ID NO: 208675 - RNA, 64 nt, Human
gucucuucacugaucaucgauaagcauuuaagagugugcuaacaccauucacagaggucccugg

SEQ ID NO: 208676 - RNA, 64 nt, Human
auuugccuuggauucuguggauucuuuaaaccugugugcuaauaauucaaacaauguugcauua

SEQ ID NO: 208677 - RNA, 64 nt, Human
aacagaaaacuauaaacuuacuggggacaggaugugugcuaaagggcacagcaagacacugucu

SEQ ID NO: 208678 - RNA, 64 nt, Human
ugagguuucuuucucuaauccacugaaauuauugugugcuaaauuugggaaacagaucuauucu

SEQ ID NO: 208679 - RNA, 64 nt, Human
cugcuaaucauuguuacagaauggugacuucauuugugcuaacaguacaacagcagauuugggu

SEQ ID NO: 208680 - RNA, 64 nt, Human
agggcacgaaggccaggccagggccugggccucuugugcuaagagggcagggggccuacggugc

SEQ ID NO: 208681 - RNA, 64 nt, Human
caucaugucagugucugguguuuucuugaaggccugugcuaaauaaaguggauuguuuauaaag

SEQ ID NO: 208682 - RNA, 64 nt, Human
auauguucaaaaucugaucuuuguuuuguauuuuugugcuaaugugcaaacauguacagaagaa

SEQ ID NO: 208683 - RNA, 64 nt, Human
guuuuguauauauacaauggauaaauuuuaagugugugcuaaggcacauggaagaccgauuuua

SEQ ID NO: 208684 - RNA, 63 nt, Human
gggcccagcuugcucagucaaggggcugccaggcccccagaaaacacuuggagccaucgggua

SEQ ID NO: 208685 - RNA, 63 nt, Human
auucagcacgcacacaacacacaagggagagaacccccagaugagaaaauaggaaggagcaau

SEQ ID NO: 208686 - RNA, 63 nt, Human
gaguuucagaaaaugacugagaaggagcgauaacccccagaaugcaaaaucaggggcaucauu

SEQ ID NO: 208687 - RNA, 64 nt, Human
caagugucuuucuguaagagcuguaacucugagaugugcuaaauaaacccucuuucucaaauuc

SEQ ID NO: 208688 - RNA, 64 nt, Human
acucugaaauuggucacuuuccuauuacacggagugugcuaaaacuaaaaagcauuuugaaaca

SEQ ID NO: 208689 - RNA, 64 nt, Human
ucguggggagagggcguaaauugucuugugaaugugugcuaaccaaaacccaaaggcucuuuuc

SEQ ID NO: 208690 - RNA, 64 nt, Human
gggucagcuuaggcucugcuucccaguggacgggugugcuaaggguuuauuuuauguaaaaaaa

SEQ ID NO: 208691 - RNA, 64 nt, Human
acauuaaucuguauuaucaauuucucauagacacugugcuaaugugaauuuuaaaugaccugca

SEQ ID NO: 208692 - RNA, 64 nt, Human
uuuauuuuguuucugucuucaacauuuuugacacugugcuaauaguuauauucaguacaugaaa

SEQ ID NO: 208693 - RNA, 64 nt, Human
cacagucgugccuccuugaaacaagccauucuacugugcuaauguuuuaauaucacaucucaca

SEQ ID NO: 208694 - RNA, 64 nt, Human
cacgccacagccugggaaggagcgugcucuacccugugcuaagcacgggguucgcgcaccaggu

SEQ ID NO: 208695 - RNA, 64 nt, Human
cugguagccuaccaaagcuguagaaaucuaggacugugcuaaucaguaucaaaccaaagauuuc

SEQ ID NO: 208696 - RNA, 64 nt, Human
agagauauuaaauuauaaccaacuuucaauuuccugugcuaauuaagggaaauucuguugugga

SEQ ID NO: 208697 - RNA, 64 nt, Human
caaacaucuccuuagugucugcagguguuaguggugugcuaaaagcaaggaaagcgaguuaguc

SEQ ID NO: 208698 - RNA, 64 nt, Human
augaacaaaaaaaaaaaaagcgaaagacugcaguugugcuaaaaacaaaacaaaacaaacaaac

SEQ ID NO: 208699 - RNA, 64 nt, Human
ugcaugcauggugacaucuuuggaaauucauuugugugcuaaacugaagucugcacuagaagua

SEQ ID NO: 208700 - RNA, 64 nt, Human
cacugguggccuuccccaagugagcucagcagcaugugcuaauaggugccaauacugugcuggc

SEQ ID NO: 208701 - RNA, 63 nt, Human
agcgccaucaugggcugauuuuuauuaccaggucccccagaagcaggugggaggcucugcuuc

SEQ ID NO: 208702 - RNA, 63 nt, Human
aaaguucaaaucggggcagaggcugcacuugugcccccagauguuucugaggagccagacuag

SEQ ID NO: 208703 - RNA, 63 nt, Human
gaugguaucuuuccuggccaugacagugugauucccccagaggaagcagaaggaaguuaaagg

SEQ ID NO: 208704 - RNA, 64 nt, Human
gugaggauacauaacauuuucucuacaaugaaucugugcuaauauuuugccuucuuucuuucuu

SEQ ID NO: 208705 - RNA, 64 nt, Human
ggagacgcccugaaaaaaagcgaaggccgagggaugugcuaaggguaacaccuucaugaugaca

SEQ ID NO: 208706 - RNA, 64 nt, Human
uuccaagcgcagggacgccggccuccagcuggugugugcuaaggcuccguccugacugcccugu

SEQ ID NO: 208707 - RNA, 64 nt, Human
ccugcagagcacaaacuucagaaacccggcuuccugugcuaagucuuucccaaucucuaccccu

SEQ ID NO: 208708 - RNA, 64 nt, Human
uguacaaauugugauguggcuacauagaaagccaugugcuaagaauaaacuccauuuaaaaaac

SEQ ID NO: 208709 - RNA, 64 nt, Human
aguaaugacaugaaaucuuuguucaucuccacuuugugcuaacccauucauaguuggcaguuaa

SEQ ID NO: 208710 - RNA, 64 nt, Human
ucuuguaauggcugaccagauugaagcccuggguugugcuaaaaauaaaugcaaugauugaugc

SEQ ID NO: 208711 - RNA, 64 nt, Human
gcaugugguucauucuagcauuucuguucugugcugugcuaagcuauacuacuguauguucuuu

SEQ ID NO: 208712 - RNA, 64 nt, Human
guaucuaugauuuuuuuugcucagggcaucaaaaugugcuaaggacaagaauuauauccuuuuu

SEQ ID NO: 208713 - RNA, 64 nt, Human
uggagagagaauuuugcacauauuauacauauuuugugcuaaucuuguuuuccucuuaguauuc

SEQ ID NO: 208714 - RNA, 64 nt, Human
ucagaauagauccuaauauuuuauugagggccuaugugcuaaaaacuaugcauaucuauauauu

SEQ ID NO: 208715 - RNA, 64 nt, Human
cuccucccccgacaauccuguccuuguguuugugugugcuaacagaaauaaguugcaguauggu

SEQ ID NO: 208716 - RNA, 64 nt, Human
aacuguaucaacuaaacuuugauauaaaccagaaugugcuaaauguuuuuuauguaaaauugua

SEQ ID NO: 208717 - RNA, 64 nt, Human
ucugaaaagccuacaaauggaggggaaaugagauugugcuaauguugaugucaucaagguaacc

SEQ ID NO: 208718 - RNA, 63 nt, Human
auugugagcucauuuuucuuuguuacuuuuguccccccagauuugggggacaaaauaaaauua

SEQ ID NO: 208719 - RNA, 63 nt, Human
ucacccuccucccccauggagguuuccaggggucccccagacaugaaagaggggugagcugga

SEQ ID NO: 208720 - RNA, 63 nt, Human
aaggaagagggggagcugguuuuucuggagguucccccagaggcccuccuguccgaaaagaaa

SEQ ID NO: 208721 - RNA, 64 nt, Human
caacauaggcauacuuaaguaauauacauacuccugugcuaacauguauacuagaaaacaaaaa

SEQ ID NO: 208722 - RNA, 64 nt, Human
cuggacaguuauacuguaaccucuuaaguuuuaaugugcuaaauauaucuuguaugauuuuuua

SEQ ID NO: 208723 - RNA, 64 nt, Human
ccuaaggcugggacauggugggcaucagggacuuugugcuaagccugaugaaaugugcuccuuc

SEQ ID NO: 208724 - RNA, 64 nt, Human
gccaaaaauuuuuuuucuuaucuaccuguuauauugugcuaauuuuucuauguaugugauguga

SEQ ID NO: 208725 - RNA, 64 nt, Human
guaagaaaaccaucaucauuaacugagcaccagcugugcuaagccugccacgggcguauccuug

SEQ ID NO: 208726 - RNA, 64 nt, Human
uacugcagaggcaguggccauggaucuguuccucugugcuaaaugucuuguggcaggguguguu

SEQ ID NO: 208727 - RNA, 64 nt, Human
uuaacagcagcaguacuuggaagcuuugaaaacaugugcuaaacuugaauggagcaacacuccu

SEQ ID NO: 208728 - RNA, 64 nt, Human
cugauuuucuuaacuguucuugugcaaucgacaaugugcuaaccugcuuuucucuuuuuguaaa

SEQ ID NO: 208729 - RNA, 64 nt, Human
uauugcuguaucguuugaggcuuaaugcuaaauaugugcuaaauacuggauuaauagauuucag

SEQ ID NO: 208730 - RNA, 64 nt, Human
uguaugucaguauggaaguaguuauagcauacugugugcuaauugaaaagaaugagguggagcu

SEQ ID NO: 208731 - RNA, 64 nt, Human
caucccauagagguuaguccugcauagccaguaaugugcuaaguucauccaaaagcuggcggac

SEQ ID NO: 208732 - RNA, 64 nt, Human
aauauuuauugaauaguuauuguguaccaagcauugugcuaaauacuuuauaugcauuaugaug

SEQ ID NO: 208733 - RNA, 64 nt, Human
uucuuuguauucuucaguccuuuuacagaauugaugugcuaacugaauaucauugcagcaacua

SEQ ID NO: 208734 - RNA, 64 nt, Human
uugaaaugagacaaagggaauaaauggcuguauuugugcuaagagcaaaggaugcaucuuccca

SEQ ID NO: 208735 - RNA, 63 nt, Human
cccccgccaggcugcccaucagggcccagggagcccccagaggacuuuauucggaccaagcag

SEQ ID NO: 208736 - RNA, 63 nt, Human
aaggcuuguuaaaacccaaggcugcuaggcccacccccagaguuugauacaguagaccucagg

SEQ ID NO: 208737 - RNA, 63 nt, Human
uucucccuguugucucaaagcgguacccauccucccccagaagcuguccccagcgagccuccc

SEQ ID NO: 208738 - RNA, 64 nt, Human
acauagccuaauaacucagcaaggccucaacgucugugcuaauuuaaacugccaaauauugacu

SEQ ID NO: 208739 - RNA, 64 nt, Human
gcuacugagcacuugcuucccaagugccagguucugugcuaaaccccaugcucacauaaaaucc

SEQ ID NO: 208740 - RNA, 64 nt, Human
cucuuuuuguaauauacucuaaaccuguuauuucugugcuaauaaacgagaugcagaacccuug

SEQ ID NO: 208741 - RNA, 64 nt, Human
guagaggcuauucaagguuaucaagaaagugcccugugcuaaugaugagacagugaauuuuuuu

SEQ ID NO: 208742 - RNA, 64 nt, Human
uucauggauccaaauguuuguugaguccuuucuuugugcuaagguucuugcggugaaccagaau

SEQ ID NO: 208743 - RNA, 64 nt, Human
uuacugaacugcuugguuaaacuaaauggaaccaugugcuaauuuuucacaauuauugaccugu

SEQ ID NO: 208744 - RNA, 64 nt, Human
aaauaauaguuuaaaacaaguagcuguuacuaagugugcuaaaaauacucauuuuauaauuaau

SEQ ID NO: 208745 - RNA, 64 nt, Human
augaaugauaauuuagauccauuucuuuugugaaugugcuaaauaaaaaguguuauuaauugcu

SEQ ID NO: 208746 - RNA, 64 nt, Human
aggaaaaugaacuuaaucaagagagacugugauaugugcuaagaagggugugagggagggagag

SEQ ID NO: 208747 - RNA, 64 nt, Human
uaccauggagacuggagugugugaggccacagccugugcuaaagagccauggagcccuccccug

SEQ ID NO: 208748 - RNA, 64 nt, Human
cagcagccgcuaggaaaucuucaaguguagugucugugcuaacccagugguaaaucccuuagau

SEQ ID NO: 208749 - RNA, 64 nt, Human
acuuuuuggguggcuugugcauucuuaucaguugugugcuaauuuauuguauuguuccuuugug

SEQ ID NO: 208750 - RNA, 64 nt, Human
aaaguuauaauuguucaauauguuuuuugaacagugugcuaaaucaauagcaaacccacugcca

SEQ ID NO: 208751 - RNA, 64 nt, Human
ggaaacccaaggaacaagagaaaaaacuagagccugugcuaaagaagcccugcugggcccaugu

SEQ ID NO: 208752 - RNA, 63 nt, Human
ucgugacuauacuggcauuucagauccaccccacccccagacucaucccacucucucccagca

SEQ ID NO: 208753 - RNA, 63 nt, Human
auccaaggcugagacagucgugcgacuccuacucccccagagcgugacccggagcaggugcug

SEQ ID NO: 208754 - RNA, 63 nt, Human
uccauggcaggcaucccugccuugggcugcccucccccagaccccugaccacccccugggucc

SEQ ID NO: 208755 - RNA, 64 nt, Human
acagugaacaguuauaagacuuuuuuuccauuuuugugcuaauuuauuccacgguagcucucac

SEQ ID NO: 208756 - RNA, 64 nt, Human
aaaggaagacuuggcccaggaaaaaccuguggguugugcuaauuucuguccagaaaauagggug

SEQ ID NO: 208757 - RNA, 64 nt, Human
ggcucuguuuugcuauauccccuaauuuguugguugugcuaaucuuuguagaaagaggucucgu

SEQ ID NO: 208758 - RNA, 64 nt, Human
ccugcccaguauguagacaaccaauucaaaugauugugcuaacuuauuuccccuaguugaccug

SEQ ID NO: 208759 - RNA, 64 nt, Human
ucaaaggcaggagaaaauaauguucacaauaaaaugugcuaacaauguuuuguuucuaucagcu

SEQ ID NO: 208760 - RNA, 64 nt, Human
agacacagcgcaaugcuacugcccuuccagaaacugugcuaaaaagagaaaguccaaaagacuc

SEQ ID NO: 208761 - RNA, 64 nt, Human
gcggcagagcuggcauuucuccucagagaagcgcugugcuaaggugaucgaggaccagacauua

SEQ ID NO: 208762 - RNA, 64 nt, Human
agggcugcaucuagcuucuuuuauuagaagugugugugcuaaauuccuuauuaauguguaauca

SEQ ID NO: 208763 - RNA, 64 nt, Human
uucuuauucuggcuauaaauuaugugaguaaaauugugcuaaccaguuaaaaguacuguacacc

SEQ ID NO: 208764 - RNA, 64 nt, Human
gcucuaggguggcugguuaguauuaauacauuggugugcuaacagggcauauaggauguggcuu

SEQ ID NO: 208765 - RNA, 64 nt, Human
augucugacaugcuauuuuuguagggagaaaauaugugcuaaugauauuuugaguuaaaauauc

SEQ ID NO: 208766 - RNA, 64 nt, Human
cucaccucugguaacaguggcccagacgcugcuuugugcuaaaagcaugggaaauguaaaggca

SEQ ID NO: 208767 - RNA, 64 nt, Human
uucuuuuuuucuuggacuggcuucauucugaauuugugcuaaaauaaucuuucauaaagagacc

SEQ ID NO: 208768 - RNA, 64 nt, Human
uaacugugaaugacacaccuugcuguaaaugaacugugcuaacccugacugugggcuugagaac

SEQ ID NO: 208769 - RNA, 63 nt, Human
agcagcacaauucugucccugucccugccccgccccccagagccagggcuguccuuagacucc

SEQ ID NO: 208770 - RNA, 63 nt, Human
gucuguaggguccccugaaaaucccacuuccugcccccagaaagggccuuuauuuccaacuag

SEQ ID NO: 208771 - RNA, 63 nt, Human
agugccaagccuguggaucaggaauaucaacagcccccagagaguggugcuggcugagggucu

SEQ ID NO: 208772 - RNA, 64 nt, Human
cuuuaaaaaaagaaagaauaaaaaaaccuucagcugugcuaaacaguauauuaccucuguauaa

SEQ ID NO: 208773 - RNA, 64 nt, Human
auuucucaccugcugugguaucuugcaggaacugugugcuaaaauugaacaauuuuuuugagau

SEQ ID NO: 208774 - RNA, 64 nt, Human
uaaggcuuccuuucccucccucucccagcuaguuugugcuaauuaagagaccuuuuauacuguu

SEQ ID NO: 208775 - RNA, 64 nt, Human
uuuuugcuguugauuugaacauuaaaacuggaauugugcuaaaaucagaacaugcgcuugaaua

SEQ ID NO: 208776 - RNA, 64 nt, Human
uuuauaacucaaauuugaaugucauaguacauugugugcuaaccauggcaagcaaacauuuaca

SEQ ID NO: 208777 - RNA, 64 nt, Human
uucuggaauauaccaaguuuauauaauuugauuuugugcuaaauuauuaagagucucuuuuuga

SEQ ID NO: 208778 - RNA, 64 nt, Human
uucucagcuguugugaauuauguguaucugugugugugcuaaguacagucucuuuaccaaaggg

SEQ ID NO: 208779 - RNA, 64 nt, Human
uuuuaacacucaaaucaaccuuuuaauaauuuucugugcuaaggguccaguauuuauuugauua

SEQ ID NO: 208780 - RNA, 64 nt, Human
gugugcaguagaccaaaagugucuucugcccuuuugugcuaagggcccugguugacugaguggc

SEQ ID NO: 208781 - RNA, 64 nt, Human
gccuugaaagcuggcuguacggacucacauccuuugugcuaaugacacuuacauauuucuugcc

SEQ ID NO: 208782 - RNA, 64 nt, Human
gcaugccaaguccugcuguaucagggaaguauucugugcuaaaaucagcgaugguucauugcuc

SEQ ID NO: 208783 - RNA, 64 nt, Human
uggggaggcugugagagagggcuuguaucccucuugugcuaagcagacucuacuccuaacugac

SEQ ID NO: 208784 - RNA, 64 nt, Human
cuccuaaaguuucccuaguuaguacucggacuccugugcuaauugucagcuuacauaucauugu

SEQ ID NO: 208785 - RNA, 64 nt, Human
ucacuuuuuguuggucuuuauauccuuuuauuaaugugcuaaaggaaccuguauaucuauuuug

SEQ ID NO: 208786 - RNA, 63 nt, Human
guaacccuaggcucagagacccaauuuuuuaagcccccagacuccuuagcccucagagccggc

SEQ ID NO: 208787 - RNA, 63 nt, Human
ccuccucgccccuuucuucaccccgccccccaacccccagacuuuccuggagcaucugcccuu

SEQ ID NO: 208788 - RNA, 63 nt, Human
uugcuucuugugaaaccacaggcccuugggguucccccagacagagccgcaaaucaaccccag

SEQ ID NO: 208789 - RNA, 64 nt, Human
uauaguuacauguauugauuuaagucucacacacugugcuaauaaguccuuugcacauauuauu

SEQ ID NO: 208790 - RNA, 64 nt, Human
cuucugggaucuccuuuugugaaaaccaguuugaugugcuaaaaguaaaaagucuauuuuccag

SEQ ID NO: 208791 - RNA, 64 nt, Human
uuuccaauggcuaaugauguugaguaucuuuuugugugcuaauuugccaucuauguauccucuu

SEQ ID NO: 208792 - RNA, 64 nt, Human
cuggccaaaagcaaaauuauuuuauguuaaaaugugugcuaaacuaucccaggaaaguauuuaa

SEQ ID NO: 208793 - RNA, 64 nt, Human
aaaguaauauauuuaagaguaaauuuugcuugcaugugcuaauaugaaauaacagacuaacauu

SEQ ID NO: 208794 - RNA, 64 nt, Human
uugugcuaccuuucuuggauuuuuguaccagagaugugcuaaacugaugaaauacauugagaaa

SEQ ID NO: 208795 - RNA, 64 nt, Human
aacauucauugagcuguuaauauguauaaguguuugugcuaaaugcuauagguaaauucauuuc

SEQ ID NO: 208796 - RNA, 64 nt, Human
gaaugaaacacucugaguggccaggccugugucaugugcuaauuccuagagccagggaaauaag

SEQ ID NO: 208797 - RNA, 64 nt, Human
ugugcaauaggucuuaugcuguuuucacucaaugugugcuaagaucuagccccauugacucuuc

SEQ ID NO: 208798 - RNA, 64 nt, Human
gccuccuccugggcuccagagggcacucagaaguugugcuaaaccaaguuaagucccauucagu

SEQ ID NO: 208799 - RNA, 64 nt, Human
uauucaucuucuuugaagcucagugguugauauuugugcuaauaaugcaauuuccugauuacug

SEQ ID NO: 208800 - RNA, 64 nt, Human
uacuugguuaauguguuauuuauugaguauuguuugugcuaagcauuguguuagauuuaaaaaa

SEQ ID NO: 208801 - RNA, 64 nt, Human
ggugggaagcaguuacuguauaugucccaggcaaugugcuaagcacuuuacacacauucccaug

SEQ ID NO: 208802 - RNA, 64 nt, Human
agugaacucaacauguguuuacugaacaccacucugugcuaagcccuagagcaggucaaaaaca

SEQ ID NO: 208803 - RNA, 63 nt, Human
ggauccugaccugacuauccaugccauccauggcccccagacugacucugcaccuggcccuuu

SEQ ID NO: 208804 - RNA, 63 nt, Human
cucaauucucagggcuggaaugagccggcuggucccccagaaagcuggagugggguacagagu

SEQ ID NO: 208805 - RNA, 63 nt, Human
ucccaaccacauguagccaauuccucacucaggcccccagagugagccuuugaaauggaacag

SEQ ID NO: 208806 - RNA, 64 nt, Human
caagugcauuuucagucguugugcuuuuuuguuuugugcuaacgucuuacuaauuuaaagaugc

SEQ ID NO: 208807 - RNA, 64 nt, Human
gaggccaccuagcaagguaguaacuagucuaaccugugcuaacauuagggcacaaccuguugga

SEQ ID NO: 208808 - RNA, 64 nt, Human
aauauuuauugagcaccaacaaugucacaagcacugugcuaaacacuguggugaaguagaacaa

SEQ ID NO: 208809 - RNA, 64 nt, Human
aguccauacuuugcacugacauacuuuuuccuucugugcuaagguaagguauccacccucgaug

SEQ ID NO: 208810 - RNA, 64 nt, Human
aucuauuuaaucauuucuacuugcaguacugcuaugugcuaagcuuaacuggaagccuuggaau

SEQ ID NO: 208811 - RNA, 56 nt, Human
aaagucgaugggacaguuagaggggaugugcuaaagcgugaaaucaguuguccuua

SEQ ID NO: 208812 - RNA, 64 nt, Human
auugcuuccugauuaccagucugauuauaccaugugugcuaauauacuuuuuuuguuauagauu

SEQ ID NO: 208813 - RNA, 64 nt, Human
aagcguggaggaugauggagaaucgugugaucagugugcuaaaucucucugccuguuuggacuu

SEQ ID NO: 208814 - RNA, 64 nt, Human
gguguuugagucagcuugucugauugaaugauaaugugcuaaauugauuaccucccccuuaaag

SEQ ID NO: 208815 - RNA, 64 nt, Human
cccaccccucccucuguccaccagcccauggcccugugcuaaucccaggauuaggccauaggag

SEQ ID NO: 208816 - RNA, 64 nt, Human
ucuguuauucauucaucaagcagguuaaagccauugugcuaagaucuaaucugaggacacuaua

SEQ ID NO: 208817 - RNA, 64 nt, Human
uccucacuguggaccccugucugggccacccuagugugcuaagcugagcagugcagugugaaca

SEQ ID NO: 208818 - RNA, 64 nt, Human
guucuggagugggggucaaccccuccccagucucugugcuaaguucacuugggaggauggcagu

SEQ ID NO: 208819 - RNA, 64 nt, Human
cuuguccuagaauccccaugacucaaucaaggacugugcuaaaugagauuguccagcccccgcc

SEQ ID NO: 208820 - RNA, 63 nt, Human
ugcagggcagacagugccuggcacugaggggugcccccagaccccgcugggacuggaugugcc

SEQ ID NO: 208821 - RNA, 63 nt, Human
gcacuggcccugccacagagaugccacuggggacccccagacaccaguggcuugacuuugagc

SEQ ID NO: 208822 - RNA, 63 nt, Human
ugggagcuuggagcuaauacgacacucugccuucccccagaaggugcaggcuuuccugagucu

SEQ ID NO: 208823 - RNA, 64 nt, Human
gcaaggcuuauauggugguagggagcuuauagcuugugcuaauacuguagcaucaagcccaagc

SEQ ID NO: 208824 - RNA, 64 nt, Human
uauauugagagaaacaaauuuuaguccuucuaacugugcuaaaacuuggauauuugugaaaacu

SEQ ID NO: 208825 - RNA, 64 nt, Human
acgcuuucugauccuggccccuaaagaauuuacuugugcuaaguaauaaaauuccuauugauca

SEQ ID NO: 208826 - RNA, 64 nt, Human
uuaacaacacuuuuuucuaaauuauuucuaagguugugcuaauucuuuugguugugaaaaguug

SEQ ID NO: 208827 - RNA, 64 nt, Human
ucauaccagguagaaacccugcaaguguaaagaaugugcuaaaacccuaaacuggugcucacac

SEQ ID NO: 208828 - RNA, 64 nt, Human
auugaggcacuuuugcuuuuguguuaaauguagaugugcuaaaauauauagaucuaucauauuu

SEQ ID NO: 208829 - RNA, 64 nt, Human
uuaaguuuuugucuaacuccccuucaucuguaacugugcuaaucuaucuagagaccucaaacac

SEQ ID NO: 208830 - RNA, 64 nt, Human
uccuccuccucuucccuugggggaaaaaaaaaaaugugcuaauaaaacuucccuccauggcuaa

SEQ ID NO: 208831 - RNA, 64 nt, Human
agcgagccuuuggugcuagaagccugcggggucaugugcuaagaggacagucuuucuccgggag

SEQ ID NO: 208832 - RNA, 64 nt, Human
ucaagagaauccagguucugucagauuaguaaggugugcuaaucuaaauuuuaaaaaaucucuu

SEQ ID NO: 208833 - RNA, 64 nt, Human
uaccaccuugcacagugggcacuggucacuccuaugugcuaagacaaggcagacaucugugugu

SEQ ID NO: 208834 - RNA, 64 nt, Human
uguaacucccucuaauagguguagucaacaaagcugugcuaauaucucuguccccuugauccug

SEQ ID NO: 208835 - RNA, 64 nt, Human
aaauucaacacccaccaggcucuaagcggcgaucugugcuaagaggucaggacccagccgaagu

SEQ ID NO: 208836 - RNA, 64 nt, Human
cucacaaaaacagauaaauauuugcacagaugggugugcuaaucauugugccuugaugguucca

SEQ ID NO: 208837 - RNA, 63 nt, Human
ggaugucaaguggugaugucguugugcuccccucccccagagcgggugggcggggggugaaua

SEQ ID NO: 208838 - RNA, 59 nt, Human; identical to SEQ ID NO: 89946

SEQ ID NO: 208839 - RNA, 63 nt, Human
agagacccccgggauggggccucacacuugccacccccagaaccagcucaccuggccagagug

SEQ ID NO: 208840 - RNA, 64 nt, Human
cucuuaaacacugaagauguagcaauaaaccaaaugugcuaaaacccugauggaguuuuauucc

SEQ ID NO: 208841 - RNA, 64 nt, Human
gacuccauuucaaaaaaaaagacugaaacaagcuugugcuaagauggaaagggcugcuucuaac

SEQ ID NO: 208842 - RNA, 64 nt, Human
aacauaaccucacuuaauucugguguaggguguaugugcuaaucguucuaauucuugauuaccu

SEQ ID NO: 208843 - RNA, 64 nt, Human
ccaguaccaccugccggguguuguggccuagcugugugcuaagugccauguugggcuccucaca

SEQ ID NO: 208844 - RNA, 64 nt, Human
cugcaaagcccgguucuacacagauuucacaaauugugcuaagaaccguccguguucucagaaa

SEQ ID NO: 208845 - RNA, 64 nt, Human
cuguauugcaacgugcaggaccauuuuaaaccugugugcuaaaaauuuuccagauacuugcuuu

SEQ ID NO: 208846 - RNA, 64 nt, Human
uuuauaugucuauuauuucauuuaaagaauaugcugugcuaauaauggagugagacaugcuuau

SEQ ID NO: 208847 - RNA, 64 nt, Human
gggguccauaaggcucuucagagcccaagagaguugugcuaagauggcccaggauggagguccg

SEQ ID NO: 208848 - RNA, 64 nt, Human
cugagcccuucauucaccucugugagugaauaaaugugcuaagucucuuuaucucggguccgaa

SEQ ID NO: 208849 - RNA, 64 nt, Human
cucuuuuaccuuugaccugcagaagaagaccugaugugcuaaugaaaccacaacguguaagccu

SEQ ID NO: 208850 - RNA, 64 nt, Human
uccucgcaaaugcccaggcccugcauuuucacgcugugcuaagcagccuuuggucugcaugggg

SEQ ID NO: 208851 - RNA, 64 nt, Human
guuuucuauauaacaucuuuaaugaguggcuuccugugcuaagaaugguccagaugugaacugc

SEQ ID NO: 208852 - RNA, 64 nt, Human
aagaauauuguugagguuccaaagaugcuggaccugugcuaaauucuucagugauaugaaaaaa

SEQ ID NO: 208853 - RNA, 64 nt, Human
gguuugguuuuugacaccugaaaugcgaacgcuaugugcuaaauuugucaccguaucauaugug

SEQ ID NO: 208854 - RNA, 63 nt, Human
aagcuggcgccgacauggcgaaggcaaggucuucccccagaggcacauuccucuccaucuuuc

SEQ ID NO: 208855 - RNA, 63 nt, Human
uccaguggucagguuuccccugaccuucccucacccccagaaacacuugcuuacagaccgaaa

SEQ ID NO: 208856 - RNA, 63 nt, Human
uaacuggcacacgccccacgccuuccucuauaacccccagagacaggcuggggcagcgccaag

SEQ ID NO: 208857 - RNA, 64 nt, Human
cacugcucuucagaauacacucuagacccaaaggugugcuaaucacuucacagugaccacuaca

SEQ ID NO: 208858 - RNA, 64 nt, Human
uccaccacuaaaaugccucugccacuuugaauucugugcuaauuuuguggccagaaugcgguga

SEQ ID NO: 208859 - RNA, 64 nt, Human
uaguaauauugagcgcucacccugugcguggccuugugcuaaccauuagcacugcaucauuuca

SEQ ID NO: 208860 - RNA, 64 nt, Human
uaggcucuuuugggauuuuugaagcuguauacugugugcuaaaacaagcacuaaacaaagagug

SEQ ID NO: 208861 - RNA, 64 nt, Human
auggaguuggaguucauucauauuacaauauuugugugcuaaacguguauguuuuucaguucaa

SEQ ID NO: 208862 - RNA, 64 nt, Human
gggugaggguggcgggccugcggggacauucuacugugcuaaaaagccacugcagacauagcaa

SEQ ID NO: 208863 - RNA, 64 nt, Human
aguaaauguccauugaaaagcaaguaauacagccugugcuaauugggagcacuugaacaauuuu

SEQ ID NO: 208864 - RNA, 64 nt, Human
guugaccauuucuacaauuuguaaaaguccaaucugugcuaacuuaauaaaguaauaaucaucu

SEQ ID NO: 208865 - RNA, 64 nt, Human
gcuggcacucguugugacuuacacagagcaaaauugugcuaaaggcuuuucuacucugagaucu

SEQ ID NO: 208866 - RNA, 64 nt, Human
guuaccgauggugucccguuguguggguuuacucugugcuaaguugucuuacacuucucaaaug

SEQ ID NO: 208867 - RNA, 64 nt, Human
aaguagugauaucugugaaaucacagguuugaugugugcuaauuauguauucuucuaauacaua

SEQ ID NO: 208868 - RNA, 64 nt, Human
ugucuuuugguuucugucaguagaaauaaccauaugugcuaaccaaauuucugugaagaauguu

SEQ ID NO: 208869 - RNA, 64 nt, Human
caucacuaauuuggcuuucacauuuaaaugguucugugcuaaucaaaacuuucguuguuauuau

SEQ ID NO: 208870 - RNA, 64 nt, Human
gggcagugucccucccuggcuugccuucuaccuuugugcuaaauccuagcagacacugccuuga

SEQ ID NO: 208871 - RNA, 63 nt, Human
cuccugcugggccuucggggucucaguuggcuucccccagauucugauucuacagcugcagaa

SEQ ID NO: 208872 - RNA, 63 nt, Human
agccuuugccaugguacuuagguagggugugugcccccagauuuaaccauuccauaaucaugu

SEQ ID NO: 208873 - RNA, 63 nt, Human
gcccaacuuagacgcggcucuccuccggcagggcccccagagggcagaagcagcguggagggg

SEQ ID NO: 208874 - RNA, 64 nt, Human
aguugcauagguuuccaugguauuuauagucucuugugcuaaauuuggccaaagaugauugucc

SEQ ID NO: 208875 - RNA, 64 nt, Human; identical to SEQ ID NO: 71419

SEQ ID NO: 208876 - RNA, 64 nt, Human; identical to SEQ ID NO: 71420

SEQ ID NO: 208877 - RNA, 64 nt, Human; identical to SEQ ID NO: 71421

SEQ ID NO: 208878 - RNA, 64 nt, Human; identical to SEQ ID NO: 71422

SEQ ID NO: 208879 - RNA, 64 nt, Human; identical to SEQ ID NO: 71423

SEQ ID NO: 208880 - RNA, 64 nt, Human; identical to SEQ ID NO: 71424

SEQ ID NO: 208881 - RNA, 64 nt, Human; identical to SEQ ID NO: 71425

SEQ ID NO: 208882 - RNA, 64 nt, Human; identical to SEQ ID NO: 71426

SEQ ID NO: 208883 - RNA, 64 nt, Human; identical to SEQ ID NO: 71427

SEQ ID NO: 208884 - RNA, 64 nt, Human; identical to SEQ ID NO: 71428

SEQ ID NO: 208885 - RNA, 64 nt, Human; identical to SEQ ID NO: 71429

SEQ ID NO: 208886 - RNA, 64 nt, Human; identical to SEQ ID NO: 71430

SEQ ID NO: 208887 - RNA, 63 nt, Human
ucccugggcucuggacaagcacugggggacgugcccccagagccacccacuucucaucccaaa

SEQ ID NO: 208888 - RNA, 63 nt, Human
cacucccuuacccccggugccgggccgugcggucccccagacggacagcagcuguggcgaccu

SEQ ID NO: 208889 - RNA, 63 nt, Human
ccucccaugagguggggagaggcaacagggcagcccccagaggaguguccuggccgcuguccu

SEQ ID NO: 208890 - RNA, 63 nt, Human
caccaccuguaggaccuccucccacccacgcugcccccagagcuugggcugcccuccugcugg

SEQ ID NO: 208891 - RNA, 64 nt, Human; identical to SEQ ID NO: 71431

SEQ ID NO: 208892 - RNA, 64 nt, Human; identical to SEQ ID NO: 71432

SEQ ID NO: 208893 - RNA, 64 nt, Human; identical to SEQ ID NO: 71433

SEQ ID NO: 208894 - RNA, 64 nt, Human; identical to SEQ ID NO: 71434

SEQ ID NO: 208895 - RNA, 64 nt, Human; identical to SEQ ID NO: 71435

SEQ ID NO: 208896 - RNA, 64 nt, Human; identical to SEQ ID NO: 71436

SEQ ID NO: 208897 - RNA, 64 nt, Human; identical to SEQ ID NO: 71437

SEQ ID NO: 208898 - RNA, 64 nt, Human; identical to SEQ ID NO: 71438

SEQ ID NO: 208899 - RNA, 64 nt, Human; identical to SEQ ID NO: 71439

SEQ ID NO: 208900 - RNA, 64 nt, Human; identical to SEQ ID NO: 71440

SEQ ID NO: 208901 - RNA, 64 nt, Human; identical to SEQ ID NO: 71441

SEQ ID NO: 208902 - RNA, 64 nt, Human; identical to SEQ ID NO: 71442

SEQ ID NO: 208903 - RNA, 64 nt, Human; identical to SEQ ID NO: 71443

SEQ ID NO: 208904 - RNA, 64 nt, Human; identical to SEQ ID NO: 71444

SEQ ID NO: 208905 - RNA, 64 nt, Human; identical to SEQ ID NO: 71445

SEQ ID NO: 208906 - RNA, 63 nt, Human
ucacacguugugcuuuuucugggcuucccuuaucccccagaacacucuaccaaccucggggaa

SEQ ID NO: 208907 - RNA, 63 nt, Human
ggaagcaaacagccaggcucccugagggccaggcccccagaccaucuuggguuggaauugagu

SEQ ID NO: 208908 - RNA, 63 nt, Human
agauccagaugagauacagcucagagugccacgcccccagaaagaggaaucaggcaaguacug

SEQ ID NO: 208909 - RNA, 64 nt, Human; identical to SEQ ID NO: 71446

SEQ ID NO: 208910 - RNA, 64 nt, Human; identical to SEQ ID NO: 71447

SEQ ID NO: 208911 - RNA, 64 nt, Human; identical to SEQ ID NO: 71448

SEQ ID NO: 208912 - RNA, 64 nt, Human; identical to SEQ ID NO: 71449

SEQ ID NO: 208913 - RNA, 64 nt, Human; identical to SEQ ID NO: 71450

SEQ ID NO: 208914 - RNA, 64 nt, Human; identical to SEQ ID NO: 71451

SEQ ID NO: 208915 - RNA, 64 nt, Human; identical to SEQ ID NO: 71452

SEQ ID NO: 208916 - RNA, 64 nt, Human; identical to SEQ ID NO: 71453

SEQ ID NO: 208917 - RNA, 64 nt, Human; identical to SEQ ID NO: 71454

SEQ ID NO: 208918 - RNA, 64 nt, Human; identical to SEQ ID NO: 71455

SEQ ID NO: 208919 - RNA, 64 nt, Human; identical to SEQ ID NO: 71456

SEQ ID NO: 208920 - RNA, 64 nt, Human; identical to SEQ ID NO: 71457

SEQ ID NO: 208921 - RNA, 64 nt, Human; identical to SEQ ID NO: 71458

SEQ ID NO: 208922 - RNA, 64 nt, Human; identical to SEQ ID NO: 71459

SEQ ID NO: 208923 - RNA, 64 nt, Human; identical to SEQ ID NO: 71460

SEQ ID NO: 208924 - RNA, 63 nt, Human
auuagcaaaggcaaaucuaagcaaucauuuuuccccccagaaguuacuuagaaggagaacugg

SEQ ID NO: 208925 - RNA, 63 nt, Human
ucgccugccgagggcugcgccccgugcugccuccccccagagggccacccgcugugcucgugg

SEQ ID NO: 208926 - RNA, 63 nt, Human
agcaagcucaccacagaggaguggaacugaggccccccagauguugccuccgguguccaagcc

SEQ ID NO: 208927 - RNA, 64 nt, Human; identical to SEQ ID NO: 71461

SEQ ID NO: 208928 - RNA, 64 nt, Human; identical to SEQ ID NO: 71462

SEQ ID NO: 208929 - RNA, 64 nt, Human; identical to SEQ ID NO: 71463

SEQ ID NO: 208930 - RNA, 64 nt, Human; identical to SEQ ID NO: 71464

SEQ ID NO: 208931 - RNA, 64 nt, Human; identical to SEQ ID NO: 71465

SEQ ID NO: 208932 - RNA, 64 nt, Human; identical to SEQ ID NO: 71466

SEQ ID NO: 208933 - RNA, 64 nt, Human; identical to SEQ ID NO: 71467

SEQ ID NO: 208934 - RNA, 64 nt, Human; identical to SEQ ID NO: 71468

SEQ ID NO: 208935 - RNA, 64 nt, Human; identical to SEQ ID NO: 71469

SEQ ID NO: 208936 - RNA, 64 nt, Human; identical to SEQ ID NO: 71470

SEQ ID NO: 208937 - RNA, 64 nt, Human; identical to SEQ ID NO: 71471

SEQ ID NO: 208938 - RNA, 64 nt, Human; identical to SEQ ID NO: 71472

SEQ ID NO: 208939 - RNA, 64 nt, Human; identical to SEQ ID NO: 71473

SEQ ID NO: 208940 - RNA, 64 nt, Human; identical to SEQ ID NO: 71474

SEQ ID NO: 208941 - RNA, 64 nt, Human; identical to SEQ ID NO: 71475

SEQ ID NO: 208942 - RNA, 63 nt, Human
uccugccuucugggcccagcccuggggccugugcccccagaggccuacaggggcaccaugcug

SEQ ID NO: 208943 - RNA, 63 nt, Human
aacuuuguuugggucaagcuuccuucuuucuaacccccagacuuuggccucugagugaaaugu

SEQ ID NO: 208944 - RNA, 63 nt, Human
cuguggugacuucugcugcuggccccgccccugcccccagagcguccuuggcugccgucuggc

SEQ ID NO: 208945 - RNA, 64 nt, Human; identical to SEQ ID NO: 71476

SEQ ID NO: 208946 - RNA, 64 nt, Human; identical to SEQ ID NO: 71477

SEQ ID NO: 208947 - RNA, 64 nt, Human; identical to SEQ ID NO: 71478

SEQ ID NO: 208948 - RNA, 64 nt, Human; identical to SEQ ID NO: 71479

SEQ ID NO: 208949 - RNA, 64 nt, Human; identical to SEQ ID NO: 71480

SEQ ID NO: 208950 - RNA, 64 nt, Human; identical to SEQ ID NO: 71481

SEQ ID NO: 208951 - RNA, 64 nt, Human; identical to SEQ ID NO: 71482

SEQ ID NO: 208952 - RNA, 64 nt, Human; identical to SEQ ID NO: 71483

SEQ ID NO: 208953 - RNA, 64 nt, Human; identical to SEQ ID NO: 71484

SEQ ID NO: 208954 - RNA, 64 nt, Human; identical to SEQ ID NO: 71485

SEQ ID NO: 208955 - RNA, 64 nt, Human; identical to SEQ ID NO: 71486

SEQ ID NO: 208956 - RNA, 64 nt, Human; identical to SEQ ID NO: 71487

SEQ ID NO: 208957 - RNA, 64 nt, Human; identical to SEQ ID NO: 71488

SEQ ID NO: 208958 - RNA, 64 nt, Human; identical to SEQ ID NO: 71489

SEQ ID NO: 208959 - RNA, 63 nt, Human
gaccugugagaggcccaauggcccaauguacuucccccagaucccacucagaacagcagguac

SEQ ID NO: 208960 - RNA, 56 nt, Human; identical to SEQ ID NO: 89970

SEQ ID NO: 208961 - RNA, 63 nt, Human
ccucaggaagaaggcccuacagauuugccaugucccccagacccugcuucugauacuaaggac

SEQ ID NO: 208962 - RNA, 64 nt, Human
uguggaacuguacaaauauuuauaccaaaaauauagauaagaaaagguggggcuauacuagcaa

SEQ ID NO: 208963 - RNA, 64 nt, Human
uuuuugagccuaucauuaauuagcuuaguaugaaagauaagaaaaucuccauguuguauccauu

SEQ ID NO: 208964 - RNA, 64 nt, Human
augcagguggguauccauaaccugcgagaucagcagauaagaucaacaggucccccccacauga

SEQ ID NO: 208965 - RNA, 64 nt, Human
uagagucaucaucuaauuggggacaggcagaccuagauaagaaaagcagagaacuacuuuggaa

SEQ ID NO: 208966 - RNA, 64 nt, Human
cuguauuaaaaugcauugaguuuuuguacaauacagauaagauuuuuacaugguagaucaacaa

SEQ ID NO: 208967 - RNA, 64 nt, Human
acaguaagaagacuucugguauuaucucucuaucagauaagauuuuguuaauguacuauuuuac

SEQ ID NO: 208968 - RNA, 64 nt, Human
uuguuuggggagaaagcuaaaaaaaccugaaaccagauaagaacauuucuuguguauagcuuuu

SEQ ID NO: 208969 - RNA, 64 nt, Human
ggcuuggggcccaggguaaugaggcaccagaugaagauaagaucugcaucaaggaauuaaauuu

SEQ ID NO: 208970 - RNA, 64 nt, Human
uaccuuuuuagcuucuguuuguggaguugucuccagauaagaggagaugugccuucccaauaac

SEQ ID NO: 208971 - RNA, 64 nt, Human
cuuggagaggguuaguccacauccaaguugcgugagauaagaugcaaagggcucuguguggaug

SEQ ID NO: 208972 - RNA, 64 nt, Human
aagaccguaucuucauuuucgugaguagaaggaaagauaagaaugaggcagcagauuuucccuc

SEQ ID NO: 208973 - RNA, 64 nt, Human
aagauacauucccaaauaaacgaccuaggcuagaagauaagacuguuuuugacaauuuuuuuau

SEQ ID NO: 208974 - RNA, 64 nt, Human
gagccaccgcugccagcccagaguuacccucuaaagauaagaaaaaggcuauuaauaucauacu

SEQ ID NO: 208975 - RNA, 64 nt, Human
ugcucgcuucugggugugcucccuucgaaggcccagauaagacagggaacacuugugagcacac

SEQ ID NO: 208976 - RNA, 64 nt, Human
uggcccagcguuacuuuucuugauaagaauuuacagauaagacacucagagagacauuguguca

SEQ ID NO: 208977 - RNA, 64 nt, Human
ugcuuuauugaguaaagguuauaguuugacuuuaagauaagaaauuuucuagaaucauguuuga

SEQ ID NO: 208978 - RNA, 63 nt, Human
uuuggacaucuggggaaguggagauuaaccccucccccagacucgugccuugccucucaggac

SEQ ID NO: 208979 - RNA, 63 nt, Human
cagccucuuggcaccuccuguuuacuccccgagcccccagauucucaccuuugcccagagcca

SEQ ID NO: 208980 - RNA, 63 nt, Human
caggcaggggcaggcugaggaguugcccuuugccccccagagacugacucucagagccagaga

SEQ ID NO: 208981 - RNA, 64 nt, Human
gguauaaacaugaaggguauggcuuuauuuuuauagauaagaaaaaugaagccaagacagggua

SEQ ID NO: 208982 - RNA, 64 nt, Human
aucggguguuuguuaucagaaaagagaugagaugagauaagacuuguuuauugacuagccaaua

SEQ ID NO: 208983 - RNA, 64 nt, Human
gaaauaauguuccuacaauaguuguauguaucuaagauaagacauauagaugcuuaagacauuu

SEQ ID NO: 208984 - RNA, 64 nt, Human
uuuuuucauauuauaacuaaauauguuuccugagagauaagagaaauaauguuccuacaauagu

SEQ ID NO: 208985 - RNA, 64 nt, Human
uucccauuugucaaacccucuucaaaggaggaacagauaagacugggucagccuagucaugccu

SEQ ID NO: 208986 - RNA, 64 nt, Human
gguuuaaaagacacacuuguccacauagguuuagagauaagaguuggcuggucaacuugagcau

SEQ ID NO: 208987 - RNA, 64 nt, Human
caucaacauuuagauuacagccuaauuaauaccuagauaagacuucauuugaaauaagaaauaa

SEQ ID NO: 208988 - RNA, 64 nt, Human
uagguagaguacuggguacaagugguccaaacuaagauaagagacuaaaauaaaaugcuaaauc

SEQ ID NO: 208989 - RNA, 64 nt, Human
ugguccugcagcuuauugaaucagagaaaugugaagauaagaugaacuaaacaaacauauuuua

SEQ ID NO: 208990 - RNA, 64 nt, Human
auuuuggggagguugauugcaaaggaaauuugaaagauaagauuuauucuuauuuaauacuuca

SEQ ID NO: 208991 - RNA, 64 nt, Human
caaaaaguaaugaagaaaauugagaccugagugaagauaagaaaugaucuuuacguggcaaaau

SEQ ID NO: 208992 - RNA, 64 nt, Human
aaugaaguaugggaacuaaauugcugguuuucuaagauaagauaugggauaugggucauauaac

SEQ ID NO: 208993 - RNA, 64 nt, Human
uuggaaaaaggacaacgaaaggcuuuucauguaaagauaagaucuuuagcuaucucuaacccug

SEQ ID NO: 208994 - RNA, 64 nt, Human
ugaaggggcgaguggagacacuguguguaucucuagauaagaagauaugcaccacguugaaaau

SEQ ID NO: 208995 - RNA, 64 nt, Human
uuguucuauuauucccuuuuuauauagcagcaaaagauaagaauaaaaucacauaaccaaguug

SEQ ID NO: 208996 - RNA, 64 nt, Human
gaaauaaguuccuuuauuuuuucuuuucuaugcaagauaagagauuaccaacauuacuugucuu

SEQ ID NO: 208997 - RNA, 63 nt, Human
gguccugagggggucuuuuggcuucagccuguucccccagaggcuugaucaucccacauuguc

SEQ ID NO: 208998 - RNA, 63 nt, Human
cuaacauaacuuauuaaaggaggggucccuccucccccagagcaguccucaacacuaugucag

SEQ ID NO: 208999 - RNA, 63 nt, Human
uauucuguuccacacccaaugcugcuccacccucccccagacacagcccaggucccuccgcgg

SEQ ID NO: 209000 - RNA, 64 nt, Human
auaagucuccuacauagcaguguuauuuauguacagauaagaaaaccauaugucagccaaagau

SEQ ID NO: 209001 - RNA, 64 nt, Human
gcccaagucacacaggcuucuguguuauguauuuagauaagaugugugaaaauauauuugaaua

SEQ ID NO: 209002 - RNA, 64 nt, Human
aucuuucuccuuucuuccagcacacacagcuaagagauaagaaggcugcaaggauuggggauaa

SEQ ID NO: 209003 - RNA, 64 nt, Human
ccauaguguuaagucauuaugagcuucaucuuaaagauaagaaaacugaggcaaggggagauua

SEQ ID NO: 209004 - RNA, 64 nt, Human
ugucuucaguuacuuuguaauuuauuguggcaugagauaagauggggaaaauuuuguuuuaagu

SEQ ID NO: 209005 - RNA, 64 nt, Human
aaccuguagcgauucguuacacuggggugagaagagauaagagaaaugaaagagaagagaaaug

SEQ ID NO: 209006 - RNA, 64 nt, Human
uuguggaguauucaauaaccauuauguagaagguagauaagaauuaaaaggguuuaauuuccua

SEQ ID NO: 209007 - RNA, 64 nt, Human
uuuuaguuucaaguuuguaugguaguguuuuuauagauaagauacgucuauuuuuucaaaauuc

SEQ ID NO: 209008 - RNA, 64 nt, Human
auugucauuauagacagcaguguguuuuuuagaaagauaagagaaucaccccuaugcugcugag

SEQ ID NO: 209009 - RNA, 64 nt, Human
cuacuugaacacuaccucuugugaagucuacuguagauaagacgauugucauuuccacuuggaa

SEQ ID NO: 209010 - RNA, 64 nt, Human
guauuugaacuuauuuuuuuaaauucugucauugagauaagaauaauucagguagcaucugaaa

SEQ ID NO: 209011 - RNA, 64 nt, Human
auguuuuugccauuuuuuuuuuguucuaccucaaagauaagacaguacaguauuuaagugccca

SEQ ID NO: 209012 - RNA, 64 nt, Human
gauagugguguuuacugcugcagcauguaucacaagauaagaaaugaaaaaucaaucuuucuua

SEQ ID NO: 209013 - RNA, 64 nt, Human
aaugcuugaaaccaaagcuucagauaaacuugcaagauaagacaacuuuaagaaaccaguguua

SEQ ID NO: 209014 - RNA, 64 nt, Human
cauguuaugauuucauauccugagauagcucugcagauaagaaaauauuuaaauauaugacaaa

SEQ ID NO: 209015 - RNA, 64 nt, Human
uuauccacauuucuaauaguggacuugauuaaguagauaagaucagcaucuguuuaugguagua

SEQ ID NO: 209016 - RNA, 63 nt, Human
gcgcugaucuucuauuuaauuccccacccaugacccccagaaagcaggagggcauugcccaca

SEQ ID NO: 209017 - RNA, 63 nt, Human
cucugacucucaaaucuuuuagucauuauagaucccccagacuuuacaugacacagcuuuauc

SEQ ID NO: 209018 - RNA, 63 nt, Human
gccuugagaaguccugaguacagagacugguuccccccagacacgaguaacauggcaucuugc

SEQ ID NO: 209019 - RNA, 64 nt, Human
ugauacagguaagauuggaacucaugaagacaaaagauaagacaguggcauagaguuaauauuu

SEQ ID NO: 209020 - RNA, 64 nt, Human
uucugugagaugagcuaaauugcuuucauaccccagauaagagcuaaaaccaccuaaugcucuu

SEQ ID NO: 209021 - RNA, 64 nt, Human
auauacagauuauuacuggcuccaaaggaugaguagauaagaccauaagaauuggaucaaugua

SEQ ID NO: 209022 - RNA, 64 nt, Human
caaagggucacagaaguguucagaagaagggcaaagauaagaacaauauuagcuguuacgaaau

SEQ ID NO: 209023 - RNA, 64 nt, Human
uaaagcacuaccgauucuuuggaguugucacaucagauaagacauaucucuaauuccauccaua

SEQ ID NO: 209024 - RNA, 64 nt, Human
cagcaacagcaacauacagaagauauguucacucagauaagacugcccuaaacaaccauuuugu

SEQ ID NO: 209025 - RNA, 64 nt, Human
auuaaucuucugacauuuucuuauguuuuuaaaaagauaagagcaucuagugcauuaaaugcca

SEQ ID NO: 209026 - RNA, 52 nt, Human
auucaacaaccaggguauagccagauaagagaaacaaacuauuuuuuuugau

SEQ ID NO: 209027 - RNA, 64 nt, Human
ucagccggcacugagaagaacgaacacaagaaaaagauaagaaauacuagaguaaaggccauca

SEQ ID NO: 209028 - RNA, 64 nt, Human
uauaauugguauggccauuagguucaguccuugaagauaagaaacuuguucucuguuuguuguc

SEQ ID NO: 209029 - RNA, 64 nt, Human
acagaauucauagguguggguguagaguucaccaagauaagauuaugaauauaauuaaaggucu

SEQ ID NO: 209030 - RNA, 64 nt, Human
aauggaagaaacugauaccacaccuaaggaccaaagauaagaaagacuuuuugcccaagacagu

SEQ ID NO: 209031 - RNA, 64 nt, Human
aaguuucagauauaggagacuucaugcaauuuggagauaagacuaauuauuggggguuuuccuu

SEQ ID NO: 209032 - RNA, 64 nt, Human
ggaauagugaaggagggaggccucuuugcaguugagauaagaggaaggcuucugucuccugcuu

SEQ ID NO: 209033 - RNA, 64 nt, Human
aacacauucaugacacacaaaacuggcuggaaggagauaagagcacuggguuugagauucccuc

SEQ ID NO: 209034 - RNA, 64 nt, Human
ucagcccagggaaugugguuuucacuucuucgucagauaagaccaacaugaagggguauguuga

SEQ ID NO: 209035 - RNA, 63 nt, Human
gauuuggcuuuccugucccuuccccaugccagccccccagaguguucugccuugugcugccuc

SEQ ID NO: 209036 - RNA, 63 nt, Human; identical to SEQ ID NO: 89984

SEQ ID NO: 209037 - RNA, 63 nt, Human
gccacacaaagucccuacgccucccugcugccucccccagaugcaugugguggcaucaccauu

SEQ ID NO: 209038 - RNA, 64 nt, Human
uuuugagggagauaugauuauauuguauuuucucagauaagaaaaauguuuuuuaacaauauua

SEQ ID NO: 209039 - RNA, 64 nt, Human
uggcguuauguuuggaguuaugaggggaagugaaagauaagaauuaccuacagcuuuguacuca

SEQ ID NO: 209040 - RNA, 64 nt, Human
uaauggccuccagguccauccauguuguugcaaaagauaagauuucauuauuuuuuuuuggcug

SEQ ID NO: 209041 - RNA, 64 nt, Human
ggaaacccccaaggugucgaggaggaucagauccagauaagagaagaugauuccuucuaguccu

SEQ ID NO: 209042 - RNA, 64 nt, Human
cuguguuuaaagcuuuuucucuggaugcaaaaaaagauaagaauaucaggaaaauauauguauc

SEQ ID NO: 209043 - RNA, 64 nt, Human
uuaauuagggguugcuaagaagcgagcacugaccagauaagaaugcugguuuuccuaaaugcag

SEQ ID NO: 209044 - RNA, 64 nt, Human
acucagcuuuauuugacauggaaccuaaaauagaagauaagaucuugauauucuguacaaguug

SEQ ID NO: 209045 - RNA, 64 nt, Human
accuuuuuuuaaucacuuguuuuguuuugacuauagauaagaaaggacuacagcauuugaugug

SEQ ID NO: 209046 - RNA, 64 nt, Human
acauuuugcauggcugcaguuccuuuguuucuugagauaagauuccaaagaacuuagauucauu

SEQ ID NO: 209047 - RNA, 64 nt, Human
aaugauaaggcuguaguacaagcaagcaguuuaaagauaagacuugagauuuuugaauugagaa

SEQ ID NO: 209048 - RNA, 64 nt, Human
agcugucauuaugcaguguguauauucaaauaugagauaagacuauguacacauccacuuuugu

SEQ ID NO: 209049 - RNA, 63 nt, Human
auccagaccuuggcuucugagcauccgcuaagaagauaagaccuacucaagcuggaaaugccg

SEQ ID NO: 209050 - RNA, 64 nt, Human
uugagaagaggaaaagaacuucucauuuucuaucagauaagaaucacauuagaaacuaaguaca

SEQ ID NO: 209051 - RNA, 64 nt, Human
caaguuuguuuuucucgggggcaucucucucaucagauaagacagcuacaucagccugccagau

SEQ ID NO: 209052 - RNA, 64 nt, Human
aagaaagaaucuugguggauuugugucucaaaucagauaagagaagccuguuuaaagagcagau

SEQ ID NO: 209053 - RNA, 64 nt, Human
acacuacuucugcuguucaaucaagagucuugguagauaagaaaaaaaucagucaauauuucca

SEQ ID NO: 209054 - RNA, 63 nt, Human
augggagaccccaacccagcugacaauguggagcccccagaacuucagaacuguguggaggca

SEQ ID NO: 209055 - RNA, 63 nt, Human
uuucccugacuccuggugcccucucccuuuguccccccagagagacauaugcccccagagaga

SEQ ID NO: 209056 - RNA, 63 nt, Human
cccucucccuuuguccccccagagagacauaugcccccagagagagcaaaucgaagcguggga

SEQ ID NO: 209057 - RNA, 64 nt, Human
uuugaauaauaguuuccuuuaauaggaguauuagagauaagaaaguauaugaaaauauacugga

SEQ ID NO: 209058 - RNA, 64 nt, Human
auuguagcauugacuugaagugagacaugguuauagauaagagaguacaaaaugacucuuuuuc

SEQ ID NO: 209059 - RNA, 64 nt, Human
auucaaauuuauaguagaagaaaaaaaaucuuucagauaagagguguucuccagaauggaggaa

SEQ ID NO: 209060 - RNA, 64 nt, Human
cggagugaguuuuuuagugcgugcagauggugagagauaagaucuauagccucugcagcggaau

SEQ ID NO: 209061 - RNA, 64 nt, Human
auucaaauuuauaguagaagaaaaaaaaucuuucagauaagagguguucuccagaauggaagaa

SEQ ID NO: 209062 - RNA, 64 nt, Human
aauuuuuaggcaguaagucaccacaaaauguuuuagauaagacacaauaaaauuauuauaaaua

SEQ ID NO: 209063 - RNA, 64 nt, Human
uaccauaauguaucaaggagcguccauggauacaagauaagauguguaccuuaguagaauacag

SEQ ID NO: 209064 - RNA, 64 nt, Human
cccucucccccuucagccaugcugauggcagagaagauaagaacuuggagcccauuucucacug

SEQ ID NO: 209065 - RNA, 64 nt, Human
gggcagugaagagcacagacucugugggcuucuuagauaagaaaacguagcuucagugggggcu

SEQ ID NO: 209066 - RNA, 64 nt, Human
caggauguugaaagggugcaaauuccuucuggguagauaagaaaugacucugggagaggauuuc

SEQ ID NO: 209067 - RNA, 64 nt, Human
gcaacgagucagaauuacuaaucauagaucuugaagauaagaaagauuuggaaccacuucagau

SEQ ID NO: 209068 - RNA, 64 nt, Human
acuugagccagagaguugaaagcuuggaaagaccagauaagaaaccugcccuuugucucccuag

SEQ ID NO: 209069 - RNA, 64 nt, Human
aaaaacaacaacaaacaaaacuaucacacaggauagauaagaagauugguuaaacaguuuugug

SEQ ID NO: 209070 - RNA, 64 nt, Human
aguagauacgcaacagauaaugugggaaaaaaagagauaagaggaggaagcuaauaagagacug

SEQ ID NO: 209071 - RNA, 64 nt, Human
uugagucauauguucuuagaguuaaauuugucucagauaagaaaguguuaaagcauuagccugu

SEQ ID NO: 209072 - RNA, 64 nt, Human
ugaauacaguagcaucauaccuauaguuggucuuagauaagaaaugaacuacuugauauagcaa

SEQ ID NO: 209073 - RNA, 63 nt, Human
uacaaagcucaccaagccccugcccauguacagcccccagacccucugcaauaucacuuuuug

SEQ ID NO: 209074 - RNA, 63 nt, Human
gaauacagcagucucaacugggggcaauuuugccccccagaggacauugggcaauguuuggag

SEQ ID NO: 209075 - RNA, 63 nt, Human
ggcgaugcugcagcggcugaaaccacgucaagucccccagagcccggcauucuauguaagcau

SEQ ID NO: 209076 - RNA, 64 nt, Human
ucugggagccugcuucgaauagugggacucagggagauaagaccuucuugcuggauuuuuauga

SEQ ID NO: 209077 - RNA, 64 nt, Human
ugaaaauucaguuuuggagcaaguccugugagcaagauaagaaucuauagaaccaagaugcuca

SEQ ID NO: 209078 - RNA, 64 nt, Human
acuacugguaauaaaacuacacaugcaagaugucagauaagaaauagguuuauauuuaccuucc

SEQ ID NO: 209079 - RNA, 64 nt, Human
agacacaggaaaacuagggaaucaaauucuucagagauaagaacuuguucuuccaaguuuccuu

SEQ ID NO: 209080 - RNA, 64 nt, Human
auuaccuacuuuauuuuguuugucuuuuuaaagaagauaagauucugggcuugggaauuuuauu

SEQ ID NO: 209081 - RNA, 64 nt, Human
ugacaaugaauugaauaucuaauaaggagauuuaagauaagacccaauaaaugaauguauucug

SEQ ID NO: 209082 - RNA, 64 nt, Human
cuaucuguaccaacaagcaaggccacuuuucagaagauaagaguucacugaaugcaccuauuau

SEQ ID NO: 209083 - RNA, 64 nt, Human
ccacuacccagcccaucucugccugugcuuauccagauaagaagaccaaaaucccgcugggaaa

SEQ ID NO: 209084 - RNA, 64 nt, Human
gcugaaaucaagcacgugagaguuuuuguuuaaaagauaagagacacagcauguauuaugcacu

SEQ ID NO: 209085 - RNA, 64 nt, Human
gaaucuuauuagguauuugaacucuaaaacuaacagauaagacagauauguaccuuauuagagc

SEQ ID NO: 209086 - RNA, 64 nt, Human
aaaaaaaaggaauccgugacccacagagcuagacagauaagaugcauaguugaccagucauaaa

SEQ ID NO: 209087 - RNA, 64 nt, Human
auugcauuugugggaaacuuaaccaccuacaaggagauaagaaagcaggugcaacacucaaguc

SEQ ID NO: 209088 - RNA, 64 nt, Human
aguaugucuccauuguucacuguagcauagggauagauaagauccugcuuuauuuggacuuggc

SEQ ID NO: 209089 - RNA, 64 nt, Human
auaugauuuuugaacuagcugauaauaaaguuguagauaagauguuuuaaccugucuuuuaaua

SEQ ID NO: 209090 - RNA, 64 nt, Human
aaaagagaaaauucauaaugauguuauggcaaacagauaagacugauaaacuucguauuguaua

SEQ ID NO: 209091 - RNA, 64 nt, Human
gaagccucccauauagacuugaucucaaagaagcagauaagaagacagaaaaguguuuuaagug

SEQ ID NO: 209092 - RNA, 63 nt, Human
uucccaauuccaucaccacugccaacaacuccucccccagagaucuggcuggagcccagaaaa

SEQ ID NO: 209093 - RNA, 63 nt, Human
ugcaguaauuuauuuucuguauggacugucccucccccagaggcuuccccacccuccauugcc

SEQ ID NO: 209094 - RNA, 63 nt, Human
cagccacugugggaccaacaccccucccacacucccccagacugcucgucuaucaccaggauc

SEQ ID NO: 209095 - RNA, 64 nt, Human
caguuuuucuuuuauuuauuuugccuguuugugcagauaagaacagaaacuuuucuaagaccca

SEQ ID NO: 209096 - RNA, 64 nt, Human
caagaagcaaguuguacugcuagaaacuucucuaagauaagaggccaggccagucaguuuggcc

SEQ ID NO: 209097 - RNA, 64 nt, Human
gucguuuuguaaaguuuucaacugcaucugaguaagauaagauuuucuaaaagacuauuuugau

SEQ ID NO: 209098 - RNA, 64 nt, Human
gauuauagagaggaagaaaugguaacaguauggcagauaagaauuacaauuauagaaaaugagg

SEQ ID NO: 209099 - RNA, 64 nt, Human
gcaaagcuuuuaaccuuccuuaacccuuaacuguagauaagaaaauucauacuggaaagaaacc

SEQ ID NO: 209100 - RNA, 64 nt, Human
gcucaccuuagaggaauuuccucgagaacaacagagauaagaaaagaaccggccuggccaaucc

SEQ ID NO: 209101 - RNA, 64 nt, Human
cacuacccugagcuaaacgugucugugcuuucuaagauaagagcuugaucccuuucuucuaucu

SEQ ID NO: 209102 - RNA, 64 nt, Human
uccuuccuuccaccugucagcuucucugcuucugagauaagaaccauuuguguaacaccaacac

SEQ ID NO: 209103 - RNA, 64 nt, Human
ucugaaauucuauugcuuggagagaauccccuccagauaagagauuuugagugaaaaacauaau

SEQ ID NO: 209104 - RNA, 64 nt, Human
ccagguuugguuccucccggggcccccacuguggagauaagaaggggauggaaugggggaagag

SEQ ID NO: 209105 - RNA, 64 nt, Human
gauuuauauugauugcacuugccugccaugauuuagauaagauuuuuuuugcaugguuuuuauu

SEQ ID NO: 209106 - RNA, 64 nt, Human
cuuuggaccauugguuacaaaacagacacagccaagauaagauccacacacacauuauuaacaa

SEQ ID NO: 209107 - RNA, 64 nt, Human
gaaaugcaacuugggauaaucaugaacagguuaaagauaagauuucaagaagccaucuaagaau

SEQ ID NO: 209108 - RNA, 64 nt, Human
uucuccuguaucugaauuuuaaaauuaaaaaggcagauaagacauaaauaguuaucauuuuaau

SEQ ID NO: 209109 - RNA, 64 nt, Human
aauaguaugcaagaaacucaggcauugaacuugaagauaagaguauuauugcuuuaauccagug

SEQ ID NO: 209110 - RNA, 64 nt, Human
ggcuggccacggccaggugugggagggacuucgaagauaagagugagcggcugccuccgggagc

SEQ ID NO: 209111 - RNA, 63 nt, Human
cugagacugguuuggaucucccugcaugacagucccccagaaacuuagugaguccuggacugg

SEQ ID NO: 209112 - RNA, 63 nt, Human
gccaaggcagacauuggcccucccuucucccagcccccagaggccuggccuuggguucgucag

SEQ ID NO: 209113 - RNA, 63 nt, Human
cugcccccacugucccccuacccaccgauggagcccccagauagagcuggguggccuguuucu

SEQ ID NO: 209114 - RNA, 64 nt, Human
uauggcugaauauacuaaauaacagaaaaguuacagauaagaauuuauuucuacugaacucuau

SEQ ID NO: 209115 - RNA, 64 nt, Human
cauaggcagccuauagggcccaaagaaggcaaaaagauaagauuuacucaaguagcauuugggc

SEQ ID NO: 209116 - RNA, 64 nt, Human
uccugggggacugggugggaaggguggugggaggagauaagagauacaaacugagacuccagcc

SEQ ID NO: 209117 - RNA, 64 nt, Human
gcuuagcucagagcaguggcugauggggacacugagauaagaucggaggggagcugucaaugcc

SEQ ID NO: 209118 - RNA, 64 nt, Human
gcauauuuaaacaaggguccucaacccugacugcagauaagaaucacuuggguuacuucagaug

SEQ ID NO: 209119 - RNA, 64 nt, Human
uuguuaaaacgguuaggacuguuuuguccaggaaagauaagaggaccaaacauauaaggugaaa

SEQ ID NO: 209120 - RNA, 64 nt, Human
aaaccagacuuuucagacaaacccuuuguauuguagauaagaggaaaagacugagcaugcucac

SEQ ID NO: 209121 - RNA, 64 nt, Human
gucaacuggcaaauuggaauauagacagucaaucagauaagaaguauacuuugauuaaguaaaa

SEQ ID NO: 209122 - RNA, 64 nt, Human
ucauuuuuuaagauucccucguuaugccacgaccagauaagaaucaccaguggguauucaauaa

SEQ ID NO: 209123 - RNA, 64 nt, Human
uuuucucuuacuauuuguguuuaccagaguugggagauaagauaguuuccaugaagguguguau

SEQ ID NO: 209124 - RNA, 64 nt, Human
aaguuaagaccuucauuuaagaggcagaagauuaagauaagaaauauaagauagaaaagcuuug

SEQ ID NO: 209125 - RNA, 64 nt, Human
agccaguugcucugccacagacauagacaaagagagauaagauuucacauuauccaucacugca

SEQ ID NO: 209126 - RNA, 64 nt, Human
gaauauagcucuuuugaaaguacucgacaccuuuagauaagaauuaaaaccaaccuauguaacu

SEQ ID NO: 209127 - RNA, 64 nt, Human
uuucuguauuaauuauaccaguguuaagugacauagauaagaacuuugcacacuucaaaucaga

SEQ ID NO: 209128 - RNA, 64 nt, Human
gaagcgccauaagucaguugaguauuugaucccuagauaagaacaugcaaaucagcaggaacug

SEQ ID NO: 209129 - RNA, 64 nt, Human
ggguuucugauauuuguaaauguguuucuuuauuagauaagaguguauuaccauuaaagucauu

SEQ ID NO: 209130 - RNA, 63 nt, Human
aggcaguaauugcauuuuaucugucucaugaugcccccagagaacuuccaacucaguaggacc

SEQ ID NO: 209131 - RNA, 63 nt, Human
gugguucagguggggucuccagaaggcugcuugcccccagagagccaucucuuccauuuuuga

SEQ ID NO: 209132 - RNA, 63 nt, Human
aaggucugugggcucuaggcagcccggcagcagcccccagaggaacugcucccaccucuccuu

SEQ ID NO: 209133 - RNA, 64 nt, Human
uuuagagaggaugacagauccauaaagagaguaaagauaagagaaaaugucuaaagcaucugga

SEQ ID NO: 209134 - RNA, 64 nt, Human
ugccagaaagauugauaaauaaauauuuuuuacaagauaagauacaauuuuuguaucucaauac

SEQ ID NO: 209135 - RNA, 64 nt, Human
uaauuuagcaaaauauuugucgguggagggaaguagauaagaauguauuaguguauuuuaaagu

SEQ ID NO: 209136 - RNA, 64 nt, Human
aguguauuuuaaauucucagucaugcacucacaaagauaagacuuguuucuuucugucucucuc

SEQ ID NO: 209137 - RNA, 64 nt, Human
ucucugagcaaaacaccuguaacuaaaaaagugaagauaagaaaauacucuuaaagcugaguau

SEQ ID NO: 209138 - RNA, 64 nt, Human
uagauguguuuguuuagaaguggguagauauugcagauaagacuguucuucagaaucauguuaa

SEQ ID NO: 209139 - RNA, 64 nt, Human
aaaggaauaugggucaguucucaaaugucaauguagauaagagucaucuaguagagaacucauc

SEQ ID NO: 209140 - RNA, 64 nt, Human
cccagaauuacaggaguuagcacaccagcucuacagauaagaaaacauugaaauucaaagauua

SEQ ID NO: 209141 - RNA, 64 nt, Human
caucugggucuuccaucuagaacuguuuacaugaagauaagauacucacuguucaugaauacac

SEQ ID NO: 209142 - RNA, 64 nt, Human
uaguuuguacaagcagcuuucguugaaguuuagaagauaagaaacaugucaucauauuuaaaug

SEQ ID NO: 209143 - RNA, 64 nt, Human
auuccaugaaucagaaaauguuuccauagccuucagauaagaugauccuuccagagcucuaugu

SEQ ID NO: 209144 - RNA, 64 nt, Human
caaagccacugacugagauggagugagcugagacagauaagagaauaccuuggucucaccuauc

SEQ ID NO: 209145 - RNA, 64 nt, Human
auugacacuggauaacaguaaugaucccauuaccagauaagauugacugacggggaaaaaaaaa

SEQ ID NO: 209146 - RNA, 64 nt, Human
augcuagugacugaggugucaauagccuuuaccaagauaagauccuuuggaguuucucuggauc

SEQ ID NO: 209147 - RNA, 51 nt, Human
agaaaaauuauaugaucugaaagauaagauuuuauuacugggcuguuuaug

SEQ ID NO: 209148 - RNA, 64 nt, Human
uauaaauccugaugccugggggucaaguauuuuaagauaagagggggaaaaacacauaaaguca

SEQ ID NO: 209149 - RNA, 63 nt, Human
aggacaccaguaaggagcuggaugaaugagaggcccccagaugcagagagacuggagagggug

SEQ ID NO: 209150 - RNA, 63 nt, Human
cccuggggcugguggauugggcagaauccugggcccccagagaccuuugcccacacacacucc

SEQ ID NO: 209151 - RNA, 63 nt, Human
caucugaaagucaggccugcugcaggacaggaucccccagagaccccauuugccucucaacac

SEQ ID NO: 209152 - RNA, 64 nt, Human
gaaucauuucuauuucuccuccaugggagaaaauagauaagaguagaaacugcagggaaaauua

SEQ ID NO: 209153 - RNA, 64 nt, Human
uaucacacugaauagcaggugucaccaccuccugagauaagaaacauaguuuuauacauuaugu

SEQ ID NO: 209154 - RNA, 64 nt, Human
ugacuuaaaaguguuaccuuuguagucaaauuucagauaagaauguacauaauguuaccggagc

SEQ ID NO: 209155 - RNA, 64 nt, Human
cuaauccaaauaucuuugacccuggccacuuucuagauaagaauggcaacuuuaagaaaaguga

SEQ ID NO: 209156 - RNA, 64 nt, Human
cuugucacuuauuugggagaaauaggggcacgugagauaagaagaagaauaauuuugauguugg

SEQ ID NO: 209157 - RNA, 64 nt, Human
gaaagaacaucaaacaagccacucaucucuacagagauaagaaaacaaguuuggcagagcaaga

SEQ ID NO: 209158 - RNA, 64 nt, Human
gcugcgaccugaugcugccagucuguuaaaauaaagauaagagacuuggacuccagaccccugu

SEQ ID NO: 209159 - RNA, 57 nt, Human
auccuauccgacuugccuaguccucaaagauaagaaguugguguucagcuuaguuga

SEQ ID NO: 209160 - RNA, 64 nt, Human
uugcauuacaucaaacagaguucaaauuccacacagauaagaggcaggauauauaagcgccagu

SEQ ID NO: 209161 - RNA, 64 nt, Human
ugauuccguuuguaucuguaaauauuuguucuauagauaagauacaaauaaauauuauccacau

SEQ ID NO: 209162 - RNA, 64 nt, Human
aaaaaaaaagccuaaauaguaagcuggugaaacaagauaagauuugcauuuuacuagaacuugc

SEQ ID NO: 209163 - RNA, 64 nt, Human
gcucuccaaagcacuuuuggauacucaggaggaaagauaagauacauguuugaaguauucaauc

SEQ ID NO: 209164 - RNA, 64 nt, Human
ggagaggagaaggaagggcaaggaaggaauugacagauaagaagcaaaugguuucuuguacaga

SEQ ID NO: 209165 - RNA, 64 nt, Human
gauuacuaaaucacaugagcggaccuugucugucagauaagauuuuuaccuggaaauuccauga

SEQ ID NO: 209166 - RNA, 64 nt, Human
cacuggcauuucagucugacguggauaaagaagaagauaagaaagagguauguaaugauacugc

SEQ ID NO: 209167 - RNA, 64 nt, Human
ugaaucauaagucuucaguggccuagcaauauccagauaagaaaggaccaacuuggguuccuua

SEQ ID NO: 209168 - RNA, 63 nt, Human
uaacuuuuuuuuuauuguggguuuugauuuuuucccccagaaauugguuuuauuugauguacc

SEQ ID NO: 209169 - RNA, 63 nt, Human
uuuuuuuuauuucaaauuauaacacuuuuuuuucccccagaaguggguguuucauguugcuac

SEQ ID NO: 209170 - RNA, 63 nt, Human
auggcucucgaaagcccaacuccaaguuccuuucccccagaaagcggggagaagccagaguuc

SEQ ID NO: 209171 - RNA, 64 nt, Human
uaagccugaaagaaccuuuaguuuaaggagggugagauaagagacccuuuuccuaccagcaacc

SEQ ID NO: 209172 - RNA, 64 nt, Human
ccgaugcagcucucuuucucccccaccucuugcgagauaagagggaucauucauguagaagaaa

SEQ ID NO: 209173 - RNA, 64 nt, Human
cuucugugaguauaacuccugcaguuccuauagcagauaagauauaagaaagugccuccuagug

SEQ ID NO: 209174 - RNA, 64 nt, Human
cacacuggcccugcagugaugcagggcgggagggagauaagaagaccccgcagucaaguggagc

SEQ ID NO: 209175 - RNA, 64 nt, Human
cacaccuguuagguuacaucugcuauugucaaaaagauaagagauagcaagugucagcaagggu

SEQ ID NO: 209176 - RNA, 64 nt, Human
aauauguggucuaucaccacugaauucauguaauagauaagaaaaaaauuagagguggaugucu

SEQ ID NO: 209177 - RNA, 64 nt, Human
uguaguagagguuaagauugcugugagcuuuaucagauaagagaccgagagaaguaagcugggu

SEQ ID NO: 209178 - RNA, 64 nt, Human
caacaauaccugcuucccaauuacucauuuccucagauaagaagaaaucaucucuacaauguag

SEQ ID NO: 209179 - RNA, 64 nt, Human
ugaaaauauucccugagagagaacagagagauuuagauaagagaaugaaauuccagccuugacu

SEQ ID NO: 209180 - RNA, 64 nt, Human
cacugggaguuagguacggucugaaguuaugucuagauaagacuucagacguccugggauugaa

SEQ ID NO: 209181 - RNA, 64 nt, Human
uuuauuuuugagauaccuguuuugaauuuaaaggagauaagaggcguaaaguaggaugcucacu

SEQ ID NO: 209182 - RNA, 64 nt, Human
gaaggguucccuuguccuagacauugaggggcccagauaagaccaaaaccaagcauaagagaag

SEQ ID NO: 209183 - RNA, 64 nt, Human
gggacagcacuguguauguuuauaaacuaaaugaagauaagauauuauuuuguauaaacauuca

SEQ ID NO: 209184 - RNA, 64 nt, Human
ccaggaguucaagaucagccugggcaacagagugagauaagacccaaucuuuauuuaaaaaaua

SEQ ID NO: 209185 - RNA, 64 nt, Human
gccacuggggccaauuugugguuaagagguggugagauaagaaguggaacgugacaucuuugcc

SEQ ID NO: 209186 - RNA, 64 nt, Human
uggcaagaagguccccaggauagaccuagcaaggagauaagaauagaucauuaaaaaauaaaua

SEQ ID NO: 209187 - RNA, 63 nt, Human
cagccaagcugccuuaacucgccccucggggcucccccagagacugugccccgggcgggccgc

SEQ ID NO: 209188 - RNA, 63 nt, Human
uacaaauaguugcuucccacugccccccgcccgcccccagaaugauauuaauuuugccuuuuu

SEQ ID NO: 209189 - RNA, 63 nt, Human
gccgagcccugcauguggagcccucccaccccacccccagauagagggaaauaaccaaaaaac

SEQ ID NO: 209190 - RNA, 64 nt, Human
ugcacuuuauauaaccaaagcuuagcaguuuguuagauaagagucuauguaugucucugguuag

SEQ ID NO: 209191 - RNA, 64 nt, Human
gacuguucagaagcacaauacuaucuccugaaagagauaagagacauucccuagauucaaaggc

SEQ ID NO: 209192 - RNA, 64 nt, Human
ugucuuuugugcaugggcgacccauuacaguaugagauaagauugaguucugaugcguuaaacg

SEQ ID NO: 209193 - RNA, 64 nt, Human
uuacuuuuuccucuucugguuuuggaaaauuuccagauaagacaugucaccauuaauucucaac

SEQ ID NO: 209194 - RNA, 64 nt, Human
aagucuguauggcaugacaacuacuuuaaggggaagauaagauuucugucuacuaagugaugcu

SEQ ID NO: 209195 - RNA, 64 nt, Human
cuuuuuacuuuaaaauaugccuuaguuuuugaauagauaagacauucaagugucagaaaguaaa

SEQ ID NO: 209196 - RNA, 64 nt, Human
uuauuuuugcuuuugugguugagggaaggacaagagauaagagguuguuaccucaguaaaaacc

SEQ ID NO: 209197 - RNA, 64 nt, Human
auaggcuguaaucaagaaaauaugccauuuauagagauaagauaaaugaaauaauacuucagcc

SEQ ID NO: 209198 - RNA, 64 nt, Human
uucuugguguauccuuuuccuuucaacacagugcagauaagaguugaauauugauaucauacau

SEQ ID NO: 209199 - RNA, 64 nt, Human
cuucuuaccaaguaccuuacuauaaguaaaccuaagauaagaaaacccagauuuaccuauaaga

SEQ ID NO: 209200 - RNA, 64 nt, Human
gaauaaggcaaggaguggguuguuuuucauagcuagauaagaucuuuuccaaaguuuuucuuag

SEQ ID NO: 209201 - RNA, 64 nt, Human
aguaguuugaguguuaugaauauuuaaaauuguaagauaagaaacaguuucuuagagcagauag

SEQ ID NO: 209202 - RNA, 64 nt, Human
ugcguuuuggcccccauuugcucccugagcuccaagauaagaauggccccgagagaacugcuga

SEQ ID NO: 209203 - RNA, 64 nt, Human
ggacauuuggauuuacuuuuacagaauauugaaaagauaagacaaauuauaaauaaguucuaaa

SEQ ID NO: 209204 - RNA, 64 nt, Human
uuuaaucacuucggcagguugaacaacuccauguagauaagagcaaguguaggcaaagguuuag

SEQ ID NO: 209205 - RNA, 64 nt, Human
cuggcauccuccuaaggaccggggcgcguggcccagauaagaauagguguuccuuugugcucau

SEQ ID NO: 209206 - RNA, 63 nt, Human
ccuuugugugcaugggucagucaccauauguuccccccagagaaugugucuauauccuccuuc

SEQ ID NO: 209207 - RNA, 63 nt, Human
uugauucacaaugaaaugcucuccuuuccccugcccccagaccuuuuauccacuuaccuagau

SEQ ID NO: 209208 - RNA, 63 nt, Human
cuuagcugucagugugacuuccuuucccacccacccccagaaaaacagaaagagcaucugggg

SEQ ID NO: 209209 - RNA, 64 nt, Human
aaaacccauauuucugaaauaaugcugauuccugagauaagaaaguggauuugauccccagucu

SEQ ID NO: 209210 - RNA, 64 nt, Human
aaggagcugggaaguaaguucuuccccagccuccagauaagagccccgccggccaaucccuuca

SEQ ID NO: 209211 - RNA, 64 nt, Human
gaaccaguguguuuuuugguaaaauggugauuguagauaagauuaguucccugauccccugccc

SEQ ID NO: 209212 - RNA, 64 nt, Human
gaacccacagaccucacaccugggggacagaggcagauaagaaggugcgagggccacagcccug

SEQ ID NO: 209213 - RNA, 64 nt, Human
gaguccaugagaguguuaaugggacauuuucuuuagauaagauguuuuauaugaagaaacugua

SEQ ID NO: 209214 - RNA, 64 nt, Human
ccuugugcugugaggaagaccaaagccucagggaagauaagagauauggagaugggagggggag

SEQ ID NO: 209215 - RNA, 64 nt, Human
aacagguucuguugcugcugagcuuucgucaggaagauaagacuuucccaacaguccgaagccu

SEQ ID NO: 209216 - RNA, 64 nt, Human
ccugaccucagaggugcaccagugccgcccagguagauaagagcugcagcauugacugugcuuc

SEQ ID NO: 209217 - RNA, 64 nt, Human
ugauuuucaugauucaugagcuggguacugacugagauaagaaaagccugaacuauuuauuaaa

SEQ ID NO: 209218 - RNA, 64 nt, Human
auaaauuuacuuuuacaugaucguauaaguuucuagauaagauaaacaaauuuuguuuaaauuu

SEQ ID NO: 209219 - RNA, 64 nt, Human
cugugggaugauuagguuuaacgcauugugggcaagauaagaaugacacuuugacuguucucuu

SEQ ID NO: 209220 - RNA, 64 nt, Human
gcaucgcugaagcuuuuggagacuuuuggauggaagauaagauagggaagauuaaguuccagca

SEQ ID NO: 209221 - RNA, 64 nt, Human
aaaacagaguguuauauauauauuuuuuggugcaagauaagauuuucuguuuuuugaaauaagu

SEQ ID NO: 209222 - RNA, 64 nt, Human
ugccucccuaugcaaaaaauuaaccagaugaugcagauaagacagcauaggugauggcugcuug

SEQ ID NO: 209223 - RNA, 64 nt, Human
cucacaauuuuccugaaccccaaagggagcagagagauaagaggacagaagaauggagauggga

SEQ ID NO: 209224 - RNA, 64 nt, Human
uaguacuuauaauauacaaaugaauuauacuauuagauaagaauuaaauauucuauuuuuauaa

SEQ ID NO: 209225 - RNA, 63 nt, Human
aggaguuggugccccucauuccagaaucuccuacccccagaaaaggggugcuggaaggaggcc

SEQ ID NO: 209226 - RNA, 63 nt, Human
aagcacaugagcucucuaacagggugggggcuacccccagaccugcuccuacacugauauuga

SEQ ID NO: 209227 - RNA, 63 nt, Human
aaacuccccaaacccaaguugaaacaaaaaaaacccccagacuguaauaguauuauuauuauu

SEQ ID NO: 209228 - RNA, 64 nt, Human
uggcuaagagccucaaaaugaaccauaagaucucagauaagaagugauggugauaaaacaucaa

SEQ ID NO: 209229 - RNA, 64 nt, Human
ccuuuuuccuuucuuuuuuuuuucgaaaucaaguagauaagaacuucuuagacaaaaacacaca

SEQ ID NO: 209230 - RNA, 64 nt, Human
uuccagaaaaauuucccuugaggaaaaauguccaagauaagaugaaucauuuaauaccgugucu

SEQ ID NO: 209231 - RNA, 64 nt, Human
uuuucuuuacccaggauugguuucuucaauaaauagauaagaucgaauccauuuaauuucuucu

SEQ ID NO: 209232 - RNA, 64 nt, Human
ccuguaaguaauuaagaagacuaaguagccccagagauaagaccuccucggaucauugucccuu

SEQ ID NO: 209233 - RNA, 64 nt, Human
agggaauuccucuacuacaggaagaagguggcugagauaagaaaggaagcacagaagucgcagg

SEQ ID NO: 209234 - RNA, 64 nt, Human
uagcacuuacuagcauuucugaagguuggucuugagauaagauugaaaaugacaguuguugauu

SEQ ID NO: 209235 - RNA, 64 nt, Human
aauaauuaaaaacgguccuaaaaacuagcaaaccagauaagaaaagauguuaaugcccauuccc

SEQ ID NO: 209236 - RNA, 64 nt, Human
cuccuuccaggccuaagccugggauuugggccagagauaagaauccaaacuaugaggcuaguuc

SEQ ID NO: 209237 - RNA, 64 nt, Human
cuucccuaggagaggagugugaagcaaggagcuuagauaagacacccccucaaacccauucccu

SEQ ID NO: 209238 - RNA, 64 nt, Human
cucugacucaacuuucuaggcaccuagcagagaaagauaagaucaaaagguguuugguuuuucu

SEQ ID NO: 209239 - RNA, 64 nt, Human
aaaaaaaauaaaauaaauggcaaccccuggucuaagauaagagauaaaacaucagguggugagg

SEQ ID NO: 209240 - RNA, 64 nt, Human
ccagcuuuuucccgugcucccccaacuauguaucagauaagauucuuugaucccgacucugugu

SEQ ID NO: 209241 - RNA, 64 nt, Human
cuuuggugguagcuuucuuuggaagagacaaacaagauaagauuugauuauuuuccaaagugua

SEQ ID NO: 209242 - RNA, 64 nt, Human
uuggugauucauggauccccagaguugauccacaagauaagaaaucccuuucagagccagggaa

SEQ ID NO: 209243 - RNA, 64 nt, Human
aagaucugcaauauuauauauauaaauauauauaagauaagagaaacuguaugugcgagggcag

SEQ ID NO: 209244 - RNA, 63 nt, Human
aauuccaggacaugguaaaauguguuuuaauaacccccagacccaaaugaaaauuucaaaguc

SEQ ID NO: 209245 - RNA, 63 nt, Human
gucacagggggugucgggcggaggaaagugcaucccccagagcuuggguuccucucuccucuc

SEQ ID NO: 209246 - RNA, 64 nt, Human
uccuagaacaggaaaaauaaggaauuauauuuugagauaagaaguuaagcucuaguauaacaau

SEQ ID NO: 209247 - RNA, 64 nt, Human
cauuuauucuuucucauuugugggcuuuguucccagauaagaucacuccuucuggggacaagau

SEQ ID NO: 209248 - RNA, 64 nt, Human
cucuucuugagcuaaaacgucaaauaggagaggaagauaagauaaauauuuguaaauaaaaccu

SEQ ID NO: 209249 - RNA, 64 nt, Human
auuuuaagguguaaguuauaguaccuguacuugcagauaagaagcuuacuauaucauuauuaua

SEQ ID NO: 209250 - RNA, 64 nt, Human
uuaacuguuuauauacuaaagaaaaagcuuuacaagauaagacugaaauucagaauaccacauc

SEQ ID NO: 209251 - RNA, 64 nt, Human
acagagaaaaaggaaaguaaaaauauggcauaaaagauaagaauuggcucuccuguacagggca

SEQ ID NO: 209252 - RNA, 64 nt, Human
ggggagaucggugcuaccaaggaagagagcacacagauaagacagaggggaggaggugggcauu

SEQ ID NO: 209253 - RNA, 64 nt, Human
caaaaaaauaaaaauuggaagaagagcuuaaaaaagauaagauuuuaaagagucccaaguuauu

SEQ ID NO: 209254 - RNA, 64 nt, Human
ucauagguacaugaaguauuguguauaaaaaaagagauaagauuuaaccaacaucaacaaaaua

SEQ ID NO: 209255 - RNA, 64 nt, Human; identical to SEQ ID NO: 209254

SEQ ID NO: 209256 - RNA, 64 nt, Human
uuaaccaaagcuuaaaauuuuguauucuucuguuagauaagaccuuuuacccauuuaauuuguc

SEQ ID NO: 209257 - RNA, 64 nt, Human
caucccuguccuucaguuuauaaucuaguuggagagauaagaaacguacaaaccaaaagauaac

SEQ ID NO: 209258 - RNA, 64 nt, Human
cugauaagaaaauuucugacugucaguagaagugagauaagauccucagaggaaacaguaagaa

SEQ ID NO: 209259 - RNA, 64 nt, Human
aaacagcaacucucagcuugcuucaagaaccagcagauaagagaugguuaagcuguucuucacc

SEQ ID NO: 209260 - RNA, 64 nt, Human
augcuauuugcaauuccugcuccuaggggaggggagauaagaaacccucacucucuacagguuu

SEQ ID NO: 209261 - RNA, 64 nt, Human
aaagacugcauacuuuuggcaauccguuuaaacaagauaagaagguaggauaccuaugccuaug

SEQ ID NO: 209262 - RNA, 63 nt, Human
ccgcguggaguucuccucaggucgugcgaaacacccccagauucuucgcacagugucuagauc

SEQ ID NO: 209263 - RNA, 63 nt, Human
cuccagcuuuucuuuuucuguauauacucaugucccccagauuccaacauuucucacugaaag

SEQ ID NO: 209264 - RNA, 63 nt, Human
cugcccuagacccugccagaaaagggggcucuucccccagagaaguggcuuggagggaacuuc

SEQ ID NO: 209265 - RNA, 64 nt, Human
aaacauggaggaugaauuaccuuccuaucccuugagauaagacaucuuucaguuucaugauuaa

SEQ ID NO: 209266 - RNA, 64 nt, Human
gaaauucauggcuuuuucuuuuuuugcauauuaaagauaagacuuccucuaccaccacaccaaa

SEQ ID NO: 209267 - RNA, 64 nt, Human
ccuuccuggguugggcuggagucuggacuggcugagauaagagccuggcaaccagcaagagcug

SEQ ID NO: 209268 - RNA, 64 nt, Human
cucugaaagugaucaucuuuguauauaacaguucagauaagaaaauuaaaguuacuuuucucaa

SEQ ID NO: 209269 - RNA, 64 nt, Human
auuuaaaacuuggaugcuuaagaggccugcauauagauaagaauuucaggcaaaacuacauuua

SEQ ID NO: 209270 - RNA, 64 nt, Human
aguacuaucaguauugugaaauaauuccucugaaagauaagaaucacuggcuucuaugcgcuuc

SEQ ID NO: 209271 - RNA, 64 nt, Human
gaaauguaaucagauuuggccagaguucgccuacagauaagaaggcacugggccaggcucacac

SEQ ID NO: 209272 - RNA, 64 nt, Human
aguggccgguccccgcugugccaggugggcaggcaggagcaaggccugcgagggaggaacgggc

SEQ ID NO: 209273 - RNA, 64 nt, Human
cuuuuuuuuuuguuuguuacugccacuucuuuuuaggagcaaaucuccccagggguguacggua

SEQ ID NO: 209274 - RNA, 64 nt, Human
gaggggccacugcuggggguucaugggaucccgaaggagcaagcagucggcagcacccaggcca

SEQ ID NO: 209275 - RNA, 64 nt, Human
aggcaauucaucagcucaccugaaaucagccaggaggagcaaggacaagaugcgcacagggugg

SEQ ID NO: 209276 - RNA, 64 nt, Human
acaucacuacuucgauguucuacuuugcuuuccaaggagcaaaaauaacuuuggagccuucugg

SEQ ID NO: 209277 - RNA, 64 nt, Human
cuggcccgggaggggagugacagagggacguucuaggagcaauuggggcaagaagaggacagug

SEQ ID NO: 209278 - RNA, 64 nt, Human
accacugacagccuccaccuugagcacuauucuaaggagcaaauaccuuagcucccuugagcug

SEQ ID NO: 209279 - RNA, 64 nt, Human
aaaauauugggaccauggcagagaaaagcaggagaggagcaaaaugaaaauuaguuaacaaaug

SEQ ID NO: 209280 - RNA, 64 nt, Human
uccuguucagagcuuggagauguacaagggacauaggagcaauuuacacugacacacagcugcu

SEQ ID NO: 209281 - RNA, 64 nt, Human; identical to SEQ ID NO: 6169

SEQ ID NO: 209282 - RNA, 64 nt, Human; identical to SEQ ID NO: 6170

SEQ ID NO: 209283 - RNA, 64 nt, Human; identical to SEQ ID NO: 6171

SEQ ID NO: 209284 - RNA, 64 nt, Human
cuccuccagcccagacacacuccuccucuugggcaggagcaauccagaguuguuauuuuucuua

SEQ ID NO: 209285 - RNA, 64 nt, Human
gagcuccccacucacugcccuagaauuuauggcaaggagcaaaucuacagcauucucucccacc

SEQ ID NO: 209286 - RNA, 64 nt, Human
aggugagauaaugggccagggcacccaguccagaaggagcaauggcaccugggcagugccaggg

SEQ ID NO: 209287 - RNA, 64 nt, Human
uuugaaacuccaugcaaaccaugccuuuuuuuuaaggagcaaaaaucugagaaaaaaagugaga

SEQ ID NO: 209288 - RNA, 64 nt, Human
agaccuuggggucaugguucagcagagguuacauaggagcaaaugguucucaauuuuccaguuu

SEQ ID NO: 209289 - RNA, 64 nt, Human
gaaaagauaggaccaucagugacaguuaaguguaaggagcaaguggaauugaguccuucaggga

SEQ ID NO: 209290 - RNA, 64 nt, Human
ugacacaugaggacaggggccucuucuggcugucaggagcaaagccugaagacuuggagcugca

SEQ ID NO: 209291 - RNA, 64 nt, Human
caacuuccggucccuuuucccugccaucucaaagaggagcaauguaucuuccagagaagauuuu

SEQ ID NO: 209292 - RNA, 64 nt, Human
uuugcagggugugaggguuuggcgagguaugcguaggagcaagaagggacagggaauuucaaga

SEQ ID NO: 209293 - RNA, 64 nt, Human
gcaggcuguuccuuggggcggucagaccccagucaggagcaaugacugacuggcugcagccuuc

SEQ ID NO: 209294 - RNA, 64 nt, Human
ccugaggaguguccugucugcugggcuacaaaccaggagcaaccgugcagccacgaacacgcau

SEQ ID NO: 209295 - RNA, 64 nt, Human
ucuucagagagcucagacucucuaaugaugcugaaggagcaaaggcugagucagaaacacacuu

SEQ ID NO: 209296 - RNA, 57 nt, Human
caauauguaacauacucuaaaaguccaaggagcaaaauuugccuguccagcucccuc

SEQ ID NO: 209297 - RNA, 64 nt, Human
cagcucugccaaagcgaaugaaugguguuuccggaggagcaaguccuuuuccaacugggugugc

SEQ ID NO: 209298 - RNA, 64 nt, Human
uaauguagcuuauugaaauaacugucgcugaauaaggagcaaugagaaacaaaacuaauuuuug

SEQ ID NO: 209299 - RNA, 64 nt, Human
gagaagauauauuaaauguagucauaggggacugaggagcaaggguggccuugaagaggccaaa

SEQ ID NO: 209300 - RNA, 64 nt, Human; identical to SEQ ID NO: 6174

SEQ ID NO: 209301 - RNA, 64 nt, Human; identical to SEQ ID NO: 6175

SEQ ID NO: 209302 - RNA, 64 nt, Human; identical to SEQ ID NO: 6176

SEQ ID NO: 209303 - RNA, 64 nt, Human
uguaaaccaaaacguacuguaccguacagagaaaaggagcaaaaaaccaagucuucuguuuauc

SEQ ID NO: 209304 - RNA, 64 nt, Human
aaggaaacugaucucugggacgucagcugcugagaggagcaagcgguaguaccaccccuuaguu

SEQ ID NO: 209305 - RNA, 64 nt, Human
caggggcuuugggcccaagaacugcagauagcccaggagcaacagccuaaucccgugccccuuu

SEQ ID NO: 209306 - RNA, 64 nt, Human
cacucuccacauccccgccucccagacauauaccaggagcaauuucaaaacccucuccaguuuc

SEQ ID NO: 209307 - RNA, 64 nt, Human
ccccaugacacuagugaccaguaaaaugaaaaggaggagcaaaggagauuuugagucacagaaa

SEQ ID NO: 209308 - RNA, 64 nt, Human
cucuucucuuccuguaacacaagccacagaagccaggagcaaauguuucugcaguagucucugu

SEQ ID NO: 209309 - RNA, 64 nt, Human
aauuugacauguguguggcauuaucaaaaugaagaggagcaaggagugaaggagugggguuaug

SEQ ID NO: 209310 - RNA, 64 nt, Human
uugggggugcuaacaacuuguggcuuuaacugacaggagcaauuaaaaagagcaagaggguucu

SEQ ID NO: 209311 - RNA, 64 nt, Human
ugaauggaagaugaugggaaauaugacuucaccaaggagcaaugcugggauugcaacuguaggg

SEQ ID NO: 209312 - RNA, 64 nt, Human
ugagauugauuauuguguuuauauguauaaaaauaggagcaaaagaaaauacucugggaauagu

SEQ ID NO: 209313 - RNA, 64 nt, Human
caugugcagaaaaacagaguuauccacacaagucaggagcaaaacccaaguagaugccucuagg

SEQ ID NO: 209314 - RNA, 64 nt, Human
guggaaaauaagucgcuguuugguuaaguaauuuaggagcaaagcaaugcuccaagcgaggccu

SEQ ID NO: 209315 - RNA, 64 nt, Human
uguaccaacugcauguacuuuuggccuggcugcaaggagcaauauugguuuacucucguauccu

SEQ ID NO: 209316 - RNA, 64 nt, Human
uucugcugcccaguccccuggacacauugaagagaggagcaaguagcccuguccugacauugac

SEQ ID NO: 209317 - RNA, 64 nt, Human
ggucuauaugacagggaggagaguaaaggagagcaggagcaauuggcugccugcaaagccagcu

SEQ ID NO: 209318 - RNA, 64 nt, Human
gccauucuuguuaguugacugguauuuuuuacugaggagcaacucauuccagcaucaacaauaa

SEQ ID NO: 209319 - RNA, 63 nt, Human
ggaaagcuguagaaggcaagaagacucgagaaucccccagaguuauuuuucuccauaaagacc

SEQ ID NO: 209320 - RNA, 63 nt, Human
acacauaagugaaaauacggaaggcuuuggaaacccccagaugaacuucuauacaugugaaaa

SEQ ID NO: 209321 - RNA, 63 nt, Human; identical to SEQ ID NO: 89978

SEQ ID NO: 209322 - RNA, 64 nt, Human
cugugguggcugucucugucccucacugccuuccaggagcaauuugcacauguaacauagauuu

SEQ ID NO: 209323 - RNA, 64 nt, Human
cgccacuaaucccaacauuuuaggaggccuaggcaggagcaaucacuugugccugggaguucua

SEQ ID NO: 209324 - RNA, 64 nt, Human
ggcagccugagcucuuggauguggucagcucuccaggagcaaguccuguguggcaaaacugccu

SEQ ID NO: 209325 - RNA, 64 nt, Human
accucugcccggccgcgaccccauuugggaggugaggagcaacucugcccagccgccccgucug

SEQ ID NO: 209326 - RNA, 64 nt, Human
uaccagaaagguauaccuguugagacugauucagaggagcaacccuauuuagaaauggauuuau

SEQ ID NO: 209327 - RNA, 64 nt, Human
aguaugaaccaagaaaugguucaaaaacagugguaggagcaaugcuuucauaguuucagauaug

SEQ ID NO: 209328 - RNA, 64 nt, Human
uacuucuaucacugcauuuauuuugccugugcauaggagcaauuaggaucuaaaaaaauauaug

SEQ ID NO: 209329 - RNA, 64 nt, Human
gcacacaccugucccaugcccacccugagggaucaggagcaaacagacccugcaagguccucca

SEQ ID NO: 209330 - RNA, 64 nt, Human
agaagaaguaggaggagcugugugcccggauccgaggagcaaguuaaucugucccuucauucgu

SEQ ID NO: 209331 - RNA, 55 nt, Human
caccaaauggaaugcuguaaauuacaggagcaagagaaagaagauaauuuaacca

SEQ ID NO: 209332 - RNA, 64 nt, Human
gccggacacagaggaagcucaggcacagaggacgaggagcaagcuggcgccgacauggcgaagg

SEQ ID NO: 209333 - RNA, 64 nt, Human
uggacugggagguggaggcagagccccccaggacaggagcaacugucucagggaggacagagga

SEQ ID NO: 209334 - RNA, 64 nt, Human
cucuggaaguguguccuuacccuucugcagagugaggagcaagcuguuagagaugcagccacgg

SEQ ID NO: 209335 - RNA, 64 nt, Human
aguuuuuuuaguagcacuuucucuggaugacagaaggagcaaccacaugggcacccuuguucau

SEQ ID NO: 209336 - RNA, 64 nt, Human
uccacuaugugggucuuccuuuccccucaagagaaggagcaauuguuccccugagcaucugggu

SEQ ID NO: 209337 - RNA, 64 nt, Human
ugcccacagcuuccgcccacagaccuccagggacaggagcaaauugcaccacagcuccccgccu

SEQ ID NO: 209338 - RNA, 64 nt, Human; identical to SEQ ID NO: 6179

SEQ ID NO: 209339 - RNA, 64 nt, Human; identical to SEQ ID NO: 6180

SEQ ID NO: 209340 - RNA, 64 nt, Human; identical to SEQ ID NO: 6181

SEQ ID NO: 209341 - RNA, 64 nt, Human
uauacaaugacuuauuuuugguggcaaauacuuuaggagcaauaaugccuuaugguaauuauug

SEQ ID NO: 209342 - RNA, 64 nt, Human
caucaauaucccagaugguaaagacugaagggaaaggagcaaagagaaaaaccuccgaggaaga

SEQ ID NO: 209343 - RNA, 64 nt, Human
gguucaccccaaccuuccauauuuaucuguucaaaggagcaagaacuuucauauaggaauagaa

SEQ ID NO: 209344 - RNA, 64 nt, Human
cacaggaggguaauuuucuaacucuaguuugcagaggagcaaauugagguucagcaaggugaga

SEQ ID NO: 209345 - RNA, 64 nt, Human
gagccagucuauagcgcaaaccacacaccugccaaggagcaacagaauccuuccaggaccguuc

SEQ ID NO: 209346 - RNA, 64 nt, Human
uuccauuugguuuuacuauuuuaaagugggcguuaggagcaauuauuuauuaccuuuccauuug

SEQ ID NO: 209347 - RNA, 64 nt, Human
uaaggaggccucacaaucaugguggaaggcaaagaggagcaagucacaucuuacauggauggca

SEQ ID NO: 209348 - RNA, 64 nt, Human
cggugaaccuauaaaucagcagucucuugggcagaggagcaagccccucgaacaugauuucaaa

SEQ ID NO: 209349 - RNA, 64 nt, Human
acccaagugaagguucccaaggacaugagucuguaggagcaagggcacaaacugcagcugugag

SEQ ID NO: 209350 - RNA, 64 nt, Human
ucgaaaccuguccauaaaguaauuuugugaaagaaggagcaagagaacauuccucugcagcacu

SEQ ID NO: 209351 - RNA, 64 nt, Human
acauaaagguauuuagaauauauuaaaucguuagaggagcaacaggagaugagaguuccagauu

SEQ ID NO: 209352 - RNA, 64 nt, Human
gaccccagcaccaaaugacuggagacgcauccuuaggagcaaaugcuaaugaaggggagauuua

SEQ ID NO: 209353 - RNA, 64 nt, Human
ugaguuucaagaauuaaagcugcaagaggacuccaggagcaaaagaaacacaauauagaggguu

SEQ ID NO: 209354 - RNA, 64 nt, Human
cuuuuucuugucauuaacacauuguuauuucuguaggagcaacuucucugaucaaaauuacuuu

SEQ ID NO: 209355 - RNA, 64 nt, Human
uuugccccuagucuggcugcugcuaggacuucugaggagcaaugggacaugagugucccuguau

SEQ ID NO: 209356 - RNA, 64 nt, Human
acagauaacuaggguuugaguucaggcuugacacaggagcaaugggcagugagguggacagccc

SEQ ID NO: 209357 - RNA, 64 nt, Human; identical to SEQ ID NO: 6184

SEQ ID NO: 209358 - RNA, 64 nt, Human; identical to SEQ ID NO: 6185

SEQ ID NO: 209359 - RNA, 64 nt, Human
ggcacacagacuguguuuacucauugcugaacaaaggagcaaauguagaugccaaagauaagug

SEQ ID NO: 209360 - RNA, 64 nt, Human
ugaaaaccaaauuuccucaagaaauaacugaagaaggagcaagugugaacaguuucuuguguau

SEQ ID NO: 209361 - RNA, 64 nt, Human
ccccccuagcuuccagcaguccacuaucugccagaggagcaagggugccuuagaccgaagccag

SEQ ID NO: 209362 - RNA, 64 nt, Human
ccacccuggggccuugccccuaguacccccuggcaggagcaacccaccccauggucgagguucc

SEQ ID NO: 209363 - RNA, 64 nt, Human
ggauguagacacauuagaauuauaagaagacaugaggagcaaaucaugaagagcggauuggucu

SEQ ID NO: 209364 - RNA, 64 nt, Human
aagugucuucauucccaccuggaggguuugggagaggagcaaagcaguugaaaacuaguuaaug

SEQ ID NO: 209365 - RNA, 64 nt, Human
cugcuauuuggcagaagcugaaauuggagaaccaaggagcaaaaacaaauuuuaaaauuaaagu

SEQ ID NO: 209366 - RNA, 64 nt, Human
gaggagaacuaacccacacaggaucauuucgugaaggagcaaggcugaagaaccagaccuggac

SEQ ID NO: 209367 - RNA, 64 nt, Human
cuaaauuaugguaaaaaugugcacuauugugaaaaggagcaacguaguuuuggguuuuuuguug

SEQ ID NO: 209368 - RNA, 64 nt, Human
cugcuaaucacugugguugccaaauauuuacuucaggagcaaagauuuucaaacaagcauacac

SEQ ID NO: 209369 - RNA, 64 nt, Human
gacuccaacagacaggauugugugagcagcugaaaggagcaaaaaagaacucaguguaagagaa

SEQ ID NO: 209370 - RNA, 64 nt, Human
aacaguaacuuggaaauaugaaaaggccagaaggaggagcaagggcuguuuucuggagugguug

SEQ ID NO: 209371 - RNA, 64 nt, Human
aauguugcaggauacauagccccaaagauggucuaggagcaaucuaagcuguguuacuccaaag

SEQ ID NO: 209372 - RNA, 64 nt, Human
aggagggaggaugcugugugagagccaugcugucaggagcaagcuugcugcuccugugcugccc

SEQ ID NO: 209373 - RNA, 64 nt, Human
acagacggacaugggcccacaugggagggugagcaggagcaaggcugugcuugccuagggccuc

SEQ ID NO: 209374 - RNA, 64 nt, Human
agaacuugaaccugaagacaaugauuauuucuggaggagcaagggaacagaaacuacauuguaa

SEQ ID NO: 209375 - RNA, 64 nt, Human
gaguuuuccaaaauauagaaagcaguaggucaguaggagcaaacuagccaacagguacugucuu

SEQ ID NO: 209376 - RNA, 64 nt, Human
aauagaucuuucuugccaaggaaugcucuggcccaggagcaagguggaauguuucccugacgcu

SEQ ID NO: 209377 - RNA, 64 nt, Human
cugaauugauuuuaagaaaguugcaugauccuguaggagcaacauuuuuaccuaaaaaaugcua

SEQ ID NO: 209378 - RNA, 64 nt, Human
aaagaauaaaaauugacuucuugcuuguacauauaggagcaauacuauuauauuauguaguccg

SEQ ID NO: 209379 - RNA, 64 nt, Human
guaguuucugggucuacaaggacuuuccaaauccaggagcaacgccaguggcaacguagugacu

SEQ ID NO: 209380 - RNA, 64 nt, Human
uuuacugcagcacuauucacaauagccaagauauaggagcaaccuagguguccaacaacagaug

SEQ ID NO: 209381 - RNA, 64 nt, Human
cauaacugaucuggagcuuuuggacaaaauagagaggagcaagauaguuuccaccaugaggugc

SEQ ID NO: 209382 - RNA, 64 nt, Human
gugaacagcacaagaagaauaugaggugguuccuaggagcaacacuuucgaccuccaguucucc

SEQ ID NO: 209383 - RNA, 64 nt, Human
auguuuggaaucuuuccuuuuucaaaaguagguuaggagcaaauuaucauacauucugugacau

SEQ ID NO: 209384 - RNA, 64 nt, Human
ucucuggagaggguccaacugggaauccugcuaaaggagcaaagccuuguauuaccucuggaag

SEQ ID NO: 209385 - RNA, 64 nt, Human
ugauaauuuuaaaguauguuuuagaaauuuucuuaggagcaaaauaaguacaaaguaaaucuug

SEQ ID NO: 209386 - RNA, 64 nt, Human
aaaaugagcgauuaaauaguaauggauacaauuaaggagcaacuauuuuauaugacuguucugu

SEQ ID NO: 209387 - RNA, 64 nt, Human
caaagucugggaguaaggagaggauuagguacuuaggagcaaagaaagaaguagcuuggaacuu

SEQ ID NO: 209388 - RNA, 64 nt, Human
aaggauuauacagcucuuuuccgggaacucacccaggagcaagcgagacacuaccauugaauca

SEQ ID NO: 209389 - RNA, 64 nt, Human
acaagggagagaacccccagaugagaaaauaggaaggagcaaucauuuguagaugggugaaaaa

SEQ ID NO: 209390 - RNA, 64 nt, Human
cugagcccagagaagcuggaagccugccgaaaacaggagcaaauggcguuuuauaaauuauuuu

SEQ ID NO: 209391 - RNA, 64 nt, Human; identical to SEQ ID NO: 6148

SEQ ID NO: 209392 - RNA, 64 nt, Human
acagcuccagaaggcacuggugggauguggagucaggagcaaccagagaccccccaauacuaga

SEQ ID NO: 209393 - RNA, 64 nt, Human
uuucuucccccuucccuuuuccagcacucaaccaaggagcaaagcucaucccaccccacacccc

SEQ ID NO: 209394 - RNA, 64 nt, Human
auuuucuauagagaagaagcacaauggggaagauaggagcaaggucauguacccuaauaguuac

SEQ ID NO: 209395 - RNA, 64 nt, Human
acaccaaaguugcuggucuauggacaacaguuugaggagcaaggucuucaagcucucauuaugg

SEQ ID NO: 209396 - RNA, 64 nt, Human
uuaaaaggguucuuuguucccauccagccgaugaaggagcaaacgucuggcuaugugaagccua

SEQ ID NO: 209397 - RNA, 64 nt, Human
gcauuguuuuaauugagaggggcagggcuggagaaggagcaaguuguggggagccaggcuuccc

SEQ ID NO: 209398 - RNA, 64 nt, Human
uggggacgccucacaaucaugguggaaggcaaggaggagcaaaucaugucuuauacauggaugg

SEQ ID NO: 209399 - RNA, 64 nt, Human
cauuccccagaucauauuucaaguccaguaacacaggagcaaccaaguacaguguauccugaua

SEQ ID NO: 209400 - RNA, 64 nt, Human
guuuuaaauugcacuguuuuuaaagaaacuguagaggagcaacaaaaauccaagcaacuucaua

SEQ ID NO: 209401 - RNA, 64 nt, Human
uccuuuaaauauauaucuaagcauauauuuuaaaaggagcaaaaauaaaaccaaaguguuagua

SEQ ID NO: 209402 - RNA, 64 nt, Human
aguauugugauuuugcugaaaagacaaggugugaaggagcaacuucaguugacacaaaauuuga

SEQ ID NO: 209403 - RNA, 64 nt, Human
uuauauuaggcaguguaguagguucaagaaacacaggagcaagcaaaacaaauuccauaauguc

SEQ ID NO: 209404 - RNA, 64 nt, Human
aaggcaccaguucagccaggagugaaauccggagaggagcaacgccagccugggucacagucca

SEQ ID NO: 209405 - RNA, 64 nt, Human
agcagugggguaggcugcugcccugcuguggaagaggagcaacaaucagacaugaguccacccu

SEQ ID NO: 209406 - RNA, 64 nt, Human
cacugcucuaguaccauuccuuccucuuagccccaggagcaaauuaaaagguacaguuaaaauc

SEQ ID NO: 209407 - RNA, 64 nt, Human
gcauggacucuccugagugagaagagacugaaauaggagcaagcagaacccugagagguguccc

SEQ ID NO: 209408 - RNA, 63 nt, Human
aagugcgguuucccaagccuuuguccaucucagcccccagaguauaucugugcuuggggaauc

SEQ ID NO: 209409 - RNA, 63 nt, Human
ggaauguacucuggaucccuuccccugcuuugacccccagacuuugcuccaucuauuauugcu

SEQ ID NO: 209410 - RNA, 64 nt, Human
ggaaagcagguuuuaaauuguaaauauuccuuagaggagcaaauggauuguuuaauaccauagu

SEQ ID NO: 209411 - RNA, 64 nt, Human
aucaagaaaaggaaucuagauuuuguugcauuguaggagcaaacaaggcuucauauucuuuuua

SEQ ID NO: 209412 - RNA, 64 nt, Human
auuuuuuuuuucuuagagaaccacaaaacauaaaaggagcaagucggacugaauaccuguuucc

SEQ ID NO: 209413 - RNA, 64 nt, Human
cgggaagcucuuugcauuugcauuuccucaacaaaggagcaaagcagaggaagcugagagucug

SEQ ID NO: 209414 - RNA, 64 nt, Human
gcuucuguuucacauuuuuuaaaagggcaaguacaggagcaacugcugcuacccagaaaaaugu

SEQ ID NO: 209415 - RNA, 64 nt, Human
uuugggcagcuaccacgggucugccaugcucuggaggagcaagggggccacauccccaccccag

SEQ ID NO: 209416 - RNA, 64 nt, Human
gucuuccacagccucugauguggaccugguacugaggagcaagacuguccaguucuccuccaca

SEQ ID NO: 209417 - RNA, 64 nt, Human
ggcacacuguuaauuacaaccucuucaaagaaauaggagcaacccccaagaggcuuaauuuacc

SEQ ID NO: 209418 - RNA, 64 nt, Human
aagaaugugaccauuuggaaaaggcaaagagaaaaggagcaaaaugaagcauucccccaggcuu

SEQ ID NO: 209419 - RNA, 64 nt, Human
uggaggagggaguccggccccaggccagggacuaaggagcaaugaccauugugcacaugcgugu

SEQ ID NO: 209420 - RNA, 64 nt, Human
cuuuuuaauuauaauuuuguuguauuuguuuccuaggagcaaguguuccugcugccaguucuuu

SEQ ID NO: 209421 - RNA, 64 nt, Human
uugcaaaaauugcaccuuauaaacugucaguauuaggagcaaugagacaaugaaagaaacaugu

SEQ ID NO: 209422 - RNA, 64 nt, Human
gaggcugcaaggauucagcauuauuccuccaggaaggagcaaaacgccucuuuucccucucuag

SEQ ID NO: 209423 - RNA, 64 nt, Human
uugggguagaucuucuucacauauucccccuggaaggagcaacuuuucugugcccugcugacgu

SEQ ID NO: 209424 - RNA, 64 nt, Human
ucuuuagauaucaauuugaaaauccuccaaaaaaaggagcaaagaaugcauaagcuauguguug

SEQ ID NO: 209425 - RNA, 64 nt, Human
gccucagcuucccuucccacauuccuccggccccaggagcaaccccuugggcuaggucugaccc

SEQ ID NO: 209426 - RNA, 64 nt, Human; identical to SEQ ID NO: 6167

SEQ ID NO: 209427 - RNA, 64 nt, Human; identical to SEQ ID NO: 6172

SEQ ID NO: 209428 - RNA, 63 nt, Human
ugcauccucagaagcucugggugugccagaggacccccagaacuaagaagggagggcgagugg

SEQ ID NO: 209429 - RNA, 64 nt, Human
uauuucucaaagacagcaaaaaccucucaaacugaggagcaacauuuauucuuacuaagcagau

SEQ ID NO: 209430 - RNA, 64 nt, Human
ugggauuuggucaacacuaacaugauuuggggaaaggagcaagucagaauagaaauuaguacuc

SEQ ID NO: 209431 - RNA, 56 nt, Human
caacacuggaccgccauuaggcaaagaggagcaaccauuagaaaaugcaggauuug

SEQ ID NO: 209432 - RNA, 64 nt, Human
ucccuccucucaccccaugcccaaucagggugcaaggagcaaggacggggccaaggucgcucau

SEQ ID NO: 209433 - RNA, 64 nt, Human
ccauaacucaugcaauaaaacugauugucauucgaggagcaaacuuaagaguaguuuauuuaua

SEQ ID NO: 209434 - RNA, 64 nt, Human
aaucaaauauguugauucauggcuauaauaaagcaggagcaauuauaaaaucuucaaucaauug

SEQ ID NO: 209435 - RNA, 64 nt, Human
cugcucacugugcaguggagauggaaggccagggaggagcaacguggaacuuccaugaggcccc

SEQ ID NO: 209436 - RNA, 64 nt, Human
cuucugccugccacuacaacaaaacugucucaggaggagcaacugaagucacaugaaaguaagc

SEQ ID NO: 209437 - RNA, 64 nt, Human
guacagauacuuucucugaagaguauuuucgaagaggagcaacugaacacuggaggaaaagaaa

SEQ ID NO: 209438 - RNA, 64 nt, Human
gugauauccaaccugguuaaaugaaugaaagaaaaggagcaaaucuuuuaaacuaaugcuugcc

SEQ ID NO: 209439 - RNA, 64 nt, Human
uccuggggcucagccuagugaacugcaaccucaaaggagcaagccuugaaacaguugcuggggg

SEQ ID NO: 209440 - RNA, 64 nt, Human
gcucccgcaccugucgguggcugccuuugaucacaggagcaaucacaggaaaauguauccagag

SEQ ID NO: 209441 - RNA, 64 nt, Human
gcuuaaaaaaaaaggcaaagaacacagaaagaggaggagcaagugggauguuuauguccccccu

SEQ ID NO: 209442 - RNA, 64 nt, Human
ucugucaacuaguccaaccccuuaaaauucauagaggagcaaacuggggcccauugaaggguga

SEQ ID NO: 209443 - RNA, 64 nt, Human
caagacgugggaggcugcuucccaguaagaauccaggagcaagcuuuggugaauccagugggcu

SEQ ID NO: 209444 - RNA, 56 nt, Human
aagaugauaugcaacuauaaaaagggaggagcaagaagaucccagugcuugcccug

SEQ ID NO: 209445 - RNA, 64 nt, Human; identical to SEQ ID NO: 6163

SEQ ID NO: 209446 - RNA, 64 nt, Human; identical to SEQ ID NO: 6177

SEQ ID NO: 209447 - RNA, 63 nt, Human
cucuacuccuaccucagccuagacccuccuccucccccagagggguggguuccucuuccccac

SEQ ID NO: 209448 - RNA, 63 nt, Human
uugggcagaggaguauaggacuggggucuaggauaggagcaagacuuccuuguauauuuggau

SEQ ID NO: 209449 - RNA, 64 nt, Human
ugugcccagcccugugcuaggcgcugacauuaacaggagcaaccagggcccaauuccuggccuu

SEQ ID NO: 209450 - RNA, 64 nt, Human
gcccaggacgguucugagacugaacacugagggcaggagcaagggaggaagccaggggcgaggc

SEQ ID NO: 209451 - RNA, 64 nt, Human
cucccuguuguguuagggauguuuaggucauacuaggagcaauuaggagccauaugccugggcu

SEQ ID NO: 209452 - RNA, 64 nt, Human
ucugccaagaacucaggguggcccuaugacuuggaggagcaagaucagaccgcucaaagguccc

SEQ ID NO: 209453 - RNA, 64 nt, Human
gacgacugagaagaggugcaaggaagcgggcuccaggagcaagcucaccaggccucucagaagu

SEQ ID NO: 209454 - RNA, 64 nt, Human
cuauacccuaagcagauagcaaagaagauaauggaggagcaauuggucauggccuugguuuccc

SEQ ID NO: 209455 - RNA, 64 nt, Human
aauaguuccugcuaaaacaaugaauaaaaacucaaggagcaacuacccuaugcuuaguuauucu

SEQ ID NO: 209456 - RNA, 64 nt, Human
aaggggauggagacaggaccacaggaaugggccaaggagcaacgugccugccauucagccagcu

SEQ ID NO: 209457 - RNA, 64 nt, Human
gaaagcuucuguuugaagagacaugaguucuggaaggagcaaggccaccagguccagagaaccu

SEQ ID NO: 209458 - RNA, 64 nt, Human
cgucuucugcaaacaauagcaauugggcuggcuuaggagcaaguggcucauuuucccauaaggc

SEQ ID NO: 209459 - RNA, 64 nt, Human
aacgcacuacagagcuacgacacagggaaaccuuaggagcaaauaaaccgugcuuucauguuuu

SEQ ID NO: 209460 - RNA, 64 nt, Human
gguaggucaaggaaaagagccccuuugauccaccaggagcaauuaagaaagguccuucagguaa

SEQ ID NO: 209461 - RNA, 64 nt, Human
guaccugacgcugagccugucaugagaaugcaacaggagcaaaccaaguguugcugugacauug

SEQ ID NO: 209462 - RNA, 64 nt, Human
cugaccaccucuggccccaggcccucagggagaaaggagcaacacacugccccuaggcgugcgu

SEQ ID NO: 209463 - RNA, 64 nt, Human
uucuuuuggagguuggaggggccaagccaaggacaggagcaagugugcccucauuuuguuucua

SEQ ID NO: 209464 - RNA, 64 nt, Human; identical to SEQ ID NO: 6126

SEQ ID NO: 209465 - RNA, 63 nt, Human
cucauucuucccuggccucuuucccacccacagcccccagaggcucuagaucaacaauguuag

SEQ ID NO: 209466 - RNA, 63 nt, Human
uuagugccccgcacugugccccaaguucuaggccccccagaaagcugccagagccggccgccu

SEQ ID NO: 209467 - RNA, 64 nt, Human
ccuaggagaggcuuuggaccugggagccacaccuaggagcaaagucucaccccuuugucuacgu

SEQ ID NO: 209468 - RNA, 64 nt, Human
gggcauacgguagauauuaucugaugaauuggaaaggagcaaaccagaaauggcuuuauuuucu

SEQ ID NO: 209469 - RNA, 64 nt, Human
aaagauaagauacauguuugaaguauucaaucauaggagcaaagaacuugcaaaauaugaagug

SEQ ID NO: 209470 - RNA, 64 nt, Human
aauaaaugauacaucuuggagaagagggaggaauaggagcaaaucuaucuuuauauuuuuauua

SEQ ID NO: 209471 - RNA, 64 nt, Human
uucuccuaccauagcacaaauccuagcggacccuaggagcaaagaggggggcagcccucaugcc

SEQ ID NO: 209472 - RNA, 64 nt, Human
aauuggagugaugaaccugcuuauaccuaagggcaggagcaagccccucacaaugcagcugcau

SEQ ID NO: 209473 - RNA, 64 nt, Human
ucacauucaauggaaauugauuaggccugagagaaggagcaagaggcagaaacacugacucuga

SEQ ID NO: 209474 - RNA, 64 nt, Human
caacuggaagcuuuguagaaauuaaacauauucaaggagcaagaaaugaacuuucagcagucua

SEQ ID NO: 209475 - RNA, 64 nt, Human
aaccacaggaauggaggcgggacacagggccaguaggagcaauaggauuuuaauaaacagaacc

SEQ ID NO: 209476 - RNA, 64 nt, Human
aguguuguacuauuugucucgguccuugugucuaaggagcaaugcagaaaaaaaggugaaauaa

SEQ ID NO: 209477 - RNA, 64 nt, Human
uuccccuucaaacaaauaauauuuuuacagaagcaggagcaaaauauggccuuucuucuaagag

SEQ ID NO: 209478 - RNA, 64 nt, Human
ugcgggugcuuugaagugccuugcaucagggauuaggagcaauuaaauuauuuuuucacgggac

SEQ ID NO: 209479 - RNA, 64 nt, Human
gcucggggugcacaggagggggucguggagagcuaggagcaaagccuguucauggcagauguag

SEQ ID NO: 209480 - RNA, 64 nt, Human
cuggaaaggcuaccaaauacuggccaaggucaggaggagcaaaaaugagccagcaccagcgccu

SEQ ID NO: 209481 - RNA, 64 nt, Human
caugaguuugcaugggcccuuggaaaaacaggaaaggagcaaugaagauccaagcaaaacuuua

SEQ ID NO: 209482 - RNA, 64 nt, Human
cugggacccugccagucucaguucaucucuuaccaggagcaaggcccucugaagcaugggccgu

SEQ ID NO: 209483 - RNA, 64 nt, Human; identical to SEQ ID NO: 6159

SEQ ID NO: 209484 - RNA, 62 nt, Human
acuauaagacguaguuuuaauuaauaaauauugcccccagauuguauuuauauuauccccca

SEQ ID NO: 209485 - RNA, 63 nt, Human
ccagggcuucuuuccaaacccccagcuccacaccccccagacccagcugguucuggaguucua

SEQ ID NO: 209486 - RNA, 64 nt, Human
cccauucccaacccaauacuggggccuucucaaaaggagcaaauuaaacaauaaaccagacagc

SEQ ID NO: 209487 - RNA, 64 nt, Human
aauaaauggaggaggggaaagggacugucacagaaggagcaagggcaggguggaggggguugaa

SEQ ID NO: 209488 - RNA, 64 nt, Human
cuggcaaugagaguauuuuuuuauucaaugaucaaggagcaaugucaguauauaguagaauauc

SEQ ID NO: 209489 - RNA, 64 nt, Human
guggaaagucuuuguaaggaaaaaacacauagcaaggagcaaauuuccacaaagugcuugguuu

SEQ ID NO: 209490 - RNA, 64 nt, Human
uauacuacagcagaaugacucagauuucauagaaaggagcaaccaaaaugucacaacccaaaac

SEQ ID NO: 209491 - RNA, 64 nt, Human
gccccuaaggaaaugccagagcuagcccggaaggaggagcaagagccagggggcccucuucagc

SEQ ID NO: 209492 - RNA, 64 nt, Human
uggacguggccagagcgagagaguagcggaggaaaggagcaauccaugcacacucuguacaguu

SEQ ID NO: 209493 - RNA, 64 nt, Human
ggaauaaucauaccaccaacuuccuaugguaauuaggagcaaaugaguuauuacaggcaaaaca

SEQ ID NO: 209494 - RNA, 64 nt, Human
ggaaggggucugaccaggcaagcugugaucugaaaggagcaaggaacagcaaggaauuauuuuc

SEQ ID NO: 209495 - RNA, 64 nt, Human
cgaccugaaaauggcugagggagggggcuaagagaggagcaaagcaggaggucuugggcuaaaa

SEQ ID NO: 209496 - RNA, 64 nt, Human
cagcaucagccuuagaacaagaaccuuaccuucaaggagcaagugaagaacucugugaaggaug

SEQ ID NO: 209497 - RNA, 64 nt, Human
gcaggagugucaggggaaccaugagagagagucuaggagcaaacacaucaccacccugagcaga

SEQ ID NO: 209498 - RNA, 59 nt, Human
caucucgagguggagcuuagccccgugccaggagcaaugggacuggagucagaugagca

SEQ ID NO: 209499 - RNA, 64 nt, Human
cacuacaauaauaugcuguacagguuuguagccuaggagcaauaggccauagcuuagguguaua

SEQ ID NO: 209500 - RNA, 64 nt, Human
cguuagcacucuuaguuccgcuacugucuuuaacaggagcaaagagcugugauaaaccaugcuu

SEQ ID NO: 209501 - RNA, 64 nt, Human
ccauaccagacagggagcaggggguagcggucaaaggagcaaaacagacuuugucuccugauua

SEQ ID NO: 209502 - RNA, 64 nt, Human; identical to SEQ ID NO: 6118

SEQ ID NO: 209503 - RNA, 64 nt, Human; identical to SEQ ID NO: 6119

SEQ ID NO: 209504 - RNA, 64 nt, Human; identical to SEQ ID NO: 6120

SEQ ID NO: 209505 - RNA, 64 nt, Human
uuuccuauuucugacuggugccuuuccccuuuuuaggagcaacgaaagcuacucucuuaguuau

SEQ ID NO: 209506 - RNA, 64 nt, Human
cagggcuuguuuuccaaagaaaaguauuguuuggaggagcaaaguuaaaagccuaccuaagcau

SEQ ID NO: 209507 - RNA, 64 nt, Human
ugggggaugggccaggguuuacccagugggacagaggagcaagguuuaaauuuguuauugugua

SEQ ID NO: 209508 - RNA, 64 nt, Human
ccagcaagaggaaggggugcugugaggcuugcccaggagcaagugaggccggagaggaguucag

SEQ ID NO: 209509 - RNA, 64 nt, Human
gaaggacuucuuccuguacaacgccuccaaggccaggagcaaaaccuacaucaacaugcgggag

SEQ ID NO: 209510 - RNA, 64 nt, Human
uaacaguaacgcaggggaaacguuuucuguuuggaggagcaaaggcugagaacacugugaaaac

SEQ ID NO: 209511 - RNA, 64 nt, Human
gagaggauucuccagugagugcacacacuaugcgaggagcaagcauuucucuaagucaagugca

SEQ ID NO: 209512 - RNA, 64 nt, Human
gagcgaaagcuggagaagaagcagcagaaggagcaggagcaagugagagccacgagccaaggug

SEQ ID NO: 209513 - RNA, 64 nt, Human
acuuuaucagaaacucaaagcuugggggauaaaaaggagcaagagaauacuguaacaaacuucg

SEQ ID NO: 209514 - RNA, 64 nt, Human
cuaaacaucaaucauugcaggaguuguugguauuaggagcaaaguagacuaacuacaacaucaa

SEQ ID NO: 209515 - RNA, 64 nt, Human
gaagaggagcaggcacagcuacaugggcagcugaaggagcaaagggugcacugccagcgccugu

SEQ ID NO: 209516 - RNA, 64 nt, Human
aaccaagaaugucuccauuguuaaauguucccuuaggagcaaaauugccccugguugagaaaca

SEQ ID NO: 209517 - RNA, 64 nt, Human
uggaaaaaugggaccuaaguaaauuugaggaacaaggagcaagugaucuggcaaaagagggaca

SEQ ID NO: 209518 - RNA, 64 nt, Human
gcgcuuucccuccccacggccccaacuccagggcaggagcaacuggacagugggccuggcccgu

SEQ ID NO: 209519 - RNA, 64 nt, Human
cauucagagguuugcuggccuucccgguuucccaaggagcaagaccucuguccgcccuuuggcc

SEQ ID NO: 209520 - RNA, 64 nt, Human
uccacuacucaaaaaugccugaauccuugcucagaggagcaaagguaucuucucgucccuuucu

SEQ ID NO: 209521 - RNA, 64 nt, Human; identical to SEQ ID NO: 6123

SEQ ID NO: 209522 - RNA, 64 nt, Human; identical to SEQ ID NO: 6124

SEQ ID NO: 209523 - RNA, 64 nt, Human; identical to SEQ ID NO: 6125

SEQ ID NO: 209524 - RNA, 64 nt, Human
ggggguggggguggggccacaaaaggaaaaccggaggagcaauuggggauccaggugucagagg

SEQ ID NO: 209525 - RNA, 64 nt, Human
ugcaucuggccugggggcuguuagcucagaggagaggagcaaacaggaaaaugacuucuguucu

SEQ ID NO: 209526 - RNA, 64 nt, Human
agggaaggcuugcuggaaaagugacuaaugagucaggagcaaggaacguccagggagugggagc

SEQ ID NO: 209527 - RNA, 64 nt, Human
ggguggggguggggguggggguggaagcagccgcaggagcaagggccccucccacauacacagg

SEQ ID NO: 209528 - RNA, 64 nt, Human
accgagaauauucaaaauuccaaauuuuuuucuuaggagcaagaagaaaauguggcccuaaagg

SEQ ID NO: 209529 - RNA, 64 nt, Human
acaugugggguuuuaaaaaugaaauuuggcuaauaggagcaauucagcuauuuuucuauacagu

SEQ ID NO: 209530 - RNA, 64 nt, Human
uuggggggauauuuguucaucacuuggguagaagaggagcaaaaauaccucuguuuucucuugc

SEQ ID NO: 209531 - RNA, 64 nt, Human
ucuggugguggggggcaggggacagaggccaugaaggagcaaguuuuguauuugugaccucagc

SEQ ID NO: 209532 - RNA, 64 nt, Human
gugaaugaagauccagccggccuugggagccuggaggagcaaagacuggggucuuuugcgaaag

SEQ ID NO: 209533 - RNA, 64 nt, Human
cugagcccagcacugcggccaagucgaagacuuuaggagcaauaaaagugcuuauuguguuuca

SEQ ID NO: 209534 - RNA, 64 nt, Human
cuguuuaucucugucauccugguggccuucagugaggagcaaaaauacuaucaggugagucgcu

SEQ ID NO: 209535 - RNA, 64 nt, Human
gaggcugaggaaaggaagagggcacggaguugccaggagcaaaccaaagugaagagagagauag

SEQ ID NO: 209536 - RNA, 64 nt, Human
cagcagcccuaauagcagcccacggacuuuggggaggagcaaagggaggcuccggcugccccag

SEQ ID NO: 209537 - RNA, 64 nt, Human
ggagguucaaguauggaggguaggagugcaacccaggagcaacgcucaagguggccgagaugca

SEQ ID NO: 209538 - RNA, 64 nt, Human
aaggccccugauggagcuauuucuuccuaguaucaggagcaauugagaccccucaggaguuucc

SEQ ID NO: 209539 - RNA, 64 nt, Human
aaagcuuuaaaaacaagauugcaucauaacccccaggagcaaagcaaccuggaggcugcauauc

SEQ ID NO: 209540 - RNA, 64 nt, Human; identical to SEQ ID NO: 6128

SEQ ID NO: 209541 - RNA, 64 nt, Human; identical to SEQ ID NO: 6129

SEQ ID NO: 209542 - RNA, 64 nt, Human; identical to SEQ ID NO: 6130

SEQ ID NO: 209543 - RNA, 64 nt, Human
guuuuguugguuauguggaaaucacaaacuccagaggagcaaagggguuuuucaaugucuuuug

SEQ ID NO: 209544 - RNA, 64 nt, Human
gccagagccuuggaggacacuaagaggaggcaggaggagcaacucaaauccccaagaacacaag

SEQ ID NO: 209545 - RNA, 64 nt, Human
accuguuucccccaccuacuccaauauuugcuggaggagcaaaugaccgguggguacgaucugu

SEQ ID NO: 209546 - RNA, 64 nt, Human
uucugcccaguggugucucugagcgcgggaugacaggagcaaccgaagcacccugaaggccuuc

SEQ ID NO: 209547 - RNA, 64 nt, Human
uucaguagggauagaugugcuagucuucuagcauaggagcaaggaaucagaggugggguuaaag

SEQ ID NO: 209548 - RNA, 64 nt, Human
ccuccgggccaaaugggccccagguuuccaaggaaggagcaaucugugacuccuaaaauggguu

SEQ ID NO: 209549 - RNA, 64 nt, Human
uuuccaaaggaaaaacaugcauuucacuccgucgaggagcaaagugagccccuaccccccaccc

SEQ ID NO: 209550 - RNA, 64 nt, Human
uauccugugcuuuuucugugggaccauuccauucaggagcaaagagcaccaugauuccaaucuu

SEQ ID NO: 209551 - RNA, 64 nt, Human
gugaccucuugccgugccccuugucauagacccaaggagcaacucuguccccugagcguugggg

SEQ ID NO: 209552 - RNA, 64 nt, Human
uggaaauaauuaggcaaauucuaaaggucucaaaaggagcaaaguaaaccguggaggacaaaga

SEQ ID NO: 209553 - RNA, 64 nt, Human
gugucccgggucgcggggaggcagcucagcucuuaggagcaaguugugggggcuuuucaagagg

SEQ ID NO: 209554 - RNA, 64 nt, Human
cgcugcgcucggccuucuuugauuuuauauuauuaggagcaaaaguaaaugaagcccaggaaaa

SEQ ID NO: 209555 - RNA, 64 nt, Human
aaccgccuggcucugccggcgcccuccucacgucaggagcaagcagccguggaccccuaagccg

SEQ ID NO: 209556 - RNA, 64 nt, Human
gaaaaucacccuuucccuuuuucuuuguagaagcaggagcaagaguguuuggcucccaguuugg

SEQ ID NO: 209557 - RNA, 64 nt, Human
ucuggaaauuaagaaggugugcuccagagccaagaggagcaauaagaaaccucgugugccagcu

SEQ ID NO: 209558 - RNA, 64 nt, Human
ggggugucugggcucaggguuggccagcuugcagaggagcaagcuaguagaaauauugcagggu

SEQ ID NO: 209559 - RNA, 64 nt, Human; identical to SEQ ID NO: 6104

SEQ ID NO: 209560 - RNA, 64 nt, Human; identical to SEQ ID NO: 6131

SEQ ID NO: 209561 - RNA, 64 nt, Human; identical to SEQ ID NO: 6133

SEQ ID NO: 209562 - RNA, 64 nt, Human
aguccuuacccuuacaauguaauguuagagauaaaggagcaaauagagucacgcaucacuuaau

SEQ ID NO: 209563 - RNA, 64 nt, Human
ugccuuuuacaaaugcaguuuaucccugguucugaggagcaagugcaggguggagguggcaccu

SEQ ID NO: 209564 - RNA, 64 nt, Human
gagggucagggaagaaacccacucuugcucuacgaggagcaagugccugcccccucccagcagc

SEQ ID NO: 209565 - RNA, 64 nt, Human
auuccuucgugcgcuagaaccuagggaaugccagaggagcaaggaugcagggcccaggacucca

SEQ ID NO: 209566 - RNA, 64 nt, Human
cuuguccucagcccaccccucauugugacuuaugaggagcaagccuguugcugccaggagacuu

SEQ ID NO: 209567 - RNA, 64 nt, Human
cuucguccuuaguuuucccaacuugggacgugauaggagcaaagucucuccauucuccaggucc

SEQ ID NO: 209568 - RNA, 64 nt, Human
agcucccuuccgggacaaguggucugggacagggaggagcaacggccccagcgcgcaacgcucu

SEQ ID NO: 209569 - RNA, 64 nt, Human
uaaggugaaaugccagagaccuagacgggguggaaggagcaagugacugcugggauuugcacca

SEQ ID NO: 209570 - RNA, 64 nt, Human
cacgauggaauuguguuuugcguuuuuugguaaaaggagcaaagcgaggaccuggagauaaacg

SEQ ID NO: 209571 - RNA, 64 nt, Human
aacacguggcacaaaugggcccggccuuuggcagaggagcaagugauaugauguguaaaguaug

SEQ ID NO: 209572 - RNA, 64 nt, Human
guuuguucggaggccucugcugucaauggauuccaggagcaaggccauuugucgcgcuuuccaa

SEQ ID NO: 209573 - RNA, 64 nt, Human
ccucacaguugccagcccugcagcccccuuccccaggagcaaggaccaguuggggcgacuccuu

SEQ ID NO: 209574 - RNA, 64 nt, Human
ugggcugggagacagggacaauggggaaaaguuaaggagcaaaauggggguuggaagcaaaaaa

SEQ ID NO: 209575 - RNA, 64 nt, Human
ucuuggcccagggccaggcagucgugguugcagaaggagcaauuaggcugccugccugugggcu

SEQ ID NO: 209576 - RNA, 64 nt, Human
acggcuuucucaguuccaagauuuugcagagagaaggagcaaaccuuuucauuggaaaaacaga

SEQ ID NO: 209577 - RNA, 64 nt, Human
auuuauaacgcacaacuucgugcucaggucaucuaggagcaaggugagaaaucacaaugagaaa

SEQ ID NO: 209578 - RNA, 64 nt, Human; identical to SEQ ID NO: 6144

SEQ ID NO: 209579 - RNA, 64 nt, Human; identical to SEQ ID NO: 6182

SEQ ID NO: 209580 - RNA, 63 nt, Human
ccugggagccgcgggcaggcgagacuggcggagcccccagaccucccaguggggacggggcag

SEQ ID NO: 209581 - RNA, 64 nt, Human
ugacaccuuuucugggcaaggaacagccccuuuaaggagcaaaucacuucugucacaguuauua

SEQ ID NO: 209582 - RNA, 64 nt, Human
aucaagaugcuuggcucaauaagaaaaccacguuaggagcaaccuuuguauauuggagacuuca

SEQ ID NO: 209583 - RNA, 64 nt, Human
ccacgaagguugagaacaaagccagggggcccagaggagcaauagcccugggccacaagcgugg

SEQ ID NO: 209584 - RNA, 52 nt, Human
gcagguucucuucuccguaaagaggagcaauugcuguacauacccuccuuuc

SEQ ID NO: 209585 - RNA, 64 nt, Human
acaucgcagguaggaaaccacagaaccgucugcaaggagcaagcaacgguggcccuguccaccc

SEQ ID NO: 209586 - RNA, 64 nt, Human
uccugccaagguuugcuguggauucagaagcaccaggagcaagagaccagaaggaugaucugcu

SEQ ID NO: 209587 - RNA, 64 nt, Human
ggaaagaguaaaaauaccaaacgagaaaauuuaaaggagcaaaaauuugcaagucaaauagaaa

SEQ ID NO: 209588 - RNA, 64 nt, Human
auagaauucuugccgccaucccaggucuagccuuaggagcaaauguaguagauagucgaauaau

SEQ ID NO: 209589 - RNA, 64 nt, Human
gggacuguauuuaauuuuucuuuccuuccaucugaggagcaaggaaauccuacugcugaauagc

SEQ ID NO: 209590 - RNA, 64 nt, Human
cuugcuugacucaguuucccuccuuugaaagggaaggagcaaaacggccauuugggaugccagg

SEQ ID NO: 209591 - RNA, 64 nt, Human
gagaggacuaaggaaaacagagagaguguuacgcaggagcaagccuuucauuuccuuggugggg

SEQ ID NO: 209592 - RNA, 64 nt, Human
ucugaucuguagucacaugacuaagccaagaggaaggagcaagacucaagacaugauugaugga

SEQ ID NO: 209593 - RNA, 64 nt, Human
caagauugugccauugcacucuagccugggcaacaggagcaaaacuccgucucaaaaaaaaaaa

SEQ ID NO: 209594 - RNA, 64 nt, Human
ugcugaacagacccccccacacgagagaaaauaaaggagcaauaaagucacgagaacuuucguc

SEQ ID NO: 209595 - RNA, 64 nt, Human
ggaagcgaggucccagaaggccagcggugguuccaggagcaacagcucccaaacccugagcaag

SEQ ID NO: 209596 - RNA, 64 nt, Human
aaacaguuuaaacaagccagcgcuacuggagaagaggagcaacaccugugccgcggccggagga

SEQ ID NO: 209597 - RNA, 64 nt, Human; identical to SEQ ID NO: 6136

SEQ ID NO: 209598 - RNA, 64 nt, Human; identical to SEQ ID NO: 6137

SEQ ID NO: 209599 - RNA, 64 nt, Human; identical to SEQ ID NO: 6138

SEQ ID NO: 209600 - RNA, 64 nt, Human
uccucagcuccagacugggugaugcuggagacccaggagcaagucagcacaggcucugcccaca

SEQ ID NO: 209601 - RNA, 64 nt, Human
gagauuuuccaucaucucaaguucucuucuauccaggagcaaagcacaggaucauaauaaauuu

SEQ ID NO: 209602 - RNA, 59 nt, Human
uaguucugucucucgccugaugcuggaagaggagcaaacacuggccucugguguccacc

SEQ ID NO: 209603 - RNA, 64 nt, Human
gccuuccccagagcaggugaaccaagggagaggaaggagcaagccacagugcuucuaugagcca

SEQ ID NO: 209604 - RNA, 64 nt, Human
ggucucagccacauccuauguauuuuggcucuggaggagcaaagcuguauccuggaguuggucu

SEQ ID NO: 209605 - RNA, 64 nt, Human
aaauucauuccagaucuauuuuucuaccagagagaggagcaaaguccuccuccccugcgcccuu

SEQ ID NO: 209606 - RNA, 64 nt, Human
uuugacagcauucagaaauaaaugccaguagcccaggagcaaaaauuuuugggaguaguuuagc

SEQ ID NO: 209607 - RNA, 64 nt, Human
agcaggagagggaacaggauuaagaauggguuuaaggagcaagacugagacucugauucagcga

SEQ ID NO: 209608 - RNA, 64 nt, Human
caaggaauggaagaguaaauuacaugacacaaaaaggagcaauuaaaucuaaaauaaggguaau

SEQ ID NO: 209609 - RNA, 64 nt, Human
guccccaucugggaggguggcauucugggacaugaggagcaaaggaagggggcaauaaauguug

SEQ ID NO: 209610 - RNA, 64 nt, Human
cuucuggggugccugucuccuggaauggagcuggaggagcaaugcuguuggugaauaaaucagu

SEQ ID NO: 209611 - RNA, 64 nt, Human
aaaaaccacaauuagacugacagcugacuuuuuuaggagcaauauuggaaggcuaaaugcaaua

SEQ ID NO: 209612 - RNA, 64 nt, Human
ccacuucccuccuuccagucaugaguaaucaucaaggagcaaguuggaguguuucagguguaua

SEQ ID NO: 209613 - RNA, 64 nt, Human
cuaaaagauaauguuuauuuuuaaaaaggaaggaaggagcaagugaaguuucauucugcuccag

SEQ ID NO: 209614 - RNA, 64 nt, Human
guuuccagccaggccucggggucaucuuuucaccaggagcaaacccaagucuuaguugcuacaa

SEQ ID NO: 209615 - RNA, 60 nt, Human
augauggggccuugcaguaagcagccugacaggagcaauggccaccagcaggugaagggc

SEQ ID NO: 209616 - RNA, 64 nt, Human; identical to SEQ ID NO: 6141

SEQ ID NO: 209617 - RNA, 64 nt, Human; identical to SEQ ID NO: 6142

SEQ ID NO: 209618 - RNA, 64 nt, Human; identical to SEQ ID NO: 6143

SEQ ID NO: 209619 - RNA, 64 nt, Human
agaagcugugaguuuuguucacaauuagguuccuaggagcaaaaccucaaggauugauuuauug

SEQ ID NO: 209620 - RNA, 64 nt, Human
aaaaucauucccuuucccauccauaaggugcaguaggagcaagagagggcaaguguucccaaau

SEQ ID NO: 209621 - RNA, 64 nt, Human
uaaaaggggcggcgaagaggacccgcaggcugcaaggagcaacagcgauggguaggcacauuca

SEQ ID NO: 209622 - RNA, 64 nt, Human
ggcccuagaagccggggcggccccagcggggaggaggagcaaggacauguaccaugccagcaag

SEQ ID NO: 209623 - RNA, 64 nt, Human
gccaccuggaggccugucuguuagccagugguggaggagcaaggcuucaggaagggccagccac

SEQ ID NO: 209624 - RNA, 64 nt, Human
uccaaccaggcaguagaugugcuucugaaccgcaaggagcaaacacugaaauaaaauaguuuau

SEQ ID NO: 209625 - RNA, 64 nt, Human
aguaguguggaguggaugaguguuccaugagccuaggagcaagaaagucucuucggccucgggc

SEQ ID NO: 209626 - RNA, 64 nt, Human
agcuguagaacucugcaggcagauuuacugucccaggagcaaaugcuggaugagcaacuccugu

SEQ ID NO: 209627 - RNA, 64 nt, Human
agauugcggucagcuaagggagaacuugcguggaaggagcaaugcagacacagugaaaucucua

SEQ ID NO: 209628 - RNA, 64 nt, Human
gaaaauaaggaauaaaucgauuuuacuuugguauaggagcaagguucaccuuuagauuuuugua

SEQ ID NO: 209629 - RNA, 64 nt, Human
ugggaaaacguacuucagacuggauagccuaaaaaggagcaaugcccuuguaggauguggagaa

SEQ ID NO: 209630 - RNA, 64 nt, Human
ugaucgcaauguuugaguuauuacuugcagagauaggagcaaaaauuacaaaaacacacagggu

SEQ ID NO: 209631 - RNA, 64 nt, Human
gcggggaucagaacucuccuaucugaaccuacugaggagcaaagcagcaauuacaugggauccu

SEQ ID NO: 209632 - RNA, 54 nt, Human
ccaucgcauuacagccugagcaacaggagcaagagauggaguuucacuguguca

SEQ ID NO: 209633 - RNA, 64 nt, Human
gagacagcaucuggaacaagcuugggauauggggaggagcaagccaucagugaugaggaugaag

SEQ ID NO: 209634 - RNA, 64 nt, Human
accuaccucacaggguuguugugagggugcacagaggagcaaagucccugaaggcccucaggca

SEQ ID NO: 209635 - RNA, 64 nt, Human; identical to SEQ ID NO: 6088

SEQ ID NO: 209636 - RNA, 64 nt, Human; identical to SEQ ID NO: 6134

SEQ ID NO: 209637 - RNA, 64 nt, Human
cuuucagcuugaggggagcucccacugccucagcaggagcaauucugcaucccuaauucuguca

SEQ ID NO: 209638 - RNA, 64 nt, Human
ugagucugcgguucucgccugggcagucuugacgaggagcaaaccccgccuucagagggcagac

SEQ ID NO: 209639 - RNA, 64 nt, Human
auuaucuuguagccaaauuugacaauauaaaguaaggagcaaaguuacaggccaguuuuuacuu

SEQ ID NO: 209640 - RNA, 64 nt, Human
acacucaaaggggcaugggugguggagaagcagaaggagcaaucaagcuuaucuggauauuucu

SEQ ID NO: 209641 - RNA, 64 nt, Human
acagccagaaaggggcugcauuugugcccaggucaggagcaaauugaaaaaaaaaauaaaguaa

SEQ ID NO: 209642 - RNA, 64 nt, Human
aucgauuuaaauugcugcucuuuagcagccaaacaggagcaaaauguaaaauuuuugaacuuac

SEQ ID NO: 209643 - RNA, 64 nt, Human
acccggcuucugguccauuccagggcagggagugaggagcaaggcaacuggcauuuguccaccu

SEQ ID NO: 209644 - RNA, 64 nt, Human
auguugaucuuuaaauuuucccacaccauaagagaggagcaaaggaaauuaccaguuuagacua

SEQ ID NO: 209645 - RNA, 64 nt, Human
agagaguggaagaagcaaaacugcuggugucccaaggagcaaguauuuacauugagaauaaaga

SEQ ID NO: 209646 - RNA, 64 nt, Human
uguccuugaagagagugaggcauugagggccaauaggagcaauggggucccuggccuuguccau

SEQ ID NO: 209647 - RNA, 64 nt, Human
auauccuuuuuauaaaaauucaugucuguauuucaggagcaaacucuucaggcuccuuuuuuau

SEQ ID NO: 209648 - RNA, 64 nt, Human
ggaguuuucugccccccaccccaaacuucugucgaggagcaaggcuugccagcaagucagaagg

SEQ ID NO: 209649 - RNA, 64 nt, Human
guucucuugggaaaugacuggggagacaccugaaaggagcaaccuccagauguucuucccuggg

SEQ ID NO: 209650 - RNA, 64 nt, Human; identical to SEQ ID NO: 6100

SEQ ID NO: 209651 - RNA, 64 nt, Human; identical to SEQ ID NO: 6146

SEQ ID NO: 209652 - RNA, 64 nt, Human; identical to SEQ ID NO: 6147

SEQ ID NO: 209653 - RNA, 64 nt, Human
caguuuagucauccaacaagaagaaauaugaaauuccagcaauaagaaaugaacaaaagauugg

SEQ ID NO: 209654 - RNA, 64 nt, Human
gccacauggugcugauggacaucagacggagacuuccagcaaucuguugguuuugcaagucuga

SEQ ID NO: 209655 - RNA, 64 nt, Human
caucaguuaaugccagugaggucagcuucugcccuccagcaauacaugugcagggguugcugcu

SEQ ID NO: 209656 - RNA, 64 nt, Human
gagacugauuaucucaugugagccaggacauucuuccagcaagguuggccucuggauggugaac

SEQ ID NO: 209657 - RNA, 64 nt, Human
cuuccuucugauucugccugaauagcugagagguuccagcaaaagcuugaagucuugccuggag

SEQ ID NO: 209658 - RNA, 64 nt, Human
ccccauccagugggucacccaggaguaaugucccuccagcaacguucccccuauggccuccagc

SEQ ID NO: 209659 - RNA, 64 nt, Human
agaaucaccuucuuuauaaagcgucagucaugcuuccagcaagaggcagcaucagucauggcuu

SEQ ID NO: 209660 - RNA, 64 nt, Human
ccaagagagaacaaaggucagagauguugaagauuccagcaaauuucuccucuuauuucuacca

SEQ ID NO: 209661 - RNA, 64 nt, Human
gauugacugccaagcuaguuugggugaaguucacuccagcaagucucaggccacaauggggugg

SEQ ID NO: 209662 - RNA, 64 nt, Human
aauauauuuaauauauaaaauuaagacuuuugcuuccagcaaguauguuagacuagauauuaua

SEQ ID NO: 209663 - RNA, 64 nt, Human
gguucccagcucccccccugcaagccuugaagccuccagcaacgucuaucuccaggagagcagg

SEQ ID NO: 209664 - RNA, 64 nt, Human
accgucuguagcaaagaagugcuuccagcaucacuccagcaacacgcccaugcgucuucucuca

SEQ ID NO: 209665 - RNA, 64 nt, Human
cguuaugaucuugcuuccaacucccaccuguauguccagcaaacucuugcauguggccacuagg

SEQ ID NO: 209666 - RNA, 64 nt, Human
auaucaggaacaucccaucugugcuuaaccagaauccagcaagucagcacacaagugauuuuau

SEQ ID NO: 209667 - RNA, 64 nt, Human
aagcccaaacacccacaccucugucucccccagggcucgggaugucuccagcagcccggccacg

SEQ ID NO: 209668 - RNA, 64 nt, Human; identical to SEQ ID NO: 6150

SEQ ID NO: 209669 - RNA, 64 nt, Human; identical to SEQ ID NO: 6151

SEQ ID NO: 209670 - RNA, 64 nt, Human; identical to SEQ ID NO: 6152

SEQ ID NO: 209671 - RNA, 64 nt, Human
gagaguucaccguaggcaucuuuaauaaacuaacuccagcaaaauguggguacguuacuaacac

SEQ ID NO: 209672 - RNA, 64 nt, Human
acucccugccucugagccaccaacuggaccccucuccagcaacaccaccgccaccaccucccac

SEQ ID NO: 209673 - RNA, 64 nt, Human
ugcaccaaggaaaggaaagaugagccuccugucuuccagcaacaacccucacauaugcacugag

SEQ ID NO: 209674 - RNA, 64 nt, Human
uucacauccucaggcaggaacuagcaguuguuuauccagcaaugccucaaggauguugcauugc

SEQ ID NO: 209675 - RNA, 64 nt, Human
ucucuccaacugcuucagcaucuggcuuccaguguccagcaacagacguuuccagccacuuucc

SEQ ID NO: 209676 - RNA, 64 nt, Human
guuagggccaacagcugauaccaagccucugaaauccagcaaggaggucugccucccaccagac

SEQ ID NO: 209677 - RNA, 64 nt, Human
uaaaaaaaaaguuugguguuuuuaaccaugcuguuccagcaaagaugauaccuuaaacucccac

SEQ ID NO: 209678 - RNA, 64 nt, Human
caaacauguaccauguuuuauaaaccucuugauuuccagcaacauacuauagaaaacaccugcu

SEQ ID NO: 209679 - RNA, 56 nt, Human
gacuguucaaaaaaucuugagcauacuccagcaagauauguuuuugguagcaaaac

SEQ ID NO: 209680 - RNA, 64 nt, Human
guuuguuuuuaguauuuaguguagauguacacauuccagcaaauguauuugcaauuaugugguu

SEQ ID NO: 209681 - RNA, 64 nt, Human
uauuuccagucuucuaccccugcaguuauccuaguccagcaaagucauuucuuucaaaagagac

SEQ ID NO: 209682 - RNA, 64 nt, Human
aguuaagccuucagguacguuguggacuaggcuuuccagcaagguuuuuguagcuauuugcuug

SEQ ID NO: 209683 - RNA, 64 nt, Human
cuuaacuuguuuuccaagagauaacaccaacuguuccagcaauaauuuguuuuuuaauucagag

SEQ ID NO: 209684 - RNA, 64 nt, Human
gauuucagcucacugcaaccuucgccaccuggguuccagcaauucuccugccucagccucccga

SEQ ID NO: 209685 - RNA, 64 nt, Human; identical to SEQ ID NO: 6155

SEQ ID NO: 209686 - RNA, 64 nt, Human; identical to SEQ ID NO: 6156

SEQ ID NO: 209687 - RNA, 64 nt, Human; identical to SEQ ID NO: 6157

SEQ ID NO: 209688 - RNA, 64 nt, Human; identical to SEQ ID NO: 6158

SEQ ID NO: 209689 - RNA, 64 nt, Human
gugucugaaaacugcaaagugaacuuaacugagauccagcaaacagguucuguuuaagaaaaau

SEQ ID NO: 209690 - RNA, 64 nt, Human
ccuauugagcuugcagggaagccaagcuugcaguuccagcaagcaaagauuuuuuuuaauagac

SEQ ID NO: 209691 - RNA, 64 nt, Human
ucaugguuuuugaagauagcuaguuuuauccaucuccagcaaagaaucaucaauaguuuauauu

SEQ ID NO: 209692 - RNA, 64 nt, Human
aauggacgugucaaugacuugaaaaaaagucacauccagcaaaugcagggucacaugaaauaug

SEQ ID NO: 209693 - RNA, 64 nt, Human
uguauauuuuugugauguguaccauacugugugcuccagcaaauguccauuuguguaaauguau

SEQ ID NO: 209694 - RNA, 59 nt, Human
ucgguaaagacgucuucuagagccuuugauccagcaauaccccacuucaccuacaauau

SEQ ID NO: 209695 - RNA, 64 nt, Human
uaaugccaguuacgacgcugccuuuccggccugcuccagcaaguagcuacugguucacgugcag

SEQ ID NO: 209696 - RNA, 64 nt, Human
uggcuggugaaguucucacauaggcugauuuaaauccagcaaaggucuauagaaaaaggcuugc

SEQ ID NO: 209697 - RNA, 64 nt, Human
uagaggcaacuggaaaauacaugucuagaacugauccagcaauuacaacggagucaaaaauuaa

SEQ ID NO: 209698 - RNA, 64 nt, Human
aggucaccucuggcugcaggcauccagggauuauuccagcaaucugcagguagggagugggucc

SEQ ID NO: 209699 - RNA, 64 nt, Human
cauggcauuauagcuuuugaagaaaggccagugauccagcaaagggggaaaaauaugcauuuca

SEQ ID NO: 209700 - RNA, 64 nt, Human
cauaacuuaaaaagugaguuugaaaaagaaaaucuccagcaagcaucucauuuaaauaaagguu

SEQ ID NO: 209701 - RNA, 64 nt, Human
uccaggggggugaguucaugccucuccuguauuuuccagcaagugggguauguguggugguuug

SEQ ID NO: 209702 - RNA, 64 nt, Human
uauuggaacuguagagcauccauccauccauccauccagcaaugugacuuuuucaugucuuucc

SEQ ID NO: 209703 - RNA, 64 nt, Human
aggcuaggguggggagagacgggcccuggugguggcucgggaggcgaagcguuguccucagccc

SEQ ID NO: 209704 - RNA, 64 nt, Human
uggucuguuuugguccccucccucgugggcuugugcucgggaucaaaccuuucuggccuguuau

SEQ ID NO: 209705 - RNA, 64 nt, Human
uaaucacuuaaccugcuuuugucacucggcuuuggcucgggacuucaaaaucagugaugggagu

SEQ ID NO: 209706 - RNA, 64 nt, Human
ucgggcguggugucacgugccuguaauccuagcugcucgggaggcugaggcaggagaaucacuu

SEQ ID NO: 209707 - RNA, 64 nt, Human
ggagagaaucauuuaaugaagccuauuuuucuguuccagcaacuguuuuuaugaaagaaaaacu

SEQ ID NO: 209708 - RNA, 64 nt, Human
acggauugcaccugaauccuaucugacguuucauuccagcaagaggggcuggggaagauuacau

SEQ ID NO: 209709 - RNA, 64 nt, Human
cccuguguuguuacaggcugugcagugcaacaauuccagcaaaaauacccuauccccgcacuua

SEQ ID NO: 209710 - RNA, 64 nt, Human
cauaaaguggccguaugggaauuuaguucauucauccagcaaacauugaguaccaauuauuugc

SEQ ID NO: 209711 - RNA, 64 nt, Human
ucuaugaaagagaaaacacuaaucuuaaauuauauccagcaauguuucugguauccuuuaagaa

SEQ ID NO: 209712 - RNA, 64 nt, Human
uuucuucuccaucucugaagaucugcucaagacguccagcaaugcucucuguguauuuaaaugg

SEQ ID NO: 209713 - RNA, 64 nt, Human
agauuuagugucugugaauguucuaguuccuagguccagcaagucacaccugccagugcccuca

SEQ ID NO: 209714 - RNA, 64 nt, Human
cagaagacuggaucaagggguucccacuggcuccuccagcaagaccucgucuuugcuuguccug

SEQ ID NO: 209715 - RNA, 64 nt, Human
aaauaaaaguccuuaaaauaauuagcaaaucaaauccagcaauguauaaaaaagauaauagggu

SEQ ID NO: 209716 - RNA, 64 nt, Human
ggcugcuaacaaauaaucuucacuuucaauuauauccagcaauaaguuguucuccagaaaagaa

SEQ ID NO: 209717 - RNA, 64 nt, Human
acucccugcacauucccucaugcucccacacaaguccagcaauggaaaugcuuggguuccucuu

SEQ ID NO: 209718 - RNA, 64 nt, Human
uucucuuaguucuucucuaacauaguacuuucuuuccagcaaaagcaaaauguguuuucagauu

SEQ ID NO: 209719 - RNA, 64 nt, Human
gcaaaaugacuacagccugaagggccauuuucaguccagcaaugucauccuuuuguucuuuuag

SEQ ID NO: 209720 - RNA, 54 nt, Human
augaccagauggagucuuaacacuuccagcaaacucaaucucagcgugugacca

SEQ ID NO: 209721 - RNA, 64 nt, Human
ugugugugugugcgcuaagugagaaagagagcaggcucgggaggcccugcccaggguaggagga

SEQ ID NO: 209722 - RNA, 64 nt, Human
cucccaaaccaugucaggaccaccuuccucuagagcucgggagcccggagggucuucacccacu

SEQ ID NO: 209723 - RNA, 64 nt, Human
cuacaaugaggcuuuacaaccuuccuuuguuuuggcucgggauuacuuccuggcugucuaauaa

SEQ ID NO: 209724 - RNA, 64 nt, Human
ucuuccuaaguuauucaucuccucuccgccugcugcucgggaaggacagacgccggccgcccgc

SEQ ID NO: 209725 - RNA, 64 nt, Human
gaauauuuaucuccaaagucgaaugagaaagaacuccagcaaauccaauggcuacaaacuaaaa

SEQ ID NO: 209726 - RNA, 64 nt, Human
gaagaugaggguagaagauguuaagaucccagguuccagcaacugaugccacugacuaacaacu

SEQ ID NO: 209727 - RNA, 64 nt, Human
aaugagcuggcauuuucaagcauauacccaggaguccagcaaucauuggggaagagagccugag

SEQ ID NO: 209728 - RNA, 64 nt, Human
ggcuaagaugggaaaaauauaaaaagauuuaaaauccagcaacaaaauuuacacauucauuugg

SEQ ID NO: 209729 - RNA, 64 nt, Human
auuuucucugcacugguuuguuuaaaggacuucuuccagcaauaaguugaaagaauaaaccacu

SEQ ID NO: 209730 - RNA, 64 nt, Human
cuuuuuuuuuuuugcccaagaggcaucucaguacuccagcaauggaggaagaauagagaauuuu

SEQ ID NO: 209731 - RNA, 64 nt, Human
gaucuuuagcuucuacucccacugcuccuaccacuccagcaacgccagauaaugcaucacagga

SEQ ID NO: 209732 - RNA, 64 nt, Human
uaacuauugaaacaccuuaaucugugguuacuaauccagcaaauucaaggaaccaggcuaugac

SEQ ID NO: 209733 - RNA, 64 nt, Human
acauguuuagcaacacggcugaucuuucaguguuuccagcaacaaccuaagcaccguuaucagu

SEQ ID NO: 209734 - RNA, 64 nt, Human
cugcacgaccccugaaucugcugagaggcaccaguccagcaaauaaagcagucaugauuuacuu

SEQ ID NO: 209735 - RNA, 64 nt, Human
ucagcugaagcuggugcgcccugucucugugcccuccagcaagaagccacccuccuugcaggau

SEQ ID NO: 209736 - RNA, 64 nt, Human
aaaaauggcuuaagauguuuuucagauccugaauuccagcaaaagagcuauugccaaccaguuu

SEQ ID NO: 209737 - RNA, 64 nt, Human
cccucgcuguuggagcaaaccauuauaccuuacuuccagcaagcaaagugcuuugacuucuugc

SEQ ID NO: 209738 - RNA, 64 nt, Human
auacagcuggcuauucagggucacccagcaguccuccagcaagguagaaacaccaaaucaauga

SEQ ID NO: 209739 - RNA, 64 nt, Human
gggagaugccugccaggaaugagcaagcucuguugcucgggagccucuugucaccuucuuggac

SEQ ID NO: 209740 - RNA, 64 nt, Human
cgcugcacaccaugcaggaugacaugggggaugcgcucgggauuggugugaagaagcaaggacu

SEQ ID NO: 209741 - RNA, 64 nt, Human
uuaggcgugguggugggcuccuguaaucccagcugcucgggaggcugaggcaggagaaucacuu

SEQ ID NO: 209742 - RNA, 64 nt, Human
ccccucggccgccuccacgacccggaguaggggggcucgggaccaugaggaugaccagcaaaau

SEQ ID NO: 209743 - RNA, 64 nt, Human
ccugacucuagagaacuggguuuucucccaguacuccagcaauucauuucugaaagcaguugag

SEQ ID NO: 209744 - RNA, 64 nt, Human
gcuguguuaacuauucuuuggaauucuccuucuguccagcaaauacucuaaugaugguuaaaca

SEQ ID NO: 209745 - RNA, 52 nt, Human
acaaaagggaaucggaauaaacuccagcaaggaaauggccaguuaaguagug

SEQ ID NO: 209746 - RNA, 64 nt, Human
aaucucggcucacugcaaccuccgccuccuugguuccagcaauucuucugccucagccucccga

SEQ ID NO: 209747 - RNA, 64 nt, Human
ggaaaaccugauaggugagacuacuucaguuuauuccagcaagaaagauugugaugcaagauuu

SEQ ID NO: 209748 - RNA, 64 nt, Human
ggaaaaccagauagauggguugacaucaguuuauuccagcaagaaagaaaagauuguuaugcaa

SEQ ID NO: 209749 - RNA, 64 nt, Human
uggugucaauugcuuauuuguuuucccacgguuguccagcaauuaauaaaacauaaccuuuuuu

SEQ ID NO: 209750 - RNA, 64 nt, Human
uaagcagauucuuccuacugcaaaggacagugaauccagcaacucaguggauccaagcugggcu

SEQ ID NO: 209751 - RNA, 64 nt, Human
uucauacuguuaaugucaaauaucaaaaauguuuuccagcaauaucaaguuauggcaauggcaa

SEQ ID NO: 209752 - RNA, 64 nt, Human
agaccagaauuaucuuuguacuaaaagagaaguuuccagcaaaacccucaucagcauuacaagg

SEQ ID NO: 209753 - RNA, 64 nt, Human
cuucaguuuguauaaaccuaaggagagugugaaauccagcaacugaauuguggucacgauugua

SEQ ID NO: 209754 - RNA, 64 nt, Human
aaaagaagauuggaaaaagaccaaaacacacuucuccagcaacacuccaucagcuuuuuaaaau

SEQ ID NO: 209755 - RNA, 64 nt, Human
uucuucaaaaauuacaaauagaacuaucauaugauccagcaauaccauuacuggaaaaaggaaa

SEQ ID NO: 209756 - RNA, 64 nt, Human
uuuggaggagucaguaaccaaucccaccaaccacuccagcaaccugacaagacuaugaguaguu

SEQ ID NO: 209757 - RNA, 64 nt, Human; identical to SEQ ID NO: 6116

SEQ ID NO: 209758 - RNA, 64 nt, Human; identical to SEQ ID NO: 6153

SEQ ID NO: 209759 - RNA, 63 nt, Human
ucuccugcuguaaccccacgcacaagccugcaacccccagagcucuuugacaggcucccaggc

SEQ ID NO: 209760 - RNA, 63 nt, Human
augguugacauucuuacucucaacaccuuggcucccccagaucagggccauuggugacaaugc

SEQ ID NO: 209761 - RNA, 64 nt, Human
ggaaaaccagauagauaggacaacuucaguuuauuccagcaagaaagaaaagauuguuaugcaa

SEQ ID NO: 209762 - RNA, 64 nt, Human
guaccuuaucuucauuauaacaacacaauaucaauccagcaaucuuuagacuacaauaauacuu

SEQ ID NO: 209763 - RNA, 64 nt, Human
auaaaaucuuuccaucucauuacagcucauucgcuccagcaagcccgucaucuucccuuuccuc

SEQ ID NO: 209764 - RNA, 64 nt, Human
uucuauauuggucauugccuugccaaacaggagcuccagcaaaagcgcaggaagagagacuggc

SEQ ID NO: 209765 - RNA, 64 nt, Human
cacuuuuugagacagacugaauauaucuaaaauuuccagcaauaaaaaaaaaagcauuuaacuu

SEQ ID NO: 209766 - RNA, 64 nt, Human
ggcuccgacucagggcagcuggaaaucuucucgcuccagcaagcucgaccaugccaagagacug

SEQ ID NO: 209767 - RNA, 64 nt, Human
gcccucuccgugcaaugucacugcucguguggucuccagcaagggauucgggcgaagacaaacg

SEQ ID NO: 209768 - RNA, 64 nt, Human
cauuacccaaaccacucugacagucuccuccaguuccagcaaugccuagagacaugcucccugc

SEQ ID NO: 209769 - RNA, 64 nt, Human
auucaucaguaaggucagaugcuguuugcacaccuccagcaauagggugcucacugccucucac

SEQ ID NO: 209770 - RNA, 64 nt, Human
cacuucucuacuccauuauuucucuacuuuuccuuccagcaaaccugaaacgugagggagaugg

SEQ ID NO: 209771 - RNA, 64 nt, Human
ggucauuuucucuuuggauaauuuucaucgcauauccagcaacuauagaccaaaguuugcuuaa

SEQ ID NO: 209772 - RNA, 64 nt, Human
uaaagagcagagaucucucugggcccuagacauuuccagcaaaaccuggaacuuucaugccaaa

SEQ ID NO: 209773 - RNA, 64 nt, Human
cuuucggagcagcacccaggaggggaugccgcgcuccagcaacaccaggucaggccugugcaga

SEQ ID NO: 209774 - RNA, 64 nt, Human
ccuauguugcccagcuggucuuaaacuccugggcuccagcaauuaucccagcuugggcuccaaa

SEQ ID NO: 209775 - RNA, 64 nt, Human
cccgaaggcgcugcccaccccgcugaggcccagagcucgggagaugcccgccucgccgccccac

SEQ ID NO: 209776 - RNA, 64 nt, Human
cuugaccccaaaucccagaccccggaagcuccaggcucgggauguguccugagcaccugucccg

SEQ ID NO: 209777 - RNA, 64 nt, Human
cacuucaggaggccgaggugggaggaucacuggagcucgggaguucaagaccagccugggcaac

SEQ ID NO: 209778 - RNA, 64 nt, Human
uuccaccuccaucagucaugugugcagagucagugcucgggaucccgggcccagcuuuugccuu

SEQ ID NO: 209779 - RNA, 64 nt, Human
ugugucagucaucuucaaaggcagauuauuagauuccagcaaucugaaaucuauuauuccagca

SEQ ID NO: 209780 - RNA, 64 nt, Human
augaaggaguacacaaaccagagaaugacaugaauccagcaaauaggauccaacacaggcaaua

SEQ ID NO: 209781 - RNA, 64 nt, Human
gugcccuuuuuagggaagcuguuggagaaaauacuccagcaaaaugaaggaguacacaaaccag

SEQ ID NO: 209782 - RNA, 64 nt, Human
gcuuuggaaaucagauuuuuuaauguuaggaagauccagcaauuuugguuucugaaaaauuaca

SEQ ID NO: 209783 - RNA, 64 nt, Human
ggaauuuguuucuaguuuggugaugccuaacuuuuccagcaaagaugauggaaaauaguuauau

SEQ ID NO: 209784 - RNA, 64 nt, Human
gucuucacagccccgacaucaacuccuucuagcauccagcaagucaaugucaccgacagugaug

SEQ ID NO: 209785 - RNA, 64 nt, Human
aagguaacuggaauguauauacuuuugcuaauguuccagcaacacugcuauuauacuauccaaa

SEQ ID NO: 209786 - RNA, 64 nt, Human
aaauagagcaacacaaaggccucgaaaagaggucuccagcaaaaggcucugcaagugcaaagac

SEQ ID NO: 209787 - RNA, 64 nt, Human
cuuuacagauaucaaagcucagcucuuugaaacauccagcaagacaggccagagugugggugag

SEQ ID NO: 209788 - RNA, 64 nt, Human
acccacccacgcucugacgagaggcuuuuccaccuccagcaaguguucccagcaaccagcucca

SEQ ID NO: 209789 - RNA, 64 nt, Human
aguuuauuaauguauauaaacuuauaaauauuucuccagcaaauuugaggaagcaugauauauu

SEQ ID NO: 209790 - RNA, 64 nt, Human
auaagcuguaauucuaaaccugcacuugucccucuccagcaagaggcuagcacugaauucauuc

SEQ ID NO: 209791 - RNA, 64 nt, Human
uugcuucucuagaggagaaaccgaguaaaugugcuccagcaagauagacuuuguguuauucuau

SEQ ID NO: 209792 - RNA, 64 nt, Human
ggagagauuuauaaaaguaaacaaaagaaaaccuuccagcaacaaauuaaaaaauaauaacaaa

SEQ ID NO: 209793 - RNA, 64 nt, Human
caguucagcuuggugggagaaagucauucgcguggcucgggacgcucauguaaauuugguuuug

SEQ ID NO: 209794 - RNA, 64 nt, Human
gggccgcggggaagcgaggacuggccugcgcugggcucgggagcucugucgcgaggaggggcgc

SEQ ID NO: 209795 - RNA, 64 nt, Human
ccaccgggagagaugcugagaaaaacccaagaccgcucgggaaaugcaggaaggccggguugug

SEQ ID NO: 209796 - RNA, 64 nt, Human
cccagacgugccucuugugugccagcuggcuguggcucgggagcagacgcaggccucuccauug

SEQ ID NO: 209797 - RNA, 64 nt, Human
gcagaucaacaggauggagcucuucaugacugucuccagcaauaggaugauuuacuauaaauuu

SEQ ID NO: 209798 - RNA, 64 nt, Human
agcuuaggcagacaucgaaccucucugggauguuuccagcaaaagugagcuuuucuaaucgucu

SEQ ID NO: 209799 - RNA, 64 nt, Human
aacaucagaugauugaaauguucgcccaggggucuccagcaacuuuggaaaucucuuuguauuu

SEQ ID NO: 209800 - RNA, 64 nt, Human
acagcugggguuccaggcaugguuuaggcccuguuccagcaauaagaaccaaucugcuguacaa

SEQ ID NO: 209801 - RNA, 64 nt, Human
ugcucacagcugugcucugagugccuagcggaguuccagcaaacaaaauggacucaagagagau

SEQ ID NO: 209802 - RNA, 64 nt, Human
ggaaggaaaacacccuuuccaaagcaaauuccccuccagcaaauaaagcaugaaauauacagaa

SEQ ID NO: 209803 - RNA, 64 nt, Human
ggggaaaggauucaguggaggcuggcagggucccuccagcaaagcucccgcggaaaacugcucc

SEQ ID NO: 209804 - RNA, 64 nt, Human
cucagccucuauuguccagagcacuggcuuggcguccagcaaugaaggcuggagaaugcagccu

SEQ ID NO: 209805 - RNA, 64 nt, Human
auucauaaucccaaucuaauuaugagcuaaaacauccagcaaacucaaguugaaggacauucua

SEQ ID NO: 209806 - RNA, 64 nt, Human
guugggccaggccagcccagcccagagcacaggcuccagcaauaugucugcauugaaaagaacc

SEQ ID NO: 209807 - RNA, 64 nt, Human
ccuaguggauguuaagugguaucuaccugugauuuccagcaagauuacuguuaucucugcucuu

SEQ ID NO: 209808 - RNA, 64 nt, Human
gugcccuguggugaccaggagaacaaggagcuccuccagcaagcagggcugcagugggagcugg

SEQ ID NO: 209809 - RNA, 64 nt, Human
gcugaagucagcuugaccuaggucuugacccucauccagcaagggacucgacagacccaagggu

SEQ ID NO: 209810 - RNA, 64 nt, Human
ccuucccuccguggcguagggagcacuguuucuuuccagcaagccuguucagguuuggccaggu

SEQ ID NO: 209811 - RNA, 63 nt, Human
gcucggcggugguggacugaagaggggcccccagcucgggaccuggugcugaucagaguggcu

SEQ ID NO: 209812 - RNA, 64 nt, Human; identical to SEQ ID NO: 6086

SEQ ID NO: 209813 - RNA, 64 nt, Human; identical to SEQ ID NO: 6087

SEQ ID NO: 209814 - RNA, 64 nt, Human
ugucuucaaacugugaagcauuuacagaaacgcauccagcaagaauauugucccuuugagcaga

SEQ ID NO: 209815 - RNA, 64 nt, Human
guaggggccacauauuacauucaguugcuauagguccagcaacugaaccugccauuaccugggc

SEQ ID NO: 209816 - RNA, 64 nt, Human
cagcucccucugcccuguacccuaggcacguggcuccagcaagagccccaggcaggacaaaggg

SEQ ID NO: 209817 - RNA, 64 nt, Human
aaaaacauuccuauuaccuuucugaggcuggcuuuccagcaauuguuucaaaggaaaauagauc

SEQ ID NO: 209818 - RNA, 64 nt, Human
guugguuucuuccauuucaaacuaaucagcauucuccagcaaugacaaagugccagaguguaua

SEQ ID NO: 209819 - RNA, 64 nt, Human
aacaguuugaaagggacugaggcucacccaggucuccagcaaacggaggacugaacuggggaga

SEQ ID NO: 209820 - RNA, 64 nt, Human
aguacgaguuccacaaaauuugauccuuauugcuuccagcaaguagcaugaacuucuguguuca

SEQ ID NO: 209821 - RNA, 64 nt, Human
cuucucccuuuauuguccuuucguguauuguucauccagcaaccaggaugaucuuguuaaaaca

SEQ ID NO: 209822 - RNA, 64 nt, Human
cacauuuuacgaagcaauuuuaaucuuaaacacauccagcaaauggugucccugcugaaacuuu

SEQ ID NO: 209823 - RNA, 64 nt, Human
aagacauucagguguuucucaacgacaucuucuguccagcaagcucgguuugaauacgucacuu

SEQ ID NO: 209824 - RNA, 64 nt, Human
agauuuucacguauuaggcacuuuaguugaaucuuccagcaaaagcugucuacuuucucuuuua

SEQ ID NO: 209825 - RNA, 64 nt, Human
aucaguagaugcuauuauucauaagaacugugauuccagcaaacuaggguaauuggugccuuuu

SEQ ID NO: 209826 - RNA, 64 nt, Human
uccuucugggcuaacuccaagguccagcagaguguccagcaaaaguaggcguuagagcauucaa

SEQ ID NO: 209827 - RNA, 64 nt, Human
uguuuuaagaccucaguaaccauuucagccucuuuccagcaaacccuucuccauaguauuucag

SEQ ID NO: 209828 - RNA, 64 nt, Human; identical to SEQ ID NO: 6111

SEQ ID NO: 209829 - RNA, 64 nt, Human; identical to SEQ ID NO: 6121

SEQ ID NO: 209830 - RNA, 64 nt, Human; identical to SEQ ID NO: 6161

SEQ ID NO: 209831 - RNA, 64 nt, Human; identical to SEQ ID NO: 6162

SEQ ID NO: 209832 - RNA, 64 nt, Human
uauuuaaaaaccucaguaaucguuuuagcuucuuuccagcaaacucuucuccacaguagcccag

SEQ ID NO: 209833 - RNA, 64 nt, Human
aaaaaagaaacaaaugaaaaaaauuuuagaacaguccagcaaauugcuagucagggugaauugu

SEQ ID NO: 209834 - RNA, 64 nt, Human
gucuguguucaaaaauauauucauguaccugugauccagcaagaagggaguuccagucaagagu

SEQ ID NO: 209835 - RNA, 64 nt, Human
ugaaaacuucagaagcaaacaauauugucucccuuccagcaauaagugguaguuaugugaaguc

SEQ ID NO: 209836 - RNA, 64 nt, Human
uuggaaaacggaaaauuuacaagcaaccuagagguccagcaaugugaaaagaaucaaguaauuc

SEQ ID NO: 209837 - RNA, 64 nt, Human
auaggaacugcuggcuuugcaaauagaaguggucuccagcaaccguugaaaggcauagaauuga

SEQ ID NO: 209838 - RNA, 64 nt, Human
gcugaccuuguccccagccccaccuggcccuuucuccagcaagcacuguccucugggcaguuug

SEQ ID NO: 209839 - RNA, 64 nt, Human
ccuggccuuguccccagcuccaccuggccccuucuccagcaagcagugcccucuggacagcuug

SEQ ID NO: 209840 - RNA, 64 nt, Human
cugccacuuagacauaauccauuccacucauuauuccagcaaacacuuacugacaaaucggguc

SEQ ID NO: 209841 - RNA, 64 nt, Human
ugcauuggcaccccuccagccuggaggccaggcuuccagcaacuuccuucugcccuagagcaag

SEQ ID NO: 209842 - RNA, 64 nt, Human
uucauauuucauauucauauuucaaaccacaauauccagcaaaaugucuccugagcacccagaa

SEQ ID NO: 209843 - RNA, 64 nt, Human
cguaagagcagcugucagggaggcccagucacaguccagcaauuccacaaccaccuugacgaau

SEQ ID NO: 209844 - RNA, 64 nt, Human
uuuuuuaacaaauugaguuuagaagugaguguaauccagcaauacaguuuacugguuuaguugg

SEQ ID NO: 209845 - RNA, 64 nt, Human
acucugcacgugcuccucaaacuuggugaucuccuccagcaagucuguccccaccuugucgucc

SEQ ID NO: 209846 - RNA, 64 nt, Human; identical to SEQ ID NO: 6090

SEQ ID NO: 209847 - RNA, 64 nt, Human; identical to SEQ ID NO: 6091

SEQ ID NO: 209848 - RNA, 63 nt, Human; identical to SEQ ID NO: 6092

SEQ ID NO: 209849 - RNA, 64 nt, Human; identical to SEQ ID NO: 6093

SEQ ID NO: 209850 - RNA, 64 nt, Human
gaucucuuuuuaacaucaugugcgucucuugggauccagcaaaaguguuaagccacaaugcccu

SEQ ID NO: 209851 - RNA, 64 nt, Human
ggguuggugggacagccaggccagaugaccugauuccagcaaaaauaaaacucagauuugggca

SEQ ID NO: 209852 - RNA, 64 nt, Human
guucuuugagcauaauucacuuuaaagucauuuuuccagcaauguuuaaauuacuuucucauuc

SEQ ID NO: 209853 - RNA, 64 nt, Human
cugcacagugucccccagguuccgaagaagaugcuccagcaacacagccugggccccagcucgc

SEQ ID NO: 209854 - RNA, 64 nt, Human
guauuuugaauaccauuaaaacugcuuuuuuuuuuccagcaaguauccaaccaacuugguucug

SEQ ID NO: 209855 - RNA, 64 nt, Human
aggggaaaagaggaaauaauacaguaaucguuaauccagcaaaaagaaaugaaaagggaaaacc

SEQ ID NO: 209856 - RNA, 64 nt, Human
cucagcaccugaggcggguuuccuggguccccucuccagcaagccuccaccagcaagcucggcc

SEQ ID NO: 209857 - RNA, 64 nt, Human
uggaaguaaagacuuuggagcuagagaagccuuuuccagcaaugauuauugacuucaccacacc

SEQ ID NO: 209858 - RNA, 64 nt, Human
gaucuugacucacugcaaccucugccucucggguuccagcaauucuccugccucagccucccga

SEQ ID NO: 209859 - RNA, 64 nt, Human
aacuuccuacaggggccaaaaccagagaaaggcuuccagcaacuucgaugaaaguaguuuggcc

SEQ ID NO: 209860 - RNA, 64 nt, Human
gguccuguaucugauguugugguuaguggaguccuccagcaauugaaugagagcaguggacaca

SEQ ID NO: 209861 - RNA, 64 nt, Human
gggcaccuggcagcauauuuucugugacaauguguccagcaaaucauucuucaacuacauuuua

SEQ ID NO: 209862 - RNA, 64 nt, Human
ucauggcauacuuuucauguuuuaauuuuuuucuuccagcaaaauaaacacugaggcccuaaaa

SEQ ID NO: 209863 - RNA, 64 nt, Human
uguaacaaaggcaaaggcuucauuucaagagucauccagcaaugagagaauccugccucuguag

SEQ ID NO: 209864 - RNA, 64 nt, Human; identical to SEQ ID NO: 6096

SEQ ID NO: 209865 - RNA, 64 nt, Human; identical to SEQ ID NO: 6097

SEQ ID NO: 209866 - RNA, 64 nt, Human; identical to SEQ ID NO: 6098

SEQ ID NO: 209867 - RNA, 64 nt, Human; identical to SEQ ID NO: 6099

SEQ ID NO: 209868 - RNA, 64 nt, Human
auuagugacagacuuguuuucuucuuguuauuccuccagcaacucccucaccaccacgccuccc

SEQ ID NO: 209869 - RNA, 64 nt, Human
ggggaggugaauguuuucuagagauucaaacugcuccagcaauuucuguaguuuucaccucuga

SEQ ID NO: 209870 - RNA, 64 nt, Human
accaucucacaaagaucuuaaguaacuuuuuccauccagcaacauccagacgauuucagugacc

SEQ ID NO: 209871 - RNA, 64 nt, Human
acccccgcacgugugcaugacucgcagagaauauuccagcaauuguguaccccugggccagucu

SEQ ID NO: 209872 - RNA, 64 nt, Human
ugccacguuagugucacaaauuuuaugguuuaucuccagcaacauuucucuaguacuugcacuu

SEQ ID NO: 209873 - RNA, 64 nt, Human
uccuuggcuugcuccucuauucuaccucucuuucuccagcaauaauaugcaaaugaagacaugu

SEQ ID NO: 209874 - RNA, 64 nt, Human
ugcccauggcuaugaugucagacaguggaugggcuccagcaacaagagacaaaauaacuaaagg

SEQ ID NO: 209875 - RNA, 64 nt, Human
uuuucaggcuaauacagaaaaagaugaacaaacguccagcaagauacuuuaauccucuauuuug

SEQ ID NO: 209876 - RNA, 64 nt, Human
acuauuggucuggcucuaacaguuuguuuguucauccagcaaauguuuaugagugaugaccaug

SEQ ID NO: 209877 - RNA, 64 nt, Human
ugcauuauguucuuaacuccuuaauguggaauuuuccagcaaaauguuuaacucaggugugauu

SEQ ID NO: 209878 - RNA, 64 nt, Human
acugaaauggcuguaaggacuccugagauauguguccagcaaggaguuuacagucaaacaggag

SEQ ID NO: 209879 - RNA, 64 nt, Human
gccagaucuguuaagugguuucauaggagacacauccagcaauuguguggucaguggcucuuuu

SEQ ID NO: 209880 - RNA, 64 nt, Human
guccagcuggccuggacaguaucccacauccaacuccagcaacuucuucuccaucccucuaaug

SEQ ID NO: 209881 - RNA, 64 nt, Human
aaaagacaagugcucaagcagcaaaauccuuacuuccagcaaaauccaaacugcugucucuuaa

SEQ ID NO: 209882 - RNA, 64 nt, Human
ggguggaggguuggggaggaaagaaagggcgguggcucgggagguuccggccuucggggaccag

SEQ ID NO: 209883 - RNA, 64 nt, Human; identical to SEQ ID NO: 6094

SEQ ID NO: 209884 - RNA, 64 nt, Human; identical to SEQ ID NO: 6102

SEQ ID NO: 209885 - RNA, 64 nt, Human; identical to SEQ ID NO: 6103

SEQ ID NO: 209886 - RNA, 64 nt, Human
ugguacuguauguaugggagagcagacugcacccuccagcaacaacagaugaaagccagugagc

SEQ ID NO: 209887 - RNA, 64 nt, Human
ccugucgggccccccgacgccgccccauuucccuuccagcaaacucaacucggcaauccaagca

SEQ ID NO: 209888 - RNA, 64 nt, Human
uugcugucuugucuccugggacgagaaggacucauccagcaaaguugccugggauucaaaauaa

SEQ ID NO: 209889 - RNA, 64 nt, Human
uucucaguuauuuuccucccuugcccuugcaaucuccagcaaaaggugggaucuaggaagaaag

SEQ ID NO: 209890 - RNA, 64 nt, Human
guaagaacauccaggaccccuucuccuugauguuuccagcaagcuucuuuccuccuuauccuua

SEQ ID NO: 209891 - RNA, 64 nt, Human
uuugcaccagguaauaggggaaaauugugugaccuccagcaaacacaugaaugguuauuuccug

SEQ ID NO: 209892 - RNA, 59 nt, Human
cugcccaagcagucuacugaauccagccuuccagcaagagauuguuuuucaaggacaag

SEQ ID NO: 209893 - RNA, 64 nt, Human
cgggcacgugcccuucaccccauuccacccuuguuccagcaagacugggauggguacaacugaa

SEQ ID NO: 209894 - RNA, 64 nt, Human
auauauuauacgguaaauauaguaucgucugcauuccagcaaaaauaucaacucguaaggcacu

SEQ ID NO: 209895 - RNA, 57 nt, Human
uccugcacauguuggagugauggugccuccagcaaccgcuggggagugugucccuga

SEQ ID NO: 209896 - RNA, 64 nt, Human
gaaacagauugagucaagugacuaugacagcucuuccagcaaaggcaaaaagagugaggagggg

SEQ ID NO: 209897 - RNA, 64 nt, Human
aaacaacuacaaaaagaaaaugucaacaaauuuuuccagcaagcugagaaccugggaauuccug

SEQ ID NO: 209898 - RNA, 64 nt, Human
uauuccauuguuaacugaauguuacuguuuccacuccagcaacuacauguccucccuucaacug

SEQ ID NO: 209899 - RNA, 64 nt, Human
augacagagggguucuugggagaagaggcauagguccagcaacaaccaacaaagcagaaggagg

SEQ ID NO: 209900 - RNA, 64 nt, Human
cagugugauggggccucagcagcgggugccccuggcucgggacagguagcacugcuguccagcc

SEQ ID NO: 209901 - RNA, 64 nt, Human; identical to SEQ ID NO: 6139

SEQ ID NO: 209902 - RNA, 64 nt, Human; identical to SEQ ID NO: 6165

SEQ ID NO: 209903 - RNA, 64 nt, Human; identical to SEQ ID NO: 6166

SEQ ID NO: 209904 - RNA, 64 nt, Human
gcaucuucagcuugagaaaaugagguugucaguuuccagcaaggcugacauccaccagacugau

SEQ ID NO: 209905 - RNA, 64 nt, Human
gcagccaccgucuccagagcccugggcagcauuuuccagcaagauguacacaaucuuuugccuu

SEQ ID NO: 209906 - RNA, 64 nt, Human
gguaggaguuccaacauuuauguccagagcaacuuccagcaaggcuggucugggucucugccca

SEQ ID NO: 209907 - RNA, 64 nt, Human
uugacuuugccacauccauugacugacccccuccuccagcaauagcauccaaggggccuggaag

SEQ ID NO: 209908 - RNA, 64 nt, Human
uuauaccugcucuuguucuacugagaaaagccucuccagcaauaauguuuucuagucacuuccu

SEQ ID NO: 209909 - RNA, 64 nt, Human
ugaaauccaauuuagauuauuuuuagaguauuuuuccagcaaauucaauuuauucugaaauuua

SEQ ID NO: 209910 - RNA, 64 nt, Human
ccuugugagagaaauaagucauuuuaauugcauuuccagcaaggaaugacauucaguucuguaa

SEQ ID NO: 209911 - RNA, 64 nt, Human
uuaucauucugcuuccguauuuuaauuuacugauuccagcaagaccaaaucauuguaucaaauu

SEQ ID NO: 209912 - RNA, 64 nt, Human
cucgucacaucaaugcaaaagguccugauuuuguuccagcaaaacacagugcaauguucucaga

SEQ ID NO: 209913 - RNA, 64 nt, Human
aaucucgguucacugcaaccucugccuuccagguuccagcaauucuccuaccucagcucccaag

SEQ ID NO: 209914 - RNA, 64 nt, Human
ugcaugcaaaaagccaccaaaugaagggauucuauccagcaagauccuguccaagaguagccug

SEQ ID NO: 209915 - RNA, 64 nt, Human
uugccuuacuuuuuaauauguauuuauaaaguauuccagcaaaagaggauguagccucugggaa

SEQ ID NO: 209916 - RNA, 64 nt, Human
ucagugauguaaaccucacuuuauuaaaaaauuauccagcaaacaaaaugggaaugugguguua

SEQ ID NO: 209917 - RNA, 64 nt, Human
uucgagcccugggcgggggucagucaagccgugguccagcaaacuccucugcagauggcuggag

SEQ ID NO: 209918 - RNA, 64 nt, Human
ggcugucagacaagccccggggggcagcaggugggcucgggacgggcugggggagggacggcca

SEQ ID NO: 209919 - RNA, 64 nt, Human
gccgggcggcggggacacggcgguaccguccugcgcucgggaacgcggaauguugcccuggucg

SEQ ID NO: 209920 - RNA, 64 nt, Human
caccaggguucucugcagccacacaaucagcccggcucgggagcaaacuccccuggaagaacgg

SEQ ID NO: 209921 - RNA, 64 nt, Human
cacuuugauaggcugaggcagguggauugcuugagcucgggaguuugagaccagccucaucaac

SEQ ID NO: 209922 - RNA, 64 nt, Human
agaaagggaggguggagggugaggccaaaucagguccagcaaaagucaguagggacauugcaga

SEQ ID NO: 209923 - RNA, 64 nt, Human
ugcuuuguccugauuguagcaaaucccaucucaguccagcaagacucagucaucucccuuuggg

SEQ ID NO: 209924 - RNA, 64 nt, Human
uucagucaguaaagacgucuuauagagccuuugauccagcaauaccccacuucaccuacaauaa

SEQ ID NO: 209925 - RNA, 64 nt, Human
agaagugugccuguuuauuauguagauacagacauccagcaaaaacaggagaaucacaugcuuu

SEQ ID NO: 209926 - RNA, 64 nt, Human
uaagaggaaauaguuuagucacagguuuuuacaguccagcaagggccaaagagguauaguauac

SEQ ID NO: 209927 - RNA, 64 nt, Human
ugugggucuccucucggcucugggauuugaacaguccagcaauagcaauccagaauugggguuu

SEQ ID NO: 209928 - RNA, 64 nt, Human
uggggguuggccauuuaugcugacaugccauccuuccagcaaacguacgggaaugugcuuucaa

SEQ ID NO: 209929 - RNA, 64 nt, Human
cacgggggacguuuagagggcacgugggaaauuuuccagcaaucaaugccuugagaaacuuaaa

SEQ ID NO: 209930 - RNA, 64 nt, Human
caucauacauuagugccauagaguuuaguaaccguccagcaagugucaucacuuuuacagaaaa

SEQ ID NO: 209931 - RNA, 64 nt, Human
ucugcagcauggaucagcaaggcucuuucguucuuccagcaaaggcuuccaagguacaacucaa

SEQ ID NO: 209932 - RNA, 64 nt, Human
accucuacagcccugaacucuugagacaacucucuccagcaauagcugcccagcuuugcccaac

SEQ ID NO: 209933 - RNA, 64 nt, Human
gaucauagaucacguuacaagcacuuggcucagguccagcaaggacagaugaacaaauuccuga

SEQ ID NO: 209934 - RNA, 64 nt, Human
augaccuggacccuggccagaagagcccuggcccuccagcaaggcagcaccugcucugaugcac

SEQ ID NO: 209935 - RNA, 64 nt, Human
cccagucuucuguggggugcacagccucccucccuccagcaagcccucccugcccagaaggaau

SEQ ID NO: 209936 - RNA, 64 nt, Human
ggauguccccgcuccugugucgcaccuggcaccugcucgggagcgcaccucaccggacugagcu

SEQ ID NO: 209937 - RNA, 64 nt, Human
agccguccuggggaugcucagggugcaggcagaggcucgggaggccggacucaggggucagaag

SEQ ID NO: 209938 - RNA, 64 nt, Human; identical to SEQ ID NO: 6106

SEQ ID NO: 209939 - RNA, 64 nt, Human; identical to SEQ ID NO: 6107

SEQ ID NO: 209940 - RNA, 64 nt, Human
ccacucaaaagucucaacaagacacaagcaaaaauccagcaaugcucaaauccaaaagcacucg

SEQ ID NO: 209941 - RNA, 64 nt, Human
ucuccccuggcagugacaagauggcugcagcagcuccagcaaccucagaggacucccccaucca

SEQ ID NO: 209942 - RNA, 64 nt, Human
cagcgcaugcuggugcagcguaaggacgaacuccuccagcaagcucgcaagugagucgcuucuc

SEQ ID NO: 209943 - RNA, 64 nt, Human
gagccccucgacucgucccguggccgccuguuuuuccagcaaaccacgcuaacuagcugaccac

SEQ ID NO: 209944 - RNA, 64 nt, Human
gauguuuuaugaaaaccaaugaggcugcugccacuccagcaagggaaauaaugcaguuuccugu

SEQ ID NO: 209945 - RNA, 64 nt, Human
gaucucggcucacugcaaccucugccucccagguuccagcaauucuccugccucagccucccua

SEQ ID NO: 209946 - RNA, 64 nt, Human
gugacaagugccgugaacaucaugcacagcagccuccagcaaggcaaauuugacacaaaaggca

SEQ ID NO: 209947 - RNA, 64 nt, Human
acuauuuugauaaguauuagagguuaaccuuaaauccagcaaaacauuaaaacagaaacuuuuc

SEQ ID NO: 209948 - RNA, 64 nt, Human
ucuguuugaaaacggcgaccuucgggcccuuuucuccagcaacugcagaggcauuucaggaguu

SEQ ID NO: 209949 - RNA, 64 nt, Human
uucuucaucaagaaaaaguggaaccagcugucccuccagcaaaaacagcagcccuaauagcagc

SEQ ID NO: 209950 - RNA, 64 nt, Human
uuuuccucuuaggguuucuuugcagaaagaaaccuccagcaagggaagagagguguguguccac

SEQ ID NO: 209951 - RNA, 64 nt, Human
guggaccaaugcaucucuuuaaaggcaaauauuauccagcaagcagucuacccuguccuuugca

SEQ ID NO: 209952 - RNA, 64 nt, Human
acaguaggaucucaaacccugcauccauccuuccuccagcaagcccugcuagccacaugaggaa

SEQ ID NO: 209953 - RNA, 64 nt, Human
ugaggggugagaagugauguuuguuacuauguucuccagcaaguaaacauuccucugcucaccu

SEQ ID NO: 209954 - RNA, 64 nt, Human
guuagcccggccaaggacacugauggguccugcugcucgggaaggccugagggaagcccacccg

SEQ ID NO: 209955 - RNA, 64 nt, Human
cagaacgggccuccccggggguccccggacgcuggcucgggacugucuucaacccugcccugca

SEQ ID NO: 209956 - RNA, 64 nt, Human
cgacccccuaugagacgccgccggccagcggggcgcucgggagccagggaccgccgcgucgccg

SEQ ID NO: 209957 - RNA, 64 nt, Human
cacacugcugugccuuagucauguuguucccuuugcucgggaugcccacuucacgucgacggca

SEQ ID NO: 209958 - RNA, 64 nt, Human
cacuauuauguagugcauuuuaacuuaaauuuuuuccagcaacauguuacuuauuuaagauaca

SEQ ID NO: 209959 - RNA, 64 nt, Human
ccgcacagguauguggaccgagugacugaauuccuccagcaaaagcugaagcagucccagcugc

SEQ ID NO: 209960 - RNA, 64 nt, Human
auccucccguaggccagugugucucugaaacggauccagcaauuccugagccaagaggaacuug

SEQ ID NO: 209961 - RNA, 64 nt, Human
ggacaaauuagcaugcaagcuuggucaaacuuuuuccagcaaaauggaagcaaagacaaaagaa

SEQ ID NO: 209962 - RNA, 64 nt, Human
cuagcggaugaccaccaggcucucaucugggacauccagcaaaugccccgagccauugaggacc

SEQ ID NO: 209963 - RNA, 64 nt, Human
ccgaaggcagggaacgcccuccccagucccgcuguccagcaaggccccgagacuuuucuucugu

SEQ ID NO: 209964 - RNA, 64 nt, Human
aauuuuggcucccugcaaccuccgccuccuggauuccagcaauucuccugccucggcuucccaa

SEQ ID NO: 209965 - RNA, 64 nt, Human
ucagagggaggcacaguccacccagauccaccuuuccagcaagacccccaguggcugcccagcc

SEQ ID NO: 209966 - RNA, 64 nt, Human
gucuuggaaacagacggcggcaccuuuccucuaauccagcaaagugauucccugcacaccagag

SEQ ID NO: 209967 - RNA, 64 nt, Human
uuaaauauuugucuccagucuccacuguuggcucuccagcaaccaaaguacaacacuccaagau

SEQ ID NO: 209968 - RNA, 64 nt, Human
uaagaaaaucauaggccaagauagggaggggcauuccagcaaaccccguguuaaugcuacugug

SEQ ID NO: 209969 - RNA, 64 nt, Human
gaggccucaccauacucccuuucagggccagggcuccagcaagcccagggcaaggauccugugc

SEQ ID NO: 209970 - RNA, 64 nt, Human
caccagcaccugccucugagaccucgcucucuguuccagcaacccugguuggggggucagacuu

SEQ ID NO: 209971 - RNA, 64 nt, Human
agacaguugaugugucaugcagagcucuuacuucuccagcaacacucuucaguacauaauaagc

SEQ ID NO: 209972 - RNA, 64 nt, Human
ucgcugggccuuagcugccuccccgcggggcagggcucgggaccugcagcccuccaugccugac

SEQ ID NO: 209973 - RNA, 64 nt, Human
cugcuuggcugugccugcagcucagggugcuggggcucgggacccaccccccugcuugcggaac

SEQ ID NO: 209974 - RNA, 64 nt, Human; identical to SEQ ID NO: 6108

SEQ ID NO: 209975 - RNA, 64 nt, Human; identical to SEQ ID NO: 6110

SEQ ID NO: 209976 - RNA, 64 nt, Human
cauccauuucguguuuuuuccugucaaacauuaauccagcaaauauaugagguauuuaccaauu

SEQ ID NO: 209977 - RNA, 64 nt, Human
aaggugccugguuugcagcaggcucuccgcucuuuccagcaaagcugcucagagagggugucca

SEQ ID NO: 209978 - RNA, 64 nt, Human
cuguucuuggugaccccaguugggcuuuggccccuccagcaaccuugugucccagcccugcccu

SEQ ID NO: 209979 - RNA, 64 nt, Human
ggcaaucaaugauagguuuauaaucuuagauuauuccagcaaaguguggauugcauuguuagga

SEQ ID NO: 209980 - RNA, 64 nt, Human
gcucucagcucacugcagcccugacugccuaggcuccagcaaucuucuuacgucagccuccaga

SEQ ID NO: 209981 - RNA, 64 nt, Human
uucuuggcuguuaaccguagauagaucuuguaaauccagcaaccuuugguugcugcauuccccu

SEQ ID NO: 209982 - RNA, 64 nt, Human
caaaaaucauuaacaaaaauauuagcaaacugaauccagcaaccuauaaaaaggauucuauauc

SEQ ID NO: 209983 - RNA, 64 nt, Human
ugaagaggacgccgccagcgaguccagcagggaguccagcaacgaggaugagggcagcagcucc

SEQ ID NO: 209984 - RNA, 64 nt, Human
augcaaagcugaagaccauggauuucauggugauuccagcaaguacagagauucuaugaagccc

SEQ ID NO: 209985 - RNA, 64 nt, Human
aaauacuaaauucauccucacuuuauguugaucuuccagcaacguuuauauauuuaguaauuuu

SEQ ID NO: 209986 - RNA, 64 nt, Human
uuucagcagaaaugaaggauaagcaucgcacauguccagcaaugucuuugagaaugcagucauu

SEQ ID NO: 209987 - RNA, 64 nt, Human
cgguguaucaagggcgcccuuaaagcuggaacauuccagcaagcuucuugcgcuucucugcacc

SEQ ID NO: 209988 - RNA, 64 nt, Human
ccacugcacuccagccuggccaauaagaccugucuccagcaagacccugucucaaaaaaaaaaa

SEQ ID NO: 209989 - RNA, 64 nt, Human
ugugacggcucacugcagccugcgccucccagcguccagcaauucuuguuucucggccucccaa

SEQ ID NO: 209990 - RNA, 64 nt, Human
ggggcgcuggggaaucuuccuccccagcccccgggcucgggaguuaugcauccagagaccugcc

SEQ ID NO: 209991 - RNA, 64 nt, Human
cagcucacaccagugacccugacugugccacgcugcucgggagagcugaggguuuuauuguuug

SEQ ID NO: 209992 - RNA, 64 nt, Human
agaacuguguggccccugccugugccagccaugggcucgggauggacucccugggccccaccca

SEQ ID NO: 209993 - RNA, 64 nt, Human
aaccuauuaccaccccaccucgcugggaccuacugcucgggaggcagcagacagggagccacca

SEQ ID NO: 209994 - RNA, 64 nt, Human
gugccguuucugggcaggagaagacaucaugguguccagcaacucagcaaagccauucuuaaga

SEQ ID NO: 209995 - RNA, 64 nt, Human
aaugguuuauucuuucuaacuccauauaagcuuuuccagcaaagauuguaauaacacauuuaug

SEQ ID NO: 209996 - RNA, 64 nt, Human
gugacaagggcccugccuccaccccuccagcccauccagcaaucgcccccuuucugcccugggg

SEQ ID NO: 209997 - RNA, 64 nt, Human
ccuuuugaagaaugaaugaaaccuuccuaagccuuccagcaauuuccccccaacuccgaugggu

SEQ ID NO: 209998 - RNA, 64 nt, Human
cugggacuuccuaaacuuuccaaaaccuuccucuuccagcaacugaaccucgccauaaggcacu

SEQ ID NO: 209999 - RNA, 64 nt, Human
agaggcucgggcuuguuugaggguucacgaccccuccagcaaaggagucugaggcugauuccag

SEQ ID NO: 210000 - RNA, 64 nt, Human
ggucuuggcucacugcaaccuccaccucccagguuccagcaauucuccugccucagccucccca

SEQ ID NO: 210001 - RNA, 64 nt, Human
gugauacccaggcagauauggucuggaguggaccuccagcaaacuccagcagaccugcagccga

SEQ ID NO: 210002 - RNA, 64 nt, Human
caugguggccccgcugugaucuggggucacccucuccagcaagagaaccccgugggguuaugua

SEQ ID NO: 210003 - RNA, 64 nt, Human
gcaggaccaagggagccagccuccagugagugacuccagcaagugcagccaccucucccuugau

SEQ ID NO: 210004 - RNA, 64 nt, Human
aaaaucaaaaucugagucugagacauacacacuuuccagcaagauggguccugacucaaaaccc

SEQ ID NO: 210005 - RNA, 64 nt, Human
uccccagccucuccuccuugggcagggucucugcuccagcaagcaaacaggguggcccaggugg

SEQ ID NO: 210006 - RNA, 64 nt, Human
ggaaaccauucuuuauacuugcauguaaacaucuuccagcaacaaucauuuauuguuaaaccug

SEQ ID NO: 210007 - RNA, 64 nt, Human
cucagcagcggcugcggcuguggcagccuccaucuccagcaagucuccuggccucuccuccuca

SEQ ID NO: 210008 - RNA, 64 nt, Human
ggacguguguccccauggcuuguggaucagcuaagcucgggaucauuuccauaagucugcuuuu

SEQ ID NO: 210009 - RNA, 64 nt, Human
cugaguggcugcuuagcaugggccaccgcgcuaggcucgggacagcuggucuuuccggccaucu

SEQ ID NO: 210010 - RNA, 64 nt, Human
ugugcagaccuuacucaggggauguuuaccuggugcucgggaagggaggggaaggggccgggga

SEQ ID NO: 210011 - RNA, 64 nt, Human
uccagggaggcagugggggccuuguuggcagcuggcucgggagccggcuuacaggagggcagcu

SEQ ID NO: 210012 - RNA, 64 nt, Human
aagauggauuugacacacucaccauuuaaucauuuccagcaaaauauauguuuggcugaaauua

SEQ ID NO: 210013 - RNA, 64 nt, Human
gccaugccugcuccugccucucucccaacauguuuccagcaaguagaugccccuguguguguuu

SEQ ID NO: 210014 - RNA, 64 nt, Human
auccagagcucggaaucuacagcguccagccauuuccagcaagagcgcuucccauuccggagac

SEQ ID NO: 210015 - RNA, 64 nt, Human
ugacgcucauucuucuuccuauuguucccugacauccagcaaauugugaauuugaaaaaugaug

SEQ ID NO: 210016 - RNA, 64 nt, Human
uuaauaagucauuauuauauuuuucagcccuucauccagcaaaucagaaggacucaguacaaac

SEQ ID NO: 210017 - RNA, 64 nt, Human
ccuguaccagcaccuccguuuucagucaguguuguccagcaacgguaccguuuacacagucacc

SEQ ID NO: 210018 - RNA, 64 nt, Human
gugagagucccccagcacacacuccccaacccccuccagcaacuacaugugacugauagcuuuu

SEQ ID NO: 210019 - RNA, 64 nt, Human
aggcacagaauucucauucuguuauccaguucauuccagcaaucauaguuaauacaguacuugg

SEQ ID NO: 210020 - RNA, 64 nt, Human
ugugccaacuacgucuuaucucccuagggaaugcuccagcaacccugugggggaaguguuuuca

SEQ ID NO: 210021 - RNA, 64 nt, Human
cggcugcugcccuucaacaacaagcccugauuuuuccagcaaugccagaaaccuggauuuuaag

SEQ ID NO: 210022 - RNA, 64 nt, Human
ccgcccagcaggagggacugaggccagacucauguccagcaaggaacgugugguguguccccug

SEQ ID NO: 210023 - RNA, 64 nt, Human
ugcuguugugugaucaaacaugucucuguguaguuccagcaaaucaagcugagcuuugaaaaag

SEQ ID NO: 210024 - RNA, 64 nt, Human
uaccugaaggagaacuaccuccagaaccgacaguuccagcaaaagcagcggcccgagcagaaga

SEQ ID NO: 210025 - RNA, 64 nt, Human
guuucaaggccaaucaaugggaugcuucguuuucuccagcaacaggaacucucucuuuucaccu

SEQ ID NO: 210026 - RNA, 63 nt, Human
ggagguaauaaaagcagaccgacacgcagauguugcucgggaagcagaugucgaugcagagau

SEQ ID NO: 210027 - RNA, 64 nt, Human
cacuggagucaaggcuccgagggaggagagaggggcucgggaagggagcuggggcggugagggc

SEQ ID NO: 210028 - RNA, 64 nt, Human
uuggccaagggcaucuuugaugguacaagcagaggcucgggagaggcucccgucacacacuaca

SEQ ID NO: 210029 - RNA, 64 nt, Human
ugaguggccuguaaugggcagaggcucccucggggcucgggaucugcagcaucuauguggauca

SEQ ID NO: 210030 - RNA, 64 nt, Human
ucagucucuacguagagcuguuaucauaggcauuuccagcaaugugagcuaaccccucuuacua

SEQ ID NO: 210031 - RNA, 64 nt, Human
acauuuuccuaggguuaacaccucaccaaguucuuccagcaaaaugcuuauuagaguuuuuguc

SEQ ID NO: 210032 - RNA, 64 nt, Human
ugggagacagaggacuggacccugggucucagguuccagcaagucaggcuagggaccugggggg

SEQ ID NO: 210033 - RNA, 64 nt, Human
agcgaccuguggacuaaaaucugccacgauugguuccagcaagugugagcagagaccccgugca

SEQ ID NO: 210034 - RNA, 64 nt, Human
aggagggugggugggagcugcagugggcucagaguccagcaaugaggcccccuggccugggcac

SEQ ID NO: 210035 - RNA, 64 nt, Human
ucugcgugucccacagacgcuuguuccagggggcuccagcaaaccccuucguggucucucaaag

SEQ ID NO: 210036 - RNA, 64 nt, Human
uccugcagucuuacuagucagccacaguccagguuccagcaacacuagcuaccuaccaaacaaa

SEQ ID NO: 210037 - RNA, 64 nt, Human
guccacaugaccuccauuucccaaaguccucugcuccagcaacugcccuuccaggugggugugg

SEQ ID NO: 210038 - RNA, 64 nt, Human
gauugcaggcgagaacacgaucuucuuccacaucuccagcaaguucucaagcucagagacggug

SEQ ID NO: 210039 - RNA, 64 nt, Human
gccaugucccgcuauaaauccagaaugggaaguguccagcaagccuacucugacuucugacuug

SEQ ID NO: 210040 - RNA, 64 nt, Human
gggcgucuccugagacaggccagcuuggauggccuccagcaacucagggauaacaugggcucca

SEQ ID NO: 210041 - RNA, 64 nt, Human
uaaguugucuuuguagaaaaugaagagccuuucuuccagcaaaaaucccugcuguaugcaauag

SEQ ID NO: 210042 - RNA, 64 nt, Human
gaucuagggcagacacacaaccuccuccuccucuuccagcaaggaacgcaccgaaaagucacau

SEQ ID NO: 210043 - RNA, 64 nt, Human
gucuaagcagugagaaucuuuucuaugccucuauuccagcaaaaaguagaaguaucaaauaaaa

SEQ ID NO: 210044 - RNA, 64 nt, Human
cugggugugguggcagacagcuguaaucucagcugcucgggaggcugaggcacaagaaucgcuu

SEQ ID NO: 210045 - RNA, 64 nt, Human; identical to SEQ ID NO: 6113

SEQ ID NO: 210046 - RNA, 64 nt, Human; identical to SEQ ID NO: 6114

SEQ ID NO: 210047 - RNA, 64 nt, Human; identical to SEQ ID NO: 6115

SEQ ID NO: 210048 - RNA, 64 nt, Human
uccugcacaggcauccuucccuuuauagauugauuccagcaaaggcggaauaaaacaaauuucc

SEQ ID NO: 210049 - RNA, 64 nt, Human
ggggcaaaaguccauucucauuugguccauuaguuccagcaauugaaauuuaugugaauuauuu

SEQ ID NO: 210050 - RNA, 64 nt, Human
gaaaucacuacacucuuagagaaucccucuguucuccagcaaacaugggauguaaagccucaca

SEQ ID NO: 210051 - RNA, 64 nt, Human
cgcccaauacacacagcuccauuaugcaauccauuccagcaaauuccccgugucuguggucacc

SEQ ID NO: 210052 - RNA, 64 nt, Human
gaauguggcccugguuucuuuucccacaugaaccuccagcaaauagcaaguccaggaaaaacuc

SEQ ID NO: 210053 - RNA, 64 nt, Human
ucccuccacuccucccaacucuggccuugguuccuccagcaaugccugccugaacaaaggccgu

SEQ ID NO: 210054 - RNA, 64 nt, Human
cucuccccagcccccuugcuucucuccagcccuguccagcaagugcagggugccugcacuucac

SEQ ID NO: 210055 - RNA, 64 nt, Human
gauccuggcucacugcaaccuccaccucccggguuccagcaaauucuccugccucagccuccca

SEQ ID NO: 210056 - RNA, 64 nt, Human
cgcucacaccaggaugcuggagcagagcugacaugcucgggaaagggcagaggucacugggggu

SEQ ID NO: 210057 - RNA, 64 nt, Human
guccugaaguuuaaaacacuuuugaccagcuuuggcucgggagaguggggcugcuuguagaacu

SEQ ID NO: 210058 - RNA, 64 nt, Human
agcgcaggugugaugggcacaguacgcagagcaagcucgggaaguugguaggaucucaggcuug

SEQ ID NO: 210059 - RNA, 64 nt, Human
aacuacagggcggcgggcugcggucagcacgugugcucgggacacagcggagucagggccagag

SEQ ID NO: 210060 - RNA, 64 nt, Human
caugguggcucacuuugggagauggauugcuugagcucgggaagagaccaguucggucucuaca

SEQ ID NO: 210061 - RNA, 64 nt, Human
ucucaacugagguucuugggauacagaucucagggcucgggagccaugucaugugagugggugg

SEQ ID NO: 210062 - RNA, 64 nt, Human
auccggcaugagggcugagaugcgcaaagagugugcucgggaguggccccuggcaccugggugc

SEQ ID NO: 210063 - RNA, 64 nt, Human
uggggccccauggcacacaccuguagucccagcugcucgggaagcugagaugggcggauugcuu

SEQ ID NO: 210064 - RNA, 64 nt, Human
ucccuggugcauaggaccuggcaugcgucaggcugcucgggaaaugugggaacuggacacccag

SEQ ID NO: 210065 - RNA, 64 nt, Human
ugcugggcuccagucacccugucugcaguccggagcucgggaucugaagggagggcuaaggaau

SEQ ID NO: 210066 - RNA, 64 nt, Human
uccccacccauccuggcgggcgggcugcgcggaggcucgggagcuggccggggaggggcggaug

SEQ ID NO: 210067 - RNA, 64 nt, Human
ccaggcaugguaaugcgcgccuguggucccagcugcucgggaggcugaggugggaggaucacuu

SEQ ID NO: 210068 - RNA, 64 nt, Human
acggaggcuggcgaccaggcgaggccuaggccaggcucgggagacuuuucugugcuccuuucua

SEQ ID NO: 210069 - RNA, 64 nt, Human
agccugacucuggcgggcagcgggagaggcgcucgcucgggaccuuccaccucuccaacauugu

SEQ ID NO: 210070 - RNA, 64 nt, Human
cagcccaccuccguccucacauacgugcaggcuggcucgggaguccagugagcagagcauugga

SEQ ID NO: 210071 - RNA, 64 nt, Human
ggcugauggggggguucugugagggagaaucagggcucgggaagccacgccugggaaggcagga

SEQ ID NO: 210072 - RNA, 64 nt, Human
cucugcugcccaggaguggccaguguucggcguugcucgggauucaagauaccaccaguucaga

SEQ ID NO: 210073 - RNA, 64 nt, Human
aaggcacagcgaagcuguaacugaggacccugcugcucgggaaggaggugguuuccagugugac

SEQ ID NO: 210074 - RNA, 64 nt, Human
caugccuguaauccuaguauuauaggaggcagaggcucgggaggauugcuugagcccaggaguu

SEQ ID NO: 210075 - RNA, 64 nt, Human
ccuccucuuggagcugagaugagccccacguggagcucgggacggauaguagacagcaauaacu

SEQ ID NO: 210076 - RNA, 64 nt, Human
cccaccggcggcccccguagcagguggugugggugcucgggaguggaggugacgucagcagcgc

SEQ ID NO: 210077 - RNA, 64 nt, Human
uccgggucgcguggaucuacccucuaguuuacuugcucgggagaagaaacugacucguuuuauu

SEQ ID NO: 210078 - RNA, 64 nt, Human
cuaaaauguauguguaugaagauccuggcuugcagcucgggagcuuuacacaccuugugucacu

SEQ ID NO: 210079 - RNA, 64 nt, Human
ccacaguggaauuguugaaguguggcgagucugugcucgggacaauaaagcuugugacaggucc

SEQ ID NO: 210080 - RNA, 63 nt, Human
ggagccuccaggauggagauggagacccagcagcccccagacuacuucuaucccugaaaacac

SEQ ID NO: 210081 - RNA, 63 nt, Human
gagacuguccuugggccuccucuggaagcagcacccccagaggacagggcuccuccugcuugc

SEQ ID NO: 210082 - RNA, 63 nt, Human
gagaagaucuucaccauuaggaagaucucuagacccccagaucucagaaucaggccuauuugu

SEQ ID NO: 210083 - RNA, 63 nt, Human
aaaacuaggugcugcagccccugggaccaggcacccccagaaugaccuggccgcagugaggcg

SEQ ID NO: 210084 - RNA, 63 nt, Human
cugucccaugugaagugguagugcggugccuuucccccagaucaugcuuuaauucuuucuuuu

SEQ ID NO: 210085 - RNA, 63 nt, Human
aggcuggagacuggaccgcugacugcaccagcgcccccagaacauacacugugaacucaaucu

SEQ ID NO: 210086 - RNA, 63 nt, Human
gugggacacccgagcugcacguuccuauacggccccccagacccagcuguccgggccacagac

SEQ ID NO: 210087 - RNA, 63 nt, Human
ggcuguggcugcggccgggagcccgccccgcuucccccagagacuguaucguggcaccguggc

SEQ ID NO: 210088 - RNA, 63 nt, Human
uuggaucuuuccagggauagccaaugauuuuaucccccagaauccuucaccuuucaaggaguu

SEQ ID NO: 210089 - RNA, 63 nt, Human
ggaaaauaccagaaaaugagggccgcuuugagucccccagagaugucaucagagcuccucugu

SEQ ID NO: 210090 - RNA, 63 nt, Human
cagggaaacugggcugugagccacacacuucuccccccagacagggacacagggucacugagc

SEQ ID NO: 210091 - RNA, 63 nt, Human
ggagccagguucacggggcuguuuccuccuccucccccagauguccccccugucaccgggcag

SEQ ID NO: 210092 - RNA, 63 nt, Human
caagcaacacagaccacucuuccccuugccccucccccagagggacuugacuuucuuucugga

SEQ ID NO: 210093 - RNA, 63 nt, Human
uaguuccuaguuguucuuacccugcuucuuucucccccagaaucgacauaguccagaccaccc

SEQ ID NO: 210094 - RNA, 63 nt, Human
uuggccaugggaggccuuucccuaagccagcugcccccagagccacaguuccccuauguggaa

SEQ ID NO: 210095 - RNA, 63 nt, Human
cuggggcuuuuccauuuaacacauggagcccuucccccagaaggcuacuuccuuguuuuagag

SEQ ID NO: 210096 - RNA, 63 nt, Human
ccuucucuuucccuuauuuaggagcccugaacucccccagagucuauccauucaugccucuug

SEQ ID NO: 210097 - RNA, 63 nt, Human
ucuagcugccggccucuggaggcuccgagccugcccccagagacgucccugccccuccaggac

SEQ ID NO: 210098 - RNA, 63 nt, Human
cuugagucugaggccccaggcccuaggauuccucccccagagccacuaccuuuguccaggccu

SEQ ID NO: 210099 - RNA, 63 nt, Human
cucaguuguccccugcauggggagauacacuaacccccagaaaugacugcuaagccucuugcc

SEQ ID NO: 210100 - RNA, 63 nt, Human
uagaggcaagaguucagugagggccaagggggacccccagaaaaagguauggagcuaacucau

SEQ ID NO: 210101 - RNA, 63 nt, Human
aguccuucaauucuacagcagaggaaauaaaaucccccagaagccaaagggcucaccuucaca

SEQ ID NO: 210102 - RNA, 63 nt, Human
cuuuauguugcuuuguucaguaccuuuugaauucccccagaagaguuguuuucaaaacaaaca

SEQ ID NO: 210103 - RNA, 63 nt, Human
cagcuccuuccugugggcugccacagacagcuacccccagaagggucaauguugggagugguu

SEQ ID NO: 210104 - RNA, 63 nt, Human
uucccuggugcccuucccuggaggucucucccucccccagagccccucaugccacagugguac

SEQ ID NO: 210105 - RNA, 63 nt, Human
cugggaagguccagcuaaaaguggcaacauuugcccccagaauugggggccugggaacacugg

SEQ ID NO: 210106 - RNA, 63 nt, Human
ccccuuggcauagggcccugccccgucggacugcccccagaaagccuccugcccccugccagu

SEQ ID NO: 210107 - RNA, 63 nt, Human
ugggcaaggcgcugagggaggaugcuuaggggacccccagaaacaggagucaggaaaaugagg

SEQ ID NO: 210108 - RNA, 63 nt, Human
acagauggccuucuuugucaucuucacucuccacccccagagaggagucagagccauaacuca

SEQ ID NO: 210109 - RNA, 63 nt, Human
auaauuaauaauaauaauaaacccaacacccaucccccagaagacuuuaucucuauacauugu

SEQ ID NO: 210110 - RNA, 63 nt, Human
ugauugggcaauugugggcccaugggguggaagcccccagaugacugagcaguucuacaaaag

SEQ ID NO: 210111 - RNA, 63 nt, Human
uauuuaaggacuggggcauagcaugggggcagucccccagaccucuucauucccccuccugug

SEQ ID NO: 210112 - RNA, 63 nt, Human
gguaagaaaugagccuagucaccaagaacuccacccccagaggaaguggaucugcuucuccag

SEQ ID NO: 210113 - RNA, 63 nt, Human
uauucucuugucuggcugcaccccuuuuucccgcccccagauugauaaguaaugaaagugcac

SEQ ID NO: 210114 - RNA, 63 nt, Human
ggaucucaggcagggugugcgucagcccuccaacccccagaggggcgccuguggggagggaac

SEQ ID NO: 210115 - RNA, 63 nt, Human
cccugaggcuccaccacccacccuuucauuucccccccagaagccuaaggccuaauagcugaa

SEQ ID NO: 210116 - RNA, 63 nt, Human
cccacagaguuaaaacuugggauuccccuggcccccccagaacacuuguauauuguuuguuug

SEQ ID NO: 210117 - RNA, 63 nt, Human
gaaucaagucggugaacugccccuggccugugucccccagagcagcccaggguccugccagag

SEQ ID NO: 210118 - RNA, 63 nt, Human
uccagagagaagcuagaagucccccuugaaugacccccagagccccucugagaagggcuggag

SEQ ID NO: 210119 - RNA, 63 nt, Human
uuggggcagagggacaggcuccucuggggaaaccccccagagcucuuuaccaaggaugaaaga

SEQ ID NO: 210120 - RNA, 63 nt, Human
uuauggcacgauuccuuuggauggcuucauuugcccccagacuguaugaaaacaucuccgaau

SEQ ID NO: 210121 - RNA, 63 nt, Human
ugauaaauugagggcacuuguacccucccugugcccccagaagguucuuggagagaagugcaa

SEQ ID NO: 210122 - RNA, 63 nt, Human
gccccccggagguggcagcagccccgagggacgcccccagaggaccgggaggcaccccacccu

SEQ ID NO: 210123 - RNA, 63 nt, Human
ugcuuucucuacucccugccucaaaccaccccucccccagaugguacuucaguuuggaucuau

SEQ ID NO: 210124 - RNA, 63 nt, Human
cauuuucauucuuguauuauaauuaauuuucuacccccagagauaaauguuuguuuauaucac

SEQ ID NO: 210125 - RNA, 63 nt, Human
ggcccauggucaguauugcaccuguguuaugaacccccagaugcugugcagggcaggggcggg

SEQ ID NO: 210126 - RNA, 63 nt, Human
caugcccaucagucucugcaguuucucuaccugcccccagagcugaggccaucugcaagcccc

SEQ ID NO: 210127 - RNA, 63 nt, Human
aaucagccagugccuugcucuuggacuucccagcccccagaacugugagaaauaaauuucugu

SEQ ID NO: 210128 - RNA, 63 nt, Human
cccugcaccagagccugcucuuagcucccggugcccccagaccccgcagcucugugcccggca

SEQ ID NO: 210129 - RNA, 63 nt, Human
ggugauggcuuugucccaucauagggggguguccccccagagacaaagcugcagagcacauuc

SEQ ID NO: 210130 - RNA, 63 nt, Human
uuguugcccuagagugggacccagcccucaccucccccagagcuaaccugggaggugcugaag

SEQ ID NO: 210131 - RNA, 63 nt, Human
ccuccauuccuacuaaggggcucugagcuucugcccccagaaucauuccaaccgacccacugc

SEQ ID NO: 210132 - RNA, 63 nt, Human
cgcgccugcggggaacguaggcgggagucgugccccccagaccgguguucgcaucgcuggcuc

SEQ ID NO: 210133 - RNA, 63 nt, Human
aucucccaaaucccaaaugccacuccaaguacccccccagauaccaugucaggauauuuuuag

SEQ ID NO: 210134 - RNA, 63 nt, Human
gagccaccaaaaguuaggggacuucaguccuagcccccagauggccgcccugaagcucucugg

SEQ ID NO: 210135 - RNA, 63 nt, Human
ccaauagacuggugagaggagaaaggagcuuaucccccagacccugcuuuauaccauucacau

SEQ ID NO: 210136 - RNA, 63 nt, Human
ucucuguguguccccucuugacacucacuguuucccccagagcuaacuauccugacguauggu

SEQ ID NO: 210137 - RNA, 63 nt, Human
gaccacuucucuaccauugucccccacccccaccccccagaauaacgcugacuguccccugaa

SEQ ID NO: 210138 - RNA, 63 nt, Human
gagaacuguaugucauggaguccucuugacguucccccagauacaaguaaagcacagguggau

SEQ ID NO: 210139 - RNA, 63 nt, Human
gaugcccagagacacagcccccacggacaaaaccccccagauaucaucuaccuagauuuaaua

SEQ ID NO: 210140 - RNA, 63 nt, Human
cagaacagguaguauuacaccaccggcccccuccccccagacucuuuuuuugagugacagcuu

SEQ ID NO: 210141 - RNA, 63 nt, Human
cagcucagacucuaagcucaacaagcccuugagcccccagaaggagaccgcuaacucucagca

SEQ ID NO: 210142 - RNA, 63 nt, Human
cugucugggucacuuuuuaagcuuguaaccgcccccccagacuuauaaucuuaaauguauuuu

SEQ ID NO: 210143 - RNA, 63 nt, Human
uucagcaguuugccacugugacugucuggcaagcccccagauggcguuauauuaauuggauua

SEQ ID NO: 210144 - RNA, 63 nt, Human
aauuagcaccccacccccauaccccuucuuccacccccagacuaaaggaagauacuuacucuc

SEQ ID NO: 210145 - RNA, 63 nt, Human
guuuugggggaaagauggaguuccuauccagagcccccagauuuccagaaucgagugagcuuc

SEQ ID NO: 210146 - RNA, 63 nt, Human
cugggaauccuagggggcuccaugacaccuucccccccagacccagacuugggccguugcucu

SEQ ID NO: 210147 - RNA, 63 nt, Human
augagcagagauggcagagggcagagcacauggcccccagaggcuuccagucucacugacaca

SEQ ID NO: 210148 - RNA, 63 nt, Human
gcugagaggagacccuagcaucuccauguccaucccccagaccuccccugagacgcugugcca

SEQ ID NO: 210149 - RNA, 63 nt, Human
gguuuauggauaggcuucaagagggucugugagcccccagaaauugugugugagacugaguau

SEQ ID NO: 210150 - RNA, 63 nt, Human
uggauauccaaaccaaaaagaagaaaacagaugcccccagaaggggccagugcgggcagccag

SEQ ID NO: 210151 - RNA, 63 nt, Human
gcugguccagagauacaacaggaugaauaccaucccccagacccgauccauucagucacgguu

SEQ ID NO: 210152 - RNA, 63 nt, Human
agcccguuagcuguaacuuggagcuccacucugcccccagaaaggggcugcccuggggugugc

SEQ ID NO: 210153 - RNA, 63 nt, Human
caccucggccagcaucuccuaugcucccugggucccccagaccucucuguguugugugcgugg

SEQ ID NO: 210154 - RNA, 63 nt, Human
ggaccaccccucacggggcauaaggucaguuuucccccagagcccgggucccugucccccaca

SEQ ID NO: 210155 - RNA, 63 nt, Human
aaauguaagaaagaaccacuuggccagaagugucccccagaugcuuuuuuuuuuuuuuuuuug

SEQ ID NO: 210156 - RNA, 63 nt, Human
caccagccauggucuaaggacauggaucgggugcccccagacgugugcacaggggacccucug

SEQ ID NO: 210157 - RNA, 63 nt, Human
cuguauggcugggggcuccucguaugcauggaacccccagaauaaauaugcucagccacccug

SEQ ID NO: 210158 - RNA, 63 nt, Human
ccccugcccugggauguccacagaugccuccaccccccagaaccuguccuugcacacuccccu

SEQ ID NO: 210159 - RNA, 63 nt, Human
ggcugcauuggauuguacaacuguuuugugaugcccccagacacugucauccugggccgagaa

SEQ ID NO: 210160 - RNA, 63 nt, Human
cugacagcucuguuuagaggaggcaacacugaucccccagaugcagggcugcaggggauucug

SEQ ID NO: 210161 - RNA, 63 nt, Human
uuccucccacugucugcccugaacccacugcugcccccagaaaaaggccgggugacaccgggg

SEQ ID NO: 210162 - RNA, 63 nt, Human
ccuugcuccccaucccccaagugccucaccagucccccagacugggugaagguacagcuggcu

SEQ ID NO: 210163 - RNA, 63 nt, Human
agccccaugcccagcccugccuuggucccccaacccccagagcuuggagucugggccccacac

SEQ ID NO: 210164 - RNA, 63 nt, Human
ggaccaaggucagggccccccugccccaccgcacccccagaauauaagcuaucaagaguauua

SEQ ID NO: 210165 - RNA, 63 nt, Human
cagcaacgagaguuggaagccuucccacagcuucccccagagcgaagaggcuguagucauguc

SEQ ID NO: 210166 - RNA, 63 nt, Human
gguacaacuggcauucaaaucuaggucagucugcccccagagccacuacccuuaccccucacu

SEQ ID NO: 210167 - RNA, 63 nt, Human
aggcugggaauggaggggcagagccaggaagaucccccagaaaagaaagcuacagaagaaacu

SEQ ID NO: 210168 - RNA, 63 nt, Human
agcugucgcugccuccauggcagcagccagggacccccagaacaagaagaccccgcaggaucc

SEQ ID NO: 210169 - RNA, 63 nt, Human
ucuucucuaccagcugccgcggcgggggcaaagcccccagagccucacuggccccggcgggau

SEQ ID NO: 210170 - RNA, 63 nt, Human
ccaggagcucggacugcugguccuggagagcugcccccagaagaagcuggagugcauagguca

SEQ ID NO: 210171 - RNA, 63 nt, Human
ccccaccgccauuggcauccccaccaagcuccucccccagaacccugaggccaagggggccac

SEQ ID NO: 210172 - RNA, 63 nt, Human
gccucugagcuggugggcaggauggcuggguggcccccagagaagcacagaccugagaugggg

SEQ ID NO: 210173 - RNA, 63 nt, Human
cagagaagccacccacguggggugugccaggcacccccagauacaaaugcagccacgcacaga

SEQ ID NO: 210174 - RNA, 63 nt, Human
ucaagagaaggcagagccccagcaccucugugccccccagagcucugugcagggaguuggcca

SEQ ID NO: 210175 - RNA, 63 nt, Human
aaaagcucagggcccugugccaggccaaagauccccccagacccccauucugacauccacaug

SEQ ID NO: 210176 - RNA, 63 nt, Human
ggagauuuguaagcuucugcugucugggcugaacccccagagguucggauugaauuggugugg

SEQ ID NO: 210177 - RNA, 63 nt, Human
uccggcuuccagggagaccuccccgcccagcagcccccagagacacaacaaccuaccuuccag

SEQ ID NO: 210178 - RNA, 63 nt, Human
ggagguccauccccagcaaauguuuuggagguccccccagagagcagagugggccauggcaga

SEQ ID NO: 210179 - RNA, 63 nt, Human
cuguccuaaaaauaggggccguuuucuuacacacccccagagagaggagggacugucacacug

SEQ ID NO: 210180 - RNA, 63 nt, Human
cccccggccucagccaccagcacccccauagggcccccagacaccacacacaugcgcgugcgc

SEQ ID NO: 210181 - RNA, 63 nt, Human
ccucuccugacuuguauuguggcagucugaacgcccccagaaaauugugccaaagaguuuaga

SEQ ID NO: 210182 - RNA, 63 nt, Human
caugaaucucguggggggucccugcccuugcgacccccagauaccuccacuugcuaccgaguc

SEQ ID NO: 210183 - RNA, 63 nt, Human
uuaucauuuucucccuaggacauucccuuguagcccccagaauugucuggcccaaauugaaua

SEQ ID NO: 210184 - RNA, 63 nt, Human
gauccagcaauuccugagccaagaggaacuugacccccagaguguggaaagaaagaccaucuc

SEQ ID NO: 210185 - RNA, 63 nt, Human
uagagccccaacacagauacccucaucccagggcccccagacacaccccuccgcuggacucac

SEQ ID NO: 210186 - RNA, 63 nt, Human
agagaagccccagagggagcuauuuccuugcaccccccagaggugaaugagguauucuauaag

SEQ ID NO: 210187 - RNA, 63 nt, Human
auggagcagcagcaggacagacccccacgaggccccccagagaggaggaagaucccacggagg

SEQ ID NO: 210188 - RNA, 63 nt, Human
cacugccugagggacaacagacaucagaacaaacccccagagagaaacagucaaaaucagggc

SEQ ID NO: 210189 - RNA, 63 nt, Human
acaggccaacccuggcacaggucaugucugcagcccccagaauguucuggacaugcaccacca

SEQ ID NO: 210190 - RNA, 63 nt, Human
gagaaaugcaaaggcucauauuuauaaaucccacccccagaguggggagggucaggugccaga

SEQ ID NO: 210191 - RNA, 63 nt, Human
ccgccuggcccaccaacccgcccaccuugacugcccccagaagugugucuugagaccuccugg

SEQ ID NO: 210192 - RNA, 63 nt, Human
gcuucuccccccaucccagggucccacccccaacccccagagguggcccuuguuuacagugag

SEQ ID NO: 210193 - RNA, 63 nt, Human
ggcagucaccacccagcccuuccuugggcgucucccccagagugcugucgggaccacaucugu

SEQ ID NO: 210194 - RNA, 63 nt, Human
ggaacuuaucgacaaugcaagcuccugggcccacccccagaccuccugaaccaaaagcuccag

SEQ ID NO: 210195 - RNA, 63 nt, Human
caugugagauggguuagggcaagucuuugccaucccccagauggcucugucuucuuguguaug

SEQ ID NO: 210196 - RNA, 63 nt, Human
uucuuuugccuuugcccgccccccuguccccagcccccagagcgcagggacacccccauccua

SEQ ID NO: 210197 - RNA, 63 nt, Human
ccaggccucugcccucugcccacccagcgucagcccccagaaaaaaggcaauaaagacgaguc

SEQ ID NO: 210198 - RNA, 63 nt, Human
uccugagucaaguccugccccaccgcccagcuccccccagaggccaccucgccccucccucug

SEQ ID NO: 210199 - RNA, 63 nt, Human
cucuguccucccgugggccaucccagccuccuucccccagaggagcgcagucacuccacuugg

SEQ ID NO: 210200 - RNA, 63 nt, Human
caagcgguucccucccgucucagcucagcggaucccccagaguggaggaggccucuccaugag

SEQ ID NO: 210201 - RNA, 63 nt, Human
ugaaaugaaggcuguggauucaaggcucccugccccccagaucauuuccccaauccuggcaaa

SEQ ID NO: 210202 - RNA, 63 nt, Human
auagaaaugacaauagagggccacggggaggcccccccagaagcaagauucaaaucucuugcu

SEQ ID NO: 210203 - RNA, 63 nt, Human
gcccauccugcaggcagaagaggcccugagaggcccccagaucacugucucugcugagcaggg

SEQ ID NO: 210204 - RNA, 63 nt, Human
agcaacaggaucugucacccaccucucucuucucccccagaucaagcgacgugccucagaggc

SEQ ID NO: 210205 - RNA, 63 nt, Human
uacacucagccuucccucucccaggcaggaggacccccagacccuguuccccugcagaccuca

SEQ ID NO: 210206 - RNA, 63 nt, Human
uuggugaaaggaaccaacacauuaacgauuuuucccccagaagccacugaauaauucuuuuug

SEQ ID NO: 210207 - RNA, 63 nt, Human
gacuucuagggaucucagccguggcugaggccacccccagaggagccccugguccacagaagc

SEQ ID NO: 210208 - RNA, 63 nt, Human
aaauacguauugauaauccaaucuugauuuuuccccccagaauauaaaucucagguaauaagg

SEQ ID NO: 210209 - RNA, 63 nt, Human
ggagacucugaagcaggaaugugacucccugggcccccagauggcgagcagcaccaccuccaa

SEQ ID NO: 210210 - RNA, 63 nt, Human
caagugucugagagauacugcaucagcccuagacccccagagccagucccgcccuuuacagag

SEQ ID NO: 210211 - RNA, 63 nt, Human
gaggggccgcuccaggccccacagagcaggagacccccagagaaagccggggcuggcaggagg

SEQ ID NO: 210212 - RNA, 63 nt, Human
caggccacgcccagcuuccuccccccgacuccccccccagagacacggucccaccauguuacc

SEQ ID NO: 210213 - RNA, 63 nt, Human
cacauuaaaccagggguuuuacuccacauccuucccccagacacuguucccaaccugucaucg

SEQ ID NO: 210214 - RNA, 63 nt, Human
cauggccaccuaagucuucauuuaauuuauugucccccagaaaagauuaagaugcuacuugaa

SEQ ID NO: 210215 - RNA, 63 nt, Human
ccuaaacuuggccauucccaggaggcuuggagacccccagauaaccauaacagggaagcaggg

SEQ ID NO: 210216 - RNA, 63 nt, Human
gugugaagaucacguuccuucccccgcaaugugcccccagacgcacgugggucuucagggggc

SEQ ID NO: 210217 - RNA, 63 nt, Human
acacacaaagcucuucaggcagcugauagauuucccccagagagcuauucaaggacuuccuaa

SEQ ID NO: 210218 - RNA, 63 nt, Human
cccgcuccccucuccccgcgggccgggggacgccccccagacucacacgggggcuuauuuauu

SEQ ID NO: 210219 - RNA, 63 nt, Human
guacccccaggaccagaagcucccccagcaaagcccccagagcccaggcucggccugccccca

SEQ ID NO: 210220 - RNA, 63 nt, Human
ucucaaccuuaauuuuucuuucuuuuuuuuuuucccccagaaagaaucucacucugucaccca

SEQ ID NO: 210221 - RNA, 63 nt, Human
gcuccgcaggugaggagcccauggggcgggcagcccccagaaagcgggcagcaggccccgaua

SEQ ID NO: 210222 - RNA, 63 nt, Human
agcagggcccuccucucucaggcuuggcccacucccccagacaccuggacacguggccacaaa

SEQ ID NO: 210223 - RNA, 63 nt, Human
ucugagaggaggcugcugggccuucggggugagcccccagagcuggaccugagcuauucucac

SEQ ID NO: 210224 - RNA, 63 nt, Human
agcugaguaguggggauccagagaggacccccgcccccagagacuugguuuuggcuccagccu

SEQ ID NO: 210225 - RNA, 61 nt, Human; identical to SEQ ID NO: 90279

SEQ ID NO: 210226 - RNA, 63 nt, Human
uagaaugccacagucccccaacccuccacagagcccccagacccaccagaacuuccacagacg

SEQ ID NO: 210227 - RNA, 63 nt, Human
gaaggugcccaccugggccaccagaaggugacacccccagaaucccuccccagagacugcacc

SEQ ID NO: 210228 - RNA, 63 nt, Human
ugagccggcuccucuccccaucugccuucuccucccccagaaaggaccucaaccacacuccac

SEQ ID NO: 210229 - RNA, 63 nt, Human
ccacucaagcaauagggccccgccauaggaagacccccagagagagggucagcaggggggccc

SEQ ID NO: 210230 - RNA, 63 nt, Human
ucagcuguguuguguggcaguuuauuaaacugucccccagaucgacacgcagcuagccuccug

SEQ ID NO: 210231 - RNA, 63 nt, Human
guucgagacuccaucuugguaguucugugccuccccccagaccccgccccuggggaaauagcc

SEQ ID NO: 210232 - RNA, 58 nt, Human; identical to SEQ ID NO: 90286

SEQ ID NO: 210233 - RNA, 63 nt, Human
aaacuuugggguccagcugccuucagccccccucccccagacuaacagacccuuggaggcagg

SEQ ID NO: 210234 - RNA, 63 nt, Human
gaggcccuuaaccuuucucucagugcucgccuucccccagaaucccuaggcaaccacugagua

SEQ ID NO: 210235 - RNA, 63 nt, Human
uuugugcgagaugcagccucagaaggaacaaggcccccagagggaggucaccugggggcagcu

SEQ ID NO: 210236 - RNA, 63 nt, Human
cugcuggugcccggggaggagcagcuauccuugcccccagaggagcagucauugcccucugcg

SEQ ID NO: 210237 - RNA, 63 nt, Human
aagccaugggagggguguccuccucagaccaugcccccagaugauuuuuuuaaauaaagaaac

SEQ ID NO: 210238 - RNA, 63 nt, Human
cugagcacagaccagcagcgaccucccuuccagcccccagaaagcucggucacuugaguguuu

SEQ ID NO: 210239 - RNA, 63 nt, Human
cuccuccacucccuuuuuguaacucccuuacagcccccagacccuucuugaaacgagagccag

SEQ ID NO: 210240 - RNA, 63 nt, Human
agggacaggggcauugucaucucaaaggcccaacccccagaggccacaccaguccucccaggg

SEQ ID NO: 210241 - RNA, 63 nt, Human
accugggagacgccccgagguguuugugcuucacccccagacgucagccucgaaggcaggacu

SEQ ID NO: 210242 - RNA, 63 nt, Human
aggagugaggcuugguccaauacauggcucugccccccagaacuuaaggcucucacugccccu

SEQ ID NO: 210243 - RNA, 63 nt, Human
ccuggcuggggggauggagaggggcuggcuauccccccagagccccucuucagcauccgcccc

SEQ ID NO: 210244 - RNA, 63 nt, Human
uaccagcacuccgcggcggggccgccgccagcucccccagacccccuccaccccccggccaca

SEQ ID NO: 210245 - RNA, 63 nt, Human
ggcuggacaucacugcaguccagugcaaagccgcccccagagcccagguguccccccaaccua

SEQ ID NO: 210246 - RNA, 63 nt, Human
cccagguggcuauuuugagaacuccagcuggugcccccagacagcugcucagagccaaggggg

SEQ ID NO: 210247 - RNA, 63 nt, Human
cagaagucgcaggcagccucucagaaaguuucacccccagaggacgaagaggucaagaaccuu

SEQ ID NO: 210248 - RNA, 63 nt, Human
aaccccaguacugacagccuccuuaaaguuucacccccagagggagccgagacucggaaagug

SEQ ID NO: 210249 - RNA, 63 nt, Human
gccccuccggccugggcugcccacaaggcuugucccccagaggcccuggcuccuggucgggaa

SEQ ID NO: 210250 - RNA, 63 nt, Human
gugacaaaccaggcuguucacagcuuccucagccccccagaaggggagugucaggaagagaca

SEQ ID NO: 210251 - RNA, 63 nt, Human
ugaggaccuccuacccccuuggcccccuccccucccccagaccuccaccuccuccagaccccc

SEQ ID NO: 210252 - RNA, 63 nt, Human
gcggaacacccugccccagggccggacuuccagcccccagagcccucucccugucacucccug

SEQ ID NO: 210253 - RNA, 63 nt, Human
cugcaccugcucuuggacccuggucuccuuuuccccccagacucggccuccucuccugggacu

SEQ ID NO: 210254 - RNA, 63 nt, Human
agggacugaagggggaccccaaaacuggcucaccccccagaacacccuccucccagggagggu

SEQ ID NO: 210255 - RNA, 63 nt, Human
gggcuccgggucacugcuguauauaacuccccucccccagaaaaauaaaugucacugccaacg

SEQ ID NO: 210256 - RNA, 52 nt, Human; identical to SEQ ID NO: 90310

SEQ ID NO: 210257 - RNA, 63 nt, Human
gcccuggacugccccuuccucccccaucgcccgcccccagaaccccugaugcugguuaggaac

SEQ ID NO: 210258 - RNA, 63 nt, Human
gaguugagaagguguggaagauagggacagcugcccccagaacucccuucaagggaggacuuc

SEQ ID NO: 210259 - RNA, 63 nt, Human
acagcuuacugaaaaagccagaggccaugacugcccccagaaacuugccccgaguuucucugg

SEQ ID NO: 210260 - RNA, 63 nt, Human
uuuaaugucugcaguagacugaauguuugugugcccccagaauucuaauguugaaaucucauu

SEQ ID NO: 210261 - RNA, 63 nt, Human
gagugggagucagguggagccaccugcugggcucccccagaacuuugcacacaucuugcuaug

SEQ ID NO: 210262 - RNA, 63 nt, Human
cuugcuugccugcugcccugauggccugagcaucccccagauccaagccugggggaucccggg

SEQ ID NO: 210263 - RNA, 63 nt, Human
cugagcgaguuuguagugacucacugcacagcacccccagacuagcaugugguucuauauuug

SEQ ID NO: 210264 - RNA, 63 nt, Human
cccucccaccacccucgccgcaggcagcugcagcccccagaggggaccacaagcccaaaaagg

SEQ ID NO: 210265 - RNA, 63 nt, Human
augccgaacgagaaaacuguccauuuucugagacccccagaaaggaaacugacccucagcagc

SEQ ID NO: 210266 - RNA, 63 nt, Human
caaccugggcuuccacagucuggagcugcccuacccccagauucucugagcacuuucccccau

SEQ ID NO: 210267 - RNA, 63 nt, Human
uucuucaagcugugauccagaaagauuuuugugcccccagaugccucuugauaggagaggcaa

SEQ ID NO: 210268 - RNA, 63 nt, Human
gagcugccgggccuccucgaggccccuaagccacccccagaggucccaucugaagcuggagua

SEQ ID NO: 210269 - RNA, 63 nt, Human
guagcaauaauuuggguccagggucaccuauugcccccagaggccucugaaccccaggcuggg

SEQ ID NO: 210270 - RNA, 63 nt, Human
auuuuuucguaucaaaaagucaccacuaacccucccccagaagcucacaaaggaaaacggaga

SEQ ID NO: 210271 - RNA, 63 nt, Human
gaagccuccugcugagugguccacauucugcugcccccagaccccauccagccaggggugggg

SEQ ID NO: 210272 - RNA, 63 nt, Human
ggagacaaagggguagagggucugucuugggcccccccagacucuagccugagcagugcagcc

SEQ ID NO: 210273 - RNA, 63 nt, Human
ccaaagccugcacaacccaaccucgcuuagggacccccagagaugcuggaaucgcuaggaggg

SEQ ID NO: 210274 - RNA, 63 nt, Human
cucaggcugggcggcuccaguccauagacguuccccccagaaaccagggcuucucucuccuga

SEQ ID NO: 210275 - RNA, 63 nt, Human
cagaugauggcugccugugggaccccagcuacucccccagacccaaguucugcagaacuaacc

SEQ ID NO: 210276 - RNA, 61 nt, Human
ccuguaucccuccgugaauaagcaucugguggacccccagauugcacacauagggcagaug

SEQ ID NO: 210277 - RNA, 63 nt, Human
augggcacuacucuucaugugcggugacaccagcccccagaugccuugaauuaaguguccuca

SEQ ID NO: 210278 - RNA, 63 nt, Human
gacucccagacugcaggggagcacuuggggcagcccccagaaggaccacugcuggaucccagg

SEQ ID NO: 210279 - RNA, 63 nt, Human
gggccaagcagaggagcccucgggucagcccugcccccagagcugccccccacgggcauccua

SEQ ID NO: 210280 - RNA, 63 nt, Human
ugaggccggcucugacugggcagcucagccccucccccagagcccagggucuugcacaccccu

SEQ ID NO: 210281 - RNA, 63 nt, Human
uucagccccuugagcagcccauggcuuagcagacccccagauguaggucaguggccuuaccug

SEQ ID NO: 210282 - RNA, 63 nt, Human
gggcaggggcagugggggcucgggcaggagcaccccccagacuccccgugcccgcagcccugc

SEQ ID NO: 210283 - RNA, 63 nt, Human
ugccagccugagugggcaaggaagcagguggaucccccagaaggaaccgcagcucgcgaggca

SEQ ID NO: 210284 - RNA, 63 nt, Human
aacaaacaaacaaaaacuaaacacacacacaaacccccagaaacccacaauauguacacgcua

SEQ ID NO: 210285 - RNA, 63 nt, Human
auaaaaauugaugucagugcaggcccaggcccgcccccagauacacuaguuucuaggucuggg

SEQ ID NO: 210286 - RNA, 63 nt, Human
uucgauucugccucuguagcucaaggggggcagcccccagaguccugugcauucugccaaggc

SEQ ID NO: 210287 - RNA, 63 nt, Human
gguccuucccucucaugacuugcagggccguugcccccagacuuccuccuuuccguguuucug

SEQ ID NO: 210288 - RNA, 63 nt, Human
ggagccaacugagaugauggggugggggugcuccccccagacuuucucaguccugcagcggcc

SEQ ID NO: 210289 - RNA, 63 nt, Human
ggcaggcugaggcuguggaggggacaagcacgccccccagaacgcagucuccacugagggcac

SEQ ID NO: 210290 - RNA, 50 nt, Human; identical to SEQ ID NO: 90344

SEQ ID NO: 210291 - RNA, 63 nt, Human
cuaugugucugucuguguguccaucccgccgaccccccagacuaaccuccaggcauggacuga

SEQ ID NO: 210292 - RNA, 63 nt, Human
uugcgguauucuuugcgguauucuuguccccgucccccagaaggcucgccucuccccguggac

SEQ ID NO: 210293 - RNA, 63 nt, Human
ugggugggggccauauccuagaccucucuguaucccccagacuaucuguaacagugccaggca

SEQ ID NO: 210294 - RNA, 63 nt, Human
uggugggcuguuuuguuuuuuuuuuuuccucuucccccagaugucuugacgggaucacugggg

SEQ ID NO: 210295 - RNA, 63 nt, Human
cuuacuuuccugaaaauaucggggagguuuucucccccagacgccugauauugaaguaaaaaa

SEQ ID NO: 210296 - RNA, 63 nt, Human
ugacacagaauaugauucccucacugccccugccccccagaaaggagagugaaacucuuauuu

SEQ ID NO: 210297 - RNA, 63 nt, Human
aagugcccuccagccucagagcuagccacaaagcccccagagcugaauucauugaguauuugu

SEQ ID NO: 210298 - RNA, 63 nt, Human
cucucaggcagaugccgaggccaaguggacugacccccagauuuccuucccuuggaugcuuuc

SEQ ID NO: 210299 - RNA, 63 nt, Human
caaagacuucauccggcaccuucuggagcgagacccccagaagagguucaccugccaacaggc

SEQ ID NO: 210300 - RNA, 63 nt, Human
aaaugaccuaaccaaaaacauucaaggguucugcccccagauuucgggagauccacguuccau

SEQ ID NO: 210301 - RNA, 63 nt, Human
ucaaaugucaaccccaccgaggcacccccccgucccccagaaucuuggcuguuuacaaaucac

SEQ ID NO: 210302 - RNA, 63 nt, Human
gacugggcccccacgucccugacuaggccggcucccccagacucagagggcagcaggagcagc

SEQ ID NO: 210303 - RNA, 63 nt, Human
acaugugccagggcaaugaugaaugagaaucuacccccagauccaagcagccugagcaacucu

SEQ ID NO: 210304 - RNA, 64 nt, Human
gguuaauauacauauauaaauauauaaauacaaacacacacacacacuuuuuuuguacuguagc

SEQ ID NO: 210305 - RNA, 64 nt, Human
uuaauauacauauauaaauauauaaauacaaacacacacacacacuuuuuuuguacuguagcaa

SEQ ID NO: 210306 - RNA, 64 nt, Human
aauauacauauauaaauauauaaauacaaacacacacacacacuuuuuuuguacuguagcaauu

SEQ ID NO: 210307 - RNA, 64 nt, Human
auaaaccaguguuuucuacuuuggcaacucacgucacacacauauuacacacaugugcgcauua

SEQ ID NO: 210308 - RNA, 64 nt, Human
acgucacacacauauuacacacaugugcgcauuacacacacacaauacacauacaugcauauag

SEQ ID NO: 210309 - RNA, 64 nt, Human
gucacacacauauuacacacaugugcgcauuacacacacacaauacacauacaugcauauagac

SEQ ID NO: 210310 - RNA, 64 nt, Human
agagacaugcaacaacaacacacacgcacacacgcacacacacacacguacacacacauacaaa

SEQ ID NO: 210311 - RNA, 64 nt, Human
agacaugcaacaacaacacacacgcacacacgcacacacacacacguacacacacauacaaaau

SEQ ID NO: 210312 - RNA, 64 nt, Human
acaugcaacaacaacacacacgcacacacgcacacacacacacguacacacacauacaaaaucc

SEQ ID NO: 210313 - RNA, 64 nt, Human
aacacacacgcacacacgcacacacacacacguacacacacauacaaaaucccucugcaguuuu

SEQ ID NO: 210314 - RNA, 64 nt, Human
ugcaagaaugugggaguaugucugccgguuucaacacacacagacaaacacagccacacgcgca

SEQ ID NO: 210315 - RNA, 64 nt, Human
auguggccuaacaaaaggaaaaaauguuuuuaaacacacacacacacacacacacacacacaca

SEQ ID NO: 210316 - RNA, 64 nt, Human
guggccuaacaaaaggaaaaaauguuuuuaaacacacacacacacacacacacacacacacaca

SEQ ID NO: 210317 - RNA, 64 nt, Human
ggccuaacaaaaggaaaaaauguuuuuaaacacacacacacacacacacacacacacacacaua

SEQ ID NO: 210318 - RNA, 64 nt, Human
ccuaacaaaaggaaaaaauguuuuuaaacacacacacacacacacacacacacacacacauaca

SEQ ID NO: 210319 - RNA, 64 nt, Human
uaacaaaaggaaaaaauguuuuuaaacacacacacacacacacacacacacacacacauacaca

SEQ ID NO: 210320 - RNA, 64 nt, Human
acaaaaggaaaaaauguuuuuaaacacacacacacacacacacacacacacacacauacacaga

SEQ ID NO: 210321 - RNA, 64 nt, Human
aaaaggaaaaaauguuuuuaaacacacacacacacacacacacacacacacacauacacagaca

SEQ ID NO: 210322 - RNA, 64 nt, Human
aaggaaaaaauguuuuuaaacacacacacacacacacacacacacacacacauacacagacaaa

SEQ ID NO: 210323 - RNA, 64 nt, Human
ggaaaaaauguuuuuaaacacacacacacacacacacacacacacacacauacacagacaaaaa

SEQ ID NO: 210324 - RNA, 64 nt, Human
aaaaaauguuuuuaaacacacacacacacacacacacacacacacacauacacagacaaaaaca

SEQ ID NO: 210325 - RNA, 64 nt, Human
aaaauguuuuuaaacacacacacacacacacacacacacacacacauacacagacaaaaacaca

SEQ ID NO: 210326 - RNA, 64 nt, Human
aauguuuuuaaacacacacacacacacacacacacacacacacauacacagacaaaaacacaaa

SEQ ID NO: 210327 - RNA, 64 nt, Human
uguuuuuaaacacacacacacacacacacacacacacacacauacacagacaaaaacacaaaaa

SEQ ID NO: 210328 - RNA, 64 nt, Human
ccugcaaggggccagcagggacguggccccacgccacacacaaccucuccacaugccucagcgc

SEQ ID NO: 210329 - RNA, 64 nt, Human
uggugucauccugaaaaacaaaacccaguguuugcacacacacaaaaucuugaccccguuaucu

SEQ ID NO: 210330 - RNA, 64 nt, Human
gugucauccugaaaaacaaaacccaguguuugcacacacacaaaaucuugaccccguuaucuau

SEQ ID NO: 210331 - RNA, 64 nt, Human
uuucuguucacccccaaaagaaaacuuacacacccacacacauacacauuucaugcuuggagug

SEQ ID NO: 210332 - RNA, 64 nt, Human
cacagacccacggagcucucuguguuuggccucucacacacacacaggcccauagacagauggg

SEQ ID NO: 210333 - RNA, 64 nt, Human
cagacccacggagcucucuguguuuggccucucacacacacacaggcccauagacagaugggca

SEQ ID NO: 210334 - RNA, 64 nt, Human
gacccacggagcucucuguguuuggccucucacacacacacaggcccauagacagaugggcaga

SEQ ID NO: 210335 - RNA, 64 nt, Human
gcagggacuaccuuucuuauaaacccagggggaccacacacacacacacacacacacacacaca

SEQ ID NO: 210336 - RNA, 64 nt, Human
agggacuaccuuucuuauaaacccagggggaccacacacacacacacacacacacacacacaca

SEQ ID NO: 210337 - RNA, 64 nt, Human
ggacuaccuuucuuauaaacccagggggaccacacacacacacacacacacacacacacacaca

SEQ ID NO: 210338 - RNA, 64 nt, Human
acuaccuuucuuauaaacccagggggaccacacacacacacacacacacacacacacacacaca

SEQ ID NO: 210339 - RNA, 64 nt, Human
uaccuuucuuauaaacccagggggaccacacacacacacacacacacacacacacacacacaca

SEQ ID NO: 210340 - RNA, 64 nt, Human
ccuuucuuauaaacccagggggaccacacacacacacacacacacacacacacacacacacaca

SEQ ID NO: 210341 - RNA, 64 nt, Human
uuucuuauaaacccagggggaccacacacacacacacacacacacacacacacacacacacaca

SEQ ID NO: 210342 - RNA, 64 nt, Human
ucuuauaaacccagggggaccacacacacacacacacacacacacacacacacacacacacaca

SEQ ID NO: 210343 - RNA, 64 nt, Human
uuauaaacccagggggaccacacacacacacacacacacacacacacacacacacacacacaca

SEQ ID NO: 210344 - RNA, 64 nt, Human
auaaacccagggggaccacacacacacacacacacacacacacacacacacacacacacacaca

SEQ ID NO: 210345 - RNA, 64 nt, Human
aaacccagggggaccacacacacacacacacacacacacacacacacacacacacacacacaca

SEQ ID NO: 210346 - RNA, 64 nt, Human
acccagggggaccacacacacacacacacacacacacacacacacacacacacacacacacacu

SEQ ID NO: 210347 - RNA, 64 nt, Human
ccagggggaccacacacacacacacacacacacacacacacacacacacacacacacacacucu

SEQ ID NO: 210348 - RNA, 64 nt, Human
agggggaccacacacacacacacacacacacacacacacacacacacacacacacacacucuug

SEQ ID NO: 210349 - RNA, 64 nt, Human
ggggaccacacacacacacacacacacacacacacacacacacacacacacacacacucuugau

SEQ ID NO: 210350 - RNA, 64 nt, Human
ggaccacacacacacacacacacacacacacacacacacacacacacacacacacucuugaucc

SEQ ID NO: 210351 - RNA, 64 nt, Human
accacacacacacacacacacacacacacacacacacacacacacacacacacucuugaucccu

SEQ ID NO: 210352 - RNA, 64 nt, Human
cacacacacacacacacacacacacacacacacacacacacacacacacacucuugaucccuug

SEQ ID NO: 210353 - RNA, 64 nt, Human
cacacacacacacacacacacacacacacacacacacacacacacacacucuugaucccuugcu

SEQ ID NO: 210354 - RNA, 64 nt, Human
cacacacacacacacacacacacacacacacacacacacacacacacucuugaucccuugcuuc

SEQ ID NO: 210355 - RNA, 64 nt, Human
cacacacacacacacacacacacacacacacacacacacacacacucuugaucccuugcuuccc

SEQ ID NO: 210356 - RNA, 64 nt, Human
cacacacacacacacacacacacacacacacacacacacacacucuugaucccuugcuucccuc

SEQ ID NO: 210357 - RNA, 64 nt, Human
cucccuaguagcugggauuacaggcgcacaccaccacacacagcuaauuuuuuuuuuuuuuuuu

SEQ ID NO: 210358 - RNA, 64 nt, Human
cagggauggucucuguuccccagcccaccuggcucacacacagccucauggguagggucagcaa

SEQ ID NO: 210359 - RNA, 64 nt, Human
cauguacauacaugcacauacucaaacaugcguacacacacacacauuuacacacgcaggacuc

SEQ ID NO: 210360 - RNA, 64 nt, Human
uguacauacaugcacauacucaaacaugcguacacacacacacauuuacacacgcaggacucug

SEQ ID NO: 210361 - RNA, 64 nt, Human
uacauacaugcacauacucaaacaugcguacacacacacacauuuacacacgcaggacucugga

SEQ ID NO: 210362 - RNA, 64 nt, Human
auauagaaauauauacgaacaaaacacacgcgcgcacacacacacauacacgaaagagagagaa

SEQ ID NO: 210363 - RNA, 64 nt, Human
auagaaauauauacgaacaaaacacacgcgcgcacacacacacauacacgaaagagagagaaac

SEQ ID NO: 210364 - RNA, 64 nt, Human
agaaauauauacgaacaaaacacacgcgcgcacacacacacauacacgaaagagagagaaacaa

SEQ ID NO: 210365 - RNA, 64 nt, Human
agguuuuauuaaaagcuacauuuuauaacacuggcacacacaaaaaaguaguuuuaagcuuguu

SEQ ID NO: 210366 - RNA, 64 nt, Human
caacuuguuucuuaguucauauaaucucgggauacacacacacacacacauauauauacacaca

SEQ ID NO: 210367 - RNA, 64 nt, Human
acuuguuucuuaguucauauaaucucgggauacacacacacacacacauauauauacacacaca

SEQ ID NO: 210368 - RNA, 64 nt, Human
uuguuucuuaguucauauaaucucgggauacacacacacacacacauauauauacacacacaua

SEQ ID NO: 210369 - RNA, 64 nt, Human
guuucuuaguucauauaaucucgggauacacacacacacacacauauauauacacacacauacg

SEQ ID NO: 210370 - RNA, 64 nt, Human
uucuuaguucauauaaucucgggauacacacacacacacacauauauauacacacacauacgua

SEQ ID NO: 210371 - RNA, 64 nt, Human
ucucgggauacacacacacacacacauauauauacacacacauacguauacacacacauacaua

SEQ ID NO: 210372 - RNA, 64 nt, Human
cacacacacauauauauacacacacauacguauacacacacauacauauauauaaauauaccug

SEQ ID NO: 210373 - RNA, 64 nt, Human
ccuucccacggcgugucccacggccagacacaugcacacacaucacacccucaaacacccagcu

SEQ ID NO: 210374 - RNA, 64 nt, Human
cacacacaucacacccucaaacacccagcucagccacacacaacuacccuccaaaccaccacag

SEQ ID NO: 210375 - RNA, 64 nt, Human
gaaucaugcagggaagggucugccccugcccuggcacacacaggcacccauucccucccccugc

SEQ ID NO: 210376 - RNA, 64 nt, Human
cccugcugacauguguaugcguaugcauacacaccacacacacacacaugcacaagucaugugc

SEQ ID NO: 210377 - RNA, 64 nt, Human
cugcugacauguguaugcguaugcauacacaccacacacacacacaugcacaagucaugugcga

SEQ ID NO: 210378 - RNA, 64 nt, Human
gcugacauguguaugcguaugcauacacaccacacacacacacaugcacaagucaugugcgaac

SEQ ID NO: 210379 - RNA, 64 nt, Human
ugacauguguaugcguaugcauacacaccacacacacacacaugcacaagucaugugcgaacag

SEQ ID NO: 210380 - RNA, 64 nt, Human
uuucuggauuuauacguaaucacuccugccccaacacacacacacacacacacacacacacaca

SEQ ID NO: 210381 - RNA, 64 nt, Human
ucuggauuuauacguaaucacuccugccccaacacacacacacacacacacacacacacacaca

SEQ ID NO: 210382 - RNA, 64 nt, Human
uggauuuauacguaaucacuccugccccaacacacacacacacacacacacacacacacacaca

SEQ ID NO: 210383 - RNA, 64 nt, Human
gauuuauacguaaucacuccugccccaacacacacacacacacacacacacacacacacacaca

SEQ ID NO: 210384 - RNA, 64 nt, Human
uuuauacguaaucacuccugccccaacacacacacacacacacacacacacacacacacacaug

SEQ ID NO: 210385 - RNA, 64 nt, Human
uauacguaaucacuccugccccaacacacacacacacacacacacacacacacacacacaugca

SEQ ID NO: 210386 - RNA, 64 nt, Human
uacguaaucacuccugccccaacacacacacacacacacacacacacacacacacacaugcacg

SEQ ID NO: 210387 - RNA, 64 nt, Human
cguaaucacuccugccccaacacacacacacacacacacacacacacacacacacaugcacgca

SEQ ID NO: 210388 - RNA, 64 nt, Human
uaaucacuccugccccaacacacacacacacacacacacacacacacacacacaugcacgcaca

SEQ ID NO: 210389 - RNA, 64 nt, Human
aucacuccugccccaacacacacacacacacacacacacacacacacacacaugcacgcacaca

SEQ ID NO: 210390 - RNA, 64 nt, Human
cacuccugccccaacacacacacacacacacacacacacacacacacacaugcacgcacacaug

SEQ ID NO: 210391 - RNA, 64 nt, Human
cuccugccccaacacacacacacacacacacacacacacacacacacaugcacgcacacaugau

SEQ ID NO: 210392 - RNA, 64 nt, Human
ccugccccaacacacacacacacacacacacacacacacacacacaugcacgcacacaugauuu

SEQ ID NO: 210393 - RNA, 64 nt, Human
ugccccaacacacacacacacacacacacacacacacacacacaugcacgcacacaugauuuug

SEQ ID NO: 210394 - RNA, 64 nt, Human
ccccaacacacacacacacacacacacacacacacacacacaugcacgcacacaugauuuugau

SEQ ID NO: 210395 - RNA, 64 nt, Human
agaggaggggggucaagugauacuuagauauuggcacacacaaggaacaacuguuggcaggcag

SEQ ID NO: 210396 - RNA, 64 nt, Human
aaaauggauuucauauaauuucggagcacggaagcacacacaagcucuuuaugaauucugcucu

SEQ ID NO: 210397 - RNA, 64 nt, Human
ucuccacacuucagacaacugucugcacucacggcacacacacuuuguaucaugcaggccacac

SEQ ID NO: 210398 - RNA, 64 nt, Human
acacaacccaaacauuugcuacuaacauaggaaacacacacauacagacacccccacucagaca

SEQ ID NO: 210399 - RNA, 64 nt, Human
agaagauuaagacagagaaacagacagaaagagacacacacacagccaggaguggguagauuuc

SEQ ID NO: 210400 - RNA, 64 nt, Human
aagauuaagacagagaaacagacagaaagagacacacacacagccaggaguggguagauuucag

SEQ ID NO: 210401 - RNA, 64 nt, Human
uggacuccuccuccauacuguaugugcaugcauucacacacacauauguacaugcacauagaug

SEQ ID NO: 210402 - RNA, 64 nt, Human
gacuccuccuccauacuguaugugcaugcauucacacacacauauguacaugcacauagaugag

SEQ ID NO: 210403 - RNA, 64 nt, Human
guauccuaaaaauacguacuauaaagcuuuuguucacacacacucugaagaauccuguaagccc

SEQ ID NO: 210404 - RNA, 64 nt, Human
accuugagaguaaagugcugcccucugcccccaacacacacacauaucaauuccuggauuccuu

SEQ ID NO: 210405 - RNA, 64 nt, Human
cuugagaguaaagugcugcccucugcccccaacacacacacauaucaauuccuggauuccuuag

SEQ ID NO: 210406 - RNA, 64 nt, Human
ucaucuggagucccuccucccccacgccuccauccacacacagcagcuccaaccuggaggcugg

SEQ ID NO: 210407 - RNA, 64 nt, Human
ccccucuggccacugcugcagacaccugccuuaacacacacaccucuaggacuccacaguuuug

SEQ ID NO: 210408 - RNA, 64 nt, Human
uguguauacauauguaugugugaguguauguauacacacacacacacacacacacacacacuuu

SEQ ID NO: 210409 - RNA, 64 nt, Human
uguauacauauguaugugugaguguauguauacacacacacacacacacacacacacacuuuug

SEQ ID NO: 210410 - RNA, 64 nt, Human
uauacauauguaugugugaguguauguauacacacacacacacacacacacacacacuuuugca

SEQ ID NO: 210411 - RNA, 64 nt, Human
uacauauguaugugugaguguauguauacacacacacacacacacacacacacacuuuugcaag

SEQ ID NO: 210412 - RNA, 64 nt, Human
cauauguaugugugaguguauguauacacacacacacacacacacacacacacuuuugcaagag

SEQ ID NO: 210413 - RNA, 64 nt, Human
uauguaugugugaguguauguauacacacacacacacacacacacacacacuuuugcaagagug

SEQ ID NO: 210414 - RNA, 64 nt, Human
uguaugugugaguguauguauacacacacacacacacacacacacacacuuuugcaagagugau

SEQ ID NO: 210415 - RNA, 64 nt, Human
uaugugugaguguauguauacacacacacacacacacacacacacacuuuugcaagagugaugg

SEQ ID NO: 210416 - RNA, 64 nt, Human
ugugugaguguauguauacacacacacacacacacacacacacacuuuugcaagagugauggga

SEQ ID NO: 210417 - RNA, 64 nt, Human
ugugaguguauguauacacacacacacacacacacacacacacuuuugcaagagugaugggaaa

SEQ ID NO: 210418 - RNA, 64 nt, Human
ucucauucuucuaaaacuacugccuuucaaagugcacacacacgcguccacauacacugcauuc

SEQ ID NO: 210419 - RNA, 64 nt, Human
gcaaaggagagaagggagaaaaaaaaaaaaaaaccacacacacccauacacacauaccagaaaa

SEQ ID NO: 210420 - RNA, 64 nt, Human
uuuuaguuuacaaccugcguuuuguuauuugaaacacacacacuuauauauaaacacauguaau

SEQ ID NO: 210421 - RNA, 64 nt, Human
agaaacagcuacugcgugcgugcgcgcacgcauacacacacacacacacacacuggcacaggga

SEQ ID NO: 210422 - RNA, 64 nt, Human
aaacagcuacugcgugcgugcgcgcacgcauacacacacacacacacacacuggcacagggagg

SEQ ID NO: 210423 - RNA, 64 nt, Human
acagcuacugcgugcgugcgcgcacgcauacacacacacacacacacacuggcacagggaggcu

SEQ ID NO: 210424 - RNA, 64 nt, Human
agcuacugcgugcgugcgcgcacgcauacacacacacacacacacacuggcacagggaggcuac

SEQ ID NO: 210425 - RNA, 64 nt, Human
cuacugcgugcgugcgcgcacgcauacacacacacacacacacacuggcacagggaggcuacaa

SEQ ID NO: 210426 - RNA, 64 nt, Human
acugcgugcgugcgcgcacgcauacacacacacacacacacacuggcacagggaggcuacaacu

SEQ ID NO: 210427 - RNA, 64 nt, Human
aguacagacguguaaauccuuccaccccgacccgcacacacacccacacugcugcccuggcggg

SEQ ID NO: 210428 - RNA, 64 nt, Human
cccagguguacgcacgcgcgcgcgcgcgcacagacacacacacacacacacacacacacacaca

SEQ ID NO: 210429 - RNA, 64 nt, Human
cagguguacgcacgcgcgcgcgcgcgcacagacacacacacacacacacacacacacacacaca

SEQ ID NO: 210430 - RNA, 64 nt, Human
gguguacgcacgcgcgcgcgcgcgcacagacacacacacacacacacacacacacacacacaca

SEQ ID NO: 210431 - RNA, 64 nt, Human
uguacgcacgcgcgcgcgcgcgcacagacacacacacacacacacacacacacacacacacaca

SEQ ID NO: 210432 - RNA, 64 nt, Human
uacgcacgcgcgcgcgcgcgcacagacacacacacacacacacacacacacacacacacacagu

SEQ ID NO: 210433 - RNA, 64 nt, Human
cgcacgcgcgcgcgcgcgcacagacacacacacacacacacacacacacacacacacacaguaa

SEQ ID NO: 210434 - RNA, 64 nt, Human
cacgcgcgcgcgcgcgcacagacacacacacacacacacacacacacacacacacacaguaacc

SEQ ID NO: 210435 - RNA, 64 nt, Human
cgcgcgcgcgcgcgcacagacacacacacacacacacacacacacacacacacacaguaaccac

SEQ ID NO: 210436 - RNA, 64 nt, Human
cgcgcgcgcgcgcacagacacacacacacacacacacacacacacacacacacaguaaccacgg

SEQ ID NO: 210437 - RNA, 64 nt, Human
cgcgcgcgcgcacagacacacacacacacacacacacacacacacacacacaguaaccacgggu

SEQ ID NO: 210438 - RNA, 64 nt, Human
cgcgcgcgcacagacacacacacacacacacacacacacacacacacacaguaaccacggguag

SEQ ID NO: 210439 - RNA, 64 nt, Human
cgcgcgcacagacacacacacacacacacacacacacacacacacacaguaaccacggguaggc

SEQ ID NO: 210440 - RNA, 64 nt, Human
cgcgcacagacacacacacacacacacacacacacacacacacacaguaaccacggguaggcac

SEQ ID NO: 210441 - RNA, 64 nt, Human
cgcacagacacacacacacacacacacacacacacacacacacaguaaccacggguaggcacca

SEQ ID NO: 210442 - RNA, 64 nt, Human
cacagacacacacacacacacacacacacacacacacacacaguaaccacggguaggcaccagg

SEQ ID NO: 210443 - RNA, 64 nt, Human
acucacuauauacaaaucauuagguuaaaacagacacacacacacacacacacacacacacaca

SEQ ID NO: 210444 - RNA, 64 nt, Human
ucacuauauacaaaucauuagguuaaaacagacacacacacacacacacacacacacacacaca

SEQ ID NO: 210445 - RNA, 64 nt, Human
acuauauacaaaucauuagguuaaaacagacacacacacacacacacacacacacacacacaca

SEQ ID NO: 210446 - RNA, 64 nt, Human
uauauacaaaucauuagguuaaaacagacacacacacacacacacacacacacacacacacaca

SEQ ID NO: 210447 - RNA, 64 nt, Human
uauacaaaucauuagguuaaaacagacacacacacacacacacacacacacacacacacacaca

SEQ ID NO: 210448 - RNA, 64 nt, Human
uacaaaucauuagguuaaaacagacacacacacacacacacacacacacacacacacacacaca

SEQ ID NO: 210449 - RNA, 64 nt, Human
caaaucauuagguuaaaacagacacacacacacacacacacacacacacacacacacacacaca

SEQ ID NO: 210450 - RNA, 64 nt, Human
aaucauuagguuaaaacagacacacacacacacacacacacacacacacacacacacacacaca

SEQ ID NO: 210451 - RNA, 64 nt, Human
ucauuagguuaaaacagacacacacacacacacacacacacacacacacacacacacacacaca

SEQ ID NO: 210452 - RNA, 64 nt, Human
auuagguuaaaacagacacacacacacacacacacacacacacacacacacacacacacacaag

SEQ ID NO: 210453 - RNA, 64 nt, Human
uagguuaaaacagacacacacacacacacacacacacacacacacacacacacacacacaagac

SEQ ID NO: 210454 - RNA, 64 nt, Human
gguuaaaacagacacacacacacacacacacacacacacacacacacacacacacacaagaccu

SEQ ID NO: 210455 - RNA, 64 nt, Human
uuaaaacagacacacacacacacacacacacacacacacacacacacacacacacaagaccugg

SEQ ID NO: 210456 - RNA, 64 nt, Human
aaaacagacacacacacacacacacacacacacacacacacacacacacacacaagaccugggc

SEQ ID NO: 210457 - RNA, 64 nt, Human
aacagacacacacacacacacacacacacacacacacacacacacacacacaagaccugggccc

SEQ ID NO: 210458 - RNA, 64 nt, Human
cagacacacacacacacacacacacacacacacacacacacacacacacaagaccugggcccuu

SEQ ID NO: 210459 - RNA, 64 nt, Human
gacacacacacacacacacacacacacacacacacacacacacacacaagaccugggcccuuaa

SEQ ID NO: 210460 - RNA, 64 nt, Human
cacacacacacacacacacacacacacacacacacacacacacacaagaccugggcccuuaagu

SEQ ID NO: 210461 - RNA, 64 nt, Human
cacacacacacacacacacacacacacacacacacacacacacaagaccugggcccuuaaguuu

SEQ ID NO: 210462 - RNA, 64 nt, Human
cacacacacacacacacacacacacacacacacacacacacaagaccugggcccuuaaguuuac

SEQ ID NO: 210463 - RNA, 64 nt, Human
gugugugugugugugugugugugucucccucucucacacacacaagagcaguuugcuguugcug

SEQ ID NO: 210464 - RNA, 64 nt, Human
gugugugugugugugugugugucucccucucucacacacacaagagcaguuugcuguugcuguu

SEQ ID NO: 210465 - RNA, 64 nt, Human
gguaaauaggcuuuacaggcuccccuccuccaaacacacacagaaugggcugguuucuuucaag

SEQ ID NO: 210466 - RNA, 64 nt, Human
aacuugaauuaagaccaaacagaacaugagaauacacacacacacacacauauacacacacaca

SEQ ID NO: 210467 - RNA, 64 nt, Human
cuugaauuaagaccaaacagaacaugagaauacacacacacacacacauauacacacacacaca

SEQ ID NO: 210468 - RNA, 64 nt, Human
ugaauuaagaccaaacagaacaugagaauacacacacacacacacauauacacacacacacacu

SEQ ID NO: 210469 - RNA, 64 nt, Human
aauuaagaccaaacagaacaugagaauacacacacacacacacauauacacacacacacacuuc

SEQ ID NO: 210470 - RNA, 64 nt, Human
uuaagaccaaacagaacaugagaauacacacacacacacacauauacacacacacacacuucac

SEQ ID NO: 210471 - RNA, 64 nt, Human
agaacaugagaauacacacacacacacacauauacacacacacacacuucacacauacacacca

SEQ ID NO: 210472 - RNA, 64 nt, Human
aacaugagaauacacacacacacacacauauacacacacacacacuucacacauacacaccacu

SEQ ID NO: 210473 - RNA, 64 nt, Human
caugagaauacacacacacacacacauauacacacacacacacuucacacauacacaccacucc

SEQ ID NO: 210474 - RNA, 64 nt, Human
agaaucauauauaguccagucuucauuuuacauacacacacauauuuuacacacacacacauuu

SEQ ID NO: 210475 - RNA, 64 nt, Human
ccagucuucauuuuacauacacacacauauuuuacacacacacacauuuuacacacacacacac

SEQ ID NO: 210476 - RNA, 64 nt, Human
agucuucauuuuacauacacacacauauuuuacacacacacacauuuuacacacacacacacac

SEQ ID NO: 210477 - RNA, 64 nt, Human
ucuucauuuuacauacacacacauauuuuacacacacacacauuuuacacacacacacacacac

SEQ ID NO: 210478 - RNA, 64 nt, Human
uacacacacauauuuuacacacacacacauuuuacacacacacacacacacacacacauauguu

SEQ ID NO: 210479 - RNA, 64 nt, Human
cacacacauauuuuacacacacacacauuuuacacacacacacacacacacacacauauguuuu

SEQ ID NO: 210480 - RNA, 64 nt, Human
cacacauauuuuacacacacacacauuuuacacacacacacacacacacacacauauguuuuuc

SEQ ID NO: 210481 - RNA, 64 nt, Human
cacauauuuuacacacacacacauuuuacacacacacacacacacacacacauauguuuuucua

SEQ ID NO: 210482 - RNA, 64 nt, Human
cauauuuuacacacacacacauuuuacacacacacacacacacacacacauauguuuuucuagu

SEQ ID NO: 210483 - RNA, 64 nt, Human
uauuuuacacacacacacauuuuacacacacacacacacacacacacauauguuuuucuagucu

SEQ ID NO: 210484 - RNA, 64 nt, Human
uuuuacacacacacacauuuuacacacacacacacacacacacacauauguuuuucuagucucu

SEQ ID NO: 210485 - RNA, 64 nt, Human
uuacacacacacacauuuuacacacacacacacacacacacacauauguuuuucuagucucugg

SEQ ID NO: 210486 - RNA, 64 nt, Human
acacacacacacauuuuacacacacacacacacacacacacauauguuuuucuagucucuggca

SEQ ID NO: 210487 - RNA, 64 nt, Human
uuucauaagauucaaccaaauaaauauauauauacacacacacauacauauacaccuauauaug

SEQ ID NO: 210488 - RNA, 64 nt, Human
ucauaagauucaaccaaauaaauauauauauacacacacacauacauauacaccuauauaugug

SEQ ID NO: 210489 - RNA, 64 nt, Human
ccuccuccacuccuggccgccuucuccagcgccgcacacacagaugcucagucucagagaggcu

SEQ ID NO: 210490 - RNA, 64 nt, Human
uucaaguauauaugauuuaaaccugggcuacugacacacacacaguagccauuaguuagacucu

SEQ ID NO: 210491 - RNA, 64 nt, Human
caaguauauaugauuuaaaccugggcuacugacacacacacaguagccauuaguuagacucuuc

SEQ ID NO: 210492 - RNA, 64 nt, Human
agggcccuccacaucugagguggcucauucccaucacacacagauuguccugguguucauuuca

SEQ ID NO: 210493 - RNA, 64 nt, Human
aaccaaggccagcaccuccgucggaagcauuuggcacacacaccuucaauacacgucaaggucg

SEQ ID NO: 210494 - RNA, 64 nt, Human
ugagcacacccgugugcacacucauacacaugugcacacacacgcacucuccccgcucaggggc

SEQ ID NO: 210495 - RNA, 64 nt, Human
gcccuugcccccaucccucggacccaccaaacugcacacacagcuccucuuaccguagccuccg

SEQ ID NO: 210496 - RNA, 64 nt, Human
uuaaucuaugaaucuauaggcucgguguguguaacacacacaccccuaucguuguccuucaaau

SEQ ID NO: 210497 - RNA, 64 nt, Human
cugggcuggacuggaggugggcaugccacccucacacacacagcugggcaaagccacaaggcug

SEQ ID NO: 210498 - RNA, 64 nt, Human
cccugggcuggacuggaggugggcaugccacccucacacacacagcugggcaaagccacaaggc

SEQ ID NO: 210499 - RNA, 64 nt, Human
uugccacaccuauucacacaccauaguaguugggcacacacaucuucccuuccaaagggcuuuu

SEQ ID NO: 210500 - RNA, 64 nt, Human
accugaagcccuggggaugauguggaaauaggggcacacacagaugauucauggauggggacau

SEQ ID NO: 210501 - RNA, 64 nt, Human
ggucaggaggccuucaccgcugcuggggcacacacacacacaugcauacacacauacgacacac

SEQ ID NO: 210502 - RNA, 64 nt, Human
agggucaggaggccuucaccgcugcuggggcacacacacacacaugcauacacacauacgacac

SEQ ID NO: 210503 - RNA, 64 nt, Human
uaagggucaggaggccuucaccgcugcuggggcacacacacacacaugcauacacacauacgac

SEQ ID NO: 210504 - RNA, 64 nt, Human
ucuaagggucaggaggccuucaccgcugcuggggcacacacacacacaugcauacacacauacg

SEQ ID NO: 210505 - RNA, 64 nt, Human
ugggcagaauccugggcccccagagaccuuugcccacacacacuccuuccccuugucccugggg

SEQ ID NO: 210506 - RNA, 64 nt, Human
uguguguguguguaugggccugaucacacacaaacacacacaccucuccuucauucacguccua

SEQ ID NO: 210507 - RNA, 64 nt, Human
gaucuguguguguguguguguguaugggccugaucacacacaaacacacacaccucuccuucau

SEQ ID NO: 210508 - RNA, 64 nt, Human
cuuucuuggcuggcaacacacacacacacacacacacacacauacacacacgacugaaucagau

SEQ ID NO: 210509 - RNA, 64 nt, Human
gccuuucuuggcuggcaacacacacacacacacacacacacacauacacacacgacugaaucag

SEQ ID NO: 210510 - RNA, 64 nt, Human
aagccuuucuuggcuggcaacacacacacacacacacacacacacauacacacacgacugaauc

SEQ ID NO: 210511 - RNA, 64 nt, Human
ggaagccuuucuuggcuggcaacacacacacacacacacacacacacauacacacacgacugaa

SEQ ID NO: 210512 - RNA, 64 nt, Human
agggaagccuuucuuggcuggcaacacacacacacacacacacacacacauacacacacgacug

SEQ ID NO: 210513 - RNA, 64 nt, Human
auagggaagccuuucuuggcuggcaacacacacacacacacacacacacacauacacacacgac

SEQ ID NO: 210514 - RNA, 64 nt, Human
uuauagggaagccuuucuuggcuggcaacacacacacacacacacacacacacauacacacacg

SEQ ID NO: 210515 - RNA, 64 nt, Human
ccuuauagggaagccuuucuuggcuggcaacacacacacacacacacacacacacauacacaca

SEQ ID NO: 210516 - RNA, 64 nt, Human
cuccuuauagggaagccuuucuuggcuggcaacacacacacacacacacacacacacauacaca

SEQ ID NO: 210517 - RNA, 64 nt, Human
aacuccuuauagggaagccuuucuuggcuggcaacacacacacacacacacacacacacauaca

SEQ ID NO: 210518 - RNA, 64 nt, Human
ugagucucccuugaggagcacucacucuugaaggcacacacauacacauauuuucagugaaaua

SEQ ID NO: 210519 - RNA, 64 nt, Human
acagacaccacacacacacauacacacacacacacacacacaccugaggccaccagaagacacu

SEQ ID NO: 210520 - RNA, 64 nt, Human
acacagacaccacacacacacauacacacacacacacacacacaccugaggccaccagaagaca

SEQ ID NO: 210521 - RNA, 64 nt, Human
agacacagacaccacacacacacauacacacacacacacacacacaccugaggccaccagaaga

SEQ ID NO: 210522 - RNA, 64 nt, Human
gcagacacagacaccacacacacacauacacacacacacacacacacaccugaggccaccagaa

SEQ ID NO: 210523 - RNA, 64 nt, Human
acgcagacacagacaccacacacacacauacacacacacacacacacacaccugaggccaccag

SEQ ID NO: 210524 - RNA, 64 nt, Human
acacgcagacacagacaccacacacacacauacacacacacacacacacacaccugaggccacc

SEQ ID NO: 210525 - RNA, 64 nt, Human
acacacgcagacacagacaccacacacacacauacacacacacacacacacacaccugaggcca

SEQ ID NO: 210526 - RNA, 64 nt, Human
guguucauguacacacgcagacacagacaccacacacacacauacacacacacacacacacaca

SEQ ID NO: 210527 - RNA, 64 nt, Human
guguguucauguacacacgcagacacagacaccacacacacacauacacacacacacacacaca

SEQ ID NO: 210528 - RNA, 64 nt, Human
auguguguucauguacacacgcagacacagacaccacacacacacauacacacacacacacaca

SEQ ID NO: 210529 - RNA, 64 nt, Human
cuuuccugaacuggaacgucgggggcaaagcauacacacacacuccaauccauccaugcauaca

SEQ ID NO: 210530 - RNA, 64 nt, Human
agcacaggacagaggcaauauacaacucuggguucacacacaagcugagaugagaagaggaaug

SEQ ID NO: 210531 - RNA, 64 nt, Human
gcuggaaugaugucuguuggaaaacccaggacuccacacacaaaacuccugggauuuuguuucc

SEQ ID NO: 210532 - RNA, 64 nt, Human
ucaugaaaauuauuggugggccacugaaaguccccacacacaaagccuuuauucuauauaauuu

SEQ ID NO: 210533 - RNA, 64 nt, Human
uacaugccuuuuccucccauccaccucccccgcacacacacaaagaugaccugggacaugauuu

SEQ ID NO: 210534 - RNA, 64 nt, Human
aauacaugccuuuuccucccauccaccucccccgcacacacacaaagaugaccugggacaugau

SEQ ID NO: 210535 - RNA, 64 nt, Human
agauuuuauauguguguguggauauauauacacacacacacagaaagaugaauauauauauaua

SEQ ID NO: 210536 - RNA, 64 nt, Human
auagauuuuauauguguguguggauauauauacacacacacacagaaagaugaauauauauaua

SEQ ID NO: 210537 - RNA, 64 nt, Human
caauagauuuuauauguguguguggauauauauacacacacacacagaaagaugaauauauaua

SEQ ID NO: 210538 - RNA, 64 nt, Human
aaauuaaggcaacaaacauauaccuuccaugaagcacacacagacuuuugaaagcaaggacaau

SEQ ID NO: 210539 - RNA, 64 nt, Human
cacauacagacagaccuaccuauacauacgugcacacacacauacauauucauacacaauucau

SEQ ID NO: 210540 - RNA, 64 nt, Human
cccacauacagacagaccuaccuauacauacgugcacacacacauacauauucauacacaauuc

SEQ ID NO: 210541 - RNA, 64 nt, Human
cucaaauauaagccaaggguaauuucagcggaugcacacacaacccugccucccacaguuccuc

SEQ ID NO: 210542 - RNA, 64 nt, Human
cuaaccauggugcuauuauuaggcuugcuuguuacacacacaggucuaagccuaguaugucaau

SEQ ID NO: 210543 - RNA, 64 nt, Human
cuuccacuccauagguaaauaaacugggugaagccacacacacccaaugaacauuuucucccau

SEQ ID NO: 210544 - RNA, 64 nt, Human
cccgucguuaguccagccccugcuucacccccuccacacacaaaacaggaaacauaaucaaagc

SEQ ID NO: 210545 - RNA, 64 nt, Human
aguaauuuuuuaaagaaggcacuuuuaaaauuaacacacacaugaacugcacaccuuccccaua

SEQ ID NO: 210546 - RNA, 64 nt, Human
gcacccagaaauuccuucccacucauguuguucccacacacaaaccaagagccaaaaaugagug

SEQ ID NO: 210547 - RNA, 64 nt, Human
uaguuccucaagcauaugugcuuauaugcacacacacacacauuuccauggacccaggucuugc

SEQ ID NO: 210548 - RNA, 64 nt, Human
uuuaguuccucaagcauaugugcuuauaugcacacacacacacauuuccauggacccaggucuu

SEQ ID NO: 210549 - RNA, 64 nt, Human
gcuuuaguuccucaagcauaugugcuuauaugcacacacacacacauuuccauggacccagguc

SEQ ID NO: 210550 - RNA, 64 nt, Human
uggcuuuaguuccucaagcauaugugcuuauaugcacacacacacacauuuccauggacccagg

SEQ ID NO: 210551 - RNA, 64 nt, Human
cagaauacuuaagccuggcccccaaaugccccugcacacacacgugccacaccugcgcugauuc

SEQ ID NO: 210552 - RNA, 64 nt, Human
gguacuuugugacagaagacauguacacacacaccacacacauacauacacacucucucacucu

SEQ ID NO: 210553 - RNA, 64 nt, Human
gacuauugugguacuuugugacagaagacauguacacacacaccacacacauacauacacacuc

SEQ ID NO: 210554 - RNA, 64 nt, Human
ugaauaaucuuccaucuuccccgccacacauacacacacacacuuuuuguuucuuucagguaga

SEQ ID NO: 210555 - RNA, 64 nt, Human
ugugaauaaucuuccaucuuccccgccacacauacacacacacacuuuuuguuucuuucaggua

SEQ ID NO: 210556 - RNA, 64 nt, Human
agaacucuuuauuuucuaucauucuuucuagacacacacacaucagacuggcaacuguuuugua

SEQ ID NO: 210557 - RNA, 64 nt, Human
caagaacucuuuauuuucuaucauucuuucuagacacacacacaucagacuggcaacuguuuug

SEQ ID NO: 210558 - RNA, 64 nt, Human
ucagugaguuaaacacgaauugauuuaaagugaacacacacaagggagcuugcuugcagauggu

SEQ ID NO: 210559 - RNA, 64 nt, Human
caggaugcuuugguuauauuuagcuccaaaccuucacacacagacuguugucccugcacucuuu

SEQ ID NO: 210560 - RNA, 64 nt, Human
cggccuugggagcaugucacuguguacagcuggccacacacagggaaggagcagcaucugguau

SEQ ID NO: 210561 - RNA, 64 nt, Human
caagucguggggugcagauuguuauggugacaggcacacacauuuuucuacccuucuucugaga

SEQ ID NO: 210562 - RNA, 64 nt, Human
uguguguauguauguacacacacacacacgugugcacacacaaugcacacaacuccuaugacug

SEQ ID NO: 210563 - RNA, 64 nt, Human
uucuccccacugaauguguguauguauguacacacacacacacgugugcacacacaaugcacac

SEQ ID NO: 210564 - RNA, 64 nt, Human
aguucuccccacugaauguguguauguauguacacacacacacacgugugcacacacaaugcac

SEQ ID NO: 210565 - RNA, 64 nt, Human
ugaguucuccccacugaauguguguauguauguacacacacacacacgugugcacacacaaugc

SEQ ID NO: 210566 - RNA, 64 nt, Human
gacacacacacacacacacacacacacacacacacacacacacucuuuuaggggacuaagagag

SEQ ID NO: 210567 - RNA, 64 nt, Human
cugacacacacacacacacacacacacacacacacacacacacacucuuuuaggggacuaagag

SEQ ID NO: 210568 - RNA, 64 nt, Human
aacugacacacacacacacacacacacacacacacacacacacacacucuuuuaggggacuaag

SEQ ID NO: 210569 - RNA, 64 nt, Human
caaacugacacacacacacacacacacacacacacacacacacacacacucuuuuaggggacua

SEQ ID NO: 210570 - RNA, 64 nt, Human
cucaaacugacacacacacacacacacacacacacacacacacacacacacucuuuuaggggac

SEQ ID NO: 210571 - RNA, 64 nt, Human
uccucaaacugacacacacacacacacacacacacacacacacacacacacacucuuuuagggg

SEQ ID NO: 210572 - RNA, 64 nt, Human
ucuccucaaacugacacacacacacacacacacacacacacacacacacacacacucuuuuagg

SEQ ID NO: 210573 - RNA, 64 nt, Human
acucuccucaaacugacacacacacacacacacacacacacacacacacacacacacucuuuua

SEQ ID NO: 210574 - RNA, 64 nt, Human
cuacucuccucaaacugacacacacacacacacacacacacacacacacacacacacacucuuu

SEQ ID NO: 210575 - RNA, 64 nt, Human
uucuacucuccucaaacugacacacacacacacacacacacacacacacacacacacacacucu

SEQ ID NO: 210576 - RNA, 64 nt, Human
aauucuacucuccucaaacugacacacacacacacacacacacacacacacacacacacacacu

SEQ ID NO: 210577 - RNA, 64 nt, Human
ccaauucuacucuccucaaacugacacacacacacacacacacacacacacacacacacacaca

SEQ ID NO: 210578 - RNA, 64 nt, Human
gcccaauucuacucuccucaaacugacacacacacacacacacacacacacacacacacacaca

SEQ ID NO: 210579 - RNA, 64 nt, Human
cagcccaauucuacucuccucaaacugacacacacacacacacacacacacacacacacacaca

SEQ ID NO: 210580 - RNA, 64 nt, Human
accagcccaauucuacucuccucaaacugacacacacacacacacacacacacacacacacaca

SEQ ID NO: 210581 - RNA, 64 nt, Human
uuaccagcccaauucuacucuccucaaacugacacacacacacacacacacacacacacacaca

SEQ ID NO: 210582 - RNA, 64 nt, Human
acuuaccagcccaauucuacucuccucaaacugacacacacacacacacacacacacacacaca

SEQ ID NO: 210583 - RNA, 64 nt, Human
cacacacacacacacacacacacacacacacacacacacacacgcccuacucuucauuugcuag

SEQ ID NO: 210584 - RNA, 64 nt, Human
cacacacacacacacacacacacacacacacacacacacacacacgcccuacucuucauuugcu

SEQ ID NO: 210585 - RNA, 64 nt, Human
cacacacacacacacacacacacacacacacacacacacacacacacgcccuacucuucauuug

SEQ ID NO: 210586 - RNA, 64 nt, Human
cacacacacacacacacacacacacacacacacacacacacacacacacgcccuacucuucauu

SEQ ID NO: 210587 - RNA, 64 nt, Human
aacacacacacacacacacacacacacacacacacacacacacacacacacgcccuacucuuca

SEQ ID NO: 210588 - RNA, 64 nt, Human
caaacacacacacacacacacacacacacacacacacacacacacacacacacgcccuacucuu

SEQ ID NO: 210589 - RNA, 64 nt, Human
cccaaacacacacacacacacacacacacacacacacacacacacacacacacacgcccuacuc

SEQ ID NO: 210590 - RNA, 64 nt, Human
cccccaaacacacacacacacacacacacacacacacacacacacacacacacacacgcccuac

SEQ ID NO: 210591 - RNA, 64 nt, Human
accccccaaacacacacacacacacacacacacacacacacacacacacacacacacacgcccu

SEQ ID NO: 210592 - RNA, 64 nt, Human
cuaccccccaaacacacacacacacacacacacacacacacacacacacacacacacacacgcc

SEQ ID NO: 210593 - RNA, 64 nt, Human
cccuaccccccaaacacacacacacacacacacacacacacacacacacacacacacacacacg

SEQ ID NO: 210594 - RNA, 64 nt, Human
cccccuaccccccaaacacacacacacacacacacacacacacacacacacacacacacacaca

SEQ ID NO: 210595 - RNA, 64 nt, Human
cacccccuaccccccaaacacacacacacacacacacacacacacacacacacacacacacaca

SEQ ID NO: 210596 - RNA, 64 nt, Human
cgcacccccuaccccccaaacacacacacacacacacacacacacacacacacacacacacaca

SEQ ID NO: 210597 - RNA, 64 nt, Human
gccgcacccccuaccccccaaacacacacacacacacacacacacacacacacacacacacaca

SEQ ID NO: 210598 - RNA, 64 nt, Human
ucgccgcacccccuaccccccaaacacacacacacacacacacacacacacacacacacacaca

SEQ ID NO: 210599 - RNA, 64 nt, Human
caucgccgcacccccuaccccccaaacacacacacacacacacacacacacacacacacacaca

SEQ ID NO: 210600 - RNA, 64 nt, Human
cccaucgccgcacccccuaccccccaaacacacacacacacacacacacacacacacacacaca

SEQ ID NO: 210601 - RNA, 64 nt, Human
uucccaucgccgcacccccuaccccccaaacacacacacacacacacacacacacacacacaca

SEQ ID NO: 210602 - RNA, 64 nt, Human
cauucccaucgccgcacccccuaccccccaaacacacacacacacacacacacacacacacaca

SEQ ID NO: 210603 - RNA, 64 nt, Human
uccauucccaucgccgcacccccuaccccccaaacacacacacacacacacacacacacacaca

SEQ ID NO: 210604 - RNA, 64 nt, Human
cacacaugcgugugcacccgcgcacgcacauacacacacacauauagcaguagcagcagcagca

SEQ ID NO: 210605 - RNA, 64 nt, Human
cgcacacaugcgugugcacccgcgcacgcacauacacacacacauauagcaguagcagcagcag

SEQ ID NO: 210606 - RNA, 64 nt, Human
ccuccacuucuucagcaccacacacacgcacacacacacacacgcacacaugcgugugcacccg

SEQ ID NO: 210607 - RNA, 64 nt, Human
aaccuccacuucuucagcaccacacacacgcacacacacacacacgcacacaugcgugugcacc

SEQ ID NO: 210608 - RNA, 64 nt, Human
gcaaccuccacuucuucagcaccacacacacgcacacacacacacacgcacacaugcgugugca

SEQ ID NO: 210609 - RNA, 64 nt, Human
aagcaaccuccacuucuucagcaccacacacacgcacacacacacacacgcacacaugcgugug

SEQ ID NO: 210610 - RNA, 64 nt, Human
agagaaggccaagcaaccuccacuucuucagcaccacacacacgcacacacacacacacgcaca

SEQ ID NO: 210611 - RNA, 64 nt, Human
guaaauuuaugucaguucuuuagagcauuugcuucacacacaguucaaccauuuaaccagaaau

SEQ ID NO: 210612 - RNA, 64 nt, Human
auguguauauguuauaaacgugaaauauauuugacacacacauucacauauaaauuguuaaaaa

SEQ ID NO: 210613 - RNA, 64 nt, Human
agaggcagaugugugcaaaaagcacaaccccaaucacacacagaaacccguaggcacggacaca

SEQ ID NO: 210614 - RNA, 64 nt, Human
auuauauauauauauauauauacacacacacacacacacacacguauaucuauuuaugcacaua

SEQ ID NO: 210615 - RNA, 64 nt, Human
acauuauauauauauauauauauacacacacacacacacacacacguauaucuauuuaugcaca

SEQ ID NO: 210616 - RNA, 64 nt, Human
acacauuauauauauauauauauauacacacacacacacacacacacguauaucuauuuaugca

SEQ ID NO: 210617 - RNA, 64 nt, Human
acacacauuauauauauauauauauauacacacacacacacacacacacguauaucuauuuaug

SEQ ID NO: 210618 - RNA, 64 nt, Human
acacacacauuauauauauauauauauauacacacacacacacacacacacguauaucuauuua

SEQ ID NO: 210619 - RNA, 64 nt, Human
auacacacacauuauauauauauauauauauacacacacacacacacacacacguauaucuauu

SEQ ID NO: 210620 - RNA, 64 nt, Human
auauacacacacauuauauauauauauauauauacacacacacacacacacacacguauaucua

SEQ ID NO: 210621 - RNA, 64 nt, Human
ggcagcucuuaaaacuaagaaaaaauaugauauacacacacauuauauauauauauauauauac

SEQ ID NO: 210622 - RNA, 64 nt, Human
ucauucccugcccaaguggggccagaccucuuuacacacacauucccguuccuaccaaccacca

SEQ ID NO: 210623 - RNA, 64 nt, Human
caugguguccauuuuauuuagcaaggacggcacccacacacaaagaggaugauuucccuuaacu

SEQ ID NO: 210624 - RNA, 64 nt, Human
aaaaguuuacugccaugaaauacuccucccaccacacacacaugcuccaaaagaggaaagaaaa

SEQ ID NO: 210625 - RNA, 64 nt, Human
uuaaaaguuuacugccaugaaauacuccucccaccacacacacaugcuccaaaagaggaaagaa

SEQ ID NO: 210626 - RNA, 64 nt, Human
gugcaugcuauuauugcugcaauuagaauauuaucacacacaaaggucucuauauuaacgcugg

SEQ ID NO: 210627 - RNA, 50 nt, Human
gcuucaaagcaaacccuuaacacacacaaagccccggugucggacacaca

SEQ ID NO: 210628 - RNA, 64 nt, Human
aaaagagagcucccuuagggaaaaaugaccaaaacacacacacacauuuacaauggacugcugg

SEQ ID NO: 210629 - RNA, 64 nt, Human
aagagagcucccuuagggaaaaaugaccaaaacacacacacacauuuacaauggacugcuggug

SEQ ID NO: 210630 - RNA, 64 nt, Human
gagagcucccuuagggaaaaaugaccaaaacacacacacacauuuacaauggacugcuggugca

SEQ ID NO: 210631 - RNA, 64 nt, Human
aaagucucaauguuccauucagucugcagcuauucacacacacacacacacacacacacacaca

SEQ ID NO: 210632 - RNA, 64 nt, Human
agucucaauguuccauucagucugcagcuauucacacacacacacacacacacacacacacaca

SEQ ID NO: 210633 - RNA, 64 nt, Human
ucucaauguuccauucagucugcagcuauucacacacacacacacacacacacacacacacaca

SEQ ID NO: 210634 - RNA, 64 nt, Human
ucaauguuccauucagucugcagcuauucacacacacacacacacacacacacacacacacaca

SEQ ID NO: 210635 - RNA, 64 nt, Human
aauguuccauucagucugcagcuauucacacacacacacacacacacacacacacacacacaca

SEQ ID NO: 210636 - RNA, 64 nt, Human
uguuccauucagucugcagcuauucacacacacacacacacacacacacacacacacacacaca

SEQ ID NO: 210637 - RNA, 64 nt, Human
uuccauucagucugcagcuauucacacacacacacacacacacacacacacacacacacacaca

SEQ ID NO: 210638 - RNA, 64 nt, Human
ccauucagucugcagcuauucacacacacacacacacacacacacacacacacacacacacaca

SEQ ID NO: 210639 - RNA, 64 nt, Human
auucagucugcagcuauucacacacacacacacacacacacacacacacacacacacacacaca

SEQ ID NO: 210640 - RNA, 64 nt, Human
ucagucugcagcuauucacacacacacacacacacacacacacacacacacacacacacacaaa

SEQ ID NO: 210641 - RNA, 64 nt, Human
agucugcagcuauucacacacacacacacacacacacacacacacacacacacacacacaaaua

SEQ ID NO: 210642 - RNA, 64 nt, Human
ucugcagcuauucacacacacacacacacacacacacacacacacacacacacacacaaauauu

SEQ ID NO: 210643 - RNA, 64 nt, Human
ugcagcuauucacacacacacacacacacacacacacacacacacacacacacacaaauauugc

SEQ ID NO: 210644 - RNA, 64 nt, Human
cagcuauucacacacacacacacacacacacacacacacacacacacacacacaaauauugcuu

SEQ ID NO: 210645 - RNA, 64 nt, Human
gcuauucacacacacacacacacacacacacacacacacacacacacacacaaauauugcuugg

SEQ ID NO: 210646 - RNA, 64 nt, Human
uauucacacacacacacacacacacacacacacacacacacacacacacaaauauugcuuggac

SEQ ID NO: 210647 - RNA, 64 nt, Human
uucacacacacacacacacacacacacacacacacacacacacacacaaauauugcuuggacua

SEQ ID NO: 210648 - RNA, 64 nt, Human
cacacacacacacacacacacacacacacacacacacacacacacaaauauugcuuggacuacc

SEQ ID NO: 210649 - RNA, 64 nt, Human
cacacacacacacacacacacacacacacacacacacacacacaaauauugcuuggacuaccua

SEQ ID NO: 210650 - RNA, 64 nt, Human
cacacacacacacacacacacacacacacacacacacacacaaauauugcuuggacuaccuaua

SEQ ID NO: 210651 - RNA, 64 nt, Human
cgcacaaucuacacugccuuaccuucacuuaaaccacacacacaaggugcucagacaugaaaug

SEQ ID NO: 210652 - RNA, 64 nt, Human
cacaaucuacacugccuuaccuucacuuaaaccacacacacaaggugcucagacaugaaaugua

SEQ ID NO: 210653 - RNA, 64 nt, Human
acuccccuugccuuccccugucuucaccugccaccacacacacacacacacacacacacacaca

SEQ ID NO: 210654 - RNA, 64 nt, Human
uccccuugccuuccccugucuucaccugccaccacacacacacacacacacacacacacacaca

SEQ ID NO: 210655 - RNA, 64 nt, Human
cccuugccuuccccugucuucaccugccaccacacacacacacacacacacacacacacacaca

SEQ ID NO: 210656 - RNA, 64 nt, Human
cuugccuuccccugucuucaccugccaccacacacacacacacacacacacacacacacacaca

SEQ ID NO: 210657 - RNA, 64 nt, Human
ugccuuccccugucuucaccugccaccacacacacacacacacacacacacacacacacacacg

SEQ ID NO: 210658 - RNA, 64 nt, Human
ccuuccccugucuucaccugccaccacacacacacacacacacacacacacacacacacacgca

SEQ ID NO: 210659 - RNA, 64 nt, Human
uuccccugucuucaccugccaccacacacacacacacacacacacacacacacacacacgcacg

SEQ ID NO: 210660 - RNA, 64 nt, Human
ccccugucuucaccugccaccacacacacacacacacacacacacacacacacacacgcacggc

SEQ ID NO: 210661 - RNA, 64 nt, Human
ccugucuucaccugccaccacacacacacacacacacacacacacacacacacacgcacggcuu

SEQ ID NO: 210662 - RNA, 64 nt, Human
ugucuucaccugccaccacacacacacacacacacacacacacacacacacacgcacggcuucc

SEQ ID NO: 210663 - RNA, 64 nt, Human
ucuucaccugccaccacacacacacacacacacacacacacacacacacacgcacggcuuccua

SEQ ID NO: 210664 - RNA, 64 nt, Human
uucaccugccaccacacacacacacacacacacacacacacacacacacgcacggcuuccuaua

SEQ ID NO: 210665 - RNA, 64 nt, Human
caccugccaccacacacacacacacacacacacacacacacacacacgcacggcuuccuauaac

SEQ ID NO: 210666 - RNA, 64 nt, Human
ccugccaccacacacacacacacacacacacacacacacacacacgcacggcuuccuauaacuu

SEQ ID NO: 210667 - RNA, 64 nt, Human
ugccaccacacacacacacacacacacacacacacacacacacgcacggcuuccuauaacuucu

SEQ ID NO: 210668 - RNA, 64 nt, Human
auuaaacaaucaucaggcuuuuagcgacaaggaacacacacauuuuucuuaaaggcccaauccu

SEQ ID NO: 210669 - RNA, 64 nt, Human
gcaguguuagaggaggagaugggagcggugacuacacacacacacacacacacacacacacaca

SEQ ID NO: 210670 - RNA, 64 nt, Human
aguguuagaggaggagaugggagcggugacuacacacacacacacacacacacacacacacaca

SEQ ID NO: 210671 - RNA, 64 nt, Human
uguuagaggaggagaugggagcggugacuacacacacacacacacacacacacacacacacaaa

SEQ ID NO: 210672 - RNA, 64 nt, Human
uuagaggaggagaugggagcggugacuacacacacacacacacacacacacacacacacaaaca

SEQ ID NO: 210673 - RNA, 64 nt, Human
agaggaggagaugggagcggugacuacacacacacacacacacacacacacacacacaaacaug

SEQ ID NO: 210674 - RNA, 64 nt, Human
aggaggagaugggagcggugacuacacacacacacacacacacacacacacacacaaacaugca

SEQ ID NO: 210675 - RNA, 64 nt, Human
gaggagaugggagcggugacuacacacacacacacacacacacacacacacacaaacaugcaca

SEQ ID NO: 210676 - RNA, 64 nt, Human
ggagaugggagcggugacuacacacacacacacacacacacacacacacacaaacaugcacaca

SEQ ID NO: 210677 - RNA, 64 nt, Human
agaugggagcggugacuacacacacacacacacacacacacacacacacaaacaugcacacaca

SEQ ID NO: 210678 - RNA, 64 nt, Human
augggagcggugacuacacacacacacacacacacacacacacacacaaacaugcacacacaca

SEQ ID NO: 210679 - RNA, 64 nt, Human
gggagcggugacuacacacacacacacacacacacacacacacacaaacaugcacacacacaua

SEQ ID NO: 210680 - RNA, 64 nt, Human
gagcggugacuacacacacacacacacacacacacacacacacaaacaugcacacacacauaug

SEQ ID NO: 210681 - RNA, 64 nt, Human
gcggugacuacacacacacacacacacacacacacacacacaaacaugcacacacacauaugca

SEQ ID NO: 210682 - RNA, 64 nt, Human
cacacacacacacacacacacacacacaaacaugcacacacacauaugcauaucuugacauugc

SEQ ID NO: 210683 - RNA, 64 nt, Human
cacacacacacacacacacacacacaaacaugcacacacacauaugcauaucuugacauugcuc

SEQ ID NO: 210684 - RNA, 64 nt, Human
aaucaggauacccaaccauacacacauacaaguccacacacacucccaccccagccaaaaauau

SEQ ID NO: 210685 - RNA, 64 nt, Human
uuauccauagguuucucucccuccuucuccuucucacacacaacuguccauacuaacaaguuug

SEQ ID NO: 210686 - RNA, 64 nt, Human
ucuguaauggguacaaugaagaaguuucuaaaaacacacacaaagcacauugggccaacuauuu

SEQ ID NO: 210687 - RNA, 64 nt, Human
aucuuuuuuucuuccuucauauauauauacacaacacacacacacauauguauaucuauacaca

SEQ ID NO: 210688 - RNA, 64 nt, Human
cuuuuuuucuuccuucauauauauauacacaacacacacacacauauguauaucuauacacaca

SEQ ID NO: 210689 - RNA, 64 nt, Human
uuuuuucuuccuucauauauauauacacaacacacacacacauauguauaucuauacacacaug

SEQ ID NO: 210690 - RNA, 64 nt, Human
aaaaauagauuugcaaaaagugaacagauugcuacacacacacacacacacacacacacacaca

SEQ ID NO: 210691 - RNA, 64 nt, Human
aaauagauuugcaaaaagugaacagauugcuacacacacacacacacacacacacacacacaca

SEQ ID NO: 210692 - RNA, 64 nt, Human
auagauuugcaaaaagugaacagauugcuacacacacacacacacacacacacacacacacaca

SEQ ID NO: 210693 - RNA, 64 nt, Human
agauuugcaaaaagugaacagauugcuacacacacacacacacacacacacacacacacacaca

SEQ ID NO: 210694 - RNA, 64 nt, Human
auuugcaaaaagugaacagauugcuacacacacacacacacacacacacacacacacacacagc

SEQ ID NO: 210695 - RNA, 64 nt, Human
uugcaaaaagugaacagauugcuacacacacacacacacacacacacacacacacacacagcca

SEQ ID NO: 210696 - RNA, 64 nt, Human
gcaaaaagugaacagauugcuacacacacacacacacacacacacacacacacacacagccauu

SEQ ID NO: 210697 - RNA, 64 nt, Human
aaaaagugaacagauugcuacacacacacacacacacacacacacacacacacacagccauuca

SEQ ID NO: 210698 - RNA, 64 nt, Human
aaagugaacagauugcuacacacacacacacacacacacacacacacacacacagccauucauc

SEQ ID NO: 210699 - RNA, 64 nt, Human
agugaacagauugcuacacacacacacacacacacacacacacacacacacagccauucaucug

SEQ ID NO: 210700 - RNA, 64 nt, Human
ugaacagauugcuacacacacacacacacacacacacacacacacacacagccauucaucuggg

SEQ ID NO: 210701 - RNA, 64 nt, Human
aacagauugcuacacacacacacacacacacacacacacacacacacagccauucaucugggcu

SEQ ID NO: 210702 - RNA, 64 nt, Human
cagauugcuacacacacacacacacacacacacacacacacacacagccauucaucugggcugg

SEQ ID NO: 210703 - RNA, 64 nt, Human
gauugcuacacacacacacacacacacacacacacacacacacagccauucaucugggcuggca

SEQ ID NO: 210704 - RNA, 64 nt, Human
uugcuacacacacacacacacacacacacacacacacacacagccauucaucugggcuggcaga

SEQ ID NO: 210705 - RNA, 64 nt, Human
aguauggcggaggccaugggggccccucggcauucacacacagccuggccuccccugcggagcu

SEQ ID NO: 210706 - RNA, 64 nt, Human
ccugcagucuggcugagcccugcuugguugucuccacacacagcugggcugugguagggggugu

SEQ ID NO: 210707 - RNA, 64 nt, Human
gagauuugggcaggaacacagacccaaaccauaccacacacauuaucauuguuaaacuuuguaa

SEQ ID NO: 210708 - RNA, 64 nt, Human
gaucuuuggggaagggagcuaccaacacuuuauacacacacacacgugcacacacacacacaca

SEQ ID NO: 210709 - RNA, 64 nt, Human
ucuuuggggaagggagcuaccaacacuuuauacacacacacacgugcacacacacacacacaca

SEQ ID NO: 210710 - RNA, 64 nt, Human
ggagcuaccaacacuuuauacacacacacacgugcacacacacacacacacacacuauauauau

SEQ ID NO: 210711 - RNA, 64 nt, Human
agcuaccaacacuuuauacacacacacacgugcacacacacacacacacacacuauauauauau

SEQ ID NO: 210712 - RNA, 64 nt, Human
cuaccaacacuuuauacacacacacacgugcacacacacacacacacacacuauauauauauau

SEQ ID NO: 210713 - RNA, 64 nt, Human
accaacacuuuauacacacacacacgugcacacacacacacacacacacuauauauauauauau

SEQ ID NO: 210714 - RNA, 64 nt, Human
caacacuuuauacacacacacacgugcacacacacacacacacacacuauauauauauauauua

SEQ ID NO: 210715 - RNA, 64 nt, Human
acacuuuauacacacacacacgugcacacacacacacacacacacuauauauauauauauuauu

SEQ ID NO: 210716 - RNA, 64 nt, Human
acuuuauacacacacacacgugcacacacacacacacacacacuauauauauauauauuauuua

SEQ ID NO: 210717 - RNA, 64 nt, Human
gcagugguaggauugcagccgugggccugcuggacacacacauacaccaaagauguauuuggau

SEQ ID NO: 210718 - RNA, 64 nt, Human
aguguccugugacuuaacacagaaacgcaauaaacacacacaaaauaguuucaugagugauucu

SEQ ID NO: 210719 - RNA, 64 nt, Human
ggcguguguguauauauggauaaauauauauauacacacacacauauuacugcaaucugugauu

SEQ ID NO: 210720 - RNA, 64 nt, Human
cguguguguauauauggauaaauauauauauacacacacacauauuacugcaaucugugauugc

SEQ ID NO: 210721 - RNA, 64 nt, Human
cacacggaggucuagugagccucuugcuaagugucacacacacucuucccaaagacgugaugag

SEQ ID NO: 210722 - RNA, 64 nt, Human
cuccaucucuauauaaaaacaaaaaccacgaaagcacacacaaaauaaaucagugggauuuggu

SEQ ID NO: 210723 - RNA, 64 nt, Human
uccugggauuauuauacugagauauauauauauacacacacacacacauauguguauauaugua

SEQ ID NO: 210724 - RNA, 64 nt, Human
cugggauuauuauacugagauauauauauauacacacacacacacauauguguauauauguaua

SEQ ID NO: 210725 - RNA, 64 nt, Human
gggauuauuauacugagauauauauauauacacacacacacacauauguguauauauguauaua

SEQ ID NO: 210726 - RNA, 64 nt, Human
gauuauuauacugagauauauauauauacacacacacacacauauguguauauauguauauaua

SEQ ID NO: 210727 - RNA, 64 nt, Human
uguauauauguauauauauaugugaguauauauacacacacacacacacacacacauauauaua

SEQ ID NO: 210728 - RNA, 64 nt, Human
uauauauguauauauauaugugaguauauauacacacacacacacacacacacauauauauaua

SEQ ID NO: 210729 - RNA, 64 nt, Human
uauauguauauauauaugugaguauauauacacacacacacacacacacacauauauauauaua

SEQ ID NO: 210730 - RNA, 64 nt, Human
uauguauauauauaugugaguauauauacacacacacacacacacacacauauauauauauaca

SEQ ID NO: 210731 - RNA, 64 nt, Human
uguauauauauaugugaguauauauacacacacacacacacacacacauauauauauauacaca

SEQ ID NO: 210732 - RNA, 64 nt, Human
uauauauauaugugaguauauauacacacacacacacacacacacauauauauauauacacaca

SEQ ID NO: 210733 - RNA, 64 nt, Human
uauauauaugugaguauauauacacacacacacacacacacacauauauauauauacacacacg

SEQ ID NO: 210734 - RNA, 64 nt, Human
uauauaugugaguauauauacacacacacacacacacacacauauauauauauacacacacgca

SEQ ID NO: 210735 - RNA, 64 nt, Human
acuuuaugugcuacgauuuaacugcagccuugaacacacacaaaaauauucuuaagggcucaga

SEQ ID NO: 210736 - RNA, 64 nt, Human
cguccacaccacucaccacacauacauacacaugcacacacacacacaugcaauucuaccuuuu

SEQ ID NO: 210737 - RNA, 64 nt, Human
uccacaccacucaccacacauacauacacaugcacacacacacacaugcaauucuaccuuuuuc

SEQ ID NO: 210738 - RNA, 64 nt, Human
cacaccacucaccacacauacauacacaugcacacacacacacaugcaauucuaccuuuuucua

SEQ ID NO: 210739 - RNA, 64 nt, Human
caccacucaccacacauacauacacaugcacacacacacacaugcaauucuaccuuuuucuaac

SEQ ID NO: 210740 - RNA, 64 nt, Human
ugcuucuaaauaucuaaacucauuaacauggaaacacacacacaggagcuacaguacauauugg

SEQ ID NO: 210741 - RNA, 64 nt, Human
cuucuaaauaucuaaacucauuaacauggaaacacacacacaggagcuacaguacauauuggca

SEQ ID NO: 210742 - RNA, 64 nt, Human
aaguggcauguuagugaggaguucugauauuaagcacacacacacaugcacacaaauggacuuc

SEQ ID NO: 210743 - RNA, 64 nt, Human
guggcauguuagugaggaguucugauauuaagcacacacacacaugcacacaaauggacuucuc

SEQ ID NO: 210744 - RNA, 64 nt, Human
ggcauguuagugaggaguucugauauuaagcacacacacacaugcacacaaauggacuucucug

SEQ ID NO: 210745 - RNA, 64 nt, Human
aaccaguuaccacacaucuaugauauaacccuaacacacacagaaaagcauacaugcaaaaaga

SEQ ID NO: 210746 - RNA, 64 nt, Human
cacguuuuuguuuucgaauuagacuucuuuaaaacacacacacacacacacacacacacacaca

SEQ ID NO: 210747 - RNA, 64 nt, Human
cguuuuuguuuucgaauuagacuucuuuaaaacacacacacacacacacacacacacacacaca

SEQ ID NO: 210748 - RNA, 64 nt, Human
uuuuuguuuucgaauuagacuucuuuaaaacacacacacacacacacacacacacacacacaca

SEQ ID NO: 210749 - RNA, 64 nt, Human
uuuguuuucgaauuagacuucuuuaaaacacacacacacacacacacacacacacacacacaca

SEQ ID NO: 210750 - RNA, 64 nt, Human
uguuuucgaauuagacuucuuuaaaacacacacacacacacacacacacacacacacacacaca

SEQ ID NO: 210751 - RNA, 64 nt, Human
uuuucgaauuagacuucuuuaaaacacacacacacacacacacacacacacacacacacacaca

SEQ ID NO: 210752 - RNA, 64 nt, Human
uucgaauuagacuucuuuaaaacacacacacacacacacacacacacacacacacacacacaca

SEQ ID NO: 210753 - RNA, 64 nt, Human
cgaauuagacuucuuuaaaacacacacacacacacacacacacacacacacacacacacacaca

SEQ ID NO: 210754 - RNA, 64 nt, Human
aauuagacuucuuuaaaacacacacacacacacacacacacacacacacacacacacacacacc

SEQ ID NO: 210755 - RNA, 64 nt, Human
uuagacuucuuuaaaacacacacacacacacacacacacacacacacacacacacacacacccc

SEQ ID NO: 210756 - RNA, 64 nt, Human
agacuucuuuaaaacacacacacacacacacacacacacacacacacacacacacacaccccug

SEQ ID NO: 210757 - RNA, 64 nt, Human
acuucuuuaaaacacacacacacacacacacacacacacacacacacacacacacaccccugau

SEQ ID NO: 210758 - RNA, 64 nt, Human
uucuuuaaaacacacacacacacacacacacacacacacacacacacacacacaccccugaucc

SEQ ID NO: 210759 - RNA, 64 nt, Human
cuuuaaaacacacacacacacacacacacacacacacacacacacacacacaccccugauccuu

SEQ ID NO: 210760 - RNA, 64 nt, Human
uuaaaacacacacacacacacacacacacacacacacacacacacacacaccccugauccuugc

SEQ ID NO: 210761 - RNA, 64 nt, Human
aaaacacacacacacacacacacacacacacacacacacacacacacaccccugauccuugcca

SEQ ID NO: 210762 - RNA, 64 nt, Human
aacacacacacacacacacacacacacacacacacacacacacacaccccugauccuugccaac

SEQ ID NO: 210763 - RNA, 64 nt, Human
cacacacacacacacacacacacacacacacacacacacacacaccccugauccuugccaacau

SEQ ID NO: 210764 - RNA, 64 nt, Human
cacacacacacacacacacacacacacacacacacacacacaccccugauccuugccaacauga

SEQ ID NO: 210765 - RNA, 64 nt, Human
uacacauaugcacacacgcauacacacaugcacgcacacacacauacacacaugcacgcacgca

SEQ ID NO: 210766 - RNA, 64 nt, Human
cacauaugcacacacgcauacacacaugcacgcacacacacauacacacaugcacgcacgcacg

SEQ ID NO: 210767 - RNA, 64 nt, Human
gaaucuuuuuuuucccuaauggacgaaggaacaacacacacacaaaaauuaaaugcaauaaagg

SEQ ID NO: 210768 - RNA, 64 nt, Human
aucuuuuuuuucccuaauggacgaaggaacaacacacacacaaaaauuaaaugcaauaaaggaa

SEQ ID NO: 210769 - RNA, 64 nt, Human
ugcaggggcucuggagagaaacaauaaagagauucacacacaagccaagcuggccccuguuguc

SEQ ID NO: 210770 - RNA, 64 nt, Human
uagugcuuuaccugugaaauuccccgccccccugcacacacacccacuuuaguacaguuccugu

SEQ ID NO: 210771 - RNA, 64 nt, Human
cuguuccccguccugagccgccacuuccagcgaacacacacagguguccugccguuggaccuuc

SEQ ID NO: 210772 - RNA, 64 nt, Human
cagaaguggcuccuuuucauaaacuccccuaaaccacacacaggagagagcgacgggccucggc

SEQ ID NO: 210773 - RNA, 64 nt, Human
aauaaacaaaaaacuguucuggacugcaaaucugcacacacaacgaacaguugcauuucagaga

SEQ ID NO: 210774 - RNA, 64 nt, Human
uuccaacgggaaguagaugggcgacugcuuuguucacacacauuugauuaaaaauaaacaaaca

SEQ ID NO: 210775 - RNA, 64 nt, Human
agaugccugggaagcccagccccucaggugcccccacacacagccuucccuugacgccuacauu

SEQ ID NO: 210776 - RNA, 64 nt, Human
uuugaacugaaauggacacacaaacacacacacgcacacacagacccacagcuuugaaugauca

SEQ ID NO: 210777 - RNA, 64 nt, Human
guuuuaguauuuugaacugaaauggacacacaaacacacacacgcacacacagacccacagcuu

SEQ ID NO: 210778 - RNA, 64 nt, Human
agugaccauuauacuguguauauauauauaaacacacacacauauauauauauauauauaguac

SEQ ID NO: 210779 - RNA, 64 nt, Human
gaagugaccauuauacuguguauauauauauaaacacacacacauauauauauauauauauagu

SEQ ID NO: 210780 - RNA, 64 nt, Human
cgauaugucuguccaucuuucuccuuucuuccagcacacacagcuaagagauaagaaggcugca

SEQ ID NO: 210781 - RNA, 64 nt, Human
uaucuuacuuuacacauacguguauguacacacacacacacaauacaagacauuuuuccuguuu

SEQ ID NO: 210782 - RNA, 64 nt, Human
uauaucuuacuuuacacauacguguauguacacacacacacacaauacaagacauuuuuccugu

SEQ ID NO: 210783 - RNA, 64 nt, Human
auuauaucuuacuuuacacauacguguauguacacacacacacacaauacaagacauuuuuccu

SEQ ID NO: 210784 - RNA, 64 nt, Human
uuauuauaucuuacuuuacacauacguguauguacacacacacacacaauacaagacauuuuuc

SEQ ID NO: 210785 - RNA, 64 nt, Human
gggaugagagaaagugggaccuggugggcucaaccacacacaccugucugugcagaugcuuugc

SEQ ID NO: 210786 - RNA, 64 nt, Human
acuucccaguuucaccaaagucuguuuauaucaacacacacaaaauggaauaauucugagucac

SEQ ID NO: 210787 - RNA, 64 nt, Human
uggcugggacacaagacaccaagucccuaggcugcacacacaugucaggggcugcccugacaug

SEQ ID NO: 210788 - RNA, 64 nt, Human
acauucacuauuuucacacacacacacacacacacacacacacgaauccacagcaauccaucag

SEQ ID NO: 210789 - RNA, 64 nt, Human
auacauucacuauuuucacacacacacacacacacacacacacacacacacacacacacacacg

SEQ ID NO: 210790 - RNA, 64 nt, Human
acauacauucacuauuuucacacacacacacacacacacacacacacacacacacacacacaca

SEQ ID NO: 210791 - RNA, 64 nt, Human
ccacauacauucacuauuuucacacacacacacacacacacacacacacacacacacacacaca

SEQ ID NO: 210792 - RNA, 64 nt, Human
ucccacauacauucacuauuuucacacacacacacacacacacacacacacacacacacacaca

SEQ ID NO: 210793 - RNA, 64 nt, Human
auucccacauacauucacuauuuucacacacacacacacacacacacacacacacacacacaca

SEQ ID NO: 210794 - RNA, 64 nt, Human
acauucccacauacauucacuauuuucacacacacacacacacacacacacacacacacacaca

SEQ ID NO: 210795 - RNA, 64 nt, Human
ucacauucccacauacauucacuauuuucacacacacacacacacacacacacacacacacaca

SEQ ID NO: 210796 - RNA, 64 nt, Human
acucacauucccacauacauucacuauuuucacacacacacacacacacacacacacacacaca

SEQ ID NO: 210797 - RNA, 64 nt, Human
auacucacauucccacauacauucacuauuuucacacacacacacacacacacacacacacaca

SEQ ID NO: 210798 - RNA, 64 nt, Human
aaauacucacauucccacauacauucacuauuuucacacacacacacacacacacacacacaca

SEQ ID NO: 210799 - RNA, 64 nt, Human
aggagcacuaccaucuguuuucaacaugaaaugccacacacauagaacuccaacaucaauuuca

SEQ ID NO: 210800 - RNA, 64 nt, Human
aacacaggcacacacaugcacacacccauaaacacacacacagugcuuuaagaaagggccaggu

SEQ ID NO: 210801 - RNA, 64 nt, Human
caaacacaggcacacacaugcacacacccauaaacacacacacagugcuuuaagaaagggccag

SEQ ID NO: 210802 - RNA, 64 nt, Human
aucugcaguugauguccccaaaugcaaacacaggcacacacaugcacacacccauaaacacaca

SEQ ID NO: 210803 - RNA, 64 nt, Human
agaauaugugugugugugugugcgucugcgagcgcacacacaugcacaagugcgaaggaguugc

SEQ ID NO: 210804 - RNA, 64 nt, Human
ccccccugcagccuuccccucuacacaggacaugcacacacaaguaacauugagcugcauggac

SEQ ID NO: 210805 - RNA, 64 nt, Human
gaauucaacacagagaaguugcugcuugugaucucacacacagauuuuuauguuuucuuucuca

SEQ ID NO: 210806 - RNA, 64 nt, Human
gcuuucugcuuaaaaacacacacacacacacacacacacacacggaaaaccuuuauuuuaaagu

SEQ ID NO: 210807 - RNA, 64 nt, Human
uagcuuucugcuuaaaaacacacacacacacacacacacacacacggaaaaccuuuauuuuaaa

SEQ ID NO: 210808 - RNA, 64 nt, Human
gauagcuuucugcuuaaaaacacacacacacacacacacacacacacggaaaaccuuuauuuua

SEQ ID NO: 210809 - RNA, 64 nt, Human
gggauagcuuucugcuuaaaaacacacacacacacacacacacacacacggaaaaccuuuauuu

SEQ ID NO: 210810 - RNA, 64 nt, Human
gagggauagcuuucugcuuaaaaacacacacacacacacacacacacacacggaaaaccuuuau

SEQ ID NO: 210811 - RNA, 64 nt, Human
uugagggauagcuuucugcuuaaaaacacacacacacacacacacacacacacggaaaaccuuu

SEQ ID NO: 210812 - RNA, 64 nt, Human
ccuugagggauagcuuucugcuuaaaaacacacacacacacacacacacacacacggaaaaccu

SEQ ID NO: 210813 - RNA, 64 nt, Human
aaccuugagggauagcuuucugcuuaaaaacacacacacacacacacacacacacacggaaaac

SEQ ID NO: 210814 - RNA, 64 nt, Human
uaaaccuugagggauagcuuucugcuuaaaaacacacacacacacacacacacacacacggaaa

SEQ ID NO: 210815 - RNA, 64 nt, Human
uguaaaccuugagggauagcuuucugcuuaaaaacacacacacacacacacacacacacacgga

SEQ ID NO: 210816 - RNA, 64 nt, Human
aacaugugcccgaacauacacacacacauauguacacacacaccucagaguacucuuucuuaca

SEQ ID NO: 210817 - RNA, 64 nt, Human
ugugacuguugaauaacaugugcccgaacauacacacacacauauguacacacacaccucagag

SEQ ID NO: 210818 - RNA, 64 nt, Human
ccugugacuguugaauaacaugugcccgaacauacacacacacauauguacacacacaccucag

SEQ ID NO: 210819 - RNA, 64 nt, Human
gaagcugaaauugaugaucccugaagguugaacccacacacaccccugcagccuccccagauga

SEQ ID NO: 210820 - RNA, 64 nt, Human
aaauguaacacacacacacauacacacacacacacacacacagagacacaucuuaaggggaccc

SEQ ID NO: 210821 - RNA, 64 nt, Human
acaaauguaacacacacacacauacacacacacacacacacacagagacacaucuuaaggggac

SEQ ID NO: 210822 - RNA, 64 nt, Human
agacaaauguaacacacacacacauacacacacacacacacacacagagacacaucuuaagggg

SEQ ID NO: 210823 - RNA, 64 nt, Human
ucagacaaauguaacacacacacacauacacacacacacacacacacagagacacaucuuaagg

SEQ ID NO: 210824 - RNA, 64 nt, Human
guucagacaaauguaacacacacacacauacacacacacacacacacacagagacacaucuuaa

SEQ ID NO: 210825 - RNA, 64 nt, Human
caguucagacaaauguaacacacacacacauacacacacacacacacacacagagacacaucuu

SEQ ID NO: 210826 - RNA, 64 nt, Human
ugcaguucagacaaauguaacacacacacacauacacacacacacacacacacagagacacauc

SEQ ID NO: 210827 - RNA, 64 nt, Human
gcuugguuguugcaguucagacaaauguaacacacacacacauacacacacacacacacacaca

SEQ ID NO: 210828 - RNA, 64 nt, Human
augcuugguuguugcaguucagacaaauguaacacacacacacauacacacacacacacacaca

SEQ ID NO: 210829 - RNA, 64 nt, Human
ccaugcuugguuguugcaguucagacaaauguaacacacacacacauacacacacacacacaca

SEQ ID NO: 210830 - RNA, 64 nt, Human
gcuuugggacuuuaaagaugcagaaguauuagaacacacacaaacuuaaaauggaaaguuacca

SEQ ID NO: 210831 - RNA, 64 nt, Human
uaugucauugguuucugaugcuuguacaaacacgcacacacaaauggauaaaacagcaccucug

SEQ ID NO: 210832 - RNA, 64 nt, Human
guuaguguaagcugauaaaaacguagcuaccguacacacacaucaaucacucaauuuccugucc

SEQ ID NO: 210833 - RNA, 64 nt, Human
cacacacacacacauauacacacacucacagacccacacacauacacacugucaugcacucaac

SEQ ID NO: 210834 - RNA, 64 nt, Human
cucacuuauaaaccucuguacacacacacacacacacacacauauacacacacucacagaccca

SEQ ID NO: 210835 - RNA, 64 nt, Human
uucucacuuauaaaccucuguacacacacacacacacacacacauauacacacacucacagacc

SEQ ID NO: 210836 - RNA, 64 nt, Human
aguucucacuuauaaaccucuguacacacacacacacacacacacauauacacacacucacaga

SEQ ID NO: 210837 - RNA, 64 nt, Human
aaaguucucacuuauaaaccucuguacacacacacacacacacacacauauacacacacucaca

SEQ ID NO: 210838 - RNA, 64 nt, Human
agaaaguucucacuuauaaaccucuguacacacacacacacacacacacauauacacacacuca

SEQ ID NO: 210839 - RNA, 64 nt, Human
gaagaaaguucucacuuauaaaccucuguacacacacacacacacacacacauauacacacacu

SEQ ID NO: 210840 - RNA, 64 nt, Human
cagaagaaaguucucacuuauaaaccucuguacacacacacacacacacacacauauacacaca

SEQ ID NO: 210841 - RNA, 64 nt, Human
cgcagaagaaaguucucacuuauaaaccucuguacacacacacacacacacacacauauacaca

SEQ ID NO: 210842 - RNA, 64 nt, Human
acaaauauguguguauaaaauaaacauacacacacacacacaccccuauguaguuuuuaaaaca

SEQ ID NO: 210843 - RNA, 64 nt, Human
auacaaauauguguguauaaaauaaacauacacacacacacacaccccuauguaguuuuuaaaa

SEQ ID NO: 210844 - RNA, 64 nt, Human
auauacaaauauguguguauaaaauaaacauacacacacacacacaccccuauguaguuuuuaa

SEQ ID NO: 210845 - RNA, 64 nt, Human
gaauauacaaauauguguguauaaaauaaacauacacacacacacacaccccuauguaguuuuu

SEQ ID NO: 210846 - RNA, 64 nt, Human
acaggacacacacacacacacacacacacacacacacacacaccccuagagaaaaguacagauu

SEQ ID NO: 210847 - RNA, 64 nt, Human
uuacaggacacacacacacacacacacacacacacacacacacaccccuagagaaaaguacaga

SEQ ID NO: 210848 - RNA, 64 nt, Human
guuuacaggacacacacacacacacacacacacacacacacacacaccccuagagaaaaguaca

SEQ ID NO: 210849 - RNA, 64 nt, Human
auguuuacaggacacacacacacacacacacacacacacacacacacaccccuagagaaaagua

SEQ ID NO: 210850 - RNA, 64 nt, Human
agauguuuacaggacacacacacacacacacacacacacacacacacacaccccuagagaaaag

SEQ ID NO: 210851 - RNA, 64 nt, Human
aaagauguuuacaggacacacacacacacacacacacacacacacacacacaccccuagagaaa

SEQ ID NO: 210852 - RNA, 64 nt, Human
ucaaagauguuuacaggacacacacacacacacacacacacacacacacacacaccccuagaga

SEQ ID NO: 210853 - RNA, 64 nt, Human
guucaaagauguuuacaggacacacacacacacacacacacacacacacacacacaccccuaga

SEQ ID NO: 210854 - RNA, 64 nt, Human
ugguucaaagauguuuacaggacacacacacacacacacacacacacacacacacacaccccua

SEQ ID NO: 210855 - RNA, 64 nt, Human
uuugguucaaagauguuuacaggacacacacacacacacacacacacacacacacacacacccc

SEQ ID NO: 210856 - RNA, 64 nt, Human
gauuugguucaaagauguuuacaggacacacacacacacacacacacacacacacacacacacc

SEQ ID NO: 210857 - RNA, 64 nt, Human
gugauuugguucaaagauguuuacaggacacacacacacacacacacacacacacacacacaca

SEQ ID NO: 210858 - RNA, 64 nt, Human
uagugauuugguucaaagauguuuacaggacacacacacacacacacacacacacacacacaca

SEQ ID NO: 210859 - RNA, 64 nt, Human
uauagugauuugguucaaagauguuuacaggacacacacacacacacacacacacacacacaca

SEQ ID NO: 210860 - RNA, 64 nt, Human
uuuauagugauuugguucaaagauguuuacaggacacacacacacacacacacacacacacaca

SEQ ID NO: 210861 - RNA, 64 nt, Human
uguauguguguauacacacacacagacacacacacacacacacgggaugaauggagccuuaaag

SEQ ID NO: 210862 - RNA, 64 nt, Human
uguguauguguguauacacacacacagacacacacacacacacacgggaugaauggagccuuaa

SEQ ID NO: 210863 - RNA, 64 nt, Human
ucuguguauguguguauacacacacacagacacacacacacacacacgggaugaauggagccuu

SEQ ID NO: 210864 - RNA, 64 nt, Human
uaucuguguauguguguauacacacacacagacacacacacacacacacgggaugaauggagcc

SEQ ID NO: 210865 - RNA, 64 nt, Human
uauaucuguguauguguguauacacacacacagacacacacacacacacacgggaugaauggag

SEQ ID NO: 210866 - RNA, 64 nt, Human
guuguaaauauauaucuguguauguguguauacacacacacagacacacacacacacacacggg

SEQ ID NO: 210867 - RNA, 64 nt, Human
auguuguaaauauauaucuguguauguguguauacacacacacagacacacacacacacacacg

SEQ ID NO: 210868 - RNA, 64 nt, Human
acagcuucuugcacucacaacggacacuuugcuccacacacauaauggcagcucacacagggac

SEQ ID NO: 210869 - RNA, 64 nt, Human
uauuuaaauuucuacucacaauuugaucaucacacacacacaaauccuugaauaucauugccag

SEQ ID NO: 210870 - RNA, 64 nt, Human
acuauuuaaauuucuacucacaauuugaucaucacacacacacaaauccuugaauaucauugcc

SEQ ID NO: 210871 - RNA, 64 nt, Human
agacuauuuaaauuucuacucacaauuugaucaucacacacacacaaauccuugaauaucauug

SEQ ID NO: 210872 - RNA, 64 nt, Human
gcagggugcucacacacccccacacccacccacccacacacaacacugggacaauucagacacg

SEQ ID NO: 210873 - RNA, 64 nt, Human
aaagaaucagcuagaguugucaugauaaagucagcacacacaaaaaggcuucuuacacauaccu

SEQ ID NO: 210874 - RNA, 64 nt, Human
acacugacuugauacagcaugaaguuucuagugccacacacaguauuuagaaaaccuuuaggcg

SEQ ID NO: 210875 - RNA, 64 nt, Human
aauguuuucacugacucauugaaaauguuaauuacacacacaugcaugcaugcacacacgagca

SEQ ID NO: 210876 - RNA, 64 nt, Human
cuauacucagcccagguacgagaaggaacucaaccacacacagcagcugccugguaaguggacc

SEQ ID NO: 210877 - RNA, 64 nt, Human
ugggcacaugggcacauacagacucacauacagacacacacauauauguacagacauguacucu

SEQ ID NO: 210878 - RNA, 64 nt, Human
cagacacacacauauauguacagacauguacucucacacacacaggcaccagcauacacacguu

SEQ ID NO: 210879 - RNA, 64 nt, Human
gacacacacauauauguacagacauguacucucacacacacaggcaccagcauacacacguuuu

SEQ ID NO: 210880 - RNA, 64 nt, Human
uuuuuuuaguuguuucccuucacuuucagucuuccacacacaaaaaauaccucacagagcuuca

SEQ ID NO: 210881 - RNA, 64 nt, Human
gucugccacacaaacguauguaaauguauauacccacacacauacacacauaugucauauauua

SEQ ID NO: 210882 - RNA, 64 nt, Human
ccaguauuucaucaaggacagggaauaucccucccacacacaggccagcugcucacccugccac

SEQ ID NO: 210883 - RNA, 64 nt, Human
cuuggacagcagauccacacaccacuuccccacccacacacaguacccugggcugguuggacaa

SEQ ID NO: 210884 - RNA, 64 nt, Human
cuagacaucugucuaaguaaucagacucagguuccacacacaagcaacaacucgugggccucuu

SEQ ID NO: 210885 - RNA, 64 nt, Human
uuacuguucuucagauuuaguacuuguaaauaaacacacacauuaaggagagauuaaacauuuu

SEQ ID NO: 210886 - RNA, 64 nt, Human
ccccaucaaacacaguuacaccccacauaucucucacacacacacacacacgcacacacacaca

SEQ ID NO: 210887 - RNA, 64 nt, Human
ccaucaaacacaguuacaccccacauaucucucacacacacacacacacgcacacacacacaca

SEQ ID NO: 210888 - RNA, 64 nt, Human
aucaaacacaguuacaccccacauaucucucacacacacacacacacgcacacacacacacaca

SEQ ID NO: 210889 - RNA, 64 nt, Human
caaacacaguuacaccccacauaucucucacacacacacacacacgcacacacacacacacaga

SEQ ID NO: 210890 - RNA, 64 nt, Human
aacacaguuacaccccacauaucucucacacacacacacacacgcacacacacacacacagauc

SEQ ID NO: 210891 - RNA, 64 nt, Human
caccccacauaucucucacacacacacacacacgcacacacacacacacagaucugacguaauc

SEQ ID NO: 210892 - RNA, 64 nt, Human
ccccacauaucucucacacacacacacacacgcacacacacacacacagaucugacguaaucaa

SEQ ID NO: 210893 - RNA, 64 nt, Human
ccacauaucucucacacacacacacacacgcacacacacacacacagaucugacguaaucaaac

SEQ ID NO: 210894 - RNA, 64 nt, Human
acauaucucucacacacacacacacacgcacacacacacacacagaucugacguaaucaaacuc

SEQ ID NO: 210895 - RNA, 64 nt, Human
auaucucucacacacacacacacacgcacacacacacacacagaucugacguaaucaaacucca

SEQ ID NO: 210896 - RNA, 64 nt, Human
auaagccugagccccucccucccagccccauauucacacacaucccagccccuggccuugcccu

SEQ ID NO: 210897 - RNA, 64 nt, Human
augacuaauaaggaagauauguguguauuucauacacacacaaggaccuggauuaaaaauccaa

SEQ ID NO: 210898 - RNA, 64 nt, Human
aacaaccucagacucaucacaaaguagacauauacacacacauauauguauguauauuuuucuc

SEQ ID NO: 210899 - RNA, 64 nt, Human
agcccacauauucuauuauagauauauaaauaaucacacacacacuugcugucaauguuuugag

SEQ ID NO: 210900 - RNA, 64 nt, Human
cccacauauucuauuauagauauauaaauaaucacacacacacuugcugucaauguuuugaguc

SEQ ID NO: 210901 - RNA, 64 nt, Human
aaguacaaguagaggaguuuuuuauuuuauauaucacacacacacacacacacacacacacaca

SEQ ID NO: 210902 - RNA, 64 nt, Human
guacaaguagaggaguuuuuuauuuuauauaucacacacacacacacacacacacacacacaca

SEQ ID NO: 210903 - RNA, 64 nt, Human
acaaguagaggaguuuuuuauuuuauauaucacacacacacacacacacacacacacacacaca

SEQ ID NO: 210904 - RNA, 64 nt, Human
aaguagaggaguuuuuuauuuuauauaucacacacacacacacacacacacacacacacacaca

SEQ ID NO: 210905 - RNA, 64 nt, Human
guagaggaguuuuuuauuuuauauaucacacacacacacacacacacacacacacacacacaca

SEQ ID NO: 210906 - RNA, 64 nt, Human
agaggaguuuuuuauuuuauauaucacacacacacacacacacacacacacacacacacacaua

SEQ ID NO: 210907 - RNA, 64 nt, Human
aggaguuuuuuauuuuauauaucacacacacacacacacacacacacacacacacacacauaua

SEQ ID NO: 210908 - RNA, 64 nt, Human
gaguuuuuuauuuuauauaucacacacacacacacacacacacacacacacacacacauauaug

SEQ ID NO: 210909 - RNA, 64 nt, Human
guuuuuuauuuuauauaucacacacacacacacacacacacacacacacacacacauauaugau

SEQ ID NO: 210910 - RNA, 64 nt, Human
uuuuuauuuuauauaucacacacacacacacacacacacacacacacacacacauauaugauac

SEQ ID NO: 210911 - RNA, 64 nt, Human
uuuauuuuauauaucacacacacacacacacacacacacacacacacacacauauaugauacaa

SEQ ID NO: 210912 - RNA, 64 nt, Human
uauuuuauauaucacacacacacacacacacacacacacacacacacacauauaugauacaaau

SEQ ID NO: 210913 - RNA, 64 nt, Human
uuuuauauaucacacacacacacacacacacacacacacacacacacauauaugauacaaaugc

SEQ ID NO: 210914 - RNA, 64 nt, Human
uuauauaucacacacacacacacacacacacacacacacacacacauauaugauacaaaugcuu

SEQ ID NO: 210915 - RNA, 64 nt, Human
auauaucacacacacacacacacacacacacacacacacacacauauaugauacaaaugcuuuc

SEQ ID NO: 210916 - RNA, 64 nt, Human
auaucacacacacacacacacacacacacacacacacacacauauaugauacaaaugcuuucag

SEQ ID NO: 210917 - RNA, 64 nt, Human
ggucauuagccauauuguauauaucgucaagcaacacacacaaaaguuccucagccacaagaca

SEQ ID NO: 210918 - RNA, 64 nt, Human
gaaaaauaaaguaggcaugaauaaauguucaggacacacacauacacucacacacaucacagua

SEQ ID NO: 210919 - RNA, 64 nt, Human
gcaugaauaaauguucaggacacacacauacacucacacacaucacaguaucagcucuuucagu

SEQ ID NO: 210920 - RNA, 64 nt, Human
acucgccuugcaaccgacaggccauucccacccccacacacaaccuccccuguuuucacauuca

SEQ ID NO: 210921 - RNA, 64 nt, Human
uagccagacaguuuaugagcccagagccuccugccacacacaugcacacauaucuagcauucuu

SEQ ID NO: 210922 - RNA, 64 nt, Human
aucuccacaaacacaaauuauauauauacauauccacacacauacauuacauauaucuguguau

SEQ ID NO: 210923 - RNA, 64 nt, Human
uccaauaucuuaaaaaggaguuuuccuuuagaaacacacacacccuuccucuugcucaaaagau

SEQ ID NO: 210924 - RNA, 64 nt, Human
agaaaauccuaaggaacucacacacacacacacacacacacacgcacacagcuauuagaacuaa

SEQ ID NO: 210925 - RNA, 64 nt, Human
auagaaaauccuaaggaacucacacacacacacacacacacacacgcacacagcuauuagaacu

SEQ ID NO: 210926 - RNA, 64 nt, Human
auauagaaaauccuaaggaacucacacacacacacacacacacacacgcacacagcuauuagaa

SEQ ID NO: 210927 - RNA, 64 nt, Human
guauauagaaaauccuaaggaacucacacacacacacacacacacacacgcacacagcuauuag

SEQ ID NO: 210928 - RNA, 64 nt, Human
uuguauauagaaaauccuaaggaacucacacacacacacacacacacacacgcacacagcuauu

SEQ ID NO: 210929 - RNA, 64 nt, Human
uuuuguauauagaaaauccuaaggaacucacacacacacacacacacacacacgcacacagcua

SEQ ID NO: 210930 - RNA, 64 nt, Human
aguuuuguauauagaaaauccuaaggaacucacacacacacacacacacacacacgcacacagc

SEQ ID NO: 210931 - RNA, 64 nt, Human
acaguuuuguauauagaaaauccuaaggaacucacacacacacacacacacacacacgcacaca

SEQ ID NO: 210932 - RNA, 64 nt, Human
acacaguuuuguauauagaaaauccuaaggaacucacacacacacacacacacacacacgcaca

SEQ ID NO: 210933 - RNA, 64 nt, Human
ggaaauggcugaugaguucacauuuagggauguacacacacagauggcagacgucuccccacuc

SEQ ID NO: 210934 - RNA, 64 nt, Human
cuuacaauaguccucccucuguuccugacccccucacacacacuggaaagugagggugggggcu

SEQ ID NO: 210935 - RNA, 64 nt, Human
cccccucacucucacacuugcacacauacacacacacacacacgaaaugguugguuugucaaaa

SEQ ID NO: 210936 - RNA, 64 nt, Human
cacccccucacucucacacuugcacacauacacacacacacacacgaaaugguugguuugucaa

SEQ ID NO: 210937 - RNA, 64 nt, Human
ugcacccccucacucucacacuugcacacauacacacacacacacacgaaaugguugguuuguc

SEQ ID NO: 210938 - RNA, 64 nt, Human
caugcacccccucacucucacacuugcacacauacacacacacacacacgaaaugguugguuug

SEQ ID NO: 210939 - RNA, 64 nt, Human
ucccacgauaucuaaaugaaaaagaaagaaaacccacacacaaagcaaaaacucaaguauuaag

SEQ ID NO: 210940 - RNA, 64 nt, Human
acccaggccguggacuuggcugagcacuguuagacacacacagaccugcaggcuguuuuagaau

SEQ ID NO: 210941 - RNA, 64 nt, Human
gauauacauauauacauauauauguauauauauacacacacauacauauguguguguauaguau

SEQ ID NO: 210942 - RNA, 64 nt, Human
aaguuaaaauuauauauauauauauauauacacacacacacauauauauauauauauaauucaa

SEQ ID NO: 210943 - RNA, 64 nt, Human
aaaaguuaaaauuauauauauauauauauauacacacacacacauauauauauauauauaauuc

SEQ ID NO: 210944 - RNA, 64 nt, Human
ucaaaaguuaaaauuauauauauauauauauauacacacacacacauauauauauauauauaau

SEQ ID NO: 210945 - RNA, 64 nt, Human
uucggggcacguguguguacacaccguauacguucacacacaugcacuauguaaacaucugagu

SEQ ID NO: 210946 - RNA, 64 nt, Human
cugggagggcugaacccccacucacacaagcacacacacacaguccucacacacggaggccaga

SEQ ID NO: 210947 - RNA, 64 nt, Human
ugcugggagggcugaacccccacucacacaagcacacacacacaguccucacacacggaggcca

SEQ ID NO: 210948 - RNA, 64 nt, Human
gaugcugggagggcugaacccccacucacacaagcacacacacacaguccucacacacggaggc

SEQ ID NO: 210949 - RNA, 64 nt, Human
cccagcugcuuguggaggauguaauauauacagacacacacauguuuuucacacaggccuggcc

SEQ ID NO: 210950 - RNA, 64 nt, Human
uccuagguacuagcccuggauguccccauggcuucacacacagaagagcccuugguuacccuaa

SEQ ID NO: 210951 - RNA, 64 nt, Human
gacagagacaaaaaugaggaaaacuaggggaccccacacacauguggcuaccauacuccugaac

SEQ ID NO: 210952 - RNA, 64 nt, Human
gaauggugcugaugguaaaguuugagacuuuugccacacacaaauuugugaaaauuaaacgaga

SEQ ID NO: 210953 - RNA, 64 nt, Human
gcaucuccccugggaccagcuggagggccacaugcacacacagccuagcugcccccagggagcu

SEQ ID NO: 210954 - RNA, 64 nt, Human
uccaggugcuacccaggaguccccuccauguacacacacacaacucagggaaggagguccuggg

SEQ ID NO: 210955 - RNA, 64 nt, Human
ccuccaggugcuacccaggaguccccuccauguacacacacacaacucagggaaggagguccug

SEQ ID NO: 210956 - RNA, 64 nt, Human
guacacucagccacugucacaggcauauucccugcacacacaugcauacuuacagacuggaaua

SEQ ID NO: 210957 - RNA, 64 nt, Human
ugucccucccuugcugaacacacacacacacacacacacacagguggggacugggcacagcucu

SEQ ID NO: 210958 - RNA, 64 nt, Human
acugucccucccuugcugaacacacacacacacacacacacacagguggggacugggcacagcu

SEQ ID NO: 210959 - RNA, 64 nt, Human
aaacugucccucccuugcugaacacacacacacacacacacacacagguggggacugggcacag

SEQ ID NO: 210960 - RNA, 64 nt, Human
ccaaacugucccucccuugcugaacacacacacacacacacacacacagguggggacugggcac

SEQ ID NO: 210961 - RNA, 64 nt, Human
ggccaaacugucccucccuugcugaacacacacacacacacacacacacagguggggacugggc

SEQ ID NO: 210962 - RNA, 64 nt, Human
gaggccaaacugucccucccuugcugaacacacacacacacacacacacacagguggggacugg

SEQ ID NO: 210963 - RNA, 64 nt, Human
aggaggccaaacugucccucccuugcugaacacacacacacacacacacacacagguggggacu

SEQ ID NO: 210964 - RNA, 64 nt, Human
gcaggaggccaaacugucccucccuugcugaacacacacacacacacacacacacaggugggga

SEQ ID NO: 210965 - RNA, 64 nt, Human
uugcaggaggccaaacugucccucccuugcugaacacacacacacacacacacacacagguggg

SEQ ID NO: 210966 - RNA, 64 nt, Human
ccugugcccacucccuaucuccuucccaccccuacacacacacucccugcuugcaggaggccaa

SEQ ID NO: 210967 - RNA, 64 nt, Human
acauucgacauaccccacugggcacacgcacaaacacacacacuauggggugggguggguguag

SEQ ID NO: 210968 - RNA, 64 nt, Human
accuggcagccagagguccccagugggccgggcucacacacaaaugaugcuucagacccgaaug

SEQ ID NO: 210969 - RNA, 64 nt, Human
guuggucaucgugcagaaggccccaggaccucagcacacacagccuccucuuggucugaguagg

SEQ ID NO: 210970 - RNA, 64 nt, Human
acaugcaaaacauacacacacacacacacacacacacacacacgcagaguugugauucucagua

SEQ ID NO: 210971 - RNA, 64 nt, Human
aaacaugcaaaacauacacacacacacacacacacacacacacacgcagaguugugauucucag

SEQ ID NO: 210972 - RNA, 64 nt, Human
gaaaacaugcaaaacauacacacacacacacacacacacacacacacgcagaguugugauucuc

SEQ ID NO: 210973 - RNA, 64 nt, Human
aggaaaacaugcaaaacauacacacacacacacacacacacacacacacgcagaguugugauuc

SEQ ID NO: 210974 - RNA, 64 nt, Human
aaaggaaaacaugcaaaacauacacacacacacacacacacacacacacacgcagaguugugau

SEQ ID NO: 210975 - RNA, 64 nt, Human
ggaaaggaaaacaugcaaaacauacacacacacacacacacacacacacacacgcagaguugug

SEQ ID NO: 210976 - RNA, 64 nt, Human
uaggaaaggaaaacaugcaaaacauacacacacacacacacacacacacacacacgcagaguug

SEQ ID NO: 210977 - RNA, 64 nt, Human
gguaggaaaggaaaacaugcaaaacauacacacacacacacacacacacacacacacgcagagu

SEQ ID NO: 210978 - RNA, 64 nt, Human
gugguaggaaaggaaaacaugcaaaacauacacacacacacacacacacacacacacacgcaga

SEQ ID NO: 210979 - RNA, 64 nt, Human
uugugguaggaaaggaaaacaugcaaaacauacacacacacacacacacacacacacacacgca

SEQ ID NO: 210980 - RNA, 64 nt, Human
guuugugguaggaaaggaaaacaugcaaaacauacacacacacacacacacacacacacacacg

SEQ ID NO: 210981 - RNA, 64 nt, Human
gacaagcuuuugguuuuggcuaaauacacacacacacacacacgcucauauguguuuacucugu

SEQ ID NO: 210982 - RNA, 64 nt, Human
uugacaagcuuuugguuuuggcuaaauacacacacacacacacacgcucauauguguuuacucu

SEQ ID NO: 210983 - RNA, 64 nt, Human
uauugacaagcuuuugguuuuggcuaaauacacacacacacacacacgcucauauguguuuacu

SEQ ID NO: 210984 - RNA, 64 nt, Human
guuauugacaagcuuuugguuuuggcuaaauacacacacacacacacacgcucauauguguuua

SEQ ID NO: 210985 - RNA, 64 nt, Human
uaguuauugacaagcuuuugguuuuggcuaaauacacacacacacacacacgcucauauguguu

SEQ ID NO: 210986 - RNA, 64 nt, Human
caaaaugguguuauuuaauugucuccaccauugucacacacaggaaugccuaauaauagcaacc

SEQ ID NO: 210987 - RNA, 64 nt, Human
uucuuuuucuuuucucuguauccucaucguuagccacacacagauuuguguggcuuuuauugua

SEQ ID NO: 210988 - RNA, 64 nt, Human
uucaggaacacacacacacacacacucacacacgcacacacaaucacaauuugcuacagcaaca

SEQ ID NO: 210989 - RNA, 64 nt, Human
cugcuggcccuucaucuguucaggaacacacacacacacacacucacacacgcacacacaauca

SEQ ID NO: 210990 - RNA, 64 nt, Human
cucugcuggcccuucaucuguucaggaacacacacacacacacacucacacacgcacacacaau

SEQ ID NO: 210991 - RNA, 64 nt, Human
gucucugcuggcccuucaucuguucaggaacacacacacacacacacucacacacgcacacaca

SEQ ID NO: 210992 - RNA, 64 nt, Human
gagucucugcuggcccuucaucuguucaggaacacacacacacacacacucacacacgcacaca

SEQ ID NO: 210993 - RNA, 64 nt, Human
gggagucucugcuggcccuucaucuguucaggaacacacacacacacacacucacacacgcaca

SEQ ID NO: 210994 - RNA, 64 nt, Human
uggccaccaacacacaaccacacacacacaaccacacacacaaaugggggcaaccacauccagu

SEQ ID NO: 210995 - RNA, 64 nt, Human
uguggccaccaacacacaaccacacacacacaaccacacacacaaaugggggcaaccacaucca

SEQ ID NO: 210996 - RNA, 64 nt, Human
gaggcucagcuguggccaccaacacacaaccacacacacacaaccacacacacaaaugggggca

SEQ ID NO: 210997 - RNA, 64 nt, Human
cagaggcucagcuguggccaccaacacacaaccacacacacacaaccacacacacaaauggggg

SEQ ID NO: 210998 - RNA, 64 nt, Human
gacagaggcucagcuguggccaccaacacacaaccacacacacacaaccacacacacaaauggg

SEQ ID NO: 210999 - RNA, 64 nt, Human
caugaauuuauuuauaugaaggcucucacagagacacacacagcacuucaguagcauuugcauu

SEQ ID NO: 211000 - RNA, 64 nt, Human
uaaaacaguagaaacucaguucccuucucaggggcacacacauccaaggcaccguggacugugu

SEQ ID NO: 211001 - RNA, 64 nt, Human
augggauuauguaugauauauauauauauacacacacacacaaagggauagagagauuaccucu

SEQ ID NO: 211002 - RNA, 64 nt, Human
auaugggauuauguaugauauauauauauauacacacacacacaaagggauagagagauuaccu

SEQ ID NO: 211003 - RNA, 64 nt, Human
agauaugggauuauguaugauauauauauauauacacacacacacaaagggauagagagauuac

SEQ ID NO: 211004 - RNA, 64 nt, Human
gcuuuguaggaagcacuuuuaauguuuucucucucacacacaaagauucaaaagaaaugugcau

SEQ ID NO: 211005 - RNA, 64 nt, Human
uacacacacacacacacacacacacacacacacacacacacacuccauaccauuuccauucaac

SEQ ID NO: 211006 - RNA, 64 nt, Human
gguacacacacacacacacacacacacacacacacacacacacacuccauaccauuuccauuca

SEQ ID NO: 211007 - RNA, 64 nt, Human
cagguacacacacacacacacacacacacacacacacacacacacacuccauaccauuuccauu

SEQ ID NO: 211008 - RNA, 64 nt, Human
ugcagguacacacacacacacacacacacacacacacacacacacacacuccauaccauuucca

SEQ ID NO: 211009 - RNA, 64 nt, Human
ggugcagguacacacacacacacacacacacacacacacacacacacacacuccauaccauuuc

SEQ ID NO: 211010 - RNA, 64 nt, Human
cuggugcagguacacacacacacacacacacacacacacacacacacacacacuccauaccauu

SEQ ID NO: 211011 - RNA, 64 nt, Human
ugcuggugcagguacacacacacacacacacacacacacacacacacacacacacuccauacca

SEQ ID NO: 211012 - RNA, 64 nt, Human
ccugcuggugcagguacacacacacacacacacacacacacacacacacacacacacuccauac

SEQ ID NO: 211013 - RNA, 64 nt, Human
uuccugcuggugcagguacacacacacacacacacacacacacacacacacacacacacuccau

SEQ ID NO: 211014 - RNA, 64 nt, Human
ucuuccugcuggugcagguacacacacacacacacacacacacacacacacacacacacacucc

SEQ ID NO: 211015 - RNA, 64 nt, Human
uuucuuccugcuggugcagguacacacacacacacacacacacacacacacacacacacacacu

SEQ ID NO: 211016 - RNA, 64 nt, Human
aguuucuuccugcuggugcagguacacacacacacacacacacacacacacacacacacacaca

SEQ ID NO: 211017 - RNA, 64 nt, Human
gcaguuucuuccugcuggugcagguacacacacacacacacacacacacacacacacacacaca

SEQ ID NO: 211018 - RNA, 64 nt, Human
cugcaguuucuuccugcuggugcagguacacacacacacacacacacacacacacacacacaca

SEQ ID NO: 211019 - RNA, 64 nt, Human
accugcaguuucuuccugcuggugcagguacacacacacacacacacacacacacacacacaca

SEQ ID NO: 211020 - RNA, 64 nt, Human
aaaccugcaguuucuuccugcuggugcagguacacacacacacacacacacacacacacacaca

SEQ ID NO: 211021 - RNA, 64 nt, Human
cuaaaccugcaguuucuuccugcuggugcagguacacacacacacacacacacacacacacaca

SEQ ID NO: 211022 - RNA, 64 nt, Human
uaagucauacauucauuuugacuccuuucaaugucacacacauaguauugaucagaaaucuuau

SEQ ID NO: 211023 - RNA, 64 nt, Human
acaauuuaugugcacacucacacaugcacacacacacacacauacacacucuucucuaaccagu

SEQ ID NO: 211024 - RNA, 64 nt, Human
acacaauuuaugugcacacucacacaugcacacacacacacacauacacacucuucucuaacca

SEQ ID NO: 211025 - RNA, 64 nt, Human
acacacaauuuaugugcacacucacacaugcacacacacacacacauacacacucuucucuaac

SEQ ID NO: 211026 - RNA, 64 nt, Human
ucacacacaauuuaugugcacacucacacaugcacacacacacacacauacacacucuucucua

SEQ ID NO: 211027 - RNA, 64 nt, Human
acucacacacaauuuaugugcacacucacacaugcacacacacacacacauacacacucuucuc

SEQ ID NO: 211028 - RNA, 64 nt, Human
ccaagagagaaagcaagaaacuauaaugcacacucacacacaauuuaugugcacacucacacau

SEQ ID NO: 211029 - RNA, 64 nt, Human
cucccccaaacacacacacacacacacacacacacacacacaauuaaguugcugcaaauucaaa

SEQ ID NO: 211030 - RNA, 64 nt, Human
uccucccccaaacacacacacacacacacacacacacacacacaauuaaguugcugcaaauuca

SEQ ID NO: 211031 - RNA, 64 nt, Human
ccuccucccccaaacacacacacacacacacacacacacacacacacacacaauuaaguugcug

SEQ ID NO: 211032 - RNA, 64 nt, Human
caccuccucccccaaacacacacacacacacacacacacacacacacacacacaauuaaguugc

SEQ ID NO: 211033 - RNA, 64 nt, Human
uucaccuccucccccaaacacacacacacacacacacacacacacacacacacacaauuaaguu

SEQ ID NO: 211034 - RNA, 64 nt, Human
aguucaccuccucccccaaacacacacacacacacacacacacacacacacacacacaauuaag

SEQ ID NO: 211035 - RNA, 64 nt, Human
ccaguucaccuccucccccaaacacacacacacacacacacacacacacacacacacacaauua

SEQ ID NO: 211036 - RNA, 64 nt, Human
gcccaguucaccuccucccccaaacacacacacacacacacacacacacacacacacacacaau

SEQ ID NO: 211037 - RNA, 64 nt, Human
aagcccaguucaccuccucccccaaacacacacacacacacacacacacacacacacacacaca

SEQ ID NO: 211038 - RNA, 64 nt, Human
caaagcccaguucaccuccucccccaaacacacacacacacacacacacacacacacacacaca

SEQ ID NO: 211039 - RNA, 64 nt, Human
aucaaagcccaguucaccuccucccccaaacacacacacacacacacacacacacacacacaca

SEQ ID NO: 211040 - RNA, 64 nt, Human
cuaucaaagcccaguucaccuccucccccaaacacacacacacacacacacacacacacacaca

SEQ ID NO: 211041 - RNA, 64 nt, Human
aucuaucaaagcccaguucaccuccucccccaaacacacacacacacacacacacacacacaca

SEQ ID NO: 211042 - RNA, 64 nt, Human
uuguguuucuguuuuaaggcucuguuagaaauuacacacacaguauauuguaaauucuuaucuc

SEQ ID NO: 211043 - RNA, 64 nt, Human
gagagggugggcccugugcuggggggccuugggucacacacaggaaccgagaccuggcuuccac

SEQ ID NO: 211044 - RNA, 64 nt, Human
cuagccugugcacgcgcgcgugcacacacacacacacacacacgaguucauaauguggugaugg

SEQ ID NO: 211045 - RNA, 64 nt, Human
cacuagccugugcacgcgcgcgugcacacacacacacacacacacgaguucauaauguggugau

SEQ ID NO: 211046 - RNA, 64 nt, Human
gacacuagccugugcacgcgcgcgugcacacacacacacacacacacgaguucauaauguggug

SEQ ID NO: 211047 - RNA, 64 nt, Human
aggacacuagccugugcacgcgcgcgugcacacacacacacacacacacgaguucauaaugugg

SEQ ID NO: 211048 - RNA, 64 nt, Human
gaaggacacuagccugugcacgcgcgcgugcacacacacacacacacacacgaguucauaaugu

SEQ ID NO: 211049 - RNA, 64 nt, Human
cagaaggacacuagccugugcacgcgcgcgugcacacacacacacacacacacgaguucauaau

SEQ ID NO: 211050 - RNA, 64 nt, Human
cacagaaggacacuagccugugcacgcgcgcgugcacacacacacacacacacacgaguucaua

SEQ ID NO: 211051 - RNA, 64 nt, Human
ggucauguuuuugucacauuagagaauaaacagccacacacacauuuuuuuuuuuccuuuaaaa

SEQ ID NO: 211052 - RNA, 64 nt, Human
ucauguuuuugucacauuagagaauaaacagccacacacacauuuuuuuuuuuccuuuaaaaca

SEQ ID NO: 211053 - RNA, 64 nt, Human
ccaggcagucugugugugaggcauagccccuggacacacacacacagacacacacacugccugg

SEQ ID NO: 211054 - RNA, 64 nt, Human
aggcagucugugugugaggcauagccccuggacacacacacacagacacacacacugccuggau

SEQ ID NO: 211055 - RNA, 64 nt, Human
gcagucugugugugaggcauagccccuggacacacacacacagacacacacacugccuggaugc

SEQ ID NO: 211056 - RNA, 64 nt, Human
ugugaggcauagccccuggacacacacacacagacacacacacugccuggaugcauguaugcac

SEQ ID NO: 211057 - RNA, 64 nt, Human
acacagacacacacacugccuggaugcauguaugcacacacaugcgcgcacacgugcucccuga

SEQ ID NO: 211058 - RNA, 64 nt, Human
acacgcacacccaugcgcagaugugcugccuggacacacacacacacacggauaugcugucugg

SEQ ID NO: 211059 - RNA, 64 nt, Human
acgcacacccaugcgcagaugugcugccuggacacacacacacacacggauaugcugucuggac

SEQ ID NO: 211060 - RNA, 64 nt, Human
gcacacccaugcgcagaugugcugccuggacacacacacacacacggauaugcugucuggacgc

SEQ ID NO: 211061 - RNA, 64 nt, Human
acacccaugcgcagaugugcugccuggacacacacacacacacggauaugcugucuggacgcac

SEQ ID NO: 211062 - RNA, 64 nt, Human
augcugccuggacacacagauaaugcugccuugacacacacaugcacggauauugccuggacac

SEQ ID NO: 211063 - RNA, 64 nt, Human
gccuugacacacacaugcacggauauugccuggacacacacacacacacgugugcacagauaug

SEQ ID NO: 211064 - RNA, 64 nt, Human
cuugacacacacaugcacggauauugccuggacacacacacacacacgugugcacagauaugcu

SEQ ID NO: 211065 - RNA, 64 nt, Human
ugacacacacaugcacggauauugccuggacacacacacacacacgugugcacagauaugcugu

SEQ ID NO: 211066 - RNA, 64 nt, Human
acacacacaugcacggauauugccuggacacacacacacacacgugugcacagauaugcugucu

SEQ ID NO: 211067 - RNA, 64 nt, Human
acacacgugugcacagauaugcugucuggacacgcacacacaugcagauaugcugccuggacac

SEQ ID NO: 211068 - RNA, 64 nt, Human
ugcugccuggacacacgcagauaugcugucuagucacacacacacgcagacaugcuguccggac

SEQ ID NO: 211069 - RNA, 64 nt, Human
cugccuggacacacgcagauaugcugucuagucacacacacacgcagacaugcuguccggacac

SEQ ID NO: 211070 - RNA, 64 nt, Human
cuagucacacacacacgcagacaugcuguccggacacacacacgcaugcacagauaugcugucc

SEQ ID NO: 211071 - RNA, 64 nt, Human
acacacacacgcaugcacagauaugcuguccggacacacacacgcacgcagauaugcugccugg

SEQ ID NO: 211072 - RNA, 64 nt, Human
ggacacacacacgcacgcagauaugcugccuggacacacacacagauaaugcugccucaacacu

SEQ ID NO: 211073 - RNA, 64 nt, Human
acacacacacgcacgcagauaugcugccuggacacacacacagauaaugcugccucaacacuca

SEQ ID NO: 211074 - RNA, 64 nt, Human
cucaacacucacacacgugcagauauugccuggacacacacaugugcacagauaugcugucugg

SEQ ID NO: 211075 - RNA, 64 nt, Human
augcugccugggcacacacuuccggacacacaugcacacacaggugcagauaugcugccuggac

SEQ ID NO: 211076 - RNA, 64 nt, Human
caugcaugugcauauagacacaucuauaauuuuacacacacaccucucaagacggagaugcaug

SEQ ID NO: 211077 - RNA, 64 nt, Human
gaucugcauaaccgcacagacauugacaagcacgcacacacacgcaaauacaugccuuuccagu

SEQ ID NO: 211078 - RNA, 64 nt, Human
gucgaaaaugcaaacuuggggagggcggaaacaucacacacaagguuuccacuucacacuugga

SEQ ID NO: 211079 - RNA, 64 nt, Human
aaauuucuaaggauaccagaaaggaaauggcaugcacacacacaaaaaauaccuaaauuuugga

SEQ ID NO: 211080 - RNA, 64 nt, Human
auuucuaaggauaccagaaaggaaauggcaugcacacacacaaaaaauaccuaaauuuuggaug

SEQ ID NO: 211081 - RNA, 64 nt, Human
gauucccccuucaccccccccacccccgccuugccacacacagcuaauauucuaaugguaaauu

SEQ ID NO: 211082 - RNA, 64 nt, Human
acuaaccgaaaaaccgaaaauauacaaacagcuucacacacacacacacacacacacacacaca

SEQ ID NO: 211083 - RNA, 64 nt, Human
uaaccgaaaaaccgaaaauauacaaacagcuucacacacacacacacacacacacacacacaca

SEQ ID NO: 211084 - RNA, 64 nt, Human
accgaaaaaccgaaaauauacaaacagcuucacacacacacacacacacacacacacacacaca

SEQ ID NO: 211085 - RNA, 64 nt, Human
cgaaaaaccgaaaauauacaaacagcuucacacacacacacacacacacacacacacacacaca

SEQ ID NO: 211086 - RNA, 64 nt, Human
aaaaaccgaaaauauacaaacagcuucacacacacacacacacacacacacacacacacacaca

SEQ ID NO: 211087 - RNA, 64 nt, Human
aaaccgaaaauauacaaacagcuucacacacacacacacacacacacacacacacacacacaca

SEQ ID NO: 211088 - RNA, 64 nt, Human
accgaaaauauacaaacagcuucacacacacacacacacacacacacacacacacacacacaca

SEQ ID NO: 211089 - RNA, 64 nt, Human
cgaaaauauacaaacagcuucacacacacacacacacacacacacacacacacacacacacaaa

SEQ ID NO: 211090 - RNA, 64 nt, Human
aaaauauacaaacagcuucacacacacacacacacacacacacacacacacacacacacaaagg

SEQ ID NO: 211091 - RNA, 64 nt, Human
aauauacaaacagcuucacacacacacacacacacacacacacacacacacacacacaaaggaa

SEQ ID NO: 211092 - RNA, 64 nt, Human
uauacaaacagcuucacacacacacacacacacacacacacacacacacacacacaaaggaaga

SEQ ID NO: 211093 - RNA, 64 nt, Human
uacaaacagcuucacacacacacacacacacacacacacacacacacacacacaaaggaagauc

SEQ ID NO: 211094 - RNA, 64 nt, Human
caaacagcuucacacacacacacacacacacacacacacacacacacacacaaaggaagaucau

SEQ ID NO: 211095 - RNA, 64 nt, Human
aacagcuucacacacacacacacacacacacacacacacacacacacacaaaggaagaucauca

SEQ ID NO: 211096 - RNA, 64 nt, Human
cagcuucacacacacacacacacacacacacacacacacacacacacaaaggaagaucaucaau

SEQ ID NO: 211097 - RNA, 64 nt, Human
gcuucacacacacacacacacacacacacacacacacacacacacaaaggaagaucaucaaugg

SEQ ID NO: 211098 - RNA, 64 nt, Human
uucacacacacacacacacacacacacacacacacacacacacaaaggaagaucaucaauggcu

SEQ ID NO: 211099 - RNA, 64 nt, Human
cacacacacacacacacacacacacacacacacacacacacaaaggaagaucaucaauggcugc

SEQ ID NO: 211100 - RNA, 64 nt, Human
aauauaaaguaguaaguuaacauaguauuauugucacacacaaugcuuuuuuugguuaaauguu

SEQ ID NO: 211101 - RNA, 64 nt, Human
guauuguauauaaugugauuuuuacacauacauacacacacaaauacacaaucucuaggguaag

SEQ ID NO: 211102 - RNA, 64 nt, Human
uuuagcaacuauauucuacaaauguuacuuauaacacacacacacacaucugaaauauaugccg

SEQ ID NO: 211103 - RNA, 64 nt, Human
uagcaacuauauucuacaaauguuacuuauaacacacacacacacaucugaaauauaugccgaa

SEQ ID NO: 211104 - RNA, 64 nt, Human
gcaacuauauucuacaaauguuacuuauaacacacacacacacaucugaaauauaugccgaaaa

SEQ ID NO: 211105 - RNA, 64 nt, Human
aacuauauucuacaaauguuacuuauaacacacacacacacaucugaaauauaugccgaaaauu

SEQ ID NO: 211106 - RNA, 64 nt, Human
gaaauauauauguguguauguguguauauauaugcacacacacacagauaaugcuuccagugaa

SEQ ID NO: 211107 - RNA, 64 nt, Human
aauauauauguguguauguguguauauauaugcacacacacacagauaaugcuuccagugaaug

SEQ ID NO: 211108 - RNA, 64 nt, Human
uauauauguguguauguguguauauauaugcacacacacacagauaaugcuuccagugaaugug

SEQ ID NO: 211109 - RNA, 64 nt, Human
cuuccuucucugcuuugugacucaccagcaguaacacacacaauccacaucuugugcaccucaa

SEQ ID NO: 211110 - RNA, 64 nt, Human
cauacauucaccgcccccccgcccccccaacgcgcacacacacguccucuccucccaggaaccu

SEQ ID NO: 211111 - RNA, 64 nt, Human
auucaaauauuuacccgggacacacacccccccccacacacacacacagacacacucacacaca

SEQ ID NO: 211112 - RNA, 64 nt, Human
ucaaauauuuacccgggacacacacccccccccacacacacacacagacacacucacacacaag

SEQ ID NO: 211113 - RNA, 64 nt, Human
aaauauuuacccgggacacacacccccccccacacacacacacagacacacucacacacaagag

SEQ ID NO: 211114 - RNA, 64 nt, Human
auauuuacccgggacacacacccccccccacacacacacacagacacacucacacacaagagcc

SEQ ID NO: 211115 - RNA, 64 nt, Human
cacacccccccccacacacacacacagacacacucacacacaagagccaggaugguggaguuuu

SEQ ID NO: 211116 - RNA, 64 nt, Human
uguguguguguguguguguauguaugugaauauacacacacacacacacacaggugagugugaa

SEQ ID NO: 211117 - RNA, 64 nt, Human
uguguguguguguguguauguaugugaauauacacacacacacacacacaggugagugugaaua

SEQ ID NO: 211118 - RNA, 64 nt, Human
uguguguguguguguauguaugugaauauacacacacacacacacacaggugagugugaauacu

SEQ ID NO: 211119 - RNA, 64 nt, Human
uguguguguguguauguaugugaauauacacacacacacacacacaggugagugugaauacuuc

SEQ ID NO: 211120 - RNA, 64 nt, Human
uguguguguguauguaugugaauauacacacacacacacacacaggugagugugaauacuuccu

SEQ ID NO: 211121 - RNA, 64 nt, Human
uguguguguauguaugugaauauacacacacacacacacacaggugagugugaauacuuccuug

SEQ ID NO: 211122 - RNA, 64 nt, Human
uggauucagaaauuuaaacaaaaaaaaaaaaaaacacacacaccuugguaacauacuguugaua

SEQ ID NO: 211123 - RNA, 64 nt, Human
ccccaugacacaugagcgcucucacuuacccuuacacacacacacacacacacacacaccucua

SEQ ID NO: 211124 - RNA, 64 nt, Human
ccaugacacaugagcgcucucacuuacccuuacacacacacacacacacacacacaccucuaac

SEQ ID NO: 211125 - RNA, 64 nt, Human
augacacaugagcgcucucacuuacccuuacacacacacacacacacacacacaccucuaacag

SEQ ID NO: 211126 - RNA, 64 nt, Human
gacacaugagcgcucucacuuacccuuacacacacacacacacacacacacaccucuaacagaa

SEQ ID NO: 211127 - RNA, 64 nt, Human
cacaugagcgcucucacuuacccuuacacacacacacacacacacacacaccucuaacagaagg

SEQ ID NO: 211128 - RNA, 64 nt, Human
caugagcgcucucacuuacccuuacacacacacacacacacacacacaccucuaacagaaggga

SEQ ID NO: 211129 - RNA, 64 nt, Human
ugagcgcucucacuuacccuuacacacacacacacacacacacacaccucuaacagaagggaag

SEQ ID NO: 211130 - RNA, 64 nt, Human
agcgcucucacuuacccuuacacacacacacacacacacacacaccucuaacagaagggaagaa

SEQ ID NO: 211131 - RNA, 64 nt, Human
cgcucucacuuacccuuacacacacacacacacacacacacaccucuaacagaagggaagaagc

SEQ ID NO: 211132 - RNA, 64 nt, Human
guaagauagaauguauuauauauauauauauauacacacacacauauauauagcugaaucuuug

SEQ ID NO: 211133 - RNA, 64 nt, Human
aagauagaauguauuauauauauauauauauacacacacacauauauauagcugaaucuuuggu

SEQ ID NO: 211134 - RNA, 64 nt, Human
ucugugcuuucaaaaaaaaaaacaaaaaaaaaaccacacacacacauaaaaaacccaacagguc

SEQ ID NO: 211135 - RNA, 64 nt, Human
ugugcuuucaaaaaaaaaaacaaaaaaaaaaccacacacacacauaaaaaacccaacaggucaa

SEQ ID NO: 211136 - RNA, 64 nt, Human
ugcuuucaaaaaaaaaaacaaaaaaaaaaccacacacacacauaaaaaacccaacaggucaaaa

SEQ ID NO: 211137 - RNA, 64 nt, Human
aagguauucauggugacucaggaauacacacauacacacacacacacacacacacacacacaca

SEQ ID NO: 211138 - RNA, 64 nt, Human
gguauucauggugacucaggaauacacacauacacacacacacacacacacacacacacacaca

SEQ ID NO: 211139 - RNA, 64 nt, Human
uauucauggugacucaggaauacacacauacacacacacacacacacacacacacacacacaua

SEQ ID NO: 211140 - RNA, 64 nt, Human
uucauggugacucaggaauacacacauacacacacacacacacacacacacacacacacauaca

SEQ ID NO: 211141 - RNA, 64 nt, Human
cauggugacucaggaauacacacauacacacacacacacacacacacacacacacacauacaca

SEQ ID NO: 211142 - RNA, 64 nt, Human
uggugacucaggaauacacacauacacacacacacacacacacacacacacacacauacacaca

SEQ ID NO: 211143 - RNA, 64 nt, Human
gugacucaggaauacacacauacacacacacacacacacacacacacacacacauacacacaua

SEQ ID NO: 211144 - RNA, 64 nt, Human
gacucaggaauacacacauacacacacacacacacacacacacacacacacauacacacauaua

SEQ ID NO: 211145 - RNA, 64 nt, Human
cucaggaauacacacauacacacacacacacacacacacacacacacacauacacacauauaau

SEQ ID NO: 211146 - RNA, 64 nt, Human
caggaauacacacauacacacacacacacacacacacacacacacacauacacacauauaauuu

SEQ ID NO: 211147 - RNA, 64 nt, Human
ggaauacacacauacacacacacacacacacacacacacacacacauacacacauauaauuuga

SEQ ID NO: 211148 - RNA, 64 nt, Human
aauacacacauacacacacacacacacacacacacacacacacauacacacauauaauuugaaa

SEQ ID NO: 211149 - RNA, 64 nt, Human
uacacacauacacacacacacacacacacacacacacacacauacacacauauaauuugaaaga

SEQ ID NO: 211150 - RNA, 64 nt, Human
aggugcaguggcccuacccagccuggccagcagacacacacagggaugcucacgggugcaccag

SEQ ID NO: 211151 - RNA, 64 nt, Human
auuguaaauauugugaacauuacuuaacuucacacacacacagagaagaguguggccccacccc

SEQ ID NO: 211152 - RNA, 64 nt, Human
uuauuguaaauauugugaacauuacuuaacuucacacacacacagagaagaguguggccccacc

SEQ ID NO: 211153 - RNA, 64 nt, Human
ucuuauuguaaauauugugaacauuacuuaacuucacacacacacagagaagaguguggcccca

SEQ ID NO: 211154 - RNA, 64 nt, Human
gcugcagagaaaucuaccgagcaaggaaaaggcacacacacacguuugcaggggugucucgguu

SEQ ID NO: 211155 - RNA, 64 nt, Human
uggcugcagagaaaucuaccgagcaaggaaaaggcacacacacacguuugcaggggugucucgg

SEQ ID NO: 211156 - RNA, 64 nt, Human
cuuuuggaaugcaaucuuuauauuuucugugcaucacacacaugcuuuucugcacgugguugcc

SEQ ID NO: 211157 - RNA, 64 nt, Human
aaaccucuaauuuuuggugacuuuucuacacacacacacacauacagucacauagauauucuua

SEQ ID NO: 211158 - RNA, 64 nt, Human
uaaaaccucuaauuuuuggugacuuuucuacacacacacacacauacagucacauagauauucu

SEQ ID NO: 211159 - RNA, 64 nt, Human
uauaaaaccucuaauuuuuggugacuuuucuacacacacacacacauacagucacauagauauu

SEQ ID NO: 211160 - RNA, 64 nt, Human
guuauaaaaccucuaauuuuuggugacuuuucuacacacacacacacauacagucacauagaua

SEQ ID NO: 211161 - RNA, 64 nt, Human
aucaaccucuguauuugaaucagccuacaggccucacacacaaugugucugagagauucaugcu

SEQ ID NO: 211162 - RNA, 64 nt, Human
agguuuguggcacuguuccaagaggccuuacacacacacacaaauauauaauuuucuauacaua

SEQ ID NO: 211163 - RNA, 64 nt, Human
ccagguuuguggcacuguuccaagaggccuuacacacacacacaaauauauaauuuucuauaca

SEQ ID NO: 211164 - RNA, 64 nt, Human
guccagguuuguggcacuguuccaagaggccuuacacacacacacaaauauauaauuuucuaua

SEQ ID NO: 211165 - RNA, 64 nt, Human
ugugauggaacacacacacacgcagacacacacacacacacaaaugcagacacacaacaucaag

SEQ ID NO: 211166 - RNA, 64 nt, Human
gaugugauggaacacacacacacgcagacacacacacacacacaaaugcagacacacaacauca

SEQ ID NO: 211167 - RNA, 64 nt, Human
augaugugauggaacacacacacacgcagacacacacacacacacaaaugcagacacacaacau

SEQ ID NO: 211168 - RNA, 64 nt, Human
agaugaugugauggaacacacacacacgcagacacacacacacacacaaaugcagacacacaac

SEQ ID NO: 211169 - RNA, 64 nt, Human
ggagaugaugugauggaacacacacacacgcagacacacacacacacacaaaugcagacacaca

SEQ ID NO: 211170 - RNA, 64 nt, Human
cccagcguucuucaggagaugaugugauggaacacacacacacgcagacacacacacacacaca

SEQ ID NO: 211171 - RNA, 64 nt, Human
aacccagcguucuucaggagaugaugugauggaacacacacacacgcagacacacacacacaca

SEQ ID NO: 211172 - RNA, 64 nt, Human
cacugcauagauuacacgcacauagccacgcauacacacacagacacacagaugugggguacac

SEQ ID NO: 211173 - RNA, 64 nt, Human
acagaugguguguaugccccucccuguuugacuucacacacacucauaacuuuccaaaugaaac

SEQ ID NO: 211174 - RNA, 64 nt, Human
aaagauuuuuacucuagaaacugugcgagcacaacacacacaauccuuucuaacuuuauggaca

SEQ ID NO: 211175 - RNA, 64 nt, Human
gaagggaagagugcuccaagacuuggaccaggcacacacacaccuccagaucaccuuggcaacu

SEQ ID NO: 211176 - RNA, 64 nt, Human
aggaagggaagagugcuccaagacuuggaccaggcacacacacaccuccagaucaccuuggcaa

SEQ ID NO: 211177 - RNA, 64 nt, Human
gcuuaugcucagaaaugccauacacacacacaaacacacacauuuaucauuuaaugcauaaauc

SEQ ID NO: 211178 - RNA, 64 nt, Human
cacuaauaaagcuuaugcucagaaaugccauacacacacacaaacacacacauuuaucauuuaa

SEQ ID NO: 211179 - RNA, 64 nt, Human
cacacuaauaaagcuuaugcucagaaaugccauacacacacacaaacacacacauuuaucauuu

SEQ ID NO: 211180 - RNA, 64 nt, Human
aaagcaucugguggcauggcagcauggggaggcucacacacagaaguugcacguggacaucugu

SEQ ID NO: 211181 - RNA, 64 nt, Human
uuucauaaagcacuuuuguggccuaguucccacacacacacaaaaguauuaggucuuuaaaacu

SEQ ID NO: 211182 - RNA, 64 nt, Human
ucuuucauaaagcacuuuuguggccuaguucccacacacacacaaaaguauuaggucuuuaaaa

SEQ ID NO: 211183 - RNA, 64 nt, Human
acucuuucauaaagcacuuuuguggccuaguucccacacacacacaaaaguauuaggucuuuaa

SEQ ID NO: 211184 - RNA, 64 nt, Human
cucuuacacacacacacacacacacacauacacacacacacacuccuucucuaagauuccuugu

SEQ ID NO: 211185 - RNA, 64 nt, Human
uacucuuacacacacacacacacacacacauacacacacacacacuccuucucuaagauuccuu

SEQ ID NO: 211186 - RNA, 64 nt, Human
auuacucuuacacacacacacacacacacacauacacacacacacacuccuucucuaagauucc

SEQ ID NO: 211187 - RNA, 64 nt, Human
cuuccagaucauuacucuuacacacacacacacacacacacauacacacacacacacuccuucu

SEQ ID NO: 211188 - RNA, 64 nt, Human
gacuuccagaucauuacucuuacacacacacacacacacacacauacacacacacacacuccuu

SEQ ID NO: 211189 - RNA, 64 nt, Human
gagacuuccagaucauuacucuuacacacacacacacacacacacauacacacacacacacucc

SEQ ID NO: 211190 - RNA, 64 nt, Human
uugagacuuccagaucauuacucuuacacacacacacacacacacacauacacacacacacacu

SEQ ID NO: 211191 - RNA, 64 nt, Human
cauugagacuuccagaucauuacucuuacacacacacacacacacacacauacacacacacaca

SEQ ID NO: 211192 - RNA, 64 nt, Human
ugcauugagacuuccagaucauuacucuuacacacacacacacacacacacauacacacacaca

SEQ ID NO: 211193 - RNA, 64 nt, Human
agugcauugagacuuccagaucauuacucuuacacacacacacacacacacacauacacacaca

SEQ ID NO: 211194 - RNA, 64 nt, Human
cgagugcauugagacuuccagaucauuacucuuacacacacacacacacacacacauacacaca

SEQ ID NO: 211195 - RNA, 64 nt, Human
gcacugggagaacuaacagaggagaaaggugaaacacacacacauucuuaaggcaauaaaacua

SEQ ID NO: 211196 - RNA, 64 nt, Human
acugggagaacuaacagaggagaaaggugaaacacacacacauucuuaaggcaauaaaacuagg

SEQ ID NO: 211197 - RNA, 64 nt, Human
ccgcccccaccccacacccacauccucucuuuuccacacacaacuaucuguuuauuuuuuguag

SEQ ID NO: 211198 - RNA, 64 nt, Human
uacauacuuacauguguguauauguagauguaugcacacacauauauuauuugcagugcaguau

SEQ ID NO: 211199 - RNA, 64 nt, Human
ccagucaguauucccagccuugagcgcacgcgcgcacacacacacacacauacacacacgcauu

SEQ ID NO: 211200 - RNA, 64 nt, Human
agucaguauucccagccuugagcgcacgcgcgcacacacacacacacauacacacacgcauuaa

SEQ ID NO: 211201 - RNA, 64 nt, Human
ucaguauucccagccuugagcgcacgcgcgcacacacacacacacauacacacacgcauuaauu

SEQ ID NO: 211202 - RNA, 64 nt, Human
aguauucccagccuugagcgcacgcgcgcacacacacacacacauacacacacgcauuaauuuu

SEQ ID NO: 211203 - RNA, 64 nt, Human
uauucccagccuugagcgcacgcgcgcacacacacacacacauacacacacgcauuaauuuuug

SEQ ID NO: 211204 - RNA, 64 nt, Human
uauauauuuuaugaauuacaugugguuuuauauacacacacacacacacacacacacacacaca

SEQ ID NO: 211205 - RNA, 64 nt, Human
uauauuuuaugaauuacaugugguuuuauauacacacacacacacacacacacacacacacaca

SEQ ID NO: 211206 - RNA, 64 nt, Human
uauuuuaugaauuacaugugguuuuauauacacacacacacacacacacacacacacacacaca

SEQ ID NO: 211207 - RNA, 64 nt, Human
uuuuaugaauuacaugugguuuuauauacacacacacacacacacacacacacacacacacacu

SEQ ID NO: 211208 - RNA, 64 nt, Human
uuaugaauuacaugugguuuuauauacacacacacacacacacacacacacacacacacacucu

SEQ ID NO: 211209 - RNA, 64 nt, Human
augaauuacaugugguuuuauauacacacacacacacacacacacacacacacacacacucuga

SEQ ID NO: 211210 - RNA, 64 nt, Human
gaauuacaugugguuuuauauacacacacacacacacacacacacacacacacacacucugaca

SEQ ID NO: 211211 - RNA, 64 nt, Human
auuacaugugguuuuauauacacacacacacacacacacacacacacacacacacucugacauu

SEQ ID NO: 211212 - RNA, 64 nt, Human
uacaugugguuuuauauacacacacacacacacacacacacacacacacacacucugacauuuu

SEQ ID NO: 211213 - RNA, 64 nt, Human
caugugguuuuauauacacacacacacacacacacacacacacacacacacucugacauuuuau

SEQ ID NO: 211214 - RNA, 64 nt, Human
ugugguuuuauauacacacacacacacacacacacacacacacacacacucugacauuuuauua

SEQ ID NO: 211215 - RNA, 64 nt, Human
ugguuuuauauacacacacacacacacacacacacacacacacacacucugacauuuuauuaca

SEQ ID NO: 211216 - RNA, 64 nt, Human
guuuuauauacacacacacacacacacacacacacacacacacacucugacauuuuauuacaag

SEQ ID NO: 211217 - RNA, 64 nt, Human
uuuauauacacacacacacacacacacacacacacacacacacucugacauuuuauuacaagcu

SEQ ID NO: 211218 - RNA, 64 nt, Human
gaucacagcucuuggcaauuacauuauuuauaaacacacacacuagcauguuuuucagaccaaa

SEQ ID NO: 211219 - RNA, 64 nt, Human
cuugccagacauguggugggacagggacccacuucacacacaggcaacugaggcagacagcagc

SEQ ID NO: 211220 - RNA, 64 nt, Human
ggagguagaucuuucucucaaccacaucugccuccacacacagcuccuccgcagggaaggagaa

SEQ ID NO: 211221 - RNA, 64 nt, Human
acacugaagguugacacaggaaagucguacuguucacacacacaguuugagacuccaagccaag

SEQ ID NO: 211222 - RNA, 64 nt, Human
acugaagguugacacaggaaagucguacuguucacacacacaguuugagacuccaagccaagag

SEQ ID NO: 211223 - RNA, 64 nt, Human
ggggaagaagauugaucaaacugaaugaaacccccacacacacacacaugcauacacacacaca

SEQ ID NO: 211224 - RNA, 64 nt, Human
ggaagaagauugaucaaacugaaugaaacccccacacacacacacaugcauacacacacacaca

SEQ ID NO: 211225 - RNA, 64 nt, Human
aagaagauugaucaaacugaaugaaacccccacacacacacacaugcauacacacacacacaca

SEQ ID NO: 211226 - RNA, 64 nt, Human
gaagauugaucaaacugaaugaaacccccacacacacacacaugcauacacacacacacacagc

SEQ ID NO: 211227 - RNA, 64 nt, Human
cugaaugaaacccccacacacacacacaugcauacacacacacacacagccacacacacagaaa

SEQ ID NO: 211228 - RNA, 64 nt, Human
gaaugaaacccccacacacacacacaugcauacacacacacacacagccacacacacagaaaau

SEQ ID NO: 211229 - RNA, 64 nt, Human
augaaacccccacacacacacacaugcauacacacacacacacagccacacacacagaaaauau

SEQ ID NO: 211230 - RNA, 64 nt, Human
gaaacccccacacacacacacaugcauacacacacacacacagccacacacacagaaaauauac

SEQ ID NO: 211231 - RNA, 64 nt, Human
cacacacacacaugcauacacacacacacacagccacacacacagaaaauauacuguaaagaaa

SEQ ID NO: 211232 - RNA, 64 nt, Human
cacacacacaugcauacacacacacacacagccacacacacagaaaauauacuguaaagaaaga

SEQ ID NO: 211233 - RNA, 64 nt, Human
gugagauacaauccagucuucucaugcacgggaacacacacacccugcguuucucccucccagg

SEQ ID NO: 211234 - RNA, 64 nt, Human
cggccuuuuguuuguuuuagagaaaguuguauuccacacacaaccuaauaauuucuuauaaaaa

SEQ ID NO: 211235 - RNA, 64 nt, Human
cucugccucuccugaaaccucugacaacccccuacacacacacacaggcauacucagacccacu

SEQ ID NO: 211236 - RNA, 64 nt, Human
cugccucuccugaaaccucugacaacccccuacacacacacacaggcauacucagacccacuca

SEQ ID NO: 211237 - RNA, 64 nt, Human
gccucuccugaaaccucugacaacccccuacacacacacacaggcauacucagacccacucaaa

SEQ ID NO: 211238 - RNA, 64 nt, Human
uguggacagcacuucacaguugaagaagggccuucacacacaaaaccugauugcaaauggcuuc

SEQ ID NO: 211239 - RNA, 64 nt, Human
gauaauugugaggguguguuacuauauuaaaauacacacacaacugaucuagacaucaagagga

SEQ ID NO: 211240 - RNA, 64 nt, Human
ccagcguugguuacugaccaccccacccucccaccacacacacacacacacacacacacacaca

SEQ ID NO: 211241 - RNA, 64 nt, Human
agcguugguuacugaccaccccacccucccaccacacacacacacacacacacacacacacaca

SEQ ID NO: 211242 - RNA, 64 nt, Human
cguugguuacugaccaccccacccucccaccacacacacacacacacacacacacacacacaca

SEQ ID NO: 211243 - RNA, 64 nt, Human
uugguuacugaccaccccacccucccaccacacacacacacacacacacacacacacacacaca

SEQ ID NO: 211244 - RNA, 64 nt, Human
gguuacugaccaccccacccucccaccacacacacacacacacacacacacacacacacacaca

SEQ ID NO: 211245 - RNA, 64 nt, Human
uuacugaccaccccacccucccaccacacacacacacacacacacacacacacacacacacaca

SEQ ID NO: 211246 - RNA, 64 nt, Human
acugaccaccccacccucccaccacacacacacacacacacacacacacacacacacacacaca

SEQ ID NO: 211247 - RNA, 64 nt, Human
ugaccaccccacccucccaccacacacacacacacacacacacacacacacacacacacacaca

SEQ ID NO: 211248 - RNA, 64 nt, Human
accaccccacccucccaccacacacacacacacacacacacacacacacacacacacacacaca

SEQ ID NO: 211249 - RNA, 64 nt, Human
caccccacccucccaccacacacacacacacacacacacacacacacacacacacacacacaca

SEQ ID NO: 211250 - RNA, 64 nt, Human
ccccacccucccaccacacacacacacacacacacacacacacacacacacacacacacacaaa

SEQ ID NO: 211251 - RNA, 64 nt, Human
ccacccucccaccacacacacacacacacacacacacacacacacacacacacacacacaaagu

SEQ ID NO: 211252 - RNA, 64 nt, Human
acccucccaccacacacacacacacacacacacacacacacacacacacacacacacaaagugg

SEQ ID NO: 211253 - RNA, 64 nt, Human
ccucccaccacacacacacacacacacacacacacacacacacacacacacacacaaaguggag

SEQ ID NO: 211254 - RNA, 64 nt, Human
ucccaccacacacacacacacacacacacacacacacacacacacacacacacaaaguggagaa

SEQ ID NO: 211255 - RNA, 64 nt, Human
ccaccacacacacacacacacacacacacacacacacacacacacacacacaaaguggagaaaa

SEQ ID NO: 211256 - RNA, 64 nt, Human
accacacacacacacacacacacacacacacacacacacacacacacacaaaguggagaaaaau

SEQ ID NO: 211257 - RNA, 64 nt, Human
cacacacacacacacacacacacacacacacacacacacacacacacaaaguggagaaaaaugu

SEQ ID NO: 211258 - RNA, 64 nt, Human
cacacacacacacacacacacacacacacacacacacacacacacaaaguggagaaaaauguau

SEQ ID NO: 211259 - RNA, 64 nt, Human
cacacacacacacacacacacacacacacacacacacacacacaaaguggagaaaaauguauac

SEQ ID NO: 211260 - RNA, 64 nt, Human
cacacacacacacacacacacacacacacacacacacacacaaaguggagaaaaauguauacuc

SEQ ID NO: 211261 - RNA, 64 nt, Human
agcccauuuguugaggcugaccuuccugaucauacacacacacagcccagcaaaagccucuccu

SEQ ID NO: 211262 - RNA, 64 nt, Human
cccauuuguugaggcugaccuuccugaucauacacacacacagcccagcaaaagccucuccuga

SEQ ID NO: 211263 - RNA, 64 nt, Human
uacuguuguuauuaaaaacagaacaaaaacaaaacacacacacacacaaaaacagaaacaaaaa

SEQ ID NO: 211264 - RNA, 64 nt, Human
cuguuguuauuaaaaacagaacaaaaacaaaacacacacacacacaaaaacagaaacaaaaaaa

SEQ ID NO: 211265 - RNA, 64 nt, Human
guuguuauuaaaaacagaacaaaaacaaaacacacacacacacaaaaacagaaacaaaaaaaac

SEQ ID NO: 211266 - RNA, 64 nt, Human
uguuauuaaaaacagaacaaaaacaaaacacacacacacacaaaaacagaaacaaaaaaaacca

SEQ ID NO: 211267 - RNA, 64 nt, Human
acugguuaaggcuucuguuuaucacacauaggcccacacacagacucaccaacuuugcaauaga

SEQ ID NO: 211268 - RNA, 64 nt, Human
guuccuaucucucccccgccccccaccgccccaccacacacauauuuuuaaaguuuuuccuuuu

SEQ ID NO: 211269 - RNA, 64 nt, Human
gagcacgugccacgcaugccucgugugcucaucucacacacaccccccucccgggucacgcaga

SEQ ID NO: 211270 - RNA, 64 nt, Human
accccccucccgggucacgcagacaccccccaaccacacacaucucaugcuguacaccugaggc

SEQ ID NO: 211271 - RNA, 64 nt, Human
gaggccguaaauugagcguucaguugacacauugcacacacagucuguucagaggcauuggagg

SEQ ID NO: 211272 - RNA, 64 nt, Human
cacacacacacacacacacaaacacacacacacacacacacacucugggacaagauuccuuuga

SEQ ID NO: 211273 - RNA, 64 nt, Human
cucacacacacacacacacacaaacacacacacacacacacacacucugggacaagauuccuuu

SEQ ID NO: 211274 - RNA, 64 nt, Human
cucucacacacacacacacacacaaacacacacacacacacacacacucugggacaagauuccu

SEQ ID NO: 211275 - RNA, 64 nt, Human
cucucucacacacacacacacacacaaacacacacacacacacacacacucugggacaagauuc

SEQ ID NO: 211276 - RNA, 64 nt, Human
aucucucucacacacacacacacacacaaacacacacacacacacacacacucugggacaagau

SEQ ID NO: 211277 - RNA, 64 nt, Human
aaaucucucucacacacacacacacacacaaacacacacacacacacacacacucugggacaag

SEQ ID NO: 211278 - RNA, 64 nt, Human
agaaaucucucucacacacacacacacacacaaacacacacacacacacacacacucugggaca

SEQ ID NO: 211279 - RNA, 64 nt, Human
aaauauuaauagaaaucucucucacacacacacacacacacaaacacacacacacacacacaca

SEQ ID NO: 211280 - RNA, 64 nt, Human
acaaauauuaauagaaaucucucucacacacacacacacacacaaacacacacacacacacaca

SEQ ID NO: 211281 - RNA, 64 nt, Human
acacaaauauuaauagaaaucucucucacacacacacacacacacaaacacacacacacacaca

SEQ ID NO: 211282 - RNA, 64 nt, Human
aaacacaaauauuaauagaaaucucucucacacacacacacacacacaaacacacacacacaca

SEQ ID NO: 211283 - RNA, 64 nt, Human
agaaacacaaauauuaauagaaaucucucucacacacacacacacacacaaacacacacacaca

SEQ ID NO: 211284 - RNA, 64 nt, Human
aaagaaacacaaauauuaauagaaaucucucucacacacacacacacacacaaacacacacaca

SEQ ID NO: 211285 - RNA, 64 nt, Human
aaaaagaaacacaaauauuaauagaaaucucucucacacacacacacacacacaaacacacaca

SEQ ID NO: 211286 - RNA, 64 nt, Human
gguugguuguuugguuauauggucagaccaagaucacacacagaaucaauugcagauuugaaac

SEQ ID NO: 211287 - RNA, 64 nt, Human
uguugauauauauauauauauauauacacacacacacacacacuaugauggauaaaugcaugag

SEQ ID NO: 211288 - RNA, 64 nt, Human
auuguugauauauauauauauauauauacacacacacacacacacuaugauggauaaaugcaug

SEQ ID NO: 211289 - RNA, 64 nt, Human
auauuguugauauauauauauauauauauacacacacacacacacacuaugauggauaaaugca

SEQ ID NO: 211290 - RNA, 64 nt, Human
auauauuguugauauauauauauauauauauacacacacacacacacacuaugauggauaaaug

SEQ ID NO: 211291 - RNA, 64 nt, Human
uuauauauuguugauauauauauauauauauauacacacacacacacacacuaugauggauaaa

SEQ ID NO: 211292 - RNA, 64 nt, Human
acacacauuacacacacacacagaaugcacauuucacacacauauacuuauuauucaaguugaa

SEQ ID NO: 211293 - RNA, 64 nt, Human
auacaccuguaugugcacauacacacauuacacacacacacagaaugcacauuucacacacaua

SEQ ID NO: 211294 - RNA, 64 nt, Human
guauacaccuguaugugcacauacacacauuacacacacacacagaaugcacauuucacacaca

SEQ ID NO: 211295 - RNA, 64 nt, Human
auguauacaccuguaugugcacauacacacauuacacacacacacagaaugcacauuucacaca

SEQ ID NO: 211296 - RNA, 64 nt, Human
ccugugauagcauacaaauucaaacauacagaaacacacacagauauggacacaguacaauucu

SEQ ID NO: 211297 - RNA, 64 nt, Human
gccuuuuguguacacacagaggcacaugugcaugcacacacaacuugugaacacacauuucugu

SEQ ID NO: 211298 - RNA, 64 nt, Human
aucagacaccaauggacugguuugugggcagaaacacacacacucgcacucucgcucacgcuca

SEQ ID NO: 211299 - RNA, 64 nt, Human
ugaaugcaacagaagacaaaagcacaggcaugcacacacacagaaccccaaaccacuaaaaacu

SEQ ID NO: 211300 - RNA, 64 nt, Human
ucugaaugcaacagaagacaaaagcacaggcaugcacacacacagaaccccaaaccacuaaaaa

SEQ ID NO: 211301 - RNA, 64 nt, Human
cauauacauacacaaacacaaucccacaugcaaacacacacagccacauauauacauguguagc

SEQ ID NO: 211302 - RNA, 64 nt, Human
cccagguucuuuaguuuuuuauucauucaacucacacacacauaaacauauacauacacaaaca

SEQ ID NO: 211303 - RNA, 64 nt, Human
ugcccagguucuuuaguuuuuuauucauucaacucacacacacauaaacauauacauacacaaa

SEQ ID NO: 211304 - RNA, 64 nt, Human
gcucaccaacuguguggcccgauuccuaacaggccacacacagcccagggcuggggaccccugc

SEQ ID NO: 211305 - RNA, 64 nt, Human
cacacacacacacacacacgaacacacacacacacacacacacgcacacauacacacuuauuuc

SEQ ID NO: 211306 - RNA, 64 nt, Human
cacacacacacacacacacacgaacacacacacacacacacacacgcacacauacacacuuauu

SEQ ID NO: 211307 - RNA, 64 nt, Human
agcacacacacacacacacacacgaacacacacacacacacacacacgcacacauacacacuua

SEQ ID NO: 211308 - RNA, 64 nt, Human
cgagcacacacacacacacacacacgaacacacacacacacacacacacgcacacauacacacu

SEQ ID NO: 211309 - RNA, 64 nt, Human
cacgagcacacacacacacacacacacgaacacacacacacacacacacacgcacacauacaca

SEQ ID NO: 211310 - RNA, 64 nt, Human
cacacgagcacacacacacacacacacacgaacacacacacacacacacacacgcacacauaca

SEQ ID NO: 211311 - RNA, 64 nt, Human
cacacacgagcacacacacacacacacacacgaacacacacacacacacacacacgcacacaua

SEQ ID NO: 211312 - RNA, 64 nt, Human
acacagcacacacacacacgagcacacacacacacacacacacgaacacacacacacacacaca

SEQ ID NO: 211313 - RNA, 64 nt, Human
aaacacagcacacacacacacgagcacacacacacacacacacacgaacacacacacacacaca

SEQ ID NO: 211314 - RNA, 64 nt, Human
caaaacacagcacacacacacacgagcacacacacacacacacacacgaacacacacacacaca

SEQ ID NO: 211315 - RNA, 64 nt, Human
cucaaaacacagcacacacacacacgagcacacacacacacacacacacgaacacacacacaca

SEQ ID NO: 211316 - RNA, 64 nt, Human
gccucaaaacacagcacacacacacacgagcacacacacacacacacacacgaacacacacaca

SEQ ID NO: 211317 - RNA, 64 nt, Human
aagccucaaaacacagcacacacacacacgagcacacacacacacacacacacgaacacacaca

SEQ ID NO: 211318 - RNA, 64 nt, Human
uaaagccucaaaacacagcacacacacacacgagcacacacacacacacacacacgaacacaca

SEQ ID NO: 211319 - RNA, 64 nt, Human
ucaaagcccacguaaagccucaaaacacagcacacacacacacgagcacacacacacacacaca

SEQ ID NO: 211320 - RNA, 64 nt, Human
cuucaaagcccacguaaagccucaaaacacagcacacacacacacgagcacacacacacacaca

SEQ ID NO: 211321 - RNA, 64 nt, Human
gccuucaaagcccacguaaagccucaaaacacagcacacacacacacgagcacacacacacaca

SEQ ID NO: 211322 - RNA, 64 nt, Human
caaacuaagaugcacaaugucuccuucaggugaucacacacaguggacgaguaugugcaaacau

SEQ ID NO: 211323 - RNA, 64 nt, Human
aaucgggaaauuuacacacacacacacacacacacacacacagaguaaccuguaacucucaauu

SEQ ID NO: 211324 - RNA, 64 nt, Human
uaaaucgggaaauuuacacacacacacacacacacacacacacagaguaaccuguaacucucaa

SEQ ID NO: 211325 - RNA, 64 nt, Human
gauaaaucgggaaauuuacacacacacacacacacacacacacacacacacacacacagaguaa

SEQ ID NO: 211326 - RNA, 64 nt, Human
gugauaaaucgggaaauuuacacacacacacacacacacacacacacacacacacacacagagu

SEQ ID NO: 211327 - RNA, 64 nt, Human
uagugauaaaucgggaaauuuacacacacacacacacacacacacacacacacacacacacaga

SEQ ID NO: 211328 - RNA, 64 nt, Human
ucuagugauaaaucgggaaauuuacacacacacacacacacacacacacacacacacacacaca

SEQ ID NO: 211329 - RNA, 64 nt, Human
acucuagugauaaaucgggaaauuuacacacacacacacacacacacacacacacacacacaca

SEQ ID NO: 211330 - RNA, 64 nt, Human
ucacucuagugauaaaucgggaaauuuacacacacacacacacacacacacacacacacacaca

SEQ ID NO: 211331 - RNA, 64 nt, Human
acucacucuagugauaaaucgggaaauuuacacacacacacacacacacacacacacacacaca

SEQ ID NO: 211332 - RNA, 64 nt, Human
uuacucacucuagugauaaaucgggaaauuuacacacacacacacacacacacacacacacaca

SEQ ID NO: 211333 - RNA, 64 nt, Human
aguuacucacucuagugauaaaucgggaaauuuacacacacacacacacacacacacacacaca

SEQ ID NO: 211334 - RNA, 64 nt, Human
aaaccucucuuauggaagcuuuaaaaguuuccgucacacacaauucucuucucaggaaguauuu

SEQ ID NO: 211335 - RNA, 64 nt, Human
acacacacacacacacacaugcacacaacacauacacacacacgcacagaggugaacagaaacu

SEQ ID NO: 211336 - RNA, 64 nt, Human
cacauaccuaccccaucccccacccccacacacacacacacaugcacacaacacauacacacac

SEQ ID NO: 211337 - RNA, 64 nt, Human
agcacauaccuaccccaucccccacccccacacacacacacacaugcacacaacacauacacac

SEQ ID NO: 211338 - RNA, 64 nt, Human
aaagcacauaccuaccccaucccccacccccacacacacacacacacacacaugcacacaacac

SEQ ID NO: 211339 - RNA, 64 nt, Human
caaaagcacauaccuaccccaucccccacccccacacacacacacacacacacaugcacacaac

SEQ ID NO: 211340 - RNA, 64 nt, Human
gccaaaagcacauaccuaccccaucccccacccccacacacacacacacacacacaugcacaca

SEQ ID NO: 211341 - RNA, 64 nt, Human
uauucuuuacuuuuuguaucaguaaccaggcucgcacacacagggucugcugccacgucgcaaa

SEQ ID NO: 211342 - RNA, 64 nt, Human
uucaauucuuccuuuuuuauuacuauuucaaacacacacacauauauauauauauuaaacuuag

SEQ ID NO: 211343 - RNA, 64 nt, Human
aauucaauucuuccuuuuuuauuacuauuucaaacacacacacauauauauauauauuaaacuu

SEQ ID NO: 211344 - RNA, 64 nt, Human
ggagaggaaacccuagacucugugucacucucaacacacacagcuccuuucacuccugccugac

SEQ ID NO: 211345 - RNA, 64 nt, Human
cgaggguuuucuuacccacauuccccaaucaauacacacacacugcagaacccagaacagaagg

SEQ ID NO: 211346 - RNA, 64 nt, Human
ugcauguacagaaagacuguaugugugugccuugcacacacacccauaccucucagaaaaagug

SEQ ID NO: 211347 - RNA, 64 nt, Human
cccaaguggggucaacuccuaagccccacccccucacacacaccgccuucccuguuuugcccuu

SEQ ID NO: 211348 - RNA, 64 nt, Human
cucgcuuaguauauugaaaacacacaccacacaucacacacagaacugaaucauaccacaugcu

SEQ ID NO: 211349 - RNA, 64 nt, Human
uucugaaaagagugggcugauaaacuuguaaauccacacacaacucugagaauacccacugcca

SEQ ID NO: 211350 - RNA, 64 nt, Human
cgcacacacacacacacacacacacacacacacacacacacacucucgcgcucucucucucaac

SEQ ID NO: 211351 - RNA, 64 nt, Human
agcgcacacacacacacacacacacacacacacacacacacacacucucgcgcucucucucuca

SEQ ID NO: 211352 - RNA, 64 nt, Human
aaagcgcacacacacacacacacacacacacacacacacacacacacucucgcgcucucucucu

SEQ ID NO: 211353 - RNA, 64 nt, Human
uaaaagcgcacacacacacacacacacacacacacacacacacacacacucucgcgcucucucu

SEQ ID NO: 211354 - RNA, 64 nt, Human
uuuaaaagcgcacacacacacacacacacacacacacacacacacacacacucucgcgcucucu

SEQ ID NO: 211355 - RNA, 64 nt, Human
ugcucccuccaauuuaaaagcacacacacacacacacacacacacacacacacucucgcgcucu

SEQ ID NO: 211356 - RNA, 64 nt, Human
caugcucccuccaauuuaaaagcacacacacacacacacacacacacacacacacucucgcgcu

SEQ ID NO: 211357 - RNA, 64 nt, Human
gacaugcucccuccaauuuaaaagcacacacacacacacacacacacacacacacacucucgcg

SEQ ID NO: 211358 - RNA, 64 nt, Human
cugacaugcucccuccaauuuaaaagcacacacacacacacacacacacacacacacacucucg

SEQ ID NO: 211359 - RNA, 64 nt, Human
uccugacaugcucccuccaauuuaaaagcacacacacacacacacacacacacacacacacucu

SEQ ID NO: 211360 - RNA, 64 nt, Human
aauccugacaugcucccuccaauuuaaaagcacacacacacacacacacacacacacacacacu

SEQ ID NO: 211361 - RNA, 64 nt, Human
acaauccugacaugcucccuccaauuuaaaagcacacacacacacacacacacacacacacaca

SEQ ID NO: 211362 - RNA, 64 nt, Human
uaacaauccugacaugcucccuccaauuuaaaagcacacacacacacacacacacacacacaca

SEQ ID NO: 211363 - RNA, 64 nt, Human
uuacauaagcuguguauacacacacacacacacacacacacaccccuaccccacacugacuguc

SEQ ID NO: 211364 - RNA, 64 nt, Human
auuuacauaagcuguguauacacacacacacacacacacacacaccccuaccccacacugacug

SEQ ID NO: 211365 - RNA, 64 nt, Human
cgauuuacauaagcuguguauacacacacacacacacacacacacaccccuaccccacacugac

SEQ ID NO: 211366 - RNA, 64 nt, Human
gucgauuuacauaagcuguguauacacacacacacacacacacacacaccccuaccccacacug

SEQ ID NO: 211367 - RNA, 64 nt, Human
gagucgauuuacauaagcuguguauacacacacacacacacacacacacaccccuaccccacac

SEQ ID NO: 211368 - RNA, 64 nt, Human
gagagucgauuuacauaagcuguguauacacacacacacacacacacacacaccccuaccccac

SEQ ID NO: 211369 - RNA, 64 nt, Human
uggagagucgauuuacauaagcuguguauacacacacacacacacacacacacaccccuacccc

SEQ ID NO: 211370 - RNA, 64 nt, Human
uguggagagucgauuuacauaagcuguguauacacacacacacacacacacacacaccccuacc

SEQ ID NO: 211371 - RNA, 64 nt, Human
ucuguggagagucgauuuacauaagcuguguauacacacacacacacacacacacacaccccua

SEQ ID NO: 211372 - RNA, 64 nt, Human
aaacacauuaugcuuuugcacacacacaccuguacacacacaccggcauguuuauacacaggga

SEQ ID NO: 211373 - RNA, 64 nt, Human
augcaaaccuuugcaaacacauuaugcuuuugcacacacacaccuguacacacacaccggcaug

SEQ ID NO: 211374 - RNA, 64 nt, Human
aaaugcaaaccuuugcaaacacauuaugcuuuugcacacacacaccuguacacacacaccggca

SEQ ID NO: 211375 - RNA, 64 nt, Human
gagacuauucuuuuagagacuacucaagugaaugcacacacagugaaaauucucggaguuguga

SEQ ID NO: 211376 - RNA, 64 nt, Human
cucgcgucccccuuccugcacaugggugugaaugcacacacauacgcguacacacaggacuugg

SEQ ID NO: 211377 - RNA, 64 nt, Human
gcagauuuuuuagaagggauaggagacacacgcgcacacacacacacacacgaaacuugaaaug

SEQ ID NO: 211378 - RNA, 64 nt, Human
agauuuuuuagaagggauaggagacacacgcgcacacacacacacacacgaaacuugaaauggc

SEQ ID NO: 211379 - RNA, 64 nt, Human
auuuuuuagaagggauaggagacacacgcgcacacacacacacacacgaaacuugaaauggcuu

SEQ ID NO: 211380 - RNA, 64 nt, Human
uuuuuagaagggauaggagacacacgcgcacacacacacacacacgaaacuugaaauggcuuug

SEQ ID NO: 211381 - RNA, 64 nt, Human
uuuagaagggauaggagacacacgcgcacacacacacacacacgaaacuugaaauggcuuugcu

SEQ ID NO: 211382 - RNA, 64 nt, Human
ucuucuucagccuccaucccuggccuccuccccucacacacacuggacuugguacaaaaugucg

SEQ ID NO: 211383 - RNA, 64 nt, Human
ggaaaauauauguguauguacacauguguauguacacacacacacacaccugccauacacuuua

SEQ ID NO: 211384 - RNA, 64 nt, Human
aaaauauauguguauguacacauguguauguacacacacacacacaccugccauacacuuuaga

SEQ ID NO: 211385 - RNA, 64 nt, Human
aauauauguguauguacacauguguauguacacacacacacacaccugccauacacuuuagaag

SEQ ID NO: 211386 - RNA, 64 nt, Human
uauauguguauguacacauguguauguacacacacacacacaccugccauacacuuuagaagaa

SEQ ID NO: 211387 - RNA, 64 nt, Human
uggucugucccaccagcuagguggggccuagauccacacacagaggaagagcaggcacauggag

SEQ ID NO: 211388 - RNA, 64 nt, Human
uucugaacagccugccucugcccagcuccccauucacacacaccggcacuuucauacccugacc

SEQ ID NO: 211389 - RNA, 64 nt, Human
uuugccaggccaauguugcugauggccccuccagcacacacacauaagcacugaaaucacuuua

SEQ ID NO: 211390 - RNA, 64 nt, Human
ugccaggccaauguugcugauggccccuccagcacacacacauaagcacugaaaucacuuuacc

SEQ ID NO: 211391 - RNA, 64 nt, Human
ggccuucccucccaggucugugucugauagcauacacacacacauauauauacacacacacaca

SEQ ID NO: 211392 - RNA, 64 nt, Human
ccuucccucccaggucugugucugauagcauacacacacacauauauauacacacacacacaca

SEQ ID NO: 211393 - RNA, 64 nt, Human
ugugucugauagcauacacacacacauauauauacacacacacacacacacacacacacacaca

SEQ ID NO: 211394 - RNA, 64 nt, Human
ugucugauagcauacacacacacauauauauacacacacacacacacacacacacacacacaca

SEQ ID NO: 211395 - RNA, 64 nt, Human
ucugauagcauacacacacacauauauauacacacacacacacacacacacacacacacacaca

SEQ ID NO: 211396 - RNA, 64 nt, Human
ugauagcauacacacacacauauauauacacacacacacacacacacacacacacacacacaca

SEQ ID NO: 211397 - RNA, 64 nt, Human
auagcauacacacacacauauauauacacacacacacacacacacacacacacacacacacaua

SEQ ID NO: 211398 - RNA, 64 nt, Human
agcauacacacacacauauauauacacacacacacacacacacacacacacacacacacauaca

SEQ ID NO: 211399 - RNA, 64 nt, Human
cauacacacacacauauauauacacacacacacacacacacacacacacacacacacauacaua

SEQ ID NO: 211400 - RNA, 64 nt, Human
uacacacacacauauauauacacacacacacacacacacacacacacacacacacauacauaca

SEQ ID NO: 211401 - RNA, 64 nt, Human
cacacacacauauauauacacacacacacacacacacacacacacacacacacauacauacaca

SEQ ID NO: 211402 - RNA, 64 nt, Human
cacacacauauauauacacacacacacacacacacacacacacacacacacauacauacacaca

SEQ ID NO: 211403 - RNA, 64 nt, Human
cacacauauauauacacacacacacacacacacacacacacacacacacauacauacacacaca

SEQ ID NO: 211404 - RNA, 64 nt, Human
cacauauauauacacacacacacacacacacacacacacacacacacauacauacacacacaca

SEQ ID NO: 211405 - RNA, 64 nt, Human
cauauauauacacacacacacacacacacacacacacacacacacauacauacacacacacaua

SEQ ID NO: 211406 - RNA, 64 nt, Human
uauauauacacacacacacacacacacacacacacacacacacauacauacacacacacauaua

SEQ ID NO: 211407 - RNA, 64 nt, Human
uauauacacacacacacacacacacacacacacacacacacauacauacacacacacauauaua

SEQ ID NO: 211408 - RNA, 64 nt, Human
cacacacacacacacacacacacacacauacauacacacacacauauauauacacacacacaca

SEQ ID NO: 211409 - RNA, 64 nt, Human
cacacacacacacacacacacacacauacauacacacacacauauauauacacacacacacaca

SEQ ID NO: 211410 - RNA, 64 nt, Human
cacacacacauacauacacacacacauauauauacacacacacacacacacacacacacacacu

SEQ ID NO: 211411 - RNA, 64 nt, Human
cacacacauacauacacacacacauauauauacacacacacacacacacacacacacacacucu

SEQ ID NO: 211412 - RNA, 64 nt, Human
cacacauacauacacacacacauauauauacacacacacacacacacacacacacacacucucu

SEQ ID NO: 211413 - RNA, 64 nt, Human
cacauacauacacacacacauauauauacacacacacacacacacacacacacacacucucucu

SEQ ID NO: 211414 - RNA, 64 nt, Human
cauacauacacacacacauauauauacacacacacacacacacacacacacacacucucucucu

SEQ ID NO: 211415 - RNA, 64 nt, Human
uacauacacacacacauauauauacacacacacacacacacacacacacacacucucucucucu

SEQ ID NO: 211416 - RNA, 64 nt, Human
cauacacacacacauauauauacacacacacacacacacacacacacacacucucucucucucu

SEQ ID NO: 211417 - RNA, 64 nt, Human
uacacacacacauauauauacacacacacacacacacacacacacacacucucucucucucuca

SEQ ID NO: 211418 - RNA, 64 nt, Human
cacacacacauauauauacacacacacacacacacacacacacacacucucucucucucucaaa

SEQ ID NO: 211419 - RNA, 64 nt, Human
cacacacauauauauacacacacacacacacacacacacacacacucucucucucucucaaaca

SEQ ID NO: 211420 - RNA, 64 nt, Human
cacacauauauauacacacacacacacacacacacacacacacucucucucucucucaaacaca

SEQ ID NO: 211421 - RNA, 64 nt, Human
cacacacacacacacacucucucucucucucaaacacacacaaaugcccaaccagcucuaagag

SEQ ID NO: 211422 - RNA, 64 nt, Human
ugguuuuuacuuaacuguuucaaagccaagaccucacacacacaaaaaaugcacaaacaaugca

SEQ ID NO: 211423 - RNA, 64 nt, Human
guuuuuacuuaacuguuucaaagccaagaccucacacacacaaaaaaugcacaaacaaugcaau

SEQ ID NO: 211424 - RNA, 64 nt, Human
gagagacacucccagggacaagggaaggaagggacacacacacacacacacacacacacacaca

SEQ ID NO: 211425 - RNA, 64 nt, Human
gagacacucccagggacaagggaaggaagggacacacacacacacacacacacacacacacaca

SEQ ID NO: 211426 - RNA, 64 nt, Human
gacacucccagggacaagggaaggaagggacacacacacacacacacacacacacacacacaca

SEQ ID NO: 211427 - RNA, 64 nt, Human
cacucccagggacaagggaaggaagggacacacacacacacacacacacacacacacacacaca

SEQ ID NO: 211428 - RNA, 64 nt, Human
cucccagggacaagggaaggaagggacacacacacacacacacacacacacacacacacacaca

SEQ ID NO: 211429 - RNA, 64 nt, Human
cccagggacaagggaaggaagggacacacacacacacacacacacacacacacacacacacaua

SEQ ID NO: 211430 - RNA, 64 nt, Human
cagggacaagggaaggaagggacacacacacacacacacacacacacacacacacacacauaca

SEQ ID NO: 211431 - RNA, 64 nt, Human
gggacaagggaaggaagggacacacacacacacacacacacacacacacacacacacauacauc

SEQ ID NO: 211432 - RNA, 64 nt, Human
gacaagggaaggaagggacacacacacacacacacacacacacacacacacacacauacauccu

SEQ ID NO: 211433 - RNA, 64 nt, Human
caagggaaggaagggacacacacacacacacacacacacacacacacacacacauacauccugc

SEQ ID NO: 211434 - RNA, 64 nt, Human
agggaaggaagggacacacacacacacacacacacacacacacacacacacauacauccugcuu

SEQ ID NO: 211435 - RNA, 64 nt, Human
ggaaggaagggacacacacacacacacacacacacacacacacacacacauacauccugcuuuc

SEQ ID NO: 211436 - RNA, 64 nt, Human
aaggaagggacacacacacacacacacacacacacacacacacacacauacauccugcuuuccc

SEQ ID NO: 211437 - RNA, 64 nt, Human
ggaagggacacacacacacacacacacacacacacacacacacacauacauccugcuuucccuc

SEQ ID NO: 211438 - RNA, 64 nt, Human
aagggacacacacacacacacacacacacacacacacacacacauacauccugcuuucccuccc

SEQ ID NO: 211439 - RNA, 64 nt, Human
gggacacacacacacacacacacacacacacacacacacacauacauccugcuuucccucccca

SEQ ID NO: 211440 - RNA, 64 nt, Human
aggaggaugagggcauccagaaggcauccccucucacacacagccccccugaugagcucugagc

SEQ ID NO: 211441 - RNA, 64 nt, Human
uuagcuuacccaaugggaccgugccccaccuccccacacacaggccuucuguggggcugggcac

SEQ ID NO: 211442 - RNA, 64 nt, Human
auuuaguuuacuagaaauucuuuaccuuaagcagcacacacauuuacuacacacacaguguuaa

SEQ ID NO: 211443 - RNA, 64 nt, Human
aauucuuuaccuuaagcagcacacacauuuacuacacacacaguguuaacaaagcacugugcuu

SEQ ID NO: 211444 - RNA, 64 nt, Human
cggagaugcauuuugaagcaccccugguacucagcacacacaugcuuaccuaaugcaucacugu

SEQ ID NO: 211445 - RNA, 64 nt, Human
cauuuagcuuacauguaaauguaauuauuuaaaacacacacacugcucugcguuguauaguuuu

SEQ ID NO: 211446 - RNA, 64 nt, Human
uguguauauguauguauguguguuucuguauaugcacacacauaaacggcuuugccuagccaag

SEQ ID NO: 211447 - RNA, 64 nt, Human
ccgaaaacugguuucuaguaaagccuugaaugaacacacacacacacacacacacacacacaca

SEQ ID NO: 211448 - RNA, 64 nt, Human
gaaaacugguuucuaguaaagccuugaaugaacacacacacacacacacacacacacacacaca

SEQ ID NO: 211449 - RNA, 64 nt, Human
aaacugguuucuaguaaagccuugaaugaacacacacacacacacacacacacacacacacaca

SEQ ID NO: 211450 - RNA, 64 nt, Human
acugguuucuaguaaagccuugaaugaacacacacacacacacacacacacacacacacacaca

SEQ ID NO: 211451 - RNA, 64 nt, Human
ugguuucuaguaaagccuugaaugaacacacacacacacacacacacacacacacacacacaca

SEQ ID NO: 211452 - RNA, 64 nt, Human
guuucuaguaaagccuugaaugaacacacacacacacacacacacacacacacacacacacaca

SEQ ID NO: 211453 - RNA, 64 nt, Human
uucuaguaaagccuugaaugaacacacacacacacacacacacacacacacacacacacacaca

SEQ ID NO: 211454 - RNA, 64 nt, Human
cuaguaaagccuugaaugaacacacacacacacacacacacacacacacacacacacacacaca

SEQ ID NO: 211455 - RNA, 64 nt, Human
aguaaagccuugaaugaacacacacacacacacacacacacacacacacacacacacacacaca

SEQ ID NO: 211456 - RNA, 64 nt, Human
uaaagccuugaaugaacacacacacacacacacacacacacacacacacacacacacacacaca

SEQ ID NO: 211457 - RNA, 64 nt, Human
aagccuugaaugaacacacacacacacacacacacacacacacacacacacacacacacacacc

SEQ ID NO: 211458 - RNA, 64 nt, Human
gccuugaaugaacacacacacacacacacacacacacacacacacacacacacacacacaccgu

SEQ ID NO: 211459 - RNA, 64 nt, Human
cuugaaugaacacacacacacacacacacacacacacacacacacacacacacacacaccgucc

SEQ ID NO: 211460 - RNA, 64 nt, Human
ugaaugaacacacacacacacacacacacacacacacacacacacacacacacacaccguccua

SEQ ID NO: 211461 - RNA, 64 nt, Human
aaugaacacacacacacacacacacacacacacacacacacacacacacacacaccguccuaca

SEQ ID NO: 211462 - RNA, 64 nt, Human
ugaacacacacacacacacacacacacacacacacacacacacacacacacaccguccuacacu

SEQ ID NO: 211463 - RNA, 64 nt, Human
aacacacacacacacacacacacacacacacacacacacacacacacacaccguccuacacuuu

SEQ ID NO: 211464 - RNA, 64 nt, Human
cacacacacacacacacacacacacacacacacacacacacacacacaccguccuacacuuuaa

SEQ ID NO: 211465 - RNA, 64 nt, Human
cacacacacacacacacacacacacacacacacacacacacacacaccguccuacacuuuaagc

SEQ ID NO: 211466 - RNA, 64 nt, Human
cacacacacacacacacacacacacacacacacacacacacacaccguccuacacuuuaagcug

SEQ ID NO: 211467 - RNA, 64 nt, Human
cacacacacacacacacacacacacacacacacacacacacaccguccuacacuuuaagcugcu

SEQ ID NO: 211468 - RNA, 64 nt, Human
cauaaaauuagccugguuuuaugugacacugauacacacacaccccuuauaugggacuaauuuu

SEQ ID NO: 211469 - RNA, 64 nt, Human
ggcauuugacuacuuuaucugaggccagaacucucacacacagcuaucaagugcuaaguuuaaa

SEQ ID NO: 211470 - RNA, 64 nt, Human
cuuuugcacaauugugcauagauauauauaugcccacacacacugggccaugcuugccaaggaa

SEQ ID NO: 211471 - RNA, 64 nt, Human
ucucuuuucucuuuugcuuucuguuucuuaagggcacacacacgugcgugcgagcacacacaca

SEQ ID NO: 211472 - RNA, 64 nt, Human
cuguuucuuaagggcacacacacgugcgugcgagcacacacacacauacgugcacagggucccc

SEQ ID NO: 211473 - RNA, 64 nt, Human
guuucuuaagggcacacacacgugcgugcgagcacacacacacauacgugcacaggguccccga

SEQ ID NO: 211474 - RNA, 64 nt, Human
uucuuaagggcacacacacgugcgugcgagcacacacacacauacgugcacaggguccccgagu

SEQ ID NO: 211475 - RNA, 64 nt, Human
aguuugcuuaaaacacacacaccacacacacacacacacacaaaacccugugacuggaguguua

SEQ ID NO: 211476 - RNA, 64 nt, Human
uuaguuugcuuaaaacacacacaccacacacacacacacacacaaaacccugugacuggagugu

SEQ ID NO: 211477 - RNA, 64 nt, Human
auuuaguuugcuuaaaacacacacaccacacacacacacacacacaaaacccugugacuggagu

SEQ ID NO: 211478 - RNA, 64 nt, Human
uaauuuaguuugcuuaaaacacacacaccacacacacacacacacacaaaacccugugacugga

SEQ ID NO: 211479 - RNA, 64 nt, Human
uuuaauuuaguuugcuuaaaacacacacaccacacacacacacacacacaaaacccugugacug

SEQ ID NO: 211480 - RNA, 64 nt, Human
uguuuaauuuaguuugcuuaaaacacacacaccacacacacacacacacacaaaacccugugac

SEQ ID NO: 211481 - RNA, 64 nt, Human
aguguuuaauuuaguuugcuuaaaacacacacaccacacacacacacacacacaaaacccugug

SEQ ID NO: 211482 - RNA, 64 nt, Human
cuaugcuuaaguguuuaauuuaguuugcuuaaaacacacacaccacacacacacacacacacaa

SEQ ID NO: 211483 - RNA, 64 nt, Human
agaggcaaauccacagaaggggggcugcccuccacacacacacgcccgucacccacaccuugag

SEQ ID NO: 211484 - RNA, 64 nt, Human
gcagaggcaaauccacagaaggggggcugcccuccacacacacacgcccgucacccacaccuug

SEQ ID NO: 211485 - RNA, 64 nt, Human
uuauuuucccuccucccucuuguuuuagcuguuacacacacaguaauaccugaauauccaacgg

SEQ ID NO: 211486 - RNA, 64 nt, Human
cagccaaaaucggaccucagcuuuaguccgucuucacacacaaauaagaaaacggcaaacccac

SEQ ID NO: 211487 - RNA, 64 nt, Human
ucauuaaaauguuguauauucaaaaaaauacagacacacacaagugccuauauaaugauaaaac

SEQ ID NO: 211488 - RNA, 64 nt, Human
ccucugucuuucucucucccucucccacaccucacacacacauacucccacuugcaacuauucu

SEQ ID NO: 211489 - RNA, 64 nt, Human
cuccucugucuuucucucucccucucccacaccucacacacacauacucccacuugcaacuauu

SEQ ID NO: 211490 - RNA, 64 nt, Human
ggacaccuacuagcuucccuucccauucaacacacacacacauucuugcucuacccaaagcucu

SEQ ID NO: 211491 - RNA, 64 nt, Human
uuggacaccuacuagcuucccuucccauucaacacacacacacauucuugcucuacccaaagcu

SEQ ID NO: 211492 - RNA, 64 nt, Human
uguuggacaccuacuagcuucccuucccauucaacacacacacacauucuugcucuacccaaag

SEQ ID NO: 211493 - RNA, 64 nt, Human
gauggugcucgccagaccuccucucaaugcucaucacacacagggcuauuccuuuccuccaaug

SEQ ID NO: 211494 - RNA, 64 nt, Human
auuguauaaaugaauauuuguaugauuaaauuaacacacacaccaaaaaaagcuguuuucaugu

SEQ ID NO: 211495 - RNA, 64 nt, Human
cccaggacccaggaggccuccccaccuaccccagcacacacacucccugccacuguucugcgcu

SEQ ID NO: 211496 - RNA, 64 nt, Human
cucagccagccuccuugugagaguggcuuucuaccacacacagccugucccugggggaguaauu

SEQ ID NO: 211497 - RNA, 64 nt, Human
guuccacuugcacacacgcacacacucaugcucacacacacagagauauauuaaagcacaaguu

SEQ ID NO: 211498 - RNA, 64 nt, Human
cuguuccacuugcacacacgcacacacucaugcucacacacacagagauauauuaaagcacaag

SEQ ID NO: 211499 - RNA, 64 nt, Human
ccaggacagacagacagacagacagacagacacgcacacacacccaucucugucuagcaagcag

SEQ ID NO: 211500 - RNA, 64 nt, Human
cacacacacacacacacacacacacacacacacacacacacaggugucuacugaccuggaguga

SEQ ID NO: 211501 - RNA, 64 nt, Human
cacacacacacacacacacacacacacacacacacacacacacaggugucuacugaccuggagu

SEQ ID NO: 211502 - RNA, 64 nt, Human
cacacacacacacacacacacacacacacacacacacacacacacaggugucuacugaccugga

SEQ ID NO: 211503 - RNA, 64 nt, Human
cacacacacacacacacacacacacacacacacacacacacacacacaggugucuacugaccug

SEQ ID NO: 211504 - RNA, 64 nt, Human
cacacacacacacacacacacacacacacacacacacacacacacacacaggugucuacugacc

SEQ ID NO: 211505 - RNA, 64 nt, Human
cacacacacacacacacacacacacacacacacacacacacacacacacacaggugucuacuga

SEQ ID NO: 211506 - RNA, 64 nt, Human
uacacacacacacacacacacacacacacacacacacacacacacacacacacaggugucuacu

SEQ ID NO: 211507 - RNA, 64 nt, Human
ccuacacacacacacacacacacacacacacacacacacacacacacacacacacaggugucua

SEQ ID NO: 211508 - RNA, 64 nt, Human
ccccuacacacacacacacacacacacacacacacacacacacacacacacacacacagguguc

SEQ ID NO: 211509 - RNA, 64 nt, Human
uuccccuacacacacacacacacacacacacacacacacacacacacacacacacacacaggug

SEQ ID NO: 211510 - RNA, 64 nt, Human
gauuccccuacacacacacacacacacacacacacacacacacacacacacacacacacacagg

SEQ ID NO: 211511 - RNA, 64 nt, Human
uggauuccccuacacacacacacacacacacacacacacacacacacacacacacacacacaca

SEQ ID NO: 211512 - RNA, 64 nt, Human
ccuggauuccccuacacacacacacacacacacacacacacacacacacacacacacacacaca

SEQ ID NO: 211513 - RNA, 64 nt, Human
agccuggauuccccuacacacacacacacacacacacacacacacacacacacacacacacaca

SEQ ID NO: 211514 - RNA, 64 nt, Human
gcagccuggauuccccuacacacacacacacacacacacacacacacacacacacacacacaca

SEQ ID NO: 211515 - RNA, 64 nt, Human
augcagccuggauuccccuacacacacacacacacacacacacacacacacacacacacacaca

SEQ ID NO: 211516 - RNA, 64 nt, Human
gaaugcagccuggauuccccuacacacacacacacacacacacacacacacacacacacacaca

SEQ ID NO: 211517 - RNA, 64 nt, Human
gagaaugcagccuggauuccccuacacacacacacacacacacacacacacacacacacacaca

SEQ ID NO: 211518 - RNA, 64 nt, Human
uggagaaugcagccuggauuccccuacacacacacacacacacacacacacacacacacacaca

SEQ ID NO: 211519 - RNA, 64 nt, Human
gcuggagaaugcagccuggauuccccuacacacacacacacacacacacacacacacacacaca

SEQ ID NO: 211520 - RNA, 64 nt, Human
aggcuggagaaugcagccuggauuccccuacacacacacacacacacacacacacacacacaca

SEQ ID NO: 211521 - RNA, 64 nt, Human
gaaggcuggagaaugcagccuggauuccccuacacacacacacacacacacacacacacacaca

SEQ ID NO: 211522 - RNA, 64 nt, Human
augaaggcuggagaaugcagccuggauuccccuacacacacacacacacacacacacacacaca

SEQ ID NO: 211523 - RNA, 64 nt, Human
agugguccguucucaccacccuucagcuuggguacacacacagaggagaccucagccucacacc

SEQ ID NO: 211524 - RNA, 64 nt, Human
uauuuagguauacacacacacacacacacacauacacacacacggaccaaaauacuuacaccug

SEQ ID NO: 211525 - RNA, 64 nt, Human
agcaguuacauauuuagguauacacacacacacacacacacauacacacacacggaccaaaaua

SEQ ID NO: 211526 - RNA, 64 nt, Human
uaagcaguuacauauuuagguauacacacacacacacacacacauacacacacacggaccaaaa

SEQ ID NO: 211527 - RNA, 64 nt, Human
auuaagcaguuacauauuuagguauacacacacacacacacacacauacacacacacggaccaa

SEQ ID NO: 211528 - RNA, 64 nt, Human
ccauuaagcaguuacauauuuagguauacacacacacacacacacacauacacacacacggacc

SEQ ID NO: 211529 - RNA, 64 nt, Human
aaccauuaagcaguuacauauuuagguauacacacacacacacacacacauacacacacacgga

SEQ ID NO: 211530 - RNA, 64 nt, Human
gaaaccauuaagcaguuacauauuuagguauacacacacacacacacacacauacacacacacg

SEQ ID NO: 211531 - RNA, 64 nt, Human
cagaaaccauuaagcaguuacauauuuagguauacacacacacacacacacacauacacacaca

SEQ ID NO: 211532 - RNA, 64 nt, Human
aucaccgggaacccucccuguccccuucccgaaucacacacauacccuacccucaccugaugau

SEQ ID NO: 211533 - RNA, 64 nt, Human
auuccauauauacacacacacacacacacacacacacacacauacauacauacauauauauaua

SEQ ID NO: 211534 - RNA, 64 nt, Human
uuauuccauauauacacacacacacacacacacacacacacacauacauacauacauauauaua

SEQ ID NO: 211535 - RNA, 64 nt, Human
cuuuauuccauauauacacacacacacacacacacacacacacacauacauacauacauauaua

SEQ ID NO: 211536 - RNA, 64 nt, Human
aacuuuauuccauauauacacacacacacacacacacacacacacacauacauacauacauaua

SEQ ID NO: 211537 - RNA, 64 nt, Human
caaacuuuauuccauauauacacacacacacacacacacacacacacacauacauacauacaua

SEQ ID NO: 211538 - RNA, 64 nt, Human
cucaaacuuuauuccauauauacacacacacacacacacacacacacacacauacauacauaca

SEQ ID NO: 211539 - RNA, 64 nt, Human
aucucaaacuuuauuccauauauacacacacacacacacacacacacacacacauacauacaua

SEQ ID NO: 211540 - RNA, 64 nt, Human
gaaucucaaacuuuauuccauauauacacacacacacacacacacacacacacacauacauaca

SEQ ID NO: 211541 - RNA, 64 nt, Human
gggaaucucaaacuuuauuccauauauacacacacacacacacacacacacacacacauacaua

SEQ ID NO: 211542 - RNA, 64 nt, Human
cagggaaucucaaacuuuauuccauauauacacacacacacacacacacacacacacacauaca

SEQ ID NO: 211543 - RNA, 64 nt, Human
agcagggaaucucaaacuuuauuccauauauacacacacacacacacacacacacacacacaua

SEQ ID NO: 211544 - RNA, 64 nt, Human
aaagcagggaaucucaaacuuuauuccauauauacacacacacacacacacacacacacacaca

SEQ ID NO: 211545 - RNA, 64 nt, Human
gcccuaagcuaccugaggguuuaggaggucugaacacacacaguggagagguuaaucuagguug

SEQ ID NO: 211546 - RNA, 64 nt, Human
gugaauuacuaguuucucuuuauuuagacaaacacacacacaccagauaauauaaacuuaauaa

SEQ ID NO: 211547 - RNA, 64 nt, Human
aagugaauuacuaguuucucuuuauuuagacaaacacacacacaccagauaauauaaacuuaau

SEQ ID NO: 211548 - RNA, 64 nt, Human
gguuuauagagugauguaauucaacugaagaaaacacacacaugcuuuuggugcuuauucuuca

SEQ ID NO: 211549 - RNA, 64 nt, Human
aauuauuuuggaaauugagucugaagcacucucgcacacacagugauucccuccucccgucacu

SEQ ID NO: 211550 - RNA, 64 nt, Human
ucuuuucaaacacacacacacacgcgcgcgcgcgcacacacacucuucaaguuuuuuucaaagu

SEQ ID NO: 211551 - RNA, 64 nt, Human
cuaccuucauuuucuaauucucuuuucaaacacacacacacacgcgcgcgcgcgcacacacacu

SEQ ID NO: 211552 - RNA, 64 nt, Human
gucuaccuucauuuucuaauucucuuuucaaacacacacacacacgcgcgcgcgcgcacacaca

SEQ ID NO: 211553 - RNA, 64 nt, Human
gugucuaccuucauuuucuaauucucuuuucaaacacacacacacacgcgcgcgcgcgcacaca

SEQ ID NO: 211554 - RNA, 64 nt, Human
guauacauauguguauauaugauacauacacauacacacacacgagagacagaaggaaagagag

SEQ ID NO: 211555 - RNA, 64 nt, Human
cauauauauauggauggauguaauauauguagaacacacacauagauguauauaggauacacac

SEQ ID NO: 211556 - RNA, 64 nt, Human
aagagagagaaguaccacuguggcuagauauauacacacacauauauauauggauggauguaau

SEQ ID NO: 211557 - RNA, 64 nt, Human
uauuuuucuuguggaggucuuugcucuaauaacacacacacacugucucucucucucucucucu

SEQ ID NO: 211558 - RNA, 64 nt, Human
uguauuuuucuuguggaggucuuugcucuaauaacacacacacacugucucucucucucucucu

SEQ ID NO: 211559 - RNA, 64 nt, Human
caguaugcuauaaaugauaccccccuaccacacccacacacacaguuuuugucuaaugaaaaug

SEQ ID NO: 211560 - RNA, 64 nt, Human
guaugcuauaaaugauaccccccuaccacacccacacacacaguuuuugucuaaugaaaauguu

SEQ ID NO: 211561 - RNA, 64 nt, Human
augucuguuuuuuaugcuaaguaggaaaaccaaccacacacauuagcaaaccggccucaacaua

SEQ ID NO: 211562 - RNA, 64 nt, Human
aggacugcaguauuugugugcccgauucuguaaacacacacacacagaguauauauguguauau

SEQ ID NO: 211563 - RNA, 64 nt, Human
gacugcaguauuugugugcccgauucuguaaacacacacacacagaguauauauguguauauau

SEQ ID NO: 211564 - RNA, 64 nt, Human
cugcaguauuugugugcccgauucuguaaacacacacacacagaguauauauguguauauauau

SEQ ID NO: 211565 - RNA, 64 nt, Human
gaggugccccugcccagcccuguccagccuuguccacacacacaucucacgccccuggucucac

SEQ ID NO: 211566 - RNA, 64 nt, Human
ggugccccugcccagcccuguccagccuuguccacacacacaucucacgccccuggucucacag

SEQ ID NO: 211567 - RNA, 64 nt, Human
cagaaaauauuuucagccuacaguuauguucagucacacacacauacaaaauguuccuuuugcu

SEQ ID NO: 211568 - RNA, 64 nt, Human
gaaaauauuuucagccuacaguuauguucagucacacacacauacaaaauguuccuuuugcuuu

SEQ ID NO: 211569 - RNA, 64 nt, Human
uucucucugccguggcccagagccggcccagcugcacacacacaccaugcucucgcccugcugu

SEQ ID NO: 211570 - RNA, 64 nt, Human
cucucugccguggcccagagccggcccagcugcacacacacaccaugcucucgcccugcuguaa

SEQ ID NO: 211571 - RNA, 64 nt, Human
acgggauccuucucccgcugcccaccaacaccaacacacacacaccucuaagcugcuggccgaa

SEQ ID NO: 211572 - RNA, 64 nt, Human
gggauccuucucccgcugcccaccaacaccaacacacacacaccucuaagcugcuggccgaaga

SEQ ID NO: 211573 - RNA, 64 nt, Human
gcagcuaaguggguccuuauguacacaccacguucacacacacacagagggaccacgugugcac

SEQ ID NO: 211574 - RNA, 64 nt, Human
agcuaaguggguccuuauguacacaccacguucacacacacacagagggaccacgugugcacgc

SEQ ID NO: 211575 - RNA, 64 nt, Human
cuaaguggguccuuauguacacaccacguucacacacacacagagggaccacgugugcacgcau

SEQ ID NO: 211576 - RNA, 64 nt, Human
uucuuccucucucucucucucacucacgcacacgcacacacacacacacacacacacacacaca

SEQ ID NO: 211577 - RNA, 64 nt, Human
cuuccucucucucucucucacucacgcacacgcacacacacacacacacacacacacacacacu

SEQ ID NO: 211578 - RNA, 64 nt, Human
uccucucucucucucucacucacgcacacgcacacacacacacacacacacacacacacacucc

SEQ ID NO: 211579 - RNA, 64 nt, Human
cucucucucucucucacucacgcacacgcacacacacacacacacacacacacacacacuccau

SEQ ID NO: 211580 - RNA, 64 nt, Human
cucucucucucucacucacgcacacgcacacacacacacacacacacacacacacacuccauuc

SEQ ID NO: 211581 - RNA, 64 nt, Human
cucucucucucacucacgcacacgcacacacacacacacacacacacacacacacuccauucac

SEQ ID NO: 211582 - RNA, 64 nt, Human
cucucucucacucacgcacacgcacacacacacacacacacacacacacacacuccauucacug

SEQ ID NO: 211583 - RNA, 64 nt, Human
cucucucacucacgcacacgcacacacacacacacacacacacacacacacuccauucacuguc

SEQ ID NO: 211584 - RNA, 64 nt, Human
cucucacucacgcacacgcacacacacacacacacacacacacacacacuccauucacugucuc

SEQ ID NO: 211585 - RNA, 64 nt, Human
cucacucacgcacacgcacacacacacacacacacacacacacacacuccauucacugucucca

SEQ ID NO: 211586 - RNA, 64 nt, Human
cacucacgcacacgcacacacacacacacacacacacacacacacuccauucacugucuccaug

SEQ ID NO: 211587 - RNA, 64 nt, Human
cucacgcacacgcacacacacacacacacacacacacacacacuccauucacugucuccaugac

SEQ ID NO: 211588 - RNA, 64 nt, Human
aauuuaccaauuuaaauagccacaguccuuaagccacacacauuguugcugcuaugacuuuuua

SEQ ID NO: 211589 - RNA, 64 nt, Human
guaagaauaguacaaacaccuuagcacaucacugcacacacaguauucugaaaggagauuugac

SEQ ID NO: 211590 - RNA, 64 nt, Human
aaaaaacacaaaaaaacaaaaacaaaaaaccauacacacacacacacacacacaaaucagcauc

SEQ ID NO: 211591 - RNA, 64 nt, Human
aaaacacaaaaaaacaaaaacaaaaaaccauacacacacacacacacacacaaaucagcaucau

SEQ ID NO: 211592 - RNA, 64 nt, Human
aacacaaaaaaacaaaaacaaaaaaccauacacacacacacacacacacaaaucagcaucauaa

SEQ ID NO: 211593 - RNA, 64 nt, Human
cacaaaaaaacaaaaacaaaaaaccauacacacacacacacacacacaaaucagcaucauaagg

SEQ ID NO: 211594 - RNA, 64 nt, Human
caaaaaaacaaaaacaaaaaaccauacacacacacacacacacacaaaucagcaucauaaggga

SEQ ID NO: 211595 - RNA, 64 nt, Human
aaaaaacaaaaacaaaaaaccauacacacacacacacacacacaaaucagcaucauaagggaau

SEQ ID NO: 211596 - RNA, 64 nt, Human
aaaacaaaaacaaaaaaccauacacacacacacacacacacaaaucagcaucauaagggaaugu

SEQ ID NO: 211597 - RNA, 64 nt, Human
uggcuaccuagaagcugauggcaggagacuguuucacacacaggagauugugagcuguguaagu

SEQ ID NO: 211598 - RNA, 63 nt, Human
uguuuacaguauuuucaguuuuauuauaaaaaugcacacacaacaaagauugucauuucuugg

SEQ ID NO: 211599 - RNA, 64 nt, Human
aagugccuccccagccucagcccccaccuccagccacacacacauuacacacacacacacacac

SEQ ID NO: 211600 - RNA, 64 nt, Human
gugccuccccagccucagcccccaccuccagccacacacacauuacacacacacacacacacac

SEQ ID NO: 211601 - RNA, 64 nt, Human
gccucagcccccaccuccagccacacacacauuacacacacacacacacacacacaaaugugcc

SEQ ID NO: 211602 - RNA, 64 nt, Human
cucagcccccaccuccagccacacacacauuacacacacacacacacacacacaaaugugccac

SEQ ID NO: 211603 - RNA, 64 nt, Human
cagcccccaccuccagccacacacacauuacacacacacacacacacacacaaaugugccacac

SEQ ID NO: 211604 - RNA, 64 nt, Human
gcccccaccuccagccacacacacauuacacacacacacacacacacacaaaugugccacaccc

SEQ ID NO: 211605 - RNA, 64 nt, Human
ccccaccuccagccacacacacauuacacacacacacacacacacacaaaugugccacacccag

SEQ ID NO: 211606 - RNA, 64 nt, Human
ccaccuccagccacacacacauuacacacacacacacacacacacaaaugugccacacccagac

SEQ ID NO: 211607 - RNA, 64 nt, Human
accuccagccacacacacauuacacacacacacacacacacacaaaugugccacacccagacac

SEQ ID NO: 211608 - RNA, 64 nt, Human
cuccagccacacacacauuacacacacacacacacacacacaaaugugccacacccagacacgc

SEQ ID NO: 211609 - RNA, 64 nt, Human
uggaaagggaaaggggaggagaugggacuuugaccacacacagugaugccucacacccugaagg

SEQ ID NO: 211610 - RNA, 64 nt, Human
ucucccccaagucuuuuuuaacucaugauuuuuacacacacaauccagaacuuauuauauagcc

SEQ ID NO: 211611 - RNA, 64 nt, Human
uugguuacaaaacagacacagccaagauaagauccacacacacauuauuaacaaggaagugauu

SEQ ID NO: 211612 - RNA, 64 nt, Human
gguuacaaaacagacacagccaagauaagauccacacacacauuauuaacaaggaagugauuug

SEQ ID NO: 211613 - RNA, 64 nt, Human
gaaauuucugaaaauguugaagcagagaaacauucacacacaaaaagcaacauagucauguggg

SEQ ID NO: 211614 - RNA, 64 nt, Human
cagcgagugaaucuuuaaaacagacuugaucacgcacacacaauaagucuuucucuccgaaacc

SEQ ID NO: 211615 - RNA, 64 nt, Human
uguguguuuacacauaugucugcaugcaugugaacacacacacacacacacacacaccaggcgu

SEQ ID NO: 211616 - RNA, 64 nt, Human
uguguuuacacauaugucugcaugcaugugaacacacacacacacacacacacaccaggcgugu

SEQ ID NO: 211617 - RNA, 64 nt, Human
uguuuacacauaugucugcaugcaugugaacacacacacacacacacacacaccaggcguguuu

SEQ ID NO: 211618 - RNA, 64 nt, Human
uuuacacauaugucugcaugcaugugaacacacacacacacacacacacaccaggcguguuuga

SEQ ID NO: 211619 - RNA, 64 nt, Human
uacacauaugucugcaugcaugugaacacacacacacacacacacacaccaggcguguuugagu

SEQ ID NO: 211620 - RNA, 64 nt, Human
cacauaugucugcaugcaugugaacacacacacacacacacacacaccaggcguguuugagucc

SEQ ID NO: 211621 - RNA, 64 nt, Human
cauaugucugcaugcaugugaacacacacacacacacacacacaccaggcguguuugaguccac

SEQ ID NO: 211622 - RNA, 64 nt, Human
uaugucugcaugcaugugaacacacacacacacacacacacaccaggcguguuugaguccacag

SEQ ID NO: 211623 - RNA, 64 nt, Human
ugacgggacuucaucuuauagacuguuaaacugucacacacaaacaggcuuuccaccccugcuc

SEQ ID NO: 211624 - RNA, 64 nt, Human
gacggcucucccaucuuccugcaagucaucugcucacacacaguuggcagcacauagcguuucc

SEQ ID NO: 211625 - RNA, 64 nt, Human
caggaugcccacggugacugccgcuccguccgugcacacacagcggugcucuucuccccuuagc

SEQ ID NO: 211626 - RNA, 64 nt, Human
uauggacuuccucuuccugccccaccugcauaggcacacacaccuugaaucugcacccucugga

SEQ ID NO: 211627 - RNA, 64 nt, Human
agccacgugaaacugcugauguuuuguuuagaugcacacacauggcagcguuucauacagguca

SEQ ID NO: 211628 - RNA, 64 nt, Human
uuucacagugguucguuuaccaaauaggauuaaacacacacaaaaugcucaaggaagggacaag

SEQ ID NO: 211629 - RNA, 64 nt, Human
gugccuuagcacgagugaccacaguuuaauagaccacacacaucguuuaaccugcucuugguca

SEQ ID NO: 211630 - RNA, 64 nt, Human
gguuucuuucagguuaacaagaggcauuugugcacacacacagggcucuuguguguguugucaa

SEQ ID NO: 211631 - RNA, 64 nt, Human
gcgguuucuuucagguuaacaagaggcauuugugcacacacacagggcucuuguguguguuguc

SEQ ID NO: 211632 - RNA, 64 nt, Human
uuacugggcccagagcagagaaggaccuguccaacacacacagcuauuuauaguagcagacaca

SEQ ID NO: 211633 - RNA, 64 nt, Human
ccuggauaugcugggagaggccugaaaaaagccacacacacaguaauugccauuuuaugacugu

SEQ ID NO: 211634 - RNA, 64 nt, Human
auccuggauaugcugggagaggccugaaaaaagccacacacacaguaauugccauuuuaugacu

SEQ ID NO: 211635 - RNA, 64 nt, Human
cuuuguggccgccguccccauccccugcccucagcacacacaucugcacacacgcagcuuuguu

SEQ ID NO: 211636 - RNA, 64 nt, Human
acucucugcuccccgagaccgagaaccggcguaucacacacaucuccgcggagcagaagcggcg

SEQ ID NO: 211637 - RNA, 64 nt, Human
ucucaguuucucccucucucucccaacacacacacacacacaccccucacauacuauaaaauaa

SEQ ID NO: 211638 - RNA, 64 nt, Human
uuucucaguuucucccucucucucccaacacacacacacacacaccccucacauacuauaaaau

SEQ ID NO: 211639 - RNA, 64 nt, Human
auuuucucaguuucucccucucucucccaacacacacacacacacaccccucacauacuauaaa

SEQ ID NO: 211640 - RNA, 64 nt, Human
ccauuuucucaguuucucccucucucucccaacacacacacacacacaccccucacauacuaua

SEQ ID NO: 211641 - RNA, 64 nt, Human
caccauuuucucaguuucucccucucucucccaacacacacacacacacaccccucacauacua

SEQ ID NO: 211642 - RNA, 64 nt, Human
uuggugagaccacuaaauuuuacauauaauuauacacacacauauguacauauauauguauaua

SEQ ID NO: 211643 - RNA, 64 nt, Human
uugagaaauuucacaaaacugccuggcacacaagcacacacauacauagacacauuuuaaguga

SEQ ID NO: 211644 - RNA, 64 nt, Human
cacacacacacacacacacacacacacacacacacacacacacuccuuguaccccuugcccuuc

SEQ ID NO: 211645 - RNA, 64 nt, Human
aacacacacacacacacacacacacacacacacacacacacacacuccuuguaccccuugcccu

SEQ ID NO: 211646 - RNA, 64 nt, Human
ccaacacacacacacacacacacacacacacacacacacacacacacuccuuguaccccuugcc

SEQ ID NO: 211647 - RNA, 64 nt, Human
ccccaacacacacacacacacacacacacacacacacacacacacacacuccuuguaccccuug

SEQ ID NO: 211648 - RNA, 64 nt, Human
cuccccaacacacacacacacacacacacacacacacacacacacacacacuccuuguaccccu

SEQ ID NO: 211649 - RNA, 64 nt, Human
cucuccccaacacacacacacacacacacacacacacacacacacacacacacuccuuguaccc

SEQ ID NO: 211650 - RNA, 64 nt, Human
cacucuccccaacacacacacacacacacacacacacacacacacacacacacacuccuuguac

SEQ ID NO: 211651 - RNA, 64 nt, Human
aacacucuccccaacacacacacacacacacacacacacacacacacacacacacacuccuugu

SEQ ID NO: 211652 - RNA, 64 nt, Human
auaacacucuccccaacacacacacacacacacacacacacacacacacacacacacacuccuu

SEQ ID NO: 211653 - RNA, 64 nt, Human
acauaacacucuccccaacacacacacacacacacacacacacacacacacacacacacacucc

SEQ ID NO: 211654 - RNA, 64 nt, Human
ccacauaacacucuccccaacacacacacacacacacacacacacacacacacacacacacacu

SEQ ID NO: 211655 - RNA, 64 nt, Human
caccacauaacacucuccccaacacacacacacacacacacacacacacacacacacacacaca

SEQ ID NO: 211656 - RNA, 64 nt, Human
uccaccacauaacacucuccccaacacacacacacacacacacacacacacacacacacacaca

SEQ ID NO: 211657 - RNA, 64 nt, Human
cauccaccacauaacacucuccccaacacacacacacacacacacacacacacacacacacaca

SEQ ID NO: 211658 - RNA, 64 nt, Human
cccauccaccacauaacacucuccccaacacacacacacacacacacacacacacacacacaca

SEQ ID NO: 211659 - RNA, 64 nt, Human
uccccauccaccacauaacacucuccccaacacacacacacacacacacacacacacacacaca

SEQ ID NO: 211660 - RNA, 64 nt, Human
guuccccauccaccacauaacacucuccccaacacacacacacacacacacacacacacacaca

SEQ ID NO: 211661 - RNA, 64 nt, Human
uuguuccccauccaccacauaacacucuccccaacacacacacacacacacacacacacacaca

SEQ ID NO: 211662 - RNA, 64 nt, Human
uggggagcagaguuagggugcacgcuauggcgcacacacacagugcacguccacagugccauac

SEQ ID NO: 211663 - RNA, 64 nt, Human
gcuggggagcagaguuagggugcacgcuauggcgcacacacacagugcacguccacagugccau

SEQ ID NO: 211664 - RNA, 64 nt, Human
cuaagugagguauaugaugaguguauugucuuugcacacacauauagguauauucugaauacaa

SEQ ID NO: 211665 - RNA, 64 nt, Human
cacuugaguguaauacuugaugcaugcacacacacacacacauaccuucuuuauagcuacaaag

SEQ ID NO: 211666 - RNA, 64 nt, Human
uucacuugaguguaauacuugaugcaugcacacacacacacacauaccuucuuuauagcuacaa

SEQ ID NO: 211667 - RNA, 64 nt, Human
uguucacuugaguguaauacuugaugcaugcacacacacacacacauaccuucuuuauagcuac

SEQ ID NO: 211668 - RNA, 64 nt, Human
ucuguucacuugaguguaauacuugaugcaugcacacacacacacacauaccuucuuuauagcu

SEQ ID NO: 211669 - RNA, 64 nt, Human
auucuguucacuugaguguaauacuugaugcaugcacacacacacacacauaccuucuuuauag

SEQ ID NO: 211670 - RNA, 64 nt, Human
uauguaugcgugcaugcgugcgcgcacacacacacacacacacugacauuauaucauggcauuu

SEQ ID NO: 211671 - RNA, 64 nt, Human
auuauguaugcgugcaugcgugcgcgcacacacacacacacacacugacauuauaucauggcau

SEQ ID NO: 211672 - RNA, 64 nt, Human
guauuauguaugcgugcaugcgugcgcgcacacacacacacacacacacacacugacauuauau

SEQ ID NO: 211673 - RNA, 64 nt, Human
guguauuauguaugcgugcaugcgugcgcgcacacacacacacacacacacacacugacauuau

SEQ ID NO: 211674 - RNA, 64 nt, Human
auguguauuauguaugcgugcaugcgugcgcgcacacacacacacacacacacacacugacauu

SEQ ID NO: 211675 - RNA, 64 nt, Human
auauguguauuauguaugcgugcaugcgugcgcgcacacacacacacacacacacacacugaca

SEQ ID NO: 211676 - RNA, 64 nt, Human
acauucaccugguagcaaaugacacaugcacgcacacacacauacacgcacaagcgccagugcg

SEQ ID NO: 211677 - RNA, 64 nt, Human
aaacauucaccugguagcaaaugacacaugcacgcacacacacauacacgcacaagcgccagug

SEQ ID NO: 211678 - RNA, 64 nt, Human
guguugggguguguguguggagguucuuuugagucacacacaaagcauugugcugagacacugc

SEQ ID NO: 211679 - RNA, 64 nt, Human
uugugugugcaaugcacacccagacacacgcacgcacacacacgcgcgcgcacacacaugcuuu

SEQ ID NO: 211680 - RNA, 64 nt, Human
cacccagacacacgcacgcacacacacgcgcgcgcacacacaugcuuuuuucuguuccccuccg

SEQ ID NO: 211681 - RNA, 64 nt, Human
aagcagccccuccucacacauacaugugcacaugcacacacaugcaugcacacacaugcacaca

SEQ ID NO: 211682 - RNA, 64 nt, Human
cacacauacaugugcacaugcacacacaugcaugcacacacaugcacacauacacgcacaugca

SEQ ID NO: 211683 - RNA, 64 nt, Human
caugcaugcacacauacacaggcauacaugcaugcacacacacaugcacgcacacacacaugca

SEQ ID NO: 211684 - RNA, 64 nt, Human
ugcaugcacacauacacaggcauacaugcaugcacacacacaugcacgcacacacacaugcaca

SEQ ID NO: 211685 - RNA, 64 nt, Human
cacaggcauacaugcaugcacacacacaugcacgcacacacacaugcacacauacacgugcaca

SEQ ID NO: 211686 - RNA, 64 nt, Human
caggcauacaugcaugcacacacacaugcacgcacacacacaugcacacauacacgugcacaca

SEQ ID NO: 211687 - RNA, 64 nt, Human
uacacaggcacacaugcaugcacacauacacaugcacacacacaugcacacauauaugcacagg

SEQ ID NO: 211688 - RNA, 64 nt, Human
cacaggcacacaugcaugcacacauacacaugcacacacacaugcacacauauaugcacaggca
